United States Patent 7,687,616 (SMALL MOLECULES MODULATING ACTIVITY OF MICRO RNA OLIGONUCLEOTIDES AND MICRO RNA TARGETS AND USES THEREOF) - sequence listing, part 189

SEQ ID NO: 7870201 - DNA, 22 bp, Homo sapiens
agtgcagctattacaacagtgt

SEQ ID NO: 7870202 - DNA, 22 bp, Homo sapiens
agtgcagctattacaacagtgt

SEQ ID NO: 7870203 - DNA, 22 bp, Homo sapiens
agtgcagctaagtggctctgtg

SEQ ID NO: 7870204 - DNA, 22 bp, Homo sapiens
agtgcagctaagtggctctgtg

SEQ ID NO: 7870205 - DNA, 22 bp, Homo sapiens
agtgcagccttctgggccgctt

SEQ ID NO: 7870206 - DNA, 22 bp, Homo sapiens
agtgcagctaagtggctctgtg

SEQ ID NO: 7870207 - DNA, 22 bp, Homo sapiens
ctcctctccatcagcgccaccc

SEQ ID NO: 7870208 - DNA, 22 bp, Homo sapiens
ctcctctcaggctggatggcgc

SEQ ID NO: 7870209 - DNA, 22 bp, Homo sapiens
ctcctctcaaaagtaggttgac

SEQ ID NO: 7870210 - DNA, 22 bp, Homo sapiens
ctcctctagaagctgacctgga

SEQ ID NO: 7870211 - DNA, 22 bp, Homo sapiens
ctcctctagaagctgacctgga

SEQ ID NO: 7870212 - DNA, 22 bp, Homo sapiens
ctcctctagaagctgacctgga

SEQ ID NO: 7870213 - DNA, 23 bp, Homo sapiens
ctcctcgtaactctgtggtgggt

SEQ ID NO: 7870214 - DNA, 22 bp, Homo sapiens
ctcctcgaagcaacctgcaggc

SEQ ID NO: 7870215 - DNA, 22 bp, Homo sapiens
ctcctcgaagcaacctgcaggc

SEQ ID NO: 7870216 - DNA, 23 bp, Homo sapiens
ctcctcgtaactctgtggtgggt

SEQ ID NO: 7870217 - DNA, 22 bp, Homo sapiens
ctcctccttcctgtgttgtgca

SEQ ID NO: 7870218 - DNA, 22 bp, Homo sapiens
ctcctccttcctgtgttgtgca

SEQ ID NO: 7870219 - DNA, 22 bp, Homo sapiens
ctcctcctggacacaggctgtg

SEQ ID NO: 7870220 - DNA, 22 bp, Homo sapiens
ctcctcctggacacaggctgtg

SEQ ID NO: 7870221 - DNA, 22 bp, Homo sapiens
ctcctcctggacacaggctgtg

SEQ ID NO: 7870222 - DNA, 22 bp, Homo sapiens
ctcctcctggacacaggctgtg

SEQ ID NO: 7870223 - DNA, 22 bp, Homo sapiens
ctcctcctggacacaggctgtg

SEQ ID NO: 7870224 - DNA, 22 bp, Homo sapiens
ctcctcctaaatgattcttcct

SEQ ID NO: 7870225 - DNA, 22 bp, Homo sapiens
ctcctcctaaatgattcttcct

SEQ ID NO: 7870226 - DNA, 22 bp, Homo sapiens
ctcctcctaaatgattcttcct

SEQ ID NO: 7870227 - DNA, 22 bp, Homo sapiens
ctcctccctgggaggctggcat

SEQ ID NO: 7870228 - DNA, 22 bp, Homo sapiens
ctcctcctggacacaggctgtg

SEQ ID NO: 7870229 - DNA, 22 bp, Homo sapiens
ctcctcctggacacaggctgtg

SEQ ID NO: 7870230 - DNA, 22 bp, Homo sapiens
ctcctcctggacacaggctgtg

SEQ ID NO: 7870231 - DNA, 22 bp, Homo sapiens
ctcctcctggacacaggctgtg

SEQ ID NO: 7870232 - DNA, 22 bp, Homo sapiens
ctcctcctcaaattagcttttg

SEQ ID NO: 7870233 - DNA, 22 bp, Homo sapiens
ctcctcctggacacaggctgtg

SEQ ID NO: 7870234 - DNA, 22 bp, Homo sapiens
ctcctcctcaaattagcttttg

SEQ ID NO: 7870235 - DNA, 22 bp, Homo sapiens
ctcctcctcaaattagcttttg

SEQ ID NO: 7870236 - DNA, 22 bp, Homo sapiens
ctcctccctgcgattgctctgc

SEQ ID NO: 7870237 - DNA, 22 bp, Homo sapiens
ctcctccctctttgccacacat

SEQ ID NO: 7870238 - DNA, 22 bp, Homo sapiens
ctcctccctctttgccacacat

SEQ ID NO: 7870239 - DNA, 22 bp, Homo sapiens
ctcctccctgcgattgctctgc

SEQ ID NO: 7870240 - DNA, 22 bp, Homo sapiens
ctcctccctgcgattgctctgc

SEQ ID NO: 7870241 - DNA, 22 bp, Homo sapiens
ctcctccctgcgattgctctgc

SEQ ID NO: 7870242 - DNA, 22 bp, Homo sapiens
ctcctccctgcgattgctctgc

SEQ ID NO: 7870243 - DNA, 22 bp, Homo sapiens
ctcctccctctttgccacacat

SEQ ID NO: 7870244 - DNA, 22 bp, Homo sapiens
ctcctccctctttgccacacat

SEQ ID NO: 7870245 - DNA, 22 bp, Homo sapiens
ctcctccctctttgccacacat

SEQ ID NO: 7870246 - DNA, 22 bp, Homo sapiens
ctcctccctctttgccacacat

SEQ ID NO: 7870247 - DNA, 22 bp, Homo sapiens
ctcctccccttgagtctgggat

SEQ ID NO: 7870248 - DNA, 22 bp, Homo sapiens
ctcctccctctttgccacacat

SEQ ID NO: 7870249 - DNA, 18 bp, Homo sapiens
ctcctccctaagggctca

SEQ ID NO: 7870250 - DNA, 22 bp, Homo sapiens
ctcctcccacggtctcaggaag

SEQ ID NO: 7870251 - DNA, 22 bp, Homo sapiens
ctcctcccacggtctcaggaag

SEQ ID NO: 7870252 - DNA, 22 bp, Homo sapiens
ctcctcccacggtctcaggaag

SEQ ID NO: 7870253 - DNA, 22 bp, Homo sapiens
ctcctcccacggtctcaggaag

SEQ ID NO: 7870254 - DNA, 22 bp, Homo sapiens
ctcctcccacggtctcaggaag

SEQ ID NO: 7870255 - DNA, 22 bp, Homo sapiens
ctcctcccacggtctcaggaag

SEQ ID NO: 7870256 - DNA, 22 bp, Homo sapiens
ctcctcccacggtctcaggaag

SEQ ID NO: 7870257 - DNA, 22 bp, Homo sapiens
ctcctccccttgagtctgggat

SEQ ID NO: 7870258 - DNA, 22 bp, Homo sapiens
agtgcagcaacaaactgccctc

SEQ ID NO: 7870259 - DNA, 22 bp, Homo sapiens
agtgcagcaccatgttacagag

SEQ ID NO: 7870260 - DNA, 22 bp, Homo sapiens
agtgcagcaccatgttacagag

SEQ ID NO: 7870261 - DNA, 22 bp, Homo sapiens
agtgcagcagctgctccttaac

SEQ ID NO: 7870262 - DNA, 22 bp, Homo sapiens
agtgcagcatgaagcacatgtg

SEQ ID NO: 7870263 - DNA, 22 bp, Homo sapiens
agtgcagcaccatgttacagag

SEQ ID NO: 7870264 - DNA, 22 bp, Homo sapiens
agtgcagcagctgctccttaac

SEQ ID NO: 7870265 - DNA, 22 bp, Homo sapiens
agtgcagcatgaagcacatgtg

SEQ ID NO: 7870266 - DNA, 22 bp, Homo sapiens
agtgcagcatgaagcacatgtg

SEQ ID NO: 7870267 - DNA, 22 bp, Homo sapiens
agtgcagcatgaagcacatgtg

SEQ ID NO: 7870268 - DNA, 22 bp, Homo sapiens
agtgcagcatgctggggaggct

SEQ ID NO: 7870269 - DNA, 22 bp, Homo sapiens
agtgcagcatgctggggaggct

SEQ ID NO: 7870270 - DNA, 22 bp, Homo sapiens
agtgcagcatgctggggaggct

SEQ ID NO: 7870271 - DNA, 22 bp, Homo sapiens
ctcccaggggaactatcaagta

SEQ ID NO: 7870272 - DNA, 22 bp, Homo sapiens
ctcccaggggaactatcaagta

SEQ ID NO: 7870273 - DNA, 22 bp, Homo sapiens
agtgcagccttctgggccgctt

SEQ ID NO: 7870274 - DNA, 22 bp, Homo sapiens
ctcccaggggaactatcaagta

SEQ ID NO: 7870275 - DNA, 22 bp, Homo sapiens
agtgcagccgagatcaggtgct

SEQ ID NO: 7870276 - DNA, 22 bp, Homo sapiens
agtgcagccgagatcaggtgct

SEQ ID NO: 7870277 - DNA, 22 bp, Homo sapiens
agtgcagccgagatcaggtgct

SEQ ID NO: 7870278 - DNA, 22 bp, Homo sapiens
agtgcagcatgctggggaggct

SEQ ID NO: 7870279 - DNA, 22 bp, Homo sapiens
ctcccagggtagggagagacta

SEQ ID NO: 7870280 - DNA, 22 bp, Homo sapiens
ctcccagggtagggagagacta

SEQ ID NO: 7870281 - DNA, 22 bp, Homo sapiens
ctcccaggggagtcatctgctt

SEQ ID NO: 7870282 - DNA, 22 bp, Homo sapiens
ctcccaggggagtcatctgctt

SEQ ID NO: 7870283 - DNA, 22 bp, Homo sapiens
ctcccaggggagtcatctgctt

SEQ ID NO: 7870284 - DNA, 22 bp, Homo sapiens
ctcccaggggagtcatctgctt

SEQ ID NO: 7870285 - DNA, 22 bp, Homo sapiens
ctcccaggggagtcatctgctt

SEQ ID NO: 7870286 - DNA, 22 bp, Homo sapiens
ctcccaggggagtcatctgctt

SEQ ID NO: 7870287 - DNA, 22 bp, Homo sapiens
ctcccagggtagggagagacta

SEQ ID NO: 7870288 - DNA, 22 bp, Homo sapiens
ctcccagggtagggagagacta

SEQ ID NO: 7870289 - DNA, 22 bp, Homo sapiens
ctcccagggtctaggctgctgg

SEQ ID NO: 7870290 - DNA, 22 bp, Homo sapiens
ctcccagggtctaggctgctgg

SEQ ID NO: 7870291 - DNA, 22 bp, Homo sapiens
ctcccaggttacatctgagcct

SEQ ID NO: 7870292 - DNA, 22 bp, Homo sapiens
ctcccaggttccgacgcctctt

SEQ ID NO: 7870293 - DNA, 22 bp, Homo sapiens
ctcccaggttccgacgcctctt

SEQ ID NO: 7870294 - DNA, 22 bp, Homo sapiens
ctcccaggttccgacgcctctt

SEQ ID NO: 7870295 - DNA, 22 bp, Homo sapiens
ctcctcagagagcagcttgggg

SEQ ID NO: 7870296 - DNA, 22 bp, Homo sapiens
ctcctcagctgggaggagtccc

SEQ ID NO: 7870297 - DNA, 22 bp, Homo sapiens
ctcctcagctgggaggagtccc

SEQ ID NO: 7870298 - DNA, 22 bp, Homo sapiens
ctcctcagctgggaggagtccc

SEQ ID NO: 7870299 - DNA, 22 bp, Homo sapiens
ctcctcccacggtctcaggaag

SEQ ID NO: 7870300 - DNA, 22 bp, Homo sapiens
ctcctcagagagcagcttgggg

SEQ ID NO: 7870301 - DNA, 22 bp, Homo sapiens
ctcctcagagagcagcttgggg

SEQ ID NO: 7870302 - DNA, 22 bp, Homo sapiens
ctcctcagagagcagcttgggg

SEQ ID NO: 7870303 - DNA, 22 bp, Homo sapiens
ctcctcagctgggaggagtccc

SEQ ID NO: 7870304 - DNA, 22 bp, Homo sapiens
ctcctcagctgggaggagtccc

SEQ ID NO: 7870305 - DNA, 22 bp, Homo sapiens
ctcctcagctgggaggagtccc

SEQ ID NO: 7870306 - DNA, 22 bp, Homo sapiens
ctcctcagctgggaggagtccc

SEQ ID NO: 7870307 - DNA, 22 bp, Homo sapiens
ctcccaggttacatctgagcct

SEQ ID NO: 7870308 - DNA, 22 bp, Homo sapiens
ctcccaggttacatctgagcct

SEQ ID NO: 7870309 - DNA, 22 bp, Homo sapiens
ctcccaggtgtcccttctgcca

SEQ ID NO: 7870310 - DNA, 22 bp, Homo sapiens
ctcccaggtgtcccttctgcca

SEQ ID NO: 7870311 - DNA, 21 bp, Homo sapiens
ctcccagggtgactgttcaac

SEQ ID NO: 7870312 - DNA, 22 bp, Homo sapiens
ctcccagggtctaggctgctgg

SEQ ID NO: 7870313 - DNA, 21 bp, Homo sapiens
ctcccagggtgactgttcaac

SEQ ID NO: 7870314 - DNA, 21 bp, Homo sapiens
ctcccagggtgactgttcaac

SEQ ID NO: 7870315 - DNA, 22 bp, Homo sapiens
ctcccaggtgtcccttctgcca

SEQ ID NO: 7870316 - DNA, 22 bp, Homo sapiens
ctccagtggcaagtccgggcgg

SEQ ID NO: 7870317 - DNA, 22 bp, Homo sapiens
ctccagtgcttctagaaaatac

SEQ ID NO: 7870318 - DNA, 22 bp, Homo sapiens
ctccagggagctgcgggagcca

SEQ ID NO: 7870319 - DNA, 22 bp, Homo sapiens
ctccagtgggggtgagcctaga

SEQ ID NO: 7870320 - DNA, 22 bp, Homo sapiens
ctccagtggcacaaatgggtgc

SEQ ID NO: 7870321 - DNA, 22 bp, Homo sapiens
ctccagtgggggtgagcctaga

SEQ ID NO: 7870322 - DNA, 22 bp, Homo sapiens
ctccagtggtgatggggaagaa

SEQ ID NO: 7870323 - DNA, 22 bp, Homo sapiens
ctccagtggtgatggggaagaa

SEQ ID NO: 7870324 - DNA, 22 bp, Homo sapiens
ctccagtggtgatggggaagaa

SEQ ID NO: 7870325 - DNA, 22 bp, Homo sapiens
ctccagtgggggtgagcctaga

SEQ ID NO: 7870326 - DNA, 21 bp, Homo sapiens
ctcaggcatttgaggagagtc

SEQ ID NO: 7870327 - DNA, 21 bp, Homo sapiens
ctcaggcatttgaggagagtc

SEQ ID NO: 7870328 - DNA, 22 bp, Homo sapiens
ctcaggcagttgtttgcatagt

SEQ ID NO: 7870329 - DNA, 21 bp, Homo sapiens
ctcaggcatttgaggagagtc

SEQ ID NO: 7870330 - DNA, 22 bp, Homo sapiens
ctccagggagctgcgggagcca

SEQ ID NO: 7870331 - DNA, 22 bp, Homo sapiens
ctccagggagctgcgggagcca

SEQ ID NO: 7870332 - DNA, 22 bp, Homo sapiens
ctccagggagctgcgggagcca

SEQ ID NO: 7870333 - DNA, 20 bp, Homo sapiens
ctccagtgttcaggggagtg

SEQ ID NO: 7870334 - DNA, 20 bp, Homo sapiens
ctccagtgttcaggggagtg

SEQ ID NO: 7870335 - DNA, 22 bp, Homo sapiens
ctccagttggccccagttggtt

SEQ ID NO: 7870336 - DNA, 22 bp, Homo sapiens
ctccagttggccccagttggtt

SEQ ID NO: 7870337 - DNA, 22 bp, Homo sapiens
ctccagttggccccagttggtt

SEQ ID NO: 7870338 - DNA, 22 bp, Homo sapiens
ctccagttggccccagttggtt

SEQ ID NO: 7870339 - DNA, 22 bp, Homo sapiens
ctccagttggccccagttggtt

SEQ ID NO: 7870340 - DNA, 22 bp, Homo sapiens
ctccagtggtgatggggaagaa

SEQ ID NO: 7870341 - DNA, 22 bp, Homo sapiens
ctccagtggtgatggggaagaa

SEQ ID NO: 7870342 - DNA, 22 bp, Homo sapiens
ctccagtgtctcagagcagatg

SEQ ID NO: 7870343 - DNA, 22 bp, Homo sapiens
ctccagtgtctcagagcagatg

SEQ ID NO: 7870344 - DNA, 22 bp, Homo sapiens
ctccagtgtctcagagcagatg

SEQ ID NO: 7870345 - DNA, 22 bp, Homo sapiens
ctccagtgtctcagagcagatg

SEQ ID NO: 7870346 - DNA, 22 bp, Homo sapiens
ctccagtgtctcagagcagatg

SEQ ID NO: 7870347 - DNA, 20 bp, Homo sapiens
ctccagtgttcaggggagtg

SEQ ID NO: 7870348 - DNA, 20 bp, Homo sapiens
ctccagtgttcaggggagtg

SEQ ID NO: 7870349 - DNA, 20 bp, Homo sapiens
ctccagtgttcaggggagtg

SEQ ID NO: 7870350 - DNA, 22 bp, Homo sapiens
ctccagttggccccagttggtt

SEQ ID NO: 7870351 - DNA, 22 bp, Homo sapiens
ctccagttggccccagttggtt

SEQ ID NO: 7870352 - DNA, 22 bp, Homo sapiens
ctccatcagctgttggttgagg

SEQ ID NO: 7870353 - DNA, 22 bp, Homo sapiens
ctccatcagctgttggttgagg

SEQ ID NO: 7870354 - DNA, 22 bp, Homo sapiens
ctccatacttccaacaaacttt

SEQ ID NO: 7870355 - DNA, 22 bp, Homo sapiens
ctccatcatgtttgatcctgag

SEQ ID NO: 7870356 - DNA, 22 bp, Homo sapiens
ctccatcatgtttgatcctgag

SEQ ID NO: 7870357 - DNA, 22 bp, Homo sapiens
ctccatggaaaaggctgttgtt

SEQ ID NO: 7870358 - DNA, 22 bp, Homo sapiens
agtgacagtatttgttgccaat

SEQ ID NO: 7870359 - DNA, 22 bp, Homo sapiens
agtgacagtatttgttgccaat

SEQ ID NO: 7870360 - DNA, 22 bp, Homo sapiens
agtgacagtatttgttgccaat

SEQ ID NO: 7870361 - DNA, 22 bp, Homo sapiens
agtgacagtatttgttgccaat

SEQ ID NO: 7870362 - DNA, 22 bp, Homo sapiens
agtgacagtctcagagatcagg

SEQ ID NO: 7870363 - DNA, 22 bp, Homo sapiens
agtgacagtctcagagatcagg

SEQ ID NO: 7870364 - DNA, 22 bp, Homo sapiens
agtgacagtctcagagatcagg

SEQ ID NO: 7870365 - DNA, 22 bp, Homo sapiens
agtgacagtctcagagatcagg

SEQ ID NO: 7870366 - DNA, 22 bp, Homo sapiens
agtgacagtatttgttgccaat

SEQ ID NO: 7870367 - DNA, 22 bp, Homo sapiens
agtgacagtttcaggcattttt

SEQ ID NO: 7870368 - DNA, 22 bp, Homo sapiens
agtgacagtctgatttctcaaa

SEQ ID NO: 7870369 - DNA, 22 bp, Homo sapiens
agtgacagtttcaggcattttt

SEQ ID NO: 7870370 - DNA, 22 bp, Homo sapiens
agtgacagtctgatttctcaaa

SEQ ID NO: 7870371 - DNA, 22 bp, Homo sapiens
agtgacagtttcaggcattttt

SEQ ID NO: 7870372 - DNA, 22 bp, Homo sapiens
agtgacatcatgtcagcaaagt

SEQ ID NO: 7870373 - DNA, 22 bp, Homo sapiens
agtgacatcatgtcagcaaagt

SEQ ID NO: 7870374 - DNA, 22 bp, Homo sapiens
agtgacatgaccacaaagcagc

SEQ ID NO: 7870375 - DNA, 22 bp, Homo sapiens
agtgacatgctctcaggcataa

SEQ ID NO: 7870376 - DNA, 22 bp, Homo sapiens
agtgacatgaccacaaagcagc

SEQ ID NO: 7870377 - DNA, 22 bp, Homo sapiens
agtgacatgagttctcggtaaa

SEQ ID NO: 7870378 - DNA, 22 bp, Homo sapiens
agtgacatttaaaaccacagct

SEQ ID NO: 7870379 - DNA, 22 bp, Homo sapiens
agtgacatttaaagacccaccc

SEQ ID NO: 7870380 - DNA, 22 bp, Homo sapiens
agtgacatttgcaccagctgct

SEQ ID NO: 7870381 - DNA, 22 bp, Homo sapiens
agtgacatttgcaccagctgct

SEQ ID NO: 7870382 - DNA, 22 bp, Homo sapiens
agtgacatttaaaaccacagct

SEQ ID NO: 7870383 - DNA, 22 bp, Homo sapiens
agtgacattaaggattcttcaa

SEQ ID NO: 7870384 - DNA, 22 bp, Homo sapiens
agtgacattaaggattcttcaa

SEQ ID NO: 7870385 - DNA, 22 bp, Homo sapiens
agtgacattaaggattcttcaa

SEQ ID NO: 7870386 - DNA, 22 bp, Homo sapiens
agtgaccgaggcacttggcaac

SEQ ID NO: 7870387 - DNA, 22 bp, Homo sapiens
agtgactaaaggttttaatggc

SEQ ID NO: 7870388 - DNA, 22 bp, Homo sapiens
agtgactactggatttgtttct

SEQ ID NO: 7870389 - DNA, 22 bp, Homo sapiens
agtgaccattttcagctagagg

SEQ ID NO: 7870390 - DNA, 23 bp, Homo sapiens
agtgacccatttcagggtgtctt

SEQ ID NO: 7870391 - DNA, 22 bp, Homo sapiens
agtgaccgaggcacttggcaac

SEQ ID NO: 7870392 - DNA, 22 bp, Homo sapiens
agtgaccaatcactgaatgatt

SEQ ID NO: 7870393 - DNA, 22 bp, Homo sapiens
agtgaccaagcctgaccaatca

SEQ ID NO: 7870394 - DNA, 22 bp, Homo sapiens
agtgacattttccccgctatgt

SEQ ID NO: 7870395 - DNA, 22 bp, Homo sapiens
agtgaccaacaatgctgagaag

SEQ ID NO: 7870396 - DNA, 22 bp, Homo sapiens
agtgaccaatcatggttagatt

SEQ ID NO: 7870397 - DNA, 22 bp, Homo sapiens
agtgatttgactcttttattgt

SEQ ID NO: 7870398 - DNA, 22 bp, Homo sapiens
agtgatttgactcttttattgt

SEQ ID NO: 7870399 - DNA, 22 bp, Homo sapiens
agtgactggtgtgaagttaaat

SEQ ID NO: 7870400 - DNA, 22 bp, Homo sapiens
agtgactggtgtgaagttaaat

SEQ ID NO: 7870401 - DNA, 22 bp, Homo sapiens
agtgactggtgtgaagttaaat

SEQ ID NO: 7870402 - DNA, 22 bp, Homo sapiens
agtgactggtgtgaagttaaat

SEQ ID NO: 7870403 - DNA, 22 bp, Homo sapiens
agtgactggtgtgaagttaaat

SEQ ID NO: 7870404 - DNA, 22 bp, Homo sapiens
agtgactggtgtgaagttaaat

SEQ ID NO: 7870405 - DNA, 22 bp, Homo sapiens
agtgactgggcagggcagggcc

SEQ ID NO: 7870406 - DNA, 22 bp, Homo sapiens
agtgactgggcagggcagggcc

SEQ ID NO: 7870407 - DNA, 22 bp, Homo sapiens
agtgactgacacctgtaatccc

SEQ ID NO: 7870408 - DNA, 22 bp, Homo sapiens
agtgcagatttttagtcagctt

SEQ ID NO: 7870409 - DNA, 22 bp, Homo sapiens
agtgcagatttttagtcagctt

SEQ ID NO: 7870410 - DNA, 22 bp, Homo sapiens
agtgcagatttttagtcagctt

SEQ ID NO: 7870411 - DNA, 22 bp, Homo sapiens
agtgcagaggctgggaaatgct

SEQ ID NO: 7870412 - DNA, 22 bp, Homo sapiens
agtgcagatttttagtcagctt

SEQ ID NO: 7870413 - DNA, 22 bp, Homo sapiens
agtgcagaggctgggaaatgct

SEQ ID NO: 7870414 - DNA, 22 bp, Homo sapiens
agtgcagagacctggtcaggca

SEQ ID NO: 7870415 - DNA, 22 bp, Homo sapiens
agtgcagagacctggtcaggca

SEQ ID NO: 7870416 - DNA, 22 bp, Homo sapiens
agtgcagagacctggtcaggca

SEQ ID NO: 7870417 - DNA, 22 bp, Homo sapiens
agtgcagactgaaatgaccttc

SEQ ID NO: 7870418 - DNA, 22 bp, Homo sapiens
agtgcagagacctggtcaggca

SEQ ID NO: 7870419 - DNA, 22 bp, Homo sapiens
agtgcacttttgggggatgtta

SEQ ID NO: 7870420 - DNA, 22 bp, Homo sapiens
agtgcacagcgtgatgtattgg

SEQ ID NO: 7870421 - DNA, 22 bp, Homo sapiens
agtgcacagcctgctgcagaat

SEQ ID NO: 7870422 - DNA, 22 bp, Homo sapiens
agtgcactggcaccatctcagc

SEQ ID NO: 7870423 - DNA, 22 bp, Homo sapiens
agtgatttgcagtatttactaa

SEQ ID NO: 7870424 - DNA, 22 bp, Homo sapiens
agtgcacaccttagtacaaagt

SEQ ID NO: 7870425 - DNA, 22 bp, Homo sapiens
agtgcacagcctgctgcagaat

SEQ ID NO: 7870426 - DNA, 22 bp, Homo sapiens
agtgatttgaggattattgctc

SEQ ID NO: 7870427 - DNA, 22 bp, Homo sapiens
agtgatttgaggattattgctc

SEQ ID NO: 7870428 - DNA, 22 bp, Homo sapiens
agtgatttgaggattattgctc

SEQ ID NO: 7870429 - DNA, 22 bp, Homo sapiens
agtgatttgcagtatttactaa

SEQ ID NO: 7870430 - DNA, 22 bp, Homo sapiens
agtgtctgccagctgccaggtg

SEQ ID NO: 7870431 - DNA, 22 bp, Homo sapiens
agtgtctgccagctgccaggtg

SEQ ID NO: 7870432 - DNA, 22 bp, Homo sapiens
agtgtctgcctatttttcaagc

SEQ ID NO: 7870433 - DNA, 22 bp, Homo sapiens
agtgtctgccaactgcatggtc

SEQ ID NO: 7870434 - DNA, 22 bp, Homo sapiens
agtgtctgccaactgcatggtc

SEQ ID NO: 7870435 - DNA, 22 bp, Homo sapiens
agtgtctgccagctgccaggtg

SEQ ID NO: 7870436 - DNA, 22 bp, Homo sapiens
agtgtctgccaactgcatggtc

SEQ ID NO: 7870437 - DNA, 22 bp, Homo sapiens
agtgtctgccagctgccaggtg

SEQ ID NO: 7870438 - DNA, 22 bp, Homo sapiens
agtgtctgcaaaatgaaagagc

SEQ ID NO: 7870439 - DNA, 22 bp, Homo sapiens
agtgtctgcagtgatgtctctt

SEQ ID NO: 7870440 - DNA, 22 bp, Homo sapiens
agtgtctgcagtgatgtctctt

SEQ ID NO: 7870441 - DNA, 22 bp, Homo sapiens
agtgtctgccaactgcatggtc

SEQ ID NO: 7870442 - DNA, 22 bp, Homo sapiens
agtgtctgcagtgatgtctctt

SEQ ID NO: 7870443 - DNA, 22 bp, Homo sapiens
agtgtctgcagtgatgtctctt

SEQ ID NO: 7870444 - DNA, 22 bp, Homo sapiens
ctctgtttggcgctgctccttc

SEQ ID NO: 7870445 - DNA, 22 bp, Homo sapiens
agtgtctgcctatttttcaagc

SEQ ID NO: 7870446 - DNA, 22 bp, Homo sapiens
ctcttaaagaatgttccagctg

SEQ ID NO: 7870447 - DNA, 22 bp, Homo sapiens
ctcttaaaattacctttgcaaa

SEQ ID NO: 7870448 - DNA, 22 bp, Homo sapiens
ctcttaaaaacttgatatattt

SEQ ID NO: 7870449 - DNA, 22 bp, Homo sapiens
ctcttaaaaacttgatatattt

SEQ ID NO: 7870450 - DNA, 22 bp, Homo sapiens
ctcttaaaaacttgatatattt

SEQ ID NO: 7870451 - DNA, 22 bp, Homo sapiens
ctcttaaaaacttgatatattt

SEQ ID NO: 7870452 - DNA, 22 bp, Homo sapiens
ctcttaattaagctgagatctg

SEQ ID NO: 7870453 - DNA, 20 bp, Homo sapiens
ctcttaattgctcacattag

SEQ ID NO: 7870454 - DNA, 22 bp, Homo sapiens
ctcttacacagattcctctagc

SEQ ID NO: 7870455 - DNA, 22 bp, Homo sapiens
ctcttacacagattcctctagc

SEQ ID NO: 7870456 - DNA, 19 bp, Homo sapiens
ctcttacagaatagacaca

SEQ ID NO: 7870457 - DNA, 22 bp, Homo sapiens
ctcttacattcttttactagca

SEQ ID NO: 7870458 - DNA, 22 bp, Homo sapiens
ctcttacattcttttactagca

SEQ ID NO: 7870459 - DNA, 22 bp, Homo sapiens
ctcttacattcttttactagca

SEQ ID NO: 7870460 - DNA, 22 bp, Homo sapiens
ctcttagaaactatagagatta

SEQ ID NO: 7870461 - DNA, 22 bp, Homo sapiens
ctcttagaaactatagagatta

SEQ ID NO: 7870462 - DNA, 22 bp, Homo sapiens
ctcttagaaactatagagatta

SEQ ID NO: 7870463 - DNA, 22 bp, Homo sapiens
ctcttagagagttgttgatcag

SEQ ID NO: 7870464 - DNA, 22 bp, Homo sapiens
ctcttagagagttgttgatcag

SEQ ID NO: 7870465 - DNA, 22 bp, Homo sapiens
ctcttagaaagaaacacactgg

SEQ ID NO: 7870466 - DNA, 20 bp, Homo sapiens
ctcttaaatgtaaagtaggc

SEQ ID NO: 7870467 - DNA, 20 bp, Homo sapiens
ctcttaaatgtaaagtaggc

SEQ ID NO: 7870468 - DNA, 22 bp, Homo sapiens
ctcttaaataacatcattgctt

SEQ ID NO: 7870469 - DNA, 22 bp, Homo sapiens
ctcttaaataacatcattgctt

SEQ ID NO: 7870470 - DNA, 22 bp, Homo sapiens
ctcttaaagcttccagtttcaa

SEQ ID NO: 7870471 - DNA, 22 bp, Homo sapiens
ctcttaaagcttccagtttcaa

SEQ ID NO: 7870472 - DNA, 19 bp, Homo sapiens
ctcttaaattgtctcttgc

SEQ ID NO: 7870473 - DNA, 22 bp, Homo sapiens
ctcttaatgttttatagattga

SEQ ID NO: 7870474 - DNA, 19 bp, Homo sapiens
ctcttaaattgtctcttgc

SEQ ID NO: 7870475 - DNA, 22 bp, Homo sapiens
agtggggacaatgagagcaggt

SEQ ID NO: 7870476 - DNA, 22 bp, Homo sapiens
agtggggacaatgagagcaggt

SEQ ID NO: 7870477 - DNA, 22 bp, Homo sapiens
agtggggacttatgccagcatt

SEQ ID NO: 7870478 - DNA, 22 bp, Homo sapiens
agtggggacttatgccagcatt

SEQ ID NO: 7870479 - DNA, 23 bp, Homo sapiens
agtggggaatcaacagattcttt

SEQ ID NO: 7870480 - DNA, 22 bp, Homo sapiens
agtggggaagattttgcagtca

SEQ ID NO: 7870481 - DNA, 22 bp, Homo sapiens
agtggggacaatgagagcaggt

SEQ ID NO: 7870482 - DNA, 22 bp, Homo sapiens
agtggggaagattttgcagtca

SEQ ID NO: 7870483 - DNA, 20 bp, Homo sapiens
agtggggagtcaggagtgcc

SEQ ID NO: 7870484 - DNA, 22 bp, Homo sapiens
agtggggaggtccaggccaccc

SEQ ID NO: 7870485 - DNA, 20 bp, Homo sapiens
agtggggagtcaggagtgcc

SEQ ID NO: 7870486 - DNA, 20 bp, Homo sapiens
agtggggagtcaggagtgcc

SEQ ID NO: 7870487 - DNA, 20 bp, Homo sapiens
agtggggagtcaggagtgcc

SEQ ID NO: 7870488 - DNA, 20 bp, Homo sapiens
agtggggagtcaggagtgcc

SEQ ID NO: 7870489 - DNA, 20 bp, Homo sapiens
agtggggagtcaggagtgcc

SEQ ID NO: 7870490 - DNA, 22 bp, Homo sapiens
agtgtctgagccagaattagaa

SEQ ID NO: 7870491 - DNA, 21 bp, Homo sapiens
agtgtctgagcgctgcttctg

SEQ ID NO: 7870492 - DNA, 22 bp, Homo sapiens
agtgtctgagccagaattagaa

SEQ ID NO: 7870493 - DNA, 22 bp, Homo sapiens
agtgtctgaaggatttggcttc

SEQ ID NO: 7870494 - DNA, 22 bp, Homo sapiens
agtgtctgaaggatttggcttc

SEQ ID NO: 7870495 - DNA, 22 bp, Homo sapiens
agtgtctgaagcctcagcccga

SEQ ID NO: 7870496 - DNA, 22 bp, Homo sapiens
agtgtctgaagcctcagcccga

SEQ ID NO: 7870497 - DNA, 22 bp, Homo sapiens
agtgtctgaactgggtgctgac

SEQ ID NO: 7870498 - DNA, 22 bp, Homo sapiens
agtgtctgaacctgcagtggga

SEQ ID NO: 7870499 - DNA, 22 bp, Homo sapiens
agtgtctgaactgggtgctgac

SEQ ID NO: 7870500 - DNA, 22 bp, Homo sapiens
agtgtctgaactgggtgctgac

SEQ ID NO: 7870501 - DNA, 22 bp, Homo sapiens
agtgtcctctattatgacttta

SEQ ID NO: 7870502 - DNA, 22 bp, Homo sapiens
agtgtctgatcagttgactaga

SEQ ID NO: 7870503 - DNA, 22 bp, Homo sapiens
agtgtctgatcagttgactaga

SEQ ID NO: 7870504 - DNA, 23 bp, Homo sapiens
agtgtctgagtgcaggctgtgca

SEQ ID NO: 7870505 - DNA, 22 bp, Homo sapiens
agtgtctgatcagttgactaga

SEQ ID NO: 7870506 - DNA, 22 bp, Homo sapiens
agtgtctgatgcacagttgtcc

SEQ ID NO: 7870507 - DNA, 22 bp, Homo sapiens
agtgtctgcaaaatgaaagagc

SEQ ID NO: 7870508 - DNA, 22 bp, Homo sapiens
agtgtctgatgcacagttgtcc

SEQ ID NO: 7870509 - DNA, 22 bp, Homo sapiens
agtgtctgatgcacagttgtcc

SEQ ID NO: 7870510 - DNA, 23 bp, Homo sapiens
agtgtctgagtgcaggctgtgca

SEQ ID NO: 7870511 - DNA, 22 bp, Homo sapiens
agtgtctgagtaaatttctcat

SEQ ID NO: 7870512 - DNA, 22 bp, Homo sapiens
agtgtctgagctatcattaggg

SEQ ID NO: 7870513 - DNA, 23 bp, Homo sapiens
agtgtctgagtgcaggctgtgca

SEQ ID NO: 7870514 - DNA, 23 bp, Homo sapiens
agtgtctgagtgcaggctgtgca

SEQ ID NO: 7870515 - DNA, 22 bp, Homo sapiens
agtgtctgagctatcattaggg

SEQ ID NO: 7870516 - DNA, 22 bp, Homo sapiens
agtgtctgagctatcattaggg

SEQ ID NO: 7870517 - DNA, 21 bp, Homo sapiens
agtgtctgagcgctgcttctg

SEQ ID NO: 7870518 - DNA, 22 bp, Homo sapiens
agtgtgtgcctttggatacctg

SEQ ID NO: 7870519 - DNA, 22 bp, Homo sapiens
agtgtgtgctgttccccggagg

SEQ ID NO: 7870520 - DNA, 22 bp, Homo sapiens
agtgtgtgcctttggatacctg

SEQ ID NO: 7870521 - DNA, 22 bp, Homo sapiens
agtgtgtgcctttggatacctg

SEQ ID NO: 7870522 - DNA, 22 bp, Homo sapiens
agtgtgtgcctttggatacctg

SEQ ID NO: 7870523 - DNA, 22 bp, Homo sapiens
agtgtgtgctgttccccggagg

SEQ ID NO: 7870524 - DNA, 21 bp, Homo sapiens
agtgtgtgtggaatgagaata

SEQ ID NO: 7870525 - DNA, 21 bp, Homo sapiens
agtgtgtgtggaatgagaata

SEQ ID NO: 7870526 - DNA, 21 bp, Homo sapiens
agtgtgtgataggcaggaaga

SEQ ID NO: 7870527 - DNA, 22 bp, Homo sapiens
agtgtgggggctttggtgtcac

SEQ ID NO: 7870528 - DNA, 22 bp, Homo sapiens
agtgtgggggctttggtgtcac

SEQ ID NO: 7870529 - DNA, 22 bp, Homo sapiens
agtgtgggggctttggtgtcac

SEQ ID NO: 7870530 - DNA, 22 bp, Homo sapiens
agtgtgtgcatgcattcgtgca

SEQ ID NO: 7870531 - DNA, 22 bp, Homo sapiens
agtgtgtgcatgcattcgtgca

SEQ ID NO: 7870532 - DNA, 18 bp, Homo sapiens
agtgtgtgccctttcagg

SEQ ID NO: 7870533 - DNA, 18 bp, Homo sapiens
agtgtgtgccctttcagg

SEQ ID NO: 7870534 - DNA, 22 bp, Homo sapiens
agtgtgtgtttgggcggtttat

SEQ ID NO: 7870535 - DNA, 22 bp, Homo sapiens
agtgtgtgtttgggcggtttat

SEQ ID NO: 7870536 - DNA, 22 bp, Homo sapiens
agtgtgtgtttgggcggtttat

SEQ ID NO: 7870537 - DNA, 21 bp, Homo sapiens
agtgtgtgtggaatgagaata

SEQ ID NO: 7870538 - DNA, 23 bp, Homo sapiens
agtgttaaatttcgcacctaaat

SEQ ID NO: 7870539 - DNA, 23 bp, Homo sapiens
agtgttaaatttcgcacctaaat

SEQ ID NO: 7870540 - DNA, 22 bp, Homo sapiens
ctgaagcaattgagagatgttt

SEQ ID NO: 7870541 - DNA, 22 bp, Homo sapiens
ctgaagcacagcatataaataa

SEQ ID NO: 7870542 - DNA, 22 bp, Homo sapiens
ctgaagcaggaacagcgagatt

SEQ ID NO: 7870543 - DNA, 22 bp, Homo sapiens
ctgaagcaaatgaaacagctct

SEQ ID NO: 7870544 - DNA, 22 bp, Homo sapiens
ctgaagcaaatgaaacagctct

SEQ ID NO: 7870545 - DNA, 23 bp, Homo sapiens
ctgaagcaatatcccctcacttc

SEQ ID NO: 7870546 - DNA, 22 bp, Homo sapiens
ctgaagcaaatgaaacagctct

SEQ ID NO: 7870547 - DNA, 19 bp, Homo sapiens
agtgttaacccagtgttgg

SEQ ID NO: 7870548 - DNA, 19 bp, Homo sapiens
agtgttaacccagtgttgg

SEQ ID NO: 7870549 - DNA, 22 bp, Homo sapiens
agtgttaacatgaatggtttcc

SEQ ID NO: 7870550 - DNA, 22 bp, Homo sapiens
agtgttaacatgaatggtttcc

SEQ ID NO: 7870551 - DNA, 19 bp, Homo sapiens
agtgttaacccagtgttgg

SEQ ID NO: 7870552 - DNA, 19 bp, Homo sapiens
agtgttaacccagtgttgg

SEQ ID NO: 7870553 - DNA, 22 bp, Homo sapiens
ctgagaaagtgagggttaaaca

SEQ ID NO: 7870554 - DNA, 22 bp, Homo sapiens
ctgaagcttgataaactataaa

SEQ ID NO: 7870555 - DNA, 22 bp, Homo sapiens
ctgaagctaggtcaaaaaaggg

SEQ ID NO: 7870556 - DNA, 22 bp, Homo sapiens
ctgaagctgaaaacttccagca

SEQ ID NO: 7870557 - DNA, 22 bp, Homo sapiens
ctgaagctgaaaacttccagca

SEQ ID NO: 7870558 - DNA, 22 bp, Homo sapiens
ctgaagctgaaaacttccagca

SEQ ID NO: 7870559 - DNA, 22 bp, Homo sapiens
ctgaagctgcataccaaagact

SEQ ID NO: 7870560 - DNA, 22 bp, Homo sapiens
ctgaagcagggagtgatgaagt

SEQ ID NO: 7870561 - DNA, 22 bp, Homo sapiens
ctgaagcatatcatgccaagtt

SEQ ID NO: 7870562 - DNA, 22 bp, Homo sapiens
ctgaagcatatcatgccaagtt

SEQ ID NO: 7870563 - DNA, 22 bp, Homo sapiens
ctgaagcagggagtgatgaagt

SEQ ID NO: 7870564 - DNA, 22 bp, Homo sapiens
ctgaagccatgtgctcactggt

SEQ ID NO: 7870565 - DNA, 22 bp, Homo sapiens
ctgaagccagtttgctgccctt

SEQ ID NO: 7870566 - DNA, 22 bp, Homo sapiens
ctgaagccacgatagcttccta

SEQ ID NO: 7870567 - DNA, 22 bp, Homo sapiens
ctgaagccacgatagcttccta

SEQ ID NO: 7870568 - DNA, 22 bp, Homo sapiens
ctgaagcatatcatgccaagtt

SEQ ID NO: 7870569 - DNA, 22 bp, Homo sapiens
ctgaagcatgcgtttgtaaact

SEQ ID NO: 7870570 - DNA, 22 bp, Homo sapiens
ctgagaggcagccagagaaaat

SEQ ID NO: 7870571 - DNA, 22 bp, Homo sapiens
ctgagaggcacaaggcatttcg

SEQ ID NO: 7870572 - DNA, 22 bp, Homo sapiens
ctgagaggcacaaggcatttcg

SEQ ID NO: 7870573 - DNA, 22 bp, Homo sapiens
ctgagaggcagccagagaaaat

SEQ ID NO: 7870574 - DNA, 22 bp, Homo sapiens
ctgagaggcggagcttgcagtg

SEQ ID NO: 7870575 - DNA, 22 bp, Homo sapiens
ctgagaggcagccagagaaaat

SEQ ID NO: 7870576 - DNA, 22 bp, Homo sapiens
ctgagaggcagccagagaaaat

SEQ ID NO: 7870577 - DNA, 22 bp, Homo sapiens
ctgagaggcggagcttgcagtg

SEQ ID NO: 7870578 - DNA, 22 bp, Homo sapiens
ctgagaggcggagcttgcagtg

SEQ ID NO: 7870579 - DNA, 22 bp, Homo sapiens
ctgagaggcggagcttgcagtg

SEQ ID NO: 7870580 - DNA, 22 bp, Homo sapiens
ctgagaggcggagcttgcagtg

SEQ ID NO: 7870581 - DNA, 22 bp, Homo sapiens
ctgagaggcggagcttgcagtg

SEQ ID NO: 7870582 - DNA, 22 bp, Homo sapiens
ctgagaggcggaggttgcagtg

SEQ ID NO: 7870583 - DNA, 22 bp, Homo sapiens
ctgagaggcggaggttgcagtg

SEQ ID NO: 7870584 - DNA, 22 bp, Homo sapiens
ctgagaggaacatcttatgctt

SEQ ID NO: 7870585 - DNA, 22 bp, Homo sapiens
ctgagagcctcctgttggctag

SEQ ID NO: 7870586 - DNA, 22 bp, Homo sapiens
ctgagaggatgctgcagtggag

SEQ ID NO: 7870587 - DNA, 22 bp, Homo sapiens
ctgagaggatgctgcagtggag

SEQ ID NO: 7870588 - DNA, 22 bp, Homo sapiens
ctgagaggatgctgcagtggag

SEQ ID NO: 7870589 - DNA, 22 bp, Homo sapiens
ctgagaggatgctgcagtggag

SEQ ID NO: 7870590 - DNA, 22 bp, Homo sapiens
ctgagaggatgctgcagtggag

SEQ ID NO: 7870591 - DNA, 22 bp, Homo sapiens
ctgagagcatcgctggagatag

SEQ ID NO: 7870592 - DNA, 22 bp, Homo sapiens
ctgagagcctcctgttggctag

SEQ ID NO: 7870593 - DNA, 22 bp, Homo sapiens
ctgagagcatcgctggagatag

SEQ ID NO: 7870594 - DNA, 22 bp, Homo sapiens
ctgagagcctcctgttggctag

SEQ ID NO: 7870595 - DNA, 22 bp, Homo sapiens
ctgagagatggtgtgtttataa

SEQ ID NO: 7870596 - DNA, 22 bp, Homo sapiens
ctgagagcagggacttgagcca

SEQ ID NO: 7870597 - DNA, 22 bp, Homo sapiens
ctgagagcagggacttgagcca

SEQ ID NO: 7870598 - DNA, 22 bp, Homo sapiens
ctctctccttagctgcagacca

SEQ ID NO: 7870599 - DNA, 22 bp, Homo sapiens
ctctctccttagctgcagacca

SEQ ID NO: 7870600 - DNA, 22 bp, Homo sapiens
ctctctccttagctgcagacca

SEQ ID NO: 7870601 - DNA, 23 bp, Homo sapiens
ctctctctaccatgtgaggacac

SEQ ID NO: 7870602 - DNA, 23 bp, Homo sapiens
ctctctctaccatgtgaggacac

SEQ ID NO: 7870603 - DNA, 22 bp, Homo sapiens
ctctctggcttggcacggagat

SEQ ID NO: 7870604 - DNA, 19 bp, Homo sapiens
agtgcagggagcaccctca

SEQ ID NO: 7870605 - DNA, 19 bp, Homo sapiens
agtgcagggagcaccctca

SEQ ID NO: 7870606 - DNA, 22 bp, Homo sapiens
agtgcagggcctgcccagcagg

SEQ ID NO: 7870607 - DNA, 22 bp, Homo sapiens
ctctctccttagctgcagacca

SEQ ID NO: 7870608 - DNA, 22 bp, Homo sapiens
ctctctccttagctgcagacca

SEQ ID NO: 7870609 - DNA, 22 bp, Homo sapiens
agtgcaggctcgcttgtgaggc

SEQ ID NO: 7870610 - DNA, 22 bp, Homo sapiens
agtgcaggctcgcttgtgaggc

SEQ ID NO: 7870611 - DNA, 22 bp, Homo sapiens
agtgcaggctcgcttgtgaggc

SEQ ID NO: 7870612 - DNA, 22 bp, Homo sapiens
agtgcaggctcgcttgtgaggc

SEQ ID NO: 7870613 - DNA, 22 bp, Homo sapiens
agtgcaggctcgcttgtgaggc

SEQ ID NO: 7870614 - DNA, 22 bp, Homo sapiens
agtgcaggctcgcttgtgaggc

SEQ ID NO: 7870615 - DNA, 19 bp, Homo sapiens
agtgcagggagcaccctca

SEQ ID NO: 7870616 - DNA, 22 bp, Homo sapiens
agtgcaggccccaggccaggcc

SEQ ID NO: 7870617 - DNA, 22 bp, Homo sapiens
agtgcaggctcgcttgtgaggc

SEQ ID NO: 7870618 - DNA, 22 bp, Homo sapiens
agtgcaggccccaggccaggcc

SEQ ID NO: 7870619 - DNA, 22 bp, Homo sapiens
agtgcaggccccaggccaggcc

SEQ ID NO: 7870620 - DNA, 22 bp, Homo sapiens
agtgcaggccccaggccaggcc

SEQ ID NO: 7870621 - DNA, 22 bp, Homo sapiens
agtgcaggccccaggccaggcc

SEQ ID NO: 7870622 - DNA, 22 bp, Homo sapiens
agtgcaggccccaggccaggcc

SEQ ID NO: 7870623 - DNA, 22 bp, Homo sapiens
agtgcaggagcctggccagagc

SEQ ID NO: 7870624 - DNA, 22 bp, Homo sapiens
agtgcaggccccaggccaggcc

SEQ ID NO: 7870625 - DNA, 22 bp, Homo sapiens
agtgcaggagcctggccagagc

SEQ ID NO: 7870626 - DNA, 22 bp, Homo sapiens
agtgcaggccccaggccaggcc

SEQ ID NO: 7870627 - DNA, 22 bp, Homo sapiens
agtgcaggccccaggccaggcc

SEQ ID NO: 7870628 - DNA, 22 bp, Homo sapiens
agtgcaggccccaggccaggcc

SEQ ID NO: 7870629 - DNA, 22 bp, Homo sapiens
agtgcaggccccaggccaggcc

SEQ ID NO: 7870630 - DNA, 22 bp, Homo sapiens
agtgcaggccccaggccaggcc

SEQ ID NO: 7870631 - DNA, 22 bp, Homo sapiens
agtgcaggccccaggccaggcc

SEQ ID NO: 7870632 - DNA, 22 bp, Homo sapiens
agtgcaggccccaggccaggcc

SEQ ID NO: 7870633 - DNA, 22 bp, Homo sapiens
ctctctgggcccagttggcacc

SEQ ID NO: 7870634 - DNA, 22 bp, Homo sapiens
ctctctgggcccagttggcacc

SEQ ID NO: 7870635 - DNA, 22 bp, Homo sapiens
ctctctgggggccatgccaaga

SEQ ID NO: 7870636 - DNA, 22 bp, Homo sapiens
ctctctggcttggcacggagat

SEQ ID NO: 7870637 - DNA, 22 bp, Homo sapiens
ctctctggcttggcacggagat

SEQ ID NO: 7870638 - DNA, 22 bp, Homo sapiens
ctctctgggaatattttattct

SEQ ID NO: 7870639 - DNA, 22 bp, Homo sapiens
ctctctggcttggcacggagat

SEQ ID NO: 7870640 - DNA, 22 bp, Homo sapiens
ctctctgggcccagttggcacc

SEQ ID NO: 7870641 - DNA, 18 bp, Homo sapiens
ctctctgggtgaggacaa

SEQ ID NO: 7870642 - DNA, 22 bp, Homo sapiens
ctctctggtacatagagtttgg

SEQ ID NO: 7870643 - DNA, 22 bp, Homo sapiens
ctctctggtacatagagtttgg

SEQ ID NO: 7870644 - DNA, 18 bp, Homo sapiens
ctctctgggtgaggacaa

SEQ ID NO: 7870645 - DNA, 18 bp, Homo sapiens
ctctctgggtgaggacaa

SEQ ID NO: 7870646 - DNA, 18 bp, Homo sapiens
ctctctgggtgaggacaa

SEQ ID NO: 7870647 - DNA, 22 bp, Homo sapiens
ctctctggggttccagacgtgg

SEQ ID NO: 7870648 - DNA, 22 bp, Homo sapiens
ctctctgggtcctcttttatag

SEQ ID NO: 7870649 - DNA, 22 bp, Homo sapiens
ctctctggggttccagacgtgg

SEQ ID NO: 7870650 - DNA, 22 bp, Homo sapiens
ctctctgggtcctcttttatag

SEQ ID NO: 7870651 - DNA, 18 bp, Homo sapiens
ctctctgggtgaggacaa

SEQ ID NO: 7870652 - DNA, 18 bp, Homo sapiens
ctctctgggtgaggacaa

SEQ ID NO: 7870653 - DNA, 22 bp, Homo sapiens
agtggcaggcggagatgtagga

SEQ ID NO: 7870654 - DNA, 22 bp, Homo sapiens
agtggcaggcggagatgtagga

SEQ ID NO: 7870655 - DNA, 22 bp, Homo sapiens
agtggctgaagcatcaaaggca

SEQ ID NO: 7870656 - DNA, 22 bp, Homo sapiens
agtggcaggcggagatgtagga

SEQ ID NO: 7870657 - DNA, 20 bp, Homo sapiens
agtggcaggcgatcattact

SEQ ID NO: 7870658 - DNA, 22 bp, Homo sapiens
agtggcaggcggagatgtagga

SEQ ID NO: 7870659 - DNA, 22 bp, Homo sapiens
agtggcaggcggagatgtagga

SEQ ID NO: 7870660 - DNA, 20 bp, Homo sapiens
agtggcaggcgatcattact

SEQ ID NO: 7870661 - DNA, 22 bp, Homo sapiens
agtggctgacaactgggttaac

SEQ ID NO: 7870662 - DNA, 22 bp, Homo sapiens
agtggctggacgacaagggtga

SEQ ID NO: 7870663 - DNA, 22 bp, Homo sapiens
agtggctggacgacaagggtga

SEQ ID NO: 7870664 - DNA, 22 bp, Homo sapiens
agtggctgaatatattttacta

SEQ ID NO: 7870665 - DNA, 22 bp, Homo sapiens
agtggctgacaactgggttaac

SEQ ID NO: 7870666 - DNA, 22 bp, Homo sapiens
agtggctgacaactgggttaac

SEQ ID NO: 7870667 - DNA, 22 bp, Homo sapiens
agtggctggagccccaggctgg

SEQ ID NO: 7870668 - DNA, 22 bp, Homo sapiens
agtggctggcataggaacagac

SEQ ID NO: 7870669 - DNA, 22 bp, Homo sapiens
agtggctggcataggaacagac

SEQ ID NO: 7870670 - DNA, 22 bp, Homo sapiens
agtggctggcataggaacagac

SEQ ID NO: 7870671 - DNA, 22 bp, Homo sapiens
agtggctggcataggaacagac

SEQ ID NO: 7870672 - DNA, 22 bp, Homo sapiens
agtggctggcataggaacagac

SEQ ID NO: 7870673 - DNA, 19 bp, Homo sapiens
agtggctgggcagaagcaa

SEQ ID NO: 7870674 - DNA, 19 bp, Homo sapiens
agtggctgggcagaagcaa

SEQ ID NO: 7870675 - DNA, 19 bp, Homo sapiens
agtggctgggcagaagcaa

SEQ ID NO: 7870676 - DNA, 19 bp, Homo sapiens
agtggctgggcagaagcaa

SEQ ID NO: 7870677 - DNA, 17 bp, Homo sapiens
agtggcaggcagatggg

SEQ ID NO: 7870678 - DNA, 17 bp, Homo sapiens
agtggcaggcagatggg

SEQ ID NO: 7870679 - DNA, 17 bp, Homo sapiens
agtggcaggcagatggg

SEQ ID NO: 7870680 - DNA, 17 bp, Homo sapiens
agtggcaggcagatggg

SEQ ID NO: 7870681 - DNA, 17 bp, Homo sapiens
agtggcaggcagatggg

SEQ ID NO: 7870682 - DNA, 17 bp, Homo sapiens
agtggcaggcagatggg

SEQ ID NO: 7870683 - DNA, 17 bp, Homo sapiens
agtggcaggcagatggg

SEQ ID NO: 7870684 - DNA, 17 bp, Homo sapiens
agtggcaggcagatggg

SEQ ID NO: 7870685 - DNA, 22 bp, Homo sapiens
agtggcaggcagaagcttctca

SEQ ID NO: 7870686 - DNA, 22 bp, Homo sapiens
agtggcaggcagaagcttctca

SEQ ID NO: 7870687 - DNA, 22 bp, Homo sapiens
agtggcaggcagaagcttctca

SEQ ID NO: 7870688 - DNA, 22 bp, Homo sapiens
agtggcaggcagaagcttctca

SEQ ID NO: 7870689 - DNA, 22 bp, Homo sapiens
agtggcaggcagaagcttctca

SEQ ID NO: 7870690 - DNA, 17 bp, Homo sapiens
agtggcaggcagatggg

SEQ ID NO: 7870691 - DNA, 22 bp, Homo sapiens
agtggcaggatctcggttcact

SEQ ID NO: 7870692 - DNA, 22 bp, Homo sapiens
agtggcaggatctcggttcact

SEQ ID NO: 7870693 - DNA, 22 bp, Homo sapiens
agtggcaggatctcggttcact

SEQ ID NO: 7870694 - DNA, 22 bp, Homo sapiens
agtggcaggatctcggttcact

SEQ ID NO: 7870695 - DNA, 22 bp, Homo sapiens
agtggcaggcagaagcttctca

SEQ ID NO: 7870696 - DNA, 22 bp, Homo sapiens
agtggcaggaaagtggaagaga

SEQ ID NO: 7870697 - DNA, 22 bp, Homo sapiens
agtggcaggaaagtggaagaga

SEQ ID NO: 7870698 - DNA, 22 bp, Homo sapiens
agtggcaggaaagtggaagaga

SEQ ID NO: 7870699 - DNA, 22 bp, Homo sapiens
agtggcaggaaagtggaagaga

SEQ ID NO: 7870700 - DNA, 22 bp, Homo sapiens
agtggcagctgtcatgccctag

SEQ ID NO: 7870701 - DNA, 22 bp, Homo sapiens
agtggcagctgtcatgccctag

SEQ ID NO: 7870702 - DNA, 22 bp, Homo sapiens
agtggcagctgtcatgccctag

SEQ ID NO: 7870703 - DNA, 22 bp, Homo sapiens
ctctctggtcccagattccaga

SEQ ID NO: 7870704 - DNA, 22 bp, Homo sapiens
ctctctggtcccagattccaga

SEQ ID NO: 7870705 - DNA, 22 bp, Homo sapiens
agtggcagccgagcaggagatg

SEQ ID NO: 7870706 - DNA, 22 bp, Homo sapiens
agtggcagccgagcaggagatg

SEQ ID NO: 7870707 - DNA, 22 bp, Homo sapiens
agtggcagccgagcaggagatg

SEQ ID NO: 7870708 - DNA, 22 bp, Homo sapiens
agtggcagccgagcaggagatg

SEQ ID NO: 7870709 - DNA, 22 bp, Homo sapiens
agtggcagccgagcaggagatg

SEQ ID NO: 7870710 - DNA, 22 bp, Homo sapiens
agtggcagccgagcaggagatg

SEQ ID NO: 7870711 - DNA, 22 bp, Homo sapiens
agtggcagccgagcaggagatg

SEQ ID NO: 7870712 - DNA, 22 bp, Homo sapiens
agtggcagccgagcaggagatg

SEQ ID NO: 7870713 - DNA, 22 bp, Homo sapiens
agtggcagccgagcaggagatg

SEQ ID NO: 7870714 - DNA, 22 bp, Homo sapiens
agtggcagccgagcaggagatg

SEQ ID NO: 7870715 - DNA, 22 bp, Homo sapiens
agtggcagctgtcatgccctag

SEQ ID NO: 7870716 - DNA, 22 bp, Homo sapiens
agtggcagctgtcatgccctag

SEQ ID NO: 7870717 - DNA, 22 bp, Homo sapiens
agtggcagctgtcatgccctag

SEQ ID NO: 7870718 - DNA, 22 bp, Homo sapiens
agtggcagctgtcatgccctag

SEQ ID NO: 7870719 - DNA, 22 bp, Homo sapiens
agtggcagccttgttcattatg

SEQ ID NO: 7870720 - DNA, 22 bp, Homo sapiens
agtggcagccgagcaggagatg

SEQ ID NO: 7870721 - DNA, 22 bp, Homo sapiens
agtggcagccttgttcattatg

SEQ ID NO: 7870722 - DNA, 18 bp, Homo sapiens
ctctgaccgccacttgct

SEQ ID NO: 7870723 - DNA, 22 bp, Homo sapiens
ctctgacctctagccagctctg

SEQ ID NO: 7870724 - DNA, 22 bp, Homo sapiens
ctctgacctctagccagctctg

SEQ ID NO: 7870725 - DNA, 22 bp, Homo sapiens
ctctgacttatcggagaagtcc

SEQ ID NO: 7870726 - DNA, 22 bp, Homo sapiens
ctctgactttaaatacaggatg

SEQ ID NO: 7870727 - DNA, 22 bp, Homo sapiens
ctctgactgacctggaatgaat

SEQ ID NO: 7870728 - DNA, 22 bp, Homo sapiens
ctctgactgacctggaatgaat

SEQ ID NO: 7870729 - DNA, 22 bp, Homo sapiens
ctctgacttatcggagaagtcc

SEQ ID NO: 7870730 - DNA, 22 bp, Homo sapiens
agtggctgtcttccaaaatctg

SEQ ID NO: 7870731 - DNA, 22 bp, Homo sapiens
agtggctgtcctggctctaact

SEQ ID NO: 7870732 - DNA, 21 bp, Homo sapiens
agtggctgtcaagggggcctt

SEQ ID NO: 7870733 - DNA, 21 bp, Homo sapiens
agtggctgtcaagggggcctt

SEQ ID NO: 7870734 - DNA, 21 bp, Homo sapiens
agtggctgtcaagggggcctt

SEQ ID NO: 7870735 - DNA, 22 bp, Homo sapiens
agtggctggtctaaggtcacag

SEQ ID NO: 7870736 - DNA, 22 bp, Homo sapiens
agtggctggtctaaggtcacag

SEQ ID NO: 7870737 - DNA, 22 bp, Homo sapiens
agtggctggtctaaggtcacag

SEQ ID NO: 7870738 - DNA, 19 bp, Homo sapiens
agtggctgggcagaagcaa

SEQ ID NO: 7870739 - DNA, 22 bp, Homo sapiens
agtggctggtagttactgagca

SEQ ID NO: 7870740 - DNA, 22 bp, Homo sapiens
agtggctggtagttactgagca

SEQ ID NO: 7870741 - DNA, 22 bp, Homo sapiens
agtggctggtagttactgagca

SEQ ID NO: 7870742 - DNA, 22 bp, Homo sapiens
agtggctgtaggctatgagaga

SEQ ID NO: 7870743 - DNA, 22 bp, Homo sapiens
agtggctgtatcagtcaaccct

SEQ ID NO: 7870744 - DNA, 22 bp, Homo sapiens
agtggctggtctaaggtcacag

SEQ ID NO: 7870745 - DNA, 22 bp, Homo sapiens
agtggctgtactattttttcat

SEQ ID NO: 7870746 - DNA, 22 bp, Homo sapiens
ctctgagacttagcatctacat

SEQ ID NO: 7870747 - DNA, 22 bp, Homo sapiens
ctctgagacttagcatctacat

SEQ ID NO: 7870748 - DNA, 22 bp, Homo sapiens
ctctgagactcaagtgagtggg

SEQ ID NO: 7870749 - DNA, 22 bp, Homo sapiens
ctctgagactcaagtgagtggg

SEQ ID NO: 7870750 - DNA, 22 bp, Homo sapiens
ctctgagactcaagtgagtggg

SEQ ID NO: 7870751 - DNA, 22 bp, Homo sapiens
ctctgagactcaagtgagtggg

SEQ ID NO: 7870752 - DNA, 22 bp, Homo sapiens
ctctgagaatataagactattt

SEQ ID NO: 7870753 - DNA, 22 bp, Homo sapiens
ctctgagaatatgagctctttg

SEQ ID NO: 7870754 - DNA, 23 bp, Homo sapiens
ctctgagacccaggtggacacgg

SEQ ID NO: 7870755 - DNA, 23 bp, Homo sapiens
ctctgagacccaggtggacacgg

SEQ ID NO: 7870756 - DNA, 22 bp, Homo sapiens
ctctgagaaagctgtgagctaa

SEQ ID NO: 7870757 - DNA, 22 bp, Homo sapiens
ctctgagaaagctgtgagctaa

SEQ ID NO: 7870758 - DNA, 22 bp, Homo sapiens
ctctgagaaagctgtgagctaa

SEQ ID NO: 7870759 - DNA, 22 bp, Homo sapiens
ctctgagaagagttcaagtaaa

SEQ ID NO: 7870760 - DNA, 22 bp, Homo sapiens
ctctgagaactcaggattctga

SEQ ID NO: 7870761 - DNA, 22 bp, Homo sapiens
ctctgagaactcaggattctga

SEQ ID NO: 7870762 - DNA, 22 bp, Homo sapiens
ctctgagaagagttcaagtaaa

SEQ ID NO: 7870763 - DNA, 22 bp, Homo sapiens
ctctgagaagccttgatgggga

SEQ ID NO: 7870764 - DNA, 22 bp, Homo sapiens
ctctgagaatataagactattt

SEQ ID NO: 7870765 - DNA, 22 bp, Homo sapiens
ctctgagaagccttgatgggga

SEQ ID NO: 7870766 - DNA, 22 bp, Homo sapiens
ctctgagaggctgccctgccat

SEQ ID NO: 7870767 - DNA, 22 bp, Homo sapiens
ctctgagagcggtctgtggctt

SEQ ID NO: 7870768 - DNA, 22 bp, Homo sapiens
ctctgagagcggtctgtggctt

SEQ ID NO: 7870769 - DNA, 22 bp, Homo sapiens
ctctgagacttttcacctccca

SEQ ID NO: 7870770 - DNA, 22 bp, Homo sapiens
ctctgagagagctggtgagcac

SEQ ID NO: 7870771 - DNA, 22 bp, Homo sapiens
ctctgagaggtgagaagcagca

SEQ ID NO: 7870772 - DNA, 22 bp, Homo sapiens
ctctgagaggtgagaagcagca

SEQ ID NO: 7870773 - DNA, 22 bp, Homo sapiens
ctctgagaggtgagaagcagca

SEQ ID NO: 7870774 - DNA, 22 bp, Homo sapiens
ctctgagaggtgagaagcagca

SEQ ID NO: 7870775 - DNA, 22 bp, Homo sapiens
ctctgagaggtgagaagcagca

SEQ ID NO: 7870776 - DNA, 22 bp, Homo sapiens
ctctgagagtgctcagagggta

SEQ ID NO: 7870777 - DNA, 22 bp, Homo sapiens
ctctgagagtgctcagagggta

SEQ ID NO: 7870778 - DNA, 22 bp, Homo sapiens
ctctgagatagtttctatcaat

SEQ ID NO: 7870779 - DNA, 22 bp, Homo sapiens
agtggggaagagcatgggccct

SEQ ID NO: 7870780 - DNA, 22 bp, Homo sapiens
agtggggaagagcatgggccct

SEQ ID NO: 7870781 - DNA, 22 bp, Homo sapiens
agtggggaagagcatgggccct

SEQ ID NO: 7870782 - DNA, 22 bp, Homo sapiens
agtgggcttactgagggagtgt

SEQ ID NO: 7870783 - DNA, 22 bp, Homo sapiens
agtgggctggtggcagggagaa

SEQ ID NO: 7870784 - DNA, 22 bp, Homo sapiens
agtgggctggtggcagggagaa

SEQ ID NO: 7870785 - DNA, 22 bp, Homo sapiens
agtgggctggtggcagggagaa

SEQ ID NO: 7870786 - DNA, 22 bp, Homo sapiens
agtgggcccttgtcacactgat

SEQ ID NO: 7870787 - DNA, 22 bp, Homo sapiens
agtgggccggacagcccaggcc

SEQ ID NO: 7870788 - DNA, 22 bp, Homo sapiens
agtgggccggacagcccaggcc

SEQ ID NO: 7870789 - DNA, 22 bp, Homo sapiens
agtgggcccttgtcacactgat

SEQ ID NO: 7870790 - DNA, 22 bp, Homo sapiens
agtgggctgagcttgctgggtg

SEQ ID NO: 7870791 - DNA, 23 bp, Homo sapiens
agtgggctcagtcctccaacccc

SEQ ID NO: 7870792 - DNA, 22 bp, Homo sapiens
agtgggccttagaaggttccct

SEQ ID NO: 7870793 - DNA, 22 bp, Homo sapiens
agtgggccttagaaggttccct

SEQ ID NO: 7870794 - DNA, 22 bp, Homo sapiens
agtgggcctgagtgaccagttc

SEQ ID NO: 7870795 - DNA, 22 bp, Homo sapiens
agtgggccggacagcccaggcc

SEQ ID NO: 7870796 - DNA, 22 bp, Homo sapiens
agtgggcatatgaagtctcaag

SEQ ID NO: 7870797 - DNA, 21 bp, Homo sapiens
agtgggccatgtgtaatattt

SEQ ID NO: 7870798 - DNA, 22 bp, Homo sapiens
agtgggccaagtgtatgtgtct

SEQ ID NO: 7870799 - DNA, 22 bp, Homo sapiens
agtgggccaaatggaggcaagt

SEQ ID NO: 7870800 - DNA, 22 bp, Homo sapiens
agtgggccaaatggaggcaagt

SEQ ID NO: 7870801 - DNA, 22 bp, Homo sapiens
agtgggcccgagccagtggtct

SEQ ID NO: 7870802 - DNA, 22 bp, Homo sapiens
agtgggcccgagccagtggtct

SEQ ID NO: 7870803 - DNA, 22 bp, Homo sapiens
agtgggcaggcagggtgcgcag

SEQ ID NO: 7870804 - DNA, 22 bp, Homo sapiens
agtgggcaggcagggtgcgcag

SEQ ID NO: 7870805 - DNA, 22 bp, Homo sapiens
agtgggcagcccaggaggtctt

SEQ ID NO: 7870806 - DNA, 22 bp, Homo sapiens
agtgggcaaaacagctcagagc

SEQ ID NO: 7870807 - DNA, 22 bp, Homo sapiens
agtgggcaaaacagctcagagc

SEQ ID NO: 7870808 - DNA, 22 bp, Homo sapiens
agtgggcaaaacagctcagagc

SEQ ID NO: 7870809 - DNA, 19 bp, Homo sapiens
agtgggcaaggaagatgac

SEQ ID NO: 7870810 - DNA, 22 bp, Homo sapiens
agtgggcaaaacagctcagagc

SEQ ID NO: 7870811 - DNA, 18 bp, Homo sapiens
agtgggcacacagagaac

SEQ ID NO: 7870812 - DNA, 22 bp, Homo sapiens
agtgggagggccatatggtgaa

SEQ ID NO: 7870813 - DNA, 20 bp, Homo sapiens
agtgggagagggcagactgc

SEQ ID NO: 7870814 - DNA, 22 bp, Homo sapiens
agtgggagggccatatggtgaa

SEQ ID NO: 7870815 - DNA, 22 bp, Homo sapiens
agtgggcaaaacagctcagagc

SEQ ID NO: 7870816 - DNA, 22 bp, Homo sapiens
ctctgagatgcttgaagaggat

SEQ ID NO: 7870817 - DNA, 22 bp, Homo sapiens
ctctgagatagtttctatcaat

SEQ ID NO: 7870818 - DNA, 22 bp, Homo sapiens
ctctgagcagaggccgtggcta

SEQ ID NO: 7870819 - DNA, 22 bp, Homo sapiens
atagacaacacttattattcct

SEQ ID NO: 7870820 - DNA, 22 bp, Homo sapiens
atagacaatggtttgccaagaa

SEQ ID NO: 7870821 - DNA, 22 bp, Homo sapiens
atagacaatggtttgccaagaa

SEQ ID NO: 7870822 - DNA, 22 bp, Homo sapiens
atagacaacacttattattcct

SEQ ID NO: 7870823 - DNA, 22 bp, Homo sapiens
atagacaacacttattattcct

SEQ ID NO: 7870824 - DNA, 20 bp, Homo sapiens
atagacaaagacatgccaga

SEQ ID NO: 7870825 - DNA, 22 bp, Homo sapiens
atagacaacacttattattcct

SEQ ID NO: 7870826 - DNA, 22 bp, Homo sapiens
atagacaatcccccatcctacc

SEQ ID NO: 7870827 - DNA, 22 bp, Homo sapiens
atagacacagctatgatttgag

SEQ ID NO: 7870828 - DNA, 22 bp, Homo sapiens
atagacagaaagataatagaat

SEQ ID NO: 7870829 - DNA, 22 bp, Homo sapiens
atagacagaaagataatagaat

SEQ ID NO: 7870830 - DNA, 22 bp, Homo sapiens
atagacactgaaatccctgcca

SEQ ID NO: 7870831 - DNA, 22 bp, Homo sapiens
atagacagatgatagataaatc

SEQ ID NO: 7870832 - DNA, 22 bp, Homo sapiens
atagacagatgatagataaatc

SEQ ID NO: 7870833 - DNA, 22 bp, Homo sapiens
atagacagaaagataatagaat

SEQ ID NO: 7870834 - DNA, 22 bp, Homo sapiens
atagacagctacatagaatata

SEQ ID NO: 7870835 - DNA, 22 bp, Homo sapiens
atagacagcgcattaaaaatgt

SEQ ID NO: 7870836 - DNA, 22 bp, Homo sapiens
atagacagcgcattaaaaatgt

SEQ ID NO: 7870837 - DNA, 22 bp, Homo sapiens
atagacatatggctttgtttct

SEQ ID NO: 7870838 - DNA, 22 bp, Homo sapiens
atagacatatggctttgtttct

SEQ ID NO: 7870839 - DNA, 22 bp, Homo sapiens
atagacatatggctttgtttct

SEQ ID NO: 7870840 - DNA, 22 bp, Homo sapiens
atagacagctacatagaatata

SEQ ID NO: 7870841 - DNA, 22 bp, Homo sapiens
atagacatagccgtaatttatt

SEQ ID NO: 7870842 - DNA, 22 bp, Homo sapiens
atagacatagccgtaatttatt

SEQ ID NO: 7870843 - DNA, 22 bp, Homo sapiens
atagacatagccgtaatttatt

SEQ ID NO: 7870844 - DNA, 22 bp, Homo sapiens
atagacatagccgtaatttatt

SEQ ID NO: 7870845 - DNA, 22 bp, Homo sapiens
atagacatggtcttttgtcatt

SEQ ID NO: 7870846 - DNA, 22 bp, Homo sapiens
atagacatgcaacactttttac

SEQ ID NO: 7870847 - DNA, 22 bp, Homo sapiens
atagacattataacacagagct

SEQ ID NO: 7870848 - DNA, 22 bp, Homo sapiens
atagacattataacacagagct

SEQ ID NO: 7870849 - DNA, 22 bp, Homo sapiens
atagacatttactgagcacgta

SEQ ID NO: 7870850 - DNA, 22 bp, Homo sapiens
atagacatatggctttgtttct

SEQ ID NO: 7870851 - DNA, 22 bp, Homo sapiens
atagacatgcaacactttttac

SEQ ID NO: 7870852 - DNA, 22 bp, Homo sapiens
atagacatgcaacactttttac

SEQ ID NO: 7870853 - DNA, 22 bp, Homo sapiens
atagacatggtcttttgtcatt

SEQ ID NO: 7870854 - DNA, 22 bp, Homo sapiens
atagacatggtcttttgtcatt

SEQ ID NO: 7870855 - DNA, 22 bp, Homo sapiens
atagacatggtcttttgtcatt

SEQ ID NO: 7870856 - DNA, 22 bp, Homo sapiens
atagaatcatctgtgcactagt

SEQ ID NO: 7870857 - DNA, 22 bp, Homo sapiens
atagaatcctgcagcaagcctt

SEQ ID NO: 7870858 - DNA, 22 bp, Homo sapiens
atagaatcatctgtgcactagt

SEQ ID NO: 7870859 - DNA, 22 bp, Homo sapiens
atagaatctttgtaaaacactt

SEQ ID NO: 7870860 - DNA, 22 bp, Homo sapiens
atagaatcctgcagcaagcctt

SEQ ID NO: 7870861 - DNA, 22 bp, Homo sapiens
atagaatgtattatagtacaga

SEQ ID NO: 7870862 - DNA, 22 bp, Homo sapiens
atagaatctttgtaaaacactt

SEQ ID NO: 7870863 - DNA, 22 bp, Homo sapiens
atagaatgtattatagtacaga

SEQ ID NO: 7870864 - DNA, 22 bp, Homo sapiens
atagaatgtattatagtacaga

SEQ ID NO: 7870865 - DNA, 22 bp, Homo sapiens
atagaatctttgtaaaacactt

SEQ ID NO: 7870866 - DNA, 22 bp, Homo sapiens
atagaattcgtgtttgtaattc

SEQ ID NO: 7870867 - DNA, 22 bp, Homo sapiens
atagaattatggaaagcatctt

SEQ ID NO: 7870868 - DNA, 22 bp, Homo sapiens
atagaattcgtgtttgtaattc

SEQ ID NO: 7870869 - DNA, 22 bp, Homo sapiens
atagaattctttgaaatttatg

SEQ ID NO: 7870870 - DNA, 22 bp, Homo sapiens
atagaattctttgaaatttatg

SEQ ID NO: 7870871 - DNA, 22 bp, Homo sapiens
atagaattctttgaaatttatg

SEQ ID NO: 7870872 - DNA, 22 bp, Homo sapiens
atagaattcgtgtttgtaattc

SEQ ID NO: 7870873 - DNA, 22 bp, Homo sapiens
atagacaaacacgaagatgaca

SEQ ID NO: 7870874 - DNA, 20 bp, Homo sapiens
atagacaaagacatgccaga

SEQ ID NO: 7870875 - DNA, 20 bp, Homo sapiens
atagacaaagacatgccaga

SEQ ID NO: 7870876 - DNA, 20 bp, Homo sapiens
atagacaaagacatgccaga

SEQ ID NO: 7870877 - DNA, 20 bp, Homo sapiens
atagacaaagacatgccaga

SEQ ID NO: 7870878 - DNA, 22 bp, Homo sapiens
atagacaaacacgaagatgaca

SEQ ID NO: 7870879 - DNA, 22 bp, Homo sapiens
atagacaaacacgaagatgaca

SEQ ID NO: 7870880 - DNA, 22 bp, Homo sapiens
atagacaaacacgaagatgaca

SEQ ID NO: 7870881 - DNA, 22 bp, Homo sapiens
atagaatttgtacttgtagaac

SEQ ID NO: 7870882 - DNA, 22 bp, Homo sapiens
atagaatttgtacttgtagaac

SEQ ID NO: 7870883 - DNA, 22 bp, Homo sapiens
atagaatttgcactaaatctgc

SEQ ID NO: 7870884 - DNA, 22 bp, Homo sapiens
atagaatttgcactaaatctgc

SEQ ID NO: 7870885 - DNA, 22 bp, Homo sapiens
atagaattctttgaaatttatg

SEQ ID NO: 7870886 - DNA, 22 bp, Homo sapiens
atagaatttgcactaaatctgc

SEQ ID NO: 7870887 - DNA, 22 bp, Homo sapiens
atagaatttgcactaaatctgc

SEQ ID NO: 7870888 - DNA, 22 bp, Homo sapiens
atagtacagatccattaattat

SEQ ID NO: 7870889 - DNA, 22 bp, Homo sapiens
atagtacacatcctacaatgtt

SEQ ID NO: 7870890 - DNA, 22 bp, Homo sapiens
atagtacagagggctactggtt

SEQ ID NO: 7870891 - DNA, 22 bp, Homo sapiens
atagtacacatcctacaatgtt

SEQ ID NO: 7870892 - DNA, 22 bp, Homo sapiens
atagtacacatcctacaatgtt

SEQ ID NO: 7870893 - DNA, 22 bp, Homo sapiens
atagtacaatcagttaattagt

SEQ ID NO: 7870894 - DNA, 22 bp, Homo sapiens
atagtacacatcctacaatgtt

SEQ ID NO: 7870895 - DNA, 22 bp, Homo sapiens
atagtacacatcctacaatgtt

SEQ ID NO: 7870896 - DNA, 22 bp, Homo sapiens
atagtacacatcctacaatgtt

SEQ ID NO: 7870897 - DNA, 22 bp, Homo sapiens
atagtacacatcctacaatgtt

SEQ ID NO: 7870898 - DNA, 22 bp, Homo sapiens
atagtacaatcagttaattagt

SEQ ID NO: 7870899 - DNA, 22 bp, Homo sapiens
atagtacaatcagttaattagt

SEQ ID NO: 7870900 - DNA, 22 bp, Homo sapiens
atagtacacatcctacaatgtt

SEQ ID NO: 7870901 - DNA, 22 bp, Homo sapiens
atagtacacatcctacaatgtt

SEQ ID NO: 7870902 - DNA, 22 bp, Homo sapiens
atagtacaagggaagagtgaag

SEQ ID NO: 7870903 - DNA, 22 bp, Homo sapiens
atagtacaagggaagagtgaag

SEQ ID NO: 7870904 - DNA, 22 bp, Homo sapiens
atagtacaagggaagagtgaag

SEQ ID NO: 7870905 - DNA, 22 bp, Homo sapiens
atagtacaatcagttaattagt

SEQ ID NO: 7870906 - DNA, 22 bp, Homo sapiens
atagggcctaaaaagtattgct

SEQ ID NO: 7870907 - DNA, 22 bp, Homo sapiens
atagggctgttgtgaggattaa

SEQ ID NO: 7870908 - DNA, 22 bp, Homo sapiens
ataggggcagatgaggaatggg

SEQ ID NO: 7870909 - DNA, 22 bp, Homo sapiens
ataggtcagagccacagtgaag

SEQ ID NO: 7870910 - DNA, 22 bp, Homo sapiens
ataggtcagagccacagtgaag

SEQ ID NO: 7870911 - DNA, 22 bp, Homo sapiens
ataggtctgaaagtgtatcctg

SEQ ID NO: 7870912 - DNA, 22 bp, Homo sapiens
atagtaatcagttgttggatca

SEQ ID NO: 7870913 - DNA, 22 bp, Homo sapiens
atagtaactggcatgtttatga

SEQ ID NO: 7870914 - DNA, 22 bp, Homo sapiens
atagtaactggcatgtttatga

SEQ ID NO: 7870915 - DNA, 22 bp, Homo sapiens
atagtaaattatcgtggagaga

SEQ ID NO: 7870916 - DNA, 22 bp, Homo sapiens
atagcagttgtcaaactccatc

SEQ ID NO: 7870917 - DNA, 22 bp, Homo sapiens
atagcagtggatgtggagaaag

SEQ ID NO: 7870918 - DNA, 22 bp, Homo sapiens
atagcagttgtcaaactccatc

SEQ ID NO: 7870919 - DNA, 22 bp, Homo sapiens
ataggcagaaatgctccctatt

SEQ ID NO: 7870920 - DNA, 22 bp, Homo sapiens
atagcatataagttataaaact

SEQ ID NO: 7870921 - DNA, 22 bp, Homo sapiens
atagcatataagttataaaact

SEQ ID NO: 7870922 - DNA, 22 bp, Homo sapiens
ataggcaagcacaaagtcagga

SEQ ID NO: 7870923 - DNA, 21 bp, Homo sapiens
atagaccagtatggataacag

SEQ ID NO: 7870924 - DNA, 22 bp, Homo sapiens
atagacatttactgagcacgta

SEQ ID NO: 7870925 - DNA, 22 bp, Homo sapiens
atagacattttgcattcaagca

SEQ ID NO: 7870926 - DNA, 22 bp, Homo sapiens
atagacattttgcattcaagca

SEQ ID NO: 7870927 - DNA, 22 bp, Homo sapiens
atagaccctggaaatggcagag

SEQ ID NO: 7870928 - DNA, 23 bp, Homo sapiens
atagacccaagagtaaaggcatc

SEQ ID NO: 7870929 - DNA, 22 bp, Homo sapiens
atagaccttctacacaggacaa

SEQ ID NO: 7870930 - DNA, 22 bp, Homo sapiens
atagcagtgacattttaatgtg

SEQ ID NO: 7870931 - DNA, 22 bp, Homo sapiens
atagggaaattgatgtcccgag

SEQ ID NO: 7870932 - DNA, 22 bp, Homo sapiens
atagggaggaactgagtcagga

SEQ ID NO: 7870933 - DNA, 22 bp, Homo sapiens
atagggaggaactgagtcagga

SEQ ID NO: 7870934 - DNA, 22 bp, Homo sapiens
ataggctttgtgttttgttatc

SEQ ID NO: 7870935 - DNA, 22 bp, Homo sapiens
ataggcttatataaaaacatct

SEQ ID NO: 7870936 - DNA, 22 bp, Homo sapiens
atagggcagtggcatctcttaa

SEQ ID NO: 7870937 - DNA, 19 bp, Homo sapiens
atagggcaccctaaggagt

SEQ ID NO: 7870938 - DNA, 22 bp, Homo sapiens
atagggaggaactgagtcagga

SEQ ID NO: 7870939 - DNA, 22 bp, Homo sapiens
ataggcattttaagtagtttag

SEQ ID NO: 7870940 - DNA, 22 bp, Homo sapiens
ataggcattaacccactccttt

SEQ ID NO: 7870941 - DNA, 22 bp, Homo sapiens
ataggcatttggagtgttgtga

SEQ ID NO: 7870942 - DNA, 22 bp, Homo sapiens
ataggcatcacctaggagcttg

SEQ ID NO: 7870943 - DNA, 22 bp, Homo sapiens
ataggcagaaatgctccctatt

SEQ ID NO: 7870944 - DNA, 22 bp, Homo sapiens
ataggcagactctttttggagg

SEQ ID NO: 7870945 - DNA, 22 bp, Homo sapiens
ataggcataacactgatgtcct

SEQ ID NO: 7870946 - DNA, 22 bp, Homo sapiens
ataggcatcaattttccttaag

SEQ ID NO: 7870947 - DNA, 20 bp, Homo sapiens
atagaatcacaagtcctgaa

SEQ ID NO: 7870948 - DNA, 20 bp, Homo sapiens
atagaatcacaagtcctgaa

SEQ ID NO: 7870949 - DNA, 22 bp, Homo sapiens
atagaatatgacttttagatcc

SEQ ID NO: 7870950 - DNA, 22 bp, Homo sapiens
atagaatatgacttttagatcc

SEQ ID NO: 7870951 - DNA, 22 bp, Homo sapiens
atagaatatgacttttagatcc

SEQ ID NO: 7870952 - DNA, 22 bp, Homo sapiens
atagaatatgacttttagatcc

SEQ ID NO: 7870953 - DNA, 22 bp, Homo sapiens
atagaatatgacttttagatcc

SEQ ID NO: 7870954 - DNA, 22 bp, Homo sapiens
atagaatatgacttttagatcc

SEQ ID NO: 7870955 - DNA, 22 bp, Homo sapiens
atagaatatgacttttagatcc

SEQ ID NO: 7870956 - DNA, 22 bp, Homo sapiens
atagaatatgacttttagatcc

SEQ ID NO: 7870957 - DNA, 22 bp, Homo sapiens
atagaatatgacttttagatcc

SEQ ID NO: 7870958 - DNA, 22 bp, Homo sapiens
atagaatagcatagaaaattga

SEQ ID NO: 7870959 - DNA, 22 bp, Homo sapiens
atagaatagcatagaaaattga

SEQ ID NO: 7870960 - DNA, 22 bp, Homo sapiens
atagaatagcatagaaaattga

SEQ ID NO: 7870961 - DNA, 22 bp, Homo sapiens
atagaaatgtattttggactag

SEQ ID NO: 7870962 - DNA, 22 bp, Homo sapiens
atagaatagcatagaaaattga

SEQ ID NO: 7870963 - DNA, 19 bp, Homo sapiens
atagaaagggttaaagaca

SEQ ID NO: 7870964 - DNA, 19 bp, Homo sapiens
atagaaagggttaaagaca

SEQ ID NO: 7870965 - DNA, 18 bp, Homo sapiens
atagaaacctttaatcag

SEQ ID NO: 7870966 - DNA, 22 bp, Homo sapiens
atagaaatggcagctggtgcta

SEQ ID NO: 7870967 - DNA, 22 bp, Homo sapiens
atagaaatggcagctggtgcta

SEQ ID NO: 7870968 - DNA, 22 bp, Homo sapiens
atagaaaggtctttggcagaca

SEQ ID NO: 7870969 - DNA, 22 bp, Homo sapiens
atagaaatggcagctggtgcta

SEQ ID NO: 7870970 - DNA, 22 bp, Homo sapiens
atagaaacagaggtcaggcatt

SEQ ID NO: 7870971 - DNA, 22 bp, Homo sapiens
atagaaaacagatgtccttaaa

SEQ ID NO: 7870972 - DNA, 22 bp, Homo sapiens
atagaaaacagatgtccttaaa

SEQ ID NO: 7870973 - DNA, 22 bp, Homo sapiens
atagaaaacagatgtccttaaa

SEQ ID NO: 7870974 - DNA, 22 bp, Homo sapiens
atagaaaacagatgtccttaaa

SEQ ID NO: 7870975 - DNA, 22 bp, Homo sapiens
atagaaaacagatgtccttaaa

SEQ ID NO: 7870976 - DNA, 22 bp, Homo sapiens
atagaaacagggaagcaaagca

SEQ ID NO: 7870977 - DNA, 22 bp, Homo sapiens
atagaaacagggaagcaaagca

SEQ ID NO: 7870978 - DNA, 22 bp, Homo sapiens
atagaaacagggaagcaaagca

SEQ ID NO: 7870979 - DNA, 22 bp, Homo sapiens
atagaaacagatgcacttctct

SEQ ID NO: 7870980 - DNA, 22 bp, Homo sapiens
atagaaacagaggtcaggcatt

SEQ ID NO: 7870981 - DNA, 22 bp, Homo sapiens
atagaaacagatgcacttctct

SEQ ID NO: 7870982 - DNA, 22 bp, Homo sapiens
atagaaacagatgcacttctct

SEQ ID NO: 7870983 - DNA, 22 bp, Homo sapiens
atagaaacagggaagcaaagca

SEQ ID NO: 7870984 - DNA, 22 bp, Homo sapiens
atactttgggggttagtgtaga

SEQ ID NO: 7870985 - DNA, 22 bp, Homo sapiens
atactttgctagtatcagtgtg

SEQ ID NO: 7870986 - DNA, 22 bp, Homo sapiens
atactttgctagtatcagtgtg

SEQ ID NO: 7870987 - DNA, 22 bp, Homo sapiens
atactttgctacattgtacatt

SEQ ID NO: 7870988 - DNA, 22 bp, Homo sapiens
atactttgctacattgtacatt

SEQ ID NO: 7870989 - DNA, 22 bp, Homo sapiens
atacttttaattccttctgagt

SEQ ID NO: 7870990 - DNA, 22 bp, Homo sapiens
atacttttaattccttctgagt

SEQ ID NO: 7870991 - DNA, 22 bp, Homo sapiens
atagaaaacagatgtccttaaa

SEQ ID NO: 7870992 - DNA, 22 bp, Homo sapiens
atagaaaacagatgtccttaaa

SEQ ID NO: 7870993 - DNA, 22 bp, Homo sapiens
atactttggtcactattattgg

SEQ ID NO: 7870994 - DNA, 22 bp, Homo sapiens
atacttttaattccttctgagt

SEQ ID NO: 7870995 - DNA, 22 bp, Homo sapiens
atacttttaattccttctgagt

SEQ ID NO: 7870996 - DNA, 22 bp, Homo sapiens
ctggccaggctctcacgtggtc

SEQ ID NO: 7870997 - DNA, 22 bp, Homo sapiens
ctggccaggctctcacgtggtc

SEQ ID NO: 7870998 - DNA, 22 bp, Homo sapiens
ctggccaggcttgggacagaca

SEQ ID NO: 7870999 - DNA, 22 bp, Homo sapiens
ctggccaggcttgggacagaca

SEQ ID NO: 7871000 - DNA, 22 bp, Homo sapiens
ctggccaggcttgggacagaca

SEQ ID NO: 7871001 - DNA, 22 bp, Homo sapiens
ctggccaggcttgggacagaca

SEQ ID NO: 7871002 - DNA, 22 bp, Homo sapiens
ctggccaggcttgggacagaca

SEQ ID NO: 7871003 - DNA, 22 bp, Homo sapiens
ctggccagaggttcctctgccc

SEQ ID NO: 7871004 - DNA, 22 bp, Homo sapiens
ctggccagaggttcctctgccc

SEQ ID NO: 7871005 - DNA, 22 bp, Homo sapiens
ctggccagaggttcctctgccc

SEQ ID NO: 7871006 - DNA, 22 bp, Homo sapiens
ctggccaggctctcacgtggtc

SEQ ID NO: 7871007 - DNA, 17 bp, Homo sapiens
ctggagctgtgtaacct

SEQ ID NO: 7871008 - DNA, 22 bp, Homo sapiens
ctggagctgttttttcaggaaa

SEQ ID NO: 7871009 - DNA, 17 bp, Homo sapiens
ctggagctgtgtaacct

SEQ ID NO: 7871010 - DNA, 22 bp, Homo sapiens
ctggagctgtcttcacaggcct

SEQ ID NO: 7871011 - DNA, 22 bp, Homo sapiens
ctggagctggtatagggacaaa

SEQ ID NO: 7871012 - DNA, 22 bp, Homo sapiens
ctggagctgtcttcacaggcct

SEQ ID NO: 7871013 - DNA, 22 bp, Homo sapiens
ctggagcttattgggagcagaa

SEQ ID NO: 7871014 - DNA, 22 bp, Homo sapiens
ctggagcttattgggagcagaa

SEQ ID NO: 7871015 - DNA, 22 bp, Homo sapiens
ctggagcttattgggagcagaa

SEQ ID NO: 7871016 - DNA, 22 bp, Homo sapiens
ctggagctgttttttcaggaaa

SEQ ID NO: 7871017 - DNA, 22 bp, Homo sapiens
ctggagcttattgggagcagaa

SEQ ID NO: 7871018 - DNA, 22 bp, Homo sapiens
ctggagctgttttttcaggaaa

SEQ ID NO: 7871019 - DNA, 21 bp, Homo sapiens
ctggagcttggtgagaagtgt

SEQ ID NO: 7871020 - DNA, 21 bp, Homo sapiens
ctggagcttggtgagaagtgt

SEQ ID NO: 7871021 - DNA, 21 bp, Homo sapiens
ctggagcttggtgagaagtgt

SEQ ID NO: 7871022 - DNA, 22 bp, Homo sapiens
ctggaggaaaacaactgcagac

SEQ ID NO: 7871023 - DNA, 22 bp, Homo sapiens
ctggaggaaaacaactgcagac

SEQ ID NO: 7871024 - DNA, 22 bp, Homo sapiens
ctggagcttattgggagcagaa

SEQ ID NO: 7871025 - DNA, 22 bp, Homo sapiens
ctggagcttattgggagcagaa

SEQ ID NO: 7871026 - DNA, 21 bp, Homo sapiens
ctggagcttggtgagaagtgt

SEQ ID NO: 7871027 - DNA, 22 bp, Homo sapiens
ctggccagtgcctgtgggcccc

SEQ ID NO: 7871028 - DNA, 22 bp, Homo sapiens
ctggccagtgcctgtgggcccc

SEQ ID NO: 7871029 - DNA, 22 bp, Homo sapiens
ctggccagtgcctgtgggcccc

SEQ ID NO: 7871030 - DNA, 22 bp, Homo sapiens
ctggccagtgcctgtgggcccc

SEQ ID NO: 7871031 - DNA, 22 bp, Homo sapiens
ctggccaggttttgaacagttg

SEQ ID NO: 7871032 - DNA, 22 bp, Homo sapiens
ctggccagtgactgctcacccg

SEQ ID NO: 7871033 - DNA, 22 bp, Homo sapiens
ctggccaggttttgaacagttg

SEQ ID NO: 7871034 - DNA, 22 bp, Homo sapiens
ctggccagtgactgctcacccg

SEQ ID NO: 7871035 - DNA, 22 bp, Homo sapiens
ctggccagtgactgctcacccg

SEQ ID NO: 7871036 - DNA, 22 bp, Homo sapiens
ctggccagtgactgctcacccg

SEQ ID NO: 7871037 - DNA, 22 bp, Homo sapiens
ctggccagtgactgctcacccg

SEQ ID NO: 7871038 - DNA, 22 bp, Homo sapiens
ctggccagtgactgctcacccg

SEQ ID NO: 7871039 - DNA, 22 bp, Homo sapiens
ctggccagtgactgctcacccg

SEQ ID NO: 7871040 - DNA, 22 bp, Homo sapiens
ctggccagggtgcgatcgtggt

SEQ ID NO: 7871041 - DNA, 22 bp, Homo sapiens
ctggccagggtgcgatcgtggt

SEQ ID NO: 7871042 - DNA, 22 bp, Homo sapiens
ctggccagggtgcgatcgtggt

SEQ ID NO: 7871043 - DNA, 22 bp, Homo sapiens
ctggccagggtgcgatcgtggt

SEQ ID NO: 7871044 - DNA, 22 bp, Homo sapiens
ctggccagggtgcgatcgtggt

SEQ ID NO: 7871045 - DNA, 22 bp, Homo sapiens
ctggccaggttttgaacagttg

SEQ ID NO: 7871046 - DNA, 22 bp, Homo sapiens
ctggccaggttttgaacagttg

SEQ ID NO: 7871047 - DNA, 22 bp, Homo sapiens
ctggccaggcttgggacagaca

SEQ ID NO: 7871048 - DNA, 22 bp, Homo sapiens
ctggccaggcttgggacagaca

SEQ ID NO: 7871049 - DNA, 22 bp, Homo sapiens
ctggccagggtgcgatcgtggt

SEQ ID NO: 7871050 - DNA, 16 bp, Homo sapiens
ataattactgctactt

SEQ ID NO: 7871051 - DNA, 22 bp, Homo sapiens
ataattacattatactgttaga

SEQ ID NO: 7871052 - DNA, 22 bp, Homo sapiens
ataattatctcagacacttgtt

SEQ ID NO: 7871053 - DNA, 22 bp, Homo sapiens
ataattatctcagacacttgtt

SEQ ID NO: 7871054 - DNA, 22 bp, Homo sapiens
ataattatctcagacacttgtt

SEQ ID NO: 7871055 - DNA, 22 bp, Homo sapiens
ataattatctcagacacttgtt

SEQ ID NO: 7871056 - DNA, 22 bp, Homo sapiens
ataattaatttcagtaatctcc

SEQ ID NO: 7871057 - DNA, 22 bp, Homo sapiens
ataattacattatactgttaga

SEQ ID NO: 7871058 - DNA, 22 bp, Homo sapiens
ataattacattatactgttaga

SEQ ID NO: 7871059 - DNA, 20 bp, Homo sapiens
ataattacatagagattgcc

SEQ ID NO: 7871060 - DNA, 22 bp, Homo sapiens
ataattaatttcagtaatctcc

SEQ ID NO: 7871061 - DNA, 22 bp, Homo sapiens
ataatttaaattagtatgtgat

SEQ ID NO: 7871062 - DNA, 22 bp, Homo sapiens
ataattgtgggcagtgtgatat

SEQ ID NO: 7871063 - DNA, 22 bp, Homo sapiens
ataatttaaattagtatgtgat

SEQ ID NO: 7871064 - DNA, 22 bp, Homo sapiens
ataattctccaatttttgttgt

SEQ ID NO: 7871065 - DNA, 22 bp, Homo sapiens
ataattctccaatttttgttgt

SEQ ID NO: 7871066 - DNA, 22 bp, Homo sapiens
ataattgatgaggctttggaca

SEQ ID NO: 7871067 - DNA, 22 bp, Homo sapiens
ataattcatgggcctttcacct

SEQ ID NO: 7871068 - DNA, 20 bp, Homo sapiens
ataattatttacttttgtgc

SEQ ID NO: 7871069 - DNA, 20 bp, Homo sapiens
ataattatttacttttgtgc

SEQ ID NO: 7871070 - DNA, 22 bp, Homo sapiens
ataatgtgatatttcatttaca

SEQ ID NO: 7871071 - DNA, 22 bp, Homo sapiens
ataatgtgatatttcatttaca

SEQ ID NO: 7871072 - DNA, 22 bp, Homo sapiens
ataatgtgttcatcttacaatt

SEQ ID NO: 7871073 - DNA, 22 bp, Homo sapiens
ataatgtgttcatcttacaatt

SEQ ID NO: 7871074 - DNA, 22 bp, Homo sapiens
ataatgtgttcatcttacaatt

SEQ ID NO: 7871075 - DNA, 22 bp, Homo sapiens
ataatgttgatgattgtctttg

SEQ ID NO: 7871076 - DNA, 22 bp, Homo sapiens
ataatgttgatgattgtctttg

SEQ ID NO: 7871077 - DNA, 22 bp, Homo sapiens
ataatgtttttgtataagcatg

SEQ ID NO: 7871078 - DNA, 22 bp, Homo sapiens
ataatgtttgattgagcagata

SEQ ID NO: 7871079 - DNA, 22 bp, Homo sapiens
ataatgtttttgtataagcatg

SEQ ID NO: 7871080 - DNA, 22 bp, Homo sapiens
ataatgtttcagtactgtctgt

SEQ ID NO: 7871081 - DNA, 22 bp, Homo sapiens
ataatgtttcagtactgtctgt

SEQ ID NO: 7871082 - DNA, 22 bp, Homo sapiens
ataatcattcacataaggtgct

SEQ ID NO: 7871083 - DNA, 22 bp, Homo sapiens
ataatcagaattcatgaaagat

SEQ ID NO: 7871084 - DNA, 22 bp, Homo sapiens
ataatcattcacataaggtgct

SEQ ID NO: 7871085 - DNA, 22 bp, Homo sapiens
ctgcctggaaggagcaagggga

SEQ ID NO: 7871086 - DNA, 22 bp, Homo sapiens
ataatggtagatgtccacgcag

SEQ ID NO: 7871087 - DNA, 22 bp, Homo sapiens
ataatggtgaacaaaatgactc

SEQ ID NO: 7871088 - DNA, 22 bp, Homo sapiens
ataatcattttaattagtggtt

SEQ ID NO: 7871089 - DNA, 22 bp, Homo sapiens
ctgcctgcttttctgggagccg

SEQ ID NO: 7871090 - DNA, 21 bp, Homo sapiens
ataatgtacaaaaactgtctt

SEQ ID NO: 7871091 - DNA, 22 bp, Homo sapiens
ataatgtaggtatgtgtattta

SEQ ID NO: 7871092 - DNA, 21 bp, Homo sapiens
ataatgtacaaaaactgtctt

SEQ ID NO: 7871093 - DNA, 20 bp, Homo sapiens
ataatttaccctgcaccact

SEQ ID NO: 7871094 - DNA, 20 bp, Homo sapiens
ataatttaccctgcaccact

SEQ ID NO: 7871095 - DNA, 20 bp, Homo sapiens
ataatttaccctgcaccact

SEQ ID NO: 7871096 - DNA, 20 bp, Homo sapiens
ataatttaccctgcaccact

SEQ ID NO: 7871097 - DNA, 22 bp, Homo sapiens
ataatttacaactgcttttaat

SEQ ID NO: 7871098 - DNA, 22 bp, Homo sapiens
ataatttacaactgcttttaat

SEQ ID NO: 7871099 - DNA, 20 bp, Homo sapiens
ataatttaccctgcaccact

SEQ ID NO: 7871100 - DNA, 20 bp, Homo sapiens
atacacattcatagaaaaat

SEQ ID NO: 7871101 - DNA, 20 bp, Homo sapiens
atacacattcatagaaaaat

SEQ ID NO: 7871102 - DNA, 22 bp, Homo sapiens
atacactttagaaaaacgctgc

SEQ ID NO: 7871103 - DNA, 20 bp, Homo sapiens
atacacattcatagaaaaat

SEQ ID NO: 7871104 - DNA, 20 bp, Homo sapiens
atacacattcatagaaaaat

SEQ ID NO: 7871105 - DNA, 20 bp, Homo sapiens
atacacattcatagaaaaat

SEQ ID NO: 7871106 - DNA, 20 bp, Homo sapiens
atacacattcatagaaaaat

SEQ ID NO: 7871107 - DNA, 22 bp, Homo sapiens
ataatttaattttcacagtggt

SEQ ID NO: 7871108 - DNA, 22 bp, Homo sapiens
ataatttaattttcacagtggt

SEQ ID NO: 7871109 - DNA, 22 bp, Homo sapiens
ataatttacaactgcttttaat

SEQ ID NO: 7871110 - DNA, 22 bp, Homo sapiens
ataatttacaactgcttttaat

SEQ ID NO: 7871111 - DNA, 22 bp, Homo sapiens
ataatttacaactgcttttaat

SEQ ID NO: 7871112 - DNA, 22 bp, Homo sapiens
ataatttaaattagtatgtgat

SEQ ID NO: 7871113 - DNA, 22 bp, Homo sapiens
ataatttaattttcacagtggt

SEQ ID NO: 7871114 - DNA, 22 bp, Homo sapiens
ataatttaattttcacagtggt

SEQ ID NO: 7871115 - DNA, 22 bp, Homo sapiens
ataatttaattttcacagtggt

SEQ ID NO: 7871116 - DNA, 22 bp, Homo sapiens
atacagaaaagtggatagccag

SEQ ID NO: 7871117 - DNA, 22 bp, Homo sapiens
atacagaaaatgatgcagagtt

SEQ ID NO: 7871118 - DNA, 22 bp, Homo sapiens
atacagaaaatgatgcagagtt

SEQ ID NO: 7871119 - DNA, 22 bp, Homo sapiens
atacactttagaaaaacgctgc

SEQ ID NO: 7871120 - DNA, 22 bp, Homo sapiens
atacagaaaagtggatagccag

SEQ ID NO: 7871121 - DNA, 22 bp, Homo sapiens
atacagaaaagtggatagccag

SEQ ID NO: 7871122 - DNA, 22 bp, Homo sapiens
atacagaaaagtggatagccag

SEQ ID NO: 7871123 - DNA, 22 bp, Homo sapiens
atacagaaaagtggatagccag

SEQ ID NO: 7871124 - DNA, 22 bp, Homo sapiens
atacagaacaagcctcacctcc

SEQ ID NO: 7871125 - DNA, 22 bp, Homo sapiens
atacagaaaatgatgcagagtt

SEQ ID NO: 7871126 - DNA, 22 bp, Homo sapiens
atacagaaaatgatgcagagtt

SEQ ID NO: 7871127 - DNA, 22 bp, Homo sapiens
atacagaaaatgatgcagagtt

SEQ ID NO: 7871128 - DNA, 22 bp, Homo sapiens
atacagaagaactatagccact

SEQ ID NO: 7871129 - DNA, 22 bp, Homo sapiens
atacagaagaactatagccact

SEQ ID NO: 7871130 - DNA, 22 bp, Homo sapiens
atacagaagaactatagccact

SEQ ID NO: 7871131 - DNA, 22 bp, Homo sapiens
atacagaagaactatagccact

SEQ ID NO: 7871132 - DNA, 22 bp, Homo sapiens
atacagaagaactatagccact

SEQ ID NO: 7871133 - DNA, 22 bp, Homo sapiens
atacagaagaactatagccact

SEQ ID NO: 7871134 - DNA, 22 bp, Homo sapiens
atacagaactctcagttgtata

SEQ ID NO: 7871135 - DNA, 22 bp, Homo sapiens
atacagaactctcagttgtata

SEQ ID NO: 7871136 - DNA, 22 bp, Homo sapiens
atacagaactctcagttgtata

SEQ ID NO: 7871137 - DNA, 22 bp, Homo sapiens
atacagaactctcagttgtata

SEQ ID NO: 7871138 - DNA, 22 bp, Homo sapiens
atacagaactctcagttgtata

SEQ ID NO: 7871139 - DNA, 21 bp, Homo sapiens
atacagaacattgatccaaga

SEQ ID NO: 7871140 - DNA, 21 bp, Homo sapiens
atacagaacattgatccaaga

SEQ ID NO: 7871141 - DNA, 21 bp, Homo sapiens
atacagaacattgatccaaga

SEQ ID NO: 7871142 - DNA, 21 bp, Homo sapiens
atacagaacattgatccaaga

SEQ ID NO: 7871143 - DNA, 22 bp, Homo sapiens
ctggaaatcactactagtcaat

SEQ ID NO: 7871144 - DNA, 19 bp, Homo sapiens
ctggaaagttggcagtgag

SEQ ID NO: 7871145 - DNA, 19 bp, Homo sapiens
ctggaaagttggcagtgag

SEQ ID NO: 7871146 - DNA, 21 bp, Homo sapiens
atacagaaggtggcaaagtac

SEQ ID NO: 7871147 - DNA, 21 bp, Homo sapiens
atacagaaggtggcaaagtac

SEQ ID NO: 7871148 - DNA, 22 bp, Homo sapiens
ctggaaagttcaagataaagct

SEQ ID NO: 7871149 - DNA, 22 bp, Homo sapiens
ctggaaatcactactagtcaat

SEQ ID NO: 7871150 - DNA, 22 bp, Homo sapiens
ctggaaattggagatgatgttt

SEQ ID NO: 7871151 - DNA, 21 bp, Homo sapiens
ctggaacaaatactagcaaac

SEQ ID NO: 7871152 - DNA, 22 bp, Homo sapiens
ctggaaattggagatgatgttt

SEQ ID NO: 7871153 - DNA, 22 bp, Homo sapiens
ctggaacacctgagttaccact

SEQ ID NO: 7871154 - DNA, 22 bp, Homo sapiens
ctggaacaagtggccttgcaag

SEQ ID NO: 7871155 - DNA, 21 bp, Homo sapiens
ctggaacaaatactagcaaac

SEQ ID NO: 7871156 - DNA, 22 bp, Homo sapiens
atacagaagcctgtatttctgg

SEQ ID NO: 7871157 - DNA, 22 bp, Homo sapiens
atacagaagcctgtatttctgg

SEQ ID NO: 7871158 - DNA, 22 bp, Homo sapiens
atacagaagcctgtatttctgg

SEQ ID NO: 7871159 - DNA, 22 bp, Homo sapiens
atacagaagcctgtatttctgg

SEQ ID NO: 7871160 - DNA, 22 bp, Homo sapiens
atacagaagcctgtatttctgg

SEQ ID NO: 7871161 - DNA, 22 bp, Homo sapiens
atacagaagacccctccgtcat

SEQ ID NO: 7871162 - DNA, 22 bp, Homo sapiens
atacagaagacccctccgtcat

SEQ ID NO: 7871163 - DNA, 22 bp, Homo sapiens
atacagaagaactatagccact

SEQ ID NO: 7871164 - DNA, 21 bp, Homo sapiens
atacagaaggtggcaaagtac

SEQ ID NO: 7871165 - DNA, 21 bp, Homo sapiens
atacagaaggtggcaaagtac

SEQ ID NO: 7871166 - DNA, 21 bp, Homo sapiens
atacagaaggtggcaaagtac

SEQ ID NO: 7871167 - DNA, 21 bp, Homo sapiens
atacagaaggtggcaaagtac

SEQ ID NO: 7871168 - DNA, 21 bp, Homo sapiens
atacagaaggtggcaaagtac

SEQ ID NO: 7871169 - DNA, 22 bp, Homo sapiens
atacagaagcctgtatttctgg

SEQ ID NO: 7871170 - DNA, 22 bp, Homo sapiens
ctggaactcctggggagctggt

SEQ ID NO: 7871171 - DNA, 22 bp, Homo sapiens
ctggaacccaggcctggaagcc

SEQ ID NO: 7871172 - DNA, 22 bp, Homo sapiens
ctggaacccaggcctggaagcc

SEQ ID NO: 7871173 - DNA, 22 bp, Homo sapiens
ctggaacagtgttggagcttga

SEQ ID NO: 7871174 - DNA, 22 bp, Homo sapiens
ctggaacagaagcactggagag

SEQ ID NO: 7871175 - DNA, 22 bp, Homo sapiens
ctggaacagaagcactggagag

SEQ ID NO: 7871176 - DNA, 22 bp, Homo sapiens
ctggaacagaagcactggagag

SEQ ID NO: 7871177 - DNA, 22 bp, Homo sapiens
ctggaacacctgagttaccact

SEQ ID NO: 7871178 - DNA, 22 bp, Homo sapiens
ctggaacacctgagttaccact

SEQ ID NO: 7871179 - DNA, 22 bp, Homo sapiens
ctggaagaactccagttctgtg

SEQ ID NO: 7871180 - DNA, 22 bp, Homo sapiens
ctggaagaactccagttctgtg

SEQ ID NO: 7871181 - DNA, 22 bp, Homo sapiens
ctggaagaactccagttctgtg

SEQ ID NO: 7871182 - DNA, 21 bp, Homo sapiens
ctggaagaagcagcaggattc

SEQ ID NO: 7871183 - DNA, 22 bp, Homo sapiens
ctggaagaactccagttctgtg

SEQ ID NO: 7871184 - DNA, 22 bp, Homo sapiens
ctggaagaactccagttctgtg

SEQ ID NO: 7871185 - DNA, 22 bp, Homo sapiens
ctggaagaactccagttctgtg

SEQ ID NO: 7871186 - DNA, 22 bp, Homo sapiens
ctggaactcctggggagctggt

SEQ ID NO: 7871187 - DNA, 22 bp, Homo sapiens
ctggaagaactccagttctgtg

SEQ ID NO: 7871188 - DNA, 22 bp, Homo sapiens
ctggaagaactccagttctgtg

SEQ ID NO: 7871189 - DNA, 22 bp, Homo sapiens
ctggaagaactccagttctgtg

SEQ ID NO: 7871190 - DNA, 22 bp, Homo sapiens
atacatatatggtacttcctgg

SEQ ID NO: 7871191 - DNA, 22 bp, Homo sapiens
atacatatatggtacttcctgg

SEQ ID NO: 7871192 - DNA, 22 bp, Homo sapiens
ctggaagactcaatggcctgcc

SEQ ID NO: 7871193 - DNA, 22 bp, Homo sapiens
atacatatatggtacttcctgg

SEQ ID NO: 7871194 - DNA, 22 bp, Homo sapiens
atacatctatgcctttctgaca

SEQ ID NO: 7871195 - DNA, 22 bp, Homo sapiens
atacatatatggtacttcctgg

SEQ ID NO: 7871196 - DNA, 21 bp, Homo sapiens
ctggaagaagcagcaggattc

SEQ ID NO: 7871197 - DNA, 22 bp, Homo sapiens
ctggaagaccccccaggactca

SEQ ID NO: 7871198 - DNA, 22 bp, Homo sapiens
ctggaagaccccccaggactca

SEQ ID NO: 7871199 - DNA, 22 bp, Homo sapiens
ctggaagacgtttgaagccatg

SEQ ID NO: 7871200 - DNA, 22 bp, Homo sapiens
ctggaagacgtttgaagccatg

SEQ ID NO: 7871201 - DNA, 22 bp, Homo sapiens
ctggaagacgtttgaagccatg

SEQ ID NO: 7871202 - DNA, 22 bp, Homo sapiens
atacatgaggaggctggaaaca

SEQ ID NO: 7871203 - DNA, 22 bp, Homo sapiens
atacatgaggctcatttatgtc

SEQ ID NO: 7871204 - DNA, 22 bp, Homo sapiens
atacatgactcacacattctgc

SEQ ID NO: 7871205 - DNA, 22 bp, Homo sapiens
atacatgactcacacattctgc

SEQ ID NO: 7871206 - DNA, 22 bp, Homo sapiens
atacatgactcacacattctgc

SEQ ID NO: 7871207 - DNA, 22 bp, Homo sapiens
atacatgactcacacattctgc

SEQ ID NO: 7871208 - DNA, 22 bp, Homo sapiens
atacatgacagcatagcatcct

SEQ ID NO: 7871209 - DNA, 22 bp, Homo sapiens
atacatcttgtcagattcatgt

SEQ ID NO: 7871210 - DNA, 22 bp, Homo sapiens
atacatcttgtcagattcatgt

SEQ ID NO: 7871211 - DNA, 22 bp, Homo sapiens
atacatcttgtcagattcatgt

SEQ ID NO: 7871212 - DNA, 22 bp, Homo sapiens
atacatgacactgggctacagg

SEQ ID NO: 7871213 - DNA, 22 bp, Homo sapiens
atacatctcatgtaagagataa

SEQ ID NO: 7871214 - DNA, 22 bp, Homo sapiens
atacatctcatgtaagagataa

SEQ ID NO: 7871215 - DNA, 22 bp, Homo sapiens
atacatctctttgaagtgcttt

SEQ ID NO: 7871216 - DNA, 22 bp, Homo sapiens
atacatctggatgtatgcattt

SEQ ID NO: 7871217 - DNA, 22 bp, Homo sapiens
atacatctctttgaagtgcttt

SEQ ID NO: 7871218 - DNA, 22 bp, Homo sapiens
atacatcttccttttaaaatgc

SEQ ID NO: 7871219 - DNA, 22 bp, Homo sapiens
atacatcttccttttaaaatgc

SEQ ID NO: 7871220 - DNA, 22 bp, Homo sapiens
atacatctggatgtatgcattt

SEQ ID NO: 7871221 - DNA, 22 bp, Homo sapiens
atacatcttccttttaaaatgc

SEQ ID NO: 7871222 - DNA, 22 bp, Homo sapiens
atacatcttccttttaaaatgc

SEQ ID NO: 7871223 - DNA, 22 bp, Homo sapiens
atacatcttccttttaaaatgc

SEQ ID NO: 7871224 - DNA, 22 bp, Homo sapiens
atacatctggatgtatgcattt

SEQ ID NO: 7871225 - DNA, 22 bp, Homo sapiens
ctggagctggtatagggacaaa

SEQ ID NO: 7871226 - DNA, 22 bp, Homo sapiens
ctggagctggtatagggacaaa

SEQ ID NO: 7871227 - DNA, 22 bp, Homo sapiens
ctggagctggtatagggacaaa

SEQ ID NO: 7871228 - DNA, 22 bp, Homo sapiens
ctggagctggtatagggacaaa

SEQ ID NO: 7871229 - DNA, 22 bp, Homo sapiens
ctggagctggtatagggacaaa

SEQ ID NO: 7871230 - DNA, 22 bp, Homo sapiens
ctggagctggtatagggacaaa

SEQ ID NO: 7871231 - DNA, 22 bp, Homo sapiens
ctggagctgtcttcacaggcct

SEQ ID NO: 7871232 - DNA, 22 bp, Homo sapiens
ctggagctgtcttcacaggcct

SEQ ID NO: 7871233 - DNA, 22 bp, Homo sapiens
ctggagctggcttccttccact

SEQ ID NO: 7871234 - DNA, 22 bp, Homo sapiens
ctggagctggcttccttccact

SEQ ID NO: 7871235 - DNA, 22 bp, Homo sapiens
ctggagctggcttccttccact

SEQ ID NO: 7871236 - DNA, 22 bp, Homo sapiens
ctggagctggcccaggctggcc

SEQ ID NO: 7871237 - DNA, 22 bp, Homo sapiens
ctggagctgggctagggtagga

SEQ ID NO: 7871238 - DNA, 22 bp, Homo sapiens
ctggagctgggctagggtagga

SEQ ID NO: 7871239 - DNA, 22 bp, Homo sapiens
ctggagctggtatagggacaaa

SEQ ID NO: 7871240 - DNA, 22 bp, Homo sapiens
ctggagctgggctagggtagga

SEQ ID NO: 7871241 - DNA, 22 bp, Homo sapiens
ctggagctggtatagggacaaa

SEQ ID NO: 7871242 - DNA, 22 bp, Homo sapiens
ctggagctggcccaggctggcc

SEQ ID NO: 7871243 - DNA, 22 bp, Homo sapiens
ctggagctggcccaggctggcc

SEQ ID NO: 7871244 - DNA, 22 bp, Homo sapiens
ctggagctggcccaggctggcc

SEQ ID NO: 7871245 - DNA, 22 bp, Homo sapiens
ctggagctggcccaggctggcc

SEQ ID NO: 7871246 - DNA, 22 bp, Homo sapiens
ctggagctggcccaggctggcc

SEQ ID NO: 7871247 - DNA, 22 bp, Homo sapiens
ctggagctggcccaggctggcc

SEQ ID NO: 7871248 - DNA, 22 bp, Homo sapiens
ctggagctgctgtccttgggtg

SEQ ID NO: 7871249 - DNA, 22 bp, Homo sapiens
ctggagctgccagggctgccgc

SEQ ID NO: 7871250 - DNA, 22 bp, Homo sapiens
ctggagctgctgtccttgggtg

SEQ ID NO: 7871251 - DNA, 22 bp, Homo sapiens
ctggagctgccagacgggcaca

SEQ ID NO: 7871252 - DNA, 22 bp, Homo sapiens
ctggagctgccagggctgccgc

SEQ ID NO: 7871253 - DNA, 22 bp, Homo sapiens
ctggagctgccagacgggcaca

SEQ ID NO: 7871254 - DNA, 22 bp, Homo sapiens
atacatgatcactgtattataa

SEQ ID NO: 7871255 - DNA, 18 bp, Homo sapiens
ctgccccttctctgagat

SEQ ID NO: 7871256 - DNA, 18 bp, Homo sapiens
ctgccccttctctgagat

SEQ ID NO: 7871257 - DNA, 18 bp, Homo sapiens
ctgcccagagcatttcat

SEQ ID NO: 7871258 - DNA, 18 bp, Homo sapiens
ctgccccttctctgagat

SEQ ID NO: 7871259 - DNA, 22 bp, Homo sapiens
ctgcccagattttaccacctgc

SEQ ID NO: 7871260 - DNA, 18 bp, Homo sapiens
ctgccccttctctgagat

SEQ ID NO: 7871261 - DNA, 22 bp, Homo sapiens
ctgccctcccagttggtccgtg

SEQ ID NO: 7871262 - DNA, 21 bp, Homo sapiens
ctgccctagatggctctggaa

SEQ ID NO: 7871263 - DNA, 22 bp, Homo sapiens
ctgcccgtccctttgctctcgc

SEQ ID NO: 7871264 - DNA, 21 bp, Homo sapiens
ctgccctagatggctctggaa

SEQ ID NO: 7871265 - DNA, 22 bp, Homo sapiens
ctgcccgctgctagagaggccg

SEQ ID NO: 7871266 - DNA, 22 bp, Homo sapiens
ctgcccgcaccatccccgggct

SEQ ID NO: 7871267 - DNA, 22 bp, Homo sapiens
ctgcccgctgctagagaggccg

SEQ ID NO: 7871268 - DNA, 22 bp, Homo sapiens
ctgcccgtccctttgctctcgc

SEQ ID NO: 7871269 - DNA, 22 bp, Homo sapiens
ctgcccgtccctttgctctcgc

SEQ ID NO: 7871270 - DNA, 22 bp, Homo sapiens
ctgcccggagctggcaaaggct

SEQ ID NO: 7871271 - DNA, 22 bp, Homo sapiens
ctgccctcgggccctcccatag

SEQ ID NO: 7871272 - DNA, 22 bp, Homo sapiens
ctgccctcgggccctcccatag

SEQ ID NO: 7871273 - DNA, 22 bp, Homo sapiens
ctgccctcgggccctcccatag

SEQ ID NO: 7871274 - DNA, 22 bp, Homo sapiens
ctgccctcccagttggtccgtg

SEQ ID NO: 7871275 - DNA, 22 bp, Homo sapiens
ctgccctcgggccctcccatag

SEQ ID NO: 7871276 - DNA, 22 bp, Homo sapiens
ctgccctcgggccctcccatag

SEQ ID NO: 7871277 - DNA, 22 bp, Homo sapiens
ctgccctcgggccctcccatag

SEQ ID NO: 7871278 - DNA, 22 bp, Homo sapiens
ctgccctctagaggaggactga

SEQ ID NO: 7871279 - DNA, 22 bp, Homo sapiens
ctgccctctagggatgcactgg

SEQ ID NO: 7871280 - DNA, 22 bp, Homo sapiens
ctgccctctagggatgcactgg

SEQ ID NO: 7871281 - DNA, 22 bp, Homo sapiens
ctgccctctagggatgcactgg

SEQ ID NO: 7871282 - DNA, 22 bp, Homo sapiens
ctgccctctagggatgcactgg

SEQ ID NO: 7871283 - DNA, 22 bp, Homo sapiens
ctgccctctagaggaggactga

SEQ ID NO: 7871284 - DNA, 22 bp, Homo sapiens
ctgccctctagaggaggactga

SEQ ID NO: 7871285 - DNA, 22 bp, Homo sapiens
ctgccctctagaggaggactga

SEQ ID NO: 7871286 - DNA, 22 bp, Homo sapiens
ctgccctctagaggaggactga

SEQ ID NO: 7871287 - DNA, 22 bp, Homo sapiens
ctgccctctagaggaggactga

SEQ ID NO: 7871288 - DNA, 22 bp, Homo sapiens
ctgccctctagaggaggactga

SEQ ID NO: 7871289 - DNA, 22 bp, Homo sapiens
ctgccctgacctgcctcagagt

SEQ ID NO: 7871290 - DNA, 22 bp, Homo sapiens
ctgccctctagggatgcactgg

SEQ ID NO: 7871291 - DNA, 22 bp, Homo sapiens
ctgccctgacctgcctcagagt

SEQ ID NO: 7871292 - DNA, 22 bp, Homo sapiens
ctgccctgacctgcctcagagt

SEQ ID NO: 7871293 - DNA, 22 bp, Homo sapiens
ctgccctgacctgcctcagagt

SEQ ID NO: 7871294 - DNA, 22 bp, Homo sapiens
ctgccctctagggatgcactgg

SEQ ID NO: 7871295 - DNA, 22 bp, Homo sapiens
ctgccctctagggatgcactgg

SEQ ID NO: 7871296 - DNA, 22 bp, Homo sapiens
ctgccctctagggatgcactgg

SEQ ID NO: 7871297 - DNA, 22 bp, Homo sapiens
ctgccctctagggatgcactgg

SEQ ID NO: 7871298 - DNA, 22 bp, Homo sapiens
ctgccctggtcccatggctgat

SEQ ID NO: 7871299 - DNA, 22 bp, Homo sapiens
ctgccctgtagctgttctagca

SEQ ID NO: 7871300 - DNA, 22 bp, Homo sapiens
ctgccctggtcccatggctgat

SEQ ID NO: 7871301 - DNA, 22 bp, Homo sapiens
ctgccctggtcccatggctgat

SEQ ID NO: 7871302 - DNA, 22 bp, Homo sapiens
ctgccctggtcccatggctgat

SEQ ID NO: 7871303 - DNA, 22 bp, Homo sapiens
ctgccctgacctgcctcagagt

SEQ ID NO: 7871304 - DNA, 22 bp, Homo sapiens
ctgccctgacctgcctcagagt

SEQ ID NO: 7871305 - DNA, 22 bp, Homo sapiens
ctgccctgactgaccttttgaa

SEQ ID NO: 7871306 - DNA, 22 bp, Homo sapiens
ctgccctgacctgcctcagagt

SEQ ID NO: 7871307 - DNA, 21 bp, Homo sapiens
agttttctgagttataaaata

SEQ ID NO: 7871308 - DNA, 21 bp, Homo sapiens
agttttctgagttataaaata

SEQ ID NO: 7871309 - DNA, 22 bp, Homo sapiens
agttttctgatgtgtagtgaga

SEQ ID NO: 7871310 - DNA, 22 bp, Homo sapiens
agttttctgatgtgtagtgaga

SEQ ID NO: 7871311 - DNA, 22 bp, Homo sapiens
agttttctgggatcactggaat

SEQ ID NO: 7871312 - DNA, 22 bp, Homo sapiens
agttttctgttctacaatttga

SEQ ID NO: 7871313 - DNA, 22 bp, Homo sapiens
agttttctgggatcactggaat

SEQ ID NO: 7871314 - DNA, 22 bp, Homo sapiens
agttttctgctaaaccagctaa

SEQ ID NO: 7871315 - DNA, 22 bp, Homo sapiens
agttttctgttctacaatttga

SEQ ID NO: 7871316 - DNA, 22 bp, Homo sapiens
agttttctgttctacaatttga

SEQ ID NO: 7871317 - DNA, 22 bp, Homo sapiens
agttttcttcattttgtggcca

SEQ ID NO: 7871318 - DNA, 22 bp, Homo sapiens
agttttctttcgcaaaggtaca

SEQ ID NO: 7871319 - DNA, 22 bp, Homo sapiens
agttttgaaatgaaatgtagtt

SEQ ID NO: 7871320 - DNA, 22 bp, Homo sapiens
agttttctttcgcaaaggtaca

SEQ ID NO: 7871321 - DNA, 22 bp, Homo sapiens
agttttctttcgcaaaggtaca

SEQ ID NO: 7871322 - DNA, 22 bp, Homo sapiens
agttttctttcatctatcagca

SEQ ID NO: 7871323 - DNA, 22 bp, Homo sapiens
agttttctcacatcaaaaatga

SEQ ID NO: 7871324 - DNA, 22 bp, Homo sapiens
agttttctcacatcaaaaatga

SEQ ID NO: 7871325 - DNA, 21 bp, Homo sapiens
agttttctgagttataaaata

SEQ ID NO: 7871326 - DNA, 22 bp, Homo sapiens
agttttcctctcatttatcaat

SEQ ID NO: 7871327 - DNA, 22 bp, Homo sapiens
agttttcctctcatttatcaat

SEQ ID NO: 7871328 - DNA, 22 bp, Homo sapiens
agttttcctctcatttatcaat

SEQ ID NO: 7871329 - DNA, 22 bp, Homo sapiens
agttttcctctcatttatcaat

SEQ ID NO: 7871330 - DNA, 22 bp, Homo sapiens
agttttcctggtcacagcttgg

SEQ ID NO: 7871331 - DNA, 22 bp, Homo sapiens
agttttcctctcatttatcaat

SEQ ID NO: 7871332 - DNA, 22 bp, Homo sapiens
agttttctcacatcaaaaatga

SEQ ID NO: 7871333 - DNA, 22 bp, Homo sapiens
agttttctcacatcaaaaatga

SEQ ID NO: 7871334 - DNA, 22 bp, Homo sapiens
agttttcagtaaatattagtga

SEQ ID NO: 7871335 - DNA, 22 bp, Homo sapiens
agttttcagtaaatattagtga

SEQ ID NO: 7871336 - DNA, 22 bp, Homo sapiens
agttttcagtaaatattagtga

SEQ ID NO: 7871337 - DNA, 22 bp, Homo sapiens
agttttcagtaaatattagtga

SEQ ID NO: 7871338 - DNA, 22 bp, Homo sapiens
agttttcagggtttctgtcctc

SEQ ID NO: 7871339 - DNA, 22 bp, Homo sapiens
agttttcacactcaccaaaagg

SEQ ID NO: 7871340 - DNA, 22 bp, Homo sapiens
ataataaaccaggatgggtctg

SEQ ID NO: 7871341 - DNA, 22 bp, Homo sapiens
ataataacaatgccagatgcct

SEQ ID NO: 7871342 - DNA, 22 bp, Homo sapiens
ataataaaccaggatgggtctg

SEQ ID NO: 7871343 - DNA, 22 bp, Homo sapiens
ataataaaccaggatgggtctg

SEQ ID NO: 7871344 - DNA, 22 bp, Homo sapiens
ataataaaccaggatgggtctg

SEQ ID NO: 7871345 - DNA, 22 bp, Homo sapiens
ataataactcctgttgaagaac

SEQ ID NO: 7871346 - DNA, 22 bp, Homo sapiens
ataataacacctgaataggaaa

SEQ ID NO: 7871347 - DNA, 22 bp, Homo sapiens
ataataacacctgaataggaaa

SEQ ID NO: 7871348 - DNA, 23 bp, Homo sapiens
ataataacgtctgtcttgtctct

SEQ ID NO: 7871349 - DNA, 22 bp, Homo sapiens
ataatacatggttaacctcttt

SEQ ID NO: 7871350 - DNA, 22 bp, Homo sapiens
ctgcctgctctatccaggcctg

SEQ ID NO: 7871351 - DNA, 18 bp, Homo sapiens
ctgcctgctctccagctt

SEQ ID NO: 7871352 - DNA, 18 bp, Homo sapiens
ctgcctgctctccagctt

SEQ ID NO: 7871353 - DNA, 18 bp, Homo sapiens
ctgcctgctctccagctt

SEQ ID NO: 7871354 - DNA, 18 bp, Homo sapiens
ctgcctgctctccagctt

SEQ ID NO: 7871355 - DNA, 23 bp, Homo sapiens
ataataattatggcagcaaagtg

SEQ ID NO: 7871356 - DNA, 23 bp, Homo sapiens
ataataattatggcagcaaagtg

SEQ ID NO: 7871357 - DNA, 22 bp, Homo sapiens
ataataatgaaagccactgtgt

SEQ ID NO: 7871358 - DNA, 23 bp, Homo sapiens
ataataattatggcagcaaagtg

SEQ ID NO: 7871359 - DNA, 22 bp, Homo sapiens
ataataatgaaagccactgtgt

SEQ ID NO: 7871360 - DNA, 22 bp, Homo sapiens
ctgcctgcttctgagccagagg

SEQ ID NO: 7871361 - DNA, 22 bp, Homo sapiens
ctgcctgcttttctgggagccg

SEQ ID NO: 7871362 - DNA, 22 bp, Homo sapiens
ctgcctgcttttctgggagccg

SEQ ID NO: 7871363 - DNA, 22 bp, Homo sapiens
ctgcctgcttctgagccagagg

SEQ ID NO: 7871364 - DNA, 22 bp, Homo sapiens
ctgcctgcttctgagccagagg

SEQ ID NO: 7871365 - DNA, 22 bp, Homo sapiens
ctgcctgcttaccatgcatcag

SEQ ID NO: 7871366 - DNA, 23 bp, Homo sapiens
ctgcctgctggggagacagatct

SEQ ID NO: 7871367 - DNA, 23 bp, Homo sapiens
ctgcctgctggggagacagatct

SEQ ID NO: 7871368 - DNA, 22 bp, Homo sapiens
ctgcctgcttaccatgcatcag

SEQ ID NO: 7871369 - DNA, 23 bp, Homo sapiens
ctgcctgctggggagacagatct

SEQ ID NO: 7871370 - DNA, 22 bp, Homo sapiens
ctgcctgctgccctccagagcc

SEQ ID NO: 7871371 - DNA, 22 bp, Homo sapiens
ctgcctgctgccctccagagcc

SEQ ID NO: 7871372 - DNA, 22 bp, Homo sapiens
ctgcctgctgccctccagagcc

SEQ ID NO: 7871373 - DNA, 22 bp, Homo sapiens
ctgcctgctgcctgtggagggt

SEQ ID NO: 7871374 - DNA, 22 bp, Homo sapiens
ctgcctgctgattagtattgtc

SEQ ID NO: 7871375 - DNA, 22 bp, Homo sapiens
ctgcctgctgattagtattgtc

SEQ ID NO: 7871376 - DNA, 18 bp, Homo sapiens
ctgcctgctctccagctt

SEQ ID NO: 7871377 - DNA, 18 bp, Homo sapiens
ctgcctgctctccagctt

SEQ ID NO: 7871378 - DNA, 22 bp, Homo sapiens
ataagcctgattcacttgtcat

SEQ ID NO: 7871379 - DNA, 22 bp, Homo sapiens
ctgccctgtttggacagcccgg

SEQ ID NO: 7871380 - DNA, 23 bp, Homo sapiens
ataagccttttctttctgcccca

SEQ ID NO: 7871381 - DNA, 22 bp, Homo sapiens
ataagtgagaacaaaaattaga

SEQ ID NO: 7871382 - DNA, 22 bp, Homo sapiens
ataagtgactgcagggaattca

SEQ ID NO: 7871383 - DNA, 22 bp, Homo sapiens
ataagtgatatttagctataga

SEQ ID NO: 7871384 - DNA, 22 bp, Homo sapiens
ctgccctgtggttgtgggttct

SEQ ID NO: 7871385 - DNA, 22 bp, Homo sapiens
ctgccctgtggttgtgggttct

SEQ ID NO: 7871386 - DNA, 22 bp, Homo sapiens
ctgccctgtttggacagcccgg

SEQ ID NO: 7871387 - DNA, 22 bp, Homo sapiens
ataataaaccaggatgggtctg

SEQ ID NO: 7871388 - DNA, 22 bp, Homo sapiens
ataataaaccaggatgggtctg

SEQ ID NO: 7871389 - DNA, 19 bp, Homo sapiens
ataagttcaactggaccca

SEQ ID NO: 7871390 - DNA, 22 bp, Homo sapiens
ataagtgcttgttgaataatag

SEQ ID NO: 7871391 - DNA, 22 bp, Homo sapiens
ataagtgctgtgctttaagact

SEQ ID NO: 7871392 - DNA, 22 bp, Homo sapiens
ataagtgtgtaaggcattctgt

SEQ ID NO: 7871393 - DNA, 22 bp, Homo sapiens
ctgccctgtggctctgagtcat

SEQ ID NO: 7871394 - DNA, 22 bp, Homo sapiens
ctgccctgtgcacaggaaactg

SEQ ID NO: 7871395 - DNA, 22 bp, Homo sapiens
ctgccctgtgcacaggaaactg

SEQ ID NO: 7871396 - DNA, 22 bp, Homo sapiens
ctgccctgtggctctgagtcat

SEQ ID NO: 7871397 - DNA, 22 bp, Homo sapiens
ctgccctgtggctctgagtcat

SEQ ID NO: 7871398 - DNA, 22 bp, Homo sapiens
ctgccctgtgagggtccttggg

SEQ ID NO: 7871399 - DNA, 22 bp, Homo sapiens
ctgccctgtgagggtccttggg

SEQ ID NO: 7871400 - DNA, 22 bp, Homo sapiens
ctgccctgtgagggtccttggg

SEQ ID NO: 7871401 - DNA, 22 bp, Homo sapiens
ctgccctgtgagggtccttggg

SEQ ID NO: 7871402 - DNA, 22 bp, Homo sapiens
ctgccctgtgagggtccttggg

SEQ ID NO: 7871403 - DNA, 22 bp, Homo sapiens
ctgccctgtctgcagcctggct

SEQ ID NO: 7871404 - DNA, 22 bp, Homo sapiens
ctgccctgtctttttctgatga

SEQ ID NO: 7871405 - DNA, 22 bp, Homo sapiens
ctgccctgtctttttctgatga

SEQ ID NO: 7871406 - DNA, 22 bp, Homo sapiens
ctgccctgtctgcagcctggct

SEQ ID NO: 7871407 - DNA, 22 bp, Homo sapiens
ctgccctgtctgcagcctggct

SEQ ID NO: 7871408 - DNA, 22 bp, Homo sapiens
ctgccctgtctgcagcctggct

SEQ ID NO: 7871409 - DNA, 22 bp, Homo sapiens
ctgccctgtctgcagcctggct

SEQ ID NO: 7871410 - DNA, 22 bp, Homo sapiens
ctgccctgtagctgttctagca

SEQ ID NO: 7871411 - DNA, 22 bp, Homo sapiens
ctgccctgtagctgttctagca

SEQ ID NO: 7871412 - DNA, 22 bp, Homo sapiens
ctgccctgtagctgttctagca

SEQ ID NO: 7871413 - DNA, 22 bp, Homo sapiens
ctgccctgtatcttctcccaat

SEQ ID NO: 7871414 - DNA, 22 bp, Homo sapiens
ctgccctgtatcttctcccaat

SEQ ID NO: 7871415 - DNA, 22 bp, Homo sapiens
ctgccctgtatcttctcccaat

SEQ ID NO: 7871416 - DNA, 22 bp, Homo sapiens
ctgccctgtatcttctcccaat

SEQ ID NO: 7871417 - DNA, 22 bp, Homo sapiens
ctgccctgtccttcccgccggc

SEQ ID NO: 7871418 - DNA, 22 bp, Homo sapiens
ctgccctgtccttcccgccggc

SEQ ID NO: 7871419 - DNA, 22 bp, Homo sapiens
agtttcttattcttagttatgt

SEQ ID NO: 7871420 - DNA, 22 bp, Homo sapiens
agtttcttattcttagttatgt

SEQ ID NO: 7871421 - DNA, 22 bp, Homo sapiens
agtttcttcatccaaaaaatgg

SEQ ID NO: 7871422 - DNA, 22 bp, Homo sapiens
agtttctctttgacaccaaaat

SEQ ID NO: 7871423 - DNA, 22 bp, Homo sapiens
agtttctctttgacaccaaaat

SEQ ID NO: 7871424 - DNA, 22 bp, Homo sapiens
agtttctcttaatctagtatct

SEQ ID NO: 7871425 - DNA, 22 bp, Homo sapiens
agtttctgttaccatatttgac

SEQ ID NO: 7871426 - DNA, 22 bp, Homo sapiens
agtttctctttgacaccaaaat

SEQ ID NO: 7871427 - DNA, 22 bp, Homo sapiens
agtttcttgaagactgatgttt

SEQ ID NO: 7871428 - DNA, 22 bp, Homo sapiens
agtttcttgaagactgatgttt

SEQ ID NO: 7871429 - DNA, 22 bp, Homo sapiens
agtttcttggtcacagttttca

SEQ ID NO: 7871430 - DNA, 22 bp, Homo sapiens
ctgagtctgtacgttagccata

SEQ ID NO: 7871431 - DNA, 22 bp, Homo sapiens
ctgagtctcccggcagtggagg

SEQ ID NO: 7871432 - DNA, 22 bp, Homo sapiens
agtttctttagatagaaagttc

SEQ ID NO: 7871433 - DNA, 22 bp, Homo sapiens
agtttcagaatttatgcagaca

SEQ ID NO: 7871434 - DNA, 22 bp, Homo sapiens
agtttcactaaggtctgtgtgt

SEQ ID NO: 7871435 - DNA, 22 bp, Homo sapiens
agtttcactaaggtctgtgtgt

SEQ ID NO: 7871436 - DNA, 22 bp, Homo sapiens
agtttcagtgttgacagatggt

SEQ ID NO: 7871437 - DNA, 22 bp, Homo sapiens
agtttcatattaccatgtcacc

SEQ ID NO: 7871438 - DNA, 22 bp, Homo sapiens
agtttcatccgatctggtctca

SEQ ID NO: 7871439 - DNA, 22 bp, Homo sapiens
agtttctagcaaggattgttga

SEQ ID NO: 7871440 - DNA, 22 bp, Homo sapiens
agtttcatgagacagattttca

SEQ ID NO: 7871441 - DNA, 22 bp, Homo sapiens
agtttcatgagacagattttca

SEQ ID NO: 7871442 - DNA, 22 bp, Homo sapiens
agtttcatgagacagattttca

SEQ ID NO: 7871443 - DNA, 22 bp, Homo sapiens
agtttctagcctcactgtttag

SEQ ID NO: 7871444 - DNA, 22 bp, Homo sapiens
agtttctcttaatctagtatct

SEQ ID NO: 7871445 - DNA, 22 bp, Homo sapiens
agtttctcttaatctagtatct

SEQ ID NO: 7871446 - DNA, 22 bp, Homo sapiens
agtttctcttaatctagtatct

SEQ ID NO: 7871447 - DNA, 22 bp, Homo sapiens
agtttctctcagtatagaatag

SEQ ID NO: 7871448 - DNA, 22 bp, Homo sapiens
agtttctctcagtatagaatag

SEQ ID NO: 7871449 - DNA, 22 bp, Homo sapiens
agtttctctagagtctttgaaa

SEQ ID NO: 7871450 - DNA, 22 bp, Homo sapiens
agtttctctagagtctttgaaa

SEQ ID NO: 7871451 - DNA, 22 bp, Homo sapiens
ctgataatgtcctgcagtaaat

SEQ ID NO: 7871452 - DNA, 21 bp, Homo sapiens
ctgataattgttaaattattt

SEQ ID NO: 7871453 - DNA, 21 bp, Homo sapiens
ctgataattgttaaattattt

SEQ ID NO: 7871454 - DNA, 22 bp, Homo sapiens
ctgagttctaggctgccacctt

SEQ ID NO: 7871455 - DNA, 22 bp, Homo sapiens
ctgagtgttttcagccacggcc

SEQ ID NO: 7871456 - DNA, 22 bp, Homo sapiens
ctgagttctgcccaaggtctgg

SEQ ID NO: 7871457 - DNA, 22 bp, Homo sapiens
ctgagttctgcccaaggtctgg

SEQ ID NO: 7871458 - DNA, 22 bp, Homo sapiens
ctgagtggaacataggatgata

SEQ ID NO: 7871459 - DNA, 22 bp, Homo sapiens
ctgagtgggtttctgcttgtca

SEQ ID NO: 7871460 - DNA, 22 bp, Homo sapiens
ctgagtggaacataggatgata

SEQ ID NO: 7871461 - DNA, 22 bp, Homo sapiens
ctgagtgaggggagcttgatgg

SEQ ID NO: 7871462 - DNA, 22 bp, Homo sapiens
ctgagtgatagcgatggggaac

SEQ ID NO: 7871463 - DNA, 22 bp, Homo sapiens
ctgataggttattttcagtgag

SEQ ID NO: 7871464 - DNA, 22 bp, Homo sapiens
ctgatagacaatcaccatggga

SEQ ID NO: 7871465 - DNA, 22 bp, Homo sapiens
ctgataggatttagtttctgtt

SEQ ID NO: 7871466 - DNA, 18 bp, Homo sapiens
ctgataggggtggcagct

SEQ ID NO: 7871467 - DNA, 22 bp, Homo sapiens
ctgatacatagtagcatgtcat

SEQ ID NO: 7871468 - DNA, 22 bp, Homo sapiens
ctgatagacaatcaccatggga

SEQ ID NO: 7871469 - DNA, 22 bp, Homo sapiens
ctgatacaatgctaataaattt

SEQ ID NO: 7871470 - DNA, 22 bp, Homo sapiens
ctgataatgtcctgcagtaaat

SEQ ID NO: 7871471 - DNA, 22 bp, Homo sapiens
agttttattccaatgtgcagca

SEQ ID NO: 7871472 - DNA, 22 bp, Homo sapiens
agttttattaaatccacagaag

SEQ ID NO: 7871473 - DNA, 22 bp, Homo sapiens
ctgatattcttgaaatcatggt

SEQ ID NO: 7871474 - DNA, 22 bp, Homo sapiens
ctgatatttctcttaacactag

SEQ ID NO: 7871475 - DNA, 22 bp, Homo sapiens
ctgatattctttgagctgctaa

SEQ ID NO: 7871476 - DNA, 22 bp, Homo sapiens
ctgatatttctcttaacactag

SEQ ID NO: 7871477 - DNA, 22 bp, Homo sapiens
ctgatattcattatggagctcc

SEQ ID NO: 7871478 - DNA, 22 bp, Homo sapiens
ctgatattaacaggcaagtgag

SEQ ID NO: 7871479 - DNA, 22 bp, Homo sapiens
ctgatattattgaagctggagt

SEQ ID NO: 7871480 - DNA, 22 bp, Homo sapiens
agtttgtatgccaacagcaaag

SEQ ID NO: 7871481 - DNA, 22 bp, Homo sapiens
agtttatttttgataagtcttg

SEQ ID NO: 7871482 - DNA, 22 bp, Homo sapiens
agtttatttttgataagtcttg

SEQ ID NO: 7871483 - DNA, 22 bp, Homo sapiens
agtttatttttgataagtcttg

SEQ ID NO: 7871484 - DNA, 22 bp, Homo sapiens
agtttatttttgataagtcttg

SEQ ID NO: 7871485 - DNA, 22 bp, Homo sapiens
agtttatttttgataagtcttg

SEQ ID NO: 7871486 - DNA, 22 bp, Homo sapiens
agtttcaaattactgcccatgg

SEQ ID NO: 7871487 - DNA, 22 bp, Homo sapiens
agtttcaattcttttcacaaag

SEQ ID NO: 7871488 - DNA, 22 bp, Homo sapiens
agtttcacacaacatttgcatg

SEQ ID NO: 7871489 - DNA, 22 bp, Homo sapiens
agtttatttttgataagtcttg

SEQ ID NO: 7871490 - DNA, 22 bp, Homo sapiens
agtttatttctccatttaccta

SEQ ID NO: 7871491 - DNA, 22 bp, Homo sapiens
agtttatttctccatttaccta

SEQ ID NO: 7871492 - DNA, 22 bp, Homo sapiens
agtttatttctccatttaccta

SEQ ID NO: 7871493 - DNA, 22 bp, Homo sapiens
agtttatttctccatttaccta

SEQ ID NO: 7871494 - DNA, 22 bp, Homo sapiens
agtttatttctccatttaccta

SEQ ID NO: 7871495 - DNA, 22 bp, Homo sapiens
agtttatttctccatttaccta

SEQ ID NO: 7871496 - DNA, 22 bp, Homo sapiens
agtttatttctccatttaccta

SEQ ID NO: 7871497 - DNA, 22 bp, Homo sapiens
agtttatttctccatttaccta

SEQ ID NO: 7871498 - DNA, 17 bp, Homo sapiens
agtttatttagccttct

SEQ ID NO: 7871499 - DNA, 17 bp, Homo sapiens
agtttatttagccttct

SEQ ID NO: 7871500 - DNA, 17 bp, Homo sapiens
agtttatttagccttct

SEQ ID NO: 7871501 - DNA, 17 bp, Homo sapiens
agtttatttagccttct

SEQ ID NO: 7871502 - DNA, 22 bp, Homo sapiens
agtttattctgcttggccctcc

SEQ ID NO: 7871503 - DNA, 22 bp, Homo sapiens
agtttattctgcttggccctcc

SEQ ID NO: 7871504 - DNA, 22 bp, Homo sapiens
agtttattctgcttggccctcc

SEQ ID NO: 7871505 - DNA, 22 bp, Homo sapiens
agtttattctgcttggccctcc

SEQ ID NO: 7871506 - DNA, 22 bp, Homo sapiens
agtttattctctggtcttagta

SEQ ID NO: 7871507 - DNA, 22 bp, Homo sapiens
agtttattctctggtcttagta

SEQ ID NO: 7871508 - DNA, 22 bp, Homo sapiens
agtttattctctggtcttagta

SEQ ID NO: 7871509 - DNA, 22 bp, Homo sapiens
agtttattctctggtcttagta

SEQ ID NO: 7871510 - DNA, 22 bp, Homo sapiens
agtttattctctggtcttagta

SEQ ID NO: 7871511 - DNA, 22 bp, Homo sapiens
agtttattctctggtcttagta

SEQ ID NO: 7871512 - DNA, 20 bp, Homo sapiens
agtttattccaggagaactg

SEQ ID NO: 7871513 - DNA, 20 bp, Homo sapiens
agtttattccaggagaactg

SEQ ID NO: 7871514 - DNA, 20 bp, Homo sapiens
agtttattccaggagaactg

SEQ ID NO: 7871515 - DNA, 20 bp, Homo sapiens
agtttattccaggagaactg

SEQ ID NO: 7871516 - DNA, 20 bp, Homo sapiens
agtttattccaggagaactg

SEQ ID NO: 7871517 - DNA, 20 bp, Homo sapiens
agtttattccaggagaactg

SEQ ID NO: 7871518 - DNA, 20 bp, Homo sapiens
agtttattccaggagaactg

SEQ ID NO: 7871519 - DNA, 22 bp, Homo sapiens
agtttattgtatatggtagttt

SEQ ID NO: 7871520 - DNA, 22 bp, Homo sapiens
agtttattgtatatggtagttt

SEQ ID NO: 7871521 - DNA, 22 bp, Homo sapiens
agtttattgtatatggtagttt

SEQ ID NO: 7871522 - DNA, 22 bp, Homo sapiens
agtttattctgcttggccctcc

SEQ ID NO: 7871523 - DNA, 22 bp, Homo sapiens
agtttattctgcttggccctcc

SEQ ID NO: 7871524 - DNA, 17 bp, Homo sapiens
agtttatttagccttct

SEQ ID NO: 7871525 - DNA, 17 bp, Homo sapiens
agtttatttagccttct

SEQ ID NO: 7871526 - DNA, 17 bp, Homo sapiens
agtttatttagccttct

SEQ ID NO: 7871527 - DNA, 17 bp, Homo sapiens
agtttatttagccttct

SEQ ID NO: 7871528 - DNA, 22 bp, Homo sapiens
agtttattgtatatggtagttt

SEQ ID NO: 7871529 - DNA, 22 bp, Homo sapiens
agtttattgtatatggtagttt

SEQ ID NO: 7871530 - DNA, 22 bp, Homo sapiens
agtttattgtatatggtagttt

SEQ ID NO: 7871531 - DNA, 22 bp, Homo sapiens
agtgttactggttcatgaatct

SEQ ID NO: 7871532 - DNA, 23 bp, Homo sapiens
agtgttagtagttgtcttatgct

SEQ ID NO: 7871533 - DNA, 22 bp, Homo sapiens
agtgttagtggctgcagctggt

SEQ ID NO: 7871534 - DNA, 22 bp, Homo sapiens
agtgttattgaggcaaaactgt

SEQ ID NO: 7871535 - DNA, 22 bp, Homo sapiens
agtgttattgaggcaaaactgt

SEQ ID NO: 7871536 - DNA, 22 bp, Homo sapiens
agtgttatttattgtttcataa

SEQ ID NO: 7871537 - DNA, 22 bp, Homo sapiens
agtgttatttattgtttcataa

SEQ ID NO: 7871538 - DNA, 18 bp, Homo sapiens
agtgttattgggagacag

SEQ ID NO: 7871539 - DNA, 22 bp, Homo sapiens
agtgttcagtgattgtcaaccg

SEQ ID NO: 7871540 - DNA, 22 bp, Homo sapiens
agtgttcagtgattgtcaaccg

SEQ ID NO: 7871541 - DNA, 23 bp, Homo sapiens
agtgttcagcatgtagtaaatac

SEQ ID NO: 7871542 - DNA, 22 bp, Homo sapiens
agtgttcactctgtggagccca

SEQ ID NO: 7871543 - DNA, 22 bp, Homo sapiens
agtgttatttattgtttcataa

SEQ ID NO: 7871544 - DNA, 23 bp, Homo sapiens
agtgttcagcatgtagtaaatac

SEQ ID NO: 7871545 - DNA, 22 bp, Homo sapiens
ctgagaggcggaggttgcagtg

SEQ ID NO: 7871546 - DNA, 22 bp, Homo sapiens
ctgagaggcggaggttgcagtg

SEQ ID NO: 7871547 - DNA, 22 bp, Homo sapiens
agtgttaagagaaaattctgct

SEQ ID NO: 7871548 - DNA, 22 bp, Homo sapiens
ctgagaggcggaggttgcagtg

SEQ ID NO: 7871549 - DNA, 18 bp, Homo sapiens
agtgttaagtaagtagca

SEQ ID NO: 7871550 - DNA, 18 bp, Homo sapiens
agtgttaagtaagtagca

SEQ ID NO: 7871551 - DNA, 22 bp, Homo sapiens
agtgttaatatctggccctagg

SEQ ID NO: 7871552 - DNA, 22 bp, Homo sapiens
agtgttaatatctggccctagg

SEQ ID NO: 7871553 - DNA, 22 bp, Homo sapiens
agtgttaagagaaaattctgct

SEQ ID NO: 7871554 - DNA, 22 bp, Homo sapiens
agtgttaaggctggttgctata

SEQ ID NO: 7871555 - DNA, 22 bp, Homo sapiens
agtgttaaggctggttgctata

SEQ ID NO: 7871556 - DNA, 22 bp, Homo sapiens
agtgttaatggtgtatattagg

SEQ ID NO: 7871557 - DNA, 22 bp, Homo sapiens
agtgttaatggtgtatattagg

SEQ ID NO: 7871558 - DNA, 21 bp, Homo sapiens
agtgttaatggaaattatatt

SEQ ID NO: 7871559 - DNA, 18 bp, Homo sapiens
agtgttaagtaagtagca

SEQ ID NO: 7871560 - DNA, 22 bp, Homo sapiens
agtgttaagagaaaattctgct

SEQ ID NO: 7871561 - DNA, 21 bp, Homo sapiens
agtgttaatggaaattatatt

SEQ ID NO: 7871562 - DNA, 21 bp, Homo sapiens
agtgttaatggaaattatatt

SEQ ID NO: 7871563 - DNA, 21 bp, Homo sapiens
agtgttaatggaaattatatt

SEQ ID NO: 7871564 - DNA, 22 bp, Homo sapiens
agtgttactggttcatgaatct

SEQ ID NO: 7871565 - DNA, 22 bp, Homo sapiens
agtgttactggttcatgaatct

SEQ ID NO: 7871566 - DNA, 22 bp, Homo sapiens
agtgttactacagactggttaa

SEQ ID NO: 7871567 - DNA, 22 bp, Homo sapiens
agtgttaatggtgtatattagg

SEQ ID NO: 7871568 - DNA, 22 bp, Homo sapiens
agtgttaatggtgtatattagg

SEQ ID NO: 7871569 - DNA, 22 bp, Homo sapiens
agtgttaatggtgtatattagg

SEQ ID NO: 7871570 - DNA, 19 bp, Homo sapiens
agtttattataggtgattc

SEQ ID NO: 7871571 - DNA, 19 bp, Homo sapiens
agtttattataggtgattc

SEQ ID NO: 7871572 - DNA, 19 bp, Homo sapiens
agtttattataggtgattc

SEQ ID NO: 7871573 - DNA, 19 bp, Homo sapiens
agtttattataggtgattc

SEQ ID NO: 7871574 - DNA, 19 bp, Homo sapiens
agtttattataggtgattc

SEQ ID NO: 7871575 - DNA, 19 bp, Homo sapiens
agtttattataggtgattc

SEQ ID NO: 7871576 - DNA, 19 bp, Homo sapiens
agtttattataggtgattc

SEQ ID NO: 7871577 - DNA, 22 bp, Homo sapiens
agtttatgttgtttataagcca

SEQ ID NO: 7871578 - DNA, 22 bp, Homo sapiens
agtttatgttgtttataagcca

SEQ ID NO: 7871579 - DNA, 22 bp, Homo sapiens
agtttatgttgtttataagcca

SEQ ID NO: 7871580 - DNA, 22 bp, Homo sapiens
agtgttctcagctactagagag

SEQ ID NO: 7871581 - DNA, 22 bp, Homo sapiens
agtttacaacagtagctatgga

SEQ ID NO: 7871582 - DNA, 22 bp, Homo sapiens
agtttacaacagtagctatgga

SEQ ID NO: 7871583 - DNA, 22 bp, Homo sapiens
agtttacaacagtagctatgga

SEQ ID NO: 7871584 - DNA, 22 bp, Homo sapiens
agtttacaacagtagctatgga

SEQ ID NO: 7871585 - DNA, 21 bp, Homo sapiens
agtttacaactgtccagcccc

SEQ ID NO: 7871586 - DNA, 22 bp, Homo sapiens
agtgttcatttattcattcact

SEQ ID NO: 7871587 - DNA, 22 bp, Homo sapiens
agtgttccacacatctggggaa

SEQ ID NO: 7871588 - DNA, 20 bp, Homo sapiens
agtgttccggaagactggca

SEQ ID NO: 7871589 - DNA, 22 bp, Homo sapiens
agtgttctaacaactgctttca

SEQ ID NO: 7871590 - DNA, 22 bp, Homo sapiens
agtgttctaacaactgctttca

SEQ ID NO: 7871591 - DNA, 19 bp, Homo sapiens
ctgtgtcacatttatgaaa

SEQ ID NO: 7871592 - DNA, 22 bp, Homo sapiens
ctgtgtattgaaaaagggttaa

SEQ ID NO: 7871593 - DNA, 22 bp, Homo sapiens
ctgtgggagcactggggaccga

SEQ ID NO: 7871594 - DNA, 22 bp, Homo sapiens
ctgtgtccatgttctaatttgg

SEQ ID NO: 7871595 - DNA, 22 bp, Homo sapiens
ctgtgtccatgttctaatttgg

SEQ ID NO: 7871596 - DNA, 22 bp, Homo sapiens
ctgtgtccaatggccttagcag

SEQ ID NO: 7871597 - DNA, 22 bp, Homo sapiens
ctgtgtccaatggccttagcag

SEQ ID NO: 7871598 - DNA, 22 bp, Homo sapiens
ctgtgtccaatggccttagcag

SEQ ID NO: 7871599 - DNA, 22 bp, Homo sapiens
ctgtgtccaatggccttagcag

SEQ ID NO: 7871600 - DNA, 22 bp, Homo sapiens
ctgtgtcactcactgcgttatg

SEQ ID NO: 7871601 - DNA, 20 bp, Homo sapiens
atcaggctttctgttgcgat

SEQ ID NO: 7871602 - DNA, 20 bp, Homo sapiens
atcaggctttctgttgcgat

SEQ ID NO: 7871603 - DNA, 22 bp, Homo sapiens
atcaggctagtgtgtgtgttca

SEQ ID NO: 7871604 - DNA, 22 bp, Homo sapiens
atcaggctagtgtgtgtgttca

SEQ ID NO: 7871605 - DNA, 22 bp, Homo sapiens
atcaggctagtgtgtgtgttca

SEQ ID NO: 7871606 - DNA, 22 bp, Homo sapiens
atcaggctaggaacctcactgc

SEQ ID NO: 7871607 - DNA, 22 bp, Homo sapiens
atcaggccagcaatccctgggc

SEQ ID NO: 7871608 - DNA, 22 bp, Homo sapiens
atcaggcagaagcagaaagatg

SEQ ID NO: 7871609 - DNA, 22 bp, Homo sapiens
atcaggccagcaatccctgggc

SEQ ID NO: 7871610 - DNA, 22 bp, Homo sapiens
atcaggccagcaatccctgggc

SEQ ID NO: 7871611 - DNA, 17 bp, Homo sapiens
ctgtgctcgagtgatgg

SEQ ID NO: 7871612 - DNA, 20 bp, Homo sapiens
ctgtgctccgggttcctgga

SEQ ID NO: 7871613 - DNA, 22 bp, Homo sapiens
atcaggaaatacttatttataa

SEQ ID NO: 7871614 - DNA, 20 bp, Homo sapiens
ctgtgctccgggttcctgga

SEQ ID NO: 7871615 - DNA, 22 bp, Homo sapiens
atcaggaaatacttatttataa

SEQ ID NO: 7871616 - DNA, 19 bp, Homo sapiens
atcaggaacaaggctgatc

SEQ ID NO: 7871617 - DNA, 22 bp, Homo sapiens
atcaggaacgttcatggactgt

SEQ ID NO: 7871618 - DNA, 22 bp, Homo sapiens
atcaggaacgttcatggactgt

SEQ ID NO: 7871619 - DNA, 20 bp, Homo sapiens
atcaggaagagagactgacc

SEQ ID NO: 7871620 - DNA, 22 bp, Homo sapiens
atcaggaagtctgccacaaggc

SEQ ID NO: 7871621 - DNA, 20 bp, Homo sapiens
atcaggaagagagactgacc

SEQ ID NO: 7871622 - DNA, 22 bp, Homo sapiens
atcaggaagatctagcgaatgt

SEQ ID NO: 7871623 - DNA, 22 bp, Homo sapiens
atcaggaagatctagcgaatgt

SEQ ID NO: 7871624 - DNA, 22 bp, Homo sapiens
atcaggaagccagtctaatgga

SEQ ID NO: 7871625 - DNA, 22 bp, Homo sapiens
atcaggaatgaatacttttgga

SEQ ID NO: 7871626 - DNA, 22 bp, Homo sapiens
atcaggaagtctgccacaaggc

SEQ ID NO: 7871627 - DNA, 22 bp, Homo sapiens
atcaggaatcttttgtcagaca

SEQ ID NO: 7871628 - DNA, 22 bp, Homo sapiens
atcaggatcagggctagcagag

SEQ ID NO: 7871629 - DNA, 22 bp, Homo sapiens
atcaggaattaggtgagatgga

SEQ ID NO: 7871630 - DNA, 22 bp, Homo sapiens
ctgtgcagtaggtcagggctgg

SEQ ID NO: 7871631 - DNA, 21 bp, Homo sapiens
ctgtccagtaattcctggcac

SEQ ID NO: 7871632 - DNA, 18 bp, Homo sapiens
ctgtccagtagactctgc

SEQ ID NO: 7871633 - DNA, 18 bp, Homo sapiens
ctgtccagtagactctgc

SEQ ID NO: 7871634 - DNA, 21 bp, Homo sapiens
ctgtccagtaattcctggcac

SEQ ID NO: 7871635 - DNA, 22 bp, Homo sapiens
ctgtccagcttggctcctgggg

SEQ ID NO: 7871636 - DNA, 23 bp, Homo sapiens
ctgtccaggattcttgagagaac

SEQ ID NO: 7871637 - DNA, 23 bp, Homo sapiens
ctgtccaggattcttgagagaac

SEQ ID NO: 7871638 - DNA, 23 bp, Homo sapiens
ctgtccaggattcttgagagaac

SEQ ID NO: 7871639 - DNA, 22 bp, Homo sapiens
ctgtccagcttggctcctgggg

SEQ ID NO: 7871640 - DNA, 22 bp, Homo sapiens
ctgtccagggtgtgcaggggct

SEQ ID NO: 7871641 - DNA, 22 bp, Homo sapiens
ctgtccagggtgtgcaggggct

SEQ ID NO: 7871642 - DNA, 22 bp, Homo sapiens
ctgtccagggtgtgcaggggct

SEQ ID NO: 7871643 - DNA, 22 bp, Homo sapiens
ctgtccagggtgtgcaggggct

SEQ ID NO: 7871644 - DNA, 23 bp, Homo sapiens
ctgtccaggattcttgagagaac

SEQ ID NO: 7871645 - DNA, 23 bp, Homo sapiens
ctgtccaggattcttgagagaac

SEQ ID NO: 7871646 - DNA, 22 bp, Homo sapiens
ctgtccaggctgaggagtttat

SEQ ID NO: 7871647 - DNA, 22 bp, Homo sapiens
ctgtgcctaagatgcatgtctc

SEQ ID NO: 7871648 - DNA, 22 bp, Homo sapiens
ctgtgcctaagatgcatgtctc

SEQ ID NO: 7871649 - DNA, 22 bp, Homo sapiens
ctgtgcctaagatgcatgtctc

SEQ ID NO: 7871650 - DNA, 22 bp, Homo sapiens
ctgtgcctcagtgtcctcgagt

SEQ ID NO: 7871651 - DNA, 22 bp, Homo sapiens
ctgtgcctcagtgtcctcgagt

SEQ ID NO: 7871652 - DNA, 22 bp, Homo sapiens
ctgtgcctccaagtggtctctg

SEQ ID NO: 7871653 - DNA, 20 bp, Homo sapiens
ctgtgcctaaacctccgggt

SEQ ID NO: 7871654 - DNA, 22 bp, Homo sapiens
ctgtgccctttgtcctcgtctc

SEQ ID NO: 7871655 - DNA, 20 bp, Homo sapiens
ctgtgcctaaacctccgggt

SEQ ID NO: 7871656 - DNA, 20 bp, Homo sapiens
ctgtgcctaaacctccgggt

SEQ ID NO: 7871657 - DNA, 22 bp, Homo sapiens
ctgtgccctttgtcctcgtctc

SEQ ID NO: 7871658 - DNA, 22 bp, Homo sapiens
ctgtgccctttcgctgcactgt

SEQ ID NO: 7871659 - DNA, 22 bp, Homo sapiens
ctgtgcagtaggtcagggctgg

SEQ ID NO: 7871660 - DNA, 22 bp, Homo sapiens
ctgtgcagtaggtcagggctgg

SEQ ID NO: 7871661 - DNA, 22 bp, Homo sapiens
ctgtgcagtaggtcagggctgg

SEQ ID NO: 7871662 - DNA, 22 bp, Homo sapiens
ctgtgccctttcgctgcactgt

SEQ ID NO: 7871663 - DNA, 22 bp, Homo sapiens
ctgtgcctgcaggccacatcaa

SEQ ID NO: 7871664 - DNA, 22 bp, Homo sapiens
ctgtgcctgcaggccacatcaa

SEQ ID NO: 7871665 - DNA, 20 bp, Homo sapiens
ctgtgcctcctgctagtcct

SEQ ID NO: 7871666 - DNA, 20 bp, Homo sapiens
ctgtgcctcctgctagtcct

SEQ ID NO: 7871667 - DNA, 22 bp, Homo sapiens
ctgtgcctccctttactttgag

SEQ ID NO: 7871668 - DNA, 22 bp, Homo sapiens
ctgtgcctccaagtggtctctg

SEQ ID NO: 7871669 - DNA, 22 bp, Homo sapiens
ctgtgcctccaagtggtctctg

SEQ ID NO: 7871670 - DNA, 22 bp, Homo sapiens
ctgtgcctccagtctcgcttct

SEQ ID NO: 7871671 - DNA, 22 bp, Homo sapiens
ctgtgcctggggggcagagctg

SEQ ID NO: 7871672 - DNA, 22 bp, Homo sapiens
ctgtgcctggggggcagagctg

SEQ ID NO: 7871673 - DNA, 22 bp, Homo sapiens
ctgtgcctgccttgttcactga

SEQ ID NO: 7871674 - DNA, 22 bp, Homo sapiens
ctgtgcctgccttgttcactga

SEQ ID NO: 7871675 - DNA, 22 bp, Homo sapiens
ctgtgccttagtattctcattt

SEQ ID NO: 7871676 - DNA, 22 bp, Homo sapiens
ctgtgccttagtattctcattt

SEQ ID NO: 7871677 - DNA, 22 bp, Homo sapiens
ctgtgcctggggggcagagctg

SEQ ID NO: 7871678 - DNA, 22 bp, Homo sapiens
ctgtgcctggggggcagagctg

SEQ ID NO: 7871679 - DNA, 22 bp, Homo sapiens
ctgtgccttagtattctcattt

SEQ ID NO: 7871680 - DNA, 22 bp, Homo sapiens
ctgtgccttggcgctgtgccac

SEQ ID NO: 7871681 - DNA, 22 bp, Homo sapiens
ctgtgcctttgtagctgtgcct

SEQ ID NO: 7871682 - DNA, 22 bp, Homo sapiens
ctgtgcctttgtagctgtgcct

SEQ ID NO: 7871683 - DNA, 22 bp, Homo sapiens
ctgtgccttggcgctgtgccac

SEQ ID NO: 7871684 - DNA, 22 bp, Homo sapiens
ctgtgccttctacttcactcta

SEQ ID NO: 7871685 - DNA, 22 bp, Homo sapiens
ctgtgccttctgcctggaacat

SEQ ID NO: 7871686 - DNA, 22 bp, Homo sapiens
ctgtgccttctgcctggaacat

SEQ ID NO: 7871687 - DNA, 22 bp, Homo sapiens
ctgtgccttctgcctggaacat

SEQ ID NO: 7871688 - DNA, 23 bp, Homo sapiens
ctgtgctcagagggagggagagc

SEQ ID NO: 7871689 - DNA, 22 bp, Homo sapiens
ctgtgctacaacctgacgtgtg

SEQ ID NO: 7871690 - DNA, 22 bp, Homo sapiens
ctgtgctacttagaagctgtgt

SEQ ID NO: 7871691 - DNA, 23 bp, Homo sapiens
ctgtgctcagagggagggagagc

SEQ ID NO: 7871692 - DNA, 23 bp, Homo sapiens
ctgtgctcagagggagggagagc

SEQ ID NO: 7871693 - DNA, 22 bp, Homo sapiens
ctgtgctccctctggcgccccg

SEQ ID NO: 7871694 - DNA, 22 bp, Homo sapiens
ctgtgcgttgtgaaatgtttag

SEQ ID NO: 7871695 - DNA, 22 bp, Homo sapiens
ctgtgcgtaagtagccaaaata

SEQ ID NO: 7871696 - DNA, 22 bp, Homo sapiens
ctgtgtcccttgtcccagagcc

SEQ ID NO: 7871697 - DNA, 22 bp, Homo sapiens
ctgtgtccccctcagccaggtg

SEQ ID NO: 7871698 - DNA, 22 bp, Homo sapiens
ctgtgtccccctcagccaggtg

SEQ ID NO: 7871699 - DNA, 22 bp, Homo sapiens
ctgtgtccccctcagccaggtg

SEQ ID NO: 7871700 - DNA, 22 bp, Homo sapiens
ctgtgtcccagtaccttgggta

SEQ ID NO: 7871701 - DNA, 22 bp, Homo sapiens
ctgtgtcccagtaccttgggta

SEQ ID NO: 7871702 - DNA, 22 bp, Homo sapiens
ctgtgtcccagtaccttgggta

SEQ ID NO: 7871703 - DNA, 22 bp, Homo sapiens
ctgtgtcccagccaggataatg

SEQ ID NO: 7871704 - DNA, 22 bp, Homo sapiens
ctgtgtcccagccaggataatg

SEQ ID NO: 7871705 - DNA, 22 bp, Homo sapiens
ctgtgtcccacacgaggtgtat

SEQ ID NO: 7871706 - DNA, 22 bp, Homo sapiens
ctgtgtcccacacgaggtgtat

SEQ ID NO: 7871707 - DNA, 22 bp, Homo sapiens
ctgtgtccatttatcattgtca

SEQ ID NO: 7871708 - DNA, 22 bp, Homo sapiens
ctgtgtccatttatcattgtca

SEQ ID NO: 7871709 - DNA, 22 bp, Homo sapiens
atcattaaatataagcttcaca

SEQ ID NO: 7871710 - DNA, 22 bp, Homo sapiens
atcattaaatataagcttcaca

SEQ ID NO: 7871711 - DNA, 22 bp, Homo sapiens
atcattaaatataagcttcaca

SEQ ID NO: 7871712 - DNA, 22 bp, Homo sapiens
ctgtgtcctccccatcacttct

SEQ ID NO: 7871713 - DNA, 22 bp, Homo sapiens
ctgtgtcccttgtcccagagcc

SEQ ID NO: 7871714 - DNA, 22 bp, Homo sapiens
ctgtgtcccttgtcccagagcc

SEQ ID NO: 7871715 - DNA, 22 bp, Homo sapiens
atcattagaccaaactagagct

SEQ ID NO: 7871716 - DNA, 22 bp, Homo sapiens
atcattagaccaaactagagct

SEQ ID NO: 7871717 - DNA, 21 bp, Homo sapiens
atcattaattgctgagtgaca

SEQ ID NO: 7871718 - DNA, 21 bp, Homo sapiens
atcattaattgctgagtgaca

SEQ ID NO: 7871719 - DNA, 22 bp, Homo sapiens
atcattaacccttgatgctggg

SEQ ID NO: 7871720 - DNA, 22 bp, Homo sapiens
ctgtgtgtgaacacagcccagc

SEQ ID NO: 7871721 - DNA, 22 bp, Homo sapiens
ctgtgtgtgaacacagcccagc

SEQ ID NO: 7871722 - DNA, 22 bp, Homo sapiens
ctgttactaatcttttctgcta

SEQ ID NO: 7871723 - DNA, 22 bp, Homo sapiens
ctgtgtgtgaacacagcccagc

SEQ ID NO: 7871724 - DNA, 22 bp, Homo sapiens
ctgttactcctttggcagatta

SEQ ID NO: 7871725 - DNA, 22 bp, Homo sapiens
ctgttactgaaatgcaccgtgc

SEQ ID NO: 7871726 - DNA, 22 bp, Homo sapiens
ctgtgtgtgaacacagcccagc

SEQ ID NO: 7871727 - DNA, 22 bp, Homo sapiens
ctgtgtgtgaacacagcccagc

SEQ ID NO: 7871728 - DNA, 22 bp, Homo sapiens
atcattccacatgtaccactag

SEQ ID NO: 7871729 - DNA, 22 bp, Homo sapiens
ctgtgtgtcctcggacgagttt

SEQ ID NO: 7871730 - DNA, 22 bp, Homo sapiens
atcattctagctgttgtgttga

SEQ ID NO: 7871731 - DNA, 22 bp, Homo sapiens
atcattcagtctctgggacagt

SEQ ID NO: 7871732 - DNA, 22 bp, Homo sapiens
atcattcagtgaccacttccca

SEQ ID NO: 7871733 - DNA, 22 bp, Homo sapiens
atcattcagcctaagcaagtac

SEQ ID NO: 7871734 - DNA, 22 bp, Homo sapiens
atcattcatcttattgccagtc

SEQ ID NO: 7871735 - DNA, 22 bp, Homo sapiens
atcattagttgtggaattcttg

SEQ ID NO: 7871736 - DNA, 22 bp, Homo sapiens
atcattataatggtatagttgt

SEQ ID NO: 7871737 - DNA, 22 bp, Homo sapiens
atcattataatggtatagttgt

SEQ ID NO: 7871738 - DNA, 22 bp, Homo sapiens
atcattagcaattttcaataag

SEQ ID NO: 7871739 - DNA, 22 bp, Homo sapiens
atcattagaccaaactagagct

SEQ ID NO: 7871740 - DNA, 22 bp, Homo sapiens
atcattatcctcctatttgcct

SEQ ID NO: 7871741 - DNA, 22 bp, Homo sapiens
atcattatcctcctatttgcct

SEQ ID NO: 7871742 - DNA, 22 bp, Homo sapiens
atcattcagtctctgggacagt

SEQ ID NO: 7871743 - DNA, 22 bp, Homo sapiens
atcattcagcctaagcaagtac

SEQ ID NO: 7871744 - DNA, 22 bp, Homo sapiens
ctgtttcaaaactagtacaaca

SEQ ID NO: 7871745 - DNA, 21 bp, Homo sapiens
ctgtttatttcacctgggtgc

SEQ ID NO: 7871746 - DNA, 22 bp, Homo sapiens
ctgtttattgagcaatctgcca

SEQ ID NO: 7871747 - DNA, 22 bp, Homo sapiens
ctgtttattgagcaatctgcca

SEQ ID NO: 7871748 - DNA, 22 bp, Homo sapiens
ctgtttattgagcaatctgcca

SEQ ID NO: 7871749 - DNA, 22 bp, Homo sapiens
ctgtttattctcatctaaaatg

SEQ ID NO: 7871750 - DNA, 22 bp, Homo sapiens
ctgtttattacactggatagca

SEQ ID NO: 7871751 - DNA, 22 bp, Homo sapiens
ctgtttattacactggatagca

SEQ ID NO: 7871752 - DNA, 22 bp, Homo sapiens
ctgtttatggaggtaaggcatc

SEQ ID NO: 7871753 - DNA, 22 bp, Homo sapiens
ctgtttatggaggtaaggcatc

SEQ ID NO: 7871754 - DNA, 22 bp, Homo sapiens
ctgtttatggaggtaaggcatc

SEQ ID NO: 7871755 - DNA, 22 bp, Homo sapiens
ctgtttattacgtaattaatat

SEQ ID NO: 7871756 - DNA, 20 bp, Homo sapiens
ctgtttattagaagtggatt

SEQ ID NO: 7871757 - DNA, 22 bp, Homo sapiens
ctgtttatctctaacctgttta

SEQ ID NO: 7871758 - DNA, 22 bp, Homo sapiens
ctgtttatgaagctgtggttta

SEQ ID NO: 7871759 - DNA, 22 bp, Homo sapiens
ctgtttatctctaacctgttta

SEQ ID NO: 7871760 - DNA, 22 bp, Homo sapiens
ctgtttatctctaacctgttta

SEQ ID NO: 7871761 - DNA, 22 bp, Homo sapiens
ctgtttatctctaacctgttta

SEQ ID NO: 7871762 - DNA, 22 bp, Homo sapiens
ctgtttatctaggagttgcagg

SEQ ID NO: 7871763 - DNA, 22 bp, Homo sapiens
ctgttatttgagagtgttgaat

SEQ ID NO: 7871764 - DNA, 22 bp, Homo sapiens
ctgttatttgctggaagagttt

SEQ ID NO: 7871765 - DNA, 22 bp, Homo sapiens
ctgttatttgagagtgttgaat

SEQ ID NO: 7871766 - DNA, 22 bp, Homo sapiens
ctgttattttataattcaagaa

SEQ ID NO: 7871767 - DNA, 22 bp, Homo sapiens
ctgttattttataattcaagaa

SEQ ID NO: 7871768 - DNA, 22 bp, Homo sapiens
ctgttattttataattcaagaa

SEQ ID NO: 7871769 - DNA, 22 bp, Homo sapiens
ctgttattttataattcaagaa

SEQ ID NO: 7871770 - DNA, 22 bp, Homo sapiens
ctgttatttggaggatgcttgg

SEQ ID NO: 7871771 - DNA, 22 bp, Homo sapiens
ctgttatttgagagtgttgaat

SEQ ID NO: 7871772 - DNA, 22 bp, Homo sapiens
ctgttatttctgccaggtgagt

SEQ ID NO: 7871773 - DNA, 22 bp, Homo sapiens
ctgttatttagaacatggaatc

SEQ ID NO: 7871774 - DNA, 22 bp, Homo sapiens
ctgttatttagaacatggaatc

SEQ ID NO: 7871775 - DNA, 22 bp, Homo sapiens
ctgttatttagaacatggaatc

SEQ ID NO: 7871776 - DNA, 22 bp, Homo sapiens
ctgttattcaagacaaaggcag

SEQ ID NO: 7871777 - DNA, 22 bp, Homo sapiens
ctgttattcaagacaaaggcag

SEQ ID NO: 7871778 - DNA, 22 bp, Homo sapiens
ctgttattccccttgctgtggt

SEQ ID NO: 7871779 - DNA, 22 bp, Homo sapiens
ctgttattccccttgctgtggt

SEQ ID NO: 7871780 - DNA, 23 bp, Homo sapiens
ctgttattccaggctgatgggtg

SEQ ID NO: 7871781 - DNA, 23 bp, Homo sapiens
ctgttattccaggctgatgggtg

SEQ ID NO: 7871782 - DNA, 19 bp, Homo sapiens
ctgttattgtcagagctcc

SEQ ID NO: 7871783 - DNA, 19 bp, Homo sapiens
ctgttattgtcagagctcc

SEQ ID NO: 7871784 - DNA, 19 bp, Homo sapiens
ctgttattgtcagagctcc

SEQ ID NO: 7871785 - DNA, 22 bp, Homo sapiens
ctgttatgcatggtcattgcct

SEQ ID NO: 7871786 - DNA, 22 bp, Homo sapiens
ctgttatattggtatatttaca

SEQ ID NO: 7871787 - DNA, 22 bp, Homo sapiens
ctgttatagctgtttgtattct

SEQ ID NO: 7871788 - DNA, 22 bp, Homo sapiens
ctgttattcaagacaaaggcag

SEQ ID NO: 7871789 - DNA, 22 bp, Homo sapiens
ctgttattcaagacaaaggcag

SEQ ID NO: 7871790 - DNA, 22 bp, Homo sapiens
ctgttattcaagacaaaggcag

SEQ ID NO: 7871791 - DNA, 22 bp, Homo sapiens
ctgttattaaaaagctcaggct

SEQ ID NO: 7871792 - DNA, 22 bp, Homo sapiens
ctgttattaaaaagctcaggct

SEQ ID NO: 7871793 - DNA, 22 bp, Homo sapiens
ctgttactggacgcacgcagct

SEQ ID NO: 7871794 - DNA, 22 bp, Homo sapiens
ctgttactgctggagccattga

SEQ ID NO: 7871795 - DNA, 22 bp, Homo sapiens
ctgttactgttggcccagggtg

SEQ ID NO: 7871796 - DNA, 22 bp, Homo sapiens
ctgttactgtatttaatcatct

SEQ ID NO: 7871797 - DNA, 22 bp, Homo sapiens
ctgttagtcttttgcaggagag

SEQ ID NO: 7871798 - DNA, 22 bp, Homo sapiens
ctgttagtgatcaaagggagag

SEQ ID NO: 7871799 - DNA, 16 bp, Homo sapiens
ctgttacttgactgtt

SEQ ID NO: 7871800 - DNA, 22 bp, Homo sapiens
ctgttacttcaatcttctcccg

SEQ ID NO: 7871801 - DNA, 22 bp, Homo sapiens
atctccagaatggcttgttaat

SEQ ID NO: 7871802 - DNA, 22 bp, Homo sapiens
atctccagaacatttataaacg

SEQ ID NO: 7871803 - DNA, 22 bp, Homo sapiens
atctccagaatggcttgttaat

SEQ ID NO: 7871804 - DNA, 22 bp, Homo sapiens
atctccagaacatttataaacg

SEQ ID NO: 7871805 - DNA, 22 bp, Homo sapiens
atctcattttggtttctactta

SEQ ID NO: 7871806 - DNA, 22 bp, Homo sapiens
atctccagcaatggggagctct

SEQ ID NO: 7871807 - DNA, 22 bp, Homo sapiens
atctccagattgtgatcatcag

SEQ ID NO: 7871808 - DNA, 22 bp, Homo sapiens
atctccagattgtgatcatcag

SEQ ID NO: 7871809 - DNA, 22 bp, Homo sapiens
atctccagaggagtcatggtct

SEQ ID NO: 7871810 - DNA, 22 bp, Homo sapiens
atctccagaggagtcatggtct

SEQ ID NO: 7871811 - DNA, 22 bp, Homo sapiens
atctccagatgcctggaaatga

SEQ ID NO: 7871812 - DNA, 22 bp, Homo sapiens
atctccagatgcctggaaatga

SEQ ID NO: 7871813 - DNA, 22 bp, Homo sapiens
atctccaggattttcacactca

SEQ ID NO: 7871814 - DNA, 22 bp, Homo sapiens
atctccaggaagtgtcatttac

SEQ ID NO: 7871815 - DNA, 22 bp, Homo sapiens
atctccaggaagtgtcatttac

SEQ ID NO: 7871816 - DNA, 22 bp, Homo sapiens
atctccagctggctgtgataaa

SEQ ID NO: 7871817 - DNA, 22 bp, Homo sapiens
atctccagctggctgtgataaa

SEQ ID NO: 7871818 - DNA, 22 bp, Homo sapiens
atctccagctcgcagagctcct

SEQ ID NO: 7871819 - DNA, 22 bp, Homo sapiens
atctccagctcgcagagctcct

SEQ ID NO: 7871820 - DNA, 22 bp, Homo sapiens
atctccagctcgcagagctcct

SEQ ID NO: 7871821 - DNA, 22 bp, Homo sapiens
atctccagctcgcagagctcct

SEQ ID NO: 7871822 - DNA, 22 bp, Homo sapiens
atctccagcagtgcttttgagc

SEQ ID NO: 7871823 - DNA, 22 bp, Homo sapiens
atctccagcagtgcttttgagc

SEQ ID NO: 7871824 - DNA, 22 bp, Homo sapiens
atctccagcaatggggagctct

SEQ ID NO: 7871825 - DNA, 22 bp, Homo sapiens
atctatttctgctaataacaat

SEQ ID NO: 7871826 - DNA, 22 bp, Homo sapiens
atctcataaacacacatatatg

SEQ ID NO: 7871827 - DNA, 22 bp, Homo sapiens
atctcaggtgaaacttctaggt

SEQ ID NO: 7871828 - DNA, 22 bp, Homo sapiens
atctatttctgctaataacaat

SEQ ID NO: 7871829 - DNA, 22 bp, Homo sapiens
atctcattttggtttctactta

SEQ ID NO: 7871830 - DNA, 22 bp, Homo sapiens
atctcattttggtttctactta

SEQ ID NO: 7871831 - DNA, 22 bp, Homo sapiens
atctcattttggtttctactta

SEQ ID NO: 7871832 - DNA, 22 bp, Homo sapiens
atctcatcagatctgtataagc

SEQ ID NO: 7871833 - DNA, 22 bp, Homo sapiens
atctcataactcatttgaagac

SEQ ID NO: 7871834 - DNA, 22 bp, Homo sapiens
atctccaggattttcacactca

SEQ ID NO: 7871835 - DNA, 22 bp, Homo sapiens
atctccaggattttcacactca

SEQ ID NO: 7871836 - DNA, 22 bp, Homo sapiens
atctccaggcatttcaagagac

SEQ ID NO: 7871837 - DNA, 22 bp, Homo sapiens
atctccagggtgcccttgttct

SEQ ID NO: 7871838 - DNA, 22 bp, Homo sapiens
atctccaggcatttcaagagac

SEQ ID NO: 7871839 - DNA, 22 bp, Homo sapiens
atctccaggttgtgcctgcgtc

SEQ ID NO: 7871840 - DNA, 22 bp, Homo sapiens
atctccaggttgtgcctgcgtc

SEQ ID NO: 7871841 - DNA, 22 bp, Homo sapiens
atctccagggtgcccttgttct

SEQ ID NO: 7871842 - DNA, 22 bp, Homo sapiens
atctccagtcctggtttcctgg

SEQ ID NO: 7871843 - DNA, 22 bp, Homo sapiens
atctccaggttgtgcctgcgtc

SEQ ID NO: 7871844 - DNA, 22 bp, Homo sapiens
atctccagtatcctagtattgt

SEQ ID NO: 7871845 - DNA, 22 bp, Homo sapiens
atctccagtatcctagtattgt

SEQ ID NO: 7871846 - DNA, 22 bp, Homo sapiens
atctccagttagcagtactgat

SEQ ID NO: 7871847 - DNA, 22 bp, Homo sapiens
atctccagtgcccaaaggaaat

SEQ ID NO: 7871848 - DNA, 22 bp, Homo sapiens
atctccagttagcagtactgat

SEQ ID NO: 7871849 - DNA, 22 bp, Homo sapiens
atctccagttagcagtactgat

SEQ ID NO: 7871850 - DNA, 22 bp, Homo sapiens
atctccagtgaggcagattctg

SEQ ID NO: 7871851 - DNA, 22 bp, Homo sapiens
atctccagtatcctagtattgt

SEQ ID NO: 7871852 - DNA, 22 bp, Homo sapiens
atctccagtcctggtttcctgg

SEQ ID NO: 7871853 - DNA, 22 bp, Homo sapiens
atctccagtcctggtttcctgg

SEQ ID NO: 7871854 - DNA, 22 bp, Homo sapiens
atctccagtgaggcagattctg

SEQ ID NO: 7871855 - DNA, 22 bp, Homo sapiens
atctccagtgcccaaaggaaat

SEQ ID NO: 7871856 - DNA, 22 bp, Homo sapiens
atctccagtgcccaaaggaaat

SEQ ID NO: 7871857 - DNA, 22 bp, Homo sapiens
cttcagttagtttcatgtgagc

SEQ ID NO: 7871858 - DNA, 18 bp, Homo sapiens
atctcccattggccaagg

SEQ ID NO: 7871859 - DNA, 22 bp, Homo sapiens
cttcagttatgtgccaaggaca

SEQ ID NO: 7871860 - DNA, 22 bp, Homo sapiens
atctcccagccacagcattctt

SEQ ID NO: 7871861 - DNA, 23 bp, Homo sapiens
cttcatgagagccctgaggaaaa

SEQ ID NO: 7871862 - DNA, 22 bp, Homo sapiens
cttcatgagactccactgccat

SEQ ID NO: 7871863 - DNA, 22 bp, Homo sapiens
cttcatgagactccactgccat

SEQ ID NO: 7871864 - DNA, 21 bp, Homo sapiens
cttcatcccggagattctggt

SEQ ID NO: 7871865 - DNA, 22 bp, Homo sapiens
cttcatctttctgagcctcagt

SEQ ID NO: 7871866 - DNA, 22 bp, Homo sapiens
cttcatctttctgagcctcagt

SEQ ID NO: 7871867 - DNA, 22 bp, Homo sapiens
cttcatgagggtaatctacaaa

SEQ ID NO: 7871868 - DNA, 22 bp, Homo sapiens
cttcatgctgagaagctgaatg

SEQ ID NO: 7871869 - DNA, 22 bp, Homo sapiens
cttcatgctgagaagctgaatg

SEQ ID NO: 7871870 - DNA, 22 bp, Homo sapiens
cttcatgatgaccaactgccat

SEQ ID NO: 7871871 - DNA, 22 bp, Homo sapiens
cttcatgctcccatttcctaca

SEQ ID NO: 7871872 - DNA, 22 bp, Homo sapiens
cttcatgctcccatttcctaca

SEQ ID NO: 7871873 - DNA, 22 bp, Homo sapiens
cttcataggcttacttgagaaa

SEQ ID NO: 7871874 - DNA, 22 bp, Homo sapiens
cttcatacaattttttgacata

SEQ ID NO: 7871875 - DNA, 22 bp, Homo sapiens
cttcagtttatcccatcatcca

SEQ ID NO: 7871876 - DNA, 22 bp, Homo sapiens
cttcataaactcagaaggcagc

SEQ ID NO: 7871877 - DNA, 22 bp, Homo sapiens
cttcatatctctgtagagtttt

SEQ ID NO: 7871878 - DNA, 22 bp, Homo sapiens
cttcatatctctgtagagtttt

SEQ ID NO: 7871879 - DNA, 22 bp, Homo sapiens
cttcatagtgagtttaatgatg

SEQ ID NO: 7871880 - DNA, 22 bp, Homo sapiens
cttcatagggttgtaaggatta

SEQ ID NO: 7871881 - DNA, 22 bp, Homo sapiens
cttcataggcttacttgagaaa

SEQ ID NO: 7871882 - DNA, 22 bp, Homo sapiens
cttcatcaactctaacaaatgt

SEQ ID NO: 7871883 - DNA, 23 bp, Homo sapiens
cttcatcaaaagttaacactagt

SEQ ID NO: 7871884 - DNA, 22 bp, Homo sapiens
cttcatcagctggcttactgtt

SEQ ID NO: 7871885 - DNA, 22 bp, Homo sapiens
cttcatcagctggcttactgtt

SEQ ID NO: 7871886 - DNA, 22 bp, Homo sapiens
cttcatcatttgcactctaaga

SEQ ID NO: 7871887 - DNA, 22 bp, Homo sapiens
atctggaaaacacagtgtagac

SEQ ID NO: 7871888 - DNA, 22 bp, Homo sapiens
atctggaaataaatacgagttc

SEQ ID NO: 7871889 - DNA, 21 bp, Homo sapiens
atctggaaattctgccagaga

SEQ ID NO: 7871890 - DNA, 21 bp, Homo sapiens
atctggaaattctgccagaga

SEQ ID NO: 7871891 - DNA, 22 bp, Homo sapiens
atctggaaataaatacgagttc

SEQ ID NO: 7871892 - DNA, 22 bp, Homo sapiens
atctggaaataaatacgagttc

SEQ ID NO: 7871893 - DNA, 22 bp, Homo sapiens
cttcatgttcttggtgaaaggc

SEQ ID NO: 7871894 - DNA, 22 bp, Homo sapiens
cttcattaaccaaaatgcaata

SEQ ID NO: 7871895 - DNA, 22 bp, Homo sapiens
cttcatgtacagttattggaga

SEQ ID NO: 7871896 - DNA, 22 bp, Homo sapiens
cttcattaaccaaaatgcaata

SEQ ID NO: 7871897 - DNA, 22 bp, Homo sapiens
cttcattaaccaaaatgcaata

SEQ ID NO: 7871898 - DNA, 21 bp, Homo sapiens
atctggaagaactggtaagtg

SEQ ID NO: 7871899 - DNA, 19 bp, Homo sapiens
atctggaactcgtttgttt

SEQ ID NO: 7871900 - DNA, 19 bp, Homo sapiens
atctggaactcgtttgttt

SEQ ID NO: 7871901 - DNA, 22 bp, Homo sapiens
atctggaacaaagcttaggaat

SEQ ID NO: 7871902 - DNA, 22 bp, Homo sapiens
atctggaacaaagcttaggaat

SEQ ID NO: 7871903 - DNA, 22 bp, Homo sapiens
atctggaacaaagcttaggaat

SEQ ID NO: 7871904 - DNA, 17 bp, Homo sapiens
atctggaagctagctga

SEQ ID NO: 7871905 - DNA, 22 bp, Homo sapiens
atctggaagccagatactcagt

SEQ ID NO: 7871906 - DNA, 22 bp, Homo sapiens
atctggaagccagatactcagt

SEQ ID NO: 7871907 - DNA, 22 bp, Homo sapiens
atctggaagccagatactcagt

SEQ ID NO: 7871908 - DNA, 22 bp, Homo sapiens
atctggaagattgaaggggagt

SEQ ID NO: 7871909 - DNA, 21 bp, Homo sapiens
atctggaagaactggtaagtg

SEQ ID NO: 7871910 - DNA, 22 bp, Homo sapiens
ctgtttctccacactcttccca

SEQ ID NO: 7871911 - DNA, 23 bp, Homo sapiens
cttcacaatcaaaatcagttctg

SEQ ID NO: 7871912 - DNA, 22 bp, Homo sapiens
cttcacacccactaggatggct

SEQ ID NO: 7871913 - DNA, 22 bp, Homo sapiens
ctgtttcctgtcttctcactat

SEQ ID NO: 7871914 - DNA, 22 bp, Homo sapiens
ctgtttctaaagggagcagatt

SEQ ID NO: 7871915 - DNA, 22 bp, Homo sapiens
ctgtttcctgtcttctcactat

SEQ ID NO: 7871916 - DNA, 22 bp, Homo sapiens
ctgtttcctaccgtttttcatt

SEQ ID NO: 7871917 - DNA, 22 bp, Homo sapiens
ctgtttccccatgccctgactc

SEQ ID NO: 7871918 - DNA, 22 bp, Homo sapiens
ctgtttccctccagggggtgga

SEQ ID NO: 7871919 - DNA, 22 bp, Homo sapiens
ctgtttccaccttcatggctaa

SEQ ID NO: 7871920 - DNA, 22 bp, Homo sapiens
ctgtttcaagtgaagtcagaca

SEQ ID NO: 7871921 - DNA, 19 bp, Homo sapiens
ctgtttcaagtaggaggag

SEQ ID NO: 7871922 - DNA, 22 bp, Homo sapiens
ctgtttcaagtgaagtcagaca

SEQ ID NO: 7871923 - DNA, 22 bp, Homo sapiens
ctgtttccatacaggtttttgg

SEQ ID NO: 7871924 - DNA, 22 bp, Homo sapiens
ctgtttcagctactgttccatg

SEQ ID NO: 7871925 - DNA, 22 bp, Homo sapiens
ctgtttcatagagttgtgaatt

SEQ ID NO: 7871926 - DNA, 22 bp, Homo sapiens
cttcagagtgcagaagattggg

SEQ ID NO: 7871927 - DNA, 22 bp, Homo sapiens
cttcagagtgcagaagattggg

SEQ ID NO: 7871928 - DNA, 22 bp, Homo sapiens
cttcagagtgcagaagattggg

SEQ ID NO: 7871929 - DNA, 22 bp, Homo sapiens
cttcagagtgcagaagattggg

SEQ ID NO: 7871930 - DNA, 22 bp, Homo sapiens
cttcagagtgcagaagattggg

SEQ ID NO: 7871931 - DNA, 22 bp, Homo sapiens
cttcagagtgactcagcatctt

SEQ ID NO: 7871932 - DNA, 22 bp, Homo sapiens
cttcagatattaatatcaatta

SEQ ID NO: 7871933 - DNA, 22 bp, Homo sapiens
cttcagatccctctgccactgt

SEQ ID NO: 7871934 - DNA, 21 bp, Homo sapiens
cttcagcaaatacttggcagg

SEQ ID NO: 7871935 - DNA, 22 bp, Homo sapiens
cttcagaggggactcaaagtca

SEQ ID NO: 7871936 - DNA, 22 bp, Homo sapiens
cttcagagtgactcagcatctt

SEQ ID NO: 7871937 - DNA, 22 bp, Homo sapiens
cttcagagcttgttaaaactgt

SEQ ID NO: 7871938 - DNA, 22 bp, Homo sapiens
cttcagagcatcacttcagctg

SEQ ID NO: 7871939 - DNA, 22 bp, Homo sapiens
cttcagagagtccagggactgc

SEQ ID NO: 7871940 - DNA, 22 bp, Homo sapiens
cttcagagagtccagggactgc

SEQ ID NO: 7871941 - DNA, 22 bp, Homo sapiens
cttcagagagtccagggactgc

SEQ ID NO: 7871942 - DNA, 22 bp, Homo sapiens
cttcagagaacttgatcgctgc

SEQ ID NO: 7871943 - DNA, 22 bp, Homo sapiens
cttcagagaacttgatcgctgc

SEQ ID NO: 7871944 - DNA, 22 bp, Homo sapiens
cttcagaattcctcagcctcag

SEQ ID NO: 7871945 - DNA, 22 bp, Homo sapiens
cttcagaattcctcagcctcag

SEQ ID NO: 7871946 - DNA, 22 bp, Homo sapiens
cttcagaattcctcagcctcag

SEQ ID NO: 7871947 - DNA, 22 bp, Homo sapiens
cttcagaatgggactgtgtttg

SEQ ID NO: 7871948 - DNA, 22 bp, Homo sapiens
cttcagaatccagaatcagaat

SEQ ID NO: 7871949 - DNA, 22 bp, Homo sapiens
cttcagaatccagaatcagaat

SEQ ID NO: 7871950 - DNA, 22 bp, Homo sapiens
cttcagaatccagaatcagaat

SEQ ID NO: 7871951 - DNA, 22 bp, Homo sapiens
cttcacagaataaactcattat

SEQ ID NO: 7871952 - DNA, 22 bp, Homo sapiens
cttcacacccactaaaatgatg

SEQ ID NO: 7871953 - DNA, 22 bp, Homo sapiens
cttcagaatccagaatcagaat

SEQ ID NO: 7871954 - DNA, 22 bp, Homo sapiens
cttcagaagcctgcagcctttg

SEQ ID NO: 7871955 - DNA, 22 bp, Homo sapiens
cttcagaagcctgcagcctttg

SEQ ID NO: 7871956 - DNA, 22 bp, Homo sapiens
atccttcttctgctagtgtcta

SEQ ID NO: 7871957 - DNA, 22 bp, Homo sapiens
atccttgacacactccagtact

SEQ ID NO: 7871958 - DNA, 22 bp, Homo sapiens
atccttgaacttagacactagg

SEQ ID NO: 7871959 - DNA, 22 bp, Homo sapiens
atccttccttcatttgacaggt

SEQ ID NO: 7871960 - DNA, 22 bp, Homo sapiens
atccttcagtggaagacagtag

SEQ ID NO: 7871961 - DNA, 22 bp, Homo sapiens
atccttccagagttattctcaa

SEQ ID NO: 7871962 - DNA, 22 bp, Homo sapiens
atccttggcacagtggaattca

SEQ ID NO: 7871963 - DNA, 22 bp, Homo sapiens
atccttggatgtgtctttttgt

SEQ ID NO: 7871964 - DNA, 22 bp, Homo sapiens
atccttgacacactccagtact

SEQ ID NO: 7871965 - DNA, 22 bp, Homo sapiens
atccttgagaaaataaatgacc

SEQ ID NO: 7871966 - DNA, 22 bp, Homo sapiens
atctattctctacagtagacag

SEQ ID NO: 7871967 - DNA, 22 bp, Homo sapiens
atcctttaagttaataaaattc

SEQ ID NO: 7871968 - DNA, 21 bp, Homo sapiens
atccttgatcagaagagtgct

SEQ ID NO: 7871969 - DNA, 18 bp, Homo sapiens
atccttggggctgctgct

SEQ ID NO: 7871970 - DNA, 22 bp, Homo sapiens
atccttgggtctctggaaattg

SEQ ID NO: 7871971 - DNA, 21 bp, Homo sapiens
atccttagcacttagaagagt

SEQ ID NO: 7871972 - DNA, 22 bp, Homo sapiens
atccttaggtggtgcatcaggg

SEQ ID NO: 7871973 - DNA, 22 bp, Homo sapiens
atccttaggtggtgcatcaggg

SEQ ID NO: 7871974 - DNA, 22 bp, Homo sapiens
atccttacctgtgcataagcct

SEQ ID NO: 7871975 - DNA, 22 bp, Homo sapiens
atccttagaagggagtgaggac

SEQ ID NO: 7871976 - DNA, 19 bp, Homo sapiens
cttcagcatctccggagct

SEQ ID NO: 7871977 - DNA, 19 bp, Homo sapiens
cttcagcatctccggagct

SEQ ID NO: 7871978 - DNA, 22 bp, Homo sapiens
atccttcaattagaaccaattg

SEQ ID NO: 7871979 - DNA, 22 bp, Homo sapiens
atccttcaattagaaccaattg

SEQ ID NO: 7871980 - DNA, 22 bp, Homo sapiens
atccttaatttcctgggcctca

SEQ ID NO: 7871981 - DNA, 22 bp, Homo sapiens
atccttcaaggggctgacagct

SEQ ID NO: 7871982 - DNA, 22 bp, Homo sapiens
atccttcaaaaggaatagcagg

SEQ ID NO: 7871983 - DNA, 22 bp, Homo sapiens
atccttagttaagaacaggagt

SEQ ID NO: 7871984 - DNA, 22 bp, Homo sapiens
atccttcaaaaggaatagcagg

SEQ ID NO: 7871985 - DNA, 22 bp, Homo sapiens
atccttcaaggggctgacagct

SEQ ID NO: 7871986 - DNA, 22 bp, Homo sapiens
atccttcaaaaggaatagcagg

SEQ ID NO: 7871987 - DNA, 23 bp, Homo sapiens
cttcagcagaaacataaattctc

SEQ ID NO: 7871988 - DNA, 22 bp, Homo sapiens
cttcagcagatgtgctagagat

SEQ ID NO: 7871989 - DNA, 22 bp, Homo sapiens
cttcagcagatgtgctagagat

SEQ ID NO: 7871990 - DNA, 22 bp, Homo sapiens
cttcagcagatgtgctagagat

SEQ ID NO: 7871991 - DNA, 22 bp, Homo sapiens
cttcagcagcctcttgcataaa

SEQ ID NO: 7871992 - DNA, 22 bp, Homo sapiens
cttcagcaccatagctccttct

SEQ ID NO: 7871993 - DNA, 22 bp, Homo sapiens
cttcagcaccatagctccttct

SEQ ID NO: 7871994 - DNA, 22 bp, Homo sapiens
cttcagcaccatagctccttct

SEQ ID NO: 7871995 - DNA, 22 bp, Homo sapiens
cttcagcacctcagctggagag

SEQ ID NO: 7871996 - DNA, 22 bp, Homo sapiens
cttcagcacctcagctggagag

SEQ ID NO: 7871997 - DNA, 22 bp, Homo sapiens
cttcagcaactttggaatgttt

SEQ ID NO: 7871998 - DNA, 22 bp, Homo sapiens
cttcagcaactttggaatgttt

SEQ ID NO: 7871999 - DNA, 21 bp, Homo sapiens
cttcagcaaatacttggcagg

SEQ ID NO: 7872000 - DNA, 22 bp, Homo sapiens
cttcagcaactttggaatgttt

SEQ ID NO: 7872001 - DNA, 22 bp, Homo sapiens
atatattttgcggtcacgtggc

SEQ ID NO: 7872002 - DNA, 22 bp, Homo sapiens
atatattttgcggtcacgtggc

SEQ ID NO: 7872003 - DNA, 22 bp, Homo sapiens
atatattttgcggtcacgtggc

SEQ ID NO: 7872004 - DNA, 22 bp, Homo sapiens
atatattttgcggtcacgtggc

SEQ ID NO: 7872005 - DNA, 22 bp, Homo sapiens
atatattttgcggtcacgtggc

SEQ ID NO: 7872006 - DNA, 22 bp, Homo sapiens
atatattttgcggtcacgtggc

SEQ ID NO: 7872007 - DNA, 22 bp, Homo sapiens
atatattttgcggtcacgtggc

SEQ ID NO: 7872008 - DNA, 22 bp, Homo sapiens
atatattttttgagacagagtc

SEQ ID NO: 7872009 - DNA, 22 bp, Homo sapiens
atatattttgcggtcacgtggc

SEQ ID NO: 7872010 - DNA, 22 bp, Homo sapiens
atatattttttgagacagagtc

SEQ ID NO: 7872011 - DNA, 22 bp, Homo sapiens
atatattttttgagacagagtc

SEQ ID NO: 7872012 - DNA, 22 bp, Homo sapiens
atatattttgaatagcctctgt

SEQ ID NO: 7872013 - DNA, 22 bp, Homo sapiens
atatattttgaatagcctctgt

SEQ ID NO: 7872014 - DNA, 22 bp, Homo sapiens
atatattacaaaagaggaagga

SEQ ID NO: 7872015 - DNA, 22 bp, Homo sapiens
atatattttgaatagcctctgt

SEQ ID NO: 7872016 - DNA, 20 bp, Homo sapiens
atatatgtatgcgtgtggtt

SEQ ID NO: 7872017 - DNA, 18 bp, Homo sapiens
atagtgcagatcaagccc

SEQ ID NO: 7872018 - DNA, 21 bp, Homo sapiens
atagtgatagataactgagtt

SEQ ID NO: 7872019 - DNA, 22 bp, Homo sapiens
atagtgaaaatgctgtcagcat

SEQ ID NO: 7872020 - DNA, 19 bp, Homo sapiens
atagtctttccaattatac

SEQ ID NO: 7872021 - DNA, 22 bp, Homo sapiens
atagtgaaaatgctgtcagcat

SEQ ID NO: 7872022 - DNA, 22 bp, Homo sapiens
atagtcttccaggtcttctact

SEQ ID NO: 7872023 - DNA, 22 bp, Homo sapiens
atagtctttactgctgaattga

SEQ ID NO: 7872024 - DNA, 22 bp, Homo sapiens
atagtcttacttttctctgcta

SEQ ID NO: 7872025 - DNA, 22 bp, Homo sapiens
atagtcatccagaaagattaca

SEQ ID NO: 7872026 - DNA, 22 bp, Homo sapiens
atagtcactctgttaggtgttt

SEQ ID NO: 7872027 - DNA, 22 bp, Homo sapiens
atagtcataggcaaatagaaga

SEQ ID NO: 7872028 - DNA, 22 bp, Homo sapiens
atagtcagtgtctatatcgttg

SEQ ID NO: 7872029 - DNA, 22 bp, Homo sapiens
atagtcaaccttgtaattagcc

SEQ ID NO: 7872030 - DNA, 22 bp, Homo sapiens
atagtcttagatcagataaagt

SEQ ID NO: 7872031 - DNA, 22 bp, Homo sapiens
atagtcttagatcagataaagt

SEQ ID NO: 7872032 - DNA, 22 bp, Homo sapiens
atagtcttagatcagataaagt

SEQ ID NO: 7872033 - DNA, 22 bp, Homo sapiens
atagtcttcagcactttgatca

SEQ ID NO: 7872034 - DNA, 22 bp, Homo sapiens
atagtcttagtctatagttttg

SEQ ID NO: 7872035 - DNA, 22 bp, Homo sapiens
atagtcttagtctatagttttg

SEQ ID NO: 7872036 - DNA, 22 bp, Homo sapiens
atagtcttcagcactttgatca

SEQ ID NO: 7872037 - DNA, 22 bp, Homo sapiens
atagtatttccagaaatagtct

SEQ ID NO: 7872038 - DNA, 22 bp, Homo sapiens
atagtatttccagaaatagtct

SEQ ID NO: 7872039 - DNA, 22 bp, Homo sapiens
atagtatttccagaaatagtct

SEQ ID NO: 7872040 - DNA, 22 bp, Homo sapiens
atagtacagatccattaattat

SEQ ID NO: 7872041 - DNA, 22 bp, Homo sapiens
atagtacagatccattaattat

SEQ ID NO: 7872042 - DNA, 22 bp, Homo sapiens
atagtacagatccattaattat

SEQ ID NO: 7872043 - DNA, 22 bp, Homo sapiens
atagtacatgggtgtcctcaca

SEQ ID NO: 7872044 - DNA, 22 bp, Homo sapiens
atagtacatgggtgtcctcaca

SEQ ID NO: 7872045 - DNA, 22 bp, Homo sapiens
atagtacagcatttttcctgag

SEQ ID NO: 7872046 - DNA, 22 bp, Homo sapiens
atagtatgagctcatacacttg

SEQ ID NO: 7872047 - DNA, 22 bp, Homo sapiens
atagtactccaccagtacatgt

SEQ ID NO: 7872048 - DNA, 22 bp, Homo sapiens
atagtacatgggtgtcctcaca

SEQ ID NO: 7872049 - DNA, 22 bp, Homo sapiens
atatcataaatcggtgcatgaa

SEQ ID NO: 7872050 - DNA, 18 bp, Homo sapiens
atatcagctacttcatgg

SEQ ID NO: 7872051 - DNA, 22 bp, Homo sapiens
atatcattatgttatgagcaca

SEQ ID NO: 7872052 - DNA, 22 bp, Homo sapiens
atatcattatgttatgagcaca

SEQ ID NO: 7872053 - DNA, 22 bp, Homo sapiens
atatcattatgttatgagcaca

SEQ ID NO: 7872054 - DNA, 22 bp, Homo sapiens
atatcattatgttatgagcaca

SEQ ID NO: 7872055 - DNA, 22 bp, Homo sapiens
atatcattatgttatgagcaca

SEQ ID NO: 7872056 - DNA, 22 bp, Homo sapiens
atatcattatgttatgagcaca

SEQ ID NO: 7872057 - DNA, 22 bp, Homo sapiens
atatcattatgttatgagcaca

SEQ ID NO: 7872058 - DNA, 22 bp, Homo sapiens
atatcacagtagttgtttagtt

SEQ ID NO: 7872059 - DNA, 22 bp, Homo sapiens
atatcacaggtgtttacctgat

SEQ ID NO: 7872060 - DNA, 22 bp, Homo sapiens
atatcacaggtgtttacctgat

SEQ ID NO: 7872061 - DNA, 22 bp, Homo sapiens
atatcacaggaaaggaagatac

SEQ ID NO: 7872062 - DNA, 22 bp, Homo sapiens
atatcacaggaaaggaagatac

SEQ ID NO: 7872063 - DNA, 22 bp, Homo sapiens
atatcacagtagttgtttagtt

SEQ ID NO: 7872064 - DNA, 22 bp, Homo sapiens
atatcacaggtgtttacctgat

SEQ ID NO: 7872065 - DNA, 22 bp, Homo sapiens
atatcacagtagttgtttagtt

SEQ ID NO: 7872066 - DNA, 22 bp, Homo sapiens
atatcacagtagttgtttagtt

SEQ ID NO: 7872067 - DNA, 22 bp, Homo sapiens
atatcacagatgcagaaagaga

SEQ ID NO: 7872068 - DNA, 23 bp, Homo sapiens
atatcacacccagtacagtctcc

SEQ ID NO: 7872069 - DNA, 22 bp, Homo sapiens
atatcacagctctttcattgct

SEQ ID NO: 7872070 - DNA, 23 bp, Homo sapiens
atatcacacccagtacagtctcc

SEQ ID NO: 7872071 - DNA, 23 bp, Homo sapiens
atatcacacccagtacagtctcc

SEQ ID NO: 7872072 - DNA, 23 bp, Homo sapiens
atatcacacccagtacagtctcc

SEQ ID NO: 7872073 - DNA, 23 bp, Homo sapiens
atatcacacccagtacagtctcc

SEQ ID NO: 7872074 - DNA, 21 bp, Homo sapiens
atatcacaaacatatggtctg

SEQ ID NO: 7872075 - DNA, 22 bp, Homo sapiens
atatcacaaacaagtctgtact

SEQ ID NO: 7872076 - DNA, 22 bp, Homo sapiens
atatcacaaacaagtctgtact

SEQ ID NO: 7872077 - DNA, 21 bp, Homo sapiens
atatcaatacagcaggacttc

SEQ ID NO: 7872078 - DNA, 22 bp, Homo sapiens
atatcaaagctagtggaaattt

SEQ ID NO: 7872079 - DNA, 22 bp, Homo sapiens
atatcaaagctagtggaaattt

SEQ ID NO: 7872080 - DNA, 22 bp, Homo sapiens
atatcaaagctagtggaaattt

SEQ ID NO: 7872081 - DNA, 22 bp, Homo sapiens
atatcaaagctagtggaaattt

SEQ ID NO: 7872082 - DNA, 22 bp, Homo sapiens
atatcaaagctagtggaaattt

SEQ ID NO: 7872083 - DNA, 22 bp, Homo sapiens
atatattttttgagacagagtc

SEQ ID NO: 7872084 - DNA, 22 bp, Homo sapiens
atatcaaaataaacagcatgca

SEQ ID NO: 7872085 - DNA, 22 bp, Homo sapiens
atatcaaaataaacagcatgca

SEQ ID NO: 7872086 - DNA, 22 bp, Homo sapiens
atatcaaaataaacagcatgca

SEQ ID NO: 7872087 - DNA, 22 bp, Homo sapiens
atatcaaacgaagttattttaa

SEQ ID NO: 7872088 - DNA, 22 bp, Homo sapiens
atatcaaagctagtggaaattt

SEQ ID NO: 7872089 - DNA, 22 bp, Homo sapiens
atatcaaacgaagttattttaa

SEQ ID NO: 7872090 - DNA, 22 bp, Homo sapiens
atatcaaacgaagttattttaa

SEQ ID NO: 7872091 - DNA, 22 bp, Homo sapiens
atatcaaacgaagttattttaa

SEQ ID NO: 7872092 - DNA, 22 bp, Homo sapiens
atatcaaacgaagttattttaa

SEQ ID NO: 7872093 - DNA, 22 bp, Homo sapiens
atatcattatgttatgagcaca

SEQ ID NO: 7872094 - DNA, 22 bp, Homo sapiens
atatcattctgatgtatatctt

SEQ ID NO: 7872095 - DNA, 22 bp, Homo sapiens
ctgggcagttcgctttcgtttt

SEQ ID NO: 7872096 - DNA, 22 bp, Homo sapiens
ctgggcagttcgctttcgtttt

SEQ ID NO: 7872097 - DNA, 22 bp, Homo sapiens
ctgggccagggaggtgtctgta

SEQ ID NO: 7872098 - DNA, 22 bp, Homo sapiens
ctgggccagtctcggccgctct

SEQ ID NO: 7872099 - DNA, 22 bp, Homo sapiens
ctgggccagtctcggccgctct

SEQ ID NO: 7872100 - DNA, 22 bp, Homo sapiens
ctgggccagtctcggccgctct

SEQ ID NO: 7872101 - DNA, 22 bp, Homo sapiens
ctgggccagggaggtgtctgta

SEQ ID NO: 7872102 - DNA, 22 bp, Homo sapiens
ctgggccagggaggtgtctgta

SEQ ID NO: 7872103 - DNA, 22 bp, Homo sapiens
ctgggccagtctcggccgctct

SEQ ID NO: 7872104 - DNA, 22 bp, Homo sapiens
ctgggccagttatgtctcatct

SEQ ID NO: 7872105 - DNA, 22 bp, Homo sapiens
ctgggccatcagaggggctgga

SEQ ID NO: 7872106 - DNA, 22 bp, Homo sapiens
ctgggccatcagaggggctgga

SEQ ID NO: 7872107 - DNA, 22 bp, Homo sapiens
ctgggccatctctctgcaagtg

SEQ ID NO: 7872108 - DNA, 22 bp, Homo sapiens
ctgggccatcagaggggctgga

SEQ ID NO: 7872109 - DNA, 22 bp, Homo sapiens
ctgggccatcagaggggctgga

SEQ ID NO: 7872110 - DNA, 22 bp, Homo sapiens
ctgggccatggaagtctctgcc

SEQ ID NO: 7872111 - DNA, 22 bp, Homo sapiens
ctgggccatgggccagcgaggc

SEQ ID NO: 7872112 - DNA, 22 bp, Homo sapiens
ctgggccatgggccagcgaggc

SEQ ID NO: 7872113 - DNA, 22 bp, Homo sapiens
ctgggccatgggccagcgaggc

SEQ ID NO: 7872114 - DNA, 22 bp, Homo sapiens
ctgggccatgggccagcgaggc

SEQ ID NO: 7872115 - DNA, 22 bp, Homo sapiens
ctgggccatgggccagcgaggc

SEQ ID NO: 7872116 - DNA, 22 bp, Homo sapiens
ctgggccatgggccagcgaggc

SEQ ID NO: 7872117 - DNA, 22 bp, Homo sapiens
ctgggccatggaagtctctgcc

SEQ ID NO: 7872118 - DNA, 22 bp, Homo sapiens
ctgggccatgggccagcgaggc

SEQ ID NO: 7872119 - DNA, 22 bp, Homo sapiens
ctgggccatctctctgcaagtg

SEQ ID NO: 7872120 - DNA, 22 bp, Homo sapiens
ctgggccatctctctgcaagtg

SEQ ID NO: 7872121 - DNA, 22 bp, Homo sapiens
ctgggccatggaagtctctgcc

SEQ ID NO: 7872122 - DNA, 22 bp, Homo sapiens
ctgggccatctctctgcaagtg

SEQ ID NO: 7872123 - DNA, 22 bp, Homo sapiens
ctgggccatctctctgcaagtg

SEQ ID NO: 7872124 - DNA, 22 bp, Homo sapiens
ctgggccatgggccagcgaggc

SEQ ID NO: 7872125 - DNA, 22 bp, Homo sapiens
ctgggccatgggccagcgaggc

SEQ ID NO: 7872126 - DNA, 22 bp, Homo sapiens
ctgggcctctcagctcccgcgg

SEQ ID NO: 7872127 - DNA, 22 bp, Homo sapiens
ctgggcctctcagctcccgcgg

SEQ ID NO: 7872128 - DNA, 17 bp, Homo sapiens
ctgggcctctgcccttt

SEQ ID NO: 7872129 - DNA, 17 bp, Homo sapiens
ctgggcctctgcccttt

SEQ ID NO: 7872130 - DNA, 17 bp, Homo sapiens
ctgggcctctgcccttt

SEQ ID NO: 7872131 - DNA, 17 bp, Homo sapiens
ctgggcctctgcccttt

SEQ ID NO: 7872132 - DNA, 22 bp, Homo sapiens
ctgggcctctcagctcccgcgg

SEQ ID NO: 7872133 - DNA, 22 bp, Homo sapiens
ctgggcctctcagctcccgcgg

SEQ ID NO: 7872134 - DNA, 17 bp, Homo sapiens
ctgggcctctgcccttt

SEQ ID NO: 7872135 - DNA, 17 bp, Homo sapiens
ctgggcctctgcccttt

SEQ ID NO: 7872136 - DNA, 22 bp, Homo sapiens
ctgggctgtaatgtggcactga

SEQ ID NO: 7872137 - DNA, 22 bp, Homo sapiens
ctgggctgtaatgtggcactga

SEQ ID NO: 7872138 - DNA, 22 bp, Homo sapiens
ctgggctgtaatgtggcactga

SEQ ID NO: 7872139 - DNA, 22 bp, Homo sapiens
ctgggctgtaatgtggcactga

SEQ ID NO: 7872140 - DNA, 22 bp, Homo sapiens
ctgggctgtcaatggccctctg

SEQ ID NO: 7872141 - DNA, 22 bp, Homo sapiens
ctgggctgtaatgtggcactga

SEQ ID NO: 7872142 - DNA, 22 bp, Homo sapiens
ctgggctgtcaatggccctctg

SEQ ID NO: 7872143 - DNA, 22 bp, Homo sapiens
ctgggctgtaatgtggcactga

SEQ ID NO: 7872144 - DNA, 22 bp, Homo sapiens
ctgggctgggtttaccctcttc

SEQ ID NO: 7872145 - DNA, 22 bp, Homo sapiens
ctgggctgtaatgtggcactga

SEQ ID NO: 7872146 - DNA, 22 bp, Homo sapiens
ctgggctgtaatgtggcactga

SEQ ID NO: 7872147 - DNA, 22 bp, Homo sapiens
ctgggctgtaatgtggcactga

SEQ ID NO: 7872148 - DNA, 22 bp, Homo sapiens
ctgggctgggtttaccctcttc

SEQ ID NO: 7872149 - DNA, 20 bp, Homo sapiens
ctgggctgggctacagggtc

SEQ ID NO: 7872150 - DNA, 20 bp, Homo sapiens
ctgggctgggctacagggtc

SEQ ID NO: 7872151 - DNA, 22 bp, Homo sapiens
ctgggcctggggctgttgagag

SEQ ID NO: 7872152 - DNA, 22 bp, Homo sapiens
ctgggcctggggctgttgagag

SEQ ID NO: 7872153 - DNA, 22 bp, Homo sapiens
ctgggctgatttagtcacgttt

SEQ ID NO: 7872154 - DNA, 22 bp, Homo sapiens
ctgggctgatttagtcacgttt

SEQ ID NO: 7872155 - DNA, 22 bp, Homo sapiens
ctgggctgatttagtcacgttt

SEQ ID NO: 7872156 - DNA, 22 bp, Homo sapiens
ctgggctgatttagtcacgttt

SEQ ID NO: 7872157 - DNA, 22 bp, Homo sapiens
ctgggcctgggaggccaggtct

SEQ ID NO: 7872158 - DNA, 22 bp, Homo sapiens
ctgggcctggggctgttgagag

SEQ ID NO: 7872159 - DNA, 20 bp, Homo sapiens
ctgggctgggctacagggtc

SEQ ID NO: 7872160 - DNA, 20 bp, Homo sapiens
ctgggctgggctacagggtc

SEQ ID NO: 7872161 - DNA, 20 bp, Homo sapiens
ctgggctgggctacagggtc

SEQ ID NO: 7872162 - DNA, 20 bp, Homo sapiens
ctgggctgggctacagggtc

SEQ ID NO: 7872163 - DNA, 22 bp, Homo sapiens
ctgggctgcagcgggagcgacg

SEQ ID NO: 7872164 - DNA, 22 bp, Homo sapiens
ctgggctgatttagtcacgttt

SEQ ID NO: 7872165 - DNA, 22 bp, Homo sapiens
ctgggctgatttagtcacgttt

SEQ ID NO: 7872166 - DNA, 22 bp, Homo sapiens
ctgggctgcagcgggagcgacg

SEQ ID NO: 7872167 - DNA, 22 bp, Homo sapiens
ctgggctgcagcgggagcgacg

SEQ ID NO: 7872168 - DNA, 17 bp, Homo sapiens
ctgggcctctgcccttt

SEQ ID NO: 7872169 - DNA, 22 bp, Homo sapiens
ctgggcctgagctctgaagagt

SEQ ID NO: 7872170 - DNA, 22 bp, Homo sapiens
ctgggcctgagctctgaagagt

SEQ ID NO: 7872171 - DNA, 22 bp, Homo sapiens
ctgggcctgagctctgaagagt

SEQ ID NO: 7872172 - DNA, 22 bp, Homo sapiens
ctgggcctgagctctgaagagt

SEQ ID NO: 7872173 - DNA, 22 bp, Homo sapiens
ctgggcctgagctctgaagagt

SEQ ID NO: 7872174 - DNA, 22 bp, Homo sapiens
ctgggcctgagctctgaagagt

SEQ ID NO: 7872175 - DNA, 19 bp, Homo sapiens
ctgggcctgcatggttgtt

SEQ ID NO: 7872176 - DNA, 19 bp, Homo sapiens
ctgggcctgcatggttgtt

SEQ ID NO: 7872177 - DNA, 22 bp, Homo sapiens
ctgggcctgccaccatcttagg

SEQ ID NO: 7872178 - DNA, 22 bp, Homo sapiens
ctgggcctgccaccatcttagg

SEQ ID NO: 7872179 - DNA, 22 bp, Homo sapiens
ctgggcctgccaccatcttagg

SEQ ID NO: 7872180 - DNA, 22 bp, Homo sapiens
ctgggcctggacgggcagatct

SEQ ID NO: 7872181 - DNA, 22 bp, Homo sapiens
ctgggcctggacgggcagatct

SEQ ID NO: 7872182 - DNA, 22 bp, Homo sapiens
ctgggcctggacgggcagatct

SEQ ID NO: 7872183 - DNA, 22 bp, Homo sapiens
ctgggcctggacgggcagatct

SEQ ID NO: 7872184 - DNA, 22 bp, Homo sapiens
ctgggcctgggaggccaggtct

SEQ ID NO: 7872185 - DNA, 22 bp, Homo sapiens
ctgggcctgggaggccaggtct

SEQ ID NO: 7872186 - DNA, 22 bp, Homo sapiens
ctgggcctgggaggccaggtct

SEQ ID NO: 7872187 - DNA, 22 bp, Homo sapiens
ctgggcctggcgttccaggctg

SEQ ID NO: 7872188 - DNA, 22 bp, Homo sapiens
ctgggcctggcgttccaggctg

SEQ ID NO: 7872189 - DNA, 22 bp, Homo sapiens
ctgggcctgggaggccaggtct

SEQ ID NO: 7872190 - DNA, 22 bp, Homo sapiens
ctgggcctggcgttccaggctg

SEQ ID NO: 7872191 - DNA, 22 bp, Homo sapiens
ctgggcctggagcccacgagcc

SEQ ID NO: 7872192 - DNA, 22 bp, Homo sapiens
ctgggcctggacgggcagatct

SEQ ID NO: 7872193 - DNA, 22 bp, Homo sapiens
ctgggcctggagcccacgagcc

SEQ ID NO: 7872194 - DNA, 22 bp, Homo sapiens
ctgggcctggcgttccaggctg

SEQ ID NO: 7872195 - DNA, 22 bp, Homo sapiens
ctgggcctggcgttccaggctg

SEQ ID NO: 7872196 - DNA, 22 bp, Homo sapiens
ctgggcctggagcccacgagcc

SEQ ID NO: 7872197 - DNA, 22 bp, Homo sapiens
ctgggcctggcgttccaggctg

SEQ ID NO: 7872198 - DNA, 22 bp, Homo sapiens
ctgggcctggagcccacgagcc

SEQ ID NO: 7872199 - DNA, 22 bp, Homo sapiens
ctgtatgtttctatgaatgtga

SEQ ID NO: 7872200 - DNA, 22 bp, Homo sapiens
ctgtatgtcttgtgaattgtag

SEQ ID NO: 7872201 - DNA, 22 bp, Homo sapiens
ctgtattcaagcttctgcccaa

SEQ ID NO: 7872202 - DNA, 22 bp, Homo sapiens
ctgtattcaaagtgaggatgta

SEQ ID NO: 7872203 - DNA, 22 bp, Homo sapiens
ctgtattaaaggcagtgatctt

SEQ ID NO: 7872204 - DNA, 22 bp, Homo sapiens
ctgtattaaaggcagtgatctt

SEQ ID NO: 7872205 - DNA, 22 bp, Homo sapiens
ctgtattagccaggtgcacaag

SEQ ID NO: 7872206 - DNA, 22 bp, Homo sapiens
ctgtatttcccacattctctat

SEQ ID NO: 7872207 - DNA, 22 bp, Homo sapiens
ctgtatttcccacattctctat

SEQ ID NO: 7872208 - DNA, 22 bp, Homo sapiens
ctgtatttcttggacagttgct

SEQ ID NO: 7872209 - DNA, 22 bp, Homo sapiens
ctgtatttgaaagaaaagattt

SEQ ID NO: 7872210 - DNA, 22 bp, Homo sapiens
ctgtatttcttggacagttgct

SEQ ID NO: 7872211 - DNA, 22 bp, Homo sapiens
ctgtattgaagtgttggctgag

SEQ ID NO: 7872212 - DNA, 22 bp, Homo sapiens
ctgtattgaagtgttggctgag

SEQ ID NO: 7872213 - DNA, 22 bp, Homo sapiens
ctgtattcaagcttctgcccaa

SEQ ID NO: 7872214 - DNA, 22 bp, Homo sapiens
ctgtattctgggcagggaagga

SEQ ID NO: 7872215 - DNA, 22 bp, Homo sapiens
ctgtatttagttaaaatgctaa

SEQ ID NO: 7872216 - DNA, 22 bp, Homo sapiens
ctgtatttagttaaaatgctaa

SEQ ID NO: 7872217 - DNA, 22 bp, Homo sapiens
ctgtatttagttaaaatgctaa

SEQ ID NO: 7872218 - DNA, 22 bp, Homo sapiens
ctgtatttagttaaaatgctaa

SEQ ID NO: 7872219 - DNA, 22 bp, Homo sapiens
ctgtatttagttaaaatgctaa

SEQ ID NO: 7872220 - DNA, 22 bp, Homo sapiens
ctgtccagaaagggggcaacaa

SEQ ID NO: 7872221 - DNA, 22 bp, Homo sapiens
ctgtccacctactgactagttg

SEQ ID NO: 7872222 - DNA, 22 bp, Homo sapiens
ctgtccacatggagaacctggt

SEQ ID NO: 7872223 - DNA, 22 bp, Homo sapiens
ctgtccacatggagaacctggt

SEQ ID NO: 7872224 - DNA, 21 bp, Homo sapiens
ctgtccacatcacagagcctc

SEQ ID NO: 7872225 - DNA, 21 bp, Homo sapiens
ctgtccacatcacagagcctc

SEQ ID NO: 7872226 - DNA, 21 bp, Homo sapiens
ctgtccacatcacagagcctc

SEQ ID NO: 7872227 - DNA, 22 bp, Homo sapiens
ctgtcatttttttagaacacct

SEQ ID NO: 7872228 - DNA, 22 bp, Homo sapiens
ctgtcattttcttccaatataa

SEQ ID NO: 7872229 - DNA, 22 bp, Homo sapiens
ctgtcatttaagacattctgga

SEQ ID NO: 7872230 - DNA, 22 bp, Homo sapiens
ctgtcatttaagacattctgga

SEQ ID NO: 7872231 - DNA, 22 bp, Homo sapiens
ctgtcatttaagacattctgga

SEQ ID NO: 7872232 - DNA, 22 bp, Homo sapiens
ctgtcatttctttagcaatggg

SEQ ID NO: 7872233 - DNA, 22 bp, Homo sapiens
ctgtccagctgaccagagcagc

SEQ ID NO: 7872234 - DNA, 22 bp, Homo sapiens
ctgtccagctgaccagagcagc

SEQ ID NO: 7872235 - DNA, 22 bp, Homo sapiens
ctgtccagctgaccagagcagc

SEQ ID NO: 7872236 - DNA, 22 bp, Homo sapiens
ctgtccagcttggctcctgggg

SEQ ID NO: 7872237 - DNA, 22 bp, Homo sapiens
ctgtccagcttggctcctgggg

SEQ ID NO: 7872238 - DNA, 22 bp, Homo sapiens
ctgtccagcttggctcctgggg

SEQ ID NO: 7872239 - DNA, 22 bp, Homo sapiens
ctgtccagctgaccagagcagc

SEQ ID NO: 7872240 - DNA, 22 bp, Homo sapiens
ctgtccagctgaccagagcagc

SEQ ID NO: 7872241 - DNA, 22 bp, Homo sapiens
ctgtccagctgaccagagcagc

SEQ ID NO: 7872242 - DNA, 22 bp, Homo sapiens
ctgtccagcgactaggggatgg

SEQ ID NO: 7872243 - DNA, 16 bp, Homo sapiens
ctgtccagcatctgcc

SEQ ID NO: 7872244 - DNA, 22 bp, Homo sapiens
ctgtccagcgactaggggatgg

SEQ ID NO: 7872245 - DNA, 22 bp, Homo sapiens
ctgtccagctgaccagagcagc

SEQ ID NO: 7872246 - DNA, 22 bp, Homo sapiens
ctgtccagaaagggggcaacaa

SEQ ID NO: 7872247 - DNA, 22 bp, Homo sapiens
ctgtccagaaagggggcaacaa

SEQ ID NO: 7872248 - DNA, 16 bp, Homo sapiens
ctgtccagcatctgcc

SEQ ID NO: 7872249 - DNA, 22 bp, Homo sapiens
ctgtccagcacatgtctgcccc

SEQ ID NO: 7872250 - DNA, 22 bp, Homo sapiens
ctgtccagaataggcaaatcca

SEQ ID NO: 7872251 - DNA, 22 bp, Homo sapiens
atatttgttagagtctatgtgt

SEQ ID NO: 7872252 - DNA, 22 bp, Homo sapiens
ctggtggggagtcctggtctcc

SEQ ID NO: 7872253 - DNA, 22 bp, Homo sapiens
atatttgttagagtctatgtgt

SEQ ID NO: 7872254 - DNA, 22 bp, Homo sapiens
atatttgttagagtctatgtgt

SEQ ID NO: 7872255 - DNA, 22 bp, Homo sapiens
atatttgttgagttcttatgat

SEQ ID NO: 7872256 - DNA, 22 bp, Homo sapiens
atatttgttgagttcttatgat

SEQ ID NO: 7872257 - DNA, 22 bp, Homo sapiens
atatttgtttggcagagttcag

SEQ ID NO: 7872258 - DNA, 22 bp, Homo sapiens
atatttgtttggcagagttcag

SEQ ID NO: 7872259 - DNA, 22 bp, Homo sapiens
atattttcacagaacttgcaaa

SEQ ID NO: 7872260 - DNA, 22 bp, Homo sapiens
atattttcacagaacttgcaaa

SEQ ID NO: 7872261 - DNA, 22 bp, Homo sapiens
atattttcacagaacttgcaaa

SEQ ID NO: 7872262 - DNA, 22 bp, Homo sapiens
atattttcactgaaccaaagta

SEQ ID NO: 7872263 - DNA, 22 bp, Homo sapiens
atattttcactgaaccaaagta

SEQ ID NO: 7872264 - DNA, 22 bp, Homo sapiens
atattttcactgaaccaaagta

SEQ ID NO: 7872265 - DNA, 22 bp, Homo sapiens
atattttcactgaaccaaagta

SEQ ID NO: 7872266 - DNA, 22 bp, Homo sapiens
atattttcacagaacttgcaaa

SEQ ID NO: 7872267 - DNA, 22 bp, Homo sapiens
atattttcactgaaccaaagta

SEQ ID NO: 7872268 - DNA, 22 bp, Homo sapiens
atattttcactgaaccaaagta

SEQ ID NO: 7872269 - DNA, 22 bp, Homo sapiens
atattttgaagttaataatgtg

SEQ ID NO: 7872270 - DNA, 22 bp, Homo sapiens
atattttctggaactatgcctg

SEQ ID NO: 7872271 - DNA, 22 bp, Homo sapiens
atattttctggaactatgcctg

SEQ ID NO: 7872272 - DNA, 22 bp, Homo sapiens
atattttccgaacttgaggtag

SEQ ID NO: 7872273 - DNA, 22 bp, Homo sapiens
atattttccgaacttgaggtag

SEQ ID NO: 7872274 - DNA, 22 bp, Homo sapiens
atattttgaagttaataatgtg

SEQ ID NO: 7872275 - DNA, 22 bp, Homo sapiens
atattttgaagttaataatgtg

SEQ ID NO: 7872276 - DNA, 22 bp, Homo sapiens
atattttgaagttaataatgtg

SEQ ID NO: 7872277 - DNA, 22 bp, Homo sapiens
atattttggcaaatgtctagat

SEQ ID NO: 7872278 - DNA, 22 bp, Homo sapiens
atattttctggaactatgcctg

SEQ ID NO: 7872279 - DNA, 22 bp, Homo sapiens
atattttggcaaatgtctagat

SEQ ID NO: 7872280 - DNA, 22 bp, Homo sapiens
ctgtaatcccagctactcggga

SEQ ID NO: 7872281 - DNA, 22 bp, Homo sapiens
ctgtaatcccagctactcggga

SEQ ID NO: 7872282 - DNA, 22 bp, Homo sapiens
ctgtaatcccagctactcggga

SEQ ID NO: 7872283 - DNA, 22 bp, Homo sapiens
ctgtaatcccagctactcggga

SEQ ID NO: 7872284 - DNA, 22 bp, Homo sapiens
ctgtaattcactagggtcagcg

SEQ ID NO: 7872285 - DNA, 22 bp, Homo sapiens
ctgtatgattccatttctataa

SEQ ID NO: 7872286 - DNA, 22 bp, Homo sapiens
ctgtatgagttgggaatagaat

SEQ ID NO: 7872287 - DNA, 22 bp, Homo sapiens
ctgtatgaaattgtcattttta

SEQ ID NO: 7872288 - DNA, 22 bp, Homo sapiens
ctgtatgaacccatatacttat

SEQ ID NO: 7872289 - DNA, 22 bp, Homo sapiens
ctgtatctgtgttggatgagtt

SEQ ID NO: 7872290 - DNA, 22 bp, Homo sapiens
ctgtatctgtgttggatgagtt

SEQ ID NO: 7872291 - DNA, 22 bp, Homo sapiens
ctgtatatgtgcatacacacac

SEQ ID NO: 7872292 - DNA, 20 bp, Homo sapiens
ctgtatcaggttacaaagta

SEQ ID NO: 7872293 - DNA, 22 bp, Homo sapiens
ctgtatatgtgcatacacacac

SEQ ID NO: 7872294 - DNA, 22 bp, Homo sapiens
ctggggcagagcccagcaattt

SEQ ID NO: 7872295 - DNA, 22 bp, Homo sapiens
ctggggcagagcccagcaattt

SEQ ID NO: 7872296 - DNA, 22 bp, Homo sapiens
ctggggcagagcccagcaattt

SEQ ID NO: 7872297 - DNA, 22 bp, Homo sapiens
ctggggcagagcctttagcaaa

SEQ ID NO: 7872298 - DNA, 22 bp, Homo sapiens
ctggggcagagcccagcaattt

SEQ ID NO: 7872299 - DNA, 17 bp, Homo sapiens
ctggggatgtgggactc

SEQ ID NO: 7872300 - DNA, 22 bp, Homo sapiens
ctggggcatcatccattctttc

SEQ ID NO: 7872301 - DNA, 22 bp, Homo sapiens
ctggggcatcatccattctttc

SEQ ID NO: 7872302 - DNA, 22 bp, Homo sapiens
ctggggcagagcctttagcaaa

SEQ ID NO: 7872303 - DNA, 22 bp, Homo sapiens
ctggggcagagcctttagcaaa

SEQ ID NO: 7872304 - DNA, 22 bp, Homo sapiens
ctggggcatcatccattctttc

SEQ ID NO: 7872305 - DNA, 22 bp, Homo sapiens
ctggtcctctccagcaggcatt

SEQ ID NO: 7872306 - DNA, 22 bp, Homo sapiens
ctggtcctctccagcaggcatt

SEQ ID NO: 7872307 - DNA, 22 bp, Homo sapiens
ctggtcctctccagcaggcatt

SEQ ID NO: 7872308 - DNA, 22 bp, Homo sapiens
ctggtcctctccagcaggcatt

SEQ ID NO: 7872309 - DNA, 19 bp, Homo sapiens
ctggtcctgactgaggggt

SEQ ID NO: 7872310 - DNA, 19 bp, Homo sapiens
ctggtcctgactgaggggt

SEQ ID NO: 7872311 - DNA, 22 bp, Homo sapiens
ctggtggagagtgggctctgga

SEQ ID NO: 7872312 - DNA, 22 bp, Homo sapiens
ctggtggagagtgggctctgga

SEQ ID NO: 7872313 - DNA, 22 bp, Homo sapiens
ctggtggaatggcagagggaac

SEQ ID NO: 7872314 - DNA, 22 bp, Homo sapiens
ctggtggagagtgggctctgga

SEQ ID NO: 7872315 - DNA, 22 bp, Homo sapiens
ctggtggaagcctgggctcaga

SEQ ID NO: 7872316 - DNA, 22 bp, Homo sapiens
ctggtggaatggcagagggaac

SEQ ID NO: 7872317 - DNA, 19 bp, Homo sapiens
ctggtgcttgagtgagtca

SEQ ID NO: 7872318 - DNA, 22 bp, Homo sapiens
ctggtccttgacgcgtgggagg

SEQ ID NO: 7872319 - DNA, 22 bp, Homo sapiens
ctggtccttgacgcgtgggagg

SEQ ID NO: 7872320 - DNA, 22 bp, Homo sapiens
ctggtgctggcaacagagtagg

SEQ ID NO: 7872321 - DNA, 22 bp, Homo sapiens
ctggtgctggcaacagagtagg

SEQ ID NO: 7872322 - DNA, 22 bp, Homo sapiens
ctggtgctggcaacagagtagg

SEQ ID NO: 7872323 - DNA, 22 bp, Homo sapiens
ctggtgctgggcagggctcagg

SEQ ID NO: 7872324 - DNA, 19 bp, Homo sapiens
ctggtgcttgagtgagtca

SEQ ID NO: 7872325 - DNA, 22 bp, Homo sapiens
ctggtgctggcaacagagtagg

SEQ ID NO: 7872326 - DNA, 22 bp, Homo sapiens
ctggtgctgggcagggctcagg

SEQ ID NO: 7872327 - DNA, 22 bp, Homo sapiens
ctggtgggagcagcaggcagct

SEQ ID NO: 7872328 - DNA, 22 bp, Homo sapiens
ctggtgggagcagcaggcagct

SEQ ID NO: 7872329 - DNA, 22 bp, Homo sapiens
ctggtgggagcagcaggcagct

SEQ ID NO: 7872330 - DNA, 22 bp, Homo sapiens
ctggtgggagcagcaggcagct

SEQ ID NO: 7872331 - DNA, 22 bp, Homo sapiens
ctggtgggagcagcaggcagct

SEQ ID NO: 7872332 - DNA, 22 bp, Homo sapiens
ctggtgggagcagcaggcagct

SEQ ID NO: 7872333 - DNA, 22 bp, Homo sapiens
atatttgttagagtctatgtgt

SEQ ID NO: 7872334 - DNA, 22 bp, Homo sapiens
ctggtgggaggcaaggtggaag

SEQ ID NO: 7872335 - DNA, 22 bp, Homo sapiens
ctggtggggagtcctggtctcc

SEQ ID NO: 7872336 - DNA, 22 bp, Homo sapiens
ctggtgggaggcaaggtggaag

SEQ ID NO: 7872337 - DNA, 22 bp, Homo sapiens
ctggtgggagcagcaggcagct

SEQ ID NO: 7872338 - DNA, 22 bp, Homo sapiens
ctggtgggaggcaaggtggaag

SEQ ID NO: 7872339 - DNA, 22 bp, Homo sapiens
ctggtgggaggcaaggtggaag

SEQ ID NO: 7872340 - DNA, 22 bp, Homo sapiens
ctggtgggaggcaaggtggaag

SEQ ID NO: 7872341 - DNA, 22 bp, Homo sapiens
ctggtgggaggcaaggtggaag

SEQ ID NO: 7872342 - DNA, 22 bp, Homo sapiens
ctggtgggagataattgaatca

SEQ ID NO: 7872343 - DNA, 22 bp, Homo sapiens
ctggtgggaagatggaaaacat

SEQ ID NO: 7872344 - DNA, 22 bp, Homo sapiens
ctggtgggaagatggaaaacat

SEQ ID NO: 7872345 - DNA, 22 bp, Homo sapiens
ctggtgggaagatggaaaacat

SEQ ID NO: 7872346 - DNA, 22 bp, Homo sapiens
ctggtggcatcttgagatggtt

SEQ ID NO: 7872347 - DNA, 22 bp, Homo sapiens
ctggtggcatcttgagatggtt

SEQ ID NO: 7872348 - DNA, 22 bp, Homo sapiens
ctggtggcatcttgagatggtt

SEQ ID NO: 7872349 - DNA, 22 bp, Homo sapiens
ctggtggcatcttgagatggtt

SEQ ID NO: 7872350 - DNA, 22 bp, Homo sapiens
ctggtggcatcttgagatggtt

SEQ ID NO: 7872351 - DNA, 22 bp, Homo sapiens
ctggtggagatgcctggcccct

SEQ ID NO: 7872352 - DNA, 22 bp, Homo sapiens
ctggtggagagtgggctctgga

SEQ ID NO: 7872353 - DNA, 22 bp, Homo sapiens
ctggtggagggacaggcttagc

SEQ ID NO: 7872354 - DNA, 22 bp, Homo sapiens
ctggtggagggacaggcttagc

SEQ ID NO: 7872355 - DNA, 22 bp, Homo sapiens
ctggtggagatgcctggcccct

SEQ ID NO: 7872356 - DNA, 22 bp, Homo sapiens
ctggtggaggtgccaggatttg

SEQ ID NO: 7872357 - DNA, 22 bp, Homo sapiens
ctggtggcaatgaggcgtcact

SEQ ID NO: 7872358 - DNA, 22 bp, Homo sapiens
ctggtggcaatgaggcgtcact

SEQ ID NO: 7872359 - DNA, 22 bp, Homo sapiens
ctggtggcaatgaggcgtcact

SEQ ID NO: 7872360 - DNA, 22 bp, Homo sapiens
ctggtggcaatgaggcgtcact

SEQ ID NO: 7872361 - DNA, 22 bp, Homo sapiens
ctgggctgtcaatggccctctg

SEQ ID NO: 7872362 - DNA, 22 bp, Homo sapiens
ctgggctgtcccaaccccatcc

SEQ ID NO: 7872363 - DNA, 22 bp, Homo sapiens
ctgggctgtcaatggccctctg

SEQ ID NO: 7872364 - DNA, 22 bp, Homo sapiens
ctgggctgtcaatggccctctg

SEQ ID NO: 7872365 - DNA, 22 bp, Homo sapiens
ctgggctgtcagttttgtttta

SEQ ID NO: 7872366 - DNA, 22 bp, Homo sapiens
ctgggctgtcccagggcggcag

SEQ ID NO: 7872367 - DNA, 22 bp, Homo sapiens
ctgggctgtcccagggcggcag

SEQ ID NO: 7872368 - DNA, 22 bp, Homo sapiens
ctgggctgtcccagggcggcag

SEQ ID NO: 7872369 - DNA, 22 bp, Homo sapiens
ctgggctgtcccagggcggcag

SEQ ID NO: 7872370 - DNA, 22 bp, Homo sapiens
ctgggctgtcccaaccccatcc

SEQ ID NO: 7872371 - DNA, 22 bp, Homo sapiens
ctgggctgtcccagggcggcag

SEQ ID NO: 7872372 - DNA, 23 bp, Homo sapiens
ctgggctgtcctgaggtcacctc

SEQ ID NO: 7872373 - DNA, 23 bp, Homo sapiens
ctgggctgtcctgaggtcacctc

SEQ ID NO: 7872374 - DNA, 23 bp, Homo sapiens
ctgggctgtcctgaggtcacctc

SEQ ID NO: 7872375 - DNA, 22 bp, Homo sapiens
ctgggctgtggtgtggcccaaa

SEQ ID NO: 7872376 - DNA, 22 bp, Homo sapiens
ctgggctgtggtgtggcccaaa

SEQ ID NO: 7872377 - DNA, 22 bp, Homo sapiens
ctgggctgtcccagggcggcag

SEQ ID NO: 7872378 - DNA, 23 bp, Homo sapiens
ctgggctgtcctgaggtcacctc

SEQ ID NO: 7872379 - DNA, 23 bp, Homo sapiens
ctgggctgtcctgaggtcacctc

SEQ ID NO: 7872380 - DNA, 23 bp, Homo sapiens
ctgggctgtcctgaggtcacctc

SEQ ID NO: 7872381 - DNA, 23 bp, Homo sapiens
ctgggctgtcctgaggtcacctc

SEQ ID NO: 7872382 - DNA, 23 bp, Homo sapiens
ctgggctgtcctgaggtcacctc

SEQ ID NO: 7872383 - DNA, 22 bp, Homo sapiens
ctgggctgtggtgtggcccaaa

SEQ ID NO: 7872384 - DNA, 22 bp, Homo sapiens
ctgggctgtggtgtggcccaaa

SEQ ID NO: 7872385 - DNA, 22 bp, Homo sapiens
ctgggctgtggtgtggcccaaa

SEQ ID NO: 7872386 - DNA, 22 bp, Homo sapiens
ctgggctgtggtgtggcccaaa

SEQ ID NO: 7872387 - DNA, 22 bp, Homo sapiens
ctgggctgtggtgtggcccaaa

SEQ ID NO: 7872388 - DNA, 22 bp, Homo sapiens
ctgggctgtggtgtggcccaaa

SEQ ID NO: 7872389 - DNA, 22 bp, Homo sapiens
ctgggctgttctgcccctgggt

SEQ ID NO: 7872390 - DNA, 22 bp, Homo sapiens
ctgggctgttctgcccctgggt

SEQ ID NO: 7872391 - DNA, 22 bp, Homo sapiens
ctgggctgtggtgtggcccaaa

SEQ ID NO: 7872392 - DNA, 22 bp, Homo sapiens
ctggggaggatgctacgacctg

SEQ ID NO: 7872393 - DNA, 22 bp, Homo sapiens
ctggggaggatgctacgacctg

SEQ ID NO: 7872394 - DNA, 22 bp, Homo sapiens
ctggggaggatgctacgacctg

SEQ ID NO: 7872395 - DNA, 22 bp, Homo sapiens
ctggggaggatgctacgacctg

SEQ ID NO: 7872396 - DNA, 22 bp, Homo sapiens
ctggggaggatgctacgacctg

SEQ ID NO: 7872397 - DNA, 20 bp, Homo sapiens
ctggggaggaggatgtgttc

SEQ ID NO: 7872398 - DNA, 22 bp, Homo sapiens
ctgggctgttctgcccctgggt

SEQ ID NO: 7872399 - DNA, 22 bp, Homo sapiens
ctggggaggcagggctgcccct

SEQ ID NO: 7872400 - DNA, 22 bp, Homo sapiens
ctggggaggcagggctgcccct

SEQ ID NO: 7872401 - DNA, 22 bp, Homo sapiens
ctggggaggcagggctgcccct

SEQ ID NO: 7872402 - DNA, 22 bp, Homo sapiens
ctggggaggcagggctgcccct

SEQ ID NO: 7872403 - DNA, 22 bp, Homo sapiens
ctggggaggatgctacgacctg

SEQ ID NO: 7872404 - DNA, 22 bp, Homo sapiens
ctggggaggcagggctgcccct

SEQ ID NO: 7872405 - DNA, 22 bp, Homo sapiens
ctggggaggcagggctgcccct

SEQ ID NO: 7872406 - DNA, 22 bp, Homo sapiens
ctggggaggcagggctgcccct

SEQ ID NO: 7872407 - DNA, 22 bp, Homo sapiens
ctggggagtgaaattcttaaat

SEQ ID NO: 7872408 - DNA, 22 bp, Homo sapiens
ctggggagtgaaattcttaaat

SEQ ID NO: 7872409 - DNA, 22 bp, Homo sapiens
ctggggagtgaaattcttaaat

SEQ ID NO: 7872410 - DNA, 22 bp, Homo sapiens
ctggggagtgaaattcttaaat

SEQ ID NO: 7872411 - DNA, 22 bp, Homo sapiens
ctggggagtgaaggtaattaca

SEQ ID NO: 7872412 - DNA, 22 bp, Homo sapiens
ctggggatcctttttgcatcta

SEQ ID NO: 7872413 - DNA, 22 bp, Homo sapiens
ctggggatcctttttgcatcta

SEQ ID NO: 7872414 - DNA, 22 bp, Homo sapiens
ctggggatgggacctggcataa

SEQ ID NO: 7872415 - DNA, 22 bp, Homo sapiens
ctggggatgggacctggcataa

SEQ ID NO: 7872416 - DNA, 22 bp, Homo sapiens
ctggggatgggacctggcataa

SEQ ID NO: 7872417 - DNA, 22 bp, Homo sapiens
ctggggatgggacctggcataa

SEQ ID NO: 7872418 - DNA, 22 bp, Homo sapiens
aggctctgtgcatcctccccaa

SEQ ID NO: 7872419 - DNA, 22 bp, Homo sapiens
aggctctgtgcatcctccccaa

SEQ ID NO: 7872420 - DNA, 22 bp, Homo sapiens
aggctctgtgcatcctccccaa

SEQ ID NO: 7872421 - DNA, 22 bp, Homo sapiens
aggctctgttattctagagggc

SEQ ID NO: 7872422 - DNA, 22 bp, Homo sapiens
aggctgaggcgggtagatcacc

SEQ ID NO: 7872423 - DNA, 22 bp, Homo sapiens
aggctctgtgcatcctccccaa

SEQ ID NO: 7872424 - DNA, 22 bp, Homo sapiens
aggctgaggcgggtagatcacc

SEQ ID NO: 7872425 - DNA, 22 bp, Homo sapiens
aggctgaggggcgagggaccct

SEQ ID NO: 7872426 - DNA, 22 bp, Homo sapiens
aggctgaggggcgagggaccct

SEQ ID NO: 7872427 - DNA, 22 bp, Homo sapiens
aggctgaggcgggtagatcacc

SEQ ID NO: 7872428 - DNA, 22 bp, Homo sapiens
aggctgaggggcgagggaccct

SEQ ID NO: 7872429 - DNA, 22 bp, Homo sapiens
aggctgaggggcgagggaccct

SEQ ID NO: 7872430 - DNA, 22 bp, Homo sapiens
aggctgaggggcgagggaccct

SEQ ID NO: 7872431 - DNA, 22 bp, Homo sapiens
aggctgaggggcgagggaccct

SEQ ID NO: 7872432 - DNA, 22 bp, Homo sapiens
aggctgaggggcgagggaccct

SEQ ID NO: 7872433 - DNA, 20 bp, Homo sapiens
aggctgagggtgattgtgtc

SEQ ID NO: 7872434 - DNA, 20 bp, Homo sapiens
aggctgagggtgattgtgtc

SEQ ID NO: 7872435 - DNA, 20 bp, Homo sapiens
aggctgagggtgattgtgtc

SEQ ID NO: 7872436 - DNA, 20 bp, Homo sapiens
aggctgagggtgattgtgtc

SEQ ID NO: 7872437 - DNA, 22 bp, Homo sapiens
aggctgaggtaggaggatcgct

SEQ ID NO: 7872438 - DNA, 22 bp, Homo sapiens
aggctgaggtaggaggatcgct

SEQ ID NO: 7872439 - DNA, 22 bp, Homo sapiens
aggctgaggtaggaggatcgct

SEQ ID NO: 7872440 - DNA, 20 bp, Homo sapiens
aggctgagggtgattgtgtc

SEQ ID NO: 7872441 - DNA, 20 bp, Homo sapiens
aggctgagggtgattgtgtc

SEQ ID NO: 7872442 - DNA, 22 bp, Homo sapiens
aggctctgtgcagcctgcatct

SEQ ID NO: 7872443 - DNA, 22 bp, Homo sapiens
aggctctgtgatgtgccaggca

SEQ ID NO: 7872444 - DNA, 22 bp, Homo sapiens
aggctctgtgcagcctgcatct

SEQ ID NO: 7872445 - DNA, 22 bp, Homo sapiens
aggctctgtgcagcctgcatct

SEQ ID NO: 7872446 - DNA, 22 bp, Homo sapiens
aggctctgtgcagcctgcatct

SEQ ID NO: 7872447 - DNA, 22 bp, Homo sapiens
aggctctgtgcagcctgcatct

SEQ ID NO: 7872448 - DNA, 22 bp, Homo sapiens
aggctctgtgatgtgccaggca

SEQ ID NO: 7872449 - DNA, 22 bp, Homo sapiens
aggctctgtgatgtgccaggca

SEQ ID NO: 7872450 - DNA, 22 bp, Homo sapiens
aggctctgtgatgtgccaggca

SEQ ID NO: 7872451 - DNA, 22 bp, Homo sapiens
aggctctgtgatgtgccaggca

SEQ ID NO: 7872452 - DNA, 22 bp, Homo sapiens
aggctctgtgatccacaatgag

SEQ ID NO: 7872453 - DNA, 22 bp, Homo sapiens
aggctctgtgatccacaatgag

SEQ ID NO: 7872454 - DNA, 22 bp, Homo sapiens
aggctctgtgatccacaatgag

SEQ ID NO: 7872455 - DNA, 22 bp, Homo sapiens
aggctctgtgatccacaatgag

SEQ ID NO: 7872456 - DNA, 22 bp, Homo sapiens
aggctctgtgatccacaatgag

SEQ ID NO: 7872457 - DNA, 22 bp, Homo sapiens
aggctctgtgatgtgccaggca

SEQ ID NO: 7872458 - DNA, 22 bp, Homo sapiens
aggctctgtgatgtgccaggca

SEQ ID NO: 7872459 - DNA, 22 bp, Homo sapiens
aggctctgtgatgtgccaggca

SEQ ID NO: 7872460 - DNA, 22 bp, Homo sapiens
aggctctgtgacaatcaagctg

SEQ ID NO: 7872461 - DNA, 22 bp, Homo sapiens
aggctctgtgacaatcaagctg

SEQ ID NO: 7872462 - DNA, 22 bp, Homo sapiens
aggctctgtgacaatcaagctg

SEQ ID NO: 7872463 - DNA, 21 bp, Homo sapiens
aggctctgtgaatatgtttcc

SEQ ID NO: 7872464 - DNA, 22 bp, Homo sapiens
aggctctgtgactaaagaggat

SEQ ID NO: 7872465 - DNA, 22 bp, Homo sapiens
aggctctgtgactaaagaggat

SEQ ID NO: 7872466 - DNA, 22 bp, Homo sapiens
aggctctgtgacaatcaagctg

SEQ ID NO: 7872467 - DNA, 22 bp, Homo sapiens
aggctctgtcaggcggagcagc

SEQ ID NO: 7872468 - DNA, 21 bp, Homo sapiens
aggctctgtgaatatgtttcc

SEQ ID NO: 7872469 - DNA, 21 bp, Homo sapiens
aggctctgtgaatatgtttcc

SEQ ID NO: 7872470 - DNA, 21 bp, Homo sapiens
aggctctgtgaatatgtttcc

SEQ ID NO: 7872471 - DNA, 22 bp, Homo sapiens
aggctctgtcaggcggagcagc

SEQ ID NO: 7872472 - DNA, 22 bp, Homo sapiens
ccagggtggaggctggatggag

SEQ ID NO: 7872473 - DNA, 19 bp, Homo sapiens
ccatgcagcctgggggcag

SEQ ID NO: 7872474 - DNA, 22 bp, Homo sapiens
ccatggctaagtatctgtagaa

SEQ ID NO: 7872475 - DNA, 18 bp, Homo sapiens
ccatggctccctcctgcc

SEQ ID NO: 7872476 - DNA, 18 bp, Homo sapiens
ccatggctccctcctgcc

SEQ ID NO: 7872477 - DNA, 22 bp, Homo sapiens
ccatggctccttgccctgtagc

SEQ ID NO: 7872478 - DNA, 22 bp, Homo sapiens
ccatggctccttgccctgtagc

SEQ ID NO: 7872479 - DNA, 18 bp, Homo sapiens
ccatggctccctcctgcc

SEQ ID NO: 7872480 - DNA, 22 bp, Homo sapiens
ccatggctccttgccctgtagc

SEQ ID NO: 7872481 - DNA, 22 bp, Homo sapiens
aggctgagtcgggaggatcact

SEQ ID NO: 7872482 - DNA, 22 bp, Homo sapiens
aggctgagtcgggaggatcact

SEQ ID NO: 7872483 - DNA, 19 bp, Homo sapiens
ccatgcagcctgggggcag

SEQ ID NO: 7872484 - DNA, 19 bp, Homo sapiens
ccatgcagcctgggggcag

SEQ ID NO: 7872485 - DNA, 19 bp, Homo sapiens
ccatgcagcctgggggcag

SEQ ID NO: 7872486 - DNA, 22 bp, Homo sapiens
ccatgcagccacgtctagctaa

SEQ ID NO: 7872487 - DNA, 22 bp, Homo sapiens
ccatgcacaccagcaggcagac

SEQ ID NO: 7872488 - DNA, 22 bp, Homo sapiens
ccatggcttctttctctgccag

SEQ ID NO: 7872489 - DNA, 22 bp, Homo sapiens
ccatggcttggaaagggaggtg

SEQ ID NO: 7872490 - DNA, 22 bp, Homo sapiens
ccatggcttggaaagggaggtg

SEQ ID NO: 7872491 - DNA, 22 bp, Homo sapiens
ccatggctttctttcattgtaa

SEQ ID NO: 7872492 - DNA, 22 bp, Homo sapiens
ccatggcttttgagtctcaaga

SEQ ID NO: 7872493 - DNA, 22 bp, Homo sapiens
ccatggcttttgagtctcaaga

SEQ ID NO: 7872494 - DNA, 22 bp, Homo sapiens
ccatggctttctttcattgtaa

SEQ ID NO: 7872495 - DNA, 22 bp, Homo sapiens
ccatggcttttgagtctcaaga

SEQ ID NO: 7872496 - DNA, 22 bp, Homo sapiens
ccatggcttttgagtctcaaga

SEQ ID NO: 7872497 - DNA, 22 bp, Homo sapiens
ccatggcttttgagtctcaaga

SEQ ID NO: 7872498 - DNA, 22 bp, Homo sapiens
ccatggcttacagatggagcat

SEQ ID NO: 7872499 - DNA, 22 bp, Homo sapiens
ccatggcttacagatggagcat

SEQ ID NO: 7872500 - DNA, 22 bp, Homo sapiens
ccatggcttctttctctgccag

SEQ ID NO: 7872501 - DNA, 22 bp, Homo sapiens
ccatggcttctttctctgccag

SEQ ID NO: 7872502 - DNA, 22 bp, Homo sapiens
ccatggctgcaattcttctgga

SEQ ID NO: 7872503 - DNA, 22 bp, Homo sapiens
ccatggctcttaccttgttata

SEQ ID NO: 7872504 - DNA, 22 bp, Homo sapiens
ccatggcttacagatggagcat

SEQ ID NO: 7872505 - DNA, 22 bp, Homo sapiens
ccatggctgcaattcttctgga

SEQ ID NO: 7872506 - DNA, 22 bp, Homo sapiens
ccatggcttacagatggagcat

SEQ ID NO: 7872507 - DNA, 22 bp, Homo sapiens
aggctgaggtgtgctgtgatcg

SEQ ID NO: 7872508 - DNA, 22 bp, Homo sapiens
aggctgaggtgtgctgtgatcg

SEQ ID NO: 7872509 - DNA, 22 bp, Homo sapiens
aggctgaggtgtgctgtgatcg

SEQ ID NO: 7872510 - DNA, 22 bp, Homo sapiens
aggctgaggtgtgctgtgatcg

SEQ ID NO: 7872511 - DNA, 22 bp, Homo sapiens
aggctgaggtgtgctgtgatcg

SEQ ID NO: 7872512 - DNA, 22 bp, Homo sapiens
aggctgaggtgtgctgtgatcg

SEQ ID NO: 7872513 - DNA, 22 bp, Homo sapiens
aggctgaggtgtgctgtgatcg

SEQ ID NO: 7872514 - DNA, 22 bp, Homo sapiens
aggctgaggtaggaggatcgct

SEQ ID NO: 7872515 - DNA, 22 bp, Homo sapiens
aggctgaggtaggaggatcgct

SEQ ID NO: 7872516 - DNA, 22 bp, Homo sapiens
aggctgaggtaggaggatcgct

SEQ ID NO: 7872517 - DNA, 22 bp, Homo sapiens
aggctgaggtaggaggatcgct

SEQ ID NO: 7872518 - DNA, 22 bp, Homo sapiens
aggctgaggtaggaggatcgct

SEQ ID NO: 7872519 - DNA, 22 bp, Homo sapiens
aggctgaggtaggaggatcgct

SEQ ID NO: 7872520 - DNA, 22 bp, Homo sapiens
aggctgagtcgggaggatcact

SEQ ID NO: 7872521 - DNA, 22 bp, Homo sapiens
aggctgagtcgggaggatcact

SEQ ID NO: 7872522 - DNA, 22 bp, Homo sapiens
aggctgagtcgggaggatcact

SEQ ID NO: 7872523 - DNA, 22 bp, Homo sapiens
aggctgagtcgggaggatcact

SEQ ID NO: 7872524 - DNA, 22 bp, Homo sapiens
aggctgagtcaagttagggtga

SEQ ID NO: 7872525 - DNA, 22 bp, Homo sapiens
aggctgagtcgggaggatcact

SEQ ID NO: 7872526 - DNA, 22 bp, Homo sapiens
aggctgagtcaagttagggtga

SEQ ID NO: 7872527 - DNA, 22 bp, Homo sapiens
aggctgagtcaagttagggtga

SEQ ID NO: 7872528 - DNA, 22 bp, Homo sapiens
aggctgagtcaagttagggtga

SEQ ID NO: 7872529 - DNA, 22 bp, Homo sapiens
aggctgagtcaagttagggtga

SEQ ID NO: 7872530 - DNA, 22 bp, Homo sapiens
aggctgaggtgtgctgtgatcg

SEQ ID NO: 7872531 - DNA, 22 bp, Homo sapiens
aggctgaggtgtgctgtgatcg

SEQ ID NO: 7872532 - DNA, 20 bp, Homo sapiens
cccagagccatagccagaca

SEQ ID NO: 7872533 - DNA, 20 bp, Homo sapiens
cccagagccatagccagaca

SEQ ID NO: 7872534 - DNA, 20 bp, Homo sapiens
cccagagccatagccagaca

SEQ ID NO: 7872535 - DNA, 20 bp, Homo sapiens
cccagagccatagccagaca

SEQ ID NO: 7872536 - DNA, 22 bp, Homo sapiens
cccagagcatgtgctgcctttg

SEQ ID NO: 7872537 - DNA, 22 bp, Homo sapiens
cccagagcatgtgctgcctttg

SEQ ID NO: 7872538 - DNA, 22 bp, Homo sapiens
cccagagcatgtgctgcctttg

SEQ ID NO: 7872539 - DNA, 22 bp, Homo sapiens
cccagagccgctcccctacttc

SEQ ID NO: 7872540 - DNA, 22 bp, Homo sapiens
cccagagccgctcccctacttc

SEQ ID NO: 7872541 - DNA, 22 bp, Homo sapiens
cccagagccgctcccctacttc

SEQ ID NO: 7872542 - DNA, 22 bp, Homo sapiens
cccagagccggtggtgctcaca

SEQ ID NO: 7872543 - DNA, 23 bp, Homo sapiens
cccagagcacagcctccagatgc

SEQ ID NO: 7872544 - DNA, 22 bp, Homo sapiens
cccagagatgtcctgagtgata

SEQ ID NO: 7872545 - DNA, 22 bp, Homo sapiens
cccagagatgtcctgagtgata

SEQ ID NO: 7872546 - DNA, 18 bp, Homo sapiens
cccactgtccccacaggc

SEQ ID NO: 7872547 - DNA, 22 bp, Homo sapiens
cccactgtctgttcccagggcc

SEQ ID NO: 7872548 - DNA, 23 bp, Homo sapiens
cccagagcacagcctccagatgc

SEQ ID NO: 7872549 - DNA, 19 bp, Homo sapiens
cccagagcatcctgaactt

SEQ ID NO: 7872550 - DNA, 22 bp, Homo sapiens
cccagagcatgtgctgcctttg

SEQ ID NO: 7872551 - DNA, 17 bp, Homo sapiens
aggctggctcacaggga

SEQ ID NO: 7872552 - DNA, 17 bp, Homo sapiens
aggctggctcacaggga

SEQ ID NO: 7872553 - DNA, 17 bp, Homo sapiens
aggctggctcacaggga

SEQ ID NO: 7872554 - DNA, 17 bp, Homo sapiens
aggctggctcacaggga

SEQ ID NO: 7872555 - DNA, 17 bp, Homo sapiens
aggctggctcacaggga

SEQ ID NO: 7872556 - DNA, 17 bp, Homo sapiens
aggctggctcacaggga

SEQ ID NO: 7872557 - DNA, 17 bp, Homo sapiens
aggctggctcacaggga

SEQ ID NO: 7872558 - DNA, 22 bp, Homo sapiens
aggctggctcggcttttctgtc

SEQ ID NO: 7872559 - DNA, 22 bp, Homo sapiens
aggctggctgaaaaacaccctt

SEQ ID NO: 7872560 - DNA, 22 bp, Homo sapiens
aggctggctgacttctgaagca

SEQ ID NO: 7872561 - DNA, 22 bp, Homo sapiens
aggctggctgaaaaacaccctt

SEQ ID NO: 7872562 - DNA, 22 bp, Homo sapiens
aggctggctgacttctgaagca

SEQ ID NO: 7872563 - DNA, 22 bp, Homo sapiens
cccagagccggtggtgctcaca

SEQ ID NO: 7872564 - DNA, 21 bp, Homo sapiens
cccagagcctagggagggcac

SEQ ID NO: 7872565 - DNA, 22 bp, Homo sapiens
cccagagccggtggtgctcaca

SEQ ID NO: 7872566 - DNA, 22 bp, Homo sapiens
cccagagccggtggtgctcaca

SEQ ID NO: 7872567 - DNA, 21 bp, Homo sapiens
cccagagcctagggagggcac

SEQ ID NO: 7872568 - DNA, 21 bp, Homo sapiens
cccagagcctagggagggcac

SEQ ID NO: 7872569 - DNA, 21 bp, Homo sapiens
cccagagcctagggagggcac

SEQ ID NO: 7872570 - DNA, 22 bp, Homo sapiens
aggctggcgtcaggggctgtac

SEQ ID NO: 7872571 - DNA, 22 bp, Homo sapiens
aggctggcgtcaggggctgtac

SEQ ID NO: 7872572 - DNA, 22 bp, Homo sapiens
aggctgcctcttttgagagggt

SEQ ID NO: 7872573 - DNA, 22 bp, Homo sapiens
aggctgcctcttttgagagggt

SEQ ID NO: 7872574 - DNA, 22 bp, Homo sapiens
aggctgcctcttttgagagggt

SEQ ID NO: 7872575 - DNA, 22 bp, Homo sapiens
aggctgcctcttttgagagggt

SEQ ID NO: 7872576 - DNA, 22 bp, Homo sapiens
aggctgcctggctgtgagtgaa

SEQ ID NO: 7872577 - DNA, 22 bp, Homo sapiens
aggctgcctggctgtgagtgaa

SEQ ID NO: 7872578 - DNA, 22 bp, Homo sapiens
aggctgcctggctgtgagtgaa

SEQ ID NO: 7872579 - DNA, 22 bp, Homo sapiens
aggctgcctcttttgagagggt

SEQ ID NO: 7872580 - DNA, 22 bp, Homo sapiens
aggctgcctctgcaggatccct

SEQ ID NO: 7872581 - DNA, 22 bp, Homo sapiens
aggctgcctctgcaggatccct

SEQ ID NO: 7872582 - DNA, 22 bp, Homo sapiens
aggctgcctctgcaggatccct

SEQ ID NO: 7872583 - DNA, 22 bp, Homo sapiens
aggctgcctctgcaggatccct

SEQ ID NO: 7872584 - DNA, 22 bp, Homo sapiens
aggctgcctctgcaggatccct

SEQ ID NO: 7872585 - DNA, 22 bp, Homo sapiens
aggctgcctcgtgagctcgctg

SEQ ID NO: 7872586 - DNA, 22 bp, Homo sapiens
cccactgctgctctccatggca

SEQ ID NO: 7872587 - DNA, 22 bp, Homo sapiens
cccactggcaatattatgagac

SEQ ID NO: 7872588 - DNA, 22 bp, Homo sapiens
aggctgctcacctccctgtctg

SEQ ID NO: 7872589 - DNA, 22 bp, Homo sapiens
aggctgctcacctccctgtctg

SEQ ID NO: 7872590 - DNA, 22 bp, Homo sapiens
aggctgctcagtagatggagct

SEQ ID NO: 7872591 - DNA, 22 bp, Homo sapiens
cccactgctgctctccatggca

SEQ ID NO: 7872592 - DNA, 22 bp, Homo sapiens
aggctgctcacctccctgtctg

SEQ ID NO: 7872593 - DNA, 22 bp, Homo sapiens
aggctgctataaacattcccgt

SEQ ID NO: 7872594 - DNA, 22 bp, Homo sapiens
aggctgcgttagcctcactccc

SEQ ID NO: 7872595 - DNA, 22 bp, Homo sapiens
aggctgcctgttccaatctcct

SEQ ID NO: 7872596 - DNA, 22 bp, Homo sapiens
aggctgcctgttccaatctcct

SEQ ID NO: 7872597 - DNA, 22 bp, Homo sapiens
ccatgtggctagcgtgcctgca

SEQ ID NO: 7872598 - DNA, 20 bp, Homo sapiens
aggctgcctaaggctctgca

SEQ ID NO: 7872599 - DNA, 20 bp, Homo sapiens
aggctgcctaaggctctgca

SEQ ID NO: 7872600 - DNA, 22 bp, Homo sapiens
ccatgtggctagcgtgcctgca

SEQ ID NO: 7872601 - DNA, 22 bp, Homo sapiens
ccatgtgcttgctctggcacct

SEQ ID NO: 7872602 - DNA, 22 bp, Homo sapiens
ccatgtgcttgctctggcacct

SEQ ID NO: 7872603 - DNA, 22 bp, Homo sapiens
ccatgtgcttgctctggcacct

SEQ ID NO: 7872604 - DNA, 22 bp, Homo sapiens
ccatgtgcttgctctggcacct

SEQ ID NO: 7872605 - DNA, 22 bp, Homo sapiens
ccatgtacatgaacacggcggc

SEQ ID NO: 7872606 - DNA, 20 bp, Homo sapiens
aggctgcctaaggctctgca

SEQ ID NO: 7872607 - DNA, 20 bp, Homo sapiens
aggctgcctaaggctctgca

SEQ ID NO: 7872608 - DNA, 20 bp, Homo sapiens
aggctgcctaaggctctgca

SEQ ID NO: 7872609 - DNA, 22 bp, Homo sapiens
aggctgcctaggttcaacacct

SEQ ID NO: 7872610 - DNA, 22 bp, Homo sapiens
aggctgcctaggttcaacacct

SEQ ID NO: 7872611 - DNA, 22 bp, Homo sapiens
aggctgcctaggttcaacacct

SEQ ID NO: 7872612 - DNA, 19 bp, Homo sapiens
aggctgcctcaccctccct

SEQ ID NO: 7872613 - DNA, 22 bp, Homo sapiens
aggctgcctcgtgagctcgctg

SEQ ID NO: 7872614 - DNA, 22 bp, Homo sapiens
ccatgggagatgatggggagtg

SEQ ID NO: 7872615 - DNA, 22 bp, Homo sapiens
ccatgggacctacctcctgtgc

SEQ ID NO: 7872616 - DNA, 22 bp, Homo sapiens
ccatgggagatgatggggagtg

SEQ ID NO: 7872617 - DNA, 22 bp, Homo sapiens
ccatgggagatgatggggagtg

SEQ ID NO: 7872618 - DNA, 21 bp, Homo sapiens
ccatgggagctgttaatcctg

SEQ ID NO: 7872619 - DNA, 22 bp, Homo sapiens
ccatgggaattgggaggtccca

SEQ ID NO: 7872620 - DNA, 21 bp, Homo sapiens
ccatgggaagcatcctcgcgg

SEQ ID NO: 7872621 - DNA, 22 bp, Homo sapiens
ccatgtacatgaacacggcggc

SEQ ID NO: 7872622 - DNA, 22 bp, Homo sapiens
ccatgggctggctgccttatca

SEQ ID NO: 7872623 - DNA, 22 bp, Homo sapiens
ccatggtctctgtgaagcctgt

SEQ ID NO: 7872624 - DNA, 22 bp, Homo sapiens
ccatgggcgcacaggcctggag

SEQ ID NO: 7872625 - DNA, 22 bp, Homo sapiens
ccatgggcactgggtggaggta

SEQ ID NO: 7872626 - DNA, 22 bp, Homo sapiens
ccaggagctggcatgtggagag

SEQ ID NO: 7872627 - DNA, 22 bp, Homo sapiens
ccaggagctggcatgtggagag

SEQ ID NO: 7872628 - DNA, 22 bp, Homo sapiens
ccaggagctggagggtgcagtg

SEQ ID NO: 7872629 - DNA, 22 bp, Homo sapiens
ccaggagctggcatgtggagag

SEQ ID NO: 7872630 - DNA, 22 bp, Homo sapiens
ccaggagctggcatgtggagag

SEQ ID NO: 7872631 - DNA, 22 bp, Homo sapiens
ccaggagctggcatgtggagag

SEQ ID NO: 7872632 - DNA, 22 bp, Homo sapiens
ccaggagctggcatgtggagag

SEQ ID NO: 7872633 - DNA, 22 bp, Homo sapiens
ccaggaggaaattctaaaggta

SEQ ID NO: 7872634 - DNA, 22 bp, Homo sapiens
ccaggaggaaattctaaaggta

SEQ ID NO: 7872635 - DNA, 22 bp, Homo sapiens
ccaggaggaaattctaaaggta

SEQ ID NO: 7872636 - DNA, 22 bp, Homo sapiens
ccaggaggaaagaccagcccat

SEQ ID NO: 7872637 - DNA, 22 bp, Homo sapiens
ccaggaggaaagaccagcccat

SEQ ID NO: 7872638 - DNA, 22 bp, Homo sapiens
ccaggagctatgtacacactat

SEQ ID NO: 7872639 - DNA, 22 bp, Homo sapiens
ccaggagctatgtacacactat

SEQ ID NO: 7872640 - DNA, 17 bp, Homo sapiens
ccaggagcgtgggtctc

SEQ ID NO: 7872641 - DNA, 17 bp, Homo sapiens
ccaggagcgtgggtctc

SEQ ID NO: 7872642 - DNA, 17 bp, Homo sapiens
ccaggagcgtgggtctc

SEQ ID NO: 7872643 - DNA, 17 bp, Homo sapiens
ccaggagcgtgggtctc

SEQ ID NO: 7872644 - DNA, 17 bp, Homo sapiens
ccaggagcgtgggtctc

SEQ ID NO: 7872645 - DNA, 17 bp, Homo sapiens
ccaggagcgtgggtctc

SEQ ID NO: 7872646 - DNA, 22 bp, Homo sapiens
ccaggagctggagggtgcagtg

SEQ ID NO: 7872647 - DNA, 22 bp, Homo sapiens
ccaggagcaaagatcactggga

SEQ ID NO: 7872648 - DNA, 22 bp, Homo sapiens
ccaggagctggagggtgcagtg

SEQ ID NO: 7872649 - DNA, 22 bp, Homo sapiens
ccaggagctatgtacacactat

SEQ ID NO: 7872650 - DNA, 22 bp, Homo sapiens
ccaggagctatgtacacactat

SEQ ID NO: 7872651 - DNA, 22 bp, Homo sapiens
ccaggagctatgtacacactat

SEQ ID NO: 7872652 - DNA, 22 bp, Homo sapiens
ccaggagctggagggtgcagtg

SEQ ID NO: 7872653 - DNA, 22 bp, Homo sapiens
ccaggagctggagggtgcagtg

SEQ ID NO: 7872654 - DNA, 22 bp, Homo sapiens
ccaggagctggagggtgcagtg

SEQ ID NO: 7872655 - DNA, 22 bp, Homo sapiens
aggctcagtatagctggcaagt

SEQ ID NO: 7872656 - DNA, 22 bp, Homo sapiens
aggctcagtatagctggcaagt

SEQ ID NO: 7872657 - DNA, 22 bp, Homo sapiens
aggctcagtatagctggcaagt

SEQ ID NO: 7872658 - DNA, 22 bp, Homo sapiens
aggctcaggtgcctcattcaca

SEQ ID NO: 7872659 - DNA, 22 bp, Homo sapiens
aggctcagtatagctggcaagt

SEQ ID NO: 7872660 - DNA, 22 bp, Homo sapiens
aggctcagcctgggcctagagc

SEQ ID NO: 7872661 - DNA, 22 bp, Homo sapiens
aggctcagcctgggcctagagc

SEQ ID NO: 7872662 - DNA, 22 bp, Homo sapiens
ccaggaggatcatcctgttttc

SEQ ID NO: 7872663 - DNA, 22 bp, Homo sapiens
ccaggaggatcatcctgttttc

SEQ ID NO: 7872664 - DNA, 22 bp, Homo sapiens
aggctcagtatagctggcaagt

SEQ ID NO: 7872665 - DNA, 22 bp, Homo sapiens
aggctcagtcccggcccgcgcc

SEQ ID NO: 7872666 - DNA, 22 bp, Homo sapiens
aggctcagtcccggcccgcgcc

SEQ ID NO: 7872667 - DNA, 22 bp, Homo sapiens
aggctcagtctgttcatgcact

SEQ ID NO: 7872668 - DNA, 22 bp, Homo sapiens
aggctcagtctgttcatgcact

SEQ ID NO: 7872669 - DNA, 22 bp, Homo sapiens
aggctcagtctgttcatgcact

SEQ ID NO: 7872670 - DNA, 22 bp, Homo sapiens
aggctcagtctgttcatgcact

SEQ ID NO: 7872671 - DNA, 22 bp, Homo sapiens
aggctcagtgatgtaaaatata

SEQ ID NO: 7872672 - DNA, 22 bp, Homo sapiens
aggctcagtgcaaatcattctg

SEQ ID NO: 7872673 - DNA, 22 bp, Homo sapiens
aggctcagtgatgtaaaatata

SEQ ID NO: 7872674 - DNA, 22 bp, Homo sapiens
aggctcagtgatgtaaaatata

SEQ ID NO: 7872675 - DNA, 22 bp, Homo sapiens
aggctcagtgatgtaaaatata

SEQ ID NO: 7872676 - DNA, 22 bp, Homo sapiens
ccagggaaggctgctggctgtg

SEQ ID NO: 7872677 - DNA, 22 bp, Homo sapiens
ccagggaaggctgctggctgtg

SEQ ID NO: 7872678 - DNA, 22 bp, Homo sapiens
ccagggaaggctctgcctgctt

SEQ ID NO: 7872679 - DNA, 22 bp, Homo sapiens
ccagggaaggctctgcctgctt

SEQ ID NO: 7872680 - DNA, 22 bp, Homo sapiens
ccaggctgtaagagtgatgttg

SEQ ID NO: 7872681 - DNA, 22 bp, Homo sapiens
ccaggctgtaaacaccttcaaa

SEQ ID NO: 7872682 - DNA, 22 bp, Homo sapiens
ccaggctgtaaacaccttcaaa

SEQ ID NO: 7872683 - DNA, 22 bp, Homo sapiens
ccaggctgtaaacaccttcaaa

SEQ ID NO: 7872684 - DNA, 22 bp, Homo sapiens
aggctccaccctacagagctcc

SEQ ID NO: 7872685 - DNA, 22 bp, Homo sapiens
aggctccaccctacagagctcc

SEQ ID NO: 7872686 - DNA, 22 bp, Homo sapiens
aggctccaccctacagagctcc

SEQ ID NO: 7872687 - DNA, 22 bp, Homo sapiens
aggctccaccctacagagctcc

SEQ ID NO: 7872688 - DNA, 22 bp, Homo sapiens
aggctccaccctacagagctcc

SEQ ID NO: 7872689 - DNA, 22 bp, Homo sapiens
aggctccaccagtcaggtgcat

SEQ ID NO: 7872690 - DNA, 22 bp, Homo sapiens
aggctccaccagtcaggtgcat

SEQ ID NO: 7872691 - DNA, 22 bp, Homo sapiens
aggctccaccagtcaggtgcat

SEQ ID NO: 7872692 - DNA, 22 bp, Homo sapiens
aggctccaccagtcaggtgcat

SEQ ID NO: 7872693 - DNA, 22 bp, Homo sapiens
aggctccaccagtcaggtgcat

SEQ ID NO: 7872694 - DNA, 23 bp, Homo sapiens
aggctccacatgggcactttgca

SEQ ID NO: 7872695 - DNA, 22 bp, Homo sapiens
aggctccaccagtcaggtgcat

SEQ ID NO: 7872696 - DNA, 22 bp, Homo sapiens
aggctccaccagtcaggtgcat

SEQ ID NO: 7872697 - DNA, 22 bp, Homo sapiens
aggctccaccccgccagacctt

SEQ ID NO: 7872698 - DNA, 22 bp, Homo sapiens
aggctccaccctacagagctcc

SEQ ID NO: 7872699 - DNA, 22 bp, Homo sapiens
aggctccaccctacagagctcc

SEQ ID NO: 7872700 - DNA, 22 bp, Homo sapiens
aggctccaccagtcaggtgcat

SEQ ID NO: 7872701 - DNA, 22 bp, Homo sapiens
aggctccaccagtcaggtgcat

SEQ ID NO: 7872702 - DNA, 22 bp, Homo sapiens
aggctccaccccgccagacctt

SEQ ID NO: 7872703 - DNA, 22 bp, Homo sapiens
aggctccaccccgccagacctt

SEQ ID NO: 7872704 - DNA, 22 bp, Homo sapiens
aggctccaccccgccagacctt

SEQ ID NO: 7872705 - DNA, 22 bp, Homo sapiens
aggctcatccccacaaagcaaa

SEQ ID NO: 7872706 - DNA, 22 bp, Homo sapiens
aggctcatccccacaaagcaaa

SEQ ID NO: 7872707 - DNA, 22 bp, Homo sapiens
aggctcagtttggtttccattg

SEQ ID NO: 7872708 - DNA, 22 bp, Homo sapiens
aggctcagtttggtttccattg

SEQ ID NO: 7872709 - DNA, 22 bp, Homo sapiens
aggctccaaattaccaagctct

SEQ ID NO: 7872710 - DNA, 22 bp, Homo sapiens
aggctccaaattaccaagctct

SEQ ID NO: 7872711 - DNA, 22 bp, Homo sapiens
aggctccaaattaccaagctct

SEQ ID NO: 7872712 - DNA, 22 bp, Homo sapiens
aggctccaagaggttaagtcac

SEQ ID NO: 7872713 - DNA, 22 bp, Homo sapiens
aggctccaagaggttaagtcac

SEQ ID NO: 7872714 - DNA, 22 bp, Homo sapiens
aggctccaagaggttaagtcac

SEQ ID NO: 7872715 - DNA, 23 bp, Homo sapiens
aggctccacatgggcactttgca

SEQ ID NO: 7872716 - DNA, 16 bp, Homo sapiens
aggctccaagagctgt

SEQ ID NO: 7872717 - DNA, 22 bp, Homo sapiens
aggctcagtgcaaatcattctg

SEQ ID NO: 7872718 - DNA, 22 bp, Homo sapiens
aggctcagttcacgtcaacttt

SEQ ID NO: 7872719 - DNA, 22 bp, Homo sapiens
aggctcagtgcaaatcattctg

SEQ ID NO: 7872720 - DNA, 22 bp, Homo sapiens
aggctcagtgcaaatcattctg

SEQ ID NO: 7872721 - DNA, 22 bp, Homo sapiens
aggctcagttcacgtcaacttt

SEQ ID NO: 7872722 - DNA, 22 bp, Homo sapiens
aggctcagttctgtggtgagcc

SEQ ID NO: 7872723 - DNA, 22 bp, Homo sapiens
aggctcagttctgtggtgagcc

SEQ ID NO: 7872724 - DNA, 22 bp, Homo sapiens
aggctcagttctgtggtgagcc

SEQ ID NO: 7872725 - DNA, 22 bp, Homo sapiens
aggctcagttctgtggtgagcc

SEQ ID NO: 7872726 - DNA, 22 bp, Homo sapiens
aggctcagttcacgtcaacttt

SEQ ID NO: 7872727 - DNA, 22 bp, Homo sapiens
aggctcagttctgtggtgagcc

SEQ ID NO: 7872728 - DNA, 22 bp, Homo sapiens
aggctcagttctgtggtgagcc

SEQ ID NO: 7872729 - DNA, 22 bp, Homo sapiens
ccagggtcttcgaggcagcaat

SEQ ID NO: 7872730 - DNA, 22 bp, Homo sapiens
ccagggtcttggagaggagtgc

SEQ ID NO: 7872731 - DNA, 22 bp, Homo sapiens
ccagggcttcagaggttttggc

SEQ ID NO: 7872732 - DNA, 22 bp, Homo sapiens
ccagggcttaacttttcaggag

SEQ ID NO: 7872733 - DNA, 22 bp, Homo sapiens
ccagggcttaacttttcaggag

SEQ ID NO: 7872734 - DNA, 20 bp, Homo sapiens
aggctcctgtacctgaggaa

SEQ ID NO: 7872735 - DNA, 22 bp, Homo sapiens
aggctccttgctcacaggctca

SEQ ID NO: 7872736 - DNA, 22 bp, Homo sapiens
aggctccttgctcacaggctca

SEQ ID NO: 7872737 - DNA, 20 bp, Homo sapiens
aggctcctgtacctgaggaa

SEQ ID NO: 7872738 - DNA, 22 bp, Homo sapiens
aggctcctgatcctggggtctg

SEQ ID NO: 7872739 - DNA, 22 bp, Homo sapiens
aggctcctgagaggcagaggct

SEQ ID NO: 7872740 - DNA, 22 bp, Homo sapiens
aggctcctgagaggcagaggct

SEQ ID NO: 7872741 - DNA, 22 bp, Homo sapiens
ccagggtgagtgtcatgggtta

SEQ ID NO: 7872742 - DNA, 22 bp, Homo sapiens
ccagggtgagtgtcatgggtta

SEQ ID NO: 7872743 - DNA, 22 bp, Homo sapiens
ccagggtgctctgtggcgtcgc

SEQ ID NO: 7872744 - DNA, 22 bp, Homo sapiens
ccagggtgctctgtggcgtcgc

SEQ ID NO: 7872745 - DNA, 22 bp, Homo sapiens
ccagggtgaggaggctcccacg

SEQ ID NO: 7872746 - DNA, 22 bp, Homo sapiens
ccagggtgaggaggctcccacg

SEQ ID NO: 7872747 - DNA, 22 bp, Homo sapiens
ccagggtgaggaggctcccacg

SEQ ID NO: 7872748 - DNA, 22 bp, Homo sapiens
ccagggtgaggaggctcccacg

SEQ ID NO: 7872749 - DNA, 22 bp, Homo sapiens
ccagggtgaggaggctcccacg

SEQ ID NO: 7872750 - DNA, 22 bp, Homo sapiens
ccagggtgagtgtcatgggtta

SEQ ID NO: 7872751 - DNA, 22 bp, Homo sapiens
ccagggtgagtgtcatgggtta

SEQ ID NO: 7872752 - DNA, 22 bp, Homo sapiens
ccagggtgagaaaaggctggat

SEQ ID NO: 7872753 - DNA, 22 bp, Homo sapiens
ccagggtgagaaaaggctggat

SEQ ID NO: 7872754 - DNA, 22 bp, Homo sapiens
ccagggtgagaaaaggctggat

SEQ ID NO: 7872755 - DNA, 22 bp, Homo sapiens
ccagggtgagaaaaggctggat

SEQ ID NO: 7872756 - DNA, 22 bp, Homo sapiens
ccagggtgaccagctggcctag

SEQ ID NO: 7872757 - DNA, 22 bp, Homo sapiens
ccagggtgaccctcccggtggc

SEQ ID NO: 7872758 - DNA, 22 bp, Homo sapiens
ccagggaggagcatttcatggt

SEQ ID NO: 7872759 - DNA, 22 bp, Homo sapiens
ccagggaggagcatttcatggt

SEQ ID NO: 7872760 - DNA, 22 bp, Homo sapiens
ccagggaggagcatttcatggt

SEQ ID NO: 7872761 - DNA, 22 bp, Homo sapiens
ccagggaggagcatttcatggt

SEQ ID NO: 7872762 - DNA, 17 bp, Homo sapiens
ccagggaggggccgcgc

SEQ ID NO: 7872763 - DNA, 22 bp, Homo sapiens
aggctccctgaatcgcccgttc

SEQ ID NO: 7872764 - DNA, 17 bp, Homo sapiens
ccagggaggggccgcgc

SEQ ID NO: 7872765 - DNA, 22 bp, Homo sapiens
ccagggagcggggctgggtctc

SEQ ID NO: 7872766 - DNA, 22 bp, Homo sapiens
ccagggagcggggctgggtctc

SEQ ID NO: 7872767 - DNA, 22 bp, Homo sapiens
ccagggagcggggctgggtctc

SEQ ID NO: 7872768 - DNA, 22 bp, Homo sapiens
ccagggagcggggctgggtctc

SEQ ID NO: 7872769 - DNA, 22 bp, Homo sapiens
ccagggagcggggctgggtctc

SEQ ID NO: 7872770 - DNA, 22 bp, Homo sapiens
ccagggagcggggctgggtctc

SEQ ID NO: 7872771 - DNA, 18 bp, Homo sapiens
ccagggagcttattagga

SEQ ID NO: 7872772 - DNA, 18 bp, Homo sapiens
ccagggagcttattagga

SEQ ID NO: 7872773 - DNA, 22 bp, Homo sapiens
aggctccgtccagtctcaggcc

SEQ ID NO: 7872774 - DNA, 22 bp, Homo sapiens
aggctccgtccagtctcaggcc

SEQ ID NO: 7872775 - DNA, 22 bp, Homo sapiens
aggctcctagcctgtggctggt

SEQ ID NO: 7872776 - DNA, 22 bp, Homo sapiens
aggctcctatcgctttcagcaa

SEQ ID NO: 7872777 - DNA, 22 bp, Homo sapiens
aggctcctcggggctgacggcg

SEQ ID NO: 7872778 - DNA, 22 bp, Homo sapiens
aggctcctgagaggcagaggct

SEQ ID NO: 7872779 - DNA, 22 bp, Homo sapiens
aggctcctgagaggcagaggct

SEQ ID NO: 7872780 - DNA, 22 bp, Homo sapiens
ccagggagcctggtgtgtcagc

SEQ ID NO: 7872781 - DNA, 22 bp, Homo sapiens
ccagggagcctggtgtgtcagc

SEQ ID NO: 7872782 - DNA, 22 bp, Homo sapiens
ccagggagcctggtgtgtcagc

SEQ ID NO: 7872783 - DNA, 22 bp, Homo sapiens
ccagggagcccacaggacaatg

SEQ ID NO: 7872784 - DNA, 22 bp, Homo sapiens
ccagggagcctggtgtgtcagc

SEQ ID NO: 7872785 - DNA, 22 bp, Homo sapiens
ccagggagcctggtgtgtcagc

SEQ ID NO: 7872786 - DNA, 22 bp, Homo sapiens
ccagggagcggggctgggtctc

SEQ ID NO: 7872787 - DNA, 22 bp, Homo sapiens
ccagggagcccacaggacaatg

SEQ ID NO: 7872788 - DNA, 22 bp, Homo sapiens
ccagggactttgcattgtttat

SEQ ID NO: 7872789 - DNA, 22 bp, Homo sapiens
ccagggagcccacaggacaatg

SEQ ID NO: 7872790 - DNA, 22 bp, Homo sapiens
ccagggagcccacaggacaatg

SEQ ID NO: 7872791 - DNA, 22 bp, Homo sapiens
ccagggagcccacaggacaatg

SEQ ID NO: 7872792 - DNA, 22 bp, Homo sapiens
ccagggagcccacaggacaatg

SEQ ID NO: 7872793 - DNA, 22 bp, Homo sapiens
ccagggaagtagttgtgagagc

SEQ ID NO: 7872794 - DNA, 22 bp, Homo sapiens
ccagggaaggctgctggctgtg

SEQ ID NO: 7872795 - DNA, 22 bp, Homo sapiens
ccagggaagtagttgtgagagc

SEQ ID NO: 7872796 - DNA, 22 bp, Homo sapiens
ccagggaatcaggcagaagtca

SEQ ID NO: 7872797 - DNA, 22 bp, Homo sapiens
ccagggaatcaggcagaagtca

SEQ ID NO: 7872798 - DNA, 22 bp, Homo sapiens
ccagggaagtcacattgtctag

SEQ ID NO: 7872799 - DNA, 22 bp, Homo sapiens
ccagggaagtcacattgtctag

SEQ ID NO: 7872800 - DNA, 22 bp, Homo sapiens
ccagggaatctctgagtgtgtt

SEQ ID NO: 7872801 - DNA, 22 bp, Homo sapiens
ccagggaatgtgggatgactct

SEQ ID NO: 7872802 - DNA, 22 bp, Homo sapiens
ccagggaatgtgggatgactct

SEQ ID NO: 7872803 - DNA, 22 bp, Homo sapiens
ccagggaatgatatttttgcct

SEQ ID NO: 7872804 - DNA, 22 bp, Homo sapiens
ccagggaatctctgagtgtgtt

SEQ ID NO: 7872805 - DNA, 22 bp, Homo sapiens
ccagggaatctctgagtgtgtt

SEQ ID NO: 7872806 - DNA, 22 bp, Homo sapiens
ccagggaatctctgagtgtgtt

SEQ ID NO: 7872807 - DNA, 22 bp, Homo sapiens
ccagggaatcaggcagaagtca

SEQ ID NO: 7872808 - DNA, 22 bp, Homo sapiens
aggcaggggagctggaagggta

SEQ ID NO: 7872809 - DNA, 22 bp, Homo sapiens
aggcaggggagctggaagggta

SEQ ID NO: 7872810 - DNA, 22 bp, Homo sapiens
aggcaggggagctggaagggta

SEQ ID NO: 7872811 - DNA, 22 bp, Homo sapiens
aggcaggggagctggaagggta

SEQ ID NO: 7872812 - DNA, 22 bp, Homo sapiens
aggcaggggagctggaagggta

SEQ ID NO: 7872813 - DNA, 22 bp, Homo sapiens
aggcaggggagctggaagggta

SEQ ID NO: 7872814 - DNA, 22 bp, Homo sapiens
aggcaggggagctggaagggta

SEQ ID NO: 7872815 - DNA, 22 bp, Homo sapiens
aggcaggggagctggaagggta

SEQ ID NO: 7872816 - DNA, 22 bp, Homo sapiens
aggcagggtcttgctatgttgc

SEQ ID NO: 7872817 - DNA, 22 bp, Homo sapiens
aggcagggtcttgctatgttgc

SEQ ID NO: 7872818 - DNA, 22 bp, Homo sapiens
aggcagggtgatgataatgatt

SEQ ID NO: 7872819 - DNA, 22 bp, Homo sapiens
aggcagggtgatgataatgatt

SEQ ID NO: 7872820 - DNA, 22 bp, Homo sapiens
aggcaggggagctggaagggta

SEQ ID NO: 7872821 - DNA, 22 bp, Homo sapiens
aggcagggtcttgctatgttgc

SEQ ID NO: 7872822 - DNA, 22 bp, Homo sapiens
aggcagggtcttgctatgttgc

SEQ ID NO: 7872823 - DNA, 22 bp, Homo sapiens
ccacagcttcgcagtctgctgc

SEQ ID NO: 7872824 - DNA, 22 bp, Homo sapiens
ccacagcttcgcagtctgctgc

SEQ ID NO: 7872825 - DNA, 22 bp, Homo sapiens
ccacagcttcgcagtctgctgc

SEQ ID NO: 7872826 - DNA, 22 bp, Homo sapiens
ccacagcttcttatatcactgg

SEQ ID NO: 7872827 - DNA, 22 bp, Homo sapiens
ccacaggaagttatgagtacta

SEQ ID NO: 7872828 - DNA, 22 bp, Homo sapiens
ccacagcttcgcagtctgctgc

SEQ ID NO: 7872829 - DNA, 21 bp, Homo sapiens
ccacagctggtctctgagccc

SEQ ID NO: 7872830 - DNA, 21 bp, Homo sapiens
ccacagctggtctctgagccc

SEQ ID NO: 7872831 - DNA, 17 bp, Homo sapiens
ccacagctgggtgcctt

SEQ ID NO: 7872832 - DNA, 17 bp, Homo sapiens
ccacagctgggtgcctt

SEQ ID NO: 7872833 - DNA, 21 bp, Homo sapiens
ccacagctggtctctgagccc

SEQ ID NO: 7872834 - DNA, 22 bp, Homo sapiens
ccacaggacacaactgctgacc

SEQ ID NO: 7872835 - DNA, 22 bp, Homo sapiens
ccacaggacagttaatgtgcag

SEQ ID NO: 7872836 - DNA, 22 bp, Homo sapiens
ccacaggacagttaatgtgcag

SEQ ID NO: 7872837 - DNA, 22 bp, Homo sapiens
ccacaggacacaactgctgacc

SEQ ID NO: 7872838 - DNA, 22 bp, Homo sapiens
ccacaggacacaactgctgacc

SEQ ID NO: 7872839 - DNA, 22 bp, Homo sapiens
ccacaggacacaactgctgacc

SEQ ID NO: 7872840 - DNA, 22 bp, Homo sapiens
ccacaggaagttatgagtacta

SEQ ID NO: 7872841 - DNA, 22 bp, Homo sapiens
ccacaggaagttatgagtacta

SEQ ID NO: 7872842 - DNA, 22 bp, Homo sapiens
ccacaggaagttatgagtacta

SEQ ID NO: 7872843 - DNA, 22 bp, Homo sapiens
aggcagggtgatgataatgatt

SEQ ID NO: 7872844 - DNA, 22 bp, Homo sapiens
aggcagggtgatgataatgatt

SEQ ID NO: 7872845 - DNA, 22 bp, Homo sapiens
aggcagggtgatgataatgatt

SEQ ID NO: 7872846 - DNA, 22 bp, Homo sapiens
aggcagggtgatgataatgatt

SEQ ID NO: 7872847 - DNA, 17 bp, Homo sapiens
aggcaggtaagagttat

SEQ ID NO: 7872848 - DNA, 17 bp, Homo sapiens
aggcaggtaagagttat

SEQ ID NO: 7872849 - DNA, 22 bp, Homo sapiens
ccacagctgaccgcaggtgagc

SEQ ID NO: 7872850 - DNA, 17 bp, Homo sapiens
ccacagctgggtgcctt

SEQ ID NO: 7872851 - DNA, 22 bp, Homo sapiens
ccacagctgaccgcaggtgagc

SEQ ID NO: 7872852 - DNA, 17 bp, Homo sapiens
ccacagctgggtgcctt

SEQ ID NO: 7872853 - DNA, 22 bp, Homo sapiens
ccagagagtatcatggagagta

SEQ ID NO: 7872854 - DNA, 22 bp, Homo sapiens
ccagagagtatcatggagagta

SEQ ID NO: 7872855 - DNA, 22 bp, Homo sapiens
ccagagagtatcatggagagta

SEQ ID NO: 7872856 - DNA, 22 bp, Homo sapiens
ccagagagtatcatggagagta

SEQ ID NO: 7872857 - DNA, 22 bp, Homo sapiens
ccagagagtatcatggagagta

SEQ ID NO: 7872858 - DNA, 22 bp, Homo sapiens
ccagagagtatcatggagagta

SEQ ID NO: 7872859 - DNA, 22 bp, Homo sapiens
ccagagagtcgatgggggacac

SEQ ID NO: 7872860 - DNA, 22 bp, Homo sapiens
ccagagagtcgatgggggacac

SEQ ID NO: 7872861 - DNA, 22 bp, Homo sapiens
ccagagagtcgatgggggacac

SEQ ID NO: 7872862 - DNA, 22 bp, Homo sapiens
ccagagagtcgatgggggacac

SEQ ID NO: 7872863 - DNA, 22 bp, Homo sapiens
ccagagagtcgatgggggacac

SEQ ID NO: 7872864 - DNA, 22 bp, Homo sapiens
ccagagagtcgatgggggacac

SEQ ID NO: 7872865 - DNA, 22 bp, Homo sapiens
ccagagagtcgatgggggacac

SEQ ID NO: 7872866 - DNA, 22 bp, Homo sapiens
ccagagagtatcatggagagta

SEQ ID NO: 7872867 - DNA, 22 bp, Homo sapiens
ccagagagtatcatggagagta

SEQ ID NO: 7872868 - DNA, 22 bp, Homo sapiens
ccagagaggtagcttaccctct

SEQ ID NO: 7872869 - DNA, 22 bp, Homo sapiens
ccagagaggggaagggcttgcc

SEQ ID NO: 7872870 - DNA, 22 bp, Homo sapiens
ccagagaggtagcttaccctct

SEQ ID NO: 7872871 - DNA, 22 bp, Homo sapiens
ccagagaggggaagggcttgcc

SEQ ID NO: 7872872 - DNA, 22 bp, Homo sapiens
ccagagaggggaagggcttgcc

SEQ ID NO: 7872873 - DNA, 22 bp, Homo sapiens
ccagagaggggaagggcttgcc

SEQ ID NO: 7872874 - DNA, 22 bp, Homo sapiens
ccagagaggggaagggcttgcc

SEQ ID NO: 7872875 - DNA, 20 bp, Homo sapiens
ccagagagtaggttagtgat

SEQ ID NO: 7872876 - DNA, 20 bp, Homo sapiens
ccagagagtaggttagtgat

SEQ ID NO: 7872877 - DNA, 22 bp, Homo sapiens
ccagagagtaggaggcattatt

SEQ ID NO: 7872878 - DNA, 20 bp, Homo sapiens
ccagagagtaggttagtgat

SEQ ID NO: 7872879 - DNA, 17 bp, Homo sapiens
ccagagagtagttagga

SEQ ID NO: 7872880 - DNA, 20 bp, Homo sapiens
ccagagagtaggttagtgat

SEQ ID NO: 7872881 - DNA, 22 bp, Homo sapiens
ccagagagggcgccacctggag

SEQ ID NO: 7872882 - DNA, 22 bp, Homo sapiens
ccagagagggcgccacctggag

SEQ ID NO: 7872883 - DNA, 22 bp, Homo sapiens
ccagagagggcgccacctggag

SEQ ID NO: 7872884 - DNA, 22 bp, Homo sapiens
ccagagaaagtgaagcaaatgt

SEQ ID NO: 7872885 - DNA, 22 bp, Homo sapiens
ccagagaaagtgaagcaaatgt

SEQ ID NO: 7872886 - DNA, 22 bp, Homo sapiens
ccagagaaaggtttgattcatt

SEQ ID NO: 7872887 - DNA, 22 bp, Homo sapiens
ccagagaaagtgaagcaaatgt

SEQ ID NO: 7872888 - DNA, 20 bp, Homo sapiens
ccacaggagtccagtcgacc

SEQ ID NO: 7872889 - DNA, 22 bp, Homo sapiens
ccacaggatccaagggaaggca

SEQ ID NO: 7872890 - DNA, 22 bp, Homo sapiens
ccagagaaaggtttgattcatt

SEQ ID NO: 7872891 - DNA, 22 bp, Homo sapiens
ccagagaaaggtttgattcatt

SEQ ID NO: 7872892 - DNA, 22 bp, Homo sapiens
ccagagaaaggtttgattcatt

SEQ ID NO: 7872893 - DNA, 22 bp, Homo sapiens
ccagagaaagctcacaggcagt

SEQ ID NO: 7872894 - DNA, 23 bp, Homo sapiens
ccacaggcacagaggcttgcatc

SEQ ID NO: 7872895 - DNA, 20 bp, Homo sapiens
ccacaggagtccagtcgacc

SEQ ID NO: 7872896 - DNA, 20 bp, Homo sapiens
ccacaggagtccagtcgacc

SEQ ID NO: 7872897 - DNA, 22 bp, Homo sapiens
ccacaggaggatgttcagacaa

SEQ ID NO: 7872898 - DNA, 22 bp, Homo sapiens
ccacaggaggatgttcagacaa

SEQ ID NO: 7872899 - DNA, 23 bp, Homo sapiens
ccacaggagggttcatttattca

SEQ ID NO: 7872900 - DNA, 22 bp, Homo sapiens
ccacaggacggaggtctggccg

SEQ ID NO: 7872901 - DNA, 22 bp, Homo sapiens
ccacaggaggaacaattagatg

SEQ ID NO: 7872902 - DNA, 22 bp, Homo sapiens
ccacaggaggaacaattagatg

SEQ ID NO: 7872903 - DNA, 22 bp, Homo sapiens
ccacaggaggatgttcagacaa

SEQ ID NO: 7872904 - DNA, 22 bp, Homo sapiens
ccacaggaccagaggagatcac

SEQ ID NO: 7872905 - DNA, 22 bp, Homo sapiens
ccacaggaccagaggagatcac

SEQ ID NO: 7872906 - DNA, 22 bp, Homo sapiens
ccacaggacagttaatgtgcag

SEQ ID NO: 7872907 - DNA, 22 bp, Homo sapiens
ccacaggacggaggtctggccg

SEQ ID NO: 7872908 - DNA, 22 bp, Homo sapiens
ccacaggaccagaggagatcac

SEQ ID NO: 7872909 - DNA, 22 bp, Homo sapiens
ccacaggacggaggtctggccg

SEQ ID NO: 7872910 - DNA, 22 bp, Homo sapiens
ccacaggacggaggtctggccg

SEQ ID NO: 7872911 - DNA, 22 bp, Homo sapiens
ccacaggacggaggtctggccg

SEQ ID NO: 7872912 - DNA, 22 bp, Homo sapiens
ccacaggacggaggtctggccg

SEQ ID NO: 7872913 - DNA, 22 bp, Homo sapiens
ccagagcagaaccggaacacca

SEQ ID NO: 7872914 - DNA, 22 bp, Homo sapiens
ccagagcagaaccggaacacca

SEQ ID NO: 7872915 - DNA, 22 bp, Homo sapiens
ccagagcagatgtggccttggt

SEQ ID NO: 7872916 - DNA, 22 bp, Homo sapiens
ccagagcagatgtggccttggt

SEQ ID NO: 7872917 - DNA, 22 bp, Homo sapiens
ccagagcagatgtggccttggt

SEQ ID NO: 7872918 - DNA, 17 bp, Homo sapiens
ccagagatgcctcaggc

SEQ ID NO: 7872919 - DNA, 17 bp, Homo sapiens
ccagagatgcctcaggc

SEQ ID NO: 7872920 - DNA, 22 bp, Homo sapiens
ccagagatgctcagggtttgca

SEQ ID NO: 7872921 - DNA, 22 bp, Homo sapiens
ccagagatgtgaaaatgccgga

SEQ ID NO: 7872922 - DNA, 22 bp, Homo sapiens
ccagagatgttcacattctaat

SEQ ID NO: 7872923 - DNA, 22 bp, Homo sapiens
ccagagatggacagggaatttg

SEQ ID NO: 7872924 - DNA, 22 bp, Homo sapiens
ccagagcaattctcacagaact

SEQ ID NO: 7872925 - DNA, 22 bp, Homo sapiens
ccagagatgttcacattctaat

SEQ ID NO: 7872926 - DNA, 22 bp, Homo sapiens
ccagagatgttcacattctaat

SEQ ID NO: 7872927 - DNA, 22 bp, Homo sapiens
ccagagatgttcacattctaat

SEQ ID NO: 7872928 - DNA, 23 bp, Homo sapiens
ccagagattgttacacagtaggc

SEQ ID NO: 7872929 - DNA, 22 bp, Homo sapiens
aggcatggacatttcggcagct

SEQ ID NO: 7872930 - DNA, 22 bp, Homo sapiens
aggcatggacatttcggcagct

SEQ ID NO: 7872931 - DNA, 22 bp, Homo sapiens
aggcatggacatttcggcagct

SEQ ID NO: 7872932 - DNA, 22 bp, Homo sapiens
aggcatggacatttcggcagct

SEQ ID NO: 7872933 - DNA, 22 bp, Homo sapiens
aggcatggatggatccagggct

SEQ ID NO: 7872934 - DNA, 21 bp, Homo sapiens
aggcatggaaatggcacactg

SEQ ID NO: 7872935 - DNA, 21 bp, Homo sapiens
aggcatggaaatggcacactg

SEQ ID NO: 7872936 - DNA, 21 bp, Homo sapiens
aggcatggaaatggcacactg

SEQ ID NO: 7872937 - DNA, 21 bp, Homo sapiens
aggcatggaaatggcacactg

SEQ ID NO: 7872938 - DNA, 19 bp, Homo sapiens
aggcatgcccctgagtcca

SEQ ID NO: 7872939 - DNA, 22 bp, Homo sapiens
aggcatgcgccaatttattaga

SEQ ID NO: 7872940 - DNA, 20 bp, Homo sapiens
ccagagcagccactgaagtt

SEQ ID NO: 7872941 - DNA, 22 bp, Homo sapiens
aggcatgcaaacagtctagagt

SEQ ID NO: 7872942 - DNA, 22 bp, Homo sapiens
aggcatgcaaacagtctagagt

SEQ ID NO: 7872943 - DNA, 22 bp, Homo sapiens
aggcatgcatcactattcttag

SEQ ID NO: 7872944 - DNA, 22 bp, Homo sapiens
aggcatggcactgagcagcttc

SEQ ID NO: 7872945 - DNA, 22 bp, Homo sapiens
aggcatggcactgagcagcttc

SEQ ID NO: 7872946 - DNA, 22 bp, Homo sapiens
aggcatggcactgagcagcttc

SEQ ID NO: 7872947 - DNA, 22 bp, Homo sapiens
aggcatggcactgagcagcttc

SEQ ID NO: 7872948 - DNA, 22 bp, Homo sapiens
aggcatggcactgagcagcttc

SEQ ID NO: 7872949 - DNA, 22 bp, Homo sapiens
aggcatggatgtagcagtgacc

SEQ ID NO: 7872950 - DNA, 22 bp, Homo sapiens
aggcatggcactgagcagcttc

SEQ ID NO: 7872951 - DNA, 22 bp, Homo sapiens
aggcatggatgtagcagtgacc

SEQ ID NO: 7872952 - DNA, 22 bp, Homo sapiens
aggcatggatgtagcagtgacc

SEQ ID NO: 7872953 - DNA, 22 bp, Homo sapiens
aggcatggatgtagcagtgacc

SEQ ID NO: 7872954 - DNA, 22 bp, Homo sapiens
aggcatggatggatccagggct

SEQ ID NO: 7872955 - DNA, 22 bp, Homo sapiens
aggcatggatgtagcagtgacc

SEQ ID NO: 7872956 - DNA, 22 bp, Homo sapiens
aggcatggatgtagcagtgacc

SEQ ID NO: 7872957 - DNA, 22 bp, Homo sapiens
aggcatggcactgagcagcttc

SEQ ID NO: 7872958 - DNA, 22 bp, Homo sapiens
aggcatggcactgagcagcttc

SEQ ID NO: 7872959 - DNA, 22 bp, Homo sapiens
aggcatggcactgagcagcttc

SEQ ID NO: 7872960 - DNA, 23 bp, Homo sapiens
aggcatggcatggatggtggctc

SEQ ID NO: 7872961 - DNA, 22 bp, Homo sapiens
ccagagtgacgtgaagtgtgaa

SEQ ID NO: 7872962 - DNA, 22 bp, Homo sapiens
ccagagtgacgtgaagtgtgaa

SEQ ID NO: 7872963 - DNA, 22 bp, Homo sapiens
ccagagtgacgtgaagtgtgaa

SEQ ID NO: 7872964 - DNA, 22 bp, Homo sapiens
aggcatggcatggggcagatgt

SEQ ID NO: 7872965 - DNA, 23 bp, Homo sapiens
aggcatggcatggatggtggctc

SEQ ID NO: 7872966 - DNA, 22 bp, Homo sapiens
aggccagagaggggaccagcct

SEQ ID NO: 7872967 - DNA, 22 bp, Homo sapiens
aggccagagaggggaccagcct

SEQ ID NO: 7872968 - DNA, 22 bp, Homo sapiens
aggccagagaggggaccagcct

SEQ ID NO: 7872969 - DNA, 22 bp, Homo sapiens
aggccagactttggccaaatcc

SEQ ID NO: 7872970 - DNA, 22 bp, Homo sapiens
aggccagagaggggaccagcct

SEQ ID NO: 7872971 - DNA, 22 bp, Homo sapiens
aggccagacagctagaaacagg

SEQ ID NO: 7872972 - DNA, 22 bp, Homo sapiens
aggccagacagctagaaacagg

SEQ ID NO: 7872973 - DNA, 22 bp, Homo sapiens
aggccagaagccagaaatgctt

SEQ ID NO: 7872974 - DNA, 22 bp, Homo sapiens
aggccagacagctagaaacagg

SEQ ID NO: 7872975 - DNA, 22 bp, Homo sapiens
aggccagaagtcaaaaactcta

SEQ ID NO: 7872976 - DNA, 22 bp, Homo sapiens
aggccagacagctagaaacagg

SEQ ID NO: 7872977 - DNA, 22 bp, Homo sapiens
aggccagaagtcaaaaactcta

SEQ ID NO: 7872978 - DNA, 22 bp, Homo sapiens
aggccagaacagctctgcacca

SEQ ID NO: 7872979 - DNA, 22 bp, Homo sapiens
aggccagaacagctctgcacca

SEQ ID NO: 7872980 - DNA, 22 bp, Homo sapiens
aggccagaagccagaaatgctt

SEQ ID NO: 7872981 - DNA, 22 bp, Homo sapiens
ccagcagaggggcggagtgcag

SEQ ID NO: 7872982 - DNA, 22 bp, Homo sapiens
ccagcagaggggcggagtgcag

SEQ ID NO: 7872983 - DNA, 22 bp, Homo sapiens
aggccagaaatgtcagggagtg

SEQ ID NO: 7872984 - DNA, 22 bp, Homo sapiens
aggccagaaatttggagtatgt

SEQ ID NO: 7872985 - DNA, 22 bp, Homo sapiens
ccagcagagggcgcttcacacc

SEQ ID NO: 7872986 - DNA, 22 bp, Homo sapiens
ccagcagagggcgcttcacacc

SEQ ID NO: 7872987 - DNA, 22 bp, Homo sapiens
ccagcagaggggcggagtgcag

SEQ ID NO: 7872988 - DNA, 22 bp, Homo sapiens
ccagcagagggcgcttcacacc

SEQ ID NO: 7872989 - DNA, 22 bp, Homo sapiens
ccagcagaggcatcatccttcc

SEQ ID NO: 7872990 - DNA, 22 bp, Homo sapiens
ccagcagagctggaagtgtgct

SEQ ID NO: 7872991 - DNA, 22 bp, Homo sapiens
ccagcagaggcatcatccttcc

SEQ ID NO: 7872992 - DNA, 22 bp, Homo sapiens
ccagcagaggcatcatccttcc

SEQ ID NO: 7872993 - DNA, 22 bp, Homo sapiens
ccagcagagcatggggaggaag

SEQ ID NO: 7872994 - DNA, 22 bp, Homo sapiens
ccagcagagcatggggaggaag

SEQ ID NO: 7872995 - DNA, 22 bp, Homo sapiens
ccagcagagctcaaacttcctg

SEQ ID NO: 7872996 - DNA, 22 bp, Homo sapiens
ccagcagagcatggggaggaag

SEQ ID NO: 7872997 - DNA, 22 bp, Homo sapiens
ccagcagagctggaagtgtgct

SEQ ID NO: 7872998 - DNA, 22 bp, Homo sapiens
ccagcagagctcaaacttcctg

SEQ ID NO: 7872999 - DNA, 19 bp, Homo sapiens
ccagcagacacagctgccc

SEQ ID NO: 7873000 - DNA, 19 bp, Homo sapiens
ccagcagacacagctgccc

SEQ ID NO: 7873001 - DNA, 19 bp, Homo sapiens
ccagcagacacagctgccc

SEQ ID NO: 7873002 - DNA, 22 bp, Homo sapiens
ccagcagagcatggggaggaag

SEQ ID NO: 7873003 - DNA, 19 bp, Homo sapiens
ccagcagacacagctgccc

SEQ ID NO: 7873004 - DNA, 19 bp, Homo sapiens
ccagcagacacagctgccc

SEQ ID NO: 7873005 - DNA, 22 bp, Homo sapiens
ccagcagaagctcccgctgggt

SEQ ID NO: 7873006 - DNA, 22 bp, Homo sapiens
ccagcagacacacaggcgtggg

SEQ ID NO: 7873007 - DNA, 22 bp, Homo sapiens
ccagcagaagctcccgctgggt

SEQ ID NO: 7873008 - DNA, 22 bp, Homo sapiens
ccagcagaagctcccgctgggt

SEQ ID NO: 7873009 - DNA, 22 bp, Homo sapiens
ccagcagaagctcccgctgggt

SEQ ID NO: 7873010 - DNA, 19 bp, Homo sapiens
ccagcagaagccactcctg

SEQ ID NO: 7873011 - DNA, 19 bp, Homo sapiens
ccagcagaagccactcctg

SEQ ID NO: 7873012 - DNA, 19 bp, Homo sapiens
ccagcagaagccactcctg

SEQ ID NO: 7873013 - DNA, 19 bp, Homo sapiens
ccagcagaagccactcctg

SEQ ID NO: 7873014 - DNA, 19 bp, Homo sapiens
ccagagttcttgccattct

SEQ ID NO: 7873015 - DNA, 22 bp, Homo sapiens
ccagcactgttctaaggaaaca

SEQ ID NO: 7873016 - DNA, 19 bp, Homo sapiens
ccagctggcctgggacctc

SEQ ID NO: 7873017 - DNA, 22 bp, Homo sapiens
ccagctggcccagctgtgctcc

SEQ ID NO: 7873018 - DNA, 19 bp, Homo sapiens
ccagctggcctgggacctc

SEQ ID NO: 7873019 - DNA, 19 bp, Homo sapiens
ccagctggcctgggacctc

SEQ ID NO: 7873020 - DNA, 19 bp, Homo sapiens
ccagctggcctgggacctc

SEQ ID NO: 7873021 - DNA, 22 bp, Homo sapiens
aggcccagctggacaaactgct

SEQ ID NO: 7873022 - DNA, 22 bp, Homo sapiens
aggcccagctggacaaactgct

SEQ ID NO: 7873023 - DNA, 22 bp, Homo sapiens
aggcccagctggacaaactgct

SEQ ID NO: 7873024 - DNA, 19 bp, Homo sapiens
ccagctggcctgggacctc

SEQ ID NO: 7873025 - DNA, 22 bp, Homo sapiens
ccagcttctctctgatgcagct

SEQ ID NO: 7873026 - DNA, 22 bp, Homo sapiens
ccagcttctctctgatgcagct

SEQ ID NO: 7873027 - DNA, 22 bp, Homo sapiens
ccagctttaggttgcctgccag

SEQ ID NO: 7873028 - DNA, 22 bp, Homo sapiens
ccagcttgtttgaagctcgtca

SEQ ID NO: 7873029 - DNA, 22 bp, Homo sapiens
ccagcttgtttgaagctcgtca

SEQ ID NO: 7873030 - DNA, 22 bp, Homo sapiens
ccagcttggaatatgccattgt

SEQ ID NO: 7873031 - DNA, 22 bp, Homo sapiens
ccagcttgctcctctgcaatgg

SEQ ID NO: 7873032 - DNA, 22 bp, Homo sapiens
ccagcttggagtaacaaatggt

SEQ ID NO: 7873033 - DNA, 22 bp, Homo sapiens
ccagcttggaatatgccattgt

SEQ ID NO: 7873034 - DNA, 22 bp, Homo sapiens
ccagcttgttccttagactctg

SEQ ID NO: 7873035 - DNA, 22 bp, Homo sapiens
ccagctttcatatcatgaggta

SEQ ID NO: 7873036 - DNA, 22 bp, Homo sapiens
ccagctttatagcttcaaagga

SEQ ID NO: 7873037 - DNA, 22 bp, Homo sapiens
ccagctttatagcttcaaagga

SEQ ID NO: 7873038 - DNA, 22 bp, Homo sapiens
ccagctttcatatcatgaggta

SEQ ID NO: 7873039 - DNA, 21 bp, Homo sapiens
ccagctttcccaagtcccttt

SEQ ID NO: 7873040 - DNA, 22 bp, Homo sapiens
aggcccagagagccagttagtg

SEQ ID NO: 7873041 - DNA, 22 bp, Homo sapiens
aggcccagagagccagttagtg

SEQ ID NO: 7873042 - DNA, 22 bp, Homo sapiens
aggcccagagagccagttagtg

SEQ ID NO: 7873043 - DNA, 22 bp, Homo sapiens
ccagcctgaaatgcctcatcct

SEQ ID NO: 7873044 - DNA, 22 bp, Homo sapiens
ccagcctggactgggtcttgtg

SEQ ID NO: 7873045 - DNA, 22 bp, Homo sapiens
ccagcctggactgggtcttgtg

SEQ ID NO: 7873046 - DNA, 22 bp, Homo sapiens
aggcccagagcaggaaagggtt

SEQ ID NO: 7873047 - DNA, 22 bp, Homo sapiens
aggcccagagagccagttagtg

SEQ ID NO: 7873048 - DNA, 22 bp, Homo sapiens
aggcccagagcaggaaagggtt

SEQ ID NO: 7873049 - DNA, 21 bp, Homo sapiens
aggcccagagtcttgggggga

SEQ ID NO: 7873050 - DNA, 22 bp, Homo sapiens
aggcccagagcaggaaagggtt

SEQ ID NO: 7873051 - DNA, 22 bp, Homo sapiens
aggcccagagcaggaaagggtt

SEQ ID NO: 7873052 - DNA, 19 bp, Homo sapiens
aggcccagcgctgggggct

SEQ ID NO: 7873053 - DNA, 19 bp, Homo sapiens
aggcccagcgctgggggct

SEQ ID NO: 7873054 - DNA, 19 bp, Homo sapiens
aggcccagcgctgggggct

SEQ ID NO: 7873055 - DNA, 19 bp, Homo sapiens
aggcccagcgctgggggct

SEQ ID NO: 7873056 - DNA, 19 bp, Homo sapiens
aggcccagcgctgggggct

SEQ ID NO: 7873057 - DNA, 19 bp, Homo sapiens
aggcccagcgctgggggct

SEQ ID NO: 7873058 - DNA, 19 bp, Homo sapiens
aggcccagcgctgggggct

SEQ ID NO: 7873059 - DNA, 22 bp, Homo sapiens
aggcccagctggacaaactgct

SEQ ID NO: 7873060 - DNA, 22 bp, Homo sapiens
aggcccagcccgtcctcgtgct

SEQ ID NO: 7873061 - DNA, 22 bp, Homo sapiens
aggcccagcccgtcctcgtgct

SEQ ID NO: 7873062 - DNA, 22 bp, Homo sapiens
aggcccagcccgtcctcgtgct

SEQ ID NO: 7873063 - DNA, 21 bp, Homo sapiens
aggcccagagtcttgggggga

SEQ ID NO: 7873064 - DNA, 22 bp, Homo sapiens
aggcccagcccgtcctcgtgct

SEQ ID NO: 7873065 - DNA, 22 bp, Homo sapiens
aggcccagcccgtcctcgtgct

SEQ ID NO: 7873066 - DNA, 22 bp, Homo sapiens
aggcccagcccgtcctcgtgct

SEQ ID NO: 7873067 - DNA, 22 bp, Homo sapiens
aggcccagcccgtcctcgtgct

SEQ ID NO: 7873068 - DNA, 22 bp, Homo sapiens
aggcccagcccgtcctcgtgct

SEQ ID NO: 7873069 - DNA, 22 bp, Homo sapiens
ccagccctgccagagagagctg

SEQ ID NO: 7873070 - DNA, 22 bp, Homo sapiens
aggccagatgtcgggctagaag

SEQ ID NO: 7873071 - DNA, 22 bp, Homo sapiens
ccagccctgccagagagagctg

SEQ ID NO: 7873072 - DNA, 22 bp, Homo sapiens
ccagcctcatcgcctgcctgtc

SEQ ID NO: 7873073 - DNA, 22 bp, Homo sapiens
ccagcctcatcgcctgcctgtc

SEQ ID NO: 7873074 - DNA, 22 bp, Homo sapiens
ccagccctgccagagagagctg

SEQ ID NO: 7873075 - DNA, 22 bp, Homo sapiens
ccagcctcatcatattcctgct

SEQ ID NO: 7873076 - DNA, 22 bp, Homo sapiens
ccagcctcatcgcctgcctgtc

SEQ ID NO: 7873077 - DNA, 22 bp, Homo sapiens
aggccagagttaaggagaacag

SEQ ID NO: 7873078 - DNA, 22 bp, Homo sapiens
aggccagagttaaggagaacag

SEQ ID NO: 7873079 - DNA, 22 bp, Homo sapiens
aggccagagttaaggagaacag

SEQ ID NO: 7873080 - DNA, 22 bp, Homo sapiens
aggccagagttaaggagaacag

SEQ ID NO: 7873081 - DNA, 17 bp, Homo sapiens
aggccagatgaggcaag

SEQ ID NO: 7873082 - DNA, 22 bp, Homo sapiens
aggccagatattgtgctaccca

SEQ ID NO: 7873083 - DNA, 22 bp, Homo sapiens
aggccagatattgtgctaccca

SEQ ID NO: 7873084 - DNA, 22 bp, Homo sapiens
aggccagatattgtgctaccca

SEQ ID NO: 7873085 - DNA, 17 bp, Homo sapiens
aggccagatgaggcaag

SEQ ID NO: 7873086 - DNA, 17 bp, Homo sapiens
aggccagatgaggcaag

SEQ ID NO: 7873087 - DNA, 17 bp, Homo sapiens
aggccagatgaggcaag

SEQ ID NO: 7873088 - DNA, 17 bp, Homo sapiens
aggccagatgaggcaag

SEQ ID NO: 7873089 - DNA, 22 bp, Homo sapiens
ccagcctgaaatgcctcatcct

SEQ ID NO: 7873090 - DNA, 23 bp, Homo sapiens
ccagcctctgggtcttcatccag

SEQ ID NO: 7873091 - DNA, 22 bp, Homo sapiens
ccagcctgaaatgcctcatcct

SEQ ID NO: 7873092 - DNA, 23 bp, Homo sapiens
ccagcctctgggtcttcatccag

SEQ ID NO: 7873093 - DNA, 23 bp, Homo sapiens
ccagcctctgggtcttcatccag

SEQ ID NO: 7873094 - DNA, 23 bp, Homo sapiens
ccagcctctgggtcttcatccag

SEQ ID NO: 7873095 - DNA, 22 bp, Homo sapiens
ccagcctgaaatgcctcatcct

SEQ ID NO: 7873096 - DNA, 22 bp, Homo sapiens
ccagcctgaaatgcctcatcct

SEQ ID NO: 7873097 - DNA, 22 bp, Homo sapiens
ccagcctgaaatgcctcatcct

SEQ ID NO: 7873098 - DNA, 22 bp, Homo sapiens
ccagcctgaaatgcctcatcct

SEQ ID NO: 7873099 - DNA, 22 bp, Homo sapiens
ccagcctgaaatgcctcatcct

SEQ ID NO: 7873100 - DNA, 22 bp, Homo sapiens
ccagcctccatgtagatagctg

SEQ ID NO: 7873101 - DNA, 22 bp, Homo sapiens
ccagcctccatgtagatagctg

SEQ ID NO: 7873102 - DNA, 22 bp, Homo sapiens
ccagcctccatgtagatagctg

SEQ ID NO: 7873103 - DNA, 22 bp, Homo sapiens
ccagcctcatcgcctgcctgtc

SEQ ID NO: 7873104 - DNA, 22 bp, Homo sapiens
ccagcctcatcgcctgcctgtc

SEQ ID NO: 7873105 - DNA, 22 bp, Homo sapiens
ccagcctcatcgcctgcctgtc

SEQ ID NO: 7873106 - DNA, 22 bp, Homo sapiens
ccagcctcatcgcctgcctgtc

SEQ ID NO: 7873107 - DNA, 22 bp, Homo sapiens
ccagcctcatcgcctgcctgtc

SEQ ID NO: 7873108 - DNA, 22 bp, Homo sapiens
ccagcctccatgtagatagctg

SEQ ID NO: 7873109 - DNA, 22 bp, Homo sapiens
ccagcctccatgtagatagctg

SEQ ID NO: 7873110 - DNA, 19 bp, Homo sapiens
ccagcctctcttccacccc

SEQ ID NO: 7873111 - DNA, 22 bp, Homo sapiens
ccagcctccatgtagatagctg

SEQ ID NO: 7873112 - DNA, 22 bp, Homo sapiens
ccaggagagcattgcacagagg

SEQ ID NO: 7873113 - DNA, 22 bp, Homo sapiens
ccaggagagcattgcacagagg

SEQ ID NO: 7873114 - DNA, 22 bp, Homo sapiens
ccaggagagcattgcacagagg

SEQ ID NO: 7873115 - DNA, 22 bp, Homo sapiens
ccaggagagcattgcacagagg

SEQ ID NO: 7873116 - DNA, 22 bp, Homo sapiens
ccaggagagcattgcacagagg

SEQ ID NO: 7873117 - DNA, 22 bp, Homo sapiens
ccaggagagcattgcacagagg

SEQ ID NO: 7873118 - DNA, 22 bp, Homo sapiens
ccaggagagcattgcacagagg

SEQ ID NO: 7873119 - DNA, 22 bp, Homo sapiens
ccaggagagcattgcacagagg

SEQ ID NO: 7873120 - DNA, 22 bp, Homo sapiens
ccaggagagcattgcacagagg

SEQ ID NO: 7873121 - DNA, 22 bp, Homo sapiens
ccaggagagcattgcacagagg

SEQ ID NO: 7873122 - DNA, 22 bp, Homo sapiens
ccaggagagcgccctcccggcc

SEQ ID NO: 7873123 - DNA, 22 bp, Homo sapiens
ccaggagagcgccctcccggcc

SEQ ID NO: 7873124 - DNA, 22 bp, Homo sapiens
ccaggagagcgccctcccggcc

SEQ ID NO: 7873125 - DNA, 22 bp, Homo sapiens
ccaggagagctctaaatggctg

SEQ ID NO: 7873126 - DNA, 22 bp, Homo sapiens
ccaggagagctctaaatggctg

SEQ ID NO: 7873127 - DNA, 22 bp, Homo sapiens
ccaggagagctctaaatggctg

SEQ ID NO: 7873128 - DNA, 22 bp, Homo sapiens
ccaggagagctctaaatggctg

SEQ ID NO: 7873129 - DNA, 22 bp, Homo sapiens
ccaggagagctctcgttcagtg

SEQ ID NO: 7873130 - DNA, 22 bp, Homo sapiens
ccaggagagctctcgttcagtg

SEQ ID NO: 7873131 - DNA, 22 bp, Homo sapiens
ccaggagagctctcgttcagtg

SEQ ID NO: 7873132 - DNA, 22 bp, Homo sapiens
ccaggagagctctcgttcagtg

SEQ ID NO: 7873133 - DNA, 22 bp, Homo sapiens
ccaggagagcaggcgtgcagct

SEQ ID NO: 7873134 - DNA, 22 bp, Homo sapiens
ccaggagagcaggcgtgcagct

SEQ ID NO: 7873135 - DNA, 22 bp, Homo sapiens
ccaggagagcaggcgtgcagct

SEQ ID NO: 7873136 - DNA, 22 bp, Homo sapiens
ccaggagagcaggcgtgcagct

SEQ ID NO: 7873137 - DNA, 22 bp, Homo sapiens
ccaggagagcaggcgtgcagct

SEQ ID NO: 7873138 - DNA, 22 bp, Homo sapiens
ccaggagagcaggcgtgcagct

SEQ ID NO: 7873139 - DNA, 22 bp, Homo sapiens
ccaggagagcaggcgtgcagct

SEQ ID NO: 7873140 - DNA, 22 bp, Homo sapiens
ccaggagagcaggcgtgcagct

SEQ ID NO: 7873141 - DNA, 22 bp, Homo sapiens
ccaggagagcagaagcccaggc

SEQ ID NO: 7873142 - DNA, 22 bp, Homo sapiens
ccaggagagcagaagcccaggc

SEQ ID NO: 7873143 - DNA, 22 bp, Homo sapiens
ccaggagagcagaagcccaggc

SEQ ID NO: 7873144 - DNA, 22 bp, Homo sapiens
ccaggagagcagaagcccaggc

SEQ ID NO: 7873145 - DNA, 22 bp, Homo sapiens
ccaggagagcagaagcccaggc

SEQ ID NO: 7873146 - DNA, 22 bp, Homo sapiens
ccaggagagcagaagcccaggc

SEQ ID NO: 7873147 - DNA, 22 bp, Homo sapiens
ccaggagagcagaagcccaggc

SEQ ID NO: 7873148 - DNA, 22 bp, Homo sapiens
ccaggagagcagaagcccaggc

SEQ ID NO: 7873149 - DNA, 22 bp, Homo sapiens
ccaggagcaaagatcactggga

SEQ ID NO: 7873150 - DNA, 22 bp, Homo sapiens
ccaggagcaaagatcactggga

SEQ ID NO: 7873151 - DNA, 22 bp, Homo sapiens
ccaggagcaaagatcactggga

SEQ ID NO: 7873152 - DNA, 22 bp, Homo sapiens
ccaggagatttttccatagcac

SEQ ID NO: 7873153 - DNA, 22 bp, Homo sapiens
ccaggagcgcgtgaacaggctg

SEQ ID NO: 7873154 - DNA, 22 bp, Homo sapiens
ccaggagcgggaaaaggaagaa

SEQ ID NO: 7873155 - DNA, 22 bp, Homo sapiens
ccaggagcgcgtgaacaggctg

SEQ ID NO: 7873156 - DNA, 22 bp, Homo sapiens
ccaggagcgggaaaaggaagaa

SEQ ID NO: 7873157 - DNA, 17 bp, Homo sapiens
ccaggagcgtgggtctc

SEQ ID NO: 7873158 - DNA, 22 bp, Homo sapiens
ccaggagcgggaaaaggaagaa

SEQ ID NO: 7873159 - DNA, 22 bp, Homo sapiens
ccaggagatgggaaagtagcag

SEQ ID NO: 7873160 - DNA, 22 bp, Homo sapiens
ccaggagatgggagcatctaaa

SEQ ID NO: 7873161 - DNA, 22 bp, Homo sapiens
ccaggagatgggagcatctaaa

SEQ ID NO: 7873162 - DNA, 22 bp, Homo sapiens
ccaggagatgggaaagtagcag

SEQ ID NO: 7873163 - DNA, 22 bp, Homo sapiens
ccaggagatgggaaagtagcag

SEQ ID NO: 7873164 - DNA, 22 bp, Homo sapiens
ccaggagatgggaaagtagcag

SEQ ID NO: 7873165 - DNA, 22 bp, Homo sapiens
ccaggagatgggaaagtagcag

SEQ ID NO: 7873166 - DNA, 22 bp, Homo sapiens
ccaggagatgggaaagtagcag

SEQ ID NO: 7873167 - DNA, 22 bp, Homo sapiens
ccaggagatgggaaagtagcag

SEQ ID NO: 7873168 - DNA, 22 bp, Homo sapiens
ccaggagataagctgagtttat

SEQ ID NO: 7873169 - DNA, 22 bp, Homo sapiens
ccaggagataagctgagtttat

SEQ ID NO: 7873170 - DNA, 19 bp, Homo sapiens
ccaggagagcttggagaag

SEQ ID NO: 7873171 - DNA, 19 bp, Homo sapiens
ccaggagagcttggagaag

SEQ ID NO: 7873172 - DNA, 22 bp, Homo sapiens
ccaggagataagctgagtttat

SEQ ID NO: 7873173 - DNA, 22 bp, Homo sapiens
ccaggagatgatgttggggatt

SEQ ID NO: 7873174 - DNA, 22 bp, Homo sapiens
ccaggagatgatgttggggatt

SEQ ID NO: 7873175 - DNA, 22 bp, Homo sapiens
aggccctggcccccagagattc

SEQ ID NO: 7873176 - DNA, 18 bp, Homo sapiens
aggccctggcctcgaaca

SEQ ID NO: 7873177 - DNA, 22 bp, Homo sapiens
aggccctggcccccagagattc

SEQ ID NO: 7873178 - DNA, 18 bp, Homo sapiens
aggccctggcctcgaaca

SEQ ID NO: 7873179 - DNA, 22 bp, Homo sapiens
aggccctggcctgactcaatgt

SEQ ID NO: 7873180 - DNA, 22 bp, Homo sapiens
aggccctgggagcagagatgca

SEQ ID NO: 7873181 - DNA, 22 bp, Homo sapiens
aggccctggctgggtttcttta

SEQ ID NO: 7873182 - DNA, 22 bp, Homo sapiens
aggccctgggagcagagatgca

SEQ ID NO: 7873183 - DNA, 22 bp, Homo sapiens
aggccctgggagcagagatgca

SEQ ID NO: 7873184 - DNA, 22 bp, Homo sapiens
aggccctgggcagttctgtagc

SEQ ID NO: 7873185 - DNA, 22 bp, Homo sapiens
aggccctgggagcagagatgca

SEQ ID NO: 7873186 - DNA, 22 bp, Homo sapiens
ccaggacaagtgtggccatggc

SEQ ID NO: 7873187 - DNA, 22 bp, Homo sapiens
ccaggacaagtgtggccatggc

SEQ ID NO: 7873188 - DNA, 22 bp, Homo sapiens
ccaggacaagtgtggccatggc

SEQ ID NO: 7873189 - DNA, 22 bp, Homo sapiens
ccaggacaagtgtggccatggc

SEQ ID NO: 7873190 - DNA, 22 bp, Homo sapiens
ccaggacaagtgtggccatggc

SEQ ID NO: 7873191 - DNA, 22 bp, Homo sapiens
ccaggacaagtgtggccatggc

SEQ ID NO: 7873192 - DNA, 22 bp, Homo sapiens
ccaggacaagtgtggccatggc

SEQ ID NO: 7873193 - DNA, 22 bp, Homo sapiens
ccaggacaagtgtggccatggc

SEQ ID NO: 7873194 - DNA, 22 bp, Homo sapiens
aggccctgggttagggcccact

SEQ ID NO: 7873195 - DNA, 20 bp, Homo sapiens
ccagctttccctgcagcatc

SEQ ID NO: 7873196 - DNA, 22 bp, Homo sapiens
ccagctttctcagaggcttcta

SEQ ID NO: 7873197 - DNA, 22 bp, Homo sapiens
ccagcttttggggtgacaattt

SEQ ID NO: 7873198 - DNA, 22 bp, Homo sapiens
ccagcttttcagaatctgcctg

SEQ ID NO: 7873199 - DNA, 22 bp, Homo sapiens
ccagcttttcagaatctgcctg

SEQ ID NO: 7873200 - DNA, 22 bp, Homo sapiens
ccagcttttcctctcattgctt

SEQ ID NO: 7873201 - DNA, 22 bp, Homo sapiens
aggccctggcactgcctgggag

SEQ ID NO: 7873202 - DNA, 22 bp, Homo sapiens
ccaggaaaaacacattgaagag

SEQ ID NO: 7873203 - DNA, 22 bp, Homo sapiens
ccaggaaaaacacattgaagag

SEQ ID NO: 7873204 - DNA, 22 bp, Homo sapiens
aggccctggcactgcctgggag

SEQ ID NO: 7873205 - DNA, 22 bp, Homo sapiens
aggccctggcactgcctgggag

SEQ ID NO: 7873206 - DNA, 22 bp, Homo sapiens
aggccctggcactgcctgggag

SEQ ID NO: 7873207 - DNA, 22 bp, Homo sapiens
aggccctggcactgcctgggag

SEQ ID NO: 7873208 - DNA, 22 bp, Homo sapiens
aggccctggcactgcctgggag

SEQ ID NO: 7873209 - DNA, 22 bp, Homo sapiens
aggccctggcccccagagattc

SEQ ID NO: 7873210 - DNA, 22 bp, Homo sapiens
aggccctggcccccagagattc

SEQ ID NO: 7873211 - DNA, 22 bp, Homo sapiens
aggccctggcccccagagattc

SEQ ID NO: 7873212 - DNA, 22 bp, Homo sapiens
aggccctggcactgcctgggag

SEQ ID NO: 7873213 - DNA, 22 bp, Homo sapiens
aggccctggcccccagagattc

SEQ ID NO: 7873214 - DNA, 22 bp, Homo sapiens
aggccctggcccccagagattc

SEQ ID NO: 7873215 - DNA, 22 bp, Homo sapiens
ccgcccacactaaatatgagcg

SEQ ID NO: 7873216 - DNA, 21 bp, Homo sapiens
ccgccacctctaagctgggtc

SEQ ID NO: 7873217 - DNA, 21 bp, Homo sapiens
ccgccgctgatagctctgggc

SEQ ID NO: 7873218 - DNA, 21 bp, Homo sapiens
ccgccgctgatagctctgggc

SEQ ID NO: 7873219 - DNA, 22 bp, Homo sapiens
ccgcccacactaaatatgagcg

SEQ ID NO: 7873220 - DNA, 22 bp, Homo sapiens
ccgcccacactaaatatgagcg

SEQ ID NO: 7873221 - DNA, 22 bp, Homo sapiens
ccgcccacactaaatatgagcg

SEQ ID NO: 7873222 - DNA, 22 bp, Homo sapiens
agggccctaaggaaggcacaca

SEQ ID NO: 7873223 - DNA, 22 bp, Homo sapiens
agggccctaaggaaggcacaca

SEQ ID NO: 7873224 - DNA, 22 bp, Homo sapiens
agggccctaaggaaggcacaca

SEQ ID NO: 7873225 - DNA, 22 bp, Homo sapiens
agggccctaaggaaggcacaca

SEQ ID NO: 7873226 - DNA, 22 bp, Homo sapiens
ccgccgtgcaggccgcgacgtg

SEQ ID NO: 7873227 - DNA, 22 bp, Homo sapiens
ccgccgtgcaggccgcgacgtg

SEQ ID NO: 7873228 - DNA, 22 bp, Homo sapiens
ccgccgtgcaggccgcgacgtg

SEQ ID NO: 7873229 - DNA, 22 bp, Homo sapiens
ccgccgtgcaggccgcgacgtg

SEQ ID NO: 7873230 - DNA, 22 bp, Homo sapiens
ccgaggctggagtgcagtggcg

SEQ ID NO: 7873231 - DNA, 22 bp, Homo sapiens
ccgaggtcctggacttggccct

SEQ ID NO: 7873232 - DNA, 22 bp, Homo sapiens
ccgaggtcctggacttggccct

SEQ ID NO: 7873233 - DNA, 22 bp, Homo sapiens
ccgaggtcctggacttggccct

SEQ ID NO: 7873234 - DNA, 22 bp, Homo sapiens
ccgaggcagggtggagccgcct

SEQ ID NO: 7873235 - DNA, 22 bp, Homo sapiens
ccgaggacattgggcttctgtt

SEQ ID NO: 7873236 - DNA, 22 bp, Homo sapiens
cccttttttatgtcaagcattg

SEQ ID NO: 7873237 - DNA, 22 bp, Homo sapiens
cccttttttatgtcaagcattg

SEQ ID NO: 7873238 - DNA, 22 bp, Homo sapiens
cccttttttatgtcaagcattg

SEQ ID NO: 7873239 - DNA, 22 bp, Homo sapiens
ccctttccatggctctcctagg

SEQ ID NO: 7873240 - DNA, 22 bp, Homo sapiens
cccttcccttctgggagatcca

SEQ ID NO: 7873241 - DNA, 22 bp, Homo sapiens
cccttcagtgctaggctgcctg

SEQ ID NO: 7873242 - DNA, 22 bp, Homo sapiens
cccttcagtgctaggctgcctg

SEQ ID NO: 7873243 - DNA, 22 bp, Homo sapiens
cccttcagtgctaggctgcctg

SEQ ID NO: 7873244 - DNA, 22 bp, Homo sapiens
cccttcagtgcgtgagaatgag

SEQ ID NO: 7873245 - DNA, 22 bp, Homo sapiens
cccttcagtgctaggctgcctg

SEQ ID NO: 7873246 - DNA, 22 bp, Homo sapiens
cccttcagtgcgtgagaatgag

SEQ ID NO: 7873247 - DNA, 22 bp, Homo sapiens
ccctttcccttctggctcaggg

SEQ ID NO: 7873248 - DNA, 22 bp, Homo sapiens
ccctttccatggctctcctagg

SEQ ID NO: 7873249 - DNA, 22 bp, Homo sapiens
ccctttccatggctctcctagg

SEQ ID NO: 7873250 - DNA, 22 bp, Homo sapiens
ccctttccatggctctcctagg

SEQ ID NO: 7873251 - DNA, 22 bp, Homo sapiens
ccctttcctgaagaatattttt

SEQ ID NO: 7873252 - DNA, 22 bp, Homo sapiens
ccctttcccttctggctcaggg

SEQ ID NO: 7873253 - DNA, 22 bp, Homo sapiens
ccctttcccttctggctcaggg

SEQ ID NO: 7873254 - DNA, 22 bp, Homo sapiens
ccctttcctgaagaatattttt

SEQ ID NO: 7873255 - DNA, 22 bp, Homo sapiens
ccctttctccagaactgtctga

SEQ ID NO: 7873256 - DNA, 22 bp, Homo sapiens
ccctttctgggacccctgtctc

SEQ ID NO: 7873257 - DNA, 22 bp, Homo sapiens
ccctttctgggacccctgtctc

SEQ ID NO: 7873258 - DNA, 21 bp, Homo sapiens
ccctttctccatacttcatcc

SEQ ID NO: 7873259 - DNA, 20 bp, Homo sapiens
cccttttcacgaaaaggaga

SEQ ID NO: 7873260 - DNA, 22 bp, Homo sapiens
ccctttttcactctaccaaggt

SEQ ID NO: 7873261 - DNA, 20 bp, Homo sapiens
cccttttcacgaaaaggaga

SEQ ID NO: 7873262 - DNA, 20 bp, Homo sapiens
cccttttcacgaaaaggaga

SEQ ID NO: 7873263 - DNA, 20 bp, Homo sapiens
cccttttcacgaaaaggaga

SEQ ID NO: 7873264 - DNA, 22 bp, Homo sapiens
ccctttttcactctaccaaggt

SEQ ID NO: 7873265 - DNA, 18 bp, Homo sapiens
ccctttgccctatgagta

SEQ ID NO: 7873266 - DNA, 22 bp, Homo sapiens
ccctttgcccagtatattctag

SEQ ID NO: 7873267 - DNA, 22 bp, Homo sapiens
ccctttcttccgtgacttctgc

SEQ ID NO: 7873268 - DNA, 22 bp, Homo sapiens
ccctttcttcttgactgaaaac

SEQ ID NO: 7873269 - DNA, 22 bp, Homo sapiens
ccctttcttcttgactgaaaac

SEQ ID NO: 7873270 - DNA, 22 bp, Homo sapiens
agggccagagtctgtgtagata

SEQ ID NO: 7873271 - DNA, 22 bp, Homo sapiens
agggccagagtctgtgtagata

SEQ ID NO: 7873272 - DNA, 22 bp, Homo sapiens
agggccagagtctgtgtagata

SEQ ID NO: 7873273 - DNA, 22 bp, Homo sapiens
agggccagagtctgtgtagata

SEQ ID NO: 7873274 - DNA, 22 bp, Homo sapiens
agggccagagtctgtgtagata

SEQ ID NO: 7873275 - DNA, 22 bp, Homo sapiens
agggccagagtctgtgtagata

SEQ ID NO: 7873276 - DNA, 22 bp, Homo sapiens
agggccagagtacatcagggct

SEQ ID NO: 7873277 - DNA, 22 bp, Homo sapiens
agggccagagtacatcagggct

SEQ ID NO: 7873278 - DNA, 22 bp, Homo sapiens
agggccagagtacatcagggct

SEQ ID NO: 7873279 - DNA, 22 bp, Homo sapiens
agggccagagtacatcagggct

SEQ ID NO: 7873280 - DNA, 22 bp, Homo sapiens
agggccagagtacatcagggct

SEQ ID NO: 7873281 - DNA, 22 bp, Homo sapiens
agggccagagtacatcagggct

SEQ ID NO: 7873282 - DNA, 22 bp, Homo sapiens
agggccagagtacatcagggct

SEQ ID NO: 7873283 - DNA, 22 bp, Homo sapiens
agggccagaggcaccttgcagc

SEQ ID NO: 7873284 - DNA, 22 bp, Homo sapiens
agggccagaggcaccttgcagc

SEQ ID NO: 7873285 - DNA, 22 bp, Homo sapiens
agggccagaggcaccttgcagc

SEQ ID NO: 7873286 - DNA, 22 bp, Homo sapiens
agggccagaatccctcagtcta

SEQ ID NO: 7873287 - DNA, 22 bp, Homo sapiens
agggccagaatccctcagtcta

SEQ ID NO: 7873288 - DNA, 22 bp, Homo sapiens
agggccagaggcaccttgcagc

SEQ ID NO: 7873289 - DNA, 22 bp, Homo sapiens
agggccagaggcaccttgcagc

SEQ ID NO: 7873290 - DNA, 22 bp, Homo sapiens
agggccagaatccctcagtcta

SEQ ID NO: 7873291 - DNA, 22 bp, Homo sapiens
agggccagaatccctcagtcta

SEQ ID NO: 7873292 - DNA, 22 bp, Homo sapiens
agggccagaatccctcagtcta

SEQ ID NO: 7873293 - DNA, 22 bp, Homo sapiens
agggccagaatccctcagtcta

SEQ ID NO: 7873294 - DNA, 22 bp, Homo sapiens
agggccagaatccctcagtcta

SEQ ID NO: 7873295 - DNA, 22 bp, Homo sapiens
ccctggaggcaaaggttgcagt

SEQ ID NO: 7873296 - DNA, 22 bp, Homo sapiens
ccctggaggcaaaggttgcagt

SEQ ID NO: 7873297 - DNA, 22 bp, Homo sapiens
ccctggaggcaaaggttgcagt

SEQ ID NO: 7873298 - DNA, 22 bp, Homo sapiens
ccctggaggcaaaggttgcagt

SEQ ID NO: 7873299 - DNA, 22 bp, Homo sapiens
ccctggaggcaaaggttgcagt

SEQ ID NO: 7873300 - DNA, 22 bp, Homo sapiens
ccctggaggcaaaggttgcagt

SEQ ID NO: 7873301 - DNA, 22 bp, Homo sapiens
ccctggaggcggagcttgcagt

SEQ ID NO: 7873302 - DNA, 22 bp, Homo sapiens
ccctggaggcggagcttgcagt

SEQ ID NO: 7873303 - DNA, 22 bp, Homo sapiens
ccctggaggcggagcttgcagt

SEQ ID NO: 7873304 - DNA, 22 bp, Homo sapiens
ccctggaggcggatgttgcagt

SEQ ID NO: 7873305 - DNA, 22 bp, Homo sapiens
ccctggaggcggagcttgcagt

SEQ ID NO: 7873306 - DNA, 22 bp, Homo sapiens
ccctggaggcggagcttgcagt

SEQ ID NO: 7873307 - DNA, 22 bp, Homo sapiens
ccctggaggctggaggcagtag

SEQ ID NO: 7873308 - DNA, 22 bp, Homo sapiens
ccctggaggctggaggcagtag

SEQ ID NO: 7873309 - DNA, 22 bp, Homo sapiens
ccctggaggctggaggcagtag

SEQ ID NO: 7873310 - DNA, 22 bp, Homo sapiens
ccctggaggcggatgttgcagt

SEQ ID NO: 7873311 - DNA, 22 bp, Homo sapiens
ccctggaggctggaggcagtag

SEQ ID NO: 7873312 - DNA, 16 bp, Homo sapiens
agggccagaagcatca

SEQ ID NO: 7873313 - DNA, 22 bp, Homo sapiens
ccctggagggacagctgctcta

SEQ ID NO: 7873314 - DNA, 22 bp, Homo sapiens
ccctggagggacagctgctcta

SEQ ID NO: 7873315 - DNA, 22 bp, Homo sapiens
agggctcccgcggtgtccggga

SEQ ID NO: 7873316 - DNA, 22 bp, Homo sapiens
agggctcccgtgaggtgactgc

SEQ ID NO: 7873317 - DNA, 22 bp, Homo sapiens
agggctccaaggaagtgtagct

SEQ ID NO: 7873318 - DNA, 22 bp, Homo sapiens
agggctccaggggctgggtgac

SEQ ID NO: 7873319 - DNA, 22 bp, Homo sapiens
agggctccaggggctgggtgac

SEQ ID NO: 7873320 - DNA, 22 bp, Homo sapiens
agggctccaggggaccatcagt

SEQ ID NO: 7873321 - DNA, 22 bp, Homo sapiens
agggctccaaggaagtgtagct

SEQ ID NO: 7873322 - DNA, 22 bp, Homo sapiens
agggctccaaggaagtgtagct

SEQ ID NO: 7873323 - DNA, 22 bp, Homo sapiens
agggctcattgacatggaaaag

SEQ ID NO: 7873324 - DNA, 22 bp, Homo sapiens
agggctcatctgagactgacat

SEQ ID NO: 7873325 - DNA, 22 bp, Homo sapiens
agggctcatctgagactgacat

SEQ ID NO: 7873326 - DNA, 22 bp, Homo sapiens
agggctcattgacatggaaaag

SEQ ID NO: 7873327 - DNA, 22 bp, Homo sapiens
agggctcatctgagactgacat

SEQ ID NO: 7873328 - DNA, 22 bp, Homo sapiens
agggctcataattcctgacttc

SEQ ID NO: 7873329 - DNA, 22 bp, Homo sapiens
agggctcagttgcctggagccc

SEQ ID NO: 7873330 - DNA, 22 bp, Homo sapiens
agggctcataattcctgacttc

SEQ ID NO: 7873331 - DNA, 22 bp, Homo sapiens
agggccctagggaatgagacat

SEQ ID NO: 7873332 - DNA, 22 bp, Homo sapiens
agggccctccccgctcagggca

SEQ ID NO: 7873333 - DNA, 22 bp, Homo sapiens
agggccctccccgctcagggca

SEQ ID NO: 7873334 - DNA, 22 bp, Homo sapiens
agggccctagggaatgagacat

SEQ ID NO: 7873335 - DNA, 22 bp, Homo sapiens
agggccctccccgctcagggca

SEQ ID NO: 7873336 - DNA, 22 bp, Homo sapiens
agggccctctggcaggccaggc

SEQ ID NO: 7873337 - DNA, 22 bp, Homo sapiens
agggccctctggcaggccaggc

SEQ ID NO: 7873338 - DNA, 22 bp, Homo sapiens
agggccctctggcaggccaggc

SEQ ID NO: 7873339 - DNA, 22 bp, Homo sapiens
agggccctctggcaggccaggc

SEQ ID NO: 7873340 - DNA, 22 bp, Homo sapiens
agggccctctggcaggccaggc

SEQ ID NO: 7873341 - DNA, 22 bp, Homo sapiens
agggccctctggcaggccaggc

SEQ ID NO: 7873342 - DNA, 22 bp, Homo sapiens
agggctaggaatggaactggag

SEQ ID NO: 7873343 - DNA, 22 bp, Homo sapiens
agggctaggaatggaactggag

SEQ ID NO: 7873344 - DNA, 23 bp, Homo sapiens
agggcctcaggagggctgcatgg

SEQ ID NO: 7873345 - DNA, 22 bp, Homo sapiens
agggcccttacgcaggcccttc

SEQ ID NO: 7873346 - DNA, 22 bp, Homo sapiens
agggcccttacgcaggcccttc

SEQ ID NO: 7873347 - DNA, 22 bp, Homo sapiens
agggcccttacgcaggcccttc

SEQ ID NO: 7873348 - DNA, 22 bp, Homo sapiens
agggcccttacgcaggcccttc

SEQ ID NO: 7873349 - DNA, 18 bp, Homo sapiens
agggccctggtggccatt

SEQ ID NO: 7873350 - DNA, 18 bp, Homo sapiens
agggccctggtggccatt

SEQ ID NO: 7873351 - DNA, 18 bp, Homo sapiens
agggccctggtggccatt

SEQ ID NO: 7873352 - DNA, 22 bp, Homo sapiens
agggccctggggtgcactgaca

SEQ ID NO: 7873353 - DNA, 22 bp, Homo sapiens
agggccctggggtgcactgaca

SEQ ID NO: 7873354 - DNA, 22 bp, Homo sapiens
agggccctggggtgcactgaca

SEQ ID NO: 7873355 - DNA, 22 bp, Homo sapiens
agggctctcttggacaactgct

SEQ ID NO: 7873356 - DNA, 22 bp, Homo sapiens
agggctctcttggacaactgct

SEQ ID NO: 7873357 - DNA, 22 bp, Homo sapiens
agggctctcttcttggtttgca

SEQ ID NO: 7873358 - DNA, 22 bp, Homo sapiens
agggctctcttcttggtttgca

SEQ ID NO: 7873359 - DNA, 18 bp, Homo sapiens
agggctctctgctgggtt

SEQ ID NO: 7873360 - DNA, 18 bp, Homo sapiens
agggctctctgctgggtt

SEQ ID NO: 7873361 - DNA, 18 bp, Homo sapiens
agggctctctgctgggtt

SEQ ID NO: 7873362 - DNA, 22 bp, Homo sapiens
agggctcctccccggcctccac

SEQ ID NO: 7873363 - DNA, 22 bp, Homo sapiens
agggctcctccccggcctccac

SEQ ID NO: 7873364 - DNA, 22 bp, Homo sapiens
agggctcctccccggcctccac

SEQ ID NO: 7873365 - DNA, 22 bp, Homo sapiens
agggctcctatgatgctctgcc

SEQ ID NO: 7873366 - DNA, 22 bp, Homo sapiens
agggctcctatgatgctctgcc

SEQ ID NO: 7873367 - DNA, 22 bp, Homo sapiens
agggctcctatgatgctctgcc

SEQ ID NO: 7873368 - DNA, 22 bp, Homo sapiens
agggctccgggccaccggcctg

SEQ ID NO: 7873369 - DNA, 22 bp, Homo sapiens
agggctccgggccaccggcctg

SEQ ID NO: 7873370 - DNA, 22 bp, Homo sapiens
agggctccgggcaggcgatgga

SEQ ID NO: 7873371 - DNA, 22 bp, Homo sapiens
agggctccgggcaggcgatgga

SEQ ID NO: 7873372 - DNA, 22 bp, Homo sapiens
agggctcctatgccccatggac

SEQ ID NO: 7873373 - DNA, 22 bp, Homo sapiens
agggctcctatgccccatggac

SEQ ID NO: 7873374 - DNA, 22 bp, Homo sapiens
agggctcctatgatgctctgcc

SEQ ID NO: 7873375 - DNA, 22 bp, Homo sapiens
agggctcctatgatgctctgcc

SEQ ID NO: 7873376 - DNA, 22 bp, Homo sapiens
agggctcctatgccccatggac

SEQ ID NO: 7873377 - DNA, 22 bp, Homo sapiens
agggctctggggtggcagagat

SEQ ID NO: 7873378 - DNA, 22 bp, Homo sapiens
agggctctggggtggcagagat

SEQ ID NO: 7873379 - DNA, 20 bp, Homo sapiens
agggctctgccttgctgatg

SEQ ID NO: 7873380 - DNA, 22 bp, Homo sapiens
agggctctgagtgggaaagagg

SEQ ID NO: 7873381 - DNA, 22 bp, Homo sapiens
agggctctggggtggcagagat

SEQ ID NO: 7873382 - DNA, 22 bp, Homo sapiens
agggctctgtccccagaggccc

SEQ ID NO: 7873383 - DNA, 22 bp, Homo sapiens
agggctctgtccccagaggccc

SEQ ID NO: 7873384 - DNA, 22 bp, Homo sapiens
agggctctgtccccagaggccc

SEQ ID NO: 7873385 - DNA, 22 bp, Homo sapiens
agggctctgtccccagaggccc

SEQ ID NO: 7873386 - DNA, 22 bp, Homo sapiens
agggctctgtccccagaggccc

SEQ ID NO: 7873387 - DNA, 22 bp, Homo sapiens
agggctctgttggggtcagcac

SEQ ID NO: 7873388 - DNA, 22 bp, Homo sapiens
agggctctgttggggtcagcac

SEQ ID NO: 7873389 - DNA, 22 bp, Homo sapiens
agggctctgtgactatcactgc

SEQ ID NO: 7873390 - DNA, 22 bp, Homo sapiens
cctccccacgggcagccggcgc

SEQ ID NO: 7873391 - DNA, 22 bp, Homo sapiens
agggctcttcctttgcctctca

SEQ ID NO: 7873392 - DNA, 22 bp, Homo sapiens
agggctcttcctttgcctctca

SEQ ID NO: 7873393 - DNA, 22 bp, Homo sapiens
agggctcttcctttgcctctca

SEQ ID NO: 7873394 - DNA, 22 bp, Homo sapiens
agggctctgttggggtcagcac

SEQ ID NO: 7873395 - DNA, 22 bp, Homo sapiens
cctcctctgtgcagctgtgggt

SEQ ID NO: 7873396 - DNA, 22 bp, Homo sapiens
cctccccatgacccggtgctgg

SEQ ID NO: 7873397 - DNA, 22 bp, Homo sapiens
cctccccacgggcagccggcgc

SEQ ID NO: 7873398 - DNA, 22 bp, Homo sapiens
cctccccacgggcagccggcgc

SEQ ID NO: 7873399 - DNA, 22 bp, Homo sapiens
cctccccacgggcagccggcgc

SEQ ID NO: 7873400 - DNA, 22 bp, Homo sapiens
cctccccacgggcagccggcgc

SEQ ID NO: 7873401 - DNA, 22 bp, Homo sapiens
cctcctgcggcgtccgcgctct

SEQ ID NO: 7873402 - DNA, 22 bp, Homo sapiens
cctcctgcggcgtccgcgctct

SEQ ID NO: 7873403 - DNA, 22 bp, Homo sapiens
cctcctgcacttgctttccttc

SEQ ID NO: 7873404 - DNA, 22 bp, Homo sapiens
cctcctgcactgcaagcttgag

SEQ ID NO: 7873405 - DNA, 22 bp, Homo sapiens
cctcctgcacctccaggaactc

SEQ ID NO: 7873406 - DNA, 22 bp, Homo sapiens
cctcctgcacctccaggaactc

SEQ ID NO: 7873407 - DNA, 22 bp, Homo sapiens
cctcctgcacctccaggaactc

SEQ ID NO: 7873408 - DNA, 22 bp, Homo sapiens
cctcctggagcattggtgagga

SEQ ID NO: 7873409 - DNA, 22 bp, Homo sapiens
cctcctggagcattggtgagga

SEQ ID NO: 7873410 - DNA, 22 bp, Homo sapiens
cctcctggagcattggtgagga

SEQ ID NO: 7873411 - DNA, 22 bp, Homo sapiens
cctcctggaggctctaagggag

SEQ ID NO: 7873412 - DNA, 22 bp, Homo sapiens
cctcctggagcattggtgagga

SEQ ID NO: 7873413 - DNA, 22 bp, Homo sapiens
cctcctggaggctctaagggag

SEQ ID NO: 7873414 - DNA, 22 bp, Homo sapiens
cctcctggaaaaattccctggc

SEQ ID NO: 7873415 - DNA, 22 bp, Homo sapiens
cctcctggaaaaattccctggc

SEQ ID NO: 7873416 - DNA, 22 bp, Homo sapiens
cctcctggaaaaattccctggc

SEQ ID NO: 7873417 - DNA, 22 bp, Homo sapiens
cctcctggagcattggtgagga

SEQ ID NO: 7873418 - DNA, 22 bp, Homo sapiens
cctcctggaaaaattccctggc

SEQ ID NO: 7873419 - DNA, 22 bp, Homo sapiens
cctcctggaaaaattccctggc

SEQ ID NO: 7873420 - DNA, 22 bp, Homo sapiens
cctcctggaaaaattccctggc

SEQ ID NO: 7873421 - DNA, 23 bp, Homo sapiens
agggctgatgccattgcagctct

SEQ ID NO: 7873422 - DNA, 23 bp, Homo sapiens
agggctgatgccattgcagctct

SEQ ID NO: 7873423 - DNA, 23 bp, Homo sapiens
agggctgatgccattgcagctct

SEQ ID NO: 7873424 - DNA, 23 bp, Homo sapiens
agggctgatgccattgcagctct

SEQ ID NO: 7873425 - DNA, 23 bp, Homo sapiens
agggctgatgccattgcagctct

SEQ ID NO: 7873426 - DNA, 22 bp, Homo sapiens
agggctgagtggtgcagtcaaa

SEQ ID NO: 7873427 - DNA, 18 bp, Homo sapiens
agggctgatgagtttggg

SEQ ID NO: 7873428 - DNA, 18 bp, Homo sapiens
agggctgatgagtttggg

SEQ ID NO: 7873429 - DNA, 18 bp, Homo sapiens
agggctgatgagtttggg

SEQ ID NO: 7873430 - DNA, 22 bp, Homo sapiens
agggctgatgcaccatgtagcc

SEQ ID NO: 7873431 - DNA, 18 bp, Homo sapiens
agggctgatgagtttggg

SEQ ID NO: 7873432 - DNA, 22 bp, Homo sapiens
agggctgatgcaccatgtagcc

SEQ ID NO: 7873433 - DNA, 22 bp, Homo sapiens
agggctgatgcaccatgtagcc

SEQ ID NO: 7873434 - DNA, 22 bp, Homo sapiens
agggctgagtgggagagagttg

SEQ ID NO: 7873435 - DNA, 22 bp, Homo sapiens
cctcctggccctgggcctggaa

SEQ ID NO: 7873436 - DNA, 22 bp, Homo sapiens
cctcctggccctgggcctggaa

SEQ ID NO: 7873437 - DNA, 22 bp, Homo sapiens
cctcctggccctgggcctggaa

SEQ ID NO: 7873438 - DNA, 22 bp, Homo sapiens
agggctgagtgggagagagttg

SEQ ID NO: 7873439 - DNA, 22 bp, Homo sapiens
agggctgagtggtgcagtcaaa

SEQ ID NO: 7873440 - DNA, 22 bp, Homo sapiens
agggctgagtggtgcagtcaaa

SEQ ID NO: 7873441 - DNA, 22 bp, Homo sapiens
cctcctggaggctctagggaaa

SEQ ID NO: 7873442 - DNA, 22 bp, Homo sapiens
cctcctggaggctctagggaaa

SEQ ID NO: 7873443 - DNA, 22 bp, Homo sapiens
cctcctggaggctctagggaaa

SEQ ID NO: 7873444 - DNA, 22 bp, Homo sapiens
cctcctggatggatttggtgga

SEQ ID NO: 7873445 - DNA, 22 bp, Homo sapiens
cctcctggaggctctagggaaa

SEQ ID NO: 7873446 - DNA, 18 bp, Homo sapiens
cctctgccatagccagca

SEQ ID NO: 7873447 - DNA, 21 bp, Homo sapiens
cctctggcttgtgctgtgccc

SEQ ID NO: 7873448 - DNA, 21 bp, Homo sapiens
cctctggcttgtgctgtgccc

SEQ ID NO: 7873449 - DNA, 22 bp, Homo sapiens
cctctggcttactgttgggttt

SEQ ID NO: 7873450 - DNA, 22 bp, Homo sapiens
cctctggcttactgttgggttt

SEQ ID NO: 7873451 - DNA, 21 bp, Homo sapiens
cctctggcttgtgctgtgccc

SEQ ID NO: 7873452 - DNA, 21 bp, Homo sapiens
cctctggcttgtgctgtgccc

SEQ ID NO: 7873453 - DNA, 21 bp, Homo sapiens
cctctggcttgtgctgtgccc

SEQ ID NO: 7873454 - DNA, 22 bp, Homo sapiens
cctctgggaagccagtcctgct

SEQ ID NO: 7873455 - DNA, 22 bp, Homo sapiens
cctctgggaagccagtcctgct

SEQ ID NO: 7873456 - DNA, 22 bp, Homo sapiens
cctctgggaagccagtcctgct

SEQ ID NO: 7873457 - DNA, 22 bp, Homo sapiens
cctctgggaagccagtcctgct

SEQ ID NO: 7873458 - DNA, 22 bp, Homo sapiens
cctctgggagactgctactgag

SEQ ID NO: 7873459 - DNA, 22 bp, Homo sapiens
cctctgggaagccagtcctgct

SEQ ID NO: 7873460 - DNA, 16 bp, Homo sapiens
cctctgggcctgcaag

SEQ ID NO: 7873461 - DNA, 16 bp, Homo sapiens
cctctgggcctgcaag

SEQ ID NO: 7873462 - DNA, 22 bp, Homo sapiens
cctctgggccagcctggaccct

SEQ ID NO: 7873463 - DNA, 22 bp, Homo sapiens
cctctgggcggagatctgctgc

SEQ ID NO: 7873464 - DNA, 22 bp, Homo sapiens
cctctgggcggagatctgctgc

SEQ ID NO: 7873465 - DNA, 22 bp, Homo sapiens
cctctgggcctggaagggcagt

SEQ ID NO: 7873466 - DNA, 22 bp, Homo sapiens
cctctgggcctggaagggcagt

SEQ ID NO: 7873467 - DNA, 22 bp, Homo sapiens
cctctgggcggagatctgctgc

SEQ ID NO: 7873468 - DNA, 22 bp, Homo sapiens
cctctgggcctggaagggcagt

SEQ ID NO: 7873469 - DNA, 22 bp, Homo sapiens
cctctgggcaggtagcagcagc

SEQ ID NO: 7873470 - DNA, 22 bp, Homo sapiens
cctctgggcaggtagcagcagc

SEQ ID NO: 7873471 - DNA, 16 bp, Homo sapiens
cctctgggatgtttgc

SEQ ID NO: 7873472 - DNA, 22 bp, Homo sapiens
cctctgggagactgctactgag

SEQ ID NO: 7873473 - DNA, 22 bp, Homo sapiens
cctctgggccagcctggaccct

SEQ ID NO: 7873474 - DNA, 22 bp, Homo sapiens
cctctgggccagcctggaccct

SEQ ID NO: 7873475 - DNA, 22 bp, Homo sapiens
cctctgggccagcctggaccct

SEQ ID NO: 7873476 - DNA, 22 bp, Homo sapiens
cctctgggcaggtagcagcagc

SEQ ID NO: 7873477 - DNA, 22 bp, Homo sapiens
cctctgggcaggtagcagcagc

SEQ ID NO: 7873478 - DNA, 21 bp, Homo sapiens
aggggacagagtagctccagg

SEQ ID NO: 7873479 - DNA, 21 bp, Homo sapiens
aggggacagagtagctccagg

SEQ ID NO: 7873480 - DNA, 21 bp, Homo sapiens
aggggacagagtagctccagg

SEQ ID NO: 7873481 - DNA, 21 bp, Homo sapiens
aggggacagagtagctccagg

SEQ ID NO: 7873482 - DNA, 21 bp, Homo sapiens
aggggacagagtagctccagg

SEQ ID NO: 7873483 - DNA, 22 bp, Homo sapiens
aggggacacggcttctccaggg

SEQ ID NO: 7873484 - DNA, 22 bp, Homo sapiens
aggggacacggcttctccaggg

SEQ ID NO: 7873485 - DNA, 21 bp, Homo sapiens
aggggacagagtagctccagg

SEQ ID NO: 7873486 - DNA, 21 bp, Homo sapiens
aggggacagagtagctccagg

SEQ ID NO: 7873487 - DNA, 22 bp, Homo sapiens
aggggaccaaaatgtcctgcct

SEQ ID NO: 7873488 - DNA, 22 bp, Homo sapiens
aggggacatttagcaatgacta

SEQ ID NO: 7873489 - DNA, 22 bp, Homo sapiens
aggggacatttagcaatgacta

SEQ ID NO: 7873490 - DNA, 22 bp, Homo sapiens
aggggacatttagcaatgacta

SEQ ID NO: 7873491 - DNA, 22 bp, Homo sapiens
aggggagaaaaatgccttctgt

SEQ ID NO: 7873492 - DNA, 22 bp, Homo sapiens
aggggagagaacataaggaagt

SEQ ID NO: 7873493 - DNA, 22 bp, Homo sapiens
aggggagagaacataaggaagt

SEQ ID NO: 7873494 - DNA, 22 bp, Homo sapiens
aggggagaggtgagcaacttct

SEQ ID NO: 7873495 - DNA, 22 bp, Homo sapiens
aggggagaggtgagcaacttct

SEQ ID NO: 7873496 - DNA, 22 bp, Homo sapiens
aggggagagaacataaggaagt

SEQ ID NO: 7873497 - DNA, 22 bp, Homo sapiens
aggggagagaacataaggaagt

SEQ ID NO: 7873498 - DNA, 22 bp, Homo sapiens
aggggagagaacataaggaagt

SEQ ID NO: 7873499 - DNA, 22 bp, Homo sapiens
aggggagagaacataaggaagt

SEQ ID NO: 7873500 - DNA, 22 bp, Homo sapiens
aggggagagaacataaggaagt

SEQ ID NO: 7873501 - DNA, 22 bp, Homo sapiens
aggggagaaaaatgccttctgt

SEQ ID NO: 7873502 - DNA, 22 bp, Homo sapiens
aggggagaaaaatgccttctgt

SEQ ID NO: 7873503 - DNA, 22 bp, Homo sapiens
aggggagaatttcaactcaggt

SEQ ID NO: 7873504 - DNA, 22 bp, Homo sapiens
aggggagaatttcaactcaggt

SEQ ID NO: 7873505 - DNA, 22 bp, Homo sapiens
aggggagaatttcaactcaggt

SEQ ID NO: 7873506 - DNA, 22 bp, Homo sapiens
aggggagaatttcaactcaggt

SEQ ID NO: 7873507 - DNA, 22 bp, Homo sapiens
aggggagaatttcaactcaggt

SEQ ID NO: 7873508 - DNA, 22 bp, Homo sapiens
aggggagactggaatctaacat

SEQ ID NO: 7873509 - DNA, 22 bp, Homo sapiens
aggggagactggaatctaacat

SEQ ID NO: 7873510 - DNA, 22 bp, Homo sapiens
aggggagactggaatctaacat

SEQ ID NO: 7873511 - DNA, 22 bp, Homo sapiens
aggggagagttaatgtgaatgt

SEQ ID NO: 7873512 - DNA, 22 bp, Homo sapiens
cctgagagtgcgtgcctcctta

SEQ ID NO: 7873513 - DNA, 22 bp, Homo sapiens
cctgagagtgcgtgcctcctta

SEQ ID NO: 7873514 - DNA, 22 bp, Homo sapiens
cctgagctttaaaagccatgta

SEQ ID NO: 7873515 - DNA, 22 bp, Homo sapiens
cctgagctttaaaagccatgta

SEQ ID NO: 7873516 - DNA, 22 bp, Homo sapiens
cctgagctttaaaagccatgta

SEQ ID NO: 7873517 - DNA, 22 bp, Homo sapiens
cctgagatcagtgcatttggtg

SEQ ID NO: 7873518 - DNA, 22 bp, Homo sapiens
cctgagagtggtgtacaggaga

SEQ ID NO: 7873519 - DNA, 22 bp, Homo sapiens
cctgagagtggtgtacaggaga

SEQ ID NO: 7873520 - DNA, 17 bp, Homo sapiens
aggggagagtgggaaga

SEQ ID NO: 7873521 - DNA, 22 bp, Homo sapiens
aggggagaggtgagcaacttct

SEQ ID NO: 7873522 - DNA, 17 bp, Homo sapiens
aggggagagtgggaaga

SEQ ID NO: 7873523 - DNA, 17 bp, Homo sapiens
aggggagagtgggaaga

SEQ ID NO: 7873524 - DNA, 17 bp, Homo sapiens
aggggagagtgggaaga

SEQ ID NO: 7873525 - DNA, 17 bp, Homo sapiens
aggggagagtgggaaga

SEQ ID NO: 7873526 - DNA, 22 bp, Homo sapiens
aggggagagttaatgtgaatgt

SEQ ID NO: 7873527 - DNA, 22 bp, Homo sapiens
cctgaggacacacgctgcagga

SEQ ID NO: 7873528 - DNA, 22 bp, Homo sapiens
cctgaggacacacgctgcagga

SEQ ID NO: 7873529 - DNA, 22 bp, Homo sapiens
cctgaggacatcagcatcacct

SEQ ID NO: 7873530 - DNA, 22 bp, Homo sapiens
cctgaggacacacgctgcagga

SEQ ID NO: 7873531 - DNA, 22 bp, Homo sapiens
cctgaggacacacgctgcagga

SEQ ID NO: 7873532 - DNA, 22 bp, Homo sapiens
cctgaggatgccagcatgggtg

SEQ ID NO: 7873533 - DNA, 22 bp, Homo sapiens
cctgaggatattcaccagcatg

SEQ ID NO: 7873534 - DNA, 22 bp, Homo sapiens
cctgaggatgccagcatgggtg

SEQ ID NO: 7873535 - DNA, 22 bp, Homo sapiens
cctgaggatgccagcatgggtg

SEQ ID NO: 7873536 - DNA, 22 bp, Homo sapiens
cctgaggatattcaccagcatg

SEQ ID NO: 7873537 - DNA, 22 bp, Homo sapiens
cctgaggatattcaccagcatg

SEQ ID NO: 7873538 - DNA, 22 bp, Homo sapiens
cctgaggagattgtggctgggg

SEQ ID NO: 7873539 - DNA, 22 bp, Homo sapiens
cctgaggagattgtggctgggg

SEQ ID NO: 7873540 - DNA, 22 bp, Homo sapiens
cctgaggaccagcacccatctg

SEQ ID NO: 7873541 - DNA, 22 bp, Homo sapiens
cctgaggagattgtggctgggg

SEQ ID NO: 7873542 - DNA, 22 bp, Homo sapiens
cctgaggagattgtggctgggg

SEQ ID NO: 7873543 - DNA, 22 bp, Homo sapiens
cctgaggaccagcacccatctg

SEQ ID NO: 7873544 - DNA, 22 bp, Homo sapiens
cctgaggccctggctgtgctga

SEQ ID NO: 7873545 - DNA, 22 bp, Homo sapiens
cctgaggccctggctgtgctga

SEQ ID NO: 7873546 - DNA, 22 bp, Homo sapiens
cctgaggccctggctgtgctga

SEQ ID NO: 7873547 - DNA, 22 bp, Homo sapiens
cctgaggcccctgaggatagca

SEQ ID NO: 7873548 - DNA, 22 bp, Homo sapiens
cctgaggcccctgaggatagca

SEQ ID NO: 7873549 - DNA, 22 bp, Homo sapiens
cctgaggcccctgaggatagca

SEQ ID NO: 7873550 - DNA, 22 bp, Homo sapiens
cctgaggattgttggtgcttcc

SEQ ID NO: 7873551 - DNA, 22 bp, Homo sapiens
cctgaggattgttggtgcttcc

SEQ ID NO: 7873552 - DNA, 22 bp, Homo sapiens
cctgaggcaaggacttggtggc

SEQ ID NO: 7873553 - DNA, 22 bp, Homo sapiens
cctgaggcaaggacttggtggc

SEQ ID NO: 7873554 - DNA, 22 bp, Homo sapiens
cctgaggcaaggacttggtggc

SEQ ID NO: 7873555 - DNA, 22 bp, Homo sapiens
cctgaggcaaggacttggtggc

SEQ ID NO: 7873556 - DNA, 22 bp, Homo sapiens
cctgaggcaaggacttggtggc

SEQ ID NO: 7873557 - DNA, 22 bp, Homo sapiens
cctgaggcaaggacttggtggc

SEQ ID NO: 7873558 - DNA, 22 bp, Homo sapiens
aggggctgcctggcttggcact

SEQ ID NO: 7873559 - DNA, 22 bp, Homo sapiens
aggggctgctgggtccgcccct

SEQ ID NO: 7873560 - DNA, 22 bp, Homo sapiens
aggggctgctgggtccgcccct

SEQ ID NO: 7873561 - DNA, 22 bp, Homo sapiens
aggggctgcctggcttggcact

SEQ ID NO: 7873562 - DNA, 22 bp, Homo sapiens
aggggctggagttcgaggttac

SEQ ID NO: 7873563 - DNA, 22 bp, Homo sapiens
aggggctggcttatctgagagt

SEQ ID NO: 7873564 - DNA, 22 bp, Homo sapiens
aggggctggcttatctgagagt

SEQ ID NO: 7873565 - DNA, 22 bp, Homo sapiens
aggggctggcttatctgagagt

SEQ ID NO: 7873566 - DNA, 22 bp, Homo sapiens
aggggctggcttatctgagagt

SEQ ID NO: 7873567 - DNA, 22 bp, Homo sapiens
aggggctggcttatctgagagt

SEQ ID NO: 7873568 - DNA, 22 bp, Homo sapiens
aggggctgggacagagccaagc

SEQ ID NO: 7873569 - DNA, 22 bp, Homo sapiens
aggggctgggacagagccaagc

SEQ ID NO: 7873570 - DNA, 22 bp, Homo sapiens
aggggctgggacagagccaagc

SEQ ID NO: 7873571 - DNA, 22 bp, Homo sapiens
aggggctgggacagagccaagc

SEQ ID NO: 7873572 - DNA, 22 bp, Homo sapiens
agggatggagcccagctgttct

SEQ ID NO: 7873573 - DNA, 22 bp, Homo sapiens
agggatggaagctcgtctgcaa

SEQ ID NO: 7873574 - DNA, 22 bp, Homo sapiens
agggatggagtgcggcccggac

SEQ ID NO: 7873575 - DNA, 22 bp, Homo sapiens
agggatggagcccagctgttct

SEQ ID NO: 7873576 - DNA, 22 bp, Homo sapiens
agggatggagcccagctgttct

SEQ ID NO: 7873577 - DNA, 22 bp, Homo sapiens
agggatggagtgcggcccggac

SEQ ID NO: 7873578 - DNA, 22 bp, Homo sapiens
agggatggatcttggccctgga

SEQ ID NO: 7873579 - DNA, 22 bp, Homo sapiens
agggatggagtgcggcccggac

SEQ ID NO: 7873580 - DNA, 22 bp, Homo sapiens
agggatggagtgcggcccggac

SEQ ID NO: 7873581 - DNA, 22 bp, Homo sapiens
agggatggatcttggccctgga

SEQ ID NO: 7873582 - DNA, 22 bp, Homo sapiens
agggatggatcttggccctgga

SEQ ID NO: 7873583 - DNA, 22 bp, Homo sapiens
agggatggatcttggccctgga

SEQ ID NO: 7873584 - DNA, 22 bp, Homo sapiens
agggatggatcttggccctgga

SEQ ID NO: 7873585 - DNA, 22 bp, Homo sapiens
agggatgatttcagtgtctgcc

SEQ ID NO: 7873586 - DNA, 22 bp, Homo sapiens
agggatgctgctaagtggtcta

SEQ ID NO: 7873587 - DNA, 22 bp, Homo sapiens
agggatgcctcattttaagtga

SEQ ID NO: 7873588 - DNA, 22 bp, Homo sapiens
agggatgatggaaagaagcagg

SEQ ID NO: 7873589 - DNA, 22 bp, Homo sapiens
agggatgatggaaagaagcagg

SEQ ID NO: 7873590 - DNA, 22 bp, Homo sapiens
agggatgatttcagtgtctgcc

SEQ ID NO: 7873591 - DNA, 22 bp, Homo sapiens
agggatggaagacttgaagacc

SEQ ID NO: 7873592 - DNA, 22 bp, Homo sapiens
agggatggaagacttgaagacc

SEQ ID NO: 7873593 - DNA, 22 bp, Homo sapiens
agggatggaagacttgaagacc

SEQ ID NO: 7873594 - DNA, 22 bp, Homo sapiens
agggatggaagctcgtctgcaa

SEQ ID NO: 7873595 - DNA, 22 bp, Homo sapiens
agggatggaagacttgaagacc

SEQ ID NO: 7873596 - DNA, 22 bp, Homo sapiens
agggatggaagacttgaagacc

SEQ ID NO: 7873597 - DNA, 22 bp, Homo sapiens
agggatggaagacttgaagacc

SEQ ID NO: 7873598 - DNA, 22 bp, Homo sapiens
agggatgctgctaagtggtcta

SEQ ID NO: 7873599 - DNA, 22 bp, Homo sapiens
agggatgctgtgatacatcctt

SEQ ID NO: 7873600 - DNA, 22 bp, Homo sapiens
agggatgctgctaagtggtcta

SEQ ID NO: 7873601 - DNA, 22 bp, Homo sapiens
agggatgactcttggctgattc

SEQ ID NO: 7873602 - DNA, 22 bp, Homo sapiens
agggatgactcttggctgattc

SEQ ID NO: 7873603 - DNA, 22 bp, Homo sapiens
agggatcagtagggacggcagc

SEQ ID NO: 7873604 - DNA, 22 bp, Homo sapiens
agggatcatcctgcaagtgcct

SEQ ID NO: 7873605 - DNA, 18 bp, Homo sapiens
agggatcatcactgcagc

SEQ ID NO: 7873606 - DNA, 18 bp, Homo sapiens
agggagttttagggaagg

SEQ ID NO: 7873607 - DNA, 18 bp, Homo sapiens
agggagttttagggaagg

SEQ ID NO: 7873608 - DNA, 22 bp, Homo sapiens
agggagtgtaaatggtgctcag

SEQ ID NO: 7873609 - DNA, 22 bp, Homo sapiens
agggagtgtaaatggtgctcag

SEQ ID NO: 7873610 - DNA, 22 bp, Homo sapiens
agggagtgtaaatggtgctcag

SEQ ID NO: 7873611 - DNA, 22 bp, Homo sapiens
agggagtgttatattccatcag

SEQ ID NO: 7873612 - DNA, 22 bp, Homo sapiens
agggagtgttacataatgggtt

SEQ ID NO: 7873613 - DNA, 17 bp, Homo sapiens
agggagtcagtaggagc

SEQ ID NO: 7873614 - DNA, 22 bp, Homo sapiens
agggagtcatatatacctgcat

SEQ ID NO: 7873615 - DNA, 17 bp, Homo sapiens
agggagtcagtaggagc

SEQ ID NO: 7873616 - DNA, 17 bp, Homo sapiens
agggagtcagtaggagc

SEQ ID NO: 7873617 - DNA, 22 bp, Homo sapiens
agggagtcatatatacctgcat

SEQ ID NO: 7873618 - DNA, 22 bp, Homo sapiens
agggagtccattttagaggtgg

SEQ ID NO: 7873619 - DNA, 21 bp, Homo sapiens
agggagtctggaggaagcgtt

SEQ ID NO: 7873620 - DNA, 22 bp, Homo sapiens
agggagtggttaagaaggtgca

SEQ ID NO: 7873621 - DNA, 22 bp, Homo sapiens
agggagtggttaagaaggtgca

SEQ ID NO: 7873622 - DNA, 22 bp, Homo sapiens
agggagtggttaagaaggtgca

SEQ ID NO: 7873623 - DNA, 22 bp, Homo sapiens
agggagtggttaagaaggtgca

SEQ ID NO: 7873624 - DNA, 22 bp, Homo sapiens
agggagtggttaagaaggtgca

SEQ ID NO: 7873625 - DNA, 22 bp, Homo sapiens
agggagtggttaagaaggtgca

SEQ ID NO: 7873626 - DNA, 17 bp, Homo sapiens
agggagtcagaggatcg

SEQ ID NO: 7873627 - DNA, 17 bp, Homo sapiens
agggagtcagaggatcg

SEQ ID NO: 7873628 - DNA, 22 bp, Homo sapiens
agggaggagtcctcaaagtcat

SEQ ID NO: 7873629 - DNA, 22 bp, Homo sapiens
agggagaaggtttagctgtgag

SEQ ID NO: 7873630 - DNA, 22 bp, Homo sapiens
agggaggagtcctcaaagtcat

SEQ ID NO: 7873631 - DNA, 22 bp, Homo sapiens
agggagaaggtttagctgtgag

SEQ ID NO: 7873632 - DNA, 22 bp, Homo sapiens
agggagaaggtttagctgtgag

SEQ ID NO: 7873633 - DNA, 22 bp, Homo sapiens
agggagaagagaacaaagccct

SEQ ID NO: 7873634 - DNA, 22 bp, Homo sapiens
agggagaaggtccatgcctgtc

SEQ ID NO: 7873635 - DNA, 22 bp, Homo sapiens
agggagaaggtccatgcctgtc

SEQ ID NO: 7873636 - DNA, 22 bp, Homo sapiens
agggagaagagaacaaagccct

SEQ ID NO: 7873637 - DNA, 22 bp, Homo sapiens
agggagaagagaacaaagccct

SEQ ID NO: 7873638 - DNA, 22 bp, Homo sapiens
agggagaaggtttagctgtgag

SEQ ID NO: 7873639 - DNA, 22 bp, Homo sapiens
agggagaaggtttagctgtgag

SEQ ID NO: 7873640 - DNA, 22 bp, Homo sapiens
agggagaaggtccatgcctgtc

SEQ ID NO: 7873641 - DNA, 22 bp, Homo sapiens
agggagaaaattggatgcacaa

SEQ ID NO: 7873642 - DNA, 22 bp, Homo sapiens
agggactggctctctgagcagg

SEQ ID NO: 7873643 - DNA, 22 bp, Homo sapiens
agggactggctctctgagcagg

SEQ ID NO: 7873644 - DNA, 22 bp, Homo sapiens
agggactggctctctgagcagg

SEQ ID NO: 7873645 - DNA, 22 bp, Homo sapiens
agggactggctctctgagcagg

SEQ ID NO: 7873646 - DNA, 22 bp, Homo sapiens
agggactggctctctgagcagg

SEQ ID NO: 7873647 - DNA, 22 bp, Homo sapiens
cccaggggtatccatggagaag

SEQ ID NO: 7873648 - DNA, 22 bp, Homo sapiens
agggactcctctgctcggctgc

SEQ ID NO: 7873649 - DNA, 22 bp, Homo sapiens
agggactgagctaggatctagt

SEQ ID NO: 7873650 - DNA, 22 bp, Homo sapiens
agggactgagctaggatctagt

SEQ ID NO: 7873651 - DNA, 22 bp, Homo sapiens
agggactcggttgagtgcccct

SEQ ID NO: 7873652 - DNA, 22 bp, Homo sapiens
agggagaaaattggatgcacaa

SEQ ID NO: 7873653 - DNA, 22 bp, Homo sapiens
agggagaaaattggatgcacaa

SEQ ID NO: 7873654 - DNA, 22 bp, Homo sapiens
agggagaaaattggatgcacaa

SEQ ID NO: 7873655 - DNA, 22 bp, Homo sapiens
agggagaaaattggatgcacaa

SEQ ID NO: 7873656 - DNA, 22 bp, Homo sapiens
agggagaaaattggatgcacaa

SEQ ID NO: 7873657 - DNA, 22 bp, Homo sapiens
agggagaaaattggatgcacaa

SEQ ID NO: 7873658 - DNA, 22 bp, Homo sapiens
agggagaacagttgcagcagac

SEQ ID NO: 7873659 - DNA, 22 bp, Homo sapiens
agggagaacagttgcagcagac

SEQ ID NO: 7873660 - DNA, 22 bp, Homo sapiens
agggagaacagttgcagcagac

SEQ ID NO: 7873661 - DNA, 22 bp, Homo sapiens
agggagaacagttgcagcagac

SEQ ID NO: 7873662 - DNA, 22 bp, Homo sapiens
agggagaagagaacaaagccct

SEQ ID NO: 7873663 - DNA, 22 bp, Homo sapiens
agggagaagagaacaaagccct

SEQ ID NO: 7873664 - DNA, 22 bp, Homo sapiens
agggcagagatctgagtgggca

SEQ ID NO: 7873665 - DNA, 22 bp, Homo sapiens
agggcagagatctgagtgggca

SEQ ID NO: 7873666 - DNA, 22 bp, Homo sapiens
agggcagagatctgagtgggca

SEQ ID NO: 7873667 - DNA, 22 bp, Homo sapiens
agggcagagatctgagtgggca

SEQ ID NO: 7873668 - DNA, 22 bp, Homo sapiens
agggcagagatctgagtgggca

SEQ ID NO: 7873669 - DNA, 22 bp, Homo sapiens
agggcagagattaattaagaca

SEQ ID NO: 7873670 - DNA, 22 bp, Homo sapiens
agggcagagattaattaagaca

SEQ ID NO: 7873671 - DNA, 22 bp, Homo sapiens
agggcagagcactgaattggga

SEQ ID NO: 7873672 - DNA, 22 bp, Homo sapiens
agggcagagcactgaattggga

SEQ ID NO: 7873673 - DNA, 22 bp, Homo sapiens
agggcagagcactgaattggga

SEQ ID NO: 7873674 - DNA, 22 bp, Homo sapiens
agggcagagctgtctaaatggc

SEQ ID NO: 7873675 - DNA, 22 bp, Homo sapiens
agggcagagctgtctaaatggc

SEQ ID NO: 7873676 - DNA, 22 bp, Homo sapiens
agggcagagagatgaatgggat

SEQ ID NO: 7873677 - DNA, 22 bp, Homo sapiens
agggcagagacatgcttcctga

SEQ ID NO: 7873678 - DNA, 22 bp, Homo sapiens
agggcagagacatgcttcctga

SEQ ID NO: 7873679 - DNA, 18 bp, Homo sapiens
ccctcttgcacaaagcaa

SEQ ID NO: 7873680 - DNA, 22 bp, Homo sapiens
agggcagagaaatgtagttgag

SEQ ID NO: 7873681 - DNA, 22 bp, Homo sapiens
agggcagagatctgagtgggca

SEQ ID NO: 7873682 - DNA, 22 bp, Homo sapiens
agggcagagatctgagtgggca

SEQ ID NO: 7873683 - DNA, 22 bp, Homo sapiens
agggcagagagatgaatgggat

SEQ ID NO: 7873684 - DNA, 22 bp, Homo sapiens
agggcagagagatgaatgggat

SEQ ID NO: 7873685 - DNA, 22 bp, Homo sapiens
agggcagagagatgaatgggat

SEQ ID NO: 7873686 - DNA, 22 bp, Homo sapiens
ccctggaggaccccaatgtggc

SEQ ID NO: 7873687 - DNA, 22 bp, Homo sapiens
ccctggaggagcttagagcttg

SEQ ID NO: 7873688 - DNA, 19 bp, Homo sapiens
ccctggaggagtgttggct

SEQ ID NO: 7873689 - DNA, 19 bp, Homo sapiens
ccctggaggagtgttggct

SEQ ID NO: 7873690 - DNA, 19 bp, Homo sapiens
ccctggaggagtgttggct

SEQ ID NO: 7873691 - DNA, 22 bp, Homo sapiens
ccctggacacacacttttattc

SEQ ID NO: 7873692 - DNA, 22 bp, Homo sapiens
ccctggaggaccccaatgtggc

SEQ ID NO: 7873693 - DNA, 21 bp, Homo sapiens
ccctggaatcctgagtgccag

SEQ ID NO: 7873694 - DNA, 22 bp, Homo sapiens
ccctggaaggttctctggctca

SEQ ID NO: 7873695 - DNA, 20 bp, Homo sapiens
agggcagagggattacaggc

SEQ ID NO: 7873696 - DNA, 20 bp, Homo sapiens
agggcagagggattacaggc

SEQ ID NO: 7873697 - DNA, 20 bp, Homo sapiens
agggcagagggattacaggc

SEQ ID NO: 7873698 - DNA, 22 bp, Homo sapiens
agggcagaggcggacacggaag

SEQ ID NO: 7873699 - DNA, 22 bp, Homo sapiens
agggcagaggcggacacggaag

SEQ ID NO: 7873700 - DNA, 22 bp, Homo sapiens
agggcagaggcggacacggaag

SEQ ID NO: 7873701 - DNA, 20 bp, Homo sapiens
agggcagagggattacaggc

SEQ ID NO: 7873702 - DNA, 22 bp, Homo sapiens
ccctctggctcttctcaggccg

SEQ ID NO: 7873703 - DNA, 22 bp, Homo sapiens
ccctctggctgtgtgttcttag

SEQ ID NO: 7873704 - DNA, 22 bp, Homo sapiens
ccctctggctcttctcaggccg

SEQ ID NO: 7873705 - DNA, 22 bp, Homo sapiens
ccctctggctcttctcaggccg

SEQ ID NO: 7873706 - DNA, 22 bp, Homo sapiens
ccctctgctcaggtgcataggc

SEQ ID NO: 7873707 - DNA, 22 bp, Homo sapiens
ccctctgctgcctggctgggtc

SEQ ID NO: 7873708 - DNA, 22 bp, Homo sapiens
ccctctggctcttctcaggccg

SEQ ID NO: 7873709 - DNA, 22 bp, Homo sapiens
ccctctggctcttctcaggccg

SEQ ID NO: 7873710 - DNA, 22 bp, Homo sapiens
ccctctggtttgcccttgggtg

SEQ ID NO: 7873711 - DNA, 22 bp, Homo sapiens
ccctctggtttgcccttgggtg

SEQ ID NO: 7873712 - DNA, 22 bp, Homo sapiens
ccctctggtttgcccttgggtg

SEQ ID NO: 7873713 - DNA, 17 bp, Homo sapiens
ccctctggggagggagg

SEQ ID NO: 7873714 - DNA, 18 bp, Homo sapiens
ccctcttgcacaaagcaa

SEQ ID NO: 7873715 - DNA, 18 bp, Homo sapiens
ccctcttgcacaaagcaa

SEQ ID NO: 7873716 - DNA, 18 bp, Homo sapiens
ccctcttgcacaaagcaa

SEQ ID NO: 7873717 - DNA, 18 bp, Homo sapiens
ccctcttgcacaaagcaa

SEQ ID NO: 7873718 - DNA, 18 bp, Homo sapiens
ccctcttgcacaaagcaa

SEQ ID NO: 7873719 - DNA, 22 bp, Homo sapiens
ccctctgcaggctggacctgcc

SEQ ID NO: 7873720 - DNA, 22 bp, Homo sapiens
ccctctgcaggctggacctgcc

SEQ ID NO: 7873721 - DNA, 20 bp, Homo sapiens
ccctctgcacatggctgtgg

SEQ ID NO: 7873722 - DNA, 20 bp, Homo sapiens
ccctctgcacatggctgtgg

SEQ ID NO: 7873723 - DNA, 20 bp, Homo sapiens
ccctctgcacatggctgtgg

SEQ ID NO: 7873724 - DNA, 22 bp, Homo sapiens
ccctctgcatacaggcgaggag

SEQ ID NO: 7873725 - DNA, 22 bp, Homo sapiens
ccctctgcctctgagtaggaca

SEQ ID NO: 7873726 - DNA, 22 bp, Homo sapiens
ccctctgcctgcgccctggtgt

SEQ ID NO: 7873727 - DNA, 22 bp, Homo sapiens
ccctctgcctgcgccctggtgt

SEQ ID NO: 7873728 - DNA, 22 bp, Homo sapiens
ccctctgctcaggtgcataggc

SEQ ID NO: 7873729 - DNA, 20 bp, Homo sapiens
ccctctgctacactgggagc

SEQ ID NO: 7873730 - DNA, 22 bp, Homo sapiens
ccctctgctcaggtgcataggc

SEQ ID NO: 7873731 - DNA, 22 bp, Homo sapiens
agggatgggaactcctccagca

SEQ ID NO: 7873732 - DNA, 22 bp, Homo sapiens
agggatggcaagttaacctgag

SEQ ID NO: 7873733 - DNA, 22 bp, Homo sapiens
agggatgggaactcctccagca

SEQ ID NO: 7873734 - DNA, 22 bp, Homo sapiens
agggatgggaactcctccagca

SEQ ID NO: 7873735 - DNA, 22 bp, Homo sapiens
ccctcccaggagtggccagaga

SEQ ID NO: 7873736 - DNA, 22 bp, Homo sapiens
agggatgggtctaacccagaac

SEQ ID NO: 7873737 - DNA, 22 bp, Homo sapiens
ccctcccaggagtggccagaga

SEQ ID NO: 7873738 - DNA, 22 bp, Homo sapiens
ccctctctcggttgctgtggtt

SEQ ID NO: 7873739 - DNA, 22 bp, Homo sapiens
ccctctctcggttgctgtggtt

SEQ ID NO: 7873740 - DNA, 22 bp, Homo sapiens
ccctctcttagaagaaacacag

SEQ ID NO: 7873741 - DNA, 22 bp, Homo sapiens
ccctctcttagaagaaacacag

SEQ ID NO: 7873742 - DNA, 20 bp, Homo sapiens
ccctctgcacatggctgtgg

SEQ ID NO: 7873743 - DNA, 20 bp, Homo sapiens
ccctctgcacatggctgtgg

SEQ ID NO: 7873744 - DNA, 22 bp, Homo sapiens
ccctctgactgggccagttctg

SEQ ID NO: 7873745 - DNA, 22 bp, Homo sapiens
ccctctctcggttgctgtggtt

SEQ ID NO: 7873746 - DNA, 21 bp, Homo sapiens
aggcttggatctagacaggcc

SEQ ID NO: 7873747 - DNA, 19 bp, Homo sapiens
aggcttggattgtggccaa

SEQ ID NO: 7873748 - DNA, 21 bp, Homo sapiens
aggcttggatctagacaggcc

SEQ ID NO: 7873749 - DNA, 22 bp, Homo sapiens
aggcttggaggttctgtagcca

SEQ ID NO: 7873750 - DNA, 22 bp, Homo sapiens
aggcttggaggttctgtagcca

SEQ ID NO: 7873751 - DNA, 22 bp, Homo sapiens
aggcttggaggttctgtagcca

SEQ ID NO: 7873752 - DNA, 22 bp, Homo sapiens
aggcttggaagtggcagaactg

SEQ ID NO: 7873753 - DNA, 21 bp, Homo sapiens
aggcttggatctagacaggcc

SEQ ID NO: 7873754 - DNA, 22 bp, Homo sapiens
aggcttggaggttctgtagcca

SEQ ID NO: 7873755 - DNA, 22 bp, Homo sapiens
cccaggagttggaggctacggt

SEQ ID NO: 7873756 - DNA, 22 bp, Homo sapiens
cccaggagttggaggctacggt

SEQ ID NO: 7873757 - DNA, 22 bp, Homo sapiens
cccaggagttggaggctacggt

SEQ ID NO: 7873758 - DNA, 22 bp, Homo sapiens
cccaggagttggaggctacggt

SEQ ID NO: 7873759 - DNA, 22 bp, Homo sapiens
cccaggagttggaggctacggt

SEQ ID NO: 7873760 - DNA, 22 bp, Homo sapiens
cccaggagttggaggctgcagt

SEQ ID NO: 7873761 - DNA, 22 bp, Homo sapiens
cccaggagttggaggctgcagt

SEQ ID NO: 7873762 - DNA, 22 bp, Homo sapiens
cccaggagttggaggctacggt

SEQ ID NO: 7873763 - DNA, 19 bp, Homo sapiens
aggcttggattgtggccaa

SEQ ID NO: 7873764 - DNA, 22 bp, Homo sapiens
cccaggaggtggagcttgcagt

SEQ ID NO: 7873765 - DNA, 22 bp, Homo sapiens
cccaggaggtggaggctgcagt

SEQ ID NO: 7873766 - DNA, 22 bp, Homo sapiens
cccaggagttggaggctacggt

SEQ ID NO: 7873767 - DNA, 22 bp, Homo sapiens
cccaggaggtggagcttgcagt

SEQ ID NO: 7873768 - DNA, 19 bp, Homo sapiens
aggcttggaacagccttat

SEQ ID NO: 7873769 - DNA, 22 bp, Homo sapiens
aggcttggaaaatttacagtgt

SEQ ID NO: 7873770 - DNA, 19 bp, Homo sapiens
aggcttggaacagccttat

SEQ ID NO: 7873771 - DNA, 19 bp, Homo sapiens
aggcttggaacagccttat

SEQ ID NO: 7873772 - DNA, 19 bp, Homo sapiens
aggcttggaacagccttat

SEQ ID NO: 7873773 - DNA, 22 bp, Homo sapiens
aggcttggaaaatttacagtgt

SEQ ID NO: 7873774 - DNA, 22 bp, Homo sapiens
aggcttggaaaatttacagtgt

SEQ ID NO: 7873775 - DNA, 22 bp, Homo sapiens
aggcttgcaatggacacatgtg

SEQ ID NO: 7873776 - DNA, 18 bp, Homo sapiens
aggcttcttggctcagtc

SEQ ID NO: 7873777 - DNA, 18 bp, Homo sapiens
aggcttcttggctcagtc

SEQ ID NO: 7873778 - DNA, 22 bp, Homo sapiens
aggcttcttgggcttcattctg

SEQ ID NO: 7873779 - DNA, 22 bp, Homo sapiens
aggcttcttttagaggggatgg

SEQ ID NO: 7873780 - DNA, 22 bp, Homo sapiens
aggcttgaaatgaaatctgtaa

SEQ ID NO: 7873781 - DNA, 22 bp, Homo sapiens
aggcttgactgctgattttgcc

SEQ ID NO: 7873782 - DNA, 22 bp, Homo sapiens
aggcttcttgagccccacaggc

SEQ ID NO: 7873783 - DNA, 22 bp, Homo sapiens
aggcttcttgagccccacaggc

SEQ ID NO: 7873784 - DNA, 22 bp, Homo sapiens
aggcttcttgataaaatgcaga

SEQ ID NO: 7873785 - DNA, 22 bp, Homo sapiens
aggcttcttgataaaatgcaga

SEQ ID NO: 7873786 - DNA, 22 bp, Homo sapiens
aggcttcttctgcctgtctttg

SEQ ID NO: 7873787 - DNA, 22 bp, Homo sapiens
aggcttcttctgcctgtctttg

SEQ ID NO: 7873788 - DNA, 22 bp, Homo sapiens
aggcttcttcttcctatttagt

SEQ ID NO: 7873789 - DNA, 22 bp, Homo sapiens
aggcttcttagattggctggag

SEQ ID NO: 7873790 - DNA, 22 bp, Homo sapiens
aggcttcttagattggctggag

SEQ ID NO: 7873791 - DNA, 22 bp, Homo sapiens
aggcttcttagattggctggag

SEQ ID NO: 7873792 - DNA, 22 bp, Homo sapiens
aggcttcgcaaggttagagctg

SEQ ID NO: 7873793 - DNA, 22 bp, Homo sapiens
aggcttcctggaggaagaggta

SEQ ID NO: 7873794 - DNA, 22 bp, Homo sapiens
aggcttcctggaggaagaggta

SEQ ID NO: 7873795 - DNA, 19 bp, Homo sapiens
aggcttctaccctgtccag

SEQ ID NO: 7873796 - DNA, 19 bp, Homo sapiens
aggcttctaccctgtccag

SEQ ID NO: 7873797 - DNA, 22 bp, Homo sapiens
aggcttcactcgacatgccaat

SEQ ID NO: 7873798 - DNA, 22 bp, Homo sapiens
aggcttcctggaggaagaggta

SEQ ID NO: 7873799 - DNA, 22 bp, Homo sapiens
aggcttcacgatgggtgaggtg

SEQ ID NO: 7873800 - DNA, 22 bp, Homo sapiens
aggcttcacgatgggtgaggtg

SEQ ID NO: 7873801 - DNA, 22 bp, Homo sapiens
aggcttcacctgcacctgagct

SEQ ID NO: 7873802 - DNA, 22 bp, Homo sapiens
aggcttcacctgcacctgagct

SEQ ID NO: 7873803 - DNA, 22 bp, Homo sapiens
aggctggctggcaggggacaca

SEQ ID NO: 7873804 - DNA, 22 bp, Homo sapiens
aggcttcaattccttacccagt

SEQ ID NO: 7873805 - DNA, 22 bp, Homo sapiens
aggctggctggcaggggacaca

SEQ ID NO: 7873806 - DNA, 22 bp, Homo sapiens
aggctggctggcaggggacaca

SEQ ID NO: 7873807 - DNA, 22 bp, Homo sapiens
aggctggctggcaggggacaca

SEQ ID NO: 7873808 - DNA, 22 bp, Homo sapiens
aggctggctggcaggggacaca

SEQ ID NO: 7873809 - DNA, 22 bp, Homo sapiens
aggctggctgagctgcagcctg

SEQ ID NO: 7873810 - DNA, 22 bp, Homo sapiens
aggctggctgagctgcagcctg

SEQ ID NO: 7873811 - DNA, 22 bp, Homo sapiens
aggctggctgagctgcagcctg

SEQ ID NO: 7873812 - DNA, 22 bp, Homo sapiens
aggctggctgagctgcagcctg

SEQ ID NO: 7873813 - DNA, 22 bp, Homo sapiens
aggctggctgacttctgaagca

SEQ ID NO: 7873814 - DNA, 22 bp, Homo sapiens
aggctggctgacttctgaagca

SEQ ID NO: 7873815 - DNA, 22 bp, Homo sapiens
aggctggctgacttctgaagca

SEQ ID NO: 7873816 - DNA, 22 bp, Homo sapiens
aggctggctgacttctgaagca

SEQ ID NO: 7873817 - DNA, 22 bp, Homo sapiens
aggcttctagggttggcagcgg

SEQ ID NO: 7873818 - DNA, 22 bp, Homo sapiens
aggcttctagggttggcagcgg

SEQ ID NO: 7873819 - DNA, 22 bp, Homo sapiens
aggcttctagggttggcagcgg

SEQ ID NO: 7873820 - DNA, 22 bp, Homo sapiens
aggcttctagggttggcagcgg

SEQ ID NO: 7873821 - DNA, 21 bp, Homo sapiens
aggcttctccgtgcaggaaga

SEQ ID NO: 7873822 - DNA, 22 bp, Homo sapiens
aggcttctcaataggtttgaag

SEQ ID NO: 7873823 - DNA, 22 bp, Homo sapiens
aggcttctacgtggtcccaggg

SEQ ID NO: 7873824 - DNA, 19 bp, Homo sapiens
aggcttctaccctgtccag

SEQ ID NO: 7873825 - DNA, 19 bp, Homo sapiens
aggcttctaccctgtccag

SEQ ID NO: 7873826 - DNA, 19 bp, Homo sapiens
aggcttctaccctgtccag

SEQ ID NO: 7873827 - DNA, 22 bp, Homo sapiens
aggcttctacgtggtcccaggg

SEQ ID NO: 7873828 - DNA, 22 bp, Homo sapiens
aggcttctaggaaactttctgg

SEQ ID NO: 7873829 - DNA, 22 bp, Homo sapiens
aggcttctacgtggtcccaggg

SEQ ID NO: 7873830 - DNA, 22 bp, Homo sapiens
aggcttctgataccatgagaga

SEQ ID NO: 7873831 - DNA, 22 bp, Homo sapiens
aggcttctgataccatgagaga

SEQ ID NO: 7873832 - DNA, 22 bp, Homo sapiens
aggcttctgataccatgagaga

SEQ ID NO: 7873833 - DNA, 22 bp, Homo sapiens
aggcttctctccttggcttgca

SEQ ID NO: 7873834 - DNA, 22 bp, Homo sapiens
aggcttctctccttggcttgca

SEQ ID NO: 7873835 - DNA, 22 bp, Homo sapiens
aggcttctccttcctaccttcc

SEQ ID NO: 7873836 - DNA, 22 bp, Homo sapiens
aggcttctctgcaagatgttaa

SEQ ID NO: 7873837 - DNA, 22 bp, Homo sapiens
aggcttctgtctttaggagttg

SEQ ID NO: 7873838 - DNA, 22 bp, Homo sapiens
aggcttctggggcaccgagcga

SEQ ID NO: 7873839 - DNA, 22 bp, Homo sapiens
aggcttctgggattcccttggt

SEQ ID NO: 7873840 - DNA, 22 bp, Homo sapiens
aggcttctgggattcccttggt

SEQ ID NO: 7873841 - DNA, 22 bp, Homo sapiens
aggcttctgggattcccttggt

SEQ ID NO: 7873842 - DNA, 22 bp, Homo sapiens
aggcttctggaatccagtttct

SEQ ID NO: 7873843 - DNA, 22 bp, Homo sapiens
aggcttctgctgtattaacact

SEQ ID NO: 7873844 - DNA, 22 bp, Homo sapiens
cccaggatcacctggtcaaggg

SEQ ID NO: 7873845 - DNA, 22 bp, Homo sapiens
cccaggatggggctgcagttat

SEQ ID NO: 7873846 - DNA, 22 bp, Homo sapiens
cccaggatgatcgagagtggga

SEQ ID NO: 7873847 - DNA, 20 bp, Homo sapiens
cccaggagtttgctcttact

SEQ ID NO: 7873848 - DNA, 22 bp, Homo sapiens
cccaggagtttgagttcagcat

SEQ ID NO: 7873849 - DNA, 22 bp, Homo sapiens
cccaggagtttgagttcagcat

SEQ ID NO: 7873850 - DNA, 23 bp, Homo sapiens
cccaggagtttcactgcaaaggt

SEQ ID NO: 7873851 - DNA, 23 bp, Homo sapiens
cccaggagtttcactgcaaaggt

SEQ ID NO: 7873852 - DNA, 23 bp, Homo sapiens
cccaggagtttcactgcaaaggt

SEQ ID NO: 7873853 - DNA, 23 bp, Homo sapiens
cccaggagtttcactgcaaaggt

SEQ ID NO: 7873854 - DNA, 23 bp, Homo sapiens
cccaggagtttcactgcaaaggt

SEQ ID NO: 7873855 - DNA, 23 bp, Homo sapiens
cccaggagtttcactgcaaaggt

SEQ ID NO: 7873856 - DNA, 23 bp, Homo sapiens
cccaggagtttcactgcaaaggt

SEQ ID NO: 7873857 - DNA, 22 bp, Homo sapiens
cccaggagttggaggctgcagt

SEQ ID NO: 7873858 - DNA, 22 bp, Homo sapiens
cccaggagttggaggctgcagt

SEQ ID NO: 7873859 - DNA, 22 bp, Homo sapiens
cccaggagttggaggctgcagt

SEQ ID NO: 7873860 - DNA, 22 bp, Homo sapiens
cccaggagttggaggctgcagt

SEQ ID NO: 7873861 - DNA, 22 bp, Homo sapiens
cccaggagttggaggctgcagt

SEQ ID NO: 7873862 - DNA, 22 bp, Homo sapiens
cccaggagttggaggctgcagt

SEQ ID NO: 7873863 - DNA, 22 bp, Homo sapiens
cccaggagttggaggctgcagt

SEQ ID NO: 7873864 - DNA, 22 bp, Homo sapiens
cccaggagttggaggctgcagt

SEQ ID NO: 7873865 - DNA, 22 bp, Homo sapiens
cccaggagttggaggctgcagt

SEQ ID NO: 7873866 - DNA, 22 bp, Homo sapiens
cccaggagttggaggctgcagt

SEQ ID NO: 7873867 - DNA, 22 bp, Homo sapiens
cccaggagttggaggctgcagt

SEQ ID NO: 7873868 - DNA, 22 bp, Homo sapiens
agggaaattaatgtgagcaatg

SEQ ID NO: 7873869 - DNA, 22 bp, Homo sapiens
agggaaattaatgtgagcaatg

SEQ ID NO: 7873870 - DNA, 22 bp, Homo sapiens
agggaaatggagagtgtagttt

SEQ ID NO: 7873871 - DNA, 22 bp, Homo sapiens
agggaaattaatgtgagcaatg

SEQ ID NO: 7873872 - DNA, 22 bp, Homo sapiens
agggaaatctttcaacacttca

SEQ ID NO: 7873873 - DNA, 22 bp, Homo sapiens
agggaaatctttcaacacttca

SEQ ID NO: 7873874 - DNA, 22 bp, Homo sapiens
cccaggatggggctgcagttat

SEQ ID NO: 7873875 - DNA, 22 bp, Homo sapiens
agggaaataatctattctgagg

SEQ ID NO: 7873876 - DNA, 23 bp, Homo sapiens
agggaaatactgcaatttttgga

SEQ ID NO: 7873877 - DNA, 21 bp, Homo sapiens
agggaaatccagtcacttttc

SEQ ID NO: 7873878 - DNA, 21 bp, Homo sapiens
agggaaatccagtcacttttc

SEQ ID NO: 7873879 - DNA, 21 bp, Homo sapiens
agggaaatccagtcacttttc

SEQ ID NO: 7873880 - DNA, 22 bp, Homo sapiens
agggaaatctcagctctaaaat

SEQ ID NO: 7873881 - DNA, 22 bp, Homo sapiens
agggaacagtgaaaggcatcag

SEQ ID NO: 7873882 - DNA, 22 bp, Homo sapiens
agggaacagtgaaaggcatcag

SEQ ID NO: 7873883 - DNA, 22 bp, Homo sapiens
agggaacagtgaaaggcatcag

SEQ ID NO: 7873884 - DNA, 22 bp, Homo sapiens
agggaagaaaatccatcgctgc

SEQ ID NO: 7873885 - DNA, 22 bp, Homo sapiens
agggaactccatgaggccagag

SEQ ID NO: 7873886 - DNA, 22 bp, Homo sapiens
agggaaattaatgtgagcaatg

SEQ ID NO: 7873887 - DNA, 22 bp, Homo sapiens
agggaaattaatgtgagcaatg

SEQ ID NO: 7873888 - DNA, 23 bp, Homo sapiens
agggaacaagcaagctgctagtc

SEQ ID NO: 7873889 - DNA, 23 bp, Homo sapiens
agggaacaagcaagctgctagtc

SEQ ID NO: 7873890 - DNA, 20 bp, Homo sapiens
agggaacaatggacgctgtc

SEQ ID NO: 7873891 - DNA, 23 bp, Homo sapiens
agggaacaagcaagctgctagtc

SEQ ID NO: 7873892 - DNA, 22 bp, Homo sapiens
cccagggctgcagatggaggct

SEQ ID NO: 7873893 - DNA, 22 bp, Homo sapiens
cccagggctgcagatggaggct

SEQ ID NO: 7873894 - DNA, 22 bp, Homo sapiens
cccagggctgcagatggaggct

SEQ ID NO: 7873895 - DNA, 22 bp, Homo sapiens
cccagggctgcagatggaggct

SEQ ID NO: 7873896 - DNA, 22 bp, Homo sapiens
cccagggctgcagatggaggct

SEQ ID NO: 7873897 - DNA, 22 bp, Homo sapiens
cccagggctgcagatggaggct

SEQ ID NO: 7873898 - DNA, 22 bp, Homo sapiens
cccagggccctggacagctaca

SEQ ID NO: 7873899 - DNA, 21 bp, Homo sapiens
cccagggaagccgcagtcacc

SEQ ID NO: 7873900 - DNA, 21 bp, Homo sapiens
cccagggaagccgcagtcacc

SEQ ID NO: 7873901 - DNA, 21 bp, Homo sapiens
cccagggaagccgcagtcacc

SEQ ID NO: 7873902 - DNA, 22 bp, Homo sapiens
cccagggccctggacagctaca

SEQ ID NO: 7873903 - DNA, 22 bp, Homo sapiens
cccagggccctggacagctaca

SEQ ID NO: 7873904 - DNA, 22 bp, Homo sapiens
cccagggccctggacagctaca

SEQ ID NO: 7873905 - DNA, 22 bp, Homo sapiens
cccagggccctggacagctaca

SEQ ID NO: 7873906 - DNA, 23 bp, Homo sapiens
agggaagaaacatgaagggctgt

SEQ ID NO: 7873907 - DNA, 22 bp, Homo sapiens
agggaagaagctggtagtaggt

SEQ ID NO: 7873908 - DNA, 22 bp, Homo sapiens
agggaagaagctggtagtaggt

SEQ ID NO: 7873909 - DNA, 21 bp, Homo sapiens
cccagggaagccgcagtcacc

SEQ ID NO: 7873910 - DNA, 22 bp, Homo sapiens
cccagggaagccatttctgact

SEQ ID NO: 7873911 - DNA, 22 bp, Homo sapiens
cccagggaagccatttctgact

SEQ ID NO: 7873912 - DNA, 22 bp, Homo sapiens
agggaagaagctggtagtaggt

SEQ ID NO: 7873913 - DNA, 23 bp, Homo sapiens
agggaagaaacatgaagggctgt

SEQ ID NO: 7873914 - DNA, 23 bp, Homo sapiens
agggaagaaacatgaagggctgt

SEQ ID NO: 7873915 - DNA, 23 bp, Homo sapiens
agggaagaaacatgaagggctgt

SEQ ID NO: 7873916 - DNA, 23 bp, Homo sapiens
agggaagaaacatgaagggctgt

SEQ ID NO: 7873917 - DNA, 23 bp, Homo sapiens
agggaagaaacatgaagggctgt

SEQ ID NO: 7873918 - DNA, 22 bp, Homo sapiens
cccagggcttttctcactagac

SEQ ID NO: 7873919 - DNA, 22 bp, Homo sapiens
cccagggcttttctcactagac

SEQ ID NO: 7873920 - DNA, 22 bp, Homo sapiens
cccagggcttttctcactagac

SEQ ID NO: 7873921 - DNA, 22 bp, Homo sapiens
cccagggcttttctcactagac

SEQ ID NO: 7873922 - DNA, 22 bp, Homo sapiens
cccagggcttttctcactagac

SEQ ID NO: 7873923 - DNA, 22 bp, Homo sapiens
cccagggcttttctcactagac

SEQ ID NO: 7873924 - DNA, 22 bp, Homo sapiens
cccagggcttgagtcatccatg

SEQ ID NO: 7873925 - DNA, 22 bp, Homo sapiens
cccagggcttgagtcatccatg

SEQ ID NO: 7873926 - DNA, 22 bp, Homo sapiens
cccagggctgtagaatgtccaa

SEQ ID NO: 7873927 - DNA, 22 bp, Homo sapiens
cccagggctgcagatggaggct

SEQ ID NO: 7873928 - DNA, 22 bp, Homo sapiens
cccagggctgtagaatgtccaa

SEQ ID NO: 7873929 - DNA, 22 bp, Homo sapiens
cccaggggaggtcctcagggaa

SEQ ID NO: 7873930 - DNA, 22 bp, Homo sapiens
cccaggggtaaggcgcagcgtg

SEQ ID NO: 7873931 - DNA, 22 bp, Homo sapiens
cccaggggtaaggcgcagcgtg

SEQ ID NO: 7873932 - DNA, 22 bp, Homo sapiens
cccaggggtaaggcgcagcgtg

SEQ ID NO: 7873933 - DNA, 22 bp, Homo sapiens
cccaggggtatccatggagaag

SEQ ID NO: 7873934 - DNA, 22 bp, Homo sapiens
cccaggggtaaggcgcagcgtg

SEQ ID NO: 7873935 - DNA, 19 bp, Homo sapiens
cccaggggacccagcccta

SEQ ID NO: 7873936 - DNA, 19 bp, Homo sapiens
cccaggggacccagcccta

SEQ ID NO: 7873937 - DNA, 22 bp, Homo sapiens
cccaggggaggtcctcagggaa

SEQ ID NO: 7873938 - DNA, 22 bp, Homo sapiens
cccaggggaggtcctcagggaa

SEQ ID NO: 7873939 - DNA, 22 bp, Homo sapiens
cccaggggaggtcctcagggaa

SEQ ID NO: 7873940 - DNA, 22 bp, Homo sapiens
cccaggggaggtcctcagggaa

SEQ ID NO: 7873941 - DNA, 22 bp, Homo sapiens
cccaggggaggtcctcagggaa

SEQ ID NO: 7873942 - DNA, 22 bp, Homo sapiens
cccaggggaggtcctcagggaa

SEQ ID NO: 7873943 - DNA, 22 bp, Homo sapiens
caggaaggcgcggctgtgcctg

SEQ ID NO: 7873944 - DNA, 22 bp, Homo sapiens
caggaaggcccacctgtcctgt

SEQ ID NO: 7873945 - DNA, 22 bp, Homo sapiens
caggaaggcgcggctgtgcctg

SEQ ID NO: 7873946 - DNA, 22 bp, Homo sapiens
caggaaggcgcggctgtgcctg

SEQ ID NO: 7873947 - DNA, 22 bp, Homo sapiens
caggaaggcgcggctgtgcctg

SEQ ID NO: 7873948 - DNA, 22 bp, Homo sapiens
caggaaggcccacctgtcctgt

SEQ ID NO: 7873949 - DNA, 22 bp, Homo sapiens
caggaaggcccacctgtcctgt

SEQ ID NO: 7873950 - DNA, 22 bp, Homo sapiens
caggaaggcccacctgtcctgt

SEQ ID NO: 7873951 - DNA, 22 bp, Homo sapiens
caggaaggcccacctgtcctgt

SEQ ID NO: 7873952 - DNA, 22 bp, Homo sapiens
caggaaggcccacctgtcctgt

SEQ ID NO: 7873953 - DNA, 22 bp, Homo sapiens
caggaaggcccacctgtcctgt

SEQ ID NO: 7873954 - DNA, 22 bp, Homo sapiens
caggaaggcccacctgtcctgt

SEQ ID NO: 7873955 - DNA, 22 bp, Homo sapiens
caggaaggcccacctgtcctgt

SEQ ID NO: 7873956 - DNA, 22 bp, Homo sapiens
caggaaggggctcactctggcc

SEQ ID NO: 7873957 - DNA, 22 bp, Homo sapiens
caggaaggggctcactctggcc

SEQ ID NO: 7873958 - DNA, 22 bp, Homo sapiens
caggaaggggctcactctggcc

SEQ ID NO: 7873959 - DNA, 22 bp, Homo sapiens
caggaaggggctcactctggcc

SEQ ID NO: 7873960 - DNA, 19 bp, Homo sapiens
caggaaggggcgaatctgg

SEQ ID NO: 7873961 - DNA, 19 bp, Homo sapiens
caggaaggggcgaatctgg

SEQ ID NO: 7873962 - DNA, 22 bp, Homo sapiens
caggaaggggctcactctggcc

SEQ ID NO: 7873963 - DNA, 19 bp, Homo sapiens
caggaaggggcgaatctgg

SEQ ID NO: 7873964 - DNA, 22 bp, Homo sapiens
caggaaggcgcggctgtgcctg

SEQ ID NO: 7873965 - DNA, 22 bp, Homo sapiens
caggaaggcgcggctgtgcctg

SEQ ID NO: 7873966 - DNA, 22 bp, Homo sapiens
caggaaggcgcggctgtgcctg

SEQ ID NO: 7873967 - DNA, 22 bp, Homo sapiens
caggaaggcgcggctgtgcctg

SEQ ID NO: 7873968 - DNA, 22 bp, Homo sapiens
caggaaggcgcggctgtgcctg

SEQ ID NO: 7873969 - DNA, 22 bp, Homo sapiens
caggaaggcgcggctgtgcctg

SEQ ID NO: 7873970 - DNA, 22 bp, Homo sapiens
agctgcagtgaattcgctaact

SEQ ID NO: 7873971 - DNA, 22 bp, Homo sapiens
agctgcagttagccccagatga

SEQ ID NO: 7873972 - DNA, 22 bp, Homo sapiens
agctgcagttcgttccagctct

SEQ ID NO: 7873973 - DNA, 22 bp, Homo sapiens
agctgcagttcgttccagctct

SEQ ID NO: 7873974 - DNA, 22 bp, Homo sapiens
agctgcagttagccccagatga

SEQ ID NO: 7873975 - DNA, 22 bp, Homo sapiens
caggaaggggctcactctggcc

SEQ ID NO: 7873976 - DNA, 22 bp, Homo sapiens
caggaaggggctcactctggcc

SEQ ID NO: 7873977 - DNA, 22 bp, Homo sapiens
caggaaggggctcactctggcc

SEQ ID NO: 7873978 - DNA, 22 bp, Homo sapiens
caggaaggggctcactctggcc

SEQ ID NO: 7873979 - DNA, 22 bp, Homo sapiens
agctgcagtcaagctgggccac

SEQ ID NO: 7873980 - DNA, 22 bp, Homo sapiens
agctgcagtgaactgttttgtc

SEQ ID NO: 7873981 - DNA, 22 bp, Homo sapiens
agctgcagtgaactgttttgtc

SEQ ID NO: 7873982 - DNA, 22 bp, Homo sapiens
agctgccaagttggagtagcaa

SEQ ID NO: 7873983 - DNA, 22 bp, Homo sapiens
agctgccaagttggagtagcaa

SEQ ID NO: 7873984 - DNA, 22 bp, Homo sapiens
agctgcatttcagtgaaatatt

SEQ ID NO: 7873985 - DNA, 22 bp, Homo sapiens
agctgccaagttggagtagcaa

SEQ ID NO: 7873986 - DNA, 22 bp, Homo sapiens
agctgcagttcgttccagctct

SEQ ID NO: 7873987 - DNA, 22 bp, Homo sapiens
agctgcatgtcttattgagctg

SEQ ID NO: 7873988 - DNA, 22 bp, Homo sapiens
agctgcatttcagctgtgacct

SEQ ID NO: 7873989 - DNA, 20 bp, Homo sapiens
agctgcatatttatgtgtac

SEQ ID NO: 7873990 - DNA, 22 bp, Homo sapiens
agctgccacagagcctggccag

SEQ ID NO: 7873991 - DNA, 22 bp, Homo sapiens
agctgccacagagcctggccag

SEQ ID NO: 7873992 - DNA, 22 bp, Homo sapiens
agctgccaagtttctcagttta

SEQ ID NO: 7873993 - DNA, 22 bp, Homo sapiens
agctgccaagtttctcagttta

SEQ ID NO: 7873994 - DNA, 22 bp, Homo sapiens
agctgccacatgcccaagggca

SEQ ID NO: 7873995 - DNA, 22 bp, Homo sapiens
agctgccacatgcccaagggca

SEQ ID NO: 7873996 - DNA, 22 bp, Homo sapiens
agctgcagaggtttgtgcaaca

SEQ ID NO: 7873997 - DNA, 22 bp, Homo sapiens
agctgcagaggtttgtgcaaca

SEQ ID NO: 7873998 - DNA, 22 bp, Homo sapiens
agctgcagataggatgttattt

SEQ ID NO: 7873999 - DNA, 22 bp, Homo sapiens
agctgcagataggatgttattt

SEQ ID NO: 7874000 - DNA, 22 bp, Homo sapiens
agctgcagagaaaagaggctgg

SEQ ID NO: 7874001 - DNA, 22 bp, Homo sapiens
agctgcagagaaaagaggctgg

SEQ ID NO: 7874002 - DNA, 22 bp, Homo sapiens
agctgcagagaaaagaggctgg

SEQ ID NO: 7874003 - DNA, 18 bp, Homo sapiens
agctgcagaccaggaggt

SEQ ID NO: 7874004 - DNA, 22 bp, Homo sapiens
agctgcagaaaggacaactaat

SEQ ID NO: 7874005 - DNA, 22 bp, Homo sapiens
agctgcagaaaggacaactaat

SEQ ID NO: 7874006 - DNA, 20 bp, Homo sapiens
agctgcagaacccactggac

SEQ ID NO: 7874007 - DNA, 20 bp, Homo sapiens
agctgcagaacccactggac

SEQ ID NO: 7874008 - DNA, 19 bp, Homo sapiens
agctgcagaccagaagtgc

SEQ ID NO: 7874009 - DNA, 19 bp, Homo sapiens
agctgcagaccagaagtgc

SEQ ID NO: 7874010 - DNA, 18 bp, Homo sapiens
agctgcagaccaggaggt

SEQ ID NO: 7874011 - DNA, 18 bp, Homo sapiens
agctgcagaccaggaggt

SEQ ID NO: 7874012 - DNA, 18 bp, Homo sapiens
agctgcagaccaggaggt

SEQ ID NO: 7874013 - DNA, 19 bp, Homo sapiens
agctgcagaccagaagtgc

SEQ ID NO: 7874014 - DNA, 19 bp, Homo sapiens
agctgcagaccagaagtgc

SEQ ID NO: 7874015 - DNA, 19 bp, Homo sapiens
agctgcagaccagaagtgc

SEQ ID NO: 7874016 - DNA, 23 bp, Homo sapiens
agctgcagatgctcagcgggcag

SEQ ID NO: 7874017 - DNA, 23 bp, Homo sapiens
agctgcagatgctcagcgggcag

SEQ ID NO: 7874018 - DNA, 17 bp, Homo sapiens
agctgcagatgaagttg

SEQ ID NO: 7874019 - DNA, 22 bp, Homo sapiens
agctgcagcactccagtagccg

SEQ ID NO: 7874020 - DNA, 22 bp, Homo sapiens
agctgcagattctatctagaag

SEQ ID NO: 7874021 - DNA, 22 bp, Homo sapiens
agctgcagcactccagtagccg

SEQ ID NO: 7874022 - DNA, 22 bp, Homo sapiens
agctgcagcactccagtagccg

SEQ ID NO: 7874023 - DNA, 22 bp, Homo sapiens
agctgcagcactccagtagccg

SEQ ID NO: 7874024 - DNA, 22 bp, Homo sapiens
agctgcagcactccagtagccg

SEQ ID NO: 7874025 - DNA, 22 bp, Homo sapiens
caggaaggaccgtccagatcag

SEQ ID NO: 7874026 - DNA, 22 bp, Homo sapiens
caggaaggaccgtccagatcag

SEQ ID NO: 7874027 - DNA, 22 bp, Homo sapiens
caggaaggaccgtccagatcag

SEQ ID NO: 7874028 - DNA, 22 bp, Homo sapiens
caggaaggaccgtccagatcag

SEQ ID NO: 7874029 - DNA, 22 bp, Homo sapiens
caggaaggaccgtccagatcag

SEQ ID NO: 7874030 - DNA, 22 bp, Homo sapiens
caggaaggcccacctgtcctgt

SEQ ID NO: 7874031 - DNA, 22 bp, Homo sapiens
caggaaggaccgtccagatcag

SEQ ID NO: 7874032 - DNA, 22 bp, Homo sapiens
caggaagagaacatggaggctg

SEQ ID NO: 7874033 - DNA, 22 bp, Homo sapiens
caggaagagaacatggaggctg

SEQ ID NO: 7874034 - DNA, 22 bp, Homo sapiens
caggaagagaacatggaggctg

SEQ ID NO: 7874035 - DNA, 21 bp, Homo sapiens
agctgcagccatgtacatggc

SEQ ID NO: 7874036 - DNA, 22 bp, Homo sapiens
caggaagagaacatggaggctg

SEQ ID NO: 7874037 - DNA, 21 bp, Homo sapiens
agctgcagccatgtacatggc

SEQ ID NO: 7874038 - DNA, 22 bp, Homo sapiens
cagctgaaggtaggaaccagga

SEQ ID NO: 7874039 - DNA, 22 bp, Homo sapiens
cagctgaatcagtgagtggaaa

SEQ ID NO: 7874040 - DNA, 22 bp, Homo sapiens
cagctctgtctgtagaaacttc

SEQ ID NO: 7874041 - DNA, 22 bp, Homo sapiens
cagctgaagcccaggcagaacc

SEQ ID NO: 7874042 - DNA, 22 bp, Homo sapiens
cagctctgtctgtagaaacttc

SEQ ID NO: 7874043 - DNA, 22 bp, Homo sapiens
cagctctggttcctgggcccag

SEQ ID NO: 7874044 - DNA, 22 bp, Homo sapiens
cagctctgtaaattccttcatc

SEQ ID NO: 7874045 - DNA, 22 bp, Homo sapiens
cagctctgtaaattccttcatc

SEQ ID NO: 7874046 - DNA, 22 bp, Homo sapiens
cagctctgtaaattccttcatc

SEQ ID NO: 7874047 - DNA, 22 bp, Homo sapiens
cagctctgtaaattccttcatc

SEQ ID NO: 7874048 - DNA, 22 bp, Homo sapiens
cagctgaattcttcagactcca

SEQ ID NO: 7874049 - DNA, 22 bp, Homo sapiens
cagctgacaaactctgagctta

SEQ ID NO: 7874050 - DNA, 22 bp, Homo sapiens
cagctgacaagagtccttggag

SEQ ID NO: 7874051 - DNA, 22 bp, Homo sapiens
cagctgacactttgacctagag

SEQ ID NO: 7874052 - DNA, 22 bp, Homo sapiens
cagctgacaagagtccttggag

SEQ ID NO: 7874053 - DNA, 22 bp, Homo sapiens
cagctgacactttgacctagag

SEQ ID NO: 7874054 - DNA, 22 bp, Homo sapiens
cagctgacctggctaagggagc

SEQ ID NO: 7874055 - DNA, 22 bp, Homo sapiens
cagctgacatggtatttgtgcc

SEQ ID NO: 7874056 - DNA, 22 bp, Homo sapiens
cagctgacagtgaggtgggggc

SEQ ID NO: 7874057 - DNA, 22 bp, Homo sapiens
cagctgacccgtgggaggcggg

SEQ ID NO: 7874058 - DNA, 22 bp, Homo sapiens
cagctgacccagtgaggaggca

SEQ ID NO: 7874059 - DNA, 22 bp, Homo sapiens
cagctctggtccagggagggca

SEQ ID NO: 7874060 - DNA, 22 bp, Homo sapiens
cagctctggttcctgggcccag

SEQ ID NO: 7874061 - DNA, 22 bp, Homo sapiens
cagctctggttcctgggcccag

SEQ ID NO: 7874062 - DNA, 22 bp, Homo sapiens
cagctctggttcctgggcccag

SEQ ID NO: 7874063 - DNA, 22 bp, Homo sapiens
cagctctggttcctgggcccag

SEQ ID NO: 7874064 - DNA, 22 bp, Homo sapiens
cagctctggttcctgggcccag

SEQ ID NO: 7874065 - DNA, 22 bp, Homo sapiens
cagctctgggtgacaggagggc

SEQ ID NO: 7874066 - DNA, 22 bp, Homo sapiens
cagctctgggtgacaggagggc

SEQ ID NO: 7874067 - DNA, 22 bp, Homo sapiens
cagctctgggtgacaggagggc

SEQ ID NO: 7874068 - DNA, 22 bp, Homo sapiens
cagctctgggtgacaggagggc

SEQ ID NO: 7874069 - DNA, 20 bp, Homo sapiens
cagctctgggcaggtcgagg

SEQ ID NO: 7874070 - DNA, 22 bp, Homo sapiens
cagctctgggtgacaggagggc

SEQ ID NO: 7874071 - DNA, 22 bp, Homo sapiens
cagctctgggtgacaggagggc

SEQ ID NO: 7874072 - DNA, 22 bp, Homo sapiens
cagctctgggtgacaggagggc

SEQ ID NO: 7874073 - DNA, 22 bp, Homo sapiens
cagctctgggtgacaggagggc

SEQ ID NO: 7874074 - DNA, 22 bp, Homo sapiens
cagctctgggtaggaggaatct

SEQ ID NO: 7874075 - DNA, 22 bp, Homo sapiens
cagctctgggtaggaggaatct

SEQ ID NO: 7874076 - DNA, 22 bp, Homo sapiens
cagctctgggtaggaggaatct

SEQ ID NO: 7874077 - DNA, 22 bp, Homo sapiens
cagctctgggtaggaggaatct

SEQ ID NO: 7874078 - DNA, 22 bp, Homo sapiens
cagctctggggcagagtgacta

SEQ ID NO: 7874079 - DNA, 22 bp, Homo sapiens
cagctctgggtaggaggaatct

SEQ ID NO: 7874080 - DNA, 20 bp, Homo sapiens
cagctctgggcaggtcgagg

SEQ ID NO: 7874081 - DNA, 20 bp, Homo sapiens
cagctctgggcaggtcgagg

SEQ ID NO: 7874082 - DNA, 20 bp, Homo sapiens
cagctctgggcaggtcgagg

SEQ ID NO: 7874083 - DNA, 20 bp, Homo sapiens
cagctctgggcaggtcgagg

SEQ ID NO: 7874084 - DNA, 22 bp, Homo sapiens
cagctctggggcagagtgacta

SEQ ID NO: 7874085 - DNA, 22 bp, Homo sapiens
cagctctggggcagagtgacta

SEQ ID NO: 7874086 - DNA, 22 bp, Homo sapiens
cagctctggggcagagtgacta

SEQ ID NO: 7874087 - DNA, 20 bp, Homo sapiens
cagctctgggcaggtcgagg

SEQ ID NO: 7874088 - DNA, 20 bp, Homo sapiens
agctgcaacagactgtatgg

SEQ ID NO: 7874089 - DNA, 21 bp, Homo sapiens
agctgcaaaaacatacagttc

SEQ ID NO: 7874090 - DNA, 21 bp, Homo sapiens
agctgcaaaaacatacagttc

SEQ ID NO: 7874091 - DNA, 22 bp, Homo sapiens
agctgcaacatctgcttgtccc

SEQ ID NO: 7874092 - DNA, 22 bp, Homo sapiens
agctgcaaccttagctataggc

SEQ ID NO: 7874093 - DNA, 23 bp, Homo sapiens
agctgcaagactccctgtctgag

SEQ ID NO: 7874094 - DNA, 22 bp, Homo sapiens
agctgcaactgtccttgccttg

SEQ ID NO: 7874095 - DNA, 23 bp, Homo sapiens
agctgcaagactccctgtctgag

SEQ ID NO: 7874096 - DNA, 22 bp, Homo sapiens
agctgcaattaaagactgtgaa

SEQ ID NO: 7874097 - DNA, 22 bp, Homo sapiens
agctgcaatacccttcttcctt

SEQ ID NO: 7874098 - DNA, 22 bp, Homo sapiens
agctgcaattctggacatagtc

SEQ ID NO: 7874099 - DNA, 22 bp, Homo sapiens
agctgcagaaaggacaactaat

SEQ ID NO: 7874100 - DNA, 22 bp, Homo sapiens
agctgcaccggctggaccactg

SEQ ID NO: 7874101 - DNA, 22 bp, Homo sapiens
agctgcaagtgttgcctcctac

SEQ ID NO: 7874102 - DNA, 22 bp, Homo sapiens
agctgcaagtaagcttgctcct

SEQ ID NO: 7874103 - DNA, 22 bp, Homo sapiens
agctgcaagataaaagtgatgt

SEQ ID NO: 7874104 - DNA, 22 bp, Homo sapiens
agctgcaagataaaagtgatgt

SEQ ID NO: 7874105 - DNA, 22 bp, Homo sapiens
agctgagggcaggatggggtga

SEQ ID NO: 7874106 - DNA, 22 bp, Homo sapiens
agctgagggcaggatggggtga

SEQ ID NO: 7874107 - DNA, 22 bp, Homo sapiens
agctgagggcaggatggggtga

SEQ ID NO: 7874108 - DNA, 22 bp, Homo sapiens
agctgattccactttttcccca

SEQ ID NO: 7874109 - DNA, 22 bp, Homo sapiens
agctgattccactttttcccca

SEQ ID NO: 7874110 - DNA, 22 bp, Homo sapiens
cagctgagagacaatgagtcat

SEQ ID NO: 7874111 - DNA, 22 bp, Homo sapiens
cagctgagagacaatgagtcat

SEQ ID NO: 7874112 - DNA, 22 bp, Homo sapiens
cagctgagagacaatgagtcat

SEQ ID NO: 7874113 - DNA, 22 bp, Homo sapiens
cagctgagagtagaaatggagg

SEQ ID NO: 7874114 - DNA, 22 bp, Homo sapiens
cagctgagagtagaaatggagg

SEQ ID NO: 7874115 - DNA, 22 bp, Homo sapiens
cagctgagagtagaaatggagg

SEQ ID NO: 7874116 - DNA, 23 bp, Homo sapiens
agctgaggctgtgggtgtcagag

SEQ ID NO: 7874117 - DNA, 22 bp, Homo sapiens
cagctgagaaggtctgatcagg

SEQ ID NO: 7874118 - DNA, 22 bp, Homo sapiens
cagctgagaaggtctgatcagg

SEQ ID NO: 7874119 - DNA, 22 bp, Homo sapiens
cagctgagaaggtctgatcagg

SEQ ID NO: 7874120 - DNA, 22 bp, Homo sapiens
cagctgagaaatggggaaaggg

SEQ ID NO: 7874121 - DNA, 22 bp, Homo sapiens
cagctgagaaaggcaggctcac

SEQ ID NO: 7874122 - DNA, 22 bp, Homo sapiens
cagctgagaaaggcaggctcac

SEQ ID NO: 7874123 - DNA, 22 bp, Homo sapiens
cagctgagaaaggcaggctcac

SEQ ID NO: 7874124 - DNA, 22 bp, Homo sapiens
cagctgagaaaggcaggctcac

SEQ ID NO: 7874125 - DNA, 22 bp, Homo sapiens
cagctgagaagtgatagctgca

SEQ ID NO: 7874126 - DNA, 22 bp, Homo sapiens
cagctgagaccagaatgcaggt

SEQ ID NO: 7874127 - DNA, 22 bp, Homo sapiens
cagctgagaccagaatgcaggt

SEQ ID NO: 7874128 - DNA, 22 bp, Homo sapiens
cagctgagaagtgatagctgca

SEQ ID NO: 7874129 - DNA, 22 bp, Homo sapiens
cagctgagaagtgatagctgca

SEQ ID NO: 7874130 - DNA, 22 bp, Homo sapiens
cagctgagaagtgatagctgca

SEQ ID NO: 7874131 - DNA, 22 bp, Homo sapiens
cagctgagaagtgatagctgca

SEQ ID NO: 7874132 - DNA, 22 bp, Homo sapiens
cagctgagaagtgatagctgca

SEQ ID NO: 7874133 - DNA, 22 bp, Homo sapiens
caggaggacatactggctcaca

SEQ ID NO: 7874134 - DNA, 22 bp, Homo sapiens
caggaggacatactggctcaca

SEQ ID NO: 7874135 - DNA, 22 bp, Homo sapiens
caggaggacatactggctcaca

SEQ ID NO: 7874136 - DNA, 22 bp, Homo sapiens
caggaggacatactggctcaca

SEQ ID NO: 7874137 - DNA, 22 bp, Homo sapiens
caggaggacatactggctcaca

SEQ ID NO: 7874138 - DNA, 22 bp, Homo sapiens
caggaggagcattagcgtctca

SEQ ID NO: 7874139 - DNA, 22 bp, Homo sapiens
caggaggagcattagcgtctca

SEQ ID NO: 7874140 - DNA, 22 bp, Homo sapiens
agctgccacctctgcctttggg

SEQ ID NO: 7874141 - DNA, 22 bp, Homo sapiens
agctgccactgagggtgcacag

SEQ ID NO: 7874142 - DNA, 22 bp, Homo sapiens
agctgccacatggtgtcactgt

SEQ ID NO: 7874143 - DNA, 21 bp, Homo sapiens
agctgccaccctagcttctga

SEQ ID NO: 7874144 - DNA, 21 bp, Homo sapiens
agctgccaccctagcttctga

SEQ ID NO: 7874145 - DNA, 22 bp, Homo sapiens
caggagccccaggctgacaata

SEQ ID NO: 7874146 - DNA, 22 bp, Homo sapiens
caggaggacatactggctcaca

SEQ ID NO: 7874147 - DNA, 22 bp, Homo sapiens
caggagcccagagtcctcagct

SEQ ID NO: 7874148 - DNA, 22 bp, Homo sapiens
caggagccccaggctgacaata

SEQ ID NO: 7874149 - DNA, 22 bp, Homo sapiens
caggaggagggtacaccatcag

SEQ ID NO: 7874150 - DNA, 22 bp, Homo sapiens
caggaggagggtacaccatcag

SEQ ID NO: 7874151 - DNA, 22 bp, Homo sapiens
caggaggagggtacaccatcag

SEQ ID NO: 7874152 - DNA, 22 bp, Homo sapiens
caggaggagggtacaccatcag

SEQ ID NO: 7874153 - DNA, 22 bp, Homo sapiens
caggaggaggtgaggtagaact

SEQ ID NO: 7874154 - DNA, 22 bp, Homo sapiens
caggaggaggtgaggtagaact

SEQ ID NO: 7874155 - DNA, 22 bp, Homo sapiens
caggaggaggtgaggtagaact

SEQ ID NO: 7874156 - DNA, 22 bp, Homo sapiens
caggaggagggtacaccatcag

SEQ ID NO: 7874157 - DNA, 22 bp, Homo sapiens
caggaggagggtacaccatcag

SEQ ID NO: 7874158 - DNA, 22 bp, Homo sapiens
caggaggagggcagccgcctcc

SEQ ID NO: 7874159 - DNA, 22 bp, Homo sapiens
caggaggagctggccgcctcat

SEQ ID NO: 7874160 - DNA, 22 bp, Homo sapiens
caggaggagctggccgcctcat

SEQ ID NO: 7874161 - DNA, 22 bp, Homo sapiens
caggaggattgcttgaggccag

SEQ ID NO: 7874162 - DNA, 22 bp, Homo sapiens
caggaggattgcttgaggccag

SEQ ID NO: 7874163 - DNA, 22 bp, Homo sapiens
caggaggattgcttgaggccag

SEQ ID NO: 7874164 - DNA, 22 bp, Homo sapiens
caggaggattgcttgaggccag

SEQ ID NO: 7874165 - DNA, 22 bp, Homo sapiens
caggaggattgcttgaggccag

SEQ ID NO: 7874166 - DNA, 22 bp, Homo sapiens
agctgctgagccatgtcctgct

SEQ ID NO: 7874167 - DNA, 22 bp, Homo sapiens
agctgctgagccatgtcctgct

SEQ ID NO: 7874168 - DNA, 22 bp, Homo sapiens
agctgctgagccatgtcctgct

SEQ ID NO: 7874169 - DNA, 22 bp, Homo sapiens
agctgctgagccatgtcctgct

SEQ ID NO: 7874170 - DNA, 22 bp, Homo sapiens
agctgctgagccatgtcctgct

SEQ ID NO: 7874171 - DNA, 19 bp, Homo sapiens
agctgctgattggtggagg

SEQ ID NO: 7874172 - DNA, 22 bp, Homo sapiens
agctgctgagccatgtcctgct

SEQ ID NO: 7874173 - DNA, 22 bp, Homo sapiens
caggcacactgtctacactgag

SEQ ID NO: 7874174 - DNA, 22 bp, Homo sapiens
caggcacactgtctacactgag

SEQ ID NO: 7874175 - DNA, 22 bp, Homo sapiens
caggcactcattcagagaggtg

SEQ ID NO: 7874176 - DNA, 22 bp, Homo sapiens
caggcactcattcagagaggtg

SEQ ID NO: 7874177 - DNA, 22 bp, Homo sapiens
caggcactgcactaccactttt

SEQ ID NO: 7874178 - DNA, 22 bp, Homo sapiens
caggcactcattcagagaggtg

SEQ ID NO: 7874179 - DNA, 22 bp, Homo sapiens
caggcactcattcagagaggtg

SEQ ID NO: 7874180 - DNA, 22 bp, Homo sapiens
caggcactggccagtcagcaca

SEQ ID NO: 7874181 - DNA, 22 bp, Homo sapiens
caggcactggccagtcagcaca

SEQ ID NO: 7874182 - DNA, 22 bp, Homo sapiens
caggcactggccagtcagcaca

SEQ ID NO: 7874183 - DNA, 22 bp, Homo sapiens
caggcactgcactaccactttt

SEQ ID NO: 7874184 - DNA, 22 bp, Homo sapiens
caggcactggccagtcagcaca

SEQ ID NO: 7874185 - DNA, 22 bp, Homo sapiens
caggcactgcactaccactttt

SEQ ID NO: 7874186 - DNA, 22 bp, Homo sapiens
caggcactgtgcctcgctccct

SEQ ID NO: 7874187 - DNA, 22 bp, Homo sapiens
caggcactgtgctagatccttg

SEQ ID NO: 7874188 - DNA, 22 bp, Homo sapiens
caggcactgtgctgagctctgc

SEQ ID NO: 7874189 - DNA, 22 bp, Homo sapiens
caggcactgtgcctcgctccct

SEQ ID NO: 7874190 - DNA, 22 bp, Homo sapiens
caggcactgtgcctcgctccct

SEQ ID NO: 7874191 - DNA, 22 bp, Homo sapiens
caggcactgtgctagatccttg

SEQ ID NO: 7874192 - DNA, 22 bp, Homo sapiens
caggcactggccagtcagcaca

SEQ ID NO: 7874193 - DNA, 22 bp, Homo sapiens
caggcactggggatgctgggat

SEQ ID NO: 7874194 - DNA, 22 bp, Homo sapiens
caggcactggggatgctgggat

SEQ ID NO: 7874195 - DNA, 22 bp, Homo sapiens
caggcactggggatgctgggat

SEQ ID NO: 7874196 - DNA, 22 bp, Homo sapiens
caggcactggggatgctgggat

SEQ ID NO: 7874197 - DNA, 22 bp, Homo sapiens
caggcactgtgcaagggtctcg

SEQ ID NO: 7874198 - DNA, 22 bp, Homo sapiens
caggcactgtgcaagggtctcg

SEQ ID NO: 7874199 - DNA, 22 bp, Homo sapiens
agctgctgcgcctcaccctggc

SEQ ID NO: 7874200 - DNA, 22 bp, Homo sapiens
agctgctgcgcctcaccctggc

SEQ ID NO: 7874201 - DNA, 22 bp, Homo sapiens
agctgctgcgcctcaccctggc

SEQ ID NO: 7874202 - DNA, 22 bp, Homo sapiens
agctgctgcctcactggtctgt

SEQ ID NO: 7874203 - DNA, 22 bp, Homo sapiens
agctgctgcctcactggtctgt

SEQ ID NO: 7874204 - DNA, 22 bp, Homo sapiens
agctgctgcaagtggtgctaac

SEQ ID NO: 7874205 - DNA, 22 bp, Homo sapiens
agctgctgcctcactggtctgt

SEQ ID NO: 7874206 - DNA, 22 bp, Homo sapiens
agctgctgccggtggccaccct

SEQ ID NO: 7874207 - DNA, 19 bp, Homo sapiens
agctgctgattggtggagg

SEQ ID NO: 7874208 - DNA, 19 bp, Homo sapiens
agctgctgattggtggagg

SEQ ID NO: 7874209 - DNA, 19 bp, Homo sapiens
agctgctgattggtggagg

SEQ ID NO: 7874210 - DNA, 19 bp, Homo sapiens
agctgctgattggtggagg

SEQ ID NO: 7874211 - DNA, 22 bp, Homo sapiens
agctgctgcaagtggtgctaac

SEQ ID NO: 7874212 - DNA, 22 bp, Homo sapiens
agctgctgcaagtggtgctaac

SEQ ID NO: 7874213 - DNA, 22 bp, Homo sapiens
agctgctgcccataggtgacat

SEQ ID NO: 7874214 - DNA, 22 bp, Homo sapiens
agctgctgccggtggccaccct

SEQ ID NO: 7874215 - DNA, 22 bp, Homo sapiens
agctgctgccggtggccaccct

SEQ ID NO: 7874216 - DNA, 22 bp, Homo sapiens
agctgctgcccataggtgacat

SEQ ID NO: 7874217 - DNA, 22 bp, Homo sapiens
agctgctgcccataggtgacat

SEQ ID NO: 7874218 - DNA, 22 bp, Homo sapiens
agctgctgcccataggtgacat

SEQ ID NO: 7874219 - DNA, 22 bp, Homo sapiens
agctgctgcccataggtgacat

SEQ ID NO: 7874220 - DNA, 22 bp, Homo sapiens
agctgctgcccataggtgacat

SEQ ID NO: 7874221 - DNA, 19 bp, Homo sapiens
agctgctggcccagggacc

SEQ ID NO: 7874222 - DNA, 19 bp, Homo sapiens
agctgctggcccagggacc

SEQ ID NO: 7874223 - DNA, 19 bp, Homo sapiens
agctgctggcccagggacc

SEQ ID NO: 7874224 - DNA, 19 bp, Homo sapiens
agctgctggcccagggacc

SEQ ID NO: 7874225 - DNA, 19 bp, Homo sapiens
agctgctggcccagggacc

SEQ ID NO: 7874226 - DNA, 19 bp, Homo sapiens
agctgctggcccagggacc

SEQ ID NO: 7874227 - DNA, 19 bp, Homo sapiens
agctgctggcccagggacc

SEQ ID NO: 7874228 - DNA, 22 bp, Homo sapiens
agctgctgcggaaagatgccac

SEQ ID NO: 7874229 - DNA, 22 bp, Homo sapiens
agctgctgcggaaagatgccac

SEQ ID NO: 7874230 - DNA, 22 bp, Homo sapiens
agctgctgcggaaagatgccac

SEQ ID NO: 7874231 - DNA, 22 bp, Homo sapiens
agctgctgcggaaagatgccac

SEQ ID NO: 7874232 - DNA, 22 bp, Homo sapiens
agctgctgcggaaagatgccac

SEQ ID NO: 7874233 - DNA, 22 bp, Homo sapiens
agctgctgcgcctcaccctggc

SEQ ID NO: 7874234 - DNA, 19 bp, Homo sapiens
agctgctggcccagggacc

SEQ ID NO: 7874235 - DNA, 19 bp, Homo sapiens
agctgctggcccagggacc

SEQ ID NO: 7874236 - DNA, 22 bp, Homo sapiens
agctgctgggaccccagatcca

SEQ ID NO: 7874237 - DNA, 22 bp, Homo sapiens
agctgctgggaccccagatcca

SEQ ID NO: 7874238 - DNA, 22 bp, Homo sapiens
agctgctgggaccccagatcca

SEQ ID NO: 7874239 - DNA, 22 bp, Homo sapiens
caggcacactgtctacactgag

SEQ ID NO: 7874240 - DNA, 22 bp, Homo sapiens
caggcacactgtctacactgag

SEQ ID NO: 7874241 - DNA, 22 bp, Homo sapiens
agctgctgggaccccagatcca

SEQ ID NO: 7874242 - DNA, 22 bp, Homo sapiens
caggcacactgtctacactgag

SEQ ID NO: 7874243 - DNA, 22 bp, Homo sapiens
caggcataggtaggatgtttct

SEQ ID NO: 7874244 - DNA, 22 bp, Homo sapiens
caggcataatctcatcttgttt

SEQ ID NO: 7874245 - DNA, 22 bp, Homo sapiens
caggcatagaagggcaagaata

SEQ ID NO: 7874246 - DNA, 22 bp, Homo sapiens
caggcatatctacattatccaa

SEQ ID NO: 7874247 - DNA, 22 bp, Homo sapiens
caggcatgagccaggcccctcc

SEQ ID NO: 7874248 - DNA, 22 bp, Homo sapiens
caggccagaggctgttgttgcg

SEQ ID NO: 7874249 - DNA, 20 bp, Homo sapiens
caggccagaggtttgatggc

SEQ ID NO: 7874250 - DNA, 20 bp, Homo sapiens
caggccagaggtttgatggc

SEQ ID NO: 7874251 - DNA, 22 bp, Homo sapiens
agctggcctccgggtgcctggg

SEQ ID NO: 7874252 - DNA, 22 bp, Homo sapiens
agctggcctccgggtgcctggg

SEQ ID NO: 7874253 - DNA, 22 bp, Homo sapiens
agctggcctcactgcagaatgc

SEQ ID NO: 7874254 - DNA, 22 bp, Homo sapiens
agctggcctccgggtgcctggg

SEQ ID NO: 7874255 - DNA, 20 bp, Homo sapiens
caggcagtttgtggttaggg

SEQ ID NO: 7874256 - DNA, 22 bp, Homo sapiens
caggcataagtaatgttttatg

SEQ ID NO: 7874257 - DNA, 22 bp, Homo sapiens
agctggcctccgggtgcctggg

SEQ ID NO: 7874258 - DNA, 22 bp, Homo sapiens
agctggcctccgggtgcctggg

SEQ ID NO: 7874259 - DNA, 22 bp, Homo sapiens
agctggccggcctccaggtgga

SEQ ID NO: 7874260 - DNA, 22 bp, Homo sapiens
agctggccggcctccaggtgga

SEQ ID NO: 7874261 - DNA, 18 bp, Homo sapiens
agctggccctggctgccg

SEQ ID NO: 7874262 - DNA, 22 bp, Homo sapiens
agctggccggcctccaggtgga

SEQ ID NO: 7874263 - DNA, 22 bp, Homo sapiens
agctggccggcctccaggtgga

SEQ ID NO: 7874264 - DNA, 22 bp, Homo sapiens
agctggccggcctccaggtgga

SEQ ID NO: 7874265 - DNA, 18 bp, Homo sapiens
agctggccctggctgccg

SEQ ID NO: 7874266 - DNA, 18 bp, Homo sapiens
agctggccctggctgccg

SEQ ID NO: 7874267 - DNA, 18 bp, Homo sapiens
agctggccctggctgccg

SEQ ID NO: 7874268 - DNA, 18 bp, Homo sapiens
agctggccctggctgccg

SEQ ID NO: 7874269 - DNA, 18 bp, Homo sapiens
agctggccctggctgccg

SEQ ID NO: 7874270 - DNA, 18 bp, Homo sapiens
agctggccctggctgccg

SEQ ID NO: 7874271 - DNA, 22 bp, Homo sapiens
agctggccattgtgagtggcct

SEQ ID NO: 7874272 - DNA, 22 bp, Homo sapiens
agctggccattgtgagtggcct

SEQ ID NO: 7874273 - DNA, 22 bp, Homo sapiens
caggcactttgctgggggcgca

SEQ ID NO: 7874274 - DNA, 22 bp, Homo sapiens
caggcacttctgctgcttgtct

SEQ ID NO: 7874275 - DNA, 22 bp, Homo sapiens
caggcactgtgttaggcactgt

SEQ ID NO: 7874276 - DNA, 22 bp, Homo sapiens
caggcacttctgctgcttgtct

SEQ ID NO: 7874277 - DNA, 22 bp, Homo sapiens
caggcactgtgctgagctctgc

SEQ ID NO: 7874278 - DNA, 22 bp, Homo sapiens
caggcactgtgctgagctctgc

SEQ ID NO: 7874279 - DNA, 22 bp, Homo sapiens
caggcactgtgttaggcactgt

SEQ ID NO: 7874280 - DNA, 22 bp, Homo sapiens
caggcactgtgttaggcactgt

SEQ ID NO: 7874281 - DNA, 20 bp, Homo sapiens
agctggcccacaggtgtggg

SEQ ID NO: 7874282 - DNA, 20 bp, Homo sapiens
agctggcccacaggtgtggg

SEQ ID NO: 7874283 - DNA, 22 bp, Homo sapiens
agctggccattgtgagtggcct

SEQ ID NO: 7874284 - DNA, 22 bp, Homo sapiens
agctggccattgtgagtggcct

SEQ ID NO: 7874285 - DNA, 20 bp, Homo sapiens
agctggcccacaggtgtggg

SEQ ID NO: 7874286 - DNA, 20 bp, Homo sapiens
agctggcccacaggtgtggg

SEQ ID NO: 7874287 - DNA, 22 bp, Homo sapiens
agctggcccactgtgtggtcca

SEQ ID NO: 7874288 - DNA, 20 bp, Homo sapiens
agctggcccacaggtgtggg

SEQ ID NO: 7874289 - DNA, 20 bp, Homo sapiens
agctggcccccggtggcctg

SEQ ID NO: 7874290 - DNA, 20 bp, Homo sapiens
agctggcccccggtggcctg

SEQ ID NO: 7874291 - DNA, 20 bp, Homo sapiens
agctggcccccggtggcctg

SEQ ID NO: 7874292 - DNA, 22 bp, Homo sapiens
agctggccctcgagagccaatt

SEQ ID NO: 7874293 - DNA, 20 bp, Homo sapiens
agctggcccccggtggcctg

SEQ ID NO: 7874294 - DNA, 22 bp, Homo sapiens
agctggcccactgtgtggtcca

SEQ ID NO: 7874295 - DNA, 22 bp, Homo sapiens
agctggcccactgtgtggtcca

SEQ ID NO: 7874296 - DNA, 22 bp, Homo sapiens
agctggcccactgtgtggtcca

SEQ ID NO: 7874297 - DNA, 22 bp, Homo sapiens
agctggcccactgtgtggtcca

SEQ ID NO: 7874298 - DNA, 22 bp, Homo sapiens
agctggcccactgtgtggtcca

SEQ ID NO: 7874299 - DNA, 22 bp, Homo sapiens
caggccagcttcctgacatcct

SEQ ID NO: 7874300 - DNA, 22 bp, Homo sapiens
caggccagcttcctgacatcct

SEQ ID NO: 7874301 - DNA, 22 bp, Homo sapiens
caggccagcgtccagaacaagc

SEQ ID NO: 7874302 - DNA, 22 bp, Homo sapiens
caggccagcgtccagaacaagc

SEQ ID NO: 7874303 - DNA, 22 bp, Homo sapiens
caggccagcgtccagaacaagc

SEQ ID NO: 7874304 - DNA, 22 bp, Homo sapiens
caggccagcgtccagaacaagc

SEQ ID NO: 7874305 - DNA, 22 bp, Homo sapiens
caggccagcttcctgacatcct

SEQ ID NO: 7874306 - DNA, 22 bp, Homo sapiens
caggccagcttcctgacatcct

SEQ ID NO: 7874307 - DNA, 22 bp, Homo sapiens
caggccaggctgcatttgcccc

SEQ ID NO: 7874308 - DNA, 22 bp, Homo sapiens
caggccaggctgcatttgcccc

SEQ ID NO: 7874309 - DNA, 22 bp, Homo sapiens
caggccagagtccaactccaga

SEQ ID NO: 7874310 - DNA, 22 bp, Homo sapiens
caggccagagtccaactccaga

SEQ ID NO: 7874311 - DNA, 22 bp, Homo sapiens
caggccagagtccaactccaga

SEQ ID NO: 7874312 - DNA, 22 bp, Homo sapiens
caggccagcagggcctccgtgg

SEQ ID NO: 7874313 - DNA, 22 bp, Homo sapiens
caggccagcagggcctccgtgg

SEQ ID NO: 7874314 - DNA, 22 bp, Homo sapiens
caggccagcggcccgcgcgttc

SEQ ID NO: 7874315 - DNA, 22 bp, Homo sapiens
caggccagcggcccgcgcgttc

SEQ ID NO: 7874316 - DNA, 22 bp, Homo sapiens
caggccagcagggcctccgtgg

SEQ ID NO: 7874317 - DNA, 22 bp, Homo sapiens
caggccagggagaatatgaagc

SEQ ID NO: 7874318 - DNA, 22 bp, Homo sapiens
caggccagggagaatatgaagc

SEQ ID NO: 7874319 - DNA, 22 bp, Homo sapiens
agctgggctggagctccaagcg

SEQ ID NO: 7874320 - DNA, 22 bp, Homo sapiens
agctgggctggagctccaagcg

SEQ ID NO: 7874321 - DNA, 22 bp, Homo sapiens
agctgggctggagctccaagcg

SEQ ID NO: 7874322 - DNA, 22 bp, Homo sapiens
agctgggctggagctccaagcg

SEQ ID NO: 7874323 - DNA, 22 bp, Homo sapiens
caggccagggagaatatgaagc

SEQ ID NO: 7874324 - DNA, 22 bp, Homo sapiens
agctgggctgggctgagctgag

SEQ ID NO: 7874325 - DNA, 22 bp, Homo sapiens
agctgggctgggctgagctgag

SEQ ID NO: 7874326 - DNA, 22 bp, Homo sapiens
agctgggctgggctgagctgag

SEQ ID NO: 7874327 - DNA, 22 bp, Homo sapiens
agctgggctgggctgagctgag

SEQ ID NO: 7874328 - DNA, 22 bp, Homo sapiens
agctgggctgggctgagctgag

SEQ ID NO: 7874329 - DNA, 22 bp, Homo sapiens
agctgggctgggctgagctgag

SEQ ID NO: 7874330 - DNA, 22 bp, Homo sapiens
agctgggctggagctccaagcg

SEQ ID NO: 7874331 - DNA, 22 bp, Homo sapiens
agctgggctgggctgagctgag

SEQ ID NO: 7874332 - DNA, 22 bp, Homo sapiens
agctgggcttggccaggtcgct

SEQ ID NO: 7874333 - DNA, 22 bp, Homo sapiens
agctgggcttggccaggtcgct

SEQ ID NO: 7874334 - DNA, 22 bp, Homo sapiens
agctgggcttggccaggtcgct

SEQ ID NO: 7874335 - DNA, 22 bp, Homo sapiens
agctgggcttggccaggtcgct

SEQ ID NO: 7874336 - DNA, 22 bp, Homo sapiens
agctgggcttggccaggtcgct

SEQ ID NO: 7874337 - DNA, 19 bp, Homo sapiens
agctgggcttactcactcg

SEQ ID NO: 7874338 - DNA, 19 bp, Homo sapiens
agctgggcttactcactcg

SEQ ID NO: 7874339 - DNA, 19 bp, Homo sapiens
agctgggcttactcactcg

SEQ ID NO: 7874340 - DNA, 22 bp, Homo sapiens
agctgggcttggccaggtcgct

SEQ ID NO: 7874341 - DNA, 19 bp, Homo sapiens
agctgggcttactcactcg

SEQ ID NO: 7874342 - DNA, 19 bp, Homo sapiens
agctgggctgtcacagtga

SEQ ID NO: 7874343 - DNA, 19 bp, Homo sapiens
agctgggctgtcacagtga

SEQ ID NO: 7874344 - DNA, 19 bp, Homo sapiens
agctgggcttactcactcg

SEQ ID NO: 7874345 - DNA, 19 bp, Homo sapiens
agctgggcttactcactcg

SEQ ID NO: 7874346 - DNA, 19 bp, Homo sapiens
agctgggctgtcacagtga

SEQ ID NO: 7874347 - DNA, 19 bp, Homo sapiens
agctgggctgtcacagtga

SEQ ID NO: 7874348 - DNA, 19 bp, Homo sapiens
agctgggctgtcacagtga

SEQ ID NO: 7874349 - DNA, 19 bp, Homo sapiens
agctgggctgtcacagtga

SEQ ID NO: 7874350 - DNA, 19 bp, Homo sapiens
agctgggctgtcacagtga

SEQ ID NO: 7874351 - DNA, 19 bp, Homo sapiens
agctgggctgtcacagtga

SEQ ID NO: 7874352 - DNA, 20 bp, Homo sapiens
caggtgagcagatctgggtg

SEQ ID NO: 7874353 - DNA, 22 bp, Homo sapiens
caggtgagctctatctagggag

SEQ ID NO: 7874354 - DNA, 22 bp, Homo sapiens
caggtgagctctatctagggag

SEQ ID NO: 7874355 - DNA, 22 bp, Homo sapiens
caggtgaggctgaacagatgaa

SEQ ID NO: 7874356 - DNA, 22 bp, Homo sapiens
caggtgagctctatctagggag

SEQ ID NO: 7874357 - DNA, 20 bp, Homo sapiens
caggtgagcagatctgggtg

SEQ ID NO: 7874358 - DNA, 20 bp, Homo sapiens
caggtgagcagatctgggtg

SEQ ID NO: 7874359 - DNA, 20 bp, Homo sapiens
caggtgagcagatctgggtg

SEQ ID NO: 7874360 - DNA, 22 bp, Homo sapiens
caggtgacttctgaggccttca

SEQ ID NO: 7874361 - DNA, 22 bp, Homo sapiens
caggtgagaggcggtcctgcat

SEQ ID NO: 7874362 - DNA, 22 bp, Homo sapiens
caggtgagaggcggtcctgcat

SEQ ID NO: 7874363 - DNA, 22 bp, Homo sapiens
caggtgagaggcggtcctgcat

SEQ ID NO: 7874364 - DNA, 22 bp, Homo sapiens
caggtgagtaacaatgggtgat

SEQ ID NO: 7874365 - DNA, 22 bp, Homo sapiens
caggtgagttttcctccttggt

SEQ ID NO: 7874366 - DNA, 22 bp, Homo sapiens
caggtgcaatgagacagctctg

SEQ ID NO: 7874367 - DNA, 22 bp, Homo sapiens
caggtgattctaaagtctagcc

SEQ ID NO: 7874368 - DNA, 22 bp, Homo sapiens
caggtgattctaaagtctagcc

SEQ ID NO: 7874369 - DNA, 20 bp, Homo sapiens
caggtgattccctggggaat

SEQ ID NO: 7874370 - DNA, 22 bp, Homo sapiens
caggtgaggctgaacagatgaa

SEQ ID NO: 7874371 - DNA, 22 bp, Homo sapiens
caggtgaggctgaacagatgaa

SEQ ID NO: 7874372 - DNA, 22 bp, Homo sapiens
caggtgagtaacaatgggtgat

SEQ ID NO: 7874373 - DNA, 22 bp, Homo sapiens
caggtgagtaacaatgggtgat

SEQ ID NO: 7874374 - DNA, 22 bp, Homo sapiens
caggtgagtaacaatgggtgat

SEQ ID NO: 7874375 - DNA, 22 bp, Homo sapiens
caggtgagtaacaatgggtgat

SEQ ID NO: 7874376 - DNA, 22 bp, Homo sapiens
cagggtgcgccactcagatgta

SEQ ID NO: 7874377 - DNA, 22 bp, Homo sapiens
caggtcctttagtgtccagaac

SEQ ID NO: 7874378 - DNA, 22 bp, Homo sapiens
caggtcctttagtgtccagaac

SEQ ID NO: 7874379 - DNA, 22 bp, Homo sapiens
caggtcctttagtgtccagaac

SEQ ID NO: 7874380 - DNA, 22 bp, Homo sapiens
caggtgacatcaacaggaccac

SEQ ID NO: 7874381 - DNA, 22 bp, Homo sapiens
caggtgacatcaacaggaccac

SEQ ID NO: 7874382 - DNA, 22 bp, Homo sapiens
caggtcctttagtgtccagaac

SEQ ID NO: 7874383 - DNA, 22 bp, Homo sapiens
caggtgaccctcagtgtggact

SEQ ID NO: 7874384 - DNA, 22 bp, Homo sapiens
caggtgaccctctcacctgctt

SEQ ID NO: 7874385 - DNA, 22 bp, Homo sapiens
caggtgaccctctcacctgctt

SEQ ID NO: 7874386 - DNA, 22 bp, Homo sapiens
caggtgacctcagcgcctgcag

SEQ ID NO: 7874387 - DNA, 22 bp, Homo sapiens
caggtgacctgggatccgctgc

SEQ ID NO: 7874388 - DNA, 17 bp, Homo sapiens
caggtgacctggtgatg

SEQ ID NO: 7874389 - DNA, 22 bp, Homo sapiens
cagggtgcctctgctcccacca

SEQ ID NO: 7874390 - DNA, 22 bp, Homo sapiens
cagggtgcctcccgctcgccgg

SEQ ID NO: 7874391 - DNA, 22 bp, Homo sapiens
cagggtgcctcccgctcgccgg

SEQ ID NO: 7874392 - DNA, 22 bp, Homo sapiens
cagggtgccaaagaacaaatat

SEQ ID NO: 7874393 - DNA, 22 bp, Homo sapiens
cagggtgcctcccgctcgccgg

SEQ ID NO: 7874394 - DNA, 22 bp, Homo sapiens
cagggtgcgccactcagatgta

SEQ ID NO: 7874395 - DNA, 22 bp, Homo sapiens
cagggtgcgccactcagatgta

SEQ ID NO: 7874396 - DNA, 22 bp, Homo sapiens
cagggtgcctgtcctcagcaaa

SEQ ID NO: 7874397 - DNA, 22 bp, Homo sapiens
cagggtgcgggagatgtgcacc

SEQ ID NO: 7874398 - DNA, 22 bp, Homo sapiens
cagggtgcgggagatgtgcacc

SEQ ID NO: 7874399 - DNA, 22 bp, Homo sapiens
caggggctgaaatgttggggtt

SEQ ID NO: 7874400 - DNA, 22 bp, Homo sapiens
caggggctgaaatgttggggtt

SEQ ID NO: 7874401 - DNA, 22 bp, Homo sapiens
caggggctgagaaggaacgtcc

SEQ ID NO: 7874402 - DNA, 22 bp, Homo sapiens
caggggctgtggcacatggtgt

SEQ ID NO: 7874403 - DNA, 22 bp, Homo sapiens
caggggctctgggtgatgtgag

SEQ ID NO: 7874404 - DNA, 22 bp, Homo sapiens
caggggctctgggtgatgtgag

SEQ ID NO: 7874405 - DNA, 22 bp, Homo sapiens
caggggctctaatgcatgatca

SEQ ID NO: 7874406 - DNA, 22 bp, Homo sapiens
caggggctctaatgcatgatca

SEQ ID NO: 7874407 - DNA, 22 bp, Homo sapiens
caggggctctaatgcatgatca

SEQ ID NO: 7874408 - DNA, 22 bp, Homo sapiens
caggggctccctgggtgccagt

SEQ ID NO: 7874409 - DNA, 22 bp, Homo sapiens
cagggtgcagtgtcgctgctag

SEQ ID NO: 7874410 - DNA, 22 bp, Homo sapiens
cagggtgcagtgtcgctgctag

SEQ ID NO: 7874411 - DNA, 22 bp, Homo sapiens
cagggtgcatacccatgcatac

SEQ ID NO: 7874412 - DNA, 22 bp, Homo sapiens
cagggtgcatacccatgcatac

SEQ ID NO: 7874413 - DNA, 22 bp, Homo sapiens
cagggtgcatacccatgcatac

SEQ ID NO: 7874414 - DNA, 22 bp, Homo sapiens
cagggtgcagtgtcgctgctag

SEQ ID NO: 7874415 - DNA, 22 bp, Homo sapiens
cagggtgcagagctagggtagt

SEQ ID NO: 7874416 - DNA, 22 bp, Homo sapiens
cagggtgagtgggaagcagcgt

SEQ ID NO: 7874417 - DNA, 22 bp, Homo sapiens
cagggtgagtgggaagcagcgt

SEQ ID NO: 7874418 - DNA, 22 bp, Homo sapiens
cagggtgacaagtggcaaggag

SEQ ID NO: 7874419 - DNA, 22 bp, Homo sapiens
cagggtcttggcgccatcaccc

SEQ ID NO: 7874420 - DNA, 22 bp, Homo sapiens
caggggctgtttgcctcaggcc

SEQ ID NO: 7874421 - DNA, 22 bp, Homo sapiens
caggggctgtgggcggagcctc

SEQ ID NO: 7874422 - DNA, 22 bp, Homo sapiens
caggggctgtgggcggagcctc

SEQ ID NO: 7874423 - DNA, 22 bp, Homo sapiens
caggggctgtgggcggagcctc

SEQ ID NO: 7874424 - DNA, 22 bp, Homo sapiens
caggggctgtttgcctcaggcc

SEQ ID NO: 7874425 - DNA, 22 bp, Homo sapiens
cagggatggttgagaattggta

SEQ ID NO: 7874426 - DNA, 22 bp, Homo sapiens
cagggatggttgagaattggta

SEQ ID NO: 7874427 - DNA, 22 bp, Homo sapiens
cagggatgtctctggaagggag

SEQ ID NO: 7874428 - DNA, 22 bp, Homo sapiens
cagggatgtctctggaagggag

SEQ ID NO: 7874429 - DNA, 22 bp, Homo sapiens
cagggatgtctctggaagggag

SEQ ID NO: 7874430 - DNA, 22 bp, Homo sapiens
cagggatgtgatgagctgagcc

SEQ ID NO: 7874431 - DNA, 22 bp, Homo sapiens
cagggatgtgatgagctgagcc

SEQ ID NO: 7874432 - DNA, 22 bp, Homo sapiens
cagggatgtgatgagctgagcc

SEQ ID NO: 7874433 - DNA, 22 bp, Homo sapiens
cagggatgtgatgagctgagcc

SEQ ID NO: 7874434 - DNA, 22 bp, Homo sapiens
cagggatgtctctggaagggag

SEQ ID NO: 7874435 - DNA, 22 bp, Homo sapiens
cagggatgtctctggaagggag

SEQ ID NO: 7874436 - DNA, 22 bp, Homo sapiens
cagggatgtctctggaagggag

SEQ ID NO: 7874437 - DNA, 22 bp, Homo sapiens
cagggcctccccggcagtcttt

SEQ ID NO: 7874438 - DNA, 22 bp, Homo sapiens
cagggcctccccggcagtcttt

SEQ ID NO: 7874439 - DNA, 22 bp, Homo sapiens
cagggcctcctaaggcatctaa

SEQ ID NO: 7874440 - DNA, 22 bp, Homo sapiens
cagggcctcctaaggcatctaa

SEQ ID NO: 7874441 - DNA, 22 bp, Homo sapiens
cagggcctcctaaggcatctaa

SEQ ID NO: 7874442 - DNA, 22 bp, Homo sapiens
cagggcctcctaaggcatctaa

SEQ ID NO: 7874443 - DNA, 22 bp, Homo sapiens
cagggcctcctaaggcatctaa

SEQ ID NO: 7874444 - DNA, 22 bp, Homo sapiens
cagggcctcctaaggcatctaa

SEQ ID NO: 7874445 - DNA, 22 bp, Homo sapiens
cagggcctccccggcagtcttt

SEQ ID NO: 7874446 - DNA, 22 bp, Homo sapiens
cagggccaggctgatggcctgg

SEQ ID NO: 7874447 - DNA, 22 bp, Homo sapiens
cagggcctccccggcagtcttt

SEQ ID NO: 7874448 - DNA, 23 bp, Homo sapiens
cagggccaggcagcagctgtcac

SEQ ID NO: 7874449 - DNA, 23 bp, Homo sapiens
cagggccaggcagcagctgtcac

SEQ ID NO: 7874450 - DNA, 23 bp, Homo sapiens
cagggccaggcagcagctgtcac

SEQ ID NO: 7874451 - DNA, 22 bp, Homo sapiens
cagggcctgcaagagacctggg

SEQ ID NO: 7874452 - DNA, 22 bp, Homo sapiens
cagggcctgcaagagacctggg

SEQ ID NO: 7874453 - DNA, 22 bp, Homo sapiens
cagggcctgcaagagacctggg

SEQ ID NO: 7874454 - DNA, 22 bp, Homo sapiens
cagggcctgcaagagacctggg

SEQ ID NO: 7874455 - DNA, 22 bp, Homo sapiens
cagggcctgcaagagacctggg

SEQ ID NO: 7874456 - DNA, 22 bp, Homo sapiens
cagggcctgcaagagacctggg

SEQ ID NO: 7874457 - DNA, 22 bp, Homo sapiens
cagggcctgagggctgctctgc

SEQ ID NO: 7874458 - DNA, 22 bp, Homo sapiens
cagggcctgagggctgctctgc

SEQ ID NO: 7874459 - DNA, 22 bp, Homo sapiens
cagggcctgagggctgctctgc

SEQ ID NO: 7874460 - DNA, 22 bp, Homo sapiens
cagggcctgagggctgctctgc

SEQ ID NO: 7874461 - DNA, 22 bp, Homo sapiens
cagggcctgagggctgctctgc

SEQ ID NO: 7874462 - DNA, 22 bp, Homo sapiens
cagggcctctgtgggctctctc

SEQ ID NO: 7874463 - DNA, 22 bp, Homo sapiens
cagggcctctgtgggctctctc

SEQ ID NO: 7874464 - DNA, 22 bp, Homo sapiens
cagggcctcgaagcctctgggc

SEQ ID NO: 7874465 - DNA, 22 bp, Homo sapiens
cagggcctcgaagcctctgggc

SEQ ID NO: 7874466 - DNA, 22 bp, Homo sapiens
cagggcctcgaagcctctgggc

SEQ ID NO: 7874467 - DNA, 22 bp, Homo sapiens
cagggcctcgaagcctctgggc

SEQ ID NO: 7874468 - DNA, 22 bp, Homo sapiens
cagggcctcgaagcctctgggc

SEQ ID NO: 7874469 - DNA, 22 bp, Homo sapiens
cagggcctctcatcccacgggc

SEQ ID NO: 7874470 - DNA, 22 bp, Homo sapiens
cagggcctctcatcccacgggc

SEQ ID NO: 7874471 - DNA, 22 bp, Homo sapiens
cagggcctctcatcccacgggc

SEQ ID NO: 7874472 - DNA, 22 bp, Homo sapiens
cagggcctctcatcccacgggc

SEQ ID NO: 7874473 - DNA, 22 bp, Homo sapiens
cagggcctctcctccaggaact

SEQ ID NO: 7874474 - DNA, 22 bp, Homo sapiens
cagggctctgccttgagggatg

SEQ ID NO: 7874475 - DNA, 22 bp, Homo sapiens
cagggcttggatctgtggtcag

SEQ ID NO: 7874476 - DNA, 22 bp, Homo sapiens
cagggcttgccttgccccggcg

SEQ ID NO: 7874477 - DNA, 22 bp, Homo sapiens
cagggcttgatctgcatcctgc

SEQ ID NO: 7874478 - DNA, 22 bp, Homo sapiens
cagggctctgccttgagggatg

SEQ ID NO: 7874479 - DNA, 22 bp, Homo sapiens
cagggctctgccttgagggatg

SEQ ID NO: 7874480 - DNA, 22 bp, Homo sapiens
cagggcttgatctgcatcctgc

SEQ ID NO: 7874481 - DNA, 22 bp, Homo sapiens
cagggcttgatctgcatcctgc

SEQ ID NO: 7874482 - DNA, 22 bp, Homo sapiens
caggggctccctgggtgccagt

SEQ ID NO: 7874483 - DNA, 22 bp, Homo sapiens
caggggctccctgggtgccagt

SEQ ID NO: 7874484 - DNA, 22 bp, Homo sapiens
caggggctccctgggtgccagt

SEQ ID NO: 7874485 - DNA, 22 bp, Homo sapiens
cagggctcgctgccagcttcag

SEQ ID NO: 7874486 - DNA, 22 bp, Homo sapiens
cagggctcgctcttgcccttcg

SEQ ID NO: 7874487 - DNA, 22 bp, Homo sapiens
cagggctccccagagagcctct

SEQ ID NO: 7874488 - DNA, 22 bp, Homo sapiens
cagggctccccagagagcctct

SEQ ID NO: 7874489 - DNA, 22 bp, Homo sapiens
cagggctccccagagagcctct

SEQ ID NO: 7874490 - DNA, 22 bp, Homo sapiens
cagggctccccagagagcctct

SEQ ID NO: 7874491 - DNA, 22 bp, Homo sapiens
cagggctccccagagagcctct

SEQ ID NO: 7874492 - DNA, 22 bp, Homo sapiens
cagggctcccaaatatctcttc

SEQ ID NO: 7874493 - DNA, 22 bp, Homo sapiens
cagggctccccagagagcctct

SEQ ID NO: 7874494 - DNA, 22 bp, Homo sapiens
cagggcctgcctggttcctgga

SEQ ID NO: 7874495 - DNA, 22 bp, Homo sapiens
cagggctccatgcagggactcc

SEQ ID NO: 7874496 - DNA, 22 bp, Homo sapiens
cagggcctgcctggttcctgga

SEQ ID NO: 7874497 - DNA, 22 bp, Homo sapiens
cagggcctgcctggttcctgga

SEQ ID NO: 7874498 - DNA, 22 bp, Homo sapiens
cagggctccctctggctcccag

SEQ ID NO: 7874499 - DNA, 22 bp, Homo sapiens
cagggctccctgcagcctctgt

SEQ ID NO: 7874500 - DNA, 22 bp, Homo sapiens
cagggctccctctggctcccag

SEQ ID NO: 7874501 - DNA, 22 bp, Homo sapiens
cagggctccccgcaccgcagcc

SEQ ID NO: 7874502 - DNA, 22 bp, Homo sapiens
cagggctccctgcagcctctgt

SEQ ID NO: 7874503 - DNA, 22 bp, Homo sapiens
cagggctccctgcagcctctgt

SEQ ID NO: 7874504 - DNA, 22 bp, Homo sapiens
cagggctcccttgcaaggaggg

SEQ ID NO: 7874505 - DNA, 22 bp, Homo sapiens
cagggctcccttgcaaggaggg

SEQ ID NO: 7874506 - DNA, 22 bp, Homo sapiens
cagggctcccttgcaaggaggg

SEQ ID NO: 7874507 - DNA, 22 bp, Homo sapiens
cagggctccctgcagcctctgt

SEQ ID NO: 7874508 - DNA, 22 bp, Homo sapiens
caggctggacattagatacata

SEQ ID NO: 7874509 - DNA, 22 bp, Homo sapiens
caggctggacattagatacata

SEQ ID NO: 7874510 - DNA, 22 bp, Homo sapiens
caggctgctgacaggcttggag

SEQ ID NO: 7874511 - DNA, 22 bp, Homo sapiens
caggctgctgtccacaaagcat

SEQ ID NO: 7874512 - DNA, 22 bp, Homo sapiens
caggctgctgtccacaaagcat

SEQ ID NO: 7874513 - DNA, 22 bp, Homo sapiens
caggctggagtgcagtgtcgcc

SEQ ID NO: 7874514 - DNA, 22 bp, Homo sapiens
caggctggagtgcagtgtcgcc

SEQ ID NO: 7874515 - DNA, 22 bp, Homo sapiens
caggctggagtgcagtgtcgcc

SEQ ID NO: 7874516 - DNA, 22 bp, Homo sapiens
caggctggagtgcagtggtgcc

SEQ ID NO: 7874517 - DNA, 22 bp, Homo sapiens
caggctggagtgcagtgtcgcc

SEQ ID NO: 7874518 - DNA, 22 bp, Homo sapiens
caggctggagtgcagtgtcgcc

SEQ ID NO: 7874519 - DNA, 22 bp, Homo sapiens
caggctggagtgcagtgtcgcc

SEQ ID NO: 7874520 - DNA, 22 bp, Homo sapiens
caggctggagtgcagtgtcgcc

SEQ ID NO: 7874521 - DNA, 22 bp, Homo sapiens
caggctggagtgcagtgtcgcc

SEQ ID NO: 7874522 - DNA, 22 bp, Homo sapiens
caggctggagtacaattgtgtg

SEQ ID NO: 7874523 - DNA, 22 bp, Homo sapiens
caggctggagtgcagtggtgcc

SEQ ID NO: 7874524 - DNA, 22 bp, Homo sapiens
cagggagcggagtcccatgcct

SEQ ID NO: 7874525 - DNA, 22 bp, Homo sapiens
cagggagcggagtcccatgcct

SEQ ID NO: 7874526 - DNA, 22 bp, Homo sapiens
cagggagctattagggttagtg

SEQ ID NO: 7874527 - DNA, 22 bp, Homo sapiens
cagggagcggagtcccatgcct

SEQ ID NO: 7874528 - DNA, 22 bp, Homo sapiens
cagggagcggagtcccatgcct

SEQ ID NO: 7874529 - DNA, 22 bp, Homo sapiens
cagggagcggagtcccatgcct

SEQ ID NO: 7874530 - DNA, 22 bp, Homo sapiens
cagggagcggagtcccatgcct

SEQ ID NO: 7874531 - DNA, 22 bp, Homo sapiens
cagggagaaatctccaggaggt

SEQ ID NO: 7874532 - DNA, 22 bp, Homo sapiens
cagggagaaatctccaggaggt

SEQ ID NO: 7874533 - DNA, 22 bp, Homo sapiens
caggctggagttacctttaggg

SEQ ID NO: 7874534 - DNA, 22 bp, Homo sapiens
cagggagaaatctccaggaggt

SEQ ID NO: 7874535 - DNA, 22 bp, Homo sapiens
caggctggagttacctttaggg

SEQ ID NO: 7874536 - DNA, 22 bp, Homo sapiens
caggctggagttacctttaggg

SEQ ID NO: 7874537 - DNA, 22 bp, Homo sapiens
caggctggagtgcagttgtgca

SEQ ID NO: 7874538 - DNA, 22 bp, Homo sapiens
caggctggagtgcagttgtgca

SEQ ID NO: 7874539 - DNA, 22 bp, Homo sapiens
caggctggagtgcagttgtgca

SEQ ID NO: 7874540 - DNA, 22 bp, Homo sapiens
caggctggagtgcagttgtgca

SEQ ID NO: 7874541 - DNA, 22 bp, Homo sapiens
caggctggagtgcagttgtgca

SEQ ID NO: 7874542 - DNA, 22 bp, Homo sapiens
caggctggagtgcagtgtcgcc

SEQ ID NO: 7874543 - DNA, 22 bp, Homo sapiens
caggctggagtgcagttgtgca

SEQ ID NO: 7874544 - DNA, 22 bp, Homo sapiens
caggctggagtgcagttgtgca

SEQ ID NO: 7874545 - DNA, 22 bp, Homo sapiens
caggctggagtgcagttgtgca

SEQ ID NO: 7874546 - DNA, 22 bp, Homo sapiens
caggctggagttacctttaggg

SEQ ID NO: 7874547 - DNA, 22 bp, Homo sapiens
caggctggagttacctttaggg

SEQ ID NO: 7874548 - DNA, 22 bp, Homo sapiens
cagggatgggatggagtcagtt

SEQ ID NO: 7874549 - DNA, 22 bp, Homo sapiens
cagggatgggatggagtcagtt

SEQ ID NO: 7874550 - DNA, 22 bp, Homo sapiens
cagggatgggatggagtcagtt

SEQ ID NO: 7874551 - DNA, 22 bp, Homo sapiens
cagggatgggatggagtcagtt

SEQ ID NO: 7874552 - DNA, 22 bp, Homo sapiens
cagggatggcgctggctgcccg

SEQ ID NO: 7874553 - DNA, 22 bp, Homo sapiens
cagggagctttcccaggaccct

SEQ ID NO: 7874554 - DNA, 22 bp, Homo sapiens
cagggagctttcccaggaccct

SEQ ID NO: 7874555 - DNA, 22 bp, Homo sapiens
cagggagctttcccaggaccct

SEQ ID NO: 7874556 - DNA, 22 bp, Homo sapiens
cagggagctttcccaggaccct

SEQ ID NO: 7874557 - DNA, 22 bp, Homo sapiens
cagggagctttcccaggaccct

SEQ ID NO: 7874558 - DNA, 22 bp, Homo sapiens
cagggagctggtgccagccgac

SEQ ID NO: 7874559 - DNA, 22 bp, Homo sapiens
cagggagctggtgccagccgac

SEQ ID NO: 7874560 - DNA, 22 bp, Homo sapiens
cagggagctggtgccagccgac

SEQ ID NO: 7874561 - DNA, 22 bp, Homo sapiens
cagggagctggtgccagccgac

SEQ ID NO: 7874562 - DNA, 22 bp, Homo sapiens
cagggagctggtgccagccgac

SEQ ID NO: 7874563 - DNA, 22 bp, Homo sapiens
cagggagctggtgccagccgac

SEQ ID NO: 7874564 - DNA, 22 bp, Homo sapiens
cagggagctggctggctgtgcc

SEQ ID NO: 7874565 - DNA, 19 bp, Homo sapiens
cagggatgggtagggactc

SEQ ID NO: 7874566 - DNA, 19 bp, Homo sapiens
cagggatgggtagggactc

SEQ ID NO: 7874567 - DNA, 19 bp, Homo sapiens
cagggatgggtagggactc

SEQ ID NO: 7874568 - DNA, 22 bp, Homo sapiens
cagggatggtaaatatgtaaag

SEQ ID NO: 7874569 - DNA, 22 bp, Homo sapiens
cagggatggttgagaattggta

SEQ ID NO: 7874570 - DNA, 19 bp, Homo sapiens
cagggatgggtagggactc

SEQ ID NO: 7874571 - DNA, 19 bp, Homo sapiens
cagggatgggtagggactc

SEQ ID NO: 7874572 - DNA, 22 bp, Homo sapiens
cagggatgggatggagtcagtt

SEQ ID NO: 7874573 - DNA, 22 bp, Homo sapiens
cagggatgggatggagtcagtt

SEQ ID NO: 7874574 - DNA, 19 bp, Homo sapiens
cagggatgggtagggactc

SEQ ID NO: 7874575 - DNA, 22 bp, Homo sapiens
cagggatgggatggagtcagtt

SEQ ID NO: 7874576 - DNA, 22 bp, Homo sapiens
cagggagctctgggccggactc

SEQ ID NO: 7874577 - DNA, 22 bp, Homo sapiens
cagggagctattagggttagtg

SEQ ID NO: 7874578 - DNA, 22 bp, Homo sapiens
cagggagctattagggttagtg

SEQ ID NO: 7874579 - DNA, 22 bp, Homo sapiens
cagggagctattagggttagtg

SEQ ID NO: 7874580 - DNA, 22 bp, Homo sapiens
cagggagctattagggttagtg

SEQ ID NO: 7874581 - DNA, 22 bp, Homo sapiens
cagggagctctgggccggactc

SEQ ID NO: 7874582 - DNA, 22 bp, Homo sapiens
cagggagctctgggccggactc

SEQ ID NO: 7874583 - DNA, 22 bp, Homo sapiens
cagggagctctgggccggactc

SEQ ID NO: 7874584 - DNA, 22 bp, Homo sapiens
cagggagctctgggccggactc

SEQ ID NO: 7874585 - DNA, 22 bp, Homo sapiens
cagggagctctgggccggactc

SEQ ID NO: 7874586 - DNA, 22 bp, Homo sapiens
cagggagctctgggccggactc

SEQ ID NO: 7874587 - DNA, 22 bp, Homo sapiens
cagggagctgacaaccaaggag

SEQ ID NO: 7874588 - DNA, 22 bp, Homo sapiens
cagggagctgacaaccaaggag

SEQ ID NO: 7874589 - DNA, 22 bp, Homo sapiens
cagggagctgacaaccaaggag

SEQ ID NO: 7874590 - DNA, 22 bp, Homo sapiens
cagggagctgacaaccaaggag

SEQ ID NO: 7874591 - DNA, 22 bp, Homo sapiens
cagggagctgacaaccaaggag

SEQ ID NO: 7874592 - DNA, 22 bp, Homo sapiens
cagggagctgacaaccaaggag

SEQ ID NO: 7874593 - DNA, 22 bp, Homo sapiens
cagggagctgacaaccaaggag

SEQ ID NO: 7874594 - DNA, 22 bp, Homo sapiens
cagggagctggagttggagtac

SEQ ID NO: 7874595 - DNA, 22 bp, Homo sapiens
cagggagctggagttggagtac

SEQ ID NO: 7874596 - DNA, 22 bp, Homo sapiens
cagggagctggagttggagtac

SEQ ID NO: 7874597 - DNA, 22 bp, Homo sapiens
cagggagctggagttggagtac

SEQ ID NO: 7874598 - DNA, 22 bp, Homo sapiens
cagggagctggctggctgtgcc

SEQ ID NO: 7874599 - DNA, 22 bp, Homo sapiens
cagggagctggctggctgtgcc

SEQ ID NO: 7874600 - DNA, 22 bp, Homo sapiens
cagggagctggctggctgtgcc

SEQ ID NO: 7874601 - DNA, 22 bp, Homo sapiens
cagggagctggctggctgtgcc

SEQ ID NO: 7874602 - DNA, 22 bp, Homo sapiens
cagggagctggctggctgtgcc

SEQ ID NO: 7874603 - DNA, 22 bp, Homo sapiens
cagggagctggctggcgtgagt

SEQ ID NO: 7874604 - DNA, 22 bp, Homo sapiens
cagggagctggctggctgtgcc

SEQ ID NO: 7874605 - DNA, 22 bp, Homo sapiens
cagggagctggctggctgtgcc

SEQ ID NO: 7874606 - DNA, 22 bp, Homo sapiens
cagggagctggctggctgtgcc

SEQ ID NO: 7874607 - DNA, 22 bp, Homo sapiens
cagggagctggctggctgtgcc

SEQ ID NO: 7874608 - DNA, 22 bp, Homo sapiens
cagggagctggctggctgtgcc

SEQ ID NO: 7874609 - DNA, 22 bp, Homo sapiens
cagggagctggagttggagtac

SEQ ID NO: 7874610 - DNA, 22 bp, Homo sapiens
cagggagctggctggcgtgagt

SEQ ID NO: 7874611 - DNA, 22 bp, Homo sapiens
cagggagctctgggccggactc

SEQ ID NO: 7874612 - DNA, 22 bp, Homo sapiens
cagggagctggctggcgtgagt

SEQ ID NO: 7874613 - DNA, 22 bp, Homo sapiens
cagggagctggctggctgtgcc

SEQ ID NO: 7874614 - DNA, 22 bp, Homo sapiens
cagggagctggctggcgtgagt

SEQ ID NO: 7874615 - DNA, 22 bp, Homo sapiens
cagggagctggctggcgtgagt

SEQ ID NO: 7874616 - DNA, 22 bp, Homo sapiens
cagggagctggctggcgtgagt

SEQ ID NO: 7874617 - DNA, 22 bp, Homo sapiens
cagggagctggctggcgtgagt

SEQ ID NO: 7874618 - DNA, 22 bp, Homo sapiens
caggctcactgtaaggtcagct

SEQ ID NO: 7874619 - DNA, 22 bp, Homo sapiens
caggctcactgtaaggtcagct

SEQ ID NO: 7874620 - DNA, 22 bp, Homo sapiens
caggctcactgtaaggtcagct

SEQ ID NO: 7874621 - DNA, 22 bp, Homo sapiens
caggcctggttgagccctgaga

SEQ ID NO: 7874622 - DNA, 22 bp, Homo sapiens
caggcctgtctgcacatgaggc

SEQ ID NO: 7874623 - DNA, 22 bp, Homo sapiens
caggcctgtctgcacatgaggc

SEQ ID NO: 7874624 - DNA, 22 bp, Homo sapiens
caggctcactgtaaggtcagct

SEQ ID NO: 7874625 - DNA, 22 bp, Homo sapiens
caggctcactttctcagtcaca

SEQ ID NO: 7874626 - DNA, 22 bp, Homo sapiens
caggctcactgtaaggtcagct

SEQ ID NO: 7874627 - DNA, 22 bp, Homo sapiens
caggctcactttctcagtcaca

SEQ ID NO: 7874628 - DNA, 22 bp, Homo sapiens
caggctcactgtaaggtcagct

SEQ ID NO: 7874629 - DNA, 22 bp, Homo sapiens
caggctcactttctcagtcaca

SEQ ID NO: 7874630 - DNA, 22 bp, Homo sapiens
caggctcactttctcagtcaca

SEQ ID NO: 7874631 - DNA, 18 bp, Homo sapiens
agctggggcctctggtcc

SEQ ID NO: 7874632 - DNA, 18 bp, Homo sapiens
agctggggcctctggtcc

SEQ ID NO: 7874633 - DNA, 18 bp, Homo sapiens
agctggggcctctggtcc

SEQ ID NO: 7874634 - DNA, 19 bp, Homo sapiens
agctggggcggtgtgtgtt

SEQ ID NO: 7874635 - DNA, 18 bp, Homo sapiens
agctggggcctctggtcc

SEQ ID NO: 7874636 - DNA, 18 bp, Homo sapiens
agctggggcctctggtcc

SEQ ID NO: 7874637 - DNA, 18 bp, Homo sapiens
agctggggcctctggtcc

SEQ ID NO: 7874638 - DNA, 22 bp, Homo sapiens
agctggggcatttatccactaa

SEQ ID NO: 7874639 - DNA, 22 bp, Homo sapiens
agctggggcatttatccactaa

SEQ ID NO: 7874640 - DNA, 18 bp, Homo sapiens
agctggggcctctggtcc

SEQ ID NO: 7874641 - DNA, 22 bp, Homo sapiens
agctggggcatttatccactaa

SEQ ID NO: 7874642 - DNA, 22 bp, Homo sapiens
agctggggcatttatccactaa

SEQ ID NO: 7874643 - DNA, 22 bp, Homo sapiens
caggctcagctctggccagtgc

SEQ ID NO: 7874644 - DNA, 22 bp, Homo sapiens
caggctcagctctggccagtgc

SEQ ID NO: 7874645 - DNA, 22 bp, Homo sapiens
caggctcagccacaggggaagg

SEQ ID NO: 7874646 - DNA, 22 bp, Homo sapiens
caggctcagctctggccagtgc

SEQ ID NO: 7874647 - DNA, 22 bp, Homo sapiens
caggctcagaagccagtggagc

SEQ ID NO: 7874648 - DNA, 22 bp, Homo sapiens
caggctcagatgccctgcgctg

SEQ ID NO: 7874649 - DNA, 22 bp, Homo sapiens
caggctcagaagccagtggagc

SEQ ID NO: 7874650 - DNA, 22 bp, Homo sapiens
caggctcagaagccagtggagc

SEQ ID NO: 7874651 - DNA, 22 bp, Homo sapiens
caggctcagaagccagtggagc

SEQ ID NO: 7874652 - DNA, 22 bp, Homo sapiens
caggctcagatgccctgcgctg

SEQ ID NO: 7874653 - DNA, 22 bp, Homo sapiens
caggctcagatgccctgcgctg

SEQ ID NO: 7874654 - DNA, 22 bp, Homo sapiens
caggctcagctctggccagtgc

SEQ ID NO: 7874655 - DNA, 22 bp, Homo sapiens
caggctccacaggggaatccgg

SEQ ID NO: 7874656 - DNA, 22 bp, Homo sapiens
caggctccactgtaggcagctc

SEQ ID NO: 7874657 - DNA, 22 bp, Homo sapiens
caggctccactgtaggcagctc

SEQ ID NO: 7874658 - DNA, 22 bp, Homo sapiens
caggctccactgtaggcagctc

SEQ ID NO: 7874659 - DNA, 22 bp, Homo sapiens
agctgtgattatccactggaat

SEQ ID NO: 7874660 - DNA, 22 bp, Homo sapiens
agctgtgattatccactggaat

SEQ ID NO: 7874661 - DNA, 22 bp, Homo sapiens
agctgtgattatccactggaat

SEQ ID NO: 7874662 - DNA, 22 bp, Homo sapiens
caggctccactgtaggcagctc

SEQ ID NO: 7874663 - DNA, 22 bp, Homo sapiens
agctgtctttggagagggagag

SEQ ID NO: 7874664 - DNA, 22 bp, Homo sapiens
agctgtgaccttcaagagctac

SEQ ID NO: 7874665 - DNA, 22 bp, Homo sapiens
agctgtgaattttatgctagtg

SEQ ID NO: 7874666 - DNA, 22 bp, Homo sapiens
caggctgctccagggtaggaaa

SEQ ID NO: 7874667 - DNA, 22 bp, Homo sapiens
caggctgctccagggtaggaaa

SEQ ID NO: 7874668 - DNA, 22 bp, Homo sapiens
caggctgctgacaggcttggag

SEQ ID NO: 7874669 - DNA, 22 bp, Homo sapiens
caggctgcggtcggctctggtc

SEQ ID NO: 7874670 - DNA, 22 bp, Homo sapiens
caggctgcggtcggctctggtc

SEQ ID NO: 7874671 - DNA, 22 bp, Homo sapiens
caggctgcggtcggctctggtc

SEQ ID NO: 7874672 - DNA, 22 bp, Homo sapiens
caggctgcggtcggctctggtc

SEQ ID NO: 7874673 - DNA, 22 bp, Homo sapiens
caggctgcggtcggctctggtc

SEQ ID NO: 7874674 - DNA, 22 bp, Homo sapiens
caggctgcggtcggctctggtc

SEQ ID NO: 7874675 - DNA, 22 bp, Homo sapiens
caggctgagctctggcctgggc

SEQ ID NO: 7874676 - DNA, 22 bp, Homo sapiens
caggctgagctctggcctgggc

SEQ ID NO: 7874677 - DNA, 22 bp, Homo sapiens
caggctgcggccgtgtgagcat

SEQ ID NO: 7874678 - DNA, 22 bp, Homo sapiens
caggctgcggccgtgtgagcat

SEQ ID NO: 7874679 - DNA, 22 bp, Homo sapiens
caggctgcggccgtgtgagcat

SEQ ID NO: 7874680 - DNA, 22 bp, Homo sapiens
caggctgcggtcggctctggtc

SEQ ID NO: 7874681 - DNA, 22 bp, Homo sapiens
caggctgcggtcggctctggtc

SEQ ID NO: 7874682 - DNA, 22 bp, Homo sapiens
caggctgcggtcggctctggtc

SEQ ID NO: 7874683 - DNA, 22 bp, Homo sapiens
caggctgcggccgtgtgagcat

SEQ ID NO: 7874684 - DNA, 22 bp, Homo sapiens
caggctgcggccgtgtgagcat

SEQ ID NO: 7874685 - DNA, 22 bp, Homo sapiens
caggctgcggccgtgtgagcat

SEQ ID NO: 7874686 - DNA, 22 bp, Homo sapiens
caggctgcggccgtgtgagcat

SEQ ID NO: 7874687 - DNA, 22 bp, Homo sapiens
agctgtggcaaccttgtcagac

SEQ ID NO: 7874688 - DNA, 22 bp, Homo sapiens
agctgtggcaaccttgtcagac

SEQ ID NO: 7874689 - DNA, 22 bp, Homo sapiens
agctgtggcagcactttggagt

SEQ ID NO: 7874690 - DNA, 22 bp, Homo sapiens
agctgtggattgggtactttct

SEQ ID NO: 7874691 - DNA, 22 bp, Homo sapiens
agctgtggaagactgtcagggt

SEQ ID NO: 7874692 - DNA, 22 bp, Homo sapiens
agctgtggaagactgtcagggt

SEQ ID NO: 7874693 - DNA, 22 bp, Homo sapiens
agctgtggaagactgtcagggt

SEQ ID NO: 7874694 - DNA, 19 bp, Homo sapiens
agctgtggatgtgggattt

SEQ ID NO: 7874695 - DNA, 19 bp, Homo sapiens
agctgtggatgtgggattt

SEQ ID NO: 7874696 - DNA, 22 bp, Homo sapiens
agctgtggagtagggggttgga

SEQ ID NO: 7874697 - DNA, 22 bp, Homo sapiens
agctgtggaagactgtcagggt

SEQ ID NO: 7874698 - DNA, 22 bp, Homo sapiens
agctgtggaagactgtcagggt

SEQ ID NO: 7874699 - DNA, 22 bp, Homo sapiens
agctgtggaaatcaggcaatga

SEQ ID NO: 7874700 - DNA, 22 bp, Homo sapiens
agctgtgctgtggtcatctggg

SEQ ID NO: 7874701 - DNA, 22 bp, Homo sapiens
agctgtgctgccaagttgctga

SEQ ID NO: 7874702 - DNA, 22 bp, Homo sapiens
agctgtgcacactgtgaagtag

SEQ ID NO: 7874703 - DNA, 22 bp, Homo sapiens
agctgtgattatccactggaat

SEQ ID NO: 7874704 - DNA, 22 bp, Homo sapiens
agctgtgcctattcgtggcaag

SEQ ID NO: 7874705 - DNA, 22 bp, Homo sapiens
agctgtgcctattcgtggcaag

SEQ ID NO: 7874706 - DNA, 19 bp, Homo sapiens
agctgtgcagacacttcgc

SEQ ID NO: 7874707 - DNA, 22 bp, Homo sapiens
agctgtgctgccaagttgctga

SEQ ID NO: 7874708 - DNA, 22 bp, Homo sapiens
agctgtgcacactgtgaagtag

SEQ ID NO: 7874709 - DNA, 22 bp, Homo sapiens
agctgtgctgccaagttgctga

SEQ ID NO: 7874710 - DNA, 22 bp, Homo sapiens
agctgtgccttgctgcacggtg

SEQ ID NO: 7874711 - DNA, 22 bp, Homo sapiens
agctgtgccttgctgcacggtg

SEQ ID NO: 7874712 - DNA, 22 bp, Homo sapiens
agctgtgccttgctgcacggtg

SEQ ID NO: 7874713 - DNA, 22 bp, Homo sapiens
catataaatacaacatgtgtta

SEQ ID NO: 7874714 - DNA, 22 bp, Homo sapiens
catataaatacaacatgtgtta

SEQ ID NO: 7874715 - DNA, 22 bp, Homo sapiens
catataaatacaacatgtgtta

SEQ ID NO: 7874716 - DNA, 22 bp, Homo sapiens
catataaatacaacatgtgtta

SEQ ID NO: 7874717 - DNA, 22 bp, Homo sapiens
catataaatacaacatgtgtta

SEQ ID NO: 7874718 - DNA, 22 bp, Homo sapiens
catagttataaggcaacactgt

SEQ ID NO: 7874719 - DNA, 22 bp, Homo sapiens
catagttagtggttcagagcaa

SEQ ID NO: 7874720 - DNA, 22 bp, Homo sapiens
catagttagtggttcagagcaa

SEQ ID NO: 7874721 - DNA, 22 bp, Homo sapiens
catagtgtctggtaacatagta

SEQ ID NO: 7874722 - DNA, 22 bp, Homo sapiens
catagtgtctggtaacatagta

SEQ ID NO: 7874723 - DNA, 22 bp, Homo sapiens
catagttttaggtagaaactgg

SEQ ID NO: 7874724 - DNA, 22 bp, Homo sapiens
catagttttaggtagaaactgg

SEQ ID NO: 7874725 - DNA, 22 bp, Homo sapiens
catagttttaggtagaaactgg

SEQ ID NO: 7874726 - DNA, 22 bp, Homo sapiens
catagttttaggtagaaactgg

SEQ ID NO: 7874727 - DNA, 22 bp, Homo sapiens
catataaatacaacatgtgtta

SEQ ID NO: 7874728 - DNA, 22 bp, Homo sapiens
catagcggtattccacgtggtt

SEQ ID NO: 7874729 - DNA, 22 bp, Homo sapiens
catagcttaggggttaaactca

SEQ ID NO: 7874730 - DNA, 22 bp, Homo sapiens
catagctgtgtgccatgtaaaa

SEQ ID NO: 7874731 - DNA, 22 bp, Homo sapiens
catagctgtgtgccatgtaaaa

SEQ ID NO: 7874732 - DNA, 22 bp, Homo sapiens
cataggaagccatctcagtcac

SEQ ID NO: 7874733 - DNA, 22 bp, Homo sapiens
cataggtcactgtacaggttaa

SEQ ID NO: 7874734 - DNA, 22 bp, Homo sapiens
cataggtcactgtacaggttaa

SEQ ID NO: 7874735 - DNA, 22 bp, Homo sapiens
catagtaaataatgcagatgat

SEQ ID NO: 7874736 - DNA, 22 bp, Homo sapiens
cataggtcactaaatcagcaaa

SEQ ID NO: 7874737 - DNA, 22 bp, Homo sapiens
catagtaagtgcataataaatg

SEQ ID NO: 7874738 - DNA, 22 bp, Homo sapiens
catagtaagtgcataataaatg

SEQ ID NO: 7874739 - DNA, 22 bp, Homo sapiens
catagtaagtgcataataaatg

SEQ ID NO: 7874740 - DNA, 22 bp, Homo sapiens
cagttttatcatctgtgaaatg

SEQ ID NO: 7874741 - DNA, 22 bp, Homo sapiens
cagttttatacactgcagctcc

SEQ ID NO: 7874742 - DNA, 22 bp, Homo sapiens
cagttttatcatctgtgaaatg

SEQ ID NO: 7874743 - DNA, 22 bp, Homo sapiens
cagttttatgaatgcttattag

SEQ ID NO: 7874744 - DNA, 22 bp, Homo sapiens
cagttttatgtcgaatgtatac

SEQ ID NO: 7874745 - DNA, 22 bp, Homo sapiens
cagttttatgtcgaatgtatac

SEQ ID NO: 7874746 - DNA, 22 bp, Homo sapiens
catacattacctaacttaatgc

SEQ ID NO: 7874747 - DNA, 22 bp, Homo sapiens
catacatatgtggatgtcatat

SEQ ID NO: 7874748 - DNA, 22 bp, Homo sapiens
catacattacctaacttaatgc

SEQ ID NO: 7874749 - DNA, 22 bp, Homo sapiens
catacattacctaacttaatgc

SEQ ID NO: 7874750 - DNA, 22 bp, Homo sapiens
catagacattcagcactcacta

SEQ ID NO: 7874751 - DNA, 22 bp, Homo sapiens
catagacattgataggttatat

SEQ ID NO: 7874752 - DNA, 22 bp, Homo sapiens
catagagtgatgtaaggtatgt

SEQ ID NO: 7874753 - DNA, 22 bp, Homo sapiens
catagagtgatgtaaggtatgt

SEQ ID NO: 7874754 - DNA, 22 bp, Homo sapiens
catagaggctaaaattatttgg

SEQ ID NO: 7874755 - DNA, 22 bp, Homo sapiens
catagattcttatttccatctt

SEQ ID NO: 7874756 - DNA, 22 bp, Homo sapiens
catagattcttatttccatctt

SEQ ID NO: 7874757 - DNA, 22 bp, Homo sapiens
catagattttaggttagatcga

SEQ ID NO: 7874758 - DNA, 22 bp, Homo sapiens
catagcaacagcatcaagtcaa

SEQ ID NO: 7874759 - DNA, 18 bp, Homo sapiens
catagcacttcagcacat

SEQ ID NO: 7874760 - DNA, 22 bp, Homo sapiens
catatttagtgtttggagatcg

SEQ ID NO: 7874761 - DNA, 22 bp, Homo sapiens
catatttagtgtttggagatcg

SEQ ID NO: 7874762 - DNA, 19 bp, Homo sapiens
catattgtgcttgcatttt

SEQ ID NO: 7874763 - DNA, 19 bp, Homo sapiens
catattgtgcttgcatttt

SEQ ID NO: 7874764 - DNA, 22 bp, Homo sapiens
catatttagtgtttggagatcg

SEQ ID NO: 7874765 - DNA, 22 bp, Homo sapiens
catattgtgtgatgagtataat

SEQ ID NO: 7874766 - DNA, 22 bp, Homo sapiens
catattgtaaaaggttgaatcc

SEQ ID NO: 7874767 - DNA, 22 bp, Homo sapiens
catattgtctattgctgttttt

SEQ ID NO: 7874768 - DNA, 22 bp, Homo sapiens
catatttatagatctggcattt

SEQ ID NO: 7874769 - DNA, 22 bp, Homo sapiens
catatttatagatctggcattt

SEQ ID NO: 7874770 - DNA, 22 bp, Homo sapiens
catatttatagatctggcattt

SEQ ID NO: 7874771 - DNA, 22 bp, Homo sapiens
catatttatagatctggcattt

SEQ ID NO: 7874772 - DNA, 22 bp, Homo sapiens
catattcaaggggtaaggcaaa

SEQ ID NO: 7874773 - DNA, 22 bp, Homo sapiens
catattcaaggggtaaggcaaa

SEQ ID NO: 7874774 - DNA, 22 bp, Homo sapiens
catattcaaggggtaaggcaaa

SEQ ID NO: 7874775 - DNA, 22 bp, Homo sapiens
catattgtaaaaggttgaatcc

SEQ ID NO: 7874776 - DNA, 22 bp, Homo sapiens
catattgtaaaaggttgaatcc

SEQ ID NO: 7874777 - DNA, 22 bp, Homo sapiens
catattaaggtctgtaaggggt

SEQ ID NO: 7874778 - DNA, 22 bp, Homo sapiens
catataaatacaacatgtgtta

SEQ ID NO: 7874779 - DNA, 22 bp, Homo sapiens
aggagggagcttaagccaggca

SEQ ID NO: 7874780 - DNA, 22 bp, Homo sapiens
aggagggagcttaagccaggca

SEQ ID NO: 7874781 - DNA, 22 bp, Homo sapiens
aggagggagcttaagccaggca

SEQ ID NO: 7874782 - DNA, 22 bp, Homo sapiens
aggagggagcttaagccaggca

SEQ ID NO: 7874783 - DNA, 22 bp, Homo sapiens
aggagggagcttaagccaggca

SEQ ID NO: 7874784 - DNA, 22 bp, Homo sapiens
aggagggagcttaagccaggca

SEQ ID NO: 7874785 - DNA, 22 bp, Homo sapiens
aggagggagcttaagccaggca

SEQ ID NO: 7874786 - DNA, 22 bp, Homo sapiens
aggagggagcttaagccaggca

SEQ ID NO: 7874787 - DNA, 22 bp, Homo sapiens
aggagggagcttaagccaggca

SEQ ID NO: 7874788 - DNA, 22 bp, Homo sapiens
aggagggagcttaagccaggca

SEQ ID NO: 7874789 - DNA, 22 bp, Homo sapiens
aggagggagcttaagccaggca

SEQ ID NO: 7874790 - DNA, 22 bp, Homo sapiens
aggagggagcttaagccaggca

SEQ ID NO: 7874791 - DNA, 22 bp, Homo sapiens
aggagggagcactatatgggga

SEQ ID NO: 7874792 - DNA, 22 bp, Homo sapiens
aggagggagcttaagccaggca

SEQ ID NO: 7874793 - DNA, 21 bp, Homo sapiens
aggaggctgtctctttcagct

SEQ ID NO: 7874794 - DNA, 21 bp, Homo sapiens
aggaggctgtctctttcagct

SEQ ID NO: 7874795 - DNA, 22 bp, Homo sapiens
aggagggagcactatatgggga

SEQ ID NO: 7874796 - DNA, 22 bp, Homo sapiens
aggagggagcactatatgggga

SEQ ID NO: 7874797 - DNA, 22 bp, Homo sapiens
aggagggagcactatatgggga

SEQ ID NO: 7874798 - DNA, 21 bp, Homo sapiens
aggaggctgtctctttcagct

SEQ ID NO: 7874799 - DNA, 21 bp, Homo sapiens
aggaggctgtctctttcagct

SEQ ID NO: 7874800 - DNA, 22 bp, Homo sapiens
catatttggtataacttaagca

SEQ ID NO: 7874801 - DNA, 22 bp, Homo sapiens
catatttattcttctgccagtg

SEQ ID NO: 7874802 - DNA, 22 bp, Homo sapiens
catatttattcttctgccagtg

SEQ ID NO: 7874803 - DNA, 22 bp, Homo sapiens
catatttcagtctaagatgtgt

SEQ ID NO: 7874804 - DNA, 22 bp, Homo sapiens
catatttggtataacttaagca

SEQ ID NO: 7874805 - DNA, 22 bp, Homo sapiens
cagttctggaggatagaagtct

SEQ ID NO: 7874806 - DNA, 22 bp, Homo sapiens
cagttctgagctttcccagaag

SEQ ID NO: 7874807 - DNA, 22 bp, Homo sapiens
cagtttatattctagtgctgtt

SEQ ID NO: 7874808 - DNA, 22 bp, Homo sapiens
cagttctggaggctccacatct

SEQ ID NO: 7874809 - DNA, 22 bp, Homo sapiens
cagtttatgcagctggaataga

SEQ ID NO: 7874810 - DNA, 22 bp, Homo sapiens
cagtttatgcagctggaataga

SEQ ID NO: 7874811 - DNA, 22 bp, Homo sapiens
cagtggtgaagagcaggggctc

SEQ ID NO: 7874812 - DNA, 22 bp, Homo sapiens
cagtttatattctagtgctgtt

SEQ ID NO: 7874813 - DNA, 20 bp, Homo sapiens
cagtttatctttccggagct

SEQ ID NO: 7874814 - DNA, 18 bp, Homo sapiens
cagtggtgctgggatgtg

SEQ ID NO: 7874815 - DNA, 22 bp, Homo sapiens
cagtggtgaagagcaggggctc

SEQ ID NO: 7874816 - DNA, 18 bp, Homo sapiens
cagtggtgctgggatgtg

SEQ ID NO: 7874817 - DNA, 22 bp, Homo sapiens
cagtggtgaagagcaggggctc

SEQ ID NO: 7874818 - DNA, 21 bp, Homo sapiens
cagtggtctgtctccattttt

SEQ ID NO: 7874819 - DNA, 22 bp, Homo sapiens
cagtggtgaagagcaggggctc

SEQ ID NO: 7874820 - DNA, 18 bp, Homo sapiens
cagtggtgctgggatgtg

SEQ ID NO: 7874821 - DNA, 18 bp, Homo sapiens
cagtggtgctgggatgtg

SEQ ID NO: 7874822 - DNA, 18 bp, Homo sapiens
cagtggtgctgggatgtg

SEQ ID NO: 7874823 - DNA, 22 bp, Homo sapiens
cagtggttatacttactgtttc

SEQ ID NO: 7874824 - DNA, 22 bp, Homo sapiens
cagtggttatacttactgtttc

SEQ ID NO: 7874825 - DNA, 22 bp, Homo sapiens
cagttctgactttcataatgtc

SEQ ID NO: 7874826 - DNA, 22 bp, Homo sapiens
cagtggttatacttactgtttc

SEQ ID NO: 7874827 - DNA, 22 bp, Homo sapiens
cagtggttatacttactgtttc

SEQ ID NO: 7874828 - DNA, 22 bp, Homo sapiens
cagtgggtggctaagtggctga

SEQ ID NO: 7874829 - DNA, 22 bp, Homo sapiens
cagtgggtgcctctcattatat

SEQ ID NO: 7874830 - DNA, 22 bp, Homo sapiens
cagtgggtggcctcttgagtca

SEQ ID NO: 7874831 - DNA, 22 bp, Homo sapiens
cagtgggtggcctcttgagtca

SEQ ID NO: 7874832 - DNA, 22 bp, Homo sapiens
cagtgggtggctaagtggctga

SEQ ID NO: 7874833 - DNA, 23 bp, Homo sapiens
cagtggtcagaacgtgggagggt

SEQ ID NO: 7874834 - DNA, 23 bp, Homo sapiens
cagtggtcagaacgtgggagggt

SEQ ID NO: 7874835 - DNA, 23 bp, Homo sapiens
cagtggtcagaacgtgggagggt

SEQ ID NO: 7874836 - DNA, 22 bp, Homo sapiens
cagtgggtggctaagtggctga

SEQ ID NO: 7874837 - DNA, 22 bp, Homo sapiens
cagtggtatttgagagaatgga

SEQ ID NO: 7874838 - DNA, 22 bp, Homo sapiens
cagtggcgtgatctctgctcac

SEQ ID NO: 7874839 - DNA, 22 bp, Homo sapiens
cagtggcgtgatctctgctcac

SEQ ID NO: 7874840 - DNA, 22 bp, Homo sapiens
cagtggcgtgatctctgctcac

SEQ ID NO: 7874841 - DNA, 22 bp, Homo sapiens
cagtgggtgccatcgtgccctt

SEQ ID NO: 7874842 - DNA, 22 bp, Homo sapiens
cagtggctgagagtggacactg

SEQ ID NO: 7874843 - DNA, 22 bp, Homo sapiens
cagtggctcatgcctataatcc

SEQ ID NO: 7874844 - DNA, 22 bp, Homo sapiens
cagtggcgtgatctctgctcac

SEQ ID NO: 7874845 - DNA, 22 bp, Homo sapiens
cagtggcgtgatctctgctcac

SEQ ID NO: 7874846 - DNA, 22 bp, Homo sapiens
cagtggcgtgatctctgctcac

SEQ ID NO: 7874847 - DNA, 22 bp, Homo sapiens
cagtggcgtgatctctgctcac

SEQ ID NO: 7874848 - DNA, 22 bp, Homo sapiens
cagtggcgtgatctctgctcac

SEQ ID NO: 7874849 - DNA, 22 bp, Homo sapiens
cagtggcctttcctgctgctca

SEQ ID NO: 7874850 - DNA, 22 bp, Homo sapiens
cagttttagctagagcaaacca

SEQ ID NO: 7874851 - DNA, 22 bp, Homo sapiens
cagttttagctagagcaaacca

SEQ ID NO: 7874852 - DNA, 22 bp, Homo sapiens
cagttttagctagagcaaacca

SEQ ID NO: 7874853 - DNA, 22 bp, Homo sapiens
cagttttagctagagcaaacca

SEQ ID NO: 7874854 - DNA, 22 bp, Homo sapiens
cagttttagctagagcaaacca

SEQ ID NO: 7874855 - DNA, 22 bp, Homo sapiens
cagttttacccaagcttatttt

SEQ ID NO: 7874856 - DNA, 22 bp, Homo sapiens
cagttttaggacatgtggatgt

SEQ ID NO: 7874857 - DNA, 22 bp, Homo sapiens
cagttttagggcaatgtgaaga

SEQ ID NO: 7874858 - DNA, 22 bp, Homo sapiens
cagttttagggcaatgtgaaga

SEQ ID NO: 7874859 - DNA, 22 bp, Homo sapiens
cagttttagggcaatgtgaaga

SEQ ID NO: 7874860 - DNA, 22 bp, Homo sapiens
cagttttaaattttgaatgtct

SEQ ID NO: 7874861 - DNA, 22 bp, Homo sapiens
cagttttaaattgttagataat

SEQ ID NO: 7874862 - DNA, 22 bp, Homo sapiens
cagttttaaattttgaatgtct

SEQ ID NO: 7874863 - DNA, 22 bp, Homo sapiens
cagttttaaattgttagataat

SEQ ID NO: 7874864 - DNA, 22 bp, Homo sapiens
cagtttctctcaataagcatcg

SEQ ID NO: 7874865 - DNA, 22 bp, Homo sapiens
cagtttctctcatacatatttg

SEQ ID NO: 7874866 - DNA, 22 bp, Homo sapiens
cagtttctctcaataagcatcg

SEQ ID NO: 7874867 - DNA, 22 bp, Homo sapiens
cagtttctctcaataagcatcg

SEQ ID NO: 7874868 - DNA, 22 bp, Homo sapiens
cagtttccctgcttgaaaacgt

SEQ ID NO: 7874869 - DNA, 22 bp, Homo sapiens
cagtttcagaatcaaaacatca

SEQ ID NO: 7874870 - DNA, 22 bp, Homo sapiens
cagtttcagaatcaaaacatca

SEQ ID NO: 7874871 - DNA, 22 bp, Homo sapiens
cagtttatttccaagatgacaa

SEQ ID NO: 7874872 - DNA, 22 bp, Homo sapiens
cagtttatttccaagatgacaa

SEQ ID NO: 7874873 - DNA, 22 bp, Homo sapiens
cagtttattgttgcgttcacat

SEQ ID NO: 7874874 - DNA, 19 bp, Homo sapiens
cagtttatgctttggggac

SEQ ID NO: 7874875 - DNA, 19 bp, Homo sapiens
cagtttatgctttggggac

SEQ ID NO: 7874876 - DNA, 19 bp, Homo sapiens
cagtttatgctttggggac

SEQ ID NO: 7874877 - DNA, 22 bp, Homo sapiens
cagtttcctgaagagaaagaat

SEQ ID NO: 7874878 - DNA, 22 bp, Homo sapiens
cagtttctacgaaggtcaaccc

SEQ ID NO: 7874879 - DNA, 22 bp, Homo sapiens
cagtttccttgtttacctactg

SEQ ID NO: 7874880 - DNA, 22 bp, Homo sapiens
cagtttctacgacttaagcaca

SEQ ID NO: 7874881 - DNA, 22 bp, Homo sapiens
cagtttctacgaaggtcaaccc

SEQ ID NO: 7874882 - DNA, 22 bp, Homo sapiens
cagtttctacgacttaagcaca

SEQ ID NO: 7874883 - DNA, 22 bp, Homo sapiens
cagtttctacgacttaagcaca

SEQ ID NO: 7874884 - DNA, 22 bp, Homo sapiens
cagtttctacgacttaagcaca

SEQ ID NO: 7874885 - DNA, 22 bp, Homo sapiens
cagtttctcagacttcccttgt

SEQ ID NO: 7874886 - DNA, 22 bp, Homo sapiens
cagtttctcaggcctctcccag

SEQ ID NO: 7874887 - DNA, 22 bp, Homo sapiens
cagtttctccaaacgcaggctg

SEQ ID NO: 7874888 - DNA, 22 bp, Homo sapiens
cagtttctctcaataagcatcg

SEQ ID NO: 7874889 - DNA, 22 bp, Homo sapiens
cagtttctatggctgggctctg

SEQ ID NO: 7874890 - DNA, 22 bp, Homo sapiens
cagtttctcagacttcccttgt

SEQ ID NO: 7874891 - DNA, 22 bp, Homo sapiens
cagtttctacgacttaagcaca

SEQ ID NO: 7874892 - DNA, 22 bp, Homo sapiens
caggtgcaatgagacagctctg

SEQ ID NO: 7874893 - DNA, 22 bp, Homo sapiens
caggtgcacattactgtgttgg

SEQ ID NO: 7874894 - DNA, 22 bp, Homo sapiens
caggtggcttattagggtcagt

SEQ ID NO: 7874895 - DNA, 22 bp, Homo sapiens
caggtgccatagacgggcctgg

SEQ ID NO: 7874896 - DNA, 22 bp, Homo sapiens
caggtggcttctccctaggcca

SEQ ID NO: 7874897 - DNA, 22 bp, Homo sapiens
caggtggcttctccctaggcca

SEQ ID NO: 7874898 - DNA, 22 bp, Homo sapiens
caggtggcttctccctaggcca

SEQ ID NO: 7874899 - DNA, 22 bp, Homo sapiens
caggtggcttctccctaggcca

SEQ ID NO: 7874900 - DNA, 22 bp, Homo sapiens
caggtggcttctccctaggcca

SEQ ID NO: 7874901 - DNA, 22 bp, Homo sapiens
caggtggcttctccctaggcca

SEQ ID NO: 7874902 - DNA, 22 bp, Homo sapiens
caggtggcttctctgcagcctt

SEQ ID NO: 7874903 - DNA, 22 bp, Homo sapiens
caggtggcttctctgcagcctt

SEQ ID NO: 7874904 - DNA, 22 bp, Homo sapiens
caggtggcttctctgcagcctt

SEQ ID NO: 7874905 - DNA, 22 bp, Homo sapiens
caggtggcttctccctaggcca

SEQ ID NO: 7874906 - DNA, 22 bp, Homo sapiens
caggtggcttctctgcagcctt

SEQ ID NO: 7874907 - DNA, 22 bp, Homo sapiens
caggtggcttctctgcagcctt

SEQ ID NO: 7874908 - DNA, 22 bp, Homo sapiens
caggtgggaccatgatagggca

SEQ ID NO: 7874909 - DNA, 22 bp, Homo sapiens
caggtgggaccatgatagggca

SEQ ID NO: 7874910 - DNA, 22 bp, Homo sapiens
caggtgggaccatgatagggca

SEQ ID NO: 7874911 - DNA, 22 bp, Homo sapiens
caggtgggagccacagcgtaca

SEQ ID NO: 7874912 - DNA, 22 bp, Homo sapiens
caggtgggagcgaggagctact

SEQ ID NO: 7874913 - DNA, 22 bp, Homo sapiens
caggtgggagcgaggagctact

SEQ ID NO: 7874914 - DNA, 22 bp, Homo sapiens
caggtgggagcgaggagctact

SEQ ID NO: 7874915 - DNA, 22 bp, Homo sapiens
caggtgggagcgaggagctact

SEQ ID NO: 7874916 - DNA, 22 bp, Homo sapiens
caggtgggagcgaggagctact

SEQ ID NO: 7874917 - DNA, 22 bp, Homo sapiens
caggtgggagcgaggagctact

SEQ ID NO: 7874918 - DNA, 22 bp, Homo sapiens
caggtgggagcgaggagctact

SEQ ID NO: 7874919 - DNA, 22 bp, Homo sapiens
caggtgggagcgaggagctact

SEQ ID NO: 7874920 - DNA, 22 bp, Homo sapiens
caggtgggagcgaggagctact

SEQ ID NO: 7874921 - DNA, 22 bp, Homo sapiens
caggtgggagcgaggagctact

SEQ ID NO: 7874922 - DNA, 22 bp, Homo sapiens
caggtgggagcggagactgatt

SEQ ID NO: 7874923 - DNA, 22 bp, Homo sapiens
caggtgggagcggagactgatt

SEQ ID NO: 7874924 - DNA, 22 bp, Homo sapiens
aggacaggattccttgccttgc

SEQ ID NO: 7874925 - DNA, 22 bp, Homo sapiens
aggacaggattgagctgaactg

SEQ ID NO: 7874926 - DNA, 22 bp, Homo sapiens
aggacaggattgagctgaactg

SEQ ID NO: 7874927 - DNA, 22 bp, Homo sapiens
aggacatgtaaatggagaggga

SEQ ID NO: 7874928 - DNA, 22 bp, Homo sapiens
aggacatgtaaatggagaggga

SEQ ID NO: 7874929 - DNA, 22 bp, Homo sapiens
aggacatgtaaatggagaggga

SEQ ID NO: 7874930 - DNA, 22 bp, Homo sapiens
aggacatgtgcctccagggcag

SEQ ID NO: 7874931 - DNA, 22 bp, Homo sapiens
aggacatgtgcctccagggcag

SEQ ID NO: 7874932 - DNA, 22 bp, Homo sapiens
aggacatgtttgtatcttcctt

SEQ ID NO: 7874933 - DNA, 22 bp, Homo sapiens
aggacgctctcgctgaacttct

SEQ ID NO: 7874934 - DNA, 22 bp, Homo sapiens
aggacgctctcgctgaacttct

SEQ ID NO: 7874935 - DNA, 22 bp, Homo sapiens
aggacgctctcgctgaacttct

SEQ ID NO: 7874936 - DNA, 22 bp, Homo sapiens
aggaccttggaataacaaattc

SEQ ID NO: 7874937 - DNA, 22 bp, Homo sapiens
aggacctttggcaaggctgctc

SEQ ID NO: 7874938 - DNA, 22 bp, Homo sapiens
aggaccttggaataacaaattc

SEQ ID NO: 7874939 - DNA, 22 bp, Homo sapiens
aggacctgactggctcctgctt

SEQ ID NO: 7874940 - DNA, 22 bp, Homo sapiens
aggacctgtacctcagcatcta

SEQ ID NO: 7874941 - DNA, 22 bp, Homo sapiens
aggacctgtacctcagcatcta

SEQ ID NO: 7874942 - DNA, 22 bp, Homo sapiens
aggacctggatcacagagatct

SEQ ID NO: 7874943 - DNA, 22 bp, Homo sapiens
aggacccagaggcagaggacgt

SEQ ID NO: 7874944 - DNA, 22 bp, Homo sapiens
aggacccagaggcagaggacgt

SEQ ID NO: 7874945 - DNA, 22 bp, Homo sapiens
aggaccctgagcgggcatgccg

SEQ ID NO: 7874946 - DNA, 22 bp, Homo sapiens
aggacccaagcacagttcctgg

SEQ ID NO: 7874947 - DNA, 22 bp, Homo sapiens
aggacctgaaattcttgctttt

SEQ ID NO: 7874948 - DNA, 22 bp, Homo sapiens
aggacctactgatatcttagca

SEQ ID NO: 7874949 - DNA, 22 bp, Homo sapiens
aggacctactgatatcttagca

SEQ ID NO: 7874950 - DNA, 22 bp, Homo sapiens
aggaccctgctcaagcatctcc

SEQ ID NO: 7874951 - DNA, 22 bp, Homo sapiens
aggaccctgagcgggcatgccg

SEQ ID NO: 7874952 - DNA, 22 bp, Homo sapiens
aggaccctgaggtctcctgtga

SEQ ID NO: 7874953 - DNA, 22 bp, Homo sapiens
aggaccaccggtccatccaccc

SEQ ID NO: 7874954 - DNA, 22 bp, Homo sapiens
aggaccagaccgaactagctaa

SEQ ID NO: 7874955 - DNA, 22 bp, Homo sapiens
aggaccaagagcagaggcatca

SEQ ID NO: 7874956 - DNA, 22 bp, Homo sapiens
aggaccaacatagcagcagtgg

SEQ ID NO: 7874957 - DNA, 22 bp, Homo sapiens
aggaccagaggccagagtcagc

SEQ ID NO: 7874958 - DNA, 22 bp, Homo sapiens
aggaccagaggccagagtcagc

SEQ ID NO: 7874959 - DNA, 22 bp, Homo sapiens
aggaccagaggccagagtcagc

SEQ ID NO: 7874960 - DNA, 22 bp, Homo sapiens
aggaccagaccgaactagctaa

SEQ ID NO: 7874961 - DNA, 22 bp, Homo sapiens
aggaccagcctccaggtctctt

SEQ ID NO: 7874962 - DNA, 22 bp, Homo sapiens
aggaccagcctccaggtctctt

SEQ ID NO: 7874963 - DNA, 22 bp, Homo sapiens
aggaccagcctccaggtctctt

SEQ ID NO: 7874964 - DNA, 22 bp, Homo sapiens
aggaccagcctccaggtctctt

SEQ ID NO: 7874965 - DNA, 22 bp, Homo sapiens
aggaccagcctccaggtctctt

SEQ ID NO: 7874966 - DNA, 22 bp, Homo sapiens
aggaccaggtctaatgaagaca

SEQ ID NO: 7874967 - DNA, 22 bp, Homo sapiens
aggaccagcctccaggtctctt

SEQ ID NO: 7874968 - DNA, 22 bp, Homo sapiens
aggaccagaggccagagtcagc

SEQ ID NO: 7874969 - DNA, 22 bp, Homo sapiens
aggaccagaggccagagtcagc

SEQ ID NO: 7874970 - DNA, 22 bp, Homo sapiens
aggaccagaggccagagtcagc

SEQ ID NO: 7874971 - DNA, 22 bp, Homo sapiens
aggacccaagcacagttcctgg

SEQ ID NO: 7874972 - DNA, 22 bp, Homo sapiens
aggaccagtgagtctggcaagt

SEQ ID NO: 7874973 - DNA, 22 bp, Homo sapiens
aggaccagtgagtctggcaagt

SEQ ID NO: 7874974 - DNA, 22 bp, Homo sapiens
aggaccagtgagtctggcaagt

SEQ ID NO: 7874975 - DNA, 22 bp, Homo sapiens
aggaccagtgagtctggcaagt

SEQ ID NO: 7874976 - DNA, 22 bp, Homo sapiens
aggaccagtgagtctggcaagt

SEQ ID NO: 7874977 - DNA, 22 bp, Homo sapiens
aggaccagtgagtctggcaagt

SEQ ID NO: 7874978 - DNA, 22 bp, Homo sapiens
aggaccagtgagtctggcaagt

SEQ ID NO: 7874979 - DNA, 22 bp, Homo sapiens
aggaccagtatgagagcatctg

SEQ ID NO: 7874980 - DNA, 22 bp, Homo sapiens
aggaccagtatgagagcatctg

SEQ ID NO: 7874981 - DNA, 23 bp, Homo sapiens
aggaccaggttcccaaaagtcaa

SEQ ID NO: 7874982 - DNA, 23 bp, Homo sapiens
aggaccaggttcccaaaagtcaa

SEQ ID NO: 7874983 - DNA, 22 bp, Homo sapiens
aggaccaggtctaatgaagaca

SEQ ID NO: 7874984 - DNA, 22 bp, Homo sapiens
aggaccaggtctaatgaagaca

SEQ ID NO: 7874985 - DNA, 22 bp, Homo sapiens
aggaccagtatgagagcatctg

SEQ ID NO: 7874986 - DNA, 22 bp, Homo sapiens
cagtgctcctgatgtacccttg

SEQ ID NO: 7874987 - DNA, 22 bp, Homo sapiens
aggagaaggaagtgcatcacta

SEQ ID NO: 7874988 - DNA, 22 bp, Homo sapiens
cagtgctcatagctgttcctcc

SEQ ID NO: 7874989 - DNA, 21 bp, Homo sapiens
cagtgctcaggaatagagaga

SEQ ID NO: 7874990 - DNA, 21 bp, Homo sapiens
cagtgctcaggaatagagaga

SEQ ID NO: 7874991 - DNA, 22 bp, Homo sapiens
cagtgctagggcagagcactcc

SEQ ID NO: 7874992 - DNA, 22 bp, Homo sapiens
cagtgctagaatgtaactctag

SEQ ID NO: 7874993 - DNA, 22 bp, Homo sapiens
cagtgctaccccggaagttggt

SEQ ID NO: 7874994 - DNA, 22 bp, Homo sapiens
cagtgctagggcagagcactcc

SEQ ID NO: 7874995 - DNA, 22 bp, Homo sapiens
cagtgctataatccagtgtcgt

SEQ ID NO: 7874996 - DNA, 22 bp, Homo sapiens
cagtgctataatccagtgtcgt

SEQ ID NO: 7874997 - DNA, 22 bp, Homo sapiens
cagtgctaggtcgtgtgctggg

SEQ ID NO: 7874998 - DNA, 22 bp, Homo sapiens
cagtgctatttggacacaggga

SEQ ID NO: 7874999 - DNA, 22 bp, Homo sapiens
cagtgctatgttggttttctgg

SEQ ID NO: 7875000 - DNA, 20 bp, Homo sapiens
cagtgcctgccccttgggtt

SEQ ID NO: 7875001 - DNA, 20 bp, Homo sapiens
cagtgcctgccccttgggtt

SEQ ID NO: 7875002 - DNA, 20 bp, Homo sapiens
cagtgcctgccccttgggtt

SEQ ID NO: 7875003 - DNA, 20 bp, Homo sapiens
cagtgcctgccccttgggtt

SEQ ID NO: 7875004 - DNA, 22 bp, Homo sapiens
cagtgcctggatagcaacatga

SEQ ID NO: 7875005 - DNA, 22 bp, Homo sapiens
cagtgcctgccttttattttgt

SEQ ID NO: 7875006 - DNA, 22 bp, Homo sapiens
cagtgcctggatagcaacatga

SEQ ID NO: 7875007 - DNA, 22 bp, Homo sapiens
cagtgcctggatagcaacatga

SEQ ID NO: 7875008 - DNA, 22 bp, Homo sapiens
cagtgcctcttaagtgtcaccc

SEQ ID NO: 7875009 - DNA, 22 bp, Homo sapiens
cagtgcctcttaagtgtcaccc

SEQ ID NO: 7875010 - DNA, 22 bp, Homo sapiens
cagtgcctcttaagtgtcaccc

SEQ ID NO: 7875011 - DNA, 20 bp, Homo sapiens
cagtgcctgccccttgggtt

SEQ ID NO: 7875012 - DNA, 22 bp, Homo sapiens
cagtgcctggccggcttccatt

SEQ ID NO: 7875013 - DNA, 22 bp, Homo sapiens
cagtgcctggccggcttccatt

SEQ ID NO: 7875014 - DNA, 22 bp, Homo sapiens
cagtgcctggcatagaggcggc

SEQ ID NO: 7875015 - DNA, 22 bp, Homo sapiens
cagtgcctgtcttattcttaca

SEQ ID NO: 7875016 - DNA, 22 bp, Homo sapiens
cagtgcctgggacccggctgtg

SEQ ID NO: 7875017 - DNA, 22 bp, Homo sapiens
cagtgctaccccggaagttggt

SEQ ID NO: 7875018 - DNA, 22 bp, Homo sapiens
cagtgcctggcatagaggcggc

SEQ ID NO: 7875019 - DNA, 22 bp, Homo sapiens
cagtgcctgggacccggctgtg

SEQ ID NO: 7875020 - DNA, 22 bp, Homo sapiens
cagtgcccttccaggactgcag

SEQ ID NO: 7875021 - DNA, 22 bp, Homo sapiens
cagtgcccttccaggactgcag

SEQ ID NO: 7875022 - DNA, 22 bp, Homo sapiens
cagtgcccttccaggactgcag

SEQ ID NO: 7875023 - DNA, 22 bp, Homo sapiens
cagtgccgagctgggggctcct

SEQ ID NO: 7875024 - DNA, 22 bp, Homo sapiens
cagtgcctcaggccagcctgca

SEQ ID NO: 7875025 - DNA, 22 bp, Homo sapiens
cagtgcctcaggccagcctgca

SEQ ID NO: 7875026 - DNA, 22 bp, Homo sapiens
cagtgcctcaggccagcctgca

SEQ ID NO: 7875027 - DNA, 20 bp, Homo sapiens
cagtgcctatcattaattcc

SEQ ID NO: 7875028 - DNA, 22 bp, Homo sapiens
cagtgcctcttaagtgtcaccc

SEQ ID NO: 7875029 - DNA, 22 bp, Homo sapiens
cagtgcctcaggccagcctgca

SEQ ID NO: 7875030 - DNA, 22 bp, Homo sapiens
cagtgcctcaggccagcctgca

SEQ ID NO: 7875031 - DNA, 21 bp, Homo sapiens
cagtgcaggggttagcgtgta

SEQ ID NO: 7875032 - DNA, 19 bp, Homo sapiens
cagtgcccgacgcaggtct

SEQ ID NO: 7875033 - DNA, 19 bp, Homo sapiens
cagtgcccgacgcaggtct

SEQ ID NO: 7875034 - DNA, 22 bp, Homo sapiens
cagtgcccgccgccgttcctgg

SEQ ID NO: 7875035 - DNA, 20 bp, Homo sapiens
cagtgcccgtggaaaagatg

SEQ ID NO: 7875036 - DNA, 22 bp, Homo sapiens
cagtgccctcatctatgaaatc

SEQ ID NO: 7875037 - DNA, 22 bp, Homo sapiens
cagtgcccttccaggactgcag

SEQ ID NO: 7875038 - DNA, 22 bp, Homo sapiens
cagtgcccttccaggactgcag

SEQ ID NO: 7875039 - DNA, 22 bp, Homo sapiens
aggactcacatagcttcagatg

SEQ ID NO: 7875040 - DNA, 22 bp, Homo sapiens
aggactaatttcaggggatata

SEQ ID NO: 7875041 - DNA, 22 bp, Homo sapiens
aggacggggacgcaagtcagca

SEQ ID NO: 7875042 - DNA, 22 bp, Homo sapiens
aggacggggacgcaagtcagca

SEQ ID NO: 7875043 - DNA, 22 bp, Homo sapiens
aggactgaaaatgagttcttct

SEQ ID NO: 7875044 - DNA, 18 bp, Homo sapiens
aggactctgctaccgtat

SEQ ID NO: 7875045 - DNA, 22 bp, Homo sapiens
aggactgacttttgccatgaaa

SEQ ID NO: 7875046 - DNA, 21 bp, Homo sapiens
cagtgcaggggttagcgtgta

SEQ ID NO: 7875047 - DNA, 21 bp, Homo sapiens
cagtgcaggggttagcgtgta

SEQ ID NO: 7875048 - DNA, 22 bp, Homo sapiens
cagtgcaggtggcagaggacag

SEQ ID NO: 7875049 - DNA, 22 bp, Homo sapiens
cagtggcatggttgactgcagt

SEQ ID NO: 7875050 - DNA, 22 bp, Homo sapiens
cagtggccatggtggcaggggt

SEQ ID NO: 7875051 - DNA, 22 bp, Homo sapiens
cagtggccaacttcctgcctct

SEQ ID NO: 7875052 - DNA, 22 bp, Homo sapiens
cagtggcatggttgactgcagt

SEQ ID NO: 7875053 - DNA, 22 bp, Homo sapiens
cagtggcatggttgactgcagt

SEQ ID NO: 7875054 - DNA, 22 bp, Homo sapiens
cagtggcatggttgactgcagt

SEQ ID NO: 7875055 - DNA, 22 bp, Homo sapiens
cagtggcatggttgactgcagt

SEQ ID NO: 7875056 - DNA, 22 bp, Homo sapiens
cagtggcatacttggctgatat

SEQ ID NO: 7875057 - DNA, 22 bp, Homo sapiens
cagtggagaggcatgcttggca

SEQ ID NO: 7875058 - DNA, 22 bp, Homo sapiens
cagtggagaggcatgcttggca

SEQ ID NO: 7875059 - DNA, 22 bp, Homo sapiens
cagtggagaggcatgcttggca

SEQ ID NO: 7875060 - DNA, 22 bp, Homo sapiens
cagtggagaggcatgcttggca

SEQ ID NO: 7875061 - DNA, 18 bp, Homo sapiens
cagtggcatagttgagta

SEQ ID NO: 7875062 - DNA, 22 bp, Homo sapiens
cagtggcatacttggctgatat

SEQ ID NO: 7875063 - DNA, 18 bp, Homo sapiens
cagtggcatagttgagta

SEQ ID NO: 7875064 - DNA, 18 bp, Homo sapiens
cagtggcatagttgagta

SEQ ID NO: 7875065 - DNA, 18 bp, Homo sapiens
cagtggcatagttgagta

SEQ ID NO: 7875066 - DNA, 18 bp, Homo sapiens
cagtggcatagttgagta

SEQ ID NO: 7875067 - DNA, 22 bp, Homo sapiens
cagtggcctttcctgctgctca

SEQ ID NO: 7875068 - DNA, 22 bp, Homo sapiens
cagtggccttgatgcctcattc

SEQ ID NO: 7875069 - DNA, 22 bp, Homo sapiens
cagtggccatggtggcaggggt

SEQ ID NO: 7875070 - DNA, 22 bp, Homo sapiens
cagtggccgcggggctgtgggt

SEQ ID NO: 7875071 - DNA, 17 bp, Homo sapiens
cagtggcctatggcttt

SEQ ID NO: 7875072 - DNA, 22 bp, Homo sapiens
cagtggcctctggctttgctgt

SEQ ID NO: 7875073 - DNA, 22 bp, Homo sapiens
cagtggcctgagccaggcttcc

SEQ ID NO: 7875074 - DNA, 22 bp, Homo sapiens
aggagaaggaggcccctcacac

SEQ ID NO: 7875075 - DNA, 22 bp, Homo sapiens
aggagaaggaggcccctcacac

SEQ ID NO: 7875076 - DNA, 22 bp, Homo sapiens
aggagaaggaagtgcatcacta

SEQ ID NO: 7875077 - DNA, 22 bp, Homo sapiens
aggagaaggaggcccctcacac

SEQ ID NO: 7875078 - DNA, 22 bp, Homo sapiens
aggagaaggaagtgcatcacta

SEQ ID NO: 7875079 - DNA, 22 bp, Homo sapiens
aggagaaggaagtgcatcacta

SEQ ID NO: 7875080 - DNA, 22 bp, Homo sapiens
aggagaagtaaggctagatgat

SEQ ID NO: 7875081 - DNA, 22 bp, Homo sapiens
aggagaagtaaggctagatgat

SEQ ID NO: 7875082 - DNA, 22 bp, Homo sapiens
aggagaagtaaggctagatgat

SEQ ID NO: 7875083 - DNA, 22 bp, Homo sapiens
aggagaaggaggcccctcacac

SEQ ID NO: 7875084 - DNA, 22 bp, Homo sapiens
aggagaaggaggcccctcacac

SEQ ID NO: 7875085 - DNA, 22 bp, Homo sapiens
aggagaagtaaggctagatgat

SEQ ID NO: 7875086 - DNA, 22 bp, Homo sapiens
aggagaagtaaggctagatgat

SEQ ID NO: 7875087 - DNA, 22 bp, Homo sapiens
aggagaagtaaggctagatgat

SEQ ID NO: 7875088 - DNA, 22 bp, Homo sapiens
aggagaagtaaggctagatgat

SEQ ID NO: 7875089 - DNA, 22 bp, Homo sapiens
aggagaagtaaggctagatgat

SEQ ID NO: 7875090 - DNA, 19 bp, Homo sapiens
aggagaagtagcagaaatt

SEQ ID NO: 7875091 - DNA, 19 bp, Homo sapiens
aggagaagtagcagaaatt

SEQ ID NO: 7875092 - DNA, 19 bp, Homo sapiens
aggagaagtagcagaaatt

SEQ ID NO: 7875093 - DNA, 19 bp, Homo sapiens
aggagaagtagcagaaatt

SEQ ID NO: 7875094 - DNA, 19 bp, Homo sapiens
aggagaagtagcagaaatt

SEQ ID NO: 7875095 - DNA, 22 bp, Homo sapiens
cagtggagagacttttactctt

SEQ ID NO: 7875096 - DNA, 22 bp, Homo sapiens
cagtggagagacttttactctt

SEQ ID NO: 7875097 - DNA, 19 bp, Homo sapiens
aggagaagtagcagaaatt

SEQ ID NO: 7875098 - DNA, 19 bp, Homo sapiens
aggagaagtagcagaaatt

SEQ ID NO: 7875099 - DNA, 19 bp, Homo sapiens
aggagaagtagcagaaatt

SEQ ID NO: 7875100 - DNA, 22 bp, Homo sapiens
cattaaatatcaacctagacta

SEQ ID NO: 7875101 - DNA, 22 bp, Homo sapiens
cattaaacaaccttgaatcaat

SEQ ID NO: 7875102 - DNA, 22 bp, Homo sapiens
cattaaatatcaacctagacta

SEQ ID NO: 7875103 - DNA, 22 bp, Homo sapiens
cattaaatcttccagacctcac

SEQ ID NO: 7875104 - DNA, 22 bp, Homo sapiens
cattaaatatcaacctagacta

SEQ ID NO: 7875105 - DNA, 22 bp, Homo sapiens
cattaaattccttgttctcaaa

SEQ ID NO: 7875106 - DNA, 22 bp, Homo sapiens
cattaaattccttgttctcaaa

SEQ ID NO: 7875107 - DNA, 22 bp, Homo sapiens
cattaaattccttgttctcaaa

SEQ ID NO: 7875108 - DNA, 22 bp, Homo sapiens
cattaaatcttccagacctcac

SEQ ID NO: 7875109 - DNA, 22 bp, Homo sapiens
cattaaaatatctcatggtgtt

SEQ ID NO: 7875110 - DNA, 22 bp, Homo sapiens
cattaacaaatggaagcatgaa

SEQ ID NO: 7875111 - DNA, 22 bp, Homo sapiens
cattaaattccttgttctcaaa

SEQ ID NO: 7875112 - DNA, 22 bp, Homo sapiens
cattaaaatatctcatggtgtt

SEQ ID NO: 7875113 - DNA, 22 bp, Homo sapiens
cattaaaatatctcatggtgtt

SEQ ID NO: 7875114 - DNA, 22 bp, Homo sapiens
cattaaaatatctcatggtgtt

SEQ ID NO: 7875115 - DNA, 22 bp, Homo sapiens
cattaaaatatctcatggtgtt

SEQ ID NO: 7875116 - DNA, 22 bp, Homo sapiens
cattaaaatatctcatggtgtt

SEQ ID NO: 7875117 - DNA, 22 bp, Homo sapiens
catgttttgtgtacagaatatt

SEQ ID NO: 7875118 - DNA, 22 bp, Homo sapiens
catgttttgtgtacagaatatt

SEQ ID NO: 7875119 - DNA, 22 bp, Homo sapiens
aggcactgtgggtgtggccgga

SEQ ID NO: 7875120 - DNA, 15 bp, Homo sapiens
aggcactgtgggacc

SEQ ID NO: 7875121 - DNA, 22 bp, Homo sapiens
cattaaaatatctcatggtgtt

SEQ ID NO: 7875122 - DNA, 23 bp, Homo sapiens
catgtttttctatctcagcgtgt

SEQ ID NO: 7875123 - DNA, 23 bp, Homo sapiens
catgtttttctatctcagcgtgt

SEQ ID NO: 7875124 - DNA, 22 bp, Homo sapiens
aggcactgtggaagacatggtt

SEQ ID NO: 7875125 - DNA, 22 bp, Homo sapiens
aggcactgtggaagacatggtt

SEQ ID NO: 7875126 - DNA, 22 bp, Homo sapiens
aggcactgtggaagacatggtt

SEQ ID NO: 7875127 - DNA, 22 bp, Homo sapiens
aggcactgtggaagacatggtt

SEQ ID NO: 7875128 - DNA, 22 bp, Homo sapiens
aggcactgtggaagacatggtt

SEQ ID NO: 7875129 - DNA, 22 bp, Homo sapiens
aggcactgtggaagacatggtt

SEQ ID NO: 7875130 - DNA, 15 bp, Homo sapiens
aggcactgtgggacc

SEQ ID NO: 7875131 - DNA, 22 bp, Homo sapiens
aggcactgtggaagacatggtt

SEQ ID NO: 7875132 - DNA, 22 bp, Homo sapiens
aggcactgtggaagacatggtt

SEQ ID NO: 7875133 - DNA, 22 bp, Homo sapiens
aggcactgtggaagacatggtt

SEQ ID NO: 7875134 - DNA, 22 bp, Homo sapiens
aggcactgtgcttcttatatgt

SEQ ID NO: 7875135 - DNA, 22 bp, Homo sapiens
aggcactgtgcttcttatatgt

SEQ ID NO: 7875136 - DNA, 22 bp, Homo sapiens
aggcactgtgcttcttatatgt

SEQ ID NO: 7875137 - DNA, 22 bp, Homo sapiens
aggcactgtgctgatgtcttat

SEQ ID NO: 7875138 - DNA, 22 bp, Homo sapiens
aggcactgtgctgatgtcttat

SEQ ID NO: 7875139 - DNA, 22 bp, Homo sapiens
aggcactgtactaggtacaggg

SEQ ID NO: 7875140 - DNA, 22 bp, Homo sapiens
aggcactgtactaggtacaggg

SEQ ID NO: 7875141 - DNA, 22 bp, Homo sapiens
aggcactggtctaccccttagt

SEQ ID NO: 7875142 - DNA, 22 bp, Homo sapiens
aggcactggtctaccccttagt

SEQ ID NO: 7875143 - DNA, 22 bp, Homo sapiens
aggcactgtgctgatgtcttat

SEQ ID NO: 7875144 - DNA, 22 bp, Homo sapiens
aggcactgtgcagtcccaagca

SEQ ID NO: 7875145 - DNA, 22 bp, Homo sapiens
aggcactgtgcagtcccaagca

SEQ ID NO: 7875146 - DNA, 22 bp, Homo sapiens
aggcactgtactaggtacaggg

SEQ ID NO: 7875147 - DNA, 22 bp, Homo sapiens
aggcactgtactaggtacaggg

SEQ ID NO: 7875148 - DNA, 22 bp, Homo sapiens
aggcactgtgcagtcccaagca

SEQ ID NO: 7875149 - DNA, 18 bp, Homo sapiens
catttgttattgtgtgtg

SEQ ID NO: 7875150 - DNA, 20 bp, Homo sapiens
catttgttagctttctactg

SEQ ID NO: 7875151 - DNA, 22 bp, Homo sapiens
catttgttcaaccattctcgct

SEQ ID NO: 7875152 - DNA, 22 bp, Homo sapiens
catttgttctgatttcaaaagg

SEQ ID NO: 7875153 - DNA, 22 bp, Homo sapiens
catttgttctgatttcaaaagg

SEQ ID NO: 7875154 - DNA, 22 bp, Homo sapiens
catttgttctgatttcaaaagg

SEQ ID NO: 7875155 - DNA, 22 bp, Homo sapiens
catttgttctgatttcaaaagg

SEQ ID NO: 7875156 - DNA, 22 bp, Homo sapiens
catttgttaagaaggaaaaagg

SEQ ID NO: 7875157 - DNA, 22 bp, Homo sapiens
catttgttaatgctgcttttaa

SEQ ID NO: 7875158 - DNA, 22 bp, Homo sapiens
catttgttaatgctgcttttaa

SEQ ID NO: 7875159 - DNA, 22 bp, Homo sapiens
catttgttaattactattatct

SEQ ID NO: 7875160 - DNA, 22 bp, Homo sapiens
catttgttaattactattatct

SEQ ID NO: 7875161 - DNA, 22 bp, Homo sapiens
catttgttaattactattatct

SEQ ID NO: 7875162 - DNA, 22 bp, Homo sapiens
catttgttaattactattatct

SEQ ID NO: 7875163 - DNA, 22 bp, Homo sapiens
catttgttaattactattatct

SEQ ID NO: 7875164 - DNA, 20 bp, Homo sapiens
catttgttagctttctactg

SEQ ID NO: 7875165 - DNA, 22 bp, Homo sapiens
catttgttaattactattatct

SEQ ID NO: 7875166 - DNA, 22 bp, Homo sapiens
catttgttaattactattatct

SEQ ID NO: 7875167 - DNA, 22 bp, Homo sapiens
catttgttaagaaggaaaaagg

SEQ ID NO: 7875168 - DNA, 22 bp, Homo sapiens
catttgttaatgctgcttttaa

SEQ ID NO: 7875169 - DNA, 22 bp, Homo sapiens
catttgttaatgctgcttttaa

SEQ ID NO: 7875170 - DNA, 22 bp, Homo sapiens
catttgaaattcttagaacaaa

SEQ ID NO: 7875171 - DNA, 22 bp, Homo sapiens
catttgaaattcttagaacaaa

SEQ ID NO: 7875172 - DNA, 22 bp, Homo sapiens
cattaacaatgactgcttgact

SEQ ID NO: 7875173 - DNA, 22 bp, Homo sapiens
catttgaaattcttagaacaaa

SEQ ID NO: 7875174 - DNA, 17 bp, Homo sapiens
catttgttgatcagttg

SEQ ID NO: 7875175 - DNA, 22 bp, Homo sapiens
catttgttgggacaatgaaaag

SEQ ID NO: 7875176 - DNA, 17 bp, Homo sapiens
catttgttgatcagttg

SEQ ID NO: 7875177 - DNA, 22 bp, Homo sapiens
catttgttggtcagattgtagt

SEQ ID NO: 7875178 - DNA, 22 bp, Homo sapiens
catttgttggtcagattgtagt

SEQ ID NO: 7875179 - DNA, 22 bp, Homo sapiens
catttgttgggacaatgaaaag

SEQ ID NO: 7875180 - DNA, 22 bp, Homo sapiens
catttgttggtcagattgtagt

SEQ ID NO: 7875181 - DNA, 22 bp, Homo sapiens
catttgtttagaagtctttata

SEQ ID NO: 7875182 - DNA, 22 bp, Homo sapiens
catttgtttagaagtctttata

SEQ ID NO: 7875183 - DNA, 22 bp, Homo sapiens
catttgtttagaagtctttata

SEQ ID NO: 7875184 - DNA, 22 bp, Homo sapiens
catttgttggttgctgtcttat

SEQ ID NO: 7875185 - DNA, 22 bp, Homo sapiens
catttgttggttgctgtcttat

SEQ ID NO: 7875186 - DNA, 22 bp, Homo sapiens
catttgtttagaagtctttata

SEQ ID NO: 7875187 - DNA, 21 bp, Homo sapiens
aggcagcaggatccagggaca

SEQ ID NO: 7875188 - DNA, 22 bp, Homo sapiens
cattttaaatgatttaagccaa

SEQ ID NO: 7875189 - DNA, 22 bp, Homo sapiens
catttgtttataagttccccag

SEQ ID NO: 7875190 - DNA, 21 bp, Homo sapiens
aggcagcaggatccagggaca

SEQ ID NO: 7875191 - DNA, 21 bp, Homo sapiens
aggcagcaggatccagggaca

SEQ ID NO: 7875192 - DNA, 21 bp, Homo sapiens
aggcagcaggatccagggaca

SEQ ID NO: 7875193 - DNA, 21 bp, Homo sapiens
aggcagcaggatccagggaca

SEQ ID NO: 7875194 - DNA, 21 bp, Homo sapiens
aggcagcaggatccagggaca

SEQ ID NO: 7875195 - DNA, 19 bp, Homo sapiens
aggcagcaggccagggatg

SEQ ID NO: 7875196 - DNA, 19 bp, Homo sapiens
aggcagcaggccagggatg

SEQ ID NO: 7875197 - DNA, 19 bp, Homo sapiens
aggcagcaggccagggatg

SEQ ID NO: 7875198 - DNA, 19 bp, Homo sapiens
aggcagcaggccagggatg

SEQ ID NO: 7875199 - DNA, 19 bp, Homo sapiens
aggcagcaggccagggatg

SEQ ID NO: 7875200 - DNA, 22 bp, Homo sapiens
aggcagcagggccactggctga

SEQ ID NO: 7875201 - DNA, 22 bp, Homo sapiens
aggcagcagggccactggctga

SEQ ID NO: 7875202 - DNA, 23 bp, Homo sapiens
aggcagcaggttgtccagggtga

SEQ ID NO: 7875203 - DNA, 23 bp, Homo sapiens
aggcagcaggttgtccagggtga

SEQ ID NO: 7875204 - DNA, 23 bp, Homo sapiens
aggcagcaggttgtccagggtga

SEQ ID NO: 7875205 - DNA, 23 bp, Homo sapiens
aggcagcaggttgtccagggtga

SEQ ID NO: 7875206 - DNA, 23 bp, Homo sapiens
aggcagcaggttgtccagggtga

SEQ ID NO: 7875207 - DNA, 23 bp, Homo sapiens
aggcagcaggttgtccagggtga

SEQ ID NO: 7875208 - DNA, 19 bp, Homo sapiens
aggcagcaggccagggatg

SEQ ID NO: 7875209 - DNA, 19 bp, Homo sapiens
aggcagcaggccagggatg

SEQ ID NO: 7875210 - DNA, 19 bp, Homo sapiens
aggcagcaggccagggatg

SEQ ID NO: 7875211 - DNA, 22 bp, Homo sapiens
aggcagcagggccactggctga

SEQ ID NO: 7875212 - DNA, 22 bp, Homo sapiens
aggcagcagggccactggctga

SEQ ID NO: 7875213 - DNA, 22 bp, Homo sapiens
aggcagcagggccactggctga

SEQ ID NO: 7875214 - DNA, 22 bp, Homo sapiens
aggcagcagggccactggctga

SEQ ID NO: 7875215 - DNA, 22 bp, Homo sapiens
aggcagcagggccactggctga

SEQ ID NO: 7875216 - DNA, 22 bp, Homo sapiens
ccaaaggccaggcactgaggtt

SEQ ID NO: 7875217 - DNA, 21 bp, Homo sapiens
ccaagatgaataataatgagg

SEQ ID NO: 7875218 - DNA, 22 bp, Homo sapiens
ccaagataatctgtgaaaaatc

SEQ ID NO: 7875219 - DNA, 21 bp, Homo sapiens
ccaagatgaataataatgagg

SEQ ID NO: 7875220 - DNA, 22 bp, Homo sapiens
ccaagataagagacaagattta

SEQ ID NO: 7875221 - DNA, 22 bp, Homo sapiens
ccaaaggggcttaggatgaagg

SEQ ID NO: 7875222 - DNA, 23 bp, Homo sapiens
aggcagcaggttgtccagggtga

SEQ ID NO: 7875223 - DNA, 23 bp, Homo sapiens
aggcagcaggttgtccagggtga

SEQ ID NO: 7875224 - DNA, 23 bp, Homo sapiens
aggcagcaggttgtccagggtga

SEQ ID NO: 7875225 - DNA, 23 bp, Homo sapiens
aggcagcaggttgtccagggtga

SEQ ID NO: 7875226 - DNA, 23 bp, Homo sapiens
aggcagcaggttgtccagggtga

SEQ ID NO: 7875227 - DNA, 22 bp, Homo sapiens
aggcagcagtcatgaggaaaga

SEQ ID NO: 7875228 - DNA, 22 bp, Homo sapiens
ccaagcaaggctaattcacttg

SEQ ID NO: 7875229 - DNA, 22 bp, Homo sapiens
ccaagcagaaccattcaggcac

SEQ ID NO: 7875230 - DNA, 22 bp, Homo sapiens
ccaagcaaataatcacccacta

SEQ ID NO: 7875231 - DNA, 22 bp, Homo sapiens
ccaagcaaataatcacccacta

SEQ ID NO: 7875232 - DNA, 22 bp, Homo sapiens
ccaagcaaggctaattcacttg

SEQ ID NO: 7875233 - DNA, 22 bp, Homo sapiens
ccaagatttatattgaataata

SEQ ID NO: 7875234 - DNA, 22 bp, Homo sapiens
ccaagattagaaaatttgagga

SEQ ID NO: 7875235 - DNA, 17 bp, Homo sapiens
ccaagatgatagaggga

SEQ ID NO: 7875236 - DNA, 22 bp, Homo sapiens
ccaagatgagctggctccatgg

SEQ ID NO: 7875237 - DNA, 22 bp, Homo sapiens
ccaagatgatctttacagtgtt

SEQ ID NO: 7875238 - DNA, 22 bp, Homo sapiens
ccaagcagtctgctaggagttt

SEQ ID NO: 7875239 - DNA, 22 bp, Homo sapiens
ccaagcaggatattctgtgtca

SEQ ID NO: 7875240 - DNA, 22 bp, Homo sapiens
ccaagcaggatattctgtgtca

SEQ ID NO: 7875241 - DNA, 22 bp, Homo sapiens
ccaagcaggatattctgtgtca

SEQ ID NO: 7875242 - DNA, 22 bp, Homo sapiens
ccaagcaggatattctgtgtca

SEQ ID NO: 7875243 - DNA, 16 bp, Homo sapiens
ccaagcagcagcagct

SEQ ID NO: 7875244 - DNA, 22 bp, Homo sapiens
ccaagcagagcagcctctctgg

SEQ ID NO: 7875245 - DNA, 22 bp, Homo sapiens
ccaagcagaaccattcaggcac

SEQ ID NO: 7875246 - DNA, 16 bp, Homo sapiens
ccaagcagcagcagct

SEQ ID NO: 7875247 - DNA, 22 bp, Homo sapiens
ccaagcagagcagcctctctgg

SEQ ID NO: 7875248 - DNA, 22 bp, Homo sapiens
ccaagctacttaggagtctgag

SEQ ID NO: 7875249 - DNA, 22 bp, Homo sapiens
ccaagctgagcaccatctgatc

SEQ ID NO: 7875250 - DNA, 22 bp, Homo sapiens
ccaagctggacagcagcaagga

SEQ ID NO: 7875251 - DNA, 22 bp, Homo sapiens
ccaagcagtctgctaggagttt

SEQ ID NO: 7875252 - DNA, 22 bp, Homo sapiens
ccaagcagtctgctaggagttt

SEQ ID NO: 7875253 - DNA, 22 bp, Homo sapiens
ccaagcatggggttcagtagga

SEQ ID NO: 7875254 - DNA, 22 bp, Homo sapiens
ccaagcatttctagccagtcac

SEQ ID NO: 7875255 - DNA, 22 bp, Homo sapiens
ccaagcatttctagccagtcac

SEQ ID NO: 7875256 - DNA, 22 bp, Homo sapiens
ccaagctacttaggagtctgag

SEQ ID NO: 7875257 - DNA, 22 bp, Homo sapiens
ccaagcctagtcgtgcacacag

SEQ ID NO: 7875258 - DNA, 18 bp, Homo sapiens
ccaagtatggcagaggct

SEQ ID NO: 7875259 - DNA, 22 bp, Homo sapiens
ccaaggtttattttgatacatt

SEQ ID NO: 7875260 - DNA, 22 bp, Homo sapiens
ccaagtcctctaccattcctgg

SEQ ID NO: 7875261 - DNA, 23 bp, Homo sapiens
ccaagtccctctccaagcctttg

SEQ ID NO: 7875262 - DNA, 22 bp, Homo sapiens
ccaagtgatacacccgcctcgg

SEQ ID NO: 7875263 - DNA, 22 bp, Homo sapiens
ccaagttaccagcaatataagt

SEQ ID NO: 7875264 - DNA, 22 bp, Homo sapiens
ccaagtcctgctgccactctac

SEQ ID NO: 7875265 - DNA, 22 bp, Homo sapiens
ccaagtcctgctgccactctac

SEQ ID NO: 7875266 - DNA, 22 bp, Homo sapiens
ccaagtctgtaacctctgcgta

SEQ ID NO: 7875267 - DNA, 22 bp, Homo sapiens
ccaagtcttggttctgtatctt

SEQ ID NO: 7875268 - DNA, 22 bp, Homo sapiens
ccaatcctcatgttcaacaacc

SEQ ID NO: 7875269 - DNA, 18 bp, Homo sapiens
aggcaggctggagtgact

SEQ ID NO: 7875270 - DNA, 18 bp, Homo sapiens
aggcaggctggagtgact

SEQ ID NO: 7875271 - DNA, 22 bp, Homo sapiens
ccaatcctgatctaatccaact

SEQ ID NO: 7875272 - DNA, 22 bp, Homo sapiens
aggcaggctggtctgaagagtg

SEQ ID NO: 7875273 - DNA, 18 bp, Homo sapiens
aggcaggctggagtgact

SEQ ID NO: 7875274 - DNA, 18 bp, Homo sapiens
aggcaggctggagtgact

SEQ ID NO: 7875275 - DNA, 18 bp, Homo sapiens
aggcaggctggagtgact

SEQ ID NO: 7875276 - DNA, 20 bp, Homo sapiens
ccaataaagctctataggga

SEQ ID NO: 7875277 - DNA, 20 bp, Homo sapiens
ccaataaagctctataggga

SEQ ID NO: 7875278 - DNA, 22 bp, Homo sapiens
ccaatacactttatagaagaaa

SEQ ID NO: 7875279 - DNA, 22 bp, Homo sapiens
ccaatacactttatagaagaaa

SEQ ID NO: 7875280 - DNA, 22 bp, Homo sapiens
ccaaggactggacacacaggtt

SEQ ID NO: 7875281 - DNA, 22 bp, Homo sapiens
ccaaggactggacacacaggtt

SEQ ID NO: 7875282 - DNA, 22 bp, Homo sapiens
ccaagggctatttacagaacag

SEQ ID NO: 7875283 - DNA, 22 bp, Homo sapiens
ccaaggagaatgacaccatgga

SEQ ID NO: 7875284 - DNA, 22 bp, Homo sapiens
ccaagggctctgacttgcctgc

SEQ ID NO: 7875285 - DNA, 22 bp, Homo sapiens
ccaagctggatttagctgcaca

SEQ ID NO: 7875286 - DNA, 23 bp, Homo sapiens
ccaagcttctaatgctgctgagc

SEQ ID NO: 7875287 - DNA, 23 bp, Homo sapiens
ccaagcttctaatgctgctgagc

SEQ ID NO: 7875288 - DNA, 20 bp, Homo sapiens
ccaaggacactggctcctgg

SEQ ID NO: 7875289 - DNA, 22 bp, Homo sapiens
ccaaggacccgagcctgcggga

SEQ ID NO: 7875290 - DNA, 20 bp, Homo sapiens
ccaaggacatctatgactgt

SEQ ID NO: 7875291 - DNA, 22 bp, Homo sapiens
ccaagcttctttcctactacag

SEQ ID NO: 7875292 - DNA, 22 bp, Homo sapiens
ccaagcttctttcctactacag

SEQ ID NO: 7875293 - DNA, 23 bp, Homo sapiens
ccaagcttgtccctgcctgcttt

SEQ ID NO: 7875294 - DNA, 23 bp, Homo sapiens
ccaagcttgtccctgcctgcttt

SEQ ID NO: 7875295 - DNA, 22 bp, Homo sapiens
ccaagggctctggacagagtgg

SEQ ID NO: 7875296 - DNA, 22 bp, Homo sapiens
ccaagggctctgacttgcctgc

SEQ ID NO: 7875297 - DNA, 22 bp, Homo sapiens
ccaagggctctgacttgcctgc

SEQ ID NO: 7875298 - DNA, 22 bp, Homo sapiens
ccaagggctctggacagagtgg

SEQ ID NO: 7875299 - DNA, 22 bp, Homo sapiens
ccaagggctgctgaggtgtcca

SEQ ID NO: 7875300 - DNA, 22 bp, Homo sapiens
ccaagggctgctgaggtgtcca

SEQ ID NO: 7875301 - DNA, 22 bp, Homo sapiens
ccaagggctgctgaggtgtcca

SEQ ID NO: 7875302 - DNA, 22 bp, Homo sapiens
ccaaggggcctttagacactat

SEQ ID NO: 7875303 - DNA, 22 bp, Homo sapiens
ccaaggtcttggacagctaatg

SEQ ID NO: 7875304 - DNA, 22 bp, Homo sapiens
ccaaggggcctttagacactat

SEQ ID NO: 7875305 - DNA, 22 bp, Homo sapiens
ccaaggggcctttagacactat

SEQ ID NO: 7875306 - DNA, 22 bp, Homo sapiens
ccaaggtggctacagccctgca

SEQ ID NO: 7875307 - DNA, 22 bp, Homo sapiens
ccaaggttgagaaactgtagga

SEQ ID NO: 7875308 - DNA, 22 bp, Homo sapiens
ccaaggtgggcagatcacgagg

SEQ ID NO: 7875309 - DNA, 22 bp, Homo sapiens
catgtagtcctaatgctggtga

SEQ ID NO: 7875310 - DNA, 22 bp, Homo sapiens
catgtacattctgtagatggag

SEQ ID NO: 7875311 - DNA, 22 bp, Homo sapiens
catgtacattctgtagatggag

SEQ ID NO: 7875312 - DNA, 22 bp, Homo sapiens
catgtacattctgtagatggag

SEQ ID NO: 7875313 - DNA, 22 bp, Homo sapiens
catgtatagacactcatacagt

SEQ ID NO: 7875314 - DNA, 22 bp, Homo sapiens
catgtatagacactcatacagt

SEQ ID NO: 7875315 - DNA, 22 bp, Homo sapiens
catgtataggtccatagtgaat

SEQ ID NO: 7875316 - DNA, 22 bp, Homo sapiens
catgtataggtccatagtgaat

SEQ ID NO: 7875317 - DNA, 19 bp, Homo sapiens
catggtgaaaccccgtctc

SEQ ID NO: 7875318 - DNA, 19 bp, Homo sapiens
catggtgaaaccccgtctc

SEQ ID NO: 7875319 - DNA, 22 bp, Homo sapiens
catgtacattctgtagatggag

SEQ ID NO: 7875320 - DNA, 22 bp, Homo sapiens
catggtcatgctgagctacaaa

SEQ ID NO: 7875321 - DNA, 22 bp, Homo sapiens
catggtcatgctgagctacaaa

SEQ ID NO: 7875322 - DNA, 19 bp, Homo sapiens
catggtgaaaccccgtctc

SEQ ID NO: 7875323 - DNA, 18 bp, Homo sapiens
catgggtgacaggtggat

SEQ ID NO: 7875324 - DNA, 22 bp, Homo sapiens
catgggtaagactcttttgccc

SEQ ID NO: 7875325 - DNA, 18 bp, Homo sapiens
catgggtgacaggtggat

SEQ ID NO: 7875326 - DNA, 18 bp, Homo sapiens
catgggtgacaggtggat

SEQ ID NO: 7875327 - DNA, 18 bp, Homo sapiens
catgggtgacaggtggat

SEQ ID NO: 7875328 - DNA, 18 bp, Homo sapiens
catgggtgacaggtggat

SEQ ID NO: 7875329 - DNA, 22 bp, Homo sapiens
catgggtaagactcttttgccc

SEQ ID NO: 7875330 - DNA, 22 bp, Homo sapiens
catgtatattttatgtggagag

SEQ ID NO: 7875331 - DNA, 22 bp, Homo sapiens
catgtatatttctgtatgtgca

SEQ ID NO: 7875332 - DNA, 17 bp, Homo sapiens
catgtatttgaaacaga

SEQ ID NO: 7875333 - DNA, 22 bp, Homo sapiens
catgtattgaagtgtgcatctg

SEQ ID NO: 7875334 - DNA, 17 bp, Homo sapiens
catgtatttgaaacaga

SEQ ID NO: 7875335 - DNA, 22 bp, Homo sapiens
catgtcaaccagttgtttgaat

SEQ ID NO: 7875336 - DNA, 22 bp, Homo sapiens
aggcactggtctaccccttagt

SEQ ID NO: 7875337 - DNA, 22 bp, Homo sapiens
aggcactgcagattacaggcgc

SEQ ID NO: 7875338 - DNA, 22 bp, Homo sapiens
aggcactgcagattacaggcgc

SEQ ID NO: 7875339 - DNA, 22 bp, Homo sapiens
aggcactgcagattacaggcgc

SEQ ID NO: 7875340 - DNA, 22 bp, Homo sapiens
catgtcccaaatgcaggcaaag

SEQ ID NO: 7875341 - DNA, 22 bp, Homo sapiens
aggcactgcagattacaggcgc

SEQ ID NO: 7875342 - DNA, 22 bp, Homo sapiens
catggggagacacctagggaaa

SEQ ID NO: 7875343 - DNA, 22 bp, Homo sapiens
catggggagacacctagggaaa

SEQ ID NO: 7875344 - DNA, 22 bp, Homo sapiens
catggggagacacctagggaaa

SEQ ID NO: 7875345 - DNA, 22 bp, Homo sapiens
catgggctttggaggctggagg

SEQ ID NO: 7875346 - DNA, 22 bp, Homo sapiens
catgggctttggaggctggagg

SEQ ID NO: 7875347 - DNA, 22 bp, Homo sapiens
catgggctttggaggctggagg

SEQ ID NO: 7875348 - DNA, 22 bp, Homo sapiens
catgggctgtgaacccaggctg

SEQ ID NO: 7875349 - DNA, 22 bp, Homo sapiens
catgggcttgctctctgagctc

SEQ ID NO: 7875350 - DNA, 22 bp, Homo sapiens
catgggcttgctctctgagctc

SEQ ID NO: 7875351 - DNA, 22 bp, Homo sapiens
catgggcttgctctctgagctc

SEQ ID NO: 7875352 - DNA, 22 bp, Homo sapiens
catgggctttggaggctggagg

SEQ ID NO: 7875353 - DNA, 22 bp, Homo sapiens
catgggctgctgacaggggctc

SEQ ID NO: 7875354 - DNA, 22 bp, Homo sapiens
catgggctgctgacaggggctc

SEQ ID NO: 7875355 - DNA, 22 bp, Homo sapiens
catgggctgctgacaggggctc

SEQ ID NO: 7875356 - DNA, 22 bp, Homo sapiens
catgggctgctgacaggggctc

SEQ ID NO: 7875357 - DNA, 23 bp, Homo sapiens
catggggagcagtgctcctgacc

SEQ ID NO: 7875358 - DNA, 23 bp, Homo sapiens
catggggagcagtgctcctgacc

SEQ ID NO: 7875359 - DNA, 22 bp, Homo sapiens
catggggatgaggctgagactt

SEQ ID NO: 7875360 - DNA, 22 bp, Homo sapiens
catggggatgaggctgagactt

SEQ ID NO: 7875361 - DNA, 22 bp, Homo sapiens
catggggcccatgtgctccaag

SEQ ID NO: 7875362 - DNA, 22 bp, Homo sapiens
catggggatgaggctgagactt

SEQ ID NO: 7875363 - DNA, 22 bp, Homo sapiens
catgggggtctggacaacaggc

SEQ ID NO: 7875364 - DNA, 22 bp, Homo sapiens
catgggggctgaggctgctgta

SEQ ID NO: 7875365 - DNA, 22 bp, Homo sapiens
aggatttacaatgattctaggt

SEQ ID NO: 7875366 - DNA, 22 bp, Homo sapiens
aggatttacaatgattctaggt

SEQ ID NO: 7875367 - DNA, 22 bp, Homo sapiens
aggatttacaatgattctaggt

SEQ ID NO: 7875368 - DNA, 22 bp, Homo sapiens
aggatttaatcagttggcattt

SEQ ID NO: 7875369 - DNA, 22 bp, Homo sapiens
aggatttaaatccttaaccact

SEQ ID NO: 7875370 - DNA, 22 bp, Homo sapiens
aggatttaaatccttaaccact

SEQ ID NO: 7875371 - DNA, 23 bp, Homo sapiens
aggatttaaaggcaatgcatttt

SEQ ID NO: 7875372 - DNA, 22 bp, Homo sapiens
aggattgtttggcttcaaaggc

SEQ ID NO: 7875373 - DNA, 22 bp, Homo sapiens
aggattgttgcagggcttcgtt

SEQ ID NO: 7875374 - DNA, 22 bp, Homo sapiens
aggattgtgcctccagtcagaa

SEQ ID NO: 7875375 - DNA, 22 bp, Homo sapiens
aggatttattccagaaatgcaa

SEQ ID NO: 7875376 - DNA, 19 bp, Homo sapiens
aggatttattatgtgctca

SEQ ID NO: 7875377 - DNA, 22 bp, Homo sapiens
aggatttattatatgccctcat

SEQ ID NO: 7875378 - DNA, 22 bp, Homo sapiens
aggatttaggagctggctaacg

SEQ ID NO: 7875379 - DNA, 22 bp, Homo sapiens
aggatttagatttggaggaact

SEQ ID NO: 7875380 - DNA, 22 bp, Homo sapiens
aggatttatcaggaactctctt

SEQ ID NO: 7875381 - DNA, 22 bp, Homo sapiens
aggatttattacaagccatggt

SEQ ID NO: 7875382 - DNA, 20 bp, Homo sapiens
aggatttactactacctgct

SEQ ID NO: 7875383 - DNA, 22 bp, Homo sapiens
aggatttactagcaaggattct

SEQ ID NO: 7875384 - DNA, 22 bp, Homo sapiens
aggatttaccgtcatttagtct

SEQ ID NO: 7875385 - DNA, 22 bp, Homo sapiens
aggatttacctccagctaggct

SEQ ID NO: 7875386 - DNA, 22 bp, Homo sapiens
aggatttagcatgaaatgtgaa

SEQ ID NO: 7875387 - DNA, 21 bp, Homo sapiens
aggatttactattaactgtgt

SEQ ID NO: 7875388 - DNA, 21 bp, Homo sapiens
aggatttactattaactgtgt

SEQ ID NO: 7875389 - DNA, 22 bp, Homo sapiens
aggatttctgtgcctggaaaat

SEQ ID NO: 7875390 - DNA, 22 bp, Homo sapiens
aggatttgaacctaggcaatca

SEQ ID NO: 7875391 - DNA, 22 bp, Homo sapiens
aggatttgaaatatttagtaaa

SEQ ID NO: 7875392 - DNA, 22 bp, Homo sapiens
aggatttattggtgggaagtta

SEQ ID NO: 7875393 - DNA, 21 bp, Homo sapiens
aggatttctgtcatttcagat

SEQ ID NO: 7875394 - DNA, 22 bp, Homo sapiens
aggatttctgtgcctggaaaat

SEQ ID NO: 7875395 - DNA, 22 bp, Homo sapiens
catggctcggggacaggaggta

SEQ ID NO: 7875396 - DNA, 22 bp, Homo sapiens
catggctgaaattcttcgcttg

SEQ ID NO: 7875397 - DNA, 22 bp, Homo sapiens
catggctcggggacaggaggta

SEQ ID NO: 7875398 - DNA, 22 bp, Homo sapiens
catggctgaaattcttcgcttg

SEQ ID NO: 7875399 - DNA, 22 bp, Homo sapiens
catggctgaaattcttcgcttg

SEQ ID NO: 7875400 - DNA, 22 bp, Homo sapiens
catggctgaacactcagtgact

SEQ ID NO: 7875401 - DNA, 22 bp, Homo sapiens
catggctgaacactcagtgact

SEQ ID NO: 7875402 - DNA, 22 bp, Homo sapiens
catgggctgaaaatctgcaaac

SEQ ID NO: 7875403 - DNA, 22 bp, Homo sapiens
catgggctgaaaatctgcaaac

SEQ ID NO: 7875404 - DNA, 20 bp, Homo sapiens
aggaggggatagaatcaaag

SEQ ID NO: 7875405 - DNA, 20 bp, Homo sapiens
aggaggggatagaatcaaag

SEQ ID NO: 7875406 - DNA, 20 bp, Homo sapiens
aggaggggatagaatcaaag

SEQ ID NO: 7875407 - DNA, 20 bp, Homo sapiens
aggaggggatagaatcaaag

SEQ ID NO: 7875408 - DNA, 20 bp, Homo sapiens
aggaggggatagaatcaaag

SEQ ID NO: 7875409 - DNA, 20 bp, Homo sapiens
aggaggggatagaatcaaag

SEQ ID NO: 7875410 - DNA, 20 bp, Homo sapiens
aggaggggatagaatcaaag

SEQ ID NO: 7875411 - DNA, 16 bp, Homo sapiens
aggaggggaattagga

SEQ ID NO: 7875412 - DNA, 16 bp, Homo sapiens
aggaggggaattagga

SEQ ID NO: 7875413 - DNA, 16 bp, Homo sapiens
aggaggggaattagga

SEQ ID NO: 7875414 - DNA, 16 bp, Homo sapiens
aggaggggaattagga

SEQ ID NO: 7875415 - DNA, 16 bp, Homo sapiens
aggaggggaattagga

SEQ ID NO: 7875416 - DNA, 16 bp, Homo sapiens
aggaggggaattagga

SEQ ID NO: 7875417 - DNA, 16 bp, Homo sapiens
aggaggggaattagga

SEQ ID NO: 7875418 - DNA, 22 bp, Homo sapiens
catgcggctctttccaaaccgg

SEQ ID NO: 7875419 - DNA, 22 bp, Homo sapiens
catgcgggttccaggctgcact

SEQ ID NO: 7875420 - DNA, 22 bp, Homo sapiens
aggaggggcaatgatagtctgg

SEQ ID NO: 7875421 - DNA, 22 bp, Homo sapiens
aggaggggcaatgatagtctgg

SEQ ID NO: 7875422 - DNA, 22 bp, Homo sapiens
catgcggctctttccaaaccgg

SEQ ID NO: 7875423 - DNA, 22 bp, Homo sapiens
aggaggggcaatgatagtctgg

SEQ ID NO: 7875424 - DNA, 20 bp, Homo sapiens
aggaggggatagaatcaaag

SEQ ID NO: 7875425 - DNA, 20 bp, Homo sapiens
aggaggggatagaatcaaag

SEQ ID NO: 7875426 - DNA, 22 bp, Homo sapiens
aggaggggcaatgatagtctgg

SEQ ID NO: 7875427 - DNA, 22 bp, Homo sapiens
aggaggggcaatgatagtctgg

SEQ ID NO: 7875428 - DNA, 21 bp, Homo sapiens
aggagggcacaaggccaggaa

SEQ ID NO: 7875429 - DNA, 21 bp, Homo sapiens
aggagggcacaaggccaggaa

SEQ ID NO: 7875430 - DNA, 21 bp, Homo sapiens
aggagggcacaaggccaggaa

SEQ ID NO: 7875431 - DNA, 21 bp, Homo sapiens
aggagggcacaaggccaggaa

SEQ ID NO: 7875432 - DNA, 21 bp, Homo sapiens
aggagggcacaaggccaggaa

SEQ ID NO: 7875433 - DNA, 21 bp, Homo sapiens
aggagggcacaaggccaggaa

SEQ ID NO: 7875434 - DNA, 21 bp, Homo sapiens
aggagggcacaaggccaggaa

SEQ ID NO: 7875435 - DNA, 22 bp, Homo sapiens
aggagggatagaaaaatacttg

SEQ ID NO: 7875436 - DNA, 21 bp, Homo sapiens
aggagggcacaaggccaggaa

SEQ ID NO: 7875437 - DNA, 21 bp, Homo sapiens
aggagggcacaaggccaggaa

SEQ ID NO: 7875438 - DNA, 22 bp, Homo sapiens
aggagggatagaaaaatacttg

SEQ ID NO: 7875439 - DNA, 22 bp, Homo sapiens
aggagggctaggaaaaccagga

SEQ ID NO: 7875440 - DNA, 22 bp, Homo sapiens
aggagggctaggaaaaccagga

SEQ ID NO: 7875441 - DNA, 22 bp, Homo sapiens
aggagggctaggaaaaccagga

SEQ ID NO: 7875442 - DNA, 22 bp, Homo sapiens
aggagggctaggaaaaccagga

SEQ ID NO: 7875443 - DNA, 22 bp, Homo sapiens
aggagggcaggctggctgccta

SEQ ID NO: 7875444 - DNA, 22 bp, Homo sapiens
aggagggcaggctggctgccta

SEQ ID NO: 7875445 - DNA, 22 bp, Homo sapiens
aggagggcaggctggctgccta

SEQ ID NO: 7875446 - DNA, 22 bp, Homo sapiens
aggagggcaggctggctgccta

SEQ ID NO: 7875447 - DNA, 21 bp, Homo sapiens
aggagggcacaaggccaggaa

SEQ ID NO: 7875448 - DNA, 22 bp, Homo sapiens
aggagggcaggctggctgccta

SEQ ID NO: 7875449 - DNA, 22 bp, Homo sapiens
aggagggcaggctggctgccta

SEQ ID NO: 7875450 - DNA, 19 bp, Homo sapiens
aggattccagaacagtgtt

SEQ ID NO: 7875451 - DNA, 22 bp, Homo sapiens
aggattcatggtgcagacaaag

SEQ ID NO: 7875452 - DNA, 22 bp, Homo sapiens
aggatgttgctattggcagtct

SEQ ID NO: 7875453 - DNA, 22 bp, Homo sapiens
aggattgtatacctaagtgtta

SEQ ID NO: 7875454 - DNA, 22 bp, Homo sapiens
aggattgtgcctccagtcagaa

SEQ ID NO: 7875455 - DNA, 22 bp, Homo sapiens
aggattgtgcctccagtcagaa

SEQ ID NO: 7875456 - DNA, 22 bp, Homo sapiens
aggattgtgcctccagtcagaa

SEQ ID NO: 7875457 - DNA, 22 bp, Homo sapiens
aggattgtgcctccagtcagaa

SEQ ID NO: 7875458 - DNA, 22 bp, Homo sapiens
aggattctgtaatctgtgaaat

SEQ ID NO: 7875459 - DNA, 22 bp, Homo sapiens
aggattctgtaatctgtgaaat

SEQ ID NO: 7875460 - DNA, 23 bp, Homo sapiens
aggattctgcttttcagaaataa

SEQ ID NO: 7875461 - DNA, 22 bp, Homo sapiens
aggattctgacttaggaggttt

SEQ ID NO: 7875462 - DNA, 22 bp, Homo sapiens
catggcagagaaggggaactgg

SEQ ID NO: 7875463 - DNA, 22 bp, Homo sapiens
catggcagagaaggggaactgg

SEQ ID NO: 7875464 - DNA, 22 bp, Homo sapiens
aggatgtggtctgttttctgag

SEQ ID NO: 7875465 - DNA, 22 bp, Homo sapiens
aggatgtgttcatagctgacgc

SEQ ID NO: 7875466 - DNA, 22 bp, Homo sapiens
aggatgtgttttgagctgacta

SEQ ID NO: 7875467 - DNA, 22 bp, Homo sapiens
catggcagaaacctgagctgct

SEQ ID NO: 7875468 - DNA, 22 bp, Homo sapiens
catggcactgagcaggtatgca

SEQ ID NO: 7875469 - DNA, 22 bp, Homo sapiens
catggcactgagcaggtatgca

SEQ ID NO: 7875470 - DNA, 22 bp, Homo sapiens
catggcactgagcaggtatgca

SEQ ID NO: 7875471 - DNA, 22 bp, Homo sapiens
catggcagaaacctgagctgct

SEQ ID NO: 7875472 - DNA, 22 bp, Homo sapiens
catggcagaaacctgagctgct

SEQ ID NO: 7875473 - DNA, 22 bp, Homo sapiens
catggcagaaacctgagctgct

SEQ ID NO: 7875474 - DNA, 22 bp, Homo sapiens
catggattgaatataaattaga

SEQ ID NO: 7875475 - DNA, 22 bp, Homo sapiens
catggcaataaacctacacagt

SEQ ID NO: 7875476 - DNA, 22 bp, Homo sapiens
catggcaatttcataaacaggt

SEQ ID NO: 7875477 - DNA, 22 bp, Homo sapiens
catggcaatttcataaacaggt

SEQ ID NO: 7875478 - DNA, 22 bp, Homo sapiens
catggcaataggaatgatgtga

SEQ ID NO: 7875479 - DNA, 22 bp, Homo sapiens
catggatcataaatgtgctaaa

SEQ ID NO: 7875480 - DNA, 22 bp, Homo sapiens
catggaggagttaggtgtgagt

SEQ ID NO: 7875481 - DNA, 22 bp, Homo sapiens
catggaggagttaggtgtgagt

SEQ ID NO: 7875482 - DNA, 22 bp, Homo sapiens
catggaggaggaagggcgttgt

SEQ ID NO: 7875483 - DNA, 22 bp, Homo sapiens
catggaggccaggaaacagcct

SEQ ID NO: 7875484 - DNA, 22 bp, Homo sapiens
catggaggccaggaaacagcct

SEQ ID NO: 7875485 - DNA, 22 bp, Homo sapiens
catggaggaccctcagggagct

SEQ ID NO: 7875486 - DNA, 22 bp, Homo sapiens
catggaggaccctcagggagct

SEQ ID NO: 7875487 - DNA, 22 bp, Homo sapiens
catggacagtgggacagtgtgt

SEQ ID NO: 7875488 - DNA, 22 bp, Homo sapiens
catggacttctgaaggtgtgtc

SEQ ID NO: 7875489 - DNA, 22 bp, Homo sapiens
catggaggaccctcagggagct

SEQ ID NO: 7875490 - DNA, 22 bp, Homo sapiens
catggaggaccctcagggagct

SEQ ID NO: 7875491 - DNA, 22 bp, Homo sapiens
catggaggaccctcagggagct

SEQ ID NO: 7875492 - DNA, 22 bp, Homo sapiens
catgctaaaccagaacatagga

SEQ ID NO: 7875493 - DNA, 22 bp, Homo sapiens
catggaatggttgaatgacgaa

SEQ ID NO: 7875494 - DNA, 22 bp, Homo sapiens
acaggcaggagctccccattcc

SEQ ID NO: 7875495 - DNA, 22 bp, Homo sapiens
acaggcaggagctccccattcc

SEQ ID NO: 7875496 - DNA, 22 bp, Homo sapiens
acaggcaggagctccccattcc

SEQ ID NO: 7875497 - DNA, 22 bp, Homo sapiens
acaggcaggagctccccattcc

SEQ ID NO: 7875498 - DNA, 22 bp, Homo sapiens
acaggcaggagctccccattcc

SEQ ID NO: 7875499 - DNA, 22 bp, Homo sapiens
acaggcaggagctccccattcc

SEQ ID NO: 7875500 - DNA, 22 bp, Homo sapiens
acaggcagcgtcattgctgctc

SEQ ID NO: 7875501 - DNA, 22 bp, Homo sapiens
acaggcagcgtcattgctgctc

SEQ ID NO: 7875502 - DNA, 22 bp, Homo sapiens
acaggcagcgtcattgctgctc

SEQ ID NO: 7875503 - DNA, 22 bp, Homo sapiens
acaggcagcgtcattgctgctc

SEQ ID NO: 7875504 - DNA, 22 bp, Homo sapiens
acaggcagcgtcattgctgctc

SEQ ID NO: 7875505 - DNA, 22 bp, Homo sapiens
acaggcagcgtcattgctgctc

SEQ ID NO: 7875506 - DNA, 22 bp, Homo sapiens
acaggcagccctctccctggtt

SEQ ID NO: 7875507 - DNA, 22 bp, Homo sapiens
acaggcagcactaatctctggt

SEQ ID NO: 7875508 - DNA, 22 bp, Homo sapiens
acaggcagccctctccctggtt

SEQ ID NO: 7875509 - DNA, 22 bp, Homo sapiens
acaggcagcactaatctctggt

SEQ ID NO: 7875510 - DNA, 22 bp, Homo sapiens
acaggcagccctctccctggtt

SEQ ID NO: 7875511 - DNA, 22 bp, Homo sapiens
acaggcagccctctccctggtt

SEQ ID NO: 7875512 - DNA, 22 bp, Homo sapiens
acaggcagccctctccctggtt

SEQ ID NO: 7875513 - DNA, 22 bp, Homo sapiens
acaggcagccctctccctggtt

SEQ ID NO: 7875514 - DNA, 22 bp, Homo sapiens
acaggcagccctctccctggtt

SEQ ID NO: 7875515 - DNA, 22 bp, Homo sapiens
acaggcaggcgggacagcccga

SEQ ID NO: 7875516 - DNA, 22 bp, Homo sapiens
acaggcaggcgggacagcccga

SEQ ID NO: 7875517 - DNA, 22 bp, Homo sapiens
acaggcaggcgggacagcccga

SEQ ID NO: 7875518 - DNA, 22 bp, Homo sapiens
acaggcaggcgggacagcccga

SEQ ID NO: 7875519 - DNA, 22 bp, Homo sapiens
acaggcaggcgggacagcccga

SEQ ID NO: 7875520 - DNA, 23 bp, Homo sapiens
acaggcaggcatggccaaatgtg

SEQ ID NO: 7875521 - DNA, 23 bp, Homo sapiens
acaggcaggcatggccaaatgtg

SEQ ID NO: 7875522 - DNA, 23 bp, Homo sapiens
acaggcaggcatggccaaatgtg

SEQ ID NO: 7875523 - DNA, 23 bp, Homo sapiens
acaggcaggcatggccaaatgtg

SEQ ID NO: 7875524 - DNA, 22 bp, Homo sapiens
acaggcaggcttcggccagagc

SEQ ID NO: 7875525 - DNA, 22 bp, Homo sapiens
acaggcaggcttcggccagagc

SEQ ID NO: 7875526 - DNA, 22 bp, Homo sapiens
acaggcaggcttcggccagagc

SEQ ID NO: 7875527 - DNA, 22 bp, Homo sapiens
acaggcaggcttcggccagagc

SEQ ID NO: 7875528 - DNA, 22 bp, Homo sapiens
acaggcaggcttcggccagagc

SEQ ID NO: 7875529 - DNA, 22 bp, Homo sapiens
acaggcaggcgggacagcccga

SEQ ID NO: 7875530 - DNA, 22 bp, Homo sapiens
acaggcaggcgggacagcccga

SEQ ID NO: 7875531 - DNA, 22 bp, Homo sapiens
acaggcaggcgggacagcccga

SEQ ID NO: 7875532 - DNA, 22 bp, Homo sapiens
acaggcaggcgggacagcccga

SEQ ID NO: 7875533 - DNA, 17 bp, Homo sapiens
acaggcagatcacctga

SEQ ID NO: 7875534 - DNA, 17 bp, Homo sapiens
acaggcagatcacctga

SEQ ID NO: 7875535 - DNA, 17 bp, Homo sapiens
acaggcagatcacctga

SEQ ID NO: 7875536 - DNA, 17 bp, Homo sapiens
acaggcagatcacctga

SEQ ID NO: 7875537 - DNA, 17 bp, Homo sapiens
acaggcagatcacctga

SEQ ID NO: 7875538 - DNA, 22 bp, Homo sapiens
acaggcagatgttttagttgta

SEQ ID NO: 7875539 - DNA, 17 bp, Homo sapiens
acaggcagatcacctga

SEQ ID NO: 7875540 - DNA, 22 bp, Homo sapiens
acaggcagatgttttagttgta

SEQ ID NO: 7875541 - DNA, 22 bp, Homo sapiens
acaggcagattaagggtaggca

SEQ ID NO: 7875542 - DNA, 22 bp, Homo sapiens
acaggcagatgttttagttgta

SEQ ID NO: 7875543 - DNA, 22 bp, Homo sapiens
acaggcagatgttttagttgta

SEQ ID NO: 7875544 - DNA, 22 bp, Homo sapiens
acaggcagatgttttagttgta

SEQ ID NO: 7875545 - DNA, 22 bp, Homo sapiens
acaggcagattaagggtaggca

SEQ ID NO: 7875546 - DNA, 22 bp, Homo sapiens
acaggcagattaagggtaggca

SEQ ID NO: 7875547 - DNA, 22 bp, Homo sapiens
acaggcagattaagggtaggca

SEQ ID NO: 7875548 - DNA, 22 bp, Homo sapiens
acaggcagattaagggtaggca

SEQ ID NO: 7875549 - DNA, 22 bp, Homo sapiens
acaggcagattaagggtaggca

SEQ ID NO: 7875550 - DNA, 22 bp, Homo sapiens
acaggcagattaagggtaggca

SEQ ID NO: 7875551 - DNA, 22 bp, Homo sapiens
acaggcagcactaatctctggt

SEQ ID NO: 7875552 - DNA, 22 bp, Homo sapiens
acaggcagcactaatctctggt

SEQ ID NO: 7875553 - DNA, 22 bp, Homo sapiens
acaggcagcaaaatcagcctca

SEQ ID NO: 7875554 - DNA, 22 bp, Homo sapiens
acaggcagcactaatctctggt

SEQ ID NO: 7875555 - DNA, 22 bp, Homo sapiens
acaggcagcaaaatcagcctca

SEQ ID NO: 7875556 - DNA, 22 bp, Homo sapiens
acaggcagcactaatctctggt

SEQ ID NO: 7875557 - DNA, 22 bp, Homo sapiens
acaggcagcactaatctctggt

SEQ ID NO: 7875558 - DNA, 22 bp, Homo sapiens
acaggcagcactaatctctggt

SEQ ID NO: 7875559 - DNA, 22 bp, Homo sapiens
acaggcagcactaatctctggt

SEQ ID NO: 7875560 - DNA, 22 bp, Homo sapiens
acaggcagcaaaatcagcctca

SEQ ID NO: 7875561 - DNA, 22 bp, Homo sapiens
acaggcagcaaaatcagcctca

SEQ ID NO: 7875562 - DNA, 22 bp, Homo sapiens
acaggcagcaaaatcagcctca

SEQ ID NO: 7875563 - DNA, 22 bp, Homo sapiens
acaggcagcaaaatcagcctca

SEQ ID NO: 7875564 - DNA, 22 bp, Homo sapiens
acaggcagcaaaatcagcctca

SEQ ID NO: 7875565 - DNA, 22 bp, Homo sapiens
acaggcagcaaaatcagcctca

SEQ ID NO: 7875566 - DNA, 22 bp, Homo sapiens
acaggcagcaaaatcagcctca

SEQ ID NO: 7875567 - DNA, 14 bp, Homo sapiens
acaggcagatttct

SEQ ID NO: 7875568 - DNA, 14 bp, Homo sapiens
acaggcagatttct

SEQ ID NO: 7875569 - DNA, 14 bp, Homo sapiens
acaggcagatttct

SEQ ID NO: 7875570 - DNA, 14 bp, Homo sapiens
acaggcagatttct

SEQ ID NO: 7875571 - DNA, 22 bp, Homo sapiens
acaggcagattaagggtaggca

SEQ ID NO: 7875572 - DNA, 22 bp, Homo sapiens
acagggaaggacatgacttggc

SEQ ID NO: 7875573 - DNA, 22 bp, Homo sapiens
acagggaaggagcatagaaaaa

SEQ ID NO: 7875574 - DNA, 22 bp, Homo sapiens
acaggctgttggggtccagggt

SEQ ID NO: 7875575 - DNA, 22 bp, Homo sapiens
acaggctgttggggtccagggt

SEQ ID NO: 7875576 - DNA, 22 bp, Homo sapiens
acagggaagctcaggggctctg

SEQ ID NO: 7875577 - DNA, 22 bp, Homo sapiens
acagggaagctcaggggctctg

SEQ ID NO: 7875578 - DNA, 22 bp, Homo sapiens
acaggctgttggggtccagggt

SEQ ID NO: 7875579 - DNA, 22 bp, Homo sapiens
acaggctgttggggtccagggt

SEQ ID NO: 7875580 - DNA, 22 bp, Homo sapiens
acaggcagggaccttggctaag

SEQ ID NO: 7875581 - DNA, 22 bp, Homo sapiens
acaggcagggaccttggctaag

SEQ ID NO: 7875582 - DNA, 22 bp, Homo sapiens
acaggcagggaccttggctaag

SEQ ID NO: 7875583 - DNA, 22 bp, Homo sapiens
acaggcagggacctcttgagtt

SEQ ID NO: 7875584 - DNA, 22 bp, Homo sapiens
acaggcagggacctcttgagtt

SEQ ID NO: 7875585 - DNA, 22 bp, Homo sapiens
acaggcagggacctcttgagtt

SEQ ID NO: 7875586 - DNA, 22 bp, Homo sapiens
acaggcaggcttcggccagagc

SEQ ID NO: 7875587 - DNA, 22 bp, Homo sapiens
acaggcaggcttcggccagagc

SEQ ID NO: 7875588 - DNA, 22 bp, Homo sapiens
acaggcaggcttcggccagagc

SEQ ID NO: 7875589 - DNA, 22 bp, Homo sapiens
acaggcagggaccttggctaag

SEQ ID NO: 7875590 - DNA, 22 bp, Homo sapiens
acaggcagggaccttggctaag

SEQ ID NO: 7875591 - DNA, 22 bp, Homo sapiens
acaggcagggacctcttgagtt

SEQ ID NO: 7875592 - DNA, 22 bp, Homo sapiens
acaggcagggaccttggctaag

SEQ ID NO: 7875593 - DNA, 22 bp, Homo sapiens
acaggcagggacctcttgagtt

SEQ ID NO: 7875594 - DNA, 22 bp, Homo sapiens
acaggcagggacctcttgagtt

SEQ ID NO: 7875595 - DNA, 22 bp, Homo sapiens
acagggagatatcttcaatatc

SEQ ID NO: 7875596 - DNA, 22 bp, Homo sapiens
acagggagatatcttcaatatc

SEQ ID NO: 7875597 - DNA, 22 bp, Homo sapiens
acagggagatgggtgaaagcgg

SEQ ID NO: 7875598 - DNA, 22 bp, Homo sapiens
acagggagatgggtgaaagcgg

SEQ ID NO: 7875599 - DNA, 22 bp, Homo sapiens
acagggagatgggtgaaagcgg

SEQ ID NO: 7875600 - DNA, 19 bp, Homo sapiens
acagggaatttccacagaa

SEQ ID NO: 7875601 - DNA, 19 bp, Homo sapiens
acagggaatttccacagaa

SEQ ID NO: 7875602 - DNA, 22 bp, Homo sapiens
acagggaatggagggatcagta

SEQ ID NO: 7875603 - DNA, 19 bp, Homo sapiens
acagggaatttccacagaa

SEQ ID NO: 7875604 - DNA, 22 bp, Homo sapiens
acagggaaggatttagtgggaa

SEQ ID NO: 7875605 - DNA, 22 bp, Homo sapiens
acagggaaggagcatagaaaaa

SEQ ID NO: 7875606 - DNA, 22 bp, Homo sapiens
acagggaaggagcatagaaaaa

SEQ ID NO: 7875607 - DNA, 22 bp, Homo sapiens
acagggaaggagcatagaaaaa

SEQ ID NO: 7875608 - DNA, 22 bp, Homo sapiens
acagggaaggagcatagaaaaa

SEQ ID NO: 7875609 - DNA, 22 bp, Homo sapiens
acagggaaggatttagtgggaa

SEQ ID NO: 7875610 - DNA, 22 bp, Homo sapiens
acagggaaggatttagtgggaa

SEQ ID NO: 7875611 - DNA, 22 bp, Homo sapiens
acagggaaggatttagtgggaa

SEQ ID NO: 7875612 - DNA, 22 bp, Homo sapiens
acagggaaggcatccgcgaatg

SEQ ID NO: 7875613 - DNA, 22 bp, Homo sapiens
acagggaaggcatccgcgaatg

SEQ ID NO: 7875614 - DNA, 22 bp, Homo sapiens
acagggaagttctgcaacagga

SEQ ID NO: 7875615 - DNA, 22 bp, Homo sapiens
acagggaatggagggatcagta

SEQ ID NO: 7875616 - DNA, 22 bp, Homo sapiens
acagggaatggagggatcagta

SEQ ID NO: 7875617 - DNA, 22 bp, Homo sapiens
acagggaatggagggatcagta

SEQ ID NO: 7875618 - DNA, 22 bp, Homo sapiens
acagggaatggagggatcagta

SEQ ID NO: 7875619 - DNA, 22 bp, Homo sapiens
acagggaagttctgcaacagga

SEQ ID NO: 7875620 - DNA, 22 bp, Homo sapiens
acagggaagttctgcaacagga

SEQ ID NO: 7875621 - DNA, 22 bp, Homo sapiens
aggaagagcattcacatggtag

SEQ ID NO: 7875622 - DNA, 22 bp, Homo sapiens
aggaagagcatctttgggtctg

SEQ ID NO: 7875623 - DNA, 22 bp, Homo sapiens
aggaagagcatctttgggtctg

SEQ ID NO: 7875624 - DNA, 22 bp, Homo sapiens
acagggctatattcctcagagt

SEQ ID NO: 7875625 - DNA, 22 bp, Homo sapiens
aggaagagcattcacatggtag

SEQ ID NO: 7875626 - DNA, 22 bp, Homo sapiens
acagggctatattcctcagagt

SEQ ID NO: 7875627 - DNA, 21 bp, Homo sapiens
acagggcttcagggagggtta

SEQ ID NO: 7875628 - DNA, 22 bp, Homo sapiens
acagggctcccagcaggtctgt

SEQ ID NO: 7875629 - DNA, 21 bp, Homo sapiens
acagggcttcagggagggtta

SEQ ID NO: 7875630 - DNA, 22 bp, Homo sapiens
acagggctatattcctcagagt

SEQ ID NO: 7875631 - DNA, 22 bp, Homo sapiens
acagggctcccagcaggtctgt

SEQ ID NO: 7875632 - DNA, 19 bp, Homo sapiens
acagggcttggcctgacat

SEQ ID NO: 7875633 - DNA, 19 bp, Homo sapiens
acagggcttggcctgacat

SEQ ID NO: 7875634 - DNA, 19 bp, Homo sapiens
acagggcttggcctgacat

SEQ ID NO: 7875635 - DNA, 19 bp, Homo sapiens
acagggcttggcctgacat

SEQ ID NO: 7875636 - DNA, 23 bp, Homo sapiens
aggaagagagagtgcctctttct

SEQ ID NO: 7875637 - DNA, 23 bp, Homo sapiens
aggaagagagagtgcctctttct

SEQ ID NO: 7875638 - DNA, 23 bp, Homo sapiens
aggaagagagagtgcctctttct

SEQ ID NO: 7875639 - DNA, 18 bp, Homo sapiens
aggaagaccatcagatat

SEQ ID NO: 7875640 - DNA, 22 bp, Homo sapiens
aggaagacaatctgtgtgctgt

SEQ ID NO: 7875641 - DNA, 22 bp, Homo sapiens
aggaagaatgtttacatatcaa

SEQ ID NO: 7875642 - DNA, 22 bp, Homo sapiens
aggaagaatgtttacatatcaa

SEQ ID NO: 7875643 - DNA, 22 bp, Homo sapiens
aggaagaatgtttacatatcaa

SEQ ID NO: 7875644 - DNA, 22 bp, Homo sapiens
aggaagaatgtttacatatcaa

SEQ ID NO: 7875645 - DNA, 22 bp, Homo sapiens
aggaagaatgtttacatatcaa

SEQ ID NO: 7875646 - DNA, 22 bp, Homo sapiens
aggaagaatgtttacatatcaa

SEQ ID NO: 7875647 - DNA, 22 bp, Homo sapiens
aggaagaacctaagaaagtctc

SEQ ID NO: 7875648 - DNA, 22 bp, Homo sapiens
aggaagaacagataatggacgc

SEQ ID NO: 7875649 - DNA, 22 bp, Homo sapiens
aggaagaaatgtgacttcaaac

SEQ ID NO: 7875650 - DNA, 22 bp, Homo sapiens
aggaagaaatgtgacttcaaac

SEQ ID NO: 7875651 - DNA, 22 bp, Homo sapiens
aggaagaaatgtgacttcaaac

SEQ ID NO: 7875652 - DNA, 22 bp, Homo sapiens
aggaagaaatgtgacttcaaac

SEQ ID NO: 7875653 - DNA, 22 bp, Homo sapiens
aggaagaaatgtgacttcaaac

SEQ ID NO: 7875654 - DNA, 21 bp, Homo sapiens
aggaagaaaggttggaggttg

SEQ ID NO: 7875655 - DNA, 22 bp, Homo sapiens
aggaagaacctaagaaagtctc

SEQ ID NO: 7875656 - DNA, 22 bp, Homo sapiens
aggaagaacctaagaaagtctc

SEQ ID NO: 7875657 - DNA, 22 bp, Homo sapiens
aggaagaacctaagaaagtctc

SEQ ID NO: 7875658 - DNA, 22 bp, Homo sapiens
aggaagaacagataatggacgc

SEQ ID NO: 7875659 - DNA, 22 bp, Homo sapiens
acagggagccccagcatttcca

SEQ ID NO: 7875660 - DNA, 22 bp, Homo sapiens
acagggagccccagcatttcca

SEQ ID NO: 7875661 - DNA, 22 bp, Homo sapiens
acagggagatgggtgaaagcgg

SEQ ID NO: 7875662 - DNA, 22 bp, Homo sapiens
acagggagatgggtgaaagcgg

SEQ ID NO: 7875663 - DNA, 22 bp, Homo sapiens
acagggagatgggtgaaagcgg

SEQ ID NO: 7875664 - DNA, 22 bp, Homo sapiens
acagggagccccagcatttcca

SEQ ID NO: 7875665 - DNA, 18 bp, Homo sapiens
acagggagggcgctgggg

SEQ ID NO: 7875666 - DNA, 22 bp, Homo sapiens
acagggagccccagcatttcca

SEQ ID NO: 7875667 - DNA, 22 bp, Homo sapiens
aggaagaaactgagctctgaca

SEQ ID NO: 7875668 - DNA, 21 bp, Homo sapiens
aggaagaaaggttggaggttg

SEQ ID NO: 7875669 - DNA, 21 bp, Homo sapiens
aggaagaaaggttggaggttg

SEQ ID NO: 7875670 - DNA, 21 bp, Homo sapiens
aggaagaaaggttggaggttg

SEQ ID NO: 7875671 - DNA, 22 bp, Homo sapiens
aggacacactgcaagagcctgg

SEQ ID NO: 7875672 - DNA, 22 bp, Homo sapiens
aggacacactgcaagagcctgg

SEQ ID NO: 7875673 - DNA, 22 bp, Homo sapiens
aggacacaccaggtccagctgt

SEQ ID NO: 7875674 - DNA, 22 bp, Homo sapiens
aggacacactgcaagagcctgg

SEQ ID NO: 7875675 - DNA, 22 bp, Homo sapiens
aggacacacagaatacaaatcc

SEQ ID NO: 7875676 - DNA, 22 bp, Homo sapiens
aggacacacagaatacaaatcc

SEQ ID NO: 7875677 - DNA, 22 bp, Homo sapiens
aggacacaccaggtccagctgt

SEQ ID NO: 7875678 - DNA, 22 bp, Homo sapiens
aggacacaccaggtccagctgt

SEQ ID NO: 7875679 - DNA, 22 bp, Homo sapiens
aggacaattttggcatagttct

SEQ ID NO: 7875680 - DNA, 22 bp, Homo sapiens
aggacaattttggcatagttct

SEQ ID NO: 7875681 - DNA, 22 bp, Homo sapiens
aggacaattagactctttgttt

SEQ ID NO: 7875682 - DNA, 22 bp, Homo sapiens
aggacaattgagagtttgttga

SEQ ID NO: 7875683 - DNA, 22 bp, Homo sapiens
aggacacacaaagagtgagaac

SEQ ID NO: 7875684 - DNA, 22 bp, Homo sapiens
aggacacacaaagagtgagaac

SEQ ID NO: 7875685 - DNA, 22 bp, Homo sapiens
aggacacacagaatacaaatcc

SEQ ID NO: 7875686 - DNA, 19 bp, Homo sapiens
acaggggctagcggaagca

SEQ ID NO: 7875687 - DNA, 19 bp, Homo sapiens
acaggggctagcggaagca

SEQ ID NO: 7875688 - DNA, 22 bp, Homo sapiens
aggacaattagactctttgttt

SEQ ID NO: 7875689 - DNA, 22 bp, Homo sapiens
aggacaatctctcctttatcag

SEQ ID NO: 7875690 - DNA, 22 bp, Homo sapiens
acaggggcaggcaggacccttt

SEQ ID NO: 7875691 - DNA, 19 bp, Homo sapiens
acaggggcctttccagggt

SEQ ID NO: 7875692 - DNA, 22 bp, Homo sapiens
acaggggcaggcaggacccttt

SEQ ID NO: 7875693 - DNA, 22 bp, Homo sapiens
acaggggcaggcaggacccttt

SEQ ID NO: 7875694 - DNA, 22 bp, Homo sapiens
acaggggcaagggctcacggcc

SEQ ID NO: 7875695 - DNA, 20 bp, Homo sapiens
acaggggcagcacaataatg

SEQ ID NO: 7875696 - DNA, 22 bp, Homo sapiens
acaggggcaagggctcacggcc

SEQ ID NO: 7875697 - DNA, 22 bp, Homo sapiens
acagggcttttaatcagtagtt

SEQ ID NO: 7875698 - DNA, 22 bp, Homo sapiens
acagggcttttaatcagtagtt

SEQ ID NO: 7875699 - DNA, 22 bp, Homo sapiens
acagggcttgtgacaactttaa

SEQ ID NO: 7875700 - DNA, 22 bp, Homo sapiens
acagggcttttaatcagtagtt

SEQ ID NO: 7875701 - DNA, 22 bp, Homo sapiens
acagggcttttaatcagtagtt

SEQ ID NO: 7875702 - DNA, 22 bp, Homo sapiens
acagggcttttaatcagtagtt

SEQ ID NO: 7875703 - DNA, 22 bp, Homo sapiens
agctggtgtcacctccagtcca

SEQ ID NO: 7875704 - DNA, 22 bp, Homo sapiens
agctggtgtcacctccagtcca

SEQ ID NO: 7875705 - DNA, 18 bp, Homo sapiens
agctggtggggagacagc

SEQ ID NO: 7875706 - DNA, 18 bp, Homo sapiens
agctggtggggagacagc

SEQ ID NO: 7875707 - DNA, 18 bp, Homo sapiens
agctggtggggagacagc

SEQ ID NO: 7875708 - DNA, 22 bp, Homo sapiens
agctggtggggaagctgcaggt

SEQ ID NO: 7875709 - DNA, 18 bp, Homo sapiens
agctggtggggagacagc

SEQ ID NO: 7875710 - DNA, 18 bp, Homo sapiens
agctggtggggagacagc

SEQ ID NO: 7875711 - DNA, 18 bp, Homo sapiens
agctggtggggagacagc

SEQ ID NO: 7875712 - DNA, 18 bp, Homo sapiens
agctggtggggagacagc

SEQ ID NO: 7875713 - DNA, 22 bp, Homo sapiens
agctggtggggaagctgcaggt

SEQ ID NO: 7875714 - DNA, 22 bp, Homo sapiens
agctggtggggaagctgcaggt

SEQ ID NO: 7875715 - DNA, 22 bp, Homo sapiens
agctggtggattatgctgtaca

SEQ ID NO: 7875716 - DNA, 22 bp, Homo sapiens
agctggtggattatgctgtaca

SEQ ID NO: 7875717 - DNA, 22 bp, Homo sapiens
agctggtggagcctttctgttt

SEQ ID NO: 7875718 - DNA, 22 bp, Homo sapiens
agctggtggattatgctgtaca

SEQ ID NO: 7875719 - DNA, 22 bp, Homo sapiens
agctggtggattatgctgtaca

SEQ ID NO: 7875720 - DNA, 22 bp, Homo sapiens
agctggtggattatgctgtaca

SEQ ID NO: 7875721 - DNA, 22 bp, Homo sapiens
agctggtggattatgctgtaca

SEQ ID NO: 7875722 - DNA, 22 bp, Homo sapiens
agctggtggggaagctgcaggt

SEQ ID NO: 7875723 - DNA, 22 bp, Homo sapiens
agctggtggattatgctgtaca

SEQ ID NO: 7875724 - DNA, 22 bp, Homo sapiens
agctggtggggaagctgcaggt

SEQ ID NO: 7875725 - DNA, 22 bp, Homo sapiens
agctggtggggaagctgcaggt

SEQ ID NO: 7875726 - DNA, 22 bp, Homo sapiens
agctggtggggaagctgcaggt

SEQ ID NO: 7875727 - DNA, 22 bp, Homo sapiens
agctggtggggaagctgcaggt

SEQ ID NO: 7875728 - DNA, 22 bp, Homo sapiens
agctggtggggaagctgcaggt

SEQ ID NO: 7875729 - DNA, 22 bp, Homo sapiens
acaggagttaaggctgagttga

SEQ ID NO: 7875730 - DNA, 22 bp, Homo sapiens
acaggagttaaccatgggaagt

SEQ ID NO: 7875731 - DNA, 22 bp, Homo sapiens
acaggagttaaggctgagttga

SEQ ID NO: 7875732 - DNA, 22 bp, Homo sapiens
acaggagttcagaggacacccc

SEQ ID NO: 7875733 - DNA, 22 bp, Homo sapiens
acaggagtttaagaaatatttc

SEQ ID NO: 7875734 - DNA, 22 bp, Homo sapiens
acaggagtttctgacagagaca

SEQ ID NO: 7875735 - DNA, 22 bp, Homo sapiens
acaggagtttaagaaatatttc

SEQ ID NO: 7875736 - DNA, 22 bp, Homo sapiens
acaggatcgccctgttgcccag

SEQ ID NO: 7875737 - DNA, 22 bp, Homo sapiens
agctggtggagaagcagacctc

SEQ ID NO: 7875738 - DNA, 22 bp, Homo sapiens
agctggtggagcctttctgttt

SEQ ID NO: 7875739 - DNA, 19 bp, Homo sapiens
acaggatatatcaggaaat

SEQ ID NO: 7875740 - DNA, 22 bp, Homo sapiens
acaggatagtttttaatcttcc

SEQ ID NO: 7875741 - DNA, 22 bp, Homo sapiens
acaggatcgccctgttgcccag

SEQ ID NO: 7875742 - DNA, 21 bp, Homo sapiens
acaggataggacagtgttcct

SEQ ID NO: 7875743 - DNA, 22 bp, Homo sapiens
acaggcacaggtgtgccccacc

SEQ ID NO: 7875744 - DNA, 21 bp, Homo sapiens
acaggcaccatgcctgtgcct

SEQ ID NO: 7875745 - DNA, 22 bp, Homo sapiens
agctggtgtgccagttccagtt

SEQ ID NO: 7875746 - DNA, 22 bp, Homo sapiens
agctggtgtggatttttgaatg

SEQ ID NO: 7875747 - DNA, 21 bp, Homo sapiens
acaggcaccatgcctgtgcct

SEQ ID NO: 7875748 - DNA, 21 bp, Homo sapiens
acaggcaccatgcctgtgcct

SEQ ID NO: 7875749 - DNA, 21 bp, Homo sapiens
acaggcaccatgcctgtgcct

SEQ ID NO: 7875750 - DNA, 22 bp, Homo sapiens
acaggcacctgccaccacatct

SEQ ID NO: 7875751 - DNA, 22 bp, Homo sapiens
acaggcagagtcaggttgggtt

SEQ ID NO: 7875752 - DNA, 22 bp, Homo sapiens
acaggcacctgccaccacatct

SEQ ID NO: 7875753 - DNA, 22 bp, Homo sapiens
agctggtgtgctctggaatcct

SEQ ID NO: 7875754 - DNA, 22 bp, Homo sapiens
agctggtgtgctctggaatcct

SEQ ID NO: 7875755 - DNA, 22 bp, Homo sapiens
acaggcacaggtgtgccccacc

SEQ ID NO: 7875756 - DNA, 22 bp, Homo sapiens
acaggcacaggtgtgccccacc

SEQ ID NO: 7875757 - DNA, 22 bp, Homo sapiens
agctggtgtgccagttccagtt

SEQ ID NO: 7875758 - DNA, 22 bp, Homo sapiens
agctggtgtgccagttccagtt

SEQ ID NO: 7875759 - DNA, 22 bp, Homo sapiens
agctggtgtgccagttccagtt

SEQ ID NO: 7875760 - DNA, 22 bp, Homo sapiens
agctggtgtgccagttccagtt

SEQ ID NO: 7875761 - DNA, 22 bp, Homo sapiens
agctggtgtcctcctggagctg

SEQ ID NO: 7875762 - DNA, 22 bp, Homo sapiens
agctggtgtcctcctggagctg

SEQ ID NO: 7875763 - DNA, 22 bp, Homo sapiens
agctggtgtcctcctggagctg

SEQ ID NO: 7875764 - DNA, 22 bp, Homo sapiens
agctggtgtcctcctggagctg

SEQ ID NO: 7875765 - DNA, 22 bp, Homo sapiens
agctggtgtgccactgttgggg

SEQ ID NO: 7875766 - DNA, 22 bp, Homo sapiens
agctggtgtgccagttccagtt

SEQ ID NO: 7875767 - DNA, 22 bp, Homo sapiens
agctggtgtgccactgttgggg

SEQ ID NO: 7875768 - DNA, 22 bp, Homo sapiens
agctggtgtgccactgttgggg

SEQ ID NO: 7875769 - DNA, 22 bp, Homo sapiens
agctggtgtgccactgttgggg

SEQ ID NO: 7875770 - DNA, 21 bp, Homo sapiens
agctggtgtcagagctctggg

SEQ ID NO: 7875771 - DNA, 22 bp, Homo sapiens
agctggtgtcacctccagtcca

SEQ ID NO: 7875772 - DNA, 21 bp, Homo sapiens
agctggtgtcagagctctggg

SEQ ID NO: 7875773 - DNA, 21 bp, Homo sapiens
agctggtgtcagagctctggg

SEQ ID NO: 7875774 - DNA, 21 bp, Homo sapiens
agctggtgtcagagctctggg

SEQ ID NO: 7875775 - DNA, 22 bp, Homo sapiens
agctggtgtcctcctggagctg

SEQ ID NO: 7875776 - DNA, 22 bp, Homo sapiens
agctggtgtcctcctggagctg

SEQ ID NO: 7875777 - DNA, 22 bp, Homo sapiens
agctggtgtcctcctggagctg

SEQ ID NO: 7875778 - DNA, 22 bp, Homo sapiens
agctggtgtcctcctggagctg

SEQ ID NO: 7875779 - DNA, 22 bp, Homo sapiens
agctggtgtcctcctggagctg

SEQ ID NO: 7875780 - DNA, 22 bp, Homo sapiens
agctggtgtcctcctggagctg

SEQ ID NO: 7875781 - DNA, 21 bp, Homo sapiens
agctggtgtcagagctctggg

SEQ ID NO: 7875782 - DNA, 22 bp, Homo sapiens
acaggagggacaccttcctgct

SEQ ID NO: 7875783 - DNA, 22 bp, Homo sapiens
acaggagggacaccttcctgct

SEQ ID NO: 7875784 - DNA, 22 bp, Homo sapiens
acaggaggagctgtttcaggga

SEQ ID NO: 7875785 - DNA, 22 bp, Homo sapiens
acaggagaattatctggaacaa

SEQ ID NO: 7875786 - DNA, 22 bp, Homo sapiens
acaggagaaatctggtcaaaag

SEQ ID NO: 7875787 - DNA, 22 bp, Homo sapiens
acaggagaattatctggaacaa

SEQ ID NO: 7875788 - DNA, 22 bp, Homo sapiens
acaggagaattatctggaacaa

SEQ ID NO: 7875789 - DNA, 23 bp, Homo sapiens
acaggaggggacaggtggccgtg

SEQ ID NO: 7875790 - DNA, 23 bp, Homo sapiens
acaggaggggacaggtggccgtg

SEQ ID NO: 7875791 - DNA, 23 bp, Homo sapiens
acaggaggggacaggtggccgtg

SEQ ID NO: 7875792 - DNA, 22 bp, Homo sapiens
acaggagggacaccttcctgct

SEQ ID NO: 7875793 - DNA, 22 bp, Homo sapiens
acaggagggacaccttcctgct

SEQ ID NO: 7875794 - DNA, 23 bp, Homo sapiens
acaggaggggacaggtggccgtg

SEQ ID NO: 7875795 - DNA, 22 bp, Homo sapiens
acaggagtggagaggtgcctct

SEQ ID NO: 7875796 - DNA, 22 bp, Homo sapiens
acaggagtggagaggtgcctct

SEQ ID NO: 7875797 - DNA, 22 bp, Homo sapiens
acaggagtggagaggtgcctct

SEQ ID NO: 7875798 - DNA, 22 bp, Homo sapiens
acaggagtggctctaccagacc

SEQ ID NO: 7875799 - DNA, 22 bp, Homo sapiens
acaggagtggctctaccagacc

SEQ ID NO: 7875800 - DNA, 22 bp, Homo sapiens
acaggagtagggctggtggaga

SEQ ID NO: 7875801 - DNA, 22 bp, Homo sapiens
acaggagtgaatctggcactta

SEQ ID NO: 7875802 - DNA, 22 bp, Homo sapiens
acaggaggggcatgaaagacgg

SEQ ID NO: 7875803 - DNA, 22 bp, Homo sapiens
acaggaggggcatgaaagacgg

SEQ ID NO: 7875804 - DNA, 22 bp, Homo sapiens
acaggaggggcatgaaagacgg

SEQ ID NO: 7875805 - DNA, 22 bp, Homo sapiens
acaggaggggcatgaaagacgg

SEQ ID NO: 7875806 - DNA, 22 bp, Homo sapiens
acaggaggggcatgaaagacgg

SEQ ID NO: 7875807 - DNA, 21 bp, Homo sapiens
agctggcagatatggtgtctg

SEQ ID NO: 7875808 - DNA, 22 bp, Homo sapiens
agctggcagagcatttgtggcc

SEQ ID NO: 7875809 - DNA, 21 bp, Homo sapiens
agctggcagatatggtgtctg

SEQ ID NO: 7875810 - DNA, 22 bp, Homo sapiens
agctggcagctctcaggggtac

SEQ ID NO: 7875811 - DNA, 22 bp, Homo sapiens
agctggcaccaaatatagtaaa

SEQ ID NO: 7875812 - DNA, 19 bp, Homo sapiens
agctggcactagaatccag

SEQ ID NO: 7875813 - DNA, 22 bp, Homo sapiens
agctggcacagaccaggagatc

SEQ ID NO: 7875814 - DNA, 22 bp, Homo sapiens
agctggcaccaaatatagtaaa

SEQ ID NO: 7875815 - DNA, 22 bp, Homo sapiens
agctggcacagaccaggagatc

SEQ ID NO: 7875816 - DNA, 22 bp, Homo sapiens
agctggcaccaaatatagtaaa

SEQ ID NO: 7875817 - DNA, 22 bp, Homo sapiens
agctggcacagaccaggagatc

SEQ ID NO: 7875818 - DNA, 22 bp, Homo sapiens
agctggcacagaccaggagatc

SEQ ID NO: 7875819 - DNA, 22 bp, Homo sapiens
agctggcacagaccaggagatc

SEQ ID NO: 7875820 - DNA, 21 bp, Homo sapiens
agctggcaatgttgtcctctt

SEQ ID NO: 7875821 - DNA, 21 bp, Homo sapiens
agctggcaatgttgtcctctt

SEQ ID NO: 7875822 - DNA, 22 bp, Homo sapiens
agctggcaatgtaagtccctgg

SEQ ID NO: 7875823 - DNA, 22 bp, Homo sapiens
agctggcaagttgaaggtggct

SEQ ID NO: 7875824 - DNA, 22 bp, Homo sapiens
agctggcaatctttctaaatac

SEQ ID NO: 7875825 - DNA, 22 bp, Homo sapiens
agctggcaatgtaagtccctgg

SEQ ID NO: 7875826 - DNA, 22 bp, Homo sapiens
agctggcaatgtaagtccctgg

SEQ ID NO: 7875827 - DNA, 22 bp, Homo sapiens
agctggattccagtgcagtcac

SEQ ID NO: 7875828 - DNA, 22 bp, Homo sapiens
agctggcaaaactaatgggaag

SEQ ID NO: 7875829 - DNA, 22 bp, Homo sapiens
agctggcaaaactaatgggaag

SEQ ID NO: 7875830 - DNA, 22 bp, Homo sapiens
agctggcaaggctttagattca

SEQ ID NO: 7875831 - DNA, 22 bp, Homo sapiens
agctggcaagttgaaggtggct

SEQ ID NO: 7875832 - DNA, 22 bp, Homo sapiens
agctggaggggccagcaggtgt

SEQ ID NO: 7875833 - DNA, 22 bp, Homo sapiens
acagctgggaatcagctgggga

SEQ ID NO: 7875834 - DNA, 22 bp, Homo sapiens
acagctgggaatcagctgggga

SEQ ID NO: 7875835 - DNA, 22 bp, Homo sapiens
acagctgggaatcagctgggga

SEQ ID NO: 7875836 - DNA, 22 bp, Homo sapiens
acagctgggaatcagctgggga

SEQ ID NO: 7875837 - DNA, 22 bp, Homo sapiens
acagctgggtgctgctcagagc

SEQ ID NO: 7875838 - DNA, 22 bp, Homo sapiens
acagctgggtgctgctcagagc

SEQ ID NO: 7875839 - DNA, 21 bp, Homo sapiens
acagctggccgcgcgggtcgg

SEQ ID NO: 7875840 - DNA, 21 bp, Homo sapiens
acagctggccgcgcgggtcgg

SEQ ID NO: 7875841 - DNA, 22 bp, Homo sapiens
acagctggccgaggctcaggga

SEQ ID NO: 7875842 - DNA, 22 bp, Homo sapiens
acagctggccgaggctcaggga

SEQ ID NO: 7875843 - DNA, 22 bp, Homo sapiens
acagctggccgaggctcaggga

SEQ ID NO: 7875844 - DNA, 22 bp, Homo sapiens
acagctggccgaggctcaggga

SEQ ID NO: 7875845 - DNA, 22 bp, Homo sapiens
acagctggcaggggggcatgaa

SEQ ID NO: 7875846 - DNA, 22 bp, Homo sapiens
acagctggcaggggggcatgaa

SEQ ID NO: 7875847 - DNA, 22 bp, Homo sapiens
acagctggcaggggggcatgaa

SEQ ID NO: 7875848 - DNA, 22 bp, Homo sapiens
acagctgctctacaggttattt

SEQ ID NO: 7875849 - DNA, 22 bp, Homo sapiens
acagctggcaggggggcatgaa

SEQ ID NO: 7875850 - DNA, 22 bp, Homo sapiens
acagctggcaggggggcatgaa

SEQ ID NO: 7875851 - DNA, 22 bp, Homo sapiens
acagctggcaggggggcatgaa

SEQ ID NO: 7875852 - DNA, 21 bp, Homo sapiens
acagctgcctgccatgggggt

SEQ ID NO: 7875853 - DNA, 22 bp, Homo sapiens
acagctgccaagacagagcagg

SEQ ID NO: 7875854 - DNA, 21 bp, Homo sapiens
acagctgcctgccatgggggt

SEQ ID NO: 7875855 - DNA, 22 bp, Homo sapiens
acagctgctcacctgtgagccc

SEQ ID NO: 7875856 - DNA, 22 bp, Homo sapiens
acagctgctcacctgtgagccc

SEQ ID NO: 7875857 - DNA, 22 bp, Homo sapiens
acagctgctcacctgtgagccc

SEQ ID NO: 7875858 - DNA, 22 bp, Homo sapiens
acagctgctcacctgtgagccc

SEQ ID NO: 7875859 - DNA, 22 bp, Homo sapiens
acagctgctctacaggttattt

SEQ ID NO: 7875860 - DNA, 21 bp, Homo sapiens
acagctggtgcagggcgggga

SEQ ID NO: 7875861 - DNA, 21 bp, Homo sapiens
acagctggtgcagggcgggga

SEQ ID NO: 7875862 - DNA, 22 bp, Homo sapiens
acagctggtgaatgttctctgt

SEQ ID NO: 7875863 - DNA, 22 bp, Homo sapiens
acagctgtatccccagagctca

SEQ ID NO: 7875864 - DNA, 22 bp, Homo sapiens
acagctgggtgctgctcagagc

SEQ ID NO: 7875865 - DNA, 22 bp, Homo sapiens
acagctgggtgtcccacttctg

SEQ ID NO: 7875866 - DNA, 22 bp, Homo sapiens
acagctgggtgtcccacttctg

SEQ ID NO: 7875867 - DNA, 22 bp, Homo sapiens
acagctggtgaatgttctctgt

SEQ ID NO: 7875868 - DNA, 22 bp, Homo sapiens
acagctgggtgtcccacttctg

SEQ ID NO: 7875869 - DNA, 22 bp, Homo sapiens
acagctggtgaatgttctctgt

SEQ ID NO: 7875870 - DNA, 22 bp, Homo sapiens
acagctgggtgtcccacttctg

SEQ ID NO: 7875871 - DNA, 22 bp, Homo sapiens
agctggattaaatatagctttc

SEQ ID NO: 7875872 - DNA, 22 bp, Homo sapiens
agctggatgaatttggaacact

SEQ ID NO: 7875873 - DNA, 22 bp, Homo sapiens
agctggaggggccagcaggtgt

SEQ ID NO: 7875874 - DNA, 22 bp, Homo sapiens
agctggaggggccagcaggtgt

SEQ ID NO: 7875875 - DNA, 22 bp, Homo sapiens
agctggaggggccagcaggtgt

SEQ ID NO: 7875876 - DNA, 22 bp, Homo sapiens
agctggaggggccagcaggtgt

SEQ ID NO: 7875877 - DNA, 22 bp, Homo sapiens
agctggaggggccagcaggtgt

SEQ ID NO: 7875878 - DNA, 23 bp, Homo sapiens
agctggaggctgtctactcccaa

SEQ ID NO: 7875879 - DNA, 23 bp, Homo sapiens
agctggaggctgtctactcccaa

SEQ ID NO: 7875880 - DNA, 22 bp, Homo sapiens
agctggaggggccagcaggtgt

SEQ ID NO: 7875881 - DNA, 22 bp, Homo sapiens
agctggaggggccagcaggtgt

SEQ ID NO: 7875882 - DNA, 22 bp, Homo sapiens
agctggaggggccagcaggtgt

SEQ ID NO: 7875883 - DNA, 23 bp, Homo sapiens
agctggaggctgtctactcccaa

SEQ ID NO: 7875884 - DNA, 23 bp, Homo sapiens
agctggaggctgtctactcccaa

SEQ ID NO: 7875885 - DNA, 22 bp, Homo sapiens
acagctgtattcaagttgcaag

SEQ ID NO: 7875886 - DNA, 22 bp, Homo sapiens
agctgaagcaacaacaggatgg

SEQ ID NO: 7875887 - DNA, 22 bp, Homo sapiens
agctgaagcactgggatggaag

SEQ ID NO: 7875888 - DNA, 22 bp, Homo sapiens
agctgaagcactgggatggaag

SEQ ID NO: 7875889 - DNA, 22 bp, Homo sapiens
agctctggttattgaagcaggg

SEQ ID NO: 7875890 - DNA, 22 bp, Homo sapiens
agctctggttattgaagcaggg

SEQ ID NO: 7875891 - DNA, 22 bp, Homo sapiens
agctgaagcagtcagttcagct

SEQ ID NO: 7875892 - DNA, 20 bp, Homo sapiens
agctgaagcccttggggaaa

SEQ ID NO: 7875893 - DNA, 22 bp, Homo sapiens
agctctgggtcacggctgccga

SEQ ID NO: 7875894 - DNA, 22 bp, Homo sapiens
agctctgggtcacggctgccga

SEQ ID NO: 7875895 - DNA, 22 bp, Homo sapiens
agctctgggtcacggctgccga

SEQ ID NO: 7875896 - DNA, 22 bp, Homo sapiens
agctctgggtcacggctgccga

SEQ ID NO: 7875897 - DNA, 22 bp, Homo sapiens
agctctggggtggagcccagga

SEQ ID NO: 7875898 - DNA, 22 bp, Homo sapiens
agctctggggtggagcccagga

SEQ ID NO: 7875899 - DNA, 22 bp, Homo sapiens
agctctggggtagggcccaaca

SEQ ID NO: 7875900 - DNA, 22 bp, Homo sapiens
agctctgggtcacggctgccga

SEQ ID NO: 7875901 - DNA, 22 bp, Homo sapiens
agctctggggtggagcccagga

SEQ ID NO: 7875902 - DNA, 22 bp, Homo sapiens
agctctggttattgaagcaggg

SEQ ID NO: 7875903 - DNA, 22 bp, Homo sapiens
agctctggttattgaagcaggg

SEQ ID NO: 7875904 - DNA, 22 bp, Homo sapiens
agctctggtgagatgttattca

SEQ ID NO: 7875905 - DNA, 22 bp, Homo sapiens
agctctggtgagatgttattca

SEQ ID NO: 7875906 - DNA, 22 bp, Homo sapiens
agctctggtatttctttaatcc

SEQ ID NO: 7875907 - DNA, 22 bp, Homo sapiens
agctctggtactgctgaccgaa

SEQ ID NO: 7875908 - DNA, 22 bp, Homo sapiens
agctctggtatttctttaatcc

SEQ ID NO: 7875909 - DNA, 22 bp, Homo sapiens
agctctggtactgctgaccgaa

SEQ ID NO: 7875910 - DNA, 22 bp, Homo sapiens
agctctggtactgctgaccgaa

SEQ ID NO: 7875911 - DNA, 22 bp, Homo sapiens
agctctggtactgctgaccgaa

SEQ ID NO: 7875912 - DNA, 22 bp, Homo sapiens
agctgacaggatggcattatta

SEQ ID NO: 7875913 - DNA, 22 bp, Homo sapiens
agctgacaggatggcattatta

SEQ ID NO: 7875914 - DNA, 22 bp, Homo sapiens
agctgaatgttctcagaccaga

SEQ ID NO: 7875915 - DNA, 22 bp, Homo sapiens
agctgaatcttgactaggaaga

SEQ ID NO: 7875916 - DNA, 22 bp, Homo sapiens
agctgaatctcaggcatccttt

SEQ ID NO: 7875917 - DNA, 22 bp, Homo sapiens
agctgaatctcaggcatccttt

SEQ ID NO: 7875918 - DNA, 22 bp, Homo sapiens
agctgaagggaggatatgtaca

SEQ ID NO: 7875919 - DNA, 22 bp, Homo sapiens
agctgaagtcctcgcggtgcta

SEQ ID NO: 7875920 - DNA, 22 bp, Homo sapiens
agctgaagtcctcgcggtgcta

SEQ ID NO: 7875921 - DNA, 22 bp, Homo sapiens
agctgaagttcagtccagagaa

SEQ ID NO: 7875922 - DNA, 22 bp, Homo sapiens
agctgaagttcagtccagagaa

SEQ ID NO: 7875923 - DNA, 22 bp, Homo sapiens
agctgaagtttagaattgtgaa

SEQ ID NO: 7875924 - DNA, 22 bp, Homo sapiens
agctgagaatcttccccagtgt

SEQ ID NO: 7875925 - DNA, 23 bp, Homo sapiens
agctgagaataaggagccgtttg

SEQ ID NO: 7875926 - DNA, 22 bp, Homo sapiens
agctgactgatgaagaggcctt

SEQ ID NO: 7875927 - DNA, 22 bp, Homo sapiens
agctgacctggaagggggcacg

SEQ ID NO: 7875928 - DNA, 22 bp, Homo sapiens
agctgaccagcatcttctggag

SEQ ID NO: 7875929 - DNA, 17 bp, Homo sapiens
agctgacatcaaaactt

SEQ ID NO: 7875930 - DNA, 22 bp, Homo sapiens
agctgacctggaagggggcacg

SEQ ID NO: 7875931 - DNA, 22 bp, Homo sapiens
agctgagacacttgagagacta

SEQ ID NO: 7875932 - DNA, 22 bp, Homo sapiens
agctgagaatcttccccagtgt

SEQ ID NO: 7875933 - DNA, 22 bp, Homo sapiens
agctgagacacttgagagacta

SEQ ID NO: 7875934 - DNA, 22 bp, Homo sapiens
agctgagacacttgagagacta

SEQ ID NO: 7875935 - DNA, 22 bp, Homo sapiens
agctgagagcccctgccctgtg

SEQ ID NO: 7875936 - DNA, 22 bp, Homo sapiens
agctgagagctgtgtcaagata

SEQ ID NO: 7875937 - DNA, 22 bp, Homo sapiens
agctgagagctgtgtcaagata

SEQ ID NO: 7875938 - DNA, 22 bp, Homo sapiens
agctgagagctgtgtcaagata

SEQ ID NO: 7875939 - DNA, 22 bp, Homo sapiens
acatagatggggtgtcatgtca

SEQ ID NO: 7875940 - DNA, 22 bp, Homo sapiens
acatagcaagtgctcaataaat

SEQ ID NO: 7875941 - DNA, 22 bp, Homo sapiens
acatagcaagtgctcaataaat

SEQ ID NO: 7875942 - DNA, 22 bp, Homo sapiens
acatagatgcctctgctgcttc

SEQ ID NO: 7875943 - DNA, 22 bp, Homo sapiens
acatagatgcctctgctgcttc

SEQ ID NO: 7875944 - DNA, 22 bp, Homo sapiens
acatagatgcctctgctgcttc

SEQ ID NO: 7875945 - DNA, 22 bp, Homo sapiens
acatagatgcctctgctgcttc

SEQ ID NO: 7875946 - DNA, 22 bp, Homo sapiens
acatagatgaggggctgatggg

SEQ ID NO: 7875947 - DNA, 22 bp, Homo sapiens
acatagatctgtgattcattct

SEQ ID NO: 7875948 - DNA, 22 bp, Homo sapiens
acatagatctgtgattcattct

SEQ ID NO: 7875949 - DNA, 20 bp, Homo sapiens
acatagatcagtgattgaca

SEQ ID NO: 7875950 - DNA, 20 bp, Homo sapiens
acatagatcagtgattgaca

SEQ ID NO: 7875951 - DNA, 22 bp, Homo sapiens
acatagagcattggatatggga

SEQ ID NO: 7875952 - DNA, 22 bp, Homo sapiens
acatagaagtgatgcttatcca

SEQ ID NO: 7875953 - DNA, 22 bp, Homo sapiens
acatagaagtgatgcttatcca

SEQ ID NO: 7875954 - DNA, 22 bp, Homo sapiens
acatagaaggaggctggcagct

SEQ ID NO: 7875955 - DNA, 22 bp, Homo sapiens
acatagaaggaggctggcagct

SEQ ID NO: 7875956 - DNA, 22 bp, Homo sapiens
acatagagtatcatactggatg

SEQ ID NO: 7875957 - DNA, 22 bp, Homo sapiens
acatagagtatcatactggatg

SEQ ID NO: 7875958 - DNA, 22 bp, Homo sapiens
acatagaaggaagagtagtagg

SEQ ID NO: 7875959 - DNA, 22 bp, Homo sapiens
acatagaaggaagagtagtagg

SEQ ID NO: 7875960 - DNA, 22 bp, Homo sapiens
acatagaaggaagagtagtagg

SEQ ID NO: 7875961 - DNA, 22 bp, Homo sapiens
acatagaaggaagagtagtagg

SEQ ID NO: 7875962 - DNA, 22 bp, Homo sapiens
acatagaacttcgatgtctttt

SEQ ID NO: 7875963 - DNA, 22 bp, Homo sapiens
acatagaacttcgatgtctttt

SEQ ID NO: 7875964 - DNA, 22 bp, Homo sapiens
acatagaacttcgatgtctttt

SEQ ID NO: 7875965 - DNA, 22 bp, Homo sapiens
acatagaaggaagagtagtagg

SEQ ID NO: 7875966 - DNA, 21 bp, Homo sapiens
acatacattatctttttaaaa

SEQ ID NO: 7875967 - DNA, 22 bp, Homo sapiens
acatagaacttcccagtgagca

SEQ ID NO: 7875968 - DNA, 22 bp, Homo sapiens
acatagaacttcccagtgagca

SEQ ID NO: 7875969 - DNA, 22 bp, Homo sapiens
acatagaacttcgatgtctttt

SEQ ID NO: 7875970 - DNA, 22 bp, Homo sapiens
aggcagctaagatggataatga

SEQ ID NO: 7875971 - DNA, 22 bp, Homo sapiens
aggcagctagagagtgaaactg

SEQ ID NO: 7875972 - DNA, 22 bp, Homo sapiens
acatagttagcttagagatact

SEQ ID NO: 7875973 - DNA, 22 bp, Homo sapiens
aggcagctaagatggataatga

SEQ ID NO: 7875974 - DNA, 22 bp, Homo sapiens
acatagtaagtgctcagtaaat

SEQ ID NO: 7875975 - DNA, 22 bp, Homo sapiens
acatagtaagtgctcagtaaat

SEQ ID NO: 7875976 - DNA, 22 bp, Homo sapiens
acatagtaagtgctcagtaaat

SEQ ID NO: 7875977 - DNA, 22 bp, Homo sapiens
acatagtaagtgctcagtaaat

SEQ ID NO: 7875978 - DNA, 17 bp, Homo sapiens
aggcagctcagaacatc

SEQ ID NO: 7875979 - DNA, 17 bp, Homo sapiens
aggcagctcagaacatc

SEQ ID NO: 7875980 - DNA, 17 bp, Homo sapiens
aggcagctcagaacatc

SEQ ID NO: 7875981 - DNA, 17 bp, Homo sapiens
aggcagctcagaacatc

SEQ ID NO: 7875982 - DNA, 22 bp, Homo sapiens
aggcagctagagagtgaaactg

SEQ ID NO: 7875983 - DNA, 22 bp, Homo sapiens
aggcagctagagagtgaaactg

SEQ ID NO: 7875984 - DNA, 22 bp, Homo sapiens
aggcagctagagagtgaaactg

SEQ ID NO: 7875985 - DNA, 17 bp, Homo sapiens
aggcagctcagaacatc

SEQ ID NO: 7875986 - DNA, 17 bp, Homo sapiens
aggcagctcagaacatc

SEQ ID NO: 7875987 - DNA, 17 bp, Homo sapiens
aggcagctcagaacatc

SEQ ID NO: 7875988 - DNA, 22 bp, Homo sapiens
acatagcataaagaatgactct

SEQ ID NO: 7875989 - DNA, 22 bp, Homo sapiens
acatagcagaggactgagcaga

SEQ ID NO: 7875990 - DNA, 22 bp, Homo sapiens
acatagcagaggactgagcaga

SEQ ID NO: 7875991 - DNA, 22 bp, Homo sapiens
acatagcacgtctcaatttgga

SEQ ID NO: 7875992 - DNA, 22 bp, Homo sapiens
acatagctcagtatcacttact

SEQ ID NO: 7875993 - DNA, 22 bp, Homo sapiens
acatagcttaaatgagaagata

SEQ ID NO: 7875994 - DNA, 22 bp, Homo sapiens
acatatattttcacacatggtt

SEQ ID NO: 7875995 - DNA, 22 bp, Homo sapiens
acatatattttcacacatggtt

SEQ ID NO: 7875996 - DNA, 22 bp, Homo sapiens
aggcagctggaggcagagacta

SEQ ID NO: 7875997 - DNA, 22 bp, Homo sapiens
aggcagctggaggcagagacta

SEQ ID NO: 7875998 - DNA, 22 bp, Homo sapiens
aggcagctggacataactaacc

SEQ ID NO: 7875999 - DNA, 21 bp, Homo sapiens
aggcagctggaaggcctggct

SEQ ID NO: 7876000 - DNA, 22 bp, Homo sapiens
aggcagctggaggcagagacta

SEQ ID NO: 7876001 - DNA, 22 bp, Homo sapiens
aggcagctggaggcagagacta

SEQ ID NO: 7876002 - DNA, 22 bp, Homo sapiens
aggcagctggacataactaacc

SEQ ID NO: 7876003 - DNA, 22 bp, Homo sapiens
acatatattttcacacatggtt

SEQ ID NO: 7876004 - DNA, 20 bp, Homo sapiens
acatatcatggtagagtcct

SEQ ID NO: 7876005 - DNA, 20 bp, Homo sapiens
acatatcatggtagagtcct

SEQ ID NO: 7876006 - DNA, 20 bp, Homo sapiens
acatatcatggtagagtcct

SEQ ID NO: 7876007 - DNA, 22 bp, Homo sapiens
acatattaactgcactacacta

SEQ ID NO: 7876008 - DNA, 22 bp, Homo sapiens
acatattaactgcactacacta

SEQ ID NO: 7876009 - DNA, 22 bp, Homo sapiens
acatatttccatgcagcatgtc

SEQ ID NO: 7876010 - DNA, 22 bp, Homo sapiens
acatatttccatgcagcatgtc

SEQ ID NO: 7876011 - DNA, 22 bp, Homo sapiens
acatatttccatgcagcatgtc

SEQ ID NO: 7876012 - DNA, 22 bp, Homo sapiens
acatatttccatgcagcatgtc

SEQ ID NO: 7876013 - DNA, 22 bp, Homo sapiens
acatatttccatgcagcatgtc

SEQ ID NO: 7876014 - DNA, 22 bp, Homo sapiens
acatattgagctctaaaagtac

SEQ ID NO: 7876015 - DNA, 22 bp, Homo sapiens
acatattgagctctaaaagtac

SEQ ID NO: 7876016 - DNA, 22 bp, Homo sapiens
acatattaactgcactacacta

SEQ ID NO: 7876017 - DNA, 22 bp, Homo sapiens
acatattggcttagctctgtga

SEQ ID NO: 7876018 - DNA, 22 bp, Homo sapiens
acatattaactgcactacacta

SEQ ID NO: 7876019 - DNA, 22 bp, Homo sapiens
acatattggcaaactggaggca

SEQ ID NO: 7876020 - DNA, 22 bp, Homo sapiens
aggcagctggaaaactccaggc

SEQ ID NO: 7876021 - DNA, 22 bp, Homo sapiens
aggcagctggaaaactccaggc

SEQ ID NO: 7876022 - DNA, 22 bp, Homo sapiens
aggcagctggaaaactccaggc

SEQ ID NO: 7876023 - DNA, 22 bp, Homo sapiens
aggcagctggaaaactccaggc

SEQ ID NO: 7876024 - DNA, 22 bp, Homo sapiens
aggcagctggaaaactccaggc

SEQ ID NO: 7876025 - DNA, 22 bp, Homo sapiens
aggcagctggaaaactccaggc

SEQ ID NO: 7876026 - DNA, 21 bp, Homo sapiens
aggcagctggaaggcctggct

SEQ ID NO: 7876027 - DNA, 21 bp, Homo sapiens
aggcagctggaaggcctggct

SEQ ID NO: 7876028 - DNA, 21 bp, Homo sapiens
aggcagctggaaggcctggct

SEQ ID NO: 7876029 - DNA, 21 bp, Homo sapiens
aggcagctggaaggcctggct

SEQ ID NO: 7876030 - DNA, 21 bp, Homo sapiens
aggcagctggaaggcctggct

SEQ ID NO: 7876031 - DNA, 21 bp, Homo sapiens
aggcagctggaaggcctggct

SEQ ID NO: 7876032 - DNA, 22 bp, Homo sapiens
aggcagctgccctctccttcct

SEQ ID NO: 7876033 - DNA, 22 bp, Homo sapiens
aggcagctgccctctccttcct

SEQ ID NO: 7876034 - DNA, 22 bp, Homo sapiens
aggcagctgccctctccttcct

SEQ ID NO: 7876035 - DNA, 22 bp, Homo sapiens
aggcagctggaaaactccaggc

SEQ ID NO: 7876036 - DNA, 22 bp, Homo sapiens
aggcagctggaaaactccaggc

SEQ ID NO: 7876037 - DNA, 22 bp, Homo sapiens
aggcagctgccctctccttcct

SEQ ID NO: 7876038 - DNA, 22 bp, Homo sapiens
aggcagctgccctctccttcct

SEQ ID NO: 7876039 - DNA, 22 bp, Homo sapiens
aggcagctgccctctccttcct

SEQ ID NO: 7876040 - DNA, 21 bp, Homo sapiens
aggcagctcaggcccagagag

SEQ ID NO: 7876041 - DNA, 21 bp, Homo sapiens
aggcagctcaggcccagagag

SEQ ID NO: 7876042 - DNA, 17 bp, Homo sapiens
aggcagctcagaacatc

SEQ ID NO: 7876043 - DNA, 21 bp, Homo sapiens
aggcagctcaggcccagagag

SEQ ID NO: 7876044 - DNA, 21 bp, Homo sapiens
aggcagctcaggcccagagag

SEQ ID NO: 7876045 - DNA, 22 bp, Homo sapiens
aggcagctctgtggcctcccag

SEQ ID NO: 7876046 - DNA, 22 bp, Homo sapiens
aggcagctctgtggcctcccag

SEQ ID NO: 7876047 - DNA, 22 bp, Homo sapiens
aggcagctctgtggcctcccag

SEQ ID NO: 7876048 - DNA, 22 bp, Homo sapiens
aggcagctctgtggcctcccag

SEQ ID NO: 7876049 - DNA, 21 bp, Homo sapiens
aggcagctcaggcccagagag

SEQ ID NO: 7876050 - DNA, 22 bp, Homo sapiens
aggcagctgaccacagtatgat

SEQ ID NO: 7876051 - DNA, 22 bp, Homo sapiens
aggcagctgaccacagtatgat

SEQ ID NO: 7876052 - DNA, 22 bp, Homo sapiens
aggcagctgaccacagtatgat

SEQ ID NO: 7876053 - DNA, 22 bp, Homo sapiens
aggcagctgaccacagtatgat

SEQ ID NO: 7876054 - DNA, 22 bp, Homo sapiens
aggcagctctgtggcctcccag

SEQ ID NO: 7876055 - DNA, 22 bp, Homo sapiens
aggcagctgaccacagtatgat

SEQ ID NO: 7876056 - DNA, 22 bp, Homo sapiens
aggcagctgaccacagtatgat

SEQ ID NO: 7876057 - DNA, 22 bp, Homo sapiens
aggcagctgaggtctggcgccc

SEQ ID NO: 7876058 - DNA, 22 bp, Homo sapiens
aggcagctgaggtctggcgccc

SEQ ID NO: 7876059 - DNA, 22 bp, Homo sapiens
aggcagctgaggtctggcgccc

SEQ ID NO: 7876060 - DNA, 22 bp, Homo sapiens
aggcagctgaggtctggcgccc

SEQ ID NO: 7876061 - DNA, 22 bp, Homo sapiens
aggcagctgaggtctggcgccc

SEQ ID NO: 7876062 - DNA, 22 bp, Homo sapiens
aggcagctgaggtctggcgccc

SEQ ID NO: 7876063 - DNA, 22 bp, Homo sapiens
acagtttatgtaaagctgccaa

SEQ ID NO: 7876064 - DNA, 21 bp, Homo sapiens
acagtttattagagtaagtgc

SEQ ID NO: 7876065 - DNA, 21 bp, Homo sapiens
acagtttattagagtaagtgc

SEQ ID NO: 7876066 - DNA, 22 bp, Homo sapiens
acagtttatgcctctgagcctg

SEQ ID NO: 7876067 - DNA, 22 bp, Homo sapiens
acagtttatggtgttttatata

SEQ ID NO: 7876068 - DNA, 22 bp, Homo sapiens
acagtttatcgattcacctacc

SEQ ID NO: 7876069 - DNA, 22 bp, Homo sapiens
acagtttatggtgttttatata

SEQ ID NO: 7876070 - DNA, 22 bp, Homo sapiens
acagtttatggtgttttatata

SEQ ID NO: 7876071 - DNA, 20 bp, Homo sapiens
acagtttattttacttggtt

SEQ ID NO: 7876072 - DNA, 22 bp, Homo sapiens
acagtttattgcacaggtaacc

SEQ ID NO: 7876073 - DNA, 22 bp, Homo sapiens
acagtttctccatttacacctt

SEQ ID NO: 7876074 - DNA, 22 bp, Homo sapiens
acagtttccccctagggcagca

SEQ ID NO: 7876075 - DNA, 22 bp, Homo sapiens
acagtttgaagtttagaagtct

SEQ ID NO: 7876076 - DNA, 22 bp, Homo sapiens
acagtttgaagtttagaagtct

SEQ ID NO: 7876077 - DNA, 17 bp, Homo sapiens
acagtttgattttagca

SEQ ID NO: 7876078 - DNA, 22 bp, Homo sapiens
aggcactgcttctaagtaggaa

SEQ ID NO: 7876079 - DNA, 18 bp, Homo sapiens
aggcactggaattaaggg

SEQ ID NO: 7876080 - DNA, 22 bp, Homo sapiens
aggcactgggaatatgctgagg

SEQ ID NO: 7876081 - DNA, 20 bp, Homo sapiens
aggcactggatttcttatat

SEQ ID NO: 7876082 - DNA, 20 bp, Homo sapiens
aggcactggatttcttatat

SEQ ID NO: 7876083 - DNA, 22 bp, Homo sapiens
aggcactgggaatatgctgagg

SEQ ID NO: 7876084 - DNA, 22 bp, Homo sapiens
aggcactgggaatatgctgagg

SEQ ID NO: 7876085 - DNA, 22 bp, Homo sapiens
aggcactgggaatatgctgagg

SEQ ID NO: 7876086 - DNA, 18 bp, Homo sapiens
aggcactggaattaaggg

SEQ ID NO: 7876087 - DNA, 22 bp, Homo sapiens
aggcactgcttctaagtaggaa

SEQ ID NO: 7876088 - DNA, 20 bp, Homo sapiens
aggcactggatttcttatat

SEQ ID NO: 7876089 - DNA, 18 bp, Homo sapiens
aggcactggaattaaggg

SEQ ID NO: 7876090 - DNA, 22 bp, Homo sapiens
aggcactgcagattacaggcgc

SEQ ID NO: 7876091 - DNA, 22 bp, Homo sapiens
aggcactgcttctaagtaggaa

SEQ ID NO: 7876092 - DNA, 22 bp, Homo sapiens
aggcactgcttctaagtaggaa

SEQ ID NO: 7876093 - DNA, 22 bp, Homo sapiens
aggcactgggggatgagcaagg

SEQ ID NO: 7876094 - DNA, 22 bp, Homo sapiens
aggcactgggtaattagtagct

SEQ ID NO: 7876095 - DNA, 22 bp, Homo sapiens
aggcactgggggatgagcaagg

SEQ ID NO: 7876096 - DNA, 22 bp, Homo sapiens
aggcactgggtaattagtagct

SEQ ID NO: 7876097 - DNA, 22 bp, Homo sapiens
aggcactgggtaattagtagct

SEQ ID NO: 7876098 - DNA, 22 bp, Homo sapiens
aggcactgggtaattagtagct

SEQ ID NO: 7876099 - DNA, 22 bp, Homo sapiens
aggcactgggtaattagtagct

SEQ ID NO: 7876100 - DNA, 22 bp, Homo sapiens
aggcactgggggatgagcaagg

SEQ ID NO: 7876101 - DNA, 20 bp, Homo sapiens
aggcactggggataggtaag

SEQ ID NO: 7876102 - DNA, 22 bp, Homo sapiens
aggcactgggggatgagcaagg

SEQ ID NO: 7876103 - DNA, 20 bp, Homo sapiens
aggcactggggataggtaag

SEQ ID NO: 7876104 - DNA, 22 bp, Homo sapiens
aggcactgggaatatgctgagg

SEQ ID NO: 7876105 - DNA, 22 bp, Homo sapiens
aggcactgggaatatgctgagg

SEQ ID NO: 7876106 - DNA, 22 bp, Homo sapiens
acagtgtgtgggaaatgtgact

SEQ ID NO: 7876107 - DNA, 22 bp, Homo sapiens
acagtgtgttctgggacctcca

SEQ ID NO: 7876108 - DNA, 22 bp, Homo sapiens
acagtgtgttctgggacctcca

SEQ ID NO: 7876109 - DNA, 22 bp, Homo sapiens
acagtgtgttggaggagactgt

SEQ ID NO: 7876110 - DNA, 22 bp, Homo sapiens
aggatgagagatacatggagca

SEQ ID NO: 7876111 - DNA, 22 bp, Homo sapiens
acagtgtgttggaggagactgt

SEQ ID NO: 7876112 - DNA, 22 bp, Homo sapiens
aggatgagattgctgtgttgta

SEQ ID NO: 7876113 - DNA, 22 bp, Homo sapiens
aggatgagattgctgtgttgta

SEQ ID NO: 7876114 - DNA, 22 bp, Homo sapiens
aggatgagccgcgcaagctgac

SEQ ID NO: 7876115 - DNA, 22 bp, Homo sapiens
aggatgagccgcgcaagctgac

SEQ ID NO: 7876116 - DNA, 22 bp, Homo sapiens
aggatgccccgtgtcttcctga

SEQ ID NO: 7876117 - DNA, 22 bp, Homo sapiens
aggatgccccgtgtcttcctga

SEQ ID NO: 7876118 - DNA, 20 bp, Homo sapiens
aggatgcagggagtctgcag

SEQ ID NO: 7876119 - DNA, 20 bp, Homo sapiens
aggatgcagggagtctgcag

SEQ ID NO: 7876120 - DNA, 20 bp, Homo sapiens
aggatgcagggagtctgcag

SEQ ID NO: 7876121 - DNA, 21 bp, Homo sapiens
aggatggaaaggactaggggt

SEQ ID NO: 7876122 - DNA, 21 bp, Homo sapiens
aggatggaaaggactaggggt

SEQ ID NO: 7876123 - DNA, 21 bp, Homo sapiens
aggatggaaaggactaggggt

SEQ ID NO: 7876124 - DNA, 22 bp, Homo sapiens
aggatggaattaggtagcaagt

SEQ ID NO: 7876125 - DNA, 22 bp, Homo sapiens
aggatgaggctggcaggtcttg

SEQ ID NO: 7876126 - DNA, 22 bp, Homo sapiens
aggatgaggctggcaggtcttg

SEQ ID NO: 7876127 - DNA, 20 bp, Homo sapiens
aggatgcagggagtctgcag

SEQ ID NO: 7876128 - DNA, 22 bp, Homo sapiens
acagtttataaaaataatgagg

SEQ ID NO: 7876129 - DNA, 22 bp, Homo sapiens
acagtttataaaaataatgagg

SEQ ID NO: 7876130 - DNA, 20 bp, Homo sapiens
acagtttatccagttagcag

SEQ ID NO: 7876131 - DNA, 22 bp, Homo sapiens
acagtttatcgattcacctacc

SEQ ID NO: 7876132 - DNA, 22 bp, Homo sapiens
acagtttatcgattcacctacc

SEQ ID NO: 7876133 - DNA, 22 bp, Homo sapiens
acagtttaggatgagagaacac

SEQ ID NO: 7876134 - DNA, 22 bp, Homo sapiens
acagtttataaaaataatgagg

SEQ ID NO: 7876135 - DNA, 22 bp, Homo sapiens
acagtttataaaaataatgagg

SEQ ID NO: 7876136 - DNA, 22 bp, Homo sapiens
acagtttaggatgagagaacac

SEQ ID NO: 7876137 - DNA, 22 bp, Homo sapiens
acagtttaggatgagagaacac

SEQ ID NO: 7876138 - DNA, 22 bp, Homo sapiens
acagtttaggatgagagaacac

SEQ ID NO: 7876139 - DNA, 22 bp, Homo sapiens
acagtttagaatgccacatagt

SEQ ID NO: 7876140 - DNA, 22 bp, Homo sapiens
acagtttagagcatgatgacca

SEQ ID NO: 7876141 - DNA, 22 bp, Homo sapiens
acagtttagagcatgatgacca

SEQ ID NO: 7876142 - DNA, 22 bp, Homo sapiens
acagtttagagcatgatgacca

SEQ ID NO: 7876143 - DNA, 22 bp, Homo sapiens
acagttcccgtcttgcacagct

SEQ ID NO: 7876144 - DNA, 22 bp, Homo sapiens
acagttcccgtcttgcacagct

SEQ ID NO: 7876145 - DNA, 21 bp, Homo sapiens
acagttcatgataactccatc

SEQ ID NO: 7876146 - DNA, 21 bp, Homo sapiens
acagttcatgataactccatc

SEQ ID NO: 7876147 - DNA, 22 bp, Homo sapiens
aggatggattctgtatgtggga

SEQ ID NO: 7876148 - DNA, 22 bp, Homo sapiens
aggatggattctgtatgtggga

SEQ ID NO: 7876149 - DNA, 19 bp, Homo sapiens
aggatggagcaggcggtga

SEQ ID NO: 7876150 - DNA, 19 bp, Homo sapiens
aggatggagcaggcggtga

SEQ ID NO: 7876151 - DNA, 22 bp, Homo sapiens
aggagcagaccgtagtcctgca

SEQ ID NO: 7876152 - DNA, 22 bp, Homo sapiens
aggagcagaccgtagtcctgca

SEQ ID NO: 7876153 - DNA, 22 bp, Homo sapiens
aggagcagaccgtagtcctgca

SEQ ID NO: 7876154 - DNA, 22 bp, Homo sapiens
aggagcagaatttaatgtgcag

SEQ ID NO: 7876155 - DNA, 22 bp, Homo sapiens
aggagcagaatttaatgtgcag

SEQ ID NO: 7876156 - DNA, 22 bp, Homo sapiens
aggagcagaatttaatgtgcag

SEQ ID NO: 7876157 - DNA, 22 bp, Homo sapiens
aggagcagaatttaatgtgcag

SEQ ID NO: 7876158 - DNA, 22 bp, Homo sapiens
acagtacaccactgtgtacagt

SEQ ID NO: 7876159 - DNA, 22 bp, Homo sapiens
acagtacagctaatgtcattag

SEQ ID NO: 7876160 - DNA, 22 bp, Homo sapiens
acagtacaccactgtgtacagt

SEQ ID NO: 7876161 - DNA, 22 bp, Homo sapiens
aggagcagaccgtagtcctgca

SEQ ID NO: 7876162 - DNA, 22 bp, Homo sapiens
aggagcagaccgtagtcctgca

SEQ ID NO: 7876163 - DNA, 22 bp, Homo sapiens
acagtatatatagtctaaaagc

SEQ ID NO: 7876164 - DNA, 22 bp, Homo sapiens
acagtatatatagtctaaaagc

SEQ ID NO: 7876165 - DNA, 22 bp, Homo sapiens
acagtatatatagtctaaaagc

SEQ ID NO: 7876166 - DNA, 22 bp, Homo sapiens
acagtatagggcttatattgta

SEQ ID NO: 7876167 - DNA, 22 bp, Homo sapiens
acagtacagctaatgtcattag

SEQ ID NO: 7876168 - DNA, 22 bp, Homo sapiens
acagtacagctaatgtcattag

SEQ ID NO: 7876169 - DNA, 22 bp, Homo sapiens
acagtatatatagtctaaaagc

SEQ ID NO: 7876170 - DNA, 22 bp, Homo sapiens
acagtatatatagtctaaaagc

SEQ ID NO: 7876171 - DNA, 22 bp, Homo sapiens
acagtatgaatgcagaatgtag

SEQ ID NO: 7876172 - DNA, 22 bp, Homo sapiens
acagtatgaatgcagaatgtag

SEQ ID NO: 7876173 - DNA, 22 bp, Homo sapiens
acagtatgaatgtctgaaaaat

SEQ ID NO: 7876174 - DNA, 22 bp, Homo sapiens
acagtatgaatgcagaatgtag

SEQ ID NO: 7876175 - DNA, 22 bp, Homo sapiens
acagtatattttcttgattgtt

SEQ ID NO: 7876176 - DNA, 22 bp, Homo sapiens
acagtatatatggttatctgat

SEQ ID NO: 7876177 - DNA, 22 bp, Homo sapiens
acagtatatatggttatctgat

SEQ ID NO: 7876178 - DNA, 21 bp, Homo sapiens
acagtatattagatatttgaa

SEQ ID NO: 7876179 - DNA, 22 bp, Homo sapiens
acagtatatatggttatctgat

SEQ ID NO: 7876180 - DNA, 21 bp, Homo sapiens
acagtatattagatatttgaa

SEQ ID NO: 7876181 - DNA, 21 bp, Homo sapiens
acagtatattagatatttgaa

SEQ ID NO: 7876182 - DNA, 22 bp, Homo sapiens
aggagatggagctcagtgggca

SEQ ID NO: 7876183 - DNA, 22 bp, Homo sapiens
aggagattggctgaaaaatatt

SEQ ID NO: 7876184 - DNA, 22 bp, Homo sapiens
acagtaaatcaacagaatatct

SEQ ID NO: 7876185 - DNA, 22 bp, Homo sapiens
acagtaaatcaacagaatatct

SEQ ID NO: 7876186 - DNA, 22 bp, Homo sapiens
acagtaaatcaacagaatatct

SEQ ID NO: 7876187 - DNA, 22 bp, Homo sapiens
acagtaaatcaacagaatatct

SEQ ID NO: 7876188 - DNA, 22 bp, Homo sapiens
aggagatggagctcagtgggca

SEQ ID NO: 7876189 - DNA, 22 bp, Homo sapiens
aggagcaaatgatgagacagca

SEQ ID NO: 7876190 - DNA, 22 bp, Homo sapiens
aggagcaaatgatgagacagca

SEQ ID NO: 7876191 - DNA, 22 bp, Homo sapiens
aggagcaaatgatgagacagca

SEQ ID NO: 7876192 - DNA, 22 bp, Homo sapiens
aggagcaaggaagctacagttt

SEQ ID NO: 7876193 - DNA, 22 bp, Homo sapiens
aggagcactgagccagcatggg

SEQ ID NO: 7876194 - DNA, 22 bp, Homo sapiens
aggagcactgagccagcatggg

SEQ ID NO: 7876195 - DNA, 22 bp, Homo sapiens
aggagcactaattcctgcagag

SEQ ID NO: 7876196 - DNA, 19 bp, Homo sapiens
aggagcactgccagcacca

SEQ ID NO: 7876197 - DNA, 19 bp, Homo sapiens
aggagcactgccagcacca

SEQ ID NO: 7876198 - DNA, 22 bp, Homo sapiens
aggagcagaactgattctgact

SEQ ID NO: 7876199 - DNA, 22 bp, Homo sapiens
aggagcagaactgattctgact

SEQ ID NO: 7876200 - DNA, 22 bp, Homo sapiens
aggagcagaactgttgtggagg

SEQ ID NO: 7876201 - DNA, 22 bp, Homo sapiens
aggagcagaactgttgtggagg

SEQ ID NO: 7876202 - DNA, 22 bp, Homo sapiens
aggagcagaactgttgtggagg

SEQ ID NO: 7876203 - DNA, 22 bp, Homo sapiens
aggagcagaactgattctgact

SEQ ID NO: 7876204 - DNA, 22 bp, Homo sapiens
aggagcagaactgattctgact

SEQ ID NO: 7876205 - DNA, 22 bp, Homo sapiens
aggacacagctcttcagtaaga

SEQ ID NO: 7876206 - DNA, 22 bp, Homo sapiens
aggacacagctcttcagtaaga

SEQ ID NO: 7876207 - DNA, 22 bp, Homo sapiens
aggacacagctgctctgcagag

SEQ ID NO: 7876208 - DNA, 22 bp, Homo sapiens
aggacacagctgctctgcagag

SEQ ID NO: 7876209 - DNA, 22 bp, Homo sapiens
aggacacaggtaagccagtgga

SEQ ID NO: 7876210 - DNA, 22 bp, Homo sapiens
aggacacagactgattgcagca

SEQ ID NO: 7876211 - DNA, 22 bp, Homo sapiens
aggacacacttctgaggtcttt

SEQ ID NO: 7876212 - DNA, 21 bp, Homo sapiens
aggacacagagacacctattg

SEQ ID NO: 7876213 - DNA, 21 bp, Homo sapiens
aggacacagagacacctattg

SEQ ID NO: 7876214 - DNA, 22 bp, Homo sapiens
aggacacagactgattgcagca

SEQ ID NO: 7876215 - DNA, 21 bp, Homo sapiens
aggacacagagacacctattg

SEQ ID NO: 7876216 - DNA, 20 bp, Homo sapiens
acaggttcattctgtgtgac

SEQ ID NO: 7876217 - DNA, 22 bp, Homo sapiens
acaggtgttgactcacaggccc

SEQ ID NO: 7876218 - DNA, 22 bp, Homo sapiens
acaggtgttttggaggatgatt

SEQ ID NO: 7876219 - DNA, 22 bp, Homo sapiens
acaggtgtacaatgcatgacag

SEQ ID NO: 7876220 - DNA, 22 bp, Homo sapiens
acaggtgtacaatgcatgacag

SEQ ID NO: 7876221 - DNA, 22 bp, Homo sapiens
acaggtgtaatttgcccgaggt

SEQ ID NO: 7876222 - DNA, 22 bp, Homo sapiens
acaggtgtaatttgcccgaggt

SEQ ID NO: 7876223 - DNA, 22 bp, Homo sapiens
acaggtgtacaatgcatgacag

SEQ ID NO: 7876224 - DNA, 22 bp, Homo sapiens
acaggtgttgaatgatgtcaca

SEQ ID NO: 7876225 - DNA, 22 bp, Homo sapiens
acaggtgttgaatgatgtcaca

SEQ ID NO: 7876226 - DNA, 22 bp, Homo sapiens
acaggtgttgactcacaggccc

SEQ ID NO: 7876227 - DNA, 22 bp, Homo sapiens
acaggtgttgactcacaggccc

SEQ ID NO: 7876228 - DNA, 22 bp, Homo sapiens
acagtaaaacatttttattagg

SEQ ID NO: 7876229 - DNA, 22 bp, Homo sapiens
acagtaaaacatttttattagg

SEQ ID NO: 7876230 - DNA, 22 bp, Homo sapiens
acagtaaaacatttttattagg

SEQ ID NO: 7876231 - DNA, 22 bp, Homo sapiens
acagtaaaacatttttattagg

SEQ ID NO: 7876232 - DNA, 22 bp, Homo sapiens
acagtaaaattaagggcagtta

SEQ ID NO: 7876233 - DNA, 22 bp, Homo sapiens
acagtaaaattaagggcagtta

SEQ ID NO: 7876234 - DNA, 22 bp, Homo sapiens
acagtaaacaatgcagcaaatt

SEQ ID NO: 7876235 - DNA, 22 bp, Homo sapiens
acagtaaacaatgcagcaaatt

SEQ ID NO: 7876236 - DNA, 22 bp, Homo sapiens
acagtaaaaagccttagaattt

SEQ ID NO: 7876237 - DNA, 22 bp, Homo sapiens
acagtaaaaagccttagaattt

SEQ ID NO: 7876238 - DNA, 22 bp, Homo sapiens
acagtaaaaagccttagaattt

SEQ ID NO: 7876239 - DNA, 22 bp, Homo sapiens
acaggttttggactccagattt

SEQ ID NO: 7876240 - DNA, 22 bp, Homo sapiens
acaggtttttgtggatatatgt

SEQ ID NO: 7876241 - DNA, 22 bp, Homo sapiens
acagtaaagccttctggttgac

SEQ ID NO: 7876242 - DNA, 18 bp, Homo sapiens
acagtaaagaaaggaatt

SEQ ID NO: 7876243 - DNA, 18 bp, Homo sapiens
acagtaaagaaaggaatt

SEQ ID NO: 7876244 - DNA, 18 bp, Homo sapiens
acagtaaagaaaggaatt

SEQ ID NO: 7876245 - DNA, 22 bp, Homo sapiens
acagtaaacaatgcagcaaatt

SEQ ID NO: 7876246 - DNA, 22 bp, Homo sapiens
acagtaaatattaagcctgagt

SEQ ID NO: 7876247 - DNA, 22 bp, Homo sapiens
acagtaaataatgcatgttgat

SEQ ID NO: 7876248 - DNA, 22 bp, Homo sapiens
acagtaaatattaagcctgagt

SEQ ID NO: 7876249 - DNA, 16 bp, Homo sapiens
acagtaaagctggaca

SEQ ID NO: 7876250 - DNA, 22 bp, Homo sapiens
acagtaaagccttctggttgac

SEQ ID NO: 7876251 - DNA, 16 bp, Homo sapiens
acagtaaagctggaca

SEQ ID NO: 7876252 - DNA, 22 bp, Homo sapiens
acagtaaataatgcatgttgat

SEQ ID NO: 7876253 - DNA, 22 bp, Homo sapiens
acagtaaataatgcatgttgat

SEQ ID NO: 7876254 - DNA, 22 bp, Homo sapiens
acagtaaataatgcatgttgat

SEQ ID NO: 7876255 - DNA, 19 bp, Homo sapiens
acagtcagggaataaagac

SEQ ID NO: 7876256 - DNA, 19 bp, Homo sapiens
acagtcagggaataaagac

SEQ ID NO: 7876257 - DNA, 20 bp, Homo sapiens
acagtcagggaatagaaaaa

SEQ ID NO: 7876258 - DNA, 20 bp, Homo sapiens
acagtcagggaatagaaaaa

SEQ ID NO: 7876259 - DNA, 20 bp, Homo sapiens
acagtcagggaatagaaaaa

SEQ ID NO: 7876260 - DNA, 19 bp, Homo sapiens
acagtcagggaataaagac

SEQ ID NO: 7876261 - DNA, 20 bp, Homo sapiens
acagtcagggaatagaaaaa

SEQ ID NO: 7876262 - DNA, 22 bp, Homo sapiens
acagtcagggcttactcaggga

SEQ ID NO: 7876263 - DNA, 22 bp, Homo sapiens
acagtcagggcttactcaggga

SEQ ID NO: 7876264 - DNA, 22 bp, Homo sapiens
acagtcagtatcccaggcaaat

SEQ ID NO: 7876265 - DNA, 22 bp, Homo sapiens
acagtcagtatcccaggcaaat

SEQ ID NO: 7876266 - DNA, 22 bp, Homo sapiens
acagtcagttgaatccaaggag

SEQ ID NO: 7876267 - DNA, 22 bp, Homo sapiens
acagtcagttgaatccaaggag

SEQ ID NO: 7876268 - DNA, 19 bp, Homo sapiens
acagtccagctgtttgtac

SEQ ID NO: 7876269 - DNA, 19 bp, Homo sapiens
acagtccagctgtttgtac

SEQ ID NO: 7876270 - DNA, 22 bp, Homo sapiens
acagtcctaagataattgtctc

SEQ ID NO: 7876271 - DNA, 22 bp, Homo sapiens
acagtccagcctagtatgtata

SEQ ID NO: 7876272 - DNA, 22 bp, Homo sapiens
acagtccagcctagtatgtata

SEQ ID NO: 7876273 - DNA, 22 bp, Homo sapiens
acagtatttgcgatactgatga

SEQ ID NO: 7876274 - DNA, 22 bp, Homo sapiens
acagtatgaatgtctgaaaaat

SEQ ID NO: 7876275 - DNA, 22 bp, Homo sapiens
acagtcaaatgtctatcttctt

SEQ ID NO: 7876276 - DNA, 22 bp, Homo sapiens
acagtcaatcagaacagcatgt

SEQ ID NO: 7876277 - DNA, 22 bp, Homo sapiens
acagtcaatcagaacagcatgt

SEQ ID NO: 7876278 - DNA, 22 bp, Homo sapiens
acagtcaatcagaacagcatgt

SEQ ID NO: 7876279 - DNA, 22 bp, Homo sapiens
acagtcaatgagtgagtgaatg

SEQ ID NO: 7876280 - DNA, 22 bp, Homo sapiens
acagtcaatgagtgagtgaatg

SEQ ID NO: 7876281 - DNA, 21 bp, Homo sapiens
acagtcacaaaaccaaggcag

SEQ ID NO: 7876282 - DNA, 21 bp, Homo sapiens
acagtcacaaaaccaaggcag

SEQ ID NO: 7876283 - DNA, 22 bp, Homo sapiens
acagtcaggaatttgtaaaacg

SEQ ID NO: 7876284 - DNA, 22 bp, Homo sapiens
acagtcagacagttaataacct

SEQ ID NO: 7876285 - DNA, 22 bp, Homo sapiens
acagtcaggccgagatgggcct

SEQ ID NO: 7876286 - DNA, 22 bp, Homo sapiens
acagtcaggccgagatgggcct

SEQ ID NO: 7876287 - DNA, 20 bp, Homo sapiens
acagtcctgcactggtgttt

SEQ ID NO: 7876288 - DNA, 22 bp, Homo sapiens
acagtcctagctgcaaagaagt

SEQ ID NO: 7876289 - DNA, 22 bp, Homo sapiens
acagtcctagctgcaaagaagt

SEQ ID NO: 7876290 - DNA, 22 bp, Homo sapiens
acagtccttgtgtggaacatta

SEQ ID NO: 7876291 - DNA, 22 bp, Homo sapiens
acagtcctgttgtcaaagcaat

SEQ ID NO: 7876292 - DNA, 22 bp, Homo sapiens
acagtcctgtacaggccatatc

SEQ ID NO: 7876293 - DNA, 23 bp, Homo sapiens
acagtcgtaggtatccttttcct

SEQ ID NO: 7876294 - DNA, 22 bp, Homo sapiens
acagtccttgtttcggtcagat

SEQ ID NO: 7876295 - DNA, 22 bp, Homo sapiens
acagtcctgtacaggccatatc

SEQ ID NO: 7876296 - DNA, 22 bp, Homo sapiens
acagtccttgtgtggaacatta

SEQ ID NO: 7876297 - DNA, 22 bp, Homo sapiens
acagtctacttgagcttgtata

SEQ ID NO: 7876298 - DNA, 22 bp, Homo sapiens
acagtctactaaacatcatcag

SEQ ID NO: 7876299 - DNA, 21 bp, Homo sapiens
acagtctccccagatctctcc

SEQ ID NO: 7876300 - DNA, 22 bp, Homo sapiens
acagtctacaaagtgatgtgtg

SEQ ID NO: 7876301 - DNA, 22 bp, Homo sapiens
acagtctaggcctaggtcaaaa

SEQ ID NO: 7876302 - DNA, 22 bp, Homo sapiens
acagtctctccacactgcaggg

SEQ ID NO: 7876303 - DNA, 22 bp, Homo sapiens
acagtctctgttgctgctgttt

SEQ ID NO: 7876304 - DNA, 22 bp, Homo sapiens
acagtctctgttgctgctgttt

SEQ ID NO: 7876305 - DNA, 22 bp, Homo sapiens
acagtctctgttgctgctgttt

SEQ ID NO: 7876306 - DNA, 22 bp, Homo sapiens
acagtctcttgcttgaatacta

SEQ ID NO: 7876307 - DNA, 22 bp, Homo sapiens
acagtgtggttgtttctggtta

SEQ ID NO: 7876308 - DNA, 22 bp, Homo sapiens
acagtgtggtttgagcactggg

SEQ ID NO: 7876309 - DNA, 22 bp, Homo sapiens
acagtgtggtgatggcacttgc

SEQ ID NO: 7876310 - DNA, 23 bp, Homo sapiens
acagtgtggtggacaaggagcag

SEQ ID NO: 7876311 - DNA, 22 bp, Homo sapiens
acagtgtggttgtttctggtta

SEQ ID NO: 7876312 - DNA, 22 bp, Homo sapiens
acagtgtggttgtttctggtta

SEQ ID NO: 7876313 - DNA, 22 bp, Homo sapiens
acagtgtgtgctttcccttacg

SEQ ID NO: 7876314 - DNA, 22 bp, Homo sapiens
acagtgtgtgggaaatgtgact

SEQ ID NO: 7876315 - DNA, 22 bp, Homo sapiens
acagtgtgtcctaaaggtctgg

SEQ ID NO: 7876316 - DNA, 22 bp, Homo sapiens
acagtgtgtgctttcccttacg

SEQ ID NO: 7876317 - DNA, 22 bp, Homo sapiens
acagtgtggtttgagcactggg

SEQ ID NO: 7876318 - DNA, 22 bp, Homo sapiens
acagtgtggtttgagcactggg

SEQ ID NO: 7876319 - DNA, 22 bp, Homo sapiens
acagtgtgtcctaaaggtctgg

SEQ ID NO: 7876320 - DNA, 22 bp, Homo sapiens
acagtgtggtttgagcactggg

SEQ ID NO: 7876321 - DNA, 22 bp, Homo sapiens
acagtgtggggtgagatggaac

SEQ ID NO: 7876322 - DNA, 22 bp, Homo sapiens
acagtgtggggtgagatggaac

SEQ ID NO: 7876323 - DNA, 22 bp, Homo sapiens
acagtgtggggtgagatggaac

SEQ ID NO: 7876324 - DNA, 22 bp, Homo sapiens
acagtgtggaaagtcaacttga

SEQ ID NO: 7876325 - DNA, 22 bp, Homo sapiens
acagtgtggaaagtcaacttga

SEQ ID NO: 7876326 - DNA, 21 bp, Homo sapiens
acagtgtgcttctctccctcc

SEQ ID NO: 7876327 - DNA, 22 bp, Homo sapiens
acagtgtggaaagtcaacttga

SEQ ID NO: 7876328 - DNA, 22 bp, Homo sapiens
acagtgtgggacattaggaaat

SEQ ID NO: 7876329 - DNA, 22 bp, Homo sapiens
acagtgtggggtgagatggaac

SEQ ID NO: 7876330 - DNA, 22 bp, Homo sapiens
acagtgtggaaagtcaacttga

SEQ ID NO: 7876331 - DNA, 16 bp, Homo sapiens
acagtgtgctaagcat

SEQ ID NO: 7876332 - DNA, 22 bp, Homo sapiens
acagtgtgcaagaaatggggga

SEQ ID NO: 7876333 - DNA, 22 bp, Homo sapiens
acagtgtgacaattgtgtcaga

SEQ ID NO: 7876334 - DNA, 22 bp, Homo sapiens
acagtgtgatgggcctgcctga

SEQ ID NO: 7876335 - DNA, 22 bp, Homo sapiens
acagtgtgatgggcctgcctga

SEQ ID NO: 7876336 - DNA, 19 bp, Homo sapiens
acagtgtctgtatataaat

SEQ ID NO: 7876337 - DNA, 22 bp, Homo sapiens
acagtgtgacaattgtgtcaga

SEQ ID NO: 7876338 - DNA, 22 bp, Homo sapiens
acagtgtgacaattgtgtcaga

SEQ ID NO: 7876339 - DNA, 22 bp, Homo sapiens
acagtgtgacaattgtgtcaga

SEQ ID NO: 7876340 - DNA, 22 bp, Homo sapiens
acagtctgcagggtgaacatgt

SEQ ID NO: 7876341 - DNA, 22 bp, Homo sapiens
acagtctgcagggtgaacatgt

SEQ ID NO: 7876342 - DNA, 22 bp, Homo sapiens
acagtctgcatatgacctgtag

SEQ ID NO: 7876343 - DNA, 22 bp, Homo sapiens
acagtctgagaattactgctct

SEQ ID NO: 7876344 - DNA, 22 bp, Homo sapiens
acagtctcttggaattttcaga

SEQ ID NO: 7876345 - DNA, 22 bp, Homo sapiens
acagtctgcaggcaagttctac

SEQ ID NO: 7876346 - DNA, 22 bp, Homo sapiens
acagtctgcaggcaagttctac

SEQ ID NO: 7876347 - DNA, 22 bp, Homo sapiens
acagtctgcagggtgaacatgt

SEQ ID NO: 7876348 - DNA, 22 bp, Homo sapiens
acagtctgcaggcaagttctac

SEQ ID NO: 7876349 - DNA, 22 bp, Homo sapiens
acagtctgcagggtgaacatgt

SEQ ID NO: 7876350 - DNA, 22 bp, Homo sapiens
acagtctgcctctcagagcagc

SEQ ID NO: 7876351 - DNA, 22 bp, Homo sapiens
acagtctgcctctcagagcagc

SEQ ID NO: 7876352 - DNA, 22 bp, Homo sapiens
acagtctgcctctcagagcagc

SEQ ID NO: 7876353 - DNA, 17 bp, Homo sapiens
acagtctgcctgacagt

SEQ ID NO: 7876354 - DNA, 17 bp, Homo sapiens
acagtctgcctgacagt

SEQ ID NO: 7876355 - DNA, 22 bp, Homo sapiens
acagtctggaagcagggggcaa

SEQ ID NO: 7876356 - DNA, 22 bp, Homo sapiens
acagtctgcttgtctccatggt

SEQ ID NO: 7876357 - DNA, 17 bp, Homo sapiens
acagtctgcctgacagt

SEQ ID NO: 7876358 - DNA, 22 bp, Homo sapiens
acagtgtctgacacgtaggaag

SEQ ID NO: 7876359 - DNA, 22 bp, Homo sapiens
acagtgtctgacacgtaggaag

SEQ ID NO: 7876360 - DNA, 22 bp, Homo sapiens
acagtgtctgacacattgtagc

SEQ ID NO: 7876361 - DNA, 23 bp, Homo sapiens
acagtgtctgctgcaagatatct

SEQ ID NO: 7876362 - DNA, 23 bp, Homo sapiens
acagtgtctgctgcaagatatct

SEQ ID NO: 7876363 - DNA, 22 bp, Homo sapiens
acagtgtctcactgctgaaatc

SEQ ID NO: 7876364 - DNA, 20 bp, Homo sapiens
acagtgggtggggagcactg

SEQ ID NO: 7876365 - DNA, 20 bp, Homo sapiens
acagtgggtggggagcactg

SEQ ID NO: 7876366 - DNA, 22 bp, Homo sapiens
acagtgtctcctggtacccagt

SEQ ID NO: 7876367 - DNA, 22 bp, Homo sapiens
acagtgggatgaggctggcccc

SEQ ID NO: 7876368 - DNA, 22 bp, Homo sapiens
acagtggggtcttaatagaaca

SEQ ID NO: 7876369 - DNA, 22 bp, Homo sapiens
agggcagcaatgcagctgctgc

SEQ ID NO: 7876370 - DNA, 22 bp, Homo sapiens
agggcagcaatttggttcctgg

SEQ ID NO: 7876371 - DNA, 22 bp, Homo sapiens
agggcagcacaaggcatggact

SEQ ID NO: 7876372 - DNA, 22 bp, Homo sapiens
agggcagcaatttggttcctgg

SEQ ID NO: 7876373 - DNA, 22 bp, Homo sapiens
agggcagcacagctgtgctcct

SEQ ID NO: 7876374 - DNA, 22 bp, Homo sapiens
agggcagcacagctgtgctcct

SEQ ID NO: 7876375 - DNA, 22 bp, Homo sapiens
agggcagcacaaggcatggact

SEQ ID NO: 7876376 - DNA, 22 bp, Homo sapiens
agggcagcacaaggcatggact

SEQ ID NO: 7876377 - DNA, 22 bp, Homo sapiens
agggcagcacaaggcatggact

SEQ ID NO: 7876378 - DNA, 22 bp, Homo sapiens
agggcagcacaaggcatggact

SEQ ID NO: 7876379 - DNA, 22 bp, Homo sapiens
agggcagcacaaggcatggact

SEQ ID NO: 7876380 - DNA, 22 bp, Homo sapiens
agggcagcacaaggcatggact

SEQ ID NO: 7876381 - DNA, 22 bp, Homo sapiens
agggcagcacaaggcatggact

SEQ ID NO: 7876382 - DNA, 22 bp, Homo sapiens
agggcagcagctcctcctagct

SEQ ID NO: 7876383 - DNA, 19 bp, Homo sapiens
accaggcctcagaggccct

SEQ ID NO: 7876384 - DNA, 19 bp, Homo sapiens
accaggcctcagaggccct

SEQ ID NO: 7876385 - DNA, 22 bp, Homo sapiens
agggcagcagctcctcctagct

SEQ ID NO: 7876386 - DNA, 22 bp, Homo sapiens
agggcagcagcggcccaggcct

SEQ ID NO: 7876387 - DNA, 22 bp, Homo sapiens
agggcagcagcggcccaggcct

SEQ ID NO: 7876388 - DNA, 22 bp, Homo sapiens
agggcagcagcggcccaggcct

SEQ ID NO: 7876389 - DNA, 22 bp, Homo sapiens
agggcagcagcggcccaggcct

SEQ ID NO: 7876390 - DNA, 22 bp, Homo sapiens
agggcagcagcccatggctctg

SEQ ID NO: 7876391 - DNA, 22 bp, Homo sapiens
agggcagcagcccatggctctg

SEQ ID NO: 7876392 - DNA, 22 bp, Homo sapiens
agggcagcagcccatggctctg

SEQ ID NO: 7876393 - DNA, 22 bp, Homo sapiens
agggcagcacagctgtgctcct

SEQ ID NO: 7876394 - DNA, 22 bp, Homo sapiens
agggcacttgaggctgggcctg

SEQ ID NO: 7876395 - DNA, 22 bp, Homo sapiens
agggcacttgaggctgggcctg

SEQ ID NO: 7876396 - DNA, 22 bp, Homo sapiens
agggcacttcctctgggtccct

SEQ ID NO: 7876397 - DNA, 22 bp, Homo sapiens
agggcacttcctctgggtccct

SEQ ID NO: 7876398 - DNA, 22 bp, Homo sapiens
agggcacttcctctgggtccct

SEQ ID NO: 7876399 - DNA, 22 bp, Homo sapiens
agggcacttcagtcagactgag

SEQ ID NO: 7876400 - DNA, 22 bp, Homo sapiens
accagctctggacaggcatttc

SEQ ID NO: 7876401 - DNA, 22 bp, Homo sapiens
accagctccaggcccctgctga

SEQ ID NO: 7876402 - DNA, 22 bp, Homo sapiens
accagctccaggcccctgctgg

SEQ ID NO: 7876403 - DNA, 22 bp, Homo sapiens
agggcagcaatgcagctgctgc

SEQ ID NO: 7876404 - DNA, 22 bp, Homo sapiens
agggcagcaatgcagctgctgc

SEQ ID NO: 7876405 - DNA, 22 bp, Homo sapiens
agggcagcaatgcagctgctgc

SEQ ID NO: 7876406 - DNA, 22 bp, Homo sapiens
agggcagcaatgcagctgctgc

SEQ ID NO: 7876407 - DNA, 22 bp, Homo sapiens
agggcagcaatgcagctgctgc

SEQ ID NO: 7876408 - DNA, 22 bp, Homo sapiens
agggcagcaatgcagctgctgc

SEQ ID NO: 7876409 - DNA, 22 bp, Homo sapiens
agggcagcaatgcagctgctgc

SEQ ID NO: 7876410 - DNA, 22 bp, Homo sapiens
agggcagcaatgcagctgctgc

SEQ ID NO: 7876411 - DNA, 22 bp, Homo sapiens
agggcagcaatgcagctgctgc

SEQ ID NO: 7876412 - DNA, 22 bp, Homo sapiens
agggcagcaaagtttgacctca

SEQ ID NO: 7876413 - DNA, 22 bp, Homo sapiens
agggcagcaaagtttgacctca

SEQ ID NO: 7876414 - DNA, 21 bp, Homo sapiens
agggcagattagctgtaagag

SEQ ID NO: 7876415 - DNA, 22 bp, Homo sapiens
agggcagcaaagtttgacctca

SEQ ID NO: 7876416 - DNA, 22 bp, Homo sapiens
agggcagatggaacttccccga

SEQ ID NO: 7876417 - DNA, 21 bp, Homo sapiens
agggcagattagctgtaagag

SEQ ID NO: 7876418 - DNA, 17 bp, Homo sapiens
accagcctctcctgggg

SEQ ID NO: 7876419 - DNA, 17 bp, Homo sapiens
accagcctctcctgggg

SEQ ID NO: 7876420 - DNA, 22 bp, Homo sapiens
accagcctggccaacatggcaa

SEQ ID NO: 7876421 - DNA, 22 bp, Homo sapiens
accagcctggccaacatggcaa

SEQ ID NO: 7876422 - DNA, 22 bp, Homo sapiens
accagcctggccaacatggcaa

SEQ ID NO: 7876423 - DNA, 22 bp, Homo sapiens
accagcctcctagctgctcctg

SEQ ID NO: 7876424 - DNA, 22 bp, Homo sapiens
accagcctcctagctgctcctg

SEQ ID NO: 7876425 - DNA, 17 bp, Homo sapiens
accagcctctcctgggg

SEQ ID NO: 7876426 - DNA, 22 bp, Homo sapiens
accagccctcaggtcagatact

SEQ ID NO: 7876427 - DNA, 22 bp, Homo sapiens
accagccctcaggtcagatact

SEQ ID NO: 7876428 - DNA, 22 bp, Homo sapiens
accagccccaccgggactgcag

SEQ ID NO: 7876429 - DNA, 22 bp, Homo sapiens
accagcctgtctgagtcgtggg

SEQ ID NO: 7876430 - DNA, 22 bp, Homo sapiens
accagctagggtagcacatctc

SEQ ID NO: 7876431 - DNA, 22 bp, Homo sapiens
accagctcagaagccagaaaga

SEQ ID NO: 7876432 - DNA, 22 bp, Homo sapiens
accagctcagagcaggctcctg

SEQ ID NO: 7876433 - DNA, 22 bp, Homo sapiens
accagcctggccaacatggcaa

SEQ ID NO: 7876434 - DNA, 22 bp, Homo sapiens
accagcctggccaacatggtga

SEQ ID NO: 7876435 - DNA, 22 bp, Homo sapiens
accagcctggccaacatggtga

SEQ ID NO: 7876436 - DNA, 22 bp, Homo sapiens
accagcctggccaacatggtga

SEQ ID NO: 7876437 - DNA, 22 bp, Homo sapiens
accagcctggccaacatggtga

SEQ ID NO: 7876438 - DNA, 22 bp, Homo sapiens
agggagagaagttatacaagat

SEQ ID NO: 7876439 - DNA, 22 bp, Homo sapiens
agggagagacatttccttcttg

SEQ ID NO: 7876440 - DNA, 22 bp, Homo sapiens
agggagagaagttatacaagat

SEQ ID NO: 7876441 - DNA, 22 bp, Homo sapiens
agggagagaagttatacaagat

SEQ ID NO: 7876442 - DNA, 22 bp, Homo sapiens
agggagagaagttatacaagat

SEQ ID NO: 7876443 - DNA, 22 bp, Homo sapiens
agggagagaagttatacaagat

SEQ ID NO: 7876444 - DNA, 22 bp, Homo sapiens
agggagagaagttatacaagat

SEQ ID NO: 7876445 - DNA, 18 bp, Homo sapiens
agggagagaccgcgggtc

SEQ ID NO: 7876446 - DNA, 18 bp, Homo sapiens
agggagagaccgcgggtc

SEQ ID NO: 7876447 - DNA, 18 bp, Homo sapiens
agggagagaccgcgggtc

SEQ ID NO: 7876448 - DNA, 18 bp, Homo sapiens
agggagagaccgcgggtc

SEQ ID NO: 7876449 - DNA, 22 bp, Homo sapiens
agggagagacatttccttcttg

SEQ ID NO: 7876450 - DNA, 22 bp, Homo sapiens
agggagagacatttccttcttg

SEQ ID NO: 7876451 - DNA, 22 bp, Homo sapiens
agggagagacatttccttcttg

SEQ ID NO: 7876452 - DNA, 22 bp, Homo sapiens
agggagaggctgaactatccta

SEQ ID NO: 7876453 - DNA, 22 bp, Homo sapiens
agggagaggagggtcttgttga

SEQ ID NO: 7876454 - DNA, 22 bp, Homo sapiens
agggagaggagcgtttcacatc

SEQ ID NO: 7876455 - DNA, 22 bp, Homo sapiens
agggagaggagggtcttgttga

SEQ ID NO: 7876456 - DNA, 18 bp, Homo sapiens
agggagagaccgcgggtc

SEQ ID NO: 7876457 - DNA, 16 bp, Homo sapiens
agggagagaggaacat

SEQ ID NO: 7876458 - DNA, 16 bp, Homo sapiens
agggagagaggaacat

SEQ ID NO: 7876459 - DNA, 22 bp, Homo sapiens
agggagaggagcgtttcacatc

SEQ ID NO: 7876460 - DNA, 22 bp, Homo sapiens
agggagagaagttatacaagat

SEQ ID NO: 7876461 - DNA, 22 bp, Homo sapiens
agggagacacatgaggaagtca

SEQ ID NO: 7876462 - DNA, 22 bp, Homo sapiens
agggagacacatgaggaagtca

SEQ ID NO: 7876463 - DNA, 22 bp, Homo sapiens
agggagacaaaagcagctgcca

SEQ ID NO: 7876464 - DNA, 19 bp, Homo sapiens
agggagaattccaagagga

SEQ ID NO: 7876465 - DNA, 22 bp, Homo sapiens
agggagacaaaagcagctgcca

SEQ ID NO: 7876466 - DNA, 22 bp, Homo sapiens
agggagacaaaagcagctgcca

SEQ ID NO: 7876467 - DNA, 22 bp, Homo sapiens
agggagacaaaagcagctgcca

SEQ ID NO: 7876468 - DNA, 22 bp, Homo sapiens
agggagacaaaagcagctgcca

SEQ ID NO: 7876469 - DNA, 22 bp, Homo sapiens
agggacagtctactgttcactg

SEQ ID NO: 7876470 - DNA, 22 bp, Homo sapiens
agggacagtctactgttcactg

SEQ ID NO: 7876471 - DNA, 22 bp, Homo sapiens
agggacagtatccatctcacag

SEQ ID NO: 7876472 - DNA, 22 bp, Homo sapiens
aggcttgttttactaaaagcaa

SEQ ID NO: 7876473 - DNA, 22 bp, Homo sapiens
aggctttaagcaagcatattgt

SEQ ID NO: 7876474 - DNA, 22 bp, Homo sapiens
aggcttgtggattggagcgagt

SEQ ID NO: 7876475 - DNA, 20 bp, Homo sapiens
aggcttggcttggcaggaac

SEQ ID NO: 7876476 - DNA, 22 bp, Homo sapiens
aggcttgggactgcttaggagc

SEQ ID NO: 7876477 - DNA, 22 bp, Homo sapiens
aggcttgggactgcttaggagc

SEQ ID NO: 7876478 - DNA, 18 bp, Homo sapiens
aggcttgggcccagcagc

SEQ ID NO: 7876479 - DNA, 18 bp, Homo sapiens
aggcttgggcccagcagc

SEQ ID NO: 7876480 - DNA, 20 bp, Homo sapiens
aggcttggcttggcaggaac

SEQ ID NO: 7876481 - DNA, 20 bp, Homo sapiens
aggcttggcttggcaggaac

SEQ ID NO: 7876482 - DNA, 22 bp, Homo sapiens
accagccccaccgggactgcag

SEQ ID NO: 7876483 - DNA, 22 bp, Homo sapiens
accagccccaccgggactgcag

SEQ ID NO: 7876484 - DNA, 22 bp, Homo sapiens
accagccccaccgggactgcag

SEQ ID NO: 7876485 - DNA, 19 bp, Homo sapiens
accagcccactcccagttt

SEQ ID NO: 7876486 - DNA, 18 bp, Homo sapiens
aggcttgggcccagcagc

SEQ ID NO: 7876487 - DNA, 22 bp, Homo sapiens
aggcttggtgccaaggagcctg

SEQ ID NO: 7876488 - DNA, 22 bp, Homo sapiens
aggcttgtctcagaagatgctg

SEQ ID NO: 7876489 - DNA, 19 bp, Homo sapiens
aggcttggttgcagcaagc

SEQ ID NO: 7876490 - DNA, 22 bp, Homo sapiens
aggcttggttaattctgtgtga

SEQ ID NO: 7876491 - DNA, 22 bp, Homo sapiens
aggcttggttaattctgtgtga

SEQ ID NO: 7876492 - DNA, 22 bp, Homo sapiens
aggcttggttaattctgtgtga

SEQ ID NO: 7876493 - DNA, 22 bp, Homo sapiens
accagcagctgccagagtggag

SEQ ID NO: 7876494 - DNA, 22 bp, Homo sapiens
accagcagctgcgggccactgc

SEQ ID NO: 7876495 - DNA, 22 bp, Homo sapiens
accagcagctgccagagtggag

SEQ ID NO: 7876496 - DNA, 22 bp, Homo sapiens
accagcagctgccagagtggag

SEQ ID NO: 7876497 - DNA, 22 bp, Homo sapiens
accagcagctgccagagtggag

SEQ ID NO: 7876498 - DNA, 22 bp, Homo sapiens
accagcagctgcgggccactgc

SEQ ID NO: 7876499 - DNA, 22 bp, Homo sapiens
accagcagctgcgggccactgc

SEQ ID NO: 7876500 - DNA, 21 bp, Homo sapiens
accagcaggagatcagaagga

SEQ ID NO: 7876501 - DNA, 21 bp, Homo sapiens
accagcaggagatcagaagga

SEQ ID NO: 7876502 - DNA, 22 bp, Homo sapiens
accagcagctgccagagtggag

SEQ ID NO: 7876503 - DNA, 22 bp, Homo sapiens
accagcagctgccagagtggag

SEQ ID NO: 7876504 - DNA, 22 bp, Homo sapiens
accagcagctgccagagtggag

SEQ ID NO: 7876505 - DNA, 22 bp, Homo sapiens
accagcagcctagagcgttctt

SEQ ID NO: 7876506 - DNA, 22 bp, Homo sapiens
accagcagcctagagcgttctt

SEQ ID NO: 7876507 - DNA, 22 bp, Homo sapiens
accagcagcctagagcgttctt

SEQ ID NO: 7876508 - DNA, 22 bp, Homo sapiens
accagcagagttgaggaggaca

SEQ ID NO: 7876509 - DNA, 22 bp, Homo sapiens
acatttgtatgcgtttttactg

SEQ ID NO: 7876510 - DNA, 22 bp, Homo sapiens
acatttgtatgcgtttttactg

SEQ ID NO: 7876511 - DNA, 22 bp, Homo sapiens
acatttggttgagctgttgtca

SEQ ID NO: 7876512 - DNA, 20 bp, Homo sapiens
acatttgtatctcccagtgg

SEQ ID NO: 7876513 - DNA, 22 bp, Homo sapiens
acatttgtatatatgcagcata

SEQ ID NO: 7876514 - DNA, 22 bp, Homo sapiens
acatttgtatatatgcagcata

SEQ ID NO: 7876515 - DNA, 22 bp, Homo sapiens
acatttgtacattggcatgtct

SEQ ID NO: 7876516 - DNA, 22 bp, Homo sapiens
acatttgtacattggcatgtct

SEQ ID NO: 7876517 - DNA, 22 bp, Homo sapiens
acatttgtaggacagaggaaga

SEQ ID NO: 7876518 - DNA, 22 bp, Homo sapiens
acatttgtaggacagaggaaga

SEQ ID NO: 7876519 - DNA, 22 bp, Homo sapiens
acatttgtctggctagaaagtt

SEQ ID NO: 7876520 - DNA, 22 bp, Homo sapiens
acatttgtctggctagaaagtt

SEQ ID NO: 7876521 - DNA, 22 bp, Homo sapiens
acatttgtctggctagaaagtt

SEQ ID NO: 7876522 - DNA, 22 bp, Homo sapiens
acatttgtatttggtgagtggt

SEQ ID NO: 7876523 - DNA, 19 bp, Homo sapiens
acatttgtcaagagaaggt

SEQ ID NO: 7876524 - DNA, 22 bp, Homo sapiens
accagagctggctctgagcacc

SEQ ID NO: 7876525 - DNA, 22 bp, Homo sapiens
accagagctcttcagcacagga

SEQ ID NO: 7876526 - DNA, 22 bp, Homo sapiens
accagcagggctgggccaatgg

SEQ ID NO: 7876527 - DNA, 22 bp, Homo sapiens
accagcagggctgggccaatgg

SEQ ID NO: 7876528 - DNA, 22 bp, Homo sapiens
accagcagggctgggccaatgg

SEQ ID NO: 7876529 - DNA, 22 bp, Homo sapiens
accagcaggccaggggcactgc

SEQ ID NO: 7876530 - DNA, 22 bp, Homo sapiens
accagcaggccaggggcactgc

SEQ ID NO: 7876531 - DNA, 22 bp, Homo sapiens
accagcagggctgggccaatgg

SEQ ID NO: 7876532 - DNA, 22 bp, Homo sapiens
accagcaggccaggggcactgc

SEQ ID NO: 7876533 - DNA, 22 bp, Homo sapiens
accagcagttatgaggccagga

SEQ ID NO: 7876534 - DNA, 22 bp, Homo sapiens
accagcagttatgaggccagga

SEQ ID NO: 7876535 - DNA, 22 bp, Homo sapiens
accagcaggtggcagtatgtat

SEQ ID NO: 7876536 - DNA, 22 bp, Homo sapiens
accagcaggtggcagtatgtat

SEQ ID NO: 7876537 - DNA, 22 bp, Homo sapiens
accagcagttatgaggccagga

SEQ ID NO: 7876538 - DNA, 22 bp, Homo sapiens
accagcagttatgaggccagga

SEQ ID NO: 7876539 - DNA, 22 bp, Homo sapiens
accagcagttatgaggccagga

SEQ ID NO: 7876540 - DNA, 22 bp, Homo sapiens
accagcagttatgaggccagga

SEQ ID NO: 7876541 - DNA, 22 bp, Homo sapiens
accagcagttatgaggccagga

SEQ ID NO: 7876542 - DNA, 22 bp, Homo sapiens
accagcagttatgaggccagga

SEQ ID NO: 7876543 - DNA, 22 bp, Homo sapiens
accagcatcacctggaggcctg

SEQ ID NO: 7876544 - DNA, 22 bp, Homo sapiens
accagcagttatgaggccagga

SEQ ID NO: 7876545 - DNA, 22 bp, Homo sapiens
accagcatccttcctattaaca

SEQ ID NO: 7876546 - DNA, 22 bp, Homo sapiens
accagccaccaccaggagatcg

SEQ ID NO: 7876547 - DNA, 22 bp, Homo sapiens
accagcattgctttgggttata

SEQ ID NO: 7876548 - DNA, 21 bp, Homo sapiens
accagcattccacactgtccc

SEQ ID NO: 7876549 - DNA, 19 bp, Homo sapiens
accagcccactcccagttt

SEQ ID NO: 7876550 - DNA, 22 bp, Homo sapiens
accagccagccacagtggctcc

SEQ ID NO: 7876551 - DNA, 19 bp, Homo sapiens
accagcccactcccagttt

SEQ ID NO: 7876552 - DNA, 22 bp, Homo sapiens
accagccaccaccaggagatcg

SEQ ID NO: 7876553 - DNA, 22 bp, Homo sapiens
agggggcattatgaggcttttc

SEQ ID NO: 7876554 - DNA, 22 bp, Homo sapiens
agggggcattatgaggcttttc

SEQ ID NO: 7876555 - DNA, 22 bp, Homo sapiens
agggggcattatgaggcttttc

SEQ ID NO: 7876556 - DNA, 22 bp, Homo sapiens
agggggctcagcaggctctgga

SEQ ID NO: 7876557 - DNA, 22 bp, Homo sapiens
agggggctcagcaggctctgga

SEQ ID NO: 7876558 - DNA, 22 bp, Homo sapiens
agggggctcagcaggctctgga

SEQ ID NO: 7876559 - DNA, 22 bp, Homo sapiens
agggggctcagcatggatggag

SEQ ID NO: 7876560 - DNA, 22 bp, Homo sapiens
agggggctcagcatggatggag

SEQ ID NO: 7876561 - DNA, 22 bp, Homo sapiens
agggggctcagcatggatggag

SEQ ID NO: 7876562 - DNA, 22 bp, Homo sapiens
agggggctcctccggtgcttcc

SEQ ID NO: 7876563 - DNA, 22 bp, Homo sapiens
accctcagtaatcgtgcagttt

SEQ ID NO: 7876564 - DNA, 22 bp, Homo sapiens
accctcagtaatcgtgcagttt

SEQ ID NO: 7876565 - DNA, 22 bp, Homo sapiens
agggggctcagtgactgaagtg

SEQ ID NO: 7876566 - DNA, 22 bp, Homo sapiens
accctccactttatctgtcttt

SEQ ID NO: 7876567 - DNA, 22 bp, Homo sapiens
accctccactttatctgtcttt

SEQ ID NO: 7876568 - DNA, 20 bp, Homo sapiens
accctccactgttcactgtg

SEQ ID NO: 7876569 - DNA, 22 bp, Homo sapiens
accctccactttatctgtcttt

SEQ ID NO: 7876570 - DNA, 22 bp, Homo sapiens
accctccactttatctgtcttt

SEQ ID NO: 7876571 - DNA, 22 bp, Homo sapiens
accctccaggcgggcttgtgac

SEQ ID NO: 7876572 - DNA, 22 bp, Homo sapiens
accctccaggcgggcttgtgac

SEQ ID NO: 7876573 - DNA, 20 bp, Homo sapiens
accctccactgttcactgtg

SEQ ID NO: 7876574 - DNA, 22 bp, Homo sapiens
agggggctcagcatggatggag

SEQ ID NO: 7876575 - DNA, 22 bp, Homo sapiens
accctccacaccagtcttattt

SEQ ID NO: 7876576 - DNA, 22 bp, Homo sapiens
agggggaggctgtgctgcgtct

SEQ ID NO: 7876577 - DNA, 22 bp, Homo sapiens
agggggagtttcagttagaaag

SEQ ID NO: 7876578 - DNA, 22 bp, Homo sapiens
aggggcctggttggcctctgtt

SEQ ID NO: 7876579 - DNA, 22 bp, Homo sapiens
agggggaggctgtgctgcgtct

SEQ ID NO: 7876580 - DNA, 22 bp, Homo sapiens
agggggaggctgtgctgcgtct

SEQ ID NO: 7876581 - DNA, 22 bp, Homo sapiens
acccaggctggcgtgcagtggc

SEQ ID NO: 7876582 - DNA, 22 bp, Homo sapiens
acccaggctggcgtgcagtggc

SEQ ID NO: 7876583 - DNA, 22 bp, Homo sapiens
acccaggctggcgtgcagtggc

SEQ ID NO: 7876584 - DNA, 22 bp, Homo sapiens
aggggcctggcactgagctggc

SEQ ID NO: 7876585 - DNA, 22 bp, Homo sapiens
aggggcctggcactgagctggc

SEQ ID NO: 7876586 - DNA, 22 bp, Homo sapiens
agggggcatcaggtcctggctc

SEQ ID NO: 7876587 - DNA, 22 bp, Homo sapiens
agggggcatcaggtcctggctc

SEQ ID NO: 7876588 - DNA, 22 bp, Homo sapiens
agggggcatcaggtcctggctc

SEQ ID NO: 7876589 - DNA, 22 bp, Homo sapiens
agggggcatcaggtcctggctc

SEQ ID NO: 7876590 - DNA, 22 bp, Homo sapiens
agggggcattatgaggcttttc

SEQ ID NO: 7876591 - DNA, 22 bp, Homo sapiens
agggggcatcaggtcctggctc

SEQ ID NO: 7876592 - DNA, 22 bp, Homo sapiens
agggggcaggagagacctgctg

SEQ ID NO: 7876593 - DNA, 22 bp, Homo sapiens
agggggcaggagagacctgctg

SEQ ID NO: 7876594 - DNA, 22 bp, Homo sapiens
agggggcaggagagacctgctg

SEQ ID NO: 7876595 - DNA, 22 bp, Homo sapiens
agggggcaggagagacctgctg

SEQ ID NO: 7876596 - DNA, 22 bp, Homo sapiens
agggggcaggagagacctgctg

SEQ ID NO: 7876597 - DNA, 22 bp, Homo sapiens
agggggagtttcagttagaaag

SEQ ID NO: 7876598 - DNA, 22 bp, Homo sapiens
agggggagtttcagttagaaag

SEQ ID NO: 7876599 - DNA, 22 bp, Homo sapiens
agggggcaggagagacctgctg

SEQ ID NO: 7876600 - DNA, 22 bp, Homo sapiens
agggctgcctgactccagagcc

SEQ ID NO: 7876601 - DNA, 22 bp, Homo sapiens
agggctgcctgactccagagcc

SEQ ID NO: 7876602 - DNA, 22 bp, Homo sapiens
agggctgcctgactccagagcc

SEQ ID NO: 7876603 - DNA, 22 bp, Homo sapiens
acccaggctggagtgcagtgac

SEQ ID NO: 7876604 - DNA, 22 bp, Homo sapiens
acccaggctggagtgcagtgat

SEQ ID NO: 7876605 - DNA, 22 bp, Homo sapiens
acccaggctggagtgcagtgat

SEQ ID NO: 7876606 - DNA, 22 bp, Homo sapiens
acccaggctggagtgcagtgat

SEQ ID NO: 7876607 - DNA, 22 bp, Homo sapiens
acccaggctggagtgcagtgac

SEQ ID NO: 7876608 - DNA, 22 bp, Homo sapiens
acccaggctggagtgcagtgac

SEQ ID NO: 7876609 - DNA, 22 bp, Homo sapiens
acccaggctggagtgcagtgac

SEQ ID NO: 7876610 - DNA, 22 bp, Homo sapiens
agggctgctgaggaagccttgc

SEQ ID NO: 7876611 - DNA, 22 bp, Homo sapiens
agggctgctcctccttcaggcc

SEQ ID NO: 7876612 - DNA, 22 bp, Homo sapiens
agggctgctcctccttcaggcc

SEQ ID NO: 7876613 - DNA, 22 bp, Homo sapiens
acccaggctggagtgcagtgat

SEQ ID NO: 7876614 - DNA, 22 bp, Homo sapiens
acccaggctggagtgcagtgat

SEQ ID NO: 7876615 - DNA, 22 bp, Homo sapiens
acccaggctggagtgcagtgat

SEQ ID NO: 7876616 - DNA, 22 bp, Homo sapiens
acccaggctggagtgcagtggc

SEQ ID NO: 7876617 - DNA, 22 bp, Homo sapiens
acccaggctggagtgcagtggc

SEQ ID NO: 7876618 - DNA, 22 bp, Homo sapiens
acccaggctggagtgcagtggc

SEQ ID NO: 7876619 - DNA, 22 bp, Homo sapiens
acccaggctggagtgcagtggc

SEQ ID NO: 7876620 - DNA, 22 bp, Homo sapiens
acccaggctggagtgcagtggg

SEQ ID NO: 7876621 - DNA, 22 bp, Homo sapiens
acccaggctggagtgcagtggg

SEQ ID NO: 7876622 - DNA, 22 bp, Homo sapiens
acccaggctggagtgcagtggg

SEQ ID NO: 7876623 - DNA, 22 bp, Homo sapiens
acccaggctggagtgcagtggc

SEQ ID NO: 7876624 - DNA, 22 bp, Homo sapiens
acccaggctggagtgcagtggc

SEQ ID NO: 7876625 - DNA, 22 bp, Homo sapiens
acccaggctggagtgcagtggg

SEQ ID NO: 7876626 - DNA, 22 bp, Homo sapiens
acccaggctggagtgcagtggg

SEQ ID NO: 7876627 - DNA, 22 bp, Homo sapiens
acccaggctggagtgcagtggg

SEQ ID NO: 7876628 - DNA, 22 bp, Homo sapiens
acccaggctggagtgcagtgtc

SEQ ID NO: 7876629 - DNA, 22 bp, Homo sapiens
acccaggctggagtgcagtgtc

SEQ ID NO: 7876630 - DNA, 22 bp, Homo sapiens
acccaggctggagtgcagtgtc

SEQ ID NO: 7876631 - DNA, 22 bp, Homo sapiens
acccaggctggcagaggctcct

SEQ ID NO: 7876632 - DNA, 22 bp, Homo sapiens
acccaggctggcgtgcagtggc

SEQ ID NO: 7876633 - DNA, 22 bp, Homo sapiens
acccaggctggagtgcagtgtc

SEQ ID NO: 7876634 - DNA, 22 bp, Homo sapiens
acccaggctggagtgcagtggt

SEQ ID NO: 7876635 - DNA, 22 bp, Homo sapiens
acccaggctggagtgcagtggt

SEQ ID NO: 7876636 - DNA, 22 bp, Homo sapiens
acccaggctggagtgcagtgtc

SEQ ID NO: 7876637 - DNA, 22 bp, Homo sapiens
acccaggctggagtgcagtgtc

SEQ ID NO: 7876638 - DNA, 22 bp, Homo sapiens
acccaggctggagtgcagtggt

SEQ ID NO: 7876639 - DNA, 22 bp, Homo sapiens
acccaggctggagtgcagtggt

SEQ ID NO: 7876640 - DNA, 22 bp, Homo sapiens
acccaggctggagtgcagtggt

SEQ ID NO: 7876641 - DNA, 22 bp, Homo sapiens
acccaggctggagtgcagtggt

SEQ ID NO: 7876642 - DNA, 22 bp, Homo sapiens
agggctgacagtgaggagtcaa

SEQ ID NO: 7876643 - DNA, 22 bp, Homo sapiens
agggctgacagtgaggagtcaa

SEQ ID NO: 7876644 - DNA, 22 bp, Homo sapiens
acccaggagagagctataaaat

SEQ ID NO: 7876645 - DNA, 22 bp, Homo sapiens
agggctgcccagtgtgagagct

SEQ ID NO: 7876646 - DNA, 22 bp, Homo sapiens
agggctgccccagtccagccgg

SEQ ID NO: 7876647 - DNA, 22 bp, Homo sapiens
agggctgccccagtccagccgg

SEQ ID NO: 7876648 - DNA, 22 bp, Homo sapiens
acccaggagacggaggtgcagt

SEQ ID NO: 7876649 - DNA, 22 bp, Homo sapiens
acccaggagacggaggtgcagt

SEQ ID NO: 7876650 - DNA, 22 bp, Homo sapiens
acccaggagacggaggtgcagt

SEQ ID NO: 7876651 - DNA, 22 bp, Homo sapiens
acccaggagacaggttgcagtg

SEQ ID NO: 7876652 - DNA, 22 bp, Homo sapiens
acccaggagacggaggtgcagt

SEQ ID NO: 7876653 - DNA, 22 bp, Homo sapiens
acccaggagacggaggtgcagt

SEQ ID NO: 7876654 - DNA, 22 bp, Homo sapiens
acccaggagagagctataaaat

SEQ ID NO: 7876655 - DNA, 22 bp, Homo sapiens
acccaggacttggcaacctcat

SEQ ID NO: 7876656 - DNA, 22 bp, Homo sapiens
acccaggacttggcaacctcat

SEQ ID NO: 7876657 - DNA, 22 bp, Homo sapiens
acccaggagacaggttgcagtg

SEQ ID NO: 7876658 - DNA, 22 bp, Homo sapiens
acccaggagacaggttgcagtg

SEQ ID NO: 7876659 - DNA, 22 bp, Homo sapiens
acccaggacatgggcacccgtg

SEQ ID NO: 7876660 - DNA, 22 bp, Homo sapiens
acccaggactctcttccagtag

SEQ ID NO: 7876661 - DNA, 22 bp, Homo sapiens
acccaggactctcttccagtag

SEQ ID NO: 7876662 - DNA, 22 bp, Homo sapiens
acccagctaaccctaccctgga

SEQ ID NO: 7876663 - DNA, 20 bp, Homo sapiens
acccagctctgtgccctggg

SEQ ID NO: 7876664 - DNA, 20 bp, Homo sapiens
acccagctctgtgccctggg

SEQ ID NO: 7876665 - DNA, 22 bp, Homo sapiens
acccagctaaccctaccctgga

SEQ ID NO: 7876666 - DNA, 22 bp, Homo sapiens
acccagctggatgcatggaggc

SEQ ID NO: 7876667 - DNA, 22 bp, Homo sapiens
acccagctggatgcatggaggc

SEQ ID NO: 7876668 - DNA, 22 bp, Homo sapiens
acccagctctttgatggtcttg

SEQ ID NO: 7876669 - DNA, 22 bp, Homo sapiens
acccagctctttgatggtcttg

SEQ ID NO: 7876670 - DNA, 22 bp, Homo sapiens
acccagctggatgcatggaggc

SEQ ID NO: 7876671 - DNA, 22 bp, Homo sapiens
acccaggacacagagatgaccc

SEQ ID NO: 7876672 - DNA, 22 bp, Homo sapiens
acccaggacacagagatgaccc

SEQ ID NO: 7876673 - DNA, 22 bp, Homo sapiens
acccaggacatgggcacccgtg

SEQ ID NO: 7876674 - DNA, 22 bp, Homo sapiens
acccaggacacagagatgaccc

SEQ ID NO: 7876675 - DNA, 22 bp, Homo sapiens
acccaggacacagagatgaccc

SEQ ID NO: 7876676 - DNA, 22 bp, Homo sapiens
acccaggacacagagatgaccc

SEQ ID NO: 7876677 - DNA, 22 bp, Homo sapiens
acccaggacaaaataaccaggt

SEQ ID NO: 7876678 - DNA, 22 bp, Homo sapiens
acccaggacaaaataaccaggt

SEQ ID NO: 7876679 - DNA, 22 bp, Homo sapiens
acccaggaaaacatggtgcaga

SEQ ID NO: 7876680 - DNA, 22 bp, Homo sapiens
acccaggacaaaataaccaggt

SEQ ID NO: 7876681 - DNA, 22 bp, Homo sapiens
acccagctgtttcccgtgtcat

SEQ ID NO: 7876682 - DNA, 22 bp, Homo sapiens
acccaggaaaacatggtgcaga

SEQ ID NO: 7876683 - DNA, 22 bp, Homo sapiens
acccaggaaaacatggtgcaga

SEQ ID NO: 7876684 - DNA, 22 bp, Homo sapiens
acccaggaaaacatggtgcaga

SEQ ID NO: 7876685 - DNA, 22 bp, Homo sapiens
acccagcatgacacctgcacat

SEQ ID NO: 7876686 - DNA, 22 bp, Homo sapiens
acccagccacagcattgaggga

SEQ ID NO: 7876687 - DNA, 22 bp, Homo sapiens
acccagccatgttcagttctct

SEQ ID NO: 7876688 - DNA, 22 bp, Homo sapiens
acccagccacagcattgaggga

SEQ ID NO: 7876689 - DNA, 22 bp, Homo sapiens
acccagagcccttagcacagac

SEQ ID NO: 7876690 - DNA, 22 bp, Homo sapiens
acccagagtgtctgtctcagtc

SEQ ID NO: 7876691 - DNA, 22 bp, Homo sapiens
acccagcatgacacctgcacat

SEQ ID NO: 7876692 - DNA, 22 bp, Homo sapiens
acccagcatgacacctgcacat

SEQ ID NO: 7876693 - DNA, 22 bp, Homo sapiens
acccagcctacaaagctcacct

SEQ ID NO: 7876694 - DNA, 22 bp, Homo sapiens
acccagcctacaaagctcacct

SEQ ID NO: 7876695 - DNA, 19 bp, Homo sapiens
acccagcccaggagtggca

SEQ ID NO: 7876696 - DNA, 19 bp, Homo sapiens
acccagcccaggagtggca

SEQ ID NO: 7876697 - DNA, 22 bp, Homo sapiens
acccagcccagaatctggggcc

SEQ ID NO: 7876698 - DNA, 22 bp, Homo sapiens
acccagccatgttcagttctct

SEQ ID NO: 7876699 - DNA, 19 bp, Homo sapiens
acccagcccaggagtggca

SEQ ID NO: 7876700 - DNA, 22 bp, Homo sapiens
acccagcccagaatctggggcc

SEQ ID NO: 7876701 - DNA, 22 bp, Homo sapiens
acccagcccagaatctggggcc

SEQ ID NO: 7876702 - DNA, 22 bp, Homo sapiens
acccagcccagaatctggggcc

SEQ ID NO: 7876703 - DNA, 19 bp, Homo sapiens
acccagcccaggagtggca

SEQ ID NO: 7876704 - DNA, 22 bp, Homo sapiens
accaggctggagtgcagtggcg

SEQ ID NO: 7876705 - DNA, 22 bp, Homo sapiens
accaggctggagtgcagtggcg

SEQ ID NO: 7876706 - DNA, 22 bp, Homo sapiens
accaggctgtgaagtgagacta

SEQ ID NO: 7876707 - DNA, 22 bp, Homo sapiens
accaggctggagtgcagtggcg

SEQ ID NO: 7876708 - DNA, 22 bp, Homo sapiens
accaggctggagtgcagtggcg

SEQ ID NO: 7876709 - DNA, 22 bp, Homo sapiens
accaggctggagtgcagtggcg

SEQ ID NO: 7876710 - DNA, 22 bp, Homo sapiens
accaggctggagtgcagtggcg

SEQ ID NO: 7876711 - DNA, 22 bp, Homo sapiens
acccagagcagagcttggcttc

SEQ ID NO: 7876712 - DNA, 22 bp, Homo sapiens
acccagagcagagcttggcttc

SEQ ID NO: 7876713 - DNA, 22 bp, Homo sapiens
acccagagccagggtcaggagc

SEQ ID NO: 7876714 - DNA, 22 bp, Homo sapiens
acccagagccagggtcaggagc

SEQ ID NO: 7876715 - DNA, 22 bp, Homo sapiens
accaggcctggctgggcagcca

SEQ ID NO: 7876716 - DNA, 22 bp, Homo sapiens
accaggcctggctgggcagcca

SEQ ID NO: 7876717 - DNA, 22 bp, Homo sapiens
accaggcctggctgggcagcca

SEQ ID NO: 7876718 - DNA, 22 bp, Homo sapiens
accaggcctggctgggcagcca

SEQ ID NO: 7876719 - DNA, 22 bp, Homo sapiens
accaggcctggctgggcagcca

SEQ ID NO: 7876720 - DNA, 22 bp, Homo sapiens
accaggctccccttggatcctg

SEQ ID NO: 7876721 - DNA, 22 bp, Homo sapiens
accaggctccccttggatcctg

SEQ ID NO: 7876722 - DNA, 22 bp, Homo sapiens
accaggctccccttggatcctg

SEQ ID NO: 7876723 - DNA, 22 bp, Homo sapiens
accaggctctgccagtgtttac

SEQ ID NO: 7876724 - DNA, 22 bp, Homo sapiens
accaggctggagtgcagtggcg

SEQ ID NO: 7876725 - DNA, 22 bp, Homo sapiens
accaggctctgccagtgtttac

SEQ ID NO: 7876726 - DNA, 22 bp, Homo sapiens
acatttgaaataaactcaagtg

SEQ ID NO: 7876727 - DNA, 22 bp, Homo sapiens
acatttgaaatgccatgtgagg

SEQ ID NO: 7876728 - DNA, 22 bp, Homo sapiens
acatttcttttcatctctatat

SEQ ID NO: 7876729 - DNA, 22 bp, Homo sapiens
acatttcttttcatctctatat

SEQ ID NO: 7876730 - DNA, 22 bp, Homo sapiens
acatttcttttcatctctatat

SEQ ID NO: 7876731 - DNA, 22 bp, Homo sapiens
acatttgaaattctgaacagat

SEQ ID NO: 7876732 - DNA, 22 bp, Homo sapiens
acatttgaagacgacagtggaa

SEQ ID NO: 7876733 - DNA, 22 bp, Homo sapiens
acatttgaaatgccatgtgagg

SEQ ID NO: 7876734 - DNA, 22 bp, Homo sapiens
acatttgaaatgccatgtgagg

SEQ ID NO: 7876735 - DNA, 22 bp, Homo sapiens
acatttgaaatgccatgtgagg

SEQ ID NO: 7876736 - DNA, 22 bp, Homo sapiens
acatttgacatttagtatcagc

SEQ ID NO: 7876737 - DNA, 22 bp, Homo sapiens
acatttgacatttagtatcagc

SEQ ID NO: 7876738 - DNA, 22 bp, Homo sapiens
acatttgagatgccttttaggt

SEQ ID NO: 7876739 - DNA, 22 bp, Homo sapiens
acatttgagatgccttttaggt

SEQ ID NO: 7876740 - DNA, 22 bp, Homo sapiens
acatttgagcatctactaagtg

SEQ ID NO: 7876741 - DNA, 22 bp, Homo sapiens
acatttgagcatctactaagtg

SEQ ID NO: 7876742 - DNA, 22 bp, Homo sapiens
acatttgactctgttcatatta

SEQ ID NO: 7876743 - DNA, 22 bp, Homo sapiens
acatttggcatcttgtaacact

SEQ ID NO: 7876744 - DNA, 19 bp, Homo sapiens
acatttggcattttctctt

SEQ ID NO: 7876745 - DNA, 22 bp, Homo sapiens
acatttggcaagaaagagaaac

SEQ ID NO: 7876746 - DNA, 22 bp, Homo sapiens
acatttggacaatagtagacaa

SEQ ID NO: 7876747 - DNA, 23 bp, Homo sapiens
acatttggccaaaaattatttct

SEQ ID NO: 7876748 - DNA, 23 bp, Homo sapiens
acatttggccaaaaattatttct

SEQ ID NO: 7876749 - DNA, 19 bp, Homo sapiens
acatttggcattttctctt

SEQ ID NO: 7876750 - DNA, 22 bp, Homo sapiens
acatttgggaccctctcttcac

SEQ ID NO: 7876751 - DNA, 22 bp, Homo sapiens
acatttggcttttggagtaaga

SEQ ID NO: 7876752 - DNA, 22 bp, Homo sapiens
acatttgggaccctctcttcac

SEQ ID NO: 7876753 - DNA, 22 bp, Homo sapiens
acatttggttgagctgttgtca

SEQ ID NO: 7876754 - DNA, 22 bp, Homo sapiens
acatttggtaacacttgagcat

SEQ ID NO: 7876755 - DNA, 18 bp, Homo sapiens
acatttggggagttaagt

SEQ ID NO: 7876756 - DNA, 18 bp, Homo sapiens
acatttggggagttaagt

SEQ ID NO: 7876757 - DNA, 20 bp, Homo sapiens
acatttgagtatcatctact

SEQ ID NO: 7876758 - DNA, 20 bp, Homo sapiens
acatttgagtatcatctact

SEQ ID NO: 7876759 - DNA, 22 bp, Homo sapiens
acatttgaggatgttaagaatg

SEQ ID NO: 7876760 - DNA, 22 bp, Homo sapiens
acatttgaggatgttaagaatg

SEQ ID NO: 7876761 - DNA, 22 bp, Homo sapiens
acatttgaggatgttaagaatg

SEQ ID NO: 7876762 - DNA, 22 bp, Homo sapiens
acatttgaggatgttaagaatg

SEQ ID NO: 7876763 - DNA, 22 bp, Homo sapiens
acatttgagtcatatttgctta

SEQ ID NO: 7876764 - DNA, 22 bp, Homo sapiens
acatttgatatggagttgtgta

SEQ ID NO: 7876765 - DNA, 22 bp, Homo sapiens
acatttgattgatgaatcaaat

SEQ ID NO: 7876766 - DNA, 22 bp, Homo sapiens
acatttgattgatgaatcaaat

SEQ ID NO: 7876767 - DNA, 22 bp, Homo sapiens
acatttgattgatgaatcaaat

SEQ ID NO: 7876768 - DNA, 22 bp, Homo sapiens
acatttctttctattcagtagc

SEQ ID NO: 7876769 - DNA, 22 bp, Homo sapiens
acatttctttctattcagtagc

SEQ ID NO: 7876770 - DNA, 22 bp, Homo sapiens
acatttcttgatgcctctgtga

SEQ ID NO: 7876771 - DNA, 22 bp, Homo sapiens
acatttcttcctaattatccct

SEQ ID NO: 7876772 - DNA, 22 bp, Homo sapiens
acatttctcttgatgtctctat

SEQ ID NO: 7876773 - DNA, 22 bp, Homo sapiens
acatttcttgatgcctctgtga

SEQ ID NO: 7876774 - DNA, 22 bp, Homo sapiens
acatttcttgatgcctctgtga

SEQ ID NO: 7876775 - DNA, 22 bp, Homo sapiens
aggctgaggagggatgttgctt

SEQ ID NO: 7876776 - DNA, 22 bp, Homo sapiens
aggctgaggagggatgttgctt

SEQ ID NO: 7876777 - DNA, 22 bp, Homo sapiens
acatttctcttgatgtctctat

SEQ ID NO: 7876778 - DNA, 22 bp, Homo sapiens
acatttctcttgatgtctctat

SEQ ID NO: 7876779 - DNA, 22 bp, Homo sapiens
acatttcttttcatctctatat

SEQ ID NO: 7876780 - DNA, 22 bp, Homo sapiens
acatttcttttcatctctatat

SEQ ID NO: 7876781 - DNA, 22 bp, Homo sapiens
acatttctttgctagacagcag

SEQ ID NO: 7876782 - DNA, 22 bp, Homo sapiens
acatttctttgctagacagcag

SEQ ID NO: 7876783 - DNA, 22 bp, Homo sapiens
acatttctttctattcagtagc

SEQ ID NO: 7876784 - DNA, 22 bp, Homo sapiens
acatttctttgctagacagcag

SEQ ID NO: 7876785 - DNA, 22 bp, Homo sapiens
acatttctttctattcagtagc

SEQ ID NO: 7876786 - DNA, 22 bp, Homo sapiens
aggctgagctggcccttgaaat

SEQ ID NO: 7876787 - DNA, 22 bp, Homo sapiens
aggctgagctggcccttgaaat

SEQ ID NO: 7876788 - DNA, 22 bp, Homo sapiens
aggctgagctggcccttgaaat

SEQ ID NO: 7876789 - DNA, 22 bp, Homo sapiens
aggctgagctggcccttgaaat

SEQ ID NO: 7876790 - DNA, 22 bp, Homo sapiens
acatttctcagggagttttgct

SEQ ID NO: 7876791 - DNA, 22 bp, Homo sapiens
aggctgagctggcccttgaaat

SEQ ID NO: 7876792 - DNA, 22 bp, Homo sapiens
aggctgagctggcccttgaaat

SEQ ID NO: 7876793 - DNA, 22 bp, Homo sapiens
aggctgagctggcccttgaaat

SEQ ID NO: 7876794 - DNA, 22 bp, Homo sapiens
aggctgagctgacctggtttgg

SEQ ID NO: 7876795 - DNA, 22 bp, Homo sapiens
acatttctcagggagttttgct

SEQ ID NO: 7876796 - DNA, 22 bp, Homo sapiens
acatttctcagggagttttgct

SEQ ID NO: 7876797 - DNA, 22 bp, Homo sapiens
acatttctcagggagttttgct

SEQ ID NO: 7876798 - DNA, 22 bp, Homo sapiens
acatttctcagggagttttgct

SEQ ID NO: 7876799 - DNA, 18 bp, Homo sapiens
acatttctatgcttctgg

SEQ ID NO: 7876800 - DNA, 18 bp, Homo sapiens
acatttctatgcttctgg

SEQ ID NO: 7876801 - DNA, 18 bp, Homo sapiens
acatttctatgcttctgg

SEQ ID NO: 7876802 - DNA, 22 bp, Homo sapiens
acatttctcagggagttttgct

SEQ ID NO: 7876803 - DNA, 18 bp, Homo sapiens
acatttctatgcttctgg

SEQ ID NO: 7876804 - DNA, 22 bp, Homo sapiens
aggctgaggagggatgttgctt

SEQ ID NO: 7876805 - DNA, 22 bp, Homo sapiens
aggctgaggagggatgttgctt

SEQ ID NO: 7876806 - DNA, 22 bp, Homo sapiens
aggctgaggagggatgttgctt

SEQ ID NO: 7876807 - DNA, 22 bp, Homo sapiens
aggctgaggagggatgttgctt

SEQ ID NO: 7876808 - DNA, 22 bp, Homo sapiens
aggctgagctggtagtgagtac

SEQ ID NO: 7876809 - DNA, 22 bp, Homo sapiens
aggctgaggagggatgttgctt

SEQ ID NO: 7876810 - DNA, 22 bp, Homo sapiens
aggctgagctggtagtgagtac

SEQ ID NO: 7876811 - DNA, 22 bp, Homo sapiens
aggctgagctggtagtgagtac

SEQ ID NO: 7876812 - DNA, 22 bp, Homo sapiens
aggctgagctggtagtgagtac

SEQ ID NO: 7876813 - DNA, 22 bp, Homo sapiens
aggctgagctggtagtgagtac

SEQ ID NO: 7876814 - DNA, 22 bp, Homo sapiens
aggctgagctggtagtgagtac

SEQ ID NO: 7876815 - DNA, 22 bp, Homo sapiens
aggctgagctggtagtgagtac

SEQ ID NO: 7876816 - DNA, 22 bp, Homo sapiens
aggctgagctggtagtgagtac

SEQ ID NO: 7876817 - DNA, 22 bp, Homo sapiens
aggctgagctggtagtgagtac

SEQ ID NO: 7876818 - DNA, 22 bp, Homo sapiens
aggctgagctggtagtgagtac

SEQ ID NO: 7876819 - DNA, 22 bp, Homo sapiens
acattgtagacttttcatatgt

SEQ ID NO: 7876820 - DNA, 22 bp, Homo sapiens
acattgtagacttttcatatgt

SEQ ID NO: 7876821 - DNA, 22 bp, Homo sapiens
acattgtagacttttcatatgt

SEQ ID NO: 7876822 - DNA, 22 bp, Homo sapiens
acattgtagacttttcatatgt

SEQ ID NO: 7876823 - DNA, 22 bp, Homo sapiens
acattgtagacttttcatatgt

SEQ ID NO: 7876824 - DNA, 22 bp, Homo sapiens
acattgtagacttttcatatgt

SEQ ID NO: 7876825 - DNA, 22 bp, Homo sapiens
acattgtagacttttcatatgt

SEQ ID NO: 7876826 - DNA, 22 bp, Homo sapiens
acattgtagttgttctgcagca

SEQ ID NO: 7876827 - DNA, 22 bp, Homo sapiens
acattgtataatgattatcaca

SEQ ID NO: 7876828 - DNA, 22 bp, Homo sapiens
acattgtaagcatattagctga

SEQ ID NO: 7876829 - DNA, 22 bp, Homo sapiens
acattgtaaatacctttatcac

SEQ ID NO: 7876830 - DNA, 22 bp, Homo sapiens
acattgtaaatacctttatcac

SEQ ID NO: 7876831 - DNA, 19 bp, Homo sapiens
acattggacatggatcttg

SEQ ID NO: 7876832 - DNA, 22 bp, Homo sapiens
acattgctgcattctccttccc

SEQ ID NO: 7876833 - DNA, 22 bp, Homo sapiens
acattgctgatatcaatttttg

SEQ ID NO: 7876834 - DNA, 22 bp, Homo sapiens
acattgtaaatacctttatcac

SEQ ID NO: 7876835 - DNA, 22 bp, Homo sapiens
acattgtataatgattatcaca

SEQ ID NO: 7876836 - DNA, 22 bp, Homo sapiens
acattgtatacagacttagtca

SEQ ID NO: 7876837 - DNA, 22 bp, Homo sapiens
acattgtatacagacttagtca

SEQ ID NO: 7876838 - DNA, 22 bp, Homo sapiens
acattgtatacagacttagtca

SEQ ID NO: 7876839 - DNA, 22 bp, Homo sapiens
acatttcactgttcacagcagg

SEQ ID NO: 7876840 - DNA, 22 bp, Homo sapiens
acattgtatacagacttagtca

SEQ ID NO: 7876841 - DNA, 22 bp, Homo sapiens
acattgtataatgattatcaca

SEQ ID NO: 7876842 - DNA, 22 bp, Homo sapiens
acattgtataatgattatcaca

SEQ ID NO: 7876843 - DNA, 22 bp, Homo sapiens
acattgtataatgattatcaca

SEQ ID NO: 7876844 - DNA, 22 bp, Homo sapiens
acattgtataatgattatcaca

SEQ ID NO: 7876845 - DNA, 22 bp, Homo sapiens
acatttcctaacgtatacactg

SEQ ID NO: 7876846 - DNA, 22 bp, Homo sapiens
acatttccacagactgaggtca

SEQ ID NO: 7876847 - DNA, 22 bp, Homo sapiens
acatttcagaatcacacagctt

SEQ ID NO: 7876848 - DNA, 22 bp, Homo sapiens
acatttcactgttcacagcagg

SEQ ID NO: 7876849 - DNA, 22 bp, Homo sapiens
acatttcagaatcacacagctt

SEQ ID NO: 7876850 - DNA, 22 bp, Homo sapiens
acatttcctaacgtatacactg

SEQ ID NO: 7876851 - DNA, 22 bp, Homo sapiens
acatttctaatttaatgtaaca

SEQ ID NO: 7876852 - DNA, 22 bp, Homo sapiens
acatttctaatttaatgtaaca

SEQ ID NO: 7876853 - DNA, 22 bp, Homo sapiens
acatttctaatttaatgtaaca

SEQ ID NO: 7876854 - DNA, 22 bp, Homo sapiens
acatttctaatttaatgtaaca

SEQ ID NO: 7876855 - DNA, 22 bp, Homo sapiens
acatttctaatttaatgtaaca

SEQ ID NO: 7876856 - DNA, 18 bp, Homo sapiens
acatttctaggtgaaagc

SEQ ID NO: 7876857 - DNA, 22 bp, Homo sapiens
acatttctatagtgcatctgtt

SEQ ID NO: 7876858 - DNA, 18 bp, Homo sapiens
acatttctatgcttctgg

SEQ ID NO: 7876859 - DNA, 18 bp, Homo sapiens
acatttctatgcttctgg

SEQ ID NO: 7876860 - DNA, 22 bp, Homo sapiens
acatttctatcatcctgtaatg

SEQ ID NO: 7876861 - DNA, 22 bp, Homo sapiens
acatttctatcatcctgtaatg

SEQ ID NO: 7876862 - DNA, 22 bp, Homo sapiens
acatttctagttgttcatctcc

SEQ ID NO: 7876863 - DNA, 22 bp, Homo sapiens
acatttctagttgttcatctcc

SEQ ID NO: 7876864 - DNA, 22 bp, Homo sapiens
acatttctagttgttcatctcc

SEQ ID NO: 7876865 - DNA, 22 bp, Homo sapiens
acatttctagttgttcatctcc

SEQ ID NO: 7876866 - DNA, 22 bp, Homo sapiens
acatttctagttgttcatctcc

SEQ ID NO: 7876867 - DNA, 22 bp, Homo sapiens
acatttctatagtgcatctgtt

SEQ ID NO: 7876868 - DNA, 22 bp, Homo sapiens
aggctctgttattctagagggc

SEQ ID NO: 7876869 - DNA, 22 bp, Homo sapiens
aggctctgtttgctgtggtacc

SEQ ID NO: 7876870 - DNA, 22 bp, Homo sapiens
aggctctgtttgctgtggtacc

SEQ ID NO: 7876871 - DNA, 22 bp, Homo sapiens
aggctctgttattctagagggc

SEQ ID NO: 7876872 - DNA, 22 bp, Homo sapiens
aggctctgttattctagagggc

SEQ ID NO: 7876873 - DNA, 22 bp, Homo sapiens
aggctctgtttgctgtggtacc

SEQ ID NO: 7876874 - DNA, 22 bp, Homo sapiens
aggctcttcttttattaactga

SEQ ID NO: 7876875 - DNA, 22 bp, Homo sapiens
aggctctgtttgctgtggtacc

SEQ ID NO: 7876876 - DNA, 22 bp, Homo sapiens
aggctgaaaacgagatggcaat

SEQ ID NO: 7876877 - DNA, 22 bp, Homo sapiens
aggctgacggcttgcttgtatc

SEQ ID NO: 7876878 - DNA, 22 bp, Homo sapiens
aggctgacaagttcgtctaaag

SEQ ID NO: 7876879 - DNA, 22 bp, Homo sapiens
aggctgaaaacgagatggcaat

SEQ ID NO: 7876880 - DNA, 22 bp, Homo sapiens
aggctgaaaacgagatggcaat

SEQ ID NO: 7876881 - DNA, 22 bp, Homo sapiens
aggctctttgagactacctgga

SEQ ID NO: 7876882 - DNA, 22 bp, Homo sapiens
aggctctttgagactacctgga

SEQ ID NO: 7876883 - DNA, 22 bp, Homo sapiens
aggctctttgagactacctgga

SEQ ID NO: 7876884 - DNA, 22 bp, Homo sapiens
aggcctgaggttcctgtgctca

SEQ ID NO: 7876885 - DNA, 22 bp, Homo sapiens
aggcctgaggttcctgtgctca

SEQ ID NO: 7876886 - DNA, 22 bp, Homo sapiens
aggcctgaggaccttctggagg

SEQ ID NO: 7876887 - DNA, 22 bp, Homo sapiens
aggcctgcagcaggagcaaacc

SEQ ID NO: 7876888 - DNA, 18 bp, Homo sapiens
aggcctgcccagcactgt

SEQ ID NO: 7876889 - DNA, 18 bp, Homo sapiens
aggcctgcccagcactgt

SEQ ID NO: 7876890 - DNA, 22 bp, Homo sapiens
aggcctgcccgtgggacctgtg

SEQ ID NO: 7876891 - DNA, 22 bp, Homo sapiens
aggcctgcccgtgggacctgtg

SEQ ID NO: 7876892 - DNA, 22 bp, Homo sapiens
aggctctggctactacagagct

SEQ ID NO: 7876893 - DNA, 22 bp, Homo sapiens
aggctctggctactacagagct

SEQ ID NO: 7876894 - DNA, 22 bp, Homo sapiens
aggctctggctactacagagct

SEQ ID NO: 7876895 - DNA, 22 bp, Homo sapiens
aggctctgttattctagagggc

SEQ ID NO: 7876896 - DNA, 22 bp, Homo sapiens
aggctctgggaacagacgggtg

SEQ ID NO: 7876897 - DNA, 22 bp, Homo sapiens
aggctctggctactacagagct

SEQ ID NO: 7876898 - DNA, 22 bp, Homo sapiens
aggctgagaaagtgggaagatg

SEQ ID NO: 7876899 - DNA, 22 bp, Homo sapiens
aggctgagaaagtgggaagatg

SEQ ID NO: 7876900 - DNA, 22 bp, Homo sapiens
aggctgagaaagtgggaagatg

SEQ ID NO: 7876901 - DNA, 22 bp, Homo sapiens
aggctgagaaagtgggaagatg

SEQ ID NO: 7876902 - DNA, 22 bp, Homo sapiens
aggctgagaaagtgggaagatg

SEQ ID NO: 7876903 - DNA, 22 bp, Homo sapiens
aggctgagaaagtgggaagatg

SEQ ID NO: 7876904 - DNA, 22 bp, Homo sapiens
acattgatatttcaaatacagg

SEQ ID NO: 7876905 - DNA, 22 bp, Homo sapiens
acattgatatttcaaatacagg

SEQ ID NO: 7876906 - DNA, 22 bp, Homo sapiens
acattgatatttcaaatacagg

SEQ ID NO: 7876907 - DNA, 22 bp, Homo sapiens
aggctgagactgtgcattagtg

SEQ ID NO: 7876908 - DNA, 22 bp, Homo sapiens
aggctgagactgtgcattagtg

SEQ ID NO: 7876909 - DNA, 22 bp, Homo sapiens
aggctgagactgtgcattagtg

SEQ ID NO: 7876910 - DNA, 22 bp, Homo sapiens
aggctgagactgtgcattagtg

SEQ ID NO: 7876911 - DNA, 22 bp, Homo sapiens
aggctgagaaagtgggaagatg

SEQ ID NO: 7876912 - DNA, 18 bp, Homo sapiens
acattgatggctttaagc

SEQ ID NO: 7876913 - DNA, 18 bp, Homo sapiens
acattgatggctttaagc

SEQ ID NO: 7876914 - DNA, 20 bp, Homo sapiens
acattgattatgtttgtaga

SEQ ID NO: 7876915 - DNA, 22 bp, Homo sapiens
acattgatgtgatgcagaagtg

SEQ ID NO: 7876916 - DNA, 22 bp, Homo sapiens
acattgatcagcctcccatgca

SEQ ID NO: 7876917 - DNA, 22 bp, Homo sapiens
acattgatcagcctcccatgca

SEQ ID NO: 7876918 - DNA, 22 bp, Homo sapiens
acattgatgaaaaggtatcatt

SEQ ID NO: 7876919 - DNA, 22 bp, Homo sapiens
acattgatgaaaaggtatcatt

SEQ ID NO: 7876920 - DNA, 22 bp, Homo sapiens
acattgatgatcccacttacag

SEQ ID NO: 7876921 - DNA, 22 bp, Homo sapiens
acattgattgagcacccattat

SEQ ID NO: 7876922 - DNA, 22 bp, Homo sapiens
aggctgagactgtgcattagtg

SEQ ID NO: 7876923 - DNA, 20 bp, Homo sapiens
acattgattatgtttgtaga

SEQ ID NO: 7876924 - DNA, 22 bp, Homo sapiens
acattgcaataataattctctt

SEQ ID NO: 7876925 - DNA, 21 bp, Homo sapiens
aggcctcttcatggccatgat

SEQ ID NO: 7876926 - DNA, 20 bp, Homo sapiens
aggcctcttcatgacagctg

SEQ ID NO: 7876927 - DNA, 20 bp, Homo sapiens
aggcctcttcatgacagctg

SEQ ID NO: 7876928 - DNA, 20 bp, Homo sapiens
aggcctcttcatgacagctg

SEQ ID NO: 7876929 - DNA, 21 bp, Homo sapiens
aggcctcttcatggccatgat

SEQ ID NO: 7876930 - DNA, 22 bp, Homo sapiens
aggcctcttcagggagcatgga

SEQ ID NO: 7876931 - DNA, 22 bp, Homo sapiens
aggcctcttcagggagcatgga

SEQ ID NO: 7876932 - DNA, 22 bp, Homo sapiens
aggcctcttcagggagcatgga

SEQ ID NO: 7876933 - DNA, 22 bp, Homo sapiens
aggcctcttcagggagcatgga

SEQ ID NO: 7876934 - DNA, 22 bp, Homo sapiens
aggcctctgggtctcctctgac

SEQ ID NO: 7876935 - DNA, 22 bp, Homo sapiens
aggcctctgtagggccctgaag

SEQ ID NO: 7876936 - DNA, 22 bp, Homo sapiens
aggcctctgtctttatatgact

SEQ ID NO: 7876937 - DNA, 22 bp, Homo sapiens
aggcctctgtagggccctgaag

SEQ ID NO: 7876938 - DNA, 18 bp, Homo sapiens
aggcctctgtgtgcccag

SEQ ID NO: 7876939 - DNA, 18 bp, Homo sapiens
aggcctctgtgtgcccag

SEQ ID NO: 7876940 - DNA, 18 bp, Homo sapiens
aggcctctgtgtgcccag

SEQ ID NO: 7876941 - DNA, 18 bp, Homo sapiens
aggcctctgtgtgcccag

SEQ ID NO: 7876942 - DNA, 22 bp, Homo sapiens
aggcctgagcagaggagtggac

SEQ ID NO: 7876943 - DNA, 20 bp, Homo sapiens
aggcctgagagatgactggg

SEQ ID NO: 7876944 - DNA, 22 bp, Homo sapiens
aggcctgaggaccttctggagg

SEQ ID NO: 7876945 - DNA, 22 bp, Homo sapiens
aggcctgaagtgtggagtgggg

SEQ ID NO: 7876946 - DNA, 22 bp, Homo sapiens
aggcctgaaggaagatgagctg

SEQ ID NO: 7876947 - DNA, 22 bp, Homo sapiens
aggcctcttgtcttcctcacat

SEQ ID NO: 7876948 - DNA, 22 bp, Homo sapiens
aggcctcttgtcttcctcacat

SEQ ID NO: 7876949 - DNA, 22 bp, Homo sapiens
acatgtttaagtttaatgaaaa

SEQ ID NO: 7876950 - DNA, 22 bp, Homo sapiens
acatgtttaagtttaatgaaaa

SEQ ID NO: 7876951 - DNA, 22 bp, Homo sapiens
acatgtttaagtttgttatatg

SEQ ID NO: 7876952 - DNA, 22 bp, Homo sapiens
acatgtttaagtttgttatatg

SEQ ID NO: 7876953 - DNA, 22 bp, Homo sapiens
acatgtttaagtttaatgaaaa

SEQ ID NO: 7876954 - DNA, 22 bp, Homo sapiens
acatgtttaagtttaatgaaaa

SEQ ID NO: 7876955 - DNA, 22 bp, Homo sapiens
acatgtttaagtttgttatatg

SEQ ID NO: 7876956 - DNA, 22 bp, Homo sapiens
acatgtttaagtttgttatatg

SEQ ID NO: 7876957 - DNA, 22 bp, Homo sapiens
acatgtttaagtttgttatatg

SEQ ID NO: 7876958 - DNA, 22 bp, Homo sapiens
acatgtttacattaggtgatat

SEQ ID NO: 7876959 - DNA, 22 bp, Homo sapiens
acatgtttgataaatatttggg

SEQ ID NO: 7876960 - DNA, 22 bp, Homo sapiens
acatgtttgataaatatttggg

SEQ ID NO: 7876961 - DNA, 22 bp, Homo sapiens
acatgtttgcctgcaggcttag

SEQ ID NO: 7876962 - DNA, 22 bp, Homo sapiens
acatgtttggctctatgctata

SEQ ID NO: 7876963 - DNA, 22 bp, Homo sapiens
acatgtttggctctatgctata

SEQ ID NO: 7876964 - DNA, 22 bp, Homo sapiens
acatgtttggctctatgctata

SEQ ID NO: 7876965 - DNA, 22 bp, Homo sapiens
acatgtttgcctgcaggcttag

SEQ ID NO: 7876966 - DNA, 22 bp, Homo sapiens
acatgtttgataaatatttggg

SEQ ID NO: 7876967 - DNA, 22 bp, Homo sapiens
acatgtttgataaatatttggg

SEQ ID NO: 7876968 - DNA, 22 bp, Homo sapiens
acatgtttgataaatatttggg

SEQ ID NO: 7876969 - DNA, 22 bp, Homo sapiens
aggcctctgggtctcctctgac

SEQ ID NO: 7876970 - DNA, 22 bp, Homo sapiens
aggcctctgggtctcctctgac

SEQ ID NO: 7876971 - DNA, 22 bp, Homo sapiens
acatgtttggctctatgctata

SEQ ID NO: 7876972 - DNA, 22 bp, Homo sapiens
acatgtttggctctatgctata

SEQ ID NO: 7876973 - DNA, 22 bp, Homo sapiens
acatgtttggctctatgctata

SEQ ID NO: 7876974 - DNA, 19 bp, Homo sapiens
acatgttttgcagaacagc

SEQ ID NO: 7876975 - DNA, 22 bp, Homo sapiens
aggccagggccagattagccac

SEQ ID NO: 7876976 - DNA, 22 bp, Homo sapiens
aggccagggccagattagccac

SEQ ID NO: 7876977 - DNA, 22 bp, Homo sapiens
aggccaggggtgagcacttctg

SEQ ID NO: 7876978 - DNA, 22 bp, Homo sapiens
aggccagggccagattagccac

SEQ ID NO: 7876979 - DNA, 22 bp, Homo sapiens
aggccagggcactgctctttag

SEQ ID NO: 7876980 - DNA, 22 bp, Homo sapiens
aggccagggccagattagccac

SEQ ID NO: 7876981 - DNA, 22 bp, Homo sapiens
aggccagggccagattagccac

SEQ ID NO: 7876982 - DNA, 22 bp, Homo sapiens
aggccagggccagattagccac

SEQ ID NO: 7876983 - DNA, 22 bp, Homo sapiens
aggccaggggtgagcacttctg

SEQ ID NO: 7876984 - DNA, 22 bp, Homo sapiens
aggccaggggtgagcacttctg

SEQ ID NO: 7876985 - DNA, 22 bp, Homo sapiens
aggccaggggtgagcacttctg

SEQ ID NO: 7876986 - DNA, 22 bp, Homo sapiens
aggccaggggtgagcacttctg

SEQ ID NO: 7876987 - DNA, 22 bp, Homo sapiens
aggccaggggtgagcacttctg

SEQ ID NO: 7876988 - DNA, 22 bp, Homo sapiens
aggccaggggtgagcacttctg

SEQ ID NO: 7876989 - DNA, 22 bp, Homo sapiens
aggccaggggtgagcacttctg

SEQ ID NO: 7876990 - DNA, 22 bp, Homo sapiens
aggccagggtagggcccattgt

SEQ ID NO: 7876991 - DNA, 22 bp, Homo sapiens
aggccagggtagggcccattgt

SEQ ID NO: 7876992 - DNA, 22 bp, Homo sapiens
aggccagggtagggcccattgt

SEQ ID NO: 7876993 - DNA, 22 bp, Homo sapiens
aggccagggtagggcccattgt

SEQ ID NO: 7876994 - DNA, 22 bp, Homo sapiens
aggccaggcctttctccattcc

SEQ ID NO: 7876995 - DNA, 22 bp, Homo sapiens
aggccaggcctttctccattcc

SEQ ID NO: 7876996 - DNA, 22 bp, Homo sapiens
aggccaggcctttctccattcc

SEQ ID NO: 7876997 - DNA, 22 bp, Homo sapiens
aggccaggcctttctccattcc

SEQ ID NO: 7876998 - DNA, 22 bp, Homo sapiens
aggccaggcctttctccattcc

SEQ ID NO: 7876999 - DNA, 22 bp, Homo sapiens
aggccaggcgagacacccggct

SEQ ID NO: 7877000 - DNA, 22 bp, Homo sapiens
aggccaggcgagacacccggct

SEQ ID NO: 7877001 - DNA, 22 bp, Homo sapiens
aggccaggcgagacacccggct

SEQ ID NO: 7877002 - DNA, 22 bp, Homo sapiens
aggccaggcgagacacccggct

SEQ ID NO: 7877003 - DNA, 22 bp, Homo sapiens
aggccaggcgagacacccggct

SEQ ID NO: 7877004 - DNA, 22 bp, Homo sapiens
aggccagggcactgctctttag

SEQ ID NO: 7877005 - DNA, 22 bp, Homo sapiens
aggccagggcactgctctttag

SEQ ID NO: 7877006 - DNA, 22 bp, Homo sapiens
aggccagggcactgctctttag

SEQ ID NO: 7877007 - DNA, 22 bp, Homo sapiens
aggccagggcactgctctttag

SEQ ID NO: 7877008 - DNA, 22 bp, Homo sapiens
aggccagggcactgctctttag

SEQ ID NO: 7877009 - DNA, 22 bp, Homo sapiens
aggccagggcactgctctttag

SEQ ID NO: 7877010 - DNA, 22 bp, Homo sapiens
aggccagggcactgctctttag

SEQ ID NO: 7877011 - DNA, 22 bp, Homo sapiens
aggccagggtcccacactcgca

SEQ ID NO: 7877012 - DNA, 22 bp, Homo sapiens
aggccagggtcccacactcgca

SEQ ID NO: 7877013 - DNA, 22 bp, Homo sapiens
aggccagggtcccacactcgca

SEQ ID NO: 7877014 - DNA, 22 bp, Homo sapiens
aggccagggtcccacactcgca

SEQ ID NO: 7877015 - DNA, 22 bp, Homo sapiens
aggccagggtcccacactcgca

SEQ ID NO: 7877016 - DNA, 22 bp, Homo sapiens
aggccagggtcccacactcgca

SEQ ID NO: 7877017 - DNA, 22 bp, Homo sapiens
acatgttaaacatcatggaatg

SEQ ID NO: 7877018 - DNA, 22 bp, Homo sapiens
acatgtttaagtttaatgaaaa

SEQ ID NO: 7877019 - DNA, 22 bp, Homo sapiens
acatgtttaagtttaatgaaaa

SEQ ID NO: 7877020 - DNA, 22 bp, Homo sapiens
acatgttgctaaatccaatggt

SEQ ID NO: 7877021 - DNA, 22 bp, Homo sapiens
acatgttcatgcatgcacaggt

SEQ ID NO: 7877022 - DNA, 22 bp, Homo sapiens
acatgttcatgcatgcacaggt

SEQ ID NO: 7877023 - DNA, 22 bp, Homo sapiens
acatgttcatgcatgcacaggt

SEQ ID NO: 7877024 - DNA, 22 bp, Homo sapiens
acatgttagctactattgttat

SEQ ID NO: 7877025 - DNA, 22 bp, Homo sapiens
acatgttagaaatgcagaatct

SEQ ID NO: 7877026 - DNA, 22 bp, Homo sapiens
acatgttagaaatgcagaatct

SEQ ID NO: 7877027 - DNA, 22 bp, Homo sapiens
acatgcatacaagcacatgtag

SEQ ID NO: 7877028 - DNA, 22 bp, Homo sapiens
acatccatcttatgagataggt

SEQ ID NO: 7877029 - DNA, 22 bp, Homo sapiens
acatccagtatcagaagcatca

SEQ ID NO: 7877030 - DNA, 22 bp, Homo sapiens
acatccagtatcagaagcatca

SEQ ID NO: 7877031 - DNA, 22 bp, Homo sapiens
acatccatcttctgcctgtgaa

SEQ ID NO: 7877032 - DNA, 22 bp, Homo sapiens
acatgcataagcctagccatca

SEQ ID NO: 7877033 - DNA, 22 bp, Homo sapiens
acatgccagcccatttaaatgg

SEQ ID NO: 7877034 - DNA, 22 bp, Homo sapiens
acatgccagcctcagcagcagt

SEQ ID NO: 7877035 - DNA, 22 bp, Homo sapiens
acatgccagcctcagcagcagt

SEQ ID NO: 7877036 - DNA, 22 bp, Homo sapiens
acatgccagcctcagcagcagt

SEQ ID NO: 7877037 - DNA, 22 bp, Homo sapiens
acatgctatgagagattacttc

SEQ ID NO: 7877038 - DNA, 22 bp, Homo sapiens
acatgctatgagagattacttc

SEQ ID NO: 7877039 - DNA, 22 bp, Homo sapiens
acatgctaggtacagatctaaa

SEQ ID NO: 7877040 - DNA, 22 bp, Homo sapiens
acatgctagactttctttatga

SEQ ID NO: 7877041 - DNA, 22 bp, Homo sapiens
acatgctaggtacagatctaaa

SEQ ID NO: 7877042 - DNA, 22 bp, Homo sapiens
acatgcttctgtttcaagaact

SEQ ID NO: 7877043 - DNA, 22 bp, Homo sapiens
acatgcttctgtttcaagaact

SEQ ID NO: 7877044 - DNA, 22 bp, Homo sapiens
acatgcttctgtttcaagaact

SEQ ID NO: 7877045 - DNA, 22 bp, Homo sapiens
acatgcttccaaattatgttgg

SEQ ID NO: 7877046 - DNA, 22 bp, Homo sapiens
acatgcttccaaattatgttgg

SEQ ID NO: 7877047 - DNA, 20 bp, Homo sapiens
acatgcttgagaggatgcag

SEQ ID NO: 7877048 - DNA, 22 bp, Homo sapiens
acatgcttgtttttcacaacct

SEQ ID NO: 7877049 - DNA, 22 bp, Homo sapiens
acatgcttgtttttcacaacct

SEQ ID NO: 7877050 - DNA, 22 bp, Homo sapiens
acatgctgggcaatgttgtttt

SEQ ID NO: 7877051 - DNA, 22 bp, Homo sapiens
acatgctgggcaatgttgtttt

SEQ ID NO: 7877052 - DNA, 22 bp, Homo sapiens
acatgctgggcaatgttgtttt

SEQ ID NO: 7877053 - DNA, 22 bp, Homo sapiens
aggccaggcctttctccattcc

SEQ ID NO: 7877054 - DNA, 22 bp, Homo sapiens
aggccaggcctttctccattcc

SEQ ID NO: 7877055 - DNA, 22 bp, Homo sapiens
acatgctttgcacttacatcat

SEQ ID NO: 7877056 - DNA, 22 bp, Homo sapiens
acatgctttgcacttacatcat

SEQ ID NO: 7877057 - DNA, 22 bp, Homo sapiens
acatgcttttcccacaattata

SEQ ID NO: 7877058 - DNA, 22 bp, Homo sapiens
acatgcttttcccacaattata

SEQ ID NO: 7877059 - DNA, 22 bp, Homo sapiens
acatgctttgatgtattttgca

SEQ ID NO: 7877060 - DNA, 22 bp, Homo sapiens
acatgctttgcacttacatcat

SEQ ID NO: 7877061 - DNA, 22 bp, Homo sapiens
acatgctttctaggtccttctg

SEQ ID NO: 7877062 - DNA, 22 bp, Homo sapiens
acatgctttctaggtccttctg

SEQ ID NO: 7877063 - DNA, 22 bp, Homo sapiens
acatgctttaacttattttgat

SEQ ID NO: 7877064 - DNA, 22 bp, Homo sapiens
acatattttgaaagctttctaa

SEQ ID NO: 7877065 - DNA, 22 bp, Homo sapiens
acatattttgaaagctttctaa

SEQ ID NO: 7877066 - DNA, 22 bp, Homo sapiens
acatattttgaaagctttctaa

SEQ ID NO: 7877067 - DNA, 22 bp, Homo sapiens
acatcacacgccttccaggagg

SEQ ID NO: 7877068 - DNA, 22 bp, Homo sapiens
acatcacacgccttccaggagg

SEQ ID NO: 7877069 - DNA, 22 bp, Homo sapiens
acatcacagagcccagataaag

SEQ ID NO: 7877070 - DNA, 22 bp, Homo sapiens
acatcacagagcccagataaag

SEQ ID NO: 7877071 - DNA, 22 bp, Homo sapiens
acatcacagagcccagataaag

SEQ ID NO: 7877072 - DNA, 22 bp, Homo sapiens
acatcacagagcccagataaag

SEQ ID NO: 7877073 - DNA, 22 bp, Homo sapiens
acatcacagagcccagataaag

SEQ ID NO: 7877074 - DNA, 22 bp, Homo sapiens
acatcagtaattaagtctcaag

SEQ ID NO: 7877075 - DNA, 22 bp, Homo sapiens
acatcagtaactgtaaaacagg

SEQ ID NO: 7877076 - DNA, 23 bp, Homo sapiens
acatcagagttagttcaatcagg

SEQ ID NO: 7877077 - DNA, 22 bp, Homo sapiens
acatcacagtagttaagccaga

SEQ ID NO: 7877078 - DNA, 22 bp, Homo sapiens
acatcacggtccagcacggctg

SEQ ID NO: 7877079 - DNA, 22 bp, Homo sapiens
acatcagacaattaattattaa

SEQ ID NO: 7877080 - DNA, 22 bp, Homo sapiens
acatcagagggctcacatgatc

SEQ ID NO: 7877081 - DNA, 22 bp, Homo sapiens
acatcacagagcccagataaag

SEQ ID NO: 7877082 - DNA, 22 bp, Homo sapiens
acatcacagagcccagataaag

SEQ ID NO: 7877083 - DNA, 22 bp, Homo sapiens
acatccagatctcagcatggct

SEQ ID NO: 7877084 - DNA, 22 bp, Homo sapiens
acatccagatctcagcatggct

SEQ ID NO: 7877085 - DNA, 17 bp, Homo sapiens
acatccagcttatgtgg

SEQ ID NO: 7877086 - DNA, 21 bp, Homo sapiens
acatccagggtcctcactgcc

SEQ ID NO: 7877087 - DNA, 22 bp, Homo sapiens
acatcatttgtctgtagctgaa

SEQ ID NO: 7877088 - DNA, 21 bp, Homo sapiens
acatccagggtcctcactgcc

SEQ ID NO: 7877089 - DNA, 21 bp, Homo sapiens
acatccagggtcctcactgcc

SEQ ID NO: 7877090 - DNA, 22 bp, Homo sapiens
acatccagtatcagaagcatca

SEQ ID NO: 7877091 - DNA, 21 bp, Homo sapiens
acatccagggtcctcactgcc

SEQ ID NO: 7877092 - DNA, 22 bp, Homo sapiens
acatccatcttatgagataggt

SEQ ID NO: 7877093 - DNA, 22 bp, Homo sapiens
acatcatttctagttcctgtca

SEQ ID NO: 7877094 - DNA, 22 bp, Homo sapiens
acatcatttctagttcctgtca

SEQ ID NO: 7877095 - DNA, 22 bp, Homo sapiens
acatcattgtccgttgtcatga

SEQ ID NO: 7877096 - DNA, 22 bp, Homo sapiens
acatcatttgtctgtagctgaa

SEQ ID NO: 7877097 - DNA, 22 bp, Homo sapiens
acatccaccacatgccaggctc

SEQ ID NO: 7877098 - DNA, 22 bp, Homo sapiens
acatccacatttattcagtcat

SEQ ID NO: 7877099 - DNA, 22 bp, Homo sapiens
acatcattttcttcagtgtttg

SEQ ID NO: 7877100 - DNA, 22 bp, Homo sapiens
acatccagaggcgtggaaggct

SEQ ID NO: 7877101 - DNA, 22 bp, Homo sapiens
acatccactatccttgcttgtt

SEQ ID NO: 7877102 - DNA, 22 bp, Homo sapiens
acatcatcgtgcacatacataa

SEQ ID NO: 7877103 - DNA, 22 bp, Homo sapiens
acatcatcgtgcacatacataa

SEQ ID NO: 7877104 - DNA, 22 bp, Homo sapiens
acatcagtgctcttggttcttg

SEQ ID NO: 7877105 - DNA, 22 bp, Homo sapiens
acatcatgagagacttaaattg

SEQ ID NO: 7877106 - DNA, 22 bp, Homo sapiens
acatcagtgctcttggttcttg

SEQ ID NO: 7877107 - DNA, 22 bp, Homo sapiens
acatcagtcttttgcatacata

SEQ ID NO: 7877108 - DNA, 18 bp, Homo sapiens
acatcagttaccaggcca

SEQ ID NO: 7877109 - DNA, 22 bp, Homo sapiens
acatcagtccaccactgcagtt

SEQ ID NO: 7877110 - DNA, 22 bp, Homo sapiens
acatcagtccaccactgcagtt

SEQ ID NO: 7877111 - DNA, 22 bp, Homo sapiens
acatcattgtttataaagggag

SEQ ID NO: 7877112 - DNA, 22 bp, Homo sapiens
acatcattgtccgttgtcatga

SEQ ID NO: 7877113 - DNA, 22 bp, Homo sapiens
acatcattcagggcctcgttgg

SEQ ID NO: 7877114 - DNA, 23 bp, Homo sapiens
acatcatgatagccaacttggga

SEQ ID NO: 7877115 - DNA, 22 bp, Homo sapiens
acatcatgagagacttaaattg

SEQ ID NO: 7877116 - DNA, 23 bp, Homo sapiens
acatcatgatagccaacttggga

SEQ ID NO: 7877117 - DNA, 21 bp, Homo sapiens
agtgtgtgataggcaggaaga

SEQ ID NO: 7877118 - DNA, 22 bp, Homo sapiens
agtgttcttcctatctgctgtt

SEQ ID NO: 7877119 - DNA, 21 bp, Homo sapiens
agtgtgtgataggcaggaaga

SEQ ID NO: 7877120 - DNA, 22 bp, Homo sapiens
agtgttcttcttcaaagctctg

SEQ ID NO: 7877121 - DNA, 22 bp, Homo sapiens
agtgttcttgtttctaagcaaa

SEQ ID NO: 7877122 - DNA, 22 bp, Homo sapiens
agtgttggagtcttggctgcag

SEQ ID NO: 7877123 - DNA, 22 bp, Homo sapiens
agtgttggaccgaggtggagcc

SEQ ID NO: 7877124 - DNA, 22 bp, Homo sapiens
agtgttggaccgaggtggagcc

SEQ ID NO: 7877125 - DNA, 22 bp, Homo sapiens
agtgttcttgtttctaagcaaa

SEQ ID NO: 7877126 - DNA, 22 bp, Homo sapiens
agtgttgcatgaggcagtacca

SEQ ID NO: 7877127 - DNA, 22 bp, Homo sapiens
agtgttgcatgaggcagtacca

SEQ ID NO: 7877128 - DNA, 23 bp, Homo sapiens
agtgttggttgggaagccaagca

SEQ ID NO: 7877129 - DNA, 22 bp, Homo sapiens
agtgtttaaaaatggaaatgca

SEQ ID NO: 7877130 - DNA, 22 bp, Homo sapiens
agtgtttaaactgaagtgatga

SEQ ID NO: 7877131 - DNA, 22 bp, Homo sapiens
agtgtttaaactgaagtgatga

SEQ ID NO: 7877132 - DNA, 22 bp, Homo sapiens
agtgtttacagagtagtggaaa

SEQ ID NO: 7877133 - DNA, 22 bp, Homo sapiens
agtgtttaaactgaagtgatga

SEQ ID NO: 7877134 - DNA, 22 bp, Homo sapiens
agtgtttaagttacacacatat

SEQ ID NO: 7877135 - DNA, 22 bp, Homo sapiens
agtgtttaccccaatcagttta

SEQ ID NO: 7877136 - DNA, 22 bp, Homo sapiens
agtgtttactcaaagggttcca

SEQ ID NO: 7877137 - DNA, 22 bp, Homo sapiens
agtgtttagaggaggaaagatg

SEQ ID NO: 7877138 - DNA, 20 bp, Homo sapiens
agtgtttagaatactattat

SEQ ID NO: 7877139 - DNA, 22 bp, Homo sapiens
actggctttgagggaatagcta

SEQ ID NO: 7877140 - DNA, 23 bp, Homo sapiens
actggctttgatccagatagatt

SEQ ID NO: 7877141 - DNA, 23 bp, Homo sapiens
actggctttgatccagatagatt

SEQ ID NO: 7877142 - DNA, 22 bp, Homo sapiens
actggctttgcctctgcctctc

SEQ ID NO: 7877143 - DNA, 22 bp, Homo sapiens
actggctttgcctctgcctctc

SEQ ID NO: 7877144 - DNA, 22 bp, Homo sapiens
actggctttggcttcagatgag

SEQ ID NO: 7877145 - DNA, 22 bp, Homo sapiens
actggctttggcttcagatgag

SEQ ID NO: 7877146 - DNA, 22 bp, Homo sapiens
actggctttgggttgccgcaga

SEQ ID NO: 7877147 - DNA, 22 bp, Homo sapiens
actggctttgggttgccgcaga

SEQ ID NO: 7877148 - DNA, 22 bp, Homo sapiens
actggcttgtgagacaatgcct

SEQ ID NO: 7877149 - DNA, 22 bp, Homo sapiens
actggcttgtgagacaatgcct

SEQ ID NO: 7877150 - DNA, 18 bp, Homo sapiens
actggctttagcatcaga

SEQ ID NO: 7877151 - DNA, 21 bp, Homo sapiens
actggcttgtatttggtaagc

SEQ ID NO: 7877152 - DNA, 21 bp, Homo sapiens
actggcttgtatttggtaagc

SEQ ID NO: 7877153 - DNA, 22 bp, Homo sapiens
actggctttgagggaatagcta

SEQ ID NO: 7877154 - DNA, 18 bp, Homo sapiens
actggctttagcatcaga

SEQ ID NO: 7877155 - DNA, 22 bp, Homo sapiens
agtgtttatattatggaaatat

SEQ ID NO: 7877156 - DNA, 21 bp, Homo sapiens
actggcttggctctggctgaa

SEQ ID NO: 7877157 - DNA, 21 bp, Homo sapiens
agtgtagttctagtttttaac

SEQ ID NO: 7877158 - DNA, 22 bp, Homo sapiens
agtgtagtggcattgacttcgt

SEQ ID NO: 7877159 - DNA, 22 bp, Homo sapiens
agtgtagtggcattgacttcgt

SEQ ID NO: 7877160 - DNA, 21 bp, Homo sapiens
agtgtaggtcattagctgttg

SEQ ID NO: 7877161 - DNA, 22 bp, Homo sapiens
agtgtatgagtttcagttcttc

SEQ ID NO: 7877162 - DNA, 22 bp, Homo sapiens
agtgtatgagtttcagttcttc

SEQ ID NO: 7877163 - DNA, 22 bp, Homo sapiens
agtgtatgcaggttttcaatgt

SEQ ID NO: 7877164 - DNA, 22 bp, Homo sapiens
agtgtatgcaggttttcaatgt

SEQ ID NO: 7877165 - DNA, 22 bp, Homo sapiens
agtgtatgcaggttttcaatgt

SEQ ID NO: 7877166 - DNA, 22 bp, Homo sapiens
agtgtatggaattagctccctt

SEQ ID NO: 7877167 - DNA, 22 bp, Homo sapiens
agtgtatgtgaaactttccaaa

SEQ ID NO: 7877168 - DNA, 22 bp, Homo sapiens
agtgtattaaaatgctcctaag

SEQ ID NO: 7877169 - DNA, 22 bp, Homo sapiens
agtgtattaagttatgaagtta

SEQ ID NO: 7877170 - DNA, 22 bp, Homo sapiens
agtgtattaagttatgaagtta

SEQ ID NO: 7877171 - DNA, 22 bp, Homo sapiens
agtgtattaagttatgaagtta

SEQ ID NO: 7877172 - DNA, 22 bp, Homo sapiens
agtgtattaaaatgctcctaag

SEQ ID NO: 7877173 - DNA, 22 bp, Homo sapiens
agtgtattaagttatgaagtta

SEQ ID NO: 7877174 - DNA, 22 bp, Homo sapiens
agtgtattaagttatgaagtta

SEQ ID NO: 7877175 - DNA, 23 bp, Homo sapiens
actgctttattcatgaggctctc

SEQ ID NO: 7877176 - DNA, 22 bp, Homo sapiens
actgcttttagaaatctataga

SEQ ID NO: 7877177 - DNA, 22 bp, Homo sapiens
actgcttttagaaatctataga

SEQ ID NO: 7877178 - DNA, 22 bp, Homo sapiens
actgctttgctctgcccccagg

SEQ ID NO: 7877179 - DNA, 22 bp, Homo sapiens
agtgtattagcaagctctccag

SEQ ID NO: 7877180 - DNA, 22 bp, Homo sapiens
agtgtattatcagaaactgtgg

SEQ ID NO: 7877181 - DNA, 22 bp, Homo sapiens
agtgtattagttgtccagcagt

SEQ ID NO: 7877182 - DNA, 22 bp, Homo sapiens
agtgtattatcagaaactgtgg

SEQ ID NO: 7877183 - DNA, 22 bp, Homo sapiens
actgctttatctgagaagtcct

SEQ ID NO: 7877184 - DNA, 22 bp, Homo sapiens
actgctttatctgagaagtcct

SEQ ID NO: 7877185 - DNA, 22 bp, Homo sapiens
actgctttatctgagaagtcct

SEQ ID NO: 7877186 - DNA, 22 bp, Homo sapiens
actgctttatctgagaagtcct

SEQ ID NO: 7877187 - DNA, 22 bp, Homo sapiens
actggaaagtattctttcactg

SEQ ID NO: 7877188 - DNA, 22 bp, Homo sapiens
actggaaagtattctttcactg

SEQ ID NO: 7877189 - DNA, 22 bp, Homo sapiens
actggaaactacagcctatcct

SEQ ID NO: 7877190 - DNA, 22 bp, Homo sapiens
actggaaaggctctgaatggga

SEQ ID NO: 7877191 - DNA, 22 bp, Homo sapiens
actggaaatgagatgatatcag

SEQ ID NO: 7877192 - DNA, 22 bp, Homo sapiens
actggaaatgagatgatatcag

SEQ ID NO: 7877193 - DNA, 22 bp, Homo sapiens
actggaaataaattttgaatgt

SEQ ID NO: 7877194 - DNA, 22 bp, Homo sapiens
actggaaataaattttgaatgt

SEQ ID NO: 7877195 - DNA, 22 bp, Homo sapiens
actggaaagttgattatgtcca

SEQ ID NO: 7877196 - DNA, 22 bp, Homo sapiens
actgcttttgatctcttctgta

SEQ ID NO: 7877197 - DNA, 22 bp, Homo sapiens
actgcttttctaagattctgtg

SEQ ID NO: 7877198 - DNA, 22 bp, Homo sapiens
actggaaaacactactacatgc

SEQ ID NO: 7877199 - DNA, 22 bp, Homo sapiens
actggaaaacactactacatgc

SEQ ID NO: 7877200 - DNA, 22 bp, Homo sapiens
actggaaaattcaaatggggtc

SEQ ID NO: 7877201 - DNA, 22 bp, Homo sapiens
actggaaaattcaaatggggtc

SEQ ID NO: 7877202 - DNA, 22 bp, Homo sapiens
actggaaaaccactgaaatgag

SEQ ID NO: 7877203 - DNA, 22 bp, Homo sapiens
actggaattggaatctggagct

SEQ ID NO: 7877204 - DNA, 22 bp, Homo sapiens
actggaattggaatctggagct

SEQ ID NO: 7877205 - DNA, 22 bp, Homo sapiens
actggaatgtcatcgtgacttt

SEQ ID NO: 7877206 - DNA, 22 bp, Homo sapiens
agtgtgtgaccttttaatttaa

SEQ ID NO: 7877207 - DNA, 21 bp, Homo sapiens
agtgtgtgataggcaggaaga

SEQ ID NO: 7877208 - DNA, 22 bp, Homo sapiens
actggaaattgagaggtcactg

SEQ ID NO: 7877209 - DNA, 22 bp, Homo sapiens
actggaaatgagatgatatcag

SEQ ID NO: 7877210 - DNA, 22 bp, Homo sapiens
actggaaattgagaggtcactg

SEQ ID NO: 7877211 - DNA, 22 bp, Homo sapiens
actggaagccagttgacaatca

SEQ ID NO: 7877212 - DNA, 22 bp, Homo sapiens
actggaagccagttgacaatca

SEQ ID NO: 7877213 - DNA, 21 bp, Homo sapiens
actggaagtgggtcaggaagt

SEQ ID NO: 7877214 - DNA, 21 bp, Homo sapiens
actggaagtgggtcaggaagt

SEQ ID NO: 7877215 - DNA, 21 bp, Homo sapiens
actggaagtgggtcaggaagt

SEQ ID NO: 7877216 - DNA, 22 bp, Homo sapiens
actggaataaatggagggatga

SEQ ID NO: 7877217 - DNA, 22 bp, Homo sapiens
actggaatcctctagagggtga

SEQ ID NO: 7877218 - DNA, 22 bp, Homo sapiens
actggaagtatctgcttgtttt

SEQ ID NO: 7877219 - DNA, 22 bp, Homo sapiens
agtgtacatgtttacagcatct

SEQ ID NO: 7877220 - DNA, 22 bp, Homo sapiens
agtgtacattctgtttgaggta

SEQ ID NO: 7877221 - DNA, 22 bp, Homo sapiens
agtgtagaaggagaaatggatc

SEQ ID NO: 7877222 - DNA, 22 bp, Homo sapiens
agtgtagaaggagaaatggatc

SEQ ID NO: 7877223 - DNA, 22 bp, Homo sapiens
agtgtagggtggtcagagcaga

SEQ ID NO: 7877224 - DNA, 22 bp, Homo sapiens
agtgtagacataggtctggtct

SEQ ID NO: 7877225 - DNA, 22 bp, Homo sapiens
agtgtagatgaaattaaaccca

SEQ ID NO: 7877226 - DNA, 22 bp, Homo sapiens
agtgtagatgaaattaaaccca

SEQ ID NO: 7877227 - DNA, 22 bp, Homo sapiens
agtgtacatgtacacattagta

SEQ ID NO: 7877228 - DNA, 22 bp, Homo sapiens
agtgtacatgtttacagcatct

SEQ ID NO: 7877229 - DNA, 22 bp, Homo sapiens
agtgtacatgtacacattagta

SEQ ID NO: 7877230 - DNA, 22 bp, Homo sapiens
agtgtacatcagaacatatcaa

SEQ ID NO: 7877231 - DNA, 22 bp, Homo sapiens
agtgtacatcagaacatatcaa

SEQ ID NO: 7877232 - DNA, 22 bp, Homo sapiens
agtgtacagttctatgaatttc

SEQ ID NO: 7877233 - DNA, 22 bp, Homo sapiens
agtgtacagttctatgaatttc

SEQ ID NO: 7877234 - DNA, 22 bp, Homo sapiens
agtgtacagttctatgaatttc

SEQ ID NO: 7877235 - DNA, 22 bp, Homo sapiens
agtgtacagttctatgaatttc

SEQ ID NO: 7877236 - DNA, 22 bp, Homo sapiens
agtgtacatagttaggaacatc

SEQ ID NO: 7877237 - DNA, 22 bp, Homo sapiens
agtgtacatagttaggaacatc

SEQ ID NO: 7877238 - DNA, 20 bp, Homo sapiens
agtgtacagacactagaaat

SEQ ID NO: 7877239 - DNA, 20 bp, Homo sapiens
agtgtacagacactagaaat

SEQ ID NO: 7877240 - DNA, 20 bp, Homo sapiens
agtgtacagacactagaaat

SEQ ID NO: 7877241 - DNA, 22 bp, Homo sapiens
agtgtacacttgcagcctcaag

SEQ ID NO: 7877242 - DNA, 21 bp, Homo sapiens
agtggggtctctgtggaggcc

SEQ ID NO: 7877243 - DNA, 22 bp, Homo sapiens
actgcacttcagcctgggtgtc

SEQ ID NO: 7877244 - DNA, 22 bp, Homo sapiens
actgcacttcagcctgggtgtc

SEQ ID NO: 7877245 - DNA, 22 bp, Homo sapiens
actgcacttcagcctgggtgtc

SEQ ID NO: 7877246 - DNA, 22 bp, Homo sapiens
actgcacttcagcctgggtgtc

SEQ ID NO: 7877247 - DNA, 22 bp, Homo sapiens
actgcacttcagcctgggtgtc

SEQ ID NO: 7877248 - DNA, 22 bp, Homo sapiens
actgcacttcagcctgggtgtc

SEQ ID NO: 7877249 - DNA, 22 bp, Homo sapiens
actgcacttcagcctgggtgtc

SEQ ID NO: 7877250 - DNA, 22 bp, Homo sapiens
actgcacttcagcctgggtgtc

SEQ ID NO: 7877251 - DNA, 22 bp, Homo sapiens
actgcacttcagcctgggtgtc

SEQ ID NO: 7877252 - DNA, 22 bp, Homo sapiens
actgcacttcagcctgggtgtc

SEQ ID NO: 7877253 - DNA, 19 bp, Homo sapiens
actgcactttagcctgggc

SEQ ID NO: 7877254 - DNA, 22 bp, Homo sapiens
actgcacttcagcctgggtgtc

SEQ ID NO: 7877255 - DNA, 22 bp, Homo sapiens
actgcacttcagcctgggtgtc

SEQ ID NO: 7877256 - DNA, 22 bp, Homo sapiens
actgcagagcttttcagttgag

SEQ ID NO: 7877257 - DNA, 22 bp, Homo sapiens
actgcagaggtggggtgcagag

SEQ ID NO: 7877258 - DNA, 22 bp, Homo sapiens
actgcagaggtggggtgcagag

SEQ ID NO: 7877259 - DNA, 22 bp, Homo sapiens
actgcagaggtggggtgcagag

SEQ ID NO: 7877260 - DNA, 22 bp, Homo sapiens
actgcagactctacagttataa

SEQ ID NO: 7877261 - DNA, 22 bp, Homo sapiens
actgcagactctacagttataa

SEQ ID NO: 7877262 - DNA, 22 bp, Homo sapiens
actgcagagcttttcagttgag

SEQ ID NO: 7877263 - DNA, 22 bp, Homo sapiens
actgcagagcttttcagttgag

SEQ ID NO: 7877264 - DNA, 22 bp, Homo sapiens
actgcagcaaagcccgtgtctt

SEQ ID NO: 7877265 - DNA, 22 bp, Homo sapiens
actgcagaggtggggtgcagag

SEQ ID NO: 7877266 - DNA, 21 bp, Homo sapiens
agtggggtctctgtggaggcc

SEQ ID NO: 7877267 - DNA, 21 bp, Homo sapiens
agtggggtctctgtggaggcc

SEQ ID NO: 7877268 - DNA, 21 bp, Homo sapiens
agtggggtctctgtggaggcc

SEQ ID NO: 7877269 - DNA, 21 bp, Homo sapiens
agtggggtctctgtggaggcc

SEQ ID NO: 7877270 - DNA, 22 bp, Homo sapiens
agtggcagtggctgggcagagc

SEQ ID NO: 7877271 - DNA, 22 bp, Homo sapiens
agtggcagtggctgggcagagc

SEQ ID NO: 7877272 - DNA, 22 bp, Homo sapiens
agtggcagtggctgggcagagc

SEQ ID NO: 7877273 - DNA, 22 bp, Homo sapiens
actgcacttcagcctgggtgac

SEQ ID NO: 7877274 - DNA, 22 bp, Homo sapiens
actgcacttcagcctgggtgac

SEQ ID NO: 7877275 - DNA, 22 bp, Homo sapiens
agtggcagtggctgggcagagc

SEQ ID NO: 7877276 - DNA, 22 bp, Homo sapiens
actgcacttcagcctgggtgac

SEQ ID NO: 7877277 - DNA, 22 bp, Homo sapiens
actgcacttcagcctgggtgac

SEQ ID NO: 7877278 - DNA, 22 bp, Homo sapiens
actgcacttcagcctgggtgac

SEQ ID NO: 7877279 - DNA, 22 bp, Homo sapiens
actgcacttcagcctgggtgac

SEQ ID NO: 7877280 - DNA, 22 bp, Homo sapiens
actgcacttcagcctgggtgac

SEQ ID NO: 7877281 - DNA, 22 bp, Homo sapiens
actgcacttcagcctgggtgac

SEQ ID NO: 7877282 - DNA, 22 bp, Homo sapiens
actgcacttcagcctgggtgac

SEQ ID NO: 7877283 - DNA, 22 bp, Homo sapiens
actgcacttcagcctgggtgtc

SEQ ID NO: 7877284 - DNA, 22 bp, Homo sapiens
actgcacttcagcctgggtgac

SEQ ID NO: 7877285 - DNA, 22 bp, Homo sapiens
agtggcagtagatgagctggtt

SEQ ID NO: 7877286 - DNA, 22 bp, Homo sapiens
agtggcagtagatgagctggtt

SEQ ID NO: 7877287 - DNA, 22 bp, Homo sapiens
agtggcagtagatgagctggtt

SEQ ID NO: 7877288 - DNA, 22 bp, Homo sapiens
agtggcagtggaaagcacacgg

SEQ ID NO: 7877289 - DNA, 22 bp, Homo sapiens
agtggcagtggaaagcacacgg

SEQ ID NO: 7877290 - DNA, 22 bp, Homo sapiens
agtggcagtggaaagcacacgg

SEQ ID NO: 7877291 - DNA, 22 bp, Homo sapiens
agtggcagtggaaagcacacgg

SEQ ID NO: 7877292 - DNA, 22 bp, Homo sapiens
agtggcagtagatgagctggtt

SEQ ID NO: 7877293 - DNA, 22 bp, Homo sapiens
agtggcagtagatgagctggtt

SEQ ID NO: 7877294 - DNA, 22 bp, Homo sapiens
agtggcagtggaaagcacacgg

SEQ ID NO: 7877295 - DNA, 22 bp, Homo sapiens
agtggcagtagatgagctggtt

SEQ ID NO: 7877296 - DNA, 22 bp, Homo sapiens
agtggcagtggctgggcagagc

SEQ ID NO: 7877297 - DNA, 22 bp, Homo sapiens
agtggcagtggctgggcagagc

SEQ ID NO: 7877298 - DNA, 22 bp, Homo sapiens
agtggcagtggctgggcagagc

SEQ ID NO: 7877299 - DNA, 22 bp, Homo sapiens
agtggcagtggctgggcagagc

SEQ ID NO: 7877300 - DNA, 22 bp, Homo sapiens
agtggcagtggctgggcagagc

SEQ ID NO: 7877301 - DNA, 22 bp, Homo sapiens
agtggcagtggctgggcagagc

SEQ ID NO: 7877302 - DNA, 22 bp, Homo sapiens
agtggcagtggctgggcagagc

SEQ ID NO: 7877303 - DNA, 22 bp, Homo sapiens
agtggcagtggctgggcagagc

SEQ ID NO: 7877304 - DNA, 22 bp, Homo sapiens
agtggcagtggaaagcacacgg

SEQ ID NO: 7877305 - DNA, 22 bp, Homo sapiens
agtggcagtaacattccacaat

SEQ ID NO: 7877306 - DNA, 22 bp, Homo sapiens
agtggcagtaacattccacaat

SEQ ID NO: 7877307 - DNA, 22 bp, Homo sapiens
agtggcaggtgtttcgtggtgc

SEQ ID NO: 7877308 - DNA, 22 bp, Homo sapiens
agtggcaggtgtttcgtggtgc

SEQ ID NO: 7877309 - DNA, 22 bp, Homo sapiens
agtggcaggtgtttcgtggtgc

SEQ ID NO: 7877310 - DNA, 22 bp, Homo sapiens
agtggcaggtgtttcgtggtgc

SEQ ID NO: 7877311 - DNA, 22 bp, Homo sapiens
agtggcaggtgtttcgtggtgc

SEQ ID NO: 7877312 - DNA, 22 bp, Homo sapiens
agtggcaggtgtttcgtggtgc

SEQ ID NO: 7877313 - DNA, 22 bp, Homo sapiens
agtggcaggtgtttcgtggtgc

SEQ ID NO: 7877314 - DNA, 22 bp, Homo sapiens
agtggcagggctggctgctgca

SEQ ID NO: 7877315 - DNA, 22 bp, Homo sapiens
agtggcagggctggctgctgca

SEQ ID NO: 7877316 - DNA, 22 bp, Homo sapiens
agtggcagggctggctgctgca

SEQ ID NO: 7877317 - DNA, 22 bp, Homo sapiens
agtggcaggtgtgtagtatccc

SEQ ID NO: 7877318 - DNA, 22 bp, Homo sapiens
agtggcaggtgtgtagtatccc

SEQ ID NO: 7877319 - DNA, 22 bp, Homo sapiens
agtggcaggtgtgtagtatccc

SEQ ID NO: 7877320 - DNA, 22 bp, Homo sapiens
agtggcagtagatgagctggtt

SEQ ID NO: 7877321 - DNA, 22 bp, Homo sapiens
agtggcagtagatgagctggtt

SEQ ID NO: 7877322 - DNA, 22 bp, Homo sapiens
agtggcagtagatgagctggtt

SEQ ID NO: 7877323 - DNA, 22 bp, Homo sapiens
agtggcagtagatgagctggtt

SEQ ID NO: 7877324 - DNA, 22 bp, Homo sapiens
agtggcagtagatgagctggtt

SEQ ID NO: 7877325 - DNA, 22 bp, Homo sapiens
agtggcagtagatgagctggtt

SEQ ID NO: 7877326 - DNA, 22 bp, Homo sapiens
agtggcagtagatgagctggtt

SEQ ID NO: 7877327 - DNA, 22 bp, Homo sapiens
agtggcagtagatgagctggtt

SEQ ID NO: 7877328 - DNA, 22 bp, Homo sapiens
agtggcagtaacattccacaat

SEQ ID NO: 7877329 - DNA, 22 bp, Homo sapiens
agtggcagtaacattccacaat

SEQ ID NO: 7877330 - DNA, 22 bp, Homo sapiens
agtggcagtagatgagctggtt

SEQ ID NO: 7877331 - DNA, 22 bp, Homo sapiens
agtggcagagccagggttggga

SEQ ID NO: 7877332 - DNA, 22 bp, Homo sapiens
agtggcagagccagggttggga

SEQ ID NO: 7877333 - DNA, 22 bp, Homo sapiens
actgaggggttggagagtgagg

SEQ ID NO: 7877334 - DNA, 22 bp, Homo sapiens
actgaggggctttcaggcccag

SEQ ID NO: 7877335 - DNA, 21 bp, Homo sapiens
actgagggccagagaggacct

SEQ ID NO: 7877336 - DNA, 22 bp, Homo sapiens
agtggcagagctgggatttggg

SEQ ID NO: 7877337 - DNA, 22 bp, Homo sapiens
agtggcagagctgggatttggg

SEQ ID NO: 7877338 - DNA, 22 bp, Homo sapiens
agtggcagagctgggatttggg

SEQ ID NO: 7877339 - DNA, 22 bp, Homo sapiens
agtggcagagccagggttggga

SEQ ID NO: 7877340 - DNA, 22 bp, Homo sapiens
agtggcagggctggctgctgca

SEQ ID NO: 7877341 - DNA, 22 bp, Homo sapiens
agtggcagggctggctgctgca

SEQ ID NO: 7877342 - DNA, 22 bp, Homo sapiens
agtggcagggctggctgctgca

SEQ ID NO: 7877343 - DNA, 22 bp, Homo sapiens
agtggcagggctggctgctgca

SEQ ID NO: 7877344 - DNA, 22 bp, Homo sapiens
agtggcagggctggctgctgca

SEQ ID NO: 7877345 - DNA, 22 bp, Homo sapiens
agtggcagggctggctgctgca

SEQ ID NO: 7877346 - DNA, 22 bp, Homo sapiens
agtggcagggctggctgctgca

SEQ ID NO: 7877347 - DNA, 22 bp, Homo sapiens
agtggcagggctggctgctgca

SEQ ID NO: 7877348 - DNA, 22 bp, Homo sapiens
agtctttaatgatcatgtattt

SEQ ID NO: 7877349 - DNA, 22 bp, Homo sapiens
agtctttaatgatcatgtattt

SEQ ID NO: 7877350 - DNA, 22 bp, Homo sapiens
agtctttaagtaatgataggca

SEQ ID NO: 7877351 - DNA, 22 bp, Homo sapiens
agtctttaagtaatgataggca

SEQ ID NO: 7877352 - DNA, 22 bp, Homo sapiens
agtctttaacatttggagattg

SEQ ID NO: 7877353 - DNA, 22 bp, Homo sapiens
agtctttacagaaaggcaggaa

SEQ ID NO: 7877354 - DNA, 22 bp, Homo sapiens
agtctttaatgatcatgtattt

SEQ ID NO: 7877355 - DNA, 22 bp, Homo sapiens
agtctttacatgtgttatatat

SEQ ID NO: 7877356 - DNA, 22 bp, Homo sapiens
actctgtaattctgaagcacct

SEQ ID NO: 7877357 - DNA, 22 bp, Homo sapiens
agtctttagagtcttagtgttt

SEQ ID NO: 7877358 - DNA, 22 bp, Homo sapiens
agtctttacatgtgttatatat

SEQ ID NO: 7877359 - DNA, 22 bp, Homo sapiens
agtctttactaaacagaccacc

SEQ ID NO: 7877360 - DNA, 22 bp, Homo sapiens
agtctttagaaggtagttgagg

SEQ ID NO: 7877361 - DNA, 22 bp, Homo sapiens
agtctttagagtcttagtgttt

SEQ ID NO: 7877362 - DNA, 18 bp, Homo sapiens
agtctttaaagatgttac

SEQ ID NO: 7877363 - DNA, 22 bp, Homo sapiens
agtctttaacatttggagattg

SEQ ID NO: 7877364 - DNA, 22 bp, Homo sapiens
agtctttaacatttggagattg

SEQ ID NO: 7877365 - DNA, 22 bp, Homo sapiens
agtctttaacatttggagattg

SEQ ID NO: 7877366 - DNA, 19 bp, Homo sapiens
agtcttgtggctttgtgca

SEQ ID NO: 7877367 - DNA, 18 bp, Homo sapiens
agtcttgttctgttgccc

SEQ ID NO: 7877368 - DNA, 18 bp, Homo sapiens
agtctttaaagatgttac

SEQ ID NO: 7877369 - DNA, 22 bp, Homo sapiens
agtcttgggagaggctggcagt

SEQ ID NO: 7877370 - DNA, 22 bp, Homo sapiens
agtcttgggagaggctggcagt

SEQ ID NO: 7877371 - DNA, 22 bp, Homo sapiens
agtcttggctatgcatagagct

SEQ ID NO: 7877372 - DNA, 22 bp, Homo sapiens
agtcttggctgccgccgtctcc

SEQ ID NO: 7877373 - DNA, 22 bp, Homo sapiens
agtcttggctatgcatagagct

SEQ ID NO: 7877374 - DNA, 22 bp, Homo sapiens
agtcttggctatgcatagagct

SEQ ID NO: 7877375 - DNA, 22 bp, Homo sapiens
agtcttggtgtcagtggtctga

SEQ ID NO: 7877376 - DNA, 22 bp, Homo sapiens
agtcttggtctccctggcagct

SEQ ID NO: 7877377 - DNA, 22 bp, Homo sapiens
agtcttggtctccctggcagct

SEQ ID NO: 7877378 - DNA, 22 bp, Homo sapiens
agtcttggttttgacagggaaa

SEQ ID NO: 7877379 - DNA, 22 bp, Homo sapiens
agtcttggttttgacagggaaa

SEQ ID NO: 7877380 - DNA, 22 bp, Homo sapiens
agtctggttgattcctttgcac

SEQ ID NO: 7877381 - DNA, 22 bp, Homo sapiens
agtcttctgggtgtttccagag

SEQ ID NO: 7877382 - DNA, 23 bp, Homo sapiens
actcgtggaattctctgcgatcg

SEQ ID NO: 7877383 - DNA, 23 bp, Homo sapiens
actcgtggaattctctgcgatcg

SEQ ID NO: 7877384 - DNA, 23 bp, Homo sapiens
actcgtggaattctctgcgatcg

SEQ ID NO: 7877385 - DNA, 22 bp, Homo sapiens
actcggggtggagagagcggtg

SEQ ID NO: 7877386 - DNA, 23 bp, Homo sapiens
actcgtggaattctctgcgatcg

SEQ ID NO: 7877387 - DNA, 22 bp, Homo sapiens
actcgcggcggacggcggccag

SEQ ID NO: 7877388 - DNA, 22 bp, Homo sapiens
actcgatttcactagagtaact

SEQ ID NO: 7877389 - DNA, 22 bp, Homo sapiens
actccttactaaaaggaacata

SEQ ID NO: 7877390 - DNA, 22 bp, Homo sapiens
actcggcagcctgagagttcac

SEQ ID NO: 7877391 - DNA, 22 bp, Homo sapiens
agtcttctttcatttactcagt

SEQ ID NO: 7877392 - DNA, 22 bp, Homo sapiens
agtcttctgtttttcagcagct

SEQ ID NO: 7877393 - DNA, 22 bp, Homo sapiens
agtcttctgtttttcagcagct

SEQ ID NO: 7877394 - DNA, 22 bp, Homo sapiens
agtcttctgtttttcagcagct

SEQ ID NO: 7877395 - DNA, 22 bp, Homo sapiens
agtcttctgtttttcagcagct

SEQ ID NO: 7877396 - DNA, 22 bp, Homo sapiens
agtcttcttgatcttttcagtg

SEQ ID NO: 7877397 - DNA, 22 bp, Homo sapiens
agtcttctttgtgttctctcat

SEQ ID NO: 7877398 - DNA, 22 bp, Homo sapiens
agtcttctttcatttactcagt

SEQ ID NO: 7877399 - DNA, 22 bp, Homo sapiens
agtcttctttgtgttctctcat

SEQ ID NO: 7877400 - DNA, 22 bp, Homo sapiens
agtcttcttttattacttgggg

SEQ ID NO: 7877401 - DNA, 22 bp, Homo sapiens
agtcttgctcttgcatctgctt

SEQ ID NO: 7877402 - DNA, 22 bp, Homo sapiens
agtcttgaaagcacattagagt

SEQ ID NO: 7877403 - DNA, 22 bp, Homo sapiens
agtcttgcattttctgaagatg

SEQ ID NO: 7877404 - DNA, 22 bp, Homo sapiens
actcctggtttgtgtcctggct

SEQ ID NO: 7877405 - DNA, 22 bp, Homo sapiens
actcctggtttgtgtcctggct

SEQ ID NO: 7877406 - DNA, 22 bp, Homo sapiens
actcctggtttgtgtcctggct

SEQ ID NO: 7877407 - DNA, 22 bp, Homo sapiens
actcctgtgaggtaggtggcaa

SEQ ID NO: 7877408 - DNA, 22 bp, Homo sapiens
actcctggttcccagttgagat

SEQ ID NO: 7877409 - DNA, 22 bp, Homo sapiens
actcctggttcccagttgagat

SEQ ID NO: 7877410 - DNA, 22 bp, Homo sapiens
actcctggttcccagttgagat

SEQ ID NO: 7877411 - DNA, 17 bp, Homo sapiens
actcctggtctgaaggg

SEQ ID NO: 7877412 - DNA, 22 bp, Homo sapiens
actcctggtgctgatgaagaga

SEQ ID NO: 7877413 - DNA, 22 bp, Homo sapiens
actcctggtgctgatgaagaga

SEQ ID NO: 7877414 - DNA, 22 bp, Homo sapiens
actcctggtgctgatgaagaga

SEQ ID NO: 7877415 - DNA, 22 bp, Homo sapiens
actcctgggttccggagattct

SEQ ID NO: 7877416 - DNA, 22 bp, Homo sapiens
actcctgggttctaaatttgaa

SEQ ID NO: 7877417 - DNA, 18 bp, Homo sapiens
agtcccatcttcagctct

SEQ ID NO: 7877418 - DNA, 22 bp, Homo sapiens
agtcccatgaggaatggggacg

SEQ ID NO: 7877419 - DNA, 22 bp, Homo sapiens
agtcccatgccaaatgcatcct

SEQ ID NO: 7877420 - DNA, 21 bp, Homo sapiens
agtcccatccggtaagcaagc

SEQ ID NO: 7877421 - DNA, 18 bp, Homo sapiens
agtcccatcttcagctct

SEQ ID NO: 7877422 - DNA, 17 bp, Homo sapiens
actcctggtctgaaggg

SEQ ID NO: 7877423 - DNA, 17 bp, Homo sapiens
actcctggtctgaaggg

SEQ ID NO: 7877424 - DNA, 20 bp, Homo sapiens
actcctggtaacttttgtga

SEQ ID NO: 7877425 - DNA, 20 bp, Homo sapiens
actcctggtaacttttgtga

SEQ ID NO: 7877426 - DNA, 22 bp, Homo sapiens
actcctgggttgcagtcctcaa

SEQ ID NO: 7877427 - DNA, 22 bp, Homo sapiens
agtcccagcttcccccatgcag

SEQ ID NO: 7877428 - DNA, 22 bp, Homo sapiens
agtcccagcttcccccatgcag

SEQ ID NO: 7877429 - DNA, 22 bp, Homo sapiens
agtcccagcttcccccatgcag

SEQ ID NO: 7877430 - DNA, 22 bp, Homo sapiens
agtcccagcttcccccatgcag

SEQ ID NO: 7877431 - DNA, 22 bp, Homo sapiens
agtcccagcttcccccatgcag

SEQ ID NO: 7877432 - DNA, 22 bp, Homo sapiens
agtcccaggcagccgagccggt

SEQ ID NO: 7877433 - DNA, 22 bp, Homo sapiens
agtcccaggcagccgagccggt

SEQ ID NO: 7877434 - DNA, 21 bp, Homo sapiens
agtcccaggggtgagtgatgt

SEQ ID NO: 7877435 - DNA, 22 bp, Homo sapiens
agtcccagtgacttggccagaa

SEQ ID NO: 7877436 - DNA, 19 bp, Homo sapiens
agtcccaggcccgaaagag

SEQ ID NO: 7877437 - DNA, 21 bp, Homo sapiens
agtcccaggggtgagtgatgt

SEQ ID NO: 7877438 - DNA, 21 bp, Homo sapiens
agtcccaggggtgagtgatgt

SEQ ID NO: 7877439 - DNA, 21 bp, Homo sapiens
agtcccaggggtgagtgatgt

SEQ ID NO: 7877440 - DNA, 22 bp, Homo sapiens
agtcccagttcggttcttcctc

SEQ ID NO: 7877441 - DNA, 22 bp, Homo sapiens
agtcccagtgagatgagccacg

SEQ ID NO: 7877442 - DNA, 22 bp, Homo sapiens
agtcccagtgagatgagccacg

SEQ ID NO: 7877443 - DNA, 22 bp, Homo sapiens
agtcccagtgagatgagccacg

SEQ ID NO: 7877444 - DNA, 22 bp, Homo sapiens
agtcccagtgagatgagccacg

SEQ ID NO: 7877445 - DNA, 22 bp, Homo sapiens
agtcccagttcggttcttcctc

SEQ ID NO: 7877446 - DNA, 22 bp, Homo sapiens
agtcccagttcggttcttcctc

SEQ ID NO: 7877447 - DNA, 22 bp, Homo sapiens
agtcccatatccgggttcaggg

SEQ ID NO: 7877448 - DNA, 22 bp, Homo sapiens
agtcccatcagatgatatgaga

SEQ ID NO: 7877449 - DNA, 22 bp, Homo sapiens
agtcccagtgagatgaaccagg

SEQ ID NO: 7877450 - DNA, 22 bp, Homo sapiens
agtcccagtgagatgaaccagg

SEQ ID NO: 7877451 - DNA, 22 bp, Homo sapiens
agtcccagtgacttggccagaa

SEQ ID NO: 7877452 - DNA, 22 bp, Homo sapiens
agtcccagtgacttggccagaa

SEQ ID NO: 7877453 - DNA, 22 bp, Homo sapiens
agtcccagtgacttggccagaa

SEQ ID NO: 7877454 - DNA, 22 bp, Homo sapiens
agtcccagtgacttggccagaa

SEQ ID NO: 7877455 - DNA, 22 bp, Homo sapiens
agtcccagtgagatgagccacg

SEQ ID NO: 7877456 - DNA, 22 bp, Homo sapiens
agtcccagtgagatgagccacg

SEQ ID NO: 7877457 - DNA, 22 bp, Homo sapiens
agtcccagtgagatgagccacg

SEQ ID NO: 7877458 - DNA, 22 bp, Homo sapiens
actcttcacacttgtctccagg

SEQ ID NO: 7877459 - DNA, 22 bp, Homo sapiens
actcttcaccgctactgaaata

SEQ ID NO: 7877460 - DNA, 22 bp, Homo sapiens
actcttcacacttgtctccagg

SEQ ID NO: 7877461 - DNA, 22 bp, Homo sapiens
actcttcacacttgtctccagg

SEQ ID NO: 7877462 - DNA, 22 bp, Homo sapiens
actcttattccctcagaaatat

SEQ ID NO: 7877463 - DNA, 22 bp, Homo sapiens
actcttattccctcagaaatat

SEQ ID NO: 7877464 - DNA, 22 bp, Homo sapiens
actcttattttgaagtaataat

SEQ ID NO: 7877465 - DNA, 22 bp, Homo sapiens
actcttattttgaagtaataat

SEQ ID NO: 7877466 - DNA, 22 bp, Homo sapiens
actcttattttgaagtaataat

SEQ ID NO: 7877467 - DNA, 22 bp, Homo sapiens
actcttcaagggcctagaggtg

SEQ ID NO: 7877468 - DNA, 22 bp, Homo sapiens
actcttcacacatgctgccctc

SEQ ID NO: 7877469 - DNA, 22 bp, Homo sapiens
actcttattttgaagtaataat

SEQ ID NO: 7877470 - DNA, 22 bp, Homo sapiens
actcttcaagggcctagaggtg

SEQ ID NO: 7877471 - DNA, 22 bp, Homo sapiens
agtgcaattttgctttcccaat

SEQ ID NO: 7877472 - DNA, 22 bp, Homo sapiens
actcttcagtacaataatatct

SEQ ID NO: 7877473 - DNA, 22 bp, Homo sapiens
actcttcacttcccctgccagc

SEQ ID NO: 7877474 - DNA, 22 bp, Homo sapiens
actcttcagggcagtgagcggg

SEQ ID NO: 7877475 - DNA, 22 bp, Homo sapiens
actcttcaccgctactgaaata

SEQ ID NO: 7877476 - DNA, 22 bp, Homo sapiens
agtgcaatgaataacagccacc

SEQ ID NO: 7877477 - DNA, 22 bp, Homo sapiens
actcttcagtacaataatatct

SEQ ID NO: 7877478 - DNA, 22 bp, Homo sapiens
agtgcagtgatgaataatggtt

SEQ ID NO: 7877479 - DNA, 22 bp, Homo sapiens
agtgcagtaaatgggcattatg

SEQ ID NO: 7877480 - DNA, 22 bp, Homo sapiens
agtgcaggttaaggaactggcc

SEQ ID NO: 7877481 - DNA, 22 bp, Homo sapiens
agtgcaggttaaggaactggcc

SEQ ID NO: 7877482 - DNA, 22 bp, Homo sapiens
agtgcaggttaaggaactggcc

SEQ ID NO: 7877483 - DNA, 22 bp, Homo sapiens
agtgcaggttaaggaactggcc

SEQ ID NO: 7877484 - DNA, 22 bp, Homo sapiens
agtgcaggttaaggaactggcc

SEQ ID NO: 7877485 - DNA, 22 bp, Homo sapiens
agtgcaggttaaggaactggcc

SEQ ID NO: 7877486 - DNA, 22 bp, Homo sapiens
agtgcagggggaaagggtgtct

SEQ ID NO: 7877487 - DNA, 22 bp, Homo sapiens
agtgcagggggaaagggtgtct

SEQ ID NO: 7877488 - DNA, 22 bp, Homo sapiens
agtgcagggggaaagggtgtct

SEQ ID NO: 7877489 - DNA, 22 bp, Homo sapiens
agtgcaggttaaggaactggcc

SEQ ID NO: 7877490 - DNA, 22 bp, Homo sapiens
actcttatagtattggttatta

SEQ ID NO: 7877491 - DNA, 22 bp, Homo sapiens
actcttattccctcagaaatat

SEQ ID NO: 7877492 - DNA, 22 bp, Homo sapiens
actcttattccctcagaaatat

SEQ ID NO: 7877493 - DNA, 22 bp, Homo sapiens
actcttatgggaacaaggatta

SEQ ID NO: 7877494 - DNA, 19 bp, Homo sapiens
actctgttgtacttgaggg

SEQ ID NO: 7877495 - DNA, 22 bp, Homo sapiens
actctgtgctggggacctcatc

SEQ ID NO: 7877496 - DNA, 22 bp, Homo sapiens
actctgtgtgagtagagcctgt

SEQ ID NO: 7877497 - DNA, 21 bp, Homo sapiens
actctgtcttgagccatctgt

SEQ ID NO: 7877498 - DNA, 21 bp, Homo sapiens
actctgtcttgagccatctgt

SEQ ID NO: 7877499 - DNA, 21 bp, Homo sapiens
actctgtcttgagccatctgt

SEQ ID NO: 7877500 - DNA, 22 bp, Homo sapiens
actctgtatccctctcaaattg

SEQ ID NO: 7877501 - DNA, 22 bp, Homo sapiens
actctgtcacctactcactgta

SEQ ID NO: 7877502 - DNA, 20 bp, Homo sapiens
actctgtaggtaatgagact

SEQ ID NO: 7877503 - DNA, 22 bp, Homo sapiens
actctgtagagtataccaatgt

SEQ ID NO: 7877504 - DNA, 22 bp, Homo sapiens
actctgtagcctgtaagagagc

SEQ ID NO: 7877505 - DNA, 22 bp, Homo sapiens
actctgtagcctgtaagagagc

SEQ ID NO: 7877506 - DNA, 22 bp, Homo sapiens
actgaggatggataggtcatat

SEQ ID NO: 7877507 - DNA, 22 bp, Homo sapiens
actgaggagaaatttgagtgaa

SEQ ID NO: 7877508 - DNA, 22 bp, Homo sapiens
actgaggacagtgaggagggct

SEQ ID NO: 7877509 - DNA, 22 bp, Homo sapiens
actgaggacagtgaggagggct

SEQ ID NO: 7877510 - DNA, 22 bp, Homo sapiens
actgagctgcttgaagtgaact

SEQ ID NO: 7877511 - DNA, 20 bp, Homo sapiens
actgagctgcatggagagga

SEQ ID NO: 7877512 - DNA, 22 bp, Homo sapiens
actgagctgtgacaatgcttaa

SEQ ID NO: 7877513 - DNA, 22 bp, Homo sapiens
actgaggcagaagggtaagtgg

SEQ ID NO: 7877514 - DNA, 21 bp, Homo sapiens
actgaggcaatggatttttgt

SEQ ID NO: 7877515 - DNA, 21 bp, Homo sapiens
actgaggcaatggatttttgt

SEQ ID NO: 7877516 - DNA, 22 bp, Homo sapiens
actgaggcagaagggtaagtgg

SEQ ID NO: 7877517 - DNA, 22 bp, Homo sapiens
actgaggcagaagggtaagtgg

SEQ ID NO: 7877518 - DNA, 22 bp, Homo sapiens
actgaggcagtgaggtcggtct

SEQ ID NO: 7877519 - DNA, 22 bp, Homo sapiens
actgaggatggataggtcatat

SEQ ID NO: 7877520 - DNA, 22 bp, Homo sapiens
actgaggattagcccaggctag

SEQ ID NO: 7877521 - DNA, 22 bp, Homo sapiens
actgaggcttacaaaggtaaag

SEQ ID NO: 7877522 - DNA, 22 bp, Homo sapiens
actgaggcttacaaaggtaaag

SEQ ID NO: 7877523 - DNA, 22 bp, Homo sapiens
actgaggcttacaaaggtaaag

SEQ ID NO: 7877524 - DNA, 21 bp, Homo sapiens
actgagggccagagaggacct

SEQ ID NO: 7877525 - DNA, 22 bp, Homo sapiens
actgaggctagattgctgttct

SEQ ID NO: 7877526 - DNA, 22 bp, Homo sapiens
actgaggctagattgctgttct

SEQ ID NO: 7877527 - DNA, 22 bp, Homo sapiens
actgaggcttaaagagattagg

SEQ ID NO: 7877528 - DNA, 22 bp, Homo sapiens
actgaggcttaaagagattagg

SEQ ID NO: 7877529 - DNA, 22 bp, Homo sapiens
actgaggcttaaagagattagg

SEQ ID NO: 7877530 - DNA, 22 bp, Homo sapiens
actgaggcgcagtccggctgtc

SEQ ID NO: 7877531 - DNA, 22 bp, Homo sapiens
actgaggcccgaggatctcctg

SEQ ID NO: 7877532 - DNA, 22 bp, Homo sapiens
actgaggcgcagtccggctgtc

SEQ ID NO: 7877533 - DNA, 22 bp, Homo sapiens
actgaggcgcagtccggctgtc

SEQ ID NO: 7877534 - DNA, 22 bp, Homo sapiens
actgaggcagtgaggtcggtct

SEQ ID NO: 7877535 - DNA, 22 bp, Homo sapiens
actgaggcccgaggatctcctg

SEQ ID NO: 7877536 - DNA, 22 bp, Homo sapiens
agtgcatgtatctacagtcaca

SEQ ID NO: 7877537 - DNA, 22 bp, Homo sapiens
actgagctcttgactgggagtt

SEQ ID NO: 7877538 - DNA, 22 bp, Homo sapiens
actgagctcttgactgggagtt

SEQ ID NO: 7877539 - DNA, 22 bp, Homo sapiens
actgagctctgatgagatttgg

SEQ ID NO: 7877540 - DNA, 22 bp, Homo sapiens
actgagctgcaagtcagggagg

SEQ ID NO: 7877541 - DNA, 22 bp, Homo sapiens
actgagctgcaagtcagggagg

SEQ ID NO: 7877542 - DNA, 20 bp, Homo sapiens
actgagctgcatggagagga

SEQ ID NO: 7877543 - DNA, 20 bp, Homo sapiens
actgagctgcatggagagga

SEQ ID NO: 7877544 - DNA, 20 bp, Homo sapiens
agtgcatggagggagagggc

SEQ ID NO: 7877545 - DNA, 20 bp, Homo sapiens
agtgcatggagggagagggc

SEQ ID NO: 7877546 - DNA, 19 bp, Homo sapiens
agtgcatgggcgaggtgca

SEQ ID NO: 7877547 - DNA, 18 bp, Homo sapiens
agtgcatgctaggggaag

SEQ ID NO: 7877548 - DNA, 20 bp, Homo sapiens
agtgcatggagggagagggc

SEQ ID NO: 7877549 - DNA, 23 bp, Homo sapiens
agtgcatgcttgacttagcaagc

SEQ ID NO: 7877550 - DNA, 22 bp, Homo sapiens
agtgcatgccttcctgtggatg

SEQ ID NO: 7877551 - DNA, 22 bp, Homo sapiens
agtgcatgcgcttgggaggggt

SEQ ID NO: 7877552 - DNA, 22 bp, Homo sapiens
agtgcatgcgcttgggaggggt

SEQ ID NO: 7877553 - DNA, 22 bp, Homo sapiens
agtgcatgcgcttgggaggggt

SEQ ID NO: 7877554 - DNA, 22 bp, Homo sapiens
agtgcatgcgcttgggaggggt

SEQ ID NO: 7877555 - DNA, 22 bp, Homo sapiens
agtgcatacccttctaaaaagt

SEQ ID NO: 7877556 - DNA, 22 bp, Homo sapiens
agtgcatagggggatgcacagc

SEQ ID NO: 7877557 - DNA, 22 bp, Homo sapiens
agtgcatatatgaagagtatga

SEQ ID NO: 7877558 - DNA, 22 bp, Homo sapiens
agtgcataaaggaaaaactgaa

SEQ ID NO: 7877559 - DNA, 22 bp, Homo sapiens
agtgcataagtggggttgaagg

SEQ ID NO: 7877560 - DNA, 22 bp, Homo sapiens
agtgcagttaggatggggaatt

SEQ ID NO: 7877561 - DNA, 22 bp, Homo sapiens
aggtggcatttacaccatggga

SEQ ID NO: 7877562 - DNA, 22 bp, Homo sapiens
aggtggcatttacaccatggga

SEQ ID NO: 7877563 - DNA, 22 bp, Homo sapiens
aggtggcatgcctgagacataa

SEQ ID NO: 7877564 - DNA, 22 bp, Homo sapiens
aggtggccaagactgtttgaca

SEQ ID NO: 7877565 - DNA, 22 bp, Homo sapiens
aggtggccaataaatgttggag

SEQ ID NO: 7877566 - DNA, 22 bp, Homo sapiens
aggtggcatttacaccatggga

SEQ ID NO: 7877567 - DNA, 22 bp, Homo sapiens
aggtggcatttacaccatggga

SEQ ID NO: 7877568 - DNA, 22 bp, Homo sapiens
aggtggccccaggcctctgcca

SEQ ID NO: 7877569 - DNA, 22 bp, Homo sapiens
aggtggccggtgccagccgggc

SEQ ID NO: 7877570 - DNA, 22 bp, Homo sapiens
aggtggcccagctgacagatag

SEQ ID NO: 7877571 - DNA, 22 bp, Homo sapiens
aggtggccccaggcctctgcca

SEQ ID NO: 7877572 - DNA, 20 bp, Homo sapiens
aggtggcccattatagtgga

SEQ ID NO: 7877573 - DNA, 21 bp, Homo sapiens
aggtggccacaaatctgtttc

SEQ ID NO: 7877574 - DNA, 23 bp, Homo sapiens
aggtggccaccagaatgttaagg

SEQ ID NO: 7877575 - DNA, 19 bp, Homo sapiens
aggtggccatgtccagcct

SEQ ID NO: 7877576 - DNA, 22 bp, Homo sapiens
aggtggctatgaggatgcagtc

SEQ ID NO: 7877577 - DNA, 22 bp, Homo sapiens
aggtggctatgaggatgcagtc

SEQ ID NO: 7877578 - DNA, 22 bp, Homo sapiens
aggtggctcccagtgttgttgt

SEQ ID NO: 7877579 - DNA, 22 bp, Homo sapiens
aggtggctcccagtgttgttgt

SEQ ID NO: 7877580 - DNA, 22 bp, Homo sapiens
aggtggctcctcccatggctgg

SEQ ID NO: 7877581 - DNA, 23 bp, Homo sapiens
aggtggcctttgcctctttctct

SEQ ID NO: 7877582 - DNA, 22 bp, Homo sapiens
aggtggctatgaggatgcagtc

SEQ ID NO: 7877583 - DNA, 22 bp, Homo sapiens
aggtggctatgaggatgcagtc

SEQ ID NO: 7877584 - DNA, 18 bp, Homo sapiens
aggtggcctgggagcttt

SEQ ID NO: 7877585 - DNA, 18 bp, Homo sapiens
aggtggcctgggagcttt

SEQ ID NO: 7877586 - DNA, 22 bp, Homo sapiens
aggtggcctaaggtggcactgg

SEQ ID NO: 7877587 - DNA, 18 bp, Homo sapiens
aggtggcctgggagcttt

SEQ ID NO: 7877588 - DNA, 23 bp, Homo sapiens
aggtggcctttgcctctttctct

SEQ ID NO: 7877589 - DNA, 22 bp, Homo sapiens
aggtggccggtgccagccgggc

SEQ ID NO: 7877590 - DNA, 22 bp, Homo sapiens
aggtggccggtgccagccgggc

SEQ ID NO: 7877591 - DNA, 18 bp, Homo sapiens
aggtggcctgggagcttt

SEQ ID NO: 7877592 - DNA, 22 bp, Homo sapiens
aggtggagatcagggactaagg

SEQ ID NO: 7877593 - DNA, 22 bp, Homo sapiens
aggtggagacccagagaaggcg

SEQ ID NO: 7877594 - DNA, 22 bp, Homo sapiens
aggtggagatcagggactaagg

SEQ ID NO: 7877595 - DNA, 22 bp, Homo sapiens
aggtggcatgcctgagacataa

SEQ ID NO: 7877596 - DNA, 22 bp, Homo sapiens
aggtggcatgcctgagacataa

SEQ ID NO: 7877597 - DNA, 20 bp, Homo sapiens
acctggctctcaggagcaac

SEQ ID NO: 7877598 - DNA, 20 bp, Homo sapiens
acctggctctcaggagcaac

SEQ ID NO: 7877599 - DNA, 22 bp, Homo sapiens
acctggccatccagctggcatc

SEQ ID NO: 7877600 - DNA, 22 bp, Homo sapiens
acctggccatccagctggcatc

SEQ ID NO: 7877601 - DNA, 22 bp, Homo sapiens
acctggccccactgtgctgctg

SEQ ID NO: 7877602 - DNA, 22 bp, Homo sapiens
acctggccccactgtgctgctg

SEQ ID NO: 7877603 - DNA, 19 bp, Homo sapiens
acctggcctcttgagcaag

SEQ ID NO: 7877604 - DNA, 19 bp, Homo sapiens
acctggcctcttgagcaag

SEQ ID NO: 7877605 - DNA, 22 bp, Homo sapiens
acctggcactacaggcacctgt

SEQ ID NO: 7877606 - DNA, 22 bp, Homo sapiens
acctggcactacaggcacctgt

SEQ ID NO: 7877607 - DNA, 22 bp, Homo sapiens
acctggcactacaggcacctgt

SEQ ID NO: 7877608 - DNA, 22 bp, Homo sapiens
acctggcactacaggcacctgt

SEQ ID NO: 7877609 - DNA, 22 bp, Homo sapiens
acctggcataagggcttgagtc

SEQ ID NO: 7877610 - DNA, 22 bp, Homo sapiens
acctggcaggaaggtgggtgat

SEQ ID NO: 7877611 - DNA, 22 bp, Homo sapiens
acctggcaggaaggtgggtgat

SEQ ID NO: 7877612 - DNA, 22 bp, Homo sapiens
acctggccagtggggccgcgct

SEQ ID NO: 7877613 - DNA, 22 bp, Homo sapiens
acctggccatccagctggcatc

SEQ ID NO: 7877614 - DNA, 22 bp, Homo sapiens
acctggccagtggggccgcgct

SEQ ID NO: 7877615 - DNA, 22 bp, Homo sapiens
acctggcatgaagcatgcctta

SEQ ID NO: 7877616 - DNA, 22 bp, Homo sapiens
acctggccaatttttgtatttt

SEQ ID NO: 7877617 - DNA, 22 bp, Homo sapiens
acctggccaatttttgtatttt

SEQ ID NO: 7877618 - DNA, 19 bp, Homo sapiens
acctggccagagttcaata

SEQ ID NO: 7877619 - DNA, 19 bp, Homo sapiens
acctggccagagttcaata

SEQ ID NO: 7877620 - DNA, 22 bp, Homo sapiens
aggtcctgtgtccaggggcctg

SEQ ID NO: 7877621 - DNA, 20 bp, Homo sapiens
aggtcctgttccttgtctcc

SEQ ID NO: 7877622 - DNA, 22 bp, Homo sapiens
aggtcctgtgtccaggggcctg

SEQ ID NO: 7877623 - DNA, 22 bp, Homo sapiens
aggtcctgtgtccaggggcctg

SEQ ID NO: 7877624 - DNA, 22 bp, Homo sapiens
aggtcctgtggtttgggtaaaa

SEQ ID NO: 7877625 - DNA, 22 bp, Homo sapiens
aggtcctgtcttatctctgtaa

SEQ ID NO: 7877626 - DNA, 22 bp, Homo sapiens
aggtcctgtcttatctctgtaa

SEQ ID NO: 7877627 - DNA, 22 bp, Homo sapiens
aggtcctgtcttatctctgtaa

SEQ ID NO: 7877628 - DNA, 22 bp, Homo sapiens
aggtcctgtcttatctctgtaa

SEQ ID NO: 7877629 - DNA, 22 bp, Homo sapiens
aggtcctgtcttatctctgtaa

SEQ ID NO: 7877630 - DNA, 22 bp, Homo sapiens
aggtccagttgccagaatggcc

SEQ ID NO: 7877631 - DNA, 22 bp, Homo sapiens
aggtcctgtctatcaccctcgc

SEQ ID NO: 7877632 - DNA, 22 bp, Homo sapiens
aggtccagttttcagttctcat

SEQ ID NO: 7877633 - DNA, 22 bp, Homo sapiens
aggtcctgtttcttccctgggg

SEQ ID NO: 7877634 - DNA, 22 bp, Homo sapiens
aggtcctgtttcttccctgggg

SEQ ID NO: 7877635 - DNA, 22 bp, Homo sapiens
aggtcctgtttcttccctgggg

SEQ ID NO: 7877636 - DNA, 19 bp, Homo sapiens
aggtctaatcataagacaa

SEQ ID NO: 7877637 - DNA, 22 bp, Homo sapiens
aggtctaactgatagaattcat

SEQ ID NO: 7877638 - DNA, 22 bp, Homo sapiens
aggtcgagtttcggggctactt

SEQ ID NO: 7877639 - DNA, 22 bp, Homo sapiens
aggtctcaatctcaggtggtca

SEQ ID NO: 7877640 - DNA, 22 bp, Homo sapiens
aggtctcaattcctgctcctgt

SEQ ID NO: 7877641 - DNA, 22 bp, Homo sapiens
aggtctcaagagaaaagtggtg

SEQ ID NO: 7877642 - DNA, 22 bp, Homo sapiens
aggtctcaaactggcaccctgt

SEQ ID NO: 7877643 - DNA, 22 bp, Homo sapiens
aggtctcaaactggcaccctgt

SEQ ID NO: 7877644 - DNA, 20 bp, Homo sapiens
aggtctcagagcaagagccc

SEQ ID NO: 7877645 - DNA, 22 bp, Homo sapiens
aggtctcaatctcaggtggtca

SEQ ID NO: 7877646 - DNA, 22 bp, Homo sapiens
aggtctcctcatattctgcctc

SEQ ID NO: 7877647 - DNA, 22 bp, Homo sapiens
aggtctcctcatattctgcctc

SEQ ID NO: 7877648 - DNA, 22 bp, Homo sapiens
aggtctctcacactcacagggc

SEQ ID NO: 7877649 - DNA, 22 bp, Homo sapiens
aggtctctgagtactgctggac

SEQ ID NO: 7877650 - DNA, 22 bp, Homo sapiens
aggtctctgagtactgctggac

SEQ ID NO: 7877651 - DNA, 22 bp, Homo sapiens
aggtctctgagtactgctggac

SEQ ID NO: 7877652 - DNA, 22 bp, Homo sapiens
aggtctctggggaactccaggg

SEQ ID NO: 7877653 - DNA, 22 bp, Homo sapiens
aggtctctggggaactccaggg

SEQ ID NO: 7877654 - DNA, 22 bp, Homo sapiens
acctggcacagagtatgctctc

SEQ ID NO: 7877655 - DNA, 22 bp, Homo sapiens
acctggcacacactggggagtg

SEQ ID NO: 7877656 - DNA, 22 bp, Homo sapiens
acctggcacattctaccacagt

SEQ ID NO: 7877657 - DNA, 22 bp, Homo sapiens
acctggatgctggccttgcctt

SEQ ID NO: 7877658 - DNA, 22 bp, Homo sapiens
acctggattttgcttagacatg

SEQ ID NO: 7877659 - DNA, 22 bp, Homo sapiens
acctggcacacactggggagtg

SEQ ID NO: 7877660 - DNA, 22 bp, Homo sapiens
aggtctcttgctgtctctgggc

SEQ ID NO: 7877661 - DNA, 22 bp, Homo sapiens
aggtctcttgctgtctctgggc

SEQ ID NO: 7877662 - DNA, 22 bp, Homo sapiens
acctggagtcatttgaggagta

SEQ ID NO: 7877663 - DNA, 22 bp, Homo sapiens
acctgagaatgggggcatgtgt

SEQ ID NO: 7877664 - DNA, 22 bp, Homo sapiens
acctgaccaggtggcttcccaa

SEQ ID NO: 7877665 - DNA, 22 bp, Homo sapiens
acctgaattttggatgagctgt

SEQ ID NO: 7877666 - DNA, 22 bp, Homo sapiens
acctgaatttgaaatgtttatt

SEQ ID NO: 7877667 - DNA, 22 bp, Homo sapiens
acctgaattgatttgacctgta

SEQ ID NO: 7877668 - DNA, 22 bp, Homo sapiens
acctgaactggtctgctgcccg

SEQ ID NO: 7877669 - DNA, 22 bp, Homo sapiens
acctgaattgtcatatcttatt

SEQ ID NO: 7877670 - DNA, 22 bp, Homo sapiens
acctgaaactcaactttatctc

SEQ ID NO: 7877671 - DNA, 22 bp, Homo sapiens
acctgaaaccaacttgtgtact

SEQ ID NO: 7877672 - DNA, 22 bp, Homo sapiens
acctgaaactcaactttatctc

SEQ ID NO: 7877673 - DNA, 22 bp, Homo sapiens
acctgaaaccaacttgtgtact

SEQ ID NO: 7877674 - DNA, 22 bp, Homo sapiens
acctgaaaattattatttccgc

SEQ ID NO: 7877675 - DNA, 22 bp, Homo sapiens
acctgaaaattattatttccgc

SEQ ID NO: 7877676 - DNA, 22 bp, Homo sapiens
acctcttaatattgcaccttct

SEQ ID NO: 7877677 - DNA, 22 bp, Homo sapiens
acctctttgaacctcagtgtga

SEQ ID NO: 7877678 - DNA, 22 bp, Homo sapiens
acctctgtatagttgcctgtgg

SEQ ID NO: 7877679 - DNA, 22 bp, Homo sapiens
acctctgtatagttgcctgtgg

SEQ ID NO: 7877680 - DNA, 22 bp, Homo sapiens
acctctgtacctcctctgacag

SEQ ID NO: 7877681 - DNA, 22 bp, Homo sapiens
acctctgtacctcctctgacag

SEQ ID NO: 7877682 - DNA, 22 bp, Homo sapiens
acctctgggcagcacctttgta

SEQ ID NO: 7877683 - DNA, 22 bp, Homo sapiens
acctctgggaaaagtatggaaa

SEQ ID NO: 7877684 - DNA, 22 bp, Homo sapiens
acctcctgatgagagtaaagga

SEQ ID NO: 7877685 - DNA, 22 bp, Homo sapiens
acctctggccaagactcgtgtt

SEQ ID NO: 7877686 - DNA, 22 bp, Homo sapiens
acctctggccttcaggcatcat

SEQ ID NO: 7877687 - DNA, 22 bp, Homo sapiens
acctctgggaaaagtatggaaa

SEQ ID NO: 7877688 - DNA, 22 bp, Homo sapiens
acctcctgatgagagtaaagga

SEQ ID NO: 7877689 - DNA, 22 bp, Homo sapiens
acctcctccaaggagccatagg

SEQ ID NO: 7877690 - DNA, 22 bp, Homo sapiens
acctcccttgctaaagactgtg

SEQ ID NO: 7877691 - DNA, 22 bp, Homo sapiens
accctctgcatcagcttcttta

SEQ ID NO: 7877692 - DNA, 20 bp, Homo sapiens
accctctgaatagtatctgg

SEQ ID NO: 7877693 - DNA, 20 bp, Homo sapiens
accctctgaatagtatctgg

SEQ ID NO: 7877694 - DNA, 19 bp, Homo sapiens
accctctctgtagaaagat

SEQ ID NO: 7877695 - DNA, 19 bp, Homo sapiens
accctctccccactgggtc

SEQ ID NO: 7877696 - DNA, 19 bp, Homo sapiens
accctctcagtgcctgagg

SEQ ID NO: 7877697 - DNA, 22 bp, Homo sapiens
accctctagagggaagcacttt

SEQ ID NO: 7877698 - DNA, 22 bp, Homo sapiens
accctccccaagaggtcgtgcc

SEQ ID NO: 7877699 - DNA, 22 bp, Homo sapiens
accctccccaagaggtcgtgcc

SEQ ID NO: 7877700 - DNA, 22 bp, Homo sapiens
accctccccaagaggtcgtgcc

SEQ ID NO: 7877701 - DNA, 22 bp, Homo sapiens
accctccccaagaggtcgtgcc

SEQ ID NO: 7877702 - DNA, 22 bp, Homo sapiens
accctcccatttccatgtagca

SEQ ID NO: 7877703 - DNA, 22 bp, Homo sapiens
accctcccatttccatgtagca

SEQ ID NO: 7877704 - DNA, 22 bp, Homo sapiens
accctcccatttccatgtagca

SEQ ID NO: 7877705 - DNA, 22 bp, Homo sapiens
accctcccatttccatgtagca

SEQ ID NO: 7877706 - DNA, 22 bp, Homo sapiens
accctccaggctgcagctcctg

SEQ ID NO: 7877707 - DNA, 22 bp, Homo sapiens
accctccaggctgcagctcctg

SEQ ID NO: 7877708 - DNA, 22 bp, Homo sapiens
accctccaggctgcagctcctg

SEQ ID NO: 7877709 - DNA, 22 bp, Homo sapiens
acctgcagtggccactcctaat

SEQ ID NO: 7877710 - DNA, 22 bp, Homo sapiens
acctgcagtggccactcctaat

SEQ ID NO: 7877711 - DNA, 21 bp, Homo sapiens
acctgccacattgcagacttg

SEQ ID NO: 7877712 - DNA, 22 bp, Homo sapiens
acctgccagaatccaagccaca

SEQ ID NO: 7877713 - DNA, 22 bp, Homo sapiens
acctgccaagcatcagtggcag

SEQ ID NO: 7877714 - DNA, 22 bp, Homo sapiens
aggtccagttgccagaatggcc

SEQ ID NO: 7877715 - DNA, 22 bp, Homo sapiens
aggtccagttgccagaatggcc

SEQ ID NO: 7877716 - DNA, 22 bp, Homo sapiens
aggtccagttgccagaatggcc

SEQ ID NO: 7877717 - DNA, 22 bp, Homo sapiens
acctgcccacacttccttccca

SEQ ID NO: 7877718 - DNA, 22 bp, Homo sapiens
acctgccagctgagaagggtgt

SEQ ID NO: 7877719 - DNA, 19 bp, Homo sapiens
acctgccatgacagcctga

SEQ ID NO: 7877720 - DNA, 22 bp, Homo sapiens
acctgccagtgaatactatctt

SEQ ID NO: 7877721 - DNA, 22 bp, Homo sapiens
acctgccagaatgctagtcctg

SEQ ID NO: 7877722 - DNA, 22 bp, Homo sapiens
acctgccagaatgctagtcctg

SEQ ID NO: 7877723 - DNA, 22 bp, Homo sapiens
acctgcaggggtgctctctggg

SEQ ID NO: 7877724 - DNA, 19 bp, Homo sapiens
acctgcagtaataattcct

SEQ ID NO: 7877725 - DNA, 22 bp, Homo sapiens
acctgcagtggccactcctaat

SEQ ID NO: 7877726 - DNA, 22 bp, Homo sapiens
acctgcagctaaagatgtaggg

SEQ ID NO: 7877727 - DNA, 22 bp, Homo sapiens
acctgcagctgagaaaatgact

SEQ ID NO: 7877728 - DNA, 22 bp, Homo sapiens
acctgcagctaaagatgtaggg

SEQ ID NO: 7877729 - DNA, 22 bp, Homo sapiens
acctgagacttgggatgggaat

SEQ ID NO: 7877730 - DNA, 22 bp, Homo sapiens
acctgagacttgggatgggaat

SEQ ID NO: 7877731 - DNA, 22 bp, Homo sapiens
acctgagacctaatctgactgt

SEQ ID NO: 7877732 - DNA, 22 bp, Homo sapiens
acctgagacttgggatgggaat

SEQ ID NO: 7877733 - DNA, 22 bp, Homo sapiens
acctgagcatgccaggagagtg

SEQ ID NO: 7877734 - DNA, 22 bp, Homo sapiens
acctgaggactggatggtagaa

SEQ ID NO: 7877735 - DNA, 21 bp, Homo sapiens
acctgagctccacctcctgcc

SEQ ID NO: 7877736 - DNA, 22 bp, Homo sapiens
acctgatgtatagattctagat

SEQ ID NO: 7877737 - DNA, 23 bp, Homo sapiens
acctgcaaatttggtcctcttct

SEQ ID NO: 7877738 - DNA, 18 bp, Homo sapiens
acctgattggcgcagccc

SEQ ID NO: 7877739 - DNA, 20 bp, Homo sapiens
acctgaggtccctatggtct

SEQ ID NO: 7877740 - DNA, 22 bp, Homo sapiens
acctgaggcctccccagcagac

SEQ ID NO: 7877741 - DNA, 22 bp, Homo sapiens
acctgaggcctccccagcagac

SEQ ID NO: 7877742 - DNA, 22 bp, Homo sapiens
acctgaggctgttagtctaggt

SEQ ID NO: 7877743 - DNA, 22 bp, Homo sapiens
agtatactgaaagtaaatatga

SEQ ID NO: 7877744 - DNA, 22 bp, Homo sapiens
agtatactgaaagtaaatatga

SEQ ID NO: 7877745 - DNA, 19 bp, Homo sapiens
agtatagagtattgaggag

SEQ ID NO: 7877746 - DNA, 22 bp, Homo sapiens
agtatactgaaagtaaatatga

SEQ ID NO: 7877747 - DNA, 22 bp, Homo sapiens
agtatacatatattagccttcg

SEQ ID NO: 7877748 - DNA, 22 bp, Homo sapiens
actagtgaagaagatttgactg

SEQ ID NO: 7877749 - DNA, 22 bp, Homo sapiens
actagtattgcctactgtacat

SEQ ID NO: 7877750 - DNA, 22 bp, Homo sapiens
actagtctgcattacaaaatag

SEQ ID NO: 7877751 - DNA, 22 bp, Homo sapiens
actagtctgccagggagaggca

SEQ ID NO: 7877752 - DNA, 22 bp, Homo sapiens
actaggggctcaggcccaggga

SEQ ID NO: 7877753 - DNA, 22 bp, Homo sapiens
actaggggctcaggcccaggga

SEQ ID NO: 7877754 - DNA, 22 bp, Homo sapiens
actaggggctcaggcccaggga

SEQ ID NO: 7877755 - DNA, 22 bp, Homo sapiens
actaggaaggcatatgggcaga

SEQ ID NO: 7877756 - DNA, 21 bp, Homo sapiens
actagctttctggagaagtgt

SEQ ID NO: 7877757 - DNA, 22 bp, Homo sapiens
actagctttacagcatgagtgg

SEQ ID NO: 7877758 - DNA, 22 bp, Homo sapiens
actagcttgggcctgggtcaga

SEQ ID NO: 7877759 - DNA, 22 bp, Homo sapiens
actaggaagtggcaaaactgga

SEQ ID NO: 7877760 - DNA, 22 bp, Homo sapiens
actaggaattcaagtagacaga

SEQ ID NO: 7877761 - DNA, 22 bp, Homo sapiens
actaggaattcaagtagacaga

SEQ ID NO: 7877762 - DNA, 22 bp, Homo sapiens
actaggggctcaggcccaggga

SEQ ID NO: 7877763 - DNA, 22 bp, Homo sapiens
actagggagatcaattgtgcag

SEQ ID NO: 7877764 - DNA, 22 bp, Homo sapiens
actagggattacactgtattca

SEQ ID NO: 7877765 - DNA, 22 bp, Homo sapiens
actagggaaagttatgttcaca

SEQ ID NO: 7877766 - DNA, 22 bp, Homo sapiens
actagggaaagttatgttcaca

SEQ ID NO: 7877767 - DNA, 22 bp, Homo sapiens
actagggagaagcacttacaca

SEQ ID NO: 7877768 - DNA, 22 bp, Homo sapiens
actagggaaagttatgttcaca

SEQ ID NO: 7877769 - DNA, 22 bp, Homo sapiens
agtatttgatacagtcttctag

SEQ ID NO: 7877770 - DNA, 22 bp, Homo sapiens
agtatttgaagatgttgagtac

SEQ ID NO: 7877771 - DNA, 22 bp, Homo sapiens
agtatttgagaggtccaggtgt

SEQ ID NO: 7877772 - DNA, 22 bp, Homo sapiens
agtatttgagaggtccaggtgt

SEQ ID NO: 7877773 - DNA, 22 bp, Homo sapiens
agtatttgaagatgttgagtac

SEQ ID NO: 7877774 - DNA, 22 bp, Homo sapiens
agtatttgtggatttgtattgg

SEQ ID NO: 7877775 - DNA, 22 bp, Homo sapiens
agtatttgttgaatgagtgaat

SEQ ID NO: 7877776 - DNA, 22 bp, Homo sapiens
agtatttgttgattgatatgaa

SEQ ID NO: 7877777 - DNA, 22 bp, Homo sapiens
agtatttgtggatttgtattgg

SEQ ID NO: 7877778 - DNA, 22 bp, Homo sapiens
agtatttggtgtggtattgacc

SEQ ID NO: 7877779 - DNA, 22 bp, Homo sapiens
agtatttgttgaatgagtgaat

SEQ ID NO: 7877780 - DNA, 22 bp, Homo sapiens
agtatttggcctctacagtctc

SEQ ID NO: 7877781 - DNA, 22 bp, Homo sapiens
agtatttgatcagatgatagta

SEQ ID NO: 7877782 - DNA, 22 bp, Homo sapiens
agtatttgcatgttagggacct

SEQ ID NO: 7877783 - DNA, 22 bp, Homo sapiens
agtatttggcctctacagtctc

SEQ ID NO: 7877784 - DNA, 22 bp, Homo sapiens
agtattttcgccatcacaagaa

SEQ ID NO: 7877785 - DNA, 22 bp, Homo sapiens
agtcaaactgcctaggaagcag

SEQ ID NO: 7877786 - DNA, 22 bp, Homo sapiens
agtattttcaaccatagcctgg

SEQ ID NO: 7877787 - DNA, 22 bp, Homo sapiens
agtcaaagatgaccgagttcct

SEQ ID NO: 7877788 - DNA, 22 bp, Homo sapiens
agtcaaactgcctaggaagcag

SEQ ID NO: 7877789 - DNA, 22 bp, Homo sapiens
agtcaaactgcctaggaagcag

SEQ ID NO: 7877790 - DNA, 22 bp, Homo sapiens
agtcaaagatgaccgagttcct

SEQ ID NO: 7877791 - DNA, 22 bp, Homo sapiens
agtcaaataagactgtcataag

SEQ ID NO: 7877792 - DNA, 22 bp, Homo sapiens
agtcaaagggtatttggattga

SEQ ID NO: 7877793 - DNA, 22 bp, Homo sapiens
agtcaaagctacaggcatttga

SEQ ID NO: 7877794 - DNA, 22 bp, Homo sapiens
agtcccagctctgccacttact

SEQ ID NO: 7877795 - DNA, 22 bp, Homo sapiens
agtcccagctctgccacttact

SEQ ID NO: 7877796 - DNA, 22 bp, Homo sapiens
agtcccagctcagaaccactag

SEQ ID NO: 7877797 - DNA, 22 bp, Homo sapiens
agtcccagctcagaaccactag

SEQ ID NO: 7877798 - DNA, 22 bp, Homo sapiens
agtccaggcgggtatagaggct

SEQ ID NO: 7877799 - DNA, 22 bp, Homo sapiens
agtcccagctactcaagaggct

SEQ ID NO: 7877800 - DNA, 22 bp, Homo sapiens
agtccaggcgggtatagaggct

SEQ ID NO: 7877801 - DNA, 22 bp, Homo sapiens
agtccaggcgggtatagaggct

SEQ ID NO: 7877802 - DNA, 22 bp, Homo sapiens
agtccaggcgggtatagaggct

SEQ ID NO: 7877803 - DNA, 22 bp, Homo sapiens
agtccaggcgggtatagaggct

SEQ ID NO: 7877804 - DNA, 22 bp, Homo sapiens
agtccaggcgggtatagaggct

SEQ ID NO: 7877805 - DNA, 22 bp, Homo sapiens
agtccaggcgggtatagaggct

SEQ ID NO: 7877806 - DNA, 22 bp, Homo sapiens
agtccaggcgggtatagaggct

SEQ ID NO: 7877807 - DNA, 22 bp, Homo sapiens
actcaggctgttttttccttgt

SEQ ID NO: 7877808 - DNA, 22 bp, Homo sapiens
actcaggcttcaggcacagctg

SEQ ID NO: 7877809 - DNA, 19 bp, Homo sapiens
actcaggcttcctctgagg

SEQ ID NO: 7877810 - DNA, 22 bp, Homo sapiens
actcaggagggatcagctatca

SEQ ID NO: 7877811 - DNA, 17 bp, Homo sapiens
actcaggatctgggagt

SEQ ID NO: 7877812 - DNA, 19 bp, Homo sapiens
actcaggcaatgagaaaca

SEQ ID NO: 7877813 - DNA, 21 bp, Homo sapiens
actcaggcaccaggggatggc

SEQ ID NO: 7877814 - DNA, 21 bp, Homo sapiens
actcaggcaccaggggatggc

SEQ ID NO: 7877815 - DNA, 22 bp, Homo sapiens
actcaggcactcagccctcgcc

SEQ ID NO: 7877816 - DNA, 22 bp, Homo sapiens
actcaggagggatcagctatca

SEQ ID NO: 7877817 - DNA, 22 bp, Homo sapiens
actcaggcactcagccctcgcc

SEQ ID NO: 7877818 - DNA, 22 bp, Homo sapiens
actcaggctacaggggcagaag

SEQ ID NO: 7877819 - DNA, 22 bp, Homo sapiens
actcaggctagggaaaaagtgg

SEQ ID NO: 7877820 - DNA, 22 bp, Homo sapiens
actcaggctacaacgcgtggct

SEQ ID NO: 7877821 - DNA, 22 bp, Homo sapiens
actcaggccccatcgcccatct

SEQ ID NO: 7877822 - DNA, 22 bp, Homo sapiens
actcaggccccatcgcccatct

SEQ ID NO: 7877823 - DNA, 22 bp, Homo sapiens
actcaggcctccttctgtcctt

SEQ ID NO: 7877824 - DNA, 22 bp, Homo sapiens
actcaggctacaacgcgtggct

SEQ ID NO: 7877825 - DNA, 22 bp, Homo sapiens
agtcaaataagactgtcataag

SEQ ID NO: 7877826 - DNA, 22 bp, Homo sapiens
agtcaaataagactgtcataag

SEQ ID NO: 7877827 - DNA, 22 bp, Homo sapiens
agtcaaataagactgtcataag

SEQ ID NO: 7877828 - DNA, 22 bp, Homo sapiens
agtcaaatatcttaaaaggcta

SEQ ID NO: 7877829 - DNA, 22 bp, Homo sapiens
agtcaaataagagagagatgtt

SEQ ID NO: 7877830 - DNA, 22 bp, Homo sapiens
agtcaaataagagagagatgtt

SEQ ID NO: 7877831 - DNA, 22 bp, Homo sapiens
agtcaaatgagtaaatatataa

SEQ ID NO: 7877832 - DNA, 22 bp, Homo sapiens
agtcaaatatcttaaaaggcta

SEQ ID NO: 7877833 - DNA, 22 bp, Homo sapiens
agtcaaatgagtaaatatataa

SEQ ID NO: 7877834 - DNA, 22 bp, Homo sapiens
agtcaacaaaaatgtggagcct

SEQ ID NO: 7877835 - DNA, 22 bp, Homo sapiens
agtcaacagtttttgatgtaaa

SEQ ID NO: 7877836 - DNA, 22 bp, Homo sapiens
agtcaaccggtattagtctgtt

SEQ ID NO: 7877837 - DNA, 22 bp, Homo sapiens
agtcaaccatttagaagagtgt

SEQ ID NO: 7877838 - DNA, 22 bp, Homo sapiens
agtcaacatttgagatgcaatg

SEQ ID NO: 7877839 - DNA, 22 bp, Homo sapiens
agtcaacacctggttctattac

SEQ ID NO: 7877840 - DNA, 22 bp, Homo sapiens
agtcaacacattaaacctaggg

SEQ ID NO: 7877841 - DNA, 22 bp, Homo sapiens
agtcaacacctggttctattac

SEQ ID NO: 7877842 - DNA, 22 bp, Homo sapiens
actcaggaaatgagaggctctc

SEQ ID NO: 7877843 - DNA, 22 bp, Homo sapiens
actcaggaaatgaagactggtt

SEQ ID NO: 7877844 - DNA, 23 bp, Homo sapiens
actcagctttgggagatgactca

SEQ ID NO: 7877845 - DNA, 22 bp, Homo sapiens
actcaggaaaaatgtagtgata

SEQ ID NO: 7877846 - DNA, 23 bp, Homo sapiens
actcagctttgggagatgactca

SEQ ID NO: 7877847 - DNA, 22 bp, Homo sapiens
agtcaagagacttaaaatattt

SEQ ID NO: 7877848 - DNA, 22 bp, Homo sapiens
actcagcttcctacagctagaa

SEQ ID NO: 7877849 - DNA, 22 bp, Homo sapiens
agtcaactgttttgctaatgat

SEQ ID NO: 7877850 - DNA, 22 bp, Homo sapiens
agtcaactgttttgctaatgat

SEQ ID NO: 7877851 - DNA, 22 bp, Homo sapiens
actcaggaagaaagcagctggt

SEQ ID NO: 7877852 - DNA, 22 bp, Homo sapiens
actcaggaatggggctgggact

SEQ ID NO: 7877853 - DNA, 21 bp, Homo sapiens
actcaggagactaactatgtc

SEQ ID NO: 7877854 - DNA, 18 bp, Homo sapiens
actcaggaaatgatgaca

SEQ ID NO: 7877855 - DNA, 22 bp, Homo sapiens
actcaggaaattgagataatgg

SEQ ID NO: 7877856 - DNA, 22 bp, Homo sapiens
actagattttggccattataca

SEQ ID NO: 7877857 - DNA, 22 bp, Homo sapiens
actagcaagttttgtgtctgga

SEQ ID NO: 7877858 - DNA, 19 bp, Homo sapiens
actagcacccaggtaaatg

SEQ ID NO: 7877859 - DNA, 22 bp, Homo sapiens
actagctgtgacagctgcgtgt

SEQ ID NO: 7877860 - DNA, 22 bp, Homo sapiens
actagacatcgagctacagagt

SEQ ID NO: 7877861 - DNA, 22 bp, Homo sapiens
actagacatcgagctacagagt

SEQ ID NO: 7877862 - DNA, 22 bp, Homo sapiens
actagacaggttgtactattgg

SEQ ID NO: 7877863 - DNA, 22 bp, Homo sapiens
actagaatgcaagctccacaag

SEQ ID NO: 7877864 - DNA, 22 bp, Homo sapiens
actagaatgcaagctccacaag

SEQ ID NO: 7877865 - DNA, 22 bp, Homo sapiens
actagaatgcaggattggtctc

SEQ ID NO: 7877866 - DNA, 23 bp, Homo sapiens
actagacttcatcgaaggttacc

SEQ ID NO: 7877867 - DNA, 19 bp, Homo sapiens
actagatacaacatgcaga

SEQ ID NO: 7877868 - DNA, 22 bp, Homo sapiens
actagataattataaaaggtag

SEQ ID NO: 7877869 - DNA, 22 bp, Homo sapiens
actagattttggccattataca

SEQ ID NO: 7877870 - DNA, 22 bp, Homo sapiens
actagattttggccattataca

SEQ ID NO: 7877871 - DNA, 22 bp, Homo sapiens
actagattttggccattataca

SEQ ID NO: 7877872 - DNA, 22 bp, Homo sapiens
agtaaacagaaagcaagatgat

SEQ ID NO: 7877873 - DNA, 22 bp, Homo sapiens
agtaaacagaaagcaagatgat

SEQ ID NO: 7877874 - DNA, 22 bp, Homo sapiens
agtaaacagaaagcaagatgat

SEQ ID NO: 7877875 - DNA, 22 bp, Homo sapiens
agtaaacactgtctttatatat

SEQ ID NO: 7877876 - DNA, 22 bp, Homo sapiens
agtaaacagaaagcaagatgat

SEQ ID NO: 7877877 - DNA, 22 bp, Homo sapiens
agtaaacagaaagcaagatgat

SEQ ID NO: 7877878 - DNA, 22 bp, Homo sapiens
agtaaacagtaggaactgagaa

SEQ ID NO: 7877879 - DNA, 22 bp, Homo sapiens
actagaaccagaggaggcaggt

SEQ ID NO: 7877880 - DNA, 22 bp, Homo sapiens
actagaaccagaggaggcaggt

SEQ ID NO: 7877881 - DNA, 22 bp, Homo sapiens
actagaacttctaactaaggtc

SEQ ID NO: 7877882 - DNA, 22 bp, Homo sapiens
actagaacttctaactaaggtc

SEQ ID NO: 7877883 - DNA, 22 bp, Homo sapiens
agtaaacagtaggaactgagaa

SEQ ID NO: 7877884 - DNA, 22 bp, Homo sapiens
agtaaacagtaggaactgagaa

SEQ ID NO: 7877885 - DNA, 22 bp, Homo sapiens
agtaaacagaaagcaagatgat

SEQ ID NO: 7877886 - DNA, 22 bp, Homo sapiens
agtaaacactgtctttatatat

SEQ ID NO: 7877887 - DNA, 22 bp, Homo sapiens
agtaaacaggcatgatagtgtt

SEQ ID NO: 7877888 - DNA, 22 bp, Homo sapiens
agtaaaatcaccatctctttgt

SEQ ID NO: 7877889 - DNA, 22 bp, Homo sapiens
agtaaaatcttaagcacagtgg

SEQ ID NO: 7877890 - DNA, 22 bp, Homo sapiens
agtaaaatcttaagcacagtgg

SEQ ID NO: 7877891 - DNA, 22 bp, Homo sapiens
agtaaaattaatggatcagaag

SEQ ID NO: 7877892 - DNA, 22 bp, Homo sapiens
agtaaaattaatggatcagaag

SEQ ID NO: 7877893 - DNA, 22 bp, Homo sapiens
agtaaaattaatggatcagaag

SEQ ID NO: 7877894 - DNA, 22 bp, Homo sapiens
agtaaaacagagaaatcactca

SEQ ID NO: 7877895 - DNA, 22 bp, Homo sapiens
agtaaaacagagaaatcactca

SEQ ID NO: 7877896 - DNA, 22 bp, Homo sapiens
agtaaaatcaccatctctttgt

SEQ ID NO: 7877897 - DNA, 22 bp, Homo sapiens
agtaaaatcaccatctctttgt

SEQ ID NO: 7877898 - DNA, 22 bp, Homo sapiens
agtaaacactaaaatgactgcg

SEQ ID NO: 7877899 - DNA, 22 bp, Homo sapiens
agtaaacactgtctttatatat

SEQ ID NO: 7877900 - DNA, 22 bp, Homo sapiens
agtaaacactgtctttatatat

SEQ ID NO: 7877901 - DNA, 22 bp, Homo sapiens
agtaaacacgtggggtttcttt

SEQ ID NO: 7877902 - DNA, 22 bp, Homo sapiens
agtaaacacgtggggtttcttt

SEQ ID NO: 7877903 - DNA, 22 bp, Homo sapiens
agtaaacactaaaatgactgcg

SEQ ID NO: 7877904 - DNA, 22 bp, Homo sapiens
agtaaacactaaaatgactgcg

SEQ ID NO: 7877905 - DNA, 22 bp, Homo sapiens
agtaaaattgtattggaaaaca

SEQ ID NO: 7877906 - DNA, 22 bp, Homo sapiens
agtaaaattgtattggaaaaca

SEQ ID NO: 7877907 - DNA, 22 bp, Homo sapiens
agtaaaattgtattggaaaaca

SEQ ID NO: 7877908 - DNA, 22 bp, Homo sapiens
agtaaacaatgtatgaggacag

SEQ ID NO: 7877909 - DNA, 22 bp, Homo sapiens
agtaaacaatgtatgaggacag

SEQ ID NO: 7877910 - DNA, 22 bp, Homo sapiens
agtaaacaatgtatgaggacag

SEQ ID NO: 7877911 - DNA, 22 bp, Homo sapiens
acgcctgtaatcccagcacttt

SEQ ID NO: 7877912 - DNA, 22 bp, Homo sapiens
acgcctgtaatcccagcacttt

SEQ ID NO: 7877913 - DNA, 22 bp, Homo sapiens
acgcctgtaatcccagcacttt

SEQ ID NO: 7877914 - DNA, 22 bp, Homo sapiens
acgcctgtaatcccagcacttt

SEQ ID NO: 7877915 - DNA, 22 bp, Homo sapiens
acgcctgtaatcccagcacttt

SEQ ID NO: 7877916 - DNA, 22 bp, Homo sapiens
acggaaggctggagaagtacca

SEQ ID NO: 7877917 - DNA, 22 bp, Homo sapiens
acggatttcagagttctgattc

SEQ ID NO: 7877918 - DNA, 22 bp, Homo sapiens
acggatttgggttaggtcacca

SEQ ID NO: 7877919 - DNA, 22 bp, Homo sapiens
acggaaggctggagaagtacca

SEQ ID NO: 7877920 - DNA, 22 bp, Homo sapiens
acggaaaaccctgagcaaactt

SEQ ID NO: 7877921 - DNA, 22 bp, Homo sapiens
acgcgcaaccaggcatgcacat

SEQ ID NO: 7877922 - DNA, 22 bp, Homo sapiens
acgctcgctgcctcgtggtggt

SEQ ID NO: 7877923 - DNA, 22 bp, Homo sapiens
agtaaaaattgaggtgcaaaat

SEQ ID NO: 7877924 - DNA, 22 bp, Homo sapiens
aggttgaacccccaagacctat

SEQ ID NO: 7877925 - DNA, 22 bp, Homo sapiens
aggttggccaagctgctggccc

SEQ ID NO: 7877926 - DNA, 22 bp, Homo sapiens
agtaaaaattgaggtgcaaaat

SEQ ID NO: 7877927 - DNA, 22 bp, Homo sapiens
aggttcttttggccaacctcat

SEQ ID NO: 7877928 - DNA, 22 bp, Homo sapiens
aggttctttgtagtgtcattgg

SEQ ID NO: 7877929 - DNA, 22 bp, Homo sapiens
aggttcttggtgtccagatttc

SEQ ID NO: 7877930 - DNA, 22 bp, Homo sapiens
acgggaatagggaataggcaga

SEQ ID NO: 7877931 - DNA, 22 bp, Homo sapiens
acggcttcttgactgtgggttg

SEQ ID NO: 7877932 - DNA, 22 bp, Homo sapiens
acggcttcttgactgtgggttg

SEQ ID NO: 7877933 - DNA, 22 bp, Homo sapiens
acggattttacttccatggtta

SEQ ID NO: 7877934 - DNA, 22 bp, Homo sapiens
acggcgggagggtcactggcca

SEQ ID NO: 7877935 - DNA, 22 bp, Homo sapiens
acggcaggctcagagctggaat

SEQ ID NO: 7877936 - DNA, 20 bp, Homo sapiens
aggtggctcctgctgggggt

SEQ ID NO: 7877937 - DNA, 20 bp, Homo sapiens
aggtggctcctgctgggggt

SEQ ID NO: 7877938 - DNA, 20 bp, Homo sapiens
aggtggctcctgctgggggt

SEQ ID NO: 7877939 - DNA, 20 bp, Homo sapiens
aggtggctcctgctgggggt

SEQ ID NO: 7877940 - DNA, 20 bp, Homo sapiens
aggtggctcctgctgggggt

SEQ ID NO: 7877941 - DNA, 20 bp, Homo sapiens
aggtggctcctgctgggggt

SEQ ID NO: 7877942 - DNA, 22 bp, Homo sapiens
aggtggctcctcccatggctgg

SEQ ID NO: 7877943 - DNA, 22 bp, Homo sapiens
aggtggctcctcccatggctgg

SEQ ID NO: 7877944 - DNA, 22 bp, Homo sapiens
aggtggctcctcccatggctgg

SEQ ID NO: 7877945 - DNA, 22 bp, Homo sapiens
aggtggctcctcccatggctgg

SEQ ID NO: 7877946 - DNA, 20 bp, Homo sapiens
aggtggctcctgctgggggt

SEQ ID NO: 7877947 - DNA, 22 bp, Homo sapiens
acgcagtttgtggacatttttt

SEQ ID NO: 7877948 - DNA, 22 bp, Homo sapiens
acgcagtctttgctctctgtca

SEQ ID NO: 7877949 - DNA, 22 bp, Homo sapiens
acgcagtctttgctctctgtca

SEQ ID NO: 7877950 - DNA, 22 bp, Homo sapiens
acgcaaaacaggtggacgccaa

SEQ ID NO: 7877951 - DNA, 22 bp, Homo sapiens
acgcagtttgtggacatttttt

SEQ ID NO: 7877952 - DNA, 22 bp, Homo sapiens
acgcccagactcccatactttg

SEQ ID NO: 7877953 - DNA, 22 bp, Homo sapiens
acgcccagactcccatactttg

SEQ ID NO: 7877954 - DNA, 22 bp, Homo sapiens
acgcccagactcccatactttg

SEQ ID NO: 7877955 - DNA, 22 bp, Homo sapiens
acgcccagactcccatactttg

SEQ ID NO: 7877956 - DNA, 22 bp, Homo sapiens
acgcccagactcccatactttg

SEQ ID NO: 7877957 - DNA, 22 bp, Homo sapiens
acgcccagactcccatactttg

SEQ ID NO: 7877958 - DNA, 22 bp, Homo sapiens
acgcccagactcccatactttg

SEQ ID NO: 7877959 - DNA, 22 bp, Homo sapiens
acgcccagactcccatactttg

SEQ ID NO: 7877960 - DNA, 22 bp, Homo sapiens
acgcccagactcccatactttg

SEQ ID NO: 7877961 - DNA, 22 bp, Homo sapiens
acgcccagactcccatactttg

SEQ ID NO: 7877962 - DNA, 22 bp, Homo sapiens
acgcccggtctccatagttttt

SEQ ID NO: 7877963 - DNA, 22 bp, Homo sapiens
acgccctttttctctagagtag

SEQ ID NO: 7877964 - DNA, 22 bp, Homo sapiens
acgcctgtaatcccagcacttt

SEQ ID NO: 7877965 - DNA, 22 bp, Homo sapiens
acgcctgtaatcccagcacttt

SEQ ID NO: 7877966 - DNA, 22 bp, Homo sapiens
acgcatgccctcagtgaggcct

SEQ ID NO: 7877967 - DNA, 22 bp, Homo sapiens
acgcctgtaatcccagcacttt

SEQ ID NO: 7877968 - DNA, 22 bp, Homo sapiens
acgcctgtaatcccagcacttt

SEQ ID NO: 7877969 - DNA, 22 bp, Homo sapiens
agaaagggttctctgaggtgct

SEQ ID NO: 7877970 - DNA, 22 bp, Homo sapiens
agaaagggtcactgaaagagga

SEQ ID NO: 7877971 - DNA, 22 bp, Homo sapiens
agaaagggtcactgaaagagga

SEQ ID NO: 7877972 - DNA, 22 bp, Homo sapiens
agaaagggctattttgaggtag

SEQ ID NO: 7877973 - DNA, 22 bp, Homo sapiens
agaaagggtcactgaaagagga

SEQ ID NO: 7877974 - DNA, 22 bp, Homo sapiens
agaaagggctattttgaggtag

SEQ ID NO: 7877975 - DNA, 22 bp, Homo sapiens
agaaagggctattttgaggtag

SEQ ID NO: 7877976 - DNA, 22 bp, Homo sapiens
agaaagctggaagagctgggat

SEQ ID NO: 7877977 - DNA, 22 bp, Homo sapiens
agaaagggtcactgaaagagga

SEQ ID NO: 7877978 - DNA, 22 bp, Homo sapiens
agaaaggtcacttagcctcagc

SEQ ID NO: 7877979 - DNA, 22 bp, Homo sapiens
agaaaggtggatgctctggaat

SEQ ID NO: 7877980 - DNA, 22 bp, Homo sapiens
agaaagtacagatgagacactt

SEQ ID NO: 7877981 - DNA, 22 bp, Homo sapiens
agaaagtacagatgagacactt

SEQ ID NO: 7877982 - DNA, 22 bp, Homo sapiens
agaaagggttctctgaggtgct

SEQ ID NO: 7877983 - DNA, 22 bp, Homo sapiens
agaaagggttctctgaggtgct

SEQ ID NO: 7877984 - DNA, 22 bp, Homo sapiens
agaaagggttctctgaggtgct

SEQ ID NO: 7877985 - DNA, 22 bp, Homo sapiens
agaaagggttctctgaggtgct

SEQ ID NO: 7877986 - DNA, 22 bp, Homo sapiens
agaaagtgtgtcatactaagtg

SEQ ID NO: 7877987 - DNA, 22 bp, Homo sapiens
agaaagttaaacagtgataaga

SEQ ID NO: 7877988 - DNA, 22 bp, Homo sapiens
agaaagttaaacagtgataaga

SEQ ID NO: 7877989 - DNA, 22 bp, Homo sapiens
agaaagtgtgtcatactaagtg

SEQ ID NO: 7877990 - DNA, 22 bp, Homo sapiens
agaaagtgcttccctttggtga

SEQ ID NO: 7877991 - DNA, 22 bp, Homo sapiens
agaaagtgcttccctttggact

SEQ ID NO: 7877992 - DNA, 22 bp, Homo sapiens
agaaagtgcttccctttggact

SEQ ID NO: 7877993 - DNA, 22 bp, Homo sapiens
agaaagtctgctttctggatgg

SEQ ID NO: 7877994 - DNA, 22 bp, Homo sapiens
agaaagtgaacgtgttcagttt

SEQ ID NO: 7877995 - DNA, 22 bp, Homo sapiens
agaaagtgcctcccttgggagc

SEQ ID NO: 7877996 - DNA, 22 bp, Homo sapiens
agaaagtgcctcccttgggagc

SEQ ID NO: 7877997 - DNA, 22 bp, Homo sapiens
agaaagttctgtgagttgttca

SEQ ID NO: 7877998 - DNA, 22 bp, Homo sapiens
agaaagttgttggaggaaatga

SEQ ID NO: 7877999 - DNA, 22 bp, Homo sapiens
agaaagttcactggtatatttt

SEQ ID NO: 7878000 - DNA, 22 bp, Homo sapiens
agaaagttagcagactcttggc

SEQ ID NO: 7878001 - DNA, 22 bp, Homo sapiens
agaaagttagcagactcttggc

SEQ ID NO: 7878002 - DNA, 22 bp, Homo sapiens
agaaagttatcacaaaattgag

SEQ ID NO: 7878003 - DNA, 22 bp, Homo sapiens
agaaattatgcagtagttttat

SEQ ID NO: 7878004 - DNA, 22 bp, Homo sapiens
agaaattatgcagtagttttat

SEQ ID NO: 7878005 - DNA, 22 bp, Homo sapiens
agaaattatgcagtagttttat

SEQ ID NO: 7878006 - DNA, 22 bp, Homo sapiens
agaaattatgcagtagttttat

SEQ ID NO: 7878007 - DNA, 22 bp, Homo sapiens
agaacacactgggggaaacaag

SEQ ID NO: 7878008 - DNA, 22 bp, Homo sapiens
agaaattatgcagtagttttat

SEQ ID NO: 7878009 - DNA, 22 bp, Homo sapiens
agaacacatagagaagttttat

SEQ ID NO: 7878010 - DNA, 22 bp, Homo sapiens
agaacacatagagaagttttat

SEQ ID NO: 7878011 - DNA, 20 bp, Homo sapiens
agaacactggtgtattgtga

SEQ ID NO: 7878012 - DNA, 22 bp, Homo sapiens
agaacactgggaagttactaac

SEQ ID NO: 7878013 - DNA, 22 bp, Homo sapiens
agaacactgctagtataatcac

SEQ ID NO: 7878014 - DNA, 22 bp, Homo sapiens
agaacactctcctgaaaattaa

SEQ ID NO: 7878015 - DNA, 22 bp, Homo sapiens
agaacactctcctgaaaattaa

SEQ ID NO: 7878016 - DNA, 23 bp, Homo sapiens
agaaagtttgtgccttgtgacac

SEQ ID NO: 7878017 - DNA, 22 bp, Homo sapiens
agaaattaggaaagtaacactt

SEQ ID NO: 7878018 - DNA, 22 bp, Homo sapiens
agaaattaggaaagtaacactt

SEQ ID NO: 7878019 - DNA, 22 bp, Homo sapiens
agaaagtttgagaactgtagat

SEQ ID NO: 7878020 - DNA, 22 bp, Homo sapiens
agaaagtttgagaactgtagat

SEQ ID NO: 7878021 - DNA, 22 bp, Homo sapiens
agaaagttgttttagccaaacc

SEQ ID NO: 7878022 - DNA, 22 bp, Homo sapiens
agaacagaggccttatgtttca

SEQ ID NO: 7878023 - DNA, 22 bp, Homo sapiens
agaacagaggccttatgtttca

SEQ ID NO: 7878024 - DNA, 22 bp, Homo sapiens
agaacagatgtgggcagacctg

SEQ ID NO: 7878025 - DNA, 22 bp, Homo sapiens
agaacagcaacatcagacaaag

SEQ ID NO: 7878026 - DNA, 22 bp, Homo sapiens
agaacagcaacatcagacaaag

SEQ ID NO: 7878027 - DNA, 22 bp, Homo sapiens
agaacagaagggaggaaggcct

SEQ ID NO: 7878028 - DNA, 22 bp, Homo sapiens
agaacacttttaaatggcttgt

SEQ ID NO: 7878029 - DNA, 22 bp, Homo sapiens
agaacacttttaaatggcttgt

SEQ ID NO: 7878030 - DNA, 22 bp, Homo sapiens
agaacacttttaaatggcttgt

SEQ ID NO: 7878031 - DNA, 18 bp, Homo sapiens
agaacacttggttagatc

SEQ ID NO: 7878032 - DNA, 18 bp, Homo sapiens
agaacacttggttagatc

SEQ ID NO: 7878033 - DNA, 22 bp, Homo sapiens
agaacacttgctcctgattctc

SEQ ID NO: 7878034 - DNA, 22 bp, Homo sapiens
agaacactgtaaagtcattgaa

SEQ ID NO: 7878035 - DNA, 22 bp, Homo sapiens
agaacactgtaaagtcattgaa

SEQ ID NO: 7878036 - DNA, 22 bp, Homo sapiens
agaacagcaggaaggccaggta

SEQ ID NO: 7878037 - DNA, 22 bp, Homo sapiens
agaacagcagtagtatacagta

SEQ ID NO: 7878038 - DNA, 22 bp, Homo sapiens
agaacagcagcacgtcaagctg

SEQ ID NO: 7878039 - DNA, 22 bp, Homo sapiens
agaacagcagcacgtcaagctg

SEQ ID NO: 7878040 - DNA, 22 bp, Homo sapiens
agaacagcaacatcagacaaag

SEQ ID NO: 7878041 - DNA, 22 bp, Homo sapiens
agaacagcacaggaagtgtatc

SEQ ID NO: 7878042 - DNA, 22 bp, Homo sapiens
agaacagctgattccatgtcaa

SEQ ID NO: 7878043 - DNA, 22 bp, Homo sapiens
agaacagctgatttacggggct

SEQ ID NO: 7878044 - DNA, 22 bp, Homo sapiens
agaacagctgattccatgtcaa

SEQ ID NO: 7878045 - DNA, 22 bp, Homo sapiens
agaacagcagttatggttcatt

SEQ ID NO: 7878046 - DNA, 22 bp, Homo sapiens
agaacagcagtagtatacagta

SEQ ID NO: 7878047 - DNA, 22 bp, Homo sapiens
agaacagccaactgtgtaggag

SEQ ID NO: 7878048 - DNA, 22 bp, Homo sapiens
agaacagcagttatggttcatt

SEQ ID NO: 7878049 - DNA, 22 bp, Homo sapiens
atctaaaaggagctctttatct

SEQ ID NO: 7878050 - DNA, 22 bp, Homo sapiens
atcgtttaccctgagtgattgc

SEQ ID NO: 7878051 - DNA, 22 bp, Homo sapiens
atcgtttaccctgagtgattgc

SEQ ID NO: 7878052 - DNA, 22 bp, Homo sapiens
atcggggaaaagggaggctgtg

SEQ ID NO: 7878053 - DNA, 22 bp, Homo sapiens
atctaaaatgtggttagttggt

SEQ ID NO: 7878054 - DNA, 22 bp, Homo sapiens
atctaaaaggagctctttatct

SEQ ID NO: 7878055 - DNA, 22 bp, Homo sapiens
atctaaaatgtggttagttggt

SEQ ID NO: 7878056 - DNA, 22 bp, Homo sapiens
atctaaaatgtggttagttggt

SEQ ID NO: 7878057 - DNA, 22 bp, Homo sapiens
atctaaaatgtggttagttggt

SEQ ID NO: 7878058 - DNA, 22 bp, Homo sapiens
atctaacagcaacaccagaata

SEQ ID NO: 7878059 - DNA, 22 bp, Homo sapiens
atctaagacaatgagtgagact

SEQ ID NO: 7878060 - DNA, 22 bp, Homo sapiens
atctaacttatgttttaccaaa

SEQ ID NO: 7878061 - DNA, 22 bp, Homo sapiens
atctaagagttaacatcaagaa

SEQ ID NO: 7878062 - DNA, 22 bp, Homo sapiens
atctaagagttaacatcaagaa

SEQ ID NO: 7878063 - DNA, 22 bp, Homo sapiens
atctaagaggatggttggaaat

SEQ ID NO: 7878064 - DNA, 19 bp, Homo sapiens
atctaagagatgggggaaa

SEQ ID NO: 7878065 - DNA, 22 bp, Homo sapiens
atctaagagagagagcatgtct

SEQ ID NO: 7878066 - DNA, 22 bp, Homo sapiens
atctaaagtgtttcatgaaaga

SEQ ID NO: 7878067 - DNA, 22 bp, Homo sapiens
atctcacactgggtttgagggt

SEQ ID NO: 7878068 - DNA, 22 bp, Homo sapiens
atctcaaagcatggagcagaat

SEQ ID NO: 7878069 - DNA, 22 bp, Homo sapiens
atctcaaagcatggagcagaat

SEQ ID NO: 7878070 - DNA, 22 bp, Homo sapiens
atctcaaatgattacaccaagc

SEQ ID NO: 7878071 - DNA, 22 bp, Homo sapiens
atctcacatcctcagtagtgca

SEQ ID NO: 7878072 - DNA, 22 bp, Homo sapiens
atctcaccaagttattacgaga

SEQ ID NO: 7878073 - DNA, 22 bp, Homo sapiens
atctcaccaagttattacgaga

SEQ ID NO: 7878074 - DNA, 22 bp, Homo sapiens
atctcacaggactgaaacgtaa

SEQ ID NO: 7878075 - DNA, 22 bp, Homo sapiens
atctaattttcactcatttgct

SEQ ID NO: 7878076 - DNA, 22 bp, Homo sapiens
atctaattttcactcatttgct

SEQ ID NO: 7878077 - DNA, 22 bp, Homo sapiens
atctcaaagcatggagcagaat

SEQ ID NO: 7878078 - DNA, 22 bp, Homo sapiens
atctattttaaatggcagtaaa

SEQ ID NO: 7878079 - DNA, 22 bp, Homo sapiens
atctcaaaaatgacctagagaa

SEQ ID NO: 7878080 - DNA, 22 bp, Homo sapiens
atctcaaacatctttgaccata

SEQ ID NO: 7878081 - DNA, 22 bp, Homo sapiens
atctaattttcactcatttgct

SEQ ID NO: 7878082 - DNA, 23 bp, Homo sapiens
atctaatttctccaaatctctac

SEQ ID NO: 7878083 - DNA, 23 bp, Homo sapiens
atctaatttctccaaatctctac

SEQ ID NO: 7878084 - DNA, 22 bp, Homo sapiens
atctaataccctctttatttct

SEQ ID NO: 7878085 - DNA, 22 bp, Homo sapiens
atctaagatgtattgagcactt

SEQ ID NO: 7878086 - DNA, 22 bp, Homo sapiens
atctaagatgtattgagcactt

SEQ ID NO: 7878087 - DNA, 22 bp, Homo sapiens
atctaataccctctttatttct

SEQ ID NO: 7878088 - DNA, 22 bp, Homo sapiens
atctaagattttgctaagatca

SEQ ID NO: 7878089 - DNA, 22 bp, Homo sapiens
atctaagattttgctaagatca

SEQ ID NO: 7878090 - DNA, 22 bp, Homo sapiens
atcatcctattgtgccccaggt

SEQ ID NO: 7878091 - DNA, 19 bp, Homo sapiens
atcatcctgggtcatgcac

SEQ ID NO: 7878092 - DNA, 19 bp, Homo sapiens
atcatcctgggtcatgcac

SEQ ID NO: 7878093 - DNA, 22 bp, Homo sapiens
atcatcctattgtgccccaggt

SEQ ID NO: 7878094 - DNA, 22 bp, Homo sapiens
atcatcctagaaggaagctagg

SEQ ID NO: 7878095 - DNA, 22 bp, Homo sapiens
atcatccatggctgatcataaa

SEQ ID NO: 7878096 - DNA, 22 bp, Homo sapiens
atcatctgggttaatgtgctca

SEQ ID NO: 7878097 - DNA, 22 bp, Homo sapiens
atcatccagccccagaagggag

SEQ ID NO: 7878098 - DNA, 22 bp, Homo sapiens
atcatccaagcgtagttcttct

SEQ ID NO: 7878099 - DNA, 22 bp, Homo sapiens
agaacaggcagttggttggatt

SEQ ID NO: 7878100 - DNA, 22 bp, Homo sapiens
agaacagggactggaggcttca

SEQ ID NO: 7878101 - DNA, 22 bp, Homo sapiens
agaacagggactggaggcttca

SEQ ID NO: 7878102 - DNA, 22 bp, Homo sapiens
atcatcattcttggataaagca

SEQ ID NO: 7878103 - DNA, 22 bp, Homo sapiens
atcatccaagcgtagttcttct

SEQ ID NO: 7878104 - DNA, 22 bp, Homo sapiens
agaacaggaggaagccagctcc

SEQ ID NO: 7878105 - DNA, 22 bp, Homo sapiens
agaacaggaggaagccagctcc

SEQ ID NO: 7878106 - DNA, 22 bp, Homo sapiens
agaacaggaggaagccagctcc

SEQ ID NO: 7878107 - DNA, 22 bp, Homo sapiens
agaacaggaggaagccagctcc

SEQ ID NO: 7878108 - DNA, 22 bp, Homo sapiens
agaacaggaggaagccagctcc

SEQ ID NO: 7878109 - DNA, 22 bp, Homo sapiens
agaacagctgcaaaacttaatc

SEQ ID NO: 7878110 - DNA, 22 bp, Homo sapiens
agaacagctgcaaaacttaatc

SEQ ID NO: 7878111 - DNA, 22 bp, Homo sapiens
atcggcaagccccacaccgtcc

SEQ ID NO: 7878112 - DNA, 22 bp, Homo sapiens
atcgctttacagcctgcttcct

SEQ ID NO: 7878113 - DNA, 22 bp, Homo sapiens
atcgcaagtttaaaaatctttg

SEQ ID NO: 7878114 - DNA, 22 bp, Homo sapiens
atcgcaagtttaaaaatctttg

SEQ ID NO: 7878115 - DNA, 22 bp, Homo sapiens
atccttttcctttgggtgccct

SEQ ID NO: 7878116 - DNA, 22 bp, Homo sapiens
atcgatcccgcgtaaggccccg

SEQ ID NO: 7878117 - DNA, 22 bp, Homo sapiens
atcatcttgaaagtctatgttt

SEQ ID NO: 7878118 - DNA, 22 bp, Homo sapiens
atcatcttgctttctgtttact

SEQ ID NO: 7878119 - DNA, 22 bp, Homo sapiens
atcatcttgctttctgtttact

SEQ ID NO: 7878120 - DNA, 18 bp, Homo sapiens
atcctgggagcagacagc

SEQ ID NO: 7878121 - DNA, 22 bp, Homo sapiens
atcctgggcaaagtatgctgtc

SEQ ID NO: 7878122 - DNA, 22 bp, Homo sapiens
atccttttcctttgggtgccct

SEQ ID NO: 7878123 - DNA, 22 bp, Homo sapiens
atcatcttcatattcctcagct

SEQ ID NO: 7878124 - DNA, 22 bp, Homo sapiens
atcatcttcgaaaaaagtcaga

SEQ ID NO: 7878125 - DNA, 22 bp, Homo sapiens
atcatcttgaaagtctatgttt

SEQ ID NO: 7878126 - DNA, 22 bp, Homo sapiens
atcatcttcgaaaaaagtcaga

SEQ ID NO: 7878127 - DNA, 22 bp, Homo sapiens
atcatcttgaaagtctatgttt

SEQ ID NO: 7878128 - DNA, 22 bp, Homo sapiens
atcatcttgaaagtctatgttt

SEQ ID NO: 7878129 - DNA, 22 bp, Homo sapiens
atcatcttgaaagtctatgttt

SEQ ID NO: 7878130 - DNA, 22 bp, Homo sapiens
atcatcttgaaagtctatgttt

SEQ ID NO: 7878131 - DNA, 22 bp, Homo sapiens
atcatcttaaggtatctcaagc

SEQ ID NO: 7878132 - DNA, 22 bp, Homo sapiens
atcatcttaaatctagaatgtg

SEQ ID NO: 7878133 - DNA, 22 bp, Homo sapiens
atcatcttatctgactcatttt

SEQ ID NO: 7878134 - DNA, 22 bp, Homo sapiens
atcatcttaaggtatctcaagc

SEQ ID NO: 7878135 - DNA, 22 bp, Homo sapiens
atcatcttatctgactcatttt

SEQ ID NO: 7878136 - DNA, 22 bp, Homo sapiens
atcatcttcatattcctcagct

SEQ ID NO: 7878137 - DNA, 22 bp, Homo sapiens
atcatcttatctgactcatttt

SEQ ID NO: 7878138 - DNA, 22 bp, Homo sapiens
atatttataaggcaggcaagta

SEQ ID NO: 7878139 - DNA, 22 bp, Homo sapiens
atatttataaggcaggcaagta

SEQ ID NO: 7878140 - DNA, 22 bp, Homo sapiens
atatttataaggcaggcaagta

SEQ ID NO: 7878141 - DNA, 22 bp, Homo sapiens
atatttataagcaagcaggact

SEQ ID NO: 7878142 - DNA, 22 bp, Homo sapiens
atatttataagcaagcaggact

SEQ ID NO: 7878143 - DNA, 22 bp, Homo sapiens
atatttataagcaagcaggact

SEQ ID NO: 7878144 - DNA, 22 bp, Homo sapiens
atatttataagcaagcaggact

SEQ ID NO: 7878145 - DNA, 22 bp, Homo sapiens
atatttataagcaagcaggact

SEQ ID NO: 7878146 - DNA, 22 bp, Homo sapiens
atattcttcttgttcagactat

SEQ ID NO: 7878147 - DNA, 22 bp, Homo sapiens
atattcttccaaaacatcattt

SEQ ID NO: 7878148 - DNA, 22 bp, Homo sapiens
atattcttccaaaacatcattt

SEQ ID NO: 7878149 - DNA, 22 bp, Homo sapiens
atattcttccaaaacatcattt

SEQ ID NO: 7878150 - DNA, 22 bp, Homo sapiens
atattcttccaaaacatcattt

SEQ ID NO: 7878151 - DNA, 22 bp, Homo sapiens
atattcttatccttttctctgt

SEQ ID NO: 7878152 - DNA, 22 bp, Homo sapiens
atattcttccaaaacatcattt

SEQ ID NO: 7878153 - DNA, 22 bp, Homo sapiens
atattcttccaaaacatcattt

SEQ ID NO: 7878154 - DNA, 22 bp, Homo sapiens
atattcttccaaaacatcattt

SEQ ID NO: 7878155 - DNA, 22 bp, Homo sapiens
atattcttccaaaacatcattt

SEQ ID NO: 7878156 - DNA, 22 bp, Homo sapiens
atatttcagctttacttaggaa

SEQ ID NO: 7878157 - DNA, 22 bp, Homo sapiens
atatttcagctttacttaggaa

SEQ ID NO: 7878158 - DNA, 20 bp, Homo sapiens
atatttcaggtagtgtgccc

SEQ ID NO: 7878159 - DNA, 20 bp, Homo sapiens
atatttcaggtagtgtgccc

SEQ ID NO: 7878160 - DNA, 22 bp, Homo sapiens
atatttcaggttttgcaggccg

SEQ ID NO: 7878161 - DNA, 22 bp, Homo sapiens
atatttcaggttttgcaggccg

SEQ ID NO: 7878162 - DNA, 21 bp, Homo sapiens
atatttcagatttccgtaatc

SEQ ID NO: 7878163 - DNA, 22 bp, Homo sapiens
atatttcacgtaggttgttttc

SEQ ID NO: 7878164 - DNA, 22 bp, Homo sapiens
atatttcacgtaggttgttttc

SEQ ID NO: 7878165 - DNA, 22 bp, Homo sapiens
atatttataaggcaggcaagta

SEQ ID NO: 7878166 - DNA, 22 bp, Homo sapiens
agaaagctccccatgagatgat

SEQ ID NO: 7878167 - DNA, 21 bp, Homo sapiens
atatttctcataaggttatgg

SEQ ID NO: 7878168 - DNA, 21 bp, Homo sapiens
atatttctcataaggttatgg

SEQ ID NO: 7878169 - DNA, 22 bp, Homo sapiens
atatttcatggggttccatact

SEQ ID NO: 7878170 - DNA, 22 bp, Homo sapiens
atatttcatggggttccatact

SEQ ID NO: 7878171 - DNA, 22 bp, Homo sapiens
atatttcatggggttccatact

SEQ ID NO: 7878172 - DNA, 22 bp, Homo sapiens
atatttcatggggttccatact

SEQ ID NO: 7878173 - DNA, 21 bp, Homo sapiens
agaaaagtatttgaatcaaga

SEQ ID NO: 7878174 - DNA, 21 bp, Homo sapiens
agaaaagtatttgaatcaaga

SEQ ID NO: 7878175 - DNA, 21 bp, Homo sapiens
agaaaagtatttgaatcaaga

SEQ ID NO: 7878176 - DNA, 21 bp, Homo sapiens
agaaaagtatttgaatcaaga

SEQ ID NO: 7878177 - DNA, 21 bp, Homo sapiens
agaaaagtatttgaatcaaga

SEQ ID NO: 7878178 - DNA, 21 bp, Homo sapiens
agaaaagtagagttttcagag

SEQ ID NO: 7878179 - DNA, 22 bp, Homo sapiens
agaaaagtgctctagtgagagc

SEQ ID NO: 7878180 - DNA, 22 bp, Homo sapiens
agaaaagtgctctagtgagagc

SEQ ID NO: 7878181 - DNA, 22 bp, Homo sapiens
agaaaagtgctctagtgagagc

SEQ ID NO: 7878182 - DNA, 21 bp, Homo sapiens
agaaaagtatttgaatcaaga

SEQ ID NO: 7878183 - DNA, 21 bp, Homo sapiens
agaaaagtatttgaatcaaga

SEQ ID NO: 7878184 - DNA, 22 bp, Homo sapiens
agaaaagtgctctagtgagagc

SEQ ID NO: 7878185 - DNA, 22 bp, Homo sapiens
agaaaataaattgatggtggaa

SEQ ID NO: 7878186 - DNA, 22 bp, Homo sapiens
agaaaagttttctgagactgac

SEQ ID NO: 7878187 - DNA, 22 bp, Homo sapiens
agaaaagttttctgagactgac

SEQ ID NO: 7878188 - DNA, 22 bp, Homo sapiens
agaaaagttttctgagactgac

SEQ ID NO: 7878189 - DNA, 22 bp, Homo sapiens
agaaaagttttctgagactgac

SEQ ID NO: 7878190 - DNA, 22 bp, Homo sapiens
agaaaagttttctgagactgac

SEQ ID NO: 7878191 - DNA, 22 bp, Homo sapiens
agaaaagtttaaatcttggcac

SEQ ID NO: 7878192 - DNA, 23 bp, Homo sapiens
agaaaagttcatacctttttaac

SEQ ID NO: 7878193 - DNA, 22 bp, Homo sapiens
agaaaagtttaaatcttggcac

SEQ ID NO: 7878194 - DNA, 22 bp, Homo sapiens
agaaaagtgctctagtgagagc

SEQ ID NO: 7878195 - DNA, 22 bp, Homo sapiens
agaaaagtgctctagtgagagc

SEQ ID NO: 7878196 - DNA, 23 bp, Homo sapiens
agaaaagttcatacctttttaac

SEQ ID NO: 7878197 - DNA, 22 bp, Homo sapiens
agaaaataaattgatggtggaa

SEQ ID NO: 7878198 - DNA, 22 bp, Homo sapiens
atattacacacggtatcacggg

SEQ ID NO: 7878199 - DNA, 22 bp, Homo sapiens
atattcatcgtgtagaaatact

SEQ ID NO: 7878200 - DNA, 22 bp, Homo sapiens
atattacataaacatgagtgaa

SEQ ID NO: 7878201 - DNA, 22 bp, Homo sapiens
atattcatcgtgtagaaatact

SEQ ID NO: 7878202 - DNA, 22 bp, Homo sapiens
atattcatcgtgtagaaatact

SEQ ID NO: 7878203 - DNA, 22 bp, Homo sapiens
atattcatcgtgtagaaatact

SEQ ID NO: 7878204 - DNA, 22 bp, Homo sapiens
atattcattgaacacctactac

SEQ ID NO: 7878205 - DNA, 17 bp, Homo sapiens
atattccaagggcttgg

SEQ ID NO: 7878206 - DNA, 22 bp, Homo sapiens
atattcattgaacacctactac

SEQ ID NO: 7878207 - DNA, 22 bp, Homo sapiens
atattccattggtttcccttct

SEQ ID NO: 7878208 - DNA, 22 bp, Homo sapiens
atattccattggtttcccttct

SEQ ID NO: 7878209 - DNA, 22 bp, Homo sapiens
atattcctgacttaatttttga

SEQ ID NO: 7878210 - DNA, 22 bp, Homo sapiens
atattccattggtttcccttct

SEQ ID NO: 7878211 - DNA, 22 bp, Homo sapiens
atattccattggtttcccttct

SEQ ID NO: 7878212 - DNA, 22 bp, Homo sapiens
atattccattggtttcccttct

SEQ ID NO: 7878213 - DNA, 22 bp, Homo sapiens
atattccttttaaagagttaca

SEQ ID NO: 7878214 - DNA, 22 bp, Homo sapiens
atattctagccaaagtgtgagc

SEQ ID NO: 7878215 - DNA, 22 bp, Homo sapiens
atattccagttatatcaaatca

SEQ ID NO: 7878216 - DNA, 22 bp, Homo sapiens
atattccagttatatcaaatca

SEQ ID NO: 7878217 - DNA, 22 bp, Homo sapiens
atattccagttatatcaaatca

SEQ ID NO: 7878218 - DNA, 22 bp, Homo sapiens
atattccagttatatcaaatca

SEQ ID NO: 7878219 - DNA, 22 bp, Homo sapiens
atattcattgaacacctactac

SEQ ID NO: 7878220 - DNA, 22 bp, Homo sapiens
atattccagttatatcaaatca

SEQ ID NO: 7878221 - DNA, 22 bp, Homo sapiens
atattctctgctgcttttgtgt

SEQ ID NO: 7878222 - DNA, 22 bp, Homo sapiens
atattctataagcagttggaag

SEQ ID NO: 7878223 - DNA, 22 bp, Homo sapiens
atattctagccaaagtgtgagc

SEQ ID NO: 7878224 - DNA, 22 bp, Homo sapiens
atattctagccaaagtgtgagc

SEQ ID NO: 7878225 - DNA, 22 bp, Homo sapiens
atatgcttatgatggttaattt

SEQ ID NO: 7878226 - DNA, 22 bp, Homo sapiens
atatgcttatgatggttaattt

SEQ ID NO: 7878227 - DNA, 22 bp, Homo sapiens
atatgcttacagcttaaaatcc

SEQ ID NO: 7878228 - DNA, 22 bp, Homo sapiens
atatgcttacagcttaaaatcc

SEQ ID NO: 7878229 - DNA, 22 bp, Homo sapiens
atatgcttacactacaagatga

SEQ ID NO: 7878230 - DNA, 22 bp, Homo sapiens
atatgcttatgatgtctcaagt

SEQ ID NO: 7878231 - DNA, 22 bp, Homo sapiens
atatgcttccaagttattccac

SEQ ID NO: 7878232 - DNA, 22 bp, Homo sapiens
atatgcttccaagttattccac

SEQ ID NO: 7878233 - DNA, 22 bp, Homo sapiens
atatgcttgggactgatacagt

SEQ ID NO: 7878234 - DNA, 22 bp, Homo sapiens
atatgcttgggactgatacagt

SEQ ID NO: 7878235 - DNA, 22 bp, Homo sapiens
atatgcttgggactgatacagt

SEQ ID NO: 7878236 - DNA, 22 bp, Homo sapiens
atatgcttgactctttcacatc

SEQ ID NO: 7878237 - DNA, 22 bp, Homo sapiens
atatgaaagtaagcatgtgtgt

SEQ ID NO: 7878238 - DNA, 22 bp, Homo sapiens
atatgaaagtaagcatgtgtgt

SEQ ID NO: 7878239 - DNA, 20 bp, Homo sapiens
actttctcggtttctcacct

SEQ ID NO: 7878240 - DNA, 22 bp, Homo sapiens
atatgaaagtaagcatgtgtgt

SEQ ID NO: 7878241 - DNA, 22 bp, Homo sapiens
actttctcccacccacccgtct

SEQ ID NO: 7878242 - DNA, 22 bp, Homo sapiens
actttctccagaaaaccaagga

SEQ ID NO: 7878243 - DNA, 22 bp, Homo sapiens
actttctcaggaattcacagac

SEQ ID NO: 7878244 - DNA, 22 bp, Homo sapiens
actttctcaggaattcacagac

SEQ ID NO: 7878245 - DNA, 22 bp, Homo sapiens
atatgcttgggactgatacagt

SEQ ID NO: 7878246 - DNA, 22 bp, Homo sapiens
atatgcttgtcacacacatcca

SEQ ID NO: 7878247 - DNA, 22 bp, Homo sapiens
atatgctttgggattagatcat

SEQ ID NO: 7878248 - DNA, 22 bp, Homo sapiens
atatgcttgtcacacacatcca

SEQ ID NO: 7878249 - DNA, 22 bp, Homo sapiens
atatggaactattctgtgtaga

SEQ ID NO: 7878250 - DNA, 22 bp, Homo sapiens
atatggaaatagcaatatggtt

SEQ ID NO: 7878251 - DNA, 22 bp, Homo sapiens
atatggaaatagcaatatggtt

SEQ ID NO: 7878252 - DNA, 18 bp, Homo sapiens
atatggaatgcctggcta

SEQ ID NO: 7878253 - DNA, 18 bp, Homo sapiens
atatggaatgcctggcta

SEQ ID NO: 7878254 - DNA, 22 bp, Homo sapiens
atatggaagttacctgacttca

SEQ ID NO: 7878255 - DNA, 22 bp, Homo sapiens
atatggaagttacctgacttca

SEQ ID NO: 7878256 - DNA, 22 bp, Homo sapiens
atatggaagttacctgacttca

SEQ ID NO: 7878257 - DNA, 22 bp, Homo sapiens
atatggaagagcctgggaattt

SEQ ID NO: 7878258 - DNA, 22 bp, Homo sapiens
atatggaagagcctgggaattt

SEQ ID NO: 7878259 - DNA, 22 bp, Homo sapiens
atatggaactattctgtgtaga

SEQ ID NO: 7878260 - DNA, 22 bp, Homo sapiens
atatggaactattctgtgtaga

SEQ ID NO: 7878261 - DNA, 22 bp, Homo sapiens
atatggaagagcctgggaattt

SEQ ID NO: 7878262 - DNA, 22 bp, Homo sapiens
agaaaaggttgaaagtaggatt

SEQ ID NO: 7878263 - DNA, 22 bp, Homo sapiens
agaaaaggttgaaagtaggatt

SEQ ID NO: 7878264 - DNA, 22 bp, Homo sapiens
atatggagtccttgctgtgtgc

SEQ ID NO: 7878265 - DNA, 22 bp, Homo sapiens
atatggagaactcaaaaagtga

SEQ ID NO: 7878266 - DNA, 22 bp, Homo sapiens
atatggaatggtaatctacaat

SEQ ID NO: 7878267 - DNA, 22 bp, Homo sapiens
atatggaatggtaatctacaat

SEQ ID NO: 7878268 - DNA, 22 bp, Homo sapiens
atatggaatggtaatctacaat

SEQ ID NO: 7878269 - DNA, 22 bp, Homo sapiens
actttcatggtagttgtattct

SEQ ID NO: 7878270 - DNA, 22 bp, Homo sapiens
actttcatggtagttgtattct

SEQ ID NO: 7878271 - DNA, 22 bp, Homo sapiens
actttcatgttcatttggaacc

SEQ ID NO: 7878272 - DNA, 22 bp, Homo sapiens
actttcatgttcatttggaacc

SEQ ID NO: 7878273 - DNA, 22 bp, Homo sapiens
actttcatggatctctgttcag

SEQ ID NO: 7878274 - DNA, 22 bp, Homo sapiens
actttcatggatctctgttcag

SEQ ID NO: 7878275 - DNA, 22 bp, Homo sapiens
actttcatgctctgagcactgg

SEQ ID NO: 7878276 - DNA, 22 bp, Homo sapiens
actttcatggatctctgttcag

SEQ ID NO: 7878277 - DNA, 22 bp, Homo sapiens
actttcatgctctgagcactgg

SEQ ID NO: 7878278 - DNA, 22 bp, Homo sapiens
actttcatttgtgaagactgta

SEQ ID NO: 7878279 - DNA, 22 bp, Homo sapiens
actttcatttgtaataaacttc

SEQ ID NO: 7878280 - DNA, 22 bp, Homo sapiens
actttcatgttggtgaagggtt

SEQ ID NO: 7878281 - DNA, 22 bp, Homo sapiens
actttcatttgtaataaacttc

SEQ ID NO: 7878282 - DNA, 22 bp, Homo sapiens
actttcatttgtaataaacttc

SEQ ID NO: 7878283 - DNA, 22 bp, Homo sapiens
actttcatttgtaataaacttc

SEQ ID NO: 7878284 - DNA, 22 bp, Homo sapiens
actttcatgttggtgaagggtt

SEQ ID NO: 7878285 - DNA, 22 bp, Homo sapiens
actttcatttgtaataaacttc

SEQ ID NO: 7878286 - DNA, 22 bp, Homo sapiens
actttcatttgtaataaacttc

SEQ ID NO: 7878287 - DNA, 22 bp, Homo sapiens
actttcatttgtaataaacttc

SEQ ID NO: 7878288 - DNA, 22 bp, Homo sapiens
actttcacatgtgtgcagacag

SEQ ID NO: 7878289 - DNA, 22 bp, Homo sapiens
actttcaagcaagaacactttg

SEQ ID NO: 7878290 - DNA, 22 bp, Homo sapiens
actttcaagaacttctttaatg

SEQ ID NO: 7878291 - DNA, 22 bp, Homo sapiens
actttcaattcccttagcaact

SEQ ID NO: 7878292 - DNA, 22 bp, Homo sapiens
actttcatgctctgagcactgg

SEQ ID NO: 7878293 - DNA, 22 bp, Homo sapiens
actttcagaattgtacagagtc

SEQ ID NO: 7878294 - DNA, 22 bp, Homo sapiens
actttctattcccacagagata

SEQ ID NO: 7878295 - DNA, 22 bp, Homo sapiens
actttctattcccacagagata

SEQ ID NO: 7878296 - DNA, 22 bp, Homo sapiens
actttctattcccacagagata

SEQ ID NO: 7878297 - DNA, 22 bp, Homo sapiens
actttctaggtctcagtccttt

SEQ ID NO: 7878298 - DNA, 22 bp, Homo sapiens
actttctaggtctcagtccttt

SEQ ID NO: 7878299 - DNA, 22 bp, Homo sapiens
actttctcaaatcagactttaa

SEQ ID NO: 7878300 - DNA, 22 bp, Homo sapiens
actttctcaggaattcacagac

SEQ ID NO: 7878301 - DNA, 22 bp, Homo sapiens
actttccctctcagaactctta

SEQ ID NO: 7878302 - DNA, 22 bp, Homo sapiens
actttctaaaattgctagcact

SEQ ID NO: 7878303 - DNA, 22 bp, Homo sapiens
actttccttatggatggggaaa

SEQ ID NO: 7878304 - DNA, 22 bp, Homo sapiens
actttcctggccctgtcctctg

SEQ ID NO: 7878305 - DNA, 22 bp, Homo sapiens
actttcctgccaaggccagagt

SEQ ID NO: 7878306 - DNA, 23 bp, Homo sapiens
actttcccatagcatggcttcct

SEQ ID NO: 7878307 - DNA, 23 bp, Homo sapiens
actttcccatagcatggcttcct

SEQ ID NO: 7878308 - DNA, 22 bp, Homo sapiens
actttcccacttaatgtattta

SEQ ID NO: 7878309 - DNA, 22 bp, Homo sapiens
actttccacaccattttgtggt

SEQ ID NO: 7878310 - DNA, 22 bp, Homo sapiens
actttcatttgtgaagactgta

SEQ ID NO: 7878311 - DNA, 22 bp, Homo sapiens
actttcctagacttcagtgaca

SEQ ID NO: 7878312 - DNA, 22 bp, Homo sapiens
actttcctagacttcagtgaca

SEQ ID NO: 7878313 - DNA, 22 bp, Homo sapiens
actttagtaaacttatgttact

SEQ ID NO: 7878314 - DNA, 22 bp, Homo sapiens
atactgtgtgcagagtcctaat

SEQ ID NO: 7878315 - DNA, 22 bp, Homo sapiens
atactgtatcacttgtgagtga

SEQ ID NO: 7878316 - DNA, 22 bp, Homo sapiens
atactgtatcacttgtgagtga

SEQ ID NO: 7878317 - DNA, 22 bp, Homo sapiens
atactgtatatttcacatcttg

SEQ ID NO: 7878318 - DNA, 22 bp, Homo sapiens
atactgtagaggcatagctagt

SEQ ID NO: 7878319 - DNA, 22 bp, Homo sapiens
atactgtagaggcatagctagt

SEQ ID NO: 7878320 - DNA, 22 bp, Homo sapiens
atactgtagaggcatagctagt

SEQ ID NO: 7878321 - DNA, 22 bp, Homo sapiens
atactgtatatttcacatcttg

SEQ ID NO: 7878322 - DNA, 22 bp, Homo sapiens
atactgtatatttcacatcttg

SEQ ID NO: 7878323 - DNA, 22 bp, Homo sapiens
atactgtatatctgagagccca

SEQ ID NO: 7878324 - DNA, 22 bp, Homo sapiens
atactgtatatttcacatcttg

SEQ ID NO: 7878325 - DNA, 22 bp, Homo sapiens
actttcaaatatcatgattcta

SEQ ID NO: 7878326 - DNA, 22 bp, Homo sapiens
actttcaaaagagaagtcatga

SEQ ID NO: 7878327 - DNA, 22 bp, Homo sapiens
actttatttcctattgcatcca

SEQ ID NO: 7878328 - DNA, 22 bp, Homo sapiens
actttatttcctattgcatcca

SEQ ID NO: 7878329 - DNA, 22 bp, Homo sapiens
actttcaaaagagaagtcatga

SEQ ID NO: 7878330 - DNA, 22 bp, Homo sapiens
actttagtctgtttcattatct

SEQ ID NO: 7878331 - DNA, 22 bp, Homo sapiens
actttatttcctattgcatcca

SEQ ID NO: 7878332 - DNA, 22 bp, Homo sapiens
actttatttcctattgcatcca

SEQ ID NO: 7878333 - DNA, 22 bp, Homo sapiens
actttatgacaccctttagtga

SEQ ID NO: 7878334 - DNA, 22 bp, Homo sapiens
atactgtaatacctaaatgaac

SEQ ID NO: 7878335 - DNA, 22 bp, Homo sapiens
atactgtaatacctaaatgaac

SEQ ID NO: 7878336 - DNA, 22 bp, Homo sapiens
atactgtacgctcctggcattt

SEQ ID NO: 7878337 - DNA, 22 bp, Homo sapiens
atactgtacgtcccagatagga

SEQ ID NO: 7878338 - DNA, 20 bp, Homo sapiens
atactgtacaactataggta

SEQ ID NO: 7878339 - DNA, 22 bp, Homo sapiens
atactgatacggaagaaaaaag

SEQ ID NO: 7878340 - DNA, 22 bp, Homo sapiens
atactgattagttgagaaagca

SEQ ID NO: 7878341 - DNA, 22 bp, Homo sapiens
atactgatgatgtgaagaaaca

SEQ ID NO: 7878342 - DNA, 23 bp, Homo sapiens
atactgaaactgttgtttatctg

SEQ ID NO: 7878343 - DNA, 22 bp, Homo sapiens
atactgaacatgtttgcagtca

SEQ ID NO: 7878344 - DNA, 22 bp, Homo sapiens
atactgaacatgtttgcagtca

SEQ ID NO: 7878345 - DNA, 22 bp, Homo sapiens
atactgaacatgtttgcagtca

SEQ ID NO: 7878346 - DNA, 22 bp, Homo sapiens
atactgaaagggtgttacctaa

SEQ ID NO: 7878347 - DNA, 22 bp, Homo sapiens
atactgaaaaatgatttgctgt

SEQ ID NO: 7878348 - DNA, 22 bp, Homo sapiens
atactgaaaaatgatttgctgt

SEQ ID NO: 7878349 - DNA, 22 bp, Homo sapiens
atactgaaaaatgatttgctgt

SEQ ID NO: 7878350 - DNA, 22 bp, Homo sapiens
atactgaaaataagtgagttga

SEQ ID NO: 7878351 - DNA, 22 bp, Homo sapiens
atactgaaaataagtgagttga

SEQ ID NO: 7878352 - DNA, 22 bp, Homo sapiens
atactgaattaggtaaagcata

SEQ ID NO: 7878353 - DNA, 22 bp, Homo sapiens
atactgaaggcattcagataac

SEQ ID NO: 7878354 - DNA, 22 bp, Homo sapiens
atactgaaggcattcagataac

SEQ ID NO: 7878355 - DNA, 22 bp, Homo sapiens
atactgaaggcattcagataac

SEQ ID NO: 7878356 - DNA, 22 bp, Homo sapiens
atactgaaggcattcagataac

SEQ ID NO: 7878357 - DNA, 21 bp, Homo sapiens
atactgaacctcataagccca

SEQ ID NO: 7878358 - DNA, 21 bp, Homo sapiens
atactgaacctcataagccca

SEQ ID NO: 7878359 - DNA, 22 bp, Homo sapiens
atactgaattaggtaaagcata

SEQ ID NO: 7878360 - DNA, 22 bp, Homo sapiens
atactgaattaggtaaagcata

SEQ ID NO: 7878361 - DNA, 22 bp, Homo sapiens
atactgaattaggtaaagcata

SEQ ID NO: 7878362 - DNA, 22 bp, Homo sapiens
atacatgttgtaccatatgttt

SEQ ID NO: 7878363 - DNA, 22 bp, Homo sapiens
atacatgttgtaccatatgttt

SEQ ID NO: 7878364 - DNA, 22 bp, Homo sapiens
atacattagaatctggtactca

SEQ ID NO: 7878365 - DNA, 22 bp, Homo sapiens
atacattagaatctggtactca

SEQ ID NO: 7878366 - DNA, 22 bp, Homo sapiens
atacatgttgtaccatatgttt

SEQ ID NO: 7878367 - DNA, 22 bp, Homo sapiens
atacatgttgtaccatatgttt

SEQ ID NO: 7878368 - DNA, 22 bp, Homo sapiens
atacatgttgtaccatatgttt

SEQ ID NO: 7878369 - DNA, 22 bp, Homo sapiens
atacatgttgtaccatatgttt

SEQ ID NO: 7878370 - DNA, 22 bp, Homo sapiens
atacatgttgtaccatatgttt

SEQ ID NO: 7878371 - DNA, 22 bp, Homo sapiens
atacatgttgagaaaatatctg

SEQ ID NO: 7878372 - DNA, 22 bp, Homo sapiens
atacatgttgagaaaatatctg

SEQ ID NO: 7878373 - DNA, 22 bp, Homo sapiens
atacattagctcatatgattaa

SEQ ID NO: 7878374 - DNA, 22 bp, Homo sapiens
atacattagctcatatgattaa

SEQ ID NO: 7878375 - DNA, 22 bp, Homo sapiens
atacattagctcatatgattaa

SEQ ID NO: 7878376 - DNA, 22 bp, Homo sapiens
atacattagctcatatgattaa

SEQ ID NO: 7878377 - DNA, 22 bp, Homo sapiens
atacattagctcatatgattaa

SEQ ID NO: 7878378 - DNA, 22 bp, Homo sapiens
atacattagctcatatgattaa

SEQ ID NO: 7878379 - DNA, 22 bp, Homo sapiens
atacattagctcatatgattaa

SEQ ID NO: 7878380 - DNA, 22 bp, Homo sapiens
atacattagctcatatgattaa

SEQ ID NO: 7878381 - DNA, 22 bp, Homo sapiens
atacattagtgaacaaaagaga

SEQ ID NO: 7878382 - DNA, 22 bp, Homo sapiens
atacattagtgaacaaaagaga

SEQ ID NO: 7878383 - DNA, 22 bp, Homo sapiens
atacattagtgaacaaaagaga

SEQ ID NO: 7878384 - DNA, 22 bp, Homo sapiens
acttctggtgtcatactgcatt

SEQ ID NO: 7878385 - DNA, 22 bp, Homo sapiens
acttctggatagagtcagcttt

SEQ ID NO: 7878386 - DNA, 22 bp, Homo sapiens
acttctgtaaagggaagacagt

SEQ ID NO: 7878387 - DNA, 22 bp, Homo sapiens
acttctgggtcccacccccaga

SEQ ID NO: 7878388 - DNA, 22 bp, Homo sapiens
acttctgtaaagggaagacagt

SEQ ID NO: 7878389 - DNA, 22 bp, Homo sapiens
acttctgtatgtcctgcattca

SEQ ID NO: 7878390 - DNA, 22 bp, Homo sapiens
acttcttcttcagctgggggat

SEQ ID NO: 7878391 - DNA, 22 bp, Homo sapiens
acttctgtcctccaagccacgt

SEQ ID NO: 7878392 - DNA, 22 bp, Homo sapiens
acttcttgatgaaaatggtact

SEQ ID NO: 7878393 - DNA, 22 bp, Homo sapiens
acttctttcacaatgtttctag

SEQ ID NO: 7878394 - DNA, 22 bp, Homo sapiens
acttcttcttcagctgggggat

SEQ ID NO: 7878395 - DNA, 22 bp, Homo sapiens
atacatctatgcctttctgaca

SEQ ID NO: 7878396 - DNA, 22 bp, Homo sapiens
atacatctatgcctttctgaca

SEQ ID NO: 7878397 - DNA, 22 bp, Homo sapiens
atacatctagagtcataaaaac

SEQ ID NO: 7878398 - DNA, 22 bp, Homo sapiens
atacatgttgagaaaatatctg

SEQ ID NO: 7878399 - DNA, 22 bp, Homo sapiens
atacatgttgagaaaatatctg

SEQ ID NO: 7878400 - DNA, 22 bp, Homo sapiens
atacatgttgagaaaatatctg

SEQ ID NO: 7878401 - DNA, 22 bp, Homo sapiens
atacatgttgagaaaatatctg

SEQ ID NO: 7878402 - DNA, 22 bp, Homo sapiens
atacatgttcgtgtacatgttc

SEQ ID NO: 7878403 - DNA, 22 bp, Homo sapiens
atacatgttcgtgtacatgttc

SEQ ID NO: 7878404 - DNA, 22 bp, Homo sapiens
atacaggtaatttgaataatag

SEQ ID NO: 7878405 - DNA, 22 bp, Homo sapiens
atacagggacatccagtttttc

SEQ ID NO: 7878406 - DNA, 22 bp, Homo sapiens
atacaggatgctgaacatctct

SEQ ID NO: 7878407 - DNA, 22 bp, Homo sapiens
atacaggatgctgaacatctct

SEQ ID NO: 7878408 - DNA, 22 bp, Homo sapiens
atacagggacatccagtttttc

SEQ ID NO: 7878409 - DNA, 22 bp, Homo sapiens
atacagggacatccagtttttc

SEQ ID NO: 7878410 - DNA, 22 bp, Homo sapiens
atacagggacatccagtttttc

SEQ ID NO: 7878411 - DNA, 22 bp, Homo sapiens
atacagggacatccagtttttc

SEQ ID NO: 7878412 - DNA, 22 bp, Homo sapiens
atacagcttatgcatatatctc

SEQ ID NO: 7878413 - DNA, 22 bp, Homo sapiens
atacagctttctttcacatgag

SEQ ID NO: 7878414 - DNA, 22 bp, Homo sapiens
atacagctttctttcacatgag

SEQ ID NO: 7878415 - DNA, 22 bp, Homo sapiens
atacagcttacagttctaatgc

SEQ ID NO: 7878416 - DNA, 22 bp, Homo sapiens
atacagattgctatacttacaa

SEQ ID NO: 7878417 - DNA, 22 bp, Homo sapiens
atacagattgctatacttacaa

SEQ ID NO: 7878418 - DNA, 22 bp, Homo sapiens
atacagcagcccttgctttgca

SEQ ID NO: 7878419 - DNA, 22 bp, Homo sapiens
atacagcagtgaataagataaa

SEQ ID NO: 7878420 - DNA, 22 bp, Homo sapiens
atacagcagtgaataagataaa

SEQ ID NO: 7878421 - DNA, 22 bp, Homo sapiens
atacagcagtgaataagataaa

SEQ ID NO: 7878422 - DNA, 22 bp, Homo sapiens
atacagcagtgaataagataaa

SEQ ID NO: 7878423 - DNA, 22 bp, Homo sapiens
atacagcagtttgtgatcctag

SEQ ID NO: 7878424 - DNA, 22 bp, Homo sapiens
atacagccagcttcctgacctt

SEQ ID NO: 7878425 - DNA, 22 bp, Homo sapiens
atacaggtaggggacatacatc

SEQ ID NO: 7878426 - DNA, 22 bp, Homo sapiens
atacaggtggaactaaataaat

SEQ ID NO: 7878427 - DNA, 22 bp, Homo sapiens
atacaggtgtacacacatgcaa

SEQ ID NO: 7878428 - DNA, 22 bp, Homo sapiens
acttctcttccccggaactcta

SEQ ID NO: 7878429 - DNA, 22 bp, Homo sapiens
acttctcttcataggtggcaat

SEQ ID NO: 7878430 - DNA, 22 bp, Homo sapiens
atacagtaaccacattctatag

SEQ ID NO: 7878431 - DNA, 22 bp, Homo sapiens
atacagtaaccacattctatag

SEQ ID NO: 7878432 - DNA, 22 bp, Homo sapiens
atacagtaaccacattctatag

SEQ ID NO: 7878433 - DNA, 22 bp, Homo sapiens
atacagtaaccacattctatag

SEQ ID NO: 7878434 - DNA, 22 bp, Homo sapiens
acttctcttcataggtggcaat

SEQ ID NO: 7878435 - DNA, 22 bp, Homo sapiens
atacagtaaccacattctatag

SEQ ID NO: 7878436 - DNA, 22 bp, Homo sapiens
atacagtaaccacattctatag

SEQ ID NO: 7878437 - DNA, 22 bp, Homo sapiens
acttctgagaaatttaaggaca

SEQ ID NO: 7878438 - DNA, 22 bp, Homo sapiens
acttctgagaaatttaaggaca

SEQ ID NO: 7878439 - DNA, 19 bp, Homo sapiens
acttctgaggaactgcaca

SEQ ID NO: 7878440 - DNA, 19 bp, Homo sapiens
acttctgaggaactgcaca

SEQ ID NO: 7878441 - DNA, 22 bp, Homo sapiens
acttctgaagcagagatttggg

SEQ ID NO: 7878442 - DNA, 22 bp, Homo sapiens
acttctgaagcagagatttggg

SEQ ID NO: 7878443 - DNA, 22 bp, Homo sapiens
acttctctttagtactaaatgt

SEQ ID NO: 7878444 - DNA, 22 bp, Homo sapiens
acttctgactcaaccgtgagct

SEQ ID NO: 7878445 - DNA, 22 bp, Homo sapiens
acttctgactcaaccgtgagct

SEQ ID NO: 7878446 - DNA, 22 bp, Homo sapiens
acttctgataaagagcatgtgc

SEQ ID NO: 7878447 - DNA, 22 bp, Homo sapiens
acttctgataaagagcatgtgc

SEQ ID NO: 7878448 - DNA, 22 bp, Homo sapiens
acttctgataaagagcatgtgc

SEQ ID NO: 7878449 - DNA, 19 bp, Homo sapiens
acttctgaggaactgcaca

SEQ ID NO: 7878450 - DNA, 22 bp, Homo sapiens
acttctgattaaggatgaatgc

SEQ ID NO: 7878451 - DNA, 22 bp, Homo sapiens
acttctgattaaggatgaatgc

SEQ ID NO: 7878452 - DNA, 22 bp, Homo sapiens
acttctgattacacatgggcct

SEQ ID NO: 7878453 - DNA, 22 bp, Homo sapiens
acttctgattacacatgggcct

SEQ ID NO: 7878454 - DNA, 22 bp, Homo sapiens
acttagaaattcagttttgtca

SEQ ID NO: 7878455 - DNA, 22 bp, Homo sapiens
acttagaaagggattctagatt

SEQ ID NO: 7878456 - DNA, 22 bp, Homo sapiens
acttaccagagaggatccgccc

SEQ ID NO: 7878457 - DNA, 22 bp, Homo sapiens
acttacccaagttatttgtagt

SEQ ID NO: 7878458 - DNA, 22 bp, Homo sapiens
acttacccacccctgggttgag

SEQ ID NO: 7878459 - DNA, 22 bp, Homo sapiens
acttacaatcaaccaccttgga

SEQ ID NO: 7878460 - DNA, 22 bp, Homo sapiens
acttacaatcaaccaccttgga

SEQ ID NO: 7878461 - DNA, 22 bp, Homo sapiens
acttacaatcaaccaccttgga

SEQ ID NO: 7878462 - DNA, 19 bp, Homo sapiens
acttaatccctatctcttg

SEQ ID NO: 7878463 - DNA, 22 bp, Homo sapiens
acttacaagctagggaagcttg

SEQ ID NO: 7878464 - DNA, 22 bp, Homo sapiens
acttaagatagagcaagtctga

SEQ ID NO: 7878465 - DNA, 22 bp, Homo sapiens
acttacaagctagggaagcttg

SEQ ID NO: 7878466 - DNA, 22 bp, Homo sapiens
acttacaagttccctttctcag

SEQ ID NO: 7878467 - DNA, 22 bp, Homo sapiens
acttacaagttccctttctcag

SEQ ID NO: 7878468 - DNA, 22 bp, Homo sapiens
acttagaagatgcagtaaagca

SEQ ID NO: 7878469 - DNA, 22 bp, Homo sapiens
acttagaagatgcagtaaagca

SEQ ID NO: 7878470 - DNA, 22 bp, Homo sapiens
acttagaagatgcagtaaagca

SEQ ID NO: 7878471 - DNA, 22 bp, Homo sapiens
acttagaacaggcagaattcca

SEQ ID NO: 7878472 - DNA, 20 bp, Homo sapiens
atacacttgcccagcttgtg

SEQ ID NO: 7878473 - DNA, 20 bp, Homo sapiens
atacacttgcccagcttgtg

SEQ ID NO: 7878474 - DNA, 22 bp, Homo sapiens
acttagaatatgttcaagattt

SEQ ID NO: 7878475 - DNA, 22 bp, Homo sapiens
acttagaatatgttcaagattt

SEQ ID NO: 7878476 - DNA, 22 bp, Homo sapiens
acttagaatatgttcaagattt

SEQ ID NO: 7878477 - DNA, 22 bp, Homo sapiens
atacagatgttgaatgttatat

SEQ ID NO: 7878478 - DNA, 22 bp, Homo sapiens
atacagatgttgaatgttatat

SEQ ID NO: 7878479 - DNA, 22 bp, Homo sapiens
atacacttgtacattttttaat

SEQ ID NO: 7878480 - DNA, 22 bp, Homo sapiens
atacagatgttaaagcaatttc

SEQ ID NO: 7878481 - DNA, 22 bp, Homo sapiens
atacacttgtacattttttaat

SEQ ID NO: 7878482 - DNA, 23 bp, Homo sapiens
acttaaatggttctttatctcag

SEQ ID NO: 7878483 - DNA, 23 bp, Homo sapiens
acttaaatggttctttatctcag

SEQ ID NO: 7878484 - DNA, 21 bp, Homo sapiens
acttaaattccttgatattta

SEQ ID NO: 7878485 - DNA, 21 bp, Homo sapiens
acttaaattccttgatattta

SEQ ID NO: 7878486 - DNA, 23 bp, Homo sapiens
acttaaatggttctttatctcag

SEQ ID NO: 7878487 - DNA, 22 bp, Homo sapiens
acttaacagacattatttacct

SEQ ID NO: 7878488 - DNA, 22 bp, Homo sapiens
acttaaagtagttttactgtgg

SEQ ID NO: 7878489 - DNA, 22 bp, Homo sapiens
ataatggccgggggctgaatgc

SEQ ID NO: 7878490 - DNA, 22 bp, Homo sapiens
ataatggattcagaaccgtcaa

SEQ ID NO: 7878491 - DNA, 22 bp, Homo sapiens
ataatggaggaagctatgtgga

SEQ ID NO: 7878492 - DNA, 22 bp, Homo sapiens
ataatggactcagtaatagtga

SEQ ID NO: 7878493 - DNA, 22 bp, Homo sapiens
acttaaagttataatttgctaa

SEQ ID NO: 7878494 - DNA, 22 bp, Homo sapiens
acttaaagttataatttgctaa

SEQ ID NO: 7878495 - DNA, 22 bp, Homo sapiens
acttaaatagaactcctcaata

SEQ ID NO: 7878496 - DNA, 22 bp, Homo sapiens
ataatggccgggggctgaatgc

SEQ ID NO: 7878497 - DNA, 22 bp, Homo sapiens
acttaaatagaactcctcaata

SEQ ID NO: 7878498 - DNA, 22 bp, Homo sapiens
ataatgcatttagaataattca

SEQ ID NO: 7878499 - DNA, 22 bp, Homo sapiens
ataatgctgggagaaattgtta

SEQ ID NO: 7878500 - DNA, 22 bp, Homo sapiens
ataatgcatttagaataattca

SEQ ID NO: 7878501 - DNA, 22 bp, Homo sapiens
ataatgcatttagaataattca

SEQ ID NO: 7878502 - DNA, 22 bp, Homo sapiens
ataatgcatttagaataattca

SEQ ID NO: 7878503 - DNA, 22 bp, Homo sapiens
ataatgcatttagaataattca

SEQ ID NO: 7878504 - DNA, 22 bp, Homo sapiens
ataaacaagactggccaacttt

SEQ ID NO: 7878505 - DNA, 22 bp, Homo sapiens
ataaacaagactggccaacttt

SEQ ID NO: 7878506 - DNA, 22 bp, Homo sapiens
ataaacaagactggccaacttt

SEQ ID NO: 7878507 - DNA, 22 bp, Homo sapiens
ataaacaagactggccaacttt

SEQ ID NO: 7878508 - DNA, 22 bp, Homo sapiens
ataaacaagactggccaacttt

SEQ ID NO: 7878509 - DNA, 22 bp, Homo sapiens
ataaaatttgctactgttaaat

SEQ ID NO: 7878510 - DNA, 22 bp, Homo sapiens
ataaaatttgctactgttaaat

SEQ ID NO: 7878511 - DNA, 22 bp, Homo sapiens
ataaaatttgctactgttaaat

SEQ ID NO: 7878512 - DNA, 22 bp, Homo sapiens
ataaaatttgctactgttaaat

SEQ ID NO: 7878513 - DNA, 22 bp, Homo sapiens
ataaaatttgctactgttaaat

SEQ ID NO: 7878514 - DNA, 22 bp, Homo sapiens
ataaaatttgctactgttaaat

SEQ ID NO: 7878515 - DNA, 22 bp, Homo sapiens
ataaaatttgctactgttaaat

SEQ ID NO: 7878516 - DNA, 22 bp, Homo sapiens
ataaaatttgctactgttaaat

SEQ ID NO: 7878517 - DNA, 22 bp, Homo sapiens
ataaaatttgctactgttaaat

SEQ ID NO: 7878518 - DNA, 22 bp, Homo sapiens
ataaaatttgctactgttaaat

SEQ ID NO: 7878519 - DNA, 22 bp, Homo sapiens
ataaaatttgctactgttaaat

SEQ ID NO: 7878520 - DNA, 22 bp, Homo sapiens
ataaaaactgacccatcctttg

SEQ ID NO: 7878521 - DNA, 22 bp, Homo sapiens
actgtgcaaatgacaggcacac

SEQ ID NO: 7878522 - DNA, 22 bp, Homo sapiens
actgtgcaaatgacaggcacac

SEQ ID NO: 7878523 - DNA, 22 bp, Homo sapiens
actgtgcaagtcaaagatgggc

SEQ ID NO: 7878524 - DNA, 22 bp, Homo sapiens
actgtgcaatgagtaataaact

SEQ ID NO: 7878525 - DNA, 22 bp, Homo sapiens
actgtgcaatgagtaataaact

SEQ ID NO: 7878526 - DNA, 22 bp, Homo sapiens
actgtgcacaattctaagtcct

SEQ ID NO: 7878527 - DNA, 22 bp, Homo sapiens
actgtgatgcagttgccatcca

SEQ ID NO: 7878528 - DNA, 22 bp, Homo sapiens
actgtgatgatgaagcatggtt

SEQ ID NO: 7878529 - DNA, 22 bp, Homo sapiens
actgtgatgcagttgccatcca

SEQ ID NO: 7878530 - DNA, 22 bp, Homo sapiens
actgtgatgttctctatcttgg

SEQ ID NO: 7878531 - DNA, 22 bp, Homo sapiens
actgtgatgtttgtgatcatct

SEQ ID NO: 7878532 - DNA, 22 bp, Homo sapiens
actgtgatgttctctatcttgg

SEQ ID NO: 7878533 - DNA, 22 bp, Homo sapiens
actgtgagtttatttatctgat

SEQ ID NO: 7878534 - DNA, 21 bp, Homo sapiens
actgtgataatgctttttctg

SEQ ID NO: 7878535 - DNA, 22 bp, Homo sapiens
actgtgagtgatttccttctgg

SEQ ID NO: 7878536 - DNA, 22 bp, Homo sapiens
actgtgagggtactggaacaga

SEQ ID NO: 7878537 - DNA, 22 bp, Homo sapiens
ataaacagtaaatgtgagcagt

SEQ ID NO: 7878538 - DNA, 22 bp, Homo sapiens
ataaacagtaaatgtgagcagt

SEQ ID NO: 7878539 - DNA, 22 bp, Homo sapiens
ataaacagctccatttagtgcc

SEQ ID NO: 7878540 - DNA, 22 bp, Homo sapiens
ataaacacttctagggcacaca

SEQ ID NO: 7878541 - DNA, 22 bp, Homo sapiens
ataaacagtagagaaaggtggt

SEQ ID NO: 7878542 - DNA, 22 bp, Homo sapiens
ataaacacttctagggcacaca

SEQ ID NO: 7878543 - DNA, 22 bp, Homo sapiens
ataaacagcataaaatacgctt

SEQ ID NO: 7878544 - DNA, 22 bp, Homo sapiens
ataaacagagtagttgctactg

SEQ ID NO: 7878545 - DNA, 22 bp, Homo sapiens
ataaacagagtagttgctactg

SEQ ID NO: 7878546 - DNA, 22 bp, Homo sapiens
ataaacagcctgcccaaattgg

SEQ ID NO: 7878547 - DNA, 22 bp, Homo sapiens
ataaacagcctgcccaaattgg

SEQ ID NO: 7878548 - DNA, 21 bp, Homo sapiens
ataaacagcatgtgatccatg

SEQ ID NO: 7878549 - DNA, 22 bp, Homo sapiens
ataatgagcttttgaatactga

SEQ ID NO: 7878550 - DNA, 23 bp, Homo sapiens
ataatgacattggcttaggtatg

SEQ ID NO: 7878551 - DNA, 22 bp, Homo sapiens
ataatgcacctttgagtatggc

SEQ ID NO: 7878552 - DNA, 22 bp, Homo sapiens
ataatgaatgcagagttatttt

SEQ ID NO: 7878553 - DNA, 22 bp, Homo sapiens
ataatgaatgcagagttatttt

SEQ ID NO: 7878554 - DNA, 22 bp, Homo sapiens
ataatgaatgcagagttatttt

SEQ ID NO: 7878555 - DNA, 22 bp, Homo sapiens
ataatctttcttttccagatag

SEQ ID NO: 7878556 - DNA, 22 bp, Homo sapiens
ataatctggtctttgtatgagt

SEQ ID NO: 7878557 - DNA, 22 bp, Homo sapiens
ataatcctgctttttcactatt

SEQ ID NO: 7878558 - DNA, 22 bp, Homo sapiens
ataatctgagctatttcatgag

SEQ ID NO: 7878559 - DNA, 22 bp, Homo sapiens
ataatctgagctatttcatgag

SEQ ID NO: 7878560 - DNA, 22 bp, Homo sapiens
ataatccatgtctagagtaaag

SEQ ID NO: 7878561 - DNA, 22 bp, Homo sapiens
ataatctgacaaagacttaagc

SEQ ID NO: 7878562 - DNA, 22 bp, Homo sapiens
ataatcttgtatttcctaaagt

SEQ ID NO: 7878563 - DNA, 22 bp, Homo sapiens
ataatctggtctttgtatgagt

SEQ ID NO: 7878564 - DNA, 22 bp, Homo sapiens
ataatctgtggatggttttgag

SEQ ID NO: 7878565 - DNA, 22 bp, Homo sapiens
ataatctggtctttgtatgagt

SEQ ID NO: 7878566 - DNA, 22 bp, Homo sapiens
ataatctttcttttccagatag

SEQ ID NO: 7878567 - DNA, 22 bp, Homo sapiens
ataatcttgtatttcctaaagt

SEQ ID NO: 7878568 - DNA, 22 bp, Homo sapiens
ataatcttgtatttcctaaagt

SEQ ID NO: 7878569 - DNA, 22 bp, Homo sapiens
ataagtaggaaaatttgaatat

SEQ ID NO: 7878570 - DNA, 22 bp, Homo sapiens
ataaggttttcttttgttccct

SEQ ID NO: 7878571 - DNA, 22 bp, Homo sapiens
ataaggttggtcttaactacct

SEQ ID NO: 7878572 - DNA, 22 bp, Homo sapiens
ataaggttaggattatagtgtt

SEQ ID NO: 7878573 - DNA, 22 bp, Homo sapiens
actgtgcatttgtcatggggtt

SEQ ID NO: 7878574 - DNA, 22 bp, Homo sapiens
actgtgccacaattcaccaggg

SEQ ID NO: 7878575 - DNA, 22 bp, Homo sapiens
actgtgccacaattcaccaggg

SEQ ID NO: 7878576 - DNA, 22 bp, Homo sapiens
ataaggttaacatcatcagtga

SEQ ID NO: 7878577 - DNA, 22 bp, Homo sapiens
actgtgccacaattcaccaggg

SEQ ID NO: 7878578 - DNA, 22 bp, Homo sapiens
actgtgcatgaaccgaaacaaa

SEQ ID NO: 7878579 - DNA, 22 bp, Homo sapiens
actgtgcatggtatccttgatg

SEQ ID NO: 7878580 - DNA, 22 bp, Homo sapiens
actgtgcattccccaacctgtg

SEQ ID NO: 7878581 - DNA, 22 bp, Homo sapiens
actgtgcattccccaacctgtg

SEQ ID NO: 7878582 - DNA, 22 bp, Homo sapiens
actgtgcatttcatgtcttttc

SEQ ID NO: 7878583 - DNA, 22 bp, Homo sapiens
actgtgcatttgaagggatcat

SEQ ID NO: 7878584 - DNA, 22 bp, Homo sapiens
actgtgccacaattcaccaggg

SEQ ID NO: 7878585 - DNA, 22 bp, Homo sapiens
actgtgcacacaaaaatagatt

SEQ ID NO: 7878586 - DNA, 22 bp, Homo sapiens
actgtgcacacaaaaatagatt

SEQ ID NO: 7878587 - DNA, 22 bp, Homo sapiens
actgtgcaccctggacagtgtc

SEQ ID NO: 7878588 - DNA, 21 bp, Homo sapiens
actgtgcagcctgaggatgtg

SEQ ID NO: 7878589 - DNA, 22 bp, Homo sapiens
actgtgcagctgagtgctaatt

SEQ ID NO: 7878590 - DNA, 22 bp, Homo sapiens
actgtgcaggggaagagagaaa

SEQ ID NO: 7878591 - DNA, 22 bp, Homo sapiens
actgtgcaggtagatgcctggg

SEQ ID NO: 7878592 - DNA, 22 bp, Homo sapiens
actgtgcaggtagatgcctggg

SEQ ID NO: 7878593 - DNA, 22 bp, Homo sapiens
actgtgcaggtgaactgtttgc

SEQ ID NO: 7878594 - DNA, 22 bp, Homo sapiens
actgtgcaggtagatgcctggg

SEQ ID NO: 7878595 - DNA, 22 bp, Homo sapiens
actgtgcagtgttgtaacccga

SEQ ID NO: 7878596 - DNA, 22 bp, Homo sapiens
actgtgcatgaaccgaaacaaa

SEQ ID NO: 7878597 - DNA, 22 bp, Homo sapiens
actgtgcatctattgccattta

SEQ ID NO: 7878598 - DNA, 22 bp, Homo sapiens
actgtcaaaagagattatatta

SEQ ID NO: 7878599 - DNA, 22 bp, Homo sapiens
actgtcaaaagagattatatta

SEQ ID NO: 7878600 - DNA, 22 bp, Homo sapiens
actgtatttttgaatcattgtg

SEQ ID NO: 7878601 - DNA, 21 bp, Homo sapiens
actgtattgttttcaaggatc

SEQ ID NO: 7878602 - DNA, 22 bp, Homo sapiens
actgtattggaaatatagcaaa

SEQ ID NO: 7878603 - DNA, 22 bp, Homo sapiens
actgtatttccaacagacaaat

SEQ ID NO: 7878604 - DNA, 21 bp, Homo sapiens
actgtattgttttcaaggatc

SEQ ID NO: 7878605 - DNA, 22 bp, Homo sapiens
actgtatttccaacagacaaat

SEQ ID NO: 7878606 - DNA, 22 bp, Homo sapiens
actgtatttggatataagatct

SEQ ID NO: 7878607 - DNA, 22 bp, Homo sapiens
actgtatttggatataagatct

SEQ ID NO: 7878608 - DNA, 22 bp, Homo sapiens
actgtatttccaacagacaaat

SEQ ID NO: 7878609 - DNA, 22 bp, Homo sapiens
actgtatttggatataagatct

SEQ ID NO: 7878610 - DNA, 22 bp, Homo sapiens
actgtatttggatataagatct

SEQ ID NO: 7878611 - DNA, 22 bp, Homo sapiens
actgtatttggatataagatct

SEQ ID NO: 7878612 - DNA, 22 bp, Homo sapiens
actgtataaggcataggtaagc

SEQ ID NO: 7878613 - DNA, 22 bp, Homo sapiens
actgtagtgatgataattaagt

SEQ ID NO: 7878614 - DNA, 22 bp, Homo sapiens
actgtagtctaaatatagtctt

SEQ ID NO: 7878615 - DNA, 22 bp, Homo sapiens
actgtatagtatttattcttag

SEQ ID NO: 7878616 - DNA, 22 bp, Homo sapiens
actgtatagtatttattcttag

SEQ ID NO: 7878617 - DNA, 22 bp, Homo sapiens
actgtatagatggagttgattt

SEQ ID NO: 7878618 - DNA, 22 bp, Homo sapiens
actgtatacttctgtatacaat

SEQ ID NO: 7878619 - DNA, 22 bp, Homo sapiens
actgtattggaaatatagcaaa

SEQ ID NO: 7878620 - DNA, 22 bp, Homo sapiens
actgtattggaaatatagcaaa

SEQ ID NO: 7878621 - DNA, 22 bp, Homo sapiens
actgtattctagtcatgtttgt

SEQ ID NO: 7878622 - DNA, 22 bp, Homo sapiens
actgtattcctactagaatcta

SEQ ID NO: 7878623 - DNA, 22 bp, Homo sapiens
actgtatagtatttattcttag

SEQ ID NO: 7878624 - DNA, 22 bp, Homo sapiens
actgtattcctactagaatcta

SEQ ID NO: 7878625 - DNA, 22 bp, Homo sapiens
actgtattcctactagaatcta

SEQ ID NO: 7878626 - DNA, 22 bp, Homo sapiens
actgtattcctactagaatcta

SEQ ID NO: 7878627 - DNA, 22 bp, Homo sapiens
actgtcaagagattcaaattca

SEQ ID NO: 7878628 - DNA, 22 bp, Homo sapiens
actgtcaatgggttcattgagt

SEQ ID NO: 7878629 - DNA, 19 bp, Homo sapiens
actgtcacataaaggaagg

SEQ ID NO: 7878630 - DNA, 22 bp, Homo sapiens
actgtcaatgggttcattgagt

SEQ ID NO: 7878631 - DNA, 19 bp, Homo sapiens
actgtcacataaaggaagg

SEQ ID NO: 7878632 - DNA, 22 bp, Homo sapiens
actgtcatcttgtaagcaatgt

SEQ ID NO: 7878633 - DNA, 22 bp, Homo sapiens
ataaaaactgacccatcctttg

SEQ ID NO: 7878634 - DNA, 22 bp, Homo sapiens
actgtcatcagaagatgaaaat

SEQ ID NO: 7878635 - DNA, 22 bp, Homo sapiens
actgtcatcagaagatgaaaat

SEQ ID NO: 7878636 - DNA, 22 bp, Homo sapiens
actgtcacttgcaactgtgagg

SEQ ID NO: 7878637 - DNA, 22 bp, Homo sapiens
actgtcacttgcaactgtgagg

SEQ ID NO: 7878638 - DNA, 22 bp, Homo sapiens
actgtcacttgcaactgtgagg

SEQ ID NO: 7878639 - DNA, 22 bp, Homo sapiens
actgtcactgacagaatcaaca

SEQ ID NO: 7878640 - DNA, 22 bp, Homo sapiens
actgtcactgacagaatcaaca

SEQ ID NO: 7878641 - DNA, 22 bp, Homo sapiens
actgtcactgacagaatcaaca

SEQ ID NO: 7878642 - DNA, 22 bp, Homo sapiens
actgtcacttgcaactgtgagg

SEQ ID NO: 7878643 - DNA, 22 bp, Homo sapiens
actgtcactgtgatgttagaga

SEQ ID NO: 7878644 - DNA, 22 bp, Homo sapiens
actgtagctgccactggatgca

SEQ ID NO: 7878645 - DNA, 22 bp, Homo sapiens
actgtagaggcctggattgagg

SEQ ID NO: 7878646 - DNA, 22 bp, Homo sapiens
actgtagaggcctggattgagg

SEQ ID NO: 7878647 - DNA, 22 bp, Homo sapiens
actgtactttcccaagcacaca

SEQ ID NO: 7878648 - DNA, 22 bp, Homo sapiens
actgtagaatggaaccaattgt

SEQ ID NO: 7878649 - DNA, 22 bp, Homo sapiens
actgtagagaatctgagaaaaa

SEQ ID NO: 7878650 - DNA, 22 bp, Homo sapiens
actgtactcttatagccatctg

SEQ ID NO: 7878651 - DNA, 22 bp, Homo sapiens
actgtactcggggaaatggggt

SEQ ID NO: 7878652 - DNA, 22 bp, Homo sapiens
actgtactgtgtattgtagaat

SEQ ID NO: 7878653 - DNA, 22 bp, Homo sapiens
actgtactcttctagccatctg

SEQ ID NO: 7878654 - DNA, 22 bp, Homo sapiens
actgtacttacgcatatacagg

SEQ ID NO: 7878655 - DNA, 22 bp, Homo sapiens
actgtactttagaaagtgtagt

SEQ ID NO: 7878656 - DNA, 22 bp, Homo sapiens
actgtactttagaaagtgtagt

SEQ ID NO: 7878657 - DNA, 22 bp, Homo sapiens
actgtacttacgcatatacagg

SEQ ID NO: 7878658 - DNA, 22 bp, Homo sapiens
actgtactgaaaagtaagcaag

SEQ ID NO: 7878659 - DNA, 22 bp, Homo sapiens
actgtaccaccttgctcttgtc

SEQ ID NO: 7878660 - DNA, 22 bp, Homo sapiens
actgtacctcaaactctggaac

SEQ ID NO: 7878661 - DNA, 22 bp, Homo sapiens
actgtactcaagcctgggcaat

SEQ ID NO: 7878662 - DNA, 22 bp, Homo sapiens
actgtactccaacctgggcaac

SEQ ID NO: 7878663 - DNA, 22 bp, Homo sapiens
actgtacatgtaaacattgtca

SEQ ID NO: 7878664 - DNA, 22 bp, Homo sapiens
actgtacatgtaaacattgtca

SEQ ID NO: 7878665 - DNA, 22 bp, Homo sapiens
actgtacatgtaaacattgtca

SEQ ID NO: 7878666 - DNA, 22 bp, Homo sapiens
actgtaacacaatggtatctgt

SEQ ID NO: 7878667 - DNA, 22 bp, Homo sapiens
actgtaacactcatactgaagt

SEQ ID NO: 7878668 - DNA, 22 bp, Homo sapiens
actgtacatgtaaacattgtca

SEQ ID NO: 7878669 - DNA, 22 bp, Homo sapiens
actgggactgtatgtgctggac

SEQ ID NO: 7878670 - DNA, 22 bp, Homo sapiens
actgggactgtatgtgctggac

SEQ ID NO: 7878671 - DNA, 22 bp, Homo sapiens
actgggagagtttgcttataat

SEQ ID NO: 7878672 - DNA, 20 bp, Homo sapiens
actgggagctaacggagatt

SEQ ID NO: 7878673 - DNA, 20 bp, Homo sapiens
actgggagctaacggagatt

SEQ ID NO: 7878674 - DNA, 20 bp, Homo sapiens
actgggagctaacggagatt

SEQ ID NO: 7878675 - DNA, 22 bp, Homo sapiens
actgggaaggaaaggaatgtaa

SEQ ID NO: 7878676 - DNA, 22 bp, Homo sapiens
actgggaaggagcaggatctgt

SEQ ID NO: 7878677 - DNA, 22 bp, Homo sapiens
actgggaagtcagagagaggct

SEQ ID NO: 7878678 - DNA, 23 bp, Homo sapiens
actgggaagtttggagagacgca

SEQ ID NO: 7878679 - DNA, 22 bp, Homo sapiens
actgggaagtcagagagaggct

SEQ ID NO: 7878680 - DNA, 23 bp, Homo sapiens
actgggaagtttggagagacgca

SEQ ID NO: 7878681 - DNA, 22 bp, Homo sapiens
actgggaatctcaggaacatgg

SEQ ID NO: 7878682 - DNA, 22 bp, Homo sapiens
actgggaatggagcctgggcct

SEQ ID NO: 7878683 - DNA, 22 bp, Homo sapiens
actgggaagatggaggcaagca

SEQ ID NO: 7878684 - DNA, 22 bp, Homo sapiens
actgggaagatggaggcaagca

SEQ ID NO: 7878685 - DNA, 22 bp, Homo sapiens
actgggaaggaaaggaatgtaa

SEQ ID NO: 7878686 - DNA, 22 bp, Homo sapiens
actgggaagctgttttgctttt

SEQ ID NO: 7878687 - DNA, 22 bp, Homo sapiens
actgggaagacaagaaagatag

SEQ ID NO: 7878688 - DNA, 22 bp, Homo sapiens
actgggaagagagaattctgtc

SEQ ID NO: 7878689 - DNA, 22 bp, Homo sapiens
actgggaagactggaattgctc

SEQ ID NO: 7878690 - DNA, 19 bp, Homo sapiens
actgggaaaaaggcactgg

SEQ ID NO: 7878691 - DNA, 19 bp, Homo sapiens
actgggaaaaaggcactgg

SEQ ID NO: 7878692 - DNA, 22 bp, Homo sapiens
actgggaaaagctatggcaaat

SEQ ID NO: 7878693 - DNA, 22 bp, Homo sapiens
actgggaaagtgctgcctgcag

SEQ ID NO: 7878694 - DNA, 22 bp, Homo sapiens
actgggaaagtgctgcctgcag

SEQ ID NO: 7878695 - DNA, 22 bp, Homo sapiens
actgggaaattgccctagttct

SEQ ID NO: 7878696 - DNA, 22 bp, Homo sapiens
actgggaacaaggtgctcagcg

SEQ ID NO: 7878697 - DNA, 22 bp, Homo sapiens
actgggaacctgtgctaggagg

SEQ ID NO: 7878698 - DNA, 22 bp, Homo sapiens
actgggaacctgtgctaggagg

SEQ ID NO: 7878699 - DNA, 22 bp, Homo sapiens
actgggaacaaggtgctcagcg

SEQ ID NO: 7878700 - DNA, 22 bp, Homo sapiens
cactgctacctctgcctcccgg

SEQ ID NO: 7878701 - DNA, 22 bp, Homo sapiens
cactgctacctctgcctcccgg

SEQ ID NO: 7878702 - DNA, 22 bp, Homo sapiens
cactgctacctctgcctcccgg

SEQ ID NO: 7878703 - DNA, 22 bp, Homo sapiens
cactgcctgtgagctgtgtgcc

SEQ ID NO: 7878704 - DNA, 22 bp, Homo sapiens
cactgcctttggtgggaacact

SEQ ID NO: 7878705 - DNA, 23 bp, Homo sapiens
cactgccttcagttgcttcacct

SEQ ID NO: 7878706 - DNA, 23 bp, Homo sapiens
cactgccttcagttgcttcacct

SEQ ID NO: 7878707 - DNA, 22 bp, Homo sapiens
cactgccttcacctgccctatc

SEQ ID NO: 7878708 - DNA, 23 bp, Homo sapiens
cactgccttcagttgcttcacct

SEQ ID NO: 7878709 - DNA, 22 bp, Homo sapiens
cactgctacctctgcctcccgg

SEQ ID NO: 7878710 - DNA, 22 bp, Homo sapiens
cactgctacctctgcctcccgg

SEQ ID NO: 7878711 - DNA, 22 bp, Homo sapiens
cactgctagtctgaagtactgg

SEQ ID NO: 7878712 - DNA, 22 bp, Homo sapiens
cactgctatgatgatgatattt

SEQ ID NO: 7878713 - DNA, 22 bp, Homo sapiens
cactgctattattagacaatgt

SEQ ID NO: 7878714 - DNA, 22 bp, Homo sapiens
cactgctcgctgcagcatggcc

SEQ ID NO: 7878715 - DNA, 22 bp, Homo sapiens
cactgcttatgtctccttttca

SEQ ID NO: 7878716 - DNA, 22 bp, Homo sapiens
cactgcttatgtctccttttca

SEQ ID NO: 7878717 - DNA, 22 bp, Homo sapiens
cactgcttataaattctaggca

SEQ ID NO: 7878718 - DNA, 22 bp, Homo sapiens
cactgctgatttcataggcagg

SEQ ID NO: 7878719 - DNA, 22 bp, Homo sapiens
cactgctgatttcataggcagg

SEQ ID NO: 7878720 - DNA, 22 bp, Homo sapiens
cactgcttagatcttccttcaa

SEQ ID NO: 7878721 - DNA, 22 bp, Homo sapiens
cactgcttagatcttccttcaa

SEQ ID NO: 7878722 - DNA, 22 bp, Homo sapiens
cactgctcgctgcagcatggcc

SEQ ID NO: 7878723 - DNA, 22 bp, Homo sapiens
cactgctgatttcataggcagg

SEQ ID NO: 7878724 - DNA, 22 bp, Homo sapiens
cactgctgatttcataggcagg

SEQ ID NO: 7878725 - DNA, 22 bp, Homo sapiens
cactgctgatttcataggcagg

SEQ ID NO: 7878726 - DNA, 22 bp, Homo sapiens
agcatacaggtctgaaacagct

SEQ ID NO: 7878727 - DNA, 22 bp, Homo sapiens
agcatacaggtctgaaacagct

SEQ ID NO: 7878728 - DNA, 22 bp, Homo sapiens
agcatacaggtctgaaacagct

SEQ ID NO: 7878729 - DNA, 22 bp, Homo sapiens
agcatacagttgaaagtggctt

SEQ ID NO: 7878730 - DNA, 22 bp, Homo sapiens
agcatacagttgaaagtggctt

SEQ ID NO: 7878731 - DNA, 22 bp, Homo sapiens
agcatacagtaggtgctcagtt

SEQ ID NO: 7878732 - DNA, 22 bp, Homo sapiens
agcatacagtaggtgctcagtt

SEQ ID NO: 7878733 - DNA, 20 bp, Homo sapiens
agcatacatcataagaaacc

SEQ ID NO: 7878734 - DNA, 19 bp, Homo sapiens
agcatagacttctcaggaa

SEQ ID NO: 7878735 - DNA, 20 bp, Homo sapiens
agcatagagcaccagaaggc

SEQ ID NO: 7878736 - DNA, 22 bp, Homo sapiens
agcatagaataagctgaagtca

SEQ ID NO: 7878737 - DNA, 22 bp, Homo sapiens
agcatagaaaagattcccagag

SEQ ID NO: 7878738 - DNA, 19 bp, Homo sapiens
agcatagacttctcaggaa

SEQ ID NO: 7878739 - DNA, 22 bp, Homo sapiens
agcatagaaaagattcccagag

SEQ ID NO: 7878740 - DNA, 22 bp, Homo sapiens
agcatagaataagctgaagtca

SEQ ID NO: 7878741 - DNA, 22 bp, Homo sapiens
cactgcttctggaggaatttgg

SEQ ID NO: 7878742 - DNA, 22 bp, Homo sapiens
cactgcttgcagtatgagtgga

SEQ ID NO: 7878743 - DNA, 22 bp, Homo sapiens
cactgcttgattgacatgcacg

SEQ ID NO: 7878744 - DNA, 22 bp, Homo sapiens
cactgcttgcagtatgagtgga

SEQ ID NO: 7878745 - DNA, 22 bp, Homo sapiens
agcatacaaacatttgaggcag

SEQ ID NO: 7878746 - DNA, 22 bp, Homo sapiens
agcatacaaacatttgaggcag

SEQ ID NO: 7878747 - DNA, 22 bp, Homo sapiens
cactgctttaaggctgagtaac

SEQ ID NO: 7878748 - DNA, 22 bp, Homo sapiens
agcatacaccctaaactgctta

SEQ ID NO: 7878749 - DNA, 22 bp, Homo sapiens
agcatacaccctaaactgctta

SEQ ID NO: 7878750 - DNA, 22 bp, Homo sapiens
agcatacaccctaaactgctta

SEQ ID NO: 7878751 - DNA, 22 bp, Homo sapiens
cacccagggctgtgcctgccca

SEQ ID NO: 7878752 - DNA, 22 bp, Homo sapiens
cacccagggctgtgcctgccca

SEQ ID NO: 7878753 - DNA, 22 bp, Homo sapiens
caccctgtcagttgcaggatag

SEQ ID NO: 7878754 - DNA, 22 bp, Homo sapiens
caccctgtacaaatggacatct

SEQ ID NO: 7878755 - DNA, 22 bp, Homo sapiens
cacccaggctggagtgcattgg

SEQ ID NO: 7878756 - DNA, 22 bp, Homo sapiens
cacccaggctggattgcagtgg

SEQ ID NO: 7878757 - DNA, 22 bp, Homo sapiens
cacccagggctgtgcctgccca

SEQ ID NO: 7878758 - DNA, 22 bp, Homo sapiens
cacccaggctggagtgcagtgg

SEQ ID NO: 7878759 - DNA, 22 bp, Homo sapiens
cacccaggctggagtgcattgg

SEQ ID NO: 7878760 - DNA, 22 bp, Homo sapiens
cacccaggctggagtgcagtgg

SEQ ID NO: 7878761 - DNA, 22 bp, Homo sapiens
cacccaggctggagtgcagtgg

SEQ ID NO: 7878762 - DNA, 22 bp, Homo sapiens
caccctttgctgctcttcctcc

SEQ ID NO: 7878763 - DNA, 22 bp, Homo sapiens
cacccttcagctttcttagctc

SEQ ID NO: 7878764 - DNA, 22 bp, Homo sapiens
caccctgtcagttgcaggatag

SEQ ID NO: 7878765 - DNA, 22 bp, Homo sapiens
caccgcggagtgatggagaaac

SEQ ID NO: 7878766 - DNA, 22 bp, Homo sapiens
caccgcggagtgatggagaaac

SEQ ID NO: 7878767 - DNA, 19 bp, Homo sapiens
cacctacttttggatttgc

SEQ ID NO: 7878768 - DNA, 22 bp, Homo sapiens
cacctactttgtgcagatttta

SEQ ID NO: 7878769 - DNA, 22 bp, Homo sapiens
cacctacttccaagagtttcca

SEQ ID NO: 7878770 - DNA, 22 bp, Homo sapiens
cacctacttccaagagtttcca

SEQ ID NO: 7878771 - DNA, 22 bp, Homo sapiens
caccgtggaggagctggagggc

SEQ ID NO: 7878772 - DNA, 22 bp, Homo sapiens
caccgtggaggagctggagggc

SEQ ID NO: 7878773 - DNA, 22 bp, Homo sapiens
caccgcggagtgatggagaaac

SEQ ID NO: 7878774 - DNA, 22 bp, Homo sapiens
cacctagggtttcgcctttctt

SEQ ID NO: 7878775 - DNA, 22 bp, Homo sapiens
cacctcaggcagcaaagtctca

SEQ ID NO: 7878776 - DNA, 22 bp, Homo sapiens
cacctactttgtgcagatttta

SEQ ID NO: 7878777 - DNA, 19 bp, Homo sapiens
cacctacttttggatttgc

SEQ ID NO: 7878778 - DNA, 22 bp, Homo sapiens
cacctagggcatccctgcccca

SEQ ID NO: 7878779 - DNA, 22 bp, Homo sapiens
cacctgagcactggggccgccc

SEQ ID NO: 7878780 - DNA, 22 bp, Homo sapiens
cacctgagactcctcaccatga

SEQ ID NO: 7878781 - DNA, 22 bp, Homo sapiens
cacctgagcactggggccgccc

SEQ ID NO: 7878782 - DNA, 22 bp, Homo sapiens
cacctgagcaaccctgtgcggg

SEQ ID NO: 7878783 - DNA, 22 bp, Homo sapiens
cactgcacttcagcctgggtga

SEQ ID NO: 7878784 - DNA, 22 bp, Homo sapiens
cactgcacttcagcctgggtga

SEQ ID NO: 7878785 - DNA, 22 bp, Homo sapiens
cactgcagatcagaggctgaga

SEQ ID NO: 7878786 - DNA, 22 bp, Homo sapiens
cactgcctgtgagctgtgtgcc

SEQ ID NO: 7878787 - DNA, 22 bp, Homo sapiens
cactgcctgtgagctgtgtgcc

SEQ ID NO: 7878788 - DNA, 22 bp, Homo sapiens
cacctcatggataagataaact

SEQ ID NO: 7878789 - DNA, 22 bp, Homo sapiens
cacctcaggcagcaaagtctca

SEQ ID NO: 7878790 - DNA, 22 bp, Homo sapiens
cacctcaggcagcaaagtctca

SEQ ID NO: 7878791 - DNA, 20 bp, Homo sapiens
cacctctgaaagtttccagc

SEQ ID NO: 7878792 - DNA, 22 bp, Homo sapiens
cacctctgcctcaagcttccca

SEQ ID NO: 7878793 - DNA, 22 bp, Homo sapiens
cacctctgcctcaagcttccca

SEQ ID NO: 7878794 - DNA, 22 bp, Homo sapiens
cacctctttgatttgaggcaag

SEQ ID NO: 7878795 - DNA, 22 bp, Homo sapiens
cacctctttgatttgaggcaag

SEQ ID NO: 7878796 - DNA, 22 bp, Homo sapiens
cacctctgctgtccacaggatg

SEQ ID NO: 7878797 - DNA, 22 bp, Homo sapiens
cacctctttgatttgaggcaag

SEQ ID NO: 7878798 - DNA, 22 bp, Homo sapiens
cacctctgctgtccacaggatg

SEQ ID NO: 7878799 - DNA, 22 bp, Homo sapiens
cacctctgctgtccacaggatg

SEQ ID NO: 7878800 - DNA, 22 bp, Homo sapiens
cacctctgctgtccacaggatg

SEQ ID NO: 7878801 - DNA, 22 bp, Homo sapiens
cacctctgctgtccacaggatg

SEQ ID NO: 7878802 - DNA, 22 bp, Homo sapiens
cacccaggctggagagcagtgg

SEQ ID NO: 7878803 - DNA, 22 bp, Homo sapiens
cacccaggctggagagcagtgg

SEQ ID NO: 7878804 - DNA, 22 bp, Homo sapiens
cacccaggctggagagcagtgg

SEQ ID NO: 7878805 - DNA, 22 bp, Homo sapiens
cacccaggctggagagcagtgg

SEQ ID NO: 7878806 - DNA, 22 bp, Homo sapiens
cacccaggctggagtgcagggg

SEQ ID NO: 7878807 - DNA, 22 bp, Homo sapiens
cacccaggctggagagcagtgg

SEQ ID NO: 7878808 - DNA, 22 bp, Homo sapiens
cacccaggctggaatgcagtgg

SEQ ID NO: 7878809 - DNA, 22 bp, Homo sapiens
cacccaggctggaatgcagtgg

SEQ ID NO: 7878810 - DNA, 22 bp, Homo sapiens
caccaggttccgggcagagctg

SEQ ID NO: 7878811 - DNA, 22 bp, Homo sapiens
caccaggtggaaatgtcacagc

SEQ ID NO: 7878812 - DNA, 22 bp, Homo sapiens
caccaggtggaaatgtcacagc

SEQ ID NO: 7878813 - DNA, 22 bp, Homo sapiens
caccaggtggaaatgtcacagc

SEQ ID NO: 7878814 - DNA, 20 bp, Homo sapiens
agcaggtaaggcacagcagt

SEQ ID NO: 7878815 - DNA, 20 bp, Homo sapiens
agcaggtaaggcacagcagt

SEQ ID NO: 7878816 - DNA, 22 bp, Homo sapiens
agcagggtttggggattggcac

SEQ ID NO: 7878817 - DNA, 22 bp, Homo sapiens
cacccaggctggagtgcagggg

SEQ ID NO: 7878818 - DNA, 22 bp, Homo sapiens
cacccaggctggagtgcagtga

SEQ ID NO: 7878819 - DNA, 22 bp, Homo sapiens
cacccaggctggagtgcagtga

SEQ ID NO: 7878820 - DNA, 22 bp, Homo sapiens
cacccaggctggagtgcagggg

SEQ ID NO: 7878821 - DNA, 22 bp, Homo sapiens
cacccaggctggagtgcagggg

SEQ ID NO: 7878822 - DNA, 22 bp, Homo sapiens
cacccaggctggagtgcagggg

SEQ ID NO: 7878823 - DNA, 22 bp, Homo sapiens
cacccaggctggagtgcagtga

SEQ ID NO: 7878824 - DNA, 22 bp, Homo sapiens
cacccaggctggagtgcagtgg

SEQ ID NO: 7878825 - DNA, 22 bp, Homo sapiens
cacccaggctggagtgcagtgg

SEQ ID NO: 7878826 - DNA, 22 bp, Homo sapiens
cacccaggctggagtgcagtga

SEQ ID NO: 7878827 - DNA, 22 bp, Homo sapiens
cacccaggctggagtgcagtga

SEQ ID NO: 7878828 - DNA, 22 bp, Homo sapiens
agcagggtgtggtggccctgga

SEQ ID NO: 7878829 - DNA, 22 bp, Homo sapiens
agcagggtgtggtggccctgga

SEQ ID NO: 7878830 - DNA, 22 bp, Homo sapiens
agcagggtcctgaggtgagtca

SEQ ID NO: 7878831 - DNA, 22 bp, Homo sapiens
agcagggtcctgaggtgagtca

SEQ ID NO: 7878832 - DNA, 22 bp, Homo sapiens
agcagggtcctgaggtgagtca

SEQ ID NO: 7878833 - DNA, 22 bp, Homo sapiens
agcagggttccaggagttgcag

SEQ ID NO: 7878834 - DNA, 22 bp, Homo sapiens
agcagggttctcagttggtgct

SEQ ID NO: 7878835 - DNA, 22 bp, Homo sapiens
agcagggttctcagttggtgct

SEQ ID NO: 7878836 - DNA, 22 bp, Homo sapiens
agcagggttctcagttggtgct

SEQ ID NO: 7878837 - DNA, 22 bp, Homo sapiens
agcagggtttggggattggcac

SEQ ID NO: 7878838 - DNA, 22 bp, Homo sapiens
agcagggttctcagttggtgct

SEQ ID NO: 7878839 - DNA, 22 bp, Homo sapiens
agcagggtatgttagagctgta

SEQ ID NO: 7878840 - DNA, 22 bp, Homo sapiens
agcagggtatgttagagctgta

SEQ ID NO: 7878841 - DNA, 22 bp, Homo sapiens
agcaggggtggaaggtagcttt

SEQ ID NO: 7878842 - DNA, 22 bp, Homo sapiens
agcaggggtggaaggtagcttt

SEQ ID NO: 7878843 - DNA, 22 bp, Homo sapiens
agcaggggtggaaggtagcttt

SEQ ID NO: 7878844 - DNA, 22 bp, Homo sapiens
agcaggggtggaaggtagcttt

SEQ ID NO: 7878845 - DNA, 22 bp, Homo sapiens
agcaggggtggaaggtagcttt

SEQ ID NO: 7878846 - DNA, 22 bp, Homo sapiens
agcaggggtggaaggtagcttt

SEQ ID NO: 7878847 - DNA, 22 bp, Homo sapiens
agcaggggtggaaggtagcttt

SEQ ID NO: 7878848 - DNA, 22 bp, Homo sapiens
agcaggggtctctgctaatgaa

SEQ ID NO: 7878849 - DNA, 22 bp, Homo sapiens
agcaggggtctctgctaatgaa

SEQ ID NO: 7878850 - DNA, 22 bp, Homo sapiens
agcaggggtctctgctaatgaa

SEQ ID NO: 7878851 - DNA, 22 bp, Homo sapiens
agcaggggtctctgctaatgaa

SEQ ID NO: 7878852 - DNA, 22 bp, Homo sapiens
agcaggggtctctgctaatgaa

SEQ ID NO: 7878853 - DNA, 22 bp, Homo sapiens
agcaggggtggaaggtagcttt

SEQ ID NO: 7878854 - DNA, 22 bp, Homo sapiens
agcaggggctcctccacagcca

SEQ ID NO: 7878855 - DNA, 22 bp, Homo sapiens
agcaggggctcctccacagcca

SEQ ID NO: 7878856 - DNA, 22 bp, Homo sapiens
agcaggggcagggttttgtgct

SEQ ID NO: 7878857 - DNA, 22 bp, Homo sapiens
agcaggggctcctccacagcca

SEQ ID NO: 7878858 - DNA, 22 bp, Homo sapiens
agcaggggctcctccacagcca

SEQ ID NO: 7878859 - DNA, 22 bp, Homo sapiens
agcaggggctcctccacagcca

SEQ ID NO: 7878860 - DNA, 22 bp, Homo sapiens
agcaggggctcctccacagcca

SEQ ID NO: 7878861 - DNA, 22 bp, Homo sapiens
agcagggctttgtctctgtgaa

SEQ ID NO: 7878862 - DNA, 22 bp, Homo sapiens
agcagggctttgtctctgtgaa

SEQ ID NO: 7878863 - DNA, 22 bp, Homo sapiens
agcaggggcagggttttgtgct

SEQ ID NO: 7878864 - DNA, 22 bp, Homo sapiens
agcaggggcagggttttgtgct

SEQ ID NO: 7878865 - DNA, 22 bp, Homo sapiens
agcaggggcagggttttgtgct

SEQ ID NO: 7878866 - DNA, 22 bp, Homo sapiens
agcaggctgccttccaaagcct

SEQ ID NO: 7878867 - DNA, 23 bp, Homo sapiens
agcaggctgcttctccacagctg

SEQ ID NO: 7878868 - DNA, 23 bp, Homo sapiens
agcaggctgcttctccacagctg

SEQ ID NO: 7878869 - DNA, 23 bp, Homo sapiens
agcaggctgcttctccacagctg

SEQ ID NO: 7878870 - DNA, 22 bp, Homo sapiens
agcagggctttgtctctgtgaa

SEQ ID NO: 7878871 - DNA, 22 bp, Homo sapiens
agcagggctttgtctctgtgaa

SEQ ID NO: 7878872 - DNA, 22 bp, Homo sapiens
agcagggctttgtctctgtgaa

SEQ ID NO: 7878873 - DNA, 22 bp, Homo sapiens
agcagggctggggcacgagcca

SEQ ID NO: 7878874 - DNA, 22 bp, Homo sapiens
agcagggggcatccttgccctt

SEQ ID NO: 7878875 - DNA, 22 bp, Homo sapiens
agcagggggcatccttgccctt

SEQ ID NO: 7878876 - DNA, 22 bp, Homo sapiens
agcagggggagttagactagat

SEQ ID NO: 7878877 - DNA, 22 bp, Homo sapiens
agcagggggagttagactagat

SEQ ID NO: 7878878 - DNA, 22 bp, Homo sapiens
agcagggggcatccttgccctt

SEQ ID NO: 7878879 - DNA, 22 bp, Homo sapiens
agcagggggcatccttgccctt

SEQ ID NO: 7878880 - DNA, 22 bp, Homo sapiens
agcaggggctcctccacagcca

SEQ ID NO: 7878881 - DNA, 22 bp, Homo sapiens
agcagggggagttagactagat

SEQ ID NO: 7878882 - DNA, 22 bp, Homo sapiens
agcagggggagttagactagat

SEQ ID NO: 7878883 - DNA, 22 bp, Homo sapiens
agcagggggagttagactagat

SEQ ID NO: 7878884 - DNA, 22 bp, Homo sapiens
agcagggggagttagactagat

SEQ ID NO: 7878885 - DNA, 22 bp, Homo sapiens
agcagggggagttagactagat

SEQ ID NO: 7878886 - DNA, 22 bp, Homo sapiens
agcagggggagttagactagat

SEQ ID NO: 7878887 - DNA, 22 bp, Homo sapiens
agcagggggcatccttgccctt

SEQ ID NO: 7878888 - DNA, 22 bp, Homo sapiens
agcagggggccacagtcacagc

SEQ ID NO: 7878889 - DNA, 22 bp, Homo sapiens
agcagggggccacagtcacagc

SEQ ID NO: 7878890 - DNA, 22 bp, Homo sapiens
agcagggggccacagtcacagc

SEQ ID NO: 7878891 - DNA, 22 bp, Homo sapiens
agcagggggccacagtcacagc

SEQ ID NO: 7878892 - DNA, 22 bp, Homo sapiens
agcagggggccacagtcacagc

SEQ ID NO: 7878893 - DNA, 22 bp, Homo sapiens
agcaggggtaacagaaggaaag

SEQ ID NO: 7878894 - DNA, 22 bp, Homo sapiens
agcaggggtaacagaaggaaag

SEQ ID NO: 7878895 - DNA, 22 bp, Homo sapiens
agcaggggtaacagaaggaaag

SEQ ID NO: 7878896 - DNA, 22 bp, Homo sapiens
agcaggggtaacagaaggaaag

SEQ ID NO: 7878897 - DNA, 22 bp, Homo sapiens
cacagtttggtatagaagtgat

SEQ ID NO: 7878898 - DNA, 22 bp, Homo sapiens
cacagtttggtatagaagtgat

SEQ ID NO: 7878899 - DNA, 22 bp, Homo sapiens
cacagtttgggtctccggggca

SEQ ID NO: 7878900 - DNA, 22 bp, Homo sapiens
cacagtttgcataggaaaaaca

SEQ ID NO: 7878901 - DNA, 22 bp, Homo sapiens
cacagtttctgaacactttgca

SEQ ID NO: 7878902 - DNA, 22 bp, Homo sapiens
cacagtttgcataggaaaaaca

SEQ ID NO: 7878903 - DNA, 22 bp, Homo sapiens
cacagtttgcataggaaaaaca

SEQ ID NO: 7878904 - DNA, 22 bp, Homo sapiens
cacagtttctgaacactttgca

SEQ ID NO: 7878905 - DNA, 22 bp, Homo sapiens
cacagtttctgaacactttgca

SEQ ID NO: 7878906 - DNA, 22 bp, Homo sapiens
cacagtttctataggtcagaat

SEQ ID NO: 7878907 - DNA, 22 bp, Homo sapiens
cacagtttcaataattattctt

SEQ ID NO: 7878908 - DNA, 22 bp, Homo sapiens
cacagtttatgatctcagtgaa

SEQ ID NO: 7878909 - DNA, 22 bp, Homo sapiens
cacagttatgggaaacgtagtt

SEQ ID NO: 7878910 - DNA, 22 bp, Homo sapiens
cacagttgtctgatttcttcct

SEQ ID NO: 7878911 - DNA, 22 bp, Homo sapiens
cacagttcctgaatatatcaca

SEQ ID NO: 7878912 - DNA, 22 bp, Homo sapiens
cacagttcctgaatatatcaca

SEQ ID NO: 7878913 - DNA, 22 bp, Homo sapiens
cacagttgtttgttcataagaa

SEQ ID NO: 7878914 - DNA, 22 bp, Homo sapiens
cacagttgtttgttcataagaa

SEQ ID NO: 7878915 - DNA, 22 bp, Homo sapiens
agcaggctccaggctggccatc

SEQ ID NO: 7878916 - DNA, 22 bp, Homo sapiens
agcaggctccttccttctctgg

SEQ ID NO: 7878917 - DNA, 22 bp, Homo sapiens
agcaggctccttccttctctgg

SEQ ID NO: 7878918 - DNA, 22 bp, Homo sapiens
agcaggctccaggctggccatc

SEQ ID NO: 7878919 - DNA, 22 bp, Homo sapiens
agcaggctgagcacccaggggg

SEQ ID NO: 7878920 - DNA, 22 bp, Homo sapiens
agcaggctgagcacccaggggg

SEQ ID NO: 7878921 - DNA, 22 bp, Homo sapiens
agcaggctccttccttctctgg

SEQ ID NO: 7878922 - DNA, 22 bp, Homo sapiens
agcaggctccttccttctctgg

SEQ ID NO: 7878923 - DNA, 22 bp, Homo sapiens
agcaggctgatgggcatgcttg

SEQ ID NO: 7878924 - DNA, 17 bp, Homo sapiens
agcaggctgcagaggcc

SEQ ID NO: 7878925 - DNA, 22 bp, Homo sapiens
agcaggctgatgggcatgcttg

SEQ ID NO: 7878926 - DNA, 20 bp, Homo sapiens
agcaggctgcagggtgaaat

SEQ ID NO: 7878927 - DNA, 20 bp, Homo sapiens
agcaggctgcagggtgaaat

SEQ ID NO: 7878928 - DNA, 17 bp, Homo sapiens
agcaggctgcagaggcc

SEQ ID NO: 7878929 - DNA, 17 bp, Homo sapiens
agcaggctgcagaggcc

SEQ ID NO: 7878930 - DNA, 22 bp, Homo sapiens
agcaggcagccatttggaaggc

SEQ ID NO: 7878931 - DNA, 22 bp, Homo sapiens
agcaggcagccatttggaaggc

SEQ ID NO: 7878932 - DNA, 22 bp, Homo sapiens
agcaggcagccatttggaaggc

SEQ ID NO: 7878933 - DNA, 22 bp, Homo sapiens
agcaggcagcatgggaccctcc

SEQ ID NO: 7878934 - DNA, 22 bp, Homo sapiens
agcaggcagcatgggaccctcc

SEQ ID NO: 7878935 - DNA, 22 bp, Homo sapiens
agcaggcacttcatagggttcc

SEQ ID NO: 7878936 - DNA, 22 bp, Homo sapiens
agcaggcacttcatagggttcc

SEQ ID NO: 7878937 - DNA, 22 bp, Homo sapiens
agcaggcagcatgggaccctcc

SEQ ID NO: 7878938 - DNA, 22 bp, Homo sapiens
agcaggcactatgccaggatct

SEQ ID NO: 7878939 - DNA, 17 bp, Homo sapiens
agcaggcacgtcagcac

SEQ ID NO: 7878940 - DNA, 22 bp, Homo sapiens
agcaggcactatgccaggatct

SEQ ID NO: 7878941 - DNA, 22 bp, Homo sapiens
agcaggcactatgccaggatct

SEQ ID NO: 7878942 - DNA, 22 bp, Homo sapiens
agcaggcactatgccaggatct

SEQ ID NO: 7878943 - DNA, 22 bp, Homo sapiens
agcaggcactatgccaggatct

SEQ ID NO: 7878944 - DNA, 22 bp, Homo sapiens
agcaggcactatgccaggatct

SEQ ID NO: 7878945 - DNA, 22 bp, Homo sapiens
agcaggcactatgccaggatct

SEQ ID NO: 7878946 - DNA, 22 bp, Homo sapiens
agcaggcactatgccaggatct

SEQ ID NO: 7878947 - DNA, 22 bp, Homo sapiens
agcaggcacgctccctgcgcga

SEQ ID NO: 7878948 - DNA, 22 bp, Homo sapiens
agcaggcagcctaggaagtgaa

SEQ ID NO: 7878949 - DNA, 22 bp, Homo sapiens
agcaggcagcctaggaagtgaa

SEQ ID NO: 7878950 - DNA, 22 bp, Homo sapiens
agcaggcagcctaggaagtgaa

SEQ ID NO: 7878951 - DNA, 22 bp, Homo sapiens
agcaggcagcctaggaagtgaa

SEQ ID NO: 7878952 - DNA, 22 bp, Homo sapiens
agcaggcagcctaggaagtgaa

SEQ ID NO: 7878953 - DNA, 22 bp, Homo sapiens
agcaggcagccatttggaaggc

SEQ ID NO: 7878954 - DNA, 22 bp, Homo sapiens
agcaggcagctgggggagttga

SEQ ID NO: 7878955 - DNA, 22 bp, Homo sapiens
agcaggcagcctaggaagtgaa

SEQ ID NO: 7878956 - DNA, 22 bp, Homo sapiens
agcaggcaggaaggcagcactg

SEQ ID NO: 7878957 - DNA, 22 bp, Homo sapiens
agcaggcaggaaggcagcactg

SEQ ID NO: 7878958 - DNA, 22 bp, Homo sapiens
agcaggcaggaaggcagcactg

SEQ ID NO: 7878959 - DNA, 22 bp, Homo sapiens
agcaggcagctgggggagttga

SEQ ID NO: 7878960 - DNA, 22 bp, Homo sapiens
agcaggcagctgggggagttga

SEQ ID NO: 7878961 - DNA, 22 bp, Homo sapiens
agcaggcagctgggggagttga

SEQ ID NO: 7878962 - DNA, 22 bp, Homo sapiens
agcaggcagctgggggagttga

SEQ ID NO: 7878963 - DNA, 22 bp, Homo sapiens
agcaggcaggaaggcagcactg

SEQ ID NO: 7878964 - DNA, 22 bp, Homo sapiens
agcaggcaggaatggtggaaca

SEQ ID NO: 7878965 - DNA, 22 bp, Homo sapiens
agcaggcaggaatggtggaaca

SEQ ID NO: 7878966 - DNA, 22 bp, Homo sapiens
agcaggcaggaatggtggaaca

SEQ ID NO: 7878967 - DNA, 22 bp, Homo sapiens
agcaggcaggaatggtggaaca

SEQ ID NO: 7878968 - DNA, 22 bp, Homo sapiens
agcaggcaggaaggcagcactg

SEQ ID NO: 7878969 - DNA, 22 bp, Homo sapiens
agcaggcaggaaggcagcactg

SEQ ID NO: 7878970 - DNA, 22 bp, Homo sapiens
agcaggcaggaaggcagcactg

SEQ ID NO: 7878971 - DNA, 22 bp, Homo sapiens
agcaggcaggaaggcagcactg

SEQ ID NO: 7878972 - DNA, 22 bp, Homo sapiens
agcaggcaggaaggcagcactg

SEQ ID NO: 7878973 - DNA, 22 bp, Homo sapiens
agcaggcaggaaggcagcactg

SEQ ID NO: 7878974 - DNA, 22 bp, Homo sapiens
cacagtcctacagagatcagag

SEQ ID NO: 7878975 - DNA, 22 bp, Homo sapiens
cacagtcccgtgcttaccatgt

SEQ ID NO: 7878976 - DNA, 22 bp, Homo sapiens
agcaggcaggcccagcggctgg

SEQ ID NO: 7878977 - DNA, 22 bp, Homo sapiens
agcaggcaggaggctactaagg

SEQ ID NO: 7878978 - DNA, 22 bp, Homo sapiens
agcaggcaggaggctactaagg

SEQ ID NO: 7878979 - DNA, 22 bp, Homo sapiens
agcaggcaggaggctactaagg

SEQ ID NO: 7878980 - DNA, 22 bp, Homo sapiens
cacagtgtttgatttaggggcc

SEQ ID NO: 7878981 - DNA, 22 bp, Homo sapiens
cacagtgttccagagcagtggt

SEQ ID NO: 7878982 - DNA, 22 bp, Homo sapiens
cacagtgttccagagcagtggt

SEQ ID NO: 7878983 - DNA, 22 bp, Homo sapiens
cacagtcctacagagatcagag

SEQ ID NO: 7878984 - DNA, 22 bp, Homo sapiens
cacagtgttccagagcagtggt

SEQ ID NO: 7878985 - DNA, 22 bp, Homo sapiens
cacagtcctgccagagggcctt

SEQ ID NO: 7878986 - DNA, 22 bp, Homo sapiens
cacagttatatgttcacaagga

SEQ ID NO: 7878987 - DNA, 22 bp, Homo sapiens
cacagttagaggtagagtccag

SEQ ID NO: 7878988 - DNA, 22 bp, Homo sapiens
agcagctgccactggaatagga

SEQ ID NO: 7878989 - DNA, 22 bp, Homo sapiens
agcagctgccactggaatagga

SEQ ID NO: 7878990 - DNA, 22 bp, Homo sapiens
agcagctgccactggaatagga

SEQ ID NO: 7878991 - DNA, 22 bp, Homo sapiens
agcagctgccactggaatagga

SEQ ID NO: 7878992 - DNA, 22 bp, Homo sapiens
agcagctgccactggaatagga

SEQ ID NO: 7878993 - DNA, 21 bp, Homo sapiens
agcagctgcagtttctatctg

SEQ ID NO: 7878994 - DNA, 21 bp, Homo sapiens
agcagctgcagtttctatctg

SEQ ID NO: 7878995 - DNA, 21 bp, Homo sapiens
agcagctgcagtttctatctg

SEQ ID NO: 7878996 - DNA, 21 bp, Homo sapiens
agcagctgcagtttctatctg

SEQ ID NO: 7878997 - DNA, 21 bp, Homo sapiens
agcagctgcagtttctatctg

SEQ ID NO: 7878998 - DNA, 22 bp, Homo sapiens
agcagctgccagagagagttcc

SEQ ID NO: 7878999 - DNA, 22 bp, Homo sapiens
agcagctgccagagagagttcc

SEQ ID NO: 7879000 - DNA, 22 bp, Homo sapiens
agcagctgccagagagagttcc

SEQ ID NO: 7879001 - DNA, 22 bp, Homo sapiens
agcagctgccactggaatagga

SEQ ID NO: 7879002 - DNA, 22 bp, Homo sapiens
agcagctgccactggaatagga

SEQ ID NO: 7879003 - DNA, 22 bp, Homo sapiens
agcagctgccactggaatagga

SEQ ID NO: 7879004 - DNA, 22 bp, Homo sapiens
agcagctgccagagagagttcc

SEQ ID NO: 7879005 - DNA, 22 bp, Homo sapiens
agcagctgccagagagagttcc

SEQ ID NO: 7879006 - DNA, 22 bp, Homo sapiens
agcagctgccagagagagttcc

SEQ ID NO: 7879007 - DNA, 22 bp, Homo sapiens
agcagctgccagagagagttcc

SEQ ID NO: 7879008 - DNA, 22 bp, Homo sapiens
agcagctgccagagagagttcc

SEQ ID NO: 7879009 - DNA, 22 bp, Homo sapiens
cacaattttcctttaagtgtat

SEQ ID NO: 7879010 - DNA, 22 bp, Homo sapiens
cacaatttttcttaggtcctgg

SEQ ID NO: 7879011 - DNA, 22 bp, Homo sapiens
agcagctgctccacttgcttaa

SEQ ID NO: 7879012 - DNA, 22 bp, Homo sapiens
agcagctgctccacttgcttaa

SEQ ID NO: 7879013 - DNA, 22 bp, Homo sapiens
agcagctgctccacttgcttaa

SEQ ID NO: 7879014 - DNA, 22 bp, Homo sapiens
agcagctgctccacttgcttaa

SEQ ID NO: 7879015 - DNA, 22 bp, Homo sapiens
agcagctgctccacttgcttaa

SEQ ID NO: 7879016 - DNA, 22 bp, Homo sapiens
cacacaaatattctggaggcaa

SEQ ID NO: 7879017 - DNA, 22 bp, Homo sapiens
cacacaattatgtgtgcacaat

SEQ ID NO: 7879018 - DNA, 22 bp, Homo sapiens
cacacaaatattctggaggcaa

SEQ ID NO: 7879019 - DNA, 22 bp, Homo sapiens
cacacaaatattctggaggcaa

SEQ ID NO: 7879020 - DNA, 22 bp, Homo sapiens
cacacacagttttgtattctgt

SEQ ID NO: 7879021 - DNA, 22 bp, Homo sapiens
cacacacagttttgtattctgt

SEQ ID NO: 7879022 - DNA, 22 bp, Homo sapiens
cacacacagttttgtattctgt

SEQ ID NO: 7879023 - DNA, 22 bp, Homo sapiens
cacacaattatgtgtgcacaat

SEQ ID NO: 7879024 - DNA, 22 bp, Homo sapiens
cacacaattatgtgtgcacaat

SEQ ID NO: 7879025 - DNA, 22 bp, Homo sapiens
agcagctgatcaaagcacttat

SEQ ID NO: 7879026 - DNA, 22 bp, Homo sapiens
agcagctgatcaaagcacttat

SEQ ID NO: 7879027 - DNA, 22 bp, Homo sapiens
agcagctgatcaaagcacttat

SEQ ID NO: 7879028 - DNA, 22 bp, Homo sapiens
agcagctgagccccagctgtga

SEQ ID NO: 7879029 - DNA, 22 bp, Homo sapiens
agcagctgatggggaaggagtt

SEQ ID NO: 7879030 - DNA, 22 bp, Homo sapiens
agcagctgatggggaaggagtt

SEQ ID NO: 7879031 - DNA, 22 bp, Homo sapiens
agcagctgatcaaagcacttat

SEQ ID NO: 7879032 - DNA, 22 bp, Homo sapiens
agcagctgatcaaagcacttat

SEQ ID NO: 7879033 - DNA, 22 bp, Homo sapiens
agcagctgatcaaagcacttat

SEQ ID NO: 7879034 - DNA, 22 bp, Homo sapiens
agcagctgatggggaaggagtt

SEQ ID NO: 7879035 - DNA, 22 bp, Homo sapiens
agcagctgatggggaaggagtt

SEQ ID NO: 7879036 - DNA, 22 bp, Homo sapiens
agcagctgatggggaaggagtt

SEQ ID NO: 7879037 - DNA, 22 bp, Homo sapiens
agcagctgatggggaaggagtt

SEQ ID NO: 7879038 - DNA, 22 bp, Homo sapiens
agcagctgatggggaaggagtt

SEQ ID NO: 7879039 - DNA, 22 bp, Homo sapiens
agcagctgatggggaaggagtt

SEQ ID NO: 7879040 - DNA, 22 bp, Homo sapiens
agcagctgatggggaaggagtt

SEQ ID NO: 7879041 - DNA, 22 bp, Homo sapiens
agcagctgatggggaaggagtt

SEQ ID NO: 7879042 - DNA, 22 bp, Homo sapiens
agcagctgcagggagggtctgc

SEQ ID NO: 7879043 - DNA, 22 bp, Homo sapiens
agcagctgcagggagggtctgc

SEQ ID NO: 7879044 - DNA, 21 bp, Homo sapiens
agcagctgcagtttctatctg

SEQ ID NO: 7879045 - DNA, 22 bp, Homo sapiens
agcagctgcagggagggtctgc

SEQ ID NO: 7879046 - DNA, 22 bp, Homo sapiens
agcagctgcagggagggtctgc

SEQ ID NO: 7879047 - DNA, 22 bp, Homo sapiens
agcagctgcagggagggtctgc

SEQ ID NO: 7879048 - DNA, 22 bp, Homo sapiens
agcagctgcagggagggtctgc

SEQ ID NO: 7879049 - DNA, 22 bp, Homo sapiens
agcagctgcagggagggtctgc

SEQ ID NO: 7879050 - DNA, 22 bp, Homo sapiens
agcagctgcagagggctccccc

SEQ ID NO: 7879051 - DNA, 22 bp, Homo sapiens
agcagctgcagagggctccccc

SEQ ID NO: 7879052 - DNA, 22 bp, Homo sapiens
agcagctgcagagggctccccc

SEQ ID NO: 7879053 - DNA, 22 bp, Homo sapiens
agcagctgcagggagggtctgc

SEQ ID NO: 7879054 - DNA, 22 bp, Homo sapiens
agcagctgcagggagggtctgc

SEQ ID NO: 7879055 - DNA, 22 bp, Homo sapiens
agcagctgcagagggctccccc

SEQ ID NO: 7879056 - DNA, 22 bp, Homo sapiens
agcagctgcagagggctccccc

SEQ ID NO: 7879057 - DNA, 22 bp, Homo sapiens
agcagctgcagagggctccccc

SEQ ID NO: 7879058 - DNA, 22 bp, Homo sapiens
agcagctgatggggaaggagtt

SEQ ID NO: 7879059 - DNA, 22 bp, Homo sapiens
agcagctgcagagggctccccc

SEQ ID NO: 7879060 - DNA, 22 bp, Homo sapiens
agcagctgcagagggctccccc

SEQ ID NO: 7879061 - DNA, 22 bp, Homo sapiens
agcaggagtttgatgcttttat

SEQ ID NO: 7879062 - DNA, 23 bp, Homo sapiens
agcaggataattttattatgccc

SEQ ID NO: 7879063 - DNA, 22 bp, Homo sapiens
agcaggagtttgatgcttttat

SEQ ID NO: 7879064 - DNA, 22 bp, Homo sapiens
agcaggagtttgatgcttttat

SEQ ID NO: 7879065 - DNA, 21 bp, Homo sapiens
agcaggcaaaggtgaagtctt

SEQ ID NO: 7879066 - DNA, 21 bp, Homo sapiens
agcaggcaaaggtgaagtctt

SEQ ID NO: 7879067 - DNA, 22 bp, Homo sapiens
agcaggattttgaagtgcaagt

SEQ ID NO: 7879068 - DNA, 22 bp, Homo sapiens
agcaggcaagcgtgagttctct

SEQ ID NO: 7879069 - DNA, 21 bp, Homo sapiens
agcaggcaaaggtgaagtctt

SEQ ID NO: 7879070 - DNA, 22 bp, Homo sapiens
agcaggcaaggtccgtgcctcg

SEQ ID NO: 7879071 - DNA, 22 bp, Homo sapiens
agcaggcaagcgtgagttctct

SEQ ID NO: 7879072 - DNA, 22 bp, Homo sapiens
agcaggcaaggtccgtgcctcg

SEQ ID NO: 7879073 - DNA, 22 bp, Homo sapiens
agcaggcaaggtccgtgcctcg

SEQ ID NO: 7879074 - DNA, 17 bp, Homo sapiens
agcaggcacgtcagcac

SEQ ID NO: 7879075 - DNA, 17 bp, Homo sapiens
agcaggcacgtcagcac

SEQ ID NO: 7879076 - DNA, 22 bp, Homo sapiens
agcaggcacgctccctgcgcga

SEQ ID NO: 7879077 - DNA, 22 bp, Homo sapiens
agcaggcacgctccctgcgcga

SEQ ID NO: 7879078 - DNA, 22 bp, Homo sapiens
agcaggcacgctccctgcgcga

SEQ ID NO: 7879079 - DNA, 22 bp, Homo sapiens
agcaggcaccagggctcgtcct

SEQ ID NO: 7879080 - DNA, 22 bp, Homo sapiens
agcaggcacaagaaagggaggt

SEQ ID NO: 7879081 - DNA, 22 bp, Homo sapiens
agcaggcacaagaaagggaggt

SEQ ID NO: 7879082 - DNA, 22 bp, Homo sapiens
agcaggcacaagaaagggaggt

SEQ ID NO: 7879083 - DNA, 22 bp, Homo sapiens
agcaggcacaagaaagggaggt

SEQ ID NO: 7879084 - DNA, 22 bp, Homo sapiens
agcaggcaccagggctcgtcct

SEQ ID NO: 7879085 - DNA, 22 bp, Homo sapiens
agcaggcaccagggctcgtcct

SEQ ID NO: 7879086 - DNA, 22 bp, Homo sapiens
agcaggcaccagggctcgtcct

SEQ ID NO: 7879087 - DNA, 22 bp, Homo sapiens
agcaggcacaagaaagggaggt

SEQ ID NO: 7879088 - DNA, 22 bp, Homo sapiens
cacacactggagcaaggagatg

SEQ ID NO: 7879089 - DNA, 22 bp, Homo sapiens
cacacactggagcaaggagatg

SEQ ID NO: 7879090 - DNA, 22 bp, Homo sapiens
cacacactgttaatgtaggagt

SEQ ID NO: 7879091 - DNA, 22 bp, Homo sapiens
cacacactgttaatgtaggagt

SEQ ID NO: 7879092 - DNA, 22 bp, Homo sapiens
agcaggagcatttccatgattc

SEQ ID NO: 7879093 - DNA, 22 bp, Homo sapiens
agcaggagcatttccatgattc

SEQ ID NO: 7879094 - DNA, 22 bp, Homo sapiens
agcaggagcatttccatgattc

SEQ ID NO: 7879095 - DNA, 22 bp, Homo sapiens
agcaggagcccttatcaccagg

SEQ ID NO: 7879096 - DNA, 22 bp, Homo sapiens
agcaggagcatttccatgattc

SEQ ID NO: 7879097 - DNA, 22 bp, Homo sapiens
agcaggagcccttatcaccagg

SEQ ID NO: 7879098 - DNA, 22 bp, Homo sapiens
agcaggagtttgatgcttttat

SEQ ID NO: 7879099 - DNA, 22 bp, Homo sapiens
agcaggagtgtcccctggctgt

SEQ ID NO: 7879100 - DNA, 22 bp, Homo sapiens
agcaggagtgtcccctggctgt

SEQ ID NO: 7879101 - DNA, 22 bp, Homo sapiens
agcaggagtgtcccctggctgt

SEQ ID NO: 7879102 - DNA, 22 bp, Homo sapiens
agcaggagtgtcccctggctgt

SEQ ID NO: 7879103 - DNA, 22 bp, Homo sapiens
cacacactgacaccttatcttg

SEQ ID NO: 7879104 - DNA, 22 bp, Homo sapiens
cacacactgacaccttatcttg

SEQ ID NO: 7879105 - DNA, 22 bp, Homo sapiens
cacacactggagcaaggagatg

SEQ ID NO: 7879106 - DNA, 22 bp, Homo sapiens
cacacactggagcaaggagatg

SEQ ID NO: 7879107 - DNA, 22 bp, Homo sapiens
cacacactgacaccttatcttg

SEQ ID NO: 7879108 - DNA, 22 bp, Homo sapiens
cacacactcttcctggcaccta

SEQ ID NO: 7879109 - DNA, 22 bp, Homo sapiens
cacacaccaatcaaatgtcaga

SEQ ID NO: 7879110 - DNA, 22 bp, Homo sapiens
cacacacagttttgtattctgt

SEQ ID NO: 7879111 - DNA, 22 bp, Homo sapiens
cacacacagttttgtattctgt

SEQ ID NO: 7879112 - DNA, 22 bp, Homo sapiens
agcacagcttcaccgagcccat

SEQ ID NO: 7879113 - DNA, 22 bp, Homo sapiens
agcacagcttagcacctggcac

SEQ ID NO: 7879114 - DNA, 22 bp, Homo sapiens
agcacagcttcaccgagcccat

SEQ ID NO: 7879115 - DNA, 20 bp, Homo sapiens
agcaaagcctttagagtttg

SEQ ID NO: 7879116 - DNA, 22 bp, Homo sapiens
agcaaagccgagacagccagtg

SEQ ID NO: 7879117 - DNA, 20 bp, Homo sapiens
agcaaagcctttagagtttg

SEQ ID NO: 7879118 - DNA, 22 bp, Homo sapiens
agcaaagctaccaattattgag

SEQ ID NO: 7879119 - DNA, 22 bp, Homo sapiens
agcaaagctaccaattattgag

SEQ ID NO: 7879120 - DNA, 21 bp, Homo sapiens
agcacagctttaagccatgtg

SEQ ID NO: 7879121 - DNA, 21 bp, Homo sapiens
agcacagctttaagccatgtg

SEQ ID NO: 7879122 - DNA, 21 bp, Homo sapiens
agcacagctttaagccatgtg

SEQ ID NO: 7879123 - DNA, 21 bp, Homo sapiens
agcacagctttaagccatgtg

SEQ ID NO: 7879124 - DNA, 22 bp, Homo sapiens
agcacaggtgaaacagtcaggt

SEQ ID NO: 7879125 - DNA, 22 bp, Homo sapiens
agcacaggtacggagatgctac

SEQ ID NO: 7879126 - DNA, 22 bp, Homo sapiens
agcacaggtacggagatgctac

SEQ ID NO: 7879127 - DNA, 22 bp, Homo sapiens
agcaaagcagtggctaagctga

SEQ ID NO: 7879128 - DNA, 22 bp, Homo sapiens
agcaaagcagtggctaagctga

SEQ ID NO: 7879129 - DNA, 22 bp, Homo sapiens
agcaaagcagtggctaagctga

SEQ ID NO: 7879130 - DNA, 22 bp, Homo sapiens
agcaaagcactttgcatacata

SEQ ID NO: 7879131 - DNA, 22 bp, Homo sapiens
agcaaagcactttgcatacata

SEQ ID NO: 7879132 - DNA, 22 bp, Homo sapiens
agcaaagcactttgcatacata

SEQ ID NO: 7879133 - DNA, 22 bp, Homo sapiens
agcaaagcagtggctaagctga

SEQ ID NO: 7879134 - DNA, 22 bp, Homo sapiens
agcaaagcatcactccaatctg

SEQ ID NO: 7879135 - DNA, 22 bp, Homo sapiens
agcaaagccgagacagccagtg

SEQ ID NO: 7879136 - DNA, 22 bp, Homo sapiens
agcaaagcaccatatggcagtt

SEQ ID NO: 7879137 - DNA, 18 bp, Homo sapiens
agcaaagcaagagatcac

SEQ ID NO: 7879138 - DNA, 22 bp, Homo sapiens
agcaaagcactttgcatacata

SEQ ID NO: 7879139 - DNA, 22 bp, Homo sapiens
agcaaagatgtccggggcaagc

SEQ ID NO: 7879140 - DNA, 22 bp, Homo sapiens
agcaaagatgtccggggcaagc

SEQ ID NO: 7879141 - DNA, 22 bp, Homo sapiens
agcaaagatgtccggggcaagc

SEQ ID NO: 7879142 - DNA, 18 bp, Homo sapiens
agcaaagcaagagatcac

SEQ ID NO: 7879143 - DNA, 22 bp, Homo sapiens
agcaaagagtaattttgttttg

SEQ ID NO: 7879144 - DNA, 22 bp, Homo sapiens
agcaaagaaatggaggctcaga

SEQ ID NO: 7879145 - DNA, 22 bp, Homo sapiens
agcaaagaaatggaggctcaga

SEQ ID NO: 7879146 - DNA, 20 bp, Homo sapiens
agcaaactcttcccatcttc

SEQ ID NO: 7879147 - DNA, 22 bp, Homo sapiens
agcaaagaaatggaggctcaga

SEQ ID NO: 7879148 - DNA, 22 bp, Homo sapiens
agcaaagaagacacaggcttca

SEQ ID NO: 7879149 - DNA, 22 bp, Homo sapiens
agcaaagaagacacaggcttca

SEQ ID NO: 7879150 - DNA, 22 bp, Homo sapiens
agcaaagaagacacaggcttca

SEQ ID NO: 7879151 - DNA, 22 bp, Homo sapiens
agcaaagaaatggaggctcaga

SEQ ID NO: 7879152 - DNA, 22 bp, Homo sapiens
agcaaagaagggttcttcatta

SEQ ID NO: 7879153 - DNA, 22 bp, Homo sapiens
agcaaagaagggttcttcatta

SEQ ID NO: 7879154 - DNA, 22 bp, Homo sapiens
agcaaagaagggttcttcatta

SEQ ID NO: 7879155 - DNA, 22 bp, Homo sapiens
agcaaagaagggttcttcatta

SEQ ID NO: 7879156 - DNA, 22 bp, Homo sapiens
agcaaagaagggttcttcatta

SEQ ID NO: 7879157 - DNA, 22 bp, Homo sapiens
agcaaagacagggacgaccaag

SEQ ID NO: 7879158 - DNA, 22 bp, Homo sapiens
agcaaagacagggacgaccaag

SEQ ID NO: 7879159 - DNA, 22 bp, Homo sapiens
agcaaagagtaattttgttttg

SEQ ID NO: 7879160 - DNA, 22 bp, Homo sapiens
agcaaagacagggacgaccaag

SEQ ID NO: 7879161 - DNA, 22 bp, Homo sapiens
caaaagtcttcctattctctta

SEQ ID NO: 7879162 - DNA, 22 bp, Homo sapiens
caaaagtcttcctattctctta

SEQ ID NO: 7879163 - DNA, 23 bp, Homo sapiens
caaaagttagcccttcccatctc

SEQ ID NO: 7879164 - DNA, 22 bp, Homo sapiens
caaaagttattgcggtttttgc

SEQ ID NO: 7879165 - DNA, 22 bp, Homo sapiens
caaaagtctgtcctttaacttc

SEQ ID NO: 7879166 - DNA, 22 bp, Homo sapiens
caaaagtcttcctattctctta

SEQ ID NO: 7879167 - DNA, 22 bp, Homo sapiens
caaaataccacgacttgtttta

SEQ ID NO: 7879168 - DNA, 22 bp, Homo sapiens
caaaataccacgacttgtttta

SEQ ID NO: 7879169 - DNA, 22 bp, Homo sapiens
caaaataccacgacttgtttta

SEQ ID NO: 7879170 - DNA, 22 bp, Homo sapiens
caaaagttctcacccagacatg

SEQ ID NO: 7879171 - DNA, 22 bp, Homo sapiens
agcaaactaattgcagttctgg

SEQ ID NO: 7879172 - DNA, 22 bp, Homo sapiens
agcaaactaattgcagttctgg

SEQ ID NO: 7879173 - DNA, 22 bp, Homo sapiens
agcaaactaattgcagttctgg

SEQ ID NO: 7879174 - DNA, 22 bp, Homo sapiens
agcaaactaattgcagttctgg

SEQ ID NO: 7879175 - DNA, 22 bp, Homo sapiens
caaatagattgttcaatcctga

SEQ ID NO: 7879176 - DNA, 22 bp, Homo sapiens
caaatagattgttcaatcctga

SEQ ID NO: 7879177 - DNA, 22 bp, Homo sapiens
caaatagattgttcaatcctga

SEQ ID NO: 7879178 - DNA, 22 bp, Homo sapiens
caaatagattgttcaatcctga

SEQ ID NO: 7879179 - DNA, 22 bp, Homo sapiens
caaatagattgttcaatcctga

SEQ ID NO: 7879180 - DNA, 18 bp, Homo sapiens
caaatagcatgatgtcct

SEQ ID NO: 7879181 - DNA, 22 bp, Homo sapiens
caaatagattgttcaatcctga

SEQ ID NO: 7879182 - DNA, 22 bp, Homo sapiens
caaatagattgttcaatcctga

SEQ ID NO: 7879183 - DNA, 22 bp, Homo sapiens
caaatagtatgagcaatgattc

SEQ ID NO: 7879184 - DNA, 22 bp, Homo sapiens
caaatagtatgagcaatgattc

SEQ ID NO: 7879185 - DNA, 22 bp, Homo sapiens
caaatagtgaaacagatggggg

SEQ ID NO: 7879186 - DNA, 22 bp, Homo sapiens
caaatagtgaaacagatggggg

SEQ ID NO: 7879187 - DNA, 22 bp, Homo sapiens
caaatagtatgagcaatgattc

SEQ ID NO: 7879188 - DNA, 22 bp, Homo sapiens
caaatagtatgagcaatgattc

SEQ ID NO: 7879189 - DNA, 22 bp, Homo sapiens
caaatagtatgagcaatgattc

SEQ ID NO: 7879190 - DNA, 18 bp, Homo sapiens
caaatagcatgatgtcct

SEQ ID NO: 7879191 - DNA, 22 bp, Homo sapiens
caaatagacttcaatctcttga

SEQ ID NO: 7879192 - DNA, 22 bp, Homo sapiens
caaatagacttcaatctcttga

SEQ ID NO: 7879193 - DNA, 22 bp, Homo sapiens
caaatagacttcaatctcttga

SEQ ID NO: 7879194 - DNA, 22 bp, Homo sapiens
agcacatgtattctccttgaat

SEQ ID NO: 7879195 - DNA, 22 bp, Homo sapiens
agcacatgcacagtgctacact

SEQ ID NO: 7879196 - DNA, 22 bp, Homo sapiens
agcacatgcacagtgctacact

SEQ ID NO: 7879197 - DNA, 22 bp, Homo sapiens
agcacatgcacagtgctacact

SEQ ID NO: 7879198 - DNA, 22 bp, Homo sapiens
agcacatgcacagtgctacact

SEQ ID NO: 7879199 - DNA, 22 bp, Homo sapiens
agcacatgacttttagtcgagt

SEQ ID NO: 7879200 - DNA, 23 bp, Homo sapiens
agcacatcaaagcagggaggaga

SEQ ID NO: 7879201 - DNA, 23 bp, Homo sapiens
agcacatcaaagcagggaggaga

SEQ ID NO: 7879202 - DNA, 22 bp, Homo sapiens
agcacatattcagttcatacaa

SEQ ID NO: 7879203 - DNA, 22 bp, Homo sapiens
agcacataccagaaccacaggt

SEQ ID NO: 7879204 - DNA, 22 bp, Homo sapiens
agcacatattcagttcatacaa

SEQ ID NO: 7879205 - DNA, 22 bp, Homo sapiens
agcacagttttcattgcagggt

SEQ ID NO: 7879206 - DNA, 22 bp, Homo sapiens
agcacagttttcattgcagggt

SEQ ID NO: 7879207 - DNA, 22 bp, Homo sapiens
agcacagttttcattgcagggt

SEQ ID NO: 7879208 - DNA, 22 bp, Homo sapiens
agcacataccagaaccacaggt

SEQ ID NO: 7879209 - DNA, 22 bp, Homo sapiens
agcacataccagaaccacaggt

SEQ ID NO: 7879210 - DNA, 22 bp, Homo sapiens
agcacagttggtaaaattgtta

SEQ ID NO: 7879211 - DNA, 22 bp, Homo sapiens
agcacagttctttctctagctg

SEQ ID NO: 7879212 - DNA, 22 bp, Homo sapiens
agcacagttctttctctagctg

SEQ ID NO: 7879213 - DNA, 22 bp, Homo sapiens
agcacagtgctctggacagagt

SEQ ID NO: 7879214 - DNA, 22 bp, Homo sapiens
agcacagtgctctggacagagt

SEQ ID NO: 7879215 - DNA, 22 bp, Homo sapiens
agcacagtaaagcagtgtcaca

SEQ ID NO: 7879216 - DNA, 22 bp, Homo sapiens
agcacaggtgaaacagtcaggt

SEQ ID NO: 7879217 - DNA, 22 bp, Homo sapiens
agcacagtaaagcagtgtcaca

SEQ ID NO: 7879218 - DNA, 22 bp, Homo sapiens
agcacagtaaagcagtgtcaca

SEQ ID NO: 7879219 - DNA, 22 bp, Homo sapiens
agcacagtgcctgacatatatg

SEQ ID NO: 7879220 - DNA, 22 bp, Homo sapiens
agcacagtaattgatattactg

SEQ ID NO: 7879221 - DNA, 22 bp, Homo sapiens
agcacagtaattgatattactg

SEQ ID NO: 7879222 - DNA, 22 bp, Homo sapiens
agcacaggtgaaacagtcaggt

SEQ ID NO: 7879223 - DNA, 22 bp, Homo sapiens
agcacaggtgaaacagtcaggt

SEQ ID NO: 7879224 - DNA, 22 bp, Homo sapiens
agcacaggtgaaacagtcaggt

SEQ ID NO: 7879225 - DNA, 22 bp, Homo sapiens
agcacaggtgaaacagtcaggt

SEQ ID NO: 7879226 - DNA, 22 bp, Homo sapiens
agcacaggtgaaacagtcaggt

SEQ ID NO: 7879227 - DNA, 22 bp, Homo sapiens
agcacaggtgaaacagtcaggt

SEQ ID NO: 7879228 - DNA, 22 bp, Homo sapiens
agcacaggtgaaacagtcaggt

SEQ ID NO: 7879229 - DNA, 22 bp, Homo sapiens
agcacaggtgaaacagtcaggt

SEQ ID NO: 7879230 - DNA, 22 bp, Homo sapiens
agcacaggtgaaacagtcaggt

SEQ ID NO: 7879231 - DNA, 22 bp, Homo sapiens
agcacaggtgaaacagtcaggt

SEQ ID NO: 7879232 - DNA, 22 bp, Homo sapiens
caagacaatgggtaagtgtaac

SEQ ID NO: 7879233 - DNA, 22 bp, Homo sapiens
caactttaatttgggtgtcaga

SEQ ID NO: 7879234 - DNA, 22 bp, Homo sapiens
caactttaaatggctatgtctg

SEQ ID NO: 7879235 - DNA, 22 bp, Homo sapiens
caacttggctctctggctatcc

SEQ ID NO: 7879236 - DNA, 22 bp, Homo sapiens
caacttggctctctggctatcc

SEQ ID NO: 7879237 - DNA, 22 bp, Homo sapiens
caacttgttcttggtagatcta

SEQ ID NO: 7879238 - DNA, 22 bp, Homo sapiens
agcaccaggctgttggaagccc

SEQ ID NO: 7879239 - DNA, 22 bp, Homo sapiens
agcaccaggccatggggtccct

SEQ ID NO: 7879240 - DNA, 22 bp, Homo sapiens
agcaccaggccatggggtccct

SEQ ID NO: 7879241 - DNA, 22 bp, Homo sapiens
agcaccaggctgttggaagccc

SEQ ID NO: 7879242 - DNA, 22 bp, Homo sapiens
caagacattgattttgtacaga

SEQ ID NO: 7879243 - DNA, 22 bp, Homo sapiens
caagacattgattttgtacaga

SEQ ID NO: 7879244 - DNA, 22 bp, Homo sapiens
caagacattgattttgtacaga

SEQ ID NO: 7879245 - DNA, 22 bp, Homo sapiens
caagacattgattttgtacaga

SEQ ID NO: 7879246 - DNA, 21 bp, Homo sapiens
caagacatatgagtactctgg

SEQ ID NO: 7879247 - DNA, 22 bp, Homo sapiens
caagacatgcaattgccacttt

SEQ ID NO: 7879248 - DNA, 22 bp, Homo sapiens
caagactcacacacagaagagg

SEQ ID NO: 7879249 - DNA, 22 bp, Homo sapiens
caagactcacacacagaagagg

SEQ ID NO: 7879250 - DNA, 22 bp, Homo sapiens
caagagacttatgtggaaacct

SEQ ID NO: 7879251 - DNA, 22 bp, Homo sapiens
caagagacgggcaaggcaagag

SEQ ID NO: 7879252 - DNA, 22 bp, Homo sapiens
agcacattttctcaaagctcat

SEQ ID NO: 7879253 - DNA, 22 bp, Homo sapiens
agcacattttatttaagaaaat

SEQ ID NO: 7879254 - DNA, 22 bp, Homo sapiens
agcaccagagctatgggcctgc

SEQ ID NO: 7879255 - DNA, 22 bp, Homo sapiens
agcaccagagctatgggcctgc

SEQ ID NO: 7879256 - DNA, 21 bp, Homo sapiens
agcaccaaatgcaggctctgg

SEQ ID NO: 7879257 - DNA, 21 bp, Homo sapiens
agcaccaaatgcaggctctgg

SEQ ID NO: 7879258 - DNA, 22 bp, Homo sapiens
agcacattcccacctgtacttc

SEQ ID NO: 7879259 - DNA, 22 bp, Homo sapiens
agcacattctgccttgctttgc

SEQ ID NO: 7879260 - DNA, 22 bp, Homo sapiens
agcacattgatttattttggag

SEQ ID NO: 7879261 - DNA, 22 bp, Homo sapiens
agcacattcttgccttaacctc

SEQ ID NO: 7879262 - DNA, 22 bp, Homo sapiens
agcacatttaagtatgaaatat

SEQ ID NO: 7879263 - DNA, 23 bp, Homo sapiens
agcaccaggaacagtgtggtcct

SEQ ID NO: 7879264 - DNA, 22 bp, Homo sapiens
agcaccaggatattgttggaga

SEQ ID NO: 7879265 - DNA, 22 bp, Homo sapiens
agcaccaggcaccaaagggcct

SEQ ID NO: 7879266 - DNA, 23 bp, Homo sapiens
agcaccaggaacagtgtggtcct

SEQ ID NO: 7879267 - DNA, 22 bp, Homo sapiens
agcaccaggaaagaaggggcca

SEQ ID NO: 7879268 - DNA, 22 bp, Homo sapiens
agcaccagctcaaggtgcacct

SEQ ID NO: 7879269 - DNA, 22 bp, Homo sapiens
agcaccaggaaagaaggggcca

SEQ ID NO: 7879270 - DNA, 22 bp, Homo sapiens
agcaccagcgtgggggccgttg

SEQ ID NO: 7879271 - DNA, 22 bp, Homo sapiens
agcaccagcgtgggggccgttg

SEQ ID NO: 7879272 - DNA, 22 bp, Homo sapiens
agcaccagctcaaggtgcacct

SEQ ID NO: 7879273 - DNA, 22 bp, Homo sapiens
agcaccagcaactatgggctgc

SEQ ID NO: 7879274 - DNA, 22 bp, Homo sapiens
agcaccagcaactatgggctgc

SEQ ID NO: 7879275 - DNA, 22 bp, Homo sapiens
agcaccagcaactatgggctgc

SEQ ID NO: 7879276 - DNA, 22 bp, Homo sapiens
caacagaaggtgtactactgaa

SEQ ID NO: 7879277 - DNA, 22 bp, Homo sapiens
caacagaaggaagcagggtcag

SEQ ID NO: 7879278 - DNA, 22 bp, Homo sapiens
caacagaaggtgtactactgaa

SEQ ID NO: 7879279 - DNA, 22 bp, Homo sapiens
caacagacctggattcaaaaac

SEQ ID NO: 7879280 - DNA, 22 bp, Homo sapiens
caacagacctggattcaaaaac

SEQ ID NO: 7879281 - DNA, 20 bp, Homo sapiens
caacagaggggtctggagta

SEQ ID NO: 7879282 - DNA, 22 bp, Homo sapiens
caacagagagaccagaaacagg

SEQ ID NO: 7879283 - DNA, 22 bp, Homo sapiens
caacagagagaccagaaacagg

SEQ ID NO: 7879284 - DNA, 22 bp, Homo sapiens
caacagctcagacacgggacct

SEQ ID NO: 7879285 - DNA, 22 bp, Homo sapiens
caacagctgatctttgatgaag

SEQ ID NO: 7879286 - DNA, 22 bp, Homo sapiens
caacagctgatctttgatgaag

SEQ ID NO: 7879287 - DNA, 22 bp, Homo sapiens
caacagctggaggcttggcccg

SEQ ID NO: 7879288 - DNA, 23 bp, Homo sapiens
caacagctgttagatatgggctt

SEQ ID NO: 7879289 - DNA, 22 bp, Homo sapiens
caacagctggaggcttggcccg

SEQ ID NO: 7879290 - DNA, 22 bp, Homo sapiens
caacagctttagaaacactttc

SEQ ID NO: 7879291 - DNA, 22 bp, Homo sapiens
caacagctttagaaacactttc

SEQ ID NO: 7879292 - DNA, 22 bp, Homo sapiens
agcacattaagtgagttcatgt

SEQ ID NO: 7879293 - DNA, 22 bp, Homo sapiens
agcacattcccacctgtacttc

SEQ ID NO: 7879294 - DNA, 22 bp, Homo sapiens
caacacttcttatacttactga

SEQ ID NO: 7879295 - DNA, 22 bp, Homo sapiens
caacagaaatcaattttcccat

SEQ ID NO: 7879296 - DNA, 22 bp, Homo sapiens
caacacttcttatacttactga

SEQ ID NO: 7879297 - DNA, 20 bp, Homo sapiens
caacactgcccattgtttgc

SEQ ID NO: 7879298 - DNA, 20 bp, Homo sapiens
caacactgcccattgtttgc

SEQ ID NO: 7879299 - DNA, 23 bp, Homo sapiens
caacactgccttcaggtgaagaa

SEQ ID NO: 7879300 - DNA, 23 bp, Homo sapiens
caacactgccttcaggtgaagaa

SEQ ID NO: 7879301 - DNA, 23 bp, Homo sapiens
caacactgccttcaggtgaagaa

SEQ ID NO: 7879302 - DNA, 22 bp, Homo sapiens
caaatagtgtcacattgtgagg

SEQ ID NO: 7879303 - DNA, 22 bp, Homo sapiens
caaatagtgtcacattgtgagg

SEQ ID NO: 7879304 - DNA, 22 bp, Homo sapiens
caaatagtgtcacattgtgagg

SEQ ID NO: 7879305 - DNA, 22 bp, Homo sapiens
caaatagtttttcatgtattat

SEQ ID NO: 7879306 - DNA, 22 bp, Homo sapiens
caaatagtttttcatgtattat

SEQ ID NO: 7879307 - DNA, 22 bp, Homo sapiens
caaatagtttttcatgtattat

SEQ ID NO: 7879308 - DNA, 22 bp, Homo sapiens
caaatatctttggcaaagagaa

SEQ ID NO: 7879309 - DNA, 22 bp, Homo sapiens
caaatatctttggcaaagagaa

SEQ ID NO: 7879310 - DNA, 22 bp, Homo sapiens
caaatatctttggcaaagagaa

SEQ ID NO: 7879311 - DNA, 22 bp, Homo sapiens
caaatattccaggtacatccct

SEQ ID NO: 7879312 - DNA, 22 bp, Homo sapiens
caaatattccaggtacatccct

SEQ ID NO: 7879313 - DNA, 22 bp, Homo sapiens
caaatattccaggtacatccct

SEQ ID NO: 7879314 - DNA, 22 bp, Homo sapiens
caaatattccaggtacatccct

SEQ ID NO: 7879315 - DNA, 22 bp, Homo sapiens
agcagcaggcttaaggaaaagt

SEQ ID NO: 7879316 - DNA, 21 bp, Homo sapiens
agcagcagggaagcctcatcc

SEQ ID NO: 7879317 - DNA, 21 bp, Homo sapiens
agcagcagggaagcctcatcc

SEQ ID NO: 7879318 - DNA, 21 bp, Homo sapiens
agcagcagggaagcctcatcc

SEQ ID NO: 7879319 - DNA, 22 bp, Homo sapiens
agcagcaggcttaaggaaaagt

SEQ ID NO: 7879320 - DNA, 21 bp, Homo sapiens
agcagcagggaagcctcatcc

SEQ ID NO: 7879321 - DNA, 22 bp, Homo sapiens
agcagcagggacaaaggaacag

SEQ ID NO: 7879322 - DNA, 22 bp, Homo sapiens
agcagcagggacaaaggaacag

SEQ ID NO: 7879323 - DNA, 22 bp, Homo sapiens
agcagcagggacaaaggaacag

SEQ ID NO: 7879324 - DNA, 21 bp, Homo sapiens
agcagcagggaagcctcatcc

SEQ ID NO: 7879325 - DNA, 22 bp, Homo sapiens
agcagcagggacaaaggaacag

SEQ ID NO: 7879326 - DNA, 22 bp, Homo sapiens
agcagcagggcatgtcttactc

SEQ ID NO: 7879327 - DNA, 22 bp, Homo sapiens
agcagcagggcatgtcttactc

SEQ ID NO: 7879328 - DNA, 22 bp, Homo sapiens
agcagcagggacaaaggaacag

SEQ ID NO: 7879329 - DNA, 22 bp, Homo sapiens
agcagcagggcatgtcttactc

SEQ ID NO: 7879330 - DNA, 22 bp, Homo sapiens
agcagcagggctctgcccgtgc

SEQ ID NO: 7879331 - DNA, 22 bp, Homo sapiens
agcagcagggtcattgctcttt

SEQ ID NO: 7879332 - DNA, 22 bp, Homo sapiens
agcagcagggctctgcccgtgc

SEQ ID NO: 7879333 - DNA, 20 bp, Homo sapiens
cacaagagaatacacactgg

SEQ ID NO: 7879334 - DNA, 20 bp, Homo sapiens
cacaagagaatacacactgg

SEQ ID NO: 7879335 - DNA, 20 bp, Homo sapiens
cacaagagaatacacactgg

SEQ ID NO: 7879336 - DNA, 20 bp, Homo sapiens
cacaagagaatacacactgg

SEQ ID NO: 7879337 - DNA, 22 bp, Homo sapiens
agcagcagggtgatagtgccca

SEQ ID NO: 7879338 - DNA, 22 bp, Homo sapiens
caattttttccatgctcttaca

SEQ ID NO: 7879339 - DNA, 22 bp, Homo sapiens
caattttttccatgctcttaca

SEQ ID NO: 7879340 - DNA, 22 bp, Homo sapiens
agcagcagggtgatagtgccca

SEQ ID NO: 7879341 - DNA, 22 bp, Homo sapiens
agcagcagggtgatagtgccca

SEQ ID NO: 7879342 - DNA, 22 bp, Homo sapiens
agcagcagggtgatagtgccca

SEQ ID NO: 7879343 - DNA, 22 bp, Homo sapiens
agcagcagggtgatagtgccca

SEQ ID NO: 7879344 - DNA, 22 bp, Homo sapiens
agcagcagggtcattgctcttt

SEQ ID NO: 7879345 - DNA, 22 bp, Homo sapiens
agcagcagggtcattgctcttt

SEQ ID NO: 7879346 - DNA, 22 bp, Homo sapiens
agcagcagggtcattgctcttt

SEQ ID NO: 7879347 - DNA, 22 bp, Homo sapiens
agcagcagggtcattgctcttt

SEQ ID NO: 7879348 - DNA, 22 bp, Homo sapiens
agcagccacccagctgctcatt

SEQ ID NO: 7879349 - DNA, 22 bp, Homo sapiens
agcagccagaaagggcagtcga

SEQ ID NO: 7879350 - DNA, 22 bp, Homo sapiens
agcagccacccagctgctcatt

SEQ ID NO: 7879351 - DNA, 22 bp, Homo sapiens
agcagccagaaatccagaggtg

SEQ ID NO: 7879352 - DNA, 22 bp, Homo sapiens
agcagccagaaatccagaggtg

SEQ ID NO: 7879353 - DNA, 22 bp, Homo sapiens
agcagccagaaagggcagtcga

SEQ ID NO: 7879354 - DNA, 22 bp, Homo sapiens
agcagctccctcctcagccacc

SEQ ID NO: 7879355 - DNA, 22 bp, Homo sapiens
agcagctccctcctcagccacc

SEQ ID NO: 7879356 - DNA, 22 bp, Homo sapiens
agcagccagaaagggcagtcga

SEQ ID NO: 7879357 - DNA, 22 bp, Homo sapiens
agcagccacccagctgctcatt

SEQ ID NO: 7879358 - DNA, 22 bp, Homo sapiens
agcagccacagtctgggacagg

SEQ ID NO: 7879359 - DNA, 22 bp, Homo sapiens
agcagccacccagctgctcatt

SEQ ID NO: 7879360 - DNA, 22 bp, Homo sapiens
agcagccacccagctgctcatt

SEQ ID NO: 7879361 - DNA, 22 bp, Homo sapiens
agcagccacagtctgggacagg

SEQ ID NO: 7879362 - DNA, 22 bp, Homo sapiens
agcagccacccagctgctcatt

SEQ ID NO: 7879363 - DNA, 22 bp, Homo sapiens
agcagccacagtctgggacagg

SEQ ID NO: 7879364 - DNA, 22 bp, Homo sapiens
agcagccacagtctgggacagg

SEQ ID NO: 7879365 - DNA, 22 bp, Homo sapiens
agcagccacacgcctccttctc

SEQ ID NO: 7879366 - DNA, 22 bp, Homo sapiens
agcagccaaggtaacctgtgct

SEQ ID NO: 7879367 - DNA, 22 bp, Homo sapiens
agcagccacagcagatctgagt

SEQ ID NO: 7879368 - DNA, 22 bp, Homo sapiens
agcagccacagcagatctgagt

SEQ ID NO: 7879369 - DNA, 22 bp, Homo sapiens
agcagccaattggaggatgaag

SEQ ID NO: 7879370 - DNA, 22 bp, Homo sapiens
agcagccacacgcctccttctc

SEQ ID NO: 7879371 - DNA, 22 bp, Homo sapiens
agcagccacacgcctccttctc

SEQ ID NO: 7879372 - DNA, 22 bp, Homo sapiens
cacaaggactggatggagtggg

SEQ ID NO: 7879373 - DNA, 22 bp, Homo sapiens
cacaaggacctcagatggatga

SEQ ID NO: 7879374 - DNA, 22 bp, Homo sapiens
cacaaggaggtcctgaggaagc

SEQ ID NO: 7879375 - DNA, 22 bp, Homo sapiens
cacaaggaggtcctgaggaagc

SEQ ID NO: 7879376 - DNA, 22 bp, Homo sapiens
cacaagatggtttccagatgct

SEQ ID NO: 7879377 - DNA, 22 bp, Homo sapiens
cacaagatggtttccagatgct

SEQ ID NO: 7879378 - DNA, 22 bp, Homo sapiens
cacaagatggtttccagatgct

SEQ ID NO: 7879379 - DNA, 22 bp, Homo sapiens
cacaagatggtcacataagtgc

SEQ ID NO: 7879380 - DNA, 22 bp, Homo sapiens
cacaagatggtcacataagtgc

SEQ ID NO: 7879381 - DNA, 22 bp, Homo sapiens
cacaaggctttcatctggcata

SEQ ID NO: 7879382 - DNA, 22 bp, Homo sapiens
cacaaggctgggacaagtgctg

SEQ ID NO: 7879383 - DNA, 22 bp, Homo sapiens
cacaaggctgggacaagtgctg

SEQ ID NO: 7879384 - DNA, 22 bp, Homo sapiens
cacaaggctttcatctggcata

SEQ ID NO: 7879385 - DNA, 22 bp, Homo sapiens
cacaaggcacattccttgtcca

SEQ ID NO: 7879386 - DNA, 22 bp, Homo sapiens
agcagccaaccttacattcatc

SEQ ID NO: 7879387 - DNA, 22 bp, Homo sapiens
agcagccaaccttacattcatc

SEQ ID NO: 7879388 - DNA, 22 bp, Homo sapiens
agcagccaaccttacattcatc

SEQ ID NO: 7879389 - DNA, 22 bp, Homo sapiens
agcagccaaggtaacctgtgct

SEQ ID NO: 7879390 - DNA, 22 bp, Homo sapiens
agcagccaaggtaacctgtgct

SEQ ID NO: 7879391 - DNA, 22 bp, Homo sapiens
agcagccaaggtaacctgtgct

SEQ ID NO: 7879392 - DNA, 22 bp, Homo sapiens
agcagcatttaagtttcttcta

SEQ ID NO: 7879393 - DNA, 22 bp, Homo sapiens
cacaagggagcttagaaaacat

SEQ ID NO: 7879394 - DNA, 22 bp, Homo sapiens
agcagcatttaagtttcttcta

SEQ ID NO: 7879395 - DNA, 22 bp, Homo sapiens
agcagccaaatgaagattttac

SEQ ID NO: 7879396 - DNA, 22 bp, Homo sapiens
agcagccaaatgaagattttac

SEQ ID NO: 7879397 - DNA, 22 bp, Homo sapiens
agcagcaggctagggaactgct

SEQ ID NO: 7879398 - DNA, 22 bp, Homo sapiens
agcagcaggctagggaactgct

SEQ ID NO: 7879399 - DNA, 22 bp, Homo sapiens
agcagcaggctagggaactgct

SEQ ID NO: 7879400 - DNA, 22 bp, Homo sapiens
agcagcaggctagggaactgct

SEQ ID NO: 7879401 - DNA, 22 bp, Homo sapiens
agcagcaggctagggaactgct

SEQ ID NO: 7879402 - DNA, 22 bp, Homo sapiens
agcagcaggctagggaactgct

SEQ ID NO: 7879403 - DNA, 22 bp, Homo sapiens
agcagcaggctagggaactgct

SEQ ID NO: 7879404 - DNA, 22 bp, Homo sapiens
agcagcaggctagggaactgct

SEQ ID NO: 7879405 - DNA, 22 bp, Homo sapiens
agcagcaggattttcgttggga

SEQ ID NO: 7879406 - DNA, 22 bp, Homo sapiens
agcagcaggattttcgttggga

SEQ ID NO: 7879407 - DNA, 22 bp, Homo sapiens
agcagcaggattttcgttggga

SEQ ID NO: 7879408 - DNA, 22 bp, Homo sapiens
agcagcaggctgggatgagtct

SEQ ID NO: 7879409 - DNA, 22 bp, Homo sapiens
agcagcaggctgggatgagtct

SEQ ID NO: 7879410 - DNA, 22 bp, Homo sapiens
agcagcaggctgggatgagtct

SEQ ID NO: 7879411 - DNA, 22 bp, Homo sapiens
agcagcaggctgtgtggactga

SEQ ID NO: 7879412 - DNA, 22 bp, Homo sapiens
agcagcaggctgtgtggactga

SEQ ID NO: 7879413 - DNA, 22 bp, Homo sapiens
agcagcaggctgtgtggactga

SEQ ID NO: 7879414 - DNA, 22 bp, Homo sapiens
agcagcaggctgtgtggactga

SEQ ID NO: 7879415 - DNA, 22 bp, Homo sapiens
agcagcaggcttaaggaaaagt

SEQ ID NO: 7879416 - DNA, 22 bp, Homo sapiens
agcagcaggctgtgtggactga

SEQ ID NO: 7879417 - DNA, 22 bp, Homo sapiens
agcagcaggctgtgtggactga

SEQ ID NO: 7879418 - DNA, 22 bp, Homo sapiens
agcagcaggctgtgtggactga

SEQ ID NO: 7879419 - DNA, 22 bp, Homo sapiens
agcagcagattatggtctacat

SEQ ID NO: 7879420 - DNA, 20 bp, Homo sapiens
agcagcagatgttggaggtg

SEQ ID NO: 7879421 - DNA, 22 bp, Homo sapiens
agcagcagctctgttgccctac

SEQ ID NO: 7879422 - DNA, 22 bp, Homo sapiens
agcagcagctctgttgccctac

SEQ ID NO: 7879423 - DNA, 22 bp, Homo sapiens
agcagcagattatggtctacat

SEQ ID NO: 7879424 - DNA, 22 bp, Homo sapiens
agcagcagctctgttgccctac

SEQ ID NO: 7879425 - DNA, 22 bp, Homo sapiens
agcagcagattatggtctacat

SEQ ID NO: 7879426 - DNA, 20 bp, Homo sapiens
agcagcagatgttggaggtg

SEQ ID NO: 7879427 - DNA, 22 bp, Homo sapiens
caagcagagaggttagaacaca

SEQ ID NO: 7879428 - DNA, 22 bp, Homo sapiens
caagcagagaggtcaactaata

SEQ ID NO: 7879429 - DNA, 22 bp, Homo sapiens
caagcagagaggtcaactaata

SEQ ID NO: 7879430 - DNA, 22 bp, Homo sapiens
caagcagagactagatagctgt

SEQ ID NO: 7879431 - DNA, 22 bp, Homo sapiens
caagcagagactagatagctgt

SEQ ID NO: 7879432 - DNA, 22 bp, Homo sapiens
caagcagagactagatagctgt

SEQ ID NO: 7879433 - DNA, 22 bp, Homo sapiens
agcagcaggaggctgtccacca

SEQ ID NO: 7879434 - DNA, 22 bp, Homo sapiens
agcagcaggaggccattgtctt

SEQ ID NO: 7879435 - DNA, 22 bp, Homo sapiens
agcagcaggaggctgtccacca

SEQ ID NO: 7879436 - DNA, 22 bp, Homo sapiens
agcagcaggaggctgtccacca

SEQ ID NO: 7879437 - DNA, 22 bp, Homo sapiens
agcagcaggaggctgtccacca

SEQ ID NO: 7879438 - DNA, 22 bp, Homo sapiens
agcagcaggaggctgtccacca

SEQ ID NO: 7879439 - DNA, 22 bp, Homo sapiens
agcagcaggagccgtggggtga

SEQ ID NO: 7879440 - DNA, 22 bp, Homo sapiens
agcagcaggagccgtggggtga

SEQ ID NO: 7879441 - DNA, 22 bp, Homo sapiens
agcagcaggaggccattgtctt

SEQ ID NO: 7879442 - DNA, 22 bp, Homo sapiens
agcagcaggaggccattgtctt

SEQ ID NO: 7879443 - DNA, 22 bp, Homo sapiens
agcagcaggaggccattgtctt

SEQ ID NO: 7879444 - DNA, 22 bp, Homo sapiens
agcagcaggaggccattgtctt

SEQ ID NO: 7879445 - DNA, 22 bp, Homo sapiens
caagagctaccctgtgccatat

SEQ ID NO: 7879446 - DNA, 22 bp, Homo sapiens
caagagcctttgggcagaagga

SEQ ID NO: 7879447 - DNA, 22 bp, Homo sapiens
caagagcctttgggcagaagga

SEQ ID NO: 7879448 - DNA, 22 bp, Homo sapiens
caagagctaccctgtgccatat

SEQ ID NO: 7879449 - DNA, 22 bp, Homo sapiens
caagagcatttagttagctggt

SEQ ID NO: 7879450 - DNA, 22 bp, Homo sapiens
caagagcatttagttagctggt

SEQ ID NO: 7879451 - DNA, 22 bp, Homo sapiens
caagagccataattttgagagt

SEQ ID NO: 7879452 - DNA, 22 bp, Homo sapiens
caagagcatttagttagctggt

SEQ ID NO: 7879453 - DNA, 22 bp, Homo sapiens
caagagctagactttgtcagga

SEQ ID NO: 7879454 - DNA, 22 bp, Homo sapiens
caagagctagaaattggttaga

SEQ ID NO: 7879455 - DNA, 22 bp, Homo sapiens
caagatttagcctgctgcctgt

SEQ ID NO: 7879456 - DNA, 22 bp, Homo sapiens
caagatttagcctgctgcctgt

SEQ ID NO: 7879457 - DNA, 22 bp, Homo sapiens
caagagctagactttgtcagga

SEQ ID NO: 7879458 - DNA, 22 bp, Homo sapiens
caagagctagactttgtcagga

SEQ ID NO: 7879459 - DNA, 22 bp, Homo sapiens
caagatttagctcccttatctc

SEQ ID NO: 7879460 - DNA, 22 bp, Homo sapiens
caagatttagctcccttatctc

SEQ ID NO: 7879461 - DNA, 22 bp, Homo sapiens
caagatttatattttcacacaa

SEQ ID NO: 7879462 - DNA, 22 bp, Homo sapiens
caagatttatattttcacacaa

SEQ ID NO: 7879463 - DNA, 22 bp, Homo sapiens
caagatttccaaccctgggtaa

SEQ ID NO: 7879464 - DNA, 17 bp, Homo sapiens
caagagagatgactgga

SEQ ID NO: 7879465 - DNA, 17 bp, Homo sapiens
caagagagatgactgga

SEQ ID NO: 7879466 - DNA, 22 bp, Homo sapiens
caagagagatgcagctcactca

SEQ ID NO: 7879467 - DNA, 17 bp, Homo sapiens
caagagagatgactgga

SEQ ID NO: 7879468 - DNA, 22 bp, Homo sapiens
caagagacttatgtggaaacct

SEQ ID NO: 7879469 - DNA, 22 bp, Homo sapiens
caagagacttatgtggaaacct

SEQ ID NO: 7879470 - DNA, 22 bp, Homo sapiens
caagagacgggcaaggcaagag

SEQ ID NO: 7879471 - DNA, 17 bp, Homo sapiens
caagagagatgactgga

SEQ ID NO: 7879472 - DNA, 22 bp, Homo sapiens
caagagcaggtgctgcttccat

SEQ ID NO: 7879473 - DNA, 22 bp, Homo sapiens
caagagcaggtgctgcttccat

SEQ ID NO: 7879474 - DNA, 22 bp, Homo sapiens
caagagcaggtgctgcttccat

SEQ ID NO: 7879475 - DNA, 22 bp, Homo sapiens
caagagcaggtgctgcttccat

SEQ ID NO: 7879476 - DNA, 22 bp, Homo sapiens
caagagcatccctgcatccagc

SEQ ID NO: 7879477 - DNA, 22 bp, Homo sapiens
caagagcatccctgcatccagc

SEQ ID NO: 7879478 - DNA, 22 bp, Homo sapiens
caagagcatccctgcatccagc

SEQ ID NO: 7879479 - DNA, 22 bp, Homo sapiens
caagagcatccctgcatccagc

SEQ ID NO: 7879480 - DNA, 22 bp, Homo sapiens
caagagcacgtgccctccataa

SEQ ID NO: 7879481 - DNA, 22 bp, Homo sapiens
caagagatacatttctagtagg

SEQ ID NO: 7879482 - DNA, 22 bp, Homo sapiens
caagagcacgtgccctccataa

SEQ ID NO: 7879483 - DNA, 22 bp, Homo sapiens
caagcaacgactttcaagctgt

SEQ ID NO: 7879484 - DNA, 22 bp, Homo sapiens
caagcaacgactttcaagctgt

SEQ ID NO: 7879485 - DNA, 22 bp, Homo sapiens
caagattttatctccgtttctg

SEQ ID NO: 7879486 - DNA, 22 bp, Homo sapiens
caagattttatctccgtttctg

SEQ ID NO: 7879487 - DNA, 22 bp, Homo sapiens
caagatttgggggcacggaatc

SEQ ID NO: 7879488 - DNA, 22 bp, Homo sapiens
caagatttgtattgggcctctg

SEQ ID NO: 7879489 - DNA, 22 bp, Homo sapiens
caagatttggcattctgaggag

SEQ ID NO: 7879490 - DNA, 19 bp, Homo sapiens
caagatttgttcacacatg

SEQ ID NO: 7879491 - DNA, 19 bp, Homo sapiens
caagatttgttcacacatg

SEQ ID NO: 7879492 - DNA, 19 bp, Homo sapiens
caagatttgttcacacatg

SEQ ID NO: 7879493 - DNA, 22 bp, Homo sapiens
caagatttggcattctgaggag

SEQ ID NO: 7879494 - DNA, 22 bp, Homo sapiens
caagatttggcaactttgtcat

SEQ ID NO: 7879495 - DNA, 22 bp, Homo sapiens
caagatttggcaactttgtcat

SEQ ID NO: 7879496 - DNA, 22 bp, Homo sapiens
caagatttggcaactttgtcat

SEQ ID NO: 7879497 - DNA, 22 bp, Homo sapiens
caagatttccaaccctgggtaa

SEQ ID NO: 7879498 - DNA, 22 bp, Homo sapiens
caagatttgacttcgtggtttg

SEQ ID NO: 7879499 - DNA, 22 bp, Homo sapiens
caagatttgccagtggccaact

SEQ ID NO: 7879500 - DNA, 22 bp, Homo sapiens
caagatttgacttcgtggtttg

SEQ ID NO: 7879501 - DNA, 22 bp, Homo sapiens
caagatttgccagtggccaact

SEQ ID NO: 7879502 - DNA, 22 bp, Homo sapiens
caagcaatgctatactcattat

SEQ ID NO: 7879503 - DNA, 22 bp, Homo sapiens
caagcaccatgtgctccatgtt

SEQ ID NO: 7879504 - DNA, 22 bp, Homo sapiens
caagcaccatgtgctccatgtt

SEQ ID NO: 7879505 - DNA, 22 bp, Homo sapiens
caagcagaaatctagaactcca

SEQ ID NO: 7879506 - DNA, 22 bp, Homo sapiens
caagcagaaatctagaactcca

SEQ ID NO: 7879507 - DNA, 22 bp, Homo sapiens
caagcactgtggcactcgcagg

SEQ ID NO: 7879508 - DNA, 22 bp, Homo sapiens
caagcagaaatctagaactcca

SEQ ID NO: 7879509 - DNA, 22 bp, Homo sapiens
caagcagaaatctagaactcca

SEQ ID NO: 7879510 - DNA, 22 bp, Homo sapiens
caagcagacagtaggcctagaa

SEQ ID NO: 7879511 - DNA, 22 bp, Homo sapiens
caagcagaagcctcaggggcat

SEQ ID NO: 7879512 - DNA, 22 bp, Homo sapiens
caagcagaaatctagaactcca

SEQ ID NO: 7879513 - DNA, 22 bp, Homo sapiens
caagcagagaagtctctaggct

SEQ ID NO: 7879514 - DNA, 22 bp, Homo sapiens
caagcagagaagtctctaggct

SEQ ID NO: 7879515 - DNA, 22 bp, Homo sapiens
caagcagacagtaggcctagaa

SEQ ID NO: 7879516 - DNA, 22 bp, Homo sapiens
caagcagaagcctcaggggcat

SEQ ID NO: 7879517 - DNA, 22 bp, Homo sapiens
agcctctgctggccctggcact

SEQ ID NO: 7879518 - DNA, 22 bp, Homo sapiens
agcctctgctggccctggcact

SEQ ID NO: 7879519 - DNA, 22 bp, Homo sapiens
agcctctgcacttcttacaggt

SEQ ID NO: 7879520 - DNA, 22 bp, Homo sapiens
agcctctgcacttcttacaggt

SEQ ID NO: 7879521 - DNA, 22 bp, Homo sapiens
agcctctgcacttcttacaggt

SEQ ID NO: 7879522 - DNA, 22 bp, Homo sapiens
agcctctgatggctcccaagga

SEQ ID NO: 7879523 - DNA, 22 bp, Homo sapiens
agcctcctggagtttctgggat

SEQ ID NO: 7879524 - DNA, 22 bp, Homo sapiens
agcctctgcacgggcacgggtg

SEQ ID NO: 7879525 - DNA, 22 bp, Homo sapiens
agcctctgcacgggcacgggtg

SEQ ID NO: 7879526 - DNA, 22 bp, Homo sapiens
agcctctgcacttcttacaggt

SEQ ID NO: 7879527 - DNA, 22 bp, Homo sapiens
agcctctgctggccctggcact

SEQ ID NO: 7879528 - DNA, 22 bp, Homo sapiens
agcctctgctggccctggcact

SEQ ID NO: 7879529 - DNA, 22 bp, Homo sapiens
agcctctgctggccctggcact

SEQ ID NO: 7879530 - DNA, 22 bp, Homo sapiens
agcctctgctggccctggcact

SEQ ID NO: 7879531 - DNA, 22 bp, Homo sapiens
agcctctgcttatgcaaaggta

SEQ ID NO: 7879532 - DNA, 18 bp, Homo sapiens
agcctctggcagagagaa

SEQ ID NO: 7879533 - DNA, 18 bp, Homo sapiens
agcctctggcagagagaa

SEQ ID NO: 7879534 - DNA, 22 bp, Homo sapiens
agcctctggccctagactgctt

SEQ ID NO: 7879535 - DNA, 22 bp, Homo sapiens
agcctctgggggagctgggagc

SEQ ID NO: 7879536 - DNA, 22 bp, Homo sapiens
agcctctggccctagactgctt

SEQ ID NO: 7879537 - DNA, 22 bp, Homo sapiens
agcctctggccctagactgctt

SEQ ID NO: 7879538 - DNA, 22 bp, Homo sapiens
agcctctggccctagactgctt

SEQ ID NO: 7879539 - DNA, 22 bp, Homo sapiens
agcctctggtcctccctcagct

SEQ ID NO: 7879540 - DNA, 22 bp, Homo sapiens
agcctctggtcctccctcagct

SEQ ID NO: 7879541 - DNA, 22 bp, Homo sapiens
agcctctggtcctccctcagct

SEQ ID NO: 7879542 - DNA, 22 bp, Homo sapiens
agcctctgtagaaagcagtgtg

SEQ ID NO: 7879543 - DNA, 22 bp, Homo sapiens
agcctctgtagaaagcagtgtg

SEQ ID NO: 7879544 - DNA, 22 bp, Homo sapiens
agcctctgtagaaagcagtgtg

SEQ ID NO: 7879545 - DNA, 22 bp, Homo sapiens
agcctctgtagaaagcagtgtg

SEQ ID NO: 7879546 - DNA, 22 bp, Homo sapiens
agcctctgtgactcacaggtca

SEQ ID NO: 7879547 - DNA, 22 bp, Homo sapiens
agcctctgtgactcacaggtca

SEQ ID NO: 7879548 - DNA, 22 bp, Homo sapiens
agcctctgtcaagcttttcaaa

SEQ ID NO: 7879549 - DNA, 22 bp, Homo sapiens
agcctctgtcaagcttttcaaa

SEQ ID NO: 7879550 - DNA, 22 bp, Homo sapiens
agcctccctatgcaccttcagg

SEQ ID NO: 7879551 - DNA, 22 bp, Homo sapiens
cagaggtgcatacaggtcatta

SEQ ID NO: 7879552 - DNA, 22 bp, Homo sapiens
cagaggtgctggagtgagtcct

SEQ ID NO: 7879553 - DNA, 22 bp, Homo sapiens
agcctcctggagtttctgggat

SEQ ID NO: 7879554 - DNA, 22 bp, Homo sapiens
agcctcctggagtttctgggat

SEQ ID NO: 7879555 - DNA, 22 bp, Homo sapiens
cagaggtgcatacaggtcatta

SEQ ID NO: 7879556 - DNA, 22 bp, Homo sapiens
cagaggtgcatacaggtcatta

SEQ ID NO: 7879557 - DNA, 22 bp, Homo sapiens
cagaggtgctggagtgagtcct

SEQ ID NO: 7879558 - DNA, 22 bp, Homo sapiens
cagaggtctgacactgaatggt

SEQ ID NO: 7879559 - DNA, 22 bp, Homo sapiens
cagaggtctgatgcgtccctgc

SEQ ID NO: 7879560 - DNA, 21 bp, Homo sapiens
cagaggtcatcctgaggacaa

SEQ ID NO: 7879561 - DNA, 22 bp, Homo sapiens
cagaggtccagcatacatttcc

SEQ ID NO: 7879562 - DNA, 21 bp, Homo sapiens
cagaggtcatcctgaggacaa

SEQ ID NO: 7879563 - DNA, 22 bp, Homo sapiens
cagaggtccctatttctttgtt

SEQ ID NO: 7879564 - DNA, 22 bp, Homo sapiens
cagagggccccctggccacagt

SEQ ID NO: 7879565 - DNA, 22 bp, Homo sapiens
cagagggccccctggccacagt

SEQ ID NO: 7879566 - DNA, 22 bp, Homo sapiens
cagagggccccctggccacagt

SEQ ID NO: 7879567 - DNA, 22 bp, Homo sapiens
cagagggccatctctatcttca

SEQ ID NO: 7879568 - DNA, 22 bp, Homo sapiens
cagaggtattgcaaaagcctag

SEQ ID NO: 7879569 - DNA, 22 bp, Homo sapiens
cagaggtagggagctatgttat

SEQ ID NO: 7879570 - DNA, 22 bp, Homo sapiens
cagagggccccctggccacagt

SEQ ID NO: 7879571 - DNA, 21 bp, Homo sapiens
cagagggccggcatgtggtct

SEQ ID NO: 7879572 - DNA, 22 bp, Homo sapiens
cagaggtattttgataaacgcc

SEQ ID NO: 7879573 - DNA, 22 bp, Homo sapiens
cagaggtcaagatctgaagtga

SEQ ID NO: 7879574 - DNA, 22 bp, Homo sapiens
cagaggtcaggttggacattat

SEQ ID NO: 7879575 - DNA, 22 bp, Homo sapiens
cagaggtcaggacttcattata

SEQ ID NO: 7879576 - DNA, 22 bp, Homo sapiens
cagagggccatctctatcttca

SEQ ID NO: 7879577 - DNA, 22 bp, Homo sapiens
cagagggcactcggagtgacat

SEQ ID NO: 7879578 - DNA, 22 bp, Homo sapiens
cagagggcactcggagtgacat

SEQ ID NO: 7879579 - DNA, 22 bp, Homo sapiens
cagagggcactcggagtgacat

SEQ ID NO: 7879580 - DNA, 22 bp, Homo sapiens
cagagggcacatggtttcctca

SEQ ID NO: 7879581 - DNA, 22 bp, Homo sapiens
cagagggcactcggagtgacat

SEQ ID NO: 7879582 - DNA, 22 bp, Homo sapiens
cagagggcacatggtttcctca

SEQ ID NO: 7879583 - DNA, 22 bp, Homo sapiens
cagagggcactcggagtgacat

SEQ ID NO: 7879584 - DNA, 22 bp, Homo sapiens
cagagggcactcggagtgacat

SEQ ID NO: 7879585 - DNA, 22 bp, Homo sapiens
cagagggagtttctgaggttgc

SEQ ID NO: 7879586 - DNA, 22 bp, Homo sapiens
cagagggagtttctgaggttgc

SEQ ID NO: 7879587 - DNA, 22 bp, Homo sapiens
cagagggatcatcttcctgaag

SEQ ID NO: 7879588 - DNA, 22 bp, Homo sapiens
cagagggatcatcttcctgaag

SEQ ID NO: 7879589 - DNA, 22 bp, Homo sapiens
cagagggatcatcttcctgaag

SEQ ID NO: 7879590 - DNA, 22 bp, Homo sapiens
agcctgagccccatccagctga

SEQ ID NO: 7879591 - DNA, 22 bp, Homo sapiens
agcctgagagccaagctgtgca

SEQ ID NO: 7879592 - DNA, 22 bp, Homo sapiens
agcctgagccccatccagctga

SEQ ID NO: 7879593 - DNA, 22 bp, Homo sapiens
agcctgagagccaagctgtgca

SEQ ID NO: 7879594 - DNA, 22 bp, Homo sapiens
agcctgagagccaagctgtgca

SEQ ID NO: 7879595 - DNA, 21 bp, Homo sapiens
agcctgaatcccaccagttca

SEQ ID NO: 7879596 - DNA, 22 bp, Homo sapiens
agcctcttattctccaggactt

SEQ ID NO: 7879597 - DNA, 23 bp, Homo sapiens
agcctcttgtggatggtcagcga

SEQ ID NO: 7879598 - DNA, 22 bp, Homo sapiens
agcctgagccccatccagctga

SEQ ID NO: 7879599 - DNA, 22 bp, Homo sapiens
cagcagcattgctctggattcc

SEQ ID NO: 7879600 - DNA, 22 bp, Homo sapiens
cagcagcattgctctggattcc

SEQ ID NO: 7879601 - DNA, 22 bp, Homo sapiens
cagcagctcactgaataatgac

SEQ ID NO: 7879602 - DNA, 22 bp, Homo sapiens
cagcagctcactcaggtggctc

SEQ ID NO: 7879603 - DNA, 22 bp, Homo sapiens
cagcagctcactcaggtggctc

SEQ ID NO: 7879604 - DNA, 22 bp, Homo sapiens
cagcagctcactcaggtggctc

SEQ ID NO: 7879605 - DNA, 22 bp, Homo sapiens
cagcagctcactcaggtggctc

SEQ ID NO: 7879606 - DNA, 22 bp, Homo sapiens
cagcagctcactcaggtggctc

SEQ ID NO: 7879607 - DNA, 22 bp, Homo sapiens
cagcagctcctctgcggctatg

SEQ ID NO: 7879608 - DNA, 22 bp, Homo sapiens
cagcagctcccatccgctgagc

SEQ ID NO: 7879609 - DNA, 22 bp, Homo sapiens
cagcagctcctctgcggctatg

SEQ ID NO: 7879610 - DNA, 22 bp, Homo sapiens
cagcagctgactccaagagagc

SEQ ID NO: 7879611 - DNA, 22 bp, Homo sapiens
cagcagctccaaagaatagcca

SEQ ID NO: 7879612 - DNA, 22 bp, Homo sapiens
cagcagctcccatccgctgagc

SEQ ID NO: 7879613 - DNA, 22 bp, Homo sapiens
cagcagctcccatccgctgagc

SEQ ID NO: 7879614 - DNA, 22 bp, Homo sapiens
cagcagctcccatccgctgagc

SEQ ID NO: 7879615 - DNA, 22 bp, Homo sapiens
cagcagctccaaagaatagcca

SEQ ID NO: 7879616 - DNA, 22 bp, Homo sapiens
cagcagctcagtctctcagtag

SEQ ID NO: 7879617 - DNA, 22 bp, Homo sapiens
cagcagctcagtctctcagtag

SEQ ID NO: 7879618 - DNA, 22 bp, Homo sapiens
cagcagctcagtctctcagtag

SEQ ID NO: 7879619 - DNA, 22 bp, Homo sapiens
cagcagctcagtctctcagtag

SEQ ID NO: 7879620 - DNA, 22 bp, Homo sapiens
cagcagctccaaagaatagcca

SEQ ID NO: 7879621 - DNA, 22 bp, Homo sapiens
cagcagctccaaagaatagcca

SEQ ID NO: 7879622 - DNA, 22 bp, Homo sapiens
cagcagctcagtctctcagtag

SEQ ID NO: 7879623 - DNA, 22 bp, Homo sapiens
cagcagctcagtctctcagtag

SEQ ID NO: 7879624 - DNA, 22 bp, Homo sapiens
cagcagctcagtctctcagtag

SEQ ID NO: 7879625 - DNA, 22 bp, Homo sapiens
cagcagctcaggctgcttccca

SEQ ID NO: 7879626 - DNA, 22 bp, Homo sapiens
cagcagctcaggctgcttccca

SEQ ID NO: 7879627 - DNA, 22 bp, Homo sapiens
cagcagctcagtctctcagtag

SEQ ID NO: 7879628 - DNA, 22 bp, Homo sapiens
cagcagctcaggctgcttccca

SEQ ID NO: 7879629 - DNA, 22 bp, Homo sapiens
cagcagctcaggctgcttccca

SEQ ID NO: 7879630 - DNA, 22 bp, Homo sapiens
cagcagctcaggctgcttccca

SEQ ID NO: 7879631 - DNA, 22 bp, Homo sapiens
cagcagctcaggctgcttccca

SEQ ID NO: 7879632 - DNA, 22 bp, Homo sapiens
cagcagctcaggctgcttccca

SEQ ID NO: 7879633 - DNA, 22 bp, Homo sapiens
cagcagctcaggctgcttccca

SEQ ID NO: 7879634 - DNA, 22 bp, Homo sapiens
cagcagctcaggctgcttccca

SEQ ID NO: 7879635 - DNA, 22 bp, Homo sapiens
cagcagctcaggctccttccca

SEQ ID NO: 7879636 - DNA, 22 bp, Homo sapiens
cagcagctcaggctccttccca

SEQ ID NO: 7879637 - DNA, 22 bp, Homo sapiens
cagcagctcactgaataatgac

SEQ ID NO: 7879638 - DNA, 22 bp, Homo sapiens
cagcagctcaggctccttccca

SEQ ID NO: 7879639 - DNA, 22 bp, Homo sapiens
cagcagctcaggctccttccca

SEQ ID NO: 7879640 - DNA, 22 bp, Homo sapiens
agcctggcactgccccatccat

SEQ ID NO: 7879641 - DNA, 22 bp, Homo sapiens
agcctggcactgccccatccat

SEQ ID NO: 7879642 - DNA, 22 bp, Homo sapiens
agcctggcactgccccatccat

SEQ ID NO: 7879643 - DNA, 22 bp, Homo sapiens
agcctggcactgaggcagggcg

SEQ ID NO: 7879644 - DNA, 22 bp, Homo sapiens
agcctggcactgaggcagggcg

SEQ ID NO: 7879645 - DNA, 22 bp, Homo sapiens
agcctggcactgaggcagggcg

SEQ ID NO: 7879646 - DNA, 22 bp, Homo sapiens
agcctggcactgaggcagggcg

SEQ ID NO: 7879647 - DNA, 22 bp, Homo sapiens
cagcagggaagctgtgctgttt

SEQ ID NO: 7879648 - DNA, 22 bp, Homo sapiens
cagcagggaagctgtgctgttt

SEQ ID NO: 7879649 - DNA, 22 bp, Homo sapiens
cagcagggaagctgtgctgttt

SEQ ID NO: 7879650 - DNA, 22 bp, Homo sapiens
cagcaggatatggtggagagag

SEQ ID NO: 7879651 - DNA, 22 bp, Homo sapiens
cagcaggatatggtggagagag

SEQ ID NO: 7879652 - DNA, 22 bp, Homo sapiens
cagcaggatatggtggagagag

SEQ ID NO: 7879653 - DNA, 22 bp, Homo sapiens
cagcaggatatggtggagagag

SEQ ID NO: 7879654 - DNA, 22 bp, Homo sapiens
cagcaggatatggtggagagag

SEQ ID NO: 7879655 - DNA, 22 bp, Homo sapiens
cagcaggatatggtggagagag

SEQ ID NO: 7879656 - DNA, 22 bp, Homo sapiens
cagcaggatatggtggagagag

SEQ ID NO: 7879657 - DNA, 22 bp, Homo sapiens
cagcaggataggtttctttgga

SEQ ID NO: 7879658 - DNA, 22 bp, Homo sapiens
cagcagggcccccgggtgcgcc

SEQ ID NO: 7879659 - DNA, 22 bp, Homo sapiens
cagcagggcccccgggtgcgcc

SEQ ID NO: 7879660 - DNA, 22 bp, Homo sapiens
cagcagggcccccgggtgcgcc

SEQ ID NO: 7879661 - DNA, 22 bp, Homo sapiens
cagcagggcccccgggtgcgcc

SEQ ID NO: 7879662 - DNA, 22 bp, Homo sapiens
cagcagggcccccgggtgcgcc

SEQ ID NO: 7879663 - DNA, 22 bp, Homo sapiens
cagcagggctgtgctaccccat

SEQ ID NO: 7879664 - DNA, 22 bp, Homo sapiens
cagcaggggaactgtgggccag

SEQ ID NO: 7879665 - DNA, 22 bp, Homo sapiens
cagcaggggaactgtgggccag

SEQ ID NO: 7879666 - DNA, 22 bp, Homo sapiens
cagcaggggaactgtgggccag

SEQ ID NO: 7879667 - DNA, 20 bp, Homo sapiens
agcctggcaaacacccccag

SEQ ID NO: 7879668 - DNA, 22 bp, Homo sapiens
agcctggattcgtgcatccaca

SEQ ID NO: 7879669 - DNA, 23 bp, Homo sapiens
agcctggcacctgcagatcggag

SEQ ID NO: 7879670 - DNA, 22 bp, Homo sapiens
agcctggcactgaggcagggcg

SEQ ID NO: 7879671 - DNA, 22 bp, Homo sapiens
agcctggatcctaggctcagct

SEQ ID NO: 7879672 - DNA, 22 bp, Homo sapiens
agcctggatcctaggctcagct

SEQ ID NO: 7879673 - DNA, 22 bp, Homo sapiens
agcctggattcgtgcatccaca

SEQ ID NO: 7879674 - DNA, 22 bp, Homo sapiens
agcctggatcctaggctcagct

SEQ ID NO: 7879675 - DNA, 22 bp, Homo sapiens
agcctggattcgtgcatccaca

SEQ ID NO: 7879676 - DNA, 22 bp, Homo sapiens
agcctggatccatgtggctacc

SEQ ID NO: 7879677 - DNA, 22 bp, Homo sapiens
agcctggatcctaggctcagct

SEQ ID NO: 7879678 - DNA, 22 bp, Homo sapiens
agcctggatcctaggctcagct

SEQ ID NO: 7879679 - DNA, 22 bp, Homo sapiens
agcctggagttcccaggagaag

SEQ ID NO: 7879680 - DNA, 22 bp, Homo sapiens
agcctggagttcccaggagaag

SEQ ID NO: 7879681 - DNA, 22 bp, Homo sapiens
agcctggagttcccaggagaag

SEQ ID NO: 7879682 - DNA, 22 bp, Homo sapiens
cagcagctgaggcgctggcgtg

SEQ ID NO: 7879683 - DNA, 22 bp, Homo sapiens
cagcagctgaggcgctggcgtg

SEQ ID NO: 7879684 - DNA, 22 bp, Homo sapiens
cagcagctgaggcgctggcgtg

SEQ ID NO: 7879685 - DNA, 22 bp, Homo sapiens
cagcagctgaggcgctggcgtg

SEQ ID NO: 7879686 - DNA, 22 bp, Homo sapiens
cagcagctgactccaagagagc

SEQ ID NO: 7879687 - DNA, 22 bp, Homo sapiens
cagcagctgaggcgctggcgtg

SEQ ID NO: 7879688 - DNA, 22 bp, Homo sapiens
cagcagctgaggcgctggcgtg

SEQ ID NO: 7879689 - DNA, 22 bp, Homo sapiens
cagcagctgatggggaagtgat

SEQ ID NO: 7879690 - DNA, 22 bp, Homo sapiens
cagcagctgatggggaagtgat

SEQ ID NO: 7879691 - DNA, 22 bp, Homo sapiens
agcctggagttcccaggagaag

SEQ ID NO: 7879692 - DNA, 22 bp, Homo sapiens
agcctggaggtaatgaggaaac

SEQ ID NO: 7879693 - DNA, 22 bp, Homo sapiens
cagcgtctcgttgtgggcctcg

SEQ ID NO: 7879694 - DNA, 22 bp, Homo sapiens
agctcaggcaactctgggcccc

SEQ ID NO: 7879695 - DNA, 22 bp, Homo sapiens
agctcaggcaactctgggcccc

SEQ ID NO: 7879696 - DNA, 19 bp, Homo sapiens
cagctcaggactcagcccc

SEQ ID NO: 7879697 - DNA, 19 bp, Homo sapiens
cagctcaggactcagcccc

SEQ ID NO: 7879698 - DNA, 19 bp, Homo sapiens
cagctcaggactcagcccc

SEQ ID NO: 7879699 - DNA, 19 bp, Homo sapiens
cagctcaggactcagcccc

SEQ ID NO: 7879700 - DNA, 22 bp, Homo sapiens
cagctcagtctggagagatgca

SEQ ID NO: 7879701 - DNA, 22 bp, Homo sapiens
cagctcaggctctccatgctcc

SEQ ID NO: 7879702 - DNA, 22 bp, Homo sapiens
cagctcagtctggagagatgca

SEQ ID NO: 7879703 - DNA, 22 bp, Homo sapiens
cagctcaggctctccatgctcc

SEQ ID NO: 7879704 - DNA, 22 bp, Homo sapiens
cagctcaggctctccatgctcc

SEQ ID NO: 7879705 - DNA, 22 bp, Homo sapiens
cagctcaggctctccatgctcc

SEQ ID NO: 7879706 - DNA, 19 bp, Homo sapiens
cagctcaggactcagcccc

SEQ ID NO: 7879707 - DNA, 22 bp, Homo sapiens
cagctcaggcactggcgcggga

SEQ ID NO: 7879708 - DNA, 22 bp, Homo sapiens
cagctcaggcactggcgcggga

SEQ ID NO: 7879709 - DNA, 22 bp, Homo sapiens
cagctcaggcactggcgcggga

SEQ ID NO: 7879710 - DNA, 22 bp, Homo sapiens
cagctcaggctctccatgctcc

SEQ ID NO: 7879711 - DNA, 22 bp, Homo sapiens
cagctcaggctctccatgctcc

SEQ ID NO: 7879712 - DNA, 22 bp, Homo sapiens
cagctcaggctctccatgctcc

SEQ ID NO: 7879713 - DNA, 22 bp, Homo sapiens
cagctcaggctctccatgctcc

SEQ ID NO: 7879714 - DNA, 22 bp, Homo sapiens
agctcagagataatcaagagac

SEQ ID NO: 7879715 - DNA, 22 bp, Homo sapiens
agctcagagataatcaagagac

SEQ ID NO: 7879716 - DNA, 22 bp, Homo sapiens
agctcagagataatcaagagac

SEQ ID NO: 7879717 - DNA, 22 bp, Homo sapiens
agctcagagataatcaagagac

SEQ ID NO: 7879718 - DNA, 22 bp, Homo sapiens
agctcagagataatcaagagac

SEQ ID NO: 7879719 - DNA, 22 bp, Homo sapiens
agctcagagctcgggaggatgg

SEQ ID NO: 7879720 - DNA, 22 bp, Homo sapiens
agctcagagataatcaagagac

SEQ ID NO: 7879721 - DNA, 22 bp, Homo sapiens
agctcagagctcgggaggatgg

SEQ ID NO: 7879722 - DNA, 22 bp, Homo sapiens
agctcagagggaggtgaagtgg

SEQ ID NO: 7879723 - DNA, 22 bp, Homo sapiens
agctcagcactgtcagcactcc

SEQ ID NO: 7879724 - DNA, 22 bp, Homo sapiens
agctcagcccgttagtaagccc

SEQ ID NO: 7879725 - DNA, 22 bp, Homo sapiens
agctcagagggaggtgaagtgg

SEQ ID NO: 7879726 - DNA, 21 bp, Homo sapiens
agctcagcaagatggaggctc

SEQ ID NO: 7879727 - DNA, 22 bp, Homo sapiens
agctcagagggaggtgaagtgg

SEQ ID NO: 7879728 - DNA, 22 bp, Homo sapiens
agctcagccctcctgtgcagct

SEQ ID NO: 7879729 - DNA, 21 bp, Homo sapiens
agctcagccgggcacagtggc

SEQ ID NO: 7879730 - DNA, 21 bp, Homo sapiens
agctcagccgggcacagtggc

SEQ ID NO: 7879731 - DNA, 22 bp, Homo sapiens
agctcagcgggcttctggtaag

SEQ ID NO: 7879732 - DNA, 22 bp, Homo sapiens
agctcagcttcctctccatgct

SEQ ID NO: 7879733 - DNA, 22 bp, Homo sapiens
agctcagcttcctctccatgct

SEQ ID NO: 7879734 - DNA, 22 bp, Homo sapiens
agctcaggcaactctgggcccc

SEQ ID NO: 7879735 - DNA, 22 bp, Homo sapiens
agctcaggcaactctgggcccc

SEQ ID NO: 7879736 - DNA, 22 bp, Homo sapiens
agctcagcttcctctccatgct

SEQ ID NO: 7879737 - DNA, 22 bp, Homo sapiens
cagctcagtctggagagatgca

SEQ ID NO: 7879738 - DNA, 22 bp, Homo sapiens
cagctcagtcttgaagcactgg

SEQ ID NO: 7879739 - DNA, 22 bp, Homo sapiens
cagctcagtcttgaagcactgg

SEQ ID NO: 7879740 - DNA, 22 bp, Homo sapiens
cagctcagtcttgaagcactgg

SEQ ID NO: 7879741 - DNA, 22 bp, Homo sapiens
cagctcagtgatgccttcacag

SEQ ID NO: 7879742 - DNA, 22 bp, Homo sapiens
cagctcagtttcaataccaggt

SEQ ID NO: 7879743 - DNA, 22 bp, Homo sapiens
cagctcagtttcaataccaggt

SEQ ID NO: 7879744 - DNA, 22 bp, Homo sapiens
cagctcagtttcaataccaggt

SEQ ID NO: 7879745 - DNA, 22 bp, Homo sapiens
cagctcagtgatgccttcacag

SEQ ID NO: 7879746 - DNA, 22 bp, Homo sapiens
cagctcattcctcaatctagga

SEQ ID NO: 7879747 - DNA, 22 bp, Homo sapiens
agctcctgaaaatccagactgg

SEQ ID NO: 7879748 - DNA, 22 bp, Homo sapiens
agctcctgaaaatccagactgg

SEQ ID NO: 7879749 - DNA, 22 bp, Homo sapiens
agctcctgaaaatccagactgg

SEQ ID NO: 7879750 - DNA, 18 bp, Homo sapiens
agctcctgaactctgtgg

SEQ ID NO: 7879751 - DNA, 18 bp, Homo sapiens
agctcctgaactctgtgg

SEQ ID NO: 7879752 - DNA, 18 bp, Homo sapiens
agctcctgaactctgtgg

SEQ ID NO: 7879753 - DNA, 18 bp, Homo sapiens
agctcctgaactctgtgg

SEQ ID NO: 7879754 - DNA, 22 bp, Homo sapiens
cagctccaaagccccactgtcc

SEQ ID NO: 7879755 - DNA, 22 bp, Homo sapiens
cagctccaaagccccactgtcc

SEQ ID NO: 7879756 - DNA, 22 bp, Homo sapiens
agctcctgaaaagcgcttgctt

SEQ ID NO: 7879757 - DNA, 22 bp, Homo sapiens
agctcctgaaaagcgcttgctt

SEQ ID NO: 7879758 - DNA, 22 bp, Homo sapiens
agctcctgaaaatccagactgg

SEQ ID NO: 7879759 - DNA, 22 bp, Homo sapiens
agctcctgaaaatccagactgg

SEQ ID NO: 7879760 - DNA, 22 bp, Homo sapiens
agctcctgaaaatccagactgg

SEQ ID NO: 7879761 - DNA, 22 bp, Homo sapiens
agctcctgattctcagagatag

SEQ ID NO: 7879762 - DNA, 22 bp, Homo sapiens
agctcctgattctcagagatag

SEQ ID NO: 7879763 - DNA, 22 bp, Homo sapiens
agctcctgattctcagagatag

SEQ ID NO: 7879764 - DNA, 22 bp, Homo sapiens
cagctctgacacagtacaaaat

SEQ ID NO: 7879765 - DNA, 22 bp, Homo sapiens
cagctctgagactgaggctatg

SEQ ID NO: 7879766 - DNA, 22 bp, Homo sapiens
cagctctgagactgaggctatg

SEQ ID NO: 7879767 - DNA, 20 bp, Homo sapiens
cagctctgggcaggtcgagg

SEQ ID NO: 7879768 - DNA, 22 bp, Homo sapiens
cagctctgagactgaggctatg

SEQ ID NO: 7879769 - DNA, 22 bp, Homo sapiens
cagctctgagactgaggctatg

SEQ ID NO: 7879770 - DNA, 22 bp, Homo sapiens
agctcctgatacatgcaggaat

SEQ ID NO: 7879771 - DNA, 22 bp, Homo sapiens
agctcctgatacatgcaggaat

SEQ ID NO: 7879772 - DNA, 22 bp, Homo sapiens
agctcctgatacatgcaggaat

SEQ ID NO: 7879773 - DNA, 22 bp, Homo sapiens
agctcctgatacatgcaggaat

SEQ ID NO: 7879774 - DNA, 22 bp, Homo sapiens
agctcctgatacatgcaggaat

SEQ ID NO: 7879775 - DNA, 22 bp, Homo sapiens
agctcctgattctcagagatag

SEQ ID NO: 7879776 - DNA, 22 bp, Homo sapiens
agctcctgattctcagagatag

SEQ ID NO: 7879777 - DNA, 22 bp, Homo sapiens
agctcctgattctcagagatag

SEQ ID NO: 7879778 - DNA, 22 bp, Homo sapiens
agctcctgattctcagagatag

SEQ ID NO: 7879779 - DNA, 23 bp, Homo sapiens
agctcctgaggccagcctctcct

SEQ ID NO: 7879780 - DNA, 23 bp, Homo sapiens
agctcctgaggccagcctctcct

SEQ ID NO: 7879781 - DNA, 23 bp, Homo sapiens
agctcctgaggccagcctctcct

SEQ ID NO: 7879782 - DNA, 23 bp, Homo sapiens
agctcctgaggccagcctctcct

SEQ ID NO: 7879783 - DNA, 23 bp, Homo sapiens
agctcctgaggccagcctctcct

SEQ ID NO: 7879784 - DNA, 23 bp, Homo sapiens
agctcctgaggccagcctctcct

SEQ ID NO: 7879785 - DNA, 23 bp, Homo sapiens
agctcctgaggccagcctctcct

SEQ ID NO: 7879786 - DNA, 20 bp, Homo sapiens
agctcctgagggttactttc

SEQ ID NO: 7879787 - DNA, 23 bp, Homo sapiens
agctcctgaggccagcctctcct

SEQ ID NO: 7879788 - DNA, 22 bp, Homo sapiens
agctcctgatacatgcaggaat

SEQ ID NO: 7879789 - DNA, 22 bp, Homo sapiens
agctcctgatacatgcaggaat

SEQ ID NO: 7879790 - DNA, 22 bp, Homo sapiens
agctcctgatacatgcaggaat

SEQ ID NO: 7879791 - DNA, 22 bp, Homo sapiens
agctcctgatacatgcaggaat

SEQ ID NO: 7879792 - DNA, 22 bp, Homo sapiens
agctcctgagtagctttactca

SEQ ID NO: 7879793 - DNA, 20 bp, Homo sapiens
agctcctgagggttactttc

SEQ ID NO: 7879794 - DNA, 20 bp, Homo sapiens
agctcctgagggttactttc

SEQ ID NO: 7879795 - DNA, 22 bp, Homo sapiens
agctcctgagtagctttactca

SEQ ID NO: 7879796 - DNA, 22 bp, Homo sapiens
cagcagtgtggaagctgagggg

SEQ ID NO: 7879797 - DNA, 22 bp, Homo sapiens
cagcagtgtggaagctgagggg

SEQ ID NO: 7879798 - DNA, 22 bp, Homo sapiens
cagcagtgtggaagctgagggg

SEQ ID NO: 7879799 - DNA, 22 bp, Homo sapiens
cagcagtgtggaagctgagggg

SEQ ID NO: 7879800 - DNA, 22 bp, Homo sapiens
cagcagtgtggaagctgagggg

SEQ ID NO: 7879801 - DNA, 22 bp, Homo sapiens
cagcagttatgagtagaatagt

SEQ ID NO: 7879802 - DNA, 22 bp, Homo sapiens
cagcagttatgagtagaatagt

SEQ ID NO: 7879803 - DNA, 22 bp, Homo sapiens
cagcagttatgagtagaatagt

SEQ ID NO: 7879804 - DNA, 22 bp, Homo sapiens
cagcagttcaatccagtgcacg

SEQ ID NO: 7879805 - DNA, 22 bp, Homo sapiens
cagcagttcacacttaacaagt

SEQ ID NO: 7879806 - DNA, 21 bp, Homo sapiens
cagcagtgtgtctgagctaga

SEQ ID NO: 7879807 - DNA, 21 bp, Homo sapiens
cagcagtgtgtctgagctaga

SEQ ID NO: 7879808 - DNA, 22 bp, Homo sapiens
cagcagttatgagtagaatagt

SEQ ID NO: 7879809 - DNA, 22 bp, Homo sapiens
cagcataggatgtggagccagg

SEQ ID NO: 7879810 - DNA, 22 bp, Homo sapiens
cagcatatctgagttgaaagag

SEQ ID NO: 7879811 - DNA, 22 bp, Homo sapiens
cagcatatctgagttgaaagag

SEQ ID NO: 7879812 - DNA, 22 bp, Homo sapiens
cagcatactgcatcaaatgagg

SEQ ID NO: 7879813 - DNA, 22 bp, Homo sapiens
cagcagttttgaagtgtggaga

SEQ ID NO: 7879814 - DNA, 22 bp, Homo sapiens
cagcagttttgaagtgtggaga

SEQ ID NO: 7879815 - DNA, 22 bp, Homo sapiens
cagcagttcaggctccttcccg

SEQ ID NO: 7879816 - DNA, 22 bp, Homo sapiens
cagcagttctgtactttagagt

SEQ ID NO: 7879817 - DNA, 22 bp, Homo sapiens
cagcagttctgtactttagagt

SEQ ID NO: 7879818 - DNA, 22 bp, Homo sapiens
cagcagttctgtactttagagt

SEQ ID NO: 7879819 - DNA, 22 bp, Homo sapiens
cagcagttttgaagtgtggaga

SEQ ID NO: 7879820 - DNA, 22 bp, Homo sapiens
cagcagtttcctatggttcagc

SEQ ID NO: 7879821 - DNA, 22 bp, Homo sapiens
cagcagttgtttcggattggga

SEQ ID NO: 7879822 - DNA, 22 bp, Homo sapiens
cagcagggtatacagggaattt

SEQ ID NO: 7879823 - DNA, 22 bp, Homo sapiens
cagcagggtatacagggaattt

SEQ ID NO: 7879824 - DNA, 22 bp, Homo sapiens
cagcagggtaggttgtatcagt

SEQ ID NO: 7879825 - DNA, 22 bp, Homo sapiens
cagcagggtatacagggaattt

SEQ ID NO: 7879826 - DNA, 22 bp, Homo sapiens
cagcagggtatacagggaattt

SEQ ID NO: 7879827 - DNA, 22 bp, Homo sapiens
cagcagtgtctccagcatcaca

SEQ ID NO: 7879828 - DNA, 22 bp, Homo sapiens
cagcagtgtgcaggtgtgctgg

SEQ ID NO: 7879829 - DNA, 22 bp, Homo sapiens
cagcagggttaagtgactcacc

SEQ ID NO: 7879830 - DNA, 22 bp, Homo sapiens
cagcagtgtctccagcatcaca

SEQ ID NO: 7879831 - DNA, 22 bp, Homo sapiens
cagcaggggaactgtgggccag

SEQ ID NO: 7879832 - DNA, 22 bp, Homo sapiens
cagcaggggaactgtgggccag

SEQ ID NO: 7879833 - DNA, 22 bp, Homo sapiens
cagcaggggaactgtgggccag

SEQ ID NO: 7879834 - DNA, 22 bp, Homo sapiens
cagcagggggcagcgcagatca

SEQ ID NO: 7879835 - DNA, 22 bp, Homo sapiens
cagcagggcccccgggtgcgcc

SEQ ID NO: 7879836 - DNA, 22 bp, Homo sapiens
cagcaggggaactgtgggccag

SEQ ID NO: 7879837 - DNA, 22 bp, Homo sapiens
cagcaggggtgtcattgtagtt

SEQ ID NO: 7879838 - DNA, 22 bp, Homo sapiens
cagcaggggtgtcattgtagtt

SEQ ID NO: 7879839 - DNA, 22 bp, Homo sapiens
cagcagggggcagcgcagatca

SEQ ID NO: 7879840 - DNA, 22 bp, Homo sapiens
cagcagggggcagcgcagatca

SEQ ID NO: 7879841 - DNA, 22 bp, Homo sapiens
cagcagggggcagcgcagatca

SEQ ID NO: 7879842 - DNA, 22 bp, Homo sapiens
cagccctgagagaaccatctat

SEQ ID NO: 7879843 - DNA, 22 bp, Homo sapiens
cagccctgagagaaccatctat

SEQ ID NO: 7879844 - DNA, 22 bp, Homo sapiens
cagccctgagagaaccatctat

SEQ ID NO: 7879845 - DNA, 22 bp, Homo sapiens
cagccctgagagaaccatctat

SEQ ID NO: 7879846 - DNA, 22 bp, Homo sapiens
cagccctgagcaaggcttttaa

SEQ ID NO: 7879847 - DNA, 23 bp, Homo sapiens
cagccctgaaatcgaggtgacac

SEQ ID NO: 7879848 - DNA, 22 bp, Homo sapiens
cagccctgagaaggaggatctc

SEQ ID NO: 7879849 - DNA, 22 bp, Homo sapiens
cagccctgagaaggaggatctc

SEQ ID NO: 7879850 - DNA, 22 bp, Homo sapiens
cagccctgagaaggaggatctc

SEQ ID NO: 7879851 - DNA, 22 bp, Homo sapiens
cagccccacacggtctagctct

SEQ ID NO: 7879852 - DNA, 22 bp, Homo sapiens
cagcatattactttaaaaaatc

SEQ ID NO: 7879853 - DNA, 20 bp, Homo sapiens
cagcatcaaaggaaggtttg

SEQ ID NO: 7879854 - DNA, 22 bp, Homo sapiens
cagccccagcacttagctgagt

SEQ ID NO: 7879855 - DNA, 22 bp, Homo sapiens
cagccccagcacttagctgagt

SEQ ID NO: 7879856 - DNA, 22 bp, Homo sapiens
cagccccatggtgtgctccagc

SEQ ID NO: 7879857 - DNA, 22 bp, Homo sapiens
cagccccatggtgtgctccagc

SEQ ID NO: 7879858 - DNA, 23 bp, Homo sapiens
cagccctgaaatcgaggtgacac

SEQ ID NO: 7879859 - DNA, 22 bp, Homo sapiens
cagccctgagttagcccacgga

SEQ ID NO: 7879860 - DNA, 22 bp, Homo sapiens
cagccctgagttagcccacgga

SEQ ID NO: 7879861 - DNA, 22 bp, Homo sapiens
cagccctgagttagcccacgga

SEQ ID NO: 7879862 - DNA, 22 bp, Homo sapiens
cagccctgagttagcccacgga

SEQ ID NO: 7879863 - DNA, 22 bp, Homo sapiens
cagccctgagttagcccacgga

SEQ ID NO: 7879864 - DNA, 22 bp, Homo sapiens
cagccctgagcaaggcttttaa

SEQ ID NO: 7879865 - DNA, 16 bp, Homo sapiens
cagccctgaggaagaa

SEQ ID NO: 7879866 - DNA, 16 bp, Homo sapiens
cagccctgaggaagaa

SEQ ID NO: 7879867 - DNA, 22 bp, Homo sapiens
cagccctgcacgctgcctccgc

SEQ ID NO: 7879868 - DNA, 22 bp, Homo sapiens
cagccctgcacgctgcctccgc

SEQ ID NO: 7879869 - DNA, 22 bp, Homo sapiens
cagccctgcacgctgcctccgc

SEQ ID NO: 7879870 - DNA, 22 bp, Homo sapiens
cagccctgcacgctgcctccgc

SEQ ID NO: 7879871 - DNA, 22 bp, Homo sapiens
cagccctgcacgctgcctccgc

SEQ ID NO: 7879872 - DNA, 22 bp, Homo sapiens
cagccctgcacgctgcctccgc

SEQ ID NO: 7879873 - DNA, 22 bp, Homo sapiens
cagccctgagttagcccacgga

SEQ ID NO: 7879874 - DNA, 22 bp, Homo sapiens
cagccctgagttagcccacgga

SEQ ID NO: 7879875 - DNA, 22 bp, Homo sapiens
cagccctgcagagggcgctcct

SEQ ID NO: 7879876 - DNA, 22 bp, Homo sapiens
cagccctgcagagggcgctcct

SEQ ID NO: 7879877 - DNA, 22 bp, Homo sapiens
cagccctgcagagggcgctcct

SEQ ID NO: 7879878 - DNA, 22 bp, Homo sapiens
cagccctgcagagggcgctcct

SEQ ID NO: 7879879 - DNA, 22 bp, Homo sapiens
agctcagagaatagggcttgag

SEQ ID NO: 7879880 - DNA, 22 bp, Homo sapiens
agctcagagataatcaagagac

SEQ ID NO: 7879881 - DNA, 22 bp, Homo sapiens
agctcagagaatagggcttgag

SEQ ID NO: 7879882 - DNA, 22 bp, Homo sapiens
cagccctgcagagggcgctcct

SEQ ID NO: 7879883 - DNA, 22 bp, Homo sapiens
cagccctgcacgctgcctccgc

SEQ ID NO: 7879884 - DNA, 22 bp, Homo sapiens
cagccctgcacgctgcctccgc

SEQ ID NO: 7879885 - DNA, 22 bp, Homo sapiens
agcatataaatggacatatttg

SEQ ID NO: 7879886 - DNA, 22 bp, Homo sapiens
agcatataaatggacatatttg

SEQ ID NO: 7879887 - DNA, 22 bp, Homo sapiens
agcataggtggagattagtgtt

SEQ ID NO: 7879888 - DNA, 22 bp, Homo sapiens
agcataggtggagattagtgtt

SEQ ID NO: 7879889 - DNA, 22 bp, Homo sapiens
agcatagagtcctgagggcagg

SEQ ID NO: 7879890 - DNA, 22 bp, Homo sapiens
agcatagatacattgagccaca

SEQ ID NO: 7879891 - DNA, 22 bp, Homo sapiens
agcatagatacattgagccaca

SEQ ID NO: 7879892 - DNA, 22 bp, Homo sapiens
agcatagattctttcctttgcc

SEQ ID NO: 7879893 - DNA, 22 bp, Homo sapiens
agcatagatacattgagccaca

SEQ ID NO: 7879894 - DNA, 22 bp, Homo sapiens
agcataggcggtggtaggaccc

SEQ ID NO: 7879895 - DNA, 22 bp, Homo sapiens
agcatagggtcctagtacacag

SEQ ID NO: 7879896 - DNA, 22 bp, Homo sapiens
agcataggcggtggtaggaccc

SEQ ID NO: 7879897 - DNA, 22 bp, Homo sapiens
agcatatacaaactcatataca

SEQ ID NO: 7879898 - DNA, 22 bp, Homo sapiens
agcatatacaaactcatataca

SEQ ID NO: 7879899 - DNA, 22 bp, Homo sapiens
agcatatacaaactcatataca

SEQ ID NO: 7879900 - DNA, 22 bp, Homo sapiens
agcatataaatggacatatttg

SEQ ID NO: 7879901 - DNA, 22 bp, Homo sapiens
agccacagtctgtagccagctt

SEQ ID NO: 7879902 - DNA, 22 bp, Homo sapiens
agccacagtctgtagccagctt

SEQ ID NO: 7879903 - DNA, 22 bp, Homo sapiens
agccacagtctgtagccagctt

SEQ ID NO: 7879904 - DNA, 22 bp, Homo sapiens
agccacagtctgtagccagctt

SEQ ID NO: 7879905 - DNA, 22 bp, Homo sapiens
agccacagtctgtagccagctt

SEQ ID NO: 7879906 - DNA, 22 bp, Homo sapiens
agccacagtgcaagagagaaaa

SEQ ID NO: 7879907 - DNA, 22 bp, Homo sapiens
agccacaggaaacagagacagc

SEQ ID NO: 7879908 - DNA, 22 bp, Homo sapiens
agccacaggaaacagagacagc

SEQ ID NO: 7879909 - DNA, 22 bp, Homo sapiens
agccacaggaaacagagacagc

SEQ ID NO: 7879910 - DNA, 22 bp, Homo sapiens
agccacaggaaacagagacagc

SEQ ID NO: 7879911 - DNA, 22 bp, Homo sapiens
agccacaggaaacagagacagc

SEQ ID NO: 7879912 - DNA, 22 bp, Homo sapiens
agccacaggaaacagagacagc

SEQ ID NO: 7879913 - DNA, 22 bp, Homo sapiens
agccacaggaaacagagacagc

SEQ ID NO: 7879914 - DNA, 22 bp, Homo sapiens
agcatatagctatctttgattg

SEQ ID NO: 7879915 - DNA, 22 bp, Homo sapiens
agcatatacaaactcatataca

SEQ ID NO: 7879916 - DNA, 22 bp, Homo sapiens
agcatatacaaactcatataca

SEQ ID NO: 7879917 - DNA, 22 bp, Homo sapiens
agccacccattcccgagcccta

SEQ ID NO: 7879918 - DNA, 22 bp, Homo sapiens
agccaccaccactgaaaggtta

SEQ ID NO: 7879919 - DNA, 22 bp, Homo sapiens
agccaccaccactgaaaggtta

SEQ ID NO: 7879920 - DNA, 22 bp, Homo sapiens
agccacatttttctgctcctga

SEQ ID NO: 7879921 - DNA, 22 bp, Homo sapiens
agccacatggacctgatgctag

SEQ ID NO: 7879922 - DNA, 22 bp, Homo sapiens
agccacatttttctgctcctga

SEQ ID NO: 7879923 - DNA, 22 bp, Homo sapiens
agccacatgagtgagccatctt

SEQ ID NO: 7879924 - DNA, 22 bp, Homo sapiens
agccacagtgcaagagagaaaa

SEQ ID NO: 7879925 - DNA, 22 bp, Homo sapiens
agccacagtgcaagagagaaaa

SEQ ID NO: 7879926 - DNA, 22 bp, Homo sapiens
agccacagtgcaagagagaaaa

SEQ ID NO: 7879927 - DNA, 22 bp, Homo sapiens
agccacagtgcaagagagaaaa

SEQ ID NO: 7879928 - DNA, 22 bp, Homo sapiens
agccacagtgggctaccagctc

SEQ ID NO: 7879929 - DNA, 22 bp, Homo sapiens
agccacagtgggctaccagctc

SEQ ID NO: 7879930 - DNA, 22 bp, Homo sapiens
agccacagtgggctaccagctc

SEQ ID NO: 7879931 - DNA, 22 bp, Homo sapiens
agccacagtgggctaccagctc

SEQ ID NO: 7879932 - DNA, 22 bp, Homo sapiens
agccacgtccctgtcagggtca

SEQ ID NO: 7879933 - DNA, 22 bp, Homo sapiens
agccactccttcagcgtctgct

SEQ ID NO: 7879934 - DNA, 22 bp, Homo sapiens
agccaccttcacatggtctatc

SEQ ID NO: 7879935 - DNA, 22 bp, Homo sapiens
agccaccttcacatggtctatc

SEQ ID NO: 7879936 - DNA, 22 bp, Homo sapiens
agccaccttctccaaggcctag

SEQ ID NO: 7879937 - DNA, 22 bp, Homo sapiens
agccacctctatcttgggctcc

SEQ ID NO: 7879938 - DNA, 22 bp, Homo sapiens
agccacctctgtgcaggcctcg

SEQ ID NO: 7879939 - DNA, 22 bp, Homo sapiens
agccacctggacacaggcttgc

SEQ ID NO: 7879940 - DNA, 22 bp, Homo sapiens
agccacctctgtgcaggcctcg

SEQ ID NO: 7879941 - DNA, 22 bp, Homo sapiens
agccacccattcccgagcccta

SEQ ID NO: 7879942 - DNA, 22 bp, Homo sapiens
agccacccattcccgagcccta

SEQ ID NO: 7879943 - DNA, 22 bp, Homo sapiens
agccaccctaccagccctgaaa

SEQ ID NO: 7879944 - DNA, 16 bp, Homo sapiens
agccacctcagaggac

SEQ ID NO: 7879945 - DNA, 22 bp, Homo sapiens
agccacctcacctgctgccgtt

SEQ ID NO: 7879946 - DNA, 22 bp, Homo sapiens
agccacctcacctgctgccgtt

SEQ ID NO: 7879947 - DNA, 22 bp, Homo sapiens
agccacctcctgctctgctcac

SEQ ID NO: 7879948 - DNA, 22 bp, Homo sapiens
agccacctcctgctctgctcac

SEQ ID NO: 7879949 - DNA, 20 bp, Homo sapiens
agccacctcatttccctacc

SEQ ID NO: 7879950 - DNA, 22 bp, Homo sapiens
cagaaatatttattgagtgaca

SEQ ID NO: 7879951 - DNA, 22 bp, Homo sapiens
cagaaatatttattgagtgaca

SEQ ID NO: 7879952 - DNA, 22 bp, Homo sapiens
cagaaatatttattgagtgaca

SEQ ID NO: 7879953 - DNA, 22 bp, Homo sapiens
cagaaatatttattgagtgaca

SEQ ID NO: 7879954 - DNA, 22 bp, Homo sapiens
cagaaatattccaagtactgca

SEQ ID NO: 7879955 - DNA, 22 bp, Homo sapiens
cagaaatattccaagtactgca

SEQ ID NO: 7879956 - DNA, 22 bp, Homo sapiens
cagaaatattccaagtactgca

SEQ ID NO: 7879957 - DNA, 22 bp, Homo sapiens
cagaaatattccaagtactgca

SEQ ID NO: 7879958 - DNA, 22 bp, Homo sapiens
cagaaatatgtgccatgcctta

SEQ ID NO: 7879959 - DNA, 22 bp, Homo sapiens
cagaaatatgtgccatgcctta

SEQ ID NO: 7879960 - DNA, 22 bp, Homo sapiens
cagaaatatgtgccatgcctta

SEQ ID NO: 7879961 - DNA, 22 bp, Homo sapiens
cagaaatatgtgccatgcctta

SEQ ID NO: 7879962 - DNA, 22 bp, Homo sapiens
cagaaatatgtgccatgcctta

SEQ ID NO: 7879963 - DNA, 22 bp, Homo sapiens
cagaaatattccaagtactgca

SEQ ID NO: 7879964 - DNA, 22 bp, Homo sapiens
cagaaatattccaagtactgca

SEQ ID NO: 7879965 - DNA, 22 bp, Homo sapiens
cagaaatattccaagtactgca

SEQ ID NO: 7879966 - DNA, 22 bp, Homo sapiens
cagaaatattccaagtactgca

SEQ ID NO: 7879967 - DNA, 22 bp, Homo sapiens
cagaaatattccaagtactgca

SEQ ID NO: 7879968 - DNA, 22 bp, Homo sapiens
cagaaatattccaagtactgca

SEQ ID NO: 7879969 - DNA, 22 bp, Homo sapiens
cagaaatctccatgtcagacat

SEQ ID NO: 7879970 - DNA, 22 bp, Homo sapiens
cagaaatcattgtgatgacagg

SEQ ID NO: 7879971 - DNA, 22 bp, Homo sapiens
cagaaggagggggcaagccctg

SEQ ID NO: 7879972 - DNA, 22 bp, Homo sapiens
cagaaatctccatgtcagacat

SEQ ID NO: 7879973 - DNA, 22 bp, Homo sapiens
cagaaggagcgctaaggtccca

SEQ ID NO: 7879974 - DNA, 22 bp, Homo sapiens
cagaaatatttattgagtgaca

SEQ ID NO: 7879975 - DNA, 22 bp, Homo sapiens
cagaaatatttattgagtgaca

SEQ ID NO: 7879976 - DNA, 18 bp, Homo sapiens
cagaaatcacaccagcac

SEQ ID NO: 7879977 - DNA, 18 bp, Homo sapiens
cagaaatcacaccagcac

SEQ ID NO: 7879978 - DNA, 18 bp, Homo sapiens
cagaaatcacaccagcac

SEQ ID NO: 7879979 - DNA, 22 bp, Homo sapiens
cagaataagctgtgttgtcaag

SEQ ID NO: 7879980 - DNA, 22 bp, Homo sapiens
cagaaggcaaacaaaaggattt

SEQ ID NO: 7879981 - DNA, 22 bp, Homo sapiens
cagaaggagggggcaagccctg

SEQ ID NO: 7879982 - DNA, 22 bp, Homo sapiens
cagaataatattggtctcatag

SEQ ID NO: 7879983 - DNA, 22 bp, Homo sapiens
cagaataccctatagacagaat

SEQ ID NO: 7879984 - DNA, 22 bp, Homo sapiens
cagaataccctatagacagaat

SEQ ID NO: 7879985 - DNA, 22 bp, Homo sapiens
cagaataccctatagacagaat

SEQ ID NO: 7879986 - DNA, 22 bp, Homo sapiens
cagaataatattggtctcatag

SEQ ID NO: 7879987 - DNA, 22 bp, Homo sapiens
cagaaatatcagttgaaagtgc

SEQ ID NO: 7879988 - DNA, 22 bp, Homo sapiens
cagaaatatcagttgaaagtgc

SEQ ID NO: 7879989 - DNA, 22 bp, Homo sapiens
cagaaatatcagttgaaagtgc

SEQ ID NO: 7879990 - DNA, 22 bp, Homo sapiens
cagaaatatcagttgaaagtgc

SEQ ID NO: 7879991 - DNA, 22 bp, Homo sapiens
cagaaatatcagttgaaagtgc

SEQ ID NO: 7879992 - DNA, 22 bp, Homo sapiens
cagaaatatcagttgaaagtgc

SEQ ID NO: 7879993 - DNA, 22 bp, Homo sapiens
cagaaatatcagttgaaagtgc

SEQ ID NO: 7879994 - DNA, 22 bp, Homo sapiens
cagaaatatatatgggtcagag

SEQ ID NO: 7879995 - DNA, 22 bp, Homo sapiens
cagaaatatcacctggactcta

SEQ ID NO: 7879996 - DNA, 22 bp, Homo sapiens
cagaaatatcacctggactcta

SEQ ID NO: 7879997 - DNA, 22 bp, Homo sapiens
cagaaatatcacctggactcta

SEQ ID NO: 7879998 - DNA, 22 bp, Homo sapiens
cagaaatatcagttgaaagtgc

SEQ ID NO: 7879999 - DNA, 22 bp, Homo sapiens
cagaaatatcagttgaaagtgc

SEQ ID NO: 7880000 - DNA, 22 bp, Homo sapiens
cagaaatatcagttgaaagtgc

SEQ ID NO: 7880001 - DNA, 21 bp, Homo sapiens
cagaaatatgaatgatggtga

SEQ ID NO: 7880002 - DNA, 21 bp, Homo sapiens
cagaaatatgaatgatggtga

SEQ ID NO: 7880003 - DNA, 21 bp, Homo sapiens
cagaaatatgaatgatggtga

SEQ ID NO: 7880004 - DNA, 22 bp, Homo sapiens
agccactgtctgaacttctgtg

SEQ ID NO: 7880005 - DNA, 22 bp, Homo sapiens
agccactgtaaggggaattgcc

SEQ ID NO: 7880006 - DNA, 22 bp, Homo sapiens
agccactgtaaggggaattgcc

SEQ ID NO: 7880007 - DNA, 19 bp, Homo sapiens
cagaaatagcgaagtgtaa

SEQ ID NO: 7880008 - DNA, 22 bp, Homo sapiens
cagaaatatatatgggtcagag

SEQ ID NO: 7880009 - DNA, 22 bp, Homo sapiens
agccactggtaaactggtagga

SEQ ID NO: 7880010 - DNA, 22 bp, Homo sapiens
agccactgcccttagccatttg

SEQ ID NO: 7880011 - DNA, 22 bp, Homo sapiens
agccactgcccttagccatttg

SEQ ID NO: 7880012 - DNA, 22 bp, Homo sapiens
agccactggcctgggcagctct

SEQ ID NO: 7880013 - DNA, 22 bp, Homo sapiens
cagaatgtagatcatcatcaag

SEQ ID NO: 7880014 - DNA, 22 bp, Homo sapiens
cagaatgtatatgatctaaggt

SEQ ID NO: 7880015 - DNA, 22 bp, Homo sapiens
cagaatgtagatcatcatcaag

SEQ ID NO: 7880016 - DNA, 22 bp, Homo sapiens
cagaatgtatatgatctaaggt

SEQ ID NO: 7880017 - DNA, 20 bp, Homo sapiens
cagaatgctgtaatcaagaa

SEQ ID NO: 7880018 - DNA, 22 bp, Homo sapiens
cagaatggcttttatggctcag

SEQ ID NO: 7880019 - DNA, 22 bp, Homo sapiens
cagaatgggaaggactgcagtt

SEQ ID NO: 7880020 - DNA, 22 bp, Homo sapiens
cagaatgggaaggactgcagtt

SEQ ID NO: 7880021 - DNA, 22 bp, Homo sapiens
cagaatgtatatgatctaaggt

SEQ ID NO: 7880022 - DNA, 22 bp, Homo sapiens
cagaatgtatatgatctaaggt

SEQ ID NO: 7880023 - DNA, 22 bp, Homo sapiens
agccactgtgagaggaccaggg

SEQ ID NO: 7880024 - DNA, 22 bp, Homo sapiens
agccactgtctgaacttctgtg

SEQ ID NO: 7880025 - DNA, 22 bp, Homo sapiens
cagaatgtattctcataaagcc

SEQ ID NO: 7880026 - DNA, 22 bp, Homo sapiens
agccactgtgagaggaccaggg

SEQ ID NO: 7880027 - DNA, 22 bp, Homo sapiens
agccactgtgagaggaccaggg

SEQ ID NO: 7880028 - DNA, 22 bp, Homo sapiens
agccactgtgagaggaccaggg

SEQ ID NO: 7880029 - DNA, 22 bp, Homo sapiens
agccagaaaaacaccaagagga

SEQ ID NO: 7880030 - DNA, 22 bp, Homo sapiens
agccactttagataccatctta

SEQ ID NO: 7880031 - DNA, 22 bp, Homo sapiens
agccagaaaaacaccaagagga

SEQ ID NO: 7880032 - DNA, 22 bp, Homo sapiens
agccagaaaggggcattatctg

SEQ ID NO: 7880033 - DNA, 22 bp, Homo sapiens
agccagaacgcatcgccaaggc

SEQ ID NO: 7880034 - DNA, 22 bp, Homo sapiens
agccagaacgcatcgccaaggc

SEQ ID NO: 7880035 - DNA, 22 bp, Homo sapiens
agccagaaccactggaacggtg

SEQ ID NO: 7880036 - DNA, 22 bp, Homo sapiens
agccagaaccactggaacggtg

SEQ ID NO: 7880037 - DNA, 22 bp, Homo sapiens
agccagaaccactggaacggtg

SEQ ID NO: 7880038 - DNA, 19 bp, Homo sapiens
agccagaactagtgtttct

SEQ ID NO: 7880039 - DNA, 22 bp, Homo sapiens
agccactgtgcaggagcagtgt

SEQ ID NO: 7880040 - DNA, 22 bp, Homo sapiens
agccactgtgcaggagcagtgt

SEQ ID NO: 7880041 - DNA, 22 bp, Homo sapiens
agccactgtgtgaccagctgtc

SEQ ID NO: 7880042 - DNA, 22 bp, Homo sapiens
agccactgtgcaggagcagtgt

SEQ ID NO: 7880043 - DNA, 22 bp, Homo sapiens
agccactgtgcaggagcagtgt

SEQ ID NO: 7880044 - DNA, 23 bp, Homo sapiens
agccacttctatcttgctcctgg

SEQ ID NO: 7880045 - DNA, 22 bp, Homo sapiens
agccactgtgtgaccagctgtc

SEQ ID NO: 7880046 - DNA, 22 bp, Homo sapiens
agccactgtgtgaccagctgtc

SEQ ID NO: 7880047 - DNA, 20 bp, Homo sapiens
cagaatgctgtaatcaagaa

SEQ ID NO: 7880048 - DNA, 20 bp, Homo sapiens
cagaatgctgtaatcaagaa

SEQ ID NO: 7880049 - DNA, 22 bp, Homo sapiens
cagaatgcattgcttctgatgg

SEQ ID NO: 7880050 - DNA, 22 bp, Homo sapiens
cagaatgcagaatgttcatttt

SEQ ID NO: 7880051 - DNA, 22 bp, Homo sapiens
cagaatgcaaattttataatat

SEQ ID NO: 7880052 - DNA, 22 bp, Homo sapiens
cagaatgagtagcatcttcacc

SEQ ID NO: 7880053 - DNA, 22 bp, Homo sapiens
cagaatgagtagcatcttcacc

SEQ ID NO: 7880054 - DNA, 22 bp, Homo sapiens
cagaatgagtagcatcttcacc

SEQ ID NO: 7880055 - DNA, 22 bp, Homo sapiens
cagaatctgagtcgtgattgta

SEQ ID NO: 7880056 - DNA, 22 bp, Homo sapiens
cagaatctctgggagtggatca

SEQ ID NO: 7880057 - DNA, 22 bp, Homo sapiens
cagaatctgttggggttgcaga

SEQ ID NO: 7880058 - DNA, 22 bp, Homo sapiens
cagaatcttcttaattggcaca

SEQ ID NO: 7880059 - DNA, 22 bp, Homo sapiens
cagaatgaaatgtaagaacacc

SEQ ID NO: 7880060 - DNA, 22 bp, Homo sapiens
cagaatgagataacccagattg

SEQ ID NO: 7880061 - DNA, 22 bp, Homo sapiens
cagaataccctatagacagaat

SEQ ID NO: 7880062 - DNA, 22 bp, Homo sapiens
cagaatatgaccctaggccttt

SEQ ID NO: 7880063 - DNA, 22 bp, Homo sapiens
cagaatatgaccctaggccttt

SEQ ID NO: 7880064 - DNA, 22 bp, Homo sapiens
cagaatcagtgacacatgtata

SEQ ID NO: 7880065 - DNA, 22 bp, Homo sapiens
cagaatatgactcgggcactac

SEQ ID NO: 7880066 - DNA, 22 bp, Homo sapiens
cagaatcagcccttgctattaa

SEQ ID NO: 7880067 - DNA, 22 bp, Homo sapiens
cagaatccatgacagacgttga

SEQ ID NO: 7880068 - DNA, 21 bp, Homo sapiens
cagaatccagtctcttattac

SEQ ID NO: 7880069 - DNA, 22 bp, Homo sapiens
cagaatccatgacagacgttga

SEQ ID NO: 7880070 - DNA, 22 bp, Homo sapiens
cagaatccatgacagacgttga

SEQ ID NO: 7880071 - DNA, 22 bp, Homo sapiens
cagaatctcgacttctggcccc

SEQ ID NO: 7880072 - DNA, 22 bp, Homo sapiens
cagaatctacaccctcagaaat

SEQ ID NO: 7880073 - DNA, 22 bp, Homo sapiens
cagaatctcgacttctggcccc

SEQ ID NO: 7880074 - DNA, 22 bp, Homo sapiens
cagaatccacaacagaagttga

SEQ ID NO: 7880075 - DNA, 22 bp, Homo sapiens
cagaatccacaacagaagttga

SEQ ID NO: 7880076 - DNA, 22 bp, Homo sapiens
cagaatccacaacagaagttga

SEQ ID NO: 7880077 - DNA, 22 bp, Homo sapiens
cagaatccagaattgctgaggt

SEQ ID NO: 7880078 - DNA, 22 bp, Homo sapiens
cagaatccagaattgctgaggt

SEQ ID NO: 7880079 - DNA, 22 bp, Homo sapiens
cagaatccagaattgctgaggt

SEQ ID NO: 7880080 - DNA, 21 bp, Homo sapiens
cagacatgagtctcagctttg

SEQ ID NO: 7880081 - DNA, 21 bp, Homo sapiens
cagacatgagtctcagctttg

SEQ ID NO: 7880082 - DNA, 22 bp, Homo sapiens
cagacatgagatacagctgcta

SEQ ID NO: 7880083 - DNA, 22 bp, Homo sapiens
cagacatgagatacagctgcta

SEQ ID NO: 7880084 - DNA, 22 bp, Homo sapiens
cagacatgagatacagctgcta

SEQ ID NO: 7880085 - DNA, 22 bp, Homo sapiens
cagacatgatgtaagcagaggc

SEQ ID NO: 7880086 - DNA, 22 bp, Homo sapiens
cagacatgatgtaagcagaggc

SEQ ID NO: 7880087 - DNA, 22 bp, Homo sapiens
cagacatgatgtaagcagaggc

SEQ ID NO: 7880088 - DNA, 22 bp, Homo sapiens
cagacatgatgtaagcagaggc

SEQ ID NO: 7880089 - DNA, 22 bp, Homo sapiens
cagacatctgtacccagcctgt

SEQ ID NO: 7880090 - DNA, 22 bp, Homo sapiens
cagacatccaggtacgagcttt

SEQ ID NO: 7880091 - DNA, 22 bp, Homo sapiens
cagacatatgttttaacagatt

SEQ ID NO: 7880092 - DNA, 22 bp, Homo sapiens
cagacatatgttttaacagatt

SEQ ID NO: 7880093 - DNA, 22 bp, Homo sapiens
cagacatcacactcagattgca

SEQ ID NO: 7880094 - DNA, 22 bp, Homo sapiens
cagacagtgttagagtcaagct

SEQ ID NO: 7880095 - DNA, 22 bp, Homo sapiens
cagacagtttatcctaaataac

SEQ ID NO: 7880096 - DNA, 22 bp, Homo sapiens
cagacatatccctgctccctta

SEQ ID NO: 7880097 - DNA, 22 bp, Homo sapiens
cagacagtggacttgataaagg

SEQ ID NO: 7880098 - DNA, 22 bp, Homo sapiens
cagacagtgttagagtcaagct

SEQ ID NO: 7880099 - DNA, 22 bp, Homo sapiens
cagacagtttatcctaaataac

SEQ ID NO: 7880100 - DNA, 22 bp, Homo sapiens
cagacagtggacttgataaagg

SEQ ID NO: 7880101 - DNA, 22 bp, Homo sapiens
cagacagtggacttgataaagg

SEQ ID NO: 7880102 - DNA, 22 bp, Homo sapiens
cagacagtggacttgataaagg

SEQ ID NO: 7880103 - DNA, 22 bp, Homo sapiens
cagacagtggacttgataaagg

SEQ ID NO: 7880104 - DNA, 22 bp, Homo sapiens
cagacaggtagggacagaacat

SEQ ID NO: 7880105 - DNA, 22 bp, Homo sapiens
cagacaggtagggacagaacat

SEQ ID NO: 7880106 - DNA, 22 bp, Homo sapiens
cagacaggtagggacagaacat

SEQ ID NO: 7880107 - DNA, 22 bp, Homo sapiens
cagacaggtagggacagaacat

SEQ ID NO: 7880108 - DNA, 22 bp, Homo sapiens
cagacaggtagggacagaacat

SEQ ID NO: 7880109 - DNA, 22 bp, Homo sapiens
cagacaggtagggacagaacat

SEQ ID NO: 7880110 - DNA, 22 bp, Homo sapiens
agccagagagtgttggagatgt

SEQ ID NO: 7880111 - DNA, 22 bp, Homo sapiens
agccagagagtgttggagatgt

SEQ ID NO: 7880112 - DNA, 22 bp, Homo sapiens
agccagagagtgttggagatgt

SEQ ID NO: 7880113 - DNA, 22 bp, Homo sapiens
agccagagagtgttggagatgt

SEQ ID NO: 7880114 - DNA, 22 bp, Homo sapiens
cagacaggaagttcagaagaaa

SEQ ID NO: 7880115 - DNA, 22 bp, Homo sapiens
agccagagagccccaggttcta

SEQ ID NO: 7880116 - DNA, 22 bp, Homo sapiens
agccagagagccccaggttcta

SEQ ID NO: 7880117 - DNA, 22 bp, Homo sapiens
cagacagggtgggtttctgggc

SEQ ID NO: 7880118 - DNA, 22 bp, Homo sapiens
cagacagggtgggtttctgggc

SEQ ID NO: 7880119 - DNA, 22 bp, Homo sapiens
cagacagggtgggtttctgggc

SEQ ID NO: 7880120 - DNA, 22 bp, Homo sapiens
cagacagggttttggtctttgg

SEQ ID NO: 7880121 - DNA, 22 bp, Homo sapiens
cagacagggttttggtctttgg

SEQ ID NO: 7880122 - DNA, 22 bp, Homo sapiens
cagacagggttttggtctttgg

SEQ ID NO: 7880123 - DNA, 22 bp, Homo sapiens
agccagagactgtgtctgtaat

SEQ ID NO: 7880124 - DNA, 22 bp, Homo sapiens
agccagagaacagcaggaaatg

SEQ ID NO: 7880125 - DNA, 22 bp, Homo sapiens
agccagagaacagcaggaaatg

SEQ ID NO: 7880126 - DNA, 22 bp, Homo sapiens
agccagagactttacctgtgca

SEQ ID NO: 7880127 - DNA, 22 bp, Homo sapiens
agccagagactttacctgtgca

SEQ ID NO: 7880128 - DNA, 22 bp, Homo sapiens
agccagagactgtgtctgtaat

SEQ ID NO: 7880129 - DNA, 22 bp, Homo sapiens
agccagacatggctcctgctcc

SEQ ID NO: 7880130 - DNA, 22 bp, Homo sapiens
agccagagaacagcaggaaatg

SEQ ID NO: 7880131 - DNA, 22 bp, Homo sapiens
agccagagaacagcaggaaatg

SEQ ID NO: 7880132 - DNA, 22 bp, Homo sapiens
agccatcctactacctcagcat

SEQ ID NO: 7880133 - DNA, 22 bp, Homo sapiens
agcccaaagtcctgcttccctg

SEQ ID NO: 7880134 - DNA, 22 bp, Homo sapiens
agcccaagaagagctttcttgc

SEQ ID NO: 7880135 - DNA, 22 bp, Homo sapiens
agcccaagcataggagggaggc

SEQ ID NO: 7880136 - DNA, 22 bp, Homo sapiens
agccatcctactacctcagcat

SEQ ID NO: 7880137 - DNA, 18 bp, Homo sapiens
agccatatggagactctg

SEQ ID NO: 7880138 - DNA, 22 bp, Homo sapiens
agccatcacttgagaatctatt

SEQ ID NO: 7880139 - DNA, 23 bp, Homo sapiens
agccatcatcctgctgctggggc

SEQ ID NO: 7880140 - DNA, 23 bp, Homo sapiens
agccatcatcctgctgctggggc

SEQ ID NO: 7880141 - DNA, 22 bp, Homo sapiens
agcccaagctatgaggtgacct

SEQ ID NO: 7880142 - DNA, 22 bp, Homo sapiens
agcccaagctatgaggtgacct

SEQ ID NO: 7880143 - DNA, 22 bp, Homo sapiens
agcccaagctatgaggtgacct

SEQ ID NO: 7880144 - DNA, 22 bp, Homo sapiens
agcccaagcctggctggcgatg

SEQ ID NO: 7880145 - DNA, 22 bp, Homo sapiens
agcccaagcctggctggcgatg

SEQ ID NO: 7880146 - DNA, 22 bp, Homo sapiens
cagagaaagggtgaattccttc

SEQ ID NO: 7880147 - DNA, 22 bp, Homo sapiens
cagagaaagggtgaattccttc

SEQ ID NO: 7880148 - DNA, 22 bp, Homo sapiens
cagagaaagggtgaattccttc

SEQ ID NO: 7880149 - DNA, 22 bp, Homo sapiens
cagagaaagggtgaattccttc

SEQ ID NO: 7880150 - DNA, 22 bp, Homo sapiens
cagagaaagggtgaattccttc

SEQ ID NO: 7880151 - DNA, 22 bp, Homo sapiens
agccagtttgcttgtaataaca

SEQ ID NO: 7880152 - DNA, 22 bp, Homo sapiens
cagagaaagggtgaattccttc

SEQ ID NO: 7880153 - DNA, 22 bp, Homo sapiens
cagagaaagaagcccattcatt

SEQ ID NO: 7880154 - DNA, 22 bp, Homo sapiens
cagagaaagacttgcccttagt

SEQ ID NO: 7880155 - DNA, 22 bp, Homo sapiens
cagagaaagaagcccattcatt

SEQ ID NO: 7880156 - DNA, 22 bp, Homo sapiens
cagagaaagacttgcccttagt

SEQ ID NO: 7880157 - DNA, 22 bp, Homo sapiens
cagagaaaaaatcctgctctca

SEQ ID NO: 7880158 - DNA, 22 bp, Homo sapiens
cagagaaaaaatcctgctctca

SEQ ID NO: 7880159 - DNA, 22 bp, Homo sapiens
cagagaaaaaatcctgctctca

SEQ ID NO: 7880160 - DNA, 22 bp, Homo sapiens
cagactttctgactcccttgcc

SEQ ID NO: 7880161 - DNA, 22 bp, Homo sapiens
cagacatggcgccaagtgctag

SEQ ID NO: 7880162 - DNA, 22 bp, Homo sapiens
cagacatggaaatttagtgtta

SEQ ID NO: 7880163 - DNA, 22 bp, Homo sapiens
cagacatggaaatttagtgtta

SEQ ID NO: 7880164 - DNA, 22 bp, Homo sapiens
cagacatgatgtaagcagaggc

SEQ ID NO: 7880165 - DNA, 22 bp, Homo sapiens
cagagaaactcagatagctgat

SEQ ID NO: 7880166 - DNA, 22 bp, Homo sapiens
cagagaaactcagatagctgat

SEQ ID NO: 7880167 - DNA, 22 bp, Homo sapiens
cagactttctggaagctaaaaa

SEQ ID NO: 7880168 - DNA, 22 bp, Homo sapiens
cagagaaaaaatcctgctctca

SEQ ID NO: 7880169 - DNA, 22 bp, Homo sapiens
cagagaaaaaatcctgctctca

SEQ ID NO: 7880170 - DNA, 22 bp, Homo sapiens
cagagaaactcagatagctgat

SEQ ID NO: 7880171 - DNA, 22 bp, Homo sapiens
cagagaaagaagcccattcatt

SEQ ID NO: 7880172 - DNA, 22 bp, Homo sapiens
cagagaaagaagcccattcatt

SEQ ID NO: 7880173 - DNA, 22 bp, Homo sapiens
cagagaaagaagcccattcatt

SEQ ID NO: 7880174 - DNA, 22 bp, Homo sapiens
cagagaaagaagcccattcatt

SEQ ID NO: 7880175 - DNA, 22 bp, Homo sapiens
cagagaaagaagcccattcatt

SEQ ID NO: 7880176 - DNA, 22 bp, Homo sapiens
cagagaaactcagatagctgat

SEQ ID NO: 7880177 - DNA, 22 bp, Homo sapiens
cagagaaagaagcccattcatt

SEQ ID NO: 7880178 - DNA, 22 bp, Homo sapiens
agcccagagccccggccatgtt

SEQ ID NO: 7880179 - DNA, 22 bp, Homo sapiens
agcccagagccccggccatgtt

SEQ ID NO: 7880180 - DNA, 22 bp, Homo sapiens
agcccagagccccggccatgtt

SEQ ID NO: 7880181 - DNA, 22 bp, Homo sapiens
agcccagaaatgaaaggatgat

SEQ ID NO: 7880182 - DNA, 22 bp, Homo sapiens
agcccagaaatgaaaggatgat

SEQ ID NO: 7880183 - DNA, 22 bp, Homo sapiens
agcccaaggcttccctgctggc

SEQ ID NO: 7880184 - DNA, 22 bp, Homo sapiens
agcccaaggcttccctgctggc

SEQ ID NO: 7880185 - DNA, 22 bp, Homo sapiens
agcccaaggcttccctgctggc

SEQ ID NO: 7880186 - DNA, 22 bp, Homo sapiens
agcccaaggccacacagttagt

SEQ ID NO: 7880187 - DNA, 23 bp, Homo sapiens
agcccaccttgttagtcctgtgg

SEQ ID NO: 7880188 - DNA, 22 bp, Homo sapiens
agcccagaggctgggcgtgcat

SEQ ID NO: 7880189 - DNA, 22 bp, Homo sapiens
agcccagagcctctcctaaagg

SEQ ID NO: 7880190 - DNA, 22 bp, Homo sapiens
agcccagagggtagcagaagaa

SEQ ID NO: 7880191 - DNA, 22 bp, Homo sapiens
agcccagagggtagcagaagaa

SEQ ID NO: 7880192 - DNA, 22 bp, Homo sapiens
agcccagaggctgggcgtgcat

SEQ ID NO: 7880193 - DNA, 22 bp, Homo sapiens
agcccagatggtagccctagaa

SEQ ID NO: 7880194 - DNA, 22 bp, Homo sapiens
agcccagatggtagccctagaa

SEQ ID NO: 7880195 - DNA, 22 bp, Homo sapiens
agcccagatggtagccctagaa

SEQ ID NO: 7880196 - DNA, 22 bp, Homo sapiens
agcccagataaagtacaaccat

SEQ ID NO: 7880197 - DNA, 22 bp, Homo sapiens
agcccagataaagtacaaccat

SEQ ID NO: 7880198 - DNA, 22 bp, Homo sapiens
agcccagagggtagcagaagaa

SEQ ID NO: 7880199 - DNA, 22 bp, Homo sapiens
agcccagagggtagcagaagaa

SEQ ID NO: 7880200 - DNA, 22 bp, Homo sapiens
agcccagcagtaagattagaga

SEQ ID NO: 7880201 - DNA, 23 bp, Homo sapiens
agcccagcagagaacctaggtcc

SEQ ID NO: 7880202 - DNA, 23 bp, Homo sapiens
agcccagcagagaacctaggtcc

SEQ ID NO: 7880203 - DNA, 23 bp, Homo sapiens
agcccagcagagaacctaggtcc

SEQ ID NO: 7880204 - DNA, 22 bp, Homo sapiens
agcccagccactattaaatgtt

SEQ ID NO: 7880205 - DNA, 22 bp, Homo sapiens
agcccagcccgggctgcgcttt

SEQ ID NO: 7880206 - DNA, 22 bp, Homo sapiens
agcccagcccgggctgcgcttt

SEQ ID NO: 7880207 - DNA, 22 bp, Homo sapiens
agcccagcccgggctgcgcttt

SEQ ID NO: 7880208 - DNA, 22 bp, Homo sapiens
agcccagcccgggctgcgcttt

SEQ ID NO: 7880209 - DNA, 22 bp, Homo sapiens
agcccagcaaagggaggttcag

SEQ ID NO: 7880210 - DNA, 22 bp, Homo sapiens
agcccagcaaagggaggttcag

SEQ ID NO: 7880211 - DNA, 22 bp, Homo sapiens
agcccagcaaagggaggttcag

SEQ ID NO: 7880212 - DNA, 22 bp, Homo sapiens
agcccagcaaaggggtttgaga

SEQ ID NO: 7880213 - DNA, 22 bp, Homo sapiens
agcccagcactgggggcccagc

SEQ ID NO: 7880214 - DNA, 22 bp, Homo sapiens
agcccagcagaaagtccagcct

SEQ ID NO: 7880215 - DNA, 22 bp, Homo sapiens
agcccagcagaaagtccagcct

SEQ ID NO: 7880216 - DNA, 22 bp, Homo sapiens
agcccagcactgggggcccagc

SEQ ID NO: 7880217 - DNA, 22 bp, Homo sapiens
agcccagcagaaagtccagcct

SEQ ID NO: 7880218 - DNA, 22 bp, Homo sapiens
cagaggagttcagtacacagcc

SEQ ID NO: 7880219 - DNA, 22 bp, Homo sapiens
agcccagccggattcccagttc

SEQ ID NO: 7880220 - DNA, 22 bp, Homo sapiens
agcccagccggattcccagttc

SEQ ID NO: 7880221 - DNA, 22 bp, Homo sapiens
agcccagccggattcccagttc

SEQ ID NO: 7880222 - DNA, 22 bp, Homo sapiens
agcccagccggattcccagttc

SEQ ID NO: 7880223 - DNA, 21 bp, Homo sapiens
cagaggcaggctctgtgtgtg

SEQ ID NO: 7880224 - DNA, 21 bp, Homo sapiens
cagaggcaggctctgtgtgtg

SEQ ID NO: 7880225 - DNA, 21 bp, Homo sapiens
cagaggcaggctctgtgtgtg

SEQ ID NO: 7880226 - DNA, 21 bp, Homo sapiens
cagaggcaggctctgtgtgtg

SEQ ID NO: 7880227 - DNA, 21 bp, Homo sapiens
cagaggcaggctctgtgtgtg

SEQ ID NO: 7880228 - DNA, 21 bp, Homo sapiens
cagaggcaggctctgtgtgtg

SEQ ID NO: 7880229 - DNA, 21 bp, Homo sapiens
cagaggcaggtcctgggacgg

SEQ ID NO: 7880230 - DNA, 21 bp, Homo sapiens
cagaggcaggtcctgggacgg

SEQ ID NO: 7880231 - DNA, 21 bp, Homo sapiens
cagaggcaggtcctgggacgg

SEQ ID NO: 7880232 - DNA, 21 bp, Homo sapiens
cagaggcaggtcctgggacgg

SEQ ID NO: 7880233 - DNA, 21 bp, Homo sapiens
cagaggcaggtcctgggacgg

SEQ ID NO: 7880234 - DNA, 21 bp, Homo sapiens
cagaggcaggtcctgggacgg

SEQ ID NO: 7880235 - DNA, 21 bp, Homo sapiens
cagaggcaggtcctgggacgg

SEQ ID NO: 7880236 - DNA, 22 bp, Homo sapiens
cagaggcagtggggttgctcct

SEQ ID NO: 7880237 - DNA, 22 bp, Homo sapiens
cagaggcagtggggttgctcct

SEQ ID NO: 7880238 - DNA, 22 bp, Homo sapiens
cagaggcagtggggttgctcct

SEQ ID NO: 7880239 - DNA, 22 bp, Homo sapiens
cagaggcagtggggttgctcct

SEQ ID NO: 7880240 - DNA, 22 bp, Homo sapiens
cagaggcagtggggttgctcct

SEQ ID NO: 7880241 - DNA, 22 bp, Homo sapiens
cagaggcagtggggttgctcct

SEQ ID NO: 7880242 - DNA, 22 bp, Homo sapiens
cagaggcagtggggttgctcct

SEQ ID NO: 7880243 - DNA, 22 bp, Homo sapiens
cagaggcatactcccagtcttg

SEQ ID NO: 7880244 - DNA, 22 bp, Homo sapiens
cagaggcagtggggttgctcct

SEQ ID NO: 7880245 - DNA, 22 bp, Homo sapiens
cagaggcatactcccagtcttg

SEQ ID NO: 7880246 - DNA, 22 bp, Homo sapiens
cagaggcatactcccagtcttg

SEQ ID NO: 7880247 - DNA, 22 bp, Homo sapiens
cagaggcatactcccagtcttg

SEQ ID NO: 7880248 - DNA, 22 bp, Homo sapiens
cagaggcatactcccagtcttg

SEQ ID NO: 7880249 - DNA, 22 bp, Homo sapiens
cagaggcatactcccagtcttg

SEQ ID NO: 7880250 - DNA, 22 bp, Homo sapiens
cagaggcatactcccagtcttg

SEQ ID NO: 7880251 - DNA, 22 bp, Homo sapiens
cagaggcatactcccagtcttg

SEQ ID NO: 7880252 - DNA, 22 bp, Homo sapiens
cagaggcatactcccagtcttg

SEQ ID NO: 7880253 - DNA, 23 bp, Homo sapiens
cagaggcatcggattcaacatca

SEQ ID NO: 7880254 - DNA, 23 bp, Homo sapiens
cagaggcatcggattcaacatca

SEQ ID NO: 7880255 - DNA, 23 bp, Homo sapiens
cagaggcatcggattcaacatca

SEQ ID NO: 7880256 - DNA, 22 bp, Homo sapiens
cagaggcatataattgctgggg

SEQ ID NO: 7880257 - DNA, 22 bp, Homo sapiens
cagaggcatataattgctgggg

SEQ ID NO: 7880258 - DNA, 22 bp, Homo sapiens
cagaggcatataattgctgggg

SEQ ID NO: 7880259 - DNA, 22 bp, Homo sapiens
cagaggcatataattgctgggg

SEQ ID NO: 7880260 - DNA, 23 bp, Homo sapiens
cagaggcatcggattcaacatca

SEQ ID NO: 7880261 - DNA, 22 bp, Homo sapiens
agcccaggcagagggatgcttg

SEQ ID NO: 7880262 - DNA, 22 bp, Homo sapiens
agcccaggcagagggatgcttg

SEQ ID NO: 7880263 - DNA, 22 bp, Homo sapiens
agcccaggcagagggatgcttg

SEQ ID NO: 7880264 - DNA, 22 bp, Homo sapiens
agcccaggcagagggatgcttg

SEQ ID NO: 7880265 - DNA, 22 bp, Homo sapiens
agcccaggcagagggatgcttg

SEQ ID NO: 7880266 - DNA, 22 bp, Homo sapiens
agcccaggcagagggatgcttg

SEQ ID NO: 7880267 - DNA, 22 bp, Homo sapiens
agcccaggcagagggatgcttg

SEQ ID NO: 7880268 - DNA, 22 bp, Homo sapiens
cagaggcattactgaaaaggtg

SEQ ID NO: 7880269 - DNA, 22 bp, Homo sapiens
cagaggcattactgaaaaggtg

SEQ ID NO: 7880270 - DNA, 22 bp, Homo sapiens
cagaggcattactgaaaaggtg

SEQ ID NO: 7880271 - DNA, 23 bp, Homo sapiens
cagaggcatcggattcaacatca

SEQ ID NO: 7880272 - DNA, 20 bp, Homo sapiens
cagaggcattttcagactct

SEQ ID NO: 7880273 - DNA, 22 bp, Homo sapiens
agcccaggcagagggatgcttg

SEQ ID NO: 7880274 - DNA, 20 bp, Homo sapiens
cagaggcattttcagactct

SEQ ID NO: 7880275 - DNA, 22 bp, Homo sapiens
cagagggacagtgtaatgcata

SEQ ID NO: 7880276 - DNA, 22 bp, Homo sapiens
cagagggacagtgtaatgcata

SEQ ID NO: 7880277 - DNA, 22 bp, Homo sapiens
cagagggaccagaacatactgt

SEQ ID NO: 7880278 - DNA, 22 bp, Homo sapiens
cagagggagccctccaggagca

SEQ ID NO: 7880279 - DNA, 22 bp, Homo sapiens
cagagggagccctccaggagca

SEQ ID NO: 7880280 - DNA, 22 bp, Homo sapiens
cagagggagccctccaggagca

SEQ ID NO: 7880281 - DNA, 22 bp, Homo sapiens
cagagggagccctccaggagca

SEQ ID NO: 7880282 - DNA, 22 bp, Homo sapiens
cagagggagtttctgaggttgc

SEQ ID NO: 7880283 - DNA, 22 bp, Homo sapiens
cagaggctcttcctcactgccc

SEQ ID NO: 7880284 - DNA, 22 bp, Homo sapiens
cagaggctcttcctcactgccc

SEQ ID NO: 7880285 - DNA, 22 bp, Homo sapiens
agcccagggaaccaggaagtgg

SEQ ID NO: 7880286 - DNA, 22 bp, Homo sapiens
agcccagggaaccaggaagtgg

SEQ ID NO: 7880287 - DNA, 22 bp, Homo sapiens
cagagggacagtatgatgaaag

SEQ ID NO: 7880288 - DNA, 22 bp, Homo sapiens
cagagggacagtatgatgaaag

SEQ ID NO: 7880289 - DNA, 22 bp, Homo sapiens
cagaggctgacaaaatattgct

SEQ ID NO: 7880290 - DNA, 22 bp, Homo sapiens
agcccaggctggagtgcagtgg

SEQ ID NO: 7880291 - DNA, 22 bp, Homo sapiens
agcccaggctggagtgcagtgg

SEQ ID NO: 7880292 - DNA, 22 bp, Homo sapiens
agcccaggctggagtgcagtgg

SEQ ID NO: 7880293 - DNA, 22 bp, Homo sapiens
agcccaggctggagtgcagtgg

SEQ ID NO: 7880294 - DNA, 22 bp, Homo sapiens
agcccaggctggagtgcagtgg

SEQ ID NO: 7880295 - DNA, 22 bp, Homo sapiens
agcccagggaaccaggaagtgg

SEQ ID NO: 7880296 - DNA, 22 bp, Homo sapiens
agcccagggaaccaggaagtgg

SEQ ID NO: 7880297 - DNA, 22 bp, Homo sapiens
agcccaggctggagtgcagtgg

SEQ ID NO: 7880298 - DNA, 22 bp, Homo sapiens
agcccagggaaccaggaagtgg

SEQ ID NO: 7880299 - DNA, 22 bp, Homo sapiens
agcccagggaaccaggaagtgg

SEQ ID NO: 7880300 - DNA, 22 bp, Homo sapiens
agcccagggaaccaggaagtgg

SEQ ID NO: 7880301 - DNA, 22 bp, Homo sapiens
agcccagggaaccaggaagtgg

SEQ ID NO: 7880302 - DNA, 22 bp, Homo sapiens
agcccaggcagagggatgcttg

SEQ ID NO: 7880303 - DNA, 18 bp, Homo sapiens
agcccaggcatcgtctgc

SEQ ID NO: 7880304 - DNA, 18 bp, Homo sapiens
agcccaggcatcgtctgc

SEQ ID NO: 7880305 - DNA, 20 bp, Homo sapiens
agcccaggcctgtgtgagtc

SEQ ID NO: 7880306 - DNA, 18 bp, Homo sapiens
agcccaggcatcgtctgc

SEQ ID NO: 7880307 - DNA, 20 bp, Homo sapiens
agcccaggcctgtgtgagtc

SEQ ID NO: 7880308 - DNA, 22 bp, Homo sapiens
agcccaggcagagggatgcttg

SEQ ID NO: 7880309 - DNA, 20 bp, Homo sapiens
agcccaggcctgtgtgagtc

SEQ ID NO: 7880310 - DNA, 20 bp, Homo sapiens
agcccaggcctgtgtgagtc

SEQ ID NO: 7880311 - DNA, 22 bp, Homo sapiens
agcccaggctggagtgcagtgg

SEQ ID NO: 7880312 - DNA, 20 bp, Homo sapiens
agcccaggcctgtgtgagtc

SEQ ID NO: 7880313 - DNA, 20 bp, Homo sapiens
agcccaggcctgtgtgagtc

SEQ ID NO: 7880314 - DNA, 20 bp, Homo sapiens
agcccaggcctgtgtgagtc

SEQ ID NO: 7880315 - DNA, 20 bp, Homo sapiens
agcccaggcctgtgtgagtc

SEQ ID NO: 7880316 - DNA, 20 bp, Homo sapiens
agcccaggcctgtgtgagtc

SEQ ID NO: 7880317 - DNA, 22 bp, Homo sapiens
atgaaagtagggtaaaatcaca

SEQ ID NO: 7880318 - DNA, 22 bp, Homo sapiens
atgaaagtgaaggtttactaag

SEQ ID NO: 7880319 - DNA, 22 bp, Homo sapiens
atgaaagtagggtaaaatcaca

SEQ ID NO: 7880320 - DNA, 22 bp, Homo sapiens
atgaaagtagggtaaaatcaca

SEQ ID NO: 7880321 - DNA, 22 bp, Homo sapiens
atgaaagtacctgtaatatgtt

SEQ ID NO: 7880322 - DNA, 22 bp, Homo sapiens
atgaaagtacctgtaatatgtt

SEQ ID NO: 7880323 - DNA, 22 bp, Homo sapiens
atgaaagctcagtgcactgaca

SEQ ID NO: 7880324 - DNA, 22 bp, Homo sapiens
atgaaagtgtttaagtttatgt

SEQ ID NO: 7880325 - DNA, 22 bp, Homo sapiens
atgaaagtggcttgattaaatg

SEQ ID NO: 7880326 - DNA, 22 bp, Homo sapiens
atgaaagtgtttaagtttatgt

SEQ ID NO: 7880327 - DNA, 22 bp, Homo sapiens
atgaaagtgtttaagtttatgt

SEQ ID NO: 7880328 - DNA, 23 bp, Homo sapiens
atgaaagttcttaaaatgtcatg

SEQ ID NO: 7880329 - DNA, 22 bp, Homo sapiens
atgaaagtgaaggtttactaag

SEQ ID NO: 7880330 - DNA, 22 bp, Homo sapiens
atgaaagtgaaggtttactaag

SEQ ID NO: 7880331 - DNA, 22 bp, Homo sapiens
atgaaagtggcttgattaaatg

SEQ ID NO: 7880332 - DNA, 22 bp, Homo sapiens
atgaaagtggcttgattaaatg

SEQ ID NO: 7880333 - DNA, 22 bp, Homo sapiens
atgaaagatgatttaaagtact

SEQ ID NO: 7880334 - DNA, 22 bp, Homo sapiens
atgaaactgggataactatagc

SEQ ID NO: 7880335 - DNA, 22 bp, Homo sapiens
atgaaactgggataactatagc

SEQ ID NO: 7880336 - DNA, 22 bp, Homo sapiens
atgaaactgaaggacaaccaga

SEQ ID NO: 7880337 - DNA, 22 bp, Homo sapiens
atgaaagatgatttaaagtact

SEQ ID NO: 7880338 - DNA, 22 bp, Homo sapiens
atgaaagcacgtgggaagataa

SEQ ID NO: 7880339 - DNA, 22 bp, Homo sapiens
atgaaatttgaccaattattta

SEQ ID NO: 7880340 - DNA, 22 bp, Homo sapiens
atgaaatttgaccaattattta

SEQ ID NO: 7880341 - DNA, 22 bp, Homo sapiens
atgaaattgatcttgaactttt

SEQ ID NO: 7880342 - DNA, 22 bp, Homo sapiens
atgaaattgatcttgaactttt

SEQ ID NO: 7880343 - DNA, 22 bp, Homo sapiens
atgaaatttgaccaattattta

SEQ ID NO: 7880344 - DNA, 22 bp, Homo sapiens
atgaaagtttgcattcctcagt

SEQ ID NO: 7880345 - DNA, 22 bp, Homo sapiens
atgaaattgatcttgaactttt

SEQ ID NO: 7880346 - DNA, 22 bp, Homo sapiens
atgaaattgatcttgaactttt

SEQ ID NO: 7880347 - DNA, 22 bp, Homo sapiens
atgaacaataaaatagatcaca

SEQ ID NO: 7880348 - DNA, 22 bp, Homo sapiens
atgaacaagtatttgcatgagc

SEQ ID NO: 7880349 - DNA, 22 bp, Homo sapiens
atgaacaataaaatagatcaca

SEQ ID NO: 7880350 - DNA, 22 bp, Homo sapiens
atgaaatttgctgctaagttcc

SEQ ID NO: 7880351 - DNA, 22 bp, Homo sapiens
atgaaattttaattatacctct

SEQ ID NO: 7880352 - DNA, 22 bp, Homo sapiens
atgaacaatctgttgacttctg

SEQ ID NO: 7880353 - DNA, 22 bp, Homo sapiens
atgaacaatgactacatattga

SEQ ID NO: 7880354 - DNA, 22 bp, Homo sapiens
atgaacaataatcatgtctatg

SEQ ID NO: 7880355 - DNA, 22 bp, Homo sapiens
atgaacaatgactacatattga

SEQ ID NO: 7880356 - DNA, 22 bp, Homo sapiens
atgaacaatgactacatattga

SEQ ID NO: 7880357 - DNA, 22 bp, Homo sapiens
atgaacaatgactacatattga

SEQ ID NO: 7880358 - DNA, 22 bp, Homo sapiens
atgaacaatgactacatattga

SEQ ID NO: 7880359 - DNA, 20 bp, Homo sapiens
agaattcttaccctttgatg

SEQ ID NO: 7880360 - DNA, 22 bp, Homo sapiens
agaattgctggaatttgcttta

SEQ ID NO: 7880361 - DNA, 22 bp, Homo sapiens
agaattcttggtggttagaata

SEQ ID NO: 7880362 - DNA, 22 bp, Homo sapiens
agaattcttggtggttagaata

SEQ ID NO: 7880363 - DNA, 22 bp, Homo sapiens
agaattcttggtggttagaata

SEQ ID NO: 7880364 - DNA, 22 bp, Homo sapiens
agacaaaccttgttttatgatg

SEQ ID NO: 7880365 - DNA, 23 bp, Homo sapiens
agacaaacttccttcactgcacc

SEQ ID NO: 7880366 - DNA, 22 bp, Homo sapiens
agacaaaccttgttttatgatg

SEQ ID NO: 7880367 - DNA, 22 bp, Homo sapiens
agacaaaccttgttttatgatg

SEQ ID NO: 7880368 - DNA, 18 bp, Homo sapiens
agacaaacttcttctgcc

SEQ ID NO: 7880369 - DNA, 18 bp, Homo sapiens
agacaaacttcttctgcc

SEQ ID NO: 7880370 - DNA, 18 bp, Homo sapiens
agacaaacttcttctgcc

SEQ ID NO: 7880371 - DNA, 22 bp, Homo sapiens
agacaaagacagcatctcaggt

SEQ ID NO: 7880372 - DNA, 22 bp, Homo sapiens
agacaaagacagcatctcaggt

SEQ ID NO: 7880373 - DNA, 22 bp, Homo sapiens
agacaaagacagcatctcaggt

SEQ ID NO: 7880374 - DNA, 22 bp, Homo sapiens
agacaaagacagcatctcaggt

SEQ ID NO: 7880375 - DNA, 22 bp, Homo sapiens
agacaaagaaaccgtagaagca

SEQ ID NO: 7880376 - DNA, 22 bp, Homo sapiens
agacaaagaaaccgtagaagca

SEQ ID NO: 7880377 - DNA, 22 bp, Homo sapiens
agacaaagaaaccgtagaagca

SEQ ID NO: 7880378 - DNA, 22 bp, Homo sapiens
agacaaatggagtatgagcaac

SEQ ID NO: 7880379 - DNA, 22 bp, Homo sapiens
agacaaatggagtatgagcaac

SEQ ID NO: 7880380 - DNA, 22 bp, Homo sapiens
agacaaatggtaattatgtcta

SEQ ID NO: 7880381 - DNA, 22 bp, Homo sapiens
agacaaatggagtatgagcaac

SEQ ID NO: 7880382 - DNA, 22 bp, Homo sapiens
agacaaatggagtatgagcaac

SEQ ID NO: 7880383 - DNA, 22 bp, Homo sapiens
agacaaatggagtatgagcaac

SEQ ID NO: 7880384 - DNA, 22 bp, Homo sapiens
agacaaatgaacaaatatgtga

SEQ ID NO: 7880385 - DNA, 22 bp, Homo sapiens
agacaaatgaacaaatatgtga

SEQ ID NO: 7880386 - DNA, 22 bp, Homo sapiens
agacaaattgggacattgtgtt

SEQ ID NO: 7880387 - DNA, 22 bp, Homo sapiens
agacaaattgggacattgtgtt

SEQ ID NO: 7880388 - DNA, 22 bp, Homo sapiens
agacaaattgggacattgtgtt

SEQ ID NO: 7880389 - DNA, 22 bp, Homo sapiens
agacaaatggtaattatgtcta

SEQ ID NO: 7880390 - DNA, 22 bp, Homo sapiens
agacaaataactttttatgtcc

SEQ ID NO: 7880391 - DNA, 22 bp, Homo sapiens
agacaaataactttttatgtcc

SEQ ID NO: 7880392 - DNA, 22 bp, Homo sapiens
agacaaataactttttatgtcc

SEQ ID NO: 7880393 - DNA, 22 bp, Homo sapiens
agacaaatgaacaaatatgtga

SEQ ID NO: 7880394 - DNA, 22 bp, Homo sapiens
agacaaatgaacaaatatgtga

SEQ ID NO: 7880395 - DNA, 22 bp, Homo sapiens
agacaaatgaacaaatatgtga

SEQ ID NO: 7880396 - DNA, 22 bp, Homo sapiens
agacaaataagtgctgggattt

SEQ ID NO: 7880397 - DNA, 22 bp, Homo sapiens
agacaaaggattaatgatgatg

SEQ ID NO: 7880398 - DNA, 22 bp, Homo sapiens
agacaaaggattaatgatgatg

SEQ ID NO: 7880399 - DNA, 22 bp, Homo sapiens
agacaaaggattaatgatgatg

SEQ ID NO: 7880400 - DNA, 22 bp, Homo sapiens
agacaaagacagcatctcaggt

SEQ ID NO: 7880401 - DNA, 22 bp, Homo sapiens
agacaaaggattaatgatgatg

SEQ ID NO: 7880402 - DNA, 22 bp, Homo sapiens
agacaaaggattaatgatgatg

SEQ ID NO: 7880403 - DNA, 22 bp, Homo sapiens
agacaaaggattaatgatgatg

SEQ ID NO: 7880404 - DNA, 21 bp, Homo sapiens
agaagtcaattgaactgaaat

SEQ ID NO: 7880405 - DNA, 22 bp, Homo sapiens
agaagtcaatgatgagagtgct

SEQ ID NO: 7880406 - DNA, 21 bp, Homo sapiens
agaagtcaattgaactgaaat

SEQ ID NO: 7880407 - DNA, 22 bp, Homo sapiens
agaagtcagccacagtgggaga

SEQ ID NO: 7880408 - DNA, 22 bp, Homo sapiens
agaagtcagccacagtgggaga

SEQ ID NO: 7880409 - DNA, 22 bp, Homo sapiens
agaagtcagccacagtgggaga

SEQ ID NO: 7880410 - DNA, 20 bp, Homo sapiens
agaagtcagctcagaagtga

SEQ ID NO: 7880411 - DNA, 20 bp, Homo sapiens
agaagtcagctcagaagtga

SEQ ID NO: 7880412 - DNA, 22 bp, Homo sapiens
agaagtctggaattcctgcagg

SEQ ID NO: 7880413 - DNA, 22 bp, Homo sapiens
agaagtccccccagcatcgtag

SEQ ID NO: 7880414 - DNA, 22 bp, Homo sapiens
agaagtctggaattcctgcagg

SEQ ID NO: 7880415 - DNA, 22 bp, Homo sapiens
agaagtctattgatggcagtcc

SEQ ID NO: 7880416 - DNA, 22 bp, Homo sapiens
agaagtctattgatggcagtcc

SEQ ID NO: 7880417 - DNA, 21 bp, Homo sapiens
agaagtccccactctgtcgca

SEQ ID NO: 7880418 - DNA, 22 bp, Homo sapiens
agaagtccagtgtgtatcaggg

SEQ ID NO: 7880419 - DNA, 23 bp, Homo sapiens
agaagtggaatggccgtggggtc

SEQ ID NO: 7880420 - DNA, 22 bp, Homo sapiens
agaagtgccgaaaggaagacag

SEQ ID NO: 7880421 - DNA, 22 bp, Homo sapiens
agaagtgctccagtgagttggg

SEQ ID NO: 7880422 - DNA, 22 bp, Homo sapiens
agaagtgagtgtgactcagcag

SEQ ID NO: 7880423 - DNA, 22 bp, Homo sapiens
agaagtgagactcagttgatga

SEQ ID NO: 7880424 - DNA, 22 bp, Homo sapiens
agaagtgagttgtgactatggg

SEQ ID NO: 7880425 - DNA, 22 bp, Homo sapiens
agaaggctttaagtactggcat

SEQ ID NO: 7880426 - DNA, 22 bp, Homo sapiens
agaaggctttaagtactggcat

SEQ ID NO: 7880427 - DNA, 22 bp, Homo sapiens
agaagtattctgcatgtactga

SEQ ID NO: 7880428 - DNA, 22 bp, Homo sapiens
agaagggaactcagagatgatt

SEQ ID NO: 7880429 - DNA, 22 bp, Homo sapiens
agaaggctggccctgggtggcc

SEQ ID NO: 7880430 - DNA, 22 bp, Homo sapiens
agaaggcttaaaacatggaata

SEQ ID NO: 7880431 - DNA, 22 bp, Homo sapiens
atctcaggaggaccctgatgct

SEQ ID NO: 7880432 - DNA, 22 bp, Homo sapiens
agaaggctggccctgggtggcc

SEQ ID NO: 7880433 - DNA, 22 bp, Homo sapiens
agaagtcaatgatgagagtgct

SEQ ID NO: 7880434 - DNA, 22 bp, Homo sapiens
agaagtcaatgatgagagtgct

SEQ ID NO: 7880435 - DNA, 22 bp, Homo sapiens
agaagtcaagtggtctatgaaa

SEQ ID NO: 7880436 - DNA, 22 bp, Homo sapiens
agaagtcaagtggtctatgaaa

SEQ ID NO: 7880437 - DNA, 22 bp, Homo sapiens
agaagtatttggctaaaagaca

SEQ ID NO: 7880438 - DNA, 22 bp, Homo sapiens
agaagtatttggctaaaagaca

SEQ ID NO: 7880439 - DNA, 22 bp, Homo sapiens
agaagtcaagtggtctatgaaa

SEQ ID NO: 7880440 - DNA, 22 bp, Homo sapiens
agaagtcaagtggtctatgaaa

SEQ ID NO: 7880441 - DNA, 22 bp, Homo sapiens
atctcaccaagttattacgaga

SEQ ID NO: 7880442 - DNA, 22 bp, Homo sapiens
atctcagaaacatatctaatcc

SEQ ID NO: 7880443 - DNA, 22 bp, Homo sapiens
atctcagaaacatatctaatcc

SEQ ID NO: 7880444 - DNA, 22 bp, Homo sapiens
atctcagaaggcatttccaaga

SEQ ID NO: 7880445 - DNA, 22 bp, Homo sapiens
atctcagaaggcatttccaaga

SEQ ID NO: 7880446 - DNA, 22 bp, Homo sapiens
atctcagaaagtttaatttttc

SEQ ID NO: 7880447 - DNA, 22 bp, Homo sapiens
atctcagaaacatatctaatcc

SEQ ID NO: 7880448 - DNA, 22 bp, Homo sapiens
atctcagatctacagatctaca

SEQ ID NO: 7880449 - DNA, 22 bp, Homo sapiens
atctcagatctacagatctaca

SEQ ID NO: 7880450 - DNA, 22 bp, Homo sapiens
atctcagatctacagatctaca

SEQ ID NO: 7880451 - DNA, 22 bp, Homo sapiens
atctcagagaaatttgaatgca

SEQ ID NO: 7880452 - DNA, 22 bp, Homo sapiens
atctcagacatgttgtccatga

SEQ ID NO: 7880453 - DNA, 22 bp, Homo sapiens
atctcagagaaatttgaatgca

SEQ ID NO: 7880454 - DNA, 22 bp, Homo sapiens
atctcagagaaatttgaatgca

SEQ ID NO: 7880455 - DNA, 22 bp, Homo sapiens
atctcaggaggaccctgatgct

SEQ ID NO: 7880456 - DNA, 22 bp, Homo sapiens
atctcaggaggaccctgatgct

SEQ ID NO: 7880457 - DNA, 22 bp, Homo sapiens
atctcagatctacagatctaca

SEQ ID NO: 7880458 - DNA, 22 bp, Homo sapiens
atctcagatctacagatctaca

SEQ ID NO: 7880459 - DNA, 22 bp, Homo sapiens
atctcagatctacagatctaca

SEQ ID NO: 7880460 - DNA, 22 bp, Homo sapiens
atgaaactctaacttaacaagt

SEQ ID NO: 7880461 - DNA, 22 bp, Homo sapiens
atgaaactctaacttaacaagt

SEQ ID NO: 7880462 - DNA, 22 bp, Homo sapiens
atgaaactctaacttaacaagt

SEQ ID NO: 7880463 - DNA, 23 bp, Homo sapiens
atgaaactcaagccagatccaag

SEQ ID NO: 7880464 - DNA, 22 bp, Homo sapiens
atgaaactctaacttaacaagt

SEQ ID NO: 7880465 - DNA, 22 bp, Homo sapiens
atgaaactgaaggacaaccaga

SEQ ID NO: 7880466 - DNA, 22 bp, Homo sapiens
atgaaactctaacttaacaagt

SEQ ID NO: 7880467 - DNA, 22 bp, Homo sapiens
atgaaacatgctttgtggatga

SEQ ID NO: 7880468 - DNA, 22 bp, Homo sapiens
atgaaactaaactacataagtt

SEQ ID NO: 7880469 - DNA, 23 bp, Homo sapiens
atgaaactcaagccagatccaag

SEQ ID NO: 7880470 - DNA, 23 bp, Homo sapiens
atgaaactcaagccagatccaag

SEQ ID NO: 7880471 - DNA, 22 bp, Homo sapiens
atctttgttgctctcatttctg

SEQ ID NO: 7880472 - DNA, 22 bp, Homo sapiens
agaagtttggtcctataaactc

SEQ ID NO: 7880473 - DNA, 22 bp, Homo sapiens
agaagtttggtcctataaactc

SEQ ID NO: 7880474 - DNA, 22 bp, Homo sapiens
agaagtttggtcctataaactc

SEQ ID NO: 7880475 - DNA, 22 bp, Homo sapiens
agaagtttgaaattaggagaaa

SEQ ID NO: 7880476 - DNA, 22 bp, Homo sapiens
agaagttgttcaaggtggtgag

SEQ ID NO: 7880477 - DNA, 22 bp, Homo sapiens
agaagttgtaggtttgcatatt

SEQ ID NO: 7880478 - DNA, 19 bp, Homo sapiens
agaagttagacattgcaat

SEQ ID NO: 7880479 - DNA, 19 bp, Homo sapiens
agaagttagacattgcaat

SEQ ID NO: 7880480 - DNA, 22 bp, Homo sapiens
agaagttatccaccttagatgc

SEQ ID NO: 7880481 - DNA, 22 bp, Homo sapiens
agaagttatccaccttagatgc

SEQ ID NO: 7880482 - DNA, 22 bp, Homo sapiens
agaagttaccacatacttctct

SEQ ID NO: 7880483 - DNA, 22 bp, Homo sapiens
agaagttaattcctgaaattct

SEQ ID NO: 7880484 - DNA, 22 bp, Homo sapiens
agaagttaattcctgaaattct

SEQ ID NO: 7880485 - DNA, 22 bp, Homo sapiens
agaagtgtttatttcagcaaca

SEQ ID NO: 7880486 - DNA, 22 bp, Homo sapiens
agaagtgtggtctagcagtggc

SEQ ID NO: 7880487 - DNA, 22 bp, Homo sapiens
agaagtgtctcatcaggcaata

SEQ ID NO: 7880488 - DNA, 22 bp, Homo sapiens
agaagtgtctcatcaggcaata

SEQ ID NO: 7880489 - DNA, 22 bp, Homo sapiens
agaagtggtctgtcttccagat

SEQ ID NO: 7880490 - DNA, 20 bp, Homo sapiens
agaagtggctgcagacacta

SEQ ID NO: 7880491 - DNA, 20 bp, Homo sapiens
agaagtggctgcagacacta

SEQ ID NO: 7880492 - DNA, 20 bp, Homo sapiens
agaagtggctgcagacacta

SEQ ID NO: 7880493 - DNA, 22 bp, Homo sapiens
agaagtggtgtgtggccgagct

SEQ ID NO: 7880494 - DNA, 22 bp, Homo sapiens
agaagtgtcagtgcaggcagct

SEQ ID NO: 7880495 - DNA, 22 bp, Homo sapiens
atgacaaaatgaatgcagctag

SEQ ID NO: 7880496 - DNA, 22 bp, Homo sapiens
atgacaaaatgaatgcagctag

SEQ ID NO: 7880497 - DNA, 22 bp, Homo sapiens
agacaaatggtaattatgtcta

SEQ ID NO: 7880498 - DNA, 22 bp, Homo sapiens
atgacaaaatgaatgcagctag

SEQ ID NO: 7880499 - DNA, 22 bp, Homo sapiens
atgacaaaataaatggtctctg

SEQ ID NO: 7880500 - DNA, 22 bp, Homo sapiens
atgacaaaatgaatgcagctag

SEQ ID NO: 7880501 - DNA, 22 bp, Homo sapiens
atgacaaaatgaatgcagctag

SEQ ID NO: 7880502 - DNA, 22 bp, Homo sapiens
atgacaaaagaagacatgaggt

SEQ ID NO: 7880503 - DNA, 22 bp, Homo sapiens
atgacaaaagaagacatgaggt

SEQ ID NO: 7880504 - DNA, 22 bp, Homo sapiens
atgacaaaagaagacatgaggt

SEQ ID NO: 7880505 - DNA, 22 bp, Homo sapiens
atgacaaaagaagacatgaggt

SEQ ID NO: 7880506 - DNA, 22 bp, Homo sapiens
atgacaaaagaagacatgaggt

SEQ ID NO: 7880507 - DNA, 22 bp, Homo sapiens
atgacaaaagaagacatgaggt

SEQ ID NO: 7880508 - DNA, 22 bp, Homo sapiens
atgacaaaagaagacatgaggt

SEQ ID NO: 7880509 - DNA, 22 bp, Homo sapiens
atgacaaacccaggatgtaaca

SEQ ID NO: 7880510 - DNA, 22 bp, Homo sapiens
atgacaaacccaggatgtaaca

SEQ ID NO: 7880511 - DNA, 23 bp, Homo sapiens
atgacaaacaggacatcttgtgc

SEQ ID NO: 7880512 - DNA, 22 bp, Homo sapiens
atgacaaaattcacaggtgtga

SEQ ID NO: 7880513 - DNA, 23 bp, Homo sapiens
atgacaaacaggacatcttgtgc

SEQ ID NO: 7880514 - DNA, 23 bp, Homo sapiens
atgacaaacaggacatcttgtgc

SEQ ID NO: 7880515 - DNA, 23 bp, Homo sapiens
atgacaaacaggacatcttgtgc

SEQ ID NO: 7880516 - DNA, 22 bp, Homo sapiens
atgacaaaggctgaaagggaaa

SEQ ID NO: 7880517 - DNA, 22 bp, Homo sapiens
atgacaaaggctgaaagggaaa

SEQ ID NO: 7880518 - DNA, 22 bp, Homo sapiens
atgacaaacccaggatgtaaca

SEQ ID NO: 7880519 - DNA, 22 bp, Homo sapiens
atgacaaacccaggatgtaaca

SEQ ID NO: 7880520 - DNA, 22 bp, Homo sapiens
atgacaaacccaggatgtaaca

SEQ ID NO: 7880521 - DNA, 22 bp, Homo sapiens
atgacaaaggctgaaagggaaa

SEQ ID NO: 7880522 - DNA, 22 bp, Homo sapiens
atgacaaattcagaccatagca

SEQ ID NO: 7880523 - DNA, 22 bp, Homo sapiens
atgacaaattcagaccatagca

SEQ ID NO: 7880524 - DNA, 22 bp, Homo sapiens
atgacaaattcagaccatagca

SEQ ID NO: 7880525 - DNA, 22 bp, Homo sapiens
atgacaacacatggtgctgaat

SEQ ID NO: 7880526 - DNA, 22 bp, Homo sapiens
atgacaagagtgttcagggaga

SEQ ID NO: 7880527 - DNA, 22 bp, Homo sapiens
atgacaagggttgacacatgtc

SEQ ID NO: 7880528 - DNA, 22 bp, Homo sapiens
atgacaagggttgacacatgtc

SEQ ID NO: 7880529 - DNA, 22 bp, Homo sapiens
atgacaagggagggtcctgcta

SEQ ID NO: 7880530 - DNA, 22 bp, Homo sapiens
atgacaagggttgacacatgtc

SEQ ID NO: 7880531 - DNA, 22 bp, Homo sapiens
atgacaagggagggtcctgcta

SEQ ID NO: 7880532 - DNA, 22 bp, Homo sapiens
atgcacatcactctgaagaaaa

SEQ ID NO: 7880533 - DNA, 22 bp, Homo sapiens
atgcacatcactctgaagaaaa

SEQ ID NO: 7880534 - DNA, 22 bp, Homo sapiens
atgcacatcactctgaagaaaa

SEQ ID NO: 7880535 - DNA, 22 bp, Homo sapiens
atgcacatcttacagatgcaga

SEQ ID NO: 7880536 - DNA, 22 bp, Homo sapiens
atgcacatcttacagatgcaga

SEQ ID NO: 7880537 - DNA, 22 bp, Homo sapiens
atgcacataggccaaatcattt

SEQ ID NO: 7880538 - DNA, 22 bp, Homo sapiens
atgcaactacttctgcaccaat

SEQ ID NO: 7880539 - DNA, 22 bp, Homo sapiens
atgcacatacatatgctctata

SEQ ID NO: 7880540 - DNA, 22 bp, Homo sapiens
atgcacatacatatgctctata

SEQ ID NO: 7880541 - DNA, 22 bp, Homo sapiens
atgcacctgaactccatcagct

SEQ ID NO: 7880542 - DNA, 22 bp, Homo sapiens
atgcacctgaactccatcagct

SEQ ID NO: 7880543 - DNA, 22 bp, Homo sapiens
atgcactaaatcttttgtgcac

SEQ ID NO: 7880544 - DNA, 22 bp, Homo sapiens
atgcacctgaactccatcagct

SEQ ID NO: 7880545 - DNA, 22 bp, Homo sapiens
atgcacctgaactccatcagct

SEQ ID NO: 7880546 - DNA, 22 bp, Homo sapiens
atgcactgtaggtgccatctgc

SEQ ID NO: 7880547 - DNA, 22 bp, Homo sapiens
atgcactgtaagactagccatg

SEQ ID NO: 7880548 - DNA, 22 bp, Homo sapiens
atgcactgggtgaggaaggaga

SEQ ID NO: 7880549 - DNA, 22 bp, Homo sapiens
atgcactgggtgaggaaggaga

SEQ ID NO: 7880550 - DNA, 22 bp, Homo sapiens
atgcactactagatgcaaaagt

SEQ ID NO: 7880551 - DNA, 22 bp, Homo sapiens
atgcactgcccctctgcacctc

SEQ ID NO: 7880552 - DNA, 22 bp, Homo sapiens
atgcactgcccctctgcacctc

SEQ ID NO: 7880553 - DNA, 22 bp, Homo sapiens
atgcacatgaggcaagcaaaat

SEQ ID NO: 7880554 - DNA, 22 bp, Homo sapiens
atgcacatgaggcaagcaaaat

SEQ ID NO: 7880555 - DNA, 22 bp, Homo sapiens
atgcacatcttacagatgcaga

SEQ ID NO: 7880556 - DNA, 22 bp, Homo sapiens
atgcacatgaggcaagcaaaat

SEQ ID NO: 7880557 - DNA, 22 bp, Homo sapiens
atgcacatgtatctatatacaa

SEQ ID NO: 7880558 - DNA, 22 bp, Homo sapiens
atgcacatgtatctatatacaa

SEQ ID NO: 7880559 - DNA, 22 bp, Homo sapiens
atgcacatgtatgtcaatattt

SEQ ID NO: 7880560 - DNA, 22 bp, Homo sapiens
atgcacatgtatctatatacaa

SEQ ID NO: 7880561 - DNA, 22 bp, Homo sapiens
atgcacatgtggctttatgtat

SEQ ID NO: 7880562 - DNA, 22 bp, Homo sapiens
atgcacatgtggctttatgtat

SEQ ID NO: 7880563 - DNA, 22 bp, Homo sapiens
atgcacccagtgtctggactat

SEQ ID NO: 7880564 - DNA, 22 bp, Homo sapiens
agacagaccatggctattcaga

SEQ ID NO: 7880565 - DNA, 22 bp, Homo sapiens
agacagaccatggctattcaga

SEQ ID NO: 7880566 - DNA, 22 bp, Homo sapiens
agacagacattctagagccacc

SEQ ID NO: 7880567 - DNA, 22 bp, Homo sapiens
agacagacattctagagccacc

SEQ ID NO: 7880568 - DNA, 22 bp, Homo sapiens
agacagacattctagagccacc

SEQ ID NO: 7880569 - DNA, 22 bp, Homo sapiens
agacagacattctagagccacc

SEQ ID NO: 7880570 - DNA, 22 bp, Homo sapiens
agacagacatgctagttttctt

SEQ ID NO: 7880571 - DNA, 22 bp, Homo sapiens
agacagacatgctagttttctt

SEQ ID NO: 7880572 - DNA, 22 bp, Homo sapiens
agacagacatagaaattagtaa

SEQ ID NO: 7880573 - DNA, 22 bp, Homo sapiens
agacagacatagaaattagtaa

SEQ ID NO: 7880574 - DNA, 22 bp, Homo sapiens
atgcactgtgagagtgaggggt

SEQ ID NO: 7880575 - DNA, 22 bp, Homo sapiens
atgcactgtgagagtgaggggt

SEQ ID NO: 7880576 - DNA, 22 bp, Homo sapiens
atgcacttaaataacataactt

SEQ ID NO: 7880577 - DNA, 22 bp, Homo sapiens
atgcacttaaataacataactt

SEQ ID NO: 7880578 - DNA, 22 bp, Homo sapiens
agacagacgtagtgtgagagta

SEQ ID NO: 7880579 - DNA, 22 bp, Homo sapiens
agacagacgtagtgtgagagta

SEQ ID NO: 7880580 - DNA, 17 bp, Homo sapiens
agacagacctctgcatc

SEQ ID NO: 7880581 - DNA, 21 bp, Homo sapiens
agacagactgcctgacccacg

SEQ ID NO: 7880582 - DNA, 22 bp, Homo sapiens
agacagacggctttatacacag

SEQ ID NO: 7880583 - DNA, 22 bp, Homo sapiens
agacagacggctttatacacag

SEQ ID NO: 7880584 - DNA, 17 bp, Homo sapiens
agacagacctctgcatc

SEQ ID NO: 7880585 - DNA, 17 bp, Homo sapiens
agacagacctctgcatc

SEQ ID NO: 7880586 - DNA, 17 bp, Homo sapiens
agacagacctctgcatc

SEQ ID NO: 7880587 - DNA, 17 bp, Homo sapiens
agacagacctctgcatc

SEQ ID NO: 7880588 - DNA, 22 bp, Homo sapiens
agacatatattgcaattcactg

SEQ ID NO: 7880589 - DNA, 22 bp, Homo sapiens
agacaggcagaggctgcagagg

SEQ ID NO: 7880590 - DNA, 22 bp, Homo sapiens
agacatatggtgaaacatttta

SEQ ID NO: 7880591 - DNA, 22 bp, Homo sapiens
agacatatggtgaaacatttta

SEQ ID NO: 7880592 - DNA, 22 bp, Homo sapiens
agacatatggtgaaacatttta

SEQ ID NO: 7880593 - DNA, 22 bp, Homo sapiens
agacatcaatgatcagaggtag

SEQ ID NO: 7880594 - DNA, 22 bp, Homo sapiens
agacatcaatgatcagaggtag

SEQ ID NO: 7880595 - DNA, 23 bp, Homo sapiens
agacatatgttctttccagatat

SEQ ID NO: 7880596 - DNA, 23 bp, Homo sapiens
agacatatgttctttccagatat

SEQ ID NO: 7880597 - DNA, 22 bp, Homo sapiens
agacatttattcacacatttat

SEQ ID NO: 7880598 - DNA, 22 bp, Homo sapiens
agacatttattgaacacctagc

SEQ ID NO: 7880599 - DNA, 22 bp, Homo sapiens
agacatttattgaacacctagc

SEQ ID NO: 7880600 - DNA, 22 bp, Homo sapiens
agacatttcctagacatcaatg

SEQ ID NO: 7880601 - DNA, 22 bp, Homo sapiens
agacatttcctagacatcaatg

SEQ ID NO: 7880602 - DNA, 22 bp, Homo sapiens
agacatttcctagacatcaatg

SEQ ID NO: 7880603 - DNA, 22 bp, Homo sapiens
agacatttggagccaactttcc

SEQ ID NO: 7880604 - DNA, 22 bp, Homo sapiens
agacattttaacatctgggttt

SEQ ID NO: 7880605 - DNA, 22 bp, Homo sapiens
agacatttggagccaactttcc

SEQ ID NO: 7880606 - DNA, 22 bp, Homo sapiens
agacatttggaagatacacata

SEQ ID NO: 7880607 - DNA, 22 bp, Homo sapiens
agacatttggaagatacacata

SEQ ID NO: 7880608 - DNA, 22 bp, Homo sapiens
agacaggcagaggctgcagagg

SEQ ID NO: 7880609 - DNA, 22 bp, Homo sapiens
agacaggcagaggctgcagagg

SEQ ID NO: 7880610 - DNA, 22 bp, Homo sapiens
agacaggatgcatactcttggt

SEQ ID NO: 7880611 - DNA, 22 bp, Homo sapiens
agacaggatgcatactcttggt

SEQ ID NO: 7880612 - DNA, 22 bp, Homo sapiens
agacaggcagaggctgcagagg

SEQ ID NO: 7880613 - DNA, 20 bp, Homo sapiens
agacaggagcccccattcag

SEQ ID NO: 7880614 - DNA, 22 bp, Homo sapiens
agacaggatgcatactcttggt

SEQ ID NO: 7880615 - DNA, 22 bp, Homo sapiens
agacaggagagggaactgccgg

SEQ ID NO: 7880616 - DNA, 20 bp, Homo sapiens
agacaggagcccccattcag

SEQ ID NO: 7880617 - DNA, 22 bp, Homo sapiens
agacaggacacaagctgcataa

SEQ ID NO: 7880618 - DNA, 22 bp, Homo sapiens
agacaggagagggaactgccgg

SEQ ID NO: 7880619 - DNA, 22 bp, Homo sapiens
agacaggacacaagctgcataa

SEQ ID NO: 7880620 - DNA, 22 bp, Homo sapiens
agacagctgctcgcagagctat

SEQ ID NO: 7880621 - DNA, 22 bp, Homo sapiens
agacagctgctcgcagagctat

SEQ ID NO: 7880622 - DNA, 22 bp, Homo sapiens
agacagctgctcgcagagctat

SEQ ID NO: 7880623 - DNA, 22 bp, Homo sapiens
agacagctgggaaatggagtgt

SEQ ID NO: 7880624 - DNA, 22 bp, Homo sapiens
agacagctgggagtgtccttct

SEQ ID NO: 7880625 - DNA, 22 bp, Homo sapiens
agacagctgggagtgtccttct

SEQ ID NO: 7880626 - DNA, 22 bp, Homo sapiens
agacagctgggagtgtccttct

SEQ ID NO: 7880627 - DNA, 22 bp, Homo sapiens
agacagctgctcgcagagctat

SEQ ID NO: 7880628 - DNA, 22 bp, Homo sapiens
agacagctgggaaatggagtgt

SEQ ID NO: 7880629 - DNA, 22 bp, Homo sapiens
agacaggacacaagctgcataa

SEQ ID NO: 7880630 - DNA, 22 bp, Homo sapiens
agacaggacacaagctgcataa

SEQ ID NO: 7880631 - DNA, 22 bp, Homo sapiens
agacaggacacaagctgcataa

SEQ ID NO: 7880632 - DNA, 21 bp, Homo sapiens
agacagctttaaagacacagg

SEQ ID NO: 7880633 - DNA, 21 bp, Homo sapiens
agacagctttaaagacacagg

SEQ ID NO: 7880634 - DNA, 22 bp, Homo sapiens
agacagctgttccttcatgttt

SEQ ID NO: 7880635 - DNA, 22 bp, Homo sapiens
agacagctgttccttcatgttt

SEQ ID NO: 7880636 - DNA, 22 bp, Homo sapiens
agacagcaggggagtctggttt

SEQ ID NO: 7880637 - DNA, 22 bp, Homo sapiens
agacagcagggagcaggattca

SEQ ID NO: 7880638 - DNA, 22 bp, Homo sapiens
agacagcagggagcaggattca

SEQ ID NO: 7880639 - DNA, 21 bp, Homo sapiens
agacagcagtctccaaacccc

SEQ ID NO: 7880640 - DNA, 22 bp, Homo sapiens
agacagcaggggagtctggttt

SEQ ID NO: 7880641 - DNA, 22 bp, Homo sapiens
agacagcaggggagtctggttt

SEQ ID NO: 7880642 - DNA, 22 bp, Homo sapiens
agacagcatgatacatgatgct

SEQ ID NO: 7880643 - DNA, 22 bp, Homo sapiens
agacagcatgagcctgctgatg

SEQ ID NO: 7880644 - DNA, 22 bp, Homo sapiens
agacagcatgatacatgatgct

SEQ ID NO: 7880645 - DNA, 22 bp, Homo sapiens
agacagcatgatacatgatgct

SEQ ID NO: 7880646 - DNA, 22 bp, Homo sapiens
agacagcatgagcctgctgatg

SEQ ID NO: 7880647 - DNA, 22 bp, Homo sapiens
agacagcatgagcctgctgatg

SEQ ID NO: 7880648 - DNA, 22 bp, Homo sapiens
agacagcatgagcctgctgatg

SEQ ID NO: 7880649 - DNA, 22 bp, Homo sapiens
agacagcatgagcctgctgatg

SEQ ID NO: 7880650 - DNA, 22 bp, Homo sapiens
agacagcatgagcctgctgatg

SEQ ID NO: 7880651 - DNA, 22 bp, Homo sapiens
agacagcagaaactagagcact

SEQ ID NO: 7880652 - DNA, 21 bp, Homo sapiens
agacagcagatagtcgaaagg

SEQ ID NO: 7880653 - DNA, 21 bp, Homo sapiens
agacagcagatagtcgaaagg

SEQ ID NO: 7880654 - DNA, 22 bp, Homo sapiens
agacagactgtgtttgaatcct

SEQ ID NO: 7880655 - DNA, 22 bp, Homo sapiens
agacagacttgaaaatgttctt

SEQ ID NO: 7880656 - DNA, 22 bp, Homo sapiens
agacagactggtttgaattggt

SEQ ID NO: 7880657 - DNA, 22 bp, Homo sapiens
agacagcatgatacatgatgct

SEQ ID NO: 7880658 - DNA, 22 bp, Homo sapiens
agacagcatgatacatgatgct

SEQ ID NO: 7880659 - DNA, 22 bp, Homo sapiens
agacagcatgatacatgatgct

SEQ ID NO: 7880660 - DNA, 22 bp, Homo sapiens
agacagcatgatacatgatgct

SEQ ID NO: 7880661 - DNA, 22 bp, Homo sapiens
agacagcatgatacatgatgct

SEQ ID NO: 7880662 - DNA, 22 bp, Homo sapiens
agacagcatgatacatgatgct

SEQ ID NO: 7880663 - DNA, 22 bp, Homo sapiens
agacagcatttctagcaccagg

SEQ ID NO: 7880664 - DNA, 22 bp, Homo sapiens
agacagcatttctagcaccagg

SEQ ID NO: 7880665 - DNA, 22 bp, Homo sapiens
agacagcatttctagcaccagg

SEQ ID NO: 7880666 - DNA, 22 bp, Homo sapiens
agacagccaatgctggaagatg

SEQ ID NO: 7880667 - DNA, 22 bp, Homo sapiens
agacagccaatgctggaagatg

SEQ ID NO: 7880668 - DNA, 22 bp, Homo sapiens
agacagctctgggttccacact

SEQ ID NO: 7880669 - DNA, 19 bp, Homo sapiens
agacagctctattattttg

SEQ ID NO: 7880670 - DNA, 22 bp, Homo sapiens
agacagctccaagtgtctctgt

SEQ ID NO: 7880671 - DNA, 22 bp, Homo sapiens
agacagctccaagtgtctctgt

SEQ ID NO: 7880672 - DNA, 22 bp, Homo sapiens
agacagctccaagtgtctctgt

SEQ ID NO: 7880673 - DNA, 22 bp, Homo sapiens
agacagctgcctccaccacagc

SEQ ID NO: 7880674 - DNA, 22 bp, Homo sapiens
agacagctctgggttccacact

SEQ ID NO: 7880675 - DNA, 22 bp, Homo sapiens
agacagctgctcgcagagctat

SEQ ID NO: 7880676 - DNA, 22 bp, Homo sapiens
agacagctagggctgcagggac

SEQ ID NO: 7880677 - DNA, 22 bp, Homo sapiens
agacagctagggctgcagggac

SEQ ID NO: 7880678 - DNA, 22 bp, Homo sapiens
agacagctagggctgcagggac

SEQ ID NO: 7880679 - DNA, 22 bp, Homo sapiens
agacagctatcaacaactttct

SEQ ID NO: 7880680 - DNA, 22 bp, Homo sapiens
agaccactaaaactttctctat

SEQ ID NO: 7880681 - DNA, 22 bp, Homo sapiens
agaccactaaaactttctctat

SEQ ID NO: 7880682 - DNA, 22 bp, Homo sapiens
agaccactcaaaattagtgtct

SEQ ID NO: 7880683 - DNA, 22 bp, Homo sapiens
agaccacagtcaggctcctggt

SEQ ID NO: 7880684 - DNA, 22 bp, Homo sapiens
agacattttggaaagtattact

SEQ ID NO: 7880685 - DNA, 22 bp, Homo sapiens
agacattttggaaagtattact

SEQ ID NO: 7880686 - DNA, 22 bp, Homo sapiens
agaccaagactataatgagagg

SEQ ID NO: 7880687 - DNA, 22 bp, Homo sapiens
agacattttagacataaaagat

SEQ ID NO: 7880688 - DNA, 22 bp, Homo sapiens
agacattttagacataaaagat

SEQ ID NO: 7880689 - DNA, 22 bp, Homo sapiens
agacattttagacataaaagat

SEQ ID NO: 7880690 - DNA, 23 bp, Homo sapiens
agacattttaataaggacttttt

SEQ ID NO: 7880691 - DNA, 22 bp, Homo sapiens
agacattttacattcttccatt

SEQ ID NO: 7880692 - DNA, 22 bp, Homo sapiens
agacattttgcaatgggtagct

SEQ ID NO: 7880693 - DNA, 22 bp, Homo sapiens
agacattttggaaagtattact

SEQ ID NO: 7880694 - DNA, 22 bp, Homo sapiens
agacattttgcaatgggtagct

SEQ ID NO: 7880695 - DNA, 22 bp, Homo sapiens
agacccagaaagcagctgcatt

SEQ ID NO: 7880696 - DNA, 22 bp, Homo sapiens
agacccagaaagcagctgcatt

SEQ ID NO: 7880697 - DNA, 22 bp, Homo sapiens
agacccagaaagcagctgcatt

SEQ ID NO: 7880698 - DNA, 22 bp, Homo sapiens
agacccacactttgagtagcaa

SEQ ID NO: 7880699 - DNA, 22 bp, Homo sapiens
agacccagaaagcagctgcatt

SEQ ID NO: 7880700 - DNA, 22 bp, Homo sapiens
agacccacactttgagtagcaa

SEQ ID NO: 7880701 - DNA, 22 bp, Homo sapiens
agaccagtaaaattagtgggag

SEQ ID NO: 7880702 - DNA, 22 bp, Homo sapiens
agaccagtagtatggattatga

SEQ ID NO: 7880703 - DNA, 22 bp, Homo sapiens
agaccagtgagtaggccttaga

SEQ ID NO: 7880704 - DNA, 22 bp, Homo sapiens
agaccagtgcatggcgtttgct

SEQ ID NO: 7880705 - DNA, 21 bp, Homo sapiens
agaccagtgggataaataggt

SEQ ID NO: 7880706 - DNA, 22 bp, Homo sapiens
agaccagttacattagaacttc

SEQ ID NO: 7880707 - DNA, 22 bp, Homo sapiens
agaccagttacattagaacttc

SEQ ID NO: 7880708 - DNA, 22 bp, Homo sapiens
agaccagtgttttagttagaag

SEQ ID NO: 7880709 - DNA, 22 bp, Homo sapiens
agaccagttcccttcttggctg

SEQ ID NO: 7880710 - DNA, 22 bp, Homo sapiens
agaccagttttattatttgagt

SEQ ID NO: 7880711 - DNA, 22 bp, Homo sapiens
agaccatagggacctcaggttg

SEQ ID NO: 7880712 - DNA, 22 bp, Homo sapiens
agaccatgacctgccactaagc

SEQ ID NO: 7880713 - DNA, 22 bp, Homo sapiens
agaccaggaaggcctacagata

SEQ ID NO: 7880714 - DNA, 22 bp, Homo sapiens
agaccaggaaggcctacagata

SEQ ID NO: 7880715 - DNA, 22 bp, Homo sapiens
agaccaggaaggcctacagata

SEQ ID NO: 7880716 - DNA, 22 bp, Homo sapiens
agaccactggcctcctgcagac

SEQ ID NO: 7880717 - DNA, 22 bp, Homo sapiens
agaccactggcctcctgcagac

SEQ ID NO: 7880718 - DNA, 22 bp, Homo sapiens
agaccactggcctcctgcagac

SEQ ID NO: 7880719 - DNA, 18 bp, Homo sapiens
agaccagacaagaatggt

SEQ ID NO: 7880720 - DNA, 22 bp, Homo sapiens
agaccaggtctttatggctcca

SEQ ID NO: 7880721 - DNA, 22 bp, Homo sapiens
agaccagggtcccacagagtct

SEQ ID NO: 7880722 - DNA, 22 bp, Homo sapiens
agaccagggtcccacagagtct

SEQ ID NO: 7880723 - DNA, 22 bp, Homo sapiens
agaccagggtcccacagagtct

SEQ ID NO: 7880724 - DNA, 22 bp, Homo sapiens
agaccagggtcccacagagtct

SEQ ID NO: 7880725 - DNA, 22 bp, Homo sapiens
agaccagggtcccacagagtct

SEQ ID NO: 7880726 - DNA, 22 bp, Homo sapiens
agaccagggtcccacagagtct

SEQ ID NO: 7880727 - DNA, 22 bp, Homo sapiens
atggccagctcagagcactcag

SEQ ID NO: 7880728 - DNA, 22 bp, Homo sapiens
atggccagctcagagcactcag

SEQ ID NO: 7880729 - DNA, 22 bp, Homo sapiens
atggccagctcagagcactcag

SEQ ID NO: 7880730 - DNA, 22 bp, Homo sapiens
atggccagctcagagcactcag

SEQ ID NO: 7880731 - DNA, 22 bp, Homo sapiens
atggccagctcagagcactcag

SEQ ID NO: 7880732 - DNA, 22 bp, Homo sapiens
atggccagctagcacttgcatt

SEQ ID NO: 7880733 - DNA, 22 bp, Homo sapiens
atggccagctagcacttgcatt

SEQ ID NO: 7880734 - DNA, 22 bp, Homo sapiens
atggccagcctggtacttggca

SEQ ID NO: 7880735 - DNA, 22 bp, Homo sapiens
atggccagcccttcccgcagct

SEQ ID NO: 7880736 - DNA, 22 bp, Homo sapiens
atggccagccactcctgatggc

SEQ ID NO: 7880737 - DNA, 22 bp, Homo sapiens
atggccagccactcctgatggc

SEQ ID NO: 7880738 - DNA, 22 bp, Homo sapiens
atggccagcaagttcagaattt

SEQ ID NO: 7880739 - DNA, 22 bp, Homo sapiens
atggccagcccttcccgcagct

SEQ ID NO: 7880740 - DNA, 22 bp, Homo sapiens
atggccagccactcctgatggc

SEQ ID NO: 7880741 - DNA, 22 bp, Homo sapiens
atggccagcccttcccgcagct

SEQ ID NO: 7880742 - DNA, 22 bp, Homo sapiens
atggccagccactcctgatggc

SEQ ID NO: 7880743 - DNA, 22 bp, Homo sapiens
atggccagcccttcccgcagct

SEQ ID NO: 7880744 - DNA, 22 bp, Homo sapiens
atggccagcccttcccgcagct

SEQ ID NO: 7880745 - DNA, 23 bp, Homo sapiens
agacccagagactggctctgctc

SEQ ID NO: 7880746 - DNA, 23 bp, Homo sapiens
agacccagagactggctctgctc

SEQ ID NO: 7880747 - DNA, 22 bp, Homo sapiens
atggcagcctgagcagaggaat

SEQ ID NO: 7880748 - DNA, 22 bp, Homo sapiens
atggcagcctgagcagaggaat

SEQ ID NO: 7880749 - DNA, 22 bp, Homo sapiens
atggcagcctgtggacagtcaa

SEQ ID NO: 7880750 - DNA, 22 bp, Homo sapiens
atggcagcctgtggacagtcaa

SEQ ID NO: 7880751 - DNA, 22 bp, Homo sapiens
atggcagcggagctggaaatga

SEQ ID NO: 7880752 - DNA, 22 bp, Homo sapiens
atggccagcaagttcagaattt

SEQ ID NO: 7880753 - DNA, 22 bp, Homo sapiens
atggccagcaaggtagggcaat

SEQ ID NO: 7880754 - DNA, 22 bp, Homo sapiens
agagaagagcaatgataaattt

SEQ ID NO: 7880755 - DNA, 22 bp, Homo sapiens
agagaagagcaatgataaattt

SEQ ID NO: 7880756 - DNA, 22 bp, Homo sapiens
agagaagagcaatgataaattt

SEQ ID NO: 7880757 - DNA, 22 bp, Homo sapiens
agagaagagcaatgataaattt

SEQ ID NO: 7880758 - DNA, 21 bp, Homo sapiens
agagaagaggactttctcaca

SEQ ID NO: 7880759 - DNA, 21 bp, Homo sapiens
agagaagaggactttctcaca

SEQ ID NO: 7880760 - DNA, 18 bp, Homo sapiens
agagaagaggtgttagtc

SEQ ID NO: 7880761 - DNA, 21 bp, Homo sapiens
agagaagaggactttctcaca

SEQ ID NO: 7880762 - DNA, 18 bp, Homo sapiens
agagaagaggtgttagtc

SEQ ID NO: 7880763 - DNA, 21 bp, Homo sapiens
agagaagaggactttctcaca

SEQ ID NO: 7880764 - DNA, 22 bp, Homo sapiens
agagaagagcaatgataaattt

SEQ ID NO: 7880765 - DNA, 22 bp, Homo sapiens
agagaagagcaatgataaattt

SEQ ID NO: 7880766 - DNA, 22 bp, Homo sapiens
agagaagagcaatgataaattt

SEQ ID NO: 7880767 - DNA, 22 bp, Homo sapiens
agagaagagcaatgataaattt

SEQ ID NO: 7880768 - DNA, 22 bp, Homo sapiens
agagaagacttacagccacagt

SEQ ID NO: 7880769 - DNA, 22 bp, Homo sapiens
agagaagagcaatgataaattt

SEQ ID NO: 7880770 - DNA, 22 bp, Homo sapiens
agagaagacttacagccacagt

SEQ ID NO: 7880771 - DNA, 22 bp, Homo sapiens
atggccagggtggcactgtggt

SEQ ID NO: 7880772 - DNA, 22 bp, Homo sapiens
atggccagggtggcactgtggt

SEQ ID NO: 7880773 - DNA, 22 bp, Homo sapiens
atggccagggtggcactgtggt

SEQ ID NO: 7880774 - DNA, 22 bp, Homo sapiens
atggccagggtggcactgtggt

SEQ ID NO: 7880775 - DNA, 22 bp, Homo sapiens
atggccagggccaaaagagatg

SEQ ID NO: 7880776 - DNA, 22 bp, Homo sapiens
atggccagggtggcactgtggt

SEQ ID NO: 7880777 - DNA, 22 bp, Homo sapiens
atggccagtcaagcctctggct

SEQ ID NO: 7880778 - DNA, 22 bp, Homo sapiens
atggccagtcaagcctctggct

SEQ ID NO: 7880779 - DNA, 22 bp, Homo sapiens
atggccagcttataggggctca

SEQ ID NO: 7880780 - DNA, 22 bp, Homo sapiens
atggccagcttataggggctca

SEQ ID NO: 7880781 - DNA, 22 bp, Homo sapiens
atggccaggcacctctggctga

SEQ ID NO: 7880782 - DNA, 22 bp, Homo sapiens
atggccagcttataggggctca

SEQ ID NO: 7880783 - DNA, 22 bp, Homo sapiens
atggccagggccaaaagagatg

SEQ ID NO: 7880784 - DNA, 22 bp, Homo sapiens
atggccaggcacctctggctga

SEQ ID NO: 7880785 - DNA, 20 bp, Homo sapiens
agagaccctgtagcttgcag

SEQ ID NO: 7880786 - DNA, 22 bp, Homo sapiens
agagaccctggagttcttcact

SEQ ID NO: 7880787 - DNA, 22 bp, Homo sapiens
agagacccgcagcctcggagct

SEQ ID NO: 7880788 - DNA, 22 bp, Homo sapiens
agagacccgcagcctcggagct

SEQ ID NO: 7880789 - DNA, 21 bp, Homo sapiens
agagaccagctgttactccca

SEQ ID NO: 7880790 - DNA, 22 bp, Homo sapiens
agagaccagaatccagctgcct

SEQ ID NO: 7880791 - DNA, 22 bp, Homo sapiens
agagacccagactgatcattgc

SEQ ID NO: 7880792 - DNA, 22 bp, Homo sapiens
agagacccattgccggaatcac

SEQ ID NO: 7880793 - DNA, 19 bp, Homo sapiens
agagaccacagagctgcct

SEQ ID NO: 7880794 - DNA, 19 bp, Homo sapiens
agagaccacagagctgcct

SEQ ID NO: 7880795 - DNA, 22 bp, Homo sapiens
agagaccagaatccagctgcct

SEQ ID NO: 7880796 - DNA, 22 bp, Homo sapiens
agagaccagaatccagctgcct

SEQ ID NO: 7880797 - DNA, 19 bp, Homo sapiens
agagaccacagagctgcct

SEQ ID NO: 7880798 - DNA, 19 bp, Homo sapiens
agagaccacagagctgcct

SEQ ID NO: 7880799 - DNA, 22 bp, Homo sapiens
agagacagggttttgtcgtgtt

SEQ ID NO: 7880800 - DNA, 22 bp, Homo sapiens
agagacagggttttgtcgtgtt

SEQ ID NO: 7880801 - DNA, 22 bp, Homo sapiens
agagacatggagaggcaaagtt

SEQ ID NO: 7880802 - DNA, 22 bp, Homo sapiens
agagacatagcacagtttttcg

SEQ ID NO: 7880803 - DNA, 22 bp, Homo sapiens
agagacatggagaggcaaagtt

SEQ ID NO: 7880804 - DNA, 22 bp, Homo sapiens
agagacagggttttgtcgtgtt

SEQ ID NO: 7880805 - DNA, 22 bp, Homo sapiens
agagaaggaaagctgacatggg

SEQ ID NO: 7880806 - DNA, 22 bp, Homo sapiens
agagaaggaaagctgacatggg

SEQ ID NO: 7880807 - DNA, 22 bp, Homo sapiens
agagaaggaaagctgacatggg

SEQ ID NO: 7880808 - DNA, 22 bp, Homo sapiens
agagaaggaaagctgacatggg

SEQ ID NO: 7880809 - DNA, 22 bp, Homo sapiens
agagaaggaaagctgacatggg

SEQ ID NO: 7880810 - DNA, 22 bp, Homo sapiens
agagaaggaaagctgacatggg

SEQ ID NO: 7880811 - DNA, 22 bp, Homo sapiens
agagacagggttttgtcgtgtt

SEQ ID NO: 7880812 - DNA, 22 bp, Homo sapiens
agagacagggttttgtcgtgtt

SEQ ID NO: 7880813 - DNA, 22 bp, Homo sapiens
agagacagggttttgtcgtgtt

SEQ ID NO: 7880814 - DNA, 22 bp, Homo sapiens
agagacagggttttgtcgtgtt

SEQ ID NO: 7880815 - DNA, 22 bp, Homo sapiens
agagacagaggcaatatagctt

SEQ ID NO: 7880816 - DNA, 22 bp, Homo sapiens
agagacagaggcaatatagctt

SEQ ID NO: 7880817 - DNA, 22 bp, Homo sapiens
agagacagaggcaatatagctt

SEQ ID NO: 7880818 - DNA, 22 bp, Homo sapiens
agagacagaggcaatatagctt

SEQ ID NO: 7880819 - DNA, 22 bp, Homo sapiens
agagaagcattcttctcagggc

SEQ ID NO: 7880820 - DNA, 22 bp, Homo sapiens
agagaagcattcttctcagggc

SEQ ID NO: 7880821 - DNA, 22 bp, Homo sapiens
agagaaggaaagctgacatggg

SEQ ID NO: 7880822 - DNA, 22 bp, Homo sapiens
agagaagcagggagtcatctgt

SEQ ID NO: 7880823 - DNA, 22 bp, Homo sapiens
agagaagattcttatatgtctt

SEQ ID NO: 7880824 - DNA, 22 bp, Homo sapiens
agagaagagtcttgtcaaatta

SEQ ID NO: 7880825 - DNA, 22 bp, Homo sapiens
agagaagattcttatatgtctt

SEQ ID NO: 7880826 - DNA, 22 bp, Homo sapiens
agagaagattcttatatgtctt

SEQ ID NO: 7880827 - DNA, 22 bp, Homo sapiens
agagaagagtcttgtcaaatta

SEQ ID NO: 7880828 - DNA, 22 bp, Homo sapiens
agagaagagtcttgtcaaatta

SEQ ID NO: 7880829 - DNA, 22 bp, Homo sapiens
agagaagagtcttgtcaaatta

SEQ ID NO: 7880830 - DNA, 18 bp, Homo sapiens
agagaagaggtgttagtc

SEQ ID NO: 7880831 - DNA, 22 bp, Homo sapiens
atggcctgcagtgctgccacag

SEQ ID NO: 7880832 - DNA, 22 bp, Homo sapiens
atggcctgcagtgctgccacag

SEQ ID NO: 7880833 - DNA, 20 bp, Homo sapiens
atggcctgctagaagtctgt

SEQ ID NO: 7880834 - DNA, 20 bp, Homo sapiens
atggcctgctagaagtctgt

SEQ ID NO: 7880835 - DNA, 22 bp, Homo sapiens
atggcctggccagagctctgct

SEQ ID NO: 7880836 - DNA, 22 bp, Homo sapiens
atggcctggccagagctctgct

SEQ ID NO: 7880837 - DNA, 22 bp, Homo sapiens
atggcctgggcccgcttcagat

SEQ ID NO: 7880838 - DNA, 22 bp, Homo sapiens
atggcctggggattcctgagca

SEQ ID NO: 7880839 - DNA, 22 bp, Homo sapiens
atggcctggggagcatgggaag

SEQ ID NO: 7880840 - DNA, 22 bp, Homo sapiens
atggcctggggagcatgggaag

SEQ ID NO: 7880841 - DNA, 22 bp, Homo sapiens
atggcctggggagcatgggaag

SEQ ID NO: 7880842 - DNA, 22 bp, Homo sapiens
atggccgcctgtccttcccgcc

SEQ ID NO: 7880843 - DNA, 22 bp, Homo sapiens
atggcctgatgcacctgtccca

SEQ ID NO: 7880844 - DNA, 22 bp, Homo sapiens
agagactaatgggagcggaagt

SEQ ID NO: 7880845 - DNA, 22 bp, Homo sapiens
agagactaagccagcatagtgc

SEQ ID NO: 7880846 - DNA, 22 bp, Homo sapiens
agagactaatgggagcggaagt

SEQ ID NO: 7880847 - DNA, 22 bp, Homo sapiens
agagactgatggagctcactct

SEQ ID NO: 7880848 - DNA, 22 bp, Homo sapiens
agagactgatggagctcactct

SEQ ID NO: 7880849 - DNA, 22 bp, Homo sapiens
agagactgatggagctcactct

SEQ ID NO: 7880850 - DNA, 22 bp, Homo sapiens
agagacctttgttattctagga

SEQ ID NO: 7880851 - DNA, 22 bp, Homo sapiens
agagaccttttgccttctagtt

SEQ ID NO: 7880852 - DNA, 22 bp, Homo sapiens
agagacgcattcagaggcaggc

SEQ ID NO: 7880853 - DNA, 22 bp, Homo sapiens
agagactaagccagcatagtgc

SEQ ID NO: 7880854 - DNA, 22 bp, Homo sapiens
agagacctttctcctgcctttc

SEQ ID NO: 7880855 - DNA, 22 bp, Homo sapiens
agagaccttcctgactccagag

SEQ ID NO: 7880856 - DNA, 22 bp, Homo sapiens
agagagttgtatgtttctaaaa

SEQ ID NO: 7880857 - DNA, 22 bp, Homo sapiens
agagagttgtaccacactcata

SEQ ID NO: 7880858 - DNA, 22 bp, Homo sapiens
atggctcagcccatggaagaaa

SEQ ID NO: 7880859 - DNA, 22 bp, Homo sapiens
atggctcagcccatggaagaaa

SEQ ID NO: 7880860 - DNA, 22 bp, Homo sapiens
atggctcagcgcctttctgtgg

SEQ ID NO: 7880861 - DNA, 22 bp, Homo sapiens
atggctcagcccatggaagaaa

SEQ ID NO: 7880862 - DNA, 22 bp, Homo sapiens
atggctcagcccatggaagaaa

SEQ ID NO: 7880863 - DNA, 22 bp, Homo sapiens
atggctaaacctgaactggtct

SEQ ID NO: 7880864 - DNA, 22 bp, Homo sapiens
atggccttcatgatagaaggta

SEQ ID NO: 7880865 - DNA, 22 bp, Homo sapiens
atggccttcatgatagaaggta

SEQ ID NO: 7880866 - DNA, 22 bp, Homo sapiens
atggccttattcaaggaagact

SEQ ID NO: 7880867 - DNA, 22 bp, Homo sapiens
atggccttagtgatgattaata

SEQ ID NO: 7880868 - DNA, 22 bp, Homo sapiens
atggctagcaccgcgttgctgg

SEQ ID NO: 7880869 - DNA, 22 bp, Homo sapiens
atggctagcaccgcgttgctgg

SEQ ID NO: 7880870 - DNA, 22 bp, Homo sapiens
atggctagcaccgcgttgctgg

SEQ ID NO: 7880871 - DNA, 22 bp, Homo sapiens
atggctagttgatatggtgttt

SEQ ID NO: 7880872 - DNA, 17 bp, Homo sapiens
atggctcacctgtgggc

SEQ ID NO: 7880873 - DNA, 17 bp, Homo sapiens
atggctcacctgtgggc

SEQ ID NO: 7880874 - DNA, 17 bp, Homo sapiens
atggctcacctgtgggc

SEQ ID NO: 7880875 - DNA, 17 bp, Homo sapiens
atggctcacctgtgggc

SEQ ID NO: 7880876 - DNA, 17 bp, Homo sapiens
atggctcacctgtgggc

SEQ ID NO: 7880877 - DNA, 22 bp, Homo sapiens
atgtgtacacacatatatgtat

SEQ ID NO: 7880878 - DNA, 22 bp, Homo sapiens
atgtgtacacacatatatgtat

SEQ ID NO: 7880879 - DNA, 22 bp, Homo sapiens
atgtgtaatgtggtattttaat

SEQ ID NO: 7880880 - DNA, 22 bp, Homo sapiens
atgtgtacaaccaagcactaaa

SEQ ID NO: 7880881 - DNA, 22 bp, Homo sapiens
atgtgtaaaaggcatgttttat

SEQ ID NO: 7880882 - DNA, 22 bp, Homo sapiens
atgtgtaaaaagtgcttaatat

SEQ ID NO: 7880883 - DNA, 22 bp, Homo sapiens
atgtggttgaagaattacatct

SEQ ID NO: 7880884 - DNA, 22 bp, Homo sapiens
atgtggggacaaaatgatggcc

SEQ ID NO: 7880885 - DNA, 22 bp, Homo sapiens
atgtggggactctgagagaatt

SEQ ID NO: 7880886 - DNA, 22 bp, Homo sapiens
atgtggggactctgagagaatt

SEQ ID NO: 7880887 - DNA, 22 bp, Homo sapiens
atgtggggacaaaatgatggcc

SEQ ID NO: 7880888 - DNA, 22 bp, Homo sapiens
atgtgggccttcaggagaaaga

SEQ ID NO: 7880889 - DNA, 22 bp, Homo sapiens
atgtgggccgtgcgggtgtcct

SEQ ID NO: 7880890 - DNA, 22 bp, Homo sapiens
atgtgggccgtgcgggtgtcct

SEQ ID NO: 7880891 - DNA, 22 bp, Homo sapiens
atgtgggccgtgcgggtgtcct

SEQ ID NO: 7880892 - DNA, 22 bp, Homo sapiens
atgtgggccgtgcgggtgtcct

SEQ ID NO: 7880893 - DNA, 22 bp, Homo sapiens
atgtgggccgtgcgggtgtcct

SEQ ID NO: 7880894 - DNA, 22 bp, Homo sapiens
atgtgggagatttcaggaggtg

SEQ ID NO: 7880895 - DNA, 22 bp, Homo sapiens
atgtgggagatttcaggaggtg

SEQ ID NO: 7880896 - DNA, 22 bp, Homo sapiens
agagcctgtacttttctgtgaa

SEQ ID NO: 7880897 - DNA, 22 bp, Homo sapiens
agagcctgtacttttctgtgaa

SEQ ID NO: 7880898 - DNA, 22 bp, Homo sapiens
agagcctgtcaattgtaaagag

SEQ ID NO: 7880899 - DNA, 22 bp, Homo sapiens
agagcctgtcaattgtaaagag

SEQ ID NO: 7880900 - DNA, 22 bp, Homo sapiens
agagcctgtctgcctttctacc

SEQ ID NO: 7880901 - DNA, 22 bp, Homo sapiens
agagcctgtctgcctttctacc

SEQ ID NO: 7880902 - DNA, 22 bp, Homo sapiens
agagcctgtcaattgtaaagag

SEQ ID NO: 7880903 - DNA, 22 bp, Homo sapiens
agagcctgtcaattgtaaagag

SEQ ID NO: 7880904 - DNA, 22 bp, Homo sapiens
agagcctggtctgagataggac

SEQ ID NO: 7880905 - DNA, 22 bp, Homo sapiens
agagcctggtctgagataggac

SEQ ID NO: 7880906 - DNA, 22 bp, Homo sapiens
agagcctggtctgagataggac

SEQ ID NO: 7880907 - DNA, 22 bp, Homo sapiens
agagcctggggattggcaaggg

SEQ ID NO: 7880908 - DNA, 22 bp, Homo sapiens
agagcctggttcaaattttacc

SEQ ID NO: 7880909 - DNA, 22 bp, Homo sapiens
agagcctgtaacatctttctta

SEQ ID NO: 7880910 - DNA, 22 bp, Homo sapiens
agagcctggttcaaattttacc

SEQ ID NO: 7880911 - DNA, 22 bp, Homo sapiens
agagcctggtctgagataggac

SEQ ID NO: 7880912 - DNA, 22 bp, Homo sapiens
agagcctgtaacatctttctta

SEQ ID NO: 7880913 - DNA, 22 bp, Homo sapiens
agagcctgtacttttctgtgaa

SEQ ID NO: 7880914 - DNA, 22 bp, Homo sapiens
agagcctgttcggaggcgcccc

SEQ ID NO: 7880915 - DNA, 22 bp, Homo sapiens
agagcctgttcggaggcgcccc

SEQ ID NO: 7880916 - DNA, 22 bp, Homo sapiens
agagcctgttcggaggcgcccc

SEQ ID NO: 7880917 - DNA, 22 bp, Homo sapiens
agagcctgttttgtgggagatg

SEQ ID NO: 7880918 - DNA, 22 bp, Homo sapiens
agagcctgttcggaggcgcccc

SEQ ID NO: 7880919 - DNA, 22 bp, Homo sapiens
atgtggcttttcctgggttcct

SEQ ID NO: 7880920 - DNA, 22 bp, Homo sapiens
agagcctgtgggagatgcagct

SEQ ID NO: 7880921 - DNA, 22 bp, Homo sapiens
agagcctgtgggagatgcagct

SEQ ID NO: 7880922 - DNA, 22 bp, Homo sapiens
agagcctgtgggagatgcagct

SEQ ID NO: 7880923 - DNA, 22 bp, Homo sapiens
agagcctgtgggagatgcagct

SEQ ID NO: 7880924 - DNA, 22 bp, Homo sapiens
agagcctgtgggagatgcagct

SEQ ID NO: 7880925 - DNA, 22 bp, Homo sapiens
agagcctgtgattgtcatcacc

SEQ ID NO: 7880926 - DNA, 22 bp, Homo sapiens
agagcctgtgattgtcatcacc

SEQ ID NO: 7880927 - DNA, 22 bp, Homo sapiens
agagcctgtgattgtcatcacc

SEQ ID NO: 7880928 - DNA, 22 bp, Homo sapiens
agagcctgtgattgtcatcacc

SEQ ID NO: 7880929 - DNA, 22 bp, Homo sapiens
agagcctgtgggagatgcagct

SEQ ID NO: 7880930 - DNA, 22 bp, Homo sapiens
agagcctgtgggagatgcagct

SEQ ID NO: 7880931 - DNA, 22 bp, Homo sapiens
agagccagatggagccgtgtgt

SEQ ID NO: 7880932 - DNA, 22 bp, Homo sapiens
agagccagatggagccgtgtgt

SEQ ID NO: 7880933 - DNA, 22 bp, Homo sapiens
agagccagatggagccgtgtgt

SEQ ID NO: 7880934 - DNA, 22 bp, Homo sapiens
agagccagcaactctagccctg

SEQ ID NO: 7880935 - DNA, 22 bp, Homo sapiens
agagccagatggagccgtgtgt

SEQ ID NO: 7880936 - DNA, 22 bp, Homo sapiens
agagccagcaactctagccctg

SEQ ID NO: 7880937 - DNA, 22 bp, Homo sapiens
agagccagcaactctagccctg

SEQ ID NO: 7880938 - DNA, 22 bp, Homo sapiens
agagccagcaactctagccctg

SEQ ID NO: 7880939 - DNA, 22 bp, Homo sapiens
agagccagcaactctagccctg

SEQ ID NO: 7880940 - DNA, 22 bp, Homo sapiens
agagccagcaagtgaatagtga

SEQ ID NO: 7880941 - DNA, 22 bp, Homo sapiens
agagccagcaactctagccctg

SEQ ID NO: 7880942 - DNA, 22 bp, Homo sapiens
atgtatttgcgaggttaggaaa

SEQ ID NO: 7880943 - DNA, 22 bp, Homo sapiens
atgtatttgcgaggttaggaaa

SEQ ID NO: 7880944 - DNA, 22 bp, Homo sapiens
atgtatttgaaatttgagacat

SEQ ID NO: 7880945 - DNA, 22 bp, Homo sapiens
atgtatttgaaatttgagacat

SEQ ID NO: 7880946 - DNA, 22 bp, Homo sapiens
atgtatttgcgtatggacatac

SEQ ID NO: 7880947 - DNA, 22 bp, Homo sapiens
atgtatttgcgtatggacatac

SEQ ID NO: 7880948 - DNA, 22 bp, Homo sapiens
atgtatttgcgtatggacatac

SEQ ID NO: 7880949 - DNA, 22 bp, Homo sapiens
atgtatttgcgaggttaggaaa

SEQ ID NO: 7880950 - DNA, 22 bp, Homo sapiens
atgtatttgcgtatggacatac

SEQ ID NO: 7880951 - DNA, 22 bp, Homo sapiens
atgtatttgcgtatggacatac

SEQ ID NO: 7880952 - DNA, 22 bp, Homo sapiens
atgtatttgcttgttatggatt

SEQ ID NO: 7880953 - DNA, 22 bp, Homo sapiens
atgtatttgcttgttatggatt

SEQ ID NO: 7880954 - DNA, 22 bp, Homo sapiens
atgtatttgcttgttatggatt

SEQ ID NO: 7880955 - DNA, 22 bp, Homo sapiens
atgtatttgcttgttatggatt

SEQ ID NO: 7880956 - DNA, 22 bp, Homo sapiens
agagcctggggattggcaaggg

SEQ ID NO: 7880957 - DNA, 22 bp, Homo sapiens
agagcctggggattggcaaggg

SEQ ID NO: 7880958 - DNA, 22 bp, Homo sapiens
agagcctggggattggcaaggg

SEQ ID NO: 7880959 - DNA, 22 bp, Homo sapiens
agagcctgggcagctcctctgg

SEQ ID NO: 7880960 - DNA, 22 bp, Homo sapiens
agagcctgggcagctcctctgg

SEQ ID NO: 7880961 - DNA, 22 bp, Homo sapiens
agagcctgggcagctcctctgg

SEQ ID NO: 7880962 - DNA, 22 bp, Homo sapiens
agagcctgggcagctcctctgg

SEQ ID NO: 7880963 - DNA, 22 bp, Homo sapiens
agagcctgggcagctcctctgg

SEQ ID NO: 7880964 - DNA, 22 bp, Homo sapiens
agagcctgcagtggagaccttg

SEQ ID NO: 7880965 - DNA, 22 bp, Homo sapiens
agagcctgcagtggagaccttg

SEQ ID NO: 7880966 - DNA, 22 bp, Homo sapiens
agagcctgcagtggagaccttg

SEQ ID NO: 7880967 - DNA, 22 bp, Homo sapiens
agagcctgcagtggagaccttg

SEQ ID NO: 7880968 - DNA, 22 bp, Homo sapiens
agagcctgcagtggagaccttg

SEQ ID NO: 7880969 - DNA, 22 bp, Homo sapiens
agagcctgcagtggagaccttg

SEQ ID NO: 7880970 - DNA, 22 bp, Homo sapiens
agagcctgggaatttgcatgtt

SEQ ID NO: 7880971 - DNA, 22 bp, Homo sapiens
agagcctgcatcaggcttgggg

SEQ ID NO: 7880972 - DNA, 22 bp, Homo sapiens
agagcctgcagtggagaccttg

SEQ ID NO: 7880973 - DNA, 22 bp, Homo sapiens
agagcctgggaatttgcatgtt

SEQ ID NO: 7880974 - DNA, 22 bp, Homo sapiens
atgtattttaagatttgcctca

SEQ ID NO: 7880975 - DNA, 22 bp, Homo sapiens
atgtattttaagatttgcctca

SEQ ID NO: 7880976 - DNA, 22 bp, Homo sapiens
atgtattttgccagactgtctc

SEQ ID NO: 7880977 - DNA, 22 bp, Homo sapiens
atgtattttgccagactgtctc

SEQ ID NO: 7880978 - DNA, 22 bp, Homo sapiens
atgtcaaacacaacaccagtgg

SEQ ID NO: 7880979 - DNA, 22 bp, Homo sapiens
atgtcaaatcagttttatcaga

SEQ ID NO: 7880980 - DNA, 22 bp, Homo sapiens
agagcctgcagctgtgaagaaa

SEQ ID NO: 7880981 - DNA, 22 bp, Homo sapiens
atgtcaaagcagactgagagcg

SEQ ID NO: 7880982 - DNA, 22 bp, Homo sapiens
atgtcaaacacaacaccagtgg

SEQ ID NO: 7880983 - DNA, 22 bp, Homo sapiens
atgtcaaagcagactgagagcg

SEQ ID NO: 7880984 - DNA, 22 bp, Homo sapiens
atgtcaaacacaacaccagtgg

SEQ ID NO: 7880985 - DNA, 22 bp, Homo sapiens
agagcagcctgtgatgatgcac

SEQ ID NO: 7880986 - DNA, 18 bp, Homo sapiens
agagcagcggcatcacac

SEQ ID NO: 7880987 - DNA, 18 bp, Homo sapiens
agagcagcggcatcacac

SEQ ID NO: 7880988 - DNA, 22 bp, Homo sapiens
agagcagtcattaatacatgta

SEQ ID NO: 7880989 - DNA, 22 bp, Homo sapiens
agagcagtcattaatacatgta

SEQ ID NO: 7880990 - DNA, 22 bp, Homo sapiens
atgggtggagggtgacacggat

SEQ ID NO: 7880991 - DNA, 22 bp, Homo sapiens
agagcagcctgtgatgatgcac

SEQ ID NO: 7880992 - DNA, 22 bp, Homo sapiens
agagcagcctgtgatgatgcac

SEQ ID NO: 7880993 - DNA, 17 bp, Homo sapiens
agagcatgtgtaggagc

SEQ ID NO: 7880994 - DNA, 22 bp, Homo sapiens
agagccaaggcctcagtctcaa

SEQ ID NO: 7880995 - DNA, 22 bp, Homo sapiens
agagcatccatttttgtcacat

SEQ ID NO: 7880996 - DNA, 22 bp, Homo sapiens
agagcatcaccgttacccactt

SEQ ID NO: 7880997 - DNA, 22 bp, Homo sapiens
agagcatccatttttgtcacat

SEQ ID NO: 7880998 - DNA, 22 bp, Homo sapiens
agagcatctaacacataagcct

SEQ ID NO: 7880999 - DNA, 22 bp, Homo sapiens
atgggtaggatttactcagatg

SEQ ID NO: 7881000 - DNA, 22 bp, Homo sapiens
atgggtcagttcagtggccaac

SEQ ID NO: 7881001 - DNA, 22 bp, Homo sapiens
atgggtggaggagaaaggcatc

SEQ ID NO: 7881002 - DNA, 22 bp, Homo sapiens
atgggtggagggtgacacggat

SEQ ID NO: 7881003 - DNA, 22 bp, Homo sapiens
atgggtggagggtgacacggat

SEQ ID NO: 7881004 - DNA, 22 bp, Homo sapiens
atgggtggaggagaaaggcatc

SEQ ID NO: 7881005 - DNA, 22 bp, Homo sapiens
atgggtggagggtgacacggat

SEQ ID NO: 7881006 - DNA, 22 bp, Homo sapiens
atggggtggagtccgggcagcg

SEQ ID NO: 7881007 - DNA, 22 bp, Homo sapiens
atggggtggagtccgggcagcg

SEQ ID NO: 7881008 - DNA, 22 bp, Homo sapiens
atggggtggagtccgggcagcg

SEQ ID NO: 7881009 - DNA, 22 bp, Homo sapiens
atggggttcacctgacagagaa

SEQ ID NO: 7881010 - DNA, 22 bp, Homo sapiens
atgggtaagggtgtttggttag

SEQ ID NO: 7881011 - DNA, 22 bp, Homo sapiens
atgggtaggatttactcagatg

SEQ ID NO: 7881012 - DNA, 22 bp, Homo sapiens
agagccagagacctgggttcac

SEQ ID NO: 7881013 - DNA, 22 bp, Homo sapiens
agagccagagacctgggttcac

SEQ ID NO: 7881014 - DNA, 22 bp, Homo sapiens
agagccagaccattgccgtgca

SEQ ID NO: 7881015 - DNA, 22 bp, Homo sapiens
agagccagaccattgccgtgca

SEQ ID NO: 7881016 - DNA, 22 bp, Homo sapiens
agagccagatggagccgtgtgt

SEQ ID NO: 7881017 - DNA, 22 bp, Homo sapiens
agagccagatggagccgtgtgt

SEQ ID NO: 7881018 - DNA, 22 bp, Homo sapiens
agagccagagacctgggttcac

SEQ ID NO: 7881019 - DNA, 22 bp, Homo sapiens
agagccagaccattgccgtgca

SEQ ID NO: 7881020 - DNA, 22 bp, Homo sapiens
agagccagaccattgccgtgca

SEQ ID NO: 7881021 - DNA, 22 bp, Homo sapiens
agagccagaccattgccgtgca

SEQ ID NO: 7881022 - DNA, 22 bp, Homo sapiens
agagccagaccattgccgtgca

SEQ ID NO: 7881023 - DNA, 22 bp, Homo sapiens
agagccagaccattgccgtgca

SEQ ID NO: 7881024 - DNA, 19 bp, Homo sapiens
agagccagacagcatagga

SEQ ID NO: 7881025 - DNA, 22 bp, Homo sapiens
agagccagaccattgccgtgca

SEQ ID NO: 7881026 - DNA, 19 bp, Homo sapiens
agagccagacagcatagga

SEQ ID NO: 7881027 - DNA, 19 bp, Homo sapiens
agagccagacagcatagga

SEQ ID NO: 7881028 - DNA, 19 bp, Homo sapiens
agagccagacagcatagga

SEQ ID NO: 7881029 - DNA, 22 bp, Homo sapiens
agagccactgggagacagagca

SEQ ID NO: 7881030 - DNA, 22 bp, Homo sapiens
agagccaaggctgagagctatt

SEQ ID NO: 7881031 - DNA, 22 bp, Homo sapiens
agagccaaggctgagagctatt

SEQ ID NO: 7881032 - DNA, 22 bp, Homo sapiens
agagccaagttgtcaaggcact

SEQ ID NO: 7881033 - DNA, 22 bp, Homo sapiens
agagccaatcttcagagcagag

SEQ ID NO: 7881034 - DNA, 22 bp, Homo sapiens
agagccacggcaggcctaggaa

SEQ ID NO: 7881035 - DNA, 22 bp, Homo sapiens
agagccacagtggataggagcc

SEQ ID NO: 7881036 - DNA, 22 bp, Homo sapiens
agagccacagtggataggagcc

SEQ ID NO: 7881037 - DNA, 22 bp, Homo sapiens
agagccaatcttcagagcagag

SEQ ID NO: 7881038 - DNA, 22 bp, Homo sapiens
agagccaatcttcagagcagag

SEQ ID NO: 7881039 - DNA, 22 bp, Homo sapiens
atggggtgcatgcagattggga

SEQ ID NO: 7881040 - DNA, 22 bp, Homo sapiens
atggggtgcatgcagattggga

SEQ ID NO: 7881041 - DNA, 22 bp, Homo sapiens
atggggtgcatgcagattggga

SEQ ID NO: 7881042 - DNA, 22 bp, Homo sapiens
atggggtggagtccgggcagcg

SEQ ID NO: 7881043 - DNA, 22 bp, Homo sapiens
atggggtgcatgcagattggga

SEQ ID NO: 7881044 - DNA, 20 bp, Homo sapiens
atggggtgagtgacgccctc

SEQ ID NO: 7881045 - DNA, 22 bp, Homo sapiens
atggggtgagactaggattaaa

SEQ ID NO: 7881046 - DNA, 22 bp, Homo sapiens
atggggggatgaaggagtccaa

SEQ ID NO: 7881047 - DNA, 22 bp, Homo sapiens
atggggtgaccatgagcattta

SEQ ID NO: 7881048 - DNA, 22 bp, Homo sapiens
atggggtgaccatgagcattta

SEQ ID NO: 7881049 - DNA, 22 bp, Homo sapiens
atgggggcggctgaagcccagg

SEQ ID NO: 7881050 - DNA, 22 bp, Homo sapiens
atggggggatgaaggagtccaa

SEQ ID NO: 7881051 - DNA, 22 bp, Homo sapiens
atgggggcggctgaagcccagg

SEQ ID NO: 7881052 - DNA, 22 bp, Homo sapiens
agagatggccttaggtgggaat

SEQ ID NO: 7881053 - DNA, 22 bp, Homo sapiens
agagatggcgtctcagagcctg

SEQ ID NO: 7881054 - DNA, 22 bp, Homo sapiens
agagatggcgtctcagagcctg

SEQ ID NO: 7881055 - DNA, 22 bp, Homo sapiens
atggggctgttctctgccctgc

SEQ ID NO: 7881056 - DNA, 22 bp, Homo sapiens
agagatggcgtctcagagcctg

SEQ ID NO: 7881057 - DNA, 22 bp, Homo sapiens
atgggggcctgaacaggcaaaa

SEQ ID NO: 7881058 - DNA, 22 bp, Homo sapiens
atgggggcctgaacaggcaaaa

SEQ ID NO: 7881059 - DNA, 22 bp, Homo sapiens
atgggggcctgaacaggcaaaa

SEQ ID NO: 7881060 - DNA, 22 bp, Homo sapiens
atgggggcctgaacaggcaaaa

SEQ ID NO: 7881061 - DNA, 22 bp, Homo sapiens
agagatggccttaggtgggaat

SEQ ID NO: 7881062 - DNA, 22 bp, Homo sapiens
agagatggccttaggtgggaat

SEQ ID NO: 7881063 - DNA, 22 bp, Homo sapiens
agagatggccttaggtgggaat

SEQ ID NO: 7881064 - DNA, 22 bp, Homo sapiens
agagatggccttaggtgggaat

SEQ ID NO: 7881065 - DNA, 22 bp, Homo sapiens
agagatggccttaggtgggaat

SEQ ID NO: 7881066 - DNA, 22 bp, Homo sapiens
agagatggccttaggtgggaat

SEQ ID NO: 7881067 - DNA, 22 bp, Homo sapiens
agagatggatgttattatgggt

SEQ ID NO: 7881068 - DNA, 22 bp, Homo sapiens
agagatggatgttattatgggt

SEQ ID NO: 7881069 - DNA, 22 bp, Homo sapiens
agagatgaagggcattccccag

SEQ ID NO: 7881070 - DNA, 22 bp, Homo sapiens
agagatgaatcttgagactctg

SEQ ID NO: 7881071 - DNA, 22 bp, Homo sapiens
agagatgaatcttgagactctg

SEQ ID NO: 7881072 - DNA, 22 bp, Homo sapiens
agagatgacatgagggacttaa

SEQ ID NO: 7881073 - DNA, 22 bp, Homo sapiens
agagatgcagggtacatggaat

SEQ ID NO: 7881074 - DNA, 22 bp, Homo sapiens
agagatgcagggtacatggaat

SEQ ID NO: 7881075 - DNA, 22 bp, Homo sapiens
agagatgactgatggctgatta

SEQ ID NO: 7881076 - DNA, 22 bp, Homo sapiens
agagatgcattcagcatggatg

SEQ ID NO: 7881077 - DNA, 22 bp, Homo sapiens
agagatgctgcccgcagacgtg

SEQ ID NO: 7881078 - DNA, 19 bp, Homo sapiens
agagatgctaagagtcttt

SEQ ID NO: 7881079 - DNA, 22 bp, Homo sapiens
agagatggagagcactggggct

SEQ ID NO: 7881080 - DNA, 22 bp, Homo sapiens
agagatggatgttattatgggt

SEQ ID NO: 7881081 - DNA, 22 bp, Homo sapiens
agagatggatgttattatgggt

SEQ ID NO: 7881082 - DNA, 22 bp, Homo sapiens
agagatggagagcactggggct

SEQ ID NO: 7881083 - DNA, 22 bp, Homo sapiens
agagatggagagcactggggct

SEQ ID NO: 7881084 - DNA, 22 bp, Homo sapiens
agagatggagagcactggggct

SEQ ID NO: 7881085 - DNA, 22 bp, Homo sapiens
agagatgctgtgggtagaggca

SEQ ID NO: 7881086 - DNA, 22 bp, Homo sapiens
agagatgctgtgggtagaggca

SEQ ID NO: 7881087 - DNA, 22 bp, Homo sapiens
agagatgctgcccgcagacgtg

SEQ ID NO: 7881088 - DNA, 22 bp, Homo sapiens
atgtgtatacttgtgcttactc

SEQ ID NO: 7881089 - DNA, 15 bp, Homo sapiens
atgtgtagtcaccag

SEQ ID NO: 7881090 - DNA, 22 bp, Homo sapiens
atgtgtaggtgaatcgaggctg

SEQ ID NO: 7881091 - DNA, 22 bp, Homo sapiens
atgtgtagggaagtgaaatgta

SEQ ID NO: 7881092 - DNA, 22 bp, Homo sapiens
atgtgtagggaagtgaaatgta

SEQ ID NO: 7881093 - DNA, 22 bp, Homo sapiens
atgtgtagaactgtaatgccca

SEQ ID NO: 7881094 - DNA, 22 bp, Homo sapiens
atgtgtaggtgaatcgaggctg

SEQ ID NO: 7881095 - DNA, 22 bp, Homo sapiens
atgtgtaggtgaatcgaggctg

SEQ ID NO: 7881096 - DNA, 21 bp, Homo sapiens
agagctgggacttgcctgaga

SEQ ID NO: 7881097 - DNA, 21 bp, Homo sapiens
agagctgggacttgcctgaga

SEQ ID NO: 7881098 - DNA, 21 bp, Homo sapiens
agagctgggacttgcctgaga

SEQ ID NO: 7881099 - DNA, 21 bp, Homo sapiens
agagctgggacttgcctgaga

SEQ ID NO: 7881100 - DNA, 22 bp, Homo sapiens
agagctggtttactcaggaatt

SEQ ID NO: 7881101 - DNA, 22 bp, Homo sapiens
agagctggtttactcaggaatt

SEQ ID NO: 7881102 - DNA, 22 bp, Homo sapiens
agagctggtttactcaggaatt

SEQ ID NO: 7881103 - DNA, 22 bp, Homo sapiens
agagctggtttactcaggaatt

SEQ ID NO: 7881104 - DNA, 22 bp, Homo sapiens
agagctggtgcatattcagaaa

SEQ ID NO: 7881105 - DNA, 22 bp, Homo sapiens
agagctggtgcatattcagaaa

SEQ ID NO: 7881106 - DNA, 22 bp, Homo sapiens
agagctggtgcatattcagaaa

SEQ ID NO: 7881107 - DNA, 22 bp, Homo sapiens
agagctggtttactcaggaatt

SEQ ID NO: 7881108 - DNA, 22 bp, Homo sapiens
agagctggtttactcaggaatt

SEQ ID NO: 7881109 - DNA, 21 bp, Homo sapiens
agagctggtaggtaggtaggt

SEQ ID NO: 7881110 - DNA, 21 bp, Homo sapiens
agagctggtaggtaggtaggt

SEQ ID NO: 7881111 - DNA, 21 bp, Homo sapiens
agagctggtaggtaggtaggt

SEQ ID NO: 7881112 - DNA, 22 bp, Homo sapiens
agagctggtgcatattcagaaa

SEQ ID NO: 7881113 - DNA, 22 bp, Homo sapiens
agagctggtgcatattcagaaa

SEQ ID NO: 7881114 - DNA, 22 bp, Homo sapiens
agagctggtgcatattcagaaa

SEQ ID NO: 7881115 - DNA, 22 bp, Homo sapiens
agagctgggacttggactcaat

SEQ ID NO: 7881116 - DNA, 22 bp, Homo sapiens
agagctgggacttggactcaat

SEQ ID NO: 7881117 - DNA, 22 bp, Homo sapiens
agagctgggacttggactcaat

SEQ ID NO: 7881118 - DNA, 21 bp, Homo sapiens
agagctggtaggtaggtaggt

SEQ ID NO: 7881119 - DNA, 22 bp, Homo sapiens
agagctgtttattgatgtcaca

SEQ ID NO: 7881120 - DNA, 22 bp, Homo sapiens
agagctgtttattgatgtcaca

SEQ ID NO: 7881121 - DNA, 22 bp, Homo sapiens
agagctgttcagcagccaggtt

SEQ ID NO: 7881122 - DNA, 22 bp, Homo sapiens
agagctgttcaacgtagcaatg

SEQ ID NO: 7881123 - DNA, 22 bp, Homo sapiens
agagctgttcagcagccaggtt

SEQ ID NO: 7881124 - DNA, 22 bp, Homo sapiens
agagctgtgtcctgtgcactag

SEQ ID NO: 7881125 - DNA, 22 bp, Homo sapiens
agagctgtgtcctgtgcactag

SEQ ID NO: 7881126 - DNA, 22 bp, Homo sapiens
agagctgtgtcctgtgcactag

SEQ ID NO: 7881127 - DNA, 22 bp, Homo sapiens
agagctgtgttaagaacaggcc

SEQ ID NO: 7881128 - DNA, 22 bp, Homo sapiens
agagctgtgttaagaacaggcc

SEQ ID NO: 7881129 - DNA, 22 bp, Homo sapiens
agagctgttcaacgtagcaatg

SEQ ID NO: 7881130 - DNA, 22 bp, Homo sapiens
agagctgttaattttgcactgg

SEQ ID NO: 7881131 - DNA, 22 bp, Homo sapiens
agagctgtgtttagtagttacg

SEQ ID NO: 7881132 - DNA, 22 bp, Homo sapiens
agagctgtggatagtcctggat

SEQ ID NO: 7881133 - DNA, 22 bp, Homo sapiens
agagctgtgctttgcaccacgt

SEQ ID NO: 7881134 - DNA, 22 bp, Homo sapiens
agagctgtgctttgcaccacgt

SEQ ID NO: 7881135 - DNA, 22 bp, Homo sapiens
agagctgtggatagtcctggat

SEQ ID NO: 7881136 - DNA, 22 bp, Homo sapiens
agagctgtggatagtcctggat

SEQ ID NO: 7881137 - DNA, 22 bp, Homo sapiens
agagctgtgaaaatgaggtttg

SEQ ID NO: 7881138 - DNA, 22 bp, Homo sapiens
agagctgtcagcgttttggcca

SEQ ID NO: 7881139 - DNA, 22 bp, Homo sapiens
agagctgtgaaaatgaggtttg

SEQ ID NO: 7881140 - DNA, 22 bp, Homo sapiens
agagctgtgaaaatgaggtttg

SEQ ID NO: 7881141 - DNA, 22 bp, Homo sapiens
agagctgtagcttcctagagcc

SEQ ID NO: 7881142 - DNA, 22 bp, Homo sapiens
agagctgtagcttcctagagcc

SEQ ID NO: 7881143 - DNA, 22 bp, Homo sapiens
agagctgtatccccttaccagt

SEQ ID NO: 7881144 - DNA, 22 bp, Homo sapiens
agagctgtcacatagagccaga

SEQ ID NO: 7881145 - DNA, 22 bp, Homo sapiens
agagctgtcacatagagccaga

SEQ ID NO: 7881146 - DNA, 22 bp, Homo sapiens
atgtttatgcaaacatgtgagt

SEQ ID NO: 7881147 - DNA, 22 bp, Homo sapiens
atgtttatgcaaacatgtgagt

SEQ ID NO: 7881148 - DNA, 22 bp, Homo sapiens
atgtttatgcaaacatgtgagt

SEQ ID NO: 7881149 - DNA, 22 bp, Homo sapiens
atgtttatgcaaacatgtgagt

SEQ ID NO: 7881150 - DNA, 22 bp, Homo sapiens
atgtttatgcaaacatgtgagt

SEQ ID NO: 7881151 - DNA, 22 bp, Homo sapiens
atgtttatgacctccataagga

SEQ ID NO: 7881152 - DNA, 22 bp, Homo sapiens
atgtttatgcaaacatgtgagt

SEQ ID NO: 7881153 - DNA, 22 bp, Homo sapiens
atgtttatgcaaacatgtgagt

SEQ ID NO: 7881154 - DNA, 22 bp, Homo sapiens
atgtttatgcaaacatgtgagt

SEQ ID NO: 7881155 - DNA, 22 bp, Homo sapiens
atgtttactggtttatagaata

SEQ ID NO: 7881156 - DNA, 22 bp, Homo sapiens
atgtttactggtttatagaata

SEQ ID NO: 7881157 - DNA, 22 bp, Homo sapiens
atgtttactggtttatagaata

SEQ ID NO: 7881158 - DNA, 22 bp, Homo sapiens
atgtttatgcaaacatgtgagt

SEQ ID NO: 7881159 - DNA, 22 bp, Homo sapiens
atgtttactggtttatagaata

SEQ ID NO: 7881160 - DNA, 22 bp, Homo sapiens
atgtttacaattcagtattaca

SEQ ID NO: 7881161 - DNA, 22 bp, Homo sapiens
atgtttacaattcagtattaca

SEQ ID NO: 7881162 - DNA, 22 bp, Homo sapiens
atgtttacaattcagtattaca

SEQ ID NO: 7881163 - DNA, 22 bp, Homo sapiens
agagctgtttggacatctgagt

SEQ ID NO: 7881164 - DNA, 22 bp, Homo sapiens
agagctgtttggacatctgagt

SEQ ID NO: 7881165 - DNA, 22 bp, Homo sapiens
agagctgtttgtctagagagtg

SEQ ID NO: 7881166 - DNA, 22 bp, Homo sapiens
atgtttacaattcagtattaca

SEQ ID NO: 7881167 - DNA, 22 bp, Homo sapiens
atgtttacagaggaagtgcctc

SEQ ID NO: 7881168 - DNA, 22 bp, Homo sapiens
atgtttactgaaaagatttcaa

SEQ ID NO: 7881169 - DNA, 22 bp, Homo sapiens
atgtttacagaggaagtgcctc

SEQ ID NO: 7881170 - DNA, 21 bp, Homo sapiens
atgtttacactgactactgtg

SEQ ID NO: 7881171 - DNA, 19 bp, Homo sapiens
atgtttacactcaggggct

SEQ ID NO: 7881172 - DNA, 21 bp, Homo sapiens
atgtttacactgactactgtg

SEQ ID NO: 7881173 - DNA, 19 bp, Homo sapiens
atgtttacactcaggggct

SEQ ID NO: 7881174 - DNA, 21 bp, Homo sapiens
atgtttacactgactactgtg

SEQ ID NO: 7881175 - DNA, 22 bp, Homo sapiens
atgtttatgttgggctatattt

SEQ ID NO: 7881176 - DNA, 22 bp, Homo sapiens
atgtttatgcaaacatgtgagt

SEQ ID NO: 7881177 - DNA, 22 bp, Homo sapiens
atgtttatgttgggctatattt

SEQ ID NO: 7881178 - DNA, 22 bp, Homo sapiens
atgtttatggagcaggtattag

SEQ ID NO: 7881179 - DNA, 22 bp, Homo sapiens
atgtttatggagcaggtattag

SEQ ID NO: 7881180 - DNA, 22 bp, Homo sapiens
atgtttatggagcaggtattag

SEQ ID NO: 7881181 - DNA, 22 bp, Homo sapiens
atgtttatggagcaggtattag

SEQ ID NO: 7881182 - DNA, 22 bp, Homo sapiens
atgtttatggagcaggtattag

SEQ ID NO: 7881183 - DNA, 22 bp, Homo sapiens
agaggaagctgagatgcctctt

SEQ ID NO: 7881184 - DNA, 22 bp, Homo sapiens
agaggaagctgagatgcctctt

SEQ ID NO: 7881185 - DNA, 22 bp, Homo sapiens
agaggaagctgagatgcctctt

SEQ ID NO: 7881186 - DNA, 22 bp, Homo sapiens
agaggaagctgagatgcctctt

SEQ ID NO: 7881187 - DNA, 22 bp, Homo sapiens
agaggaagctgagatgcctctt

SEQ ID NO: 7881188 - DNA, 22 bp, Homo sapiens
agaggaagctgagatgcctctt

SEQ ID NO: 7881189 - DNA, 22 bp, Homo sapiens
agaggacagcccccttgtctgg

SEQ ID NO: 7881190 - DNA, 22 bp, Homo sapiens
agaggacagcccccttgtctgg

SEQ ID NO: 7881191 - DNA, 22 bp, Homo sapiens
agaggacagcccccttgtctgg

SEQ ID NO: 7881192 - DNA, 22 bp, Homo sapiens
agaggacagagtgctggattta

SEQ ID NO: 7881193 - DNA, 22 bp, Homo sapiens
agaggacaggttttccatgggc

SEQ ID NO: 7881194 - DNA, 22 bp, Homo sapiens
agaggacaggttttccatgggc

SEQ ID NO: 7881195 - DNA, 22 bp, Homo sapiens
agaggacagcccccttgtctgg

SEQ ID NO: 7881196 - DNA, 22 bp, Homo sapiens
agaggacaggttttccatgggc

SEQ ID NO: 7881197 - DNA, 22 bp, Homo sapiens
agaggacagcccccttgtctgg

SEQ ID NO: 7881198 - DNA, 22 bp, Homo sapiens
agaggacagcccccttgtctgg

SEQ ID NO: 7881199 - DNA, 22 bp, Homo sapiens
agaggacagacggaaagtgcca

SEQ ID NO: 7881200 - DNA, 22 bp, Homo sapiens
agaggacaaaatgagaagtgct

SEQ ID NO: 7881201 - DNA, 22 bp, Homo sapiens
agaggacacatctttcctcaaa

SEQ ID NO: 7881202 - DNA, 22 bp, Homo sapiens
agaggaggaagagctttaaaat

SEQ ID NO: 7881203 - DNA, 20 bp, Homo sapiens
agaggaggattattttattc

SEQ ID NO: 7881204 - DNA, 22 bp, Homo sapiens
agaggaggaagagctttaaaat

SEQ ID NO: 7881205 - DNA, 22 bp, Homo sapiens
agaggaggaagagctttaaaat

SEQ ID NO: 7881206 - DNA, 22 bp, Homo sapiens
agaggaggatttgtaaaggtct

SEQ ID NO: 7881207 - DNA, 22 bp, Homo sapiens
agaggaggatttgtaaaggtct

SEQ ID NO: 7881208 - DNA, 22 bp, Homo sapiens
agaggaggatttgtaaaggtct

SEQ ID NO: 7881209 - DNA, 22 bp, Homo sapiens
agaggaggatttgtaaaggtct

SEQ ID NO: 7881210 - DNA, 22 bp, Homo sapiens
agaggagaatccgtttccttgc

SEQ ID NO: 7881211 - DNA, 22 bp, Homo sapiens
agaggactgttggtcttagaaa

SEQ ID NO: 7881212 - DNA, 22 bp, Homo sapiens
agaggacaggttttccatgggc

SEQ ID NO: 7881213 - DNA, 22 bp, Homo sapiens
agaggacaggttttccatgggc

SEQ ID NO: 7881214 - DNA, 22 bp, Homo sapiens
agaggacaggttttccatgggc

SEQ ID NO: 7881215 - DNA, 22 bp, Homo sapiens
agaggagctgggaggccctcgt

SEQ ID NO: 7881216 - DNA, 22 bp, Homo sapiens
agaggagcttttggaaaaggcc

SEQ ID NO: 7881217 - DNA, 22 bp, Homo sapiens
agaggaggccaggcccacacct

SEQ ID NO: 7881218 - DNA, 22 bp, Homo sapiens
agaggaggccaggcccacacct

SEQ ID NO: 7881219 - DNA, 22 bp, Homo sapiens
agaggaggccaggcccacacct

SEQ ID NO: 7881220 - DNA, 22 bp, Homo sapiens
agaggaggccaggcccacacct

SEQ ID NO: 7881221 - DNA, 22 bp, Homo sapiens
agaggaggccaggcccacacct

SEQ ID NO: 7881222 - DNA, 22 bp, Homo sapiens
agaggaggctctgggatcgtcc

SEQ ID NO: 7881223 - DNA, 22 bp, Homo sapiens
agaggaggctctgggatcgtcc

SEQ ID NO: 7881224 - DNA, 22 bp, Homo sapiens
agaggaggcagcttaactcagt

SEQ ID NO: 7881225 - DNA, 22 bp, Homo sapiens
agaggaggcagcttaactcagt

SEQ ID NO: 7881226 - DNA, 22 bp, Homo sapiens
agaggaggcagcttaactcagt

SEQ ID NO: 7881227 - DNA, 22 bp, Homo sapiens
agaggaggctgggtccagataa

SEQ ID NO: 7881228 - DNA, 22 bp, Homo sapiens
agaggaggctgggtccagataa

SEQ ID NO: 7881229 - DNA, 22 bp, Homo sapiens
attataggcttgagccaccgtg

SEQ ID NO: 7881230 - DNA, 22 bp, Homo sapiens
attataggcttgagccaccgtg

SEQ ID NO: 7881231 - DNA, 22 bp, Homo sapiens
agaggaggctgggtccagataa

SEQ ID NO: 7881232 - DNA, 22 bp, Homo sapiens
agaggaggctctgggatcgtcc

SEQ ID NO: 7881233 - DNA, 22 bp, Homo sapiens
agaggaggctctgggatcgtcc

SEQ ID NO: 7881234 - DNA, 22 bp, Homo sapiens
agaggaggctctgggatcgtcc

SEQ ID NO: 7881235 - DNA, 22 bp, Homo sapiens
agaggaggctctgggatcgtcc

SEQ ID NO: 7881236 - DNA, 22 bp, Homo sapiens
agaggaggctctgggatcgtcc

SEQ ID NO: 7881237 - DNA, 22 bp, Homo sapiens
agaggaggctctgggatcgtcc

SEQ ID NO: 7881238 - DNA, 22 bp, Homo sapiens
agaggaggctgggtccagataa

SEQ ID NO: 7881239 - DNA, 22 bp, Homo sapiens
agaggaggctctgggatcgtcc

SEQ ID NO: 7881240 - DNA, 22 bp, Homo sapiens
attattagacttatatggtagt

SEQ ID NO: 7881241 - DNA, 22 bp, Homo sapiens
attattactcctgattgtactg

SEQ ID NO: 7881242 - DNA, 22 bp, Homo sapiens
attattactcctgattgtactg

SEQ ID NO: 7881243 - DNA, 23 bp, Homo sapiens
attattaaggacatggactttgt

SEQ ID NO: 7881244 - DNA, 23 bp, Homo sapiens
attattaaggacatggactttgt

SEQ ID NO: 7881245 - DNA, 23 bp, Homo sapiens
attattaaggacatggactttgt

SEQ ID NO: 7881246 - DNA, 23 bp, Homo sapiens
attattaaggacatggactttgt

SEQ ID NO: 7881247 - DNA, 23 bp, Homo sapiens
attattaaggacatggactttgt

SEQ ID NO: 7881248 - DNA, 23 bp, Homo sapiens
attattaaggacatggactttgt

SEQ ID NO: 7881249 - DNA, 22 bp, Homo sapiens
attataggcttgagccaccgtg

SEQ ID NO: 7881250 - DNA, 22 bp, Homo sapiens
attataggcttgagccaccgtg

SEQ ID NO: 7881251 - DNA, 22 bp, Homo sapiens
attattaaagcttaggtcttat

SEQ ID NO: 7881252 - DNA, 22 bp, Homo sapiens
attattaaagcttaggtcttat

SEQ ID NO: 7881253 - DNA, 22 bp, Homo sapiens
attattaaagcttaggtcttat

SEQ ID NO: 7881254 - DNA, 22 bp, Homo sapiens
attattaaagcttaggtcttat

SEQ ID NO: 7881255 - DNA, 22 bp, Homo sapiens
attattaaagcttaggtcttat

SEQ ID NO: 7881256 - DNA, 22 bp, Homo sapiens
attattaaagcttaggtcttat

SEQ ID NO: 7881257 - DNA, 22 bp, Homo sapiens
attattagattcttaattgtaa

SEQ ID NO: 7881258 - DNA, 22 bp, Homo sapiens
attattagattcttaattgtaa

SEQ ID NO: 7881259 - DNA, 21 bp, Homo sapiens
attattataaagaccacaggg

SEQ ID NO: 7881260 - DNA, 22 bp, Homo sapiens
attattatatagggaaagtccc

SEQ ID NO: 7881261 - DNA, 22 bp, Homo sapiens
agaggcactccagccactggtc

SEQ ID NO: 7881262 - DNA, 22 bp, Homo sapiens
attattcaacacttgagaaatt

SEQ ID NO: 7881263 - DNA, 22 bp, Homo sapiens
attattcaacacttgagaaatt

SEQ ID NO: 7881264 - DNA, 22 bp, Homo sapiens
attattcaacacttgagaaatt

SEQ ID NO: 7881265 - DNA, 22 bp, Homo sapiens
attattcaaattcccactatac

SEQ ID NO: 7881266 - DNA, 22 bp, Homo sapiens
agaggcactgttcttagcgact

SEQ ID NO: 7881267 - DNA, 22 bp, Homo sapiens
agaggcactgttcttagcgact

SEQ ID NO: 7881268 - DNA, 22 bp, Homo sapiens
agaggcactcgggagtctgtgg

SEQ ID NO: 7881269 - DNA, 22 bp, Homo sapiens
agaggcactcgggagtctgtgg

SEQ ID NO: 7881270 - DNA, 22 bp, Homo sapiens
agaggcactcgggagtctgtgg

SEQ ID NO: 7881271 - DNA, 22 bp, Homo sapiens
agaggcactccagccactggtc

SEQ ID NO: 7881272 - DNA, 22 bp, Homo sapiens
agaggcagaagtgttcaaaccc

SEQ ID NO: 7881273 - DNA, 22 bp, Homo sapiens
agaggcagaagtgttcaaaccc

SEQ ID NO: 7881274 - DNA, 22 bp, Homo sapiens
agaggcagaagtgttcaaaccc

SEQ ID NO: 7881275 - DNA, 22 bp, Homo sapiens
attattattgttgatgttaggg

SEQ ID NO: 7881276 - DNA, 22 bp, Homo sapiens
attattattgttgatgttaggg

SEQ ID NO: 7881277 - DNA, 22 bp, Homo sapiens
attattattgttgatgttaggg

SEQ ID NO: 7881278 - DNA, 22 bp, Homo sapiens
attattattgttgatgttaggg

SEQ ID NO: 7881279 - DNA, 21 bp, Homo sapiens
attattatttctgtgtccagc

SEQ ID NO: 7881280 - DNA, 22 bp, Homo sapiens
attattattgttgatgttaggg

SEQ ID NO: 7881281 - DNA, 22 bp, Homo sapiens
attattattgttgatgttaggg

SEQ ID NO: 7881282 - DNA, 21 bp, Homo sapiens
attattatttctgtgtccagc

SEQ ID NO: 7881283 - DNA, 22 bp, Homo sapiens
attccattgtatgtgtagacta

SEQ ID NO: 7881284 - DNA, 22 bp, Homo sapiens
attccattcttgcttttgatct

SEQ ID NO: 7881285 - DNA, 22 bp, Homo sapiens
attccattgtatgtgtagacta

SEQ ID NO: 7881286 - DNA, 22 bp, Homo sapiens
attccattcttgcttttgatct

SEQ ID NO: 7881287 - DNA, 22 bp, Homo sapiens
attccattacagatcttttcct

SEQ ID NO: 7881288 - DNA, 22 bp, Homo sapiens
attccattgtatgtgtagacta

SEQ ID NO: 7881289 - DNA, 22 bp, Homo sapiens
attccagttctcctctctaaag

SEQ ID NO: 7881290 - DNA, 22 bp, Homo sapiens
attccagttagtggcagcttat

SEQ ID NO: 7881291 - DNA, 22 bp, Homo sapiens
attccagtgtcatgctctcagg

SEQ ID NO: 7881292 - DNA, 22 bp, Homo sapiens
attccagtgtcatgctctcagg

SEQ ID NO: 7881293 - DNA, 22 bp, Homo sapiens
attccaggttgtagaaaagttt

SEQ ID NO: 7881294 - DNA, 22 bp, Homo sapiens
attccaggcatgcaggaacaag

SEQ ID NO: 7881295 - DNA, 22 bp, Homo sapiens
attccaggttgtagaaaagttt

SEQ ID NO: 7881296 - DNA, 22 bp, Homo sapiens
attccagatggcttcaagtaag

SEQ ID NO: 7881297 - DNA, 22 bp, Homo sapiens
attccagatgttactgaaaggc

SEQ ID NO: 7881298 - DNA, 22 bp, Homo sapiens
attccagatgttactgaaaggc

SEQ ID NO: 7881299 - DNA, 22 bp, Homo sapiens
attccaggagctaactgtggtc

SEQ ID NO: 7881300 - DNA, 22 bp, Homo sapiens
attccaggactaaaggaacagc

SEQ ID NO: 7881301 - DNA, 22 bp, Homo sapiens
attccaggaagtgtgggaccaa

SEQ ID NO: 7881302 - DNA, 23 bp, Homo sapiens
attccaggaaatacttggctttc

SEQ ID NO: 7881303 - DNA, 22 bp, Homo sapiens
attccaggcagaccagagagat

SEQ ID NO: 7881304 - DNA, 22 bp, Homo sapiens
attccaggcaaagcagagaaga

SEQ ID NO: 7881305 - DNA, 22 bp, Homo sapiens
attccaggattccaggacaaat

SEQ ID NO: 7881306 - DNA, 22 bp, Homo sapiens
attccaggcaaagcagagaaga

SEQ ID NO: 7881307 - DNA, 22 bp, Homo sapiens
attccaggattccaggacaaat

SEQ ID NO: 7881308 - DNA, 22 bp, Homo sapiens
attgcattcattgacatatgag

SEQ ID NO: 7881309 - DNA, 22 bp, Homo sapiens
attgcattgcagctagattttg

SEQ ID NO: 7881310 - DNA, 22 bp, Homo sapiens
attgcattcattgacatatgag

SEQ ID NO: 7881311 - DNA, 22 bp, Homo sapiens
attgcagtgttgcctggggcct

SEQ ID NO: 7881312 - DNA, 22 bp, Homo sapiens
attgcagtgttgcctggggcct

SEQ ID NO: 7881313 - DNA, 22 bp, Homo sapiens
attgcatatgcagcacatcagg

SEQ ID NO: 7881314 - DNA, 22 bp, Homo sapiens
attgcagtgatggttgcataat

SEQ ID NO: 7881315 - DNA, 22 bp, Homo sapiens
attgcagtgtgtgttccatgag

SEQ ID NO: 7881316 - DNA, 22 bp, Homo sapiens
attgcagtgtgtgttccatgag

SEQ ID NO: 7881317 - DNA, 22 bp, Homo sapiens
attgcagtgatggttgcataat

SEQ ID NO: 7881318 - DNA, 22 bp, Homo sapiens
attgcagggactcaataagaat

SEQ ID NO: 7881319 - DNA, 22 bp, Homo sapiens
attcccacaatgtgtgcttcat

SEQ ID NO: 7881320 - DNA, 22 bp, Homo sapiens
attcccacaatgtgtgcttcat

SEQ ID NO: 7881321 - DNA, 22 bp, Homo sapiens
attccatttacaaggactagat

SEQ ID NO: 7881322 - DNA, 22 bp, Homo sapiens
attccattgtatgtgtagacta

SEQ ID NO: 7881323 - DNA, 22 bp, Homo sapiens
attcccaccaagcaggccatgc

SEQ ID NO: 7881324 - DNA, 22 bp, Homo sapiens
attcccaccaagcaggccatgc

SEQ ID NO: 7881325 - DNA, 22 bp, Homo sapiens
attgagggctgagaagggccct

SEQ ID NO: 7881326 - DNA, 22 bp, Homo sapiens
attcccaccaacaatgtacagg

SEQ ID NO: 7881327 - DNA, 22 bp, Homo sapiens
attcccaccaacaatgtacagg

SEQ ID NO: 7881328 - DNA, 22 bp, Homo sapiens
attcccacagctggtataaata

SEQ ID NO: 7881329 - DNA, 22 bp, Homo sapiens
attcccacacttgaagccctct

SEQ ID NO: 7881330 - DNA, 22 bp, Homo sapiens
attcccacatgtcgtgggaggg

SEQ ID NO: 7881331 - DNA, 22 bp, Homo sapiens
attgagtacctccagattcata

SEQ ID NO: 7881332 - DNA, 22 bp, Homo sapiens
attgataaattgcaatggggct

SEQ ID NO: 7881333 - DNA, 22 bp, Homo sapiens
attgataaattgcaatggggct

SEQ ID NO: 7881334 - DNA, 22 bp, Homo sapiens
attccagagaaaggcctggctg

SEQ ID NO: 7881335 - DNA, 22 bp, Homo sapiens
attccagagaaaggcctggctg

SEQ ID NO: 7881336 - DNA, 22 bp, Homo sapiens
attccagacaggtaaattaggt

SEQ ID NO: 7881337 - DNA, 22 bp, Homo sapiens
attccagacaggtaaattaggt

SEQ ID NO: 7881338 - DNA, 21 bp, Homo sapiens
agagggagagtggcccttcca

SEQ ID NO: 7881339 - DNA, 22 bp, Homo sapiens
attccagaataccggcaagatg

SEQ ID NO: 7881340 - DNA, 21 bp, Homo sapiens
agagggagagtggcccttcca

SEQ ID NO: 7881341 - DNA, 21 bp, Homo sapiens
agagggagagtggcccttcca

SEQ ID NO: 7881342 - DNA, 22 bp, Homo sapiens
attccagagaggttctggaggt

SEQ ID NO: 7881343 - DNA, 22 bp, Homo sapiens
attccagagaggttctggaggt

SEQ ID NO: 7881344 - DNA, 23 bp, Homo sapiens
attccagagctagagtcaagtgg

SEQ ID NO: 7881345 - DNA, 22 bp, Homo sapiens
attccagatgaattgcatagtt

SEQ ID NO: 7881346 - DNA, 22 bp, Homo sapiens
attccagatgaattgcatagtt

SEQ ID NO: 7881347 - DNA, 22 bp, Homo sapiens
attccagatggcttcaagtaag

SEQ ID NO: 7881348 - DNA, 22 bp, Homo sapiens
attccagatggcttcaagtaag

SEQ ID NO: 7881349 - DNA, 22 bp, Homo sapiens
agagggagaaaagaatcagttg

SEQ ID NO: 7881350 - DNA, 22 bp, Homo sapiens
agagggaatgtgattgcaccat

SEQ ID NO: 7881351 - DNA, 22 bp, Homo sapiens
agagggagaaaagaatcagttg

SEQ ID NO: 7881352 - DNA, 22 bp, Homo sapiens
agagggagaaaagaatcagttg

SEQ ID NO: 7881353 - DNA, 22 bp, Homo sapiens
agagggagaaaagaatcagttg

SEQ ID NO: 7881354 - DNA, 21 bp, Homo sapiens
agagggagagtggcccttcca

SEQ ID NO: 7881355 - DNA, 22 bp, Homo sapiens
agagggagaaaagaatcagttg

SEQ ID NO: 7881356 - DNA, 22 bp, Homo sapiens
agagggagaaaagaatcagttg

SEQ ID NO: 7881357 - DNA, 22 bp, Homo sapiens
agagggagaagctaaaataact

SEQ ID NO: 7881358 - DNA, 22 bp, Homo sapiens
agagggagaagctaaaataact

SEQ ID NO: 7881359 - DNA, 22 bp, Homo sapiens
agagggaaatccaggagtgctt

SEQ ID NO: 7881360 - DNA, 18 bp, Homo sapiens
agagggaaagcaggctga

SEQ ID NO: 7881361 - DNA, 18 bp, Homo sapiens
agagggaaagcaggctga

SEQ ID NO: 7881362 - DNA, 22 bp, Homo sapiens
agagggaaatccaggagtgctt

SEQ ID NO: 7881363 - DNA, 22 bp, Homo sapiens
agagggaaatccaggagtgctt

SEQ ID NO: 7881364 - DNA, 22 bp, Homo sapiens
agagggaacggatcccagcgcg

SEQ ID NO: 7881365 - DNA, 22 bp, Homo sapiens
agagggaacggatcccagcgcg

SEQ ID NO: 7881366 - DNA, 22 bp, Homo sapiens
agagggaagatggtccaatctt

SEQ ID NO: 7881367 - DNA, 18 bp, Homo sapiens
agagggaatcagttggat

SEQ ID NO: 7881368 - DNA, 22 bp, Homo sapiens
agagggaaggacagatgtttca

SEQ ID NO: 7881369 - DNA, 18 bp, Homo sapiens
agagggaatcagttggat

SEQ ID NO: 7881370 - DNA, 17 bp, Homo sapiens
agagggaaaatgcggtt

SEQ ID NO: 7881371 - DNA, 18 bp, Homo sapiens
agagggaaagcaggctga

SEQ ID NO: 7881372 - DNA, 18 bp, Homo sapiens
agagggaaagcaggctga

SEQ ID NO: 7881373 - DNA, 18 bp, Homo sapiens
agagggaaagcaggctga

SEQ ID NO: 7881374 - DNA, 18 bp, Homo sapiens
agagggaaagcaggctga

SEQ ID NO: 7881375 - DNA, 18 bp, Homo sapiens
agagggaaagcaggctga

SEQ ID NO: 7881376 - DNA, 18 bp, Homo sapiens
agagggaaagcaggctga

SEQ ID NO: 7881377 - DNA, 22 bp, Homo sapiens
agaggctgtgcagagggagtgc

SEQ ID NO: 7881378 - DNA, 22 bp, Homo sapiens
agaggctgtgcagagggagtgc

SEQ ID NO: 7881379 - DNA, 22 bp, Homo sapiens
agaggctgtctcatattttgta

SEQ ID NO: 7881380 - DNA, 22 bp, Homo sapiens
agagggaaaaactcatgtcatt

SEQ ID NO: 7881381 - DNA, 22 bp, Homo sapiens
agaggctgtgcagagggagtgc

SEQ ID NO: 7881382 - DNA, 22 bp, Homo sapiens
agaggctgtgcagagggagtgc

SEQ ID NO: 7881383 - DNA, 22 bp, Homo sapiens
agaggctgtgcagagggagtgc

SEQ ID NO: 7881384 - DNA, 22 bp, Homo sapiens
agaggcagaagtgttcaaaccc

SEQ ID NO: 7881385 - DNA, 17 bp, Homo sapiens
agaggcagatacttgga

SEQ ID NO: 7881386 - DNA, 17 bp, Homo sapiens
agaggcagatacttgga

SEQ ID NO: 7881387 - DNA, 17 bp, Homo sapiens
agaggcagatacttgga

SEQ ID NO: 7881388 - DNA, 22 bp, Homo sapiens
agaggcagcagtcatactacag

SEQ ID NO: 7881389 - DNA, 22 bp, Homo sapiens
agaggcagcagtcatactacag

SEQ ID NO: 7881390 - DNA, 22 bp, Homo sapiens
agaggcagcagtcatactacag

SEQ ID NO: 7881391 - DNA, 17 bp, Homo sapiens
agaggcagatacttgga

SEQ ID NO: 7881392 - DNA, 22 bp, Homo sapiens
agaggcagccgtatttcaaagg

SEQ ID NO: 7881393 - DNA, 22 bp, Homo sapiens
agaggcagccgtatttcaaagg

SEQ ID NO: 7881394 - DNA, 22 bp, Homo sapiens
agaggcagcagtcatactacag

SEQ ID NO: 7881395 - DNA, 22 bp, Homo sapiens
agaggcaggaagagctgatttt

SEQ ID NO: 7881396 - DNA, 22 bp, Homo sapiens
agaggcaggaagagctgatttt

SEQ ID NO: 7881397 - DNA, 22 bp, Homo sapiens
agaggcaggaggttgacttgag

SEQ ID NO: 7881398 - DNA, 22 bp, Homo sapiens
agaggcaggaggttgacttgag

SEQ ID NO: 7881399 - DNA, 22 bp, Homo sapiens
agaggcaggaagagctgatttt

SEQ ID NO: 7881400 - DNA, 22 bp, Homo sapiens
agaggcaggaagagctgatttt

SEQ ID NO: 7881401 - DNA, 22 bp, Homo sapiens
agaggcagccgtatttcaaagg

SEQ ID NO: 7881402 - DNA, 19 bp, Homo sapiens
attcattggccagggtggt

SEQ ID NO: 7881403 - DNA, 22 bp, Homo sapiens
attcattctgacctcaagagaa

SEQ ID NO: 7881404 - DNA, 22 bp, Homo sapiens
attcattagccactaactagca

SEQ ID NO: 7881405 - DNA, 22 bp, Homo sapiens
attcatgttcggggccacgttg

SEQ ID NO: 7881406 - DNA, 22 bp, Homo sapiens
attcatgttagcccacatgtag

SEQ ID NO: 7881407 - DNA, 22 bp, Homo sapiens
attcatgttagcccacatgtag

SEQ ID NO: 7881408 - DNA, 22 bp, Homo sapiens
attcatgttttcttgcttcaag

SEQ ID NO: 7881409 - DNA, 22 bp, Homo sapiens
attcatgttttcttgcttcaag

SEQ ID NO: 7881410 - DNA, 22 bp, Homo sapiens
attcatgttttcttgcttcaag

SEQ ID NO: 7881411 - DNA, 20 bp, Homo sapiens
attcatgtctttataaaagc

SEQ ID NO: 7881412 - DNA, 20 bp, Homo sapiens
attcatgtctttataaaagc

SEQ ID NO: 7881413 - DNA, 22 bp, Homo sapiens
attcatgtggggagccttctgt

SEQ ID NO: 7881414 - DNA, 22 bp, Homo sapiens
attcatgttagcccacatgtag

SEQ ID NO: 7881415 - DNA, 22 bp, Homo sapiens
attcagtaggtctagaataaga

SEQ ID NO: 7881416 - DNA, 22 bp, Homo sapiens
attcagtagaagttagctatta

SEQ ID NO: 7881417 - DNA, 18 bp, Homo sapiens
attcaggggctgaatgtg

SEQ ID NO: 7881418 - DNA, 22 bp, Homo sapiens
agaggcaggaggttgacttgag

SEQ ID NO: 7881419 - DNA, 22 bp, Homo sapiens
agaggcaggaggttgacttgag

SEQ ID NO: 7881420 - DNA, 22 bp, Homo sapiens
attcatgtaacattagagaaat

SEQ ID NO: 7881421 - DNA, 22 bp, Homo sapiens
attcatgcaggattgtctccaa

SEQ ID NO: 7881422 - DNA, 22 bp, Homo sapiens
attcagtattctgctgcataat

SEQ ID NO: 7881423 - DNA, 22 bp, Homo sapiens
attcagtaggtgtgaacttatt

SEQ ID NO: 7881424 - DNA, 22 bp, Homo sapiens
attcatgtcatagcaggatttc

SEQ ID NO: 7881425 - DNA, 20 bp, Homo sapiens
attcatgtctttataaaagc

SEQ ID NO: 7881426 - DNA, 21 bp, Homo sapiens
agaggccttacaggatagacc

SEQ ID NO: 7881427 - DNA, 22 bp, Homo sapiens
agaggcctttgggcaacatccc

SEQ ID NO: 7881428 - DNA, 22 bp, Homo sapiens
agaggcgcagactcttgagtgt

SEQ ID NO: 7881429 - DNA, 22 bp, Homo sapiens
agaggcggagcttgcagtgagc

SEQ ID NO: 7881430 - DNA, 22 bp, Homo sapiens
agaggcggagcttgcagtgagc

SEQ ID NO: 7881431 - DNA, 22 bp, Homo sapiens
agaggcggagcttgcagtgagc

SEQ ID NO: 7881432 - DNA, 22 bp, Homo sapiens
agaggcggagcttgcagtgagc

SEQ ID NO: 7881433 - DNA, 22 bp, Homo sapiens
agaggcggaggttgcagtgagc

SEQ ID NO: 7881434 - DNA, 22 bp, Homo sapiens
agaggcggaggttgcagtgagc

SEQ ID NO: 7881435 - DNA, 22 bp, Homo sapiens
agaggcggaggttgcagtgagc

SEQ ID NO: 7881436 - DNA, 22 bp, Homo sapiens
agaggcggaggttgcagtgagc

SEQ ID NO: 7881437 - DNA, 21 bp, Homo sapiens
agaggcggggttttggaggcc

SEQ ID NO: 7881438 - DNA, 21 bp, Homo sapiens
agaggcggggttttggaggcc

SEQ ID NO: 7881439 - DNA, 22 bp, Homo sapiens
agaggctcagaggcctggtcct

SEQ ID NO: 7881440 - DNA, 22 bp, Homo sapiens
agaggctcagaggcctggtcct

SEQ ID NO: 7881441 - DNA, 23 bp, Homo sapiens
agaggctcagcgtccacctctac

SEQ ID NO: 7881442 - DNA, 22 bp, Homo sapiens
agaggctcagaggcctggtcct

SEQ ID NO: 7881443 - DNA, 22 bp, Homo sapiens
agaggctcactcttggaaccca

SEQ ID NO: 7881444 - DNA, 22 bp, Homo sapiens
agaggctagagatctgtcctac

SEQ ID NO: 7881445 - DNA, 22 bp, Homo sapiens
agaggctcactcttggaaccca

SEQ ID NO: 7881446 - DNA, 22 bp, Homo sapiens
agaggctcctagccactggctt

SEQ ID NO: 7881447 - DNA, 22 bp, Homo sapiens
agaggctcctagccactggctt

SEQ ID NO: 7881448 - DNA, 22 bp, Homo sapiens
agaggcctgtgtgctccagtgg

SEQ ID NO: 7881449 - DNA, 21 bp, Homo sapiens
agaggccttacaggatagacc

SEQ ID NO: 7881450 - DNA, 22 bp, Homo sapiens
agaggcctgtgtgctccagtgg

SEQ ID NO: 7881451 - DNA, 22 bp, Homo sapiens
agaggcctgtgtgctccagtgg

SEQ ID NO: 7881452 - DNA, 22 bp, Homo sapiens
attcatttgctattgtgtatgg

SEQ ID NO: 7881453 - DNA, 22 bp, Homo sapiens
attcatttgctattgtgtatgg

SEQ ID NO: 7881454 - DNA, 22 bp, Homo sapiens
attcatttgctattgtgtatgg

SEQ ID NO: 7881455 - DNA, 22 bp, Homo sapiens
attcatttgctattgtgtatgg

SEQ ID NO: 7881456 - DNA, 22 bp, Homo sapiens
attcatttgctattgtgtatgg

SEQ ID NO: 7881457 - DNA, 22 bp, Homo sapiens
attcatttaggtattcacttac

SEQ ID NO: 7881458 - DNA, 22 bp, Homo sapiens
attcatttaggtattcacttac

SEQ ID NO: 7881459 - DNA, 22 bp, Homo sapiens
attcatttaggtattcacttac

SEQ ID NO: 7881460 - DNA, 22 bp, Homo sapiens
attcatttagagggattaagca

SEQ ID NO: 7881461 - DNA, 22 bp, Homo sapiens
attcattggcttgaactccacc

SEQ ID NO: 7881462 - DNA, 22 bp, Homo sapiens
attcatttagagggattaagca

SEQ ID NO: 7881463 - DNA, 22 bp, Homo sapiens
attcatttagagggattaagca

SEQ ID NO: 7881464 - DNA, 22 bp, Homo sapiens
attcatttagagggattaagca

SEQ ID NO: 7881465 - DNA, 22 bp, Homo sapiens
agatacatcatttataccttca

SEQ ID NO: 7881466 - DNA, 22 bp, Homo sapiens
agatacatcatttataccttca

SEQ ID NO: 7881467 - DNA, 22 bp, Homo sapiens
agatacatcttgaacttctaga

SEQ ID NO: 7881468 - DNA, 22 bp, Homo sapiens
agatacatcttgaacttctaga

SEQ ID NO: 7881469 - DNA, 22 bp, Homo sapiens
agatacatcttgaacttctaga

SEQ ID NO: 7881470 - DNA, 22 bp, Homo sapiens
agatacattagtagttacttgt

SEQ ID NO: 7881471 - DNA, 22 bp, Homo sapiens
agatacatggaacgtcaaacct

SEQ ID NO: 7881472 - DNA, 22 bp, Homo sapiens
agatacatgtcaagagacttat

SEQ ID NO: 7881473 - DNA, 22 bp, Homo sapiens
agatacattagtagttacttgt

SEQ ID NO: 7881474 - DNA, 22 bp, Homo sapiens
agatacattgagtttcctcctg

SEQ ID NO: 7881475 - DNA, 22 bp, Homo sapiens
agatacattgttctaagcattg

SEQ ID NO: 7881476 - DNA, 22 bp, Homo sapiens
agatacattgcacgatgcagat

SEQ ID NO: 7881477 - DNA, 22 bp, Homo sapiens
agatacattgttctaagcattg

SEQ ID NO: 7881478 - DNA, 22 bp, Homo sapiens
agatacattgttctaagcattg

SEQ ID NO: 7881479 - DNA, 17 bp, Homo sapiens
atttcacttagcatgag

SEQ ID NO: 7881480 - DNA, 17 bp, Homo sapiens
atttcacttagcatgag

SEQ ID NO: 7881481 - DNA, 22 bp, Homo sapiens
agatacagtgttacatttttat

SEQ ID NO: 7881482 - DNA, 20 bp, Homo sapiens
agatacagtggtttctttag

SEQ ID NO: 7881483 - DNA, 21 bp, Homo sapiens
atttcagaaatattggtggga

SEQ ID NO: 7881484 - DNA, 22 bp, Homo sapiens
agatacatatagaaaacatcaa

SEQ ID NO: 7881485 - DNA, 22 bp, Homo sapiens
agatacatatagaaaacatcaa

SEQ ID NO: 7881486 - DNA, 22 bp, Homo sapiens
agatacatagctgtgagcacac

SEQ ID NO: 7881487 - DNA, 22 bp, Homo sapiens
agatacatagctgtgagcacac

SEQ ID NO: 7881488 - DNA, 20 bp, Homo sapiens
agatacagtttaattactct

SEQ ID NO: 7881489 - DNA, 22 bp, Homo sapiens
atttcacagctgtcagtgttac

SEQ ID NO: 7881490 - DNA, 22 bp, Homo sapiens
atttcacagctgtcagtgttac

SEQ ID NO: 7881491 - DNA, 22 bp, Homo sapiens
atttcacatctatctcagattt

SEQ ID NO: 7881492 - DNA, 22 bp, Homo sapiens
atttcacatctatctcagattt

SEQ ID NO: 7881493 - DNA, 22 bp, Homo sapiens
atttcacagctgtcagtgttac

SEQ ID NO: 7881494 - DNA, 22 bp, Homo sapiens
atttcactctccctgccactta

SEQ ID NO: 7881495 - DNA, 22 bp, Homo sapiens
atttcactcttaattgcttcct

SEQ ID NO: 7881496 - DNA, 22 bp, Homo sapiens
atttcactgcttgagctgcagc

SEQ ID NO: 7881497 - DNA, 22 bp, Homo sapiens
atttcactcattcatgttactt

SEQ ID NO: 7881498 - DNA, 22 bp, Homo sapiens
atttcactctccctgccactta

SEQ ID NO: 7881499 - DNA, 22 bp, Homo sapiens
atttcactctccctgccactta

SEQ ID NO: 7881500 - DNA, 22 bp, Homo sapiens
atttcacattaatttgatgctc

SEQ ID NO: 7881501 - DNA, 22 bp, Homo sapiens
atttcacattaatttgatgctc

SEQ ID NO: 7881502 - DNA, 22 bp, Homo sapiens
atttcacattaatttgatgctc

SEQ ID NO: 7881503 - DNA, 22 bp, Homo sapiens
agataaaatgattttctggatc

SEQ ID NO: 7881504 - DNA, 22 bp, Homo sapiens
agataaaatggttcaaaggcta

SEQ ID NO: 7881505 - DNA, 22 bp, Homo sapiens
agataaaatgattttctggatc

SEQ ID NO: 7881506 - DNA, 23 bp, Homo sapiens
agagttttctgttttctgtaggg

SEQ ID NO: 7881507 - DNA, 17 bp, Homo sapiens
agagttttaagaaattt

SEQ ID NO: 7881508 - DNA, 17 bp, Homo sapiens
agagttttaagaaattt

SEQ ID NO: 7881509 - DNA, 22 bp, Homo sapiens
agagtttggattttaggacatc

SEQ ID NO: 7881510 - DNA, 22 bp, Homo sapiens
agagtttgtatttttcagtgaa

SEQ ID NO: 7881511 - DNA, 22 bp, Homo sapiens
atttcacagctgctgttcaggt

SEQ ID NO: 7881512 - DNA, 22 bp, Homo sapiens
atttcacagctgctgttcaggt

SEQ ID NO: 7881513 - DNA, 22 bp, Homo sapiens
atttcacagctgctgttcaggt

SEQ ID NO: 7881514 - DNA, 22 bp, Homo sapiens
atttcacagctgctgttcaggt

SEQ ID NO: 7881515 - DNA, 22 bp, Homo sapiens
atttcacagcgtggttgactgc

SEQ ID NO: 7881516 - DNA, 21 bp, Homo sapiens
atttcacaccctcctttttct

SEQ ID NO: 7881517 - DNA, 21 bp, Homo sapiens
atttcacaccctcctttttct

SEQ ID NO: 7881518 - DNA, 22 bp, Homo sapiens
atttcacaaagaacagatgcag

SEQ ID NO: 7881519 - DNA, 22 bp, Homo sapiens
atttcacaaagaacagatgcag

SEQ ID NO: 7881520 - DNA, 22 bp, Homo sapiens
agataaaatggttcaaaggcta

SEQ ID NO: 7881521 - DNA, 22 bp, Homo sapiens
agataaaatggttcaaaggcta

SEQ ID NO: 7881522 - DNA, 22 bp, Homo sapiens
agataaaatggttcaaaggcta

SEQ ID NO: 7881523 - DNA, 22 bp, Homo sapiens
agataaattcctaagatttcag

SEQ ID NO: 7881524 - DNA, 22 bp, Homo sapiens
atttattgaagcttattacgtt

SEQ ID NO: 7881525 - DNA, 22 bp, Homo sapiens
atttattgaagcttattacgtt

SEQ ID NO: 7881526 - DNA, 22 bp, Homo sapiens
agataaattcctaagatttcag

SEQ ID NO: 7881527 - DNA, 22 bp, Homo sapiens
agataaattcctaagatttcag

SEQ ID NO: 7881528 - DNA, 22 bp, Homo sapiens
atttattgaagcttattacgtt

SEQ ID NO: 7881529 - DNA, 22 bp, Homo sapiens
atttattgagacttaacaaccc

SEQ ID NO: 7881530 - DNA, 22 bp, Homo sapiens
atttattgaagcttattacgtt

SEQ ID NO: 7881531 - DNA, 22 bp, Homo sapiens
atttattgaagcttattacgtt

SEQ ID NO: 7881532 - DNA, 22 bp, Homo sapiens
agaggtcagctgcatgccacat

SEQ ID NO: 7881533 - DNA, 22 bp, Homo sapiens
agaggtcagagcaggaaaggca

SEQ ID NO: 7881534 - DNA, 22 bp, Homo sapiens
agaggtcagaggtcgccaggtc

SEQ ID NO: 7881535 - DNA, 22 bp, Homo sapiens
agaggtcagaggtcgccaggtc

SEQ ID NO: 7881536 - DNA, 22 bp, Homo sapiens
agaggtctatgctaggggaact

SEQ ID NO: 7881537 - DNA, 21 bp, Homo sapiens
agaggtcattgggctggttct

SEQ ID NO: 7881538 - DNA, 22 bp, Homo sapiens
agaggtctgactcagcagatta

SEQ ID NO: 7881539 - DNA, 21 bp, Homo sapiens
agaggtctaagattctagctt

SEQ ID NO: 7881540 - DNA, 22 bp, Homo sapiens
agaggtattagatttgcatagg

SEQ ID NO: 7881541 - DNA, 22 bp, Homo sapiens
agaggtatgttcacttcccttt

SEQ ID NO: 7881542 - DNA, 22 bp, Homo sapiens
attgctgaacttataaatgaat

SEQ ID NO: 7881543 - DNA, 22 bp, Homo sapiens
attgctgactcaataattgaag

SEQ ID NO: 7881544 - DNA, 22 bp, Homo sapiens
agaggtattagatttgcatagg

SEQ ID NO: 7881545 - DNA, 22 bp, Homo sapiens
agaggtattaggtaattcagta

SEQ ID NO: 7881546 - DNA, 22 bp, Homo sapiens
agaggtattgcacgtgctctct

SEQ ID NO: 7881547 - DNA, 22 bp, Homo sapiens
agaggtattagatttgcatagg

SEQ ID NO: 7881548 - DNA, 22 bp, Homo sapiens
agaggtcactccaccttcttct

SEQ ID NO: 7881549 - DNA, 22 bp, Homo sapiens
agaggtcaatgggacttggatc

SEQ ID NO: 7881550 - DNA, 22 bp, Homo sapiens
agaggtcagaacaggaaagtgt

SEQ ID NO: 7881551 - DNA, 22 bp, Homo sapiens
attgctaatgtgcgaatgtgta

SEQ ID NO: 7881552 - DNA, 22 bp, Homo sapiens
attgctaggaacaggttgcacc

SEQ ID NO: 7881553 - DNA, 19 bp, Homo sapiens
attgctcaccatggggctt

SEQ ID NO: 7881554 - DNA, 22 bp, Homo sapiens
attgctcagcacaagcagcaga

SEQ ID NO: 7881555 - DNA, 22 bp, Homo sapiens
attgctcagcacaagcagcaga

SEQ ID NO: 7881556 - DNA, 22 bp, Homo sapiens
attgctcagcacaagcagcaga

SEQ ID NO: 7881557 - DNA, 22 bp, Homo sapiens
attgctcttgcttagggaggca

SEQ ID NO: 7881558 - DNA, 22 bp, Homo sapiens
attgctcctgatgcatagagct

SEQ ID NO: 7881559 - DNA, 22 bp, Homo sapiens
attgctgaaagtattttatgac

SEQ ID NO: 7881560 - DNA, 22 bp, Homo sapiens
attgcctttggaggaagaaagc

SEQ ID NO: 7881561 - DNA, 22 bp, Homo sapiens
attgcctgccactctgtgagga

SEQ ID NO: 7881562 - DNA, 22 bp, Homo sapiens
attgcctgccactctgtgagga

SEQ ID NO: 7881563 - DNA, 22 bp, Homo sapiens
attgccctctggctgacaggct

SEQ ID NO: 7881564 - DNA, 22 bp, Homo sapiens
attgccctagggctaagcagga

SEQ ID NO: 7881565 - DNA, 22 bp, Homo sapiens
attgccatgctcatagggtcga

SEQ ID NO: 7881566 - DNA, 23 bp, Homo sapiens
attgccaggatgctgaagcttac

SEQ ID NO: 7881567 - DNA, 22 bp, Homo sapiens
attgccaggagggttgagaata

SEQ ID NO: 7881568 - DNA, 22 bp, Homo sapiens
attgcattgtgttttaggaggt

SEQ ID NO: 7881569 - DNA, 22 bp, Homo sapiens
attgcatttgtcattgttgagg

SEQ ID NO: 7881570 - DNA, 22 bp, Homo sapiens
attgccaactgcattacagtcc

SEQ ID NO: 7881571 - DNA, 22 bp, Homo sapiens
agagttggcccacgtgtaggcg

SEQ ID NO: 7881572 - DNA, 22 bp, Homo sapiens
agagttggcccacgtgtaggcg

SEQ ID NO: 7881573 - DNA, 22 bp, Homo sapiens
agagttggcccacgtgtaggcg

SEQ ID NO: 7881574 - DNA, 22 bp, Homo sapiens
agagttgtattggaatagctat

SEQ ID NO: 7881575 - DNA, 22 bp, Homo sapiens
agagttggccaaaaggggcatt

SEQ ID NO: 7881576 - DNA, 22 bp, Homo sapiens
agagttggagaaattaaaattt

SEQ ID NO: 7881577 - DNA, 22 bp, Homo sapiens
agagttggccaaaaggggcatt

SEQ ID NO: 7881578 - DNA, 22 bp, Homo sapiens
agagttgcttatgtcaggtgag

SEQ ID NO: 7881579 - DNA, 22 bp, Homo sapiens
agagttgctatagaaggatgga

SEQ ID NO: 7881580 - DNA, 19 bp, Homo sapiens
agagtttaggtctatcagg

SEQ ID NO: 7881581 - DNA, 19 bp, Homo sapiens
agagtttaggtctatcagg

SEQ ID NO: 7881582 - DNA, 22 bp, Homo sapiens
agagtttaggggtaagcatagt

SEQ ID NO: 7881583 - DNA, 22 bp, Homo sapiens
agagtttaggggtaagcatagt

SEQ ID NO: 7881584 - DNA, 22 bp, Homo sapiens
agagtttaggggacacagaata

SEQ ID NO: 7881585 - DNA, 22 bp, Homo sapiens
agagtttacagaaataagctgt

SEQ ID NO: 7881586 - DNA, 22 bp, Homo sapiens
agagtttaccactatttttggt

SEQ ID NO: 7881587 - DNA, 22 bp, Homo sapiens
agagtttacagaaataagctgt

SEQ ID NO: 7881588 - DNA, 22 bp, Homo sapiens
agagtttaacacaagaaaagtt

SEQ ID NO: 7881589 - DNA, 22 bp, Homo sapiens
agagttgttgtacaaactaaat

SEQ ID NO: 7881590 - DNA, 22 bp, Homo sapiens
agagtttaaacactgtcacaga

SEQ ID NO: 7881591 - DNA, 22 bp, Homo sapiens
agagtttaaacactgtcacaga

SEQ ID NO: 7881592 - DNA, 22 bp, Homo sapiens
agaggtctgactcagcagatta

SEQ ID NO: 7881593 - DNA, 22 bp, Homo sapiens
agaggtcttcacatggcaatga

SEQ ID NO: 7881594 - DNA, 22 bp, Homo sapiens
agaggtgaaagaatttggctct

SEQ ID NO: 7881595 - DNA, 22 bp, Homo sapiens
agagtggggacagggcctgtcc

SEQ ID NO: 7881596 - DNA, 22 bp, Homo sapiens
agaggtgaaagaatttggctct

SEQ ID NO: 7881597 - DNA, 22 bp, Homo sapiens
agaggtcttcagcatttgaact

SEQ ID NO: 7881598 - DNA, 22 bp, Homo sapiens
agaggtcttttggtctgcagaa

SEQ ID NO: 7881599 - DNA, 22 bp, Homo sapiens
agaggtgacataggagaggctc

SEQ ID NO: 7881600 - DNA, 22 bp, Homo sapiens
agaggtgacataggagaggctc

SEQ ID NO: 7881601 - DNA, 22 bp, Homo sapiens
agagttctgaaattatctttac

SEQ ID NO: 7881602 - DNA, 22 bp, Homo sapiens
agagttctgaaattatctttac

SEQ ID NO: 7881603 - DNA, 22 bp, Homo sapiens
agagttctgctcttctcagtga

SEQ ID NO: 7881604 - DNA, 22 bp, Homo sapiens
agagttctgaattttattctct

SEQ ID NO: 7881605 - DNA, 21 bp, Homo sapiens
agagttcttgctgagcaagcc

SEQ ID NO: 7881606 - DNA, 22 bp, Homo sapiens
agagttgaagtataatagggat

SEQ ID NO: 7881607 - DNA, 21 bp, Homo sapiens
agagttcttgctgagcaagcc

SEQ ID NO: 7881608 - DNA, 22 bp, Homo sapiens
agagttcttgccctagaaaatg

SEQ ID NO: 7881609 - DNA, 22 bp, Homo sapiens
agagttctgtctgccacacgaa

SEQ ID NO: 7881610 - DNA, 22 bp, Homo sapiens
agagttctgtctgccacacgaa

SEQ ID NO: 7881611 - DNA, 18 bp, Homo sapiens
atttggcagatgatgaac

SEQ ID NO: 7881612 - DNA, 22 bp, Homo sapiens
atttggcacagcttttcctacc

SEQ ID NO: 7881613 - DNA, 22 bp, Homo sapiens
atttggcacactgggttctcgt

SEQ ID NO: 7881614 - DNA, 22 bp, Homo sapiens
atttggcacagcttttcctacc

SEQ ID NO: 7881615 - DNA, 22 bp, Homo sapiens
atttggcaatgctagagaagtt

SEQ ID NO: 7881616 - DNA, 22 bp, Homo sapiens
atttggcacactgggttctcgt

SEQ ID NO: 7881617 - DNA, 22 bp, Homo sapiens
atttggcaatgctagagaagtt

SEQ ID NO: 7881618 - DNA, 22 bp, Homo sapiens
atttggcaacattaattgaatc

SEQ ID NO: 7881619 - DNA, 22 bp, Homo sapiens
atttggcaacattaattgaatc

SEQ ID NO: 7881620 - DNA, 22 bp, Homo sapiens
atttggcaaaagttagaagaaa

SEQ ID NO: 7881621 - DNA, 22 bp, Homo sapiens
atttggcaaaagttagaagaaa

SEQ ID NO: 7881622 - DNA, 22 bp, Homo sapiens
atttggcaaaaattagcagtag

SEQ ID NO: 7881623 - DNA, 22 bp, Homo sapiens
atttggcaaaaattagcagtag

SEQ ID NO: 7881624 - DNA, 21 bp, Homo sapiens
atttggcaaaggcgatgcaca

SEQ ID NO: 7881625 - DNA, 21 bp, Homo sapiens
atttggcaaaggcgatgcaca

SEQ ID NO: 7881626 - DNA, 22 bp, Homo sapiens
atttggcaaataatttgagggt

SEQ ID NO: 7881627 - DNA, 22 bp, Homo sapiens
atttggcaaataatttgagggt

SEQ ID NO: 7881628 - DNA, 22 bp, Homo sapiens
atttggcagtataaattctggc

SEQ ID NO: 7881629 - DNA, 22 bp, Homo sapiens
atttggcagccacagcaatctt

SEQ ID NO: 7881630 - DNA, 22 bp, Homo sapiens
atttggcagccacagcaatctt

SEQ ID NO: 7881631 - DNA, 18 bp, Homo sapiens
atttggcagatgatgaac

SEQ ID NO: 7881632 - DNA, 22 bp, Homo sapiens
atttggcagtgaagggatcaca

SEQ ID NO: 7881633 - DNA, 22 bp, Homo sapiens
atttggcagtataaattctggc

SEQ ID NO: 7881634 - DNA, 22 bp, Homo sapiens
atttggcagtgaagggatcaca

SEQ ID NO: 7881635 - DNA, 22 bp, Homo sapiens
atttggcatagagtatcattct

SEQ ID NO: 7881636 - DNA, 22 bp, Homo sapiens
atttggcatagagtatcattct

SEQ ID NO: 7881637 - DNA, 22 bp, Homo sapiens
atttggcatagagtatcattct

SEQ ID NO: 7881638 - DNA, 22 bp, Homo sapiens
atttggcataggcagaggccca

SEQ ID NO: 7881639 - DNA, 20 bp, Homo sapiens
atttggcatagtttaagcaa

SEQ ID NO: 7881640 - DNA, 20 bp, Homo sapiens
atttggcatagtttaagcaa

SEQ ID NO: 7881641 - DNA, 22 bp, Homo sapiens
atttggcataggcagaggccca

SEQ ID NO: 7881642 - DNA, 20 bp, Homo sapiens
atttggcatgaagtattgat

SEQ ID NO: 7881643 - DNA, 20 bp, Homo sapiens
atttggcatgaagtattgat

SEQ ID NO: 7881644 - DNA, 15 bp, Homo sapiens
atttggcatggcctc

SEQ ID NO: 7881645 - DNA, 20 bp, Homo sapiens
atttggcatgaagtattgat

SEQ ID NO: 7881646 - DNA, 22 bp, Homo sapiens
atttgttaattatgaggcatac

SEQ ID NO: 7881647 - DNA, 22 bp, Homo sapiens
atttgttaattatgaggcatac

SEQ ID NO: 7881648 - DNA, 22 bp, Homo sapiens
atttgttaattatgaggcatac

SEQ ID NO: 7881649 - DNA, 22 bp, Homo sapiens
atttgttcacaatcagggcagg

SEQ ID NO: 7881650 - DNA, 22 bp, Homo sapiens
atttgttcacaatcagggcagg

SEQ ID NO: 7881651 - DNA, 22 bp, Homo sapiens
atttgttcatgggttgttatgc

SEQ ID NO: 7881652 - DNA, 22 bp, Homo sapiens
atttgttcagcattgaatttgg

SEQ ID NO: 7881653 - DNA, 22 bp, Homo sapiens
atttgttcagcattgaatttgg

SEQ ID NO: 7881654 - DNA, 22 bp, Homo sapiens
atttgttcagcattgaatttgg

SEQ ID NO: 7881655 - DNA, 22 bp, Homo sapiens
atttgttcagcattgaatttgg

SEQ ID NO: 7881656 - DNA, 22 bp, Homo sapiens
atttgttccacacatatttact

SEQ ID NO: 7881657 - DNA, 22 bp, Homo sapiens
atttgttccacacatatttact

SEQ ID NO: 7881658 - DNA, 22 bp, Homo sapiens
atttgttcatgggttgttatgc

SEQ ID NO: 7881659 - DNA, 22 bp, Homo sapiens
atttgttcatgggttgttatgc

SEQ ID NO: 7881660 - DNA, 22 bp, Homo sapiens
atttgttcatgggttgttatgc

SEQ ID NO: 7881661 - DNA, 22 bp, Homo sapiens
atttgttcagcattgaatttgg

SEQ ID NO: 7881662 - DNA, 22 bp, Homo sapiens
atttgttcttcatgatcctgtc

SEQ ID NO: 7881663 - DNA, 22 bp, Homo sapiens
atttgttgaataaattagtatt

SEQ ID NO: 7881664 - DNA, 22 bp, Homo sapiens
atttgttccatgagtaaggcta

SEQ ID NO: 7881665 - DNA, 22 bp, Homo sapiens
atttgttgaataaattagtatt

SEQ ID NO: 7881666 - DNA, 22 bp, Homo sapiens
atttgttctcataaagaatgaa

SEQ ID NO: 7881667 - DNA, 22 bp, Homo sapiens
atttgttctcataaagaatgaa

SEQ ID NO: 7881668 - DNA, 22 bp, Homo sapiens
atttgtgggactataatgcagg

SEQ ID NO: 7881669 - DNA, 22 bp, Homo sapiens
atttgtgataatttgttacagc

SEQ ID NO: 7881670 - DNA, 22 bp, Homo sapiens
atttgtgataatttgttacagc

SEQ ID NO: 7881671 - DNA, 22 bp, Homo sapiens
atttggctattgaattattcct

SEQ ID NO: 7881672 - DNA, 22 bp, Homo sapiens
atttggctagcttatggttata

SEQ ID NO: 7881673 - DNA, 22 bp, Homo sapiens
atttggctgggtgttagaaaga

SEQ ID NO: 7881674 - DNA, 22 bp, Homo sapiens
atttggctgactcactaattgt

SEQ ID NO: 7881675 - DNA, 22 bp, Homo sapiens
atttggctaattaaatttggag

SEQ ID NO: 7881676 - DNA, 15 bp, Homo sapiens
atttggcatggcctc

SEQ ID NO: 7881677 - DNA, 22 bp, Homo sapiens
atttggctaccatgaggatggg

SEQ ID NO: 7881678 - DNA, 22 bp, Homo sapiens
atttgtgataatttgttacagc

SEQ ID NO: 7881679 - DNA, 22 bp, Homo sapiens
atttgtgataatttgttacagc

SEQ ID NO: 7881680 - DNA, 22 bp, Homo sapiens
atttgtgaattaagcatgtcaa

SEQ ID NO: 7881681 - DNA, 22 bp, Homo sapiens
atttggctgggtgttagaaaga

SEQ ID NO: 7881682 - DNA, 22 bp, Homo sapiens
atttggctgtagtaactggatc

SEQ ID NO: 7881683 - DNA, 22 bp, Homo sapiens
atttggctgtagtaactggatc

SEQ ID NO: 7881684 - DNA, 22 bp, Homo sapiens
attttaaccctcttatatatac

SEQ ID NO: 7881685 - DNA, 20 bp, Homo sapiens
atttgtttctactctctgac

SEQ ID NO: 7881686 - DNA, 22 bp, Homo sapiens
caaaaaacacagatgtctgtgt

SEQ ID NO: 7881687 - DNA, 22 bp, Homo sapiens
caaaaaacacagatgtctgtgt

SEQ ID NO: 7881688 - DNA, 22 bp, Homo sapiens
caaaaaacacagatgtctgtgt

SEQ ID NO: 7881689 - DNA, 22 bp, Homo sapiens
caaaaaacacagatgtctgtgt

SEQ ID NO: 7881690 - DNA, 22 bp, Homo sapiens
caaaaaacacagatgtctgtgt

SEQ ID NO: 7881691 - DNA, 21 bp, Homo sapiens
caaaaggataggaaattaggg

SEQ ID NO: 7881692 - DNA, 21 bp, Homo sapiens
caaaaggataggaaattaggg

SEQ ID NO: 7881693 - DNA, 21 bp, Homo sapiens
caaaaggataggaaattaggg

SEQ ID NO: 7881694 - DNA, 22 bp, Homo sapiens
caaaagcagttctatctgagtt

SEQ ID NO: 7881695 - DNA, 22 bp, Homo sapiens
caaaaaacacagatgtctgtgt

SEQ ID NO: 7881696 - DNA, 22 bp, Homo sapiens
caaaaaacacagatgtctgtgt

SEQ ID NO: 7881697 - DNA, 21 bp, Homo sapiens
caaaaggataggaaattaggg

SEQ ID NO: 7881698 - DNA, 22 bp, Homo sapiens
atttgttgctagcagcactgat

SEQ ID NO: 7881699 - DNA, 22 bp, Homo sapiens
atttgtttatcgtcgattgtag

SEQ ID NO: 7881700 - DNA, 22 bp, Homo sapiens
atttgtttatcgtcgattgtag

SEQ ID NO: 7881701 - DNA, 22 bp, Homo sapiens
atttgtttatcgtcgattgtag

SEQ ID NO: 7881702 - DNA, 20 bp, Homo sapiens
atttgtttctactctctgac

SEQ ID NO: 7881703 - DNA, 22 bp, Homo sapiens
atttgtttcagggccttggtat

SEQ ID NO: 7881704 - DNA, 22 bp, Homo sapiens
atttgtttcagggccttggtat

SEQ ID NO: 7881705 - DNA, 22 bp, Homo sapiens
caaaaggccagtactttgtttg

SEQ ID NO: 7881706 - DNA, 22 bp, Homo sapiens
caaaagtaatcgtggcttttgc

SEQ ID NO: 7881707 - DNA, 22 bp, Homo sapiens
caaaaggccagtactttgtttg

SEQ ID NO: 7881708 - DNA, 22 bp, Homo sapiens
caaaaggccagtactttgtttg

SEQ ID NO: 7881709 - DNA, 22 bp, Homo sapiens
caaaaggcaggggaaagagtgc

SEQ ID NO: 7881710 - DNA, 22 bp, Homo sapiens
caaaaggcaggggaaagagtgc

SEQ ID NO: 7881711 - DNA, 22 bp, Homo sapiens
caaaagtaatggcggtttttac

SEQ ID NO: 7881712 - DNA, 22 bp, Homo sapiens
caaaagtaatgtatgctcatcg

SEQ ID NO: 7881713 - DNA, 22 bp, Homo sapiens
caaaagtaatgtatgctcatcg

SEQ ID NO: 7881714 - DNA, 22 bp, Homo sapiens
caaaagtaattatggtttttgc

SEQ ID NO: 7881715 - DNA, 22 bp, Homo sapiens
caaaagtaattgcagtttttgc

SEQ ID NO: 7881716 - DNA, 22 bp, Homo sapiens
caaaagtaccttgtgtgctttg

SEQ ID NO: 7881717 - DNA, 22 bp, Homo sapiens
caaaagtaccttgtgtgctttg

SEQ ID NO: 7881718 - DNA, 22 bp, Homo sapiens
caaaagtaattgcagtttttgc

SEQ ID NO: 7881719 - DNA, 22 bp, Homo sapiens
caaaagtaattgcagtttttgc

SEQ ID NO: 7881720 - DNA, 22 bp, Homo sapiens
caaaagtaattgcggtttttgc

SEQ ID NO: 7881721 - DNA, 22 bp, Homo sapiens
caaaagtaattgtggtttttgc

SEQ ID NO: 7881722 - DNA, 22 bp, Homo sapiens
caaaagtaattgtggttttcac

SEQ ID NO: 7881723 - DNA, 22 bp, Homo sapiens
atttcctatagatatggtgagt

SEQ ID NO: 7881724 - DNA, 22 bp, Homo sapiens
agatacattgttctaagcattg

SEQ ID NO: 7881725 - DNA, 22 bp, Homo sapiens
agatacatttgtgtgcatgtat

SEQ ID NO: 7881726 - DNA, 22 bp, Homo sapiens
agatacatttgtgtgcatgtat

SEQ ID NO: 7881727 - DNA, 22 bp, Homo sapiens
agatacattgttctaagcattg

SEQ ID NO: 7881728 - DNA, 22 bp, Homo sapiens
agatacattgttctaagcattg

SEQ ID NO: 7881729 - DNA, 22 bp, Homo sapiens
agatactaagcatttccagcac

SEQ ID NO: 7881730 - DNA, 22 bp, Homo sapiens
agatacatttgtgtgcatgtat

SEQ ID NO: 7881731 - DNA, 22 bp, Homo sapiens
agatactatggaattttatgag

SEQ ID NO: 7881732 - DNA, 22 bp, Homo sapiens
agatactatggaattttatgag

SEQ ID NO: 7881733 - DNA, 22 bp, Homo sapiens
agatagtattttggtggggttc

SEQ ID NO: 7881734 - DNA, 22 bp, Homo sapiens
agataggccattaagaaggata

SEQ ID NO: 7881735 - DNA, 22 bp, Homo sapiens
agatagatagtgaggtaatagc

SEQ ID NO: 7881736 - DNA, 21 bp, Homo sapiens
agatacttgctaacttaggca

SEQ ID NO: 7881737 - DNA, 22 bp, Homo sapiens
agatagacatacaatgtatgaa

SEQ ID NO: 7881738 - DNA, 22 bp, Homo sapiens
atttccttcagtgtttaatact

SEQ ID NO: 7881739 - DNA, 22 bp, Homo sapiens
atttcctgttgcttttgccact

SEQ ID NO: 7881740 - DNA, 22 bp, Homo sapiens
atttcctgttgcttttgccact

SEQ ID NO: 7881741 - DNA, 22 bp, Homo sapiens
atttccttcagtgtttaatact

SEQ ID NO: 7881742 - DNA, 22 bp, Homo sapiens
atttcctgtgtctctatttatg

SEQ ID NO: 7881743 - DNA, 22 bp, Homo sapiens
atttcctgtgtctctatttatg

SEQ ID NO: 7881744 - DNA, 22 bp, Homo sapiens
atttcctgtaggggcttgcgaa

SEQ ID NO: 7881745 - DNA, 22 bp, Homo sapiens
atttcctgtacctatcaaggca

SEQ ID NO: 7881746 - DNA, 22 bp, Homo sapiens
atttcctgtacctatcaaggca

SEQ ID NO: 7881747 - DNA, 22 bp, Homo sapiens
atttcctggtgtggaagtattt

SEQ ID NO: 7881748 - DNA, 22 bp, Homo sapiens
atttcctggttgcattggcttt

SEQ ID NO: 7881749 - DNA, 22 bp, Homo sapiens
atttcctgtaaaatggtactgc

SEQ ID NO: 7881750 - DNA, 22 bp, Homo sapiens
atttcctgggtctcactccaga

SEQ ID NO: 7881751 - DNA, 22 bp, Homo sapiens
atttcctggtaccaggctttct

SEQ ID NO: 7881752 - DNA, 22 bp, Homo sapiens
atttcctggagccagtttacct

SEQ ID NO: 7881753 - DNA, 22 bp, Homo sapiens
atttcctggaggaatggaagca

SEQ ID NO: 7881754 - DNA, 22 bp, Homo sapiens
atttcctgatctgtaaaatagc

SEQ ID NO: 7881755 - DNA, 22 bp, Homo sapiens
atttcctgatctgtaaaatagc

SEQ ID NO: 7881756 - DNA, 22 bp, Homo sapiens
atttcctgatttgtaaaattcc

SEQ ID NO: 7881757 - DNA, 17 bp, Homo sapiens
atttcctgcaagcccct

SEQ ID NO: 7881758 - DNA, 22 bp, Homo sapiens
atttcctgcaaggagtgggttt

SEQ ID NO: 7881759 - DNA, 22 bp, Homo sapiens
atttcctgcagagcccctccga

SEQ ID NO: 7881760 - DNA, 22 bp, Homo sapiens
atttcctgcaggggctggtggg

SEQ ID NO: 7881761 - DNA, 22 bp, Homo sapiens
atttcctgcaggggctggtggg

SEQ ID NO: 7881762 - DNA, 22 bp, Homo sapiens
atttcctggaatgactagtggg

SEQ ID NO: 7881763 - DNA, 22 bp, Homo sapiens
atttcctggaatgactagtggg

SEQ ID NO: 7881764 - DNA, 22 bp, Homo sapiens
atttcctcatgatcataatgca

SEQ ID NO: 7881765 - DNA, 17 bp, Homo sapiens
atttcctcagggctgag

SEQ ID NO: 7881766 - DNA, 22 bp, Homo sapiens
atttcctcatgatcataatgca

SEQ ID NO: 7881767 - DNA, 22 bp, Homo sapiens
atttcctgacagggcagtggta

SEQ ID NO: 7881768 - DNA, 22 bp, Homo sapiens
atttcctgatatatcctgtagt

SEQ ID NO: 7881769 - DNA, 22 bp, Homo sapiens
atttcctgacttccattgaggc

SEQ ID NO: 7881770 - DNA, 22 bp, Homo sapiens
atttcctgatctgtaaaatagc

SEQ ID NO: 7881771 - DNA, 22 bp, Homo sapiens
atttcctgatctgtaaaatagc

SEQ ID NO: 7881772 - DNA, 22 bp, Homo sapiens
atttctcttagcaagacattac

SEQ ID NO: 7881773 - DNA, 22 bp, Homo sapiens
atttgctttgggacagcttaaa

SEQ ID NO: 7881774 - DNA, 18 bp, Homo sapiens
atttctctggggtgattc

SEQ ID NO: 7881775 - DNA, 22 bp, Homo sapiens
atttctcttagcaagacattac

SEQ ID NO: 7881776 - DNA, 22 bp, Homo sapiens
atttctcttagcaagacattac

SEQ ID NO: 7881777 - DNA, 22 bp, Homo sapiens
atttctctgcctcagcttctgc

SEQ ID NO: 7881778 - DNA, 22 bp, Homo sapiens
atttctctgcagtgttcggaat

SEQ ID NO: 7881779 - DNA, 22 bp, Homo sapiens
atttctctgcagtgttcggaat

SEQ ID NO: 7881780 - DNA, 22 bp, Homo sapiens
atttctctgcagtgttcggaat

SEQ ID NO: 7881781 - DNA, 18 bp, Homo sapiens
atttctctggggtgattc

SEQ ID NO: 7881782 - DNA, 22 bp, Homo sapiens
atttctctgcctcagcttctgc

SEQ ID NO: 7881783 - DNA, 22 bp, Homo sapiens
atttctctgcctcagcttctgc

SEQ ID NO: 7881784 - DNA, 22 bp, Homo sapiens
atttgcttttactatgttaaaa

SEQ ID NO: 7881785 - DNA, 22 bp, Homo sapiens
atttgcttttactatgttaaaa

SEQ ID NO: 7881786 - DNA, 22 bp, Homo sapiens
atttgcttttactatgttaaaa

SEQ ID NO: 7881787 - DNA, 22 bp, Homo sapiens
atttggaattctatttcagtag

SEQ ID NO: 7881788 - DNA, 22 bp, Homo sapiens
atttggaattctatttcagtag

SEQ ID NO: 7881789 - DNA, 17 bp, Homo sapiens
atttggaatttctcttc

SEQ ID NO: 7881790 - DNA, 17 bp, Homo sapiens
atttggaatttctcttc

SEQ ID NO: 7881791 - DNA, 22 bp, Homo sapiens
atttggatgcactaaataaaat

SEQ ID NO: 7881792 - DNA, 22 bp, Homo sapiens
atttggattcttatttagcact

SEQ ID NO: 7881793 - DNA, 22 bp, Homo sapiens
atttggatgcactaaataaaat

SEQ ID NO: 7881794 - DNA, 22 bp, Homo sapiens
atttggatatcactgaatacat

SEQ ID NO: 7881795 - DNA, 22 bp, Homo sapiens
atttggatatcactgaatacat

SEQ ID NO: 7881796 - DNA, 22 bp, Homo sapiens
atttccttcatcagcctatcct

SEQ ID NO: 7881797 - DNA, 22 bp, Homo sapiens
atttccttcatcagcctatcct

SEQ ID NO: 7881798 - DNA, 22 bp, Homo sapiens
atttctcattaagatcttccaa

SEQ ID NO: 7881799 - DNA, 22 bp, Homo sapiens
atttctcatgtacaaaaacact

SEQ ID NO: 7881800 - DNA, 22 bp, Homo sapiens
atttctcattttgcttcaaagg

SEQ ID NO: 7881801 - DNA, 22 bp, Homo sapiens
atttctcattaagatcttccaa

SEQ ID NO: 7881802 - DNA, 22 bp, Homo sapiens
atttctccttgttgcaatgcag

SEQ ID NO: 7881803 - DNA, 22 bp, Homo sapiens
atttctctaagcatccgtttgc

SEQ ID NO: 7881804 - DNA, 22 bp, Homo sapiens
atttctctaagcatccgtttgc

SEQ ID NO: 7881805 - DNA, 22 bp, Homo sapiens
atttctctaagcatccgtttgc

SEQ ID NO: 7881806 - DNA, 22 bp, Homo sapiens
atttctccttgttgcaatgcag

SEQ ID NO: 7881807 - DNA, 22 bp, Homo sapiens
atttctcctccagatggtggtt

SEQ ID NO: 7881808 - DNA, 22 bp, Homo sapiens
atttctcctccagatggtggtt

SEQ ID NO: 7881809 - DNA, 22 bp, Homo sapiens
atttctcattttgcttcaaagg

SEQ ID NO: 7881810 - DNA, 22 bp, Homo sapiens
atttctctcattgttagctagg

SEQ ID NO: 7881811 - DNA, 22 bp, Homo sapiens
atttctctcattgttagctagg

SEQ ID NO: 7881812 - DNA, 22 bp, Homo sapiens
atttctctcattgttagctagg

SEQ ID NO: 7881813 - DNA, 22 bp, Homo sapiens
atttctctcattgttagctagg

SEQ ID NO: 7881814 - DNA, 22 bp, Homo sapiens
aaggcttctttgcaggctttag

SEQ ID NO: 7881815 - DNA, 22 bp, Homo sapiens
aaggcttggagtaagcttggct

SEQ ID NO: 7881816 - DNA, 19 bp, Homo sapiens
aaggcttggctgagctggg

SEQ ID NO: 7881817 - DNA, 19 bp, Homo sapiens
aaggcttggctgagctggg

SEQ ID NO: 7881818 - DNA, 22 bp, Homo sapiens
aaggcttgtagatttgggcttt

SEQ ID NO: 7881819 - DNA, 22 bp, Homo sapiens
aaggcttgtagatttgggcttt

SEQ ID NO: 7881820 - DNA, 22 bp, Homo sapiens
aaggcttgtgtgttcagtgagg

SEQ ID NO: 7881821 - DNA, 22 bp, Homo sapiens
aaggcttgtgtgttcagtgagg

SEQ ID NO: 7881822 - DNA, 22 bp, Homo sapiens
aaggctttatgtgaccaaaaga

SEQ ID NO: 7881823 - DNA, 22 bp, Homo sapiens
aaggctttatgactccagtgga

SEQ ID NO: 7881824 - DNA, 22 bp, Homo sapiens
aaggctttatgactccagtgga

SEQ ID NO: 7881825 - DNA, 22 bp, Homo sapiens
aaggctttaaataaccgtaaag

SEQ ID NO: 7881826 - DNA, 22 bp, Homo sapiens
aaggcttctttagtgtcctaat

SEQ ID NO: 7881827 - DNA, 22 bp, Homo sapiens
aaggcttctggagcttgctggc

SEQ ID NO: 7881828 - DNA, 22 bp, Homo sapiens
aaggcttcctggaggaggtgtc

SEQ ID NO: 7881829 - DNA, 22 bp, Homo sapiens
aaggcttcctggaggaggtgtc

SEQ ID NO: 7881830 - DNA, 22 bp, Homo sapiens
aaggcttctggagcttgctggc

SEQ ID NO: 7881831 - DNA, 22 bp, Homo sapiens
aaggcttccactttgttgggtc

SEQ ID NO: 7881832 - DNA, 22 bp, Homo sapiens
aaggctgtggttctatacagaa

SEQ ID NO: 7881833 - DNA, 22 bp, Homo sapiens
aaggctgtgtcagaagctccct

SEQ ID NO: 7881834 - DNA, 22 bp, Homo sapiens
aaggctgtgtcagaagctccct

SEQ ID NO: 7881835 - DNA, 22 bp, Homo sapiens
acatgtgtatagcctgtataga

SEQ ID NO: 7881836 - DNA, 22 bp, Homo sapiens
acatgtgtacttttaaggatgt

SEQ ID NO: 7881837 - DNA, 22 bp, Homo sapiens
acatgtgtacttttaaggatgt

SEQ ID NO: 7881838 - DNA, 22 bp, Homo sapiens
acatgtgtgacaacagaggtga

SEQ ID NO: 7881839 - DNA, 22 bp, Homo sapiens
acatgtgtggacatgaatctac

SEQ ID NO: 7881840 - DNA, 22 bp, Homo sapiens
acatgtgtggccgctgtagaca

SEQ ID NO: 7881841 - DNA, 22 bp, Homo sapiens
acatgtgtggccgctgtagaca

SEQ ID NO: 7881842 - DNA, 22 bp, Homo sapiens
acatgtgtggccgctgtagaca

SEQ ID NO: 7881843 - DNA, 22 bp, Homo sapiens
acatgtgtgtatacgtatttat

SEQ ID NO: 7881844 - DNA, 22 bp, Homo sapiens
aaggctggggtgcagacggcct

SEQ ID NO: 7881845 - DNA, 22 bp, Homo sapiens
aaggctggtttccttgatgttt

SEQ ID NO: 7881846 - DNA, 22 bp, Homo sapiens
aaggctggtttccttgatgttt

SEQ ID NO: 7881847 - DNA, 22 bp, Homo sapiens
aaggctgaggctggagaattac

SEQ ID NO: 7881848 - DNA, 22 bp, Homo sapiens
aaggctgaggctggagaattac

SEQ ID NO: 7881849 - DNA, 22 bp, Homo sapiens
aaggctgaggcagtgaggcaga

SEQ ID NO: 7881850 - DNA, 22 bp, Homo sapiens
aaggctgaggcagtgaggcaga

SEQ ID NO: 7881851 - DNA, 22 bp, Homo sapiens
aaggctgaggcagtgaggcaga

SEQ ID NO: 7881852 - DNA, 22 bp, Homo sapiens
aaggctgaggcagtgaggcaga

SEQ ID NO: 7881853 - DNA, 22 bp, Homo sapiens
aaggctcttggagtgaatgcag

SEQ ID NO: 7881854 - DNA, 22 bp, Homo sapiens
aaggctgaaagaccttgaacct

SEQ ID NO: 7881855 - DNA, 22 bp, Homo sapiens
aaggctgaaagaccttgaacct

SEQ ID NO: 7881856 - DNA, 22 bp, Homo sapiens
aaggctgaggagggcctgcagg

SEQ ID NO: 7881857 - DNA, 22 bp, Homo sapiens
aaggctgaggagggcctgcagg

SEQ ID NO: 7881858 - DNA, 22 bp, Homo sapiens
aaggcatgaaagcgaaatgaga

SEQ ID NO: 7881859 - DNA, 22 bp, Homo sapiens
aaggcatgaaagcgaaatgaga

SEQ ID NO: 7881860 - DNA, 22 bp, Homo sapiens
aaggcatatgctgtgtacagtt

SEQ ID NO: 7881861 - DNA, 22 bp, Homo sapiens
aaggcatcatggctggctattt

SEQ ID NO: 7881862 - DNA, 22 bp, Homo sapiens
aaggcatctggatggaggagga

SEQ ID NO: 7881863 - DNA, 22 bp, Homo sapiens
aaggcatctggatggaggagga

SEQ ID NO: 7881864 - DNA, 22 bp, Homo sapiens
aaggcatctggatggaggagga

SEQ ID NO: 7881865 - DNA, 22 bp, Homo sapiens
aaggcatggcagggtttacaca

SEQ ID NO: 7881866 - DNA, 22 bp, Homo sapiens
aaggcatgctgagtcctaaaag

SEQ ID NO: 7881867 - DNA, 22 bp, Homo sapiens
aaggcatacatattgttatagg

SEQ ID NO: 7881868 - DNA, 22 bp, Homo sapiens
aaggcatatattctaaacagga

SEQ ID NO: 7881869 - DNA, 22 bp, Homo sapiens
aaggcatatattctaaacagga

SEQ ID NO: 7881870 - DNA, 22 bp, Homo sapiens
aaggcatcatggctggctattt

SEQ ID NO: 7881871 - DNA, 22 bp, Homo sapiens
aaggcatatgcatagaagacag

SEQ ID NO: 7881872 - DNA, 22 bp, Homo sapiens
aaggcatatgctgtgtacagtt

SEQ ID NO: 7881873 - DNA, 22 bp, Homo sapiens
aaggctgattagactgatagct

SEQ ID NO: 7881874 - DNA, 22 bp, Homo sapiens
aaggctgagtaaaacagagaac

SEQ ID NO: 7881875 - DNA, 22 bp, Homo sapiens
aaggctgattagactgatagct

SEQ ID NO: 7881876 - DNA, 22 bp, Homo sapiens
aaggctgagtaaaacagagaac

SEQ ID NO: 7881877 - DNA, 22 bp, Homo sapiens
aaggctgagtaaaacagagaac

SEQ ID NO: 7881878 - DNA, 22 bp, Homo sapiens
aaggctgagtaaaacagagaac

SEQ ID NO: 7881879 - DNA, 22 bp, Homo sapiens
aaggctgaggtagggcctaaaa

SEQ ID NO: 7881880 - DNA, 22 bp, Homo sapiens
aaggctgaggtagggcctaaaa

SEQ ID NO: 7881881 - DNA, 22 bp, Homo sapiens
aaggctgagtaaaacagagaac

SEQ ID NO: 7881882 - DNA, 22 bp, Homo sapiens
aaggctgaggtagggcctaaaa

SEQ ID NO: 7881883 - DNA, 22 bp, Homo sapiens
aaggctgagggctgtacctggc

SEQ ID NO: 7881884 - DNA, 22 bp, Homo sapiens
aaggctgaggctggagaattac

SEQ ID NO: 7881885 - DNA, 22 bp, Homo sapiens
aaggctgagggctgtacctggc

SEQ ID NO: 7881886 - DNA, 16 bp, Homo sapiens
aaggctgattttccct

SEQ ID NO: 7881887 - DNA, 16 bp, Homo sapiens
aaggctgattttccct

SEQ ID NO: 7881888 - DNA, 22 bp, Homo sapiens
aaggctgattagactgatagct

SEQ ID NO: 7881889 - DNA, 22 bp, Homo sapiens
aaggctgcctctgccagaggag

SEQ ID NO: 7881890 - DNA, 22 bp, Homo sapiens
acatgtgtacatatatatgtgc

SEQ ID NO: 7881891 - DNA, 22 bp, Homo sapiens
aaggctgcttttaacatgcata

SEQ ID NO: 7881892 - DNA, 22 bp, Homo sapiens
acatgtgtaaggtctctcagtc

SEQ ID NO: 7881893 - DNA, 22 bp, Homo sapiens
acatgtgtaaggtctctcagtc

SEQ ID NO: 7881894 - DNA, 22 bp, Homo sapiens
acatgtgtacatatatatgtgc

SEQ ID NO: 7881895 - DNA, 22 bp, Homo sapiens
aagggctccctgcctgaggtgg

SEQ ID NO: 7881896 - DNA, 22 bp, Homo sapiens
aagggctcggtagcagtcctga

SEQ ID NO: 7881897 - DNA, 22 bp, Homo sapiens
aagggctcggtagcagtcctga

SEQ ID NO: 7881898 - DNA, 22 bp, Homo sapiens
aagggctcggtagcagtcctga

SEQ ID NO: 7881899 - DNA, 22 bp, Homo sapiens
aagggctctgctgtctctcccc

SEQ ID NO: 7881900 - DNA, 22 bp, Homo sapiens
aagggctgaaagaccttgggca

SEQ ID NO: 7881901 - DNA, 22 bp, Homo sapiens
aagggctctgtgtgcctcccca

SEQ ID NO: 7881902 - DNA, 22 bp, Homo sapiens
aagggctctgtgcttgtcccat

SEQ ID NO: 7881903 - DNA, 22 bp, Homo sapiens
aagggctctgtgcttgtcccat

SEQ ID NO: 7881904 - DNA, 22 bp, Homo sapiens
aagggctcacccaactcacttc

SEQ ID NO: 7881905 - DNA, 22 bp, Homo sapiens
aagggctcacccaactcacttc

SEQ ID NO: 7881906 - DNA, 22 bp, Homo sapiens
aagggccttcactgtctaagca

SEQ ID NO: 7881907 - DNA, 22 bp, Homo sapiens
aagggccttcactgtctaagca

SEQ ID NO: 7881908 - DNA, 22 bp, Homo sapiens
aagggccttgccaggtgaagag

SEQ ID NO: 7881909 - DNA, 22 bp, Homo sapiens
aagggccttgccaggtgaagag

SEQ ID NO: 7881910 - DNA, 22 bp, Homo sapiens
aagggccttgccaggtgaagag

SEQ ID NO: 7881911 - DNA, 22 bp, Homo sapiens
aagggcctgccagctcttcatg

SEQ ID NO: 7881912 - DNA, 19 bp, Homo sapiens
aagggcctctgctgtcttc

SEQ ID NO: 7881913 - DNA, 22 bp, Homo sapiens
aagggcctcctggggagcctgg

SEQ ID NO: 7881914 - DNA, 19 bp, Homo sapiens
aagggcctctgctgtcttc

SEQ ID NO: 7881915 - DNA, 22 bp, Homo sapiens
aagggcccattctctcagaaaa

SEQ ID NO: 7881916 - DNA, 22 bp, Homo sapiens
aagggcaggaaaagatggatgt

SEQ ID NO: 7881917 - DNA, 22 bp, Homo sapiens
aagggcaggtgggcatttctgg

SEQ ID NO: 7881918 - DNA, 22 bp, Homo sapiens
aagggcatgagaagcttgaaag

SEQ ID NO: 7881919 - DNA, 22 bp, Homo sapiens
aagggcattgaggctgagagac

SEQ ID NO: 7881920 - DNA, 22 bp, Homo sapiens
aagggccacatgccatttaaaa

SEQ ID NO: 7881921 - DNA, 22 bp, Homo sapiens
aagggccaagctcttctcccat

SEQ ID NO: 7881922 - DNA, 22 bp, Homo sapiens
aagggccacttactcctgctgt

SEQ ID NO: 7881923 - DNA, 22 bp, Homo sapiens
aagggccacatttgggtccctg

SEQ ID NO: 7881924 - DNA, 22 bp, Homo sapiens
aagggccagggctctagagata

SEQ ID NO: 7881925 - DNA, 22 bp, Homo sapiens
aagggccagtagaattttagtg

SEQ ID NO: 7881926 - DNA, 22 bp, Homo sapiens
aagggccagggcagggttgtga

SEQ ID NO: 7881927 - DNA, 22 bp, Homo sapiens
aagggccagggctctagagata

SEQ ID NO: 7881928 - DNA, 22 bp, Homo sapiens
aagggccatcttggactcccca

SEQ ID NO: 7881929 - DNA, 22 bp, Homo sapiens
aagggccatcccagaacagaaa

SEQ ID NO: 7881930 - DNA, 22 bp, Homo sapiens
aagggccataacttgcagtgtt

SEQ ID NO: 7881931 - DNA, 22 bp, Homo sapiens
aagggccatcccagaacagaaa

SEQ ID NO: 7881932 - DNA, 22 bp, Homo sapiens
aagggccataacttgcagtgtt

SEQ ID NO: 7881933 - DNA, 22 bp, Homo sapiens
aagggccataacttgcagtgtt

SEQ ID NO: 7881934 - DNA, 22 bp, Homo sapiens
aagggccatgcctctactttct

SEQ ID NO: 7881935 - DNA, 22 bp, Homo sapiens
aagggccattgctgagagcagt

SEQ ID NO: 7881936 - DNA, 22 bp, Homo sapiens
aagggccatgcctctactttct

SEQ ID NO: 7881937 - DNA, 22 bp, Homo sapiens
aagggccattgctgagagcagt

SEQ ID NO: 7881938 - DNA, 22 bp, Homo sapiens
aagggccattgctgagagcagt

SEQ ID NO: 7881939 - DNA, 22 bp, Homo sapiens
aagggacatagactgtacatct

SEQ ID NO: 7881940 - DNA, 22 bp, Homo sapiens
aagggactttgtcagctttcca

SEQ ID NO: 7881941 - DNA, 22 bp, Homo sapiens
aagggactttgtcagctttcca

SEQ ID NO: 7881942 - DNA, 22 bp, Homo sapiens
aagggaagtttgcatcctcact

SEQ ID NO: 7881943 - DNA, 22 bp, Homo sapiens
aagggacatagactgtacatct

SEQ ID NO: 7881944 - DNA, 22 bp, Homo sapiens
aagggacatagactgtacatct

SEQ ID NO: 7881945 - DNA, 22 bp, Homo sapiens
aagggacatagactgtacatct

SEQ ID NO: 7881946 - DNA, 22 bp, Homo sapiens
aagggaagtttgcatcctcact

SEQ ID NO: 7881947 - DNA, 22 bp, Homo sapiens
aagggaagtttgcatcctcact

SEQ ID NO: 7881948 - DNA, 22 bp, Homo sapiens
aagggagaaaacttgtggctta

SEQ ID NO: 7881949 - DNA, 22 bp, Homo sapiens
aagggagaaaacttgtggctta

SEQ ID NO: 7881950 - DNA, 22 bp, Homo sapiens
aagggaagtttgcatcctcact

SEQ ID NO: 7881951 - DNA, 22 bp, Homo sapiens
aagggaccctggatcaaatgga

SEQ ID NO: 7881952 - DNA, 22 bp, Homo sapiens
aagggaaatcctcagcccagga

SEQ ID NO: 7881953 - DNA, 22 bp, Homo sapiens
aagggaaatcctcagcccagga

SEQ ID NO: 7881954 - DNA, 22 bp, Homo sapiens
aagggaaatcctcagcccagga

SEQ ID NO: 7881955 - DNA, 22 bp, Homo sapiens
aagggaaatcctcagcccagga

SEQ ID NO: 7881956 - DNA, 22 bp, Homo sapiens
aagggaaatggccaggcagaga

SEQ ID NO: 7881957 - DNA, 22 bp, Homo sapiens
aagggaaggttccattatactt

SEQ ID NO: 7881958 - DNA, 22 bp, Homo sapiens
aagggaaggttccattatactt

SEQ ID NO: 7881959 - DNA, 22 bp, Homo sapiens
aagggaaggttccattatactt

SEQ ID NO: 7881960 - DNA, 22 bp, Homo sapiens
aagggaaatggccaggcagaga

SEQ ID NO: 7881961 - DNA, 22 bp, Homo sapiens
aagggaaatcatatggtgcagt

SEQ ID NO: 7881962 - DNA, 22 bp, Homo sapiens
aagggaaatcatatggtgcagt

SEQ ID NO: 7881963 - DNA, 22 bp, Homo sapiens
aagggaaatcatatggtgcagt

SEQ ID NO: 7881964 - DNA, 22 bp, Homo sapiens
aagggaaactttcacaatgtcc

SEQ ID NO: 7881965 - DNA, 22 bp, Homo sapiens
aagggaaactttcacaatgtcc

SEQ ID NO: 7881966 - DNA, 22 bp, Homo sapiens
aagggaaactttcacaatgtcc

SEQ ID NO: 7881967 - DNA, 22 bp, Homo sapiens
aagggaaaatagttgatgacca

SEQ ID NO: 7881968 - DNA, 22 bp, Homo sapiens
aagggaaactttcacaatgtcc

SEQ ID NO: 7881969 - DNA, 22 bp, Homo sapiens
aagggaaaatagttgatgacca

SEQ ID NO: 7881970 - DNA, 22 bp, Homo sapiens
aagggaaaatagttgatgacca

SEQ ID NO: 7881971 - DNA, 22 bp, Homo sapiens
aaggcttttgttcctatttagt

SEQ ID NO: 7881972 - DNA, 22 bp, Homo sapiens
aaggctttttcactggtgactc

SEQ ID NO: 7881973 - DNA, 22 bp, Homo sapiens
aaggcttttgggaattttcaac

SEQ ID NO: 7881974 - DNA, 22 bp, Homo sapiens
aaggcttttgacggttgcctct

SEQ ID NO: 7881975 - DNA, 22 bp, Homo sapiens
aaggcttttaatgagttagaga

SEQ ID NO: 7881976 - DNA, 22 bp, Homo sapiens
aaggcttttaatgagttagaga

SEQ ID NO: 7881977 - DNA, 22 bp, Homo sapiens
aaggcttttaactactgtttta

SEQ ID NO: 7881978 - DNA, 22 bp, Homo sapiens
aaggcttttaatgagttagaga

SEQ ID NO: 7881979 - DNA, 22 bp, Homo sapiens
aaggcttttgacggttgcctct

SEQ ID NO: 7881980 - DNA, 22 bp, Homo sapiens
aaggctttgtgctgagttgtcg

SEQ ID NO: 7881981 - DNA, 22 bp, Homo sapiens
aaggctttgtgggctgcaggca

SEQ ID NO: 7881982 - DNA, 22 bp, Homo sapiens
aaggcttttaaactgtcaagga

SEQ ID NO: 7881983 - DNA, 22 bp, Homo sapiens
aaggcttttaaactgtcaagga

SEQ ID NO: 7881984 - DNA, 22 bp, Homo sapiens
aaggctttctcaggccctggaa

SEQ ID NO: 7881985 - DNA, 19 bp, Homo sapiens
aaggctttctgagtgaaaa

SEQ ID NO: 7881986 - DNA, 22 bp, Homo sapiens
aaggctttgaaaaccaaaaggt

SEQ ID NO: 7881987 - DNA, 22 bp, Homo sapiens
aaggctttgattccattgccct

SEQ ID NO: 7881988 - DNA, 22 bp, Homo sapiens
aaggctttggcccgagggaaga

SEQ ID NO: 7881989 - DNA, 22 bp, Homo sapiens
aaggctttcctgtaggaagaca

SEQ ID NO: 7881990 - DNA, 22 bp, Homo sapiens
aaggctttcctgtaggaagaca

SEQ ID NO: 7881991 - DNA, 22 bp, Homo sapiens
aaggctttccagaaagtcttga

SEQ ID NO: 7881992 - DNA, 22 bp, Homo sapiens
aaggctttccttgggcggttac

SEQ ID NO: 7881993 - DNA, 22 bp, Homo sapiens
aaggctttccttgggcggttac

SEQ ID NO: 7881994 - DNA, 22 bp, Homo sapiens
aaggctttatgtgaccaaaaga

SEQ ID NO: 7881995 - DNA, 22 bp, Homo sapiens
aaggctttccagaaagtcttga

SEQ ID NO: 7881996 - DNA, 22 bp, Homo sapiens
aaggctttcagctaacttgatt

SEQ ID NO: 7881997 - DNA, 22 bp, Homo sapiens
aagtactgacagagaagaatga

SEQ ID NO: 7881998 - DNA, 22 bp, Homo sapiens
aagtactgtttaaattgcagaa

SEQ ID NO: 7881999 - DNA, 22 bp, Homo sapiens
aagtactgacagagaagaatga

SEQ ID NO: 7882000 - DNA, 22 bp, Homo sapiens
aagtactaaggctattatgatg

SEQ ID NO: 7882001 - DNA, 22 bp, Homo sapiens
aagtactacagagctaaatgaa

SEQ ID NO: 7882002 - DNA, 22 bp, Homo sapiens
aagtactaaggctattatgatg

SEQ ID NO: 7882003 - DNA, 22 bp, Homo sapiens
aagtacctagaaatatttttga

SEQ ID NO: 7882004 - DNA, 22 bp, Homo sapiens
aagtacctcatagggttatttt

SEQ ID NO: 7882005 - DNA, 22 bp, Homo sapiens
aagtacatttttaacttacagc

SEQ ID NO: 7882006 - DNA, 22 bp, Homo sapiens
aagtacattatatgagcagaat

SEQ ID NO: 7882007 - DNA, 22 bp, Homo sapiens
aagtaccattcaaatgcaaata

SEQ ID NO: 7882008 - DNA, 22 bp, Homo sapiens
aagtaccctcgggcttaggagt

SEQ ID NO: 7882009 - DNA, 22 bp, Homo sapiens
aagtaccattcaaatgcaaata

SEQ ID NO: 7882010 - DNA, 22 bp, Homo sapiens
accccaggaagtggaggtcatg

SEQ ID NO: 7882011 - DNA, 21 bp, Homo sapiens
aagtagaagggagaagggtta

SEQ ID NO: 7882012 - DNA, 22 bp, Homo sapiens
accccaggagctgtgcctagtc

SEQ ID NO: 7882013 - DNA, 22 bp, Homo sapiens
accccaggagctgtgcctagtc

SEQ ID NO: 7882014 - DNA, 22 bp, Homo sapiens
accccaggagctgtgcctagtc

SEQ ID NO: 7882015 - DNA, 22 bp, Homo sapiens
accccaggagctgtgcctagtc

SEQ ID NO: 7882016 - DNA, 22 bp, Homo sapiens
accccaggagctgtgcctagtc

SEQ ID NO: 7882017 - DNA, 22 bp, Homo sapiens
aagtacttgatagattaactgt

SEQ ID NO: 7882018 - DNA, 22 bp, Homo sapiens
aagtacttgatagattaactgt

SEQ ID NO: 7882019 - DNA, 22 bp, Homo sapiens
aagtactttaggatatgtaact

SEQ ID NO: 7882020 - DNA, 22 bp, Homo sapiens
aagtactttaggatatgtaact

SEQ ID NO: 7882021 - DNA, 22 bp, Homo sapiens
aagtactttaggatatgtaact

SEQ ID NO: 7882022 - DNA, 22 bp, Homo sapiens
aagtagaaaaccgcactggact

SEQ ID NO: 7882023 - DNA, 22 bp, Homo sapiens
aagtacatgctttattcagagt

SEQ ID NO: 7882024 - DNA, 22 bp, Homo sapiens
aagtacatgctttattcagagt

SEQ ID NO: 7882025 - DNA, 22 bp, Homo sapiens
aagtacatgctgtaatgattgg

SEQ ID NO: 7882026 - DNA, 22 bp, Homo sapiens
aagtacatgctgtaatgattgg

SEQ ID NO: 7882027 - DNA, 22 bp, Homo sapiens
aagtacatgttgctcaacagcc

SEQ ID NO: 7882028 - DNA, 22 bp, Homo sapiens
aagtacatgttgctcaacagcc

SEQ ID NO: 7882029 - DNA, 22 bp, Homo sapiens
aagtacatgttgctcaacagcc

SEQ ID NO: 7882030 - DNA, 22 bp, Homo sapiens
aagtacatgttgttcaaaagcc

SEQ ID NO: 7882031 - DNA, 22 bp, Homo sapiens
aagtacattatatgagcagaat

SEQ ID NO: 7882032 - DNA, 22 bp, Homo sapiens
aagtacatgttgttcaaaagcc

SEQ ID NO: 7882033 - DNA, 22 bp, Homo sapiens
aagtacatcaaatgtttggcta

SEQ ID NO: 7882034 - DNA, 22 bp, Homo sapiens
aagtacatatatttatgattct

SEQ ID NO: 7882035 - DNA, 22 bp, Homo sapiens
aagtacatatatttatgattct

SEQ ID NO: 7882036 - DNA, 23 bp, Homo sapiens
aagtacatatatttagatagtga

SEQ ID NO: 7882037 - DNA, 22 bp, Homo sapiens
aagtacagccttcattctcatg

SEQ ID NO: 7882038 - DNA, 22 bp, Homo sapiens
aagtacagccttcattctcatg

SEQ ID NO: 7882039 - DNA, 22 bp, Homo sapiens
aagtacagattcctagtgagat

SEQ ID NO: 7882040 - DNA, 22 bp, Homo sapiens
aagtacagccagcacccagact

SEQ ID NO: 7882041 - DNA, 22 bp, Homo sapiens
aagtacagccttcattctcatg

SEQ ID NO: 7882042 - DNA, 22 bp, Homo sapiens
aagtacagagcctcagtttgac

SEQ ID NO: 7882043 - DNA, 22 bp, Homo sapiens
aagtcaatttatgttctcagac

SEQ ID NO: 7882044 - DNA, 22 bp, Homo sapiens
aagtcaattagtaaacttggaa

SEQ ID NO: 7882045 - DNA, 22 bp, Homo sapiens
aagtcacaagcatatatgcatt

SEQ ID NO: 7882046 - DNA, 22 bp, Homo sapiens
aagtcacaagcatatatgcatt

SEQ ID NO: 7882047 - DNA, 22 bp, Homo sapiens
aagtcacaagcatatatgcatt

SEQ ID NO: 7882048 - DNA, 22 bp, Homo sapiens
aagtcacaaagtgctgtacatg

SEQ ID NO: 7882049 - DNA, 22 bp, Homo sapiens
aagtatgaatcaaagactatct

SEQ ID NO: 7882050 - DNA, 22 bp, Homo sapiens
aagtcacacagttaacatgagg

SEQ ID NO: 7882051 - DNA, 22 bp, Homo sapiens
aagtcacacagttaacatgagg

SEQ ID NO: 7882052 - DNA, 22 bp, Homo sapiens
aagtcacacagttaacatgagg

SEQ ID NO: 7882053 - DNA, 22 bp, Homo sapiens
aagtcacaagcatatatgcatt

SEQ ID NO: 7882054 - DNA, 22 bp, Homo sapiens
aagtcacaagcatatatgcatt

SEQ ID NO: 7882055 - DNA, 22 bp, Homo sapiens
aagtcacaagcatatatgcatt

SEQ ID NO: 7882056 - DNA, 22 bp, Homo sapiens
aagtcaatcaagggtgtaggca

SEQ ID NO: 7882057 - DNA, 22 bp, Homo sapiens
aagtatgaatcaaagactatct

SEQ ID NO: 7882058 - DNA, 22 bp, Homo sapiens
aagtcaatcacatgcacactga

SEQ ID NO: 7882059 - DNA, 22 bp, Homo sapiens
accccccagataatcccttgag

SEQ ID NO: 7882060 - DNA, 22 bp, Homo sapiens
aagtatgaatcaaagactatct

SEQ ID NO: 7882061 - DNA, 22 bp, Homo sapiens
aagtatgaatcaaagactatct

SEQ ID NO: 7882062 - DNA, 22 bp, Homo sapiens
accccccagataatcccttgag

SEQ ID NO: 7882063 - DNA, 22 bp, Homo sapiens
aagtatctgggagatttgcttt

SEQ ID NO: 7882064 - DNA, 21 bp, Homo sapiens
acccccacacctccttagttc

SEQ ID NO: 7882065 - DNA, 21 bp, Homo sapiens
acccccacacctccttagttc

SEQ ID NO: 7882066 - DNA, 22 bp, Homo sapiens
acccccacggaaggccgtacgc

SEQ ID NO: 7882067 - DNA, 22 bp, Homo sapiens
acccccacggaaggccgtacgc

SEQ ID NO: 7882068 - DNA, 22 bp, Homo sapiens
accccaggtcatctgagagtcc

SEQ ID NO: 7882069 - DNA, 22 bp, Homo sapiens
accccaggtccaggttacagag

SEQ ID NO: 7882070 - DNA, 22 bp, Homo sapiens
accccaggtccaggttacagag

SEQ ID NO: 7882071 - DNA, 22 bp, Homo sapiens
accccaggtctccaggctctgg

SEQ ID NO: 7882072 - DNA, 22 bp, Homo sapiens
accccaggtctccaggctctgg

SEQ ID NO: 7882073 - DNA, 20 bp, Homo sapiens
accccagtgtgtgcctcaag

SEQ ID NO: 7882074 - DNA, 22 bp, Homo sapiens
acccccaaacatgatcatggtg

SEQ ID NO: 7882075 - DNA, 21 bp, Homo sapiens
acccccacacctccttagttc

SEQ ID NO: 7882076 - DNA, 23 bp, Homo sapiens
accccaggcatcgcattcctctt

SEQ ID NO: 7882077 - DNA, 22 bp, Homo sapiens
accccaggcccagggaagaggc

SEQ ID NO: 7882078 - DNA, 22 bp, Homo sapiens
accccaggcccagggaagaggc

SEQ ID NO: 7882079 - DNA, 23 bp, Homo sapiens
accccaggcatcgcattcctctt

SEQ ID NO: 7882080 - DNA, 22 bp, Homo sapiens
accccagggctgccagcctcct

SEQ ID NO: 7882081 - DNA, 22 bp, Homo sapiens
accccagggctgccagcctcct

SEQ ID NO: 7882082 - DNA, 22 bp, Homo sapiens
accccagggctgccagcctcct

SEQ ID NO: 7882083 - DNA, 22 bp, Homo sapiens
accccagggctgccagcctcct

SEQ ID NO: 7882084 - DNA, 22 bp, Homo sapiens
aaggtgctcacgggctcaggga

SEQ ID NO: 7882085 - DNA, 22 bp, Homo sapiens
aaggtgcctggctttgccttct

SEQ ID NO: 7882086 - DNA, 22 bp, Homo sapiens
aaggtgccagcccctccactga

SEQ ID NO: 7882087 - DNA, 22 bp, Homo sapiens
aaggtgccacagttcttttagc

SEQ ID NO: 7882088 - DNA, 22 bp, Homo sapiens
aaggtgccatattttggaatag

SEQ ID NO: 7882089 - DNA, 22 bp, Homo sapiens
aaggtgctcgttatggccagtg

SEQ ID NO: 7882090 - DNA, 22 bp, Homo sapiens
aaggtgctcgttatggccagtg

SEQ ID NO: 7882091 - DNA, 22 bp, Homo sapiens
aaggtgctcacgggctcaggga

SEQ ID NO: 7882092 - DNA, 19 bp, Homo sapiens
aaggtggcagcaggtatta

SEQ ID NO: 7882093 - DNA, 22 bp, Homo sapiens
aaggtggaggttgcagtgagct

SEQ ID NO: 7882094 - DNA, 22 bp, Homo sapiens
aaggtggaggttgcagtgagct

SEQ ID NO: 7882095 - DNA, 17 bp, Homo sapiens
aaggtgagagctgttct

SEQ ID NO: 7882096 - DNA, 22 bp, Homo sapiens
aaggtgccacttccctcagact

SEQ ID NO: 7882097 - DNA, 22 bp, Homo sapiens
aaggtgccacttccctcagact

SEQ ID NO: 7882098 - DNA, 22 bp, Homo sapiens
aaggtgaggattttgttctgct

SEQ ID NO: 7882099 - DNA, 22 bp, Homo sapiens
aaggtgaactggtaatgacaga

SEQ ID NO: 7882100 - DNA, 22 bp, Homo sapiens
aaggtgactcacaaagccagtt

SEQ ID NO: 7882101 - DNA, 22 bp, Homo sapiens
aaggtgaactggtaatgacaga

SEQ ID NO: 7882102 - DNA, 22 bp, Homo sapiens
aaggtgaactggtaatgacaga

SEQ ID NO: 7882103 - DNA, 22 bp, Homo sapiens
aaggtgaactggtaatgacaga

SEQ ID NO: 7882104 - DNA, 22 bp, Homo sapiens
aaggtgaactggtaatgacaga

SEQ ID NO: 7882105 - DNA, 22 bp, Homo sapiens
aaggtgaactggtaatgacaga

SEQ ID NO: 7882106 - DNA, 22 bp, Homo sapiens
aaggtgaactggtaatgacaga

SEQ ID NO: 7882107 - DNA, 22 bp, Homo sapiens
aaggtctgtggccacctctggg

SEQ ID NO: 7882108 - DNA, 18 bp, Homo sapiens
aaggtctgtctggtaggt

SEQ ID NO: 7882109 - DNA, 22 bp, Homo sapiens
aaggtctgtgaggctgtttgtc

SEQ ID NO: 7882110 - DNA, 22 bp, Homo sapiens
aaggtagattctggatcgaagg

SEQ ID NO: 7882111 - DNA, 22 bp, Homo sapiens
aaggtagattctggatcgaagg

SEQ ID NO: 7882112 - DNA, 22 bp, Homo sapiens
aagggctgatctcactttcttt

SEQ ID NO: 7882113 - DNA, 22 bp, Homo sapiens
aagggctgatctcactttcttt

SEQ ID NO: 7882114 - DNA, 22 bp, Homo sapiens
aagggctgatctcactttcttt

SEQ ID NO: 7882115 - DNA, 22 bp, Homo sapiens
aagggctgagcacagtgagcca

SEQ ID NO: 7882116 - DNA, 22 bp, Homo sapiens
aagggctgagcacagtgagcca

SEQ ID NO: 7882117 - DNA, 22 bp, Homo sapiens
aagggctgagcacagtgagcca

SEQ ID NO: 7882118 - DNA, 22 bp, Homo sapiens
aagggctgagcacagtgagcca

SEQ ID NO: 7882119 - DNA, 22 bp, Homo sapiens
aagggctgagcacagtgagcca

SEQ ID NO: 7882120 - DNA, 22 bp, Homo sapiens
aagggctgagcacagtgagcca

SEQ ID NO: 7882121 - DNA, 22 bp, Homo sapiens
aagggctgagcacagtgagcca

SEQ ID NO: 7882122 - DNA, 22 bp, Homo sapiens
aagggctgagaagtggggctgg

SEQ ID NO: 7882123 - DNA, 22 bp, Homo sapiens
aagggctgagaagtggggctgg

SEQ ID NO: 7882124 - DNA, 22 bp, Homo sapiens
aagggctgagaagtggggctgg

SEQ ID NO: 7882125 - DNA, 22 bp, Homo sapiens
aagggctgagaagtggggctgg

SEQ ID NO: 7882126 - DNA, 22 bp, Homo sapiens
aagggctgagaagtggggctgg

SEQ ID NO: 7882127 - DNA, 22 bp, Homo sapiens
aagggctgaatgaagggttgaa

SEQ ID NO: 7882128 - DNA, 22 bp, Homo sapiens
aagggctgaatgaagggttgaa

SEQ ID NO: 7882129 - DNA, 22 bp, Homo sapiens
aagggctgaatgaagggttgaa

SEQ ID NO: 7882130 - DNA, 22 bp, Homo sapiens
aagggctgagaagtggggctgg

SEQ ID NO: 7882131 - DNA, 22 bp, Homo sapiens
aagggctgaaagaccttgggca

SEQ ID NO: 7882132 - DNA, 22 bp, Homo sapiens
aagggctgaaagaccttgggca

SEQ ID NO: 7882133 - DNA, 22 bp, Homo sapiens
aagggctgaaagaccttgggca

SEQ ID NO: 7882134 - DNA, 22 bp, Homo sapiens
aagggctgaaagaccttgggca

SEQ ID NO: 7882135 - DNA, 22 bp, Homo sapiens
aagggctgaaagaccttgggca

SEQ ID NO: 7882136 - DNA, 22 bp, Homo sapiens
aagggctgaatgaagggttgaa

SEQ ID NO: 7882137 - DNA, 22 bp, Homo sapiens
aagggctgaatgaagggttgaa

SEQ ID NO: 7882138 - DNA, 22 bp, Homo sapiens
aagggctgaatgaagggttgaa

SEQ ID NO: 7882139 - DNA, 22 bp, Homo sapiens
aagggctgaatgaagggttgaa

SEQ ID NO: 7882140 - DNA, 22 bp, Homo sapiens
accatgcatcaaagctaatata

SEQ ID NO: 7882141 - DNA, 22 bp, Homo sapiens
accatgccagtggcagccagac

SEQ ID NO: 7882142 - DNA, 22 bp, Homo sapiens
accatggaccatagttcctatt

SEQ ID NO: 7882143 - DNA, 22 bp, Homo sapiens
accatgggtcagccacctcagc

SEQ ID NO: 7882144 - DNA, 22 bp, Homo sapiens
accatgggcagaatctttgcag

SEQ ID NO: 7882145 - DNA, 22 bp, Homo sapiens
accatgattcacccaccactgt

SEQ ID NO: 7882146 - DNA, 22 bp, Homo sapiens
accatgcacagctgttctatta

SEQ ID NO: 7882147 - DNA, 22 bp, Homo sapiens
accatgcacagctgttctatta

SEQ ID NO: 7882148 - DNA, 22 bp, Homo sapiens
accatgaggaaatacatttgtg

SEQ ID NO: 7882149 - DNA, 22 bp, Homo sapiens
accatgtcatttattggccaaa

SEQ ID NO: 7882150 - DNA, 22 bp, Homo sapiens
accatgtcatttattggccaaa

SEQ ID NO: 7882151 - DNA, 22 bp, Homo sapiens
accatgtcatttattggccaaa

SEQ ID NO: 7882152 - DNA, 22 bp, Homo sapiens
accatgtgatcaaaacaaatcc

SEQ ID NO: 7882153 - DNA, 22 bp, Homo sapiens
accatgttggccaagctggtct

SEQ ID NO: 7882154 - DNA, 22 bp, Homo sapiens
accatgttggccaagctggtct

SEQ ID NO: 7882155 - DNA, 22 bp, Homo sapiens
accatgttggccaagctggtct

SEQ ID NO: 7882156 - DNA, 22 bp, Homo sapiens
aagtaacaggcatgtgaatgac

SEQ ID NO: 7882157 - DNA, 23 bp, Homo sapiens
aagtaacagggataatagcagtt

SEQ ID NO: 7882158 - DNA, 22 bp, Homo sapiens
accatgttggccaagctggtct

SEQ ID NO: 7882159 - DNA, 23 bp, Homo sapiens
aagtaacagggataatagcagtt

SEQ ID NO: 7882160 - DNA, 23 bp, Homo sapiens
aagtaacagggataatagcagtt

SEQ ID NO: 7882161 - DNA, 22 bp, Homo sapiens
aagtacagaatcattggaagca

SEQ ID NO: 7882162 - DNA, 22 bp, Homo sapiens
aaggtgggtggatcacgaggtc

SEQ ID NO: 7882163 - DNA, 22 bp, Homo sapiens
aaggtgggcagatcacaaggtc

SEQ ID NO: 7882164 - DNA, 22 bp, Homo sapiens
aaggtggcgctggagctggtcc

SEQ ID NO: 7882165 - DNA, 22 bp, Homo sapiens
aaggtgggcagatcacaaggtc

SEQ ID NO: 7882166 - DNA, 22 bp, Homo sapiens
aaggtggccctgagcatgacaa

SEQ ID NO: 7882167 - DNA, 22 bp, Homo sapiens
aaggtggcgctggagctggtcc

SEQ ID NO: 7882168 - DNA, 22 bp, Homo sapiens
aaggtggcatgtcccctggcca

SEQ ID NO: 7882169 - DNA, 22 bp, Homo sapiens
accatcctgaaaccttcatgct

SEQ ID NO: 7882170 - DNA, 22 bp, Homo sapiens
accatcctgtgactccgcttcc

SEQ ID NO: 7882171 - DNA, 22 bp, Homo sapiens
accatcctttagtttgcgtttc

SEQ ID NO: 7882172 - DNA, 22 bp, Homo sapiens
accatctgagtagagagaagta

SEQ ID NO: 7882173 - DNA, 22 bp, Homo sapiens
accatcttaaggggacttctta

SEQ ID NO: 7882174 - DNA, 22 bp, Homo sapiens
accatcttaaggggacttctta

SEQ ID NO: 7882175 - DNA, 22 bp, Homo sapiens
accatcctcatcttggatttga

SEQ ID NO: 7882176 - DNA, 22 bp, Homo sapiens
accatccaaactgctttctgtg

SEQ ID NO: 7882177 - DNA, 22 bp, Homo sapiens
accatcttagtggccagctctc

SEQ ID NO: 7882178 - DNA, 22 bp, Homo sapiens
accatcttagcagactgcagtg

SEQ ID NO: 7882179 - DNA, 22 bp, Homo sapiens
accatcttagcagactgcagtg

SEQ ID NO: 7882180 - DNA, 21 bp, Homo sapiens
accatcttccatgcattatat

SEQ ID NO: 7882181 - DNA, 22 bp, Homo sapiens
accatcttagtggccagctctc

SEQ ID NO: 7882182 - DNA, 21 bp, Homo sapiens
accatcttccatgcattatat

SEQ ID NO: 7882183 - DNA, 22 bp, Homo sapiens
accatcttttcctctgcctcct

SEQ ID NO: 7882184 - DNA, 22 bp, Homo sapiens
accatcttttcctctgcctcct

SEQ ID NO: 7882185 - DNA, 22 bp, Homo sapiens
aaggcagcctctgccagccggg

SEQ ID NO: 7882186 - DNA, 22 bp, Homo sapiens
aaggcagcctctgccagccggg

SEQ ID NO: 7882187 - DNA, 22 bp, Homo sapiens
aaggcagcctctgccagccggg

SEQ ID NO: 7882188 - DNA, 22 bp, Homo sapiens
aaggcagccgtgtgactgcatg

SEQ ID NO: 7882189 - DNA, 22 bp, Homo sapiens
aaggcagccgtgtgactgcatg

SEQ ID NO: 7882190 - DNA, 22 bp, Homo sapiens
aaggcagccgtgtgactgcatg

SEQ ID NO: 7882191 - DNA, 22 bp, Homo sapiens
aaggcagccgtgtgactgcatg

SEQ ID NO: 7882192 - DNA, 22 bp, Homo sapiens
aaggcagccttttgagttgatt

SEQ ID NO: 7882193 - DNA, 22 bp, Homo sapiens
aaggcagccttttgagttgatt

SEQ ID NO: 7882194 - DNA, 22 bp, Homo sapiens
aaggcagccttttgagttgatt

SEQ ID NO: 7882195 - DNA, 22 bp, Homo sapiens
aaggcagccttttgagttgatt

SEQ ID NO: 7882196 - DNA, 22 bp, Homo sapiens
aaggcagcctttgtttgattga

SEQ ID NO: 7882197 - DNA, 22 bp, Homo sapiens
aaggcagcctttgtttgattga

SEQ ID NO: 7882198 - DNA, 22 bp, Homo sapiens
aaggcagctcagctcatggcag

SEQ ID NO: 7882199 - DNA, 22 bp, Homo sapiens
aaggcagctcagctcatggcag

SEQ ID NO: 7882200 - DNA, 22 bp, Homo sapiens
aaggcagctcagctcatggcag

SEQ ID NO: 7882201 - DNA, 22 bp, Homo sapiens
aaggcagctcagctcatggcag

SEQ ID NO: 7882202 - DNA, 22 bp, Homo sapiens
aaggcagccttttgagttgatt

SEQ ID NO: 7882203 - DNA, 22 bp, Homo sapiens
acagttgagatgcaactttggg

SEQ ID NO: 7882204 - DNA, 22 bp, Homo sapiens
acagttgaggacttaaacaaaa

SEQ ID NO: 7882205 - DNA, 22 bp, Homo sapiens
acagttgggctgtagcatgctt

SEQ ID NO: 7882206 - DNA, 22 bp, Homo sapiens
acagttgatttcattagaatcg

SEQ ID NO: 7882207 - DNA, 22 bp, Homo sapiens
acagttgttttccagatatgtt

SEQ ID NO: 7882208 - DNA, 22 bp, Homo sapiens
acagttggttaacacaaatatt

SEQ ID NO: 7882209 - DNA, 22 bp, Homo sapiens
acagttgatttcattagaatcg

SEQ ID NO: 7882210 - DNA, 22 bp, Homo sapiens
acagttgggctgtagcatgctt

SEQ ID NO: 7882211 - DNA, 22 bp, Homo sapiens
acagttgggctgtagcatgctt

SEQ ID NO: 7882212 - DNA, 22 bp, Homo sapiens
acagttggttaacacaaatatt

SEQ ID NO: 7882213 - DNA, 22 bp, Homo sapiens
aaggcagatataaagactagag

SEQ ID NO: 7882214 - DNA, 22 bp, Homo sapiens
aaggcagatataaagactagag

SEQ ID NO: 7882215 - DNA, 22 bp, Homo sapiens
aaggcagatataaagactagag

SEQ ID NO: 7882216 - DNA, 22 bp, Homo sapiens
aaggcagccgtgtgactgcatg

SEQ ID NO: 7882217 - DNA, 22 bp, Homo sapiens
aaggcagccgtgtgactgcatg

SEQ ID NO: 7882218 - DNA, 22 bp, Homo sapiens
aaggcagccgtgtgactgcatg

SEQ ID NO: 7882219 - DNA, 22 bp, Homo sapiens
aaggcagatataaagactagag

SEQ ID NO: 7882220 - DNA, 22 bp, Homo sapiens
aaggcagatataaagactagag

SEQ ID NO: 7882221 - DNA, 22 bp, Homo sapiens
acagtttacagggatttgagct

SEQ ID NO: 7882222 - DNA, 22 bp, Homo sapiens
acagttctttgtttatagcttg

SEQ ID NO: 7882223 - DNA, 22 bp, Homo sapiens
acagttctttggatggaagaat

SEQ ID NO: 7882224 - DNA, 22 bp, Homo sapiens
acagttctttggatggaagaat

SEQ ID NO: 7882225 - DNA, 22 bp, Homo sapiens
acagttctttgtttatagcttg

SEQ ID NO: 7882226 - DNA, 22 bp, Homo sapiens
acagttcttaaaacttgaatta

SEQ ID NO: 7882227 - DNA, 21 bp, Homo sapiens
acagttctgccggcatctttc

SEQ ID NO: 7882228 - DNA, 22 bp, Homo sapiens
acagttctgagctataattgct

SEQ ID NO: 7882229 - DNA, 22 bp, Homo sapiens
acagttctgcaagatatttttt

SEQ ID NO: 7882230 - DNA, 22 bp, Homo sapiens
acagttctgcctgtttgagaag

SEQ ID NO: 7882231 - DNA, 21 bp, Homo sapiens
acagttctgccggcatctttc

SEQ ID NO: 7882232 - DNA, 22 bp, Homo sapiens
acagttctgcctgtttgagaag

SEQ ID NO: 7882233 - DNA, 22 bp, Homo sapiens
acagttctgtcctagacttcgt

SEQ ID NO: 7882234 - DNA, 22 bp, Homo sapiens
acagttctgcaagatatttttt

SEQ ID NO: 7882235 - DNA, 22 bp, Homo sapiens
aaggcagagatattcttgatct

SEQ ID NO: 7882236 - DNA, 22 bp, Homo sapiens
acagttctaaatcttggataat

SEQ ID NO: 7882237 - DNA, 21 bp, Homo sapiens
aaggcagaagcatggaatgag

SEQ ID NO: 7882238 - DNA, 19 bp, Homo sapiens
acagttctaatttctgtgg

SEQ ID NO: 7882239 - DNA, 22 bp, Homo sapiens
aaggcagagatattcttgatct

SEQ ID NO: 7882240 - DNA, 22 bp, Homo sapiens
acagttctaaatcttggataat

SEQ ID NO: 7882241 - DNA, 19 bp, Homo sapiens
acagttctaatttctgtgg

SEQ ID NO: 7882242 - DNA, 22 bp, Homo sapiens
acagttctgagctataattgct

SEQ ID NO: 7882243 - DNA, 22 bp, Homo sapiens
acagttctcttgtcacttcctc

SEQ ID NO: 7882244 - DNA, 23 bp, Homo sapiens
acagttctctgatgggtttaaca

SEQ ID NO: 7882245 - DNA, 22 bp, Homo sapiens
acagttctcttgtcacttcctc

SEQ ID NO: 7882246 - DNA, 22 bp, Homo sapiens
acagttctgaagactagagcct

SEQ ID NO: 7882247 - DNA, 22 bp, Homo sapiens
acagttctagcttttacatttt

SEQ ID NO: 7882248 - DNA, 22 bp, Homo sapiens
acagttctagcttttacatttt

SEQ ID NO: 7882249 - DNA, 22 bp, Homo sapiens
acagttctccagtgcctttgag

SEQ ID NO: 7882250 - DNA, 23 bp, Homo sapiens
acagttctctgatgggtttaaca

SEQ ID NO: 7882251 - DNA, 22 bp, Homo sapiens
aaggcagcttcaccacagcatt

SEQ ID NO: 7882252 - DNA, 22 bp, Homo sapiens
aaggcagcttcaccacagcatt

SEQ ID NO: 7882253 - DNA, 22 bp, Homo sapiens
aaggcagcttcaccacagcatt

SEQ ID NO: 7882254 - DNA, 22 bp, Homo sapiens
aaggcagctttaaaaaagatgc

SEQ ID NO: 7882255 - DNA, 22 bp, Homo sapiens
aaggcagctttaaaaaagatgc

SEQ ID NO: 7882256 - DNA, 22 bp, Homo sapiens
aaggcaggagctgtatcttatt

SEQ ID NO: 7882257 - DNA, 22 bp, Homo sapiens
aaggcagctttaaaaaagatgc

SEQ ID NO: 7882258 - DNA, 22 bp, Homo sapiens
aaggcaggagctgtatcttatt

SEQ ID NO: 7882259 - DNA, 22 bp, Homo sapiens
aaggcaggagctgtatcttatt

SEQ ID NO: 7882260 - DNA, 22 bp, Homo sapiens
aaggcaggatgcggacccatct

SEQ ID NO: 7882261 - DNA, 22 bp, Homo sapiens
aaggcagggaaagtggattagg

SEQ ID NO: 7882262 - DNA, 22 bp, Homo sapiens
aaggcagggaaagtggattagg

SEQ ID NO: 7882263 - DNA, 22 bp, Homo sapiens
aaggcagggaaagtggattagg

SEQ ID NO: 7882264 - DNA, 22 bp, Homo sapiens
aaggcagggaaagtggattagg

SEQ ID NO: 7882265 - DNA, 22 bp, Homo sapiens
aaggcagggaaagtggattagg

SEQ ID NO: 7882266 - DNA, 22 bp, Homo sapiens
aaggcaggatgggaaaagattt

SEQ ID NO: 7882267 - DNA, 22 bp, Homo sapiens
aaggcaggatgggaaaagattt

SEQ ID NO: 7882268 - DNA, 22 bp, Homo sapiens
aaggcaggatgggaaaagattt

SEQ ID NO: 7882269 - DNA, 22 bp, Homo sapiens
aaggcaggatgggaaaagattt

SEQ ID NO: 7882270 - DNA, 22 bp, Homo sapiens
aaggcaggatgcggacccatct

SEQ ID NO: 7882271 - DNA, 22 bp, Homo sapiens
aaggcagtcagttgttttgaaa

SEQ ID NO: 7882272 - DNA, 22 bp, Homo sapiens
aaggcagtcaaagcagacttct

SEQ ID NO: 7882273 - DNA, 22 bp, Homo sapiens
aaggcagtctggtttcaaagca

SEQ ID NO: 7882274 - DNA, 22 bp, Homo sapiens
aaggcagtggttgtgatactgt

SEQ ID NO: 7882275 - DNA, 22 bp, Homo sapiens
aaggcagttcactcacgcagcc

SEQ ID NO: 7882276 - DNA, 22 bp, Homo sapiens
aaggcagttcactcacgcagcc

SEQ ID NO: 7882277 - DNA, 22 bp, Homo sapiens
aaggcagtttgggccaccatct

SEQ ID NO: 7882278 - DNA, 22 bp, Homo sapiens
aaggcatacatattgttatagg

SEQ ID NO: 7882279 - DNA, 22 bp, Homo sapiens
aaggcagtaggatcttccacag

SEQ ID NO: 7882280 - DNA, 22 bp, Homo sapiens
aaggcagtaggatcttccacag

SEQ ID NO: 7882281 - DNA, 18 bp, Homo sapiens
aaggcagtatgattgcac

SEQ ID NO: 7882282 - DNA, 22 bp, Homo sapiens
aaggcaggtattgatgccacag

SEQ ID NO: 7882283 - DNA, 22 bp, Homo sapiens
aaggcaggtattgatgccacag

SEQ ID NO: 7882284 - DNA, 22 bp, Homo sapiens
aaggcaggtattgatgccacag

SEQ ID NO: 7882285 - DNA, 22 bp, Homo sapiens
aaggcaggtattgatgccacag

SEQ ID NO: 7882286 - DNA, 22 bp, Homo sapiens
aaggcagtactttatgtccata

SEQ ID NO: 7882287 - DNA, 22 bp, Homo sapiens
acagtatacattgattaggacc

SEQ ID NO: 7882288 - DNA, 22 bp, Homo sapiens
acagtataccattgtgactttg

SEQ ID NO: 7882289 - DNA, 22 bp, Homo sapiens
acagtataccattgtgactttg

SEQ ID NO: 7882290 - DNA, 22 bp, Homo sapiens
acagtatagggcttatattgta

SEQ ID NO: 7882291 - DNA, 22 bp, Homo sapiens
acagtatagggcttatattgta

SEQ ID NO: 7882292 - DNA, 22 bp, Homo sapiens
acagtatagggcttatattgta

SEQ ID NO: 7882293 - DNA, 22 bp, Homo sapiens
acagtataactccatgccaccc

SEQ ID NO: 7882294 - DNA, 22 bp, Homo sapiens
aaggaaatgaagctgatgttgg

SEQ ID NO: 7882295 - DNA, 22 bp, Homo sapiens
aaggaaatgaagctgatgttgg

SEQ ID NO: 7882296 - DNA, 22 bp, Homo sapiens
aaggaaatgaggttgatggatg

SEQ ID NO: 7882297 - DNA, 22 bp, Homo sapiens
aaggaaatgaagctgatgttgg

SEQ ID NO: 7882298 - DNA, 22 bp, Homo sapiens
aaggaaatctttgtaacatctt

SEQ ID NO: 7882299 - DNA, 22 bp, Homo sapiens
aaggaaatctttgtaacatctt

SEQ ID NO: 7882300 - DNA, 22 bp, Homo sapiens
aaggaaatctttgtaacatctt

SEQ ID NO: 7882301 - DNA, 22 bp, Homo sapiens
aaggaaatctttgtaacatctt

SEQ ID NO: 7882302 - DNA, 22 bp, Homo sapiens
aaggaaatctttgtaacatctt

SEQ ID NO: 7882303 - DNA, 22 bp, Homo sapiens
aaggaaatgaggttgatggatg

SEQ ID NO: 7882304 - DNA, 22 bp, Homo sapiens
aaggaaatgaggttgatggatg

SEQ ID NO: 7882305 - DNA, 22 bp, Homo sapiens
aaggaaatgtgcctgacactgc

SEQ ID NO: 7882306 - DNA, 22 bp, Homo sapiens
aaggaaatgtgcctgacactgc

SEQ ID NO: 7882307 - DNA, 22 bp, Homo sapiens
aaggaaatgaggttgatggatg

SEQ ID NO: 7882308 - DNA, 22 bp, Homo sapiens
aaggaaattaggttattttgct

SEQ ID NO: 7882309 - DNA, 22 bp, Homo sapiens
aaggaaatgtgcctgacactgc

SEQ ID NO: 7882310 - DNA, 22 bp, Homo sapiens
aaggaaatgtgcctgacactgc

SEQ ID NO: 7882311 - DNA, 22 bp, Homo sapiens
aaggaaatgtgcctgacactgc

SEQ ID NO: 7882312 - DNA, 22 bp, Homo sapiens
aaggaaatgtgcctgacactgc

SEQ ID NO: 7882313 - DNA, 22 bp, Homo sapiens
aaggaacactacaaggctggga

SEQ ID NO: 7882314 - DNA, 22 bp, Homo sapiens
aaggaaattaggttattttgct

SEQ ID NO: 7882315 - DNA, 22 bp, Homo sapiens
aaggaacctggagtagagggag

SEQ ID NO: 7882316 - DNA, 22 bp, Homo sapiens
aaggaacactacaaggctggga

SEQ ID NO: 7882317 - DNA, 22 bp, Homo sapiens
acagtactgctgttcttgtcct

SEQ ID NO: 7882318 - DNA, 22 bp, Homo sapiens
acagtagaaacaggcaggcaga

SEQ ID NO: 7882319 - DNA, 22 bp, Homo sapiens
acagtagaaacaggcaggcaga

SEQ ID NO: 7882320 - DNA, 22 bp, Homo sapiens
acagtagatggctcagagacag

SEQ ID NO: 7882321 - DNA, 22 bp, Homo sapiens
acagtagatggctcagagacag

SEQ ID NO: 7882322 - DNA, 22 bp, Homo sapiens
acagtagaccctggataaacat

SEQ ID NO: 7882323 - DNA, 22 bp, Homo sapiens
acagtagaccctggataaacat

SEQ ID NO: 7882324 - DNA, 22 bp, Homo sapiens
acagtagaggcttgatcgcagc

SEQ ID NO: 7882325 - DNA, 22 bp, Homo sapiens
acagtagaccctggataaacat

SEQ ID NO: 7882326 - DNA, 22 bp, Homo sapiens
acagtagttggttgttttggga

SEQ ID NO: 7882327 - DNA, 22 bp, Homo sapiens
acagtataaactcctaaaagcc

SEQ ID NO: 7882328 - DNA, 22 bp, Homo sapiens
acagtataaactcctaaaagcc

SEQ ID NO: 7882329 - DNA, 22 bp, Homo sapiens
acagtagtttataaaaatgttg

SEQ ID NO: 7882330 - DNA, 22 bp, Homo sapiens
acagtagtgtgtgaaacttgcc

SEQ ID NO: 7882331 - DNA, 22 bp, Homo sapiens
acagtaggaatagatgtagata

SEQ ID NO: 7882332 - DNA, 22 bp, Homo sapiens
acagtagtctcaggaataggca

SEQ ID NO: 7882333 - DNA, 22 bp, Homo sapiens
acagtagattggtatgatgtca

SEQ ID NO: 7882334 - DNA, 22 bp, Homo sapiens
acagtagctaatattgcattat

SEQ ID NO: 7882335 - DNA, 22 bp, Homo sapiens
aaggcagaaagggatgtgagtg

SEQ ID NO: 7882336 - DNA, 22 bp, Homo sapiens
aaggcagaaagggatgtgagtg

SEQ ID NO: 7882337 - DNA, 22 bp, Homo sapiens
aaggcagaaagggatgtgagtg

SEQ ID NO: 7882338 - DNA, 22 bp, Homo sapiens
aaggcagaaagggatgtgagtg

SEQ ID NO: 7882339 - DNA, 22 bp, Homo sapiens
aaggcagaaagggatgtgagtg

SEQ ID NO: 7882340 - DNA, 22 bp, Homo sapiens
aaggcacttttctaaagacctt

SEQ ID NO: 7882341 - DNA, 22 bp, Homo sapiens
aaggcagaaagggatgtgagtg

SEQ ID NO: 7882342 - DNA, 22 bp, Homo sapiens
aaggcagaaagggatgtgagtg

SEQ ID NO: 7882343 - DNA, 22 bp, Homo sapiens
aaggcagaaagggatgtgagtg

SEQ ID NO: 7882344 - DNA, 22 bp, Homo sapiens
aaggcacttttctaaagacctt

SEQ ID NO: 7882345 - DNA, 22 bp, Homo sapiens
aaggcacttttcctgagatgat

SEQ ID NO: 7882346 - DNA, 22 bp, Homo sapiens
aaggcacttttcctgagatgat

SEQ ID NO: 7882347 - DNA, 22 bp, Homo sapiens
aaggcacttttctaaagacctt

SEQ ID NO: 7882348 - DNA, 22 bp, Homo sapiens
aaggcacttttctaaagacctt

SEQ ID NO: 7882349 - DNA, 22 bp, Homo sapiens
aaggcacttttctaaagacctt

SEQ ID NO: 7882350 - DNA, 21 bp, Homo sapiens
aaggcagaagcatggaatgag

SEQ ID NO: 7882351 - DNA, 22 bp, Homo sapiens
aaggcagaaattcaactactgg

SEQ ID NO: 7882352 - DNA, 22 bp, Homo sapiens
aaggcagaaattcaactactgg

SEQ ID NO: 7882353 - DNA, 22 bp, Homo sapiens
aaggcagaaattcaactactgg

SEQ ID NO: 7882354 - DNA, 22 bp, Homo sapiens
aaggcagaaattcaactactgg

SEQ ID NO: 7882355 - DNA, 19 bp, Homo sapiens
aaggcagaagttggatatg

SEQ ID NO: 7882356 - DNA, 19 bp, Homo sapiens
aaggcagaagttggatatg

SEQ ID NO: 7882357 - DNA, 19 bp, Homo sapiens
aaggcagaagttggatatg

SEQ ID NO: 7882358 - DNA, 21 bp, Homo sapiens
aaggcagaagcatggaatgag

SEQ ID NO: 7882359 - DNA, 22 bp, Homo sapiens
aaggcacttaacgtgggaggat

SEQ ID NO: 7882360 - DNA, 22 bp, Homo sapiens
aaggcactacgctgctggggcg

SEQ ID NO: 7882361 - DNA, 22 bp, Homo sapiens
aaggcacttgcccagagctgca

SEQ ID NO: 7882362 - DNA, 22 bp, Homo sapiens
aaggcacttgcccagagctgca

SEQ ID NO: 7882363 - DNA, 22 bp, Homo sapiens
aaggcacttgcccagagctgca

SEQ ID NO: 7882364 - DNA, 22 bp, Homo sapiens
aaggcacttgcccagagctgca

SEQ ID NO: 7882365 - DNA, 22 bp, Homo sapiens
aaggcacttgcccagagctgca

SEQ ID NO: 7882366 - DNA, 22 bp, Homo sapiens
aaggaagaagggaagttactta

SEQ ID NO: 7882367 - DNA, 22 bp, Homo sapiens
aaggcactacgctgctggggcg

SEQ ID NO: 7882368 - DNA, 22 bp, Homo sapiens
aaggcactagcaagctgcctgg

SEQ ID NO: 7882369 - DNA, 22 bp, Homo sapiens
aaggaacttgccacagaaaaga

SEQ ID NO: 7882370 - DNA, 22 bp, Homo sapiens
aaggaacttgccacagaaaaga

SEQ ID NO: 7882371 - DNA, 22 bp, Homo sapiens
aaggaactttgcagaggtgatt

SEQ ID NO: 7882372 - DNA, 22 bp, Homo sapiens
aaggaactgatgctcaaagaat

SEQ ID NO: 7882373 - DNA, 22 bp, Homo sapiens
aaggaactgctgatgtggtgac

SEQ ID NO: 7882374 - DNA, 22 bp, Homo sapiens
aaggaactaactatgtagagat

SEQ ID NO: 7882375 - DNA, 22 bp, Homo sapiens
aaggaactctagagccttgaac

SEQ ID NO: 7882376 - DNA, 22 bp, Homo sapiens
aaggaactgatgctcaaagaat

SEQ ID NO: 7882377 - DNA, 22 bp, Homo sapiens
aaggaactgatgctcaaagaat

SEQ ID NO: 7882378 - DNA, 22 bp, Homo sapiens
aaggaagaaatgaataggtgga

SEQ ID NO: 7882379 - DNA, 22 bp, Homo sapiens
aaggaagaaatgaataggtgga

SEQ ID NO: 7882380 - DNA, 22 bp, Homo sapiens
aaggaagaaatgaataggtgga

SEQ ID NO: 7882381 - DNA, 22 bp, Homo sapiens
aaggaactttgcagaggtgatt

SEQ ID NO: 7882382 - DNA, 22 bp, Homo sapiens
aaggaagaaatgaataggtgga

SEQ ID NO: 7882383 - DNA, 22 bp, Homo sapiens
aaggaaatacaacatgtattca

SEQ ID NO: 7882384 - DNA, 22 bp, Homo sapiens
aaggaaaggatgagcatgcatt

SEQ ID NO: 7882385 - DNA, 22 bp, Homo sapiens
aaggaaatacaacatgtattca

SEQ ID NO: 7882386 - DNA, 22 bp, Homo sapiens
aaggaaaggatgagcatgcatt

SEQ ID NO: 7882387 - DNA, 22 bp, Homo sapiens
aaggaaaggatgagcatgcatt

SEQ ID NO: 7882388 - DNA, 22 bp, Homo sapiens
aaggaaaggatgagcatgcatt

SEQ ID NO: 7882389 - DNA, 22 bp, Homo sapiens
aaggaaaggatgagcatgcatt

SEQ ID NO: 7882390 - DNA, 22 bp, Homo sapiens
aaggaaatacttctgcagagca

SEQ ID NO: 7882391 - DNA, 22 bp, Homo sapiens
aaggaaatacttctgcagagca

SEQ ID NO: 7882392 - DNA, 22 bp, Homo sapiens
aaggaaatacttctgcagagca

SEQ ID NO: 7882393 - DNA, 22 bp, Homo sapiens
aaggaaatagatgcagatggta

SEQ ID NO: 7882394 - DNA, 22 bp, Homo sapiens
aaggaaatagatgcagatggta

SEQ ID NO: 7882395 - DNA, 22 bp, Homo sapiens
aaggaaatagatgcagatggta

SEQ ID NO: 7882396 - DNA, 22 bp, Homo sapiens
aaggaaatacttctgcagagca

SEQ ID NO: 7882397 - DNA, 22 bp, Homo sapiens
aaggaaatacttctgcagagca

SEQ ID NO: 7882398 - DNA, 22 bp, Homo sapiens
aaggaaagattctctctctaga

SEQ ID NO: 7882399 - DNA, 22 bp, Homo sapiens
aaggaaagattctctctctaga

SEQ ID NO: 7882400 - DNA, 22 bp, Homo sapiens
aaggaaagattctctctctaga

SEQ ID NO: 7882401 - DNA, 22 bp, Homo sapiens
aaggaaagattctctctctaga

SEQ ID NO: 7882402 - DNA, 22 bp, Homo sapiens
aaggaaagattctctctctaga

SEQ ID NO: 7882403 - DNA, 22 bp, Homo sapiens
aaggaaagattctctctctaga

SEQ ID NO: 7882404 - DNA, 22 bp, Homo sapiens
aaggaaagattctctctctaga

SEQ ID NO: 7882405 - DNA, 22 bp, Homo sapiens
aaggaaaggatgagcatgcatt

SEQ ID NO: 7882406 - DNA, 22 bp, Homo sapiens
aaggaaaggatgagcatgcatt

SEQ ID NO: 7882407 - DNA, 22 bp, Homo sapiens
aaggaaaggatgagcatgcatt

SEQ ID NO: 7882408 - DNA, 22 bp, Homo sapiens
aaggaaagctgtggttctgaga

SEQ ID NO: 7882409 - DNA, 22 bp, Homo sapiens
aaggaaagctgtggttctgaga

SEQ ID NO: 7882410 - DNA, 22 bp, Homo sapiens
aaggaaagctgtggttctgaga

SEQ ID NO: 7882411 - DNA, 22 bp, Homo sapiens
aaggaaagctgtggttctgaga

SEQ ID NO: 7882412 - DNA, 22 bp, Homo sapiens
aaggaaagattctctctctaga

SEQ ID NO: 7882413 - DNA, 22 bp, Homo sapiens
aagctttaaggaattttatgga

SEQ ID NO: 7882414 - DNA, 22 bp, Homo sapiens
acaggccagaggtggggcagcc

SEQ ID NO: 7882415 - DNA, 22 bp, Homo sapiens
acaggccagaggtggggcagcc

SEQ ID NO: 7882416 - DNA, 22 bp, Homo sapiens
aagctttaagtgtcagtcagcc

SEQ ID NO: 7882417 - DNA, 22 bp, Homo sapiens
aaggaaagacaggacggaattc

SEQ ID NO: 7882418 - DNA, 22 bp, Homo sapiens
aaggaaagacatataaatgact

SEQ ID NO: 7882419 - DNA, 22 bp, Homo sapiens
aaggaaagacatataaatgact

SEQ ID NO: 7882420 - DNA, 22 bp, Homo sapiens
aaggaaagacatataaatgact

SEQ ID NO: 7882421 - DNA, 22 bp, Homo sapiens
aaggaaagacatataaatgact

SEQ ID NO: 7882422 - DNA, 22 bp, Homo sapiens
aaggaaagacatataaatgact

SEQ ID NO: 7882423 - DNA, 22 bp, Homo sapiens
aaggaaagacatataaatgact

SEQ ID NO: 7882424 - DNA, 22 bp, Homo sapiens
aaggaaagagtatgcaccttgt

SEQ ID NO: 7882425 - DNA, 22 bp, Homo sapiens
aaggaaagagtatgcaccttgt

SEQ ID NO: 7882426 - DNA, 22 bp, Homo sapiens
aaggaaagagtatgcaccttgt

SEQ ID NO: 7882427 - DNA, 22 bp, Homo sapiens
aaggaaagacatataaatgact

SEQ ID NO: 7882428 - DNA, 22 bp, Homo sapiens
acaggcatatttctagattaca

SEQ ID NO: 7882429 - DNA, 22 bp, Homo sapiens
acaggcagttgaggtttgtgtg

SEQ ID NO: 7882430 - DNA, 22 bp, Homo sapiens
acaggcatccaggactaggcct

SEQ ID NO: 7882431 - DNA, 22 bp, Homo sapiens
acaggcatatttctagattaca

SEQ ID NO: 7882432 - DNA, 22 bp, Homo sapiens
acaggcatccaggactaggcct

SEQ ID NO: 7882433 - DNA, 22 bp, Homo sapiens
acaggcatccaggactaggcct

SEQ ID NO: 7882434 - DNA, 22 bp, Homo sapiens
acaggccacagtggagtctctg

SEQ ID NO: 7882435 - DNA, 22 bp, Homo sapiens
acaggccacagtggagtctctg

SEQ ID NO: 7882436 - DNA, 22 bp, Homo sapiens
acaggccacagtggagtctctg

SEQ ID NO: 7882437 - DNA, 22 bp, Homo sapiens
acaggcagttgaggtttgtgtg

SEQ ID NO: 7882438 - DNA, 22 bp, Homo sapiens
acaggcagttgaggtttgtgtg

SEQ ID NO: 7882439 - DNA, 22 bp, Homo sapiens
acaggcagttgaggtttgtgtg

SEQ ID NO: 7882440 - DNA, 22 bp, Homo sapiens
acaggcagttgaggtttgtgtg

SEQ ID NO: 7882441 - DNA, 22 bp, Homo sapiens
acaggcagttgaggtttgtgtg

SEQ ID NO: 7882442 - DNA, 22 bp, Homo sapiens
acaggcagttgaggtttgtgtg

SEQ ID NO: 7882443 - DNA, 22 bp, Homo sapiens
acaggcagtgggccagatttgt

SEQ ID NO: 7882444 - DNA, 22 bp, Homo sapiens
acaggcagtgggccagatttgt

SEQ ID NO: 7882445 - DNA, 22 bp, Homo sapiens
acaggcagtgggccagatttgt

SEQ ID NO: 7882446 - DNA, 22 bp, Homo sapiens
acaggtgtggggctgtggtact

SEQ ID NO: 7882447 - DNA, 22 bp, Homo sapiens
acagggcttagaacttggcctc

SEQ ID NO: 7882448 - DNA, 22 bp, Homo sapiens
acagtacagctgaaactttagt

SEQ ID NO: 7882449 - DNA, 22 bp, Homo sapiens
acaggtgtggggctgtggtact

SEQ ID NO: 7882450 - DNA, 22 bp, Homo sapiens
acaggtgtgttcccggaaagcc

SEQ ID NO: 7882451 - DNA, 23 bp, Homo sapiens
acagggctgtccagggctaggtc

SEQ ID NO: 7882452 - DNA, 23 bp, Homo sapiens
acagggctgtccagggctaggtc

SEQ ID NO: 7882453 - DNA, 23 bp, Homo sapiens
acagggctgtccagggctaggtc

SEQ ID NO: 7882454 - DNA, 22 bp, Homo sapiens
acagggcttagaacttggcctc

SEQ ID NO: 7882455 - DNA, 22 bp, Homo sapiens
acagtacagtgcagaggaagat

SEQ ID NO: 7882456 - DNA, 22 bp, Homo sapiens
acagtacagctgaaactttagt

SEQ ID NO: 7882457 - DNA, 22 bp, Homo sapiens
acagtactctaatgaaaagtgc

SEQ ID NO: 7882458 - DNA, 22 bp, Homo sapiens
acagtacctgctctcaagcaaa

SEQ ID NO: 7882459 - DNA, 22 bp, Homo sapiens
acagtaccaggccaaaccatga

SEQ ID NO: 7882460 - DNA, 22 bp, Homo sapiens
acagggctctgacaccaaggta

SEQ ID NO: 7882461 - DNA, 19 bp, Homo sapiens
acagggctctggacgccat

SEQ ID NO: 7882462 - DNA, 22 bp, Homo sapiens
acagggctcgtcgggccctcgg

SEQ ID NO: 7882463 - DNA, 22 bp, Homo sapiens
acagggctcgtcgggccctcgg

SEQ ID NO: 7882464 - DNA, 22 bp, Homo sapiens
acagggctcgtcgggccctcgg

SEQ ID NO: 7882465 - DNA, 22 bp, Homo sapiens
acagggctccttgggctgacac

SEQ ID NO: 7882466 - DNA, 22 bp, Homo sapiens
aaggaaatctttgtaacatctt

SEQ ID NO: 7882467 - DNA, 22 bp, Homo sapiens
acagggctccttgggctgacac

SEQ ID NO: 7882468 - DNA, 22 bp, Homo sapiens
acagggctccttgggctgacac

SEQ ID NO: 7882469 - DNA, 22 bp, Homo sapiens
acagggctccttgggctgacac

SEQ ID NO: 7882470 - DNA, 22 bp, Homo sapiens
acagggctcctaggtggtgtgc

SEQ ID NO: 7882471 - DNA, 22 bp, Homo sapiens
acagggctggcgttgggacaga

SEQ ID NO: 7882472 - DNA, 22 bp, Homo sapiens
acagggctggcgttgggacaga

SEQ ID NO: 7882473 - DNA, 22 bp, Homo sapiens
acagggctggcgttgggacaga

SEQ ID NO: 7882474 - DNA, 22 bp, Homo sapiens
acagggctggggcacttggctg

SEQ ID NO: 7882475 - DNA, 22 bp, Homo sapiens
acagggctggggaaagaggcta

SEQ ID NO: 7882476 - DNA, 23 bp, Homo sapiens
acagggctggcagctgcaagacc

SEQ ID NO: 7882477 - DNA, 23 bp, Homo sapiens
acagggctggcagctgcaagacc

SEQ ID NO: 7882478 - DNA, 23 bp, Homo sapiens
acagggctggcagctgcaagacc

SEQ ID NO: 7882479 - DNA, 19 bp, Homo sapiens
acagggctctggacgccat

SEQ ID NO: 7882480 - DNA, 22 bp, Homo sapiens
acagggctgaggctggcttctt

SEQ ID NO: 7882481 - DNA, 22 bp, Homo sapiens
acagggctgaggctggcttctt

SEQ ID NO: 7882482 - DNA, 22 bp, Homo sapiens
acaggcagtgatttcctctggt

SEQ ID NO: 7882483 - DNA, 22 bp, Homo sapiens
acaggcagtgatttcctctggt

SEQ ID NO: 7882484 - DNA, 22 bp, Homo sapiens
acaggcagtgatttcctctggt

SEQ ID NO: 7882485 - DNA, 22 bp, Homo sapiens
acaggcagtgatttcctctggt

SEQ ID NO: 7882486 - DNA, 22 bp, Homo sapiens
acaggcagtgggccagatttgt

SEQ ID NO: 7882487 - DNA, 22 bp, Homo sapiens
acaggcagtgggccagatttgt

SEQ ID NO: 7882488 - DNA, 22 bp, Homo sapiens
acaggcagtgggccagatttgt

SEQ ID NO: 7882489 - DNA, 22 bp, Homo sapiens
acaggcagtgggccagatttgt

SEQ ID NO: 7882490 - DNA, 22 bp, Homo sapiens
acaggcagtgatttcctctggt

SEQ ID NO: 7882491 - DNA, 22 bp, Homo sapiens
acaggcagtgggccagatttgt

SEQ ID NO: 7882492 - DNA, 22 bp, Homo sapiens
acaggcagtgggccagatttgt

SEQ ID NO: 7882493 - DNA, 22 bp, Homo sapiens
acaggcagtgatttcctctggt

SEQ ID NO: 7882494 - DNA, 22 bp, Homo sapiens
acaggcagtgatttcctctggt

SEQ ID NO: 7882495 - DNA, 22 bp, Homo sapiens
acaggcagtgatttcctctggt

SEQ ID NO: 7882496 - DNA, 22 bp, Homo sapiens
acaggcagtgatttcctctggt

SEQ ID NO: 7882497 - DNA, 22 bp, Homo sapiens
acaggcagtgatttcctctggt

SEQ ID NO: 7882498 - DNA, 22 bp, Homo sapiens
acaggcaggttgagaaacattt

SEQ ID NO: 7882499 - DNA, 22 bp, Homo sapiens
acaggcaggttgagaaacattt

SEQ ID NO: 7882500 - DNA, 22 bp, Homo sapiens
acaggcaggttgagaaacattt

SEQ ID NO: 7882501 - DNA, 22 bp, Homo sapiens
acaggcaggttgagaaacattt

SEQ ID NO: 7882502 - DNA, 22 bp, Homo sapiens
acaggcaggtcctgtcccagct

SEQ ID NO: 7882503 - DNA, 22 bp, Homo sapiens
acaggcaggttgagaaacattt

SEQ ID NO: 7882504 - DNA, 22 bp, Homo sapiens
acaggcaggtcctgtcccagct

SEQ ID NO: 7882505 - DNA, 22 bp, Homo sapiens
acaggcaggtcctgtcccagct

SEQ ID NO: 7882506 - DNA, 22 bp, Homo sapiens
acaggcaggtcctgtcccagct

SEQ ID NO: 7882507 - DNA, 22 bp, Homo sapiens
acaggcaggtcctgtcccagct

SEQ ID NO: 7882508 - DNA, 18 bp, Homo sapiens
aagctgccctcaggcagg

SEQ ID NO: 7882509 - DNA, 22 bp, Homo sapiens
acaggcaggtcctgtcccagct

SEQ ID NO: 7882510 - DNA, 22 bp, Homo sapiens
acaggcaggtcctgtcccagct

SEQ ID NO: 7882511 - DNA, 22 bp, Homo sapiens
acaggcaggtcctgtcccagct

SEQ ID NO: 7882512 - DNA, 22 bp, Homo sapiens
aagctgcccaagactgaagcat

SEQ ID NO: 7882513 - DNA, 22 bp, Homo sapiens
aagctgcccaagactgaagcat

SEQ ID NO: 7882514 - DNA, 22 bp, Homo sapiens
aagctgccatagaacgagaggt

SEQ ID NO: 7882515 - DNA, 23 bp, Homo sapiens
aagctgccagtctgaagcctggg

SEQ ID NO: 7882516 - DNA, 22 bp, Homo sapiens
aagctgcaaggaagtgtgccag

SEQ ID NO: 7882517 - DNA, 22 bp, Homo sapiens
aagctgcagaccccctgtctca

SEQ ID NO: 7882518 - DNA, 22 bp, Homo sapiens
aagctgcactacttgagggacc

SEQ ID NO: 7882519 - DNA, 22 bp, Homo sapiens
aagctgcagaccccctgtctca

SEQ ID NO: 7882520 - DNA, 22 bp, Homo sapiens
aagctgcaggttgaatccaggt

SEQ ID NO: 7882521 - DNA, 22 bp, Homo sapiens
aagctgcatgaagttgagtaga

SEQ ID NO: 7882522 - DNA, 22 bp, Homo sapiens
aagctgcagatgtgcctgtgga

SEQ ID NO: 7882523 - DNA, 22 bp, Homo sapiens
aagctgcagcacagagaggtgg

SEQ ID NO: 7882524 - DNA, 22 bp, Homo sapiens
aagctgccagctgagctgaggc

SEQ ID NO: 7882525 - DNA, 22 bp, Homo sapiens
aagctgccagctgagctgaggc

SEQ ID NO: 7882526 - DNA, 22 bp, Homo sapiens
aagctgccagctgagctgaggc

SEQ ID NO: 7882527 - DNA, 22 bp, Homo sapiens
aagctgccagattcagtctgct

SEQ ID NO: 7882528 - DNA, 22 bp, Homo sapiens
aagctgccacacggtgagtact

SEQ ID NO: 7882529 - DNA, 22 bp, Homo sapiens
aagctgccacacggtgagtact

SEQ ID NO: 7882530 - DNA, 22 bp, Homo sapiens
aagctgccaccagcccagggca

SEQ ID NO: 7882531 - DNA, 22 bp, Homo sapiens
aagctgccaatggtaagctgct

SEQ ID NO: 7882532 - DNA, 22 bp, Homo sapiens
aagctgccaatggtaagctgct

SEQ ID NO: 7882533 - DNA, 18 bp, Homo sapiens
aagccaggtcaagataag

SEQ ID NO: 7882534 - DNA, 18 bp, Homo sapiens
aagccaggtcaagataag

SEQ ID NO: 7882535 - DNA, 22 bp, Homo sapiens
aagccaggtgtgcccaggatcc

SEQ ID NO: 7882536 - DNA, 18 bp, Homo sapiens
aagccaggtcaagataag

SEQ ID NO: 7882537 - DNA, 22 bp, Homo sapiens
aagccagggtttgtggatctat

SEQ ID NO: 7882538 - DNA, 22 bp, Homo sapiens
aagccagggtttgtggatctat

SEQ ID NO: 7882539 - DNA, 22 bp, Homo sapiens
aagccagggtttgtggatctat

SEQ ID NO: 7882540 - DNA, 18 bp, Homo sapiens
aagccaggtcaagataag

SEQ ID NO: 7882541 - DNA, 22 bp, Homo sapiens
aagccagggtttgtggatctat

SEQ ID NO: 7882542 - DNA, 22 bp, Homo sapiens
aagccaggtgttgtggtaagag

SEQ ID NO: 7882543 - DNA, 22 bp, Homo sapiens
aagccaggtgttgtggtaagag

SEQ ID NO: 7882544 - DNA, 22 bp, Homo sapiens
aagccaggtgtttaggccagcg

SEQ ID NO: 7882545 - DNA, 22 bp, Homo sapiens
aagccaggtgttgtggtaagag

SEQ ID NO: 7882546 - DNA, 22 bp, Homo sapiens
aagccaggtgttgtggtaagag

SEQ ID NO: 7882547 - DNA, 22 bp, Homo sapiens
aagccaggtgtgcccaggatcc

SEQ ID NO: 7882548 - DNA, 22 bp, Homo sapiens
aagccaggtgtgcccaggatcc

SEQ ID NO: 7882549 - DNA, 22 bp, Homo sapiens
aagccaggtgttgtggtaagag

SEQ ID NO: 7882550 - DNA, 22 bp, Homo sapiens
aagccaggtgttgtggtaagag

SEQ ID NO: 7882551 - DNA, 22 bp, Homo sapiens
aagccaggtgtttaggccagcg

SEQ ID NO: 7882552 - DNA, 22 bp, Homo sapiens
aagccaggtgtttaggccagcg

SEQ ID NO: 7882553 - DNA, 22 bp, Homo sapiens
aagccaggtgtttaggccagcg

SEQ ID NO: 7882554 - DNA, 22 bp, Homo sapiens
aagccaggtgtttaggccagcg

SEQ ID NO: 7882555 - DNA, 22 bp, Homo sapiens
aagccaggtgtttaggccagcg

SEQ ID NO: 7882556 - DNA, 22 bp, Homo sapiens
aagccaggttccatggaggagc

SEQ ID NO: 7882557 - DNA, 22 bp, Homo sapiens
aagccaggtgtttaggccagcg

SEQ ID NO: 7882558 - DNA, 22 bp, Homo sapiens
aagccaggtgtttaggccagcg

SEQ ID NO: 7882559 - DNA, 22 bp, Homo sapiens
aagccaggtgtttaggccagcg

SEQ ID NO: 7882560 - DNA, 22 bp, Homo sapiens
aagctgcaaaaaatttctgtct

SEQ ID NO: 7882561 - DNA, 22 bp, Homo sapiens
aagctcttcttgccaccattca

SEQ ID NO: 7882562 - DNA, 22 bp, Homo sapiens
aagctcttctgtggatttgagt

SEQ ID NO: 7882563 - DNA, 22 bp, Homo sapiens
aagctcttctgtggatttgagt

SEQ ID NO: 7882564 - DNA, 22 bp, Homo sapiens
aagccagggatggaatgatagg

SEQ ID NO: 7882565 - DNA, 22 bp, Homo sapiens
aagccagggatggaatgatagg

SEQ ID NO: 7882566 - DNA, 22 bp, Homo sapiens
aagccaggctgcacttgctggg

SEQ ID NO: 7882567 - DNA, 22 bp, Homo sapiens
aagccaggctgcacttgctggg

SEQ ID NO: 7882568 - DNA, 22 bp, Homo sapiens
aagccaggctgcacttgctggg

SEQ ID NO: 7882569 - DNA, 22 bp, Homo sapiens
aagccagggattcctgagggag

SEQ ID NO: 7882570 - DNA, 22 bp, Homo sapiens
aagccagggattcctgagggag

SEQ ID NO: 7882571 - DNA, 22 bp, Homo sapiens
aagccagggatggaatgatagg

SEQ ID NO: 7882572 - DNA, 22 bp, Homo sapiens
aagccaggccattctctggttc

SEQ ID NO: 7882573 - DNA, 22 bp, Homo sapiens
aagccaggcatgcttggacagt

SEQ ID NO: 7882574 - DNA, 22 bp, Homo sapiens
aagccaggccattctctggttc

SEQ ID NO: 7882575 - DNA, 22 bp, Homo sapiens
aagccaggccattctctggttc

SEQ ID NO: 7882576 - DNA, 22 bp, Homo sapiens
aagccaggctgcacttgctggg

SEQ ID NO: 7882577 - DNA, 22 bp, Homo sapiens
aagccaggataaagttgtttta

SEQ ID NO: 7882578 - DNA, 22 bp, Homo sapiens
aagccaggccattctctggttc

SEQ ID NO: 7882579 - DNA, 22 bp, Homo sapiens
aagccaggctgcacttgctggg

SEQ ID NO: 7882580 - DNA, 22 bp, Homo sapiens
aagccagggtcaggggcctcct

SEQ ID NO: 7882581 - DNA, 22 bp, Homo sapiens
aagccagggtcaggggcctcct

SEQ ID NO: 7882582 - DNA, 22 bp, Homo sapiens
aagccagggtcaggggcctcct

SEQ ID NO: 7882583 - DNA, 22 bp, Homo sapiens
aagccaggggttggtatgctat

SEQ ID NO: 7882584 - DNA, 22 bp, Homo sapiens
aagccagggtcagaatttgggc

SEQ ID NO: 7882585 - DNA, 22 bp, Homo sapiens
aagccaggggttggtatgctat

SEQ ID NO: 7882586 - DNA, 22 bp, Homo sapiens
aagccagggtcaggggcctcct

SEQ ID NO: 7882587 - DNA, 22 bp, Homo sapiens
aagccaggggttggtatgctat

SEQ ID NO: 7882588 - DNA, 22 bp, Homo sapiens
aagccagggtcagaatttgggc

SEQ ID NO: 7882589 - DNA, 22 bp, Homo sapiens
aagccagggtcagaatttgggc

SEQ ID NO: 7882590 - DNA, 22 bp, Homo sapiens
aagccaggggttggtatgctat

SEQ ID NO: 7882591 - DNA, 22 bp, Homo sapiens
aagccaggggctgcttaggaga

SEQ ID NO: 7882592 - DNA, 22 bp, Homo sapiens
aagccaggggttggtatgctat

SEQ ID NO: 7882593 - DNA, 22 bp, Homo sapiens
aagccaggggctgcttaggaga

SEQ ID NO: 7882594 - DNA, 22 bp, Homo sapiens
aagccagggattcctgagggag

SEQ ID NO: 7882595 - DNA, 22 bp, Homo sapiens
aagccagggattcctgagggag

SEQ ID NO: 7882596 - DNA, 22 bp, Homo sapiens
aagccagggattcctgagggag

SEQ ID NO: 7882597 - DNA, 21 bp, Homo sapiens
aataattcagacattgttgtt

SEQ ID NO: 7882598 - DNA, 22 bp, Homo sapiens
aataatttccagccaactggaa

SEQ ID NO: 7882599 - DNA, 22 bp, Homo sapiens
aataatttccagccaactggaa

SEQ ID NO: 7882600 - DNA, 22 bp, Homo sapiens
aataatttccagccaactggaa

SEQ ID NO: 7882601 - DNA, 22 bp, Homo sapiens
aataatttccagccaactggaa

SEQ ID NO: 7882602 - DNA, 22 bp, Homo sapiens
aataattatttgagagcagacc

SEQ ID NO: 7882603 - DNA, 22 bp, Homo sapiens
aataattatttgagagcagacc

SEQ ID NO: 7882604 - DNA, 22 bp, Homo sapiens
aataattatttgagagcagacc

SEQ ID NO: 7882605 - DNA, 22 bp, Homo sapiens
aataattatttgagagcagacc

SEQ ID NO: 7882606 - DNA, 22 bp, Homo sapiens
aataattatttgagagcagacc

SEQ ID NO: 7882607 - DNA, 22 bp, Homo sapiens
aataattatttgagagcagacc

SEQ ID NO: 7882608 - DNA, 22 bp, Homo sapiens
aataattagtgggacagagaac

SEQ ID NO: 7882609 - DNA, 22 bp, Homo sapiens
aataattttagctcagagttgt

SEQ ID NO: 7882610 - DNA, 22 bp, Homo sapiens
aataattttagctcagagttgt

SEQ ID NO: 7882611 - DNA, 22 bp, Homo sapiens
aataattttagctcagagttgt

SEQ ID NO: 7882612 - DNA, 22 bp, Homo sapiens
aataattttagctcagagttgt

SEQ ID NO: 7882613 - DNA, 22 bp, Homo sapiens
aatacaagatttatagttgttt

SEQ ID NO: 7882614 - DNA, 22 bp, Homo sapiens
aatacaagatttatagttgttt

SEQ ID NO: 7882615 - DNA, 22 bp, Homo sapiens
aatacaagatttatagttgttt

SEQ ID NO: 7882616 - DNA, 22 bp, Homo sapiens
aatacaagatttatagttgttt

SEQ ID NO: 7882617 - DNA, 22 bp, Homo sapiens
aatacaatcaaattcactagca

SEQ ID NO: 7882618 - DNA, 22 bp, Homo sapiens
aatacaatcaaattcactagca

SEQ ID NO: 7882619 - DNA, 22 bp, Homo sapiens
aataattttgagagcctggaaa

SEQ ID NO: 7882620 - DNA, 22 bp, Homo sapiens
aataattttgagagcctggaaa

SEQ ID NO: 7882621 - DNA, 19 bp, Homo sapiens
aataatgttcatgagattg

SEQ ID NO: 7882622 - DNA, 22 bp, Homo sapiens
aataatgttatgtcattcttct

SEQ ID NO: 7882623 - DNA, 22 bp, Homo sapiens
aataatgtgtgctgcagtctta

SEQ ID NO: 7882624 - DNA, 22 bp, Homo sapiens
aataatgttgacgatagtctta

SEQ ID NO: 7882625 - DNA, 22 bp, Homo sapiens
aataatgtttatttgtattctc

SEQ ID NO: 7882626 - DNA, 22 bp, Homo sapiens
aataatgttgacgatagtctta

SEQ ID NO: 7882627 - DNA, 22 bp, Homo sapiens
aataatgttgacgatagtctta

SEQ ID NO: 7882628 - DNA, 22 bp, Homo sapiens
aataattagtgggacagagaac

SEQ ID NO: 7882629 - DNA, 22 bp, Homo sapiens
aataattagtgggacagagaac

SEQ ID NO: 7882630 - DNA, 22 bp, Homo sapiens
aataattagtgggacagagaac

SEQ ID NO: 7882631 - DNA, 22 bp, Homo sapiens
aataattagtgggacagagaac

SEQ ID NO: 7882632 - DNA, 22 bp, Homo sapiens
aataattagtgggacagagaac

SEQ ID NO: 7882633 - DNA, 22 bp, Homo sapiens
aataattagtgggacagagaac

SEQ ID NO: 7882634 - DNA, 22 bp, Homo sapiens
aataattagtgggacagagaac

SEQ ID NO: 7882635 - DNA, 22 bp, Homo sapiens
aataattacccatctttttgta

SEQ ID NO: 7882636 - DNA, 22 bp, Homo sapiens
aataatgtttatttgtattctc

SEQ ID NO: 7882637 - DNA, 22 bp, Homo sapiens
aataattacccatctttttgta

SEQ ID NO: 7882638 - DNA, 22 bp, Homo sapiens
aataattacccatctttttgta

SEQ ID NO: 7882639 - DNA, 22 bp, Homo sapiens
aataagattgacacaagtacct

SEQ ID NO: 7882640 - DNA, 22 bp, Homo sapiens
aataagattgacacaagtacct

SEQ ID NO: 7882641 - DNA, 22 bp, Homo sapiens
aataagcaagcctgtgtgcaag

SEQ ID NO: 7882642 - DNA, 23 bp, Homo sapiens
actgcctgtgccgatctctctca

SEQ ID NO: 7882643 - DNA, 22 bp, Homo sapiens
actgcctgtgtcccttcagtgc

SEQ ID NO: 7882644 - DNA, 22 bp, Homo sapiens
actgcctgtgtcccttcagtgc

SEQ ID NO: 7882645 - DNA, 22 bp, Homo sapiens
actgcctgtgtcccttcagtgc

SEQ ID NO: 7882646 - DNA, 22 bp, Homo sapiens
actgcctgtgtcccttcagtgc

SEQ ID NO: 7882647 - DNA, 22 bp, Homo sapiens
actgcctgtttggcatggcccc

SEQ ID NO: 7882648 - DNA, 22 bp, Homo sapiens
actgccttagaacaaagcagga

SEQ ID NO: 7882649 - DNA, 22 bp, Homo sapiens
aataagattgacacaagtacct

SEQ ID NO: 7882650 - DNA, 22 bp, Homo sapiens
aataagattgacacaagtacct

SEQ ID NO: 7882651 - DNA, 22 bp, Homo sapiens
aataagattgacacaagtacct

SEQ ID NO: 7882652 - DNA, 22 bp, Homo sapiens
aataagattactggttgtctga

SEQ ID NO: 7882653 - DNA, 22 bp, Homo sapiens
aataagattactggttgtctga

SEQ ID NO: 7882654 - DNA, 22 bp, Homo sapiens
aataagattgacacaagtacct

SEQ ID NO: 7882655 - DNA, 22 bp, Homo sapiens
aataagatgtgcttgagtttgg

SEQ ID NO: 7882656 - DNA, 22 bp, Homo sapiens
aataagatgtgcttgagtttgg

SEQ ID NO: 7882657 - DNA, 22 bp, Homo sapiens
aataagatgtgcttgagtttgg

SEQ ID NO: 7882658 - DNA, 22 bp, Homo sapiens
aataagatcttaaaggttatat

SEQ ID NO: 7882659 - DNA, 22 bp, Homo sapiens
aataagatcttaaaggttatat

SEQ ID NO: 7882660 - DNA, 22 bp, Homo sapiens
aataagatcctgaagatatgtt

SEQ ID NO: 7882661 - DNA, 22 bp, Homo sapiens
aataagatcttaaaggttatat

SEQ ID NO: 7882662 - DNA, 22 bp, Homo sapiens
aataagatcttaaaggttatat

SEQ ID NO: 7882663 - DNA, 22 bp, Homo sapiens
aataatagttgcaaagtgttta

SEQ ID NO: 7882664 - DNA, 22 bp, Homo sapiens
aataatattcctctgtgtgcgt

SEQ ID NO: 7882665 - DNA, 22 bp, Homo sapiens
aataatagttgcaaagtgttta

SEQ ID NO: 7882666 - DNA, 22 bp, Homo sapiens
aataatagttgcaaagtgttta

SEQ ID NO: 7882667 - DNA, 22 bp, Homo sapiens
actgcgctccagcctgggtgac

SEQ ID NO: 7882668 - DNA, 22 bp, Homo sapiens
actgcgctccagcctgggtgac

SEQ ID NO: 7882669 - DNA, 22 bp, Homo sapiens
actgcgctccagcctgggtgac

SEQ ID NO: 7882670 - DNA, 22 bp, Homo sapiens
actgcgctccagcctgggtgac

SEQ ID NO: 7882671 - DNA, 22 bp, Homo sapiens
actgcgctccagcctgggtgac

SEQ ID NO: 7882672 - DNA, 22 bp, Homo sapiens
aataatagttgcaaagtgttta

SEQ ID NO: 7882673 - DNA, 22 bp, Homo sapiens
actgcgctccagcctgggtgac

SEQ ID NO: 7882674 - DNA, 22 bp, Homo sapiens
actgcgctccagcctgggtgac

SEQ ID NO: 7882675 - DNA, 22 bp, Homo sapiens
actgccttttccattacttaat

SEQ ID NO: 7882676 - DNA, 22 bp, Homo sapiens
actgccttttccattacttaat

SEQ ID NO: 7882677 - DNA, 20 bp, Homo sapiens
actgcctttaggtatccttg

SEQ ID NO: 7882678 - DNA, 22 bp, Homo sapiens
actgccttgtctcttgcctgtt

SEQ ID NO: 7882679 - DNA, 22 bp, Homo sapiens
actgccttgattgccagtttcc

SEQ ID NO: 7882680 - DNA, 20 bp, Homo sapiens
actgccttggttcagtaggt

SEQ ID NO: 7882681 - DNA, 22 bp, Homo sapiens
actgccttatatgctgtgtgtg

SEQ ID NO: 7882682 - DNA, 22 bp, Homo sapiens
actgccttataatatgtcaaca

SEQ ID NO: 7882683 - DNA, 22 bp, Homo sapiens
actgccttcaaacagcgccacc

SEQ ID NO: 7882684 - DNA, 22 bp, Homo sapiens
actgccttcaaacagcgccacc

SEQ ID NO: 7882685 - DNA, 22 bp, Homo sapiens
actgccttccacctatggatga

SEQ ID NO: 7882686 - DNA, 22 bp, Homo sapiens
actgccttcatgcagacccctg

SEQ ID NO: 7882687 - DNA, 22 bp, Homo sapiens
actgccttgattcatgctgatg

SEQ ID NO: 7882688 - DNA, 22 bp, Homo sapiens
actgccttctttaatcctagtt

SEQ ID NO: 7882689 - DNA, 22 bp, Homo sapiens
actgccttgaaagattgttgag

SEQ ID NO: 7882690 - DNA, 22 bp, Homo sapiens
actgccttctgctcagggttca

SEQ ID NO: 7882691 - DNA, 22 bp, Homo sapiens
actgccttccacctatggatga

SEQ ID NO: 7882692 - DNA, 22 bp, Homo sapiens
actgccttcttggccttcaaaa

SEQ ID NO: 7882693 - DNA, 22 bp, Homo sapiens
aagtttcatgacttggttatta

SEQ ID NO: 7882694 - DNA, 22 bp, Homo sapiens
aagtttcatgacttggttatta

SEQ ID NO: 7882695 - DNA, 22 bp, Homo sapiens
aagtttcaaatgttgattatgc

SEQ ID NO: 7882696 - DNA, 22 bp, Homo sapiens
aagtttcaaatgttgattatgc

SEQ ID NO: 7882697 - DNA, 22 bp, Homo sapiens
aagtttcaaatgttgattatgc

SEQ ID NO: 7882698 - DNA, 22 bp, Homo sapiens
aagtttcatgatgtaattattg

SEQ ID NO: 7882699 - DNA, 22 bp, Homo sapiens
aagtttcatgatgtaattattg

SEQ ID NO: 7882700 - DNA, 22 bp, Homo sapiens
aagtttcatgatgtaattattg

SEQ ID NO: 7882701 - DNA, 22 bp, Homo sapiens
aagtttccactggcagtccgta

SEQ ID NO: 7882702 - DNA, 22 bp, Homo sapiens
aagtttctacatctccatcata

SEQ ID NO: 7882703 - DNA, 22 bp, Homo sapiens
aagtttccactggcagtccgta

SEQ ID NO: 7882704 - DNA, 22 bp, Homo sapiens
aagtttctacatctccatcata

SEQ ID NO: 7882705 - DNA, 22 bp, Homo sapiens
aagtttctacatctccatcata

SEQ ID NO: 7882706 - DNA, 22 bp, Homo sapiens
aagtttcatgtggaggtagact

SEQ ID NO: 7882707 - DNA, 22 bp, Homo sapiens
aagtttcattgttcatgtaaca

SEQ ID NO: 7882708 - DNA, 22 bp, Homo sapiens
aagtttattaattgacttgtgc

SEQ ID NO: 7882709 - DNA, 22 bp, Homo sapiens
aagtttatgttggtaagatatc

SEQ ID NO: 7882710 - DNA, 22 bp, Homo sapiens
aagtttatgttggtaagatatc

SEQ ID NO: 7882711 - DNA, 22 bp, Homo sapiens
aagtttcaaatataaaattaca

SEQ ID NO: 7882712 - DNA, 22 bp, Homo sapiens
aagtttattaattgacttgtgc

SEQ ID NO: 7882713 - DNA, 22 bp, Homo sapiens
aataacttcagttcttacatta

SEQ ID NO: 7882714 - DNA, 22 bp, Homo sapiens
aataagaatttacttgtcaaga

SEQ ID NO: 7882715 - DNA, 22 bp, Homo sapiens
aataagaattgccagatttgaa

SEQ ID NO: 7882716 - DNA, 22 bp, Homo sapiens
aataagaattgccagatttgaa

SEQ ID NO: 7882717 - DNA, 22 bp, Homo sapiens
aataagaattgccagatttgaa

SEQ ID NO: 7882718 - DNA, 22 bp, Homo sapiens
aagtttctattattacattcgt

SEQ ID NO: 7882719 - DNA, 22 bp, Homo sapiens
aataacttaagaaatttcccca

SEQ ID NO: 7882720 - DNA, 22 bp, Homo sapiens
aataacttaagaaatttcccca

SEQ ID NO: 7882721 - DNA, 22 bp, Homo sapiens
aataacttcagttcttacatta

SEQ ID NO: 7882722 - DNA, 22 bp, Homo sapiens
aataagatcctgaagatatgtt

SEQ ID NO: 7882723 - DNA, 22 bp, Homo sapiens
aataagatcctgaagatatgtt

SEQ ID NO: 7882724 - DNA, 22 bp, Homo sapiens
aataagatcctgaagatatgtt

SEQ ID NO: 7882725 - DNA, 22 bp, Homo sapiens
aataagatcctgaagatatgtt

SEQ ID NO: 7882726 - DNA, 22 bp, Homo sapiens
aataagatcctgaagatatgtt

SEQ ID NO: 7882727 - DNA, 22 bp, Homo sapiens
aataagataagatttctgctct

SEQ ID NO: 7882728 - DNA, 22 bp, Homo sapiens
aataagagcactggctttggag

SEQ ID NO: 7882729 - DNA, 22 bp, Homo sapiens
aataagacacgctattactaga

SEQ ID NO: 7882730 - DNA, 22 bp, Homo sapiens
aataagacacgctattactaga

SEQ ID NO: 7882731 - DNA, 22 bp, Homo sapiens
aataagacacgctattactaga

SEQ ID NO: 7882732 - DNA, 22 bp, Homo sapiens
aataagaatttacttgtcaaga

SEQ ID NO: 7882733 - DNA, 22 bp, Homo sapiens
aataagaatttacttgtcaaga

SEQ ID NO: 7882734 - DNA, 22 bp, Homo sapiens
aataagacacacaactgtcaag

SEQ ID NO: 7882735 - DNA, 22 bp, Homo sapiens
aataagacacacaactgtcaag

SEQ ID NO: 7882736 - DNA, 22 bp, Homo sapiens
aagtttaacttgaattctttct

SEQ ID NO: 7882737 - DNA, 22 bp, Homo sapiens
aagtttaacttgaattctttct

SEQ ID NO: 7882738 - DNA, 22 bp, Homo sapiens
aagtttaacttgaattctttct

SEQ ID NO: 7882739 - DNA, 22 bp, Homo sapiens
aagtttaaggtggaagtggtgg

SEQ ID NO: 7882740 - DNA, 22 bp, Homo sapiens
aagtttaaggtggaagtggtgg

SEQ ID NO: 7882741 - DNA, 22 bp, Homo sapiens
aagttgtatgtcttagaaagta

SEQ ID NO: 7882742 - DNA, 21 bp, Homo sapiens
aagttgtctcttttggttcct

SEQ ID NO: 7882743 - DNA, 22 bp, Homo sapiens
aagtttaacttgaattctttct

SEQ ID NO: 7882744 - DNA, 22 bp, Homo sapiens
aagtttaacttgaattctttct

SEQ ID NO: 7882745 - DNA, 22 bp, Homo sapiens
aagttctagaggttgatttggt

SEQ ID NO: 7882746 - DNA, 22 bp, Homo sapiens
aagttggtaggagacagaaggt

SEQ ID NO: 7882747 - DNA, 20 bp, Homo sapiens
aagttggctcctcctagcaa

SEQ ID NO: 7882748 - DNA, 20 bp, Homo sapiens
aagttggctcctcctagcaa

SEQ ID NO: 7882749 - DNA, 22 bp, Homo sapiens
aagttggttctgtgacatgttg

SEQ ID NO: 7882750 - DNA, 22 bp, Homo sapiens
aagttgtagatgaagtaattca

SEQ ID NO: 7882751 - DNA, 22 bp, Homo sapiens
aagttggtgtatgagacagaag

SEQ ID NO: 7882752 - DNA, 22 bp, Homo sapiens
aagttggtaggagacagaaggt

SEQ ID NO: 7882753 - DNA, 22 bp, Homo sapiens
aagtttatgttggtaagatatc

SEQ ID NO: 7882754 - DNA, 22 bp, Homo sapiens
aagtttatgttggtaagatatc

SEQ ID NO: 7882755 - DNA, 22 bp, Homo sapiens
aagtttatgttggtaagatatc

SEQ ID NO: 7882756 - DNA, 22 bp, Homo sapiens
aagtttatgttggtaagatatc

SEQ ID NO: 7882757 - DNA, 22 bp, Homo sapiens
aagtttatgttctttgaaggca

SEQ ID NO: 7882758 - DNA, 22 bp, Homo sapiens
aagtttatgttctttgaaggca

SEQ ID NO: 7882759 - DNA, 22 bp, Homo sapiens
aagtttatgaagtctaagccaa

SEQ ID NO: 7882760 - DNA, 22 bp, Homo sapiens
aagtttatgttctttgaaggca

SEQ ID NO: 7882761 - DNA, 22 bp, Homo sapiens
aagtttatgaagtctaagccaa

SEQ ID NO: 7882762 - DNA, 22 bp, Homo sapiens
aagtttatctttgctgggtact

SEQ ID NO: 7882763 - DNA, 22 bp, Homo sapiens
aagtttatctttgctgggtact

SEQ ID NO: 7882764 - DNA, 22 bp, Homo sapiens
aagtttatccctctcacagtta

SEQ ID NO: 7882765 - DNA, 22 bp, Homo sapiens
aagtttatccctctcacagtta

SEQ ID NO: 7882766 - DNA, 22 bp, Homo sapiens
aagtttatccctctcacagtta

SEQ ID NO: 7882767 - DNA, 22 bp, Homo sapiens
aagtttagcgctctctcaagga

SEQ ID NO: 7882768 - DNA, 22 bp, Homo sapiens
aagtttacataagtgatgatga

SEQ ID NO: 7882769 - DNA, 22 bp, Homo sapiens
aagtttaaggtggaagtggtgg

SEQ ID NO: 7882770 - DNA, 22 bp, Homo sapiens
aagtgcttggattgcaggtatg

SEQ ID NO: 7882771 - DNA, 22 bp, Homo sapiens
aagtgcttggctaatggttatg

SEQ ID NO: 7882772 - DNA, 22 bp, Homo sapiens
aagtgcttggctaatggttatg

SEQ ID NO: 7882773 - DNA, 21 bp, Homo sapiens
aagtcagtcagttctatacta

SEQ ID NO: 7882774 - DNA, 22 bp, Homo sapiens
aagtgcttggctaatggttatg

SEQ ID NO: 7882775 - DNA, 22 bp, Homo sapiens
aagtgcttggctaatggttatg

SEQ ID NO: 7882776 - DNA, 22 bp, Homo sapiens
aagtgcatatttttgttgtaga

SEQ ID NO: 7882777 - DNA, 22 bp, Homo sapiens
aagtgcatacactagttaattg

SEQ ID NO: 7882778 - DNA, 22 bp, Homo sapiens
aagtcaggacttatgctacctg

SEQ ID NO: 7882779 - DNA, 22 bp, Homo sapiens
aagtcaggtgagactctctggg

SEQ ID NO: 7882780 - DNA, 22 bp, Homo sapiens
aagtgctttacaaatgtctgtt

SEQ ID NO: 7882781 - DNA, 22 bp, Homo sapiens
aagtgctttacaaatgtctgtt

SEQ ID NO: 7882782 - DNA, 22 bp, Homo sapiens
aagtgctttaaaatttcctgag

SEQ ID NO: 7882783 - DNA, 22 bp, Homo sapiens
aagtgctttaaaatttcctgag

SEQ ID NO: 7882784 - DNA, 22 bp, Homo sapiens
aagtgctttataaacaatgaag

SEQ ID NO: 7882785 - DNA, 22 bp, Homo sapiens
aagtgctttataaacaatgaag

SEQ ID NO: 7882786 - DNA, 22 bp, Homo sapiens
aagtgctttcatatagtcttaa

SEQ ID NO: 7882787 - DNA, 22 bp, Homo sapiens
aagtgctttataaacaatgaag

SEQ ID NO: 7882788 - DNA, 22 bp, Homo sapiens
aagtgctttcatatagtcttaa

SEQ ID NO: 7882789 - DNA, 22 bp, Homo sapiens
aagtgctttttcttgagctgct

SEQ ID NO: 7882790 - DNA, 22 bp, Homo sapiens
aagtgctttttcttgagctgct

SEQ ID NO: 7882791 - DNA, 23 bp, Homo sapiens
aagtgctttgggatggagtctgg

SEQ ID NO: 7882792 - DNA, 22 bp, Homo sapiens
aagtgctttttcttgagctgct

SEQ ID NO: 7882793 - DNA, 22 bp, Homo sapiens
aagtgctttttcttgagctgct

SEQ ID NO: 7882794 - DNA, 22 bp, Homo sapiens
aagtgcttttttcttgaggcca

SEQ ID NO: 7882795 - DNA, 22 bp, Homo sapiens
aagtggaaagagtgttgcaagg

SEQ ID NO: 7882796 - DNA, 22 bp, Homo sapiens
aagtgcttttttcttgaggcca

SEQ ID NO: 7882797 - DNA, 22 bp, Homo sapiens
aagtggactaatacaaggacta

SEQ ID NO: 7882798 - DNA, 22 bp, Homo sapiens
aagtggaagagaagttatctta

SEQ ID NO: 7882799 - DNA, 22 bp, Homo sapiens
aagtggaagagaagttatctta

SEQ ID NO: 7882800 - DNA, 22 bp, Homo sapiens
aagtggactaatacaaggacta

SEQ ID NO: 7882801 - DNA, 22 bp, Homo sapiens
aagtggactaatacaaggacta

SEQ ID NO: 7882802 - DNA, 21 bp, Homo sapiens
aagtggagaagaaaagctgga

SEQ ID NO: 7882803 - DNA, 22 bp, Homo sapiens
aagtggactaatacaaggacta

SEQ ID NO: 7882804 - DNA, 22 bp, Homo sapiens
aagtggactaatacaaggacta

SEQ ID NO: 7882805 - DNA, 21 bp, Homo sapiens
aagtggagaagaaaagctgga

SEQ ID NO: 7882806 - DNA, 22 bp, Homo sapiens
aagtggagagccctggaggtct

SEQ ID NO: 7882807 - DNA, 21 bp, Homo sapiens
aagtggagaagaaaagctgga

SEQ ID NO: 7882808 - DNA, 22 bp, Homo sapiens
aagtggagagccctggaggtct

SEQ ID NO: 7882809 - DNA, 22 bp, Homo sapiens
aagtggagagccctggaggtct

SEQ ID NO: 7882810 - DNA, 22 bp, Homo sapiens
aagtggagagccctggaggtct

SEQ ID NO: 7882811 - DNA, 22 bp, Homo sapiens
aagtggagccagggaaactgaa

SEQ ID NO: 7882812 - DNA, 22 bp, Homo sapiens
aagtggagctataggctcagat

SEQ ID NO: 7882813 - DNA, 22 bp, Homo sapiens
aagtggagagccctggaggtct

SEQ ID NO: 7882814 - DNA, 22 bp, Homo sapiens
actaaatggaatgattactata

SEQ ID NO: 7882815 - DNA, 22 bp, Homo sapiens
actaaatgcattggtatctatt

SEQ ID NO: 7882816 - DNA, 22 bp, Homo sapiens
actaaatgcattggtatctatt

SEQ ID NO: 7882817 - DNA, 22 bp, Homo sapiens
actaaatgagatactgtcttca

SEQ ID NO: 7882818 - DNA, 22 bp, Homo sapiens
aagtggagccagggaaactgaa

SEQ ID NO: 7882819 - DNA, 22 bp, Homo sapiens
actaaatgaactattaatactt

SEQ ID NO: 7882820 - DNA, 22 bp, Homo sapiens
actaaatttgtcaatgacactt

SEQ ID NO: 7882821 - DNA, 23 bp, Homo sapiens
actaaatggggctttgcttaaag

SEQ ID NO: 7882822 - DNA, 22 bp, Homo sapiens
actaacttctgagaaccaattg

SEQ ID NO: 7882823 - DNA, 22 bp, Homo sapiens
actaacatttgtgtatgtcttg

SEQ ID NO: 7882824 - DNA, 20 bp, Homo sapiens
actaacatttgcaaggggct

SEQ ID NO: 7882825 - DNA, 20 bp, Homo sapiens
actaacatttgcaaggggct

SEQ ID NO: 7882826 - DNA, 22 bp, Homo sapiens
aagtcactggcaaaagctgcag

SEQ ID NO: 7882827 - DNA, 22 bp, Homo sapiens
aagtcactggcaaaagctgcag

SEQ ID NO: 7882828 - DNA, 22 bp, Homo sapiens
aagtcactgtgaaaggtgaagc

SEQ ID NO: 7882829 - DNA, 22 bp, Homo sapiens
aagtcacttcttaggaaaggag

SEQ ID NO: 7882830 - DNA, 22 bp, Homo sapiens
aagtcacttgattgttgacaga

SEQ ID NO: 7882831 - DNA, 22 bp, Homo sapiens
aagtcacattctgaggtattgg

SEQ ID NO: 7882832 - DNA, 22 bp, Homo sapiens
aagtcactaagtgaaccactgg

SEQ ID NO: 7882833 - DNA, 22 bp, Homo sapiens
aagtcactggaggaactctact

SEQ ID NO: 7882834 - DNA, 22 bp, Homo sapiens
aagtcactgaaagggcagaaag

SEQ ID NO: 7882835 - DNA, 22 bp, Homo sapiens
aagtcacagctaaatagctaag

SEQ ID NO: 7882836 - DNA, 22 bp, Homo sapiens
aagtcacagctaaatagctaag

SEQ ID NO: 7882837 - DNA, 22 bp, Homo sapiens
aagtcacagagttggaagtcag

SEQ ID NO: 7882838 - DNA, 22 bp, Homo sapiens
aagtcacagagttggaagtcag

SEQ ID NO: 7882839 - DNA, 22 bp, Homo sapiens
aagtcacagctaaatagctaag

SEQ ID NO: 7882840 - DNA, 22 bp, Homo sapiens
aagtcacagctaaatagctaag

SEQ ID NO: 7882841 - DNA, 22 bp, Homo sapiens
aagtcacagagttggaagtcag

SEQ ID NO: 7882842 - DNA, 22 bp, Homo sapiens
aagtcacagaacccattgtaac

SEQ ID NO: 7882843 - DNA, 22 bp, Homo sapiens
aagtcacactagacaactgagg

SEQ ID NO: 7882844 - DNA, 22 bp, Homo sapiens
aagtcacactgctgggaactct

SEQ ID NO: 7882845 - DNA, 22 bp, Homo sapiens
aagtcagataggtgagtccaaa

SEQ ID NO: 7882846 - DNA, 23 bp, Homo sapiens
aagtcagagccaagtcaatgaga

SEQ ID NO: 7882847 - DNA, 22 bp, Homo sapiens
aagtcagataggtgagtccaaa

SEQ ID NO: 7882848 - DNA, 22 bp, Homo sapiens
aagtcagataggtgagtccaaa

SEQ ID NO: 7882849 - DNA, 22 bp, Homo sapiens
aagtcagcactccaggaagcca

SEQ ID NO: 7882850 - DNA, 22 bp, Homo sapiens
aagtcagcactccaggaagcca

SEQ ID NO: 7882851 - DNA, 22 bp, Homo sapiens
aagtcagagcaactgagacatt

SEQ ID NO: 7882852 - DNA, 22 bp, Homo sapiens
aagtcagagcaactgagacatt

SEQ ID NO: 7882853 - DNA, 22 bp, Homo sapiens
aagtcagagatcaaggtgtcta

SEQ ID NO: 7882854 - DNA, 22 bp, Homo sapiens
aagtcagagatcaaggtgtcta

SEQ ID NO: 7882855 - DNA, 22 bp, Homo sapiens
aagtcagagatgccaaagatta

SEQ ID NO: 7882856 - DNA, 22 bp, Homo sapiens
aagtcagagatgccaaagatta

SEQ ID NO: 7882857 - DNA, 22 bp, Homo sapiens
aagtcagagcaactgagacatt

SEQ ID NO: 7882858 - DNA, 22 bp, Homo sapiens
aagtcagagcaactgagacatt

SEQ ID NO: 7882859 - DNA, 22 bp, Homo sapiens
aagtcagagcaactgagacatt

SEQ ID NO: 7882860 - DNA, 22 bp, Homo sapiens
aagtcagagatcaaggtgtcta

SEQ ID NO: 7882861 - DNA, 22 bp, Homo sapiens
aagtcagagatgccaaagatta

SEQ ID NO: 7882862 - DNA, 22 bp, Homo sapiens
aagtcagagcaactgagacatt

SEQ ID NO: 7882863 - DNA, 22 bp, Homo sapiens
aagtcagaccttgttgatagct

SEQ ID NO: 7882864 - DNA, 22 bp, Homo sapiens
aagtcagaccttgttgatagct

SEQ ID NO: 7882865 - DNA, 22 bp, Homo sapiens
aagtcagacagctgagctgcct

SEQ ID NO: 7882866 - DNA, 22 bp, Homo sapiens
aagtcagacagctgagctgcct

SEQ ID NO: 7882867 - DNA, 22 bp, Homo sapiens
aagtcagaataatgtttctttt

SEQ ID NO: 7882868 - DNA, 22 bp, Homo sapiens
aagtcagacagctgagctgcct

SEQ ID NO: 7882869 - DNA, 22 bp, Homo sapiens
aagtcagaaattattcaggaat

SEQ ID NO: 7882870 - DNA, 22 bp, Homo sapiens
aagtcagaaatcatctagtgta

SEQ ID NO: 7882871 - DNA, 22 bp, Homo sapiens
aagtcagaaaacagagcaatta

SEQ ID NO: 7882872 - DNA, 22 bp, Homo sapiens
aagtcagaaatatctgccatca

SEQ ID NO: 7882873 - DNA, 22 bp, Homo sapiens
aagtcagaaatatctgccatca

SEQ ID NO: 7882874 - DNA, 22 bp, Homo sapiens
aagtcagaaatatctgccatca

SEQ ID NO: 7882875 - DNA, 22 bp, Homo sapiens
aagtcacttgattgttgacaga

SEQ ID NO: 7882876 - DNA, 22 bp, Homo sapiens
aagtcacttgattgttgacaga

SEQ ID NO: 7882877 - DNA, 22 bp, Homo sapiens
aagtcacttgattgttgacaga

SEQ ID NO: 7882878 - DNA, 22 bp, Homo sapiens
aagtcagaaaacagagcaatta

SEQ ID NO: 7882879 - DNA, 22 bp, Homo sapiens
aagtcagaaaacagagcaatta

SEQ ID NO: 7882880 - DNA, 22 bp, Homo sapiens
actccccagactgccatgctgg

SEQ ID NO: 7882881 - DNA, 22 bp, Homo sapiens
actccccagactgccatgctgg

SEQ ID NO: 7882882 - DNA, 22 bp, Homo sapiens
actccccagactgccatgctgg

SEQ ID NO: 7882883 - DNA, 23 bp, Homo sapiens
actccccagtctcttcttgccaa

SEQ ID NO: 7882884 - DNA, 22 bp, Homo sapiens
aagttctaattttgcattcagg

SEQ ID NO: 7882885 - DNA, 22 bp, Homo sapiens
actccccagactgccatgctgg

SEQ ID NO: 7882886 - DNA, 18 bp, Homo sapiens
actccccacaggctctgt

SEQ ID NO: 7882887 - DNA, 18 bp, Homo sapiens
actccccacaggctctgt

SEQ ID NO: 7882888 - DNA, 22 bp, Homo sapiens
actccccagactgccatgctgg

SEQ ID NO: 7882889 - DNA, 22 bp, Homo sapiens
actccccagactgccatgctgg

SEQ ID NO: 7882890 - DNA, 22 bp, Homo sapiens
actcccaggttgcctggcaggc

SEQ ID NO: 7882891 - DNA, 22 bp, Homo sapiens
actcccaggttgcctggcaggc

SEQ ID NO: 7882892 - DNA, 22 bp, Homo sapiens
actccccaaaactaaccatgca

SEQ ID NO: 7882893 - DNA, 22 bp, Homo sapiens
actcccaggttgcctggcaggc

SEQ ID NO: 7882894 - DNA, 22 bp, Homo sapiens
actccccaaaactaaccatgca

SEQ ID NO: 7882895 - DNA, 22 bp, Homo sapiens
actccccaaaactaaccatgca

SEQ ID NO: 7882896 - DNA, 22 bp, Homo sapiens
actccccaaaactaaccatgca

SEQ ID NO: 7882897 - DNA, 18 bp, Homo sapiens
actccccacaggctctgt

SEQ ID NO: 7882898 - DNA, 18 bp, Homo sapiens
actccccacaggctctgt

SEQ ID NO: 7882899 - DNA, 18 bp, Homo sapiens
actccccacaggctctgt

SEQ ID NO: 7882900 - DNA, 22 bp, Homo sapiens
actccaggttttttcactgaag

SEQ ID NO: 7882901 - DNA, 22 bp, Homo sapiens
actccaggttttttcactgaag

SEQ ID NO: 7882902 - DNA, 22 bp, Homo sapiens
actccaggttttttcactgaag

SEQ ID NO: 7882903 - DNA, 22 bp, Homo sapiens
actccaggttttctctcaagtt

SEQ ID NO: 7882904 - DNA, 22 bp, Homo sapiens
actccaggttttctctcaagtt

SEQ ID NO: 7882905 - DNA, 22 bp, Homo sapiens
actccatacaatggcaggctgt

SEQ ID NO: 7882906 - DNA, 22 bp, Homo sapiens
actcccagaacatgctcttctt

SEQ ID NO: 7882907 - DNA, 22 bp, Homo sapiens
actcccagaacatgctcttctt

SEQ ID NO: 7882908 - DNA, 22 bp, Homo sapiens
actcccaggttgcctggcaggc

SEQ ID NO: 7882909 - DNA, 22 bp, Homo sapiens
actcccaggttgcctggcaggc

SEQ ID NO: 7882910 - DNA, 22 bp, Homo sapiens
actcccagctcagggctttccc

SEQ ID NO: 7882911 - DNA, 20 bp, Homo sapiens
actccaggtggcatgaggac

SEQ ID NO: 7882912 - DNA, 20 bp, Homo sapiens
actccaggtggcatgaggac

SEQ ID NO: 7882913 - DNA, 22 bp, Homo sapiens
actccaggtgtgttggactcta

SEQ ID NO: 7882914 - DNA, 22 bp, Homo sapiens
actccaggtgtgttggactcta

SEQ ID NO: 7882915 - DNA, 22 bp, Homo sapiens
actccaggtaggcacattgaca

SEQ ID NO: 7882916 - DNA, 20 bp, Homo sapiens
actccaggtggcatgaggac

SEQ ID NO: 7882917 - DNA, 20 bp, Homo sapiens
actccaggtggcatgaggac

SEQ ID NO: 7882918 - DNA, 20 bp, Homo sapiens
actccaggtggcatgaggac

SEQ ID NO: 7882919 - DNA, 22 bp, Homo sapiens
aagttcaagagtgacatattag

SEQ ID NO: 7882920 - DNA, 22 bp, Homo sapiens
aagttatttcctcgtgactgaa

SEQ ID NO: 7882921 - DNA, 22 bp, Homo sapiens
aagttatttttcaagatccttt

SEQ ID NO: 7882922 - DNA, 22 bp, Homo sapiens
aagttattggtggagagcactg

SEQ ID NO: 7882923 - DNA, 22 bp, Homo sapiens
aagttattgcagcaatccaagt

SEQ ID NO: 7882924 - DNA, 22 bp, Homo sapiens
aagtgttttgtaaacagaaaag

SEQ ID NO: 7882925 - DNA, 22 bp, Homo sapiens
aagttactaaaaggattttcag

SEQ ID NO: 7882926 - DNA, 21 bp, Homo sapiens
aagttactactgtttccaaga

SEQ ID NO: 7882927 - DNA, 22 bp, Homo sapiens
aagttaccttcttcccagtgat

SEQ ID NO: 7882928 - DNA, 22 bp, Homo sapiens
aagttactatgactcttctttt

SEQ ID NO: 7882929 - DNA, 22 bp, Homo sapiens
aagttactggcaagggctgcag

SEQ ID NO: 7882930 - DNA, 22 bp, Homo sapiens
aagttactttacctctttagct

SEQ ID NO: 7882931 - DNA, 22 bp, Homo sapiens
aagttactggcaagggctgcag

SEQ ID NO: 7882932 - DNA, 22 bp, Homo sapiens
aagttactttacctctttagct

SEQ ID NO: 7882933 - DNA, 22 bp, Homo sapiens
aagttattgcagcaatccaagt

SEQ ID NO: 7882934 - DNA, 22 bp, Homo sapiens
aagttatgaaatttggacagct

SEQ ID NO: 7882935 - DNA, 22 bp, Homo sapiens
aagttatatcatctcattgacg

SEQ ID NO: 7882936 - DNA, 22 bp, Homo sapiens
aagttatcagaatgctgctttc

SEQ ID NO: 7882937 - DNA, 22 bp, Homo sapiens
aagttatatcatctcattgacg

SEQ ID NO: 7882938 - DNA, 22 bp, Homo sapiens
aagttatatcatctcattgacg

SEQ ID NO: 7882939 - DNA, 22 bp, Homo sapiens
aagttatatcatctcattgacg

SEQ ID NO: 7882940 - DNA, 22 bp, Homo sapiens
aagttatatcatctcattgacg

SEQ ID NO: 7882941 - DNA, 22 bp, Homo sapiens
aagttatatcatctcattgacg

SEQ ID NO: 7882942 - DNA, 22 bp, Homo sapiens
aagttaggagagtaaagtggta

SEQ ID NO: 7882943 - DNA, 22 bp, Homo sapiens
aagttaggttgcattggtcatc

SEQ ID NO: 7882944 - DNA, 22 bp, Homo sapiens
actaacttgctgagtgaccatg

SEQ ID NO: 7882945 - DNA, 21 bp, Homo sapiens
actaagagatctctgtctcat

SEQ ID NO: 7882946 - DNA, 22 bp, Homo sapiens
actaagcaccatgcctgttggg

SEQ ID NO: 7882947 - DNA, 22 bp, Homo sapiens
actaagatgcaggaaatgctag

SEQ ID NO: 7882948 - DNA, 20 bp, Homo sapiens
actaaggtggtagcagcagg

SEQ ID NO: 7882949 - DNA, 20 bp, Homo sapiens
actaatcatccagtcacagt

SEQ ID NO: 7882950 - DNA, 20 bp, Homo sapiens
actaatcatccagtcacagt

SEQ ID NO: 7882951 - DNA, 22 bp, Homo sapiens
actaatgattattgtcattgtg

SEQ ID NO: 7882952 - DNA, 22 bp, Homo sapiens
actaattgaaatgagactggtg

SEQ ID NO: 7882953 - DNA, 22 bp, Homo sapiens
actaagtagtttcacatataat

SEQ ID NO: 7882954 - DNA, 22 bp, Homo sapiens
actaagtagtttcacatataat

SEQ ID NO: 7882955 - DNA, 22 bp, Homo sapiens
actaagtagtttgttcctcttt

SEQ ID NO: 7882956 - DNA, 22 bp, Homo sapiens
actaagtgggacatttactagg

SEQ ID NO: 7882957 - DNA, 22 bp, Homo sapiens
actaatagagacaaacatagat

SEQ ID NO: 7882958 - DNA, 22 bp, Homo sapiens
aagtgttttggcttctgtacac

SEQ ID NO: 7882959 - DNA, 22 bp, Homo sapiens
aagtgttttggcttctgtacac

SEQ ID NO: 7882960 - DNA, 20 bp, Homo sapiens
aagtgttttgacttctgacc

SEQ ID NO: 7882961 - DNA, 22 bp, Homo sapiens
actacaaaagcactgggtatta

SEQ ID NO: 7882962 - DNA, 22 bp, Homo sapiens
actacaaaagcactgggtatta

SEQ ID NO: 7882963 - DNA, 22 bp, Homo sapiens
actacaatactcttagtaaaag

SEQ ID NO: 7882964 - DNA, 22 bp, Homo sapiens
actacaatactcttagtaaaag

SEQ ID NO: 7882965 - DNA, 22 bp, Homo sapiens
actacaatactcttagtaaaag

SEQ ID NO: 7882966 - DNA, 22 bp, Homo sapiens
actaattgctttcttgtgctga

SEQ ID NO: 7882967 - DNA, 22 bp, Homo sapiens
actaattgaaatgtcctggcca

SEQ ID NO: 7882968 - DNA, 22 bp, Homo sapiens
actaattgagtgcatgatcttt

SEQ ID NO: 7882969 - DNA, 22 bp, Homo sapiens
actacaaaagcactgggtatta

SEQ ID NO: 7882970 - DNA, 22 bp, Homo sapiens
actaattggaacactttttgcc

SEQ ID NO: 7882971 - DNA, 22 bp, Homo sapiens
actaattgtatagttgatgtaa

SEQ ID NO: 7882972 - DNA, 22 bp, Homo sapiens
agaaaaatcttggcgcttgtct

SEQ ID NO: 7882973 - DNA, 22 bp, Homo sapiens
agaaaaatcttggcgcttgtct

SEQ ID NO: 7882974 - DNA, 22 bp, Homo sapiens
agaaaaatcttggcgcttgtct

SEQ ID NO: 7882975 - DNA, 22 bp, Homo sapiens
agaaaaatcttggcgcttgtct

SEQ ID NO: 7882976 - DNA, 22 bp, Homo sapiens
agaaaaatcttggcgcttgtct

SEQ ID NO: 7882977 - DNA, 22 bp, Homo sapiens
agaaaaatcttggcgcttgtct

SEQ ID NO: 7882978 - DNA, 22 bp, Homo sapiens
agaaaacactgccccctctctc

SEQ ID NO: 7882979 - DNA, 22 bp, Homo sapiens
agaaaacactgccccctctctc

SEQ ID NO: 7882980 - DNA, 22 bp, Homo sapiens
agaaaacagaaagtcattggtg

SEQ ID NO: 7882981 - DNA, 22 bp, Homo sapiens
agaaaacagaaagtcattggtg

SEQ ID NO: 7882982 - DNA, 22 bp, Homo sapiens
agaaaacactgccccctctctc

SEQ ID NO: 7882983 - DNA, 22 bp, Homo sapiens
agaaaaatcttggcgcttgtct

SEQ ID NO: 7882984 - DNA, 22 bp, Homo sapiens
agaaaacagaaagtcattggtg

SEQ ID NO: 7882985 - DNA, 22 bp, Homo sapiens
agaaaacagaaagtcattggtg

SEQ ID NO: 7882986 - DNA, 22 bp, Homo sapiens
agaaaacagaaagtcattggtg

SEQ ID NO: 7882987 - DNA, 22 bp, Homo sapiens
agaaaacataggagacaggaaa

SEQ ID NO: 7882988 - DNA, 22 bp, Homo sapiens
agaaaacataggagacaggaaa

SEQ ID NO: 7882989 - DNA, 22 bp, Homo sapiens
agaaaacataggagacaggaaa

SEQ ID NO: 7882990 - DNA, 22 bp, Homo sapiens
agaaaacataggagacaggaaa

SEQ ID NO: 7882991 - DNA, 22 bp, Homo sapiens
agaaaacataggagacaggaaa

SEQ ID NO: 7882992 - DNA, 22 bp, Homo sapiens
agaaaacataggagacaggaaa

SEQ ID NO: 7882993 - DNA, 22 bp, Homo sapiens
agaaaacataggagacaggaaa

SEQ ID NO: 7882994 - DNA, 22 bp, Homo sapiens
agaaaacataggagacaggaaa

SEQ ID NO: 7882995 - DNA, 22 bp, Homo sapiens
agaaaacattacataggtgtgt

SEQ ID NO: 7882996 - DNA, 22 bp, Homo sapiens
agaaaactctacatctgtatgt

SEQ ID NO: 7882997 - DNA, 22 bp, Homo sapiens
agaaaactctacatctgtatgt

SEQ ID NO: 7882998 - DNA, 22 bp, Homo sapiens
agaaaacattacataggtgtgt

SEQ ID NO: 7882999 - DNA, 22 bp, Homo sapiens
agaaaacattacataggtgtgt

SEQ ID NO: 7883000 - DNA, 22 bp, Homo sapiens
agaaaacattacataggtgtgt

SEQ ID NO: 7883001 - DNA, 22 bp, Homo sapiens
agaaaacattacataggtgtgt

SEQ ID NO: 7883002 - DNA, 22 bp, Homo sapiens
agaaaactgcagagtagcctca

SEQ ID NO: 7883003 - DNA, 22 bp, Homo sapiens
agaaaactctacatctgtatgt

SEQ ID NO: 7883004 - DNA, 22 bp, Homo sapiens
aatgaaactatatttagagagg

SEQ ID NO: 7883005 - DNA, 22 bp, Homo sapiens
aatgaaactagtagaatctttg

SEQ ID NO: 7883006 - DNA, 22 bp, Homo sapiens
agaaaactggagcctggggttg

SEQ ID NO: 7883007 - DNA, 22 bp, Homo sapiens
aatgaacacagccctctacttt

SEQ ID NO: 7883008 - DNA, 22 bp, Homo sapiens
aatgaacacagccctctacttt

SEQ ID NO: 7883009 - DNA, 22 bp, Homo sapiens
aatgaacacatgtggtcagttt

SEQ ID NO: 7883010 - DNA, 22 bp, Homo sapiens
aatgaacaagagagagaacttt

SEQ ID NO: 7883011 - DNA, 22 bp, Homo sapiens
aatgaacaagagagagaacttt

SEQ ID NO: 7883012 - DNA, 22 bp, Homo sapiens
aatgaacaagagagagaacttt

SEQ ID NO: 7883013 - DNA, 22 bp, Homo sapiens
aatgaacaagagagagaacttt

SEQ ID NO: 7883014 - DNA, 22 bp, Homo sapiens
aatgaaactcgaaataatcaca

SEQ ID NO: 7883015 - DNA, 22 bp, Homo sapiens
aatgaaactcgaaataatcaca

SEQ ID NO: 7883016 - DNA, 22 bp, Homo sapiens
aatgaaactcgaaataatcaca

SEQ ID NO: 7883017 - DNA, 22 bp, Homo sapiens
aatgaacggtgtccatctgttt

SEQ ID NO: 7883018 - DNA, 22 bp, Homo sapiens
aatgaacccttcaagctctgat

SEQ ID NO: 7883019 - DNA, 22 bp, Homo sapiens
aatgaacatgggagtactaata

SEQ ID NO: 7883020 - DNA, 22 bp, Homo sapiens
aatgaacatgggagtactaata

SEQ ID NO: 7883021 - DNA, 22 bp, Homo sapiens
aatgaacatggacaagttaata

SEQ ID NO: 7883022 - DNA, 22 bp, Homo sapiens
aatgaacatgggagtactaata

SEQ ID NO: 7883023 - DNA, 22 bp, Homo sapiens
aatgaacatataaagagatctt

SEQ ID NO: 7883024 - DNA, 22 bp, Homo sapiens
aatgaacatggacaagttaata

SEQ ID NO: 7883025 - DNA, 22 bp, Homo sapiens
aatgaacatggacaagttaata

SEQ ID NO: 7883026 - DNA, 22 bp, Homo sapiens
aatgaacatggacaagttaata

SEQ ID NO: 7883027 - DNA, 22 bp, Homo sapiens
aatgaacatggacaagttaata

SEQ ID NO: 7883028 - DNA, 22 bp, Homo sapiens
aatgaacatggacaagttaata

SEQ ID NO: 7883029 - DNA, 22 bp, Homo sapiens
aatgaacatggacaagttaata

SEQ ID NO: 7883030 - DNA, 22 bp, Homo sapiens
aatgaacatggacaagttaata

SEQ ID NO: 7883031 - DNA, 22 bp, Homo sapiens
aatgaacagatacacataggca

SEQ ID NO: 7883032 - DNA, 22 bp, Homo sapiens
aatgaacagatacacataggca

SEQ ID NO: 7883033 - DNA, 22 bp, Homo sapiens
aatgaacagatacacataggca

SEQ ID NO: 7883034 - DNA, 22 bp, Homo sapiens
aatgaacaggtgaatgtcagat

SEQ ID NO: 7883035 - DNA, 22 bp, Homo sapiens
aatgaacaggtgaatgtcagat

SEQ ID NO: 7883036 - DNA, 22 bp, Homo sapiens
aatgaacaggtgaatgtcagat

SEQ ID NO: 7883037 - DNA, 22 bp, Homo sapiens
aatgaacaggtgaatgtcagat

SEQ ID NO: 7883038 - DNA, 22 bp, Homo sapiens
aatgaacatataaagagatctt

SEQ ID NO: 7883039 - DNA, 22 bp, Homo sapiens
aatgaacatataaagagatctt

SEQ ID NO: 7883040 - DNA, 22 bp, Homo sapiens
aatgaacatataaagagatctt

SEQ ID NO: 7883041 - DNA, 22 bp, Homo sapiens
agaaatactaggaatattcata

SEQ ID NO: 7883042 - DNA, 22 bp, Homo sapiens
agaaatactaggaatattcata

SEQ ID NO: 7883043 - DNA, 22 bp, Homo sapiens
agaaatactaggaatattcata

SEQ ID NO: 7883044 - DNA, 22 bp, Homo sapiens
agaaatactaggaatattcata

SEQ ID NO: 7883045 - DNA, 22 bp, Homo sapiens
agaaatactaggaatattcata

SEQ ID NO: 7883046 - DNA, 22 bp, Homo sapiens
agaaatacattctctggtgtgt

SEQ ID NO: 7883047 - DNA, 22 bp, Homo sapiens
agaaatacattctctggtgtgt

SEQ ID NO: 7883048 - DNA, 18 bp, Homo sapiens
agaaataccagtattgga

SEQ ID NO: 7883049 - DNA, 18 bp, Homo sapiens
agaaataccagtattgga

SEQ ID NO: 7883050 - DNA, 18 bp, Homo sapiens
agaaataccagtattgga

SEQ ID NO: 7883051 - DNA, 18 bp, Homo sapiens
agaaataccagtattgga

SEQ ID NO: 7883052 - DNA, 18 bp, Homo sapiens
agaaataccagtattgga

SEQ ID NO: 7883053 - DNA, 18 bp, Homo sapiens
agaaataccagtattgga

SEQ ID NO: 7883054 - DNA, 22 bp, Homo sapiens
agaaatacaaagtactaagata

SEQ ID NO: 7883055 - DNA, 22 bp, Homo sapiens
agaaatacaaagtactaagata

SEQ ID NO: 7883056 - DNA, 21 bp, Homo sapiens
agaaatacagcagggatgatc

SEQ ID NO: 7883057 - DNA, 20 bp, Homo sapiens
agaaatacatgcatgcatga

SEQ ID NO: 7883058 - DNA, 22 bp, Homo sapiens
agaaatacaaagtactaagata

SEQ ID NO: 7883059 - DNA, 21 bp, Homo sapiens
agaaatacagcagggatgatc

SEQ ID NO: 7883060 - DNA, 22 bp, Homo sapiens
agaaataagagctttccttggg

SEQ ID NO: 7883061 - DNA, 22 bp, Homo sapiens
agaaataagagctttccttggg

SEQ ID NO: 7883062 - DNA, 22 bp, Homo sapiens
agaaataatcagcttaggggca

SEQ ID NO: 7883063 - DNA, 22 bp, Homo sapiens
agaaataagagctttccttggg

SEQ ID NO: 7883064 - DNA, 22 bp, Homo sapiens
agaaataagagctttccttggg

SEQ ID NO: 7883065 - DNA, 22 bp, Homo sapiens
agaaataagagctttccttggg

SEQ ID NO: 7883066 - DNA, 23 bp, Homo sapiens
aatgaactgagaatctgtacagt

SEQ ID NO: 7883067 - DNA, 19 bp, Homo sapiens
aatgagttccatgaaaaga

SEQ ID NO: 7883068 - DNA, 20 bp, Homo sapiens
aatgagttattttgtatatg

SEQ ID NO: 7883069 - DNA, 18 bp, Homo sapiens
agaaggagctatgggcag

SEQ ID NO: 7883070 - DNA, 18 bp, Homo sapiens
agaaggagctatgggcag

SEQ ID NO: 7883071 - DNA, 18 bp, Homo sapiens
agaaggagctatgggcag

SEQ ID NO: 7883072 - DNA, 20 bp, Homo sapiens
aatgagttattttgtatatg

SEQ ID NO: 7883073 - DNA, 22 bp, Homo sapiens
aatgagtgtcacatgtggagtc

SEQ ID NO: 7883074 - DNA, 22 bp, Homo sapiens
aatgagttagatgagaaaataa

SEQ ID NO: 7883075 - DNA, 20 bp, Homo sapiens
aatgagtcctgctggatcac

SEQ ID NO: 7883076 - DNA, 22 bp, Homo sapiens
aatgagtcaaaacagcatatag

SEQ ID NO: 7883077 - DNA, 22 bp, Homo sapiens
aatgagtcaaaacagcatatag

SEQ ID NO: 7883078 - DNA, 22 bp, Homo sapiens
agaagggagagaaagttggtta

SEQ ID NO: 7883079 - DNA, 22 bp, Homo sapiens
agaagggagagaaagttggtta

SEQ ID NO: 7883080 - DNA, 21 bp, Homo sapiens
agaagggattgtggtaaagat

SEQ ID NO: 7883081 - DNA, 21 bp, Homo sapiens
agaagggattgtggtaaagat

SEQ ID NO: 7883082 - DNA, 21 bp, Homo sapiens
agaagggattgtggtaaagat

SEQ ID NO: 7883083 - DNA, 21 bp, Homo sapiens
agaagggattgtggtaaagat

SEQ ID NO: 7883084 - DNA, 22 bp, Homo sapiens
agaagggagagaaagttggtta

SEQ ID NO: 7883085 - DNA, 22 bp, Homo sapiens
agaagggagagaaagttggtta

SEQ ID NO: 7883086 - DNA, 22 bp, Homo sapiens
agaagggaactcagagatgatt

SEQ ID NO: 7883087 - DNA, 18 bp, Homo sapiens
agaaggagctatgggcag

SEQ ID NO: 7883088 - DNA, 22 bp, Homo sapiens
agaagggaactcagagatgatt

SEQ ID NO: 7883089 - DNA, 22 bp, Homo sapiens
agaagggaactcagagatgatt

SEQ ID NO: 7883090 - DNA, 22 bp, Homo sapiens
aatgagctgctgctgttccacc

SEQ ID NO: 7883091 - DNA, 21 bp, Homo sapiens
aatgaggcaaggaggaggata

SEQ ID NO: 7883092 - DNA, 21 bp, Homo sapiens
aatgaggcaaggaggaggata

SEQ ID NO: 7883093 - DNA, 23 bp, Homo sapiens
aatgaggcattgcattgattctg

SEQ ID NO: 7883094 - DNA, 20 bp, Homo sapiens
aatgaggcaatggagggcat

SEQ ID NO: 7883095 - DNA, 22 bp, Homo sapiens
aatgaggtgttgagaccagcac

SEQ ID NO: 7883096 - DNA, 22 bp, Homo sapiens
aatgagatggaattcccgccta

SEQ ID NO: 7883097 - DNA, 20 bp, Homo sapiens
aatgagatgacttagaggaa

SEQ ID NO: 7883098 - DNA, 22 bp, Homo sapiens
aatgagatggaattcccgccta

SEQ ID NO: 7883099 - DNA, 22 bp, Homo sapiens
aatgagattccaatagctcctg

SEQ ID NO: 7883100 - DNA, 22 bp, Homo sapiens
aatgagcaaatgaagacgctgt

SEQ ID NO: 7883101 - DNA, 22 bp, Homo sapiens
aatgacctgggtgtcatttcat

SEQ ID NO: 7883102 - DNA, 22 bp, Homo sapiens
aatgacctgggtgtcatttcat

SEQ ID NO: 7883103 - DNA, 22 bp, Homo sapiens
aatgacatggagcatcttttca

SEQ ID NO: 7883104 - DNA, 22 bp, Homo sapiens
aatgacctcagagcacccagaa

SEQ ID NO: 7883105 - DNA, 22 bp, Homo sapiens
aatgaatgtttgttgagtgaag

SEQ ID NO: 7883106 - DNA, 22 bp, Homo sapiens
aatgaatgtttgttgagtgaag

SEQ ID NO: 7883107 - DNA, 22 bp, Homo sapiens
aatgacatggagcatcttttca

SEQ ID NO: 7883108 - DNA, 22 bp, Homo sapiens
aatgacatggagcatcttttca

SEQ ID NO: 7883109 - DNA, 22 bp, Homo sapiens
aatgactctgctgcagagacac

SEQ ID NO: 7883110 - DNA, 19 bp, Homo sapiens
aatgactgagtacattgtc

SEQ ID NO: 7883111 - DNA, 22 bp, Homo sapiens
aatgactgaagcaattgcagtg

SEQ ID NO: 7883112 - DNA, 22 bp, Homo sapiens
aatgactgaagcaattgcagtg

SEQ ID NO: 7883113 - DNA, 22 bp, Homo sapiens
agaaatactgcctaagactgta

SEQ ID NO: 7883114 - DNA, 22 bp, Homo sapiens
agaaatactgcctaagactgta

SEQ ID NO: 7883115 - DNA, 22 bp, Homo sapiens
agaaatactgcctaagactgta

SEQ ID NO: 7883116 - DNA, 22 bp, Homo sapiens
agaaatactgcctaagactgta

SEQ ID NO: 7883117 - DNA, 22 bp, Homo sapiens
agaaatactgcctaagactgta

SEQ ID NO: 7883118 - DNA, 22 bp, Homo sapiens
agaaatactgtgagagcagcct

SEQ ID NO: 7883119 - DNA, 22 bp, Homo sapiens
agaaatactgtgagagcagcct

SEQ ID NO: 7883120 - DNA, 22 bp, Homo sapiens
agaaatactgtgagagcagcct

SEQ ID NO: 7883121 - DNA, 22 bp, Homo sapiens
agaaatactttgtaaatctcac

SEQ ID NO: 7883122 - DNA, 20 bp, Homo sapiens
agaaatactttggtataatg

SEQ ID NO: 7883123 - DNA, 20 bp, Homo sapiens
agaaatactttggtataatg

SEQ ID NO: 7883124 - DNA, 22 bp, Homo sapiens
aatgagaatgtaagtgaagaga

SEQ ID NO: 7883125 - DNA, 22 bp, Homo sapiens
aatgagaagcctaggtgtactg

SEQ ID NO: 7883126 - DNA, 22 bp, Homo sapiens
aatgagaactgggagttggtgg

SEQ ID NO: 7883127 - DNA, 22 bp, Homo sapiens
aatgagaatgtaagtgaagaga

SEQ ID NO: 7883128 - DNA, 22 bp, Homo sapiens
aatgagaatgtaagtgaagaga

SEQ ID NO: 7883129 - DNA, 22 bp, Homo sapiens
aatgagaatgtaagtgaagaga

SEQ ID NO: 7883130 - DNA, 22 bp, Homo sapiens
aatgagacacgtgaagcagatg

SEQ ID NO: 7883131 - DNA, 22 bp, Homo sapiens
aatgagagaagacaggcaagtg

SEQ ID NO: 7883132 - DNA, 22 bp, Homo sapiens
aatgagagaagacaggcaagtg

SEQ ID NO: 7883133 - DNA, 23 bp, Homo sapiens
aatgagagaccatgtggagcaga

SEQ ID NO: 7883134 - DNA, 22 bp, Homo sapiens
aatgagaaaacacagaggaggt

SEQ ID NO: 7883135 - DNA, 22 bp, Homo sapiens
aatgagaaccttgaaaggaact

SEQ ID NO: 7883136 - DNA, 22 bp, Homo sapiens
aatgagaaccttgaaaggaact

SEQ ID NO: 7883137 - DNA, 19 bp, Homo sapiens
aatgactgagtacattgtc

SEQ ID NO: 7883138 - DNA, 19 bp, Homo sapiens
aatgactgagtacattgtc

SEQ ID NO: 7883139 - DNA, 19 bp, Homo sapiens
aatgactgagtacattgtc

SEQ ID NO: 7883140 - DNA, 22 bp, Homo sapiens
aatgactttgaaatatttgagt

SEQ ID NO: 7883141 - DNA, 22 bp, Homo sapiens
aatgactttgaaatatttgagt

SEQ ID NO: 7883142 - DNA, 22 bp, Homo sapiens
aatgactttgaaatatttgagt

SEQ ID NO: 7883143 - DNA, 22 bp, Homo sapiens
aatgactttgaaatatttgagt

SEQ ID NO: 7883144 - DNA, 22 bp, Homo sapiens
aatgacttatgggtgaggagag

SEQ ID NO: 7883145 - DNA, 22 bp, Homo sapiens
aatgactgtagtcatattaagg

SEQ ID NO: 7883146 - DNA, 22 bp, Homo sapiens
aatatatgactccactgcatga

SEQ ID NO: 7883147 - DNA, 22 bp, Homo sapiens
aatatatgactccactgcatga

SEQ ID NO: 7883148 - DNA, 22 bp, Homo sapiens
aatatatgagggagctatttga

SEQ ID NO: 7883149 - DNA, 22 bp, Homo sapiens
aatatatgagggagctatttga

SEQ ID NO: 7883150 - DNA, 22 bp, Homo sapiens
aatatatgagggagctatttga

SEQ ID NO: 7883151 - DNA, 21 bp, Homo sapiens
aatatatgcaatgctttctgc

SEQ ID NO: 7883152 - DNA, 22 bp, Homo sapiens
aatatatagaagtacccgttgt

SEQ ID NO: 7883153 - DNA, 22 bp, Homo sapiens
aatatatgaccaggaagttctg

SEQ ID NO: 7883154 - DNA, 22 bp, Homo sapiens
aatatatgaccaggaagttctg

SEQ ID NO: 7883155 - DNA, 22 bp, Homo sapiens
aatatatgactccactgcatga

SEQ ID NO: 7883156 - DNA, 22 bp, Homo sapiens
aatatatgactccactgcatga

SEQ ID NO: 7883157 - DNA, 22 bp, Homo sapiens
aatatatagaagtacccgttgt

SEQ ID NO: 7883158 - DNA, 22 bp, Homo sapiens
aatatatagaagtacccgttgt

SEQ ID NO: 7883159 - DNA, 22 bp, Homo sapiens
aatatatagaagtacccgttgt

SEQ ID NO: 7883160 - DNA, 22 bp, Homo sapiens
acttgacacctaattagtcatc

SEQ ID NO: 7883161 - DNA, 22 bp, Homo sapiens
acttgacagaagtcagtacttt

SEQ ID NO: 7883162 - DNA, 22 bp, Homo sapiens
acttgacattaatttaggttgt

SEQ ID NO: 7883163 - DNA, 22 bp, Homo sapiens
acttgagagaatcggaggagtc

SEQ ID NO: 7883164 - DNA, 23 bp, Homo sapiens
acttgattattgttgatagattc

SEQ ID NO: 7883165 - DNA, 23 bp, Homo sapiens
acttgattattgttgatagattc

SEQ ID NO: 7883166 - DNA, 22 bp, Homo sapiens
acttgaggaagcagcaagggat

SEQ ID NO: 7883167 - DNA, 22 bp, Homo sapiens
aatatatagaagtacccgttgt

SEQ ID NO: 7883168 - DNA, 22 bp, Homo sapiens
aatatatagaagtacccgttgt

SEQ ID NO: 7883169 - DNA, 22 bp, Homo sapiens
aatatatagaagtacccgttgt

SEQ ID NO: 7883170 - DNA, 22 bp, Homo sapiens
aatatatagaagtacccgttgt

SEQ ID NO: 7883171 - DNA, 23 bp, Homo sapiens
aatatatgtgtttttctgcttca

SEQ ID NO: 7883172 - DNA, 23 bp, Homo sapiens
aatatatgtgtttttctgcttca

SEQ ID NO: 7883173 - DNA, 21 bp, Homo sapiens
aatatatgcaatgctttctgc

SEQ ID NO: 7883174 - DNA, 22 bp, Homo sapiens
aatatatttgaatcaggaacaa

SEQ ID NO: 7883175 - DNA, 22 bp, Homo sapiens
aatatatttgaatcaggaacaa

SEQ ID NO: 7883176 - DNA, 22 bp, Homo sapiens
aatatcaacagtgtccttctaa

SEQ ID NO: 7883177 - DNA, 22 bp, Homo sapiens
aatatatttgaatcaggaacaa

SEQ ID NO: 7883178 - DNA, 22 bp, Homo sapiens
aatatatttgaatcaggaacaa

SEQ ID NO: 7883179 - DNA, 23 bp, Homo sapiens
aatatcaaggtgatgttcccaga

SEQ ID NO: 7883180 - DNA, 23 bp, Homo sapiens
aatatcaaggtgatgttcccaga

SEQ ID NO: 7883181 - DNA, 22 bp, Homo sapiens
aatatcaacagtgtccttctaa

SEQ ID NO: 7883182 - DNA, 22 bp, Homo sapiens
aatattcatttgcagaagaagt

SEQ ID NO: 7883183 - DNA, 22 bp, Homo sapiens
aatattcatttgcagaagaagt

SEQ ID NO: 7883184 - DNA, 22 bp, Homo sapiens
aatatcacaggaggagaccaag

SEQ ID NO: 7883185 - DNA, 22 bp, Homo sapiens
aatatcagattatgacgtttca

SEQ ID NO: 7883186 - DNA, 22 bp, Homo sapiens
aatatcacaggaggagaccaag

SEQ ID NO: 7883187 - DNA, 22 bp, Homo sapiens
aatattctaataaatgcccatc

SEQ ID NO: 7883188 - DNA, 22 bp, Homo sapiens
aatatttgttagtgttttaatg

SEQ ID NO: 7883189 - DNA, 22 bp, Homo sapiens
aatatttgttagtgttttaatg

SEQ ID NO: 7883190 - DNA, 19 bp, Homo sapiens
aatattttagcctcttcct

SEQ ID NO: 7883191 - DNA, 19 bp, Homo sapiens
aatattttagcctcttcct

SEQ ID NO: 7883192 - DNA, 19 bp, Homo sapiens
aatattttagcctcttcct

SEQ ID NO: 7883193 - DNA, 19 bp, Homo sapiens
aatattttagcctcttcct

SEQ ID NO: 7883194 - DNA, 19 bp, Homo sapiens
aatattttagcctcttcct

SEQ ID NO: 7883195 - DNA, 22 bp, Homo sapiens
acttcttttcaaatcatgcaaa

SEQ ID NO: 7883196 - DNA, 22 bp, Homo sapiens
acttcctggcgtagctgacatt

SEQ ID NO: 7883197 - DNA, 22 bp, Homo sapiens
acttcctggcgtagctgacatt

SEQ ID NO: 7883198 - DNA, 22 bp, Homo sapiens
acttcttttcaaatcatgcaaa

SEQ ID NO: 7883199 - DNA, 19 bp, Homo sapiens
acttcttttcaacacagga

SEQ ID NO: 7883200 - DNA, 22 bp, Homo sapiens
acttcctggattcccaagggct

SEQ ID NO: 7883201 - DNA, 22 bp, Homo sapiens
acttcctggattcccaagggct

SEQ ID NO: 7883202 - DNA, 22 bp, Homo sapiens
acttcctggattcccaagggct

SEQ ID NO: 7883203 - DNA, 22 bp, Homo sapiens
acttcctgctatgagcttctgt

SEQ ID NO: 7883204 - DNA, 22 bp, Homo sapiens
aatacagagaatgttatttgga

SEQ ID NO: 7883205 - DNA, 22 bp, Homo sapiens
aatacagagaatgttatttgga

SEQ ID NO: 7883206 - DNA, 22 bp, Homo sapiens
aatacaatcaaattcactagca

SEQ ID NO: 7883207 - DNA, 22 bp, Homo sapiens
aatacaatcaaattcactagca

SEQ ID NO: 7883208 - DNA, 22 bp, Homo sapiens
aatacaatcaaattcactagca

SEQ ID NO: 7883209 - DNA, 22 bp, Homo sapiens
aatacactattttgtgctcagt

SEQ ID NO: 7883210 - DNA, 21 bp, Homo sapiens
aatacagaaatgagtagttgc

SEQ ID NO: 7883211 - DNA, 21 bp, Homo sapiens
aatacagaaatgagtagttgc

SEQ ID NO: 7883212 - DNA, 21 bp, Homo sapiens
aatacagaaatgagtagttgc

SEQ ID NO: 7883213 - DNA, 21 bp, Homo sapiens
aatacagaaatgagtagttgc

SEQ ID NO: 7883214 - DNA, 22 bp, Homo sapiens
aatacagagaatgttatttgga

SEQ ID NO: 7883215 - DNA, 22 bp, Homo sapiens
aatacagagaatgttatttgga

SEQ ID NO: 7883216 - DNA, 22 bp, Homo sapiens
aatacagagaatgttatttgga

SEQ ID NO: 7883217 - DNA, 22 bp, Homo sapiens
acttgaaaccttggcaaacaat

SEQ ID NO: 7883218 - DNA, 22 bp, Homo sapiens
acttgaaaccctgagatgataa

SEQ ID NO: 7883219 - DNA, 22 bp, Homo sapiens
acttgaaaccctgagatgataa

SEQ ID NO: 7883220 - DNA, 22 bp, Homo sapiens
acttgaaacatctttaaatgta

SEQ ID NO: 7883221 - DNA, 22 bp, Homo sapiens
acttgaaaccctgagatgataa

SEQ ID NO: 7883222 - DNA, 22 bp, Homo sapiens
acttgaaaccctgagatgataa

SEQ ID NO: 7883223 - DNA, 22 bp, Homo sapiens
acttgaaaccctgagatgataa

SEQ ID NO: 7883224 - DNA, 22 bp, Homo sapiens
acttgaaacatctttaaatgta

SEQ ID NO: 7883225 - DNA, 22 bp, Homo sapiens
acttgaaacatctttaaatgta

SEQ ID NO: 7883226 - DNA, 22 bp, Homo sapiens
acttgaaaagctcagcagtagt

SEQ ID NO: 7883227 - DNA, 19 bp, Homo sapiens
acttcttttcaacacagga

SEQ ID NO: 7883228 - DNA, 19 bp, Homo sapiens
acttcttttcaacacagga

SEQ ID NO: 7883229 - DNA, 19 bp, Homo sapiens
acttcttttcaacacagga

SEQ ID NO: 7883230 - DNA, 22 bp, Homo sapiens
acttgaattaggccttgagaga

SEQ ID NO: 7883231 - DNA, 22 bp, Homo sapiens
acttgaattatatttctagaga

SEQ ID NO: 7883232 - DNA, 21 bp, Homo sapiens
acttgaagttggagtttctgt

SEQ ID NO: 7883233 - DNA, 21 bp, Homo sapiens
acttgaagttggagtttctgt

SEQ ID NO: 7883234 - DNA, 19 bp, Homo sapiens
acttgaaagcagagagttt

SEQ ID NO: 7883235 - DNA, 19 bp, Homo sapiens
acttgaaagcagagagttt

SEQ ID NO: 7883236 - DNA, 19 bp, Homo sapiens
acttgaaagcagagagttt

SEQ ID NO: 7883237 - DNA, 22 bp, Homo sapiens
acttgaaagaagtttccttaaa

SEQ ID NO: 7883238 - DNA, 19 bp, Homo sapiens
acttgaaagcagagagttt

SEQ ID NO: 7883239 - DNA, 22 bp, Homo sapiens
acttgaaagaagtttccttaaa

SEQ ID NO: 7883240 - DNA, 22 bp, Homo sapiens
aatcctgaggcaaagagatgag

SEQ ID NO: 7883241 - DNA, 22 bp, Homo sapiens
aatcctgaggcaaagagatgag

SEQ ID NO: 7883242 - DNA, 22 bp, Homo sapiens
aatcctgaggcaaagagatgag

SEQ ID NO: 7883243 - DNA, 22 bp, Homo sapiens
aatcctgacctgggcatgcttg

SEQ ID NO: 7883244 - DNA, 22 bp, Homo sapiens
aatcctagaaatttatttgaag

SEQ ID NO: 7883245 - DNA, 20 bp, Homo sapiens
aatccattggtctatatgtc

SEQ ID NO: 7883246 - DNA, 22 bp, Homo sapiens
aatccctttttcatttaataga

SEQ ID NO: 7883247 - DNA, 20 bp, Homo sapiens
aatcccttctctggactctt

SEQ ID NO: 7883248 - DNA, 20 bp, Homo sapiens
aatcccttctctggactctt

SEQ ID NO: 7883249 - DNA, 22 bp, Homo sapiens
aatcctaagcatccttttctgc

SEQ ID NO: 7883250 - DNA, 22 bp, Homo sapiens
aatcccttcccttctctgggac

SEQ ID NO: 7883251 - DNA, 22 bp, Homo sapiens
aatcccttcccttctctgggac

SEQ ID NO: 7883252 - DNA, 22 bp, Homo sapiens
aatccctccccaggcaagtcct

SEQ ID NO: 7883253 - DNA, 22 bp, Homo sapiens
aatccctctgtcgggcatctgt

SEQ ID NO: 7883254 - DNA, 22 bp, Homo sapiens
aatccatgcatgcaaggaaagg

SEQ ID NO: 7883255 - DNA, 22 bp, Homo sapiens
aatccatctcagtagtaccctg

SEQ ID NO: 7883256 - DNA, 22 bp, Homo sapiens
aatccatctctccgagaagttt

SEQ ID NO: 7883257 - DNA, 22 bp, Homo sapiens
aatccatctcaatttattccta

SEQ ID NO: 7883258 - DNA, 22 bp, Homo sapiens
aatccatctcaatttattccta

SEQ ID NO: 7883259 - DNA, 22 bp, Homo sapiens
aatccattgctgtgctgccagg

SEQ ID NO: 7883260 - DNA, 22 bp, Homo sapiens
aatccattcagaaattgggaat

SEQ ID NO: 7883261 - DNA, 22 bp, Homo sapiens
aatccattaaaaacaagcgcat

SEQ ID NO: 7883262 - DNA, 22 bp, Homo sapiens
aatccattaaaaacaagcgcat

SEQ ID NO: 7883263 - DNA, 22 bp, Homo sapiens
aatcccagctactcaggaagtt

SEQ ID NO: 7883264 - DNA, 22 bp, Homo sapiens
aatccatttacctttgcttgaa

SEQ ID NO: 7883265 - DNA, 20 bp, Homo sapiens
aatccattggtctatatgtc

SEQ ID NO: 7883266 - DNA, 22 bp, Homo sapiens
aatccatttactctttacaaga

SEQ ID NO: 7883267 - DNA, 22 bp, Homo sapiens
aatccatttactctttacaaga

SEQ ID NO: 7883268 - DNA, 22 bp, Homo sapiens
acttgtttcaactgtactctca

SEQ ID NO: 7883269 - DNA, 22 bp, Homo sapiens
acttgtttcaactgtactctcc

SEQ ID NO: 7883270 - DNA, 22 bp, Homo sapiens
acttgtttgaatctctctagag

SEQ ID NO: 7883271 - DNA, 22 bp, Homo sapiens
acttgtttgaatctctctagag

SEQ ID NO: 7883272 - DNA, 19 bp, Homo sapiens
acttgttttggaggtgatg

SEQ ID NO: 7883273 - DNA, 22 bp, Homo sapiens
actttaaaaagagccttctaac

SEQ ID NO: 7883274 - DNA, 22 bp, Homo sapiens
aatccagctgtgtcacaggtga

SEQ ID NO: 7883275 - DNA, 22 bp, Homo sapiens
aatccagggtgtggcctttcca

SEQ ID NO: 7883276 - DNA, 22 bp, Homo sapiens
aatccagggtgtggcctttcca

SEQ ID NO: 7883277 - DNA, 19 bp, Homo sapiens
aatccaggataagcccctt

SEQ ID NO: 7883278 - DNA, 22 bp, Homo sapiens
aatccagcacatggacacagtc

SEQ ID NO: 7883279 - DNA, 22 bp, Homo sapiens
aatccagcacatggacacagtc

SEQ ID NO: 7883280 - DNA, 22 bp, Homo sapiens
aatcataattgtatacattcat

SEQ ID NO: 7883281 - DNA, 22 bp, Homo sapiens
aatcataattgtatacattcat

SEQ ID NO: 7883282 - DNA, 22 bp, Homo sapiens
aatcaaaacctacagaggtaat

SEQ ID NO: 7883283 - DNA, 22 bp, Homo sapiens
aatcaaagaatgggctagttgg

SEQ ID NO: 7883284 - DNA, 22 bp, Homo sapiens
aatcaacattgttttaagtcaa

SEQ ID NO: 7883285 - DNA, 21 bp, Homo sapiens
aatcaaatgtcatatccccag

SEQ ID NO: 7883286 - DNA, 22 bp, Homo sapiens
aatcaacaggatgtgcattgta

SEQ ID NO: 7883287 - DNA, 22 bp, Homo sapiens
aatatttttgaggccctgttat

SEQ ID NO: 7883288 - DNA, 22 bp, Homo sapiens
aatatttttgaggccctgttat

SEQ ID NO: 7883289 - DNA, 22 bp, Homo sapiens
aatatttttgaggccctgttat

SEQ ID NO: 7883290 - DNA, 22 bp, Homo sapiens
aatatttttgaggccctgttat

SEQ ID NO: 7883291 - DNA, 22 bp, Homo sapiens
aatatttttgaggccctgttat

SEQ ID NO: 7883292 - DNA, 22 bp, Homo sapiens
aatattttaggctttccaggct

SEQ ID NO: 7883293 - DNA, 22 bp, Homo sapiens
aatattttaggctttccaggct

SEQ ID NO: 7883294 - DNA, 22 bp, Homo sapiens
aatattttaggctttccaggct

SEQ ID NO: 7883295 - DNA, 19 bp, Homo sapiens
aatattttagcctcttcct

SEQ ID NO: 7883296 - DNA, 22 bp, Homo sapiens
aatattttaggctttccaggct

SEQ ID NO: 7883297 - DNA, 22 bp, Homo sapiens
acttgtctttgtaaaatagaaa

SEQ ID NO: 7883298 - DNA, 22 bp, Homo sapiens
acttgtctttgtaaaatagaaa

SEQ ID NO: 7883299 - DNA, 22 bp, Homo sapiens
acttgtctttgtaaaatagaaa

SEQ ID NO: 7883300 - DNA, 22 bp, Homo sapiens
acttgtctggcagatcatgcaa

SEQ ID NO: 7883301 - DNA, 22 bp, Homo sapiens
acttgtctatggttacatccta

SEQ ID NO: 7883302 - DNA, 22 bp, Homo sapiens
acttgtctttaatccgaatgta

SEQ ID NO: 7883303 - DNA, 22 bp, Homo sapiens
acttgtctggcagatcatgcaa

SEQ ID NO: 7883304 - DNA, 22 bp, Homo sapiens
acttgtctatggttacatccta

SEQ ID NO: 7883305 - DNA, 22 bp, Homo sapiens
acttgtctaccatgaatattta

SEQ ID NO: 7883306 - DNA, 22 bp, Homo sapiens
acttgtctaccatgaatattta

SEQ ID NO: 7883307 - DNA, 17 bp, Homo sapiens
acttgtattgtgcttta

SEQ ID NO: 7883308 - DNA, 22 bp, Homo sapiens
acttgtacttaaaaattatttg

SEQ ID NO: 7883309 - DNA, 22 bp, Homo sapiens
acttgtacttaaaaattatttg

SEQ ID NO: 7883310 - DNA, 22 bp, Homo sapiens
acttgtacttaaaaattatttg

SEQ ID NO: 7883311 - DNA, 22 bp, Homo sapiens
acttgtgttaccaaggtttggt

SEQ ID NO: 7883312 - DNA, 22 bp, Homo sapiens
acttgtgtcaaagctatacagg

SEQ ID NO: 7883313 - DNA, 22 bp, Homo sapiens
acttgtttacaagcagttctga

SEQ ID NO: 7883314 - DNA, 22 bp, Homo sapiens
acttgttcattgagtacatatg

SEQ ID NO: 7883315 - DNA, 22 bp, Homo sapiens
acttgttcattgagtacatatg

SEQ ID NO: 7883316 - DNA, 22 bp, Homo sapiens
acttgtaaacaaatctaatgta

SEQ ID NO: 7883317 - DNA, 22 bp, Homo sapiens
acttgtaaacaaatctaatgta

SEQ ID NO: 7883318 - DNA, 21 bp, Homo sapiens
aatcaagagtactggtgtggc

SEQ ID NO: 7883319 - DNA, 22 bp, Homo sapiens
acttggttggtctcaccctgtt

SEQ ID NO: 7883320 - DNA, 22 bp, Homo sapiens
acttggttgttttaacttggca

SEQ ID NO: 7883321 - DNA, 22 bp, Homo sapiens
aatcaagagctgactatatttt

SEQ ID NO: 7883322 - DNA, 22 bp, Homo sapiens
aatcaagagctgactatatttt

SEQ ID NO: 7883323 - DNA, 18 bp, Homo sapiens
aatcaagagctggctgta

SEQ ID NO: 7883324 - DNA, 22 bp, Homo sapiens
aatcaagaggcgatggatggaa

SEQ ID NO: 7883325 - DNA, 22 bp, Homo sapiens
aatcaagagcggcgacagcctt

SEQ ID NO: 7883326 - DNA, 22 bp, Homo sapiens
aatcaagaataagttgtaaagc

SEQ ID NO: 7883327 - DNA, 22 bp, Homo sapiens
aatcaagaataagttgtaaagc

SEQ ID NO: 7883328 - DNA, 22 bp, Homo sapiens
acacaggcatagccatacatgt

SEQ ID NO: 7883329 - DNA, 21 bp, Homo sapiens
acacaggcagtgtcccgaggt

SEQ ID NO: 7883330 - DNA, 22 bp, Homo sapiens
acacaggcaatgtgagtgggag

SEQ ID NO: 7883331 - DNA, 22 bp, Homo sapiens
acacaggcaagagtgcaggtct

SEQ ID NO: 7883332 - DNA, 22 bp, Homo sapiens
acacaggcaagagtgcaggtct

SEQ ID NO: 7883333 - DNA, 22 bp, Homo sapiens
agcagcaggtgcttctggatct

SEQ ID NO: 7883334 - DNA, 22 bp, Homo sapiens
agcagcaggtgcttctggatct

SEQ ID NO: 7883335 - DNA, 22 bp, Homo sapiens
agcagcaggtgcttctggatct

SEQ ID NO: 7883336 - DNA, 22 bp, Homo sapiens
agcagcaggtgcttctggatct

SEQ ID NO: 7883337 - DNA, 22 bp, Homo sapiens
agcagcaggtgacctcgatgcc

SEQ ID NO: 7883338 - DNA, 22 bp, Homo sapiens
agcagcaggtgacctcgatgcc

SEQ ID NO: 7883339 - DNA, 22 bp, Homo sapiens
agcagcaggtgacctcgatgcc

SEQ ID NO: 7883340 - DNA, 22 bp, Homo sapiens
agcagcaggtgacctcgatgcc

SEQ ID NO: 7883341 - DNA, 22 bp, Homo sapiens
agcagcaggtgacctcgatgcc

SEQ ID NO: 7883342 - DNA, 22 bp, Homo sapiens
agcagcaggtgacctcgatgcc

SEQ ID NO: 7883343 - DNA, 22 bp, Homo sapiens
agcagcagtcctttgtgtaatt

SEQ ID NO: 7883344 - DNA, 22 bp, Homo sapiens
agcagcagtcctttgtgtaatt

SEQ ID NO: 7883345 - DNA, 22 bp, Homo sapiens
agcagcagtatccttccccggc

SEQ ID NO: 7883346 - DNA, 22 bp, Homo sapiens
agcagcagtcatgcctatgctc

SEQ ID NO: 7883347 - DNA, 22 bp, Homo sapiens
agcagcagtcatgcctatgctc

SEQ ID NO: 7883348 - DNA, 22 bp, Homo sapiens
agcagcagtcatgcctatgctc

SEQ ID NO: 7883349 - DNA, 22 bp, Homo sapiens
agcagcaggtgcttctggatct

SEQ ID NO: 7883350 - DNA, 22 bp, Homo sapiens
agcagcagtacatataagacta

SEQ ID NO: 7883351 - DNA, 22 bp, Homo sapiens
agcagcagtatccttccccggc

SEQ ID NO: 7883352 - DNA, 22 bp, Homo sapiens
agcagcagtgtgtggtcatgtt

SEQ ID NO: 7883353 - DNA, 22 bp, Homo sapiens
agcagcagtgtgtggtcatgtt

SEQ ID NO: 7883354 - DNA, 22 bp, Homo sapiens
agcagcagtgtgtggtcatgtt

SEQ ID NO: 7883355 - DNA, 22 bp, Homo sapiens
agcagcagtgtgtggtcatgtt

SEQ ID NO: 7883356 - DNA, 22 bp, Homo sapiens
agcagcagtgtggtttggggaa

SEQ ID NO: 7883357 - DNA, 23 bp, Homo sapiens
agcagcagtgagaggtgtcttac

SEQ ID NO: 7883358 - DNA, 23 bp, Homo sapiens
agcagcagtgagaggtgtcttac

SEQ ID NO: 7883359 - DNA, 22 bp, Homo sapiens
agcagcagtgacagccgaaagc

SEQ ID NO: 7883360 - DNA, 22 bp, Homo sapiens
agcagcagtcctttgtgtaatt

SEQ ID NO: 7883361 - DNA, 22 bp, Homo sapiens
agcagcagtgacagccgaaagc

SEQ ID NO: 7883362 - DNA, 22 bp, Homo sapiens
agcagcagtcatgcctatgctc

SEQ ID NO: 7883363 - DNA, 23 bp, Homo sapiens
agcagcagtgagaggtgtcttac

SEQ ID NO: 7883364 - DNA, 23 bp, Homo sapiens
agcagcagtgagaggtgtcttac

SEQ ID NO: 7883365 - DNA, 23 bp, Homo sapiens
agcagcagtgagaggtgtcttac

SEQ ID NO: 7883366 - DNA, 22 bp, Homo sapiens
acacataagaaactacaaagag

SEQ ID NO: 7883367 - DNA, 22 bp, Homo sapiens
agcagcagttgctgacgttcta

SEQ ID NO: 7883368 - DNA, 22 bp, Homo sapiens
agcagcagtgtgtggtcatgtt

SEQ ID NO: 7883369 - DNA, 22 bp, Homo sapiens
agcagcagtgtgtggtcatgtt

SEQ ID NO: 7883370 - DNA, 22 bp, Homo sapiens
acacataagaaactacaaagag

SEQ ID NO: 7883371 - DNA, 22 bp, Homo sapiens
acacatatatgtgcgtgtatat

SEQ ID NO: 7883372 - DNA, 22 bp, Homo sapiens
acacatatatgtcgaagtcctc

SEQ ID NO: 7883373 - DNA, 22 bp, Homo sapiens
acacatatgtatgcatcatgtg

SEQ ID NO: 7883374 - DNA, 22 bp, Homo sapiens
acacatatgtatgcatcatgtg

SEQ ID NO: 7883375 - DNA, 22 bp, Homo sapiens
acacatatgtatgcatcatgtg

SEQ ID NO: 7883376 - DNA, 21 bp, Homo sapiens
agcagcttgagtctggagctc

SEQ ID NO: 7883377 - DNA, 21 bp, Homo sapiens
agcagcttgagtctggagctc

SEQ ID NO: 7883378 - DNA, 22 bp, Homo sapiens
agcagcttggggccgagataga

SEQ ID NO: 7883379 - DNA, 22 bp, Homo sapiens
agcagcttgggtctctcctgct

SEQ ID NO: 7883380 - DNA, 22 bp, Homo sapiens
agcagcttgggtctctcctgct

SEQ ID NO: 7883381 - DNA, 22 bp, Homo sapiens
agcagcttggggccgagataga

SEQ ID NO: 7883382 - DNA, 22 bp, Homo sapiens
agcagcttgggtctctcctgct

SEQ ID NO: 7883383 - DNA, 22 bp, Homo sapiens
agcagctttcacctccccgcct

SEQ ID NO: 7883384 - DNA, 22 bp, Homo sapiens
agcagcttgggtctctcctgct

SEQ ID NO: 7883385 - DNA, 22 bp, Homo sapiens
agcagcttgggtctctcctgct

SEQ ID NO: 7883386 - DNA, 22 bp, Homo sapiens
agcagcttggttttaggcatgg

SEQ ID NO: 7883387 - DNA, 18 bp, Homo sapiens
agcagctttgtgcttgat

SEQ ID NO: 7883388 - DNA, 21 bp, Homo sapiens
agcagctttggttgaagcaga

SEQ ID NO: 7883389 - DNA, 22 bp, Homo sapiens
agcagctttcctctggggtcag

SEQ ID NO: 7883390 - DNA, 18 bp, Homo sapiens
agcagctttgacaggaaa

SEQ ID NO: 7883391 - DNA, 20 bp, Homo sapiens
agcaggaaaagtgccagtct

SEQ ID NO: 7883392 - DNA, 20 bp, Homo sapiens
agcaggaaaagtgccagtct

SEQ ID NO: 7883393 - DNA, 20 bp, Homo sapiens
agcaggaaaagtgccagtct

SEQ ID NO: 7883394 - DNA, 23 bp, Homo sapiens
agcaggaaaccgagggtgatgtt

SEQ ID NO: 7883395 - DNA, 22 bp, Homo sapiens
acacatatggttgctgcagtga

SEQ ID NO: 7883396 - DNA, 22 bp, Homo sapiens
acacatatggttgctgcagtga

SEQ ID NO: 7883397 - DNA, 22 bp, Homo sapiens
acacatatgccattacagcaaa

SEQ ID NO: 7883398 - DNA, 22 bp, Homo sapiens
acacatatgccattacagcaaa

SEQ ID NO: 7883399 - DNA, 22 bp, Homo sapiens
acacatatgccattacagcaaa

SEQ ID NO: 7883400 - DNA, 22 bp, Homo sapiens
acacatatctaagatagatgac

SEQ ID NO: 7883401 - DNA, 22 bp, Homo sapiens
acacatatctaagatagatgac

SEQ ID NO: 7883402 - DNA, 22 bp, Homo sapiens
acacatatctaagatagatgac

SEQ ID NO: 7883403 - DNA, 22 bp, Homo sapiens
acacatatctaagatagatgac

SEQ ID NO: 7883404 - DNA, 22 bp, Homo sapiens
acacatatctaagatagatgac

SEQ ID NO: 7883405 - DNA, 22 bp, Homo sapiens
acacatatatttgcatatacac

SEQ ID NO: 7883406 - DNA, 22 bp, Homo sapiens
acacatatatttgcatatacac

SEQ ID NO: 7883407 - DNA, 23 bp, Homo sapiens
acacatatattcagatacagatg

SEQ ID NO: 7883408 - DNA, 23 bp, Homo sapiens
acacatatattcagatacagatg

SEQ ID NO: 7883409 - DNA, 23 bp, Homo sapiens
acacatatattcagatacagatg

SEQ ID NO: 7883410 - DNA, 23 bp, Homo sapiens
acacatatattcagatacagatg

SEQ ID NO: 7883411 - DNA, 23 bp, Homo sapiens
acacatatattcagatacagatg

SEQ ID NO: 7883412 - DNA, 22 bp, Homo sapiens
acacatatatttgcatatacac

SEQ ID NO: 7883413 - DNA, 22 bp, Homo sapiens
agcaccctggggaagcacaaag

SEQ ID NO: 7883414 - DNA, 22 bp, Homo sapiens
agcaccctcccaccctctcaga

SEQ ID NO: 7883415 - DNA, 22 bp, Homo sapiens
agcaccatttatcatctaggta

SEQ ID NO: 7883416 - DNA, 22 bp, Homo sapiens
agcaccctggggaagcacaaag

SEQ ID NO: 7883417 - DNA, 22 bp, Homo sapiens
agcacccttcagcccagcctgg

SEQ ID NO: 7883418 - DNA, 22 bp, Homo sapiens
agcacccttcagcccagcctgg

SEQ ID NO: 7883419 - DNA, 22 bp, Homo sapiens
agcacccttcagcccagcctgg

SEQ ID NO: 7883420 - DNA, 22 bp, Homo sapiens
agcaccatgaccttgccattga

SEQ ID NO: 7883421 - DNA, 23 bp, Homo sapiens
agcaccattacagtttgattggg

SEQ ID NO: 7883422 - DNA, 22 bp, Homo sapiens
agcaccattgcaaatatggcag

SEQ ID NO: 7883423 - DNA, 22 bp, Homo sapiens
agcaccattgcaaatatggcag

SEQ ID NO: 7883424 - DNA, 22 bp, Homo sapiens
agcaccccatagtcagtcacgt

SEQ ID NO: 7883425 - DNA, 22 bp, Homo sapiens
agcaccccatagtcagtcacgt

SEQ ID NO: 7883426 - DNA, 22 bp, Homo sapiens
agcaccctcagccttatccaga

SEQ ID NO: 7883427 - DNA, 22 bp, Homo sapiens
agcacctccttagctatgacca

SEQ ID NO: 7883428 - DNA, 22 bp, Homo sapiens
agcacctccttagctatgacca

SEQ ID NO: 7883429 - DNA, 22 bp, Homo sapiens
agcacctccttagctatgacca

SEQ ID NO: 7883430 - DNA, 22 bp, Homo sapiens
agcacctgcacagtggaggaaa

SEQ ID NO: 7883431 - DNA, 22 bp, Homo sapiens
agcacctgcacagtggaggaaa

SEQ ID NO: 7883432 - DNA, 22 bp, Homo sapiens
agcacctgcacagtggaggaaa

SEQ ID NO: 7883433 - DNA, 22 bp, Homo sapiens
agcaccctttgtgagcataagt

SEQ ID NO: 7883434 - DNA, 22 bp, Homo sapiens
agcaccgtcatagccaggtaag

SEQ ID NO: 7883435 - DNA, 22 bp, Homo sapiens
agcaccgttcaaacccaggtta

SEQ ID NO: 7883436 - DNA, 20 bp, Homo sapiens
agcacctcccatatgctaga

SEQ ID NO: 7883437 - DNA, 20 bp, Homo sapiens
agcacctcccatatgctaga

SEQ ID NO: 7883438 - DNA, 22 bp, Homo sapiens
agcacctccagagcttgaagct

SEQ ID NO: 7883439 - DNA, 22 bp, Homo sapiens
acaatttatccattgtatagtt

SEQ ID NO: 7883440 - DNA, 22 bp, Homo sapiens
acaatttatccattgtatagtt

SEQ ID NO: 7883441 - DNA, 22 bp, Homo sapiens
acaatttatccattgtatagtt

SEQ ID NO: 7883442 - DNA, 22 bp, Homo sapiens
acaatttatccattgtatagtt

SEQ ID NO: 7883443 - DNA, 22 bp, Homo sapiens
acaattgcattgtcacaaataa

SEQ ID NO: 7883444 - DNA, 22 bp, Homo sapiens
acaattgagtttctgagggttt

SEQ ID NO: 7883445 - DNA, 22 bp, Homo sapiens
acaattgcattgtcacaaataa

SEQ ID NO: 7883446 - DNA, 22 bp, Homo sapiens
acaattgtgagtatgaagtgat

SEQ ID NO: 7883447 - DNA, 20 bp, Homo sapiens
acaatttcctcactatatgc

SEQ ID NO: 7883448 - DNA, 20 bp, Homo sapiens
acaatttcctcactatatgc

SEQ ID NO: 7883449 - DNA, 22 bp, Homo sapiens
agcacctgctatgtgtcaggga

SEQ ID NO: 7883450 - DNA, 22 bp, Homo sapiens
agcacctgcctgcattggctat

SEQ ID NO: 7883451 - DNA, 22 bp, Homo sapiens
agcacctgctatgtgtcaggga

SEQ ID NO: 7883452 - DNA, 22 bp, Homo sapiens
agcacctgcttaatgtgcagtg

SEQ ID NO: 7883453 - DNA, 22 bp, Homo sapiens
acaattctgatggtttcccagt

SEQ ID NO: 7883454 - DNA, 22 bp, Homo sapiens
acaattctgatggtttcccagt

SEQ ID NO: 7883455 - DNA, 22 bp, Homo sapiens
acaattctgatggtttcccagt

SEQ ID NO: 7883456 - DNA, 22 bp, Homo sapiens
acaattctgtggttgtctgtgg

SEQ ID NO: 7883457 - DNA, 22 bp, Homo sapiens
acaattctgtggttgtctgtgg

SEQ ID NO: 7883458 - DNA, 22 bp, Homo sapiens
acaattgactgtatttttagct

SEQ ID NO: 7883459 - DNA, 22 bp, Homo sapiens
acaatttgtgtcttttgcttat

SEQ ID NO: 7883460 - DNA, 22 bp, Homo sapiens
acaatttgtgtcttttgcttat

SEQ ID NO: 7883461 - DNA, 22 bp, Homo sapiens
acaattttccccataggttatc

SEQ ID NO: 7883462 - DNA, 22 bp, Homo sapiens
acaattttccccataggttatc

SEQ ID NO: 7883463 - DNA, 22 bp, Homo sapiens
acacagatgggtagaaaacaga

SEQ ID NO: 7883464 - DNA, 22 bp, Homo sapiens
acaatttctgatcagtgaattt

SEQ ID NO: 7883465 - DNA, 22 bp, Homo sapiens
acaatttctgatcagtgaattt

SEQ ID NO: 7883466 - DNA, 22 bp, Homo sapiens
acaatttctgatcagtgaattt

SEQ ID NO: 7883467 - DNA, 22 bp, Homo sapiens
acaatttctaatatagatctta

SEQ ID NO: 7883468 - DNA, 22 bp, Homo sapiens
acaatttctaatatagatctta

SEQ ID NO: 7883469 - DNA, 22 bp, Homo sapiens
acaatttcttatagttcaattc

SEQ ID NO: 7883470 - DNA, 22 bp, Homo sapiens
acaatttcttatagttcaattc

SEQ ID NO: 7883471 - DNA, 22 bp, Homo sapiens
acaatttgaggctactcaattg

SEQ ID NO: 7883472 - DNA, 22 bp, Homo sapiens
acaatttgaggctactcaattg

SEQ ID NO: 7883473 - DNA, 22 bp, Homo sapiens
acaatttgaggctactcaattg

SEQ ID NO: 7883474 - DNA, 22 bp, Homo sapiens
acacaggaactctgagaggtgg

SEQ ID NO: 7883475 - DNA, 22 bp, Homo sapiens
acacagatttcactggaataga

SEQ ID NO: 7883476 - DNA, 22 bp, Homo sapiens
acacagattttacatgttatgc

SEQ ID NO: 7883477 - DNA, 22 bp, Homo sapiens
acacagatgggtagaaaacaga

SEQ ID NO: 7883478 - DNA, 22 bp, Homo sapiens
acacaggaagagagataataat

SEQ ID NO: 7883479 - DNA, 22 bp, Homo sapiens
acacaggaagcaatttcagagc

SEQ ID NO: 7883480 - DNA, 22 bp, Homo sapiens
acacaggaagcaatttcagagc

SEQ ID NO: 7883481 - DNA, 22 bp, Homo sapiens
acacaggaagagagataataat

SEQ ID NO: 7883482 - DNA, 22 bp, Homo sapiens
acacaggaactctgagaggtgg

SEQ ID NO: 7883483 - DNA, 22 bp, Homo sapiens
acacaggaactctgagaggtgg

SEQ ID NO: 7883484 - DNA, 22 bp, Homo sapiens
acacaggaagtcagcactgatg

SEQ ID NO: 7883485 - DNA, 22 bp, Homo sapiens
acacaggaagtcagcactgatg

SEQ ID NO: 7883486 - DNA, 22 bp, Homo sapiens
acacaggaagcaatttcagagc

SEQ ID NO: 7883487 - DNA, 22 bp, Homo sapiens
acacaggaagtcagcactgatg

SEQ ID NO: 7883488 - DNA, 22 bp, Homo sapiens
acacaggaagtcagcactgatg

SEQ ID NO: 7883489 - DNA, 22 bp, Homo sapiens
acacaggacagggatgtgtttt

SEQ ID NO: 7883490 - DNA, 22 bp, Homo sapiens
acacaggacagggatgtgtttt

SEQ ID NO: 7883491 - DNA, 22 bp, Homo sapiens
acacaggagaaaagatctccca

SEQ ID NO: 7883492 - DNA, 22 bp, Homo sapiens
acacaggacggccctgtggctt

SEQ ID NO: 7883493 - DNA, 22 bp, Homo sapiens
acacaggacggccctgtggctt

SEQ ID NO: 7883494 - DNA, 22 bp, Homo sapiens
acacaggacggccctgtggctt

SEQ ID NO: 7883495 - DNA, 22 bp, Homo sapiens
acacaggaggaggatggtggtc

SEQ ID NO: 7883496 - DNA, 23 bp, Homo sapiens
acacaggatacatacggaagcaa

SEQ ID NO: 7883497 - DNA, 22 bp, Homo sapiens
acacaggcaagagtgcaggtct

SEQ ID NO: 7883498 - DNA, 22 bp, Homo sapiens
acacaggagatatgtaatggct

SEQ ID NO: 7883499 - DNA, 22 bp, Homo sapiens
acacaggagatatgtaatggct

SEQ ID NO: 7883500 - DNA, 22 bp, Homo sapiens
acacaggaggaggatggtggtc

SEQ ID NO: 7883501 - DNA, 22 bp, Homo sapiens
acacaggaggaggatggtggtc

SEQ ID NO: 7883502 - DNA, 22 bp, Homo sapiens
agcagtggctggatggtgtgct

SEQ ID NO: 7883503 - DNA, 22 bp, Homo sapiens
agcagtgggggagtgttagttt

SEQ ID NO: 7883504 - DNA, 22 bp, Homo sapiens
agcagtgggggagtgttagttt

SEQ ID NO: 7883505 - DNA, 22 bp, Homo sapiens
agcagtggtgtgaggagggctc

SEQ ID NO: 7883506 - DNA, 22 bp, Homo sapiens
agcagtggtccccaacctttct

SEQ ID NO: 7883507 - DNA, 22 bp, Homo sapiens
agcagtggtccccaacctttct

SEQ ID NO: 7883508 - DNA, 22 bp, Homo sapiens
agcagtgggtgacagagctgag

SEQ ID NO: 7883509 - DNA, 22 bp, Homo sapiens
agcagtgggtgacagagctgag

SEQ ID NO: 7883510 - DNA, 22 bp, Homo sapiens
agcagtgggtgacagagctgag

SEQ ID NO: 7883511 - DNA, 21 bp, Homo sapiens
acactgtgtcataatgcttaa

SEQ ID NO: 7883512 - DNA, 21 bp, Homo sapiens
acactgtgtcataatgcttaa

SEQ ID NO: 7883513 - DNA, 22 bp, Homo sapiens
acactgtgcttagatgctgaac

SEQ ID NO: 7883514 - DNA, 22 bp, Homo sapiens
acactgtgcttagatgctgaac

SEQ ID NO: 7883515 - DNA, 21 bp, Homo sapiens
acactgtgtcataatgcttaa

SEQ ID NO: 7883516 - DNA, 22 bp, Homo sapiens
acactgtgtctagcattttaca

SEQ ID NO: 7883517 - DNA, 22 bp, Homo sapiens
acactgtgtctagcattttaca

SEQ ID NO: 7883518 - DNA, 22 bp, Homo sapiens
acactgtgcagattccctgtga

SEQ ID NO: 7883519 - DNA, 22 bp, Homo sapiens
acactgtgcatgcatatacaca

SEQ ID NO: 7883520 - DNA, 20 bp, Homo sapiens
acactgtgctaaggattttc

SEQ ID NO: 7883521 - DNA, 22 bp, Homo sapiens
acactgtgcatgcatatacaca

SEQ ID NO: 7883522 - DNA, 22 bp, Homo sapiens
acactgtgcatgcatatacaca

SEQ ID NO: 7883523 - DNA, 22 bp, Homo sapiens
acactgtgatttctgggttcca

SEQ ID NO: 7883524 - DNA, 22 bp, Homo sapiens
acactgtgatcttgagaaaggt

SEQ ID NO: 7883525 - DNA, 22 bp, Homo sapiens
acactgtgcagattccctgtga

SEQ ID NO: 7883526 - DNA, 22 bp, Homo sapiens
acactgtgcagattccctgtga

SEQ ID NO: 7883527 - DNA, 22 bp, Homo sapiens
agcagtggtgtgaggagggctc

SEQ ID NO: 7883528 - DNA, 22 bp, Homo sapiens
agcagtggtgtgaggagggctc

SEQ ID NO: 7883529 - DNA, 22 bp, Homo sapiens
agcagtgtggccttagacccgg

SEQ ID NO: 7883530 - DNA, 18 bp, Homo sapiens
agcagtgtggcaagcaga

SEQ ID NO: 7883531 - DNA, 22 bp, Homo sapiens
agcagtgttcaatgatacactg

SEQ ID NO: 7883532 - DNA, 22 bp, Homo sapiens
agcagtgtttgtgactttagat

SEQ ID NO: 7883533 - DNA, 22 bp, Homo sapiens
agcagttaccaaggaacctggt

SEQ ID NO: 7883534 - DNA, 22 bp, Homo sapiens
agcagttacgggcctatctagg

SEQ ID NO: 7883535 - DNA, 22 bp, Homo sapiens
agcagtgttcaatgatacactg

SEQ ID NO: 7883536 - DNA, 22 bp, Homo sapiens
agcagtgttctaatctggctag

SEQ ID NO: 7883537 - DNA, 22 bp, Homo sapiens
agcagtgtttaggcattcagta

SEQ ID NO: 7883538 - DNA, 22 bp, Homo sapiens
agcagttactagttaaatgcat

SEQ ID NO: 7883539 - DNA, 22 bp, Homo sapiens
acagaaagatgatttgaaatgg

SEQ ID NO: 7883540 - DNA, 22 bp, Homo sapiens
acagaacaacaaggtggaccag

SEQ ID NO: 7883541 - DNA, 22 bp, Homo sapiens
acagaaattgggcaaatggaag

SEQ ID NO: 7883542 - DNA, 22 bp, Homo sapiens
acagaacaacaaggtggaccag

SEQ ID NO: 7883543 - DNA, 22 bp, Homo sapiens
acagaacaacaaggtggaccag

SEQ ID NO: 7883544 - DNA, 22 bp, Homo sapiens
acagaacaacaaggtggaccag

SEQ ID NO: 7883545 - DNA, 22 bp, Homo sapiens
acagaacaagacctgcttattg

SEQ ID NO: 7883546 - DNA, 22 bp, Homo sapiens
acagaacaagacctgcttattg

SEQ ID NO: 7883547 - DNA, 22 bp, Homo sapiens
acagaacaagacctgcttattg

SEQ ID NO: 7883548 - DNA, 22 bp, Homo sapiens
acagaaattgggcaaatggaag

SEQ ID NO: 7883549 - DNA, 22 bp, Homo sapiens
acagaaattgggcaaatggaag

SEQ ID NO: 7883550 - DNA, 22 bp, Homo sapiens
acagaacaacaaggtggaccag

SEQ ID NO: 7883551 - DNA, 22 bp, Homo sapiens
acagaaattgggcaaatggaag

SEQ ID NO: 7883552 - DNA, 22 bp, Homo sapiens
acagaaattgggcaaatggaag

SEQ ID NO: 7883553 - DNA, 22 bp, Homo sapiens
agccacagggggtgagggacaa

SEQ ID NO: 7883554 - DNA, 22 bp, Homo sapiens
agccacagggggtgagggacaa

SEQ ID NO: 7883555 - DNA, 22 bp, Homo sapiens
agccacaggccatgagatacca

SEQ ID NO: 7883556 - DNA, 22 bp, Homo sapiens
agccacagggggtgagggacaa

SEQ ID NO: 7883557 - DNA, 22 bp, Homo sapiens
agccacagggggtgagggacaa

SEQ ID NO: 7883558 - DNA, 22 bp, Homo sapiens
agccacaggtgttggccagtgt

SEQ ID NO: 7883559 - DNA, 22 bp, Homo sapiens
agccacaggtgttggccagtgt

SEQ ID NO: 7883560 - DNA, 22 bp, Homo sapiens
agccacagggggtgagggacaa

SEQ ID NO: 7883561 - DNA, 22 bp, Homo sapiens
agccacaggtgttggccagtgt

SEQ ID NO: 7883562 - DNA, 22 bp, Homo sapiens
agccacaggccatgagatacca

SEQ ID NO: 7883563 - DNA, 22 bp, Homo sapiens
agccacagggggtgagggacaa

SEQ ID NO: 7883564 - DNA, 22 bp, Homo sapiens
agccacagggggtgagggacaa

SEQ ID NO: 7883565 - DNA, 22 bp, Homo sapiens
agccacaggccatgagatacca

SEQ ID NO: 7883566 - DNA, 22 bp, Homo sapiens
agccacaggccatgagatacca

SEQ ID NO: 7883567 - DNA, 22 bp, Homo sapiens
agccacaggaaacagagacagc

SEQ ID NO: 7883568 - DNA, 22 bp, Homo sapiens
agccacaggaaacagagacagc

SEQ ID NO: 7883569 - DNA, 22 bp, Homo sapiens
agccacaggaaacagagacagc

SEQ ID NO: 7883570 - DNA, 22 bp, Homo sapiens
agccacaggccatgagatacca

SEQ ID NO: 7883571 - DNA, 22 bp, Homo sapiens
acagaaattctgggacagaaaa

SEQ ID NO: 7883572 - DNA, 22 bp, Homo sapiens
acagaaattctgggacagaaaa

SEQ ID NO: 7883573 - DNA, 22 bp, Homo sapiens
acagaaattgctaatagctcat

SEQ ID NO: 7883574 - DNA, 22 bp, Homo sapiens
acagaaattctgggacagaaaa

SEQ ID NO: 7883575 - DNA, 22 bp, Homo sapiens
acagaaattctgggacagaaaa

SEQ ID NO: 7883576 - DNA, 22 bp, Homo sapiens
acagaaattgctaatagctcat

SEQ ID NO: 7883577 - DNA, 22 bp, Homo sapiens
acagaaattgctaatagctcat

SEQ ID NO: 7883578 - DNA, 22 bp, Homo sapiens
acagaaattgctaatagctcat

SEQ ID NO: 7883579 - DNA, 22 bp, Homo sapiens
acagaaattgggcaaatggaag

SEQ ID NO: 7883580 - DNA, 22 bp, Homo sapiens
acagaaattgctaatagctcat

SEQ ID NO: 7883581 - DNA, 22 bp, Homo sapiens
acagaaattctgggacagaaaa

SEQ ID NO: 7883582 - DNA, 22 bp, Homo sapiens
acagaaattcaaactggaattt

SEQ ID NO: 7883583 - DNA, 19 bp, Homo sapiens
acagaaattagttattttc

SEQ ID NO: 7883584 - DNA, 22 bp, Homo sapiens
acagaaattcaaactggaattt

SEQ ID NO: 7883585 - DNA, 22 bp, Homo sapiens
acagaaattcaaactggaattt

SEQ ID NO: 7883586 - DNA, 22 bp, Homo sapiens
acagaaattcaaactggaattt

SEQ ID NO: 7883587 - DNA, 22 bp, Homo sapiens
acagaaattcaaactggaattt

SEQ ID NO: 7883588 - DNA, 22 bp, Homo sapiens
acagaaattcaaactggaattt

SEQ ID NO: 7883589 - DNA, 22 bp, Homo sapiens
acagaaattcaaactggaattt

SEQ ID NO: 7883590 - DNA, 19 bp, Homo sapiens
acagaaattagttattttc

SEQ ID NO: 7883591 - DNA, 19 bp, Homo sapiens
acagaaattagttattttc

SEQ ID NO: 7883592 - DNA, 19 bp, Homo sapiens
acagaaattagttattttc

SEQ ID NO: 7883593 - DNA, 19 bp, Homo sapiens
acagaaattagttattttc

SEQ ID NO: 7883594 - DNA, 22 bp, Homo sapiens
acagaaattagcagtgagttta

SEQ ID NO: 7883595 - DNA, 22 bp, Homo sapiens
acagaaattagcagtgagttta

SEQ ID NO: 7883596 - DNA, 22 bp, Homo sapiens
acagaaagatgatttgaaatgg

SEQ ID NO: 7883597 - DNA, 22 bp, Homo sapiens
acagaaattagcagtgagttta

SEQ ID NO: 7883598 - DNA, 22 bp, Homo sapiens
acacattataggcaatcaaaag

SEQ ID NO: 7883599 - DNA, 22 bp, Homo sapiens
agcaggaaagaaaaatctgtgt

SEQ ID NO: 7883600 - DNA, 22 bp, Homo sapiens
agcaggaaagaaaaatctgtgt

SEQ ID NO: 7883601 - DNA, 23 bp, Homo sapiens
agcaggaaaccgagggtgatgtt

SEQ ID NO: 7883602 - DNA, 23 bp, Homo sapiens
agcaggaaaccgagggtgatgtt

SEQ ID NO: 7883603 - DNA, 23 bp, Homo sapiens
agcaggaaaccgagggtgatgtt

SEQ ID NO: 7883604 - DNA, 20 bp, Homo sapiens
agcaggaaaagtgccagtct

SEQ ID NO: 7883605 - DNA, 23 bp, Homo sapiens
agcaggaaaccgagggtgatgtt

SEQ ID NO: 7883606 - DNA, 22 bp, Homo sapiens
acacattatctcattaaatact

SEQ ID NO: 7883607 - DNA, 22 bp, Homo sapiens
acacattatctcattaaatact

SEQ ID NO: 7883608 - DNA, 22 bp, Homo sapiens
acacattatctcattaaatact

SEQ ID NO: 7883609 - DNA, 22 bp, Homo sapiens
acacatttctctttttgtaagt

SEQ ID NO: 7883610 - DNA, 22 bp, Homo sapiens
acacattatctcattaaatact

SEQ ID NO: 7883611 - DNA, 22 bp, Homo sapiens
acacatttgcataatacctcat

SEQ ID NO: 7883612 - DNA, 19 bp, Homo sapiens
acacatttgcacaatccac

SEQ ID NO: 7883613 - DNA, 22 bp, Homo sapiens
acacatttgcataatacctcat

SEQ ID NO: 7883614 - DNA, 22 bp, Homo sapiens
acacatttgcataatacctcat

SEQ ID NO: 7883615 - DNA, 19 bp, Homo sapiens
acacatttgcacaatccac

SEQ ID NO: 7883616 - DNA, 19 bp, Homo sapiens
acacatttgcacaatccac

SEQ ID NO: 7883617 - DNA, 22 bp, Homo sapiens
acacatttgctaaaatgagctc

SEQ ID NO: 7883618 - DNA, 22 bp, Homo sapiens
acacatttgctaaaatgagctc

SEQ ID NO: 7883619 - DNA, 22 bp, Homo sapiens
acacatttgggctcctacataa

SEQ ID NO: 7883620 - DNA, 22 bp, Homo sapiens
acacatttgggctcctacataa

SEQ ID NO: 7883621 - DNA, 22 bp, Homo sapiens
acacatttgggctcctacataa

SEQ ID NO: 7883622 - DNA, 22 bp, Homo sapiens
acacattttcaacactgtcaag

SEQ ID NO: 7883623 - DNA, 22 bp, Homo sapiens
acacattttcaacactgtcaag

SEQ ID NO: 7883624 - DNA, 22 bp, Homo sapiens
acacattttcaacactgtcaag

SEQ ID NO: 7883625 - DNA, 22 bp, Homo sapiens
acacatttgggctcctacataa

SEQ ID NO: 7883626 - DNA, 22 bp, Homo sapiens
acacattttcaacactgtcaag

SEQ ID NO: 7883627 - DNA, 22 bp, Homo sapiens
acacattttcaacactgtcaag

SEQ ID NO: 7883628 - DNA, 22 bp, Homo sapiens
acacattttcaacactgtcaag

SEQ ID NO: 7883629 - DNA, 22 bp, Homo sapiens
acacattttctaacagggatca

SEQ ID NO: 7883630 - DNA, 22 bp, Homo sapiens
acacattttggctaggtggaga

SEQ ID NO: 7883631 - DNA, 22 bp, Homo sapiens
acacattttgttaaaccctgtg

SEQ ID NO: 7883632 - DNA, 22 bp, Homo sapiens
acacattttctaacagggatca

SEQ ID NO: 7883633 - DNA, 22 bp, Homo sapiens
acacattttctaacagggatca

SEQ ID NO: 7883634 - DNA, 22 bp, Homo sapiens
acacattttggctaggtggaga

SEQ ID NO: 7883635 - DNA, 23 bp, Homo sapiens
acacatttttcccgttctgaggt

SEQ ID NO: 7883636 - DNA, 23 bp, Homo sapiens
acacatttttcccgttctgaggt

SEQ ID NO: 7883637 - DNA, 23 bp, Homo sapiens
acacatttttcccgttctgaggt

SEQ ID NO: 7883638 - DNA, 22 bp, Homo sapiens
acaccaaagtagaattaatgta

SEQ ID NO: 7883639 - DNA, 22 bp, Homo sapiens
acaccaaagtagaattaatgta

SEQ ID NO: 7883640 - DNA, 22 bp, Homo sapiens
acaccaaagtagaattaatgta

SEQ ID NO: 7883641 - DNA, 22 bp, Homo sapiens
acaccaaagtagaattaatgta

SEQ ID NO: 7883642 - DNA, 22 bp, Homo sapiens
agcagggcagtgcttcagctct

SEQ ID NO: 7883643 - DNA, 22 bp, Homo sapiens
agcagggcagtgcttcagctct

SEQ ID NO: 7883644 - DNA, 22 bp, Homo sapiens
acaccagggatatgaggaagga

SEQ ID NO: 7883645 - DNA, 22 bp, Homo sapiens
acaccagggatatgaggaagga

SEQ ID NO: 7883646 - DNA, 22 bp, Homo sapiens
acaccagcctcgcccgtgtgtt

SEQ ID NO: 7883647 - DNA, 22 bp, Homo sapiens
acactgtctgggactcaggagt

SEQ ID NO: 7883648 - DNA, 22 bp, Homo sapiens
acactgtctgggactcaggagt

SEQ ID NO: 7883649 - DNA, 22 bp, Homo sapiens
acactgtctgggactcaggagt

SEQ ID NO: 7883650 - DNA, 23 bp, Homo sapiens
acactgtctcatggatagactgc

SEQ ID NO: 7883651 - DNA, 23 bp, Homo sapiens
acactgtctcatggatagactgc

SEQ ID NO: 7883652 - DNA, 22 bp, Homo sapiens
acactgtctcatatgaggggac

SEQ ID NO: 7883653 - DNA, 22 bp, Homo sapiens
acactgtatgaaaacaggaaat

SEQ ID NO: 7883654 - DNA, 22 bp, Homo sapiens
acactgtatgaaaacaggaaat

SEQ ID NO: 7883655 - DNA, 22 bp, Homo sapiens
acactgtctcatatgaggggac

SEQ ID NO: 7883656 - DNA, 22 bp, Homo sapiens
acactgtgagctgaagggctgc

SEQ ID NO: 7883657 - DNA, 22 bp, Homo sapiens
acactgtgacggaaataaagaa

SEQ ID NO: 7883658 - DNA, 22 bp, Homo sapiens
acactgtgagctgaagggctgc

SEQ ID NO: 7883659 - DNA, 22 bp, Homo sapiens
acactgtgagctgaagggctgc

SEQ ID NO: 7883660 - DNA, 22 bp, Homo sapiens
acactgtgacggaaataaagaa

SEQ ID NO: 7883661 - DNA, 22 bp, Homo sapiens
acactgtgacaagaaagagctg

SEQ ID NO: 7883662 - DNA, 22 bp, Homo sapiens
acactgtgacaagaaagagctg

SEQ ID NO: 7883663 - DNA, 22 bp, Homo sapiens
acactgtctgggactcaggagt

SEQ ID NO: 7883664 - DNA, 22 bp, Homo sapiens
acactgtgacaaaggctgttct

SEQ ID NO: 7883665 - DNA, 18 bp, Homo sapiens
acactgcagcagtctgct

SEQ ID NO: 7883666 - DNA, 18 bp, Homo sapiens
acactgcagcagtctgct

SEQ ID NO: 7883667 - DNA, 18 bp, Homo sapiens
acactgcagcagtctgct

SEQ ID NO: 7883668 - DNA, 22 bp, Homo sapiens
acactgtaggagaaaggagttt

SEQ ID NO: 7883669 - DNA, 22 bp, Homo sapiens
acactgtagatatagagttagt

SEQ ID NO: 7883670 - DNA, 22 bp, Homo sapiens
acactgtagatatagagttagt

SEQ ID NO: 7883671 - DNA, 22 bp, Homo sapiens
acactgtagactgttgaagtac

SEQ ID NO: 7883672 - DNA, 19 bp, Homo sapiens
acactgtagatatagctat

SEQ ID NO: 7883673 - DNA, 22 bp, Homo sapiens
acactgtagatatagagttagt

SEQ ID NO: 7883674 - DNA, 22 bp, Homo sapiens
agcagggccaacagtaaacacc

SEQ ID NO: 7883675 - DNA, 22 bp, Homo sapiens
agcagggccaacagtaaacacc

SEQ ID NO: 7883676 - DNA, 18 bp, Homo sapiens
agcagggcattttgccat

SEQ ID NO: 7883677 - DNA, 22 bp, Homo sapiens
agcagggcatgaataagggttt

SEQ ID NO: 7883678 - DNA, 22 bp, Homo sapiens
agcagggcatgaataagggttt

SEQ ID NO: 7883679 - DNA, 22 bp, Homo sapiens
agcagggcatgaataagggttt

SEQ ID NO: 7883680 - DNA, 22 bp, Homo sapiens
agcagggcagttaaagggtcct

SEQ ID NO: 7883681 - DNA, 22 bp, Homo sapiens
agcagggcagttaaagggtcct

SEQ ID NO: 7883682 - DNA, 22 bp, Homo sapiens
agcagggcccactaggggagat

SEQ ID NO: 7883683 - DNA, 22 bp, Homo sapiens
agcagggcccactaggggagat

SEQ ID NO: 7883684 - DNA, 22 bp, Homo sapiens
agcagggcccactaggggagat

SEQ ID NO: 7883685 - DNA, 23 bp, Homo sapiens
agcagggccagaatacttgctgt

SEQ ID NO: 7883686 - DNA, 22 bp, Homo sapiens
agcagggcccactaggggagat

SEQ ID NO: 7883687 - DNA, 22 bp, Homo sapiens
agcagggcccactaggggagat

SEQ ID NO: 7883688 - DNA, 22 bp, Homo sapiens
agcagggcccactaggggagat

SEQ ID NO: 7883689 - DNA, 22 bp, Homo sapiens
agcagggcccactaggggagat

SEQ ID NO: 7883690 - DNA, 22 bp, Homo sapiens
agcagggcccactaggggagat

SEQ ID NO: 7883691 - DNA, 22 bp, Homo sapiens
acactgcagatgaaagcataag

SEQ ID NO: 7883692 - DNA, 22 bp, Homo sapiens
agcagggcccactaggggagat

SEQ ID NO: 7883693 - DNA, 22 bp, Homo sapiens
agcagggcccactaggggagat

SEQ ID NO: 7883694 - DNA, 22 bp, Homo sapiens
agccacagtcaacctgtccata

SEQ ID NO: 7883695 - DNA, 22 bp, Homo sapiens
agccacagtcaacctgtccata

SEQ ID NO: 7883696 - DNA, 22 bp, Homo sapiens
agccacaggtgttggccagtgt

SEQ ID NO: 7883697 - DNA, 22 bp, Homo sapiens
agccacagtcaacctgtccata

SEQ ID NO: 7883698 - DNA, 22 bp, Homo sapiens
agccacaggtgttggccagtgt

SEQ ID NO: 7883699 - DNA, 22 bp, Homo sapiens
agccacagtcaacctgtccata

SEQ ID NO: 7883700 - DNA, 22 bp, Homo sapiens
agccacagtcaacctgtccata

SEQ ID NO: 7883701 - DNA, 22 bp, Homo sapiens
agccacagtcaacctgtccata

SEQ ID NO: 7883702 - DNA, 22 bp, Homo sapiens
agccacagtcaacctgtccata

SEQ ID NO: 7883703 - DNA, 22 bp, Homo sapiens
agccacagtctgatgcctgaga

SEQ ID NO: 7883704 - DNA, 22 bp, Homo sapiens
agccacagtcaacctgtccata

SEQ ID NO: 7883705 - DNA, 22 bp, Homo sapiens
agccacagtcaacctgtccata

SEQ ID NO: 7883706 - DNA, 22 bp, Homo sapiens
agccacagtcaacctgtccata

SEQ ID NO: 7883707 - DNA, 22 bp, Homo sapiens
agccacagtcaacctgtccata

SEQ ID NO: 7883708 - DNA, 22 bp, Homo sapiens
agccatcctccacagccttgat

SEQ ID NO: 7883709 - DNA, 22 bp, Homo sapiens
agccatcctccacagccttgat

SEQ ID NO: 7883710 - DNA, 22 bp, Homo sapiens
agccatcctcccacctcagcct

SEQ ID NO: 7883711 - DNA, 21 bp, Homo sapiens
agccatcctgaatggtgccat

SEQ ID NO: 7883712 - DNA, 22 bp, Homo sapiens
agccagggtgggtgaatgctat

SEQ ID NO: 7883713 - DNA, 22 bp, Homo sapiens
agccagggtgggtgaatgctat

SEQ ID NO: 7883714 - DNA, 22 bp, Homo sapiens
agccagggtgggtgaatgctat

SEQ ID NO: 7883715 - DNA, 22 bp, Homo sapiens
agccatcctccacagccttgat

SEQ ID NO: 7883716 - DNA, 22 bp, Homo sapiens
agccagggtgggtgaatgctat

SEQ ID NO: 7883717 - DNA, 22 bp, Homo sapiens
agccagggtgggtgaatgctat

SEQ ID NO: 7883718 - DNA, 22 bp, Homo sapiens
agccacagtctgatgcctgaga

SEQ ID NO: 7883719 - DNA, 22 bp, Homo sapiens
agccacagtctgatgcctgaga

SEQ ID NO: 7883720 - DNA, 21 bp, Homo sapiens
agccagggtggacactgtatg

SEQ ID NO: 7883721 - DNA, 22 bp, Homo sapiens
agccacagtctgatgcctgaga

SEQ ID NO: 7883722 - DNA, 21 bp, Homo sapiens
agccagggtggacactgtatg

SEQ ID NO: 7883723 - DNA, 21 bp, Homo sapiens
agccagggtggacactgtatg

SEQ ID NO: 7883724 - DNA, 21 bp, Homo sapiens
agccagggtggacactgtatg

SEQ ID NO: 7883725 - DNA, 22 bp, Homo sapiens
agccacagtctgatgcctgaga

SEQ ID NO: 7883726 - DNA, 22 bp, Homo sapiens
agccacagtctgatgcctgaga

SEQ ID NO: 7883727 - DNA, 22 bp, Homo sapiens
agccacagtctgatgcctgaga

SEQ ID NO: 7883728 - DNA, 22 bp, Homo sapiens
agccatgctccttcccctctgg

SEQ ID NO: 7883729 - DNA, 22 bp, Homo sapiens
agccatgctcagttcctggagc

SEQ ID NO: 7883730 - DNA, 22 bp, Homo sapiens
agccatgcaccttactcttgct

SEQ ID NO: 7883731 - DNA, 22 bp, Homo sapiens
agccatgaccttgcagacctgc

SEQ ID NO: 7883732 - DNA, 22 bp, Homo sapiens
agccatcctcccacctcagcct

SEQ ID NO: 7883733 - DNA, 22 bp, Homo sapiens
agccatgcaccttactcttgct

SEQ ID NO: 7883734 - DNA, 22 bp, Homo sapiens
agccatctaagaaatacaaaat

SEQ ID NO: 7883735 - DNA, 22 bp, Homo sapiens
agccatctgaattagctttgtt

SEQ ID NO: 7883736 - DNA, 22 bp, Homo sapiens
agccatggcgccactagaggga

SEQ ID NO: 7883737 - DNA, 22 bp, Homo sapiens
agccatggcgccactagaggga

SEQ ID NO: 7883738 - DNA, 22 bp, Homo sapiens
agccattcattgtgctctcaga

SEQ ID NO: 7883739 - DNA, 22 bp, Homo sapiens
agccatttcatacacctgcagc

SEQ ID NO: 7883740 - DNA, 22 bp, Homo sapiens
agccatgtcacatatggtcatc

SEQ ID NO: 7883741 - DNA, 22 bp, Homo sapiens
agccatgggctcccagtccttt

SEQ ID NO: 7883742 - DNA, 22 bp, Homo sapiens
agccatgggctcccagtccttt

SEQ ID NO: 7883743 - DNA, 22 bp, Homo sapiens
agccatgggctcccagtccttt

SEQ ID NO: 7883744 - DNA, 22 bp, Homo sapiens
agccatgggctcccagtccttt

SEQ ID NO: 7883745 - DNA, 22 bp, Homo sapiens
agccatggtctcagggccataa

SEQ ID NO: 7883746 - DNA, 22 bp, Homo sapiens
agcccaaacctgcgagcagagc

SEQ ID NO: 7883747 - DNA, 22 bp, Homo sapiens
agcccaaacctgcgagcagagc

SEQ ID NO: 7883748 - DNA, 22 bp, Homo sapiens
agcccaaacctgcgagcagagc

SEQ ID NO: 7883749 - DNA, 22 bp, Homo sapiens
agcccaaactcatggtcctttg

SEQ ID NO: 7883750 - DNA, 22 bp, Homo sapiens
agcccagcggagcgggcccggg

SEQ ID NO: 7883751 - DNA, 22 bp, Homo sapiens
agcccagcctgattctacaccc

SEQ ID NO: 7883752 - DNA, 22 bp, Homo sapiens
agcccagcggagcgggcccggg

SEQ ID NO: 7883753 - DNA, 22 bp, Homo sapiens
agccattttcctgaaatataac

SEQ ID NO: 7883754 - DNA, 22 bp, Homo sapiens
agccatttggacttctggtagg

SEQ ID NO: 7883755 - DNA, 22 bp, Homo sapiens
agccatttcctgaactctggac

SEQ ID NO: 7883756 - DNA, 22 bp, Homo sapiens
agccattttggtaatgataaca

SEQ ID NO: 7883757 - DNA, 22 bp, Homo sapiens
agccattttcctgaaatataac

SEQ ID NO: 7883758 - DNA, 22 bp, Homo sapiens
agccattttcctgaaatataac

SEQ ID NO: 7883759 - DNA, 22 bp, Homo sapiens
agcccagctcctccacagaata

SEQ ID NO: 7883760 - DNA, 22 bp, Homo sapiens
agcccagctcctccacagaata

SEQ ID NO: 7883761 - DNA, 22 bp, Homo sapiens
agcccagctcctccacagaata

SEQ ID NO: 7883762 - DNA, 22 bp, Homo sapiens
agcccagctgcctgcctgctgt

SEQ ID NO: 7883763 - DNA, 18 bp, Homo sapiens
agcccagcggagtgaatc

SEQ ID NO: 7883764 - DNA, 18 bp, Homo sapiens
agcccagcggagtgaatc

SEQ ID NO: 7883765 - DNA, 18 bp, Homo sapiens
agcccagcggagtgaatc

SEQ ID NO: 7883766 - DNA, 22 bp, Homo sapiens
agcccagctgctatgtacctgg

SEQ ID NO: 7883767 - DNA, 22 bp, Homo sapiens
agcccagctgctatgtacctgg

SEQ ID NO: 7883768 - DNA, 22 bp, Homo sapiens
agcccagctgcctgcctgctgt

SEQ ID NO: 7883769 - DNA, 22 bp, Homo sapiens
agcccagctgcctgcctgctgt

SEQ ID NO: 7883770 - DNA, 22 bp, Homo sapiens
agcccagctgcctgcctgctgt

SEQ ID NO: 7883771 - DNA, 22 bp, Homo sapiens
agcccagctgcctgcctgctgt

SEQ ID NO: 7883772 - DNA, 22 bp, Homo sapiens
agcccagctgcctgcctgctgt

SEQ ID NO: 7883773 - DNA, 22 bp, Homo sapiens
agcccagctgcctgcctgctgt

SEQ ID NO: 7883774 - DNA, 22 bp, Homo sapiens
acagagcagtaagaacacagct

SEQ ID NO: 7883775 - DNA, 22 bp, Homo sapiens
acagagcagtaagaacacagct

SEQ ID NO: 7883776 - DNA, 22 bp, Homo sapiens
acagagcagtaagaacacagct

SEQ ID NO: 7883777 - DNA, 22 bp, Homo sapiens
acagagcaggtccagaagtgcc

SEQ ID NO: 7883778 - DNA, 22 bp, Homo sapiens
acagagcagtaagaacacagct

SEQ ID NO: 7883779 - DNA, 22 bp, Homo sapiens
acagagcaggtccagaagtgcc

SEQ ID NO: 7883780 - DNA, 22 bp, Homo sapiens
acagagcaggtccagaagtgcc

SEQ ID NO: 7883781 - DNA, 22 bp, Homo sapiens
acagagcaggtccagaagtgcc

SEQ ID NO: 7883782 - DNA, 22 bp, Homo sapiens
acagagcactgccctgtgccgc

SEQ ID NO: 7883783 - DNA, 22 bp, Homo sapiens
acagagcaggtccagaagtgcc

SEQ ID NO: 7883784 - DNA, 22 bp, Homo sapiens
acagagatcagaggcataagca

SEQ ID NO: 7883785 - DNA, 17 bp, Homo sapiens
acagagcacatcaagat

SEQ ID NO: 7883786 - DNA, 17 bp, Homo sapiens
acagagcacatcaagat

SEQ ID NO: 7883787 - DNA, 22 bp, Homo sapiens
acagagcactgccctgtgccgc

SEQ ID NO: 7883788 - DNA, 22 bp, Homo sapiens
acagagcactgccctgtgccgc

SEQ ID NO: 7883789 - DNA, 22 bp, Homo sapiens
acagagcactgccctgtgccgc

SEQ ID NO: 7883790 - DNA, 22 bp, Homo sapiens
acagagcactgccctgtgccgc

SEQ ID NO: 7883791 - DNA, 22 bp, Homo sapiens
acagagcactgccctgtgccgc

SEQ ID NO: 7883792 - DNA, 22 bp, Homo sapiens
acagagaggtaaaatatatagt

SEQ ID NO: 7883793 - DNA, 22 bp, Homo sapiens
agcccagctttcacccctctgg

SEQ ID NO: 7883794 - DNA, 22 bp, Homo sapiens
acagagagggagtgataaatcc

SEQ ID NO: 7883795 - DNA, 22 bp, Homo sapiens
acagagagggagtgataaatcc

SEQ ID NO: 7883796 - DNA, 22 bp, Homo sapiens
agcccagctttcacccctctgg

SEQ ID NO: 7883797 - DNA, 22 bp, Homo sapiens
agcccagcttccttctgtctct

SEQ ID NO: 7883798 - DNA, 22 bp, Homo sapiens
agcccagcttccttctgtctct

SEQ ID NO: 7883799 - DNA, 22 bp, Homo sapiens
agcccagcttccttctgtctct

SEQ ID NO: 7883800 - DNA, 22 bp, Homo sapiens
agcccagcttccttctgtctct

SEQ ID NO: 7883801 - DNA, 19 bp, Homo sapiens
agcccagcttatttgtcag

SEQ ID NO: 7883802 - DNA, 22 bp, Homo sapiens
agcccagctgctatgtacctgg

SEQ ID NO: 7883803 - DNA, 22 bp, Homo sapiens
agccccccaagggccttctctt

SEQ ID NO: 7883804 - DNA, 22 bp, Homo sapiens
agcccccaggagtctccacgcc

SEQ ID NO: 7883805 - DNA, 22 bp, Homo sapiens
agcccccaggagtctccacgcc

SEQ ID NO: 7883806 - DNA, 22 bp, Homo sapiens
agcccccaggatgcaaaatgac

SEQ ID NO: 7883807 - DNA, 22 bp, Homo sapiens
agcccccaggagtctccacgcc

SEQ ID NO: 7883808 - DNA, 19 bp, Homo sapiens
agcccccagacagcaggcc

SEQ ID NO: 7883809 - DNA, 22 bp, Homo sapiens
agcccccaggagtctccacgcc

SEQ ID NO: 7883810 - DNA, 22 bp, Homo sapiens
acagagcatttgggacagagag

SEQ ID NO: 7883811 - DNA, 22 bp, Homo sapiens
acagagcatttgggacagagag

SEQ ID NO: 7883812 - DNA, 22 bp, Homo sapiens
acagagcatttgggacagagag

SEQ ID NO: 7883813 - DNA, 22 bp, Homo sapiens
agcccctctccgccctgagtcg

SEQ ID NO: 7883814 - DNA, 22 bp, Homo sapiens
agcccctccagtggcataaaat

SEQ ID NO: 7883815 - DNA, 22 bp, Homo sapiens
agcccctccagtggcataaaat

SEQ ID NO: 7883816 - DNA, 22 bp, Homo sapiens
agcccctctgtagctaatagta

SEQ ID NO: 7883817 - DNA, 22 bp, Homo sapiens
agcccctctgtggctctgcctc

SEQ ID NO: 7883818 - DNA, 22 bp, Homo sapiens
agcccctctccgccctgagtcg

SEQ ID NO: 7883819 - DNA, 22 bp, Homo sapiens
agcccctctgtagctaatagta

SEQ ID NO: 7883820 - DNA, 17 bp, Homo sapiens
agcccctcagcgtcacc

SEQ ID NO: 7883821 - DNA, 23 bp, Homo sapiens
agcccctcatatctgctttctct

SEQ ID NO: 7883822 - DNA, 23 bp, Homo sapiens
agcccctcatggtgtctagacag

SEQ ID NO: 7883823 - DNA, 23 bp, Homo sapiens
agcccctcatatctgctttctct

SEQ ID NO: 7883824 - DNA, 23 bp, Homo sapiens
agcccctcatggtgtctagacag

SEQ ID NO: 7883825 - DNA, 21 bp, Homo sapiens
acagagcataatggtgtggca

SEQ ID NO: 7883826 - DNA, 21 bp, Homo sapiens
acagagcataatggtgtggca

SEQ ID NO: 7883827 - DNA, 21 bp, Homo sapiens
acagagcataatggtgtggca

SEQ ID NO: 7883828 - DNA, 22 bp, Homo sapiens
acagagcataatgtctagcaca

SEQ ID NO: 7883829 - DNA, 22 bp, Homo sapiens
acagagcataatgtctagcaca

SEQ ID NO: 7883830 - DNA, 22 bp, Homo sapiens
acagagcataatgtctagcaca

SEQ ID NO: 7883831 - DNA, 22 bp, Homo sapiens
acagagcataatgtctagcaca

SEQ ID NO: 7883832 - DNA, 22 bp, Homo sapiens
acagagcataatgtctagcaca

SEQ ID NO: 7883833 - DNA, 22 bp, Homo sapiens
acagagcataatgtctagcaca

SEQ ID NO: 7883834 - DNA, 22 bp, Homo sapiens
acagagcagtaagaacacagct

SEQ ID NO: 7883835 - DNA, 22 bp, Homo sapiens
acagagcagtaagaacacagct

SEQ ID NO: 7883836 - DNA, 22 bp, Homo sapiens
acagagcagtaagaacacagct

SEQ ID NO: 7883837 - DNA, 22 bp, Homo sapiens
acagagcagttctggagctggc

SEQ ID NO: 7883838 - DNA, 22 bp, Homo sapiens
acagagcagttctggagctggc

SEQ ID NO: 7883839 - DNA, 22 bp, Homo sapiens
acagagcagttctggagctggc

SEQ ID NO: 7883840 - DNA, 22 bp, Homo sapiens
acagagcatgctcagtgtgtga

SEQ ID NO: 7883841 - DNA, 22 bp, Homo sapiens
acagagcatttgggacagagag

SEQ ID NO: 7883842 - DNA, 22 bp, Homo sapiens
acagagcatataaagtgctttg

SEQ ID NO: 7883843 - DNA, 22 bp, Homo sapiens
acagagcatgctcagtgtgtga

SEQ ID NO: 7883844 - DNA, 22 bp, Homo sapiens
acagagcatttgggacagagag

SEQ ID NO: 7883845 - DNA, 22 bp, Homo sapiens
acagagcatttgggacagagag

SEQ ID NO: 7883846 - DNA, 22 bp, Homo sapiens
acagagcatttgggacagagag

SEQ ID NO: 7883847 - DNA, 22 bp, Homo sapiens
acagagcatgatggaagatcga

SEQ ID NO: 7883848 - DNA, 22 bp, Homo sapiens
acagagcatgatggaagatcga

SEQ ID NO: 7883849 - DNA, 22 bp, Homo sapiens
acagagcatgatggaagatcga

SEQ ID NO: 7883850 - DNA, 22 bp, Homo sapiens
acagagcatgatggaagatcga

SEQ ID NO: 7883851 - DNA, 22 bp, Homo sapiens
acagagcatgctcagtgtgtga

SEQ ID NO: 7883852 - DNA, 22 bp, Homo sapiens
acagagcatataaagtgctttg

SEQ ID NO: 7883853 - DNA, 22 bp, Homo sapiens
acagagcatataaagtgctttg

SEQ ID NO: 7883854 - DNA, 22 bp, Homo sapiens
acagagcatataaagtgctttg

SEQ ID NO: 7883855 - DNA, 22 bp, Homo sapiens
acagagcatataaagtgctttg

SEQ ID NO: 7883856 - DNA, 22 bp, Homo sapiens
acagagcatcagatgaaatcaa

SEQ ID NO: 7883857 - DNA, 22 bp, Homo sapiens
acagagcatcagatgaaatcaa

SEQ ID NO: 7883858 - DNA, 22 bp, Homo sapiens
acagagcatcagatgaaatcaa

SEQ ID NO: 7883859 - DNA, 22 bp, Homo sapiens
acagagcatcagatgaaatcaa

SEQ ID NO: 7883860 - DNA, 22 bp, Homo sapiens
acagagtctcaaacctacaaag

SEQ ID NO: 7883861 - DNA, 22 bp, Homo sapiens
acagaggtggacctcagcaggc

SEQ ID NO: 7883862 - DNA, 22 bp, Homo sapiens
acagaggtggacctcagcaggc

SEQ ID NO: 7883863 - DNA, 22 bp, Homo sapiens
acagagtcttacgtggtgataa

SEQ ID NO: 7883864 - DNA, 22 bp, Homo sapiens
acagagtctgacaggtaggcgc

SEQ ID NO: 7883865 - DNA, 22 bp, Homo sapiens
acagagtctgacaggtaggcgc

SEQ ID NO: 7883866 - DNA, 22 bp, Homo sapiens
acagagtctcagggatgaaagc

SEQ ID NO: 7883867 - DNA, 22 bp, Homo sapiens
agcccctctgtggctctgcctc

SEQ ID NO: 7883868 - DNA, 22 bp, Homo sapiens
agcccctgggagtagctgctgc

SEQ ID NO: 7883869 - DNA, 22 bp, Homo sapiens
agcccctgctgggtgtagctca

SEQ ID NO: 7883870 - DNA, 22 bp, Homo sapiens
agcccctgctgggtgtagctca

SEQ ID NO: 7883871 - DNA, 22 bp, Homo sapiens
agcccctgctgggtgtagctca

SEQ ID NO: 7883872 - DNA, 23 bp, Homo sapiens
acagaggtccaaacagtataagc

SEQ ID NO: 7883873 - DNA, 22 bp, Homo sapiens
agcccctgtaccctgagtgctt

SEQ ID NO: 7883874 - DNA, 22 bp, Homo sapiens
agcccctgtaccctgagtgctt

SEQ ID NO: 7883875 - DNA, 22 bp, Homo sapiens
agcccctgtaccctgagtgctt

SEQ ID NO: 7883876 - DNA, 22 bp, Homo sapiens
agcccctgggagtagctgctgc

SEQ ID NO: 7883877 - DNA, 22 bp, Homo sapiens
agcccctgggagtagctgctgc

SEQ ID NO: 7883878 - DNA, 22 bp, Homo sapiens
agcccctgtaccctgagtgctt

SEQ ID NO: 7883879 - DNA, 22 bp, Homo sapiens
acagataaaagttgtttaaaat

SEQ ID NO: 7883880 - DNA, 22 bp, Homo sapiens
acagataaagaaacaatcacag

SEQ ID NO: 7883881 - DNA, 22 bp, Homo sapiens
acagagtttatgtgtgtacaaa

SEQ ID NO: 7883882 - DNA, 22 bp, Homo sapiens
acagataaggcagttaagagtt

SEQ ID NO: 7883883 - DNA, 22 bp, Homo sapiens
acagataaagaaacaatcacag

SEQ ID NO: 7883884 - DNA, 22 bp, Homo sapiens
acagataatacattgtgctaca

SEQ ID NO: 7883885 - DNA, 22 bp, Homo sapiens
acagataatacattgtgctaca

SEQ ID NO: 7883886 - DNA, 22 bp, Homo sapiens
agcctgagtgcttaggactgtt

SEQ ID NO: 7883887 - DNA, 22 bp, Homo sapiens
acagagttagcagaaagttgga

SEQ ID NO: 7883888 - DNA, 22 bp, Homo sapiens
acagagttcccactccagaagc

SEQ ID NO: 7883889 - DNA, 22 bp, Homo sapiens
acagagttcccactccagaagc

SEQ ID NO: 7883890 - DNA, 22 bp, Homo sapiens
acagagttgtgtttgtacaacg

SEQ ID NO: 7883891 - DNA, 22 bp, Homo sapiens
acagagttgtgtttgtacaacg

SEQ ID NO: 7883892 - DNA, 22 bp, Homo sapiens
acagagttgtgtttgtacaacg

SEQ ID NO: 7883893 - DNA, 22 bp, Homo sapiens
acagagttaatggataggcagg

SEQ ID NO: 7883894 - DNA, 22 bp, Homo sapiens
acagagtgtttttaagtatatt

SEQ ID NO: 7883895 - DNA, 22 bp, Homo sapiens
acagagtggagttcagtaaata

SEQ ID NO: 7883896 - DNA, 23 bp, Homo sapiens
agctataaaatctgtgacagcag

SEQ ID NO: 7883897 - DNA, 22 bp, Homo sapiens
agctagttaaactatgaataca

SEQ ID NO: 7883898 - DNA, 22 bp, Homo sapiens
agctagtgggctgggagaggaa

SEQ ID NO: 7883899 - DNA, 22 bp, Homo sapiens
agctagttaaactatgaataca

SEQ ID NO: 7883900 - DNA, 22 bp, Homo sapiens
agctaggggaccaaggtggccc

SEQ ID NO: 7883901 - DNA, 22 bp, Homo sapiens
agctaggggaccaaggtggccc

SEQ ID NO: 7883902 - DNA, 22 bp, Homo sapiens
agctaggggaccaaggtggccc

SEQ ID NO: 7883903 - DNA, 22 bp, Homo sapiens
agctaggggaccaaggtggccc

SEQ ID NO: 7883904 - DNA, 22 bp, Homo sapiens
agctaggggaccaaggtggccc

SEQ ID NO: 7883905 - DNA, 19 bp, Homo sapiens
agctagtgctcagctgtca

SEQ ID NO: 7883906 - DNA, 22 bp, Homo sapiens
agctagggacagataccagcca

SEQ ID NO: 7883907 - DNA, 22 bp, Homo sapiens
agctaggataagcagagactgg

SEQ ID NO: 7883908 - DNA, 22 bp, Homo sapiens
agctaggccatttgttcagtga

SEQ ID NO: 7883909 - DNA, 17 bp, Homo sapiens
agctagggcctagaatc

SEQ ID NO: 7883910 - DNA, 22 bp, Homo sapiens
agctaggggaccaaggtggccc

SEQ ID NO: 7883911 - DNA, 22 bp, Homo sapiens
agctaggataagcagagactgg

SEQ ID NO: 7883912 - DNA, 22 bp, Homo sapiens
acagcaatcaatatggcattct

SEQ ID NO: 7883913 - DNA, 22 bp, Homo sapiens
acagcaataggaaatacttgca

SEQ ID NO: 7883914 - DNA, 22 bp, Homo sapiens
acagcaataggaaatacttgca

SEQ ID NO: 7883915 - DNA, 22 bp, Homo sapiens
acagcaataggaaatacttgca

SEQ ID NO: 7883916 - DNA, 21 bp, Homo sapiens
acagcaagccttcacatgagt

SEQ ID NO: 7883917 - DNA, 21 bp, Homo sapiens
acagcaagccttcacatgagt

SEQ ID NO: 7883918 - DNA, 21 bp, Homo sapiens
acagcaagccttcctttcagg

SEQ ID NO: 7883919 - DNA, 23 bp, Homo sapiens
acagcaagaggaccagatgtgag

SEQ ID NO: 7883920 - DNA, 23 bp, Homo sapiens
acagcaagaggaccagatgtgag

SEQ ID NO: 7883921 - DNA, 23 bp, Homo sapiens
acagcaagaggaccagatgtgag

SEQ ID NO: 7883922 - DNA, 23 bp, Homo sapiens
acagcaagaggaccagatgtgag

SEQ ID NO: 7883923 - DNA, 22 bp, Homo sapiens
acagcaagacccctagcatggt

SEQ ID NO: 7883924 - DNA, 23 bp, Homo sapiens
acagcaagaggaccagatgtgag

SEQ ID NO: 7883925 - DNA, 22 bp, Homo sapiens
acagcaagccagcttgtcactg

SEQ ID NO: 7883926 - DNA, 22 bp, Homo sapiens
acagcaagccagcttgtcactg

SEQ ID NO: 7883927 - DNA, 21 bp, Homo sapiens
acagcaagccttcacatgagt

SEQ ID NO: 7883928 - DNA, 21 bp, Homo sapiens
acagcaagccttcacatgagt

SEQ ID NO: 7883929 - DNA, 21 bp, Homo sapiens
acagcaagccttcacatgagt

SEQ ID NO: 7883930 - DNA, 22 bp, Homo sapiens
acagcaaaagacaagaacttaa

SEQ ID NO: 7883931 - DNA, 22 bp, Homo sapiens
acagcaaaagacaagaacttaa

SEQ ID NO: 7883932 - DNA, 22 bp, Homo sapiens
acagcaaaggacgaacactctg

SEQ ID NO: 7883933 - DNA, 22 bp, Homo sapiens
acagcaaaggacgaacactctg

SEQ ID NO: 7883934 - DNA, 22 bp, Homo sapiens
acagcaaaggacgaacactctg

SEQ ID NO: 7883935 - DNA, 22 bp, Homo sapiens
acagcaaaggacgaacactctg

SEQ ID NO: 7883936 - DNA, 22 bp, Homo sapiens
acagcaactcctgcttctgagt

SEQ ID NO: 7883937 - DNA, 22 bp, Homo sapiens
acagcaactcctgcttctgagt

SEQ ID NO: 7883938 - DNA, 22 bp, Homo sapiens
acagcaagacccctagcatggt

SEQ ID NO: 7883939 - DNA, 22 bp, Homo sapiens
acagcaagacccctagcatggt

SEQ ID NO: 7883940 - DNA, 22 bp, Homo sapiens
acagcaaaggacgaacactctg

SEQ ID NO: 7883941 - DNA, 22 bp, Homo sapiens
acagcaaatggttttctgtctg

SEQ ID NO: 7883942 - DNA, 22 bp, Homo sapiens
acagcaaatggttttctgtctg

SEQ ID NO: 7883943 - DNA, 22 bp, Homo sapiens
agcctgcgatcccacctggcct

SEQ ID NO: 7883944 - DNA, 22 bp, Homo sapiens
agcctgcgatcccacctggcct

SEQ ID NO: 7883945 - DNA, 22 bp, Homo sapiens
agcctgccttgggctgcttgag

SEQ ID NO: 7883946 - DNA, 22 bp, Homo sapiens
agcctgcgatcccacctggcct

SEQ ID NO: 7883947 - DNA, 17 bp, Homo sapiens
agcctgctgatctcaca

SEQ ID NO: 7883948 - DNA, 17 bp, Homo sapiens
agcctgctgatctcaca

SEQ ID NO: 7883949 - DNA, 22 bp, Homo sapiens
acagattgaagtccagaatggc

SEQ ID NO: 7883950 - DNA, 22 bp, Homo sapiens
acagattgaagtccagaatggc

SEQ ID NO: 7883951 - DNA, 21 bp, Homo sapiens
acagattgctgagctctacct

SEQ ID NO: 7883952 - DNA, 22 bp, Homo sapiens
acagatttaggactgtagcgat

SEQ ID NO: 7883953 - DNA, 17 bp, Homo sapiens
agcctgccccatgctgc

SEQ ID NO: 7883954 - DNA, 22 bp, Homo sapiens
agcctgcctcagactcaggata

SEQ ID NO: 7883955 - DNA, 17 bp, Homo sapiens
agcctgccccatgctgc

SEQ ID NO: 7883956 - DNA, 22 bp, Homo sapiens
agcctgcctcagactcaggata

SEQ ID NO: 7883957 - DNA, 17 bp, Homo sapiens
agcctgccccatgctgc

SEQ ID NO: 7883958 - DNA, 17 bp, Homo sapiens
agcctgccccatgctgc

SEQ ID NO: 7883959 - DNA, 22 bp, Homo sapiens
agcctgccaggcgctgcctgga

SEQ ID NO: 7883960 - DNA, 22 bp, Homo sapiens
agcctgcctgtgaggctttgag

SEQ ID NO: 7883961 - DNA, 21 bp, Homo sapiens
agcctgcctgaactctgtggc

SEQ ID NO: 7883962 - DNA, 22 bp, Homo sapiens
agcctgcctgtgaggctttgag

SEQ ID NO: 7883963 - DNA, 22 bp, Homo sapiens
agcctgcctcagactcaggata

SEQ ID NO: 7883964 - DNA, 22 bp, Homo sapiens
agcctgcctcagactcaggata

SEQ ID NO: 7883965 - DNA, 22 bp, Homo sapiens
agcctgcctcagactcaggata

SEQ ID NO: 7883966 - DNA, 22 bp, Homo sapiens
agcctgcctcagactcaggata

SEQ ID NO: 7883967 - DNA, 22 bp, Homo sapiens
agcctgcacctgaccaacctgc

SEQ ID NO: 7883968 - DNA, 21 bp, Homo sapiens
agcctgcaatgtaggtaccgg

SEQ ID NO: 7883969 - DNA, 22 bp, Homo sapiens
agcctgcacctgaccaacctgc

SEQ ID NO: 7883970 - DNA, 22 bp, Homo sapiens
agcctgcaggatgggcagcacc

SEQ ID NO: 7883971 - DNA, 22 bp, Homo sapiens
agcctgcaggatgggcagcacc

SEQ ID NO: 7883972 - DNA, 22 bp, Homo sapiens
agcctgcaggatgggcagcacc

SEQ ID NO: 7883973 - DNA, 20 bp, Homo sapiens
agcctgccagctggcccaga

SEQ ID NO: 7883974 - DNA, 20 bp, Homo sapiens
agcctgccagctggcccaga

SEQ ID NO: 7883975 - DNA, 20 bp, Homo sapiens
agcctgccagctggcccaga

SEQ ID NO: 7883976 - DNA, 22 bp, Homo sapiens
agcctgccaggcgctgcctgga

SEQ ID NO: 7883977 - DNA, 20 bp, Homo sapiens
agcctgccagctggcccaga

SEQ ID NO: 7883978 - DNA, 20 bp, Homo sapiens
agcctgccagctggcccaga

SEQ ID NO: 7883979 - DNA, 22 bp, Homo sapiens
agcctgccaggcgctgcctgga

SEQ ID NO: 7883980 - DNA, 22 bp, Homo sapiens
agcctgccaggcgctgcctgga

SEQ ID NO: 7883981 - DNA, 22 bp, Homo sapiens
agcctgccaggcgctgcctgga

SEQ ID NO: 7883982 - DNA, 19 bp, Homo sapiens
agctcctgttcagcagctc

SEQ ID NO: 7883983 - DNA, 19 bp, Homo sapiens
agctcctgttcagcagctc

SEQ ID NO: 7883984 - DNA, 19 bp, Homo sapiens
agctcctgttcagcagctc

SEQ ID NO: 7883985 - DNA, 19 bp, Homo sapiens
agctcctgttcagcagctc

SEQ ID NO: 7883986 - DNA, 19 bp, Homo sapiens
agctcctgttcagcagctc

SEQ ID NO: 7883987 - DNA, 22 bp, Homo sapiens
agctcctgttctgagagcagga

SEQ ID NO: 7883988 - DNA, 19 bp, Homo sapiens
agctcctgttcagcagctc

SEQ ID NO: 7883989 - DNA, 22 bp, Homo sapiens
agctcctgttctgagagcagga

SEQ ID NO: 7883990 - DNA, 22 bp, Homo sapiens
agctcctgttctgagagcagga

SEQ ID NO: 7883991 - DNA, 22 bp, Homo sapiens
agctcctgttctgagagcagga

SEQ ID NO: 7883992 - DNA, 22 bp, Homo sapiens
agctcctgttctgagagcagga

SEQ ID NO: 7883993 - DNA, 22 bp, Homo sapiens
agctcctgttctgagagcagga

SEQ ID NO: 7883994 - DNA, 22 bp, Homo sapiens
agctccttgaaggcagtagctg

SEQ ID NO: 7883995 - DNA, 22 bp, Homo sapiens
agctccttgaagggctctggga

SEQ ID NO: 7883996 - DNA, 22 bp, Homo sapiens
agctccttgaagggctctggga

SEQ ID NO: 7883997 - DNA, 22 bp, Homo sapiens
agctccttgaaggcagtagctg

SEQ ID NO: 7883998 - DNA, 22 bp, Homo sapiens
agctctcaagataagaaagaac

SEQ ID NO: 7883999 - DNA, 20 bp, Homo sapiens
agctctcagcatgctgcctg

SEQ ID NO: 7884000 - DNA, 22 bp, Homo sapiens
agctctcaagataagaaagaac

SEQ ID NO: 7884001 - DNA, 22 bp, Homo sapiens
agctctcattactttacagatg

SEQ ID NO: 7884002 - DNA, 22 bp, Homo sapiens
agctctccacacataggactag

SEQ ID NO: 7884003 - DNA, 22 bp, Homo sapiens
agctccttgaagggctctggga

SEQ ID NO: 7884004 - DNA, 22 bp, Homo sapiens
agctccttgaagggctctggga

SEQ ID NO: 7884005 - DNA, 22 bp, Homo sapiens
agctccttgaagggctctggga

SEQ ID NO: 7884006 - DNA, 22 bp, Homo sapiens
agctctaaatggaattttgcct

SEQ ID NO: 7884007 - DNA, 22 bp, Homo sapiens
agctctatcacctgtcagttgc

SEQ ID NO: 7884008 - DNA, 22 bp, Homo sapiens
agctcgcccctccctcttattt

SEQ ID NO: 7884009 - DNA, 22 bp, Homo sapiens
agctctgggggaaagtctgctc

SEQ ID NO: 7884010 - DNA, 22 bp, Homo sapiens
agctctgggggaaagtctgctc

SEQ ID NO: 7884011 - DNA, 22 bp, Homo sapiens
agctctgggggaaagtctgctc

SEQ ID NO: 7884012 - DNA, 22 bp, Homo sapiens
agctctgggggaaagtctgctc

SEQ ID NO: 7884013 - DNA, 22 bp, Homo sapiens
agctctgggggaaagtctgctc

SEQ ID NO: 7884014 - DNA, 22 bp, Homo sapiens
agctctggggtagggcccaaca

SEQ ID NO: 7884015 - DNA, 22 bp, Homo sapiens
agctctggggtagggcccaaca

SEQ ID NO: 7884016 - DNA, 22 bp, Homo sapiens
agctctggggtagggcccaaca

SEQ ID NO: 7884017 - DNA, 22 bp, Homo sapiens
agctctggggtggagcccagga

SEQ ID NO: 7884018 - DNA, 22 bp, Homo sapiens
agctctggggcctgtcccacat

SEQ ID NO: 7884019 - DNA, 18 bp, Homo sapiens
agctctggggagatgggc

SEQ ID NO: 7884020 - DNA, 22 bp, Homo sapiens
agctctggggcctgtcccacat

SEQ ID NO: 7884021 - DNA, 22 bp, Homo sapiens
agctctgggggaaagtctgctc

SEQ ID NO: 7884022 - DNA, 22 bp, Homo sapiens
agctctgggggaaagtctgctc

SEQ ID NO: 7884023 - DNA, 22 bp, Homo sapiens
agctctggggcctgtcccacat

SEQ ID NO: 7884024 - DNA, 18 bp, Homo sapiens
agctctggggagatgggc

SEQ ID NO: 7884025 - DNA, 18 bp, Homo sapiens
agctctggggagatgggc

SEQ ID NO: 7884026 - DNA, 18 bp, Homo sapiens
agctctggggagatgggc

SEQ ID NO: 7884027 - DNA, 18 bp, Homo sapiens
agctctggggagatgggc

SEQ ID NO: 7884028 - DNA, 22 bp, Homo sapiens
agctctgggctgacatgctccc

SEQ ID NO: 7884029 - DNA, 22 bp, Homo sapiens
agctctgggctgacatgctccc

SEQ ID NO: 7884030 - DNA, 22 bp, Homo sapiens
agctctgggctgacatgctccc

SEQ ID NO: 7884031 - DNA, 22 bp, Homo sapiens
agctctgggctgacatgctccc

SEQ ID NO: 7884032 - DNA, 22 bp, Homo sapiens
agctctccatctatctgtgatg

SEQ ID NO: 7884033 - DNA, 22 bp, Homo sapiens
agctctccatctatctgtgatg

SEQ ID NO: 7884034 - DNA, 22 bp, Homo sapiens
agctctccatctatctgtgatg

SEQ ID NO: 7884035 - DNA, 22 bp, Homo sapiens
agctctcccaccttcttcttac

SEQ ID NO: 7884036 - DNA, 22 bp, Homo sapiens
agctctgggccaggaaccctaa

SEQ ID NO: 7884037 - DNA, 22 bp, Homo sapiens
agctctgggccaggaaccctaa

SEQ ID NO: 7884038 - DNA, 22 bp, Homo sapiens
agctctgggctgacatgctccc

SEQ ID NO: 7884039 - DNA, 22 bp, Homo sapiens
agctctgggctgacatgctccc

SEQ ID NO: 7884040 - DNA, 22 bp, Homo sapiens
agctcctgtgtgcccacctgct

SEQ ID NO: 7884041 - DNA, 22 bp, Homo sapiens
agctcctgtgtgcccacctgct

SEQ ID NO: 7884042 - DNA, 22 bp, Homo sapiens
agctcctgtgtgcccacctgct

SEQ ID NO: 7884043 - DNA, 22 bp, Homo sapiens
agctcctgtgtgcccacctgct

SEQ ID NO: 7884044 - DNA, 22 bp, Homo sapiens
agctcctgtgtgcccacctgct

SEQ ID NO: 7884045 - DNA, 22 bp, Homo sapiens
acagcaggcatgaatgacactg

SEQ ID NO: 7884046 - DNA, 22 bp, Homo sapiens
acagcaggcatgaatgacactg

SEQ ID NO: 7884047 - DNA, 22 bp, Homo sapiens
agctcctgtgtgcccacctgct

SEQ ID NO: 7884048 - DNA, 22 bp, Homo sapiens
acagcaggcatgaatgacactg

SEQ ID NO: 7884049 - DNA, 22 bp, Homo sapiens
acagcaggcatgaatgacactg

SEQ ID NO: 7884050 - DNA, 22 bp, Homo sapiens
acagcaggcatgaatgacactg

SEQ ID NO: 7884051 - DNA, 22 bp, Homo sapiens
acagcaggcatgaagaaatgtt

SEQ ID NO: 7884052 - DNA, 22 bp, Homo sapiens
acagcaggcatgaagaaatgtt

SEQ ID NO: 7884053 - DNA, 22 bp, Homo sapiens
acagcaggcatgaagaaatgtt

SEQ ID NO: 7884054 - DNA, 22 bp, Homo sapiens
acagcaggcatgaagaaatgtt

SEQ ID NO: 7884055 - DNA, 22 bp, Homo sapiens
acagcaggcacacaaggataga

SEQ ID NO: 7884056 - DNA, 22 bp, Homo sapiens
acagcaggcacacaaggataga

SEQ ID NO: 7884057 - DNA, 22 bp, Homo sapiens
acagcaggcacacaaggataga

SEQ ID NO: 7884058 - DNA, 22 bp, Homo sapiens
acagcaggcacacaaggataga

SEQ ID NO: 7884059 - DNA, 22 bp, Homo sapiens
acagcaggatttggcgatgttg

SEQ ID NO: 7884060 - DNA, 22 bp, Homo sapiens
acagcaggcatgaagaaatgtt

SEQ ID NO: 7884061 - DNA, 22 bp, Homo sapiens
acagcaggcacacaaggataga

SEQ ID NO: 7884062 - DNA, 22 bp, Homo sapiens
acagcaggcatgaagaaatgtt

SEQ ID NO: 7884063 - DNA, 22 bp, Homo sapiens
acagcaggcatgaagaaatgtt

SEQ ID NO: 7884064 - DNA, 22 bp, Homo sapiens
acagcaggcacacaaggataga

SEQ ID NO: 7884065 - DNA, 22 bp, Homo sapiens
acagcaggcacacaaggataga

SEQ ID NO: 7884066 - DNA, 22 bp, Homo sapiens
acagcaggaattaacatataag

SEQ ID NO: 7884067 - DNA, 22 bp, Homo sapiens
acagcaggaagctggagggaaa

SEQ ID NO: 7884068 - DNA, 22 bp, Homo sapiens
acagcagctaaaggtgtctcct

SEQ ID NO: 7884069 - DNA, 22 bp, Homo sapiens
acagcaggaattaacatataag

SEQ ID NO: 7884070 - DNA, 22 bp, Homo sapiens
acagcaggaattaacatataag

SEQ ID NO: 7884071 - DNA, 22 bp, Homo sapiens
acagcaggaattaacatataag

SEQ ID NO: 7884072 - DNA, 22 bp, Homo sapiens
acagcaggagccttcatatgct

SEQ ID NO: 7884073 - DNA, 22 bp, Homo sapiens
acagcaggatttggcgatgttg

SEQ ID NO: 7884074 - DNA, 22 bp, Homo sapiens
acagcaggagccttcatatgct

SEQ ID NO: 7884075 - DNA, 22 bp, Homo sapiens
acagcaggatttggcgatgttg

SEQ ID NO: 7884076 - DNA, 22 bp, Homo sapiens
acagcaggatttggcgatgttg

SEQ ID NO: 7884077 - DNA, 22 bp, Homo sapiens
acagcaggagccttcatatgct

SEQ ID NO: 7884078 - DNA, 22 bp, Homo sapiens
acagcaggagccttcatatgct

SEQ ID NO: 7884079 - DNA, 22 bp, Homo sapiens
acagcaggagccttcatatgct

SEQ ID NO: 7884080 - DNA, 22 bp, Homo sapiens
acagcagcgtgaagtgtgttat

SEQ ID NO: 7884081 - DNA, 22 bp, Homo sapiens
acagcagcgtgaagtgtgttat

SEQ ID NO: 7884082 - DNA, 22 bp, Homo sapiens
acagcagcgtgaagtgtgttat

SEQ ID NO: 7884083 - DNA, 22 bp, Homo sapiens
acagcagcgtgaagtgtgttat

SEQ ID NO: 7884084 - DNA, 22 bp, Homo sapiens
acagcagctaaaggtgtctcct

SEQ ID NO: 7884085 - DNA, 22 bp, Homo sapiens
agctcaagagtagttcgagggg

SEQ ID NO: 7884086 - DNA, 22 bp, Homo sapiens
agctcaagagtagttcgagggg

SEQ ID NO: 7884087 - DNA, 22 bp, Homo sapiens
agctcaaagctgttacattgta

SEQ ID NO: 7884088 - DNA, 22 bp, Homo sapiens
agctcaagagtagttcgagggg

SEQ ID NO: 7884089 - DNA, 22 bp, Homo sapiens
agctcaagcgtgggctgggcgc

SEQ ID NO: 7884090 - DNA, 22 bp, Homo sapiens
agctcaagcgtgggctgggcgc

SEQ ID NO: 7884091 - DNA, 21 bp, Homo sapiens
agctatttcagatttgagagc

SEQ ID NO: 7884092 - DNA, 22 bp, Homo sapiens
agctatttcaaagtttgagaca

SEQ ID NO: 7884093 - DNA, 22 bp, Homo sapiens
agctatttctcttattatatcc

SEQ ID NO: 7884094 - DNA, 22 bp, Homo sapiens
agctatttcaggaaatttgtga

SEQ ID NO: 7884095 - DNA, 22 bp, Homo sapiens
agctatttcaggaaatttgtga

SEQ ID NO: 7884096 - DNA, 22 bp, Homo sapiens
agctatttctcttattatatcc

SEQ ID NO: 7884097 - DNA, 22 bp, Homo sapiens
agaagtactggcagaagattgg

SEQ ID NO: 7884098 - DNA, 22 bp, Homo sapiens
agaagtaggcagggctgtatca

SEQ ID NO: 7884099 - DNA, 22 bp, Homo sapiens
agaaggtggctactcagtcatc

SEQ ID NO: 7884100 - DNA, 22 bp, Homo sapiens
agaagggtagttgtaagagtga

SEQ ID NO: 7884101 - DNA, 22 bp, Homo sapiens
agaagggtgtatacatttcctg

SEQ ID NO: 7884102 - DNA, 22 bp, Homo sapiens
agaagggtagggacttatccaa

SEQ ID NO: 7884103 - DNA, 23 bp, Homo sapiens
agaagggtccttggcagcgacag

SEQ ID NO: 7884104 - DNA, 22 bp, Homo sapiens
agaagggtagttgtaagagtga

SEQ ID NO: 7884105 - DNA, 23 bp, Homo sapiens
agaagggtccttggcagcgacag

SEQ ID NO: 7884106 - DNA, 22 bp, Homo sapiens
agaagtagtccagtggaaagta

SEQ ID NO: 7884107 - DNA, 22 bp, Homo sapiens
agaagggttcaggaatatgtta

SEQ ID NO: 7884108 - DNA, 22 bp, Homo sapiens
agaagtataaagaatgtttatg

SEQ ID NO: 7884109 - DNA, 22 bp, Homo sapiens
agaagtataaagaatgtttatg

SEQ ID NO: 7884110 - DNA, 22 bp, Homo sapiens
agaagtatgtgagaaattatcc

SEQ ID NO: 7884111 - DNA, 22 bp, Homo sapiens
agaagtatcaggaagattctca

SEQ ID NO: 7884112 - DNA, 22 bp, Homo sapiens
agaagtattctgcatgtactga

SEQ ID NO: 7884113 - DNA, 22 bp, Homo sapiens
agaaggggcccaaggatgtcag

SEQ ID NO: 7884114 - DNA, 22 bp, Homo sapiens
agaagggtagttgtaagagtga

SEQ ID NO: 7884115 - DNA, 22 bp, Homo sapiens
agaaggggagaagctaccagga

SEQ ID NO: 7884116 - DNA, 22 bp, Homo sapiens
agaaggggcccaaggatgtcag

SEQ ID NO: 7884117 - DNA, 21 bp, Homo sapiens
agaagggattgtggtaaagat

SEQ ID NO: 7884118 - DNA, 22 bp, Homo sapiens
agaagggccagctggacacctg

SEQ ID NO: 7884119 - DNA, 22 bp, Homo sapiens
agaagggccagctggacacctg

SEQ ID NO: 7884120 - DNA, 22 bp, Homo sapiens
agaagggctacacgggctctcc

SEQ ID NO: 7884121 - DNA, 22 bp, Homo sapiens
agaagggctacacgggctctcc

SEQ ID NO: 7884122 - DNA, 22 bp, Homo sapiens
aatgcaaacttcttgttacttg

SEQ ID NO: 7884123 - DNA, 22 bp, Homo sapiens
aatgcaaacttcttgttacttg

SEQ ID NO: 7884124 - DNA, 22 bp, Homo sapiens
aatgcaaacttcttgttacttg

SEQ ID NO: 7884125 - DNA, 22 bp, Homo sapiens
aatgcaaactccactggagcag

SEQ ID NO: 7884126 - DNA, 22 bp, Homo sapiens
aatgcaaacagcccagaatcca

SEQ ID NO: 7884127 - DNA, 22 bp, Homo sapiens
aatgcaaagcaagcagagattt

SEQ ID NO: 7884128 - DNA, 22 bp, Homo sapiens
aatgcaaagcaagcagagattt

SEQ ID NO: 7884129 - DNA, 22 bp, Homo sapiens
aatgcaaagagttgcttatcaa

SEQ ID NO: 7884130 - DNA, 22 bp, Homo sapiens
aatgcaaagagttgcttatcaa

SEQ ID NO: 7884131 - DNA, 22 bp, Homo sapiens
aatgcaaacttcttgttacttg

SEQ ID NO: 7884132 - DNA, 22 bp, Homo sapiens
aatgcaaacttcttgttacttg

SEQ ID NO: 7884133 - DNA, 22 bp, Homo sapiens
aatgcaaacttcttgttacttg

SEQ ID NO: 7884134 - DNA, 22 bp, Homo sapiens
aatgcaaagtgaggtgagtggc

SEQ ID NO: 7884135 - DNA, 22 bp, Homo sapiens
aatgcaaagctctttaatcctt

SEQ ID NO: 7884136 - DNA, 22 bp, Homo sapiens
aatgcaagatcaaatctaacac

SEQ ID NO: 7884137 - DNA, 22 bp, Homo sapiens
aatgcaacctgctgatctgaca

SEQ ID NO: 7884138 - DNA, 22 bp, Homo sapiens
aatgcaaattatcaggcttctc

SEQ ID NO: 7884139 - DNA, 22 bp, Homo sapiens
agacagagatactatgttgtca

SEQ ID NO: 7884140 - DNA, 19 bp, Homo sapiens
agacagagctcagtgggtt

SEQ ID NO: 7884141 - DNA, 19 bp, Homo sapiens
agacagagctcagtgggtt

SEQ ID NO: 7884142 - DNA, 19 bp, Homo sapiens
agacagagctcagtgggtt

SEQ ID NO: 7884143 - DNA, 19 bp, Homo sapiens
agacagagctcagtgggtt

SEQ ID NO: 7884144 - DNA, 19 bp, Homo sapiens
agacagagctcagtgggtt

SEQ ID NO: 7884145 - DNA, 22 bp, Homo sapiens
agacagagatactatgttgtca

SEQ ID NO: 7884146 - DNA, 22 bp, Homo sapiens
agacagagatactatgttgtca

SEQ ID NO: 7884147 - DNA, 19 bp, Homo sapiens
agacagagactgaaataga

SEQ ID NO: 7884148 - DNA, 22 bp, Homo sapiens
agacagagatactatgttgtca

SEQ ID NO: 7884149 - DNA, 22 bp, Homo sapiens
agacagagatactatgttgtca

SEQ ID NO: 7884150 - DNA, 19 bp, Homo sapiens
agacagagactgaaataga

SEQ ID NO: 7884151 - DNA, 22 bp, Homo sapiens
aatgcaaggcctgtatctgatt

SEQ ID NO: 7884152 - DNA, 22 bp, Homo sapiens
aatgcaaggcctgtatctgatt

SEQ ID NO: 7884153 - DNA, 22 bp, Homo sapiens
aatgcaagatcaaatctaacac

SEQ ID NO: 7884154 - DNA, 22 bp, Homo sapiens
aatgcaagtcaatgctataccc

SEQ ID NO: 7884155 - DNA, 22 bp, Homo sapiens
aatgcaatgcagcacctccttg

SEQ ID NO: 7884156 - DNA, 22 bp, Homo sapiens
aatgcaatgcagcacctccttg

SEQ ID NO: 7884157 - DNA, 22 bp, Homo sapiens
aatgcaatgcagcacctccttg

SEQ ID NO: 7884158 - DNA, 22 bp, Homo sapiens
aatgcaatgcagcacctccttg

SEQ ID NO: 7884159 - DNA, 22 bp, Homo sapiens
agacagactttgatctggatgt

SEQ ID NO: 7884160 - DNA, 23 bp, Homo sapiens
agacactgtaaagaattgcagtt

SEQ ID NO: 7884161 - DNA, 23 bp, Homo sapiens
agacactgtaaagaattgcagtt

SEQ ID NO: 7884162 - DNA, 23 bp, Homo sapiens
agacactgtaaagaattgcagtt

SEQ ID NO: 7884163 - DNA, 23 bp, Homo sapiens
agacagaggctgaggctggccgc

SEQ ID NO: 7884164 - DNA, 23 bp, Homo sapiens
agacagaggctgaggctggccgc

SEQ ID NO: 7884165 - DNA, 22 bp, Homo sapiens
agacagcaatatgggagacgga

SEQ ID NO: 7884166 - DNA, 21 bp, Homo sapiens
agacagagtgcagtctacata

SEQ ID NO: 7884167 - DNA, 21 bp, Homo sapiens
agacagagtgcagtctacata

SEQ ID NO: 7884168 - DNA, 21 bp, Homo sapiens
agacagagtgcagtctacata

SEQ ID NO: 7884169 - DNA, 21 bp, Homo sapiens
agacagagtgcagtctacata

SEQ ID NO: 7884170 - DNA, 22 bp, Homo sapiens
agacaggccactctggtctggt

SEQ ID NO: 7884171 - DNA, 22 bp, Homo sapiens
agacaggccactctggtctggt

SEQ ID NO: 7884172 - DNA, 22 bp, Homo sapiens
agacaggccactctggtctggt

SEQ ID NO: 7884173 - DNA, 22 bp, Homo sapiens
agacaggcttggaaaaaacctc

SEQ ID NO: 7884174 - DNA, 22 bp, Homo sapiens
agacaggctgctgtctgctagg

SEQ ID NO: 7884175 - DNA, 22 bp, Homo sapiens
agacaggccactctggtctggt

SEQ ID NO: 7884176 - DNA, 22 bp, Homo sapiens
agacagcagaaactagagcact

SEQ ID NO: 7884177 - DNA, 22 bp, Homo sapiens
agacagcagaaactagagcact

SEQ ID NO: 7884178 - DNA, 22 bp, Homo sapiens
agacagcagaaactagagcact

SEQ ID NO: 7884179 - DNA, 22 bp, Homo sapiens
aatgtcatagcatttcttcaat

SEQ ID NO: 7884180 - DNA, 22 bp, Homo sapiens
aatgtcatagcatttcttcaat

SEQ ID NO: 7884181 - DNA, 22 bp, Homo sapiens
aatgtcatattagtttgtgcct

SEQ ID NO: 7884182 - DNA, 22 bp, Homo sapiens
aatgtcatagcatttcttcaat

SEQ ID NO: 7884183 - DNA, 22 bp, Homo sapiens
aatgtcatgagcctgctcttgt

SEQ ID NO: 7884184 - DNA, 22 bp, Homo sapiens
aatgtcatgggaatttattcat

SEQ ID NO: 7884185 - DNA, 22 bp, Homo sapiens
aatgtcattgagctccaatcct

SEQ ID NO: 7884186 - DNA, 22 bp, Homo sapiens
aatgtcattgagctccaatcct

SEQ ID NO: 7884187 - DNA, 22 bp, Homo sapiens
aatgtcattggtaaagattagg

SEQ ID NO: 7884188 - DNA, 21 bp, Homo sapiens
aatgtcattgaatggtgagac

SEQ ID NO: 7884189 - DNA, 22 bp, Homo sapiens
aatgtcatgggaatttattcat

SEQ ID NO: 7884190 - DNA, 22 bp, Homo sapiens
aatgtcagcctgaaagctattc

SEQ ID NO: 7884191 - DNA, 22 bp, Homo sapiens
aatgtcagcctgaaagctattc

SEQ ID NO: 7884192 - DNA, 19 bp, Homo sapiens
aatgtcagcatgttaattt

SEQ ID NO: 7884193 - DNA, 22 bp, Homo sapiens
aatgtcagtgttactgctattg

SEQ ID NO: 7884194 - DNA, 22 bp, Homo sapiens
aatgtcatagcaaagagagtga

SEQ ID NO: 7884195 - DNA, 22 bp, Homo sapiens
aatgtcatagcatttcttcaat

SEQ ID NO: 7884196 - DNA, 22 bp, Homo sapiens
aatgtcatagcatttcttcaat

SEQ ID NO: 7884197 - DNA, 22 bp, Homo sapiens
aatgtattctctttataagata

SEQ ID NO: 7884198 - DNA, 22 bp, Homo sapiens
aatgtattctctttataagata

SEQ ID NO: 7884199 - DNA, 22 bp, Homo sapiens
aatgtattctctttataagata

SEQ ID NO: 7884200 - DNA, 22 bp, Homo sapiens
aatgtcaatctcagagaacaca

SEQ ID NO: 7884201 - DNA, 22 bp, Homo sapiens
aatgtcaatctcagagaacaca

SEQ ID NO: 7884202 - DNA, 22 bp, Homo sapiens
aatgtcaattaccagaacagaa

SEQ ID NO: 7884203 - DNA, 22 bp, Homo sapiens
aatgtcaattaccagaacagaa

SEQ ID NO: 7884204 - DNA, 22 bp, Homo sapiens
aatgtcaattaccagaacagaa

SEQ ID NO: 7884205 - DNA, 22 bp, Homo sapiens
agacagggtcttgatcagagct

SEQ ID NO: 7884206 - DNA, 22 bp, Homo sapiens
agacagggtcttgatcagagct

SEQ ID NO: 7884207 - DNA, 22 bp, Homo sapiens
agacagggtcttgatcagagct

SEQ ID NO: 7884208 - DNA, 22 bp, Homo sapiens
agacagggtcttgatcagagct

SEQ ID NO: 7884209 - DNA, 22 bp, Homo sapiens
agacagggtcttgatcagagct

SEQ ID NO: 7884210 - DNA, 22 bp, Homo sapiens
agacagggtcttgatcagagct

SEQ ID NO: 7884211 - DNA, 22 bp, Homo sapiens
agacagggagggagcgcggctg

SEQ ID NO: 7884212 - DNA, 22 bp, Homo sapiens
agacagggagggagcgcggctg

SEQ ID NO: 7884213 - DNA, 22 bp, Homo sapiens
agacagggccactcatcctcac

SEQ ID NO: 7884214 - DNA, 22 bp, Homo sapiens
agacagggccactcatcctcac

SEQ ID NO: 7884215 - DNA, 22 bp, Homo sapiens
agacagggccactcatcctcac

SEQ ID NO: 7884216 - DNA, 22 bp, Homo sapiens
agacagggtgatcgcttgagcc

SEQ ID NO: 7884217 - DNA, 22 bp, Homo sapiens
agacagggtgatcgcttgagcc

SEQ ID NO: 7884218 - DNA, 22 bp, Homo sapiens
agacagggtgatcgcttgagcc

SEQ ID NO: 7884219 - DNA, 22 bp, Homo sapiens
agacagggtgatcgcttgagcc

SEQ ID NO: 7884220 - DNA, 22 bp, Homo sapiens
agacagggtgatcgcttgagcc

SEQ ID NO: 7884221 - DNA, 22 bp, Homo sapiens
agacagggtgatcgcttgagcc

SEQ ID NO: 7884222 - DNA, 22 bp, Homo sapiens
agacagggtcttgatcagagct

SEQ ID NO: 7884223 - DNA, 22 bp, Homo sapiens
agacagggtgatcgcttgagcc

SEQ ID NO: 7884224 - DNA, 22 bp, Homo sapiens
agacagggtcttgatcagagct

SEQ ID NO: 7884225 - DNA, 22 bp, Homo sapiens
agacagggtcttgatcagagct

SEQ ID NO: 7884226 - DNA, 22 bp, Homo sapiens
agacagggtgatcgcttgagcc

SEQ ID NO: 7884227 - DNA, 22 bp, Homo sapiens
aatgtattcctcatgcaagagt

SEQ ID NO: 7884228 - DNA, 22 bp, Homo sapiens
agacagggccactcatcctcac

SEQ ID NO: 7884229 - DNA, 22 bp, Homo sapiens
aatgtattctctttataagata

SEQ ID NO: 7884230 - DNA, 22 bp, Homo sapiens
aatgtattcctcatgcaagagt

SEQ ID NO: 7884231 - DNA, 22 bp, Homo sapiens
aatgtattcctcatgcaagagt

SEQ ID NO: 7884232 - DNA, 22 bp, Homo sapiens
aatgtgtttagttaatgagttg

SEQ ID NO: 7884233 - DNA, 22 bp, Homo sapiens
aatgtgtttagttaatgagttg

SEQ ID NO: 7884234 - DNA, 22 bp, Homo sapiens
aatgtgttagtattgatttgtc

SEQ ID NO: 7884235 - DNA, 22 bp, Homo sapiens
aatgtgttagtattgatttgtc

SEQ ID NO: 7884236 - DNA, 22 bp, Homo sapiens
aatgtcttcagtgtatacatgg

SEQ ID NO: 7884237 - DNA, 22 bp, Homo sapiens
aatgtcttcagtgtatacatgg

SEQ ID NO: 7884238 - DNA, 22 bp, Homo sapiens
aatgtcttcagtgtatacatgg

SEQ ID NO: 7884239 - DNA, 22 bp, Homo sapiens
aatgtcttcagtgtatacatgg

SEQ ID NO: 7884240 - DNA, 22 bp, Homo sapiens
aatgtcttacatttactgagca

SEQ ID NO: 7884241 - DNA, 22 bp, Homo sapiens
aatgtctgtgccttaaaacttc

SEQ ID NO: 7884242 - DNA, 22 bp, Homo sapiens
aatgtctgtgccttaaaacttc

SEQ ID NO: 7884243 - DNA, 22 bp, Homo sapiens
aatgtcttaaagtcgtgttaca

SEQ ID NO: 7884244 - DNA, 22 bp, Homo sapiens
aatgtcttacatttactgagca

SEQ ID NO: 7884245 - DNA, 22 bp, Homo sapiens
aatgtctctctaaataaacttt

SEQ ID NO: 7884246 - DNA, 22 bp, Homo sapiens
aatgtctctctaaataaacttt

SEQ ID NO: 7884247 - DNA, 22 bp, Homo sapiens
aatgtctgaaaatcagactgca

SEQ ID NO: 7884248 - DNA, 22 bp, Homo sapiens
aatgtctgaaaatcagactgca

SEQ ID NO: 7884249 - DNA, 22 bp, Homo sapiens
aatgtctgaaaatcagactgca

SEQ ID NO: 7884250 - DNA, 22 bp, Homo sapiens
aatgtctgaggctcatctgagg

SEQ ID NO: 7884251 - DNA, 22 bp, Homo sapiens
aatgtctgagtctctgtatccc

SEQ ID NO: 7884252 - DNA, 22 bp, Homo sapiens
aatgtctgccagaactgatcat

SEQ ID NO: 7884253 - DNA, 22 bp, Homo sapiens
aatgtctgccagaactgatcat

SEQ ID NO: 7884254 - DNA, 22 bp, Homo sapiens
aatgtctgaggctcatctgagg

SEQ ID NO: 7884255 - DNA, 22 bp, Homo sapiens
aatgtctgcctgaactttatat

SEQ ID NO: 7884256 - DNA, 22 bp, Homo sapiens
aatgtctgctctactcaggagg

SEQ ID NO: 7884257 - DNA, 22 bp, Homo sapiens
aatgtctgtctgcacgttgctt

SEQ ID NO: 7884258 - DNA, 22 bp, Homo sapiens
aatgtcctaggcatgattttgt

SEQ ID NO: 7884259 - DNA, 22 bp, Homo sapiens
aatgtccaccgtgatgatggaa

SEQ ID NO: 7884260 - DNA, 22 bp, Homo sapiens
aatgtcctcagaggtgtgtaga

SEQ ID NO: 7884261 - DNA, 22 bp, Homo sapiens
aatgtctacaccgtatgttgtt

SEQ ID NO: 7884262 - DNA, 17 bp, Homo sapiens
aatgtccttggaccaca

SEQ ID NO: 7884263 - DNA, 22 bp, Homo sapiens
aatgtctatgatcctttaagtt

SEQ ID NO: 7884264 - DNA, 22 bp, Homo sapiens
aatgtctagagttttaagctta

SEQ ID NO: 7884265 - DNA, 22 bp, Homo sapiens
aatgtctacattctgaattcgt

SEQ ID NO: 7884266 - DNA, 22 bp, Homo sapiens
aatgtcatttaaaataattctg

SEQ ID NO: 7884267 - DNA, 22 bp, Homo sapiens
aatgtcattgtgagttaggctt

SEQ ID NO: 7884268 - DNA, 22 bp, Homo sapiens
aatgtcatttaaaataattctg

SEQ ID NO: 7884269 - DNA, 22 bp, Homo sapiens
aatgtcattggtaaagattagg

SEQ ID NO: 7884270 - DNA, 22 bp, Homo sapiens
aatgtcattggtaaagattagg

SEQ ID NO: 7884271 - DNA, 22 bp, Homo sapiens
aatgtcatttttaaatgtgaga

SEQ ID NO: 7884272 - DNA, 22 bp, Homo sapiens
aatgtcatttttaaatgtgaga

SEQ ID NO: 7884273 - DNA, 22 bp, Homo sapiens
aatgtcatttttaaatgtgaga

SEQ ID NO: 7884274 - DNA, 22 bp, Homo sapiens
aatgtcatttaaagacaaagaa

SEQ ID NO: 7884275 - DNA, 22 bp, Homo sapiens
aatgtcatttaggattatgttt

SEQ ID NO: 7884276 - DNA, 22 bp, Homo sapiens
aatgtcatttaggattatgttt

SEQ ID NO: 7884277 - DNA, 22 bp, Homo sapiens
aatgtcatttaggattatgttt

SEQ ID NO: 7884278 - DNA, 22 bp, Homo sapiens
aatgtcatttaggattatgttt

SEQ ID NO: 7884279 - DNA, 22 bp, Homo sapiens
aattatatgttaatcttcaatt

SEQ ID NO: 7884280 - DNA, 22 bp, Homo sapiens
aattatatgttaatcttcaatt

SEQ ID NO: 7884281 - DNA, 22 bp, Homo sapiens
aattatatgttaatcttcaatt

SEQ ID NO: 7884282 - DNA, 22 bp, Homo sapiens
aattatatgttaatcttcaatt

SEQ ID NO: 7884283 - DNA, 22 bp, Homo sapiens
aattatattgaagttgaatgtc

SEQ ID NO: 7884284 - DNA, 22 bp, Homo sapiens
aattatatgttaatcttcaatt

SEQ ID NO: 7884285 - DNA, 22 bp, Homo sapiens
aattatatgttaatcttcaatt

SEQ ID NO: 7884286 - DNA, 22 bp, Homo sapiens
aattatatgttaatcttcaatt

SEQ ID NO: 7884287 - DNA, 22 bp, Homo sapiens
aattatacaattgtcaagttct

SEQ ID NO: 7884288 - DNA, 22 bp, Homo sapiens
aattatacatgaaggcattata

SEQ ID NO: 7884289 - DNA, 22 bp, Homo sapiens
aattatacaattgtcaagttct

SEQ ID NO: 7884290 - DNA, 22 bp, Homo sapiens
aattagtattgcgattcattag

SEQ ID NO: 7884291 - DNA, 22 bp, Homo sapiens
aattatacatgaaggcattata

SEQ ID NO: 7884292 - DNA, 22 bp, Homo sapiens
aattatacattgaacaatctag

SEQ ID NO: 7884293 - DNA, 22 bp, Homo sapiens
aattatacattgaacaatctag

SEQ ID NO: 7884294 - DNA, 20 bp, Homo sapiens
aattatataactccaacatt

SEQ ID NO: 7884295 - DNA, 20 bp, Homo sapiens
aattatataactccaacatt

SEQ ID NO: 7884296 - DNA, 22 bp, Homo sapiens
aattatccacctttgcatgatt

SEQ ID NO: 7884297 - DNA, 22 bp, Homo sapiens
aattatcagatataaaactgca

SEQ ID NO: 7884298 - DNA, 22 bp, Homo sapiens
aattatcagatataaaactgca

SEQ ID NO: 7884299 - DNA, 22 bp, Homo sapiens
aattatcagatataaaactgca

SEQ ID NO: 7884300 - DNA, 22 bp, Homo sapiens
aattatccacctttgcatgatt

SEQ ID NO: 7884301 - DNA, 22 bp, Homo sapiens
aattatccacctttgcatgatt

SEQ ID NO: 7884302 - DNA, 22 bp, Homo sapiens
aattatattgtggtgtgaatgt

SEQ ID NO: 7884303 - DNA, 22 bp, Homo sapiens
aattatattgtggtgtgaatgt

SEQ ID NO: 7884304 - DNA, 22 bp, Homo sapiens
aattatattgtggtgtgaatgt

SEQ ID NO: 7884305 - DNA, 22 bp, Homo sapiens
aattgcttttgggggcagttac

SEQ ID NO: 7884306 - DNA, 22 bp, Homo sapiens
aattggaaaaagacttaattgc

SEQ ID NO: 7884307 - DNA, 22 bp, Homo sapiens
aattggaaaaagacttaattgc

SEQ ID NO: 7884308 - DNA, 22 bp, Homo sapiens
aattggaaaaagacttaattgc

SEQ ID NO: 7884309 - DNA, 22 bp, Homo sapiens
aattatggtggatcccagtggg

SEQ ID NO: 7884310 - DNA, 22 bp, Homo sapiens
aattatggtgtgtggttaaggg

SEQ ID NO: 7884311 - DNA, 22 bp, Homo sapiens
aattgcttttcaagggtacagc

SEQ ID NO: 7884312 - DNA, 22 bp, Homo sapiens
aattatggtatgttcaacaact

SEQ ID NO: 7884313 - DNA, 22 bp, Homo sapiens
aattatggtcactgttcctggg

SEQ ID NO: 7884314 - DNA, 22 bp, Homo sapiens
aattatggtatgttcaacaact

SEQ ID NO: 7884315 - DNA, 22 bp, Homo sapiens
aattatgaggtagatatcacat

SEQ ID NO: 7884316 - DNA, 22 bp, Homo sapiens
aattatggaatttttagagaag

SEQ ID NO: 7884317 - DNA, 22 bp, Homo sapiens
aattatgcaaccaatgaccacg

SEQ ID NO: 7884318 - DNA, 22 bp, Homo sapiens
aatttacacttcatttggaggg

SEQ ID NO: 7884319 - DNA, 22 bp, Homo sapiens
aatttacaggtgcactcgccat

SEQ ID NO: 7884320 - DNA, 22 bp, Homo sapiens
aatttacacttcatttggaggg

SEQ ID NO: 7884321 - DNA, 22 bp, Homo sapiens
aatttacacttcatttggaggg

SEQ ID NO: 7884322 - DNA, 22 bp, Homo sapiens
aatttacacttcatttggaggg

SEQ ID NO: 7884323 - DNA, 22 bp, Homo sapiens
aatttacacttcatttggaggg

SEQ ID NO: 7884324 - DNA, 22 bp, Homo sapiens
aatttacacttcatttggaggg

SEQ ID NO: 7884325 - DNA, 22 bp, Homo sapiens
aatttacaggtgcactcgccat

SEQ ID NO: 7884326 - DNA, 22 bp, Homo sapiens
aatttacaggtgcactcgccat

SEQ ID NO: 7884327 - DNA, 22 bp, Homo sapiens
aatttacaggtgcactcgccat

SEQ ID NO: 7884328 - DNA, 22 bp, Homo sapiens
aatttacagttgctgatggtac

SEQ ID NO: 7884329 - DNA, 22 bp, Homo sapiens
aatttacagttgctgatggtac

SEQ ID NO: 7884330 - DNA, 22 bp, Homo sapiens
aatttacagttgctgatggtac

SEQ ID NO: 7884331 - DNA, 22 bp, Homo sapiens
aatttacagttgctgatggtac

SEQ ID NO: 7884332 - DNA, 22 bp, Homo sapiens
aatttacagttgctgatggtac

SEQ ID NO: 7884333 - DNA, 22 bp, Homo sapiens
aatttacagttgctgatggtac

SEQ ID NO: 7884334 - DNA, 22 bp, Homo sapiens
aatttacctctaaacaggagcc

SEQ ID NO: 7884335 - DNA, 22 bp, Homo sapiens
aatttacctctaaacaggagcc

SEQ ID NO: 7884336 - DNA, 20 bp, Homo sapiens
aatttactcacagaatgaat

SEQ ID NO: 7884337 - DNA, 22 bp, Homo sapiens
aatttagattgataaacatgga

SEQ ID NO: 7884338 - DNA, 22 bp, Homo sapiens
aatttagattgataaacatgga

SEQ ID NO: 7884339 - DNA, 22 bp, Homo sapiens
agagctgggacttggactcaat

SEQ ID NO: 7884340 - DNA, 22 bp, Homo sapiens
agagctgggacttggactcaat

SEQ ID NO: 7884341 - DNA, 22 bp, Homo sapiens
agagctgggacttggactcaat

SEQ ID NO: 7884342 - DNA, 22 bp, Homo sapiens
agagctgggacttggactcaat

SEQ ID NO: 7884343 - DNA, 22 bp, Homo sapiens
agagctggggcataaatgccac

SEQ ID NO: 7884344 - DNA, 22 bp, Homo sapiens
agagctggggcataaatgccac

SEQ ID NO: 7884345 - DNA, 22 bp, Homo sapiens
agagctggggcataaatgccac

SEQ ID NO: 7884346 - DNA, 22 bp, Homo sapiens
agagctgggacttggactcaat

SEQ ID NO: 7884347 - DNA, 22 bp, Homo sapiens
agagctgggacttggactcaat

SEQ ID NO: 7884348 - DNA, 22 bp, Homo sapiens
agagctggggccagagtcaagg

SEQ ID NO: 7884349 - DNA, 22 bp, Homo sapiens
agagctggggccagagtcaagg

SEQ ID NO: 7884350 - DNA, 22 bp, Homo sapiens
agagctggggcataaatgccac

SEQ ID NO: 7884351 - DNA, 22 bp, Homo sapiens
agagctggggccagagtcaagg

SEQ ID NO: 7884352 - DNA, 19 bp, Homo sapiens
aatttagttcttgtttaga

SEQ ID NO: 7884353 - DNA, 19 bp, Homo sapiens
aatttagttcttgtttaga

SEQ ID NO: 7884354 - DNA, 22 bp, Homo sapiens
aatttagtccttacagtgcaga

SEQ ID NO: 7884355 - DNA, 21 bp, Homo sapiens
aatttagtcaacagactgtgg

SEQ ID NO: 7884356 - DNA, 22 bp, Homo sapiens
aatttagattgataaacatgga

SEQ ID NO: 7884357 - DNA, 19 bp, Homo sapiens
aatttagttcttgtttaga

SEQ ID NO: 7884358 - DNA, 22 bp, Homo sapiens
aatttatatgtaattaggcaca

SEQ ID NO: 7884359 - DNA, 22 bp, Homo sapiens
aatgttgtacctatgctgagag

SEQ ID NO: 7884360 - DNA, 22 bp, Homo sapiens
aatgttgtaaatattctttgag

SEQ ID NO: 7884361 - DNA, 22 bp, Homo sapiens
aatgttgtaaatattctttgag

SEQ ID NO: 7884362 - DNA, 22 bp, Homo sapiens
aatgttgtaaatattctttgag

SEQ ID NO: 7884363 - DNA, 22 bp, Homo sapiens
aatgttgcagagtgattgtcca

SEQ ID NO: 7884364 - DNA, 22 bp, Homo sapiens
aatgttgcagagtgattgtcca

SEQ ID NO: 7884365 - DNA, 22 bp, Homo sapiens
aatgttgcagagtgattgtcca

SEQ ID NO: 7884366 - DNA, 22 bp, Homo sapiens
aatgttgcagagtgattgtcca

SEQ ID NO: 7884367 - DNA, 22 bp, Homo sapiens
aatgttgaggatatcagaaaat

SEQ ID NO: 7884368 - DNA, 22 bp, Homo sapiens
aatgttgagcttgaaagtaggt

SEQ ID NO: 7884369 - DNA, 22 bp, Homo sapiens
aatgttctgggagagaagctgt

SEQ ID NO: 7884370 - DNA, 22 bp, Homo sapiens
aatgttctcaacaaaaggaagc

SEQ ID NO: 7884371 - DNA, 22 bp, Homo sapiens
aatgttctcaacaaaaggaagc

SEQ ID NO: 7884372 - DNA, 22 bp, Homo sapiens
aatgttcattgttttccatatg

SEQ ID NO: 7884373 - DNA, 22 bp, Homo sapiens
aatgttcattgattaaatgaat

SEQ ID NO: 7884374 - DNA, 22 bp, Homo sapiens
aatgttcagtgcctttaaacat

SEQ ID NO: 7884375 - DNA, 22 bp, Homo sapiens
aatgttcattagcattgttgac

SEQ ID NO: 7884376 - DNA, 22 bp, Homo sapiens
aatgttcattagcattgttgac

SEQ ID NO: 7884377 - DNA, 22 bp, Homo sapiens
aatgttcagtagaataggaatg

SEQ ID NO: 7884378 - DNA, 22 bp, Homo sapiens
aatgttcagtatctggtccacc

SEQ ID NO: 7884379 - DNA, 22 bp, Homo sapiens
aatgttcagtctcaagagtgat

SEQ ID NO: 7884380 - DNA, 22 bp, Homo sapiens
aatgttatttctgcatagtagt

SEQ ID NO: 7884381 - DNA, 22 bp, Homo sapiens
aatgttcaaaagcatcagtgaa

SEQ ID NO: 7884382 - DNA, 22 bp, Homo sapiens
aatgttcaaaagcatcagtgaa

SEQ ID NO: 7884383 - DNA, 22 bp, Homo sapiens
aatgttcaaaagcatcagtgaa

SEQ ID NO: 7884384 - DNA, 22 bp, Homo sapiens
aatgttcaaaagcatcagtgaa

SEQ ID NO: 7884385 - DNA, 22 bp, Homo sapiens
aatgttattgtcctttccaaaa

SEQ ID NO: 7884386 - DNA, 22 bp, Homo sapiens
aatgttatttctgcatagtagt

SEQ ID NO: 7884387 - DNA, 22 bp, Homo sapiens
aatgttattgtcctttccaaaa

SEQ ID NO: 7884388 - DNA, 22 bp, Homo sapiens
aatgtgtttatttagtgattta

SEQ ID NO: 7884389 - DNA, 22 bp, Homo sapiens
aatgttcagaggacaatataaa

SEQ ID NO: 7884390 - DNA, 22 bp, Homo sapiens
aatgttcagaggacaatataaa

SEQ ID NO: 7884391 - DNA, 22 bp, Homo sapiens
aatgttcagaggacaatataaa

SEQ ID NO: 7884392 - DNA, 22 bp, Homo sapiens
aatgttcagaggacaatataaa

SEQ ID NO: 7884393 - DNA, 22 bp, Homo sapiens
aatgttcagaggacaatataaa

SEQ ID NO: 7884394 - DNA, 22 bp, Homo sapiens
aatgttcagaggacaatataaa

SEQ ID NO: 7884395 - DNA, 22 bp, Homo sapiens
aatgttcaaacagatcacttag

SEQ ID NO: 7884396 - DNA, 20 bp, Homo sapiens
aatgttcagtaattgtttta

SEQ ID NO: 7884397 - DNA, 20 bp, Homo sapiens
aatgttcagtaattgtttta

SEQ ID NO: 7884398 - DNA, 22 bp, Homo sapiens
aatgttcagtagaataggaatg

SEQ ID NO: 7884399 - DNA, 22 bp, Homo sapiens
aatgttcagctttcttacttaa

SEQ ID NO: 7884400 - DNA, 22 bp, Homo sapiens
aatgttcagcgagggatgctag

SEQ ID NO: 7884401 - DNA, 22 bp, Homo sapiens
aatgttcagcgagggatgctag

SEQ ID NO: 7884402 - DNA, 22 bp, Homo sapiens
aatgttcagcgagggatgctag

SEQ ID NO: 7884403 - DNA, 22 bp, Homo sapiens
aatgttcagctttcttacttaa

SEQ ID NO: 7884404 - DNA, 22 bp, Homo sapiens
aatgttgtgtttcagttcaaga

SEQ ID NO: 7884405 - DNA, 22 bp, Homo sapiens
aatgttgtgtttcagttcaaga

SEQ ID NO: 7884406 - DNA, 22 bp, Homo sapiens
aatgttgtgtttcagttcaaga

SEQ ID NO: 7884407 - DNA, 22 bp, Homo sapiens
aatgttgtgcatgtattttgta

SEQ ID NO: 7884408 - DNA, 22 bp, Homo sapiens
aatgttgtatggtgccttcaga

SEQ ID NO: 7884409 - DNA, 22 bp, Homo sapiens
aatgttgtttttctgcatgtct

SEQ ID NO: 7884410 - DNA, 22 bp, Homo sapiens
aatgttgttggctcttcatgat

SEQ ID NO: 7884411 - DNA, 22 bp, Homo sapiens
aatgttgttctctgcaaacaca

SEQ ID NO: 7884412 - DNA, 22 bp, Homo sapiens
aatgttgttctctgcaaacaca

SEQ ID NO: 7884413 - DNA, 22 bp, Homo sapiens
aatgttgttggctcttcatgat

SEQ ID NO: 7884414 - DNA, 19 bp, Homo sapiens
aatgtttaagagaaaaagg

SEQ ID NO: 7884415 - DNA, 19 bp, Homo sapiens
aatgtttaagagaaaaagg

SEQ ID NO: 7884416 - DNA, 19 bp, Homo sapiens
aatgtttaagagaaaaagg

SEQ ID NO: 7884417 - DNA, 19 bp, Homo sapiens
aatgtttaagagaaaaagg

SEQ ID NO: 7884418 - DNA, 22 bp, Homo sapiens
aatgttgttggtatcctaccca

SEQ ID NO: 7884419 - DNA, 19 bp, Homo sapiens
aatgtttaagagaaaaagg

SEQ ID NO: 7884420 - DNA, 22 bp, Homo sapiens
aatgtttaatgttagtggtaat

SEQ ID NO: 7884421 - DNA, 22 bp, Homo sapiens
aatgtttaatgttagtggtaat

SEQ ID NO: 7884422 - DNA, 22 bp, Homo sapiens
aatgtttgaactttgcatattt

SEQ ID NO: 7884423 - DNA, 22 bp, Homo sapiens
aatgtttcgtaaattgtctatg

SEQ ID NO: 7884424 - DNA, 22 bp, Homo sapiens
aatgtttcatttagttgtctcc

SEQ ID NO: 7884425 - DNA, 22 bp, Homo sapiens
aatgtttcattcttgcccattg

SEQ ID NO: 7884426 - DNA, 22 bp, Homo sapiens
aattagtaacctaattccatct

SEQ ID NO: 7884427 - DNA, 21 bp, Homo sapiens
aattagggtgcctcttataat

SEQ ID NO: 7884428 - DNA, 22 bp, Homo sapiens
aattagtattgcgattcattag

SEQ ID NO: 7884429 - DNA, 22 bp, Homo sapiens
aattagtattgcgattcattag

SEQ ID NO: 7884430 - DNA, 22 bp, Homo sapiens
aattagtaacctaattccatct

SEQ ID NO: 7884431 - DNA, 22 bp, Homo sapiens
aattagtattgcgattcattag

SEQ ID NO: 7884432 - DNA, 22 bp, Homo sapiens
aattagggaaaatttacttgta

SEQ ID NO: 7884433 - DNA, 22 bp, Homo sapiens
aattaggaaattcagccatttt

SEQ ID NO: 7884434 - DNA, 23 bp, Homo sapiens
aattaccatgcaacttgtgaaac

SEQ ID NO: 7884435 - DNA, 22 bp, Homo sapiens
aattacccataggcagccgagc

SEQ ID NO: 7884436 - DNA, 22 bp, Homo sapiens
aattacctcatacccggactat

SEQ ID NO: 7884437 - DNA, 22 bp, Homo sapiens
aattaccttttccacttaggcc

SEQ ID NO: 7884438 - DNA, 22 bp, Homo sapiens
aattaccttttccacttaggcc

SEQ ID NO: 7884439 - DNA, 22 bp, Homo sapiens
aattacctgtcatacatcaagc

SEQ ID NO: 7884440 - DNA, 22 bp, Homo sapiens
aattactgggtctgagattaat

SEQ ID NO: 7884441 - DNA, 22 bp, Homo sapiens
aattactgatctacaaaatcca

SEQ ID NO: 7884442 - DNA, 22 bp, Homo sapiens
aatttgttaaaagtgagtgaca

SEQ ID NO: 7884443 - DNA, 22 bp, Homo sapiens
aatttgttaaaagtgagtgaca

SEQ ID NO: 7884444 - DNA, 22 bp, Homo sapiens
agagctgggtggtggtgactca

SEQ ID NO: 7884445 - DNA, 22 bp, Homo sapiens
agagctgggtggtggtgactca

SEQ ID NO: 7884446 - DNA, 22 bp, Homo sapiens
aatttgtatacatgttacattt

SEQ ID NO: 7884447 - DNA, 22 bp, Homo sapiens
agagctgggtggacttgtagtt

SEQ ID NO: 7884448 - DNA, 22 bp, Homo sapiens
agagctgggtgaagtgccatca

SEQ ID NO: 7884449 - DNA, 22 bp, Homo sapiens
agagctgggtggacttgtagtt

SEQ ID NO: 7884450 - DNA, 22 bp, Homo sapiens
agagctgggtggacttgtagtt

SEQ ID NO: 7884451 - DNA, 22 bp, Homo sapiens
agagctgggtggacttgtagtt

SEQ ID NO: 7884452 - DNA, 22 bp, Homo sapiens
agagctgggtggtggtgactca

SEQ ID NO: 7884453 - DNA, 22 bp, Homo sapiens
agagctgggtggtggtgactca

SEQ ID NO: 7884454 - DNA, 22 bp, Homo sapiens
agagctgggtggtggtgactca

SEQ ID NO: 7884455 - DNA, 22 bp, Homo sapiens
agagctgggtggtggtgactca

SEQ ID NO: 7884456 - DNA, 22 bp, Homo sapiens
agagctgggtggtggtgactca

SEQ ID NO: 7884457 - DNA, 22 bp, Homo sapiens
agagctgggtgaagtgccatca

SEQ ID NO: 7884458 - DNA, 22 bp, Homo sapiens
agagctgggtgaagtgccatca

SEQ ID NO: 7884459 - DNA, 22 bp, Homo sapiens
agagctgggtgaagtgccatca

SEQ ID NO: 7884460 - DNA, 22 bp, Homo sapiens
agagctgggtgaagtgccatca

SEQ ID NO: 7884461 - DNA, 22 bp, Homo sapiens
agagctgggtgaagtgccatca

SEQ ID NO: 7884462 - DNA, 22 bp, Homo sapiens
agagctggggctctgggtttaa

SEQ ID NO: 7884463 - DNA, 22 bp, Homo sapiens
agagctggggctctgggtttaa

SEQ ID NO: 7884464 - DNA, 22 bp, Homo sapiens
agagctggggctctgggtttaa

SEQ ID NO: 7884465 - DNA, 22 bp, Homo sapiens
agagctggggcccgtaaagcca

SEQ ID NO: 7884466 - DNA, 22 bp, Homo sapiens
agagctggggctctgggtttaa

SEQ ID NO: 7884467 - DNA, 22 bp, Homo sapiens
agagctggggctctgggtttaa

SEQ ID NO: 7884468 - DNA, 22 bp, Homo sapiens
agagctgggtgaagtgccatca

SEQ ID NO: 7884469 - DNA, 22 bp, Homo sapiens
agagctgggtgaagtgccatca

SEQ ID NO: 7884470 - DNA, 22 bp, Homo sapiens
agagctggggccagagtcaagg

SEQ ID NO: 7884471 - DNA, 22 bp, Homo sapiens
agagctggggccagagtcaagg

SEQ ID NO: 7884472 - DNA, 22 bp, Homo sapiens
agagctggggccagagtcaagg

SEQ ID NO: 7884473 - DNA, 22 bp, Homo sapiens
agagctggggccagagtcaagg

SEQ ID NO: 7884474 - DNA, 22 bp, Homo sapiens
agagctggggccagagtcaagg

SEQ ID NO: 7884475 - DNA, 22 bp, Homo sapiens
agagctggggccagagtcaagg

SEQ ID NO: 7884476 - DNA, 22 bp, Homo sapiens
agagctggggccagagtcaagg

SEQ ID NO: 7884477 - DNA, 22 bp, Homo sapiens
agagctggggcccgtaaagcca

SEQ ID NO: 7884478 - DNA, 22 bp, Homo sapiens
agagctggggcccgtaaagcca

SEQ ID NO: 7884479 - DNA, 22 bp, Homo sapiens
agagctggggcccgtaaagcca

SEQ ID NO: 7884480 - DNA, 22 bp, Homo sapiens
aattttatctctaagcaggctt

SEQ ID NO: 7884481 - DNA, 22 bp, Homo sapiens
aattttatgccttgcacgttgg

SEQ ID NO: 7884482 - DNA, 22 bp, Homo sapiens
aattttatgccttgcacgttgg

SEQ ID NO: 7884483 - DNA, 22 bp, Homo sapiens
aattttatgccttgcacgttgg

SEQ ID NO: 7884484 - DNA, 22 bp, Homo sapiens
aatttgttaaaagtgagtgaca

SEQ ID NO: 7884485 - DNA, 22 bp, Homo sapiens
aatttgttacacagcaatataa

SEQ ID NO: 7884486 - DNA, 22 bp, Homo sapiens
aattttatgccttgcacgttgg

SEQ ID NO: 7884487 - DNA, 22 bp, Homo sapiens
aattttatgccttgcacgttgg

SEQ ID NO: 7884488 - DNA, 22 bp, Homo sapiens
aattttatgccttgcacgttgg

SEQ ID NO: 7884489 - DNA, 22 bp, Homo sapiens
aattttattaactggatgtagc

SEQ ID NO: 7884490 - DNA, 22 bp, Homo sapiens
aattttattaactggatgtagc

SEQ ID NO: 7884491 - DNA, 22 bp, Homo sapiens
aattttattaactggatgtagc

SEQ ID NO: 7884492 - DNA, 22 bp, Homo sapiens
aattttattaactggatgtagc

SEQ ID NO: 7884493 - DNA, 22 bp, Homo sapiens
aattttccatccaaagtaacat

SEQ ID NO: 7884494 - DNA, 22 bp, Homo sapiens
aattttcacagtgctgtgagat

SEQ ID NO: 7884495 - DNA, 22 bp, Homo sapiens
aattttccatccaaagtaacat

SEQ ID NO: 7884496 - DNA, 22 bp, Homo sapiens
aattttcacagtgctgtgagat

SEQ ID NO: 7884497 - DNA, 22 bp, Homo sapiens
aattttcacagtgctgtgagat

SEQ ID NO: 7884498 - DNA, 22 bp, Homo sapiens
aattttattagaaggcaagggg

SEQ ID NO: 7884499 - DNA, 22 bp, Homo sapiens
aattttattagaaggcaagggg

SEQ ID NO: 7884500 - DNA, 22 bp, Homo sapiens
aattttattagaaggcaagggg

SEQ ID NO: 7884501 - DNA, 22 bp, Homo sapiens
agaggccagtggctgtgctgtc

SEQ ID NO: 7884502 - DNA, 22 bp, Homo sapiens
agaggccagtggctgtgctgtc

SEQ ID NO: 7884503 - DNA, 22 bp, Homo sapiens
agaggccaggtccagagtttgt

SEQ ID NO: 7884504 - DNA, 22 bp, Homo sapiens
aattttctgcctagcaaaaact

SEQ ID NO: 7884505 - DNA, 22 bp, Homo sapiens
aattttctgcctagcaaaaact

SEQ ID NO: 7884506 - DNA, 22 bp, Homo sapiens
aattttctgatgatgaagcacg

SEQ ID NO: 7884507 - DNA, 22 bp, Homo sapiens
aattttctgatgatgaagcacg

SEQ ID NO: 7884508 - DNA, 22 bp, Homo sapiens
aattttctaaggtgatgatctg

SEQ ID NO: 7884509 - DNA, 22 bp, Homo sapiens
aattttctgatgatgaagcacg

SEQ ID NO: 7884510 - DNA, 22 bp, Homo sapiens
aattttctgatgatgaagcacg

SEQ ID NO: 7884511 - DNA, 22 bp, Homo sapiens
agaggccatctgctctgtgggg

SEQ ID NO: 7884512 - DNA, 20 bp, Homo sapiens
agaggccagttaggagtcta

SEQ ID NO: 7884513 - DNA, 20 bp, Homo sapiens
agaggccagttaggagtcta

SEQ ID NO: 7884514 - DNA, 20 bp, Homo sapiens
agaggccagttaggagtcta

SEQ ID NO: 7884515 - DNA, 20 bp, Homo sapiens
agaggccagttaggagtcta

SEQ ID NO: 7884516 - DNA, 20 bp, Homo sapiens
agaggccagttaggagtcta

SEQ ID NO: 7884517 - DNA, 22 bp, Homo sapiens
agaggccagtggctgtgctgtc

SEQ ID NO: 7884518 - DNA, 20 bp, Homo sapiens
agaggccagttaggagtcta

SEQ ID NO: 7884519 - DNA, 22 bp, Homo sapiens
agaggccatctgctctgtgggg

SEQ ID NO: 7884520 - DNA, 22 bp, Homo sapiens
agaggccatctgctctgtgggg

SEQ ID NO: 7884521 - DNA, 22 bp, Homo sapiens
agaggccatctgctctgtgggg

SEQ ID NO: 7884522 - DNA, 22 bp, Homo sapiens
agaggccatgctagaggcctgg

SEQ ID NO: 7884523 - DNA, 22 bp, Homo sapiens
agaggccatgctagaggcctgg

SEQ ID NO: 7884524 - DNA, 22 bp, Homo sapiens
agaggccatgctagaggcctgg

SEQ ID NO: 7884525 - DNA, 22 bp, Homo sapiens
agaggccatgctagaggcctgg

SEQ ID NO: 7884526 - DNA, 22 bp, Homo sapiens
agaggccatctgctctgtgggg

SEQ ID NO: 7884527 - DNA, 22 bp, Homo sapiens
agaggccatctgctctgtgggg

SEQ ID NO: 7884528 - DNA, 22 bp, Homo sapiens
agaggccatgctagaggcctgg

SEQ ID NO: 7884529 - DNA, 22 bp, Homo sapiens
acaaaatagagttctcccctgg

SEQ ID NO: 7884530 - DNA, 20 bp, Homo sapiens
acaaaataggtactgggtag

SEQ ID NO: 7884531 - DNA, 20 bp, Homo sapiens
acaaaataggtactgggtag

SEQ ID NO: 7884532 - DNA, 20 bp, Homo sapiens
acaaaataggtactgggtag

SEQ ID NO: 7884533 - DNA, 20 bp, Homo sapiens
acaaaataggtactgggtag

SEQ ID NO: 7884534 - DNA, 20 bp, Homo sapiens
acaaaataggtactgggtag

SEQ ID NO: 7884535 - DNA, 20 bp, Homo sapiens
acaaaataggtactgggtag

SEQ ID NO: 7884536 - DNA, 22 bp, Homo sapiens
acaaaaagggagatgaggtaga

SEQ ID NO: 7884537 - DNA, 22 bp, Homo sapiens
acaaaaagggagatgaggtaga

SEQ ID NO: 7884538 - DNA, 22 bp, Homo sapiens
acaaaaagctccattactgtcc

SEQ ID NO: 7884539 - DNA, 21 bp, Homo sapiens
agaggccctcggactgggcgt

SEQ ID NO: 7884540 - DNA, 21 bp, Homo sapiens
agaggccctcggactgggcgt

SEQ ID NO: 7884541 - DNA, 22 bp, Homo sapiens
acaaaaagggagatgaggtaga

SEQ ID NO: 7884542 - DNA, 22 bp, Homo sapiens
agaggccatgctagaggcctgg

SEQ ID NO: 7884543 - DNA, 22 bp, Homo sapiens
agaggccatgctagaggcctgg

SEQ ID NO: 7884544 - DNA, 22 bp, Homo sapiens
agaggccatctgctctgtgggg

SEQ ID NO: 7884545 - DNA, 22 bp, Homo sapiens
agaggccatgctagaggcctgg

SEQ ID NO: 7884546 - DNA, 22 bp, Homo sapiens
agaggccccaggtgagcatgcc

SEQ ID NO: 7884547 - DNA, 22 bp, Homo sapiens
agaggccatggggcatttttca

SEQ ID NO: 7884548 - DNA, 22 bp, Homo sapiens
agaggccatggggcatttttca

SEQ ID NO: 7884549 - DNA, 22 bp, Homo sapiens
agaggccatggggcatttttca

SEQ ID NO: 7884550 - DNA, 22 bp, Homo sapiens
agaggccccatgggatggcggt

SEQ ID NO: 7884551 - DNA, 22 bp, Homo sapiens
agaggccccatgggatggcggt

SEQ ID NO: 7884552 - DNA, 21 bp, Homo sapiens
agaggccctcggactgggcgt

SEQ ID NO: 7884553 - DNA, 21 bp, Homo sapiens
agaggccctcggactgggcgt

SEQ ID NO: 7884554 - DNA, 22 bp, Homo sapiens
agaggccccaggtgagcatgcc

SEQ ID NO: 7884555 - DNA, 22 bp, Homo sapiens
agaggccccatgggatggcggt

SEQ ID NO: 7884556 - DNA, 22 bp, Homo sapiens
agaggccccaggtgagcatgcc

SEQ ID NO: 7884557 - DNA, 22 bp, Homo sapiens
agaggccccaggtgagcatgcc

SEQ ID NO: 7884558 - DNA, 22 bp, Homo sapiens
agaggccccaggtgagcatgcc

SEQ ID NO: 7884559 - DNA, 22 bp, Homo sapiens
acaaatgccatatataaattct

SEQ ID NO: 7884560 - DNA, 22 bp, Homo sapiens
acaaatgccatatataaattct

SEQ ID NO: 7884561 - DNA, 23 bp, Homo sapiens
acaaatgcccatacatctagttc

SEQ ID NO: 7884562 - DNA, 22 bp, Homo sapiens
acaaatgcttagttcaccaaaa

SEQ ID NO: 7884563 - DNA, 22 bp, Homo sapiens
acaaatgcttagttcaccaaaa

SEQ ID NO: 7884564 - DNA, 22 bp, Homo sapiens
acaaatgcagcataaagtgaac

SEQ ID NO: 7884565 - DNA, 22 bp, Homo sapiens
acaaatgcagcataaagtgaac

SEQ ID NO: 7884566 - DNA, 20 bp, Homo sapiens
acaaatgcattctgtgacat

SEQ ID NO: 7884567 - DNA, 22 bp, Homo sapiens
acaaatgattttccaagccagt

SEQ ID NO: 7884568 - DNA, 22 bp, Homo sapiens
acaaatgattttccaagccagt

SEQ ID NO: 7884569 - DNA, 22 bp, Homo sapiens
acaaatgattttccaagccagt

SEQ ID NO: 7884570 - DNA, 22 bp, Homo sapiens
acaaatgattttccaagccagt

SEQ ID NO: 7884571 - DNA, 22 bp, Homo sapiens
acaaatgattatcacagaggag

SEQ ID NO: 7884572 - DNA, 22 bp, Homo sapiens
acaaatgattttccaagccagt

SEQ ID NO: 7884573 - DNA, 22 bp, Homo sapiens
acaaatgattttccaagccagt

SEQ ID NO: 7884574 - DNA, 22 bp, Homo sapiens
acaaatgattatcacagaggag

SEQ ID NO: 7884575 - DNA, 22 bp, Homo sapiens
acaaatgattatcacagaggag

SEQ ID NO: 7884576 - DNA, 22 bp, Homo sapiens
acaaatgattatcacagaggag

SEQ ID NO: 7884577 - DNA, 22 bp, Homo sapiens
acaaatgattatcacagaggag

SEQ ID NO: 7884578 - DNA, 19 bp, Homo sapiens
acaaatgatgttgcactga

SEQ ID NO: 7884579 - DNA, 19 bp, Homo sapiens
acaaatgatgttgcactga

SEQ ID NO: 7884580 - DNA, 22 bp, Homo sapiens
acaaatgagaatgtagacagag

SEQ ID NO: 7884581 - DNA, 22 bp, Homo sapiens
acaaatgagaatgtagacagag

SEQ ID NO: 7884582 - DNA, 19 bp, Homo sapiens
acaaatgatgttgcactga

SEQ ID NO: 7884583 - DNA, 22 bp, Homo sapiens
acaaatgagaatgtagacagag

SEQ ID NO: 7884584 - DNA, 22 bp, Homo sapiens
acaaatgagaatgtagacagag

SEQ ID NO: 7884585 - DNA, 22 bp, Homo sapiens
acaaatgagaatgtagacagag

SEQ ID NO: 7884586 - DNA, 22 bp, Homo sapiens
acaaatgagaatgtagacagag

SEQ ID NO: 7884587 - DNA, 22 bp, Homo sapiens
acaaatgactcaaacaccactt

SEQ ID NO: 7884588 - DNA, 22 bp, Homo sapiens
acaaatgagaatgtagacagag

SEQ ID NO: 7884589 - DNA, 22 bp, Homo sapiens
acaaacttatgtttcatatgta

SEQ ID NO: 7884590 - DNA, 22 bp, Homo sapiens
acaaacttatgtttcatatgta

SEQ ID NO: 7884591 - DNA, 19 bp, Homo sapiens
acaaactgagtacacttgt

SEQ ID NO: 7884592 - DNA, 22 bp, Homo sapiens
acaaactgaatgggttttctgt

SEQ ID NO: 7884593 - DNA, 21 bp, Homo sapiens
acaaactgaaatgagtttcct

SEQ ID NO: 7884594 - DNA, 22 bp, Homo sapiens
acaaactacctacagatgttca

SEQ ID NO: 7884595 - DNA, 22 bp, Homo sapiens
acaaactacctacagatgttca

SEQ ID NO: 7884596 - DNA, 22 bp, Homo sapiens
acaaatgactcaaacaccactt

SEQ ID NO: 7884597 - DNA, 22 bp, Homo sapiens
acaaatgactcaaacaccactt

SEQ ID NO: 7884598 - DNA, 22 bp, Homo sapiens
acaaatgactatttggtacagg

SEQ ID NO: 7884599 - DNA, 22 bp, Homo sapiens
acaaatgactatttggtacagg

SEQ ID NO: 7884600 - DNA, 22 bp, Homo sapiens
acaaatgactatttggtacagg

SEQ ID NO: 7884601 - DNA, 22 bp, Homo sapiens
acaaatgactatttggtacagg

SEQ ID NO: 7884602 - DNA, 22 bp, Homo sapiens
acaaatatggtactcggagaaa

SEQ ID NO: 7884603 - DNA, 22 bp, Homo sapiens
acaaatatggtactcggagaaa

SEQ ID NO: 7884604 - DNA, 22 bp, Homo sapiens
acaaatatggtactcggagaaa

SEQ ID NO: 7884605 - DNA, 22 bp, Homo sapiens
acaaatatggtactcggagaaa

SEQ ID NO: 7884606 - DNA, 19 bp, Homo sapiens
acaaatagttacatatcct

SEQ ID NO: 7884607 - DNA, 19 bp, Homo sapiens
acaaatagttacatatcct

SEQ ID NO: 7884608 - DNA, 19 bp, Homo sapiens
acaaatagttacatatcct

SEQ ID NO: 7884609 - DNA, 19 bp, Homo sapiens
acaaatagttacatatcct

SEQ ID NO: 7884610 - DNA, 19 bp, Homo sapiens
acaaatagttacatatcct

SEQ ID NO: 7884611 - DNA, 20 bp, Homo sapiens
acaaaataggtactgggtag

SEQ ID NO: 7884612 - DNA, 22 bp, Homo sapiens
acaaaatcaaaggagtgattca

SEQ ID NO: 7884613 - DNA, 22 bp, Homo sapiens
acaaaatcaaaggagtgattca

SEQ ID NO: 7884614 - DNA, 23 bp, Homo sapiens
acaaaatgttctgctgggaggtg

SEQ ID NO: 7884615 - DNA, 23 bp, Homo sapiens
acaaaatgttctgctgggaggtg

SEQ ID NO: 7884616 - DNA, 22 bp, Homo sapiens
acaaaattacctagttattttc

SEQ ID NO: 7884617 - DNA, 22 bp, Homo sapiens
acaaaattacctagttattttc

SEQ ID NO: 7884618 - DNA, 22 bp, Homo sapiens
acaaaattacctagttattttc

SEQ ID NO: 7884619 - DNA, 22 bp, Homo sapiens
acaaaattacctagttattttc

SEQ ID NO: 7884620 - DNA, 22 bp, Homo sapiens
acaaaattatgaagaggccttg

SEQ ID NO: 7884621 - DNA, 22 bp, Homo sapiens
acaaaattgtgttaaactttat

SEQ ID NO: 7884622 - DNA, 22 bp, Homo sapiens
acaaaattgtgttaaactttat

SEQ ID NO: 7884623 - DNA, 22 bp, Homo sapiens
acaaaattgtgttaaactttat

SEQ ID NO: 7884624 - DNA, 22 bp, Homo sapiens
acaaaatttttagacaaggctt

SEQ ID NO: 7884625 - DNA, 22 bp, Homo sapiens
acaaaatttttagacaaggctt

SEQ ID NO: 7884626 - DNA, 22 bp, Homo sapiens
acaaacacgagacgccactgtg

SEQ ID NO: 7884627 - DNA, 22 bp, Homo sapiens
acaaacacgagacgccactgtg

SEQ ID NO: 7884628 - DNA, 22 bp, Homo sapiens
acaaacacgagacgccactgtg

SEQ ID NO: 7884629 - DNA, 22 bp, Homo sapiens
acaaacacgagacgccactgtg

SEQ ID NO: 7884630 - DNA, 22 bp, Homo sapiens
acaaacagagttgaaaaatagg

SEQ ID NO: 7884631 - DNA, 22 bp, Homo sapiens
acaaacagagttgaaaaatagg

SEQ ID NO: 7884632 - DNA, 22 bp, Homo sapiens
acaaacagagttgaaaaatagg

SEQ ID NO: 7884633 - DNA, 22 bp, Homo sapiens
acaaacagagttgaaaaatagg

SEQ ID NO: 7884634 - DNA, 22 bp, Homo sapiens
acaaacagagttgaaaaatagg

SEQ ID NO: 7884635 - DNA, 22 bp, Homo sapiens
acaaacagagttgaaaaatagg

SEQ ID NO: 7884636 - DNA, 22 bp, Homo sapiens
acaaacagagttgaaaaatagg

SEQ ID NO: 7884637 - DNA, 22 bp, Homo sapiens
acaaacagagttgaaaaatagg

SEQ ID NO: 7884638 - DNA, 22 bp, Homo sapiens
acaaacagagttgaaaaatagg

SEQ ID NO: 7884639 - DNA, 22 bp, Homo sapiens
acaaacagagttgaaaaatagg

SEQ ID NO: 7884640 - DNA, 22 bp, Homo sapiens
acaaacagctaacatatgttaa

SEQ ID NO: 7884641 - DNA, 22 bp, Homo sapiens
acaaacagctaacatatgttaa

SEQ ID NO: 7884642 - DNA, 22 bp, Homo sapiens
acaaacagctaacatatgttaa

SEQ ID NO: 7884643 - DNA, 22 bp, Homo sapiens
acaaacagctaacatatgttaa

SEQ ID NO: 7884644 - DNA, 22 bp, Homo sapiens
acaaacagctaacatatgttaa

SEQ ID NO: 7884645 - DNA, 22 bp, Homo sapiens
acaaaccagcttaagcaagatg

SEQ ID NO: 7884646 - DNA, 22 bp, Homo sapiens
acaaaccagcttaagcaagatg

SEQ ID NO: 7884647 - DNA, 22 bp, Homo sapiens
acaaaccagcttaagcaagatg

SEQ ID NO: 7884648 - DNA, 22 bp, Homo sapiens
acaaacatcttgacctcagatt

SEQ ID NO: 7884649 - DNA, 22 bp, Homo sapiens
acaaacagctaacatatgttaa

SEQ ID NO: 7884650 - DNA, 22 bp, Homo sapiens
acaaacatcttgacctcagatt

SEQ ID NO: 7884651 - DNA, 22 bp, Homo sapiens
acaaacatcttgacctcagatt

SEQ ID NO: 7884652 - DNA, 22 bp, Homo sapiens
acaaacatcttgacctcagatt

SEQ ID NO: 7884653 - DNA, 22 bp, Homo sapiens
acaaacatcttgacctcagatt

SEQ ID NO: 7884654 - DNA, 22 bp, Homo sapiens
acaaaccagcttaagcaagatg

SEQ ID NO: 7884655 - DNA, 22 bp, Homo sapiens
acaaaccagcttaagcaagatg

SEQ ID NO: 7884656 - DNA, 22 bp, Homo sapiens
acaaactaaaattctttattga

SEQ ID NO: 7884657 - DNA, 22 bp, Homo sapiens
acaaactaaaattctttattga

SEQ ID NO: 7884658 - DNA, 22 bp, Homo sapiens
acaaactaaaattctttattga

SEQ ID NO: 7884659 - DNA, 22 bp, Homo sapiens
acaaactaaaattctttattga

SEQ ID NO: 7884660 - DNA, 22 bp, Homo sapiens
acaaactaaaattctttattga

SEQ ID NO: 7884661 - DNA, 22 bp, Homo sapiens
acaatgttttgaaacatctagg

SEQ ID NO: 7884662 - DNA, 22 bp, Homo sapiens
acaatgtttttgttcaaagagt

SEQ ID NO: 7884663 - DNA, 22 bp, Homo sapiens
acaatgtttttgttcaaagagt

SEQ ID NO: 7884664 - DNA, 22 bp, Homo sapiens
acaatgctgttgagacattctt

SEQ ID NO: 7884665 - DNA, 22 bp, Homo sapiens
acaatggcatgctagcaaatgg

SEQ ID NO: 7884666 - DNA, 22 bp, Homo sapiens
agatgggtaattgatggcagta

SEQ ID NO: 7884667 - DNA, 22 bp, Homo sapiens
agatgggtaattgatggcagta

SEQ ID NO: 7884668 - DNA, 22 bp, Homo sapiens
agatgggtaactggagtctgct

SEQ ID NO: 7884669 - DNA, 22 bp, Homo sapiens
agatgggtaactggagtctgct

SEQ ID NO: 7884670 - DNA, 22 bp, Homo sapiens
agatgggtaactggagtctgct

SEQ ID NO: 7884671 - DNA, 22 bp, Homo sapiens
agatggggtttcatcatgttgg

SEQ ID NO: 7884672 - DNA, 22 bp, Homo sapiens
agatggggtttcatcatgttgg

SEQ ID NO: 7884673 - DNA, 22 bp, Homo sapiens
agatggggtttcatcatgttgg

SEQ ID NO: 7884674 - DNA, 22 bp, Homo sapiens
agatggggctgaaagttccaat

SEQ ID NO: 7884675 - DNA, 22 bp, Homo sapiens
agatggggctgaaagttccaat

SEQ ID NO: 7884676 - DNA, 22 bp, Homo sapiens
agatggggctgaaagttccaat

SEQ ID NO: 7884677 - DNA, 22 bp, Homo sapiens
agatggggctgaaagttccaat

SEQ ID NO: 7884678 - DNA, 22 bp, Homo sapiens
agatggggctgaaagttccaat

SEQ ID NO: 7884679 - DNA, 22 bp, Homo sapiens
agatggggctgaaagttccaat

SEQ ID NO: 7884680 - DNA, 22 bp, Homo sapiens
agatggggctcagtgtggaggc

SEQ ID NO: 7884681 - DNA, 22 bp, Homo sapiens
agatggggctcagtgtggaggc

SEQ ID NO: 7884682 - DNA, 22 bp, Homo sapiens
agatggggctcagtgtggaggc

SEQ ID NO: 7884683 - DNA, 22 bp, Homo sapiens
agatggggctcagtgtggaggc

SEQ ID NO: 7884684 - DNA, 22 bp, Homo sapiens
acaattcctgagaatacttgtt

SEQ ID NO: 7884685 - DNA, 22 bp, Homo sapiens
acaattctctcatatcttatta

SEQ ID NO: 7884686 - DNA, 22 bp, Homo sapiens
acaattcattaatgtgaggtag

SEQ ID NO: 7884687 - DNA, 22 bp, Homo sapiens
acaattcaagcaagagagacaa

SEQ ID NO: 7884688 - DNA, 22 bp, Homo sapiens
acaattcattaatgtgaggtag

SEQ ID NO: 7884689 - DNA, 22 bp, Homo sapiens
acaattcactccagtgacccca

SEQ ID NO: 7884690 - DNA, 22 bp, Homo sapiens
acaattcactccagtgacccca

SEQ ID NO: 7884691 - DNA, 22 bp, Homo sapiens
agcaagattgaggcttcctcag

SEQ ID NO: 7884692 - DNA, 22 bp, Homo sapiens
agcaagattgaggcttcctcag

SEQ ID NO: 7884693 - DNA, 22 bp, Homo sapiens
acaattagctgtgtgtctatct

SEQ ID NO: 7884694 - DNA, 22 bp, Homo sapiens
acaattagcaaggggaagattt

SEQ ID NO: 7884695 - DNA, 22 bp, Homo sapiens
acaattagctgtgtgtctatct

SEQ ID NO: 7884696 - DNA, 22 bp, Homo sapiens
acaattagcaaggggaagattt

SEQ ID NO: 7884697 - DNA, 22 bp, Homo sapiens
acaattactcaactttgctgct

SEQ ID NO: 7884698 - DNA, 22 bp, Homo sapiens
acaattaccctggcttgataaa

SEQ ID NO: 7884699 - DNA, 22 bp, Homo sapiens
acaattaccctggcttgataaa

SEQ ID NO: 7884700 - DNA, 22 bp, Homo sapiens
acaattaccctggcttgataaa

SEQ ID NO: 7884701 - DNA, 22 bp, Homo sapiens
acaattagtgatcagtgatgcc

SEQ ID NO: 7884702 - DNA, 22 bp, Homo sapiens
acaattagtgatcagtgatgcc

SEQ ID NO: 7884703 - DNA, 22 bp, Homo sapiens
acaattcaagaagagagatgaa

SEQ ID NO: 7884704 - DNA, 22 bp, Homo sapiens
acaattcaagaagagagatgaa

SEQ ID NO: 7884705 - DNA, 22 bp, Homo sapiens
acaattcaagatgagattcagg

SEQ ID NO: 7884706 - DNA, 22 bp, Homo sapiens
acaattcaagatgagattcagg

SEQ ID NO: 7884707 - DNA, 22 bp, Homo sapiens
agcaagcagaattctgtcctct

SEQ ID NO: 7884708 - DNA, 21 bp, Homo sapiens
agcaagcagaatccatctaga

SEQ ID NO: 7884709 - DNA, 22 bp, Homo sapiens
agcaagcagaaatgccatggca

SEQ ID NO: 7884710 - DNA, 22 bp, Homo sapiens
agcaagcagaaatgccatggca

SEQ ID NO: 7884711 - DNA, 22 bp, Homo sapiens
agcaagcacacttcatgtgaac

SEQ ID NO: 7884712 - DNA, 22 bp, Homo sapiens
agcaagatttttcaggttagta

SEQ ID NO: 7884713 - DNA, 22 bp, Homo sapiens
agcaagatttaaacccaggtca

SEQ ID NO: 7884714 - DNA, 22 bp, Homo sapiens
agcaagattttccttgaatgtt

SEQ ID NO: 7884715 - DNA, 22 bp, Homo sapiens
agcaagattttccttgaatgtt

SEQ ID NO: 7884716 - DNA, 22 bp, Homo sapiens
agcaagattgaggcttcctcag

SEQ ID NO: 7884717 - DNA, 22 bp, Homo sapiens
agcaagattgaggcttcctcag

SEQ ID NO: 7884718 - DNA, 22 bp, Homo sapiens
agcaagatttaaacccaggtca

SEQ ID NO: 7884719 - DNA, 22 bp, Homo sapiens
agcaagatttaaacccaggtca

SEQ ID NO: 7884720 - DNA, 22 bp, Homo sapiens
agcaagcattgctggttaggtc

SEQ ID NO: 7884721 - DNA, 18 bp, Homo sapiens
agcaagcagttttcatgt

SEQ ID NO: 7884722 - DNA, 22 bp, Homo sapiens
agcaagcagtgaagttgaatgt

SEQ ID NO: 7884723 - DNA, 22 bp, Homo sapiens
agcaagcaggatggtcaaacta

SEQ ID NO: 7884724 - DNA, 18 bp, Homo sapiens
agcaagcagttttcatgt

SEQ ID NO: 7884725 - DNA, 18 bp, Homo sapiens
agcaagcagttttcatgt

SEQ ID NO: 7884726 - DNA, 22 bp, Homo sapiens
agcaaggaaactatggagagat

SEQ ID NO: 7884727 - DNA, 22 bp, Homo sapiens
agcaagctgtcaagagagctga

SEQ ID NO: 7884728 - DNA, 22 bp, Homo sapiens
agcaaggaaactatggagagat

SEQ ID NO: 7884729 - DNA, 22 bp, Homo sapiens
agcaaggcagtcagctggctgg

SEQ ID NO: 7884730 - DNA, 22 bp, Homo sapiens
agcacaggtacggagatgctac

SEQ ID NO: 7884731 - DNA, 22 bp, Homo sapiens
agcacaggtacggagatgctac

SEQ ID NO: 7884732 - DNA, 22 bp, Homo sapiens
agcacaggtacggagatgctac

SEQ ID NO: 7884733 - DNA, 22 bp, Homo sapiens
agcaaggcagctttcactgctt

SEQ ID NO: 7884734 - DNA, 22 bp, Homo sapiens
agcaaggcagctttcactgctt

SEQ ID NO: 7884735 - DNA, 22 bp, Homo sapiens
agcaaggcagctttcactgctt

SEQ ID NO: 7884736 - DNA, 22 bp, Homo sapiens
agcaaggattatcctgggaagg

SEQ ID NO: 7884737 - DNA, 21 bp, Homo sapiens
agcaaggcagcctctcagcct

SEQ ID NO: 7884738 - DNA, 22 bp, Homo sapiens
agcaaggagtagaacaagagtg

SEQ ID NO: 7884739 - DNA, 22 bp, Homo sapiens
agcaaggattatcctgggaagg

SEQ ID NO: 7884740 - DNA, 22 bp, Homo sapiens
agcaaggattatcctgggaagg

SEQ ID NO: 7884741 - DNA, 22 bp, Homo sapiens
agcaaggaaagtaggcacggaa

SEQ ID NO: 7884742 - DNA, 22 bp, Homo sapiens
agcaaggaaagtaggcacggaa

SEQ ID NO: 7884743 - DNA, 22 bp, Homo sapiens
agcaaggaaagtaggcacggaa

SEQ ID NO: 7884744 - DNA, 22 bp, Homo sapiens
agcaccagtttcgtcgtgacaa

SEQ ID NO: 7884745 - DNA, 20 bp, Homo sapiens
agcaccagtgggggcagccc

SEQ ID NO: 7884746 - DNA, 21 bp, Homo sapiens
agcaccagttttatgccaggc

SEQ ID NO: 7884747 - DNA, 21 bp, Homo sapiens
agcaccagttttatgccaggc

SEQ ID NO: 7884748 - DNA, 20 bp, Homo sapiens
agcaccagtgggggcagccc

SEQ ID NO: 7884749 - DNA, 20 bp, Homo sapiens
agcaccagtgggggcagccc

SEQ ID NO: 7884750 - DNA, 20 bp, Homo sapiens
agcaccagtgggggcagccc

SEQ ID NO: 7884751 - DNA, 20 bp, Homo sapiens
agcaccagtgggggcagccc

SEQ ID NO: 7884752 - DNA, 20 bp, Homo sapiens
agcaccagtgggggcagccc

SEQ ID NO: 7884753 - DNA, 22 bp, Homo sapiens
agcacaggtacggagatgctac

SEQ ID NO: 7884754 - DNA, 22 bp, Homo sapiens
agcaaggcagtcagctggctgg

SEQ ID NO: 7884755 - DNA, 22 bp, Homo sapiens
agcacaggtacggagatgctac

SEQ ID NO: 7884756 - DNA, 22 bp, Homo sapiens
acaaatgtctacattgagaata

SEQ ID NO: 7884757 - DNA, 22 bp, Homo sapiens
acaaatgtctacattgagaata

SEQ ID NO: 7884758 - DNA, 23 bp, Homo sapiens
acaaatgtctagagagggtgtga

SEQ ID NO: 7884759 - DNA, 22 bp, Homo sapiens
acaaatgtctcctcttttgtta

SEQ ID NO: 7884760 - DNA, 22 bp, Homo sapiens
acaaatgtctacattgagaata

SEQ ID NO: 7884761 - DNA, 22 bp, Homo sapiens
acaaatgtctacattgagaata

SEQ ID NO: 7884762 - DNA, 22 bp, Homo sapiens
acaaatgtctacattgagaata

SEQ ID NO: 7884763 - DNA, 22 bp, Homo sapiens
acaaatggactctcatcttttg

SEQ ID NO: 7884764 - DNA, 18 bp, Homo sapiens
acaaatgtagtgtcttaa

SEQ ID NO: 7884765 - DNA, 18 bp, Homo sapiens
acaaatgtagtgtcttaa

SEQ ID NO: 7884766 - DNA, 18 bp, Homo sapiens
acaaatgtagtgtcttaa

SEQ ID NO: 7884767 - DNA, 18 bp, Homo sapiens
acaaatgtagtgtcttaa

SEQ ID NO: 7884768 - DNA, 22 bp, Homo sapiens
acaaatggaaggtgttctcttc

SEQ ID NO: 7884769 - DNA, 22 bp, Homo sapiens
acaaatggaacaatgaagactg

SEQ ID NO: 7884770 - DNA, 22 bp, Homo sapiens
acaaatgtggacatggataatg

SEQ ID NO: 7884771 - DNA, 18 bp, Homo sapiens
acaaatgtgtcacaggaa

SEQ ID NO: 7884772 - DNA, 18 bp, Homo sapiens
acaaatgtgtcacaggaa

SEQ ID NO: 7884773 - DNA, 22 bp, Homo sapiens
acaaatgtgtctaattgtgcct

SEQ ID NO: 7884774 - DNA, 22 bp, Homo sapiens
acaaatgtgtctaattgtgcct

SEQ ID NO: 7884775 - DNA, 18 bp, Homo sapiens
acaaatgtgtcacaggaa

SEQ ID NO: 7884776 - DNA, 22 bp, Homo sapiens
acaaatgtggacatggataatg

SEQ ID NO: 7884777 - DNA, 22 bp, Homo sapiens
acaaatgtggacatggataatg

SEQ ID NO: 7884778 - DNA, 22 bp, Homo sapiens
acaaatgtggacatggataatg

SEQ ID NO: 7884779 - DNA, 22 bp, Homo sapiens
acaaatgtggacatggataatg

SEQ ID NO: 7884780 - DNA, 22 bp, Homo sapiens
acaaatgtggacatggataatg

SEQ ID NO: 7884781 - DNA, 22 bp, Homo sapiens
acaaatgtgattgtttctgaaa

SEQ ID NO: 7884782 - DNA, 23 bp, Homo sapiens
acaaatgtctagagagggtgtga

SEQ ID NO: 7884783 - DNA, 22 bp, Homo sapiens
acaaatgtctcctcttttgtta

SEQ ID NO: 7884784 - DNA, 22 bp, Homo sapiens
acaaatgtctcctcttttgtta

SEQ ID NO: 7884785 - DNA, 22 bp, Homo sapiens
acaaatgtgattgtttctgaaa

SEQ ID NO: 7884786 - DNA, 22 bp, Homo sapiens
acaaatgtgattgtttctgaaa

SEQ ID NO: 7884787 - DNA, 22 bp, Homo sapiens
acaaatgtgattgtttctgaaa

SEQ ID NO: 7884788 - DNA, 22 bp, Homo sapiens
acaaattatagaaaattgagct

SEQ ID NO: 7884789 - DNA, 22 bp, Homo sapiens
acaaattatagaaaattgagct

SEQ ID NO: 7884790 - DNA, 22 bp, Homo sapiens
acaaattaccatggaatttggg

SEQ ID NO: 7884791 - DNA, 22 bp, Homo sapiens
acaaattaccatggaatttggg

SEQ ID NO: 7884792 - DNA, 22 bp, Homo sapiens
acaaattatagaaaattgagct

SEQ ID NO: 7884793 - DNA, 22 bp, Homo sapiens
acaaattatagaaaattgagct

SEQ ID NO: 7884794 - DNA, 22 bp, Homo sapiens
acaaattatagaaaattgagct

SEQ ID NO: 7884795 - DNA, 22 bp, Homo sapiens
acaaattatagaaaattgagct

SEQ ID NO: 7884796 - DNA, 22 bp, Homo sapiens
acaaatgttacataagtttgga

SEQ ID NO: 7884797 - DNA, 22 bp, Homo sapiens
acaaatgttacataagtttgga

SEQ ID NO: 7884798 - DNA, 22 bp, Homo sapiens
acaaatgttacataagtttgga

SEQ ID NO: 7884799 - DNA, 22 bp, Homo sapiens
acaaatgttggatttgtcttcc

SEQ ID NO: 7884800 - DNA, 22 bp, Homo sapiens
acaaatgttggatttgtcttcc

SEQ ID NO: 7884801 - DNA, 22 bp, Homo sapiens
acaaatgttggatttgtcttcc

SEQ ID NO: 7884802 - DNA, 22 bp, Homo sapiens
acaagctttgtgatagtagaga

SEQ ID NO: 7884803 - DNA, 22 bp, Homo sapiens
acaaattctttctgcctattgg

SEQ ID NO: 7884804 - DNA, 22 bp, Homo sapiens
acaaattgaccgcaagattcat

SEQ ID NO: 7884805 - DNA, 22 bp, Homo sapiens
acaaattctttctgcctattgg

SEQ ID NO: 7884806 - DNA, 22 bp, Homo sapiens
acaaattctctaggcaaggaag

SEQ ID NO: 7884807 - DNA, 22 bp, Homo sapiens
acaaattctacaatcatatgat

SEQ ID NO: 7884808 - DNA, 22 bp, Homo sapiens
acaaattctacaatcatatgat

SEQ ID NO: 7884809 - DNA, 22 bp, Homo sapiens
acaaattctacaatcatatgat

SEQ ID NO: 7884810 - DNA, 22 bp, Homo sapiens
acaaattctacaatcatatgat

SEQ ID NO: 7884811 - DNA, 22 bp, Homo sapiens
acaaggaacaagcatgtagttt

SEQ ID NO: 7884812 - DNA, 22 bp, Homo sapiens
acaaggaacaagcatgtagttt

SEQ ID NO: 7884813 - DNA, 22 bp, Homo sapiens
acaaggaacaagcatgtagttt

SEQ ID NO: 7884814 - DNA, 22 bp, Homo sapiens
acaaggaacaagcatgtagttt

SEQ ID NO: 7884815 - DNA, 22 bp, Homo sapiens
acaaggctttggagggttctta

SEQ ID NO: 7884816 - DNA, 22 bp, Homo sapiens
acaagggattgttgagtagtct

SEQ ID NO: 7884817 - DNA, 19 bp, Homo sapiens
agatggggaagagtgtgag

SEQ ID NO: 7884818 - DNA, 19 bp, Homo sapiens
agatggggaagagtgtgag

SEQ ID NO: 7884819 - DNA, 22 bp, Homo sapiens
acaagtttatttgattagaaca

SEQ ID NO: 7884820 - DNA, 22 bp, Homo sapiens
acaagtttcattgtttagaacc

SEQ ID NO: 7884821 - DNA, 22 bp, Homo sapiens
acaagtttatttgattagaaca

SEQ ID NO: 7884822 - DNA, 22 bp, Homo sapiens
acaagtttatttgattagaaca

SEQ ID NO: 7884823 - DNA, 22 bp, Homo sapiens
acaagttaccaaaaaagattca

SEQ ID NO: 7884824 - DNA, 22 bp, Homo sapiens
acaagttaggttttaatccaaa

SEQ ID NO: 7884825 - DNA, 22 bp, Homo sapiens
acaagttaggttttaatccaaa

SEQ ID NO: 7884826 - DNA, 19 bp, Homo sapiens
agatggggaagagtgtgag

SEQ ID NO: 7884827 - DNA, 19 bp, Homo sapiens
agatggggaagagtgtgag

SEQ ID NO: 7884828 - DNA, 19 bp, Homo sapiens
agatggggaagagtgtgag

SEQ ID NO: 7884829 - DNA, 19 bp, Homo sapiens
agatggggaagagtgtgag

SEQ ID NO: 7884830 - DNA, 19 bp, Homo sapiens
agatggggaagagtgtgag

SEQ ID NO: 7884831 - DNA, 22 bp, Homo sapiens
agatggggcagaatggagccat

SEQ ID NO: 7884832 - DNA, 22 bp, Homo sapiens
agatggggcagaatggagccat

SEQ ID NO: 7884833 - DNA, 22 bp, Homo sapiens
agatggggcagaatggagccat

SEQ ID NO: 7884834 - DNA, 22 bp, Homo sapiens
agatggggcagaatggagccat

SEQ ID NO: 7884835 - DNA, 22 bp, Homo sapiens
agatggggcagaatggagccat

SEQ ID NO: 7884836 - DNA, 22 bp, Homo sapiens
agatggggctcagtgtggaggc

SEQ ID NO: 7884837 - DNA, 22 bp, Homo sapiens
agatggggctcagtgtggaggc

SEQ ID NO: 7884838 - DNA, 22 bp, Homo sapiens
agatggggctcagtgtggaggc

SEQ ID NO: 7884839 - DNA, 22 bp, Homo sapiens
agatggggctcagtgtggaggc

SEQ ID NO: 7884840 - DNA, 22 bp, Homo sapiens
agatggggcagaatggagccat

SEQ ID NO: 7884841 - DNA, 22 bp, Homo sapiens
agatggggcagaatggagccat

SEQ ID NO: 7884842 - DNA, 22 bp, Homo sapiens
acaaggtttggtcctatatttt

SEQ ID NO: 7884843 - DNA, 22 bp, Homo sapiens
acaagtatttaaggttagtata

SEQ ID NO: 7884844 - DNA, 22 bp, Homo sapiens
acaagtattggtgaggatgtag

SEQ ID NO: 7884845 - DNA, 22 bp, Homo sapiens
acaagtcactctatcattttca

SEQ ID NO: 7884846 - DNA, 22 bp, Homo sapiens
acaaggttggctctttctttgt

SEQ ID NO: 7884847 - DNA, 22 bp, Homo sapiens
acaaggtatccacattaaatgt

SEQ ID NO: 7884848 - DNA, 22 bp, Homo sapiens
acaagtctttttcatgtcttct

SEQ ID NO: 7884849 - DNA, 22 bp, Homo sapiens
acaagtctgttatgcacctgga

SEQ ID NO: 7884850 - DNA, 19 bp, Homo sapiens
acaagtcacttacttagta

SEQ ID NO: 7884851 - DNA, 22 bp, Homo sapiens
acaagtctcaacagcagccagc

SEQ ID NO: 7884852 - DNA, 22 bp, Homo sapiens
acaagtctttttcatgtcttct

SEQ ID NO: 7884853 - DNA, 22 bp, Homo sapiens
acaagtggctacctagattata

SEQ ID NO: 7884854 - DNA, 22 bp, Homo sapiens
acaagtctcaacagcagccagc

SEQ ID NO: 7884855 - DNA, 22 bp, Homo sapiens
acaagtgtgtgcagtttgtaaa

SEQ ID NO: 7884856 - DNA, 22 bp, Homo sapiens
acaagtgtgtgcagtttgtaaa

SEQ ID NO: 7884857 - DNA, 22 bp, Homo sapiens
acaagtgggtcctacataaagc

SEQ ID NO: 7884858 - DNA, 22 bp, Homo sapiens
acaagttaccaaaaaagattca

SEQ ID NO: 7884859 - DNA, 22 bp, Homo sapiens
acaagtgttgcattttgccatt

SEQ ID NO: 7884860 - DNA, 22 bp, Homo sapiens
aaatgcaggtagtatttatttt

SEQ ID NO: 7884861 - DNA, 22 bp, Homo sapiens
aaatgcaggtagtatttatttt

SEQ ID NO: 7884862 - DNA, 22 bp, Homo sapiens
aaatgcaggttcttgagccaag

SEQ ID NO: 7884863 - DNA, 22 bp, Homo sapiens
aaatgcaggttcttgagccaag

SEQ ID NO: 7884864 - DNA, 22 bp, Homo sapiens
aaatgcagtggttctacttctc

SEQ ID NO: 7884865 - DNA, 21 bp, Homo sapiens
aaatgcagtctctgagatctg

SEQ ID NO: 7884866 - DNA, 21 bp, Homo sapiens
aaatgcagtctctgagatctg

SEQ ID NO: 7884867 - DNA, 22 bp, Homo sapiens
aaatgcatcagctcataagaga

SEQ ID NO: 7884868 - DNA, 22 bp, Homo sapiens
aaatgcagtttcctgagaccca

SEQ ID NO: 7884869 - DNA, 22 bp, Homo sapiens
aaatgcagtttcctgagaccca

SEQ ID NO: 7884870 - DNA, 22 bp, Homo sapiens
aaatgcatgagaaagtattctg

SEQ ID NO: 7884871 - DNA, 22 bp, Homo sapiens
aagcatcaacactatattgatg

SEQ ID NO: 7884872 - DNA, 22 bp, Homo sapiens
aagcacagctggaacagcagga

SEQ ID NO: 7884873 - DNA, 22 bp, Homo sapiens
aagcacagctggaacagcagga

SEQ ID NO: 7884874 - DNA, 22 bp, Homo sapiens
aaatgcacaggttttaaatcct

SEQ ID NO: 7884875 - DNA, 22 bp, Homo sapiens
aagcacagctggaacagcagga

SEQ ID NO: 7884876 - DNA, 22 bp, Homo sapiens
aagcacagctggaacagcagga

SEQ ID NO: 7884877 - DNA, 22 bp, Homo sapiens
aagcacagctggaacagcagga

SEQ ID NO: 7884878 - DNA, 22 bp, Homo sapiens
aagcacagctggaacagcagga

SEQ ID NO: 7884879 - DNA, 22 bp, Homo sapiens
aagcacagattgctgcatccat

SEQ ID NO: 7884880 - DNA, 22 bp, Homo sapiens
aagcacagcagagccttgcttg

SEQ ID NO: 7884881 - DNA, 22 bp, Homo sapiens
aagcacagatgcaagggggacc

SEQ ID NO: 7884882 - DNA, 22 bp, Homo sapiens
aagcacagatgcaagggggacc

SEQ ID NO: 7884883 - DNA, 22 bp, Homo sapiens
aagcacagatgcaagggggacc

SEQ ID NO: 7884884 - DNA, 22 bp, Homo sapiens
aagcacagattgctgcatccat

SEQ ID NO: 7884885 - DNA, 22 bp, Homo sapiens
aagcacagatgcaagggggacc

SEQ ID NO: 7884886 - DNA, 22 bp, Homo sapiens
aaatgcaggaaattatgctttt

SEQ ID NO: 7884887 - DNA, 22 bp, Homo sapiens
aaatgcaggaaattatgctttt

SEQ ID NO: 7884888 - DNA, 22 bp, Homo sapiens
aaatgcaggaaattatgctttt

SEQ ID NO: 7884889 - DNA, 22 bp, Homo sapiens
aaatgcaggaaattatgctttt

SEQ ID NO: 7884890 - DNA, 22 bp, Homo sapiens
aaatgcaggattaacagctttg

SEQ ID NO: 7884891 - DNA, 23 bp, Homo sapiens
aaatgcacagtattgatttttaa

SEQ ID NO: 7884892 - DNA, 22 bp, Homo sapiens
aaatgcacaggttttaaatcct

SEQ ID NO: 7884893 - DNA, 23 bp, Homo sapiens
aaatgcacagtattgatttttaa

SEQ ID NO: 7884894 - DNA, 22 bp, Homo sapiens
aaatgcaggaaattatgctttt

SEQ ID NO: 7884895 - DNA, 22 bp, Homo sapiens
aaatgcagctgggcatgagagg

SEQ ID NO: 7884896 - DNA, 22 bp, Homo sapiens
aaatcctaatgacaagtttagt

SEQ ID NO: 7884897 - DNA, 22 bp, Homo sapiens
aaatcctaataatgcactagtg

SEQ ID NO: 7884898 - DNA, 22 bp, Homo sapiens
aaatcccttgctctctcagacc

SEQ ID NO: 7884899 - DNA, 22 bp, Homo sapiens
aaatccctgataatgtaggtct

SEQ ID NO: 7884900 - DNA, 22 bp, Homo sapiens
aaatcctaagcagaggaattta

SEQ ID NO: 7884901 - DNA, 23 bp, Homo sapiens
aaatcctgcctcttgtatttatc

SEQ ID NO: 7884902 - DNA, 22 bp, Homo sapiens
aaatcctggcctcaagtggtcc

SEQ ID NO: 7884903 - DNA, 22 bp, Homo sapiens
aaatcctgtccatttaccagat

SEQ ID NO: 7884904 - DNA, 22 bp, Homo sapiens
aaatccttgatagtttgcccta

SEQ ID NO: 7884905 - DNA, 22 bp, Homo sapiens
aaatccttgatagtttgcccta

SEQ ID NO: 7884906 - DNA, 22 bp, Homo sapiens
aaatcgcttgaacccaggaagt

SEQ ID NO: 7884907 - DNA, 22 bp, Homo sapiens
aaatctagaagtttaaaaggat

SEQ ID NO: 7884908 - DNA, 22 bp, Homo sapiens
aaatctagaagtttaaaaggat

SEQ ID NO: 7884909 - DNA, 22 bp, Homo sapiens
aaatctaggccgggtgcggtgg

SEQ ID NO: 7884910 - DNA, 22 bp, Homo sapiens
aaatcgtggaagacaccagtgg

SEQ ID NO: 7884911 - DNA, 22 bp, Homo sapiens
aaatcggttggttcaaggtaat

SEQ ID NO: 7884912 - DNA, 22 bp, Homo sapiens
aaatcggttggttcaaggtaat

SEQ ID NO: 7884913 - DNA, 22 bp, Homo sapiens
aaatcggttggttcaaggtaat

SEQ ID NO: 7884914 - DNA, 22 bp, Homo sapiens
aaatctagtacctttttgatta

SEQ ID NO: 7884915 - DNA, 22 bp, Homo sapiens
aaatctaggctcatcctggtcc

SEQ ID NO: 7884916 - DNA, 22 bp, Homo sapiens
aaatctagtacctttttgatta

SEQ ID NO: 7884917 - DNA, 22 bp, Homo sapiens
aaatctaggccgggtgcggtgg

SEQ ID NO: 7884918 - DNA, 22 bp, Homo sapiens
aaatctaggctcatcctggtcc

SEQ ID NO: 7884919 - DNA, 22 bp, Homo sapiens
aaatctcaaaggcttagcatct

SEQ ID NO: 7884920 - DNA, 22 bp, Homo sapiens
aaatctcaaaggcttagcatct

SEQ ID NO: 7884921 - DNA, 22 bp, Homo sapiens
aagcacagactccctctgagtg

SEQ ID NO: 7884922 - DNA, 22 bp, Homo sapiens
aagcacagactccctctgagtg

SEQ ID NO: 7884923 - DNA, 22 bp, Homo sapiens
aagcacagactccctctgagtg

SEQ ID NO: 7884924 - DNA, 22 bp, Homo sapiens
aagcacagactccctctgagtg

SEQ ID NO: 7884925 - DNA, 22 bp, Homo sapiens
aagcacagacacaaaaggcttt

SEQ ID NO: 7884926 - DNA, 22 bp, Homo sapiens
aagcacagacacaaaaggcttt

SEQ ID NO: 7884927 - DNA, 22 bp, Homo sapiens
aagcacagacacaaaaggcttt

SEQ ID NO: 7884928 - DNA, 22 bp, Homo sapiens
aagcacagacacaaaaggcttt

SEQ ID NO: 7884929 - DNA, 22 bp, Homo sapiens
aagcacagaccagatctccagg

SEQ ID NO: 7884930 - DNA, 22 bp, Homo sapiens
aagcacagaccagatctccagg

SEQ ID NO: 7884931 - DNA, 23 bp, Homo sapiens
aagcacagaatggtttaggagtt

SEQ ID NO: 7884932 - DNA, 23 bp, Homo sapiens
aagcacagaatggtttaggagtt

SEQ ID NO: 7884933 - DNA, 22 bp, Homo sapiens
aaatctcaaaggcttagcatct

SEQ ID NO: 7884934 - DNA, 22 bp, Homo sapiens
aagcacagagatgggcacgcct

SEQ ID NO: 7884935 - DNA, 22 bp, Homo sapiens
aagcacagagatgggcacgcct

SEQ ID NO: 7884936 - DNA, 22 bp, Homo sapiens
aagcacagacacaaaaggcttt

SEQ ID NO: 7884937 - DNA, 22 bp, Homo sapiens
aagcacagataaaacaggattc

SEQ ID NO: 7884938 - DNA, 22 bp, Homo sapiens
aagcacagataaaacaggattc

SEQ ID NO: 7884939 - DNA, 22 bp, Homo sapiens
aagcacagactccctctgagtg

SEQ ID NO: 7884940 - DNA, 22 bp, Homo sapiens
aagcacagactccctctgagtg

SEQ ID NO: 7884941 - DNA, 22 bp, Homo sapiens
aagcacagactccctctgagtg

SEQ ID NO: 7884942 - DNA, 22 bp, Homo sapiens
aagcacagactccctctgagtg

SEQ ID NO: 7884943 - DNA, 22 bp, Homo sapiens
aagcacagagaggtaaagtaac

SEQ ID NO: 7884944 - DNA, 22 bp, Homo sapiens
aagcacagagaggtaaagtaac

SEQ ID NO: 7884945 - DNA, 22 bp, Homo sapiens
aagcacagagaggtaaagtaac

SEQ ID NO: 7884946 - DNA, 22 bp, Homo sapiens
aagcacagagaggtaaagtaac

SEQ ID NO: 7884947 - DNA, 18 bp, Homo sapiens
aaatggcagaatggatag

SEQ ID NO: 7884948 - DNA, 22 bp, Homo sapiens
aaatggcagcccagaggtaagg

SEQ ID NO: 7884949 - DNA, 22 bp, Homo sapiens
aagcatgggaggcctggaggag

SEQ ID NO: 7884950 - DNA, 20 bp, Homo sapiens
aagcatggtcaaaacttatg

SEQ ID NO: 7884951 - DNA, 22 bp, Homo sapiens
aagcatggctgagtgcaatggt

SEQ ID NO: 7884952 - DNA, 22 bp, Homo sapiens
aaatgtacaacatccatatata

SEQ ID NO: 7884953 - DNA, 22 bp, Homo sapiens
aaatgtacaacatccatatata

SEQ ID NO: 7884954 - DNA, 22 bp, Homo sapiens
aaatgtacaacatccatatata

SEQ ID NO: 7884955 - DNA, 22 bp, Homo sapiens
aaatgtacactttgcatcttga

SEQ ID NO: 7884956 - DNA, 22 bp, Homo sapiens
aaatgtaagtctttgtttctta

SEQ ID NO: 7884957 - DNA, 22 bp, Homo sapiens
aaatgtaagtctttgtttctta

SEQ ID NO: 7884958 - DNA, 22 bp, Homo sapiens
aaatgtaagtctttgtttctta

SEQ ID NO: 7884959 - DNA, 22 bp, Homo sapiens
aaatgtaagtctttgtttctta

SEQ ID NO: 7884960 - DNA, 22 bp, Homo sapiens
aaatgtaagtctttgtttctta

SEQ ID NO: 7884961 - DNA, 22 bp, Homo sapiens
aaatgtaagtctttgtttctta

SEQ ID NO: 7884962 - DNA, 22 bp, Homo sapiens
aaatgtaagtctttgtttctta

SEQ ID NO: 7884963 - DNA, 22 bp, Homo sapiens
aaatggcaggctctttgctagt

SEQ ID NO: 7884964 - DNA, 22 bp, Homo sapiens
aaatggcagcccagaggtaagg

SEQ ID NO: 7884965 - DNA, 22 bp, Homo sapiens
aagcatcttaaaaagtatcaga

SEQ ID NO: 7884966 - DNA, 22 bp, Homo sapiens
aagcatctgtaaagacccttat

SEQ ID NO: 7884967 - DNA, 20 bp, Homo sapiens
aagcatctggatgtagcaat

SEQ ID NO: 7884968 - DNA, 20 bp, Homo sapiens
aagcatctggatgtagcaat

SEQ ID NO: 7884969 - DNA, 22 bp, Homo sapiens
aagcatgcactccaaacagctt

SEQ ID NO: 7884970 - DNA, 22 bp, Homo sapiens
aagcatgcaatctgtgataagg

SEQ ID NO: 7884971 - DNA, 22 bp, Homo sapiens
aagcatgcaatctgtgataagg

SEQ ID NO: 7884972 - DNA, 22 bp, Homo sapiens
aagcatgcaatctgtgataagg

SEQ ID NO: 7884973 - DNA, 23 bp, Homo sapiens
aagcatcttttcctagctccatc

SEQ ID NO: 7884974 - DNA, 22 bp, Homo sapiens
aagcatgaatcgactcggcaac

SEQ ID NO: 7884975 - DNA, 22 bp, Homo sapiens
aagcatctcctcatcatttggg

SEQ ID NO: 7884976 - DNA, 22 bp, Homo sapiens
aagcatctcctcatcatttggg

SEQ ID NO: 7884977 - DNA, 22 bp, Homo sapiens
aagcatctctatgtggagagtg

SEQ ID NO: 7884978 - DNA, 22 bp, Homo sapiens
aagcatctcattcttgcctgtc

SEQ ID NO: 7884979 - DNA, 22 bp, Homo sapiens
aagcatctcctcatcatttggg

SEQ ID NO: 7884980 - DNA, 22 bp, Homo sapiens
aagcatcaacactatattgatg

SEQ ID NO: 7884981 - DNA, 22 bp, Homo sapiens
aagcatccggggctccaggtgc

SEQ ID NO: 7884982 - DNA, 22 bp, Homo sapiens
aagcatccgtatctctttttta

SEQ ID NO: 7884983 - DNA, 22 bp, Homo sapiens
aagcatcaacctgtatgctgca

SEQ ID NO: 7884984 - DNA, 22 bp, Homo sapiens
aagcatcattcacttccttctg

SEQ ID NO: 7884985 - DNA, 22 bp, Homo sapiens
aagcatcaacctgtatgctgca

SEQ ID NO: 7884986 - DNA, 22 bp, Homo sapiens
aagcatctatattccactgtga

SEQ ID NO: 7884987 - DNA, 22 bp, Homo sapiens
aagcatctataggttctaggag

SEQ ID NO: 7884988 - DNA, 21 bp, Homo sapiens
aagcatcctctcaggagctgt

SEQ ID NO: 7884989 - DNA, 22 bp, Homo sapiens
aagcatctaggtgactgacata

SEQ ID NO: 7884990 - DNA, 22 bp, Homo sapiens
aaatgtattgcataggatattt

SEQ ID NO: 7884991 - DNA, 22 bp, Homo sapiens
aaatgtatcctacttcctgagt

SEQ ID NO: 7884992 - DNA, 22 bp, Homo sapiens
aaatgtattgcataggatattt

SEQ ID NO: 7884993 - DNA, 22 bp, Homo sapiens
aaatgtattgcataggatattt

SEQ ID NO: 7884994 - DNA, 22 bp, Homo sapiens
aaatgtattgcataggatattt

SEQ ID NO: 7884995 - DNA, 22 bp, Homo sapiens
aaatgtagtatgttgcatgtat

SEQ ID NO: 7884996 - DNA, 22 bp, Homo sapiens
aaatgtagttgaaaagttaagg

SEQ ID NO: 7884997 - DNA, 22 bp, Homo sapiens
aaatgtatcctacttcctgagt

SEQ ID NO: 7884998 - DNA, 22 bp, Homo sapiens
aaatgtattgcataggatattt

SEQ ID NO: 7884999 - DNA, 18 bp, Homo sapiens
aaatgtactgtccatggc

SEQ ID NO: 7885000 - DNA, 22 bp, Homo sapiens
aaatgtactgatacttatttta

SEQ ID NO: 7885001 - DNA, 18 bp, Homo sapiens
aaatgtactgtccatggc

SEQ ID NO: 7885002 - DNA, 18 bp, Homo sapiens
aaatgtactgtccatggc

SEQ ID NO: 7885003 - DNA, 18 bp, Homo sapiens
aaatgtactgtccatggc

SEQ ID NO: 7885004 - DNA, 22 bp, Homo sapiens
aaatgtacgggagtagaattag

SEQ ID NO: 7885005 - DNA, 22 bp, Homo sapiens
aaatgtactgatacttatttta

SEQ ID NO: 7885006 - DNA, 22 bp, Homo sapiens
aaatgtactgatacttatttta

SEQ ID NO: 7885007 - DNA, 22 bp, Homo sapiens
aaatgtacgggagtagaattag

SEQ ID NO: 7885008 - DNA, 22 bp, Homo sapiens
aaatgtacgggagtagaattag

SEQ ID NO: 7885009 - DNA, 22 bp, Homo sapiens
aaatgtacgggagtagaattag

SEQ ID NO: 7885010 - DNA, 22 bp, Homo sapiens
aaatgtaccttgatagtttggt

SEQ ID NO: 7885011 - DNA, 22 bp, Homo sapiens
aaatgtaccttgatagtttggt

SEQ ID NO: 7885012 - DNA, 22 bp, Homo sapiens
aagctgaagacacagctccagt

SEQ ID NO: 7885013 - DNA, 22 bp, Homo sapiens
aagctgaagatgccagtgggag

SEQ ID NO: 7885014 - DNA, 22 bp, Homo sapiens
aagctgaagacacagctccagt

SEQ ID NO: 7885015 - DNA, 23 bp, Homo sapiens
aagctgaacttgtttgctgggag

SEQ ID NO: 7885016 - DNA, 22 bp, Homo sapiens
aagctcttttctgcctcaccca

SEQ ID NO: 7885017 - DNA, 22 bp, Homo sapiens
aagctgaaacattagcctaaac

SEQ ID NO: 7885018 - DNA, 22 bp, Homo sapiens
aagctgaagccggatcaaaaag

SEQ ID NO: 7885019 - DNA, 22 bp, Homo sapiens
aagctgaagccggatcaaaaag

SEQ ID NO: 7885020 - DNA, 22 bp, Homo sapiens
aagctgaattttctaaaagaat

SEQ ID NO: 7885021 - DNA, 22 bp, Homo sapiens
aagctgaatctgaaatagaatt

SEQ ID NO: 7885022 - DNA, 22 bp, Homo sapiens
aagctgaatctgaaatagaatt

SEQ ID NO: 7885023 - DNA, 22 bp, Homo sapiens
aagctcttttcaccattaaagt

SEQ ID NO: 7885024 - DNA, 22 bp, Homo sapiens
aagctcttttcataagagcaaa

SEQ ID NO: 7885025 - DNA, 22 bp, Homo sapiens
aagctctttccctcttcagaac

SEQ ID NO: 7885026 - DNA, 22 bp, Homo sapiens
aagctctttccctcttcagaac

SEQ ID NO: 7885027 - DNA, 22 bp, Homo sapiens
aaatgtattgcataggatattt

SEQ ID NO: 7885028 - DNA, 22 bp, Homo sapiens
aagctcttgagtaaactagttt

SEQ ID NO: 7885029 - DNA, 22 bp, Homo sapiens
aagctctttccactaaaccact

SEQ ID NO: 7885030 - DNA, 22 bp, Homo sapiens
aagctctttccactaaaccact

SEQ ID NO: 7885031 - DNA, 22 bp, Homo sapiens
aaatgtcaaagacgtgtttttg

SEQ ID NO: 7885032 - DNA, 22 bp, Homo sapiens
aagctcttgttgaatcttgtca

SEQ ID NO: 7885033 - DNA, 22 bp, Homo sapiens
aaatagattgctgaggcattac

SEQ ID NO: 7885034 - DNA, 22 bp, Homo sapiens
aaatagattgctgaggcattac

SEQ ID NO: 7885035 - DNA, 22 bp, Homo sapiens
aaatagattgctgaggcattac

SEQ ID NO: 7885036 - DNA, 22 bp, Homo sapiens
aaatagagctgggttaaacttt

SEQ ID NO: 7885037 - DNA, 22 bp, Homo sapiens
aaatagagctgggttaaacttt

SEQ ID NO: 7885038 - DNA, 23 bp, Homo sapiens
aaatagagataggccagctttgc

SEQ ID NO: 7885039 - DNA, 22 bp, Homo sapiens
aaatagagctgggttaaacttt

SEQ ID NO: 7885040 - DNA, 22 bp, Homo sapiens
aaatagatttcctagcattgga

SEQ ID NO: 7885041 - DNA, 22 bp, Homo sapiens
aaatagatttcctagcattgga

SEQ ID NO: 7885042 - DNA, 22 bp, Homo sapiens
aaatagatttcctagcattgga

SEQ ID NO: 7885043 - DNA, 22 bp, Homo sapiens
aaatagatttcctagcattgga

SEQ ID NO: 7885044 - DNA, 22 bp, Homo sapiens
aaatagattgctgaggcattac

SEQ ID NO: 7885045 - DNA, 22 bp, Homo sapiens
aaatagatttaacatccatccc

SEQ ID NO: 7885046 - DNA, 22 bp, Homo sapiens
aaatagatttaacatccatccc

SEQ ID NO: 7885047 - DNA, 22 bp, Homo sapiens
aaatagattgctgaggcattac

SEQ ID NO: 7885048 - DNA, 22 bp, Homo sapiens
aaatagatttaacatccatccc

SEQ ID NO: 7885049 - DNA, 22 bp, Homo sapiens
aaatagcaatgtgaaaagagga

SEQ ID NO: 7885050 - DNA, 22 bp, Homo sapiens
aaatagcaatgtgaaaagagga

SEQ ID NO: 7885051 - DNA, 22 bp, Homo sapiens
aaatagatttcctagcattgga

SEQ ID NO: 7885052 - DNA, 22 bp, Homo sapiens
aaatagcagcctttagttaaca

SEQ ID NO: 7885053 - DNA, 22 bp, Homo sapiens
aaatagcagcctttagttaaca

SEQ ID NO: 7885054 - DNA, 22 bp, Homo sapiens
aaatagatttctctgggtttgt

SEQ ID NO: 7885055 - DNA, 22 bp, Homo sapiens
aaatagcaatgtgaaaagagga

SEQ ID NO: 7885056 - DNA, 22 bp, Homo sapiens
aaatagcaatgtgaaaagagga

SEQ ID NO: 7885057 - DNA, 22 bp, Homo sapiens
aaatagatttcctagcattgga

SEQ ID NO: 7885058 - DNA, 22 bp, Homo sapiens
aaatagatttcctagcattgga

SEQ ID NO: 7885059 - DNA, 22 bp, Homo sapiens
aaataattatagcgagtctatc

SEQ ID NO: 7885060 - DNA, 22 bp, Homo sapiens
aaataattatagcgagtctatc

SEQ ID NO: 7885061 - DNA, 22 bp, Homo sapiens
aaataattatagcgagtctatc

SEQ ID NO: 7885062 - DNA, 22 bp, Homo sapiens
aaataattatagcgagtctatc

SEQ ID NO: 7885063 - DNA, 22 bp, Homo sapiens
aaataattgagttggtcaatat

SEQ ID NO: 7885064 - DNA, 22 bp, Homo sapiens
aaataattgagttggtcaatat

SEQ ID NO: 7885065 - DNA, 22 bp, Homo sapiens
aaataattgagttggtcaatat

SEQ ID NO: 7885066 - DNA, 22 bp, Homo sapiens
aaataattgagttggtcaatat

SEQ ID NO: 7885067 - DNA, 22 bp, Homo sapiens
aaataattgagttggtcaatat

SEQ ID NO: 7885068 - DNA, 22 bp, Homo sapiens
aaataattgagttggtcaatat

SEQ ID NO: 7885069 - DNA, 22 bp, Homo sapiens
aaatacaaaaattagccaggca

SEQ ID NO: 7885070 - DNA, 22 bp, Homo sapiens
aaatagacaggcttaaatagga

SEQ ID NO: 7885071 - DNA, 22 bp, Homo sapiens
aaatagacaggcttaaatagga

SEQ ID NO: 7885072 - DNA, 23 bp, Homo sapiens
aaatagagataggccagctttgc

SEQ ID NO: 7885073 - DNA, 22 bp, Homo sapiens
aaatagacacttggacagacaa

SEQ ID NO: 7885074 - DNA, 22 bp, Homo sapiens
aaatagacaggcttaaatagga

SEQ ID NO: 7885075 - DNA, 22 bp, Homo sapiens
aaatagacaggcttaaatagga

SEQ ID NO: 7885076 - DNA, 22 bp, Homo sapiens
aaatagacaggcttaaatagga

SEQ ID NO: 7885077 - DNA, 22 bp, Homo sapiens
aaatactgtagataatagagtt

SEQ ID NO: 7885078 - DNA, 22 bp, Homo sapiens
aaatactgtagataatagagtt

SEQ ID NO: 7885079 - DNA, 22 bp, Homo sapiens
aaatactgtagataatagagtt

SEQ ID NO: 7885080 - DNA, 22 bp, Homo sapiens
aaatacaaaaattagccaggca

SEQ ID NO: 7885081 - DNA, 22 bp, Homo sapiens
aaatagacacatgcgttcatat

SEQ ID NO: 7885082 - DNA, 22 bp, Homo sapiens
aaatagacacttggacagacaa

SEQ ID NO: 7885083 - DNA, 22 bp, Homo sapiens
aaatcagatcttacacaattgt

SEQ ID NO: 7885084 - DNA, 22 bp, Homo sapiens
aaatcagagtggttggtcatcc

SEQ ID NO: 7885085 - DNA, 23 bp, Homo sapiens
aaataggagtatctggatcatga

SEQ ID NO: 7885086 - DNA, 22 bp, Homo sapiens
aaatcagatgcttcctagttgg

SEQ ID NO: 7885087 - DNA, 22 bp, Homo sapiens
aaatcagattatttgattggca

SEQ ID NO: 7885088 - DNA, 22 bp, Homo sapiens
aaatcagatgcttcctagttgg

SEQ ID NO: 7885089 - DNA, 23 bp, Homo sapiens
aaataggagtatctggatcatga

SEQ ID NO: 7885090 - DNA, 23 bp, Homo sapiens
aaataggagtatctggatcatga

SEQ ID NO: 7885091 - DNA, 23 bp, Homo sapiens
aaataggagtatctggatcatga

SEQ ID NO: 7885092 - DNA, 22 bp, Homo sapiens
aaataggagcttaagcacttct

SEQ ID NO: 7885093 - DNA, 22 bp, Homo sapiens
aaatccattctgttttaaaagt

SEQ ID NO: 7885094 - DNA, 22 bp, Homo sapiens
aaatccattctgttttaaaagt

SEQ ID NO: 7885095 - DNA, 22 bp, Homo sapiens
aaatccatggtaatctgttaca

SEQ ID NO: 7885096 - DNA, 22 bp, Homo sapiens
aaatccatcaaatcttctagaa

SEQ ID NO: 7885097 - DNA, 22 bp, Homo sapiens
aaatccatggtaatctgttaca

SEQ ID NO: 7885098 - DNA, 22 bp, Homo sapiens
aaatccatcaaatcttctagaa

SEQ ID NO: 7885099 - DNA, 22 bp, Homo sapiens
aaatccatcaaatcttctagaa

SEQ ID NO: 7885100 - DNA, 23 bp, Homo sapiens
aaatagctccgtggcacactctc

SEQ ID NO: 7885101 - DNA, 22 bp, Homo sapiens
aaatagctgaaagttcctagat

SEQ ID NO: 7885102 - DNA, 22 bp, Homo sapiens
aaatagctgtatttaccctgta

SEQ ID NO: 7885103 - DNA, 22 bp, Homo sapiens
aaatagcttttcataattctca

SEQ ID NO: 7885104 - DNA, 22 bp, Homo sapiens
aaataggagcttaagcacttct

SEQ ID NO: 7885105 - DNA, 22 bp, Homo sapiens
aaatagcttttcataattctca

SEQ ID NO: 7885106 - DNA, 22 bp, Homo sapiens
aaatagcataaaataggaagct

SEQ ID NO: 7885107 - DNA, 22 bp, Homo sapiens
aaatagcataaaataggaagct

SEQ ID NO: 7885108 - DNA, 22 bp, Homo sapiens
aaatagcattgtatttagctga

SEQ ID NO: 7885109 - DNA, 22 bp, Homo sapiens
aaatagctacatgatctctagg

SEQ ID NO: 7885110 - DNA, 22 bp, Homo sapiens
aaatagcattgtatttagctga

SEQ ID NO: 7885111 - DNA, 22 bp, Homo sapiens
aaatagcattgtatttagctga

SEQ ID NO: 7885112 - DNA, 22 bp, Homo sapiens
aaatagcagctttgacagcaca

SEQ ID NO: 7885113 - DNA, 22 bp, Homo sapiens
aaatagcagctttgacagcaca

SEQ ID NO: 7885114 - DNA, 22 bp, Homo sapiens
aaatagcagctttgacagcaca

SEQ ID NO: 7885115 - DNA, 22 bp, Homo sapiens
aaatagcagctttgacagcaca

SEQ ID NO: 7885116 - DNA, 22 bp, Homo sapiens
aaatagcagcctttagttaaca

SEQ ID NO: 7885117 - DNA, 22 bp, Homo sapiens
aaatagcagcctttagttaaca

SEQ ID NO: 7885118 - DNA, 22 bp, Homo sapiens
aaataactttctgtgtatagtc

SEQ ID NO: 7885119 - DNA, 22 bp, Homo sapiens
aaataactttctgtgtatagtc

SEQ ID NO: 7885120 - DNA, 22 bp, Homo sapiens
aaataactttctgtgtatagtc

SEQ ID NO: 7885121 - DNA, 22 bp, Homo sapiens
aaataactttctgtgtatagtc

SEQ ID NO: 7885122 - DNA, 22 bp, Homo sapiens
aaataactttctgtgtatagtc

SEQ ID NO: 7885123 - DNA, 22 bp, Homo sapiens
aaataactttctgtgtatagtc

SEQ ID NO: 7885124 - DNA, 22 bp, Homo sapiens
aaataactttctgtgtatagtc

SEQ ID NO: 7885125 - DNA, 22 bp, Homo sapiens
aaataagaaattcttctttgca

SEQ ID NO: 7885126 - DNA, 22 bp, Homo sapiens
aaataagaaattcttctttgca

SEQ ID NO: 7885127 - DNA, 22 bp, Homo sapiens
aaataagaaattcttctttgca

SEQ ID NO: 7885128 - DNA, 22 bp, Homo sapiens
aaataacttggtttcatcagag

SEQ ID NO: 7885129 - DNA, 22 bp, Homo sapiens
aaataacttggtttcatcagag

SEQ ID NO: 7885130 - DNA, 22 bp, Homo sapiens
aaataacttggtttcatcagag

SEQ ID NO: 7885131 - DNA, 22 bp, Homo sapiens
aaataacttggtttcatcagag

SEQ ID NO: 7885132 - DNA, 22 bp, Homo sapiens
aaataacttggtttcatcagag

SEQ ID NO: 7885133 - DNA, 22 bp, Homo sapiens
aaataagaggacagatgtttgg

SEQ ID NO: 7885134 - DNA, 22 bp, Homo sapiens
aaataagaggacagatgtttgg

SEQ ID NO: 7885135 - DNA, 22 bp, Homo sapiens
aaataagaggacagatgtttgg

SEQ ID NO: 7885136 - DNA, 22 bp, Homo sapiens
aaataagaaattcttctttgca

SEQ ID NO: 7885137 - DNA, 22 bp, Homo sapiens
aaataagaggacagatgtttgg

SEQ ID NO: 7885138 - DNA, 22 bp, Homo sapiens
aaataagaaattcttctttgca

SEQ ID NO: 7885139 - DNA, 22 bp, Homo sapiens
aaataagaaattcttctttgca

SEQ ID NO: 7885140 - DNA, 22 bp, Homo sapiens
aaataagaaattcttctttgca

SEQ ID NO: 7885141 - DNA, 22 bp, Homo sapiens
aaataagcacttaactgtatca

SEQ ID NO: 7885142 - DNA, 21 bp, Homo sapiens
aaataaggatagatggtttgg

SEQ ID NO: 7885143 - DNA, 22 bp, Homo sapiens
aaataagtaatgtcttcctttt

SEQ ID NO: 7885144 - DNA, 22 bp, Homo sapiens
aaataagaggacagatgtttgg

SEQ ID NO: 7885145 - DNA, 22 bp, Homo sapiens
aaataagaggacagatgtttgg

SEQ ID NO: 7885146 - DNA, 22 bp, Homo sapiens
aaataagaggacagatgtttgg

SEQ ID NO: 7885147 - DNA, 22 bp, Homo sapiens
aaataagttagcagattccagt

SEQ ID NO: 7885148 - DNA, 22 bp, Homo sapiens
aaataatcaatttttgtagata

SEQ ID NO: 7885149 - DNA, 22 bp, Homo sapiens
aaataatcaatttttgtagata

SEQ ID NO: 7885150 - DNA, 22 bp, Homo sapiens
aaataagttaaactagaatgat

SEQ ID NO: 7885151 - DNA, 22 bp, Homo sapiens
aaataagttagcagattccagt

SEQ ID NO: 7885152 - DNA, 22 bp, Homo sapiens
aaataagttagcagattccagt

SEQ ID NO: 7885153 - DNA, 22 bp, Homo sapiens
aaataattatagcgagtctatc

SEQ ID NO: 7885154 - DNA, 22 bp, Homo sapiens
aaataattatagcgagtctatc

SEQ ID NO: 7885155 - DNA, 22 bp, Homo sapiens
aaataatcaatttttgtagata

SEQ ID NO: 7885156 - DNA, 22 bp, Homo sapiens
aaataagttaaactagaatgat

SEQ ID NO: 7885157 - DNA, 22 bp, Homo sapiens
aaataagttaaactagaatgat

SEQ ID NO: 7885158 - DNA, 22 bp, Homo sapiens
aaataagttaaactagaatgat

SEQ ID NO: 7885159 - DNA, 22 bp, Homo sapiens
aaataagttaaactagaatgat

SEQ ID NO: 7885160 - DNA, 22 bp, Homo sapiens
aaataagtgtgggccagtcaaa

SEQ ID NO: 7885161 - DNA, 22 bp, Homo sapiens
aaataagttaaactagaatgat

SEQ ID NO: 7885162 - DNA, 22 bp, Homo sapiens
aaataagttaaactagaatgat

SEQ ID NO: 7885163 - DNA, 22 bp, Homo sapiens
aaataagtgtgggccagtcaaa

SEQ ID NO: 7885164 - DNA, 22 bp, Homo sapiens
aaataagtgtgggccagtcaaa

SEQ ID NO: 7885165 - DNA, 22 bp, Homo sapiens
aaataagtgtgggccagtcaaa

SEQ ID NO: 7885166 - DNA, 22 bp, Homo sapiens
aaataagtagtttagtgttgtg

SEQ ID NO: 7885167 - DNA, 22 bp, Homo sapiens
aaataagtagtttagtgttgtg

SEQ ID NO: 7885168 - DNA, 19 bp, Homo sapiens
aaagtgttttcttttctgt

SEQ ID NO: 7885169 - DNA, 19 bp, Homo sapiens
aaagtgttttcttttctgt

SEQ ID NO: 7885170 - DNA, 22 bp, Homo sapiens
aaagtgttttgtgagcagtctg

SEQ ID NO: 7885171 - DNA, 22 bp, Homo sapiens
aaagttttatatgctgcagcga

SEQ ID NO: 7885172 - DNA, 22 bp, Homo sapiens
aaagttttatatgctgcagcga

SEQ ID NO: 7885173 - DNA, 22 bp, Homo sapiens
aaagtgtttttgagctgtagtt

SEQ ID NO: 7885174 - DNA, 22 bp, Homo sapiens
aaataacttatgatcgtctggc

SEQ ID NO: 7885175 - DNA, 22 bp, Homo sapiens
aaataacttatgatcgtctggc

SEQ ID NO: 7885176 - DNA, 22 bp, Homo sapiens
aaataacagtcagggacaacat

SEQ ID NO: 7885177 - DNA, 22 bp, Homo sapiens
aaataacagtcagggacaacat

SEQ ID NO: 7885178 - DNA, 22 bp, Homo sapiens
aaataacagtcagggacaacat

SEQ ID NO: 7885179 - DNA, 22 bp, Homo sapiens
aaagttttattcaagcattagt

SEQ ID NO: 7885180 - DNA, 22 bp, Homo sapiens
aaagttttattcaagcattagt

SEQ ID NO: 7885181 - DNA, 22 bp, Homo sapiens
aaagttttattcaagcattagt

SEQ ID NO: 7885182 - DNA, 22 bp, Homo sapiens
aaagttttatatgctgcagcga

SEQ ID NO: 7885183 - DNA, 22 bp, Homo sapiens
aaagtgtttacattgctataag

SEQ ID NO: 7885184 - DNA, 22 bp, Homo sapiens
aaagtgtttacattgctataag

SEQ ID NO: 7885185 - DNA, 22 bp, Homo sapiens
aaagtgttttctgatgtgttct

SEQ ID NO: 7885186 - DNA, 22 bp, Homo sapiens
aaagtgttttctgatgtgttct

SEQ ID NO: 7885187 - DNA, 22 bp, Homo sapiens
aaagtgttttccatgcaatgaa

SEQ ID NO: 7885188 - DNA, 22 bp, Homo sapiens
aaagtgttttccatgcaatgaa

SEQ ID NO: 7885189 - DNA, 22 bp, Homo sapiens
aaagtgttttccatgcaatgaa

SEQ ID NO: 7885190 - DNA, 22 bp, Homo sapiens
aaagtgttgggattacaggtgt

SEQ ID NO: 7885191 - DNA, 22 bp, Homo sapiens
aaagtgttgggattacaggtgt

SEQ ID NO: 7885192 - DNA, 22 bp, Homo sapiens
aaagtgttgggattataggcgt

SEQ ID NO: 7885193 - DNA, 22 bp, Homo sapiens
aaagtgtttacattgctataag

SEQ ID NO: 7885194 - DNA, 22 bp, Homo sapiens
aaagtgttgggattacaggcat

SEQ ID NO: 7885195 - DNA, 22 bp, Homo sapiens
aaagtgttgggattacaggcat

SEQ ID NO: 7885196 - DNA, 22 bp, Homo sapiens
aaagtgttgggattacaggtgt

SEQ ID NO: 7885197 - DNA, 22 bp, Homo sapiens
aaagtgtggcacaagtcacatc

SEQ ID NO: 7885198 - DNA, 22 bp, Homo sapiens
aaagtgtggcacaagtcacatc

SEQ ID NO: 7885199 - DNA, 21 bp, Homo sapiens
aaagtgtgtggggaagaagga

SEQ ID NO: 7885200 - DNA, 22 bp, Homo sapiens
aaagtgtggtcgttcattttgt

SEQ ID NO: 7885201 - DNA, 22 bp, Homo sapiens
aaagtgtggtcgttcattttgt

SEQ ID NO: 7885202 - DNA, 22 bp, Homo sapiens
aaagtgttaacactggctactt

SEQ ID NO: 7885203 - DNA, 22 bp, Homo sapiens
aaagtgttatgagaactaagtg

SEQ ID NO: 7885204 - DNA, 22 bp, Homo sapiens
aaagtgtcttacccagggagaa

SEQ ID NO: 7885205 - DNA, 22 bp, Homo sapiens
aaagtgtggagattgaactaaa

SEQ ID NO: 7885206 - DNA, 23 bp, Homo sapiens
aaagtgtagccaggttaagaacc

SEQ ID NO: 7885207 - DNA, 23 bp, Homo sapiens
aaagtgtagccaggttaagaacc

SEQ ID NO: 7885208 - DNA, 22 bp, Homo sapiens
aaagtgttatgcaaaactctgt

SEQ ID NO: 7885209 - DNA, 22 bp, Homo sapiens
aaagtgttgaagaaaatgttca

SEQ ID NO: 7885210 - DNA, 22 bp, Homo sapiens
aaagtgttgaagaaaatgttca

SEQ ID NO: 7885211 - DNA, 22 bp, Homo sapiens
aaagtgttgaagaaaatgttca

SEQ ID NO: 7885212 - DNA, 22 bp, Homo sapiens
aaagtgttgatatgtgacatcc

SEQ ID NO: 7885213 - DNA, 22 bp, Homo sapiens
aaagtgttgatatgtgacatcc

SEQ ID NO: 7885214 - DNA, 22 bp, Homo sapiens
aactaaaagtgtgtctcttgta

SEQ ID NO: 7885215 - DNA, 22 bp, Homo sapiens
aactaaaagtgtgtctcttgta

SEQ ID NO: 7885216 - DNA, 22 bp, Homo sapiens
aactaaaagtgtgtctcttgta

SEQ ID NO: 7885217 - DNA, 22 bp, Homo sapiens
aactaaaccatgacattatatt

SEQ ID NO: 7885218 - DNA, 22 bp, Homo sapiens
aactaaaactggtttgttctct

SEQ ID NO: 7885219 - DNA, 22 bp, Homo sapiens
aactaaaactggtttgttctct

SEQ ID NO: 7885220 - DNA, 22 bp, Homo sapiens
aactaaaagtgtgtctcttgta

SEQ ID NO: 7885221 - DNA, 22 bp, Homo sapiens
aactaaaactggtttgttctct

SEQ ID NO: 7885222 - DNA, 22 bp, Homo sapiens
aactaaaactggtttgttctct

SEQ ID NO: 7885223 - DNA, 22 bp, Homo sapiens
aactaaaactggtttgttctct

SEQ ID NO: 7885224 - DNA, 22 bp, Homo sapiens
aaaggttttcatcacagcaaga

SEQ ID NO: 7885225 - DNA, 22 bp, Homo sapiens
aaaggttttattctgagctctg

SEQ ID NO: 7885226 - DNA, 22 bp, Homo sapiens
aacgttaatattttataagtct

SEQ ID NO: 7885227 - DNA, 22 bp, Homo sapiens
aactaaatctggcatttagagc

SEQ ID NO: 7885228 - DNA, 22 bp, Homo sapiens
aactaaatctggcatttagagc

SEQ ID NO: 7885229 - DNA, 22 bp, Homo sapiens
aactaaatctggcatttagagc

SEQ ID NO: 7885230 - DNA, 22 bp, Homo sapiens
aactaaagtaaccaaggatatc

SEQ ID NO: 7885231 - DNA, 18 bp, Homo sapiens
aactaaagatctttaagc

SEQ ID NO: 7885232 - DNA, 22 bp, Homo sapiens
aactaaaccatgacattatatt

SEQ ID NO: 7885233 - DNA, 22 bp, Homo sapiens
aactaaaggctgttgcagggaa

SEQ ID NO: 7885234 - DNA, 22 bp, Homo sapiens
aactaaaggctgttgcagggaa

SEQ ID NO: 7885235 - DNA, 22 bp, Homo sapiens
aactaaatctggcatttagagc

SEQ ID NO: 7885236 - DNA, 22 bp, Homo sapiens
aactaaatctggcatttagagc

SEQ ID NO: 7885237 - DNA, 22 bp, Homo sapiens
aactaacagtcattaaaagaac

SEQ ID NO: 7885238 - DNA, 22 bp, Homo sapiens
aactaaatgtgtatctactcaa

SEQ ID NO: 7885239 - DNA, 22 bp, Homo sapiens
aactaaatgtgtatctactcaa

SEQ ID NO: 7885240 - DNA, 22 bp, Homo sapiens
aactaaatctggcatttagagc

SEQ ID NO: 7885241 - DNA, 22 bp, Homo sapiens
aactaaatctggcatttagagc

SEQ ID NO: 7885242 - DNA, 22 bp, Homo sapiens
aactaacagtcattaaaagaac

SEQ ID NO: 7885243 - DNA, 22 bp, Homo sapiens
aactaacagtcattaaaagaac

SEQ ID NO: 7885244 - DNA, 22 bp, Homo sapiens
aactaacagtcattaaaagaac

SEQ ID NO: 7885245 - DNA, 22 bp, Homo sapiens
aactaacagtcattaaaagaac

SEQ ID NO: 7885246 - DNA, 22 bp, Homo sapiens
aactaagtcatagagtccctca

SEQ ID NO: 7885247 - DNA, 22 bp, Homo sapiens
aaagtacaaatgttctagccat

SEQ ID NO: 7885248 - DNA, 22 bp, Homo sapiens
aaagtacccaagaacagagtga

SEQ ID NO: 7885249 - DNA, 22 bp, Homo sapiens
aaagtaattgtggttcttgcca

SEQ ID NO: 7885250 - DNA, 22 bp, Homo sapiens
aaagtaattgtggttcttgcca

SEQ ID NO: 7885251 - DNA, 22 bp, Homo sapiens
aaagtaattgtggtttctgtca

SEQ ID NO: 7885252 - DNA, 22 bp, Homo sapiens
aaagtacttgatgctacagagt

SEQ ID NO: 7885253 - DNA, 22 bp, Homo sapiens
aaagtacttgatgctacagagt

SEQ ID NO: 7885254 - DNA, 23 bp, Homo sapiens
aaagtacttccacagctatgatc

SEQ ID NO: 7885255 - DNA, 22 bp, Homo sapiens
aaagtagaggcattgatcaggt

SEQ ID NO: 7885256 - DNA, 22 bp, Homo sapiens
aaagtagaggcattgatcaggt

SEQ ID NO: 7885257 - DNA, 22 bp, Homo sapiens
aaagtagaacattttcttatct

SEQ ID NO: 7885258 - DNA, 22 bp, Homo sapiens
aaagtagaacattttcttatct

SEQ ID NO: 7885259 - DNA, 22 bp, Homo sapiens
aaagtactaatgaatattttgc

SEQ ID NO: 7885260 - DNA, 22 bp, Homo sapiens
aaagtactgatgccatcagcac

SEQ ID NO: 7885261 - DNA, 22 bp, Homo sapiens
aaagtactgatgccatcagcac

SEQ ID NO: 7885262 - DNA, 22 bp, Homo sapiens
aaagtactaatgaatattttgc

SEQ ID NO: 7885263 - DNA, 22 bp, Homo sapiens
aaagtactcgaggaggaggagc

SEQ ID NO: 7885264 - DNA, 22 bp, Homo sapiens
aaagtactgggattacaggtct

SEQ ID NO: 7885265 - DNA, 22 bp, Homo sapiens
aaagtactgatgccatcagcac

SEQ ID NO: 7885266 - DNA, 22 bp, Homo sapiens
aaaggtttattgattctgctct

SEQ ID NO: 7885267 - DNA, 22 bp, Homo sapiens
aaaggtttattgattctgctct

SEQ ID NO: 7885268 - DNA, 22 bp, Homo sapiens
aaaggtttattgctatggttgt

SEQ ID NO: 7885269 - DNA, 22 bp, Homo sapiens
aaaggttgtgttctggggtgag

SEQ ID NO: 7885270 - DNA, 22 bp, Homo sapiens
aaaggttgaattcaggatccac

SEQ ID NO: 7885271 - DNA, 22 bp, Homo sapiens
aaaggttgaattcaggatccac

SEQ ID NO: 7885272 - DNA, 22 bp, Homo sapiens
aaaggtttatttaatcagggag

SEQ ID NO: 7885273 - DNA, 22 bp, Homo sapiens
aaaggtttatttgttgctcaca

SEQ ID NO: 7885274 - DNA, 22 bp, Homo sapiens
aaaggtttatttgttgctcaca

SEQ ID NO: 7885275 - DNA, 22 bp, Homo sapiens
aaaggtttgccgacctctgctt

SEQ ID NO: 7885276 - DNA, 22 bp, Homo sapiens
aaaggtttgaggtgggaagagg

SEQ ID NO: 7885277 - DNA, 22 bp, Homo sapiens
aaaggtttgcatggaatttacc

SEQ ID NO: 7885278 - DNA, 22 bp, Homo sapiens
aaaggtttgcatggaatttacc

SEQ ID NO: 7885279 - DNA, 22 bp, Homo sapiens
aaaggtttccgagctttaattt

SEQ ID NO: 7885280 - DNA, 22 bp, Homo sapiens
aaagggcctccgcctgggcagg

SEQ ID NO: 7885281 - DNA, 22 bp, Homo sapiens
aaagggcctccgcctgggcagg

SEQ ID NO: 7885282 - DNA, 22 bp, Homo sapiens
aaagggctgaagtagtctctgt

SEQ ID NO: 7885283 - DNA, 22 bp, Homo sapiens
aaaggttattattactattgtc

SEQ ID NO: 7885284 - DNA, 22 bp, Homo sapiens
aaaggttctacttttaaagaat

SEQ ID NO: 7885285 - DNA, 22 bp, Homo sapiens
aaaggaagattgagcttttcca

SEQ ID NO: 7885286 - DNA, 22 bp, Homo sapiens
aaagggcagagttcactagaaa

SEQ ID NO: 7885287 - DNA, 22 bp, Homo sapiens
aaagggcagagttcactagaaa

SEQ ID NO: 7885288 - DNA, 22 bp, Homo sapiens
aaaggaagatgccaggactctg

SEQ ID NO: 7885289 - DNA, 22 bp, Homo sapiens
aaaggaagatgccaggactctg

SEQ ID NO: 7885290 - DNA, 22 bp, Homo sapiens
aaaggaagatgccaggactctg

SEQ ID NO: 7885291 - DNA, 22 bp, Homo sapiens
aaagctttgtaaataaacaggt

SEQ ID NO: 7885292 - DNA, 22 bp, Homo sapiens
aaagctttgtaaataaacaggt

SEQ ID NO: 7885293 - DNA, 22 bp, Homo sapiens
aaagctttgtaaataaacaggt

SEQ ID NO: 7885294 - DNA, 22 bp, Homo sapiens
aaagctttgtaaataaacaggt

SEQ ID NO: 7885295 - DNA, 22 bp, Homo sapiens
aaagctttgtaaataaacaggt

SEQ ID NO: 7885296 - DNA, 22 bp, Homo sapiens
aaagcttttcagtatgttcatg

SEQ ID NO: 7885297 - DNA, 22 bp, Homo sapiens
aaagcttttcagtatgttcatg

SEQ ID NO: 7885298 - DNA, 22 bp, Homo sapiens
aaagcttttcagtatgttcatg

SEQ ID NO: 7885299 - DNA, 22 bp, Homo sapiens
aaaggaaaataagtagttccat

SEQ ID NO: 7885300 - DNA, 22 bp, Homo sapiens
aaagtatatttacttactgtga

SEQ ID NO: 7885301 - DNA, 22 bp, Homo sapiens
aaagtatatatgcactttagaa

SEQ ID NO: 7885302 - DNA, 22 bp, Homo sapiens
aaagtatatatgcactttagaa

SEQ ID NO: 7885303 - DNA, 22 bp, Homo sapiens
aaagtagttagtcatgtgaaaa

SEQ ID NO: 7885304 - DNA, 22 bp, Homo sapiens
aaagtatatatgcactttagaa

SEQ ID NO: 7885305 - DNA, 22 bp, Homo sapiens
aaagtatatatgcactttagaa

SEQ ID NO: 7885306 - DNA, 22 bp, Homo sapiens
aaagtatatatgcactttagaa

SEQ ID NO: 7885307 - DNA, 22 bp, Homo sapiens
aaagtatcaagggaagcatttt

SEQ ID NO: 7885308 - DNA, 22 bp, Homo sapiens
aaagtatatttacttactgtga

SEQ ID NO: 7885309 - DNA, 22 bp, Homo sapiens
aaagtatgattggggattattt

SEQ ID NO: 7885310 - DNA, 22 bp, Homo sapiens
aaagtatctgaccgattataaa

SEQ ID NO: 7885311 - DNA, 22 bp, Homo sapiens
aaagtagcttagttgatatttc

SEQ ID NO: 7885312 - DNA, 22 bp, Homo sapiens
aaagtagctttgtaggtacagt

SEQ ID NO: 7885313 - DNA, 22 bp, Homo sapiens
aaagtagcttagttgatatttc

SEQ ID NO: 7885314 - DNA, 22 bp, Homo sapiens
aaagtagtccttggagcgaaat

SEQ ID NO: 7885315 - DNA, 22 bp, Homo sapiens
aaagtagctttgtaggtacagt

SEQ ID NO: 7885316 - DNA, 22 bp, Homo sapiens
aaagtagctttgtaggtacagt

SEQ ID NO: 7885317 - DNA, 22 bp, Homo sapiens
aaagtagcccttctggaattta

SEQ ID NO: 7885318 - DNA, 22 bp, Homo sapiens
aaagtagcagtaattatgaaat

SEQ ID NO: 7885319 - DNA, 22 bp, Homo sapiens
aaagtagagttgtggaattact

SEQ ID NO: 7885320 - DNA, 22 bp, Homo sapiens
aaagtagaggcattgatcaggt

SEQ ID NO: 7885321 - DNA, 22 bp, Homo sapiens
aaagtagagttgtggaattact

SEQ ID NO: 7885322 - DNA, 22 bp, Homo sapiens
aaagtagagttgtggaattact

SEQ ID NO: 7885323 - DNA, 22 bp, Homo sapiens
aaagtcaaaatgctctcctgtc

SEQ ID NO: 7885324 - DNA, 22 bp, Homo sapiens
aaagtatttttgacaggcatta

SEQ ID NO: 7885325 - DNA, 22 bp, Homo sapiens
aaagtcaaggtttagactagag

SEQ ID NO: 7885326 - DNA, 22 bp, Homo sapiens
aaagtcaaggtttagactagag

SEQ ID NO: 7885327 - DNA, 22 bp, Homo sapiens
aaagtatttgtgatttttacca

SEQ ID NO: 7885328 - DNA, 22 bp, Homo sapiens
aaagtatttttgacaggcatta

SEQ ID NO: 7885329 - DNA, 22 bp, Homo sapiens
aaagtatttttgacaggcatta

SEQ ID NO: 7885330 - DNA, 22 bp, Homo sapiens
aaagtatttttgacaggcatta

SEQ ID NO: 7885331 - DNA, 22 bp, Homo sapiens
aaagtatttgtgatttttacca

SEQ ID NO: 7885332 - DNA, 22 bp, Homo sapiens
aaagtattcttgactgtttttc

SEQ ID NO: 7885333 - DNA, 22 bp, Homo sapiens
aaagtattcttgactgtttttc

SEQ ID NO: 7885334 - DNA, 22 bp, Homo sapiens
aaagtattcttgactgtttttc

SEQ ID NO: 7885335 - DNA, 22 bp, Homo sapiens
aaagtattcaaaaatatttggt

SEQ ID NO: 7885336 - DNA, 22 bp, Homo sapiens
aaagtattcaaaaatatttggt

SEQ ID NO: 7885337 - DNA, 22 bp, Homo sapiens
aaagtatgttgtggcttttaaa

SEQ ID NO: 7885338 - DNA, 22 bp, Homo sapiens
aaagtatgattggggattattt

SEQ ID NO: 7885339 - DNA, 22 bp, Homo sapiens
aaagtattcaaaaatatttggt

SEQ ID NO: 7885340 - DNA, 22 bp, Homo sapiens
aaagtatgttgtggcttttaaa

SEQ ID NO: 7885341 - DNA, 22 bp, Homo sapiens
aaagtattcaaaaatatttggt

SEQ ID NO: 7885342 - DNA, 22 bp, Homo sapiens
aaagtcaatgatttctcctgga

SEQ ID NO: 7885343 - DNA, 22 bp, Homo sapiens
aaagtcacaatattggaaggtg

SEQ ID NO: 7885344 - DNA, 22 bp, Homo sapiens
aaagtcacatagcatcacttct

SEQ ID NO: 7885345 - DNA, 22 bp, Homo sapiens
aaagtcacatagcatcacttct

SEQ ID NO: 7885346 - DNA, 22 bp, Homo sapiens
aaagtcacatagcatcacttct

SEQ ID NO: 7885347 - DNA, 22 bp, Homo sapiens
aaagtcacagtttaggggatat

SEQ ID NO: 7885348 - DNA, 22 bp, Homo sapiens
aaagtgctgtgggctgtaagtg

SEQ ID NO: 7885349 - DNA, 22 bp, Homo sapiens
aaagtgctgtgggctgtaagtg

SEQ ID NO: 7885350 - DNA, 22 bp, Homo sapiens
aaagtgctgtgggctgtaagtg

SEQ ID NO: 7885351 - DNA, 22 bp, Homo sapiens
aaagtgcttccttttagaggct

SEQ ID NO: 7885352 - DNA, 22 bp, Homo sapiens
aaagtgctgtgattacaggcat

SEQ ID NO: 7885353 - DNA, 22 bp, Homo sapiens
aaagtgcttctctttggtgggt

SEQ ID NO: 7885354 - DNA, 22 bp, Homo sapiens
aaagtgcttcctttttgagggt

SEQ ID NO: 7885355 - DNA, 22 bp, Homo sapiens
aaagtgctttaggatatttgga

SEQ ID NO: 7885356 - DNA, 23 bp, Homo sapiens
aaagtgcttggcacgacacctgg

SEQ ID NO: 7885357 - DNA, 22 bp, Homo sapiens
aaagtgctttaggatatttgga

SEQ ID NO: 7885358 - DNA, 22 bp, Homo sapiens
aaagtgctttcccacatttgtt

SEQ ID NO: 7885359 - DNA, 22 bp, Homo sapiens
aaagtggccatcctctgcatcg

SEQ ID NO: 7885360 - DNA, 22 bp, Homo sapiens
aaagtggccatcctctgcatcg

SEQ ID NO: 7885361 - DNA, 22 bp, Homo sapiens
aaagtgctttcccacatttgtt

SEQ ID NO: 7885362 - DNA, 20 bp, Homo sapiens
aaagtgtaagcatataatta

SEQ ID NO: 7885363 - DNA, 20 bp, Homo sapiens
aaagtgtaagcatataatta

SEQ ID NO: 7885364 - DNA, 20 bp, Homo sapiens
aaagtgtaagcatataatta

SEQ ID NO: 7885365 - DNA, 20 bp, Homo sapiens
aaagtgtaagcatataatta

SEQ ID NO: 7885366 - DNA, 22 bp, Homo sapiens
aaagtgtaaaagcatgttaggg

SEQ ID NO: 7885367 - DNA, 22 bp, Homo sapiens
aaagtgtaaaagcatgttaggg

SEQ ID NO: 7885368 - DNA, 22 bp, Homo sapiens
aaagtgtagagtgcctcaaaat

SEQ ID NO: 7885369 - DNA, 22 bp, Homo sapiens
aaagtgtactatgtcatgaaca

SEQ ID NO: 7885370 - DNA, 22 bp, Homo sapiens
aaagtgtactatgtcatgaaca

SEQ ID NO: 7885371 - DNA, 22 bp, Homo sapiens
aaagtgtactatgtcatgaaca

SEQ ID NO: 7885372 - DNA, 20 bp, Homo sapiens
aaagtgtaaggcaaagttgt

SEQ ID NO: 7885373 - DNA, 22 bp, Homo sapiens
aaagtggtttcccagttcagta

SEQ ID NO: 7885374 - DNA, 22 bp, Homo sapiens
aaagtgggaacaatggagagtg

SEQ ID NO: 7885375 - DNA, 22 bp, Homo sapiens
aaagtgggaacaatggagagtg

SEQ ID NO: 7885376 - DNA, 22 bp, Homo sapiens
aaagataatgtttccttattct

SEQ ID NO: 7885377 - DNA, 22 bp, Homo sapiens
aaagataatgtttccttattct

SEQ ID NO: 7885378 - DNA, 22 bp, Homo sapiens
aaagagtttggagacaagatca

SEQ ID NO: 7885379 - DNA, 22 bp, Homo sapiens
aaagagtttggagacaagatca

SEQ ID NO: 7885380 - DNA, 22 bp, Homo sapiens
aaagagtttggagacaagatca

SEQ ID NO: 7885381 - DNA, 22 bp, Homo sapiens
aaagataatgtttccttattct

SEQ ID NO: 7885382 - DNA, 22 bp, Homo sapiens
aacaaacaaacattttgtcatc

SEQ ID NO: 7885383 - DNA, 22 bp, Homo sapiens
aacaaacaaacattttgtcatc

SEQ ID NO: 7885384 - DNA, 22 bp, Homo sapiens
aacaaacaaacattttgtcatc

SEQ ID NO: 7885385 - DNA, 22 bp, Homo sapiens
aaagagtttccattgacatttc

SEQ ID NO: 7885386 - DNA, 22 bp, Homo sapiens
aaagagtttccattgacatttc

SEQ ID NO: 7885387 - DNA, 22 bp, Homo sapiens
aacaaacaaacattttgtcatc

SEQ ID NO: 7885388 - DNA, 22 bp, Homo sapiens
aacaaaagccgaagtaggtgtc

SEQ ID NO: 7885389 - DNA, 22 bp, Homo sapiens
aacaaaagccgaagtaggtgtc

SEQ ID NO: 7885390 - DNA, 22 bp, Homo sapiens
aacaaaagccgaagtaggtgtc

SEQ ID NO: 7885391 - DNA, 22 bp, Homo sapiens
aacaaacaaacattttgtcatc

SEQ ID NO: 7885392 - DNA, 22 bp, Homo sapiens
aacaaacaaacattttgtcatc

SEQ ID NO: 7885393 - DNA, 22 bp, Homo sapiens
aacaaacaaacattttgtcatc

SEQ ID NO: 7885394 - DNA, 22 bp, Homo sapiens
aacaaacaaacattttgtcatc

SEQ ID NO: 7885395 - DNA, 22 bp, Homo sapiens
aaattttgtattctagttctag

SEQ ID NO: 7885396 - DNA, 22 bp, Homo sapiens
aacaaaacatttgtcttgtttc

SEQ ID NO: 7885397 - DNA, 22 bp, Homo sapiens
aacaaaacatttgtcttgtttc

SEQ ID NO: 7885398 - DNA, 22 bp, Homo sapiens
aacaaaacatttgtcttgtttc

SEQ ID NO: 7885399 - DNA, 22 bp, Homo sapiens
aacaaaacatttgtcttgtttc

SEQ ID NO: 7885400 - DNA, 21 bp, Homo sapiens
aaattttcttggctgtagtgt

SEQ ID NO: 7885401 - DNA, 22 bp, Homo sapiens
aaattttgtattctagttctag

SEQ ID NO: 7885402 - DNA, 22 bp, Homo sapiens
aaattttgtattctagttctag

SEQ ID NO: 7885403 - DNA, 22 bp, Homo sapiens
aaattttgtattctagttctag

SEQ ID NO: 7885404 - DNA, 22 bp, Homo sapiens
aaattttgtattctagttctag

SEQ ID NO: 7885405 - DNA, 22 bp, Homo sapiens
aaattttgtattctagttctag

SEQ ID NO: 7885406 - DNA, 22 bp, Homo sapiens
aaattttctctctaagacttaa

SEQ ID NO: 7885407 - DNA, 22 bp, Homo sapiens
aaattttcctggtaaagatgga

SEQ ID NO: 7885408 - DNA, 22 bp, Homo sapiens
aaattttcctggtaaagatgga

SEQ ID NO: 7885409 - DNA, 22 bp, Homo sapiens
aaattttagtaaggaagttgag

SEQ ID NO: 7885410 - DNA, 22 bp, Homo sapiens
aaattttcagagcactagagaa

SEQ ID NO: 7885411 - DNA, 22 bp, Homo sapiens
aaattttcagagcactagagaa

SEQ ID NO: 7885412 - DNA, 22 bp, Homo sapiens
aaattttcagagcactagagaa

SEQ ID NO: 7885413 - DNA, 22 bp, Homo sapiens
aaattttagtaaggaagttgag

SEQ ID NO: 7885414 - DNA, 22 bp, Homo sapiens
aaattttagactcctgggtcta

SEQ ID NO: 7885415 - DNA, 22 bp, Homo sapiens
aaattttagactcctgggtcta

SEQ ID NO: 7885416 - DNA, 22 bp, Homo sapiens
aaattttagtaaggaagttgag

SEQ ID NO: 7885417 - DNA, 22 bp, Homo sapiens
aaattgtgagctatagatctag

SEQ ID NO: 7885418 - DNA, 22 bp, Homo sapiens
aaattttagactcctgggtcta

SEQ ID NO: 7885419 - DNA, 22 bp, Homo sapiens
aaattttagactcctgggtcta

SEQ ID NO: 7885420 - DNA, 23 bp, Homo sapiens
aaagatcaaagtggcaggcctgt

SEQ ID NO: 7885421 - DNA, 22 bp, Homo sapiens
aaagatatgtctccaaagagat

SEQ ID NO: 7885422 - DNA, 22 bp, Homo sapiens
aaagatatgtctccaaagagat

SEQ ID NO: 7885423 - DNA, 22 bp, Homo sapiens
aaagatatgtctccaaagagat

SEQ ID NO: 7885424 - DNA, 20 bp, Homo sapiens
aaagatactttttgtaatgg

SEQ ID NO: 7885425 - DNA, 22 bp, Homo sapiens
aaagatacttaatagttgtctg

SEQ ID NO: 7885426 - DNA, 20 bp, Homo sapiens
aaagatactttttgtaatgg

SEQ ID NO: 7885427 - DNA, 20 bp, Homo sapiens
aaagatactttttgtaatgg

SEQ ID NO: 7885428 - DNA, 22 bp, Homo sapiens
aaagatcacgtcccaggactcg

SEQ ID NO: 7885429 - DNA, 22 bp, Homo sapiens
aaagatcagaggatagctgagt

SEQ ID NO: 7885430 - DNA, 22 bp, Homo sapiens
aaagatcacgtcccaggactcg

SEQ ID NO: 7885431 - DNA, 23 bp, Homo sapiens
aaagatcaaagtggcaggcctgt

SEQ ID NO: 7885432 - DNA, 22 bp, Homo sapiens
aaagccacgtggcctggggagc

SEQ ID NO: 7885433 - DNA, 22 bp, Homo sapiens
aaagatcagaggatagctgagt

SEQ ID NO: 7885434 - DNA, 22 bp, Homo sapiens
aaagatcagaggatagctgagt

SEQ ID NO: 7885435 - DNA, 22 bp, Homo sapiens
aaagatcagaggatagctgagt

SEQ ID NO: 7885436 - DNA, 22 bp, Homo sapiens
aaagccacagttctatgtctgc

SEQ ID NO: 7885437 - DNA, 22 bp, Homo sapiens
aaagccataagcctaatactaa

SEQ ID NO: 7885438 - DNA, 22 bp, Homo sapiens
aaagccatcagtaaaatgattt

SEQ ID NO: 7885439 - DNA, 22 bp, Homo sapiens
aaagccatcagtaaaatgattt

SEQ ID NO: 7885440 - DNA, 22 bp, Homo sapiens
aaagccagtttctggaagtacc

SEQ ID NO: 7885441 - DNA, 22 bp, Homo sapiens
aaagccagtttctggaagtacc

SEQ ID NO: 7885442 - DNA, 22 bp, Homo sapiens
aaagccagtttctggaagtacc

SEQ ID NO: 7885443 - DNA, 22 bp, Homo sapiens
aaagccagttcttttatattgg

SEQ ID NO: 7885444 - DNA, 22 bp, Homo sapiens
aaagccaggttgtgtgcaggaa

SEQ ID NO: 7885445 - DNA, 22 bp, Homo sapiens
aaagccaggttgtgtgcaggaa

SEQ ID NO: 7885446 - DNA, 22 bp, Homo sapiens
aaagccaggttgtgtgcaggaa

SEQ ID NO: 7885447 - DNA, 22 bp, Homo sapiens
aaagccagtggtatgagagaaa

SEQ ID NO: 7885448 - DNA, 22 bp, Homo sapiens
aaagccaggggagggattccca

SEQ ID NO: 7885449 - DNA, 22 bp, Homo sapiens
aaagccagttcttagagaaagc

SEQ ID NO: 7885450 - DNA, 22 bp, Homo sapiens
aaagccagttcttagagaaagc

SEQ ID NO: 7885451 - DNA, 22 bp, Homo sapiens
aaagccagttcttagagaaagc

SEQ ID NO: 7885452 - DNA, 22 bp, Homo sapiens
aaagccagtggtatgagagaaa

SEQ ID NO: 7885453 - DNA, 22 bp, Homo sapiens
aaagccagtggtatgagagaaa

SEQ ID NO: 7885454 - DNA, 22 bp, Homo sapiens
aaagccagttcttagagaaagc

SEQ ID NO: 7885455 - DNA, 22 bp, Homo sapiens
aaagcttaccttttcagtcttt

SEQ ID NO: 7885456 - DNA, 22 bp, Homo sapiens
aaagcttagcattttcaaaatg

SEQ ID NO: 7885457 - DNA, 22 bp, Homo sapiens
aaagctttctagctatgttcta

SEQ ID NO: 7885458 - DNA, 22 bp, Homo sapiens
aaagctttctagctatgttcta

SEQ ID NO: 7885459 - DNA, 22 bp, Homo sapiens
aaagctttgctggaaggaagag

SEQ ID NO: 7885460 - DNA, 22 bp, Homo sapiens
aaagctttgcatattcggcccg

SEQ ID NO: 7885461 - DNA, 22 bp, Homo sapiens
aaagctttgctggaaggaagag

SEQ ID NO: 7885462 - DNA, 22 bp, Homo sapiens
aaagctttgctggaaggaagag

SEQ ID NO: 7885463 - DNA, 22 bp, Homo sapiens
aaagctttgggtaggaatggga

SEQ ID NO: 7885464 - DNA, 18 bp, Homo sapiens
aaagctgttattccagaa

SEQ ID NO: 7885465 - DNA, 22 bp, Homo sapiens
aaagctgttaaatgcataatgc

SEQ ID NO: 7885466 - DNA, 18 bp, Homo sapiens
aaagctgttattccagaa

SEQ ID NO: 7885467 - DNA, 18 bp, Homo sapiens
aaagctgttattccagaa

SEQ ID NO: 7885468 - DNA, 22 bp, Homo sapiens
aaagctgttaaatgcataatgc

SEQ ID NO: 7885469 - DNA, 18 bp, Homo sapiens
aaagctgttattccagaa

SEQ ID NO: 7885470 - DNA, 23 bp, Homo sapiens
aaagcttaactgggtaataaagc

SEQ ID NO: 7885471 - DNA, 22 bp, Homo sapiens
aaagctgggggccctggtctag

SEQ ID NO: 7885472 - DNA, 22 bp, Homo sapiens
aaagctggttattctgaggcag

SEQ ID NO: 7885473 - DNA, 22 bp, Homo sapiens
aaagctggttattctgaggcag

SEQ ID NO: 7885474 - DNA, 22 bp, Homo sapiens
aaagctgtaatgcatgctttct

SEQ ID NO: 7885475 - DNA, 22 bp, Homo sapiens
aaagctgtaatgcatgctttct

SEQ ID NO: 7885476 - DNA, 22 bp, Homo sapiens
aaagctgtagaatcatcttaat

SEQ ID NO: 7885477 - DNA, 22 bp, Homo sapiens
aaagctgtagaatcatcttaat

SEQ ID NO: 7885478 - DNA, 22 bp, Homo sapiens
aaagctggcctctcaggcttta

SEQ ID NO: 7885479 - DNA, 22 bp, Homo sapiens
aaagctgctttaaacatctatg

SEQ ID NO: 7885480 - DNA, 22 bp, Homo sapiens
aaagctgggctggccaacccag

SEQ ID NO: 7885481 - DNA, 22 bp, Homo sapiens
aaagctgcccttgtgaaacaag

SEQ ID NO: 7885482 - DNA, 22 bp, Homo sapiens
aaagctgccctacacggaagca

SEQ ID NO: 7885483 - DNA, 22 bp, Homo sapiens
aaagctgcccagctgcctgttt

SEQ ID NO: 7885484 - DNA, 22 bp, Homo sapiens
aaagctgccctacacggaagca

SEQ ID NO: 7885485 - DNA, 22 bp, Homo sapiens
aaagctgcccttgtgaaacaag

SEQ ID NO: 7885486 - DNA, 22 bp, Homo sapiens
aaagctgcaagctcctgaggaa

SEQ ID NO: 7885487 - DNA, 22 bp, Homo sapiens
aaagctgattgcaggaagagag

SEQ ID NO: 7885488 - DNA, 22 bp, Homo sapiens
aaagctgattgcaggaagagag

SEQ ID NO: 7885489 - DNA, 22 bp, Homo sapiens
aaagctcttttccaagtattga

SEQ ID NO: 7885490 - DNA, 22 bp, Homo sapiens
aaagctcttttccaagtattga

SEQ ID NO: 7885491 - DNA, 22 bp, Homo sapiens
aacagcaatagcactattcatt

SEQ ID NO: 7885492 - DNA, 22 bp, Homo sapiens
aacagcaatagcactattcatt

SEQ ID NO: 7885493 - DNA, 22 bp, Homo sapiens
aacagcaatagcactattcatt

SEQ ID NO: 7885494 - DNA, 22 bp, Homo sapiens
aacagcaatagcactattcatt

SEQ ID NO: 7885495 - DNA, 22 bp, Homo sapiens
aacagcaatagcactattcatt

SEQ ID NO: 7885496 - DNA, 22 bp, Homo sapiens
aacagcagcaagtaagcaggtc

SEQ ID NO: 7885497 - DNA, 22 bp, Homo sapiens
aacagcagaggagcgatggctg

SEQ ID NO: 7885498 - DNA, 22 bp, Homo sapiens
aacagcagaaactgcaagctac

SEQ ID NO: 7885499 - DNA, 22 bp, Homo sapiens
aaagcgacctctaatctagtgc

SEQ ID NO: 7885500 - DNA, 22 bp, Homo sapiens
aacagcagcaagtaagcaggtc

SEQ ID NO: 7885501 - DNA, 22 bp, Homo sapiens
aaagcgacctctaatctagtgc

SEQ ID NO: 7885502 - DNA, 22 bp, Homo sapiens
aaagcgcatagggggcagcaag

SEQ ID NO: 7885503 - DNA, 22 bp, Homo sapiens
aaagcgctatataaatgttaac

SEQ ID NO: 7885504 - DNA, 22 bp, Homo sapiens
aaagcgcttccctttggagcgt

SEQ ID NO: 7885505 - DNA, 22 bp, Homo sapiens
aaagctaaggtagcattggaga

SEQ ID NO: 7885506 - DNA, 22 bp, Homo sapiens
aaagcgcttccctttggagcgt

SEQ ID NO: 7885507 - DNA, 22 bp, Homo sapiens
aaagctacctttgtgttcatag

SEQ ID NO: 7885508 - DNA, 22 bp, Homo sapiens
aaagctacctttgtgttcatag

SEQ ID NO: 7885509 - DNA, 22 bp, Homo sapiens
aacagataagtatatctatgta

SEQ ID NO: 7885510 - DNA, 22 bp, Homo sapiens
aacagataatttctaagttact

SEQ ID NO: 7885511 - DNA, 22 bp, Homo sapiens
aacagatataggcagaactttg

SEQ ID NO: 7885512 - DNA, 22 bp, Homo sapiens
aacagagtttcaaataacatct

SEQ ID NO: 7885513 - DNA, 22 bp, Homo sapiens
aaagccatctgtattaagtgaa

SEQ ID NO: 7885514 - DNA, 22 bp, Homo sapiens
aaagccatgaatgttatagagg

SEQ ID NO: 7885515 - DNA, 22 bp, Homo sapiens
aaagccatgaatgttatagagg

SEQ ID NO: 7885516 - DNA, 19 bp, Homo sapiens
aacagcaacttcctagtca

SEQ ID NO: 7885517 - DNA, 19 bp, Homo sapiens
aacagcaacttcctagtca

SEQ ID NO: 7885518 - DNA, 19 bp, Homo sapiens
aacagcaacttcctagtca

SEQ ID NO: 7885519 - DNA, 22 bp, Homo sapiens
aacagattgtaacctgatagcc

SEQ ID NO: 7885520 - DNA, 22 bp, Homo sapiens
aacagattgtaacctgatagcc

SEQ ID NO: 7885521 - DNA, 22 bp, Homo sapiens
aacagatttaagaagccaaggt

SEQ ID NO: 7885522 - DNA, 22 bp, Homo sapiens
aacagattgtaacctgatagcc

SEQ ID NO: 7885523 - DNA, 22 bp, Homo sapiens
aacagatttaagaagccaaggt

SEQ ID NO: 7885524 - DNA, 22 bp, Homo sapiens
aacagatataggcagaactttg

SEQ ID NO: 7885525 - DNA, 22 bp, Homo sapiens
aacagatggccaagtgcatggg

SEQ ID NO: 7885526 - DNA, 22 bp, Homo sapiens
aaaagtatagggtttggagtca

SEQ ID NO: 7885527 - DNA, 22 bp, Homo sapiens
aaaagtatagggtttggagtca

SEQ ID NO: 7885528 - DNA, 22 bp, Homo sapiens
aaaagtatagggtttggagtca

SEQ ID NO: 7885529 - DNA, 22 bp, Homo sapiens
aaaagtactattttaacaaagt

SEQ ID NO: 7885530 - DNA, 22 bp, Homo sapiens
aaaagtactattttaacaaagt

SEQ ID NO: 7885531 - DNA, 22 bp, Homo sapiens
aaaagtactattttaacaaagt

SEQ ID NO: 7885532 - DNA, 22 bp, Homo sapiens
aaaagtactattttaacaaagt

SEQ ID NO: 7885533 - DNA, 22 bp, Homo sapiens
aaaagtactattttaacaaagt

SEQ ID NO: 7885534 - DNA, 22 bp, Homo sapiens
aaaagtactattttaacaaagt

SEQ ID NO: 7885535 - DNA, 22 bp, Homo sapiens
aaaagtactattttaacaaagt

SEQ ID NO: 7885536 - DNA, 22 bp, Homo sapiens
aaaagtactattttaacaaagt

SEQ ID NO: 7885537 - DNA, 22 bp, Homo sapiens
aaaagtactattttaacaaagt

SEQ ID NO: 7885538 - DNA, 22 bp, Homo sapiens
aaaagtactattttaacaaagt

SEQ ID NO: 7885539 - DNA, 22 bp, Homo sapiens
aaaagtaattgtggtttttgct

SEQ ID NO: 7885540 - DNA, 22 bp, Homo sapiens
aaaagtaattgtggtttttgct

SEQ ID NO: 7885541 - DNA, 22 bp, Homo sapiens
aaaagtaattgtggtttttgcc

SEQ ID NO: 7885542 - DNA, 22 bp, Homo sapiens
aaactctagggctccacattcc

SEQ ID NO: 7885543 - DNA, 22 bp, Homo sapiens
aaactctagggctccacattcc

SEQ ID NO: 7885544 - DNA, 22 bp, Homo sapiens
aaaagtaattgtggtttttgct

SEQ ID NO: 7885545 - DNA, 22 bp, Homo sapiens
aaaagtaattgtggtttttgct

SEQ ID NO: 7885546 - DNA, 22 bp, Homo sapiens
aaactctaagacactgtacaat

SEQ ID NO: 7885547 - DNA, 22 bp, Homo sapiens
aaactctaagacactgtacaat

SEQ ID NO: 7885548 - DNA, 22 bp, Homo sapiens
aaactccagtgaatactagaat

SEQ ID NO: 7885549 - DNA, 22 bp, Homo sapiens
aaactctagctactaggataac

SEQ ID NO: 7885550 - DNA, 22 bp, Homo sapiens
aaactctagctactaggataac

SEQ ID NO: 7885551 - DNA, 22 bp, Homo sapiens
aaactctactgaggaaataaga

SEQ ID NO: 7885552 - DNA, 22 bp, Homo sapiens
aaactctaagacactgtacaat

SEQ ID NO: 7885553 - DNA, 20 bp, Homo sapiens
aaactctacctcaatcgtca

SEQ ID NO: 7885554 - DNA, 22 bp, Homo sapiens
aaaagtattggccaccatttct

SEQ ID NO: 7885555 - DNA, 22 bp, Homo sapiens
aaaagtatttatggctatgtaa

SEQ ID NO: 7885556 - DNA, 22 bp, Homo sapiens
aaaagtatttatggctatgtaa

SEQ ID NO: 7885557 - DNA, 22 bp, Homo sapiens
aaaagtatttatggctatgtaa

SEQ ID NO: 7885558 - DNA, 22 bp, Homo sapiens
aaagaagggacagactgcctct

SEQ ID NO: 7885559 - DNA, 22 bp, Homo sapiens
aaagaaggggtctacatccaat

SEQ ID NO: 7885560 - DNA, 22 bp, Homo sapiens
aaagaaggggtctacatccaat

SEQ ID NO: 7885561 - DNA, 22 bp, Homo sapiens
aaagacatggaactagagatgg

SEQ ID NO: 7885562 - DNA, 22 bp, Homo sapiens
aaagacatggaactagagatgg

SEQ ID NO: 7885563 - DNA, 22 bp, Homo sapiens
aaagacatggaactagagatgg

SEQ ID NO: 7885564 - DNA, 22 bp, Homo sapiens
aaagacatggaactagagatgg

SEQ ID NO: 7885565 - DNA, 22 bp, Homo sapiens
aaagacatggaactagagatgg

SEQ ID NO: 7885566 - DNA, 22 bp, Homo sapiens
aaagaaggtagggctggtgact

SEQ ID NO: 7885567 - DNA, 22 bp, Homo sapiens
aaaagtatggtggtccttttta

SEQ ID NO: 7885568 - DNA, 22 bp, Homo sapiens
aaaagtattggccaccatttct

SEQ ID NO: 7885569 - DNA, 22 bp, Homo sapiens
aaaagtattggccaccatttct

SEQ ID NO: 7885570 - DNA, 22 bp, Homo sapiens
aaaagtattggccaccatttct

SEQ ID NO: 7885571 - DNA, 22 bp, Homo sapiens
aaaagtattggccaccatttct

SEQ ID NO: 7885572 - DNA, 22 bp, Homo sapiens
aaaagtattggccaccatttct

SEQ ID NO: 7885573 - DNA, 22 bp, Homo sapiens
aaaagtatccacagctcaggag

SEQ ID NO: 7885574 - DNA, 22 bp, Homo sapiens
aaaagtatccacagctcaggag

SEQ ID NO: 7885575 - DNA, 22 bp, Homo sapiens
aaaagtatggtggtccttttta

SEQ ID NO: 7885576 - DNA, 22 bp, Homo sapiens
aaaagtatggtggtccttttta

SEQ ID NO: 7885577 - DNA, 22 bp, Homo sapiens
aaaagtatggtggtccttttta

SEQ ID NO: 7885578 - DNA, 22 bp, Homo sapiens
aaaagagaatcctgtacagaga

SEQ ID NO: 7885579 - DNA, 22 bp, Homo sapiens
aaaagagaatcctgtacagaga

SEQ ID NO: 7885580 - DNA, 22 bp, Homo sapiens
aaaagagaatcctgtacagaga

SEQ ID NO: 7885581 - DNA, 22 bp, Homo sapiens
aaaagagaatcctgtacagaga

SEQ ID NO: 7885582 - DNA, 22 bp, Homo sapiens
aaaagagaatcctgtacagaga

SEQ ID NO: 7885583 - DNA, 22 bp, Homo sapiens
aaaagagaaagtggcaggcttt

SEQ ID NO: 7885584 - DNA, 22 bp, Homo sapiens
aaaagagaaagtggcaggcttt

SEQ ID NO: 7885585 - DNA, 22 bp, Homo sapiens
aaaagagagctgaggagctcca

SEQ ID NO: 7885586 - DNA, 22 bp, Homo sapiens
aaaagagagctgaggagctcca

SEQ ID NO: 7885587 - DNA, 22 bp, Homo sapiens
aaaagagagctgaggagctcca

SEQ ID NO: 7885588 - DNA, 22 bp, Homo sapiens
aaaagagagctgaggagctcca

SEQ ID NO: 7885589 - DNA, 22 bp, Homo sapiens
aaaagagaatcctgtacagaga

SEQ ID NO: 7885590 - DNA, 22 bp, Homo sapiens
aaaagagaatcctgtacagaga

SEQ ID NO: 7885591 - DNA, 22 bp, Homo sapiens
aaacccagagactagaaagacc

SEQ ID NO: 7885592 - DNA, 22 bp, Homo sapiens
aaacccagagactagaaagacc

SEQ ID NO: 7885593 - DNA, 22 bp, Homo sapiens
aaacccagagactagaaagacc

SEQ ID NO: 7885594 - DNA, 22 bp, Homo sapiens
aaacccagagactagaaagacc

SEQ ID NO: 7885595 - DNA, 22 bp, Homo sapiens
aaacccagggttttgtcttccc

SEQ ID NO: 7885596 - DNA, 22 bp, Homo sapiens
aaactagattaccactgctaga

SEQ ID NO: 7885597 - DNA, 22 bp, Homo sapiens
aaactagattaccactgctaga

SEQ ID NO: 7885598 - DNA, 22 bp, Homo sapiens
aaactagattaccactgctaga

SEQ ID NO: 7885599 - DNA, 22 bp, Homo sapiens
aaactagattaccactgctaga

SEQ ID NO: 7885600 - DNA, 22 bp, Homo sapiens
aaaagagcaaacatgtaatagt

SEQ ID NO: 7885601 - DNA, 22 bp, Homo sapiens
aaaagagcaaacatgtaatagt

SEQ ID NO: 7885602 - DNA, 22 bp, Homo sapiens
aaaagagagttgccagtctgta

SEQ ID NO: 7885603 - DNA, 22 bp, Homo sapiens
aaaagagcaaacatgtaatagt

SEQ ID NO: 7885604 - DNA, 22 bp, Homo sapiens
aaaagagcaaacatgtaatagt

SEQ ID NO: 7885605 - DNA, 22 bp, Homo sapiens
aaaccatttgaattattactga

SEQ ID NO: 7885606 - DNA, 22 bp, Homo sapiens
aaaagagcaaacatgtaatagt

SEQ ID NO: 7885607 - DNA, 22 bp, Homo sapiens
aaaagagagttgccagtctgta

SEQ ID NO: 7885608 - DNA, 22 bp, Homo sapiens
aaaagagagttgccagtctgta

SEQ ID NO: 7885609 - DNA, 22 bp, Homo sapiens
aaactcaaattaaactagctta

SEQ ID NO: 7885610 - DNA, 22 bp, Homo sapiens
aaactcaaattaaactagctta

SEQ ID NO: 7885611 - DNA, 22 bp, Homo sapiens
aaactcaaagtcagatcagaga

SEQ ID NO: 7885612 - DNA, 22 bp, Homo sapiens
aaactcaagtctatgaacaagg

SEQ ID NO: 7885613 - DNA, 22 bp, Homo sapiens
aaactcaagtctatgaacaagg

SEQ ID NO: 7885614 - DNA, 22 bp, Homo sapiens
aaactcaagtctatgaacaagg

SEQ ID NO: 7885615 - DNA, 22 bp, Homo sapiens
aaactagctcttagtttagagg

SEQ ID NO: 7885616 - DNA, 22 bp, Homo sapiens
aaactagccaaggagagataga

SEQ ID NO: 7885617 - DNA, 22 bp, Homo sapiens
aaactagccacacagaatacac

SEQ ID NO: 7885618 - DNA, 22 bp, Homo sapiens
aaactagccaaggagagataga

SEQ ID NO: 7885619 - DNA, 22 bp, Homo sapiens
aaactagccacacagaatacac

SEQ ID NO: 7885620 - DNA, 20 bp, Homo sapiens
aaactagattagcagggcag

SEQ ID NO: 7885621 - DNA, 21 bp, Homo sapiens
aaactagcagcaaccatgatc

SEQ ID NO: 7885622 - DNA, 22 bp, Homo sapiens
aaactagctgcaggcagtcatg

SEQ ID NO: 7885623 - DNA, 19 bp, Homo sapiens
aaactcatagactcatatt

SEQ ID NO: 7885624 - DNA, 22 bp, Homo sapiens
aaactcatgccattaatccttt

SEQ ID NO: 7885625 - DNA, 19 bp, Homo sapiens
aaactcatagactcatatt

SEQ ID NO: 7885626 - DNA, 22 bp, Homo sapiens
aaactcagatgtggtgaagacc

SEQ ID NO: 7885627 - DNA, 19 bp, Homo sapiens
aaactcatagactcatatt

SEQ ID NO: 7885628 - DNA, 22 bp, Homo sapiens
aaactcagatgtggtgaagacc

SEQ ID NO: 7885629 - DNA, 22 bp, Homo sapiens
aaactcagaaggtacagaaggg

SEQ ID NO: 7885630 - DNA, 22 bp, Homo sapiens
aaactcagaaggtacagaaggg

SEQ ID NO: 7885631 - DNA, 22 bp, Homo sapiens
aaactcaagtctatgaacaagg

SEQ ID NO: 7885632 - DNA, 22 bp, Homo sapiens
aaactcaagtttcttaatgtca

SEQ ID NO: 7885633 - DNA, 22 bp, Homo sapiens
aaaatcagtacactttattttg

SEQ ID NO: 7885634 - DNA, 22 bp, Homo sapiens
aaaatcagtacactttattttg

SEQ ID NO: 7885635 - DNA, 21 bp, Homo sapiens
aaaatcaccttaggtcactgg

SEQ ID NO: 7885636 - DNA, 22 bp, Homo sapiens
aaaatcagtacactttattttg

SEQ ID NO: 7885637 - DNA, 22 bp, Homo sapiens
aaaatcagtacactttattttg

SEQ ID NO: 7885638 - DNA, 22 bp, Homo sapiens
aaaatcacaagcttgggtcact

SEQ ID NO: 7885639 - DNA, 22 bp, Homo sapiens
aaaatcacaagcttgggtcact

SEQ ID NO: 7885640 - DNA, 22 bp, Homo sapiens
aaaatcacacaagtagatgggg

SEQ ID NO: 7885641 - DNA, 22 bp, Homo sapiens
aaagactaagaagagtattatt

SEQ ID NO: 7885642 - DNA, 22 bp, Homo sapiens
aaaatcctctaattctagaata

SEQ ID NO: 7885643 - DNA, 22 bp, Homo sapiens
aaaatccacaacgctcatttca

SEQ ID NO: 7885644 - DNA, 22 bp, Homo sapiens
aaaatccacaacgctcatttca

SEQ ID NO: 7885645 - DNA, 22 bp, Homo sapiens
aaaatccacaacgctcatttca

SEQ ID NO: 7885646 - DNA, 22 bp, Homo sapiens
aaaatcctgctgactcgagatg

SEQ ID NO: 7885647 - DNA, 22 bp, Homo sapiens
aaaatcctgctgactcgagatg

SEQ ID NO: 7885648 - DNA, 22 bp, Homo sapiens
aaaatcctctaattctagaata

SEQ ID NO: 7885649 - DNA, 22 bp, Homo sapiens
aaaatcctctaattctagaata

SEQ ID NO: 7885650 - DNA, 22 bp, Homo sapiens
aaaatcctctaattctagaata

SEQ ID NO: 7885651 - DNA, 22 bp, Homo sapiens
aaagacattagcttagatgtca

SEQ ID NO: 7885652 - DNA, 22 bp, Homo sapiens
aaagacattgaagaaggactta

SEQ ID NO: 7885653 - DNA, 22 bp, Homo sapiens
aaagacattgaagaaggactta

SEQ ID NO: 7885654 - DNA, 22 bp, Homo sapiens
aaagacattgaagaaggactta

SEQ ID NO: 7885655 - DNA, 22 bp, Homo sapiens
aaagacctgtggtagctctaaa

SEQ ID NO: 7885656 - DNA, 22 bp, Homo sapiens
aaagactaaatgaatgagctca

SEQ ID NO: 7885657 - DNA, 22 bp, Homo sapiens
aaagaccatgtttacagctagg

SEQ ID NO: 7885658 - DNA, 22 bp, Homo sapiens
aaagaccatgtttacagctagg

SEQ ID NO: 7885659 - DNA, 22 bp, Homo sapiens
aaagacatggcaagagatgggg

SEQ ID NO: 7885660 - DNA, 22 bp, Homo sapiens
aaagacatggaactagagatgg

SEQ ID NO: 7885661 - DNA, 22 bp, Homo sapiens
aaagacattagcttagatgtca

SEQ ID NO: 7885662 - DNA, 22 bp, Homo sapiens
aaagacattagcttagatgtca

SEQ ID NO: 7885663 - DNA, 22 bp, Homo sapiens
aaagacattagcttagatgtca

SEQ ID NO: 7885664 - DNA, 22 bp, Homo sapiens
aaagacattagcttagatgtca

SEQ ID NO: 7885665 - DNA, 22 bp, Homo sapiens
aaagacattagcttagatgtca

SEQ ID NO: 7885666 - DNA, 22 bp, Homo sapiens
aaagacattagcttagatgtca

SEQ ID NO: 7885667 - DNA, 22 bp, Homo sapiens
aaacaagagtcttgctccacct

SEQ ID NO: 7885668 - DNA, 22 bp, Homo sapiens
aaacaagagtcttgctccacct

SEQ ID NO: 7885669 - DNA, 22 bp, Homo sapiens
aaacaaacaattagttgtgtgg

SEQ ID NO: 7885670 - DNA, 22 bp, Homo sapiens
aaacaagagtcttgctccacct

SEQ ID NO: 7885671 - DNA, 23 bp, Homo sapiens
aaacaagccctaatgaagagtcc

SEQ ID NO: 7885672 - DNA, 22 bp, Homo sapiens
aaacaaggtccttctgtgacat

SEQ ID NO: 7885673 - DNA, 20 bp, Homo sapiens
aaacaaggttgctctgagga

SEQ ID NO: 7885674 - DNA, 20 bp, Homo sapiens
aaacaaggttgctctgagga

SEQ ID NO: 7885675 - DNA, 22 bp, Homo sapiens
aaacaagctgcagacaagccat

SEQ ID NO: 7885676 - DNA, 22 bp, Homo sapiens
aaacaaggtacacagtaatggt

SEQ ID NO: 7885677 - DNA, 22 bp, Homo sapiens
aaacaaggtacacagtaatggt

SEQ ID NO: 7885678 - DNA, 22 bp, Homo sapiens
aaacaagctgcagacaagccat

SEQ ID NO: 7885679 - DNA, 23 bp, Homo sapiens
aaacaagccctaatgaagagtcc

SEQ ID NO: 7885680 - DNA, 22 bp, Homo sapiens
aaaattttgccctatccttcat

SEQ ID NO: 7885681 - DNA, 22 bp, Homo sapiens
aaacaaacaattagttgtgtgg

SEQ ID NO: 7885682 - DNA, 22 bp, Homo sapiens
aaacaaacaattagttgtgtgg

SEQ ID NO: 7885683 - DNA, 20 bp, Homo sapiens
aaaatctcccagaaacttat

SEQ ID NO: 7885684 - DNA, 22 bp, Homo sapiens
aaaatctaagtagcgagtaagg

SEQ ID NO: 7885685 - DNA, 22 bp, Homo sapiens
aaaatctcattatcaggaaggg

SEQ ID NO: 7885686 - DNA, 20 bp, Homo sapiens
aaaatctcccagaaacttat

SEQ ID NO: 7885687 - DNA, 22 bp, Homo sapiens
aaacaatgaaatatttttatgg

SEQ ID NO: 7885688 - DNA, 22 bp, Homo sapiens
aaacaatgaaattcattcttca

SEQ ID NO: 7885689 - DNA, 22 bp, Homo sapiens
aaacaatgaaattcattcttca

SEQ ID NO: 7885690 - DNA, 22 bp, Homo sapiens
aaacaatgaaatatttttatgg

SEQ ID NO: 7885691 - DNA, 22 bp, Homo sapiens
aaacaatgaaatatttttatgg

SEQ ID NO: 7885692 - DNA, 22 bp, Homo sapiens
aaacaatgaaatatttttatgg

SEQ ID NO: 7885693 - DNA, 22 bp, Homo sapiens
aaacaatgaaatatttttatgg

SEQ ID NO: 7885694 - DNA, 22 bp, Homo sapiens
aaacaatccaggaacctgttta

SEQ ID NO: 7885695 - DNA, 22 bp, Homo sapiens
aaacaatccaggaacctgttta

SEQ ID NO: 7885696 - DNA, 22 bp, Homo sapiens
aaacaagtttgtagactagcca

SEQ ID NO: 7885697 - DNA, 22 bp, Homo sapiens
aaacaagtttgtagactagcca

SEQ ID NO: 7885698 - DNA, 22 bp, Homo sapiens
aaacaagtttgtagactagcca

SEQ ID NO: 7885699 - DNA, 22 bp, Homo sapiens
aaacaagtttagaataatgaat

SEQ ID NO: 7885700 - DNA, 22 bp, Homo sapiens
aaacaagtttgtagactagcca

SEQ ID NO: 7885701 - DNA, 22 bp, Homo sapiens
aaacaagtgtaaactagtctgt

SEQ ID NO: 7885702 - DNA, 23 bp, Homo sapiens
aaacaagtctctcaatggcttgc

SEQ ID NO: 7885703 - DNA, 23 bp, Homo sapiens
aaacaagtctctcaatggcttgc

SEQ ID NO: 7885704 - DNA, 23 bp, Homo sapiens
aaacaagtctctcaatggcttgc

SEQ ID NO: 7885705 - DNA, 22 bp, Homo sapiens
aaacaagtcactttatcttgaa

SEQ ID NO: 7885706 - DNA, 22 bp, Homo sapiens
aaacaagtcactttatcttgaa

SEQ ID NO: 7885707 - DNA, 22 bp, Homo sapiens
aaacaagtcactttatcttgaa

SEQ ID NO: 7885708 - DNA, 22 bp, Homo sapiens
aaacaagtttagaataatgaat

SEQ ID NO: 7885709 - DNA, 22 bp, Homo sapiens
aaacaagtgtaaactagtctgt

SEQ ID NO: 7885710 - DNA, 22 bp, Homo sapiens
aaacaagtttagaataatgaat

SEQ ID NO: 7885711 - DNA, 22 bp, Homo sapiens
aaacaagtttagaataatgaat

SEQ ID NO: 7885712 - DNA, 22 bp, Homo sapiens
aaacaagtttagaataatgaat

SEQ ID NO: 7885713 - DNA, 22 bp, Homo sapiens
aaacaagtttagaataatgaat

SEQ ID NO: 7885714 - DNA, 23 bp, Homo sapiens
aaaatcttctgcctatgaagaaa

SEQ ID NO: 7885715 - DNA, 23 bp, Homo sapiens
aaaatcttctgcctatgaagaaa

SEQ ID NO: 7885716 - DNA, 23 bp, Homo sapiens
aaaatcttctgcctatgaagaaa

SEQ ID NO: 7885717 - DNA, 22 bp, Homo sapiens
aaaatctggtaatttgaatgtg

SEQ ID NO: 7885718 - DNA, 22 bp, Homo sapiens
aaaatcttgactgtttttagaa

SEQ ID NO: 7885719 - DNA, 22 bp, Homo sapiens
aaaatcttgactgtttttagaa

SEQ ID NO: 7885720 - DNA, 22 bp, Homo sapiens
aaaatcttgtgacttaggaagg

SEQ ID NO: 7885721 - DNA, 22 bp, Homo sapiens
aaaatcttgtgacttaggaagg

SEQ ID NO: 7885722 - DNA, 22 bp, Homo sapiens
aaaatcttgactgtttttagaa

SEQ ID NO: 7885723 - DNA, 22 bp, Homo sapiens
aaaatgaagcaaaggcattcag

SEQ ID NO: 7885724 - DNA, 22 bp, Homo sapiens
aaaatgaacagaacaatgggga

SEQ ID NO: 7885725 - DNA, 22 bp, Homo sapiens
aaaatgaacagaacaatgggga

SEQ ID NO: 7885726 - DNA, 22 bp, Homo sapiens
aaaatgaagcaaaggcattcag

SEQ ID NO: 7885727 - DNA, 22 bp, Homo sapiens
aaaatgaagcaaaggcattcag

SEQ ID NO: 7885728 - DNA, 22 bp, Homo sapiens
aaaatgaataagttaacccagg

SEQ ID NO: 7885729 - DNA, 22 bp, Homo sapiens
aaaatcttgtgacttaggaagg

SEQ ID NO: 7885730 - DNA, 22 bp, Homo sapiens
aaaatcttgtgacttaggaagg

SEQ ID NO: 7885731 - DNA, 22 bp, Homo sapiens
aaaatcttgtgacttaggaagg

SEQ ID NO: 7885732 - DNA, 22 bp, Homo sapiens
aaaatcttgtgacttaggaagg

SEQ ID NO: 7885733 - DNA, 22 bp, Homo sapiens
aaaatgaacagaacaatgggga

SEQ ID NO: 7885734 - DNA, 22 bp, Homo sapiens
aaaatgaacagaacaatgggga

SEQ ID NO: 7885735 - DNA, 22 bp, Homo sapiens
aaaatgaacagaacaatgggga

SEQ ID NO: 7885736 - DNA, 22 bp, Homo sapiens
aaaatgaacagaacaatgggga

SEQ ID NO: 7885737 - DNA, 22 bp, Homo sapiens
aaaaacctcaattacttttgca

SEQ ID NO: 7885738 - DNA, 22 bp, Homo sapiens
aaaaaccattgtcttcagtctc

SEQ ID NO: 7885739 - DNA, 22 bp, Homo sapiens
aaaaacctcaattacttttgca

SEQ ID NO: 7885740 - DNA, 22 bp, Homo sapiens
aaaaacctttcattgcaaatgt

SEQ ID NO: 7885741 - DNA, 22 bp, Homo sapiens
aaaaacctttcattgcaaatgt

SEQ ID NO: 7885742 - DNA, 20 bp, Homo sapiens
aaaaacagtaatgctgaaga

SEQ ID NO: 7885743 - DNA, 20 bp, Homo sapiens
aaaaacagtaatgctgaaga

SEQ ID NO: 7885744 - DNA, 22 bp, Homo sapiens
aaaaaccattgtcttcagtctc

SEQ ID NO: 7885745 - DNA, 22 bp, Homo sapiens
aaaaaccattgtcttcagtctc

SEQ ID NO: 7885746 - DNA, 22 bp, Homo sapiens
aaaaaccattgtcttcagtctc

SEQ ID NO: 7885747 - DNA, 22 bp, Homo sapiens
aaaatagttaacgttcagagta

SEQ ID NO: 7885748 - DNA, 22 bp, Homo sapiens
aaaatagttaacgttcagagta

SEQ ID NO: 7885749 - DNA, 22 bp, Homo sapiens
aaaaacctttcccatactaaga

SEQ ID NO: 7885750 - DNA, 22 bp, Homo sapiens
aaaatagttaacgttcagagta

SEQ ID NO: 7885751 - DNA, 22 bp, Homo sapiens
aaaatagttaacgttcagagta

SEQ ID NO: 7885752 - DNA, 22 bp, Homo sapiens
aaaatagttaacgttcagagta

SEQ ID NO: 7885753 - DNA, 22 bp, Homo sapiens
aaaaacctttcattgcaaatgt

SEQ ID NO: 7885754 - DNA, 22 bp, Homo sapiens
aaaaacctttcattgcaaatgt

SEQ ID NO: 7885755 - DNA, 22 bp, Homo sapiens
aaaaacctttcccatactaaga

SEQ ID NO: 7885756 - DNA, 22 bp, Homo sapiens
aaaaacctttcccatactaaga

SEQ ID NO: 7885757 - DNA, 22 bp, Homo sapiens
aaaaactgcaattacttttgtc

SEQ ID NO: 7885758 - DNA, 22 bp, Homo sapiens
aaaaactgcaattacttttgtc

SEQ ID NO: 7885759 - DNA, 22 bp, Homo sapiens
aaaatagttaacgttcagagta

SEQ ID NO: 7885760 - DNA, 22 bp, Homo sapiens
aaaaaatcagatctttggttaa

SEQ ID NO: 7885761 - DNA, 22 bp, Homo sapiens
aaaaaatcagatctttggttaa

SEQ ID NO: 7885762 - DNA, 22 bp, Homo sapiens
aaaaaatcagatctttggttaa

SEQ ID NO: 7885763 - DNA, 22 bp, Homo sapiens
aaaaaattatcatagttcctga

SEQ ID NO: 7885764 - DNA, 22 bp, Homo sapiens
aaaaaattatcatagttcctga

SEQ ID NO: 7885765 - DNA, 22 bp, Homo sapiens
aaaaaattatcatagttcctga

SEQ ID NO: 7885766 - DNA, 22 bp, Homo sapiens
aaaaaattatcatagttcctga

SEQ ID NO: 7885767 - DNA, 22 bp, Homo sapiens
aaaaaattatcatagttcctga

SEQ ID NO: 7885768 - DNA, 22 bp, Homo sapiens
aaaaaattatcatagttcctga

SEQ ID NO: 7885769 - DNA, 22 bp, Homo sapiens
aaaaaattccattctgtgcctt

SEQ ID NO: 7885770 - DNA, 22 bp, Homo sapiens
aaaaaattatcatagttcctga

SEQ ID NO: 7885771 - DNA, 22 bp, Homo sapiens
aaaaaagattgatggtggatgc

SEQ ID NO: 7885772 - DNA, 22 bp, Homo sapiens
aaaaaagattgatggtggatgc

SEQ ID NO: 7885773 - DNA, 22 bp, Homo sapiens
aaaaaatcagatctttggttaa

SEQ ID NO: 7885774 - DNA, 22 bp, Homo sapiens
aaaaaagattgatggtggatgc

SEQ ID NO: 7885775 - DNA, 22 bp, Homo sapiens
aaaaaagattgatggtggatgc

SEQ ID NO: 7885776 - DNA, 22 bp, Homo sapiens
aaaaaagattgatggtggatgc

SEQ ID NO: 7885777 - DNA, 23 bp, Homo sapiens
aaaaaaccatgtaggcactcagt

SEQ ID NO: 7885778 - DNA, 23 bp, Homo sapiens
aaaaaaccatgtaggcactcagt

SEQ ID NO: 7885779 - DNA, 23 bp, Homo sapiens
aaaaaaccatgtaggcactcagt

SEQ ID NO: 7885780 - DNA, 22 bp, Homo sapiens
aaaaaagattgatggtggatgc

SEQ ID NO: 7885781 - DNA, 23 bp, Homo sapiens
aaaaaaccatgtaggcactcagt

SEQ ID NO: 7885782 - DNA, 22 bp, Homo sapiens
aaaaaattccattctgtgcctt

SEQ ID NO: 7885783 - DNA, 22 bp, Homo sapiens
aaaaaattccattctgtgcctt

SEQ ID NO: 7885784 - DNA, 22 bp, Homo sapiens
aaaaaattccattctgtgcctt

SEQ ID NO: 7885785 - DNA, 22 bp, Homo sapiens
aaaaaattccattctgtgcctt

SEQ ID NO: 7885786 - DNA, 22 bp, Homo sapiens
aaaaaattccattctgtgcctt

SEQ ID NO: 7885787 - DNA, 22 bp, Homo sapiens
aaaaacacaactgtctttctct

SEQ ID NO: 7885788 - DNA, 22 bp, Homo sapiens
aaaaacacaactgtctttctct

SEQ ID NO: 7885789 - DNA, 22 bp, Homo sapiens
aaaaacacaactgtctttctct

SEQ ID NO: 7885790 - DNA, 22 bp, Homo sapiens
aaaaacacaactgtctttctct

SEQ ID NO: 7885791 - DNA, 22 bp, Homo sapiens
aaaaacacaactgtctttctct

SEQ ID NO: 7885792 - DNA, 22 bp, Homo sapiens
aaaaacacaactgtctttctct

SEQ ID NO: 7885793 - DNA, 22 bp, Homo sapiens
aaaaacacaactgtctttctct

SEQ ID NO: 7885794 - DNA, 22 bp, Homo sapiens
aaaaacacaactgtctttctct

SEQ ID NO: 7885795 - DNA, 20 bp, Homo sapiens
aaaaacagtaatgctgaaga

SEQ ID NO: 7885796 - DNA, 20 bp, Homo sapiens
aaaaacagtaatgctgaaga

SEQ ID NO: 7885797 - DNA, 20 bp, Homo sapiens
aaaaacagtaatgctgaaga

SEQ ID NO: 7885798 - DNA, 20 bp, Homo sapiens
aaaaacagtaatgctgaaga

SEQ ID NO: 7885799 - DNA, 22 bp, Homo sapiens
aaaaacactgggctgggagtca

SEQ ID NO: 7885800 - DNA, 22 bp, Homo sapiens
aaaaacagaatgtgtctaactc

SEQ ID NO: 7885801 - DNA, 22 bp, Homo sapiens
aaaaacagaatgtgtctaactc

SEQ ID NO: 7885802 - DNA, 22 bp, Homo sapiens
aaaaacagaatgtgtctaactc

SEQ ID NO: 7885803 - DNA, 22 bp, Homo sapiens
aaaaacacaagtggcttggtct

SEQ ID NO: 7885804 - DNA, 22 bp, Homo sapiens
aaaaacactgggctgggagtca

SEQ ID NO: 7885805 - DNA, 22 bp, Homo sapiens
aaacacaggtactgcagaagtg

SEQ ID NO: 7885806 - DNA, 22 bp, Homo sapiens
aaacacaggtactgcagaagtg

SEQ ID NO: 7885807 - DNA, 22 bp, Homo sapiens
aaacacatcattcatgtcgtca

SEQ ID NO: 7885808 - DNA, 22 bp, Homo sapiens
aaacacatcattcatgtcgtca

SEQ ID NO: 7885809 - DNA, 22 bp, Homo sapiens
aaacactgtgggacatcttact

SEQ ID NO: 7885810 - DNA, 22 bp, Homo sapiens
aaacacatcattcatgtcgtca

SEQ ID NO: 7885811 - DNA, 22 bp, Homo sapiens
aaaaatcacttttataggcagc

SEQ ID NO: 7885812 - DNA, 22 bp, Homo sapiens
aaaaatcacttttataggcagc

SEQ ID NO: 7885813 - DNA, 22 bp, Homo sapiens
aaaaatcacttttataggcagc

SEQ ID NO: 7885814 - DNA, 22 bp, Homo sapiens
aaaaatcacttttataggcagc

SEQ ID NO: 7885815 - DNA, 22 bp, Homo sapiens
aaaaatctatgactgcttctcc

SEQ ID NO: 7885816 - DNA, 22 bp, Homo sapiens
aaaaatcacttttataggcagc

SEQ ID NO: 7885817 - DNA, 22 bp, Homo sapiens
aaaaatcacttttataggcagc

SEQ ID NO: 7885818 - DNA, 22 bp, Homo sapiens
aaaaatcacttttataggcagc

SEQ ID NO: 7885819 - DNA, 22 bp, Homo sapiens
aaaaatcacttttataggcagc

SEQ ID NO: 7885820 - DNA, 22 bp, Homo sapiens
aaaaatcacttttataggcagc

SEQ ID NO: 7885821 - DNA, 22 bp, Homo sapiens
aaaaatcacttttataggcagc

SEQ ID NO: 7885822 - DNA, 22 bp, Homo sapiens
aaaaatcacttttataggcagc

SEQ ID NO: 7885823 - DNA, 22 bp, Homo sapiens
aaaaatcacttttataggcagc

SEQ ID NO: 7885824 - DNA, 22 bp, Homo sapiens
aaaaatcacttttataggcagc

SEQ ID NO: 7885825 - DNA, 22 bp, Homo sapiens
aaaaatcacttttataggcagc

SEQ ID NO: 7885826 - DNA, 22 bp, Homo sapiens
aaaaatcacttttataggcagc

SEQ ID NO: 7885827 - DNA, 22 bp, Homo sapiens
aaaaatcacttttataggcagc

SEQ ID NO: 7885828 - DNA, 22 bp, Homo sapiens
aaaaatcacttttataggcagc

SEQ ID NO: 7885829 - DNA, 22 bp, Homo sapiens
aaaaatcacttttataggcagc

SEQ ID NO: 7885830 - DNA, 22 bp, Homo sapiens
aaaaatcacttttataggcagc

SEQ ID NO: 7885831 - DNA, 22 bp, Homo sapiens
aaaaataggtcaaccgtgtatg

SEQ ID NO: 7885832 - DNA, 22 bp, Homo sapiens
aaaaatagcttctcttgtccct

SEQ ID NO: 7885833 - DNA, 22 bp, Homo sapiens
aaaaataggtcaaccgtgtatg

SEQ ID NO: 7885834 - DNA, 22 bp, Homo sapiens
aaaaataggtcaaccgtgtatg

SEQ ID NO: 7885835 - DNA, 22 bp, Homo sapiens
aaaaataggtcaaccgtgtatg

SEQ ID NO: 7885836 - DNA, 22 bp, Homo sapiens
aaaaatagcttctcttgtccct

SEQ ID NO: 7885837 - DNA, 22 bp, Homo sapiens
aaaaatagaaggattgactgag

SEQ ID NO: 7885838 - DNA, 22 bp, Homo sapiens
aaaaatagcttctcttgtccct

SEQ ID NO: 7885839 - DNA, 22 bp, Homo sapiens
aaaaatagcttctcttgtccct

SEQ ID NO: 7885840 - DNA, 22 bp, Homo sapiens
aaaaatagcttctcttgtccct

SEQ ID NO: 7885841 - DNA, 22 bp, Homo sapiens
aaaaatagaaggattgactgag

SEQ ID NO: 7885842 - DNA, 22 bp, Homo sapiens
aaaaatagaaggattgactgag

SEQ ID NO: 7885843 - DNA, 22 bp, Homo sapiens
aaaaatagaaggattgactgag

SEQ ID NO: 7885844 - DNA, 22 bp, Homo sapiens
aaaatgaataagttaacccagg

SEQ ID NO: 7885845 - DNA, 22 bp, Homo sapiens
aaaatgaataagttaacccagg

SEQ ID NO: 7885846 - DNA, 22 bp, Homo sapiens
aaaatgaataagttaacccagg

SEQ ID NO: 7885847 - DNA, 22 bp, Homo sapiens
aaaatgaataagttaacccagg

SEQ ID NO: 7885848 - DNA, 22 bp, Homo sapiens
aaaatgaataagttaacccagg

SEQ ID NO: 7885849 - DNA, 22 bp, Homo sapiens
aaaatgaataagttaacccagg

SEQ ID NO: 7885850 - DNA, 22 bp, Homo sapiens
aaaaatagaaggattgactgag

SEQ ID NO: 7885851 - DNA, 22 bp, Homo sapiens
aaaaatagaaggattgactgag

SEQ ID NO: 7885852 - DNA, 22 bp, Homo sapiens
aaaaatagaaggattgactgag

SEQ ID NO: 7885853 - DNA, 22 bp, Homo sapiens
aaaaatagaaggattgactgag

SEQ ID NO: 7885854 - DNA, 22 bp, Homo sapiens
aaaatgacattccagtgatatt

SEQ ID NO: 7885855 - DNA, 22 bp, Homo sapiens
aaaatgacattccagtgatatt

SEQ ID NO: 7885856 - DNA, 22 bp, Homo sapiens
aaaatgacattccagtgatatt

SEQ ID NO: 7885857 - DNA, 22 bp, Homo sapiens
aaaatgaataagttaacccagg

SEQ ID NO: 7885858 - DNA, 22 bp, Homo sapiens
aaaatgacattccagtgatatt

SEQ ID NO: 7885859 - DNA, 22 bp, Homo sapiens
aaaatgacattccagtgatatt

SEQ ID NO: 7885860 - DNA, 22 bp, Homo sapiens
aaaagacatctatttcaggcag

SEQ ID NO: 7885861 - DNA, 22 bp, Homo sapiens
aaaagacatctatttcaggcag

SEQ ID NO: 7885862 - DNA, 22 bp, Homo sapiens
aaaagacatctatttcaggcag

SEQ ID NO: 7885863 - DNA, 22 bp, Homo sapiens
aaaagagaaagtggcaggcttt

SEQ ID NO: 7885864 - DNA, 22 bp, Homo sapiens
aaaagagaaagtggcaggcttt

SEQ ID NO: 7885865 - DNA, 22 bp, Homo sapiens
aaaagacatctatttcaggcag

SEQ ID NO: 7885866 - DNA, 22 bp, Homo sapiens
aaaagacatctatttcaggcag

SEQ ID NO: 7885867 - DNA, 22 bp, Homo sapiens
aaaagacatatgtgggcattct

SEQ ID NO: 7885868 - DNA, 22 bp, Homo sapiens
aaaagacatatgtgggcattct

SEQ ID NO: 7885869 - DNA, 22 bp, Homo sapiens
aaaagacaggtgtctgcggccc

SEQ ID NO: 7885870 - DNA, 22 bp, Homo sapiens
aaaagacaggtgtctgcggccc

SEQ ID NO: 7885871 - DNA, 22 bp, Homo sapiens
aaaagacaggtgtctgcggccc

SEQ ID NO: 7885872 - DNA, 22 bp, Homo sapiens
aaaagaacctagctcctcagtc

SEQ ID NO: 7885873 - DNA, 22 bp, Homo sapiens
aaacagagggccactgaggctc

SEQ ID NO: 7885874 - DNA, 22 bp, Homo sapiens
aaacagagagatgtatgtggag

SEQ ID NO: 7885875 - DNA, 21 bp, Homo sapiens
aaacagagctgagtaatagat

SEQ ID NO: 7885876 - DNA, 22 bp, Homo sapiens
aaacagaagggtaggtaaacat

SEQ ID NO: 7885877 - DNA, 22 bp, Homo sapiens
aaacagaagggtaggtaaacat

SEQ ID NO: 7885878 - DNA, 22 bp, Homo sapiens
aaacagaagggtaggtaaacat

SEQ ID NO: 7885879 - DNA, 22 bp, Homo sapiens
aaacagagagatgtatgtggag

SEQ ID NO: 7885880 - DNA, 22 bp, Homo sapiens
aaacagactgaagagttgaagc

SEQ ID NO: 7885881 - DNA, 22 bp, Homo sapiens
aaacactgtgtcaaactggggc

SEQ ID NO: 7885882 - DNA, 22 bp, Homo sapiens
aaacacttcaaggacttctgtc

SEQ ID NO: 7885883 - DNA, 22 bp, Homo sapiens
aaacacttcaaggacttctgtc

SEQ ID NO: 7885884 - DNA, 22 bp, Homo sapiens
aaacacttcaaggacttctgtc

SEQ ID NO: 7885885 - DNA, 22 bp, Homo sapiens
aaacacttcaaggacttctgtc

SEQ ID NO: 7885886 - DNA, 22 bp, Homo sapiens
aaacacttcttaggtcttaagt

SEQ ID NO: 7885887 - DNA, 22 bp, Homo sapiens
aaacacttcctgtaacatgaca

SEQ ID NO: 7885888 - DNA, 22 bp, Homo sapiens
aaacacttcctgtaacatgaca

SEQ ID NO: 7885889 - DNA, 22 bp, Homo sapiens
aaacacttcctgtaacatgaca

SEQ ID NO: 7885890 - DNA, 22 bp, Homo sapiens
aaacacttcaaggacttctgtc

SEQ ID NO: 7885891 - DNA, 22 bp, Homo sapiens
aaacacttcctgtaacatgaca

SEQ ID NO: 7885892 - DNA, 22 bp, Homo sapiens
aaacacttcctgtaacatgaca

SEQ ID NO: 7885893 - DNA, 22 bp, Homo sapiens
aaacagaaatttcctcatgctc

SEQ ID NO: 7885894 - DNA, 22 bp, Homo sapiens
aaacagaaatttcctcatgctc

SEQ ID NO: 7885895 - DNA, 22 bp, Homo sapiens
aaacagaaatttcctcatgctc

SEQ ID NO: 7885896 - DNA, 22 bp, Homo sapiens
aaacagaaatttcctcatgctc

SEQ ID NO: 7885897 - DNA, 22 bp, Homo sapiens
aaacagaaatttcctcatgctc

SEQ ID NO: 7885898 - DNA, 22 bp, Homo sapiens
aaacagaaatttcctcatgctc

SEQ ID NO: 7885899 - DNA, 22 bp, Homo sapiens
aaacagaaatttcctcatgctc

SEQ ID NO: 7885900 - DNA, 22 bp, Homo sapiens
aaacacttgcaaaatggttcct

SEQ ID NO: 7885901 - DNA, 22 bp, Homo sapiens
aaacactttagaaagggacttg

SEQ ID NO: 7885902 - DNA, 22 bp, Homo sapiens
aaacactttagaaagggacttg

SEQ ID NO: 7885903 - DNA, 22 bp, Homo sapiens
aaacactttaagtgaggaggat

SEQ ID NO: 7885904 - DNA, 22 bp, Homo sapiens
aaacacttgcaaaatggttcct

SEQ ID NO: 7885905 - DNA, 22 bp, Homo sapiens
aaactcttcatatacatatgct

SEQ ID NO: 7885906 - DNA, 22 bp, Homo sapiens
aaactcttcctttctttaaagt

SEQ ID NO: 7885907 - DNA, 22 bp, Homo sapiens
aaactctgttgagataatattt

SEQ ID NO: 7885908 - DNA, 22 bp, Homo sapiens
aaactctgttgagataatattt

SEQ ID NO: 7885909 - DNA, 22 bp, Homo sapiens
aaactctgtagctaaacataat

SEQ ID NO: 7885910 - DNA, 22 bp, Homo sapiens
aaactctgccatttttggcctg

SEQ ID NO: 7885911 - DNA, 22 bp, Homo sapiens
aaactgaaacatcatcatgttg

SEQ ID NO: 7885912 - DNA, 17 bp, Homo sapiens
aaactgaaaaattcact

SEQ ID NO: 7885913 - DNA, 17 bp, Homo sapiens
aaactgaaaaattcact

SEQ ID NO: 7885914 - DNA, 21 bp, Homo sapiens
aaactgaagagacaggaactt

SEQ ID NO: 7885915 - DNA, 21 bp, Homo sapiens
aaactgaagagacaggaactt

SEQ ID NO: 7885916 - DNA, 22 bp, Homo sapiens
aaactctttccacgattacttt

SEQ ID NO: 7885917 - DNA, 22 bp, Homo sapiens
aaactcttttgcatattagagg

SEQ ID NO: 7885918 - DNA, 17 bp, Homo sapiens
aaactgaaaaattcact

SEQ ID NO: 7885919 - DNA, 21 bp, Homo sapiens
aaactgaccttgcctgagaca

SEQ ID NO: 7885920 - DNA, 21 bp, Homo sapiens
aaactgaccttgcctgagaca

SEQ ID NO: 7885921 - DNA, 21 bp, Homo sapiens
aaactgaccttgcctgagaca

SEQ ID NO: 7885922 - DNA, 22 bp, Homo sapiens
aaactgaagtagattctgaaat

SEQ ID NO: 7885923 - DNA, 22 bp, Homo sapiens
aaactgaattcaagtatccagt

SEQ ID NO: 7885924 - DNA, 22 bp, Homo sapiens
aaactgaagagctttttgacac

SEQ ID NO: 7885925 - DNA, 22 bp, Homo sapiens
aaactgaattcaagtatccagt

SEQ ID NO: 7885926 - DNA, 22 bp, Homo sapiens
aaactgaattcccaagggcatg

SEQ ID NO: 7885927 - DNA, 22 bp, Homo sapiens
aaactgaattcccaagggcatg

SEQ ID NO: 7885928 - DNA, 21 bp, Homo sapiens
aaactgaggcttcaagcagtg

SEQ ID NO: 7885929 - DNA, 22 bp, Homo sapiens
aaactgaggctcccgagggtgt

SEQ ID NO: 7885930 - DNA, 22 bp, Homo sapiens
aaactgaggagttagactaggg

SEQ ID NO: 7885931 - DNA, 22 bp, Homo sapiens
aaactgaggagttagactaggg

SEQ ID NO: 7885932 - DNA, 22 bp, Homo sapiens
aaactgaggagttagactaggg

SEQ ID NO: 7885933 - DNA, 22 bp, Homo sapiens
aaactgaggagttagactaggg

SEQ ID NO: 7885934 - DNA, 22 bp, Homo sapiens
aaactgaggaacaaggaaggat

SEQ ID NO: 7885935 - DNA, 22 bp, Homo sapiens
aaactgagaccgaaaggggtag

SEQ ID NO: 7885936 - DNA, 22 bp, Homo sapiens
aaactgagattgctgctgtctg

SEQ ID NO: 7885937 - DNA, 22 bp, Homo sapiens
aaagaatcagaagtctcaaaca

SEQ ID NO: 7885938 - DNA, 22 bp, Homo sapiens
aaagaatagttaagtttagggc

SEQ ID NO: 7885939 - DNA, 22 bp, Homo sapiens
aaagaatagcctttgtccaaat

SEQ ID NO: 7885940 - DNA, 22 bp, Homo sapiens
aaagaatagcctttgtccaaat

SEQ ID NO: 7885941 - DNA, 22 bp, Homo sapiens
aaagaatagcctttgtccaaat

SEQ ID NO: 7885942 - DNA, 22 bp, Homo sapiens
aaagaatagcctttgtccaaat

SEQ ID NO: 7885943 - DNA, 22 bp, Homo sapiens
aaagaatagcctttgtccaaat

SEQ ID NO: 7885944 - DNA, 22 bp, Homo sapiens
aaagaatagcctttgtccaaat

SEQ ID NO: 7885945 - DNA, 22 bp, Homo sapiens
aaagaataccctgggtcataaa

SEQ ID NO: 7885946 - DNA, 22 bp, Homo sapiens
aaagaatactccttttgccttg

SEQ ID NO: 7885947 - DNA, 22 bp, Homo sapiens
aaagaatactccttttgccttg

SEQ ID NO: 7885948 - DNA, 22 bp, Homo sapiens
aaagaatactccttttgccttg

SEQ ID NO: 7885949 - DNA, 22 bp, Homo sapiens
aaagaatttgtacaccctacta

SEQ ID NO: 7885950 - DNA, 22 bp, Homo sapiens
aaagaatgtctgaacagctggc

SEQ ID NO: 7885951 - DNA, 22 bp, Homo sapiens
aaagacacaaatgtagaccaaa

SEQ ID NO: 7885952 - DNA, 22 bp, Homo sapiens
aaagacacaaatgtagaccaaa

SEQ ID NO: 7885953 - DNA, 22 bp, Homo sapiens
aaagaatctatatatcaccacc

SEQ ID NO: 7885954 - DNA, 22 bp, Homo sapiens
aaagaatctatatatcaccacc

SEQ ID NO: 7885955 - DNA, 22 bp, Homo sapiens
aaagaatctatatatcaccacc

SEQ ID NO: 7885956 - DNA, 22 bp, Homo sapiens
aaagaatgcagtgccttccagc

SEQ ID NO: 7885957 - DNA, 22 bp, Homo sapiens
aaagaactacctgtatgatatt

SEQ ID NO: 7885958 - DNA, 22 bp, Homo sapiens
aaagaagtgttgaatttgcaag

SEQ ID NO: 7885959 - DNA, 22 bp, Homo sapiens
aaagaagtgttgaatttgcaag

SEQ ID NO: 7885960 - DNA, 22 bp, Homo sapiens
aaagaagtgttgaatttgcaag

SEQ ID NO: 7885961 - DNA, 22 bp, Homo sapiens
aaagaagtgttgaatttgcaag

SEQ ID NO: 7885962 - DNA, 22 bp, Homo sapiens
aaagaataccctgggtcataaa

SEQ ID NO: 7885963 - DNA, 22 bp, Homo sapiens
aaagaatactccttttgccttg

SEQ ID NO: 7885964 - DNA, 22 bp, Homo sapiens
aaagaataccctgggtcataaa

SEQ ID NO: 7885965 - DNA, 22 bp, Homo sapiens
aaagaataccctgggtcataaa

SEQ ID NO: 7885966 - DNA, 22 bp, Homo sapiens
aaagaataccctgggtcataaa

SEQ ID NO: 7885967 - DNA, 22 bp, Homo sapiens
aaagaataccctgggtcataaa

SEQ ID NO: 7885968 - DNA, 22 bp, Homo sapiens
aaagaactaatgtgcaaggttt

SEQ ID NO: 7885969 - DNA, 21 bp, Homo sapiens
aaagaacaggcagatgttctt

SEQ ID NO: 7885970 - DNA, 22 bp, Homo sapiens
aaactgagtggcttataaacaa

SEQ ID NO: 7885971 - DNA, 22 bp, Homo sapiens
aaactgagtggcttataaacaa

SEQ ID NO: 7885972 - DNA, 22 bp, Homo sapiens
aaattactttacactttcatct

SEQ ID NO: 7885973 - DNA, 20 bp, Homo sapiens
aaattactgccacacatttc

SEQ ID NO: 7885974 - DNA, 22 bp, Homo sapiens
aaattagaaatactttcaaagc

SEQ ID NO: 7885975 - DNA, 22 bp, Homo sapiens
aaattagaaatactttcaaagc

SEQ ID NO: 7885976 - DNA, 22 bp, Homo sapiens
aaattagaaatactttcaaagc

SEQ ID NO: 7885977 - DNA, 22 bp, Homo sapiens
aaattagaaatactttcaaagc

SEQ ID NO: 7885978 - DNA, 22 bp, Homo sapiens
aaattagaaatactttcaaagc

SEQ ID NO: 7885979 - DNA, 22 bp, Homo sapiens
aaattagaaatactttcaaagc

SEQ ID NO: 7885980 - DNA, 22 bp, Homo sapiens
aaattagaccagggctcctgga

SEQ ID NO: 7885981 - DNA, 22 bp, Homo sapiens
aaattagaccagggctcctgga

SEQ ID NO: 7885982 - DNA, 22 bp, Homo sapiens
aaattgtctttaatcaggtcat

SEQ ID NO: 7885983 - DNA, 22 bp, Homo sapiens
aaattagaagtgctcaggaata

SEQ ID NO: 7885984 - DNA, 22 bp, Homo sapiens
aaattagaagtgctcaggaata

SEQ ID NO: 7885985 - DNA, 22 bp, Homo sapiens
aaattagaagtgctcaggaata

SEQ ID NO: 7885986 - DNA, 22 bp, Homo sapiens
aaattaccattgtaaagtattt

SEQ ID NO: 7885987 - DNA, 22 bp, Homo sapiens
aaattaccattgtaaagtattt

SEQ ID NO: 7885988 - DNA, 22 bp, Homo sapiens
aaattaccattgtaaagtattt

SEQ ID NO: 7885989 - DNA, 22 bp, Homo sapiens
aaattacagatcaccaatgcat

SEQ ID NO: 7885990 - DNA, 22 bp, Homo sapiens
aaattacagccttgggtagctt

SEQ ID NO: 7885991 - DNA, 22 bp, Homo sapiens
aaattaagggtgagaagagttg

SEQ ID NO: 7885992 - DNA, 22 bp, Homo sapiens
aaattaagggtgagaagagttg

SEQ ID NO: 7885993 - DNA, 22 bp, Homo sapiens
aaattacagatcaccaatgcat

SEQ ID NO: 7885994 - DNA, 22 bp, Homo sapiens
aaattacagatcaccaatgcat

SEQ ID NO: 7885995 - DNA, 22 bp, Homo sapiens
aaattacagatcaccaatgcat

SEQ ID NO: 7885996 - DNA, 22 bp, Homo sapiens
aaagagtctggcgttttaatgg

SEQ ID NO: 7885997 - DNA, 22 bp, Homo sapiens
aaagagttcacggaggccaaag

SEQ ID NO: 7885998 - DNA, 22 bp, Homo sapiens
aaagagttccaagtcattttat

SEQ ID NO: 7885999 - DNA, 22 bp, Homo sapiens
aaagagttctatgatctttcca

SEQ ID NO: 7886000 - DNA, 21 bp, Homo sapiens
aaagaggttaatattgtaagt

SEQ ID NO: 7886001 - DNA, 22 bp, Homo sapiens
aaagaggggactgttaattcca

SEQ ID NO: 7886002 - DNA, 22 bp, Homo sapiens
aaagaggggactgttaattcca

SEQ ID NO: 7886003 - DNA, 22 bp, Homo sapiens
aaagagttgaggcagttatcca

SEQ ID NO: 7886004 - DNA, 22 bp, Homo sapiens
aaagagttgaggcagttatcca

SEQ ID NO: 7886005 - DNA, 22 bp, Homo sapiens
aaagagttctgtttgagctgaa

SEQ ID NO: 7886006 - DNA, 22 bp, Homo sapiens
aaagagttggactttctcaggc

SEQ ID NO: 7886007 - DNA, 22 bp, Homo sapiens
aaagagttggactttctcaggc

SEQ ID NO: 7886008 - DNA, 22 bp, Homo sapiens
aaagagttgttgtataacagga

SEQ ID NO: 7886009 - DNA, 22 bp, Homo sapiens
aaagagttgttgtataacagga

SEQ ID NO: 7886010 - DNA, 22 bp, Homo sapiens
aaattaagagtaactctgtaga

SEQ ID NO: 7886011 - DNA, 22 bp, Homo sapiens
aaatgcagatccctgaatctca

SEQ ID NO: 7886012 - DNA, 22 bp, Homo sapiens
aaatgcagatccctgaatctca

SEQ ID NO: 7886013 - DNA, 22 bp, Homo sapiens
aaatgcagattcatgagcccca

SEQ ID NO: 7886014 - DNA, 22 bp, Homo sapiens
aaatgcagattgtcattcagga

SEQ ID NO: 7886015 - DNA, 22 bp, Homo sapiens
aaatgcagattgtcattcagga

SEQ ID NO: 7886016 - DNA, 22 bp, Homo sapiens
aaatgcagattgtcattcagga

SEQ ID NO: 7886017 - DNA, 22 bp, Homo sapiens
aaatgcagattttgatgcagca

SEQ ID NO: 7886018 - DNA, 22 bp, Homo sapiens
aaatgcagcagctaattgaaaa

SEQ ID NO: 7886019 - DNA, 22 bp, Homo sapiens
aaatgcactgaacacatgttgt

SEQ ID NO: 7886020 - DNA, 22 bp, Homo sapiens
aaatgcactgaacacatgttgt

SEQ ID NO: 7886021 - DNA, 22 bp, Homo sapiens
aaatgcagaatctcagacccca

SEQ ID NO: 7886022 - DNA, 22 bp, Homo sapiens
aaatgcagacagcttcacacac

SEQ ID NO: 7886023 - DNA, 22 bp, Homo sapiens
aaatgcagaatgatttcatcta

SEQ ID NO: 7886024 - DNA, 22 bp, Homo sapiens
aaagacacaaatgtagaccaaa

SEQ ID NO: 7886025 - DNA, 22 bp, Homo sapiens
aaatgcaccttgctgtgagact

SEQ ID NO: 7886026 - DNA, 22 bp, Homo sapiens
aaatgcaccttgctgtgagact

SEQ ID NO: 7886027 - DNA, 22 bp, Homo sapiens
aaatgcactgaacacatgttgt

SEQ ID NO: 7886028 - DNA, 22 bp, Homo sapiens
aaatgcactctgcttctgtgac

SEQ ID NO: 7886029 - DNA, 22 bp, Homo sapiens
aaatgcactctgcttctgtgac

SEQ ID NO: 7886030 - DNA, 22 bp, Homo sapiens
aaagagcaccctcaatgtctga

SEQ ID NO: 7886031 - DNA, 22 bp, Homo sapiens
aaagagcaccctcaatgtctga

SEQ ID NO: 7886032 - DNA, 22 bp, Homo sapiens
aaagagcaccctcaatgtctga

SEQ ID NO: 7886033 - DNA, 22 bp, Homo sapiens
aaagagcaccctcaatgtctga

SEQ ID NO: 7886034 - DNA, 22 bp, Homo sapiens
aaagagcaccctcaatgtctga

SEQ ID NO: 7886035 - DNA, 21 bp, Homo sapiens
aaagagcttttgtgctagtta

SEQ ID NO: 7886036 - DNA, 21 bp, Homo sapiens
aaagagcttttgtgctagtta

SEQ ID NO: 7886037 - DNA, 21 bp, Homo sapiens
aaagagcttttgtgctagtta

SEQ ID NO: 7886038 - DNA, 22 bp, Homo sapiens
aaagaggaaccaagagcacgtg

SEQ ID NO: 7886039 - DNA, 22 bp, Homo sapiens
aaagagcatggaaagttcagga

SEQ ID NO: 7886040 - DNA, 22 bp, Homo sapiens
aaagagcatggaaagttcagga

SEQ ID NO: 7886041 - DNA, 22 bp, Homo sapiens
aaagagcatggaaagttcagga

SEQ ID NO: 7886042 - DNA, 22 bp, Homo sapiens
aaagagcatggaaagttcagga

SEQ ID NO: 7886043 - DNA, 22 bp, Homo sapiens
aaagagcatggaaagttcagga

SEQ ID NO: 7886044 - DNA, 22 bp, Homo sapiens
aaagagcaccctcaatgtctga

SEQ ID NO: 7886045 - DNA, 22 bp, Homo sapiens
aaagaggatggagtagtcagct

SEQ ID NO: 7886046 - DNA, 22 bp, Homo sapiens
aaagaggaaccaagagcacgtg

SEQ ID NO: 7886047 - DNA, 22 bp, Homo sapiens
aaagagcatggaaagttcagga

SEQ ID NO: 7886048 - DNA, 22 bp, Homo sapiens
aaagaggaaccaagagcacgtg

SEQ ID NO: 7886049 - DNA, 22 bp, Homo sapiens
aaagaggcaggtgttactggaa

SEQ ID NO: 7886050 - DNA, 22 bp, Homo sapiens
aaagaggctcaaggtgggccag

SEQ ID NO: 7886051 - DNA, 22 bp, Homo sapiens
aaagaggcaatcaatgtagcaa

SEQ ID NO: 7886052 - DNA, 22 bp, Homo sapiens
aaagaggcaatcaatgtagcaa

SEQ ID NO: 7886053 - DNA, 22 bp, Homo sapiens
aaacaatgtacatttataatgc

SEQ ID NO: 7886054 - DNA, 22 bp, Homo sapiens
aaacaatgtagattaccattta

SEQ ID NO: 7886055 - DNA, 22 bp, Homo sapiens
aaacaatgtagattaccattta

SEQ ID NO: 7886056 - DNA, 22 bp, Homo sapiens
aaacaatgtacatttataatgc

SEQ ID NO: 7886057 - DNA, 22 bp, Homo sapiens
aaacaatgtacatttataatgc

SEQ ID NO: 7886058 - DNA, 22 bp, Homo sapiens
aaacaatgtacacatgaatgtt

SEQ ID NO: 7886059 - DNA, 22 bp, Homo sapiens
aaacaatgtacatttataatgc

SEQ ID NO: 7886060 - DNA, 22 bp, Homo sapiens
aaacaatgtacatttataatgc

SEQ ID NO: 7886061 - DNA, 22 bp, Homo sapiens
aaacaatgtacacatgaatgtt

SEQ ID NO: 7886062 - DNA, 22 bp, Homo sapiens
aaacaatgtacatttataatgc

SEQ ID NO: 7886063 - DNA, 17 bp, Homo sapiens
aaacaatgcagacaagc

SEQ ID NO: 7886064 - DNA, 17 bp, Homo sapiens
aaacaatgcagacaagc

SEQ ID NO: 7886065 - DNA, 17 bp, Homo sapiens
aaacaatgcagacaagc

SEQ ID NO: 7886066 - DNA, 17 bp, Homo sapiens
aaacaatgcagacaagc

SEQ ID NO: 7886067 - DNA, 22 bp, Homo sapiens
aaacaatgtacacatgaatgtt

SEQ ID NO: 7886068 - DNA, 22 bp, Homo sapiens
aaacaatgacaacacagctgcg

SEQ ID NO: 7886069 - DNA, 22 bp, Homo sapiens
aaacaatgaaattcattcttca

SEQ ID NO: 7886070 - DNA, 22 bp, Homo sapiens
aaacaatgaaattcattcttca

SEQ ID NO: 7886071 - DNA, 22 bp, Homo sapiens
aaacaatgaaattcattcttca

SEQ ID NO: 7886072 - DNA, 22 bp, Homo sapiens
aaacaatgacaacacagctgcg

SEQ ID NO: 7886073 - DNA, 22 bp, Homo sapiens
aaacaatgacaacacagctgcg

SEQ ID NO: 7886074 - DNA, 22 bp, Homo sapiens
aaacaatgacaacacagctgcg

SEQ ID NO: 7886075 - DNA, 22 bp, Homo sapiens
aaacaatgagcttttacacact

SEQ ID NO: 7886076 - DNA, 22 bp, Homo sapiens
aaacaatgagcttttacacact

SEQ ID NO: 7886077 - DNA, 22 bp, Homo sapiens
aaacaatgagcttttacacact

SEQ ID NO: 7886078 - DNA, 22 bp, Homo sapiens
aaacaatgagcttttacacact

SEQ ID NO: 7886079 - DNA, 22 bp, Homo sapiens
aaacaatgagcttttacacact

SEQ ID NO: 7886080 - DNA, 22 bp, Homo sapiens
aaacaatgagcttttacacact

SEQ ID NO: 7886081 - DNA, 17 bp, Homo sapiens
aaacaatgcagacaagc

SEQ ID NO: 7886082 - DNA, 22 bp, Homo sapiens
aaacaatgttcctatattagag

SEQ ID NO: 7886083 - DNA, 22 bp, Homo sapiens
aaacaatgttcctatattagag

SEQ ID NO: 7886084 - DNA, 22 bp, Homo sapiens
aaacaatgttcctatattagag

SEQ ID NO: 7886085 - DNA, 22 bp, Homo sapiens
aaacaatgttcctatattagag

SEQ ID NO: 7886086 - DNA, 22 bp, Homo sapiens
aaacaatgttcctatattagag

SEQ ID NO: 7886087 - DNA, 23 bp, Homo sapiens
aaacaatgtcatcaggacttggt

SEQ ID NO: 7886088 - DNA, 22 bp, Homo sapiens
aaacaatgtctaaggtgcacag

SEQ ID NO: 7886089 - DNA, 23 bp, Homo sapiens
aaacaatgtcatcaggacttggt

SEQ ID NO: 7886090 - DNA, 22 bp, Homo sapiens
aaacaatgtagattaccattta

SEQ ID NO: 7886091 - DNA, 22 bp, Homo sapiens
aaacaatgtagattaccattta

SEQ ID NO: 7886092 - DNA, 22 bp, Homo sapiens
aaacaatgtagattaccattta

SEQ ID NO: 7886093 - DNA, 22 bp, Homo sapiens
aaacaatttccacctctcctga

SEQ ID NO: 7886094 - DNA, 22 bp, Homo sapiens
aaacaatgttgtctccaagagg

SEQ ID NO: 7886095 - DNA, 22 bp, Homo sapiens
aaacaatgttcctatattagag

SEQ ID NO: 7886096 - DNA, 22 bp, Homo sapiens
aaacaatgttgctgggtgcggt

SEQ ID NO: 7886097 - DNA, 22 bp, Homo sapiens
aaacaatgttgtctccaagagg

SEQ ID NO: 7886098 - DNA, 22 bp, Homo sapiens
aaacaatgttgtctccaagagg

SEQ ID NO: 7886099 - DNA, 22 bp, Homo sapiens
aaacaatgttgtctccaagagg

SEQ ID NO: 7886100 - DNA, 22 bp, Homo sapiens
aaacaatgttgtctccaagagg

SEQ ID NO: 7886101 - DNA, 22 bp, Homo sapiens
aaacagtgccaggcagatgcca

SEQ ID NO: 7886102 - DNA, 22 bp, Homo sapiens
aaacagtgcaggaagttaagca

SEQ ID NO: 7886103 - DNA, 22 bp, Homo sapiens
aaacagtgcaggaagttaagca

SEQ ID NO: 7886104 - DNA, 17 bp, Homo sapiens
aaacagtgagtgttatg

SEQ ID NO: 7886105 - DNA, 22 bp, Homo sapiens
aaacagtgactggtacataata

SEQ ID NO: 7886106 - DNA, 17 bp, Homo sapiens
aaacagtgagtgttatg

SEQ ID NO: 7886107 - DNA, 22 bp, Homo sapiens
aaacagtgactggtacataata

SEQ ID NO: 7886108 - DNA, 22 bp, Homo sapiens
aaacagtgatgttgagtgtaaa

SEQ ID NO: 7886109 - DNA, 22 bp, Homo sapiens
aaacagtgactggtacataata

SEQ ID NO: 7886110 - DNA, 22 bp, Homo sapiens
aaacagtgactggtacataata

SEQ ID NO: 7886111 - DNA, 22 bp, Homo sapiens
aaacagtgactggtacataata

SEQ ID NO: 7886112 - DNA, 22 bp, Homo sapiens
aaacagcttgtaaggtgtaatt

SEQ ID NO: 7886113 - DNA, 22 bp, Homo sapiens
aaacacaagaggcagggtacag

SEQ ID NO: 7886114 - DNA, 22 bp, Homo sapiens
aaacagttgttatttttatatg

SEQ ID NO: 7886115 - DNA, 22 bp, Homo sapiens
aaacagtttataacatgatact

SEQ ID NO: 7886116 - DNA, 22 bp, Homo sapiens
aaacagttctcatttgtttaga

SEQ ID NO: 7886117 - DNA, 22 bp, Homo sapiens
aaacagttctccaggaagccag

SEQ ID NO: 7886118 - DNA, 22 bp, Homo sapiens
aaacagttgttatttttatatg

SEQ ID NO: 7886119 - DNA, 22 bp, Homo sapiens
aaacagtttcattttcatgacc

SEQ ID NO: 7886120 - DNA, 22 bp, Homo sapiens
aaacagtttcattttcatgacc

SEQ ID NO: 7886121 - DNA, 22 bp, Homo sapiens
aaacagtttcattttcatgacc

SEQ ID NO: 7886122 - DNA, 22 bp, Homo sapiens
aaacagtttcattttcatgacc

SEQ ID NO: 7886123 - DNA, 22 bp, Homo sapiens
aaacagtttataacatgatact

SEQ ID NO: 7886124 - DNA, 22 bp, Homo sapiens
aaacagtttataacatgatact

SEQ ID NO: 7886125 - DNA, 22 bp, Homo sapiens
aaacagtttataacatgatact

SEQ ID NO: 7886126 - DNA, 22 bp, Homo sapiens
aaacagtttataacatgatact

SEQ ID NO: 7886127 - DNA, 22 bp, Homo sapiens
aaacagtggccaattctggaga

SEQ ID NO: 7886128 - DNA, 22 bp, Homo sapiens
aaacagtgtgtttcagagaggc

SEQ ID NO: 7886129 - DNA, 22 bp, Homo sapiens
aaacagtgtaggtggccaggca

SEQ ID NO: 7886130 - DNA, 22 bp, Homo sapiens
aaacagtgcctggcatggagga

SEQ ID NO: 7886131 - DNA, 22 bp, Homo sapiens
aaacagtggccaattctggaga

SEQ ID NO: 7886132 - DNA, 22 bp, Homo sapiens
aaacagtgcctggcatggagga

SEQ ID NO: 7886133 - DNA, 22 bp, Homo sapiens
aaacagtgtttttatgatttat

SEQ ID NO: 7886134 - DNA, 22 bp, Homo sapiens
aaacagtgtttttatgatttat

SEQ ID NO: 7886135 - DNA, 22 bp, Homo sapiens
aaacagttaattgctttcagtt

SEQ ID NO: 7886136 - DNA, 22 bp, Homo sapiens
aaaggtaacagttataaccagg

SEQ ID NO: 7886137 - DNA, 22 bp, Homo sapiens
aaaggtaaagtatctgcccaag

SEQ ID NO: 7886138 - DNA, 22 bp, Homo sapiens
aaaggtaactggggttttgcca

SEQ ID NO: 7886139 - DNA, 22 bp, Homo sapiens
aaagggtcagattctgctagtg

SEQ ID NO: 7886140 - DNA, 22 bp, Homo sapiens
aaagggttgttgtaaggattat

SEQ ID NO: 7886141 - DNA, 22 bp, Homo sapiens
aaagggtccagatacttggaaa

SEQ ID NO: 7886142 - DNA, 22 bp, Homo sapiens
aaagggtcagattctgctagtg

SEQ ID NO: 7886143 - DNA, 22 bp, Homo sapiens
aaagggctgatgtgacatagct

SEQ ID NO: 7886144 - DNA, 22 bp, Homo sapiens
aaacagttttcctagctgtctg

SEQ ID NO: 7886145 - DNA, 22 bp, Homo sapiens
aaagggctgtcaaataagcaac

SEQ ID NO: 7886146 - DNA, 22 bp, Homo sapiens
aaacagtttctaatcatggaga

SEQ ID NO: 7886147 - DNA, 22 bp, Homo sapiens
aaacagtttctaatcatggaga

SEQ ID NO: 7886148 - DNA, 22 bp, Homo sapiens
aaaggtcattgaaaaggaggaa

SEQ ID NO: 7886149 - DNA, 22 bp, Homo sapiens
aaaggtcattgaaaaggaggaa

SEQ ID NO: 7886150 - DNA, 22 bp, Homo sapiens
aaaggtcttaaggttaagcagg

SEQ ID NO: 7886151 - DNA, 22 bp, Homo sapiens
aaaggtatgatactgtgacatg

SEQ ID NO: 7886152 - DNA, 22 bp, Homo sapiens
aaaccttttcagctgaatggag

SEQ ID NO: 7886153 - DNA, 22 bp, Homo sapiens
aaagttcactatgtagcagcgt

SEQ ID NO: 7886154 - DNA, 22 bp, Homo sapiens
aaagttagtaaaatgggatata

SEQ ID NO: 7886155 - DNA, 22 bp, Homo sapiens
aaagttactttgctgtgcttca

SEQ ID NO: 7886156 - DNA, 22 bp, Homo sapiens
aaagttagacagcatcatttct

SEQ ID NO: 7886157 - DNA, 18 bp, Homo sapiens
aaagttcagggagagttg

SEQ ID NO: 7886158 - DNA, 22 bp, Homo sapiens
aaagttcagattagactcaaga

SEQ ID NO: 7886159 - DNA, 22 bp, Homo sapiens
aaagttcagtgccttctataca

SEQ ID NO: 7886160 - DNA, 22 bp, Homo sapiens
aaagttcagtgccttctataca

SEQ ID NO: 7886161 - DNA, 22 bp, Homo sapiens
aaagttagtttcttatatgtct

SEQ ID NO: 7886162 - DNA, 22 bp, Homo sapiens
aaagttcactgaccagcactgg

SEQ ID NO: 7886163 - DNA, 22 bp, Homo sapiens
aaagttcactgaccagcactgg

SEQ ID NO: 7886164 - DNA, 22 bp, Homo sapiens
aaagttcactgaccagcactgg

SEQ ID NO: 7886165 - DNA, 20 bp, Homo sapiens
aaagttcatgtttgcacttt

SEQ ID NO: 7886166 - DNA, 22 bp, Homo sapiens
aaactagaaatcagcaagatag

SEQ ID NO: 7886167 - DNA, 21 bp, Homo sapiens
aaactagagtgtggcaaagct

SEQ ID NO: 7886168 - DNA, 22 bp, Homo sapiens
aaactagaaatcagcaagatag

SEQ ID NO: 7886169 - DNA, 21 bp, Homo sapiens
aaagttcatgctttaatattc

SEQ ID NO: 7886170 - DNA, 22 bp, Homo sapiens
aaagttcatggtgttatagaaa

SEQ ID NO: 7886171 - DNA, 22 bp, Homo sapiens
aaactctatttctgttggctta

SEQ ID NO: 7886172 - DNA, 22 bp, Homo sapiens
aaactctcttttcttcagtagg

SEQ ID NO: 7886173 - DNA, 22 bp, Homo sapiens
aaactctcttttcttcagtagg

SEQ ID NO: 7886174 - DNA, 22 bp, Homo sapiens
aaactctcattttagtgcactg

SEQ ID NO: 7886175 - DNA, 22 bp, Homo sapiens
aaactctataggcagaagcaat

SEQ ID NO: 7886176 - DNA, 22 bp, Homo sapiens
aaactctataggcagaagcaat

SEQ ID NO: 7886177 - DNA, 22 bp, Homo sapiens
aaactctataaataagggctat

SEQ ID NO: 7886178 - DNA, 22 bp, Homo sapiens
aaactctatgaaccttctacca

SEQ ID NO: 7886179 - DNA, 22 bp, Homo sapiens
aaactctataggcagaagcaat

SEQ ID NO: 7886180 - DNA, 22 bp, Homo sapiens
aaactctagtaaaatgtattca

SEQ ID NO: 7886181 - DNA, 22 bp, Homo sapiens
aaactagatgaaacgagtaaag

SEQ ID NO: 7886182 - DNA, 22 bp, Homo sapiens
aaactagatgaaacgagtaaag

SEQ ID NO: 7886183 - DNA, 22 bp, Homo sapiens
aaactagatgaaacgagtaaag

SEQ ID NO: 7886184 - DNA, 22 bp, Homo sapiens
aaactagatgattatgaagcat

SEQ ID NO: 7886185 - DNA, 22 bp, Homo sapiens
aaactagatgattatgaagcat

SEQ ID NO: 7886186 - DNA, 22 bp, Homo sapiens
aaactagatgattatgaagcat

SEQ ID NO: 7886187 - DNA, 22 bp, Homo sapiens
aaacctttctgctctcagcgta

SEQ ID NO: 7886188 - DNA, 22 bp, Homo sapiens
aaaccttcacatctactctaca

SEQ ID NO: 7886189 - DNA, 22 bp, Homo sapiens
aaacctttctcagtgctaaaat

SEQ ID NO: 7886190 - DNA, 22 bp, Homo sapiens
aaaccttttcagctgaatggag

SEQ ID NO: 7886191 - DNA, 22 bp, Homo sapiens
aaacctttgtgtgtctgtgcct

SEQ ID NO: 7886192 - DNA, 22 bp, Homo sapiens
aaacctgtctgattatggagac

SEQ ID NO: 7886193 - DNA, 22 bp, Homo sapiens
aaaccttcacatctactctaca

SEQ ID NO: 7886194 - DNA, 22 bp, Homo sapiens
aaacctcttctcaagatttctg

SEQ ID NO: 7886195 - DNA, 22 bp, Homo sapiens
aaaccttaaaccaagctcttga

SEQ ID NO: 7886196 - DNA, 22 bp, Homo sapiens
aaacctgaagtacgttacataa

SEQ ID NO: 7886197 - DNA, 22 bp, Homo sapiens
aaacctgaagtacgttacataa

SEQ ID NO: 7886198 - DNA, 22 bp, Homo sapiens
aaacctgaatgtatgtcagaag

SEQ ID NO: 7886199 - DNA, 22 bp, Homo sapiens
aaacctgatagattttcagaat

SEQ ID NO: 7886200 - DNA, 22 bp, Homo sapiens
aaacctgaatgtatgtcagaag

SEQ ID NO: 7886201 - DNA, 22 bp, Homo sapiens
aaacctgatagattttcagaat

SEQ ID NO: 7886202 - DNA, 22 bp, Homo sapiens
aaacctgatagattttcagaat

SEQ ID NO: 7886203 - DNA, 22 bp, Homo sapiens
aaacctggtggaacggtgaata

SEQ ID NO: 7886204 - DNA, 22 bp, Homo sapiens
aaacctcttttaaggagttgtt

SEQ ID NO: 7886205 - DNA, 22 bp, Homo sapiens
aaacctgaaggatgatacaaca

SEQ ID NO: 7886206 - DNA, 22 bp, Homo sapiens
aaacctgaaggatgatacaaca

SEQ ID NO: 7886207 - DNA, 22 bp, Homo sapiens
aaacctgaagtacgttacataa

SEQ ID NO: 7886208 - DNA, 22 bp, Homo sapiens
aaacctattggcaagaataata

SEQ ID NO: 7886209 - DNA, 22 bp, Homo sapiens
aaacctatatagtcttagaagc

SEQ ID NO: 7886210 - DNA, 22 bp, Homo sapiens
aaacctattggcaagaataata

SEQ ID NO: 7886211 - DNA, 22 bp, Homo sapiens
aaacctatatagtcttagaagc

SEQ ID NO: 7886212 - DNA, 22 bp, Homo sapiens
aaacctagaaggaagggtctct

SEQ ID NO: 7886213 - DNA, 22 bp, Homo sapiens
aaaccctgcccttcccaagatg

SEQ ID NO: 7886214 - DNA, 22 bp, Homo sapiens
aaaccctgctcttatggaactt

SEQ ID NO: 7886215 - DNA, 22 bp, Homo sapiens
aaacccatggctgatatcacta

SEQ ID NO: 7886216 - DNA, 22 bp, Homo sapiens
aaaccctgcccttcccaagatg

SEQ ID NO: 7886217 - DNA, 22 bp, Homo sapiens
aaacccatctgtctgtctgcag

SEQ ID NO: 7886218 - DNA, 22 bp, Homo sapiens
aaacattgtacattctgtagct

SEQ ID NO: 7886219 - DNA, 22 bp, Homo sapiens
aaacattgtacattctgtagct

SEQ ID NO: 7886220 - DNA, 22 bp, Homo sapiens
aaacccagggttttgtcttccc

SEQ ID NO: 7886221 - DNA, 22 bp, Homo sapiens
aaacccagggttttgtcttccc

SEQ ID NO: 7886222 - DNA, 22 bp, Homo sapiens
aaacccagggttttgtcttccc

SEQ ID NO: 7886223 - DNA, 22 bp, Homo sapiens
aaaggtcttctcaaacatccca

SEQ ID NO: 7886224 - DNA, 22 bp, Homo sapiens
aaaggtcttcagtgctttcact

SEQ ID NO: 7886225 - DNA, 22 bp, Homo sapiens
aaaggtcttgtcttgacagagt

SEQ ID NO: 7886226 - DNA, 22 bp, Homo sapiens
aaaggtcttcagtgctttcact

SEQ ID NO: 7886227 - DNA, 22 bp, Homo sapiens
aaaggtcttaaggttaagcagg

SEQ ID NO: 7886228 - DNA, 23 bp, Homo sapiens
aaaggtctctgagccttggtttc

SEQ ID NO: 7886229 - DNA, 22 bp, Homo sapiens
aaaggtctttattggtcagcca

SEQ ID NO: 7886230 - DNA, 22 bp, Homo sapiens
aaaggtcttgtcttgacagagt

SEQ ID NO: 7886231 - DNA, 22 bp, Homo sapiens
aaaggtgctactgtgttcctca

SEQ ID NO: 7886232 - DNA, 22 bp, Homo sapiens
aaaggtgcctcttacaaggctt

SEQ ID NO: 7886233 - DNA, 22 bp, Homo sapiens
aaaggtggagttgtgcccattt

SEQ ID NO: 7886234 - DNA, 22 bp, Homo sapiens
aaaggtgttgccttggagacct

SEQ ID NO: 7886235 - DNA, 22 bp, Homo sapiens
aaacattgtaattttagcatgg

SEQ ID NO: 7886236 - DNA, 22 bp, Homo sapiens
aaaggtgttgccttggagacct

SEQ ID NO: 7886237 - DNA, 22 bp, Homo sapiens
aagcacaggatcttgaggagcg

SEQ ID NO: 7886238 - DNA, 22 bp, Homo sapiens
aagcacaggatcttgaggagcg

SEQ ID NO: 7886239 - DNA, 22 bp, Homo sapiens
aagcacaggatcttgaggagcg

SEQ ID NO: 7886240 - DNA, 22 bp, Homo sapiens
aagcacaggatcttgaggagcg

SEQ ID NO: 7886241 - DNA, 22 bp, Homo sapiens
aagcacagggactcaggaccgg

SEQ ID NO: 7886242 - DNA, 22 bp, Homo sapiens
aagcacagggactcaggaccgg

SEQ ID NO: 7886243 - DNA, 22 bp, Homo sapiens
aagcacagggactcaggaccgg

SEQ ID NO: 7886244 - DNA, 22 bp, Homo sapiens
aagcacaggagacgcacagcca

SEQ ID NO: 7886245 - DNA, 22 bp, Homo sapiens
aagcacaggagacgcacagcca

SEQ ID NO: 7886246 - DNA, 22 bp, Homo sapiens
aagcacaggagacgcacagcca

SEQ ID NO: 7886247 - DNA, 22 bp, Homo sapiens
aagcacaggagacgcacagcca

SEQ ID NO: 7886248 - DNA, 22 bp, Homo sapiens
aagcacaggagacgcacagcca

SEQ ID NO: 7886249 - DNA, 22 bp, Homo sapiens
aagcacaggatcttgaggagcg

SEQ ID NO: 7886250 - DNA, 17 bp, Homo sapiens
acactggtgctggagtc

SEQ ID NO: 7886251 - DNA, 22 bp, Homo sapiens
aagcacagaaaaggagcatgga

SEQ ID NO: 7886252 - DNA, 22 bp, Homo sapiens
aagcacagaaaaggagcatgga

SEQ ID NO: 7886253 - DNA, 22 bp, Homo sapiens
aagcacagaaaaggagcatgga

SEQ ID NO: 7886254 - DNA, 22 bp, Homo sapiens
aagcacagaaaaggagcatgga

SEQ ID NO: 7886255 - DNA, 22 bp, Homo sapiens
aagcacagaaaaggagcatgga

SEQ ID NO: 7886256 - DNA, 22 bp, Homo sapiens
acactgggcttgttacgttgca

SEQ ID NO: 7886257 - DNA, 22 bp, Homo sapiens
acactgggtaacatatctgtta

SEQ ID NO: 7886258 - DNA, 22 bp, Homo sapiens
acactggtaggaagagatggct

SEQ ID NO: 7886259 - DNA, 22 bp, Homo sapiens
acactgggttacctgtactatt

SEQ ID NO: 7886260 - DNA, 22 bp, Homo sapiens
acactggtaggaagagatggct

SEQ ID NO: 7886261 - DNA, 22 bp, Homo sapiens
acactggtatgactgttccagt

SEQ ID NO: 7886262 - DNA, 22 bp, Homo sapiens
acactggtcatgcctgggtgtt

SEQ ID NO: 7886263 - DNA, 22 bp, Homo sapiens
acactggtcatgcctgggtgtt

SEQ ID NO: 7886264 - DNA, 22 bp, Homo sapiens
acactggtgatcaaagggtaga

SEQ ID NO: 7886265 - DNA, 21 bp, Homo sapiens
acactggtgcctgatgtcagg

SEQ ID NO: 7886266 - DNA, 22 bp, Homo sapiens
acactggtgccctttctggccc

SEQ ID NO: 7886267 - DNA, 22 bp, Homo sapiens
acactggtatgactgttccagt

SEQ ID NO: 7886268 - DNA, 21 bp, Homo sapiens
acactggtgcctgatgtcagg

SEQ ID NO: 7886269 - DNA, 18 bp, Homo sapiens
aagcacaggtgtttcagg

SEQ ID NO: 7886270 - DNA, 18 bp, Homo sapiens
aagcacaggtgtttcagg

SEQ ID NO: 7886271 - DNA, 22 bp, Homo sapiens
aagcacagggtgtctgcattca

SEQ ID NO: 7886272 - DNA, 22 bp, Homo sapiens
aagcacagggtgtctgcattca

SEQ ID NO: 7886273 - DNA, 22 bp, Homo sapiens
aagcacagggtgtctgcattca

SEQ ID NO: 7886274 - DNA, 18 bp, Homo sapiens
aagcacaggtgtttcagg

SEQ ID NO: 7886275 - DNA, 18 bp, Homo sapiens
aagcacaggtgtttcagg

SEQ ID NO: 7886276 - DNA, 22 bp, Homo sapiens
aagcacaggttgaggattattc

SEQ ID NO: 7886277 - DNA, 22 bp, Homo sapiens
aagcacaggggaaataagttgt

SEQ ID NO: 7886278 - DNA, 22 bp, Homo sapiens
aagcacagggactttaggaata

SEQ ID NO: 7886279 - DNA, 22 bp, Homo sapiens
aagcacagggactttaggaata

SEQ ID NO: 7886280 - DNA, 22 bp, Homo sapiens
aagcacaggggaaataagttgt

SEQ ID NO: 7886281 - DNA, 22 bp, Homo sapiens
aagcacagggactcaggaccgg

SEQ ID NO: 7886282 - DNA, 22 bp, Homo sapiens
aagcacagggactcaggaccgg

SEQ ID NO: 7886283 - DNA, 22 bp, Homo sapiens
aagcacagggactttaggaata

SEQ ID NO: 7886284 - DNA, 22 bp, Homo sapiens
aagcacagggactttaggaata

SEQ ID NO: 7886285 - DNA, 22 bp, Homo sapiens
aagcacagtaaaagcagatttt

SEQ ID NO: 7886286 - DNA, 22 bp, Homo sapiens
aagcacagtgccaagttctatt

SEQ ID NO: 7886287 - DNA, 22 bp, Homo sapiens
aagcacagtgccaagttctatt

SEQ ID NO: 7886288 - DNA, 22 bp, Homo sapiens
aagcacagtgccaagttctatt

SEQ ID NO: 7886289 - DNA, 22 bp, Homo sapiens
aagcacagtgccaagttctatt

SEQ ID NO: 7886290 - DNA, 22 bp, Homo sapiens
aagcacagtaaaagcagatttt

SEQ ID NO: 7886291 - DNA, 22 bp, Homo sapiens
aagcacaggttgaggattattc

SEQ ID NO: 7886292 - DNA, 22 bp, Homo sapiens
aagcacagtaaaagcagatttt

SEQ ID NO: 7886293 - DNA, 22 bp, Homo sapiens
aagcacagtgggcagagcagcc

SEQ ID NO: 7886294 - DNA, 22 bp, Homo sapiens
acagaattaggagatcctcttg

SEQ ID NO: 7886295 - DNA, 22 bp, Homo sapiens
acagaattaggagatcctcttg

SEQ ID NO: 7886296 - DNA, 22 bp, Homo sapiens
acagaattaggagatcctcttg

SEQ ID NO: 7886297 - DNA, 22 bp, Homo sapiens
aagcacagtgggcagagcagcc

SEQ ID NO: 7886298 - DNA, 22 bp, Homo sapiens
aagcacagtgggcagagcagcc

SEQ ID NO: 7886299 - DNA, 22 bp, Homo sapiens
aagatttactttctttgtaata

SEQ ID NO: 7886300 - DNA, 22 bp, Homo sapiens
aagatttactttctttgtaata

SEQ ID NO: 7886301 - DNA, 22 bp, Homo sapiens
aagatttactttctttgtaata

SEQ ID NO: 7886302 - DNA, 22 bp, Homo sapiens
aagatttactttctttgtaata

SEQ ID NO: 7886303 - DNA, 22 bp, Homo sapiens
aagatttactagcataatagct

SEQ ID NO: 7886304 - DNA, 22 bp, Homo sapiens
aagatttactagcataatagct

SEQ ID NO: 7886305 - DNA, 22 bp, Homo sapiens
aagatttactttctttgtaata

SEQ ID NO: 7886306 - DNA, 22 bp, Homo sapiens
aagatttactttctttgtaata

SEQ ID NO: 7886307 - DNA, 22 bp, Homo sapiens
aagatttagggccagtttacat

SEQ ID NO: 7886308 - DNA, 22 bp, Homo sapiens
aagatttagggccagtttacat

SEQ ID NO: 7886309 - DNA, 22 bp, Homo sapiens
aagatttactttctttgtaata

SEQ ID NO: 7886310 - DNA, 22 bp, Homo sapiens
aagatttactttctttgtaata

SEQ ID NO: 7886311 - DNA, 22 bp, Homo sapiens
aagatttattagatgcttacct

SEQ ID NO: 7886312 - DNA, 22 bp, Homo sapiens
aagatttattagatgcttacct

SEQ ID NO: 7886313 - DNA, 21 bp, Homo sapiens
aagatttatgggacttgccaa

SEQ ID NO: 7886314 - DNA, 22 bp, Homo sapiens
aagatttagggccagtttacat

SEQ ID NO: 7886315 - DNA, 21 bp, Homo sapiens
aagatttatgggacttgccaa

SEQ ID NO: 7886316 - DNA, 22 bp, Homo sapiens
aagatttagggccagtttacat

SEQ ID NO: 7886317 - DNA, 22 bp, Homo sapiens
aagatttattagatgcttacct

SEQ ID NO: 7886318 - DNA, 22 bp, Homo sapiens
aagatttattagatgcttacct

SEQ ID NO: 7886319 - DNA, 22 bp, Homo sapiens
aagatttattagatgcttacct

SEQ ID NO: 7886320 - DNA, 22 bp, Homo sapiens
aagatttccatttctagctcat

SEQ ID NO: 7886321 - DNA, 22 bp, Homo sapiens
aagatttcctggatgtaattcc

SEQ ID NO: 7886322 - DNA, 18 bp, Homo sapiens
acactgcagcagtctgct

SEQ ID NO: 7886323 - DNA, 22 bp, Homo sapiens
acactgctcacttcttcccttg

SEQ ID NO: 7886324 - DNA, 22 bp, Homo sapiens
acactgctcacttcttcccttg

SEQ ID NO: 7886325 - DNA, 22 bp, Homo sapiens
acactgctaaacagtaaagatg

SEQ ID NO: 7886326 - DNA, 22 bp, Homo sapiens
acactggaaatagggaggtttt

SEQ ID NO: 7886327 - DNA, 22 bp, Homo sapiens
acactggaaatagggaggtttt

SEQ ID NO: 7886328 - DNA, 22 bp, Homo sapiens
acactgcttctctggcagagcc

SEQ ID NO: 7886329 - DNA, 22 bp, Homo sapiens
acactgcttctctggcagagcc

SEQ ID NO: 7886330 - DNA, 21 bp, Homo sapiens
acactgcaggtgaagtgcact

SEQ ID NO: 7886331 - DNA, 21 bp, Homo sapiens
acactgcaggtgaagtgcact

SEQ ID NO: 7886332 - DNA, 21 bp, Homo sapiens
acactgcaggtgaagtgcact

SEQ ID NO: 7886333 - DNA, 21 bp, Homo sapiens
acactgcaggtgaagtgcact

SEQ ID NO: 7886334 - DNA, 21 bp, Homo sapiens
acactgcaggtgaagtgcact

SEQ ID NO: 7886335 - DNA, 22 bp, Homo sapiens
acactgcatttcaacaaggccc

SEQ ID NO: 7886336 - DNA, 22 bp, Homo sapiens
acactgctaaacagtaaagatg

SEQ ID NO: 7886337 - DNA, 22 bp, Homo sapiens
acactgcatttcaacaaggccc

SEQ ID NO: 7886338 - DNA, 22 bp, Homo sapiens
acactgcatttcaacaaggccc

SEQ ID NO: 7886339 - DNA, 22 bp, Homo sapiens
acactggataccactgttatta

SEQ ID NO: 7886340 - DNA, 22 bp, Homo sapiens
acactggatgaagcaagctaaa

SEQ ID NO: 7886341 - DNA, 22 bp, Homo sapiens
acactggatgaagcaagctaaa

SEQ ID NO: 7886342 - DNA, 22 bp, Homo sapiens
acactggataccactgttatta

SEQ ID NO: 7886343 - DNA, 22 bp, Homo sapiens
acactggataccactgttatta

SEQ ID NO: 7886344 - DNA, 22 bp, Homo sapiens
acactggataccactgttatta

SEQ ID NO: 7886345 - DNA, 22 bp, Homo sapiens
acactggagggtccagggatgt

SEQ ID NO: 7886346 - DNA, 22 bp, Homo sapiens
acactggagggtccagggatgt

SEQ ID NO: 7886347 - DNA, 22 bp, Homo sapiens
acactggattcttgtagtgaag

SEQ ID NO: 7886348 - DNA, 22 bp, Homo sapiens
acactggattcttgtagtgaag

SEQ ID NO: 7886349 - DNA, 22 bp, Homo sapiens
acactggatgaagcaagctaaa

SEQ ID NO: 7886350 - DNA, 19 bp, Homo sapiens
acactgggagaagactgct

SEQ ID NO: 7886351 - DNA, 19 bp, Homo sapiens
acactgggagaagactgct

SEQ ID NO: 7886352 - DNA, 22 bp, Homo sapiens
acactggaccatttaaacttga

SEQ ID NO: 7886353 - DNA, 22 bp, Homo sapiens
acactggaccatttaaacttga

SEQ ID NO: 7886354 - DNA, 22 bp, Homo sapiens
acactggaccatttaaacttga

SEQ ID NO: 7886355 - DNA, 22 bp, Homo sapiens
acactggaaatagggaggtttt

SEQ ID NO: 7886356 - DNA, 22 bp, Homo sapiens
acactggacactgaactccctg

SEQ ID NO: 7886357 - DNA, 22 bp, Homo sapiens
acactggactcagaggccagaa

SEQ ID NO: 7886358 - DNA, 22 bp, Homo sapiens
acactggactcagaggccagaa

SEQ ID NO: 7886359 - DNA, 22 bp, Homo sapiens
acactggactcagaggccagaa

SEQ ID NO: 7886360 - DNA, 22 bp, Homo sapiens
acactggagatggacctcacaa

SEQ ID NO: 7886361 - DNA, 22 bp, Homo sapiens
acactggagatggacctcacaa

SEQ ID NO: 7886362 - DNA, 22 bp, Homo sapiens
acactggagcttctagcccacg

SEQ ID NO: 7886363 - DNA, 22 bp, Homo sapiens
acactggagcttctagcccacg

SEQ ID NO: 7886364 - DNA, 22 bp, Homo sapiens
acactggagcttctagcccacg

SEQ ID NO: 7886365 - DNA, 22 bp, Homo sapiens
acactggaggagagctgttgct

SEQ ID NO: 7886366 - DNA, 22 bp, Homo sapiens
acactggaggagagctgttgct

SEQ ID NO: 7886367 - DNA, 22 bp, Homo sapiens
aagaggccttggtctgacctga

SEQ ID NO: 7886368 - DNA, 22 bp, Homo sapiens
aagaggccttggtctgacctga

SEQ ID NO: 7886369 - DNA, 22 bp, Homo sapiens
aagaggcgccgggtacgtggcg

SEQ ID NO: 7886370 - DNA, 22 bp, Homo sapiens
aagaggcgctcctcacttccta

SEQ ID NO: 7886371 - DNA, 22 bp, Homo sapiens
aagaggcctcacctcactgccc

SEQ ID NO: 7886372 - DNA, 22 bp, Homo sapiens
aagaggcctggaggcagaggtg

SEQ ID NO: 7886373 - DNA, 22 bp, Homo sapiens
aagaggcctggaggcagaggtg

SEQ ID NO: 7886374 - DNA, 22 bp, Homo sapiens
aagaggctgaatgagaaagtac

SEQ ID NO: 7886375 - DNA, 22 bp, Homo sapiens
aagaggctgaatgagaaagtac

SEQ ID NO: 7886376 - DNA, 22 bp, Homo sapiens
aagaggctggaggatactgcgc

SEQ ID NO: 7886377 - DNA, 22 bp, Homo sapiens
aagaggctagccggctcactaa

SEQ ID NO: 7886378 - DNA, 22 bp, Homo sapiens
aagaggctagccggctcactaa

SEQ ID NO: 7886379 - DNA, 22 bp, Homo sapiens
aagaggctagccggctcactaa

SEQ ID NO: 7886380 - DNA, 22 bp, Homo sapiens
aagaggctagccggctcactaa

SEQ ID NO: 7886381 - DNA, 22 bp, Homo sapiens
aagaggctagccggctcactaa

SEQ ID NO: 7886382 - DNA, 20 bp, Homo sapiens
aagaggctgtggatcctact

SEQ ID NO: 7886383 - DNA, 22 bp, Homo sapiens
aagaggctggcattgatggtag

SEQ ID NO: 7886384 - DNA, 22 bp, Homo sapiens
aagatgttattgtcttccttgc

SEQ ID NO: 7886385 - DNA, 22 bp, Homo sapiens
aagaggcttcagatccttcaga

SEQ ID NO: 7886386 - DNA, 22 bp, Homo sapiens
aagaggcttatagtcttcctgt

SEQ ID NO: 7886387 - DNA, 22 bp, Homo sapiens
aagaggcttcagatccttcaga

SEQ ID NO: 7886388 - DNA, 22 bp, Homo sapiens
aagatgttgactcctttgatgt

SEQ ID NO: 7886389 - DNA, 18 bp, Homo sapiens
aagattctgcttctctct

SEQ ID NO: 7886390 - DNA, 22 bp, Homo sapiens
aagatgttctattttcactttt

SEQ ID NO: 7886391 - DNA, 22 bp, Homo sapiens
aagatgttgactcctttgatgt

SEQ ID NO: 7886392 - DNA, 22 bp, Homo sapiens
aagattctgtatttctaacaat

SEQ ID NO: 7886393 - DNA, 22 bp, Homo sapiens
aagattctgtatttctaacaat

SEQ ID NO: 7886394 - DNA, 22 bp, Homo sapiens
aagattctgtcagttaggagga

SEQ ID NO: 7886395 - DNA, 22 bp, Homo sapiens
aagattctgtatttctaacaat

SEQ ID NO: 7886396 - DNA, 22 bp, Homo sapiens
aagattctgtcagttaggagga

SEQ ID NO: 7886397 - DNA, 22 bp, Homo sapiens
aagattcttaaatttgtttctc

SEQ ID NO: 7886398 - DNA, 22 bp, Homo sapiens
aagattcttaaatttgtttctc

SEQ ID NO: 7886399 - DNA, 22 bp, Homo sapiens
aagattcttacctatacccagt

SEQ ID NO: 7886400 - DNA, 22 bp, Homo sapiens
aagattcttacctatacccagt

SEQ ID NO: 7886401 - DNA, 22 bp, Homo sapiens
aagattcttattaggtaatttt

SEQ ID NO: 7886402 - DNA, 18 bp, Homo sapiens
aagattctgcttctctct

SEQ ID NO: 7886403 - DNA, 22 bp, Homo sapiens
aagattcttattaggtaatttt

SEQ ID NO: 7886404 - DNA, 22 bp, Homo sapiens
aagattcttattaggtaatttt

SEQ ID NO: 7886405 - DNA, 22 bp, Homo sapiens
aagatttaccactttattcaag

SEQ ID NO: 7886406 - DNA, 22 bp, Homo sapiens
aagatttaccactttattcaag

SEQ ID NO: 7886407 - DNA, 22 bp, Homo sapiens
aagatttaccactttattcaag

SEQ ID NO: 7886408 - DNA, 22 bp, Homo sapiens
aagatttaccactttattcaag

SEQ ID NO: 7886409 - DNA, 22 bp, Homo sapiens
aagatttaccactttattcaag

SEQ ID NO: 7886410 - DNA, 22 bp, Homo sapiens
aagatttactagcataatagct

SEQ ID NO: 7886411 - DNA, 22 bp, Homo sapiens
aagattctttgaggattttact

SEQ ID NO: 7886412 - DNA, 22 bp, Homo sapiens
aagattgacggctttgagtgct

SEQ ID NO: 7886413 - DNA, 22 bp, Homo sapiens
aagattgtcaggcttgctgtat

SEQ ID NO: 7886414 - DNA, 22 bp, Homo sapiens
aagattcttgactagaatgatt

SEQ ID NO: 7886415 - DNA, 22 bp, Homo sapiens
aagattcttgactagaatgatt

SEQ ID NO: 7886416 - DNA, 22 bp, Homo sapiens
aagattcttgactagaatgatt

SEQ ID NO: 7886417 - DNA, 22 bp, Homo sapiens
aagattcttgactagaatgatt

SEQ ID NO: 7886418 - DNA, 22 bp, Homo sapiens
aagattctttgaggattttact

SEQ ID NO: 7886419 - DNA, 22 bp, Homo sapiens
aagattctttgaggattttact

SEQ ID NO: 7886420 - DNA, 22 bp, Homo sapiens
acacagtaggccaccatgtcat

SEQ ID NO: 7886421 - DNA, 22 bp, Homo sapiens
acacagtagtgtggaaaaacat

SEQ ID NO: 7886422 - DNA, 22 bp, Homo sapiens
acacagtaggccaccatgtcat

SEQ ID NO: 7886423 - DNA, 22 bp, Homo sapiens
acacagtaggccaccatgtcat

SEQ ID NO: 7886424 - DNA, 22 bp, Homo sapiens
acacagtaggccaccatgtcat

SEQ ID NO: 7886425 - DNA, 20 bp, Homo sapiens
acacagtagcaattagtgca

SEQ ID NO: 7886426 - DNA, 22 bp, Homo sapiens
acacagtaggatagtttgagga

SEQ ID NO: 7886427 - DNA, 22 bp, Homo sapiens
acacagtaggatagtttgagga

SEQ ID NO: 7886428 - DNA, 20 bp, Homo sapiens
acacagtagcaattagtgca

SEQ ID NO: 7886429 - DNA, 20 bp, Homo sapiens
acacagtagcaattagtgca

SEQ ID NO: 7886430 - DNA, 20 bp, Homo sapiens
acacagtagcaattagtgca

SEQ ID NO: 7886431 - DNA, 22 bp, Homo sapiens
acacagtagtgtggaaaaacat

SEQ ID NO: 7886432 - DNA, 22 bp, Homo sapiens
acacagtagtttgtcattgcta

SEQ ID NO: 7886433 - DNA, 22 bp, Homo sapiens
acacagtagtttgtcattgcta

SEQ ID NO: 7886434 - DNA, 22 bp, Homo sapiens
acacagtagtttgtcattgcta

SEQ ID NO: 7886435 - DNA, 22 bp, Homo sapiens
aagaggccacagctgacagcac

SEQ ID NO: 7886436 - DNA, 22 bp, Homo sapiens
aagaggcatctcagcttcctct

SEQ ID NO: 7886437 - DNA, 22 bp, Homo sapiens
acacagtagtttgtcattgcta

SEQ ID NO: 7886438 - DNA, 22 bp, Homo sapiens
aagaggcatctcagcttcctct

SEQ ID NO: 7886439 - DNA, 22 bp, Homo sapiens
acacagtaaatatgtattgaat

SEQ ID NO: 7886440 - DNA, 22 bp, Homo sapiens
acacaggttccatctccacctt

SEQ ID NO: 7886441 - DNA, 18 bp, Homo sapiens
acacaggttattctctcc

SEQ ID NO: 7886442 - DNA, 22 bp, Homo sapiens
acacagtaaatattgtctcctc

SEQ ID NO: 7886443 - DNA, 22 bp, Homo sapiens
acacagtaaatattgtctcctc

SEQ ID NO: 7886444 - DNA, 22 bp, Homo sapiens
acacagtaaatattgtctcctc

SEQ ID NO: 7886445 - DNA, 22 bp, Homo sapiens
acacagtaaatattgtctcctc

SEQ ID NO: 7886446 - DNA, 22 bp, Homo sapiens
acacaggttccatctccacctt

SEQ ID NO: 7886447 - DNA, 22 bp, Homo sapiens
acacaggttccatctccacctt

SEQ ID NO: 7886448 - DNA, 22 bp, Homo sapiens
acacagtaaatatgtattgaat

SEQ ID NO: 7886449 - DNA, 18 bp, Homo sapiens
acacaggttattctctcc

SEQ ID NO: 7886450 - DNA, 18 bp, Homo sapiens
acacaggttattctctcc

SEQ ID NO: 7886451 - DNA, 22 bp, Homo sapiens
acacaggttccatctccacctt

SEQ ID NO: 7886452 - DNA, 20 bp, Homo sapiens
acacagtagatgagtgactg

SEQ ID NO: 7886453 - DNA, 20 bp, Homo sapiens
acacagtagatgagtgactg

SEQ ID NO: 7886454 - DNA, 17 bp, Homo sapiens
acacagtacttttttgc

SEQ ID NO: 7886455 - DNA, 17 bp, Homo sapiens
acacagtacttttttgc

SEQ ID NO: 7886456 - DNA, 21 bp, Homo sapiens
acacagtaactgggcgcaggg

SEQ ID NO: 7886457 - DNA, 21 bp, Homo sapiens
acacagtaactgggcgcaggg

SEQ ID NO: 7886458 - DNA, 22 bp, Homo sapiens
acacagtaccccaaggctgggc

SEQ ID NO: 7886459 - DNA, 22 bp, Homo sapiens
acacagggggcattctaggagt

SEQ ID NO: 7886460 - DNA, 22 bp, Homo sapiens
acacaggggctcggctgggtgc

SEQ ID NO: 7886461 - DNA, 22 bp, Homo sapiens
acacaggggctcggctgggtgc

SEQ ID NO: 7886462 - DNA, 22 bp, Homo sapiens
acacaggggaaagtggagctga

SEQ ID NO: 7886463 - DNA, 22 bp, Homo sapiens
acacagggtctagagttaggcc

SEQ ID NO: 7886464 - DNA, 22 bp, Homo sapiens
acacagggggcattctaggagt

SEQ ID NO: 7886465 - DNA, 22 bp, Homo sapiens
acacagggggcattctaggagt

SEQ ID NO: 7886466 - DNA, 22 bp, Homo sapiens
acacagggggcattctaggagt

SEQ ID NO: 7886467 - DNA, 22 bp, Homo sapiens
acacagggggcattctaggagt

SEQ ID NO: 7886468 - DNA, 22 bp, Homo sapiens
acacaggtacacatatgtacct

SEQ ID NO: 7886469 - DNA, 22 bp, Homo sapiens
acacaggtaatggttttggaag

SEQ ID NO: 7886470 - DNA, 22 bp, Homo sapiens
acacagggtctagagttaggcc

SEQ ID NO: 7886471 - DNA, 22 bp, Homo sapiens
acacagggtctagagttaggcc

SEQ ID NO: 7886472 - DNA, 22 bp, Homo sapiens
acacagggtctagagttaggcc

SEQ ID NO: 7886473 - DNA, 22 bp, Homo sapiens
acacaggttaaaataattggga

SEQ ID NO: 7886474 - DNA, 22 bp, Homo sapiens
acacaggttaaaataattggga

SEQ ID NO: 7886475 - DNA, 22 bp, Homo sapiens
acacaggtacacatatgtacct

SEQ ID NO: 7886476 - DNA, 22 bp, Homo sapiens
acacaggtacacatatgtacct

SEQ ID NO: 7886477 - DNA, 22 bp, Homo sapiens
acacaggggaaagtggagctga

SEQ ID NO: 7886478 - DNA, 22 bp, Homo sapiens
acacaggggaaagtggagctga

SEQ ID NO: 7886479 - DNA, 22 bp, Homo sapiens
acacagggctgcgcctgacccc

SEQ ID NO: 7886480 - DNA, 22 bp, Homo sapiens
acacaggggaaagtggagctga

SEQ ID NO: 7886481 - DNA, 22 bp, Homo sapiens
acacaggggctcggctgggtgc

SEQ ID NO: 7886482 - DNA, 22 bp, Homo sapiens
acacaggaactcaagctcgctt

SEQ ID NO: 7886483 - DNA, 22 bp, Homo sapiens
acacaggaactcaagctcgctt

SEQ ID NO: 7886484 - DNA, 22 bp, Homo sapiens
acacagggctgcgcctgacccc

SEQ ID NO: 7886485 - DNA, 22 bp, Homo sapiens
acacagctttgtgttgctccac

SEQ ID NO: 7886486 - DNA, 22 bp, Homo sapiens
acacagctttcagtcattatct

SEQ ID NO: 7886487 - DNA, 22 bp, Homo sapiens
acacaggaaatggtttagtttt

SEQ ID NO: 7886488 - DNA, 22 bp, Homo sapiens
acacagctttgtgttgctccac

SEQ ID NO: 7886489 - DNA, 22 bp, Homo sapiens
aagccaagtgctggccatgggc

SEQ ID NO: 7886490 - DNA, 22 bp, Homo sapiens
aagccaagtgctggccatgggc

SEQ ID NO: 7886491 - DNA, 22 bp, Homo sapiens
aagccaagtgctggccatgggc

SEQ ID NO: 7886492 - DNA, 21 bp, Homo sapiens
aagccagcccacagtggtttg

SEQ ID NO: 7886493 - DNA, 22 bp, Homo sapiens
aagccaatgagagaggcctcag

SEQ ID NO: 7886494 - DNA, 22 bp, Homo sapiens
aagccaatcgtgtgaacttagt

SEQ ID NO: 7886495 - DNA, 22 bp, Homo sapiens
aagccaatcgtgtgaacttagt

SEQ ID NO: 7886496 - DNA, 22 bp, Homo sapiens
aagccaggaagagagccttcac

SEQ ID NO: 7886497 - DNA, 22 bp, Homo sapiens
aagccaggaagggagctgtccc

SEQ ID NO: 7886498 - DNA, 22 bp, Homo sapiens
aagccaggaagagagccttcac

SEQ ID NO: 7886499 - DNA, 22 bp, Homo sapiens
aagccaggaagagagccttcac

SEQ ID NO: 7886500 - DNA, 22 bp, Homo sapiens
aagccagctccagcatatcact

SEQ ID NO: 7886501 - DNA, 22 bp, Homo sapiens
aagccagctccagcatatcact

SEQ ID NO: 7886502 - DNA, 19 bp, Homo sapiens
aagccagctgccagctcgg

SEQ ID NO: 7886503 - DNA, 22 bp, Homo sapiens
aagccagcctgtttccttcttc

SEQ ID NO: 7886504 - DNA, 22 bp, Homo sapiens
aagccagctccagcatatcact

SEQ ID NO: 7886505 - DNA, 22 bp, Homo sapiens
aagccagcctgtttccttcttc

SEQ ID NO: 7886506 - DNA, 22 bp, Homo sapiens
aagccagcctgtttccttcttc

SEQ ID NO: 7886507 - DNA, 22 bp, Homo sapiens
aagccaggagcgaggcctcggc

SEQ ID NO: 7886508 - DNA, 22 bp, Homo sapiens
aagccaggagcgaggcctcggc

SEQ ID NO: 7886509 - DNA, 22 bp, Homo sapiens
aagccaggagcgaggcctcggc

SEQ ID NO: 7886510 - DNA, 22 bp, Homo sapiens
aagccaggagcgaggcctcggc

SEQ ID NO: 7886511 - DNA, 22 bp, Homo sapiens
aagccaggcatgcttggacagt

SEQ ID NO: 7886512 - DNA, 22 bp, Homo sapiens
aagccaggataaagttgtttta

SEQ ID NO: 7886513 - DNA, 22 bp, Homo sapiens
aagccaggcatgcttggacagt

SEQ ID NO: 7886514 - DNA, 22 bp, Homo sapiens
aagccaggataaagttgtttta

SEQ ID NO: 7886515 - DNA, 22 bp, Homo sapiens
aagccaggataaagttgtttta

SEQ ID NO: 7886516 - DNA, 22 bp, Homo sapiens
aagccaggaatggagtcttcgc

SEQ ID NO: 7886517 - DNA, 22 bp, Homo sapiens
aagccaggaatggagtcttcgc

SEQ ID NO: 7886518 - DNA, 22 bp, Homo sapiens
aagccaggaatggagtcttcgc

SEQ ID NO: 7886519 - DNA, 22 bp, Homo sapiens
aagccaggaagggagctgtccc

SEQ ID NO: 7886520 - DNA, 22 bp, Homo sapiens
aagccaggaagggagctgtccc

SEQ ID NO: 7886521 - DNA, 22 bp, Homo sapiens
aagccaggaccaaactcatcct

SEQ ID NO: 7886522 - DNA, 22 bp, Homo sapiens
aagccaggagcgaggcctcggc

SEQ ID NO: 7886523 - DNA, 22 bp, Homo sapiens
aagccaggaccaaactcatcct

SEQ ID NO: 7886524 - DNA, 22 bp, Homo sapiens
aagccaggaccaaactcatcct

SEQ ID NO: 7886525 - DNA, 22 bp, Homo sapiens
acagcagctgccttcaggctct

SEQ ID NO: 7886526 - DNA, 22 bp, Homo sapiens
acagcagctgccttcaggctct

SEQ ID NO: 7886527 - DNA, 22 bp, Homo sapiens
acagcagctgccttcaggctct

SEQ ID NO: 7886528 - DNA, 22 bp, Homo sapiens
acagcagctaacccctgggcca

SEQ ID NO: 7886529 - DNA, 22 bp, Homo sapiens
acagcagctaacccctgggcca

SEQ ID NO: 7886530 - DNA, 22 bp, Homo sapiens
acagcagctgccttcaggctct

SEQ ID NO: 7886531 - DNA, 22 bp, Homo sapiens
acagcagctaacccctgggcca

SEQ ID NO: 7886532 - DNA, 22 bp, Homo sapiens
acagcagctaacccctgggcca

SEQ ID NO: 7886533 - DNA, 22 bp, Homo sapiens
acagcagctaacccctgggcca

SEQ ID NO: 7886534 - DNA, 22 bp, Homo sapiens
acagcagctgggttcccaccat

SEQ ID NO: 7886535 - DNA, 22 bp, Homo sapiens
acagcagctgggttcccaccat

SEQ ID NO: 7886536 - DNA, 22 bp, Homo sapiens
acagcagctgggttcccaccat

SEQ ID NO: 7886537 - DNA, 22 bp, Homo sapiens
acagcagctgccttcaggctct

SEQ ID NO: 7886538 - DNA, 22 bp, Homo sapiens
acagcagctgccttcaggctct

SEQ ID NO: 7886539 - DNA, 22 bp, Homo sapiens
acagcagctgccttcaggctct

SEQ ID NO: 7886540 - DNA, 22 bp, Homo sapiens
acagcagctgggttcccaccat

SEQ ID NO: 7886541 - DNA, 22 bp, Homo sapiens
acagcagcttgtctgttcttta

SEQ ID NO: 7886542 - DNA, 22 bp, Homo sapiens
acagcagcttgcgtgtctggtc

SEQ ID NO: 7886543 - DNA, 22 bp, Homo sapiens
acagcagcttgcgtgtctggtc

SEQ ID NO: 7886544 - DNA, 22 bp, Homo sapiens
acagcagcttgtctgttcttta

SEQ ID NO: 7886545 - DNA, 22 bp, Homo sapiens
acagcagcttgtctgttcttta

SEQ ID NO: 7886546 - DNA, 22 bp, Homo sapiens
acagcagcttgtctgttcttta

SEQ ID NO: 7886547 - DNA, 22 bp, Homo sapiens
acagcaggaagctggagggaaa

SEQ ID NO: 7886548 - DNA, 22 bp, Homo sapiens
acagcagcttgtctgttcttta

SEQ ID NO: 7886549 - DNA, 22 bp, Homo sapiens
acagcagcttgcgtgtctggtc

SEQ ID NO: 7886550 - DNA, 22 bp, Homo sapiens
acagcagcttgcgtgtctggtc

SEQ ID NO: 7886551 - DNA, 22 bp, Homo sapiens
acagcagcttgcgtgtctggtc

SEQ ID NO: 7886552 - DNA, 22 bp, Homo sapiens
acagcagcttgcgtgtctggtc

SEQ ID NO: 7886553 - DNA, 22 bp, Homo sapiens
acagcagcttcctgactgtact

SEQ ID NO: 7886554 - DNA, 22 bp, Homo sapiens
acagcagcttcctgactgtact

SEQ ID NO: 7886555 - DNA, 22 bp, Homo sapiens
acagcagcttcctgactgtact

SEQ ID NO: 7886556 - DNA, 22 bp, Homo sapiens
acagcagcttcctgactgtact

SEQ ID NO: 7886557 - DNA, 22 bp, Homo sapiens
acagcagctaacccctgggcca

SEQ ID NO: 7886558 - DNA, 22 bp, Homo sapiens
acagcagctaacccctgggcca

SEQ ID NO: 7886559 - DNA, 22 bp, Homo sapiens
acagcagctaaaggtgtctcct

SEQ ID NO: 7886560 - DNA, 22 bp, Homo sapiens
acagcagctaaaggtgtctcct

SEQ ID NO: 7886561 - DNA, 22 bp, Homo sapiens
acagcagctaaaggtgtctcct

SEQ ID NO: 7886562 - DNA, 22 bp, Homo sapiens
acagcagctaacccctgggcca

SEQ ID NO: 7886563 - DNA, 22 bp, Homo sapiens
acagcagctaaaggtgtctcct

SEQ ID NO: 7886564 - DNA, 22 bp, Homo sapiens
aagcatttgtgaaattcagatg

SEQ ID NO: 7886565 - DNA, 22 bp, Homo sapiens
aagcatttggcatgaaactctt

SEQ ID NO: 7886566 - DNA, 22 bp, Homo sapiens
aagcatttggttctgaagactc

SEQ ID NO: 7886567 - DNA, 22 bp, Homo sapiens
aagcatttggttctgaagactc

SEQ ID NO: 7886568 - DNA, 22 bp, Homo sapiens
aagcatttgtgaaattcagatg

SEQ ID NO: 7886569 - DNA, 22 bp, Homo sapiens
aagcatttggttctgaagactc

SEQ ID NO: 7886570 - DNA, 22 bp, Homo sapiens
aagcatttcaggtagagatatt

SEQ ID NO: 7886571 - DNA, 22 bp, Homo sapiens
aagcatttcaatataatattca

SEQ ID NO: 7886572 - DNA, 22 bp, Homo sapiens
aagcatttctgtttatctatcg

SEQ ID NO: 7886573 - DNA, 22 bp, Homo sapiens
aagcatttctgtttatctatcg

SEQ ID NO: 7886574 - DNA, 22 bp, Homo sapiens
aagcatttctgtttatctatcg

SEQ ID NO: 7886575 - DNA, 22 bp, Homo sapiens
aagcatttatagataagaattt

SEQ ID NO: 7886576 - DNA, 17 bp, Homo sapiens
aagcatttaatttgcta

SEQ ID NO: 7886577 - DNA, 17 bp, Homo sapiens
aagcatttaatttgcta

SEQ ID NO: 7886578 - DNA, 22 bp, Homo sapiens
aagcatttcaatataatattca

SEQ ID NO: 7886579 - DNA, 22 bp, Homo sapiens
aagcatttcaatataatattca

SEQ ID NO: 7886580 - DNA, 22 bp, Homo sapiens
aagcatttcaatataatattca

SEQ ID NO: 7886581 - DNA, 22 bp, Homo sapiens
aagcatttatagataagaattt

SEQ ID NO: 7886582 - DNA, 22 bp, Homo sapiens
aagcatttatagataagaattt

SEQ ID NO: 7886583 - DNA, 22 bp, Homo sapiens
aagcatgtactcaagcaaatgt

SEQ ID NO: 7886584 - DNA, 22 bp, Homo sapiens
aagcatcaacactatattgatg

SEQ ID NO: 7886585 - DNA, 22 bp, Homo sapiens
aagcatcaacactatattgatg

SEQ ID NO: 7886586 - DNA, 22 bp, Homo sapiens
aagcatcaacactatattgatg

SEQ ID NO: 7886587 - DNA, 22 bp, Homo sapiens
aagcatatattttatatgttgt

SEQ ID NO: 7886588 - DNA, 22 bp, Homo sapiens
aagcatattttaattagccaca

SEQ ID NO: 7886589 - DNA, 22 bp, Homo sapiens
aagcatagagacacaaatttgg

SEQ ID NO: 7886590 - DNA, 22 bp, Homo sapiens
aagcattgtaagcagaagatgc

SEQ ID NO: 7886591 - DNA, 19 bp, Homo sapiens
aagcattagccaaagcatt

SEQ ID NO: 7886592 - DNA, 22 bp, Homo sapiens
aagcatgtactcaagcaaatgt

SEQ ID NO: 7886593 - DNA, 22 bp, Homo sapiens
aagcatgtgctggggctttttg

SEQ ID NO: 7886594 - DNA, 22 bp, Homo sapiens
aagcatgtgctggggctttttg

SEQ ID NO: 7886595 - DNA, 22 bp, Homo sapiens
aagcatgtgtataagctgggca

SEQ ID NO: 7886596 - DNA, 19 bp, Homo sapiens
aagcattagccaaagcatt

SEQ ID NO: 7886597 - DNA, 22 bp, Homo sapiens
aagcatagagacacaaatttgg

SEQ ID NO: 7886598 - DNA, 22 bp, Homo sapiens
acagagtattggaaaggcagtg

SEQ ID NO: 7886599 - DNA, 21 bp, Homo sapiens
acagagtagttgaaacagaga

SEQ ID NO: 7886600 - DNA, 22 bp, Homo sapiens
acagagtaggtgctcagtaaat

SEQ ID NO: 7886601 - DNA, 22 bp, Homo sapiens
acagagtaggtgctcagtaaat

SEQ ID NO: 7886602 - DNA, 22 bp, Homo sapiens
acagagtagctcaagaagattg

SEQ ID NO: 7886603 - DNA, 22 bp, Homo sapiens
acagagtaggtgctcagtaaat

SEQ ID NO: 7886604 - DNA, 21 bp, Homo sapiens
acagagtagttgaaacagaga

SEQ ID NO: 7886605 - DNA, 22 bp, Homo sapiens
acagaggtttccattgaggttt

SEQ ID NO: 7886606 - DNA, 22 bp, Homo sapiens
acagaggtttccattgaggttt

SEQ ID NO: 7886607 - DNA, 22 bp, Homo sapiens
acagaggtttccattgaggttt

SEQ ID NO: 7886608 - DNA, 23 bp, Homo sapiens
acagagtacagtgtgcttagtgg

SEQ ID NO: 7886609 - DNA, 23 bp, Homo sapiens
acagagtacagtgtgcttagtgg

SEQ ID NO: 7886610 - DNA, 22 bp, Homo sapiens
acagagtagctcaagaagattg

SEQ ID NO: 7886611 - DNA, 20 bp, Homo sapiens
acagagtagaacatatgcca

SEQ ID NO: 7886612 - DNA, 22 bp, Homo sapiens
aagcagctgatttcacagctca

SEQ ID NO: 7886613 - DNA, 22 bp, Homo sapiens
aagcagctgatttcacagctca

SEQ ID NO: 7886614 - DNA, 22 bp, Homo sapiens
aagcagctgaaggattcagggt

SEQ ID NO: 7886615 - DNA, 22 bp, Homo sapiens
aagcagctgatttcacagctca

SEQ ID NO: 7886616 - DNA, 22 bp, Homo sapiens
aagcagctgatttcacagctca

SEQ ID NO: 7886617 - DNA, 22 bp, Homo sapiens
aagcagccagccatcatgcccg

SEQ ID NO: 7886618 - DNA, 22 bp, Homo sapiens
aagcagcattgtaaccaatgcc

SEQ ID NO: 7886619 - DNA, 22 bp, Homo sapiens
aagcagcattgtggtaggggag

SEQ ID NO: 7886620 - DNA, 22 bp, Homo sapiens
aagcagcattgtggtaggggag

SEQ ID NO: 7886621 - DNA, 22 bp, Homo sapiens
aagcagccacctcatctccact

SEQ ID NO: 7886622 - DNA, 22 bp, Homo sapiens
aagcagcctggacttgggctgg

SEQ ID NO: 7886623 - DNA, 22 bp, Homo sapiens
aagcagcctggacttgggctgg

SEQ ID NO: 7886624 - DNA, 22 bp, Homo sapiens
aagcagccagccatcatgcccg

SEQ ID NO: 7886625 - DNA, 22 bp, Homo sapiens
aagcagcctggcatgatgcttt

SEQ ID NO: 7886626 - DNA, 22 bp, Homo sapiens
aagcagcctggcatgatgcttt

SEQ ID NO: 7886627 - DNA, 22 bp, Homo sapiens
aagcagctgaaggattcagggt

SEQ ID NO: 7886628 - DNA, 22 bp, Homo sapiens
acagaatttaaagctctagact

SEQ ID NO: 7886629 - DNA, 22 bp, Homo sapiens
acagaatttaaagctctagact

SEQ ID NO: 7886630 - DNA, 22 bp, Homo sapiens
acagaatttaaagctctagact

SEQ ID NO: 7886631 - DNA, 22 bp, Homo sapiens
acagaatttacacatctctaaa

SEQ ID NO: 7886632 - DNA, 22 bp, Homo sapiens
acagaatttacacatctctaaa

SEQ ID NO: 7886633 - DNA, 22 bp, Homo sapiens
acagaatttacacatctctaaa

SEQ ID NO: 7886634 - DNA, 22 bp, Homo sapiens
acagaattgatggaaatctcag

SEQ ID NO: 7886635 - DNA, 22 bp, Homo sapiens
acagaattggggttcttgggga

SEQ ID NO: 7886636 - DNA, 22 bp, Homo sapiens
acagaattggggttcttgggga

SEQ ID NO: 7886637 - DNA, 18 bp, Homo sapiens
acagacaaaatggaaatg

SEQ ID NO: 7886638 - DNA, 18 bp, Homo sapiens
acagacaaaatggaaatg

SEQ ID NO: 7886639 - DNA, 18 bp, Homo sapiens
acagacaaaatggaaatg

SEQ ID NO: 7886640 - DNA, 22 bp, Homo sapiens
acagaatttacacatctctaaa

SEQ ID NO: 7886641 - DNA, 22 bp, Homo sapiens
acagaatttgcttgggcaatgg

SEQ ID NO: 7886642 - DNA, 22 bp, Homo sapiens
acagaatttttacacagggtaa

SEQ ID NO: 7886643 - DNA, 22 bp, Homo sapiens
acagaatttttacacagggtaa

SEQ ID NO: 7886644 - DNA, 22 bp, Homo sapiens
acagaattctctctgcagaggc

SEQ ID NO: 7886645 - DNA, 22 bp, Homo sapiens
acagaattgaaagtataatctg

SEQ ID NO: 7886646 - DNA, 22 bp, Homo sapiens
acagaattgaaagtataatctg

SEQ ID NO: 7886647 - DNA, 22 bp, Homo sapiens
acagaattatcaggaaatgtta

SEQ ID NO: 7886648 - DNA, 22 bp, Homo sapiens
acagaattatcaggaaatgtta

SEQ ID NO: 7886649 - DNA, 22 bp, Homo sapiens
acagaattatcaggaaatgtta

SEQ ID NO: 7886650 - DNA, 22 bp, Homo sapiens
acagaattctagtatgtggctt

SEQ ID NO: 7886651 - DNA, 22 bp, Homo sapiens
acagaattgaagctgagtaaat

SEQ ID NO: 7886652 - DNA, 22 bp, Homo sapiens
acagaattgaagctgagtaaat

SEQ ID NO: 7886653 - DNA, 22 bp, Homo sapiens
acagaattgatggaaatctcag

SEQ ID NO: 7886654 - DNA, 22 bp, Homo sapiens
acagaattgatggaaatctcag

SEQ ID NO: 7886655 - DNA, 22 bp, Homo sapiens
acagaattgatggaaatctcag

SEQ ID NO: 7886656 - DNA, 22 bp, Homo sapiens
acagaattgaaagtataatctg

SEQ ID NO: 7886657 - DNA, 22 bp, Homo sapiens
acagaattgaaagtataatctg

SEQ ID NO: 7886658 - DNA, 22 bp, Homo sapiens
acagaattgaagctgagtaaat

SEQ ID NO: 7886659 - DNA, 22 bp, Homo sapiens
acagaattgaagctgagtaaat

SEQ ID NO: 7886660 - DNA, 22 bp, Homo sapiens
aagcagcattcagtgaaatgtg

SEQ ID NO: 7886661 - DNA, 22 bp, Homo sapiens
aagcagcatgtgggttatcggg

SEQ ID NO: 7886662 - DNA, 22 bp, Homo sapiens
aagcagcattcagtgaaatgtg

SEQ ID NO: 7886663 - DNA, 22 bp, Homo sapiens
aagcagcattcagtgaaatgtg

SEQ ID NO: 7886664 - DNA, 22 bp, Homo sapiens
aagcagcattcagtgaaatgtg

SEQ ID NO: 7886665 - DNA, 22 bp, Homo sapiens
aagcagcattcagtgaaatgtg

SEQ ID NO: 7886666 - DNA, 22 bp, Homo sapiens
aagcagcattgtaaccaatgcc

SEQ ID NO: 7886667 - DNA, 22 bp, Homo sapiens
aagcagcatgctatgctggtgg

SEQ ID NO: 7886668 - DNA, 22 bp, Homo sapiens
aagcagcatgctatgctggtgg

SEQ ID NO: 7886669 - DNA, 22 bp, Homo sapiens
aagcagcatgtgggttatcggg

SEQ ID NO: 7886670 - DNA, 22 bp, Homo sapiens
aagcagagtccccttcccatgg

SEQ ID NO: 7886671 - DNA, 22 bp, Homo sapiens
aagcagcatcctgggcagacct

SEQ ID NO: 7886672 - DNA, 22 bp, Homo sapiens
aagcagagtgatataaacatgg

SEQ ID NO: 7886673 - DNA, 22 bp, Homo sapiens
aagcagcatgattgtaatacta

SEQ ID NO: 7886674 - DNA, 22 bp, Homo sapiens
aagcagcatgattgtaatacta

SEQ ID NO: 7886675 - DNA, 22 bp, Homo sapiens
aagcagcatcctgggcagacct

SEQ ID NO: 7886676 - DNA, 22 bp, Homo sapiens
aagcagcatcctgggcagacct

SEQ ID NO: 7886677 - DNA, 22 bp, Homo sapiens
aagcagcatcctgggcagacct

SEQ ID NO: 7886678 - DNA, 22 bp, Homo sapiens
aagcagcatcctgggcagacct

SEQ ID NO: 7886679 - DNA, 22 bp, Homo sapiens
aagcagaggtagggtgtgcagt

SEQ ID NO: 7886680 - DNA, 23 bp, Homo sapiens
acagacaacactgatgagagaaa

SEQ ID NO: 7886681 - DNA, 22 bp, Homo sapiens
aagagctgattaagtcatgagg

SEQ ID NO: 7886682 - DNA, 22 bp, Homo sapiens
aagagctgattaagtcatgagg

SEQ ID NO: 7886683 - DNA, 20 bp, Homo sapiens
aagagctgactcacagtggt

SEQ ID NO: 7886684 - DNA, 20 bp, Homo sapiens
aagagctgactcacagtggt

SEQ ID NO: 7886685 - DNA, 20 bp, Homo sapiens
aagagctgactcacagtggt

SEQ ID NO: 7886686 - DNA, 20 bp, Homo sapiens
aagagctgactcacagtggt

SEQ ID NO: 7886687 - DNA, 22 bp, Homo sapiens
aagagctgcatctaagccatga

SEQ ID NO: 7886688 - DNA, 22 bp, Homo sapiens
aagagctgcccaaggtgaacag

SEQ ID NO: 7886689 - DNA, 22 bp, Homo sapiens
aagagctgcatctaagccatga

SEQ ID NO: 7886690 - DNA, 22 bp, Homo sapiens
aagagctgcccaaggtgaacag

SEQ ID NO: 7886691 - DNA, 22 bp, Homo sapiens
aagagctgcatctaagccatga

SEQ ID NO: 7886692 - DNA, 22 bp, Homo sapiens
aagagctgcacatatttatatc

SEQ ID NO: 7886693 - DNA, 22 bp, Homo sapiens
aagagctgcacatatttatatc

SEQ ID NO: 7886694 - DNA, 22 bp, Homo sapiens
acaaggctgttggtcacaaacc

SEQ ID NO: 7886695 - DNA, 22 bp, Homo sapiens
aagagcagtgttttactcagct

SEQ ID NO: 7886696 - DNA, 22 bp, Homo sapiens
aagagcagtgttttactcagct

SEQ ID NO: 7886697 - DNA, 22 bp, Homo sapiens
aagagctcttcataaaggcata

SEQ ID NO: 7886698 - DNA, 20 bp, Homo sapiens
aagagctgactcacagtggt

SEQ ID NO: 7886699 - DNA, 20 bp, Homo sapiens
aagagctgactcacagtggt

SEQ ID NO: 7886700 - DNA, 22 bp, Homo sapiens
aagagctatgttaaggaagaga

SEQ ID NO: 7886701 - DNA, 22 bp, Homo sapiens
aagagcagtgttttactcagct

SEQ ID NO: 7886702 - DNA, 23 bp, Homo sapiens
aagagctatacattcacctggta

SEQ ID NO: 7886703 - DNA, 22 bp, Homo sapiens
acaaggctatgaagtattagtt

SEQ ID NO: 7886704 - DNA, 22 bp, Homo sapiens
acaaggctctaatttcattgaa

SEQ ID NO: 7886705 - DNA, 22 bp, Homo sapiens
acaaggctctaatttcattgaa

SEQ ID NO: 7886706 - DNA, 22 bp, Homo sapiens
acaaggctctaatttcattgaa

SEQ ID NO: 7886707 - DNA, 22 bp, Homo sapiens
acaaggctgaacagtgaagccg

SEQ ID NO: 7886708 - DNA, 23 bp, Homo sapiens
acaaggctctgttctgcagtttc

SEQ ID NO: 7886709 - DNA, 22 bp, Homo sapiens
acaaggctgtggggagaactga

SEQ ID NO: 7886710 - DNA, 22 bp, Homo sapiens
acaaggctgtggggagaactga

SEQ ID NO: 7886711 - DNA, 22 bp, Homo sapiens
acaaggctgtgggagaacctct

SEQ ID NO: 7886712 - DNA, 22 bp, Homo sapiens
acaaggctgtgggagaacctct

SEQ ID NO: 7886713 - DNA, 19 bp, Homo sapiens
acaaggctgggagagcgcc

SEQ ID NO: 7886714 - DNA, 22 bp, Homo sapiens
acaaggctgctgtgattgggaa

SEQ ID NO: 7886715 - DNA, 22 bp, Homo sapiens
acaaggctgctgtgattgggaa

SEQ ID NO: 7886716 - DNA, 22 bp, Homo sapiens
acaaggcattccggaagtaacc

SEQ ID NO: 7886717 - DNA, 22 bp, Homo sapiens
acaaggcattccggaagtaacc

SEQ ID NO: 7886718 - DNA, 22 bp, Homo sapiens
acaaggcattccggaagtaacc

SEQ ID NO: 7886719 - DNA, 22 bp, Homo sapiens
acaaggccaagcattctagcaa

SEQ ID NO: 7886720 - DNA, 22 bp, Homo sapiens
acaaggcagtacaatgatgaca

SEQ ID NO: 7886721 - DNA, 22 bp, Homo sapiens
acaaggcagtacaatgatgaca

SEQ ID NO: 7886722 - DNA, 22 bp, Homo sapiens
acaaggcagtacaatgatgaca

SEQ ID NO: 7886723 - DNA, 22 bp, Homo sapiens
acaaggattaaggtatgcaaca

SEQ ID NO: 7886724 - DNA, 22 bp, Homo sapiens
acaaggatttgttcctaatgtt

SEQ ID NO: 7886725 - DNA, 22 bp, Homo sapiens
acaaggcaatggcaggatttca

SEQ ID NO: 7886726 - DNA, 23 bp, Homo sapiens
acaaggcaacatagatcagggca

SEQ ID NO: 7886727 - DNA, 22 bp, Homo sapiens
acaaggcaattcctggtgaatt

SEQ ID NO: 7886728 - DNA, 22 bp, Homo sapiens
acaaggcactttatgaagagga

SEQ ID NO: 7886729 - DNA, 22 bp, Homo sapiens
acaaggcactttatgaagagga

SEQ ID NO: 7886730 - DNA, 22 bp, Homo sapiens
acaaggcactttatgaagagga

SEQ ID NO: 7886731 - DNA, 18 bp, Homo sapiens
aagagcttcgcatataca

SEQ ID NO: 7886732 - DNA, 22 bp, Homo sapiens
aagagcttccctgttgtagagg

SEQ ID NO: 7886733 - DNA, 22 bp, Homo sapiens
aagagctgtgggtggtagtcct

SEQ ID NO: 7886734 - DNA, 22 bp, Homo sapiens
aagagctgttgtctgcttactg

SEQ ID NO: 7886735 - DNA, 22 bp, Homo sapiens
aagagctgttgtctgcttactg

SEQ ID NO: 7886736 - DNA, 22 bp, Homo sapiens
aagaggaactgggggctgagtc

SEQ ID NO: 7886737 - DNA, 22 bp, Homo sapiens
aagaggaactgggggctgagtc

SEQ ID NO: 7886738 - DNA, 22 bp, Homo sapiens
aagaggaactgggggctgagtc

SEQ ID NO: 7886739 - DNA, 22 bp, Homo sapiens
aagaggaactgggggctgagtc

SEQ ID NO: 7886740 - DNA, 22 bp, Homo sapiens
aagaggaactgggggctgagtc

SEQ ID NO: 7886741 - DNA, 22 bp, Homo sapiens
aagaggaactgggggctgagtc

SEQ ID NO: 7886742 - DNA, 22 bp, Homo sapiens
aagaggaaatgattgactatat

SEQ ID NO: 7886743 - DNA, 22 bp, Homo sapiens
aagaggaaatgattgactatat

SEQ ID NO: 7886744 - DNA, 22 bp, Homo sapiens
aagagctggctcttgcagcagc

SEQ ID NO: 7886745 - DNA, 22 bp, Homo sapiens
aagagctggtcacaggtccatt

SEQ ID NO: 7886746 - DNA, 22 bp, Homo sapiens
aagagctggctcttgcagcagc

SEQ ID NO: 7886747 - DNA, 22 bp, Homo sapiens
aagagctggcccaatctgagca

SEQ ID NO: 7886748 - DNA, 22 bp, Homo sapiens
aagagctggcccaatctgagca

SEQ ID NO: 7886749 - DNA, 22 bp, Homo sapiens
aagagctggctcttgcagcagc

SEQ ID NO: 7886750 - DNA, 21 bp, Homo sapiens
aagagctgtcaggaaggctgc

SEQ ID NO: 7886751 - DNA, 21 bp, Homo sapiens
aagagctgtcaggaaggctgc

SEQ ID NO: 7886752 - DNA, 22 bp, Homo sapiens
aagagctgtatgccatatgatt

SEQ ID NO: 7886753 - DNA, 22 bp, Homo sapiens
aagagctgtatgccatatgatt

SEQ ID NO: 7886754 - DNA, 22 bp, Homo sapiens
aagagctgtgggtggtagtcct

SEQ ID NO: 7886755 - DNA, 21 bp, Homo sapiens
aagagctgtcaggaaggctgc

SEQ ID NO: 7886756 - DNA, 22 bp, Homo sapiens
aagagctgtatgccatatgatt

SEQ ID NO: 7886757 - DNA, 22 bp, Homo sapiens
aagagctggtcacaggtccatt

SEQ ID NO: 7886758 - DNA, 22 bp, Homo sapiens
aagagctggagctgctacagga

SEQ ID NO: 7886759 - DNA, 22 bp, Homo sapiens
aagagctggagctgctacagga

SEQ ID NO: 7886760 - DNA, 22 bp, Homo sapiens
aagagctggaagtgaagataac

SEQ ID NO: 7886761 - DNA, 22 bp, Homo sapiens
aagagctggaagtgaagataac

SEQ ID NO: 7886762 - DNA, 22 bp, Homo sapiens
aagagctggagctgctacagga

SEQ ID NO: 7886763 - DNA, 22 bp, Homo sapiens
aagagctggagctgctacagga

SEQ ID NO: 7886764 - DNA, 22 bp, Homo sapiens
aagagctggagtttgcagccct

SEQ ID NO: 7886765 - DNA, 22 bp, Homo sapiens
aagagctggagtttgcagccct

SEQ ID NO: 7886766 - DNA, 22 bp, Homo sapiens
aagagctggagtttgcagccct

SEQ ID NO: 7886767 - DNA, 22 bp, Homo sapiens
aagagctggagtttgcagccct

SEQ ID NO: 7886768 - DNA, 22 bp, Homo sapiens
aagagctggagtttgcagccct

SEQ ID NO: 7886769 - DNA, 21 bp, Homo sapiens
aagagctggatcaaggataag

SEQ ID NO: 7886770 - DNA, 21 bp, Homo sapiens
aagagctggatcaaggataag

SEQ ID NO: 7886771 - DNA, 22 bp, Homo sapiens
aagagctggattgtgctgcaga

SEQ ID NO: 7886772 - DNA, 22 bp, Homo sapiens
aagagctggattgtgctgcaga

SEQ ID NO: 7886773 - DNA, 22 bp, Homo sapiens
aagagctggcccaatctgagca

SEQ ID NO: 7886774 - DNA, 22 bp, Homo sapiens
aagagctggcccaatctgagca

SEQ ID NO: 7886775 - DNA, 21 bp, Homo sapiens
aagagctggatcaaggataag

SEQ ID NO: 7886776 - DNA, 22 bp, Homo sapiens
aagagctggatggaatctggga

SEQ ID NO: 7886777 - DNA, 22 bp, Homo sapiens
aagagctggatggaatctggga

SEQ ID NO: 7886778 - DNA, 22 bp, Homo sapiens
aagagctggatgaagaaatcaa

SEQ ID NO: 7886779 - DNA, 21 bp, Homo sapiens
aagagctggatcaaggataag

SEQ ID NO: 7886780 - DNA, 22 bp, Homo sapiens
aagacatgttttaagaatattt

SEQ ID NO: 7886781 - DNA, 22 bp, Homo sapiens
aagacatgttttaagaatattt

SEQ ID NO: 7886782 - DNA, 22 bp, Homo sapiens
aagacatgcaattagcaaggaa

SEQ ID NO: 7886783 - DNA, 22 bp, Homo sapiens
aagacatgactgcacagccaaa

SEQ ID NO: 7886784 - DNA, 22 bp, Homo sapiens
aagacatgcaattagcaaggaa

SEQ ID NO: 7886785 - DNA, 22 bp, Homo sapiens
aagacatacagacagtgagcca

SEQ ID NO: 7886786 - DNA, 22 bp, Homo sapiens
aagacatacagacagtgagcca

SEQ ID NO: 7886787 - DNA, 22 bp, Homo sapiens
aagacataaaacagtcagcgaa

SEQ ID NO: 7886788 - DNA, 22 bp, Homo sapiens
aagacagtgtgtcaggcaggtg

SEQ ID NO: 7886789 - DNA, 22 bp, Homo sapiens
aagacagtgtgtcaggcaggtg

SEQ ID NO: 7886790 - DNA, 22 bp, Homo sapiens
aagacatcagtgatgacatttg

SEQ ID NO: 7886791 - DNA, 22 bp, Homo sapiens
aagacatcagtgatgacatttg

SEQ ID NO: 7886792 - DNA, 22 bp, Homo sapiens
aagacatcagtgatgacatttg

SEQ ID NO: 7886793 - DNA, 22 bp, Homo sapiens
aagacatatagttctccccaag

SEQ ID NO: 7886794 - DNA, 20 bp, Homo sapiens
acaaagactggaaaagcaag

SEQ ID NO: 7886795 - DNA, 20 bp, Homo sapiens
acaaagactggaaaagcaag

SEQ ID NO: 7886796 - DNA, 22 bp, Homo sapiens
aagacattactggaatctgact

SEQ ID NO: 7886797 - DNA, 22 bp, Homo sapiens
aagacattactggaatctgact

SEQ ID NO: 7886798 - DNA, 22 bp, Homo sapiens
acaaagagaccatgagccaaac

SEQ ID NO: 7886799 - DNA, 22 bp, Homo sapiens
acaaagagaccatgagccaaac

SEQ ID NO: 7886800 - DNA, 22 bp, Homo sapiens
acaaagagggaccagtgacttg

SEQ ID NO: 7886801 - DNA, 22 bp, Homo sapiens
acaaagagggaccagtgacttg

SEQ ID NO: 7886802 - DNA, 22 bp, Homo sapiens
acaaagagggaccagtgacttg

SEQ ID NO: 7886803 - DNA, 22 bp, Homo sapiens
acaaagataagtcagaaagtca

SEQ ID NO: 7886804 - DNA, 22 bp, Homo sapiens
acaaagatgtttaaagcattta

SEQ ID NO: 7886805 - DNA, 22 bp, Homo sapiens
acaaagatgtttaaagcattta

SEQ ID NO: 7886806 - DNA, 22 bp, Homo sapiens
acaaagatgtttaaagcattta

SEQ ID NO: 7886807 - DNA, 22 bp, Homo sapiens
acaaagatgtttaaagcattta

SEQ ID NO: 7886808 - DNA, 22 bp, Homo sapiens
acaaagatgtttaaagcattta

SEQ ID NO: 7886809 - DNA, 22 bp, Homo sapiens
acaaagataagtcagaaagtca

SEQ ID NO: 7886810 - DNA, 22 bp, Homo sapiens
acaaagataagtcagaaagtca

SEQ ID NO: 7886811 - DNA, 22 bp, Homo sapiens
acaaagataagtcagaaagtca

SEQ ID NO: 7886812 - DNA, 22 bp, Homo sapiens
acaaagataagtcagaaagtca

SEQ ID NO: 7886813 - DNA, 22 bp, Homo sapiens
acaaagataagtcagaaagtca

SEQ ID NO: 7886814 - DNA, 22 bp, Homo sapiens
acaaagataagtcagaaagtca

SEQ ID NO: 7886815 - DNA, 22 bp, Homo sapiens
acaaagataagtcagaaagtca

SEQ ID NO: 7886816 - DNA, 22 bp, Homo sapiens
acaaagataagtcagaaagtca

SEQ ID NO: 7886817 - DNA, 22 bp, Homo sapiens
acaaagattcatttgcattatt

SEQ ID NO: 7886818 - DNA, 22 bp, Homo sapiens
acaaagattcatttgcattatt

SEQ ID NO: 7886819 - DNA, 22 bp, Homo sapiens
acaaagattcatttgcattatt

SEQ ID NO: 7886820 - DNA, 22 bp, Homo sapiens
acaaagattcatttgcattatt

SEQ ID NO: 7886821 - DNA, 22 bp, Homo sapiens
acaaagattcatttgcattatt

SEQ ID NO: 7886822 - DNA, 22 bp, Homo sapiens
acaaagcacgagtgccatggac

SEQ ID NO: 7886823 - DNA, 22 bp, Homo sapiens
acaaagcacgagtgccatggac

SEQ ID NO: 7886824 - DNA, 20 bp, Homo sapiens
aagagaggaagttatactag

SEQ ID NO: 7886825 - DNA, 22 bp, Homo sapiens
aagagagaacacagcttgggca

SEQ ID NO: 7886826 - DNA, 22 bp, Homo sapiens
aagagagaacacagcttgggca

SEQ ID NO: 7886827 - DNA, 22 bp, Homo sapiens
acaaagcacgagtgccatggac

SEQ ID NO: 7886828 - DNA, 22 bp, Homo sapiens
aagagatgatggcagccagagg

SEQ ID NO: 7886829 - DNA, 22 bp, Homo sapiens
aagagatgatggcagccagagg

SEQ ID NO: 7886830 - DNA, 22 bp, Homo sapiens
aagagatgatggcagccagagg

SEQ ID NO: 7886831 - DNA, 22 bp, Homo sapiens
aagagatgatggcagccagagg

SEQ ID NO: 7886832 - DNA, 22 bp, Homo sapiens
aagagatgtggaatcatttaca

SEQ ID NO: 7886833 - DNA, 22 bp, Homo sapiens
aagagatgtggaatcatttaca

SEQ ID NO: 7886834 - DNA, 22 bp, Homo sapiens
aagagatgctttacatcggatg

SEQ ID NO: 7886835 - DNA, 22 bp, Homo sapiens
aagagatgctttacatcggatg

SEQ ID NO: 7886836 - DNA, 22 bp, Homo sapiens
aagagatgttgaagtttattag

SEQ ID NO: 7886837 - DNA, 22 bp, Homo sapiens
aagagatgtgggctgctgtgca

SEQ ID NO: 7886838 - DNA, 22 bp, Homo sapiens
aagagatgtgggctgctgtgca

SEQ ID NO: 7886839 - DNA, 22 bp, Homo sapiens
aagagatgtgggctgctgtgca

SEQ ID NO: 7886840 - DNA, 22 bp, Homo sapiens
aagagatgtgggctgctgtgca

SEQ ID NO: 7886841 - DNA, 22 bp, Homo sapiens
aagagattaaagtaacttgcct

SEQ ID NO: 7886842 - DNA, 22 bp, Homo sapiens
aagagatgttgaagtttattag

SEQ ID NO: 7886843 - DNA, 22 bp, Homo sapiens
aagagattcctcactcagaatg

SEQ ID NO: 7886844 - DNA, 22 bp, Homo sapiens
aagagattggttataagagatt

SEQ ID NO: 7886845 - DNA, 22 bp, Homo sapiens
acaaggaggatatgtttaaggg

SEQ ID NO: 7886846 - DNA, 22 bp, Homo sapiens
acaaggattaaatgatatacag

SEQ ID NO: 7886847 - DNA, 22 bp, Homo sapiens
acaaggagagcacacatgggga

SEQ ID NO: 7886848 - DNA, 20 bp, Homo sapiens
acaaggaaccaggaggtggc

SEQ ID NO: 7886849 - DNA, 20 bp, Homo sapiens
acaaggaaccaggaggtggc

SEQ ID NO: 7886850 - DNA, 22 bp, Homo sapiens
aagagattgtcagagatatgcc

SEQ ID NO: 7886851 - DNA, 22 bp, Homo sapiens
acaaggaccatgaggcagaccc

SEQ ID NO: 7886852 - DNA, 17 bp, Homo sapiens
aagagaggctgagctgg

SEQ ID NO: 7886853 - DNA, 22 bp, Homo sapiens
aagagagggacttattaaagtc

SEQ ID NO: 7886854 - DNA, 22 bp, Homo sapiens
aagagagggacttattaaagtc

SEQ ID NO: 7886855 - DNA, 22 bp, Homo sapiens
aagagagggacttattaaagtc

SEQ ID NO: 7886856 - DNA, 17 bp, Homo sapiens
aagagaggctgagctgg

SEQ ID NO: 7886857 - DNA, 17 bp, Homo sapiens
aagagaggctgagctgg

SEQ ID NO: 7886858 - DNA, 17 bp, Homo sapiens
aagagaggctgagctgg

SEQ ID NO: 7886859 - DNA, 17 bp, Homo sapiens
aagagaggctgagctgg

SEQ ID NO: 7886860 - DNA, 17 bp, Homo sapiens
aagagaggctgagctgg

SEQ ID NO: 7886861 - DNA, 22 bp, Homo sapiens
aagagaggacatggtgaacctg

SEQ ID NO: 7886862 - DNA, 22 bp, Homo sapiens
aagagaggacatggtgaacctg

SEQ ID NO: 7886863 - DNA, 22 bp, Homo sapiens
aagagaggacatggtgaacctg

SEQ ID NO: 7886864 - DNA, 22 bp, Homo sapiens
aagagaggggttgcatggaaat

SEQ ID NO: 7886865 - DNA, 22 bp, Homo sapiens
aagagaggggttgcatggaaat

SEQ ID NO: 7886866 - DNA, 22 bp, Homo sapiens
aagagaggggttgcatggaaat

SEQ ID NO: 7886867 - DNA, 22 bp, Homo sapiens
aagagaggggttgcatggaaat

SEQ ID NO: 7886868 - DNA, 22 bp, Homo sapiens
aagagaggggttgcatggaaat

SEQ ID NO: 7886869 - DNA, 22 bp, Homo sapiens
aagagagtcagtctgagcacca

SEQ ID NO: 7886870 - DNA, 22 bp, Homo sapiens
aagagagggatttggtttattg

SEQ ID NO: 7886871 - DNA, 22 bp, Homo sapiens
aagagagggatttggtttattg

SEQ ID NO: 7886872 - DNA, 22 bp, Homo sapiens
aagagaggggttgcatggaaat

SEQ ID NO: 7886873 - DNA, 22 bp, Homo sapiens
aagagaggggttgcatggaaat

SEQ ID NO: 7886874 - DNA, 22 bp, Homo sapiens
aagagaggggttgcatggaaat

SEQ ID NO: 7886875 - DNA, 22 bp, Homo sapiens
aagagagggatttggtttattg

SEQ ID NO: 7886876 - DNA, 22 bp, Homo sapiens
aagagagggatttggtttattg

SEQ ID NO: 7886877 - DNA, 22 bp, Homo sapiens
aagagagggatttggtttattg

SEQ ID NO: 7886878 - DNA, 22 bp, Homo sapiens
aagaataaattaagatacttag

SEQ ID NO: 7886879 - DNA, 22 bp, Homo sapiens
aagaataaattaagatacttag

SEQ ID NO: 7886880 - DNA, 22 bp, Homo sapiens
aagaataaattaagatacttag

SEQ ID NO: 7886881 - DNA, 22 bp, Homo sapiens
aagaataaattaagatacttag

SEQ ID NO: 7886882 - DNA, 22 bp, Homo sapiens
aagaataaattaagatacttag

SEQ ID NO: 7886883 - DNA, 22 bp, Homo sapiens
aagaataaattaagatacttag

SEQ ID NO: 7886884 - DNA, 22 bp, Homo sapiens
aagaataacacttaggttttgc

SEQ ID NO: 7886885 - DNA, 22 bp, Homo sapiens
aagaataacacttaggttttgc

SEQ ID NO: 7886886 - DNA, 22 bp, Homo sapiens
aagaataacacttaggttttgc

SEQ ID NO: 7886887 - DNA, 22 bp, Homo sapiens
aagaataacacttaggttttgc

SEQ ID NO: 7886888 - DNA, 22 bp, Homo sapiens
aagaataagaggatttagaaca

SEQ ID NO: 7886889 - DNA, 22 bp, Homo sapiens
aagaataagaggatttagaaca

SEQ ID NO: 7886890 - DNA, 22 bp, Homo sapiens
aagaagcagagctgtgggtgtt

SEQ ID NO: 7886891 - DNA, 18 bp, Homo sapiens
aagaagttggccaaagag

SEQ ID NO: 7886892 - DNA, 20 bp, Homo sapiens
aagaagttggtaagcagtgc

SEQ ID NO: 7886893 - DNA, 21 bp, Homo sapiens
aagaagtttggattttgtcct

SEQ ID NO: 7886894 - DNA, 23 bp, Homo sapiens
aagaataaatgacattaaaggtg

SEQ ID NO: 7886895 - DNA, 22 bp, Homo sapiens
aagaataaattaagatacttag

SEQ ID NO: 7886896 - DNA, 21 bp, Homo sapiens
aagaagtttggattttgtcct

SEQ ID NO: 7886897 - DNA, 23 bp, Homo sapiens
aagaataaatgacattaaaggtg

SEQ ID NO: 7886898 - DNA, 22 bp, Homo sapiens
aattggttattctgtccttttt

SEQ ID NO: 7886899 - DNA, 22 bp, Homo sapiens
aattgggctatagggaggagcc

SEQ ID NO: 7886900 - DNA, 22 bp, Homo sapiens
aattgggcactttcttcttgca

SEQ ID NO: 7886901 - DNA, 22 bp, Homo sapiens
aattggcttccattttctgttt

SEQ ID NO: 7886902 - DNA, 22 bp, Homo sapiens
aattggcatagcatacaattca

SEQ ID NO: 7886903 - DNA, 22 bp, Homo sapiens
aattggcatagcatacaattca

SEQ ID NO: 7886904 - DNA, 22 bp, Homo sapiens
aattggcagaactttatatatt

SEQ ID NO: 7886905 - DNA, 22 bp, Homo sapiens
aattggcaagcaagttatccag

SEQ ID NO: 7886906 - DNA, 23 bp, Homo sapiens
aattggacttgctgtcaaacttc

SEQ ID NO: 7886907 - DNA, 22 bp, Homo sapiens
aattggactgtgctgctcaaaa

SEQ ID NO: 7886908 - DNA, 22 bp, Homo sapiens
aagaatacttcgtaagtaggat

SEQ ID NO: 7886909 - DNA, 22 bp, Homo sapiens
aattggaaaatgctacatatca

SEQ ID NO: 7886910 - DNA, 22 bp, Homo sapiens
aagaatatagattttttgaagt

SEQ ID NO: 7886911 - DNA, 22 bp, Homo sapiens
aattggaaaatgctacatatca

SEQ ID NO: 7886912 - DNA, 22 bp, Homo sapiens
aagaataagtagatgggagaag

SEQ ID NO: 7886913 - DNA, 22 bp, Homo sapiens
aagaataagtagatgggagaag

SEQ ID NO: 7886914 - DNA, 22 bp, Homo sapiens
aagaatacgtatcaacaatggt

SEQ ID NO: 7886915 - DNA, 22 bp, Homo sapiens
aagaatacgtatcaacaatggt

SEQ ID NO: 7886916 - DNA, 22 bp, Homo sapiens
aagaatacgtatcaacaatggt

SEQ ID NO: 7886917 - DNA, 22 bp, Homo sapiens
aagaatacgtatcaacaatggt

SEQ ID NO: 7886918 - DNA, 22 bp, Homo sapiens
aagaataagaggatttagaaca

SEQ ID NO: 7886919 - DNA, 22 bp, Homo sapiens
aagaataagaggatttagaaca

SEQ ID NO: 7886920 - DNA, 22 bp, Homo sapiens
aagaataagaggatttagaaca

SEQ ID NO: 7886921 - DNA, 22 bp, Homo sapiens
aagaataagaggatttagaaca

SEQ ID NO: 7886922 - DNA, 22 bp, Homo sapiens
aagaataagaggatttagaaca

SEQ ID NO: 7886923 - DNA, 22 bp, Homo sapiens
aagaataagtagatgggagaag

SEQ ID NO: 7886924 - DNA, 22 bp, Homo sapiens
aagacaggaaaagctccaggcc

SEQ ID NO: 7886925 - DNA, 22 bp, Homo sapiens
aagacaggaaaagctccaggcc

SEQ ID NO: 7886926 - DNA, 22 bp, Homo sapiens
aagacaggaaaagctccaggcc

SEQ ID NO: 7886927 - DNA, 22 bp, Homo sapiens
aagacaggaacatagcaaatcc

SEQ ID NO: 7886928 - DNA, 22 bp, Homo sapiens
aagacagtgacagtcacaattg

SEQ ID NO: 7886929 - DNA, 22 bp, Homo sapiens
aagacagtgacagtcacaattg

SEQ ID NO: 7886930 - DNA, 22 bp, Homo sapiens
aagacagtgatctctgagagat

SEQ ID NO: 7886931 - DNA, 22 bp, Homo sapiens
aagacaggaacatagcaaatcc

SEQ ID NO: 7886932 - DNA, 22 bp, Homo sapiens
aagacagtgacagtcacaattg

SEQ ID NO: 7886933 - DNA, 22 bp, Homo sapiens
aagacaggaacatagcaaatcc

SEQ ID NO: 7886934 - DNA, 22 bp, Homo sapiens
aagacaggaacatagcaaatcc

SEQ ID NO: 7886935 - DNA, 22 bp, Homo sapiens
aagacagcactggcattttcaa

SEQ ID NO: 7886936 - DNA, 22 bp, Homo sapiens
aagacacagcgaaatgttcctg

SEQ ID NO: 7886937 - DNA, 20 bp, Homo sapiens
aagacaccagtggcagcccc

SEQ ID NO: 7886938 - DNA, 20 bp, Homo sapiens
aagacaccagtggcagcccc

SEQ ID NO: 7886939 - DNA, 20 bp, Homo sapiens
aagacaccagtggcagcccc

SEQ ID NO: 7886940 - DNA, 22 bp, Homo sapiens
aagacagctcaggacagattca

SEQ ID NO: 7886941 - DNA, 22 bp, Homo sapiens
aagacagctcaggacagattca

SEQ ID NO: 7886942 - DNA, 22 bp, Homo sapiens
aagacagcctttccctggtgcc

SEQ ID NO: 7886943 - DNA, 22 bp, Homo sapiens
aagacagccagctccatgggat

SEQ ID NO: 7886944 - DNA, 22 bp, Homo sapiens
aagacagcctttccctggtgcc

SEQ ID NO: 7886945 - DNA, 22 bp, Homo sapiens
aagacagcctttccctggtgcc

SEQ ID NO: 7886946 - DNA, 22 bp, Homo sapiens
aagacagcctttccctggtgcc

SEQ ID NO: 7886947 - DNA, 22 bp, Homo sapiens
aagacagcattgctgagggctt

SEQ ID NO: 7886948 - DNA, 22 bp, Homo sapiens
aagacagccagctccatgggat

SEQ ID NO: 7886949 - DNA, 22 bp, Homo sapiens
aagacagcattttaccccaaca

SEQ ID NO: 7886950 - DNA, 22 bp, Homo sapiens
aagacagcagcacctctcgttt

SEQ ID NO: 7886951 - DNA, 22 bp, Homo sapiens
aagacagcattgctgagggctt

SEQ ID NO: 7886952 - DNA, 22 bp, Homo sapiens
aagacagcattgctgagggctt

SEQ ID NO: 7886953 - DNA, 22 bp, Homo sapiens
aagacagcagcacctctcgttt

SEQ ID NO: 7886954 - DNA, 22 bp, Homo sapiens
aagacagcagcacctctcgttt

SEQ ID NO: 7886955 - DNA, 22 bp, Homo sapiens
aatttaactgagagtactttta

SEQ ID NO: 7886956 - DNA, 22 bp, Homo sapiens
aattgttgggtattcctgtgac

SEQ ID NO: 7886957 - DNA, 22 bp, Homo sapiens
aattgtgaacctttacagttgt

SEQ ID NO: 7886958 - DNA, 22 bp, Homo sapiens
aattgtgcccgtgacatttcat

SEQ ID NO: 7886959 - DNA, 22 bp, Homo sapiens
aattgtgcatttttaaatcacg

SEQ ID NO: 7886960 - DNA, 22 bp, Homo sapiens
aattgtcaaacacaaataagag

SEQ ID NO: 7886961 - DNA, 22 bp, Homo sapiens
aattgtcaaacacaaataagag

SEQ ID NO: 7886962 - DNA, 17 bp, Homo sapiens
aattgtcagcagtagct

SEQ ID NO: 7886963 - DNA, 22 bp, Homo sapiens
aattgtcaaacacaaataagag

SEQ ID NO: 7886964 - DNA, 22 bp, Homo sapiens
aattgtcttggtgcaatcatga

SEQ ID NO: 7886965 - DNA, 22 bp, Homo sapiens
aattgtcttgaaagcaacactt

SEQ ID NO: 7886966 - DNA, 22 bp, Homo sapiens
aattgtaagtgctgagttaagg

SEQ ID NO: 7886967 - DNA, 22 bp, Homo sapiens
aattgtacaagccttgtgccat

SEQ ID NO: 7886968 - DNA, 22 bp, Homo sapiens
aattgtcaaaaattgcaattgt

SEQ ID NO: 7886969 - DNA, 22 bp, Homo sapiens
aattgtacataaaccatttggc

SEQ ID NO: 7886970 - DNA, 22 bp, Homo sapiens
aattgtacatatttatgagcga

SEQ ID NO: 7886971 - DNA, 22 bp, Homo sapiens
aattgtacataaaccatttggc

SEQ ID NO: 7886972 - DNA, 22 bp, Homo sapiens
aattgtacaggaagttgctgga

SEQ ID NO: 7886973 - DNA, 22 bp, Homo sapiens
aacttcatgtaatttaaaacag

SEQ ID NO: 7886974 - DNA, 22 bp, Homo sapiens
aacttcatgtaatttaaaacag

SEQ ID NO: 7886975 - DNA, 22 bp, Homo sapiens
aacttcatgggttcaaagctgg

SEQ ID NO: 7886976 - DNA, 22 bp, Homo sapiens
aacttcatgggttcaaagctgg

SEQ ID NO: 7886977 - DNA, 22 bp, Homo sapiens
aacttcagggggcacattcaag

SEQ ID NO: 7886978 - DNA, 22 bp, Homo sapiens
aacttcagggacagaaaagagc

SEQ ID NO: 7886979 - DNA, 22 bp, Homo sapiens
aacttcagttgagaaaggcatg

SEQ ID NO: 7886980 - DNA, 22 bp, Homo sapiens
aacttcattcctttttatgact

SEQ ID NO: 7886981 - DNA, 21 bp, Homo sapiens
aagaaagataattaaggaccc

SEQ ID NO: 7886982 - DNA, 21 bp, Homo sapiens
aagaaagataattaaggaccc

SEQ ID NO: 7886983 - DNA, 21 bp, Homo sapiens
aagaaagataattaaggaccc

SEQ ID NO: 7886984 - DNA, 22 bp, Homo sapiens
aacttatcagactgatgtatgg

SEQ ID NO: 7886985 - DNA, 22 bp, Homo sapiens
aacttagtttagggtattgatt

SEQ ID NO: 7886986 - DNA, 22 bp, Homo sapiens
aacttatacccagggcagaaat

SEQ ID NO: 7886987 - DNA, 22 bp, Homo sapiens
aacttagttggggacaccatgg

SEQ ID NO: 7886988 - DNA, 22 bp, Homo sapiens
aacttagtttagggtattgatt

SEQ ID NO: 7886989 - DNA, 22 bp, Homo sapiens
aacttcaagcttcgtcccttcg

SEQ ID NO: 7886990 - DNA, 22 bp, Homo sapiens
aacttcaaatgtgactttgcat

SEQ ID NO: 7886991 - DNA, 22 bp, Homo sapiens
aagaaatattgggccttataaa

SEQ ID NO: 7886992 - DNA, 22 bp, Homo sapiens
aagaaatattgggccttataaa

SEQ ID NO: 7886993 - DNA, 22 bp, Homo sapiens
aagaaatattgggccttataaa

SEQ ID NO: 7886994 - DNA, 22 bp, Homo sapiens
aagaaatattgggccttataaa

SEQ ID NO: 7886995 - DNA, 22 bp, Homo sapiens
aagaaatattgggccttataaa

SEQ ID NO: 7886996 - DNA, 22 bp, Homo sapiens
aagaaatattgggccttataaa

SEQ ID NO: 7886997 - DNA, 22 bp, Homo sapiens
aagaaatctgatatttgtttca

SEQ ID NO: 7886998 - DNA, 22 bp, Homo sapiens
aagaaatgcacacaactgctgg

SEQ ID NO: 7886999 - DNA, 22 bp, Homo sapiens
aagaaataagacttctctgtcc

SEQ ID NO: 7887000 - DNA, 22 bp, Homo sapiens
aagaaataagacttctctgtcc

SEQ ID NO: 7887001 - DNA, 22 bp, Homo sapiens
aagaaatacatggtttttgagt

SEQ ID NO: 7887002 - DNA, 22 bp, Homo sapiens
aagaaatacatggtttttgagt

SEQ ID NO: 7887003 - DNA, 22 bp, Homo sapiens
aagaaataagacttctctgtcc

SEQ ID NO: 7887004 - DNA, 22 bp, Homo sapiens
aagaaatacatggtttttgagt

SEQ ID NO: 7887005 - DNA, 22 bp, Homo sapiens
aagaaatacatggtttttgagt

SEQ ID NO: 7887006 - DNA, 22 bp, Homo sapiens
aagaaatacatggtttttgagt

SEQ ID NO: 7887007 - DNA, 22 bp, Homo sapiens
aagaaatacatggtttttgagt

SEQ ID NO: 7887008 - DNA, 22 bp, Homo sapiens
aagaaagcattagacaggcatt

SEQ ID NO: 7887009 - DNA, 22 bp, Homo sapiens
aagaaatattgggccttataaa

SEQ ID NO: 7887010 - DNA, 22 bp, Homo sapiens
aagaaatattgggccttataaa

SEQ ID NO: 7887011 - DNA, 22 bp, Homo sapiens
aagaaatacatggtttttgagt

SEQ ID NO: 7887012 - DNA, 22 bp, Homo sapiens
aagaaatgcagaaatgtgctgg

SEQ ID NO: 7887013 - DNA, 22 bp, Homo sapiens
aagaaatgctgatgttggatgg

SEQ ID NO: 7887014 - DNA, 22 bp, Homo sapiens
aagaaatgctgatgttggatgg

SEQ ID NO: 7887015 - DNA, 22 bp, Homo sapiens
aagaaatggaagatccatggtg

SEQ ID NO: 7887016 - DNA, 22 bp, Homo sapiens
aagaaatggcttcatctgagta

SEQ ID NO: 7887017 - DNA, 22 bp, Homo sapiens
aagaaatggaagatccatggtg

SEQ ID NO: 7887018 - DNA, 22 bp, Homo sapiens
aagaaatggaagatccatggtg

SEQ ID NO: 7887019 - DNA, 22 bp, Homo sapiens
aagaaatgcacacaactgctgg

SEQ ID NO: 7887020 - DNA, 22 bp, Homo sapiens
aagaaatgcacacaactgctgg

SEQ ID NO: 7887021 - DNA, 22 bp, Homo sapiens
aagaaatgcacacaactgctgg

SEQ ID NO: 7887022 - DNA, 22 bp, Homo sapiens
aagaaatgcacacaactgctgg

SEQ ID NO: 7887023 - DNA, 22 bp, Homo sapiens
aagaaatgcacacaactgctgg

SEQ ID NO: 7887024 - DNA, 22 bp, Homo sapiens
aagaaatgcagaaatgtgctgg

SEQ ID NO: 7887025 - DNA, 22 bp, Homo sapiens
aagaaatgcagaaatgtgctgg

SEQ ID NO: 7887026 - DNA, 22 bp, Homo sapiens
aatgttttacagatcccattag

SEQ ID NO: 7887027 - DNA, 22 bp, Homo sapiens
aatgttttaaaagagattgaga

SEQ ID NO: 7887028 - DNA, 22 bp, Homo sapiens
aagaaatggcttcatctgagta

SEQ ID NO: 7887029 - DNA, 22 bp, Homo sapiens
aagaaatggcttcatctgagta

SEQ ID NO: 7887030 - DNA, 22 bp, Homo sapiens
aatgttttagattactgctggg

SEQ ID NO: 7887031 - DNA, 22 bp, Homo sapiens
aatgttttagattactgctggg

SEQ ID NO: 7887032 - DNA, 22 bp, Homo sapiens
aatgttttacagatcccattag

SEQ ID NO: 7887033 - DNA, 22 bp, Homo sapiens
aatgttttctctgtgaacacat

SEQ ID NO: 7887034 - DNA, 22 bp, Homo sapiens
aatgttttctctgtgaacacat

SEQ ID NO: 7887035 - DNA, 22 bp, Homo sapiens
aatgttttctctgtgaacacat

SEQ ID NO: 7887036 - DNA, 22 bp, Homo sapiens
aatgttttcattatcctaactg

SEQ ID NO: 7887037 - DNA, 22 bp, Homo sapiens
aatgttttcccagtgcagacga

SEQ ID NO: 7887038 - DNA, 22 bp, Homo sapiens
aatgttttcccagtgcagacga

SEQ ID NO: 7887039 - DNA, 22 bp, Homo sapiens
aatgttttatagctcaagcaat

SEQ ID NO: 7887040 - DNA, 22 bp, Homo sapiens
aatgttttatagctcaagcaat

SEQ ID NO: 7887041 - DNA, 22 bp, Homo sapiens
aatgttttatagctcaagcaat

SEQ ID NO: 7887042 - DNA, 22 bp, Homo sapiens
aatgttttgcattagttttcta

SEQ ID NO: 7887043 - DNA, 22 bp, Homo sapiens
aatgttttgcattagttttcta

SEQ ID NO: 7887044 - DNA, 22 bp, Homo sapiens
aatgttttgcattagttttcta

SEQ ID NO: 7887045 - DNA, 22 bp, Homo sapiens
aagaagcactttcctacatgtt

SEQ ID NO: 7887046 - DNA, 22 bp, Homo sapiens
aagaagcactttcctacatgtt

SEQ ID NO: 7887047 - DNA, 22 bp, Homo sapiens
aagaagcactttcctacatgtt

SEQ ID NO: 7887048 - DNA, 22 bp, Homo sapiens
aagaagcactttcctacatgtt

SEQ ID NO: 7887049 - DNA, 22 bp, Homo sapiens
aatgttttgcattagttttcta

SEQ ID NO: 7887050 - DNA, 22 bp, Homo sapiens
aatgttttgcattagttttcta

SEQ ID NO: 7887051 - DNA, 22 bp, Homo sapiens
aatgttttctgactgctaactt

SEQ ID NO: 7887052 - DNA, 22 bp, Homo sapiens
aatgttttctgactgctaactt

SEQ ID NO: 7887053 - DNA, 22 bp, Homo sapiens
aaattcctctgatcataagaat

SEQ ID NO: 7887054 - DNA, 22 bp, Homo sapiens
aaattcccatagtctgcttcta

SEQ ID NO: 7887055 - DNA, 22 bp, Homo sapiens
aaattccattttgtgactattc

SEQ ID NO: 7887056 - DNA, 22 bp, Homo sapiens
aaattccattttgtgactattc

SEQ ID NO: 7887057 - DNA, 22 bp, Homo sapiens
aaattcacttgcctgcttagct

SEQ ID NO: 7887058 - DNA, 22 bp, Homo sapiens
aaattcacttgcctgcttagct

SEQ ID NO: 7887059 - DNA, 22 bp, Homo sapiens
aaattcacttgcctgcttagct

SEQ ID NO: 7887060 - DNA, 22 bp, Homo sapiens
aaattcacttgcctgcttagct

SEQ ID NO: 7887061 - DNA, 22 bp, Homo sapiens
aaattctaaggtcacaatgttg

SEQ ID NO: 7887062 - DNA, 22 bp, Homo sapiens
aaattctaaggtcacaatgttg

SEQ ID NO: 7887063 - DNA, 22 bp, Homo sapiens
aaattctaaggtcacaatgttg

SEQ ID NO: 7887064 - DNA, 22 bp, Homo sapiens
aaattctaaggtcacaatgttg

SEQ ID NO: 7887065 - DNA, 22 bp, Homo sapiens
aaattcctgtcatttgcacttt

SEQ ID NO: 7887066 - DNA, 22 bp, Homo sapiens
aaattcctgtcatttgcacttt

SEQ ID NO: 7887067 - DNA, 22 bp, Homo sapiens
aaattcctgtcatttgcacttt

SEQ ID NO: 7887068 - DNA, 22 bp, Homo sapiens
aaattccttgagacgcaggttt

SEQ ID NO: 7887069 - DNA, 23 bp, Homo sapiens
aaattccttgcagataggtattg

SEQ ID NO: 7887070 - DNA, 23 bp, Homo sapiens
aaattccttgcagataggtattg

SEQ ID NO: 7887071 - DNA, 22 bp, Homo sapiens
aaatgtttctacttgtgagcat

SEQ ID NO: 7887072 - DNA, 22 bp, Homo sapiens
aaatgtttctacttgtgagcat

SEQ ID NO: 7887073 - DNA, 22 bp, Homo sapiens
aaattcactctgttcctcatgg

SEQ ID NO: 7887074 - DNA, 22 bp, Homo sapiens
aaatgtttctacttgtgagcat

SEQ ID NO: 7887075 - DNA, 22 bp, Homo sapiens
aaatgtttaagtgtaggagcaa

SEQ ID NO: 7887076 - DNA, 22 bp, Homo sapiens
aaatgtttctacttgtgagcat

SEQ ID NO: 7887077 - DNA, 22 bp, Homo sapiens
aaatgtttctacttgtgagcat

SEQ ID NO: 7887078 - DNA, 22 bp, Homo sapiens
aaatgtttaagtgtaggagcaa

SEQ ID NO: 7887079 - DNA, 22 bp, Homo sapiens
aaatgttctgaaagacccgctc

SEQ ID NO: 7887080 - DNA, 22 bp, Homo sapiens
aaatgttctactttgataatta

SEQ ID NO: 7887081 - DNA, 22 bp, Homo sapiens
aaatgttccgggtaaggagaaa

SEQ ID NO: 7887082 - DNA, 22 bp, Homo sapiens
aaatgttccgggtaaggagaaa

SEQ ID NO: 7887083 - DNA, 22 bp, Homo sapiens
aaatgttcccaatatgaagctg

SEQ ID NO: 7887084 - DNA, 22 bp, Homo sapiens
aaatgttcatttctcactcaca

SEQ ID NO: 7887085 - DNA, 22 bp, Homo sapiens
aaatgttcccaatatgaagctg

SEQ ID NO: 7887086 - DNA, 22 bp, Homo sapiens
aaatgttccattattgtgtaat

SEQ ID NO: 7887087 - DNA, 22 bp, Homo sapiens
aaatgttaggttgtactgagtc

SEQ ID NO: 7887088 - DNA, 22 bp, Homo sapiens
aaatgttcaccagatccatgac

SEQ ID NO: 7887089 - DNA, 22 bp, Homo sapiens
aaatgtgtttctttgtgaatgg

SEQ ID NO: 7887090 - DNA, 22 bp, Homo sapiens
aaatgtgtttcgaaaactggtg

SEQ ID NO: 7887091 - DNA, 22 bp, Homo sapiens
aaatgtgtttagatggtttatt

SEQ ID NO: 7887092 - DNA, 22 bp, Homo sapiens
aaatgtgttcctttgctacaga

SEQ ID NO: 7887093 - DNA, 22 bp, Homo sapiens
aaatgtgtttgataggaatatt

SEQ ID NO: 7887094 - DNA, 22 bp, Homo sapiens
aaatgtgtttgataggaatatt

SEQ ID NO: 7887095 - DNA, 22 bp, Homo sapiens
aaatgtgtttgataggaatatt

SEQ ID NO: 7887096 - DNA, 22 bp, Homo sapiens
aaatgtgtttgataggaatatt

SEQ ID NO: 7887097 - DNA, 22 bp, Homo sapiens
aaatgtgtatatgaaacatgat

SEQ ID NO: 7887098 - DNA, 22 bp, Homo sapiens
aaatgtgcttgtgatcagctgt

SEQ ID NO: 7887099 - DNA, 22 bp, Homo sapiens
aaatgtgcttgtgatcagctgt

SEQ ID NO: 7887100 - DNA, 22 bp, Homo sapiens
aaatgtgtcagtttcattctct

SEQ ID NO: 7887101 - DNA, 22 bp, Homo sapiens
aaatgtgtcagtttcattctct

SEQ ID NO: 7887102 - DNA, 22 bp, Homo sapiens
aaatgtgtcagtttcattctct

SEQ ID NO: 7887103 - DNA, 22 bp, Homo sapiens
aaatgtgtatatgaaacatgat

SEQ ID NO: 7887104 - DNA, 22 bp, Homo sapiens
aaatgtgtatatgaaacatgat

SEQ ID NO: 7887105 - DNA, 21 bp, Homo sapiens
aaatgtgttccataatgcttt

SEQ ID NO: 7887106 - DNA, 22 bp, Homo sapiens
aaatgtgttcctttgctacaga

SEQ ID NO: 7887107 - DNA, 21 bp, Homo sapiens
aaatgtgttccataatgcttt

SEQ ID NO: 7887108 - DNA, 21 bp, Homo sapiens
aaatgtgttccataatgcttt

SEQ ID NO: 7887109 - DNA, 22 bp, Homo sapiens
aaatgtgtgtatgtacatatat

SEQ ID NO: 7887110 - DNA, 22 bp, Homo sapiens
aaatgtgtgtatgtacatatat

SEQ ID NO: 7887111 - DNA, 22 bp, Homo sapiens
aaatgtgtgtatgtacatatat

SEQ ID NO: 7887112 - DNA, 22 bp, Homo sapiens
aaatgtgtgtatgtacatatat

SEQ ID NO: 7887113 - DNA, 22 bp, Homo sapiens
aaatgtgtcatattcaaagtca

SEQ ID NO: 7887114 - DNA, 22 bp, Homo sapiens
aaatgtgtgcacaaagacagct

SEQ ID NO: 7887115 - DNA, 22 bp, Homo sapiens
aaatgtgtgtatgtacatatat

SEQ ID NO: 7887116 - DNA, 22 bp, Homo sapiens
aaatgtgtgcacaaagacagct

SEQ ID NO: 7887117 - DNA, 22 bp, Homo sapiens
aaatgtctatctggcatattcc

SEQ ID NO: 7887118 - DNA, 22 bp, Homo sapiens
aaatgtctatctggcatattcc

SEQ ID NO: 7887119 - DNA, 22 bp, Homo sapiens
aaatgtctatctggcatattcc

SEQ ID NO: 7887120 - DNA, 22 bp, Homo sapiens
aaatgtctatctggcatattcc

SEQ ID NO: 7887121 - DNA, 22 bp, Homo sapiens
aaatgtgatactgttcttttta

SEQ ID NO: 7887122 - DNA, 22 bp, Homo sapiens
aaatgtgatactgttcttttta

SEQ ID NO: 7887123 - DNA, 19 bp, Homo sapiens
aaatgtgatggtacaattc

SEQ ID NO: 7887124 - DNA, 22 bp, Homo sapiens
aaatgtgcatgagtcagaagtg

SEQ ID NO: 7887125 - DNA, 22 bp, Homo sapiens
aaatgtgctcatttataaaagt

SEQ ID NO: 7887126 - DNA, 19 bp, Homo sapiens
aaatgtgatggtacaattc

SEQ ID NO: 7887127 - DNA, 19 bp, Homo sapiens
aaatgtgatggtacaattc

SEQ ID NO: 7887128 - DNA, 19 bp, Homo sapiens
aagctgagggctgtccacc

SEQ ID NO: 7887129 - DNA, 19 bp, Homo sapiens
aagctgagggctgtccacc

SEQ ID NO: 7887130 - DNA, 22 bp, Homo sapiens
aagctgaggtcaagtagctagt

SEQ ID NO: 7887131 - DNA, 22 bp, Homo sapiens
aaatgtctacttcccatctgta

SEQ ID NO: 7887132 - DNA, 19 bp, Homo sapiens
aagctgagggctgtccacc

SEQ ID NO: 7887133 - DNA, 22 bp, Homo sapiens
aagctgaggctcccctgaggga

SEQ ID NO: 7887134 - DNA, 22 bp, Homo sapiens
aagctgaggctcccctgaggga

SEQ ID NO: 7887135 - DNA, 22 bp, Homo sapiens
aagctgaggctcccctgaggga

SEQ ID NO: 7887136 - DNA, 22 bp, Homo sapiens
aagctgaggcccatggcaaggt

SEQ ID NO: 7887137 - DNA, 22 bp, Homo sapiens
aagctgaggcccatggcaaggt

SEQ ID NO: 7887138 - DNA, 22 bp, Homo sapiens
aagctgaggatacatgaagcct

SEQ ID NO: 7887139 - DNA, 22 bp, Homo sapiens
aagctgagccagtggcaagtgc

SEQ ID NO: 7887140 - DNA, 22 bp, Homo sapiens
aagctgagccagtggcaagtgc

SEQ ID NO: 7887141 - DNA, 22 bp, Homo sapiens
aagctgaggatacatgaagcct

SEQ ID NO: 7887142 - DNA, 22 bp, Homo sapiens
aagctgaggatacatgaagcct

SEQ ID NO: 7887143 - DNA, 22 bp, Homo sapiens
aagctgaggcccatggcaaggt

SEQ ID NO: 7887144 - DNA, 22 bp, Homo sapiens
aagctgaggcccatggcaaggt

SEQ ID NO: 7887145 - DNA, 22 bp, Homo sapiens
aaattctttcatggctaataag

SEQ ID NO: 7887146 - DNA, 22 bp, Homo sapiens
aaattctttcatggctaataag

SEQ ID NO: 7887147 - DNA, 22 bp, Homo sapiens
aaattctttggcctactttgaa

SEQ ID NO: 7887148 - DNA, 22 bp, Homo sapiens
aaattctttggcctactttgaa

SEQ ID NO: 7887149 - DNA, 22 bp, Homo sapiens
aaattctttggcctactttgaa

SEQ ID NO: 7887150 - DNA, 22 bp, Homo sapiens
aaattctttggcctactttgaa

SEQ ID NO: 7887151 - DNA, 22 bp, Homo sapiens
aaattgaatttgggaaacattg

SEQ ID NO: 7887152 - DNA, 22 bp, Homo sapiens
aaattgcagatgctaaatgact

SEQ ID NO: 7887153 - DNA, 22 bp, Homo sapiens
aaattgcacaatatagacatga

SEQ ID NO: 7887154 - DNA, 22 bp, Homo sapiens
aaattgcaaaagtacttttagg

SEQ ID NO: 7887155 - DNA, 22 bp, Homo sapiens
aaattgagctcatttcctctgt

SEQ ID NO: 7887156 - DNA, 22 bp, Homo sapiens
aaattgcaaaagtacttttagg

SEQ ID NO: 7887157 - DNA, 22 bp, Homo sapiens
aaattgcaaaagtacttttagg

SEQ ID NO: 7887158 - DNA, 22 bp, Homo sapiens
aaattgcaaaagtacttttagg

SEQ ID NO: 7887159 - DNA, 22 bp, Homo sapiens
aaattctaaggtcacaatgttg

SEQ ID NO: 7887160 - DNA, 22 bp, Homo sapiens
aaattctatgtcaatgtttatt

SEQ ID NO: 7887161 - DNA, 22 bp, Homo sapiens
aaattctatgtcaatgtttatt

SEQ ID NO: 7887162 - DNA, 22 bp, Homo sapiens
aaattctatgtcaatgtttatt

SEQ ID NO: 7887163 - DNA, 22 bp, Homo sapiens
aaattctatgtcaatgtttatt

SEQ ID NO: 7887164 - DNA, 22 bp, Homo sapiens
aaattctatgtcaatgtttatt

SEQ ID NO: 7887165 - DNA, 22 bp, Homo sapiens
aaattctatgtcaatgtttatt

SEQ ID NO: 7887166 - DNA, 22 bp, Homo sapiens
aaattctctaaagaaaacatga

SEQ ID NO: 7887167 - DNA, 22 bp, Homo sapiens
aaattctctaaagaaaacatga

SEQ ID NO: 7887168 - DNA, 22 bp, Homo sapiens
aaattctggcctatcacagtga

SEQ ID NO: 7887169 - DNA, 22 bp, Homo sapiens
aaattctgtcctgaatgccatt

SEQ ID NO: 7887170 - DNA, 22 bp, Homo sapiens
aaattcttcaggtaattttgat

SEQ ID NO: 7887171 - DNA, 22 bp, Homo sapiens
aaattctgcaatttgacaagat

SEQ ID NO: 7887172 - DNA, 22 bp, Homo sapiens
aaattctgcaatttgacaagat

SEQ ID NO: 7887173 - DNA, 22 bp, Homo sapiens
aaattctggcctatcacagtga

SEQ ID NO: 7887174 - DNA, 22 bp, Homo sapiens
aaattctgatttaataagtgta

SEQ ID NO: 7887175 - DNA, 19 bp, Homo sapiens
aaattctgacagtctttta

SEQ ID NO: 7887176 - DNA, 22 bp, Homo sapiens
aaattctgatttaataagtgta

SEQ ID NO: 7887177 - DNA, 22 bp, Homo sapiens
aaattctcttcagaggaaccag

SEQ ID NO: 7887178 - DNA, 22 bp, Homo sapiens
aacaaacaaacattttgtcatc

SEQ ID NO: 7887179 - DNA, 22 bp, Homo sapiens
aaattttagaccaggcaaaact

SEQ ID NO: 7887180 - DNA, 22 bp, Homo sapiens
aaattttagaccaggcaaaact

SEQ ID NO: 7887181 - DNA, 22 bp, Homo sapiens
aaattttagaccaggcaaaact

SEQ ID NO: 7887182 - DNA, 22 bp, Homo sapiens
aacaaacagttaagtgtggatg

SEQ ID NO: 7887183 - DNA, 22 bp, Homo sapiens
aacaaacagttaagtgtggatg

SEQ ID NO: 7887184 - DNA, 22 bp, Homo sapiens
aacaaacagttaagtgtggatg

SEQ ID NO: 7887185 - DNA, 22 bp, Homo sapiens
aaattttagaccaggcaaaact

SEQ ID NO: 7887186 - DNA, 22 bp, Homo sapiens
aaattttagaccaggcaaaact

SEQ ID NO: 7887187 - DNA, 22 bp, Homo sapiens
aaattttagaccaggcaaaact

SEQ ID NO: 7887188 - DNA, 22 bp, Homo sapiens
aaattgcattcttgtcttgata

SEQ ID NO: 7887189 - DNA, 22 bp, Homo sapiens
aaattgcattgagctgcttatt

SEQ ID NO: 7887190 - DNA, 22 bp, Homo sapiens
aaattgcaggtaggtgggtgat

SEQ ID NO: 7887191 - DNA, 22 bp, Homo sapiens
aaattgcattcaggatgcagga

SEQ ID NO: 7887192 - DNA, 20 bp, Homo sapiens
aacaaactacaaaattatgt

SEQ ID NO: 7887193 - DNA, 20 bp, Homo sapiens
aacaaactacaaaattatgt

SEQ ID NO: 7887194 - DNA, 20 bp, Homo sapiens
aacaaactacaaaattatgt

SEQ ID NO: 7887195 - DNA, 22 bp, Homo sapiens
aacaaacctgggtggagaaagg

SEQ ID NO: 7887196 - DNA, 22 bp, Homo sapiens
aacaaaccttccctatacgtct

SEQ ID NO: 7887197 - DNA, 22 bp, Homo sapiens
aacaaaccttccctatacgtct

SEQ ID NO: 7887198 - DNA, 22 bp, Homo sapiens
aacaaacattacctggtgctgg

SEQ ID NO: 7887199 - DNA, 22 bp, Homo sapiens
aacaaacattacctggtgctgg

SEQ ID NO: 7887200 - DNA, 22 bp, Homo sapiens
aacaaacattacctggtgctgg

SEQ ID NO: 7887201 - DNA, 22 bp, Homo sapiens
aacaaacagttaagtgtggatg

SEQ ID NO: 7887202 - DNA, 22 bp, Homo sapiens
aacaaacagttaagtgtggatg

SEQ ID NO: 7887203 - DNA, 22 bp, Homo sapiens
aacaaacattacctggtgctgg

SEQ ID NO: 7887204 - DNA, 22 bp, Homo sapiens
aacaaacattacctggtgctgg

SEQ ID NO: 7887205 - DNA, 22 bp, Homo sapiens
aacaaacattacctggtgctgg

SEQ ID NO: 7887206 - DNA, 22 bp, Homo sapiens
aacaaaggccgttaataaccac

SEQ ID NO: 7887207 - DNA, 22 bp, Homo sapiens
aacaaagccctgcccaagagct

SEQ ID NO: 7887208 - DNA, 22 bp, Homo sapiens
aacaaagcaccactgagtcagt

SEQ ID NO: 7887209 - DNA, 21 bp, Homo sapiens
aacaaagggatgctcatcttt

SEQ ID NO: 7887210 - DNA, 21 bp, Homo sapiens
aacaaagggatgctcatcttt

SEQ ID NO: 7887211 - DNA, 22 bp, Homo sapiens
aacaaagtacttttcagtgctt

SEQ ID NO: 7887212 - DNA, 22 bp, Homo sapiens
aacaaagtagctgctgttctta

SEQ ID NO: 7887213 - DNA, 22 bp, Homo sapiens
aacaaagtacttttcagtgctt

SEQ ID NO: 7887214 - DNA, 22 bp, Homo sapiens
aacaaagtcgttgcctagaaga

SEQ ID NO: 7887215 - DNA, 22 bp, Homo sapiens
aacaaagtcgttgcctagaaga

SEQ ID NO: 7887216 - DNA, 20 bp, Homo sapiens
aacaaactacaaaattatgt

SEQ ID NO: 7887217 - DNA, 20 bp, Homo sapiens
aacaaactacaaaattatgt

SEQ ID NO: 7887218 - DNA, 22 bp, Homo sapiens
aacaaagaagactggttatttt

SEQ ID NO: 7887219 - DNA, 22 bp, Homo sapiens
aacaaagaagactggttatttt

SEQ ID NO: 7887220 - DNA, 22 bp, Homo sapiens
aacaaactcaaatggaagagtg

SEQ ID NO: 7887221 - DNA, 22 bp, Homo sapiens
aacaaactcaaatggaagagtg

SEQ ID NO: 7887222 - DNA, 22 bp, Homo sapiens
aacaaagcaccactgagtcagt

SEQ ID NO: 7887223 - DNA, 22 bp, Homo sapiens
aacaaagcaccactgagtcagt

SEQ ID NO: 7887224 - DNA, 22 bp, Homo sapiens
aacaaagatgggtgggaaagag

SEQ ID NO: 7887225 - DNA, 22 bp, Homo sapiens
aacaaagatgggtgggaaagag

SEQ ID NO: 7887226 - DNA, 22 bp, Homo sapiens
aacaaagatgggtgggaaagag

SEQ ID NO: 7887227 - DNA, 22 bp, Homo sapiens
aacaaagatgggtgggaaagag

SEQ ID NO: 7887228 - DNA, 22 bp, Homo sapiens
aacaggaatgaggagaaaaggt

SEQ ID NO: 7887229 - DNA, 22 bp, Homo sapiens
aacaggaatgaggagaaaaggt

SEQ ID NO: 7887230 - DNA, 22 bp, Homo sapiens
aacaggaattgatgggagtcct

SEQ ID NO: 7887231 - DNA, 22 bp, Homo sapiens
aacaggaattgatgggagtcct

SEQ ID NO: 7887232 - DNA, 22 bp, Homo sapiens
aacagcttgaggaatatcatca

SEQ ID NO: 7887233 - DNA, 22 bp, Homo sapiens
aacagcttgaggaatatcatca

SEQ ID NO: 7887234 - DNA, 22 bp, Homo sapiens
aacagcttgaggaatatcatca

SEQ ID NO: 7887235 - DNA, 22 bp, Homo sapiens
aagtccaggctggcgtagagtc

SEQ ID NO: 7887236 - DNA, 22 bp, Homo sapiens
aagtccaggctggcgtagagtc

SEQ ID NO: 7887237 - DNA, 22 bp, Homo sapiens
aagtccagggatcaaagtaggc

SEQ ID NO: 7887238 - DNA, 22 bp, Homo sapiens
aagtccagggatcaaagtaggc

SEQ ID NO: 7887239 - DNA, 22 bp, Homo sapiens
aacagcttgaggaatatcatca

SEQ ID NO: 7887240 - DNA, 22 bp, Homo sapiens
aacagcttgagactggatatgc

SEQ ID NO: 7887241 - DNA, 22 bp, Homo sapiens
aagtccaggtcccgggctctgg

SEQ ID NO: 7887242 - DNA, 22 bp, Homo sapiens
aagtccaggtccaggaggttcc

SEQ ID NO: 7887243 - DNA, 22 bp, Homo sapiens
aagtccaggtccaggaggttcc

SEQ ID NO: 7887244 - DNA, 22 bp, Homo sapiens
aagtccagctctaaatatctga

SEQ ID NO: 7887245 - DNA, 22 bp, Homo sapiens
aagtccagctctaaatatctga

SEQ ID NO: 7887246 - DNA, 22 bp, Homo sapiens
aagtccagctgtagctcaacag

SEQ ID NO: 7887247 - DNA, 17 bp, Homo sapiens
aagtccagcctgcagct

SEQ ID NO: 7887248 - DNA, 17 bp, Homo sapiens
aagtccagcctgcagct

SEQ ID NO: 7887249 - DNA, 22 bp, Homo sapiens
aagtccagcagtgcttgttgat

SEQ ID NO: 7887250 - DNA, 17 bp, Homo sapiens
aagtccagcctgcagct

SEQ ID NO: 7887251 - DNA, 22 bp, Homo sapiens
aagtccagcatttgggtagatt

SEQ ID NO: 7887252 - DNA, 22 bp, Homo sapiens
aagtccagcatttgggtagatt

SEQ ID NO: 7887253 - DNA, 22 bp, Homo sapiens
aagtccagacctgaggccctca

SEQ ID NO: 7887254 - DNA, 22 bp, Homo sapiens
aagtccagactcctttgcgtgg

SEQ ID NO: 7887255 - DNA, 17 bp, Homo sapiens
aagtccagagttgagca

SEQ ID NO: 7887256 - DNA, 17 bp, Homo sapiens
aagtccagagttgagca

SEQ ID NO: 7887257 - DNA, 17 bp, Homo sapiens
aagtccagagttgagca

SEQ ID NO: 7887258 - DNA, 22 bp, Homo sapiens
aagtccagacctgaggccctca

SEQ ID NO: 7887259 - DNA, 22 bp, Homo sapiens
aagtccagacctgaggccctca

SEQ ID NO: 7887260 - DNA, 23 bp, Homo sapiens
aagtccagaaggagaactgggag

SEQ ID NO: 7887261 - DNA, 22 bp, Homo sapiens
aagtccagaactcctgtgatag

SEQ ID NO: 7887262 - DNA, 22 bp, Homo sapiens
aagtcattcctgcttgttgccc

SEQ ID NO: 7887263 - DNA, 22 bp, Homo sapiens
aagtcattatctcttctaatct

SEQ ID NO: 7887264 - DNA, 22 bp, Homo sapiens
aagtccaagatgcagttgtcag

SEQ ID NO: 7887265 - DNA, 22 bp, Homo sapiens
aagtccaagatgcagttgtcag

SEQ ID NO: 7887266 - DNA, 22 bp, Homo sapiens
aagtcattctatttctctatgt

SEQ ID NO: 7887267 - DNA, 22 bp, Homo sapiens
aagtcattggtagcttgatagg

SEQ ID NO: 7887268 - DNA, 22 bp, Homo sapiens
aagtccaccagtcagactagga

SEQ ID NO: 7887269 - DNA, 21 bp, Homo sapiens
aagtccaatacctaaggctcc

SEQ ID NO: 7887270 - DNA, 23 bp, Homo sapiens
aagtccacacgtagtgaaacagt

SEQ ID NO: 7887271 - DNA, 22 bp, Homo sapiens
aagtccaaggctgggtgcagtg

SEQ ID NO: 7887272 - DNA, 22 bp, Homo sapiens
aagtccaaggctgggtgcagtg

SEQ ID NO: 7887273 - DNA, 22 bp, Homo sapiens
aagtccaaggtcaccattcaca

SEQ ID NO: 7887274 - DNA, 22 bp, Homo sapiens
aagtccaaggtcaccattcaca

SEQ ID NO: 7887275 - DNA, 22 bp, Homo sapiens
aagtcattatctcttctaatct

SEQ ID NO: 7887276 - DNA, 22 bp, Homo sapiens
aagtcatgtggaagaataacct

SEQ ID NO: 7887277 - DNA, 22 bp, Homo sapiens
aagtcatcttgagtctaagatt

SEQ ID NO: 7887278 - DNA, 22 bp, Homo sapiens
aagtcatcttgagtctaagatt

SEQ ID NO: 7887279 - DNA, 22 bp, Homo sapiens
aagtcatgagtcctcttctgtg

SEQ ID NO: 7887280 - DNA, 22 bp, Homo sapiens
aagtcatcttgagtctaagatt

SEQ ID NO: 7887281 - DNA, 23 bp, Homo sapiens
aacagccacactgctgagattca

SEQ ID NO: 7887282 - DNA, 22 bp, Homo sapiens
aacagcatgctgggtaacattg

SEQ ID NO: 7887283 - DNA, 22 bp, Homo sapiens
aacagcatgctgggtaacattg

SEQ ID NO: 7887284 - DNA, 23 bp, Homo sapiens
aacagccacactgctgagattca

SEQ ID NO: 7887285 - DNA, 22 bp, Homo sapiens
aacagcctcagtgagattagga

SEQ ID NO: 7887286 - DNA, 23 bp, Homo sapiens
aacagccacactgctgagattca

SEQ ID NO: 7887287 - DNA, 22 bp, Homo sapiens
aacagccactgatactgaatag

SEQ ID NO: 7887288 - DNA, 22 bp, Homo sapiens
aacagcataccaatgtacatat

SEQ ID NO: 7887289 - DNA, 22 bp, Homo sapiens
aacagcagtggcaggagaaggc

SEQ ID NO: 7887290 - DNA, 22 bp, Homo sapiens
aacagcataccaatgtacatat

SEQ ID NO: 7887291 - DNA, 22 bp, Homo sapiens
aacagcataagtatttatttca

SEQ ID NO: 7887292 - DNA, 22 bp, Homo sapiens
aacagcataagtatttatttca

SEQ ID NO: 7887293 - DNA, 22 bp, Homo sapiens
aacagcagttacttttgcatca

SEQ ID NO: 7887294 - DNA, 22 bp, Homo sapiens
aacagcagtggcaggagaaggc

SEQ ID NO: 7887295 - DNA, 22 bp, Homo sapiens
aacagcatatttcatatattga

SEQ ID NO: 7887296 - DNA, 22 bp, Homo sapiens
aacagcatcaccccataacatt

SEQ ID NO: 7887297 - DNA, 22 bp, Homo sapiens
aacagcatcaccccataacatt

SEQ ID NO: 7887298 - DNA, 22 bp, Homo sapiens
aacagcatgctgggtaacattg

SEQ ID NO: 7887299 - DNA, 22 bp, Homo sapiens
aacagcagggatggggtggcca

SEQ ID NO: 7887300 - DNA, 22 bp, Homo sapiens
aacagcagggatggggtggcca

SEQ ID NO: 7887301 - DNA, 22 bp, Homo sapiens
aacagcagggatgacatggcca

SEQ ID NO: 7887302 - DNA, 22 bp, Homo sapiens
aacagcagggacttgaatggaa

SEQ ID NO: 7887303 - DNA, 22 bp, Homo sapiens
aacagcagggacttgaatggaa

SEQ ID NO: 7887304 - DNA, 22 bp, Homo sapiens
aacagcagggatgacatggcca

SEQ ID NO: 7887305 - DNA, 22 bp, Homo sapiens
aacagcagggatgacatggcca

SEQ ID NO: 7887306 - DNA, 23 bp, Homo sapiens
aacagcaggatgatagaggaggt

SEQ ID NO: 7887307 - DNA, 22 bp, Homo sapiens
aacagcagggacttgaatggaa

SEQ ID NO: 7887308 - DNA, 22 bp, Homo sapiens
aacagaggctccctgcacttgt

SEQ ID NO: 7887309 - DNA, 22 bp, Homo sapiens
aaggtctgagttttgccaggcc

SEQ ID NO: 7887310 - DNA, 22 bp, Homo sapiens
aaggtctctgttgagaacattt

SEQ ID NO: 7887311 - DNA, 22 bp, Homo sapiens
aaggtctggatgatgggtgtgc

SEQ ID NO: 7887312 - DNA, 22 bp, Homo sapiens
aaggtccttttgcagtgtgatc

SEQ ID NO: 7887313 - DNA, 22 bp, Homo sapiens
aaggtcctgtagccacagagcc

SEQ ID NO: 7887314 - DNA, 22 bp, Homo sapiens
aaggtccatgactcggcatagt

SEQ ID NO: 7887315 - DNA, 22 bp, Homo sapiens
aaggtctgagttttgccaggcc

SEQ ID NO: 7887316 - DNA, 22 bp, Homo sapiens
aacagcagctgcctgaatttgc

SEQ ID NO: 7887317 - DNA, 22 bp, Homo sapiens
aacagagtggagccaaactttg

SEQ ID NO: 7887318 - DNA, 22 bp, Homo sapiens
aacagcagctttcaggatcatc

SEQ ID NO: 7887319 - DNA, 22 bp, Homo sapiens
aacagcaggcaccaaggctatg

SEQ ID NO: 7887320 - DNA, 23 bp, Homo sapiens
aacagcaggatgatagaggaggt

SEQ ID NO: 7887321 - DNA, 22 bp, Homo sapiens
aacagcaggcaccaaggctatg

SEQ ID NO: 7887322 - DNA, 22 bp, Homo sapiens
aaggtcaagacacaggaatcta

SEQ ID NO: 7887323 - DNA, 22 bp, Homo sapiens
aaggtattttctaatgtatact

SEQ ID NO: 7887324 - DNA, 22 bp, Homo sapiens
aaggtattatttgcaatcattt

SEQ ID NO: 7887325 - DNA, 22 bp, Homo sapiens
aaggtatcagtaaagctctgcc

SEQ ID NO: 7887326 - DNA, 22 bp, Homo sapiens
aaggtatatgtacaatagacat

SEQ ID NO: 7887327 - DNA, 22 bp, Homo sapiens
aaggtattgttccctagtttct

SEQ ID NO: 7887328 - DNA, 22 bp, Homo sapiens
aaggtccagtggaaactagagt

SEQ ID NO: 7887329 - DNA, 22 bp, Homo sapiens
aaggtccagaggtcccgtcacc

SEQ ID NO: 7887330 - DNA, 20 bp, Homo sapiens
aaggtccaaactctgtgttc

SEQ ID NO: 7887331 - DNA, 20 bp, Homo sapiens
aaggtccaaactctgtgttc

SEQ ID NO: 7887332 - DNA, 22 bp, Homo sapiens
aaggtcattttttcctctgttg

SEQ ID NO: 7887333 - DNA, 22 bp, Homo sapiens
aaggtcatggcaaattactttt

SEQ ID NO: 7887334 - DNA, 22 bp, Homo sapiens
aaggtcatttaacaatttatga

SEQ ID NO: 7887335 - DNA, 22 bp, Homo sapiens
aaggtcattggttctgaattct

SEQ ID NO: 7887336 - DNA, 22 bp, Homo sapiens
aaggtcacttttattcctgaga

SEQ ID NO: 7887337 - DNA, 22 bp, Homo sapiens
aaggtcacttttattcctgaga

SEQ ID NO: 7887338 - DNA, 22 bp, Homo sapiens
aaggtcactgatcagttgagta

SEQ ID NO: 7887339 - DNA, 22 bp, Homo sapiens
aaggtcagagcaggaaggagtc

SEQ ID NO: 7887340 - DNA, 22 bp, Homo sapiens
aaggtcacttttattcctgaga

SEQ ID NO: 7887341 - DNA, 22 bp, Homo sapiens
aaggtcagagcaggaaggagtc

SEQ ID NO: 7887342 - DNA, 22 bp, Homo sapiens
aaggtcacacagtgattaagtg

SEQ ID NO: 7887343 - DNA, 22 bp, Homo sapiens
aaggtcacactcccagagctga

SEQ ID NO: 7887344 - DNA, 23 bp, Homo sapiens
aaggtcacagaacttagcaagcc

SEQ ID NO: 7887345 - DNA, 23 bp, Homo sapiens
aaggtcacagaacttagcaagcc

SEQ ID NO: 7887346 - DNA, 22 bp, Homo sapiens
aacactgaaatgtcttaagatt

SEQ ID NO: 7887347 - DNA, 22 bp, Homo sapiens
aacactgaaatgtcttaagatt

SEQ ID NO: 7887348 - DNA, 22 bp, Homo sapiens
aacactgaaatgtcttaagatt

SEQ ID NO: 7887349 - DNA, 22 bp, Homo sapiens
aacactgaaacattgattgaca

SEQ ID NO: 7887350 - DNA, 22 bp, Homo sapiens
aacactgaagaccaggtaattt

SEQ ID NO: 7887351 - DNA, 22 bp, Homo sapiens
aacactgaagccgttaaacctt

SEQ ID NO: 7887352 - DNA, 22 bp, Homo sapiens
aacactgaagtagtgaatactg

SEQ ID NO: 7887353 - DNA, 22 bp, Homo sapiens
aacactgaagtagtgaatactg

SEQ ID NO: 7887354 - DNA, 22 bp, Homo sapiens
aacactgaagtagtgaatactg

SEQ ID NO: 7887355 - DNA, 22 bp, Homo sapiens
aacactgacctctaccctcagt

SEQ ID NO: 7887356 - DNA, 22 bp, Homo sapiens
aacactgacctctaccctcagt

SEQ ID NO: 7887357 - DNA, 22 bp, Homo sapiens
aacactgacgacgtgaactaaa

SEQ ID NO: 7887358 - DNA, 22 bp, Homo sapiens
aacactgacgacgtgaactaaa

SEQ ID NO: 7887359 - DNA, 22 bp, Homo sapiens
aacactgagctattacggtgga

SEQ ID NO: 7887360 - DNA, 20 bp, Homo sapiens
aacactgaggcctactcttc

SEQ ID NO: 7887361 - DNA, 22 bp, Homo sapiens
aaggtatagagtttggaaaaat

SEQ ID NO: 7887362 - DNA, 22 bp, Homo sapiens
aaggtatagcttgcatacagaa

SEQ ID NO: 7887363 - DNA, 22 bp, Homo sapiens
aaggtatatgtacaatagacat

SEQ ID NO: 7887364 - DNA, 22 bp, Homo sapiens
aaggtatatctgatccatgagg

SEQ ID NO: 7887365 - DNA, 22 bp, Homo sapiens
aaggtatatgtacaatagacat

SEQ ID NO: 7887366 - DNA, 22 bp, Homo sapiens
aacactatctgccttacaggga

SEQ ID NO: 7887367 - DNA, 22 bp, Homo sapiens
aacactcaatttacaaactctg

SEQ ID NO: 7887368 - DNA, 22 bp, Homo sapiens
aacactaatgggagaacaaccc

SEQ ID NO: 7887369 - DNA, 22 bp, Homo sapiens
aacactaacatatagtcagtgg

SEQ ID NO: 7887370 - DNA, 22 bp, Homo sapiens
aacactctgagtatagaccact

SEQ ID NO: 7887371 - DNA, 22 bp, Homo sapiens
aacactctctgttggtaaggct

SEQ ID NO: 7887372 - DNA, 22 bp, Homo sapiens
aacactctgagtatagaccact

SEQ ID NO: 7887373 - DNA, 22 bp, Homo sapiens
aacactctctgttggtaaggct

SEQ ID NO: 7887374 - DNA, 22 bp, Homo sapiens
aacactgaaacattgattgaca

SEQ ID NO: 7887375 - DNA, 22 bp, Homo sapiens
aacactctctgttggtaaggct

SEQ ID NO: 7887376 - DNA, 22 bp, Homo sapiens
aacactctacgtgcagctccta

SEQ ID NO: 7887377 - DNA, 22 bp, Homo sapiens
aacactctctgttggtaaggct

SEQ ID NO: 7887378 - DNA, 19 bp, Homo sapiens
aacaccagagtcaggagtc

SEQ ID NO: 7887379 - DNA, 22 bp, Homo sapiens
aacacataggcagagcatgaca

SEQ ID NO: 7887380 - DNA, 22 bp, Homo sapiens
aacacctaaaaatcattgttga

SEQ ID NO: 7887381 - DNA, 22 bp, Homo sapiens
aacaccagtcccaagagaggct

SEQ ID NO: 7887382 - DNA, 22 bp, Homo sapiens
aacactaaaggtcagttagaag

SEQ ID NO: 7887383 - DNA, 22 bp, Homo sapiens
aacactaaaggtcagttagaag

SEQ ID NO: 7887384 - DNA, 22 bp, Homo sapiens
aacacatagacgtttgatatca

SEQ ID NO: 7887385 - DNA, 22 bp, Homo sapiens
aacacatagacgtttgatatca

SEQ ID NO: 7887386 - DNA, 22 bp, Homo sapiens
aacacatagacgtttgatatca

SEQ ID NO: 7887387 - DNA, 22 bp, Homo sapiens
aacaaatgtaaaatgcagatgc

SEQ ID NO: 7887388 - DNA, 22 bp, Homo sapiens
aacaaatgtaaaatgcagatgc

SEQ ID NO: 7887389 - DNA, 22 bp, Homo sapiens
aacaaatcttaaagtaattcaa

SEQ ID NO: 7887390 - DNA, 22 bp, Homo sapiens
aacaaatgacctgatttcttcc

SEQ ID NO: 7887391 - DNA, 22 bp, Homo sapiens
aacaaatgacctgatttcttcc

SEQ ID NO: 7887392 - DNA, 22 bp, Homo sapiens
aacaaatgacctgatttcttcc

SEQ ID NO: 7887393 - DNA, 22 bp, Homo sapiens
aacaaatgacctgatttcttcc

SEQ ID NO: 7887394 - DNA, 22 bp, Homo sapiens
aacaaatgacctgatttcttcc

SEQ ID NO: 7887395 - DNA, 22 bp, Homo sapiens
aacaaagtttcaggaagataga

SEQ ID NO: 7887396 - DNA, 22 bp, Homo sapiens
aacaaagtttcaggaagataga

SEQ ID NO: 7887397 - DNA, 22 bp, Homo sapiens
aacaaagtgtacttccatactg

SEQ ID NO: 7887398 - DNA, 22 bp, Homo sapiens
aacaaagtttcaggaagataga

SEQ ID NO: 7887399 - DNA, 22 bp, Homo sapiens
aacaaagtttcaggaagataga

SEQ ID NO: 7887400 - DNA, 22 bp, Homo sapiens
aacaaagtttcaggaagataga

SEQ ID NO: 7887401 - DNA, 22 bp, Homo sapiens
aacaaatggggccttgtatgaa

SEQ ID NO: 7887402 - DNA, 22 bp, Homo sapiens
aacaaatggggccttgtatgaa

SEQ ID NO: 7887403 - DNA, 22 bp, Homo sapiens
aacaaatggggccttgtatgaa

SEQ ID NO: 7887404 - DNA, 22 bp, Homo sapiens
aacaaatggaacacaaatcttt

SEQ ID NO: 7887405 - DNA, 22 bp, Homo sapiens
aacaaatggaacacaaatcttt

SEQ ID NO: 7887406 - DNA, 22 bp, Homo sapiens
aacaaatgataccagttctcaa

SEQ ID NO: 7887407 - DNA, 22 bp, Homo sapiens
aacaaatgattgttggttggag

SEQ ID NO: 7887408 - DNA, 22 bp, Homo sapiens
aacaaatgattgttggttggag

SEQ ID NO: 7887409 - DNA, 22 bp, Homo sapiens
aacaaatgataccagttctcaa

SEQ ID NO: 7887410 - DNA, 22 bp, Homo sapiens
aacaaatgataccagttctcaa

SEQ ID NO: 7887411 - DNA, 22 bp, Homo sapiens
aacaaatgataccagttctcaa

SEQ ID NO: 7887412 - DNA, 22 bp, Homo sapiens
aacaaatggaacacaaatcttt

SEQ ID NO: 7887413 - DNA, 22 bp, Homo sapiens
aacaaatggaacacaaatcttt

SEQ ID NO: 7887414 - DNA, 22 bp, Homo sapiens
aacaaatggaacacaaatcttt

SEQ ID NO: 7887415 - DNA, 22 bp, Homo sapiens
aacaaatggaacacaaatcttt

SEQ ID NO: 7887416 - DNA, 22 bp, Homo sapiens
aacaaatggaacacaaatcttt

SEQ ID NO: 7887417 - DNA, 22 bp, Homo sapiens
aacaaatggaacacaaatcttt

SEQ ID NO: 7887418 - DNA, 22 bp, Homo sapiens
aacaggcaatttaggactcttt

SEQ ID NO: 7887419 - DNA, 22 bp, Homo sapiens
aacaggcaatttaggactcttt

SEQ ID NO: 7887420 - DNA, 22 bp, Homo sapiens
aacaggcactaagcatgtgggg

SEQ ID NO: 7887421 - DNA, 22 bp, Homo sapiens
aacaggcactaagcatgtgggg

SEQ ID NO: 7887422 - DNA, 22 bp, Homo sapiens
aacaggcactaagcatgtgggg

SEQ ID NO: 7887423 - DNA, 22 bp, Homo sapiens
aacaggcaatttaggactcttt

SEQ ID NO: 7887424 - DNA, 22 bp, Homo sapiens
aacaggcaaactgtgggatccc

SEQ ID NO: 7887425 - DNA, 22 bp, Homo sapiens
aacaggcaacagttgactctga

SEQ ID NO: 7887426 - DNA, 22 bp, Homo sapiens
aacaggcaaactgtgggatccc

SEQ ID NO: 7887427 - DNA, 22 bp, Homo sapiens
aacaggcaacagttgactctga

SEQ ID NO: 7887428 - DNA, 22 bp, Homo sapiens
aacaggcaacagttgactctga

SEQ ID NO: 7887429 - DNA, 23 bp, Homo sapiens
aacaggatgtgcttcatcttttg

SEQ ID NO: 7887430 - DNA, 22 bp, Homo sapiens
aacaggagtcattgtcattatt

SEQ ID NO: 7887431 - DNA, 18 bp, Homo sapiens
aacaggatcctccacttc

SEQ ID NO: 7887432 - DNA, 22 bp, Homo sapiens
aacaggaattgcaggcagatct

SEQ ID NO: 7887433 - DNA, 22 bp, Homo sapiens
aacaggaattgatgggagtcct

SEQ ID NO: 7887434 - DNA, 22 bp, Homo sapiens
aacaggaattgcaggcagatct

SEQ ID NO: 7887435 - DNA, 22 bp, Homo sapiens
aacaggaccttccaatccatca

SEQ ID NO: 7887436 - DNA, 22 bp, Homo sapiens
aacaggagaggggaatgtagag

SEQ ID NO: 7887437 - DNA, 22 bp, Homo sapiens
aacaggagagtaaatatatgat

SEQ ID NO: 7887438 - DNA, 22 bp, Homo sapiens
aacaggagaggggaatgtagag

SEQ ID NO: 7887439 - DNA, 22 bp, Homo sapiens
aacaggagagtaaatatatgat

SEQ ID NO: 7887440 - DNA, 22 bp, Homo sapiens
aacaggagtcattgtcattatt

SEQ ID NO: 7887441 - DNA, 22 bp, Homo sapiens
aacaggaggccttccagtccag

SEQ ID NO: 7887442 - DNA, 22 bp, Homo sapiens
aacaggaggccttccagtccag

SEQ ID NO: 7887443 - DNA, 22 bp, Homo sapiens
aacaggcagcagactgaatctg

SEQ ID NO: 7887444 - DNA, 22 bp, Homo sapiens
aacaggcagcagactgaatctg

SEQ ID NO: 7887445 - DNA, 22 bp, Homo sapiens
aacaggcaggagaattctgcct

SEQ ID NO: 7887446 - DNA, 22 bp, Homo sapiens
aacaggcctatagggaaggcgc

SEQ ID NO: 7887447 - DNA, 22 bp, Homo sapiens
aacaggctagttttaaagcata

SEQ ID NO: 7887448 - DNA, 20 bp, Homo sapiens
aacagggcagaagcggagac

SEQ ID NO: 7887449 - DNA, 20 bp, Homo sapiens
aacagggcagaagcggagac

SEQ ID NO: 7887450 - DNA, 22 bp, Homo sapiens
aacagggctttggaagtctccg

SEQ ID NO: 7887451 - DNA, 22 bp, Homo sapiens
aacaggcttttggaaagttaca

SEQ ID NO: 7887452 - DNA, 22 bp, Homo sapiens
aacagggacaaggatagagaaa

SEQ ID NO: 7887453 - DNA, 22 bp, Homo sapiens
aacagggacaaggatagagaaa

SEQ ID NO: 7887454 - DNA, 22 bp, Homo sapiens
aacaggctggccttgaagcagt

SEQ ID NO: 7887455 - DNA, 22 bp, Homo sapiens
aacaggcttccaggagggacga

SEQ ID NO: 7887456 - DNA, 22 bp, Homo sapiens
aacatgcatttgtgggatggaa

SEQ ID NO: 7887457 - DNA, 22 bp, Homo sapiens
aacatgctatgtgtctgaatca

SEQ ID NO: 7887458 - DNA, 18 bp, Homo sapiens
aacatgcattagaactgc

SEQ ID NO: 7887459 - DNA, 18 bp, Homo sapiens
aacatgcattagaactgc

SEQ ID NO: 7887460 - DNA, 22 bp, Homo sapiens
aacatgcatgaagaagttatat

SEQ ID NO: 7887461 - DNA, 22 bp, Homo sapiens
aacatgcatgaagaagttatat

SEQ ID NO: 7887462 - DNA, 18 bp, Homo sapiens
aacatgcattagaactgc

SEQ ID NO: 7887463 - DNA, 18 bp, Homo sapiens
aacatgcattagaactgc

SEQ ID NO: 7887464 - DNA, 22 bp, Homo sapiens
aacatgcatgttatttatcagt

SEQ ID NO: 7887465 - DNA, 22 bp, Homo sapiens
aacatgcatgttatttatcagt

SEQ ID NO: 7887466 - DNA, 22 bp, Homo sapiens
aacatgctcttcctggctagtc

SEQ ID NO: 7887467 - DNA, 22 bp, Homo sapiens
aacatgctctgtttcttggatg

SEQ ID NO: 7887468 - DNA, 22 bp, Homo sapiens
aacatgctctgtttcttggatg

SEQ ID NO: 7887469 - DNA, 22 bp, Homo sapiens
aacatgctgcctttctacgagt

SEQ ID NO: 7887470 - DNA, 22 bp, Homo sapiens
aacatgcttgcttagaatcagc

SEQ ID NO: 7887471 - DNA, 22 bp, Homo sapiens
aacatgctgcctttctacgagt

SEQ ID NO: 7887472 - DNA, 22 bp, Homo sapiens
aacatgctcttcctggctagtc

SEQ ID NO: 7887473 - DNA, 22 bp, Homo sapiens
aacatgctgcctttctacgagt

SEQ ID NO: 7887474 - DNA, 22 bp, Homo sapiens
aacatgcatataggtaaatgga

SEQ ID NO: 7887475 - DNA, 22 bp, Homo sapiens
aacatgcatataggtaaatgga

SEQ ID NO: 7887476 - DNA, 22 bp, Homo sapiens
aacatgcagtgagccgatgagg

SEQ ID NO: 7887477 - DNA, 22 bp, Homo sapiens
aacatgcaggttttagggttgc

SEQ ID NO: 7887478 - DNA, 22 bp, Homo sapiens
aacatgcaggttttagggttgc

SEQ ID NO: 7887479 - DNA, 22 bp, Homo sapiens
aacatgcagattccccgggccc

SEQ ID NO: 7887480 - DNA, 22 bp, Homo sapiens
aacagtaaagacagaatttatc

SEQ ID NO: 7887481 - DNA, 22 bp, Homo sapiens
aacatgaaaagcccagagaggt

SEQ ID NO: 7887482 - DNA, 22 bp, Homo sapiens
aacagtaaagacagaatttatc

SEQ ID NO: 7887483 - DNA, 22 bp, Homo sapiens
aacagtaaaaatcatttagttg

SEQ ID NO: 7887484 - DNA, 22 bp, Homo sapiens
aacatgcacatcatagctcgtg

SEQ ID NO: 7887485 - DNA, 22 bp, Homo sapiens
aacatgaaacccaaacagaata

SEQ ID NO: 7887486 - DNA, 22 bp, Homo sapiens
aacagtaaaaatcatttagttg

SEQ ID NO: 7887487 - DNA, 22 bp, Homo sapiens
aacagtaaaaatcatttagttg

SEQ ID NO: 7887488 - DNA, 22 bp, Homo sapiens
aacagtaaaaatcatttagttg

SEQ ID NO: 7887489 - DNA, 22 bp, Homo sapiens
aacagtaaaaatcatttagttg

SEQ ID NO: 7887490 - DNA, 22 bp, Homo sapiens
aacaggggtgggtgctactgga

SEQ ID NO: 7887491 - DNA, 22 bp, Homo sapiens
aacaggggtgggtgctactgga

SEQ ID NO: 7887492 - DNA, 20 bp, Homo sapiens
aacagggggctgcagagggc

SEQ ID NO: 7887493 - DNA, 20 bp, Homo sapiens
aacagggggctgcagagggc

SEQ ID NO: 7887494 - DNA, 20 bp, Homo sapiens
aacagggggctgcagagggc

SEQ ID NO: 7887495 - DNA, 20 bp, Homo sapiens
aacagggggctgcagagggc

SEQ ID NO: 7887496 - DNA, 20 bp, Homo sapiens
aacagggcagaagcggagac

SEQ ID NO: 7887497 - DNA, 22 bp, Homo sapiens
aacaggggattagatagcaggc

SEQ ID NO: 7887498 - DNA, 22 bp, Homo sapiens
aacaggggattagatagcaggc

SEQ ID NO: 7887499 - DNA, 22 bp, Homo sapiens
aacaggggctggttgaaagagc

SEQ ID NO: 7887500 - DNA, 22 bp, Homo sapiens
aatataaattcctgggcccagc

SEQ ID NO: 7887501 - DNA, 22 bp, Homo sapiens
aatagtttgaatttatcagatg

SEQ ID NO: 7887502 - DNA, 22 bp, Homo sapiens
aatataaattcctgggcccagc

SEQ ID NO: 7887503 - DNA, 22 bp, Homo sapiens
aatataaattcctgggcccagc

SEQ ID NO: 7887504 - DNA, 22 bp, Homo sapiens
aatataaattcctgggcccagc

SEQ ID NO: 7887505 - DNA, 22 bp, Homo sapiens
aatataaattcctgggcccagc

SEQ ID NO: 7887506 - DNA, 22 bp, Homo sapiens
aatagtttgaatttatcagatg

SEQ ID NO: 7887507 - DNA, 22 bp, Homo sapiens
aatagtttgaatttatcagatg

SEQ ID NO: 7887508 - DNA, 22 bp, Homo sapiens
aatagtttgaatttatcagatg

SEQ ID NO: 7887509 - DNA, 22 bp, Homo sapiens
aatagttgtgaatcaggactag

SEQ ID NO: 7887510 - DNA, 22 bp, Homo sapiens
aatagtttgaatttatcagatg

SEQ ID NO: 7887511 - DNA, 22 bp, Homo sapiens
aatagttctagctcagaagctc

SEQ ID NO: 7887512 - DNA, 21 bp, Homo sapiens
aaccagagccaggctctcagc

SEQ ID NO: 7887513 - DNA, 21 bp, Homo sapiens
aaccagagccaggctctcagc

SEQ ID NO: 7887514 - DNA, 21 bp, Homo sapiens
aaccagagccaggctctcagc

SEQ ID NO: 7887515 - DNA, 22 bp, Homo sapiens
aaccagactctccaaaggcaaa

SEQ ID NO: 7887516 - DNA, 22 bp, Homo sapiens
aaccagaggcagcagtacctga

SEQ ID NO: 7887517 - DNA, 22 bp, Homo sapiens
aaccagaggggccctgcctggg

SEQ ID NO: 7887518 - DNA, 22 bp, Homo sapiens
aatagtgcttttgtacatagga

SEQ ID NO: 7887519 - DNA, 22 bp, Homo sapiens
aatagttagcttagttctgtat

SEQ ID NO: 7887520 - DNA, 22 bp, Homo sapiens
aatagttaagcaactttttcca

SEQ ID NO: 7887521 - DNA, 22 bp, Homo sapiens
aatagttaagcaactttttcca

SEQ ID NO: 7887522 - DNA, 22 bp, Homo sapiens
aaccaacataggaatgcagaga

SEQ ID NO: 7887523 - DNA, 21 bp, Homo sapiens
aaccaagccagccagcctctc

SEQ ID NO: 7887524 - DNA, 22 bp, Homo sapiens
aaccaagagggttttccttgaa

SEQ ID NO: 7887525 - DNA, 20 bp, Homo sapiens
aaccaacagaatcatgtctc

SEQ ID NO: 7887526 - DNA, 22 bp, Homo sapiens
aaccaattaatagataggaaac

SEQ ID NO: 7887527 - DNA, 22 bp, Homo sapiens
aaccaagctcaatggtctgagt

SEQ ID NO: 7887528 - DNA, 22 bp, Homo sapiens
aaccaaggacagctagtgatgc

SEQ ID NO: 7887529 - DNA, 22 bp, Homo sapiens
aaccacagagccccctcagatg

SEQ ID NO: 7887530 - DNA, 22 bp, Homo sapiens
aaccacagagccccctcagatg

SEQ ID NO: 7887531 - DNA, 22 bp, Homo sapiens
aaccacagacccagactagaga

SEQ ID NO: 7887532 - DNA, 22 bp, Homo sapiens
aaccacaacactaaatgctggt

SEQ ID NO: 7887533 - DNA, 22 bp, Homo sapiens
aaccaccattctctcctcttcc

SEQ ID NO: 7887534 - DNA, 22 bp, Homo sapiens
aaccaccattctctcctcttcc

SEQ ID NO: 7887535 - DNA, 22 bp, Homo sapiens
aaccaccattctctcctcttcc

SEQ ID NO: 7887536 - DNA, 22 bp, Homo sapiens
aaccaccattctctcctcttcc

SEQ ID NO: 7887537 - DNA, 22 bp, Homo sapiens
aaccaccaccgtaatttaccca

SEQ ID NO: 7887538 - DNA, 22 bp, Homo sapiens
aaccacatggctcagtggacat

SEQ ID NO: 7887539 - DNA, 22 bp, Homo sapiens
aaccactggctctaacattttg

SEQ ID NO: 7887540 - DNA, 22 bp, Homo sapiens
aaccaccattctctcctcttcc

SEQ ID NO: 7887541 - DNA, 22 bp, Homo sapiens
aaccactggtctgaggtacaag

SEQ ID NO: 7887542 - DNA, 22 bp, Homo sapiens
aaccactggtctgaggtacaag

SEQ ID NO: 7887543 - DNA, 22 bp, Homo sapiens
aaccactggtctgaggtacaag

SEQ ID NO: 7887544 - DNA, 22 bp, Homo sapiens
aaccagaaggaatctgagctga

SEQ ID NO: 7887545 - DNA, 22 bp, Homo sapiens
aaccagaaggaatctgagctga

SEQ ID NO: 7887546 - DNA, 22 bp, Homo sapiens
aataagaactccatttactcgt

SEQ ID NO: 7887547 - DNA, 21 bp, Homo sapiens
aacatttcaggatccaaattg

SEQ ID NO: 7887548 - DNA, 21 bp, Homo sapiens
aacatttcaggatccaaattg

SEQ ID NO: 7887549 - DNA, 21 bp, Homo sapiens
aacatttcaggatccaaattg

SEQ ID NO: 7887550 - DNA, 22 bp, Homo sapiens
aacatttttaagaccaagtgct

SEQ ID NO: 7887551 - DNA, 22 bp, Homo sapiens
aacatttttaagaccaagtgct

SEQ ID NO: 7887552 - DNA, 22 bp, Homo sapiens
aacatttttaagaccaagtgct

SEQ ID NO: 7887553 - DNA, 22 bp, Homo sapiens
aacatttcataacttgactttt

SEQ ID NO: 7887554 - DNA, 22 bp, Homo sapiens
aacatttttaagaccaagtgct

SEQ ID NO: 7887555 - DNA, 22 bp, Homo sapiens
aaccaacaggagtggggattgg

SEQ ID NO: 7887556 - DNA, 22 bp, Homo sapiens
aaccaaatggatggtaagaggg

SEQ ID NO: 7887557 - DNA, 22 bp, Homo sapiens
aaccaaaggaacctgattttct

SEQ ID NO: 7887558 - DNA, 22 bp, Homo sapiens
aaccaaaggaacctgattttct

SEQ ID NO: 7887559 - DNA, 22 bp, Homo sapiens
aaccaaatggatggtaagaggg

SEQ ID NO: 7887560 - DNA, 22 bp, Homo sapiens
aacatttttaagaccaagtgct

SEQ ID NO: 7887561 - DNA, 22 bp, Homo sapiens
aaccaaagaaaactgtggtgag

SEQ ID NO: 7887562 - DNA, 22 bp, Homo sapiens
aataagaactccatttactcgt

SEQ ID NO: 7887563 - DNA, 22 bp, Homo sapiens
aataagaactccatttactcgt

SEQ ID NO: 7887564 - DNA, 22 bp, Homo sapiens
aataagaactccatttactcgt

SEQ ID NO: 7887565 - DNA, 22 bp, Homo sapiens
aataagaactccatttactcgt

SEQ ID NO: 7887566 - DNA, 22 bp, Homo sapiens
aataagaactccatttactcgt

SEQ ID NO: 7887567 - DNA, 22 bp, Homo sapiens
aataagaactccatttactcgt

SEQ ID NO: 7887568 - DNA, 22 bp, Homo sapiens
aataacttttaaaagaccctgg

SEQ ID NO: 7887569 - DNA, 22 bp, Homo sapiens
aataagaacaactaaggtttat

SEQ ID NO: 7887570 - DNA, 22 bp, Homo sapiens
aataagaactccatttactcgt

SEQ ID NO: 7887571 - DNA, 22 bp, Homo sapiens
aataagaacaactaaggtttat

SEQ ID NO: 7887572 - DNA, 22 bp, Homo sapiens
aataagaacaactaaggtttat

SEQ ID NO: 7887573 - DNA, 22 bp, Homo sapiens
aataagaacaactaaggtttat

SEQ ID NO: 7887574 - DNA, 22 bp, Homo sapiens
aataagaacaactaaggtttat

SEQ ID NO: 7887575 - DNA, 22 bp, Homo sapiens
aataagaaagagtcagcttcag

SEQ ID NO: 7887576 - DNA, 22 bp, Homo sapiens
aataagaaagagtcagcttcag

SEQ ID NO: 7887577 - DNA, 22 bp, Homo sapiens
aataagaaagagtcagcttcag

SEQ ID NO: 7887578 - DNA, 22 bp, Homo sapiens
aataacttttaaaagaccctgg

SEQ ID NO: 7887579 - DNA, 22 bp, Homo sapiens
aataagaaagagtcagcttcag

SEQ ID NO: 7887580 - DNA, 22 bp, Homo sapiens
aataacttttaaaagaccctgg

SEQ ID NO: 7887581 - DNA, 22 bp, Homo sapiens
aataagaaagagtcagcttcag

SEQ ID NO: 7887582 - DNA, 22 bp, Homo sapiens
aataacttcatcttcaggatag

SEQ ID NO: 7887583 - DNA, 22 bp, Homo sapiens
aataacttcatgtaacatttaa

SEQ ID NO: 7887584 - DNA, 22 bp, Homo sapiens
aataacttcatgtaacatttaa

SEQ ID NO: 7887585 - DNA, 22 bp, Homo sapiens
aataacttcatgtaacatttaa

SEQ ID NO: 7887586 - DNA, 22 bp, Homo sapiens
aataacttcatgtaacatttaa

SEQ ID NO: 7887587 - DNA, 22 bp, Homo sapiens
aataacttgaagatctcttcca

SEQ ID NO: 7887588 - DNA, 22 bp, Homo sapiens
aataacttgaagatctcttcca

SEQ ID NO: 7887589 - DNA, 22 bp, Homo sapiens
aataacttgtatggttattcca

SEQ ID NO: 7887590 - DNA, 22 bp, Homo sapiens
aataacttcagttcttacatta

SEQ ID NO: 7887591 - DNA, 22 bp, Homo sapiens
aataacttcagttcttacatta

SEQ ID NO: 7887592 - DNA, 22 bp, Homo sapiens
aataacttcagttcttacatta

SEQ ID NO: 7887593 - DNA, 22 bp, Homo sapiens
aacatgtaaatatcattgtact

SEQ ID NO: 7887594 - DNA, 22 bp, Homo sapiens
aacatgtaaatatcattgtact

SEQ ID NO: 7887595 - DNA, 22 bp, Homo sapiens
aacatgtaaatatcattgtact

SEQ ID NO: 7887596 - DNA, 19 bp, Homo sapiens
aacatggaactggagaggg

SEQ ID NO: 7887597 - DNA, 22 bp, Homo sapiens
aactgttctacccttcatttca

SEQ ID NO: 7887598 - DNA, 22 bp, Homo sapiens
aactgttccttaagatgttaat

SEQ ID NO: 7887599 - DNA, 22 bp, Homo sapiens
aactgttacatagttatagatc

SEQ ID NO: 7887600 - DNA, 22 bp, Homo sapiens
aactgttcttgtgtttgctatg

SEQ ID NO: 7887601 - DNA, 22 bp, Homo sapiens
aactgttcttcattttcagtat

SEQ ID NO: 7887602 - DNA, 19 bp, Homo sapiens
aactgtaaagatctgtagc

SEQ ID NO: 7887603 - DNA, 22 bp, Homo sapiens
aactgtgtggtatacctgtgat

SEQ ID NO: 7887604 - DNA, 19 bp, Homo sapiens
aactgtaaagatctgtagc

SEQ ID NO: 7887605 - DNA, 22 bp, Homo sapiens
aactgtttatgtaagtatgcag

SEQ ID NO: 7887606 - DNA, 22 bp, Homo sapiens
aactgttgtcatatggtcttaa

SEQ ID NO: 7887607 - DNA, 22 bp, Homo sapiens
aactgttggaggattattttgc

SEQ ID NO: 7887608 - DNA, 22 bp, Homo sapiens
aactgttggaggattattttgc

SEQ ID NO: 7887609 - DNA, 18 bp, Homo sapiens
aactgttgaaatagcttg

SEQ ID NO: 7887610 - DNA, 22 bp, Homo sapiens
aacttaggaaaataaggcatga

SEQ ID NO: 7887611 - DNA, 22 bp, Homo sapiens
aacttagttaagattaagtctc

SEQ ID NO: 7887612 - DNA, 22 bp, Homo sapiens
aacttacgataatgttaaatgg

SEQ ID NO: 7887613 - DNA, 22 bp, Homo sapiens
aacttagagctctcctaaatga

SEQ ID NO: 7887614 - DNA, 22 bp, Homo sapiens
aacttagacttgtttcttggta

SEQ ID NO: 7887615 - DNA, 23 bp, Homo sapiens
aacttaccaaccaatacttggta

SEQ ID NO: 7887616 - DNA, 22 bp, Homo sapiens
aacttaccagctgtgcactgaa

SEQ ID NO: 7887617 - DNA, 22 bp, Homo sapiens
aacttacaatgttagagtctca

SEQ ID NO: 7887618 - DNA, 22 bp, Homo sapiens
aacttacaaggatgatagctgc

SEQ ID NO: 7887619 - DNA, 22 bp, Homo sapiens
aacttacaaggatgatagctgc

SEQ ID NO: 7887620 - DNA, 23 bp, Homo sapiens
aacttaatactgggataagatgc

SEQ ID NO: 7887621 - DNA, 22 bp, Homo sapiens
aacttacaaggatgatagctgc

SEQ ID NO: 7887622 - DNA, 22 bp, Homo sapiens
aactgttttttactagaggact

SEQ ID NO: 7887623 - DNA, 22 bp, Homo sapiens
aacttaaacccactcatgtaga

SEQ ID NO: 7887624 - DNA, 22 bp, Homo sapiens
aacttaaacaagctcccaagtt

SEQ ID NO: 7887625 - DNA, 22 bp, Homo sapiens
aacttaaacccactcatgtaga

SEQ ID NO: 7887626 - DNA, 22 bp, Homo sapiens
aacttaaacccactcatgtaga

SEQ ID NO: 7887627 - DNA, 22 bp, Homo sapiens
aacttaaacccactcatgtaga

SEQ ID NO: 7887628 - DNA, 22 bp, Homo sapiens
aacttaagaggttaagggcttg

SEQ ID NO: 7887629 - DNA, 22 bp, Homo sapiens
aacttaagtgtgaagagactct

SEQ ID NO: 7887630 - DNA, 22 bp, Homo sapiens
aactgcttagtgatggatgacc

SEQ ID NO: 7887631 - DNA, 22 bp, Homo sapiens
aactgcttatctttggtagatg

SEQ ID NO: 7887632 - DNA, 22 bp, Homo sapiens
aactgcttcacttggcatttgg

SEQ ID NO: 7887633 - DNA, 22 bp, Homo sapiens
aatgatacatatgtatcgttag

SEQ ID NO: 7887634 - DNA, 22 bp, Homo sapiens
aatgatacatatgtatcgttag

SEQ ID NO: 7887635 - DNA, 22 bp, Homo sapiens
aatgataccaaacatgtagata

SEQ ID NO: 7887636 - DNA, 22 bp, Homo sapiens
aatgataccgccaatattacca

SEQ ID NO: 7887637 - DNA, 22 bp, Homo sapiens
aatgataccgccaatattacca

SEQ ID NO: 7887638 - DNA, 22 bp, Homo sapiens
aatgataccgccaatattacca

SEQ ID NO: 7887639 - DNA, 22 bp, Homo sapiens
aatgataccgccaatattacca

SEQ ID NO: 7887640 - DNA, 22 bp, Homo sapiens
aactgctctgcatgcaatggaa

SEQ ID NO: 7887641 - DNA, 22 bp, Homo sapiens
aactgctgacaagtgaccagtg

SEQ ID NO: 7887642 - DNA, 22 bp, Homo sapiens
aactgctggggaggccaaactc

SEQ ID NO: 7887643 - DNA, 22 bp, Homo sapiens
aactgctcatttgagagtatgc

SEQ ID NO: 7887644 - DNA, 22 bp, Homo sapiens
aactgctgcatcttagaatgca

SEQ ID NO: 7887645 - DNA, 22 bp, Homo sapiens
aactgcttagtgatggatgacc

SEQ ID NO: 7887646 - DNA, 22 bp, Homo sapiens
aactgctgtggcctagtactta

SEQ ID NO: 7887647 - DNA, 22 bp, Homo sapiens
aactgcatttgcataagtccat

SEQ ID NO: 7887648 - DNA, 20 bp, Homo sapiens
aactgcctgcccagaggtgg

SEQ ID NO: 7887649 - DNA, 22 bp, Homo sapiens
aactgcctcaggtcatatatca

SEQ ID NO: 7887650 - DNA, 22 bp, Homo sapiens
aactgcctcaggtcatatatca

SEQ ID NO: 7887651 - DNA, 22 bp, Homo sapiens
aactgcctggccaggctgcaac

SEQ ID NO: 7887652 - DNA, 22 bp, Homo sapiens
aactgcctgtaaaatcttgggt

SEQ ID NO: 7887653 - DNA, 22 bp, Homo sapiens
aactgctagattgttattcaag

SEQ ID NO: 7887654 - DNA, 22 bp, Homo sapiens
aactgctaagcaaagaagcagg

SEQ ID NO: 7887655 - DNA, 22 bp, Homo sapiens
aactgctaactggtttgatact

SEQ ID NO: 7887656 - DNA, 22 bp, Homo sapiens
aatgatcattataaagtgctct

SEQ ID NO: 7887657 - DNA, 20 bp, Homo sapiens
aatgatcagcatagcaagga

SEQ ID NO: 7887658 - DNA, 22 bp, Homo sapiens
aatgatcacctggtaaagagag

SEQ ID NO: 7887659 - DNA, 22 bp, Homo sapiens
aatgatcactgcagttgatgag

SEQ ID NO: 7887660 - DNA, 22 bp, Homo sapiens
aatgatcattataaagtgctct

SEQ ID NO: 7887661 - DNA, 22 bp, Homo sapiens
aatgatcattataaagtgctct

SEQ ID NO: 7887662 - DNA, 22 bp, Homo sapiens
aatgatcccatttagaaacaga

SEQ ID NO: 7887663 - DNA, 22 bp, Homo sapiens
aatgatatttattgaatagatg

SEQ ID NO: 7887664 - DNA, 22 bp, Homo sapiens
aatgatatttattgaatagatg

SEQ ID NO: 7887665 - DNA, 22 bp, Homo sapiens
aatgatcacctggtaaagagag

SEQ ID NO: 7887666 - DNA, 22 bp, Homo sapiens
aatgatatagcagacatagcct

SEQ ID NO: 7887667 - DNA, 22 bp, Homo sapiens
aatgatatgcaaattatcatca

SEQ ID NO: 7887668 - DNA, 22 bp, Homo sapiens
aatgatatgcaaattatcatca

SEQ ID NO: 7887669 - DNA, 22 bp, Homo sapiens
aatgatatgcaaattatcatca

SEQ ID NO: 7887670 - DNA, 22 bp, Homo sapiens
aatataatgctgttttatgcca

SEQ ID NO: 7887671 - DNA, 22 bp, Homo sapiens
aatataatgctgttttatgcca

SEQ ID NO: 7887672 - DNA, 22 bp, Homo sapiens
aatataaattcctgggcccagc

SEQ ID NO: 7887673 - DNA, 22 bp, Homo sapiens
aatataaattcctgggcccagc

SEQ ID NO: 7887674 - DNA, 22 bp, Homo sapiens
aatataatgctgttttatgcca

SEQ ID NO: 7887675 - DNA, 22 bp, Homo sapiens
aatataacacagatggcctgtt

SEQ ID NO: 7887676 - DNA, 20 bp, Homo sapiens
aatataattctctgaattta

SEQ ID NO: 7887677 - DNA, 22 bp, Homo sapiens
aatataatgctgttttatgcca

SEQ ID NO: 7887678 - DNA, 22 bp, Homo sapiens
aacgtccacgtcaggctctggg

SEQ ID NO: 7887679 - DNA, 22 bp, Homo sapiens
aacgtcttctctccaagtaaat

SEQ ID NO: 7887680 - DNA, 22 bp, Homo sapiens
aacggctgtggctggcggcagc

SEQ ID NO: 7887681 - DNA, 22 bp, Homo sapiens
aacggctgtggctggcggcagc

SEQ ID NO: 7887682 - DNA, 22 bp, Homo sapiens
aacggaattgtttcgtcaagca

SEQ ID NO: 7887683 - DNA, 22 bp, Homo sapiens
aactacagaatcatagaaaata

SEQ ID NO: 7887684 - DNA, 22 bp, Homo sapiens
aactacagaatcatagaaaata

SEQ ID NO: 7887685 - DNA, 22 bp, Homo sapiens
aactacaatatgtatgtatgta

SEQ ID NO: 7887686 - DNA, 22 bp, Homo sapiens
aactacaatatgtatgtatgta

SEQ ID NO: 7887687 - DNA, 22 bp, Homo sapiens
aatcataattttgtgaatgtag

SEQ ID NO: 7887688 - DNA, 22 bp, Homo sapiens
aatcataattttgtgaatgtag

SEQ ID NO: 7887689 - DNA, 22 bp, Homo sapiens
aactacattttacagaagatga

SEQ ID NO: 7887690 - DNA, 22 bp, Homo sapiens
aactacattttacagaagatga

SEQ ID NO: 7887691 - DNA, 22 bp, Homo sapiens
aactacattttacagaagatga

SEQ ID NO: 7887692 - DNA, 22 bp, Homo sapiens
aactacattgtcctttctgaag

SEQ ID NO: 7887693 - DNA, 22 bp, Homo sapiens
aactacattttacagaagatga

SEQ ID NO: 7887694 - DNA, 22 bp, Homo sapiens
aactacattgtcctttctgaag

SEQ ID NO: 7887695 - DNA, 22 bp, Homo sapiens
aactacatagaaattagtattt

SEQ ID NO: 7887696 - DNA, 22 bp, Homo sapiens
aactacatagaaattagtattt

SEQ ID NO: 7887697 - DNA, 22 bp, Homo sapiens
aactacagtgggcagaggcaat

SEQ ID NO: 7887698 - DNA, 22 bp, Homo sapiens
aactacatcaccctatttctgt

SEQ ID NO: 7887699 - DNA, 22 bp, Homo sapiens
aactacagctcttgtctttctg

SEQ ID NO: 7887700 - DNA, 22 bp, Homo sapiens
aactacagctcttgtctttctg

SEQ ID NO: 7887701 - DNA, 19 bp, Homo sapiens
aactacagcgcactgtcct

SEQ ID NO: 7887702 - DNA, 22 bp, Homo sapiens
aactacagcatctatacaaata

SEQ ID NO: 7887703 - DNA, 22 bp, Homo sapiens
aactacagcatctatacaaata

SEQ ID NO: 7887704 - DNA, 22 bp, Homo sapiens
aactacagcatctatacaaata

SEQ ID NO: 7887705 - DNA, 22 bp, Homo sapiens
aactacagtgggcagaggcaat

SEQ ID NO: 7887706 - DNA, 22 bp, Homo sapiens
aactacagtatgtccaaagaat

SEQ ID NO: 7887707 - DNA, 22 bp, Homo sapiens
aactacagtatgtccaaagaat

SEQ ID NO: 7887708 - DNA, 22 bp, Homo sapiens
aactacagtagtttgcccttct

SEQ ID NO: 7887709 - DNA, 22 bp, Homo sapiens
aatcatgacaggaatagaaggg

SEQ ID NO: 7887710 - DNA, 22 bp, Homo sapiens
aatcatgaaatatcagttcttt

SEQ ID NO: 7887711 - DNA, 22 bp, Homo sapiens
aatcatgacaggaatagaaggg

SEQ ID NO: 7887712 - DNA, 22 bp, Homo sapiens
aatcatcttcatcttacacaga

SEQ ID NO: 7887713 - DNA, 22 bp, Homo sapiens
aatcatcttcatcttacacaga

SEQ ID NO: 7887714 - DNA, 22 bp, Homo sapiens
aatcatcttcatcttacacaga

SEQ ID NO: 7887715 - DNA, 22 bp, Homo sapiens
aatcatctccgaaaaaagagta

SEQ ID NO: 7887716 - DNA, 22 bp, Homo sapiens
aatcatctccgaaaaaagagta

SEQ ID NO: 7887717 - DNA, 22 bp, Homo sapiens
aatcatcctgaagtcaataaag

SEQ ID NO: 7887718 - DNA, 21 bp, Homo sapiens
aatcatacaaaacatgtcagg

SEQ ID NO: 7887719 - DNA, 21 bp, Homo sapiens
aatcatacaaaacatgtcagg

SEQ ID NO: 7887720 - DNA, 21 bp, Homo sapiens
aatcatacaaaacatgtcagg

SEQ ID NO: 7887721 - DNA, 22 bp, Homo sapiens
aatcattgagacaaattagctt

SEQ ID NO: 7887722 - DNA, 22 bp, Homo sapiens
aatcattgagacaaattagctt

SEQ ID NO: 7887723 - DNA, 22 bp, Homo sapiens
aatccaatcctactcagaaagt

SEQ ID NO: 7887724 - DNA, 22 bp, Homo sapiens
aatcattgttcttcagatttga

SEQ ID NO: 7887725 - DNA, 22 bp, Homo sapiens
aatcattcttatttcacagcaa

SEQ ID NO: 7887726 - DNA, 22 bp, Homo sapiens
aatcattcttatttcacagcaa

SEQ ID NO: 7887727 - DNA, 22 bp, Homo sapiens
aatcattctcatgccagtttcc

SEQ ID NO: 7887728 - DNA, 22 bp, Homo sapiens
aatcatgtttacgtgacatgtc

SEQ ID NO: 7887729 - DNA, 22 bp, Homo sapiens
aatcatgtttacgtgacatgtc

SEQ ID NO: 7887730 - DNA, 22 bp, Homo sapiens
aatcatgtttcagatgagtttt

SEQ ID NO: 7887731 - DNA, 22 bp, Homo sapiens
aactgcagttaacaagtcttca

SEQ ID NO: 7887732 - DNA, 22 bp, Homo sapiens
aactgcattcagaaagctcact

SEQ ID NO: 7887733 - DNA, 22 bp, Homo sapiens
aactgcaattacttttgcacta

SEQ ID NO: 7887734 - DNA, 22 bp, Homo sapiens
aactgcaattacttttgcacca

SEQ ID NO: 7887735 - DNA, 22 bp, Homo sapiens
aactgcaatcacttttgcacca

SEQ ID NO: 7887736 - DNA, 22 bp, Homo sapiens
aatccacacatctggcatgtga

SEQ ID NO: 7887737 - DNA, 22 bp, Homo sapiens
aatccacacatctggcatgtga

SEQ ID NO: 7887738 - DNA, 22 bp, Homo sapiens
aactgaaacttaggaagtaatc

SEQ ID NO: 7887739 - DNA, 22 bp, Homo sapiens
aactgaaacgtatttttgagat

SEQ ID NO: 7887740 - DNA, 22 bp, Homo sapiens
aactgaaacttaggaagtaatc

SEQ ID NO: 7887741 - DNA, 22 bp, Homo sapiens
aactgcaagctctttactgcta

SEQ ID NO: 7887742 - DNA, 22 bp, Homo sapiens
ggctctgccacttcttggctgt

SEQ ID NO: 7887743 - DNA, 22 bp, Homo sapiens
ggctctgccacttcttggctgt

SEQ ID NO: 7887744 - DNA, 22 bp, Homo sapiens
ggctctgccacttcttggctgt

SEQ ID NO: 7887745 - DNA, 22 bp, Homo sapiens
ggctctgccatttcctagctgc

SEQ ID NO: 7887746 - DNA, 22 bp, Homo sapiens
ggctctgccatttcctagctgc

SEQ ID NO: 7887747 - DNA, 22 bp, Homo sapiens
ggctctgcccaggtggacagca

SEQ ID NO: 7887748 - DNA, 22 bp, Homo sapiens
ggctctgcccaggtggacagca

SEQ ID NO: 7887749 - DNA, 22 bp, Homo sapiens
ggctctgcctgcccagcagcac

SEQ ID NO: 7887750 - DNA, 22 bp, Homo sapiens
ggctctgcctgcctgagtgtcc

SEQ ID NO: 7887751 - DNA, 22 bp, Homo sapiens
ggctctgcctgcccagcagcac

SEQ ID NO: 7887752 - DNA, 22 bp, Homo sapiens
ggctctgcctgcctgagtgtcc

SEQ ID NO: 7887753 - DNA, 22 bp, Homo sapiens
ggctctgccgtgtgctcacatg

SEQ ID NO: 7887754 - DNA, 22 bp, Homo sapiens
ggctctgccgtgtgctcacatg

SEQ ID NO: 7887755 - DNA, 22 bp, Homo sapiens
ggctctgccgtgtgctcacatg

SEQ ID NO: 7887756 - DNA, 22 bp, Homo sapiens
ggctctgcctgcccagcagcac

SEQ ID NO: 7887757 - DNA, 22 bp, Homo sapiens
ggctctgccgtgtgctcacatg

SEQ ID NO: 7887758 - DNA, 22 bp, Homo sapiens
ggctctgagtttagaagggtgg

SEQ ID NO: 7887759 - DNA, 22 bp, Homo sapiens
ggctctgaggctatgctttaca

SEQ ID NO: 7887760 - DNA, 22 bp, Homo sapiens
ggctctgaggctatgctttaca

SEQ ID NO: 7887761 - DNA, 22 bp, Homo sapiens
ggctctgcaaaagtagatactt

SEQ ID NO: 7887762 - DNA, 22 bp, Homo sapiens
ggctctgcaaaagtagatactt

SEQ ID NO: 7887763 - DNA, 23 bp, Homo sapiens
ggctctgaggatggagctggtgg

SEQ ID NO: 7887764 - DNA, 22 bp, Homo sapiens
ggctctgacctcccaggcagtt

SEQ ID NO: 7887765 - DNA, 22 bp, Homo sapiens
ggctctgaattattcctgagtc

SEQ ID NO: 7887766 - DNA, 22 bp, Homo sapiens
ggctctgaattattcctgagtc

SEQ ID NO: 7887767 - DNA, 22 bp, Homo sapiens
ggctctgcatgtgagtgggtgg

SEQ ID NO: 7887768 - DNA, 22 bp, Homo sapiens
ggctctgcatgcaggttgtcag

SEQ ID NO: 7887769 - DNA, 22 bp, Homo sapiens
ggctctgcagtgacttgagggg

SEQ ID NO: 7887770 - DNA, 22 bp, Homo sapiens
ggctctgcatgcaggttgtcag

SEQ ID NO: 7887771 - DNA, 22 bp, Homo sapiens
ggctctgcagcttgctaactgt

SEQ ID NO: 7887772 - DNA, 22 bp, Homo sapiens
ggctctgcagagggcccagctt

SEQ ID NO: 7887773 - DNA, 22 bp, Homo sapiens
ggctctgcagagggcccagctt

SEQ ID NO: 7887774 - DNA, 22 bp, Homo sapiens
ggctctgaacatggggaggagt

SEQ ID NO: 7887775 - DNA, 22 bp, Homo sapiens
ggctctgaaggagacagctgct

SEQ ID NO: 7887776 - DNA, 22 bp, Homo sapiens
ggctctgaaggagacagctgct

SEQ ID NO: 7887777 - DNA, 22 bp, Homo sapiens
ggctctgaaggagacagctgct

SEQ ID NO: 7887778 - DNA, 22 bp, Homo sapiens
ggctctctggaggagctcaccc

SEQ ID NO: 7887779 - DNA, 22 bp, Homo sapiens
ggctctctccttggctttcaga

SEQ ID NO: 7887780 - DNA, 19 bp, Homo sapiens
ggctctcttaaagctgttt

SEQ ID NO: 7887781 - DNA, 22 bp, Homo sapiens
ggctctcttaactggccatcct

SEQ ID NO: 7887782 - DNA, 22 bp, Homo sapiens
ggctctcttaactggccatcct

SEQ ID NO: 7887783 - DNA, 22 bp, Homo sapiens
ggctcagattccgagtggccct

SEQ ID NO: 7887784 - DNA, 22 bp, Homo sapiens
ggctcagattccgagtggccct

SEQ ID NO: 7887785 - DNA, 22 bp, Homo sapiens
ggctcagattccgagtggccct

SEQ ID NO: 7887786 - DNA, 22 bp, Homo sapiens
ggctcagattccgagtggccct

SEQ ID NO: 7887787 - DNA, 22 bp, Homo sapiens
ggctcagattccgagtggccct

SEQ ID NO: 7887788 - DNA, 22 bp, Homo sapiens
ggctcagaggttgaggccggca

SEQ ID NO: 7887789 - DNA, 22 bp, Homo sapiens
ggctcagagttaggacccatgt

SEQ ID NO: 7887790 - DNA, 22 bp, Homo sapiens
ggctcagatggtttgttctaga

SEQ ID NO: 7887791 - DNA, 22 bp, Homo sapiens
ggctcagcaatgatgagcccct

SEQ ID NO: 7887792 - DNA, 22 bp, Homo sapiens
ggctcagattccgagtggccct

SEQ ID NO: 7887793 - DNA, 22 bp, Homo sapiens
ggctcagcaatgatgagcccct

SEQ ID NO: 7887794 - DNA, 22 bp, Homo sapiens
ggctcagcacagggctggcatc

SEQ ID NO: 7887795 - DNA, 22 bp, Homo sapiens
ggctcagcacagggctggcatc

SEQ ID NO: 7887796 - DNA, 22 bp, Homo sapiens
ggctcagcacagggctggcatc

SEQ ID NO: 7887797 - DNA, 22 bp, Homo sapiens
ggctcagcacagggctggcatc

SEQ ID NO: 7887798 - DNA, 22 bp, Homo sapiens
ggctcactttggggtcagctgg

SEQ ID NO: 7887799 - DNA, 22 bp, Homo sapiens
ggctcactttggggtcagctgg

SEQ ID NO: 7887800 - DNA, 23 bp, Homo sapiens
ggctcagaaaaagtcctggcctc

SEQ ID NO: 7887801 - DNA, 23 bp, Homo sapiens
ggctcagaaaaagtcctggcctc

SEQ ID NO: 7887802 - DNA, 22 bp, Homo sapiens
ggctcactgcaacttccgcctc

SEQ ID NO: 7887803 - DNA, 23 bp, Homo sapiens
ggctcagaaaaagtcctggcctc

SEQ ID NO: 7887804 - DNA, 22 bp, Homo sapiens
ggctcagaaacctctggtgtct

SEQ ID NO: 7887805 - DNA, 22 bp, Homo sapiens
ggctcagaaactaaaggcgctg

SEQ ID NO: 7887806 - DNA, 22 bp, Homo sapiens
ggctcagaaactaaaggcgctg

SEQ ID NO: 7887807 - DNA, 22 bp, Homo sapiens
ggctcagaaggccatgctctgc

SEQ ID NO: 7887808 - DNA, 22 bp, Homo sapiens
ggctcagaaactaaaggcgctg

SEQ ID NO: 7887809 - DNA, 22 bp, Homo sapiens
ggctcagaaggccatgctctgc

SEQ ID NO: 7887810 - DNA, 22 bp, Homo sapiens
ggctcagactcccaggccctct

SEQ ID NO: 7887811 - DNA, 22 bp, Homo sapiens
ggctcagactcccaggccctct

SEQ ID NO: 7887812 - DNA, 22 bp, Homo sapiens
ggctcagactcccaggccctct

SEQ ID NO: 7887813 - DNA, 22 bp, Homo sapiens
ggctcagagacctgcgatctga

SEQ ID NO: 7887814 - DNA, 22 bp, Homo sapiens
ggctcagagacctgcgatctga

SEQ ID NO: 7887815 - DNA, 22 bp, Homo sapiens
ggctcagacctcccagctccag

SEQ ID NO: 7887816 - DNA, 22 bp, Homo sapiens
ggctcagacctcccagctccag

SEQ ID NO: 7887817 - DNA, 22 bp, Homo sapiens
ggctcagacctcccagctccag

SEQ ID NO: 7887818 - DNA, 22 bp, Homo sapiens
ggctcagacctcccagctccag

SEQ ID NO: 7887819 - DNA, 22 bp, Homo sapiens
ggctcagaggagctggaacggt

SEQ ID NO: 7887820 - DNA, 22 bp, Homo sapiens
ggctcagaggagctggaacggt

SEQ ID NO: 7887821 - DNA, 22 bp, Homo sapiens
ggctcagaggagctggaacggt

SEQ ID NO: 7887822 - DNA, 22 bp, Homo sapiens
ggctcagaggccagcaggtaga

SEQ ID NO: 7887823 - DNA, 22 bp, Homo sapiens
ggctcagaggccagcaggtaga

SEQ ID NO: 7887824 - DNA, 22 bp, Homo sapiens
ggctcagaggccagcaggtaga

SEQ ID NO: 7887825 - DNA, 22 bp, Homo sapiens
ggctcagaggttgaggccggca

SEQ ID NO: 7887826 - DNA, 22 bp, Homo sapiens
ggctcagaggttgaggccggca

SEQ ID NO: 7887827 - DNA, 22 bp, Homo sapiens
ggctcagaggttgaggccggca

SEQ ID NO: 7887828 - DNA, 22 bp, Homo sapiens
ggcctctcttgggacagctgtc

SEQ ID NO: 7887829 - DNA, 22 bp, Homo sapiens
ggcctctcttgggacagctgtc

SEQ ID NO: 7887830 - DNA, 22 bp, Homo sapiens
ggcctctctggcatggctgccc

SEQ ID NO: 7887831 - DNA, 22 bp, Homo sapiens
ggcctctctggcatggctgccc

SEQ ID NO: 7887832 - DNA, 22 bp, Homo sapiens
ggcctctgaggacagccttggc

SEQ ID NO: 7887833 - DNA, 22 bp, Homo sapiens
ggcctctgaggacagccttggc

SEQ ID NO: 7887834 - DNA, 22 bp, Homo sapiens
ggcctctgaggacagccttggc

SEQ ID NO: 7887835 - DNA, 20 bp, Homo sapiens
ggcctctgaggacaaggaga

SEQ ID NO: 7887836 - DNA, 22 bp, Homo sapiens
ggcctctctgagagcagacgtt

SEQ ID NO: 7887837 - DNA, 22 bp, Homo sapiens
ggcctcctcaccctgctcaggc

SEQ ID NO: 7887838 - DNA, 22 bp, Homo sapiens
ggcctcctcaccctgctcaggc

SEQ ID NO: 7887839 - DNA, 21 bp, Homo sapiens
ggcctcctacagtcatgggcc

SEQ ID NO: 7887840 - DNA, 21 bp, Homo sapiens
ggcctcctacagtcatgggcc

SEQ ID NO: 7887841 - DNA, 21 bp, Homo sapiens
ggcctcctacagtcatgggcc

SEQ ID NO: 7887842 - DNA, 22 bp, Homo sapiens
ggcctcctcaccctgctcaggc

SEQ ID NO: 7887843 - DNA, 22 bp, Homo sapiens
ggcctcctcaccctgctcaggc

SEQ ID NO: 7887844 - DNA, 21 bp, Homo sapiens
ggcctcctacagtcatgggcc

SEQ ID NO: 7887845 - DNA, 22 bp, Homo sapiens
ggcctccatcttatcttactct

SEQ ID NO: 7887846 - DNA, 21 bp, Homo sapiens
ggcctcccggaccgcagcgcc

SEQ ID NO: 7887847 - DNA, 22 bp, Homo sapiens
ggcccatgcatcctgtgcagcc

SEQ ID NO: 7887848 - DNA, 22 bp, Homo sapiens
ggcctccaggcctactcagggc

SEQ ID NO: 7887849 - DNA, 22 bp, Homo sapiens
ggcctccaggcctactcagggc

SEQ ID NO: 7887850 - DNA, 22 bp, Homo sapiens
ggcctccatcttatcttactct

SEQ ID NO: 7887851 - DNA, 22 bp, Homo sapiens
ggcctctgcctcatctgggcac

SEQ ID NO: 7887852 - DNA, 22 bp, Homo sapiens
ggcctctgcctcatctgggcac

SEQ ID NO: 7887853 - DNA, 21 bp, Homo sapiens
ggcctctgccttgccccactc

SEQ ID NO: 7887854 - DNA, 21 bp, Homo sapiens
ggcctctgccttgccccactc

SEQ ID NO: 7887855 - DNA, 21 bp, Homo sapiens
ggcctctgccttgccccactc

SEQ ID NO: 7887856 - DNA, 22 bp, Homo sapiens
ggcctctgccccgcggggctcg

SEQ ID NO: 7887857 - DNA, 22 bp, Homo sapiens
ggcctctgccctcactcctgtc

SEQ ID NO: 7887858 - DNA, 22 bp, Homo sapiens
ggcctctgccctcactcctgtc

SEQ ID NO: 7887859 - DNA, 22 bp, Homo sapiens
ggcctctgccctcactcctgtc

SEQ ID NO: 7887860 - DNA, 22 bp, Homo sapiens
ggcctctgccccagccacacct

SEQ ID NO: 7887861 - DNA, 22 bp, Homo sapiens
ggcctctgccctcactcctgtc

SEQ ID NO: 7887862 - DNA, 22 bp, Homo sapiens
ggcctctgccctcactcctgtc

SEQ ID NO: 7887863 - DNA, 22 bp, Homo sapiens
ggcctctgcctcatctgggcac

SEQ ID NO: 7887864 - DNA, 22 bp, Homo sapiens
ggcctctgcaggcctcgacaag

SEQ ID NO: 7887865 - DNA, 19 bp, Homo sapiens
ggcctctgcaggccgcccc

SEQ ID NO: 7887866 - DNA, 22 bp, Homo sapiens
ggcctctgccccagccacacct

SEQ ID NO: 7887867 - DNA, 22 bp, Homo sapiens
ggcctctgccccagccacacct

SEQ ID NO: 7887868 - DNA, 22 bp, Homo sapiens
ggcctctgccccagccacacct

SEQ ID NO: 7887869 - DNA, 22 bp, Homo sapiens
ggcctctgcaactggctgtggc

SEQ ID NO: 7887870 - DNA, 22 bp, Homo sapiens
ggcctctgcaactggctgtggc

SEQ ID NO: 7887871 - DNA, 22 bp, Homo sapiens
ggcctctgcaactggctgtggc

SEQ ID NO: 7887872 - DNA, 22 bp, Homo sapiens
ggcctctgcaactggctgtggc

SEQ ID NO: 7887873 - DNA, 22 bp, Homo sapiens
ggcctctgcaactggctgtggc

SEQ ID NO: 7887874 - DNA, 19 bp, Homo sapiens
ggcctctgcaggccgcccc

SEQ ID NO: 7887875 - DNA, 19 bp, Homo sapiens
ggcctctgcaggccgcccc

SEQ ID NO: 7887876 - DNA, 22 bp, Homo sapiens
ggctcacgcaattatcccggcc

SEQ ID NO: 7887877 - DNA, 22 bp, Homo sapiens
ggctcacgcaattatcccggcc

SEQ ID NO: 7887878 - DNA, 22 bp, Homo sapiens
ggctcacgcaattatcccggcc

SEQ ID NO: 7887879 - DNA, 22 bp, Homo sapiens
ggctcacgcaattatcccggcc

SEQ ID NO: 7887880 - DNA, 22 bp, Homo sapiens
ggctcactgcaaactgtgcctc

SEQ ID NO: 7887881 - DNA, 22 bp, Homo sapiens
ggctcactgcaacttccgcctc

SEQ ID NO: 7887882 - DNA, 22 bp, Homo sapiens
ggctcactgcaacttccgcctc

SEQ ID NO: 7887883 - DNA, 22 bp, Homo sapiens
ggctcactgcaacttccgcctc

SEQ ID NO: 7887884 - DNA, 22 bp, Homo sapiens
ggctcactgcaacttccgcctc

SEQ ID NO: 7887885 - DNA, 22 bp, Homo sapiens
ggctcactgcaacttccgcctc

SEQ ID NO: 7887886 - DNA, 22 bp, Homo sapiens
ggctagggacacagctctgctc

SEQ ID NO: 7887887 - DNA, 23 bp, Homo sapiens
ggctcacacggagtgcctccacc

SEQ ID NO: 7887888 - DNA, 22 bp, Homo sapiens
ggctcaccatggcctccctgct

SEQ ID NO: 7887889 - DNA, 22 bp, Homo sapiens
ggctcacgcaattatcccggcc

SEQ ID NO: 7887890 - DNA, 22 bp, Homo sapiens
ggctcacgcaattatcccggcc

SEQ ID NO: 7887891 - DNA, 23 bp, Homo sapiens
ggctcacacggagtgcctccacc

SEQ ID NO: 7887892 - DNA, 22 bp, Homo sapiens
ggctcaccattttcactctctg

SEQ ID NO: 7887893 - DNA, 22 bp, Homo sapiens
ggctcaccatggcctccctgct

SEQ ID NO: 7887894 - DNA, 22 bp, Homo sapiens
ggctagggacacagctctgctc

SEQ ID NO: 7887895 - DNA, 22 bp, Homo sapiens
ggctagggacacagctctgctc

SEQ ID NO: 7887896 - DNA, 22 bp, Homo sapiens
ggctagggacacagctctgctc

SEQ ID NO: 7887897 - DNA, 22 bp, Homo sapiens
ggctagggacacagctctgctc

SEQ ID NO: 7887898 - DNA, 22 bp, Homo sapiens
ggctagggaaatcctgatccaa

SEQ ID NO: 7887899 - DNA, 22 bp, Homo sapiens
ggctagggaaaatgattggata

SEQ ID NO: 7887900 - DNA, 22 bp, Homo sapiens
ggctagggaaaatgattggata

SEQ ID NO: 7887901 - DNA, 22 bp, Homo sapiens
ggctagggaaaatgattggata

SEQ ID NO: 7887902 - DNA, 22 bp, Homo sapiens
ggcctctggcaggcaggccctc

SEQ ID NO: 7887903 - DNA, 22 bp, Homo sapiens
ggcctctggcaggcaggccctc

SEQ ID NO: 7887904 - DNA, 22 bp, Homo sapiens
ggcctctggcaggcaggccctc

SEQ ID NO: 7887905 - DNA, 22 bp, Homo sapiens
ggcctctggcaggcaggccctc

SEQ ID NO: 7887906 - DNA, 18 bp, Homo sapiens
ggcctctggactggcagc

SEQ ID NO: 7887907 - DNA, 22 bp, Homo sapiens
ggcctctggcaggcaggccctc

SEQ ID NO: 7887908 - DNA, 22 bp, Homo sapiens
ggcctctgcttatgctgatgac

SEQ ID NO: 7887909 - DNA, 22 bp, Homo sapiens
ggcctctgcttatgctgatgac

SEQ ID NO: 7887910 - DNA, 22 bp, Homo sapiens
ggcctctgcttatgctgatgac

SEQ ID NO: 7887911 - DNA, 22 bp, Homo sapiens
ggcctctgcttatgctgatgac

SEQ ID NO: 7887912 - DNA, 22 bp, Homo sapiens
ggcctctgcttatgctgatgac

SEQ ID NO: 7887913 - DNA, 18 bp, Homo sapiens
ggcctctggactggcagc

SEQ ID NO: 7887914 - DNA, 18 bp, Homo sapiens
ggcctctggactggcagc

SEQ ID NO: 7887915 - DNA, 18 bp, Homo sapiens
ggcctctggactggcagc

SEQ ID NO: 7887916 - DNA, 22 bp, Homo sapiens
ggctaggctcacctggagagtt

SEQ ID NO: 7887917 - DNA, 22 bp, Homo sapiens
ggctaggctcacctggagagtt

SEQ ID NO: 7887918 - DNA, 22 bp, Homo sapiens
ggcctctggttcacagggagga

SEQ ID NO: 7887919 - DNA, 22 bp, Homo sapiens
ggcctctggttcacagggagga

SEQ ID NO: 7887920 - DNA, 22 bp, Homo sapiens
ggcctctggttcacagggagga

SEQ ID NO: 7887921 - DNA, 22 bp, Homo sapiens
ggcctctggttcacagggagga

SEQ ID NO: 7887922 - DNA, 22 bp, Homo sapiens
ggcctctggttcacagggagga

SEQ ID NO: 7887923 - DNA, 22 bp, Homo sapiens
ggcctctggtgcctgaagcgcc

SEQ ID NO: 7887924 - DNA, 22 bp, Homo sapiens
ggcctctggggtcctgagccca

SEQ ID NO: 7887925 - DNA, 22 bp, Homo sapiens
ggcctctggggtcctgagccca

SEQ ID NO: 7887926 - DNA, 22 bp, Homo sapiens
ggcctctggggtcctgagccca

SEQ ID NO: 7887927 - DNA, 22 bp, Homo sapiens
ggcctctggggtcctgagccca

SEQ ID NO: 7887928 - DNA, 22 bp, Homo sapiens
ggcctctggtcaagacaagcat

SEQ ID NO: 7887929 - DNA, 22 bp, Homo sapiens
ggccacagggctgaacgtggac

SEQ ID NO: 7887930 - DNA, 22 bp, Homo sapiens
ggccacagggctgaacgtggac

SEQ ID NO: 7887931 - DNA, 22 bp, Homo sapiens
ggccacagggctgaacgtggac

SEQ ID NO: 7887932 - DNA, 20 bp, Homo sapiens
ggccacagggtgctggtgga

SEQ ID NO: 7887933 - DNA, 20 bp, Homo sapiens
ggccacagggtgctggtgga

SEQ ID NO: 7887934 - DNA, 20 bp, Homo sapiens
ggccacagggtgctggtgga

SEQ ID NO: 7887935 - DNA, 22 bp, Homo sapiens
ggccacagggctgaacgtggac

SEQ ID NO: 7887936 - DNA, 20 bp, Homo sapiens
ggccacagggtgctggtgga

SEQ ID NO: 7887937 - DNA, 20 bp, Homo sapiens
ggccacagggtgctggtgga

SEQ ID NO: 7887938 - DNA, 20 bp, Homo sapiens
ggccacagggtgctggtgga

SEQ ID NO: 7887939 - DNA, 20 bp, Homo sapiens
ggccacagggtgctggtgga

SEQ ID NO: 7887940 - DNA, 20 bp, Homo sapiens
ggccacagggtgctggtgga

SEQ ID NO: 7887941 - DNA, 22 bp, Homo sapiens
ggccacagtctctggaaggatg

SEQ ID NO: 7887942 - DNA, 20 bp, Homo sapiens
ggccacagggtgctggtgga

SEQ ID NO: 7887943 - DNA, 20 bp, Homo sapiens
ggccacagggtgctggtgga

SEQ ID NO: 7887944 - DNA, 22 bp, Homo sapiens
ggccacagtctctggaaggatg

SEQ ID NO: 7887945 - DNA, 22 bp, Homo sapiens
ggccacagtctctggaaggatg

SEQ ID NO: 7887946 - DNA, 22 bp, Homo sapiens
ggccacagtctctggaaggatg

SEQ ID NO: 7887947 - DNA, 22 bp, Homo sapiens
ggccacagtctctggaaggatg

SEQ ID NO: 7887948 - DNA, 22 bp, Homo sapiens
ggccacagcagatgcttcagat

SEQ ID NO: 7887949 - DNA, 22 bp, Homo sapiens
ggccacagcagatgcttcagat

SEQ ID NO: 7887950 - DNA, 22 bp, Homo sapiens
ggccacagcagatgcttcagat

SEQ ID NO: 7887951 - DNA, 22 bp, Homo sapiens
ggccacagcaatgctgtgatgt

SEQ ID NO: 7887952 - DNA, 22 bp, Homo sapiens
ggccacagcaatgctgtgatgt

SEQ ID NO: 7887953 - DNA, 22 bp, Homo sapiens
ggccacagcagatgcttcagat

SEQ ID NO: 7887954 - DNA, 22 bp, Homo sapiens
ggccacagagggcgggatgctg

SEQ ID NO: 7887955 - DNA, 22 bp, Homo sapiens
ggccacagagggcgggatgctg

SEQ ID NO: 7887956 - DNA, 22 bp, Homo sapiens
ggccacagcaatgctgtgatgt

SEQ ID NO: 7887957 - DNA, 22 bp, Homo sapiens
ggccacagcaatgctgtgatgt

SEQ ID NO: 7887958 - DNA, 22 bp, Homo sapiens
ggccacagcaatgctgtgatgt

SEQ ID NO: 7887959 - DNA, 22 bp, Homo sapiens
ggccacagcaatgctgtgatgt

SEQ ID NO: 7887960 - DNA, 22 bp, Homo sapiens
ggccacagagggcgggatgctg

SEQ ID NO: 7887961 - DNA, 22 bp, Homo sapiens
ggccacagagggcgggatgctg

SEQ ID NO: 7887962 - DNA, 22 bp, Homo sapiens
ggccacagagggcgggatgctg

SEQ ID NO: 7887963 - DNA, 22 bp, Homo sapiens
ggccacagagggcgggatgctg

SEQ ID NO: 7887964 - DNA, 17 bp, Homo sapiens
ggccacagagcttgggg

SEQ ID NO: 7887965 - DNA, 17 bp, Homo sapiens
ggccacagagcttgggg

SEQ ID NO: 7887966 - DNA, 17 bp, Homo sapiens
ggccacagagcttgggg

SEQ ID NO: 7887967 - DNA, 17 bp, Homo sapiens
ggccacagagcttgggg

SEQ ID NO: 7887968 - DNA, 17 bp, Homo sapiens
ggccacagagcttgggg

SEQ ID NO: 7887969 - DNA, 22 bp, Homo sapiens
ggcagtgggtggatctcaggga

SEQ ID NO: 7887970 - DNA, 17 bp, Homo sapiens
ggccacagagcttgggg

SEQ ID NO: 7887971 - DNA, 22 bp, Homo sapiens
ggcagtgggtggatctcaggga

SEQ ID NO: 7887972 - DNA, 22 bp, Homo sapiens
ggcagtgggaaataagtgagaa

SEQ ID NO: 7887973 - DNA, 22 bp, Homo sapiens
ggcagtggctgtagtctcttgg

SEQ ID NO: 7887974 - DNA, 22 bp, Homo sapiens
ggcagtgggaaataagtgagaa

SEQ ID NO: 7887975 - DNA, 22 bp, Homo sapiens
ggcagtgggaaataagtgagaa

SEQ ID NO: 7887976 - DNA, 22 bp, Homo sapiens
ggcagtggctcctctctactcc

SEQ ID NO: 7887977 - DNA, 22 bp, Homo sapiens
ggcagtggctgtagtctcttgg

SEQ ID NO: 7887978 - DNA, 22 bp, Homo sapiens
ggcagtggcatgtgggtagtgg

SEQ ID NO: 7887979 - DNA, 22 bp, Homo sapiens
ggcagtggcatgtgggtagtgg

SEQ ID NO: 7887980 - DNA, 22 bp, Homo sapiens
ggcagtggcatgtgggtagtgg

SEQ ID NO: 7887981 - DNA, 22 bp, Homo sapiens
ggcagtggctcctctctactcc

SEQ ID NO: 7887982 - DNA, 22 bp, Homo sapiens
ggcagtggctcctctctactcc

SEQ ID NO: 7887983 - DNA, 22 bp, Homo sapiens
ggcagtggcatgtgggtagtgg

SEQ ID NO: 7887984 - DNA, 22 bp, Homo sapiens
ggcagtggcatgtgggtagtgg

SEQ ID NO: 7887985 - DNA, 22 bp, Homo sapiens
ggcagtggcagagcttggtcta

SEQ ID NO: 7887986 - DNA, 22 bp, Homo sapiens
ggcagtggcatgtgggtagtgg

SEQ ID NO: 7887987 - DNA, 22 bp, Homo sapiens
ggcagtggcatgtgggtagtgg

SEQ ID NO: 7887988 - DNA, 21 bp, Homo sapiens
ggccacagttagggctcagga

SEQ ID NO: 7887989 - DNA, 21 bp, Homo sapiens
ggccacagttagggctcagga

SEQ ID NO: 7887990 - DNA, 21 bp, Homo sapiens
ggccacagttagggctcagga

SEQ ID NO: 7887991 - DNA, 21 bp, Homo sapiens
ggccacagttagggctcagga

SEQ ID NO: 7887992 - DNA, 21 bp, Homo sapiens
ggccacagttagggctcagga

SEQ ID NO: 7887993 - DNA, 22 bp, Homo sapiens
ggccacagtgggaaatcctggg

SEQ ID NO: 7887994 - DNA, 22 bp, Homo sapiens
ggccacagtgggaaatcctggg

SEQ ID NO: 7887995 - DNA, 22 bp, Homo sapiens
ggccacagtgggaaatcctggg

SEQ ID NO: 7887996 - DNA, 22 bp, Homo sapiens
ggccacagtgggaaatcctggg

SEQ ID NO: 7887997 - DNA, 22 bp, Homo sapiens
ggccacagtgggaaatcctggg

SEQ ID NO: 7887998 - DNA, 22 bp, Homo sapiens
ggccacagtgggaaatcctggg

SEQ ID NO: 7887999 - DNA, 22 bp, Homo sapiens
ggccacagtgggaaatcctggg

SEQ ID NO: 7888000 - DNA, 21 bp, Homo sapiens
ggccacagttagggctcagga

SEQ ID NO: 7888001 - DNA, 22 bp, Homo sapiens
ggccacagtgggaaatcctggg

SEQ ID NO: 7888002 - DNA, 22 bp, Homo sapiens
ggccacagtgggaaatcctggg

SEQ ID NO: 7888003 - DNA, 22 bp, Homo sapiens
ggccaccagtcctctggcaggg

SEQ ID NO: 7888004 - DNA, 22 bp, Homo sapiens
ggccaccagtcctctggcaggg

SEQ ID NO: 7888005 - DNA, 22 bp, Homo sapiens
ggccaccagtcctctggcaggg

SEQ ID NO: 7888006 - DNA, 22 bp, Homo sapiens
ggccaccaaagtcctgtggctt

SEQ ID NO: 7888007 - DNA, 22 bp, Homo sapiens
ggccaccaaagtcctgtggctt

SEQ ID NO: 7888008 - DNA, 22 bp, Homo sapiens
ggccaccaaagtcctgtggctt

SEQ ID NO: 7888009 - DNA, 22 bp, Homo sapiens
ggccaccagtcctctggcaggg

SEQ ID NO: 7888010 - DNA, 22 bp, Homo sapiens
ggccaccagtcctctggcaggg

SEQ ID NO: 7888011 - DNA, 22 bp, Homo sapiens
ggccacctaggagccacagtga

SEQ ID NO: 7888012 - DNA, 22 bp, Homo sapiens
ggccacatgaattcttggacag

SEQ ID NO: 7888013 - DNA, 22 bp, Homo sapiens
ggccacattcaaagctgtcctg

SEQ ID NO: 7888014 - DNA, 22 bp, Homo sapiens
ggccaccaaagtcctgtggctt

SEQ ID NO: 7888015 - DNA, 22 bp, Homo sapiens
ggccaccaaagtcctgtggctt

SEQ ID NO: 7888016 - DNA, 22 bp, Homo sapiens
ggccacatgaattcttggacag

SEQ ID NO: 7888017 - DNA, 22 bp, Homo sapiens
ggccagcagacctcagggactc

SEQ ID NO: 7888018 - DNA, 22 bp, Homo sapiens
ggccagcagacctcagggactc

SEQ ID NO: 7888019 - DNA, 22 bp, Homo sapiens
ggccagcagacctcagggactc

SEQ ID NO: 7888020 - DNA, 22 bp, Homo sapiens
ggccagcagacctcagggactc

SEQ ID NO: 7888021 - DNA, 22 bp, Homo sapiens
ggccagcagacctcagggactc

SEQ ID NO: 7888022 - DNA, 22 bp, Homo sapiens
ggccagcagacctcagggactc

SEQ ID NO: 7888023 - DNA, 21 bp, Homo sapiens
ggccagcagcgtccactgtgg

SEQ ID NO: 7888024 - DNA, 19 bp, Homo sapiens
ggccagcacagggctctgt

SEQ ID NO: 7888025 - DNA, 19 bp, Homo sapiens
ggccagcacagggctctgt

SEQ ID NO: 7888026 - DNA, 22 bp, Homo sapiens
ggccagagttgatggcatcttg

SEQ ID NO: 7888027 - DNA, 22 bp, Homo sapiens
ggccagagttgatggcatcttg

SEQ ID NO: 7888028 - DNA, 22 bp, Homo sapiens
ggccagagttgatggcatcttg

SEQ ID NO: 7888029 - DNA, 22 bp, Homo sapiens
ggccagagttgatggcatcttg

SEQ ID NO: 7888030 - DNA, 22 bp, Homo sapiens
ggccagagttgatggcatcttg

SEQ ID NO: 7888031 - DNA, 22 bp, Homo sapiens
ggccagagttgatggcatcttg

SEQ ID NO: 7888032 - DNA, 22 bp, Homo sapiens
ggccagagtctatatgcagaca

SEQ ID NO: 7888033 - DNA, 22 bp, Homo sapiens
ggccagagtctatatgcagaca

SEQ ID NO: 7888034 - DNA, 22 bp, Homo sapiens
ggccagagtctatatgcagaca

SEQ ID NO: 7888035 - DNA, 22 bp, Homo sapiens
ggccagagtctatatgcagaca

SEQ ID NO: 7888036 - DNA, 22 bp, Homo sapiens
ggccagagtctatatgcagaca

SEQ ID NO: 7888037 - DNA, 22 bp, Homo sapiens
ggccagagttgatggcatcttg

SEQ ID NO: 7888038 - DNA, 19 bp, Homo sapiens
ggccacctctcttcccagg

SEQ ID NO: 7888039 - DNA, 19 bp, Homo sapiens
ggccacctctcttcccagg

SEQ ID NO: 7888040 - DNA, 22 bp, Homo sapiens
ggccacctctgccctactgagt

SEQ ID NO: 7888041 - DNA, 22 bp, Homo sapiens
ggcccatccatgctgctggtct

SEQ ID NO: 7888042 - DNA, 22 bp, Homo sapiens
ggcccatctcttgctctgggtt

SEQ ID NO: 7888043 - DNA, 22 bp, Homo sapiens
ggcccatgaccctagccaactg

SEQ ID NO: 7888044 - DNA, 22 bp, Homo sapiens
ggcccatctcttgctctgggtt

SEQ ID NO: 7888045 - DNA, 22 bp, Homo sapiens
ggcccagtgtgggtggatgttg

SEQ ID NO: 7888046 - DNA, 22 bp, Homo sapiens
ggcccagtgttgccagacctga

SEQ ID NO: 7888047 - DNA, 22 bp, Homo sapiens
ggcccagtgttgccagacctga

SEQ ID NO: 7888048 - DNA, 22 bp, Homo sapiens
ggcccagtgttgccagacctga

SEQ ID NO: 7888049 - DNA, 22 bp, Homo sapiens
ggcccagtgtgggtggatgttg

SEQ ID NO: 7888050 - DNA, 22 bp, Homo sapiens
ggcccagtgtcccggtcgtggc

SEQ ID NO: 7888051 - DNA, 22 bp, Homo sapiens
ggcccagtgtaccccaggcagt

SEQ ID NO: 7888052 - DNA, 22 bp, Homo sapiens
ggcccagtgtaccccaggcagt

SEQ ID NO: 7888053 - DNA, 22 bp, Homo sapiens
ggcccagtgtaccccaggcagt

SEQ ID NO: 7888054 - DNA, 22 bp, Homo sapiens
ggcccagtgtaccccaggcagt

SEQ ID NO: 7888055 - DNA, 22 bp, Homo sapiens
ggcccagtctggggccctgtga

SEQ ID NO: 7888056 - DNA, 20 bp, Homo sapiens
ggcccagtgaaccaggacgg

SEQ ID NO: 7888057 - DNA, 22 bp, Homo sapiens
ggcccagtctggggccctgtga

SEQ ID NO: 7888058 - DNA, 20 bp, Homo sapiens
ggcccagtgaaccaggacgg

SEQ ID NO: 7888059 - DNA, 20 bp, Homo sapiens
ggcccagtgaaccaggacgg

SEQ ID NO: 7888060 - DNA, 22 bp, Homo sapiens
ggcccagtgctgttcacccagt

SEQ ID NO: 7888061 - DNA, 20 bp, Homo sapiens
ggcccagtgaaccaggacgg

SEQ ID NO: 7888062 - DNA, 22 bp, Homo sapiens
ggcccagtgctgttcacccagt

SEQ ID NO: 7888063 - DNA, 22 bp, Homo sapiens
ggcccaggtccagcgagtacct

SEQ ID NO: 7888064 - DNA, 22 bp, Homo sapiens
ggcccaggtccagcgagtacct

SEQ ID NO: 7888065 - DNA, 22 bp, Homo sapiens
ggcccaggctggagtgcggtgg

SEQ ID NO: 7888066 - DNA, 22 bp, Homo sapiens
ggcccaggctggagtgcggtgg

SEQ ID NO: 7888067 - DNA, 22 bp, Homo sapiens
ggcccaggctggagtgcagtgg

SEQ ID NO: 7888068 - DNA, 22 bp, Homo sapiens
ggcccaggctggagtgcagtgg

SEQ ID NO: 7888069 - DNA, 22 bp, Homo sapiens
ggcccaggctggagtgcagtgg

SEQ ID NO: 7888070 - DNA, 22 bp, Homo sapiens
ggcccaggctggagtgcagtgg

SEQ ID NO: 7888071 - DNA, 22 bp, Homo sapiens
ggcccaggctggagtgcagtgg

SEQ ID NO: 7888072 - DNA, 22 bp, Homo sapiens
ggcccaggatgcaagaactgaa

SEQ ID NO: 7888073 - DNA, 22 bp, Homo sapiens
ggcccagctttcattccttgct

SEQ ID NO: 7888074 - DNA, 22 bp, Homo sapiens
ggcccaggatgcaagaactgaa

SEQ ID NO: 7888075 - DNA, 22 bp, Homo sapiens
ggcccaggatgcaagaactgaa

SEQ ID NO: 7888076 - DNA, 22 bp, Homo sapiens
ggcccaggatgcaagaactgaa

SEQ ID NO: 7888077 - DNA, 22 bp, Homo sapiens
ggcccaggatgcaagaactgaa

SEQ ID NO: 7888078 - DNA, 22 bp, Homo sapiens
ggcccaggatgcaagaactgaa

SEQ ID NO: 7888079 - DNA, 22 bp, Homo sapiens
ggcccaggatgcaagaactgaa

SEQ ID NO: 7888080 - DNA, 22 bp, Homo sapiens
ggcccaggatgcaagaactgaa

SEQ ID NO: 7888081 - DNA, 22 bp, Homo sapiens
ggcccagctgtgcttccagccc

SEQ ID NO: 7888082 - DNA, 22 bp, Homo sapiens
ggcccagctgtgcttccagccc

SEQ ID NO: 7888083 - DNA, 22 bp, Homo sapiens
ggcccagctgtgcttccagccc

SEQ ID NO: 7888084 - DNA, 22 bp, Homo sapiens
ggcccagctttcattccttgct

SEQ ID NO: 7888085 - DNA, 22 bp, Homo sapiens
ggcccagctttcattccttgct

SEQ ID NO: 7888086 - DNA, 22 bp, Homo sapiens
ggcccagctttcattccttgct

SEQ ID NO: 7888087 - DNA, 22 bp, Homo sapiens
ggcccagctgtatattacagtt

SEQ ID NO: 7888088 - DNA, 22 bp, Homo sapiens
ggcccagctgtatattacagtt

SEQ ID NO: 7888089 - DNA, 22 bp, Homo sapiens
ggcccagctgtatattacagtt

SEQ ID NO: 7888090 - DNA, 22 bp, Homo sapiens
ggcccagctgtatattacagtt

SEQ ID NO: 7888091 - DNA, 22 bp, Homo sapiens
ggcccagctgggcggggacacg

SEQ ID NO: 7888092 - DNA, 22 bp, Homo sapiens
ggcccagctgggcggggacacg

SEQ ID NO: 7888093 - DNA, 22 bp, Homo sapiens
ggcccagctgggcggggacacg

SEQ ID NO: 7888094 - DNA, 22 bp, Homo sapiens
ggcccagctgggcggggacacg

SEQ ID NO: 7888095 - DNA, 19 bp, Homo sapiens
ggccagccacctcgcctgg

SEQ ID NO: 7888096 - DNA, 19 bp, Homo sapiens
ggccagccacctcgcctgg

SEQ ID NO: 7888097 - DNA, 19 bp, Homo sapiens
ggccagccacctcgcctgg

SEQ ID NO: 7888098 - DNA, 22 bp, Homo sapiens
ggccagcccagtggtcctctct

SEQ ID NO: 7888099 - DNA, 22 bp, Homo sapiens
ggccagcccagtggtcctctct

SEQ ID NO: 7888100 - DNA, 22 bp, Homo sapiens
ggccagcatggcaagaccaact

SEQ ID NO: 7888101 - DNA, 19 bp, Homo sapiens
ggccagccacctcgcctgg

SEQ ID NO: 7888102 - DNA, 22 bp, Homo sapiens
ggccagcccagtggtcctctct

SEQ ID NO: 7888103 - DNA, 22 bp, Homo sapiens
ggccagctctgcacagcagctg

SEQ ID NO: 7888104 - DNA, 22 bp, Homo sapiens
ggccagctctgcacagcagctg

SEQ ID NO: 7888105 - DNA, 22 bp, Homo sapiens
ggccagctctgcacagcagctg

SEQ ID NO: 7888106 - DNA, 22 bp, Homo sapiens
ggccagctcttgtccacggagg

SEQ ID NO: 7888107 - DNA, 22 bp, Homo sapiens
ggccagctctgcacagcagctg

SEQ ID NO: 7888108 - DNA, 22 bp, Homo sapiens
ggccagctgagctgctgcacag

SEQ ID NO: 7888109 - DNA, 22 bp, Homo sapiens
ggccagctgagctgctgcacag

SEQ ID NO: 7888110 - DNA, 22 bp, Homo sapiens
ggccagctgagctgctgcacag

SEQ ID NO: 7888111 - DNA, 22 bp, Homo sapiens
ggccagcagtatatagctaatt

SEQ ID NO: 7888112 - DNA, 22 bp, Homo sapiens
ggccagcagtcacagggtcaga

SEQ ID NO: 7888113 - DNA, 21 bp, Homo sapiens
ggccagcagcgtccactgtgg

SEQ ID NO: 7888114 - DNA, 22 bp, Homo sapiens
ggccagcagtcacagggtcaga

SEQ ID NO: 7888115 - DNA, 22 bp, Homo sapiens
ggccagcagtcacagggtcaga

SEQ ID NO: 7888116 - DNA, 22 bp, Homo sapiens
ggccagcagtcacagggtcaga

SEQ ID NO: 7888117 - DNA, 22 bp, Homo sapiens
ggccagcatatagagtgaagta

SEQ ID NO: 7888118 - DNA, 21 bp, Homo sapiens
ggccagctgcatatgtcactg

SEQ ID NO: 7888119 - DNA, 22 bp, Homo sapiens
ggccagctgccaccagccctat

SEQ ID NO: 7888120 - DNA, 22 bp, Homo sapiens
ggccagctgagctgctgcacag

SEQ ID NO: 7888121 - DNA, 22 bp, Homo sapiens
ggccagctgagctgctgcacag

SEQ ID NO: 7888122 - DNA, 22 bp, Homo sapiens
ggccagctgagctgctgcacag

SEQ ID NO: 7888123 - DNA, 22 bp, Homo sapiens
ggccagctgagctgctgcacag

SEQ ID NO: 7888124 - DNA, 22 bp, Homo sapiens
ggccagctgctcagtgtctctg

SEQ ID NO: 7888125 - DNA, 22 bp, Homo sapiens
ggccagctgctcagtgtctctg

SEQ ID NO: 7888126 - DNA, 22 bp, Homo sapiens
ggccagctgccaccagccctat

SEQ ID NO: 7888127 - DNA, 22 bp, Homo sapiens
ggccagctgcctgaccttctgt

SEQ ID NO: 7888128 - DNA, 22 bp, Homo sapiens
ggccagctggatgtgggtgacg

SEQ ID NO: 7888129 - DNA, 22 bp, Homo sapiens
ggccagctgggccaccaggtgc

SEQ ID NO: 7888130 - DNA, 22 bp, Homo sapiens
ggccagctggatgtgggtgacg

SEQ ID NO: 7888131 - DNA, 22 bp, Homo sapiens
ggccagctggatgtgggtgacg

SEQ ID NO: 7888132 - DNA, 22 bp, Homo sapiens
ggcccagctctattgaattaca

SEQ ID NO: 7888133 - DNA, 22 bp, Homo sapiens
ggcccagctctattgaattaca

SEQ ID NO: 7888134 - DNA, 22 bp, Homo sapiens
ggcccagctgggcggggacacg

SEQ ID NO: 7888135 - DNA, 22 bp, Homo sapiens
ggcccagctctattgaattaca

SEQ ID NO: 7888136 - DNA, 22 bp, Homo sapiens
ggcccagcgaggccacctacag

SEQ ID NO: 7888137 - DNA, 22 bp, Homo sapiens
ggcagatggagaagcagcaggt

SEQ ID NO: 7888138 - DNA, 22 bp, Homo sapiens
ggcagatggagaagcagcaggt

SEQ ID NO: 7888139 - DNA, 22 bp, Homo sapiens
ggcagatggggtgacaagagag

SEQ ID NO: 7888140 - DNA, 22 bp, Homo sapiens
ggcagatggagaagcagcaggt

SEQ ID NO: 7888141 - DNA, 22 bp, Homo sapiens
ggcagatggagaagcagcaggt

SEQ ID NO: 7888142 - DNA, 22 bp, Homo sapiens
ggcagatggagaagcagcaggt

SEQ ID NO: 7888143 - DNA, 22 bp, Homo sapiens
ggcagatggagaagcagcaggt

SEQ ID NO: 7888144 - DNA, 22 bp, Homo sapiens
ggcagatggggtgacaagagag

SEQ ID NO: 7888145 - DNA, 22 bp, Homo sapiens
ggcagatggggtgacaagagag

SEQ ID NO: 7888146 - DNA, 22 bp, Homo sapiens
ggcagatggggtgacaagagag

SEQ ID NO: 7888147 - DNA, 22 bp, Homo sapiens
ggcagatggggtgacaagagag

SEQ ID NO: 7888148 - DNA, 22 bp, Homo sapiens
ggcagatgttatatgatctgag

SEQ ID NO: 7888149 - DNA, 22 bp, Homo sapiens
ggcagatggggtgacaagagag

SEQ ID NO: 7888150 - DNA, 22 bp, Homo sapiens
ggcagatgttgcagtgagcaga

SEQ ID NO: 7888151 - DNA, 22 bp, Homo sapiens
ggcagatgttatatgatctgag

SEQ ID NO: 7888152 - DNA, 22 bp, Homo sapiens
ggcagaggtgacagtgtctttt

SEQ ID NO: 7888153 - DNA, 22 bp, Homo sapiens
ggcagaggtgacagtgtctttt

SEQ ID NO: 7888154 - DNA, 22 bp, Homo sapiens
ggcagatggaatgagctgtcta

SEQ ID NO: 7888155 - DNA, 22 bp, Homo sapiens
ggcagaggtgacagtgtctttt

SEQ ID NO: 7888156 - DNA, 22 bp, Homo sapiens
ggcagaggtgacagtgtctttt

SEQ ID NO: 7888157 - DNA, 22 bp, Homo sapiens
ggcagaggtgaagttcacaagg

SEQ ID NO: 7888158 - DNA, 22 bp, Homo sapiens
ggcagaggtgaagttcacaagg

SEQ ID NO: 7888159 - DNA, 22 bp, Homo sapiens
ggcagaggtgacagtgtctttt

SEQ ID NO: 7888160 - DNA, 22 bp, Homo sapiens
ggcagaggtgacagtgtctttt

SEQ ID NO: 7888161 - DNA, 22 bp, Homo sapiens
ggcactgattccattcatgaag

SEQ ID NO: 7888162 - DNA, 22 bp, Homo sapiens
ggcactgatctgatttccctcc

SEQ ID NO: 7888163 - DNA, 22 bp, Homo sapiens
ggcactgagctgccttggggca

SEQ ID NO: 7888164 - DNA, 22 bp, Homo sapiens
ggcagaggtgaagttcacaagg

SEQ ID NO: 7888165 - DNA, 22 bp, Homo sapiens
ggcactgattccattcatgaag

SEQ ID NO: 7888166 - DNA, 23 bp, Homo sapiens
ggcactgaagctacaatggtgag

SEQ ID NO: 7888167 - DNA, 22 bp, Homo sapiens
ggcactgaagtgggtgttgggt

SEQ ID NO: 7888168 - DNA, 22 bp, Homo sapiens
ggcactgaagtgggtgttgggt

SEQ ID NO: 7888169 - DNA, 22 bp, Homo sapiens
ggcactgaatttcttggcatct

SEQ ID NO: 7888170 - DNA, 22 bp, Homo sapiens
ggcactgaatttcttggcatct

SEQ ID NO: 7888171 - DNA, 22 bp, Homo sapiens
ggcacgtgcctaaggagcaggc

SEQ ID NO: 7888172 - DNA, 21 bp, Homo sapiens
ggcactaggcccggaggaagc

SEQ ID NO: 7888173 - DNA, 22 bp, Homo sapiens
ggcactaggagacctgggggtc

SEQ ID NO: 7888174 - DNA, 22 bp, Homo sapiens
ggcactcaataaatgttgccaa

SEQ ID NO: 7888175 - DNA, 22 bp, Homo sapiens
ggcactagtgacaaggggacat

SEQ ID NO: 7888176 - DNA, 22 bp, Homo sapiens
ggcactgagcgggctctgagcg

SEQ ID NO: 7888177 - DNA, 22 bp, Homo sapiens
ggcactgagctgccttggggca

SEQ ID NO: 7888178 - DNA, 22 bp, Homo sapiens
ggcactgagcgggctctgagcg

SEQ ID NO: 7888179 - DNA, 22 bp, Homo sapiens
ggcactgagaacaggctgactt

SEQ ID NO: 7888180 - DNA, 22 bp, Homo sapiens
ggcactgagaggctcttcctaa

SEQ ID NO: 7888181 - DNA, 22 bp, Homo sapiens
ggcactgactgtgcagcgcacc

SEQ ID NO: 7888182 - DNA, 22 bp, Homo sapiens
ggcactgagaacaggctgactt

SEQ ID NO: 7888183 - DNA, 22 bp, Homo sapiens
ggcactgacactagcatggcac

SEQ ID NO: 7888184 - DNA, 22 bp, Homo sapiens
ggcactgactgtgcagcgcacc

SEQ ID NO: 7888185 - DNA, 22 bp, Homo sapiens
ggcactgacactagcatggcac

SEQ ID NO: 7888186 - DNA, 22 bp, Homo sapiens
ggcactgacactagcatggcac

SEQ ID NO: 7888187 - DNA, 22 bp, Homo sapiens
ggcagcactgcagcttgttggg

SEQ ID NO: 7888188 - DNA, 22 bp, Homo sapiens
ggcagcactgcagcttgttggg

SEQ ID NO: 7888189 - DNA, 22 bp, Homo sapiens
ggcagcactgcagcttgttggg

SEQ ID NO: 7888190 - DNA, 22 bp, Homo sapiens
ggcagcactgcagcttgttggg

SEQ ID NO: 7888191 - DNA, 22 bp, Homo sapiens
ggcagcacgacaggagtggaag

SEQ ID NO: 7888192 - DNA, 21 bp, Homo sapiens
ggcagcactacctgaagcata

SEQ ID NO: 7888193 - DNA, 22 bp, Homo sapiens
ggcagcacgacaggagtggaag

SEQ ID NO: 7888194 - DNA, 21 bp, Homo sapiens
ggcagcactacctgaagcata

SEQ ID NO: 7888195 - DNA, 22 bp, Homo sapiens
ggcagcaatgctgtgcaggcat

SEQ ID NO: 7888196 - DNA, 22 bp, Homo sapiens
ggcagcaatgctgtgcaggcat

SEQ ID NO: 7888197 - DNA, 22 bp, Homo sapiens
ggcagcaagtaggattcttatt

SEQ ID NO: 7888198 - DNA, 22 bp, Homo sapiens
ggcagcaaggtggcggaaatga

SEQ ID NO: 7888199 - DNA, 22 bp, Homo sapiens
ggcagcaagtggtgggagactt

SEQ ID NO: 7888200 - DNA, 20 bp, Homo sapiens
ggcagcaattcaccctatcc

SEQ ID NO: 7888201 - DNA, 22 bp, Homo sapiens
ggcagcaattcttcagaatcat

SEQ ID NO: 7888202 - DNA, 22 bp, Homo sapiens
ggcagcactgcagcttgttggg

SEQ ID NO: 7888203 - DNA, 22 bp, Homo sapiens
ggcagcagaactggccctgtat

SEQ ID NO: 7888204 - DNA, 22 bp, Homo sapiens
ggcagcagaactggccctgtat

SEQ ID NO: 7888205 - DNA, 22 bp, Homo sapiens
ggcagcactgcagcttgttggg

SEQ ID NO: 7888206 - DNA, 22 bp, Homo sapiens
ggcagcagaactggccctgtat

SEQ ID NO: 7888207 - DNA, 22 bp, Homo sapiens
ggcagcagaactggccctgtat

SEQ ID NO: 7888208 - DNA, 22 bp, Homo sapiens
ggcagccatggacactggctag

SEQ ID NO: 7888209 - DNA, 22 bp, Homo sapiens
ggcagcagacccctaagtctac

SEQ ID NO: 7888210 - DNA, 22 bp, Homo sapiens
ggcagcagacccctaagtctac

SEQ ID NO: 7888211 - DNA, 22 bp, Homo sapiens
ggcagcagaactggccctgtat

SEQ ID NO: 7888212 - DNA, 22 bp, Homo sapiens
ggcagcagaactggccctgtat

SEQ ID NO: 7888213 - DNA, 22 bp, Homo sapiens
ggcagcagaactggccctgtat

SEQ ID NO: 7888214 - DNA, 22 bp, Homo sapiens
ggcagcaactcggagagaagag

SEQ ID NO: 7888215 - DNA, 22 bp, Homo sapiens
ggcagcaactcggagagaagag

SEQ ID NO: 7888216 - DNA, 18 bp, Homo sapiens
ggcagcaagaagggaggg

SEQ ID NO: 7888217 - DNA, 22 bp, Homo sapiens
ggcagcaacgaggcttgatacc

SEQ ID NO: 7888218 - DNA, 22 bp, Homo sapiens
ggcagcaaccaaccaggcattt

SEQ ID NO: 7888219 - DNA, 22 bp, Homo sapiens
ggcagcaactcggagagaagag

SEQ ID NO: 7888220 - DNA, 19 bp, Homo sapiens
ggcagcaagctctgaaggc

SEQ ID NO: 7888221 - DNA, 19 bp, Homo sapiens
ggcagcaagctctgaaggc

SEQ ID NO: 7888222 - DNA, 22 bp, Homo sapiens
ggcagcaagtggtgggagactt

SEQ ID NO: 7888223 - DNA, 22 bp, Homo sapiens
ggcagcaagcagaagttctatg

SEQ ID NO: 7888224 - DNA, 22 bp, Homo sapiens
ggcagcaagagaggttcagctt

SEQ ID NO: 7888225 - DNA, 18 bp, Homo sapiens
ggcagcaagaagggaggg

SEQ ID NO: 7888226 - DNA, 22 bp, Homo sapiens
ggcagatgttgcagtgagcaga

SEQ ID NO: 7888227 - DNA, 22 bp, Homo sapiens
ggcagatgttgcagtgagcaga

SEQ ID NO: 7888228 - DNA, 22 bp, Homo sapiens
ggcagatgttgcagtgagcaga

SEQ ID NO: 7888229 - DNA, 22 bp, Homo sapiens
ggcagatgttgcagtgagcaga

SEQ ID NO: 7888230 - DNA, 22 bp, Homo sapiens
ggcagatgttgcagtgagcaga

SEQ ID NO: 7888231 - DNA, 22 bp, Homo sapiens
ggcagcaaaaagcctggttgaa

SEQ ID NO: 7888232 - DNA, 22 bp, Homo sapiens
ggcagcaaaaagcctggttgaa

SEQ ID NO: 7888233 - DNA, 23 bp, Homo sapiens
ggcagatttggtttgttttaata

SEQ ID NO: 7888234 - DNA, 22 bp, Homo sapiens
ggcagcaaagtcacatggaaaa

SEQ ID NO: 7888235 - DNA, 22 bp, Homo sapiens
ggcagcaaatattgtcagctgt

SEQ ID NO: 7888236 - DNA, 22 bp, Homo sapiens
ggcagcaaatattgtcagctgt

SEQ ID NO: 7888237 - DNA, 22 bp, Homo sapiens
ggaggaggtgggttaagttgta

SEQ ID NO: 7888238 - DNA, 22 bp, Homo sapiens
ggaggaggggtttacattggaa

SEQ ID NO: 7888239 - DNA, 22 bp, Homo sapiens
ggaggaggtgggttaagttgta

SEQ ID NO: 7888240 - DNA, 22 bp, Homo sapiens
ggaggagtcagttgggctgctt

SEQ ID NO: 7888241 - DNA, 22 bp, Homo sapiens
ggaggatgagctacgaggagct

SEQ ID NO: 7888242 - DNA, 22 bp, Homo sapiens
ggaggatgagctacgaggagct

SEQ ID NO: 7888243 - DNA, 22 bp, Homo sapiens
ggaggagtgtggggcactctgc

SEQ ID NO: 7888244 - DNA, 22 bp, Homo sapiens
ggaggaggggtttacattggaa

SEQ ID NO: 7888245 - DNA, 22 bp, Homo sapiens
ggaggaggggtttacattggaa

SEQ ID NO: 7888246 - DNA, 22 bp, Homo sapiens
ggaggaggggtttacattggaa

SEQ ID NO: 7888247 - DNA, 22 bp, Homo sapiens
ggaggaggggtttacattggaa

SEQ ID NO: 7888248 - DNA, 22 bp, Homo sapiens
ggaggaggggtttacattggaa

SEQ ID NO: 7888249 - DNA, 22 bp, Homo sapiens
ggaggaggggtgactgaatgct

SEQ ID NO: 7888250 - DNA, 22 bp, Homo sapiens
ggaggaggggtgactgaatgct

SEQ ID NO: 7888251 - DNA, 22 bp, Homo sapiens
ggaggaggggtgactgaatgct

SEQ ID NO: 7888252 - DNA, 22 bp, Homo sapiens
ggaggaggggtgactgaatgct

SEQ ID NO: 7888253 - DNA, 22 bp, Homo sapiens
ggaggaggggtgactgaatgct

SEQ ID NO: 7888254 - DNA, 22 bp, Homo sapiens
ggaggaggggtgactgaatgct

SEQ ID NO: 7888255 - DNA, 22 bp, Homo sapiens
ggaggaggggtgactgaatgct

SEQ ID NO: 7888256 - DNA, 22 bp, Homo sapiens
ggaggaggggtgactgaatgct

SEQ ID NO: 7888257 - DNA, 22 bp, Homo sapiens
ggaggatttgtcatctgaagat

SEQ ID NO: 7888258 - DNA, 22 bp, Homo sapiens
ggaggattagctctgcctgaaa

SEQ ID NO: 7888259 - DNA, 22 bp, Homo sapiens
ggaggcaaagcactttgcttgg

SEQ ID NO: 7888260 - DNA, 22 bp, Homo sapiens
ggaggcaaagcactttgcttgg

SEQ ID NO: 7888261 - DNA, 17 bp, Homo sapiens
ggaggcaacagacaggg

SEQ ID NO: 7888262 - DNA, 22 bp, Homo sapiens
ggaggcaacacagggtgtgttt

SEQ ID NO: 7888263 - DNA, 22 bp, Homo sapiens
ggaggatgccaagctgtgcaca

SEQ ID NO: 7888264 - DNA, 22 bp, Homo sapiens
ggaggatgccaagctgtgcaca

SEQ ID NO: 7888265 - DNA, 22 bp, Homo sapiens
ggaggatgagctacgaggagct

SEQ ID NO: 7888266 - DNA, 22 bp, Homo sapiens
ggaggcacacctcagactggga

SEQ ID NO: 7888267 - DNA, 22 bp, Homo sapiens
ggaggcacacctcagactggga

SEQ ID NO: 7888268 - DNA, 22 bp, Homo sapiens
ggaggcaccactcatcatcctc

SEQ ID NO: 7888269 - DNA, 22 bp, Homo sapiens
ggaggcacacctcagactggga

SEQ ID NO: 7888270 - DNA, 22 bp, Homo sapiens
ggaggcacacctcagactggga

SEQ ID NO: 7888271 - DNA, 22 bp, Homo sapiens
ggaggcaacatgcttgtttcta

SEQ ID NO: 7888272 - DNA, 17 bp, Homo sapiens
ggaggcaacagacaggg

SEQ ID NO: 7888273 - DNA, 23 bp, Homo sapiens
ggaggcacttaggcagagcagag

SEQ ID NO: 7888274 - DNA, 22 bp, Homo sapiens
ggaggcaccctatttgaggcct

SEQ ID NO: 7888275 - DNA, 22 bp, Homo sapiens
ggaggcaccctatttgaggcct

SEQ ID NO: 7888276 - DNA, 23 bp, Homo sapiens
ggaggcacttaggcagagcagag

SEQ ID NO: 7888277 - DNA, 23 bp, Homo sapiens
ggaggcacttaggcagagcagag

SEQ ID NO: 7888278 - DNA, 23 bp, Homo sapiens
ggaggcacttaggcagagcagag

SEQ ID NO: 7888279 - DNA, 23 bp, Homo sapiens
ggaggcacttaggcagagcagag

SEQ ID NO: 7888280 - DNA, 22 bp, Homo sapiens
ggcacctggatgtagcagtgaa

SEQ ID NO: 7888281 - DNA, 22 bp, Homo sapiens
ggcacctggatgtagcagtgaa

SEQ ID NO: 7888282 - DNA, 22 bp, Homo sapiens
ggcacctggtaagtgctcagta

SEQ ID NO: 7888283 - DNA, 22 bp, Homo sapiens
ggcacctggtaagtgctcagta

SEQ ID NO: 7888284 - DNA, 22 bp, Homo sapiens
ggcacctggtaagtgctcagta

SEQ ID NO: 7888285 - DNA, 22 bp, Homo sapiens
ggcacctggatgtagcagtgaa

SEQ ID NO: 7888286 - DNA, 22 bp, Homo sapiens
ggcacctggatgtagcagtgaa

SEQ ID NO: 7888287 - DNA, 22 bp, Homo sapiens
ggcacctggatgtagcagtgaa

SEQ ID NO: 7888288 - DNA, 22 bp, Homo sapiens
ggcacctgctcatctggactca

SEQ ID NO: 7888289 - DNA, 22 bp, Homo sapiens
ggcacctgctcatctggactca

SEQ ID NO: 7888290 - DNA, 22 bp, Homo sapiens
ggcacctggaggtttactggat

SEQ ID NO: 7888291 - DNA, 22 bp, Homo sapiens
ggcacctgctcatctggactca

SEQ ID NO: 7888292 - DNA, 22 bp, Homo sapiens
ggcacctgatgactgcttccct

SEQ ID NO: 7888293 - DNA, 22 bp, Homo sapiens
ggcacctgatgactgcttccct

SEQ ID NO: 7888294 - DNA, 22 bp, Homo sapiens
ggcacctctgggctctgttagg

SEQ ID NO: 7888295 - DNA, 22 bp, Homo sapiens
ggcacctggtaagtgctcagta

SEQ ID NO: 7888296 - DNA, 22 bp, Homo sapiens
ggcacctggtaagtgctcagta

SEQ ID NO: 7888297 - DNA, 22 bp, Homo sapiens
ggcacctggtaagtgctcagta

SEQ ID NO: 7888298 - DNA, 22 bp, Homo sapiens
ggcacctggtaagtgctcagta

SEQ ID NO: 7888299 - DNA, 22 bp, Homo sapiens
ggcacctgtgtaagatctggaa

SEQ ID NO: 7888300 - DNA, 22 bp, Homo sapiens
ggcacctgtgtaagatctggaa

SEQ ID NO: 7888301 - DNA, 22 bp, Homo sapiens
ggcacctgtgtaagatctggaa

SEQ ID NO: 7888302 - DNA, 22 bp, Homo sapiens
ggcacctgtctgctcacagtga

SEQ ID NO: 7888303 - DNA, 19 bp, Homo sapiens
ggcaccttggctatgcctg

SEQ ID NO: 7888304 - DNA, 19 bp, Homo sapiens
ggcaccttggctatgcctg

SEQ ID NO: 7888305 - DNA, 22 bp, Homo sapiens
ggcaccttgagggcagaacctt

SEQ ID NO: 7888306 - DNA, 22 bp, Homo sapiens
ggcacctgtgtaagatctggaa

SEQ ID NO: 7888307 - DNA, 19 bp, Homo sapiens
ggcacctttctgctgtgtc

SEQ ID NO: 7888308 - DNA, 19 bp, Homo sapiens
ggcaccttggtcttggact

SEQ ID NO: 7888309 - DNA, 22 bp, Homo sapiens
ggcaccaggctgggcataggcc

SEQ ID NO: 7888310 - DNA, 22 bp, Homo sapiens
ggcaccagggaaggaaggctgg

SEQ ID NO: 7888311 - DNA, 22 bp, Homo sapiens
ggcaccagggaaggaaggctgg

SEQ ID NO: 7888312 - DNA, 22 bp, Homo sapiens
ggcaccaggctgggcataggcc

SEQ ID NO: 7888313 - DNA, 22 bp, Homo sapiens
ggaggcagaacttcccgtcagt

SEQ ID NO: 7888314 - DNA, 22 bp, Homo sapiens
ggcaccaggctgggcataggcc

SEQ ID NO: 7888315 - DNA, 22 bp, Homo sapiens
ggaggcagaacttcccgtcagt

SEQ ID NO: 7888316 - DNA, 22 bp, Homo sapiens
ggcaccaggctgggcataggcc

SEQ ID NO: 7888317 - DNA, 22 bp, Homo sapiens
ggaggcagaacttcccgtcagt

SEQ ID NO: 7888318 - DNA, 22 bp, Homo sapiens
ggaggcagaacttcccgtcagt

SEQ ID NO: 7888319 - DNA, 22 bp, Homo sapiens
ggaggcagaacttcccgtcagt

SEQ ID NO: 7888320 - DNA, 22 bp, Homo sapiens
ggaggcagaacttcccgtcagt

SEQ ID NO: 7888321 - DNA, 22 bp, Homo sapiens
ggaggcacttcatgctgacccg

SEQ ID NO: 7888322 - DNA, 22 bp, Homo sapiens
ggaggcacttcatgctgacccg

SEQ ID NO: 7888323 - DNA, 22 bp, Homo sapiens
ggaggcacttcccgtctcagcc

SEQ ID NO: 7888324 - DNA, 22 bp, Homo sapiens
ggaggcacttcccgtctcagcc

SEQ ID NO: 7888325 - DNA, 22 bp, Homo sapiens
ggaggcacttcccgtctcagcc

SEQ ID NO: 7888326 - DNA, 22 bp, Homo sapiens
ggcaccagggaaggaaggctgg

SEQ ID NO: 7888327 - DNA, 22 bp, Homo sapiens
ggcaccagggaaggaaggctgg

SEQ ID NO: 7888328 - DNA, 22 bp, Homo sapiens
ggcaccagggacaatcctcttc

SEQ ID NO: 7888329 - DNA, 22 bp, Homo sapiens
ggcaccagggcaagggtctttc

SEQ ID NO: 7888330 - DNA, 22 bp, Homo sapiens
ggcaccatcagctgtgcagggg

SEQ ID NO: 7888331 - DNA, 22 bp, Homo sapiens
ggcacccttggggggccacagc

SEQ ID NO: 7888332 - DNA, 16 bp, Homo sapiens
ggcaccagtgaacaca

SEQ ID NO: 7888333 - DNA, 16 bp, Homo sapiens
ggcaccagtgaacaca

SEQ ID NO: 7888334 - DNA, 22 bp, Homo sapiens
ggcaccaggggatgtaatgtcc

SEQ ID NO: 7888335 - DNA, 17 bp, Homo sapiens
ggcagtggaggaagaga

SEQ ID NO: 7888336 - DNA, 22 bp, Homo sapiens
ggcagtgccttagaatctgtgg

SEQ ID NO: 7888337 - DNA, 22 bp, Homo sapiens
ggcagtggaggaccctgtgtct

SEQ ID NO: 7888338 - DNA, 22 bp, Homo sapiens
ggcagtggaggaccctgtgtct

SEQ ID NO: 7888339 - DNA, 22 bp, Homo sapiens
ggcagtggcagagcttggtcta

SEQ ID NO: 7888340 - DNA, 22 bp, Homo sapiens
ggcagtggcagagcttggtcta

SEQ ID NO: 7888341 - DNA, 22 bp, Homo sapiens
ggcagtggaggaccctgtgtct

SEQ ID NO: 7888342 - DNA, 22 bp, Homo sapiens
ggcagtgccactaagctctgct

SEQ ID NO: 7888343 - DNA, 22 bp, Homo sapiens
ggcagtgccactaagctctgct

SEQ ID NO: 7888344 - DNA, 22 bp, Homo sapiens
ggcagtgccactaagctctgct

SEQ ID NO: 7888345 - DNA, 22 bp, Homo sapiens
ggcagtgccactaagctctgct

SEQ ID NO: 7888346 - DNA, 18 bp, Homo sapiens
ggcagtgcagtctcaggg

SEQ ID NO: 7888347 - DNA, 22 bp, Homo sapiens
ggcagtgcctgatgctgcagga

SEQ ID NO: 7888348 - DNA, 22 bp, Homo sapiens
ggcagtgcctgatgctgcagga

SEQ ID NO: 7888349 - DNA, 18 bp, Homo sapiens
ggcagtgcagtctcaggg

SEQ ID NO: 7888350 - DNA, 22 bp, Homo sapiens
ggcagtgcaggcccttcagcct

SEQ ID NO: 7888351 - DNA, 18 bp, Homo sapiens
ggcagtgcagtctcaggg

SEQ ID NO: 7888352 - DNA, 22 bp, Homo sapiens
ggcagtgcaggcccttcagcct

SEQ ID NO: 7888353 - DNA, 22 bp, Homo sapiens
ggcagtgagtcccggagaggcc

SEQ ID NO: 7888354 - DNA, 22 bp, Homo sapiens
ggcagtgagtcccggagaggcc

SEQ ID NO: 7888355 - DNA, 22 bp, Homo sapiens
ggcagtgagtcccggagaggcc

SEQ ID NO: 7888356 - DNA, 22 bp, Homo sapiens
ggcagtgagtcccggagaggcc

SEQ ID NO: 7888357 - DNA, 22 bp, Homo sapiens
ggcagtgagtcccggagaggcc

SEQ ID NO: 7888358 - DNA, 22 bp, Homo sapiens
ggcagtgagtcccggagaggcc

SEQ ID NO: 7888359 - DNA, 22 bp, Homo sapiens
ggcagtgcaaggcagcctggat

SEQ ID NO: 7888360 - DNA, 22 bp, Homo sapiens
ggcagtgcaaggcagcctggat

SEQ ID NO: 7888361 - DNA, 21 bp, Homo sapiens
ggcagtgatgtgaagtgcatc

SEQ ID NO: 7888362 - DNA, 21 bp, Homo sapiens
ggcagtgatgtgaagtgcatc

SEQ ID NO: 7888363 - DNA, 22 bp, Homo sapiens
ggcagtgatgtcaaacagtgaa

SEQ ID NO: 7888364 - DNA, 22 bp, Homo sapiens
ggcagtgatgtcaaacagtgaa

SEQ ID NO: 7888365 - DNA, 21 bp, Homo sapiens
ggcagtgatgtgaagtgcatc

SEQ ID NO: 7888366 - DNA, 22 bp, Homo sapiens
ggcagtgatgtcaaacagtgaa

SEQ ID NO: 7888367 - DNA, 22 bp, Homo sapiens
ggcagtgagaggtctcctggtc

SEQ ID NO: 7888368 - DNA, 22 bp, Homo sapiens
ggcagtgagctggagggaagga

SEQ ID NO: 7888369 - DNA, 22 bp, Homo sapiens
ggcagtgagaggtctcctggtc

SEQ ID NO: 7888370 - DNA, 22 bp, Homo sapiens
ggcagtgagaggtctcctggtc

SEQ ID NO: 7888371 - DNA, 22 bp, Homo sapiens
ggcagtgagaggtctcctggtc

SEQ ID NO: 7888372 - DNA, 22 bp, Homo sapiens
ggcagtgagctggagggaagga

SEQ ID NO: 7888373 - DNA, 22 bp, Homo sapiens
ggcagtgagctggagggaagga

SEQ ID NO: 7888374 - DNA, 22 bp, Homo sapiens
ggcagtgagctggagggaagga

SEQ ID NO: 7888375 - DNA, 18 bp, Homo sapiens
ggcaggggtgaaccacag

SEQ ID NO: 7888376 - DNA, 18 bp, Homo sapiens
ggcaggggtgaaccacag

SEQ ID NO: 7888377 - DNA, 22 bp, Homo sapiens
ggcagtgactggggacccccaa

SEQ ID NO: 7888378 - DNA, 19 bp, Homo sapiens
ggcagtgagaagactcctg

SEQ ID NO: 7888379 - DNA, 19 bp, Homo sapiens
ggcagtgagaagactcctg

SEQ ID NO: 7888380 - DNA, 19 bp, Homo sapiens
ggcagtgagaagactcctg

SEQ ID NO: 7888381 - DNA, 22 bp, Homo sapiens
ggcagtgactgttcagacgtcc

SEQ ID NO: 7888382 - DNA, 19 bp, Homo sapiens
ggcagtgagaagactcctg

SEQ ID NO: 7888383 - DNA, 22 bp, Homo sapiens
ggcagtgagaggtctcctggtc

SEQ ID NO: 7888384 - DNA, 22 bp, Homo sapiens
ggcagggaagctggcatcacgg

SEQ ID NO: 7888385 - DNA, 22 bp, Homo sapiens
ggcagggaagctggcatcacgg

SEQ ID NO: 7888386 - DNA, 22 bp, Homo sapiens
ggcagggaagctggcatcacgg

SEQ ID NO: 7888387 - DNA, 22 bp, Homo sapiens
ggcagggaagctggcatcacgg

SEQ ID NO: 7888388 - DNA, 22 bp, Homo sapiens
ggcagggaagctggcatcacgg

SEQ ID NO: 7888389 - DNA, 22 bp, Homo sapiens
ggcagggaagctggcatcacgg

SEQ ID NO: 7888390 - DNA, 22 bp, Homo sapiens
ggcagggaaacagctgatccca

SEQ ID NO: 7888391 - DNA, 22 bp, Homo sapiens
ggcagggaaacagctgatccca

SEQ ID NO: 7888392 - DNA, 18 bp, Homo sapiens
ggcagggaaaagataggg

SEQ ID NO: 7888393 - DNA, 22 bp, Homo sapiens
ggcagggaaacagctgatccca

SEQ ID NO: 7888394 - DNA, 22 bp, Homo sapiens
ggcagggaaacagctgatccca

SEQ ID NO: 7888395 - DNA, 22 bp, Homo sapiens
ggcagggaaacagctgatccca

SEQ ID NO: 7888396 - DNA, 22 bp, Homo sapiens
ggcagggaaacagctgatccca

SEQ ID NO: 7888397 - DNA, 22 bp, Homo sapiens
ggcagggaaacagctgatccca

SEQ ID NO: 7888398 - DNA, 22 bp, Homo sapiens
ggcagggacaggatagggtttt

SEQ ID NO: 7888399 - DNA, 22 bp, Homo sapiens
ggcagggacaggatagggtttt

SEQ ID NO: 7888400 - DNA, 22 bp, Homo sapiens
ggcagggacaggatagggtttt

SEQ ID NO: 7888401 - DNA, 22 bp, Homo sapiens
ggcagggacaggatagggtttt

SEQ ID NO: 7888402 - DNA, 22 bp, Homo sapiens
ggcagggacaggatagggtttt

SEQ ID NO: 7888403 - DNA, 22 bp, Homo sapiens
ggcagggaagctggcatcacgg

SEQ ID NO: 7888404 - DNA, 22 bp, Homo sapiens
ggcagggactatgtttcatgga

SEQ ID NO: 7888405 - DNA, 22 bp, Homo sapiens
ggcagggactatgtttcatgga

SEQ ID NO: 7888406 - DNA, 22 bp, Homo sapiens
ggcagggactatgtttcatgga

SEQ ID NO: 7888407 - DNA, 22 bp, Homo sapiens
ggcagggactttgcaaatcttt

SEQ ID NO: 7888408 - DNA, 22 bp, Homo sapiens
ggcagggactttgcaaatcttt

SEQ ID NO: 7888409 - DNA, 22 bp, Homo sapiens
ggcagggactatgtttcatgga

SEQ ID NO: 7888410 - DNA, 22 bp, Homo sapiens
ggcagggactttgcaaatcttt

SEQ ID NO: 7888411 - DNA, 22 bp, Homo sapiens
ggcagggactttgcaaatcttt

SEQ ID NO: 7888412 - DNA, 22 bp, Homo sapiens
ggcagggactttgcaaatcttt

SEQ ID NO: 7888413 - DNA, 22 bp, Homo sapiens
ggcaggggtcctggtgttgact

SEQ ID NO: 7888414 - DNA, 22 bp, Homo sapiens
ggcaggggtcctggtgttgact

SEQ ID NO: 7888415 - DNA, 22 bp, Homo sapiens
ggcaggggtcctggtgttgact

SEQ ID NO: 7888416 - DNA, 22 bp, Homo sapiens
ggcaggggtcctggtgttgact

SEQ ID NO: 7888417 - DNA, 22 bp, Homo sapiens
ggcaggggtcctggtgttgact

SEQ ID NO: 7888418 - DNA, 22 bp, Homo sapiens
ggcaggggtcctggtgttgact

SEQ ID NO: 7888419 - DNA, 22 bp, Homo sapiens
ggcagggcttgtctctgtgatg

SEQ ID NO: 7888420 - DNA, 22 bp, Homo sapiens
ggcagggcttgtctctgtgatg

SEQ ID NO: 7888421 - DNA, 22 bp, Homo sapiens
ggcagggcttgtctctgtgatg

SEQ ID NO: 7888422 - DNA, 22 bp, Homo sapiens
ggcagggcttgtctctgtgatg

SEQ ID NO: 7888423 - DNA, 20 bp, Homo sapiens
ggcagggcatcaacagctct

SEQ ID NO: 7888424 - DNA, 20 bp, Homo sapiens
ggcagggcatcaacagctct

SEQ ID NO: 7888425 - DNA, 20 bp, Homo sapiens
ggcagggcatcaacagctct

SEQ ID NO: 7888426 - DNA, 22 bp, Homo sapiens
ggcagggagagcatgctgataa

SEQ ID NO: 7888427 - DNA, 22 bp, Homo sapiens
ggcagggagagcatgctgataa

SEQ ID NO: 7888428 - DNA, 20 bp, Homo sapiens
ggcagggcatcaacagctct

SEQ ID NO: 7888429 - DNA, 22 bp, Homo sapiens
ggcagggagagcatgctgataa

SEQ ID NO: 7888430 - DNA, 22 bp, Homo sapiens
ggcagggccctgattcctgggg

SEQ ID NO: 7888431 - DNA, 22 bp, Homo sapiens
ggcagggccctgattcctgggg

SEQ ID NO: 7888432 - DNA, 22 bp, Homo sapiens
ggcagggccctgattcctgggg

SEQ ID NO: 7888433 - DNA, 17 bp, Homo sapiens
ggcagcctcaggcgttt

SEQ ID NO: 7888434 - DNA, 17 bp, Homo sapiens
ggcagcctcaggcgttt

SEQ ID NO: 7888435 - DNA, 17 bp, Homo sapiens
ggcagcctcaggcgttt

SEQ ID NO: 7888436 - DNA, 22 bp, Homo sapiens
ggcagcctcaggttttctttga

SEQ ID NO: 7888437 - DNA, 22 bp, Homo sapiens
ggcagcctcaggttttctttga

SEQ ID NO: 7888438 - DNA, 22 bp, Homo sapiens
ggcagccctttctggccagctc

SEQ ID NO: 7888439 - DNA, 22 bp, Homo sapiens
ggcagccctttctggccagctc

SEQ ID NO: 7888440 - DNA, 22 bp, Homo sapiens
ggcagccctgtggagaggccca

SEQ ID NO: 7888441 - DNA, 22 bp, Homo sapiens
ggcagccctgtggagaggccca

SEQ ID NO: 7888442 - DNA, 22 bp, Homo sapiens
ggcagccctgtggagaggccca

SEQ ID NO: 7888443 - DNA, 22 bp, Homo sapiens
ggcagccccagaaacagttcag

SEQ ID NO: 7888444 - DNA, 22 bp, Homo sapiens
ggcagcccaccagcccacgtct

SEQ ID NO: 7888445 - DNA, 22 bp, Homo sapiens
ggcagccccagaaacagttcag

SEQ ID NO: 7888446 - DNA, 21 bp, Homo sapiens
ggcagcccgccctctcctggc

SEQ ID NO: 7888447 - DNA, 21 bp, Homo sapiens
ggcagcccgccctctcctggc

SEQ ID NO: 7888448 - DNA, 22 bp, Homo sapiens
ggcagccatgtgggcagcgagt

SEQ ID NO: 7888449 - DNA, 22 bp, Homo sapiens
ggcagccatgtgggcagcgagt

SEQ ID NO: 7888450 - DNA, 22 bp, Homo sapiens
ggcagccatgtcccagggcttc

SEQ ID NO: 7888451 - DNA, 22 bp, Homo sapiens
ggcagccatgtcccagggcttc

SEQ ID NO: 7888452 - DNA, 22 bp, Homo sapiens
ggcagccatgtgggcagcgagt

SEQ ID NO: 7888453 - DNA, 22 bp, Homo sapiens
ggcagccatgtcccagggcttc

SEQ ID NO: 7888454 - DNA, 22 bp, Homo sapiens
ggcagccatgtcccagggcttc

SEQ ID NO: 7888455 - DNA, 22 bp, Homo sapiens
ggcagccatgtcccagggcttc

SEQ ID NO: 7888456 - DNA, 22 bp, Homo sapiens
ggcagccatgtcccagggcttc

SEQ ID NO: 7888457 - DNA, 22 bp, Homo sapiens
ggcagccatgtcccagggcttc

SEQ ID NO: 7888458 - DNA, 22 bp, Homo sapiens
ggcagccatgtcccagggcttc

SEQ ID NO: 7888459 - DNA, 22 bp, Homo sapiens
ggcagcctccagggcactggtg

SEQ ID NO: 7888460 - DNA, 22 bp, Homo sapiens
ggcagcctccagggcactggtg

SEQ ID NO: 7888461 - DNA, 22 bp, Homo sapiens
ggcagcctccagggcactggtg

SEQ ID NO: 7888462 - DNA, 22 bp, Homo sapiens
ggcagcctccagggcactggtg

SEQ ID NO: 7888463 - DNA, 22 bp, Homo sapiens
ggcagcctccagggcactggtg

SEQ ID NO: 7888464 - DNA, 23 bp, Homo sapiens
ggcagcctctgactctgctttgc

SEQ ID NO: 7888465 - DNA, 23 bp, Homo sapiens
ggcagcctctgactctgctttgc

SEQ ID NO: 7888466 - DNA, 21 bp, Homo sapiens
ggcagcctgacccccagagag

SEQ ID NO: 7888467 - DNA, 21 bp, Homo sapiens
ggcagcctgacccccagagag

SEQ ID NO: 7888468 - DNA, 19 bp, Homo sapiens
ggcagcctgcacgggctgc

SEQ ID NO: 7888469 - DNA, 21 bp, Homo sapiens
ggcagcctctgtggaagggga

SEQ ID NO: 7888470 - DNA, 21 bp, Homo sapiens
ggcagcctgacccccagagag

SEQ ID NO: 7888471 - DNA, 21 bp, Homo sapiens
ggcagcctctgtggaagggga

SEQ ID NO: 7888472 - DNA, 21 bp, Homo sapiens
ggcagcctctgtggaagggga

SEQ ID NO: 7888473 - DNA, 18 bp, Homo sapiens
ggcagcctggacatgctc

SEQ ID NO: 7888474 - DNA, 18 bp, Homo sapiens
ggcagcctggacatgctc

SEQ ID NO: 7888475 - DNA, 19 bp, Homo sapiens
ggcagcctgcacgggctgc

SEQ ID NO: 7888476 - DNA, 18 bp, Homo sapiens
ggcagcctggacatgctc

SEQ ID NO: 7888477 - DNA, 18 bp, Homo sapiens
ggcagcctggacatgctc

SEQ ID NO: 7888478 - DNA, 22 bp, Homo sapiens
ggcagcctggagactttgtgaa

SEQ ID NO: 7888479 - DNA, 22 bp, Homo sapiens
ggcagcctggagactttgtgaa

SEQ ID NO: 7888480 - DNA, 22 bp, Homo sapiens
ggcagccttctctcataggtga

SEQ ID NO: 7888481 - DNA, 22 bp, Homo sapiens
ggcagccttgactagtgactta

SEQ ID NO: 7888482 - DNA, 22 bp, Homo sapiens
ggcagccttctctcataggtga

SEQ ID NO: 7888483 - DNA, 22 bp, Homo sapiens
ggcagccttctctcataggtga

SEQ ID NO: 7888484 - DNA, 22 bp, Homo sapiens
ggcagccttgagggaggcctgg

SEQ ID NO: 7888485 - DNA, 22 bp, Homo sapiens
ggcagccttgactagtgactta

SEQ ID NO: 7888486 - DNA, 22 bp, Homo sapiens
ggcagctcacgggcatggggtg

SEQ ID NO: 7888487 - DNA, 22 bp, Homo sapiens
ggcagctcacgggcatggggtg

SEQ ID NO: 7888488 - DNA, 20 bp, Homo sapiens
ggcagctcactactttctgt

SEQ ID NO: 7888489 - DNA, 22 bp, Homo sapiens
ggcagctcactgattagcaatt

SEQ ID NO: 7888490 - DNA, 21 bp, Homo sapiens
ggcagctcagcagatggggac

SEQ ID NO: 7888491 - DNA, 21 bp, Homo sapiens
ggcagctcagcagatggggac

SEQ ID NO: 7888492 - DNA, 22 bp, Homo sapiens
ggcagctcgatgacttctgcat

SEQ ID NO: 7888493 - DNA, 22 bp, Homo sapiens
ggcagctcgatgacttctgcat

SEQ ID NO: 7888494 - DNA, 22 bp, Homo sapiens
ggcagctcgatgacttctgcat

SEQ ID NO: 7888495 - DNA, 21 bp, Homo sapiens
ggcagctcccagtttgggtgt

SEQ ID NO: 7888496 - DNA, 22 bp, Homo sapiens
ggcagctcacctctggtccagg

SEQ ID NO: 7888497 - DNA, 22 bp, Homo sapiens
ggcagctattccaagcagcact

SEQ ID NO: 7888498 - DNA, 22 bp, Homo sapiens
ggcagctagaattgtgatgctg

SEQ ID NO: 7888499 - DNA, 22 bp, Homo sapiens
ggcagctagagctctttaaagt

SEQ ID NO: 7888500 - DNA, 20 bp, Homo sapiens
ggcagcgggttcgggcgcag

SEQ ID NO: 7888501 - DNA, 20 bp, Homo sapiens
ggcagcgggttcgggcgcag

SEQ ID NO: 7888502 - DNA, 22 bp, Homo sapiens
ggcagcgagtcgccaagtctcg

SEQ ID NO: 7888503 - DNA, 22 bp, Homo sapiens
ggcagccttgagggaggcctgg

SEQ ID NO: 7888504 - DNA, 22 bp, Homo sapiens
ggcagccttgagggaggcctgg

SEQ ID NO: 7888505 - DNA, 22 bp, Homo sapiens
ggcagccttgagggaggcctgg

SEQ ID NO: 7888506 - DNA, 22 bp, Homo sapiens
ggcagccttgagggaggcctgg

SEQ ID NO: 7888507 - DNA, 22 bp, Homo sapiens
ggcagccttgagggaggcctgg

SEQ ID NO: 7888508 - DNA, 22 bp, Homo sapiens
ggcaggctgttcacctgctttt

SEQ ID NO: 7888509 - DNA, 22 bp, Homo sapiens
ggcaggctgttcacctgctttt

SEQ ID NO: 7888510 - DNA, 22 bp, Homo sapiens
ggcaggcttgatatggggggac

SEQ ID NO: 7888511 - DNA, 22 bp, Homo sapiens
ggcaggctgttcacctgctttt

SEQ ID NO: 7888512 - DNA, 22 bp, Homo sapiens
ggcaggctgttcacctgctttt

SEQ ID NO: 7888513 - DNA, 22 bp, Homo sapiens
ggcaggcttgatatggggggac

SEQ ID NO: 7888514 - DNA, 22 bp, Homo sapiens
ggcaggcttgatatggggggac

SEQ ID NO: 7888515 - DNA, 22 bp, Homo sapiens
ggcaggcttgatatggggggac

SEQ ID NO: 7888516 - DNA, 22 bp, Homo sapiens
ggcaggcttggtggcaccggtt

SEQ ID NO: 7888517 - DNA, 20 bp, Homo sapiens
ggcaggctttatatggaggg

SEQ ID NO: 7888518 - DNA, 20 bp, Homo sapiens
ggcaggctttatatggaggg

SEQ ID NO: 7888519 - DNA, 20 bp, Homo sapiens
ggcaggctttatatggaggg

SEQ ID NO: 7888520 - DNA, 20 bp, Homo sapiens
ggcaggctttatatggaggg

SEQ ID NO: 7888521 - DNA, 20 bp, Homo sapiens
ggcaggctttatatggaggg

SEQ ID NO: 7888522 - DNA, 22 bp, Homo sapiens
ggcaggctttcagcatcaagtc

SEQ ID NO: 7888523 - DNA, 22 bp, Homo sapiens
ggcaggctttcagcatcaagtc

SEQ ID NO: 7888524 - DNA, 22 bp, Homo sapiens
ggcaggctttcagcatcaagtc

SEQ ID NO: 7888525 - DNA, 22 bp, Homo sapiens
ggcaggctttcagcatcaagtc

SEQ ID NO: 7888526 - DNA, 22 bp, Homo sapiens
ggcaggctttcagcatcaagtc

SEQ ID NO: 7888527 - DNA, 22 bp, Homo sapiens
ggcaggctttgagaaagagcat

SEQ ID NO: 7888528 - DNA, 18 bp, Homo sapiens
ggcagggaaaagataggg

SEQ ID NO: 7888529 - DNA, 18 bp, Homo sapiens
ggcagggaaaagataggg

SEQ ID NO: 7888530 - DNA, 18 bp, Homo sapiens
ggcagggaaaagataggg

SEQ ID NO: 7888531 - DNA, 16 bp, Homo sapiens
gggagtgaaggagggt

SEQ ID NO: 7888532 - DNA, 22 bp, Homo sapiens
gggagtcctcagaagttcccgg

SEQ ID NO: 7888533 - DNA, 22 bp, Homo sapiens
gggagtcctcagaagttcccgg

SEQ ID NO: 7888534 - DNA, 22 bp, Homo sapiens
gggagtcatgtggctaaatctc

SEQ ID NO: 7888535 - DNA, 22 bp, Homo sapiens
gggagtcaggctccctcagaga

SEQ ID NO: 7888536 - DNA, 22 bp, Homo sapiens
gggagtcaggctccctcagaga

SEQ ID NO: 7888537 - DNA, 22 bp, Homo sapiens
gggagtaaactatggtgaggat

SEQ ID NO: 7888538 - DNA, 22 bp, Homo sapiens
gggagtcagtgaaggagtcaga

SEQ ID NO: 7888539 - DNA, 22 bp, Homo sapiens
gggagtcagtgaaggagtcaga

SEQ ID NO: 7888540 - DNA, 22 bp, Homo sapiens
gggagtggagagcaatggatga

SEQ ID NO: 7888541 - DNA, 22 bp, Homo sapiens
gggagtggagagcaatggatga

SEQ ID NO: 7888542 - DNA, 22 bp, Homo sapiens
gggagtggagagcaatggatga

SEQ ID NO: 7888543 - DNA, 22 bp, Homo sapiens
gggagtggattatgtggaccca

SEQ ID NO: 7888544 - DNA, 22 bp, Homo sapiens
gggagtggattatgtggaccca

SEQ ID NO: 7888545 - DNA, 22 bp, Homo sapiens
gggagtggattatgtggaccca

SEQ ID NO: 7888546 - DNA, 22 bp, Homo sapiens
gggaggttgaggctgcagtgag

SEQ ID NO: 7888547 - DNA, 22 bp, Homo sapiens
gggaggttgaggctgcagtgag

SEQ ID NO: 7888548 - DNA, 22 bp, Homo sapiens
gggagtcagagaggtaatggga

SEQ ID NO: 7888549 - DNA, 22 bp, Homo sapiens
gggagtaaactatggtgaggat

SEQ ID NO: 7888550 - DNA, 22 bp, Homo sapiens
gggaggttgaggctgcagtgag

SEQ ID NO: 7888551 - DNA, 22 bp, Homo sapiens
gggaggttgaggctgcagtgag

SEQ ID NO: 7888552 - DNA, 22 bp, Homo sapiens
gggaggttgaggctgcagtgag

SEQ ID NO: 7888553 - DNA, 22 bp, Homo sapiens
gggaggttgaggctgcagtgag

SEQ ID NO: 7888554 - DNA, 22 bp, Homo sapiens
gggagctgaatggcaatggaga

SEQ ID NO: 7888555 - DNA, 22 bp, Homo sapiens
gggagctgaatggcaatggaga

SEQ ID NO: 7888556 - DNA, 22 bp, Homo sapiens
gggagccttgggagtgccagcc

SEQ ID NO: 7888557 - DNA, 22 bp, Homo sapiens
gggagccttgggagtgccagcc

SEQ ID NO: 7888558 - DNA, 22 bp, Homo sapiens
gggagccttgggagtgccagcc

SEQ ID NO: 7888559 - DNA, 22 bp, Homo sapiens
gggagccttgggagtgccagcc

SEQ ID NO: 7888560 - DNA, 22 bp, Homo sapiens
gggagccttgggagtgccagcc

SEQ ID NO: 7888561 - DNA, 22 bp, Homo sapiens
gggagcgggactgcgcaggctt

SEQ ID NO: 7888562 - DNA, 22 bp, Homo sapiens
gggagcgggactgcgcaggctt

SEQ ID NO: 7888563 - DNA, 22 bp, Homo sapiens
gggagcgggactgcgcaggctt

SEQ ID NO: 7888564 - DNA, 22 bp, Homo sapiens
gggagctctccctgaggcctgg

SEQ ID NO: 7888565 - DNA, 22 bp, Homo sapiens
gggagctctccctgaggcctgg

SEQ ID NO: 7888566 - DNA, 22 bp, Homo sapiens
gggagctccactgcctctcatt

SEQ ID NO: 7888567 - DNA, 22 bp, Homo sapiens
gggagctcgtgcgcccaggtgc

SEQ ID NO: 7888568 - DNA, 22 bp, Homo sapiens
gggagctccactgcctctcatt

SEQ ID NO: 7888569 - DNA, 22 bp, Homo sapiens
gggagctatgacactagcacca

SEQ ID NO: 7888570 - DNA, 22 bp, Homo sapiens
gggagctatttatagaggctga

SEQ ID NO: 7888571 - DNA, 22 bp, Homo sapiens
gggagcgggactgcgcaggctt

SEQ ID NO: 7888572 - DNA, 22 bp, Homo sapiens
gggagctgaactgctgaagttg

SEQ ID NO: 7888573 - DNA, 22 bp, Homo sapiens
gggagctctccctgaggcctgg

SEQ ID NO: 7888574 - DNA, 22 bp, Homo sapiens
gggagctgaaggagccggcggg

SEQ ID NO: 7888575 - DNA, 22 bp, Homo sapiens
gggagctgaaggagccggcggg

SEQ ID NO: 7888576 - DNA, 22 bp, Homo sapiens
gggagctgaactgctgaagttg

SEQ ID NO: 7888577 - DNA, 22 bp, Homo sapiens
gggagctgaagtaggggtaaat

SEQ ID NO: 7888578 - DNA, 22 bp, Homo sapiens
gggagctgaatggcaatggaga

SEQ ID NO: 7888579 - DNA, 22 bp, Homo sapiens
gggagctgaaggagccggcggg

SEQ ID NO: 7888580 - DNA, 22 bp, Homo sapiens
gggataggagattgggagtgtt

SEQ ID NO: 7888581 - DNA, 22 bp, Homo sapiens
gggataggagattgggagtgtt

SEQ ID NO: 7888582 - DNA, 22 bp, Homo sapiens
gggataggagattgggagtgtt

SEQ ID NO: 7888583 - DNA, 22 bp, Homo sapiens
gggataggagattgggagtgtt

SEQ ID NO: 7888584 - DNA, 22 bp, Homo sapiens
gggataggtttggaagaggtgg

SEQ ID NO: 7888585 - DNA, 22 bp, Homo sapiens
gggataggtttggaagaggtgg

SEQ ID NO: 7888586 - DNA, 22 bp, Homo sapiens
gggataggtttggaagaggtgg

SEQ ID NO: 7888587 - DNA, 22 bp, Homo sapiens
gggataggagattgggagtgtt

SEQ ID NO: 7888588 - DNA, 22 bp, Homo sapiens
gggataggtttggaagaggtgg

SEQ ID NO: 7888589 - DNA, 22 bp, Homo sapiens
gggataggtttggaagaggtgg

SEQ ID NO: 7888590 - DNA, 22 bp, Homo sapiens
gggataggaaacttaggtacac

SEQ ID NO: 7888591 - DNA, 22 bp, Homo sapiens
gggataggagattgggagtgtt

SEQ ID NO: 7888592 - DNA, 19 bp, Homo sapiens
gggagttgttctgatccta

SEQ ID NO: 7888593 - DNA, 22 bp, Homo sapiens
gggatacatgagtgactttatg

SEQ ID NO: 7888594 - DNA, 22 bp, Homo sapiens
gggataggaaacttaggtacac

SEQ ID NO: 7888595 - DNA, 22 bp, Homo sapiens
gggagtgttgagcgccctgcca

SEQ ID NO: 7888596 - DNA, 22 bp, Homo sapiens
gggagtgtgcagaagctggggg

SEQ ID NO: 7888597 - DNA, 22 bp, Homo sapiens
gggagtggttgatggtgaaaat

SEQ ID NO: 7888598 - DNA, 22 bp, Homo sapiens
gggagtgtgcacacatggtata

SEQ ID NO: 7888599 - DNA, 19 bp, Homo sapiens
gggatcagcccagggctct

SEQ ID NO: 7888600 - DNA, 19 bp, Homo sapiens
gggatcagcccagggctct

SEQ ID NO: 7888601 - DNA, 19 bp, Homo sapiens
gggatcagcccagggctct

SEQ ID NO: 7888602 - DNA, 22 bp, Homo sapiens
gggatcagcaagccactgcacc

SEQ ID NO: 7888603 - DNA, 20 bp, Homo sapiens
gggatcaggaaaggaggcta

SEQ ID NO: 7888604 - DNA, 19 bp, Homo sapiens
gggatcagcccagggctct

SEQ ID NO: 7888605 - DNA, 20 bp, Homo sapiens
gggatcaggaaaggaggcta

SEQ ID NO: 7888606 - DNA, 22 bp, Homo sapiens
gggatcaataatggcaggtgtt

SEQ ID NO: 7888607 - DNA, 22 bp, Homo sapiens
gggatcagaaacatagccctga

SEQ ID NO: 7888608 - DNA, 22 bp, Homo sapiens
gggatcagcaagccactgcacc

SEQ ID NO: 7888609 - DNA, 22 bp, Homo sapiens
gggatcagattccctgtcccaa

SEQ ID NO: 7888610 - DNA, 22 bp, Homo sapiens
gggatcagactctgggatgtag

SEQ ID NO: 7888611 - DNA, 22 bp, Homo sapiens
gggagtgggtttggcctaggcc

SEQ ID NO: 7888612 - DNA, 22 bp, Homo sapiens
gggagtgggtttggcctaggcc

SEQ ID NO: 7888613 - DNA, 22 bp, Homo sapiens
gggagtgggtttggcctaggcc

SEQ ID NO: 7888614 - DNA, 22 bp, Homo sapiens
gggagtgggtttggcctaggcc

SEQ ID NO: 7888615 - DNA, 22 bp, Homo sapiens
gggagtgggtttggcctaggcc

SEQ ID NO: 7888616 - DNA, 22 bp, Homo sapiens
gggagtgggtttggcctaggcc

SEQ ID NO: 7888617 - DNA, 22 bp, Homo sapiens
gggagtggattatgtggaccca

SEQ ID NO: 7888618 - DNA, 22 bp, Homo sapiens
gggagtggggcttaccttgaag

SEQ ID NO: 7888619 - DNA, 22 bp, Homo sapiens
gggagtggggcttaccttgaag

SEQ ID NO: 7888620 - DNA, 22 bp, Homo sapiens
gggagtgggtttggcctaggcc

SEQ ID NO: 7888621 - DNA, 22 bp, Homo sapiens
gggagtgggtttggcctaggcc

SEQ ID NO: 7888622 - DNA, 20 bp, Homo sapiens
gggagtggtggtagcctgtg

SEQ ID NO: 7888623 - DNA, 20 bp, Homo sapiens
gggagtggtggtagcctgtg

SEQ ID NO: 7888624 - DNA, 20 bp, Homo sapiens
gggagtggtggtagcctgtg

SEQ ID NO: 7888625 - DNA, 22 bp, Homo sapiens
gggagtgggtttggcctaggcc

SEQ ID NO: 7888626 - DNA, 22 bp, Homo sapiens
gggagtgggtttggcctaggcc

SEQ ID NO: 7888627 - DNA, 22 bp, Homo sapiens
gggagtggttgatggtgaaaat

SEQ ID NO: 7888628 - DNA, 22 bp, Homo sapiens
gggagtggttgatggtgaaaat

SEQ ID NO: 7888629 - DNA, 22 bp, Homo sapiens
gggagtggttgatggtgaaaat

SEQ ID NO: 7888630 - DNA, 22 bp, Homo sapiens
gggagtggttgatggtgaaaat

SEQ ID NO: 7888631 - DNA, 22 bp, Homo sapiens
gggcagagagctggaactcctt

SEQ ID NO: 7888632 - DNA, 22 bp, Homo sapiens
gggcagagagctggaactcctt

SEQ ID NO: 7888633 - DNA, 22 bp, Homo sapiens
gggcagagagctggaactcctt

SEQ ID NO: 7888634 - DNA, 20 bp, Homo sapiens
gggcagagccagccagtccc

SEQ ID NO: 7888635 - DNA, 20 bp, Homo sapiens
gggcagagccagccagtccc

SEQ ID NO: 7888636 - DNA, 20 bp, Homo sapiens
gggcagagccagccagtccc

SEQ ID NO: 7888637 - DNA, 20 bp, Homo sapiens
gggcagagccagccagtccc

SEQ ID NO: 7888638 - DNA, 20 bp, Homo sapiens
gggcagagccagccagtccc

SEQ ID NO: 7888639 - DNA, 20 bp, Homo sapiens
gggcagagccagccagtccc

SEQ ID NO: 7888640 - DNA, 20 bp, Homo sapiens
gggcagagccagccagtccc

SEQ ID NO: 7888641 - DNA, 20 bp, Homo sapiens
gggcagagccagccagtccc

SEQ ID NO: 7888642 - DNA, 20 bp, Homo sapiens
gggcagagccagccagtccc

SEQ ID NO: 7888643 - DNA, 22 bp, Homo sapiens
gggcagaggctctggcccatcc

SEQ ID NO: 7888644 - DNA, 22 bp, Homo sapiens
gggcagaggctctggcccatcc

SEQ ID NO: 7888645 - DNA, 22 bp, Homo sapiens
gggcagaggctctggcccatcc

SEQ ID NO: 7888646 - DNA, 22 bp, Homo sapiens
gggcagaggctctggcccatcc

SEQ ID NO: 7888647 - DNA, 20 bp, Homo sapiens
gggcagagccagccagtccc

SEQ ID NO: 7888648 - DNA, 20 bp, Homo sapiens
gggcagagccagccagtccc

SEQ ID NO: 7888649 - DNA, 22 bp, Homo sapiens
gggcagagactcagaaacagaa

SEQ ID NO: 7888650 - DNA, 22 bp, Homo sapiens
gggcagagactcagaaacagaa

SEQ ID NO: 7888651 - DNA, 22 bp, Homo sapiens
gggcagagactcagaaacagaa

SEQ ID NO: 7888652 - DNA, 22 bp, Homo sapiens
gggcagagactcagaaacagaa

SEQ ID NO: 7888653 - DNA, 22 bp, Homo sapiens
gggcagagactcagaaacagaa

SEQ ID NO: 7888654 - DNA, 22 bp, Homo sapiens
gggcagagagctggaactcctt

SEQ ID NO: 7888655 - DNA, 22 bp, Homo sapiens
gggcagagagctggaactcctt

SEQ ID NO: 7888656 - DNA, 22 bp, Homo sapiens
gggcagagagctggaactcctt

SEQ ID NO: 7888657 - DNA, 22 bp, Homo sapiens
gggcagagagctggaactcctt

SEQ ID NO: 7888658 - DNA, 22 bp, Homo sapiens
gggcagagagctggaactcctt

SEQ ID NO: 7888659 - DNA, 22 bp, Homo sapiens
gggcagagagctggaactcctt

SEQ ID NO: 7888660 - DNA, 22 bp, Homo sapiens
gggcagagactcagaaacagaa

SEQ ID NO: 7888661 - DNA, 22 bp, Homo sapiens
gggcagagagctggaactcctt

SEQ ID NO: 7888662 - DNA, 22 bp, Homo sapiens
gggatccatccgtgcagcagag

SEQ ID NO: 7888663 - DNA, 22 bp, Homo sapiens
gggcactggtgctgccatcttg

SEQ ID NO: 7888664 - DNA, 18 bp, Homo sapiens
gggatcaggctgcctagg

SEQ ID NO: 7888665 - DNA, 18 bp, Homo sapiens
gggatcaggctgcctagg

SEQ ID NO: 7888666 - DNA, 22 bp, Homo sapiens
gggcactgtacactgtgcatgg

SEQ ID NO: 7888667 - DNA, 22 bp, Homo sapiens
gggcactgtgctaggtgctgag

SEQ ID NO: 7888668 - DNA, 22 bp, Homo sapiens
gggcactggtgctgccatcttg

SEQ ID NO: 7888669 - DNA, 22 bp, Homo sapiens
gggcactgtacactgtgcatgg

SEQ ID NO: 7888670 - DNA, 21 bp, Homo sapiens
gggcagaggggcctcctgggt

SEQ ID NO: 7888671 - DNA, 21 bp, Homo sapiens
gggcagaggggcctcctgggt

SEQ ID NO: 7888672 - DNA, 21 bp, Homo sapiens
gggcagaggggcctcctgggt

SEQ ID NO: 7888673 - DNA, 21 bp, Homo sapiens
gggcagaggggcctcctgggt

SEQ ID NO: 7888674 - DNA, 21 bp, Homo sapiens
gggcagaggggcctcctgggt

SEQ ID NO: 7888675 - DNA, 21 bp, Homo sapiens
gggcagaggggcctcctgggt

SEQ ID NO: 7888676 - DNA, 21 bp, Homo sapiens
gggcagaggggcctcctgggt

SEQ ID NO: 7888677 - DNA, 22 bp, Homo sapiens
gggcagaggctctggcccatcc

SEQ ID NO: 7888678 - DNA, 22 bp, Homo sapiens
gggcagaggctctggcccatcc

SEQ ID NO: 7888679 - DNA, 22 bp, Homo sapiens
gggcagaggctctggcccatcc

SEQ ID NO: 7888680 - DNA, 22 bp, Homo sapiens
gggcagaggctctggcccatcc

SEQ ID NO: 7888681 - DNA, 22 bp, Homo sapiens
gggcagaggctctggcccatcc

SEQ ID NO: 7888682 - DNA, 17 bp, Homo sapiens
gggcagggactcctggg

SEQ ID NO: 7888683 - DNA, 17 bp, Homo sapiens
gggcagggactcctggg

SEQ ID NO: 7888684 - DNA, 17 bp, Homo sapiens
gggcagggactcctggg

SEQ ID NO: 7888685 - DNA, 17 bp, Homo sapiens
gggcagggactcctggg

SEQ ID NO: 7888686 - DNA, 17 bp, Homo sapiens
gggcagggactcctggg

SEQ ID NO: 7888687 - DNA, 21 bp, Homo sapiens
gggcagaggggcctcctgggt

SEQ ID NO: 7888688 - DNA, 21 bp, Homo sapiens
gggcagaggggcctcctgggt

SEQ ID NO: 7888689 - DNA, 21 bp, Homo sapiens
gggcagaggggcctcctgggt

SEQ ID NO: 7888690 - DNA, 21 bp, Homo sapiens
gggcagaggggcctcctgggt

SEQ ID NO: 7888691 - DNA, 22 bp, Homo sapiens
gggcaggtctgggtcagcctga

SEQ ID NO: 7888692 - DNA, 22 bp, Homo sapiens
gggcaggtctgggtcagcctga

SEQ ID NO: 7888693 - DNA, 21 bp, Homo sapiens
gggcaggtctctgatgtcaac

SEQ ID NO: 7888694 - DNA, 22 bp, Homo sapiens
gggcaggtctgggtcagcctga

SEQ ID NO: 7888695 - DNA, 21 bp, Homo sapiens
gggcaggtctctgatgtcaac

SEQ ID NO: 7888696 - DNA, 21 bp, Homo sapiens
gggcaggtctctgatgtcaac

SEQ ID NO: 7888697 - DNA, 21 bp, Homo sapiens
gggcaggtctctgatgtcaac

SEQ ID NO: 7888698 - DNA, 21 bp, Homo sapiens
gggcaggtctctgatgtcaac

SEQ ID NO: 7888699 - DNA, 21 bp, Homo sapiens
gggcaggtctctgatgtcaac

SEQ ID NO: 7888700 - DNA, 22 bp, Homo sapiens
gggcaggtgattttggctccat

SEQ ID NO: 7888701 - DNA, 22 bp, Homo sapiens
gggcaggtgcccagggccagag

SEQ ID NO: 7888702 - DNA, 22 bp, Homo sapiens
gggcaggtgcccagggccagag

SEQ ID NO: 7888703 - DNA, 22 bp, Homo sapiens
gggcaggtgcccagggccagag

SEQ ID NO: 7888704 - DNA, 22 bp, Homo sapiens
gggcaggtgcccagggccagag

SEQ ID NO: 7888705 - DNA, 22 bp, Homo sapiens
gggcaggtgccagctccctgtc

SEQ ID NO: 7888706 - DNA, 22 bp, Homo sapiens
gggcaggtgccagctccctgtc

SEQ ID NO: 7888707 - DNA, 22 bp, Homo sapiens
gggccccttgtatctctggctc

SEQ ID NO: 7888708 - DNA, 22 bp, Homo sapiens
gggccccttgtatctctggctc

SEQ ID NO: 7888709 - DNA, 22 bp, Homo sapiens
gggccccttgtatctctggctc

SEQ ID NO: 7888710 - DNA, 22 bp, Homo sapiens
gggccccttgctgctctgctgg

SEQ ID NO: 7888711 - DNA, 22 bp, Homo sapiens
gggccccttgctgctctgctgg

SEQ ID NO: 7888712 - DNA, 22 bp, Homo sapiens
gggcccctgggaattctgtgat

SEQ ID NO: 7888713 - DNA, 22 bp, Homo sapiens
gggccccttgctgctctgctgg

SEQ ID NO: 7888714 - DNA, 22 bp, Homo sapiens
gggccccactggggctgcctgc

SEQ ID NO: 7888715 - DNA, 22 bp, Homo sapiens
gggccccagtcctcccacgtgg

SEQ ID NO: 7888716 - DNA, 22 bp, Homo sapiens
gggccccactggggctgcctgc

SEQ ID NO: 7888717 - DNA, 22 bp, Homo sapiens
gggccccactggggctgcctgc

SEQ ID NO: 7888718 - DNA, 22 bp, Homo sapiens
gggcccctgggaattctgtgat

SEQ ID NO: 7888719 - DNA, 22 bp, Homo sapiens
gggccccagtcctcccacgtgg

SEQ ID NO: 7888720 - DNA, 22 bp, Homo sapiens
gggccccagtcctcccacgtgg

SEQ ID NO: 7888721 - DNA, 22 bp, Homo sapiens
gggcccagtaccctctgccaag

SEQ ID NO: 7888722 - DNA, 22 bp, Homo sapiens
gggcccagtaccctctgccaag

SEQ ID NO: 7888723 - DNA, 22 bp, Homo sapiens
gggcccagtaccctctgccaag

SEQ ID NO: 7888724 - DNA, 22 bp, Homo sapiens
gggcccagtaccctctgccaag

SEQ ID NO: 7888725 - DNA, 22 bp, Homo sapiens
gggcccagtaccctctgccaag

SEQ ID NO: 7888726 - DNA, 22 bp, Homo sapiens
gggcccagtaccctctgccaag

SEQ ID NO: 7888727 - DNA, 22 bp, Homo sapiens
gggcccaggcctccttccttcc

SEQ ID NO: 7888728 - DNA, 22 bp, Homo sapiens
gggcccaggcctccttccttcc

SEQ ID NO: 7888729 - DNA, 22 bp, Homo sapiens
gggcccaggcctccttccttcc

SEQ ID NO: 7888730 - DNA, 22 bp, Homo sapiens
gggcccagtaccctctgccaag

SEQ ID NO: 7888731 - DNA, 22 bp, Homo sapiens
gggccccaagaacctcctcctg

SEQ ID NO: 7888732 - DNA, 22 bp, Homo sapiens
gggccccaaaatgccaggctct

SEQ ID NO: 7888733 - DNA, 22 bp, Homo sapiens
gggccccaagaacctcctcctg

SEQ ID NO: 7888734 - DNA, 22 bp, Homo sapiens
gggcaggtgtgcagagctgttg

SEQ ID NO: 7888735 - DNA, 22 bp, Homo sapiens
gggcaggtgtgcagagctgttg

SEQ ID NO: 7888736 - DNA, 22 bp, Homo sapiens
gggcaggtgtgcagagctgttg

SEQ ID NO: 7888737 - DNA, 22 bp, Homo sapiens
gggcaggtgtttccaaggtgag

SEQ ID NO: 7888738 - DNA, 22 bp, Homo sapiens
gggcaggtgttgtcaatctaat

SEQ ID NO: 7888739 - DNA, 22 bp, Homo sapiens
gggcaggtgtttccaaggtgag

SEQ ID NO: 7888740 - DNA, 22 bp, Homo sapiens
gggcaggtgtttccaaggtgag

SEQ ID NO: 7888741 - DNA, 22 bp, Homo sapiens
gggcaggtgtttccaaggtgag

SEQ ID NO: 7888742 - DNA, 22 bp, Homo sapiens
gggcaggtgtttccaaggtgag

SEQ ID NO: 7888743 - DNA, 22 bp, Homo sapiens
gggcaggtgtttccaaggtgag

SEQ ID NO: 7888744 - DNA, 22 bp, Homo sapiens
gggcaggtggcaaagccagagg

SEQ ID NO: 7888745 - DNA, 22 bp, Homo sapiens
gggcaggtggagggcccagcca

SEQ ID NO: 7888746 - DNA, 22 bp, Homo sapiens
gggcaggtggagggcccagcca

SEQ ID NO: 7888747 - DNA, 22 bp, Homo sapiens
gggcaggtggcctcttgtacta

SEQ ID NO: 7888748 - DNA, 22 bp, Homo sapiens
gggcaggtggcagggtctctgg

SEQ ID NO: 7888749 - DNA, 22 bp, Homo sapiens
gggcaggtggcaaagccagagg

SEQ ID NO: 7888750 - DNA, 22 bp, Homo sapiens
gggcaggtggcagggtctctgg

SEQ ID NO: 7888751 - DNA, 22 bp, Homo sapiens
gggcaggtggcaaagccagagg

SEQ ID NO: 7888752 - DNA, 18 bp, Homo sapiens
gggctcacacaggtcatc

SEQ ID NO: 7888753 - DNA, 22 bp, Homo sapiens
gggctcagacatccctcctgga

SEQ ID NO: 7888754 - DNA, 19 bp, Homo sapiens
gggcctcacccacacctcc

SEQ ID NO: 7888755 - DNA, 19 bp, Homo sapiens
gggcctcacccacacctcc

SEQ ID NO: 7888756 - DNA, 22 bp, Homo sapiens
gggcctcacctctccaccgcct

SEQ ID NO: 7888757 - DNA, 22 bp, Homo sapiens
gggcctcactatgtggtccagg

SEQ ID NO: 7888758 - DNA, 22 bp, Homo sapiens
gggccggagctgggtcccgcgc

SEQ ID NO: 7888759 - DNA, 22 bp, Homo sapiens
gggccggagctgggtcccgcgc

SEQ ID NO: 7888760 - DNA, 22 bp, Homo sapiens
gggccctgtgatttcttgagga

SEQ ID NO: 7888761 - DNA, 22 bp, Homo sapiens
gggccggagctgggtcccgcgc

SEQ ID NO: 7888762 - DNA, 22 bp, Homo sapiens
gggccggagctgggtcccgcgc

SEQ ID NO: 7888763 - DNA, 22 bp, Homo sapiens
gggccggagctgggtcccgcgc

SEQ ID NO: 7888764 - DNA, 22 bp, Homo sapiens
gggccctggggcctgatttgca

SEQ ID NO: 7888765 - DNA, 22 bp, Homo sapiens
gggccctggggcctgatttgca

SEQ ID NO: 7888766 - DNA, 22 bp, Homo sapiens
gggccctgtgatttcttgagga

SEQ ID NO: 7888767 - DNA, 22 bp, Homo sapiens
gggccctggggcctgatttgca

SEQ ID NO: 7888768 - DNA, 22 bp, Homo sapiens
gggccctgccccgtggctctga

SEQ ID NO: 7888769 - DNA, 22 bp, Homo sapiens
gggccctgcctaaggaacacac

SEQ ID NO: 7888770 - DNA, 22 bp, Homo sapiens
gggccctgcctaaggaacacac

SEQ ID NO: 7888771 - DNA, 22 bp, Homo sapiens
gggccctgcctaaggaacacac

SEQ ID NO: 7888772 - DNA, 22 bp, Homo sapiens
gggccctgcctaaggaacacac

SEQ ID NO: 7888773 - DNA, 22 bp, Homo sapiens
gggccctgggattcagagcaag

SEQ ID NO: 7888774 - DNA, 22 bp, Homo sapiens
gggccctgggattcagagcaag

SEQ ID NO: 7888775 - DNA, 22 bp, Homo sapiens
gggccctgggattcagagcaag

SEQ ID NO: 7888776 - DNA, 22 bp, Homo sapiens
gggccctggggatgtggacgcg

SEQ ID NO: 7888777 - DNA, 22 bp, Homo sapiens
gggccctggggatgtggacgcg

SEQ ID NO: 7888778 - DNA, 22 bp, Homo sapiens
gggccctggggatgtggacgcg

SEQ ID NO: 7888779 - DNA, 22 bp, Homo sapiens
gggccctggggatgtggacgcg

SEQ ID NO: 7888780 - DNA, 22 bp, Homo sapiens
gggccctgggattcagagcaag

SEQ ID NO: 7888781 - DNA, 22 bp, Homo sapiens
gggccctgggattcagagcaag

SEQ ID NO: 7888782 - DNA, 22 bp, Homo sapiens
gggccctggggatgtggacgcg

SEQ ID NO: 7888783 - DNA, 22 bp, Homo sapiens
gggccctctgcagctgcccagg

SEQ ID NO: 7888784 - DNA, 22 bp, Homo sapiens
gggccctgatctgtgagcgcag

SEQ ID NO: 7888785 - DNA, 22 bp, Homo sapiens
gggccctgatctgtgagcgcag

SEQ ID NO: 7888786 - DNA, 22 bp, Homo sapiens
gggccctgatctgtgagcgcag

SEQ ID NO: 7888787 - DNA, 22 bp, Homo sapiens
gggccctctgcagctgcccagg

SEQ ID NO: 7888788 - DNA, 22 bp, Homo sapiens
gggccctctgcagctgcccagg

SEQ ID NO: 7888789 - DNA, 22 bp, Homo sapiens
gggccctcagtcccaggccttc

SEQ ID NO: 7888790 - DNA, 22 bp, Homo sapiens
gggccctcagtcccaggccttc

SEQ ID NO: 7888791 - DNA, 22 bp, Homo sapiens
gggccctcagtcccaggccttc

SEQ ID NO: 7888792 - DNA, 22 bp, Homo sapiens
gggccctgatctgtgagcgcag

SEQ ID NO: 7888793 - DNA, 22 bp, Homo sapiens
gggccctgccccgtggctctga

SEQ ID NO: 7888794 - DNA, 22 bp, Homo sapiens
gggccctgatctgtgagcgcag

SEQ ID NO: 7888795 - DNA, 22 bp, Homo sapiens
gggccctgccccgtggctctga

SEQ ID NO: 7888796 - DNA, 22 bp, Homo sapiens
gggccctgccccgtggctctga

SEQ ID NO: 7888797 - DNA, 22 bp, Homo sapiens
gggccctgccccgtggctctga

SEQ ID NO: 7888798 - DNA, 22 bp, Homo sapiens
gggccctgccccgtggctctga

SEQ ID NO: 7888799 - DNA, 22 bp, Homo sapiens
gggctccaactacatcagcctt

SEQ ID NO: 7888800 - DNA, 22 bp, Homo sapiens
gggctccaactacatcagcctt

SEQ ID NO: 7888801 - DNA, 22 bp, Homo sapiens
gggctccaactacatcagcctt

SEQ ID NO: 7888802 - DNA, 22 bp, Homo sapiens
gggctctggaaatgggagctcc

SEQ ID NO: 7888803 - DNA, 22 bp, Homo sapiens
gggctctgagctctgggaatta

SEQ ID NO: 7888804 - DNA, 22 bp, Homo sapiens
gggctctgagctctgggaatta

SEQ ID NO: 7888805 - DNA, 22 bp, Homo sapiens
gggctctgactgaatattgaat

SEQ ID NO: 7888806 - DNA, 22 bp, Homo sapiens
gggctctgaatgagttaccaag

SEQ ID NO: 7888807 - DNA, 22 bp, Homo sapiens
gggctctgaatgagttaccaag

SEQ ID NO: 7888808 - DNA, 22 bp, Homo sapiens
gggctccaaaatctatgtcttc

SEQ ID NO: 7888809 - DNA, 22 bp, Homo sapiens
gggctccaaaatcctgtagcct

SEQ ID NO: 7888810 - DNA, 22 bp, Homo sapiens
gggctccaaaatctatgtcttc

SEQ ID NO: 7888811 - DNA, 22 bp, Homo sapiens
gggctccaaaatcctgtagcct

SEQ ID NO: 7888812 - DNA, 22 bp, Homo sapiens
gggctcattgggcgctttctaa

SEQ ID NO: 7888813 - DNA, 22 bp, Homo sapiens
gggctcattcatctgggcttgg

SEQ ID NO: 7888814 - DNA, 22 bp, Homo sapiens
gggctccaaccccagtgaactc

SEQ ID NO: 7888815 - DNA, 22 bp, Homo sapiens
gggctccaacggtgagcatgga

SEQ ID NO: 7888816 - DNA, 22 bp, Homo sapiens
gggctccaacggtgagcatgga

SEQ ID NO: 7888817 - DNA, 18 bp, Homo sapiens
gggctctggcatctgggt

SEQ ID NO: 7888818 - DNA, 18 bp, Homo sapiens
gggctctggcatctgggt

SEQ ID NO: 7888819 - DNA, 18 bp, Homo sapiens
gggctctggcatctgggt

SEQ ID NO: 7888820 - DNA, 18 bp, Homo sapiens
gggctctggcatctgggt

SEQ ID NO: 7888821 - DNA, 22 bp, Homo sapiens
gggctctggatggagcctgcag

SEQ ID NO: 7888822 - DNA, 22 bp, Homo sapiens
gggctctggatggagcctgcag

SEQ ID NO: 7888823 - DNA, 22 bp, Homo sapiens
gggctctggatggagcctgcag

SEQ ID NO: 7888824 - DNA, 22 bp, Homo sapiens
gggctctggatggagcctgcag

SEQ ID NO: 7888825 - DNA, 22 bp, Homo sapiens
gggctctggatggagcctgcag

SEQ ID NO: 7888826 - DNA, 22 bp, Homo sapiens
gggctctggatggagcctgcag

SEQ ID NO: 7888827 - DNA, 22 bp, Homo sapiens
gggctctggatggagcctgcag

SEQ ID NO: 7888828 - DNA, 22 bp, Homo sapiens
gggctctggagttctagaaaga

SEQ ID NO: 7888829 - DNA, 22 bp, Homo sapiens
gggctctggagttctagaaaga

SEQ ID NO: 7888830 - DNA, 22 bp, Homo sapiens
gggctctggagttctagaaaga

SEQ ID NO: 7888831 - DNA, 22 bp, Homo sapiens
gggctctggacccaggcaagag

SEQ ID NO: 7888832 - DNA, 22 bp, Homo sapiens
gggctctggacccaggcaagag

SEQ ID NO: 7888833 - DNA, 22 bp, Homo sapiens
gggctctggacccaggcaagag

SEQ ID NO: 7888834 - DNA, 22 bp, Homo sapiens
gggctctggacccaggcaagag

SEQ ID NO: 7888835 - DNA, 22 bp, Homo sapiens
gggctctggacccaggcaagag

SEQ ID NO: 7888836 - DNA, 22 bp, Homo sapiens
gggctctggaaggtgcaccatg

SEQ ID NO: 7888837 - DNA, 22 bp, Homo sapiens
gggctctggaaggtgcaccatg

SEQ ID NO: 7888838 - DNA, 22 bp, Homo sapiens
gggctctggaaggtgcaccatg

SEQ ID NO: 7888839 - DNA, 22 bp, Homo sapiens
gggctctggacccaggcaagag

SEQ ID NO: 7888840 - DNA, 22 bp, Homo sapiens
gggctctggacccaggcaagag

SEQ ID NO: 7888841 - DNA, 22 bp, Homo sapiens
gggctctggaaatgggagctcc

SEQ ID NO: 7888842 - DNA, 22 bp, Homo sapiens
gggctctggaaatgggagctcc

SEQ ID NO: 7888843 - DNA, 22 bp, Homo sapiens
gggctctggaaatgggagctcc

SEQ ID NO: 7888844 - DNA, 22 bp, Homo sapiens
gggctctggaaatgggagctcc

SEQ ID NO: 7888845 - DNA, 22 bp, Homo sapiens
gggctctggaaggtgcaccatg

SEQ ID NO: 7888846 - DNA, 22 bp, Homo sapiens
gggctcagttctgcttcatgct

SEQ ID NO: 7888847 - DNA, 22 bp, Homo sapiens
gggctcagttctgcttcatgct

SEQ ID NO: 7888848 - DNA, 22 bp, Homo sapiens
gggctcatcatctgtgggggat

SEQ ID NO: 7888849 - DNA, 22 bp, Homo sapiens
gggctcatcagctaggaaaatg

SEQ ID NO: 7888850 - DNA, 22 bp, Homo sapiens
gggctcatcaagcctctccgcc

SEQ ID NO: 7888851 - DNA, 22 bp, Homo sapiens
gggctcatgatgtaggctggta

SEQ ID NO: 7888852 - DNA, 22 bp, Homo sapiens
gggctcatggacagctctccag

SEQ ID NO: 7888853 - DNA, 21 bp, Homo sapiens
gggctcagtggaaaagagtgt

SEQ ID NO: 7888854 - DNA, 21 bp, Homo sapiens
gggctcagtggaaaagagtgt

SEQ ID NO: 7888855 - DNA, 22 bp, Homo sapiens
gggctcaggagtttgaggctgc

SEQ ID NO: 7888856 - DNA, 22 bp, Homo sapiens
gggctcagttctgcttcatgct

SEQ ID NO: 7888857 - DNA, 22 bp, Homo sapiens
gggctcagttctgcttcatgct

SEQ ID NO: 7888858 - DNA, 22 bp, Homo sapiens
gggctcagttctgcttcatgct

SEQ ID NO: 7888859 - DNA, 22 bp, Homo sapiens
gggctcagctccttccttccta

SEQ ID NO: 7888860 - DNA, 22 bp, Homo sapiens
gggctcagctgggcgtgctggt

SEQ ID NO: 7888861 - DNA, 22 bp, Homo sapiens
gggctcagctccttccttccta

SEQ ID NO: 7888862 - DNA, 22 bp, Homo sapiens
gggctcagctccttccttccta

SEQ ID NO: 7888863 - DNA, 22 bp, Homo sapiens
gggctcagctgggcgtgctggt

SEQ ID NO: 7888864 - DNA, 22 bp, Homo sapiens
gggctcagctgggcgtgctggt

SEQ ID NO: 7888865 - DNA, 22 bp, Homo sapiens
gggctcagctgggcgtgctggt

SEQ ID NO: 7888866 - DNA, 21 bp, Homo sapiens
gggctcagcgctcggctcctc

SEQ ID NO: 7888867 - DNA, 21 bp, Homo sapiens
gggctcagcgctcggctcctc

SEQ ID NO: 7888868 - DNA, 22 bp, Homo sapiens
gggctcagctccttccttccta

SEQ ID NO: 7888869 - DNA, 22 bp, Homo sapiens
gggctcagctccttccttccta

SEQ ID NO: 7888870 - DNA, 22 bp, Homo sapiens
gggctcagctccttccttccta

SEQ ID NO: 7888871 - DNA, 22 bp, Homo sapiens
gggctcagaggagtggcctggg

SEQ ID NO: 7888872 - DNA, 16 bp, Homo sapiens
gggctcagatctttga

SEQ ID NO: 7888873 - DNA, 22 bp, Homo sapiens
gggctcagaggagtggcctggg

SEQ ID NO: 7888874 - DNA, 23 bp, Homo sapiens
gggctcagatttcattctgtgcc

SEQ ID NO: 7888875 - DNA, 23 bp, Homo sapiens
gggctcagatttcattctgtgcc

SEQ ID NO: 7888876 - DNA, 22 bp, Homo sapiens
gggctcagccccattgaaccag

SEQ ID NO: 7888877 - DNA, 23 bp, Homo sapiens
gggctcagatttcattctgtgcc

SEQ ID NO: 7888878 - DNA, 23 bp, Homo sapiens
gggctcagatttcattctgtgcc

SEQ ID NO: 7888879 - DNA, 22 bp, Homo sapiens
gggctcagcctcctcacttcga

SEQ ID NO: 7888880 - DNA, 21 bp, Homo sapiens
gggctcagcgctcggctcctc

SEQ ID NO: 7888881 - DNA, 22 bp, Homo sapiens
gggctcagcctcctcacttcga

SEQ ID NO: 7888882 - DNA, 22 bp, Homo sapiens
gggctcagcctcctcacttcga

SEQ ID NO: 7888883 - DNA, 22 bp, Homo sapiens
gggctcagaggagtggcctggg

SEQ ID NO: 7888884 - DNA, 22 bp, Homo sapiens
gggctcagaggagtggcctggg

SEQ ID NO: 7888885 - DNA, 22 bp, Homo sapiens
gggctcagaggagtggcctggg

SEQ ID NO: 7888886 - DNA, 22 bp, Homo sapiens
gggctcagaggagtggcctggg

SEQ ID NO: 7888887 - DNA, 22 bp, Homo sapiens
gggctcagagcatttgggttgg

SEQ ID NO: 7888888 - DNA, 22 bp, Homo sapiens
gggctcagaggagtggcctggg

SEQ ID NO: 7888889 - DNA, 22 bp, Homo sapiens
gggctcagaggagtggcctggg

SEQ ID NO: 7888890 - DNA, 22 bp, Homo sapiens
gggctcagacatccctcctgga

SEQ ID NO: 7888891 - DNA, 22 bp, Homo sapiens
gggctcagacatccctcctgga

SEQ ID NO: 7888892 - DNA, 22 bp, Homo sapiens
gggctcagacatccctcctgga

SEQ ID NO: 7888893 - DNA, 22 bp, Homo sapiens
gggctcagagcatttgggttgg

SEQ ID NO: 7888894 - DNA, 22 bp, Homo sapiens
gggctcagagcatttgggttgg

SEQ ID NO: 7888895 - DNA, 22 bp, Homo sapiens
gggctcagacatccctcctgga

SEQ ID NO: 7888896 - DNA, 22 bp, Homo sapiens
ggctggcagcttcatcccagat

SEQ ID NO: 7888897 - DNA, 22 bp, Homo sapiens
ggctggcagcttcatcccagat

SEQ ID NO: 7888898 - DNA, 22 bp, Homo sapiens
ggctggcaggactcacacttgg

SEQ ID NO: 7888899 - DNA, 22 bp, Homo sapiens
ggctggcaggcacagtatgcaa

SEQ ID NO: 7888900 - DNA, 22 bp, Homo sapiens
ggctggcaggcacagtatgcaa

SEQ ID NO: 7888901 - DNA, 22 bp, Homo sapiens
ggctggcagaagtgtgctggct

SEQ ID NO: 7888902 - DNA, 22 bp, Homo sapiens
ggctggcagaagtgtgctggct

SEQ ID NO: 7888903 - DNA, 22 bp, Homo sapiens
ggctggcagaagtgtgctggct

SEQ ID NO: 7888904 - DNA, 22 bp, Homo sapiens
ggctggcagaggggagtctgtg

SEQ ID NO: 7888905 - DNA, 22 bp, Homo sapiens
ggctggcagaggggagtctgtg

SEQ ID NO: 7888906 - DNA, 22 bp, Homo sapiens
ggctggcagaggggagtctgtg

SEQ ID NO: 7888907 - DNA, 22 bp, Homo sapiens
ggctggcagtgtgagagaggga

SEQ ID NO: 7888908 - DNA, 22 bp, Homo sapiens
ggctggcagtgtgagagaggga

SEQ ID NO: 7888909 - DNA, 22 bp, Homo sapiens
ggctggcagtgtgagagaggga

SEQ ID NO: 7888910 - DNA, 22 bp, Homo sapiens
ggctggcaggggatgtcagatg

SEQ ID NO: 7888911 - DNA, 22 bp, Homo sapiens
ggctggcaggggatgtcagatg

SEQ ID NO: 7888912 - DNA, 22 bp, Homo sapiens
ggctggcagtgtgagagaggga

SEQ ID NO: 7888913 - DNA, 22 bp, Homo sapiens
ggctggccagggccctcgctgg

SEQ ID NO: 7888914 - DNA, 22 bp, Homo sapiens
ggctggcattgctctattgcct

SEQ ID NO: 7888915 - DNA, 17 bp, Homo sapiens
ggctggaggggacccgg

SEQ ID NO: 7888916 - DNA, 17 bp, Homo sapiens
ggctggaggggacccgg

SEQ ID NO: 7888917 - DNA, 17 bp, Homo sapiens
ggctggaggggacccgg

SEQ ID NO: 7888918 - DNA, 22 bp, Homo sapiens
ggctggaggagaatgggtgtga

SEQ ID NO: 7888919 - DNA, 22 bp, Homo sapiens
ggctggaggagaatgggtgtga

SEQ ID NO: 7888920 - DNA, 17 bp, Homo sapiens
ggctggaggggacccgg

SEQ ID NO: 7888921 - DNA, 22 bp, Homo sapiens
ggctggaggtagaagaacactt

SEQ ID NO: 7888922 - DNA, 17 bp, Homo sapiens
ggctggaggggacccgg

SEQ ID NO: 7888923 - DNA, 22 bp, Homo sapiens
ggctggaggtagaagaacactt

SEQ ID NO: 7888924 - DNA, 22 bp, Homo sapiens
ggctggaggtagaagaacactt

SEQ ID NO: 7888925 - DNA, 22 bp, Homo sapiens
ggctggaggtagaagaacactt

SEQ ID NO: 7888926 - DNA, 19 bp, Homo sapiens
ggctggagtggccatctgt

SEQ ID NO: 7888927 - DNA, 19 bp, Homo sapiens
ggctggagtggccatctgt

SEQ ID NO: 7888928 - DNA, 19 bp, Homo sapiens
ggctggagtggccatctgt

SEQ ID NO: 7888929 - DNA, 19 bp, Homo sapiens
ggctggagtggccatctgt

SEQ ID NO: 7888930 - DNA, 19 bp, Homo sapiens
ggctggagtggccatctgt

SEQ ID NO: 7888931 - DNA, 22 bp, Homo sapiens
ggctggagtgggctccagagtt

SEQ ID NO: 7888932 - DNA, 22 bp, Homo sapiens
ggctggagtgggctccagagtt

SEQ ID NO: 7888933 - DNA, 22 bp, Homo sapiens
ggctggagtgggctccagagtt

SEQ ID NO: 7888934 - DNA, 22 bp, Homo sapiens
ggctggagtgggctccagagtt

SEQ ID NO: 7888935 - DNA, 22 bp, Homo sapiens
ggctggagtgggctccagagtt

SEQ ID NO: 7888936 - DNA, 19 bp, Homo sapiens
ggctggagtggccatctgt

SEQ ID NO: 7888937 - DNA, 19 bp, Homo sapiens
ggctggagtggccatctgt

SEQ ID NO: 7888938 - DNA, 22 bp, Homo sapiens
ggctggagtgggctccagagtt

SEQ ID NO: 7888939 - DNA, 22 bp, Homo sapiens
ggctggataccaggagacaggg

SEQ ID NO: 7888940 - DNA, 22 bp, Homo sapiens
ggctggagtgggctccagagtt

SEQ ID NO: 7888941 - DNA, 22 bp, Homo sapiens
ggctggatgtactttggggctg

SEQ ID NO: 7888942 - DNA, 22 bp, Homo sapiens
ggctggagtgggctccagagtt

SEQ ID NO: 7888943 - DNA, 22 bp, Homo sapiens
ggctggagtgggctccagagtt

SEQ ID NO: 7888944 - DNA, 22 bp, Homo sapiens
ggctgcctctgatgtgcagacg

SEQ ID NO: 7888945 - DNA, 22 bp, Homo sapiens
ggctgcctctgatgtgcagacg

SEQ ID NO: 7888946 - DNA, 22 bp, Homo sapiens
ggctgcctctgatgtgcagacg

SEQ ID NO: 7888947 - DNA, 22 bp, Homo sapiens
ggctgcctctggaagctggaga

SEQ ID NO: 7888948 - DNA, 22 bp, Homo sapiens
ggctgcctctggaagctggaga

SEQ ID NO: 7888949 - DNA, 22 bp, Homo sapiens
ggctgcctctggaagctggaga

SEQ ID NO: 7888950 - DNA, 22 bp, Homo sapiens
ggctgcctgaactttggggaaa

SEQ ID NO: 7888951 - DNA, 22 bp, Homo sapiens
ggctgcctgaactttggggaaa

SEQ ID NO: 7888952 - DNA, 22 bp, Homo sapiens
ggctgcctgaactttggggaaa

SEQ ID NO: 7888953 - DNA, 22 bp, Homo sapiens
ggctgcctctttcttagtgtct

SEQ ID NO: 7888954 - DNA, 22 bp, Homo sapiens
ggctgcctctttcttagtgtct

SEQ ID NO: 7888955 - DNA, 22 bp, Homo sapiens
ggctgcctgaggcagtgagaga

SEQ ID NO: 7888956 - DNA, 22 bp, Homo sapiens
ggctgcctgaggcagtgagaga

SEQ ID NO: 7888957 - DNA, 22 bp, Homo sapiens
ggctgcctgaggcagtgagaga

SEQ ID NO: 7888958 - DNA, 22 bp, Homo sapiens
ggctgcctgaggcagtgagaga

SEQ ID NO: 7888959 - DNA, 22 bp, Homo sapiens
ggctgcctgaggctgaggcccg

SEQ ID NO: 7888960 - DNA, 22 bp, Homo sapiens
ggctgcctgaggctgaggcccg

SEQ ID NO: 7888961 - DNA, 22 bp, Homo sapiens
ggctgcctgaggctgaggcccg

SEQ ID NO: 7888962 - DNA, 22 bp, Homo sapiens
ggctgcctgaggctgaggcccg

SEQ ID NO: 7888963 - DNA, 22 bp, Homo sapiens
ggctgcctgccgcccacttggc

SEQ ID NO: 7888964 - DNA, 22 bp, Homo sapiens
ggctgcctgccgcccacttggc

SEQ ID NO: 7888965 - DNA, 22 bp, Homo sapiens
ggctgcctgccgcccacttggc

SEQ ID NO: 7888966 - DNA, 22 bp, Homo sapiens
ggctgcctgccgcccacttggc

SEQ ID NO: 7888967 - DNA, 22 bp, Homo sapiens
ggctgcctgaggctgaggcccg

SEQ ID NO: 7888968 - DNA, 22 bp, Homo sapiens
ggctgcctgcctccaagccggg

SEQ ID NO: 7888969 - DNA, 22 bp, Homo sapiens
ggctgcctgcctccaagccggg

SEQ ID NO: 7888970 - DNA, 22 bp, Homo sapiens
ggctgcctgccgcccacttggc

SEQ ID NO: 7888971 - DNA, 22 bp, Homo sapiens
ggctgcctgcctccaagccggg

SEQ ID NO: 7888972 - DNA, 22 bp, Homo sapiens
ggctgcctgctcaggtgcggcg

SEQ ID NO: 7888973 - DNA, 22 bp, Homo sapiens
ggctgcctgctcaggtgcggcg

SEQ ID NO: 7888974 - DNA, 22 bp, Homo sapiens
ggctgcctgctcctcctgcacg

SEQ ID NO: 7888975 - DNA, 22 bp, Homo sapiens
ggctgcctgctcctcctgcacg

SEQ ID NO: 7888976 - DNA, 22 bp, Homo sapiens
ggctgcctgctcaggtgcggcg

SEQ ID NO: 7888977 - DNA, 22 bp, Homo sapiens
ggctgcctgctcaggtgcggcg

SEQ ID NO: 7888978 - DNA, 22 bp, Homo sapiens
ggctgcctgctcctcctgcacg

SEQ ID NO: 7888979 - DNA, 22 bp, Homo sapiens
ggctgcctgctcctcctgcacg

SEQ ID NO: 7888980 - DNA, 22 bp, Homo sapiens
ggctgcctgctcctcctgcacg

SEQ ID NO: 7888981 - DNA, 22 bp, Homo sapiens
ggctggagacaacgtcctgccc

SEQ ID NO: 7888982 - DNA, 22 bp, Homo sapiens
ggctggagacaacgtcctgccc

SEQ ID NO: 7888983 - DNA, 19 bp, Homo sapiens
ggctgcctggagcgagggc

SEQ ID NO: 7888984 - DNA, 22 bp, Homo sapiens
ggctgcctggacctcctctttc

SEQ ID NO: 7888985 - DNA, 22 bp, Homo sapiens
ggctgcctggacctcctctttc

SEQ ID NO: 7888986 - DNA, 22 bp, Homo sapiens
ggctggagatatgtctggaaca

SEQ ID NO: 7888987 - DNA, 22 bp, Homo sapiens
ggctggagatatgtctggaaca

SEQ ID NO: 7888988 - DNA, 22 bp, Homo sapiens
ggctggagatatgtctggaaca

SEQ ID NO: 7888989 - DNA, 22 bp, Homo sapiens
ggctggagatatgtctggaaca

SEQ ID NO: 7888990 - DNA, 22 bp, Homo sapiens
ggctggagatatgtctggaaca

SEQ ID NO: 7888991 - DNA, 22 bp, Homo sapiens
ggctggagatatgtctggaaca

SEQ ID NO: 7888992 - DNA, 22 bp, Homo sapiens
ggctggagacaacgtcctgccc

SEQ ID NO: 7888993 - DNA, 22 bp, Homo sapiens
ggctggagacaacgtcctgccc

SEQ ID NO: 7888994 - DNA, 17 bp, Homo sapiens
ggctggagcagctcccc

SEQ ID NO: 7888995 - DNA, 17 bp, Homo sapiens
ggctggagcagctcccc

SEQ ID NO: 7888996 - DNA, 17 bp, Homo sapiens
ggctggagcagctcccc

SEQ ID NO: 7888997 - DNA, 17 bp, Homo sapiens
ggctggagcagctcccc

SEQ ID NO: 7888998 - DNA, 17 bp, Homo sapiens
ggctggagcagctcccc

SEQ ID NO: 7888999 - DNA, 17 bp, Homo sapiens
ggctggagcagctcccc

SEQ ID NO: 7889000 - DNA, 22 bp, Homo sapiens
ggctggaggagaatgggtgtga

SEQ ID NO: 7889001 - DNA, 22 bp, Homo sapiens
ggctggaggagaatgggtgtga

SEQ ID NO: 7889002 - DNA, 22 bp, Homo sapiens
ggctggaggagaatgggtgtga

SEQ ID NO: 7889003 - DNA, 22 bp, Homo sapiens
ggctggaggagaatgggtgtga

SEQ ID NO: 7889004 - DNA, 22 bp, Homo sapiens
ggctggaggagaatgggtgtga

SEQ ID NO: 7889005 - DNA, 22 bp, Homo sapiens
ggctggaggagaatgggtgtga

SEQ ID NO: 7889006 - DNA, 17 bp, Homo sapiens
ggctggagcagctcccc

SEQ ID NO: 7889007 - DNA, 22 bp, Homo sapiens
ggctggaggagaatgggtgtga

SEQ ID NO: 7889008 - DNA, 22 bp, Homo sapiens
ggctggaggagaatgggtgtga

SEQ ID NO: 7889009 - DNA, 17 bp, Homo sapiens
ggctggagcagctcccc

SEQ ID NO: 7889010 - DNA, 22 bp, Homo sapiens
ggctgccaggagggaggccagt

SEQ ID NO: 7889011 - DNA, 22 bp, Homo sapiens
ggctgccaggagggaggccagt

SEQ ID NO: 7889012 - DNA, 22 bp, Homo sapiens
ggctgccaggagggaggccagt

SEQ ID NO: 7889013 - DNA, 22 bp, Homo sapiens
ggctgccaggagaagctcagtg

SEQ ID NO: 7889014 - DNA, 22 bp, Homo sapiens
ggctgccaggagaagctcagtg

SEQ ID NO: 7889015 - DNA, 22 bp, Homo sapiens
ggctgccacgtcgagggtccaa

SEQ ID NO: 7889016 - DNA, 22 bp, Homo sapiens
ggctgccagcactggtgtagag

SEQ ID NO: 7889017 - DNA, 22 bp, Homo sapiens
ggctgccagcactggtgtagag

SEQ ID NO: 7889018 - DNA, 22 bp, Homo sapiens
ggctgccacgtcgagggtccaa

SEQ ID NO: 7889019 - DNA, 22 bp, Homo sapiens
ggctgccaccctcggacttccg

SEQ ID NO: 7889020 - DNA, 22 bp, Homo sapiens
ggctgccacgtcgagggtccaa

SEQ ID NO: 7889021 - DNA, 22 bp, Homo sapiens
ggctgccacatgccatgtcctc

SEQ ID NO: 7889022 - DNA, 22 bp, Homo sapiens
ggctgcagttgtgtgaaggccg

SEQ ID NO: 7889023 - DNA, 22 bp, Homo sapiens
ggctgcagtttgtcttttgctt

SEQ ID NO: 7889024 - DNA, 22 bp, Homo sapiens
ggctgcagttgtgtgaaggccg

SEQ ID NO: 7889025 - DNA, 22 bp, Homo sapiens
ggctgcagttgtgtgaaggccg

SEQ ID NO: 7889026 - DNA, 22 bp, Homo sapiens
ggctgcagttgtgtgaaggccg

SEQ ID NO: 7889027 - DNA, 22 bp, Homo sapiens
ggctgcagttgtgtgaaggccg

SEQ ID NO: 7889028 - DNA, 22 bp, Homo sapiens
ggctgcagttgtgtgaaggccg

SEQ ID NO: 7889029 - DNA, 22 bp, Homo sapiens
ggctgcagttgtgtgaaggccg

SEQ ID NO: 7889030 - DNA, 22 bp, Homo sapiens
ggctgcagttgtgtgaaggccg

SEQ ID NO: 7889031 - DNA, 22 bp, Homo sapiens
ggctgcagttgtgtgaaggccg

SEQ ID NO: 7889032 - DNA, 22 bp, Homo sapiens
ggctgcagttgtgtgaaggccg

SEQ ID NO: 7889033 - DNA, 22 bp, Homo sapiens
ggctgcctcctgctgggctgga

SEQ ID NO: 7889034 - DNA, 22 bp, Homo sapiens
ggctgcctcctgctgggctgga

SEQ ID NO: 7889035 - DNA, 22 bp, Homo sapiens
ggctgcctcctcgagacaggat

SEQ ID NO: 7889036 - DNA, 22 bp, Homo sapiens
ggctgcctcctgctgggctgga

SEQ ID NO: 7889037 - DNA, 19 bp, Homo sapiens
ggctgcctcctgggagatt

SEQ ID NO: 7889038 - DNA, 19 bp, Homo sapiens
ggctgcctcctgggagatt

SEQ ID NO: 7889039 - DNA, 19 bp, Homo sapiens
ggctgcctcctgggagatt

SEQ ID NO: 7889040 - DNA, 19 bp, Homo sapiens
ggctgcctcctgggagatt

SEQ ID NO: 7889041 - DNA, 22 bp, Homo sapiens
ggctgcctcctgctgggctgga

SEQ ID NO: 7889042 - DNA, 22 bp, Homo sapiens
ggctgcctcctgctgggctgga

SEQ ID NO: 7889043 - DNA, 22 bp, Homo sapiens
ggctgcctcctgctgggctgga

SEQ ID NO: 7889044 - DNA, 22 bp, Homo sapiens
ggctgcctctatttaggatcaa

SEQ ID NO: 7889045 - DNA, 20 bp, Homo sapiens
ggctgcctccttcctttcct

SEQ ID NO: 7889046 - DNA, 22 bp, Homo sapiens
ggctgcctctatttaggatcaa

SEQ ID NO: 7889047 - DNA, 22 bp, Homo sapiens
ggctgcctctatttaggatcaa

SEQ ID NO: 7889048 - DNA, 22 bp, Homo sapiens
ggctgcctctatttaggatcaa

SEQ ID NO: 7889049 - DNA, 20 bp, Homo sapiens
ggctgcctccttcctttcct

SEQ ID NO: 7889050 - DNA, 19 bp, Homo sapiens
ggctgcctcctgggagatt

SEQ ID NO: 7889051 - DNA, 19 bp, Homo sapiens
ggctgcctcctgggagatt

SEQ ID NO: 7889052 - DNA, 22 bp, Homo sapiens
ggctgcctcctcgagacaggat

SEQ ID NO: 7889053 - DNA, 22 bp, Homo sapiens
ggctgcctcctcgagacaggat

SEQ ID NO: 7889054 - DNA, 22 bp, Homo sapiens
ggctgcctcctcgagacaggat

SEQ ID NO: 7889055 - DNA, 22 bp, Homo sapiens
ggctgcctcctcgagacaggat

SEQ ID NO: 7889056 - DNA, 22 bp, Homo sapiens
ggctgcctcctcgagacaggat

SEQ ID NO: 7889057 - DNA, 22 bp, Homo sapiens
ggctgcctccactgcttgtccc

SEQ ID NO: 7889058 - DNA, 22 bp, Homo sapiens
ggctgcctccactgcttgtccc

SEQ ID NO: 7889059 - DNA, 22 bp, Homo sapiens
ggctgcctcccaggagaatctg

SEQ ID NO: 7889060 - DNA, 22 bp, Homo sapiens
ggctgcctcccaggagaatctg

SEQ ID NO: 7889061 - DNA, 22 bp, Homo sapiens
ggctgcctccactgcttgtccc

SEQ ID NO: 7889062 - DNA, 22 bp, Homo sapiens
ggctgcctcccaggagaatctg

SEQ ID NO: 7889063 - DNA, 22 bp, Homo sapiens
ggctgcctcccaggagaatctg

SEQ ID NO: 7889064 - DNA, 22 bp, Homo sapiens
ggctgcctcagatttgctgact

SEQ ID NO: 7889065 - DNA, 22 bp, Homo sapiens
ggctgccagtgagtgcagaccg

SEQ ID NO: 7889066 - DNA, 22 bp, Homo sapiens
ggctgcctcagatttgctgact

SEQ ID NO: 7889067 - DNA, 22 bp, Homo sapiens
ggctgccagtgagtgcagaccg

SEQ ID NO: 7889068 - DNA, 22 bp, Homo sapiens
ggctgccaggagggaggccagt

SEQ ID NO: 7889069 - DNA, 22 bp, Homo sapiens
ggctgcaggcttccctccagca

SEQ ID NO: 7889070 - DNA, 21 bp, Homo sapiens
ggctgcagggagccctggggt

SEQ ID NO: 7889071 - DNA, 21 bp, Homo sapiens
ggctgcagggagccctggggt

SEQ ID NO: 7889072 - DNA, 21 bp, Homo sapiens
ggctgcagggagccctggggt

SEQ ID NO: 7889073 - DNA, 21 bp, Homo sapiens
ggctgcagggagccctggggt

SEQ ID NO: 7889074 - DNA, 21 bp, Homo sapiens
ggctgcagggagccctggggt

SEQ ID NO: 7889075 - DNA, 21 bp, Homo sapiens
ggctgcagggagccctggggt

SEQ ID NO: 7889076 - DNA, 21 bp, Homo sapiens
ggctgcagggagccctggggt

SEQ ID NO: 7889077 - DNA, 21 bp, Homo sapiens
ggctgcagggagccctggggt

SEQ ID NO: 7889078 - DNA, 21 bp, Homo sapiens
ggctgcagggagccctggggt

SEQ ID NO: 7889079 - DNA, 22 bp, Homo sapiens
ggctgcaggcttccctccagca

SEQ ID NO: 7889080 - DNA, 22 bp, Homo sapiens
ggctgcaggcttccctccagca

SEQ ID NO: 7889081 - DNA, 22 bp, Homo sapiens
ggctgcaggcttccctccagca

SEQ ID NO: 7889082 - DNA, 22 bp, Homo sapiens
ggctgcaggcttccctccagca

SEQ ID NO: 7889083 - DNA, 22 bp, Homo sapiens
ggctgcaggcagggtatccact

SEQ ID NO: 7889084 - DNA, 22 bp, Homo sapiens
ggctgcaggcagggtatccact

SEQ ID NO: 7889085 - DNA, 22 bp, Homo sapiens
ggctgcaggcagggtatccact

SEQ ID NO: 7889086 - DNA, 22 bp, Homo sapiens
ggctctgctcacagcccgcagc

SEQ ID NO: 7889087 - DNA, 22 bp, Homo sapiens
ggctctgcggcgtgtgcgcagg

SEQ ID NO: 7889088 - DNA, 22 bp, Homo sapiens
ggctgcaggttggttggcagct

SEQ ID NO: 7889089 - DNA, 22 bp, Homo sapiens
ggctgcaggttggttggcagct

SEQ ID NO: 7889090 - DNA, 22 bp, Homo sapiens
ggctgcaggttggttggcagct

SEQ ID NO: 7889091 - DNA, 22 bp, Homo sapiens
ggctgcaggttggttggcagct

SEQ ID NO: 7889092 - DNA, 22 bp, Homo sapiens
ggctgcaggttggttggcagct

SEQ ID NO: 7889093 - DNA, 22 bp, Homo sapiens
ggctgcaggttggttggcagct

SEQ ID NO: 7889094 - DNA, 22 bp, Homo sapiens
ggctgcaggttggttggcagct

SEQ ID NO: 7889095 - DNA, 22 bp, Homo sapiens
ggctgcagggcagctggtgtgg

SEQ ID NO: 7889096 - DNA, 22 bp, Homo sapiens
ggctgcagggcagctggtgtgg

SEQ ID NO: 7889097 - DNA, 22 bp, Homo sapiens
ggctgcagggcagctggtgtgg

SEQ ID NO: 7889098 - DNA, 22 bp, Homo sapiens
ggctgcagggcagctggtgtgg

SEQ ID NO: 7889099 - DNA, 22 bp, Homo sapiens
ggctgcagggcagctggtgtgg

SEQ ID NO: 7889100 - DNA, 17 bp, Homo sapiens
ggctgcagtccaggagg

SEQ ID NO: 7889101 - DNA, 17 bp, Homo sapiens
ggctgcagtccaggagg

SEQ ID NO: 7889102 - DNA, 17 bp, Homo sapiens
ggctgcagtccaggagg

SEQ ID NO: 7889103 - DNA, 22 bp, Homo sapiens
ggctgcaggttggttggcagct

SEQ ID NO: 7889104 - DNA, 17 bp, Homo sapiens
ggctgcagtccaggagg

SEQ ID NO: 7889105 - DNA, 17 bp, Homo sapiens
ggctgcagtccaggagg

SEQ ID NO: 7889106 - DNA, 17 bp, Homo sapiens
ggctgcagtccaggagg

SEQ ID NO: 7889107 - DNA, 17 bp, Homo sapiens
ggctgcagtccaggagg

SEQ ID NO: 7889108 - DNA, 20 bp, Homo sapiens
ggctgcagtgcacctcatct

SEQ ID NO: 7889109 - DNA, 20 bp, Homo sapiens
ggctgcagtgcacctcatct

SEQ ID NO: 7889110 - DNA, 20 bp, Homo sapiens
ggctgcagtgcacctcatct

SEQ ID NO: 7889111 - DNA, 20 bp, Homo sapiens
ggctgcagtgcacctcatct

SEQ ID NO: 7889112 - DNA, 22 bp, Homo sapiens
gggaagagtaactagcccatgt

SEQ ID NO: 7889113 - DNA, 22 bp, Homo sapiens
gggaagagtgtcggttgaagtg

SEQ ID NO: 7889114 - DNA, 22 bp, Homo sapiens
gggaagagtaactagcccatgt

SEQ ID NO: 7889115 - DNA, 22 bp, Homo sapiens
gggaagagtgtcggttgaagtg

SEQ ID NO: 7889116 - DNA, 22 bp, Homo sapiens
gggaagagtgtcggttgaagtg

SEQ ID NO: 7889117 - DNA, 22 bp, Homo sapiens
gggaagagtgtcggttgaagtg

SEQ ID NO: 7889118 - DNA, 22 bp, Homo sapiens
gggaagagtgtcggttgaagtg

SEQ ID NO: 7889119 - DNA, 22 bp, Homo sapiens
gggaagagtgtcggttgaagtg

SEQ ID NO: 7889120 - DNA, 22 bp, Homo sapiens
gggaagagtgtcggttgaagtg

SEQ ID NO: 7889121 - DNA, 22 bp, Homo sapiens
gggaagagtaactagcccatgt

SEQ ID NO: 7889122 - DNA, 22 bp, Homo sapiens
gggaagagtaactagcccatgt

SEQ ID NO: 7889123 - DNA, 22 bp, Homo sapiens
gggaagagtaactagcccatgt

SEQ ID NO: 7889124 - DNA, 22 bp, Homo sapiens
gggaagagtaactagcccatgt

SEQ ID NO: 7889125 - DNA, 22 bp, Homo sapiens
gggaagagtaactagcccatgt

SEQ ID NO: 7889126 - DNA, 22 bp, Homo sapiens
gggaagagggagctggaatgat

SEQ ID NO: 7889127 - DNA, 22 bp, Homo sapiens
gggaagagtaactagcccatgt

SEQ ID NO: 7889128 - DNA, 22 bp, Homo sapiens
gggaagagtaactagcccatgt

SEQ ID NO: 7889129 - DNA, 22 bp, Homo sapiens
gggaagcagacggcggggaaat

SEQ ID NO: 7889130 - DNA, 22 bp, Homo sapiens
gggaagcagatcataccagacc

SEQ ID NO: 7889131 - DNA, 22 bp, Homo sapiens
gggaagatagtgttgagggccc

SEQ ID NO: 7889132 - DNA, 22 bp, Homo sapiens
gggaagatagtgttgagggccc

SEQ ID NO: 7889133 - DNA, 22 bp, Homo sapiens
gggaagcagatcataccagacc

SEQ ID NO: 7889134 - DNA, 22 bp, Homo sapiens
gggaagcagcattgtgctggct

SEQ ID NO: 7889135 - DNA, 22 bp, Homo sapiens
gggaagcaggtgcagctcgcct

SEQ ID NO: 7889136 - DNA, 22 bp, Homo sapiens
gggaagcaggtgcagctcgcct

SEQ ID NO: 7889137 - DNA, 22 bp, Homo sapiens
gggaagcaggtgcagctcgcct

SEQ ID NO: 7889138 - DNA, 22 bp, Homo sapiens
gggaagcaggtgcagctcgcct

SEQ ID NO: 7889139 - DNA, 22 bp, Homo sapiens
gggaagcagcattgtgctggct

SEQ ID NO: 7889140 - DNA, 22 bp, Homo sapiens
gggaagcagcattgtgctggct

SEQ ID NO: 7889141 - DNA, 22 bp, Homo sapiens
gggaagcagcattgtgctggct

SEQ ID NO: 7889142 - DNA, 22 bp, Homo sapiens
gggaagatagtgttgagggccc

SEQ ID NO: 7889143 - DNA, 22 bp, Homo sapiens
gggaagatagtgttgagggccc

SEQ ID NO: 7889144 - DNA, 22 bp, Homo sapiens
gggaagatagtgttgagggccc

SEQ ID NO: 7889145 - DNA, 22 bp, Homo sapiens
gggaagcatctgagggtccact

SEQ ID NO: 7889146 - DNA, 22 bp, Homo sapiens
gggaagcatctgagggtccact

SEQ ID NO: 7889147 - DNA, 22 bp, Homo sapiens
gggaagcatctgagggtccact

SEQ ID NO: 7889148 - DNA, 22 bp, Homo sapiens
gggaagccatgctcagaggtac

SEQ ID NO: 7889149 - DNA, 18 bp, Homo sapiens
gggaagccgggaagccgg

SEQ ID NO: 7889150 - DNA, 22 bp, Homo sapiens
gggaagccatgctcagaggtac

SEQ ID NO: 7889151 - DNA, 22 bp, Homo sapiens
gggaagccatgctcagaggtac

SEQ ID NO: 7889152 - DNA, 22 bp, Homo sapiens
gggaagccatgctcagaggtac

SEQ ID NO: 7889153 - DNA, 22 bp, Homo sapiens
gggaaggcaggattctctggtg

SEQ ID NO: 7889154 - DNA, 22 bp, Homo sapiens
gggaaggcaggcctctgttgga

SEQ ID NO: 7889155 - DNA, 22 bp, Homo sapiens
gggaaggcaggattctctggtg

SEQ ID NO: 7889156 - DNA, 22 bp, Homo sapiens
gggaaggcaccatggtgttcca

SEQ ID NO: 7889157 - DNA, 22 bp, Homo sapiens
gggaaggcaccatggtgttcca

SEQ ID NO: 7889158 - DNA, 22 bp, Homo sapiens
gggaaggcatacctgagggaga

SEQ ID NO: 7889159 - DNA, 22 bp, Homo sapiens
gggaaggcatacctgagggaga

SEQ ID NO: 7889160 - DNA, 22 bp, Homo sapiens
gggaaggcagtgtctggttgaa

SEQ ID NO: 7889161 - DNA, 22 bp, Homo sapiens
gggaaggcatacctgagggaga

SEQ ID NO: 7889162 - DNA, 22 bp, Homo sapiens
gggaaggcatacctgagggaga

SEQ ID NO: 7889163 - DNA, 22 bp, Homo sapiens
gggaaggcatacctgagggaga

SEQ ID NO: 7889164 - DNA, 22 bp, Homo sapiens
gggaaggcagtgggaggaactg

SEQ ID NO: 7889165 - DNA, 22 bp, Homo sapiens
gggaaggcagtgggaggaactg

SEQ ID NO: 7889166 - DNA, 22 bp, Homo sapiens
gggaaggcagtgggaggaactg

SEQ ID NO: 7889167 - DNA, 22 bp, Homo sapiens
gggaaggcagtgtctggttgaa

SEQ ID NO: 7889168 - DNA, 22 bp, Homo sapiens
gggaaggcagtgtctggttgaa

SEQ ID NO: 7889169 - DNA, 22 bp, Homo sapiens
gggaaggcagtgggaggaactg

SEQ ID NO: 7889170 - DNA, 22 bp, Homo sapiens
gggagccatgctggtcttcttt

SEQ ID NO: 7889171 - DNA, 22 bp, Homo sapiens
gggagccatgctggtcttcttt

SEQ ID NO: 7889172 - DNA, 23 bp, Homo sapiens
gggagccatgggtggtcatggag

SEQ ID NO: 7889173 - DNA, 22 bp, Homo sapiens
gggagccatgctggtcttcttt

SEQ ID NO: 7889174 - DNA, 23 bp, Homo sapiens
gggagccatgggtggtcatggag

SEQ ID NO: 7889175 - DNA, 22 bp, Homo sapiens
gggagccccacctcggtgcccg

SEQ ID NO: 7889176 - DNA, 22 bp, Homo sapiens
gggagccagcctttgcctataa

SEQ ID NO: 7889177 - DNA, 22 bp, Homo sapiens
gggagccagcctttgcctataa

SEQ ID NO: 7889178 - DNA, 22 bp, Homo sapiens
gggagccagccatccagaacct

SEQ ID NO: 7889179 - DNA, 22 bp, Homo sapiens
gggagccagcctttgcctataa

SEQ ID NO: 7889180 - DNA, 22 bp, Homo sapiens
gggagccagcctttgcctataa

SEQ ID NO: 7889181 - DNA, 23 bp, Homo sapiens
gggagccaggacctcgcgcccca

SEQ ID NO: 7889182 - DNA, 22 bp, Homo sapiens
gggagccatgctggtcttcttt

SEQ ID NO: 7889183 - DNA, 22 bp, Homo sapiens
gggagccactcagctgagagtt

SEQ ID NO: 7889184 - DNA, 22 bp, Homo sapiens
gggagccactcagctgagagtt

SEQ ID NO: 7889185 - DNA, 22 bp, Homo sapiens
gggagccactcagctgagagtt

SEQ ID NO: 7889186 - DNA, 22 bp, Homo sapiens
gggagccagagtcacctagaga

SEQ ID NO: 7889187 - DNA, 19 bp, Homo sapiens
gggagccagaccctttgct

SEQ ID NO: 7889188 - DNA, 19 bp, Homo sapiens
gggagccagaccctttgct

SEQ ID NO: 7889189 - DNA, 22 bp, Homo sapiens
gggagccactcagctgagagtt

SEQ ID NO: 7889190 - DNA, 22 bp, Homo sapiens
gggagccactcagctgagagtt

SEQ ID NO: 7889191 - DNA, 22 bp, Homo sapiens
gggagccagcagggcatggagc

SEQ ID NO: 7889192 - DNA, 22 bp, Homo sapiens
gggagccagcagggcatggagc

SEQ ID NO: 7889193 - DNA, 22 bp, Homo sapiens
gggagccagcagggcatggagc

SEQ ID NO: 7889194 - DNA, 22 bp, Homo sapiens
gggagccagagtcacctagaga

SEQ ID NO: 7889195 - DNA, 22 bp, Homo sapiens
gggagccagagtcacctagaga

SEQ ID NO: 7889196 - DNA, 22 bp, Homo sapiens
gggagccacagtgaggtgcatg

SEQ ID NO: 7889197 - DNA, 22 bp, Homo sapiens
gggagccacagtgaggtgcatg

SEQ ID NO: 7889198 - DNA, 22 bp, Homo sapiens
gggagccacagtgaggtgcatg

SEQ ID NO: 7889199 - DNA, 22 bp, Homo sapiens
gggagccacagtagcagctact

SEQ ID NO: 7889200 - DNA, 22 bp, Homo sapiens
gggagccacagtagcagctact

SEQ ID NO: 7889201 - DNA, 22 bp, Homo sapiens
gggagccacagtagcagctact

SEQ ID NO: 7889202 - DNA, 22 bp, Homo sapiens
gggagccacagtagcagctact

SEQ ID NO: 7889203 - DNA, 22 bp, Homo sapiens
gggagccacagtagcagctact

SEQ ID NO: 7889204 - DNA, 23 bp, Homo sapiens
gggagatgggaaatgaaggctct

SEQ ID NO: 7889205 - DNA, 22 bp, Homo sapiens
gggaaggccggtccagtcaggt

SEQ ID NO: 7889206 - DNA, 22 bp, Homo sapiens
gggaaggccggtccagtcaggt

SEQ ID NO: 7889207 - DNA, 22 bp, Homo sapiens
gggaaggccttgtcagcggatt

SEQ ID NO: 7889208 - DNA, 22 bp, Homo sapiens
gggaaggccttgtcagcggatt

SEQ ID NO: 7889209 - DNA, 22 bp, Homo sapiens
gggagatggctcagaggccgcg

SEQ ID NO: 7889210 - DNA, 22 bp, Homo sapiens
gggagatggctcagaggccgcg

SEQ ID NO: 7889211 - DNA, 22 bp, Homo sapiens
gggagatggctcagaggccgcg

SEQ ID NO: 7889212 - DNA, 23 bp, Homo sapiens
gggagatgggaaatgaaggctct

SEQ ID NO: 7889213 - DNA, 23 bp, Homo sapiens
gggagatgggaaatgaaggctct

SEQ ID NO: 7889214 - DNA, 22 bp, Homo sapiens
gggagatggctcagaggccgcg

SEQ ID NO: 7889215 - DNA, 22 bp, Homo sapiens
gggagatgactcagtgacctcg

SEQ ID NO: 7889216 - DNA, 22 bp, Homo sapiens
gggagatggctcagaggccgcg

SEQ ID NO: 7889217 - DNA, 22 bp, Homo sapiens
gggagatggctcagaggccgcg

SEQ ID NO: 7889218 - DNA, 18 bp, Homo sapiens
ggctgtgcgtggaggctg

SEQ ID NO: 7889219 - DNA, 18 bp, Homo sapiens
ggctgtgcgtggaggctg

SEQ ID NO: 7889220 - DNA, 18 bp, Homo sapiens
ggctgtgcgtggaggctg

SEQ ID NO: 7889221 - DNA, 18 bp, Homo sapiens
ggctgtgcgtggaggctg

SEQ ID NO: 7889222 - DNA, 22 bp, Homo sapiens
ggctggccagggccctcgctgg

SEQ ID NO: 7889223 - DNA, 22 bp, Homo sapiens
ggctggccagggccctcgctgg

SEQ ID NO: 7889224 - DNA, 22 bp, Homo sapiens
ggctggccagggccctcgctgg

SEQ ID NO: 7889225 - DNA, 23 bp, Homo sapiens
ggctggcccggggctgctcctga

SEQ ID NO: 7889226 - DNA, 23 bp, Homo sapiens
ggctggcccggggctgctcctga

SEQ ID NO: 7889227 - DNA, 22 bp, Homo sapiens
ggctgtgcgtcatccggctgca

SEQ ID NO: 7889228 - DNA, 22 bp, Homo sapiens
ggctgtggacactgagctcaga

SEQ ID NO: 7889229 - DNA, 22 bp, Homo sapiens
ggctgtggacactgagctcaga

SEQ ID NO: 7889230 - DNA, 21 bp, Homo sapiens
ggctgtggagccatgactcac

SEQ ID NO: 7889231 - DNA, 22 bp, Homo sapiens
ggctgtggacactgagctcaga

SEQ ID NO: 7889232 - DNA, 22 bp, Homo sapiens
ggctgtggacactgagctcaga

SEQ ID NO: 7889233 - DNA, 22 bp, Homo sapiens
ggctgtgcttggtgtccttgga

SEQ ID NO: 7889234 - DNA, 22 bp, Homo sapiens
ggctgtgctgagggggaagccc

SEQ ID NO: 7889235 - DNA, 22 bp, Homo sapiens
ggctgtgctgagggggaagccc

SEQ ID NO: 7889236 - DNA, 22 bp, Homo sapiens
ggctgtggcagctggaagtggt

SEQ ID NO: 7889237 - DNA, 22 bp, Homo sapiens
ggctgtggcagctggaagtggt

SEQ ID NO: 7889238 - DNA, 22 bp, Homo sapiens
ggctgtggcagctggaagtggt

SEQ ID NO: 7889239 - DNA, 22 bp, Homo sapiens
ggctgtggcagctggaagtggt

SEQ ID NO: 7889240 - DNA, 21 bp, Homo sapiens
ggctgtggagccatgactcac

SEQ ID NO: 7889241 - DNA, 21 bp, Homo sapiens
ggctgtggagccatgactcac

SEQ ID NO: 7889242 - DNA, 21 bp, Homo sapiens
ggctgtggagccatgactcac

SEQ ID NO: 7889243 - DNA, 22 bp, Homo sapiens
ggctgtggagctgcagagttgg

SEQ ID NO: 7889244 - DNA, 21 bp, Homo sapiens
ggctgtggagccatgactcac

SEQ ID NO: 7889245 - DNA, 22 bp, Homo sapiens
ggctgtggagctgcagagttgg

SEQ ID NO: 7889246 - DNA, 22 bp, Homo sapiens
ggctgtggcagctggaagtggt

SEQ ID NO: 7889247 - DNA, 22 bp, Homo sapiens
ggctgtggcattaggtgaggcc

SEQ ID NO: 7889248 - DNA, 22 bp, Homo sapiens
ggctgtggcattaggtgaggcc

SEQ ID NO: 7889249 - DNA, 22 bp, Homo sapiens
ggctgtggccagcggggctgag

SEQ ID NO: 7889250 - DNA, 22 bp, Homo sapiens
ggctgtggcattaggtgaggcc

SEQ ID NO: 7889251 - DNA, 22 bp, Homo sapiens
ggctgtggcattaggtgaggcc

SEQ ID NO: 7889252 - DNA, 22 bp, Homo sapiens
ggctgtggcagctggaagtggt

SEQ ID NO: 7889253 - DNA, 22 bp, Homo sapiens
ggctgtggcattaggtgaggcc

SEQ ID NO: 7889254 - DNA, 22 bp, Homo sapiens
ggctgtggcagctggaagtggt

SEQ ID NO: 7889255 - DNA, 22 bp, Homo sapiens
ggctgtggggggagcctgcccg

SEQ ID NO: 7889256 - DNA, 22 bp, Homo sapiens
ggctgtgggtgtgacaggcctc

SEQ ID NO: 7889257 - DNA, 22 bp, Homo sapiens
ggctgtgggtgtgacaggcctc

SEQ ID NO: 7889258 - DNA, 22 bp, Homo sapiens
ggctgtggggggagcctgcccg

SEQ ID NO: 7889259 - DNA, 22 bp, Homo sapiens
ggctgtggggggagcctgcccg

SEQ ID NO: 7889260 - DNA, 22 bp, Homo sapiens
ggctgtggggaccaacaggact

SEQ ID NO: 7889261 - DNA, 22 bp, Homo sapiens
ggctgtggggccgggtacagtg

SEQ ID NO: 7889262 - DNA, 22 bp, Homo sapiens
ggctgtggggccgggtacagtg

SEQ ID NO: 7889263 - DNA, 22 bp, Homo sapiens
ggctgtggggaccaacaggact

SEQ ID NO: 7889264 - DNA, 22 bp, Homo sapiens
ggctgtggggaccaacaggact

SEQ ID NO: 7889265 - DNA, 22 bp, Homo sapiens
ggctgtgggccagctagaccct

SEQ ID NO: 7889266 - DNA, 22 bp, Homo sapiens
ggctgtgggccagctagaccct

SEQ ID NO: 7889267 - DNA, 22 bp, Homo sapiens
ggctgtgggatgcataggagct

SEQ ID NO: 7889268 - DNA, 22 bp, Homo sapiens
ggctgtgggatgcataggagct

SEQ ID NO: 7889269 - DNA, 22 bp, Homo sapiens
ggctgtgggatgcataggagct

SEQ ID NO: 7889270 - DNA, 22 bp, Homo sapiens
ggctgtgggatgcataggagct

SEQ ID NO: 7889271 - DNA, 22 bp, Homo sapiens
ggctgtgggatgcataggagct

SEQ ID NO: 7889272 - DNA, 22 bp, Homo sapiens
ggctgtggccagcggggctgag

SEQ ID NO: 7889273 - DNA, 22 bp, Homo sapiens
ggctgtggccagcggggctgag

SEQ ID NO: 7889274 - DNA, 22 bp, Homo sapiens
ggctgtggccagcggggctgag

SEQ ID NO: 7889275 - DNA, 22 bp, Homo sapiens
ggctgtggccagcggggctgag

SEQ ID NO: 7889276 - DNA, 22 bp, Homo sapiens
ggctgtggccagcggggctgag

SEQ ID NO: 7889277 - DNA, 22 bp, Homo sapiens
ggctgtggtctgggtgctcccc

SEQ ID NO: 7889278 - DNA, 22 bp, Homo sapiens
ggctgtggtctgggtgctcccc

SEQ ID NO: 7889279 - DNA, 22 bp, Homo sapiens
ggctgtggtctgggtgctcccc

SEQ ID NO: 7889280 - DNA, 22 bp, Homo sapiens
ggctgtggtctgggtgctcccc

SEQ ID NO: 7889281 - DNA, 22 bp, Homo sapiens
ggctgtggtctcatctagcctt

SEQ ID NO: 7889282 - DNA, 22 bp, Homo sapiens
ggctgtggtctcatctagcctt

SEQ ID NO: 7889283 - DNA, 22 bp, Homo sapiens
ggctgtggtcattaggaggttg

SEQ ID NO: 7889284 - DNA, 22 bp, Homo sapiens
ggctgtggtcattaggaggttg

SEQ ID NO: 7889285 - DNA, 22 bp, Homo sapiens
ggctgtggtcattaggaggttg

SEQ ID NO: 7889286 - DNA, 22 bp, Homo sapiens
ggctgtggtcattaggaggttg

SEQ ID NO: 7889287 - DNA, 22 bp, Homo sapiens
ggctgtggtcattaggaggttg

SEQ ID NO: 7889288 - DNA, 22 bp, Homo sapiens
ggctgtgggtgtgacaggcctc

SEQ ID NO: 7889289 - DNA, 22 bp, Homo sapiens
ggctgtgggtgtgacaggcctc

SEQ ID NO: 7889290 - DNA, 22 bp, Homo sapiens
ggctgtggtcattaggaggttg

SEQ ID NO: 7889291 - DNA, 22 bp, Homo sapiens
gggaagagggagctggaatgat

SEQ ID NO: 7889292 - DNA, 22 bp, Homo sapiens
gggaagagggagctggaatgat

SEQ ID NO: 7889293 - DNA, 22 bp, Homo sapiens
gggaagagggagctggaatgat

SEQ ID NO: 7889294 - DNA, 22 bp, Homo sapiens
ggctgtggtctgggtgctcccc

SEQ ID NO: 7889295 - DNA, 22 bp, Homo sapiens
gggaagagggagctggaatgat

SEQ ID NO: 7889296 - DNA, 22 bp, Homo sapiens
ggctgtggtctgggtgctcccc

SEQ ID NO: 7889297 - DNA, 22 bp, Homo sapiens
gggaagagggagctggaatgat

SEQ ID NO: 7889298 - DNA, 22 bp, Homo sapiens
gggaagagggagctggaatgat

SEQ ID NO: 7889299 - DNA, 22 bp, Homo sapiens
gggaagagggagctggaatgat

SEQ ID NO: 7889300 - DNA, 22 bp, Homo sapiens
gggaagagggagctggaatgat

SEQ ID NO: 7889301 - DNA, 22 bp, Homo sapiens
gggaagagggagctggaatgat

SEQ ID NO: 7889302 - DNA, 22 bp, Homo sapiens
gggaagagggagctggaatgat

SEQ ID NO: 7889303 - DNA, 22 bp, Homo sapiens
gggaagagggagctggaatgat

SEQ ID NO: 7889304 - DNA, 22 bp, Homo sapiens
gggaagagggagctggaatgat

SEQ ID NO: 7889305 - DNA, 22 bp, Homo sapiens
ggtggggattcctgatcactgt

SEQ ID NO: 7889306 - DNA, 22 bp, Homo sapiens
ggtggggattcctgatcactgt

SEQ ID NO: 7889307 - DNA, 22 bp, Homo sapiens
ggtgggcgactgagaggggttt

SEQ ID NO: 7889308 - DNA, 22 bp, Homo sapiens
ggtgggcgactgagaggggttt

SEQ ID NO: 7889309 - DNA, 22 bp, Homo sapiens
ggtggggagtcaggcattcttg

SEQ ID NO: 7889310 - DNA, 22 bp, Homo sapiens
ggtgggccaggaaggccgccag

SEQ ID NO: 7889311 - DNA, 22 bp, Homo sapiens
ggtgggcgactgagaggggttt

SEQ ID NO: 7889312 - DNA, 22 bp, Homo sapiens
ggtgggccaggaaggccgccag

SEQ ID NO: 7889313 - DNA, 22 bp, Homo sapiens
ggtgggccaggaaggccgccag

SEQ ID NO: 7889314 - DNA, 22 bp, Homo sapiens
ggtgggccacggcataacgggc

SEQ ID NO: 7889315 - DNA, 22 bp, Homo sapiens
ggtgggccaggaaggccgccag

SEQ ID NO: 7889316 - DNA, 22 bp, Homo sapiens
ggtggggccagggctccaacct

SEQ ID NO: 7889317 - DNA, 22 bp, Homo sapiens
ggtggggccagggctccaacct

SEQ ID NO: 7889318 - DNA, 22 bp, Homo sapiens
ggtggggccagggctccaacct

SEQ ID NO: 7889319 - DNA, 22 bp, Homo sapiens
ggtggggattcctgatcactgt

SEQ ID NO: 7889320 - DNA, 22 bp, Homo sapiens
ggtggggattcctgatcactgt

SEQ ID NO: 7889321 - DNA, 22 bp, Homo sapiens
ggtggggcccaggcatctgatg

SEQ ID NO: 7889322 - DNA, 22 bp, Homo sapiens
ggtggggcccaggcatctgatg

SEQ ID NO: 7889323 - DNA, 22 bp, Homo sapiens
ggtggggattcctgatcactgt

SEQ ID NO: 7889324 - DNA, 22 bp, Homo sapiens
ggtggggcccaggcatctgatg

SEQ ID NO: 7889325 - DNA, 22 bp, Homo sapiens
ggtggggcccaggcatctgatg

SEQ ID NO: 7889326 - DNA, 22 bp, Homo sapiens
ggtggggccctggcactggtat

SEQ ID NO: 7889327 - DNA, 22 bp, Homo sapiens
ggtggggccctggcactggtat

SEQ ID NO: 7889328 - DNA, 22 bp, Homo sapiens
ggtgggtggaaacagcatgtac

SEQ ID NO: 7889329 - DNA, 22 bp, Homo sapiens
ggtgggtggaaacagcatgtac

SEQ ID NO: 7889330 - DNA, 22 bp, Homo sapiens
ggtgggtggaaacagcatgtac

SEQ ID NO: 7889331 - DNA, 22 bp, Homo sapiens
ggtgggtgcagggggcttctta

SEQ ID NO: 7889332 - DNA, 22 bp, Homo sapiens
ggtgggtgcagggggcttctta

SEQ ID NO: 7889333 - DNA, 22 bp, Homo sapiens
ggtgggtgcagggggcttctta

SEQ ID NO: 7889334 - DNA, 22 bp, Homo sapiens
ggtgggtgagccctgggagctg

SEQ ID NO: 7889335 - DNA, 22 bp, Homo sapiens
ggtgggtgagccctgggagctg

SEQ ID NO: 7889336 - DNA, 22 bp, Homo sapiens
ggtgggtgagccctgggagctg

SEQ ID NO: 7889337 - DNA, 22 bp, Homo sapiens
ggtgggtgagccctgggagctg

SEQ ID NO: 7889338 - DNA, 19 bp, Homo sapiens
ggtgggtgacctccccacc

SEQ ID NO: 7889339 - DNA, 19 bp, Homo sapiens
ggtgggtgacctccccacc

SEQ ID NO: 7889340 - DNA, 22 bp, Homo sapiens
ggtgggtgagccctgggagctg

SEQ ID NO: 7889341 - DNA, 22 bp, Homo sapiens
ggtgggtgagccctgggagctg

SEQ ID NO: 7889342 - DNA, 22 bp, Homo sapiens
ggtggggcctgctccagcggcc

SEQ ID NO: 7889343 - DNA, 22 bp, Homo sapiens
ggtggggctaggacctcaggat

SEQ ID NO: 7889344 - DNA, 22 bp, Homo sapiens
ggtggggcctgctccagcggcc

SEQ ID NO: 7889345 - DNA, 22 bp, Homo sapiens
ggtggggcctgctccagcggcc

SEQ ID NO: 7889346 - DNA, 22 bp, Homo sapiens
ggtggggcctgctccagcggcc

SEQ ID NO: 7889347 - DNA, 22 bp, Homo sapiens
ggtggggcctgctccagcggcc

SEQ ID NO: 7889348 - DNA, 22 bp, Homo sapiens
ggtggggcctgctccagcggcc

SEQ ID NO: 7889349 - DNA, 22 bp, Homo sapiens
ggtggggccctggcactggtat

SEQ ID NO: 7889350 - DNA, 22 bp, Homo sapiens
ggtggggccctggcactggtat

SEQ ID NO: 7889351 - DNA, 22 bp, Homo sapiens
ggtggggcctgctccagcggcc

SEQ ID NO: 7889352 - DNA, 22 bp, Homo sapiens
ggtggagtaattcgcagaggtt

SEQ ID NO: 7889353 - DNA, 22 bp, Homo sapiens
ggtggatggactctcgggggcc

SEQ ID NO: 7889354 - DNA, 22 bp, Homo sapiens
ggtggatggactctcgggggcc

SEQ ID NO: 7889355 - DNA, 22 bp, Homo sapiens
ggtggatgctgactgttctgct

SEQ ID NO: 7889356 - DNA, 22 bp, Homo sapiens
ggtggagtaattcgcagaggtt

SEQ ID NO: 7889357 - DNA, 22 bp, Homo sapiens
ggtggagtaattcgcagaggtt

SEQ ID NO: 7889358 - DNA, 22 bp, Homo sapiens
ggtggagtaattcgcagaggtt

SEQ ID NO: 7889359 - DNA, 22 bp, Homo sapiens
ggtggagtaattcgcagaggtt

SEQ ID NO: 7889360 - DNA, 22 bp, Homo sapiens
ggtggcaccttgatcttggact

SEQ ID NO: 7889361 - DNA, 22 bp, Homo sapiens
ggtggcaccttgatcttggact

SEQ ID NO: 7889362 - DNA, 22 bp, Homo sapiens
ggtggcaccttaccctgcgcag

SEQ ID NO: 7889363 - DNA, 22 bp, Homo sapiens
ggtggcaccttaccctgcgcag

SEQ ID NO: 7889364 - DNA, 22 bp, Homo sapiens
ggtggcaccttaccctgcgcag

SEQ ID NO: 7889365 - DNA, 22 bp, Homo sapiens
ggtggcaagggcagccagtaac

SEQ ID NO: 7889366 - DNA, 22 bp, Homo sapiens
ggtggcacactggggagctcgg

SEQ ID NO: 7889367 - DNA, 22 bp, Homo sapiens
ggtggagagctggatgagaggt

SEQ ID NO: 7889368 - DNA, 22 bp, Homo sapiens
ggtggagagctggatgagaggt

SEQ ID NO: 7889369 - DNA, 22 bp, Homo sapiens
ggtggagcgcagggtgctggcg

SEQ ID NO: 7889370 - DNA, 22 bp, Homo sapiens
ggtggagcgcagggtgctggcg

SEQ ID NO: 7889371 - DNA, 22 bp, Homo sapiens
ggtggagcgcagggtgctggcg

SEQ ID NO: 7889372 - DNA, 22 bp, Homo sapiens
ggtggagcgcagggtgctggcg

SEQ ID NO: 7889373 - DNA, 22 bp, Homo sapiens
ggtggagagctggatgagaggt

SEQ ID NO: 7889374 - DNA, 22 bp, Homo sapiens
ggtggagagctggatgagaggt

SEQ ID NO: 7889375 - DNA, 22 bp, Homo sapiens
ggtggactgtgttggagttgac

SEQ ID NO: 7889376 - DNA, 22 bp, Homo sapiens
ggtggactgtgttggagttgac

SEQ ID NO: 7889377 - DNA, 22 bp, Homo sapiens
ggtggactcaaaatgtgcttga

SEQ ID NO: 7889378 - DNA, 22 bp, Homo sapiens
ggtggagctggaccaggagagg

SEQ ID NO: 7889379 - DNA, 22 bp, Homo sapiens
ggtggagctggaccaggagagg

SEQ ID NO: 7889380 - DNA, 22 bp, Homo sapiens
ggtggagctggaccaggagagg

SEQ ID NO: 7889381 - DNA, 22 bp, Homo sapiens
ggtggagctggaccaggagagg

SEQ ID NO: 7889382 - DNA, 22 bp, Homo sapiens
ggtggagctatacgggatggct

SEQ ID NO: 7889383 - DNA, 22 bp, Homo sapiens
ggtggagctatacgggatggct

SEQ ID NO: 7889384 - DNA, 19 bp, Homo sapiens
ggtggcagaacgtgggtcc

SEQ ID NO: 7889385 - DNA, 19 bp, Homo sapiens
ggtggcagaacgtgggtcc

SEQ ID NO: 7889386 - DNA, 19 bp, Homo sapiens
ggtggcagaacgtgggtcc

SEQ ID NO: 7889387 - DNA, 19 bp, Homo sapiens
ggtggcagaacgtgggtcc

SEQ ID NO: 7889388 - DNA, 19 bp, Homo sapiens
ggtggcagaacgtgggtcc

SEQ ID NO: 7889389 - DNA, 22 bp, Homo sapiens
ggtggcactcattatcaggtgc

SEQ ID NO: 7889390 - DNA, 22 bp, Homo sapiens
ggtggcactcattatcaggtgc

SEQ ID NO: 7889391 - DNA, 22 bp, Homo sapiens
ggtggcagagacataggacata

SEQ ID NO: 7889392 - DNA, 22 bp, Homo sapiens
ggtggcagagacataggacata

SEQ ID NO: 7889393 - DNA, 22 bp, Homo sapiens
ggtggcagaataattgaaggtc

SEQ ID NO: 7889394 - DNA, 22 bp, Homo sapiens
ggtggcagaataattgaaggtc

SEQ ID NO: 7889395 - DNA, 22 bp, Homo sapiens
ggtggcagagacataggacata

SEQ ID NO: 7889396 - DNA, 22 bp, Homo sapiens
ggtggcagaataattgaaggtc

SEQ ID NO: 7889397 - DNA, 19 bp, Homo sapiens
ggtggcagaacgtgggtcc

SEQ ID NO: 7889398 - DNA, 22 bp, Homo sapiens
ggtggcagaataattgaaggtc

SEQ ID NO: 7889399 - DNA, 22 bp, Homo sapiens
ggtggcagagacataggacata

SEQ ID NO: 7889400 - DNA, 22 bp, Homo sapiens
ggtggcagagacataggacata

SEQ ID NO: 7889401 - DNA, 22 bp, Homo sapiens
ggtggcagagacataggacata

SEQ ID NO: 7889402 - DNA, 22 bp, Homo sapiens
ggtggcagagacataggacata

SEQ ID NO: 7889403 - DNA, 22 bp, Homo sapiens
ggtggcagagacataggacata

SEQ ID NO: 7889404 - DNA, 22 bp, Homo sapiens
ggtggcagagaggaggtagttt

SEQ ID NO: 7889405 - DNA, 22 bp, Homo sapiens
ggtggcagagacataggacata

SEQ ID NO: 7889406 - DNA, 22 bp, Homo sapiens
ggtggcagagaggaggtagttt

SEQ ID NO: 7889407 - DNA, 22 bp, Homo sapiens
ggtggcagagaggaggtagttt

SEQ ID NO: 7889408 - DNA, 22 bp, Homo sapiens
ggtgggcaggcgaggcccaggt

SEQ ID NO: 7889409 - DNA, 22 bp, Homo sapiens
ggtgggcaggcgaggcccaggt

SEQ ID NO: 7889410 - DNA, 22 bp, Homo sapiens
gtaattacatgagtactgtaag

SEQ ID NO: 7889411 - DNA, 22 bp, Homo sapiens
gtaatgcatttattttatgaaa

SEQ ID NO: 7889412 - DNA, 19 bp, Homo sapiens
gtaatgcatctgtgtatga

SEQ ID NO: 7889413 - DNA, 22 bp, Homo sapiens
ggtttaatgggtgaaggcatga

SEQ ID NO: 7889414 - DNA, 22 bp, Homo sapiens
ggtttaatggagatatttcaga

SEQ ID NO: 7889415 - DNA, 22 bp, Homo sapiens
ggtttaagacaggcttcacagt

SEQ ID NO: 7889416 - DNA, 21 bp, Homo sapiens
ggttggtgtgtccagtggcca

SEQ ID NO: 7889417 - DNA, 21 bp, Homo sapiens
ggttggtgtgtccagtggcca

SEQ ID NO: 7889418 - DNA, 22 bp, Homo sapiens
ggttgtagttggaggttgtata

SEQ ID NO: 7889419 - DNA, 22 bp, Homo sapiens
ggtttaaaagccatgcatgggg

SEQ ID NO: 7889420 - DNA, 17 bp, Homo sapiens
ggtttaatccttacctg

SEQ ID NO: 7889421 - DNA, 22 bp, Homo sapiens
ggtttaaaagccatgcatgggg

SEQ ID NO: 7889422 - DNA, 22 bp, Homo sapiens
gtaatttttagttcattctatc

SEQ ID NO: 7889423 - DNA, 22 bp, Homo sapiens
gtaatttttagttcattctatc

SEQ ID NO: 7889424 - DNA, 22 bp, Homo sapiens
gtaatttttagttcattctatc

SEQ ID NO: 7889425 - DNA, 22 bp, Homo sapiens
gtaatttttagttcattctatc

SEQ ID NO: 7889426 - DNA, 22 bp, Homo sapiens
gtaatttttagttcattctatc

SEQ ID NO: 7889427 - DNA, 22 bp, Homo sapiens
gtacaaaagttattgcggtttt

SEQ ID NO: 7889428 - DNA, 22 bp, Homo sapiens
gtacaaaagttattgcggtttt

SEQ ID NO: 7889429 - DNA, 22 bp, Homo sapiens
gtaattttggagtataacctgg

SEQ ID NO: 7889430 - DNA, 22 bp, Homo sapiens
gtaattttggagtataacctgg

SEQ ID NO: 7889431 - DNA, 22 bp, Homo sapiens
gtaatttttagttcattctatc

SEQ ID NO: 7889432 - DNA, 22 bp, Homo sapiens
gtaatttttagttcattctatc

SEQ ID NO: 7889433 - DNA, 22 bp, Homo sapiens
gtaatttaattctctgacttga

SEQ ID NO: 7889434 - DNA, 22 bp, Homo sapiens
gtaatttaattctctgacttga

SEQ ID NO: 7889435 - DNA, 22 bp, Homo sapiens
gtaattacattagggtaaataa

SEQ ID NO: 7889436 - DNA, 21 bp, Homo sapiens
gtaattctgcctcatcttcac

SEQ ID NO: 7889437 - DNA, 22 bp, Homo sapiens
gtaattctagagtttggacagc

SEQ ID NO: 7889438 - DNA, 22 bp, Homo sapiens
gtaattctgtgtgaatctatta

SEQ ID NO: 7889439 - DNA, 22 bp, Homo sapiens
gtaattctgtgtgaatctatta

SEQ ID NO: 7889440 - DNA, 22 bp, Homo sapiens
ggttggctactggagacctatg

SEQ ID NO: 7889441 - DNA, 23 bp, Homo sapiens
ggttggctgtacccaggctccct

SEQ ID NO: 7889442 - DNA, 22 bp, Homo sapiens
ggttcattctgaagtcttcagc

SEQ ID NO: 7889443 - DNA, 17 bp, Homo sapiens
ggttcagttctgcattc

SEQ ID NO: 7889444 - DNA, 22 bp, Homo sapiens
ggttcagcagcagccacaattc

SEQ ID NO: 7889445 - DNA, 22 bp, Homo sapiens
ggttcagagaaggctaaatagt

SEQ ID NO: 7889446 - DNA, 22 bp, Homo sapiens
ggttcagagtcaggatctaagt

SEQ ID NO: 7889447 - DNA, 22 bp, Homo sapiens
ggttcagagtcaggatctaagt

SEQ ID NO: 7889448 - DNA, 22 bp, Homo sapiens
ggttcagagaaggctaaatagt

SEQ ID NO: 7889449 - DNA, 22 bp, Homo sapiens
ggttcagggatgtgggtgatgc

SEQ ID NO: 7889450 - DNA, 22 bp, Homo sapiens
ggttggggcgagctggaggccc

SEQ ID NO: 7889451 - DNA, 22 bp, Homo sapiens
ggttggtgcccaggccatactg

SEQ ID NO: 7889452 - DNA, 21 bp, Homo sapiens
ggttggtgtgtccagtggcca

SEQ ID NO: 7889453 - DNA, 22 bp, Homo sapiens
ggttggggcgagctggaggccc

SEQ ID NO: 7889454 - DNA, 22 bp, Homo sapiens
ggttggggcgagctggaggccc

SEQ ID NO: 7889455 - DNA, 22 bp, Homo sapiens
ggttggggcgagctggaggccc

SEQ ID NO: 7889456 - DNA, 17 bp, Homo sapiens
ggttggcttatcccagg

SEQ ID NO: 7889457 - DNA, 17 bp, Homo sapiens
ggttggcttatcccagg

SEQ ID NO: 7889458 - DNA, 22 bp, Homo sapiens
ggtggtgactgtcctagggatg

SEQ ID NO: 7889459 - DNA, 23 bp, Homo sapiens
ggtggtgctcatatctcaggcct

SEQ ID NO: 7889460 - DNA, 22 bp, Homo sapiens
ggtggtctgcgcagcccagggt

SEQ ID NO: 7889461 - DNA, 22 bp, Homo sapiens
ggtgggtttggaagagcaggct

SEQ ID NO: 7889462 - DNA, 22 bp, Homo sapiens
ggtggtgaagacaagtggaagt

SEQ ID NO: 7889463 - DNA, 22 bp, Homo sapiens
ggtggtctgcgcagcccagggt

SEQ ID NO: 7889464 - DNA, 22 bp, Homo sapiens
ggtggtggagccagctgggagt

SEQ ID NO: 7889465 - DNA, 22 bp, Homo sapiens
ggtggtggagccagctgggagt

SEQ ID NO: 7889466 - DNA, 22 bp, Homo sapiens
ggtggtggagccagctgggagt

SEQ ID NO: 7889467 - DNA, 22 bp, Homo sapiens
ggtggtggagccagctgggagt

SEQ ID NO: 7889468 - DNA, 22 bp, Homo sapiens
ggtggtggagccagctgggagt

SEQ ID NO: 7889469 - DNA, 22 bp, Homo sapiens
ggtggtggagccagctgggagt

SEQ ID NO: 7889470 - DNA, 22 bp, Homo sapiens
ggtggtggagccagctgggagt

SEQ ID NO: 7889471 - DNA, 22 bp, Homo sapiens
ggtggtggagccagctgggagt

SEQ ID NO: 7889472 - DNA, 22 bp, Homo sapiens
ggtggtggagccagctgggagt

SEQ ID NO: 7889473 - DNA, 22 bp, Homo sapiens
ggttaaaatctaaaatgtgact

SEQ ID NO: 7889474 - DNA, 21 bp, Homo sapiens
ggttaaaagacacatctgttt

SEQ ID NO: 7889475 - DNA, 22 bp, Homo sapiens
ggttaaaactgatattatgggt

SEQ ID NO: 7889476 - DNA, 19 bp, Homo sapiens
ggttaatgttaggatactt

SEQ ID NO: 7889477 - DNA, 22 bp, Homo sapiens
ggttacaaggatattcaggtaa

SEQ ID NO: 7889478 - DNA, 22 bp, Homo sapiens
ggttaaaaataatttacttggc

SEQ ID NO: 7889479 - DNA, 22 bp, Homo sapiens
ggtgtttgcatggggccagttt

SEQ ID NO: 7889480 - DNA, 22 bp, Homo sapiens
ggttcacagtaaggtttgtgct

SEQ ID NO: 7889481 - DNA, 22 bp, Homo sapiens
ggttcacatattgagagtattc

SEQ ID NO: 7889482 - DNA, 22 bp, Homo sapiens
ggttcacaggtccgactgctgg

SEQ ID NO: 7889483 - DNA, 22 bp, Homo sapiens
ggttcacaggtcctgggagcag

SEQ ID NO: 7889484 - DNA, 22 bp, Homo sapiens
ggttcacactttcatgatttca

SEQ ID NO: 7889485 - DNA, 22 bp, Homo sapiens
ggttcacagctgtggggttccc

SEQ ID NO: 7889486 - DNA, 22 bp, Homo sapiens
ggttcacactaagcttaagtgg

SEQ ID NO: 7889487 - DNA, 22 bp, Homo sapiens
ggttattttggttgtctaaggc

SEQ ID NO: 7889488 - DNA, 22 bp, Homo sapiens
ggttatttttgattctgtggat

SEQ ID NO: 7889489 - DNA, 23 bp, Homo sapiens
ggttatttgcatcctgtaattat

SEQ ID NO: 7889490 - DNA, 22 bp, Homo sapiens
ggttattttggttgtctaaggc

SEQ ID NO: 7889491 - DNA, 22 bp, Homo sapiens
ggttagagggcatgcgatcttt

SEQ ID NO: 7889492 - DNA, 22 bp, Homo sapiens
ggttactcaagcctgccttctc

SEQ ID NO: 7889493 - DNA, 23 bp, Homo sapiens
ggttagggaatgatctcaggcat

SEQ ID NO: 7889494 - DNA, 22 bp, Homo sapiens
ggttagagagctgagaaagttt

SEQ ID NO: 7889495 - DNA, 22 bp, Homo sapiens
ggttacatgtatgtttggtata

SEQ ID NO: 7889496 - DNA, 20 bp, Homo sapiens
ggttacattgtctacatgtg

SEQ ID NO: 7889497 - DNA, 22 bp, Homo sapiens
ggttacatagtaaggtcctatt

SEQ ID NO: 7889498 - DNA, 21 bp, Homo sapiens
ggttacaacagttaaacagag

SEQ ID NO: 7889499 - DNA, 22 bp, Homo sapiens
ggttacatctcaagtggagtct

SEQ ID NO: 7889500 - DNA, 22 bp, Homo sapiens
ggttacatggaagaaatataat

SEQ ID NO: 7889501 - DNA, 22 bp, Homo sapiens
ggttatctaagacagtttggca

SEQ ID NO: 7889502 - DNA, 22 bp, Homo sapiens
ggttatttctgattatatgata

SEQ ID NO: 7889503 - DNA, 23 bp, Homo sapiens
ggttatttgcatcctgtaattat

SEQ ID NO: 7889504 - DNA, 19 bp, Homo sapiens
ggttatttgagggttaaga

SEQ ID NO: 7889505 - DNA, 23 bp, Homo sapiens
ggttatttgcatcctgtaattat

SEQ ID NO: 7889506 - DNA, 19 bp, Homo sapiens
ggttatttgagggttaaga

SEQ ID NO: 7889507 - DNA, 22 bp, Homo sapiens
ggtgagaggcagtgctgtggaa

SEQ ID NO: 7889508 - DNA, 22 bp, Homo sapiens
ggtgacagccgcttggcgctag

SEQ ID NO: 7889509 - DNA, 22 bp, Homo sapiens
ggtgacagcgggtcaagaggag

SEQ ID NO: 7889510 - DNA, 22 bp, Homo sapiens
ggtgagcaaagcttcatctgta

SEQ ID NO: 7889511 - DNA, 22 bp, Homo sapiens
ggtgagaggcagtgctgtggaa

SEQ ID NO: 7889512 - DNA, 22 bp, Homo sapiens
ggtgagcaaagcttcatctgta

SEQ ID NO: 7889513 - DNA, 22 bp, Homo sapiens
ggtgagagttatgattccaatt

SEQ ID NO: 7889514 - DNA, 22 bp, Homo sapiens
ggtgagaggcctgagagctgga

SEQ ID NO: 7889515 - DNA, 22 bp, Homo sapiens
ggtgagaggcctgagagctgga

SEQ ID NO: 7889516 - DNA, 22 bp, Homo sapiens
ggtgagaggcctgagagctgga

SEQ ID NO: 7889517 - DNA, 22 bp, Homo sapiens
ggtgagaggcctgagagctgga

SEQ ID NO: 7889518 - DNA, 22 bp, Homo sapiens
ggtgagaggcctgagagctgga

SEQ ID NO: 7889519 - DNA, 21 bp, Homo sapiens
ggtgacacgtggccccgctct

SEQ ID NO: 7889520 - DNA, 21 bp, Homo sapiens
ggtgacacgtggccccgctct

SEQ ID NO: 7889521 - DNA, 22 bp, Homo sapiens
ggtgacagccgcttgccctgta

SEQ ID NO: 7889522 - DNA, 22 bp, Homo sapiens
ggtgacagccgcttggcgctag

SEQ ID NO: 7889523 - DNA, 22 bp, Homo sapiens
ggtccctggaaggcactagtga

SEQ ID NO: 7889524 - DNA, 21 bp, Homo sapiens
ggtgacacgtggccccgctct

SEQ ID NO: 7889525 - DNA, 22 bp, Homo sapiens
ggtgacacagggaccagagtct

SEQ ID NO: 7889526 - DNA, 22 bp, Homo sapiens
ggtccctggaaggccaagcttg

SEQ ID NO: 7889527 - DNA, 22 bp, Homo sapiens
ggtccctgctgaagccttggtg

SEQ ID NO: 7889528 - DNA, 22 bp, Homo sapiens
ggtccctgctgaagccttggtg

SEQ ID NO: 7889529 - DNA, 22 bp, Homo sapiens
ggtgaggaaagatggtgacagt

SEQ ID NO: 7889530 - DNA, 22 bp, Homo sapiens
ggtgagcttgctgctagaggct

SEQ ID NO: 7889531 - DNA, 22 bp, Homo sapiens
ggtgaggaaagatggtgacagt

SEQ ID NO: 7889532 - DNA, 22 bp, Homo sapiens
ggtgaggaaagatggtgacagt

SEQ ID NO: 7889533 - DNA, 22 bp, Homo sapiens
ggtgagcttgctgctagaggct

SEQ ID NO: 7889534 - DNA, 22 bp, Homo sapiens
ggtgagctggtctggggctgct

SEQ ID NO: 7889535 - DNA, 22 bp, Homo sapiens
ggtgagcagctgtctgtatgga

SEQ ID NO: 7889536 - DNA, 22 bp, Homo sapiens
ggtgagcactgccctgggtctc

SEQ ID NO: 7889537 - DNA, 22 bp, Homo sapiens
ggtgagcactgccctgggtctc

SEQ ID NO: 7889538 - DNA, 22 bp, Homo sapiens
ggtgagcactgccctgggtctc

SEQ ID NO: 7889539 - DNA, 22 bp, Homo sapiens
ggtgagcaaagcttcatctgta

SEQ ID NO: 7889540 - DNA, 22 bp, Homo sapiens
ggtgaggaattggggactgacc

SEQ ID NO: 7889541 - DNA, 22 bp, Homo sapiens
ggtgaggaattggggactgacc

SEQ ID NO: 7889542 - DNA, 22 bp, Homo sapiens
ggtgaggaattggggactgacc

SEQ ID NO: 7889543 - DNA, 22 bp, Homo sapiens
ggtgaggaattggggactgacc

SEQ ID NO: 7889544 - DNA, 22 bp, Homo sapiens
ggtgaggaaagatggtgacagt

SEQ ID NO: 7889545 - DNA, 22 bp, Homo sapiens
ggtgaggcaggtggctgctgag

SEQ ID NO: 7889546 - DNA, 22 bp, Homo sapiens
ggtgaggcaggtggctgctgag

SEQ ID NO: 7889547 - DNA, 22 bp, Homo sapiens
ggtgaggcaggtggctgctgag

SEQ ID NO: 7889548 - DNA, 22 bp, Homo sapiens
ggtgaggcagagggagtaacct

SEQ ID NO: 7889549 - DNA, 22 bp, Homo sapiens
ggtgaggaattggggactgacc

SEQ ID NO: 7889550 - DNA, 22 bp, Homo sapiens
ggtgaggaattggggactgacc

SEQ ID NO: 7889551 - DNA, 22 bp, Homo sapiens
ggtgaggaattggggactgacc

SEQ ID NO: 7889552 - DNA, 18 bp, Homo sapiens
ggtgaggcggcggccagc

SEQ ID NO: 7889553 - DNA, 22 bp, Homo sapiens
ggtgaggcctgtacaaagctgc

SEQ ID NO: 7889554 - DNA, 22 bp, Homo sapiens
ggtgaggcaggtggctgctgag

SEQ ID NO: 7889555 - DNA, 22 bp, Homo sapiens
ggtgagggacatcactcagcca

SEQ ID NO: 7889556 - DNA, 22 bp, Homo sapiens
ggtgagggacatcactcagcca

SEQ ID NO: 7889557 - DNA, 22 bp, Homo sapiens
ggtgagggacatcactcagcca

SEQ ID NO: 7889558 - DNA, 22 bp, Homo sapiens
ggtgaggcgtccccaccatggg

SEQ ID NO: 7889559 - DNA, 22 bp, Homo sapiens
ggtgagggagtggaacgaggtg

SEQ ID NO: 7889560 - DNA, 18 bp, Homo sapiens
ggtgagggagctggaagc

SEQ ID NO: 7889561 - DNA, 18 bp, Homo sapiens
ggtgagggagctggaagc

SEQ ID NO: 7889562 - DNA, 18 bp, Homo sapiens
ggtgagggagctggaagc

SEQ ID NO: 7889563 - DNA, 18 bp, Homo sapiens
ggtgagggagctggaagc

SEQ ID NO: 7889564 - DNA, 18 bp, Homo sapiens
ggtgagggagctggaagc

SEQ ID NO: 7889565 - DNA, 18 bp, Homo sapiens
ggtgagggagctggaagc

SEQ ID NO: 7889566 - DNA, 18 bp, Homo sapiens
ggtgagggagctggaagc

SEQ ID NO: 7889567 - DNA, 18 bp, Homo sapiens
ggtgagggagctggaagc

SEQ ID NO: 7889568 - DNA, 21 bp, Homo sapiens
ggtgctcgctgatgaggagtg

SEQ ID NO: 7889569 - DNA, 22 bp, Homo sapiens
ggtggaagccttcagaacagca

SEQ ID NO: 7889570 - DNA, 22 bp, Homo sapiens
ggtgctctttctcagacaagat

SEQ ID NO: 7889571 - DNA, 22 bp, Homo sapiens
ggtgagggagtggaacgaggtg

SEQ ID NO: 7889572 - DNA, 21 bp, Homo sapiens
ggtgctcctccatgctgctct

SEQ ID NO: 7889573 - DNA, 22 bp, Homo sapiens
ggtgctcaaggtgacaggacat

SEQ ID NO: 7889574 - DNA, 21 bp, Homo sapiens
ggtgctcctccatgctgctct

SEQ ID NO: 7889575 - DNA, 22 bp, Homo sapiens
ggtggacagtgttagctctggg

SEQ ID NO: 7889576 - DNA, 22 bp, Homo sapiens
ggtggacagtgttagctctggg

SEQ ID NO: 7889577 - DNA, 17 bp, Homo sapiens
ggtggaagtttctagtt

SEQ ID NO: 7889578 - DNA, 22 bp, Homo sapiens
ggtggacaaatgaatgactgaa

SEQ ID NO: 7889579 - DNA, 22 bp, Homo sapiens
ggtggaaggcctggaaggaggc

SEQ ID NO: 7889580 - DNA, 22 bp, Homo sapiens
ggtggaaggcctggaaggaggc

SEQ ID NO: 7889581 - DNA, 22 bp, Homo sapiens
ggtggaaggcagcagtctcagg

SEQ ID NO: 7889582 - DNA, 22 bp, Homo sapiens
ggtggaaggcctggaaggaggc

SEQ ID NO: 7889583 - DNA, 22 bp, Homo sapiens
ggtggaaggcctggaaggaggc

SEQ ID NO: 7889584 - DNA, 22 bp, Homo sapiens
ggtggaaggcagcagtctcagg

SEQ ID NO: 7889585 - DNA, 22 bp, Homo sapiens
ggtggaaggcctggaaggaggc

SEQ ID NO: 7889586 - DNA, 22 bp, Homo sapiens
ggtggaagccttcagaacagca

SEQ ID NO: 7889587 - DNA, 22 bp, Homo sapiens
ggtccctgaagaggcctggggt

SEQ ID NO: 7889588 - DNA, 22 bp, Homo sapiens
ggtccctgaagaggcctggggt

SEQ ID NO: 7889589 - DNA, 22 bp, Homo sapiens
ggtccctgaagaggcctggggt

SEQ ID NO: 7889590 - DNA, 22 bp, Homo sapiens
ggtccctgaagatgcctgagga

SEQ ID NO: 7889591 - DNA, 22 bp, Homo sapiens
ggtccctgaagatgcctgagga

SEQ ID NO: 7889592 - DNA, 22 bp, Homo sapiens
ggtccctgaagatgcctgagga

SEQ ID NO: 7889593 - DNA, 22 bp, Homo sapiens
ggtccctgaagatgcctgagga

SEQ ID NO: 7889594 - DNA, 22 bp, Homo sapiens
ggtccccgtggaggctggagcg

SEQ ID NO: 7889595 - DNA, 22 bp, Homo sapiens
ggtccccgtggaggctggagcg

SEQ ID NO: 7889596 - DNA, 22 bp, Homo sapiens
ggtccccgtggaggctggagcg

SEQ ID NO: 7889597 - DNA, 22 bp, Homo sapiens
ggtccccgtggaggctggagcg

SEQ ID NO: 7889598 - DNA, 22 bp, Homo sapiens
ggtccccgtggaggctggagcg

SEQ ID NO: 7889599 - DNA, 22 bp, Homo sapiens
ggtccctgcccacctgggagct

SEQ ID NO: 7889600 - DNA, 22 bp, Homo sapiens
ggtccctgcccaaagcccttgg

SEQ ID NO: 7889601 - DNA, 22 bp, Homo sapiens
ggtccctgcccaaagcccttgg

SEQ ID NO: 7889602 - DNA, 23 bp, Homo sapiens
ggtccctgacagcgggcaagttg

SEQ ID NO: 7889603 - DNA, 23 bp, Homo sapiens
ggtccctgacagcgggcaagttg

SEQ ID NO: 7889604 - DNA, 22 bp, Homo sapiens
ggtccctgccctacattttctt

SEQ ID NO: 7889605 - DNA, 20 bp, Homo sapiens
ggtccctgccctctgtcatc

SEQ ID NO: 7889606 - DNA, 20 bp, Homo sapiens
ggtccctgccctctgtcatc

SEQ ID NO: 7889607 - DNA, 22 bp, Homo sapiens
ggtccctgccctaaaactcgtc

SEQ ID NO: 7889608 - DNA, 22 bp, Homo sapiens
ggtccctgccctacattttctt

SEQ ID NO: 7889609 - DNA, 22 bp, Homo sapiens
ggtccctgcctgaggctggcct

SEQ ID NO: 7889610 - DNA, 20 bp, Homo sapiens
ggtccctgccctctgtcatc

SEQ ID NO: 7889611 - DNA, 22 bp, Homo sapiens
ggtccctgcctgaggctggcct

SEQ ID NO: 7889612 - DNA, 22 bp, Homo sapiens
ggtccccccatggtgagcactg

SEQ ID NO: 7889613 - DNA, 22 bp, Homo sapiens
ggtccccccatggtgagcactg

SEQ ID NO: 7889614 - DNA, 22 bp, Homo sapiens
ggtccccccatggtgagcactg

SEQ ID NO: 7889615 - DNA, 22 bp, Homo sapiens
ggtcccatgaaagagggaggcc

SEQ ID NO: 7889616 - DNA, 23 bp, Homo sapiens
ggtcccagtggagaggcctcacc

SEQ ID NO: 7889617 - DNA, 22 bp, Homo sapiens
ggtcccagttgcccaggtcagg

SEQ ID NO: 7889618 - DNA, 23 bp, Homo sapiens
ggtcccagtggagaggcctcacc

SEQ ID NO: 7889619 - DNA, 22 bp, Homo sapiens
ggtcccagttgcccaggtcagg

SEQ ID NO: 7889620 - DNA, 22 bp, Homo sapiens
ggtcccagttgcccaggtcagg

SEQ ID NO: 7889621 - DNA, 22 bp, Homo sapiens
ggtcccagttgcccaggtcagg

SEQ ID NO: 7889622 - DNA, 22 bp, Homo sapiens
ggtcccagttgcccaggtcagg

SEQ ID NO: 7889623 - DNA, 22 bp, Homo sapiens
ggtcccagttgcccaggtcagg

SEQ ID NO: 7889624 - DNA, 22 bp, Homo sapiens
ggtcccagtcctctccctgcta

SEQ ID NO: 7889625 - DNA, 22 bp, Homo sapiens
ggtcccaggttgacagggagac

SEQ ID NO: 7889626 - DNA, 22 bp, Homo sapiens
ggtcccagtcctctccctgcta

SEQ ID NO: 7889627 - DNA, 22 bp, Homo sapiens
ggtcccagtcctctccctgcta

SEQ ID NO: 7889628 - DNA, 22 bp, Homo sapiens
ggtcccagtccctttccaccgt

SEQ ID NO: 7889629 - DNA, 22 bp, Homo sapiens
ggtcccagtccctttccaccgt

SEQ ID NO: 7889630 - DNA, 22 bp, Homo sapiens
ggtcccaggttgacagggagac

SEQ ID NO: 7889631 - DNA, 23 bp, Homo sapiens
ggtcccagtggagaggcctcacc

SEQ ID NO: 7889632 - DNA, 23 bp, Homo sapiens
ggtcccagtggagaggcctcacc

SEQ ID NO: 7889633 - DNA, 23 bp, Homo sapiens
ggtcccagtggagaggcctcacc

SEQ ID NO: 7889634 - DNA, 22 bp, Homo sapiens
ggtcccaggctgcgggctggtg

SEQ ID NO: 7889635 - DNA, 22 bp, Homo sapiens
ggtcccaggctgcgggctggtg

SEQ ID NO: 7889636 - DNA, 22 bp, Homo sapiens
ggtcccaggctgcgggctggtg

SEQ ID NO: 7889637 - DNA, 22 bp, Homo sapiens
ggtcccaggttgacagggagac

SEQ ID NO: 7889638 - DNA, 22 bp, Homo sapiens
ggtcccaggttgacagggagac

SEQ ID NO: 7889639 - DNA, 22 bp, Homo sapiens
ggtcccaggttgacagggagac

SEQ ID NO: 7889640 - DNA, 22 bp, Homo sapiens
gggttggggcccagcagtctgc

SEQ ID NO: 7889641 - DNA, 22 bp, Homo sapiens
ggtaaaaatcacaaatacttta

SEQ ID NO: 7889642 - DNA, 22 bp, Homo sapiens
ggtaaaaatcacaaatacttta

SEQ ID NO: 7889643 - DNA, 22 bp, Homo sapiens
gggttttatggttcacttgcaa

SEQ ID NO: 7889644 - DNA, 22 bp, Homo sapiens
ggtcccagctgctcaagaggct

SEQ ID NO: 7889645 - DNA, 22 bp, Homo sapiens
ggtaaaaatcacaaatacttta

SEQ ID NO: 7889646 - DNA, 22 bp, Homo sapiens
ggtaaaaatcacaaatacttta

SEQ ID NO: 7889647 - DNA, 22 bp, Homo sapiens
ggtcccagctggtcactgtcag

SEQ ID NO: 7889648 - DNA, 22 bp, Homo sapiens
ggtcccagctggtcactgtcag

SEQ ID NO: 7889649 - DNA, 22 bp, Homo sapiens
ggtcccagctggtcactgtcag

SEQ ID NO: 7889650 - DNA, 22 bp, Homo sapiens
ggtcccagctggtcactgtcag

SEQ ID NO: 7889651 - DNA, 22 bp, Homo sapiens
ggtcccagctggtcactgtcag

SEQ ID NO: 7889652 - DNA, 22 bp, Homo sapiens
ggtcccaggaagtgcggcggcg

SEQ ID NO: 7889653 - DNA, 22 bp, Homo sapiens
ggtcccaggaagtgcggcggcg

SEQ ID NO: 7889654 - DNA, 22 bp, Homo sapiens
ggtcccaggctccctcttgtcc

SEQ ID NO: 7889655 - DNA, 22 bp, Homo sapiens
ggtcccaggagaataggtgcaa

SEQ ID NO: 7889656 - DNA, 22 bp, Homo sapiens
ggtcccaggattggttgcgcag

SEQ ID NO: 7889657 - DNA, 22 bp, Homo sapiens
ggtcccaggattggttgcgcag

SEQ ID NO: 7889658 - DNA, 22 bp, Homo sapiens
gggttgaggcggatgtcggcgg

SEQ ID NO: 7889659 - DNA, 22 bp, Homo sapiens
gggttgaggcggatgtcggcgg

SEQ ID NO: 7889660 - DNA, 22 bp, Homo sapiens
gggtgtccttctgtggactctg

SEQ ID NO: 7889661 - DNA, 22 bp, Homo sapiens
gggttgaggcggatgtcggcgg

SEQ ID NO: 7889662 - DNA, 22 bp, Homo sapiens
gggtgtgcaggtcatggcgtct

SEQ ID NO: 7889663 - DNA, 22 bp, Homo sapiens
gggtgtcctgtgccaagctggg

SEQ ID NO: 7889664 - DNA, 22 bp, Homo sapiens
gggtgtccttctgtggactctg

SEQ ID NO: 7889665 - DNA, 22 bp, Homo sapiens
gggtgtccagggcgtgtctgga

SEQ ID NO: 7889666 - DNA, 22 bp, Homo sapiens
gggtgtccagggcgtgtctgga

SEQ ID NO: 7889667 - DNA, 22 bp, Homo sapiens
gggtgtccacaaaatggctttg

SEQ ID NO: 7889668 - DNA, 18 bp, Homo sapiens
gggtggtgtgctcttcgc

SEQ ID NO: 7889669 - DNA, 18 bp, Homo sapiens
gggtggtgtgctcttcgc

SEQ ID NO: 7889670 - DNA, 22 bp, Homo sapiens
gggtggtgtattagagctgcag

SEQ ID NO: 7889671 - DNA, 18 bp, Homo sapiens
gggtggtgtgctcttcgc

SEQ ID NO: 7889672 - DNA, 22 bp, Homo sapiens
gggttggattacttagggagaa

SEQ ID NO: 7889673 - DNA, 22 bp, Homo sapiens
gggttggatcctggtggctgcc

SEQ ID NO: 7889674 - DNA, 22 bp, Homo sapiens
gggttggattacttagggagaa

SEQ ID NO: 7889675 - DNA, 22 bp, Homo sapiens
gggttggatcctggtggctgcc

SEQ ID NO: 7889676 - DNA, 22 bp, Homo sapiens
gggttggcagcaccagaggagg

SEQ ID NO: 7889677 - DNA, 22 bp, Homo sapiens
ggggccaggtccagcttccaaa

SEQ ID NO: 7889678 - DNA, 22 bp, Homo sapiens
ggggccaggtccagcttccaaa

SEQ ID NO: 7889679 - DNA, 22 bp, Homo sapiens
ggggccaggtccagcttccaaa

SEQ ID NO: 7889680 - DNA, 22 bp, Homo sapiens
ggggccaggtccagcttccaaa

SEQ ID NO: 7889681 - DNA, 22 bp, Homo sapiens
ggggccaggtccagcttccaaa

SEQ ID NO: 7889682 - DNA, 22 bp, Homo sapiens
ggggccaggtccagcttccaaa

SEQ ID NO: 7889683 - DNA, 22 bp, Homo sapiens
ggggccagtaggagtgatgtac

SEQ ID NO: 7889684 - DNA, 20 bp, Homo sapiens
ggggcccaagccctcttgcc

SEQ ID NO: 7889685 - DNA, 22 bp, Homo sapiens
ggggccagtaggagtgatgtac

SEQ ID NO: 7889686 - DNA, 22 bp, Homo sapiens
ggggccagcttcgcgtgctctt

SEQ ID NO: 7889687 - DNA, 22 bp, Homo sapiens
ggggccagcttcgcgtgctctt

SEQ ID NO: 7889688 - DNA, 22 bp, Homo sapiens
ggggccagcttcgcgtgctctt

SEQ ID NO: 7889689 - DNA, 22 bp, Homo sapiens
ggggccagcactgtgcctttgt

SEQ ID NO: 7889690 - DNA, 22 bp, Homo sapiens
ggggccagcaatgttgaggaat

SEQ ID NO: 7889691 - DNA, 22 bp, Homo sapiens
ggggccagcaatgttgaggaat

SEQ ID NO: 7889692 - DNA, 22 bp, Homo sapiens
ggggccagcaatgttgaggaat

SEQ ID NO: 7889693 - DNA, 22 bp, Homo sapiens
ggggccagatatcactaaggtt

SEQ ID NO: 7889694 - DNA, 22 bp, Homo sapiens
ggggccagatatcactaaggtt

SEQ ID NO: 7889695 - DNA, 22 bp, Homo sapiens
ggggccagatatcactaaggtt

SEQ ID NO: 7889696 - DNA, 22 bp, Homo sapiens
ggggccagatatcactaaggtt

SEQ ID NO: 7889697 - DNA, 22 bp, Homo sapiens
ggggccagatatcactaaggtt

SEQ ID NO: 7889698 - DNA, 22 bp, Homo sapiens
ggggcccagggcagcagtgcag

SEQ ID NO: 7889699 - DNA, 22 bp, Homo sapiens
ggggcccagggcagcagtgcag

SEQ ID NO: 7889700 - DNA, 22 bp, Homo sapiens
ggggcccagggcagcagtgcag

SEQ ID NO: 7889701 - DNA, 22 bp, Homo sapiens
ggggcccgggcactggccgtca

SEQ ID NO: 7889702 - DNA, 22 bp, Homo sapiens
ggggcccctgtggcttgatgcc

SEQ ID NO: 7889703 - DNA, 22 bp, Homo sapiens
ggggcccctgtggcttgatgcc

SEQ ID NO: 7889704 - DNA, 22 bp, Homo sapiens
ggggcccctcggacacgtgcgg

SEQ ID NO: 7889705 - DNA, 22 bp, Homo sapiens
ggggcccctcggacacgtgcgg

SEQ ID NO: 7889706 - DNA, 22 bp, Homo sapiens
ggggcccttgtggctgcaggcc

SEQ ID NO: 7889707 - DNA, 22 bp, Homo sapiens
ggggcccttgtggctgcaggcc

SEQ ID NO: 7889708 - DNA, 19 bp, Homo sapiens
ggggcccggggtctgcgag

SEQ ID NO: 7889709 - DNA, 22 bp, Homo sapiens
ggggtagggcgattgctgcttt

SEQ ID NO: 7889710 - DNA, 22 bp, Homo sapiens
ggggtagggcgattgctgcttt

SEQ ID NO: 7889711 - DNA, 22 bp, Homo sapiens
ggggtaggcaggtgatctgatc

SEQ ID NO: 7889712 - DNA, 22 bp, Homo sapiens
ggggtaggcaggtgatctgatc

SEQ ID NO: 7889713 - DNA, 22 bp, Homo sapiens
ggggcccttgtggctgcaggcc

SEQ ID NO: 7889714 - DNA, 22 bp, Homo sapiens
ggggtaggcaggtgatctgatc

SEQ ID NO: 7889715 - DNA, 22 bp, Homo sapiens
ggggcccttgtggctgcaggcc

SEQ ID NO: 7889716 - DNA, 22 bp, Homo sapiens
ggggtgagttagcgtcggcttg

SEQ ID NO: 7889717 - DNA, 22 bp, Homo sapiens
ggggtgagttagcgtcggcttg

SEQ ID NO: 7889718 - DNA, 22 bp, Homo sapiens
ggggtgagtgctcagccccgga

SEQ ID NO: 7889719 - DNA, 22 bp, Homo sapiens
ggggtgagtgctcagccccgga

SEQ ID NO: 7889720 - DNA, 22 bp, Homo sapiens
ggggtagggtgattgtgaagta

SEQ ID NO: 7889721 - DNA, 22 bp, Homo sapiens
ggggtagggcgattgctgcttt

SEQ ID NO: 7889722 - DNA, 22 bp, Homo sapiens
ggggtagggcgattgctgcttt

SEQ ID NO: 7889723 - DNA, 22 bp, Homo sapiens
ggggtggattcctacaggtcca

SEQ ID NO: 7889724 - DNA, 22 bp, Homo sapiens
ggggtggattcctacaggtcca

SEQ ID NO: 7889725 - DNA, 22 bp, Homo sapiens
ggggtggatcaggcaggcccag

SEQ ID NO: 7889726 - DNA, 22 bp, Homo sapiens
ggggtggatttcaggcggtgtc

SEQ ID NO: 7889727 - DNA, 22 bp, Homo sapiens
ggggtggattcctacaggtcca

SEQ ID NO: 7889728 - DNA, 22 bp, Homo sapiens
ggggtggattcctacaggtcca

SEQ ID NO: 7889729 - DNA, 22 bp, Homo sapiens
ggggtggatttcaggcggtgtc

SEQ ID NO: 7889730 - DNA, 22 bp, Homo sapiens
ggggtggatttcaggcggtgtc

SEQ ID NO: 7889731 - DNA, 22 bp, Homo sapiens
ggggtggccaaggactctgacc

SEQ ID NO: 7889732 - DNA, 22 bp, Homo sapiens
ggggtggccaaggactctgacc

SEQ ID NO: 7889733 - DNA, 22 bp, Homo sapiens
ggggtggatcaggcaggcccag

SEQ ID NO: 7889734 - DNA, 22 bp, Homo sapiens
ggggtggagctaaatgtctact

SEQ ID NO: 7889735 - DNA, 22 bp, Homo sapiens
ggggtggagctaaatgtctact

SEQ ID NO: 7889736 - DNA, 22 bp, Homo sapiens
ggggtggagatggtggcccttt

SEQ ID NO: 7889737 - DNA, 22 bp, Homo sapiens
ggggtggagatggtggcccttt

SEQ ID NO: 7889738 - DNA, 22 bp, Homo sapiens
ggggtggagatggtggcccttt

SEQ ID NO: 7889739 - DNA, 22 bp, Homo sapiens
ggggtggagatggtggcccttt

SEQ ID NO: 7889740 - DNA, 22 bp, Homo sapiens
ggggtgctagagtggggccact

SEQ ID NO: 7889741 - DNA, 18 bp, Homo sapiens
ggggtgcccagactgtct

SEQ ID NO: 7889742 - DNA, 19 bp, Homo sapiens
ggggtggctggggctccag

SEQ ID NO: 7889743 - DNA, 22 bp, Homo sapiens
ggggtgggagtgccatccttga

SEQ ID NO: 7889744 - DNA, 19 bp, Homo sapiens
ggggtggctggggctccag

SEQ ID NO: 7889745 - DNA, 22 bp, Homo sapiens
ggggtgggagtgccatccttga

SEQ ID NO: 7889746 - DNA, 22 bp, Homo sapiens
ggggtgggagtgccatccttga

SEQ ID NO: 7889747 - DNA, 22 bp, Homo sapiens
ggggtgggagtgccatccttga

SEQ ID NO: 7889748 - DNA, 22 bp, Homo sapiens
ggggtgggagtgccatccttga

SEQ ID NO: 7889749 - DNA, 22 bp, Homo sapiens
ggggtgggagtgccatccttga

SEQ ID NO: 7889750 - DNA, 22 bp, Homo sapiens
ggggtgggagtgccatccttga

SEQ ID NO: 7889751 - DNA, 22 bp, Homo sapiens
ggggtgggagtgccatccttga

SEQ ID NO: 7889752 - DNA, 22 bp, Homo sapiens
ggggtgggagtgccatccttga

SEQ ID NO: 7889753 - DNA, 22 bp, Homo sapiens
ggggtgggagtgccatccttga

SEQ ID NO: 7889754 - DNA, 22 bp, Homo sapiens
ggggtgggcgtgcagggacacc

SEQ ID NO: 7889755 - DNA, 22 bp, Homo sapiens
ggggtgggagtgccatccttga

SEQ ID NO: 7889756 - DNA, 22 bp, Homo sapiens
ggggtggccctaccctctggaa

SEQ ID NO: 7889757 - DNA, 22 bp, Homo sapiens
ggggtggccctaccctctggaa

SEQ ID NO: 7889758 - DNA, 22 bp, Homo sapiens
ggggtggcctgtaggcagcatg

SEQ ID NO: 7889759 - DNA, 22 bp, Homo sapiens
ggggtggcctgtaggcagcatg

SEQ ID NO: 7889760 - DNA, 22 bp, Homo sapiens
ggggtggcctgtaggcagcatg

SEQ ID NO: 7889761 - DNA, 22 bp, Homo sapiens
ggggtggcctgtaggcagcatg

SEQ ID NO: 7889762 - DNA, 22 bp, Homo sapiens
ggggtggcctgtaggcagcatg

SEQ ID NO: 7889763 - DNA, 22 bp, Homo sapiens
ggggtggcctgtaggcagcatg

SEQ ID NO: 7889764 - DNA, 19 bp, Homo sapiens
ggggtggctggggctccag

SEQ ID NO: 7889765 - DNA, 19 bp, Homo sapiens
ggggtggctggggctccag

SEQ ID NO: 7889766 - DNA, 19 bp, Homo sapiens
ggggtggctggggctccag

SEQ ID NO: 7889767 - DNA, 19 bp, Homo sapiens
ggggtggctggggctccag

SEQ ID NO: 7889768 - DNA, 22 bp, Homo sapiens
ggggtggctggcacctcctggt

SEQ ID NO: 7889769 - DNA, 22 bp, Homo sapiens
ggggtggctggcacctcctggt

SEQ ID NO: 7889770 - DNA, 22 bp, Homo sapiens
ggggtggctggcacctcctggt

SEQ ID NO: 7889771 - DNA, 19 bp, Homo sapiens
ggggtggctggggctccag

SEQ ID NO: 7889772 - DNA, 22 bp, Homo sapiens
gggtgctttggctcacgcctgt

SEQ ID NO: 7889773 - DNA, 22 bp, Homo sapiens
gggtggaaagtatttggggacc

SEQ ID NO: 7889774 - DNA, 22 bp, Homo sapiens
gggtggaagccagagaggtcat

SEQ ID NO: 7889775 - DNA, 22 bp, Homo sapiens
gggtggaagccagagaggtcat

SEQ ID NO: 7889776 - DNA, 21 bp, Homo sapiens
gggtgctgtggtcatgcagga

SEQ ID NO: 7889777 - DNA, 18 bp, Homo sapiens
gggtgctggggccccttg

SEQ ID NO: 7889778 - DNA, 18 bp, Homo sapiens
gggtgctggggccccttg

SEQ ID NO: 7889779 - DNA, 22 bp, Homo sapiens
gggtgcaggcagcccaggcagg

SEQ ID NO: 7889780 - DNA, 22 bp, Homo sapiens
gggtgcaggcagcccaggcagg

SEQ ID NO: 7889781 - DNA, 22 bp, Homo sapiens
gggtgctgggaggctgacatct

SEQ ID NO: 7889782 - DNA, 18 bp, Homo sapiens
gggtgcaggcactgactg

SEQ ID NO: 7889783 - DNA, 18 bp, Homo sapiens
gggtgcaggcactgactg

SEQ ID NO: 7889784 - DNA, 18 bp, Homo sapiens
gggtgcaggcactgactg

SEQ ID NO: 7889785 - DNA, 22 bp, Homo sapiens
gggtgcagcagagctcctctgt

SEQ ID NO: 7889786 - DNA, 22 bp, Homo sapiens
gggtgcagcagagctcctctgt

SEQ ID NO: 7889787 - DNA, 22 bp, Homo sapiens
gggtgcagcagagctcctctgt

SEQ ID NO: 7889788 - DNA, 22 bp, Homo sapiens
gggtgcagctttgaaagcatgt

SEQ ID NO: 7889789 - DNA, 22 bp, Homo sapiens
gggtgcagctttgaaagcatgt

SEQ ID NO: 7889790 - DNA, 18 bp, Homo sapiens
gggtgcaggcactgactg

SEQ ID NO: 7889791 - DNA, 22 bp, Homo sapiens
gggtgcaggcagcccaggcagg

SEQ ID NO: 7889792 - DNA, 22 bp, Homo sapiens
gggtgcaggcagcccaggcagg

SEQ ID NO: 7889793 - DNA, 22 bp, Homo sapiens
gggtgcaggcagcccaggcagg

SEQ ID NO: 7889794 - DNA, 22 bp, Homo sapiens
gggtgcaggcagcccaggcagg

SEQ ID NO: 7889795 - DNA, 22 bp, Homo sapiens
gggtgcaggcagcccaggcagg

SEQ ID NO: 7889796 - DNA, 22 bp, Homo sapiens
gggtgcaggcagcccaggcagg

SEQ ID NO: 7889797 - DNA, 22 bp, Homo sapiens
gggtgaggccttgctgccatca

SEQ ID NO: 7889798 - DNA, 22 bp, Homo sapiens
gggtgagggatgagccttcttc

SEQ ID NO: 7889799 - DNA, 22 bp, Homo sapiens
gggtgagggatgagccttcttc

SEQ ID NO: 7889800 - DNA, 22 bp, Homo sapiens
gggtgagggatgagccttcttc

SEQ ID NO: 7889801 - DNA, 22 bp, Homo sapiens
gggtgagggatgagccttcttc

SEQ ID NO: 7889802 - DNA, 22 bp, Homo sapiens
gggtgagggatgagccttcttc

SEQ ID NO: 7889803 - DNA, 22 bp, Homo sapiens
gggtgagggatgagccttcttc

SEQ ID NO: 7889804 - DNA, 22 bp, Homo sapiens
gggtgcagcagagctcctctgt

SEQ ID NO: 7889805 - DNA, 22 bp, Homo sapiens
gggtgcagcagagctcctctgt

SEQ ID NO: 7889806 - DNA, 22 bp, Homo sapiens
gggtgcagcagagctcctctgt

SEQ ID NO: 7889807 - DNA, 22 bp, Homo sapiens
gggtgcaagcaagtggcacaga

SEQ ID NO: 7889808 - DNA, 22 bp, Homo sapiens
gggtgcagagcttaactgtagg

SEQ ID NO: 7889809 - DNA, 22 bp, Homo sapiens
gggtgcaactaagaagaggtga

SEQ ID NO: 7889810 - DNA, 22 bp, Homo sapiens
ggggtgggagtgccatccttga

SEQ ID NO: 7889811 - DNA, 22 bp, Homo sapiens
gggtgaggagctgccagtcatg

SEQ ID NO: 7889812 - DNA, 20 bp, Homo sapiens
gggtgaggatggagaatttg

SEQ ID NO: 7889813 - DNA, 20 bp, Homo sapiens
gggtgaggatggagaatttg

SEQ ID NO: 7889814 - DNA, 20 bp, Homo sapiens
gggtgaggatggagaatttg

SEQ ID NO: 7889815 - DNA, 22 bp, Homo sapiens
gggtgaggcccatttgaggcca

SEQ ID NO: 7889816 - DNA, 22 bp, Homo sapiens
gggtgaggccttgctgccatca

SEQ ID NO: 7889817 - DNA, 22 bp, Homo sapiens
gggtgaggccttgctgccatca

SEQ ID NO: 7889818 - DNA, 22 bp, Homo sapiens
gggtgaggcccatttgaggcca

SEQ ID NO: 7889819 - DNA, 22 bp, Homo sapiens
gggtgaggcccatttgaggcca

SEQ ID NO: 7889820 - DNA, 22 bp, Homo sapiens
gggtgaggcccatttgaggcca

SEQ ID NO: 7889821 - DNA, 22 bp, Homo sapiens
gggtggtggcggaggctccagg

SEQ ID NO: 7889822 - DNA, 22 bp, Homo sapiens
gggtggtggcggaggctccagg

SEQ ID NO: 7889823 - DNA, 22 bp, Homo sapiens
gggtggtggcggaggctccagg

SEQ ID NO: 7889824 - DNA, 22 bp, Homo sapiens
gggtggtgggcacagaatctgg

SEQ ID NO: 7889825 - DNA, 22 bp, Homo sapiens
gggtggtggccagcagtgggca

SEQ ID NO: 7889826 - DNA, 22 bp, Homo sapiens
gggtggtggccagcagtgggca

SEQ ID NO: 7889827 - DNA, 22 bp, Homo sapiens
gggtggtggcggaggctccagg

SEQ ID NO: 7889828 - DNA, 22 bp, Homo sapiens
gggtggtggccagcagtgggca

SEQ ID NO: 7889829 - DNA, 22 bp, Homo sapiens
gggtggtgtattagagctgcag

SEQ ID NO: 7889830 - DNA, 22 bp, Homo sapiens
gggtggtgtattagagctgcag

SEQ ID NO: 7889831 - DNA, 22 bp, Homo sapiens
gggtggtgtattagagctgcag

SEQ ID NO: 7889832 - DNA, 22 bp, Homo sapiens
gggtggtgtattagagctgcag

SEQ ID NO: 7889833 - DNA, 22 bp, Homo sapiens
gggtggtgtattagagctgcag

SEQ ID NO: 7889834 - DNA, 22 bp, Homo sapiens
gggtggtgggcacagaatctgg

SEQ ID NO: 7889835 - DNA, 22 bp, Homo sapiens
gggtggtgggcacagaatctgg

SEQ ID NO: 7889836 - DNA, 22 bp, Homo sapiens
gggtggtgtattagagctgcag

SEQ ID NO: 7889837 - DNA, 22 bp, Homo sapiens
gggtggtgtattagagctgcag

SEQ ID NO: 7889838 - DNA, 22 bp, Homo sapiens
gggtggtgtattagagctgcag

SEQ ID NO: 7889839 - DNA, 22 bp, Homo sapiens
gggtggtgtattagagctgcag

SEQ ID NO: 7889840 - DNA, 21 bp, Homo sapiens
gggtggtctgctgaagaggga

SEQ ID NO: 7889841 - DNA, 22 bp, Homo sapiens
gggtgggtggtccgcagacata

SEQ ID NO: 7889842 - DNA, 22 bp, Homo sapiens
gggtggtgagatgtagctgatg

SEQ ID NO: 7889843 - DNA, 22 bp, Homo sapiens
gggtggtctggcaggctggaaa

SEQ ID NO: 7889844 - DNA, 22 bp, Homo sapiens
gggtggtctggcaggctggaaa

SEQ ID NO: 7889845 - DNA, 22 bp, Homo sapiens
gggtggtggccagcagtgggca

SEQ ID NO: 7889846 - DNA, 22 bp, Homo sapiens
gggtggtggccagcagtgggca

SEQ ID NO: 7889847 - DNA, 22 bp, Homo sapiens
gggtggtggccagcagtgggca

SEQ ID NO: 7889848 - DNA, 22 bp, Homo sapiens
gggtggtggccagcagtgggca

SEQ ID NO: 7889849 - DNA, 22 bp, Homo sapiens
gggtggtggccagcagtgggca

SEQ ID NO: 7889850 - DNA, 22 bp, Homo sapiens
gggtggtgagatgtagctgatg

SEQ ID NO: 7889851 - DNA, 22 bp, Homo sapiens
gggtggtgagatgtagctgatg

SEQ ID NO: 7889852 - DNA, 22 bp, Homo sapiens
gggtgggtggtccgcagacata

SEQ ID NO: 7889853 - DNA, 22 bp, Homo sapiens
gggtgggtggtccgcagacata

SEQ ID NO: 7889854 - DNA, 22 bp, Homo sapiens
gggtgggtggtccgcagacata

SEQ ID NO: 7889855 - DNA, 22 bp, Homo sapiens
gggtgggtggcagcaccgaggc

SEQ ID NO: 7889856 - DNA, 21 bp, Homo sapiens
gggtgggtggaattaggagtg

SEQ ID NO: 7889857 - DNA, 21 bp, Homo sapiens
gggtgggtggaattaggagtg

SEQ ID NO: 7889858 - DNA, 22 bp, Homo sapiens
gggtgggtggcagcaccgaggc

SEQ ID NO: 7889859 - DNA, 21 bp, Homo sapiens
gggtggggttccagccttttc

SEQ ID NO: 7889860 - DNA, 21 bp, Homo sapiens
gggtggggttccagccttttc

SEQ ID NO: 7889861 - DNA, 21 bp, Homo sapiens
gggtggggttccagccttttc

SEQ ID NO: 7889862 - DNA, 21 bp, Homo sapiens
gggtggggttccagccttttc

SEQ ID NO: 7889863 - DNA, 21 bp, Homo sapiens
gggtgggtggaattaggagtg

SEQ ID NO: 7889864 - DNA, 21 bp, Homo sapiens
gggtgggtggaattaggagtg

SEQ ID NO: 7889865 - DNA, 22 bp, Homo sapiens
gggtggagagaaagaaacgtga

SEQ ID NO: 7889866 - DNA, 22 bp, Homo sapiens
gggtggagagaaagaaacgtga

SEQ ID NO: 7889867 - DNA, 22 bp, Homo sapiens
gggtggagagaaagaaacgtga

SEQ ID NO: 7889868 - DNA, 22 bp, Homo sapiens
gggtggagaggctaagtccagt

SEQ ID NO: 7889869 - DNA, 22 bp, Homo sapiens
gggtggagaggctaagtccagt

SEQ ID NO: 7889870 - DNA, 22 bp, Homo sapiens
gggtggagaggctaagtccagt

SEQ ID NO: 7889871 - DNA, 22 bp, Homo sapiens
gggtggagaggctaagtccagt

SEQ ID NO: 7889872 - DNA, 22 bp, Homo sapiens
gggtggagaggctaagtccagt

SEQ ID NO: 7889873 - DNA, 22 bp, Homo sapiens
gggtggagccagttgactctgt

SEQ ID NO: 7889874 - DNA, 22 bp, Homo sapiens
gggtggagccagttgactctgt

SEQ ID NO: 7889875 - DNA, 22 bp, Homo sapiens
gggtggagccagttgactctgt

SEQ ID NO: 7889876 - DNA, 21 bp, Homo sapiens
gggtggggttccagccttttc

SEQ ID NO: 7889877 - DNA, 22 bp, Homo sapiens
gggtggagaggctaagtccagt

SEQ ID NO: 7889878 - DNA, 22 bp, Homo sapiens
gggtggagaggctaagtccagt

SEQ ID NO: 7889879 - DNA, 22 bp, Homo sapiens
gggtggagccagttgactctgt

SEQ ID NO: 7889880 - DNA, 22 bp, Homo sapiens
gggtggagaggctaagtccagt

SEQ ID NO: 7889881 - DNA, 22 bp, Homo sapiens
ggggaggccagtggaccgtccc

SEQ ID NO: 7889882 - DNA, 22 bp, Homo sapiens
ggggaggccagtggaccgtccc

SEQ ID NO: 7889883 - DNA, 22 bp, Homo sapiens
ggggaggcaagatgaagtgagg

SEQ ID NO: 7889884 - DNA, 22 bp, Homo sapiens
ggggaggcaagatgaagtgagg

SEQ ID NO: 7889885 - DNA, 22 bp, Homo sapiens
ggggaggcaagatgaagtgagg

SEQ ID NO: 7889886 - DNA, 22 bp, Homo sapiens
ggggaggcaagatgaagtgagg

SEQ ID NO: 7889887 - DNA, 22 bp, Homo sapiens
ggggaggcaagatgaagtgagg

SEQ ID NO: 7889888 - DNA, 22 bp, Homo sapiens
ggggaggctgatgtgggcaaag

SEQ ID NO: 7889889 - DNA, 22 bp, Homo sapiens
ggggaggctgatgtgggcaaag

SEQ ID NO: 7889890 - DNA, 22 bp, Homo sapiens
ggggaggctgatgtgggcaaag

SEQ ID NO: 7889891 - DNA, 22 bp, Homo sapiens
ggggaggctgatgtgggcaaag

SEQ ID NO: 7889892 - DNA, 22 bp, Homo sapiens
ggggaggccagtggaccgtccc

SEQ ID NO: 7889893 - DNA, 22 bp, Homo sapiens
ggggaggagccatgtaactagt

SEQ ID NO: 7889894 - DNA, 22 bp, Homo sapiens
ggggaggacctttccaaggctt

SEQ ID NO: 7889895 - DNA, 22 bp, Homo sapiens
ggggaggacctttccaaggctt

SEQ ID NO: 7889896 - DNA, 22 bp, Homo sapiens
ggggaggacctttccaaggctt

SEQ ID NO: 7889897 - DNA, 22 bp, Homo sapiens
ggggaggagtgtacaggtttat

SEQ ID NO: 7889898 - DNA, 22 bp, Homo sapiens
ggggaggagtgtacaggtttat

SEQ ID NO: 7889899 - DNA, 22 bp, Homo sapiens
ggggaggagccatgtaactagt

SEQ ID NO: 7889900 - DNA, 22 bp, Homo sapiens
ggggaggagccatgtaactagt

SEQ ID NO: 7889901 - DNA, 22 bp, Homo sapiens
ggggaggcaagatgaagtgagg

SEQ ID NO: 7889902 - DNA, 22 bp, Homo sapiens
ggggaggcaagatgaagtgagg

SEQ ID NO: 7889903 - DNA, 22 bp, Homo sapiens
ggggaggagtgtacaggtttat

SEQ ID NO: 7889904 - DNA, 22 bp, Homo sapiens
ggggaggaagctggaacacggg

SEQ ID NO: 7889905 - DNA, 22 bp, Homo sapiens
ggggaggaagctggaacacggg

SEQ ID NO: 7889906 - DNA, 22 bp, Homo sapiens
ggggaggaagctggaacacggg

SEQ ID NO: 7889907 - DNA, 22 bp, Homo sapiens
ggggaggaagctggaacacggg

SEQ ID NO: 7889908 - DNA, 22 bp, Homo sapiens
ggggaggaagctggaacacggg

SEQ ID NO: 7889909 - DNA, 22 bp, Homo sapiens
ggggaggaagctggaacacggg

SEQ ID NO: 7889910 - DNA, 22 bp, Homo sapiens
ggggaggaagctggaacacggg

SEQ ID NO: 7889911 - DNA, 22 bp, Homo sapiens
ggggaggaagctggaacacggg

SEQ ID NO: 7889912 - DNA, 22 bp, Homo sapiens
ggggaggaagctggaacacggg

SEQ ID NO: 7889913 - DNA, 22 bp, Homo sapiens
ggggaggaagctggaacacggg

SEQ ID NO: 7889914 - DNA, 22 bp, Homo sapiens
ggggaggaagctggaacacggg

SEQ ID NO: 7889915 - DNA, 22 bp, Homo sapiens
ggggaggacctttccaaggctt

SEQ ID NO: 7889916 - DNA, 22 bp, Homo sapiens
ggggaggacctttccaaggctt

SEQ ID NO: 7889917 - DNA, 22 bp, Homo sapiens
ggggaggacctttccaaggctt

SEQ ID NO: 7889918 - DNA, 22 bp, Homo sapiens
ggggaggaagctggaacacggg

SEQ ID NO: 7889919 - DNA, 22 bp, Homo sapiens
ggggaggaagctggaacacggg

SEQ ID NO: 7889920 - DNA, 22 bp, Homo sapiens
ggggaggaagctggaacacggg

SEQ ID NO: 7889921 - DNA, 22 bp, Homo sapiens
ggggagaattacatggcgtgga

SEQ ID NO: 7889922 - DNA, 22 bp, Homo sapiens
ggggagaattacatggcgtgga

SEQ ID NO: 7889923 - DNA, 22 bp, Homo sapiens
ggggagaataaatcagatttta

SEQ ID NO: 7889924 - DNA, 22 bp, Homo sapiens
ggggagaattaccaaaagcgct

SEQ ID NO: 7889925 - DNA, 22 bp, Homo sapiens
ggggagaattaccaaaagcgct

SEQ ID NO: 7889926 - DNA, 22 bp, Homo sapiens
ggggagaattacatggcgtgga

SEQ ID NO: 7889927 - DNA, 22 bp, Homo sapiens
ggggagaattaccaaaagcgct

SEQ ID NO: 7889928 - DNA, 22 bp, Homo sapiens
ggggagaattaccaaaagcgct

SEQ ID NO: 7889929 - DNA, 19 bp, Homo sapiens
ggggagaactagagacagc

SEQ ID NO: 7889930 - DNA, 22 bp, Homo sapiens
ggggagaataaatcagatttta

SEQ ID NO: 7889931 - DNA, 19 bp, Homo sapiens
ggggagaactagagacagc

SEQ ID NO: 7889932 - DNA, 19 bp, Homo sapiens
ggggagaactagagacagc

SEQ ID NO: 7889933 - DNA, 19 bp, Homo sapiens
ggggagaactagagacagc

SEQ ID NO: 7889934 - DNA, 22 bp, Homo sapiens
gggcttctgtacctacctggaa

SEQ ID NO: 7889935 - DNA, 22 bp, Homo sapiens
ggggcaggaggtgttctctttt

SEQ ID NO: 7889936 - DNA, 21 bp, Homo sapiens
ggggatgcgaccacaggctcc

SEQ ID NO: 7889937 - DNA, 22 bp, Homo sapiens
ggggagttaaaatgtgctgcaa

SEQ ID NO: 7889938 - DNA, 22 bp, Homo sapiens
ggggcagggaggttatcgccga

SEQ ID NO: 7889939 - DNA, 22 bp, Homo sapiens
ggggcagggaggttatcgccga

SEQ ID NO: 7889940 - DNA, 22 bp, Homo sapiens
ggggcagggaggttatcgccga

SEQ ID NO: 7889941 - DNA, 22 bp, Homo sapiens
ggggcagggaggttatcgccga

SEQ ID NO: 7889942 - DNA, 19 bp, Homo sapiens
ggggaggtattgttttcat

SEQ ID NO: 7889943 - DNA, 22 bp, Homo sapiens
ggggaggctgatgtgggcaaag

SEQ ID NO: 7889944 - DNA, 22 bp, Homo sapiens
ggggaggctgatgtgggcaaag

SEQ ID NO: 7889945 - DNA, 22 bp, Homo sapiens
ggggagtgacgcagggccatag

SEQ ID NO: 7889946 - DNA, 22 bp, Homo sapiens
ggggagtgacgcagggccatag

SEQ ID NO: 7889947 - DNA, 22 bp, Homo sapiens
ggggagtgttttcatgggcttg

SEQ ID NO: 7889948 - DNA, 22 bp, Homo sapiens
ggggagtgttttcatgggcttg

SEQ ID NO: 7889949 - DNA, 22 bp, Homo sapiens
ggggagtggttgcctgtgatcc

SEQ ID NO: 7889950 - DNA, 22 bp, Homo sapiens
ggggagtgttttcatgggcttg

SEQ ID NO: 7889951 - DNA, 22 bp, Homo sapiens
ggggagtgttttcatgggcttg

SEQ ID NO: 7889952 - DNA, 22 bp, Homo sapiens
ggggccagagaggacccaggtg

SEQ ID NO: 7889953 - DNA, 22 bp, Homo sapiens
ggggccagagaggacccaggtg

SEQ ID NO: 7889954 - DNA, 22 bp, Homo sapiens
ggggccagatatcactaaggtt

SEQ ID NO: 7889955 - DNA, 22 bp, Homo sapiens
ggggccagatatcactaaggtt

SEQ ID NO: 7889956 - DNA, 22 bp, Homo sapiens
ggggccagatatcactaaggtt

SEQ ID NO: 7889957 - DNA, 22 bp, Homo sapiens
ggggccagagaggacccaggtg

SEQ ID NO: 7889958 - DNA, 22 bp, Homo sapiens
ggggccaagggaatgtattgtg

SEQ ID NO: 7889959 - DNA, 22 bp, Homo sapiens
ggggccagagaggacccaggtg

SEQ ID NO: 7889960 - DNA, 22 bp, Homo sapiens
ggggccagagaggacccaggtg

SEQ ID NO: 7889961 - DNA, 22 bp, Homo sapiens
ggggccactggcaggaccttgg

SEQ ID NO: 7889962 - DNA, 22 bp, Homo sapiens
ggggccactggcaggaccttgg

SEQ ID NO: 7889963 - DNA, 22 bp, Homo sapiens
ggggccaagggaatgtattgtg

SEQ ID NO: 7889964 - DNA, 22 bp, Homo sapiens
ggggcattgtgtctgggttcct

SEQ ID NO: 7889965 - DNA, 21 bp, Homo sapiens
ggggcatcaagacagagttag

SEQ ID NO: 7889966 - DNA, 22 bp, Homo sapiens
ggggcatcagaaccctgtggga

SEQ ID NO: 7889967 - DNA, 22 bp, Homo sapiens
ggggcagtgaggtggcagcccg

SEQ ID NO: 7889968 - DNA, 22 bp, Homo sapiens
ggggcagtgaggtggcagcccg

SEQ ID NO: 7889969 - DNA, 20 bp, Homo sapiens
ggggcaggtttttatggcta

SEQ ID NO: 7889970 - DNA, 20 bp, Homo sapiens
ggggcaggtttttatggcta

SEQ ID NO: 7889971 - DNA, 20 bp, Homo sapiens
ggggcaggtttttatggcta

SEQ ID NO: 7889972 - DNA, 22 bp, Homo sapiens
gggcttctgctcttttggtgct

SEQ ID NO: 7889973 - DNA, 22 bp, Homo sapiens
gggcttctgctcttttggtgct

SEQ ID NO: 7889974 - DNA, 22 bp, Homo sapiens
gggcttctctttagtgagctga

SEQ ID NO: 7889975 - DNA, 22 bp, Homo sapiens
gggcttctctttagtgagctga

SEQ ID NO: 7889976 - DNA, 22 bp, Homo sapiens
gggcttctcttatgctaactgg

SEQ ID NO: 7889977 - DNA, 22 bp, Homo sapiens
gggcttctctttagtgagctga

SEQ ID NO: 7889978 - DNA, 22 bp, Homo sapiens
gggcttctgggcaccactccct

SEQ ID NO: 7889979 - DNA, 22 bp, Homo sapiens
gggcttctggctactgtatgag

SEQ ID NO: 7889980 - DNA, 22 bp, Homo sapiens
gggcttctggctactgtatgag

SEQ ID NO: 7889981 - DNA, 22 bp, Homo sapiens
gggcttctccctaaggactctg

SEQ ID NO: 7889982 - DNA, 22 bp, Homo sapiens
gggcttctcagagaggctttag

SEQ ID NO: 7889983 - DNA, 22 bp, Homo sapiens
gggcttctccctaaggactctg

SEQ ID NO: 7889984 - DNA, 22 bp, Homo sapiens
gggcttctctgggagtcctggt

SEQ ID NO: 7889985 - DNA, 22 bp, Homo sapiens
gggcttctctgggagtcctggt

SEQ ID NO: 7889986 - DNA, 22 bp, Homo sapiens
gggcttctctcaggggcatgag

SEQ ID NO: 7889987 - DNA, 23 bp, Homo sapiens
gggcttcattttaattcagctgc

SEQ ID NO: 7889988 - DNA, 22 bp, Homo sapiens
gggcttcagttctgaccatctt

SEQ ID NO: 7889989 - DNA, 22 bp, Homo sapiens
gggcttctagaatttctgatat

SEQ ID NO: 7889990 - DNA, 22 bp, Homo sapiens
gggcttctagaatttctgatat

SEQ ID NO: 7889991 - DNA, 22 bp, Homo sapiens
gggcttctattcaagtctgttt

SEQ ID NO: 7889992 - DNA, 22 bp, Homo sapiens
gggcttctagaccagcagtgag

SEQ ID NO: 7889993 - DNA, 22 bp, Homo sapiens
gggcttctattcaagtctgttt

SEQ ID NO: 7889994 - DNA, 22 bp, Homo sapiens
gggcttctattcaagtctgttt

SEQ ID NO: 7889995 - DNA, 22 bp, Homo sapiens
gggcttcaaaattggcactctt

SEQ ID NO: 7889996 - DNA, 22 bp, Homo sapiens
gggctgtttgcatatgtttata

SEQ ID NO: 7889997 - DNA, 22 bp, Homo sapiens
gggctgtttgcatatgtttata

SEQ ID NO: 7889998 - DNA, 22 bp, Homo sapiens
gggcttaaggccagtgtgcttt

SEQ ID NO: 7889999 - DNA, 22 bp, Homo sapiens
gggcttcaaaattggcactctt

SEQ ID NO: 7890000 - DNA, 22 bp, Homo sapiens
gggcttcaggagggtcagccca

SEQ ID NO: 7890001 - DNA, 22 bp, Homo sapiens
gggcttcagatccagggacctc

SEQ ID NO: 7890002 - DNA, 22 bp, Homo sapiens
gggcttcagggtacttcctcct

SEQ ID NO: 7890003 - DNA, 22 bp, Homo sapiens
gggctctgggattcagagcaag

SEQ ID NO: 7890004 - DNA, 22 bp, Homo sapiens
gggctctgggattcagagcaag

SEQ ID NO: 7890005 - DNA, 22 bp, Homo sapiens
gggctctgggattcagagcaag

SEQ ID NO: 7890006 - DNA, 22 bp, Homo sapiens
gggctctggggtcagacagcct

SEQ ID NO: 7890007 - DNA, 22 bp, Homo sapiens
gggctctggggtcagacagcct

SEQ ID NO: 7890008 - DNA, 22 bp, Homo sapiens
gggctctggggtcagacagcct

SEQ ID NO: 7890009 - DNA, 22 bp, Homo sapiens
gggctctggggaggacccttca

SEQ ID NO: 7890010 - DNA, 22 bp, Homo sapiens
gggctctggggaggacccttca

SEQ ID NO: 7890011 - DNA, 22 bp, Homo sapiens
gggctctgggattcagagcaag

SEQ ID NO: 7890012 - DNA, 22 bp, Homo sapiens
gggctctgggattcagagcaag

SEQ ID NO: 7890013 - DNA, 22 bp, Homo sapiens
gggctctgggattcagagcaag

SEQ ID NO: 7890014 - DNA, 22 bp, Homo sapiens
gggctctgggattcagagcaag

SEQ ID NO: 7890015 - DNA, 22 bp, Homo sapiens
gggctctgggattcagagcaag

SEQ ID NO: 7890016 - DNA, 22 bp, Homo sapiens
gggctctgggatgctcttagag

SEQ ID NO: 7890017 - DNA, 22 bp, Homo sapiens
gggctctgggatgctcttagag

SEQ ID NO: 7890018 - DNA, 18 bp, Homo sapiens
gggctctggcatctgggt

SEQ ID NO: 7890019 - DNA, 18 bp, Homo sapiens
gggctctggcatctgggt

SEQ ID NO: 7890020 - DNA, 19 bp, Homo sapiens
gggctctggcctcagtggg

SEQ ID NO: 7890021 - DNA, 19 bp, Homo sapiens
gggctctggcctcagtggg

SEQ ID NO: 7890022 - DNA, 19 bp, Homo sapiens
gggctctggcctcagtggg

SEQ ID NO: 7890023 - DNA, 19 bp, Homo sapiens
gggctctggcctcagtggg

SEQ ID NO: 7890024 - DNA, 20 bp, Homo sapiens
gggctctggccaatgctttg

SEQ ID NO: 7890025 - DNA, 19 bp, Homo sapiens
gggctctggcctcagtggg

SEQ ID NO: 7890026 - DNA, 19 bp, Homo sapiens
gggctctggcctcagtggg

SEQ ID NO: 7890027 - DNA, 19 bp, Homo sapiens
gggctctggcctcagtggg

SEQ ID NO: 7890028 - DNA, 19 bp, Homo sapiens
gggctctggcctcagtggg

SEQ ID NO: 7890029 - DNA, 22 bp, Homo sapiens
gggctctgggatgctcttagag

SEQ ID NO: 7890030 - DNA, 22 bp, Homo sapiens
gggctggtgaggctgccctgca

SEQ ID NO: 7890031 - DNA, 22 bp, Homo sapiens
gggctggtgaggctgccctgca

SEQ ID NO: 7890032 - DNA, 22 bp, Homo sapiens
gggctggtgaggctgccctgca

SEQ ID NO: 7890033 - DNA, 22 bp, Homo sapiens
gggctggtgaggctgccctgca

SEQ ID NO: 7890034 - DNA, 22 bp, Homo sapiens
gggctggtgaggctgccctgca

SEQ ID NO: 7890035 - DNA, 22 bp, Homo sapiens
gggctggtgaggctgccctgca

SEQ ID NO: 7890036 - DNA, 22 bp, Homo sapiens
gggctggtctggcttagtcagg

SEQ ID NO: 7890037 - DNA, 16 bp, Homo sapiens
gggctgggggattctg

SEQ ID NO: 7890038 - DNA, 18 bp, Homo sapiens
gggctgtgttcatgccca

SEQ ID NO: 7890039 - DNA, 22 bp, Homo sapiens
gggctgtgttaggtgcggttac

SEQ ID NO: 7890040 - DNA, 22 bp, Homo sapiens
gggctgtgtgcccacttcccat

SEQ ID NO: 7890041 - DNA, 16 bp, Homo sapiens
gggctgggggattctg

SEQ ID NO: 7890042 - DNA, 22 bp, Homo sapiens
gggctggtctggcttagtcagg

SEQ ID NO: 7890043 - DNA, 16 bp, Homo sapiens
gggctgggggattctg

SEQ ID NO: 7890044 - DNA, 16 bp, Homo sapiens
gggctgggggattctg

SEQ ID NO: 7890045 - DNA, 22 bp, Homo sapiens
gggctctggggtgccctggcat

SEQ ID NO: 7890046 - DNA, 22 bp, Homo sapiens
gggctctggggtgccctggcat

SEQ ID NO: 7890047 - DNA, 22 bp, Homo sapiens
gggctctggggtgccctggcat

SEQ ID NO: 7890048 - DNA, 22 bp, Homo sapiens
gggctctggggtgccctggcat

SEQ ID NO: 7890049 - DNA, 22 bp, Homo sapiens
gggctctggggtcagacagcct

SEQ ID NO: 7890050 - DNA, 22 bp, Homo sapiens
gggctctggggtgccctggcat

SEQ ID NO: 7890051 - DNA, 22 bp, Homo sapiens
gtcagagatggcatgaaagatt

SEQ ID NO: 7890052 - DNA, 21 bp, Homo sapiens
gtcagagatgcccaactgcct

SEQ ID NO: 7890053 - DNA, 22 bp, Homo sapiens
gtcagagatggcatgaaagatt

SEQ ID NO: 7890054 - DNA, 22 bp, Homo sapiens
gtcagagacaaacttcctctct

SEQ ID NO: 7890055 - DNA, 22 bp, Homo sapiens
gtcagagaactggattttccaa

SEQ ID NO: 7890056 - DNA, 22 bp, Homo sapiens
gtcagaggaggctgagtaggaa

SEQ ID NO: 7890057 - DNA, 20 bp, Homo sapiens
gtcagaggaccctagagcga

SEQ ID NO: 7890058 - DNA, 22 bp, Homo sapiens
gtcagaggaatggatgagtgat

SEQ ID NO: 7890059 - DNA, 22 bp, Homo sapiens
gtccagaaggaggtcaagttgg

SEQ ID NO: 7890060 - DNA, 22 bp, Homo sapiens
gtccagaaggaggtcaagttgg

SEQ ID NO: 7890061 - DNA, 22 bp, Homo sapiens
gtccagaagctcaagttgaact

SEQ ID NO: 7890062 - DNA, 22 bp, Homo sapiens
gtccagaaggaggtcaagttgg

SEQ ID NO: 7890063 - DNA, 22 bp, Homo sapiens
gtccagaattactactgtttga

SEQ ID NO: 7890064 - DNA, 22 bp, Homo sapiens
gtcagaggaggctgagtaggaa

SEQ ID NO: 7890065 - DNA, 22 bp, Homo sapiens
gtccagaagctcaagttgaact

SEQ ID NO: 7890066 - DNA, 22 bp, Homo sapiens
gtcagaggaggctgagtaggaa

SEQ ID NO: 7890067 - DNA, 22 bp, Homo sapiens
gtccagagagatcttctgatag

SEQ ID NO: 7890068 - DNA, 21 bp, Homo sapiens
gtccagagagccggctcctga

SEQ ID NO: 7890069 - DNA, 21 bp, Homo sapiens
gtccagagagccggctcctga

SEQ ID NO: 7890070 - DNA, 22 bp, Homo sapiens
gtccagagagatcttctgatag

SEQ ID NO: 7890071 - DNA, 22 bp, Homo sapiens
gtccagagaagggaggggactc

SEQ ID NO: 7890072 - DNA, 22 bp, Homo sapiens
gtccagaattactactgtttga

SEQ ID NO: 7890073 - DNA, 22 bp, Homo sapiens
gtccagccctctgcctccaggt

SEQ ID NO: 7890074 - DNA, 22 bp, Homo sapiens
gtccagccctctgcctccaggt

SEQ ID NO: 7890075 - DNA, 22 bp, Homo sapiens
gtccagccctctgcctccaggt

SEQ ID NO: 7890076 - DNA, 22 bp, Homo sapiens
gtccagcccgggctccgccagc

SEQ ID NO: 7890077 - DNA, 22 bp, Homo sapiens
gtccagcccgggctccgccagc

SEQ ID NO: 7890078 - DNA, 22 bp, Homo sapiens
gtccagccctctgcctccaggt

SEQ ID NO: 7890079 - DNA, 22 bp, Homo sapiens
gtccagccctctgcctccaggt

SEQ ID NO: 7890080 - DNA, 22 bp, Homo sapiens
gtccagcccctgactcccaggc

SEQ ID NO: 7890081 - DNA, 22 bp, Homo sapiens
gtccagcccctgactcccaggc

SEQ ID NO: 7890082 - DNA, 22 bp, Homo sapiens
gtccagcccctgactcccaggc

SEQ ID NO: 7890083 - DNA, 22 bp, Homo sapiens
gtccagccaggctgcagcaccc

SEQ ID NO: 7890084 - DNA, 22 bp, Homo sapiens
gtccagccaggcctgtctctgg

SEQ ID NO: 7890085 - DNA, 22 bp, Homo sapiens
gtccagcctgaagagtgggggc

SEQ ID NO: 7890086 - DNA, 19 bp, Homo sapiens
gtccagcctttgggtctta

SEQ ID NO: 7890087 - DNA, 22 bp, Homo sapiens
gtccagcctgaagagtgggggc

SEQ ID NO: 7890088 - DNA, 22 bp, Homo sapiens
gtccagcccttgcagcttcttt

SEQ ID NO: 7890089 - DNA, 22 bp, Homo sapiens
gtccagctccagggaggcaggc

SEQ ID NO: 7890090 - DNA, 22 bp, Homo sapiens
gtccagctgcagctgggcagaa

SEQ ID NO: 7890091 - DNA, 22 bp, Homo sapiens
gtccagctgcagctgggcagaa

SEQ ID NO: 7890092 - DNA, 22 bp, Homo sapiens
gtccagctctgagaagaaacat

SEQ ID NO: 7890093 - DNA, 22 bp, Homo sapiens
gtccagctctcagatggctgca

SEQ ID NO: 7890094 - DNA, 22 bp, Homo sapiens
gtccagctgatcttgacccagc

SEQ ID NO: 7890095 - DNA, 22 bp, Homo sapiens
gtcagaagcatttgtggctgaa

SEQ ID NO: 7890096 - DNA, 22 bp, Homo sapiens
gtcagaaaccagtcaaacaaga

SEQ ID NO: 7890097 - DNA, 22 bp, Homo sapiens
gtcagaagcatttgtggctgaa

SEQ ID NO: 7890098 - DNA, 22 bp, Homo sapiens
gtcagaagcatttgtggctgaa

SEQ ID NO: 7890099 - DNA, 22 bp, Homo sapiens
gtcagaatttacttaatagcca

SEQ ID NO: 7890100 - DNA, 22 bp, Homo sapiens
gtcagacacatttctttcagtg

SEQ ID NO: 7890101 - DNA, 22 bp, Homo sapiens
gtcagacacatttctttcagtg

SEQ ID NO: 7890102 - DNA, 22 bp, Homo sapiens
gtcagagaactggattttccaa

SEQ ID NO: 7890103 - DNA, 17 bp, Homo sapiens
gtcactttgtttaaagg

SEQ ID NO: 7890104 - DNA, 22 bp, Homo sapiens
gtcactttctgtgagatgtagt

SEQ ID NO: 7890105 - DNA, 22 bp, Homo sapiens
gtcactttggcctctacagcca

SEQ ID NO: 7890106 - DNA, 22 bp, Homo sapiens
gtcacttttaagggccttttct

SEQ ID NO: 7890107 - DNA, 22 bp, Homo sapiens
gtcagaaaaagcaaggctgggc

SEQ ID NO: 7890108 - DNA, 22 bp, Homo sapiens
gtcagaaaaagcaaggctgggc

SEQ ID NO: 7890109 - DNA, 22 bp, Homo sapiens
gtcagaaaaagcaaggctgggc

SEQ ID NO: 7890110 - DNA, 18 bp, Homo sapiens
gtcactgtgtttctgagc

SEQ ID NO: 7890111 - DNA, 17 bp, Homo sapiens
gtcactgtctaatgaag

SEQ ID NO: 7890112 - DNA, 17 bp, Homo sapiens
gtcactgtctaatgaag

SEQ ID NO: 7890113 - DNA, 22 bp, Homo sapiens
gtcactgtttcctattatattt

SEQ ID NO: 7890114 - DNA, 22 bp, Homo sapiens
gtcactgtttcctattatattt

SEQ ID NO: 7890115 - DNA, 22 bp, Homo sapiens
gtcacttaccagagtattttat

SEQ ID NO: 7890116 - DNA, 22 bp, Homo sapiens
gtcacttgagcatttcttcttt

SEQ ID NO: 7890117 - DNA, 22 bp, Homo sapiens
gtcacttgagcatttcttcttt

SEQ ID NO: 7890118 - DNA, 22 bp, Homo sapiens
gtcactttaaagggttaacagg

SEQ ID NO: 7890119 - DNA, 22 bp, Homo sapiens
gtcactttacactcctactaaa

SEQ ID NO: 7890120 - DNA, 22 bp, Homo sapiens
gtcactttcacactttattgct

SEQ ID NO: 7890121 - DNA, 22 bp, Homo sapiens
gtcactttctgtgagatgtagt

SEQ ID NO: 7890122 - DNA, 22 bp, Homo sapiens
gtcactttgaagctgtttttag

SEQ ID NO: 7890123 - DNA, 22 bp, Homo sapiens
gtcactttgaagctgtttttag

SEQ ID NO: 7890124 - DNA, 22 bp, Homo sapiens
gtcactttattaattttggtga

SEQ ID NO: 7890125 - DNA, 22 bp, Homo sapiens
gtcactttcacactttattgct

SEQ ID NO: 7890126 - DNA, 22 bp, Homo sapiens
gtcactttacactcctactaaa

SEQ ID NO: 7890127 - DNA, 22 bp, Homo sapiens
gtcactttattaattttggtga

SEQ ID NO: 7890128 - DNA, 22 bp, Homo sapiens
gtcactgtatccaggttccagc

SEQ ID NO: 7890129 - DNA, 22 bp, Homo sapiens
gtcactgtatccaggttccagc

SEQ ID NO: 7890130 - DNA, 17 bp, Homo sapiens
gtcactgtctaatgaag

SEQ ID NO: 7890131 - DNA, 22 bp, Homo sapiens
gtcactgtatccaggttccagc

SEQ ID NO: 7890132 - DNA, 22 bp, Homo sapiens
gtcactgtatccaggttccagc

SEQ ID NO: 7890133 - DNA, 22 bp, Homo sapiens
gtcactgtatccaggttccagc

SEQ ID NO: 7890134 - DNA, 22 bp, Homo sapiens
gtcactgtatccaggttccagc

SEQ ID NO: 7890135 - DNA, 22 bp, Homo sapiens
gtcactggaattacaggcatgc

SEQ ID NO: 7890136 - DNA, 22 bp, Homo sapiens
gtcactgcctcttaactttttc

SEQ ID NO: 7890137 - DNA, 22 bp, Homo sapiens
gtcactggggccacatgcagaa

SEQ ID NO: 7890138 - DNA, 22 bp, Homo sapiens
gtcactggggccacatgcagaa

SEQ ID NO: 7890139 - DNA, 22 bp, Homo sapiens
gtcactggaattacaggcatgc

SEQ ID NO: 7890140 - DNA, 22 bp, Homo sapiens
gtcactggagctcttgcggttc

SEQ ID NO: 7890141 - DNA, 22 bp, Homo sapiens
gtcacccactccctgctgctgt

SEQ ID NO: 7890142 - DNA, 22 bp, Homo sapiens
gtcacccgtttgactatccacc

SEQ ID NO: 7890143 - DNA, 22 bp, Homo sapiens
gtcaccctgctgtttgtccatt

SEQ ID NO: 7890144 - DNA, 22 bp, Homo sapiens
gtcacctgaggggaggtgacag

SEQ ID NO: 7890145 - DNA, 22 bp, Homo sapiens
gtcactatcctgtgttgtttgt

SEQ ID NO: 7890146 - DNA, 18 bp, Homo sapiens
gtcactagttcaaacttc

SEQ ID NO: 7890147 - DNA, 22 bp, Homo sapiens
gtcacctgttccagttgcggtc

SEQ ID NO: 7890148 - DNA, 22 bp, Homo sapiens
gtcctggctggttctgtggggc

SEQ ID NO: 7890149 - DNA, 22 bp, Homo sapiens
gtcctggctggttctgtggggc

SEQ ID NO: 7890150 - DNA, 22 bp, Homo sapiens
gtcctggctggttctgtggggc

SEQ ID NO: 7890151 - DNA, 22 bp, Homo sapiens
gtcctggctagtcgtccgcgac

SEQ ID NO: 7890152 - DNA, 22 bp, Homo sapiens
gtcctggctagtcgtccgcgac

SEQ ID NO: 7890153 - DNA, 22 bp, Homo sapiens
gtcctggctagtcgtccgcgac

SEQ ID NO: 7890154 - DNA, 22 bp, Homo sapiens
gtcctggcctctgggggtatgg

SEQ ID NO: 7890155 - DNA, 19 bp, Homo sapiens
gtcctggcgccgccacacc

SEQ ID NO: 7890156 - DNA, 22 bp, Homo sapiens
gtcctggcccaggagtacacat

SEQ ID NO: 7890157 - DNA, 22 bp, Homo sapiens
gtcctggcccaggagtacacat

SEQ ID NO: 7890158 - DNA, 22 bp, Homo sapiens
gtcctggcccaggagtacacat

SEQ ID NO: 7890159 - DNA, 22 bp, Homo sapiens
gtcctggcccactggcaggctg

SEQ ID NO: 7890160 - DNA, 22 bp, Homo sapiens
gtcctggcccactggcaggctg

SEQ ID NO: 7890161 - DNA, 22 bp, Homo sapiens
gtcctggcacctcactggctac

SEQ ID NO: 7890162 - DNA, 22 bp, Homo sapiens
gtcctggcttagttcgctgtaa

SEQ ID NO: 7890163 - DNA, 22 bp, Homo sapiens
gtcctgggaactggacagctaa

SEQ ID NO: 7890164 - DNA, 22 bp, Homo sapiens
gtcctggcttagttcgctgtaa

SEQ ID NO: 7890165 - DNA, 22 bp, Homo sapiens
gtcctggcttagttcgctgtaa

SEQ ID NO: 7890166 - DNA, 22 bp, Homo sapiens
gtcctgggaactggacagctaa

SEQ ID NO: 7890167 - DNA, 22 bp, Homo sapiens
gtctaaacaaaaatgcaccttt

SEQ ID NO: 7890168 - DNA, 22 bp, Homo sapiens
gtctaaacacaatgcaagaagt

SEQ ID NO: 7890169 - DNA, 22 bp, Homo sapiens
gtctaaacacagccttttctgt

SEQ ID NO: 7890170 - DNA, 22 bp, Homo sapiens
gtctaaacacagccttttctgt

SEQ ID NO: 7890171 - DNA, 22 bp, Homo sapiens
gtcgtggtcagacaccagaaaa

SEQ ID NO: 7890172 - DNA, 20 bp, Homo sapiens
gtcggctctacccagactgt

SEQ ID NO: 7890173 - DNA, 22 bp, Homo sapiens
gtcgtggagctcacagtgtgcc

SEQ ID NO: 7890174 - DNA, 22 bp, Homo sapiens
gtcctggagtggcatggcatgg

SEQ ID NO: 7890175 - DNA, 22 bp, Homo sapiens
gtcctggaatcctagaacagtg

SEQ ID NO: 7890176 - DNA, 22 bp, Homo sapiens
gtcctgcttgttaggcctagtc

SEQ ID NO: 7890177 - DNA, 22 bp, Homo sapiens
gtcctgcacatggagggcaatg

SEQ ID NO: 7890178 - DNA, 22 bp, Homo sapiens
gtcctgcacatggagggcaatg

SEQ ID NO: 7890179 - DNA, 22 bp, Homo sapiens
gtcctctgtgtaggctgcagac

SEQ ID NO: 7890180 - DNA, 22 bp, Homo sapiens
gtcctgctggcttcaggagatt

SEQ ID NO: 7890181 - DNA, 22 bp, Homo sapiens
gtcctgcttcccacagaaaccg

SEQ ID NO: 7890182 - DNA, 22 bp, Homo sapiens
gtcctctgggctttgagcagtc

SEQ ID NO: 7890183 - DNA, 22 bp, Homo sapiens
gtcctgctctggcccaggtttg

SEQ ID NO: 7890184 - DNA, 22 bp, Homo sapiens
gtcctctgggctttgagcagtc

SEQ ID NO: 7890185 - DNA, 22 bp, Homo sapiens
gtcctctggtgaaagcattccc

SEQ ID NO: 7890186 - DNA, 22 bp, Homo sapiens
gtcctctggtgaaagcattccc

SEQ ID NO: 7890187 - DNA, 22 bp, Homo sapiens
gtcctctgggctttgagcagtc

SEQ ID NO: 7890188 - DNA, 22 bp, Homo sapiens
gtcctctgggctttgagcagtc

SEQ ID NO: 7890189 - DNA, 22 bp, Homo sapiens
gtcctctgggctttgagcagtc

SEQ ID NO: 7890190 - DNA, 22 bp, Homo sapiens
gtcctctgtccctggggcacgg

SEQ ID NO: 7890191 - DNA, 22 bp, Homo sapiens
gtcctctgtccctggggcacgg

SEQ ID NO: 7890192 - DNA, 22 bp, Homo sapiens
gtcctctgtccctggggcacgg

SEQ ID NO: 7890193 - DNA, 22 bp, Homo sapiens
gtcctctgtccctggggcacgg

SEQ ID NO: 7890194 - DNA, 22 bp, Homo sapiens
gtcctctgtagggctgggccac

SEQ ID NO: 7890195 - DNA, 20 bp, Homo sapiens
gtccaggacccagcaggagg

SEQ ID NO: 7890196 - DNA, 20 bp, Homo sapiens
gtccaggacccagcaggagg

SEQ ID NO: 7890197 - DNA, 20 bp, Homo sapiens
gtccaggacccagcaggagg

SEQ ID NO: 7890198 - DNA, 20 bp, Homo sapiens
gtccaggacccagcaggagg

SEQ ID NO: 7890199 - DNA, 22 bp, Homo sapiens
gtccaggagctcagggcttatt

SEQ ID NO: 7890200 - DNA, 22 bp, Homo sapiens
gtccaggaatcaaaagatggaa

SEQ ID NO: 7890201 - DNA, 22 bp, Homo sapiens
gtccaggaagcaataaatagaa

SEQ ID NO: 7890202 - DNA, 20 bp, Homo sapiens
gtccaggacccagcaggagg

SEQ ID NO: 7890203 - DNA, 22 bp, Homo sapiens
gtccaggaatcaaaagatggaa

SEQ ID NO: 7890204 - DNA, 22 bp, Homo sapiens
gtccaggagctcagggcttatt

SEQ ID NO: 7890205 - DNA, 22 bp, Homo sapiens
gtccaggagtttccaattaagc

SEQ ID NO: 7890206 - DNA, 19 bp, Homo sapiens
gtccaggcattgggttggt

SEQ ID NO: 7890207 - DNA, 22 bp, Homo sapiens
gtccaggccatggtggacacag

SEQ ID NO: 7890208 - DNA, 19 bp, Homo sapiens
gtccaggcattgggttggt

SEQ ID NO: 7890209 - DNA, 22 bp, Homo sapiens
gtccaggctcaaaaggttgtta

SEQ ID NO: 7890210 - DNA, 22 bp, Homo sapiens
gtccaggctcaaaaggttgtta

SEQ ID NO: 7890211 - DNA, 22 bp, Homo sapiens
gtccaggctcaaaaggttgtta

SEQ ID NO: 7890212 - DNA, 22 bp, Homo sapiens
gtccaggctgacccctagagga

SEQ ID NO: 7890213 - DNA, 22 bp, Homo sapiens
gtccaggctgacccctagagga

SEQ ID NO: 7890214 - DNA, 22 bp, Homo sapiens
gtccaggctgacccctagagga

SEQ ID NO: 7890215 - DNA, 22 bp, Homo sapiens
gtccaggcctgcctctgaggag

SEQ ID NO: 7890216 - DNA, 22 bp, Homo sapiens
gtccaggctaagtcccttctgc

SEQ ID NO: 7890217 - DNA, 22 bp, Homo sapiens
gtccaggccatggtggacacag

SEQ ID NO: 7890218 - DNA, 22 bp, Homo sapiens
gtccaggccatggtggacacag

SEQ ID NO: 7890219 - DNA, 22 bp, Homo sapiens
gtccaggccccagggattcttg

SEQ ID NO: 7890220 - DNA, 22 bp, Homo sapiens
gtccaggccatggtggacacag

SEQ ID NO: 7890221 - DNA, 22 bp, Homo sapiens
gtccaggccccagggattcttg

SEQ ID NO: 7890222 - DNA, 22 bp, Homo sapiens
gtccaggcctgcctctgaggag

SEQ ID NO: 7890223 - DNA, 22 bp, Homo sapiens
gtccaggcctgcctctgaggag

SEQ ID NO: 7890224 - DNA, 23 bp, Homo sapiens
gtcctctggagagaaaggcagta

SEQ ID NO: 7890225 - DNA, 23 bp, Homo sapiens
gtcctctggagagaaaggcagta

SEQ ID NO: 7890226 - DNA, 22 bp, Homo sapiens
gtcctctggaggtttttaggtg

SEQ ID NO: 7890227 - DNA, 22 bp, Homo sapiens
gtcctctggaggtttttaggtg

SEQ ID NO: 7890228 - DNA, 22 bp, Homo sapiens
gtcctctggaggtttttaggtg

SEQ ID NO: 7890229 - DNA, 22 bp, Homo sapiens
gtcctctggcctttcccaggac

SEQ ID NO: 7890230 - DNA, 22 bp, Homo sapiens
gtcctctggcctttcccaggac

SEQ ID NO: 7890231 - DNA, 22 bp, Homo sapiens
gtcctctggcctttcccaggac

SEQ ID NO: 7890232 - DNA, 22 bp, Homo sapiens
gtcctctgggcagctgccccac

SEQ ID NO: 7890233 - DNA, 22 bp, Homo sapiens
gtcctctgggcagctgccccac

SEQ ID NO: 7890234 - DNA, 22 bp, Homo sapiens
gtcctctgggcagctgccccac

SEQ ID NO: 7890235 - DNA, 22 bp, Homo sapiens
gtcctctgggagccttgagcct

SEQ ID NO: 7890236 - DNA, 22 bp, Homo sapiens
gtcctctgggagccttgagcct

SEQ ID NO: 7890237 - DNA, 22 bp, Homo sapiens
gtccagggaaatagcgacaggg

SEQ ID NO: 7890238 - DNA, 22 bp, Homo sapiens
gtcctctgcttcatgccctgat

SEQ ID NO: 7890239 - DNA, 22 bp, Homo sapiens
gtccaggctgcccagggtcctg

SEQ ID NO: 7890240 - DNA, 22 bp, Homo sapiens
gtccagggaaatagcgacaggg

SEQ ID NO: 7890241 - DNA, 22 bp, Homo sapiens
gtcctctgcttcatgccctgat

SEQ ID NO: 7890242 - DNA, 22 bp, Homo sapiens
gtcctctgcttcatgccctgat

SEQ ID NO: 7890243 - DNA, 22 bp, Homo sapiens
gtcctctggaagatgagttctt

SEQ ID NO: 7890244 - DNA, 23 bp, Homo sapiens
gtcctctggagagaaaggcagta

SEQ ID NO: 7890245 - DNA, 22 bp, Homo sapiens
gtcctctggaagatgagttctt

SEQ ID NO: 7890246 - DNA, 22 bp, Homo sapiens
gtccaggctgacccctagagga

SEQ ID NO: 7890247 - DNA, 22 bp, Homo sapiens
gtccaggctgacccctagagga

SEQ ID NO: 7890248 - DNA, 22 bp, Homo sapiens
gtccaggctgacccctagagga

SEQ ID NO: 7890249 - DNA, 22 bp, Homo sapiens
gtccaggctgacccctagagga

SEQ ID NO: 7890250 - DNA, 22 bp, Homo sapiens
gtccaggctgcccagggtcctg

SEQ ID NO: 7890251 - DNA, 22 bp, Homo sapiens
gtccaggctgcccagggtcctg

SEQ ID NO: 7890252 - DNA, 22 bp, Homo sapiens
gtccaggctgcccagggtcctg

SEQ ID NO: 7890253 - DNA, 22 bp, Homo sapiens
gtccaggctgacccctagagga

SEQ ID NO: 7890254 - DNA, 22 bp, Homo sapiens
gtccaggctgcccagggtcctg

SEQ ID NO: 7890255 - DNA, 22 bp, Homo sapiens
gtagtataaatgggaaatacat

SEQ ID NO: 7890256 - DNA, 22 bp, Homo sapiens
gtagtacatgaagcacttggca

SEQ ID NO: 7890257 - DNA, 22 bp, Homo sapiens
gtagtcccagctaccccggagg

SEQ ID NO: 7890258 - DNA, 22 bp, Homo sapiens
gtagtcccagctaccccggagg

SEQ ID NO: 7890259 - DNA, 22 bp, Homo sapiens
gtagtcccagctaccccggagg

SEQ ID NO: 7890260 - DNA, 22 bp, Homo sapiens
gtagtccaaagctggcatgatg

SEQ ID NO: 7890261 - DNA, 22 bp, Homo sapiens
gtagtctgaacagtaattttgt

SEQ ID NO: 7890262 - DNA, 22 bp, Homo sapiens
gtagtctgaacagtaattttgt

SEQ ID NO: 7890263 - DNA, 22 bp, Homo sapiens
gtagtctgagcaagcagtgtgt

SEQ ID NO: 7890264 - DNA, 22 bp, Homo sapiens
gtagtctgaacagtaattttgt

SEQ ID NO: 7890265 - DNA, 22 bp, Homo sapiens
gtagtggagtctcctgtcctgg

SEQ ID NO: 7890266 - DNA, 22 bp, Homo sapiens
gtagtctgaacagtaattttgt

SEQ ID NO: 7890267 - DNA, 22 bp, Homo sapiens
gtagtgcgcatggcctgtttgt

SEQ ID NO: 7890268 - DNA, 22 bp, Homo sapiens
gtaggtcagacataagaggaca

SEQ ID NO: 7890269 - DNA, 22 bp, Homo sapiens
gtaggtcagacataagaggaca

SEQ ID NO: 7890270 - DNA, 22 bp, Homo sapiens
gtaggtatagattctctgagga

SEQ ID NO: 7890271 - DNA, 22 bp, Homo sapiens
gtaggggtgctgagatctggaa

SEQ ID NO: 7890272 - DNA, 22 bp, Homo sapiens
gtagggttggagagcacaacca

SEQ ID NO: 7890273 - DNA, 22 bp, Homo sapiens
gtaggtcagacataagaggaca

SEQ ID NO: 7890274 - DNA, 22 bp, Homo sapiens
gtaggtcagacataagaggaca

SEQ ID NO: 7890275 - DNA, 22 bp, Homo sapiens
gtagtaaagcaggttttgctgt

SEQ ID NO: 7890276 - DNA, 19 bp, Homo sapiens
gtagtacaattaggacaat

SEQ ID NO: 7890277 - DNA, 22 bp, Homo sapiens
gtagtacagtgagacaatgttt

SEQ ID NO: 7890278 - DNA, 22 bp, Homo sapiens
gtagtacagtgagacaatgttt

SEQ ID NO: 7890279 - DNA, 22 bp, Homo sapiens
gtagtacatcgttatgtaatat

SEQ ID NO: 7890280 - DNA, 22 bp, Homo sapiens
gtagtacatgaagcacttggca

SEQ ID NO: 7890281 - DNA, 22 bp, Homo sapiens
gtaggtgagtgatgctcagatt

SEQ ID NO: 7890282 - DNA, 22 bp, Homo sapiens
gtaggtgagtgatgctcagatt

SEQ ID NO: 7890283 - DNA, 22 bp, Homo sapiens
gtagggttggagagcacaacca

SEQ ID NO: 7890284 - DNA, 22 bp, Homo sapiens
gtaggggtcaggtagggactct

SEQ ID NO: 7890285 - DNA, 22 bp, Homo sapiens
gtagggctcagtaaatactttg

SEQ ID NO: 7890286 - DNA, 22 bp, Homo sapiens
gtagggctcagtaaatactttg

SEQ ID NO: 7890287 - DNA, 22 bp, Homo sapiens
gtaggggatggttccctagaaa

SEQ ID NO: 7890288 - DNA, 22 bp, Homo sapiens
gtagggctcagtaaatactttg

SEQ ID NO: 7890289 - DNA, 22 bp, Homo sapiens
gtaggcagaataattcctcctt

SEQ ID NO: 7890290 - DNA, 22 bp, Homo sapiens
gtaggcagaccagtggatgggt

SEQ ID NO: 7890291 - DNA, 22 bp, Homo sapiens
gtaggcagaccagtggatgggt

SEQ ID NO: 7890292 - DNA, 22 bp, Homo sapiens
gtagggcatagagatgttggca

SEQ ID NO: 7890293 - DNA, 22 bp, Homo sapiens
gtaggcagataggagtgcagcc

SEQ ID NO: 7890294 - DNA, 22 bp, Homo sapiens
gtaggcagataggagtgcagcc

SEQ ID NO: 7890295 - DNA, 22 bp, Homo sapiens
gtaggagcattgagggtatgga

SEQ ID NO: 7890296 - DNA, 22 bp, Homo sapiens
gtaggagctcatggggccagga

SEQ ID NO: 7890297 - DNA, 22 bp, Homo sapiens
gtaggcaaattatggaacattg

SEQ ID NO: 7890298 - DNA, 22 bp, Homo sapiens
gtaggcaaattatggaacattg

SEQ ID NO: 7890299 - DNA, 22 bp, Homo sapiens
gtacaattatttaaatggtgaa

SEQ ID NO: 7890300 - DNA, 22 bp, Homo sapiens
gtacaattatttaaatggtgaa

SEQ ID NO: 7890301 - DNA, 22 bp, Homo sapiens
gtacaattaagtgcacaaatag

SEQ ID NO: 7890302 - DNA, 22 bp, Homo sapiens
gtaggaagctctgaggctagtt

SEQ ID NO: 7890303 - DNA, 22 bp, Homo sapiens
gtacaattcctgtcaagctggc

SEQ ID NO: 7890304 - DNA, 22 bp, Homo sapiens
gtacaattaagtgcacaaatag

SEQ ID NO: 7890305 - DNA, 22 bp, Homo sapiens
gtacaattaagtgcacaaatag

SEQ ID NO: 7890306 - DNA, 22 bp, Homo sapiens
gtacaatagtccctgtttggat

SEQ ID NO: 7890307 - DNA, 22 bp, Homo sapiens
gtacaataactagtcttatagt

SEQ ID NO: 7890308 - DNA, 22 bp, Homo sapiens
gtacaatagcagttttcccttt

SEQ ID NO: 7890309 - DNA, 22 bp, Homo sapiens
gtacaagttctactctataaat

SEQ ID NO: 7890310 - DNA, 22 bp, Homo sapiens
gtacaagttctactctataaat

SEQ ID NO: 7890311 - DNA, 22 bp, Homo sapiens
gtacaagttctactctataaat

SEQ ID NO: 7890312 - DNA, 22 bp, Homo sapiens
gtacaagtgtatttggcttgat

SEQ ID NO: 7890313 - DNA, 22 bp, Homo sapiens
gtacaagtgtgtgtttgagcag

SEQ ID NO: 7890314 - DNA, 22 bp, Homo sapiens
gtacaagtgtgtgtttgagcag

SEQ ID NO: 7890315 - DNA, 22 bp, Homo sapiens
gtacaagtgtatttggcttgat

SEQ ID NO: 7890316 - DNA, 22 bp, Homo sapiens
gtacaataactagtcttatagt

SEQ ID NO: 7890317 - DNA, 22 bp, Homo sapiens
gtacaagttgcctaccttaagt

SEQ ID NO: 7890318 - DNA, 22 bp, Homo sapiens
gtacaataactagtcttatagt

SEQ ID NO: 7890319 - DNA, 22 bp, Homo sapiens
gtacaaggcatttatctgttca

SEQ ID NO: 7890320 - DNA, 22 bp, Homo sapiens
gtacaataactagtcttatagt

SEQ ID NO: 7890321 - DNA, 22 bp, Homo sapiens
gtacaagtgctgtgagggaaaa

SEQ ID NO: 7890322 - DNA, 22 bp, Homo sapiens
gtacaagtaagaaaattgccca

SEQ ID NO: 7890323 - DNA, 22 bp, Homo sapiens
gtacaagtgctgtgagggaaaa

SEQ ID NO: 7890324 - DNA, 22 bp, Homo sapiens
gtacaagaggagaaaatggagt

SEQ ID NO: 7890325 - DNA, 22 bp, Homo sapiens
gtacaagaggagaaaatggagt

SEQ ID NO: 7890326 - DNA, 22 bp, Homo sapiens
gtacaactccccaggcactgct

SEQ ID NO: 7890327 - DNA, 19 bp, Homo sapiens
gtacaagaatgactgagca

SEQ ID NO: 7890328 - DNA, 19 bp, Homo sapiens
gtacaagaatgactgagca

SEQ ID NO: 7890329 - DNA, 22 bp, Homo sapiens
gtacaacttctgtagctacttt

SEQ ID NO: 7890330 - DNA, 22 bp, Homo sapiens
gtacaagaggagaaaatggagt

SEQ ID NO: 7890331 - DNA, 22 bp, Homo sapiens
gtacaacaggattgatgtacca

SEQ ID NO: 7890332 - DNA, 22 bp, Homo sapiens
gtacaacatgattttactctct

SEQ ID NO: 7890333 - DNA, 22 bp, Homo sapiens
gtacaaattttgacatctagga

SEQ ID NO: 7890334 - DNA, 22 bp, Homo sapiens
gtacaaattttgacatctagga

SEQ ID NO: 7890335 - DNA, 22 bp, Homo sapiens
gtacaaattttgacatctagga

SEQ ID NO: 7890336 - DNA, 22 bp, Homo sapiens
gtacaaattttgacatctagga

SEQ ID NO: 7890337 - DNA, 22 bp, Homo sapiens
gtacaacaggattgatgtacca

SEQ ID NO: 7890338 - DNA, 22 bp, Homo sapiens
gtacaaattgatacaggttttc

SEQ ID NO: 7890339 - DNA, 22 bp, Homo sapiens
gtacaaattgatacaggttttc

SEQ ID NO: 7890340 - DNA, 22 bp, Homo sapiens
gtacaaattgatacaggttttc

SEQ ID NO: 7890341 - DNA, 22 bp, Homo sapiens
gtacaaattttgacatctagga

SEQ ID NO: 7890342 - DNA, 22 bp, Homo sapiens
gtacaaattgatacaggttttc

SEQ ID NO: 7890343 - DNA, 22 bp, Homo sapiens
gtacaaattgatacaggttttc

SEQ ID NO: 7890344 - DNA, 22 bp, Homo sapiens
gtacaaattgatacagatttga

SEQ ID NO: 7890345 - DNA, 22 bp, Homo sapiens
gtacaaattgatacaggttttc

SEQ ID NO: 7890346 - DNA, 22 bp, Homo sapiens
gtacaaattgatacagatttga

SEQ ID NO: 7890347 - DNA, 22 bp, Homo sapiens
gtacaaattgatacagatttga

SEQ ID NO: 7890348 - DNA, 22 bp, Homo sapiens
gtacaaattgatacagatttga

SEQ ID NO: 7890349 - DNA, 22 bp, Homo sapiens
gtacaaatgtacacttgtataa

SEQ ID NO: 7890350 - DNA, 22 bp, Homo sapiens
gtacaaattgatacagatttga

SEQ ID NO: 7890351 - DNA, 22 bp, Homo sapiens
gtacaaattgatacagatttga

SEQ ID NO: 7890352 - DNA, 22 bp, Homo sapiens
gtacaaattgatacagatttga

SEQ ID NO: 7890353 - DNA, 22 bp, Homo sapiens
gtacaaaagttattgcggtttt

SEQ ID NO: 7890354 - DNA, 22 bp, Homo sapiens
gtacaaaagttattgcggtttt

SEQ ID NO: 7890355 - DNA, 22 bp, Homo sapiens
gtacaaaagttattgcggtttt

SEQ ID NO: 7890356 - DNA, 22 bp, Homo sapiens
gtacaaaagttattgcggtttt

SEQ ID NO: 7890357 - DNA, 22 bp, Homo sapiens
gtacaaaagttattgcggtttt

SEQ ID NO: 7890358 - DNA, 22 bp, Homo sapiens
gtacaaaagttattgcggtttt

SEQ ID NO: 7890359 - DNA, 22 bp, Homo sapiens
gtacaaatacattctgaaggta

SEQ ID NO: 7890360 - DNA, 22 bp, Homo sapiens
gtacaaatacattctgaaggta

SEQ ID NO: 7890361 - DNA, 22 bp, Homo sapiens
gtacaaatgaaaatagaccact

SEQ ID NO: 7890362 - DNA, 22 bp, Homo sapiens
gtacaaatgaaaatagaccact

SEQ ID NO: 7890363 - DNA, 22 bp, Homo sapiens
gtacaaatgaaaatagaccact

SEQ ID NO: 7890364 - DNA, 22 bp, Homo sapiens
gtacaaatacattctgaaggta

SEQ ID NO: 7890365 - DNA, 22 bp, Homo sapiens
gtacaaagtggacctgatagta

SEQ ID NO: 7890366 - DNA, 22 bp, Homo sapiens
gtacaaagtggacctgatagta

SEQ ID NO: 7890367 - DNA, 22 bp, Homo sapiens
gtacaaaagttattgcggtttt

SEQ ID NO: 7890368 - DNA, 22 bp, Homo sapiens
gtacaaattaggaagctttgtg

SEQ ID NO: 7890369 - DNA, 22 bp, Homo sapiens
gtacaaattaggaagctttgtg

SEQ ID NO: 7890370 - DNA, 22 bp, Homo sapiens
gtacaaattaggaagctttgtg

SEQ ID NO: 7890371 - DNA, 22 bp, Homo sapiens
gtacaaattaggaagctttgtg

SEQ ID NO: 7890372 - DNA, 22 bp, Homo sapiens
gtacaaattaggaagctttgtg

SEQ ID NO: 7890373 - DNA, 22 bp, Homo sapiens
gtacaaatgtacacttgtataa

SEQ ID NO: 7890374 - DNA, 22 bp, Homo sapiens
gtacaaatgtacacttgtataa

SEQ ID NO: 7890375 - DNA, 22 bp, Homo sapiens
gtacaaatgtacacttgtataa

SEQ ID NO: 7890376 - DNA, 22 bp, Homo sapiens
gtacaaatgtacacttgtataa

SEQ ID NO: 7890377 - DNA, 22 bp, Homo sapiens
gtacaaatgtacacttgtataa

SEQ ID NO: 7890378 - DNA, 22 bp, Homo sapiens
gtacaaatgtacacttgtataa

SEQ ID NO: 7890379 - DNA, 22 bp, Homo sapiens
gtacaaatgcaggtttgttaca

SEQ ID NO: 7890380 - DNA, 22 bp, Homo sapiens
gtacaaatgcaggtttgttaca

SEQ ID NO: 7890381 - DNA, 22 bp, Homo sapiens
gtacaaatgcaggtttgttaca

SEQ ID NO: 7890382 - DNA, 22 bp, Homo sapiens
gtacaaatgcaggtttgttaca

SEQ ID NO: 7890383 - DNA, 22 bp, Homo sapiens
gtacaaatgcaggtttgttaca

SEQ ID NO: 7890384 - DNA, 22 bp, Homo sapiens
gtacaaatgcaggtttgttaca

SEQ ID NO: 7890385 - DNA, 22 bp, Homo sapiens
gtacaaatgcaggtttgttaca

SEQ ID NO: 7890386 - DNA, 22 bp, Homo sapiens
gtacaaatgagagttctgtttt

SEQ ID NO: 7890387 - DNA, 22 bp, Homo sapiens
gtacaaatgagagttctgtttt

SEQ ID NO: 7890388 - DNA, 22 bp, Homo sapiens
gtacaaatgagagttctgtttt

SEQ ID NO: 7890389 - DNA, 22 bp, Homo sapiens
gtacaaatgagagttctgtttt

SEQ ID NO: 7890390 - DNA, 22 bp, Homo sapiens
gtacaaatgaaaatagaccact

SEQ ID NO: 7890391 - DNA, 22 bp, Homo sapiens
gtacaaatgagagttctgtttt

SEQ ID NO: 7890392 - DNA, 22 bp, Homo sapiens
gtagtgtgtaggcactgtgctc

SEQ ID NO: 7890393 - DNA, 22 bp, Homo sapiens
gtagttattgctgtttacttct

SEQ ID NO: 7890394 - DNA, 22 bp, Homo sapiens
gtagttttctgaaaattacttt

SEQ ID NO: 7890395 - DNA, 22 bp, Homo sapiens
gtagtttaattcctggcctttc

SEQ ID NO: 7890396 - DNA, 22 bp, Homo sapiens
gtagtttacagaagaggagcaa

SEQ ID NO: 7890397 - DNA, 22 bp, Homo sapiens
gtagttctgcagtgtcacctga

SEQ ID NO: 7890398 - DNA, 22 bp, Homo sapiens
gtagttctttctcaatgttcaa

SEQ ID NO: 7890399 - DNA, 22 bp, Homo sapiens
gtagttctgcagtgtcacctga

SEQ ID NO: 7890400 - DNA, 22 bp, Homo sapiens
gtatacagatacttagacgtgc

SEQ ID NO: 7890401 - DNA, 22 bp, Homo sapiens
gtatacagatacttagacgtgc

SEQ ID NO: 7890402 - DNA, 22 bp, Homo sapiens
gtatacaatacacaatgctctg

SEQ ID NO: 7890403 - DNA, 22 bp, Homo sapiens
gtatacaatacacaatgctctg

SEQ ID NO: 7890404 - DNA, 22 bp, Homo sapiens
gtatacactggtaagatttgtc

SEQ ID NO: 7890405 - DNA, 22 bp, Homo sapiens
gtatacaactattgttgggtaa

SEQ ID NO: 7890406 - DNA, 22 bp, Homo sapiens
gtatacaactattgttgggtaa

SEQ ID NO: 7890407 - DNA, 22 bp, Homo sapiens
gtataaggtatgtaaactattt

SEQ ID NO: 7890408 - DNA, 22 bp, Homo sapiens
gtataaagtataagcttgtttt

SEQ ID NO: 7890409 - DNA, 22 bp, Homo sapiens
gtataaagtataagcttgtttt

SEQ ID NO: 7890410 - DNA, 22 bp, Homo sapiens
gtataaagtataagcttgtttt

SEQ ID NO: 7890411 - DNA, 22 bp, Homo sapiens
gtatacatagatgatgaacaag

SEQ ID NO: 7890412 - DNA, 22 bp, Homo sapiens
gtatacatacttctagattaaa

SEQ ID NO: 7890413 - DNA, 22 bp, Homo sapiens
gtatacatacttctagattaaa

SEQ ID NO: 7890414 - DNA, 22 bp, Homo sapiens
gtatacatagatgatgaacaag

SEQ ID NO: 7890415 - DNA, 22 bp, Homo sapiens
gtatttcctcgcttgtgggatt

SEQ ID NO: 7890416 - DNA, 22 bp, Homo sapiens
gtattttatggcatgcagtggc

SEQ ID NO: 7890417 - DNA, 22 bp, Homo sapiens
gtattttatggcatgcagtggc

SEQ ID NO: 7890418 - DNA, 22 bp, Homo sapiens
gtattttcatgatttcagacca

SEQ ID NO: 7890419 - DNA, 22 bp, Homo sapiens
gtattttatggcctggggccta

SEQ ID NO: 7890420 - DNA, 22 bp, Homo sapiens
gtattttatggcctggggccta

SEQ ID NO: 7890421 - DNA, 22 bp, Homo sapiens
gtattttcaagagcagtagtat

SEQ ID NO: 7890422 - DNA, 22 bp, Homo sapiens
gtatttttaggtaaggaaagta

SEQ ID NO: 7890423 - DNA, 22 bp, Homo sapiens
gtatttttaggtaaggaaagta

SEQ ID NO: 7890424 - DNA, 22 bp, Homo sapiens
gtatttttaggtaaggaaagta

SEQ ID NO: 7890425 - DNA, 22 bp, Homo sapiens
gtattttcaagagcagtagtat

SEQ ID NO: 7890426 - DNA, 22 bp, Homo sapiens
gtatttttaggtaaggaaagta

SEQ ID NO: 7890427 - DNA, 22 bp, Homo sapiens
gtatttttaggtaaggaaagta

SEQ ID NO: 7890428 - DNA, 22 bp, Homo sapiens
gtattttgttagggtgtggtat

SEQ ID NO: 7890429 - DNA, 22 bp, Homo sapiens
gtattttgttagggtgtggtat

SEQ ID NO: 7890430 - DNA, 22 bp, Homo sapiens
gtatttttaggtaaggaaagta

SEQ ID NO: 7890431 - DNA, 22 bp, Homo sapiens
gtatttttaggtaaggaaagta

SEQ ID NO: 7890432 - DNA, 22 bp, Homo sapiens
gtatttttagtagagtcggggt

SEQ ID NO: 7890433 - DNA, 22 bp, Homo sapiens
gtatttttagtagagtcggggt

SEQ ID NO: 7890434 - DNA, 22 bp, Homo sapiens
gtatttttagtagagtcggggt

SEQ ID NO: 7890435 - DNA, 22 bp, Homo sapiens
gtatttttaggtaaggaaagta

SEQ ID NO: 7890436 - DNA, 22 bp, Homo sapiens
gtatttttagtagagtcggggt

SEQ ID NO: 7890437 - DNA, 22 bp, Homo sapiens
gtatttttagtagagtcggggt

SEQ ID NO: 7890438 - DNA, 22 bp, Homo sapiens
gtatttttcagttaggagctta

SEQ ID NO: 7890439 - DNA, 22 bp, Homo sapiens
gtatttttcagttaggagctta

SEQ ID NO: 7890440 - DNA, 22 bp, Homo sapiens
gtatttttagtagagtcggggt

SEQ ID NO: 7890441 - DNA, 22 bp, Homo sapiens
gtatttttcagttaggagctta

SEQ ID NO: 7890442 - DNA, 22 bp, Homo sapiens
gtcaaaacaaagttaagaattc

SEQ ID NO: 7890443 - DNA, 22 bp, Homo sapiens
gtcaaaaagtagtcatttctgt

SEQ ID NO: 7890444 - DNA, 22 bp, Homo sapiens
gtcaaaaagtagtcatttctgt

SEQ ID NO: 7890445 - DNA, 22 bp, Homo sapiens
gtcaaaaagtagtcatttctgt

SEQ ID NO: 7890446 - DNA, 22 bp, Homo sapiens
gtatttttcattccaagtgaga

SEQ ID NO: 7890447 - DNA, 22 bp, Homo sapiens
gtcaaaaagtagtcatttctgt

SEQ ID NO: 7890448 - DNA, 22 bp, Homo sapiens
gtcaaaaagtagtcatttctgt

SEQ ID NO: 7890449 - DNA, 22 bp, Homo sapiens
gtatttttcattccaagtgaga

SEQ ID NO: 7890450 - DNA, 22 bp, Homo sapiens
gtatttttcattccaagtgaga

SEQ ID NO: 7890451 - DNA, 22 bp, Homo sapiens
gtatttttcagttaggagctta

SEQ ID NO: 7890452 - DNA, 22 bp, Homo sapiens
gtatttttcagttaggagctta

SEQ ID NO: 7890453 - DNA, 22 bp, Homo sapiens
gtatttttcagttaggagctta

SEQ ID NO: 7890454 - DNA, 22 bp, Homo sapiens
gtatttttcattccaagtgaga

SEQ ID NO: 7890455 - DNA, 22 bp, Homo sapiens
gtatttttcattccaagtgaga

SEQ ID NO: 7890456 - DNA, 22 bp, Homo sapiens
gtcaaaatgagctttgttattg

SEQ ID NO: 7890457 - DNA, 22 bp, Homo sapiens
gtcaaacagcctcctgttctaa

SEQ ID NO: 7890458 - DNA, 22 bp, Homo sapiens
gtcaaacaaattaacatatcca

SEQ ID NO: 7890459 - DNA, 22 bp, Homo sapiens
gtcaaacagcctcctgttctaa

SEQ ID NO: 7890460 - DNA, 22 bp, Homo sapiens
gtcaaataattttctcaatagt

SEQ ID NO: 7890461 - DNA, 22 bp, Homo sapiens
gtcaaagatcctatgagttaaa

SEQ ID NO: 7890462 - DNA, 22 bp, Homo sapiens
gtcaaataattttctcaatagt

SEQ ID NO: 7890463 - DNA, 22 bp, Homo sapiens
gtcaaagatcctatgagttaaa

SEQ ID NO: 7890464 - DNA, 22 bp, Homo sapiens
gtcacccactccctgctgctgt

SEQ ID NO: 7890465 - DNA, 22 bp, Homo sapiens
gtcaacaaagaaaattgttaat

SEQ ID NO: 7890466 - DNA, 22 bp, Homo sapiens
gtcaaatgcacagaaccattaa

SEQ ID NO: 7890467 - DNA, 22 bp, Homo sapiens
gtcaaatgcacagaaccattaa

SEQ ID NO: 7890468 - DNA, 22 bp, Homo sapiens
gtcaaatgcacagaaccattaa

SEQ ID NO: 7890469 - DNA, 22 bp, Homo sapiens
gtcaaatatatgcaaaactatt

SEQ ID NO: 7890470 - DNA, 22 bp, Homo sapiens
gtcaaatatatgcaaaactatt

SEQ ID NO: 7890471 - DNA, 22 bp, Homo sapiens
gtcaaatattatgcagcttgga

SEQ ID NO: 7890472 - DNA, 22 bp, Homo sapiens
gtcaaatatatgcaaaactatt

SEQ ID NO: 7890473 - DNA, 22 bp, Homo sapiens
gtcaaatatatgcaaaactatt

SEQ ID NO: 7890474 - DNA, 22 bp, Homo sapiens
gtcaaatatactaagaggtaaa

SEQ ID NO: 7890475 - DNA, 22 bp, Homo sapiens
gtcaaatatactaagaggtaaa

SEQ ID NO: 7890476 - DNA, 22 bp, Homo sapiens
gtgagctgttttggacccatct

SEQ ID NO: 7890477 - DNA, 22 bp, Homo sapiens
gtgagctgttttggacccatct

SEQ ID NO: 7890478 - DNA, 22 bp, Homo sapiens
gtgagctttgtggtaatgaagt

SEQ ID NO: 7890479 - DNA, 22 bp, Homo sapiens
gtgaggactggtaaggactgca

SEQ ID NO: 7890480 - DNA, 22 bp, Homo sapiens
gtgaggaagtggtcaggcatcc

SEQ ID NO: 7890481 - DNA, 22 bp, Homo sapiens
gtgaggaatcggttcacggtga

SEQ ID NO: 7890482 - DNA, 22 bp, Homo sapiens
gtgaggagctctttgactcacg

SEQ ID NO: 7890483 - DNA, 22 bp, Homo sapiens
gtgaggagctctttgactcacg

SEQ ID NO: 7890484 - DNA, 22 bp, Homo sapiens
gtgaggagctgacactggggtg

SEQ ID NO: 7890485 - DNA, 22 bp, Homo sapiens
gtgaggagctgacactggggtg

SEQ ID NO: 7890486 - DNA, 22 bp, Homo sapiens
gtgaggagctgacactggggtg

SEQ ID NO: 7890487 - DNA, 22 bp, Homo sapiens
gtgaggagctgacactggggtg

SEQ ID NO: 7890488 - DNA, 22 bp, Homo sapiens
gtgaggagctgacactggggtg

SEQ ID NO: 7890489 - DNA, 22 bp, Homo sapiens
gtgaggagtctgaagcacataa

SEQ ID NO: 7890490 - DNA, 22 bp, Homo sapiens
gtgaggagggctggtcccaggc

SEQ ID NO: 7890491 - DNA, 22 bp, Homo sapiens
gtgaggagggctggtcccaggc

SEQ ID NO: 7890492 - DNA, 22 bp, Homo sapiens
gtgaggagggctggtcccaggc

SEQ ID NO: 7890493 - DNA, 22 bp, Homo sapiens
gtgagccaataccatgctgttc

SEQ ID NO: 7890494 - DNA, 22 bp, Homo sapiens
gtgagccaataccatgctgttc

SEQ ID NO: 7890495 - DNA, 22 bp, Homo sapiens
gtgagcagttgtgagccccaaa

SEQ ID NO: 7890496 - DNA, 22 bp, Homo sapiens
gtgagcagtttgttccagaatc

SEQ ID NO: 7890497 - DNA, 22 bp, Homo sapiens
gtgagcagttgtataaagactt

SEQ ID NO: 7890498 - DNA, 22 bp, Homo sapiens
gtgagcagttgtgagccccaaa

SEQ ID NO: 7890499 - DNA, 22 bp, Homo sapiens
gtgagccgagtatagttcatag

SEQ ID NO: 7890500 - DNA, 22 bp, Homo sapiens
gtgagccgagtatagttcatag

SEQ ID NO: 7890501 - DNA, 22 bp, Homo sapiens
gtgagctggaatagtggagaaa

SEQ ID NO: 7890502 - DNA, 17 bp, Homo sapiens
gtgagctgagtcaggac

SEQ ID NO: 7890503 - DNA, 22 bp, Homo sapiens
gtgagcgtggtcttctgtgggt

SEQ ID NO: 7890504 - DNA, 22 bp, Homo sapiens
gtgagctggaatagtggagaaa

SEQ ID NO: 7890505 - DNA, 22 bp, Homo sapiens
gtgagctggaatagtggagaaa

SEQ ID NO: 7890506 - DNA, 22 bp, Homo sapiens
gtgagctgggtgaatggtaggg

SEQ ID NO: 7890507 - DNA, 22 bp, Homo sapiens
gtgagctgggtgaatggtaggg

SEQ ID NO: 7890508 - DNA, 22 bp, Homo sapiens
gtgagctgtctgagtctcttgg

SEQ ID NO: 7890509 - DNA, 22 bp, Homo sapiens
gtgagctgttggagtggcagag

SEQ ID NO: 7890510 - DNA, 22 bp, Homo sapiens
gtctttcatggatattcagttt

SEQ ID NO: 7890511 - DNA, 22 bp, Homo sapiens
gtctttcatggatattcagttt

SEQ ID NO: 7890512 - DNA, 21 bp, Homo sapiens
gtctttctacctctatgtggc

SEQ ID NO: 7890513 - DNA, 22 bp, Homo sapiens
gtctttccttataatgccctaa

SEQ ID NO: 7890514 - DNA, 22 bp, Homo sapiens
gtctttctatgatgaactgttg

SEQ ID NO: 7890515 - DNA, 22 bp, Homo sapiens
gtctttctatgatgaactgttg

SEQ ID NO: 7890516 - DNA, 22 bp, Homo sapiens
gtctttccttataatgccctaa

SEQ ID NO: 7890517 - DNA, 22 bp, Homo sapiens
gtctttcatggatattcagttt

SEQ ID NO: 7890518 - DNA, 22 bp, Homo sapiens
gtctttcaggaggggcttagag

SEQ ID NO: 7890519 - DNA, 22 bp, Homo sapiens
gtctttcatggatattcagttt

SEQ ID NO: 7890520 - DNA, 22 bp, Homo sapiens
gtctttcactgcggtttacatg

SEQ ID NO: 7890521 - DNA, 22 bp, Homo sapiens
gtctttctatgcatagagcaga

SEQ ID NO: 7890522 - DNA, 22 bp, Homo sapiens
gtctttctatgcatagagcaga

SEQ ID NO: 7890523 - DNA, 22 bp, Homo sapiens
gtctttctatgcatagagcaga

SEQ ID NO: 7890524 - DNA, 22 bp, Homo sapiens
gtctttggatgtaagataaagt

SEQ ID NO: 7890525 - DNA, 22 bp, Homo sapiens
gtctttctatgcatagagcaga

SEQ ID NO: 7890526 - DNA, 22 bp, Homo sapiens
gtctttggatgtaagataaagt

SEQ ID NO: 7890527 - DNA, 21 bp, Homo sapiens
gtcttttaagtgaagagaggc

SEQ ID NO: 7890528 - DNA, 21 bp, Homo sapiens
gtctttttaattgcgatttcc

SEQ ID NO: 7890529 - DNA, 22 bp, Homo sapiens
gtcttttgctagccagagagct

SEQ ID NO: 7890530 - DNA, 21 bp, Homo sapiens
gtctttttaattgcgatttcc

SEQ ID NO: 7890531 - DNA, 22 bp, Homo sapiens
gtgaaaaatcatcatgacttga

SEQ ID NO: 7890532 - DNA, 22 bp, Homo sapiens
gtgaaaaatcatcatgacttga

SEQ ID NO: 7890533 - DNA, 22 bp, Homo sapiens
gtgaaaaatcatcatgacttga

SEQ ID NO: 7890534 - DNA, 22 bp, Homo sapiens
gtgaaaaatcatcatgacttga

SEQ ID NO: 7890535 - DNA, 22 bp, Homo sapiens
gtgaaaaatcatcatgacttga

SEQ ID NO: 7890536 - DNA, 22 bp, Homo sapiens
gtgaaaaatcatcatgacttga

SEQ ID NO: 7890537 - DNA, 22 bp, Homo sapiens
gtgaaaaatcatcatgacttga

SEQ ID NO: 7890538 - DNA, 22 bp, Homo sapiens
gtgaaaaatgatttgttaactg

SEQ ID NO: 7890539 - DNA, 22 bp, Homo sapiens
gtgaaaagagagcctgtgtcag

SEQ ID NO: 7890540 - DNA, 22 bp, Homo sapiens
gtgagcagtggccagggtccta

SEQ ID NO: 7890541 - DNA, 22 bp, Homo sapiens
gtgaaaaatgatttgttaactg

SEQ ID NO: 7890542 - DNA, 22 bp, Homo sapiens
gtgaaaaatgatttgttaactg

SEQ ID NO: 7890543 - DNA, 22 bp, Homo sapiens
gtctttttgtctggcagaggtc

SEQ ID NO: 7890544 - DNA, 22 bp, Homo sapiens
gtcttttttacaccttacatca

SEQ ID NO: 7890545 - DNA, 22 bp, Homo sapiens
gtcttttttacaccttacatca

SEQ ID NO: 7890546 - DNA, 22 bp, Homo sapiens
gtcttttttacaccttacatca

SEQ ID NO: 7890547 - DNA, 22 bp, Homo sapiens
gtcttttttacaccttacatca

SEQ ID NO: 7890548 - DNA, 22 bp, Homo sapiens
gtcttttttacaccttacatca

SEQ ID NO: 7890549 - DNA, 22 bp, Homo sapiens
gtctttttattatagagtggag

SEQ ID NO: 7890550 - DNA, 22 bp, Homo sapiens
gtctttttgtctggcagaggtc

SEQ ID NO: 7890551 - DNA, 22 bp, Homo sapiens
gtctttttctacgatagcgcct

SEQ ID NO: 7890552 - DNA, 22 bp, Homo sapiens
gtctccagaattcttgggaggg

SEQ ID NO: 7890553 - DNA, 22 bp, Homo sapiens
gtctccagaattcttgggaggg

SEQ ID NO: 7890554 - DNA, 22 bp, Homo sapiens
gtctccagaattcttgggaggg

SEQ ID NO: 7890555 - DNA, 22 bp, Homo sapiens
gtctccagaggttacatcctgt

SEQ ID NO: 7890556 - DNA, 22 bp, Homo sapiens
gtctccagaattcttgggaggg

SEQ ID NO: 7890557 - DNA, 22 bp, Homo sapiens
gtctatttgggatcatgatatg

SEQ ID NO: 7890558 - DNA, 22 bp, Homo sapiens
gtctccagaagcctagacagcc

SEQ ID NO: 7890559 - DNA, 22 bp, Homo sapiens
gtctatgtgtaatagcatgtgt

SEQ ID NO: 7890560 - DNA, 22 bp, Homo sapiens
gtctatgtaaacgtctacatta

SEQ ID NO: 7890561 - DNA, 22 bp, Homo sapiens
gtctccagcccactctagatat

SEQ ID NO: 7890562 - DNA, 22 bp, Homo sapiens
gtctccagcccactctagatat

SEQ ID NO: 7890563 - DNA, 22 bp, Homo sapiens
gtctccagcccactctagatat

SEQ ID NO: 7890564 - DNA, 22 bp, Homo sapiens
gtctccagccattctctgatca

SEQ ID NO: 7890565 - DNA, 22 bp, Homo sapiens
gtctccagccattctctgatca

SEQ ID NO: 7890566 - DNA, 22 bp, Homo sapiens
gtctccagatatcctacacaac

SEQ ID NO: 7890567 - DNA, 22 bp, Homo sapiens
gtctccagatatcctacacaac

SEQ ID NO: 7890568 - DNA, 22 bp, Homo sapiens
gtctccagatatcctacacaac

SEQ ID NO: 7890569 - DNA, 22 bp, Homo sapiens
gtctccagaggttacatcctgt

SEQ ID NO: 7890570 - DNA, 22 bp, Homo sapiens
gtctccagaggttacatcctgt

SEQ ID NO: 7890571 - DNA, 22 bp, Homo sapiens
gtctatgatattttgttatagc

SEQ ID NO: 7890572 - DNA, 22 bp, Homo sapiens
gtctatgatattttgttatagc

SEQ ID NO: 7890573 - DNA, 22 bp, Homo sapiens
gtctatgatattttgttatagc

SEQ ID NO: 7890574 - DNA, 22 bp, Homo sapiens
gtctagggtctgtagtgcatgt

SEQ ID NO: 7890575 - DNA, 22 bp, Homo sapiens
gtctatgatattttgttatagc

SEQ ID NO: 7890576 - DNA, 22 bp, Homo sapiens
gtctatatattgcttgaataat

SEQ ID NO: 7890577 - DNA, 22 bp, Homo sapiens
gtctagggctcctcagtgacaa

SEQ ID NO: 7890578 - DNA, 22 bp, Homo sapiens
gtctaggccatcacaggcgcca

SEQ ID NO: 7890579 - DNA, 22 bp, Homo sapiens
gtctagggctcctcagtgacaa

SEQ ID NO: 7890580 - DNA, 22 bp, Homo sapiens
gtctataagtacaattgcactc

SEQ ID NO: 7890581 - DNA, 22 bp, Homo sapiens
gtctataagcaggggaaaactt

SEQ ID NO: 7890582 - DNA, 22 bp, Homo sapiens
gtctataagcaggggaaaactt

SEQ ID NO: 7890583 - DNA, 22 bp, Homo sapiens
gtctagagaggaaggaagtgtg

SEQ ID NO: 7890584 - DNA, 22 bp, Homo sapiens
gtctagagcctgatgaggatga

SEQ ID NO: 7890585 - DNA, 22 bp, Homo sapiens
gtctagagtgcttcctagtcat

SEQ ID NO: 7890586 - DNA, 18 bp, Homo sapiens
gtctaggaggtcacaagg

SEQ ID NO: 7890587 - DNA, 22 bp, Homo sapiens
gtctagatgattcaaagtggta

SEQ ID NO: 7890588 - DNA, 22 bp, Homo sapiens
gtctagaatggatgagcatttt

SEQ ID NO: 7890589 - DNA, 22 bp, Homo sapiens
gtctagaattgcttggcagatg

SEQ ID NO: 7890590 - DNA, 22 bp, Homo sapiens
gtctagaattgcttggcagatg

SEQ ID NO: 7890591 - DNA, 22 bp, Homo sapiens
gtctagaattgcttggcagatg

SEQ ID NO: 7890592 - DNA, 22 bp, Homo sapiens
gtctagaattgcttggcagatg

SEQ ID NO: 7890593 - DNA, 19 bp, Homo sapiens
gtctagaccaggctcctta

SEQ ID NO: 7890594 - DNA, 22 bp, Homo sapiens
gtctagaatatctagaaagatc

SEQ ID NO: 7890595 - DNA, 22 bp, Homo sapiens
gtctagaatggatgagcatttt

SEQ ID NO: 7890596 - DNA, 22 bp, Homo sapiens
gtctagaatatctagaaagatc

SEQ ID NO: 7890597 - DNA, 22 bp, Homo sapiens
gtctagaatggatgagcatttt

SEQ ID NO: 7890598 - DNA, 22 bp, Homo sapiens
gtctagaatggatgagcatttt

SEQ ID NO: 7890599 - DNA, 22 bp, Homo sapiens
gtctagaatatctagaaagatc

SEQ ID NO: 7890600 - DNA, 22 bp, Homo sapiens
gtctagaatatctagaaagatc

SEQ ID NO: 7890601 - DNA, 19 bp, Homo sapiens
gtctagaacattgtaggtg

SEQ ID NO: 7890602 - DNA, 19 bp, Homo sapiens
gtctagaacattgtaggtg

SEQ ID NO: 7890603 - DNA, 19 bp, Homo sapiens
gtctagaacattgtaggtg

SEQ ID NO: 7890604 - DNA, 22 bp, Homo sapiens
gtctagaaatcatgtactgtga

SEQ ID NO: 7890605 - DNA, 22 bp, Homo sapiens
gtctagaaatcatgtactgtga

SEQ ID NO: 7890606 - DNA, 22 bp, Homo sapiens
gtctagaaatgccatacgtgcc

SEQ ID NO: 7890607 - DNA, 22 bp, Homo sapiens
gtctagaaatgccatacgtgcc

SEQ ID NO: 7890608 - DNA, 22 bp, Homo sapiens
gtctagaaatgccatacgtgcc

SEQ ID NO: 7890609 - DNA, 22 bp, Homo sapiens
gtctagaaatgttctcaggggt

SEQ ID NO: 7890610 - DNA, 22 bp, Homo sapiens
gtctagaaatgttctcaggggt

SEQ ID NO: 7890611 - DNA, 19 bp, Homo sapiens
gtctagaacattgtaggtg

SEQ ID NO: 7890612 - DNA, 22 bp, Homo sapiens
gtctagaaatgttctcaggggt

SEQ ID NO: 7890613 - DNA, 22 bp, Homo sapiens
gtctagaaaatgccgagggatg

SEQ ID NO: 7890614 - DNA, 22 bp, Homo sapiens
gtctagaaaatgccgagggatg

SEQ ID NO: 7890615 - DNA, 22 bp, Homo sapiens
gtctagaaaatgccgagggatg

SEQ ID NO: 7890616 - DNA, 22 bp, Homo sapiens
gtctagaaataggtttcagaaa

SEQ ID NO: 7890617 - DNA, 22 bp, Homo sapiens
gtctagaaatcatgtactgtga

SEQ ID NO: 7890618 - DNA, 22 bp, Homo sapiens
gtctagaaatcatgtactgtga

SEQ ID NO: 7890619 - DNA, 22 bp, Homo sapiens
gtctagaaataggtttcagaaa

SEQ ID NO: 7890620 - DNA, 22 bp, Homo sapiens
gtctagaaataggtttcagaaa

SEQ ID NO: 7890621 - DNA, 22 bp, Homo sapiens
gtctagaaataggtttcagaaa

SEQ ID NO: 7890622 - DNA, 22 bp, Homo sapiens
gtctacttttgtcatcattgca

SEQ ID NO: 7890623 - DNA, 22 bp, Homo sapiens
gtctacactgaatttccacaga

SEQ ID NO: 7890624 - DNA, 22 bp, Homo sapiens
gtctacaaagcatataaaagag

SEQ ID NO: 7890625 - DNA, 20 bp, Homo sapiens
gtctacacgggcagtgtaga

SEQ ID NO: 7890626 - DNA, 20 bp, Homo sapiens
gtctacacgggcagtgtaga

SEQ ID NO: 7890627 - DNA, 22 bp, Homo sapiens
gtctaaactttggcccagattt

SEQ ID NO: 7890628 - DNA, 22 bp, Homo sapiens
gtctaaagtctatacttttgtg

SEQ ID NO: 7890629 - DNA, 22 bp, Homo sapiens
gtctaaagcccttagaatagta

SEQ ID NO: 7890630 - DNA, 22 bp, Homo sapiens
gtctaaagcccttagaatagta

SEQ ID NO: 7890631 - DNA, 22 bp, Homo sapiens
gtctaaagcccttagaatagta

SEQ ID NO: 7890632 - DNA, 23 bp, Homo sapiens
gtctaagaaaggcatcaggatga

SEQ ID NO: 7890633 - DNA, 22 bp, Homo sapiens
gtctaagtgggtggcactgaca

SEQ ID NO: 7890634 - DNA, 22 bp, Homo sapiens
gtcttgatctcctgaccttgtg

SEQ ID NO: 7890635 - DNA, 22 bp, Homo sapiens
gtcttgatctcctgaccttgtg

SEQ ID NO: 7890636 - DNA, 22 bp, Homo sapiens
gtcttgatctcctgaccttgtg

SEQ ID NO: 7890637 - DNA, 22 bp, Homo sapiens
gtcttgcacttacctaagaact

SEQ ID NO: 7890638 - DNA, 22 bp, Homo sapiens
gtcttggccgtgcagatgaaga

SEQ ID NO: 7890639 - DNA, 22 bp, Homo sapiens
gtcttggccgtgcagatgaaga

SEQ ID NO: 7890640 - DNA, 22 bp, Homo sapiens
gtcttggcatattttcaccaag

SEQ ID NO: 7890641 - DNA, 21 bp, Homo sapiens
gtcttggcaccaggagagaga

SEQ ID NO: 7890642 - DNA, 22 bp, Homo sapiens
gtctcccaatccgggacagcct

SEQ ID NO: 7890643 - DNA, 22 bp, Homo sapiens
gtctcccaacccctgtgcccag

SEQ ID NO: 7890644 - DNA, 22 bp, Homo sapiens
gtctccagttacagcagccagg

SEQ ID NO: 7890645 - DNA, 22 bp, Homo sapiens
gtctccagttacagcagccagg

SEQ ID NO: 7890646 - DNA, 22 bp, Homo sapiens
gtctccatggaaagtagccagt

SEQ ID NO: 7890647 - DNA, 22 bp, Homo sapiens
gtctccagttacagcagccagg

SEQ ID NO: 7890648 - DNA, 22 bp, Homo sapiens
gtctccagttacagcagccagg

SEQ ID NO: 7890649 - DNA, 22 bp, Homo sapiens
gtctccagttacagcagccagg

SEQ ID NO: 7890650 - DNA, 22 bp, Homo sapiens
gtctccagggctgctggcgcct

SEQ ID NO: 7890651 - DNA, 22 bp, Homo sapiens
gtctccagggctgctggcgcct

SEQ ID NO: 7890652 - DNA, 22 bp, Homo sapiens
gtctccagggctgctggcgcct

SEQ ID NO: 7890653 - DNA, 22 bp, Homo sapiens
gtctccagggctgctggcgcct

SEQ ID NO: 7890654 - DNA, 22 bp, Homo sapiens
gtctccagggctgctggcgcct

SEQ ID NO: 7890655 - DNA, 22 bp, Homo sapiens
gtctccagggacacactagccg

SEQ ID NO: 7890656 - DNA, 22 bp, Homo sapiens
gtctccagggacacactagccg

SEQ ID NO: 7890657 - DNA, 22 bp, Homo sapiens
gtctccagcccactctagatat

SEQ ID NO: 7890658 - DNA, 22 bp, Homo sapiens
gtctccagggacacactagccg

SEQ ID NO: 7890659 - DNA, 22 bp, Homo sapiens
gtctccagggacacactagccg

SEQ ID NO: 7890660 - DNA, 22 bp, Homo sapiens
gtctccagtgttcaggtgactg

SEQ ID NO: 7890661 - DNA, 22 bp, Homo sapiens
gtctccagtgttcaggtgactg

SEQ ID NO: 7890662 - DNA, 22 bp, Homo sapiens
gtctccagtgttcaggtgactg

SEQ ID NO: 7890663 - DNA, 22 bp, Homo sapiens
gtctccagggctgctggcgcct

SEQ ID NO: 7890664 - DNA, 22 bp, Homo sapiens
gtctccagggctgctggcgcct

SEQ ID NO: 7890665 - DNA, 22 bp, Homo sapiens
gtctccagtgttcaggtgactg

SEQ ID NO: 7890666 - DNA, 22 bp, Homo sapiens
gtctccagtgttcaggtgactg

SEQ ID NO: 7890667 - DNA, 22 bp, Homo sapiens
gtctccagtgttcaggtgactg

SEQ ID NO: 7890668 - DNA, 22 bp, Homo sapiens
gtctccagtgttcaggtgactg

SEQ ID NO: 7890669 - DNA, 22 bp, Homo sapiens
gtctttattacaaatccttttc

SEQ ID NO: 7890670 - DNA, 22 bp, Homo sapiens
gtctttatggtatgaaaactga

SEQ ID NO: 7890671 - DNA, 20 bp, Homo sapiens
gtctttatgttttatgacct

SEQ ID NO: 7890672 - DNA, 20 bp, Homo sapiens
gtctttatgttttatgacct

SEQ ID NO: 7890673 - DNA, 22 bp, Homo sapiens
gtctttagttgaaacatgtggt

SEQ ID NO: 7890674 - DNA, 22 bp, Homo sapiens
gtctttatctttgaaattagtc

SEQ ID NO: 7890675 - DNA, 22 bp, Homo sapiens
gtctttagttgaaacatgtggt

SEQ ID NO: 7890676 - DNA, 22 bp, Homo sapiens
gtctttagagctcctggcatct

SEQ ID NO: 7890677 - DNA, 22 bp, Homo sapiens
gtctttagttgaaacatgtggt

SEQ ID NO: 7890678 - DNA, 21 bp, Homo sapiens
gtctttaaaaaaggctgatac

SEQ ID NO: 7890679 - DNA, 21 bp, Homo sapiens
gtctttaaaaaaggctgatac

SEQ ID NO: 7890680 - DNA, 22 bp, Homo sapiens
gtcttgtttgggatgtggatgg

SEQ ID NO: 7890681 - DNA, 22 bp, Homo sapiens
gtctttaagggactgaatttgg

SEQ ID NO: 7890682 - DNA, 22 bp, Homo sapiens
gtctttaagggactgaatttgg

SEQ ID NO: 7890683 - DNA, 22 bp, Homo sapiens
gtcttgttaagattttggaata

SEQ ID NO: 7890684 - DNA, 22 bp, Homo sapiens
gtcttgtcccagctctgccact

SEQ ID NO: 7890685 - DNA, 22 bp, Homo sapiens
gtcttgttggagttcttgcagc

SEQ ID NO: 7890686 - DNA, 22 bp, Homo sapiens
gtcttgtccattccatgctgct

SEQ ID NO: 7890687 - DNA, 19 bp, Homo sapiens
gtcttggctctcaaccatc

SEQ ID NO: 7890688 - DNA, 22 bp, Homo sapiens
gtgctgcctgccagcttctggg

SEQ ID NO: 7890689 - DNA, 22 bp, Homo sapiens
gtgctgcctccatatccgtcag

SEQ ID NO: 7890690 - DNA, 22 bp, Homo sapiens
gtgctgcatgacttgctcctga

SEQ ID NO: 7890691 - DNA, 23 bp, Homo sapiens
gtgctgcaaaatcggccactgca

SEQ ID NO: 7890692 - DNA, 22 bp, Homo sapiens
gtgctgccagacagtgagaggg

SEQ ID NO: 7890693 - DNA, 22 bp, Homo sapiens
gtgctgcctgccagcttctggg

SEQ ID NO: 7890694 - DNA, 22 bp, Homo sapiens
gtgctgctcaagggacaggaca

SEQ ID NO: 7890695 - DNA, 22 bp, Homo sapiens
gtgctgcctgccagcttctggg

SEQ ID NO: 7890696 - DNA, 22 bp, Homo sapiens
gtgctgctcacatctggaggta

SEQ ID NO: 7890697 - DNA, 22 bp, Homo sapiens
gtgctgctgccagcaggatcct

SEQ ID NO: 7890698 - DNA, 22 bp, Homo sapiens
gtgctggaactgtgctaagaga

SEQ ID NO: 7890699 - DNA, 22 bp, Homo sapiens
gtgctgcttgggggcagagcag

SEQ ID NO: 7890700 - DNA, 22 bp, Homo sapiens
gtgctggaccctggaaggtggt

SEQ ID NO: 7890701 - DNA, 22 bp, Homo sapiens
gtgctggaccctggaaggtggt

SEQ ID NO: 7890702 - DNA, 22 bp, Homo sapiens
gtgctggaccctggaaggtggt

SEQ ID NO: 7890703 - DNA, 20 bp, Homo sapiens
gtgctggagttaggaaaggt

SEQ ID NO: 7890704 - DNA, 22 bp, Homo sapiens
gtgctggccctgtcctcgagct

SEQ ID NO: 7890705 - DNA, 22 bp, Homo sapiens
gtgctggccctgtcctcgagct

SEQ ID NO: 7890706 - DNA, 22 bp, Homo sapiens
gtgctggcacccctctccagtt

SEQ ID NO: 7890707 - DNA, 22 bp, Homo sapiens
gtgctggatgaaataactggaa

SEQ ID NO: 7890708 - DNA, 22 bp, Homo sapiens
gtgctggcacccctctccagtt

SEQ ID NO: 7890709 - DNA, 22 bp, Homo sapiens
gtgctgcagggtcagcaccctc

SEQ ID NO: 7890710 - DNA, 22 bp, Homo sapiens
gtgctgcagggtcagcaccctc

SEQ ID NO: 7890711 - DNA, 22 bp, Homo sapiens
gtgctgcagggcctcctgcacc

SEQ ID NO: 7890712 - DNA, 22 bp, Homo sapiens
gtgctgcagagtctcgtgccgc

SEQ ID NO: 7890713 - DNA, 23 bp, Homo sapiens
gtgctgcaaaatcggccactgca

SEQ ID NO: 7890714 - DNA, 22 bp, Homo sapiens
gtgctgatcttcacttggctgc

SEQ ID NO: 7890715 - DNA, 20 bp, Homo sapiens
gtgctgagtgtctaactcct

SEQ ID NO: 7890716 - DNA, 22 bp, Homo sapiens
gtgctgagtgcagagtgcagag

SEQ ID NO: 7890717 - DNA, 22 bp, Homo sapiens
gtgctgaatccactcttaggaa

SEQ ID NO: 7890718 - DNA, 22 bp, Homo sapiens
gtgctgaattggagatgctcct

SEQ ID NO: 7890719 - DNA, 22 bp, Homo sapiens
gtgctgaattgtgctctttaca

SEQ ID NO: 7890720 - DNA, 22 bp, Homo sapiens
gtgctgacaggagcctggcggt

SEQ ID NO: 7890721 - DNA, 22 bp, Homo sapiens
gtgctgacaggagcctggcggt

SEQ ID NO: 7890722 - DNA, 22 bp, Homo sapiens
gtgctgacaggagcctggcggt

SEQ ID NO: 7890723 - DNA, 22 bp, Homo sapiens
gtgctgaatttgagaaactctg

SEQ ID NO: 7890724 - DNA, 16 bp, Homo sapiens
gtgctgacagctctgg

SEQ ID NO: 7890725 - DNA, 22 bp, Homo sapiens
gtgctgacaggagcctggcggt

SEQ ID NO: 7890726 - DNA, 22 bp, Homo sapiens
gtgctgaataacagtagaaatt

SEQ ID NO: 7890727 - DNA, 18 bp, Homo sapiens
gtgctgaataactacttt

SEQ ID NO: 7890728 - DNA, 22 bp, Homo sapiens
gtgcccaggcccaaggcaccac

SEQ ID NO: 7890729 - DNA, 22 bp, Homo sapiens
gtgcccaggcccaaggcaccac

SEQ ID NO: 7890730 - DNA, 22 bp, Homo sapiens
gtgcccaggcccaaggcaccac

SEQ ID NO: 7890731 - DNA, 22 bp, Homo sapiens
gtgcccaggcccaaggcaccac

SEQ ID NO: 7890732 - DNA, 22 bp, Homo sapiens
gtgcccagctccacctcacaga

SEQ ID NO: 7890733 - DNA, 22 bp, Homo sapiens
gtgcccagctccacctcacaga

SEQ ID NO: 7890734 - DNA, 22 bp, Homo sapiens
gtgcccagctccacctcacaga

SEQ ID NO: 7890735 - DNA, 22 bp, Homo sapiens
gtgcccagctccacctcacaga

SEQ ID NO: 7890736 - DNA, 22 bp, Homo sapiens
gtgcccagctccacctcacaga

SEQ ID NO: 7890737 - DNA, 22 bp, Homo sapiens
gtgccatcgggctcctcctgct

SEQ ID NO: 7890738 - DNA, 22 bp, Homo sapiens
gtgccattgcactccagcctgg

SEQ ID NO: 7890739 - DNA, 22 bp, Homo sapiens
gtgccatttctcaaaacacagt

SEQ ID NO: 7890740 - DNA, 22 bp, Homo sapiens
gtgcccaccggtgccctgagct

SEQ ID NO: 7890741 - DNA, 22 bp, Homo sapiens
gtgccatttttctccagaaata

SEQ ID NO: 7890742 - DNA, 22 bp, Homo sapiens
gtgcccaccacgggctgtggcg

SEQ ID NO: 7890743 - DNA, 22 bp, Homo sapiens
gtgcccacgaggccaggctggt

SEQ ID NO: 7890744 - DNA, 22 bp, Homo sapiens
gtgcccacgaggccaggctggt

SEQ ID NO: 7890745 - DNA, 22 bp, Homo sapiens
gtgcccagcagcagcgtccccg

SEQ ID NO: 7890746 - DNA, 22 bp, Homo sapiens
gtgcccagcagcagcgtccccg

SEQ ID NO: 7890747 - DNA, 22 bp, Homo sapiens
gtgccaggtgctaagctgtgct

SEQ ID NO: 7890748 - DNA, 22 bp, Homo sapiens
gtgccaggtgctaagctgtgct

SEQ ID NO: 7890749 - DNA, 22 bp, Homo sapiens
gtgccaggtgctaagctgtgct

SEQ ID NO: 7890750 - DNA, 22 bp, Homo sapiens
gtgccaggtgctaagctgtgct

SEQ ID NO: 7890751 - DNA, 22 bp, Homo sapiens
gtgccatactcatatcattttt

SEQ ID NO: 7890752 - DNA, 22 bp, Homo sapiens
gtgccatcattcaataaattca

SEQ ID NO: 7890753 - DNA, 22 bp, Homo sapiens
gtgccaggtgctaagctgtgct

SEQ ID NO: 7890754 - DNA, 22 bp, Homo sapiens
gtgccaggtgctaagctgtgct

SEQ ID NO: 7890755 - DNA, 22 bp, Homo sapiens
gtgccaggtgctaagctgtgct

SEQ ID NO: 7890756 - DNA, 22 bp, Homo sapiens
gtgccagggggcactgaacaga

SEQ ID NO: 7890757 - DNA, 22 bp, Homo sapiens
gtgccagggggcactgaacaga

SEQ ID NO: 7890758 - DNA, 22 bp, Homo sapiens
gtgccagggggcactgaacaga

SEQ ID NO: 7890759 - DNA, 22 bp, Homo sapiens
gtgccaggtgctaagctgtgct

SEQ ID NO: 7890760 - DNA, 22 bp, Homo sapiens
gtgccaggtgctaagctgtgct

SEQ ID NO: 7890761 - DNA, 22 bp, Homo sapiens
gtgccagggagtggaggagctt

SEQ ID NO: 7890762 - DNA, 22 bp, Homo sapiens
gtgccagggggcactgaacaga

SEQ ID NO: 7890763 - DNA, 22 bp, Homo sapiens
gtgccagctctccccacatctg

SEQ ID NO: 7890764 - DNA, 22 bp, Homo sapiens
gtgccagctgtccatgttcctc

SEQ ID NO: 7890765 - DNA, 22 bp, Homo sapiens
gtgccagctctccccacatctg

SEQ ID NO: 7890766 - DNA, 22 bp, Homo sapiens
gtgccagctctccccacatctg

SEQ ID NO: 7890767 - DNA, 22 bp, Homo sapiens
gtgccagccgcaccccaggaga

SEQ ID NO: 7890768 - DNA, 22 bp, Homo sapiens
gtgccagcctggtgcgcctggg

SEQ ID NO: 7890769 - DNA, 22 bp, Homo sapiens
gtgccagcctggtgcgcctggg

SEQ ID NO: 7890770 - DNA, 22 bp, Homo sapiens
gtgccagcctggtgcgcctggg

SEQ ID NO: 7890771 - DNA, 18 bp, Homo sapiens
gtgccaggaggcgcagcc

SEQ ID NO: 7890772 - DNA, 18 bp, Homo sapiens
gtgccaggaggcgcagcc

SEQ ID NO: 7890773 - DNA, 18 bp, Homo sapiens
gtgccaggaggcgcagcc

SEQ ID NO: 7890774 - DNA, 18 bp, Homo sapiens
gtgccaggaggcgcagcc

SEQ ID NO: 7890775 - DNA, 18 bp, Homo sapiens
gtgccaggaggcgcagcc

SEQ ID NO: 7890776 - DNA, 18 bp, Homo sapiens
gtgccaggaggcgcagcc

SEQ ID NO: 7890777 - DNA, 18 bp, Homo sapiens
gtgccaggaggcgcagcc

SEQ ID NO: 7890778 - DNA, 18 bp, Homo sapiens
gtgccaggaggcgcagcc

SEQ ID NO: 7890779 - DNA, 20 bp, Homo sapiens
gtgccaggcaagacaggtgg

SEQ ID NO: 7890780 - DNA, 22 bp, Homo sapiens
gtgccaggcctattgttaaact

SEQ ID NO: 7890781 - DNA, 22 bp, Homo sapiens
gtgccaggcccagggagcgggg

SEQ ID NO: 7890782 - DNA, 22 bp, Homo sapiens
gtgccagggagtggaggagctt

SEQ ID NO: 7890783 - DNA, 22 bp, Homo sapiens
gtgccagggagtggaggagctt

SEQ ID NO: 7890784 - DNA, 22 bp, Homo sapiens
gtgccagggagtggaggagctt

SEQ ID NO: 7890785 - DNA, 20 bp, Homo sapiens
gtgccaggcaagacaggtgg

SEQ ID NO: 7890786 - DNA, 22 bp, Homo sapiens
gtgccagggagtggaggagctt

SEQ ID NO: 7890787 - DNA, 22 bp, Homo sapiens
gtgccaggcccagggagcgggg

SEQ ID NO: 7890788 - DNA, 22 bp, Homo sapiens
gtgccaggcccagggagcgggg

SEQ ID NO: 7890789 - DNA, 22 bp, Homo sapiens
gtgccaggcccagggagcgggg

SEQ ID NO: 7890790 - DNA, 20 bp, Homo sapiens
gtgccaggcaagacaggtgg

SEQ ID NO: 7890791 - DNA, 20 bp, Homo sapiens
gtgccaggcaagacaggtgg

SEQ ID NO: 7890792 - DNA, 20 bp, Homo sapiens
gtgccaggcaagacaggtgg

SEQ ID NO: 7890793 - DNA, 22 bp, Homo sapiens
gtgccagaggcagtgaggagtt

SEQ ID NO: 7890794 - DNA, 22 bp, Homo sapiens
gtgccagaggcagtgaggagtt

SEQ ID NO: 7890795 - DNA, 22 bp, Homo sapiens
gtgccagaggcagtgaggagtt

SEQ ID NO: 7890796 - DNA, 22 bp, Homo sapiens
gtgccagaggccccaaacaagt

SEQ ID NO: 7890797 - DNA, 22 bp, Homo sapiens
gtgccagagtttgaggacaatt

SEQ ID NO: 7890798 - DNA, 22 bp, Homo sapiens
gtgccagatgctgctttgtttt

SEQ ID NO: 7890799 - DNA, 22 bp, Homo sapiens
gtgccagccgcaccccaggaga

SEQ ID NO: 7890800 - DNA, 22 bp, Homo sapiens
gtgccagaaggttcccgctgca

SEQ ID NO: 7890801 - DNA, 22 bp, Homo sapiens
gtgccagaaggttcccgctgca

SEQ ID NO: 7890802 - DNA, 22 bp, Homo sapiens
gtgccagacagggcagtggtat

SEQ ID NO: 7890803 - DNA, 22 bp, Homo sapiens
gtgccagaatctttgaagagag

SEQ ID NO: 7890804 - DNA, 22 bp, Homo sapiens
gtgccagactgtgtcttgctaa

SEQ ID NO: 7890805 - DNA, 22 bp, Homo sapiens
gtgccagagacatgactagctg

SEQ ID NO: 7890806 - DNA, 22 bp, Homo sapiens
gtgccagagattcctaaacttt

SEQ ID NO: 7890807 - DNA, 22 bp, Homo sapiens
gtgccagagcaatcaggctctg

SEQ ID NO: 7890808 - DNA, 22 bp, Homo sapiens
gtgccagagacatgactagctg

SEQ ID NO: 7890809 - DNA, 22 bp, Homo sapiens
gtgccagagatgacaggcctgc

SEQ ID NO: 7890810 - DNA, 22 bp, Homo sapiens
gtgcaggggcctccccttgctg

SEQ ID NO: 7890811 - DNA, 22 bp, Homo sapiens
gtgcagggtagcgacggcagga

SEQ ID NO: 7890812 - DNA, 22 bp, Homo sapiens
gtgcaggggcctccccttgctg

SEQ ID NO: 7890813 - DNA, 22 bp, Homo sapiens
gtgcaggggatcaggttgcagc

SEQ ID NO: 7890814 - DNA, 22 bp, Homo sapiens
gtgcaggggatcaggttgcagc

SEQ ID NO: 7890815 - DNA, 22 bp, Homo sapiens
gtgcagggtagcgacggcagga

SEQ ID NO: 7890816 - DNA, 22 bp, Homo sapiens
gtgcagggtagcgacggcagga

SEQ ID NO: 7890817 - DNA, 22 bp, Homo sapiens
gtgcagggtagcgacggcagga

SEQ ID NO: 7890818 - DNA, 22 bp, Homo sapiens
gtgcagggtagcgacggcagga

SEQ ID NO: 7890819 - DNA, 22 bp, Homo sapiens
gtgccactgataaatcagaatg

SEQ ID NO: 7890820 - DNA, 22 bp, Homo sapiens
gtgccaccttcaaatcacattg

SEQ ID NO: 7890821 - DNA, 22 bp, Homo sapiens
gtgccactgcactctagcctag

SEQ ID NO: 7890822 - DNA, 22 bp, Homo sapiens
gtgcagggtagcgacggcagga

SEQ ID NO: 7890823 - DNA, 22 bp, Homo sapiens
gtgcagggctggcaccggaggc

SEQ ID NO: 7890824 - DNA, 22 bp, Homo sapiens
gtgcagggctggcaccggaggc

SEQ ID NO: 7890825 - DNA, 22 bp, Homo sapiens
gtgcagggctggcaccggaggc

SEQ ID NO: 7890826 - DNA, 22 bp, Homo sapiens
gtgcaggggatcaggttgcagc

SEQ ID NO: 7890827 - DNA, 22 bp, Homo sapiens
gtgcaggggatcaggttgcagc

SEQ ID NO: 7890828 - DNA, 22 bp, Homo sapiens
gtgcagggctggcaccggaggc

SEQ ID NO: 7890829 - DNA, 22 bp, Homo sapiens
gtgcaggggatcaggttgcagc

SEQ ID NO: 7890830 - DNA, 22 bp, Homo sapiens
gtgcaggggatcaggttgcagc

SEQ ID NO: 7890831 - DNA, 22 bp, Homo sapiens
gtgcagggcaggtgtccttcca

SEQ ID NO: 7890832 - DNA, 22 bp, Homo sapiens
gtgcagggccctcctaacatct

SEQ ID NO: 7890833 - DNA, 22 bp, Homo sapiens
gtgcagggcagccgaatgggct

SEQ ID NO: 7890834 - DNA, 22 bp, Homo sapiens
gtgcagggcaggtgtccttcca

SEQ ID NO: 7890835 - DNA, 22 bp, Homo sapiens
gtgcagggcagccgaatgggct

SEQ ID NO: 7890836 - DNA, 22 bp, Homo sapiens
gtgcagggcagccgaatgggct

SEQ ID NO: 7890837 - DNA, 22 bp, Homo sapiens
gtgcagggcagccgaatgggct

SEQ ID NO: 7890838 - DNA, 22 bp, Homo sapiens
gtgcagggcagccgaatgggct

SEQ ID NO: 7890839 - DNA, 22 bp, Homo sapiens
gtgcagggcagccgaatgggct

SEQ ID NO: 7890840 - DNA, 22 bp, Homo sapiens
gtgcagggcagccgaatgggct

SEQ ID NO: 7890841 - DNA, 22 bp, Homo sapiens
gtgcagggcagccgaatgggct

SEQ ID NO: 7890842 - DNA, 17 bp, Homo sapiens
gtgcagggatgaaggat

SEQ ID NO: 7890843 - DNA, 17 bp, Homo sapiens
gtgcagggatgaaggat

SEQ ID NO: 7890844 - DNA, 17 bp, Homo sapiens
gtgcagggatgaaggat

SEQ ID NO: 7890845 - DNA, 17 bp, Homo sapiens
gtgcagggatgaaggat

SEQ ID NO: 7890846 - DNA, 17 bp, Homo sapiens
gtgcagggatgaaggat

SEQ ID NO: 7890847 - DNA, 17 bp, Homo sapiens
gtgcagggatgaaggat

SEQ ID NO: 7890848 - DNA, 22 bp, Homo sapiens
gtgcagggagcccagaaggtcc

SEQ ID NO: 7890849 - DNA, 22 bp, Homo sapiens
gtgaggcagcaggagcctctgt

SEQ ID NO: 7890850 - DNA, 22 bp, Homo sapiens
gtgaggcaggcattctcctttc

SEQ ID NO: 7890851 - DNA, 22 bp, Homo sapiens
gtgaggcagcaggagcctctgt

SEQ ID NO: 7890852 - DNA, 22 bp, Homo sapiens
gtgaggcagggaaagaggataa

SEQ ID NO: 7890853 - DNA, 22 bp, Homo sapiens
gtgaggcaggcattctcctttc

SEQ ID NO: 7890854 - DNA, 22 bp, Homo sapiens
gtgcagcaaactagtgcgaggg

SEQ ID NO: 7890855 - DNA, 22 bp, Homo sapiens
gtgcagcaaactagtgcgaggg

SEQ ID NO: 7890856 - DNA, 22 bp, Homo sapiens
gtgcagcaaactagtgcgaggg

SEQ ID NO: 7890857 - DNA, 22 bp, Homo sapiens
gtgcagcaaactagtgcgaggg

SEQ ID NO: 7890858 - DNA, 22 bp, Homo sapiens
gtgcagcaaactagtgcgaggg

SEQ ID NO: 7890859 - DNA, 22 bp, Homo sapiens
gtgcagcaaactagtgcgaggg

SEQ ID NO: 7890860 - DNA, 22 bp, Homo sapiens
gtgcagcaaagtttgagatata

SEQ ID NO: 7890861 - DNA, 22 bp, Homo sapiens
gtgaggagtctgaagcacataa

SEQ ID NO: 7890862 - DNA, 22 bp, Homo sapiens
gtgaggatacttaagagaacac

SEQ ID NO: 7890863 - DNA, 22 bp, Homo sapiens
gtgaggatcaaatgaaatagca

SEQ ID NO: 7890864 - DNA, 22 bp, Homo sapiens
gtgaggatgtactgagataaat

SEQ ID NO: 7890865 - DNA, 22 bp, Homo sapiens
gtgaggcagagatgccaaaact

SEQ ID NO: 7890866 - DNA, 22 bp, Homo sapiens
gtgaggcagaagttccctttta

SEQ ID NO: 7890867 - DNA, 22 bp, Homo sapiens
gtgaggcagaagttccctttta

SEQ ID NO: 7890868 - DNA, 22 bp, Homo sapiens
gtgaggattgctctggagaatt

SEQ ID NO: 7890869 - DNA, 22 bp, Homo sapiens
gtgaggcaagggcatactaggc

SEQ ID NO: 7890870 - DNA, 22 bp, Homo sapiens
gtgaggcaagggcatactaggc

SEQ ID NO: 7890871 - DNA, 22 bp, Homo sapiens
gtgcagggagcccagaaggtcc

SEQ ID NO: 7890872 - DNA, 17 bp, Homo sapiens
gtgcagggatgaaggat

SEQ ID NO: 7890873 - DNA, 22 bp, Homo sapiens
gtgcagggagcccagaaggtcc

SEQ ID NO: 7890874 - DNA, 22 bp, Homo sapiens
gtgcagggagcccagaaggtcc

SEQ ID NO: 7890875 - DNA, 22 bp, Homo sapiens
gtgcagggagcccagaaggtcc

SEQ ID NO: 7890876 - DNA, 22 bp, Homo sapiens
gtgcaggctctcgttcttgaca

SEQ ID NO: 7890877 - DNA, 22 bp, Homo sapiens
gtgcagggagcccagaaggtcc

SEQ ID NO: 7890878 - DNA, 22 bp, Homo sapiens
gtgcaggctagatccttcctac

SEQ ID NO: 7890879 - DNA, 22 bp, Homo sapiens
gtgcaggcattgggctagccat

SEQ ID NO: 7890880 - DNA, 22 bp, Homo sapiens
gtgcaggcaaaagggccaggcc

SEQ ID NO: 7890881 - DNA, 22 bp, Homo sapiens
gtgcaggcaaaagggccaggcc

SEQ ID NO: 7890882 - DNA, 22 bp, Homo sapiens
gtgcaggatttatagcccagct

SEQ ID NO: 7890883 - DNA, 22 bp, Homo sapiens
gtgcaggagtaggagagggctt

SEQ ID NO: 7890884 - DNA, 22 bp, Homo sapiens
gtgcaggagtaggagagggctt

SEQ ID NO: 7890885 - DNA, 22 bp, Homo sapiens
gtgcaggagtaggagagggctt

SEQ ID NO: 7890886 - DNA, 22 bp, Homo sapiens
gtgcaggaggtaacatagcaaa

SEQ ID NO: 7890887 - DNA, 20 bp, Homo sapiens
gtgcagcacttgggggtagg

SEQ ID NO: 7890888 - DNA, 20 bp, Homo sapiens
gtgcagcacttgggggtagg

SEQ ID NO: 7890889 - DNA, 22 bp, Homo sapiens
gtgcaggaggtaacatagcaaa

SEQ ID NO: 7890890 - DNA, 20 bp, Homo sapiens
gtgcagcacttgggggtagg

SEQ ID NO: 7890891 - DNA, 22 bp, Homo sapiens
gtgcaggagtaggagagggctt

SEQ ID NO: 7890892 - DNA, 22 bp, Homo sapiens
gtgcaggatctcagaacaagtg

SEQ ID NO: 7890893 - DNA, 22 bp, Homo sapiens
gtgcaggatgttgggaatcagg

SEQ ID NO: 7890894 - DNA, 22 bp, Homo sapiens
gtgcaggatgttgggaatcagg

SEQ ID NO: 7890895 - DNA, 22 bp, Homo sapiens
gctgcctcccagagccctgcag

SEQ ID NO: 7890896 - DNA, 22 bp, Homo sapiens
gctgcctccactggctcccagt

SEQ ID NO: 7890897 - DNA, 22 bp, Homo sapiens
gctgcctcccagagccctgcag

SEQ ID NO: 7890898 - DNA, 22 bp, Homo sapiens
gctgcctcccagagccctgcag

SEQ ID NO: 7890899 - DNA, 22 bp, Homo sapiens
gctgcctccactggctcccagt

SEQ ID NO: 7890900 - DNA, 22 bp, Homo sapiens
gctgcctcccagagccctgcag

SEQ ID NO: 7890901 - DNA, 22 bp, Homo sapiens
gctgcctcccagagccctgcag

SEQ ID NO: 7890902 - DNA, 22 bp, Homo sapiens
gctgcctcccagagccctgcag

SEQ ID NO: 7890903 - DNA, 22 bp, Homo sapiens
gctgcctcccagagccctgcag

SEQ ID NO: 7890904 - DNA, 22 bp, Homo sapiens
gctgcctccactggctcccagt

SEQ ID NO: 7890905 - DNA, 22 bp, Homo sapiens
gctgcctccactggctcccagt

SEQ ID NO: 7890906 - DNA, 22 bp, Homo sapiens
gctgcctccaatctgtgccccg

SEQ ID NO: 7890907 - DNA, 22 bp, Homo sapiens
gctgcctccactggctcccagt

SEQ ID NO: 7890908 - DNA, 22 bp, Homo sapiens
gctgcctccactggctcccagt

SEQ ID NO: 7890909 - DNA, 22 bp, Homo sapiens
gctgcctccactggctcccagt

SEQ ID NO: 7890910 - DNA, 22 bp, Homo sapiens
gctgcctccactggctcccagt

SEQ ID NO: 7890911 - DNA, 22 bp, Homo sapiens
gctgcctccactggctcccagt

SEQ ID NO: 7890912 - DNA, 22 bp, Homo sapiens
gctgcctccgccggctccacag

SEQ ID NO: 7890913 - DNA, 22 bp, Homo sapiens
gctgcctccgccggctccacag

SEQ ID NO: 7890914 - DNA, 22 bp, Homo sapiens
gctgcctccgccggctccacag

SEQ ID NO: 7890915 - DNA, 22 bp, Homo sapiens
gctgcctccgccggctccacag

SEQ ID NO: 7890916 - DNA, 22 bp, Homo sapiens
gctgcctccgccggctccacag

SEQ ID NO: 7890917 - DNA, 22 bp, Homo sapiens
gctgcctccgccggctccacag

SEQ ID NO: 7890918 - DNA, 23 bp, Homo sapiens
gctgcctcctacaaaagcccagc

SEQ ID NO: 7890919 - DNA, 22 bp, Homo sapiens
gctgcctccgccggctccacag

SEQ ID NO: 7890920 - DNA, 22 bp, Homo sapiens
gctgcctccgccggctccacag

SEQ ID NO: 7890921 - DNA, 22 bp, Homo sapiens
gctgcctccgccggctccacag

SEQ ID NO: 7890922 - DNA, 22 bp, Homo sapiens
gctgcctccgccggctccacag

SEQ ID NO: 7890923 - DNA, 22 bp, Homo sapiens
gctgcctcccccatggctggaa

SEQ ID NO: 7890924 - DNA, 22 bp, Homo sapiens
gctgcctcccccatggctggaa

SEQ ID NO: 7890925 - DNA, 22 bp, Homo sapiens
gctgcctcccccatggctggaa

SEQ ID NO: 7890926 - DNA, 22 bp, Homo sapiens
gctgcctcccccatggctggaa

SEQ ID NO: 7890927 - DNA, 22 bp, Homo sapiens
gctgcctccgccggctccacag

SEQ ID NO: 7890928 - DNA, 22 bp, Homo sapiens
gctgcctcccccatggctggaa

SEQ ID NO: 7890929 - DNA, 22 bp, Homo sapiens
gctgcctcccccatggctggaa

SEQ ID NO: 7890930 - DNA, 22 bp, Homo sapiens
gctgcctcccccatggctggaa

SEQ ID NO: 7890931 - DNA, 22 bp, Homo sapiens
gctgcctcccccatggctggaa

SEQ ID NO: 7890932 - DNA, 22 bp, Homo sapiens
gctgcctcctgaaagcgctctg

SEQ ID NO: 7890933 - DNA, 22 bp, Homo sapiens
gctgcctcctgaaagcgctctg

SEQ ID NO: 7890934 - DNA, 22 bp, Homo sapiens
gctgcctcctgaaagcgctctg

SEQ ID NO: 7890935 - DNA, 22 bp, Homo sapiens
gctgcctcctgaaagcgctctg

SEQ ID NO: 7890936 - DNA, 22 bp, Homo sapiens
gctgcctcctgaaagcgctctg

SEQ ID NO: 7890937 - DNA, 23 bp, Homo sapiens
gctgcctcctacaaaagcccagc

SEQ ID NO: 7890938 - DNA, 23 bp, Homo sapiens
gctgcctcctacaaaagcccagc

SEQ ID NO: 7890939 - DNA, 23 bp, Homo sapiens
gctgcctcctacaaaagcccagc

SEQ ID NO: 7890940 - DNA, 23 bp, Homo sapiens
gctgcctcctacaaaagcccagc

SEQ ID NO: 7890941 - DNA, 22 bp, Homo sapiens
gctgcctctcctgagttgacag

SEQ ID NO: 7890942 - DNA, 22 bp, Homo sapiens
gctgcctctcctgagttgacag

SEQ ID NO: 7890943 - DNA, 22 bp, Homo sapiens
gctgcctctcctgagttgacag

SEQ ID NO: 7890944 - DNA, 22 bp, Homo sapiens
gctgcctcctgagatttgggca

SEQ ID NO: 7890945 - DNA, 22 bp, Homo sapiens
gctgcctcctgagatttgggca

SEQ ID NO: 7890946 - DNA, 22 bp, Homo sapiens
gctgcctcctgagatttgggca

SEQ ID NO: 7890947 - DNA, 22 bp, Homo sapiens
gctgcctcctgagatttgggca

SEQ ID NO: 7890948 - DNA, 22 bp, Homo sapiens
gctgcctctgcacagctcactc

SEQ ID NO: 7890949 - DNA, 22 bp, Homo sapiens
gctgcctctgcacagctcactc

SEQ ID NO: 7890950 - DNA, 22 bp, Homo sapiens
gctgcctctcctgagttgacag

SEQ ID NO: 7890951 - DNA, 22 bp, Homo sapiens
gctgcctctgcacagctcactc

SEQ ID NO: 7890952 - DNA, 22 bp, Homo sapiens
gctgcctctgcacagctcactc

SEQ ID NO: 7890953 - DNA, 22 bp, Homo sapiens
gctgcctctgcacagctcactc

SEQ ID NO: 7890954 - DNA, 22 bp, Homo sapiens
gctgcctctcctgagttgacag

SEQ ID NO: 7890955 - DNA, 22 bp, Homo sapiens
gctgcctctgcacagctcactc

SEQ ID NO: 7890956 - DNA, 22 bp, Homo sapiens
gctgcctctgtagctttggacc

SEQ ID NO: 7890957 - DNA, 22 bp, Homo sapiens
gctgcctctgtagctttggacc

SEQ ID NO: 7890958 - DNA, 22 bp, Homo sapiens
gctgcctctgcgactctgggcg

SEQ ID NO: 7890959 - DNA, 22 bp, Homo sapiens
gctgcctctgcgactctgggcg

SEQ ID NO: 7890960 - DNA, 22 bp, Homo sapiens
gctgcctctgcgactctgggcg

SEQ ID NO: 7890961 - DNA, 22 bp, Homo sapiens
gctgcctctgcacagctcactc

SEQ ID NO: 7890962 - DNA, 22 bp, Homo sapiens
gctgcctctgcgactctgggcg

SEQ ID NO: 7890963 - DNA, 22 bp, Homo sapiens
gctgcctctgcgactctgggcg

SEQ ID NO: 7890964 - DNA, 21 bp, Homo sapiens
gctgcagggcccagggcaccc

SEQ ID NO: 7890965 - DNA, 21 bp, Homo sapiens
gctgcagggcccagggcaccc

SEQ ID NO: 7890966 - DNA, 21 bp, Homo sapiens
gctgcagggcccagggcaccc

SEQ ID NO: 7890967 - DNA, 21 bp, Homo sapiens
gctgcagggcccagggcaccc

SEQ ID NO: 7890968 - DNA, 21 bp, Homo sapiens
gctgcagggcccagggcaccc

SEQ ID NO: 7890969 - DNA, 21 bp, Homo sapiens
gctgcagggcccagggcaccc

SEQ ID NO: 7890970 - DNA, 22 bp, Homo sapiens
gctgcagggagctggaaggctc

SEQ ID NO: 7890971 - DNA, 22 bp, Homo sapiens
gctgcagggagctggaaggctc

SEQ ID NO: 7890972 - DNA, 22 bp, Homo sapiens
gctgcagggagctggaaggctc

SEQ ID NO: 7890973 - DNA, 22 bp, Homo sapiens
gctgcagggctctcacaggggg

SEQ ID NO: 7890974 - DNA, 21 bp, Homo sapiens
gctgcagggcccagggcaccc

SEQ ID NO: 7890975 - DNA, 22 bp, Homo sapiens
gctgcagggctctcacaggggg

SEQ ID NO: 7890976 - DNA, 22 bp, Homo sapiens
gctgcagggctctcacaggggg

SEQ ID NO: 7890977 - DNA, 22 bp, Homo sapiens
gctgcagggctctcacaggggg

SEQ ID NO: 7890978 - DNA, 22 bp, Homo sapiens
gctgcagggctctcacaggggg

SEQ ID NO: 7890979 - DNA, 22 bp, Homo sapiens
gctgcaggggggtctggacttg

SEQ ID NO: 7890980 - DNA, 22 bp, Homo sapiens
gctgcaggggggtctggacttg

SEQ ID NO: 7890981 - DNA, 22 bp, Homo sapiens
gctgcaggggggtctggacttg

SEQ ID NO: 7890982 - DNA, 22 bp, Homo sapiens
gctgcaggggggtctggacttg

SEQ ID NO: 7890983 - DNA, 22 bp, Homo sapiens
gctgcaggggggtctggacttg

SEQ ID NO: 7890984 - DNA, 22 bp, Homo sapiens
gctgcaggcggccgtggtggcg

SEQ ID NO: 7890985 - DNA, 22 bp, Homo sapiens
gctgcaggcggccgtggtggcg

SEQ ID NO: 7890986 - DNA, 22 bp, Homo sapiens
gctgcaggcggccgtggtggcg

SEQ ID NO: 7890987 - DNA, 22 bp, Homo sapiens
gctgcaggcggccgtggtggcg

SEQ ID NO: 7890988 - DNA, 22 bp, Homo sapiens
gctgcaggcggccgtggtggcg

SEQ ID NO: 7890989 - DNA, 22 bp, Homo sapiens
gctgcaggctctgcaggaattg

SEQ ID NO: 7890990 - DNA, 22 bp, Homo sapiens
gctgcaggctctgcaggaattg

SEQ ID NO: 7890991 - DNA, 22 bp, Homo sapiens
gctgcaggctctgcaggaattg

SEQ ID NO: 7890992 - DNA, 22 bp, Homo sapiens
gctgcaggctctgcaggaattg

SEQ ID NO: 7890993 - DNA, 22 bp, Homo sapiens
gctgcaggctctgcaggaattg

SEQ ID NO: 7890994 - DNA, 22 bp, Homo sapiens
gctgcaggctgtggcaggggag

SEQ ID NO: 7890995 - DNA, 22 bp, Homo sapiens
gctgcaggctgtggcaggggag

SEQ ID NO: 7890996 - DNA, 22 bp, Homo sapiens
gctgcagggaatgtatggattt

SEQ ID NO: 7890997 - DNA, 22 bp, Homo sapiens
gctgcaggctgtggcaggggag

SEQ ID NO: 7890998 - DNA, 22 bp, Homo sapiens
gctgcaggctgtggcaggggag

SEQ ID NO: 7890999 - DNA, 22 bp, Homo sapiens
gctgcaggctgtggcaggggag

SEQ ID NO: 7891000 - DNA, 22 bp, Homo sapiens
gctgcaggctgtggcaggggag

SEQ ID NO: 7891001 - DNA, 22 bp, Homo sapiens
gctgcaggctgtggcaggggag

SEQ ID NO: 7891002 - DNA, 22 bp, Homo sapiens
gctgcaggctgtggcaggggag

SEQ ID NO: 7891003 - DNA, 22 bp, Homo sapiens
gctgcagggagctggaaggctc

SEQ ID NO: 7891004 - DNA, 22 bp, Homo sapiens
gctgcagggagctggaaggctc

SEQ ID NO: 7891005 - DNA, 22 bp, Homo sapiens
gctgcagggagctggaaggctc

SEQ ID NO: 7891006 - DNA, 22 bp, Homo sapiens
gctgcagggagctggaaggctc

SEQ ID NO: 7891007 - DNA, 22 bp, Homo sapiens
gctgcagggagctggaaggctc

SEQ ID NO: 7891008 - DNA, 22 bp, Homo sapiens
gctgcagggagctggaaggctc

SEQ ID NO: 7891009 - DNA, 22 bp, Homo sapiens
gctgcagggagctggaaggctc

SEQ ID NO: 7891010 - DNA, 22 bp, Homo sapiens
gctgcagggagctggaaggctc

SEQ ID NO: 7891011 - DNA, 22 bp, Homo sapiens
gctgcagggaatgtatggattt

SEQ ID NO: 7891012 - DNA, 17 bp, Homo sapiens
gctgagtgcagggagtc

SEQ ID NO: 7891013 - DNA, 22 bp, Homo sapiens
gctgagtgattcatacgctgct

SEQ ID NO: 7891014 - DNA, 22 bp, Homo sapiens
gctgagtgaggtccagagcttg

SEQ ID NO: 7891015 - DNA, 22 bp, Homo sapiens
gctgagtgaggtccagagcttg

SEQ ID NO: 7891016 - DNA, 22 bp, Homo sapiens
gctgagtgaggtccagagcttg

SEQ ID NO: 7891017 - DNA, 22 bp, Homo sapiens
gctgagtcttgcctgtgctgtc

SEQ ID NO: 7891018 - DNA, 22 bp, Homo sapiens
gctgagtgaggaaaaggttata

SEQ ID NO: 7891019 - DNA, 17 bp, Homo sapiens
gctgagtgcagggagtc

SEQ ID NO: 7891020 - DNA, 22 bp, Homo sapiens
gctgagtggagcagtcagcgct

SEQ ID NO: 7891021 - DNA, 22 bp, Homo sapiens
gctgagtggagcagtcagcgct

SEQ ID NO: 7891022 - DNA, 22 bp, Homo sapiens
gctgagtgtaatgatggcagag

SEQ ID NO: 7891023 - DNA, 22 bp, Homo sapiens
gctgagttgaaagcagaggata

SEQ ID NO: 7891024 - DNA, 22 bp, Homo sapiens
gctgagttgaaagcagaggata

SEQ ID NO: 7891025 - DNA, 22 bp, Homo sapiens
gctgagtgtaatgatggcagag

SEQ ID NO: 7891026 - DNA, 22 bp, Homo sapiens
gctgagttgaaagcagaggata

SEQ ID NO: 7891027 - DNA, 22 bp, Homo sapiens
gctgagtgtaatgatggcagag

SEQ ID NO: 7891028 - DNA, 22 bp, Homo sapiens
gctgagtgtaatgatggcagag

SEQ ID NO: 7891029 - DNA, 22 bp, Homo sapiens
gctgagtgtaatgatggcagag

SEQ ID NO: 7891030 - DNA, 18 bp, Homo sapiens
gctgcaggcgcctgcggt

SEQ ID NO: 7891031 - DNA, 18 bp, Homo sapiens
gctgcaggcgcctgcggt

SEQ ID NO: 7891032 - DNA, 18 bp, Homo sapiens
gctgcaggcgcctgcggt

SEQ ID NO: 7891033 - DNA, 18 bp, Homo sapiens
gctgcaggcgcctgcggt

SEQ ID NO: 7891034 - DNA, 22 bp, Homo sapiens
gctgcaggcgcctgcggtctct

SEQ ID NO: 7891035 - DNA, 22 bp, Homo sapiens
gctgcaggcgcctgcggtctct

SEQ ID NO: 7891036 - DNA, 22 bp, Homo sapiens
gctgcaggcgcctgcggtctct

SEQ ID NO: 7891037 - DNA, 22 bp, Homo sapiens
gctgcaggcgcctgcggtctct

SEQ ID NO: 7891038 - DNA, 18 bp, Homo sapiens
gctgcaggcgcctgcggt

SEQ ID NO: 7891039 - DNA, 18 bp, Homo sapiens
gctgcaggccctccgagg

SEQ ID NO: 7891040 - DNA, 22 bp, Homo sapiens
gctgataagagggcaatgagtg

SEQ ID NO: 7891041 - DNA, 22 bp, Homo sapiens
gctgataagaagacccatcctg

SEQ ID NO: 7891042 - DNA, 22 bp, Homo sapiens
gctgatagactgaatgttggga

SEQ ID NO: 7891043 - DNA, 22 bp, Homo sapiens
gctgatagactgaatgttggga

SEQ ID NO: 7891044 - DNA, 22 bp, Homo sapiens
gctgagttggagatcactttga

SEQ ID NO: 7891045 - DNA, 22 bp, Homo sapiens
gctgataaatagttgatgtacc

SEQ ID NO: 7891046 - DNA, 22 bp, Homo sapiens
gctgcaggcattttcctgggca

SEQ ID NO: 7891047 - DNA, 22 bp, Homo sapiens
gctgcaggcattttcctgggca

SEQ ID NO: 7891048 - DNA, 22 bp, Homo sapiens
gctgcaggcattttcctgggca

SEQ ID NO: 7891049 - DNA, 22 bp, Homo sapiens
gctgcaggcattttcctgggca

SEQ ID NO: 7891050 - DNA, 22 bp, Homo sapiens
gctgcaggcagaatctcccaat

SEQ ID NO: 7891051 - DNA, 22 bp, Homo sapiens
gctgcaggcagaatctcccaat

SEQ ID NO: 7891052 - DNA, 22 bp, Homo sapiens
gctgcaggcagaatctcccaat

SEQ ID NO: 7891053 - DNA, 22 bp, Homo sapiens
gctgagtcagattgcagtcttg

SEQ ID NO: 7891054 - DNA, 22 bp, Homo sapiens
gctgaggttttctgcctgctca

SEQ ID NO: 7891055 - DNA, 22 bp, Homo sapiens
gctgaggttttctgcctgctca

SEQ ID NO: 7891056 - DNA, 22 bp, Homo sapiens
gctgagtcagattgcagtcttg

SEQ ID NO: 7891057 - DNA, 22 bp, Homo sapiens
gctgagtcagattgcagtcttg

SEQ ID NO: 7891058 - DNA, 22 bp, Homo sapiens
gctgagtcttgagcactgagca

SEQ ID NO: 7891059 - DNA, 20 bp, Homo sapiens
gctgaggtttcttcctatat

SEQ ID NO: 7891060 - DNA, 22 bp, Homo sapiens
gctgaggtttcaggagtggcag

SEQ ID NO: 7891061 - DNA, 22 bp, Homo sapiens
gctgaggttttctgcctgctca

SEQ ID NO: 7891062 - DNA, 20 bp, Homo sapiens
gctgaggtttcttcctatat

SEQ ID NO: 7891063 - DNA, 22 bp, Homo sapiens
gctgaggtggtgatggttcatc

SEQ ID NO: 7891064 - DNA, 22 bp, Homo sapiens
gctgagggtctgttcatgttgc

SEQ ID NO: 7891065 - DNA, 22 bp, Homo sapiens
gctgaggtggctgccttagtaa

SEQ ID NO: 7891066 - DNA, 22 bp, Homo sapiens
gctgaggtggtgatggttcatc

SEQ ID NO: 7891067 - DNA, 22 bp, Homo sapiens
gctgaggtggctgccttagtaa

SEQ ID NO: 7891068 - DNA, 18 bp, Homo sapiens
gctgaggtggtgtcagag

SEQ ID NO: 7891069 - DNA, 18 bp, Homo sapiens
gctgaggtggtgtcagag

SEQ ID NO: 7891070 - DNA, 22 bp, Homo sapiens
gctgaggtgtcaccttgctggg

SEQ ID NO: 7891071 - DNA, 22 bp, Homo sapiens
gctgaggtgtcaccttgctggg

SEQ ID NO: 7891072 - DNA, 22 bp, Homo sapiens
gctgaggtgtcaccttgctggg

SEQ ID NO: 7891073 - DNA, 22 bp, Homo sapiens
gctgaggtttcaggagtggcag

SEQ ID NO: 7891074 - DNA, 20 bp, Homo sapiens
gctgaggggtctatggcata

SEQ ID NO: 7891075 - DNA, 20 bp, Homo sapiens
gctgaggggtctatggcata

SEQ ID NO: 7891076 - DNA, 22 bp, Homo sapiens
gctctgtgtccacagctggaaa

SEQ ID NO: 7891077 - DNA, 22 bp, Homo sapiens
gctgagggtaacacttcgggat

SEQ ID NO: 7891078 - DNA, 20 bp, Homo sapiens
gctgaggggtctatggcata

SEQ ID NO: 7891079 - DNA, 23 bp, Homo sapiens
gctgaggtacatttacaggaaga

SEQ ID NO: 7891080 - DNA, 22 bp, Homo sapiens
gctgagggtctgttcatgttgc

SEQ ID NO: 7891081 - DNA, 22 bp, Homo sapiens
gctgagggtaacacttcgggat

SEQ ID NO: 7891082 - DNA, 22 bp, Homo sapiens
gctctgtgtatgtggcaggtgc

SEQ ID NO: 7891083 - DNA, 22 bp, Homo sapiens
gctctgtgtatgtggcaggtgc

SEQ ID NO: 7891084 - DNA, 20 bp, Homo sapiens
gctctgtggtttgagtctcc

SEQ ID NO: 7891085 - DNA, 20 bp, Homo sapiens
gctctgtggtttgagtctcc

SEQ ID NO: 7891086 - DNA, 22 bp, Homo sapiens
gctctgtggcattcatgggcag

SEQ ID NO: 7891087 - DNA, 23 bp, Homo sapiens
gctgcctctgttggtcttcagtt

SEQ ID NO: 7891088 - DNA, 23 bp, Homo sapiens
gctgcctctgttggtcttcagtt

SEQ ID NO: 7891089 - DNA, 23 bp, Homo sapiens
gctgcctctgttggtcttcagtt

SEQ ID NO: 7891090 - DNA, 23 bp, Homo sapiens
gctgcctctgttggtcttcagtt

SEQ ID NO: 7891091 - DNA, 23 bp, Homo sapiens
gctgcctctgttggtcttcagtt

SEQ ID NO: 7891092 - DNA, 23 bp, Homo sapiens
gctgcctctgttggtcttcagtt

SEQ ID NO: 7891093 - DNA, 22 bp, Homo sapiens
gctgcctctgtagctttggacc

SEQ ID NO: 7891094 - DNA, 22 bp, Homo sapiens
gctgcctctgtagctttggacc

SEQ ID NO: 7891095 - DNA, 22 bp, Homo sapiens
gctgcctctgtagctttggacc

SEQ ID NO: 7891096 - DNA, 22 bp, Homo sapiens
gctgcctctgtagctttggacc

SEQ ID NO: 7891097 - DNA, 23 bp, Homo sapiens
gctgcctctgttggtcttcagtt

SEQ ID NO: 7891098 - DNA, 22 bp, Homo sapiens
gctgcctgaaatgttgcctagc

SEQ ID NO: 7891099 - DNA, 23 bp, Homo sapiens
gctgcctctgttggtcttcagtt

SEQ ID NO: 7891100 - DNA, 22 bp, Homo sapiens
gctgcctgaagtgtctacactg

SEQ ID NO: 7891101 - DNA, 22 bp, Homo sapiens
gctgcctgaagtgtctacactg

SEQ ID NO: 7891102 - DNA, 22 bp, Homo sapiens
gctgctggaagcatgcgatgaa

SEQ ID NO: 7891103 - DNA, 22 bp, Homo sapiens
gctgctggaagcatgcgatgaa

SEQ ID NO: 7891104 - DNA, 22 bp, Homo sapiens
gctgctggaagcatgcgatgaa

SEQ ID NO: 7891105 - DNA, 22 bp, Homo sapiens
gctgctggaacaaatcacccca

SEQ ID NO: 7891106 - DNA, 22 bp, Homo sapiens
gctgctggaacaaatcacccca

SEQ ID NO: 7891107 - DNA, 22 bp, Homo sapiens
gctgctgcttgaaggctcggag

SEQ ID NO: 7891108 - DNA, 22 bp, Homo sapiens
gctgctgcttgaaggctcggag

SEQ ID NO: 7891109 - DNA, 22 bp, Homo sapiens
gctgctggaacaaatcacccca

SEQ ID NO: 7891110 - DNA, 22 bp, Homo sapiens
gctgctggaacaaatcacccca

SEQ ID NO: 7891111 - DNA, 22 bp, Homo sapiens
gctgctggaagcatgcgatgaa

SEQ ID NO: 7891112 - DNA, 22 bp, Homo sapiens
gctgctggaagcatgcgatgaa

SEQ ID NO: 7891113 - DNA, 22 bp, Homo sapiens
gctgctggaagcatgcgatgaa

SEQ ID NO: 7891114 - DNA, 22 bp, Homo sapiens
gctgctggaagcatgcgatgaa

SEQ ID NO: 7891115 - DNA, 22 bp, Homo sapiens
gctgctggcgctgggcgtccgg

SEQ ID NO: 7891116 - DNA, 22 bp, Homo sapiens
gctgctggcgctgggcgtccgg

SEQ ID NO: 7891117 - DNA, 19 bp, Homo sapiens
gctgctggctctggctgga

SEQ ID NO: 7891118 - DNA, 19 bp, Homo sapiens
gctgctggctctggctgga

SEQ ID NO: 7891119 - DNA, 22 bp, Homo sapiens
gctgctggggtcacatggtaag

SEQ ID NO: 7891120 - DNA, 22 bp, Homo sapiens
gctgctggggtcacatggtaag

SEQ ID NO: 7891121 - DNA, 22 bp, Homo sapiens
gctgctggggtcacatggtaag

SEQ ID NO: 7891122 - DNA, 22 bp, Homo sapiens
gctgctggggtcacatggtaag

SEQ ID NO: 7891123 - DNA, 22 bp, Homo sapiens
gctgctggggtcacatggtaag

SEQ ID NO: 7891124 - DNA, 22 bp, Homo sapiens
gctgctgggggaacagttaaaa

SEQ ID NO: 7891125 - DNA, 22 bp, Homo sapiens
gctgctggggtcacatggtaag

SEQ ID NO: 7891126 - DNA, 22 bp, Homo sapiens
gctgctggggccttccctcggg

SEQ ID NO: 7891127 - DNA, 22 bp, Homo sapiens
gctgctggggccttccctcggg

SEQ ID NO: 7891128 - DNA, 22 bp, Homo sapiens
gctgctgggatcctgggtctca

SEQ ID NO: 7891129 - DNA, 22 bp, Homo sapiens
gctgctgggatcctgggtctca

SEQ ID NO: 7891130 - DNA, 22 bp, Homo sapiens
gctgctgggatcctgggtctca

SEQ ID NO: 7891131 - DNA, 22 bp, Homo sapiens
gctgctgggcaccccctgagct

SEQ ID NO: 7891132 - DNA, 22 bp, Homo sapiens
gctgctgggcaccccctgagct

SEQ ID NO: 7891133 - DNA, 22 bp, Homo sapiens
gctgctggggccttccctcggg

SEQ ID NO: 7891134 - DNA, 22 bp, Homo sapiens
gctgctggggccttccctcggg

SEQ ID NO: 7891135 - DNA, 22 bp, Homo sapiens
gctgctggggccttccctcggg

SEQ ID NO: 7891136 - DNA, 22 bp, Homo sapiens
gctgctgggcaccccctgagct

SEQ ID NO: 7891137 - DNA, 22 bp, Homo sapiens
gctgctgggcaccccctgagct

SEQ ID NO: 7891138 - DNA, 22 bp, Homo sapiens
gctgctgggcaccccctgagct

SEQ ID NO: 7891139 - DNA, 22 bp, Homo sapiens
gctgctgggcaccccctgagct

SEQ ID NO: 7891140 - DNA, 19 bp, Homo sapiens
gctgctggctctggctgga

SEQ ID NO: 7891141 - DNA, 19 bp, Homo sapiens
gctgctggctctggctgga

SEQ ID NO: 7891142 - DNA, 19 bp, Homo sapiens
gctgctggctctggctgga

SEQ ID NO: 7891143 - DNA, 19 bp, Homo sapiens
gctgctggctctggctgga

SEQ ID NO: 7891144 - DNA, 19 bp, Homo sapiens
gctgctggctctggctgga

SEQ ID NO: 7891145 - DNA, 19 bp, Homo sapiens
gctgctggctctggctgga

SEQ ID NO: 7891146 - DNA, 19 bp, Homo sapiens
gctgctggctctggctgga

SEQ ID NO: 7891147 - DNA, 22 bp, Homo sapiens
gctgctggcttcctgctgtttt

SEQ ID NO: 7891148 - DNA, 22 bp, Homo sapiens
gctgctggcttcctgctgtttt

SEQ ID NO: 7891149 - DNA, 22 bp, Homo sapiens
gctgctgggaatgaacagtgtt

SEQ ID NO: 7891150 - DNA, 22 bp, Homo sapiens
gctgctgggaatgaacagtgtt

SEQ ID NO: 7891151 - DNA, 22 bp, Homo sapiens
gctgctgggaatgaacagtgtt

SEQ ID NO: 7891152 - DNA, 22 bp, Homo sapiens
gctgctggcttcctgctgtttt

SEQ ID NO: 7891153 - DNA, 22 bp, Homo sapiens
gctgctggcttcctgctgtttt

SEQ ID NO: 7891154 - DNA, 22 bp, Homo sapiens
gctgctgggaatgaacagtgtt

SEQ ID NO: 7891155 - DNA, 22 bp, Homo sapiens
gctgctgggatcctgggtctca

SEQ ID NO: 7891156 - DNA, 22 bp, Homo sapiens
gctgctgggatcctgggtctca

SEQ ID NO: 7891157 - DNA, 22 bp, Homo sapiens
gctgctgggaatgaacagtgtt

SEQ ID NO: 7891158 - DNA, 22 bp, Homo sapiens
gctgctgggagggatcgtaaat

SEQ ID NO: 7891159 - DNA, 22 bp, Homo sapiens
gctgctgggaatgaacagtgtt

SEQ ID NO: 7891160 - DNA, 22 bp, Homo sapiens
gctgctgggaatgaacagtgtt

SEQ ID NO: 7891161 - DNA, 22 bp, Homo sapiens
gctgctgggaatgaacagtgtt

SEQ ID NO: 7891162 - DNA, 22 bp, Homo sapiens
gctgctggtcctcagagctcat

SEQ ID NO: 7891163 - DNA, 22 bp, Homo sapiens
gctgctggtcctcagagctcat

SEQ ID NO: 7891164 - DNA, 22 bp, Homo sapiens
gctgctggtcctcagagctcat

SEQ ID NO: 7891165 - DNA, 22 bp, Homo sapiens
gctgctggtcctcagagctcat

SEQ ID NO: 7891166 - DNA, 22 bp, Homo sapiens
gctgctggtcctcagagctcat

SEQ ID NO: 7891167 - DNA, 22 bp, Homo sapiens
gctgctggtcctcagagctcat

SEQ ID NO: 7891168 - DNA, 22 bp, Homo sapiens
gctgctggtcctcagagctcat

SEQ ID NO: 7891169 - DNA, 18 bp, Homo sapiens
gctgctggtggagggagc

SEQ ID NO: 7891170 - DNA, 18 bp, Homo sapiens
gctgctggtggagggagc

SEQ ID NO: 7891171 - DNA, 22 bp, Homo sapiens
gctgctggtcctcagagctcat

SEQ ID NO: 7891172 - DNA, 22 bp, Homo sapiens
gctgctggtcctcagagctcat

SEQ ID NO: 7891173 - DNA, 22 bp, Homo sapiens
gctgctggtcctcagagctcat

SEQ ID NO: 7891174 - DNA, 22 bp, Homo sapiens
gctgctgggtccctctgtgcca

SEQ ID NO: 7891175 - DNA, 22 bp, Homo sapiens
gctgctgggtccctctgtgcca

SEQ ID NO: 7891176 - DNA, 22 bp, Homo sapiens
gctgctgggtccctctgtgcca

SEQ ID NO: 7891177 - DNA, 22 bp, Homo sapiens
gctgctgggtccctctgtgcca

SEQ ID NO: 7891178 - DNA, 22 bp, Homo sapiens
gctgctggtcctcagagctcat

SEQ ID NO: 7891179 - DNA, 22 bp, Homo sapiens
gctgctggggtggagaaacgct

SEQ ID NO: 7891180 - DNA, 22 bp, Homo sapiens
gctgctggggtggagaaacgct

SEQ ID NO: 7891181 - DNA, 22 bp, Homo sapiens
gctgctgggtccctctgtgcca

SEQ ID NO: 7891182 - DNA, 22 bp, Homo sapiens
gctgctgggtccctctgtgcca

SEQ ID NO: 7891183 - DNA, 22 bp, Homo sapiens
gctgctgggtccctctgtgcca

SEQ ID NO: 7891184 - DNA, 22 bp, Homo sapiens
gctgctgggtccctctgtgcca

SEQ ID NO: 7891185 - DNA, 18 bp, Homo sapiens
gctgctggtggagggagc

SEQ ID NO: 7891186 - DNA, 18 bp, Homo sapiens
gctgctggtggagggagc

SEQ ID NO: 7891187 - DNA, 18 bp, Homo sapiens
gctgctggtggagggagc

SEQ ID NO: 7891188 - DNA, 22 bp, Homo sapiens
gctgctgtaatgtgttaagtca

SEQ ID NO: 7891189 - DNA, 22 bp, Homo sapiens
gctgctgtcacccacatctgtc

SEQ ID NO: 7891190 - DNA, 22 bp, Homo sapiens
gctgctgtcacggtgctaaggg

SEQ ID NO: 7891191 - DNA, 22 bp, Homo sapiens
gctgctgtcacggtgctaaggg

SEQ ID NO: 7891192 - DNA, 22 bp, Homo sapiens
gctgctgtctcatgcgatgcgg

SEQ ID NO: 7891193 - DNA, 22 bp, Homo sapiens
gctggagctgcagcctgggcct

SEQ ID NO: 7891194 - DNA, 22 bp, Homo sapiens
gctggagctgcagcctgggcct

SEQ ID NO: 7891195 - DNA, 22 bp, Homo sapiens
gctggagcttgagaggacaggg

SEQ ID NO: 7891196 - DNA, 22 bp, Homo sapiens
gctgctgtcagtggtggcagtt

SEQ ID NO: 7891197 - DNA, 22 bp, Homo sapiens
gctgctgtcagtggtggcagtt

SEQ ID NO: 7891198 - DNA, 22 bp, Homo sapiens
gctgctgtcagtggtggcagtt

SEQ ID NO: 7891199 - DNA, 22 bp, Homo sapiens
gctggaggggtaataggatggg

SEQ ID NO: 7891200 - DNA, 22 bp, Homo sapiens
gctggaggggtaataggatggg

SEQ ID NO: 7891201 - DNA, 22 bp, Homo sapiens
gctggaggggtaataggatggg

SEQ ID NO: 7891202 - DNA, 22 bp, Homo sapiens
gctggaggggtaataggatggg

SEQ ID NO: 7891203 - DNA, 22 bp, Homo sapiens
gctggaggggtaataggatggg

SEQ ID NO: 7891204 - DNA, 22 bp, Homo sapiens
gctggaggggtaataggatggg

SEQ ID NO: 7891205 - DNA, 22 bp, Homo sapiens
gctggagcttgagaggacaggg

SEQ ID NO: 7891206 - DNA, 22 bp, Homo sapiens
gctggagcttgagaggacaggg

SEQ ID NO: 7891207 - DNA, 22 bp, Homo sapiens
gctggaggggtaataggatggg

SEQ ID NO: 7891208 - DNA, 22 bp, Homo sapiens
gctggagcttgagaggacaggg

SEQ ID NO: 7891209 - DNA, 22 bp, Homo sapiens
gctggagcttgagaggacaggg

SEQ ID NO: 7891210 - DNA, 22 bp, Homo sapiens
gctggagcttgagaggacaggg

SEQ ID NO: 7891211 - DNA, 22 bp, Homo sapiens
gctggagcttgagaggacaggg

SEQ ID NO: 7891212 - DNA, 22 bp, Homo sapiens
gctggagcttgagaggacaggg

SEQ ID NO: 7891213 - DNA, 22 bp, Homo sapiens
gctggcaggtccaagatagagc

SEQ ID NO: 7891214 - DNA, 22 bp, Homo sapiens
gctggcaggtaaagccccgggg

SEQ ID NO: 7891215 - DNA, 22 bp, Homo sapiens
gctggcaggtccaagatagagc

SEQ ID NO: 7891216 - DNA, 22 bp, Homo sapiens
gctggcaggtccaagatagagc

SEQ ID NO: 7891217 - DNA, 22 bp, Homo sapiens
gctggcagggttctcactgaaa

SEQ ID NO: 7891218 - DNA, 22 bp, Homo sapiens
gctggcagggttctcactgaaa

SEQ ID NO: 7891219 - DNA, 22 bp, Homo sapiens
gctggcagggttctcactgaaa

SEQ ID NO: 7891220 - DNA, 22 bp, Homo sapiens
gctggcaggtaaagccccgggg

SEQ ID NO: 7891221 - DNA, 22 bp, Homo sapiens
gctggcaggtaaagccccgggg

SEQ ID NO: 7891222 - DNA, 22 bp, Homo sapiens
gctggcaggtaaagccccgggg

SEQ ID NO: 7891223 - DNA, 22 bp, Homo sapiens
gctggcaggtaaagccccgggg

SEQ ID NO: 7891224 - DNA, 22 bp, Homo sapiens
gctggcagggttctcactgaaa

SEQ ID NO: 7891225 - DNA, 22 bp, Homo sapiens
gctggatcatatggtggttcta

SEQ ID NO: 7891226 - DNA, 22 bp, Homo sapiens
gctggcagggtggttgagagag

SEQ ID NO: 7891227 - DNA, 22 bp, Homo sapiens
gctggcagggtggttgagagag

SEQ ID NO: 7891228 - DNA, 22 bp, Homo sapiens
gctggatccctgtgggagtggt

SEQ ID NO: 7891229 - DNA, 22 bp, Homo sapiens
gctggatccctgtgggagtggt

SEQ ID NO: 7891230 - DNA, 22 bp, Homo sapiens
gctggatcctgattcgtctttg

SEQ ID NO: 7891231 - DNA, 22 bp, Homo sapiens
gctggcagggtggttgagagag

SEQ ID NO: 7891232 - DNA, 22 bp, Homo sapiens
gctggcagggtggttgagagag

SEQ ID NO: 7891233 - DNA, 22 bp, Homo sapiens
gctggcagggtggttgagagag

SEQ ID NO: 7891234 - DNA, 22 bp, Homo sapiens
gctggagttggcaaggcatgta

SEQ ID NO: 7891235 - DNA, 22 bp, Homo sapiens
gctggatccacaaataactttg

SEQ ID NO: 7891236 - DNA, 22 bp, Homo sapiens
gctggatcaagtccttcaccca

SEQ ID NO: 7891237 - DNA, 22 bp, Homo sapiens
gctggatcaagtccttcaccca

SEQ ID NO: 7891238 - DNA, 22 bp, Homo sapiens
gctggagttggcaaggcatgta

SEQ ID NO: 7891239 - DNA, 22 bp, Homo sapiens
gctggagttggcaaggcatgta

SEQ ID NO: 7891240 - DNA, 22 bp, Homo sapiens
gctggagttggcaaggcatgta

SEQ ID NO: 7891241 - DNA, 22 bp, Homo sapiens
gctggagttggcaaggcatgta

SEQ ID NO: 7891242 - DNA, 22 bp, Homo sapiens
gctggcagtgtgaatgacaagc

SEQ ID NO: 7891243 - DNA, 22 bp, Homo sapiens
gctggcagtttcctcaccgagg

SEQ ID NO: 7891244 - DNA, 22 bp, Homo sapiens
gctggcagtttcctcaccgagg

SEQ ID NO: 7891245 - DNA, 22 bp, Homo sapiens
gctggcagtgtgaatgacaagc

SEQ ID NO: 7891246 - DNA, 22 bp, Homo sapiens
gctggcagtgtattgttagctg

SEQ ID NO: 7891247 - DNA, 22 bp, Homo sapiens
gctggcagtgtgaatgacaagc

SEQ ID NO: 7891248 - DNA, 22 bp, Homo sapiens
gctggcagtgtgaatgacaagc

SEQ ID NO: 7891249 - DNA, 22 bp, Homo sapiens
gctggcagtttcctcaccgagg

SEQ ID NO: 7891250 - DNA, 22 bp, Homo sapiens
gctggcatggagactctgggtc

SEQ ID NO: 7891251 - DNA, 22 bp, Homo sapiens
gctggcattacaggagagaacc

SEQ ID NO: 7891252 - DNA, 22 bp, Homo sapiens
gctggcattacaggagagaacc

SEQ ID NO: 7891253 - DNA, 22 bp, Homo sapiens
gctggccaaagtgtacctggag

SEQ ID NO: 7891254 - DNA, 22 bp, Homo sapiens
gctggccaaagtgtacctggag

SEQ ID NO: 7891255 - DNA, 22 bp, Homo sapiens
gctggccaaagtgtacctggag

SEQ ID NO: 7891256 - DNA, 22 bp, Homo sapiens
gctggcagtgtattgttagctg

SEQ ID NO: 7891257 - DNA, 22 bp, Homo sapiens
gctggcagtgtattgttagctg

SEQ ID NO: 7891258 - DNA, 22 bp, Homo sapiens
gctggcagtcccatcagctggg

SEQ ID NO: 7891259 - DNA, 22 bp, Homo sapiens
gctggcagtcccatcagctggg

SEQ ID NO: 7891260 - DNA, 22 bp, Homo sapiens
gctggcagtcccatcagctggg

SEQ ID NO: 7891261 - DNA, 22 bp, Homo sapiens
gctggcagtcccatcagctggg

SEQ ID NO: 7891262 - DNA, 22 bp, Homo sapiens
gctggcagtcccatcagctggg

SEQ ID NO: 7891263 - DNA, 22 bp, Homo sapiens
gctggcagtcccatcagctggg

SEQ ID NO: 7891264 - DNA, 22 bp, Homo sapiens
gctggcagtaaagggtttggca

SEQ ID NO: 7891265 - DNA, 22 bp, Homo sapiens
gctggcagtaaagggtttggca

SEQ ID NO: 7891266 - DNA, 22 bp, Homo sapiens
gctggcaggtccaagatagagc

SEQ ID NO: 7891267 - DNA, 22 bp, Homo sapiens
gctggcagtaaagggtttggca

SEQ ID NO: 7891268 - DNA, 22 bp, Homo sapiens
gctggaggtagggaggtcctgt

SEQ ID NO: 7891269 - DNA, 22 bp, Homo sapiens
gctggaggtagggaggtcctgt

SEQ ID NO: 7891270 - DNA, 22 bp, Homo sapiens
gctggaggtagggaggtcctgt

SEQ ID NO: 7891271 - DNA, 22 bp, Homo sapiens
gctggaggtagggaggtcctgt

SEQ ID NO: 7891272 - DNA, 22 bp, Homo sapiens
gctggaggtggtgagaaaaggt

SEQ ID NO: 7891273 - DNA, 22 bp, Homo sapiens
gctggaggtggtgagaaaaggt

SEQ ID NO: 7891274 - DNA, 22 bp, Homo sapiens
gctggaggtggtgagaaaaggt

SEQ ID NO: 7891275 - DNA, 22 bp, Homo sapiens
gctggaggtggtgagaaaaggt

SEQ ID NO: 7891276 - DNA, 22 bp, Homo sapiens
gctggaggtggtgagaaaaggt

SEQ ID NO: 7891277 - DNA, 22 bp, Homo sapiens
gctggaggtttcacctgagttt

SEQ ID NO: 7891278 - DNA, 22 bp, Homo sapiens
gctggaggtttcacctgagttt

SEQ ID NO: 7891279 - DNA, 22 bp, Homo sapiens
gctggaggtttcacctgagttt

SEQ ID NO: 7891280 - DNA, 22 bp, Homo sapiens
gctggagtaggaccatgcttga

SEQ ID NO: 7891281 - DNA, 22 bp, Homo sapiens
gctggagtccagtggcatgatc

SEQ ID NO: 7891282 - DNA, 22 bp, Homo sapiens
gctggagtccagtggcatgatc

SEQ ID NO: 7891283 - DNA, 22 bp, Homo sapiens
gctggagtccagtggcatgatc

SEQ ID NO: 7891284 - DNA, 22 bp, Homo sapiens
gctggagtatctggggaaggag

SEQ ID NO: 7891285 - DNA, 22 bp, Homo sapiens
gctggagtatctggggaaggag

SEQ ID NO: 7891286 - DNA, 19 bp, Homo sapiens
gctggagtcacttttgaga

SEQ ID NO: 7891287 - DNA, 22 bp, Homo sapiens
gctggagtgagtatgtgtagtc

SEQ ID NO: 7891288 - DNA, 22 bp, Homo sapiens
gctggagtgatgcctgtgtctc

SEQ ID NO: 7891289 - DNA, 22 bp, Homo sapiens
gctggagtcttgaaagtggact

SEQ ID NO: 7891290 - DNA, 22 bp, Homo sapiens
gctggagtcttgaaagtggact

SEQ ID NO: 7891291 - DNA, 22 bp, Homo sapiens
gctggagtctggaggtgtgcca

SEQ ID NO: 7891292 - DNA, 22 bp, Homo sapiens
gctggagtctggaggtgtgcca

SEQ ID NO: 7891293 - DNA, 16 bp, Homo sapiens
gctggagtcctggagc

SEQ ID NO: 7891294 - DNA, 22 bp, Homo sapiens
gctggagtccagtggtatgatc

SEQ ID NO: 7891295 - DNA, 22 bp, Homo sapiens
gctggagttaggtgggcttgaa

SEQ ID NO: 7891296 - DNA, 22 bp, Homo sapiens
gctggagttaggtgggcttgaa

SEQ ID NO: 7891297 - DNA, 22 bp, Homo sapiens
gctggagttagaactagcctgg

SEQ ID NO: 7891298 - DNA, 22 bp, Homo sapiens
gctggagtgctggagtgcagtg

SEQ ID NO: 7891299 - DNA, 22 bp, Homo sapiens
gctggagtgctggagtgcagtg

SEQ ID NO: 7891300 - DNA, 22 bp, Homo sapiens
gctggagtgctggagtgcagtg

SEQ ID NO: 7891301 - DNA, 22 bp, Homo sapiens
gctggagttagaactagcctgg

SEQ ID NO: 7891302 - DNA, 22 bp, Homo sapiens
gctggagtgcagttgcacagtc

SEQ ID NO: 7891303 - DNA, 22 bp, Homo sapiens
gctggagtgatgcctgtgtctc

SEQ ID NO: 7891304 - DNA, 22 bp, Homo sapiens
gctggagtgctgaggtgcagtg

SEQ ID NO: 7891305 - DNA, 22 bp, Homo sapiens
gctggagtgctgaggtgcagtg

SEQ ID NO: 7891306 - DNA, 22 bp, Homo sapiens
gctggagtgctggagtgcagtg

SEQ ID NO: 7891307 - DNA, 22 bp, Homo sapiens
gctggagtgctgaggtgcagtg

SEQ ID NO: 7891308 - DNA, 22 bp, Homo sapiens
gctctctgcctttctcaatgac

SEQ ID NO: 7891309 - DNA, 22 bp, Homo sapiens
gctctctgcctttctcaatgac

SEQ ID NO: 7891310 - DNA, 22 bp, Homo sapiens
gctctctgccatatgaggatac

SEQ ID NO: 7891311 - DNA, 22 bp, Homo sapiens
gctctctgccatatgaggatac

SEQ ID NO: 7891312 - DNA, 22 bp, Homo sapiens
gctctctggaaggtatcattat

SEQ ID NO: 7891313 - DNA, 22 bp, Homo sapiens
gctctctggaaggtatcattat

SEQ ID NO: 7891314 - DNA, 22 bp, Homo sapiens
gctctctggaaggtatcattat

SEQ ID NO: 7891315 - DNA, 22 bp, Homo sapiens
gctctctggaggccatggacag

SEQ ID NO: 7891316 - DNA, 22 bp, Homo sapiens
gctctctggaggccatggacag

SEQ ID NO: 7891317 - DNA, 22 bp, Homo sapiens
gctctctggaggccatggacag

SEQ ID NO: 7891318 - DNA, 22 bp, Homo sapiens
gctctctggttccagtcaggaa

SEQ ID NO: 7891319 - DNA, 22 bp, Homo sapiens
gctctctggttccagtcaggaa

SEQ ID NO: 7891320 - DNA, 22 bp, Homo sapiens
gctctctggttccagtcaggaa

SEQ ID NO: 7891321 - DNA, 22 bp, Homo sapiens
gctctctgggtgtgtctagata

SEQ ID NO: 7891322 - DNA, 22 bp, Homo sapiens
gctctctggctagtccatcggg

SEQ ID NO: 7891323 - DNA, 22 bp, Homo sapiens
gctctctggctagtccatcggg

SEQ ID NO: 7891324 - DNA, 22 bp, Homo sapiens
gctctctgggcgggagctaaga

SEQ ID NO: 7891325 - DNA, 22 bp, Homo sapiens
gctctctgggtggtgggcaaca

SEQ ID NO: 7891326 - DNA, 22 bp, Homo sapiens
gctctctgggtggtgggcaaca

SEQ ID NO: 7891327 - DNA, 22 bp, Homo sapiens
gctctgggtagccactgcctgg

SEQ ID NO: 7891328 - DNA, 22 bp, Homo sapiens
gctctgggtagccactgcctgg

SEQ ID NO: 7891329 - DNA, 22 bp, Homo sapiens
gctctgggtagccactgcctgg

SEQ ID NO: 7891330 - DNA, 22 bp, Homo sapiens
gctctgggtagccactgcctgg

SEQ ID NO: 7891331 - DNA, 22 bp, Homo sapiens
gctctgggtagccactgcctgg

SEQ ID NO: 7891332 - DNA, 21 bp, Homo sapiens
gctctgtacgttggtgccttc

SEQ ID NO: 7891333 - DNA, 22 bp, Homo sapiens
gctctgtagtatttagtaaata

SEQ ID NO: 7891334 - DNA, 22 bp, Homo sapiens
gctctggttctcttagagtagt

SEQ ID NO: 7891335 - DNA, 22 bp, Homo sapiens
gctctggtttcctgttcactca

SEQ ID NO: 7891336 - DNA, 22 bp, Homo sapiens
gctctggttttagcctttcagg

SEQ ID NO: 7891337 - DNA, 22 bp, Homo sapiens
gctctggggttggaaagtgatc

SEQ ID NO: 7891338 - DNA, 22 bp, Homo sapiens
gctctcttggtggctgtcctgg

SEQ ID NO: 7891339 - DNA, 22 bp, Homo sapiens
gctctggggttggaaagtgatc

SEQ ID NO: 7891340 - DNA, 22 bp, Homo sapiens
gctctcttggtggctgtcctgg

SEQ ID NO: 7891341 - DNA, 22 bp, Homo sapiens
gctctcttgacagcttgctgtt

SEQ ID NO: 7891342 - DNA, 22 bp, Homo sapiens
gctctcttgacagcttgctgtt

SEQ ID NO: 7891343 - DNA, 22 bp, Homo sapiens
gctctctgttattaagatcttt

SEQ ID NO: 7891344 - DNA, 22 bp, Homo sapiens
gctctctgttattaagatcttt

SEQ ID NO: 7891345 - DNA, 22 bp, Homo sapiens
gctctctgtcgttatgcttcat

SEQ ID NO: 7891346 - DNA, 22 bp, Homo sapiens
gctctctgtcgttatgcttcat

SEQ ID NO: 7891347 - DNA, 21 bp, Homo sapiens
gctctgtccctgctgtgtgtc

SEQ ID NO: 7891348 - DNA, 21 bp, Homo sapiens
gctctgtccctgctgtgtgtc

SEQ ID NO: 7891349 - DNA, 22 bp, Homo sapiens
gctctgtcttcagcacacagta

SEQ ID NO: 7891350 - DNA, 22 bp, Homo sapiens
gctctgtcttcagcacacagta

SEQ ID NO: 7891351 - DNA, 22 bp, Homo sapiens
gctctgtcattttgcagacact

SEQ ID NO: 7891352 - DNA, 22 bp, Homo sapiens
gctctgtcattttgcagacact

SEQ ID NO: 7891353 - DNA, 22 bp, Homo sapiens
gctctgtcattttgcagacact

SEQ ID NO: 7891354 - DNA, 22 bp, Homo sapiens
gctctgtcaacagctagctgtg

SEQ ID NO: 7891355 - DNA, 22 bp, Homo sapiens
gctctgtccagcgtgcacagaa

SEQ ID NO: 7891356 - DNA, 22 bp, Homo sapiens
gctctgtccagcgtgcacagaa

SEQ ID NO: 7891357 - DNA, 22 bp, Homo sapiens
gctctgtcaacagctagctgtg

SEQ ID NO: 7891358 - DNA, 22 bp, Homo sapiens
gctctgtcaacagctagctgtg

SEQ ID NO: 7891359 - DNA, 22 bp, Homo sapiens
gctctgtatgtagttcttgctt

SEQ ID NO: 7891360 - DNA, 22 bp, Homo sapiens
gctctgtgaccttaggcaagtt

SEQ ID NO: 7891361 - DNA, 22 bp, Homo sapiens
gctctgtgaccttaggcaagtt

SEQ ID NO: 7891362 - DNA, 22 bp, Homo sapiens
gctctgtgagccacttgatgta

SEQ ID NO: 7891363 - DNA, 22 bp, Homo sapiens
gctctgtgagccacttgatgta

SEQ ID NO: 7891364 - DNA, 22 bp, Homo sapiens
gctctgtgagtattggccctgg

SEQ ID NO: 7891365 - DNA, 22 bp, Homo sapiens
gctctgtgagtattggccctgg

SEQ ID NO: 7891366 - DNA, 22 bp, Homo sapiens
gctctgtgagtattggccctgg

SEQ ID NO: 7891367 - DNA, 19 bp, Homo sapiens
gctctgtgatgctgagggg

SEQ ID NO: 7891368 - DNA, 22 bp, Homo sapiens
gctctgtggcaggaggtcttgt

SEQ ID NO: 7891369 - DNA, 20 bp, Homo sapiens
gctctgtgctggcggaggct

SEQ ID NO: 7891370 - DNA, 22 bp, Homo sapiens
gctctgtgctagaactaagaat

SEQ ID NO: 7891371 - DNA, 20 bp, Homo sapiens
gctctgtgctggcggaggct

SEQ ID NO: 7891372 - DNA, 22 bp, Homo sapiens
gctctgtgcccctgccgtggac

SEQ ID NO: 7891373 - DNA, 22 bp, Homo sapiens
gctctgtgccagggctgggcca

SEQ ID NO: 7891374 - DNA, 22 bp, Homo sapiens
gctctgtgcccctgccgtggac

SEQ ID NO: 7891375 - DNA, 19 bp, Homo sapiens
gctctgtgatgctgagggg

SEQ ID NO: 7891376 - DNA, 19 bp, Homo sapiens
gctctgtgatgctgagggg

SEQ ID NO: 7891377 - DNA, 19 bp, Homo sapiens
gctctgtgatgctgagggg

SEQ ID NO: 7891378 - DNA, 19 bp, Homo sapiens
gctctgtgatgctgagggg

SEQ ID NO: 7891379 - DNA, 22 bp, Homo sapiens
gctctgtgccacatgcagtgtt

SEQ ID NO: 7891380 - DNA, 22 bp, Homo sapiens
gctctgtgccacatgcagtgtt

SEQ ID NO: 7891381 - DNA, 22 bp, Homo sapiens
gctctgtgcagttcagggacac

SEQ ID NO: 7891382 - DNA, 22 bp, Homo sapiens
gctctgtgcagttcagggacac

SEQ ID NO: 7891383 - DNA, 22 bp, Homo sapiens
gctctgtgccacatgcagtgtt

SEQ ID NO: 7891384 - DNA, 22 bp, Homo sapiens
gctccccttggtcctcctggga

SEQ ID NO: 7891385 - DNA, 20 bp, Homo sapiens
gctccccttctctgggcctc

SEQ ID NO: 7891386 - DNA, 22 bp, Homo sapiens
gctccccattgatctgcaggct

SEQ ID NO: 7891387 - DNA, 22 bp, Homo sapiens
gctccccattgatctgcaggct

SEQ ID NO: 7891388 - DNA, 22 bp, Homo sapiens
gctccccattgatctgcaggct

SEQ ID NO: 7891389 - DNA, 22 bp, Homo sapiens
gctccccattgatctgcaggct

SEQ ID NO: 7891390 - DNA, 22 bp, Homo sapiens
gctccccattgatctgcaggct

SEQ ID NO: 7891391 - DNA, 22 bp, Homo sapiens
gctccccattgatctgcaggct

SEQ ID NO: 7891392 - DNA, 22 bp, Homo sapiens
gctccccattgatctgcaggct

SEQ ID NO: 7891393 - DNA, 22 bp, Homo sapiens
gctccctccatgaggcagaccg

SEQ ID NO: 7891394 - DNA, 22 bp, Homo sapiens
gctccctcatctgtgctgtttt

SEQ ID NO: 7891395 - DNA, 22 bp, Homo sapiens
gctccctccatgaggcagaccg

SEQ ID NO: 7891396 - DNA, 22 bp, Homo sapiens
gctccctcatctgtgctgtttt

SEQ ID NO: 7891397 - DNA, 22 bp, Homo sapiens
gctccctaatttgttaatgctg

SEQ ID NO: 7891398 - DNA, 22 bp, Homo sapiens
gctccctatttggccttctctg

SEQ ID NO: 7891399 - DNA, 22 bp, Homo sapiens
gctccctccatgaggcagaccg

SEQ ID NO: 7891400 - DNA, 22 bp, Homo sapiens
gctccctccatgaggcagaccg

SEQ ID NO: 7891401 - DNA, 22 bp, Homo sapiens
gctccctcccaccagcctgcag

SEQ ID NO: 7891402 - DNA, 22 bp, Homo sapiens
gctccctcccaccagcctgcag

SEQ ID NO: 7891403 - DNA, 22 bp, Homo sapiens
gctccctcccaccagcctgcag

SEQ ID NO: 7891404 - DNA, 22 bp, Homo sapiens
gctccctcccaccagcctgcag

SEQ ID NO: 7891405 - DNA, 22 bp, Homo sapiens
gctccctcccaccagcctgcag

SEQ ID NO: 7891406 - DNA, 22 bp, Homo sapiens
gctccctcccaccagcctgcag

SEQ ID NO: 7891407 - DNA, 22 bp, Homo sapiens
gctccctcccaccagcctgcag

SEQ ID NO: 7891408 - DNA, 22 bp, Homo sapiens
gctcccaggaagagaagggcca

SEQ ID NO: 7891409 - DNA, 22 bp, Homo sapiens
gctcccaggatgaggagccagg

SEQ ID NO: 7891410 - DNA, 22 bp, Homo sapiens
gctcccaggatgaggagccagg

SEQ ID NO: 7891411 - DNA, 22 bp, Homo sapiens
gctcccaggaagagaagggcca

SEQ ID NO: 7891412 - DNA, 22 bp, Homo sapiens
gctcccaggatgaggagccagg

SEQ ID NO: 7891413 - DNA, 22 bp, Homo sapiens
gctcccaggatgaggagccagg

SEQ ID NO: 7891414 - DNA, 22 bp, Homo sapiens
gctcccagctggagcctcaaca

SEQ ID NO: 7891415 - DNA, 22 bp, Homo sapiens
gctcccagctggagcctcaaca

SEQ ID NO: 7891416 - DNA, 22 bp, Homo sapiens
gctcccagctggagcctcaaca

SEQ ID NO: 7891417 - DNA, 22 bp, Homo sapiens
gctcccagctggagcctcaaca

SEQ ID NO: 7891418 - DNA, 22 bp, Homo sapiens
gctcccagctggagcctcaaca

SEQ ID NO: 7891419 - DNA, 20 bp, Homo sapiens
gctcccagcctgcagtcccc

SEQ ID NO: 7891420 - DNA, 22 bp, Homo sapiens
gctcccagcattgctgctgaat

SEQ ID NO: 7891421 - DNA, 22 bp, Homo sapiens
gctcccagcattgctgctgaat

SEQ ID NO: 7891422 - DNA, 22 bp, Homo sapiens
gctcccagcattgctgctgaat

SEQ ID NO: 7891423 - DNA, 22 bp, Homo sapiens
gctcccagcattgcttcccagg

SEQ ID NO: 7891424 - DNA, 20 bp, Homo sapiens
gctcccagcctgcagtcccc

SEQ ID NO: 7891425 - DNA, 20 bp, Homo sapiens
gctcccagcctgcagtcccc

SEQ ID NO: 7891426 - DNA, 20 bp, Homo sapiens
gctcccagcctgcagtcccc

SEQ ID NO: 7891427 - DNA, 20 bp, Homo sapiens
gctcccagcctgcagtcccc

SEQ ID NO: 7891428 - DNA, 22 bp, Homo sapiens
gctcccagcattgcttcccagg

SEQ ID NO: 7891429 - DNA, 22 bp, Homo sapiens
gctcccagcattgcttcccagg

SEQ ID NO: 7891430 - DNA, 22 bp, Homo sapiens
gctcccagcattgcttcccagg

SEQ ID NO: 7891431 - DNA, 20 bp, Homo sapiens
gctcccagcctgcagtcccc

SEQ ID NO: 7891432 - DNA, 22 bp, Homo sapiens
gctctctgcagcctccttggag

SEQ ID NO: 7891433 - DNA, 22 bp, Homo sapiens
gctctctgcagcctccttggag

SEQ ID NO: 7891434 - DNA, 21 bp, Homo sapiens
gctctctgcatggtggctcag

SEQ ID NO: 7891435 - DNA, 22 bp, Homo sapiens
gctctctgaggtgctggcagag

SEQ ID NO: 7891436 - DNA, 22 bp, Homo sapiens
gctctctgaggtgctggcagag

SEQ ID NO: 7891437 - DNA, 22 bp, Homo sapiens
gctctctgcaagtcagcagcct

SEQ ID NO: 7891438 - DNA, 22 bp, Homo sapiens
gctctctgcaagtcagcagcct

SEQ ID NO: 7891439 - DNA, 22 bp, Homo sapiens
gctctctccctaggcaagtgag

SEQ ID NO: 7891440 - DNA, 22 bp, Homo sapiens
gctctcctgtgcagatgctgct

SEQ ID NO: 7891441 - DNA, 22 bp, Homo sapiens
gctctctccctaggcaagtgag

SEQ ID NO: 7891442 - DNA, 22 bp, Homo sapiens
gctctctaattaagcattgtat

SEQ ID NO: 7891443 - DNA, 22 bp, Homo sapiens
gctctctcgtgaacaggtggtt

SEQ ID NO: 7891444 - DNA, 22 bp, Homo sapiens
gctctctgaggtgctggcagag

SEQ ID NO: 7891445 - DNA, 22 bp, Homo sapiens
gctctctgaggtgctggcagag

SEQ ID NO: 7891446 - DNA, 22 bp, Homo sapiens
gctctctcttggggattcagca

SEQ ID NO: 7891447 - DNA, 22 bp, Homo sapiens
gctctctcgtgaacaggtggtt

SEQ ID NO: 7891448 - DNA, 22 bp, Homo sapiens
gctccctctgctcaggcacttg

SEQ ID NO: 7891449 - DNA, 22 bp, Homo sapiens
gctccctctgctcaggcacttg

SEQ ID NO: 7891450 - DNA, 22 bp, Homo sapiens
gctccctctgctcaggcacttg

SEQ ID NO: 7891451 - DNA, 22 bp, Homo sapiens
gctccctctgctcaggcacttg

SEQ ID NO: 7891452 - DNA, 22 bp, Homo sapiens
gctccctcccaccagcctgcag

SEQ ID NO: 7891453 - DNA, 22 bp, Homo sapiens
gctccctctgctcaggcacttg

SEQ ID NO: 7891454 - DNA, 22 bp, Homo sapiens
gctctccaggggctcccaggat

SEQ ID NO: 7891455 - DNA, 22 bp, Homo sapiens
gctctccaggggctcccaggat

SEQ ID NO: 7891456 - DNA, 22 bp, Homo sapiens
gctccctatttggccttctctg

SEQ ID NO: 7891457 - DNA, 22 bp, Homo sapiens
gctctccaggtccaagaatcca

SEQ ID NO: 7891458 - DNA, 22 bp, Homo sapiens
gctctccaggtccaagaatcca

SEQ ID NO: 7891459 - DNA, 22 bp, Homo sapiens
gctctccaggtctcatgcactg

SEQ ID NO: 7891460 - DNA, 22 bp, Homo sapiens
gctctccaggtctcatgcactg

SEQ ID NO: 7891461 - DNA, 22 bp, Homo sapiens
gctctcccgcagcctggtgggc

SEQ ID NO: 7891462 - DNA, 22 bp, Homo sapiens
gctctccaggtctcatgcactg

SEQ ID NO: 7891463 - DNA, 19 bp, Homo sapiens
gctctccctctcagttgag

SEQ ID NO: 7891464 - DNA, 19 bp, Homo sapiens
gctctccctctcagttgag

SEQ ID NO: 7891465 - DNA, 19 bp, Homo sapiens
gctctccctctcagttgag

SEQ ID NO: 7891466 - DNA, 22 bp, Homo sapiens
gctctcctgtgcagatgctgct

SEQ ID NO: 7891467 - DNA, 19 bp, Homo sapiens
gctctccctctcagttgag

SEQ ID NO: 7891468 - DNA, 20 bp, Homo sapiens
gctcagtggagaaatgcacc

SEQ ID NO: 7891469 - DNA, 20 bp, Homo sapiens
gctcagtggagaaatgcacc

SEQ ID NO: 7891470 - DNA, 22 bp, Homo sapiens
gctcagtggtattcggaaactg

SEQ ID NO: 7891471 - DNA, 22 bp, Homo sapiens
gctcagtgcatcattccaggct

SEQ ID NO: 7891472 - DNA, 19 bp, Homo sapiens
gctcagtgatgccagacca

SEQ ID NO: 7891473 - DNA, 22 bp, Homo sapiens
gctcagtgcagcctttctgtat

SEQ ID NO: 7891474 - DNA, 19 bp, Homo sapiens
gctcagtgatgccagacca

SEQ ID NO: 7891475 - DNA, 19 bp, Homo sapiens
gctcagtgatgccagacca

SEQ ID NO: 7891476 - DNA, 22 bp, Homo sapiens
gctcagtgcagcctttctgtat

SEQ ID NO: 7891477 - DNA, 22 bp, Homo sapiens
gctcagtgcatcattccaggct

SEQ ID NO: 7891478 - DNA, 22 bp, Homo sapiens
gctcagtgagatattgactcca

SEQ ID NO: 7891479 - DNA, 22 bp, Homo sapiens
gctcagtgagatattgactcca

SEQ ID NO: 7891480 - DNA, 22 bp, Homo sapiens
gctcagtgaagggtgccaagta

SEQ ID NO: 7891481 - DNA, 22 bp, Homo sapiens
gctcagtgaatttttgcccatg

SEQ ID NO: 7891482 - DNA, 22 bp, Homo sapiens
gctcagggcgcgagggacgtgg

SEQ ID NO: 7891483 - DNA, 22 bp, Homo sapiens
gctcagggcgcgagggacgtgg

SEQ ID NO: 7891484 - DNA, 22 bp, Homo sapiens
gctcagtttcttctattgtatt

SEQ ID NO: 7891485 - DNA, 22 bp, Homo sapiens
gctcagttatccgtgtgtgact

SEQ ID NO: 7891486 - DNA, 23 bp, Homo sapiens
gctcatcaggcttagagtcaagg

SEQ ID NO: 7891487 - DNA, 23 bp, Homo sapiens
gctcatcaggcttagagtcaagg

SEQ ID NO: 7891488 - DNA, 23 bp, Homo sapiens
gctcatcaggcttagagtcaagg

SEQ ID NO: 7891489 - DNA, 23 bp, Homo sapiens
gctcatcaggcttagagtcaagg

SEQ ID NO: 7891490 - DNA, 22 bp, Homo sapiens
gctcagtgtggtcctcagatgt

SEQ ID NO: 7891491 - DNA, 18 bp, Homo sapiens
gctcagtgtgttaacact

SEQ ID NO: 7891492 - DNA, 22 bp, Homo sapiens
gctcagtggtattcggaaactg

SEQ ID NO: 7891493 - DNA, 22 bp, Homo sapiens
gctcagtgtgcacgagtactct

SEQ ID NO: 7891494 - DNA, 22 bp, Homo sapiens
gctcagtgtgcacgagtactct

SEQ ID NO: 7891495 - DNA, 22 bp, Homo sapiens
gctcagtgtgttcaagggctca

SEQ ID NO: 7891496 - DNA, 22 bp, Homo sapiens
gctcagtgtggtcctcagatgt

SEQ ID NO: 7891497 - DNA, 22 bp, Homo sapiens
gctcagtgttcatctgtatgca

SEQ ID NO: 7891498 - DNA, 22 bp, Homo sapiens
gctcagtgtttctggtagaaaa

SEQ ID NO: 7891499 - DNA, 22 bp, Homo sapiens
gctcccagcaattgaggcagcc

SEQ ID NO: 7891500 - DNA, 22 bp, Homo sapiens
gctcccagcaattgaggcagcc

SEQ ID NO: 7891501 - DNA, 22 bp, Homo sapiens
gctcccagatttcagccttgtg

SEQ ID NO: 7891502 - DNA, 22 bp, Homo sapiens
gctcccagatttcagccttgtg

SEQ ID NO: 7891503 - DNA, 22 bp, Homo sapiens
gctcccagatttcagccttgtg

SEQ ID NO: 7891504 - DNA, 22 bp, Homo sapiens
gctcccagcaattgaggcagcc

SEQ ID NO: 7891505 - DNA, 22 bp, Homo sapiens
gctcccagcaattgaggcagcc

SEQ ID NO: 7891506 - DNA, 22 bp, Homo sapiens
gctcccagactgaccagaggtg

SEQ ID NO: 7891507 - DNA, 22 bp, Homo sapiens
gctcccagactgaccagaggtg

SEQ ID NO: 7891508 - DNA, 22 bp, Homo sapiens
gctcccagactgaccagaggtg

SEQ ID NO: 7891509 - DNA, 22 bp, Homo sapiens
gctcccagactgaccagaggtg

SEQ ID NO: 7891510 - DNA, 22 bp, Homo sapiens
gctcccagatttcagccttgtg

SEQ ID NO: 7891511 - DNA, 23 bp, Homo sapiens
gctcatccacggagaggggctcc

SEQ ID NO: 7891512 - DNA, 18 bp, Homo sapiens
gctcatcccacaatcagg

SEQ ID NO: 7891513 - DNA, 22 bp, Homo sapiens
gctcatccagcaagccagggcc

SEQ ID NO: 7891514 - DNA, 18 bp, Homo sapiens
gctcatcccacaatcagg

SEQ ID NO: 7891515 - DNA, 22 bp, Homo sapiens
gctcccagactgaccagaggtg

SEQ ID NO: 7891516 - DNA, 22 bp, Homo sapiens
gctcccagactgaccagaggtg

SEQ ID NO: 7891517 - DNA, 22 bp, Homo sapiens
gctcagggcgcgagggacgtgg

SEQ ID NO: 7891518 - DNA, 22 bp, Homo sapiens
gctcagggcgcgagggacgtgg

SEQ ID NO: 7891519 - DNA, 20 bp, Homo sapiens
gctcagggcctgggtctgga

SEQ ID NO: 7891520 - DNA, 20 bp, Homo sapiens
gctcagggcctgggtctgga

SEQ ID NO: 7891521 - DNA, 20 bp, Homo sapiens
gctcagggcctgggtctgga

SEQ ID NO: 7891522 - DNA, 20 bp, Homo sapiens
gctcagggcctgggtctgga

SEQ ID NO: 7891523 - DNA, 20 bp, Homo sapiens
gctcagggcctgggtctgga

SEQ ID NO: 7891524 - DNA, 22 bp, Homo sapiens
gctcagggcctggctgcggact

SEQ ID NO: 7891525 - DNA, 22 bp, Homo sapiens
gctcagggcctggctgcggact

SEQ ID NO: 7891526 - DNA, 22 bp, Homo sapiens
gctcagggcctggctgcggact

SEQ ID NO: 7891527 - DNA, 22 bp, Homo sapiens
gctcagggcctggctgcggact

SEQ ID NO: 7891528 - DNA, 22 bp, Homo sapiens
gctcagggcctggctgcggact

SEQ ID NO: 7891529 - DNA, 22 bp, Homo sapiens
gctcagggagtttcacagtgta

SEQ ID NO: 7891530 - DNA, 22 bp, Homo sapiens
gctcagggagtttcacagtgta

SEQ ID NO: 7891531 - DNA, 22 bp, Homo sapiens
gctcagggagcgatttaccatg

SEQ ID NO: 7891532 - DNA, 22 bp, Homo sapiens
gctcagggagagagggcagccg

SEQ ID NO: 7891533 - DNA, 22 bp, Homo sapiens
gctcagggagagagggcagccg

SEQ ID NO: 7891534 - DNA, 22 bp, Homo sapiens
gctcagggagagagggcagccg

SEQ ID NO: 7891535 - DNA, 22 bp, Homo sapiens
gctcagggagtttcacagtgta

SEQ ID NO: 7891536 - DNA, 22 bp, Homo sapiens
gctcagggagtttcacagtgta

SEQ ID NO: 7891537 - DNA, 22 bp, Homo sapiens
gctcagggagtttcacagtgta

SEQ ID NO: 7891538 - DNA, 22 bp, Homo sapiens
gctcagggagtttcacagtgta

SEQ ID NO: 7891539 - DNA, 22 bp, Homo sapiens
gctcagggagtttcacagtgta

SEQ ID NO: 7891540 - DNA, 22 bp, Homo sapiens
gctcagggccatggaccagcag

SEQ ID NO: 7891541 - DNA, 22 bp, Homo sapiens
gctcagggccatggaccagcag

SEQ ID NO: 7891542 - DNA, 22 bp, Homo sapiens
gctcagggccatggaccagcag

SEQ ID NO: 7891543 - DNA, 22 bp, Homo sapiens
gctcagggccatggaccagcag

SEQ ID NO: 7891544 - DNA, 22 bp, Homo sapiens
gctcagggagtttcacagtgta

SEQ ID NO: 7891545 - DNA, 22 bp, Homo sapiens
gctcagggccatggaccagcag

SEQ ID NO: 7891546 - DNA, 22 bp, Homo sapiens
gctaggtgcagcagacagctta

SEQ ID NO: 7891547 - DNA, 23 bp, Homo sapiens
gctaggtgcttccacacgtgctg

SEQ ID NO: 7891548 - DNA, 23 bp, Homo sapiens
gctaggtgcttccacacgtgctg

SEQ ID NO: 7891549 - DNA, 22 bp, Homo sapiens
gctaggttggggaagttctcct

SEQ ID NO: 7891550 - DNA, 22 bp, Homo sapiens
gctaggttggggaagttctcct

SEQ ID NO: 7891551 - DNA, 19 bp, Homo sapiens
gctaggtgaccagctggat

SEQ ID NO: 7891552 - DNA, 19 bp, Homo sapiens
gctaggtgaccagctggat

SEQ ID NO: 7891553 - DNA, 22 bp, Homo sapiens
gctaggtgcagcagacagctta

SEQ ID NO: 7891554 - DNA, 23 bp, Homo sapiens
gctaggtgcttccacacgtgctg

SEQ ID NO: 7891555 - DNA, 22 bp, Homo sapiens
gctaggtgcagcagacagctta

SEQ ID NO: 7891556 - DNA, 22 bp, Homo sapiens
gctaggtgcagcagacagctta

SEQ ID NO: 7891557 - DNA, 22 bp, Homo sapiens
gctaggtgcagcagacagctta

SEQ ID NO: 7891558 - DNA, 22 bp, Homo sapiens
gctagtccacagccatccaggc

SEQ ID NO: 7891559 - DNA, 22 bp, Homo sapiens
gctagtgcagggaaatctttgg

SEQ ID NO: 7891560 - DNA, 18 bp, Homo sapiens
gctagttcattaggtagg

SEQ ID NO: 7891561 - DNA, 22 bp, Homo sapiens
gctagttctctgtattgtgtaa

SEQ ID NO: 7891562 - DNA, 22 bp, Homo sapiens
gctagtttcttgaatactctaa

SEQ ID NO: 7891563 - DNA, 22 bp, Homo sapiens
gctagtttcttgttggcagaga

SEQ ID NO: 7891564 - DNA, 22 bp, Homo sapiens
gctatacaagtgtagaatagag

SEQ ID NO: 7891565 - DNA, 22 bp, Homo sapiens
gctcagggagagagggcagccg

SEQ ID NO: 7891566 - DNA, 22 bp, Homo sapiens
gctcagggagagagggcagccg

SEQ ID NO: 7891567 - DNA, 22 bp, Homo sapiens
gctcagggagagagggcagccg

SEQ ID NO: 7891568 - DNA, 22 bp, Homo sapiens
gctcagggagagagggcagccg

SEQ ID NO: 7891569 - DNA, 22 bp, Homo sapiens
gctcagggaatgagaagatgtt

SEQ ID NO: 7891570 - DNA, 20 bp, Homo sapiens
gctcagggaattcaggaagc

SEQ ID NO: 7891571 - DNA, 20 bp, Homo sapiens
gctcagggaattcaggaagc

SEQ ID NO: 7891572 - DNA, 22 bp, Homo sapiens
gctcagggaaggccacgtgaga

SEQ ID NO: 7891573 - DNA, 22 bp, Homo sapiens
gctcagggaaggccacgtgaga

SEQ ID NO: 7891574 - DNA, 22 bp, Homo sapiens
gctcagggaaggccacgtgaga

SEQ ID NO: 7891575 - DNA, 22 bp, Homo sapiens
gctagaagttgggcctggtgct

SEQ ID NO: 7891576 - DNA, 19 bp, Homo sapiens
gctagaagatagaatgaaa

SEQ ID NO: 7891577 - DNA, 19 bp, Homo sapiens
gctagaagatagaatgaaa

SEQ ID NO: 7891578 - DNA, 22 bp, Homo sapiens
gctagagaccagaggccttgaa

SEQ ID NO: 7891579 - DNA, 22 bp, Homo sapiens
gctagagaccagaggccttgaa

SEQ ID NO: 7891580 - DNA, 22 bp, Homo sapiens
gctagaatattgggtaggcaag

SEQ ID NO: 7891581 - DNA, 22 bp, Homo sapiens
gctagagtggctaagcctgcag

SEQ ID NO: 7891582 - DNA, 22 bp, Homo sapiens
gctagaggcaacaactttatag

SEQ ID NO: 7891583 - DNA, 22 bp, Homo sapiens
gctagcctgcagtggctatggt

SEQ ID NO: 7891584 - DNA, 22 bp, Homo sapiens
gctagcctgcagtggctatggt

SEQ ID NO: 7891585 - DNA, 22 bp, Homo sapiens
gctagcctgcagtggctatggt

SEQ ID NO: 7891586 - DNA, 22 bp, Homo sapiens
gctagcctcccttttccatggt

SEQ ID NO: 7891587 - DNA, 22 bp, Homo sapiens
gctagcctcccttttccatggt

SEQ ID NO: 7891588 - DNA, 22 bp, Homo sapiens
gctagcagaaagcaggctgctc

SEQ ID NO: 7891589 - DNA, 22 bp, Homo sapiens
gctagcagaaagcaggctgctc

SEQ ID NO: 7891590 - DNA, 22 bp, Homo sapiens
gctagcaaatgtcatttggaag

SEQ ID NO: 7891591 - DNA, 22 bp, Homo sapiens
gctagcagagtgcatccttcta

SEQ ID NO: 7891592 - DNA, 22 bp, Homo sapiens
gctagcctccattttattacta

SEQ ID NO: 7891593 - DNA, 22 bp, Homo sapiens
gctagctgggtttcactgtgga

SEQ ID NO: 7891594 - DNA, 22 bp, Homo sapiens
gctagctgggtttcactgtgga

SEQ ID NO: 7891595 - DNA, 22 bp, Homo sapiens
gctagctgggtttcactgtgga

SEQ ID NO: 7891596 - DNA, 22 bp, Homo sapiens
gctagcctgcagtggctatggt

SEQ ID NO: 7891597 - DNA, 22 bp, Homo sapiens
gctagcggtaacagcgtttgcc

SEQ ID NO: 7891598 - DNA, 22 bp, Homo sapiens
gctagctgggtttcactgtgga

SEQ ID NO: 7891599 - DNA, 22 bp, Homo sapiens
gctaggaagaagggtgcttgaa

SEQ ID NO: 7891600 - DNA, 22 bp, Homo sapiens
gctaggaagaagggtgcttgaa

SEQ ID NO: 7891601 - DNA, 22 bp, Homo sapiens
gctaggaggccctgcacgctta

SEQ ID NO: 7891602 - DNA, 22 bp, Homo sapiens
gctaggaggaagaatgtgaatt

SEQ ID NO: 7891603 - DNA, 22 bp, Homo sapiens
gctaggagattgagctctgaag

SEQ ID NO: 7891604 - DNA, 22 bp, Homo sapiens
gctaggaatcggacccaggaag

SEQ ID NO: 7891605 - DNA, 17 bp, Homo sapiens
gctaggagagggaggag

SEQ ID NO: 7891606 - DNA, 22 bp, Homo sapiens
gctaggcttcaaaatctccctg

SEQ ID NO: 7891607 - DNA, 22 bp, Homo sapiens
gctaggctgtgtttcagaccct

SEQ ID NO: 7891608 - DNA, 22 bp, Homo sapiens
gctaggctgtgtttcagaccct

SEQ ID NO: 7891609 - DNA, 20 bp, Homo sapiens
gctaggctggtgattgtcaa

SEQ ID NO: 7891610 - DNA, 22 bp, Homo sapiens
gctaggctgaatatggtgctta

SEQ ID NO: 7891611 - DNA, 22 bp, Homo sapiens
gctaggctgaatatggtgctta

SEQ ID NO: 7891612 - DNA, 22 bp, Homo sapiens
gctaggctgaatatggtgctta

SEQ ID NO: 7891613 - DNA, 22 bp, Homo sapiens
gctaggctcttccatcagggca

SEQ ID NO: 7891614 - DNA, 19 bp, Homo sapiens
gctaggctggccttgaggg

SEQ ID NO: 7891615 - DNA, 22 bp, Homo sapiens
gctaggctcggaagcagcaggg

SEQ ID NO: 7891616 - DNA, 19 bp, Homo sapiens
gctaggctggccttgaggg

SEQ ID NO: 7891617 - DNA, 22 bp, Homo sapiens
gctaggctcggaagcagcaggg

SEQ ID NO: 7891618 - DNA, 22 bp, Homo sapiens
gctaggctcggaagcagcaggg

SEQ ID NO: 7891619 - DNA, 22 bp, Homo sapiens
gctaggctcggaagcagcaggg

SEQ ID NO: 7891620 - DNA, 22 bp, Homo sapiens
gctaggagtgggatggaagtcg

SEQ ID NO: 7891621 - DNA, 22 bp, Homo sapiens
gctaggaggccctgcacgctta

SEQ ID NO: 7891622 - DNA, 22 bp, Homo sapiens
gctaggagtgggatggaagtcg

SEQ ID NO: 7891623 - DNA, 22 bp, Homo sapiens
gctaggagtgggatggaagtcg

SEQ ID NO: 7891624 - DNA, 22 bp, Homo sapiens
gctagggcgggagtgctggaga

SEQ ID NO: 7891625 - DNA, 22 bp, Homo sapiens
gctagggcgggagtgctggaga

SEQ ID NO: 7891626 - DNA, 18 bp, Homo sapiens
gctagggcatgcatggtg

SEQ ID NO: 7891627 - DNA, 18 bp, Homo sapiens
gctagggcatgcatggtg

SEQ ID NO: 7891628 - DNA, 22 bp, Homo sapiens
gctagggtggctaataggagag

SEQ ID NO: 7891629 - DNA, 19 bp, Homo sapiens
gctagggttggtggcgtgc

SEQ ID NO: 7891630 - DNA, 22 bp, Homo sapiens
gctaggtctgtgcgcagccgct

SEQ ID NO: 7891631 - DNA, 19 bp, Homo sapiens
gctaggtgaccagctggat

SEQ ID NO: 7891632 - DNA, 19 bp, Homo sapiens
gctaggtgaccagctggat

SEQ ID NO: 7891633 - DNA, 22 bp, Homo sapiens
gctagggaacctcttctgagga

SEQ ID NO: 7891634 - DNA, 22 bp, Homo sapiens
gctaggcttcaaaatctccctg

SEQ ID NO: 7891635 - DNA, 20 bp, Homo sapiens
gctaggctgtgtcctgccca

SEQ ID NO: 7891636 - DNA, 22 bp, Homo sapiens
gctaggcttcaaaatctccctg

SEQ ID NO: 7891637 - DNA, 22 bp, Homo sapiens
gctagggagacttgtgtcatca

SEQ ID NO: 7891638 - DNA, 22 bp, Homo sapiens
gctagggatctgatttgctgtt

SEQ ID NO: 7891639 - DNA, 22 bp, Homo sapiens
gctagggatttctttctcacta

SEQ ID NO: 7891640 - DNA, 22 bp, Homo sapiens
gctagggatctgatttgctgtt

SEQ ID NO: 7891641 - DNA, 22 bp, Homo sapiens
gctagggagacttgtgtcatca

SEQ ID NO: 7891642 - DNA, 22 bp, Homo sapiens
gctagggagacttgtgtcatca

SEQ ID NO: 7891643 - DNA, 22 bp, Homo sapiens
gctagggactagggaaggagca

SEQ ID NO: 7891644 - DNA, 22 bp, Homo sapiens
gcctggcactcactgaagaggc

SEQ ID NO: 7891645 - DNA, 22 bp, Homo sapiens
gcctggcacgggctcggcccac

SEQ ID NO: 7891646 - DNA, 22 bp, Homo sapiens
gcctggcacgggctcggcccac

SEQ ID NO: 7891647 - DNA, 22 bp, Homo sapiens
gcctggcactcaatcatctgct

SEQ ID NO: 7891648 - DNA, 22 bp, Homo sapiens
gcctggcactcaatcatctgct

SEQ ID NO: 7891649 - DNA, 22 bp, Homo sapiens
gcctggcagattgacatagcca

SEQ ID NO: 7891650 - DNA, 22 bp, Homo sapiens
gcctggcagattgacatagcca

SEQ ID NO: 7891651 - DNA, 22 bp, Homo sapiens
gcctggcagattgacatagcca

SEQ ID NO: 7891652 - DNA, 22 bp, Homo sapiens
gcctggcagattgacatagcca

SEQ ID NO: 7891653 - DNA, 22 bp, Homo sapiens
gcctggcactgggctcctggcc

SEQ ID NO: 7891654 - DNA, 22 bp, Homo sapiens
gcctggcactgggctcctggcc

SEQ ID NO: 7891655 - DNA, 22 bp, Homo sapiens
gctagaaactgtttaatctctt

SEQ ID NO: 7891656 - DNA, 22 bp, Homo sapiens
gctagaaatcgacttcagaatt

SEQ ID NO: 7891657 - DNA, 22 bp, Homo sapiens
gctagaaaatgaaagataattt

SEQ ID NO: 7891658 - DNA, 22 bp, Homo sapiens
gctagaaaatgaaagataattt

SEQ ID NO: 7891659 - DNA, 22 bp, Homo sapiens
gcctggcaggaatctcagtgct

SEQ ID NO: 7891660 - DNA, 22 bp, Homo sapiens
gcctggcaggaatctcagtgct

SEQ ID NO: 7891661 - DNA, 22 bp, Homo sapiens
gcctggcaggcctcatgagggg

SEQ ID NO: 7891662 - DNA, 22 bp, Homo sapiens
gcctggcaggcctcatgagggg

SEQ ID NO: 7891663 - DNA, 22 bp, Homo sapiens
gcctggcaggcctcatgagggg

SEQ ID NO: 7891664 - DNA, 22 bp, Homo sapiens
gcctggcagcccctagacattt

SEQ ID NO: 7891665 - DNA, 22 bp, Homo sapiens
gcctggcagcctccaaccttca

SEQ ID NO: 7891666 - DNA, 22 bp, Homo sapiens
gcctggcaggaatctcagtgct

SEQ ID NO: 7891667 - DNA, 22 bp, Homo sapiens
gcctggcaggaatctcagtgct

SEQ ID NO: 7891668 - DNA, 22 bp, Homo sapiens
gcctggagtggtcctgctgccc

SEQ ID NO: 7891669 - DNA, 22 bp, Homo sapiens
gcctggagtggtcctgctgccc

SEQ ID NO: 7891670 - DNA, 22 bp, Homo sapiens
gcctggagtggtcctgctgccc

SEQ ID NO: 7891671 - DNA, 22 bp, Homo sapiens
gcctggagtggtcctgctgccc

SEQ ID NO: 7891672 - DNA, 22 bp, Homo sapiens
gcctggagtggtcctgctgccc

SEQ ID NO: 7891673 - DNA, 22 bp, Homo sapiens
gcctggagtggtcctgctgccc

SEQ ID NO: 7891674 - DNA, 22 bp, Homo sapiens
gcctggagtggtcctgctgccc

SEQ ID NO: 7891675 - DNA, 20 bp, Homo sapiens
gcctggcacccggggctggc

SEQ ID NO: 7891676 - DNA, 20 bp, Homo sapiens
gcctggcacccggggctggc

SEQ ID NO: 7891677 - DNA, 20 bp, Homo sapiens
gcctggcacccggggctggc

SEQ ID NO: 7891678 - DNA, 16 bp, Homo sapiens
gcctggcaccgtcggc

SEQ ID NO: 7891679 - DNA, 16 bp, Homo sapiens
gcctggcaccgtcggc

SEQ ID NO: 7891680 - DNA, 22 bp, Homo sapiens
gcctggagttcagccaagtccc

SEQ ID NO: 7891681 - DNA, 22 bp, Homo sapiens
gcctggcaccacagcctttcag

SEQ ID NO: 7891682 - DNA, 22 bp, Homo sapiens
gcctggagttcagccaagtccc

SEQ ID NO: 7891683 - DNA, 22 bp, Homo sapiens
gcctggagttcagccaagtccc

SEQ ID NO: 7891684 - DNA, 22 bp, Homo sapiens
gcctggagttcagccaagtccc

SEQ ID NO: 7891685 - DNA, 22 bp, Homo sapiens
gcctggagttcagccaagtccc

SEQ ID NO: 7891686 - DNA, 22 bp, Homo sapiens
ggaaaaatgacacatatctcaa

SEQ ID NO: 7891687 - DNA, 22 bp, Homo sapiens
ggaaaaatagagtatactttaa

SEQ ID NO: 7891688 - DNA, 22 bp, Homo sapiens
ggaaaaacagtctttattattt

SEQ ID NO: 7891689 - DNA, 22 bp, Homo sapiens
ggaaaaacagtctttattattt

SEQ ID NO: 7891690 - DNA, 22 bp, Homo sapiens
ggaaaaacagtctttattattt

SEQ ID NO: 7891691 - DNA, 23 bp, Homo sapiens
ggaaaaacactgtgtcttggcag

SEQ ID NO: 7891692 - DNA, 22 bp, Homo sapiens
ggaaaaacagtctttattattt

SEQ ID NO: 7891693 - DNA, 19 bp, Homo sapiens
ggaaggagagaaatgcatg

SEQ ID NO: 7891694 - DNA, 22 bp, Homo sapiens
ggaaggaattccaagactaaag

SEQ ID NO: 7891695 - DNA, 19 bp, Homo sapiens
ggaaggagagaaatgcatg

SEQ ID NO: 7891696 - DNA, 22 bp, Homo sapiens
ggaaggaattccaagactaaag

SEQ ID NO: 7891697 - DNA, 22 bp, Homo sapiens
ggaaggaagtgcagactttaaa

SEQ ID NO: 7891698 - DNA, 22 bp, Homo sapiens
ggaaggagcatttgccagttta

SEQ ID NO: 7891699 - DNA, 22 bp, Homo sapiens
ggaaggagcatttgccagttta

SEQ ID NO: 7891700 - DNA, 22 bp, Homo sapiens
ggaaggagcatttgccagttta

SEQ ID NO: 7891701 - DNA, 22 bp, Homo sapiens
ggaaggagcatttgccagttta

SEQ ID NO: 7891702 - DNA, 22 bp, Homo sapiens
ggaaggagcatttgccagttta

SEQ ID NO: 7891703 - DNA, 19 bp, Homo sapiens
ggaaggagagaaatgcatg

SEQ ID NO: 7891704 - DNA, 22 bp, Homo sapiens
ggaaggagcatttgccagttta

SEQ ID NO: 7891705 - DNA, 19 bp, Homo sapiens
ggaaggagagaaatgcatg

SEQ ID NO: 7891706 - DNA, 19 bp, Homo sapiens
ggaaggagagaaatgcatg

SEQ ID NO: 7891707 - DNA, 19 bp, Homo sapiens
ggaaggagagaaatgcatg

SEQ ID NO: 7891708 - DNA, 19 bp, Homo sapiens
ggaaggagagaaatgcatg

SEQ ID NO: 7891709 - DNA, 22 bp, Homo sapiens
ggaaggagtctttaacacccat

SEQ ID NO: 7891710 - DNA, 18 bp, Homo sapiens
ggaaggagtggaccccag

SEQ ID NO: 7891711 - DNA, 18 bp, Homo sapiens
ggaaggagtggaccccag

SEQ ID NO: 7891712 - DNA, 22 bp, Homo sapiens
ggaaggatctggctgaaatcca

SEQ ID NO: 7891713 - DNA, 19 bp, Homo sapiens
ggaaggcagaggggctgtg

SEQ ID NO: 7891714 - DNA, 18 bp, Homo sapiens
ggaaggagtggaccccag

SEQ ID NO: 7891715 - DNA, 18 bp, Homo sapiens
ggaaggagtggaccccag

SEQ ID NO: 7891716 - DNA, 19 bp, Homo sapiens
ggaaggcagaggggctgtg

SEQ ID NO: 7891717 - DNA, 19 bp, Homo sapiens
ggaaggcagaggggctgtg

SEQ ID NO: 7891718 - DNA, 19 bp, Homo sapiens
ggaaggcagaggggctgtg

SEQ ID NO: 7891719 - DNA, 19 bp, Homo sapiens
ggaaggcagaggggctgtg

SEQ ID NO: 7891720 - DNA, 19 bp, Homo sapiens
ggaaggcagaggggctgtg

SEQ ID NO: 7891721 - DNA, 19 bp, Homo sapiens
ggaaggcagaggggctgtg

SEQ ID NO: 7891722 - DNA, 22 bp, Homo sapiens
ggaaggaggggcaaagcagttc

SEQ ID NO: 7891723 - DNA, 22 bp, Homo sapiens
ggaaggagtctttaacacccat

SEQ ID NO: 7891724 - DNA, 18 bp, Homo sapiens
ggaaggagtggaccccag

SEQ ID NO: 7891725 - DNA, 22 bp, Homo sapiens
ggaaggaggggcaaagcagttc

SEQ ID NO: 7891726 - DNA, 22 bp, Homo sapiens
ggaaggaggggcaaagcagttc

SEQ ID NO: 7891727 - DNA, 22 bp, Homo sapiens
ggaaggaggggcaaagcagttc

SEQ ID NO: 7891728 - DNA, 22 bp, Homo sapiens
ggaaggagggcggcaatgatga

SEQ ID NO: 7891729 - DNA, 22 bp, Homo sapiens
ggaaggaggggcaaagcagttc

SEQ ID NO: 7891730 - DNA, 22 bp, Homo sapiens
ggaaggaggggcaaagcagttc

SEQ ID NO: 7891731 - DNA, 22 bp, Homo sapiens
ggaaggaggggcaaagcagttc

SEQ ID NO: 7891732 - DNA, 22 bp, Homo sapiens
ggaaggaggggcaaagcagttc

SEQ ID NO: 7891733 - DNA, 22 bp, Homo sapiens
ggaaggaggggcaaagcagttc

SEQ ID NO: 7891734 - DNA, 22 bp, Homo sapiens
ggaaggaggatgctctggcctt

SEQ ID NO: 7891735 - DNA, 22 bp, Homo sapiens
ggaaggagggcggcaatgatga

SEQ ID NO: 7891736 - DNA, 22 bp, Homo sapiens
ggaaggaggggcaaagcagttc

SEQ ID NO: 7891737 - DNA, 22 bp, Homo sapiens
ggaaggagccatatcatatcca

SEQ ID NO: 7891738 - DNA, 22 bp, Homo sapiens
ggaaggagccatatcatatcca

SEQ ID NO: 7891739 - DNA, 22 bp, Homo sapiens
ggaaggagccatatcatatcca

SEQ ID NO: 7891740 - DNA, 22 bp, Homo sapiens
ggaaggaggatgctctggcctt

SEQ ID NO: 7891741 - DNA, 22 bp, Homo sapiens
ggaaggaggatgctctggcctt

SEQ ID NO: 7891742 - DNA, 22 bp, Homo sapiens
ggaaggaggatgctctggcctt

SEQ ID NO: 7891743 - DNA, 22 bp, Homo sapiens
ggaaggaggatgctctggcctt

SEQ ID NO: 7891744 - DNA, 22 bp, Homo sapiens
ggaaggaggatgctctggcctt

SEQ ID NO: 7891745 - DNA, 22 bp, Homo sapiens
ggaaggctaataatgcaagaaa

SEQ ID NO: 7891746 - DNA, 22 bp, Homo sapiens
ggaaggctacaggaatccagcg

SEQ ID NO: 7891747 - DNA, 22 bp, Homo sapiens
ggaaggctaataatgcaagaaa

SEQ ID NO: 7891748 - DNA, 22 bp, Homo sapiens
ggaaggctaataatgcaagaaa

SEQ ID NO: 7891749 - DNA, 22 bp, Homo sapiens
ggaaggcagtgaaggggctgat

SEQ ID NO: 7891750 - DNA, 22 bp, Homo sapiens
ggaaggcagtgaaggggctgat

SEQ ID NO: 7891751 - DNA, 22 bp, Homo sapiens
ggaaggcagaggtgtcgtgggg

SEQ ID NO: 7891752 - DNA, 22 bp, Homo sapiens
ggaaggcagaggtgtcgtgggg

SEQ ID NO: 7891753 - DNA, 19 bp, Homo sapiens
ggaaggcagaggggctgtg

SEQ ID NO: 7891754 - DNA, 22 bp, Homo sapiens
ggaaggcagaggtgtcgtgggg

SEQ ID NO: 7891755 - DNA, 22 bp, Homo sapiens
ggaaggcagtgaaggggctgat

SEQ ID NO: 7891756 - DNA, 22 bp, Homo sapiens
ggaaggcagtgaaggggctgat

SEQ ID NO: 7891757 - DNA, 22 bp, Homo sapiens
ggaaggcagtgaaggggctgat

SEQ ID NO: 7891758 - DNA, 22 bp, Homo sapiens
ggaaggcagaggtgtcgtgggg

SEQ ID NO: 7891759 - DNA, 22 bp, Homo sapiens
ggaaggcagtgaaggggctgat

SEQ ID NO: 7891760 - DNA, 22 bp, Homo sapiens
ggaaggcagtgaaggggctgat

SEQ ID NO: 7891761 - DNA, 22 bp, Homo sapiens
ggaaggctctgttccttgactt

SEQ ID NO: 7891762 - DNA, 22 bp, Homo sapiens
ggaaggctgtgcagtgtttgca

SEQ ID NO: 7891763 - DNA, 22 bp, Homo sapiens
ggaaggctgttcactaacatgt

SEQ ID NO: 7891764 - DNA, 22 bp, Homo sapiens
ggaaggctgtgccagaagaact

SEQ ID NO: 7891765 - DNA, 22 bp, Homo sapiens
ggaaggctccatacacaaagca

SEQ ID NO: 7891766 - DNA, 22 bp, Homo sapiens
ggaaggctccatacacaaagca

SEQ ID NO: 7891767 - DNA, 22 bp, Homo sapiens
ggaaggctcgaggatgcttctg

SEQ ID NO: 7891768 - DNA, 22 bp, Homo sapiens
ggaaggctccacccaaggcgag

SEQ ID NO: 7891769 - DNA, 22 bp, Homo sapiens
ggaaggctttctgttctgtgac

SEQ ID NO: 7891770 - DNA, 22 bp, Homo sapiens
ggaaggctttgaggggtgctgg

SEQ ID NO: 7891771 - DNA, 22 bp, Homo sapiens
ggaaggctttctgttctgtgac

SEQ ID NO: 7891772 - DNA, 22 bp, Homo sapiens
ggaaggctttgtagaagtgcca

SEQ ID NO: 7891773 - DNA, 22 bp, Homo sapiens
ggaaggctttgaggggtgctgg

SEQ ID NO: 7891774 - DNA, 22 bp, Homo sapiens
ggaaggctttaagcaccaaagc

SEQ ID NO: 7891775 - DNA, 22 bp, Homo sapiens
ggaaggcttgagttcccaggtc

SEQ ID NO: 7891776 - DNA, 20 bp, Homo sapiens
ggaaggcttgaagtttacat

SEQ ID NO: 7891777 - DNA, 22 bp, Homo sapiens
ggacaggagtgaggcgggttcc

SEQ ID NO: 7891778 - DNA, 22 bp, Homo sapiens
ggacaggataagagacactgcc

SEQ ID NO: 7891779 - DNA, 22 bp, Homo sapiens
ggacaggagtgaggcgggttcc

SEQ ID NO: 7891780 - DNA, 18 bp, Homo sapiens
ggacaggagacatgggtg

SEQ ID NO: 7891781 - DNA, 22 bp, Homo sapiens
ggacaggagtgaggcgggttcc

SEQ ID NO: 7891782 - DNA, 18 bp, Homo sapiens
ggacaggagacatgggtg

SEQ ID NO: 7891783 - DNA, 22 bp, Homo sapiens
ggacaggatgctgaagatgaag

SEQ ID NO: 7891784 - DNA, 22 bp, Homo sapiens
ggacaggatgctgaagatgaag

SEQ ID NO: 7891785 - DNA, 22 bp, Homo sapiens
ggacaggatgctgaagatgaag

SEQ ID NO: 7891786 - DNA, 22 bp, Homo sapiens
ggacaggatgctgaagatgaag

SEQ ID NO: 7891787 - DNA, 22 bp, Homo sapiens
ggacaggataagagacactgcc

SEQ ID NO: 7891788 - DNA, 22 bp, Homo sapiens
ggacaggataagagacactgcc

SEQ ID NO: 7891789 - DNA, 22 bp, Homo sapiens
ggacaggataagagacactgcc

SEQ ID NO: 7891790 - DNA, 22 bp, Homo sapiens
ggacaggataagagacactgcc

SEQ ID NO: 7891791 - DNA, 22 bp, Homo sapiens
ggacagagggttgacagagtat

SEQ ID NO: 7891792 - DNA, 22 bp, Homo sapiens
ggacagagggttgacagagtat

SEQ ID NO: 7891793 - DNA, 22 bp, Homo sapiens
ggacagagggttgacagagtat

SEQ ID NO: 7891794 - DNA, 22 bp, Homo sapiens
ggacagagggttgacagagtat

SEQ ID NO: 7891795 - DNA, 22 bp, Homo sapiens
ggacagagggttgacagagtat

SEQ ID NO: 7891796 - DNA, 22 bp, Homo sapiens
ggaagggaatccatctggttag

SEQ ID NO: 7891797 - DNA, 22 bp, Homo sapiens
ggacagagggttgacagagtat

SEQ ID NO: 7891798 - DNA, 22 bp, Homo sapiens
ggaagggagtagttggaatgca

SEQ ID NO: 7891799 - DNA, 22 bp, Homo sapiens
ggaagggaatccatctggttag

SEQ ID NO: 7891800 - DNA, 22 bp, Homo sapiens
ggaagggaaaattcattcggct

SEQ ID NO: 7891801 - DNA, 22 bp, Homo sapiens
ggaagggaaaattcattcggct

SEQ ID NO: 7891802 - DNA, 22 bp, Homo sapiens
ggaaggctttgtagaagtgcca

SEQ ID NO: 7891803 - DNA, 22 bp, Homo sapiens
ggacagggctcttggcactcct

SEQ ID NO: 7891804 - DNA, 22 bp, Homo sapiens
ggacagggctcttggcactcct

SEQ ID NO: 7891805 - DNA, 22 bp, Homo sapiens
ggacagggctcttggcactcct

SEQ ID NO: 7891806 - DNA, 23 bp, Homo sapiens
ggacagggccctgccctatggcc

SEQ ID NO: 7891807 - DNA, 23 bp, Homo sapiens
ggacagggccctgccctatggcc

SEQ ID NO: 7891808 - DNA, 23 bp, Homo sapiens
ggacagggccctgccctatggcc

SEQ ID NO: 7891809 - DNA, 23 bp, Homo sapiens
ggacagggccctgccctatggcc

SEQ ID NO: 7891810 - DNA, 22 bp, Homo sapiens
ggacagggatcattatctgagc

SEQ ID NO: 7891811 - DNA, 22 bp, Homo sapiens
ggacagggatcattatctgagc

SEQ ID NO: 7891812 - DNA, 22 bp, Homo sapiens
ggacaggggcgtggggattgtt

SEQ ID NO: 7891813 - DNA, 22 bp, Homo sapiens
ggacaggggcgtggggattgtt

SEQ ID NO: 7891814 - DNA, 22 bp, Homo sapiens
ggacaggggcgtggggattgtt

SEQ ID NO: 7891815 - DNA, 22 bp, Homo sapiens
ggacaggggcgtggggattgtt

SEQ ID NO: 7891816 - DNA, 19 bp, Homo sapiens
ggacagggggagcttttat

SEQ ID NO: 7891817 - DNA, 22 bp, Homo sapiens
ggacagggctcttggcactcct

SEQ ID NO: 7891818 - DNA, 22 bp, Homo sapiens
ggacagggctcttggcactcct

SEQ ID NO: 7891819 - DNA, 22 bp, Homo sapiens
ggacaggggcgtggggattgtt

SEQ ID NO: 7891820 - DNA, 22 bp, Homo sapiens
ggacaggggcgtggggattgtt

SEQ ID NO: 7891821 - DNA, 22 bp, Homo sapiens
ggacaggggcgtggggattgtt

SEQ ID NO: 7891822 - DNA, 22 bp, Homo sapiens
ggacaggcccggggagcctgga

SEQ ID NO: 7891823 - DNA, 22 bp, Homo sapiens
ggacaggcccggggagcctgga

SEQ ID NO: 7891824 - DNA, 22 bp, Homo sapiens
ggacaggcccggggagcctgga

SEQ ID NO: 7891825 - DNA, 22 bp, Homo sapiens
ggacaggatgctgaagatgaag

SEQ ID NO: 7891826 - DNA, 22 bp, Homo sapiens
ggacaggcaggtgatttccaga

SEQ ID NO: 7891827 - DNA, 22 bp, Homo sapiens
ggacaggcccggggagcctgga

SEQ ID NO: 7891828 - DNA, 22 bp, Homo sapiens
ggacaggccctctggtcagctt

SEQ ID NO: 7891829 - DNA, 22 bp, Homo sapiens
ggacaggccctctggtcagctt

SEQ ID NO: 7891830 - DNA, 22 bp, Homo sapiens
ggacaggccctctggtcagctt

SEQ ID NO: 7891831 - DNA, 22 bp, Homo sapiens
ggacaggccctctggtcagctt

SEQ ID NO: 7891832 - DNA, 22 bp, Homo sapiens
ggacaggccgcctcggtggggg

SEQ ID NO: 7891833 - DNA, 22 bp, Homo sapiens
ggacaggccctctggtcagctt

SEQ ID NO: 7891834 - DNA, 22 bp, Homo sapiens
ggacaggctgcatctgagcatg

SEQ ID NO: 7891835 - DNA, 22 bp, Homo sapiens
ggacaggctgcatctgagcatg

SEQ ID NO: 7891836 - DNA, 22 bp, Homo sapiens
ggacaggctgcatctgagcatg

SEQ ID NO: 7891837 - DNA, 22 bp, Homo sapiens
ggacaggctgcatctgagcatg

SEQ ID NO: 7891838 - DNA, 22 bp, Homo sapiens
ggacaggctgcatctgagcatg

SEQ ID NO: 7891839 - DNA, 22 bp, Homo sapiens
ggacaggctgcatctgagcatg

SEQ ID NO: 7891840 - DNA, 22 bp, Homo sapiens
ggacaggcgcagggccaaggaa

SEQ ID NO: 7891841 - DNA, 22 bp, Homo sapiens
ggacaggcgcagggccaaggaa

SEQ ID NO: 7891842 - DNA, 22 bp, Homo sapiens
ggacaggccgcctcggtggggg

SEQ ID NO: 7891843 - DNA, 22 bp, Homo sapiens
ggacaggcctggcacagtactg

SEQ ID NO: 7891844 - DNA, 22 bp, Homo sapiens
ggacaggcctggcacagtactg

SEQ ID NO: 7891845 - DNA, 21 bp, Homo sapiens
ggacttggatggtggcagtag

SEQ ID NO: 7891846 - DNA, 22 bp, Homo sapiens
ggacttctggggactgtagatt

SEQ ID NO: 7891847 - DNA, 22 bp, Homo sapiens
ggacttcattattgggagaggc

SEQ ID NO: 7891848 - DNA, 22 bp, Homo sapiens
ggacttgagccgctcggagttc

SEQ ID NO: 7891849 - DNA, 22 bp, Homo sapiens
ggactgtctccttgctggtagg

SEQ ID NO: 7891850 - DNA, 22 bp, Homo sapiens
ggactggtggctccttgggcag

SEQ ID NO: 7891851 - DNA, 22 bp, Homo sapiens
ggactgtctactaacaagaagc

SEQ ID NO: 7891852 - DNA, 22 bp, Homo sapiens
ggactgtgaggtctgggtgagg

SEQ ID NO: 7891853 - DNA, 22 bp, Homo sapiens
ggactgtgtgggtgtctttcag

SEQ ID NO: 7891854 - DNA, 22 bp, Homo sapiens
ggactgggtcactaagatagta

SEQ ID NO: 7891855 - DNA, 22 bp, Homo sapiens
ggactgggtcactaagatagta

SEQ ID NO: 7891856 - DNA, 22 bp, Homo sapiens
ggactggtctgagagggattca

SEQ ID NO: 7891857 - DNA, 22 bp, Homo sapiens
ggacagggtaagtactagtgtg

SEQ ID NO: 7891858 - DNA, 22 bp, Homo sapiens
ggactgctccagtgtgatttgt

SEQ ID NO: 7891859 - DNA, 22 bp, Homo sapiens
ggactgctgtggacagagtcat

SEQ ID NO: 7891860 - DNA, 22 bp, Homo sapiens
ggactggactctcaggctcaca

SEQ ID NO: 7891861 - DNA, 22 bp, Homo sapiens
ggactgggaatcagggagatgc

SEQ ID NO: 7891862 - DNA, 22 bp, Homo sapiens
ggactgggaatcagggagatgc

SEQ ID NO: 7891863 - DNA, 22 bp, Homo sapiens
ggactgggaatcagggagatgc

SEQ ID NO: 7891864 - DNA, 22 bp, Homo sapiens
ggactgggaatcagggagatgc

SEQ ID NO: 7891865 - DNA, 22 bp, Homo sapiens
ggactgggaatcagggagatgc

SEQ ID NO: 7891866 - DNA, 22 bp, Homo sapiens
ggactgggtcactaagatagta

SEQ ID NO: 7891867 - DNA, 22 bp, Homo sapiens
ggagaaaggcatagcagaacct

SEQ ID NO: 7891868 - DNA, 22 bp, Homo sapiens
ggagaaaggcatagcagaacct

SEQ ID NO: 7891869 - DNA, 22 bp, Homo sapiens
ggagaaaggcatagcagaacct

SEQ ID NO: 7891870 - DNA, 22 bp, Homo sapiens
ggagaaaggataggaatgtgct

SEQ ID NO: 7891871 - DNA, 22 bp, Homo sapiens
ggagaaagctatgtgggggagt

SEQ ID NO: 7891872 - DNA, 22 bp, Homo sapiens
ggagaaaggcatagcagaacct

SEQ ID NO: 7891873 - DNA, 22 bp, Homo sapiens
ggagaaaggcatagcagaacct

SEQ ID NO: 7891874 - DNA, 22 bp, Homo sapiens
ggagaaaggcatagcagaacct

SEQ ID NO: 7891875 - DNA, 22 bp, Homo sapiens
ggagaaagctatgtgggggagt

SEQ ID NO: 7891876 - DNA, 22 bp, Homo sapiens
ggagaaagctgtagtggaatgt

SEQ ID NO: 7891877 - DNA, 22 bp, Homo sapiens
ggagaaagctgtagtggaatgt

SEQ ID NO: 7891878 - DNA, 22 bp, Homo sapiens
ggagaaagctgtagtggaatgt

SEQ ID NO: 7891879 - DNA, 22 bp, Homo sapiens
ggagaaagctgtagtggaatgt

SEQ ID NO: 7891880 - DNA, 22 bp, Homo sapiens
ggagaaaggataggaatgtgct

SEQ ID NO: 7891881 - DNA, 22 bp, Homo sapiens
ggagaaagctgtagtggaatgt

SEQ ID NO: 7891882 - DNA, 22 bp, Homo sapiens
ggacttggggaaggcacagtta

SEQ ID NO: 7891883 - DNA, 22 bp, Homo sapiens
ggagaaaattgatgaagttggc

SEQ ID NO: 7891884 - DNA, 22 bp, Homo sapiens
ggagaaagaaatttttgattgg

SEQ ID NO: 7891885 - DNA, 22 bp, Homo sapiens
ggagaaagctatgtgggggagt

SEQ ID NO: 7891886 - DNA, 22 bp, Homo sapiens
ggagaaagaagacgaacattgt

SEQ ID NO: 7891887 - DNA, 22 bp, Homo sapiens
ggagaaagaagacgaacattgt

SEQ ID NO: 7891888 - DNA, 22 bp, Homo sapiens
ggagaaagaagacgaacattgt

SEQ ID NO: 7891889 - DNA, 22 bp, Homo sapiens
ggaggaggcggcagaagttcct

SEQ ID NO: 7891890 - DNA, 22 bp, Homo sapiens
ggaggaggggcgctttgtctat

SEQ ID NO: 7891891 - DNA, 22 bp, Homo sapiens
ggaggaggggcgctttgtctat

SEQ ID NO: 7891892 - DNA, 22 bp, Homo sapiens
ggaggaggggcgctttgtctat

SEQ ID NO: 7891893 - DNA, 22 bp, Homo sapiens
ggaggaggggtgactgaatgct

SEQ ID NO: 7891894 - DNA, 22 bp, Homo sapiens
ggaggaggggtgactgaatgct

SEQ ID NO: 7891895 - DNA, 22 bp, Homo sapiens
ggaggaggggtgactgaatgct

SEQ ID NO: 7891896 - DNA, 22 bp, Homo sapiens
ggaggaggggtgactgaatgct

SEQ ID NO: 7891897 - DNA, 22 bp, Homo sapiens
ggaggaggggtgactgaatgct

SEQ ID NO: 7891898 - DNA, 22 bp, Homo sapiens
ggaggaggggtgactgaatgct

SEQ ID NO: 7891899 - DNA, 22 bp, Homo sapiens
ggaggaggggtgactgaatgct

SEQ ID NO: 7891900 - DNA, 22 bp, Homo sapiens
ggaggaggggtgactgaatgct

SEQ ID NO: 7891901 - DNA, 22 bp, Homo sapiens
ggaggaggggtgactgaatgct

SEQ ID NO: 7891902 - DNA, 21 bp, Homo sapiens
ggaggaaaaaggaatgacttg

SEQ ID NO: 7891903 - DNA, 22 bp, Homo sapiens
ggaggaggcggcagaagttcct

SEQ ID NO: 7891904 - DNA, 22 bp, Homo sapiens
ggagctgttggcagctatcttg

SEQ ID NO: 7891905 - DNA, 19 bp, Homo sapiens
ggagcttggtggctgtggc

SEQ ID NO: 7891906 - DNA, 19 bp, Homo sapiens
ggagcttggtggctgtggc

SEQ ID NO: 7891907 - DNA, 19 bp, Homo sapiens
ggagcttggtggctgtggc

SEQ ID NO: 7891908 - DNA, 22 bp, Homo sapiens
ggagctgttggcagctatcttg

SEQ ID NO: 7891909 - DNA, 22 bp, Homo sapiens
ggagctgttgcgcatgcgctcg

SEQ ID NO: 7891910 - DNA, 22 bp, Homo sapiens
ggagctgttgattgtttgagga

SEQ ID NO: 7891911 - DNA, 22 bp, Homo sapiens
ggagctgttgattgtttgagga

SEQ ID NO: 7891912 - DNA, 22 bp, Homo sapiens
ggagctgttgcgcatgcgctcg

SEQ ID NO: 7891913 - DNA, 22 bp, Homo sapiens
ggagctgttcaggactgcttca

SEQ ID NO: 7891914 - DNA, 22 bp, Homo sapiens
ggagctgttatggcataagcat

SEQ ID NO: 7891915 - DNA, 21 bp, Homo sapiens
ggagctggggagctggcccca

SEQ ID NO: 7891916 - DNA, 21 bp, Homo sapiens
ggagctggggagctggcccca

SEQ ID NO: 7891917 - DNA, 22 bp, Homo sapiens
ggagctggggttggcatcttcc

SEQ ID NO: 7891918 - DNA, 21 bp, Homo sapiens
ggagctggggagctggcccca

SEQ ID NO: 7891919 - DNA, 22 bp, Homo sapiens
ggagctggggttggcatcttcc

SEQ ID NO: 7891920 - DNA, 22 bp, Homo sapiens
ggagctggggttggcatcttcc

SEQ ID NO: 7891921 - DNA, 22 bp, Homo sapiens
ggagctggggttggcatcttcc

SEQ ID NO: 7891922 - DNA, 22 bp, Homo sapiens
ggagctggggttggcatcttcc

SEQ ID NO: 7891923 - DNA, 22 bp, Homo sapiens
ggagctggggttggcatcttcc

SEQ ID NO: 7891924 - DNA, 22 bp, Homo sapiens
ggagctggggttggcatcttcc

SEQ ID NO: 7891925 - DNA, 22 bp, Homo sapiens
ggagctggtcagccttgagcat

SEQ ID NO: 7891926 - DNA, 22 bp, Homo sapiens
ggagctggtcagccttgagcat

SEQ ID NO: 7891927 - DNA, 22 bp, Homo sapiens
ggagctggtcagccttgagcat

SEQ ID NO: 7891928 - DNA, 22 bp, Homo sapiens
ggagctggtcagccttgagcat

SEQ ID NO: 7891929 - DNA, 22 bp, Homo sapiens
ggagctggtcagccttgagcat

SEQ ID NO: 7891930 - DNA, 22 bp, Homo sapiens
ggagctggtcagccttgagcat

SEQ ID NO: 7891931 - DNA, 22 bp, Homo sapiens
ggagctggtcagccttgagcat

SEQ ID NO: 7891932 - DNA, 22 bp, Homo sapiens
ggagctgtaacgagccattgct

SEQ ID NO: 7891933 - DNA, 22 bp, Homo sapiens
ggagctggtcagccttgagcat

SEQ ID NO: 7891934 - DNA, 22 bp, Homo sapiens
ggagctgtgggacgctgtccca

SEQ ID NO: 7891935 - DNA, 22 bp, Homo sapiens
ggagctgtgctgggtgatcagg

SEQ ID NO: 7891936 - DNA, 22 bp, Homo sapiens
ggagctgtgggacgctgtccca

SEQ ID NO: 7891937 - DNA, 22 bp, Homo sapiens
ggagctgttatggcataagcat

SEQ ID NO: 7891938 - DNA, 22 bp, Homo sapiens
ggagctgttaaatgcagaattt

SEQ ID NO: 7891939 - DNA, 22 bp, Homo sapiens
ggagctgtgttatccattccca

SEQ ID NO: 7891940 - DNA, 22 bp, Homo sapiens
ggagctgtgggacgctgtccca

SEQ ID NO: 7891941 - DNA, 22 bp, Homo sapiens
ggagctgtctgtagggcacagg

SEQ ID NO: 7891942 - DNA, 22 bp, Homo sapiens
ggagctgtagatcagctaatct

SEQ ID NO: 7891943 - DNA, 22 bp, Homo sapiens
ggagctgtctgtagggcacagg

SEQ ID NO: 7891944 - DNA, 22 bp, Homo sapiens
ggagctgtaacgagccattgct

SEQ ID NO: 7891945 - DNA, 22 bp, Homo sapiens
ggagctgtgcagtgactacaga

SEQ ID NO: 7891946 - DNA, 22 bp, Homo sapiens
ggagctgtctgtagggcacagg

SEQ ID NO: 7891947 - DNA, 22 bp, Homo sapiens
ggagctgtgcagtgactacaga

SEQ ID NO: 7891948 - DNA, 22 bp, Homo sapiens
ggagctgtgcagtgactacaga

SEQ ID NO: 7891949 - DNA, 22 bp, Homo sapiens
ggagcctgggcctcctgccctt

SEQ ID NO: 7891950 - DNA, 22 bp, Homo sapiens
ggagcctgggcctcctgccctt

SEQ ID NO: 7891951 - DNA, 22 bp, Homo sapiens
ggagcctggtatagtgttgcat

SEQ ID NO: 7891952 - DNA, 22 bp, Homo sapiens
ggagcctgggcctcctgccctt

SEQ ID NO: 7891953 - DNA, 22 bp, Homo sapiens
ggagcctggcctggctctgtgt

SEQ ID NO: 7891954 - DNA, 22 bp, Homo sapiens
ggagcctggcctggctctgtgt

SEQ ID NO: 7891955 - DNA, 21 bp, Homo sapiens
ggagctgcaggagccgaaggc

SEQ ID NO: 7891956 - DNA, 22 bp, Homo sapiens
ggagctgcatttagggagcctt

SEQ ID NO: 7891957 - DNA, 22 bp, Homo sapiens
ggagctgcatttagggagcctt

SEQ ID NO: 7891958 - DNA, 22 bp, Homo sapiens
ggagcctggtatagtgttgcat

SEQ ID NO: 7891959 - DNA, 22 bp, Homo sapiens
ggagcctggtcaggttggctcc

SEQ ID NO: 7891960 - DNA, 22 bp, Homo sapiens
ggagctggctacagagaactcc

SEQ ID NO: 7891961 - DNA, 22 bp, Homo sapiens
ggagctggctacagagaactcc

SEQ ID NO: 7891962 - DNA, 22 bp, Homo sapiens
ggagctggctacagagaactcc

SEQ ID NO: 7891963 - DNA, 22 bp, Homo sapiens
ggagctggctacagagaactcc

SEQ ID NO: 7891964 - DNA, 22 bp, Homo sapiens
ggagctggctacagagaactcc

SEQ ID NO: 7891965 - DNA, 22 bp, Homo sapiens
ggagctggctacagagaactcc

SEQ ID NO: 7891966 - DNA, 22 bp, Homo sapiens
ggagctggctacagagaactcc

SEQ ID NO: 7891967 - DNA, 22 bp, Homo sapiens
ggagctggccgcctatgtgcag

SEQ ID NO: 7891968 - DNA, 22 bp, Homo sapiens
ggagctgctcagagccagtccc

SEQ ID NO: 7891969 - DNA, 22 bp, Homo sapiens
ggagctgctcagagccagtccc

SEQ ID NO: 7891970 - DNA, 22 bp, Homo sapiens
ggagctggccgcctatgtgcag

SEQ ID NO: 7891971 - DNA, 22 bp, Homo sapiens
ggagctggccgcctatgtgcag

SEQ ID NO: 7891972 - DNA, 20 bp, Homo sapiens
ggagctgccctgggctggag

SEQ ID NO: 7891973 - DNA, 20 bp, Homo sapiens
ggagctgccctgggctggag

SEQ ID NO: 7891974 - DNA, 22 bp, Homo sapiens
ggagctgcatttagggagcctt

SEQ ID NO: 7891975 - DNA, 22 bp, Homo sapiens
ggagctgggaccctgtcatctg

SEQ ID NO: 7891976 - DNA, 22 bp, Homo sapiens
ggagctgggaccctgtcatctg

SEQ ID NO: 7891977 - DNA, 22 bp, Homo sapiens
ggagctgggaccctgtcatctg

SEQ ID NO: 7891978 - DNA, 22 bp, Homo sapiens
ggagctgggaccctgtcatctg

SEQ ID NO: 7891979 - DNA, 22 bp, Homo sapiens
ggagctgggaccctgtcatctg

SEQ ID NO: 7891980 - DNA, 18 bp, Homo sapiens
ggagctgggccccactcc

SEQ ID NO: 7891981 - DNA, 18 bp, Homo sapiens
ggagctgggccccactcc

SEQ ID NO: 7891982 - DNA, 18 bp, Homo sapiens
ggagctgggccccactcc

SEQ ID NO: 7891983 - DNA, 18 bp, Homo sapiens
ggagctgggcctggttcc

SEQ ID NO: 7891984 - DNA, 18 bp, Homo sapiens
ggagctgggcctggttcc

SEQ ID NO: 7891985 - DNA, 18 bp, Homo sapiens
ggagctgggcctggttcc

SEQ ID NO: 7891986 - DNA, 21 bp, Homo sapiens
ggagctggggagctggcccca

SEQ ID NO: 7891987 - DNA, 21 bp, Homo sapiens
ggagctggggagctggcccca

SEQ ID NO: 7891988 - DNA, 21 bp, Homo sapiens
ggagctggggagctggcccca

SEQ ID NO: 7891989 - DNA, 21 bp, Homo sapiens
ggagctggggagctggcccca

SEQ ID NO: 7891990 - DNA, 21 bp, Homo sapiens
ggagctggggagctggcccca

SEQ ID NO: 7891991 - DNA, 21 bp, Homo sapiens
ggagctggggagctggcccca

SEQ ID NO: 7891992 - DNA, 21 bp, Homo sapiens
ggagctggggagctggcccca

SEQ ID NO: 7891993 - DNA, 21 bp, Homo sapiens
ggagctggggagctggcccca

SEQ ID NO: 7891994 - DNA, 21 bp, Homo sapiens
ggagctggggagctggcccca

SEQ ID NO: 7891995 - DNA, 21 bp, Homo sapiens
ggagctggggagctggcccca

SEQ ID NO: 7891996 - DNA, 22 bp, Homo sapiens
ggagctgggaactatgtagtat

SEQ ID NO: 7891997 - DNA, 22 bp, Homo sapiens
ggagctgggaactatgtagtat

SEQ ID NO: 7891998 - DNA, 22 bp, Homo sapiens
ggagctgggaattggatcatct

SEQ ID NO: 7891999 - DNA, 22 bp, Homo sapiens
ggagctgggaattggatcatct

SEQ ID NO: 7892000 - DNA, 22 bp, Homo sapiens
ggagctgggaactatgtagtat

SEQ ID NO: 7892001 - DNA, 22 bp, Homo sapiens
ggagctgggaactatgtagtat

SEQ ID NO: 7892002 - DNA, 22 bp, Homo sapiens
ggagctggctacagagaactcc

SEQ ID NO: 7892003 - DNA, 22 bp, Homo sapiens
ggagctggctacagagaactcc

SEQ ID NO: 7892004 - DNA, 22 bp, Homo sapiens
ggagctgggaccctgtcatctg

SEQ ID NO: 7892005 - DNA, 22 bp, Homo sapiens
ggagctgggaccctgtcatctg

SEQ ID NO: 7892006 - DNA, 22 bp, Homo sapiens
ggagctgggaccctgtcatctg

SEQ ID NO: 7892007 - DNA, 22 bp, Homo sapiens
ggagctgggaccctgtcatctg

SEQ ID NO: 7892008 - DNA, 22 bp, Homo sapiens
ggagctgggaattggatcatct

SEQ ID NO: 7892009 - DNA, 22 bp, Homo sapiens
ggagctgggaattggatcatct

SEQ ID NO: 7892010 - DNA, 22 bp, Homo sapiens
ggagctgggaattggatcatct

SEQ ID NO: 7892011 - DNA, 22 bp, Homo sapiens
ggagctgggaattggatcatct

SEQ ID NO: 7892012 - DNA, 22 bp, Homo sapiens
ggagaagaggagctggaagcct

SEQ ID NO: 7892013 - DNA, 22 bp, Homo sapiens
ggagaagaggagctggaagcct

SEQ ID NO: 7892014 - DNA, 22 bp, Homo sapiens
ggagaagaggagctggaagcct

SEQ ID NO: 7892015 - DNA, 22 bp, Homo sapiens
ggagaagaggagctggaagcct

SEQ ID NO: 7892016 - DNA, 22 bp, Homo sapiens
ggagaagaggagctggaagcct

SEQ ID NO: 7892017 - DNA, 22 bp, Homo sapiens
ggagaagaggagctggaagcct

SEQ ID NO: 7892018 - DNA, 22 bp, Homo sapiens
ggagaagaggagctggaagcct

SEQ ID NO: 7892019 - DNA, 22 bp, Homo sapiens
ggagaagaggagctggaagcct

SEQ ID NO: 7892020 - DNA, 22 bp, Homo sapiens
ggagaagaggagctggaagcct

SEQ ID NO: 7892021 - DNA, 18 bp, Homo sapiens
ggagaagaacagatgtgg

SEQ ID NO: 7892022 - DNA, 18 bp, Homo sapiens
ggagaagaacagatgtgg

SEQ ID NO: 7892023 - DNA, 18 bp, Homo sapiens
ggagaagaacagatgtgg

SEQ ID NO: 7892024 - DNA, 22 bp, Homo sapiens
ggagaacaggcaagcatctggc

SEQ ID NO: 7892025 - DNA, 22 bp, Homo sapiens
ggagaactccaaatccatattt

SEQ ID NO: 7892026 - DNA, 22 bp, Homo sapiens
ggagaacaggcaagcatctggc

SEQ ID NO: 7892027 - DNA, 22 bp, Homo sapiens
ggagaacaaatatctggcttct

SEQ ID NO: 7892028 - DNA, 22 bp, Homo sapiens
ggagaacaggcaagcatctggc

SEQ ID NO: 7892029 - DNA, 22 bp, Homo sapiens
ggagaaagtcagctccaagcag

SEQ ID NO: 7892030 - DNA, 22 bp, Homo sapiens
ggagaaagtacagcaggcaaca

SEQ ID NO: 7892031 - DNA, 22 bp, Homo sapiens
ggagaaagggactgatctgctc

SEQ ID NO: 7892032 - DNA, 22 bp, Homo sapiens
ggagaaagggactgatctgctc

SEQ ID NO: 7892033 - DNA, 22 bp, Homo sapiens
ggagaaagggactgatctgctc

SEQ ID NO: 7892034 - DNA, 22 bp, Homo sapiens
ggagaaagggactgatctgctc

SEQ ID NO: 7892035 - DNA, 22 bp, Homo sapiens
ggagaaagtacagcaggcaaca

SEQ ID NO: 7892036 - DNA, 22 bp, Homo sapiens
ggagaaagtacagcaggcaaca

SEQ ID NO: 7892037 - DNA, 22 bp, Homo sapiens
ggagccaggggaccttcacaga

SEQ ID NO: 7892038 - DNA, 22 bp, Homo sapiens
ggagccaggggaccttcacaga

SEQ ID NO: 7892039 - DNA, 22 bp, Homo sapiens
ggagccagtatttagtggtctt

SEQ ID NO: 7892040 - DNA, 22 bp, Homo sapiens
ggagccagtatttagtggtctt

SEQ ID NO: 7892041 - DNA, 22 bp, Homo sapiens
ggagccagtatttagtggtctt

SEQ ID NO: 7892042 - DNA, 22 bp, Homo sapiens
ggagccagtatttagtggtctt

SEQ ID NO: 7892043 - DNA, 22 bp, Homo sapiens
ggagccagtatttagtggtctt

SEQ ID NO: 7892044 - DNA, 22 bp, Homo sapiens
ggagccagtatttagtggtctt

SEQ ID NO: 7892045 - DNA, 22 bp, Homo sapiens
ggagccaggcatatcggggcac

SEQ ID NO: 7892046 - DNA, 22 bp, Homo sapiens
ggagccaggcatatcggggcac

SEQ ID NO: 7892047 - DNA, 22 bp, Homo sapiens
ggagccaggcatatcggggcac

SEQ ID NO: 7892048 - DNA, 22 bp, Homo sapiens
ggagccaggcatatcggggcac

SEQ ID NO: 7892049 - DNA, 22 bp, Homo sapiens
ggagccagggaagctgcttcct

SEQ ID NO: 7892050 - DNA, 22 bp, Homo sapiens
ggagccagggaagctgcttcct

SEQ ID NO: 7892051 - DNA, 17 bp, Homo sapiens
ggagccaggagcccacc

SEQ ID NO: 7892052 - DNA, 17 bp, Homo sapiens
ggagccaggagcccacc

SEQ ID NO: 7892053 - DNA, 22 bp, Homo sapiens
ggagccaggcaatctgtacttt

SEQ ID NO: 7892054 - DNA, 22 bp, Homo sapiens
ggagccaggcaatctgtacttt

SEQ ID NO: 7892055 - DNA, 22 bp, Homo sapiens
ggagccaggcaatctgtacttt

SEQ ID NO: 7892056 - DNA, 22 bp, Homo sapiens
ggagaagattggaattaagcac

SEQ ID NO: 7892057 - DNA, 22 bp, Homo sapiens
ggagaagattggaattaagcac

SEQ ID NO: 7892058 - DNA, 22 bp, Homo sapiens
ggagaagcagcttcttgatgaa

SEQ ID NO: 7892059 - DNA, 22 bp, Homo sapiens
ggagaagattggaattaagcac

SEQ ID NO: 7892060 - DNA, 17 bp, Homo sapiens
ggagccaggagcccacc

SEQ ID NO: 7892061 - DNA, 22 bp, Homo sapiens
ggagcccaagtctgcactcggc

SEQ ID NO: 7892062 - DNA, 22 bp, Homo sapiens
ggagccatgttttcagcatgat

SEQ ID NO: 7892063 - DNA, 22 bp, Homo sapiens
ggagccatgttttcagcatgat

SEQ ID NO: 7892064 - DNA, 18 bp, Homo sapiens
ggagcccacggcgtccca

SEQ ID NO: 7892065 - DNA, 22 bp, Homo sapiens
ggagcccaagtctgcactcggc

SEQ ID NO: 7892066 - DNA, 18 bp, Homo sapiens
ggagcccacggcgtccca

SEQ ID NO: 7892067 - DNA, 18 bp, Homo sapiens
ggagcccagaggacagga

SEQ ID NO: 7892068 - DNA, 18 bp, Homo sapiens
ggagcccagaggtgagtt

SEQ ID NO: 7892069 - DNA, 18 bp, Homo sapiens
ggagcccagaggtgagtt

SEQ ID NO: 7892070 - DNA, 18 bp, Homo sapiens
ggagcccacggcgtccca

SEQ ID NO: 7892071 - DNA, 18 bp, Homo sapiens
ggagcccagaggacagga

SEQ ID NO: 7892072 - DNA, 18 bp, Homo sapiens
ggagcccagaggacagga

SEQ ID NO: 7892073 - DNA, 22 bp, Homo sapiens
ggagccagtatttagtggtctt

SEQ ID NO: 7892074 - DNA, 22 bp, Homo sapiens
ggagccagtatttagtggtctt

SEQ ID NO: 7892075 - DNA, 18 bp, Homo sapiens
ggagccagtctgtctctg

SEQ ID NO: 7892076 - DNA, 22 bp, Homo sapiens
ggagccagtgccctctggtgga

SEQ ID NO: 7892077 - DNA, 18 bp, Homo sapiens
ggagccagtctgtctctg

SEQ ID NO: 7892078 - DNA, 18 bp, Homo sapiens
ggagccagtctgtctctg

SEQ ID NO: 7892079 - DNA, 22 bp, Homo sapiens
ggagccagtttagacctcagtt

SEQ ID NO: 7892080 - DNA, 22 bp, Homo sapiens
ggagccagtttagacctcagtt

SEQ ID NO: 7892081 - DNA, 22 bp, Homo sapiens
ggagccagtgccctctggtgga

SEQ ID NO: 7892082 - DNA, 22 bp, Homo sapiens
ggagccagtgccctctggtgga

SEQ ID NO: 7892083 - DNA, 22 bp, Homo sapiens
ggagccagtgccctctggtgga

SEQ ID NO: 7892084 - DNA, 22 bp, Homo sapiens
ggagccagtgccctctggtgga

SEQ ID NO: 7892085 - DNA, 22 bp, Homo sapiens
ggagccagtgccctctggtgga

SEQ ID NO: 7892086 - DNA, 22 bp, Homo sapiens
ggagccagtgccctctggtgga

SEQ ID NO: 7892087 - DNA, 22 bp, Homo sapiens
ggagccagtgccctctggtgga

SEQ ID NO: 7892088 - DNA, 22 bp, Homo sapiens
ggagccctcaccggcgagtgcc

SEQ ID NO: 7892089 - DNA, 19 bp, Homo sapiens
ggagcctggagcacgtgcc

SEQ ID NO: 7892090 - DNA, 22 bp, Homo sapiens
ggagcctggagtttctgatggg

SEQ ID NO: 7892091 - DNA, 22 bp, Homo sapiens
ggagcctggcaatgctgcgtcc

SEQ ID NO: 7892092 - DNA, 22 bp, Homo sapiens
ggagcctggcaatgctgcgtcc

SEQ ID NO: 7892093 - DNA, 22 bp, Homo sapiens
ggagcctggcaatgctgcgtcc

SEQ ID NO: 7892094 - DNA, 22 bp, Homo sapiens
ggagcccaggttgtttgtgcag

SEQ ID NO: 7892095 - DNA, 22 bp, Homo sapiens
ggagcccagtcggggtgtaggt

SEQ ID NO: 7892096 - DNA, 22 bp, Homo sapiens
ggagccccaattgagcagtacg

SEQ ID NO: 7892097 - DNA, 22 bp, Homo sapiens
ggagccctcaccggcgagtgcc

SEQ ID NO: 7892098 - DNA, 22 bp, Homo sapiens
ggagcctggcccggcccttggc

SEQ ID NO: 7892099 - DNA, 22 bp, Homo sapiens
ggagcctggcccggcccttggc

SEQ ID NO: 7892100 - DNA, 22 bp, Homo sapiens
ggagcctggcccggcccttggc

SEQ ID NO: 7892101 - DNA, 19 bp, Homo sapiens
ggagcctggcaggggcgtg

SEQ ID NO: 7892102 - DNA, 23 bp, Homo sapiens
ggagcctggcatatgagacgcat

SEQ ID NO: 7892103 - DNA, 23 bp, Homo sapiens
ggagcctggcatatgagacgcat

SEQ ID NO: 7892104 - DNA, 23 bp, Homo sapiens
ggagcctggcatatgagacgcat

SEQ ID NO: 7892105 - DNA, 19 bp, Homo sapiens
ggagcctggcaggggcgtg

SEQ ID NO: 7892106 - DNA, 23 bp, Homo sapiens
ggagcctggcatatgagacgcat

SEQ ID NO: 7892107 - DNA, 19 bp, Homo sapiens
ggagcctggcaggggcgtg

SEQ ID NO: 7892108 - DNA, 19 bp, Homo sapiens
ggagcctggcaggggcgtg

SEQ ID NO: 7892109 - DNA, 22 bp, Homo sapiens
ggagcctggcaatgctgcgtcc

SEQ ID NO: 7892110 - DNA, 22 bp, Homo sapiens
ggagcctggcaatgctgcgtcc

SEQ ID NO: 7892111 - DNA, 22 bp, Homo sapiens
gctgtagtgaatggccgcgttc

SEQ ID NO: 7892112 - DNA, 22 bp, Homo sapiens
gctgtatgtgaggccacagtga

SEQ ID NO: 7892113 - DNA, 22 bp, Homo sapiens
gctgtatgtgaggccacagtga

SEQ ID NO: 7892114 - DNA, 22 bp, Homo sapiens
gctgtatgtgaggccacagtga

SEQ ID NO: 7892115 - DNA, 22 bp, Homo sapiens
gctgtagtgaatggccgcgttc

SEQ ID NO: 7892116 - DNA, 17 bp, Homo sapiens
gctgtagtttgataaga

SEQ ID NO: 7892117 - DNA, 22 bp, Homo sapiens
gctgtaggtaaggatggcaaag

SEQ ID NO: 7892118 - DNA, 22 bp, Homo sapiens
gctgtagatggactggcatcca

SEQ ID NO: 7892119 - DNA, 19 bp, Homo sapiens
gctgtattaaagatacatg

SEQ ID NO: 7892120 - DNA, 19 bp, Homo sapiens
gctgtattaaagatacatg

SEQ ID NO: 7892121 - DNA, 19 bp, Homo sapiens
gctgtattaaagatacatg

SEQ ID NO: 7892122 - DNA, 22 bp, Homo sapiens
gctgtatgtttatttgggaatt

SEQ ID NO: 7892123 - DNA, 22 bp, Homo sapiens
gctgtatgtttatttgggaatt

SEQ ID NO: 7892124 - DNA, 22 bp, Homo sapiens
gctgtattcaacagtgaaaaga

SEQ ID NO: 7892125 - DNA, 22 bp, Homo sapiens
gctgtattcaacagtgaaaaga

SEQ ID NO: 7892126 - DNA, 22 bp, Homo sapiens
gctgtattggaacacatccatg

SEQ ID NO: 7892127 - DNA, 22 bp, Homo sapiens
gctgtattcctgcactgtatag

SEQ ID NO: 7892128 - DNA, 22 bp, Homo sapiens
gctgtattggaacacatccatg

SEQ ID NO: 7892129 - DNA, 22 bp, Homo sapiens
gctgtatttaacaactggctca

SEQ ID NO: 7892130 - DNA, 22 bp, Homo sapiens
gctgtatttaacaactggctca

SEQ ID NO: 7892131 - DNA, 22 bp, Homo sapiens
gctgtcacatttggagcactgg

SEQ ID NO: 7892132 - DNA, 22 bp, Homo sapiens
gctgtcacatttggagcactgg

SEQ ID NO: 7892133 - DNA, 22 bp, Homo sapiens
gctgtcacacatggccccagct

SEQ ID NO: 7892134 - DNA, 22 bp, Homo sapiens
gctgtcacaaattgggttcttt

SEQ ID NO: 7892135 - DNA, 22 bp, Homo sapiens
gctgtcagaaggtgaagggtaa

SEQ ID NO: 7892136 - DNA, 22 bp, Homo sapiens
gctgtcactcaccaggcctgca

SEQ ID NO: 7892137 - DNA, 22 bp, Homo sapiens
gctgtcactggcatgttccggg

SEQ ID NO: 7892138 - DNA, 22 bp, Homo sapiens
gctggtcccaatgtgtttcctt

SEQ ID NO: 7892139 - DNA, 19 bp, Homo sapiens
gctgtacagtaaggagaca

SEQ ID NO: 7892140 - DNA, 19 bp, Homo sapiens
gctgtaccctgaaaactct

SEQ ID NO: 7892141 - DNA, 22 bp, Homo sapiens
gctgtacctccatcagcacctc

SEQ ID NO: 7892142 - DNA, 22 bp, Homo sapiens
gctggtccacatcctggtacgt

SEQ ID NO: 7892143 - DNA, 22 bp, Homo sapiens
gctggtccacatcctggtacgt

SEQ ID NO: 7892144 - DNA, 22 bp, Homo sapiens
gctggtccaattatgaactgtt

SEQ ID NO: 7892145 - DNA, 22 bp, Homo sapiens
gctggtcagggagggcacccat

SEQ ID NO: 7892146 - DNA, 22 bp, Homo sapiens
gctggtcagagagaaaggaggc

SEQ ID NO: 7892147 - DNA, 22 bp, Homo sapiens
gctggtcagagagaaaggaggc

SEQ ID NO: 7892148 - DNA, 22 bp, Homo sapiens
gctggccagggctgctcgcgga

SEQ ID NO: 7892149 - DNA, 22 bp, Homo sapiens
gctggccaggaagagtctcaga

SEQ ID NO: 7892150 - DNA, 22 bp, Homo sapiens
gctggtccactccctggaggct

SEQ ID NO: 7892151 - DNA, 22 bp, Homo sapiens
gctggtccactccctggaggct

SEQ ID NO: 7892152 - DNA, 22 bp, Homo sapiens
gctggtccactccctggaggct

SEQ ID NO: 7892153 - DNA, 22 bp, Homo sapiens
gctggtccagggcctctgtggg

SEQ ID NO: 7892154 - DNA, 22 bp, Homo sapiens
gctggtccactccctggaggct

SEQ ID NO: 7892155 - DNA, 22 bp, Homo sapiens
gctggtccagggcctctgtggg

SEQ ID NO: 7892156 - DNA, 22 bp, Homo sapiens
gctggtccagggcctctgtggg

SEQ ID NO: 7892157 - DNA, 22 bp, Homo sapiens
gctggtccattggcactgctca

SEQ ID NO: 7892158 - DNA, 22 bp, Homo sapiens
gctggtccattggcactgctca

SEQ ID NO: 7892159 - DNA, 22 bp, Homo sapiens
gctggtccattggcactgctca

SEQ ID NO: 7892160 - DNA, 22 bp, Homo sapiens
gctggtcccaatgtgtttcctt

SEQ ID NO: 7892161 - DNA, 22 bp, Homo sapiens
gctggtcccaatgtgtttcctt

SEQ ID NO: 7892162 - DNA, 22 bp, Homo sapiens
gctggccacactgctgatggag

SEQ ID NO: 7892163 - DNA, 22 bp, Homo sapiens
gctggccaaagtgtacctggag

SEQ ID NO: 7892164 - DNA, 22 bp, Homo sapiens
gctggccacactgctgatggag

SEQ ID NO: 7892165 - DNA, 22 bp, Homo sapiens
gctggccacactgctgatggag

SEQ ID NO: 7892166 - DNA, 22 bp, Homo sapiens
gctggccacactgctgatggag

SEQ ID NO: 7892167 - DNA, 22 bp, Homo sapiens
gctggccacagatccccaggga

SEQ ID NO: 7892168 - DNA, 22 bp, Homo sapiens
gctggccacattgtgccgtcct

SEQ ID NO: 7892169 - DNA, 22 bp, Homo sapiens
gctggccacagatccccaggga

SEQ ID NO: 7892170 - DNA, 22 bp, Homo sapiens
gctggccacagatccccaggga

SEQ ID NO: 7892171 - DNA, 19 bp, Homo sapiens
gctggccacgccccagttg

SEQ ID NO: 7892172 - DNA, 19 bp, Homo sapiens
gctggccacgccccagttg

SEQ ID NO: 7892173 - DNA, 22 bp, Homo sapiens
gctggccacattgtgccgtcct

SEQ ID NO: 7892174 - DNA, 19 bp, Homo sapiens
gctggccacgccccagttg

SEQ ID NO: 7892175 - DNA, 22 bp, Homo sapiens
gctggccagccctcttcctcca

SEQ ID NO: 7892176 - DNA, 22 bp, Homo sapiens
gctggccagccctcttcctcca

SEQ ID NO: 7892177 - DNA, 22 bp, Homo sapiens
gctggccagccctcttcctcca

SEQ ID NO: 7892178 - DNA, 22 bp, Homo sapiens
gctggccagccctcttcctcca

SEQ ID NO: 7892179 - DNA, 22 bp, Homo sapiens
gctggccaggaagagtctcaga

SEQ ID NO: 7892180 - DNA, 22 bp, Homo sapiens
gctggccaggaagagtctcaga

SEQ ID NO: 7892181 - DNA, 22 bp, Homo sapiens
gctgtcgtgtgcaagtgacaga

SEQ ID NO: 7892182 - DNA, 22 bp, Homo sapiens
gctgtccttcctggctggggtg

SEQ ID NO: 7892183 - DNA, 22 bp, Homo sapiens
gctgtccttcctggctggggtg

SEQ ID NO: 7892184 - DNA, 22 bp, Homo sapiens
gctgtcctgggaacaggcacta

SEQ ID NO: 7892185 - DNA, 22 bp, Homo sapiens
gctgtctcatgggtgctagtcc

SEQ ID NO: 7892186 - DNA, 22 bp, Homo sapiens
gctgtctgctgggtcgctcagg

SEQ ID NO: 7892187 - DNA, 22 bp, Homo sapiens
gctgtctgctgtgcactgagca

SEQ ID NO: 7892188 - DNA, 22 bp, Homo sapiens
gctgtctcatacaaggccctgc

SEQ ID NO: 7892189 - DNA, 23 bp, Homo sapiens
gctgtcctcctgggcccagcagc

SEQ ID NO: 7892190 - DNA, 22 bp, Homo sapiens
gctgtccctttcacaaggtttt

SEQ ID NO: 7892191 - DNA, 22 bp, Homo sapiens
gctgtcccttgtcccaccttgc

SEQ ID NO: 7892192 - DNA, 22 bp, Homo sapiens
gctgtccctttcacaaggtttt

SEQ ID NO: 7892193 - DNA, 22 bp, Homo sapiens
gctgtcccgctgacttccagct

SEQ ID NO: 7892194 - DNA, 22 bp, Homo sapiens
gctgtcccgctgacttccagct

SEQ ID NO: 7892195 - DNA, 22 bp, Homo sapiens
gctgtcccgctgacttccagct

SEQ ID NO: 7892196 - DNA, 22 bp, Homo sapiens
gctgtcctcgtctctcacgcaa

SEQ ID NO: 7892197 - DNA, 22 bp, Homo sapiens
gctgtcctctgatctctggagg

SEQ ID NO: 7892198 - DNA, 22 bp, Homo sapiens
gctgtcctcgtctctcacgcaa

SEQ ID NO: 7892199 - DNA, 22 bp, Homo sapiens
gctgtcctctgatctctggagg

SEQ ID NO: 7892200 - DNA, 22 bp, Homo sapiens
gctgtcctcttggactcagggc

SEQ ID NO: 7892201 - DNA, 22 bp, Homo sapiens
gctgtcctcttggactcagggc

SEQ ID NO: 7892202 - DNA, 22 bp, Homo sapiens
gctgtcccatggttgcaagatg

SEQ ID NO: 7892203 - DNA, 23 bp, Homo sapiens
gctgtccccatgctccatccctg

SEQ ID NO: 7892204 - DNA, 22 bp, Homo sapiens
gctgtcccgaacccctggtaat

SEQ ID NO: 7892205 - DNA, 22 bp, Homo sapiens
gctgtcccgaacccctggtaat

SEQ ID NO: 7892206 - DNA, 22 bp, Homo sapiens
gctgtcccgaacccctggtaat

SEQ ID NO: 7892207 - DNA, 22 bp, Homo sapiens
gctgtccatccacttcccagcg

SEQ ID NO: 7892208 - DNA, 22 bp, Homo sapiens
gctgtccatccacttcccagcg

SEQ ID NO: 7892209 - DNA, 22 bp, Homo sapiens
gctgtccaggttgtggagcaac

SEQ ID NO: 7892210 - DNA, 22 bp, Homo sapiens
gctgtccatgtctggcctcagt

SEQ ID NO: 7892211 - DNA, 22 bp, Homo sapiens
gctgtcccatggttgcaagatg

SEQ ID NO: 7892212 - DNA, 22 bp, Homo sapiens
gctgtccagagcatgggagcaa

SEQ ID NO: 7892213 - DNA, 22 bp, Homo sapiens
gctgtccaacctgcactcgcgt

SEQ ID NO: 7892214 - DNA, 22 bp, Homo sapiens
gctgtcatagagtgggtgggcc

SEQ ID NO: 7892215 - DNA, 22 bp, Homo sapiens
gctgtcagttttacccacagac

SEQ ID NO: 7892216 - DNA, 22 bp, Homo sapiens
gctgtccaggttgtggagcaac

SEQ ID NO: 7892217 - DNA, 22 bp, Homo sapiens
gctgtccaggttgtggagcaac

SEQ ID NO: 7892218 - DNA, 22 bp, Homo sapiens
gctgtccaggttgtggagcaac

SEQ ID NO: 7892219 - DNA, 22 bp, Homo sapiens
gctgtccaggttgtggagcaac

SEQ ID NO: 7892220 - DNA, 22 bp, Homo sapiens
gctgtccagctccagccagcca

SEQ ID NO: 7892221 - DNA, 22 bp, Homo sapiens
gctgtctgggaggcctccactt

SEQ ID NO: 7892222 - DNA, 22 bp, Homo sapiens
gctgtctgctgtgcactgagca

SEQ ID NO: 7892223 - DNA, 22 bp, Homo sapiens
gctgtctggaggctctgaggga

SEQ ID NO: 7892224 - DNA, 22 bp, Homo sapiens
gctgtctggaggctctgaggga

SEQ ID NO: 7892225 - DNA, 22 bp, Homo sapiens
gctgtctggatatcttggaatt

SEQ ID NO: 7892226 - DNA, 22 bp, Homo sapiens
gctgtctgtctctgtcccacca

SEQ ID NO: 7892227 - DNA, 22 bp, Homo sapiens
gctgtctgggttgagggccctg

SEQ ID NO: 7892228 - DNA, 22 bp, Homo sapiens
gctgtctgggttgagggccctg

SEQ ID NO: 7892229 - DNA, 22 bp, Homo sapiens
gctgtctgtggtgtcagctgac

SEQ ID NO: 7892230 - DNA, 22 bp, Homo sapiens
gctgtgtgaccctagccagtag

SEQ ID NO: 7892231 - DNA, 22 bp, Homo sapiens
gctgtctgttcgagcgtgtgtt

SEQ ID NO: 7892232 - DNA, 22 bp, Homo sapiens
gctgtctgtctctgtgacttaa

SEQ ID NO: 7892233 - DNA, 22 bp, Homo sapiens
gctgtctgtctctgtcccacca

SEQ ID NO: 7892234 - DNA, 18 bp, Homo sapiens
gctgtgtgcacctgataa

SEQ ID NO: 7892235 - DNA, 22 bp, Homo sapiens
gctgtgtgactgagagcctggc

SEQ ID NO: 7892236 - DNA, 22 bp, Homo sapiens
gctgtgtgccaggggaaggctg

SEQ ID NO: 7892237 - DNA, 22 bp, Homo sapiens
gctgtgtgctaggatatgtttt

SEQ ID NO: 7892238 - DNA, 22 bp, Homo sapiens
gctgtgtgccaggggaaggctg

SEQ ID NO: 7892239 - DNA, 22 bp, Homo sapiens
gctgtgtgctaggatatgtttt

SEQ ID NO: 7892240 - DNA, 22 bp, Homo sapiens
gctgtgtgctcacgtagtggaa

SEQ ID NO: 7892241 - DNA, 22 bp, Homo sapiens
gctgtgtgctcacgtagtggaa

SEQ ID NO: 7892242 - DNA, 22 bp, Homo sapiens
gctgtgtgctcacgtagtggaa

SEQ ID NO: 7892243 - DNA, 22 bp, Homo sapiens
gctgtgtgctcacgtagtggaa

SEQ ID NO: 7892244 - DNA, 22 bp, Homo sapiens
gctgtgtgactgagagcctggc

SEQ ID NO: 7892245 - DNA, 22 bp, Homo sapiens
gctgtgtgactgagagcctggc

SEQ ID NO: 7892246 - DNA, 22 bp, Homo sapiens
gctgtgtgactgagagcctggc

SEQ ID NO: 7892247 - DNA, 22 bp, Homo sapiens
gctgtgtgactgagagcctggc

SEQ ID NO: 7892248 - DNA, 19 bp, Homo sapiens
gctgtgtgaccttgggcaa

SEQ ID NO: 7892249 - DNA, 19 bp, Homo sapiens
gctgtgtgaccttgggcaa

SEQ ID NO: 7892250 - DNA, 19 bp, Homo sapiens
gctgtgtgaccttgggcaa

SEQ ID NO: 7892251 - DNA, 22 bp, Homo sapiens
gctgtgtgacctgggcaagtct

SEQ ID NO: 7892252 - DNA, 22 bp, Homo sapiens
gctgtgtgacctgggcaagtct

SEQ ID NO: 7892253 - DNA, 22 bp, Homo sapiens
gctgtgtgctcacgtagtggaa

SEQ ID NO: 7892254 - DNA, 22 bp, Homo sapiens
gctgtgtgctcacgtagtggaa

SEQ ID NO: 7892255 - DNA, 22 bp, Homo sapiens
gctgtgtgctctggtctttctt

SEQ ID NO: 7892256 - DNA, 22 bp, Homo sapiens
gctgtgtgctgggcatggcact

SEQ ID NO: 7892257 - DNA, 22 bp, Homo sapiens
gctgtgtgctgggcatggcact

SEQ ID NO: 7892258 - DNA, 22 bp, Homo sapiens
gctgtgtgctgggcatggcact

SEQ ID NO: 7892259 - DNA, 22 bp, Homo sapiens
gctgtgtgctgggcatggcact

SEQ ID NO: 7892260 - DNA, 22 bp, Homo sapiens
gctgtgtgctgggcatggcact

SEQ ID NO: 7892261 - DNA, 22 bp, Homo sapiens
gctgtgtggctgtgccgtcacg

SEQ ID NO: 7892262 - DNA, 22 bp, Homo sapiens
gctgtgtgctgggcatggcact

SEQ ID NO: 7892263 - DNA, 22 bp, Homo sapiens
gctgtgtgctgggcatggcact

SEQ ID NO: 7892264 - DNA, 22 bp, Homo sapiens
gctgtgtgctgggcatggcact

SEQ ID NO: 7892265 - DNA, 22 bp, Homo sapiens
gctgtgtgttcaataatgtgat

SEQ ID NO: 7892266 - DNA, 22 bp, Homo sapiens
gctgtgtgttcaataatgtgat

SEQ ID NO: 7892267 - DNA, 22 bp, Homo sapiens
gctgtgtgttcaataatgtgat

SEQ ID NO: 7892268 - DNA, 22 bp, Homo sapiens
gctgtgtgttcaataatgtgat

SEQ ID NO: 7892269 - DNA, 22 bp, Homo sapiens
gctgtgtgttcaataatgtgat

SEQ ID NO: 7892270 - DNA, 22 bp, Homo sapiens
gctgtgtgttcaataatgtgat

SEQ ID NO: 7892271 - DNA, 22 bp, Homo sapiens
gctgtgtgttcaataatgtgat

SEQ ID NO: 7892272 - DNA, 22 bp, Homo sapiens
gctgtgttggtgaagctgtagc

SEQ ID NO: 7892273 - DNA, 22 bp, Homo sapiens
gctgtgtttgacagtagcagac

SEQ ID NO: 7892274 - DNA, 22 bp, Homo sapiens
gctgttggggccagcaggtcat

SEQ ID NO: 7892275 - DNA, 21 bp, Homo sapiens
gctgtttaacaataaggagtc

SEQ ID NO: 7892276 - DNA, 22 bp, Homo sapiens
gctgtttaaatttaagtgtttc

SEQ ID NO: 7892277 - DNA, 22 bp, Homo sapiens
gctgtgttttatgttaggttaa

SEQ ID NO: 7892278 - DNA, 22 bp, Homo sapiens
gctgttggcgaggagctcagct

SEQ ID NO: 7892279 - DNA, 22 bp, Homo sapiens
gcttaaaatccatgatttttac

SEQ ID NO: 7892280 - DNA, 22 bp, Homo sapiens
gcttaaaatccatgatttttac

SEQ ID NO: 7892281 - DNA, 22 bp, Homo sapiens
gcttaaaagccacttagtctat

SEQ ID NO: 7892282 - DNA, 22 bp, Homo sapiens
gcttaaaagccacttagtctat

SEQ ID NO: 7892283 - DNA, 22 bp, Homo sapiens
gctgtttctttggcaaactgat

SEQ ID NO: 7892284 - DNA, 22 bp, Homo sapiens
gctgtttctgtggtgtatagcc

SEQ ID NO: 7892285 - DNA, 22 bp, Homo sapiens
gctgtttctttcctggcacttg

SEQ ID NO: 7892286 - DNA, 22 bp, Homo sapiens
gctgtttctgagtagctaggct

SEQ ID NO: 7892287 - DNA, 22 bp, Homo sapiens
gctgtttctcttgagtcaaaat

SEQ ID NO: 7892288 - DNA, 22 bp, Homo sapiens
gctgtttctgagtagctaggct

SEQ ID NO: 7892289 - DNA, 22 bp, Homo sapiens
gctgtttctcttgagtcaaaat

SEQ ID NO: 7892290 - DNA, 22 bp, Homo sapiens
gctgtttctccaggtcaggaag

SEQ ID NO: 7892291 - DNA, 22 bp, Homo sapiens
gctgtttctaccagaagaatca

SEQ ID NO: 7892292 - DNA, 22 bp, Homo sapiens
gctgtttcgggtggaggtggag

SEQ ID NO: 7892293 - DNA, 22 bp, Homo sapiens
gctgtttctaagctggttccta

SEQ ID NO: 7892294 - DNA, 22 bp, Homo sapiens
gctgtttcggcctcctggggaa

SEQ ID NO: 7892295 - DNA, 22 bp, Homo sapiens
gctgtttcctacatggtgttat

SEQ ID NO: 7892296 - DNA, 22 bp, Homo sapiens
gctgtttccccttcacagtggc

SEQ ID NO: 7892297 - DNA, 22 bp, Homo sapiens
gctgtttccatttaagtgaatc

SEQ ID NO: 7892298 - DNA, 22 bp, Homo sapiens
gctgtttccagttacgtggata

SEQ ID NO: 7892299 - DNA, 22 bp, Homo sapiens
gctgtttagctgggtaaatgga

SEQ ID NO: 7892300 - DNA, 22 bp, Homo sapiens
gctgtttagtggcagagtcaga

SEQ ID NO: 7892301 - DNA, 22 bp, Homo sapiens
gctgtttagctgggtaaatgga

SEQ ID NO: 7892302 - DNA, 22 bp, Homo sapiens
gctgtttacatgaaaaatgctc

SEQ ID NO: 7892303 - DNA, 22 bp, Homo sapiens
gctgtttagatccacactgttg

SEQ ID NO: 7892304 - DNA, 22 bp, Homo sapiens
gctgtttacatgaaaaatgctc

SEQ ID NO: 7892305 - DNA, 22 bp, Homo sapiens
gctgtttaagtggaatttgttt

SEQ ID NO: 7892306 - DNA, 22 bp, Homo sapiens
gctgtttaattcaccattcaac

SEQ ID NO: 7892307 - DNA, 22 bp, Homo sapiens
gcttaaagttgtaaattagaga

SEQ ID NO: 7892308 - DNA, 22 bp, Homo sapiens
gcttaaatcccaatgctagacc

SEQ ID NO: 7892309 - DNA, 22 bp, Homo sapiens
gcttaaatcccaatgctagacc

SEQ ID NO: 7892310 - DNA, 22 bp, Homo sapiens
gcttaaatcccaatgctagacc

SEQ ID NO: 7892311 - DNA, 22 bp, Homo sapiens
gcttaaattgtttgtggatagt

SEQ ID NO: 7892312 - DNA, 22 bp, Homo sapiens
gcttaaattgtttgtggatagt

SEQ ID NO: 7892313 - DNA, 22 bp, Homo sapiens
gcttaaattgtttgtggatagt

SEQ ID NO: 7892314 - DNA, 21 bp, Homo sapiens
gcttggagtagcttgaaggag

SEQ ID NO: 7892315 - DNA, 22 bp, Homo sapiens
gcttggagtagaatgcattctt

SEQ ID NO: 7892316 - DNA, 21 bp, Homo sapiens
gcttggagtagcttgaaggag

SEQ ID NO: 7892317 - DNA, 22 bp, Homo sapiens
gcttggagatgggggatgagcc

SEQ ID NO: 7892318 - DNA, 22 bp, Homo sapiens
gcttggagatgggggatgagcc

SEQ ID NO: 7892319 - DNA, 22 bp, Homo sapiens
gcttggagatgggggatgagcc

SEQ ID NO: 7892320 - DNA, 22 bp, Homo sapiens
gcttggagatgggggatgagcc

SEQ ID NO: 7892321 - DNA, 22 bp, Homo sapiens
gcttggagatgggggatgagcc

SEQ ID NO: 7892322 - DNA, 22 bp, Homo sapiens
gcttggagaagatgttctcaat

SEQ ID NO: 7892323 - DNA, 22 bp, Homo sapiens
gcttggaagtaggattgggaga

SEQ ID NO: 7892324 - DNA, 22 bp, Homo sapiens
gcttgtctctcagccccagtca

SEQ ID NO: 7892325 - DNA, 23 bp, Homo sapiens
gcttgtctagtgaattcatatct

SEQ ID NO: 7892326 - DNA, 22 bp, Homo sapiens
gcttgtcatagttgttacaaat

SEQ ID NO: 7892327 - DNA, 22 bp, Homo sapiens
gcttggggtcatgaggctgctg

SEQ ID NO: 7892328 - DNA, 18 bp, Homo sapiens
gcttggtttccacaaacc

SEQ ID NO: 7892329 - DNA, 22 bp, Homo sapiens
gcttggggtcatgaggctgctg

SEQ ID NO: 7892330 - DNA, 22 bp, Homo sapiens
gcttggggtcatgaggctgctg

SEQ ID NO: 7892331 - DNA, 22 bp, Homo sapiens
gcttggggtcatgaggctgctg

SEQ ID NO: 7892332 - DNA, 22 bp, Homo sapiens
gcttggcagggcctgctggagc

SEQ ID NO: 7892333 - DNA, 22 bp, Homo sapiens
gcttggcagcaacaggcatccc

SEQ ID NO: 7892334 - DNA, 20 bp, Homo sapiens
gcttggcacctgctcattgt

SEQ ID NO: 7892335 - DNA, 22 bp, Homo sapiens
gctttacataaacatttattat

SEQ ID NO: 7892336 - DNA, 22 bp, Homo sapiens
gctttacagagaaagtttgcct

SEQ ID NO: 7892337 - DNA, 22 bp, Homo sapiens
gctttacatgatttctcaccct

SEQ ID NO: 7892338 - DNA, 22 bp, Homo sapiens
gctttacataaacatttattat

SEQ ID NO: 7892339 - DNA, 22 bp, Homo sapiens
gctttacataaacatttattat

SEQ ID NO: 7892340 - DNA, 22 bp, Homo sapiens
gctttaatgcaatttcacctca

SEQ ID NO: 7892341 - DNA, 22 bp, Homo sapiens
gctttacaagtggtgcagatta

SEQ ID NO: 7892342 - DNA, 20 bp, Homo sapiens
gctttaagccaaaatgtgaa

SEQ ID NO: 7892343 - DNA, 22 bp, Homo sapiens
gctttaaatggcttgcccaagt

SEQ ID NO: 7892344 - DNA, 22 bp, Homo sapiens
gctttaaatggcttgcccaagt

SEQ ID NO: 7892345 - DNA, 22 bp, Homo sapiens
gctttaaacctctactctgtcc

SEQ ID NO: 7892346 - DNA, 22 bp, Homo sapiens
gctttaaacctctactctgtcc

SEQ ID NO: 7892347 - DNA, 22 bp, Homo sapiens
gctttaaacctctactctgtcc

SEQ ID NO: 7892348 - DNA, 22 bp, Homo sapiens
gcttgtttgtgatttctccaga

SEQ ID NO: 7892349 - DNA, 23 bp, Homo sapiens
gcttgtgtatacaggaggccacc

SEQ ID NO: 7892350 - DNA, 22 bp, Homo sapiens
gcttgtttgtgcctctgcagaa

SEQ ID NO: 7892351 - DNA, 22 bp, Homo sapiens
gcttgtctgctgagccacctgt

SEQ ID NO: 7892352 - DNA, 22 bp, Homo sapiens
gcttgtctctcagccccagtca

SEQ ID NO: 7892353 - DNA, 22 bp, Homo sapiens
gcttgtcattactggtttctcg

SEQ ID NO: 7892354 - DNA, 22 bp, Homo sapiens
gcttttttgctattgaagtggt

SEQ ID NO: 7892355 - DNA, 22 bp, Homo sapiens
gcttttttaggtaagacccagg

SEQ ID NO: 7892356 - DNA, 22 bp, Homo sapiens
gcttttttaggtaagacccagg

SEQ ID NO: 7892357 - DNA, 19 bp, Homo sapiens
gctttttgttgtcaaaggt

SEQ ID NO: 7892358 - DNA, 22 bp, Homo sapiens
gcttttttgggatgcctgcctt

SEQ ID NO: 7892359 - DNA, 21 bp, Homo sapiens
gctttttgtatggcccaggaa

SEQ ID NO: 7892360 - DNA, 18 bp, Homo sapiens
gctttttagtgcatcttc

SEQ ID NO: 7892361 - DNA, 18 bp, Homo sapiens
gctttttagtgcatcttc

SEQ ID NO: 7892362 - DNA, 18 bp, Homo sapiens
gctttttagtgcatcttc

SEQ ID NO: 7892363 - DNA, 22 bp, Homo sapiens
gcttttggacctctgatgtttc

SEQ ID NO: 7892364 - DNA, 22 bp, Homo sapiens
gcttttcttcagcagcctgatg

SEQ ID NO: 7892365 - DNA, 22 bp, Homo sapiens
gcttttcttcagcagcctgatg

SEQ ID NO: 7892366 - DNA, 19 bp, Homo sapiens
gcttttctccttcaagcca

SEQ ID NO: 7892367 - DNA, 22 bp, Homo sapiens
gcttttgtcatggtgactcagt

SEQ ID NO: 7892368 - DNA, 22 bp, Homo sapiens
gcttttgtcattcaaatgctct

SEQ ID NO: 7892369 - DNA, 22 bp, Homo sapiens
gcttttgtcatggtgactcagt

SEQ ID NO: 7892370 - DNA, 22 bp, Homo sapiens
gcttttggacctctgatgtttc

SEQ ID NO: 7892371 - DNA, 18 bp, Homo sapiens
gctttttagtgcatcttc

SEQ ID NO: 7892372 - DNA, 22 bp, Homo sapiens
gcttttgtcattcaaatgctct

SEQ ID NO: 7892373 - DNA, 22 bp, Homo sapiens
gcttttgtgagattaagctact

SEQ ID NO: 7892374 - DNA, 22 bp, Homo sapiens
gcttttgtgagctctcactttg

SEQ ID NO: 7892375 - DNA, 22 bp, Homo sapiens
gcttttgtgagctctcactttg

SEQ ID NO: 7892376 - DNA, 22 bp, Homo sapiens
gcttttctccttagtgtccctg

SEQ ID NO: 7892377 - DNA, 19 bp, Homo sapiens
gcttttctccttcaagcca

SEQ ID NO: 7892378 - DNA, 22 bp, Homo sapiens
gcttttctccttagtgtccctg

SEQ ID NO: 7892379 - DNA, 22 bp, Homo sapiens
gcttttctataagaactttcaa

SEQ ID NO: 7892380 - DNA, 22 bp, Homo sapiens
gcttttctataagaactttcaa

SEQ ID NO: 7892381 - DNA, 22 bp, Homo sapiens
gcttttctagctagaacatccg

SEQ ID NO: 7892382 - DNA, 22 bp, Homo sapiens
gcttttctataagaactttcaa

SEQ ID NO: 7892383 - DNA, 22 bp, Homo sapiens
gcttttctagctagaacatccg

SEQ ID NO: 7892384 - DNA, 22 bp, Homo sapiens
gcttttcatagataaaattcta

SEQ ID NO: 7892385 - DNA, 22 bp, Homo sapiens
gcttttcatgacaactcagcga

SEQ ID NO: 7892386 - DNA, 22 bp, Homo sapiens
gcttttcctgactttccattag

SEQ ID NO: 7892387 - DNA, 22 bp, Homo sapiens
gcttttcatagataaaattcta

SEQ ID NO: 7892388 - DNA, 22 bp, Homo sapiens
gcttttatttcttcacaaaagt

SEQ ID NO: 7892389 - DNA, 22 bp, Homo sapiens
gcttttatttcttcacaaaagt

SEQ ID NO: 7892390 - DNA, 22 bp, Homo sapiens
gctttgtgtgaagtccatggcg

SEQ ID NO: 7892391 - DNA, 22 bp, Homo sapiens
gcttttatgcacataagggtca

SEQ ID NO: 7892392 - DNA, 22 bp, Homo sapiens
gcttttatgcacataagggtca

SEQ ID NO: 7892393 - DNA, 19 bp, Homo sapiens
gcttttattgctcaggtgc

SEQ ID NO: 7892394 - DNA, 19 bp, Homo sapiens
gcttttattgctcaggtgc

SEQ ID NO: 7892395 - DNA, 22 bp, Homo sapiens
gcttttattgtctttacgacga

SEQ ID NO: 7892396 - DNA, 22 bp, Homo sapiens
gcttttattgtctttacgacga

SEQ ID NO: 7892397 - DNA, 22 bp, Homo sapiens
gcttttatttcttcacaaaagt

SEQ ID NO: 7892398 - DNA, 22 bp, Homo sapiens
gcttttatttcttcacaaaagt

SEQ ID NO: 7892399 - DNA, 22 bp, Homo sapiens
gcttttattgtctttacgacga

SEQ ID NO: 7892400 - DNA, 22 bp, Homo sapiens
gctttacattttggaaaggtga

SEQ ID NO: 7892401 - DNA, 22 bp, Homo sapiens
gctttactgagatgacacaggg

SEQ ID NO: 7892402 - DNA, 22 bp, Homo sapiens
gctttagaaatatcactgtgga

SEQ ID NO: 7892403 - DNA, 22 bp, Homo sapiens
gctttagaaatatcactgtgga

SEQ ID NO: 7892404 - DNA, 22 bp, Homo sapiens
gctttagaaatgagtaaattag

SEQ ID NO: 7892405 - DNA, 22 bp, Homo sapiens
gctttagagcccagcttggtgg

SEQ ID NO: 7892406 - DNA, 22 bp, Homo sapiens
gctttagagaagaaaggttgct

SEQ ID NO: 7892407 - DNA, 22 bp, Homo sapiens
gctttagagaagaaaggttgct

SEQ ID NO: 7892408 - DNA, 22 bp, Homo sapiens
gctttagaaatgagtaaattag

SEQ ID NO: 7892409 - DNA, 22 bp, Homo sapiens
gctttagaaatgtaggagatac

SEQ ID NO: 7892410 - DNA, 22 bp, Homo sapiens
gctttagaaatgtaggagatac

SEQ ID NO: 7892411 - DNA, 22 bp, Homo sapiens
gctttagaagacactctgtttt

SEQ ID NO: 7892412 - DNA, 22 bp, Homo sapiens
gctttagacataaagttcttca

SEQ ID NO: 7892413 - DNA, 22 bp, Homo sapiens
gctttagatagatttagtcttt

SEQ ID NO: 7892414 - DNA, 22 bp, Homo sapiens
gctttagatctgactttctgtg

SEQ ID NO: 7892415 - DNA, 21 bp, Homo sapiens
gctttagatttagtgagccag

SEQ ID NO: 7892416 - DNA, 22 bp, Homo sapiens
gctttagatagatttagtcttt

SEQ ID NO: 7892417 - DNA, 22 bp, Homo sapiens
gctttagagcccagcttggtgg

SEQ ID NO: 7892418 - DNA, 22 bp, Homo sapiens
gctttagatactcccaatgtcc

SEQ ID NO: 7892419 - DNA, 19 bp, Homo sapiens
gctttagtttactcatcta

SEQ ID NO: 7892420 - DNA, 22 bp, Homo sapiens
gctttatagccctattacatga

SEQ ID NO: 7892421 - DNA, 22 bp, Homo sapiens
gctttatagccctattacatga

SEQ ID NO: 7892422 - DNA, 23 bp, Homo sapiens
gctttatagttctcccaacatta

SEQ ID NO: 7892423 - DNA, 23 bp, Homo sapiens
gctttatagttctcccaacatta

SEQ ID NO: 7892424 - DNA, 19 bp, Homo sapiens
gctttagtttactcatcta

SEQ ID NO: 7892425 - DNA, 22 bp, Homo sapiens
gctttagtttccacggttataa

SEQ ID NO: 7892426 - DNA, 22 bp, Homo sapiens
gctttgtgaattattactcaca

SEQ ID NO: 7892427 - DNA, 22 bp, Homo sapiens
gctttgtgaattattactcaca

SEQ ID NO: 7892428 - DNA, 22 bp, Homo sapiens
gctttggttcaaccaggcaatt

SEQ ID NO: 7892429 - DNA, 22 bp, Homo sapiens
gctttggtcttctagctgtgag

SEQ ID NO: 7892430 - DNA, 22 bp, Homo sapiens
gctttggtcttctagctgtgag

SEQ ID NO: 7892431 - DNA, 22 bp, Homo sapiens
gctttggtgatacttgctggct

SEQ ID NO: 7892432 - DNA, 22 bp, Homo sapiens
gctttggtgatacttgctggct

SEQ ID NO: 7892433 - DNA, 22 bp, Homo sapiens
gctttggtcaggtgtccagccc

SEQ ID NO: 7892434 - DNA, 22 bp, Homo sapiens
gctttggtcaggtgtccagccc

SEQ ID NO: 7892435 - DNA, 22 bp, Homo sapiens
gctttggtacctcctgctgatc

SEQ ID NO: 7892436 - DNA, 22 bp, Homo sapiens
gctttggtacctcctgctgatc

SEQ ID NO: 7892437 - DNA, 22 bp, Homo sapiens
gctttgggtgtcctctgggcct

SEQ ID NO: 7892438 - DNA, 22 bp, Homo sapiens
gctttggatgtgtgcctgaggt

SEQ ID NO: 7892439 - DNA, 22 bp, Homo sapiens
gctttggagttaggactcggcc

SEQ ID NO: 7892440 - DNA, 22 bp, Homo sapiens
gctttggatgtgtgcctgaggt

SEQ ID NO: 7892441 - DNA, 22 bp, Homo sapiens
gctttatggattgtaaactgca

SEQ ID NO: 7892442 - DNA, 22 bp, Homo sapiens
gctttggatgtgtgcctgaggt

SEQ ID NO: 7892443 - DNA, 17 bp, Homo sapiens
gctttggcagtttcaag

SEQ ID NO: 7892444 - DNA, 22 bp, Homo sapiens
gctttggatgtgtgcctgaggt

SEQ ID NO: 7892445 - DNA, 21 bp, Homo sapiens
gcagctggtctcagagcttgc

SEQ ID NO: 7892446 - DNA, 21 bp, Homo sapiens
gcagctggtctcagagcttgc

SEQ ID NO: 7892447 - DNA, 22 bp, Homo sapiens
gcagctggtctggcctagagta

SEQ ID NO: 7892448 - DNA, 22 bp, Homo sapiens
gcagctggtctggcctagagta

SEQ ID NO: 7892449 - DNA, 22 bp, Homo sapiens
gcagctggtgcaaatgtcactc

SEQ ID NO: 7892450 - DNA, 22 bp, Homo sapiens
gcagctggtgcaaatgtcactc

SEQ ID NO: 7892451 - DNA, 22 bp, Homo sapiens
gcagctggtgcaaatgtcactc

SEQ ID NO: 7892452 - DNA, 22 bp, Homo sapiens
gcagctggtctggcctagagta

SEQ ID NO: 7892453 - DNA, 22 bp, Homo sapiens
gcagctggtctggcctagagta

SEQ ID NO: 7892454 - DNA, 22 bp, Homo sapiens
gcagctggtgcaaatgtcactc

SEQ ID NO: 7892455 - DNA, 23 bp, Homo sapiens
gcagctggttagaagggaaggag

SEQ ID NO: 7892456 - DNA, 23 bp, Homo sapiens
gcagctggttagaagggaaggag

SEQ ID NO: 7892457 - DNA, 23 bp, Homo sapiens
gcagctggttagaagggaaggag

SEQ ID NO: 7892458 - DNA, 22 bp, Homo sapiens
gcagctggttaatgggagaatt

SEQ ID NO: 7892459 - DNA, 23 bp, Homo sapiens
gcagctggttagaagggaaggag

SEQ ID NO: 7892460 - DNA, 23 bp, Homo sapiens
gcagctggttagaagggaaggag

SEQ ID NO: 7892461 - DNA, 23 bp, Homo sapiens
gcagctggttagaagggaaggag

SEQ ID NO: 7892462 - DNA, 23 bp, Homo sapiens
gcagctggttagaagggaaggag

SEQ ID NO: 7892463 - DNA, 23 bp, Homo sapiens
gcagctggttagaagggaaggag

SEQ ID NO: 7892464 - DNA, 23 bp, Homo sapiens
gcagctggttagaagggaaggag

SEQ ID NO: 7892465 - DNA, 22 bp, Homo sapiens
gcagctggttaatgggagaatt

SEQ ID NO: 7892466 - DNA, 22 bp, Homo sapiens
gcagctggttaatgggagaatt

SEQ ID NO: 7892467 - DNA, 22 bp, Homo sapiens
gcagctggtgcaaatgtcactc

SEQ ID NO: 7892468 - DNA, 22 bp, Homo sapiens
gcagctggtgcaaatgtcactc

SEQ ID NO: 7892469 - DNA, 22 bp, Homo sapiens
gcagctggttaatgggagaatt

SEQ ID NO: 7892470 - DNA, 22 bp, Homo sapiens
gcagctggttaatgggagaatt

SEQ ID NO: 7892471 - DNA, 22 bp, Homo sapiens
gcagctggttaatgggagaatt

SEQ ID NO: 7892472 - DNA, 22 bp, Homo sapiens
gcagctggttaatgggagaatt

SEQ ID NO: 7892473 - DNA, 22 bp, Homo sapiens
gcagctgggccccagcctctcc

SEQ ID NO: 7892474 - DNA, 22 bp, Homo sapiens
gcagctgggccccagcctctcc

SEQ ID NO: 7892475 - DNA, 22 bp, Homo sapiens
gcagctgggccccagcctctcc

SEQ ID NO: 7892476 - DNA, 22 bp, Homo sapiens
gcagctgggccccagcctctcc

SEQ ID NO: 7892477 - DNA, 22 bp, Homo sapiens
gcagctgggacactgaggccag

SEQ ID NO: 7892478 - DNA, 22 bp, Homo sapiens
gcagctgggacactgaggccag

SEQ ID NO: 7892479 - DNA, 22 bp, Homo sapiens
gcagctgggacactgaggccag

SEQ ID NO: 7892480 - DNA, 22 bp, Homo sapiens
gcagctggggaggtcgtgggga

SEQ ID NO: 7892481 - DNA, 22 bp, Homo sapiens
gcagctggggaggtcgtgggga

SEQ ID NO: 7892482 - DNA, 22 bp, Homo sapiens
gcagctggggaggtcgtgggga

SEQ ID NO: 7892483 - DNA, 22 bp, Homo sapiens
gcagctggggaggtcgtgggga

SEQ ID NO: 7892484 - DNA, 22 bp, Homo sapiens
gcagctggggaggtcgtgggga

SEQ ID NO: 7892485 - DNA, 22 bp, Homo sapiens
gcagctggggaggtcgtgggga

SEQ ID NO: 7892486 - DNA, 22 bp, Homo sapiens
gcagctggggaggtcgtgggga

SEQ ID NO: 7892487 - DNA, 22 bp, Homo sapiens
gcagctggggccacacttaggc

SEQ ID NO: 7892488 - DNA, 22 bp, Homo sapiens
gcagctggggccacacttaggc

SEQ ID NO: 7892489 - DNA, 22 bp, Homo sapiens
gcagctggggccacacttaggc

SEQ ID NO: 7892490 - DNA, 22 bp, Homo sapiens
gcagctggggaggtcgtgggga

SEQ ID NO: 7892491 - DNA, 22 bp, Homo sapiens
gcagctggggaggtcgtgggga

SEQ ID NO: 7892492 - DNA, 22 bp, Homo sapiens
gcagctgggtctgtgtgggctg

SEQ ID NO: 7892493 - DNA, 22 bp, Homo sapiens
gcagctgggtctgtgtgggctg

SEQ ID NO: 7892494 - DNA, 22 bp, Homo sapiens
gcagctgggtctgtgtgggctg

SEQ ID NO: 7892495 - DNA, 22 bp, Homo sapiens
gcagctgggtctgtgtgggctg

SEQ ID NO: 7892496 - DNA, 22 bp, Homo sapiens
gcagctgggtctgtgtgggctg

SEQ ID NO: 7892497 - DNA, 22 bp, Homo sapiens
gcagctgggtctgtgtgggctg

SEQ ID NO: 7892498 - DNA, 22 bp, Homo sapiens
gcagctgggtctgtgtgggctg

SEQ ID NO: 7892499 - DNA, 22 bp, Homo sapiens
gcagctgggtctgtgtgggctg

SEQ ID NO: 7892500 - DNA, 22 bp, Homo sapiens
gcagctggccctgacacgcaga

SEQ ID NO: 7892501 - DNA, 22 bp, Homo sapiens
gcagcccacaccactctgctca

SEQ ID NO: 7892502 - DNA, 22 bp, Homo sapiens
gcagcccacagctggaggccta

SEQ ID NO: 7892503 - DNA, 22 bp, Homo sapiens
gcagcccaagcctgagcatcct

SEQ ID NO: 7892504 - DNA, 22 bp, Homo sapiens
gcagcccaagcctgagcatcct

SEQ ID NO: 7892505 - DNA, 22 bp, Homo sapiens
gcagcccaatggactgagacag

SEQ ID NO: 7892506 - DNA, 22 bp, Homo sapiens
gcagcccaatggactgagacag

SEQ ID NO: 7892507 - DNA, 22 bp, Homo sapiens
gcagcccaatggactgagacag

SEQ ID NO: 7892508 - DNA, 22 bp, Homo sapiens
gcagcccacaccactctgctca

SEQ ID NO: 7892509 - DNA, 22 bp, Homo sapiens
gcagctgggacactgaggccag

SEQ ID NO: 7892510 - DNA, 22 bp, Homo sapiens
gcagctgggacactgaggccag

SEQ ID NO: 7892511 - DNA, 22 bp, Homo sapiens
gcagctgggacactgaggccag

SEQ ID NO: 7892512 - DNA, 22 bp, Homo sapiens
gcagctgggacactgaggccag

SEQ ID NO: 7892513 - DNA, 22 bp, Homo sapiens
gcagctgggacactgaggccag

SEQ ID NO: 7892514 - DNA, 22 bp, Homo sapiens
gcagctgggacactgaggccag

SEQ ID NO: 7892515 - DNA, 22 bp, Homo sapiens
gcagctgggacactgaggccag

SEQ ID NO: 7892516 - DNA, 22 bp, Homo sapiens
gcagctggctctgggaaaaact

SEQ ID NO: 7892517 - DNA, 22 bp, Homo sapiens
gcagctgggacactgaggccag

SEQ ID NO: 7892518 - DNA, 22 bp, Homo sapiens
gcagctggctcagagaggtggg

SEQ ID NO: 7892519 - DNA, 22 bp, Homo sapiens
gcagctggctctgggaaaaact

SEQ ID NO: 7892520 - DNA, 22 bp, Homo sapiens
gcagctggctcagagaggtggg

SEQ ID NO: 7892521 - DNA, 22 bp, Homo sapiens
gcagctggctcagagaggtggg

SEQ ID NO: 7892522 - DNA, 22 bp, Homo sapiens
gcagctggctcagagaggtggg

SEQ ID NO: 7892523 - DNA, 22 bp, Homo sapiens
gcagctggctcagagaggtggg

SEQ ID NO: 7892524 - DNA, 22 bp, Homo sapiens
gcagctggctcagagaggtggg

SEQ ID NO: 7892525 - DNA, 22 bp, Homo sapiens
gcagctggctcagagaggtggg

SEQ ID NO: 7892526 - DNA, 22 bp, Homo sapiens
gcagctggctcagagaggtggg

SEQ ID NO: 7892527 - DNA, 22 bp, Homo sapiens
gcagctggctcagagaggtggg

SEQ ID NO: 7892528 - DNA, 17 bp, Homo sapiens
gcagccagtgcagcagg

SEQ ID NO: 7892529 - DNA, 17 bp, Homo sapiens
gcagccagtgcagcagg

SEQ ID NO: 7892530 - DNA, 22 bp, Homo sapiens
gcagccagtatcctctgagatt

SEQ ID NO: 7892531 - DNA, 22 bp, Homo sapiens
gcagccagtatcctctgagatt

SEQ ID NO: 7892532 - DNA, 22 bp, Homo sapiens
gcagccagtatcctctgagatt

SEQ ID NO: 7892533 - DNA, 17 bp, Homo sapiens
gcagccagtgcagcagg

SEQ ID NO: 7892534 - DNA, 17 bp, Homo sapiens
gcagccagtgcagcagg

SEQ ID NO: 7892535 - DNA, 22 bp, Homo sapiens
gcagccaggaagcccaggacac

SEQ ID NO: 7892536 - DNA, 22 bp, Homo sapiens
gcagccaggaagcccaggacac

SEQ ID NO: 7892537 - DNA, 22 bp, Homo sapiens
gcagccaggaagcccaggacac

SEQ ID NO: 7892538 - DNA, 22 bp, Homo sapiens
gcagccaggaagcccaggacac

SEQ ID NO: 7892539 - DNA, 22 bp, Homo sapiens
gcagccaggtttgaggaccact

SEQ ID NO: 7892540 - DNA, 22 bp, Homo sapiens
gcagccagtatcctctgagatt

SEQ ID NO: 7892541 - DNA, 22 bp, Homo sapiens
gcagccagtatcctctgagatt

SEQ ID NO: 7892542 - DNA, 22 bp, Homo sapiens
gcagcccaaaaaagaggtagat

SEQ ID NO: 7892543 - DNA, 22 bp, Homo sapiens
gcagccagtgggatgagaaaga

SEQ ID NO: 7892544 - DNA, 22 bp, Homo sapiens
gcagccagtgggatgagaaaga

SEQ ID NO: 7892545 - DNA, 22 bp, Homo sapiens
gcagccagtgggatgagaaaga

SEQ ID NO: 7892546 - DNA, 22 bp, Homo sapiens
gcagcccaagcctgagcatcct

SEQ ID NO: 7892547 - DNA, 22 bp, Homo sapiens
gcagcccaagagactctgttga

SEQ ID NO: 7892548 - DNA, 22 bp, Homo sapiens
gcagcccaaaaaagaggtagat

SEQ ID NO: 7892549 - DNA, 22 bp, Homo sapiens
gcagccagcccctctgacctct

SEQ ID NO: 7892550 - DNA, 22 bp, Homo sapiens
gcagccagcaggaagcgggaga

SEQ ID NO: 7892551 - DNA, 22 bp, Homo sapiens
gcagccagagggggtgtgatca

SEQ ID NO: 7892552 - DNA, 22 bp, Homo sapiens
gcagccagcccctctgacctct

SEQ ID NO: 7892553 - DNA, 22 bp, Homo sapiens
gcagccagcccctctgacctct

SEQ ID NO: 7892554 - DNA, 21 bp, Homo sapiens
gcagccagacgggattcagtt

SEQ ID NO: 7892555 - DNA, 21 bp, Homo sapiens
gcagccagacgggattcagtt

SEQ ID NO: 7892556 - DNA, 22 bp, Homo sapiens
gcagccagagggggtgtgatca

SEQ ID NO: 7892557 - DNA, 22 bp, Homo sapiens
gcagccagaagactcagaacaa

SEQ ID NO: 7892558 - DNA, 21 bp, Homo sapiens
gcagccagacgggattcagtt

SEQ ID NO: 7892559 - DNA, 22 bp, Homo sapiens
gcagccagaagactcagaacaa

SEQ ID NO: 7892560 - DNA, 22 bp, Homo sapiens
gcagccaggaaagctggaccct

SEQ ID NO: 7892561 - DNA, 22 bp, Homo sapiens
gcagccaggaaagctggaccct

SEQ ID NO: 7892562 - DNA, 21 bp, Homo sapiens
gcagccagccgagaccatgcc

SEQ ID NO: 7892563 - DNA, 22 bp, Homo sapiens
gcagccaggaaagctggaccct

SEQ ID NO: 7892564 - DNA, 22 bp, Homo sapiens
gcagccaggaaagctggaccct

SEQ ID NO: 7892565 - DNA, 22 bp, Homo sapiens
gcagccaggaaagctggaccct

SEQ ID NO: 7892566 - DNA, 21 bp, Homo sapiens
gcagccagccgagaccatgcc

SEQ ID NO: 7892567 - DNA, 21 bp, Homo sapiens
gcagccagccgagaccatgcc

SEQ ID NO: 7892568 - DNA, 22 bp, Homo sapiens
gcagccagccctagtcccactt

SEQ ID NO: 7892569 - DNA, 21 bp, Homo sapiens
gcagccagccgagaccatgcc

SEQ ID NO: 7892570 - DNA, 22 bp, Homo sapiens
gcagccagcccctctgacctct

SEQ ID NO: 7892571 - DNA, 22 bp, Homo sapiens
gcagccagccctagtcccactt

SEQ ID NO: 7892572 - DNA, 22 bp, Homo sapiens
gcagcagcccagggctctcaga

SEQ ID NO: 7892573 - DNA, 22 bp, Homo sapiens
gcagcagccactattctggcat

SEQ ID NO: 7892574 - DNA, 22 bp, Homo sapiens
gcagcagccactattctggcat

SEQ ID NO: 7892575 - DNA, 22 bp, Homo sapiens
gcagcagccactattctggcat

SEQ ID NO: 7892576 - DNA, 22 bp, Homo sapiens
gcagcagcccagggctctcaga

SEQ ID NO: 7892577 - DNA, 22 bp, Homo sapiens
gcagcagcccagggctctcaga

SEQ ID NO: 7892578 - DNA, 21 bp, Homo sapiens
gcagccacagccaccaagcta

SEQ ID NO: 7892579 - DNA, 22 bp, Homo sapiens
gcagccaccctcaaggctgaat

SEQ ID NO: 7892580 - DNA, 22 bp, Homo sapiens
gcagcagcccagggctctcaga

SEQ ID NO: 7892581 - DNA, 22 bp, Homo sapiens
gcagcagcccagggctctcaga

SEQ ID NO: 7892582 - DNA, 22 bp, Homo sapiens
gcagccacagaggagggatgca

SEQ ID NO: 7892583 - DNA, 22 bp, Homo sapiens
gcagccacagaggagggatgca

SEQ ID NO: 7892584 - DNA, 22 bp, Homo sapiens
gcagccaccctcaaggctgaat

SEQ ID NO: 7892585 - DNA, 22 bp, Homo sapiens
gcagccaccctcaaggctgaat

SEQ ID NO: 7892586 - DNA, 22 bp, Homo sapiens
gcagccaccctcaaggctgaat

SEQ ID NO: 7892587 - DNA, 19 bp, Homo sapiens
gcagccaccgcggcggccg

SEQ ID NO: 7892588 - DNA, 22 bp, Homo sapiens
gcagccacctcccatggcgggg

SEQ ID NO: 7892589 - DNA, 22 bp, Homo sapiens
gcagccagaagactcagaacaa

SEQ ID NO: 7892590 - DNA, 22 bp, Homo sapiens
gcagccagaagactcagaacaa

SEQ ID NO: 7892591 - DNA, 22 bp, Homo sapiens
gcagccactttgcaaccaagag

SEQ ID NO: 7892592 - DNA, 22 bp, Homo sapiens
gcagccactctcattccacgtg

SEQ ID NO: 7892593 - DNA, 22 bp, Homo sapiens
gcagcaccaaccagggcctgtt

SEQ ID NO: 7892594 - DNA, 22 bp, Homo sapiens
gcagcacatataaacaaagaga

SEQ ID NO: 7892595 - DNA, 22 bp, Homo sapiens
gcagcacatataaacaaagaga

SEQ ID NO: 7892596 - DNA, 22 bp, Homo sapiens
gcagcacacggtggtgccctgg

SEQ ID NO: 7892597 - DNA, 22 bp, Homo sapiens
gcagcactgatcctaaacttag

SEQ ID NO: 7892598 - DNA, 22 bp, Homo sapiens
gcagcaccaaccagggcctgtt

SEQ ID NO: 7892599 - DNA, 22 bp, Homo sapiens
gcagcactaatgggccccagaa

SEQ ID NO: 7892600 - DNA, 22 bp, Homo sapiens
gcagcagaaggccaaggggagc

SEQ ID NO: 7892601 - DNA, 22 bp, Homo sapiens
gcagcagaaggccaaggggagc

SEQ ID NO: 7892602 - DNA, 22 bp, Homo sapiens
gcagcactgtcttgtcttagga

SEQ ID NO: 7892603 - DNA, 22 bp, Homo sapiens
gcagcagaaggccaaggggagc

SEQ ID NO: 7892604 - DNA, 22 bp, Homo sapiens
gcagcaagaggtttctgttgac

SEQ ID NO: 7892605 - DNA, 22 bp, Homo sapiens
gcagcaagaggtttctgttgac

SEQ ID NO: 7892606 - DNA, 22 bp, Homo sapiens
gcagcaagtctagtttgtaggc

SEQ ID NO: 7892607 - DNA, 19 bp, Homo sapiens
gcagcaatagaagacaaat

SEQ ID NO: 7892608 - DNA, 22 bp, Homo sapiens
gcagcaataatgttttggagga

SEQ ID NO: 7892609 - DNA, 22 bp, Homo sapiens
gcagcaatcccaagtctgagtg

SEQ ID NO: 7892610 - DNA, 22 bp, Homo sapiens
gcagcaatcccaagtctgagtg

SEQ ID NO: 7892611 - DNA, 22 bp, Homo sapiens
gcagcaatcttcacagtgtcat

SEQ ID NO: 7892612 - DNA, 22 bp, Homo sapiens
gcagcaatcttcacagtgtcat

SEQ ID NO: 7892613 - DNA, 22 bp, Homo sapiens
gcagcagcaggcgctcggccgt

SEQ ID NO: 7892614 - DNA, 22 bp, Homo sapiens
gcagcagcaggcgctcggccgt

SEQ ID NO: 7892615 - DNA, 22 bp, Homo sapiens
gcagcagcaggcgctcggccgt

SEQ ID NO: 7892616 - DNA, 22 bp, Homo sapiens
gcagcagcagcaattttctgtc

SEQ ID NO: 7892617 - DNA, 22 bp, Homo sapiens
gcagcagcaggcgctcggccgt

SEQ ID NO: 7892618 - DNA, 22 bp, Homo sapiens
gcagcagcaggcgctcggccgt

SEQ ID NO: 7892619 - DNA, 22 bp, Homo sapiens
gcagcagcaggcgctcggccgt

SEQ ID NO: 7892620 - DNA, 22 bp, Homo sapiens
gcagcagcaggcgctcggccgt

SEQ ID NO: 7892621 - DNA, 22 bp, Homo sapiens
gcagcagcaggcgctcggccgt

SEQ ID NO: 7892622 - DNA, 22 bp, Homo sapiens
gcagcagcagggagtctgactt

SEQ ID NO: 7892623 - DNA, 22 bp, Homo sapiens
gcagcagcaggcgctcggccgt

SEQ ID NO: 7892624 - DNA, 22 bp, Homo sapiens
gcagcagcaggcgctcggccgt

SEQ ID NO: 7892625 - DNA, 19 bp, Homo sapiens
gcagcagcatttggtaata

SEQ ID NO: 7892626 - DNA, 19 bp, Homo sapiens
gcagcagcatttggtaata

SEQ ID NO: 7892627 - DNA, 19 bp, Homo sapiens
gcagcagcatttggtaata

SEQ ID NO: 7892628 - DNA, 19 bp, Homo sapiens
gcagcagcatttggtaata

SEQ ID NO: 7892629 - DNA, 22 bp, Homo sapiens
gcagcagccactattctggcat

SEQ ID NO: 7892630 - DNA, 22 bp, Homo sapiens
gcagcagccactattctggcat

SEQ ID NO: 7892631 - DNA, 22 bp, Homo sapiens
gcagcagccactattctggcat

SEQ ID NO: 7892632 - DNA, 22 bp, Homo sapiens
gcagcagccactattctggcat

SEQ ID NO: 7892633 - DNA, 22 bp, Homo sapiens
gcagcagccactattctggcat

SEQ ID NO: 7892634 - DNA, 22 bp, Homo sapiens
gcagcagcagggagtctgactt

SEQ ID NO: 7892635 - DNA, 22 bp, Homo sapiens
gcagcagcagggagtctgactt

SEQ ID NO: 7892636 - DNA, 22 bp, Homo sapiens
gcagcagcagggagtctgactt

SEQ ID NO: 7892637 - DNA, 22 bp, Homo sapiens
gcagcagcagggagtctgactt

SEQ ID NO: 7892638 - DNA, 22 bp, Homo sapiens
gcagcagaagtagaagtacagg

SEQ ID NO: 7892639 - DNA, 22 bp, Homo sapiens
gcagcagaagtagaagtacagg

SEQ ID NO: 7892640 - DNA, 22 bp, Homo sapiens
gcagcagaaggccaaggggagc

SEQ ID NO: 7892641 - DNA, 22 bp, Homo sapiens
gcagcagatgtgggcccagagc

SEQ ID NO: 7892642 - DNA, 22 bp, Homo sapiens
gcagcagaagtagaagtacagg

SEQ ID NO: 7892643 - DNA, 22 bp, Homo sapiens
gcagcagatgtgggcccagagc

SEQ ID NO: 7892644 - DNA, 22 bp, Homo sapiens
gcagcagaagtagaagtacagg

SEQ ID NO: 7892645 - DNA, 22 bp, Homo sapiens
gcagcagcaagaaggttggact

SEQ ID NO: 7892646 - DNA, 22 bp, Homo sapiens
gcagcagcaagaaggttggact

SEQ ID NO: 7892647 - DNA, 22 bp, Homo sapiens
gcagcagattgttttttcacct

SEQ ID NO: 7892648 - DNA, 22 bp, Homo sapiens
gcagcagatgtgggcccagagc

SEQ ID NO: 7892649 - DNA, 22 bp, Homo sapiens
gcagcagcaagaaggttggact

SEQ ID NO: 7892650 - DNA, 22 bp, Homo sapiens
gcagcagcaagaaggttggact

SEQ ID NO: 7892651 - DNA, 22 bp, Homo sapiens
gcagcagcaagaaggttggact

SEQ ID NO: 7892652 - DNA, 22 bp, Homo sapiens
gcagcagcagcaattttctgtc

SEQ ID NO: 7892653 - DNA, 22 bp, Homo sapiens
gcagcagcagcaattttctgtc

SEQ ID NO: 7892654 - DNA, 22 bp, Homo sapiens
gcagcagcagcaattttctgtc

SEQ ID NO: 7892655 - DNA, 22 bp, Homo sapiens
gcagcagcagcaattttctgtc

SEQ ID NO: 7892656 - DNA, 22 bp, Homo sapiens
gcaggccaggctaggggctgtc

SEQ ID NO: 7892657 - DNA, 22 bp, Homo sapiens
gcaggccattcaggagatgtgc

SEQ ID NO: 7892658 - DNA, 19 bp, Homo sapiens
gcaggccaggaggcggagg

SEQ ID NO: 7892659 - DNA, 19 bp, Homo sapiens
gcaggccaggaggcggagg

SEQ ID NO: 7892660 - DNA, 22 bp, Homo sapiens
gcaggccaggctaggggctgtc

SEQ ID NO: 7892661 - DNA, 22 bp, Homo sapiens
gcaggccattcaggagatgtgc

SEQ ID NO: 7892662 - DNA, 22 bp, Homo sapiens
gcaggccattcaggagatgtgc

SEQ ID NO: 7892663 - DNA, 22 bp, Homo sapiens
gcaggcccagagtcgctggcct

SEQ ID NO: 7892664 - DNA, 22 bp, Homo sapiens
gcaggcccagagtcgctggcct

SEQ ID NO: 7892665 - DNA, 22 bp, Homo sapiens
gcaggccagctgtgcagatggg

SEQ ID NO: 7892666 - DNA, 22 bp, Homo sapiens
gcaggccagctgtgcagatggg

SEQ ID NO: 7892667 - DNA, 22 bp, Homo sapiens
gcaggccagctgtgcagatggg

SEQ ID NO: 7892668 - DNA, 22 bp, Homo sapiens
gcaggccagctgtgcagatggg

SEQ ID NO: 7892669 - DNA, 22 bp, Homo sapiens
gcaggccacagtggagtctctg

SEQ ID NO: 7892670 - DNA, 22 bp, Homo sapiens
gcaggccacagtggagtctctg

SEQ ID NO: 7892671 - DNA, 22 bp, Homo sapiens
gcaggccacagtggagtctctg

SEQ ID NO: 7892672 - DNA, 22 bp, Homo sapiens
gcaggccacagtggagtctctg

SEQ ID NO: 7892673 - DNA, 22 bp, Homo sapiens
gcaggccacagtggagtctctg

SEQ ID NO: 7892674 - DNA, 22 bp, Homo sapiens
gcaggccactgtctcctctggg

SEQ ID NO: 7892675 - DNA, 22 bp, Homo sapiens
gcaggccactgtctcctctggg

SEQ ID NO: 7892676 - DNA, 22 bp, Homo sapiens
gcaggccactgtctcctctggg

SEQ ID NO: 7892677 - DNA, 22 bp, Homo sapiens
gcaggccacagtggagtctctg

SEQ ID NO: 7892678 - DNA, 22 bp, Homo sapiens
gcagctgtactggcagcattgt

SEQ ID NO: 7892679 - DNA, 22 bp, Homo sapiens
gcagctgtagaggggagaaaga

SEQ ID NO: 7892680 - DNA, 22 bp, Homo sapiens
gcagctgtatcacttttaaaca

SEQ ID NO: 7892681 - DNA, 22 bp, Homo sapiens
gcagctgtactggcagcattgt

SEQ ID NO: 7892682 - DNA, 22 bp, Homo sapiens
gcagctgtaaagcagaaatagt

SEQ ID NO: 7892683 - DNA, 22 bp, Homo sapiens
gcagctgtaaagcagaaatagt

SEQ ID NO: 7892684 - DNA, 23 bp, Homo sapiens
gcagctggttagaagggaaggag

SEQ ID NO: 7892685 - DNA, 22 bp, Homo sapiens
gcagctgtcactttcacaatgc

SEQ ID NO: 7892686 - DNA, 22 bp, Homo sapiens
gcagctgtcactttcacaatgc

SEQ ID NO: 7892687 - DNA, 22 bp, Homo sapiens
gcagctgtatcacttttaaaca

SEQ ID NO: 7892688 - DNA, 22 bp, Homo sapiens
gcagctgtcactttcacaatgc

SEQ ID NO: 7892689 - DNA, 22 bp, Homo sapiens
gcagctgtcagaagttggaatc

SEQ ID NO: 7892690 - DNA, 22 bp, Homo sapiens
gcaggcatggtcgctgccaggt

SEQ ID NO: 7892691 - DNA, 22 bp, Homo sapiens
gcaggcatctctgtagccaggg

SEQ ID NO: 7892692 - DNA, 22 bp, Homo sapiens
gcaggcatctctgtagccaggg

SEQ ID NO: 7892693 - DNA, 22 bp, Homo sapiens
gcaggcagtttgcttttccctc

SEQ ID NO: 7892694 - DNA, 22 bp, Homo sapiens
gcaggcagtttgcttttccctc

SEQ ID NO: 7892695 - DNA, 22 bp, Homo sapiens
gcaggcagtttgcttttccctc

SEQ ID NO: 7892696 - DNA, 22 bp, Homo sapiens
gcaggcagtttgcttttccctc

SEQ ID NO: 7892697 - DNA, 22 bp, Homo sapiens
gcaggcatggtcgctgccaggt

SEQ ID NO: 7892698 - DNA, 22 bp, Homo sapiens
gcaggccaagccctcgcagaga

SEQ ID NO: 7892699 - DNA, 22 bp, Homo sapiens
gcaggccaagccctcgcagaga

SEQ ID NO: 7892700 - DNA, 22 bp, Homo sapiens
gcaggccaagccctcgcagaga

SEQ ID NO: 7892701 - DNA, 22 bp, Homo sapiens
gcaggccaagccctcgcagaga

SEQ ID NO: 7892702 - DNA, 22 bp, Homo sapiens
gcaggccaagccctcgcagaga

SEQ ID NO: 7892703 - DNA, 22 bp, Homo sapiens
gcaggccaagccctcgcagaga

SEQ ID NO: 7892704 - DNA, 22 bp, Homo sapiens
gcaggccacagtggagtctctg

SEQ ID NO: 7892705 - DNA, 22 bp, Homo sapiens
gcaggcctcccctgctggagct

SEQ ID NO: 7892706 - DNA, 22 bp, Homo sapiens
gcaggcctcccctgctggagct

SEQ ID NO: 7892707 - DNA, 22 bp, Homo sapiens
gcaggcctcccctgctggagct

SEQ ID NO: 7892708 - DNA, 22 bp, Homo sapiens
gcaggcctcccctgctggagct

SEQ ID NO: 7892709 - DNA, 22 bp, Homo sapiens
gcaggcctcccctgctggagct

SEQ ID NO: 7892710 - DNA, 22 bp, Homo sapiens
gcaggcctcccctgctggagct

SEQ ID NO: 7892711 - DNA, 22 bp, Homo sapiens
gcaggcctctaattcaccgcag

SEQ ID NO: 7892712 - DNA, 18 bp, Homo sapiens
gcaggcctagaacttggt

SEQ ID NO: 7892713 - DNA, 18 bp, Homo sapiens
gcaggcctagaacttggt

SEQ ID NO: 7892714 - DNA, 18 bp, Homo sapiens
gcaggcctagaacttggt

SEQ ID NO: 7892715 - DNA, 22 bp, Homo sapiens
gcaggcctaagagaaggcattg

SEQ ID NO: 7892716 - DNA, 22 bp, Homo sapiens
gcaggcctaagagaaggcattg

SEQ ID NO: 7892717 - DNA, 22 bp, Homo sapiens
gcaggcctaagagaaggcattg

SEQ ID NO: 7892718 - DNA, 22 bp, Homo sapiens
gcaggcctaagagaaggcattg

SEQ ID NO: 7892719 - DNA, 22 bp, Homo sapiens
gcaggcctaagagaaggcattg

SEQ ID NO: 7892720 - DNA, 22 bp, Homo sapiens
gcaggcctaagagaaggcattg

SEQ ID NO: 7892721 - DNA, 22 bp, Homo sapiens
gcaggcccttagccttggtggg

SEQ ID NO: 7892722 - DNA, 20 bp, Homo sapiens
gcaggccctctctctagtct

SEQ ID NO: 7892723 - DNA, 20 bp, Homo sapiens
gcaggccctctctctagtct

SEQ ID NO: 7892724 - DNA, 20 bp, Homo sapiens
gcaggccctctctctagtct

SEQ ID NO: 7892725 - DNA, 18 bp, Homo sapiens
gcaggccctgtttctggg

SEQ ID NO: 7892726 - DNA, 18 bp, Homo sapiens
gcaggccctgtttctggg

SEQ ID NO: 7892727 - DNA, 22 bp, Homo sapiens
gcaggcccttagccttggtggg

SEQ ID NO: 7892728 - DNA, 22 bp, Homo sapiens
gcaggcccttagccttggtggg

SEQ ID NO: 7892729 - DNA, 19 bp, Homo sapiens
gcaggcccagtcgggctgg

SEQ ID NO: 7892730 - DNA, 19 bp, Homo sapiens
gcaggcccagtcgggctgg

SEQ ID NO: 7892731 - DNA, 19 bp, Homo sapiens
gcaggcccagtcgggctgg

SEQ ID NO: 7892732 - DNA, 20 bp, Homo sapiens
gcaggccctctctctagtct

SEQ ID NO: 7892733 - DNA, 22 bp, Homo sapiens
gcagggcagctgaagctaggtg

SEQ ID NO: 7892734 - DNA, 22 bp, Homo sapiens
gcagggcagctgaagctaggtg

SEQ ID NO: 7892735 - DNA, 22 bp, Homo sapiens
gcagggcagctcactgtggttc

SEQ ID NO: 7892736 - DNA, 22 bp, Homo sapiens
gcagggcagctcactgtggttc

SEQ ID NO: 7892737 - DNA, 22 bp, Homo sapiens
gcagggcagccacaggccccct

SEQ ID NO: 7892738 - DNA, 22 bp, Homo sapiens
gcaggcctctaattcaccgcag

SEQ ID NO: 7892739 - DNA, 22 bp, Homo sapiens
gcagggcagccacaggccccct

SEQ ID NO: 7892740 - DNA, 22 bp, Homo sapiens
gcagggcagctcactgtggttc

SEQ ID NO: 7892741 - DNA, 22 bp, Homo sapiens
gcagggcagctcactgtggttc

SEQ ID NO: 7892742 - DNA, 22 bp, Homo sapiens
gcagggcagcttagtccctgtc

SEQ ID NO: 7892743 - DNA, 22 bp, Homo sapiens
gcagggcagcttagtccctgtc

SEQ ID NO: 7892744 - DNA, 22 bp, Homo sapiens
gcagggcagcttagtccctgtc

SEQ ID NO: 7892745 - DNA, 22 bp, Homo sapiens
gcagggcagcttagtccctgtc

SEQ ID NO: 7892746 - DNA, 22 bp, Homo sapiens
gcagggcagcttagtccctgtc

SEQ ID NO: 7892747 - DNA, 22 bp, Homo sapiens
gcagggcagcttagtccctgtc

SEQ ID NO: 7892748 - DNA, 22 bp, Homo sapiens
gcagggcagctgaagctaggtg

SEQ ID NO: 7892749 - DNA, 22 bp, Homo sapiens
gcagggcagctgaagctaggtg

SEQ ID NO: 7892750 - DNA, 22 bp, Homo sapiens
gcagggcagctgaagctaggtg

SEQ ID NO: 7892751 - DNA, 22 bp, Homo sapiens
gcagggcagctgaagctaggtg

SEQ ID NO: 7892752 - DNA, 22 bp, Homo sapiens
gcagggcagctgaagctaggtg

SEQ ID NO: 7892753 - DNA, 22 bp, Homo sapiens
gcagggtgtgtctcatacagtt

SEQ ID NO: 7892754 - DNA, 19 bp, Homo sapiens
gcagggtgttgactgtccc

SEQ ID NO: 7892755 - DNA, 19 bp, Homo sapiens
gcagggtgttgactgtccc

SEQ ID NO: 7892756 - DNA, 19 bp, Homo sapiens
gcagggtgttgactgtccc

SEQ ID NO: 7892757 - DNA, 22 bp, Homo sapiens
gcagggtgtgtctcatacagtt

SEQ ID NO: 7892758 - DNA, 19 bp, Homo sapiens
gcagggtggcagagctctt

SEQ ID NO: 7892759 - DNA, 22 bp, Homo sapiens
gcagggtgtgtctcatacagtt

SEQ ID NO: 7892760 - DNA, 19 bp, Homo sapiens
gcagggtggcagagctctt

SEQ ID NO: 7892761 - DNA, 19 bp, Homo sapiens
gcagggtggcagagctctt

SEQ ID NO: 7892762 - DNA, 22 bp, Homo sapiens
gcagggccttagcagcggctgc

SEQ ID NO: 7892763 - DNA, 22 bp, Homo sapiens
gcagggccttagcagcggctgc

SEQ ID NO: 7892764 - DNA, 19 bp, Homo sapiens
gcagggtggcagagctctt

SEQ ID NO: 7892765 - DNA, 22 bp, Homo sapiens
gcagggccagtgcagagaggaa

SEQ ID NO: 7892766 - DNA, 22 bp, Homo sapiens
gcagggccagtgcagagaggaa

SEQ ID NO: 7892767 - DNA, 22 bp, Homo sapiens
gcagggccagtgcagagaggaa

SEQ ID NO: 7892768 - DNA, 22 bp, Homo sapiens
gcagggccagtgcagagaggaa

SEQ ID NO: 7892769 - DNA, 22 bp, Homo sapiens
gcagggccagtgcagagaggaa

SEQ ID NO: 7892770 - DNA, 22 bp, Homo sapiens
gcagggccaggtacaagaagca

SEQ ID NO: 7892771 - DNA, 22 bp, Homo sapiens
gcagggccaggtacaagaagca

SEQ ID NO: 7892772 - DNA, 22 bp, Homo sapiens
gcagggccaggtacaagaagca

SEQ ID NO: 7892773 - DNA, 22 bp, Homo sapiens
gcagggccagtgcagagaggaa

SEQ ID NO: 7892774 - DNA, 22 bp, Homo sapiens
gcagggccaggtacaagaagca

SEQ ID NO: 7892775 - DNA, 22 bp, Homo sapiens
gcagggccagggctcaggctgt

SEQ ID NO: 7892776 - DNA, 22 bp, Homo sapiens
gcagggccagggctcaggctgt

SEQ ID NO: 7892777 - DNA, 22 bp, Homo sapiens
gcagggccagggctcaggctgt

SEQ ID NO: 7892778 - DNA, 22 bp, Homo sapiens
gcagggccagggctcaggctgt

SEQ ID NO: 7892779 - DNA, 22 bp, Homo sapiens
gcagggccagggctcaggctgt

SEQ ID NO: 7892780 - DNA, 22 bp, Homo sapiens
gcagggccagggctcaggctgt

SEQ ID NO: 7892781 - DNA, 22 bp, Homo sapiens
gcagggccagggctcaggctgt

SEQ ID NO: 7892782 - DNA, 22 bp, Homo sapiens
gcagggcatgggccctgtctgc

SEQ ID NO: 7892783 - DNA, 22 bp, Homo sapiens
gcagggcatgggccctgtctgc

SEQ ID NO: 7892784 - DNA, 22 bp, Homo sapiens
gcagggcatgggccctgtctgc

SEQ ID NO: 7892785 - DNA, 22 bp, Homo sapiens
gcagggcatgggccctgtctgc

SEQ ID NO: 7892786 - DNA, 22 bp, Homo sapiens
gcagggcatgggccctgtctgc

SEQ ID NO: 7892787 - DNA, 22 bp, Homo sapiens
gcagggcatgggccctgtctgc

SEQ ID NO: 7892788 - DNA, 22 bp, Homo sapiens
gcagggcatgggccctgtctgc

SEQ ID NO: 7892789 - DNA, 22 bp, Homo sapiens
gcagggcagggcaagaactggg

SEQ ID NO: 7892790 - DNA, 22 bp, Homo sapiens
gcagggcagggcaagaactggg

SEQ ID NO: 7892791 - DNA, 22 bp, Homo sapiens
gcagggcagcttagtccctgtc

SEQ ID NO: 7892792 - DNA, 22 bp, Homo sapiens
gcagggcaggatttgaacccag

SEQ ID NO: 7892793 - DNA, 22 bp, Homo sapiens
gcagggcaggatttgaacccag

SEQ ID NO: 7892794 - DNA, 22 bp, Homo sapiens
gcagggcaggatttgaacccag

SEQ ID NO: 7892795 - DNA, 22 bp, Homo sapiens
gcagggcagcttagtccctgtc

SEQ ID NO: 7892796 - DNA, 22 bp, Homo sapiens
gcagggcagggcaagaactggg

SEQ ID NO: 7892797 - DNA, 22 bp, Homo sapiens
gcagggcagggcaagaactggg

SEQ ID NO: 7892798 - DNA, 22 bp, Homo sapiens
gcagggcagggcaagaactggg

SEQ ID NO: 7892799 - DNA, 22 bp, Homo sapiens
gcagggcagggcaagaactggg

SEQ ID NO: 7892800 - DNA, 22 bp, Homo sapiens
gcagggcagtaagagctagagt

SEQ ID NO: 7892801 - DNA, 22 bp, Homo sapiens
gcagggcagtaagagctagagt

SEQ ID NO: 7892802 - DNA, 22 bp, Homo sapiens
gcagggcagtaagagctagagt

SEQ ID NO: 7892803 - DNA, 22 bp, Homo sapiens
gcagggcagtaagagctagagt

SEQ ID NO: 7892804 - DNA, 22 bp, Homo sapiens
gcaggtaagagaggctggcttc

SEQ ID NO: 7892805 - DNA, 19 bp, Homo sapiens
gcaggtagagacagcagcc

SEQ ID NO: 7892806 - DNA, 22 bp, Homo sapiens
gcaggtacccttgtccatgaca

SEQ ID NO: 7892807 - DNA, 19 bp, Homo sapiens
gcaggtagagacagcagcc

SEQ ID NO: 7892808 - DNA, 19 bp, Homo sapiens
gcaggtagagacagcagcc

SEQ ID NO: 7892809 - DNA, 22 bp, Homo sapiens
gcaggtagtgatcgagggtgac

SEQ ID NO: 7892810 - DNA, 22 bp, Homo sapiens
gcaggtagtgatcgagggtgac

SEQ ID NO: 7892811 - DNA, 22 bp, Homo sapiens
gcaggtagtgatcgagggtgac

SEQ ID NO: 7892812 - DNA, 22 bp, Homo sapiens
gcaggtagcattttttgacaaa

SEQ ID NO: 7892813 - DNA, 19 bp, Homo sapiens
gcagggtgttgactgtccc

SEQ ID NO: 7892814 - DNA, 19 bp, Homo sapiens
gcagggtgttgactgtccc

SEQ ID NO: 7892815 - DNA, 22 bp, Homo sapiens
gcaggtctagaagctgcctctg

SEQ ID NO: 7892816 - DNA, 22 bp, Homo sapiens
gcaggtctagaagctgcctctg

SEQ ID NO: 7892817 - DNA, 22 bp, Homo sapiens
gcaggtctagaagctgcctctg

SEQ ID NO: 7892818 - DNA, 22 bp, Homo sapiens
gcaggtctagaagctgcctctg

SEQ ID NO: 7892819 - DNA, 20 bp, Homo sapiens
gcaggtccctggcatgcaga

SEQ ID NO: 7892820 - DNA, 19 bp, Homo sapiens
gcaggtcattaggctaggt

SEQ ID NO: 7892821 - DNA, 22 bp, Homo sapiens
gcaggtagtgatcgagggtgac

SEQ ID NO: 7892822 - DNA, 19 bp, Homo sapiens
gcaggtcattaggctaggt

SEQ ID NO: 7892823 - DNA, 22 bp, Homo sapiens
gcaggtagtgctaaagacttac

SEQ ID NO: 7892824 - DNA, 19 bp, Homo sapiens
gcaggtcattaggctaggt

SEQ ID NO: 7892825 - DNA, 22 bp, Homo sapiens
gcaggtctcaatctgagcaggc

SEQ ID NO: 7892826 - DNA, 22 bp, Homo sapiens
gcaggtctcaatctgagcaggc

SEQ ID NO: 7892827 - DNA, 22 bp, Homo sapiens
gcaggtctggagggcactgggg

SEQ ID NO: 7892828 - DNA, 22 bp, Homo sapiens
gcaggtctcaatctgagcaggc

SEQ ID NO: 7892829 - DNA, 22 bp, Homo sapiens
gcaggtctcaatctgagcaggc

SEQ ID NO: 7892830 - DNA, 22 bp, Homo sapiens
gcaggtctatcaggctgcaggt

SEQ ID NO: 7892831 - DNA, 22 bp, Homo sapiens
gcaggtctatcaggctgcaggt

SEQ ID NO: 7892832 - DNA, 22 bp, Homo sapiens
gcaggtctcaatctgagcaggc

SEQ ID NO: 7892833 - DNA, 22 bp, Homo sapiens
gcaggtcttgaaggtgtgattt

SEQ ID NO: 7892834 - DNA, 22 bp, Homo sapiens
gcaggtgaaagtgagtagtgag

SEQ ID NO: 7892835 - DNA, 22 bp, Homo sapiens
gcaggtgaaagtgagtagtgag

SEQ ID NO: 7892836 - DNA, 22 bp, Homo sapiens
gcaggtcttgaaggtgtgattt

SEQ ID NO: 7892837 - DNA, 22 bp, Homo sapiens
gcaggtctggagggcactgggg

SEQ ID NO: 7892838 - DNA, 22 bp, Homo sapiens
gcaggtctgttgattacagtca

SEQ ID NO: 7892839 - DNA, 22 bp, Homo sapiens
gcaggtctggcatagagcctgc

SEQ ID NO: 7892840 - DNA, 22 bp, Homo sapiens
gcaggtgatgtgatgtgagcat

SEQ ID NO: 7892841 - DNA, 22 bp, Homo sapiens
gcaggtgatgtgatgtgagcat

SEQ ID NO: 7892842 - DNA, 22 bp, Homo sapiens
gcaggtgatgtgatgtgagcat

SEQ ID NO: 7892843 - DNA, 19 bp, Homo sapiens
gcaggtgagccgtggctcc

SEQ ID NO: 7892844 - DNA, 22 bp, Homo sapiens
gcaggtgatgtgatgtgagcat

SEQ ID NO: 7892845 - DNA, 22 bp, Homo sapiens
gcaggtgagggtgtctgaatag

SEQ ID NO: 7892846 - DNA, 22 bp, Homo sapiens
gcaggtgaatgatggactagga

SEQ ID NO: 7892847 - DNA, 22 bp, Homo sapiens
gcaggtgaatgatggactagga

SEQ ID NO: 7892848 - DNA, 22 bp, Homo sapiens
gcaggtgaaagtgagtagtgag

SEQ ID NO: 7892849 - DNA, 22 bp, Homo sapiens
gcaggtgaatgatggactagga

SEQ ID NO: 7892850 - DNA, 22 bp, Homo sapiens
gcaatagattatgatctacagt

SEQ ID NO: 7892851 - DNA, 22 bp, Homo sapiens
gcaatagacttggttcttctgt

SEQ ID NO: 7892852 - DNA, 22 bp, Homo sapiens
gcaatagactgtttttattgtt

SEQ ID NO: 7892853 - DNA, 22 bp, Homo sapiens
gcacagaaccagacatgaggca

SEQ ID NO: 7892854 - DNA, 22 bp, Homo sapiens
gcacagaacttctcttagtagg

SEQ ID NO: 7892855 - DNA, 22 bp, Homo sapiens
gcacagactttgattgcagtca

SEQ ID NO: 7892856 - DNA, 22 bp, Homo sapiens
gcacagactttgattgcagtca

SEQ ID NO: 7892857 - DNA, 22 bp, Homo sapiens
gcacagacagaatccctactcc

SEQ ID NO: 7892858 - DNA, 22 bp, Homo sapiens
gcacagaataacactctgggct

SEQ ID NO: 7892859 - DNA, 22 bp, Homo sapiens
gcacagacaccattaaatattt

SEQ ID NO: 7892860 - DNA, 22 bp, Homo sapiens
gcacagaagtaaaatacaagtc

SEQ ID NO: 7892861 - DNA, 22 bp, Homo sapiens
gcacagaagtaaaatacaagtc

SEQ ID NO: 7892862 - DNA, 22 bp, Homo sapiens
gcacagaagtaaaatacaagtc

SEQ ID NO: 7892863 - DNA, 20 bp, Homo sapiens
gcacagagatgagcaaagta

SEQ ID NO: 7892864 - DNA, 22 bp, Homo sapiens
gcacagagagtcccgggtgccc

SEQ ID NO: 7892865 - DNA, 22 bp, Homo sapiens
gcacagagagtcccgggtgccc

SEQ ID NO: 7892866 - DNA, 22 bp, Homo sapiens
gcacagagagggaaggtaactt

SEQ ID NO: 7892867 - DNA, 22 bp, Homo sapiens
gcacagagagggaaggtaactt

SEQ ID NO: 7892868 - DNA, 20 bp, Homo sapiens
gcacagagatgagcaaagta

SEQ ID NO: 7892869 - DNA, 17 bp, Homo sapiens
gcacagaggccaaagga

SEQ ID NO: 7892870 - DNA, 22 bp, Homo sapiens
gcacagagggcagtgagcctct

SEQ ID NO: 7892871 - DNA, 20 bp, Homo sapiens
gcacagagatgagcaaagta

SEQ ID NO: 7892872 - DNA, 20 bp, Homo sapiens
gcacagagatgagcaaagta

SEQ ID NO: 7892873 - DNA, 20 bp, Homo sapiens
gcacagagatgagcaaagta

SEQ ID NO: 7892874 - DNA, 20 bp, Homo sapiens
gcacagagatgagcaaagta

SEQ ID NO: 7892875 - DNA, 22 bp, Homo sapiens
gcacagaggtggaggacaaata

SEQ ID NO: 7892876 - DNA, 22 bp, Homo sapiens
gcacagagggcagtgagcctct

SEQ ID NO: 7892877 - DNA, 22 bp, Homo sapiens
gcacagagacagtcctgagatc

SEQ ID NO: 7892878 - DNA, 22 bp, Homo sapiens
gcacagagacagtcctgagatc

SEQ ID NO: 7892879 - DNA, 22 bp, Homo sapiens
gcacagactttgattgcagtca

SEQ ID NO: 7892880 - DNA, 22 bp, Homo sapiens
gcacagagagcagtgggggaca

SEQ ID NO: 7892881 - DNA, 22 bp, Homo sapiens
gcacagagacagtcctgagatc

SEQ ID NO: 7892882 - DNA, 22 bp, Homo sapiens
gcacagagacagtcctgagatc

SEQ ID NO: 7892883 - DNA, 22 bp, Homo sapiens
gcacagagagcagtgggggaca

SEQ ID NO: 7892884 - DNA, 22 bp, Homo sapiens
gcacagagaggctgtgagcgcc

SEQ ID NO: 7892885 - DNA, 22 bp, Homo sapiens
gcacagagagcagtgggggaca

SEQ ID NO: 7892886 - DNA, 22 bp, Homo sapiens
gcacagagaggctgtgagcgcc

SEQ ID NO: 7892887 - DNA, 22 bp, Homo sapiens
gcacagagagcagtgggggaca

SEQ ID NO: 7892888 - DNA, 22 bp, Homo sapiens
gcacagagagcagtgggggaca

SEQ ID NO: 7892889 - DNA, 22 bp, Homo sapiens
gcacagcagctgctcagttgct

SEQ ID NO: 7892890 - DNA, 22 bp, Homo sapiens
gcacagcagctgctcagttgct

SEQ ID NO: 7892891 - DNA, 22 bp, Homo sapiens
gcacagcagctgctcagttgct

SEQ ID NO: 7892892 - DNA, 22 bp, Homo sapiens
gcacagcagctgctcagttgct

SEQ ID NO: 7892893 - DNA, 22 bp, Homo sapiens
gcacagcagctgctcagttgct

SEQ ID NO: 7892894 - DNA, 22 bp, Homo sapiens
gcacagcagctgggggccctgg

SEQ ID NO: 7892895 - DNA, 22 bp, Homo sapiens
gcacagcagctgggggccctgg

SEQ ID NO: 7892896 - DNA, 22 bp, Homo sapiens
gcacagcagctgggggccctgg

SEQ ID NO: 7892897 - DNA, 20 bp, Homo sapiens
gcacatgcaacttttattta

SEQ ID NO: 7892898 - DNA, 20 bp, Homo sapiens
gcacatgcaacttttattta

SEQ ID NO: 7892899 - DNA, 22 bp, Homo sapiens
gcacatgcactgtgggggcaat

SEQ ID NO: 7892900 - DNA, 22 bp, Homo sapiens
gcacagcacagcaacatgtttt

SEQ ID NO: 7892901 - DNA, 22 bp, Homo sapiens
gcacagcacagcaacatgtttt

SEQ ID NO: 7892902 - DNA, 22 bp, Homo sapiens
gcacagcacagcaacatgtttt

SEQ ID NO: 7892903 - DNA, 22 bp, Homo sapiens
gcacagcacagcaacatgtttt

SEQ ID NO: 7892904 - DNA, 22 bp, Homo sapiens
gcacagcagacttggtggggct

SEQ ID NO: 7892905 - DNA, 22 bp, Homo sapiens
gcacagcagccgaaatgccctt

SEQ ID NO: 7892906 - DNA, 22 bp, Homo sapiens
gcacagcagacttggtggggct

SEQ ID NO: 7892907 - DNA, 22 bp, Homo sapiens
gcacagagtcactagctaagca

SEQ ID NO: 7892908 - DNA, 22 bp, Homo sapiens
gcacagagtcactagctaagca

SEQ ID NO: 7892909 - DNA, 22 bp, Homo sapiens
gcacagagtcactagctaagca

SEQ ID NO: 7892910 - DNA, 22 bp, Homo sapiens
gcacagagtcactagctaagca

SEQ ID NO: 7892911 - DNA, 22 bp, Homo sapiens
gcacagaggtggaggacaaata

SEQ ID NO: 7892912 - DNA, 22 bp, Homo sapiens
gcacagaggtggaggacaaata

SEQ ID NO: 7892913 - DNA, 22 bp, Homo sapiens
gcacagcaatttctataagctc

SEQ ID NO: 7892914 - DNA, 22 bp, Homo sapiens
gcacagatggtactagcttggt

SEQ ID NO: 7892915 - DNA, 22 bp, Homo sapiens
gcacagatggtactagcttggt

SEQ ID NO: 7892916 - DNA, 22 bp, Homo sapiens
gcacagatggtactagcttggt

SEQ ID NO: 7892917 - DNA, 22 bp, Homo sapiens
gcacagagtgggtgagatgtgg

SEQ ID NO: 7892918 - DNA, 22 bp, Homo sapiens
gcacagagtgggtgagatgtgg

SEQ ID NO: 7892919 - DNA, 22 bp, Homo sapiens
gcacagagtgggtgagatgtgg

SEQ ID NO: 7892920 - DNA, 22 bp, Homo sapiens
gcacagagtcactagctaagca

SEQ ID NO: 7892921 - DNA, 22 bp, Homo sapiens
gcacatggcggccagcaggtga

SEQ ID NO: 7892922 - DNA, 22 bp, Homo sapiens
gcacatggcggccagcaggtga

SEQ ID NO: 7892923 - DNA, 22 bp, Homo sapiens
gcacatggacaatggaggtgca

SEQ ID NO: 7892924 - DNA, 22 bp, Homo sapiens
gcacatgcttgagtgtgatgtg

SEQ ID NO: 7892925 - DNA, 18 bp, Homo sapiens
gcacatgtaagagtaaag

SEQ ID NO: 7892926 - DNA, 22 bp, Homo sapiens
gcacatgcagactcattatcta

SEQ ID NO: 7892927 - DNA, 22 bp, Homo sapiens
gcacatgcatgcatattcctgg

SEQ ID NO: 7892928 - DNA, 22 bp, Homo sapiens
gcacatgccccattcttgtcac

SEQ ID NO: 7892929 - DNA, 22 bp, Homo sapiens
gcacatgcgtgcttagaaagaa

SEQ ID NO: 7892930 - DNA, 22 bp, Homo sapiens
gcacatgctcaatgtgtatgta

SEQ ID NO: 7892931 - DNA, 21 bp, Homo sapiens
gcacatgctgtgtgtttctct

SEQ ID NO: 7892932 - DNA, 21 bp, Homo sapiens
gcacatgctgtgtgtttctct

SEQ ID NO: 7892933 - DNA, 21 bp, Homo sapiens
gcacatgctgtgtgtttctct

SEQ ID NO: 7892934 - DNA, 22 bp, Homo sapiens
gcacatgtcttattcactgtta

SEQ ID NO: 7892935 - DNA, 22 bp, Homo sapiens
gcacatgtgagagtagaggcct

SEQ ID NO: 7892936 - DNA, 22 bp, Homo sapiens
gcacatgtgagagtagaggcct

SEQ ID NO: 7892937 - DNA, 18 bp, Homo sapiens
gcacatgtaagagtaaag

SEQ ID NO: 7892938 - DNA, 22 bp, Homo sapiens
gcacatgtcttattcactgtta

SEQ ID NO: 7892939 - DNA, 22 bp, Homo sapiens
gcacatgtcttattcactgtta

SEQ ID NO: 7892940 - DNA, 22 bp, Homo sapiens
gcacatgtgggaatggtgctga

SEQ ID NO: 7892941 - DNA, 22 bp, Homo sapiens
gcacatgtgggaatggtgctga

SEQ ID NO: 7892942 - DNA, 17 bp, Homo sapiens
gcacatgtgttctttta

SEQ ID NO: 7892943 - DNA, 17 bp, Homo sapiens
gcacatgtgttctttta

SEQ ID NO: 7892944 - DNA, 22 bp, Homo sapiens
gcacatgttgctagttacttgc

SEQ ID NO: 7892945 - DNA, 22 bp, Homo sapiens
gcacattgttactcttactgtg

SEQ ID NO: 7892946 - DNA, 22 bp, Homo sapiens
gcaaggagactgtagggccaag

SEQ ID NO: 7892947 - DNA, 22 bp, Homo sapiens
gcaaggagactgtagggccaag

SEQ ID NO: 7892948 - DNA, 22 bp, Homo sapiens
gcaaggagactgtagggccaag

SEQ ID NO: 7892949 - DNA, 17 bp, Homo sapiens
gcaaggaagttctttgc

SEQ ID NO: 7892950 - DNA, 22 bp, Homo sapiens
gcaaggaagcagagttgctatc

SEQ ID NO: 7892951 - DNA, 22 bp, Homo sapiens
gagtcacaaaagatgcccaggg

SEQ ID NO: 7892952 - DNA, 22 bp, Homo sapiens
gcaaggaagagcaggtggtgct

SEQ ID NO: 7892953 - DNA, 22 bp, Homo sapiens
gcaaggaagcagagttgctatc

SEQ ID NO: 7892954 - DNA, 22 bp, Homo sapiens
gagtcaacaagtcagatctcac

SEQ ID NO: 7892955 - DNA, 19 bp, Homo sapiens
gagtattttccaacttggt

SEQ ID NO: 7892956 - DNA, 22 bp, Homo sapiens
gcaaggagactgtagggccaag

SEQ ID NO: 7892957 - DNA, 22 bp, Homo sapiens
gcaaggagactgtagggccaag

SEQ ID NO: 7892958 - DNA, 22 bp, Homo sapiens
gcaaggagcctggaggtgagtg

SEQ ID NO: 7892959 - DNA, 22 bp, Homo sapiens
gcaaggagcctggaggtgagtg

SEQ ID NO: 7892960 - DNA, 22 bp, Homo sapiens
gcaaggagcctggaggtgagtg

SEQ ID NO: 7892961 - DNA, 22 bp, Homo sapiens
gcaaggaggctggtggaggaag

SEQ ID NO: 7892962 - DNA, 22 bp, Homo sapiens
gcaaggaggctggtggaggaag

SEQ ID NO: 7892963 - DNA, 22 bp, Homo sapiens
gcaaggagcctggaggtgagtg

SEQ ID NO: 7892964 - DNA, 22 bp, Homo sapiens
gcaaggaggctggtggaggaag

SEQ ID NO: 7892965 - DNA, 22 bp, Homo sapiens
gagtagacaaggtacatgttct

SEQ ID NO: 7892966 - DNA, 22 bp, Homo sapiens
gagtagacattaaattacactg

SEQ ID NO: 7892967 - DNA, 22 bp, Homo sapiens
gagtagaactagaattcttcaa

SEQ ID NO: 7892968 - DNA, 22 bp, Homo sapiens
gagtagaactggttatctaata

SEQ ID NO: 7892969 - DNA, 22 bp, Homo sapiens
gagtagaaggaagttatctacc

SEQ ID NO: 7892970 - DNA, 22 bp, Homo sapiens
gagtagaactggttatctaata

SEQ ID NO: 7892971 - DNA, 22 bp, Homo sapiens
gagtagaactagaattcttcaa

SEQ ID NO: 7892972 - DNA, 22 bp, Homo sapiens
gagtagaactggttatctaata

SEQ ID NO: 7892973 - DNA, 22 bp, Homo sapiens
gagtagaaagtaaagtacgaat

SEQ ID NO: 7892974 - DNA, 22 bp, Homo sapiens
gagtacttaactccaaatagga

SEQ ID NO: 7892975 - DNA, 22 bp, Homo sapiens
gagtagaaagtaaagtacgaat

SEQ ID NO: 7892976 - DNA, 20 bp, Homo sapiens
gagtacctttagtatgttac

SEQ ID NO: 7892977 - DNA, 21 bp, Homo sapiens
gagtacctttagtatgttacc

SEQ ID NO: 7892978 - DNA, 22 bp, Homo sapiens
gagtagcattctagagtatgct

SEQ ID NO: 7892979 - DNA, 22 bp, Homo sapiens
gagtagcattctagagtatgct

SEQ ID NO: 7892980 - DNA, 22 bp, Homo sapiens
gagtagcagccacagaggaccc

SEQ ID NO: 7892981 - DNA, 22 bp, Homo sapiens
gagtagaaggaagttatctacc

SEQ ID NO: 7892982 - DNA, 22 bp, Homo sapiens
gagtagcagccacagaggaccc

SEQ ID NO: 7892983 - DNA, 22 bp, Homo sapiens
gagtaggcaaggtagctctgtt

SEQ ID NO: 7892984 - DNA, 18 bp, Homo sapiens
gagtagcattgaggaaac

SEQ ID NO: 7892985 - DNA, 22 bp, Homo sapiens
gagtagggatgctggtgactcc

SEQ ID NO: 7892986 - DNA, 22 bp, Homo sapiens
gagtagttgctgcagagaatac

SEQ ID NO: 7892987 - DNA, 22 bp, Homo sapiens
gagtagggatgctggtgactcc

SEQ ID NO: 7892988 - DNA, 22 bp, Homo sapiens
gagtagggtttccaggttagag

SEQ ID NO: 7892989 - DNA, 22 bp, Homo sapiens
gagtataagctttttcacttca

SEQ ID NO: 7892990 - DNA, 22 bp, Homo sapiens
gagtataagctttttcacttca

SEQ ID NO: 7892991 - DNA, 22 bp, Homo sapiens
gagtataagtaatttcaagcaa

SEQ ID NO: 7892992 - DNA, 22 bp, Homo sapiens
gagtataatgattttcattcac

SEQ ID NO: 7892993 - DNA, 22 bp, Homo sapiens
gagtattcctcagtcattttgt

SEQ ID NO: 7892994 - DNA, 22 bp, Homo sapiens
gagtattcaatatatacaaatg

SEQ ID NO: 7892995 - DNA, 22 bp, Homo sapiens
gagtataatgattttcattcac

SEQ ID NO: 7892996 - DNA, 22 bp, Homo sapiens
gagtatataattaattggtctg

SEQ ID NO: 7892997 - DNA, 22 bp, Homo sapiens
gcaataaaatgtaatgattggg

SEQ ID NO: 7892998 - DNA, 22 bp, Homo sapiens
gcaaggctcccgcagcccaggg

SEQ ID NO: 7892999 - DNA, 22 bp, Homo sapiens
gcaaggctcccgcagcccaggg

SEQ ID NO: 7893000 - DNA, 20 bp, Homo sapiens
gcaaggctccaaggggtgtg

SEQ ID NO: 7893001 - DNA, 20 bp, Homo sapiens
gcaaggctccaaggggtgtg

SEQ ID NO: 7893002 - DNA, 22 bp, Homo sapiens
gcaataaaatgtaatgattggg

SEQ ID NO: 7893003 - DNA, 22 bp, Homo sapiens
gcaataaactctctcaagccac

SEQ ID NO: 7893004 - DNA, 22 bp, Homo sapiens
gcaataaactctctcaagccac

SEQ ID NO: 7893005 - DNA, 22 bp, Homo sapiens
gcaataaacatgtttgatgcgc

SEQ ID NO: 7893006 - DNA, 22 bp, Homo sapiens
gcaataaacatgtttgatgcgc

SEQ ID NO: 7893007 - DNA, 22 bp, Homo sapiens
gcaataaagattttactgtcag

SEQ ID NO: 7893008 - DNA, 22 bp, Homo sapiens
gcaataaagattttactgtcag

SEQ ID NO: 7893009 - DNA, 22 bp, Homo sapiens
gcaataaagattttactgtcag

SEQ ID NO: 7893010 - DNA, 22 bp, Homo sapiens
gcaataaactctctcaagccac

SEQ ID NO: 7893011 - DNA, 22 bp, Homo sapiens
gcaataaataacatggaagaca

SEQ ID NO: 7893012 - DNA, 22 bp, Homo sapiens
gcaataaataacatggaagaca

SEQ ID NO: 7893013 - DNA, 22 bp, Homo sapiens
gcaataaataacatggaagaca

SEQ ID NO: 7893014 - DNA, 22 bp, Homo sapiens
gcaataaataacatggaagaca

SEQ ID NO: 7893015 - DNA, 22 bp, Homo sapiens
gcaataaagtagcagctcatca

SEQ ID NO: 7893016 - DNA, 22 bp, Homo sapiens
gcaataaagtagcagctcatca

SEQ ID NO: 7893017 - DNA, 22 bp, Homo sapiens
gcaatacagtaggtttattggt

SEQ ID NO: 7893018 - DNA, 22 bp, Homo sapiens
gcaatacagtaagagtactgta

SEQ ID NO: 7893019 - DNA, 22 bp, Homo sapiens
gcaataaataacatggaagaca

SEQ ID NO: 7893020 - DNA, 18 bp, Homo sapiens
gcaaggctcaggccaggc

SEQ ID NO: 7893021 - DNA, 21 bp, Homo sapiens
gcaaggctcattcttgttgta

SEQ ID NO: 7893022 - DNA, 20 bp, Homo sapiens
gcaaggctccaaggggtgtg

SEQ ID NO: 7893023 - DNA, 18 bp, Homo sapiens
gcaaggctcaggccaggc

SEQ ID NO: 7893024 - DNA, 22 bp, Homo sapiens
gcaaggctcacattgaactgaa

SEQ ID NO: 7893025 - DNA, 22 bp, Homo sapiens
gcaaggctcacattgaactgaa

SEQ ID NO: 7893026 - DNA, 22 bp, Homo sapiens
gcaaggctcacattgaactgaa

SEQ ID NO: 7893027 - DNA, 18 bp, Homo sapiens
gcaaggctcaggccaggc

SEQ ID NO: 7893028 - DNA, 19 bp, Homo sapiens
gcaaggccagcttgatgtg

SEQ ID NO: 7893029 - DNA, 21 bp, Homo sapiens
gcaaggcctatcatggcagct

SEQ ID NO: 7893030 - DNA, 21 bp, Homo sapiens
gcaaggcctatcatggcagct

SEQ ID NO: 7893031 - DNA, 21 bp, Homo sapiens
gcaaggcctatcatggcagct

SEQ ID NO: 7893032 - DNA, 22 bp, Homo sapiens
gcaaggcctgaggtgggtgctc

SEQ ID NO: 7893033 - DNA, 21 bp, Homo sapiens
gcaaggcctatcatggcagct

SEQ ID NO: 7893034 - DNA, 22 bp, Homo sapiens
gcaaggcagtcctggggccctg

SEQ ID NO: 7893035 - DNA, 22 bp, Homo sapiens
gcaaggcagtcctggggccctg

SEQ ID NO: 7893036 - DNA, 22 bp, Homo sapiens
gcaaggcagtcctggggccctg

SEQ ID NO: 7893037 - DNA, 22 bp, Homo sapiens
gcaaggcagcgcggagtagcta

SEQ ID NO: 7893038 - DNA, 22 bp, Homo sapiens
gcaaggcagcgcggagtagcta

SEQ ID NO: 7893039 - DNA, 22 bp, Homo sapiens
gcaaggcagcatccttttgagg

SEQ ID NO: 7893040 - DNA, 18 bp, Homo sapiens
gcaaggcagctctctggg

SEQ ID NO: 7893041 - DNA, 18 bp, Homo sapiens
gcaaggcagctctctggg

SEQ ID NO: 7893042 - DNA, 22 bp, Homo sapiens
gcaaggcagcgcggagtagcta

SEQ ID NO: 7893043 - DNA, 22 bp, Homo sapiens
gcaaggcagcgcggagtagcta

SEQ ID NO: 7893044 - DNA, 20 bp, Homo sapiens
gcaaggcacagtgaggaggg

SEQ ID NO: 7893045 - DNA, 21 bp, Homo sapiens
gcaaggcaatgccatgatttc

SEQ ID NO: 7893046 - DNA, 20 bp, Homo sapiens
gcaaggcacagtgaggaggg

SEQ ID NO: 7893047 - DNA, 22 bp, Homo sapiens
gcaaggcagcatccttttgagg

SEQ ID NO: 7893048 - DNA, 20 bp, Homo sapiens
gcaaggcacagtgaggaggg

SEQ ID NO: 7893049 - DNA, 20 bp, Homo sapiens
gcaaggcacagtgaggaggg

SEQ ID NO: 7893050 - DNA, 22 bp, Homo sapiens
gcagagtgagccgaggctgctc

SEQ ID NO: 7893051 - DNA, 22 bp, Homo sapiens
gcagagtgagccgaggctgctc

SEQ ID NO: 7893052 - DNA, 22 bp, Homo sapiens
gcagagtgagccgaggctgctc

SEQ ID NO: 7893053 - DNA, 22 bp, Homo sapiens
gcagagtgaggaagagcttcca

SEQ ID NO: 7893054 - DNA, 22 bp, Homo sapiens
gcagagtgagccgaggctgctc

SEQ ID NO: 7893055 - DNA, 22 bp, Homo sapiens
gcagagtgagccgaggctgctc

SEQ ID NO: 7893056 - DNA, 22 bp, Homo sapiens
gcagagtgaagggagaggtgtg

SEQ ID NO: 7893057 - DNA, 22 bp, Homo sapiens
gcagagtgaagggagaggtgtg

SEQ ID NO: 7893058 - DNA, 22 bp, Homo sapiens
gcagagtgaagggagaggtgtg

SEQ ID NO: 7893059 - DNA, 22 bp, Homo sapiens
gcagagtgaagggagaggtgtg

SEQ ID NO: 7893060 - DNA, 22 bp, Homo sapiens
gcagagtgaagcatttctttct

SEQ ID NO: 7893061 - DNA, 22 bp, Homo sapiens
gcagagtgagatatgaacccag

SEQ ID NO: 7893062 - DNA, 22 bp, Homo sapiens
gcagagtgagccgaggctgctc

SEQ ID NO: 7893063 - DNA, 18 bp, Homo sapiens
gcagagtgcgtctctgtg

SEQ ID NO: 7893064 - DNA, 18 bp, Homo sapiens
gcagagtgcgtctctgtg

SEQ ID NO: 7893065 - DNA, 22 bp, Homo sapiens
gcagagtgctgtcgtacgcccc

SEQ ID NO: 7893066 - DNA, 22 bp, Homo sapiens
gcagagtgggagcccagggctg

SEQ ID NO: 7893067 - DNA, 22 bp, Homo sapiens
gcagagtgggagcccagggctg

SEQ ID NO: 7893068 - DNA, 22 bp, Homo sapiens
gcagagtgaggaagagcttcca

SEQ ID NO: 7893069 - DNA, 22 bp, Homo sapiens
gcagagtgaggaagagcttcca

SEQ ID NO: 7893070 - DNA, 22 bp, Homo sapiens
gcagagtgccgagatggaagcg

SEQ ID NO: 7893071 - DNA, 22 bp, Homo sapiens
gcagagtgatggaatgtgggtg

SEQ ID NO: 7893072 - DNA, 22 bp, Homo sapiens
gcagagtgccagtatttgttgt

SEQ ID NO: 7893073 - DNA, 22 bp, Homo sapiens
gcagcaaacttccacaagtaga

SEQ ID NO: 7893074 - DNA, 22 bp, Homo sapiens
gcagcaaacttccacaagtaga

SEQ ID NO: 7893075 - DNA, 19 bp, Homo sapiens
gcagcaaacaaaacaggta

SEQ ID NO: 7893076 - DNA, 19 bp, Homo sapiens
gcagcaaacaaaacaggta

SEQ ID NO: 7893077 - DNA, 22 bp, Homo sapiens
gcagcaaacttccacaagtaga

SEQ ID NO: 7893078 - DNA, 22 bp, Homo sapiens
gcagcaaacttccacaagtaga

SEQ ID NO: 7893079 - DNA, 22 bp, Homo sapiens
gcagcaaagctcttcatgtgat

SEQ ID NO: 7893080 - DNA, 22 bp, Homo sapiens
gcagcaaagctcttcatgtgat

SEQ ID NO: 7893081 - DNA, 22 bp, Homo sapiens
gcagcaagaataatttgggtag

SEQ ID NO: 7893082 - DNA, 18 bp, Homo sapiens
gcagcaaagggcccgggg

SEQ ID NO: 7893083 - DNA, 21 bp, Homo sapiens
gcagcaaatgacaacagtgag

SEQ ID NO: 7893084 - DNA, 21 bp, Homo sapiens
gcagcaaatgacaacagtgag

SEQ ID NO: 7893085 - DNA, 22 bp, Homo sapiens
gcagcaagaataatttgggtag

SEQ ID NO: 7893086 - DNA, 22 bp, Homo sapiens
gcagcaagaggtgccatcttga

SEQ ID NO: 7893087 - DNA, 22 bp, Homo sapiens
gcagatgttgttgctgggagtt

SEQ ID NO: 7893088 - DNA, 22 bp, Homo sapiens
gcagattactggactgattcca

SEQ ID NO: 7893089 - DNA, 22 bp, Homo sapiens
gcagatgttgttgctgggagtt

SEQ ID NO: 7893090 - DNA, 22 bp, Homo sapiens
gcagatgttgtgaggctggtaa

SEQ ID NO: 7893091 - DNA, 22 bp, Homo sapiens
gcagatgttgtgaggctggtaa

SEQ ID NO: 7893092 - DNA, 22 bp, Homo sapiens
gcagcaaaaaagtaatatttat

SEQ ID NO: 7893093 - DNA, 22 bp, Homo sapiens
gcagatgttgttgctgggagtt

SEQ ID NO: 7893094 - DNA, 22 bp, Homo sapiens
gcagatgttgtgaggctggtaa

SEQ ID NO: 7893095 - DNA, 22 bp, Homo sapiens
gcagatttcatttaaacctttc

SEQ ID NO: 7893096 - DNA, 19 bp, Homo sapiens
gcagagtggggtggagggt

SEQ ID NO: 7893097 - DNA, 19 bp, Homo sapiens
gcagagtggggtggagggt

SEQ ID NO: 7893098 - DNA, 19 bp, Homo sapiens
gcagagtggggtggagggt

SEQ ID NO: 7893099 - DNA, 19 bp, Homo sapiens
gcagagtggggtggagggt

SEQ ID NO: 7893100 - DNA, 22 bp, Homo sapiens
gcagacagggctacagaggtac

SEQ ID NO: 7893101 - DNA, 22 bp, Homo sapiens
gcagacagggctacagaggtac

SEQ ID NO: 7893102 - DNA, 22 bp, Homo sapiens
gcagacagggctacagaggtac

SEQ ID NO: 7893103 - DNA, 22 bp, Homo sapiens
gcagacagggctacagaggtac

SEQ ID NO: 7893104 - DNA, 22 bp, Homo sapiens
gcagacagggctacagaggtac

SEQ ID NO: 7893105 - DNA, 22 bp, Homo sapiens
gcagacagggctacagaggtac

SEQ ID NO: 7893106 - DNA, 22 bp, Homo sapiens
gcagacagggctacagaggtac

SEQ ID NO: 7893107 - DNA, 22 bp, Homo sapiens
gcagacagggctacagaggtac

SEQ ID NO: 7893108 - DNA, 22 bp, Homo sapiens
gcagacagggctacagaggtac

SEQ ID NO: 7893109 - DNA, 22 bp, Homo sapiens
gcagaggtgctcagtggcagaa

SEQ ID NO: 7893110 - DNA, 22 bp, Homo sapiens
gcagaggtgctcagtggcagaa

SEQ ID NO: 7893111 - DNA, 22 bp, Homo sapiens
gcagaggtgctcagtggcagaa

SEQ ID NO: 7893112 - DNA, 22 bp, Homo sapiens
gcagacagggctacagaggtac

SEQ ID NO: 7893113 - DNA, 22 bp, Homo sapiens
gcagaggtggcatctgggctct

SEQ ID NO: 7893114 - DNA, 22 bp, Homo sapiens
gcagaggtggcatctgggctct

SEQ ID NO: 7893115 - DNA, 22 bp, Homo sapiens
gcagaggtggcatctgggctct

SEQ ID NO: 7893116 - DNA, 22 bp, Homo sapiens
gcagaggtgctcagtggcagaa

SEQ ID NO: 7893117 - DNA, 22 bp, Homo sapiens
gcagaggtggatgcaattgggg

SEQ ID NO: 7893118 - DNA, 22 bp, Homo sapiens
gcagaggtggatgcaattgggg

SEQ ID NO: 7893119 - DNA, 22 bp, Homo sapiens
gcagaggtgtgggaggggccac

SEQ ID NO: 7893120 - DNA, 22 bp, Homo sapiens
gcagaggtgtcaccttccagga

SEQ ID NO: 7893121 - DNA, 22 bp, Homo sapiens
gcagaggtggcatctgggctct

SEQ ID NO: 7893122 - DNA, 23 bp, Homo sapiens
gcagaggtttttcagtatggttt

SEQ ID NO: 7893123 - DNA, 23 bp, Homo sapiens
gcagaggtttttcagtatggttt

SEQ ID NO: 7893124 - DNA, 23 bp, Homo sapiens
gcagaggtttttcagtatggttt

SEQ ID NO: 7893125 - DNA, 23 bp, Homo sapiens
gcagaggtttttcagtatggttt

SEQ ID NO: 7893126 - DNA, 19 bp, Homo sapiens
gcagagtcaagagctgctg

SEQ ID NO: 7893127 - DNA, 22 bp, Homo sapiens
gcagaggttggattggtgactt

SEQ ID NO: 7893128 - DNA, 22 bp, Homo sapiens
gcagaggttggattggtgactt

SEQ ID NO: 7893129 - DNA, 22 bp, Homo sapiens
gcagaggttggattggtgactt

SEQ ID NO: 7893130 - DNA, 23 bp, Homo sapiens
gcagaggttatgttttttaggct

SEQ ID NO: 7893131 - DNA, 23 bp, Homo sapiens
gcagagtcaagtagtcatgagtg

SEQ ID NO: 7893132 - DNA, 19 bp, Homo sapiens
gcagagtcaagagctgctg

SEQ ID NO: 7893133 - DNA, 19 bp, Homo sapiens
gcagagtcaagagctgctg

SEQ ID NO: 7893134 - DNA, 19 bp, Homo sapiens
gcagagtcaagagctgctg

SEQ ID NO: 7893135 - DNA, 22 bp, Homo sapiens
gcagagtcccagcaggtggtgg

SEQ ID NO: 7893136 - DNA, 22 bp, Homo sapiens
gcagagtcccagcaggtggtgg

SEQ ID NO: 7893137 - DNA, 22 bp, Homo sapiens
gcagagtctgggcagcctccat

SEQ ID NO: 7893138 - DNA, 22 bp, Homo sapiens
gcagagtctggtaggtgctggt

SEQ ID NO: 7893139 - DNA, 22 bp, Homo sapiens
gcagagtctggtaggtgctggt

SEQ ID NO: 7893140 - DNA, 22 bp, Homo sapiens
gcagagtctgggctacctcttg

SEQ ID NO: 7893141 - DNA, 22 bp, Homo sapiens
gcagagtgaagcagtatggaaa

SEQ ID NO: 7893142 - DNA, 22 bp, Homo sapiens
gcagagtgaagcagtatggaaa

SEQ ID NO: 7893143 - DNA, 22 bp, Homo sapiens
gcagagtgaaagaatatattaa

SEQ ID NO: 7893144 - DNA, 22 bp, Homo sapiens
gcagacaatttattagcagatt

SEQ ID NO: 7893145 - DNA, 22 bp, Homo sapiens
gcagaagggaataaggagcttt

SEQ ID NO: 7893146 - DNA, 22 bp, Homo sapiens
gcagacaatttattagcagatt

SEQ ID NO: 7893147 - DNA, 22 bp, Homo sapiens
gcagacacagggaaggcaagga

SEQ ID NO: 7893148 - DNA, 22 bp, Homo sapiens
gcagacacagggaaggcaagga

SEQ ID NO: 7893149 - DNA, 22 bp, Homo sapiens
gcagaagggaataaggagcttt

SEQ ID NO: 7893150 - DNA, 22 bp, Homo sapiens
gcagaagggaataaggagcttt

SEQ ID NO: 7893151 - DNA, 22 bp, Homo sapiens
gcagaaggcctcttggttaata

SEQ ID NO: 7893152 - DNA, 18 bp, Homo sapiens
gcagacactcgtggaggg

SEQ ID NO: 7893153 - DNA, 18 bp, Homo sapiens
gcagacactcgtggaggg

SEQ ID NO: 7893154 - DNA, 22 bp, Homo sapiens
gcagacacttcccactgcagcg

SEQ ID NO: 7893155 - DNA, 22 bp, Homo sapiens
gcagacaccttgtaggtgtgta

SEQ ID NO: 7893156 - DNA, 22 bp, Homo sapiens
gcagacacatccactcctacag

SEQ ID NO: 7893157 - DNA, 22 bp, Homo sapiens
gcagacacatccactcctacag

SEQ ID NO: 7893158 - DNA, 22 bp, Homo sapiens
gcagacacagggaaggcaagga

SEQ ID NO: 7893159 - DNA, 22 bp, Homo sapiens
gcagacagactgcagtgatttt

SEQ ID NO: 7893160 - DNA, 22 bp, Homo sapiens
gcagacagactgcagtgatttt

SEQ ID NO: 7893161 - DNA, 22 bp, Homo sapiens
gcagacacttttattctgcata

SEQ ID NO: 7893162 - DNA, 23 bp, Homo sapiens
gcagacagagcagactaagacaa

SEQ ID NO: 7893163 - DNA, 22 bp, Homo sapiens
gcagacagactgcagtgatttt

SEQ ID NO: 7893164 - DNA, 22 bp, Homo sapiens
gcagacagactgcagtgatttt

SEQ ID NO: 7893165 - DNA, 23 bp, Homo sapiens
gcagacagagcagactaagacaa

SEQ ID NO: 7893166 - DNA, 22 bp, Homo sapiens
gcagacagaagctaagtagaca

SEQ ID NO: 7893167 - DNA, 22 bp, Homo sapiens
gcagacagaagctaagtagaca

SEQ ID NO: 7893168 - DNA, 22 bp, Homo sapiens
gcagacacttttattctgcata

SEQ ID NO: 7893169 - DNA, 22 bp, Homo sapiens
gcagacacttttattctgcata

SEQ ID NO: 7893170 - DNA, 17 bp, Homo sapiens
gcagacacttctattga

SEQ ID NO: 7893171 - DNA, 22 bp, Homo sapiens
gcagacacttcccactgcagcg

SEQ ID NO: 7893172 - DNA, 22 bp, Homo sapiens
gcagacagatgagggtgctggg

SEQ ID NO: 7893173 - DNA, 22 bp, Homo sapiens
gcagacagatgagggtgctggg

SEQ ID NO: 7893174 - DNA, 22 bp, Homo sapiens
gcagacagatgagggtgctggg

SEQ ID NO: 7893175 - DNA, 22 bp, Homo sapiens
gcagacagatgagggtgctggg

SEQ ID NO: 7893176 - DNA, 22 bp, Homo sapiens
gcagacagatgagggtgctggg

SEQ ID NO: 7893177 - DNA, 22 bp, Homo sapiens
gcagacagcatgttgggctatt

SEQ ID NO: 7893178 - DNA, 22 bp, Homo sapiens
gcagacagcatgttgggctatt

SEQ ID NO: 7893179 - DNA, 22 bp, Homo sapiens
gcagacagatgagggtgctggg

SEQ ID NO: 7893180 - DNA, 22 bp, Homo sapiens
gcagacagcatgttgggctatt

SEQ ID NO: 7893181 - DNA, 22 bp, Homo sapiens
gcagacagcatgttgggctatt

SEQ ID NO: 7893182 - DNA, 22 bp, Homo sapiens
gcagacagccagactgcactgg

SEQ ID NO: 7893183 - DNA, 22 bp, Homo sapiens
gcagacagccagactgcactgg

SEQ ID NO: 7893184 - DNA, 22 bp, Homo sapiens
gcagacagccagactgcactgg

SEQ ID NO: 7893185 - DNA, 22 bp, Homo sapiens
gcagacaggattgggttaatag

SEQ ID NO: 7893186 - DNA, 22 bp, Homo sapiens
gcagacaggcccagtggaggga

SEQ ID NO: 7893187 - DNA, 22 bp, Homo sapiens
gcagacaggcccagtggaggga

SEQ ID NO: 7893188 - DNA, 22 bp, Homo sapiens
gcagacaggcccagtggaggga

SEQ ID NO: 7893189 - DNA, 22 bp, Homo sapiens
gcagacaggcccagtggaggga

SEQ ID NO: 7893190 - DNA, 22 bp, Homo sapiens
gcagacaggcccagtggaggga

SEQ ID NO: 7893191 - DNA, 22 bp, Homo sapiens
gcagacaggcccagtggaggga

SEQ ID NO: 7893192 - DNA, 22 bp, Homo sapiens
gcagacaggcccagtggaggga

SEQ ID NO: 7893193 - DNA, 22 bp, Homo sapiens
gcacccagccagcatctcagag

SEQ ID NO: 7893194 - DNA, 22 bp, Homo sapiens
gcacccagccagcatctcagag

SEQ ID NO: 7893195 - DNA, 22 bp, Homo sapiens
gcacccagatattgccttgacc

SEQ ID NO: 7893196 - DNA, 22 bp, Homo sapiens
gcacccagatattgccttgacc

SEQ ID NO: 7893197 - DNA, 22 bp, Homo sapiens
gcacccagaggtcagcagtgct

SEQ ID NO: 7893198 - DNA, 22 bp, Homo sapiens
gcacccagatagcaaggattag

SEQ ID NO: 7893199 - DNA, 22 bp, Homo sapiens
gcacccagaggtcagcagtgct

SEQ ID NO: 7893200 - DNA, 22 bp, Homo sapiens
gcacccagcccagggcgtgatg

SEQ ID NO: 7893201 - DNA, 22 bp, Homo sapiens
gcacccagcccagggcgtgatg

SEQ ID NO: 7893202 - DNA, 22 bp, Homo sapiens
gcacccagcccagggcgtgatg

SEQ ID NO: 7893203 - DNA, 21 bp, Homo sapiens
gcacccagccggttctcccag

SEQ ID NO: 7893204 - DNA, 21 bp, Homo sapiens
gcacccagccggttctcccag

SEQ ID NO: 7893205 - DNA, 22 bp, Homo sapiens
gcagaaggatccgcaggtgcaa

SEQ ID NO: 7893206 - DNA, 20 bp, Homo sapiens
gcacccagcttcttgttcta

SEQ ID NO: 7893207 - DNA, 22 bp, Homo sapiens
gcagaaggatccgcaggtgcaa

SEQ ID NO: 7893208 - DNA, 22 bp, Homo sapiens
gcagaaggatccgcaggtgcaa

SEQ ID NO: 7893209 - DNA, 22 bp, Homo sapiens
gcaccaggagaatcacgttaga

SEQ ID NO: 7893210 - DNA, 22 bp, Homo sapiens
gcaccaggagaatcacgttaga

SEQ ID NO: 7893211 - DNA, 22 bp, Homo sapiens
gcaccaggaggcccttctcatc

SEQ ID NO: 7893212 - DNA, 22 bp, Homo sapiens
gcacccagagggcagggtctcc

SEQ ID NO: 7893213 - DNA, 22 bp, Homo sapiens
gcacccagaggtcagcagtgct

SEQ ID NO: 7893214 - DNA, 22 bp, Homo sapiens
gcacccagagggcagggtctcc

SEQ ID NO: 7893215 - DNA, 22 bp, Homo sapiens
gcacccagaggtcagcagtgct

SEQ ID NO: 7893216 - DNA, 22 bp, Homo sapiens
gcaccagctgcagggtggctga

SEQ ID NO: 7893217 - DNA, 22 bp, Homo sapiens
gcaccagctgcagggtggctga

SEQ ID NO: 7893218 - DNA, 22 bp, Homo sapiens
gcaccagctgccttctgtgccc

SEQ ID NO: 7893219 - DNA, 22 bp, Homo sapiens
gcaccagctgccttctgtgccc

SEQ ID NO: 7893220 - DNA, 22 bp, Homo sapiens
gcaccagctgccttctgtgccc

SEQ ID NO: 7893221 - DNA, 22 bp, Homo sapiens
gcaccagctgccttctgtgccc

SEQ ID NO: 7893222 - DNA, 22 bp, Homo sapiens
gcaccagctgccttctgtgccc

SEQ ID NO: 7893223 - DNA, 22 bp, Homo sapiens
gcaccaggaagctgttatagca

SEQ ID NO: 7893224 - DNA, 22 bp, Homo sapiens
gcaccagctgctgggttctaga

SEQ ID NO: 7893225 - DNA, 22 bp, Homo sapiens
gcaccaccaccatcggcacctc

SEQ ID NO: 7893226 - DNA, 22 bp, Homo sapiens
gcaccactaagagcagggaccg

SEQ ID NO: 7893227 - DNA, 22 bp, Homo sapiens
gcacatttctcaaagaattgtc

SEQ ID NO: 7893228 - DNA, 22 bp, Homo sapiens
gcacatttaactgagctcagga

SEQ ID NO: 7893229 - DNA, 19 bp, Homo sapiens
gcaccagattgagtgacac

SEQ ID NO: 7893230 - DNA, 22 bp, Homo sapiens
gcaccagcctgagcctcttgca

SEQ ID NO: 7893231 - DNA, 22 bp, Homo sapiens
gcaccagcctgagcctcttgca

SEQ ID NO: 7893232 - DNA, 22 bp, Homo sapiens
gcaccagctgcagggtggctga

SEQ ID NO: 7893233 - DNA, 22 bp, Homo sapiens
gcaccagctgcagggtggctga

SEQ ID NO: 7893234 - DNA, 22 bp, Homo sapiens
gcaccagagggggctctgcagg

SEQ ID NO: 7893235 - DNA, 22 bp, Homo sapiens
gcaccactagagtagagatggt

SEQ ID NO: 7893236 - DNA, 22 bp, Homo sapiens
gcaccactacactccagcctgg

SEQ ID NO: 7893237 - DNA, 22 bp, Homo sapiens
gcaccactacactccagcctgg

SEQ ID NO: 7893238 - DNA, 22 bp, Homo sapiens
gcaccactagagtagagatggt

SEQ ID NO: 7893239 - DNA, 22 bp, Homo sapiens
gcaccagagggggctctgcagg

SEQ ID NO: 7893240 - DNA, 19 bp, Homo sapiens
gcaccagattgagtgacac

SEQ ID NO: 7893241 - DNA, 22 bp, Homo sapiens
gcccgcgccagcctctccatct

SEQ ID NO: 7893242 - DNA, 22 bp, Homo sapiens
gcccgcgccagcctctccatct

SEQ ID NO: 7893243 - DNA, 22 bp, Homo sapiens
gcccgcgccagcctctccatct

SEQ ID NO: 7893244 - DNA, 17 bp, Homo sapiens
gcccgcggcccggggtg

SEQ ID NO: 7893245 - DNA, 22 bp, Homo sapiens
gcccggccaggaacagagtata

SEQ ID NO: 7893246 - DNA, 22 bp, Homo sapiens
gcccggccaggaacagagtata

SEQ ID NO: 7893247 - DNA, 22 bp, Homo sapiens
gcccgtgtctcctgctctgtgg

SEQ ID NO: 7893248 - DNA, 22 bp, Homo sapiens
gcccggccaggaacagagtata

SEQ ID NO: 7893249 - DNA, 22 bp, Homo sapiens
gccctagcgccagctcagcacc

SEQ ID NO: 7893250 - DNA, 22 bp, Homo sapiens
gccctagcgccagctcagcacc

SEQ ID NO: 7893251 - DNA, 22 bp, Homo sapiens
gccctagcgccagctcagcacc

SEQ ID NO: 7893252 - DNA, 22 bp, Homo sapiens
gccctagccatcctgtgctctg

SEQ ID NO: 7893253 - DNA, 22 bp, Homo sapiens
gccctagaatcacatttcttgt

SEQ ID NO: 7893254 - DNA, 22 bp, Homo sapiens
gccctacctcagtccagatctg

SEQ ID NO: 7893255 - DNA, 22 bp, Homo sapiens
gccccttgtctccaggccccaa

SEQ ID NO: 7893256 - DNA, 22 bp, Homo sapiens
gcccgcagagatctttaacaaa

SEQ ID NO: 7893257 - DNA, 22 bp, Homo sapiens
gccccttctctgaggaacctgc

SEQ ID NO: 7893258 - DNA, 22 bp, Homo sapiens
gccccttctctgaggaacctgc

SEQ ID NO: 7893259 - DNA, 22 bp, Homo sapiens
gccccttctctgaggaacctgc

SEQ ID NO: 7893260 - DNA, 22 bp, Homo sapiens
gccccttcttctggagattcaa

SEQ ID NO: 7893261 - DNA, 22 bp, Homo sapiens
gccccttgggaattcctccact

SEQ ID NO: 7893262 - DNA, 22 bp, Homo sapiens
gcccctgggagcagagccacca

SEQ ID NO: 7893263 - DNA, 22 bp, Homo sapiens
gcccctgggagcagagccacca

SEQ ID NO: 7893264 - DNA, 22 bp, Homo sapiens
gcccctgttgtggctttgtcta

SEQ ID NO: 7893265 - DNA, 22 bp, Homo sapiens
gccccttccatcatgtgaggac

SEQ ID NO: 7893266 - DNA, 22 bp, Homo sapiens
gcccctgttgtggctttgtcta

SEQ ID NO: 7893267 - DNA, 22 bp, Homo sapiens
gccccttcgtggaagtgcattc

SEQ ID NO: 7893268 - DNA, 22 bp, Homo sapiens
gccccttctctgaggaacctgc

SEQ ID NO: 7893269 - DNA, 22 bp, Homo sapiens
gccccttcgtggaagtgcattc

SEQ ID NO: 7893270 - DNA, 22 bp, Homo sapiens
gccccttccatcatgtgaggac

SEQ ID NO: 7893271 - DNA, 21 bp, Homo sapiens
gccctaggctacctggagcgc

SEQ ID NO: 7893272 - DNA, 21 bp, Homo sapiens
gccctaggctacctggagcgc

SEQ ID NO: 7893273 - DNA, 22 bp, Homo sapiens
gccctaggcttttgtgactgcc

SEQ ID NO: 7893274 - DNA, 22 bp, Homo sapiens
gccctagggggaaccgaggact

SEQ ID NO: 7893275 - DNA, 22 bp, Homo sapiens
gccctatcattcattgagtgct

SEQ ID NO: 7893276 - DNA, 22 bp, Homo sapiens
gccctagggcttttgggcctgt

SEQ ID NO: 7893277 - DNA, 22 bp, Homo sapiens
gccctcagaggacagctgactt

SEQ ID NO: 7893278 - DNA, 22 bp, Homo sapiens
gccctcagaatgggctctaatc

SEQ ID NO: 7893279 - DNA, 22 bp, Homo sapiens
gccctgagtggtacctgtgggt

SEQ ID NO: 7893280 - DNA, 22 bp, Homo sapiens
gccctgagtggtacctgtgggt

SEQ ID NO: 7893281 - DNA, 22 bp, Homo sapiens
gccctgagtggtacctgtgggt

SEQ ID NO: 7893282 - DNA, 22 bp, Homo sapiens
gccctgagttgagccttccaaa

SEQ ID NO: 7893283 - DNA, 22 bp, Homo sapiens
gccctgagtggtacctgtgggt

SEQ ID NO: 7893284 - DNA, 22 bp, Homo sapiens
gccctgagtgcctgtgtaagaa

SEQ ID NO: 7893285 - DNA, 19 bp, Homo sapiens
gccctgagtaagctaggag

SEQ ID NO: 7893286 - DNA, 22 bp, Homo sapiens
gccctgagtgcctgtgtaagaa

SEQ ID NO: 7893287 - DNA, 19 bp, Homo sapiens
gccctgagtaagctaggag

SEQ ID NO: 7893288 - DNA, 22 bp, Homo sapiens
gccctcagagttccccacagtg

SEQ ID NO: 7893289 - DNA, 22 bp, Homo sapiens
gccctcagaggacagctgactt

SEQ ID NO: 7893290 - DNA, 22 bp, Homo sapiens
gccctcagaggacagctgactt

SEQ ID NO: 7893291 - DNA, 22 bp, Homo sapiens
gccctcagagttccccacagtg

SEQ ID NO: 7893292 - DNA, 22 bp, Homo sapiens
gccctcagagttccccacagtg

SEQ ID NO: 7893293 - DNA, 19 bp, Homo sapiens
gccctgagtaagctaggag

SEQ ID NO: 7893294 - DNA, 19 bp, Homo sapiens
gccctgagtaagctaggag

SEQ ID NO: 7893295 - DNA, 19 bp, Homo sapiens
gccctgagtaagctaggag

SEQ ID NO: 7893296 - DNA, 19 bp, Homo sapiens
gccctgagtaagctaggag

SEQ ID NO: 7893297 - DNA, 22 bp, Homo sapiens
gcccctggctggccagctcctc

SEQ ID NO: 7893298 - DNA, 22 bp, Homo sapiens
gcccctggctggccagctcctc

SEQ ID NO: 7893299 - DNA, 22 bp, Homo sapiens
gcccctgggagcagagccacca

SEQ ID NO: 7893300 - DNA, 22 bp, Homo sapiens
gcccctggctggccagctcctc

SEQ ID NO: 7893301 - DNA, 22 bp, Homo sapiens
gcccctggctggccagctcctc

SEQ ID NO: 7893302 - DNA, 22 bp, Homo sapiens
gcccctggctggccagctcctc

SEQ ID NO: 7893303 - DNA, 22 bp, Homo sapiens
gcccctccgggcgcgtcatagc

SEQ ID NO: 7893304 - DNA, 22 bp, Homo sapiens
gcccctctcccttgaggcaggc

SEQ ID NO: 7893305 - DNA, 22 bp, Homo sapiens
gcccctctcccttgaggcaggc

SEQ ID NO: 7893306 - DNA, 22 bp, Homo sapiens
gcccctctcccttgaggcaggc

SEQ ID NO: 7893307 - DNA, 22 bp, Homo sapiens
gcccctctccttgtgcacctgc

SEQ ID NO: 7893308 - DNA, 22 bp, Homo sapiens
gcccctctccttgtgcacctgc

SEQ ID NO: 7893309 - DNA, 22 bp, Homo sapiens
gcccctcccagtcaggagcact

SEQ ID NO: 7893310 - DNA, 22 bp, Homo sapiens
gcccctccgggcgcgtcatagc

SEQ ID NO: 7893311 - DNA, 22 bp, Homo sapiens
gcccctcccagtcaggagcact

SEQ ID NO: 7893312 - DNA, 22 bp, Homo sapiens
gcccctcccagtcaggagcact

SEQ ID NO: 7893313 - DNA, 22 bp, Homo sapiens
gccccaggtggtaaacctaaga

SEQ ID NO: 7893314 - DNA, 22 bp, Homo sapiens
gccccaggtggtaaacctaaga

SEQ ID NO: 7893315 - DNA, 22 bp, Homo sapiens
gccccaggggaggtgccctgca

SEQ ID NO: 7893316 - DNA, 22 bp, Homo sapiens
gcccctccatccatcaccgggg

SEQ ID NO: 7893317 - DNA, 22 bp, Homo sapiens
gccccaggttgcctgtcccagg

SEQ ID NO: 7893318 - DNA, 22 bp, Homo sapiens
gcccaaggtcccatggcagcac

SEQ ID NO: 7893319 - DNA, 22 bp, Homo sapiens
gcccaaggtcccatggcagcac

SEQ ID NO: 7893320 - DNA, 20 bp, Homo sapiens
gcccaaggtccagaaggggg

SEQ ID NO: 7893321 - DNA, 22 bp, Homo sapiens
gcccaaggtcccatggcagcac

SEQ ID NO: 7893322 - DNA, 22 bp, Homo sapiens
gcccaaggtcccatggcagcac

SEQ ID NO: 7893323 - DNA, 22 bp, Homo sapiens
gcccacacaccagctcaggagg

SEQ ID NO: 7893324 - DNA, 22 bp, Homo sapiens
gcccacacagcagatcctttgg

SEQ ID NO: 7893325 - DNA, 22 bp, Homo sapiens
gcccacaccatttattctttgt

SEQ ID NO: 7893326 - DNA, 21 bp, Homo sapiens
gcccaatgaacctgggcagct

SEQ ID NO: 7893327 - DNA, 22 bp, Homo sapiens
gcccacaggggacctggtggct

SEQ ID NO: 7893328 - DNA, 22 bp, Homo sapiens
gcccacaggggacctggtggct

SEQ ID NO: 7893329 - DNA, 22 bp, Homo sapiens
gccccaggggaggtgccctgca

SEQ ID NO: 7893330 - DNA, 22 bp, Homo sapiens
gcccacagaggcaccaccaggc

SEQ ID NO: 7893331 - DNA, 22 bp, Homo sapiens
gcccacagaggcaccaccaggc

SEQ ID NO: 7893332 - DNA, 22 bp, Homo sapiens
gcccacagaggcaccaccaggc

SEQ ID NO: 7893333 - DNA, 22 bp, Homo sapiens
gcccacagctcgttcctctcct

SEQ ID NO: 7893334 - DNA, 22 bp, Homo sapiens
gccctgctgctggcagaggcgc

SEQ ID NO: 7893335 - DNA, 23 bp, Homo sapiens
gccctgctgggacctcctgctac

SEQ ID NO: 7893336 - DNA, 23 bp, Homo sapiens
gccctgctgggacctcctgctac

SEQ ID NO: 7893337 - DNA, 22 bp, Homo sapiens
gccctgctcttttgcccaccca

SEQ ID NO: 7893338 - DNA, 22 bp, Homo sapiens
gccctgctcttttgcccaccca

SEQ ID NO: 7893339 - DNA, 22 bp, Homo sapiens
gccctgctgcgcagcacgcatg

SEQ ID NO: 7893340 - DNA, 22 bp, Homo sapiens
gccctgctgagtccggctcaga

SEQ ID NO: 7893341 - DNA, 22 bp, Homo sapiens
gccctgctctggtctctgcccg

SEQ ID NO: 7893342 - DNA, 22 bp, Homo sapiens
gccctgctgtttagagagctac

SEQ ID NO: 7893343 - DNA, 22 bp, Homo sapiens
gccctgcttctggcatgcagaa

SEQ ID NO: 7893344 - DNA, 22 bp, Homo sapiens
gccctgctgtttagagagctac

SEQ ID NO: 7893345 - DNA, 22 bp, Homo sapiens
gccctgcttctggcatgcagaa

SEQ ID NO: 7893346 - DNA, 22 bp, Homo sapiens
gccctgctgtcttcagagtata

SEQ ID NO: 7893347 - DNA, 23 bp, Homo sapiens
gccctgctgggacctcctgctac

SEQ ID NO: 7893348 - DNA, 22 bp, Homo sapiens
gccctgcctgtctgctgggagg

SEQ ID NO: 7893349 - DNA, 22 bp, Homo sapiens
gccctgcctgtctgctgggagg

SEQ ID NO: 7893350 - DNA, 22 bp, Homo sapiens
gccctgcctgtctgctgggagg

SEQ ID NO: 7893351 - DNA, 22 bp, Homo sapiens
gccctgcctgtctgctgggagg

SEQ ID NO: 7893352 - DNA, 17 bp, Homo sapiens
gccctgcctgctgccct

SEQ ID NO: 7893353 - DNA, 22 bp, Homo sapiens
gccctgagttgagccttccaaa

SEQ ID NO: 7893354 - DNA, 22 bp, Homo sapiens
gccctgctcatttcacgtgttt

SEQ ID NO: 7893355 - DNA, 22 bp, Homo sapiens
gccctgctcatttcacgtgttt

SEQ ID NO: 7893356 - DNA, 22 bp, Homo sapiens
gccctgctcctccgtcccacga

SEQ ID NO: 7893357 - DNA, 23 bp, Homo sapiens
gccctgctcctggctgggaggga

SEQ ID NO: 7893358 - DNA, 22 bp, Homo sapiens
gccctgctctggtctctgcccg

SEQ ID NO: 7893359 - DNA, 22 bp, Homo sapiens
gccctgctctgttggtcacctg

SEQ ID NO: 7893360 - DNA, 22 bp, Homo sapiens
gccctgctctggtctctgcccg

SEQ ID NO: 7893361 - DNA, 22 bp, Homo sapiens
gccctgctctggtctctgcccg

SEQ ID NO: 7893362 - DNA, 22 bp, Homo sapiens
gccctgctctggtctctgcccg

SEQ ID NO: 7893363 - DNA, 22 bp, Homo sapiens
gccctgctctggtctctgcccg

SEQ ID NO: 7893364 - DNA, 22 bp, Homo sapiens
gccctggaatctctccatggga

SEQ ID NO: 7893365 - DNA, 22 bp, Homo sapiens
gccctggaatctctccatggga

SEQ ID NO: 7893366 - DNA, 22 bp, Homo sapiens
gccctggaatctctccatggga

SEQ ID NO: 7893367 - DNA, 22 bp, Homo sapiens
gccctggaatctctccatggga

SEQ ID NO: 7893368 - DNA, 22 bp, Homo sapiens
gccctggacagtgacggtgacc

SEQ ID NO: 7893369 - DNA, 20 bp, Homo sapiens
gccctggacgtggcctcggc

SEQ ID NO: 7893370 - DNA, 22 bp, Homo sapiens
gccctggacagtgacggtgacc

SEQ ID NO: 7893371 - DNA, 22 bp, Homo sapiens
gccctggacagtgacggtgacc

SEQ ID NO: 7893372 - DNA, 22 bp, Homo sapiens
gccctgcttggtcatggccttc

SEQ ID NO: 7893373 - DNA, 22 bp, Homo sapiens
gccctggaaaggaacctgggct

SEQ ID NO: 7893374 - DNA, 22 bp, Homo sapiens
gccctggaaaggaacctgggct

SEQ ID NO: 7893375 - DNA, 22 bp, Homo sapiens
gccctggaatctctccatggga

SEQ ID NO: 7893376 - DNA, 22 bp, Homo sapiens
gcctcagggggagaggccagct

SEQ ID NO: 7893377 - DNA, 22 bp, Homo sapiens
gcctcagggggagaggccagct

SEQ ID NO: 7893378 - DNA, 22 bp, Homo sapiens
gcctcagggggagaggccagct

SEQ ID NO: 7893379 - DNA, 22 bp, Homo sapiens
gccctggagagggatatggcat

SEQ ID NO: 7893380 - DNA, 22 bp, Homo sapiens
gccctggagagggatatggcat

SEQ ID NO: 7893381 - DNA, 20 bp, Homo sapiens
gccctggacgtggcctcggc

SEQ ID NO: 7893382 - DNA, 22 bp, Homo sapiens
gcctcagggggagaggccagct

SEQ ID NO: 7893383 - DNA, 22 bp, Homo sapiens
gcctcagggggagaggccagct

SEQ ID NO: 7893384 - DNA, 22 bp, Homo sapiens
gcctcagggggagaggccagct

SEQ ID NO: 7893385 - DNA, 22 bp, Homo sapiens
gcctcagggggagaggccagct

SEQ ID NO: 7893386 - DNA, 22 bp, Homo sapiens
gcctcagggggagaggccagct

SEQ ID NO: 7893387 - DNA, 22 bp, Homo sapiens
gcctcaggtgcatctctcattc

SEQ ID NO: 7893388 - DNA, 22 bp, Homo sapiens
gcctcaggtgcatctctcattc

SEQ ID NO: 7893389 - DNA, 22 bp, Homo sapiens
gcctcaggtgcatctctcattc

SEQ ID NO: 7893390 - DNA, 22 bp, Homo sapiens
gcctcaggtaaaacttgagttt

SEQ ID NO: 7893391 - DNA, 22 bp, Homo sapiens
gcctcaggtaaaacttgagttt

SEQ ID NO: 7893392 - DNA, 22 bp, Homo sapiens
gcctcaggtaaaacttgagttt

SEQ ID NO: 7893393 - DNA, 22 bp, Homo sapiens
gcctcaggtaaaacttgagttt

SEQ ID NO: 7893394 - DNA, 18 bp, Homo sapiens
gcctccaccatggagggt

SEQ ID NO: 7893395 - DNA, 18 bp, Homo sapiens
gcctccaccatggagggt

SEQ ID NO: 7893396 - DNA, 18 bp, Homo sapiens
gcctccaccatggagggt

SEQ ID NO: 7893397 - DNA, 20 bp, Homo sapiens
gcctccaccccaggcttcag

SEQ ID NO: 7893398 - DNA, 20 bp, Homo sapiens
gcctccaccccaggcttcag

SEQ ID NO: 7893399 - DNA, 18 bp, Homo sapiens
gcctccaccatggagggt

SEQ ID NO: 7893400 - DNA, 20 bp, Homo sapiens
gcctccaccccaggcttcag

SEQ ID NO: 7893401 - DNA, 22 bp, Homo sapiens
gcctcattacagccaggaagca

SEQ ID NO: 7893402 - DNA, 19 bp, Homo sapiens
gcctcatttccacctcccc

SEQ ID NO: 7893403 - DNA, 19 bp, Homo sapiens
gcctcatttccacctcccc

SEQ ID NO: 7893404 - DNA, 19 bp, Homo sapiens
gcctcatttccacctcccc

SEQ ID NO: 7893405 - DNA, 19 bp, Homo sapiens
gcctcatttccacctcccc

SEQ ID NO: 7893406 - DNA, 23 bp, Homo sapiens
gcctccaaacctctaggctggtg

SEQ ID NO: 7893407 - DNA, 23 bp, Homo sapiens
gcctccaaacctctaggctggtg

SEQ ID NO: 7893408 - DNA, 20 bp, Homo sapiens
gcctccacactcacccctta

SEQ ID NO: 7893409 - DNA, 22 bp, Homo sapiens
gcctcagtctcccgagtagctg

SEQ ID NO: 7893410 - DNA, 22 bp, Homo sapiens
gcctcagtctcccgagtagctg

SEQ ID NO: 7893411 - DNA, 20 bp, Homo sapiens
gcctcagtcacatggcctac

SEQ ID NO: 7893412 - DNA, 20 bp, Homo sapiens
gcctcagtcacatggcctac

SEQ ID NO: 7893413 - DNA, 22 bp, Homo sapiens
gcctcagtgatatgtgggacaa

SEQ ID NO: 7893414 - DNA, 22 bp, Homo sapiens
gcctcagtgatatgtgggacaa

SEQ ID NO: 7893415 - DNA, 22 bp, Homo sapiens
gcctcagtctcccgagtagctg

SEQ ID NO: 7893416 - DNA, 22 bp, Homo sapiens
gcctcaggtgcatctctcattc

SEQ ID NO: 7893417 - DNA, 22 bp, Homo sapiens
gcctcaggtgcatctctcattc

SEQ ID NO: 7893418 - DNA, 22 bp, Homo sapiens
gcctcaggtgcatctctcattc

SEQ ID NO: 7893419 - DNA, 22 bp, Homo sapiens
gcctcagtaaccttaggggata

SEQ ID NO: 7893420 - DNA, 18 bp, Homo sapiens
gcctcagtttcctcacct

SEQ ID NO: 7893421 - DNA, 22 bp, Homo sapiens
gcctcagttgatctgtgtgagc

SEQ ID NO: 7893422 - DNA, 22 bp, Homo sapiens
gcctcagtttatacacctgtaa

SEQ ID NO: 7893423 - DNA, 22 bp, Homo sapiens
gcctcagtttatacacctgtaa

SEQ ID NO: 7893424 - DNA, 22 bp, Homo sapiens
gcctcatgagggatctgccctc

SEQ ID NO: 7893425 - DNA, 22 bp, Homo sapiens
gcctcatgagggatctgccctc

SEQ ID NO: 7893426 - DNA, 22 bp, Homo sapiens
gcctcagtggctttaggagttc

SEQ ID NO: 7893427 - DNA, 22 bp, Homo sapiens
gcctcagtgtcctcctccatgt

SEQ ID NO: 7893428 - DNA, 22 bp, Homo sapiens
gcctcagttgatctgtgtgagc

SEQ ID NO: 7893429 - DNA, 22 bp, Homo sapiens
gcctcagttgatctgtgtgagc

SEQ ID NO: 7893430 - DNA, 22 bp, Homo sapiens
gcctccctgtttcctgctccaa

SEQ ID NO: 7893431 - DNA, 22 bp, Homo sapiens
gcctccctgtttcctgctccaa

SEQ ID NO: 7893432 - DNA, 22 bp, Homo sapiens
gcctccctgttcttccacaata

SEQ ID NO: 7893433 - DNA, 22 bp, Homo sapiens
gcctccctgttcttccacaata

SEQ ID NO: 7893434 - DNA, 22 bp, Homo sapiens
gcctccctgttcttccacaata

SEQ ID NO: 7893435 - DNA, 22 bp, Homo sapiens
gcctccctgtagaggccagcct

SEQ ID NO: 7893436 - DNA, 18 bp, Homo sapiens
gcctccctggctacactt

SEQ ID NO: 7893437 - DNA, 18 bp, Homo sapiens
gcctccctggctacactt

SEQ ID NO: 7893438 - DNA, 18 bp, Homo sapiens
gcctccctggctacactt

SEQ ID NO: 7893439 - DNA, 22 bp, Homo sapiens
gcctgagggctcctagcaggct

SEQ ID NO: 7893440 - DNA, 22 bp, Homo sapiens
gcctgagggctcctagcaggct

SEQ ID NO: 7893441 - DNA, 22 bp, Homo sapiens
gcctgagggctcctagcaggct

SEQ ID NO: 7893442 - DNA, 22 bp, Homo sapiens
gcctgagggctcctagcaggct

SEQ ID NO: 7893443 - DNA, 22 bp, Homo sapiens
gcctgagggctcctagcaggct

SEQ ID NO: 7893444 - DNA, 22 bp, Homo sapiens
gcctgaggaattgagggggtaa

SEQ ID NO: 7893445 - DNA, 22 bp, Homo sapiens
gcctcccttggtgtctcccggg

SEQ ID NO: 7893446 - DNA, 22 bp, Homo sapiens
gcctcccctgcaattgtccttg

SEQ ID NO: 7893447 - DNA, 22 bp, Homo sapiens
gcctcccctgcaattgtccttg

SEQ ID NO: 7893448 - DNA, 22 bp, Homo sapiens
gcctcccctgcaattgtccttg

SEQ ID NO: 7893449 - DNA, 22 bp, Homo sapiens
gcctccctccaccactgcaggt

SEQ ID NO: 7893450 - DNA, 22 bp, Homo sapiens
gcctccctccaccactgcaggt

SEQ ID NO: 7893451 - DNA, 22 bp, Homo sapiens
gcctccctccaccactgcaggt

SEQ ID NO: 7893452 - DNA, 22 bp, Homo sapiens
gcctccctccaccactgcaggt

SEQ ID NO: 7893453 - DNA, 22 bp, Homo sapiens
gcctccctgagtcacccaagca

SEQ ID NO: 7893454 - DNA, 22 bp, Homo sapiens
gcctccctggcccacagcagcg

SEQ ID NO: 7893455 - DNA, 22 bp, Homo sapiens
gcctccctggcccacagcagcg

SEQ ID NO: 7893456 - DNA, 22 bp, Homo sapiens
gcctccccaggggtgtcatgag

SEQ ID NO: 7893457 - DNA, 22 bp, Homo sapiens
gcctccccaggggtgtcatgag

SEQ ID NO: 7893458 - DNA, 22 bp, Homo sapiens
gcctcccctgcaattgtccttg

SEQ ID NO: 7893459 - DNA, 22 bp, Homo sapiens
gcctccacttctttagtatgac

SEQ ID NO: 7893460 - DNA, 22 bp, Homo sapiens
gcctccacttctttagtatgac

SEQ ID NO: 7893461 - DNA, 22 bp, Homo sapiens
gcctccacttttgctggcttct

SEQ ID NO: 7893462 - DNA, 22 bp, Homo sapiens
gcctccactgatcagacttgac

SEQ ID NO: 7893463 - DNA, 22 bp, Homo sapiens
gcctccacccctggggagtgga

SEQ ID NO: 7893464 - DNA, 22 bp, Homo sapiens
gcctccacccctggggagtgga

SEQ ID NO: 7893465 - DNA, 22 bp, Homo sapiens
gcctccacccctggggagtgga

SEQ ID NO: 7893466 - DNA, 22 bp, Homo sapiens
gcctccaccgaacgctctcttg

SEQ ID NO: 7893467 - DNA, 22 bp, Homo sapiens
gcctccacccctggggagtgga

SEQ ID NO: 7893468 - DNA, 22 bp, Homo sapiens
gcctccaccgaacgctctcttg

SEQ ID NO: 7893469 - DNA, 22 bp, Homo sapiens
gcctccaccgaacgctctcttg

SEQ ID NO: 7893470 - DNA, 22 bp, Homo sapiens
gcctccaccgaacgctctcttg

SEQ ID NO: 7893471 - DNA, 22 bp, Homo sapiens
gcctccactgatcagacttgac

SEQ ID NO: 7893472 - DNA, 22 bp, Homo sapiens
gcctgcagcctcagagaatttt

SEQ ID NO: 7893473 - DNA, 22 bp, Homo sapiens
gcctgcagcctcagagaatttt

SEQ ID NO: 7893474 - DNA, 18 bp, Homo sapiens
gcctgcaggcacgggggt

SEQ ID NO: 7893475 - DNA, 22 bp, Homo sapiens
gcctgcagggcccttgtgggtc

SEQ ID NO: 7893476 - DNA, 17 bp, Homo sapiens
gcctgcaggcccgcaga

SEQ ID NO: 7893477 - DNA, 22 bp, Homo sapiens
gcctgcaggctgtagtttgtga

SEQ ID NO: 7893478 - DNA, 22 bp, Homo sapiens
gcctgcagggcctgggcctacc

SEQ ID NO: 7893479 - DNA, 22 bp, Homo sapiens
gcctgcagggcctgggcctacc

SEQ ID NO: 7893480 - DNA, 22 bp, Homo sapiens
gcctgcagcccctctgcagtag

SEQ ID NO: 7893481 - DNA, 22 bp, Homo sapiens
gcctgcagcccctctgcagtag

SEQ ID NO: 7893482 - DNA, 22 bp, Homo sapiens
gcctgcagcccctctgcagtag

SEQ ID NO: 7893483 - DNA, 22 bp, Homo sapiens
gcctgcagcctcaagggctgag

SEQ ID NO: 7893484 - DNA, 22 bp, Homo sapiens
gcctgcagcctcaagggctgag

SEQ ID NO: 7893485 - DNA, 22 bp, Homo sapiens
gcctgcagcctcaagggctgag

SEQ ID NO: 7893486 - DNA, 22 bp, Homo sapiens
gcctgcagcatgctaggtcttg

SEQ ID NO: 7893487 - DNA, 22 bp, Homo sapiens
gcctgcagatatataggatggt

SEQ ID NO: 7893488 - DNA, 22 bp, Homo sapiens
gcctgcagaggtgctgctagct

SEQ ID NO: 7893489 - DNA, 19 bp, Homo sapiens
gcctgcagaaaaggcaggg

SEQ ID NO: 7893490 - DNA, 22 bp, Homo sapiens
gcctgcactcaaacactctctt

SEQ ID NO: 7893491 - DNA, 22 bp, Homo sapiens
gcctgcagaactgtgaggcaat

SEQ ID NO: 7893492 - DNA, 22 bp, Homo sapiens
gcctgcagaactgtgaggcaat

SEQ ID NO: 7893493 - DNA, 19 bp, Homo sapiens
gcctgcagaaaaggcaggg

SEQ ID NO: 7893494 - DNA, 19 bp, Homo sapiens
gcctgcagaaaaggcaggg

SEQ ID NO: 7893495 - DNA, 20 bp, Homo sapiens
gcctgatggacatttcagtt

SEQ ID NO: 7893496 - DNA, 22 bp, Homo sapiens
gcctgagtgcatctgcagacat

SEQ ID NO: 7893497 - DNA, 22 bp, Homo sapiens
gcctgcaagatggctggtcact

SEQ ID NO: 7893498 - DNA, 21 bp, Homo sapiens
gcctgcacacagtaggtgcac

SEQ ID NO: 7893499 - DNA, 22 bp, Homo sapiens
gcctgcacccacaggcatggcc

SEQ ID NO: 7893500 - DNA, 21 bp, Homo sapiens
gcctgcagaccccaccaggct

SEQ ID NO: 7893501 - DNA, 20 bp, Homo sapiens
gcctgcagagaaggtcagag

SEQ ID NO: 7893502 - DNA, 21 bp, Homo sapiens
gcctgcagaccccaccaggct

SEQ ID NO: 7893503 - DNA, 22 bp, Homo sapiens
gcctgcagaactgtgaggcaat

SEQ ID NO: 7893504 - DNA, 20 bp, Homo sapiens
gcctgcagagaaggtcagag

SEQ ID NO: 7893505 - DNA, 20 bp, Homo sapiens
gcctgcagagaaggtcagag

SEQ ID NO: 7893506 - DNA, 20 bp, Homo sapiens
gcctgcagagaaggtcagag

SEQ ID NO: 7893507 - DNA, 22 bp, Homo sapiens
gcctgcagaggtgctgctagct

SEQ ID NO: 7893508 - DNA, 22 bp, Homo sapiens
gcctgcagtgagtgcagaaggt

SEQ ID NO: 7893509 - DNA, 22 bp, Homo sapiens
gcctgcagtgagtgcagaaggt

SEQ ID NO: 7893510 - DNA, 20 bp, Homo sapiens
gcctgcaggttggatgggat

SEQ ID NO: 7893511 - DNA, 22 bp, Homo sapiens
gcctgcagggtgatgggctgcc

SEQ ID NO: 7893512 - DNA, 22 bp, Homo sapiens
gcctgcagggtgatgggctgcc

SEQ ID NO: 7893513 - DNA, 22 bp, Homo sapiens
gcctgcagggcctgggcctacc

SEQ ID NO: 7893514 - DNA, 22 bp, Homo sapiens
gcctgcagggtgatgggctgcc

SEQ ID NO: 7893515 - DNA, 22 bp, Homo sapiens
gcctgcagttctgtgctaggca

SEQ ID NO: 7893516 - DNA, 22 bp, Homo sapiens
gcctgcagtgagtgcagaaggt

SEQ ID NO: 7893517 - DNA, 22 bp, Homo sapiens
gcctgcagttctgtgctaggca

SEQ ID NO: 7893518 - DNA, 23 bp, Homo sapiens
gcctggagaaaagctgcagttca

SEQ ID NO: 7893519 - DNA, 23 bp, Homo sapiens
gcctggagaaaagctgcagttca

SEQ ID NO: 7893520 - DNA, 23 bp, Homo sapiens
gcctggagaaaagctgcagttca

SEQ ID NO: 7893521 - DNA, 22 bp, Homo sapiens
gcctggactgttctaccatttt

SEQ ID NO: 7893522 - DNA, 22 bp, Homo sapiens
gcctggagacaaggacaaaggg

SEQ ID NO: 7893523 - DNA, 22 bp, Homo sapiens
gcctggagacaaggacaaaggg

SEQ ID NO: 7893524 - DNA, 22 bp, Homo sapiens
gcctggagacagcagaggcggc

SEQ ID NO: 7893525 - DNA, 22 bp, Homo sapiens
gcctggagacagcagaggcggc

SEQ ID NO: 7893526 - DNA, 22 bp, Homo sapiens
gcctggagacaaggacaaaggg

SEQ ID NO: 7893527 - DNA, 22 bp, Homo sapiens
gcctggagaattaaaaggaagg

SEQ ID NO: 7893528 - DNA, 22 bp, Homo sapiens
gcctggagaattaaaaggaagg

SEQ ID NO: 7893529 - DNA, 22 bp, Homo sapiens
gcctggagaagatggaactagc

SEQ ID NO: 7893530 - DNA, 22 bp, Homo sapiens
gcctggagaattaaaaggaagg

SEQ ID NO: 7893531 - DNA, 22 bp, Homo sapiens
gcctggagaagatggaactagc

SEQ ID NO: 7893532 - DNA, 22 bp, Homo sapiens
gcctggagaagatggaactagc

SEQ ID NO: 7893533 - DNA, 22 bp, Homo sapiens
gcctggagaaaggaaggtggga

SEQ ID NO: 7893534 - DNA, 22 bp, Homo sapiens
gcctggagaaaggaaggtggga

SEQ ID NO: 7893535 - DNA, 22 bp, Homo sapiens
gcctggagaaaggaaggtggga

SEQ ID NO: 7893536 - DNA, 22 bp, Homo sapiens
gcctggagaaaggaaggtggga

SEQ ID NO: 7893537 - DNA, 22 bp, Homo sapiens
gcctggagaaaggaaggtggga

SEQ ID NO: 7893538 - DNA, 22 bp, Homo sapiens
gcctggagaaaggaaggtggga

SEQ ID NO: 7893539 - DNA, 22 bp, Homo sapiens
gcctggagaaaggaaggtggga

SEQ ID NO: 7893540 - DNA, 22 bp, Homo sapiens
gcctggagaaaggaaggtggga

SEQ ID NO: 7893541 - DNA, 22 bp, Homo sapiens
gcctggagaaaggaaggtggga

SEQ ID NO: 7893542 - DNA, 22 bp, Homo sapiens
gcctggagtgcagtggcgtgat

SEQ ID NO: 7893543 - DNA, 22 bp, Homo sapiens
gcctggagtgcagtggcgtgat

SEQ ID NO: 7893544 - DNA, 22 bp, Homo sapiens
gcctggagtgcagtggcgtgat

SEQ ID NO: 7893545 - DNA, 22 bp, Homo sapiens
gcctggagtgcagtggcgtgat

SEQ ID NO: 7893546 - DNA, 16 bp, Homo sapiens
gcctggagtggcaggg

SEQ ID NO: 7893547 - DNA, 22 bp, Homo sapiens
gcctggagtggacttggcccct

SEQ ID NO: 7893548 - DNA, 16 bp, Homo sapiens
gcctggagtggcaggg

SEQ ID NO: 7893549 - DNA, 16 bp, Homo sapiens
gcctggagtggcaggg

SEQ ID NO: 7893550 - DNA, 22 bp, Homo sapiens
gcctggagcccagtgtggggct

SEQ ID NO: 7893551 - DNA, 22 bp, Homo sapiens
gcctggagcccagtgtggggct

SEQ ID NO: 7893552 - DNA, 22 bp, Homo sapiens
gcctggagcccagtgtggggct

SEQ ID NO: 7893553 - DNA, 22 bp, Homo sapiens
gcctggagcccagtgtggggct

SEQ ID NO: 7893554 - DNA, 22 bp, Homo sapiens
gcctggagcccagtgtggggct

SEQ ID NO: 7893555 - DNA, 22 bp, Homo sapiens
gcctggagcccagtgtggggct

SEQ ID NO: 7893556 - DNA, 22 bp, Homo sapiens
gcctggagtgcagtggcgtgat

SEQ ID NO: 7893557 - DNA, 22 bp, Homo sapiens
gcctggagtagcatggcaagcc

SEQ ID NO: 7893558 - DNA, 22 bp, Homo sapiens
gcctggagtagcatggcaagcc

SEQ ID NO: 7893559 - DNA, 22 bp, Homo sapiens
gcctggagtgcagtggcgtgat

SEQ ID NO: 7893560 - DNA, 22 bp, Homo sapiens
gcctggagtgcagtggcgtgat

SEQ ID NO: 7893561 - DNA, 22 bp, Homo sapiens
gcctggagtgcagtggcgtgat

SEQ ID NO: 7893562 - DNA, 22 bp, Homo sapiens
gcctggagtgcagtggcgtgat

SEQ ID NO: 7893563 - DNA, 22 bp, Homo sapiens
gcctggagtagcatggcaagcc

SEQ ID NO: 7893564 - DNA, 22 bp, Homo sapiens
gcctggagagcactgtgcgctt

SEQ ID NO: 7893565 - DNA, 22 bp, Homo sapiens
gcctggagagcactgtgcgctt

SEQ ID NO: 7893566 - DNA, 22 bp, Homo sapiens
gcctggagagcactgtgcgctt

SEQ ID NO: 7893567 - DNA, 22 bp, Homo sapiens
gcctggagacagcagaggcggc

SEQ ID NO: 7893568 - DNA, 22 bp, Homo sapiens
gcctggagacagcagaggcggc

SEQ ID NO: 7893569 - DNA, 22 bp, Homo sapiens
gcctggagacctgctcctctac

SEQ ID NO: 7893570 - DNA, 22 bp, Homo sapiens
gcctggagacctgctcctctac

SEQ ID NO: 7893571 - DNA, 22 bp, Homo sapiens
gcctggagacagcagaggcggc

SEQ ID NO: 7893572 - DNA, 22 bp, Homo sapiens
gcctggagacctgctcctctac

SEQ ID NO: 7893573 - DNA, 22 bp, Homo sapiens
gcctggagcagacgtgtcccgg

SEQ ID NO: 7893574 - DNA, 22 bp, Homo sapiens
gcctggagaggaagccggtgga

SEQ ID NO: 7893575 - DNA, 22 bp, Homo sapiens
gcctggagagcactgtgcgctt

SEQ ID NO: 7893576 - DNA, 22 bp, Homo sapiens
gcctggagaggaagccggtgga

SEQ ID NO: 7893577 - DNA, 22 bp, Homo sapiens
gcctggagaggaagccggtgga

SEQ ID NO: 7893578 - DNA, 22 bp, Homo sapiens
gcctggagaggaagccggtgga

SEQ ID NO: 7893579 - DNA, 22 bp, Homo sapiens
gcctggagaggaagccggtgga

SEQ ID NO: 7893580 - DNA, 22 bp, Homo sapiens
gccaggctccccggatccctgg

SEQ ID NO: 7893581 - DNA, 22 bp, Homo sapiens
gccaggctccccggatccctgg

SEQ ID NO: 7893582 - DNA, 22 bp, Homo sapiens
gccaggctccccggatccctgg

SEQ ID NO: 7893583 - DNA, 22 bp, Homo sapiens
gccaggctccccggatccctgg

SEQ ID NO: 7893584 - DNA, 22 bp, Homo sapiens
gccaggctccccggatccctgg

SEQ ID NO: 7893585 - DNA, 22 bp, Homo sapiens
gccaggctccccggatccctgg

SEQ ID NO: 7893586 - DNA, 23 bp, Homo sapiens
gccaggctccggtctgtggccac

SEQ ID NO: 7893587 - DNA, 23 bp, Homo sapiens
gccaggctccggtctgtggccac

SEQ ID NO: 7893588 - DNA, 22 bp, Homo sapiens
gccaggctccccggatccctgg

SEQ ID NO: 7893589 - DNA, 23 bp, Homo sapiens
gccaggctccggtctgtggccac

SEQ ID NO: 7893590 - DNA, 23 bp, Homo sapiens
gccaggctccggtctgtggccac

SEQ ID NO: 7893591 - DNA, 23 bp, Homo sapiens
gccaggctccggtctgtggccac

SEQ ID NO: 7893592 - DNA, 22 bp, Homo sapiens
gccaggctccaggccctcctga

SEQ ID NO: 7893593 - DNA, 22 bp, Homo sapiens
gccaggctccaggccctcctga

SEQ ID NO: 7893594 - DNA, 22 bp, Homo sapiens
gccaggctccaggccctcctga

SEQ ID NO: 7893595 - DNA, 22 bp, Homo sapiens
gccaggctccaggccctcctga

SEQ ID NO: 7893596 - DNA, 22 bp, Homo sapiens
gccaggctccaggccctcctga

SEQ ID NO: 7893597 - DNA, 22 bp, Homo sapiens
gccaggctccaggccctcctga

SEQ ID NO: 7893598 - DNA, 19 bp, Homo sapiens
gccaggctccatagccggc

SEQ ID NO: 7893599 - DNA, 19 bp, Homo sapiens
gccaggctccatagccggc

SEQ ID NO: 7893600 - DNA, 19 bp, Homo sapiens
gccaggctccatagccggc

SEQ ID NO: 7893601 - DNA, 19 bp, Homo sapiens
gccaggctccatagccggc

SEQ ID NO: 7893602 - DNA, 22 bp, Homo sapiens
gccaggctaagaaaggtgtgat

SEQ ID NO: 7893603 - DNA, 22 bp, Homo sapiens
gccaggctaagaaaggtgtgat

SEQ ID NO: 7893604 - DNA, 22 bp, Homo sapiens
gccaggcgggtctcaaactcct

SEQ ID NO: 7893605 - DNA, 22 bp, Homo sapiens
gccaggctaagaaaggtgtgat

SEQ ID NO: 7893606 - DNA, 22 bp, Homo sapiens
gccaggcgggtctcaaactcct

SEQ ID NO: 7893607 - DNA, 22 bp, Homo sapiens
gccaggcgggtctcaaactcct

SEQ ID NO: 7893608 - DNA, 22 bp, Homo sapiens
gccaggctaagaaaggtgtgat

SEQ ID NO: 7893609 - DNA, 22 bp, Homo sapiens
gccaggcattattccgatccct

SEQ ID NO: 7893610 - DNA, 22 bp, Homo sapiens
gccaggcattattccgatccct

SEQ ID NO: 7893611 - DNA, 22 bp, Homo sapiens
gccaggcattattccgatccct

SEQ ID NO: 7893612 - DNA, 22 bp, Homo sapiens
gccaggcattattccgatccct

SEQ ID NO: 7893613 - DNA, 22 bp, Homo sapiens
gccaggcgggtctcaaactcct

SEQ ID NO: 7893614 - DNA, 22 bp, Homo sapiens
gccaggcgggtctcaaactcct

SEQ ID NO: 7893615 - DNA, 22 bp, Homo sapiens
gccaggcgggtctcaaactcct

SEQ ID NO: 7893616 - DNA, 22 bp, Homo sapiens
gccaggctaagaaaggtgtgat

SEQ ID NO: 7893617 - DNA, 22 bp, Homo sapiens
gccaggctaagaaaggtgtgat

SEQ ID NO: 7893618 - DNA, 22 bp, Homo sapiens
gccaggctaagaaaggtgtgat

SEQ ID NO: 7893619 - DNA, 22 bp, Homo sapiens
gccaggctaagaaaggtgtgat

SEQ ID NO: 7893620 - DNA, 22 bp, Homo sapiens
gccaggctaagaaaggtgtgat

SEQ ID NO: 7893621 - DNA, 22 bp, Homo sapiens
gccaggctcagcagtcaacctg

SEQ ID NO: 7893622 - DNA, 22 bp, Homo sapiens
gccaggctcagcagtcaacctg

SEQ ID NO: 7893623 - DNA, 22 bp, Homo sapiens
gccaggctcagcagtcaacctg

SEQ ID NO: 7893624 - DNA, 22 bp, Homo sapiens
gccaggctcagtagcgattcct

SEQ ID NO: 7893625 - DNA, 22 bp, Homo sapiens
gccaggctcagtagcgattcct

SEQ ID NO: 7893626 - DNA, 22 bp, Homo sapiens
gccaggctcagtagcgattcct

SEQ ID NO: 7893627 - DNA, 22 bp, Homo sapiens
gccaggctcagtagcgattcct

SEQ ID NO: 7893628 - DNA, 22 bp, Homo sapiens
gcccaagctccgcctcctgtcg

SEQ ID NO: 7893629 - DNA, 22 bp, Homo sapiens
gcccaagctccgcctcctgtcg

SEQ ID NO: 7893630 - DNA, 20 bp, Homo sapiens
gcccaagcgccggccgcaga

SEQ ID NO: 7893631 - DNA, 20 bp, Homo sapiens
gcccaagcgccggccgcaga

SEQ ID NO: 7893632 - DNA, 22 bp, Homo sapiens
gcccaagctggactgcagtggc

SEQ ID NO: 7893633 - DNA, 22 bp, Homo sapiens
gcccaagggcatcaagttctac

SEQ ID NO: 7893634 - DNA, 22 bp, Homo sapiens
gcccaagccgccttccagagac

SEQ ID NO: 7893635 - DNA, 22 bp, Homo sapiens
gcccaagccgccttccagagac

SEQ ID NO: 7893636 - DNA, 22 bp, Homo sapiens
gcccaagccggagctgggagag

SEQ ID NO: 7893637 - DNA, 20 bp, Homo sapiens
gcccaagcgccggccgcaga

SEQ ID NO: 7893638 - DNA, 20 bp, Homo sapiens
gcccaagcgccggccgcaga

SEQ ID NO: 7893639 - DNA, 22 bp, Homo sapiens
gcccaaggtcacacacaggaag

SEQ ID NO: 7893640 - DNA, 22 bp, Homo sapiens
gcccaaggtcacacacaggaag

SEQ ID NO: 7893641 - DNA, 22 bp, Homo sapiens
gcccaaggtcacacacaggaag

SEQ ID NO: 7893642 - DNA, 20 bp, Homo sapiens
gcccaaggtccagaaggggg

SEQ ID NO: 7893643 - DNA, 20 bp, Homo sapiens
gcccaaggtccagaaggggg

SEQ ID NO: 7893644 - DNA, 20 bp, Homo sapiens
gcccaaggtccagaaggggg

SEQ ID NO: 7893645 - DNA, 22 bp, Homo sapiens
gcccaaggtatatcagagacag

SEQ ID NO: 7893646 - DNA, 22 bp, Homo sapiens
gcccaaggtcacacacaggaag

SEQ ID NO: 7893647 - DNA, 22 bp, Homo sapiens
gcccaaggtatatcagagacag

SEQ ID NO: 7893648 - DNA, 22 bp, Homo sapiens
gcccaaggtatatcagagacag

SEQ ID NO: 7893649 - DNA, 22 bp, Homo sapiens
gcccaaggtatatcagagacag

SEQ ID NO: 7893650 - DNA, 22 bp, Homo sapiens
gcccaaggtatatcagagacag

SEQ ID NO: 7893651 - DNA, 22 bp, Homo sapiens
gcccaagcagcttcccgagctt

SEQ ID NO: 7893652 - DNA, 22 bp, Homo sapiens
gcccaagatcagtggggcagat

SEQ ID NO: 7893653 - DNA, 22 bp, Homo sapiens
gcccaagatctggagctgcagg

SEQ ID NO: 7893654 - DNA, 22 bp, Homo sapiens
gcccaagagttaagtctctgct

SEQ ID NO: 7893655 - DNA, 22 bp, Homo sapiens
gcccaagatcacactggaaatc

SEQ ID NO: 7893656 - DNA, 22 bp, Homo sapiens
gcccaagatcagtggggcagat

SEQ ID NO: 7893657 - DNA, 22 bp, Homo sapiens
gcccaaagccagtgtgctctcc

SEQ ID NO: 7893658 - DNA, 22 bp, Homo sapiens
gcccaaagtcactcagctagga

SEQ ID NO: 7893659 - DNA, 22 bp, Homo sapiens
gcccaaagtcactcagctagga

SEQ ID NO: 7893660 - DNA, 22 bp, Homo sapiens
gcccaaagtcactcagctagga

SEQ ID NO: 7893661 - DNA, 22 bp, Homo sapiens
gcccaagacatttagtaaagag

SEQ ID NO: 7893662 - DNA, 22 bp, Homo sapiens
gcccaagactgtacagttaaag

SEQ ID NO: 7893663 - DNA, 22 bp, Homo sapiens
gccaggctctcagtgactgccc

SEQ ID NO: 7893664 - DNA, 22 bp, Homo sapiens
gccaggctctcagtgactgccc

SEQ ID NO: 7893665 - DNA, 22 bp, Homo sapiens
gccaggctctcagtgactgccc

SEQ ID NO: 7893666 - DNA, 23 bp, Homo sapiens
gccaggctccggtctgtggccac

SEQ ID NO: 7893667 - DNA, 22 bp, Homo sapiens
gcccaaagagctttgatctcag

SEQ ID NO: 7893668 - DNA, 22 bp, Homo sapiens
gccatttggcaaaactgacttc

SEQ ID NO: 7893669 - DNA, 18 bp, Homo sapiens
gccagctgcacggccctc

SEQ ID NO: 7893670 - DNA, 22 bp, Homo sapiens
gccagctgcaaagtatgttgaa

SEQ ID NO: 7893671 - DNA, 22 bp, Homo sapiens
gccagctgcaaagtatgttgaa

SEQ ID NO: 7893672 - DNA, 22 bp, Homo sapiens
gccagctggctgcaggtcccag

SEQ ID NO: 7893673 - DNA, 18 bp, Homo sapiens
gccagctgcacggccctc

SEQ ID NO: 7893674 - DNA, 22 bp, Homo sapiens
gccagctgggccttagggctgg

SEQ ID NO: 7893675 - DNA, 22 bp, Homo sapiens
gccagctgggccttagggctgg

SEQ ID NO: 7893676 - DNA, 22 bp, Homo sapiens
gccagctggtaggcacctagcc

SEQ ID NO: 7893677 - DNA, 22 bp, Homo sapiens
gccagctggtaggcacctagcc

SEQ ID NO: 7893678 - DNA, 22 bp, Homo sapiens
gccagctggtaggcacctagcc

SEQ ID NO: 7893679 - DNA, 22 bp, Homo sapiens
gccagctggtaggcacctagcc

SEQ ID NO: 7893680 - DNA, 22 bp, Homo sapiens
gccagctggtaggcacctagcc

SEQ ID NO: 7893681 - DNA, 21 bp, Homo sapiens
gccagctgggtcttgcaggag

SEQ ID NO: 7893682 - DNA, 22 bp, Homo sapiens
gccagctgggccttagggctgg

SEQ ID NO: 7893683 - DNA, 21 bp, Homo sapiens
gccagctgggtcttgcaggag

SEQ ID NO: 7893684 - DNA, 22 bp, Homo sapiens
gccagctgtaagctggggtgat

SEQ ID NO: 7893685 - DNA, 22 bp, Homo sapiens
gccagctgtaagctggggtgat

SEQ ID NO: 7893686 - DNA, 22 bp, Homo sapiens
gccagctgtaagctggggtgat

SEQ ID NO: 7893687 - DNA, 22 bp, Homo sapiens
gccagctgtaagctggggtgat

SEQ ID NO: 7893688 - DNA, 22 bp, Homo sapiens
gccagctgtaagcagtgattct

SEQ ID NO: 7893689 - DNA, 22 bp, Homo sapiens
gccagctgtaagcagtgattct

SEQ ID NO: 7893690 - DNA, 20 bp, Homo sapiens
gccagctggtcccaattatg

SEQ ID NO: 7893691 - DNA, 20 bp, Homo sapiens
gccagctggtcccaattatg

SEQ ID NO: 7893692 - DNA, 22 bp, Homo sapiens
gccagctgtatctttggccagc

SEQ ID NO: 7893693 - DNA, 22 bp, Homo sapiens
gccagctgtatctttggccagc

SEQ ID NO: 7893694 - DNA, 22 bp, Homo sapiens
gccagctgtctaagagagtaaa

SEQ ID NO: 7893695 - DNA, 22 bp, Homo sapiens
gccagctgtctaagagagtaaa

SEQ ID NO: 7893696 - DNA, 22 bp, Homo sapiens
gccagctgtaggtggtgggttg

SEQ ID NO: 7893697 - DNA, 22 bp, Homo sapiens
gccagctgtatctttggccagc

SEQ ID NO: 7893698 - DNA, 22 bp, Homo sapiens
gccagctgtaggtggtgggttg

SEQ ID NO: 7893699 - DNA, 22 bp, Homo sapiens
gccagagacacttggaggtaga

SEQ ID NO: 7893700 - DNA, 22 bp, Homo sapiens
gccagctgagaaatcattgata

SEQ ID NO: 7893701 - DNA, 22 bp, Homo sapiens
gccagctgacaccttgattttg

SEQ ID NO: 7893702 - DNA, 22 bp, Homo sapiens
gccagagacacttggaggtaga

SEQ ID NO: 7893703 - DNA, 22 bp, Homo sapiens
gccagagacacttggaggtaga

SEQ ID NO: 7893704 - DNA, 22 bp, Homo sapiens
gccagaaagaggaggacctggg

SEQ ID NO: 7893705 - DNA, 22 bp, Homo sapiens
gccagagaatgaaaatcagatt

SEQ ID NO: 7893706 - DNA, 22 bp, Homo sapiens
gccagacactcccctgggcagg

SEQ ID NO: 7893707 - DNA, 22 bp, Homo sapiens
gccagctgagcaaattccagct

SEQ ID NO: 7893708 - DNA, 22 bp, Homo sapiens
gccagctgagaaatcattgata

SEQ ID NO: 7893709 - DNA, 22 bp, Homo sapiens
gccagctgagaaatcattgata

SEQ ID NO: 7893710 - DNA, 22 bp, Homo sapiens
gccagctgagcaaattccagct

SEQ ID NO: 7893711 - DNA, 22 bp, Homo sapiens
gccagctgagcaaattccagct

SEQ ID NO: 7893712 - DNA, 22 bp, Homo sapiens
gccagctgaggccgtgcaggct

SEQ ID NO: 7893713 - DNA, 22 bp, Homo sapiens
gccagctgaggccgtgcaggct

SEQ ID NO: 7893714 - DNA, 22 bp, Homo sapiens
gccagctgaggccgtgcaggct

SEQ ID NO: 7893715 - DNA, 22 bp, Homo sapiens
gccagctgaggccgtgcaggct

SEQ ID NO: 7893716 - DNA, 22 bp, Homo sapiens
gccagaagactggagtcagctg

SEQ ID NO: 7893717 - DNA, 22 bp, Homo sapiens
gccagaagcacatgagaggtga

SEQ ID NO: 7893718 - DNA, 22 bp, Homo sapiens
gccagaaggggtggatccaggc

SEQ ID NO: 7893719 - DNA, 22 bp, Homo sapiens
gccagaaggggtggatccaggc

SEQ ID NO: 7893720 - DNA, 22 bp, Homo sapiens
gccagaaagaggaggacctggg

SEQ ID NO: 7893721 - DNA, 22 bp, Homo sapiens
gccagaagactggagtcagctg

SEQ ID NO: 7893722 - DNA, 22 bp, Homo sapiens
gccagaaagaggaggacctggg

SEQ ID NO: 7893723 - DNA, 22 bp, Homo sapiens
gccagaagactggagtcagctg

SEQ ID NO: 7893724 - DNA, 22 bp, Homo sapiens
gccagaagactggagtcagctg

SEQ ID NO: 7893725 - DNA, 22 bp, Homo sapiens
gccagaaacatacacatcactt

SEQ ID NO: 7893726 - DNA, 22 bp, Homo sapiens
gccagaaagaggaggacctggg

SEQ ID NO: 7893727 - DNA, 22 bp, Homo sapiens
gccagaaagaggaggacctggg

SEQ ID NO: 7893728 - DNA, 22 bp, Homo sapiens
gccagaaacatacacatcactt

SEQ ID NO: 7893729 - DNA, 22 bp, Homo sapiens
gccactgttgctcctcaggaaa

SEQ ID NO: 7893730 - DNA, 22 bp, Homo sapiens
gccagaaacatacacatcactt

SEQ ID NO: 7893731 - DNA, 22 bp, Homo sapiens
gccagaaacatacacatcactt

SEQ ID NO: 7893732 - DNA, 22 bp, Homo sapiens
gccactttgatgatataaaaac

SEQ ID NO: 7893733 - DNA, 22 bp, Homo sapiens
gccagctgtgcttttcctaaaa

SEQ ID NO: 7893734 - DNA, 22 bp, Homo sapiens
gccagctgtctaagagagtaaa

SEQ ID NO: 7893735 - DNA, 22 bp, Homo sapiens
gccagctgttcagacattcttt

SEQ ID NO: 7893736 - DNA, 22 bp, Homo sapiens
gccagctgtttcagagcccagt

SEQ ID NO: 7893737 - DNA, 22 bp, Homo sapiens
gccagctgtttcagagcccagt

SEQ ID NO: 7893738 - DNA, 22 bp, Homo sapiens
gccagctgtttcagagcccagt

SEQ ID NO: 7893739 - DNA, 22 bp, Homo sapiens
gccagctgtttcagagcccagt

SEQ ID NO: 7893740 - DNA, 22 bp, Homo sapiens
gccagctgtttcagagcccagt

SEQ ID NO: 7893741 - DNA, 22 bp, Homo sapiens
gccagcttggccagtggccagt

SEQ ID NO: 7893742 - DNA, 22 bp, Homo sapiens
gccagcttggccagtggccagt

SEQ ID NO: 7893743 - DNA, 22 bp, Homo sapiens
gccagctttggcacagggtggt

SEQ ID NO: 7893744 - DNA, 23 bp, Homo sapiens
gccagctttggtctgtctcctag

SEQ ID NO: 7893745 - DNA, 22 bp, Homo sapiens
gccagcttcccatctggcttcc

SEQ ID NO: 7893746 - DNA, 19 bp, Homo sapiens
gccaggaaagaatcaggcg

SEQ ID NO: 7893747 - DNA, 19 bp, Homo sapiens
gccaggaaagaatcaggcg

SEQ ID NO: 7893748 - DNA, 19 bp, Homo sapiens
gccaggaaagaatcaggcg

SEQ ID NO: 7893749 - DNA, 19 bp, Homo sapiens
gccaggaaagaatcaggcg

SEQ ID NO: 7893750 - DNA, 19 bp, Homo sapiens
gccaggaaagaatcaggcg

SEQ ID NO: 7893751 - DNA, 22 bp, Homo sapiens
gccaggaaaagaagctggtgct

SEQ ID NO: 7893752 - DNA, 22 bp, Homo sapiens
gccaggaaagccactggcatac

SEQ ID NO: 7893753 - DNA, 22 bp, Homo sapiens
gccaggaaagcaaaatcaccca

SEQ ID NO: 7893754 - DNA, 19 bp, Homo sapiens
gccaggaaagaatcaggcg

SEQ ID NO: 7893755 - DNA, 22 bp, Homo sapiens
gccaggaaagccactggcatac

SEQ ID NO: 7893756 - DNA, 22 bp, Homo sapiens
gccaggaaagccactggcatac

SEQ ID NO: 7893757 - DNA, 22 bp, Homo sapiens
gccaggaaaaagggtggccaat

SEQ ID NO: 7893758 - DNA, 22 bp, Homo sapiens
gccagcttttgaccccgttgtg

SEQ ID NO: 7893759 - DNA, 22 bp, Homo sapiens
gccaggaaaaaccggccctgct

SEQ ID NO: 7893760 - DNA, 22 bp, Homo sapiens
gccaggaaaaaccggccctgct

SEQ ID NO: 7893761 - DNA, 22 bp, Homo sapiens
gccaggaaaaaccggccctgct

SEQ ID NO: 7893762 - DNA, 22 bp, Homo sapiens
gccaggaaaaaccggccctgct

SEQ ID NO: 7893763 - DNA, 18 bp, Homo sapiens
gccaggaagaggaatgtg

SEQ ID NO: 7893764 - DNA, 18 bp, Homo sapiens
gccaggaagaggaatgtg

SEQ ID NO: 7893765 - DNA, 22 bp, Homo sapiens
gccaggaacacaatgccaagct

SEQ ID NO: 7893766 - DNA, 22 bp, Homo sapiens
gccaggaagagagagccctcca

SEQ ID NO: 7893767 - DNA, 18 bp, Homo sapiens
gccaggaagaggaatgtg

SEQ ID NO: 7893768 - DNA, 18 bp, Homo sapiens
gccaggaagaggaatgtg

SEQ ID NO: 7893769 - DNA, 22 bp, Homo sapiens
gccaggaagcagttagatgggt

SEQ ID NO: 7893770 - DNA, 22 bp, Homo sapiens
gccaggaagcagttagatgggt

SEQ ID NO: 7893771 - DNA, 18 bp, Homo sapiens
gccaggaagcatggggac

SEQ ID NO: 7893772 - DNA, 18 bp, Homo sapiens
gccaggaagcatggggac

SEQ ID NO: 7893773 - DNA, 22 bp, Homo sapiens
gccaggaagcagttagatgggt

SEQ ID NO: 7893774 - DNA, 22 bp, Homo sapiens
gccaggaaattcatgccagatc

SEQ ID NO: 7893775 - DNA, 22 bp, Homo sapiens
gccaggaaagggaattccctga

SEQ ID NO: 7893776 - DNA, 22 bp, Homo sapiens
gccaggaaattcatgccagatc

SEQ ID NO: 7893777 - DNA, 22 bp, Homo sapiens
gccaggaaattcatgccagatc

SEQ ID NO: 7893778 - DNA, 22 bp, Homo sapiens
gccaggaaattcatgccagatc

SEQ ID NO: 7893779 - DNA, 22 bp, Homo sapiens
gccaggaacacaatgccaagct

SEQ ID NO: 7893780 - DNA, 22 bp, Homo sapiens
gccaggaacacaatgccaagct

SEQ ID NO: 7893781 - DNA, 22 bp, Homo sapiens
gccaggaaattcatgccagatc

SEQ ID NO: 7893782 - DNA, 22 bp, Homo sapiens
gccaggaacacaatgccaagct

SEQ ID NO: 7893783 - DNA, 22 bp, Homo sapiens
gccaggaacacaatgccaagct

SEQ ID NO: 7893784 - DNA, 22 bp, Homo sapiens
gccaggaacacaatgccaagct

SEQ ID NO: 7893785 - DNA, 22 bp, Homo sapiens
gccaggaaggctgaagccagaa

SEQ ID NO: 7893786 - DNA, 22 bp, Homo sapiens
gccaggaaggctgaagccagaa

SEQ ID NO: 7893787 - DNA, 22 bp, Homo sapiens
gccaggaaggctccctggtcac

SEQ ID NO: 7893788 - DNA, 18 bp, Homo sapiens
gccaggaagcatggggac

SEQ ID NO: 7893789 - DNA, 22 bp, Homo sapiens
gccaggaaggctccctggtcac

SEQ ID NO: 7893790 - DNA, 22 bp, Homo sapiens
gccaggaaggctgaagccagaa

SEQ ID NO: 7893791 - DNA, 22 bp, Homo sapiens
gccaggaagtcagccaagccca

SEQ ID NO: 7893792 - DNA, 22 bp, Homo sapiens
gccaggaagtgcagccctgcca

SEQ ID NO: 7893793 - DNA, 22 bp, Homo sapiens
gccaggaatcactgctgagtaa

SEQ ID NO: 7893794 - DNA, 22 bp, Homo sapiens
gccaggaatgcataaatgacct

SEQ ID NO: 7893795 - DNA, 22 bp, Homo sapiens
gccaggcatgtcctctgcagaa

SEQ ID NO: 7893796 - DNA, 22 bp, Homo sapiens
gccaggcatgtcctctgcagaa

SEQ ID NO: 7893797 - DNA, 22 bp, Homo sapiens
gccaggaagttgggccagtcta

SEQ ID NO: 7893798 - DNA, 22 bp, Homo sapiens
gccaggaatcactgctgagtaa

SEQ ID NO: 7893799 - DNA, 22 bp, Homo sapiens
gcattcttggtggagtgctaaa

SEQ ID NO: 7893800 - DNA, 22 bp, Homo sapiens
gcattcttgaggtgtggactca

SEQ ID NO: 7893801 - DNA, 22 bp, Homo sapiens
gcattcttcgaagtaagtagtg

SEQ ID NO: 7893802 - DNA, 22 bp, Homo sapiens
gcattctttagactgagagata

SEQ ID NO: 7893803 - DNA, 22 bp, Homo sapiens
gcattcttgtttttcctaccct

SEQ ID NO: 7893804 - DNA, 22 bp, Homo sapiens
gcattcttcacagtattcctcc

SEQ ID NO: 7893805 - DNA, 22 bp, Homo sapiens
gcattcttcacagtattcctcc

SEQ ID NO: 7893806 - DNA, 18 bp, Homo sapiens
gcattctgttaatgtgga

SEQ ID NO: 7893807 - DNA, 21 bp, Homo sapiens
gcattcttcatgtgattcaga

SEQ ID NO: 7893808 - DNA, 22 bp, Homo sapiens
gcattgaaccatctagatttct

SEQ ID NO: 7893809 - DNA, 22 bp, Homo sapiens
gcattgaaatggcaaaaagaga

SEQ ID NO: 7893810 - DNA, 22 bp, Homo sapiens
gcattgatctgtatgcattaag

SEQ ID NO: 7893811 - DNA, 22 bp, Homo sapiens
gcattgatctgtatgcattaag

SEQ ID NO: 7893812 - DNA, 22 bp, Homo sapiens
gcattgagtccactctgtcttt

SEQ ID NO: 7893813 - DNA, 22 bp, Homo sapiens
gcattgatcacagttgaggttt

SEQ ID NO: 7893814 - DNA, 22 bp, Homo sapiens
gcattgaaggacttccattata

SEQ ID NO: 7893815 - DNA, 19 bp, Homo sapiens
gcataaaatgtcaatgtgt

SEQ ID NO: 7893816 - DNA, 22 bp, Homo sapiens
gcataaactccaaaaggcaggg

SEQ ID NO: 7893817 - DNA, 19 bp, Homo sapiens
gcataaaatgtcaatgtgt

SEQ ID NO: 7893818 - DNA, 19 bp, Homo sapiens
gcataaaatgtcaatgtgt

SEQ ID NO: 7893819 - DNA, 22 bp, Homo sapiens
gcattaaatgctagggacctaa

SEQ ID NO: 7893820 - DNA, 22 bp, Homo sapiens
gcattaatgtaagacccactcc

SEQ ID NO: 7893821 - DNA, 21 bp, Homo sapiens
gcattaaaagcagttgttggt

SEQ ID NO: 7893822 - DNA, 21 bp, Homo sapiens
gcattaaaagcagttgttggt

SEQ ID NO: 7893823 - DNA, 22 bp, Homo sapiens
gcattagacccaaggtattttg

SEQ ID NO: 7893824 - DNA, 22 bp, Homo sapiens
gcattagacccaaggtattttg

SEQ ID NO: 7893825 - DNA, 22 bp, Homo sapiens
gcattagaagggacctctgggg

SEQ ID NO: 7893826 - DNA, 22 bp, Homo sapiens
gcattagaaactattgctgcaa

SEQ ID NO: 7893827 - DNA, 22 bp, Homo sapiens
gcattacagcagttcaacttgg

SEQ ID NO: 7893828 - DNA, 19 bp, Homo sapiens
gcataaaatgtcaatgtgt

SEQ ID NO: 7893829 - DNA, 22 bp, Homo sapiens
gcagttttattatgatggaaat

SEQ ID NO: 7893830 - DNA, 22 bp, Homo sapiens
gcagttttattatgatggaaat

SEQ ID NO: 7893831 - DNA, 22 bp, Homo sapiens
gcagttttagtggatctggggc

SEQ ID NO: 7893832 - DNA, 21 bp, Homo sapiens
gcagtttatgtaatatgcact

SEQ ID NO: 7893833 - DNA, 21 bp, Homo sapiens
gcagtttatgtaatatgcact

SEQ ID NO: 7893834 - DNA, 22 bp, Homo sapiens
gcagtttgaaagtatgagtcca

SEQ ID NO: 7893835 - DNA, 22 bp, Homo sapiens
gcagtttcagacatatctccat

SEQ ID NO: 7893836 - DNA, 22 bp, Homo sapiens
gcagtttctgaatttatccaag

SEQ ID NO: 7893837 - DNA, 22 bp, Homo sapiens
gcagtgtttgtgttctcacatg

SEQ ID NO: 7893838 - DNA, 22 bp, Homo sapiens
gcagtgtttttcaatgcttcca

SEQ ID NO: 7893839 - DNA, 22 bp, Homo sapiens
gcagtgttttacagaccagcat

SEQ ID NO: 7893840 - DNA, 22 bp, Homo sapiens
gcagtgtttgtgttctcacatg

SEQ ID NO: 7893841 - DNA, 22 bp, Homo sapiens
gcagtgtttttcaatgcttcca

SEQ ID NO: 7893842 - DNA, 22 bp, Homo sapiens
gcagtgtttttcaatgcttcca

SEQ ID NO: 7893843 - DNA, 17 bp, Homo sapiens
gcagttaaattaagatg

SEQ ID NO: 7893844 - DNA, 22 bp, Homo sapiens
gcagttcctacagtggaaagcg

SEQ ID NO: 7893845 - DNA, 22 bp, Homo sapiens
gcagttcacccaagtgcagaga

SEQ ID NO: 7893846 - DNA, 22 bp, Homo sapiens
gcagttcctacagtggaaagcg

SEQ ID NO: 7893847 - DNA, 22 bp, Homo sapiens
gcagttagcttgtcacagtcct

SEQ ID NO: 7893848 - DNA, 22 bp, Homo sapiens
gcagttagtgaagcagcttaga

SEQ ID NO: 7893849 - DNA, 22 bp, Homo sapiens
gcagtttagtagatgacattat

SEQ ID NO: 7893850 - DNA, 22 bp, Homo sapiens
gcagtttagtagatgacattat

SEQ ID NO: 7893851 - DNA, 16 bp, Homo sapiens
gcagttggggagagct

SEQ ID NO: 7893852 - DNA, 22 bp, Homo sapiens
gcagtttactgtcaataactct

SEQ ID NO: 7893853 - DNA, 22 bp, Homo sapiens
gcagttggcagggagcccagat

SEQ ID NO: 7893854 - DNA, 22 bp, Homo sapiens
gcagttgcaggatttgtgttgt

SEQ ID NO: 7893855 - DNA, 22 bp, Homo sapiens
gcagttggcagggagcccagat

SEQ ID NO: 7893856 - DNA, 22 bp, Homo sapiens
gcagttggcagggagcccagat

SEQ ID NO: 7893857 - DNA, 22 bp, Homo sapiens
gcagttggcagggagcccagat

SEQ ID NO: 7893858 - DNA, 23 bp, Homo sapiens
gcagtgtttgcttcatcttatcc

SEQ ID NO: 7893859 - DNA, 22 bp, Homo sapiens
gcagtgtttggatccatagcga

SEQ ID NO: 7893860 - DNA, 23 bp, Homo sapiens
gcagtgtttgcttcatcttatcc

SEQ ID NO: 7893861 - DNA, 22 bp, Homo sapiens
gcagtgtttcagtgctttttct

SEQ ID NO: 7893862 - DNA, 22 bp, Homo sapiens
gcagtgtttacatattagaaac

SEQ ID NO: 7893863 - DNA, 22 bp, Homo sapiens
gcagtgtttcccagagatggaa

SEQ ID NO: 7893864 - DNA, 22 bp, Homo sapiens
gcagtgttgttaaaagattaga

SEQ ID NO: 7893865 - DNA, 22 bp, Homo sapiens
gcagtgttgtgatccaggtctt

SEQ ID NO: 7893866 - DNA, 22 bp, Homo sapiens
gcagtgtttacatattagaaac

SEQ ID NO: 7893867 - DNA, 22 bp, Homo sapiens
gcagtgtttcaaatcaaaggca

SEQ ID NO: 7893868 - DNA, 22 bp, Homo sapiens
gcagtgttggcaggatggggct

SEQ ID NO: 7893869 - DNA, 22 bp, Homo sapiens
gcaggtggaagcagcagactca

SEQ ID NO: 7893870 - DNA, 22 bp, Homo sapiens
gcagtgttgctaggtgcggtga

SEQ ID NO: 7893871 - DNA, 22 bp, Homo sapiens
gcagtgttggcaggatggggct

SEQ ID NO: 7893872 - DNA, 22 bp, Homo sapiens
gcagtgttggtttgctctgcag

SEQ ID NO: 7893873 - DNA, 22 bp, Homo sapiens
gcaggtggaagcagcagactca

SEQ ID NO: 7893874 - DNA, 22 bp, Homo sapiens
gcaggtggaagcagcagactca

SEQ ID NO: 7893875 - DNA, 18 bp, Homo sapiens
gcaggtgccactgctgtt

SEQ ID NO: 7893876 - DNA, 18 bp, Homo sapiens
gcaggtgccactgctgtt

SEQ ID NO: 7893877 - DNA, 18 bp, Homo sapiens
gcaggtgccactgctgtt

SEQ ID NO: 7893878 - DNA, 22 bp, Homo sapiens
gcaggtgattcaccctgggcct

SEQ ID NO: 7893879 - DNA, 18 bp, Homo sapiens
gcaggtgccactgctgtt

SEQ ID NO: 7893880 - DNA, 22 bp, Homo sapiens
gcaggtgattcaccctgggcct

SEQ ID NO: 7893881 - DNA, 22 bp, Homo sapiens
gcaggtgattcaccctgggcct

SEQ ID NO: 7893882 - DNA, 22 bp, Homo sapiens
gcatttaaatttgaacttcaga

SEQ ID NO: 7893883 - DNA, 22 bp, Homo sapiens
gcatttaaatttgaacttcaga

SEQ ID NO: 7893884 - DNA, 23 bp, Homo sapiens
gcatttacagactcacttttcta

SEQ ID NO: 7893885 - DNA, 22 bp, Homo sapiens
gcatttagctttaaaatatttc

SEQ ID NO: 7893886 - DNA, 20 bp, Homo sapiens
gcattgttgtagtagattgt

SEQ ID NO: 7893887 - DNA, 22 bp, Homo sapiens
gcatttaaatttgaacttcaga

SEQ ID NO: 7893888 - DNA, 22 bp, Homo sapiens
gcattgttgaaaggaatgggct

SEQ ID NO: 7893889 - DNA, 22 bp, Homo sapiens
gcattgttagtctatgcagata

SEQ ID NO: 7893890 - DNA, 23 bp, Homo sapiens
gcattgtagaatgtttagcagca

SEQ ID NO: 7893891 - DNA, 23 bp, Homo sapiens
gcattgtagaatgtttagcagca

SEQ ID NO: 7893892 - DNA, 22 bp, Homo sapiens
gcattggcagggatgcattacg

SEQ ID NO: 7893893 - DNA, 22 bp, Homo sapiens
gcattggcatttctccagcgga

SEQ ID NO: 7893894 - DNA, 22 bp, Homo sapiens
gcattgatttaaacatctctct

SEQ ID NO: 7893895 - DNA, 22 bp, Homo sapiens
gcattgatttaaacatctctct

SEQ ID NO: 7893896 - DNA, 22 bp, Homo sapiens
gcattgattctgaagtgaaatg

SEQ ID NO: 7893897 - DNA, 22 bp, Homo sapiens
gcattgattctgaagtgaaatg

SEQ ID NO: 7893898 - DNA, 22 bp, Homo sapiens
gcattgatgccaaccagattct

SEQ ID NO: 7893899 - DNA, 22 bp, Homo sapiens
gcattgatctttattctgcttt

SEQ ID NO: 7893900 - DNA, 22 bp, Homo sapiens
gcattgcaaaaagcagcttgat

SEQ ID NO: 7893901 - DNA, 22 bp, Homo sapiens
gcattgcaactgacagatcatt

SEQ ID NO: 7893902 - DNA, 22 bp, Homo sapiens
gccaccctgacgccgcagaccc

SEQ ID NO: 7893903 - DNA, 18 bp, Homo sapiens
gccaccctcctcgtctcc

SEQ ID NO: 7893904 - DNA, 22 bp, Homo sapiens
gccaccctgacgccgcagaccc

SEQ ID NO: 7893905 - DNA, 22 bp, Homo sapiens
gccaccctgagctgggccaggg

SEQ ID NO: 7893906 - DNA, 22 bp, Homo sapiens
gccaccctgcaaatgcccagga

SEQ ID NO: 7893907 - DNA, 22 bp, Homo sapiens
gccaccctgcaaatgcccagga

SEQ ID NO: 7893908 - DNA, 22 bp, Homo sapiens
gccaccctgcaaatgcccagga

SEQ ID NO: 7893909 - DNA, 22 bp, Homo sapiens
gccaccctggaccaccctgggc

SEQ ID NO: 7893910 - DNA, 22 bp, Homo sapiens
gcatttcatgtaagtcagacca

SEQ ID NO: 7893911 - DNA, 22 bp, Homo sapiens
gcatttcatgctccttggaacc

SEQ ID NO: 7893912 - DNA, 18 bp, Homo sapiens
gccaccctcctcgtctcc

SEQ ID NO: 7893913 - DNA, 22 bp, Homo sapiens
gcatttcagagaaaatctgctt

SEQ ID NO: 7893914 - DNA, 22 bp, Homo sapiens
gcatttcatgccgtggaagtcc

SEQ ID NO: 7893915 - DNA, 22 bp, Homo sapiens
gcatttatttctttactgcatc

SEQ ID NO: 7893916 - DNA, 22 bp, Homo sapiens
gcatttatttctttactgcatc

SEQ ID NO: 7893917 - DNA, 22 bp, Homo sapiens
gcatttatttctttactgcatc

SEQ ID NO: 7893918 - DNA, 22 bp, Homo sapiens
gcatttcaaaattccaggcaag

SEQ ID NO: 7893919 - DNA, 22 bp, Homo sapiens
gcatttcagaagcatgccctct

SEQ ID NO: 7893920 - DNA, 18 bp, Homo sapiens
gcatttatgcggggctac

SEQ ID NO: 7893921 - DNA, 22 bp, Homo sapiens
gcatttattatctgccaggcac

SEQ ID NO: 7893922 - DNA, 22 bp, Homo sapiens
gcatttattatctgccaggcac

SEQ ID NO: 7893923 - DNA, 22 bp, Homo sapiens
gccacctctttgtctctgccgc

SEQ ID NO: 7893924 - DNA, 22 bp, Homo sapiens
gccacctctctcttgactcgag

SEQ ID NO: 7893925 - DNA, 22 bp, Homo sapiens
gccacctctctcttgactcgag

SEQ ID NO: 7893926 - DNA, 20 bp, Homo sapiens
gccacctctctagcagtaga

SEQ ID NO: 7893927 - DNA, 20 bp, Homo sapiens
gccacctctctagcagtaga

SEQ ID NO: 7893928 - DNA, 21 bp, Homo sapiens
gccacctcgtctcggagcagc

SEQ ID NO: 7893929 - DNA, 22 bp, Homo sapiens
gccacctctagcaaagctcagc

SEQ ID NO: 7893930 - DNA, 22 bp, Homo sapiens
gccacctctagcaaagctcagc

SEQ ID NO: 7893931 - DNA, 22 bp, Homo sapiens
gccacctcggctttctctgctc

SEQ ID NO: 7893932 - DNA, 21 bp, Homo sapiens
gccacctcgtctcggagcagc

SEQ ID NO: 7893933 - DNA, 22 bp, Homo sapiens
gccacccttatcccatgcttct

SEQ ID NO: 7893934 - DNA, 22 bp, Homo sapiens
gccacccttgcgtcactgacat

SEQ ID NO: 7893935 - DNA, 21 bp, Homo sapiens
gccacctcaatcttctagcgc

SEQ ID NO: 7893936 - DNA, 22 bp, Homo sapiens
gccaccctggacgcactgttcg

SEQ ID NO: 7893937 - DNA, 22 bp, Homo sapiens
gccaccctggacgcactgttcg

SEQ ID NO: 7893938 - DNA, 22 bp, Homo sapiens
gccaccctggacgcactgttcg

SEQ ID NO: 7893939 - DNA, 22 bp, Homo sapiens
gccacccttatcccatgcttct

SEQ ID NO: 7893940 - DNA, 22 bp, Homo sapiens
gccacctcccaggacgaggctg

SEQ ID NO: 7893941 - DNA, 22 bp, Homo sapiens
gccacctcccaggacgaggctg

SEQ ID NO: 7893942 - DNA, 23 bp, Homo sapiens
gccacctcctggtcagaaagagg

SEQ ID NO: 7893943 - DNA, 23 bp, Homo sapiens
gccacctcctggtcagaaagagg

SEQ ID NO: 7893944 - DNA, 22 bp, Homo sapiens
gccacctccttattccacctgt

SEQ ID NO: 7893945 - DNA, 22 bp, Homo sapiens
gccacctccttattccacctgt

SEQ ID NO: 7893946 - DNA, 22 bp, Homo sapiens
gccacctcggctttctctgctc

SEQ ID NO: 7893947 - DNA, 22 bp, Homo sapiens
gccacctgcgggccgtggtgga

SEQ ID NO: 7893948 - DNA, 22 bp, Homo sapiens
gccacctggacagctgtgccct

SEQ ID NO: 7893949 - DNA, 22 bp, Homo sapiens
gccacctggacagctgtgccct

SEQ ID NO: 7893950 - DNA, 22 bp, Homo sapiens
gccacctggacagctgtgccct

SEQ ID NO: 7893951 - DNA, 22 bp, Homo sapiens
gccacctggactcagagccagg

SEQ ID NO: 7893952 - DNA, 22 bp, Homo sapiens
gccacctggactcagagccagg

SEQ ID NO: 7893953 - DNA, 22 bp, Homo sapiens
gccacctggactcagagccagg

SEQ ID NO: 7893954 - DNA, 22 bp, Homo sapiens
gccacctggactcagagccagg

SEQ ID NO: 7893955 - DNA, 22 bp, Homo sapiens
gccacctggactcagagccagg

SEQ ID NO: 7893956 - DNA, 22 bp, Homo sapiens
gccacctgtaagccattaggcc

SEQ ID NO: 7893957 - DNA, 22 bp, Homo sapiens
gccacctggactcagagccagg

SEQ ID NO: 7893958 - DNA, 22 bp, Homo sapiens
gccacctgtgtgggcctttgtg

SEQ ID NO: 7893959 - DNA, 22 bp, Homo sapiens
gccacctgtttcagatgtggtt

SEQ ID NO: 7893960 - DNA, 22 bp, Homo sapiens
gccacctgtttcgcttgcccag

SEQ ID NO: 7893961 - DNA, 22 bp, Homo sapiens
gccacctgtttcgcttgcccag

SEQ ID NO: 7893962 - DNA, 20 bp, Homo sapiens
gccactgtgcttacactgct

SEQ ID NO: 7893963 - DNA, 22 bp, Homo sapiens
gccactgtggtcctcccatgat

SEQ ID NO: 7893964 - DNA, 22 bp, Homo sapiens
gccactgttccaccatcttgat

SEQ ID NO: 7893965 - DNA, 22 bp, Homo sapiens
gccacttactaacctcctatcc

SEQ ID NO: 7893966 - DNA, 22 bp, Homo sapiens
gccactgttgctcctcaggaaa

SEQ ID NO: 7893967 - DNA, 22 bp, Homo sapiens
gccactgttcttctttgttcca

SEQ ID NO: 7893968 - DNA, 22 bp, Homo sapiens
tcccaaagtattagcatttcaa

SEQ ID NO: 7893969 - DNA, 22 bp, Homo sapiens
tcccaaagtattagcatttcaa

SEQ ID NO: 7893970 - DNA, 22 bp, Homo sapiens
tcccaaagtattagcatttcaa

SEQ ID NO: 7893971 - DNA, 22 bp, Homo sapiens
tcccaaatataatgcaagagac

SEQ ID NO: 7893972 - DNA, 22 bp, Homo sapiens
tcccaaagtcaagctgtgtctt

SEQ ID NO: 7893973 - DNA, 22 bp, Homo sapiens
tcccaagacctggcatccaagt

SEQ ID NO: 7893974 - DNA, 22 bp, Homo sapiens
tcccaagacgatgtgcttggcc

SEQ ID NO: 7893975 - DNA, 22 bp, Homo sapiens
tcccaaatataatgcaagagac

SEQ ID NO: 7893976 - DNA, 22 bp, Homo sapiens
tcccaagacgatgtgcttggcc

SEQ ID NO: 7893977 - DNA, 22 bp, Homo sapiens
tcccaagagctactcaatggaa

SEQ ID NO: 7893978 - DNA, 22 bp, Homo sapiens
tcccaagatgacacagtggacg

SEQ ID NO: 7893979 - DNA, 22 bp, Homo sapiens
tcccaagagctctgggataagg

SEQ ID NO: 7893980 - DNA, 22 bp, Homo sapiens
tcccaagatgacacagtggacg

SEQ ID NO: 7893981 - DNA, 22 bp, Homo sapiens
tcccaagatgacacagtggacg

SEQ ID NO: 7893982 - DNA, 22 bp, Homo sapiens
tcccaagattaggttggaaagg

SEQ ID NO: 7893983 - DNA, 22 bp, Homo sapiens
tcccagagaagagctggatgga

SEQ ID NO: 7893984 - DNA, 19 bp, Homo sapiens
tcccaagatttctgtatca

SEQ ID NO: 7893985 - DNA, 22 bp, Homo sapiens
tcccagagaaagtcaaggtctt

SEQ ID NO: 7893986 - DNA, 19 bp, Homo sapiens
tcccaagatttctgtatca

SEQ ID NO: 7893987 - DNA, 22 bp, Homo sapiens
tcccaagattattgagggaggg

SEQ ID NO: 7893988 - DNA, 22 bp, Homo sapiens
tcccaagattattgagggaggg

SEQ ID NO: 7893989 - DNA, 22 bp, Homo sapiens
tcccagagaagagctggatgga

SEQ ID NO: 7893990 - DNA, 22 bp, Homo sapiens
tcccagagaagagctggatgga

SEQ ID NO: 7893991 - DNA, 22 bp, Homo sapiens
tcccagagaagagctggatgga

SEQ ID NO: 7893992 - DNA, 22 bp, Homo sapiens
tcccagagacagagcctcctcc

SEQ ID NO: 7893993 - DNA, 22 bp, Homo sapiens
tcccagagaagagctggatgga

SEQ ID NO: 7893994 - DNA, 22 bp, Homo sapiens
tcccagagccaagctatggatg

SEQ ID NO: 7893995 - DNA, 22 bp, Homo sapiens
tcccagagcagtactccaggag

SEQ ID NO: 7893996 - DNA, 22 bp, Homo sapiens
tcccagagcagtactccaggag

SEQ ID NO: 7893997 - DNA, 22 bp, Homo sapiens
tcccagagccaagctatggatg

SEQ ID NO: 7893998 - DNA, 22 bp, Homo sapiens
tcccagagccaagctatggatg

SEQ ID NO: 7893999 - DNA, 22 bp, Homo sapiens
tcccagagccaagctatggatg

SEQ ID NO: 7894000 - DNA, 22 bp, Homo sapiens
tcccagagccaagctatggatg

SEQ ID NO: 7894001 - DNA, 22 bp, Homo sapiens
tcccagagcagatgtgctaaag

SEQ ID NO: 7894002 - DNA, 22 bp, Homo sapiens
tcccagagcagatgtgctaaag

SEQ ID NO: 7894003 - DNA, 22 bp, Homo sapiens
tcccagagcagatgtgctaaag

SEQ ID NO: 7894004 - DNA, 22 bp, Homo sapiens
tcccagagcagatgtgctaaag

SEQ ID NO: 7894005 - DNA, 22 bp, Homo sapiens
tcccagagcagatgtgctaaag

SEQ ID NO: 7894006 - DNA, 22 bp, Homo sapiens
tcccagagcagtactccaggag

SEQ ID NO: 7894007 - DNA, 22 bp, Homo sapiens
tcccagagcagtactccaggag

SEQ ID NO: 7894008 - DNA, 22 bp, Homo sapiens
tcccagagcagtactccaggag

SEQ ID NO: 7894009 - DNA, 22 bp, Homo sapiens
tcccagagacatcatttctccg

SEQ ID NO: 7894010 - DNA, 22 bp, Homo sapiens
tcccagagacatcatttctccg

SEQ ID NO: 7894011 - DNA, 22 bp, Homo sapiens
tcccagagacagagcctcctcc

SEQ ID NO: 7894012 - DNA, 22 bp, Homo sapiens
tcccagagacatcatttctccg

SEQ ID NO: 7894013 - DNA, 22 bp, Homo sapiens
tcccagagacatcatttctccg

SEQ ID NO: 7894014 - DNA, 22 bp, Homo sapiens
tcccagagacagagcctcctcc

SEQ ID NO: 7894015 - DNA, 22 bp, Homo sapiens
tcccagagacagagcctcctcc

SEQ ID NO: 7894016 - DNA, 22 bp, Homo sapiens
tcccagagacagagcctcctcc

SEQ ID NO: 7894017 - DNA, 22 bp, Homo sapiens
tcccagagacagagcctcctcc

SEQ ID NO: 7894018 - DNA, 22 bp, Homo sapiens
tcccagagatttcctctccttc

SEQ ID NO: 7894019 - DNA, 22 bp, Homo sapiens
tcccagagatttcctctccttc

SEQ ID NO: 7894020 - DNA, 22 bp, Homo sapiens
tcccagagacatcatttctccg

SEQ ID NO: 7894021 - DNA, 22 bp, Homo sapiens
tcccagagatttcctctccttc

SEQ ID NO: 7894022 - DNA, 22 bp, Homo sapiens
tcccagagatttcctctccttc

SEQ ID NO: 7894023 - DNA, 22 bp, Homo sapiens
tcccagagatttcctctccttc

SEQ ID NO: 7894024 - DNA, 22 bp, Homo sapiens
tcccagagatttcctctccttc

SEQ ID NO: 7894025 - DNA, 22 bp, Homo sapiens
tcccagagatttcctctccttc

SEQ ID NO: 7894026 - DNA, 22 bp, Homo sapiens
tccattctttttacctctcaga

SEQ ID NO: 7894027 - DNA, 22 bp, Homo sapiens
tccattctttttacctctcaga

SEQ ID NO: 7894028 - DNA, 22 bp, Homo sapiens
tccattcttttgctgtcttcct

SEQ ID NO: 7894029 - DNA, 22 bp, Homo sapiens
tccattcttttgctgtcttcct

SEQ ID NO: 7894030 - DNA, 22 bp, Homo sapiens
tccattctacaaggtagcaggg

SEQ ID NO: 7894031 - DNA, 22 bp, Homo sapiens
tccattatacttctgattcaaa

SEQ ID NO: 7894032 - DNA, 22 bp, Homo sapiens
tccattcagaaatctggctaca

SEQ ID NO: 7894033 - DNA, 22 bp, Homo sapiens
tccattatacttctgattcaaa

SEQ ID NO: 7894034 - DNA, 22 bp, Homo sapiens
tccattatacttctgattcaaa

SEQ ID NO: 7894035 - DNA, 17 bp, Homo sapiens
tccattcctaaggccct

SEQ ID NO: 7894036 - DNA, 20 bp, Homo sapiens
tccattcagcattgtggaaa

SEQ ID NO: 7894037 - DNA, 22 bp, Homo sapiens
tccattcaggccagtgcaaagt

SEQ ID NO: 7894038 - DNA, 22 bp, Homo sapiens
tccattgtgattatatacaaaa

SEQ ID NO: 7894039 - DNA, 22 bp, Homo sapiens
tccatttactattctcatatcg

SEQ ID NO: 7894040 - DNA, 22 bp, Homo sapiens
tcccaaagctactcttctgact

SEQ ID NO: 7894041 - DNA, 22 bp, Homo sapiens
tcccaaagctactcttctgact

SEQ ID NO: 7894042 - DNA, 22 bp, Homo sapiens
tcccaaaggtccgagcgggaat

SEQ ID NO: 7894043 - DNA, 22 bp, Homo sapiens
tccatggagatggatgactgta

SEQ ID NO: 7894044 - DNA, 22 bp, Homo sapiens
tccatggagatggatgactgta

SEQ ID NO: 7894045 - DNA, 22 bp, Homo sapiens
tccatgggaagattttgagtgg

SEQ ID NO: 7894046 - DNA, 22 bp, Homo sapiens
tccatggggcccaggatgagag

SEQ ID NO: 7894047 - DNA, 22 bp, Homo sapiens
tccatggtaggtttcttaaaga

SEQ ID NO: 7894048 - DNA, 22 bp, Homo sapiens
tccatggtttcagtctggctgg

SEQ ID NO: 7894049 - DNA, 22 bp, Homo sapiens
tccatggtaggtttcttaaaga

SEQ ID NO: 7894050 - DNA, 22 bp, Homo sapiens
tccatgtgcttcctcaggggaa

SEQ ID NO: 7894051 - DNA, 22 bp, Homo sapiens
tccatgtggcaataggagacag

SEQ ID NO: 7894052 - DNA, 22 bp, Homo sapiens
tccatgtgacggtggcagtttt

SEQ ID NO: 7894053 - DNA, 22 bp, Homo sapiens
tccatgtgaccttgagctgctt

SEQ ID NO: 7894054 - DNA, 19 bp, Homo sapiens
tccattaagctcagagctc

SEQ ID NO: 7894055 - DNA, 19 bp, Homo sapiens
tccattaagctcagagctc

SEQ ID NO: 7894056 - DNA, 22 bp, Homo sapiens
tccattaatgattatttctgtg

SEQ ID NO: 7894057 - DNA, 22 bp, Homo sapiens
tccattatacttctgattcaaa

SEQ ID NO: 7894058 - DNA, 22 bp, Homo sapiens
tccattatacttctgattcaaa

SEQ ID NO: 7894059 - DNA, 22 bp, Homo sapiens
tccattatacttctgattcaaa

SEQ ID NO: 7894060 - DNA, 22 bp, Homo sapiens
tccatgtgttttcctgtccaca

SEQ ID NO: 7894061 - DNA, 22 bp, Homo sapiens
tccatgtggcaataggagacag

SEQ ID NO: 7894062 - DNA, 19 bp, Homo sapiens
tccatgtgtttcagacctg

SEQ ID NO: 7894063 - DNA, 22 bp, Homo sapiens
tccatgttgagaatgctataat

SEQ ID NO: 7894064 - DNA, 22 bp, Homo sapiens
tcccagccttccagtctggttt

SEQ ID NO: 7894065 - DNA, 22 bp, Homo sapiens
tcccagccttccagtctggttt

SEQ ID NO: 7894066 - DNA, 22 bp, Homo sapiens
tcccagccttccagtctggttt

SEQ ID NO: 7894067 - DNA, 22 bp, Homo sapiens
tcccagccttatctcccctggc

SEQ ID NO: 7894068 - DNA, 22 bp, Homo sapiens
tcccagccttatctcccctggc

SEQ ID NO: 7894069 - DNA, 22 bp, Homo sapiens
tcccagccttatctcccctggc

SEQ ID NO: 7894070 - DNA, 22 bp, Homo sapiens
tcccagccttatctcccctggc

SEQ ID NO: 7894071 - DNA, 22 bp, Homo sapiens
tcccagcctggaccctgccagt

SEQ ID NO: 7894072 - DNA, 22 bp, Homo sapiens
tcccagccttatctcccctggc

SEQ ID NO: 7894073 - DNA, 22 bp, Homo sapiens
tcccagccttatctcccctggc

SEQ ID NO: 7894074 - DNA, 22 bp, Homo sapiens
tcccagcctggaccctgccagt

SEQ ID NO: 7894075 - DNA, 22 bp, Homo sapiens
tcccagcctggaccctgccagt

SEQ ID NO: 7894076 - DNA, 22 bp, Homo sapiens
tcccagcctggaccctgccagt

SEQ ID NO: 7894077 - DNA, 22 bp, Homo sapiens
tcccagcctggaccctgccagt

SEQ ID NO: 7894078 - DNA, 22 bp, Homo sapiens
tcccagcctgacagtgcatcaa

SEQ ID NO: 7894079 - DNA, 22 bp, Homo sapiens
tcccagcctgacagtgcatcaa

SEQ ID NO: 7894080 - DNA, 22 bp, Homo sapiens
tcccagcctgacagtgcatcaa

SEQ ID NO: 7894081 - DNA, 22 bp, Homo sapiens
tcccagcctgacagtgcatcaa

SEQ ID NO: 7894082 - DNA, 22 bp, Homo sapiens
tcccagcctggaccctgccagt

SEQ ID NO: 7894083 - DNA, 22 bp, Homo sapiens
tcccagcctggaccctgccagt

SEQ ID NO: 7894084 - DNA, 16 bp, Homo sapiens
tcccaggccaggtgga

SEQ ID NO: 7894085 - DNA, 22 bp, Homo sapiens
tcccaggccataaaactcagag

SEQ ID NO: 7894086 - DNA, 22 bp, Homo sapiens
tcccaggccacacttggggaac

SEQ ID NO: 7894087 - DNA, 22 bp, Homo sapiens
tcccaggcaggtgacaggggga

SEQ ID NO: 7894088 - DNA, 22 bp, Homo sapiens
tcccaggccataaaactcagag

SEQ ID NO: 7894089 - DNA, 22 bp, Homo sapiens
tcccaggccataaaactcagag

SEQ ID NO: 7894090 - DNA, 22 bp, Homo sapiens
tcccaggcgcctggtggggagc

SEQ ID NO: 7894091 - DNA, 22 bp, Homo sapiens
tcccaggctaccagtgaggtca

SEQ ID NO: 7894092 - DNA, 22 bp, Homo sapiens
tcccaggcgcctggtggggagc

SEQ ID NO: 7894093 - DNA, 22 bp, Homo sapiens
tcccagcctttctttctccagc

SEQ ID NO: 7894094 - DNA, 22 bp, Homo sapiens
tcccagcctttctttctccagc

SEQ ID NO: 7894095 - DNA, 22 bp, Homo sapiens
tcccaggccacacttggggaac

SEQ ID NO: 7894096 - DNA, 22 bp, Homo sapiens
tcccaggcaggtgacaggggga

SEQ ID NO: 7894097 - DNA, 22 bp, Homo sapiens
tcccaggcaggtgacaggggga

SEQ ID NO: 7894098 - DNA, 22 bp, Homo sapiens
tcccagccttccttgtggtgaa

SEQ ID NO: 7894099 - DNA, 22 bp, Homo sapiens
tcccagccttccttgtggtgaa

SEQ ID NO: 7894100 - DNA, 22 bp, Homo sapiens
tcccagccttccttgtggtgaa

SEQ ID NO: 7894101 - DNA, 22 bp, Homo sapiens
tcccagccttccttgtggtgaa

SEQ ID NO: 7894102 - DNA, 22 bp, Homo sapiens
tcccagccggtgcctgggtccc

SEQ ID NO: 7894103 - DNA, 22 bp, Homo sapiens
tcccagccggtgcctgggtccc

SEQ ID NO: 7894104 - DNA, 22 bp, Homo sapiens
tcccagccggtgcctgggtccc

SEQ ID NO: 7894105 - DNA, 22 bp, Homo sapiens
tcccagccggtgcctgggtccc

SEQ ID NO: 7894106 - DNA, 22 bp, Homo sapiens
tcccagcccaggtatgatgata

SEQ ID NO: 7894107 - DNA, 22 bp, Homo sapiens
tcccagcccaggtatgatgata

SEQ ID NO: 7894108 - DNA, 22 bp, Homo sapiens
tcccagcattaatgcctgtcag

SEQ ID NO: 7894109 - DNA, 22 bp, Homo sapiens
tcccagccacaggtgtagccct

SEQ ID NO: 7894110 - DNA, 22 bp, Homo sapiens
tcccagcattaatgcctgtcag

SEQ ID NO: 7894111 - DNA, 22 bp, Homo sapiens
tcccagcattaatgcctgtcag

SEQ ID NO: 7894112 - DNA, 22 bp, Homo sapiens
tcccagcattaatgcctgtcag

SEQ ID NO: 7894113 - DNA, 22 bp, Homo sapiens
tcccagcataacaaactgcccg

SEQ ID NO: 7894114 - DNA, 22 bp, Homo sapiens
tcccagcattaatgcctgtcag

SEQ ID NO: 7894115 - DNA, 22 bp, Homo sapiens
tcccagcctcctgacagttttg

SEQ ID NO: 7894116 - DNA, 22 bp, Homo sapiens
tcccagccggtgcctgggtccc

SEQ ID NO: 7894117 - DNA, 22 bp, Homo sapiens
tcccagccggtgcctgggtccc

SEQ ID NO: 7894118 - DNA, 23 bp, Homo sapiens
tcccagcctcttctcttgcatac

SEQ ID NO: 7894119 - DNA, 22 bp, Homo sapiens
tcccagcctcctgacagttttg

SEQ ID NO: 7894120 - DNA, 22 bp, Homo sapiens
tcccagcctcctgacagttttg

SEQ ID NO: 7894121 - DNA, 22 bp, Homo sapiens
tcccagagtattagcaattgct

SEQ ID NO: 7894122 - DNA, 22 bp, Homo sapiens
tcccagagtattagcaattgct

SEQ ID NO: 7894123 - DNA, 22 bp, Homo sapiens
tcccagaggttgagtcacttat

SEQ ID NO: 7894124 - DNA, 22 bp, Homo sapiens
tcccagaggttgagtcacttat

SEQ ID NO: 7894125 - DNA, 22 bp, Homo sapiens
tcccagaggttgagtcacttat

SEQ ID NO: 7894126 - DNA, 22 bp, Homo sapiens
tcccagcataacaaactgcccg

SEQ ID NO: 7894127 - DNA, 22 bp, Homo sapiens
tcccagagtattagcaattgct

SEQ ID NO: 7894128 - DNA, 22 bp, Homo sapiens
tcccagagtattagcaattgct

SEQ ID NO: 7894129 - DNA, 22 bp, Homo sapiens
tcccagagtattagcaattgct

SEQ ID NO: 7894130 - DNA, 22 bp, Homo sapiens
tcccagaggttgagtcacttat

SEQ ID NO: 7894131 - DNA, 22 bp, Homo sapiens
tcccagaggttgagtcacttat

SEQ ID NO: 7894132 - DNA, 22 bp, Homo sapiens
tcccagaggttgagtcacttat

SEQ ID NO: 7894133 - DNA, 22 bp, Homo sapiens
tcccagaggtctctgctggttc

SEQ ID NO: 7894134 - DNA, 22 bp, Homo sapiens
tcccagaggtctctgctggttc

SEQ ID NO: 7894135 - DNA, 22 bp, Homo sapiens
tcccagaggtctctgctggttc

SEQ ID NO: 7894136 - DNA, 22 bp, Homo sapiens
tcccagaggtctctgctggttc

SEQ ID NO: 7894137 - DNA, 22 bp, Homo sapiens
tcccagaggtctctgctggttc

SEQ ID NO: 7894138 - DNA, 22 bp, Homo sapiens
tcccagaggtctctgctggttc

SEQ ID NO: 7894139 - DNA, 22 bp, Homo sapiens
tcccagaggctccagtctctat

SEQ ID NO: 7894140 - DNA, 22 bp, Homo sapiens
tcccagaggctccagtctctat

SEQ ID NO: 7894141 - DNA, 22 bp, Homo sapiens
tcccagaggctccagtctctat

SEQ ID NO: 7894142 - DNA, 22 bp, Homo sapiens
tcccagaggctccagtctctat

SEQ ID NO: 7894143 - DNA, 22 bp, Homo sapiens
tcccagaggctccagtctctat

SEQ ID NO: 7894144 - DNA, 22 bp, Homo sapiens
tcccagaggctccagtctctat

SEQ ID NO: 7894145 - DNA, 22 bp, Homo sapiens
tcccagaggctccagtctctat

SEQ ID NO: 7894146 - DNA, 22 bp, Homo sapiens
tcccagaggctccagtctctat

SEQ ID NO: 7894147 - DNA, 22 bp, Homo sapiens
tcccagaggctccagtctctat

SEQ ID NO: 7894148 - DNA, 22 bp, Homo sapiens
tcccagaggctccagtctctat

SEQ ID NO: 7894149 - DNA, 22 bp, Homo sapiens
tcccagagccaagctatggatg

SEQ ID NO: 7894150 - DNA, 22 bp, Homo sapiens
tcccagagccaagctatggatg

SEQ ID NO: 7894151 - DNA, 22 bp, Homo sapiens
tcccagagccaagctatggatg

SEQ ID NO: 7894152 - DNA, 22 bp, Homo sapiens
tcccagaggcagttggtaactt

SEQ ID NO: 7894153 - DNA, 22 bp, Homo sapiens
tcccagaggcagttggtaactt

SEQ ID NO: 7894154 - DNA, 22 bp, Homo sapiens
tcccagaggcagttggtaactt

SEQ ID NO: 7894155 - DNA, 22 bp, Homo sapiens
tcccagaggactgttggtgcta

SEQ ID NO: 7894156 - DNA, 22 bp, Homo sapiens
tccaggctgggctgaagggtgc

SEQ ID NO: 7894157 - DNA, 22 bp, Homo sapiens
tccaggctttttcatgctgtct

SEQ ID NO: 7894158 - DNA, 22 bp, Homo sapiens
tccaggctgggctgaagggtgc

SEQ ID NO: 7894159 - DNA, 23 bp, Homo sapiens
tccaggctgggacttcaactggc

SEQ ID NO: 7894160 - DNA, 23 bp, Homo sapiens
tccaggctgggacttcaactggc

SEQ ID NO: 7894161 - DNA, 23 bp, Homo sapiens
tccaggctgggacttcaactggc

SEQ ID NO: 7894162 - DNA, 22 bp, Homo sapiens
tccagggaagagcagaggctac

SEQ ID NO: 7894163 - DNA, 21 bp, Homo sapiens
tccagggaacttctcaggaat

SEQ ID NO: 7894164 - DNA, 22 bp, Homo sapiens
tccagggaagagcagaggctac

SEQ ID NO: 7894165 - DNA, 21 bp, Homo sapiens
tccagggaacttctcaggaat

SEQ ID NO: 7894166 - DNA, 21 bp, Homo sapiens
tccagggaacttctcaggaat

SEQ ID NO: 7894167 - DNA, 21 bp, Homo sapiens
tccagggaacttctcaggaat

SEQ ID NO: 7894168 - DNA, 21 bp, Homo sapiens
tccagggaacttctcaggaat

SEQ ID NO: 7894169 - DNA, 21 bp, Homo sapiens
tccagggaacttctcaggaat

SEQ ID NO: 7894170 - DNA, 21 bp, Homo sapiens
tccagggaacttctcaggaat

SEQ ID NO: 7894171 - DNA, 21 bp, Homo sapiens
tccagggaacttctcaggaat

SEQ ID NO: 7894172 - DNA, 22 bp, Homo sapiens
tccagggaaggtgtgaggctgg

SEQ ID NO: 7894173 - DNA, 22 bp, Homo sapiens
tccagggaaggtgtgaggctgg

SEQ ID NO: 7894174 - DNA, 22 bp, Homo sapiens
tccagggaagagcagaggctac

SEQ ID NO: 7894175 - DNA, 22 bp, Homo sapiens
tccagggaagagcagaggctac

SEQ ID NO: 7894176 - DNA, 22 bp, Homo sapiens
tccagggaagagcagaggctac

SEQ ID NO: 7894177 - DNA, 22 bp, Homo sapiens
tccagggaagagcagaggctac

SEQ ID NO: 7894178 - DNA, 22 bp, Homo sapiens
tccagggaagagcagaggctac

SEQ ID NO: 7894179 - DNA, 22 bp, Homo sapiens
tccagggaagagcagaggctac

SEQ ID NO: 7894180 - DNA, 22 bp, Homo sapiens
tccagggaaggtgtgaggctgg

SEQ ID NO: 7894181 - DNA, 22 bp, Homo sapiens
tccagggaaggtgtgaggctgg

SEQ ID NO: 7894182 - DNA, 22 bp, Homo sapiens
tccagggaaggtgtgaggctgg

SEQ ID NO: 7894183 - DNA, 22 bp, Homo sapiens
tccagggaaggtgtgaggctgg

SEQ ID NO: 7894184 - DNA, 22 bp, Homo sapiens
tccagggaaggtgtgaggctgg

SEQ ID NO: 7894185 - DNA, 21 bp, Homo sapiens
tccagggaatttcaactttta

SEQ ID NO: 7894186 - DNA, 22 bp, Homo sapiens
tccagggaaggtgtgaggctgg

SEQ ID NO: 7894187 - DNA, 22 bp, Homo sapiens
tccagggacacagagtccttct

SEQ ID NO: 7894188 - DNA, 22 bp, Homo sapiens
tccagggacacagagtccttct

SEQ ID NO: 7894189 - DNA, 22 bp, Homo sapiens
tccagggacacagagtccttct

SEQ ID NO: 7894190 - DNA, 22 bp, Homo sapiens
tccagggacacagagtccttct

SEQ ID NO: 7894191 - DNA, 22 bp, Homo sapiens
tccagggacagcgctggagcta

SEQ ID NO: 7894192 - DNA, 22 bp, Homo sapiens
tccagggacagcgctggagcta

SEQ ID NO: 7894193 - DNA, 22 bp, Homo sapiens
tccagggacagcgctggagcta

SEQ ID NO: 7894194 - DNA, 23 bp, Homo sapiens
tccagggctggccagacctcggt

SEQ ID NO: 7894195 - DNA, 22 bp, Homo sapiens
tccagggctgacttgggagagg

SEQ ID NO: 7894196 - DNA, 22 bp, Homo sapiens
tccagggctgacttgggagagg

SEQ ID NO: 7894197 - DNA, 22 bp, Homo sapiens
tccagggctgacttgggagagg

SEQ ID NO: 7894198 - DNA, 22 bp, Homo sapiens
tccagggctgacttgggagagg

SEQ ID NO: 7894199 - DNA, 22 bp, Homo sapiens
tccagggctgacttgggagagg

SEQ ID NO: 7894200 - DNA, 22 bp, Homo sapiens
tccagggctgacttgggagagg

SEQ ID NO: 7894201 - DNA, 22 bp, Homo sapiens
tccagggctgacttgggagagg

SEQ ID NO: 7894202 - DNA, 18 bp, Homo sapiens
tccagggcttcctcctct

SEQ ID NO: 7894203 - DNA, 18 bp, Homo sapiens
tccagggcttcctcctct

SEQ ID NO: 7894204 - DNA, 18 bp, Homo sapiens
tccagggcttcctcctct

SEQ ID NO: 7894205 - DNA, 22 bp, Homo sapiens
tccagggctgttactttacata

SEQ ID NO: 7894206 - DNA, 22 bp, Homo sapiens
tccagggctgggttggctcagc

SEQ ID NO: 7894207 - DNA, 22 bp, Homo sapiens
tccagggctgggttggctcagc

SEQ ID NO: 7894208 - DNA, 22 bp, Homo sapiens
tccagggctgggttggctcagc

SEQ ID NO: 7894209 - DNA, 23 bp, Homo sapiens
tccagggctggccagacctcggt

SEQ ID NO: 7894210 - DNA, 23 bp, Homo sapiens
tccagggctggccagacctcggt

SEQ ID NO: 7894211 - DNA, 23 bp, Homo sapiens
tccagggctggccagacctcggt

SEQ ID NO: 7894212 - DNA, 22 bp, Homo sapiens
tccagggctgggttggctcagc

SEQ ID NO: 7894213 - DNA, 22 bp, Homo sapiens
tccagggctgggttggctcagc

SEQ ID NO: 7894214 - DNA, 22 bp, Homo sapiens
tccagggctgggttggctcagc

SEQ ID NO: 7894215 - DNA, 22 bp, Homo sapiens
tccatgctcttgtctagcctcc

SEQ ID NO: 7894216 - DNA, 22 bp, Homo sapiens
tccatgctcttgtctagcctcc

SEQ ID NO: 7894217 - DNA, 19 bp, Homo sapiens
tccatgcccaggcaccaag

SEQ ID NO: 7894218 - DNA, 19 bp, Homo sapiens
tccatgcccaggcaccaag

SEQ ID NO: 7894219 - DNA, 22 bp, Homo sapiens
tccagtcacttcattttacaga

SEQ ID NO: 7894220 - DNA, 22 bp, Homo sapiens
tccagtcaagcttgagaatttc

SEQ ID NO: 7894221 - DNA, 21 bp, Homo sapiens
tccagtcaacttggcttggct

SEQ ID NO: 7894222 - DNA, 22 bp, Homo sapiens
tccagtcaacttaatctcttta

SEQ ID NO: 7894223 - DNA, 22 bp, Homo sapiens
tccagtcaacttaatctcttta

SEQ ID NO: 7894224 - DNA, 22 bp, Homo sapiens
tccagtactgaagctccttcaa

SEQ ID NO: 7894225 - DNA, 22 bp, Homo sapiens
tccagtacaggtctctcatttc

SEQ ID NO: 7894226 - DNA, 22 bp, Homo sapiens
tccagtatgactgatgtccttc

SEQ ID NO: 7894227 - DNA, 22 bp, Homo sapiens
tccagtatcaaagtcctagtcc

SEQ ID NO: 7894228 - DNA, 22 bp, Homo sapiens
tccagtatcaaagtcctagtcc

SEQ ID NO: 7894229 - DNA, 22 bp, Homo sapiens
tccaggtgggctgcacccaggc

SEQ ID NO: 7894230 - DNA, 22 bp, Homo sapiens
tccaggtgggctgcacccaggc

SEQ ID NO: 7894231 - DNA, 22 bp, Homo sapiens
tccaggtgtgctctgtgccctg

SEQ ID NO: 7894232 - DNA, 22 bp, Homo sapiens
tccaggtttcgctacaggagag

SEQ ID NO: 7894233 - DNA, 22 bp, Homo sapiens
tccaggtctggttggacaggtt

SEQ ID NO: 7894234 - DNA, 22 bp, Homo sapiens
tccaggtcttcctattccaggt

SEQ ID NO: 7894235 - DNA, 22 bp, Homo sapiens
tccaggtgacagagacaggata

SEQ ID NO: 7894236 - DNA, 22 bp, Homo sapiens
tccaggtgagtgcaggtgcaga

SEQ ID NO: 7894237 - DNA, 22 bp, Homo sapiens
tccaggtgagtgcaggtgcaga

SEQ ID NO: 7894238 - DNA, 22 bp, Homo sapiens
tccaggtgagtgcaggtgcaga

SEQ ID NO: 7894239 - DNA, 19 bp, Homo sapiens
tccaggtggagagacaccc

SEQ ID NO: 7894240 - DNA, 22 bp, Homo sapiens
tccaggtgccggggactgaggc

SEQ ID NO: 7894241 - DNA, 22 bp, Homo sapiens
tccaggtgccggggactgaggc

SEQ ID NO: 7894242 - DNA, 22 bp, Homo sapiens
tccaggtgggctgcacccaggc

SEQ ID NO: 7894243 - DNA, 19 bp, Homo sapiens
tccaggtggagagacaccc

SEQ ID NO: 7894244 - DNA, 22 bp, Homo sapiens
tccaggtgtatttactgaagta

SEQ ID NO: 7894245 - DNA, 19 bp, Homo sapiens
tccaggtggagagacaccc

SEQ ID NO: 7894246 - DNA, 22 bp, Homo sapiens
tccaggtctggttggacaggtt

SEQ ID NO: 7894247 - DNA, 22 bp, Homo sapiens
tccaggtctggcctgctaggca

SEQ ID NO: 7894248 - DNA, 22 bp, Homo sapiens
tccaggtcctactggcccatag

SEQ ID NO: 7894249 - DNA, 22 bp, Homo sapiens
tccaggtctaatttgtccttga

SEQ ID NO: 7894250 - DNA, 21 bp, Homo sapiens
tccagggctttgattctctca

SEQ ID NO: 7894251 - DNA, 21 bp, Homo sapiens
tccagggctttgattctctca

SEQ ID NO: 7894252 - DNA, 21 bp, Homo sapiens
tccagggctttgattctctca

SEQ ID NO: 7894253 - DNA, 19 bp, Homo sapiens
tccagggctttatggcttt

SEQ ID NO: 7894254 - DNA, 19 bp, Homo sapiens
tccagggctttatggcttt

SEQ ID NO: 7894255 - DNA, 19 bp, Homo sapiens
tccagggctttatggcttt

SEQ ID NO: 7894256 - DNA, 21 bp, Homo sapiens
tccagggctttgattctctca

SEQ ID NO: 7894257 - DNA, 19 bp, Homo sapiens
tccagggctttatggcttt

SEQ ID NO: 7894258 - DNA, 22 bp, Homo sapiens
tccagggcttggctgggacggt

SEQ ID NO: 7894259 - DNA, 22 bp, Homo sapiens
tccagggcttggctgggacggt

SEQ ID NO: 7894260 - DNA, 19 bp, Homo sapiens
tccagggctttatggcttt

SEQ ID NO: 7894261 - DNA, 18 bp, Homo sapiens
tccagggcttcctcctct

SEQ ID NO: 7894262 - DNA, 18 bp, Homo sapiens
tccagggcttcctcctct

SEQ ID NO: 7894263 - DNA, 18 bp, Homo sapiens
tccagggcttcctcctct

SEQ ID NO: 7894264 - DNA, 18 bp, Homo sapiens
tccagggcttcctcctct

SEQ ID NO: 7894265 - DNA, 22 bp, Homo sapiens
tccagggcttgacagggtgcct

SEQ ID NO: 7894266 - DNA, 22 bp, Homo sapiens
tccagggcttgacagggtgcct

SEQ ID NO: 7894267 - DNA, 22 bp, Homo sapiens
tccagggcttgacagggtgcct

SEQ ID NO: 7894268 - DNA, 22 bp, Homo sapiens
tccagggcttgacagggtgcct

SEQ ID NO: 7894269 - DNA, 22 bp, Homo sapiens
tccagggcttgacagggtgcct

SEQ ID NO: 7894270 - DNA, 22 bp, Homo sapiens
tccagggcttgacagggtgcct

SEQ ID NO: 7894271 - DNA, 22 bp, Homo sapiens
tccagggcttgacagggtgcct

SEQ ID NO: 7894272 - DNA, 22 bp, Homo sapiens
tccagggcttgacagggtgcct

SEQ ID NO: 7894273 - DNA, 22 bp, Homo sapiens
tccagggcttgacagggtgcct

SEQ ID NO: 7894274 - DNA, 22 bp, Homo sapiens
tccagggcttggctgggacggt

SEQ ID NO: 7894275 - DNA, 22 bp, Homo sapiens
tccagggcttggctgggacggt

SEQ ID NO: 7894276 - DNA, 22 bp, Homo sapiens
tccagggcttggctgggacggt

SEQ ID NO: 7894277 - DNA, 22 bp, Homo sapiens
tccagggcttggctgggacggt

SEQ ID NO: 7894278 - DNA, 22 bp, Homo sapiens
tccaggctggctcttcaaaatt

SEQ ID NO: 7894279 - DNA, 22 bp, Homo sapiens
tccaggctggcctcgcgtgaca

SEQ ID NO: 7894280 - DNA, 22 bp, Homo sapiens
tccaggctggcctcgcgtgaca

SEQ ID NO: 7894281 - DNA, 22 bp, Homo sapiens
tccaggctggcctcgcgtgaca

SEQ ID NO: 7894282 - DNA, 22 bp, Homo sapiens
tccaggctggcctcgcgtgaca

SEQ ID NO: 7894283 - DNA, 22 bp, Homo sapiens
tccaggctggctcttcaaaatt

SEQ ID NO: 7894284 - DNA, 22 bp, Homo sapiens
tccaggctggctcttcaaaatt

SEQ ID NO: 7894285 - DNA, 22 bp, Homo sapiens
tccaggctggctcttcaaaatt

SEQ ID NO: 7894286 - DNA, 18 bp, Homo sapiens
tccaggctggattgatga

SEQ ID NO: 7894287 - DNA, 22 bp, Homo sapiens
tccaggctggcctcgcgtgaca

SEQ ID NO: 7894288 - DNA, 22 bp, Homo sapiens
tccaggctggcctcgcgtgaca

SEQ ID NO: 7894289 - DNA, 18 bp, Homo sapiens
tccaggctggattgatga

SEQ ID NO: 7894290 - DNA, 22 bp, Homo sapiens
tccaggctggagtgcagtggcg

SEQ ID NO: 7894291 - DNA, 22 bp, Homo sapiens
tccaggctggacatgaggcggg

SEQ ID NO: 7894292 - DNA, 22 bp, Homo sapiens
tccaggctggacatgaggcggg

SEQ ID NO: 7894293 - DNA, 22 bp, Homo sapiens
tccaggctggacatgaggcggg

SEQ ID NO: 7894294 - DNA, 22 bp, Homo sapiens
tccaggctggacatgaggcggg

SEQ ID NO: 7894295 - DNA, 22 bp, Homo sapiens
tccaggctggagtgcagtggca

SEQ ID NO: 7894296 - DNA, 22 bp, Homo sapiens
tccaggctggagtgcagtggca

SEQ ID NO: 7894297 - DNA, 22 bp, Homo sapiens
tccaggctggagtgcagtggca

SEQ ID NO: 7894298 - DNA, 22 bp, Homo sapiens
tccaggctggagtgcagtggca

SEQ ID NO: 7894299 - DNA, 22 bp, Homo sapiens
tccaggctggagtgcagtggcg

SEQ ID NO: 7894300 - DNA, 22 bp, Homo sapiens
tccaggctggagtgcagtggcg

SEQ ID NO: 7894301 - DNA, 22 bp, Homo sapiens
tccaggctggagtgcagtggcg

SEQ ID NO: 7894302 - DNA, 22 bp, Homo sapiens
tccaggctggagtgcagtggcg

SEQ ID NO: 7894303 - DNA, 22 bp, Homo sapiens
tccaggctggagtgcagtggcg

SEQ ID NO: 7894304 - DNA, 22 bp, Homo sapiens
tccaggctggagtgcagtggca

SEQ ID NO: 7894305 - DNA, 22 bp, Homo sapiens
tccaggctggagtgcagtggca

SEQ ID NO: 7894306 - DNA, 22 bp, Homo sapiens
tccaggctaggtttacaggaca

SEQ ID NO: 7894307 - DNA, 22 bp, Homo sapiens
tccaggctagcctggtagagaa

SEQ ID NO: 7894308 - DNA, 22 bp, Homo sapiens
tccaggctagcctggtagagaa

SEQ ID NO: 7894309 - DNA, 22 bp, Homo sapiens
tccaggctagcctggtagagaa

SEQ ID NO: 7894310 - DNA, 22 bp, Homo sapiens
tccaggctagcctggtagagaa

SEQ ID NO: 7894311 - DNA, 22 bp, Homo sapiens
tccaggctagcctggtagagaa

SEQ ID NO: 7894312 - DNA, 22 bp, Homo sapiens
tccaggctagagtgcagtggcc

SEQ ID NO: 7894313 - DNA, 21 bp, Homo sapiens
tccaggctggaaggggcgttg

SEQ ID NO: 7894314 - DNA, 21 bp, Homo sapiens
tccaggctggaaggggcgttg

SEQ ID NO: 7894315 - DNA, 22 bp, Homo sapiens
tccaggctggacatgaggcggg

SEQ ID NO: 7894316 - DNA, 21 bp, Homo sapiens
tccaggctggaaggggcgttg

SEQ ID NO: 7894317 - DNA, 21 bp, Homo sapiens
tccaggctggaaggggcgttg

SEQ ID NO: 7894318 - DNA, 22 bp, Homo sapiens
tccaggctaggtttacaggaca

SEQ ID NO: 7894319 - DNA, 22 bp, Homo sapiens
tccaggctagaagtcacaggcc

SEQ ID NO: 7894320 - DNA, 22 bp, Homo sapiens
tccaggctagaagtcacaggcc

SEQ ID NO: 7894321 - DNA, 22 bp, Homo sapiens
tccaggctagaagtcacaggcc

SEQ ID NO: 7894322 - DNA, 22 bp, Homo sapiens
tccaggctagaagtcacaggcc

SEQ ID NO: 7894323 - DNA, 22 bp, Homo sapiens
tccaggctagaagtcacaggcc

SEQ ID NO: 7894324 - DNA, 22 bp, Homo sapiens
tccaggctacttggattcctgg

SEQ ID NO: 7894325 - DNA, 22 bp, Homo sapiens
tccaggctacttggattcctgg

SEQ ID NO: 7894326 - DNA, 22 bp, Homo sapiens
tccaggctagaagtcacaggcc

SEQ ID NO: 7894327 - DNA, 22 bp, Homo sapiens
tccaggctagaagtcacaggcc

SEQ ID NO: 7894328 - DNA, 22 bp, Homo sapiens
tccaggctagagtgcagtggcc

SEQ ID NO: 7894329 - DNA, 22 bp, Homo sapiens
tccaggctagagtgcagtggcc

SEQ ID NO: 7894330 - DNA, 22 bp, Homo sapiens
tccaggctagagtgcagtggcc

SEQ ID NO: 7894331 - DNA, 22 bp, Homo sapiens
tccaggctagagtgcagtggcc

SEQ ID NO: 7894332 - DNA, 22 bp, Homo sapiens
tccaggctagagtgcagtggcc

SEQ ID NO: 7894333 - DNA, 22 bp, Homo sapiens
tccaggctagaagtcacaggcc

SEQ ID NO: 7894334 - DNA, 22 bp, Homo sapiens
tccaggctagaagtcacaggcc

SEQ ID NO: 7894335 - DNA, 20 bp, Homo sapiens
tccaggccttgttctcagat

SEQ ID NO: 7894336 - DNA, 20 bp, Homo sapiens
tccaggccttgttctcagat

SEQ ID NO: 7894337 - DNA, 20 bp, Homo sapiens
tccaggccttgttctcagat

SEQ ID NO: 7894338 - DNA, 20 bp, Homo sapiens
tccaggccttgttctcagat

SEQ ID NO: 7894339 - DNA, 20 bp, Homo sapiens
tccaggccttgttctcagat

SEQ ID NO: 7894340 - DNA, 22 bp, Homo sapiens
tccaggccttgacaggtcagtt

SEQ ID NO: 7894341 - DNA, 22 bp, Homo sapiens
tccaggccttgacaggtcagtt

SEQ ID NO: 7894342 - DNA, 22 bp, Homo sapiens
tccaggccttgacaggtcagtt

SEQ ID NO: 7894343 - DNA, 22 bp, Homo sapiens
tccaggcctggctccattcagt

SEQ ID NO: 7894344 - DNA, 22 bp, Homo sapiens
tccaggcctggctccattcagt

SEQ ID NO: 7894345 - DNA, 22 bp, Homo sapiens
tccaggccttgacaggtcagtt

SEQ ID NO: 7894346 - DNA, 22 bp, Homo sapiens
tccaggcctggctccattcagt

SEQ ID NO: 7894347 - DNA, 22 bp, Homo sapiens
tccaggcctggctccattcagt

SEQ ID NO: 7894348 - DNA, 22 bp, Homo sapiens
tccaggcctgcctggtgtttgc

SEQ ID NO: 7894349 - DNA, 22 bp, Homo sapiens
tccaggctaattttgcattgtt

SEQ ID NO: 7894350 - DNA, 22 bp, Homo sapiens
tccaggctacttggattcctgg

SEQ ID NO: 7894351 - DNA, 22 bp, Homo sapiens
tccaggctacttggattcctgg

SEQ ID NO: 7894352 - DNA, 22 bp, Homo sapiens
tccaggctaattttgcattgtt

SEQ ID NO: 7894353 - DNA, 22 bp, Homo sapiens
tccaggctaattttgcattgtt

SEQ ID NO: 7894354 - DNA, 22 bp, Homo sapiens
tccaggctaattttgcattgtt

SEQ ID NO: 7894355 - DNA, 22 bp, Homo sapiens
tccaggctaattttgcattgtt

SEQ ID NO: 7894356 - DNA, 22 bp, Homo sapiens
tccaggcctttgcacatgttgt

SEQ ID NO: 7894357 - DNA, 22 bp, Homo sapiens
tccaggcctttgcacatgttgt

SEQ ID NO: 7894358 - DNA, 20 bp, Homo sapiens
tccaggccttgttctcagat

SEQ ID NO: 7894359 - DNA, 22 bp, Homo sapiens
tccaggcctttgcacatgttgt

SEQ ID NO: 7894360 - DNA, 20 bp, Homo sapiens
tccaggccttgttctcagat

SEQ ID NO: 7894361 - DNA, 22 bp, Homo sapiens
tccacaaggcagctcctccagg

SEQ ID NO: 7894362 - DNA, 22 bp, Homo sapiens
tccacaaggcagctcctccagg

SEQ ID NO: 7894363 - DNA, 22 bp, Homo sapiens
tccacaaggcagctcctccagg

SEQ ID NO: 7894364 - DNA, 21 bp, Homo sapiens
tccaatttttaagactatggc

SEQ ID NO: 7894365 - DNA, 22 bp, Homo sapiens
tccaggcctctagccctctctt

SEQ ID NO: 7894366 - DNA, 22 bp, Homo sapiens
tccaggcctctagccctctctt

SEQ ID NO: 7894367 - DNA, 22 bp, Homo sapiens
tccaggcctctagccctctctt

SEQ ID NO: 7894368 - DNA, 22 bp, Homo sapiens
tccaggcctctagcccctatct

SEQ ID NO: 7894369 - DNA, 22 bp, Homo sapiens
tccaggcctctagcccctatct

SEQ ID NO: 7894370 - DNA, 22 bp, Homo sapiens
tccaggcctctagcccctatct

SEQ ID NO: 7894371 - DNA, 22 bp, Homo sapiens
tccaggcctgactataaatgta

SEQ ID NO: 7894372 - DNA, 22 bp, Homo sapiens
tccaggcctgcaatgacaaagc

SEQ ID NO: 7894373 - DNA, 22 bp, Homo sapiens
tccaggcctgcaatgacaaagc

SEQ ID NO: 7894374 - DNA, 18 bp, Homo sapiens
tccaggcctgaagtgtcc

SEQ ID NO: 7894375 - DNA, 22 bp, Homo sapiens
tccaggcctctagccctctctt

SEQ ID NO: 7894376 - DNA, 18 bp, Homo sapiens
tccaggcctgaagtgtcc

SEQ ID NO: 7894377 - DNA, 18 bp, Homo sapiens
tccaggcctgaagtgtcc

SEQ ID NO: 7894378 - DNA, 22 bp, Homo sapiens
tccaggcctgactataaatgta

SEQ ID NO: 7894379 - DNA, 19 bp, Homo sapiens
tcctcaggggctcacagac

SEQ ID NO: 7894380 - DNA, 19 bp, Homo sapiens
tcctcaggggctcacagac

SEQ ID NO: 7894381 - DNA, 22 bp, Homo sapiens
tcctcagggcggcctccgtctt

SEQ ID NO: 7894382 - DNA, 22 bp, Homo sapiens
tcctcagggcggcctccgtctt

SEQ ID NO: 7894383 - DNA, 22 bp, Homo sapiens
tcctcagcattagcacagacat

SEQ ID NO: 7894384 - DNA, 21 bp, Homo sapiens
tcctcagggccccagagcact

SEQ ID NO: 7894385 - DNA, 21 bp, Homo sapiens
tcctcagggccccagagcact

SEQ ID NO: 7894386 - DNA, 22 bp, Homo sapiens
tcctcagggggccaacccagcc

SEQ ID NO: 7894387 - DNA, 19 bp, Homo sapiens
tcctcaggggctcacagac

SEQ ID NO: 7894388 - DNA, 19 bp, Homo sapiens
tcctcaggggctcacagac

SEQ ID NO: 7894389 - DNA, 22 bp, Homo sapiens
tcctcaggggtttcaggtgtac

SEQ ID NO: 7894390 - DNA, 22 bp, Homo sapiens
tcctcaggggtttcaggtgtac

SEQ ID NO: 7894391 - DNA, 22 bp, Homo sapiens
tcctcaggtcaaagcaggagaa

SEQ ID NO: 7894392 - DNA, 22 bp, Homo sapiens
tcctcaggtcaaagcaggagaa

SEQ ID NO: 7894393 - DNA, 22 bp, Homo sapiens
tcctcaggtcaaagcaggagaa

SEQ ID NO: 7894394 - DNA, 22 bp, Homo sapiens
tcctcaggtcaaagcaggagaa

SEQ ID NO: 7894395 - DNA, 22 bp, Homo sapiens
tcctcaggtcaaagcaggagaa

SEQ ID NO: 7894396 - DNA, 22 bp, Homo sapiens
tcctcaggggtttcaggtgtac

SEQ ID NO: 7894397 - DNA, 22 bp, Homo sapiens
tcctcagatacctggcagatca

SEQ ID NO: 7894398 - DNA, 22 bp, Homo sapiens
tcctcagagcagccctccgcat

SEQ ID NO: 7894399 - DNA, 22 bp, Homo sapiens
tcctcagatacctggcagatca

SEQ ID NO: 7894400 - DNA, 22 bp, Homo sapiens
tcctcagatataaatgagggtg

SEQ ID NO: 7894401 - DNA, 22 bp, Homo sapiens
tcctcagatacctggcagatca

SEQ ID NO: 7894402 - DNA, 22 bp, Homo sapiens
tcctcagacttccctttgtgta

SEQ ID NO: 7894403 - DNA, 22 bp, Homo sapiens
tcctcagagatgggcatctaag

SEQ ID NO: 7894404 - DNA, 22 bp, Homo sapiens
tcctcagacaccctgctggctt

SEQ ID NO: 7894405 - DNA, 22 bp, Homo sapiens
tcctcagcatggaatctggact

SEQ ID NO: 7894406 - DNA, 22 bp, Homo sapiens
tcctcagcatggaatctggact

SEQ ID NO: 7894407 - DNA, 23 bp, Homo sapiens
tcctcagcatgttttgtcatgta

SEQ ID NO: 7894408 - DNA, 23 bp, Homo sapiens
tcctcagcatgttttgtcatgta

SEQ ID NO: 7894409 - DNA, 22 bp, Homo sapiens
tcctcagcattagcacagacat

SEQ ID NO: 7894410 - DNA, 23 bp, Homo sapiens
tcctcagcatgttttgtcatgta

SEQ ID NO: 7894411 - DNA, 22 bp, Homo sapiens
tcctcagcaaacacttcactct

SEQ ID NO: 7894412 - DNA, 22 bp, Homo sapiens
tcctcagcaggtctgtgtacca

SEQ ID NO: 7894413 - DNA, 22 bp, Homo sapiens
tcctcagcaggtctgtgtacca

SEQ ID NO: 7894414 - DNA, 22 bp, Homo sapiens
tcctagtgcaaattggagcatg

SEQ ID NO: 7894415 - DNA, 22 bp, Homo sapiens
tcctagtacacactattatttg

SEQ ID NO: 7894416 - DNA, 22 bp, Homo sapiens
tcctatgttttcccctagagaa

SEQ ID NO: 7894417 - DNA, 22 bp, Homo sapiens
tcctattagaatgattaaattc

SEQ ID NO: 7894418 - DNA, 22 bp, Homo sapiens
tcctcaaaggatacccaggctt

SEQ ID NO: 7894419 - DNA, 22 bp, Homo sapiens
tcctagttctctgccagtcgct

SEQ ID NO: 7894420 - DNA, 22 bp, Homo sapiens
tcctcacaagcaagcacaggta

SEQ ID NO: 7894421 - DNA, 22 bp, Homo sapiens
tcctcaaattagcagatcatag

SEQ ID NO: 7894422 - DNA, 22 bp, Homo sapiens
tcctcaaatatttacttactga

SEQ ID NO: 7894423 - DNA, 22 bp, Homo sapiens
tcctcaaagttgtataaatatt

SEQ ID NO: 7894424 - DNA, 22 bp, Homo sapiens
tcctcaaagttgtataaatatt

SEQ ID NO: 7894425 - DNA, 22 bp, Homo sapiens
tcctcacactatagatgaggat

SEQ ID NO: 7894426 - DNA, 22 bp, Homo sapiens
tcctcacagatgggtgcatagc

SEQ ID NO: 7894427 - DNA, 22 bp, Homo sapiens
tcctcacagagtggcaggcaat

SEQ ID NO: 7894428 - DNA, 22 bp, Homo sapiens
tcctcacagctggttcattcag

SEQ ID NO: 7894429 - DNA, 22 bp, Homo sapiens
tcctcacagcatgaccaggcag

SEQ ID NO: 7894430 - DNA, 22 bp, Homo sapiens
tcctcagaatcacctggcagct

SEQ ID NO: 7894431 - DNA, 22 bp, Homo sapiens
tcctcagaatggatggcagggg

SEQ ID NO: 7894432 - DNA, 22 bp, Homo sapiens
tcctcagaatcacctggcagct

SEQ ID NO: 7894433 - DNA, 22 bp, Homo sapiens
tcctcagaatcacctggcagct

SEQ ID NO: 7894434 - DNA, 22 bp, Homo sapiens
tcctcagaatcacctggcagct

SEQ ID NO: 7894435 - DNA, 22 bp, Homo sapiens
tcctcagaagaacccctagatt

SEQ ID NO: 7894436 - DNA, 22 bp, Homo sapiens
tcctcagaaacccctgtgaggt

SEQ ID NO: 7894437 - DNA, 22 bp, Homo sapiens
tcctcagaatcacctggcagct

SEQ ID NO: 7894438 - DNA, 22 bp, Homo sapiens
tcctcacatggtgagccacaca

SEQ ID NO: 7894439 - DNA, 22 bp, Homo sapiens
tcctcacagtcaacactttgag

SEQ ID NO: 7894440 - DNA, 22 bp, Homo sapiens
tcctcacagggcaggaaggagg

SEQ ID NO: 7894441 - DNA, 22 bp, Homo sapiens
tcctcacagggcaggaaggagg

SEQ ID NO: 7894442 - DNA, 22 bp, Homo sapiens
tcctcacatggtgagccacaca

SEQ ID NO: 7894443 - DNA, 22 bp, Homo sapiens
tcctcactgcagtgctccgagc

SEQ ID NO: 7894444 - DNA, 22 bp, Homo sapiens
tcctcactgcagtgctccgagc

SEQ ID NO: 7894445 - DNA, 22 bp, Homo sapiens
tcctcagaaacccctgtgaggt

SEQ ID NO: 7894446 - DNA, 22 bp, Homo sapiens
tcctcactttgtagccatcctt

SEQ ID NO: 7894447 - DNA, 22 bp, Homo sapiens
tcctcactttgtagccatcctt

SEQ ID NO: 7894448 - DNA, 22 bp, Homo sapiens
tcctagaatatttgtggaggtt

SEQ ID NO: 7894449 - DNA, 22 bp, Homo sapiens
tcctagaatctttgtaagattg

SEQ ID NO: 7894450 - DNA, 22 bp, Homo sapiens
tcctagaatagtgtgtctggag

SEQ ID NO: 7894451 - DNA, 22 bp, Homo sapiens
tcctagaatagtgtgtctggag

SEQ ID NO: 7894452 - DNA, 22 bp, Homo sapiens
tcctagaataagtaacaggaca

SEQ ID NO: 7894453 - DNA, 22 bp, Homo sapiens
tcctagaaggatcattctagtg

SEQ ID NO: 7894454 - DNA, 22 bp, Homo sapiens
tcctaacgtataatttcaggtt

SEQ ID NO: 7894455 - DNA, 22 bp, Homo sapiens
tcctagaataatctttgactgc

SEQ ID NO: 7894456 - DNA, 22 bp, Homo sapiens
tcctagaataatctttgactgc

SEQ ID NO: 7894457 - DNA, 22 bp, Homo sapiens
tcctagaataatctttgactgc

SEQ ID NO: 7894458 - DNA, 22 bp, Homo sapiens
tcctagagagtaatacagtttt

SEQ ID NO: 7894459 - DNA, 22 bp, Homo sapiens
tcctagagcctccagagggaga

SEQ ID NO: 7894460 - DNA, 22 bp, Homo sapiens
tcctagaatgcacctctgctgt

SEQ ID NO: 7894461 - DNA, 22 bp, Homo sapiens
tcctagaatgcacctctgctgt

SEQ ID NO: 7894462 - DNA, 22 bp, Homo sapiens
tcctagaatctttgtaagattg

SEQ ID NO: 7894463 - DNA, 19 bp, Homo sapiens
tcctagaatgagggtgttg

SEQ ID NO: 7894464 - DNA, 19 bp, Homo sapiens
tcctagaatgagggtgttg

SEQ ID NO: 7894465 - DNA, 22 bp, Homo sapiens
tcctaggctccagaactgtgaa

SEQ ID NO: 7894466 - DNA, 22 bp, Homo sapiens
tcctagggatgccatcgtgtaa

SEQ ID NO: 7894467 - DNA, 22 bp, Homo sapiens
tcctaggctccagaactgtgaa

SEQ ID NO: 7894468 - DNA, 22 bp, Homo sapiens
tcctagggtaatcagcatacat

SEQ ID NO: 7894469 - DNA, 22 bp, Homo sapiens
tcctagggttggagacagtgac

SEQ ID NO: 7894470 - DNA, 22 bp, Homo sapiens
tcctagaggatggtaggaagct

SEQ ID NO: 7894471 - DNA, 20 bp, Homo sapiens
tcctagcttctctctgtaca

SEQ ID NO: 7894472 - DNA, 22 bp, Homo sapiens
tcctagcttgtcagttctctaa

SEQ ID NO: 7894473 - DNA, 22 bp, Homo sapiens
tcctaggatctggggtgttttt

SEQ ID NO: 7894474 - DNA, 22 bp, Homo sapiens
tccctgggagatgatgatgagg

SEQ ID NO: 7894475 - DNA, 16 bp, Homo sapiens
tccctgggagtggtgg

SEQ ID NO: 7894476 - DNA, 22 bp, Homo sapiens
tccctgggactcagacatggaa

SEQ ID NO: 7894477 - DNA, 22 bp, Homo sapiens
tccctgggactcagacatggaa

SEQ ID NO: 7894478 - DNA, 22 bp, Homo sapiens
tccctgggacggccttttggag

SEQ ID NO: 7894479 - DNA, 22 bp, Homo sapiens
tccctgggcaagtttactcttc

SEQ ID NO: 7894480 - DNA, 22 bp, Homo sapiens
tccgtgcccctggcactaggtc

SEQ ID NO: 7894481 - DNA, 22 bp, Homo sapiens
tccgtaaagtcttacaatgtct

SEQ ID NO: 7894482 - DNA, 22 bp, Homo sapiens
tccgtgttccaagacagggtgg

SEQ ID NO: 7894483 - DNA, 22 bp, Homo sapiens
tcctaaaggctgcttttatatt

SEQ ID NO: 7894484 - DNA, 22 bp, Homo sapiens
tcctaaatacatatcaaagatc

SEQ ID NO: 7894485 - DNA, 20 bp, Homo sapiens
tcctaacgaggcccattgca

SEQ ID NO: 7894486 - DNA, 22 bp, Homo sapiens
tcctaacgctggttctatcaac

SEQ ID NO: 7894487 - DNA, 22 bp, Homo sapiens
tccctggcacaagaaggctgtc

SEQ ID NO: 7894488 - DNA, 22 bp, Homo sapiens
tccctggaggtgtttgctcagg

SEQ ID NO: 7894489 - DNA, 22 bp, Homo sapiens
tccctggaggtgtttgctcagg

SEQ ID NO: 7894490 - DNA, 20 bp, Homo sapiens
tccctggaggtggtggcatc

SEQ ID NO: 7894491 - DNA, 20 bp, Homo sapiens
tccctggaggtggtggcatc

SEQ ID NO: 7894492 - DNA, 20 bp, Homo sapiens
tccctggaggtggtggcatc

SEQ ID NO: 7894493 - DNA, 23 bp, Homo sapiens
tccctggaggcaggtccagggcc

SEQ ID NO: 7894494 - DNA, 22 bp, Homo sapiens
tccctggcacaagaaggctgtc

SEQ ID NO: 7894495 - DNA, 22 bp, Homo sapiens
tccctggcagctaagggtggtc

SEQ ID NO: 7894496 - DNA, 22 bp, Homo sapiens
tccctgcctctcagacttcctt

SEQ ID NO: 7894497 - DNA, 22 bp, Homo sapiens
tccctggaacagagagacaacg

SEQ ID NO: 7894498 - DNA, 22 bp, Homo sapiens
tccctggacaacagacttcact

SEQ ID NO: 7894499 - DNA, 22 bp, Homo sapiens
tccctggacaacagacttcact

SEQ ID NO: 7894500 - DNA, 22 bp, Homo sapiens
tccctggagataacttctggga

SEQ ID NO: 7894501 - DNA, 22 bp, Homo sapiens
tccctggagataacttctggga

SEQ ID NO: 7894502 - DNA, 23 bp, Homo sapiens
tccctggaggcaggtccagggcc

SEQ ID NO: 7894503 - DNA, 23 bp, Homo sapiens
tccctggaggcaggtccagggcc

SEQ ID NO: 7894504 - DNA, 22 bp, Homo sapiens
tccctggacagccttgcctggg

SEQ ID NO: 7894505 - DNA, 22 bp, Homo sapiens
tccctggacaacagacttcact

SEQ ID NO: 7894506 - DNA, 23 bp, Homo sapiens
tccctggccgcaatggccgcctt

SEQ ID NO: 7894507 - DNA, 22 bp, Homo sapiens
tccctggcctggaaggatatca

SEQ ID NO: 7894508 - DNA, 22 bp, Homo sapiens
tccctggccattcctctaggcc

SEQ ID NO: 7894509 - DNA, 22 bp, Homo sapiens
tccctggccattcctctaggcc

SEQ ID NO: 7894510 - DNA, 22 bp, Homo sapiens
tccctggccattcctctaggcc

SEQ ID NO: 7894511 - DNA, 22 bp, Homo sapiens
tccctggctgggggctgccttg

SEQ ID NO: 7894512 - DNA, 22 bp, Homo sapiens
tccctggctgggggctgccttg

SEQ ID NO: 7894513 - DNA, 22 bp, Homo sapiens
tccctggctggtgtagagggat

SEQ ID NO: 7894514 - DNA, 22 bp, Homo sapiens
tccctgggaacaaaggatgaga

SEQ ID NO: 7894515 - DNA, 22 bp, Homo sapiens
tccctggctgtgttcaggtgcg

SEQ ID NO: 7894516 - DNA, 22 bp, Homo sapiens
tccctggctgtgttcaggtgcg

SEQ ID NO: 7894517 - DNA, 22 bp, Homo sapiens
tccctggctgtgttcaggtgcg

SEQ ID NO: 7894518 - DNA, 22 bp, Homo sapiens
tccctgggaccggcagctcaca

SEQ ID NO: 7894519 - DNA, 22 bp, Homo sapiens
tccctgggaccggcagctcaca

SEQ ID NO: 7894520 - DNA, 22 bp, Homo sapiens
tccctgggaacaaaggatgaga

SEQ ID NO: 7894521 - DNA, 23 bp, Homo sapiens
tcccagggaaggtgagcgaggct

SEQ ID NO: 7894522 - DNA, 22 bp, Homo sapiens
tcccagggacaccaagctgttt

SEQ ID NO: 7894523 - DNA, 22 bp, Homo sapiens
tcccagggacaccaagctgttt

SEQ ID NO: 7894524 - DNA, 22 bp, Homo sapiens
tcccaggctgggggcctgaagt

SEQ ID NO: 7894525 - DNA, 22 bp, Homo sapiens
tcccaggctgggggcctgaagt

SEQ ID NO: 7894526 - DNA, 23 bp, Homo sapiens
tcccagggaaggtgagcgaggct

SEQ ID NO: 7894527 - DNA, 22 bp, Homo sapiens
tcccaggctgggggcctgaagt

SEQ ID NO: 7894528 - DNA, 23 bp, Homo sapiens
tcccagggaaggtgagcgaggct

SEQ ID NO: 7894529 - DNA, 23 bp, Homo sapiens
tcccagggaaggtgagcgaggct

SEQ ID NO: 7894530 - DNA, 20 bp, Homo sapiens
tcccaggctgggctccagct

SEQ ID NO: 7894531 - DNA, 20 bp, Homo sapiens
tcccaggctgggctccagct

SEQ ID NO: 7894532 - DNA, 20 bp, Homo sapiens
tcccaggctgggctccagct

SEQ ID NO: 7894533 - DNA, 20 bp, Homo sapiens
tcccaggctgggctccagct

SEQ ID NO: 7894534 - DNA, 22 bp, Homo sapiens
tcccaggctggggccaggtgac

SEQ ID NO: 7894535 - DNA, 22 bp, Homo sapiens
tcccaggctggggccaggtgac

SEQ ID NO: 7894536 - DNA, 22 bp, Homo sapiens
tcccaggctggggccaggtgac

SEQ ID NO: 7894537 - DNA, 22 bp, Homo sapiens
tcccaggctggggccaggtgac

SEQ ID NO: 7894538 - DNA, 20 bp, Homo sapiens
tcccaggctccaccctagac

SEQ ID NO: 7894539 - DNA, 20 bp, Homo sapiens
tcccaggctccaccctagac

SEQ ID NO: 7894540 - DNA, 22 bp, Homo sapiens
tcccaggctaggcctctgcgtt

SEQ ID NO: 7894541 - DNA, 22 bp, Homo sapiens
tcccaggctaggcctctgcgtt

SEQ ID NO: 7894542 - DNA, 22 bp, Homo sapiens
tcccaggctaggcctctgcgtt

SEQ ID NO: 7894543 - DNA, 20 bp, Homo sapiens
tcccaggctccaccctagac

SEQ ID NO: 7894544 - DNA, 22 bp, Homo sapiens
tcccaggctaggcctctgcgtt

SEQ ID NO: 7894545 - DNA, 22 bp, Homo sapiens
tcccaggctaggcctctgcgtt

SEQ ID NO: 7894546 - DNA, 22 bp, Homo sapiens
tcccaggctaggcctctgcgtt

SEQ ID NO: 7894547 - DNA, 22 bp, Homo sapiens
tcccaggctaccagtgaggtca

SEQ ID NO: 7894548 - DNA, 22 bp, Homo sapiens
tcccaggctaccagtgaggtca

SEQ ID NO: 7894549 - DNA, 22 bp, Homo sapiens
tcccaggctaccagtgaggtca

SEQ ID NO: 7894550 - DNA, 22 bp, Homo sapiens
tcccaggctggcaggcagcagt

SEQ ID NO: 7894551 - DNA, 22 bp, Homo sapiens
tcccaggctggcaggcagcagt

SEQ ID NO: 7894552 - DNA, 22 bp, Homo sapiens
tcccaggctggcaggcagcagt

SEQ ID NO: 7894553 - DNA, 22 bp, Homo sapiens
tcccaggctggcaggcagcagt

SEQ ID NO: 7894554 - DNA, 20 bp, Homo sapiens
tcccaggctgggctccagct

SEQ ID NO: 7894555 - DNA, 22 bp, Homo sapiens
tcccaggctcttcaaggaagac

SEQ ID NO: 7894556 - DNA, 22 bp, Homo sapiens
tcccaggctggcaggcagcagt

SEQ ID NO: 7894557 - DNA, 20 bp, Homo sapiens
tcccaggctccaccctagac

SEQ ID NO: 7894558 - DNA, 22 bp, Homo sapiens
tcccaggctcttcaaggaagac

SEQ ID NO: 7894559 - DNA, 20 bp, Homo sapiens
tcccaggctccaccctagac

SEQ ID NO: 7894560 - DNA, 22 bp, Homo sapiens
tcccagggacccagcctgatac

SEQ ID NO: 7894561 - DNA, 22 bp, Homo sapiens
tcccagggacccagcctgatac

SEQ ID NO: 7894562 - DNA, 22 bp, Homo sapiens
tcccagggactctctgccttcc

SEQ ID NO: 7894563 - DNA, 22 bp, Homo sapiens
tcccagggacccagcctgatac

SEQ ID NO: 7894564 - DNA, 22 bp, Homo sapiens
tcccagggacaccaagctgttt

SEQ ID NO: 7894565 - DNA, 22 bp, Homo sapiens
tcccagggacccagcctgatac

SEQ ID NO: 7894566 - DNA, 18 bp, Homo sapiens
tccccttccaggaagtca

SEQ ID NO: 7894567 - DNA, 22 bp, Homo sapiens
tcccctggcacctagtcctact

SEQ ID NO: 7894568 - DNA, 22 bp, Homo sapiens
tcccagggactggatgatgcag

SEQ ID NO: 7894569 - DNA, 22 bp, Homo sapiens
tcccagggactggatgatgcag

SEQ ID NO: 7894570 - DNA, 22 bp, Homo sapiens
tccccttggcttggtcaagagg

SEQ ID NO: 7894571 - DNA, 22 bp, Homo sapiens
tcccgataggcagggctctggc

SEQ ID NO: 7894572 - DNA, 22 bp, Homo sapiens
tcccctttgtaagatggaaacg

SEQ ID NO: 7894573 - DNA, 22 bp, Homo sapiens
tcccctttgtcttcctgtgggt

SEQ ID NO: 7894574 - DNA, 22 bp, Homo sapiens
tcccgcttcttccgaatcgcga

SEQ ID NO: 7894575 - DNA, 22 bp, Homo sapiens
tcccggagcctgcactcctaac

SEQ ID NO: 7894576 - DNA, 21 bp, Homo sapiens
tccctcagaagctcttggtca

SEQ ID NO: 7894577 - DNA, 21 bp, Homo sapiens
tccctcagaaggtagccaagc

SEQ ID NO: 7894578 - DNA, 22 bp, Homo sapiens
tccctcagacagatgtgttcct

SEQ ID NO: 7894579 - DNA, 18 bp, Homo sapiens
tccctcagaattatagaa

SEQ ID NO: 7894580 - DNA, 22 bp, Homo sapiens
tccctcagattggcaattagat

SEQ ID NO: 7894581 - DNA, 22 bp, Homo sapiens
tccctcagattggcaattagat

SEQ ID NO: 7894582 - DNA, 22 bp, Homo sapiens
tccctcagatgagctcctagca

SEQ ID NO: 7894583 - DNA, 20 bp, Homo sapiens
tccctcagcacttctacctc

SEQ ID NO: 7894584 - DNA, 22 bp, Homo sapiens
tccctcagcaggaactggcctg

SEQ ID NO: 7894585 - DNA, 22 bp, Homo sapiens
tccctcagcaggaactggcctg

SEQ ID NO: 7894586 - DNA, 22 bp, Homo sapiens
tccctcagcaggaactggcctg

SEQ ID NO: 7894587 - DNA, 22 bp, Homo sapiens
tccctcagcaggaactggcctg

SEQ ID NO: 7894588 - DNA, 22 bp, Homo sapiens
tccctcagcaggaatgtggcag

SEQ ID NO: 7894589 - DNA, 21 bp, Homo sapiens
tccctcagacagggtgcctat

SEQ ID NO: 7894590 - DNA, 21 bp, Homo sapiens
tccctcagacagggtgcctat

SEQ ID NO: 7894591 - DNA, 22 bp, Homo sapiens
tccctcagagaccgtggtgcag

SEQ ID NO: 7894592 - DNA, 22 bp, Homo sapiens
tccctcagagggcaagcgcaga

SEQ ID NO: 7894593 - DNA, 22 bp, Homo sapiens
tccctcagatgagctcctagca

SEQ ID NO: 7894594 - DNA, 22 bp, Homo sapiens
tccctcagatgagctcctagca

SEQ ID NO: 7894595 - DNA, 22 bp, Homo sapiens
tccctcagagggcaagcgcaga

SEQ ID NO: 7894596 - DNA, 22 bp, Homo sapiens
tccctcagatgagctcctagca

SEQ ID NO: 7894597 - DNA, 22 bp, Homo sapiens
tccctcagatgagctcctagca

SEQ ID NO: 7894598 - DNA, 22 bp, Homo sapiens
tccctcagatgagctcctagca

SEQ ID NO: 7894599 - DNA, 18 bp, Homo sapiens
tccctccctgctgtggcc

SEQ ID NO: 7894600 - DNA, 18 bp, Homo sapiens
tccctccctgctgtggcc

SEQ ID NO: 7894601 - DNA, 18 bp, Homo sapiens
tccctccctgctgtggcc

SEQ ID NO: 7894602 - DNA, 20 bp, Homo sapiens
tccctccctccagctctggg

SEQ ID NO: 7894603 - DNA, 20 bp, Homo sapiens
tccctccctccagctctggg

SEQ ID NO: 7894604 - DNA, 20 bp, Homo sapiens
tccctccctccagctctggg

SEQ ID NO: 7894605 - DNA, 19 bp, Homo sapiens
tccctccctgtaatctcac

SEQ ID NO: 7894606 - DNA, 19 bp, Homo sapiens
tccctccctgtaatctcac

SEQ ID NO: 7894607 - DNA, 19 bp, Homo sapiens
tccctccctgtaatctcac

SEQ ID NO: 7894608 - DNA, 19 bp, Homo sapiens
tccctccctgtaatctcac

SEQ ID NO: 7894609 - DNA, 19 bp, Homo sapiens
tccctccctgtaatctcac

SEQ ID NO: 7894610 - DNA, 18 bp, Homo sapiens
tccctccctgctgtggcc

SEQ ID NO: 7894611 - DNA, 18 bp, Homo sapiens
tccctccctgctgtggcc

SEQ ID NO: 7894612 - DNA, 18 bp, Homo sapiens
tccctccctgctgtggcc

SEQ ID NO: 7894613 - DNA, 19 bp, Homo sapiens
tccctccctgtaatctcac

SEQ ID NO: 7894614 - DNA, 22 bp, Homo sapiens
tccctctgctagtgcttgagct

SEQ ID NO: 7894615 - DNA, 22 bp, Homo sapiens
tccctctgctagtgcttgagct

SEQ ID NO: 7894616 - DNA, 22 bp, Homo sapiens
tccctctgggctccagcacgga

SEQ ID NO: 7894617 - DNA, 22 bp, Homo sapiens
tccctctggaggctctagggga

SEQ ID NO: 7894618 - DNA, 22 bp, Homo sapiens
tccctctggtctggacgccata

SEQ ID NO: 7894619 - DNA, 22 bp, Homo sapiens
tccctctggtctggacgccata

SEQ ID NO: 7894620 - DNA, 22 bp, Homo sapiens
tccctctggtcctcggtggaga

SEQ ID NO: 7894621 - DNA, 22 bp, Homo sapiens
tccctctgggctggagcagggt

SEQ ID NO: 7894622 - DNA, 22 bp, Homo sapiens
tccctctgggctggagcagggt

SEQ ID NO: 7894623 - DNA, 22 bp, Homo sapiens
tccctctgggctggagcagggt

SEQ ID NO: 7894624 - DNA, 22 bp, Homo sapiens
tccctgagactctggagtgtaa

SEQ ID NO: 7894625 - DNA, 22 bp, Homo sapiens
tccctgagagcactggggagcc

SEQ ID NO: 7894626 - DNA, 22 bp, Homo sapiens
tccctgagactctggagtgtaa

SEQ ID NO: 7894627 - DNA, 22 bp, Homo sapiens
tccctgagactctggagtgtaa

SEQ ID NO: 7894628 - DNA, 22 bp, Homo sapiens
tccctgagaaagcccaggaggt

SEQ ID NO: 7894629 - DNA, 22 bp, Homo sapiens
tccctgagaaagcccaggaggt

SEQ ID NO: 7894630 - DNA, 22 bp, Homo sapiens
tccctgagaaagcccaggaggt

SEQ ID NO: 7894631 - DNA, 22 bp, Homo sapiens
tccctgcctcctggcagtgcca

SEQ ID NO: 7894632 - DNA, 22 bp, Homo sapiens
tccctgcctcctggcagtgcca

SEQ ID NO: 7894633 - DNA, 22 bp, Homo sapiens
tccctgccctgccttcatggtt

SEQ ID NO: 7894634 - DNA, 22 bp, Homo sapiens
tccctgccctgccttcatggtt

SEQ ID NO: 7894635 - DNA, 22 bp, Homo sapiens
tccctgccctgccttcatggtt

SEQ ID NO: 7894636 - DNA, 22 bp, Homo sapiens
tccctgccctgccttcatggtt

SEQ ID NO: 7894637 - DNA, 22 bp, Homo sapiens
tccctctgtgttgggcatgcct

SEQ ID NO: 7894638 - DNA, 22 bp, Homo sapiens
tccctctgtggttggttctgtc

SEQ ID NO: 7894639 - DNA, 22 bp, Homo sapiens
tccctctgtgttgggcatgcct

SEQ ID NO: 7894640 - DNA, 22 bp, Homo sapiens
tccctgaagccagggaaggaag

SEQ ID NO: 7894641 - DNA, 22 bp, Homo sapiens
tccctgaaacatctctgtggat

SEQ ID NO: 7894642 - DNA, 22 bp, Homo sapiens
tccctgaaacatctctgtggat

SEQ ID NO: 7894643 - DNA, 22 bp, Homo sapiens
tccctgaaatttgaagaggaat

SEQ ID NO: 7894644 - DNA, 19 bp, Homo sapiens
tccctcagtctgccaggcc

SEQ ID NO: 7894645 - DNA, 20 bp, Homo sapiens
tccctcagtttccagccctg

SEQ ID NO: 7894646 - DNA, 19 bp, Homo sapiens
tccctcagtctgccaggcc

SEQ ID NO: 7894647 - DNA, 19 bp, Homo sapiens
tccctcagtctgccaggcc

SEQ ID NO: 7894648 - DNA, 19 bp, Homo sapiens
tccctcagtctgccaggcc

SEQ ID NO: 7894649 - DNA, 20 bp, Homo sapiens
tccctcagtcctggctttgt

SEQ ID NO: 7894650 - DNA, 20 bp, Homo sapiens
tccctcagtttccagccctg

SEQ ID NO: 7894651 - DNA, 22 bp, Homo sapiens
tccctccagaatggtgaggaag

SEQ ID NO: 7894652 - DNA, 22 bp, Homo sapiens
tccctccacacctgctggtacc

SEQ ID NO: 7894653 - DNA, 22 bp, Homo sapiens
tccctccagaatggtgaggaag

SEQ ID NO: 7894654 - DNA, 22 bp, Homo sapiens
tccctccccacttctgagcttt

SEQ ID NO: 7894655 - DNA, 22 bp, Homo sapiens
tccctccccacttctgagcttt

SEQ ID NO: 7894656 - DNA, 22 bp, Homo sapiens
tccctccccacttctgagcttt

SEQ ID NO: 7894657 - DNA, 20 bp, Homo sapiens
tccctccctccagctctggg

SEQ ID NO: 7894658 - DNA, 20 bp, Homo sapiens
tccctccctccagctctggg

SEQ ID NO: 7894659 - DNA, 20 bp, Homo sapiens
tccctccctccagctctggg

SEQ ID NO: 7894660 - DNA, 20 bp, Homo sapiens
tccctccctccagctctggg

SEQ ID NO: 7894661 - DNA, 22 bp, Homo sapiens
tccctccccacttctgagcttt

SEQ ID NO: 7894662 - DNA, 22 bp, Homo sapiens
tccctccccacttctgagcttt

SEQ ID NO: 7894663 - DNA, 22 bp, Homo sapiens
tccctccccacttctgagcttt

SEQ ID NO: 7894664 - DNA, 22 bp, Homo sapiens
tccctccataacagaggtgagc

SEQ ID NO: 7894665 - DNA, 22 bp, Homo sapiens
tccctccataacagaggtgagc

SEQ ID NO: 7894666 - DNA, 22 bp, Homo sapiens
tccctccaggcagctgggtact

SEQ ID NO: 7894667 - DNA, 20 bp, Homo sapiens
tccctcaggtcattgggctg

SEQ ID NO: 7894668 - DNA, 20 bp, Homo sapiens
tccctcaggtcattgggctg

SEQ ID NO: 7894669 - DNA, 23 bp, Homo sapiens
tccctcaggccttatctccatct

SEQ ID NO: 7894670 - DNA, 22 bp, Homo sapiens
tccctcagggtgcagttgcttt

SEQ ID NO: 7894671 - DNA, 23 bp, Homo sapiens
tccctcaggccttatctccatct

SEQ ID NO: 7894672 - DNA, 22 bp, Homo sapiens
tccctcaggtggttcttgtttc

SEQ ID NO: 7894673 - DNA, 22 bp, Homo sapiens
tccctcagtccctggacaggca

SEQ ID NO: 7894674 - DNA, 22 bp, Homo sapiens
tccctcagtccctggacaggca

SEQ ID NO: 7894675 - DNA, 22 bp, Homo sapiens
tccctcagcttgtctccatgca

SEQ ID NO: 7894676 - DNA, 15 bp, Homo sapiens
tccctcagctaaaga

SEQ ID NO: 7894677 - DNA, 22 bp, Homo sapiens
tccctcagctcatatttatgcc

SEQ ID NO: 7894678 - DNA, 22 bp, Homo sapiens
tccctcagcttgtctccatgca

SEQ ID NO: 7894679 - DNA, 22 bp, Homo sapiens
tccctcagcttgtctccatgca

SEQ ID NO: 7894680 - DNA, 22 bp, Homo sapiens
tccctcagcttgtctccatgca

SEQ ID NO: 7894681 - DNA, 22 bp, Homo sapiens
tccctcaggacccaacttgtaa

SEQ ID NO: 7894682 - DNA, 22 bp, Homo sapiens
tccctcaggacccaacttgtaa

SEQ ID NO: 7894683 - DNA, 23 bp, Homo sapiens
tccctcaggccttatctccatct

SEQ ID NO: 7894684 - DNA, 23 bp, Homo sapiens
tccctcaggccttatctccatct

SEQ ID NO: 7894685 - DNA, 22 bp, Homo sapiens
tccctcagcttgtctccatgca

SEQ ID NO: 7894686 - DNA, 22 bp, Homo sapiens
tcctgaagaacgaagtcatgta

SEQ ID NO: 7894687 - DNA, 22 bp, Homo sapiens
tcctgaagaaggcagatatttg

SEQ ID NO: 7894688 - DNA, 19 bp, Homo sapiens
tcctgaagatttcctcagc

SEQ ID NO: 7894689 - DNA, 22 bp, Homo sapiens
tcctgaagcagttagcatgagc

SEQ ID NO: 7894690 - DNA, 22 bp, Homo sapiens
tcctgaagcagttagcatgagc

SEQ ID NO: 7894691 - DNA, 22 bp, Homo sapiens
tcctgaagaggttgtctttata

SEQ ID NO: 7894692 - DNA, 22 bp, Homo sapiens
tcctgaagaggttgtctttata

SEQ ID NO: 7894693 - DNA, 19 bp, Homo sapiens
tcctgaaaacttctggaat

SEQ ID NO: 7894694 - DNA, 19 bp, Homo sapiens
tcctgaaaacttctggaat

SEQ ID NO: 7894695 - DNA, 19 bp, Homo sapiens
tcctgaaaacttctggaat

SEQ ID NO: 7894696 - DNA, 22 bp, Homo sapiens
tcctgaaaaattacatgttcag

SEQ ID NO: 7894697 - DNA, 19 bp, Homo sapiens
tcctgaaaacttctggaat

SEQ ID NO: 7894698 - DNA, 19 bp, Homo sapiens
tcctgaaaacttctggaat

SEQ ID NO: 7894699 - DNA, 22 bp, Homo sapiens
tcctgaaaataatttcacaaga

SEQ ID NO: 7894700 - DNA, 22 bp, Homo sapiens
tcctgaaaataatttcacaaga

SEQ ID NO: 7894701 - DNA, 22 bp, Homo sapiens
tcctgaaatgtgcacatgacat

SEQ ID NO: 7894702 - DNA, 22 bp, Homo sapiens
tcctgaaaataatttcacaaga

SEQ ID NO: 7894703 - DNA, 22 bp, Homo sapiens
tcctgaaatgtgcacatgacat

SEQ ID NO: 7894704 - DNA, 22 bp, Homo sapiens
tcctgaaatgtgcacatgacat

SEQ ID NO: 7894705 - DNA, 22 bp, Homo sapiens
tcctgaaaaattacatgttcag

SEQ ID NO: 7894706 - DNA, 22 bp, Homo sapiens
tcctgaaatgtgcacatgacat

SEQ ID NO: 7894707 - DNA, 22 bp, Homo sapiens
tcctgaaattctggttgtcact

SEQ ID NO: 7894708 - DNA, 22 bp, Homo sapiens
tcctgaaatttgttttaattct

SEQ ID NO: 7894709 - DNA, 22 bp, Homo sapiens
tcctgagagcagagtccaggtg

SEQ ID NO: 7894710 - DNA, 20 bp, Homo sapiens
tcctgagacctgggaaggtt

SEQ ID NO: 7894711 - DNA, 22 bp, Homo sapiens
tcctgagagcagagtccaggtg

SEQ ID NO: 7894712 - DNA, 22 bp, Homo sapiens
tcctgagagcagagtccaggtg

SEQ ID NO: 7894713 - DNA, 20 bp, Homo sapiens
tcctgagacctgggaaggtt

SEQ ID NO: 7894714 - DNA, 20 bp, Homo sapiens
tcctgagacctgggaaggtt

SEQ ID NO: 7894715 - DNA, 20 bp, Homo sapiens
tcctgagacctgggaaggtt

SEQ ID NO: 7894716 - DNA, 22 bp, Homo sapiens
tcctgagacatctctgctggtc

SEQ ID NO: 7894717 - DNA, 22 bp, Homo sapiens
tcctgagacatctctgctggtc

SEQ ID NO: 7894718 - DNA, 22 bp, Homo sapiens
tcctgagagcagctgctttgga

SEQ ID NO: 7894719 - DNA, 22 bp, Homo sapiens
tcctgagagcagctgctttgga

SEQ ID NO: 7894720 - DNA, 22 bp, Homo sapiens
tcctgagagcagctgctttgga

SEQ ID NO: 7894721 - DNA, 22 bp, Homo sapiens
tcctgagagcagctgctttgga

SEQ ID NO: 7894722 - DNA, 22 bp, Homo sapiens
tcctgagagccttggcttcaga

SEQ ID NO: 7894723 - DNA, 22 bp, Homo sapiens
tcctgagagccttggcttcaga

SEQ ID NO: 7894724 - DNA, 22 bp, Homo sapiens
tcctgagagcagctgctttgga

SEQ ID NO: 7894725 - DNA, 22 bp, Homo sapiens
tcctgagagccttggcttcaga

SEQ ID NO: 7894726 - DNA, 22 bp, Homo sapiens
tcctgagagccttggcttcaga

SEQ ID NO: 7894727 - DNA, 20 bp, Homo sapiens
tcctgagaggctcttggaga

SEQ ID NO: 7894728 - DNA, 20 bp, Homo sapiens
tcctgagaggctcttggaga

SEQ ID NO: 7894729 - DNA, 22 bp, Homo sapiens
tcctgaaggcagatggggatca

SEQ ID NO: 7894730 - DNA, 22 bp, Homo sapiens
tcctgaagctctcttaaggaaa

SEQ ID NO: 7894731 - DNA, 22 bp, Homo sapiens
tcctgaagcctgagtgatgact

SEQ ID NO: 7894732 - DNA, 22 bp, Homo sapiens
tcctgagacatctctgctggtc

SEQ ID NO: 7894733 - DNA, 22 bp, Homo sapiens
tcctgagacatctctgctggtc

SEQ ID NO: 7894734 - DNA, 22 bp, Homo sapiens
tcctgagaatagagttgcatgt

SEQ ID NO: 7894735 - DNA, 22 bp, Homo sapiens
tcctgagaatagagttgcatgt

SEQ ID NO: 7894736 - DNA, 22 bp, Homo sapiens
tcctgagaatagagttgcatgt

SEQ ID NO: 7894737 - DNA, 22 bp, Homo sapiens
tcctgaaggcctgagttccacc

SEQ ID NO: 7894738 - DNA, 22 bp, Homo sapiens
tcctcagtaaggatcgtcagct

SEQ ID NO: 7894739 - DNA, 22 bp, Homo sapiens
tcctcagtaaggatcgtcagct

SEQ ID NO: 7894740 - DNA, 22 bp, Homo sapiens
tcctcagtaaggatcgtcagct

SEQ ID NO: 7894741 - DNA, 22 bp, Homo sapiens
tcctcagtaaggcatggctttg

SEQ ID NO: 7894742 - DNA, 22 bp, Homo sapiens
tcctctgggctccctgcaacag

SEQ ID NO: 7894743 - DNA, 22 bp, Homo sapiens
tcctcaggtgactaggtatctt

SEQ ID NO: 7894744 - DNA, 22 bp, Homo sapiens
tcctcaggtgactaggtatctt

SEQ ID NO: 7894745 - DNA, 22 bp, Homo sapiens
tcctctggggcgtggtcctgga

SEQ ID NO: 7894746 - DNA, 22 bp, Homo sapiens
tcctctggggcgtggtcctgga

SEQ ID NO: 7894747 - DNA, 22 bp, Homo sapiens
tcctctggggcgtggtcctgga

SEQ ID NO: 7894748 - DNA, 22 bp, Homo sapiens
tcctctgggctccctgcaacag

SEQ ID NO: 7894749 - DNA, 22 bp, Homo sapiens
tcctctggtcctgcagcagatc

SEQ ID NO: 7894750 - DNA, 22 bp, Homo sapiens
tcctctggtcctgcagcagatc

SEQ ID NO: 7894751 - DNA, 22 bp, Homo sapiens
tcctctggttatacttgcaccc

SEQ ID NO: 7894752 - DNA, 22 bp, Homo sapiens
tcctctggttatacttgcaccc

SEQ ID NO: 7894753 - DNA, 22 bp, Homo sapiens
tcctctggggtcagggcactac

SEQ ID NO: 7894754 - DNA, 22 bp, Homo sapiens
tcctctggggcgtggtcctgga

SEQ ID NO: 7894755 - DNA, 22 bp, Homo sapiens
tcctctttctcaacattagtta

SEQ ID NO: 7894756 - DNA, 22 bp, Homo sapiens
tcctctttctcaacattagtta

SEQ ID NO: 7894757 - DNA, 22 bp, Homo sapiens
tcctctttctcaacattagtta

SEQ ID NO: 7894758 - DNA, 22 bp, Homo sapiens
tcctctttctcaacattagtta

SEQ ID NO: 7894759 - DNA, 22 bp, Homo sapiens
tcctcttctgtggattccctga

SEQ ID NO: 7894760 - DNA, 22 bp, Homo sapiens
tcctcttctgcctatatctgcc

SEQ ID NO: 7894761 - DNA, 22 bp, Homo sapiens
tcctcttctgcctatatctgcc

SEQ ID NO: 7894762 - DNA, 22 bp, Homo sapiens
tcctcttctgtggattccctga

SEQ ID NO: 7894763 - DNA, 22 bp, Homo sapiens
tcctcttctgcctatatctgcc

SEQ ID NO: 7894764 - DNA, 22 bp, Homo sapiens
tcctcttctgcccatcagaggc

SEQ ID NO: 7894765 - DNA, 22 bp, Homo sapiens
tcctcttctaagctcattcagg

SEQ ID NO: 7894766 - DNA, 22 bp, Homo sapiens
tcctcttcaaaaggatttcctt

SEQ ID NO: 7894767 - DNA, 22 bp, Homo sapiens
tcctcttcaaaaggatttcctt

SEQ ID NO: 7894768 - DNA, 22 bp, Homo sapiens
tcctcttcaaaatagctctgaa

SEQ ID NO: 7894769 - DNA, 22 bp, Homo sapiens
tcctctgtggaccgggctttgg

SEQ ID NO: 7894770 - DNA, 22 bp, Homo sapiens
tcctcttcaaaatagctctgaa

SEQ ID NO: 7894771 - DNA, 22 bp, Homo sapiens
tcctcttcagagggacctcggg

SEQ ID NO: 7894772 - DNA, 22 bp, Homo sapiens
tcctcttcaaaatagctctgaa

SEQ ID NO: 7894773 - DNA, 22 bp, Homo sapiens
tcctcttcaaaatagctctgaa

SEQ ID NO: 7894774 - DNA, 22 bp, Homo sapiens
tcctcttccttctgtccaaatg

SEQ ID NO: 7894775 - DNA, 22 bp, Homo sapiens
tcctcttcagagggacctcggg

SEQ ID NO: 7894776 - DNA, 20 bp, Homo sapiens
tcctgagcctccaccatgtc

SEQ ID NO: 7894777 - DNA, 22 bp, Homo sapiens
tcctgagctacagtagtatgat

SEQ ID NO: 7894778 - DNA, 22 bp, Homo sapiens
tcctgagccctgtaggaccctg

SEQ ID NO: 7894779 - DNA, 22 bp, Homo sapiens
tcctgagccctggggtcagtgt

SEQ ID NO: 7894780 - DNA, 22 bp, Homo sapiens
tcctgagcacctatgccatggc

SEQ ID NO: 7894781 - DNA, 22 bp, Homo sapiens
tcctgagcacctatgccatggc

SEQ ID NO: 7894782 - DNA, 22 bp, Homo sapiens
tcctgagccctggggtcagtgt

SEQ ID NO: 7894783 - DNA, 22 bp, Homo sapiens
tcctgagccctggggtcagtgt

SEQ ID NO: 7894784 - DNA, 22 bp, Homo sapiens
tcctgagccctactctagacga

SEQ ID NO: 7894785 - DNA, 22 bp, Homo sapiens
tcctgagcaacacagctaagtg

SEQ ID NO: 7894786 - DNA, 20 bp, Homo sapiens
tcctgagatttaaggggttc

SEQ ID NO: 7894787 - DNA, 20 bp, Homo sapiens
tcctgagatttaaggggttc

SEQ ID NO: 7894788 - DNA, 22 bp, Homo sapiens
tcctgagcacctatgccatggc

SEQ ID NO: 7894789 - DNA, 22 bp, Homo sapiens
tcctgagcacagagacaaggaa

SEQ ID NO: 7894790 - DNA, 22 bp, Homo sapiens
tcctgagcacagagacaaggaa

SEQ ID NO: 7894791 - DNA, 20 bp, Homo sapiens
tcctgagatttaaggggttc

SEQ ID NO: 7894792 - DNA, 20 bp, Homo sapiens
tcctgagatttaaggggttc

SEQ ID NO: 7894793 - DNA, 22 bp, Homo sapiens
tcctgagattctgcatttctaa

SEQ ID NO: 7894794 - DNA, 22 bp, Homo sapiens
tcctgagattctgcatttctaa

SEQ ID NO: 7894795 - DNA, 22 bp, Homo sapiens
tcctgagatgtggagctccatg

SEQ ID NO: 7894796 - DNA, 22 bp, Homo sapiens
tcctgagattctgcatttctaa

SEQ ID NO: 7894797 - DNA, 22 bp, Homo sapiens
tcctgagatgtggagctccatg

SEQ ID NO: 7894798 - DNA, 22 bp, Homo sapiens
tcctgagatgtggagctccatg

SEQ ID NO: 7894799 - DNA, 23 bp, Homo sapiens
tcctgagatgagacagtgctgcc

SEQ ID NO: 7894800 - DNA, 23 bp, Homo sapiens
tcctgagatgagacagtgctgcc

SEQ ID NO: 7894801 - DNA, 22 bp, Homo sapiens
tcctgagatgagacagtgctgc

SEQ ID NO: 7894802 - DNA, 23 bp, Homo sapiens
tcctgagatgagacagtgctgcc

SEQ ID NO: 7894803 - DNA, 23 bp, Homo sapiens
tcctgagatgagacagtgctgcc

SEQ ID NO: 7894804 - DNA, 22 bp, Homo sapiens
tcctgagatccttttagggatc

SEQ ID NO: 7894805 - DNA, 22 bp, Homo sapiens
tcctgagatccttttagggatc

SEQ ID NO: 7894806 - DNA, 22 bp, Homo sapiens
tcctgagatccttttagggatc

SEQ ID NO: 7894807 - DNA, 22 bp, Homo sapiens
tcctgagatccttttagggatc

SEQ ID NO: 7894808 - DNA, 22 bp, Homo sapiens
tcctgagatccttttagggatc

SEQ ID NO: 7894809 - DNA, 22 bp, Homo sapiens
tcctgagatgagacagtgctgc

SEQ ID NO: 7894810 - DNA, 22 bp, Homo sapiens
tcctgagatgagacagtgctgc

SEQ ID NO: 7894811 - DNA, 22 bp, Homo sapiens
tcctgagatgagacagtgctgc

SEQ ID NO: 7894812 - DNA, 22 bp, Homo sapiens
tcctgagatgagacagtgctgc

SEQ ID NO: 7894813 - DNA, 22 bp, Homo sapiens
tcctgagatgagacagtgctgc

SEQ ID NO: 7894814 - DNA, 22 bp, Homo sapiens
tcctgagataaatctcatgtga

SEQ ID NO: 7894815 - DNA, 22 bp, Homo sapiens
tcctgagataaatctcatgtga

SEQ ID NO: 7894816 - DNA, 22 bp, Homo sapiens
tcctgagataggagttgaaggc

SEQ ID NO: 7894817 - DNA, 22 bp, Homo sapiens
tcctgagataggagttgaaggc

SEQ ID NO: 7894818 - DNA, 22 bp, Homo sapiens
tcctgagataggagttgaaggc

SEQ ID NO: 7894819 - DNA, 22 bp, Homo sapiens
tcctgagataaatctcatgtga

SEQ ID NO: 7894820 - DNA, 22 bp, Homo sapiens
tcctgagataaatctcatgtga

SEQ ID NO: 7894821 - DNA, 22 bp, Homo sapiens
tcctgagagtcaagaatgcagg

SEQ ID NO: 7894822 - DNA, 22 bp, Homo sapiens
tcctgagaggtgtgaggtgcag

SEQ ID NO: 7894823 - DNA, 22 bp, Homo sapiens
tcctgagaggggtgggtttccc

SEQ ID NO: 7894824 - DNA, 22 bp, Homo sapiens
tcctgagaggggtgggtttccc

SEQ ID NO: 7894825 - DNA, 22 bp, Homo sapiens
tcctgagagtcaagaatgcagg

SEQ ID NO: 7894826 - DNA, 22 bp, Homo sapiens
tcctgagagtcaagaatgcagg

SEQ ID NO: 7894827 - DNA, 22 bp, Homo sapiens
tcctgagaggtgtgaggtgcag

SEQ ID NO: 7894828 - DNA, 22 bp, Homo sapiens
tcctgagaggtttataacgcag

SEQ ID NO: 7894829 - DNA, 21 bp, Homo sapiens
tcctgagtgtgcccaggctct

SEQ ID NO: 7894830 - DNA, 22 bp, Homo sapiens
tcctgagtgagagctgggaggt

SEQ ID NO: 7894831 - DNA, 22 bp, Homo sapiens
tcctgagtgagagctgggaggt

SEQ ID NO: 7894832 - DNA, 20 bp, Homo sapiens
tcctgagtgcagttggcttg

SEQ ID NO: 7894833 - DNA, 22 bp, Homo sapiens
tcctgatgatattgctctttct

SEQ ID NO: 7894834 - DNA, 22 bp, Homo sapiens
tcctgatgatattgctctttct

SEQ ID NO: 7894835 - DNA, 22 bp, Homo sapiens
tcctgagtgtttggccaggcca

SEQ ID NO: 7894836 - DNA, 22 bp, Homo sapiens
tcctgatggaggggtcatcttt

SEQ ID NO: 7894837 - DNA, 22 bp, Homo sapiens
tcctgatggaggggtcatcttt

SEQ ID NO: 7894838 - DNA, 22 bp, Homo sapiens
tcctgatggaggggtcatcttt

SEQ ID NO: 7894839 - DNA, 22 bp, Homo sapiens
tcctgatggcctctggctccag

SEQ ID NO: 7894840 - DNA, 22 bp, Homo sapiens
tcctgatggcctctggctccag

SEQ ID NO: 7894841 - DNA, 22 bp, Homo sapiens
tcctgatggcctctggctccag

SEQ ID NO: 7894842 - DNA, 22 bp, Homo sapiens
tcctgagtgagagctgggaggt

SEQ ID NO: 7894843 - DNA, 22 bp, Homo sapiens
tcctgagtgagagctgggaggt

SEQ ID NO: 7894844 - DNA, 22 bp, Homo sapiens
tcctgaggttttaaaactattc

SEQ ID NO: 7894845 - DNA, 22 bp, Homo sapiens
tcctgaggctaaagtgcagtgg

SEQ ID NO: 7894846 - DNA, 22 bp, Homo sapiens
tcctgaggctcactttgaatgt

SEQ ID NO: 7894847 - DNA, 22 bp, Homo sapiens
tcctgaggctcactttgaatgt

SEQ ID NO: 7894848 - DNA, 22 bp, Homo sapiens
tcctgaggcacaatcctagaat

SEQ ID NO: 7894849 - DNA, 22 bp, Homo sapiens
tcctgaggagaagagtgctagg

SEQ ID NO: 7894850 - DNA, 22 bp, Homo sapiens
tcctgaggatggttgaagtgca

SEQ ID NO: 7894851 - DNA, 22 bp, Homo sapiens
tcctgaggcctctgtgatgtga

SEQ ID NO: 7894852 - DNA, 22 bp, Homo sapiens
tcctgaggctaaagtgcagtgg

SEQ ID NO: 7894853 - DNA, 22 bp, Homo sapiens
tcctgaggctaaagtgcagtgg

SEQ ID NO: 7894854 - DNA, 22 bp, Homo sapiens
tcctgagctttacagtaaggac

SEQ ID NO: 7894855 - DNA, 22 bp, Homo sapiens
tcctgaggaaagttcatgaatg

SEQ ID NO: 7894856 - DNA, 22 bp, Homo sapiens
tcctgaggaaagttcatgaatg

SEQ ID NO: 7894857 - DNA, 22 bp, Homo sapiens
tcctgagctgccgcatcagcag

SEQ ID NO: 7894858 - DNA, 22 bp, Homo sapiens
tcctgagctgccgcatcagcag

SEQ ID NO: 7894859 - DNA, 22 bp, Homo sapiens
tcctgagctcccatgaacaggc

SEQ ID NO: 7894860 - DNA, 22 bp, Homo sapiens
tcctgaggactaacaggaagga

SEQ ID NO: 7894861 - DNA, 22 bp, Homo sapiens
tcctgaggactaacaggaagga

SEQ ID NO: 7894862 - DNA, 22 bp, Homo sapiens
tcctgaggaccctgtcaggggc

SEQ ID NO: 7894863 - DNA, 23 bp, Homo sapiens
tcctgaggaatggcatctcacat

SEQ ID NO: 7894864 - DNA, 23 bp, Homo sapiens
tcctgaggaatggcatctcacat

SEQ ID NO: 7894865 - DNA, 23 bp, Homo sapiens
tcctgaggaatggcatctcacat

SEQ ID NO: 7894866 - DNA, 22 bp, Homo sapiens
tcctgaggaatgtgaagagaac

SEQ ID NO: 7894867 - DNA, 23 bp, Homo sapiens
tcctgaggaatggcatctcacat

SEQ ID NO: 7894868 - DNA, 22 bp, Homo sapiens
tcctgaggaatgtgaagagaac

SEQ ID NO: 7894869 - DNA, 22 bp, Homo sapiens
tcctgaggaccctgtcaggggc

SEQ ID NO: 7894870 - DNA, 22 bp, Homo sapiens
tcctgaggaccctgtcaggggc

SEQ ID NO: 7894871 - DNA, 22 bp, Homo sapiens
tcctgaggaccctgtcaggggc

SEQ ID NO: 7894872 - DNA, 22 bp, Homo sapiens
tcctgccctcgggggtgttcca

SEQ ID NO: 7894873 - DNA, 22 bp, Homo sapiens
tcctgccctgaaaagtcagtct

SEQ ID NO: 7894874 - DNA, 22 bp, Homo sapiens
tcctgccctgaaaagtcagtct

SEQ ID NO: 7894875 - DNA, 20 bp, Homo sapiens
tcctgcagtcgctagcgccc

SEQ ID NO: 7894876 - DNA, 22 bp, Homo sapiens
tcctgcagtctgcactctgcct

SEQ ID NO: 7894877 - DNA, 22 bp, Homo sapiens
tcctgcccagagctctccactc

SEQ ID NO: 7894878 - DNA, 20 bp, Homo sapiens
tcctgcagtcgctagcgccc

SEQ ID NO: 7894879 - DNA, 22 bp, Homo sapiens
tcctgcagtctgcactctgcct

SEQ ID NO: 7894880 - DNA, 19 bp, Homo sapiens
tcctgcaggtggcttgcag

SEQ ID NO: 7894881 - DNA, 19 bp, Homo sapiens
tcctgcaggtggcttgcag

SEQ ID NO: 7894882 - DNA, 20 bp, Homo sapiens
tcctgcagtcgctagcgccc

SEQ ID NO: 7894883 - DNA, 22 bp, Homo sapiens
tcctgcaggggctgaggaacca

SEQ ID NO: 7894884 - DNA, 22 bp, Homo sapiens
tcctgcaggggctgaggaacca

SEQ ID NO: 7894885 - DNA, 22 bp, Homo sapiens
tcctgcaggggctgaggaacca

SEQ ID NO: 7894886 - DNA, 19 bp, Homo sapiens
tcctgcaggtggcttgcag

SEQ ID NO: 7894887 - DNA, 22 bp, Homo sapiens
tcctgcaggcttgagtcctcag

SEQ ID NO: 7894888 - DNA, 22 bp, Homo sapiens
tcctgcaggcttgagtcctcag

SEQ ID NO: 7894889 - DNA, 21 bp, Homo sapiens
tcctgcagggcagcagagtgg

SEQ ID NO: 7894890 - DNA, 22 bp, Homo sapiens
tcctgcaggcttgagtcctcag

SEQ ID NO: 7894891 - DNA, 22 bp, Homo sapiens
tcctgcaggcttgagtcctcag

SEQ ID NO: 7894892 - DNA, 21 bp, Homo sapiens
tcctgcagggcagcagagtgg

SEQ ID NO: 7894893 - DNA, 21 bp, Homo sapiens
tcctgcagggcagcagagtgg

SEQ ID NO: 7894894 - DNA, 21 bp, Homo sapiens
tcctgcagggcagcagagtgg

SEQ ID NO: 7894895 - DNA, 22 bp, Homo sapiens
tcctgcagctgcagacctgggg

SEQ ID NO: 7894896 - DNA, 18 bp, Homo sapiens
tcctgcagcttctatgta

SEQ ID NO: 7894897 - DNA, 21 bp, Homo sapiens
tcctgcaggaggcctgagagg

SEQ ID NO: 7894898 - DNA, 22 bp, Homo sapiens
tcctgcaggccagaggggtgag

SEQ ID NO: 7894899 - DNA, 21 bp, Homo sapiens
tcctgcaggaggcctgagagg

SEQ ID NO: 7894900 - DNA, 22 bp, Homo sapiens
tcctgcaggccagaggggtgag

SEQ ID NO: 7894901 - DNA, 22 bp, Homo sapiens
tcctgcaggcctgttcccagta

SEQ ID NO: 7894902 - DNA, 22 bp, Homo sapiens
tcctgcaggccagaggggtgag

SEQ ID NO: 7894903 - DNA, 22 bp, Homo sapiens
tcctgcaggccagaggggtgag

SEQ ID NO: 7894904 - DNA, 22 bp, Homo sapiens
tcctgcaggccagaggggtgag

SEQ ID NO: 7894905 - DNA, 22 bp, Homo sapiens
tcctgcaggcctgttcccagta

SEQ ID NO: 7894906 - DNA, 22 bp, Homo sapiens
tcctgcaggcctgttcccagta

SEQ ID NO: 7894907 - DNA, 22 bp, Homo sapiens
tcctgcaggcttgagtcctcag

SEQ ID NO: 7894908 - DNA, 22 bp, Homo sapiens
tcctgcagctgcagacctgggg

SEQ ID NO: 7894909 - DNA, 22 bp, Homo sapiens
tcctgcagctgaagctcatgtg

SEQ ID NO: 7894910 - DNA, 22 bp, Homo sapiens
tcctgcagctgaagctcatgtg

SEQ ID NO: 7894911 - DNA, 22 bp, Homo sapiens
tcctgcagctgaagctcatgtg

SEQ ID NO: 7894912 - DNA, 22 bp, Homo sapiens
tcctgcagctctgagaagcatc

SEQ ID NO: 7894913 - DNA, 22 bp, Homo sapiens
tcctgcagctctgagaagcatc

SEQ ID NO: 7894914 - DNA, 22 bp, Homo sapiens
tcctgcagccttgggctggagc

SEQ ID NO: 7894915 - DNA, 22 bp, Homo sapiens
tcctgcagccttgggctggagc

SEQ ID NO: 7894916 - DNA, 22 bp, Homo sapiens
tcctgcagctgaagctcatgtg

SEQ ID NO: 7894917 - DNA, 22 bp, Homo sapiens
tcctgcagctgaagctcatgtg

SEQ ID NO: 7894918 - DNA, 22 bp, Homo sapiens
tcctgcagatcaaagcctttga

SEQ ID NO: 7894919 - DNA, 22 bp, Homo sapiens
tcctgcagagtcccactgattt

SEQ ID NO: 7894920 - DNA, 23 bp, Homo sapiens
tcctgcagataagctggttgaca

SEQ ID NO: 7894921 - DNA, 22 bp, Homo sapiens
tcctgcagagtcccactgattt

SEQ ID NO: 7894922 - DNA, 22 bp, Homo sapiens
tcctgcagagccgccctcaggt

SEQ ID NO: 7894923 - DNA, 22 bp, Homo sapiens
tcctgcagagccgccctcaggt

SEQ ID NO: 7894924 - DNA, 22 bp, Homo sapiens
tcctgcagagacagaggcctca

SEQ ID NO: 7894925 - DNA, 22 bp, Homo sapiens
tcctgcagagccgccctcaggt

SEQ ID NO: 7894926 - DNA, 22 bp, Homo sapiens
tcctgcagagccgccctcaggt

SEQ ID NO: 7894927 - DNA, 22 bp, Homo sapiens
tcctgcagccaagggtcatcga

SEQ ID NO: 7894928 - DNA, 22 bp, Homo sapiens
tcctgcagcatccgtcgtctgt

SEQ ID NO: 7894929 - DNA, 22 bp, Homo sapiens
tcctgcagcatccgtcgtctgt

SEQ ID NO: 7894930 - DNA, 22 bp, Homo sapiens
tcctgcagccaagggtcatcga

SEQ ID NO: 7894931 - DNA, 22 bp, Homo sapiens
tcctgcagccaagggtcatcga

SEQ ID NO: 7894932 - DNA, 22 bp, Homo sapiens
tcctgcagccactgcaggcaga

SEQ ID NO: 7894933 - DNA, 22 bp, Homo sapiens
tcctgcagccactgcaggcaga

SEQ ID NO: 7894934 - DNA, 22 bp, Homo sapiens
tcctgcagccattagaggtcaa

SEQ ID NO: 7894935 - DNA, 22 bp, Homo sapiens
tcctgcagccattagaggtcaa

SEQ ID NO: 7894936 - DNA, 22 bp, Homo sapiens
tcctgcagccttgggctggagc

SEQ ID NO: 7894937 - DNA, 22 bp, Homo sapiens
tcctgcagccttgggctggagc

SEQ ID NO: 7894938 - DNA, 22 bp, Homo sapiens
tcctgcagccactgcaggcaga

SEQ ID NO: 7894939 - DNA, 22 bp, Homo sapiens
tcctgcagccactgcaggcaga

SEQ ID NO: 7894940 - DNA, 22 bp, Homo sapiens
tcctgcagccactgcaggcaga

SEQ ID NO: 7894941 - DNA, 22 bp, Homo sapiens
tcctgatgtgcacttgcacctc

SEQ ID NO: 7894942 - DNA, 22 bp, Homo sapiens
tcctgatggttctctggttctt

SEQ ID NO: 7894943 - DNA, 21 bp, Homo sapiens
tcctgatgtgtaaaaggcagg

SEQ ID NO: 7894944 - DNA, 22 bp, Homo sapiens
tcctgcacaccttgagcttgga

SEQ ID NO: 7894945 - DNA, 22 bp, Homo sapiens
tcctgcacattagtatttttta

SEQ ID NO: 7894946 - DNA, 22 bp, Homo sapiens
tcctgcacagttggtgcttgaa

SEQ ID NO: 7894947 - DNA, 22 bp, Homo sapiens
tcctgcacagcctaagtagaaa

SEQ ID NO: 7894948 - DNA, 22 bp, Homo sapiens
tcctgcacactgatgagatcac

SEQ ID NO: 7894949 - DNA, 21 bp, Homo sapiens
tcctgcagaatgccttcctac

SEQ ID NO: 7894950 - DNA, 21 bp, Homo sapiens
tcctgcagaatgccttcctac

SEQ ID NO: 7894951 - DNA, 22 bp, Homo sapiens
tcctgcagacatttacaccttt

SEQ ID NO: 7894952 - DNA, 21 bp, Homo sapiens
tcctgcagaatgccttcctac

SEQ ID NO: 7894953 - DNA, 21 bp, Homo sapiens
tcctgcagaatgccttcctac

SEQ ID NO: 7894954 - DNA, 19 bp, Homo sapiens
tcctgcagaccagacctgt

SEQ ID NO: 7894955 - DNA, 19 bp, Homo sapiens
tcctgcagaccagacctgt

SEQ ID NO: 7894956 - DNA, 19 bp, Homo sapiens
tcctgcagaccagacctgt

SEQ ID NO: 7894957 - DNA, 19 bp, Homo sapiens
tcctgcagaccagacctgt

SEQ ID NO: 7894958 - DNA, 22 bp, Homo sapiens
tcctgcagagacagaggcctca

SEQ ID NO: 7894959 - DNA, 22 bp, Homo sapiens
tcctgcagacctcagtcaggtc

SEQ ID NO: 7894960 - DNA, 22 bp, Homo sapiens
tcctgcagacctcagtcaggtc

SEQ ID NO: 7894961 - DNA, 22 bp, Homo sapiens
tcctgcagagacagaggcctca

SEQ ID NO: 7894962 - DNA, 22 bp, Homo sapiens
tcctgcagagacagaggcctca

SEQ ID NO: 7894963 - DNA, 22 bp, Homo sapiens
tcctgcagacctcagtcaggtc

SEQ ID NO: 7894964 - DNA, 19 bp, Homo sapiens
tcctgcagaccagacctgt

SEQ ID NO: 7894965 - DNA, 19 bp, Homo sapiens
tcctgcagaccagacctgt

SEQ ID NO: 7894966 - DNA, 22 bp, Homo sapiens
tcctgcagacctcagtcaggtc

SEQ ID NO: 7894967 - DNA, 22 bp, Homo sapiens
tcctgcctcttttcttattcca

SEQ ID NO: 7894968 - DNA, 22 bp, Homo sapiens
tcctgcctcttttcttattcca

SEQ ID NO: 7894969 - DNA, 22 bp, Homo sapiens
tcctgcctcttttcttattcca

SEQ ID NO: 7894970 - DNA, 22 bp, Homo sapiens
tcctgcctcttgccttcttcac

SEQ ID NO: 7894971 - DNA, 22 bp, Homo sapiens
tcctgcctcttgccttcttcac

SEQ ID NO: 7894972 - DNA, 22 bp, Homo sapiens
tcctgcctcttgccttcttcac

SEQ ID NO: 7894973 - DNA, 22 bp, Homo sapiens
tcctgcctcttgccttcttcac

SEQ ID NO: 7894974 - DNA, 22 bp, Homo sapiens
tcctgcctcttgccttcttcac

SEQ ID NO: 7894975 - DNA, 22 bp, Homo sapiens
tcctgcctctccatgctaacta

SEQ ID NO: 7894976 - DNA, 22 bp, Homo sapiens
tcctgcctctccatgctaacta

SEQ ID NO: 7894977 - DNA, 22 bp, Homo sapiens
tcctgcctctccatgctaacta

SEQ ID NO: 7894978 - DNA, 22 bp, Homo sapiens
tcctgcctgcaatcccagcact

SEQ ID NO: 7894979 - DNA, 22 bp, Homo sapiens
tcctgcctgagcgtggaggagg

SEQ ID NO: 7894980 - DNA, 22 bp, Homo sapiens
tcctgcctgcaatcccagcact

SEQ ID NO: 7894981 - DNA, 22 bp, Homo sapiens
tcctgcctgcaatcccagcact

SEQ ID NO: 7894982 - DNA, 22 bp, Homo sapiens
tcctgcctgcaatcccagcact

SEQ ID NO: 7894983 - DNA, 22 bp, Homo sapiens
tcctgcctgagcgtggaggagg

SEQ ID NO: 7894984 - DNA, 22 bp, Homo sapiens
tcctgcctcttttcttattcca

SEQ ID NO: 7894985 - DNA, 22 bp, Homo sapiens
tcctgcctcttttcttattcca

SEQ ID NO: 7894986 - DNA, 22 bp, Homo sapiens
tcctgcctgagcgtggaggagg

SEQ ID NO: 7894987 - DNA, 22 bp, Homo sapiens
tcctgcctgagcgtggaggagg

SEQ ID NO: 7894988 - DNA, 22 bp, Homo sapiens
tcctgcctgcaatcccagcact

SEQ ID NO: 7894989 - DNA, 22 bp, Homo sapiens
tcctgcctctccatgctaacta

SEQ ID NO: 7894990 - DNA, 22 bp, Homo sapiens
tcctgcctcaggctctggagta

SEQ ID NO: 7894991 - DNA, 22 bp, Homo sapiens
tcctgcctcaggctctggagta

SEQ ID NO: 7894992 - DNA, 22 bp, Homo sapiens
tcctgcctcaggctctggagta

SEQ ID NO: 7894993 - DNA, 22 bp, Homo sapiens
tcctgcctcaggctctggagta

SEQ ID NO: 7894994 - DNA, 22 bp, Homo sapiens
tcctgcctcaggctctggagta

SEQ ID NO: 7894995 - DNA, 22 bp, Homo sapiens
tcctgcctcaggctctggagta

SEQ ID NO: 7894996 - DNA, 22 bp, Homo sapiens
tcctgcctcacagttgaagttt

SEQ ID NO: 7894997 - DNA, 22 bp, Homo sapiens
tcctgcctcacagttgaagttt

SEQ ID NO: 7894998 - DNA, 22 bp, Homo sapiens
tcctgcctagcaggtgacctat

SEQ ID NO: 7894999 - DNA, 22 bp, Homo sapiens
tcctgcctcaggctctggagta

SEQ ID NO: 7895000 - DNA, 22 bp, Homo sapiens
tcctgcctcacagttgaagttt

SEQ ID NO: 7895001 - DNA, 22 bp, Homo sapiens
tcctgcctaccttgcggaggtg

SEQ ID NO: 7895002 - DNA, 22 bp, Homo sapiens
tcctgcctaccttgcggaggtg

SEQ ID NO: 7895003 - DNA, 22 bp, Homo sapiens
tcctgcctagcaggtgacctat

SEQ ID NO: 7895004 - DNA, 22 bp, Homo sapiens
tcctgcctaccttgcggaggtg

SEQ ID NO: 7895005 - DNA, 22 bp, Homo sapiens
tcctgcctaccttgcggaggtg

SEQ ID NO: 7895006 - DNA, 22 bp, Homo sapiens
tcctgcctagcaggtgacctat

SEQ ID NO: 7895007 - DNA, 22 bp, Homo sapiens
tcctgcctagcaggtgacctat

SEQ ID NO: 7895008 - DNA, 22 bp, Homo sapiens
tcctgcctagcaggtgacctat

SEQ ID NO: 7895009 - DNA, 22 bp, Homo sapiens
tcctgcctcacagttgaagttt

SEQ ID NO: 7895010 - DNA, 22 bp, Homo sapiens
tcctgcctagcaggtgacctat

SEQ ID NO: 7895011 - DNA, 22 bp, Homo sapiens
tcctgcctagcaggtgacctat

SEQ ID NO: 7895012 - DNA, 22 bp, Homo sapiens
tcagtgttttaactgtctttta

SEQ ID NO: 7895013 - DNA, 22 bp, Homo sapiens
tcagtgttttccagggtctact

SEQ ID NO: 7895014 - DNA, 22 bp, Homo sapiens
tcagtgtttgtggcaaatgtta

SEQ ID NO: 7895015 - DNA, 22 bp, Homo sapiens
tcagtgtttcctgtggtacagc

SEQ ID NO: 7895016 - DNA, 22 bp, Homo sapiens
tcagtgtttgaacccagggtta

SEQ ID NO: 7895017 - DNA, 22 bp, Homo sapiens
tcagttaacaactatttattga

SEQ ID NO: 7895018 - DNA, 22 bp, Homo sapiens
tcagttaacggaaaggggtgtg

SEQ ID NO: 7895019 - DNA, 22 bp, Homo sapiens
tcagttaagactgcactggact

SEQ ID NO: 7895020 - DNA, 23 bp, Homo sapiens
tcagttaactgtgttacctgtgc

SEQ ID NO: 7895021 - DNA, 22 bp, Homo sapiens
tcagtgttttccagggtctact

SEQ ID NO: 7895022 - DNA, 22 bp, Homo sapiens
tcagttaacaactatttattga

SEQ ID NO: 7895023 - DNA, 20 bp, Homo sapiens
tcagttaagttgctgaatct

SEQ ID NO: 7895024 - DNA, 22 bp, Homo sapiens
tcagttaagcactataccctaa

SEQ ID NO: 7895025 - DNA, 22 bp, Homo sapiens
tcagttaagaggccacggcagt

SEQ ID NO: 7895026 - DNA, 22 bp, Homo sapiens
tcagttaatcaatgtggtctaa

SEQ ID NO: 7895027 - DNA, 22 bp, Homo sapiens
tcagttaatatgggtaaagcat

SEQ ID NO: 7895028 - DNA, 22 bp, Homo sapiens
tcagttaatggattctgtcaga

SEQ ID NO: 7895029 - DNA, 23 bp, Homo sapiens
tcataaatattagcacagtagga

SEQ ID NO: 7895030 - DNA, 23 bp, Homo sapiens
tcataaatattagcacagtagga

SEQ ID NO: 7895031 - DNA, 23 bp, Homo sapiens
tcataaatattagcacagtagga

SEQ ID NO: 7895032 - DNA, 23 bp, Homo sapiens
tcataaatattagcacagtagga

SEQ ID NO: 7895033 - DNA, 22 bp, Homo sapiens
tcataaatagttgtgcctgaat

SEQ ID NO: 7895034 - DNA, 22 bp, Homo sapiens
tcataaatagttgtgcctgaat

SEQ ID NO: 7895035 - DNA, 22 bp, Homo sapiens
tcataaatcatactccatttgc

SEQ ID NO: 7895036 - DNA, 22 bp, Homo sapiens
tcataaatcatactccatttgc

SEQ ID NO: 7895037 - DNA, 23 bp, Homo sapiens
tcataaatattagcacagtagga

SEQ ID NO: 7895038 - DNA, 22 bp, Homo sapiens
tcataaatcatactccatttgc

SEQ ID NO: 7895039 - DNA, 22 bp, Homo sapiens
tcataaatatttgtgggggctt

SEQ ID NO: 7895040 - DNA, 22 bp, Homo sapiens
tcataaagttatcaccaaatcc

SEQ ID NO: 7895041 - DNA, 22 bp, Homo sapiens
tcataaagttatcaccaaatcc

SEQ ID NO: 7895042 - DNA, 22 bp, Homo sapiens
tcataaagttatcaccaaatcc

SEQ ID NO: 7895043 - DNA, 22 bp, Homo sapiens
tcataaagttgttttaatggga

SEQ ID NO: 7895044 - DNA, 22 bp, Homo sapiens
tcataaagttgttttaatggga

SEQ ID NO: 7895045 - DNA, 22 bp, Homo sapiens
tcataaagttctaagaattgta

SEQ ID NO: 7895046 - DNA, 22 bp, Homo sapiens
tcataaagttctaagaattgta

SEQ ID NO: 7895047 - DNA, 22 bp, Homo sapiens
tcataaagttacccaaatttta

SEQ ID NO: 7895048 - DNA, 22 bp, Homo sapiens
tcataaagttacccaaatttta

SEQ ID NO: 7895049 - DNA, 22 bp, Homo sapiens
tcataaagtgaaggatgatggg

SEQ ID NO: 7895050 - DNA, 22 bp, Homo sapiens
tcagttaatggtaagggtgaaa

SEQ ID NO: 7895051 - DNA, 22 bp, Homo sapiens
tcataaagcttgcctgcagtgt

SEQ ID NO: 7895052 - DNA, 22 bp, Homo sapiens
tcataaagcttgcctgcagtgt

SEQ ID NO: 7895053 - DNA, 22 bp, Homo sapiens
tcagtccttggcatttaggagc

SEQ ID NO: 7895054 - DNA, 22 bp, Homo sapiens
tcagtctatccagctcagatcc

SEQ ID NO: 7895055 - DNA, 21 bp, Homo sapiens
tcagtcctgttagcctttggg

SEQ ID NO: 7895056 - DNA, 21 bp, Homo sapiens
tcagtcctgttagcctttggg

SEQ ID NO: 7895057 - DNA, 22 bp, Homo sapiens
tcagtccttatctggtgttcag

SEQ ID NO: 7895058 - DNA, 22 bp, Homo sapiens
tcagtccttatctggtgttcag

SEQ ID NO: 7895059 - DNA, 22 bp, Homo sapiens
tcagtccttggaggattctctt

SEQ ID NO: 7895060 - DNA, 22 bp, Homo sapiens
tcagtcctctctgggtttctta

SEQ ID NO: 7895061 - DNA, 22 bp, Homo sapiens
tcagtcctgatgacaggcccaa

SEQ ID NO: 7895062 - DNA, 22 bp, Homo sapiens
tcagtcctctctgggtttctta

SEQ ID NO: 7895063 - DNA, 22 bp, Homo sapiens
tcagtcctctctgggtttctta

SEQ ID NO: 7895064 - DNA, 22 bp, Homo sapiens
tcagtcctgatgacaggcccaa

SEQ ID NO: 7895065 - DNA, 22 bp, Homo sapiens
tcagtcctgatgacaggcccaa

SEQ ID NO: 7895066 - DNA, 22 bp, Homo sapiens
tcagtcctgggccggcatcctc

SEQ ID NO: 7895067 - DNA, 23 bp, Homo sapiens
tcagtcctgtaggggctccaggt

SEQ ID NO: 7895068 - DNA, 23 bp, Homo sapiens
tcagtcctgtaggggctccaggt

SEQ ID NO: 7895069 - DNA, 23 bp, Homo sapiens
tcagtcctgtaggggctccaggt

SEQ ID NO: 7895070 - DNA, 22 bp, Homo sapiens
tcagtcctgggccggcatcctc

SEQ ID NO: 7895071 - DNA, 23 bp, Homo sapiens
tcagtcctgtaggggctccaggt

SEQ ID NO: 7895072 - DNA, 22 bp, Homo sapiens
tcagtcctgggccggcatcctc

SEQ ID NO: 7895073 - DNA, 22 bp, Homo sapiens
tcagtatccacaaatgctcaaa

SEQ ID NO: 7895074 - DNA, 22 bp, Homo sapiens
tcagtatccacaaatgctcaaa

SEQ ID NO: 7895075 - DNA, 22 bp, Homo sapiens
tcagtatctactatcttgatga

SEQ ID NO: 7895076 - DNA, 22 bp, Homo sapiens
tcagtatctactatcttgatga

SEQ ID NO: 7895077 - DNA, 22 bp, Homo sapiens
tcagtcctacacgctcagggac

SEQ ID NO: 7895078 - DNA, 22 bp, Homo sapiens
tcagtcctatccaaactatata

SEQ ID NO: 7895079 - DNA, 22 bp, Homo sapiens
tcagtcctcctctcatagagag

SEQ ID NO: 7895080 - DNA, 22 bp, Homo sapiens
tcagtcctcctctcatagagag

SEQ ID NO: 7895081 - DNA, 18 bp, Homo sapiens
tcagtcctccatagagct

SEQ ID NO: 7895082 - DNA, 18 bp, Homo sapiens
tcagtcctccatagagct

SEQ ID NO: 7895083 - DNA, 22 bp, Homo sapiens
tcagtcctccacacaggcaccc

SEQ ID NO: 7895084 - DNA, 22 bp, Homo sapiens
tcagtcctccacacaggcaccc

SEQ ID NO: 7895085 - DNA, 22 bp, Homo sapiens
tcagtcctcacttggttctaag

SEQ ID NO: 7895086 - DNA, 22 bp, Homo sapiens
tcagtcctccacacaggcaccc

SEQ ID NO: 7895087 - DNA, 22 bp, Homo sapiens
tcagtcctccacacaggcaccc

SEQ ID NO: 7895088 - DNA, 22 bp, Homo sapiens
tcagtgttggcattcagaaatg

SEQ ID NO: 7895089 - DNA, 22 bp, Homo sapiens
tcagtgttggctacatctgcct

SEQ ID NO: 7895090 - DNA, 22 bp, Homo sapiens
tcagtgttggcattcagaaatg

SEQ ID NO: 7895091 - DNA, 22 bp, Homo sapiens
tcagtgttggtcaagaatcagt

SEQ ID NO: 7895092 - DNA, 22 bp, Homo sapiens
tcagtgtttattcaatgttatt

SEQ ID NO: 7895093 - DNA, 22 bp, Homo sapiens
tcagtgttcttatttaattagg

SEQ ID NO: 7895094 - DNA, 22 bp, Homo sapiens
tcagtgttctggatttggggca

SEQ ID NO: 7895095 - DNA, 22 bp, Homo sapiens
tcagtctcctttcctctagaca

SEQ ID NO: 7895096 - DNA, 22 bp, Homo sapiens
tcagtctcctttcctctagaca

SEQ ID NO: 7895097 - DNA, 22 bp, Homo sapiens
tcagtctcatcaactctattcc

SEQ ID NO: 7895098 - DNA, 22 bp, Homo sapiens
tcagtctcatcaactctattcc

SEQ ID NO: 7895099 - DNA, 22 bp, Homo sapiens
tcagtctccatctgcttgtctt

SEQ ID NO: 7895100 - DNA, 22 bp, Homo sapiens
tcatctgttgattttaagtctt

SEQ ID NO: 7895101 - DNA, 22 bp, Homo sapiens
tcatctgtttctctgtagttct

SEQ ID NO: 7895102 - DNA, 22 bp, Homo sapiens
tcatcttaggtgatgagacagt

SEQ ID NO: 7895103 - DNA, 22 bp, Homo sapiens
tcatcttgcagtgtgtgttctg

SEQ ID NO: 7895104 - DNA, 22 bp, Homo sapiens
tcatcttgctgccattgcttta

SEQ ID NO: 7895105 - DNA, 22 bp, Homo sapiens
tcatctgtgagtaaaggcacat

SEQ ID NO: 7895106 - DNA, 22 bp, Homo sapiens
tcatctgtgaataatgaactgg

SEQ ID NO: 7895107 - DNA, 22 bp, Homo sapiens
tcatctgttcatacacatgcgt

SEQ ID NO: 7895108 - DNA, 22 bp, Homo sapiens
tcatctgttatttatgcctgag

SEQ ID NO: 7895109 - DNA, 22 bp, Homo sapiens
tcatctgttatttatgcctgag

SEQ ID NO: 7895110 - DNA, 22 bp, Homo sapiens
tcatctgttcatacacatgcgt

SEQ ID NO: 7895111 - DNA, 22 bp, Homo sapiens
tcatctgttcatacacatgcgt

SEQ ID NO: 7895112 - DNA, 22 bp, Homo sapiens
tcatctgaccccatctattctc

SEQ ID NO: 7895113 - DNA, 22 bp, Homo sapiens
tcatctgggagcttgttagaaa

SEQ ID NO: 7895114 - DNA, 22 bp, Homo sapiens
tcatctgggagcttgttagaaa

SEQ ID NO: 7895115 - DNA, 21 bp, Homo sapiens
tcatctggtctggggcctgct

SEQ ID NO: 7895116 - DNA, 21 bp, Homo sapiens
tcatctggtctggggcctgct

SEQ ID NO: 7895117 - DNA, 22 bp, Homo sapiens
tcatctgtcatccacaaagctg

SEQ ID NO: 7895118 - DNA, 22 bp, Homo sapiens
tcatctgtcaaattgcaataag

SEQ ID NO: 7895119 - DNA, 22 bp, Homo sapiens
tcatctgtcatccacaaagctg

SEQ ID NO: 7895120 - DNA, 22 bp, Homo sapiens
tcatctgtctgagagacttctg

SEQ ID NO: 7895121 - DNA, 22 bp, Homo sapiens
tcatctgtctgagagacttctg

SEQ ID NO: 7895122 - DNA, 22 bp, Homo sapiens
tcatgcagataagaataagtaa

SEQ ID NO: 7895123 - DNA, 22 bp, Homo sapiens
tcatgcagatttggaggtattt

SEQ ID NO: 7895124 - DNA, 22 bp, Homo sapiens
tcatgcagataagaataagtaa

SEQ ID NO: 7895125 - DNA, 22 bp, Homo sapiens
tcatgcagagccagtcaggata

SEQ ID NO: 7895126 - DNA, 22 bp, Homo sapiens
tcatgcagataagaataagtaa

SEQ ID NO: 7895127 - DNA, 22 bp, Homo sapiens
tcatgcagagtagaaagggcaa

SEQ ID NO: 7895128 - DNA, 22 bp, Homo sapiens
tcatgcagagtagaaagggcaa

SEQ ID NO: 7895129 - DNA, 22 bp, Homo sapiens
tcatgcagagtagaaagggcaa

SEQ ID NO: 7895130 - DNA, 22 bp, Homo sapiens
tcatgcagagtagaaagggcaa

SEQ ID NO: 7895131 - DNA, 22 bp, Homo sapiens
tcatgcagataagaataagtaa

SEQ ID NO: 7895132 - DNA, 22 bp, Homo sapiens
tcatgcagaggaaggctagttt

SEQ ID NO: 7895133 - DNA, 22 bp, Homo sapiens
tcatgcagagccagtcaggata

SEQ ID NO: 7895134 - DNA, 22 bp, Homo sapiens
tcatgcagaggaaggctagttt

SEQ ID NO: 7895135 - DNA, 22 bp, Homo sapiens
tcatgcagaggaaggctagttt

SEQ ID NO: 7895136 - DNA, 22 bp, Homo sapiens
tcatgcagagtagaaagggcaa

SEQ ID NO: 7895137 - DNA, 22 bp, Homo sapiens
tcatgcagagtagaaagggcaa

SEQ ID NO: 7895138 - DNA, 22 bp, Homo sapiens
tcatgaaaatagatcagaaatt

SEQ ID NO: 7895139 - DNA, 22 bp, Homo sapiens
tcatgcagagccagtcaggata

SEQ ID NO: 7895140 - DNA, 23 bp, Homo sapiens
tcatgcagagaaggactgcttac

SEQ ID NO: 7895141 - DNA, 23 bp, Homo sapiens
tcatgcagagaaggactgcttac

SEQ ID NO: 7895142 - DNA, 23 bp, Homo sapiens
tcatgcagagaaggactgcttac

SEQ ID NO: 7895143 - DNA, 22 bp, Homo sapiens
tcatgaaaatagatcagaaatt

SEQ ID NO: 7895144 - DNA, 22 bp, Homo sapiens
tcatctttaccccttgcttcaa

SEQ ID NO: 7895145 - DNA, 22 bp, Homo sapiens
tcatctttaccccttgcttcaa

SEQ ID NO: 7895146 - DNA, 22 bp, Homo sapiens
tcatctttcctcaaaagatcca

SEQ ID NO: 7895147 - DNA, 22 bp, Homo sapiens
tcatctttcctcaaaagatcca

SEQ ID NO: 7895148 - DNA, 22 bp, Homo sapiens
tcatctttaccccttgcttcaa

SEQ ID NO: 7895149 - DNA, 22 bp, Homo sapiens
tcatctttgtatccctaacaca

SEQ ID NO: 7895150 - DNA, 22 bp, Homo sapiens
tcatgaaaaattttccatgtca

SEQ ID NO: 7895151 - DNA, 22 bp, Homo sapiens
tcatctttcctcaaaagatcca

SEQ ID NO: 7895152 - DNA, 22 bp, Homo sapiens
tcatctttgtatccctaacaca

SEQ ID NO: 7895153 - DNA, 22 bp, Homo sapiens
tcatctttcctcaaaagatcca

SEQ ID NO: 7895154 - DNA, 22 bp, Homo sapiens
tcatacattcagcagatatttg

SEQ ID NO: 7895155 - DNA, 22 bp, Homo sapiens
tcatacattcagcagatatttg

SEQ ID NO: 7895156 - DNA, 22 bp, Homo sapiens
tcatacattcagcagatatttg

SEQ ID NO: 7895157 - DNA, 22 bp, Homo sapiens
tcatagaaatggaaagtatatt

SEQ ID NO: 7895158 - DNA, 22 bp, Homo sapiens
tcatagaaatatcacgtctttt

SEQ ID NO: 7895159 - DNA, 22 bp, Homo sapiens
tcatagaaatggaaagtatatt

SEQ ID NO: 7895160 - DNA, 22 bp, Homo sapiens
tcatagaaatggaaagtatatt

SEQ ID NO: 7895161 - DNA, 22 bp, Homo sapiens
tcatagaaatggaaagtatatt

SEQ ID NO: 7895162 - DNA, 22 bp, Homo sapiens
tcatagaaatggaaagtatatt

SEQ ID NO: 7895163 - DNA, 22 bp, Homo sapiens
tcatagaaatggaaagtatatt

SEQ ID NO: 7895164 - DNA, 22 bp, Homo sapiens
tcatagaaatgtggccagaaac

SEQ ID NO: 7895165 - DNA, 22 bp, Homo sapiens
tcatagaagcaccagaagatat

SEQ ID NO: 7895166 - DNA, 22 bp, Homo sapiens
tcatagaagcaccagaagatat

SEQ ID NO: 7895167 - DNA, 22 bp, Homo sapiens
tcatagaaatgtggccagaaac

SEQ ID NO: 7895168 - DNA, 22 bp, Homo sapiens
tcatagaagcaccagaagatat

SEQ ID NO: 7895169 - DNA, 22 bp, Homo sapiens
tcatagaagcaccagaagatat

SEQ ID NO: 7895170 - DNA, 22 bp, Homo sapiens
tcatctgaaattgtatatgtag

SEQ ID NO: 7895171 - DNA, 22 bp, Homo sapiens
tcatagatgtgctgtgcacaaa

SEQ ID NO: 7895172 - DNA, 22 bp, Homo sapiens
tcatctgaccactttatctctc

SEQ ID NO: 7895173 - DNA, 22 bp, Homo sapiens
tcatagaatgagttaatgaact

SEQ ID NO: 7895174 - DNA, 22 bp, Homo sapiens
tcatagaatgagttaatgaact

SEQ ID NO: 7895175 - DNA, 22 bp, Homo sapiens
tcatagaatgagttaatgaact

SEQ ID NO: 7895176 - DNA, 18 bp, Homo sapiens
tcatagaagtgaatcaga

SEQ ID NO: 7895177 - DNA, 18 bp, Homo sapiens
tcatagaagtgaatcaga

SEQ ID NO: 7895178 - DNA, 22 bp, Homo sapiens
tcatagaaggaactgggagata

SEQ ID NO: 7895179 - DNA, 22 bp, Homo sapiens
tcatagaagtagtatccacatt

SEQ ID NO: 7895180 - DNA, 22 bp, Homo sapiens
tcatagaaggaactgggagata

SEQ ID NO: 7895181 - DNA, 22 bp, Homo sapiens
tcataaattctggtgctgtgag

SEQ ID NO: 7895182 - DNA, 22 bp, Homo sapiens
tcataaattagctgtctttgaa

SEQ ID NO: 7895183 - DNA, 22 bp, Homo sapiens
tcataaattatctatttggcta

SEQ ID NO: 7895184 - DNA, 22 bp, Homo sapiens
tcataaattctggtgctgtgag

SEQ ID NO: 7895185 - DNA, 22 bp, Homo sapiens
tcataaattgattatgtgcttt

SEQ ID NO: 7895186 - DNA, 22 bp, Homo sapiens
tcataaattgattatgtgcttt

SEQ ID NO: 7895187 - DNA, 22 bp, Homo sapiens
tcataaattatctatttggcta

SEQ ID NO: 7895188 - DNA, 22 bp, Homo sapiens
tcataaatgcagtgtcataaat

SEQ ID NO: 7895189 - DNA, 22 bp, Homo sapiens
tcataaatgcagtgtcataaat

SEQ ID NO: 7895190 - DNA, 22 bp, Homo sapiens
tcataaatgcagtgtcataaat

SEQ ID NO: 7895191 - DNA, 22 bp, Homo sapiens
tcataaattgattatgtgcttt

SEQ ID NO: 7895192 - DNA, 22 bp, Homo sapiens
tcataaattgattatgtgcttt

SEQ ID NO: 7895193 - DNA, 22 bp, Homo sapiens
tcataaattgattatgtgcttt

SEQ ID NO: 7895194 - DNA, 22 bp, Homo sapiens
tcataaattgggttggctgggt

SEQ ID NO: 7895195 - DNA, 22 bp, Homo sapiens
tcatacatctgtcctggagctc

SEQ ID NO: 7895196 - DNA, 22 bp, Homo sapiens
tcatacatcttgtatatctatc

SEQ ID NO: 7895197 - DNA, 22 bp, Homo sapiens
tcatacatcttgtatatctatc

SEQ ID NO: 7895198 - DNA, 22 bp, Homo sapiens
tcatacatcttgtatatctatc

SEQ ID NO: 7895199 - DNA, 22 bp, Homo sapiens
tcatacatgttgtgttcaaatg

SEQ ID NO: 7895200 - DNA, 22 bp, Homo sapiens
tcagtaaatgaatgaatatatg

SEQ ID NO: 7895201 - DNA, 22 bp, Homo sapiens
tcagtaaatgagcaaaaatttc

SEQ ID NO: 7895202 - DNA, 22 bp, Homo sapiens
tcagtaaatgaatgaatatatg

SEQ ID NO: 7895203 - DNA, 22 bp, Homo sapiens
tcagtaaatgagcaaaaatttc

SEQ ID NO: 7895204 - DNA, 22 bp, Homo sapiens
tcagtaaatgcttgcaggccga

SEQ ID NO: 7895205 - DNA, 22 bp, Homo sapiens
tcagtaaatgcttgcaggccga

SEQ ID NO: 7895206 - DNA, 22 bp, Homo sapiens
tcagtaaatgcctttctgtgaa

SEQ ID NO: 7895207 - DNA, 22 bp, Homo sapiens
tcagtaaatggttgctgttatt

SEQ ID NO: 7895208 - DNA, 23 bp, Homo sapiens
tcagtaaatggtaaagtctcttc

SEQ ID NO: 7895209 - DNA, 22 bp, Homo sapiens
tcagtaacttggccgaggtcat

SEQ ID NO: 7895210 - DNA, 22 bp, Homo sapiens
tcagtaaagttctttcttgctg

SEQ ID NO: 7895211 - DNA, 22 bp, Homo sapiens
tcagtaaataactcagatgctc

SEQ ID NO: 7895212 - DNA, 22 bp, Homo sapiens
tcagtaaagtctctagagggta

SEQ ID NO: 7895213 - DNA, 22 bp, Homo sapiens
tcagtaaagttctttcttgctg

SEQ ID NO: 7895214 - DNA, 22 bp, Homo sapiens
tcagtaaatctctaattggcat

SEQ ID NO: 7895215 - DNA, 22 bp, Homo sapiens
tcagtaaataactcagatgctc

SEQ ID NO: 7895216 - DNA, 22 bp, Homo sapiens
tcagtaaataactcagatgctc

SEQ ID NO: 7895217 - DNA, 22 bp, Homo sapiens
tcagtaaatgaatgaatatatg

SEQ ID NO: 7895218 - DNA, 22 bp, Homo sapiens
tcagtaaatctctaattggcat

SEQ ID NO: 7895219 - DNA, 22 bp, Homo sapiens
tcagtaaacaggtttaagtcct

SEQ ID NO: 7895220 - DNA, 22 bp, Homo sapiens
tcagtaaacaggtttaagtcct

SEQ ID NO: 7895221 - DNA, 22 bp, Homo sapiens
tcagtaaaattacagatctaca

SEQ ID NO: 7895222 - DNA, 22 bp, Homo sapiens
tcagtaaaattacagatctaca

SEQ ID NO: 7895223 - DNA, 22 bp, Homo sapiens
tcagtaaaattacagatctaca

SEQ ID NO: 7895224 - DNA, 22 bp, Homo sapiens
tcagtaaaggggaggtgatggg

SEQ ID NO: 7895225 - DNA, 22 bp, Homo sapiens
tcagtaaaggggaggtgatggg

SEQ ID NO: 7895226 - DNA, 22 bp, Homo sapiens
tcagtaaaggggaggtgatggg

SEQ ID NO: 7895227 - DNA, 22 bp, Homo sapiens
tcagtaaaggctaggttatgct

SEQ ID NO: 7895228 - DNA, 22 bp, Homo sapiens
tcagtaaaggctaggttatgct

SEQ ID NO: 7895229 - DNA, 22 bp, Homo sapiens
tcagtaaaggctaggttatgct

SEQ ID NO: 7895230 - DNA, 21 bp, Homo sapiens
tcagtaaacctaaagattgta

SEQ ID NO: 7895231 - DNA, 21 bp, Homo sapiens
tcagtaaacctaaagattgta

SEQ ID NO: 7895232 - DNA, 22 bp, Homo sapiens
tcagtaatattctttaaaatac

SEQ ID NO: 7895233 - DNA, 22 bp, Homo sapiens
tcagtaatattctttaaaatac

SEQ ID NO: 7895234 - DNA, 22 bp, Homo sapiens
tcagtaattacctatgactcga

SEQ ID NO: 7895235 - DNA, 23 bp, Homo sapiens
tcagtaccacagctgcatgacct

SEQ ID NO: 7895236 - DNA, 22 bp, Homo sapiens
tcagtacgtgggcagttccttc

SEQ ID NO: 7895237 - DNA, 22 bp, Homo sapiens
tcagtagcccttgagttcatgt

SEQ ID NO: 7895238 - DNA, 23 bp, Homo sapiens
tcagtagtcattgggaaagtgtg

SEQ ID NO: 7895239 - DNA, 22 bp, Homo sapiens
tcagtagtctaggatttcacct

SEQ ID NO: 7895240 - DNA, 23 bp, Homo sapiens
tcagtactctgctgggtatagag

SEQ ID NO: 7895241 - DNA, 22 bp, Homo sapiens
tcagtagcagaaagcaatgagt

SEQ ID NO: 7895242 - DNA, 23 bp, Homo sapiens
tcagtagtgcattgaataagtgc

SEQ ID NO: 7895243 - DNA, 22 bp, Homo sapiens
tcagtagtgtgccagtgggcat

SEQ ID NO: 7895244 - DNA, 22 bp, Homo sapiens
tcagtagttcagcaaatatttt

SEQ ID NO: 7895245 - DNA, 22 bp, Homo sapiens
tcagtagttcagcaaatatttt

SEQ ID NO: 7895246 - DNA, 22 bp, Homo sapiens
tcagtagtttctgctttgtgtt

SEQ ID NO: 7895247 - DNA, 22 bp, Homo sapiens
tcagtatcaggctggaattaag

SEQ ID NO: 7895248 - DNA, 22 bp, Homo sapiens
tcagtatccacaaatgctcaaa

SEQ ID NO: 7895249 - DNA, 22 bp, Homo sapiens
tcagtatcatgcggtagccatg

SEQ ID NO: 7895250 - DNA, 22 bp, Homo sapiens
tcagtagttttgatctgagcag

SEQ ID NO: 7895251 - DNA, 22 bp, Homo sapiens
tcagtatagcttctaaactaac

SEQ ID NO: 7895252 - DNA, 22 bp, Homo sapiens
tcagggcatactcttcaaggtc

SEQ ID NO: 7895253 - DNA, 21 bp, Homo sapiens
tcagggcagtgggaggttcct

SEQ ID NO: 7895254 - DNA, 22 bp, Homo sapiens
tcagggcatactcttcaaggtc

SEQ ID NO: 7895255 - DNA, 22 bp, Homo sapiens
tcagggcatactcttcaaggtc

SEQ ID NO: 7895256 - DNA, 22 bp, Homo sapiens
tcagggcatcatcatgaatata

SEQ ID NO: 7895257 - DNA, 22 bp, Homo sapiens
tcagggcatccattgcctgttg

SEQ ID NO: 7895258 - DNA, 22 bp, Homo sapiens
tcagggcatccattgcctgttg

SEQ ID NO: 7895259 - DNA, 22 bp, Homo sapiens
tcagggccggggctgtggcgag

SEQ ID NO: 7895260 - DNA, 22 bp, Homo sapiens
tcagggcctttgcagttgtttt

SEQ ID NO: 7895261 - DNA, 22 bp, Homo sapiens
tcagggcctgagcttttaatta

SEQ ID NO: 7895262 - DNA, 22 bp, Homo sapiens
tcagggccgccggggatctcgc

SEQ ID NO: 7895263 - DNA, 22 bp, Homo sapiens
tcagggccgccggggatctcgc

SEQ ID NO: 7895264 - DNA, 22 bp, Homo sapiens
tcagggcatctcttaagtggtg

SEQ ID NO: 7895265 - DNA, 22 bp, Homo sapiens
tcagggccctggacaaccctcc

SEQ ID NO: 7895266 - DNA, 22 bp, Homo sapiens
tcagggccctggcaggaaacag

SEQ ID NO: 7895267 - DNA, 19 bp, Homo sapiens
tcagggccgcagagggtac

SEQ ID NO: 7895268 - DNA, 22 bp, Homo sapiens
tcagggctgcatacaggagata

SEQ ID NO: 7895269 - DNA, 22 bp, Homo sapiens
tcagggctgcatacaggagata

SEQ ID NO: 7895270 - DNA, 22 bp, Homo sapiens
tcagggctgcatacaggagata

SEQ ID NO: 7895271 - DNA, 22 bp, Homo sapiens
tcagggctgcatacaggagata

SEQ ID NO: 7895272 - DNA, 22 bp, Homo sapiens
tcagtaaaagggtgctttactc

SEQ ID NO: 7895273 - DNA, 22 bp, Homo sapiens
tcagtaaaataaaacatgggac

SEQ ID NO: 7895274 - DNA, 22 bp, Homo sapiens
tcagtaaaagggtgctttactc

SEQ ID NO: 7895275 - DNA, 21 bp, Homo sapiens
tcagtaaaaaaactacctaga

SEQ ID NO: 7895276 - DNA, 22 bp, Homo sapiens
tcagtaaaacctgcttttagtg

SEQ ID NO: 7895277 - DNA, 22 bp, Homo sapiens
tcagggctgcagaagaggcagg

SEQ ID NO: 7895278 - DNA, 22 bp, Homo sapiens
tcagggctgcatacaggagata

SEQ ID NO: 7895279 - DNA, 22 bp, Homo sapiens
tcagggctgcatacaggagata

SEQ ID NO: 7895280 - DNA, 22 bp, Homo sapiens
tcagggctgcatacaggagata

SEQ ID NO: 7895281 - DNA, 22 bp, Homo sapiens
tcagggctgcagaagaggcagg

SEQ ID NO: 7895282 - DNA, 22 bp, Homo sapiens
tcagggctgcagaagaggcagg

SEQ ID NO: 7895283 - DNA, 22 bp, Homo sapiens
tcagggctgcagaagaggcagg

SEQ ID NO: 7895284 - DNA, 22 bp, Homo sapiens
tcagggctgcagaagaggcagg

SEQ ID NO: 7895285 - DNA, 22 bp, Homo sapiens
tcagggctgcagaagaggcagg

SEQ ID NO: 7895286 - DNA, 22 bp, Homo sapiens
tcagggctcaccagcctctgcc

SEQ ID NO: 7895287 - DNA, 22 bp, Homo sapiens
tcagggctcagcatctggcatt

SEQ ID NO: 7895288 - DNA, 22 bp, Homo sapiens
tcagggctcaccagcctctgcc

SEQ ID NO: 7895289 - DNA, 22 bp, Homo sapiens
tcagggctcagcatctggcatt

SEQ ID NO: 7895290 - DNA, 22 bp, Homo sapiens
tcagggctcagcatctggcatt

SEQ ID NO: 7895291 - DNA, 23 bp, Homo sapiens
tcagggctcacacgttttctggc

SEQ ID NO: 7895292 - DNA, 22 bp, Homo sapiens
tcagggctcaccagcctctgcc

SEQ ID NO: 7895293 - DNA, 22 bp, Homo sapiens
tcagggctccggaagtggcctc

SEQ ID NO: 7895294 - DNA, 22 bp, Homo sapiens
tcagggctgactgctactctcc

SEQ ID NO: 7895295 - DNA, 22 bp, Homo sapiens
tcagggctgactgctactctcc

SEQ ID NO: 7895296 - DNA, 22 bp, Homo sapiens
tcagggctgactgctactctcc

SEQ ID NO: 7895297 - DNA, 22 bp, Homo sapiens
tcagggctgactgctactctcc

SEQ ID NO: 7895298 - DNA, 22 bp, Homo sapiens
tcaggctggtggtcagatggct

SEQ ID NO: 7895299 - DNA, 22 bp, Homo sapiens
tcaggctgtaaatggtgtgggt

SEQ ID NO: 7895300 - DNA, 22 bp, Homo sapiens
tcaggctggtggtcagatggct

SEQ ID NO: 7895301 - DNA, 22 bp, Homo sapiens
tcaggctggtggtcagatggct

SEQ ID NO: 7895302 - DNA, 22 bp, Homo sapiens
tcaggctggtggtcagatggct

SEQ ID NO: 7895303 - DNA, 22 bp, Homo sapiens
tcaggctggtggtcagatggct

SEQ ID NO: 7895304 - DNA, 22 bp, Homo sapiens
tcaggctgtaaatggtgtgggt

SEQ ID NO: 7895305 - DNA, 22 bp, Homo sapiens
tcaggctgtaaatggtgtgggt

SEQ ID NO: 7895306 - DNA, 22 bp, Homo sapiens
tcaggctgtaaatggtgtgggt

SEQ ID NO: 7895307 - DNA, 22 bp, Homo sapiens
tcaggctgtaaatggtgtgggt

SEQ ID NO: 7895308 - DNA, 22 bp, Homo sapiens
tcaggctgtaaatggtgtgggt

SEQ ID NO: 7895309 - DNA, 22 bp, Homo sapiens
tcaggctgtaaatggtgtgggt

SEQ ID NO: 7895310 - DNA, 22 bp, Homo sapiens
tcaggctgtaaatggtgtgggt

SEQ ID NO: 7895311 - DNA, 22 bp, Homo sapiens
tcaggctgtagggcccctggag

SEQ ID NO: 7895312 - DNA, 22 bp, Homo sapiens
tcaggctggtccccacagtgga

SEQ ID NO: 7895313 - DNA, 22 bp, Homo sapiens
tcaggctggtccccacagtgga

SEQ ID NO: 7895314 - DNA, 22 bp, Homo sapiens
tcaggctggtccccacagtgga

SEQ ID NO: 7895315 - DNA, 22 bp, Homo sapiens
tcaggctggtccccacagtgga

SEQ ID NO: 7895316 - DNA, 22 bp, Homo sapiens
tcaggctggtccccacagtgga

SEQ ID NO: 7895317 - DNA, 22 bp, Homo sapiens
tcaggctggtccccacagtgga

SEQ ID NO: 7895318 - DNA, 20 bp, Homo sapiens
tcaggctggtgggctttccc

SEQ ID NO: 7895319 - DNA, 20 bp, Homo sapiens
tcaggctggtgggctttccc

SEQ ID NO: 7895320 - DNA, 22 bp, Homo sapiens
tcaggctggtggtcagatggct

SEQ ID NO: 7895321 - DNA, 22 bp, Homo sapiens
tcaggctggtggtcagatggct

SEQ ID NO: 7895322 - DNA, 22 bp, Homo sapiens
tcaggctggtggtcagatggct

SEQ ID NO: 7895323 - DNA, 20 bp, Homo sapiens
tcaggctggtgggctttccc

SEQ ID NO: 7895324 - DNA, 22 bp, Homo sapiens
tcaggctggtggtcagatggct

SEQ ID NO: 7895325 - DNA, 20 bp, Homo sapiens
tcaggctggtgggctttccc

SEQ ID NO: 7895326 - DNA, 22 bp, Homo sapiens
tcaggagacttatgtcacagtg

SEQ ID NO: 7895327 - DNA, 22 bp, Homo sapiens
tcaggagacttatgtcacagtg

SEQ ID NO: 7895328 - DNA, 22 bp, Homo sapiens
tcaggagacttatgtcacagtg

SEQ ID NO: 7895329 - DNA, 22 bp, Homo sapiens
tcaggagacttatgtcacagtg

SEQ ID NO: 7895330 - DNA, 22 bp, Homo sapiens
tcaggagacttatgtcacagtg

SEQ ID NO: 7895331 - DNA, 22 bp, Homo sapiens
tcaggagagaaagaatacaatt

SEQ ID NO: 7895332 - DNA, 22 bp, Homo sapiens
tcaggagacttatgtcacagtg

SEQ ID NO: 7895333 - DNA, 22 bp, Homo sapiens
tcaggagagaaagaatacaatt

SEQ ID NO: 7895334 - DNA, 22 bp, Homo sapiens
tcaggagagaaagaatacaatt

SEQ ID NO: 7895335 - DNA, 22 bp, Homo sapiens
tcaggagagagaaattggggct

SEQ ID NO: 7895336 - DNA, 22 bp, Homo sapiens
tcaggagagagaaattggggct

SEQ ID NO: 7895337 - DNA, 22 bp, Homo sapiens
tcaggagagagttgggtaggct

SEQ ID NO: 7895338 - DNA, 22 bp, Homo sapiens
tcaggagagagttgggtaggct

SEQ ID NO: 7895339 - DNA, 21 bp, Homo sapiens
tcaggagagcccatctacaaa

SEQ ID NO: 7895340 - DNA, 17 bp, Homo sapiens
tcaggctgggtgcagtg

SEQ ID NO: 7895341 - DNA, 21 bp, Homo sapiens
tcaggagagcccatctacaaa

SEQ ID NO: 7895342 - DNA, 21 bp, Homo sapiens
tcaggagagcccatctacaaa

SEQ ID NO: 7895343 - DNA, 21 bp, Homo sapiens
tcaggagagcccatctacaaa

SEQ ID NO: 7895344 - DNA, 17 bp, Homo sapiens
tcaggctgggtgcagtg

SEQ ID NO: 7895345 - DNA, 17 bp, Homo sapiens
tcaggctgggtgcagtg

SEQ ID NO: 7895346 - DNA, 17 bp, Homo sapiens
tcaggctgggtgcagtg

SEQ ID NO: 7895347 - DNA, 17 bp, Homo sapiens
tcaggctgggtgcagtg

SEQ ID NO: 7895348 - DNA, 17 bp, Homo sapiens
tcaggctgggtgcagtg

SEQ ID NO: 7895349 - DNA, 17 bp, Homo sapiens
tcaggctgggtgcagtg

SEQ ID NO: 7895350 - DNA, 22 bp, Homo sapiens
tcaggctgttagccacctcctc

SEQ ID NO: 7895351 - DNA, 22 bp, Homo sapiens
tcaggctgttcctgtccaaaat

SEQ ID NO: 7895352 - DNA, 22 bp, Homo sapiens
tcaggctgttcctgtccaaaat

SEQ ID NO: 7895353 - DNA, 22 bp, Homo sapiens
tcaggcttccaacaatgatgtt

SEQ ID NO: 7895354 - DNA, 22 bp, Homo sapiens
tcaggctgttcctgtccaaaat

SEQ ID NO: 7895355 - DNA, 22 bp, Homo sapiens
tcaggctgtagggcccctggag

SEQ ID NO: 7895356 - DNA, 22 bp, Homo sapiens
tcaggctgtagggcccctggag

SEQ ID NO: 7895357 - DNA, 22 bp, Homo sapiens
tcaggctgtatatcttgcactc

SEQ ID NO: 7895358 - DNA, 22 bp, Homo sapiens
tcaggctgttagccacctcctc

SEQ ID NO: 7895359 - DNA, 22 bp, Homo sapiens
tcaggctgtatatcttgcactc

SEQ ID NO: 7895360 - DNA, 22 bp, Homo sapiens
tcaggctgtatatcttgcactc

SEQ ID NO: 7895361 - DNA, 22 bp, Homo sapiens
tcaggcttgtctctagagcaat

SEQ ID NO: 7895362 - DNA, 22 bp, Homo sapiens
tcaggctttccgaagcgcgcgg

SEQ ID NO: 7895363 - DNA, 22 bp, Homo sapiens
tcaggcttgggaggcccagggc

SEQ ID NO: 7895364 - DNA, 22 bp, Homo sapiens
tcaggcttggtgctccagtgcc

SEQ ID NO: 7895365 - DNA, 22 bp, Homo sapiens
tcaggcttgtctctagagcaat

SEQ ID NO: 7895366 - DNA, 22 bp, Homo sapiens
tcaggcttgaggtctgtatgtg

SEQ ID NO: 7895367 - DNA, 22 bp, Homo sapiens
tcaggcttgcgatggaagtcac

SEQ ID NO: 7895368 - DNA, 22 bp, Homo sapiens
tcaggcttccaggctctgctga

SEQ ID NO: 7895369 - DNA, 19 bp, Homo sapiens
tcagggcagtccggtcccc

SEQ ID NO: 7895370 - DNA, 21 bp, Homo sapiens
tcagggcagtgggaggttcct

SEQ ID NO: 7895371 - DNA, 22 bp, Homo sapiens
tcagggcaggttaacttgggtg

SEQ ID NO: 7895372 - DNA, 22 bp, Homo sapiens
tcagggcaggttaacttgggtg

SEQ ID NO: 7895373 - DNA, 22 bp, Homo sapiens
tcagggcaggcgagcagctgct

SEQ ID NO: 7895374 - DNA, 22 bp, Homo sapiens
tcagggcaggcgagcagctgct

SEQ ID NO: 7895375 - DNA, 22 bp, Homo sapiens
tcagggcaggcgagcagctgct

SEQ ID NO: 7895376 - DNA, 18 bp, Homo sapiens
tcaggctttgagagaatc

SEQ ID NO: 7895377 - DNA, 22 bp, Homo sapiens
tcaggcttttcctgcctcctac

SEQ ID NO: 7895378 - DNA, 22 bp, Homo sapiens
tcaggcttttcttccctcagtg

SEQ ID NO: 7895379 - DNA, 21 bp, Homo sapiens
tcagggcagctgctcttcaga

SEQ ID NO: 7895380 - DNA, 22 bp, Homo sapiens
tcagggcaggcgagcagctgct

SEQ ID NO: 7895381 - DNA, 22 bp, Homo sapiens
tcagggcaggacagtgtaggcc

SEQ ID NO: 7895382 - DNA, 22 bp, Homo sapiens
tcagggcaggacagtgtaggcc

SEQ ID NO: 7895383 - DNA, 22 bp, Homo sapiens
tccaatgttcctgctttcagct

SEQ ID NO: 7895384 - DNA, 23 bp, Homo sapiens
tccaattcaattgggtcaggaag

SEQ ID NO: 7895385 - DNA, 20 bp, Homo sapiens
tccaattaaaaattgtatgc

SEQ ID NO: 7895386 - DNA, 19 bp, Homo sapiens
tccaatttctattcatgtt

SEQ ID NO: 7895387 - DNA, 22 bp, Homo sapiens
tccaatatttctcatatatgga

SEQ ID NO: 7895388 - DNA, 22 bp, Homo sapiens
tccaatatttctcacatatgga

SEQ ID NO: 7895389 - DNA, 22 bp, Homo sapiens
tccaatatttctcatatatgga

SEQ ID NO: 7895390 - DNA, 22 bp, Homo sapiens
tccaatcagggaaagccaggtc

SEQ ID NO: 7895391 - DNA, 22 bp, Homo sapiens
tccaatcatgagtctatactag

SEQ ID NO: 7895392 - DNA, 22 bp, Homo sapiens
tccaatcatgagtctatactag

SEQ ID NO: 7895393 - DNA, 22 bp, Homo sapiens
tccaatatttctcatatatgga

SEQ ID NO: 7895394 - DNA, 22 bp, Homo sapiens
tccaatcaactctggactcctg

SEQ ID NO: 7895395 - DNA, 22 bp, Homo sapiens
tccaatcaattgttctacctga

SEQ ID NO: 7895396 - DNA, 22 bp, Homo sapiens
tccaatcagctcctatgagaat

SEQ ID NO: 7895397 - DNA, 22 bp, Homo sapiens
tccaagttgatgtttcttaaat

SEQ ID NO: 7895398 - DNA, 22 bp, Homo sapiens
tccaagtttcttctgcacaaca

SEQ ID NO: 7895399 - DNA, 22 bp, Homo sapiens
tccaagtttcttctgcacaaca

SEQ ID NO: 7895400 - DNA, 22 bp, Homo sapiens
tccaagtttcttctgcacaaca

SEQ ID NO: 7895401 - DNA, 22 bp, Homo sapiens
tccaagttctaggaactgctgc

SEQ ID NO: 7895402 - DNA, 21 bp, Homo sapiens
tccaagtctggggcatgtgtg

SEQ ID NO: 7895403 - DNA, 22 bp, Homo sapiens
tccaagttctaggaactgctgc

SEQ ID NO: 7895404 - DNA, 20 bp, Homo sapiens
tccaagttataaagtgccaa

SEQ ID NO: 7895405 - DNA, 22 bp, Homo sapiens
tccaaggctccggccctggcgt

SEQ ID NO: 7895406 - DNA, 22 bp, Homo sapiens
tccaaggctccggccctggcgt

SEQ ID NO: 7895407 - DNA, 22 bp, Homo sapiens
tccaagggaaactgcacttcta

SEQ ID NO: 7895408 - DNA, 22 bp, Homo sapiens
tccaaggccgcaggctgggcct

SEQ ID NO: 7895409 - DNA, 22 bp, Homo sapiens
tccaaggccgcaggctgggcct

SEQ ID NO: 7895410 - DNA, 22 bp, Homo sapiens
tccaaggccgcaggctgggcct

SEQ ID NO: 7895411 - DNA, 22 bp, Homo sapiens
tccaaggccgcaggctgggcct

SEQ ID NO: 7895412 - DNA, 22 bp, Homo sapiens
tccaagggaatgtgggcaatgc

SEQ ID NO: 7895413 - DNA, 22 bp, Homo sapiens
tccaagggcagcagccatagcc

SEQ ID NO: 7895414 - DNA, 22 bp, Homo sapiens
tccaagggcagcagccatagcc

SEQ ID NO: 7895415 - DNA, 23 bp, Homo sapiens
tccaaggttgttgtggaaggggc

SEQ ID NO: 7895416 - DNA, 22 bp, Homo sapiens
tccaagtcttccttcccaaacc

SEQ ID NO: 7895417 - DNA, 21 bp, Homo sapiens
tccaagtctggggcatgtgtg

SEQ ID NO: 7895418 - DNA, 22 bp, Homo sapiens
tccaagtataaattagatactg

SEQ ID NO: 7895419 - DNA, 22 bp, Homo sapiens
tccaagtataaattagatactg

SEQ ID NO: 7895420 - DNA, 22 bp, Homo sapiens
tccaagtataaattagatactg

SEQ ID NO: 7895421 - DNA, 22 bp, Homo sapiens
tccaagtccattatggtggtct

SEQ ID NO: 7895422 - DNA, 22 bp, Homo sapiens
tccaagggcatgctgaaataag

SEQ ID NO: 7895423 - DNA, 22 bp, Homo sapiens
tccaaattctagggccttggtt

SEQ ID NO: 7895424 - DNA, 22 bp, Homo sapiens
tccaaatattcggtctttctga

SEQ ID NO: 7895425 - DNA, 21 bp, Homo sapiens
tccaaatcccattctgtagtc

SEQ ID NO: 7895426 - DNA, 22 bp, Homo sapiens
tccaaatattcggtctttctga

SEQ ID NO: 7895427 - DNA, 22 bp, Homo sapiens
tccaaatattcggtctttctga

SEQ ID NO: 7895428 - DNA, 22 bp, Homo sapiens
tccaaatattcatctacttctg

SEQ ID NO: 7895429 - DNA, 22 bp, Homo sapiens
tccaaatattcatctacttctg

SEQ ID NO: 7895430 - DNA, 22 bp, Homo sapiens
tccaaatattcatctacttctg

SEQ ID NO: 7895431 - DNA, 22 bp, Homo sapiens
tccaaatattcatctacttctg

SEQ ID NO: 7895432 - DNA, 22 bp, Homo sapiens
tccaaatattatgattatagga

SEQ ID NO: 7895433 - DNA, 22 bp, Homo sapiens
tccaaatatattcacgtcctag

SEQ ID NO: 7895434 - DNA, 22 bp, Homo sapiens
tccaaatatattcacgtcctag

SEQ ID NO: 7895435 - DNA, 22 bp, Homo sapiens
tccaaatattatgattatagga

SEQ ID NO: 7895436 - DNA, 22 bp, Homo sapiens
tccaaatattatgattatagga

SEQ ID NO: 7895437 - DNA, 22 bp, Homo sapiens
tccaaatatcttggtggttagg

SEQ ID NO: 7895438 - DNA, 22 bp, Homo sapiens
tccaaatatcttggtggttagg

SEQ ID NO: 7895439 - DNA, 22 bp, Homo sapiens
tccaaattgacagtagtgatta

SEQ ID NO: 7895440 - DNA, 22 bp, Homo sapiens
tccaacatttatcaaggttgtt

SEQ ID NO: 7895441 - DNA, 22 bp, Homo sapiens
tccaacatgcagtcaggcctag

SEQ ID NO: 7895442 - DNA, 22 bp, Homo sapiens
tccaagaagagcctttctcctc

SEQ ID NO: 7895443 - DNA, 22 bp, Homo sapiens
tccaagaagctcagcaaacatc

SEQ ID NO: 7895444 - DNA, 22 bp, Homo sapiens
tccaagaagctcagcaaacatc

SEQ ID NO: 7895445 - DNA, 22 bp, Homo sapiens
tccaactttctcctccggcttg

SEQ ID NO: 7895446 - DNA, 22 bp, Homo sapiens
tccaactttctcctccggcttg

SEQ ID NO: 7895447 - DNA, 22 bp, Homo sapiens
tccaactttctcctccggcttg

SEQ ID NO: 7895448 - DNA, 22 bp, Homo sapiens
tccaaggagtcttaagttacat

SEQ ID NO: 7895449 - DNA, 22 bp, Homo sapiens
tccaaggcatagacacagtgcc

SEQ ID NO: 7895450 - DNA, 19 bp, Homo sapiens
tccaaggcatggcccagtg

SEQ ID NO: 7895451 - DNA, 19 bp, Homo sapiens
tccaaggcatggcccagtg

SEQ ID NO: 7895452 - DNA, 22 bp, Homo sapiens
tccaaggactcttgtcagctgt

SEQ ID NO: 7895453 - DNA, 22 bp, Homo sapiens
tccaaggagcagatccagagga

SEQ ID NO: 7895454 - DNA, 22 bp, Homo sapiens
tccaaggagcagatccagagga

SEQ ID NO: 7895455 - DNA, 22 bp, Homo sapiens
tccaaggaggagctggagattg

SEQ ID NO: 7895456 - DNA, 22 bp, Homo sapiens
tccaaggagcagtcttcaacct

SEQ ID NO: 7895457 - DNA, 22 bp, Homo sapiens
tccaaggaggagctggagattg

SEQ ID NO: 7895458 - DNA, 22 bp, Homo sapiens
tccaaggaggctttgacgtcca

SEQ ID NO: 7895459 - DNA, 22 bp, Homo sapiens
tccaaggacattgttctagttg

SEQ ID NO: 7895460 - DNA, 22 bp, Homo sapiens
tccaaggactaaattctagatt

SEQ ID NO: 7895461 - DNA, 22 bp, Homo sapiens
tccaaggacattgttctagttg

SEQ ID NO: 7895462 - DNA, 22 bp, Homo sapiens
tccaaggaagtcatttaaactg

SEQ ID NO: 7895463 - DNA, 22 bp, Homo sapiens
tccaagcttgctttagccacag

SEQ ID NO: 7895464 - DNA, 22 bp, Homo sapiens
tccaagaagctcagcaaacatc

SEQ ID NO: 7895465 - DNA, 22 bp, Homo sapiens
tccaagaagcttacaatctaat

SEQ ID NO: 7895466 - DNA, 22 bp, Homo sapiens
tccaagaagcttacaatctaat

SEQ ID NO: 7895467 - DNA, 22 bp, Homo sapiens
tccaagaagcttacaatctaat

SEQ ID NO: 7895468 - DNA, 22 bp, Homo sapiens
tccaagctgtatgttcctagag

SEQ ID NO: 7895469 - DNA, 22 bp, Homo sapiens
tccaagctctctatgccatgat

SEQ ID NO: 7895470 - DNA, 22 bp, Homo sapiens
tccaagcttgctttagccacag

SEQ ID NO: 7895471 - DNA, 22 bp, Homo sapiens
tccaagctgtatgttcctagag

SEQ ID NO: 7895472 - DNA, 22 bp, Homo sapiens
tccaagctactgaaggtttggg

SEQ ID NO: 7895473 - DNA, 22 bp, Homo sapiens
tcatttgtgtgagtgatttgac

SEQ ID NO: 7895474 - DNA, 22 bp, Homo sapiens
tcatttgtgtgagtgatttgac

SEQ ID NO: 7895475 - DNA, 22 bp, Homo sapiens
tcatttgtggaagtgattgtgg

SEQ ID NO: 7895476 - DNA, 19 bp, Homo sapiens
tcatttgttagtagaagtt

SEQ ID NO: 7895477 - DNA, 22 bp, Homo sapiens
tcatttgttacagccacatacc

SEQ ID NO: 7895478 - DNA, 22 bp, Homo sapiens
tcatttgtggaagtgattgtgg

SEQ ID NO: 7895479 - DNA, 22 bp, Homo sapiens
tcatttgtggaagtgattgtgg

SEQ ID NO: 7895480 - DNA, 22 bp, Homo sapiens
tcatttgtgctgtcagcatgca

SEQ ID NO: 7895481 - DNA, 22 bp, Homo sapiens
tcatttgtgcaatgtagatgaa

SEQ ID NO: 7895482 - DNA, 21 bp, Homo sapiens
tcatttgtgatctgatttcca

SEQ ID NO: 7895483 - DNA, 22 bp, Homo sapiens
tcatttgtacttgtgtgcttgt

SEQ ID NO: 7895484 - DNA, 22 bp, Homo sapiens
tcatttgtaccattttttaaga

SEQ ID NO: 7895485 - DNA, 22 bp, Homo sapiens
tcatttgtacttgtgtgcttgt

SEQ ID NO: 7895486 - DNA, 21 bp, Homo sapiens
tcatttgtgatctgatttcca

SEQ ID NO: 7895487 - DNA, 22 bp, Homo sapiens
tcatttgtctggcacagggaat

SEQ ID NO: 7895488 - DNA, 21 bp, Homo sapiens
tcatttgtgatctgatttcca

SEQ ID NO: 7895489 - DNA, 22 bp, Homo sapiens
tcatttgtaccattttttaaga

SEQ ID NO: 7895490 - DNA, 22 bp, Homo sapiens
tcatttgtacttgtgtgcttgt

SEQ ID NO: 7895491 - DNA, 22 bp, Homo sapiens
tcatttttcacacagggtcacc

SEQ ID NO: 7895492 - DNA, 21 bp, Homo sapiens
tcatttttattgctaccttgc

SEQ ID NO: 7895493 - DNA, 21 bp, Homo sapiens
tcatttttattgctaccttgc

SEQ ID NO: 7895494 - DNA, 21 bp, Homo sapiens
tcatttttattgctaccttgc

SEQ ID NO: 7895495 - DNA, 22 bp, Homo sapiens
tcatttttagcgcgcaaaagtt

SEQ ID NO: 7895496 - DNA, 22 bp, Homo sapiens
tcatttttagcgcgcaaaagtt

SEQ ID NO: 7895497 - DNA, 22 bp, Homo sapiens
tcatttttagcgcgcaaaagtt

SEQ ID NO: 7895498 - DNA, 22 bp, Homo sapiens
tcatttttagcgcgcaaaagtt

SEQ ID NO: 7895499 - DNA, 22 bp, Homo sapiens
tcatttgttcatctgctcttct

SEQ ID NO: 7895500 - DNA, 22 bp, Homo sapiens
tcatttgttcatctgctcttct

SEQ ID NO: 7895501 - DNA, 22 bp, Homo sapiens
tcatttttttccggtaggaata

SEQ ID NO: 7895502 - DNA, 22 bp, Homo sapiens
tcatttttttccggtaggaata

SEQ ID NO: 7895503 - DNA, 22 bp, Homo sapiens
tcatttttttccggtaggaata

SEQ ID NO: 7895504 - DNA, 22 bp, Homo sapiens
tcatttttttccggtaggaata

SEQ ID NO: 7895505 - DNA, 22 bp, Homo sapiens
tcatttttttccggtaggaata

SEQ ID NO: 7895506 - DNA, 22 bp, Homo sapiens
tcattttttgcatacctgtgtc

SEQ ID NO: 7895507 - DNA, 22 bp, Homo sapiens
tcattttttgcatacctgtgtc

SEQ ID NO: 7895508 - DNA, 22 bp, Homo sapiens
tcattttttgcatacctgtgtc

SEQ ID NO: 7895509 - DNA, 22 bp, Homo sapiens
tcattttttgcatacctgtgtc

SEQ ID NO: 7895510 - DNA, 22 bp, Homo sapiens
tcatttttttccggtaggaata

SEQ ID NO: 7895511 - DNA, 22 bp, Homo sapiens
tccaaaacagaactctgtgaat

SEQ ID NO: 7895512 - DNA, 21 bp, Homo sapiens
tccaaaaaggagcgtccttct

SEQ ID NO: 7895513 - DNA, 18 bp, Homo sapiens
tccaaaatcatgtatttt

SEQ ID NO: 7895514 - DNA, 21 bp, Homo sapiens
tccaaaaaggagcgtccttct

SEQ ID NO: 7895515 - DNA, 22 bp, Homo sapiens
tccaaaaaacgtttgaatagtt

SEQ ID NO: 7895516 - DNA, 22 bp, Homo sapiens
tccaaaaaacgtttgaatagtt

SEQ ID NO: 7895517 - DNA, 22 bp, Homo sapiens
tccaaaaaacgtttgaatagtt

SEQ ID NO: 7895518 - DNA, 22 bp, Homo sapiens
tccaaaaaacgtttgaatagtt

SEQ ID NO: 7895519 - DNA, 22 bp, Homo sapiens
tcatttttctcttacacgtaga

SEQ ID NO: 7895520 - DNA, 22 bp, Homo sapiens
tcatttttctcttacacgtaga

SEQ ID NO: 7895521 - DNA, 22 bp, Homo sapiens
tcatttttctcttacacgtaga

SEQ ID NO: 7895522 - DNA, 22 bp, Homo sapiens
tcatttttgaccatgggtagga

SEQ ID NO: 7895523 - DNA, 22 bp, Homo sapiens
tcatttttcacacagggtcacc

SEQ ID NO: 7895524 - DNA, 22 bp, Homo sapiens
tcatttttctcttacacgtaga

SEQ ID NO: 7895525 - DNA, 22 bp, Homo sapiens
tcatttttctcttacacgtaga

SEQ ID NO: 7895526 - DNA, 22 bp, Homo sapiens
tcattttttgcatacctgtgtc

SEQ ID NO: 7895527 - DNA, 22 bp, Homo sapiens
tcattttttgcatacctgtgtc

SEQ ID NO: 7895528 - DNA, 22 bp, Homo sapiens
tcatttttgtctccggtttgtg

SEQ ID NO: 7895529 - DNA, 22 bp, Homo sapiens
tcatttttgtctccggtttgtg

SEQ ID NO: 7895530 - DNA, 22 bp, Homo sapiens
tcatttttgtctccggtttgtg

SEQ ID NO: 7895531 - DNA, 22 bp, Homo sapiens
tcatttttgtctccggtttgtg

SEQ ID NO: 7895532 - DNA, 22 bp, Homo sapiens
tcatttttgaccatgggtagga

SEQ ID NO: 7895533 - DNA, 22 bp, Homo sapiens
tcatttttgaccatgggtagga

SEQ ID NO: 7895534 - DNA, 22 bp, Homo sapiens
tcatttttgaccatgggtagga

SEQ ID NO: 7895535 - DNA, 22 bp, Homo sapiens
tcatttttgaccatgggtagga

SEQ ID NO: 7895536 - DNA, 22 bp, Homo sapiens
tcatttttgtctccggtttgtg

SEQ ID NO: 7895537 - DNA, 22 bp, Homo sapiens
tcatttttgaccatgggtagga

SEQ ID NO: 7895538 - DNA, 22 bp, Homo sapiens
tccaaagccgactgacatctga

SEQ ID NO: 7895539 - DNA, 22 bp, Homo sapiens
tccaaagcatttggctcccacc

SEQ ID NO: 7895540 - DNA, 22 bp, Homo sapiens
tccaaagccgactgacatctga

SEQ ID NO: 7895541 - DNA, 19 bp, Homo sapiens
tccaaaggacccacctcca

SEQ ID NO: 7895542 - DNA, 22 bp, Homo sapiens
tccaaaggacatttctgcttct

SEQ ID NO: 7895543 - DNA, 22 bp, Homo sapiens
tccaaaggaagaggctgtcagt

SEQ ID NO: 7895544 - DNA, 22 bp, Homo sapiens
tccaaaggaggctgccaagttc

SEQ ID NO: 7895545 - DNA, 22 bp, Homo sapiens
tccaaaggcaaaactgtggtgt

SEQ ID NO: 7895546 - DNA, 19 bp, Homo sapiens
tccaaaggacccacctcca

SEQ ID NO: 7895547 - DNA, 21 bp, Homo sapiens
tccaaaggagactgagtgtgt

SEQ ID NO: 7895548 - DNA, 22 bp, Homo sapiens
tccaaaggggcagtgtccagcc

SEQ ID NO: 7895549 - DNA, 22 bp, Homo sapiens
tccaaaggccctgagttcactt

SEQ ID NO: 7895550 - DNA, 22 bp, Homo sapiens
tccaaaggccctaataagcttg

SEQ ID NO: 7895551 - DNA, 22 bp, Homo sapiens
tccaaagtaatttcacttctgt

SEQ ID NO: 7895552 - DNA, 22 bp, Homo sapiens
tccaaagtaatttcacttctgt

SEQ ID NO: 7895553 - DNA, 18 bp, Homo sapiens
tccaaaggtcccctccca

SEQ ID NO: 7895554 - DNA, 18 bp, Homo sapiens
tccaaagctgctggtttt

SEQ ID NO: 7895555 - DNA, 22 bp, Homo sapiens
tccaaatacatttactgtattt

SEQ ID NO: 7895556 - DNA, 22 bp, Homo sapiens
tccaaatacatttactgtattt

SEQ ID NO: 7895557 - DNA, 22 bp, Homo sapiens
tccaaatacatttactgtattt

SEQ ID NO: 7895558 - DNA, 22 bp, Homo sapiens
tccaaatacatttactgtattt

SEQ ID NO: 7895559 - DNA, 22 bp, Homo sapiens
tccaaataccagatgggctaat

SEQ ID NO: 7895560 - DNA, 22 bp, Homo sapiens
tccaaataccagatgggctaat

SEQ ID NO: 7895561 - DNA, 22 bp, Homo sapiens
tccaaatagctggatgatggtg

SEQ ID NO: 7895562 - DNA, 22 bp, Homo sapiens
tccaaatagctggatgatggtg

SEQ ID NO: 7895563 - DNA, 23 bp, Homo sapiens
tccaaatacctgtcaccttgtct

SEQ ID NO: 7895564 - DNA, 23 bp, Homo sapiens
tccaaatacctgtcaccttgtct

SEQ ID NO: 7895565 - DNA, 22 bp, Homo sapiens
tccaaatagttctggaagactg

SEQ ID NO: 7895566 - DNA, 22 bp, Homo sapiens
tccaaatagttctggaagactg

SEQ ID NO: 7895567 - DNA, 22 bp, Homo sapiens
tccaaatatacagaatctcctc

SEQ ID NO: 7895568 - DNA, 22 bp, Homo sapiens
tccaaatatacagaatctcctc

SEQ ID NO: 7895569 - DNA, 22 bp, Homo sapiens
tccaaatatacagaatctcctc

SEQ ID NO: 7895570 - DNA, 22 bp, Homo sapiens
tccaaatatagatgagttgtaa

SEQ ID NO: 7895571 - DNA, 22 bp, Homo sapiens
tccaaatatagatgagttgtaa

SEQ ID NO: 7895572 - DNA, 22 bp, Homo sapiens
tccaaatataggatgtgatata

SEQ ID NO: 7895573 - DNA, 22 bp, Homo sapiens
tccaaatataggatgtgatata

SEQ ID NO: 7895574 - DNA, 18 bp, Homo sapiens
tccaaaatcatgtatttt

SEQ ID NO: 7895575 - DNA, 22 bp, Homo sapiens
tccaaacaccctccatgctgca

SEQ ID NO: 7895576 - DNA, 18 bp, Homo sapiens
tccaaaatcatgtatttt

SEQ ID NO: 7895577 - DNA, 22 bp, Homo sapiens
tccaaacaccctccatgctgca

SEQ ID NO: 7895578 - DNA, 22 bp, Homo sapiens
tccaaacaccctccatgctgca

SEQ ID NO: 7895579 - DNA, 21 bp, Homo sapiens
tccaaacctgtctctggctct

SEQ ID NO: 7895580 - DNA, 22 bp, Homo sapiens
tccaaagaacctggctactgtc

SEQ ID NO: 7895581 - DNA, 22 bp, Homo sapiens
tccaaagaacattgctgagacc

SEQ ID NO: 7895582 - DNA, 22 bp, Homo sapiens
tccaaagaacctggctactgtc

SEQ ID NO: 7895583 - DNA, 22 bp, Homo sapiens
tccaaacgggagccaaatgagc

SEQ ID NO: 7895584 - DNA, 22 bp, Homo sapiens
tccaaagaacattgctgagacc

SEQ ID NO: 7895585 - DNA, 22 bp, Homo sapiens
tccaaagaacattgctgagacc

SEQ ID NO: 7895586 - DNA, 22 bp, Homo sapiens
tccaaagccccatgcactttct

SEQ ID NO: 7895587 - DNA, 18 bp, Homo sapiens
tccaaagccagagaagtt

SEQ ID NO: 7895588 - DNA, 18 bp, Homo sapiens
tccaaagccagagaagtt

SEQ ID NO: 7895589 - DNA, 22 bp, Homo sapiens
tccaaagccgactgacatctga

SEQ ID NO: 7895590 - DNA, 16 bp, Homo sapiens
tccaaagcccgacttc

SEQ ID NO: 7895591 - DNA, 22 bp, Homo sapiens
tccaaagcatttggctcccacc

SEQ ID NO: 7895592 - DNA, 22 bp, Homo sapiens
tccaaagcatttggctcccacc

SEQ ID NO: 7895593 - DNA, 22 bp, Homo sapiens
tccaaagcatctgagtgtgcat

SEQ ID NO: 7895594 - DNA, 22 bp, Homo sapiens
tccaaagcagacagggggcgta

SEQ ID NO: 7895595 - DNA, 22 bp, Homo sapiens
tccaaagacttgctgtatgtaa

SEQ ID NO: 7895596 - DNA, 22 bp, Homo sapiens
tccaaagagcttaggagagaaa

SEQ ID NO: 7895597 - DNA, 22 bp, Homo sapiens
tccaaagaggttaagaacgaga

SEQ ID NO: 7895598 - DNA, 22 bp, Homo sapiens
tcatttcagccatttttaaatg

SEQ ID NO: 7895599 - DNA, 22 bp, Homo sapiens
tcatttcagccatttttaaatg

SEQ ID NO: 7895600 - DNA, 22 bp, Homo sapiens
tcatttcagccatttttaaatg

SEQ ID NO: 7895601 - DNA, 22 bp, Homo sapiens
tcatttcagatgcatttagaat

SEQ ID NO: 7895602 - DNA, 22 bp, Homo sapiens
tcatttcagatgcatttagaat

SEQ ID NO: 7895603 - DNA, 22 bp, Homo sapiens
tcatttcacttctctagggaga

SEQ ID NO: 7895604 - DNA, 22 bp, Homo sapiens
tcatttatcatttgtgctgtag

SEQ ID NO: 7895605 - DNA, 22 bp, Homo sapiens
tcatttcaatgatactactaag

SEQ ID NO: 7895606 - DNA, 23 bp, Homo sapiens
tcatttcacagtgagcttcctag

SEQ ID NO: 7895607 - DNA, 22 bp, Homo sapiens
tcatttatattgtattctgtag

SEQ ID NO: 7895608 - DNA, 22 bp, Homo sapiens
tcatttatattgtattctgtag

SEQ ID NO: 7895609 - DNA, 22 bp, Homo sapiens
tcatttatattgtattctgtag

SEQ ID NO: 7895610 - DNA, 23 bp, Homo sapiens
tcatttcatccagccttgagagt

SEQ ID NO: 7895611 - DNA, 23 bp, Homo sapiens
tcatttcatccagccttgagagt

SEQ ID NO: 7895612 - DNA, 22 bp, Homo sapiens
tcatttcatgtctcaggcactg

SEQ ID NO: 7895613 - DNA, 23 bp, Homo sapiens
tcatttcatccagccttgagagt

SEQ ID NO: 7895614 - DNA, 22 bp, Homo sapiens
tcatttcatgtctcaggcactg

SEQ ID NO: 7895615 - DNA, 22 bp, Homo sapiens
tcatttccctcctacaaagagg

SEQ ID NO: 7895616 - DNA, 22 bp, Homo sapiens
tcatttcagtcctctgtgtgag

SEQ ID NO: 7895617 - DNA, 17 bp, Homo sapiens
tcatttcagtaaatcca

SEQ ID NO: 7895618 - DNA, 17 bp, Homo sapiens
tcatttcagtaaatcca

SEQ ID NO: 7895619 - DNA, 22 bp, Homo sapiens
tcatttcagtggcacagaagat

SEQ ID NO: 7895620 - DNA, 23 bp, Homo sapiens
tcatttcatccagccttgagagt

SEQ ID NO: 7895621 - DNA, 22 bp, Homo sapiens
tcatttctgttgtgcatcactg

SEQ ID NO: 7895622 - DNA, 22 bp, Homo sapiens
tcatttctgttgtgcatcactg

SEQ ID NO: 7895623 - DNA, 22 bp, Homo sapiens
tcatttctgttgtgcatcactg

SEQ ID NO: 7895624 - DNA, 22 bp, Homo sapiens
tcatttctgagccttccatgat

SEQ ID NO: 7895625 - DNA, 22 bp, Homo sapiens
tcatttctgagccttccatgat

SEQ ID NO: 7895626 - DNA, 22 bp, Homo sapiens
tcatttctgagccttccatgat

SEQ ID NO: 7895627 - DNA, 22 bp, Homo sapiens
tcatttctgagccttccatgat

SEQ ID NO: 7895628 - DNA, 22 bp, Homo sapiens
tcatttcttaactagagtgaac

SEQ ID NO: 7895629 - DNA, 22 bp, Homo sapiens
tcatttcttaactagagtgaac

SEQ ID NO: 7895630 - DNA, 22 bp, Homo sapiens
tcatttcttaactagagtgaac

SEQ ID NO: 7895631 - DNA, 20 bp, Homo sapiens
tcatttcttggggttccaag

SEQ ID NO: 7895632 - DNA, 20 bp, Homo sapiens
tcatttcttggggttccaag

SEQ ID NO: 7895633 - DNA, 22 bp, Homo sapiens
tcatttggtattaattttcaga

SEQ ID NO: 7895634 - DNA, 22 bp, Homo sapiens
tcatttggtcctcccaacaagc

SEQ ID NO: 7895635 - DNA, 22 bp, Homo sapiens
tcatttgggtcagttttccata

SEQ ID NO: 7895636 - DNA, 17 bp, Homo sapiens
tcatttgggcctcacaa

SEQ ID NO: 7895637 - DNA, 22 bp, Homo sapiens
tcatttggccttctttgcattg

SEQ ID NO: 7895638 - DNA, 22 bp, Homo sapiens
tcatttggagccttcctgtttt

SEQ ID NO: 7895639 - DNA, 23 bp, Homo sapiens
tcatttggacaaggcacagcaga

SEQ ID NO: 7895640 - DNA, 23 bp, Homo sapiens
tcatttggacaaggcacagcaga

SEQ ID NO: 7895641 - DNA, 22 bp, Homo sapiens
tcatttggaagcctgagagtgt

SEQ ID NO: 7895642 - DNA, 22 bp, Homo sapiens
tcatttggaagcctgagagtgt

SEQ ID NO: 7895643 - DNA, 22 bp, Homo sapiens
tcatttggaagcctgagagtgt

SEQ ID NO: 7895644 - DNA, 22 bp, Homo sapiens
tcatttctccgacctgctgtcc

SEQ ID NO: 7895645 - DNA, 22 bp, Homo sapiens
tcatttctccgacctgctgtcc

SEQ ID NO: 7895646 - DNA, 22 bp, Homo sapiens
tcatttctccgacctgctgtcc

SEQ ID NO: 7895647 - DNA, 22 bp, Homo sapiens
tcatttctcccggccaaaaact

SEQ ID NO: 7895648 - DNA, 22 bp, Homo sapiens
tcatttctcccggccaaaaact

SEQ ID NO: 7895649 - DNA, 22 bp, Homo sapiens
tcatttctcccggccaaaaact

SEQ ID NO: 7895650 - DNA, 22 bp, Homo sapiens
tcatttctattgctactgtctg

SEQ ID NO: 7895651 - DNA, 22 bp, Homo sapiens
tcatttctctgagtctgataat

SEQ ID NO: 7895652 - DNA, 22 bp, Homo sapiens
tcatttctctgagtctgataat

SEQ ID NO: 7895653 - DNA, 22 bp, Homo sapiens
tcatttctctgagtctgataat

SEQ ID NO: 7895654 - DNA, 21 bp, Homo sapiens
tcatttctctatgtatttcac

SEQ ID NO: 7895655 - DNA, 22 bp, Homo sapiens
tcatttctcctaagtgaaatat

SEQ ID NO: 7895656 - DNA, 22 bp, Homo sapiens
tcatttctcctaagtgaaatat

SEQ ID NO: 7895657 - DNA, 22 bp, Homo sapiens
tcatttctcctaagtgaaatat

SEQ ID NO: 7895658 - DNA, 22 bp, Homo sapiens
tcatttctcctaagtgaaatat

SEQ ID NO: 7895659 - DNA, 21 bp, Homo sapiens
tcatttctctatgtatttcac

SEQ ID NO: 7895660 - DNA, 21 bp, Homo sapiens
tcatttctctatgtatttcac

SEQ ID NO: 7895661 - DNA, 22 bp, Homo sapiens
tcatttacagactgtgtgggtg

SEQ ID NO: 7895662 - DNA, 22 bp, Homo sapiens
tcatttacatagaaacaatata

SEQ ID NO: 7895663 - DNA, 22 bp, Homo sapiens
tcatttacatagaaacaatata

SEQ ID NO: 7895664 - DNA, 22 bp, Homo sapiens
tcatttacaggtgaagcaacta

SEQ ID NO: 7895665 - DNA, 22 bp, Homo sapiens
tcatttaattggttttgctcgt

SEQ ID NO: 7895666 - DNA, 22 bp, Homo sapiens
tcatttaataatttttgagtag

SEQ ID NO: 7895667 - DNA, 22 bp, Homo sapiens
tcattgttgcgttaatgtcttc

SEQ ID NO: 7895668 - DNA, 21 bp, Homo sapiens
tcattgttgcatggtaggggg

SEQ ID NO: 7895669 - DNA, 22 bp, Homo sapiens
tcattgttcctatttggcaaga

SEQ ID NO: 7895670 - DNA, 21 bp, Homo sapiens
tcattgttgcatggtaggggg

SEQ ID NO: 7895671 - DNA, 22 bp, Homo sapiens
tcattgtttctgcttttcatga

SEQ ID NO: 7895672 - DNA, 22 bp, Homo sapiens
tcattgtttctgcttttcatga

SEQ ID NO: 7895673 - DNA, 22 bp, Homo sapiens
tcattgtttctgcttttcatga

SEQ ID NO: 7895674 - DNA, 22 bp, Homo sapiens
tcatttaataatttttgagtag

SEQ ID NO: 7895675 - DNA, 22 bp, Homo sapiens
tcatttaaaatgtaccaggatt

SEQ ID NO: 7895676 - DNA, 22 bp, Homo sapiens
tcatttaataatttttgagtag

SEQ ID NO: 7895677 - DNA, 22 bp, Homo sapiens
tcattgtttctgcttttcatga

SEQ ID NO: 7895678 - DNA, 22 bp, Homo sapiens
tcatttaaaatgtaccaggatt

SEQ ID NO: 7895679 - DNA, 22 bp, Homo sapiens
tcatttaaaatgtaccaggatt

SEQ ID NO: 7895680 - DNA, 22 bp, Homo sapiens
tcatttaaaatgtaccaggatt

SEQ ID NO: 7895681 - DNA, 22 bp, Homo sapiens
tcatttatattgtattctgtag

SEQ ID NO: 7895682 - DNA, 22 bp, Homo sapiens
tcatttatattgtattctgtag

SEQ ID NO: 7895683 - DNA, 22 bp, Homo sapiens
tcatttatattgtattctgtag

SEQ ID NO: 7895684 - DNA, 22 bp, Homo sapiens
tcatttataaggatgcaattaa

SEQ ID NO: 7895685 - DNA, 22 bp, Homo sapiens
tcatttacttggttttaatctt

SEQ ID NO: 7895686 - DNA, 22 bp, Homo sapiens
tcatttacatagaaacaatata

SEQ ID NO: 7895687 - DNA, 22 bp, Homo sapiens
tcatttacatgtctttctctga

SEQ ID NO: 7895688 - DNA, 22 bp, Homo sapiens
tcatttacatgtctttctctga

SEQ ID NO: 7895689 - DNA, 22 bp, Homo sapiens
tcatttacatgtctttctctga

SEQ ID NO: 7895690 - DNA, 22 bp, Homo sapiens
tcatttacgcgcctccttcctt

SEQ ID NO: 7895691 - DNA, 22 bp, Homo sapiens
tcatgcagtttcttatctgcca

SEQ ID NO: 7895692 - DNA, 22 bp, Homo sapiens
tcatgcagtttcttatctgcca

SEQ ID NO: 7895693 - DNA, 22 bp, Homo sapiens
tcatgcagttttgccacctaag

SEQ ID NO: 7895694 - DNA, 22 bp, Homo sapiens
tcatgcagtttgaagttcaggg

SEQ ID NO: 7895695 - DNA, 22 bp, Homo sapiens
tcatgcagttactgttatgcaa

SEQ ID NO: 7895696 - DNA, 19 bp, Homo sapiens
tcatgcagtggggggtgtg

SEQ ID NO: 7895697 - DNA, 22 bp, Homo sapiens
tcatgcagttactgttatgcaa

SEQ ID NO: 7895698 - DNA, 19 bp, Homo sapiens
tcatgcagtggggggtgtg

SEQ ID NO: 7895699 - DNA, 22 bp, Homo sapiens
tcatgcagtgaatctttcttgc

SEQ ID NO: 7895700 - DNA, 19 bp, Homo sapiens
tcatgcagtggggggtgtg

SEQ ID NO: 7895701 - DNA, 22 bp, Homo sapiens
tcatgcagtgaatctttcttgc

SEQ ID NO: 7895702 - DNA, 22 bp, Homo sapiens
tcatgcagtgaatctttcttgc

SEQ ID NO: 7895703 - DNA, 22 bp, Homo sapiens
tcatgcaggtttccagccagat

SEQ ID NO: 7895704 - DNA, 22 bp, Homo sapiens
tcatgcagttttgccacctaag

SEQ ID NO: 7895705 - DNA, 22 bp, Homo sapiens
tcatgcagtttgaagttcaggg

SEQ ID NO: 7895706 - DNA, 22 bp, Homo sapiens
tcatgcatctgggctggctggt

SEQ ID NO: 7895707 - DNA, 20 bp, Homo sapiens
tcatgcaggtgttctaggtt

SEQ ID NO: 7895708 - DNA, 21 bp, Homo sapiens
tcatgcaggcagagtttggta

SEQ ID NO: 7895709 - DNA, 20 bp, Homo sapiens
tcatgcaggtgttctaggtt

SEQ ID NO: 7895710 - DNA, 22 bp, Homo sapiens
tcatgcaggtttccagccagat

SEQ ID NO: 7895711 - DNA, 22 bp, Homo sapiens
tcatgcaggtttccagccagat

SEQ ID NO: 7895712 - DNA, 20 bp, Homo sapiens
tcatgcaggtgttctaggtt

SEQ ID NO: 7895713 - DNA, 20 bp, Homo sapiens
tcatgcaggtgttctaggtt

SEQ ID NO: 7895714 - DNA, 22 bp, Homo sapiens
tcatgcaggcagcctttagtaa

SEQ ID NO: 7895715 - DNA, 22 bp, Homo sapiens
tcatgcaggcagcctttagtaa

SEQ ID NO: 7895716 - DNA, 21 bp, Homo sapiens
tcatgcaggcagagtttggta

SEQ ID NO: 7895717 - DNA, 21 bp, Homo sapiens
tcatgcaggcagagtttggta

SEQ ID NO: 7895718 - DNA, 22 bp, Homo sapiens
tcatgcaggacttacgagagat

SEQ ID NO: 7895719 - DNA, 22 bp, Homo sapiens
tcatgcaggacttacgagagat

SEQ ID NO: 7895720 - DNA, 22 bp, Homo sapiens
tcatgcaggacttacgagagat

SEQ ID NO: 7895721 - DNA, 22 bp, Homo sapiens
tcatgcaggacttacaagagat

SEQ ID NO: 7895722 - DNA, 22 bp, Homo sapiens
tcatgcaggacttacgagagat

SEQ ID NO: 7895723 - DNA, 22 bp, Homo sapiens
tcatgcaggacttacaagagat

SEQ ID NO: 7895724 - DNA, 22 bp, Homo sapiens
tcatgcagcaatatgcattagg

SEQ ID NO: 7895725 - DNA, 22 bp, Homo sapiens
tcatgcagcaatatgcattagg

SEQ ID NO: 7895726 - DNA, 22 bp, Homo sapiens
tcatgcagatttggaggtattt

SEQ ID NO: 7895727 - DNA, 22 bp, Homo sapiens
tcatgcagatttggaggtattt

SEQ ID NO: 7895728 - DNA, 22 bp, Homo sapiens
tcatgcagcttttccattcagc

SEQ ID NO: 7895729 - DNA, 23 bp, Homo sapiens
tcatgcagcctggaacctcccag

SEQ ID NO: 7895730 - DNA, 23 bp, Homo sapiens
tcatgcagcctggaacctcccag

SEQ ID NO: 7895731 - DNA, 23 bp, Homo sapiens
tcatgcagcctggaacctcccag

SEQ ID NO: 7895732 - DNA, 22 bp, Homo sapiens
tcatgcagcaatatgcattagg

SEQ ID NO: 7895733 - DNA, 22 bp, Homo sapiens
tcatgcaggacttacaagagat

SEQ ID NO: 7895734 - DNA, 22 bp, Homo sapiens
tcatgcaggacttacaagagat

SEQ ID NO: 7895735 - DNA, 22 bp, Homo sapiens
tcatgcaggacttacaagagat

SEQ ID NO: 7895736 - DNA, 22 bp, Homo sapiens
tcatgcaggacttacaagagat

SEQ ID NO: 7895737 - DNA, 22 bp, Homo sapiens
tcatgcaggaccaccccagcat

SEQ ID NO: 7895738 - DNA, 22 bp, Homo sapiens
tcatgcaggaccaccccagcat

SEQ ID NO: 7895739 - DNA, 22 bp, Homo sapiens
tcatgcagcttttccattcagc

SEQ ID NO: 7895740 - DNA, 22 bp, Homo sapiens
tcatgcagcttttccattcagc

SEQ ID NO: 7895741 - DNA, 22 bp, Homo sapiens
tcatgcagcttttccattcagc

SEQ ID NO: 7895742 - DNA, 22 bp, Homo sapiens
tcattggttgtcacacagggag

SEQ ID NO: 7895743 - DNA, 22 bp, Homo sapiens
tcattgctctaggttccttgga

SEQ ID NO: 7895744 - DNA, 22 bp, Homo sapiens
tcattgctggctctggagtatg

SEQ ID NO: 7895745 - DNA, 22 bp, Homo sapiens
tcattgtaattatctgtggtat

SEQ ID NO: 7895746 - DNA, 22 bp, Homo sapiens
tcattgtacaattgcatgtgcg

SEQ ID NO: 7895747 - DNA, 22 bp, Homo sapiens
tcattgtagggcatttagagag

SEQ ID NO: 7895748 - DNA, 22 bp, Homo sapiens
tcattgtattcagaactgaaga

SEQ ID NO: 7895749 - DNA, 22 bp, Homo sapiens
tcattgtattaaaatattggtt

SEQ ID NO: 7895750 - DNA, 22 bp, Homo sapiens
tcattgtatactttatttatga

SEQ ID NO: 7895751 - DNA, 23 bp, Homo sapiens
tcattgtgactgtgccacataac

SEQ ID NO: 7895752 - DNA, 22 bp, Homo sapiens
tcattgtcttgatatgattgtc

SEQ ID NO: 7895753 - DNA, 22 bp, Homo sapiens
tcattgtattcagaactgaaga

SEQ ID NO: 7895754 - DNA, 22 bp, Homo sapiens
tcattgtcagctcttgacttct

SEQ ID NO: 7895755 - DNA, 22 bp, Homo sapiens
tcattgtctctcttttcatata

SEQ ID NO: 7895756 - DNA, 22 bp, Homo sapiens
tcattgtcgctctgcggtgttc

SEQ ID NO: 7895757 - DNA, 22 bp, Homo sapiens
tcattgttactgtttagttgcc

SEQ ID NO: 7895758 - DNA, 22 bp, Homo sapiens
tcattgttaattgtatgatctg

SEQ ID NO: 7895759 - DNA, 22 bp, Homo sapiens
tcattgttatgttttgctgtct

SEQ ID NO: 7895760 - DNA, 22 bp, Homo sapiens
tcattgttatgttttgctgtct

SEQ ID NO: 7895761 - DNA, 22 bp, Homo sapiens
tcattgttcctatttggcaaga

SEQ ID NO: 7895762 - DNA, 22 bp, Homo sapiens
tcacagttttagctgttaaata

SEQ ID NO: 7895763 - DNA, 22 bp, Homo sapiens
tcacagttttagaaaatagata

SEQ ID NO: 7895764 - DNA, 22 bp, Homo sapiens
tcacagttttagaaaatagata

SEQ ID NO: 7895765 - DNA, 22 bp, Homo sapiens
tcacataaattatacaatttca

SEQ ID NO: 7895766 - DNA, 22 bp, Homo sapiens
tcacataaatttaccagatgat

SEQ ID NO: 7895767 - DNA, 22 bp, Homo sapiens
tcacatacactaggatattttt

SEQ ID NO: 7895768 - DNA, 22 bp, Homo sapiens
tcacatacactaggatattttt

SEQ ID NO: 7895769 - DNA, 22 bp, Homo sapiens
tcacatactgaaagtccagtga

SEQ ID NO: 7895770 - DNA, 22 bp, Homo sapiens
tcacatacactaggatattttt

SEQ ID NO: 7895771 - DNA, 23 bp, Homo sapiens
tcacataatccttcatccacagg

SEQ ID NO: 7895772 - DNA, 23 bp, Homo sapiens
tcacataatccttcatccacagg

SEQ ID NO: 7895773 - DNA, 23 bp, Homo sapiens
tcacataatccttcatccacagg

SEQ ID NO: 7895774 - DNA, 22 bp, Homo sapiens
tcacagtttcttttctgataaa

SEQ ID NO: 7895775 - DNA, 22 bp, Homo sapiens
tcacagttttaagtgtgatcca

SEQ ID NO: 7895776 - DNA, 22 bp, Homo sapiens
tcacagtttccataggtcagca

SEQ ID NO: 7895777 - DNA, 22 bp, Homo sapiens
tcacagtttccataggtcagca

SEQ ID NO: 7895778 - DNA, 22 bp, Homo sapiens
tcacagttttagaaaatagata

SEQ ID NO: 7895779 - DNA, 22 bp, Homo sapiens
tcacagttttagaaaatagata

SEQ ID NO: 7895780 - DNA, 22 bp, Homo sapiens
tcacagtgtcacaatgcctgga

SEQ ID NO: 7895781 - DNA, 22 bp, Homo sapiens
tcacagtgtcacaatgcctgga

SEQ ID NO: 7895782 - DNA, 22 bp, Homo sapiens
tcacagtgtcgtccttgggtgt

SEQ ID NO: 7895783 - DNA, 22 bp, Homo sapiens
tcacagtgtcacaatgcctgga

SEQ ID NO: 7895784 - DNA, 22 bp, Homo sapiens
tcacagtgtcacaatgcctgga

SEQ ID NO: 7895785 - DNA, 22 bp, Homo sapiens
tcacagtgtcacaatgcctgga

SEQ ID NO: 7895786 - DNA, 22 bp, Homo sapiens
tcacagtgggacttttatcgct

SEQ ID NO: 7895787 - DNA, 22 bp, Homo sapiens
tcacagtgtcacaatgcctgga

SEQ ID NO: 7895788 - DNA, 22 bp, Homo sapiens
tcacagtgtcgtccttgggtgt

SEQ ID NO: 7895789 - DNA, 22 bp, Homo sapiens
tcacagtgtcgtccttgggtgt

SEQ ID NO: 7895790 - DNA, 22 bp, Homo sapiens
tcacagtgtgaaggtcagtcac

SEQ ID NO: 7895791 - DNA, 22 bp, Homo sapiens
tcacagtgtgaaggtcagtcac

SEQ ID NO: 7895792 - DNA, 22 bp, Homo sapiens
tcacagtgtgaaggtcagtcac

SEQ ID NO: 7895793 - DNA, 18 bp, Homo sapiens
tcacagtgctcttgccta

SEQ ID NO: 7895794 - DNA, 22 bp, Homo sapiens
tcacagtgcaggatcagttaat

SEQ ID NO: 7895795 - DNA, 22 bp, Homo sapiens
tcacagtgctctgggtggcaga

SEQ ID NO: 7895796 - DNA, 22 bp, Homo sapiens
tcacagtgctctgggtggcaga

SEQ ID NO: 7895797 - DNA, 22 bp, Homo sapiens
tcacagtggagccaccaaggta

SEQ ID NO: 7895798 - DNA, 22 bp, Homo sapiens
tcacagtggagccaccaaggta

SEQ ID NO: 7895799 - DNA, 18 bp, Homo sapiens
tcacagtgctcttgccta

SEQ ID NO: 7895800 - DNA, 22 bp, Homo sapiens
tcacagtggagccaccaaggta

SEQ ID NO: 7895801 - DNA, 22 bp, Homo sapiens
tcacagtgggacttttatcgct

SEQ ID NO: 7895802 - DNA, 22 bp, Homo sapiens
tcacagtgggacttttatcgct

SEQ ID NO: 7895803 - DNA, 22 bp, Homo sapiens
tcacagtgcaggatcagttaat

SEQ ID NO: 7895804 - DNA, 22 bp, Homo sapiens
tcacagtgcaggatcagttaat

SEQ ID NO: 7895805 - DNA, 22 bp, Homo sapiens
tcacagtgcaggatcagttaat

SEQ ID NO: 7895806 - DNA, 19 bp, Homo sapiens
tcacagtgcagaaccctcc

SEQ ID NO: 7895807 - DNA, 19 bp, Homo sapiens
tcacagtgcagaaccctcc

SEQ ID NO: 7895808 - DNA, 22 bp, Homo sapiens
tcacagtgcacccctcacaggg

SEQ ID NO: 7895809 - DNA, 22 bp, Homo sapiens
tcacagtgcacccctcacaggg

SEQ ID NO: 7895810 - DNA, 19 bp, Homo sapiens
tcacagtgcagaaccctcc

SEQ ID NO: 7895811 - DNA, 22 bp, Homo sapiens
tcacagtgcacccctcacaggg

SEQ ID NO: 7895812 - DNA, 22 bp, Homo sapiens
tcacagtgcacccctcacaggg

SEQ ID NO: 7895813 - DNA, 22 bp, Homo sapiens
tcacagtgatgacgtgggagca

SEQ ID NO: 7895814 - DNA, 22 bp, Homo sapiens
tcacagtgatgacgtgggagca

SEQ ID NO: 7895815 - DNA, 22 bp, Homo sapiens
tcacagtgataactaagtcctg

SEQ ID NO: 7895816 - DNA, 22 bp, Homo sapiens
tcacagtgataactaagtcctg

SEQ ID NO: 7895817 - DNA, 22 bp, Homo sapiens
tcacagtgcaccagtgtgaagc

SEQ ID NO: 7895818 - DNA, 22 bp, Homo sapiens
tcacagtgcaccagtgtgaagc

SEQ ID NO: 7895819 - DNA, 22 bp, Homo sapiens
tcacagtgcaccagtgtgaagc

SEQ ID NO: 7895820 - DNA, 22 bp, Homo sapiens
tcacagtgcacagcaggcgtgg

SEQ ID NO: 7895821 - DNA, 22 bp, Homo sapiens
tcacagtgatgacgtgggagca

SEQ ID NO: 7895822 - DNA, 22 bp, Homo sapiens
tcacagtgcacagcaggcgtgg

SEQ ID NO: 7895823 - DNA, 22 bp, Homo sapiens
tcacagtgagccatgtcagaga

SEQ ID NO: 7895824 - DNA, 22 bp, Homo sapiens
tcacagtgagccatgtcagaga

SEQ ID NO: 7895825 - DNA, 22 bp, Homo sapiens
tcacagtgagccatgtcagaga

SEQ ID NO: 7895826 - DNA, 22 bp, Homo sapiens
tcacagtgagccatgtcagaga

SEQ ID NO: 7895827 - DNA, 22 bp, Homo sapiens
tcacagtgaggagttacagttt

SEQ ID NO: 7895828 - DNA, 22 bp, Homo sapiens
tcacagtgaggagttacagttt

SEQ ID NO: 7895829 - DNA, 22 bp, Homo sapiens
tcacagtgaggagttacagttt

SEQ ID NO: 7895830 - DNA, 22 bp, Homo sapiens
tcacagtgaggagttacagttt

SEQ ID NO: 7895831 - DNA, 22 bp, Homo sapiens
tcacagtgataactaagtcctg

SEQ ID NO: 7895832 - DNA, 22 bp, Homo sapiens
tcacagtgaggcagttcttgta

SEQ ID NO: 7895833 - DNA, 22 bp, Homo sapiens
tcacatactgaaagtccagtga

SEQ ID NO: 7895834 - DNA, 22 bp, Homo sapiens
tcacatgctactgagccagacc

SEQ ID NO: 7895835 - DNA, 22 bp, Homo sapiens
tcacatgctactgagccagacc

SEQ ID NO: 7895836 - DNA, 22 bp, Homo sapiens
tcacatgctactgagccagacc

SEQ ID NO: 7895837 - DNA, 22 bp, Homo sapiens
tcacatgctactgagccagacc

SEQ ID NO: 7895838 - DNA, 22 bp, Homo sapiens
tcacatgcttgaggaaagaaaa

SEQ ID NO: 7895839 - DNA, 21 bp, Homo sapiens
tcacatgcttattcctggaat

SEQ ID NO: 7895840 - DNA, 21 bp, Homo sapiens
tcacatgcttattcctggaat

SEQ ID NO: 7895841 - DNA, 22 bp, Homo sapiens
tcacatgctgtgggatctgtat

SEQ ID NO: 7895842 - DNA, 22 bp, Homo sapiens
tcacatttatttcaaagttact

SEQ ID NO: 7895843 - DNA, 22 bp, Homo sapiens
tcacatttatttcaaagttact

SEQ ID NO: 7895844 - DNA, 22 bp, Homo sapiens
tcacattgttatgtaaatgttt

SEQ ID NO: 7895845 - DNA, 22 bp, Homo sapiens
tcacattgccgtctgtgcactt

SEQ ID NO: 7895846 - DNA, 22 bp, Homo sapiens
tcacattggaccttcctgacaa

SEQ ID NO: 7895847 - DNA, 22 bp, Homo sapiens
tcacattgtaggatagcagaga

SEQ ID NO: 7895848 - DNA, 22 bp, Homo sapiens
tcacattgtaggtcatttgcaa

SEQ ID NO: 7895849 - DNA, 22 bp, Homo sapiens
tcacattgtaggtcatttgcaa

SEQ ID NO: 7895850 - DNA, 22 bp, Homo sapiens
tcacatttctcagcactgatga

SEQ ID NO: 7895851 - DNA, 22 bp, Homo sapiens
tcacatttctcagcactgatga

SEQ ID NO: 7895852 - DNA, 22 bp, Homo sapiens
tcacatttctcagcactgatga

SEQ ID NO: 7895853 - DNA, 22 bp, Homo sapiens
tcacatttatttcaaagttact

SEQ ID NO: 7895854 - DNA, 22 bp, Homo sapiens
tcacatttatttcaaagttact

SEQ ID NO: 7895855 - DNA, 22 bp, Homo sapiens
tcacatttcaagtgctcaaaag

SEQ ID NO: 7895856 - DNA, 22 bp, Homo sapiens
tcacatttctttatgtagtctt

SEQ ID NO: 7895857 - DNA, 22 bp, Homo sapiens
tcacatttctgattataccaaa

SEQ ID NO: 7895858 - DNA, 22 bp, Homo sapiens
tcacatttctgattataccaaa

SEQ ID NO: 7895859 - DNA, 21 bp, Homo sapiens
tcacatttctcatgggtaaat

SEQ ID NO: 7895860 - DNA, 22 bp, Homo sapiens
tcacatttctcagcactgatga

SEQ ID NO: 7895861 - DNA, 22 bp, Homo sapiens
tcacatttctgattataccaaa

SEQ ID NO: 7895862 - DNA, 22 bp, Homo sapiens
tcaacactaaagaataatcttt

SEQ ID NO: 7895863 - DNA, 22 bp, Homo sapiens
tcaacactaaagaataatcttt

SEQ ID NO: 7895864 - DNA, 22 bp, Homo sapiens
tcaacactatccaggcaatctt

SEQ ID NO: 7895865 - DNA, 22 bp, Homo sapiens
tcaacaccacaatttcttaact

SEQ ID NO: 7895866 - DNA, 22 bp, Homo sapiens
tcaacacaacagagaaatgctg

SEQ ID NO: 7895867 - DNA, 22 bp, Homo sapiens
tcaacaattttgagatgagaca

SEQ ID NO: 7895868 - DNA, 22 bp, Homo sapiens
tcaacaataggatatagcaggt

SEQ ID NO: 7895869 - DNA, 22 bp, Homo sapiens
tcaacaatcccatggttcagtt

SEQ ID NO: 7895870 - DNA, 22 bp, Homo sapiens
tcaacaataggatatagcaggt

SEQ ID NO: 7895871 - DNA, 22 bp, Homo sapiens
tcaacaatgggtctgtaatgga

SEQ ID NO: 7895872 - DNA, 22 bp, Homo sapiens
tcaacaatgggtctgtaatgga

SEQ ID NO: 7895873 - DNA, 22 bp, Homo sapiens
tcaacaatcccatggttcagtt

SEQ ID NO: 7895874 - DNA, 22 bp, Homo sapiens
tcaacaattgcatgttgatgtt

SEQ ID NO: 7895875 - DNA, 22 bp, Homo sapiens
tcaacaatgggtctgtaatgga

SEQ ID NO: 7895876 - DNA, 22 bp, Homo sapiens
tcaacaataggatatagcaggt

SEQ ID NO: 7895877 - DNA, 22 bp, Homo sapiens
tcaacaagcattggtggtaaaa

SEQ ID NO: 7895878 - DNA, 22 bp, Homo sapiens
tcaacaagtatttttcaaggct

SEQ ID NO: 7895879 - DNA, 22 bp, Homo sapiens
tcaacaagagcccatgcttttt

SEQ ID NO: 7895880 - DNA, 22 bp, Homo sapiens
tcaacaagaataccatcctcct

SEQ ID NO: 7895881 - DNA, 22 bp, Homo sapiens
tcaaatgcacctctcatttgtt

SEQ ID NO: 7895882 - DNA, 22 bp, Homo sapiens
tcaaatgcacgtagagaaaata

SEQ ID NO: 7895883 - DNA, 22 bp, Homo sapiens
tcaaatgaggctgatgaatgtg

SEQ ID NO: 7895884 - DNA, 22 bp, Homo sapiens
tcaaatgagtgactcacacagg

SEQ ID NO: 7895885 - DNA, 22 bp, Homo sapiens
tcaaatgcacctctcatttgtt

SEQ ID NO: 7895886 - DNA, 22 bp, Homo sapiens
tcaaatgagtgactcacacagg

SEQ ID NO: 7895887 - DNA, 22 bp, Homo sapiens
tcaacagacatttttaagcact

SEQ ID NO: 7895888 - DNA, 22 bp, Homo sapiens
tcaacacttgctggtttcctct

SEQ ID NO: 7895889 - DNA, 22 bp, Homo sapiens
tcaacattcatatatagccaca

SEQ ID NO: 7895890 - DNA, 22 bp, Homo sapiens
tcaacatataggcaacctgtaa

SEQ ID NO: 7895891 - DNA, 22 bp, Homo sapiens
tcaacagtggcaaagaggcacg

SEQ ID NO: 7895892 - DNA, 22 bp, Homo sapiens
tcaaccacagtcccatgtctcc

SEQ ID NO: 7895893 - DNA, 22 bp, Homo sapiens
tcaacattcatatatagccaca

SEQ ID NO: 7895894 - DNA, 22 bp, Homo sapiens
tcaaccacagtcccatgtctcc

SEQ ID NO: 7895895 - DNA, 22 bp, Homo sapiens
tcaacagctagaaatatagaga

SEQ ID NO: 7895896 - DNA, 22 bp, Homo sapiens
tcaacagttgcactggagaggt

SEQ ID NO: 7895897 - DNA, 22 bp, Homo sapiens
tcaacatacatacatggtcagg

SEQ ID NO: 7895898 - DNA, 22 bp, Homo sapiens
tcaacgcatgctccaagaaaga

SEQ ID NO: 7895899 - DNA, 22 bp, Homo sapiens
tcaaccttgtgagaactgagtc

SEQ ID NO: 7895900 - DNA, 22 bp, Homo sapiens
tcaactcacaagaatgagcaag

SEQ ID NO: 7895901 - DNA, 22 bp, Homo sapiens
tcaactaactctattatttgaa

SEQ ID NO: 7895902 - DNA, 22 bp, Homo sapiens
tcaactaaggcacaatctctaa

SEQ ID NO: 7895903 - DNA, 22 bp, Homo sapiens
tcaactcacaagaatgagcaag

SEQ ID NO: 7895904 - DNA, 22 bp, Homo sapiens
tcaactcatgttattctgtgaa

SEQ ID NO: 7895905 - DNA, 22 bp, Homo sapiens
tcaactgcaagtttgcttagtt

SEQ ID NO: 7895906 - DNA, 22 bp, Homo sapiens
tcaactagttcaggctttagat

SEQ ID NO: 7895907 - DNA, 22 bp, Homo sapiens
tcaactgcaagtttgcttagtt

SEQ ID NO: 7895908 - DNA, 22 bp, Homo sapiens
tcaacttggagcacatttggct

SEQ ID NO: 7895909 - DNA, 22 bp, Homo sapiens
tcaactgcaagtttgcttagtt

SEQ ID NO: 7895910 - DNA, 23 bp, Homo sapiens
tcaactgctctgggaaggtcccc

SEQ ID NO: 7895911 - DNA, 22 bp, Homo sapiens
tcaactttgaaaccatagtgaa

SEQ ID NO: 7895912 - DNA, 22 bp, Homo sapiens
tcaactttagtgtagctattta

SEQ ID NO: 7895913 - DNA, 22 bp, Homo sapiens
tcaagaaaatgcctgctggtgt

SEQ ID NO: 7895914 - DNA, 22 bp, Homo sapiens
tcaagaaactgtagcaatgggt

SEQ ID NO: 7895915 - DNA, 22 bp, Homo sapiens
tcaagaaactgtgctacagagt

SEQ ID NO: 7895916 - DNA, 22 bp, Homo sapiens
tcaagaaactgtgctacagagt

SEQ ID NO: 7895917 - DNA, 22 bp, Homo sapiens
tcaagaaagggcttcaccagga

SEQ ID NO: 7895918 - DNA, 22 bp, Homo sapiens
tcaagaaactgtgctacagagt

SEQ ID NO: 7895919 - DNA, 22 bp, Homo sapiens
tcaagaaactgtgctacagagt

SEQ ID NO: 7895920 - DNA, 22 bp, Homo sapiens
tcaagaaactgtgctacagagt

SEQ ID NO: 7895921 - DNA, 23 bp, Homo sapiens
tcacagtatctctggagccatag

SEQ ID NO: 7895922 - DNA, 22 bp, Homo sapiens
tcacagtattcatgaacatgga

SEQ ID NO: 7895923 - DNA, 23 bp, Homo sapiens
tcacagtatctctggagccatag

SEQ ID NO: 7895924 - DNA, 22 bp, Homo sapiens
tcacagtattgggggtggagga

SEQ ID NO: 7895925 - DNA, 22 bp, Homo sapiens
tcacagtgacagccaatgtttt

SEQ ID NO: 7895926 - DNA, 22 bp, Homo sapiens
tcacagtcggtgacttcttgct

SEQ ID NO: 7895927 - DNA, 22 bp, Homo sapiens
tcacagtgacagccaatgtttt

SEQ ID NO: 7895928 - DNA, 22 bp, Homo sapiens
tcacagtcggtgacttcttgct

SEQ ID NO: 7895929 - DNA, 22 bp, Homo sapiens
tcacagtattgggggtggagga

SEQ ID NO: 7895930 - DNA, 22 bp, Homo sapiens
tcacagtattcatgaacatgga

SEQ ID NO: 7895931 - DNA, 22 bp, Homo sapiens
tcacagtcggtgacttcttgct

SEQ ID NO: 7895932 - DNA, 22 bp, Homo sapiens
tcacagtgacttacagagattg

SEQ ID NO: 7895933 - DNA, 22 bp, Homo sapiens
tcacagtgacagccaatgtttt

SEQ ID NO: 7895934 - DNA, 22 bp, Homo sapiens
tcacagtgacagccaatgtttt

SEQ ID NO: 7895935 - DNA, 22 bp, Homo sapiens
tcacagtgacagccaatgtttt

SEQ ID NO: 7895936 - DNA, 22 bp, Homo sapiens
tcacagtgacagccaatgtttt

SEQ ID NO: 7895937 - DNA, 22 bp, Homo sapiens
tcacagtgagaaatttgttggc

SEQ ID NO: 7895938 - DNA, 22 bp, Homo sapiens
tcacagtgagaaatttgttggc

SEQ ID NO: 7895939 - DNA, 22 bp, Homo sapiens
tcacagtgagaaatttgttggc

SEQ ID NO: 7895940 - DNA, 22 bp, Homo sapiens
tcacagtgacttacagagattg

SEQ ID NO: 7895941 - DNA, 22 bp, Homo sapiens
tcacagtgacttacagagattg

SEQ ID NO: 7895942 - DNA, 22 bp, Homo sapiens
tcacagtgacttacagagattg

SEQ ID NO: 7895943 - DNA, 22 bp, Homo sapiens
tcaagaaagggcttcaccagga

SEQ ID NO: 7895944 - DNA, 22 bp, Homo sapiens
tcaagaactggaaattgatatg

SEQ ID NO: 7895945 - DNA, 22 bp, Homo sapiens
tcaagaactggaaattgatatg

SEQ ID NO: 7895946 - DNA, 22 bp, Homo sapiens
tcaagaaggagactccactgtg

SEQ ID NO: 7895947 - DNA, 22 bp, Homo sapiens
tcaagaactgtgaagagtctga

SEQ ID NO: 7895948 - DNA, 22 bp, Homo sapiens
tcaagaacttaggagcaagcca

SEQ ID NO: 7895949 - DNA, 22 bp, Homo sapiens
tcacagtatcacacaaggatta

SEQ ID NO: 7895950 - DNA, 22 bp, Homo sapiens
tcacagtatcacacaaggatta

SEQ ID NO: 7895951 - DNA, 22 bp, Homo sapiens
tcaagaaggagactccactgtg

SEQ ID NO: 7895952 - DNA, 22 bp, Homo sapiens
tcacagtatcacacaaggatta

SEQ ID NO: 7895953 - DNA, 22 bp, Homo sapiens
tcacagtatcaggtggagtgga

SEQ ID NO: 7895954 - DNA, 22 bp, Homo sapiens
tcacagtatcaggtggagtgga

SEQ ID NO: 7895955 - DNA, 22 bp, Homo sapiens
tcacagtatctagaaatgaggg

SEQ ID NO: 7895956 - DNA, 22 bp, Homo sapiens
tcacagtatctagaaatgaggg

SEQ ID NO: 7895957 - DNA, 22 bp, Homo sapiens
tcagaacagcacagggtgattt

SEQ ID NO: 7895958 - DNA, 22 bp, Homo sapiens
tcagaacagcgagaatattcac

SEQ ID NO: 7895959 - DNA, 22 bp, Homo sapiens
tcagaacagctctcagatatcc

SEQ ID NO: 7895960 - DNA, 22 bp, Homo sapiens
tcagaacagctctcagatatcc

SEQ ID NO: 7895961 - DNA, 22 bp, Homo sapiens
tcagaacagctctcagatatcc

SEQ ID NO: 7895962 - DNA, 22 bp, Homo sapiens
tcagaacaggactggctgccat

SEQ ID NO: 7895963 - DNA, 22 bp, Homo sapiens
tcagaacaggttgtactatgtc

SEQ ID NO: 7895964 - DNA, 22 bp, Homo sapiens
tcagaacaggttgtactatgtc

SEQ ID NO: 7895965 - DNA, 20 bp, Homo sapiens
tcagaacagtagaggagcta

SEQ ID NO: 7895966 - DNA, 22 bp, Homo sapiens
tcagaagccaccttttgttggg

SEQ ID NO: 7895967 - DNA, 22 bp, Homo sapiens
tcagaagccggaagtgctcctc

SEQ ID NO: 7895968 - DNA, 22 bp, Homo sapiens
tcagaagccgggcaggttttgg

SEQ ID NO: 7895969 - DNA, 22 bp, Homo sapiens
tcagaagccgggcaggttttgg

SEQ ID NO: 7895970 - DNA, 22 bp, Homo sapiens
tcagaagttaatacgaggagaa

SEQ ID NO: 7895971 - DNA, 22 bp, Homo sapiens
tcagaagttaatatataaattt

SEQ ID NO: 7895972 - DNA, 22 bp, Homo sapiens
tcagaagttgaaggctcttttt

SEQ ID NO: 7895973 - DNA, 22 bp, Homo sapiens
tcagaagctaaatttgatattt

SEQ ID NO: 7895974 - DNA, 22 bp, Homo sapiens
tcagaagttaatacgaggagaa

SEQ ID NO: 7895975 - DNA, 22 bp, Homo sapiens
tcagaagccttgattatctaga

SEQ ID NO: 7895976 - DNA, 22 bp, Homo sapiens
tcagaagttgataaagtagttg

SEQ ID NO: 7895977 - DNA, 22 bp, Homo sapiens
tcagaagttgagatattcaggg

SEQ ID NO: 7895978 - DNA, 22 bp, Homo sapiens
tcagaagttgagatattcaggg

SEQ ID NO: 7895979 - DNA, 22 bp, Homo sapiens
tcagaagttgataaagtagttg

SEQ ID NO: 7895980 - DNA, 22 bp, Homo sapiens
tcagaagtttcaatcccagctg

SEQ ID NO: 7895981 - DNA, 22 bp, Homo sapiens
tcagaagtttcaatcccagctg

SEQ ID NO: 7895982 - DNA, 20 bp, Homo sapiens
tcagaagtttcctggagcat

SEQ ID NO: 7895983 - DNA, 20 bp, Homo sapiens
tcagaagtttcctggagcat

SEQ ID NO: 7895984 - DNA, 20 bp, Homo sapiens
tcagaagtttcctggagcat

SEQ ID NO: 7895985 - DNA, 22 bp, Homo sapiens
tcagaataaacatgggcatggg

SEQ ID NO: 7895986 - DNA, 23 bp, Homo sapiens
tcagaagtttggttgtaacatgg

SEQ ID NO: 7895987 - DNA, 23 bp, Homo sapiens
tcagaagtttggttgtaacatgg

SEQ ID NO: 7895988 - DNA, 22 bp, Homo sapiens
tcagaatatattcatgttgtca

SEQ ID NO: 7895989 - DNA, 22 bp, Homo sapiens
tcagaatatgctaatgacattt

SEQ ID NO: 7895990 - DNA, 22 bp, Homo sapiens
tcagaatatgctaatgacattt

SEQ ID NO: 7895991 - DNA, 23 bp, Homo sapiens
tcagaataataacctagtaactg

SEQ ID NO: 7895992 - DNA, 22 bp, Homo sapiens
tcagaataagttatgaaatgaa

SEQ ID NO: 7895993 - DNA, 22 bp, Homo sapiens
tcagaatcggtggggccaggaa

SEQ ID NO: 7895994 - DNA, 22 bp, Homo sapiens
tcagaatatgctaatgacattt

SEQ ID NO: 7895995 - DNA, 22 bp, Homo sapiens
tcagaatatgctaatgacattt

SEQ ID NO: 7895996 - DNA, 22 bp, Homo sapiens
tcagaatctctggaggcttggc

SEQ ID NO: 7895997 - DNA, 22 bp, Homo sapiens
tcagaatctctggaggcttggc

SEQ ID NO: 7895998 - DNA, 22 bp, Homo sapiens
tcagaatctgaaaagcgcttgg

SEQ ID NO: 7895999 - DNA, 22 bp, Homo sapiens
tcagaatctgcatttaacaaaa

SEQ ID NO: 7896000 - DNA, 22 bp, Homo sapiens
tcagaatctgcatttaacaaaa

SEQ ID NO: 7896001 - DNA, 21 bp, Homo sapiens
tcagaatctgtgagctatctc

SEQ ID NO: 7896002 - DNA, 22 bp, Homo sapiens
tcagaatctttctagagtctag

SEQ ID NO: 7896003 - DNA, 22 bp, Homo sapiens
tcagaatgaaatttctttcaga

SEQ ID NO: 7896004 - DNA, 21 bp, Homo sapiens
tcagaatgaaaaggcaatctg

SEQ ID NO: 7896005 - DNA, 22 bp, Homo sapiens
tcagaatggacccagactatag

SEQ ID NO: 7896006 - DNA, 22 bp, Homo sapiens
tcagaatggcccataaatagtc

SEQ ID NO: 7896007 - DNA, 23 bp, Homo sapiens
tcagaatgcactgaatttaccct

SEQ ID NO: 7896008 - DNA, 22 bp, Homo sapiens
tcagaacagaagctggctataa

SEQ ID NO: 7896009 - DNA, 22 bp, Homo sapiens
tcagaacagaagctggctataa

SEQ ID NO: 7896010 - DNA, 22 bp, Homo sapiens
tcagaacagcacagggtgattt

SEQ ID NO: 7896011 - DNA, 22 bp, Homo sapiens
tcagaacagaagaaggaacacg

SEQ ID NO: 7896012 - DNA, 22 bp, Homo sapiens
tcagaacagaagaaggaacacg

SEQ ID NO: 7896013 - DNA, 22 bp, Homo sapiens
tcagaacactttctctactgac

SEQ ID NO: 7896014 - DNA, 22 bp, Homo sapiens
tcagaacactttctctactgac

SEQ ID NO: 7896015 - DNA, 22 bp, Homo sapiens
tcagaacaattgggaaccatta

SEQ ID NO: 7896016 - DNA, 22 bp, Homo sapiens
tcagaacactttctctactgac

SEQ ID NO: 7896017 - DNA, 22 bp, Homo sapiens
tcagaaaggccacatggtgcag

SEQ ID NO: 7896018 - DNA, 22 bp, Homo sapiens
tcagaaaggccacatggtgcag

SEQ ID NO: 7896019 - DNA, 22 bp, Homo sapiens
tcagaaaggagttagaggtctc

SEQ ID NO: 7896020 - DNA, 22 bp, Homo sapiens
tcagaaaggccacatggtgcag

SEQ ID NO: 7896021 - DNA, 22 bp, Homo sapiens
tcagaaaggagttagaggtctc

SEQ ID NO: 7896022 - DNA, 22 bp, Homo sapiens
tcagaaaggagttagaggtctc

SEQ ID NO: 7896023 - DNA, 22 bp, Homo sapiens
tcagaaagcttttacttaaaca

SEQ ID NO: 7896024 - DNA, 22 bp, Homo sapiens
tcagaaagcttttacttaaaca

SEQ ID NO: 7896025 - DNA, 22 bp, Homo sapiens
tcagaaagcttttacttaaaca

SEQ ID NO: 7896026 - DNA, 22 bp, Homo sapiens
tcagaacaattcctttataaca

SEQ ID NO: 7896027 - DNA, 22 bp, Homo sapiens
tcagaacaattcctttataaca

SEQ ID NO: 7896028 - DNA, 22 bp, Homo sapiens
tcagaaaggttctatgttttac

SEQ ID NO: 7896029 - DNA, 22 bp, Homo sapiens
tcagaaaggttgagtcatgtgc

SEQ ID NO: 7896030 - DNA, 22 bp, Homo sapiens
tcagaaaggttctatgttttac

SEQ ID NO: 7896031 - DNA, 22 bp, Homo sapiens
tcagaaaggccacatggtgcag

SEQ ID NO: 7896032 - DNA, 22 bp, Homo sapiens
tcagaaaggccacatggtgcag

SEQ ID NO: 7896033 - DNA, 22 bp, Homo sapiens
tcagaaaggttctatgttttac

SEQ ID NO: 7896034 - DNA, 22 bp, Homo sapiens
tcagaaagacgaaacagatggg

SEQ ID NO: 7896035 - DNA, 22 bp, Homo sapiens
tcagaaagacgaaacagatggg

SEQ ID NO: 7896036 - DNA, 22 bp, Homo sapiens
tcagaaagacgaaacagatggg

SEQ ID NO: 7896037 - DNA, 22 bp, Homo sapiens
tcagaaagacgaaacagatggg

SEQ ID NO: 7896038 - DNA, 22 bp, Homo sapiens
tcagaaagctatatggtgtgtc

SEQ ID NO: 7896039 - DNA, 22 bp, Homo sapiens
tcagaaagctatatggtgtgtc

SEQ ID NO: 7896040 - DNA, 22 bp, Homo sapiens
tcagaaagctatatggtgtgtc

SEQ ID NO: 7896041 - DNA, 22 bp, Homo sapiens
tcagaaagcttagtgtcttgca

SEQ ID NO: 7896042 - DNA, 22 bp, Homo sapiens
tcagaaagcttttacttaaaca

SEQ ID NO: 7896043 - DNA, 22 bp, Homo sapiens
tcagaaacagaaactaagaacc

SEQ ID NO: 7896044 - DNA, 22 bp, Homo sapiens
tcagaaaccccaacaatggaga

SEQ ID NO: 7896045 - DNA, 22 bp, Homo sapiens
tcagaaaccagctctctcaatt

SEQ ID NO: 7896046 - DNA, 22 bp, Homo sapiens
tcagaaacagaaactaagaacc

SEQ ID NO: 7896047 - DNA, 22 bp, Homo sapiens
tcagaaaatgaaatggactctc

SEQ ID NO: 7896048 - DNA, 22 bp, Homo sapiens
tcagaaagaacacaggcagtag

SEQ ID NO: 7896049 - DNA, 22 bp, Homo sapiens
tcagaaactaaatgtggatttg

SEQ ID NO: 7896050 - DNA, 22 bp, Homo sapiens
tcagaaaccccaacaatggaga

SEQ ID NO: 7896051 - DNA, 22 bp, Homo sapiens
tcagaaagaacacaggcagtag

SEQ ID NO: 7896052 - DNA, 22 bp, Homo sapiens
tcagaaagacgaaacagatggg

SEQ ID NO: 7896053 - DNA, 22 bp, Homo sapiens
tcagaaagaacacaggcagtag

SEQ ID NO: 7896054 - DNA, 22 bp, Homo sapiens
tcagaaagaacacaggcagtag

SEQ ID NO: 7896055 - DNA, 22 bp, Homo sapiens
tcagaaagaacacaggcagtag

SEQ ID NO: 7896056 - DNA, 22 bp, Homo sapiens
tcagaaagaacacaggcagtag

SEQ ID NO: 7896057 - DNA, 22 bp, Homo sapiens
tcagaaagaacacaggcagtag

SEQ ID NO: 7896058 - DNA, 22 bp, Homo sapiens
tcactgctctgaaagtacaggg

SEQ ID NO: 7896059 - DNA, 22 bp, Homo sapiens
tcactgctctgaaagtacaggg

SEQ ID NO: 7896060 - DNA, 22 bp, Homo sapiens
tcactgctctctaagcatcgcc

SEQ ID NO: 7896061 - DNA, 22 bp, Homo sapiens
tcactgctctccaatgtggagt

SEQ ID NO: 7896062 - DNA, 22 bp, Homo sapiens
tcactgctctgaaagtacaggg

SEQ ID NO: 7896063 - DNA, 22 bp, Homo sapiens
tcactgctgctgccatgatgga

SEQ ID NO: 7896064 - DNA, 22 bp, Homo sapiens
tcactgctgctgccatgatgga

SEQ ID NO: 7896065 - DNA, 22 bp, Homo sapiens
tcactgcttcttggagaatgtc

SEQ ID NO: 7896066 - DNA, 22 bp, Homo sapiens
tcactgcttcttggagaatgtc

SEQ ID NO: 7896067 - DNA, 22 bp, Homo sapiens
tcactgcttaactcaagatctc

SEQ ID NO: 7896068 - DNA, 22 bp, Homo sapiens
tcactgcttaactcaagatctc

SEQ ID NO: 7896069 - DNA, 22 bp, Homo sapiens
tcagaaaatgaaatggactctc

SEQ ID NO: 7896070 - DNA, 22 bp, Homo sapiens
tcagaaaatgaaatggactctc

SEQ ID NO: 7896071 - DNA, 22 bp, Homo sapiens
tcagaaaataactgttagtttg

SEQ ID NO: 7896072 - DNA, 23 bp, Homo sapiens
tcactgctactcagcctgagatt

SEQ ID NO: 7896073 - DNA, 23 bp, Homo sapiens
tcactgctactcagcctgagatt

SEQ ID NO: 7896074 - DNA, 23 bp, Homo sapiens
tcactgctactcagcctgagatt

SEQ ID NO: 7896075 - DNA, 23 bp, Homo sapiens
tcactgctactcagcctgagatt

SEQ ID NO: 7896076 - DNA, 23 bp, Homo sapiens
tcactgctactcagcctgagatt

SEQ ID NO: 7896077 - DNA, 22 bp, Homo sapiens
tcactgctatattggatactga

SEQ ID NO: 7896078 - DNA, 22 bp, Homo sapiens
tcactgctatattggatactga

SEQ ID NO: 7896079 - DNA, 22 bp, Homo sapiens
tcactgctcagtctgtactaca

SEQ ID NO: 7896080 - DNA, 22 bp, Homo sapiens
tcactgctcgataacatgatta

SEQ ID NO: 7896081 - DNA, 22 bp, Homo sapiens
tcactgctcgataacatgatta

SEQ ID NO: 7896082 - DNA, 22 bp, Homo sapiens
tcactgctcgataacatgatta

SEQ ID NO: 7896083 - DNA, 22 bp, Homo sapiens
tcactgctctccaatgtggagt

SEQ ID NO: 7896084 - DNA, 22 bp, Homo sapiens
tcactgctctccaatgtggagt

SEQ ID NO: 7896085 - DNA, 22 bp, Homo sapiens
tcactgctcgataacatgatta

SEQ ID NO: 7896086 - DNA, 22 bp, Homo sapiens
tcactgctctccaatgtggagt

SEQ ID NO: 7896087 - DNA, 22 bp, Homo sapiens
tcactgcaacctccacctcccg

SEQ ID NO: 7896088 - DNA, 22 bp, Homo sapiens
tcactgcaacctccacctcccg

SEQ ID NO: 7896089 - DNA, 22 bp, Homo sapiens
tcactgcaacctccacctcctg

SEQ ID NO: 7896090 - DNA, 22 bp, Homo sapiens
tcactgcaacctccacctcccg

SEQ ID NO: 7896091 - DNA, 22 bp, Homo sapiens
tcactgcaacctccacctcccg

SEQ ID NO: 7896092 - DNA, 22 bp, Homo sapiens
tcactgcaacctccacctcccg

SEQ ID NO: 7896093 - DNA, 22 bp, Homo sapiens
tcactgcaacctccacctcccg

SEQ ID NO: 7896094 - DNA, 22 bp, Homo sapiens
tcactgcaacctccacctcctg

SEQ ID NO: 7896095 - DNA, 22 bp, Homo sapiens
tcactgcaacctccacctcctg

SEQ ID NO: 7896096 - DNA, 22 bp, Homo sapiens
tcactgcaacctccacctcctg

SEQ ID NO: 7896097 - DNA, 22 bp, Homo sapiens
tcactgcaacctccacctcctg

SEQ ID NO: 7896098 - DNA, 22 bp, Homo sapiens
tcactgcaacctccacctcctg

SEQ ID NO: 7896099 - DNA, 22 bp, Homo sapiens
tcactgcaacctccacctcctg

SEQ ID NO: 7896100 - DNA, 22 bp, Homo sapiens
tcactgcaacctccacctcctg

SEQ ID NO: 7896101 - DNA, 22 bp, Homo sapiens
tcactgcaacctccacctcctg

SEQ ID NO: 7896102 - DNA, 22 bp, Homo sapiens
tcactgcaacctccacctcctg

SEQ ID NO: 7896103 - DNA, 22 bp, Homo sapiens
tcactgcaacctccacctcctg

SEQ ID NO: 7896104 - DNA, 22 bp, Homo sapiens
tcactgcaacctccacctcctg

SEQ ID NO: 7896105 - DNA, 22 bp, Homo sapiens
tcactgcgcttcagcctgggtg

SEQ ID NO: 7896106 - DNA, 22 bp, Homo sapiens
tcactgcgcttcagcctgggtg

SEQ ID NO: 7896107 - DNA, 22 bp, Homo sapiens
tcactgctacacaagtttctgc

SEQ ID NO: 7896108 - DNA, 22 bp, Homo sapiens
tcactgcgcttcagcctgggtg

SEQ ID NO: 7896109 - DNA, 22 bp, Homo sapiens
tcactgcatcccatctccagcc

SEQ ID NO: 7896110 - DNA, 22 bp, Homo sapiens
tcactgcaacctccacctcctg

SEQ ID NO: 7896111 - DNA, 22 bp, Homo sapiens
tcactgcaacctccacctcctg

SEQ ID NO: 7896112 - DNA, 22 bp, Homo sapiens
tcactgcaacctccacctcctg

SEQ ID NO: 7896113 - DNA, 22 bp, Homo sapiens
tcactgcaacctccacctcctg

SEQ ID NO: 7896114 - DNA, 22 bp, Homo sapiens
tcactgcaacctccacctcctg

SEQ ID NO: 7896115 - DNA, 22 bp, Homo sapiens
tcacatttgttcttgaatctaa

SEQ ID NO: 7896116 - DNA, 22 bp, Homo sapiens
tcacatttgttcctctgcactt

SEQ ID NO: 7896117 - DNA, 22 bp, Homo sapiens
tcacatttgttcctctgcactt

SEQ ID NO: 7896118 - DNA, 22 bp, Homo sapiens
tcacatttgttcctctgcactt

SEQ ID NO: 7896119 - DNA, 22 bp, Homo sapiens
tcacatttggagaaagcctgcc

SEQ ID NO: 7896120 - DNA, 22 bp, Homo sapiens
tcacattttagtaccatgattt

SEQ ID NO: 7896121 - DNA, 22 bp, Homo sapiens
tcacattttatatctctggttt

SEQ ID NO: 7896122 - DNA, 22 bp, Homo sapiens
tcacatttgttcttgaatctaa

SEQ ID NO: 7896123 - DNA, 22 bp, Homo sapiens
tcacattttagtaccatgattt

SEQ ID NO: 7896124 - DNA, 22 bp, Homo sapiens
tcacatttgataatgcccattg

SEQ ID NO: 7896125 - DNA, 22 bp, Homo sapiens
tcacatttgcaattgcattgtt

SEQ ID NO: 7896126 - DNA, 22 bp, Homo sapiens
tcacatttgcaattgcattgtt

SEQ ID NO: 7896127 - DNA, 22 bp, Homo sapiens
tcacatttgctatcccactcct

SEQ ID NO: 7896128 - DNA, 22 bp, Homo sapiens
tcacatttgtgttttattagag

SEQ ID NO: 7896129 - DNA, 22 bp, Homo sapiens
tcacatttgtgttttattagag

SEQ ID NO: 7896130 - DNA, 22 bp, Homo sapiens
tcacattttatatctctggttt

SEQ ID NO: 7896131 - DNA, 22 bp, Homo sapiens
tcacattttatctattttaagt

SEQ ID NO: 7896132 - DNA, 22 bp, Homo sapiens
tcacattttatctattttaagt

SEQ ID NO: 7896133 - DNA, 22 bp, Homo sapiens
tcacattttatctattttaagt

SEQ ID NO: 7896134 - DNA, 22 bp, Homo sapiens
tcactgattatgaaaatgaagg

SEQ ID NO: 7896135 - DNA, 22 bp, Homo sapiens
tcactgattatgaaaatgaagg

SEQ ID NO: 7896136 - DNA, 22 bp, Homo sapiens
tcactgattatgaaaatgaagg

SEQ ID NO: 7896137 - DNA, 22 bp, Homo sapiens
tcactgattatgaaaatgaagg

SEQ ID NO: 7896138 - DNA, 22 bp, Homo sapiens
tcactgattatgaaaatgaagg

SEQ ID NO: 7896139 - DNA, 22 bp, Homo sapiens
tcactgcaacctccacctcccg

SEQ ID NO: 7896140 - DNA, 22 bp, Homo sapiens
tcactgatttgcccttatcctg

SEQ ID NO: 7896141 - DNA, 22 bp, Homo sapiens
tcactgatttgcccttatcctg

SEQ ID NO: 7896142 - DNA, 22 bp, Homo sapiens
tcactgcaacctccacctcccg

SEQ ID NO: 7896143 - DNA, 22 bp, Homo sapiens
tcactgcaacctccacctcccg

SEQ ID NO: 7896144 - DNA, 22 bp, Homo sapiens
tcactgcaacctccacctcccg

SEQ ID NO: 7896145 - DNA, 22 bp, Homo sapiens
tcactgcaacctccacctcccg

SEQ ID NO: 7896146 - DNA, 22 bp, Homo sapiens
tcactgcaacctccacctcccg

SEQ ID NO: 7896147 - DNA, 22 bp, Homo sapiens
tcactgcaacctccacctcccg

SEQ ID NO: 7896148 - DNA, 22 bp, Homo sapiens
tcactgcaacctccacctcccg

SEQ ID NO: 7896149 - DNA, 22 bp, Homo sapiens
tcactgcaacctccacctcccg

SEQ ID NO: 7896150 - DNA, 22 bp, Homo sapiens
tcactgcaacctccacctcccg

SEQ ID NO: 7896151 - DNA, 22 bp, Homo sapiens
tcactgcaacctccacctcccg

SEQ ID NO: 7896152 - DNA, 22 bp, Homo sapiens
tcactgcaacctccacctcccg

SEQ ID NO: 7896153 - DNA, 22 bp, Homo sapiens
tcactgcaacctccacctcccg

SEQ ID NO: 7896154 - DNA, 22 bp, Homo sapiens
tcactgcaacctccacctcccg

SEQ ID NO: 7896155 - DNA, 22 bp, Homo sapiens
tcactgcaacctccacctcccg

SEQ ID NO: 7896156 - DNA, 22 bp, Homo sapiens
tcactgcaacctccacctcccg

SEQ ID NO: 7896157 - DNA, 22 bp, Homo sapiens
tcactgcaacctccacctcccg

SEQ ID NO: 7896158 - DNA, 22 bp, Homo sapiens
tcagatggcataggttggaatt

SEQ ID NO: 7896159 - DNA, 20 bp, Homo sapiens
tcagatgggagtgagccatc

SEQ ID NO: 7896160 - DNA, 22 bp, Homo sapiens
tcagatggcacacagagcctgc

SEQ ID NO: 7896161 - DNA, 22 bp, Homo sapiens
tcagatggcacacagagcctgc

SEQ ID NO: 7896162 - DNA, 22 bp, Homo sapiens
tcagatggatttatactatttc

SEQ ID NO: 7896163 - DNA, 22 bp, Homo sapiens
tcagatggaatgatgccactgc

SEQ ID NO: 7896164 - DNA, 22 bp, Homo sapiens
tcagatggaaaggttactgtcc

SEQ ID NO: 7896165 - DNA, 22 bp, Homo sapiens
tcagatggaatgatgccactgc

SEQ ID NO: 7896166 - DNA, 22 bp, Homo sapiens
tcagatggaggcaatgttacct

SEQ ID NO: 7896167 - DNA, 22 bp, Homo sapiens
tcagatggaggcaatgttacct

SEQ ID NO: 7896168 - DNA, 22 bp, Homo sapiens
tcagatggattcattacatgac

SEQ ID NO: 7896169 - DNA, 22 bp, Homo sapiens
tcagatggattcattacatgac

SEQ ID NO: 7896170 - DNA, 22 bp, Homo sapiens
tcagatgctagggctgagctat

SEQ ID NO: 7896171 - DNA, 22 bp, Homo sapiens
tcagatgcttagtgactacaca

SEQ ID NO: 7896172 - DNA, 22 bp, Homo sapiens
tcagatgcttagtgactacaca

SEQ ID NO: 7896173 - DNA, 19 bp, Homo sapiens
tcagatgcttctcgtctca

SEQ ID NO: 7896174 - DNA, 22 bp, Homo sapiens
tcagatgcttagagattagact

SEQ ID NO: 7896175 - DNA, 22 bp, Homo sapiens
tcagatgctgttttcttatata

SEQ ID NO: 7896176 - DNA, 22 bp, Homo sapiens
tcagatgcttagagattagact

SEQ ID NO: 7896177 - DNA, 20 bp, Homo sapiens
tcagatgggagtgagccatc

SEQ ID NO: 7896178 - DNA, 22 bp, Homo sapiens
tcagatgggttttgaaggatgt

SEQ ID NO: 7896179 - DNA, 22 bp, Homo sapiens
tcagatggtactaatttaagga

SEQ ID NO: 7896180 - DNA, 22 bp, Homo sapiens
tcagatggtcattcactagggt

SEQ ID NO: 7896181 - DNA, 22 bp, Homo sapiens
tcagatgtctccaagggctggg

SEQ ID NO: 7896182 - DNA, 22 bp, Homo sapiens
tcagatgtccttccagagattt

SEQ ID NO: 7896183 - DNA, 22 bp, Homo sapiens
tcagatgttgaaaaggaaaagt

SEQ ID NO: 7896184 - DNA, 22 bp, Homo sapiens
tcagatgtctctcagcagggtt

SEQ ID NO: 7896185 - DNA, 22 bp, Homo sapiens
tcagattctggatagatcttca

SEQ ID NO: 7896186 - DNA, 18 bp, Homo sapiens
tcagatttaactgtatcc

SEQ ID NO: 7896187 - DNA, 20 bp, Homo sapiens
tcagattaaatgttctgtct

SEQ ID NO: 7896188 - DNA, 18 bp, Homo sapiens
tcagatttaactgtatcc

SEQ ID NO: 7896189 - DNA, 22 bp, Homo sapiens
tcagattgttggagccaaacag

SEQ ID NO: 7896190 - DNA, 22 bp, Homo sapiens
tcagatttactgcagagcagat

SEQ ID NO: 7896191 - DNA, 18 bp, Homo sapiens
tcagatttaactgtatcc

SEQ ID NO: 7896192 - DNA, 22 bp, Homo sapiens
tcagatttactgcagagcagat

SEQ ID NO: 7896193 - DNA, 22 bp, Homo sapiens
tcagatttactgcagagcagat

SEQ ID NO: 7896194 - DNA, 22 bp, Homo sapiens
tcagattttattttcctgttac

SEQ ID NO: 7896195 - DNA, 22 bp, Homo sapiens
tcagattttattttcctgttac

SEQ ID NO: 7896196 - DNA, 22 bp, Homo sapiens
tcagatttgtcctactaggcac

SEQ ID NO: 7896197 - DNA, 22 bp, Homo sapiens
tcagatttgatgtggttttcta

SEQ ID NO: 7896198 - DNA, 22 bp, Homo sapiens
tcagatttgtcctactaggcac

SEQ ID NO: 7896199 - DNA, 22 bp, Homo sapiens
tcagatttggacacaggaactt

SEQ ID NO: 7896200 - DNA, 22 bp, Homo sapiens
tcagatttggacacaggaactt

SEQ ID NO: 7896201 - DNA, 22 bp, Homo sapiens
tcagatttgatgtggttttcta

SEQ ID NO: 7896202 - DNA, 22 bp, Homo sapiens
tcagatttgaatattcctttcg

SEQ ID NO: 7896203 - DNA, 22 bp, Homo sapiens
tcagatttgaatattcctttcg

SEQ ID NO: 7896204 - DNA, 22 bp, Homo sapiens
tcagatttgaatattcctttcg

SEQ ID NO: 7896205 - DNA, 22 bp, Homo sapiens
tcagatttcttcttgcaacggc

SEQ ID NO: 7896206 - DNA, 22 bp, Homo sapiens
tcagattttgcacgaggttttg

SEQ ID NO: 7896207 - DNA, 20 bp, Homo sapiens
tcagattttgggtcactgat

SEQ ID NO: 7896208 - DNA, 22 bp, Homo sapiens
tcagattttccagcctttctct

SEQ ID NO: 7896209 - DNA, 22 bp, Homo sapiens
tcagattttgcacgaggttttg

SEQ ID NO: 7896210 - DNA, 20 bp, Homo sapiens
tcagatttttctaactttga

SEQ ID NO: 7896211 - DNA, 22 bp, Homo sapiens
tcagattttccagcctttctct

SEQ ID NO: 7896212 - DNA, 22 bp, Homo sapiens
tcagattttccagcctttctct

SEQ ID NO: 7896213 - DNA, 22 bp, Homo sapiens
tcagattttattttcctgttac

SEQ ID NO: 7896214 - DNA, 22 bp, Homo sapiens
tcagattttccacagactggaa

SEQ ID NO: 7896215 - DNA, 22 bp, Homo sapiens
tcagattttccacagactggaa

SEQ ID NO: 7896216 - DNA, 22 bp, Homo sapiens
tcagatttatgtggctaggctc

SEQ ID NO: 7896217 - DNA, 22 bp, Homo sapiens
tcagatttcagctaaagggatg

SEQ ID NO: 7896218 - DNA, 22 bp, Homo sapiens
tcagatttcagctaaagggatg

SEQ ID NO: 7896219 - DNA, 22 bp, Homo sapiens
tcagatttcctgttgaagaagt

SEQ ID NO: 7896220 - DNA, 22 bp, Homo sapiens
tcagatttagggtgattacctt

SEQ ID NO: 7896221 - DNA, 22 bp, Homo sapiens
tcagatttatgaatatactatg

SEQ ID NO: 7896222 - DNA, 22 bp, Homo sapiens
tcagatttatgaatatactatg

SEQ ID NO: 7896223 - DNA, 22 bp, Homo sapiens
tcagatttagggtgattacctt

SEQ ID NO: 7896224 - DNA, 22 bp, Homo sapiens
tcagatttagggtgattacctt

SEQ ID NO: 7896225 - DNA, 22 bp, Homo sapiens
tcagatttatgaatatactatg

SEQ ID NO: 7896226 - DNA, 22 bp, Homo sapiens
tcagatttcctgttgaagaagt

SEQ ID NO: 7896227 - DNA, 22 bp, Homo sapiens
tcagatttcctgttgaagaagt

SEQ ID NO: 7896228 - DNA, 22 bp, Homo sapiens
tcagatttatgtggctaggctc

SEQ ID NO: 7896229 - DNA, 22 bp, Homo sapiens
tcagatttccttgcagtttgga

SEQ ID NO: 7896230 - DNA, 22 bp, Homo sapiens
tcagatttctagcgtttggcca

SEQ ID NO: 7896231 - DNA, 22 bp, Homo sapiens
tcagatttctagcgtttggcca

SEQ ID NO: 7896232 - DNA, 22 bp, Homo sapiens
tcagatttctgaaagccctctc

SEQ ID NO: 7896233 - DNA, 22 bp, Homo sapiens
tcagatttctgaaagccctctc

SEQ ID NO: 7896234 - DNA, 22 bp, Homo sapiens
tcagatttctagcgtttggcca

SEQ ID NO: 7896235 - DNA, 22 bp, Homo sapiens
tcagatttctagcgtttggcca

SEQ ID NO: 7896236 - DNA, 22 bp, Homo sapiens
tcagatttcttcttgcaacggc

SEQ ID NO: 7896237 - DNA, 22 bp, Homo sapiens
tcagatttccttgcagtttgga

SEQ ID NO: 7896238 - DNA, 22 bp, Homo sapiens
tcagatttcttcttgcaacggc

SEQ ID NO: 7896239 - DNA, 22 bp, Homo sapiens
tcagaattttctggaatggagc

SEQ ID NO: 7896240 - DNA, 22 bp, Homo sapiens
tcagacaactctggaggctggc

SEQ ID NO: 7896241 - DNA, 22 bp, Homo sapiens
tcagaattttaaaccaaggaaa

SEQ ID NO: 7896242 - DNA, 22 bp, Homo sapiens
tcagaatttaaaatgtgtagat

SEQ ID NO: 7896243 - DNA, 21 bp, Homo sapiens
tcagaattacccctggatctg

SEQ ID NO: 7896244 - DNA, 22 bp, Homo sapiens
tcagaatgttcctgctgtcagt

SEQ ID NO: 7896245 - DNA, 22 bp, Homo sapiens
tcagaatgtgcagaggaacagt

SEQ ID NO: 7896246 - DNA, 22 bp, Homo sapiens
tcagaatgtgcagaggaacagt

SEQ ID NO: 7896247 - DNA, 23 bp, Homo sapiens
tcagaattccagtttctttgaag

SEQ ID NO: 7896248 - DNA, 22 bp, Homo sapiens
tcagacagagaagtacaatgag

SEQ ID NO: 7896249 - DNA, 22 bp, Homo sapiens
tcagacagaaggactatttgaa

SEQ ID NO: 7896250 - DNA, 22 bp, Homo sapiens
tcagacacagatgagacaagga

SEQ ID NO: 7896251 - DNA, 22 bp, Homo sapiens
tcagacaccgtctattttgcct

SEQ ID NO: 7896252 - DNA, 18 bp, Homo sapiens
tcagacaagttagacagg

SEQ ID NO: 7896253 - DNA, 22 bp, Homo sapiens
tcagacaagtaaaataatgtaa

SEQ ID NO: 7896254 - DNA, 22 bp, Homo sapiens
tcagacaagtaaaataatgtaa

SEQ ID NO: 7896255 - DNA, 22 bp, Homo sapiens
tcagacaagtaaaataatgtaa

SEQ ID NO: 7896256 - DNA, 22 bp, Homo sapiens
tcagacaactctggaggctggc

SEQ ID NO: 7896257 - DNA, 22 bp, Homo sapiens
tcagacacagatgagacaagga

SEQ ID NO: 7896258 - DNA, 22 bp, Homo sapiens
tcagacaagttgatgtacctgg

SEQ ID NO: 7896259 - DNA, 22 bp, Homo sapiens
tcagacacagatgagacaagga

SEQ ID NO: 7896260 - DNA, 22 bp, Homo sapiens
tcagacaagtaaaataatgtaa

SEQ ID NO: 7896261 - DNA, 22 bp, Homo sapiens
tcagacacagatgagacaagga

SEQ ID NO: 7896262 - DNA, 22 bp, Homo sapiens
tcagacaagttgatgtacctgg

SEQ ID NO: 7896263 - DNA, 22 bp, Homo sapiens
tcagacaagttgatgtacctgg

SEQ ID NO: 7896264 - DNA, 22 bp, Homo sapiens
tcagagttcctcatagatccag

SEQ ID NO: 7896265 - DNA, 22 bp, Homo sapiens
tcagagtgttttactaaacaag

SEQ ID NO: 7896266 - DNA, 21 bp, Homo sapiens
tcagagtgtgttacagcaagc

SEQ ID NO: 7896267 - DNA, 22 bp, Homo sapiens
tcagagtgtggtgagatgtgca

SEQ ID NO: 7896268 - DNA, 21 bp, Homo sapiens
tcagagtgtgttacagcaagc

SEQ ID NO: 7896269 - DNA, 22 bp, Homo sapiens
tcagagtgtgacttggtcatga

SEQ ID NO: 7896270 - DNA, 22 bp, Homo sapiens
tcagagtgtgagacatattgga

SEQ ID NO: 7896271 - DNA, 22 bp, Homo sapiens
tcagacagaggagctcgtgcag

SEQ ID NO: 7896272 - DNA, 22 bp, Homo sapiens
tcagcaggcaggaggcatgcca

SEQ ID NO: 7896273 - DNA, 22 bp, Homo sapiens
tcagcaggcagaaatctgcaga

SEQ ID NO: 7896274 - DNA, 22 bp, Homo sapiens
tcagcaggcaggaggcatgcca

SEQ ID NO: 7896275 - DNA, 22 bp, Homo sapiens
tcagcaagaagctgtgggcttc

SEQ ID NO: 7896276 - DNA, 22 bp, Homo sapiens
tcagcaactctcattccgcttt

SEQ ID NO: 7896277 - DNA, 22 bp, Homo sapiens
tcagcaagaagtcatttgtagc

SEQ ID NO: 7896278 - DNA, 22 bp, Homo sapiens
tcagcaagaagctgtgggcttc

SEQ ID NO: 7896279 - DNA, 22 bp, Homo sapiens
tcagcaactatttatcaaattc

SEQ ID NO: 7896280 - DNA, 22 bp, Homo sapiens
tcagcaaatacttattgagcgc

SEQ ID NO: 7896281 - DNA, 22 bp, Homo sapiens
tcagatttttgagatgtctgtt

SEQ ID NO: 7896282 - DNA, 22 bp, Homo sapiens
tcagatttttgagatgtctgtt

SEQ ID NO: 7896283 - DNA, 22 bp, Homo sapiens
tcagatttttgagatgtctgtt

SEQ ID NO: 7896284 - DNA, 22 bp, Homo sapiens
tcagatttttgagatgtctgtt

SEQ ID NO: 7896285 - DNA, 22 bp, Homo sapiens
tcagatttttgagatgtctgtt

SEQ ID NO: 7896286 - DNA, 20 bp, Homo sapiens
tcagatttttctaactttga

SEQ ID NO: 7896287 - DNA, 20 bp, Homo sapiens
tcagattttgggtcactgat

SEQ ID NO: 7896288 - DNA, 20 bp, Homo sapiens
tcagatttttctaactttga

SEQ ID NO: 7896289 - DNA, 22 bp, Homo sapiens
tcagcaaacattgattggactt

SEQ ID NO: 7896290 - DNA, 22 bp, Homo sapiens
tcagcaaaatgtggctagtgct

SEQ ID NO: 7896291 - DNA, 21 bp, Homo sapiens
tcagcaaaataagcaaatgga

SEQ ID NO: 7896292 - DNA, 21 bp, Homo sapiens
tcagcaaaataagcaaatgga

SEQ ID NO: 7896293 - DNA, 22 bp, Homo sapiens
tcagcaaaggaccagcacaggc

SEQ ID NO: 7896294 - DNA, 22 bp, Homo sapiens
tcagcaaaggaccagcacaggc

SEQ ID NO: 7896295 - DNA, 17 bp, Homo sapiens
tcagcaaagacaaagga

SEQ ID NO: 7896296 - DNA, 17 bp, Homo sapiens
tcagcaaagacaaagga

SEQ ID NO: 7896297 - DNA, 17 bp, Homo sapiens
tcagcaaagacaaagga

SEQ ID NO: 7896298 - DNA, 22 bp, Homo sapiens
tcagcaggctgtcagcaggggc

SEQ ID NO: 7896299 - DNA, 22 bp, Homo sapiens
tcagcaggctgtcagcaggggc

SEQ ID NO: 7896300 - DNA, 22 bp, Homo sapiens
tcagcaggctgtcagcaggggc

SEQ ID NO: 7896301 - DNA, 22 bp, Homo sapiens
tcagcaggctgtcagcaggggc

SEQ ID NO: 7896302 - DNA, 22 bp, Homo sapiens
tcagcaggctgtcagcaggggc

SEQ ID NO: 7896303 - DNA, 22 bp, Homo sapiens
tcagcaggctgtcagcaggggc

SEQ ID NO: 7896304 - DNA, 22 bp, Homo sapiens
tcagcaggctctggttgaccat

SEQ ID NO: 7896305 - DNA, 22 bp, Homo sapiens
tcagcaggctctggttgaccat

SEQ ID NO: 7896306 - DNA, 22 bp, Homo sapiens
tcagcaggctctggttgaccat

SEQ ID NO: 7896307 - DNA, 22 bp, Homo sapiens
tcagcaggcggttccttgtggg

SEQ ID NO: 7896308 - DNA, 22 bp, Homo sapiens
tcagcaggcggttccttgtggg

SEQ ID NO: 7896309 - DNA, 22 bp, Homo sapiens
tcagcaggcggttccttgtggg

SEQ ID NO: 7896310 - DNA, 22 bp, Homo sapiens
tcagcaggcagtgggtcacaat

SEQ ID NO: 7896311 - DNA, 22 bp, Homo sapiens
tcagcaggcagtgggtcacaat

SEQ ID NO: 7896312 - DNA, 22 bp, Homo sapiens
tcagcaggcagtgggtcacaat

SEQ ID NO: 7896313 - DNA, 22 bp, Homo sapiens
tcagcaggcaggaggcatgcca

SEQ ID NO: 7896314 - DNA, 22 bp, Homo sapiens
tcagcaggcaggaggcatgcca

SEQ ID NO: 7896315 - DNA, 22 bp, Homo sapiens
tcagcaggcccatcctccaggc

SEQ ID NO: 7896316 - DNA, 22 bp, Homo sapiens
tcagcaggcccatcctccaggc

SEQ ID NO: 7896317 - DNA, 22 bp, Homo sapiens
tcagcaggcccatcctccaggc

SEQ ID NO: 7896318 - DNA, 22 bp, Homo sapiens
tcagcaggcggttccttgtggg

SEQ ID NO: 7896319 - DNA, 22 bp, Homo sapiens
tcagcagggaggctctgtgccc

SEQ ID NO: 7896320 - DNA, 22 bp, Homo sapiens
tcagcagggagaggagaatgca

SEQ ID NO: 7896321 - DNA, 22 bp, Homo sapiens
tcagcagggaggctctgtgccc

SEQ ID NO: 7896322 - DNA, 22 bp, Homo sapiens
tcagcagggcatactgagccta

SEQ ID NO: 7896323 - DNA, 22 bp, Homo sapiens
tcagcagggaggctctgtgccc

SEQ ID NO: 7896324 - DNA, 22 bp, Homo sapiens
tcagcagggagaggagaatgca

SEQ ID NO: 7896325 - DNA, 22 bp, Homo sapiens
tcagcagggagaggagaatgca

SEQ ID NO: 7896326 - DNA, 22 bp, Homo sapiens
tcagcagggagaggagaatgca

SEQ ID NO: 7896327 - DNA, 22 bp, Homo sapiens
tcagcagggagaggagaatgca

SEQ ID NO: 7896328 - DNA, 22 bp, Homo sapiens
tcagcagggcctccttgtgcag

SEQ ID NO: 7896329 - DNA, 22 bp, Homo sapiens
tcagcagggcctccttgtgcag

SEQ ID NO: 7896330 - DNA, 22 bp, Homo sapiens
tcagcagggcctccttgtgcag

SEQ ID NO: 7896331 - DNA, 22 bp, Homo sapiens
tcagcagggccatgctctctct

SEQ ID NO: 7896332 - DNA, 22 bp, Homo sapiens
tcagcagggccatgctctctct

SEQ ID NO: 7896333 - DNA, 22 bp, Homo sapiens
tcagcagggccatgctctctct

SEQ ID NO: 7896334 - DNA, 22 bp, Homo sapiens
tcagcagggcatactgagccta

SEQ ID NO: 7896335 - DNA, 22 bp, Homo sapiens
tcagcagggcatactgagccta

SEQ ID NO: 7896336 - DNA, 22 bp, Homo sapiens
tcagcagggcatactgagccta

SEQ ID NO: 7896337 - DNA, 22 bp, Homo sapiens
tcagcagggcatactgagccta

SEQ ID NO: 7896338 - DNA, 22 bp, Homo sapiens
tcagcagggctgtggtgtggct

SEQ ID NO: 7896339 - DNA, 22 bp, Homo sapiens
tcagcagggctgggagctgtga

SEQ ID NO: 7896340 - DNA, 22 bp, Homo sapiens
tcagcagggctgtggtgtggct

SEQ ID NO: 7896341 - DNA, 22 bp, Homo sapiens
tcagcagggctgtggtgtggct

SEQ ID NO: 7896342 - DNA, 22 bp, Homo sapiens
tcagcagggctgggagctgtga

SEQ ID NO: 7896343 - DNA, 22 bp, Homo sapiens
tcagcagggctgggagctgtga

SEQ ID NO: 7896344 - DNA, 22 bp, Homo sapiens
tcagcagggcctccttgtgcag

SEQ ID NO: 7896345 - DNA, 22 bp, Homo sapiens
tcagcagggcctccttgtgcag

SEQ ID NO: 7896346 - DNA, 22 bp, Homo sapiens
tcagcaggggccgttgggtgga

SEQ ID NO: 7896347 - DNA, 22 bp, Homo sapiens
tcagcaggggccgttgggtgga

SEQ ID NO: 7896348 - DNA, 22 bp, Homo sapiens
tcagcaggggccgttgggtgga

SEQ ID NO: 7896349 - DNA, 22 bp, Homo sapiens
tcagcagtgtcagttcccagag

SEQ ID NO: 7896350 - DNA, 17 bp, Homo sapiens
tcagcaggggccaagct

SEQ ID NO: 7896351 - DNA, 17 bp, Homo sapiens
tcagcaggggccaagct

SEQ ID NO: 7896352 - DNA, 17 bp, Homo sapiens
tcagcaggggccaagct

SEQ ID NO: 7896353 - DNA, 22 bp, Homo sapiens
tcagcagggctgtggtgtggct

SEQ ID NO: 7896354 - DNA, 17 bp, Homo sapiens
tcagcaggggccaagct

SEQ ID NO: 7896355 - DNA, 17 bp, Homo sapiens
tcagcaggggccaagct

SEQ ID NO: 7896356 - DNA, 22 bp, Homo sapiens
tcagcatcaggttgtctgaatt

SEQ ID NO: 7896357 - DNA, 22 bp, Homo sapiens
tcagcatcagtattgtttagga

SEQ ID NO: 7896358 - DNA, 21 bp, Homo sapiens
tcagcatcctgagctgtcctc

SEQ ID NO: 7896359 - DNA, 22 bp, Homo sapiens
tcagcatctacagctttgctat

SEQ ID NO: 7896360 - DNA, 22 bp, Homo sapiens
tcagcatcttcagcatggggaa

SEQ ID NO: 7896361 - DNA, 22 bp, Homo sapiens
tcagcatctcaaccttctctac

SEQ ID NO: 7896362 - DNA, 22 bp, Homo sapiens
tcagcatctcaaccttctctac

SEQ ID NO: 7896363 - DNA, 22 bp, Homo sapiens
tcagcatctcaaccttctctac

SEQ ID NO: 7896364 - DNA, 20 bp, Homo sapiens
tcagcatgttctcctccggt

SEQ ID NO: 7896365 - DNA, 22 bp, Homo sapiens
tcagcatgtacttctcctccat

SEQ ID NO: 7896366 - DNA, 20 bp, Homo sapiens
tcagcatgctcctcagacat

SEQ ID NO: 7896367 - DNA, 20 bp, Homo sapiens
tcagcatgctcctcagacat

SEQ ID NO: 7896368 - DNA, 22 bp, Homo sapiens
tcagcattctttacaaggatga

SEQ ID NO: 7896369 - DNA, 22 bp, Homo sapiens
tcagcattcctgaagacaagca

SEQ ID NO: 7896370 - DNA, 19 bp, Homo sapiens
tcagcatcaatttggtcct

SEQ ID NO: 7896371 - DNA, 19 bp, Homo sapiens
tcagcatcaatttggtcct

SEQ ID NO: 7896372 - DNA, 22 bp, Homo sapiens
tcagcatcacgtggtccgagaa

SEQ ID NO: 7896373 - DNA, 23 bp, Homo sapiens
tcagcatcacctgggaacttact

SEQ ID NO: 7896374 - DNA, 22 bp, Homo sapiens
tcagcagtgtcagttcccagag

SEQ ID NO: 7896375 - DNA, 22 bp, Homo sapiens
tcagcagtgtgcccagaggctg

SEQ ID NO: 7896376 - DNA, 22 bp, Homo sapiens
tcagcagtgtgcccagaggctg

SEQ ID NO: 7896377 - DNA, 22 bp, Homo sapiens
tcagcagttattcccctacaga

SEQ ID NO: 7896378 - DNA, 22 bp, Homo sapiens
tcagcagttattcccctacaga

SEQ ID NO: 7896379 - DNA, 22 bp, Homo sapiens
tcagcagttgccccctcccagc

SEQ ID NO: 7896380 - DNA, 22 bp, Homo sapiens
tcagcagttgccccctcccagc

SEQ ID NO: 7896381 - DNA, 22 bp, Homo sapiens
tcagcagttcaaccccgtcaga

SEQ ID NO: 7896382 - DNA, 22 bp, Homo sapiens
tcagccagaggcttcttggttt

SEQ ID NO: 7896383 - DNA, 22 bp, Homo sapiens
tcagccagaggcttcttggttt

SEQ ID NO: 7896384 - DNA, 22 bp, Homo sapiens
tcagccagaaagtgattttcag

SEQ ID NO: 7896385 - DNA, 22 bp, Homo sapiens
tcagccagaaagtgattttcag

SEQ ID NO: 7896386 - DNA, 22 bp, Homo sapiens
tcagccagaggcttcttggttt

SEQ ID NO: 7896387 - DNA, 19 bp, Homo sapiens
tcagccaccagaagagata

SEQ ID NO: 7896388 - DNA, 22 bp, Homo sapiens
tcagccacttccctctggtcag

SEQ ID NO: 7896389 - DNA, 22 bp, Homo sapiens
tcagccagaaagtgattttcag

SEQ ID NO: 7896390 - DNA, 22 bp, Homo sapiens
tcagcattgtggcagagaatgg

SEQ ID NO: 7896391 - DNA, 22 bp, Homo sapiens
tcagccaagctgtgagagagta

SEQ ID NO: 7896392 - DNA, 22 bp, Homo sapiens
tcagccaagctgtgagagagta

SEQ ID NO: 7896393 - DNA, 22 bp, Homo sapiens
tcagccaagcgtaggatattgg

SEQ ID NO: 7896394 - DNA, 19 bp, Homo sapiens
tcagccaccagaagagata

SEQ ID NO: 7896395 - DNA, 22 bp, Homo sapiens
tcagccaagcgtaggatattgg

SEQ ID NO: 7896396 - DNA, 22 bp, Homo sapiens
tcagccaagcgtaggatattgg

SEQ ID NO: 7896397 - DNA, 22 bp, Homo sapiens
tcagccaagaagggaactggtc

SEQ ID NO: 7896398 - DNA, 22 bp, Homo sapiens
tcagccaagaagggaactggtc

SEQ ID NO: 7896399 - DNA, 22 bp, Homo sapiens
tcagccaagaagggaactggtc

SEQ ID NO: 7896400 - DNA, 22 bp, Homo sapiens
tcagccaagcagccatcatctg

SEQ ID NO: 7896401 - DNA, 22 bp, Homo sapiens
tcagccagagggggcaaaggaa

SEQ ID NO: 7896402 - DNA, 22 bp, Homo sapiens
tcagccagagggggcaaaggaa

SEQ ID NO: 7896403 - DNA, 22 bp, Homo sapiens
tcagccagagggggcaaaggaa

SEQ ID NO: 7896404 - DNA, 22 bp, Homo sapiens
tcagccagaggtggatgagtca

SEQ ID NO: 7896405 - DNA, 22 bp, Homo sapiens
tcagccagcattacccctgact

SEQ ID NO: 7896406 - DNA, 22 bp, Homo sapiens
tcagccagcatcagctaagtgc

SEQ ID NO: 7896407 - DNA, 22 bp, Homo sapiens
tcagccagcatcagctaagtgc

SEQ ID NO: 7896408 - DNA, 22 bp, Homo sapiens
tcagccagcatcagctaagtgc

SEQ ID NO: 7896409 - DNA, 22 bp, Homo sapiens
tcagccagcatcagctaagtgc

SEQ ID NO: 7896410 - DNA, 22 bp, Homo sapiens
tcagccagccagctacaggctt

SEQ ID NO: 7896411 - DNA, 22 bp, Homo sapiens
tcagccagccagctacaggctt

SEQ ID NO: 7896412 - DNA, 22 bp, Homo sapiens
tcagctgctctgttgagctgaa

SEQ ID NO: 7896413 - DNA, 22 bp, Homo sapiens
tcagctgctctgttgagctgaa

SEQ ID NO: 7896414 - DNA, 22 bp, Homo sapiens
tcagctgctcaaatttatgtca

SEQ ID NO: 7896415 - DNA, 22 bp, Homo sapiens
tcagctgctcaaatttatgtca

SEQ ID NO: 7896416 - DNA, 22 bp, Homo sapiens
tcagctgctcaaatttatgtca

SEQ ID NO: 7896417 - DNA, 22 bp, Homo sapiens
tcagctgcgacaggggcctgag

SEQ ID NO: 7896418 - DNA, 22 bp, Homo sapiens
tcagctgcgacaggggcctgag

SEQ ID NO: 7896419 - DNA, 22 bp, Homo sapiens
tcagctgctgtggtatgtacat

SEQ ID NO: 7896420 - DNA, 22 bp, Homo sapiens
tcagctgctgtggtatgtacat

SEQ ID NO: 7896421 - DNA, 22 bp, Homo sapiens
tcagctgctctgttgagctgaa

SEQ ID NO: 7896422 - DNA, 22 bp, Homo sapiens
tcagctgctctgttgagctgaa

SEQ ID NO: 7896423 - DNA, 22 bp, Homo sapiens
tcagctgctctgttgagctgaa

SEQ ID NO: 7896424 - DNA, 23 bp, Homo sapiens
tcagctgcttcctcctgcctgcc

SEQ ID NO: 7896425 - DNA, 23 bp, Homo sapiens
tcagctgcttcctcctgcctgcc

SEQ ID NO: 7896426 - DNA, 22 bp, Homo sapiens
tcagctgctgtggtatgtacat

SEQ ID NO: 7896427 - DNA, 22 bp, Homo sapiens
tcagctgcttcatgttctgaat

SEQ ID NO: 7896428 - DNA, 22 bp, Homo sapiens
tcagctgcttcatgttctgaat

SEQ ID NO: 7896429 - DNA, 22 bp, Homo sapiens
tcagctgcttcatgttctgaat

SEQ ID NO: 7896430 - DNA, 19 bp, Homo sapiens
tcagctctggggtcagtgg

SEQ ID NO: 7896431 - DNA, 22 bp, Homo sapiens
tcagctgccccatgtgttcact

SEQ ID NO: 7896432 - DNA, 22 bp, Homo sapiens
tcagctgccccatgtgttcact

SEQ ID NO: 7896433 - DNA, 22 bp, Homo sapiens
tcagctgccccgggcactgccc

SEQ ID NO: 7896434 - DNA, 22 bp, Homo sapiens
tcagctgccccgggcactgccc

SEQ ID NO: 7896435 - DNA, 22 bp, Homo sapiens
tcagctgccccgggcactgccc

SEQ ID NO: 7896436 - DNA, 22 bp, Homo sapiens
tcagctgccccgggcactgccc

SEQ ID NO: 7896437 - DNA, 22 bp, Homo sapiens
tcagctgcctttcccatgctag

SEQ ID NO: 7896438 - DNA, 22 bp, Homo sapiens
tcagctgcctttcccatgctag

SEQ ID NO: 7896439 - DNA, 22 bp, Homo sapiens
tcagctgcctttcccatgctag

SEQ ID NO: 7896440 - DNA, 22 bp, Homo sapiens
tcagctgcgacaggggcctgag

SEQ ID NO: 7896441 - DNA, 22 bp, Homo sapiens
tcagctgcgacaggggcctgag

SEQ ID NO: 7896442 - DNA, 22 bp, Homo sapiens
tcagctgcctttcccatgctag

SEQ ID NO: 7896443 - DNA, 22 bp, Homo sapiens
tcagctgccccgggcactgccc

SEQ ID NO: 7896444 - DNA, 22 bp, Homo sapiens
tcagctgccccgggcactgccc

SEQ ID NO: 7896445 - DNA, 22 bp, Homo sapiens
tcagctgcctctccctggaaga

SEQ ID NO: 7896446 - DNA, 22 bp, Homo sapiens
tcagctgcctctccctggaaga

SEQ ID NO: 7896447 - DNA, 22 bp, Homo sapiens
tcagctgcctctccctggaaga

SEQ ID NO: 7896448 - DNA, 22 bp, Homo sapiens
tcagctctgcctgtggaggcac

SEQ ID NO: 7896449 - DNA, 19 bp, Homo sapiens
tcagctctggggtcagtgg

SEQ ID NO: 7896450 - DNA, 22 bp, Homo sapiens
tcagctctgcctgtggaggcac

SEQ ID NO: 7896451 - DNA, 22 bp, Homo sapiens
tcagccaggccaggcattcaca

SEQ ID NO: 7896452 - DNA, 22 bp, Homo sapiens
tcagctctgcactccactgtgg

SEQ ID NO: 7896453 - DNA, 22 bp, Homo sapiens
tcagccaggcagccccctggtc

SEQ ID NO: 7896454 - DNA, 22 bp, Homo sapiens
tcagccaggcagccccctggtc

SEQ ID NO: 7896455 - DNA, 22 bp, Homo sapiens
tcagccaggcacaatggcagct

SEQ ID NO: 7896456 - DNA, 22 bp, Homo sapiens
tcagccaggcacaatggcagct

SEQ ID NO: 7896457 - DNA, 22 bp, Homo sapiens
tcagccaggccaccttcagctt

SEQ ID NO: 7896458 - DNA, 20 bp, Homo sapiens
tcagccagctaacatgggga

SEQ ID NO: 7896459 - DNA, 20 bp, Homo sapiens
tcagccagctaacatgggga

SEQ ID NO: 7896460 - DNA, 22 bp, Homo sapiens
tcagccagctcttggactctga

SEQ ID NO: 7896461 - DNA, 22 bp, Homo sapiens
tcagccagctgtgtgcttctgc

SEQ ID NO: 7896462 - DNA, 22 bp, Homo sapiens
tcagccagctgtgtgcttctgc

SEQ ID NO: 7896463 - DNA, 22 bp, Homo sapiens
tcagccaggcacaatggcagct

SEQ ID NO: 7896464 - DNA, 22 bp, Homo sapiens
tcagccagctgtgtgcttctgc

SEQ ID NO: 7896465 - DNA, 22 bp, Homo sapiens
tcagccaggcacaatggcagct

SEQ ID NO: 7896466 - DNA, 22 bp, Homo sapiens
tcagccaggcacaatggcagct

SEQ ID NO: 7896467 - DNA, 22 bp, Homo sapiens
tcagccaggcacaatggcagct

SEQ ID NO: 7896468 - DNA, 21 bp, Homo sapiens
tcagctgtagagattacattc

SEQ ID NO: 7896469 - DNA, 22 bp, Homo sapiens
tcaggaagggctcagtctgtgc

SEQ ID NO: 7896470 - DNA, 22 bp, Homo sapiens
tcaggaagggctcagtctgtgc

SEQ ID NO: 7896471 - DNA, 22 bp, Homo sapiens
tcaggaagggctcagtctgtgc

SEQ ID NO: 7896472 - DNA, 22 bp, Homo sapiens
tcaggaagggctcagtctgtgc

SEQ ID NO: 7896473 - DNA, 22 bp, Homo sapiens
tcaggaagggtggtccacaggg

SEQ ID NO: 7896474 - DNA, 22 bp, Homo sapiens
tcaggaagggtggtccacaggg

SEQ ID NO: 7896475 - DNA, 22 bp, Homo sapiens
tcaggaagggtggtccacaggg

SEQ ID NO: 7896476 - DNA, 22 bp, Homo sapiens
tcaggaagggtggtccacaggg

SEQ ID NO: 7896477 - DNA, 22 bp, Homo sapiens
tcaggaagggtggtccacaggg

SEQ ID NO: 7896478 - DNA, 22 bp, Homo sapiens
tcaggaagggtggtccacaggg

SEQ ID NO: 7896479 - DNA, 22 bp, Homo sapiens
tcaggaagggtggtccacaggg

SEQ ID NO: 7896480 - DNA, 22 bp, Homo sapiens
tcaggaattttgttctgtatcc

SEQ ID NO: 7896481 - DNA, 22 bp, Homo sapiens
tcaggaagtataatcagattca

SEQ ID NO: 7896482 - DNA, 22 bp, Homo sapiens
tcagctgtactgtgccatagct

SEQ ID NO: 7896483 - DNA, 21 bp, Homo sapiens
tcagctgtagagattacattc

SEQ ID NO: 7896484 - DNA, 22 bp, Homo sapiens
tcagctgtactgtgccatagct

SEQ ID NO: 7896485 - DNA, 22 bp, Homo sapiens
tcagctgtactgtgccatagct

SEQ ID NO: 7896486 - DNA, 22 bp, Homo sapiens
tcagctggtgccactcagtcaa

SEQ ID NO: 7896487 - DNA, 22 bp, Homo sapiens
tcagctggtgagtggatagaca

SEQ ID NO: 7896488 - DNA, 22 bp, Homo sapiens
tcagctgggtgagtgttctgca

SEQ ID NO: 7896489 - DNA, 18 bp, Homo sapiens
tcagctggggctgcagcc

SEQ ID NO: 7896490 - DNA, 18 bp, Homo sapiens
tcagctggggctgcagcc

SEQ ID NO: 7896491 - DNA, 22 bp, Homo sapiens
tcagctggtgaatggactcatc

SEQ ID NO: 7896492 - DNA, 22 bp, Homo sapiens
tcagctggtgaatggactcatc

SEQ ID NO: 7896493 - DNA, 22 bp, Homo sapiens
tcagctggtgaatggactcatc

SEQ ID NO: 7896494 - DNA, 22 bp, Homo sapiens
tcagctggaagatggtgcagaa

SEQ ID NO: 7896495 - DNA, 23 bp, Homo sapiens
tcagctgcttcctcctgcctgcc

SEQ ID NO: 7896496 - DNA, 23 bp, Homo sapiens
tcagctgcttcctcctgcctgcc

SEQ ID NO: 7896497 - DNA, 23 bp, Homo sapiens
tcagctgcttcctcctgcctgcc

SEQ ID NO: 7896498 - DNA, 22 bp, Homo sapiens
tcagctggagactgctcaatga

SEQ ID NO: 7896499 - DNA, 22 bp, Homo sapiens
tcagctggaagatggtgcagaa

SEQ ID NO: 7896500 - DNA, 22 bp, Homo sapiens
tcagctggaagatggtgcagaa

SEQ ID NO: 7896501 - DNA, 22 bp, Homo sapiens
tcagctggagatccttgttgtg

SEQ ID NO: 7896502 - DNA, 19 bp, Homo sapiens
tcagctggcaggcctcctc

SEQ ID NO: 7896503 - DNA, 22 bp, Homo sapiens
tcagctggatgtggaagtgcta

SEQ ID NO: 7896504 - DNA, 18 bp, Homo sapiens
tcagctggggctgcagcc

SEQ ID NO: 7896505 - DNA, 18 bp, Homo sapiens
tcagctggggctgcagcc

SEQ ID NO: 7896506 - DNA, 22 bp, Homo sapiens
tcagctggggccccctctgtcc

SEQ ID NO: 7896507 - DNA, 22 bp, Homo sapiens
tcagctggggccccctctgtcc

SEQ ID NO: 7896508 - DNA, 22 bp, Homo sapiens
tcagctgggaagttctcgcttg

SEQ ID NO: 7896509 - DNA, 22 bp, Homo sapiens
tcagctggcatcggctcaccca

SEQ ID NO: 7896510 - DNA, 22 bp, Homo sapiens
tcagctgggaagttctcgcttg

SEQ ID NO: 7896511 - DNA, 22 bp, Homo sapiens
tcagctgggaagttctcgcttg

SEQ ID NO: 7896512 - DNA, 22 bp, Homo sapiens
tcagctggcatcggctcaccca

SEQ ID NO: 7896513 - DNA, 22 bp, Homo sapiens
tcagctggcaggttctgggaag

SEQ ID NO: 7896514 - DNA, 22 bp, Homo sapiens
tcagctggcaggttctgggaag

SEQ ID NO: 7896515 - DNA, 22 bp, Homo sapiens
tcaggacagaaggctgccaggg

SEQ ID NO: 7896516 - DNA, 22 bp, Homo sapiens
tcaggacagactagactagcgt

SEQ ID NO: 7896517 - DNA, 22 bp, Homo sapiens
tcaggacagactagactagcgt

SEQ ID NO: 7896518 - DNA, 22 bp, Homo sapiens
tcaggacagactagactagcgt

SEQ ID NO: 7896519 - DNA, 22 bp, Homo sapiens
tcaggacacttggcacaaggtc

SEQ ID NO: 7896520 - DNA, 22 bp, Homo sapiens
tcaggacacttggcacaaggtc

SEQ ID NO: 7896521 - DNA, 22 bp, Homo sapiens
tcaggacacttggcacaaggtc

SEQ ID NO: 7896522 - DNA, 22 bp, Homo sapiens
tcaggacacttggcacaaggtc

SEQ ID NO: 7896523 - DNA, 22 bp, Homo sapiens
tcaggacaacctgttttcagac

SEQ ID NO: 7896524 - DNA, 22 bp, Homo sapiens
tcaggacaacctgttttcagac

SEQ ID NO: 7896525 - DNA, 22 bp, Homo sapiens
tcaggacaacaagacttgttta

SEQ ID NO: 7896526 - DNA, 22 bp, Homo sapiens
tcaggacaacatgttgctaatc

SEQ ID NO: 7896527 - DNA, 22 bp, Homo sapiens
tcaggacaatagtgatttttac

SEQ ID NO: 7896528 - DNA, 22 bp, Homo sapiens
tcaggacaccctgtgcttcctt

SEQ ID NO: 7896529 - DNA, 22 bp, Homo sapiens
tcaggacaccctgtgcttcctt

SEQ ID NO: 7896530 - DNA, 22 bp, Homo sapiens
tcaggacagactagactagcgt

SEQ ID NO: 7896531 - DNA, 22 bp, Homo sapiens
tcaggacagagatcagaacttc

SEQ ID NO: 7896532 - DNA, 22 bp, Homo sapiens
tcaggacagagatcagaacttc

SEQ ID NO: 7896533 - DNA, 22 bp, Homo sapiens
tcaggacagagatcagaacttc

SEQ ID NO: 7896534 - DNA, 22 bp, Homo sapiens
tcaggacagccagggtgcagac

SEQ ID NO: 7896535 - DNA, 22 bp, Homo sapiens
tcaggacagccagggtgcagac

SEQ ID NO: 7896536 - DNA, 22 bp, Homo sapiens
tcaggacagccagggtgcagac

SEQ ID NO: 7896537 - DNA, 22 bp, Homo sapiens
tcaggacagccagggtgcagac

SEQ ID NO: 7896538 - DNA, 22 bp, Homo sapiens
tcaggacagccagggtgcagac

SEQ ID NO: 7896539 - DNA, 22 bp, Homo sapiens
tcaggacaggttcgggtgggta

SEQ ID NO: 7896540 - DNA, 22 bp, Homo sapiens
tcaggacagggatcacatcatc

SEQ ID NO: 7896541 - DNA, 22 bp, Homo sapiens
tcaggacaggttcgggtgggta

SEQ ID NO: 7896542 - DNA, 22 bp, Homo sapiens
tcaggacagttccctgcaaatt

SEQ ID NO: 7896543 - DNA, 22 bp, Homo sapiens
tcaggacatttgtcagcaggag

SEQ ID NO: 7896544 - DNA, 22 bp, Homo sapiens
tcaggacagttccctgcaaatt

SEQ ID NO: 7896545 - DNA, 22 bp, Homo sapiens
tcaggacatttgtcagcaggag

SEQ ID NO: 7896546 - DNA, 22 bp, Homo sapiens
tcaggacatttgtcagcaggag

SEQ ID NO: 7896547 - DNA, 22 bp, Homo sapiens
tcaggacatttgtcagcaggag

SEQ ID NO: 7896548 - DNA, 22 bp, Homo sapiens
tcaggacatttgtcagcaggag

SEQ ID NO: 7896549 - DNA, 22 bp, Homo sapiens
tcaggacatttgtcagcaggag

SEQ ID NO: 7896550 - DNA, 22 bp, Homo sapiens
tcaggacatttgtcagcaggag

SEQ ID NO: 7896551 - DNA, 22 bp, Homo sapiens
tcaggagaaaatatcaggaagt

SEQ ID NO: 7896552 - DNA, 22 bp, Homo sapiens
tcaggagaaagccaattagagt

SEQ ID NO: 7896553 - DNA, 22 bp, Homo sapiens
tcaggagaaagccaattagagt

SEQ ID NO: 7896554 - DNA, 22 bp, Homo sapiens
tcaggagaaggcaatgtggaaa

SEQ ID NO: 7896555 - DNA, 22 bp, Homo sapiens
tcaggagaacttccttctaccc

SEQ ID NO: 7896556 - DNA, 22 bp, Homo sapiens
tcaggagaaggcaatgtggaaa

SEQ ID NO: 7896557 - DNA, 22 bp, Homo sapiens
tcaggagaacttccttctaccc

SEQ ID NO: 7896558 - DNA, 22 bp, Homo sapiens
tcaggagaacttccttctaccc

SEQ ID NO: 7896559 - DNA, 22 bp, Homo sapiens
tcaggagaacttccttctaccc

SEQ ID NO: 7896560 - DNA, 22 bp, Homo sapiens
tcaggagaacttccttctaccc

SEQ ID NO: 7896561 - DNA, 18 bp, Homo sapiens
tcaggagacacagacgca

SEQ ID NO: 7896562 - DNA, 18 bp, Homo sapiens
tcaggagacacagacgca

SEQ ID NO: 7896563 - DNA, 22 bp, Homo sapiens
tcaggagacattcttaaagtag

SEQ ID NO: 7896564 - DNA, 22 bp, Homo sapiens
tcaggagacattcttaaagtag

SEQ ID NO: 7896565 - DNA, 22 bp, Homo sapiens
tcaggagacattcttaaagtag

SEQ ID NO: 7896566 - DNA, 22 bp, Homo sapiens
tcaggagacattcttaaagtag

SEQ ID NO: 7896567 - DNA, 22 bp, Homo sapiens
tcaggagactggcagtgcccac

SEQ ID NO: 7896568 - DNA, 22 bp, Homo sapiens
tcaggagactggcagtgcccac

SEQ ID NO: 7896569 - DNA, 22 bp, Homo sapiens
tcaggagactggcagtgcccac

SEQ ID NO: 7896570 - DNA, 22 bp, Homo sapiens
tcaggagactggcagtgcccac

SEQ ID NO: 7896571 - DNA, 22 bp, Homo sapiens
tcaggagacaaagggtgcggag

SEQ ID NO: 7896572 - DNA, 22 bp, Homo sapiens
tcaggagacaaagggtgcggag

SEQ ID NO: 7896573 - DNA, 22 bp, Homo sapiens
tcaggagacaaagggtgcggag

SEQ ID NO: 7896574 - DNA, 18 bp, Homo sapiens
tcaggagacacagacgca

SEQ ID NO: 7896575 - DNA, 22 bp, Homo sapiens
tcaggagaatcagggctgtcct

SEQ ID NO: 7896576 - DNA, 22 bp, Homo sapiens
tcaggagaatcagggctgtcct

SEQ ID NO: 7896577 - DNA, 22 bp, Homo sapiens
tcaggagaatcagggctgtcct

SEQ ID NO: 7896578 - DNA, 22 bp, Homo sapiens
tcaggagaatcagggctgtcct

SEQ ID NO: 7896579 - DNA, 22 bp, Homo sapiens
taaatgcaagggaaaggcaaga

SEQ ID NO: 7896580 - DNA, 22 bp, Homo sapiens
taaatgcaagggaaaggcaaga

SEQ ID NO: 7896581 - DNA, 22 bp, Homo sapiens
taaatgcaagggaaaggcaaga

SEQ ID NO: 7896582 - DNA, 22 bp, Homo sapiens
taaatgcaagggaaaggcaaga

SEQ ID NO: 7896583 - DNA, 22 bp, Homo sapiens
taaatgcaagtgctcctgggag

SEQ ID NO: 7896584 - DNA, 22 bp, Homo sapiens
taaatgcaagtgctcctgggag

SEQ ID NO: 7896585 - DNA, 22 bp, Homo sapiens
taaatgcaagtgctcctgggag

SEQ ID NO: 7896586 - DNA, 22 bp, Homo sapiens
taaatgcaatgtgctttaccag

SEQ ID NO: 7896587 - DNA, 22 bp, Homo sapiens
taaatgcaatgtgctttaccag

SEQ ID NO: 7896588 - DNA, 22 bp, Homo sapiens
taaatgatttatgtatgtgaaa

SEQ ID NO: 7896589 - DNA, 22 bp, Homo sapiens
taaatgatttatgtatgtgaaa

SEQ ID NO: 7896590 - DNA, 22 bp, Homo sapiens
taaatgcaaagcttggcgctta

SEQ ID NO: 7896591 - DNA, 22 bp, Homo sapiens
taaatgcaaagcttggcgctta

SEQ ID NO: 7896592 - DNA, 22 bp, Homo sapiens
taaatgcaaagcttggcgctta

SEQ ID NO: 7896593 - DNA, 22 bp, Homo sapiens
taaagcagccagggtctaagcc

SEQ ID NO: 7896594 - DNA, 22 bp, Homo sapiens
taaagcagccagggtctaagcc

SEQ ID NO: 7896595 - DNA, 22 bp, Homo sapiens
taaagcacatatcttacaataa

SEQ ID NO: 7896596 - DNA, 22 bp, Homo sapiens
taaagcacatatcttacaataa

SEQ ID NO: 7896597 - DNA, 22 bp, Homo sapiens
taaagcacatatcttacaataa

SEQ ID NO: 7896598 - DNA, 22 bp, Homo sapiens
taaagcacatatcttacaataa

SEQ ID NO: 7896599 - DNA, 20 bp, Homo sapiens
taaagcagccgtggagggta

SEQ ID NO: 7896600 - DNA, 20 bp, Homo sapiens
taaagcagccgtggagggta

SEQ ID NO: 7896601 - DNA, 20 bp, Homo sapiens
taaagcagccgtggagggta

SEQ ID NO: 7896602 - DNA, 22 bp, Homo sapiens
taaatgataataatgctagtgt

SEQ ID NO: 7896603 - DNA, 22 bp, Homo sapiens
taaatgatttatgtatgtgaaa

SEQ ID NO: 7896604 - DNA, 20 bp, Homo sapiens
taaatgcatctgttcaactg

SEQ ID NO: 7896605 - DNA, 20 bp, Homo sapiens
taaatgcatctgttcaactg

SEQ ID NO: 7896606 - DNA, 20 bp, Homo sapiens
taaatgcatctgttcaactg

SEQ ID NO: 7896607 - DNA, 22 bp, Homo sapiens
taaatgcagttagtacttgcca

SEQ ID NO: 7896608 - DNA, 22 bp, Homo sapiens
taaatgcagtacaaattgttct

SEQ ID NO: 7896609 - DNA, 22 bp, Homo sapiens
taaatgcagttagtacttgcca

SEQ ID NO: 7896610 - DNA, 20 bp, Homo sapiens
taaatgcatgaatgtaaggc

SEQ ID NO: 7896611 - DNA, 20 bp, Homo sapiens
taaatgcatgaatgtaaggc

SEQ ID NO: 7896612 - DNA, 20 bp, Homo sapiens
taaatgcatgaatgtaaggc

SEQ ID NO: 7896613 - DNA, 20 bp, Homo sapiens
taaatgcatgaatgtaaggc

SEQ ID NO: 7896614 - DNA, 20 bp, Homo sapiens
taaatgcatgaatgtaaggc

SEQ ID NO: 7896615 - DNA, 18 bp, Homo sapiens
taaatgcatgttaataac

SEQ ID NO: 7896616 - DNA, 18 bp, Homo sapiens
taaatgcatgttaataac

SEQ ID NO: 7896617 - DNA, 20 bp, Homo sapiens
taaatgcatgaatgtaaggc

SEQ ID NO: 7896618 - DNA, 18 bp, Homo sapiens
taaatgcatgttaataac

SEQ ID NO: 7896619 - DNA, 18 bp, Homo sapiens
taaatgcatgttaataac

SEQ ID NO: 7896620 - DNA, 18 bp, Homo sapiens
taaatgcatgttaataac

SEQ ID NO: 7896621 - DNA, 22 bp, Homo sapiens
taaatgcagtacaaattgttct

SEQ ID NO: 7896622 - DNA, 22 bp, Homo sapiens
taaatgcagttagtacttgcca

SEQ ID NO: 7896623 - DNA, 22 bp, Homo sapiens
taaatgcagttagtacttgcca

SEQ ID NO: 7896624 - DNA, 22 bp, Homo sapiens
taaatgcagcagtttctgttct

SEQ ID NO: 7896625 - DNA, 22 bp, Homo sapiens
taaatgcagtacaaattgttct

SEQ ID NO: 7896626 - DNA, 22 bp, Homo sapiens
taaatgcagcagtttctgttct

SEQ ID NO: 7896627 - DNA, 22 bp, Homo sapiens
taaatgcagcagtttctgttct

SEQ ID NO: 7896628 - DNA, 22 bp, Homo sapiens
taaatgcagattcctgagccta

SEQ ID NO: 7896629 - DNA, 22 bp, Homo sapiens
taaatgcagattcctgagccta

SEQ ID NO: 7896630 - DNA, 22 bp, Homo sapiens
taaatgcaatgtgctttaccag

SEQ ID NO: 7896631 - DNA, 22 bp, Homo sapiens
taaatgcaatgtgctttaccag

SEQ ID NO: 7896632 - DNA, 22 bp, Homo sapiens
taaagataagacatcaactgag

SEQ ID NO: 7896633 - DNA, 22 bp, Homo sapiens
taaagataagacatcaactgag

SEQ ID NO: 7896634 - DNA, 22 bp, Homo sapiens
taaagatgcccacattgcaggt

SEQ ID NO: 7896635 - DNA, 22 bp, Homo sapiens
taaagagccattgtatggtttt

SEQ ID NO: 7896636 - DNA, 22 bp, Homo sapiens
taaagagcgatatgctttaaag

SEQ ID NO: 7896637 - DNA, 22 bp, Homo sapiens
taaagataagacatcaactgag

SEQ ID NO: 7896638 - DNA, 22 bp, Homo sapiens
taaagacatggtgtaggtgaac

SEQ ID NO: 7896639 - DNA, 22 bp, Homo sapiens
taaagacatggtgtaggtgaac

SEQ ID NO: 7896640 - DNA, 22 bp, Homo sapiens
taaagacatggtgtaggtgaac

SEQ ID NO: 7896641 - DNA, 22 bp, Homo sapiens
taaagagcacgcttttctctct

SEQ ID NO: 7896642 - DNA, 19 bp, Homo sapiens
taaagagaataccggtggc

SEQ ID NO: 7896643 - DNA, 22 bp, Homo sapiens
taaagatgcccacattgcaggt

SEQ ID NO: 7896644 - DNA, 22 bp, Homo sapiens
taaagatgcccacattgcaggt

SEQ ID NO: 7896645 - DNA, 22 bp, Homo sapiens
taaagatgctatagtgaaggag

SEQ ID NO: 7896646 - DNA, 22 bp, Homo sapiens
taaagatgctatagtgaaggag

SEQ ID NO: 7896647 - DNA, 22 bp, Homo sapiens
taaagatggagatgacctagga

SEQ ID NO: 7896648 - DNA, 22 bp, Homo sapiens
taaagatgttctcatttcatag

SEQ ID NO: 7896649 - DNA, 22 bp, Homo sapiens
taaagatggagatgacctagga

SEQ ID NO: 7896650 - DNA, 22 bp, Homo sapiens
taaagatgttctcatttcatag

SEQ ID NO: 7896651 - DNA, 22 bp, Homo sapiens
taaagatgttctcatttcatag

SEQ ID NO: 7896652 - DNA, 22 bp, Homo sapiens
taaagattgctcaaaactgtga

SEQ ID NO: 7896653 - DNA, 23 bp, Homo sapiens
taaagcaaagtcaagtgcactcc

SEQ ID NO: 7896654 - DNA, 23 bp, Homo sapiens
taaagcaaagtcaagtgcactcc

SEQ ID NO: 7896655 - DNA, 23 bp, Homo sapiens
taaagcaaagtcaagtgcactcc

SEQ ID NO: 7896656 - DNA, 22 bp, Homo sapiens
taaagcaaaaatgaactgccat

SEQ ID NO: 7896657 - DNA, 22 bp, Homo sapiens
taaagcaaaaatgaactgccat

SEQ ID NO: 7896658 - DNA, 22 bp, Homo sapiens
taaagcaaaaatgaactgccat

SEQ ID NO: 7896659 - DNA, 22 bp, Homo sapiens
taaagattgctcaaaactgtga

SEQ ID NO: 7896660 - DNA, 22 bp, Homo sapiens
taaagattgctcaaaactgtga

SEQ ID NO: 7896661 - DNA, 22 bp, Homo sapiens
taaagcaatttgagcaagttct

SEQ ID NO: 7896662 - DNA, 22 bp, Homo sapiens
taaagcaatttgagcaagttct

SEQ ID NO: 7896663 - DNA, 22 bp, Homo sapiens
taaagcaatttgagcaagttct

SEQ ID NO: 7896664 - DNA, 22 bp, Homo sapiens
taaagcaatttgagcaagttct

SEQ ID NO: 7896665 - DNA, 22 bp, Homo sapiens
taaagcaatgaaagttttgcag

SEQ ID NO: 7896666 - DNA, 22 bp, Homo sapiens
taaagcaatgaaagttttgcag

SEQ ID NO: 7896667 - DNA, 22 bp, Homo sapiens
taaagcaatgaaagttttgcag

SEQ ID NO: 7896668 - DNA, 22 bp, Homo sapiens
taaagcaatgaaagttttgcag

SEQ ID NO: 7896669 - DNA, 22 bp, Homo sapiens
taaagcaattactcagtggctt

SEQ ID NO: 7896670 - DNA, 22 bp, Homo sapiens
taaagcaattactcagtggctt

SEQ ID NO: 7896671 - DNA, 22 bp, Homo sapiens
taaagcaattactcagtggctt

SEQ ID NO: 7896672 - DNA, 22 bp, Homo sapiens
taaagcaattactcagtggctt

SEQ ID NO: 7896673 - DNA, 22 bp, Homo sapiens
taaagcaaggaatagagtagtc

SEQ ID NO: 7896674 - DNA, 22 bp, Homo sapiens
taaagcaaggaatagagtagtc

SEQ ID NO: 7896675 - DNA, 22 bp, Homo sapiens
taaagcaaggaatagagtagtc

SEQ ID NO: 7896676 - DNA, 22 bp, Homo sapiens
taaagcaaggaatagagtagtc

SEQ ID NO: 7896677 - DNA, 22 bp, Homo sapiens
taaagcaaggaatagagtagtc

SEQ ID NO: 7896678 - DNA, 22 bp, Homo sapiens
taaagcaaggcaaattgttggt

SEQ ID NO: 7896679 - DNA, 22 bp, Homo sapiens
taaagcaaggcaaattgttggt

SEQ ID NO: 7896680 - DNA, 22 bp, Homo sapiens
taaagcaaggcaaattgttggt

SEQ ID NO: 7896681 - DNA, 22 bp, Homo sapiens
taaagcaaggcaaattgttggt

SEQ ID NO: 7896682 - DNA, 22 bp, Homo sapiens
taaagcaagacacacccatagc

SEQ ID NO: 7896683 - DNA, 23 bp, Homo sapiens
taaagcaaagtcaagtgcactcc

SEQ ID NO: 7896684 - DNA, 23 bp, Homo sapiens
taaagcaaagtcaagtgcactcc

SEQ ID NO: 7896685 - DNA, 22 bp, Homo sapiens
taaagcaagacacacccatagc

SEQ ID NO: 7896686 - DNA, 22 bp, Homo sapiens
taaagcaagacacacccatagc

SEQ ID NO: 7896687 - DNA, 22 bp, Homo sapiens
taaagcaaggaatagagtagtc

SEQ ID NO: 7896688 - DNA, 22 bp, Homo sapiens
taaagcaaggaatagagtagtc

SEQ ID NO: 7896689 - DNA, 22 bp, Homo sapiens
taaaagattttataggaacaag

SEQ ID NO: 7896690 - DNA, 22 bp, Homo sapiens
taaaagattttataggaacaag

SEQ ID NO: 7896691 - DNA, 22 bp, Homo sapiens
taaaagattttataggaacaag

SEQ ID NO: 7896692 - DNA, 22 bp, Homo sapiens
taaaagctgagatatcctgtac

SEQ ID NO: 7896693 - DNA, 22 bp, Homo sapiens
taaaagctcttctgttgagtta

SEQ ID NO: 7896694 - DNA, 22 bp, Homo sapiens
taaaagctgagatatcctgtac

SEQ ID NO: 7896695 - DNA, 22 bp, Homo sapiens
taaaagctgagatatcctgtac

SEQ ID NO: 7896696 - DNA, 19 bp, Homo sapiens
taaaaggatgtggaaggat

SEQ ID NO: 7896697 - DNA, 22 bp, Homo sapiens
taaaaggattagcaggatgggc

SEQ ID NO: 7896698 - DNA, 19 bp, Homo sapiens
taaaaggatgtggaaggat

SEQ ID NO: 7896699 - DNA, 22 bp, Homo sapiens
taaaaggattagcaggatgggc

SEQ ID NO: 7896700 - DNA, 22 bp, Homo sapiens
taaaaggaggttgaagctgtca

SEQ ID NO: 7896701 - DNA, 22 bp, Homo sapiens
taaaaggaggttgaagctgtca

SEQ ID NO: 7896702 - DNA, 19 bp, Homo sapiens
taaaaggatgtggaaggat

SEQ ID NO: 7896703 - DNA, 22 bp, Homo sapiens
taaaagtatactttcaaaggag

SEQ ID NO: 7896704 - DNA, 22 bp, Homo sapiens
taaaagtaggaatgaaacgcat

SEQ ID NO: 7896705 - DNA, 22 bp, Homo sapiens
taaaagtatactttcaaaggag

SEQ ID NO: 7896706 - DNA, 22 bp, Homo sapiens
taaaaggcaatactagatgagt

SEQ ID NO: 7896707 - DNA, 22 bp, Homo sapiens
taaaaggcaatactagatgagt

SEQ ID NO: 7896708 - DNA, 22 bp, Homo sapiens
taaaaggattagcaggatgggc

SEQ ID NO: 7896709 - DNA, 22 bp, Homo sapiens
taaaaggcaatactagatgagt

SEQ ID NO: 7896710 - DNA, 22 bp, Homo sapiens
taaaaggcacttggatgctgag

SEQ ID NO: 7896711 - DNA, 22 bp, Homo sapiens
taaaagtaggaatgaaacgcat

SEQ ID NO: 7896712 - DNA, 22 bp, Homo sapiens
taaaagtaggaatgaaacgcat

SEQ ID NO: 7896713 - DNA, 22 bp, Homo sapiens
taaaaggcacttggatgctgag

SEQ ID NO: 7896714 - DNA, 22 bp, Homo sapiens
taaaaggcacttggatgctgag

SEQ ID NO: 7896715 - DNA, 20 bp, Homo sapiens
taaagacataagctactatc

SEQ ID NO: 7896716 - DNA, 20 bp, Homo sapiens
taaagacataagctactatc

SEQ ID NO: 7896717 - DNA, 22 bp, Homo sapiens
taaagacataggatcagggaga

SEQ ID NO: 7896718 - DNA, 22 bp, Homo sapiens
taaagacataggatcagggaga

SEQ ID NO: 7896719 - DNA, 22 bp, Homo sapiens
taaagacataggatcagggaga

SEQ ID NO: 7896720 - DNA, 22 bp, Homo sapiens
taaagacatgcaaagtctaatt

SEQ ID NO: 7896721 - DNA, 22 bp, Homo sapiens
taaagacatgcaaagtctaatt

SEQ ID NO: 7896722 - DNA, 22 bp, Homo sapiens
taaagacatgcaaagtctaatt

SEQ ID NO: 7896723 - DNA, 22 bp, Homo sapiens
taaagacatgcaaagtctaatt

SEQ ID NO: 7896724 - DNA, 22 bp, Homo sapiens
taaagacatggtgtaggtgaac

SEQ ID NO: 7896725 - DNA, 22 bp, Homo sapiens
taaagacatggtgtaggtgaac

SEQ ID NO: 7896726 - DNA, 22 bp, Homo sapiens
taaagacatggtgtaggtgaac

SEQ ID NO: 7896727 - DNA, 22 bp, Homo sapiens
taaagacagatggaccagccat

SEQ ID NO: 7896728 - DNA, 23 bp, Homo sapiens
taaagacagccttcaggattctg

SEQ ID NO: 7896729 - DNA, 23 bp, Homo sapiens
taaagacagccttcaggattctg

SEQ ID NO: 7896730 - DNA, 22 bp, Homo sapiens
taaaagttagctaggacaaagt

SEQ ID NO: 7896731 - DNA, 22 bp, Homo sapiens
taaaagttagctaggacaaagt

SEQ ID NO: 7896732 - DNA, 22 bp, Homo sapiens
taaaagttagctaggacaaagt

SEQ ID NO: 7896733 - DNA, 22 bp, Homo sapiens
taaaagttagctaggacaaagt

SEQ ID NO: 7896734 - DNA, 22 bp, Homo sapiens
gttttacaaatgacggcattca

SEQ ID NO: 7896735 - DNA, 22 bp, Homo sapiens
gttttacaaatgacggcattca

SEQ ID NO: 7896736 - DNA, 21 bp, Homo sapiens
gttttaagggagaaaacctag

SEQ ID NO: 7896737 - DNA, 21 bp, Homo sapiens
gttttaagggagaaaacctag

SEQ ID NO: 7896738 - DNA, 21 bp, Homo sapiens
gttttaagggagaaaacctag

SEQ ID NO: 7896739 - DNA, 22 bp, Homo sapiens
taaaactgaatacatactgagg

SEQ ID NO: 7896740 - DNA, 22 bp, Homo sapiens
taaaactgaatacatactgagg

SEQ ID NO: 7896741 - DNA, 22 bp, Homo sapiens
taaaactgcttggtatggtcta

SEQ ID NO: 7896742 - DNA, 22 bp, Homo sapiens
taaaactgaatacatactgagg

SEQ ID NO: 7896743 - DNA, 22 bp, Homo sapiens
taaaactgaatacatactgagg

SEQ ID NO: 7896744 - DNA, 22 bp, Homo sapiens
taaaactgcttggtatggtcta

SEQ ID NO: 7896745 - DNA, 22 bp, Homo sapiens
taaaactgcttggtatggtcta

SEQ ID NO: 7896746 - DNA, 22 bp, Homo sapiens
taaaacttctcatttttatggt

SEQ ID NO: 7896747 - DNA, 22 bp, Homo sapiens
taaaacttctcatttttatggt

SEQ ID NO: 7896748 - DNA, 22 bp, Homo sapiens
taaaacttctcatttttatggt

SEQ ID NO: 7896749 - DNA, 22 bp, Homo sapiens
taaaacttctcatttttatggt

SEQ ID NO: 7896750 - DNA, 22 bp, Homo sapiens
taaaactttgaaggtgctcagt

SEQ ID NO: 7896751 - DNA, 22 bp, Homo sapiens
taaaagaagcttcaaggccggc

SEQ ID NO: 7896752 - DNA, 21 bp, Homo sapiens
taaaactgtaactttgtcctg

SEQ ID NO: 7896753 - DNA, 21 bp, Homo sapiens
taaaactgtaactttgtcctg

SEQ ID NO: 7896754 - DNA, 22 bp, Homo sapiens
taaaacttaactatccagatta

SEQ ID NO: 7896755 - DNA, 22 bp, Homo sapiens
taaaacttctcatttttatggt

SEQ ID NO: 7896756 - DNA, 22 bp, Homo sapiens
taaaagatcactggctgcttta

SEQ ID NO: 7896757 - DNA, 22 bp, Homo sapiens
taaaagatatcttagggatttg

SEQ ID NO: 7896758 - DNA, 22 bp, Homo sapiens
taaaagagaatggataacagag

SEQ ID NO: 7896759 - DNA, 22 bp, Homo sapiens
taaaagagaatggataacagag

SEQ ID NO: 7896760 - DNA, 22 bp, Homo sapiens
taaaagagaatggataacagag

SEQ ID NO: 7896761 - DNA, 22 bp, Homo sapiens
taaaagagaatggataacagag

SEQ ID NO: 7896762 - DNA, 21 bp, Homo sapiens
taaaagatgacaagacagctc

SEQ ID NO: 7896763 - DNA, 21 bp, Homo sapiens
taaaagatgacaagacagctc

SEQ ID NO: 7896764 - DNA, 21 bp, Homo sapiens
taaaagatgacaagacagctc

SEQ ID NO: 7896765 - DNA, 22 bp, Homo sapiens
taaaagattttataggaacaag

SEQ ID NO: 7896766 - DNA, 22 bp, Homo sapiens
taaaagattttataggaacaag

SEQ ID NO: 7896767 - DNA, 22 bp, Homo sapiens
taaaagattttataggaacaag

SEQ ID NO: 7896768 - DNA, 21 bp, Homo sapiens
taaaagatgacaagacagctc

SEQ ID NO: 7896769 - DNA, 21 bp, Homo sapiens
taaaagatgacaagacagctc

SEQ ID NO: 7896770 - DNA, 21 bp, Homo sapiens
taaaagatgacaagacagctc

SEQ ID NO: 7896771 - DNA, 22 bp, Homo sapiens
taaaagacatataactgtagga

SEQ ID NO: 7896772 - DNA, 22 bp, Homo sapiens
taaaagacatataactgtagga

SEQ ID NO: 7896773 - DNA, 22 bp, Homo sapiens
taaaagaagcttcaaggccggc

SEQ ID NO: 7896774 - DNA, 22 bp, Homo sapiens
taaaagagaatggataacagag

SEQ ID NO: 7896775 - DNA, 22 bp, Homo sapiens
taaaagagaatggataacagag

SEQ ID NO: 7896776 - DNA, 22 bp, Homo sapiens
taaaagaccctctagagtccca

SEQ ID NO: 7896777 - DNA, 22 bp, Homo sapiens
taaaagacatataactgtagga

SEQ ID NO: 7896778 - DNA, 22 bp, Homo sapiens
taaaagaccacaaggtggtaat

SEQ ID NO: 7896779 - DNA, 22 bp, Homo sapiens
taaatgtttagtcttatttggg

SEQ ID NO: 7896780 - DNA, 22 bp, Homo sapiens
taaatgtttagtcttatttggg

SEQ ID NO: 7896781 - DNA, 22 bp, Homo sapiens
taaatgtttagtcttatttggg

SEQ ID NO: 7896782 - DNA, 22 bp, Homo sapiens
taaatgttgtaagtacatctaa

SEQ ID NO: 7896783 - DNA, 22 bp, Homo sapiens
taaatgttggcattggaggccg

SEQ ID NO: 7896784 - DNA, 22 bp, Homo sapiens
taaatgttgtaagtacatctaa

SEQ ID NO: 7896785 - DNA, 22 bp, Homo sapiens
taaatgttgtaagtacatctaa

SEQ ID NO: 7896786 - DNA, 22 bp, Homo sapiens
taaattaaagattggagaagga

SEQ ID NO: 7896787 - DNA, 22 bp, Homo sapiens
taacagcatatgaaattactgg

SEQ ID NO: 7896788 - DNA, 22 bp, Homo sapiens
taacagcatttgaatgagtaac

SEQ ID NO: 7896789 - DNA, 22 bp, Homo sapiens
taacagctctgtgtggctgtaa

SEQ ID NO: 7896790 - DNA, 22 bp, Homo sapiens
taacagccctccctccatcctg

SEQ ID NO: 7896791 - DNA, 22 bp, Homo sapiens
taacagctggcgttataggaat

SEQ ID NO: 7896792 - DNA, 22 bp, Homo sapiens
taacagctctgtgtggctgtaa

SEQ ID NO: 7896793 - DNA, 22 bp, Homo sapiens
taacagctggcgttataggaat

SEQ ID NO: 7896794 - DNA, 22 bp, Homo sapiens
taacaggcaaggtcacaccttg

SEQ ID NO: 7896795 - DNA, 22 bp, Homo sapiens
taacaggctgatcatatatcct

SEQ ID NO: 7896796 - DNA, 22 bp, Homo sapiens
taacaggatgacagcagacatt

SEQ ID NO: 7896797 - DNA, 22 bp, Homo sapiens
taacaggatgacagcagacatt

SEQ ID NO: 7896798 - DNA, 22 bp, Homo sapiens
taaatgttatgcccatcatcca

SEQ ID NO: 7896799 - DNA, 22 bp, Homo sapiens
taaatgttactttcctttcaca

SEQ ID NO: 7896800 - DNA, 22 bp, Homo sapiens
taaatgtgttgtggatgaagtt

SEQ ID NO: 7896801 - DNA, 22 bp, Homo sapiens
taaatgtgtgtagccatctgtg

SEQ ID NO: 7896802 - DNA, 22 bp, Homo sapiens
taaatgtgtgtagccatctgtg

SEQ ID NO: 7896803 - DNA, 22 bp, Homo sapiens
taaatgctcagaccttattcca

SEQ ID NO: 7896804 - DNA, 22 bp, Homo sapiens
taaatgtggagactcaggagtc

SEQ ID NO: 7896805 - DNA, 22 bp, Homo sapiens
taaatgtggagactcaggagtc

SEQ ID NO: 7896806 - DNA, 18 bp, Homo sapiens
taaatgcatgttaataac

SEQ ID NO: 7896807 - DNA, 22 bp, Homo sapiens
taacagttggtgtaatttcttg

SEQ ID NO: 7896808 - DNA, 20 bp, Homo sapiens
taacagttgaagaacaagga

SEQ ID NO: 7896809 - DNA, 22 bp, Homo sapiens
taacagttggtgtaatttcttg

SEQ ID NO: 7896810 - DNA, 22 bp, Homo sapiens
taacatcaaactgcattttcta

SEQ ID NO: 7896811 - DNA, 22 bp, Homo sapiens
taacatcaaactgcattttcta

SEQ ID NO: 7896812 - DNA, 22 bp, Homo sapiens
taacatcctacactgttgtctt

SEQ ID NO: 7896813 - DNA, 22 bp, Homo sapiens
taacatccacattagatgattc

SEQ ID NO: 7896814 - DNA, 22 bp, Homo sapiens
taacagttttgagttttgcttc

SEQ ID NO: 7896815 - DNA, 22 bp, Homo sapiens
taacatattgtgtggcactagg

SEQ ID NO: 7896816 - DNA, 22 bp, Homo sapiens
taacatcaaacatgttttaaag

SEQ ID NO: 7896817 - DNA, 22 bp, Homo sapiens
taacatctttagcagctcgaac

SEQ ID NO: 7896818 - DNA, 22 bp, Homo sapiens
taacatgaaactccaaatggta

SEQ ID NO: 7896819 - DNA, 22 bp, Homo sapiens
taacatgatttgctatttagat

SEQ ID NO: 7896820 - DNA, 22 bp, Homo sapiens
taacagtatagcctaacatttc

SEQ ID NO: 7896821 - DNA, 22 bp, Homo sapiens
taacagtatagcctaacatttc

SEQ ID NO: 7896822 - DNA, 22 bp, Homo sapiens
taacagtatagcctaacatttc

SEQ ID NO: 7896823 - DNA, 22 bp, Homo sapiens
taacagtatagcctaacatttc

SEQ ID NO: 7896824 - DNA, 22 bp, Homo sapiens
taacagtagccttatgtggtct

SEQ ID NO: 7896825 - DNA, 22 bp, Homo sapiens
taacagtagccttatgtggtct

SEQ ID NO: 7896826 - DNA, 22 bp, Homo sapiens
taacagtaccattaactttgat

SEQ ID NO: 7896827 - DNA, 22 bp, Homo sapiens
taacagtaccattaactttgat

SEQ ID NO: 7896828 - DNA, 22 bp, Homo sapiens
taacagtaaagtaagttagctt

SEQ ID NO: 7896829 - DNA, 22 bp, Homo sapiens
taacagtaaagtaagttagctt

SEQ ID NO: 7896830 - DNA, 20 bp, Homo sapiens
taacagtaagtgatgttaca

SEQ ID NO: 7896831 - DNA, 22 bp, Homo sapiens
taacagtgtgtccagtcagttt

SEQ ID NO: 7896832 - DNA, 22 bp, Homo sapiens
taacagtgtggacttgagatct

SEQ ID NO: 7896833 - DNA, 20 bp, Homo sapiens
taacagttgaagaacaagga

SEQ ID NO: 7896834 - DNA, 22 bp, Homo sapiens
taacagtgacctgaatgtcaat

SEQ ID NO: 7896835 - DNA, 22 bp, Homo sapiens
taacagtgtggacttgagatct

SEQ ID NO: 7896836 - DNA, 22 bp, Homo sapiens
taacagtgacctgaatgtcaat

SEQ ID NO: 7896837 - DNA, 21 bp, Homo sapiens
taacagtctccagtgcccgct

SEQ ID NO: 7896838 - DNA, 22 bp, Homo sapiens
taacagtattgaagataaacta

SEQ ID NO: 7896839 - DNA, 22 bp, Homo sapiens
taacagtcatgtgctactgcta

SEQ ID NO: 7896840 - DNA, 22 bp, Homo sapiens
taacagtattgaagataaacta

SEQ ID NO: 7896841 - DNA, 22 bp, Homo sapiens
taacagtattgaagataaacta

SEQ ID NO: 7896842 - DNA, 22 bp, Homo sapiens
taacagtattgaagataaacta

SEQ ID NO: 7896843 - DNA, 22 bp, Homo sapiens
taacagtatatttaccaaacct

SEQ ID NO: 7896844 - DNA, 22 bp, Homo sapiens
taacagtatatttaccaaacct

SEQ ID NO: 7896845 - DNA, 22 bp, Homo sapiens
taagaggatatttggccagaag

SEQ ID NO: 7896846 - DNA, 22 bp, Homo sapiens
taagcatggtggtaaaagaggt

SEQ ID NO: 7896847 - DNA, 22 bp, Homo sapiens
taagagcttcttcatttcaact

SEQ ID NO: 7896848 - DNA, 22 bp, Homo sapiens
taagaggatatttggccagaag

SEQ ID NO: 7896849 - DNA, 22 bp, Homo sapiens
taagagcttcttcatttcaact

SEQ ID NO: 7896850 - DNA, 22 bp, Homo sapiens
taagagcttagctaaggatgtg

SEQ ID NO: 7896851 - DNA, 22 bp, Homo sapiens
taagagcttaatctggatcgta

SEQ ID NO: 7896852 - DNA, 22 bp, Homo sapiens
taagagctcccttctccttgca

SEQ ID NO: 7896853 - DNA, 22 bp, Homo sapiens
taagagctcccttctccttgca

SEQ ID NO: 7896854 - DNA, 22 bp, Homo sapiens
taagagctgaggcattgggaca

SEQ ID NO: 7896855 - DNA, 22 bp, Homo sapiens
taagagctgttcaggtacccat

SEQ ID NO: 7896856 - DNA, 22 bp, Homo sapiens
taagagctgagcctcgtattca

SEQ ID NO: 7896857 - DNA, 22 bp, Homo sapiens
taagagcagaggttgaataaat

SEQ ID NO: 7896858 - DNA, 22 bp, Homo sapiens
taagagcagaggttgaataaat

SEQ ID NO: 7896859 - DNA, 22 bp, Homo sapiens
taagagcagaggttgaataaat

SEQ ID NO: 7896860 - DNA, 18 bp, Homo sapiens
taagagcagactgtaggc

SEQ ID NO: 7896861 - DNA, 18 bp, Homo sapiens
taagagcagactgtaggc

SEQ ID NO: 7896862 - DNA, 18 bp, Homo sapiens
taagagcagactgtaggc

SEQ ID NO: 7896863 - DNA, 22 bp, Homo sapiens
taagagcataggcttgaaaata

SEQ ID NO: 7896864 - DNA, 22 bp, Homo sapiens
taagagcagaggttgaataaat

SEQ ID NO: 7896865 - DNA, 22 bp, Homo sapiens
taagagctacagcccagggttc

SEQ ID NO: 7896866 - DNA, 22 bp, Homo sapiens
taagagctaggattttaaatca

SEQ ID NO: 7896867 - DNA, 22 bp, Homo sapiens
taagagcattgtaaaataatct

SEQ ID NO: 7896868 - DNA, 22 bp, Homo sapiens
taagagctaggattttaaatca

SEQ ID NO: 7896869 - DNA, 21 bp, Homo sapiens
taagagctattattgcaaacc

SEQ ID NO: 7896870 - DNA, 22 bp, Homo sapiens
taagagctccaatatttgtggc

SEQ ID NO: 7896871 - DNA, 22 bp, Homo sapiens
taagagcattgtaaaataatct

SEQ ID NO: 7896872 - DNA, 22 bp, Homo sapiens
taagagcattgtaaaataatct

SEQ ID NO: 7896873 - DNA, 22 bp, Homo sapiens
taagagcctgtgctttgagttc

SEQ ID NO: 7896874 - DNA, 22 bp, Homo sapiens
taagagcattgtaaaataatct

SEQ ID NO: 7896875 - DNA, 22 bp, Homo sapiens
taagagcattgtaaaataatct

SEQ ID NO: 7896876 - DNA, 22 bp, Homo sapiens
taagacttgatccaaagaacta

SEQ ID NO: 7896877 - DNA, 22 bp, Homo sapiens
taagagaactggatagatagga

SEQ ID NO: 7896878 - DNA, 22 bp, Homo sapiens
taagagaaggatctgttccagg

SEQ ID NO: 7896879 - DNA, 22 bp, Homo sapiens
taagagaaggatctgttccagg

SEQ ID NO: 7896880 - DNA, 22 bp, Homo sapiens
taagagaaggatctgttccagg

SEQ ID NO: 7896881 - DNA, 22 bp, Homo sapiens
taagagaaggatctgttccagg

SEQ ID NO: 7896882 - DNA, 22 bp, Homo sapiens
taagagaatgttgtggctaggt

SEQ ID NO: 7896883 - DNA, 22 bp, Homo sapiens
taagagaatgttgtggctaggt

SEQ ID NO: 7896884 - DNA, 22 bp, Homo sapiens
taagagaatgtcaggagtggat

SEQ ID NO: 7896885 - DNA, 22 bp, Homo sapiens
taagagaaggatctgttccagg

SEQ ID NO: 7896886 - DNA, 22 bp, Homo sapiens
taagagaatgtcaggagtggat

SEQ ID NO: 7896887 - DNA, 22 bp, Homo sapiens
taagagaatgtcaggagtggat

SEQ ID NO: 7896888 - DNA, 22 bp, Homo sapiens
taagagcagaacagcaacatat

SEQ ID NO: 7896889 - DNA, 22 bp, Homo sapiens
taagagcagaacagcaacatat

SEQ ID NO: 7896890 - DNA, 22 bp, Homo sapiens
taagagcagaacagcaacatat

SEQ ID NO: 7896891 - DNA, 22 bp, Homo sapiens
taagagcactgaagtcttctta

SEQ ID NO: 7896892 - DNA, 22 bp, Homo sapiens
taagagattctaaagctactgg

SEQ ID NO: 7896893 - DNA, 22 bp, Homo sapiens
taagagattctaaagctactgg

SEQ ID NO: 7896894 - DNA, 22 bp, Homo sapiens
taagagatggttatcaaaagca

SEQ ID NO: 7896895 - DNA, 22 bp, Homo sapiens
taagagatggttatcaaaagca

SEQ ID NO: 7896896 - DNA, 22 bp, Homo sapiens
taagagacttaagaataattga

SEQ ID NO: 7896897 - DNA, 22 bp, Homo sapiens
taagagatgcttttctaaataa

SEQ ID NO: 7896898 - DNA, 22 bp, Homo sapiens
taagagaccgatattcttaagt

SEQ ID NO: 7896899 - DNA, 22 bp, Homo sapiens
taagagaatgttgtggctaggt

SEQ ID NO: 7896900 - DNA, 22 bp, Homo sapiens
taagagacttaagaataattga

SEQ ID NO: 7896901 - DNA, 22 bp, Homo sapiens
taagagatgcttttctaaataa

SEQ ID NO: 7896902 - DNA, 22 bp, Homo sapiens
taagacaaatactatttcaaga

SEQ ID NO: 7896903 - DNA, 22 bp, Homo sapiens
taagacaaatactatttcaaga

SEQ ID NO: 7896904 - DNA, 22 bp, Homo sapiens
taagacaaatactatttcaaga

SEQ ID NO: 7896905 - DNA, 18 bp, Homo sapiens
taacatgttttcattaag

SEQ ID NO: 7896906 - DNA, 22 bp, Homo sapiens
taagacaaatactatttcaaga

SEQ ID NO: 7896907 - DNA, 22 bp, Homo sapiens
taagacagggtctattcttagt

SEQ ID NO: 7896908 - DNA, 22 bp, Homo sapiens
taagacaggtagtaagaacatt

SEQ ID NO: 7896909 - DNA, 22 bp, Homo sapiens
taagacagggagggctctcagc

SEQ ID NO: 7896910 - DNA, 22 bp, Homo sapiens
taagacaattcttcagtcacaa

SEQ ID NO: 7896911 - DNA, 22 bp, Homo sapiens
taagacaattcttcagtcacaa

SEQ ID NO: 7896912 - DNA, 22 bp, Homo sapiens
taagacaattcttcagtcacaa

SEQ ID NO: 7896913 - DNA, 19 bp, Homo sapiens
taagacagattcctagagt

SEQ ID NO: 7896914 - DNA, 18 bp, Homo sapiens
taacatgttttcattaag

SEQ ID NO: 7896915 - DNA, 18 bp, Homo sapiens
taacatgttttcattaag

SEQ ID NO: 7896916 - DNA, 18 bp, Homo sapiens
taacatgttttcattaag

SEQ ID NO: 7896917 - DNA, 22 bp, Homo sapiens
taacatgttaagaaattagata

SEQ ID NO: 7896918 - DNA, 22 bp, Homo sapiens
taacatgttaagaaattagata

SEQ ID NO: 7896919 - DNA, 22 bp, Homo sapiens
taacatgtggagagaatggtga

SEQ ID NO: 7896920 - DNA, 22 bp, Homo sapiens
taacatgcagagtttagctttt

SEQ ID NO: 7896921 - DNA, 22 bp, Homo sapiens
taacatgcatagatttgtatta

SEQ ID NO: 7896922 - DNA, 22 bp, Homo sapiens
taacatgcatagatttgtatta

SEQ ID NO: 7896923 - DNA, 22 bp, Homo sapiens
taacatgtccctgattctttgt

SEQ ID NO: 7896924 - DNA, 22 bp, Homo sapiens
taacatgtccctgattctttgt

SEQ ID NO: 7896925 - DNA, 22 bp, Homo sapiens
taacatgtccctgattctttgt

SEQ ID NO: 7896926 - DNA, 22 bp, Homo sapiens
taagacatcattaaacagcaat

SEQ ID NO: 7896927 - DNA, 22 bp, Homo sapiens
taagacatccgttgcttataat

SEQ ID NO: 7896928 - DNA, 22 bp, Homo sapiens
taagacatcctggatgttcaaa

SEQ ID NO: 7896929 - DNA, 22 bp, Homo sapiens
taagacatcctggatgttcaaa

SEQ ID NO: 7896930 - DNA, 22 bp, Homo sapiens
taagacatgagactcagccagt

SEQ ID NO: 7896931 - DNA, 22 bp, Homo sapiens
taagacatcctggatgttcaaa

SEQ ID NO: 7896932 - DNA, 22 bp, Homo sapiens
taagacataccaagttgtgtga

SEQ ID NO: 7896933 - DNA, 22 bp, Homo sapiens
taagacatcattaaacagcaat

SEQ ID NO: 7896934 - DNA, 22 bp, Homo sapiens
taagacatcattaaacagcaat

SEQ ID NO: 7896935 - DNA, 22 bp, Homo sapiens
taagacatagccaagagcatcc

SEQ ID NO: 7896936 - DNA, 21 bp, Homo sapiens
taagacagtatgaatactttc

SEQ ID NO: 7896937 - DNA, 22 bp, Homo sapiens
taagacaattcttcagtcacaa

SEQ ID NO: 7896938 - DNA, 21 bp, Homo sapiens
taagacagtatgaatactttc

SEQ ID NO: 7896939 - DNA, 22 bp, Homo sapiens
taagacataaataggcttttta

SEQ ID NO: 7896940 - DNA, 22 bp, Homo sapiens
taagaccaatcctgtgtacctc

SEQ ID NO: 7896941 - DNA, 22 bp, Homo sapiens
taagaccagtatgcattttcac

SEQ ID NO: 7896942 - DNA, 22 bp, Homo sapiens
taagactagttgaatggttttc

SEQ ID NO: 7896943 - DNA, 22 bp, Homo sapiens
taagacttaggtcgagtttggc

SEQ ID NO: 7896944 - DNA, 22 bp, Homo sapiens
taagacatgtccaggctgtgag

SEQ ID NO: 7896945 - DNA, 22 bp, Homo sapiens
taagacatttgaaatgtgatcc

SEQ ID NO: 7896946 - DNA, 22 bp, Homo sapiens
gtttcaaagcacagctcacatt

SEQ ID NO: 7896947 - DNA, 22 bp, Homo sapiens
gtttattatacaacaaaagcta

SEQ ID NO: 7896948 - DNA, 22 bp, Homo sapiens
gtttattatacaacaaaagcta

SEQ ID NO: 7896949 - DNA, 22 bp, Homo sapiens
gtttattatacaacaaaagcta

SEQ ID NO: 7896950 - DNA, 22 bp, Homo sapiens
gtttattatacaacaaaagcta

SEQ ID NO: 7896951 - DNA, 22 bp, Homo sapiens
gtttattatacaacaaaagcta

SEQ ID NO: 7896952 - DNA, 22 bp, Homo sapiens
gtttattatacaacaaaagcta

SEQ ID NO: 7896953 - DNA, 22 bp, Homo sapiens
gtttattatacaacaaaagcta

SEQ ID NO: 7896954 - DNA, 22 bp, Homo sapiens
gtttcaaagtcagaaaaggagg

SEQ ID NO: 7896955 - DNA, 22 bp, Homo sapiens
gtttcaaagtcagaaaaggagg

SEQ ID NO: 7896956 - DNA, 22 bp, Homo sapiens
gtttattaactgtcaagtgatt

SEQ ID NO: 7896957 - DNA, 22 bp, Homo sapiens
gtttattaactgtcaagtgatt

SEQ ID NO: 7896958 - DNA, 22 bp, Homo sapiens
gtttattaactgtcaagtgatt

SEQ ID NO: 7896959 - DNA, 22 bp, Homo sapiens
gtttattaactgtcaagtgatt

SEQ ID NO: 7896960 - DNA, 22 bp, Homo sapiens
gtttattagagttttctgtctg

SEQ ID NO: 7896961 - DNA, 22 bp, Homo sapiens
gtttattagagttttctgtctg

SEQ ID NO: 7896962 - DNA, 22 bp, Homo sapiens
gtttattagagttttctgtctg

SEQ ID NO: 7896963 - DNA, 22 bp, Homo sapiens
gtttattagagttttctgtctg

SEQ ID NO: 7896964 - DNA, 22 bp, Homo sapiens
gtttattagagttttctgtctg

SEQ ID NO: 7896965 - DNA, 22 bp, Homo sapiens
gtttattagagttttctgtctg

SEQ ID NO: 7896966 - DNA, 22 bp, Homo sapiens
gtttattagagttttctgtctg

SEQ ID NO: 7896967 - DNA, 22 bp, Homo sapiens
gtttattagagttttctgtctg

SEQ ID NO: 7896968 - DNA, 22 bp, Homo sapiens
gtttatgaattgcattcccttt

SEQ ID NO: 7896969 - DNA, 21 bp, Homo sapiens
gtttatgaatcttgtcctgct

SEQ ID NO: 7896970 - DNA, 22 bp, Homo sapiens
gtttatgaattgcattcccttt

SEQ ID NO: 7896971 - DNA, 22 bp, Homo sapiens
gtttatgaattgcattcccttt

SEQ ID NO: 7896972 - DNA, 22 bp, Homo sapiens
gtttatgaggaaaagttatgat

SEQ ID NO: 7896973 - DNA, 22 bp, Homo sapiens
gtttatgagttacgtaggggtt

SEQ ID NO: 7896974 - DNA, 22 bp, Homo sapiens
gtttatggagggggtgaaggca

SEQ ID NO: 7896975 - DNA, 20 bp, Homo sapiens
gtttatggacagtccaaaca

SEQ ID NO: 7896976 - DNA, 22 bp, Homo sapiens
gtttatggactgtgtatgttat

SEQ ID NO: 7896977 - DNA, 22 bp, Homo sapiens
gtttattaactgtcaagtgatt

SEQ ID NO: 7896978 - DNA, 22 bp, Homo sapiens
gtttatgagttacgtaggggtt

SEQ ID NO: 7896979 - DNA, 22 bp, Homo sapiens
gtttatgaggaaaagttatgat

SEQ ID NO: 7896980 - DNA, 21 bp, Homo sapiens
gtttatgaatcttgtcctgct

SEQ ID NO: 7896981 - DNA, 22 bp, Homo sapiens
gtttatgaatgtgtcagacata

SEQ ID NO: 7896982 - DNA, 21 bp, Homo sapiens
gtttatgaatcttgtcctgct

SEQ ID NO: 7896983 - DNA, 22 bp, Homo sapiens
gtttatgaatgtgtcagacata

SEQ ID NO: 7896984 - DNA, 22 bp, Homo sapiens
gtttatgaatgttactatagag

SEQ ID NO: 7896985 - DNA, 22 bp, Homo sapiens
gtttatgaatgttactatagag

SEQ ID NO: 7896986 - DNA, 22 bp, Homo sapiens
gtttatgaatgttactatagag

SEQ ID NO: 7896987 - DNA, 22 bp, Homo sapiens
gtttatattcaacggagtatct

SEQ ID NO: 7896988 - DNA, 22 bp, Homo sapiens
gtttatattcaacggagtatct

SEQ ID NO: 7896989 - DNA, 22 bp, Homo sapiens
gttgagagttaagcgggctaat

SEQ ID NO: 7896990 - DNA, 22 bp, Homo sapiens
gttgagcaaggccagagaagcc

SEQ ID NO: 7896991 - DNA, 22 bp, Homo sapiens
gttgagctctccagcttcattt

SEQ ID NO: 7896992 - DNA, 22 bp, Homo sapiens
gtttatgaaatttcaggcattt

SEQ ID NO: 7896993 - DNA, 22 bp, Homo sapiens
gtttatcttaatggactcagag

SEQ ID NO: 7896994 - DNA, 22 bp, Homo sapiens
gtttatgaaatttcaggcattt

SEQ ID NO: 7896995 - DNA, 22 bp, Homo sapiens
gtttatctgcactctcttgtag

SEQ ID NO: 7896996 - DNA, 22 bp, Homo sapiens
gtttatctagtgaagtgaagaa

SEQ ID NO: 7896997 - DNA, 22 bp, Homo sapiens
gtttatcagagagcagaggtgg

SEQ ID NO: 7896998 - DNA, 22 bp, Homo sapiens
gtttatcagagagcagaggtgg

SEQ ID NO: 7896999 - DNA, 22 bp, Homo sapiens
gttctttaacctagtctcattt

SEQ ID NO: 7897000 - DNA, 22 bp, Homo sapiens
gttctttaagtggagaaggaaa

SEQ ID NO: 7897001 - DNA, 22 bp, Homo sapiens
gttctttaagtggagaaggaaa

SEQ ID NO: 7897002 - DNA, 22 bp, Homo sapiens
gttctttaagtggagaaggaaa

SEQ ID NO: 7897003 - DNA, 22 bp, Homo sapiens
gttcttggaccagcagcattga

SEQ ID NO: 7897004 - DNA, 21 bp, Homo sapiens
gttcttgcaggatttccttcc

SEQ ID NO: 7897005 - DNA, 21 bp, Homo sapiens
gttcttgcaggatttccttcc

SEQ ID NO: 7897006 - DNA, 22 bp, Homo sapiens
gttcttcctcattgctttgaag

SEQ ID NO: 7897007 - DNA, 21 bp, Homo sapiens
gttcttcctgactagagtagt

SEQ ID NO: 7897008 - DNA, 22 bp, Homo sapiens
gttcttgagtcagactattttg

SEQ ID NO: 7897009 - DNA, 22 bp, Homo sapiens
gttcttgagtcagactattttg

SEQ ID NO: 7897010 - DNA, 22 bp, Homo sapiens
gttcttctcttgtaatggaatc

SEQ ID NO: 7897011 - DNA, 22 bp, Homo sapiens
gttctttgactccaagaaagta

SEQ ID NO: 7897012 - DNA, 19 bp, Homo sapiens
gttcttttcacctctgtgc

SEQ ID NO: 7897013 - DNA, 22 bp, Homo sapiens
gttctttgactccaagaaagta

SEQ ID NO: 7897014 - DNA, 19 bp, Homo sapiens
gttctttcatagtaagagc

SEQ ID NO: 7897015 - DNA, 19 bp, Homo sapiens
gttcttttcacctctgtgc

SEQ ID NO: 7897016 - DNA, 22 bp, Homo sapiens
gttgaaatttgtgataatttag

SEQ ID NO: 7897017 - DNA, 22 bp, Homo sapiens
gttgaaatcctaaccccctagt

SEQ ID NO: 7897018 - DNA, 22 bp, Homo sapiens
gttgaaatgagggattaatcag

SEQ ID NO: 7897019 - DNA, 22 bp, Homo sapiens
gttgaaatcctaaccccctagt

SEQ ID NO: 7897020 - DNA, 22 bp, Homo sapiens
gttgaaatcctaaccccctagt

SEQ ID NO: 7897021 - DNA, 22 bp, Homo sapiens
gttgaaatcctaaccccctagt

SEQ ID NO: 7897022 - DNA, 22 bp, Homo sapiens
gttgaaatcctaaccccctagt

SEQ ID NO: 7897023 - DNA, 22 bp, Homo sapiens
gttgaaaatacagattcctagg

SEQ ID NO: 7897024 - DNA, 22 bp, Homo sapiens
gttgaaatcctaaccccctagt

SEQ ID NO: 7897025 - DNA, 22 bp, Homo sapiens
gttgaactatgttttatctgac

SEQ ID NO: 7897026 - DNA, 22 bp, Homo sapiens
gttgaacatgtgagtctcagga

SEQ ID NO: 7897027 - DNA, 22 bp, Homo sapiens
gttgaataattcatagaagcta

SEQ ID NO: 7897028 - DNA, 21 bp, Homo sapiens
gttgaatatccatgtatgtgt

SEQ ID NO: 7897029 - DNA, 22 bp, Homo sapiens
gttgacagaaaaataacatagc

SEQ ID NO: 7897030 - DNA, 22 bp, Homo sapiens
gttgacagaattgtgtggctgg

SEQ ID NO: 7897031 - DNA, 22 bp, Homo sapiens
gttgacagtgaccctgaaagca

SEQ ID NO: 7897032 - DNA, 22 bp, Homo sapiens
gtttcaaataggtttcagcaaa

SEQ ID NO: 7897033 - DNA, 22 bp, Homo sapiens
gtttcaaataggtttcagcaaa

SEQ ID NO: 7897034 - DNA, 22 bp, Homo sapiens
gtttcaaataggtttcagcaaa

SEQ ID NO: 7897035 - DNA, 22 bp, Homo sapiens
gtttcaagcagatggcctgagg

SEQ ID NO: 7897036 - DNA, 22 bp, Homo sapiens
gtttcaagcagatggcctgagg

SEQ ID NO: 7897037 - DNA, 22 bp, Homo sapiens
gtttcaagagtggctcaaaact

SEQ ID NO: 7897038 - DNA, 22 bp, Homo sapiens
gtttcaagtagctgctgattat

SEQ ID NO: 7897039 - DNA, 22 bp, Homo sapiens
gtttcacaagcaacgggtaagg

SEQ ID NO: 7897040 - DNA, 22 bp, Homo sapiens
gtttcacacatcctgcacatag

SEQ ID NO: 7897041 - DNA, 22 bp, Homo sapiens
gtttcacagatggggagacacg

SEQ ID NO: 7897042 - DNA, 22 bp, Homo sapiens
gtttcacagatggggagacacg

SEQ ID NO: 7897043 - DNA, 22 bp, Homo sapiens
gtttcacagggccatggaggaa

SEQ ID NO: 7897044 - DNA, 22 bp, Homo sapiens
gtttcacagggccatggaggaa

SEQ ID NO: 7897045 - DNA, 22 bp, Homo sapiens
gtttcacaggttggagccagca

SEQ ID NO: 7897046 - DNA, 22 bp, Homo sapiens
gtttcacaggttggagccagca

SEQ ID NO: 7897047 - DNA, 22 bp, Homo sapiens
gtttcacagatggtgttcatat

SEQ ID NO: 7897048 - DNA, 22 bp, Homo sapiens
gtttcacagatggtgttcatat

SEQ ID NO: 7897049 - DNA, 22 bp, Homo sapiens
gtttcactgcaaactgactttt

SEQ ID NO: 7897050 - DNA, 22 bp, Homo sapiens
gtttcagaaatggtttatgcaa

SEQ ID NO: 7897051 - DNA, 22 bp, Homo sapiens
gtttcactgcactatagcacca

SEQ ID NO: 7897052 - DNA, 22 bp, Homo sapiens
gtttcacagtctgcagaatttt

SEQ ID NO: 7897053 - DNA, 22 bp, Homo sapiens
gtttcacataattttaaattgt

SEQ ID NO: 7897054 - DNA, 22 bp, Homo sapiens
gtttcttttgtgatcaccaacc

SEQ ID NO: 7897055 - DNA, 22 bp, Homo sapiens
gtttgaaaaaagcagtatgtaa

SEQ ID NO: 7897056 - DNA, 22 bp, Homo sapiens
gtttgaaaaaagcagtatgtaa

SEQ ID NO: 7897057 - DNA, 22 bp, Homo sapiens
gtttgaaaaaagcagtatgtaa

SEQ ID NO: 7897058 - DNA, 22 bp, Homo sapiens
gtttcttttaaaatatgtagac

SEQ ID NO: 7897059 - DNA, 22 bp, Homo sapiens
gtttcttttaaaatatgtagac

SEQ ID NO: 7897060 - DNA, 22 bp, Homo sapiens
gtttctttctattgactgaaca

SEQ ID NO: 7897061 - DNA, 22 bp, Homo sapiens
gtttcttttaaaatatgtagac

SEQ ID NO: 7897062 - DNA, 22 bp, Homo sapiens
gtttctttctattgactgaaca

SEQ ID NO: 7897063 - DNA, 22 bp, Homo sapiens
gtttctttctattgactgaaca

SEQ ID NO: 7897064 - DNA, 22 bp, Homo sapiens
gtttcttatttcaactggaaca

SEQ ID NO: 7897065 - DNA, 22 bp, Homo sapiens
gtttcttagacagacattatct

SEQ ID NO: 7897066 - DNA, 22 bp, Homo sapiens
gtttcagaaatgttctcctgct

SEQ ID NO: 7897067 - DNA, 22 bp, Homo sapiens
gtttgttcactatgactgtggt

SEQ ID NO: 7897068 - DNA, 22 bp, Homo sapiens
gtttgttcactatgactgtggt

SEQ ID NO: 7897069 - DNA, 22 bp, Homo sapiens
gtttgttcatggctgatgcttg

SEQ ID NO: 7897070 - DNA, 22 bp, Homo sapiens
gtttgttcatggctgatgcttg

SEQ ID NO: 7897071 - DNA, 22 bp, Homo sapiens
gtttgttagaagagcagaatct

SEQ ID NO: 7897072 - DNA, 22 bp, Homo sapiens
gtttgtttatacaaaagatcct

SEQ ID NO: 7897073 - DNA, 22 bp, Homo sapiens
gtttgtttatacaaaagatcct

SEQ ID NO: 7897074 - DNA, 22 bp, Homo sapiens
gtttgtttatacaaaagatcct

SEQ ID NO: 7897075 - DNA, 22 bp, Homo sapiens
gtttgtttatacaaaagatcct

SEQ ID NO: 7897076 - DNA, 20 bp, Homo sapiens
gttttaaggcacaggccttt

SEQ ID NO: 7897077 - DNA, 20 bp, Homo sapiens
gttttaaggcacaggccttt

SEQ ID NO: 7897078 - DNA, 20 bp, Homo sapiens
gttttaaggcacaggccttt

SEQ ID NO: 7897079 - DNA, 22 bp, Homo sapiens
gtttgttttaagataggatgga

SEQ ID NO: 7897080 - DNA, 22 bp, Homo sapiens
gtttgttttaagataggatgga

SEQ ID NO: 7897081 - DNA, 22 bp, Homo sapiens
gtttgtttgtagggaagccgtg

SEQ ID NO: 7897082 - DNA, 22 bp, Homo sapiens
gtttgtttgtagggaagccgtg

SEQ ID NO: 7897083 - DNA, 22 bp, Homo sapiens
gtttgtgtaacatgatgatgat

SEQ ID NO: 7897084 - DNA, 22 bp, Homo sapiens
gtttgtgtaacatgatgatgat

SEQ ID NO: 7897085 - DNA, 22 bp, Homo sapiens
gtttgcataaagtggatgcagg

SEQ ID NO: 7897086 - DNA, 22 bp, Homo sapiens
gtttgtcaggaggttgaagtca

SEQ ID NO: 7897087 - DNA, 17 bp, Homo sapiens
gtttgcatggtgttaac

SEQ ID NO: 7897088 - DNA, 22 bp, Homo sapiens
gtttgcatggaagacagtgagt

SEQ ID NO: 7897089 - DNA, 22 bp, Homo sapiens
gtttgcatgtgtacttaattgg

SEQ ID NO: 7897090 - DNA, 22 bp, Homo sapiens
gtttgcatgtattaagtcaata

SEQ ID NO: 7897091 - DNA, 22 bp, Homo sapiens
gtttgaaacatgcacctggagg

SEQ ID NO: 7897092 - DNA, 22 bp, Homo sapiens
gtttgaaagaccaattagattt

SEQ ID NO: 7897093 - DNA, 22 bp, Homo sapiens
gtttgaaagaccaattagattt

SEQ ID NO: 7897094 - DNA, 22 bp, Homo sapiens
gtttgaaagttcaacaggaaaa

SEQ ID NO: 7897095 - DNA, 22 bp, Homo sapiens
gtttgaaagttcaacaggaaaa

SEQ ID NO: 7897096 - DNA, 20 bp, Homo sapiens
gtttgaaatgattggttggt

SEQ ID NO: 7897097 - DNA, 22 bp, Homo sapiens
gtttgaaagttcaacaggaaaa

SEQ ID NO: 7897098 - DNA, 22 bp, Homo sapiens
gtttgaaatgtctgcaagggaa

SEQ ID NO: 7897099 - DNA, 22 bp, Homo sapiens
gtttgacacggtgcgtcttcag

SEQ ID NO: 7897100 - DNA, 22 bp, Homo sapiens
gtttgatttgatccggagagat

SEQ ID NO: 7897101 - DNA, 22 bp, Homo sapiens
gtttgattcaagaacaaagagt

SEQ ID NO: 7897102 - DNA, 22 bp, Homo sapiens
gtttgattcaagaacaaagagt

SEQ ID NO: 7897103 - DNA, 22 bp, Homo sapiens
gtttgacactgagataaataaa

SEQ ID NO: 7897104 - DNA, 21 bp, Homo sapiens
gtttgacctaaggaaggattt

SEQ ID NO: 7897105 - DNA, 21 bp, Homo sapiens
gtttgcatgaacaagtcagcc

SEQ ID NO: 7897106 - DNA, 22 bp, Homo sapiens
gtttgcatatctgtgaaatgga

SEQ ID NO: 7897107 - DNA, 22 bp, Homo sapiens
gtttgcatatttgcacaggaat

SEQ ID NO: 7897108 - DNA, 22 bp, Homo sapiens
gtttgcagggagagatgtggtg

SEQ ID NO: 7897109 - DNA, 22 bp, Homo sapiens
gtttgcagttgtcatcctcctg

SEQ ID NO: 7897110 - DNA, 22 bp, Homo sapiens
gtgttgtggagcttgtcagggg

SEQ ID NO: 7897111 - DNA, 23 bp, Homo sapiens
gtgttggcagcagtgctctgggg

SEQ ID NO: 7897112 - DNA, 23 bp, Homo sapiens
gtgttggcagcagtgctctgggg

SEQ ID NO: 7897113 - DNA, 22 bp, Homo sapiens
gtgttgcttcatctttatggtg

SEQ ID NO: 7897114 - DNA, 22 bp, Homo sapiens
gtgttgctctgtttgggggttg

SEQ ID NO: 7897115 - DNA, 22 bp, Homo sapiens
gtgttctgggatgattgtagtg

SEQ ID NO: 7897116 - DNA, 22 bp, Homo sapiens
gtgttcttttgcttcacagaaa

SEQ ID NO: 7897117 - DNA, 22 bp, Homo sapiens
gtgttcttttgcttcacagaaa

SEQ ID NO: 7897118 - DNA, 22 bp, Homo sapiens
gtgttcttttgcttcacagaaa

SEQ ID NO: 7897119 - DNA, 22 bp, Homo sapiens
gtgttcttttgcttcacagaaa

SEQ ID NO: 7897120 - DNA, 22 bp, Homo sapiens
gtgttgacacagccatcttgtc

SEQ ID NO: 7897121 - DNA, 22 bp, Homo sapiens
gtgttgatgacattttagaaac

SEQ ID NO: 7897122 - DNA, 22 bp, Homo sapiens
gtgttgatgacattttagaaac

SEQ ID NO: 7897123 - DNA, 22 bp, Homo sapiens
gtgttctgggatgattgtagtg

SEQ ID NO: 7897124 - DNA, 22 bp, Homo sapiens
gtgttctgcagaccagcatcat

SEQ ID NO: 7897125 - DNA, 22 bp, Homo sapiens
gtgttctctctacaggaattta

SEQ ID NO: 7897126 - DNA, 22 bp, Homo sapiens
gtgttctctagagctgtacaaa

SEQ ID NO: 7897127 - DNA, 22 bp, Homo sapiens
gtgttcattgctagtgaggtgt

SEQ ID NO: 7897128 - DNA, 22 bp, Homo sapiens
gtgttcctggacagcaagtgag

SEQ ID NO: 7897129 - DNA, 22 bp, Homo sapiens
gtgttcatggatgtcaatttga

SEQ ID NO: 7897130 - DNA, 17 bp, Homo sapiens
gtgttcacaatgactgt

SEQ ID NO: 7897131 - DNA, 17 bp, Homo sapiens
gtgttcacaatgactgt

SEQ ID NO: 7897132 - DNA, 22 bp, Homo sapiens
gtgctggctgccaggaggctgc

SEQ ID NO: 7897133 - DNA, 17 bp, Homo sapiens
gtgctggcctggggctc

SEQ ID NO: 7897134 - DNA, 17 bp, Homo sapiens
gtgctggcctggggctc

SEQ ID NO: 7897135 - DNA, 17 bp, Homo sapiens
gtgctggcctggggctc

SEQ ID NO: 7897136 - DNA, 17 bp, Homo sapiens
gtgctggcctggggctc

SEQ ID NO: 7897137 - DNA, 22 bp, Homo sapiens
gtgctggcctcagagggtcatg

SEQ ID NO: 7897138 - DNA, 17 bp, Homo sapiens
gtgctggcctggggctc

SEQ ID NO: 7897139 - DNA, 17 bp, Homo sapiens
gtgctggcctggggctc

SEQ ID NO: 7897140 - DNA, 22 bp, Homo sapiens
gtgctggctggacatggagcac

SEQ ID NO: 7897141 - DNA, 22 bp, Homo sapiens
gtgctggctggacatggagcac

SEQ ID NO: 7897142 - DNA, 22 bp, Homo sapiens
gtgctggctggacatggagcac

SEQ ID NO: 7897143 - DNA, 22 bp, Homo sapiens
gtgctggctgccaggaggctgc

SEQ ID NO: 7897144 - DNA, 21 bp, Homo sapiens
gtgctgggacacagccaggct

SEQ ID NO: 7897145 - DNA, 21 bp, Homo sapiens
gtgctgggacacagccaggct

SEQ ID NO: 7897146 - DNA, 21 bp, Homo sapiens
gtgctgggacacagccaggct

SEQ ID NO: 7897147 - DNA, 21 bp, Homo sapiens
gtgctgggacacagccaggct

SEQ ID NO: 7897148 - DNA, 22 bp, Homo sapiens
gtgctggctggggcatcaggca

SEQ ID NO: 7897149 - DNA, 22 bp, Homo sapiens
gtgctggctggggcatcaggca

SEQ ID NO: 7897150 - DNA, 22 bp, Homo sapiens
gtgctggctggggcatcaggca

SEQ ID NO: 7897151 - DNA, 21 bp, Homo sapiens
gtgctgggacacagccaggct

SEQ ID NO: 7897152 - DNA, 21 bp, Homo sapiens
gtgctgggacacagccaggct

SEQ ID NO: 7897153 - DNA, 21 bp, Homo sapiens
gtgctgggacacagccaggct

SEQ ID NO: 7897154 - DNA, 22 bp, Homo sapiens
gtgctgggattacaggtgtgag

SEQ ID NO: 7897155 - DNA, 21 bp, Homo sapiens
gtgctgggacacagccaggct

SEQ ID NO: 7897156 - DNA, 21 bp, Homo sapiens
gtgctgggacacagccaggct

SEQ ID NO: 7897157 - DNA, 21 bp, Homo sapiens
gtgctgggacacagccaggct

SEQ ID NO: 7897158 - DNA, 22 bp, Homo sapiens
gtgttattagagcattaatttt

SEQ ID NO: 7897159 - DNA, 22 bp, Homo sapiens
gtgttattagagcattaatttt

SEQ ID NO: 7897160 - DNA, 22 bp, Homo sapiens
gtgttattagagcattaatttt

SEQ ID NO: 7897161 - DNA, 22 bp, Homo sapiens
gtgttattagagcattaatttt

SEQ ID NO: 7897162 - DNA, 22 bp, Homo sapiens
gtgttattagagcattaatttt

SEQ ID NO: 7897163 - DNA, 22 bp, Homo sapiens
gtgctgggattacaggtgtgag

SEQ ID NO: 7897164 - DNA, 22 bp, Homo sapiens
gttaaataacctcatgtccgtt

SEQ ID NO: 7897165 - DNA, 22 bp, Homo sapiens
gttaaataacctcatgtccgtt

SEQ ID NO: 7897166 - DNA, 22 bp, Homo sapiens
gtgtttcttgcactccccggac

SEQ ID NO: 7897167 - DNA, 22 bp, Homo sapiens
gttaaataacctcatgtccgtt

SEQ ID NO: 7897168 - DNA, 22 bp, Homo sapiens
gtgtttccctggcacaagaacc

SEQ ID NO: 7897169 - DNA, 22 bp, Homo sapiens
gtgtttcccctcctggagaagg

SEQ ID NO: 7897170 - DNA, 22 bp, Homo sapiens
gtgtttcctctagaagccatgg

SEQ ID NO: 7897171 - DNA, 22 bp, Homo sapiens
gtgtttcctcacttctctgact

SEQ ID NO: 7897172 - DNA, 22 bp, Homo sapiens
gtgtttctggggcattcatagt

SEQ ID NO: 7897173 - DNA, 21 bp, Homo sapiens
gtgtttcctgtttatggcttg

SEQ ID NO: 7897174 - DNA, 22 bp, Homo sapiens
gtgtttccagttcagaaagcaa

SEQ ID NO: 7897175 - DNA, 22 bp, Homo sapiens
gtgtttattttcatagttggcc

SEQ ID NO: 7897176 - DNA, 22 bp, Homo sapiens
gtgtttattttcatagttggcc

SEQ ID NO: 7897177 - DNA, 22 bp, Homo sapiens
gtgtttatgagtgaccttgtct

SEQ ID NO: 7897178 - DNA, 22 bp, Homo sapiens
gtgtttataggagtgaatgctg

SEQ ID NO: 7897179 - DNA, 22 bp, Homo sapiens
gtgtttatttagagtaggccat

SEQ ID NO: 7897180 - DNA, 22 bp, Homo sapiens
gtgtttatgtttgtgtagggga

SEQ ID NO: 7897181 - DNA, 22 bp, Homo sapiens
gtgtttaatgcagatgtgggtg

SEQ ID NO: 7897182 - DNA, 22 bp, Homo sapiens
gtgtttatacagcaaagagcat

SEQ ID NO: 7897183 - DNA, 19 bp, Homo sapiens
gtgtttactgtgtgcagaa

SEQ ID NO: 7897184 - DNA, 19 bp, Homo sapiens
gtgtttactgtgtgcagaa

SEQ ID NO: 7897185 - DNA, 22 bp, Homo sapiens
gttaaatgcattttccaagcac

SEQ ID NO: 7897186 - DNA, 22 bp, Homo sapiens
gttaaatgcattttccaagcac

SEQ ID NO: 7897187 - DNA, 22 bp, Homo sapiens
gttaaattcgatgatggataaa

SEQ ID NO: 7897188 - DNA, 22 bp, Homo sapiens
gttaaattcgatgatggataaa

SEQ ID NO: 7897189 - DNA, 22 bp, Homo sapiens
gttaacaaatgtaaagcaatta

SEQ ID NO: 7897190 - DNA, 22 bp, Homo sapiens
gttaaatgcagattctgactca

SEQ ID NO: 7897191 - DNA, 22 bp, Homo sapiens
gttaaatgcactattgaaagct

SEQ ID NO: 7897192 - DNA, 22 bp, Homo sapiens
gttaaatgcagattctgactca

SEQ ID NO: 7897193 - DNA, 22 bp, Homo sapiens
gttaaatgcagattctgactca

SEQ ID NO: 7897194 - DNA, 22 bp, Homo sapiens
gttaaataacctcatgtccgtt

SEQ ID NO: 7897195 - DNA, 22 bp, Homo sapiens
gttaaatgcactattgaaagct

SEQ ID NO: 7897196 - DNA, 22 bp, Homo sapiens
gttaaataacctcatgtccgtt

SEQ ID NO: 7897197 - DNA, 22 bp, Homo sapiens
gttaacacaggactctctgcct

SEQ ID NO: 7897198 - DNA, 18 bp, Homo sapiens
gttaacaattactaacgc

SEQ ID NO: 7897199 - DNA, 22 bp, Homo sapiens
gttaacataggagtttgttgta

SEQ ID NO: 7897200 - DNA, 22 bp, Homo sapiens
gttataaatacctaataggatt

SEQ ID NO: 7897201 - DNA, 22 bp, Homo sapiens
gttaacattcaattaaacagtc

SEQ ID NO: 7897202 - DNA, 23 bp, Homo sapiens
gttaacatggtccatggaagagc

SEQ ID NO: 7897203 - DNA, 23 bp, Homo sapiens
gttaacatggtccatggaagagc

SEQ ID NO: 7897204 - DNA, 22 bp, Homo sapiens
gttcttcagtcacatcacagaa

SEQ ID NO: 7897205 - DNA, 22 bp, Homo sapiens
gttcttcagtcacatcacagaa

SEQ ID NO: 7897206 - DNA, 22 bp, Homo sapiens
gttcttcagtcacatcacagaa

SEQ ID NO: 7897207 - DNA, 22 bp, Homo sapiens
gttcttcatcattttagatagg

SEQ ID NO: 7897208 - DNA, 22 bp, Homo sapiens
gttctggagtggtgccaggcct

SEQ ID NO: 7897209 - DNA, 21 bp, Homo sapiens
gttctggaggctgcaagtcca

SEQ ID NO: 7897210 - DNA, 22 bp, Homo sapiens
gttctggaagcttttgagcaac

SEQ ID NO: 7897211 - DNA, 22 bp, Homo sapiens
gttctgctgtgtctcagcaggt

SEQ ID NO: 7897212 - DNA, 22 bp, Homo sapiens
gttctgcttaaattattgatcc

SEQ ID NO: 7897213 - DNA, 22 bp, Homo sapiens
gttctgcttaaattattgatcc

SEQ ID NO: 7897214 - DNA, 22 bp, Homo sapiens
gttctggaaagcaagaaagagt

SEQ ID NO: 7897215 - DNA, 22 bp, Homo sapiens
gttctgcttccttgcttgcgca

SEQ ID NO: 7897216 - DNA, 22 bp, Homo sapiens
gttctgcttccttgcttgcgca

SEQ ID NO: 7897217 - DNA, 22 bp, Homo sapiens
gttattggaaagcctggagggc

SEQ ID NO: 7897218 - DNA, 20 bp, Homo sapiens
gttattggaaatattgtgtg

SEQ ID NO: 7897219 - DNA, 22 bp, Homo sapiens
gttattggaaagcctggagggc

SEQ ID NO: 7897220 - DNA, 20 bp, Homo sapiens
gttattggaaatattgtgtg

SEQ ID NO: 7897221 - DNA, 22 bp, Homo sapiens
gttattgctggatagatacatc

SEQ ID NO: 7897222 - DNA, 22 bp, Homo sapiens
gttattggcagcatttcagagt

SEQ ID NO: 7897223 - DNA, 22 bp, Homo sapiens
gttattgggtgcctcaggccct

SEQ ID NO: 7897224 - DNA, 22 bp, Homo sapiens
gttattggcagcatttcagagt

SEQ ID NO: 7897225 - DNA, 20 bp, Homo sapiens
gttattggtcatttttgcca

SEQ ID NO: 7897226 - DNA, 22 bp, Homo sapiens
gttattgggtgcctcaggccct

SEQ ID NO: 7897227 - DNA, 21 bp, Homo sapiens
gttattggttacactgcactt

SEQ ID NO: 7897228 - DNA, 21 bp, Homo sapiens
gttattggttacactgcactt

SEQ ID NO: 7897229 - DNA, 20 bp, Homo sapiens
gttattggtcatttttgcca

SEQ ID NO: 7897230 - DNA, 22 bp, Homo sapiens
gttattgtccagcacagttggg

SEQ ID NO: 7897231 - DNA, 22 bp, Homo sapiens
gttattgtccagcacagttggg

SEQ ID NO: 7897232 - DNA, 22 bp, Homo sapiens
gttattgtccagcacagttggg

SEQ ID NO: 7897233 - DNA, 22 bp, Homo sapiens
gttatttataaggtgtaactcc

SEQ ID NO: 7897234 - DNA, 22 bp, Homo sapiens
gttatttataaggtgtaactcc

SEQ ID NO: 7897235 - DNA, 22 bp, Homo sapiens
gttatttataaggtgtaactcc

SEQ ID NO: 7897236 - DNA, 22 bp, Homo sapiens
gttatttaactttgtagcatgg

SEQ ID NO: 7897237 - DNA, 22 bp, Homo sapiens
gttatttataaggtgtaactcc

SEQ ID NO: 7897238 - DNA, 22 bp, Homo sapiens
gttatttataaggtgtaactcc

SEQ ID NO: 7897239 - DNA, 22 bp, Homo sapiens
gttatttaactttgtagcatgg

SEQ ID NO: 7897240 - DNA, 22 bp, Homo sapiens
gttatttaactttgtagcatgg

SEQ ID NO: 7897241 - DNA, 22 bp, Homo sapiens
gttattgtttatcctgcacccc

SEQ ID NO: 7897242 - DNA, 22 bp, Homo sapiens
gttattgtccatttatttagca

SEQ ID NO: 7897243 - DNA, 22 bp, Homo sapiens
gttattgtccatttatttagca

SEQ ID NO: 7897244 - DNA, 22 bp, Homo sapiens
gttattgtttatcctgcacccc

SEQ ID NO: 7897245 - DNA, 22 bp, Homo sapiens
gttattgtttatcctgcacccc

SEQ ID NO: 7897246 - DNA, 22 bp, Homo sapiens
gttatttaactttgtagcatgg

SEQ ID NO: 7897247 - DNA, 22 bp, Homo sapiens
gttattgtgtttgttcagggca

SEQ ID NO: 7897248 - DNA, 22 bp, Homo sapiens
gttattgtgtttgttcagggca

SEQ ID NO: 7897249 - DNA, 22 bp, Homo sapiens
gttattgtgtttgttcagggca

SEQ ID NO: 7897250 - DNA, 22 bp, Homo sapiens
gttattgtccagcacagttggg

SEQ ID NO: 7897251 - DNA, 22 bp, Homo sapiens
gttattgtccatttatttagca

SEQ ID NO: 7897252 - DNA, 22 bp, Homo sapiens
gttataaatgactgcaaaagtt

SEQ ID NO: 7897253 - DNA, 22 bp, Homo sapiens
gttataaatgactgcaaaagtt

SEQ ID NO: 7897254 - DNA, 22 bp, Homo sapiens
gttataaatgactgcaaaagtt

SEQ ID NO: 7897255 - DNA, 22 bp, Homo sapiens
gttatacacattcctggtgagg

SEQ ID NO: 7897256 - DNA, 22 bp, Homo sapiens
gttataaatgactgcaaaagtt

SEQ ID NO: 7897257 - DNA, 22 bp, Homo sapiens
gttataaatgactgcaaaagtt

SEQ ID NO: 7897258 - DNA, 22 bp, Homo sapiens
gttatacagttttgggtctgct

SEQ ID NO: 7897259 - DNA, 22 bp, Homo sapiens
gttatacacattcctggtgagg

SEQ ID NO: 7897260 - DNA, 22 bp, Homo sapiens
gttatacatatgtgttaacaaa

SEQ ID NO: 7897261 - DNA, 22 bp, Homo sapiens
gttatacatatgtgttaacaaa

SEQ ID NO: 7897262 - DNA, 21 bp, Homo sapiens
gttatacattctatggatttg

SEQ ID NO: 7897263 - DNA, 22 bp, Homo sapiens
gttatacttatgtgcaaaaata

SEQ ID NO: 7897264 - DNA, 18 bp, Homo sapiens
gttatagcagcagcattt

SEQ ID NO: 7897265 - DNA, 22 bp, Homo sapiens
gttatacatatgtgttaacaaa

SEQ ID NO: 7897266 - DNA, 22 bp, Homo sapiens
gttatataagacaaatcagagt

SEQ ID NO: 7897267 - DNA, 22 bp, Homo sapiens
gttatataattcctgtggtagt

SEQ ID NO: 7897268 - DNA, 22 bp, Homo sapiens
gttatataattcctgtggtagt

SEQ ID NO: 7897269 - DNA, 22 bp, Homo sapiens
gttatataagacaaatcagagt

SEQ ID NO: 7897270 - DNA, 22 bp, Homo sapiens
gttatataagacaaatcagagt

SEQ ID NO: 7897271 - DNA, 22 bp, Homo sapiens
gttatagccatgcttatttgtt

SEQ ID NO: 7897272 - DNA, 22 bp, Homo sapiens
gttatataagacaaatcagagt

SEQ ID NO: 7897273 - DNA, 22 bp, Homo sapiens
gttatatatagtatttctctga

SEQ ID NO: 7897274 - DNA, 22 bp, Homo sapiens
gttatattcaaaatgaggctgt

SEQ ID NO: 7897275 - DNA, 22 bp, Homo sapiens
gttatatatagtatttctctga

SEQ ID NO: 7897276 - DNA, 22 bp, Homo sapiens
gttatatatagtatttctctga

SEQ ID NO: 7897277 - DNA, 22 bp, Homo sapiens
gttatatatagtatttctctga

SEQ ID NO: 7897278 - DNA, 22 bp, Homo sapiens
gttatgtactttttaaatcttg

SEQ ID NO: 7897279 - DNA, 22 bp, Homo sapiens
gttatgtaatctaacactcagt

SEQ ID NO: 7897280 - DNA, 22 bp, Homo sapiens
gttatgaagtcattcacaaata

SEQ ID NO: 7897281 - DNA, 22 bp, Homo sapiens
gttatgaaataaatatagatca

SEQ ID NO: 7897282 - DNA, 22 bp, Homo sapiens
gttatgaaataaatatagatca

SEQ ID NO: 7897283 - DNA, 22 bp, Homo sapiens
gttatgtatgagggaatgatta

SEQ ID NO: 7897284 - DNA, 22 bp, Homo sapiens
gttatgtatcttgattgggtgg

SEQ ID NO: 7897285 - DNA, 22 bp, Homo sapiens
gttatgtactttttaaatcttg

SEQ ID NO: 7897286 - DNA, 22 bp, Homo sapiens
gttattgctatacatgtacact

SEQ ID NO: 7897287 - DNA, 22 bp, Homo sapiens
gttatattggcagaagagaaga

SEQ ID NO: 7897288 - DNA, 22 bp, Homo sapiens
gttatattggcagaagagaaga

SEQ ID NO: 7897289 - DNA, 22 bp, Homo sapiens
gttatattggcagaagagaaga

SEQ ID NO: 7897290 - DNA, 22 bp, Homo sapiens
gttatattggcagaagagaaga

SEQ ID NO: 7897291 - DNA, 22 bp, Homo sapiens
gttatattgccaagtatattgt

SEQ ID NO: 7897292 - DNA, 22 bp, Homo sapiens
gttatattgccaagtatattgt

SEQ ID NO: 7897293 - DNA, 22 bp, Homo sapiens
gttatattgccaagtatattgt

SEQ ID NO: 7897294 - DNA, 22 bp, Homo sapiens
gttatattgccaagtatattgt

SEQ ID NO: 7897295 - DNA, 22 bp, Homo sapiens
gttatcttagggtacaaaggac

SEQ ID NO: 7897296 - DNA, 22 bp, Homo sapiens
gttatcttctatttctcatact

SEQ ID NO: 7897297 - DNA, 22 bp, Homo sapiens
gttatcttccctttgatgattt

SEQ ID NO: 7897298 - DNA, 22 bp, Homo sapiens
gttatcatgcttcatcatcact

SEQ ID NO: 7897299 - DNA, 22 bp, Homo sapiens
gttatctagaccaaaagcctaa

SEQ ID NO: 7897300 - DNA, 22 bp, Homo sapiens
gttatcatgcttcatcatcact

SEQ ID NO: 7897301 - DNA, 22 bp, Homo sapiens
tacacatacaccaatgtggtca

SEQ ID NO: 7897302 - DNA, 22 bp, Homo sapiens
tacacatacaccaatgtggtca

SEQ ID NO: 7897303 - DNA, 22 bp, Homo sapiens
tacacatacattgcttacaagg

SEQ ID NO: 7897304 - DNA, 22 bp, Homo sapiens
tacacatacattgcttacaagg

SEQ ID NO: 7897305 - DNA, 22 bp, Homo sapiens
tacacatacattgcttacaagg

SEQ ID NO: 7897306 - DNA, 22 bp, Homo sapiens
tacacatacattgcttacaagg

SEQ ID NO: 7897307 - DNA, 22 bp, Homo sapiens
tacacatacattgcttacaagg

SEQ ID NO: 7897308 - DNA, 22 bp, Homo sapiens
tacacataaaatgctcatggta

SEQ ID NO: 7897309 - DNA, 22 bp, Homo sapiens
tacacataaaatgctcatggta

SEQ ID NO: 7897310 - DNA, 22 bp, Homo sapiens
tacacagtgagtcctctctgcc

SEQ ID NO: 7897311 - DNA, 22 bp, Homo sapiens
tacacagtgagtcctctctgcc

SEQ ID NO: 7897312 - DNA, 22 bp, Homo sapiens
tacacagtaaatggtaaataca

SEQ ID NO: 7897313 - DNA, 22 bp, Homo sapiens
tacacagtagagtataatgcgt

SEQ ID NO: 7897314 - DNA, 22 bp, Homo sapiens
tacacagtagagtataatgcgt

SEQ ID NO: 7897315 - DNA, 22 bp, Homo sapiens
tacacagtatatgggatcacag

SEQ ID NO: 7897316 - DNA, 22 bp, Homo sapiens
tacacagaacctggtgtacagt

SEQ ID NO: 7897317 - DNA, 22 bp, Homo sapiens
tacacagaacctggtgtacagt

SEQ ID NO: 7897318 - DNA, 22 bp, Homo sapiens
tacacagaacctggtgtacagt

SEQ ID NO: 7897319 - DNA, 22 bp, Homo sapiens
tacacagaacctggtgtacagt

SEQ ID NO: 7897320 - DNA, 22 bp, Homo sapiens
tacacagaaattgtgtagggat

SEQ ID NO: 7897321 - DNA, 22 bp, Homo sapiens
tacacacttactggagatgaag

SEQ ID NO: 7897322 - DNA, 22 bp, Homo sapiens
tacacagaacctggtgtacagt

SEQ ID NO: 7897323 - DNA, 22 bp, Homo sapiens
tacacagaaattgtgtagggat

SEQ ID NO: 7897324 - DNA, 22 bp, Homo sapiens
tacacacagaggccatgggatt

SEQ ID NO: 7897325 - DNA, 22 bp, Homo sapiens
tacacacagaggccatgggatt

SEQ ID NO: 7897326 - DNA, 22 bp, Homo sapiens
tacacacatgcatttgccttat

SEQ ID NO: 7897327 - DNA, 22 bp, Homo sapiens
tacacacatgcatttgccttat

SEQ ID NO: 7897328 - DNA, 22 bp, Homo sapiens
tacacacatgcatttgccttat

SEQ ID NO: 7897329 - DNA, 22 bp, Homo sapiens
tacacacttactggagatgaag

SEQ ID NO: 7897330 - DNA, 22 bp, Homo sapiens
tacacactgtgataatgaagca

SEQ ID NO: 7897331 - DNA, 22 bp, Homo sapiens
tacacacatgcatttgccttat

SEQ ID NO: 7897332 - DNA, 22 bp, Homo sapiens
tacacacatgcatttgccttat

SEQ ID NO: 7897333 - DNA, 22 bp, Homo sapiens
tacacacatgcatttgccttat

SEQ ID NO: 7897334 - DNA, 22 bp, Homo sapiens
tacacacatgcatttgccttat

SEQ ID NO: 7897335 - DNA, 22 bp, Homo sapiens
tacacacagaggccatgggatt

SEQ ID NO: 7897336 - DNA, 22 bp, Homo sapiens
tacacacagaggccatgggatt

SEQ ID NO: 7897337 - DNA, 22 bp, Homo sapiens
tacacacagaggccatgggatt

SEQ ID NO: 7897338 - DNA, 22 bp, Homo sapiens
tacacacagaggccatgggatt

SEQ ID NO: 7897339 - DNA, 22 bp, Homo sapiens
tacacacagaggccatgggatt

SEQ ID NO: 7897340 - DNA, 22 bp, Homo sapiens
tacacaattagttgcaaagtga

SEQ ID NO: 7897341 - DNA, 22 bp, Homo sapiens
tacacaattagttgcaaagtga

SEQ ID NO: 7897342 - DNA, 22 bp, Homo sapiens
tacacaattagttgcaaagtga

SEQ ID NO: 7897343 - DNA, 22 bp, Homo sapiens
tacacaattagttgcaaagtga

SEQ ID NO: 7897344 - DNA, 22 bp, Homo sapiens
tacacaatgacttaagatgtca

SEQ ID NO: 7897345 - DNA, 22 bp, Homo sapiens
tacacaatgacttaagatgtca

SEQ ID NO: 7897346 - DNA, 22 bp, Homo sapiens
tacacaattctggatgcatgtc

SEQ ID NO: 7897347 - DNA, 22 bp, Homo sapiens
tacacaattagttgcaaagtga

SEQ ID NO: 7897348 - DNA, 22 bp, Homo sapiens
tacacacagaggccatgggatt

SEQ ID NO: 7897349 - DNA, 22 bp, Homo sapiens
tacagaatgttatgaagcatag

SEQ ID NO: 7897350 - DNA, 22 bp, Homo sapiens
tacagaatgttatgaagcatag

SEQ ID NO: 7897351 - DNA, 22 bp, Homo sapiens
tacagaatgttatgaagcatag

SEQ ID NO: 7897352 - DNA, 22 bp, Homo sapiens
tacagaatgttatgaagcatag

SEQ ID NO: 7897353 - DNA, 22 bp, Homo sapiens
tacagaattagattattagaga

SEQ ID NO: 7897354 - DNA, 22 bp, Homo sapiens
tacagaattagattattagaga

SEQ ID NO: 7897355 - DNA, 22 bp, Homo sapiens
tacagaattagattattagaga

SEQ ID NO: 7897356 - DNA, 22 bp, Homo sapiens
tacagaattagattattagaga

SEQ ID NO: 7897357 - DNA, 22 bp, Homo sapiens
tacagaattagattattagaga

SEQ ID NO: 7897358 - DNA, 22 bp, Homo sapiens
tacagaattagattattagaga

SEQ ID NO: 7897359 - DNA, 22 bp, Homo sapiens
tacagaattagattattagaga

SEQ ID NO: 7897360 - DNA, 21 bp, Homo sapiens
tacagaatgcgcttcagtctg

SEQ ID NO: 7897361 - DNA, 21 bp, Homo sapiens
tacagaatgcgcttcagtctg

SEQ ID NO: 7897362 - DNA, 21 bp, Homo sapiens
tacagaatgcgcttcagtctg

SEQ ID NO: 7897363 - DNA, 22 bp, Homo sapiens
tacagaatgtgtatcattacca

SEQ ID NO: 7897364 - DNA, 22 bp, Homo sapiens
tacagaatgtgtatcattacca

SEQ ID NO: 7897365 - DNA, 22 bp, Homo sapiens
tacagaatgttatgaagcatag

SEQ ID NO: 7897366 - DNA, 22 bp, Homo sapiens
tacagaattagattattagaga

SEQ ID NO: 7897367 - DNA, 22 bp, Homo sapiens
tacagacaaagagcatgcggta

SEQ ID NO: 7897368 - DNA, 22 bp, Homo sapiens
tacagacaaagagcatgcggta

SEQ ID NO: 7897369 - DNA, 22 bp, Homo sapiens
tacagacaaagagcatgcggta

SEQ ID NO: 7897370 - DNA, 22 bp, Homo sapiens
tacagacaaagagcatgcggta

SEQ ID NO: 7897371 - DNA, 22 bp, Homo sapiens
tacagacagacttcccaccctc

SEQ ID NO: 7897372 - DNA, 22 bp, Homo sapiens
tacagacaaagtgctatagggt

SEQ ID NO: 7897373 - DNA, 22 bp, Homo sapiens
tacagacaaagtgctatagggt

SEQ ID NO: 7897374 - DNA, 22 bp, Homo sapiens
tacagacagacttcccaccctc

SEQ ID NO: 7897375 - DNA, 22 bp, Homo sapiens
tacagacagacttcccaccctc

SEQ ID NO: 7897376 - DNA, 22 bp, Homo sapiens
tacagacagtttttcagatatt

SEQ ID NO: 7897377 - DNA, 22 bp, Homo sapiens
tacagacagtttttcagatatt

SEQ ID NO: 7897378 - DNA, 22 bp, Homo sapiens
tacagacagtttttcagatatt

SEQ ID NO: 7897379 - DNA, 22 bp, Homo sapiens
tacacataggtctgaataaaaa

SEQ ID NO: 7897380 - DNA, 22 bp, Homo sapiens
tacacataggtctgaataaaaa

SEQ ID NO: 7897381 - DNA, 22 bp, Homo sapiens
tacacataggtctgaataaaaa

SEQ ID NO: 7897382 - DNA, 22 bp, Homo sapiens
tacacataggtctgaataaaaa

SEQ ID NO: 7897383 - DNA, 22 bp, Homo sapiens
tacagaataaagcgtgaagctt

SEQ ID NO: 7897384 - DNA, 22 bp, Homo sapiens
tacacataggtctgaataaaaa

SEQ ID NO: 7897385 - DNA, 22 bp, Homo sapiens
tacagaatagaatagggacagg

SEQ ID NO: 7897386 - DNA, 22 bp, Homo sapiens
tacagaatagaatagggacagg

SEQ ID NO: 7897387 - DNA, 22 bp, Homo sapiens
tacacataggagggtaataaaa

SEQ ID NO: 7897388 - DNA, 22 bp, Homo sapiens
tacacataggagggtaataaaa

SEQ ID NO: 7897389 - DNA, 22 bp, Homo sapiens
tacacataggagggtaataaaa

SEQ ID NO: 7897390 - DNA, 22 bp, Homo sapiens
tacacataggagggtaataaaa

SEQ ID NO: 7897391 - DNA, 20 bp, Homo sapiens
tacagaatgcaataaaatgg

SEQ ID NO: 7897392 - DNA, 20 bp, Homo sapiens
tacagaatgcaataaaatgg

SEQ ID NO: 7897393 - DNA, 20 bp, Homo sapiens
tacagaatgcaataaaatgg

SEQ ID NO: 7897394 - DNA, 20 bp, Homo sapiens
tacagaatgcaataaaatgg

SEQ ID NO: 7897395 - DNA, 22 bp, Homo sapiens
tacagaatgatgtgtttaaata

SEQ ID NO: 7897396 - DNA, 20 bp, Homo sapiens
tacagaatgcaataaaatgg

SEQ ID NO: 7897397 - DNA, 20 bp, Homo sapiens
tacagaatgcaataaaatgg

SEQ ID NO: 7897398 - DNA, 20 bp, Homo sapiens
tacagaatgcaataaaatgg

SEQ ID NO: 7897399 - DNA, 20 bp, Homo sapiens
tacagaatgcaataaaatgg

SEQ ID NO: 7897400 - DNA, 22 bp, Homo sapiens
tacagaatgatgtgtttaaata

SEQ ID NO: 7897401 - DNA, 22 bp, Homo sapiens
tacagaatctatgcttcacagt

SEQ ID NO: 7897402 - DNA, 22 bp, Homo sapiens
tacagaatctatgcttcacagt

SEQ ID NO: 7897403 - DNA, 22 bp, Homo sapiens
tacagaatctatgcttcacagt

SEQ ID NO: 7897404 - DNA, 22 bp, Homo sapiens
tacagaatatagaagctggaag

SEQ ID NO: 7897405 - DNA, 22 bp, Homo sapiens
tacagaatatttctgccctgag

SEQ ID NO: 7897406 - DNA, 22 bp, Homo sapiens
tacagaatatagaagctggaag

SEQ ID NO: 7897407 - DNA, 22 bp, Homo sapiens
tacaagaaactacatgaatgca

SEQ ID NO: 7897408 - DNA, 22 bp, Homo sapiens
tacaagaaactacatgaatgca

SEQ ID NO: 7897409 - DNA, 22 bp, Homo sapiens
tacaagaaactacatgaatgca

SEQ ID NO: 7897410 - DNA, 22 bp, Homo sapiens
tacaagaaactacatgaatgca

SEQ ID NO: 7897411 - DNA, 22 bp, Homo sapiens
tacaagaaatttctgcatatat

SEQ ID NO: 7897412 - DNA, 22 bp, Homo sapiens
tacaagaagaggcagagctgga

SEQ ID NO: 7897413 - DNA, 22 bp, Homo sapiens
tacaagaagaggcagagctgga

SEQ ID NO: 7897414 - DNA, 22 bp, Homo sapiens
tacaagaaatttctgcatatat

SEQ ID NO: 7897415 - DNA, 22 bp, Homo sapiens
tacaagaaatttctgcatatat

SEQ ID NO: 7897416 - DNA, 22 bp, Homo sapiens
tacaacatttacgttaggctgt

SEQ ID NO: 7897417 - DNA, 22 bp, Homo sapiens
tacaacattgtgttgcttcata

SEQ ID NO: 7897418 - DNA, 22 bp, Homo sapiens
tacaacattgtgttgcttcata

SEQ ID NO: 7897419 - DNA, 22 bp, Homo sapiens
tacaacatttacgttaggctgt

SEQ ID NO: 7897420 - DNA, 22 bp, Homo sapiens
tacaacatttacgttaggctgt

SEQ ID NO: 7897421 - DNA, 22 bp, Homo sapiens
tacaaccatagacatatactag

SEQ ID NO: 7897422 - DNA, 22 bp, Homo sapiens
tacaaccttctccccaaaagct

SEQ ID NO: 7897423 - DNA, 22 bp, Homo sapiens
tacaaccatagacatatactag

SEQ ID NO: 7897424 - DNA, 22 bp, Homo sapiens
tacaaccatagacatatactag

SEQ ID NO: 7897425 - DNA, 22 bp, Homo sapiens
tacaaccatagacatatactag

SEQ ID NO: 7897426 - DNA, 22 bp, Homo sapiens
tacaactgcacatctgaatcac

SEQ ID NO: 7897427 - DNA, 22 bp, Homo sapiens
tacaacttacttgaatggcttt

SEQ ID NO: 7897428 - DNA, 22 bp, Homo sapiens
taatttcaaatttcttagcgtg

SEQ ID NO: 7897429 - DNA, 22 bp, Homo sapiens
tacaacataacgggcattcagt

SEQ ID NO: 7897430 - DNA, 22 bp, Homo sapiens
tacaacattgtgttgcttcata

SEQ ID NO: 7897431 - DNA, 22 bp, Homo sapiens
tacaacatgtggtcctttatga

SEQ ID NO: 7897432 - DNA, 22 bp, Homo sapiens
tacaacatgtggtcctttatga

SEQ ID NO: 7897433 - DNA, 22 bp, Homo sapiens
tacaacatgtggtcctttatga

SEQ ID NO: 7897434 - DNA, 22 bp, Homo sapiens
tacaacatgtaaagtggtttaa

SEQ ID NO: 7897435 - DNA, 22 bp, Homo sapiens
tacaacataacgggcattcagt

SEQ ID NO: 7897436 - DNA, 22 bp, Homo sapiens
taatttatggtatgtgtgtaat

SEQ ID NO: 7897437 - DNA, 22 bp, Homo sapiens
taatttatggtatgtgtgtaat

SEQ ID NO: 7897438 - DNA, 22 bp, Homo sapiens
taatttatggtatgtgtgtaat

SEQ ID NO: 7897439 - DNA, 22 bp, Homo sapiens
taatttatttcaactgccaagg

SEQ ID NO: 7897440 - DNA, 22 bp, Homo sapiens
taatttatttcaactgccaagg

SEQ ID NO: 7897441 - DNA, 22 bp, Homo sapiens
tacacaatgacttaagatgtca

SEQ ID NO: 7897442 - DNA, 22 bp, Homo sapiens
tacacaatgacttaagatgtca

SEQ ID NO: 7897443 - DNA, 22 bp, Homo sapiens
tacacaatgacttaagatgtca

SEQ ID NO: 7897444 - DNA, 22 bp, Homo sapiens
tacacaatgacttaagatgtca

SEQ ID NO: 7897445 - DNA, 22 bp, Homo sapiens
tacacaatgacttaagatgtca

SEQ ID NO: 7897446 - DNA, 22 bp, Homo sapiens
tacacaatctgtttttccattt

SEQ ID NO: 7897447 - DNA, 22 bp, Homo sapiens
tacaagattaaaacttatacca

SEQ ID NO: 7897448 - DNA, 22 bp, Homo sapiens
tacacaactgacaaccattctg

SEQ ID NO: 7897449 - DNA, 22 bp, Homo sapiens
tacacaatctgtttttccattt

SEQ ID NO: 7897450 - DNA, 22 bp, Homo sapiens
tacacaatctgtttttccattt

SEQ ID NO: 7897451 - DNA, 22 bp, Homo sapiens
tacaagagtgagattatcatgt

SEQ ID NO: 7897452 - DNA, 22 bp, Homo sapiens
tacaagataagaattggcaagg

SEQ ID NO: 7897453 - DNA, 22 bp, Homo sapiens
tacaagaggtatatagaaacag

SEQ ID NO: 7897454 - DNA, 22 bp, Homo sapiens
tacaagaggatgtggacatgga

SEQ ID NO: 7897455 - DNA, 22 bp, Homo sapiens
tacaagaggatgtggacatgga

SEQ ID NO: 7897456 - DNA, 22 bp, Homo sapiens
tacaagaggtatatagaaacag

SEQ ID NO: 7897457 - DNA, 22 bp, Homo sapiens
tacaagatgtactaaaaattat

SEQ ID NO: 7897458 - DNA, 22 bp, Homo sapiens
tacaagatgtactaaaaattat

SEQ ID NO: 7897459 - DNA, 22 bp, Homo sapiens
tacaagatgtactaaaaattat

SEQ ID NO: 7897460 - DNA, 22 bp, Homo sapiens
tacaagatgtactaaaaattat

SEQ ID NO: 7897461 - DNA, 22 bp, Homo sapiens
tacaagatgtactaaaaattat

SEQ ID NO: 7897462 - DNA, 21 bp, Homo sapiens
tacaagatagaggtaatatat

SEQ ID NO: 7897463 - DNA, 21 bp, Homo sapiens
tacaagatagaggtaatatat

SEQ ID NO: 7897464 - DNA, 21 bp, Homo sapiens
tacaagatagaggtaatatat

SEQ ID NO: 7897465 - DNA, 22 bp, Homo sapiens
tacaagaatgtcttaaaagctc

SEQ ID NO: 7897466 - DNA, 22 bp, Homo sapiens
tacaagaatgtcttaaaagctc

SEQ ID NO: 7897467 - DNA, 22 bp, Homo sapiens
tacaagaatgtcttaaaagctc

SEQ ID NO: 7897468 - DNA, 22 bp, Homo sapiens
tacaagaatgtcttaaaagctc

SEQ ID NO: 7897469 - DNA, 22 bp, Homo sapiens
tacaagaatgtcttaaaagctc

SEQ ID NO: 7897470 - DNA, 22 bp, Homo sapiens
tacaagaaggatggagcccact

SEQ ID NO: 7897471 - DNA, 22 bp, Homo sapiens
tacaagaaggatggagcccact

SEQ ID NO: 7897472 - DNA, 20 bp, Homo sapiens
tacaagaatccccagttgtc

SEQ ID NO: 7897473 - DNA, 22 bp, Homo sapiens
tacaagaatgtcttaaaagctc

SEQ ID NO: 7897474 - DNA, 22 bp, Homo sapiens
tacaagaagaggcagagctgga

SEQ ID NO: 7897475 - DNA, 22 bp, Homo sapiens
tacaagaaggaaaactagcaat

SEQ ID NO: 7897476 - DNA, 22 bp, Homo sapiens
tacaagagaactaatgtaagtc

SEQ ID NO: 7897477 - DNA, 22 bp, Homo sapiens
tacaagagaactaatgtaagtc

SEQ ID NO: 7897478 - DNA, 22 bp, Homo sapiens
tacaagagcagtaagcttgtcc

SEQ ID NO: 7897479 - DNA, 22 bp, Homo sapiens
tacaagagacaccagggaggct

SEQ ID NO: 7897480 - DNA, 22 bp, Homo sapiens
tacaagagacaccagggaggct

SEQ ID NO: 7897481 - DNA, 22 bp, Homo sapiens
tacaagaatttctttctggttg

SEQ ID NO: 7897482 - DNA, 22 bp, Homo sapiens
tacaagaatttctttctggttg

SEQ ID NO: 7897483 - DNA, 22 bp, Homo sapiens
tacaagaatgtcttaaaagctc

SEQ ID NO: 7897484 - DNA, 22 bp, Homo sapiens
tacaagacgagggaagttcttt

SEQ ID NO: 7897485 - DNA, 22 bp, Homo sapiens
taatatacttcccatagtttga

SEQ ID NO: 7897486 - DNA, 22 bp, Homo sapiens
taatatacttcccatagtttga

SEQ ID NO: 7897487 - DNA, 22 bp, Homo sapiens
taatatacttcccatagtttga

SEQ ID NO: 7897488 - DNA, 22 bp, Homo sapiens
taatataccaaactgtaatttt

SEQ ID NO: 7897489 - DNA, 22 bp, Homo sapiens
taatataccaaactgtaatttt

SEQ ID NO: 7897490 - DNA, 22 bp, Homo sapiens
taatataccaaactgtaatttt

SEQ ID NO: 7897491 - DNA, 22 bp, Homo sapiens
taatataccaaactgtaatttt

SEQ ID NO: 7897492 - DNA, 19 bp, Homo sapiens
taatatacagacccatctg

SEQ ID NO: 7897493 - DNA, 22 bp, Homo sapiens
taatataccaaactgtaatttt

SEQ ID NO: 7897494 - DNA, 22 bp, Homo sapiens
taatataccaaactgtaatttt

SEQ ID NO: 7897495 - DNA, 22 bp, Homo sapiens
taatataccaaactgtaatttt

SEQ ID NO: 7897496 - DNA, 22 bp, Homo sapiens
taatagtttcataatgtgcttc

SEQ ID NO: 7897497 - DNA, 19 bp, Homo sapiens
taatatacagacccatctg

SEQ ID NO: 7897498 - DNA, 22 bp, Homo sapiens
taatagttgtgactttgtaaag

SEQ ID NO: 7897499 - DNA, 21 bp, Homo sapiens
taatataggttcacaactagt

SEQ ID NO: 7897500 - DNA, 22 bp, Homo sapiens
taatatatacctttgttaggaa

SEQ ID NO: 7897501 - DNA, 21 bp, Homo sapiens
taatataggttcacaactagt

SEQ ID NO: 7897502 - DNA, 22 bp, Homo sapiens
taatatacttcccatagtttga

SEQ ID NO: 7897503 - DNA, 22 bp, Homo sapiens
taatatacttcccatagtttga

SEQ ID NO: 7897504 - DNA, 22 bp, Homo sapiens
taatatacttcccatagtttga

SEQ ID NO: 7897505 - DNA, 22 bp, Homo sapiens
taatatatacctttgttaggaa

SEQ ID NO: 7897506 - DNA, 21 bp, Homo sapiens
taatataggttcacaactagt

SEQ ID NO: 7897507 - DNA, 22 bp, Homo sapiens
taatatatacctttgttaggaa

SEQ ID NO: 7897508 - DNA, 22 bp, Homo sapiens
taatatatacctttgttaggaa

SEQ ID NO: 7897509 - DNA, 22 bp, Homo sapiens
taatagttgtgactttgtaaag

SEQ ID NO: 7897510 - DNA, 22 bp, Homo sapiens
taatagttatggttggttctca

SEQ ID NO: 7897511 - DNA, 22 bp, Homo sapiens
taaggattaaataagaatattt

SEQ ID NO: 7897512 - DNA, 22 bp, Homo sapiens
taaggacaatcaggttagtagc

SEQ ID NO: 7897513 - DNA, 22 bp, Homo sapiens
taaggaggctgctgtgaagaaa

SEQ ID NO: 7897514 - DNA, 22 bp, Homo sapiens
taaggaggcgaggtggtgagca

SEQ ID NO: 7897515 - DNA, 22 bp, Homo sapiens
taaggaggctgctgtgaagaaa

SEQ ID NO: 7897516 - DNA, 22 bp, Homo sapiens
taaggaggtgcccactctcagg

SEQ ID NO: 7897517 - DNA, 22 bp, Homo sapiens
taaggaggttggtgggttggat

SEQ ID NO: 7897518 - DNA, 22 bp, Homo sapiens
taaggagggggaatgattggca

SEQ ID NO: 7897519 - DNA, 22 bp, Homo sapiens
taaggagggggaatgattggca

SEQ ID NO: 7897520 - DNA, 22 bp, Homo sapiens
taaggacattggttttgagtaa

SEQ ID NO: 7897521 - DNA, 22 bp, Homo sapiens
taaggacattggttttgagtaa

SEQ ID NO: 7897522 - DNA, 22 bp, Homo sapiens
taaggacattagaaatgatgct

SEQ ID NO: 7897523 - DNA, 22 bp, Homo sapiens
taaggagagaatttagaggttt

SEQ ID NO: 7897524 - DNA, 22 bp, Homo sapiens
taaggaggcagtcattatcagg

SEQ ID NO: 7897525 - DNA, 22 bp, Homo sapiens
taaggaggcgaggtggtgagca

SEQ ID NO: 7897526 - DNA, 22 bp, Homo sapiens
taaggagagaatttagaggttt

SEQ ID NO: 7897527 - DNA, 22 bp, Homo sapiens
taaggagagaatttagaggttt

SEQ ID NO: 7897528 - DNA, 22 bp, Homo sapiens
taaggaatgcttgaatgttcct

SEQ ID NO: 7897529 - DNA, 22 bp, Homo sapiens
taaggaatatcataagaagtag

SEQ ID NO: 7897530 - DNA, 22 bp, Homo sapiens
taaggaatagtgctatgaaaaa

SEQ ID NO: 7897531 - DNA, 22 bp, Homo sapiens
taagctctgttatccagagccc

SEQ ID NO: 7897532 - DNA, 22 bp, Homo sapiens
taaggaaaatggacatcaaaca

SEQ ID NO: 7897533 - DNA, 22 bp, Homo sapiens
taaggaaaatggacatcaaaca

SEQ ID NO: 7897534 - DNA, 22 bp, Homo sapiens
taaggaaaatggacatcaaaca

SEQ ID NO: 7897535 - DNA, 22 bp, Homo sapiens
taaggaaaatggacatcaaaca

SEQ ID NO: 7897536 - DNA, 22 bp, Homo sapiens
taagcctgcatgaaccatgaga

SEQ ID NO: 7897537 - DNA, 22 bp, Homo sapiens
taagctcactgtaagaactgat

SEQ ID NO: 7897538 - DNA, 22 bp, Homo sapiens
taagctcactgtaagaactgat

SEQ ID NO: 7897539 - DNA, 22 bp, Homo sapiens
taagctattcctgaagaaggtt

SEQ ID NO: 7897540 - DNA, 22 bp, Homo sapiens
taagccatacatttcagactct

SEQ ID NO: 7897541 - DNA, 22 bp, Homo sapiens
taagccactagtctgttatgaa

SEQ ID NO: 7897542 - DNA, 22 bp, Homo sapiens
taagcctgcatgaaccatgaga

SEQ ID NO: 7897543 - DNA, 22 bp, Homo sapiens
taagcccaggaatgcacttcag

SEQ ID NO: 7897544 - DNA, 22 bp, Homo sapiens
taagcattatggtaaagaagta

SEQ ID NO: 7897545 - DNA, 22 bp, Homo sapiens
taagcattaactctgctgcaag

SEQ ID NO: 7897546 - DNA, 22 bp, Homo sapiens
taagcattaactctgctgcaag

SEQ ID NO: 7897547 - DNA, 22 bp, Homo sapiens
taagcattaactctgctgcaag

SEQ ID NO: 7897548 - DNA, 21 bp, Homo sapiens
taagccaccatgtgaaaccag

SEQ ID NO: 7897549 - DNA, 22 bp, Homo sapiens
taaggaatagtgctatgaaaaa

SEQ ID NO: 7897550 - DNA, 22 bp, Homo sapiens
taaggaagtcacaagaatcgct

SEQ ID NO: 7897551 - DNA, 22 bp, Homo sapiens
taaggaagtacccattcttagg

SEQ ID NO: 7897552 - DNA, 22 bp, Homo sapiens
taaggaagagcttggtaatagg

SEQ ID NO: 7897553 - DNA, 22 bp, Homo sapiens
taaggaaagtgccatgatttct

SEQ ID NO: 7897554 - DNA, 22 bp, Homo sapiens
taaggaaagtgccatgatttct

SEQ ID NO: 7897555 - DNA, 22 bp, Homo sapiens
taaggaaacaacttgtattttt

SEQ ID NO: 7897556 - DNA, 22 bp, Homo sapiens
taaggaaacaacttgtattttt

SEQ ID NO: 7897557 - DNA, 22 bp, Homo sapiens
taaggaaacaacttgtattttt

SEQ ID NO: 7897558 - DNA, 22 bp, Homo sapiens
taaggaaaatggacatcaaaca

SEQ ID NO: 7897559 - DNA, 22 bp, Homo sapiens
taaggaaaatggacatcaaaca

SEQ ID NO: 7897560 - DNA, 22 bp, Homo sapiens
taaggaaagtgccatgatttct

SEQ ID NO: 7897561 - DNA, 22 bp, Homo sapiens
taaggaaagtgccatgatttct

SEQ ID NO: 7897562 - DNA, 22 bp, Homo sapiens
taaggaaagtacatgttttgac

SEQ ID NO: 7897563 - DNA, 22 bp, Homo sapiens
taaggaaagtgccatgatttct

SEQ ID NO: 7897564 - DNA, 22 bp, Homo sapiens
taaggaaagtacatgttttgac

SEQ ID NO: 7897565 - DNA, 22 bp, Homo sapiens
taaggaaagtacatgttttgac

SEQ ID NO: 7897566 - DNA, 22 bp, Homo sapiens
taaggaaacaacttgtattttt

SEQ ID NO: 7897567 - DNA, 22 bp, Homo sapiens
taatttatgatgcaaagaaaag

SEQ ID NO: 7897568 - DNA, 22 bp, Homo sapiens
taatttatgatgcaaagaaaag

SEQ ID NO: 7897569 - DNA, 22 bp, Homo sapiens
taatttatgatgcaaagaaaag

SEQ ID NO: 7897570 - DNA, 22 bp, Homo sapiens
taatttatatggaattgttgct

SEQ ID NO: 7897571 - DNA, 22 bp, Homo sapiens
taatttatagaatttcttggat

SEQ ID NO: 7897572 - DNA, 22 bp, Homo sapiens
taatttatagaatttcttggat

SEQ ID NO: 7897573 - DNA, 22 bp, Homo sapiens
taatttagtccaatgtgaatat

SEQ ID NO: 7897574 - DNA, 22 bp, Homo sapiens
taatttacttgcaaataacaat

SEQ ID NO: 7897575 - DNA, 22 bp, Homo sapiens
taattgcagggtgtcagaatac

SEQ ID NO: 7897576 - DNA, 22 bp, Homo sapiens
taattctagattgacattttga

SEQ ID NO: 7897577 - DNA, 22 bp, Homo sapiens
taattctagattgacattttga

SEQ ID NO: 7897578 - DNA, 22 bp, Homo sapiens
taattctagattgacattttga

SEQ ID NO: 7897579 - DNA, 22 bp, Homo sapiens
taattcctagaaattattctca

SEQ ID NO: 7897580 - DNA, 21 bp, Homo sapiens
taattccagaggtcactgaag

SEQ ID NO: 7897581 - DNA, 22 bp, Homo sapiens
taattccttaagctgaagactt

SEQ ID NO: 7897582 - DNA, 22 bp, Homo sapiens
taattccaagttgagacatgca

SEQ ID NO: 7897583 - DNA, 22 bp, Homo sapiens
taattcatgggcccagtgatat

SEQ ID NO: 7897584 - DNA, 22 bp, Homo sapiens
taattcatgggcccagtgatat

SEQ ID NO: 7897585 - DNA, 22 bp, Homo sapiens
taattcagtcattaatcttagc

SEQ ID NO: 7897586 - DNA, 22 bp, Homo sapiens
taattcagtgttcacttggaca

SEQ ID NO: 7897587 - DNA, 22 bp, Homo sapiens
taattcagggccagaatcccca

SEQ ID NO: 7897588 - DNA, 22 bp, Homo sapiens
taattcaggtagaacttaccag

SEQ ID NO: 7897589 - DNA, 23 bp, Homo sapiens
taattcacatatacattgcttca

SEQ ID NO: 7897590 - DNA, 22 bp, Homo sapiens
taattatttgaagacattagag

SEQ ID NO: 7897591 - DNA, 22 bp, Homo sapiens
taattcagctgaacaactgtgt

SEQ ID NO: 7897592 - DNA, 22 bp, Homo sapiens
taattcagaagtcctggctgga

SEQ ID NO: 7897593 - DNA, 22 bp, Homo sapiens
taattcagagtagttgtggagc

SEQ ID NO: 7897594 - DNA, 22 bp, Homo sapiens
taattattgtctgaagagttat

SEQ ID NO: 7897595 - DNA, 22 bp, Homo sapiens
taattatttgaagacattagag

SEQ ID NO: 7897596 - DNA, 22 bp, Homo sapiens
taattatttgaagacattagag

SEQ ID NO: 7897597 - DNA, 22 bp, Homo sapiens
taattatttgaagacattagag

SEQ ID NO: 7897598 - DNA, 22 bp, Homo sapiens
taattatttgaagacattagag

SEQ ID NO: 7897599 - DNA, 22 bp, Homo sapiens
taatcttagacatgtatttttc

SEQ ID NO: 7897600 - DNA, 18 bp, Homo sapiens
taatcttacagacaggat

SEQ ID NO: 7897601 - DNA, 22 bp, Homo sapiens
taatcttagcaacctccagtgt

SEQ ID NO: 7897602 - DNA, 22 bp, Homo sapiens
taatgaacaatatatcaatagc

SEQ ID NO: 7897603 - DNA, 19 bp, Homo sapiens
taatcttattgggcagatt

SEQ ID NO: 7897604 - DNA, 21 bp, Homo sapiens
taatcttcgaaaatgtattag

SEQ ID NO: 7897605 - DNA, 22 bp, Homo sapiens
taatctgtattcctactttgca

SEQ ID NO: 7897606 - DNA, 22 bp, Homo sapiens
taatctgtaatttttgcaatag

SEQ ID NO: 7897607 - DNA, 22 bp, Homo sapiens
taatctgtgtaccttcatcgga

SEQ ID NO: 7897608 - DNA, 22 bp, Homo sapiens
taatctgtgtaccttcatcgga

SEQ ID NO: 7897609 - DNA, 22 bp, Homo sapiens
taatctgtattcctactttgca

SEQ ID NO: 7897610 - DNA, 22 bp, Homo sapiens
taatctgttaatatttgtatcc

SEQ ID NO: 7897611 - DNA, 22 bp, Homo sapiens
taatctgttgactaacttggga

SEQ ID NO: 7897612 - DNA, 22 bp, Homo sapiens
taatctgttaatatttgtatcc

SEQ ID NO: 7897613 - DNA, 22 bp, Homo sapiens
taatctgttgttaatattgact

SEQ ID NO: 7897614 - DNA, 22 bp, Homo sapiens
taatctgttgttaatattgact

SEQ ID NO: 7897615 - DNA, 22 bp, Homo sapiens
taattattgtctgaagagttat

SEQ ID NO: 7897616 - DNA, 22 bp, Homo sapiens
taattattgtctgaagagttat

SEQ ID NO: 7897617 - DNA, 22 bp, Homo sapiens
taattattctagtcacatagca

SEQ ID NO: 7897618 - DNA, 22 bp, Homo sapiens
taattattctagtcacatagca

SEQ ID NO: 7897619 - DNA, 22 bp, Homo sapiens
taattattctagtcacatagca

SEQ ID NO: 7897620 - DNA, 22 bp, Homo sapiens
taattattatgacaacaattgc

SEQ ID NO: 7897621 - DNA, 22 bp, Homo sapiens
taattattatgacaacaattgc

SEQ ID NO: 7897622 - DNA, 22 bp, Homo sapiens
taattattatgacaacaattgc

SEQ ID NO: 7897623 - DNA, 22 bp, Homo sapiens
taattattatgacaacaattgc

SEQ ID NO: 7897624 - DNA, 22 bp, Homo sapiens
taattattatgacaacaattgc

SEQ ID NO: 7897625 - DNA, 22 bp, Homo sapiens
taattattatgacaacaattgc

SEQ ID NO: 7897626 - DNA, 22 bp, Homo sapiens
taattattatgacaacaattgc

SEQ ID NO: 7897627 - DNA, 22 bp, Homo sapiens
taatatatttctgctaagctca

SEQ ID NO: 7897628 - DNA, 22 bp, Homo sapiens
taatatatttctgctaagctca

SEQ ID NO: 7897629 - DNA, 22 bp, Homo sapiens
taatatatttctgctaagctca

SEQ ID NO: 7897630 - DNA, 22 bp, Homo sapiens
taatatatttctgctaagctca

SEQ ID NO: 7897631 - DNA, 22 bp, Homo sapiens
taatccagggtattctagtttc

SEQ ID NO: 7897632 - DNA, 22 bp, Homo sapiens
taatatctacttcatagagttt

SEQ ID NO: 7897633 - DNA, 23 bp, Homo sapiens
taatatcctgcaatgcacagaac

SEQ ID NO: 7897634 - DNA, 18 bp, Homo sapiens
taatccatatgctttgcc

SEQ ID NO: 7897635 - DNA, 22 bp, Homo sapiens
taatccaggtaagacataatag

SEQ ID NO: 7897636 - DNA, 22 bp, Homo sapiens
taatctcttttaggacagagcc

SEQ ID NO: 7897637 - DNA, 22 bp, Homo sapiens
taatctctttatgagaagaagg

SEQ ID NO: 7897638 - DNA, 23 bp, Homo sapiens
taatctcttcaagagaaggggaa

SEQ ID NO: 7897639 - DNA, 22 bp, Homo sapiens
taatctatcaagcaacaaagtg

SEQ ID NO: 7897640 - DNA, 22 bp, Homo sapiens
taatctagtcccacatggaatt

SEQ ID NO: 7897641 - DNA, 22 bp, Homo sapiens
taatctatcaagcaacaaagtg

SEQ ID NO: 7897642 - DNA, 22 bp, Homo sapiens
taatctagaacatatgagagca

SEQ ID NO: 7897643 - DNA, 22 bp, Homo sapiens
taatcgtatgtgtatcaaatca

SEQ ID NO: 7897644 - DNA, 20 bp, Homo sapiens
tacagtgtatgtatttaggc

SEQ ID NO: 7897645 - DNA, 22 bp, Homo sapiens
tacagtgcttggtatctagtaa

SEQ ID NO: 7897646 - DNA, 22 bp, Homo sapiens
tacagtgctttttggtggagaa

SEQ ID NO: 7897647 - DNA, 22 bp, Homo sapiens
tacagtgctttttggtggagaa

SEQ ID NO: 7897648 - DNA, 22 bp, Homo sapiens
tacagtgtatgtatttgtaggt

SEQ ID NO: 7897649 - DNA, 20 bp, Homo sapiens
tacagtgtatgtatttaggc

SEQ ID NO: 7897650 - DNA, 22 bp, Homo sapiens
tacagtgtatgtatttgtaggt

SEQ ID NO: 7897651 - DNA, 22 bp, Homo sapiens
tacagtgtctgcaactgcacac

SEQ ID NO: 7897652 - DNA, 22 bp, Homo sapiens
tacagtgtccctttttcagaca

SEQ ID NO: 7897653 - DNA, 22 bp, Homo sapiens
tacagtgtatgtatttgtaggt

SEQ ID NO: 7897654 - DNA, 22 bp, Homo sapiens
tacagtgctagaacctgctgta

SEQ ID NO: 7897655 - DNA, 22 bp, Homo sapiens
tacagtgcttggtatctagtaa

SEQ ID NO: 7897656 - DNA, 22 bp, Homo sapiens
tacagtgcttggtatctagtaa

SEQ ID NO: 7897657 - DNA, 22 bp, Homo sapiens
tacagtgcttggtatctagtaa

SEQ ID NO: 7897658 - DNA, 22 bp, Homo sapiens
tacagtgcgggtgcgggcctct

SEQ ID NO: 7897659 - DNA, 22 bp, Homo sapiens
tacagtgcgatttttaggcctc

SEQ ID NO: 7897660 - DNA, 22 bp, Homo sapiens
tacagtgcatagaggcatgata

SEQ ID NO: 7897661 - DNA, 22 bp, Homo sapiens
tacagtgcgatttttaggcctc

SEQ ID NO: 7897662 - DNA, 22 bp, Homo sapiens
tacagtgcaatgtgatgtagat

SEQ ID NO: 7897663 - DNA, 22 bp, Homo sapiens
tacagtgatttctactggtgtt

SEQ ID NO: 7897664 - DNA, 22 bp, Homo sapiens
tacagtgatagagagtagctat

SEQ ID NO: 7897665 - DNA, 22 bp, Homo sapiens
tacagtgcaatgtgatgtagat

SEQ ID NO: 7897666 - DNA, 22 bp, Homo sapiens
tacagtgagtggcagagccaga

SEQ ID NO: 7897667 - DNA, 22 bp, Homo sapiens
tacagtgcatagaggcatgata

SEQ ID NO: 7897668 - DNA, 22 bp, Homo sapiens
tacagtgcatagaggcatgata

SEQ ID NO: 7897669 - DNA, 22 bp, Homo sapiens
tacagtgcaatgtgatgtagat

SEQ ID NO: 7897670 - DNA, 22 bp, Homo sapiens
tacagtgcacatttcttaggaa

SEQ ID NO: 7897671 - DNA, 22 bp, Homo sapiens
tacagtgcacatttcttaggaa

SEQ ID NO: 7897672 - DNA, 22 bp, Homo sapiens
tacagtctctgataactgtcag

SEQ ID NO: 7897673 - DNA, 22 bp, Homo sapiens
tacagtctttggaaagagatag

SEQ ID NO: 7897674 - DNA, 22 bp, Homo sapiens
tacagtctctttgagtgattgt

SEQ ID NO: 7897675 - DNA, 22 bp, Homo sapiens
tacagtctctttgagtgattgt

SEQ ID NO: 7897676 - DNA, 21 bp, Homo sapiens
tacagtctcccctgttgtcca

SEQ ID NO: 7897677 - DNA, 21 bp, Homo sapiens
tacagtctcccctgttgtcca

SEQ ID NO: 7897678 - DNA, 21 bp, Homo sapiens
tacagtctcccctgttgtcca

SEQ ID NO: 7897679 - DNA, 20 bp, Homo sapiens
tacagtcagggcacaggcag

SEQ ID NO: 7897680 - DNA, 22 bp, Homo sapiens
tacagtcaagcataagaagtca

SEQ ID NO: 7897681 - DNA, 22 bp, Homo sapiens
tacagtcaagcataagaagtca

SEQ ID NO: 7897682 - DNA, 22 bp, Homo sapiens
tacagtcaatactaggaccata

SEQ ID NO: 7897683 - DNA, 22 bp, Homo sapiens
tacagtcaagcataagaagtca

SEQ ID NO: 7897684 - DNA, 22 bp, Homo sapiens
tacagtcaatactaggaccata

SEQ ID NO: 7897685 - DNA, 22 bp, Homo sapiens
tacagtcacattctgaggtctt

SEQ ID NO: 7897686 - DNA, 22 bp, Homo sapiens
tacagtatttgaagaatatgag

SEQ ID NO: 7897687 - DNA, 22 bp, Homo sapiens
tacagtcaacattgatgatgat

SEQ ID NO: 7897688 - DNA, 22 bp, Homo sapiens
tacagtatttgaagaatatgag

SEQ ID NO: 7897689 - DNA, 22 bp, Homo sapiens
tacagtctttggaaagagatag

SEQ ID NO: 7897690 - DNA, 22 bp, Homo sapiens
tacagtctttggaaagagatag

SEQ ID NO: 7897691 - DNA, 19 bp, Homo sapiens
tacagtgaaccaggaggag

SEQ ID NO: 7897692 - DNA, 22 bp, Homo sapiens
tacagtgaatgaatggctgtgc

SEQ ID NO: 7897693 - DNA, 22 bp, Homo sapiens
tacagtgacagatagggataga

SEQ ID NO: 7897694 - DNA, 22 bp, Homo sapiens
tacagtgaccctatttccaaat

SEQ ID NO: 7897695 - DNA, 22 bp, Homo sapiens
tacagtgacctagaataaatac

SEQ ID NO: 7897696 - DNA, 22 bp, Homo sapiens
tacagtgaccctatttccaaat

SEQ ID NO: 7897697 - DNA, 22 bp, Homo sapiens
tacagtgactggactttgtcat

SEQ ID NO: 7897698 - DNA, 22 bp, Homo sapiens
tacagtgacctagaataaatac

SEQ ID NO: 7897699 - DNA, 22 bp, Homo sapiens
tacagtgactggactttgtcat

SEQ ID NO: 7897700 - DNA, 22 bp, Homo sapiens
tacagtgagactggctcaggga

SEQ ID NO: 7897701 - DNA, 21 bp, Homo sapiens
tacagtgaggtgttaggatgt

SEQ ID NO: 7897702 - DNA, 22 bp, Homo sapiens
tacagtgatagagagtagctat

SEQ ID NO: 7897703 - DNA, 22 bp, Homo sapiens
tacagtgaggtggtttccttta

SEQ ID NO: 7897704 - DNA, 22 bp, Homo sapiens
tacagagatgtgaaaagctcta

SEQ ID NO: 7897705 - DNA, 22 bp, Homo sapiens
tacagagatttattgctaaggc

SEQ ID NO: 7897706 - DNA, 22 bp, Homo sapiens
tacagagatttattgctaaggc

SEQ ID NO: 7897707 - DNA, 22 bp, Homo sapiens
tacagagatttattgctaaggc

SEQ ID NO: 7897708 - DNA, 20 bp, Homo sapiens
tacagacatgacaataatgg

SEQ ID NO: 7897709 - DNA, 20 bp, Homo sapiens
tacagacatgacaataatgg

SEQ ID NO: 7897710 - DNA, 20 bp, Homo sapiens
tacagacatgacaataatgg

SEQ ID NO: 7897711 - DNA, 22 bp, Homo sapiens
tacagagatgccgaagagtgaa

SEQ ID NO: 7897712 - DNA, 22 bp, Homo sapiens
tacagagatgccgaagagtgaa

SEQ ID NO: 7897713 - DNA, 22 bp, Homo sapiens
tacagagatactctagatcaaa

SEQ ID NO: 7897714 - DNA, 22 bp, Homo sapiens
tacagagatactctagatcaaa

SEQ ID NO: 7897715 - DNA, 22 bp, Homo sapiens
tacagagatactctagatcaaa

SEQ ID NO: 7897716 - DNA, 22 bp, Homo sapiens
tacagaggggacatggaagaca

SEQ ID NO: 7897717 - DNA, 22 bp, Homo sapiens
tacagtagtaagaatgccttat

SEQ ID NO: 7897718 - DNA, 22 bp, Homo sapiens
tacagtagtatcttcatttgtt

SEQ ID NO: 7897719 - DNA, 22 bp, Homo sapiens
tacagtatggaaaatgtatagt

SEQ ID NO: 7897720 - DNA, 22 bp, Homo sapiens
tacagtatggaaaatgtatagt

SEQ ID NO: 7897721 - DNA, 22 bp, Homo sapiens
tacagtatggaaaatgtatagt

SEQ ID NO: 7897722 - DNA, 22 bp, Homo sapiens
tacagtatatactgtgtgtaga

SEQ ID NO: 7897723 - DNA, 22 bp, Homo sapiens
tacagtatggaaaatgtatagt

SEQ ID NO: 7897724 - DNA, 22 bp, Homo sapiens
tacagtatgttcttgaatttgg

SEQ ID NO: 7897725 - DNA, 22 bp, Homo sapiens
tacagtattactgtgttgtttt

SEQ ID NO: 7897726 - DNA, 22 bp, Homo sapiens
tacatgaacaaaatagcagaaa

SEQ ID NO: 7897727 - DNA, 22 bp, Homo sapiens
tacatgaacaaaatagcagaaa

SEQ ID NO: 7897728 - DNA, 22 bp, Homo sapiens
tacatgaacaaaatagcagaaa

SEQ ID NO: 7897729 - DNA, 22 bp, Homo sapiens
tacatgaacaaaatagcagaaa

SEQ ID NO: 7897730 - DNA, 22 bp, Homo sapiens
tacatgaacaaaatagcagaaa

SEQ ID NO: 7897731 - DNA, 22 bp, Homo sapiens
tacagtgtttcccccaggatag

SEQ ID NO: 7897732 - DNA, 22 bp, Homo sapiens
tacagtgtttcccccaggatag

SEQ ID NO: 7897733 - DNA, 22 bp, Homo sapiens
tacagtgtgacatttctacaaa

SEQ ID NO: 7897734 - DNA, 22 bp, Homo sapiens
tacagtgtgacatttctacaaa

SEQ ID NO: 7897735 - DNA, 22 bp, Homo sapiens
tacagtgtgacatttctacaaa

SEQ ID NO: 7897736 - DNA, 22 bp, Homo sapiens
tacagtgtctggatatcaaagg

SEQ ID NO: 7897737 - DNA, 22 bp, Homo sapiens
tacagtgtgaataagcaggcat

SEQ ID NO: 7897738 - DNA, 22 bp, Homo sapiens
tacagtgtgaataagcaggcat

SEQ ID NO: 7897739 - DNA, 22 bp, Homo sapiens
tacatgaatgtttcaatattgt

SEQ ID NO: 7897740 - DNA, 22 bp, Homo sapiens
tacatgaatgtttcaatattgt

SEQ ID NO: 7897741 - DNA, 22 bp, Homo sapiens
tacatgaatgtttcaatattgt

SEQ ID NO: 7897742 - DNA, 22 bp, Homo sapiens
tacatgaagaaaattaagcagt

SEQ ID NO: 7897743 - DNA, 22 bp, Homo sapiens
tacatgaagaaaattaagcagt

SEQ ID NO: 7897744 - DNA, 22 bp, Homo sapiens
tacatgaagaaaattaagcagt

SEQ ID NO: 7897745 - DNA, 22 bp, Homo sapiens
tacatgaagaaaattaagcagt

SEQ ID NO: 7897746 - DNA, 22 bp, Homo sapiens
tacatgaagaaaattaagcagt

SEQ ID NO: 7897747 - DNA, 22 bp, Homo sapiens
tacatgaagatgaatgtatggc

SEQ ID NO: 7897748 - DNA, 20 bp, Homo sapiens
tacatgagccctggcctcac

SEQ ID NO: 7897749 - DNA, 21 bp, Homo sapiens
tacatgagtgtatgagcatat

SEQ ID NO: 7897750 - DNA, 22 bp, Homo sapiens
tacatgacatttctttctgttc

SEQ ID NO: 7897751 - DNA, 22 bp, Homo sapiens
tacatgaatgtttcaatattgt

SEQ ID NO: 7897752 - DNA, 22 bp, Homo sapiens
tacatgaatgtttcaatattgt

SEQ ID NO: 7897753 - DNA, 22 bp, Homo sapiens
tacatgaatgtttcaatattgt

SEQ ID NO: 7897754 - DNA, 22 bp, Homo sapiens
tacatgaatttgagtcagagga

SEQ ID NO: 7897755 - DNA, 22 bp, Homo sapiens
tacatgaatttgagtcagagga

SEQ ID NO: 7897756 - DNA, 22 bp, Homo sapiens
tacatgcacatgaacatgtgtg

SEQ ID NO: 7897757 - DNA, 22 bp, Homo sapiens
tacatgcaattaagagggtgaa

SEQ ID NO: 7897758 - DNA, 22 bp, Homo sapiens
tacatgcaattaagagggtgaa

SEQ ID NO: 7897759 - DNA, 18 bp, Homo sapiens
tacatgcataaatgaagc

SEQ ID NO: 7897760 - DNA, 18 bp, Homo sapiens
tacatgcataaatgaagc

SEQ ID NO: 7897761 - DNA, 22 bp, Homo sapiens
tacatgcacatgaacatgtgtg

SEQ ID NO: 7897762 - DNA, 22 bp, Homo sapiens
tacatgcacatgaacatgtgtg

SEQ ID NO: 7897763 - DNA, 19 bp, Homo sapiens
tacatgcagcaggcacgca

SEQ ID NO: 7897764 - DNA, 22 bp, Homo sapiens
tacatgcatgatacaaagttgc

SEQ ID NO: 7897765 - DNA, 22 bp, Homo sapiens
tacatgcatgtcacagaatgaa

SEQ ID NO: 7897766 - DNA, 22 bp, Homo sapiens
tacatgcatgtcacagaatgaa

SEQ ID NO: 7897767 - DNA, 22 bp, Homo sapiens
tacatgcatgtcacagaatgaa

SEQ ID NO: 7897768 - DNA, 22 bp, Homo sapiens
tacatgcatgatacaaagttgc

SEQ ID NO: 7897769 - DNA, 18 bp, Homo sapiens
tacatgcataaatgaagc

SEQ ID NO: 7897770 - DNA, 20 bp, Homo sapiens
taccaacagcaggaagcata

SEQ ID NO: 7897771 - DNA, 22 bp, Homo sapiens
taccaaggcttgtgggggcaac

SEQ ID NO: 7897772 - DNA, 22 bp, Homo sapiens
taccaatgataagacagataat

SEQ ID NO: 7897773 - DNA, 22 bp, Homo sapiens
taccaaggcttgtgggggcaac

SEQ ID NO: 7897774 - DNA, 19 bp, Homo sapiens
taccaaattgcattatggc

SEQ ID NO: 7897775 - DNA, 19 bp, Homo sapiens
taccaaattgcattatggc

SEQ ID NO: 7897776 - DNA, 22 bp, Homo sapiens
taccaaatgtaatcattctaat

SEQ ID NO: 7897777 - DNA, 22 bp, Homo sapiens
taccaaagttttctgagtgata

SEQ ID NO: 7897778 - DNA, 18 bp, Homo sapiens
taccaaaggctttctttt

SEQ ID NO: 7897779 - DNA, 22 bp, Homo sapiens
taccaaagattaaatagcaaca

SEQ ID NO: 7897780 - DNA, 22 bp, Homo sapiens
tacatgtatgtgttaatatctg

SEQ ID NO: 7897781 - DNA, 22 bp, Homo sapiens
tacatgtatgtgtacgtgcatg

SEQ ID NO: 7897782 - DNA, 22 bp, Homo sapiens
tacatgtatgtgtacgtgcatg

SEQ ID NO: 7897783 - DNA, 22 bp, Homo sapiens
tacatgtatgtgttaatatctg

SEQ ID NO: 7897784 - DNA, 22 bp, Homo sapiens
tacatgtatgtgttaatatctg

SEQ ID NO: 7897785 - DNA, 22 bp, Homo sapiens
tacatgtaggtgacattttaat

SEQ ID NO: 7897786 - DNA, 22 bp, Homo sapiens
tacatgtaggtgacattttaat

SEQ ID NO: 7897787 - DNA, 22 bp, Homo sapiens
tacatgtacattgggcattaat

SEQ ID NO: 7897788 - DNA, 22 bp, Homo sapiens
tacatgtaggtgacattttaat

SEQ ID NO: 7897789 - DNA, 22 bp, Homo sapiens
tacatgtaggtgacattttaat

SEQ ID NO: 7897790 - DNA, 22 bp, Homo sapiens
tacatgtacatgcataggtaga

SEQ ID NO: 7897791 - DNA, 22 bp, Homo sapiens
tacatgtaattttcatagtaag

SEQ ID NO: 7897792 - DNA, 22 bp, Homo sapiens
tacatgtaattttcatagtaag

SEQ ID NO: 7897793 - DNA, 22 bp, Homo sapiens
tacatgcttctatatgtgaagt

SEQ ID NO: 7897794 - DNA, 22 bp, Homo sapiens
tacatggtggtggtgtctcggc

SEQ ID NO: 7897795 - DNA, 22 bp, Homo sapiens
tacatggtggtggcacttgact

SEQ ID NO: 7897796 - DNA, 22 bp, Homo sapiens
tacatgtaagacatgagactct

SEQ ID NO: 7897797 - DNA, 22 bp, Homo sapiens
tacatgtaagacatgagactct

SEQ ID NO: 7897798 - DNA, 22 bp, Homo sapiens
tacatggttgctttgttgatga

SEQ ID NO: 7897799 - DNA, 22 bp, Homo sapiens
tacatggttggcccattcttct

SEQ ID NO: 7897800 - DNA, 22 bp, Homo sapiens
tacatgtaagacatgagactct

SEQ ID NO: 7897801 - DNA, 22 bp, Homo sapiens
tacatgtaagacatgagactct

SEQ ID NO: 7897802 - DNA, 22 bp, Homo sapiens
tacatgtaattttcatagtaag

SEQ ID NO: 7897803 - DNA, 22 bp, Homo sapiens
tacatgtaagacatgagactct

SEQ ID NO: 7897804 - DNA, 22 bp, Homo sapiens
tacatgcatgtgtgtaaatata

SEQ ID NO: 7897805 - DNA, 22 bp, Homo sapiens
tacatgcatgtcacagaatgaa

SEQ ID NO: 7897806 - DNA, 22 bp, Homo sapiens
tacatgcatgtgtgtaaatata

SEQ ID NO: 7897807 - DNA, 22 bp, Homo sapiens
tacatgcatgtgtgtaaatata

SEQ ID NO: 7897808 - DNA, 22 bp, Homo sapiens
tacatgctccactttctcctgt

SEQ ID NO: 7897809 - DNA, 22 bp, Homo sapiens
tacatgctccactttctcctgt

SEQ ID NO: 7897810 - DNA, 22 bp, Homo sapiens
tacatgctcagtaactttcagt

SEQ ID NO: 7897811 - DNA, 23 bp, Homo sapiens
tacatgctataatttcaccctca

SEQ ID NO: 7897812 - DNA, 22 bp, Homo sapiens
tactgtgttgtgctgaaaggga

SEQ ID NO: 7897813 - DNA, 22 bp, Homo sapiens
tactgtgtgcccagccgagctg

SEQ ID NO: 7897814 - DNA, 22 bp, Homo sapiens
tactgtgtgcccagccgagctg

SEQ ID NO: 7897815 - DNA, 22 bp, Homo sapiens
tactgtgtgcccagccgagctg

SEQ ID NO: 7897816 - DNA, 22 bp, Homo sapiens
tactgaaacttttcttcaactg

SEQ ID NO: 7897817 - DNA, 22 bp, Homo sapiens
tactgaaagaatacataatttc

SEQ ID NO: 7897818 - DNA, 22 bp, Homo sapiens
tactgtactgcagttctgcaaa

SEQ ID NO: 7897819 - DNA, 22 bp, Homo sapiens
tactgtactcaacatgtgagtt

SEQ ID NO: 7897820 - DNA, 22 bp, Homo sapiens
tactgtactcaacatgtgagtt

SEQ ID NO: 7897821 - DNA, 22 bp, Homo sapiens
tactctggaaaacagaaagttg

SEQ ID NO: 7897822 - DNA, 22 bp, Homo sapiens
tactctaacatttgttagatgt

SEQ ID NO: 7897823 - DNA, 22 bp, Homo sapiens
tactctcagggttagtacagga

SEQ ID NO: 7897824 - DNA, 22 bp, Homo sapiens
tactcgaaatttactaaggtgt

SEQ ID NO: 7897825 - DNA, 22 bp, Homo sapiens
tactcgaaatcagagagaataa

SEQ ID NO: 7897826 - DNA, 22 bp, Homo sapiens
tactgaaactcttgtaaatatc

SEQ ID NO: 7897827 - DNA, 22 bp, Homo sapiens
tactgaaactcttgtaaatatc

SEQ ID NO: 7897828 - DNA, 22 bp, Homo sapiens
tactgaaactcttgtaaatatc

SEQ ID NO: 7897829 - DNA, 22 bp, Homo sapiens
tactgaaacttttcttcaactg

SEQ ID NO: 7897830 - DNA, 22 bp, Homo sapiens
tactgaaactcttgtaaatatc

SEQ ID NO: 7897831 - DNA, 22 bp, Homo sapiens
tactgaaaaagaatccagacct

SEQ ID NO: 7897832 - DNA, 22 bp, Homo sapiens
tactgaaaagccacaaggacca

SEQ ID NO: 7897833 - DNA, 22 bp, Homo sapiens
tactgaaaagccacaaggacca

SEQ ID NO: 7897834 - DNA, 22 bp, Homo sapiens
tacttacagaaggaagcaattg

SEQ ID NO: 7897835 - DNA, 22 bp, Homo sapiens
tacttacagagcttataagtta

SEQ ID NO: 7897836 - DNA, 22 bp, Homo sapiens
tacttacagaaggaagcaattg

SEQ ID NO: 7897837 - DNA, 22 bp, Homo sapiens
tacttacagaaggaagcaattg

SEQ ID NO: 7897838 - DNA, 22 bp, Homo sapiens
tacttacagaaggaagcaattg

SEQ ID NO: 7897839 - DNA, 22 bp, Homo sapiens
tacttaaaactgatagaatctc

SEQ ID NO: 7897840 - DNA, 22 bp, Homo sapiens
tacttacactgaagcaaagata

SEQ ID NO: 7897841 - DNA, 22 bp, Homo sapiens
tacttacacagctgtagaaggt

SEQ ID NO: 7897842 - DNA, 22 bp, Homo sapiens
tacttacacagctgtagaaggt

SEQ ID NO: 7897843 - DNA, 22 bp, Homo sapiens
tacttacagagcttataagtta

SEQ ID NO: 7897844 - DNA, 22 bp, Homo sapiens
tacttacagagcttataagtta

SEQ ID NO: 7897845 - DNA, 22 bp, Homo sapiens
tacttacagagcttataagtta

SEQ ID NO: 7897846 - DNA, 22 bp, Homo sapiens
tacttacagttgatcgatgtat

SEQ ID NO: 7897847 - DNA, 22 bp, Homo sapiens
tacttacagttacggcaagtgg

SEQ ID NO: 7897848 - DNA, 22 bp, Homo sapiens
tacttacatgaattcaagagca

SEQ ID NO: 7897849 - DNA, 22 bp, Homo sapiens
tacttacataaaaactgaatgt

SEQ ID NO: 7897850 - DNA, 22 bp, Homo sapiens
tacttacataaaaactgaatgt

SEQ ID NO: 7897851 - DNA, 22 bp, Homo sapiens
tacttaatgccactgaattgta

SEQ ID NO: 7897852 - DNA, 22 bp, Homo sapiens
tacttacacagctgtagaaggt

SEQ ID NO: 7897853 - DNA, 22 bp, Homo sapiens
tacttaaaactgatagaatctc

SEQ ID NO: 7897854 - DNA, 22 bp, Homo sapiens
tacttaaataattgctgctatt

SEQ ID NO: 7897855 - DNA, 22 bp, Homo sapiens
tacttaaaactgatagaatctc

SEQ ID NO: 7897856 - DNA, 22 bp, Homo sapiens
tacttaaaactgatagaatctc

SEQ ID NO: 7897857 - DNA, 22 bp, Homo sapiens
tacttaaaactgatagaatctc

SEQ ID NO: 7897858 - DNA, 22 bp, Homo sapiens
tacttaaaactgatagaatctc

SEQ ID NO: 7897859 - DNA, 22 bp, Homo sapiens
tacttaaaactgatagaatctc

SEQ ID NO: 7897860 - DNA, 22 bp, Homo sapiens
tacttaaaactgatagaatctc

SEQ ID NO: 7897861 - DNA, 22 bp, Homo sapiens
tactgtttttgcctctttagaa

SEQ ID NO: 7897862 - DNA, 22 bp, Homo sapiens
tactgtttttaaaattgcatcc

SEQ ID NO: 7897863 - DNA, 22 bp, Homo sapiens
tactgtttttaaaattgcatcc

SEQ ID NO: 7897864 - DNA, 22 bp, Homo sapiens
tactgttttctttatagtacag

SEQ ID NO: 7897865 - DNA, 22 bp, Homo sapiens
tactgttttctttatagtacag

SEQ ID NO: 7897866 - DNA, 22 bp, Homo sapiens
tactgttttctttacaccatgt

SEQ ID NO: 7897867 - DNA, 22 bp, Homo sapiens
tactgttttctttatagtacag

SEQ ID NO: 7897868 - DNA, 22 bp, Homo sapiens
tactgttttctttatagtacag

SEQ ID NO: 7897869 - DNA, 22 bp, Homo sapiens
tacttaaaaattatcaaagtgg

SEQ ID NO: 7897870 - DNA, 22 bp, Homo sapiens
tacttaaaaattatcaaagtgg

SEQ ID NO: 7897871 - DNA, 22 bp, Homo sapiens
tacttaaaaattatcaaagtgg

SEQ ID NO: 7897872 - DNA, 22 bp, Homo sapiens
tacttaaaaattatcaaagtgg

SEQ ID NO: 7897873 - DNA, 22 bp, Homo sapiens
tacttaaaaattatcaaagtgg

SEQ ID NO: 7897874 - DNA, 22 bp, Homo sapiens
tacttaaaaattatcaaagtgg

SEQ ID NO: 7897875 - DNA, 22 bp, Homo sapiens
tactgtttttgcctctttagaa

SEQ ID NO: 7897876 - DNA, 22 bp, Homo sapiens
tactgttagagcgatttgtcct

SEQ ID NO: 7897877 - DNA, 22 bp, Homo sapiens
tactgttagagccagaaaccta

SEQ ID NO: 7897878 - DNA, 22 bp, Homo sapiens
tactgttacagggagtgttcaa

SEQ ID NO: 7897879 - DNA, 22 bp, Homo sapiens
tactgttaatgttaaattcagg

SEQ ID NO: 7897880 - DNA, 22 bp, Homo sapiens
tactgttatatatagcagcagt

SEQ ID NO: 7897881 - DNA, 18 bp, Homo sapiens
tactgtttaattgattac

SEQ ID NO: 7897882 - DNA, 22 bp, Homo sapiens
tactgtttcaagccctcacaga

SEQ ID NO: 7897883 - DNA, 22 bp, Homo sapiens
tactgtttgcagtttgcagtat

SEQ ID NO: 7897884 - DNA, 22 bp, Homo sapiens
tactgtttgcagtttgcagtat

SEQ ID NO: 7897885 - DNA, 22 bp, Homo sapiens
tactgttttaaaaggtacttgt

SEQ ID NO: 7897886 - DNA, 22 bp, Homo sapiens
tactgttttctataatggctgt

SEQ ID NO: 7897887 - DNA, 22 bp, Homo sapiens
tactgttttctataatggctgt

SEQ ID NO: 7897888 - DNA, 22 bp, Homo sapiens
tactagtttctaccttacagaa

SEQ ID NO: 7897889 - DNA, 22 bp, Homo sapiens
tactatactctccattttatag

SEQ ID NO: 7897890 - DNA, 22 bp, Homo sapiens
tactatctggccctttacagaa

SEQ ID NO: 7897891 - DNA, 22 bp, Homo sapiens
tactatctcttctaacttcaga

SEQ ID NO: 7897892 - DNA, 23 bp, Homo sapiens
tactatggttattatccctctcc

SEQ ID NO: 7897893 - DNA, 22 bp, Homo sapiens
tactataccatgtaagatatga

SEQ ID NO: 7897894 - DNA, 22 bp, Homo sapiens
tactatactctccattttatag

SEQ ID NO: 7897895 - DNA, 23 bp, Homo sapiens
tactatggttattatccctctcc

SEQ ID NO: 7897896 - DNA, 22 bp, Homo sapiens
tactccacacgctattataatg

SEQ ID NO: 7897897 - DNA, 22 bp, Homo sapiens
tactagttcccagctaaaagta

SEQ ID NO: 7897898 - DNA, 22 bp, Homo sapiens
tactagtttctaccttacagaa

SEQ ID NO: 7897899 - DNA, 22 bp, Homo sapiens
tactagctaacattctcaccaa

SEQ ID NO: 7897900 - DNA, 22 bp, Homo sapiens
tactaggaagcagctgcattgg

SEQ ID NO: 7897901 - DNA, 22 bp, Homo sapiens
tactagaagctgtaatttttca

SEQ ID NO: 7897902 - DNA, 22 bp, Homo sapiens
tactacattaataaaacattca

SEQ ID NO: 7897903 - DNA, 17 bp, Homo sapiens
tactagaatagagacag

SEQ ID NO: 7897904 - DNA, 22 bp, Homo sapiens
tactagaagctgtaatttttca

SEQ ID NO: 7897905 - DNA, 22 bp, Homo sapiens
tactagaaaaacacatgctctg

SEQ ID NO: 7897906 - DNA, 22 bp, Homo sapiens
tactagaaaaacacatgctctg

SEQ ID NO: 7897907 - DNA, 22 bp, Homo sapiens
tactagaaattaccttctcact

SEQ ID NO: 7897908 - DNA, 22 bp, Homo sapiens
tactagaacctcacaacaatcc

SEQ ID NO: 7897909 - DNA, 22 bp, Homo sapiens
tactagaacctcacaacaatcc

SEQ ID NO: 7897910 - DNA, 22 bp, Homo sapiens
taccatttgagagagaacataa

SEQ ID NO: 7897911 - DNA, 22 bp, Homo sapiens
taccattttgaaacatttcatc

SEQ ID NO: 7897912 - DNA, 22 bp, Homo sapiens
tactacaaggccgaagctctca

SEQ ID NO: 7897913 - DNA, 22 bp, Homo sapiens
tactacaagggccctaaaaggt

SEQ ID NO: 7897914 - DNA, 22 bp, Homo sapiens
tactacaagggccctaaaaggt

SEQ ID NO: 7897915 - DNA, 22 bp, Homo sapiens
taccatttgagagagaacataa

SEQ ID NO: 7897916 - DNA, 22 bp, Homo sapiens
taccatttgagagagaacataa

SEQ ID NO: 7897917 - DNA, 22 bp, Homo sapiens
taccatttgagagagaacataa

SEQ ID NO: 7897918 - DNA, 22 bp, Homo sapiens
taccatttctacatatcttgtc

SEQ ID NO: 7897919 - DNA, 22 bp, Homo sapiens
taccatttctacatatcttgtc

SEQ ID NO: 7897920 - DNA, 22 bp, Homo sapiens
taccatttcattctttcctcat

SEQ ID NO: 7897921 - DNA, 22 bp, Homo sapiens
taccatttctacatatcttgtc

SEQ ID NO: 7897922 - DNA, 22 bp, Homo sapiens
taccatttcattctttcctcat

SEQ ID NO: 7897923 - DNA, 22 bp, Homo sapiens
taccatttcattctttcctcat

SEQ ID NO: 7897924 - DNA, 22 bp, Homo sapiens
tactactttcccccacatattt

SEQ ID NO: 7897925 - DNA, 22 bp, Homo sapiens
tactagaaaaacacatgctctg

SEQ ID NO: 7897926 - DNA, 22 bp, Homo sapiens
tactacattaataaaacattca

SEQ ID NO: 7897927 - DNA, 22 bp, Homo sapiens
tactacattaataaaacattca

SEQ ID NO: 7897928 - DNA, 22 bp, Homo sapiens
tactacattaataaaacattca

SEQ ID NO: 7897929 - DNA, 22 bp, Homo sapiens
tactacatacagaatttagaga

SEQ ID NO: 7897930 - DNA, 22 bp, Homo sapiens
tactacatacagaatttagaga

SEQ ID NO: 7897931 - DNA, 22 bp, Homo sapiens
tactacatacagaatttagaga

SEQ ID NO: 7897932 - DNA, 23 bp, Homo sapiens
tactacagggtcttgctatgaat

SEQ ID NO: 7897933 - DNA, 23 bp, Homo sapiens
tactacagggtcttgctatgaat

SEQ ID NO: 7897934 - DNA, 22 bp, Homo sapiens
tactacatacagaatttagaga

SEQ ID NO: 7897935 - DNA, 22 bp, Homo sapiens
tactacatacagaatttagaga

SEQ ID NO: 7897936 - DNA, 22 bp, Homo sapiens
taccatttcagtaaaaacttag

SEQ ID NO: 7897937 - DNA, 22 bp, Homo sapiens
taccatttcagtaaaaacttag

SEQ ID NO: 7897938 - DNA, 22 bp, Homo sapiens
taccatttcagtaaaaacttag

SEQ ID NO: 7897939 - DNA, 22 bp, Homo sapiens
taccatttacttgaaaataaaa

SEQ ID NO: 7897940 - DNA, 22 bp, Homo sapiens
taccatttacttgaaaataaaa

SEQ ID NO: 7897941 - DNA, 22 bp, Homo sapiens
taccatttcagtaaaaacttag

SEQ ID NO: 7897942 - DNA, 22 bp, Homo sapiens
taccatttacttgaaaataaaa

SEQ ID NO: 7897943 - DNA, 22 bp, Homo sapiens
taccatttacttgaaaataaaa

SEQ ID NO: 7897944 - DNA, 22 bp, Homo sapiens
taccattattcacatgatcttt

SEQ ID NO: 7897945 - DNA, 22 bp, Homo sapiens
taccatgatcaggctcatcctt

SEQ ID NO: 7897946 - DNA, 22 bp, Homo sapiens
taccatgatgtttgagttacta

SEQ ID NO: 7897947 - DNA, 22 bp, Homo sapiens
taccattgtaccaaggtaattt

SEQ ID NO: 7897948 - DNA, 22 bp, Homo sapiens
taccaggagcccccttctggtc

SEQ ID NO: 7897949 - DNA, 22 bp, Homo sapiens
taccaggcagctgcacagaggc

SEQ ID NO: 7897950 - DNA, 22 bp, Homo sapiens
taccagggaacagggatattaa

SEQ ID NO: 7897951 - DNA, 22 bp, Homo sapiens
taccagggaacagggatattaa

SEQ ID NO: 7897952 - DNA, 22 bp, Homo sapiens
taccaggtctgtgcaggtgtca

SEQ ID NO: 7897953 - DNA, 22 bp, Homo sapiens
taccagtaatagtatgtgagat

SEQ ID NO: 7897954 - DNA, 22 bp, Homo sapiens
taccagggaacagggatattaa

SEQ ID NO: 7897955 - DNA, 22 bp, Homo sapiens
taccagggaacagggatattaa

SEQ ID NO: 7897956 - DNA, 22 bp, Homo sapiens
taccataacgtaatgaacttga

SEQ ID NO: 7897957 - DNA, 19 bp, Homo sapiens
taccatccaagctggtttg

SEQ ID NO: 7897958 - DNA, 20 bp, Homo sapiens
taccatcatatgcatttaat

SEQ ID NO: 7897959 - DNA, 22 bp, Homo sapiens
taccagttgatgttttaaatag

SEQ ID NO: 7897960 - DNA, 19 bp, Homo sapiens
taccatgaccctctttccc

SEQ ID NO: 7897961 - DNA, 22 bp, Homo sapiens
taccatgatcaggctcatcctt

SEQ ID NO: 7897962 - DNA, 19 bp, Homo sapiens
taccatccaagctggtttg

SEQ ID NO: 7897963 - DNA, 20 bp, Homo sapiens
taccacttatttgaataatt

SEQ ID NO: 7897964 - DNA, 22 bp, Homo sapiens
taccacaggccaaatttgaggt

SEQ ID NO: 7897965 - DNA, 22 bp, Homo sapiens
taccagcaactggaagtcagat

SEQ ID NO: 7897966 - DNA, 22 bp, Homo sapiens
taccagcaatgtatgagtgttt

SEQ ID NO: 7897967 - DNA, 22 bp, Homo sapiens
taccagcaatgctagtcaactc

SEQ ID NO: 7897968 - DNA, 22 bp, Homo sapiens
taccagcaactggaagtcagat

SEQ ID NO: 7897969 - DNA, 22 bp, Homo sapiens
taccacctccatcctcctttca

SEQ ID NO: 7897970 - DNA, 22 bp, Homo sapiens
taccacctccatcctcctttca

SEQ ID NO: 7897971 - DNA, 22 bp, Homo sapiens
taccactggcaggccactacta

SEQ ID NO: 7897972 - DNA, 22 bp, Homo sapiens
taccactgataccttggagttc

SEQ ID NO: 7897973 - DNA, 22 bp, Homo sapiens
taccactgctccctgcctgtga

SEQ ID NO: 7897974 - DNA, 22 bp, Homo sapiens
taccacctcaacctcatctgac

SEQ ID NO: 7897975 - DNA, 22 bp, Homo sapiens
taccacagtctgccattagatg

SEQ ID NO: 7897976 - DNA, 22 bp, Homo sapiens
taccacagtttatctattcagc

SEQ ID NO: 7897977 - DNA, 22 bp, Homo sapiens
taccaggaattattttacattt

SEQ ID NO: 7897978 - DNA, 22 bp, Homo sapiens
taccaggagttacaggcagcag

SEQ ID NO: 7897979 - DNA, 22 bp, Homo sapiens
taccaggagttacaggcagcag

SEQ ID NO: 7897980 - DNA, 22 bp, Homo sapiens
taccaggaatggggtcaccgtc

SEQ ID NO: 7897981 - DNA, 22 bp, Homo sapiens
taccagcttccttcaagatgtg

SEQ ID NO: 7897982 - DNA, 22 bp, Homo sapiens
taccagcaatgtatgagtgttt

SEQ ID NO: 7897983 - DNA, 22 bp, Homo sapiens
taccagcatcacagcatgttgg

SEQ ID NO: 7897984 - DNA, 22 bp, Homo sapiens
taccagcctgaccctgtctgac

SEQ ID NO: 7897985 - DNA, 22 bp, Homo sapiens
tatcacatagtgtttagtaaat

SEQ ID NO: 7897986 - DNA, 22 bp, Homo sapiens
tatcacatagtgtttagtaaat

SEQ ID NO: 7897987 - DNA, 22 bp, Homo sapiens
tatcacaggtgtgatttacatt

SEQ ID NO: 7897988 - DNA, 21 bp, Homo sapiens
tatcacagtagaataggatct

SEQ ID NO: 7897989 - DNA, 21 bp, Homo sapiens
tatcacagtagaataggatct

SEQ ID NO: 7897990 - DNA, 22 bp, Homo sapiens
tatcacatcaatgttttaaaat

SEQ ID NO: 7897991 - DNA, 22 bp, Homo sapiens
tatcacatcaatgttttaaaat

SEQ ID NO: 7897992 - DNA, 22 bp, Homo sapiens
tatcacatttggagatttatga

SEQ ID NO: 7897993 - DNA, 22 bp, Homo sapiens
tatcaccagagggatagtctct

SEQ ID NO: 7897994 - DNA, 22 bp, Homo sapiens
tatcactacacctggctaatta

SEQ ID NO: 7897995 - DNA, 22 bp, Homo sapiens
tatcagaaatcaacacacagtg

SEQ ID NO: 7897996 - DNA, 22 bp, Homo sapiens
tatcagaaatgccttaaattgg

SEQ ID NO: 7897997 - DNA, 22 bp, Homo sapiens
tatcagaaatgccttaaattgg

SEQ ID NO: 7897998 - DNA, 22 bp, Homo sapiens
tatcagaagacttacagtatcg

SEQ ID NO: 7897999 - DNA, 22 bp, Homo sapiens
tatcactgacctgtatcagttg

SEQ ID NO: 7898000 - DNA, 22 bp, Homo sapiens
tatcagaaactctggggcaggg

SEQ ID NO: 7898001 - DNA, 22 bp, Homo sapiens
tatcagaaactctggggcaggg

SEQ ID NO: 7898002 - DNA, 22 bp, Homo sapiens
tatcatttaacagaatcattgc

SEQ ID NO: 7898003 - DNA, 22 bp, Homo sapiens
tatcatttaacagaatcattgc

SEQ ID NO: 7898004 - DNA, 22 bp, Homo sapiens
tatcagatttagaggagtcata

SEQ ID NO: 7898005 - DNA, 22 bp, Homo sapiens
tatcagcgtgcaaatctttgga

SEQ ID NO: 7898006 - DNA, 22 bp, Homo sapiens
tatcagcatctcctcaaagata

SEQ ID NO: 7898007 - DNA, 22 bp, Homo sapiens
tatcagcatatttactttcttg

SEQ ID NO: 7898008 - DNA, 22 bp, Homo sapiens
tatcagcaactcagagcagtct

SEQ ID NO: 7898009 - DNA, 22 bp, Homo sapiens
tatcagcaactcagagcagtct

SEQ ID NO: 7898010 - DNA, 22 bp, Homo sapiens
tatcagcaactcagagcagtct

SEQ ID NO: 7898011 - DNA, 22 bp, Homo sapiens
tatcagcaccgcggacagcatc

SEQ ID NO: 7898012 - DNA, 22 bp, Homo sapiens
tatcagatggtgatacatatca

SEQ ID NO: 7898013 - DNA, 22 bp, Homo sapiens
tatcagatgacatcttctatgg

SEQ ID NO: 7898014 - DNA, 22 bp, Homo sapiens
tatcagaagacttacagtatcg

SEQ ID NO: 7898015 - DNA, 22 bp, Homo sapiens
tatcagaaggcacatggagtct

SEQ ID NO: 7898016 - DNA, 22 bp, Homo sapiens
tatcagatatagcattcactgg

SEQ ID NO: 7898017 - DNA, 22 bp, Homo sapiens
tatcagatatagcattcactgg

SEQ ID NO: 7898018 - DNA, 22 bp, Homo sapiens
tatcagatatagcattcactgg

SEQ ID NO: 7898019 - DNA, 22 bp, Homo sapiens
tatcagaatgcagccatgtgca

SEQ ID NO: 7898020 - DNA, 22 bp, Homo sapiens
tatcagaaggcacatggagtct

SEQ ID NO: 7898021 - DNA, 18 bp, Homo sapiens
tataaacacacttaggtt

SEQ ID NO: 7898022 - DNA, 22 bp, Homo sapiens
tataaactcctcttgcattcct

SEQ ID NO: 7898023 - DNA, 22 bp, Homo sapiens
tataaactcctcttgcattcct

SEQ ID NO: 7898024 - DNA, 22 bp, Homo sapiens
tataaactcctcttgcattcct

SEQ ID NO: 7898025 - DNA, 22 bp, Homo sapiens
tataaagaaatgatttccagaa

SEQ ID NO: 7898026 - DNA, 22 bp, Homo sapiens
tataaagaaatgatttccagaa

SEQ ID NO: 7898027 - DNA, 22 bp, Homo sapiens
tataaactatatgttagccaga

SEQ ID NO: 7898028 - DNA, 22 bp, Homo sapiens
tataaagaaggcacagcaagac

SEQ ID NO: 7898029 - DNA, 22 bp, Homo sapiens
tataaagaaatgatttccagaa

SEQ ID NO: 7898030 - DNA, 22 bp, Homo sapiens
tataaacttaatggttccgaat

SEQ ID NO: 7898031 - DNA, 22 bp, Homo sapiens
tataaactttaaccaggatgtc

SEQ ID NO: 7898032 - DNA, 22 bp, Homo sapiens
tataaaacagaaagcactacct

SEQ ID NO: 7898033 - DNA, 22 bp, Homo sapiens
tataaaacagaaagcactacct

SEQ ID NO: 7898034 - DNA, 22 bp, Homo sapiens
tagttttttcaacaaatggtgc

SEQ ID NO: 7898035 - DNA, 22 bp, Homo sapiens
tataaaacagaaagcactacct

SEQ ID NO: 7898036 - DNA, 22 bp, Homo sapiens
tataaaatggcatcagctccaa

SEQ ID NO: 7898037 - DNA, 22 bp, Homo sapiens
tataaaatggcatcagctccaa

SEQ ID NO: 7898038 - DNA, 22 bp, Homo sapiens
tataaaatggcatcagctccaa

SEQ ID NO: 7898039 - DNA, 22 bp, Homo sapiens
tataaaatggcatcagctccaa

SEQ ID NO: 7898040 - DNA, 22 bp, Homo sapiens
tataaaatggcatcagctccaa

SEQ ID NO: 7898041 - DNA, 22 bp, Homo sapiens
tataaaattctcagtttggggt

SEQ ID NO: 7898042 - DNA, 22 bp, Homo sapiens
tataaaattctcagtttggggt

SEQ ID NO: 7898043 - DNA, 22 bp, Homo sapiens
tataaagtgtgaactgtgagta

SEQ ID NO: 7898044 - DNA, 22 bp, Homo sapiens
tatcacaggtgtgatttacatt

SEQ ID NO: 7898045 - DNA, 22 bp, Homo sapiens
tataaagtttcgaaagatgtat

SEQ ID NO: 7898046 - DNA, 22 bp, Homo sapiens
tataaagagtctcaaagaagtt

SEQ ID NO: 7898047 - DNA, 22 bp, Homo sapiens
tataaagagtctcaaagaagtt

SEQ ID NO: 7898048 - DNA, 22 bp, Homo sapiens
tataaagagtctcaaagaagtt

SEQ ID NO: 7898049 - DNA, 22 bp, Homo sapiens
tataaagctgactcatgaaact

SEQ ID NO: 7898050 - DNA, 22 bp, Homo sapiens
tataaagtgtgaactgtgagta

SEQ ID NO: 7898051 - DNA, 22 bp, Homo sapiens
tataaagctgactcatgaaact

SEQ ID NO: 7898052 - DNA, 22 bp, Homo sapiens
tataaagaaggcacagcaagac

SEQ ID NO: 7898053 - DNA, 22 bp, Homo sapiens
tataaagaaggcacagcaagac

SEQ ID NO: 7898054 - DNA, 22 bp, Homo sapiens
tataaagaagtgtaaacaggaa

SEQ ID NO: 7898055 - DNA, 22 bp, Homo sapiens
tataaagaagtgtaaacaggaa

SEQ ID NO: 7898056 - DNA, 22 bp, Homo sapiens
tataaagaagtgtaaacaggaa

SEQ ID NO: 7898057 - DNA, 22 bp, Homo sapiens
tataaagaatccagaagagaca

SEQ ID NO: 7898058 - DNA, 22 bp, Homo sapiens
tataaagagtctcaaagaagtt

SEQ ID NO: 7898059 - DNA, 22 bp, Homo sapiens
tataaagagtctatctggtggc

SEQ ID NO: 7898060 - DNA, 22 bp, Homo sapiens
tatgaattctgttcattgatga

SEQ ID NO: 7898061 - DNA, 22 bp, Homo sapiens
tatgaattctcttgtgtatagt

SEQ ID NO: 7898062 - DNA, 22 bp, Homo sapiens
tatgaattctcttgtgtatagt

SEQ ID NO: 7898063 - DNA, 20 bp, Homo sapiens
tatgaattctggtccctggg

SEQ ID NO: 7898064 - DNA, 22 bp, Homo sapiens
tatgaatataccacaatttagg

SEQ ID NO: 7898065 - DNA, 22 bp, Homo sapiens
tatgaattctcttgtgtatagt

SEQ ID NO: 7898066 - DNA, 22 bp, Homo sapiens
tatgaattctgttcattgatga

SEQ ID NO: 7898067 - DNA, 22 bp, Homo sapiens
tatgacaaggtggagtatgagt

SEQ ID NO: 7898068 - DNA, 22 bp, Homo sapiens
tatgacaaggtggagtatgagt

SEQ ID NO: 7898069 - DNA, 20 bp, Homo sapiens
tatgacaacgcagcaaggca

SEQ ID NO: 7898070 - DNA, 22 bp, Homo sapiens
tatgaagattgcggtctggaat

SEQ ID NO: 7898071 - DNA, 22 bp, Homo sapiens
tatgaatataccacaatttagg

SEQ ID NO: 7898072 - DNA, 22 bp, Homo sapiens
tatgaatataccacaatttagg

SEQ ID NO: 7898073 - DNA, 22 bp, Homo sapiens
tatgaatgctccagtaactttc

SEQ ID NO: 7898074 - DNA, 22 bp, Homo sapiens
tatgaatataccacaatttagg

SEQ ID NO: 7898075 - DNA, 22 bp, Homo sapiens
tatgaacacactttggaagtga

SEQ ID NO: 7898076 - DNA, 20 bp, Homo sapiens
tatgaagatatgtgaacagc

SEQ ID NO: 7898077 - DNA, 20 bp, Homo sapiens
tatgaagatatgtgaacagc

SEQ ID NO: 7898078 - DNA, 22 bp, Homo sapiens
tatgaagattgcggtctggaat

SEQ ID NO: 7898079 - DNA, 20 bp, Homo sapiens
tatgaagatatgtgaacagc

SEQ ID NO: 7898080 - DNA, 22 bp, Homo sapiens
tatgaaatttctagttctgctt

SEQ ID NO: 7898081 - DNA, 22 bp, Homo sapiens
tatgaaatttctagttctgctt

SEQ ID NO: 7898082 - DNA, 22 bp, Homo sapiens
tatgaacacactttggaagtga

SEQ ID NO: 7898083 - DNA, 22 bp, Homo sapiens
tatgaacacactttggaagtga

SEQ ID NO: 7898084 - DNA, 22 bp, Homo sapiens
tatgaaatttctagttctgctt

SEQ ID NO: 7898085 - DNA, 22 bp, Homo sapiens
tatgaaatttaaacacagatca

SEQ ID NO: 7898086 - DNA, 22 bp, Homo sapiens
tatgaaatttaaacacagatca

SEQ ID NO: 7898087 - DNA, 22 bp, Homo sapiens
tatgaaatttaaacacagatca

SEQ ID NO: 7898088 - DNA, 22 bp, Homo sapiens
tatgaaatttaaacacagatca

SEQ ID NO: 7898089 - DNA, 22 bp, Homo sapiens
tatgaaatttaaacacagatca

SEQ ID NO: 7898090 - DNA, 22 bp, Homo sapiens
tatgaaatttaaacacagatca

SEQ ID NO: 7898091 - DNA, 22 bp, Homo sapiens
tatgaaatggtagtaggaaggg

SEQ ID NO: 7898092 - DNA, 22 bp, Homo sapiens
tatgaaatggtagtaggaaggg

SEQ ID NO: 7898093 - DNA, 22 bp, Homo sapiens
tatgaaatggtagtaggaaggg

SEQ ID NO: 7898094 - DNA, 22 bp, Homo sapiens
tatgaaattgccatttttatgg

SEQ ID NO: 7898095 - DNA, 22 bp, Homo sapiens
tatgaaattgccatttttatgg

SEQ ID NO: 7898096 - DNA, 22 bp, Homo sapiens
tatgaaattgccatttttatgg

SEQ ID NO: 7898097 - DNA, 22 bp, Homo sapiens
tatgaaattgccatttttatgg

SEQ ID NO: 7898098 - DNA, 22 bp, Homo sapiens
tatgaaattgccatttttatgg

SEQ ID NO: 7898099 - DNA, 22 bp, Homo sapiens
tatgaaatgatggggaaaatag

SEQ ID NO: 7898100 - DNA, 22 bp, Homo sapiens
tatgaaatgatggggaaaatag

SEQ ID NO: 7898101 - DNA, 22 bp, Homo sapiens
tatgaaatgatggggaaaatag

SEQ ID NO: 7898102 - DNA, 22 bp, Homo sapiens
tatccaaacatatagtctctct

SEQ ID NO: 7898103 - DNA, 22 bp, Homo sapiens
tatcattttactgtgacatttt

SEQ ID NO: 7898104 - DNA, 22 bp, Homo sapiens
tatcattttactgtgacatttt

SEQ ID NO: 7898105 - DNA, 22 bp, Homo sapiens
tatcattttactgtgacatttt

SEQ ID NO: 7898106 - DNA, 22 bp, Homo sapiens
tatcattttactgtgacatttt

SEQ ID NO: 7898107 - DNA, 22 bp, Homo sapiens
tatcattttactgtgacatttt

SEQ ID NO: 7898108 - DNA, 22 bp, Homo sapiens
tatcattttactgtgacatttt

SEQ ID NO: 7898109 - DNA, 22 bp, Homo sapiens
tatcatttgttattattagtgg

SEQ ID NO: 7898110 - DNA, 22 bp, Homo sapiens
tatcatttgttattattagtgg

SEQ ID NO: 7898111 - DNA, 22 bp, Homo sapiens
tatcatttgttattattagtgg

SEQ ID NO: 7898112 - DNA, 23 bp, Homo sapiens
tatcatttcagctctctgcctgg

SEQ ID NO: 7898113 - DNA, 23 bp, Homo sapiens
tatcatttcagctctctgcctgg

SEQ ID NO: 7898114 - DNA, 22 bp, Homo sapiens
tatcatttagagtatttcttca

SEQ ID NO: 7898115 - DNA, 23 bp, Homo sapiens
tatcatttcagctctctgcctgg

SEQ ID NO: 7898116 - DNA, 22 bp, Homo sapiens
tatcatttagagtatttcttca

SEQ ID NO: 7898117 - DNA, 22 bp, Homo sapiens
tatcatttagagtatttcttca

SEQ ID NO: 7898118 - DNA, 22 bp, Homo sapiens
tatgaaaatttagctgaagcat

SEQ ID NO: 7898119 - DNA, 22 bp, Homo sapiens
tatgaaaatttagctgaagcat

SEQ ID NO: 7898120 - DNA, 22 bp, Homo sapiens
tatgaaacattcatacaaataa

SEQ ID NO: 7898121 - DNA, 22 bp, Homo sapiens
tatgaaacattcatacaaataa

SEQ ID NO: 7898122 - DNA, 22 bp, Homo sapiens
tatgaaaatttagctgaagcat

SEQ ID NO: 7898123 - DNA, 22 bp, Homo sapiens
tatgaaaatttagctgaagcat

SEQ ID NO: 7898124 - DNA, 22 bp, Homo sapiens
tatgaaaaggtggccaatgtag

SEQ ID NO: 7898125 - DNA, 22 bp, Homo sapiens
tatcttttgagttctcaagatg

SEQ ID NO: 7898126 - DNA, 22 bp, Homo sapiens
tatcttttgagttctcaagatg

SEQ ID NO: 7898127 - DNA, 18 bp, Homo sapiens
tatcttttccagtggtat

SEQ ID NO: 7898128 - DNA, 18 bp, Homo sapiens
tatcttttccagtggtat

SEQ ID NO: 7898129 - DNA, 18 bp, Homo sapiens
tatcttttccagtggtat

SEQ ID NO: 7898130 - DNA, 18 bp, Homo sapiens
tatcttttccagtggtat

SEQ ID NO: 7898131 - DNA, 22 bp, Homo sapiens
tatctttgtgtcccttttgatg

SEQ ID NO: 7898132 - DNA, 22 bp, Homo sapiens
tatctttgtgtcccttttgatg

SEQ ID NO: 7898133 - DNA, 22 bp, Homo sapiens
tatcttttgagttctcaagatg

SEQ ID NO: 7898134 - DNA, 23 bp, Homo sapiens
tatctttttcaatgttggaaata

SEQ ID NO: 7898135 - DNA, 23 bp, Homo sapiens
tatctttttcaatgttggaaata

SEQ ID NO: 7898136 - DNA, 22 bp, Homo sapiens
tatgaaaaggtggccaatgtag

SEQ ID NO: 7898137 - DNA, 23 bp, Homo sapiens
tatctttttcaatgttggaaata

SEQ ID NO: 7898138 - DNA, 22 bp, Homo sapiens
tatgtactcatcaactattgaa

SEQ ID NO: 7898139 - DNA, 22 bp, Homo sapiens
tatgtactctaatttgtctcat

SEQ ID NO: 7898140 - DNA, 22 bp, Homo sapiens
tatgtactctaatttgtctcat

SEQ ID NO: 7898141 - DNA, 22 bp, Homo sapiens
tatgtagaaaacaaaagttgaa

SEQ ID NO: 7898142 - DNA, 22 bp, Homo sapiens
tatgtactttcctgggaatgtt

SEQ ID NO: 7898143 - DNA, 22 bp, Homo sapiens
tatgtagacaggctgcttttcc

SEQ ID NO: 7898144 - DNA, 22 bp, Homo sapiens
tatgtacatatacacgtgtgtg

SEQ ID NO: 7898145 - DNA, 22 bp, Homo sapiens
tatgtacatacatgtgcatacg

SEQ ID NO: 7898146 - DNA, 22 bp, Homo sapiens
tatgtacatacatgtgcatacg

SEQ ID NO: 7898147 - DNA, 22 bp, Homo sapiens
tatgtacatatacacgtgtgtg

SEQ ID NO: 7898148 - DNA, 22 bp, Homo sapiens
tatgtacatatacacgtgtgtg

SEQ ID NO: 7898149 - DNA, 22 bp, Homo sapiens
tatgtacaagcacacatgtgac

SEQ ID NO: 7898150 - DNA, 22 bp, Homo sapiens
tatgtacatacatgtgcatacg

SEQ ID NO: 7898151 - DNA, 22 bp, Homo sapiens
tatgtacatacatgtgcatacg

SEQ ID NO: 7898152 - DNA, 22 bp, Homo sapiens
tatgtacaagcacacatgtgac

SEQ ID NO: 7898153 - DNA, 22 bp, Homo sapiens
tatgtacaagcacacatgtgac

SEQ ID NO: 7898154 - DNA, 22 bp, Homo sapiens
tatggtcatggttgcacaattt

SEQ ID NO: 7898155 - DNA, 22 bp, Homo sapiens
tatgtaaaaattcatcaggctg

SEQ ID NO: 7898156 - DNA, 22 bp, Homo sapiens
tatggtcatttgttagtgcttt

SEQ ID NO: 7898157 - DNA, 22 bp, Homo sapiens
tatgtaaagtagatggcaggta

SEQ ID NO: 7898158 - DNA, 22 bp, Homo sapiens
tatgtaaagtagatggcaggta

SEQ ID NO: 7898159 - DNA, 22 bp, Homo sapiens
tatgtaaaaattcatcaggctg

SEQ ID NO: 7898160 - DNA, 22 bp, Homo sapiens
tatgggctgggtatgagctggt

SEQ ID NO: 7898161 - DNA, 22 bp, Homo sapiens
tatggctttttattcatcttac

SEQ ID NO: 7898162 - DNA, 22 bp, Homo sapiens
tatgggctgggtatgagctggt

SEQ ID NO: 7898163 - DNA, 22 bp, Homo sapiens
tatggtagaaaaactgagtccc

SEQ ID NO: 7898164 - DNA, 21 bp, Homo sapiens
tatggtaaccagacaagaatg

SEQ ID NO: 7898165 - DNA, 22 bp, Homo sapiens
tatggtaataatatgaaggtct

SEQ ID NO: 7898166 - DNA, 22 bp, Homo sapiens
tatggtaaatgagcatatgttc

SEQ ID NO: 7898167 - DNA, 21 bp, Homo sapiens
tatggtaaccagacaagaatg

SEQ ID NO: 7898168 - DNA, 22 bp, Homo sapiens
tatggacatgagtcaaggtgct

SEQ ID NO: 7898169 - DNA, 22 bp, Homo sapiens
tatggcttgagtttcagactat

SEQ ID NO: 7898170 - DNA, 22 bp, Homo sapiens
tatggaaataattagacaagtg

SEQ ID NO: 7898171 - DNA, 22 bp, Homo sapiens
tatggaaataattagacaagtg

SEQ ID NO: 7898172 - DNA, 22 bp, Homo sapiens
tatggaaataattagacaagtg

SEQ ID NO: 7898173 - DNA, 22 bp, Homo sapiens
tatggaaataattagacaagtg

SEQ ID NO: 7898174 - DNA, 22 bp, Homo sapiens
tatggacatctgaagttgcaga

SEQ ID NO: 7898175 - DNA, 22 bp, Homo sapiens
tatggaatggctattttctagg

SEQ ID NO: 7898176 - DNA, 22 bp, Homo sapiens
tatggaacgctagaggaagaaa

SEQ ID NO: 7898177 - DNA, 22 bp, Homo sapiens
tatggaactgggtgaaggcacg

SEQ ID NO: 7898178 - DNA, 22 bp, Homo sapiens
tatggaatggctattttctagg

SEQ ID NO: 7898179 - DNA, 22 bp, Homo sapiens
tatggaaaaatgtatcttgtca

SEQ ID NO: 7898180 - DNA, 20 bp, Homo sapiens
tatgctttttataagattga

SEQ ID NO: 7898181 - DNA, 22 bp, Homo sapiens
tatggaaaaatgtatcttgtca

SEQ ID NO: 7898182 - DNA, 22 bp, Homo sapiens
tatggaaaaatgtatcttgtca

SEQ ID NO: 7898183 - DNA, 22 bp, Homo sapiens
tatggaaactaattcatttttc

SEQ ID NO: 7898184 - DNA, 22 bp, Homo sapiens
tatggaaactaattcatttttc

SEQ ID NO: 7898185 - DNA, 22 bp, Homo sapiens
tatggaaagtgttttcttctgt

SEQ ID NO: 7898186 - DNA, 22 bp, Homo sapiens
tatggaaagtgttttcttctgt

SEQ ID NO: 7898187 - DNA, 22 bp, Homo sapiens
tatggaaagctctttttgattg

SEQ ID NO: 7898188 - DNA, 22 bp, Homo sapiens
tatggaaagctctttttgattg

SEQ ID NO: 7898189 - DNA, 22 bp, Homo sapiens
tatggaaagctctttttgattg

SEQ ID NO: 7898190 - DNA, 22 bp, Homo sapiens
tatggaaactaattcatttttc

SEQ ID NO: 7898191 - DNA, 22 bp, Homo sapiens
tatggaaagctctttttgattg

SEQ ID NO: 7898192 - DNA, 22 bp, Homo sapiens
tatgctttgaaaatgtgctgaa

SEQ ID NO: 7898193 - DNA, 22 bp, Homo sapiens
tatgctttgaaaatgtgctgaa

SEQ ID NO: 7898194 - DNA, 22 bp, Homo sapiens
tatgctttcattcatatgtgag

SEQ ID NO: 7898195 - DNA, 22 bp, Homo sapiens
tatgctttcattcatatgtgag

SEQ ID NO: 7898196 - DNA, 22 bp, Homo sapiens
tatgctttacttttcattgtga

SEQ ID NO: 7898197 - DNA, 22 bp, Homo sapiens
tatgctttacttttcattgtga

SEQ ID NO: 7898198 - DNA, 22 bp, Homo sapiens
tatgctttacttttcattgtga

SEQ ID NO: 7898199 - DNA, 22 bp, Homo sapiens
tatgctttaaccctcttatatt

SEQ ID NO: 7898200 - DNA, 22 bp, Homo sapiens
tatgctttaaccctcttatatt

SEQ ID NO: 7898201 - DNA, 22 bp, Homo sapiens
tatgctttaaccctcttatatt

SEQ ID NO: 7898202 - DNA, 22 bp, Homo sapiens
tatgctttaaccctcttatatt

SEQ ID NO: 7898203 - DNA, 22 bp, Homo sapiens
tatgctttaaccctcttatatt

SEQ ID NO: 7898204 - DNA, 22 bp, Homo sapiens
tatgctttaaccctcttatatt

SEQ ID NO: 7898205 - DNA, 22 bp, Homo sapiens
tatgctttaacattaaacaaca

SEQ ID NO: 7898206 - DNA, 19 bp, Homo sapiens
tatgacaagtactagttct

SEQ ID NO: 7898207 - DNA, 22 bp, Homo sapiens
tatgctttgcaattggaaaagg

SEQ ID NO: 7898208 - DNA, 22 bp, Homo sapiens
tatgctttggtagagagttgtg

SEQ ID NO: 7898209 - DNA, 22 bp, Homo sapiens
tatgctttggtagagagttgtg

SEQ ID NO: 7898210 - DNA, 22 bp, Homo sapiens
tatgctttgcaattggaaaagg

SEQ ID NO: 7898211 - DNA, 22 bp, Homo sapiens
tatgctttgcaattggaaaagg

SEQ ID NO: 7898212 - DNA, 22 bp, Homo sapiens
tatgctttgcaattggaaaagg

SEQ ID NO: 7898213 - DNA, 22 bp, Homo sapiens
tatgctttgatttcctcagctg

SEQ ID NO: 7898214 - DNA, 22 bp, Homo sapiens
tatgctttgatttcctcagctg

SEQ ID NO: 7898215 - DNA, 22 bp, Homo sapiens
tatgcttttaacctgtaactga

SEQ ID NO: 7898216 - DNA, 22 bp, Homo sapiens
tatgcttttaacctgtaactga

SEQ ID NO: 7898217 - DNA, 17 bp, Homo sapiens
tatgcttttcttctcca

SEQ ID NO: 7898218 - DNA, 17 bp, Homo sapiens
tatgcttttcttctcca

SEQ ID NO: 7898219 - DNA, 17 bp, Homo sapiens
tatgcttttcttctcca

SEQ ID NO: 7898220 - DNA, 22 bp, Homo sapiens
tatgcttttctcttggaatgtg

SEQ ID NO: 7898221 - DNA, 20 bp, Homo sapiens
tatgctttttataagattga

SEQ ID NO: 7898222 - DNA, 17 bp, Homo sapiens
tatgcttttcttctcca

SEQ ID NO: 7898223 - DNA, 22 bp, Homo sapiens
tattaaattatggatttaggag

SEQ ID NO: 7898224 - DNA, 22 bp, Homo sapiens
tattaaattatggatttaggag

SEQ ID NO: 7898225 - DNA, 22 bp, Homo sapiens
tatgtttggcctggcaatttca

SEQ ID NO: 7898226 - DNA, 22 bp, Homo sapiens
tattaacacgtataaagtgttt

SEQ ID NO: 7898227 - DNA, 22 bp, Homo sapiens
tattaacatgaactgacttttc

SEQ ID NO: 7898228 - DNA, 22 bp, Homo sapiens
tattaacacgtataaagtgttt

SEQ ID NO: 7898229 - DNA, 22 bp, Homo sapiens
tattaaattatggatttaggag

SEQ ID NO: 7898230 - DNA, 22 bp, Homo sapiens
tatgtcctaggcatttctctta

SEQ ID NO: 7898231 - DNA, 22 bp, Homo sapiens
tatgtttcatcaggcatggagt

SEQ ID NO: 7898232 - DNA, 22 bp, Homo sapiens
tatgtttcattcttttctggta

SEQ ID NO: 7898233 - DNA, 22 bp, Homo sapiens
tatgtttctgggcttgatattt

SEQ ID NO: 7898234 - DNA, 22 bp, Homo sapiens
tatgtcatgtcttagagaatga

SEQ ID NO: 7898235 - DNA, 22 bp, Homo sapiens
tatgtcatgggtcaaaatgaag

SEQ ID NO: 7898236 - DNA, 22 bp, Homo sapiens
tatgtcaactgtgctggttaat

SEQ ID NO: 7898237 - DNA, 22 bp, Homo sapiens
tatgtcaactgtgctggttaat

SEQ ID NO: 7898238 - DNA, 22 bp, Homo sapiens
tatgtcaaagttaagaaatagg

SEQ ID NO: 7898239 - DNA, 22 bp, Homo sapiens
tattaagagatgtatgaagaga

SEQ ID NO: 7898240 - DNA, 22 bp, Homo sapiens
tattaacatgaactgacttttc

SEQ ID NO: 7898241 - DNA, 22 bp, Homo sapiens
tattaacatgaactgacttttc

SEQ ID NO: 7898242 - DNA, 22 bp, Homo sapiens
tattaacatgaactgacttttc

SEQ ID NO: 7898243 - DNA, 22 bp, Homo sapiens
tattaacacgtataaagtgttt

SEQ ID NO: 7898244 - DNA, 22 bp, Homo sapiens
tattaacatgaactgacttttc

SEQ ID NO: 7898245 - DNA, 22 bp, Homo sapiens
tattaacattttatgaaaataa

SEQ ID NO: 7898246 - DNA, 22 bp, Homo sapiens
tattaataaatatgtaggggcc

SEQ ID NO: 7898247 - DNA, 22 bp, Homo sapiens
tattaataaatatgtaggggcc

SEQ ID NO: 7898248 - DNA, 22 bp, Homo sapiens
tattaagtatcttgatgacaaa

SEQ ID NO: 7898249 - DNA, 22 bp, Homo sapiens
tattaagtatcttgatgacaaa

SEQ ID NO: 7898250 - DNA, 22 bp, Homo sapiens
tattaataaatatgtaggggcc

SEQ ID NO: 7898251 - DNA, 22 bp, Homo sapiens
tattaagatacgtagttgtaaa

SEQ ID NO: 7898252 - DNA, 22 bp, Homo sapiens
tattaagagatgtatgaagaga

SEQ ID NO: 7898253 - DNA, 22 bp, Homo sapiens
tattaatatgtgtgtgcatgta

SEQ ID NO: 7898254 - DNA, 21 bp, Homo sapiens
tattaatatgtctaagctgat

SEQ ID NO: 7898255 - DNA, 22 bp, Homo sapiens
tattaatatgtgtgtgcatgta

SEQ ID NO: 7898256 - DNA, 22 bp, Homo sapiens
tattaatatgtgtgtgcatgta

SEQ ID NO: 7898257 - DNA, 22 bp, Homo sapiens
tattaataagtgactactagct

SEQ ID NO: 7898258 - DNA, 22 bp, Homo sapiens
tattaataagtgactactagct

SEQ ID NO: 7898259 - DNA, 22 bp, Homo sapiens
tattaataagtgactactagct

SEQ ID NO: 7898260 - DNA, 22 bp, Homo sapiens
tattaataagtgactactagct

SEQ ID NO: 7898261 - DNA, 21 bp, Homo sapiens
tattaatatgtctaagctgat

SEQ ID NO: 7898262 - DNA, 21 bp, Homo sapiens
tattaatatgtctaagctgat

SEQ ID NO: 7898263 - DNA, 22 bp, Homo sapiens
tatgtatatatgttgggtagaa

SEQ ID NO: 7898264 - DNA, 22 bp, Homo sapiens
tatgtatatggtagaagtatgt

SEQ ID NO: 7898265 - DNA, 22 bp, Homo sapiens
tatgtatatgtgtgttgacaac

SEQ ID NO: 7898266 - DNA, 22 bp, Homo sapiens
tatgtatatgtatacacacaca

SEQ ID NO: 7898267 - DNA, 22 bp, Homo sapiens
tatgtatatgtgtgttgacaac

SEQ ID NO: 7898268 - DNA, 22 bp, Homo sapiens
tatgtatccgtgtgtgtacaga

SEQ ID NO: 7898269 - DNA, 22 bp, Homo sapiens
tatgtatctgttcatcagttaa

SEQ ID NO: 7898270 - DNA, 22 bp, Homo sapiens
tatgtattctgagtacaagttc

SEQ ID NO: 7898271 - DNA, 22 bp, Homo sapiens
tatgtcaaaaaagattatgttt

SEQ ID NO: 7898272 - DNA, 22 bp, Homo sapiens
tatgtattctgagtacaagttc

SEQ ID NO: 7898273 - DNA, 22 bp, Homo sapiens
tatgtattctgagtacaagttc

SEQ ID NO: 7898274 - DNA, 22 bp, Homo sapiens
tatgtattctgagtacaagttc

SEQ ID NO: 7898275 - DNA, 22 bp, Homo sapiens
tatgtattctgagtacaagttc

SEQ ID NO: 7898276 - DNA, 22 bp, Homo sapiens
tatgtagtcaagtggatatatg

SEQ ID NO: 7898277 - DNA, 22 bp, Homo sapiens
tatgtaggtaaacacagacata

SEQ ID NO: 7898278 - DNA, 22 bp, Homo sapiens
tatgtactacactagaacattt

SEQ ID NO: 7898279 - DNA, 21 bp, Homo sapiens
tatgtagactcgttagaatgc

SEQ ID NO: 7898280 - DNA, 22 bp, Homo sapiens
tatgtagacttcattgtttact

SEQ ID NO: 7898281 - DNA, 22 bp, Homo sapiens
tatgtagagataaaatccaaat

SEQ ID NO: 7898282 - DNA, 22 bp, Homo sapiens
tatgtagatggaattaactgat

SEQ ID NO: 7898283 - DNA, 22 bp, Homo sapiens
tatgtagatttctctgtttttc

SEQ ID NO: 7898284 - DNA, 22 bp, Homo sapiens
tatgtagatgtcatataaattg

SEQ ID NO: 7898285 - DNA, 22 bp, Homo sapiens
tatgtagatgtcatataaattg

SEQ ID NO: 7898286 - DNA, 22 bp, Homo sapiens
tatgtagcaatagcatcatact

SEQ ID NO: 7898287 - DNA, 18 bp, Homo sapiens
tatgtataacatagttca

SEQ ID NO: 7898288 - DNA, 22 bp, Homo sapiens
tatgtataaatgcatgtgtgga

SEQ ID NO: 7898289 - DNA, 22 bp, Homo sapiens
tatgtataaatgcatgtgtgga

SEQ ID NO: 7898290 - DNA, 18 bp, Homo sapiens
tatgtataacatagttca

SEQ ID NO: 7898291 - DNA, 18 bp, Homo sapiens
tatgtataacatagttca

SEQ ID NO: 7898292 - DNA, 22 bp, Homo sapiens
tatgtatagagtcttttaaatt

SEQ ID NO: 7898293 - DNA, 22 bp, Homo sapiens
tatgtatataggtgtgtgtctc

SEQ ID NO: 7898294 - DNA, 22 bp, Homo sapiens
tatgtatagagtcttttaaatt

SEQ ID NO: 7898295 - DNA, 22 bp, Homo sapiens
tatgtatagagtcttttaaatt

SEQ ID NO: 7898296 - DNA, 22 bp, Homo sapiens
tatgtataatcacagagtgtca

SEQ ID NO: 7898297 - DNA, 22 bp, Homo sapiens
tattgtccatggctgctttggt

SEQ ID NO: 7898298 - DNA, 22 bp, Homo sapiens
tattgtccaataggatgttcct

SEQ ID NO: 7898299 - DNA, 22 bp, Homo sapiens
tattgtccaataggatgttcct

SEQ ID NO: 7898300 - DNA, 22 bp, Homo sapiens
tattgtcagtgcctgcctcata

SEQ ID NO: 7898301 - DNA, 21 bp, Homo sapiens
tattgtcaatctgctttcaga

SEQ ID NO: 7898302 - DNA, 22 bp, Homo sapiens
tattgtctcacagttttggagg

SEQ ID NO: 7898303 - DNA, 22 bp, Homo sapiens
tattgtctgtttgaatgactat

SEQ ID NO: 7898304 - DNA, 22 bp, Homo sapiens
tattgtctgtccgggtcaaagc

SEQ ID NO: 7898305 - DNA, 22 bp, Homo sapiens
tattgtctgcaaaggtttataa

SEQ ID NO: 7898306 - DNA, 22 bp, Homo sapiens
tattgtatcttctgtttagaag

SEQ ID NO: 7898307 - DNA, 22 bp, Homo sapiens
tattgtatcttctgtttagaag

SEQ ID NO: 7898308 - DNA, 22 bp, Homo sapiens
tattgtattaaggattcaagta

SEQ ID NO: 7898309 - DNA, 22 bp, Homo sapiens
tattgtatcttaccacatgtat

SEQ ID NO: 7898310 - DNA, 22 bp, Homo sapiens
tattgtcaagaagtttatagtg

SEQ ID NO: 7898311 - DNA, 22 bp, Homo sapiens
tattgtattaaggattcaagta

SEQ ID NO: 7898312 - DNA, 22 bp, Homo sapiens
tattgtattaaggattcaagta

SEQ ID NO: 7898313 - DNA, 22 bp, Homo sapiens
tattgtattaaggattcaagta

SEQ ID NO: 7898314 - DNA, 22 bp, Homo sapiens
tattgtcacgtcttaattctag

SEQ ID NO: 7898315 - DNA, 22 bp, Homo sapiens
tattgtcaagaagtttatagtg

SEQ ID NO: 7898316 - DNA, 23 bp, Homo sapiens
tattacaattggtcttattaaga

SEQ ID NO: 7898317 - DNA, 23 bp, Homo sapiens
tattacaattggtcttattaaga

SEQ ID NO: 7898318 - DNA, 23 bp, Homo sapiens
tattacaattggtcttattaaga

SEQ ID NO: 7898319 - DNA, 23 bp, Homo sapiens
tattacaattggtcttattaaga

SEQ ID NO: 7898320 - DNA, 23 bp, Homo sapiens
tattacaattggtcttattaaga

SEQ ID NO: 7898321 - DNA, 22 bp, Homo sapiens
tattacaatttacattgcactt

SEQ ID NO: 7898322 - DNA, 22 bp, Homo sapiens
tattacaatttacattgcactt

SEQ ID NO: 7898323 - DNA, 23 bp, Homo sapiens
tattacaattggtcttattaaga

SEQ ID NO: 7898324 - DNA, 22 bp, Homo sapiens
tattacaatttacattgcactt

SEQ ID NO: 7898325 - DNA, 22 bp, Homo sapiens
tattacaagaaagggcatgaat

SEQ ID NO: 7898326 - DNA, 22 bp, Homo sapiens
tattacaagaaagggcatgaat

SEQ ID NO: 7898327 - DNA, 22 bp, Homo sapiens
tattacaagaaagggcatgaat

SEQ ID NO: 7898328 - DNA, 22 bp, Homo sapiens
tattacaagaaagggcatgaat

SEQ ID NO: 7898329 - DNA, 22 bp, Homo sapiens
tattacaagaaagggcatgaat

SEQ ID NO: 7898330 - DNA, 22 bp, Homo sapiens
tattacaagaaagggcatgaat

SEQ ID NO: 7898331 - DNA, 22 bp, Homo sapiens
tattacaaattataatgggaga

SEQ ID NO: 7898332 - DNA, 22 bp, Homo sapiens
tattacaagaaagggcatgaat

SEQ ID NO: 7898333 - DNA, 22 bp, Homo sapiens
tattacaaattataatgggaga

SEQ ID NO: 7898334 - DNA, 22 bp, Homo sapiens
tattacaaattataatgggaga

SEQ ID NO: 7898335 - DNA, 22 bp, Homo sapiens
tattacaaattataatgggaga

SEQ ID NO: 7898336 - DNA, 22 bp, Homo sapiens
tattacaaattataatgggaga

SEQ ID NO: 7898337 - DNA, 22 bp, Homo sapiens
tattacaaattataatgggaga

SEQ ID NO: 7898338 - DNA, 21 bp, Homo sapiens
tattaatttttcttcccacta

SEQ ID NO: 7898339 - DNA, 22 bp, Homo sapiens
tattaatttaatctccatggta

SEQ ID NO: 7898340 - DNA, 22 bp, Homo sapiens
tatttaataaaactatggcatg

SEQ ID NO: 7898341 - DNA, 22 bp, Homo sapiens
tatttaataaaactatggcatg

SEQ ID NO: 7898342 - DNA, 22 bp, Homo sapiens
tatttaataaaactatggcatg

SEQ ID NO: 7898343 - DNA, 22 bp, Homo sapiens
tatttaataaaactatggcatg

SEQ ID NO: 7898344 - DNA, 22 bp, Homo sapiens
tatttaactggaaacacaatga

SEQ ID NO: 7898345 - DNA, 22 bp, Homo sapiens
tatttaactggaaacacaatga

SEQ ID NO: 7898346 - DNA, 22 bp, Homo sapiens
tatttaagatgtgtcataaaga

SEQ ID NO: 7898347 - DNA, 22 bp, Homo sapiens
tatttaaccagttaaatttcca

SEQ ID NO: 7898348 - DNA, 22 bp, Homo sapiens
tatttaaccagttaaatttcca

SEQ ID NO: 7898349 - DNA, 22 bp, Homo sapiens
tatttaactggaaacacaatga

SEQ ID NO: 7898350 - DNA, 22 bp, Homo sapiens
tatttaactggaaacacaatga

SEQ ID NO: 7898351 - DNA, 22 bp, Homo sapiens
tatttaactggaaacacaatga

SEQ ID NO: 7898352 - DNA, 22 bp, Homo sapiens
tatttaactggaaacacaatga

SEQ ID NO: 7898353 - DNA, 22 bp, Homo sapiens
tatttaaaatagtgctccagca

SEQ ID NO: 7898354 - DNA, 22 bp, Homo sapiens
tatttaaaatagtgctccagca

SEQ ID NO: 7898355 - DNA, 22 bp, Homo sapiens
tatttaaaatagtgctccagca

SEQ ID NO: 7898356 - DNA, 22 bp, Homo sapiens
tatttaaaatagtgctccagca

SEQ ID NO: 7898357 - DNA, 22 bp, Homo sapiens
tatttaaccagttaaatttcca

SEQ ID NO: 7898358 - DNA, 22 bp, Homo sapiens
tatttaaaatagtgctccagca

SEQ ID NO: 7898359 - DNA, 22 bp, Homo sapiens
tatttaaaataagccccagtgg

SEQ ID NO: 7898360 - DNA, 22 bp, Homo sapiens
tatttaaaataagccccagtgg

SEQ ID NO: 7898361 - DNA, 22 bp, Homo sapiens
tatttaaaataagccccagtgg

SEQ ID NO: 7898362 - DNA, 22 bp, Homo sapiens
tatttaaaaagaggccagctgg

SEQ ID NO: 7898363 - DNA, 22 bp, Homo sapiens
tatttaaaaagaggccagctgg

SEQ ID NO: 7898364 - DNA, 22 bp, Homo sapiens
tatttaaaataagccccagtgg

SEQ ID NO: 7898365 - DNA, 22 bp, Homo sapiens
tattgtttctggctgtggcagc

SEQ ID NO: 7898366 - DNA, 22 bp, Homo sapiens
tattgttcttcactggtcttat

SEQ ID NO: 7898367 - DNA, 22 bp, Homo sapiens
tattgttcttcactggtcttat

SEQ ID NO: 7898368 - DNA, 22 bp, Homo sapiens
tattgtgttttctctgtgcgga

SEQ ID NO: 7898369 - DNA, 22 bp, Homo sapiens
tattgtgcccctcccaggaaca

SEQ ID NO: 7898370 - DNA, 22 bp, Homo sapiens
tattgtgtttgcaagtcctatt

SEQ ID NO: 7898371 - DNA, 22 bp, Homo sapiens
tatttaaaaagaggccagctgg

SEQ ID NO: 7898372 - DNA, 22 bp, Homo sapiens
tatttaaaaagaggccagctgg

SEQ ID NO: 7898373 - DNA, 22 bp, Homo sapiens
tatttaaaaagaggccagctgg

SEQ ID NO: 7898374 - DNA, 22 bp, Homo sapiens
tatttaaaaagaggccagctgg

SEQ ID NO: 7898375 - DNA, 22 bp, Homo sapiens
tatttaaaaagaggccagctgg

SEQ ID NO: 7898376 - DNA, 22 bp, Homo sapiens
tatttaaaaagaggccagctgg

SEQ ID NO: 7898377 - DNA, 22 bp, Homo sapiens
tatttaaaaagaggccagctgg

SEQ ID NO: 7898378 - DNA, 20 bp, Homo sapiens
tattgtgataggtgttaatc

SEQ ID NO: 7898379 - DNA, 22 bp, Homo sapiens
tattgtgagttcagactaaaaa

SEQ ID NO: 7898380 - DNA, 22 bp, Homo sapiens
tattgtgagtataactgcattt

SEQ ID NO: 7898381 - DNA, 22 bp, Homo sapiens
tattgtgaatttggaagcaatg

SEQ ID NO: 7898382 - DNA, 22 bp, Homo sapiens
tattgtgagggcaaagtttcta

SEQ ID NO: 7898383 - DNA, 22 bp, Homo sapiens
tatttgatagagataaatgata

SEQ ID NO: 7898384 - DNA, 22 bp, Homo sapiens
tatttgatagagataaatgata

SEQ ID NO: 7898385 - DNA, 22 bp, Homo sapiens
tatttgatagagataaatgata

SEQ ID NO: 7898386 - DNA, 22 bp, Homo sapiens
tatttgactcttaggaagactc

SEQ ID NO: 7898387 - DNA, 22 bp, Homo sapiens
tatttgaccgtgaggaatatga

SEQ ID NO: 7898388 - DNA, 22 bp, Homo sapiens
tatttgaccgtgaggaatatga

SEQ ID NO: 7898389 - DNA, 22 bp, Homo sapiens
tatttgacatggtggatttgct

SEQ ID NO: 7898390 - DNA, 22 bp, Homo sapiens
tatttgacactaggtgccctga

SEQ ID NO: 7898391 - DNA, 22 bp, Homo sapiens
tatttgacatggtggatttgct

SEQ ID NO: 7898392 - DNA, 22 bp, Homo sapiens
tatttgaagggagaaagtgcca

SEQ ID NO: 7898393 - DNA, 22 bp, Homo sapiens
tatttgaaggcatacattttga

SEQ ID NO: 7898394 - DNA, 22 bp, Homo sapiens
tatttgaaggcatacattttga

SEQ ID NO: 7898395 - DNA, 22 bp, Homo sapiens
tatttgaaggcatacattttga

SEQ ID NO: 7898396 - DNA, 22 bp, Homo sapiens
tatttcttgttattctcgttga

SEQ ID NO: 7898397 - DNA, 22 bp, Homo sapiens
tatttgaaggcatacattttga

SEQ ID NO: 7898398 - DNA, 22 bp, Homo sapiens
tatttgaaggcatacattttga

SEQ ID NO: 7898399 - DNA, 22 bp, Homo sapiens
tatttcttgttattctcgttga

SEQ ID NO: 7898400 - DNA, 22 bp, Homo sapiens
tatttcttgttattctcgttga

SEQ ID NO: 7898401 - DNA, 22 bp, Homo sapiens
tatttcttgttattctcgttga

SEQ ID NO: 7898402 - DNA, 22 bp, Homo sapiens
tatttcttgagtggtcagtttc

SEQ ID NO: 7898403 - DNA, 22 bp, Homo sapiens
tatttaattagtgattgtagag

SEQ ID NO: 7898404 - DNA, 22 bp, Homo sapiens
tatttgatggttctaaaacagc

SEQ ID NO: 7898405 - DNA, 22 bp, Homo sapiens
tatttgatgaaggtaaagtctt

SEQ ID NO: 7898406 - DNA, 22 bp, Homo sapiens
tatttgatgaaggtaaagtctt

SEQ ID NO: 7898407 - DNA, 22 bp, Homo sapiens
tatttgatagagataaatgata

SEQ ID NO: 7898408 - DNA, 22 bp, Homo sapiens
tatttgcaacataaaactctga

SEQ ID NO: 7898409 - DNA, 22 bp, Homo sapiens
tatttgcaacataaaactctga

SEQ ID NO: 7898410 - DNA, 22 bp, Homo sapiens
tatttgcaaagaactacactag

SEQ ID NO: 7898411 - DNA, 22 bp, Homo sapiens
tatttgatggttctaaaacagc

SEQ ID NO: 7898412 - DNA, 22 bp, Homo sapiens
tatttgcaaagaactacactag

SEQ ID NO: 7898413 - DNA, 23 bp, Homo sapiens
tatttgctactggtaattctgga

SEQ ID NO: 7898414 - DNA, 22 bp, Homo sapiens
tatttgcaggcttttgtcatgg

SEQ ID NO: 7898415 - DNA, 22 bp, Homo sapiens
tatttgcaggcttttgtcatgg

SEQ ID NO: 7898416 - DNA, 22 bp, Homo sapiens
tatttgcaggacatagatatgg

SEQ ID NO: 7898417 - DNA, 22 bp, Homo sapiens
tatttgcaggacatagatatgg

SEQ ID NO: 7898418 - DNA, 22 bp, Homo sapiens
tatttgcaggacatagatatgg

SEQ ID NO: 7898419 - DNA, 22 bp, Homo sapiens
tatttgcaggacatagatatgg

SEQ ID NO: 7898420 - DNA, 22 bp, Homo sapiens
tatttgcaggcttttgtcatgg

SEQ ID NO: 7898421 - DNA, 23 bp, Homo sapiens
tattttccaaatgatgactacat

SEQ ID NO: 7898422 - DNA, 23 bp, Homo sapiens
tattttcctggcaacaggggaac

SEQ ID NO: 7898423 - DNA, 23 bp, Homo sapiens
tattttccaaatgatgactacat

SEQ ID NO: 7898424 - DNA, 23 bp, Homo sapiens
tattttccaaatgatgactacat

SEQ ID NO: 7898425 - DNA, 22 bp, Homo sapiens
tattttctggacagtcttgctt

SEQ ID NO: 7898426 - DNA, 22 bp, Homo sapiens
tattttccttggtggacccagt

SEQ ID NO: 7898427 - DNA, 22 bp, Homo sapiens
tattttccttggtggacccagt

SEQ ID NO: 7898428 - DNA, 22 bp, Homo sapiens
tatttggacaccaagtagaagt

SEQ ID NO: 7898429 - DNA, 22 bp, Homo sapiens
tatttggacaccaagtagaagt

SEQ ID NO: 7898430 - DNA, 22 bp, Homo sapiens
tatttggagataagatttttag

SEQ ID NO: 7898431 - DNA, 22 bp, Homo sapiens
tatttggagcctatccatagat

SEQ ID NO: 7898432 - DNA, 22 bp, Homo sapiens
tattttcattctgtgtgactgt

SEQ ID NO: 7898433 - DNA, 22 bp, Homo sapiens
tattttgacgattttatgcaaa

SEQ ID NO: 7898434 - DNA, 22 bp, Homo sapiens
tattttgacgattttatgcaaa

SEQ ID NO: 7898435 - DNA, 22 bp, Homo sapiens
tattttgaaagtctgttttgaa

SEQ ID NO: 7898436 - DNA, 22 bp, Homo sapiens
tattttgaaagtctgttttgaa

SEQ ID NO: 7898437 - DNA, 22 bp, Homo sapiens
tattttgacgattttatgcaaa

SEQ ID NO: 7898438 - DNA, 22 bp, Homo sapiens
tattttgacgattttatgcaaa

SEQ ID NO: 7898439 - DNA, 22 bp, Homo sapiens
tattttctgtggaggaccagat

SEQ ID NO: 7898440 - DNA, 22 bp, Homo sapiens
tattttctgtggaggaccagat

SEQ ID NO: 7898441 - DNA, 22 bp, Homo sapiens
tattttgaaagtctgttttgaa

SEQ ID NO: 7898442 - DNA, 22 bp, Homo sapiens
tattttctggggagagtgaacc

SEQ ID NO: 7898443 - DNA, 22 bp, Homo sapiens
tattttctggggagagtgaacc

SEQ ID NO: 7898444 - DNA, 22 bp, Homo sapiens
tattttctggggagagtgaacc

SEQ ID NO: 7898445 - DNA, 22 bp, Homo sapiens
tattttctggacagtcttgctt

SEQ ID NO: 7898446 - DNA, 22 bp, Homo sapiens
tattttctggggagagtgaacc

SEQ ID NO: 7898447 - DNA, 22 bp, Homo sapiens
tatttggaaaggacatgtaagt

SEQ ID NO: 7898448 - DNA, 23 bp, Homo sapiens
tatttggaaagagggaagaagac

SEQ ID NO: 7898449 - DNA, 22 bp, Homo sapiens
tatttggaaagtttatctatct

SEQ ID NO: 7898450 - DNA, 22 bp, Homo sapiens
tatttggaaatagggctttgta

SEQ ID NO: 7898451 - DNA, 22 bp, Homo sapiens
tatttggacaccaagtagaagt

SEQ ID NO: 7898452 - DNA, 22 bp, Homo sapiens
tatttggaaggtataaacacaa

SEQ ID NO: 7898453 - DNA, 22 bp, Homo sapiens
tatttggaaatgataaagtact

SEQ ID NO: 7898454 - DNA, 22 bp, Homo sapiens
tatttggaaatgataaagtact

SEQ ID NO: 7898455 - DNA, 22 bp, Homo sapiens
tatttggaaatgataaagtact

SEQ ID NO: 7898456 - DNA, 22 bp, Homo sapiens
tatttggaaatgataaagtact

SEQ ID NO: 7898457 - DNA, 22 bp, Homo sapiens
tatttggaaggtataaacacaa

SEQ ID NO: 7898458 - DNA, 22 bp, Homo sapiens
tatttggaaacaattcacatgc

SEQ ID NO: 7898459 - DNA, 22 bp, Homo sapiens
tatttggaaacaattcacatgc

SEQ ID NO: 7898460 - DNA, 22 bp, Homo sapiens
tatttgcttttgtgccacagat

SEQ ID NO: 7898461 - DNA, 22 bp, Homo sapiens
tatttggaaaagggaagggaca

SEQ ID NO: 7898462 - DNA, 22 bp, Homo sapiens
tatttgctttgctttatagaga

SEQ ID NO: 7898463 - DNA, 22 bp, Homo sapiens
tatttgctttgctttatagaga

SEQ ID NO: 7898464 - DNA, 21 bp, Homo sapiens
tatttgctgccatctttgagg

SEQ ID NO: 7898465 - DNA, 22 bp, Homo sapiens
tcaaagagctattcagttgtgg

SEQ ID NO: 7898466 - DNA, 22 bp, Homo sapiens
tcaaagagctctatcttcaaaa

SEQ ID NO: 7898467 - DNA, 22 bp, Homo sapiens
tcaaagagctattcagttgtgg

SEQ ID NO: 7898468 - DNA, 22 bp, Homo sapiens
tcaaagatagatgttgagaaat

SEQ ID NO: 7898469 - DNA, 22 bp, Homo sapiens
tcaaagatagatgttgagaaat

SEQ ID NO: 7898470 - DNA, 22 bp, Homo sapiens
tcaaagaatgttatgagggtag

SEQ ID NO: 7898471 - DNA, 22 bp, Homo sapiens
tcaaagactatatattttattt

SEQ ID NO: 7898472 - DNA, 19 bp, Homo sapiens
tcaaagcaagcatgttctg

SEQ ID NO: 7898473 - DNA, 22 bp, Homo sapiens
tcaaagatgataggaaatcata

SEQ ID NO: 7898474 - DNA, 22 bp, Homo sapiens
tcaaagagctattcagttgtgg

SEQ ID NO: 7898475 - DNA, 17 bp, Homo sapiens
tcaaagaatgcatgcag

SEQ ID NO: 7898476 - DNA, 17 bp, Homo sapiens
tcaaagaatgcatgcag

SEQ ID NO: 7898477 - DNA, 22 bp, Homo sapiens
tcaaagaatgttatgagggtag

SEQ ID NO: 7898478 - DNA, 22 bp, Homo sapiens
tcaaagaatgttatgagggtag

SEQ ID NO: 7898479 - DNA, 22 bp, Homo sapiens
tcaaagaatgttatgagggtag

SEQ ID NO: 7898480 - DNA, 22 bp, Homo sapiens
tcaaagaagattaccctcccat

SEQ ID NO: 7898481 - DNA, 22 bp, Homo sapiens
tcaaagaagattaccctcccat

SEQ ID NO: 7898482 - DNA, 20 bp, Homo sapiens
tcaaagaagattcagctcaa

SEQ ID NO: 7898483 - DNA, 20 bp, Homo sapiens
tcaaagaagattcagctcaa

SEQ ID NO: 7898484 - DNA, 22 bp, Homo sapiens
tcaaagaacatcatctgaaatg

SEQ ID NO: 7898485 - DNA, 22 bp, Homo sapiens
tcaaagaagtgcaaacctcatc

SEQ ID NO: 7898486 - DNA, 22 bp, Homo sapiens
tcaaagaagtgcaaacctcatc

SEQ ID NO: 7898487 - DNA, 22 bp, Homo sapiens
tcaaagaagtgcaaacctcatc

SEQ ID NO: 7898488 - DNA, 20 bp, Homo sapiens
tcaaagaagattcagctcaa

SEQ ID NO: 7898489 - DNA, 22 bp, Homo sapiens
tcaaactggcagacttctactt

SEQ ID NO: 7898490 - DNA, 18 bp, Homo sapiens
tcaaactgtcattggtga

SEQ ID NO: 7898491 - DNA, 22 bp, Homo sapiens
tcaaaaatggtctttgagctgc

SEQ ID NO: 7898492 - DNA, 22 bp, Homo sapiens
tcaaactgttcagaactccttt

SEQ ID NO: 7898493 - DNA, 22 bp, Homo sapiens
tcaaagaacatcatctgaaatg

SEQ ID NO: 7898494 - DNA, 22 bp, Homo sapiens
tcaaagaacatcatctgaaatg

SEQ ID NO: 7898495 - DNA, 22 bp, Homo sapiens
tcaaagaacatcatctgaaatg

SEQ ID NO: 7898496 - DNA, 22 bp, Homo sapiens
tcaaacttggtaagagaaatac

SEQ ID NO: 7898497 - DNA, 22 bp, Homo sapiens
tcaaaaataagatattctggac

SEQ ID NO: 7898498 - DNA, 22 bp, Homo sapiens
tcaaaaataagatattctggac

SEQ ID NO: 7898499 - DNA, 22 bp, Homo sapiens
tcaaaaataagatattctggac

SEQ ID NO: 7898500 - DNA, 22 bp, Homo sapiens
tcaaaaataagatattctggac

SEQ ID NO: 7898501 - DNA, 22 bp, Homo sapiens
tcaaaaataagatattctggac

SEQ ID NO: 7898502 - DNA, 22 bp, Homo sapiens
tcaaaaataagatattctggac

SEQ ID NO: 7898503 - DNA, 22 bp, Homo sapiens
tcaaaaataagatattctggac

SEQ ID NO: 7898504 - DNA, 22 bp, Homo sapiens
tcaaaaataagatattctggac

SEQ ID NO: 7898505 - DNA, 22 bp, Homo sapiens
tatttttgcctctcagataaaa

SEQ ID NO: 7898506 - DNA, 22 bp, Homo sapiens
tatttttgcctctcagataaaa

SEQ ID NO: 7898507 - DNA, 22 bp, Homo sapiens
tattttgtcttctgctcatcac

SEQ ID NO: 7898508 - DNA, 22 bp, Homo sapiens
tattttgtgccatgcactgcct

SEQ ID NO: 7898509 - DNA, 22 bp, Homo sapiens
tattttgtcttctgctcatcac

SEQ ID NO: 7898510 - DNA, 22 bp, Homo sapiens
tattttgtcttctgctcatcac

SEQ ID NO: 7898511 - DNA, 22 bp, Homo sapiens
tattttgtatttatgcaagaaa

SEQ ID NO: 7898512 - DNA, 22 bp, Homo sapiens
tattttgttttgtatccactgt

SEQ ID NO: 7898513 - DNA, 22 bp, Homo sapiens
tattttgttttgtatccactgt

SEQ ID NO: 7898514 - DNA, 22 bp, Homo sapiens
tattttgttaataatccagtcc

SEQ ID NO: 7898515 - DNA, 22 bp, Homo sapiens
tattttgttaataatccagtcc

SEQ ID NO: 7898516 - DNA, 22 bp, Homo sapiens
tattttgttaataatccagtcc

SEQ ID NO: 7898517 - DNA, 22 bp, Homo sapiens
tattttgcaaacctgagtttga

SEQ ID NO: 7898518 - DNA, 22 bp, Homo sapiens
tattttgcaaacctgagtttga

SEQ ID NO: 7898519 - DNA, 22 bp, Homo sapiens
tattttgaggtatttttgagct

SEQ ID NO: 7898520 - DNA, 22 bp, Homo sapiens
tattttgagcccctgacatcta

SEQ ID NO: 7898521 - DNA, 22 bp, Homo sapiens
tattttgaggtatttttgagct

SEQ ID NO: 7898522 - DNA, 22 bp, Homo sapiens
tattttgaggtatttttgagct

SEQ ID NO: 7898523 - DNA, 22 bp, Homo sapiens
tattttgaggtatttttgagct

SEQ ID NO: 7898524 - DNA, 22 bp, Homo sapiens
tattttgagcccctgacatcta

SEQ ID NO: 7898525 - DNA, 22 bp, Homo sapiens
tattttgactattaaaccaaca

SEQ ID NO: 7898526 - DNA, 22 bp, Homo sapiens
tattttgactattaaaccaaca

SEQ ID NO: 7898527 - DNA, 22 bp, Homo sapiens
tattttgacgattttatgcaaa

SEQ ID NO: 7898528 - DNA, 22 bp, Homo sapiens
tattttgacgattttatgcaaa

SEQ ID NO: 7898529 - DNA, 22 bp, Homo sapiens
tattttgacgattttatgcaaa

SEQ ID NO: 7898530 - DNA, 22 bp, Homo sapiens
tattttgacgattttatgcaaa

SEQ ID NO: 7898531 - DNA, 22 bp, Homo sapiens
tattttgtaattggtcatagct

SEQ ID NO: 7898532 - DNA, 22 bp, Homo sapiens
tattttgtaattggtcatagct

SEQ ID NO: 7898533 - DNA, 22 bp, Homo sapiens
tattttgtaattggtcatagct

SEQ ID NO: 7898534 - DNA, 22 bp, Homo sapiens
tattttggctgattcatcatgt

SEQ ID NO: 7898535 - DNA, 22 bp, Homo sapiens
tattttggctgattcatcatgt

SEQ ID NO: 7898536 - DNA, 22 bp, Homo sapiens
tattttgtatttatgcaagaaa

SEQ ID NO: 7898537 - DNA, 22 bp, Homo sapiens
tattttgtatttatgcaagaaa

SEQ ID NO: 7898538 - DNA, 22 bp, Homo sapiens
tattttgtatttatgcaagaaa

SEQ ID NO: 7898539 - DNA, 22 bp, Homo sapiens
tattttgtaattggtcatagct

SEQ ID NO: 7898540 - DNA, 20 bp, Homo sapiens
tattttgcaattatggttca

SEQ ID NO: 7898541 - DNA, 22 bp, Homo sapiens
tattttgcaaacctgagtttga

SEQ ID NO: 7898542 - DNA, 20 bp, Homo sapiens
tattttgcaattatggttca

SEQ ID NO: 7898543 - DNA, 22 bp, Homo sapiens
tattttgcgttgagtcagattt

SEQ ID NO: 7898544 - DNA, 22 bp, Homo sapiens
tattttgcgttgagtcagattt

SEQ ID NO: 7898545 - DNA, 22 bp, Homo sapiens
tattttgctttagctgactgtt

SEQ ID NO: 7898546 - DNA, 22 bp, Homo sapiens
tcaaatacagaagatcctttcc

SEQ ID NO: 7898547 - DNA, 22 bp, Homo sapiens
tcaaatacagaagatcctttcc

SEQ ID NO: 7898548 - DNA, 22 bp, Homo sapiens
tcaaatacatggtcaatcaact

SEQ ID NO: 7898549 - DNA, 22 bp, Homo sapiens
tcaaataccagcaatttcatgt

SEQ ID NO: 7898550 - DNA, 22 bp, Homo sapiens
tcaaatacatggtcaatcaact

SEQ ID NO: 7898551 - DNA, 22 bp, Homo sapiens
tcaaataccagcaatttcatgt

SEQ ID NO: 7898552 - DNA, 22 bp, Homo sapiens
tcaaatacatggtcaatcaact

SEQ ID NO: 7898553 - DNA, 22 bp, Homo sapiens
tcaaatagttgacattaacttg

SEQ ID NO: 7898554 - DNA, 22 bp, Homo sapiens
tcaaatagttgacattaacttg

SEQ ID NO: 7898555 - DNA, 22 bp, Homo sapiens
tcaaataggtatgagtagaaat

SEQ ID NO: 7898556 - DNA, 22 bp, Homo sapiens
tcaaatagttgacattaacttg

SEQ ID NO: 7898557 - DNA, 22 bp, Homo sapiens
tcaaatagttgacattaacttg

SEQ ID NO: 7898558 - DNA, 22 bp, Homo sapiens
tcaaatatgtgatagaagctaa

SEQ ID NO: 7898559 - DNA, 22 bp, Homo sapiens
tcaaataccagcaatttcatgt

SEQ ID NO: 7898560 - DNA, 22 bp, Homo sapiens
tcaaataggcttgtagtgactg

SEQ ID NO: 7898561 - DNA, 22 bp, Homo sapiens
tcaaataggcttgtagtgactg

SEQ ID NO: 7898562 - DNA, 22 bp, Homo sapiens
tcaaataggtatgagtagaaat

SEQ ID NO: 7898563 - DNA, 22 bp, Homo sapiens
tcaaatatgtgatagaagctaa

SEQ ID NO: 7898564 - DNA, 22 bp, Homo sapiens
tcaaatatgtgatagaagctaa

SEQ ID NO: 7898565 - DNA, 22 bp, Homo sapiens
tcaaatatgtgatagaagctaa

SEQ ID NO: 7898566 - DNA, 22 bp, Homo sapiens
tcaaatatgtgatagaagctaa

SEQ ID NO: 7898567 - DNA, 22 bp, Homo sapiens
tcaaatatgtgatagaagctaa

SEQ ID NO: 7898568 - DNA, 21 bp, Homo sapiens
tcaaatcaggtatcactattg

SEQ ID NO: 7898569 - DNA, 21 bp, Homo sapiens
tcaaatcaggtatcactattg

SEQ ID NO: 7898570 - DNA, 21 bp, Homo sapiens
tcaaatcaggtatcactattg

SEQ ID NO: 7898571 - DNA, 21 bp, Homo sapiens
tcaaatcaggtatcactattg

SEQ ID NO: 7898572 - DNA, 22 bp, Homo sapiens
tcaaatcaccaaactcactggc

SEQ ID NO: 7898573 - DNA, 22 bp, Homo sapiens
tcaaatattggctatttcacat

SEQ ID NO: 7898574 - DNA, 22 bp, Homo sapiens
tcaaatattggctatttcacat

SEQ ID NO: 7898575 - DNA, 22 bp, Homo sapiens
tcaaatattggctatttcacat

SEQ ID NO: 7898576 - DNA, 22 bp, Homo sapiens
tcaaatattggctatttcacat

SEQ ID NO: 7898577 - DNA, 22 bp, Homo sapiens
tcaaatattggctatttcacat

SEQ ID NO: 7898578 - DNA, 21 bp, Homo sapiens
tcaaatcatgtactgaccaca

SEQ ID NO: 7898579 - DNA, 22 bp, Homo sapiens
tcaaatctttgaccacttatgt

SEQ ID NO: 7898580 - DNA, 22 bp, Homo sapiens
tcaaatgagaggcagggcagct

SEQ ID NO: 7898581 - DNA, 22 bp, Homo sapiens
tcaaatgaagacagttgacttg

SEQ ID NO: 7898582 - DNA, 22 bp, Homo sapiens
tcaaataatgccattcatcatc

SEQ ID NO: 7898583 - DNA, 22 bp, Homo sapiens
tcaaataatgccattcatcatc

SEQ ID NO: 7898584 - DNA, 22 bp, Homo sapiens
tcaaataaggagtcatgaccat

SEQ ID NO: 7898585 - DNA, 22 bp, Homo sapiens
tcaaataatgccattcatcatc

SEQ ID NO: 7898586 - DNA, 22 bp, Homo sapiens
tcaaataaggagtcatgaccat

SEQ ID NO: 7898587 - DNA, 22 bp, Homo sapiens
tcaaataaggagtcatgaccat

SEQ ID NO: 7898588 - DNA, 22 bp, Homo sapiens
tcaaataaggagtcatgaccat

SEQ ID NO: 7898589 - DNA, 19 bp, Homo sapiens
tcaaagtctgagtcacttt

SEQ ID NO: 7898590 - DNA, 22 bp, Homo sapiens
tcaaagttacttgtggttttct

SEQ ID NO: 7898591 - DNA, 23 bp, Homo sapiens
tcaaagtagttttatccaataaa

SEQ ID NO: 7898592 - DNA, 22 bp, Homo sapiens
tcaaagtatctcatggagagca

SEQ ID NO: 7898593 - DNA, 22 bp, Homo sapiens
tcaaagtatctcatggagagca

SEQ ID NO: 7898594 - DNA, 22 bp, Homo sapiens
tcaaagtatctcatggagagca

SEQ ID NO: 7898595 - DNA, 22 bp, Homo sapiens
tcaaagtatatcccttcgaaac

SEQ ID NO: 7898596 - DNA, 22 bp, Homo sapiens
tcaaagtatatcccttcgaaac

SEQ ID NO: 7898597 - DNA, 17 bp, Homo sapiens
tcaaagtattctgatgc

SEQ ID NO: 7898598 - DNA, 22 bp, Homo sapiens
tcaaagtataattgcttttttg

SEQ ID NO: 7898599 - DNA, 22 bp, Homo sapiens
tcaaagtatgctttctttggga

SEQ ID NO: 7898600 - DNA, 22 bp, Homo sapiens
tcaaagtatgctttctttggga

SEQ ID NO: 7898601 - DNA, 22 bp, Homo sapiens
tcaaagtcatggcaggctcaga

SEQ ID NO: 7898602 - DNA, 22 bp, Homo sapiens
tcaaagtcatggcaggctcaga

SEQ ID NO: 7898603 - DNA, 22 bp, Homo sapiens
tcaaagtctatctgtaattact

SEQ ID NO: 7898604 - DNA, 22 bp, Homo sapiens
tcaaagtaagattgttgaagct

SEQ ID NO: 7898605 - DNA, 22 bp, Homo sapiens
tcaaagtaccagagtgaactga

SEQ ID NO: 7898606 - DNA, 22 bp, Homo sapiens
tcaaagtaccattatcagtgga

SEQ ID NO: 7898607 - DNA, 22 bp, Homo sapiens
tcaaagtactactcagttcagc

SEQ ID NO: 7898608 - DNA, 22 bp, Homo sapiens
tcaaagtagagttcagtgcagc

SEQ ID NO: 7898609 - DNA, 22 bp, Homo sapiens
tcaaagtaggggtaagccaggc

SEQ ID NO: 7898610 - DNA, 22 bp, Homo sapiens
tcaaagtaggggtaagccaggc

SEQ ID NO: 7898611 - DNA, 22 bp, Homo sapiens
tcaaagtaggggtaagccaggc

SEQ ID NO: 7898612 - DNA, 22 bp, Homo sapiens
tcaaagtaaaagtatagagttt

SEQ ID NO: 7898613 - DNA, 22 bp, Homo sapiens
tcaaagtaaaagtatagagttt

SEQ ID NO: 7898614 - DNA, 22 bp, Homo sapiens
tcaaagtaaacgctttgggcca

SEQ ID NO: 7898615 - DNA, 22 bp, Homo sapiens
tcaaagggtagcccagggaaga

SEQ ID NO: 7898616 - DNA, 22 bp, Homo sapiens
tcaaagggtaatgtaatagtct

SEQ ID NO: 7898617 - DNA, 22 bp, Homo sapiens
tcaaagggtccttaacatgaga

SEQ ID NO: 7898618 - DNA, 22 bp, Homo sapiens
tcaaaggttaactctgttgttc

SEQ ID NO: 7898619 - DNA, 22 bp, Homo sapiens
tcaaaggcttgtggttctggga

SEQ ID NO: 7898620 - DNA, 19 bp, Homo sapiens
tcaaaggcttttaggagac

SEQ ID NO: 7898621 - DNA, 22 bp, Homo sapiens
tagcaaaatgtggatgtagttg

SEQ ID NO: 7898622 - DNA, 22 bp, Homo sapiens
tagcaaaatgtggatgtagttg

SEQ ID NO: 7898623 - DNA, 22 bp, Homo sapiens
tagcaaaatgtggatgtagttg

SEQ ID NO: 7898624 - DNA, 22 bp, Homo sapiens
tagcaaaatgtggatgtagttg

SEQ ID NO: 7898625 - DNA, 22 bp, Homo sapiens
tagcaaaatgtggatgtagttg

SEQ ID NO: 7898626 - DNA, 22 bp, Homo sapiens
tagcaaaatgtggatgtagttg

SEQ ID NO: 7898627 - DNA, 22 bp, Homo sapiens
tagcaaaagctcaacaggaagg

SEQ ID NO: 7898628 - DNA, 22 bp, Homo sapiens
tagcaaaatgtggatgtagttg

SEQ ID NO: 7898629 - DNA, 22 bp, Homo sapiens
tagcaaaatgtggatgtagttg

SEQ ID NO: 7898630 - DNA, 22 bp, Homo sapiens
tagcaaaagctcaacaggaagg

SEQ ID NO: 7898631 - DNA, 22 bp, Homo sapiens
tagcaaaagctcaacaggaagg

SEQ ID NO: 7898632 - DNA, 22 bp, Homo sapiens
tagcaaagaagatattattgca

SEQ ID NO: 7898633 - DNA, 22 bp, Homo sapiens
tagcaaagaacctgatacccca

SEQ ID NO: 7898634 - DNA, 22 bp, Homo sapiens
tagcaaagaacctgatacccca

SEQ ID NO: 7898635 - DNA, 22 bp, Homo sapiens
tagcaaagaacctgatacccca

SEQ ID NO: 7898636 - DNA, 22 bp, Homo sapiens
tagcaaactcatacatgtgggt

SEQ ID NO: 7898637 - DNA, 22 bp, Homo sapiens
tagcaaaatgtggatgtagttg

SEQ ID NO: 7898638 - DNA, 18 bp, Homo sapiens
tagcaaagatgtggattg

SEQ ID NO: 7898639 - DNA, 22 bp, Homo sapiens
tagcaaagaggagacctaggca

SEQ ID NO: 7898640 - DNA, 22 bp, Homo sapiens
tagcaaagaggagacctaggca

SEQ ID NO: 7898641 - DNA, 21 bp, Homo sapiens
tagcaaagccagatgtatatt

SEQ ID NO: 7898642 - DNA, 18 bp, Homo sapiens
tagcaaagatgtggattg

SEQ ID NO: 7898643 - DNA, 18 bp, Homo sapiens
tagcaaagatgtggattg

SEQ ID NO: 7898644 - DNA, 22 bp, Homo sapiens
tagcaaagaccaaagctagttg

SEQ ID NO: 7898645 - DNA, 22 bp, Homo sapiens
tagcaaagaccaaagctagttg

SEQ ID NO: 7898646 - DNA, 22 bp, Homo sapiens
tagcaaagaccaaagctagttg

SEQ ID NO: 7898647 - DNA, 22 bp, Homo sapiens
tagcaaagaagatattattgca

SEQ ID NO: 7898648 - DNA, 22 bp, Homo sapiens
tagcaaagagaaaaattatgct

SEQ ID NO: 7898649 - DNA, 22 bp, Homo sapiens
tagcaaagagaaaaattatgct

SEQ ID NO: 7898650 - DNA, 22 bp, Homo sapiens
tagcaaagagaaaaattatgct

SEQ ID NO: 7898651 - DNA, 22 bp, Homo sapiens
tagcaaagaagatattattgca

SEQ ID NO: 7898652 - DNA, 22 bp, Homo sapiens
tagcaaagcccttgctgtgtaa

SEQ ID NO: 7898653 - DNA, 22 bp, Homo sapiens
tagcaaagcccttcaggccctg

SEQ ID NO: 7898654 - DNA, 22 bp, Homo sapiens
tagcaaagcccttcaggccctg

SEQ ID NO: 7898655 - DNA, 22 bp, Homo sapiens
tagcaaagcccacgtgccaagc

SEQ ID NO: 7898656 - DNA, 22 bp, Homo sapiens
tagcaaagcccacgtgccaagc

SEQ ID NO: 7898657 - DNA, 21 bp, Homo sapiens
tagcaaagccagatgtatatt

SEQ ID NO: 7898658 - DNA, 21 bp, Homo sapiens
tagcaaagccagatgtatatt

SEQ ID NO: 7898659 - DNA, 22 bp, Homo sapiens
tagcaaagctccgtagttattt

SEQ ID NO: 7898660 - DNA, 22 bp, Homo sapiens
tagcaaagctccgtagttattt

SEQ ID NO: 7898661 - DNA, 22 bp, Homo sapiens
tagcaaagcgaaagagatttat

SEQ ID NO: 7898662 - DNA, 22 bp, Homo sapiens
tagcaaagctccgtagttattt

SEQ ID NO: 7898663 - DNA, 22 bp, Homo sapiens
tagcaaagcgaaagagatttat

SEQ ID NO: 7898664 - DNA, 22 bp, Homo sapiens
tagcaaagcgaaagagatttat

SEQ ID NO: 7898665 - DNA, 22 bp, Homo sapiens
tagcaaagcccttgctgtgtaa

SEQ ID NO: 7898666 - DNA, 22 bp, Homo sapiens
tagcaaagcgaaagagatttat

SEQ ID NO: 7898667 - DNA, 22 bp, Homo sapiens
tagcaaagcgaaagagatttat

SEQ ID NO: 7898668 - DNA, 22 bp, Homo sapiens
tagatgaaggggttcagcatgg

SEQ ID NO: 7898669 - DNA, 22 bp, Homo sapiens
tagatgaattagcaattatctt

SEQ ID NO: 7898670 - DNA, 22 bp, Homo sapiens
tagatgaccttgtgttaggcaa

SEQ ID NO: 7898671 - DNA, 22 bp, Homo sapiens
tagatgaccttgtgttaggcaa

SEQ ID NO: 7898672 - DNA, 22 bp, Homo sapiens
tagatgaccttgtgttaggcaa

SEQ ID NO: 7898673 - DNA, 22 bp, Homo sapiens
tagatgaccttgtgttaggcaa

SEQ ID NO: 7898674 - DNA, 22 bp, Homo sapiens
tagcaaaagccacgattacttt

SEQ ID NO: 7898675 - DNA, 22 bp, Homo sapiens
tagatgaccttgtgttaggcaa

SEQ ID NO: 7898676 - DNA, 22 bp, Homo sapiens
tagcaaaagctcaacaggaagg

SEQ ID NO: 7898677 - DNA, 22 bp, Homo sapiens
tagcaaaagctcaacaggaagg

SEQ ID NO: 7898678 - DNA, 22 bp, Homo sapiens
tagcaaaagctcaacaggaagg

SEQ ID NO: 7898679 - DNA, 22 bp, Homo sapiens
tagcaaaagctcaacaggaagg

SEQ ID NO: 7898680 - DNA, 20 bp, Homo sapiens
tagatcctggggatttattg

SEQ ID NO: 7898681 - DNA, 22 bp, Homo sapiens
tagatctgatacaattcatctg

SEQ ID NO: 7898682 - DNA, 22 bp, Homo sapiens
tagatctgatacaattcatctg

SEQ ID NO: 7898683 - DNA, 23 bp, Homo sapiens
tagatcttcatctaattctgtag

SEQ ID NO: 7898684 - DNA, 22 bp, Homo sapiens
tagatctttcactactgtgtag

SEQ ID NO: 7898685 - DNA, 22 bp, Homo sapiens
tagatgaaaggtctagcacagt

SEQ ID NO: 7898686 - DNA, 22 bp, Homo sapiens
tagcaagaagctgtcacaggtg

SEQ ID NO: 7898687 - DNA, 22 bp, Homo sapiens
tagcaagaaaacacaagaatta

SEQ ID NO: 7898688 - DNA, 22 bp, Homo sapiens
tagcaagaagctgtcacaggtg

SEQ ID NO: 7898689 - DNA, 22 bp, Homo sapiens
tagcaagaaaacacaagaatta

SEQ ID NO: 7898690 - DNA, 22 bp, Homo sapiens
tagcaactgctctattctagga

SEQ ID NO: 7898691 - DNA, 22 bp, Homo sapiens
tagcaactgctctattctagga

SEQ ID NO: 7898692 - DNA, 22 bp, Homo sapiens
tagcaactgcctttactatatt

SEQ ID NO: 7898693 - DNA, 22 bp, Homo sapiens
tagcaacctatggatagagaag

SEQ ID NO: 7898694 - DNA, 22 bp, Homo sapiens
tagcaagaagggagatggggtt

SEQ ID NO: 7898695 - DNA, 22 bp, Homo sapiens
tagcagctctttactaaccagt

SEQ ID NO: 7898696 - DNA, 22 bp, Homo sapiens
tagcagctctgattctgggccc

SEQ ID NO: 7898697 - DNA, 22 bp, Homo sapiens
tagcagctcctaaacagtggtg

SEQ ID NO: 7898698 - DNA, 22 bp, Homo sapiens
tagcaaatgtgttatgctatgc

SEQ ID NO: 7898699 - DNA, 22 bp, Homo sapiens
tagcaaatgtgttatgctatgc

SEQ ID NO: 7898700 - DNA, 22 bp, Homo sapiens
tagcaaatgtgttatgctatgc

SEQ ID NO: 7898701 - DNA, 22 bp, Homo sapiens
tagcaaatgtgttatgctatgc

SEQ ID NO: 7898702 - DNA, 21 bp, Homo sapiens
tagcaaattgctattaaggca

SEQ ID NO: 7898703 - DNA, 22 bp, Homo sapiens
tagcaacatggttatcacatta

SEQ ID NO: 7898704 - DNA, 22 bp, Homo sapiens
tagcaaaggatgactatgtacc

SEQ ID NO: 7898705 - DNA, 22 bp, Homo sapiens
tagcaaaggatgactatgtacc

SEQ ID NO: 7898706 - DNA, 22 bp, Homo sapiens
tagcaaaggatgactatgtacc

SEQ ID NO: 7898707 - DNA, 22 bp, Homo sapiens
tagcaaaggatgactatgtacc

SEQ ID NO: 7898708 - DNA, 22 bp, Homo sapiens
tagcaaagctccgtagttattt

SEQ ID NO: 7898709 - DNA, 22 bp, Homo sapiens
tagcaaaggatgactatgtacc

SEQ ID NO: 7898710 - DNA, 22 bp, Homo sapiens
tagcaaaggccttggacacgct

SEQ ID NO: 7898711 - DNA, 22 bp, Homo sapiens
tagcaaaggccttggacacgct

SEQ ID NO: 7898712 - DNA, 22 bp, Homo sapiens
tagcaaagggaaagaagggcct

SEQ ID NO: 7898713 - DNA, 22 bp, Homo sapiens
tagcaaataaaacagtattgaa

SEQ ID NO: 7898714 - DNA, 22 bp, Homo sapiens
tagcaaataaaacagtattgaa

SEQ ID NO: 7898715 - DNA, 22 bp, Homo sapiens
tagcaaataaaacagtattgaa

SEQ ID NO: 7898716 - DNA, 22 bp, Homo sapiens
tagcaaataaaacagtattgaa

SEQ ID NO: 7898717 - DNA, 23 bp, Homo sapiens
tagcaaagttgtttgggaaattt

SEQ ID NO: 7898718 - DNA, 23 bp, Homo sapiens
tagcaaagttgtttgggaaattt

SEQ ID NO: 7898719 - DNA, 23 bp, Homo sapiens
tagcaaagttgtttgggaaattt

SEQ ID NO: 7898720 - DNA, 22 bp, Homo sapiens
tagcaaaggtagagttttgaga

SEQ ID NO: 7898721 - DNA, 23 bp, Homo sapiens
tagcaaagttgtttgggaaattt

SEQ ID NO: 7898722 - DNA, 22 bp, Homo sapiens
tagcaaagttttgtggtgatta

SEQ ID NO: 7898723 - DNA, 22 bp, Homo sapiens
tagcaaagttttgtggtgatta

SEQ ID NO: 7898724 - DNA, 22 bp, Homo sapiens
tagcaaatgtctgaaggaatag

SEQ ID NO: 7898725 - DNA, 22 bp, Homo sapiens
tagcaaatgtaaaatgcctaca

SEQ ID NO: 7898726 - DNA, 22 bp, Homo sapiens
tagcaaatgtaaaatgcctaca

SEQ ID NO: 7898727 - DNA, 21 bp, Homo sapiens
tagcaaatggagagtaagaga

SEQ ID NO: 7898728 - DNA, 21 bp, Homo sapiens
tagcaaatggagagtaagaga

SEQ ID NO: 7898729 - DNA, 22 bp, Homo sapiens
tagcaaatgggcttgttttcca

SEQ ID NO: 7898730 - DNA, 22 bp, Homo sapiens
tagcaaatgggcttgttttcca

SEQ ID NO: 7898731 - DNA, 22 bp, Homo sapiens
tagcaaatacatgatgtaattt

SEQ ID NO: 7898732 - DNA, 22 bp, Homo sapiens
tagcaaatacatgatgtaattt

SEQ ID NO: 7898733 - DNA, 22 bp, Homo sapiens
tagcaaatacatgatgtaattt

SEQ ID NO: 7898734 - DNA, 22 bp, Homo sapiens
tagcaaatacatgatgtaattt

SEQ ID NO: 7898735 - DNA, 21 bp, Homo sapiens
tagcaaatggagagtaagaga

SEQ ID NO: 7898736 - DNA, 22 bp, Homo sapiens
tagcaaatgcctggttaattag

SEQ ID NO: 7898737 - DNA, 22 bp, Homo sapiens
tagcaaatgcctggttaattag

SEQ ID NO: 7898738 - DNA, 22 bp, Homo sapiens
tagcagggtccaatgtgaggca

SEQ ID NO: 7898739 - DNA, 22 bp, Homo sapiens
tagcagggtccaatgtgaggca

SEQ ID NO: 7898740 - DNA, 22 bp, Homo sapiens
tagcagggtccaatgtgaggca

SEQ ID NO: 7898741 - DNA, 22 bp, Homo sapiens
tagcagggtccaatgtgaggca

SEQ ID NO: 7898742 - DNA, 18 bp, Homo sapiens
tagcagggcttgtccttt

SEQ ID NO: 7898743 - DNA, 22 bp, Homo sapiens
tagcagggtaaatgtagatgga

SEQ ID NO: 7898744 - DNA, 22 bp, Homo sapiens
tagcagggtaaatgtagatgga

SEQ ID NO: 7898745 - DNA, 22 bp, Homo sapiens
tagcaggggtagatagagtgtg

SEQ ID NO: 7898746 - DNA, 20 bp, Homo sapiens
tagctgcacagccctaggag

SEQ ID NO: 7898747 - DNA, 22 bp, Homo sapiens
tagctgcacaggaagtaagatt

SEQ ID NO: 7898748 - DNA, 22 bp, Homo sapiens
tagctgccaaaagggtgggcta

SEQ ID NO: 7898749 - DNA, 22 bp, Homo sapiens
tagctgacgctaaataaatgtt

SEQ ID NO: 7898750 - DNA, 22 bp, Homo sapiens
tagctgagagctcacttgagga

SEQ ID NO: 7898751 - DNA, 22 bp, Homo sapiens
tagcagggtctcaggagtcagg

SEQ ID NO: 7898752 - DNA, 22 bp, Homo sapiens
tagctgacgctaaataaatgtt

SEQ ID NO: 7898753 - DNA, 22 bp, Homo sapiens
tagctgcttctcacatgggcaa

SEQ ID NO: 7898754 - DNA, 22 bp, Homo sapiens
tagctgcttcagtctaggtctc

SEQ ID NO: 7898755 - DNA, 22 bp, Homo sapiens
tagctggcaaaacattatttct

SEQ ID NO: 7898756 - DNA, 22 bp, Homo sapiens
tagctgcttgaccaggcagtgg

SEQ ID NO: 7898757 - DNA, 22 bp, Homo sapiens
tagctgcctttgggctcctgct

SEQ ID NO: 7898758 - DNA, 22 bp, Homo sapiens
tagctgctgcagcacagggagg

SEQ ID NO: 7898759 - DNA, 22 bp, Homo sapiens
tagctgcttagaaatcactgag

SEQ ID NO: 7898760 - DNA, 22 bp, Homo sapiens
tagctggcttatataaaagggc

SEQ ID NO: 7898761 - DNA, 22 bp, Homo sapiens
tagctggccctgggactcccgg

SEQ ID NO: 7898762 - DNA, 22 bp, Homo sapiens
tagctggcatggccctgtggga

SEQ ID NO: 7898763 - DNA, 22 bp, Homo sapiens
tagctgggaattatctggttgc

SEQ ID NO: 7898764 - DNA, 22 bp, Homo sapiens
tagctgggaattatctggttgc

SEQ ID NO: 7898765 - DNA, 22 bp, Homo sapiens
tagctggctaatagtatgaata

SEQ ID NO: 7898766 - DNA, 22 bp, Homo sapiens
tagctgcctttgggctcctgct

SEQ ID NO: 7898767 - DNA, 22 bp, Homo sapiens
tagctgcctttgggctcctgct

SEQ ID NO: 7898768 - DNA, 22 bp, Homo sapiens
tagctgcctttgggctcctgct

SEQ ID NO: 7898769 - DNA, 19 bp, Homo sapiens
tagctgcctgttacctcca

SEQ ID NO: 7898770 - DNA, 22 bp, Homo sapiens
tagctgcctagacagctatagc

SEQ ID NO: 7898771 - DNA, 22 bp, Homo sapiens
tagctgcctatgtgataagaga

SEQ ID NO: 7898772 - DNA, 22 bp, Homo sapiens
tagctgccagaccattcttact

SEQ ID NO: 7898773 - DNA, 22 bp, Homo sapiens
tagctgccattgctccaggaag

SEQ ID NO: 7898774 - DNA, 22 bp, Homo sapiens
tagctgcccatctttcctttag

SEQ ID NO: 7898775 - DNA, 17 bp, Homo sapiens
tagctgccccgaatgct

SEQ ID NO: 7898776 - DNA, 22 bp, Homo sapiens
tagcagggatacaaggtcgcct

SEQ ID NO: 7898777 - DNA, 22 bp, Homo sapiens
tagcagggagggccagtgtcaa

SEQ ID NO: 7898778 - DNA, 22 bp, Homo sapiens
tagcagggccaggctgggaacc

SEQ ID NO: 7898779 - DNA, 22 bp, Homo sapiens
tagcagggatacaaggtcgcct

SEQ ID NO: 7898780 - DNA, 22 bp, Homo sapiens
tagcagggccaggctgggaacc

SEQ ID NO: 7898781 - DNA, 22 bp, Homo sapiens
tagcagggaagatgatcagaat

SEQ ID NO: 7898782 - DNA, 22 bp, Homo sapiens
tagcagggagggccagtgtcaa

SEQ ID NO: 7898783 - DNA, 22 bp, Homo sapiens
tagcaggagtgatgttgtgtga

SEQ ID NO: 7898784 - DNA, 22 bp, Homo sapiens
tagcagggaaggtgtgctgagc

SEQ ID NO: 7898785 - DNA, 22 bp, Homo sapiens
tagcagggaaggtgtgctgagc

SEQ ID NO: 7898786 - DNA, 22 bp, Homo sapiens
tagcaggcatggagatgactgt

SEQ ID NO: 7898787 - DNA, 22 bp, Homo sapiens
tagcaggcatccaataaatact

SEQ ID NO: 7898788 - DNA, 21 bp, Homo sapiens
tagcaggatttggtttatttt

SEQ ID NO: 7898789 - DNA, 21 bp, Homo sapiens
tagcaggatttggtttatttt

SEQ ID NO: 7898790 - DNA, 22 bp, Homo sapiens
tagcaggcttgtgaatggagcc

SEQ ID NO: 7898791 - DNA, 22 bp, Homo sapiens
tagcaggatttgaagaagatct

SEQ ID NO: 7898792 - DNA, 22 bp, Homo sapiens
tagcaggatttgaagaagatct

SEQ ID NO: 7898793 - DNA, 22 bp, Homo sapiens
tagcaggatcacagggagagcc

SEQ ID NO: 7898794 - DNA, 22 bp, Homo sapiens
tagcaggatcacagggagagcc

SEQ ID NO: 7898795 - DNA, 22 bp, Homo sapiens
tagcaggagtgtgttctatttt

SEQ ID NO: 7898796 - DNA, 22 bp, Homo sapiens
tagcaggagtgatgttgtgtga

SEQ ID NO: 7898797 - DNA, 21 bp, Homo sapiens
tagcaggaggcccctgcttgc

SEQ ID NO: 7898798 - DNA, 22 bp, Homo sapiens
tagcaggagtgtgttctatttt

SEQ ID NO: 7898799 - DNA, 22 bp, Homo sapiens
tagcaggagtgtgttctatttt

SEQ ID NO: 7898800 - DNA, 22 bp, Homo sapiens
tagcaggaggcagttcctcgct

SEQ ID NO: 7898801 - DNA, 22 bp, Homo sapiens
tagcaggaatgaagttctgagg

SEQ ID NO: 7898802 - DNA, 21 bp, Homo sapiens
tagcaggagcgaattttgatg

SEQ ID NO: 7898803 - DNA, 22 bp, Homo sapiens
tagcaggaggcagttcctcgct

SEQ ID NO: 7898804 - DNA, 21 bp, Homo sapiens
tagcaggaggcccctgcttgc

SEQ ID NO: 7898805 - DNA, 22 bp, Homo sapiens
tagcaggagcagcctgcctaga

SEQ ID NO: 7898806 - DNA, 21 bp, Homo sapiens
tagcaggagcgaattttgatg

SEQ ID NO: 7898807 - DNA, 21 bp, Homo sapiens
tagcaggagcgaattttgatg

SEQ ID NO: 7898808 - DNA, 22 bp, Homo sapiens
tagcagctgtggaggggctgtg

SEQ ID NO: 7898809 - DNA, 22 bp, Homo sapiens
tagcagctgtgagtaaaagcca

SEQ ID NO: 7898810 - DNA, 22 bp, Homo sapiens
tagcagctgtcagtttcacata

SEQ ID NO: 7898811 - DNA, 22 bp, Homo sapiens
tagcagctgtcagtttcacata

SEQ ID NO: 7898812 - DNA, 22 bp, Homo sapiens
tagcagctggggctattcatca

SEQ ID NO: 7898813 - DNA, 22 bp, Homo sapiens
tagcagctgtcagtttcacata

SEQ ID NO: 7898814 - DNA, 19 bp, Homo sapiens
tagcagctgccaaaggaga

SEQ ID NO: 7898815 - DNA, 22 bp, Homo sapiens
tagcagctggggctattcatca

SEQ ID NO: 7898816 - DNA, 22 bp, Homo sapiens
tagcagctctttactaaccagt

SEQ ID NO: 7898817 - DNA, 19 bp, Homo sapiens
tagcagctgccaaaggaga

SEQ ID NO: 7898818 - DNA, 22 bp, Homo sapiens
tagcagctgcatcattttacag

SEQ ID NO: 7898819 - DNA, 22 bp, Homo sapiens
tagcagcttccagagagggcag

SEQ ID NO: 7898820 - DNA, 22 bp, Homo sapiens
tagcaggaaacctgtgttgagg

SEQ ID NO: 7898821 - DNA, 22 bp, Homo sapiens
tagcagcttccagagagggcag

SEQ ID NO: 7898822 - DNA, 22 bp, Homo sapiens
tagcagcttaagtaattagaat

SEQ ID NO: 7898823 - DNA, 22 bp, Homo sapiens
tagcagcttccagagagggcag

SEQ ID NO: 7898824 - DNA, 22 bp, Homo sapiens
tagcaggaagaaagctactcag

SEQ ID NO: 7898825 - DNA, 22 bp, Homo sapiens
tagcaggaagaaagctactcag

SEQ ID NO: 7898826 - DNA, 22 bp, Homo sapiens
tagcaggaagaaagctactcag

SEQ ID NO: 7898827 - DNA, 22 bp, Homo sapiens
tagcaggaaacctgtgttgagg

SEQ ID NO: 7898828 - DNA, 22 bp, Homo sapiens
tagcaggaaggttcagggccct

SEQ ID NO: 7898829 - DNA, 22 bp, Homo sapiens
tagcaggaaggttcagggccct

SEQ ID NO: 7898830 - DNA, 22 bp, Homo sapiens
tagcaggaataaaaatgtaccc

SEQ ID NO: 7898831 - DNA, 22 bp, Homo sapiens
tagcaggaataaaaatgtaccc

SEQ ID NO: 7898832 - DNA, 22 bp, Homo sapiens
tagcaggaaggttcagggccct

SEQ ID NO: 7898833 - DNA, 22 bp, Homo sapiens
tagcaggaaggttcagggccct

SEQ ID NO: 7898834 - DNA, 22 bp, Homo sapiens
tagcaggaataaaaatgtaccc

SEQ ID NO: 7898835 - DNA, 22 bp, Homo sapiens
tagcaggagagaagttttaagt

SEQ ID NO: 7898836 - DNA, 22 bp, Homo sapiens
tagcaggagagaagttttaagt

SEQ ID NO: 7898837 - DNA, 22 bp, Homo sapiens
tagcaggagcagcctgcctaga

SEQ ID NO: 7898838 - DNA, 22 bp, Homo sapiens
tagcaggaccctgagcatccca

SEQ ID NO: 7898839 - DNA, 22 bp, Homo sapiens
tagcaggacatgtgcagagaag

SEQ ID NO: 7898840 - DNA, 22 bp, Homo sapiens
tagcaggaccctgagcatccca

SEQ ID NO: 7898841 - DNA, 22 bp, Homo sapiens
tagcaggaccatgacaagaaaa

SEQ ID NO: 7898842 - DNA, 22 bp, Homo sapiens
tagcaggaccatgacaagaaaa

SEQ ID NO: 7898843 - DNA, 22 bp, Homo sapiens
tagcaggacatgtgcagagaag

SEQ ID NO: 7898844 - DNA, 22 bp, Homo sapiens
tagcaggaattggctgcagctg

SEQ ID NO: 7898845 - DNA, 22 bp, Homo sapiens
tagcaggaattggctgcagctg

SEQ ID NO: 7898846 - DNA, 22 bp, Homo sapiens
tagcaggaattggctgcagctg

SEQ ID NO: 7898847 - DNA, 22 bp, Homo sapiens
tagcaggaatgaagttctgagg

SEQ ID NO: 7898848 - DNA, 22 bp, Homo sapiens
tagcaggaatgaagttctgagg

SEQ ID NO: 7898849 - DNA, 22 bp, Homo sapiens
tagcaggaatatgaggttaata

SEQ ID NO: 7898850 - DNA, 22 bp, Homo sapiens
tagcaggaataaaaatgtaccc

SEQ ID NO: 7898851 - DNA, 22 bp, Homo sapiens
tagcaggaatatgaggttaata

SEQ ID NO: 7898852 - DNA, 22 bp, Homo sapiens
tagcaggaatatgaggttaata

SEQ ID NO: 7898853 - DNA, 22 bp, Homo sapiens
tagagtctagtgtatacaaagt

SEQ ID NO: 7898854 - DNA, 22 bp, Homo sapiens
tagagtctagagtgggaccgag

SEQ ID NO: 7898855 - DNA, 22 bp, Homo sapiens
tagatacagtgttaagtgtgga

SEQ ID NO: 7898856 - DNA, 22 bp, Homo sapiens
tagatacagtgttaagtgtgga

SEQ ID NO: 7898857 - DNA, 22 bp, Homo sapiens
tagagtctagtgtatacaaagt

SEQ ID NO: 7898858 - DNA, 22 bp, Homo sapiens
tagatacatacattttaaaatg

SEQ ID NO: 7898859 - DNA, 22 bp, Homo sapiens
tagatacatacattttaaaatg

SEQ ID NO: 7898860 - DNA, 22 bp, Homo sapiens
tagatacatacattttaaaatg

SEQ ID NO: 7898861 - DNA, 22 bp, Homo sapiens
tagatacatacattttaaaatg

SEQ ID NO: 7898862 - DNA, 22 bp, Homo sapiens
tagatacatacattttaaaatg

SEQ ID NO: 7898863 - DNA, 22 bp, Homo sapiens
tagatacatacattttaaaatg

SEQ ID NO: 7898864 - DNA, 22 bp, Homo sapiens
tagatacagtgttaagtgtgga

SEQ ID NO: 7898865 - DNA, 22 bp, Homo sapiens
tagatacatttttctttcctgt

SEQ ID NO: 7898866 - DNA, 22 bp, Homo sapiens
tagatacatttttctttcctgt

SEQ ID NO: 7898867 - DNA, 20 bp, Homo sapiens
tagatacccaatgctcatca

SEQ ID NO: 7898868 - DNA, 22 bp, Homo sapiens
tagataggtgattaggaaaagc

SEQ ID NO: 7898869 - DNA, 22 bp, Homo sapiens
tagatataaggtccttagaaca

SEQ ID NO: 7898870 - DNA, 22 bp, Homo sapiens
tagatagataaaatgttgcaga

SEQ ID NO: 7898871 - DNA, 22 bp, Homo sapiens
tagatagattctcctatagagt

SEQ ID NO: 7898872 - DNA, 22 bp, Homo sapiens
tagatagactaatccagcaact

SEQ ID NO: 7898873 - DNA, 22 bp, Homo sapiens
tagatagactaatccagcaact

SEQ ID NO: 7898874 - DNA, 22 bp, Homo sapiens
tagatacttataatcttccaag

SEQ ID NO: 7898875 - DNA, 22 bp, Homo sapiens
tagatacttattcgttgtttac

SEQ ID NO: 7898876 - DNA, 22 bp, Homo sapiens
tagatacttataatcttccaag

SEQ ID NO: 7898877 - DNA, 22 bp, Homo sapiens
tagatactcagaaatgctttca

SEQ ID NO: 7898878 - DNA, 22 bp, Homo sapiens
tagatactcagaaatgctttca

SEQ ID NO: 7898879 - DNA, 19 bp, Homo sapiens
tagatactgatgaactcca

SEQ ID NO: 7898880 - DNA, 22 bp, Homo sapiens
tagatacctgctggacctcatt

SEQ ID NO: 7898881 - DNA, 22 bp, Homo sapiens
tagatcaggctgcttagataga

SEQ ID NO: 7898882 - DNA, 22 bp, Homo sapiens
tagatcataaatactatggtgc

SEQ ID NO: 7898883 - DNA, 22 bp, Homo sapiens
tagatatgtgtttattatgctg

SEQ ID NO: 7898884 - DNA, 22 bp, Homo sapiens
tagatcatggagtaaaatggaa

SEQ ID NO: 7898885 - DNA, 22 bp, Homo sapiens
tagatcatcagtgggctcttat

SEQ ID NO: 7898886 - DNA, 22 bp, Homo sapiens
tagatcatatttgtggagaaaa

SEQ ID NO: 7898887 - DNA, 22 bp, Homo sapiens
tagatcatatttgtggagaaaa

SEQ ID NO: 7898888 - DNA, 22 bp, Homo sapiens
tagatcatatacttgccatgac

SEQ ID NO: 7898889 - DNA, 22 bp, Homo sapiens
tagatcctgagccctatctact

SEQ ID NO: 7898890 - DNA, 22 bp, Homo sapiens
tagatccagctgttatgttatg

SEQ ID NO: 7898891 - DNA, 22 bp, Homo sapiens
tagatccagctgttatgttatg

SEQ ID NO: 7898892 - DNA, 22 bp, Homo sapiens
tagatcatttgaattgaggtag

SEQ ID NO: 7898893 - DNA, 22 bp, Homo sapiens
tagatcattagcgggggtgaga

SEQ ID NO: 7898894 - DNA, 21 bp, Homo sapiens
tagatcatggtattctttggc

SEQ ID NO: 7898895 - DNA, 21 bp, Homo sapiens
tagatcatggtattctttggc

SEQ ID NO: 7898896 - DNA, 21 bp, Homo sapiens
tagatcatggtattctttggc

SEQ ID NO: 7898897 - DNA, 22 bp, Homo sapiens
tagatcatgggtactgcatatg

SEQ ID NO: 7898898 - DNA, 22 bp, Homo sapiens
tagatcatggagtaaaatggaa

SEQ ID NO: 7898899 - DNA, 22 bp, Homo sapiens
tagatcatgggtactgcatatg

SEQ ID NO: 7898900 - DNA, 22 bp, Homo sapiens
tagatataaggtccttagaaca

SEQ ID NO: 7898901 - DNA, 22 bp, Homo sapiens
tagatataaggtccttagaaca

SEQ ID NO: 7898902 - DNA, 22 bp, Homo sapiens
tagatataaggtccttagaaca

SEQ ID NO: 7898903 - DNA, 22 bp, Homo sapiens
tagatataaggtccttagaaca

SEQ ID NO: 7898904 - DNA, 22 bp, Homo sapiens
tagatataaggtccttagaaca

SEQ ID NO: 7898905 - DNA, 22 bp, Homo sapiens
tagatataaggtccttagaaca

SEQ ID NO: 7898906 - DNA, 22 bp, Homo sapiens
tagatataggacagtactgtat

SEQ ID NO: 7898907 - DNA, 22 bp, Homo sapiens
tagatatggccgtctgttttaa

SEQ ID NO: 7898908 - DNA, 22 bp, Homo sapiens
tagatatcagaaatagaattta

SEQ ID NO: 7898909 - DNA, 22 bp, Homo sapiens
tagatatatctgtcatactggt

SEQ ID NO: 7898910 - DNA, 22 bp, Homo sapiens
tagatatatctgtcatactggt

SEQ ID NO: 7898911 - DNA, 22 bp, Homo sapiens
tagatataggacagtactgtat

SEQ ID NO: 7898912 - DNA, 22 bp, Homo sapiens
tagatatatctgtcatactggt

SEQ ID NO: 7898913 - DNA, 22 bp, Homo sapiens
tagatataggacagtactgtat

SEQ ID NO: 7898914 - DNA, 22 bp, Homo sapiens
tagatataggacagtactgtat

SEQ ID NO: 7898915 - DNA, 22 bp, Homo sapiens
tagagtcagagaatcattacag

SEQ ID NO: 7898916 - DNA, 22 bp, Homo sapiens
tagagaggtttgaattggctgc

SEQ ID NO: 7898917 - DNA, 22 bp, Homo sapiens
tagagtatagctaactgtatta

SEQ ID NO: 7898918 - DNA, 22 bp, Homo sapiens
tagagtaacacaaacgaattgg

SEQ ID NO: 7898919 - DNA, 22 bp, Homo sapiens
tagagtaacacaaacgaattgg

SEQ ID NO: 7898920 - DNA, 22 bp, Homo sapiens
tagagaggtttgaattggctgc

SEQ ID NO: 7898921 - DNA, 22 bp, Homo sapiens
tagagaggtttgaattggctgc

SEQ ID NO: 7898922 - DNA, 22 bp, Homo sapiens
tagagaggccgcgggtcccctc

SEQ ID NO: 7898923 - DNA, 16 bp, Homo sapiens
tagagagggcagggag

SEQ ID NO: 7898924 - DNA, 16 bp, Homo sapiens
tagagagggcagggag

SEQ ID NO: 7898925 - DNA, 16 bp, Homo sapiens
tagagagggcagggag

SEQ ID NO: 7898926 - DNA, 16 bp, Homo sapiens
tagagagggcagggag

SEQ ID NO: 7898927 - DNA, 22 bp, Homo sapiens
tagagaggccgcgggtcccctc

SEQ ID NO: 7898928 - DNA, 22 bp, Homo sapiens
tagagagctgtttgaaagcagg

SEQ ID NO: 7898929 - DNA, 22 bp, Homo sapiens
tagagagccagttgtcatagtt

SEQ ID NO: 7898930 - DNA, 22 bp, Homo sapiens
tagagagccagttgtcatagtt

SEQ ID NO: 7898931 - DNA, 20 bp, Homo sapiens
tagagagatatgggggttcc

SEQ ID NO: 7898932 - DNA, 22 bp, Homo sapiens
tagagacaccagtaccattctg

SEQ ID NO: 7898933 - DNA, 22 bp, Homo sapiens
tagagacagaaagtagaatggt

SEQ ID NO: 7898934 - DNA, 22 bp, Homo sapiens
tagagaatggccttgaagtagt

SEQ ID NO: 7898935 - DNA, 22 bp, Homo sapiens
tagagaatggccttgaagtagt

SEQ ID NO: 7898936 - DNA, 22 bp, Homo sapiens
tagagagagatatatacacaca

SEQ ID NO: 7898937 - DNA, 22 bp, Homo sapiens
tagagagagatatatacacaca

SEQ ID NO: 7898938 - DNA, 22 bp, Homo sapiens
tagagagagctgtggtggctct

SEQ ID NO: 7898939 - DNA, 22 bp, Homo sapiens
tagagagagctgtggtggctct

SEQ ID NO: 7898940 - DNA, 20 bp, Homo sapiens
tagagagaggatattaaagt

SEQ ID NO: 7898941 - DNA, 20 bp, Homo sapiens
tagagagaggatattaaagt

SEQ ID NO: 7898942 - DNA, 20 bp, Homo sapiens
tagagagaggatattaaagt

SEQ ID NO: 7898943 - DNA, 20 bp, Homo sapiens
tagagagatatgggggttcc

SEQ ID NO: 7898944 - DNA, 22 bp, Homo sapiens
tagagaaacagaaccaacaggg

SEQ ID NO: 7898945 - DNA, 22 bp, Homo sapiens
tagagaaacagaaccaacaggg

SEQ ID NO: 7898946 - DNA, 22 bp, Homo sapiens
tagagaaacagaaccaacaggg

SEQ ID NO: 7898947 - DNA, 22 bp, Homo sapiens
tagagaaaagcagggatcagga

SEQ ID NO: 7898948 - DNA, 21 bp, Homo sapiens
tagagaaaagaagctgttcct

SEQ ID NO: 7898949 - DNA, 22 bp, Homo sapiens
tagagaaaagcagggatcagga

SEQ ID NO: 7898950 - DNA, 22 bp, Homo sapiens
tagagaaaagcagggatcagga

SEQ ID NO: 7898951 - DNA, 22 bp, Homo sapiens
tagagaaaagcagggatcagga

SEQ ID NO: 7898952 - DNA, 22 bp, Homo sapiens
tagagaaataagctttgccttg

SEQ ID NO: 7898953 - DNA, 22 bp, Homo sapiens
tagagaaataagctttgccttg

SEQ ID NO: 7898954 - DNA, 22 bp, Homo sapiens
tagagaaacagaaccaacaggg

SEQ ID NO: 7898955 - DNA, 23 bp, Homo sapiens
tagagaaagccaccgagtctctc

SEQ ID NO: 7898956 - DNA, 23 bp, Homo sapiens
tagagaaagccaccgagtctctc

SEQ ID NO: 7898957 - DNA, 20 bp, Homo sapiens
tagacttttcatcaacctta

SEQ ID NO: 7898958 - DNA, 22 bp, Homo sapiens
tagacttttcaaaatctagacc

SEQ ID NO: 7898959 - DNA, 22 bp, Homo sapiens
tagacttttcaaaatctagacc

SEQ ID NO: 7898960 - DNA, 22 bp, Homo sapiens
tagagaaaaccactggtgagct

SEQ ID NO: 7898961 - DNA, 22 bp, Homo sapiens
tagactttgatattgtacaccc

SEQ ID NO: 7898962 - DNA, 22 bp, Homo sapiens
tagactttgatattgtacaccc

SEQ ID NO: 7898963 - DNA, 22 bp, Homo sapiens
tagagaaaaccactggtgagct

SEQ ID NO: 7898964 - DNA, 22 bp, Homo sapiens
tagagaaaaccactggtgagct

SEQ ID NO: 7898965 - DNA, 21 bp, Homo sapiens
tagagaaaagaagctgttcct

SEQ ID NO: 7898966 - DNA, 21 bp, Homo sapiens
tagagaaaagaagctgttcct

SEQ ID NO: 7898967 - DNA, 21 bp, Homo sapiens
tagagaaaagaagctgttcct

SEQ ID NO: 7898968 - DNA, 22 bp, Homo sapiens
tagagaaaagcagggatcagga

SEQ ID NO: 7898969 - DNA, 22 bp, Homo sapiens
tagaagaaagtgaagctgggga

SEQ ID NO: 7898970 - DNA, 22 bp, Homo sapiens
tagaagaaagtgaagctgggga

SEQ ID NO: 7898971 - DNA, 22 bp, Homo sapiens
tagaagaaagtgaagctgggga

SEQ ID NO: 7898972 - DNA, 22 bp, Homo sapiens
tagaagaaaagcacttagagat

SEQ ID NO: 7898973 - DNA, 20 bp, Homo sapiens
tagaacttttcagtatggat

SEQ ID NO: 7898974 - DNA, 22 bp, Homo sapiens
tagaactttcagaaattccaaa

SEQ ID NO: 7898975 - DNA, 22 bp, Homo sapiens
tagaagagacatagcctgtggt

SEQ ID NO: 7898976 - DNA, 22 bp, Homo sapiens
tagaagacaggaaatacaaacc

SEQ ID NO: 7898977 - DNA, 22 bp, Homo sapiens
tagaagacaggaaatacaaacc

SEQ ID NO: 7898978 - DNA, 22 bp, Homo sapiens
tagaagaacatgtcaaactata

SEQ ID NO: 7898979 - DNA, 22 bp, Homo sapiens
tagaagaacatgtcaaactata

SEQ ID NO: 7898980 - DNA, 22 bp, Homo sapiens
tagaagaacatgtcaaactata

SEQ ID NO: 7898981 - DNA, 22 bp, Homo sapiens
tagaagaacatgtcaaactata

SEQ ID NO: 7898982 - DNA, 22 bp, Homo sapiens
tagaagattcatttcctctgaa

SEQ ID NO: 7898983 - DNA, 22 bp, Homo sapiens
tagaagattccagaggcaaagc

SEQ ID NO: 7898984 - DNA, 22 bp, Homo sapiens
tagaagattccagaggcaaagc

SEQ ID NO: 7898985 - DNA, 22 bp, Homo sapiens
tagaagattctaaagtggagag

SEQ ID NO: 7898986 - DNA, 22 bp, Homo sapiens
tagaagatgccttaaagttgaa

SEQ ID NO: 7898987 - DNA, 22 bp, Homo sapiens
tagaagataagacaagtgctgc

SEQ ID NO: 7898988 - DNA, 21 bp, Homo sapiens
tagaagcacataggttcaaag

SEQ ID NO: 7898989 - DNA, 22 bp, Homo sapiens
tagaagcacaggttaaaggcat

SEQ ID NO: 7898990 - DNA, 22 bp, Homo sapiens
tagacagatttaaaggaatgga

SEQ ID NO: 7898991 - DNA, 21 bp, Homo sapiens
tagaagcacataggttcaaag

SEQ ID NO: 7898992 - DNA, 22 bp, Homo sapiens
tagaagcacagcctgatggaca

SEQ ID NO: 7898993 - DNA, 22 bp, Homo sapiens
tagaagcacaggttaaaggcat

SEQ ID NO: 7898994 - DNA, 22 bp, Homo sapiens
tagaagcacagcctgatggaca

SEQ ID NO: 7898995 - DNA, 22 bp, Homo sapiens
tagaagcacagcctgatggaca

SEQ ID NO: 7898996 - DNA, 19 bp, Homo sapiens
tagactctaatgttaagct

SEQ ID NO: 7898997 - DNA, 22 bp, Homo sapiens
tagactcagacagaaaatgtgt

SEQ ID NO: 7898998 - DNA, 23 bp, Homo sapiens
tagactgcaggctccttgagggc

SEQ ID NO: 7898999 - DNA, 22 bp, Homo sapiens
tagactatttcttttgcatagg

SEQ ID NO: 7899000 - DNA, 22 bp, Homo sapiens
tagactcagacagaaaatgtgt

SEQ ID NO: 7899001 - DNA, 22 bp, Homo sapiens
tagactagaggatcagcaaggg

SEQ ID NO: 7899002 - DNA, 22 bp, Homo sapiens
tagactagaggatcagcaaggg

SEQ ID NO: 7899003 - DNA, 22 bp, Homo sapiens
tagactggtgaattagggggaa

SEQ ID NO: 7899004 - DNA, 22 bp, Homo sapiens
tagactggtgaattagggggaa

SEQ ID NO: 7899005 - DNA, 22 bp, Homo sapiens
tagactgtgagctccttgaggg

SEQ ID NO: 7899006 - DNA, 22 bp, Homo sapiens
tagactgttacagcttttcaga

SEQ ID NO: 7899007 - DNA, 22 bp, Homo sapiens
tagactggtgaattagggggaa

SEQ ID NO: 7899008 - DNA, 22 bp, Homo sapiens
tagactggtgaattagggggaa

SEQ ID NO: 7899009 - DNA, 22 bp, Homo sapiens
tagactggtgaattagggggaa

SEQ ID NO: 7899010 - DNA, 22 bp, Homo sapiens
tagacaggagtcaggctagaat

SEQ ID NO: 7899011 - DNA, 22 bp, Homo sapiens
tagacaggaaacattaggatgg

SEQ ID NO: 7899012 - DNA, 21 bp, Homo sapiens
tagaccagctgtgctcctcgg

SEQ ID NO: 7899013 - DNA, 22 bp, Homo sapiens
tagaccagaattgtcagcacct

SEQ ID NO: 7899014 - DNA, 22 bp, Homo sapiens
tagaccagaacttgtcacctgg

SEQ ID NO: 7899015 - DNA, 22 bp, Homo sapiens
tagacagatttcttgttagaca

SEQ ID NO: 7899016 - DNA, 22 bp, Homo sapiens
tagacaggaaacattaggatgg

SEQ ID NO: 7899017 - DNA, 22 bp, Homo sapiens
tagaccattttacaatagtgtg

SEQ ID NO: 7899018 - DNA, 22 bp, Homo sapiens
tagaccaggttgaccaggtagg

SEQ ID NO: 7899019 - DNA, 22 bp, Homo sapiens
tagaccaggcccacacacgggg

SEQ ID NO: 7899020 - DNA, 22 bp, Homo sapiens
tagacctgcagacctgggcccc

SEQ ID NO: 7899021 - DNA, 22 bp, Homo sapiens
tagacctgaaatatggacctgg

SEQ ID NO: 7899022 - DNA, 22 bp, Homo sapiens
tagaccattttacaatagtgtg

SEQ ID NO: 7899023 - DNA, 22 bp, Homo sapiens
tagactagaggatcagcaaggg

SEQ ID NO: 7899024 - DNA, 22 bp, Homo sapiens
tagaacatttgtagcagctgag

SEQ ID NO: 7899025 - DNA, 22 bp, Homo sapiens
tagaaccaccttctcctttacc

SEQ ID NO: 7899026 - DNA, 22 bp, Homo sapiens
tagaacatgtgaaaatatagcc

SEQ ID NO: 7899027 - DNA, 22 bp, Homo sapiens
tagaacatgggatagagttttt

SEQ ID NO: 7899028 - DNA, 22 bp, Homo sapiens
tagaacatgctcatgtataaat

SEQ ID NO: 7899029 - DNA, 22 bp, Homo sapiens
tagaacatgtgaaaatatagcc

SEQ ID NO: 7899030 - DNA, 22 bp, Homo sapiens
tagaacatgtgaaaatatagcc

SEQ ID NO: 7899031 - DNA, 22 bp, Homo sapiens
tagaacatgggatagagttttt

SEQ ID NO: 7899032 - DNA, 22 bp, Homo sapiens
tagaacatgctcatgtataaat

SEQ ID NO: 7899033 - DNA, 22 bp, Homo sapiens
tagaacatgacttatttttgga

SEQ ID NO: 7899034 - DNA, 23 bp, Homo sapiens
tagaacatcggtgtcttggagca

SEQ ID NO: 7899035 - DNA, 23 bp, Homo sapiens
tagaacatcggtgtcttggagca

SEQ ID NO: 7899036 - DNA, 22 bp, Homo sapiens
tagaacatgacttatttttgga

SEQ ID NO: 7899037 - DNA, 22 bp, Homo sapiens
tagaacatcaggttgaatttgg

SEQ ID NO: 7899038 - DNA, 23 bp, Homo sapiens
tagaacatcggtgtcttggagca

SEQ ID NO: 7899039 - DNA, 22 bp, Homo sapiens
tagaaatggggaagtagttagg

SEQ ID NO: 7899040 - DNA, 22 bp, Homo sapiens
tagaaatggggaagtagttagg

SEQ ID NO: 7899041 - DNA, 22 bp, Homo sapiens
tagaaatggggaagtagttagg

SEQ ID NO: 7899042 - DNA, 22 bp, Homo sapiens
tacttacattagcaaacaaggt

SEQ ID NO: 7899043 - DNA, 22 bp, Homo sapiens
tacttacatgaattcaagagca

SEQ ID NO: 7899044 - DNA, 22 bp, Homo sapiens
tacttacattagcaaacaaggt

SEQ ID NO: 7899045 - DNA, 22 bp, Homo sapiens
tagaaatgggttacatttagag

SEQ ID NO: 7899046 - DNA, 22 bp, Homo sapiens
tagaaatgggttacatttagag

SEQ ID NO: 7899047 - DNA, 22 bp, Homo sapiens
tagaaatgtaggcttcctgaca

SEQ ID NO: 7899048 - DNA, 22 bp, Homo sapiens
tagaaatggggaagtagttagg

SEQ ID NO: 7899049 - DNA, 22 bp, Homo sapiens
tagaaatgggttacatttagag

SEQ ID NO: 7899050 - DNA, 22 bp, Homo sapiens
tagaaatgggttacatttagag

SEQ ID NO: 7899051 - DNA, 22 bp, Homo sapiens
tagaaatgggttacatttagag

SEQ ID NO: 7899052 - DNA, 22 bp, Homo sapiens
tagaacctctgattatgttact

SEQ ID NO: 7899053 - DNA, 19 bp, Homo sapiens
tagaacctggatttcagga

SEQ ID NO: 7899054 - DNA, 22 bp, Homo sapiens
tagaactaagagttatcattta

SEQ ID NO: 7899055 - DNA, 22 bp, Homo sapiens
tagaaccagtccacagaatttg

SEQ ID NO: 7899056 - DNA, 22 bp, Homo sapiens
tagaacctattagaaatgtatt

SEQ ID NO: 7899057 - DNA, 22 bp, Homo sapiens
tagaaccagtccacagaatttg

SEQ ID NO: 7899058 - DNA, 22 bp, Homo sapiens
tagaaccagtccacagaatttg

SEQ ID NO: 7899059 - DNA, 22 bp, Homo sapiens
tagaacctcataagaatcgaaa

SEQ ID NO: 7899060 - DNA, 22 bp, Homo sapiens
tagaacctccacaggacctcca

SEQ ID NO: 7899061 - DNA, 22 bp, Homo sapiens
tagaacctccagagtggccccc

SEQ ID NO: 7899062 - DNA, 22 bp, Homo sapiens
tagaactagaacaaggatttga

SEQ ID NO: 7899063 - DNA, 21 bp, Homo sapiens
tagaactgacgatttcagagt

SEQ ID NO: 7899064 - DNA, 22 bp, Homo sapiens
tagaactgacgttagggaagaa

SEQ ID NO: 7899065 - DNA, 19 bp, Homo sapiens
tagaactgaggacttgcat

SEQ ID NO: 7899066 - DNA, 22 bp, Homo sapiens
tagaactctggtcttctcatcc

SEQ ID NO: 7899067 - DNA, 21 bp, Homo sapiens
tagaactgacgatttcagagt

SEQ ID NO: 7899068 - DNA, 22 bp, Homo sapiens
tagaactgctctcatacttgct

SEQ ID NO: 7899069 - DNA, 22 bp, Homo sapiens
tagaacttgagatcaggtcttc

SEQ ID NO: 7899070 - DNA, 22 bp, Homo sapiens
tagaacttgaatgtgaaatcag

SEQ ID NO: 7899071 - DNA, 22 bp, Homo sapiens
tagaacttgatagacagtacaa

SEQ ID NO: 7899072 - DNA, 22 bp, Homo sapiens
tagaacttgtgaaatatcaatg

SEQ ID NO: 7899073 - DNA, 22 bp, Homo sapiens
tagaacttattagaaaggctca

SEQ ID NO: 7899074 - DNA, 22 bp, Homo sapiens
tagaacttatttggcattattt

SEQ ID NO: 7899075 - DNA, 22 bp, Homo sapiens
tagaacttcttacagctaagtt

SEQ ID NO: 7899076 - DNA, 22 bp, Homo sapiens
tagaacttccaattcagggctg

SEQ ID NO: 7899077 - DNA, 22 bp, Homo sapiens
tagaactgtccaagtctgagct

SEQ ID NO: 7899078 - DNA, 22 bp, Homo sapiens
tagaactggaattttgtggttt

SEQ ID NO: 7899079 - DNA, 22 bp, Homo sapiens
tagaactggcggctagaccact

SEQ ID NO: 7899080 - DNA, 22 bp, Homo sapiens
tagaacttagcactagacttgt

SEQ ID NO: 7899081 - DNA, 22 bp, Homo sapiens
tagaacttagcactagacttgt

SEQ ID NO: 7899082 - DNA, 22 bp, Homo sapiens
tagaacttaaatatgttttccc

SEQ ID NO: 7899083 - DNA, 22 bp, Homo sapiens
tagctggggctttcattcttgc

SEQ ID NO: 7899084 - DNA, 22 bp, Homo sapiens
tagctggggctttcattcttgc

SEQ ID NO: 7899085 - DNA, 22 bp, Homo sapiens
tagctgggtctctgttttctca

SEQ ID NO: 7899086 - DNA, 22 bp, Homo sapiens
tagctgggtctctgttttctca

SEQ ID NO: 7899087 - DNA, 22 bp, Homo sapiens
tagctgggtctctgttttctca

SEQ ID NO: 7899088 - DNA, 22 bp, Homo sapiens
tagctggtcctcagctccagcc

SEQ ID NO: 7899089 - DNA, 22 bp, Homo sapiens
tagctggtctttaagcatgtaa

SEQ ID NO: 7899090 - DNA, 22 bp, Homo sapiens
tagctggtctttaagcatgtaa

SEQ ID NO: 7899091 - DNA, 22 bp, Homo sapiens
tagctgggttgaggtcatctac

SEQ ID NO: 7899092 - DNA, 22 bp, Homo sapiens
tagctgggagtgtctgatgggt

SEQ ID NO: 7899093 - DNA, 22 bp, Homo sapiens
tagctgggagtgtctgatgggt

SEQ ID NO: 7899094 - DNA, 22 bp, Homo sapiens
tagctgggactactggccctgc

SEQ ID NO: 7899095 - DNA, 22 bp, Homo sapiens
tagctgggaattatctggttgc

SEQ ID NO: 7899096 - DNA, 22 bp, Homo sapiens
tagctgggactactggccctgc

SEQ ID NO: 7899097 - DNA, 22 bp, Homo sapiens
tagctgggagtgtctgatgggt

SEQ ID NO: 7899098 - DNA, 22 bp, Homo sapiens
tagctgggagtgtctgatgggt

SEQ ID NO: 7899099 - DNA, 22 bp, Homo sapiens
tagctgtgaaacagcagaagag

SEQ ID NO: 7899100 - DNA, 22 bp, Homo sapiens
tagctgtgaaacagcagaagag

SEQ ID NO: 7899101 - DNA, 22 bp, Homo sapiens
tagctggttctccaggagctag

SEQ ID NO: 7899102 - DNA, 22 bp, Homo sapiens
tagctggttctccaggagctag

SEQ ID NO: 7899103 - DNA, 22 bp, Homo sapiens
tagctgtcaccagaaatggcca

SEQ ID NO: 7899104 - DNA, 22 bp, Homo sapiens
tagctgtacaaacttgtgcaag

SEQ ID NO: 7899105 - DNA, 22 bp, Homo sapiens
tagctgtggagcagaggtctcc

SEQ ID NO: 7899106 - DNA, 22 bp, Homo sapiens
tagctgtggagcagaggtctcc

SEQ ID NO: 7899107 - DNA, 22 bp, Homo sapiens
tagctgtggccttgctggtctg

SEQ ID NO: 7899108 - DNA, 22 bp, Homo sapiens
tagctgtggagcagaggtctcc

SEQ ID NO: 7899109 - DNA, 22 bp, Homo sapiens
tagctgtgcccgccacccaacg

SEQ ID NO: 7899110 - DNA, 22 bp, Homo sapiens
tagctgtgcccagggaagttgt

SEQ ID NO: 7899111 - DNA, 22 bp, Homo sapiens
tagctgtgcccgccacccaacg

SEQ ID NO: 7899112 - DNA, 22 bp, Homo sapiens
tagctgtgcccagggaagttgt

SEQ ID NO: 7899113 - DNA, 22 bp, Homo sapiens
tagctgtgacgtatctctatgg

SEQ ID NO: 7899114 - DNA, 21 bp, Homo sapiens
tagctgtgcaactttgggcaa

SEQ ID NO: 7899115 - DNA, 21 bp, Homo sapiens
tagctgtgcaactttgggcaa

SEQ ID NO: 7899116 - DNA, 22 bp, Homo sapiens
tagctgtgagcacccaggctgt

SEQ ID NO: 7899117 - DNA, 22 bp, Homo sapiens
tagctgtgagcacccaggctgt

SEQ ID NO: 7899118 - DNA, 22 bp, Homo sapiens
tagctgtgagcacccaggctgt

SEQ ID NO: 7899119 - DNA, 22 bp, Homo sapiens
tagctgtgaagagctaaaaaat

SEQ ID NO: 7899120 - DNA, 22 bp, Homo sapiens
tagctgtgaaacagcagaagag

SEQ ID NO: 7899121 - DNA, 22 bp, Homo sapiens
tagctgtgaagagctaaaaaat

SEQ ID NO: 7899122 - DNA, 22 bp, Homo sapiens
tagctgtgacgtatctctatgg

SEQ ID NO: 7899123 - DNA, 22 bp, Homo sapiens
taggcagaattgttgaatgaag

SEQ ID NO: 7899124 - DNA, 22 bp, Homo sapiens
taggcagaattcattgtgctgc

SEQ ID NO: 7899125 - DNA, 22 bp, Homo sapiens
taggcagaattgtgggctctaa

SEQ ID NO: 7899126 - DNA, 22 bp, Homo sapiens
taggcagagaggccataagaat

SEQ ID NO: 7899127 - DNA, 22 bp, Homo sapiens
taggcagaattgttgaatgaag

SEQ ID NO: 7899128 - DNA, 22 bp, Homo sapiens
taggcagaattgttgaatgaag

SEQ ID NO: 7899129 - DNA, 22 bp, Homo sapiens
taggcagaattcattgtgctgc

SEQ ID NO: 7899130 - DNA, 22 bp, Homo sapiens
taggcagaattgtgggctctaa

SEQ ID NO: 7899131 - DNA, 22 bp, Homo sapiens
taggcagagaggccataagaat

SEQ ID NO: 7899132 - DNA, 20 bp, Homo sapiens
taggcagagctgtgcagcct

SEQ ID NO: 7899133 - DNA, 22 bp, Homo sapiens
taggcagagaggccataagaat

SEQ ID NO: 7899134 - DNA, 20 bp, Homo sapiens
taggcagagctgtgcagcct

SEQ ID NO: 7899135 - DNA, 20 bp, Homo sapiens
taggcagagctgtgcagcct

SEQ ID NO: 7899136 - DNA, 20 bp, Homo sapiens
taggcagagctgtgcagcct

SEQ ID NO: 7899137 - DNA, 22 bp, Homo sapiens
taggcagagaggccataagaat

SEQ ID NO: 7899138 - DNA, 20 bp, Homo sapiens
taggcagagctgtgcagcct

SEQ ID NO: 7899139 - DNA, 22 bp, Homo sapiens
tagctgtgtaacatgagaatgt

SEQ ID NO: 7899140 - DNA, 22 bp, Homo sapiens
tagctgtgtaacatgagaatgt

SEQ ID NO: 7899141 - DNA, 22 bp, Homo sapiens
tagctgtgtaagcttggtaaga

SEQ ID NO: 7899142 - DNA, 23 bp, Homo sapiens
tagctgtggcgtaaggctcagct

SEQ ID NO: 7899143 - DNA, 22 bp, Homo sapiens
tagctgtgtaagcttggtaaga

SEQ ID NO: 7899144 - DNA, 23 bp, Homo sapiens
tagctgtggcgtaaggctcagct

SEQ ID NO: 7899145 - DNA, 22 bp, Homo sapiens
tagctgtggccttgctggtctg

SEQ ID NO: 7899146 - DNA, 22 bp, Homo sapiens
tagctgtgtaacatgagaatgt

SEQ ID NO: 7899147 - DNA, 23 bp, Homo sapiens
tagctgtggcgtaaggctcagct

SEQ ID NO: 7899148 - DNA, 22 bp, Homo sapiens
tagctgtgtagacactcagagc

SEQ ID NO: 7899149 - DNA, 22 bp, Homo sapiens
tagctgtgtaagcttggtaaga

SEQ ID NO: 7899150 - DNA, 22 bp, Homo sapiens
tagctgtgtgatgggaaacctt

SEQ ID NO: 7899151 - DNA, 22 bp, Homo sapiens
tagctgtgtatggtttacaaat

SEQ ID NO: 7899152 - DNA, 22 bp, Homo sapiens
tagctgtgtatggtttacaaat

SEQ ID NO: 7899153 - DNA, 22 bp, Homo sapiens
tagctgtgtatggtttacaaat

SEQ ID NO: 7899154 - DNA, 22 bp, Homo sapiens
tagctgtgtagacactcagagc

SEQ ID NO: 7899155 - DNA, 17 bp, Homo sapiens
tagctgtgtttcagcta

SEQ ID NO: 7899156 - DNA, 22 bp, Homo sapiens
tagctgtgtgtccttgggcaaa

SEQ ID NO: 7899157 - DNA, 22 bp, Homo sapiens
tagctgtgtgtccttgggcaaa

SEQ ID NO: 7899158 - DNA, 22 bp, Homo sapiens
tagctgtgtgatgggaaacctt

SEQ ID NO: 7899159 - DNA, 17 bp, Homo sapiens
tagctgtgtttcagcta

SEQ ID NO: 7899160 - DNA, 17 bp, Homo sapiens
tagctgtgtttcagcta

SEQ ID NO: 7899161 - DNA, 22 bp, Homo sapiens
tagctgttacccataaaagcca

SEQ ID NO: 7899162 - DNA, 22 bp, Homo sapiens
taggcagaaaggaaggcaagtt

SEQ ID NO: 7899163 - DNA, 22 bp, Homo sapiens
taggcaggctgaatgtagattt

SEQ ID NO: 7899164 - DNA, 22 bp, Homo sapiens
taggcaggctgaatgtagattt

SEQ ID NO: 7899165 - DNA, 22 bp, Homo sapiens
taggccagattactagagtagg

SEQ ID NO: 7899166 - DNA, 22 bp, Homo sapiens
taggcagggattagggttgatt

SEQ ID NO: 7899167 - DNA, 22 bp, Homo sapiens
taggccagattactagagtagg

SEQ ID NO: 7899168 - DNA, 22 bp, Homo sapiens
taggccagattactagagtagg

SEQ ID NO: 7899169 - DNA, 22 bp, Homo sapiens
taggccaggaatcagcaagctt

SEQ ID NO: 7899170 - DNA, 22 bp, Homo sapiens
taggccaggaatcagcaagctt

SEQ ID NO: 7899171 - DNA, 22 bp, Homo sapiens
taggccagcccttagtcctgtc

SEQ ID NO: 7899172 - DNA, 22 bp, Homo sapiens
taggccagattgttatccatgg

SEQ ID NO: 7899173 - DNA, 22 bp, Homo sapiens
taggccagattgttatccatgg

SEQ ID NO: 7899174 - DNA, 22 bp, Homo sapiens
taggccagcccttagtcctgtc

SEQ ID NO: 7899175 - DNA, 22 bp, Homo sapiens
taggccaggacagagcttccag

SEQ ID NO: 7899176 - DNA, 22 bp, Homo sapiens
taggccaggagtcagacagatt

SEQ ID NO: 7899177 - DNA, 22 bp, Homo sapiens
taggccaggacagagcttccag

SEQ ID NO: 7899178 - DNA, 23 bp, Homo sapiens
taggccagggtgacctggggaga

SEQ ID NO: 7899179 - DNA, 22 bp, Homo sapiens
taggccaggagtcagacagatt

SEQ ID NO: 7899180 - DNA, 23 bp, Homo sapiens
taggccagggtgacctggggaga

SEQ ID NO: 7899181 - DNA, 22 bp, Homo sapiens
taggccagttggtggccctgga

SEQ ID NO: 7899182 - DNA, 22 bp, Homo sapiens
taggccagttggtggccctgga

SEQ ID NO: 7899183 - DNA, 22 bp, Homo sapiens
taggccagtggcaggttgtgtg

SEQ ID NO: 7899184 - DNA, 22 bp, Homo sapiens
taggccagtggcaggttgtgtg

SEQ ID NO: 7899185 - DNA, 18 bp, Homo sapiens
taggccagtatacttttc

SEQ ID NO: 7899186 - DNA, 22 bp, Homo sapiens
taggccagtaaaatgtttcagt

SEQ ID NO: 7899187 - DNA, 23 bp, Homo sapiens
taggccagggtgacctggggaga

SEQ ID NO: 7899188 - DNA, 22 bp, Homo sapiens
taggccaggacagagcttccag

SEQ ID NO: 7899189 - DNA, 22 bp, Homo sapiens
taggcagatgttaacaggaaaa

SEQ ID NO: 7899190 - DNA, 22 bp, Homo sapiens
taggcagatgttaacaggaaaa

SEQ ID NO: 7899191 - DNA, 22 bp, Homo sapiens
taggcagatgttaacaggaaaa

SEQ ID NO: 7899192 - DNA, 22 bp, Homo sapiens
taggcagagtttaatggttaag

SEQ ID NO: 7899193 - DNA, 22 bp, Homo sapiens
taggcagattccatattttggc

SEQ ID NO: 7899194 - DNA, 22 bp, Homo sapiens
taggcagattccatattttggc

SEQ ID NO: 7899195 - DNA, 22 bp, Homo sapiens
taggcagatgttaacaggaaaa

SEQ ID NO: 7899196 - DNA, 22 bp, Homo sapiens
taggcagattccatattttggc

SEQ ID NO: 7899197 - DNA, 22 bp, Homo sapiens
taggcagatgttaacaggaaaa

SEQ ID NO: 7899198 - DNA, 22 bp, Homo sapiens
taggcagagtttaatggttaag

SEQ ID NO: 7899199 - DNA, 22 bp, Homo sapiens
taggcagagtttaatggttaag

SEQ ID NO: 7899200 - DNA, 22 bp, Homo sapiens
taggcagaggtatggtaaggac

SEQ ID NO: 7899201 - DNA, 22 bp, Homo sapiens
taggcagaggtatggtaaggac

SEQ ID NO: 7899202 - DNA, 22 bp, Homo sapiens
taggcagaggtatggtaaggac

SEQ ID NO: 7899203 - DNA, 21 bp, Homo sapiens
taggcagaggagcaggtatct

SEQ ID NO: 7899204 - DNA, 21 bp, Homo sapiens
taggcagaggagcaggtatct

SEQ ID NO: 7899205 - DNA, 21 bp, Homo sapiens
taggcagaggagcaggtatct

SEQ ID NO: 7899206 - DNA, 21 bp, Homo sapiens
taggcagaggagcaggtatct

SEQ ID NO: 7899207 - DNA, 23 bp, Homo sapiens
taggcaggactcagatatgacag

SEQ ID NO: 7899208 - DNA, 22 bp, Homo sapiens
taggcagcttaggttagaagtg

SEQ ID NO: 7899209 - DNA, 20 bp, Homo sapiens
taggcagcttgacccttggt

SEQ ID NO: 7899210 - DNA, 22 bp, Homo sapiens
taggcagcttaggttagaagtg

SEQ ID NO: 7899211 - DNA, 22 bp, Homo sapiens
taggcaggctgaatgtagattt

SEQ ID NO: 7899212 - DNA, 23 bp, Homo sapiens
taggcaggactcagatatgacag

SEQ ID NO: 7899213 - DNA, 23 bp, Homo sapiens
taggcaggactcagatatgacag

SEQ ID NO: 7899214 - DNA, 20 bp, Homo sapiens
taggcagcttgacccttggt

SEQ ID NO: 7899215 - DNA, 22 bp, Homo sapiens
taggcagctgcaaacttcggtc

SEQ ID NO: 7899216 - DNA, 22 bp, Homo sapiens
taggcagctgcaaacttcggtc

SEQ ID NO: 7899217 - DNA, 22 bp, Homo sapiens
taggcagcgcttggctgtgctt

SEQ ID NO: 7899218 - DNA, 22 bp, Homo sapiens
taggcagccagcatcagttggg

SEQ ID NO: 7899219 - DNA, 22 bp, Homo sapiens
taggcagcgcttggctgtgctt

SEQ ID NO: 7899220 - DNA, 22 bp, Homo sapiens
taggcagcatggattctgaata

SEQ ID NO: 7899221 - DNA, 22 bp, Homo sapiens
taggcagattccatattttggc

SEQ ID NO: 7899222 - DNA, 22 bp, Homo sapiens
taggcagcagtgctatgattct

SEQ ID NO: 7899223 - DNA, 22 bp, Homo sapiens
tagggctgaggcaacaagggag

SEQ ID NO: 7899224 - DNA, 22 bp, Homo sapiens
tagggctgaggcaacaagggag

SEQ ID NO: 7899225 - DNA, 21 bp, Homo sapiens
tagggctctatttttatttca

SEQ ID NO: 7899226 - DNA, 23 bp, Homo sapiens
tagggcagctgggagggacatgc

SEQ ID NO: 7899227 - DNA, 23 bp, Homo sapiens
tagggcagctgggagggacatgc

SEQ ID NO: 7899228 - DNA, 23 bp, Homo sapiens
tagggcagctgggagggacatgc

SEQ ID NO: 7899229 - DNA, 23 bp, Homo sapiens
tagggcagctgggagggacatgc

SEQ ID NO: 7899230 - DNA, 23 bp, Homo sapiens
tagggcagctgggagggacatgc

SEQ ID NO: 7899231 - DNA, 23 bp, Homo sapiens
tagggcagctgggagggacatgc

SEQ ID NO: 7899232 - DNA, 23 bp, Homo sapiens
tagggcagctgggagggacatgc

SEQ ID NO: 7899233 - DNA, 23 bp, Homo sapiens
tagggcagctgggagggacatgc

SEQ ID NO: 7899234 - DNA, 22 bp, Homo sapiens
tagggcagctgcatcaggcact

SEQ ID NO: 7899235 - DNA, 22 bp, Homo sapiens
tagggcagctgcatcaggcact

SEQ ID NO: 7899236 - DNA, 22 bp, Homo sapiens
tagggcagctgcatcaggcact

SEQ ID NO: 7899237 - DNA, 23 bp, Homo sapiens
tagggcagctgggagggacatgc

SEQ ID NO: 7899238 - DNA, 22 bp, Homo sapiens
tagggcagccttatagctccca

SEQ ID NO: 7899239 - DNA, 22 bp, Homo sapiens
tagggcagccttatagctccca

SEQ ID NO: 7899240 - DNA, 22 bp, Homo sapiens
tagggcagccttatagctccca

SEQ ID NO: 7899241 - DNA, 22 bp, Homo sapiens
tagggcagctgcatcaggcact

SEQ ID NO: 7899242 - DNA, 22 bp, Homo sapiens
tagggcagccttatagctccca

SEQ ID NO: 7899243 - DNA, 22 bp, Homo sapiens
tagggcagccacccaggctgct

SEQ ID NO: 7899244 - DNA, 22 bp, Homo sapiens
tagggcagccacccaggctgct

SEQ ID NO: 7899245 - DNA, 22 bp, Homo sapiens
tagggcagccacccaggctgct

SEQ ID NO: 7899246 - DNA, 22 bp, Homo sapiens
tagggcagccacccaggctgct

SEQ ID NO: 7899247 - DNA, 22 bp, Homo sapiens
tagggcagccacccaggctgct

SEQ ID NO: 7899248 - DNA, 22 bp, Homo sapiens
tagggcagattcggtggagttt

SEQ ID NO: 7899249 - DNA, 22 bp, Homo sapiens
tagggcagccacccaggctgct

SEQ ID NO: 7899250 - DNA, 22 bp, Homo sapiens
tagggcagattcggtggagttt

SEQ ID NO: 7899251 - DNA, 22 bp, Homo sapiens
tagggcagattcggtggagttt

SEQ ID NO: 7899252 - DNA, 22 bp, Homo sapiens
tagggcagattcggtggagttt

SEQ ID NO: 7899253 - DNA, 22 bp, Homo sapiens
tagggcagattcggtggagttt

SEQ ID NO: 7899254 - DNA, 22 bp, Homo sapiens
tagggcagccacccaggctgct

SEQ ID NO: 7899255 - DNA, 22 bp, Homo sapiens
tagggcagattcggtggagttt

SEQ ID NO: 7899256 - DNA, 22 bp, Homo sapiens
tagggcagagtccaggatgggc

SEQ ID NO: 7899257 - DNA, 22 bp, Homo sapiens
tagggcagagtccaggatgggc

SEQ ID NO: 7899258 - DNA, 22 bp, Homo sapiens
tagggcagagtccaggatgggc

SEQ ID NO: 7899259 - DNA, 22 bp, Homo sapiens
tagggcagagtccaggatgggc

SEQ ID NO: 7899260 - DNA, 22 bp, Homo sapiens
taggccattgatttttataagt

SEQ ID NO: 7899261 - DNA, 22 bp, Homo sapiens
tagggcagagtccaggatgggc

SEQ ID NO: 7899262 - DNA, 22 bp, Homo sapiens
tagggcagagtccaggatgggc

SEQ ID NO: 7899263 - DNA, 22 bp, Homo sapiens
tagggcagattcggtggagttt

SEQ ID NO: 7899264 - DNA, 22 bp, Homo sapiens
tagggcagagtccaggatgggc

SEQ ID NO: 7899265 - DNA, 22 bp, Homo sapiens
tagggctgctgcagatgacagg

SEQ ID NO: 7899266 - DNA, 22 bp, Homo sapiens
tagggctgctgcagatgacagg

SEQ ID NO: 7899267 - DNA, 22 bp, Homo sapiens
tagggctgctttgtattctgct

SEQ ID NO: 7899268 - DNA, 19 bp, Homo sapiens
tagggctggccgggcggtg

SEQ ID NO: 7899269 - DNA, 22 bp, Homo sapiens
tagggctgctttgtattctgct

SEQ ID NO: 7899270 - DNA, 22 bp, Homo sapiens
tagggctgctttgtattctgct

SEQ ID NO: 7899271 - DNA, 22 bp, Homo sapiens
tagggctggcgtgctcagggaa

SEQ ID NO: 7899272 - DNA, 22 bp, Homo sapiens
tagggctggcgtgctcagggaa

SEQ ID NO: 7899273 - DNA, 19 bp, Homo sapiens
tagggctggccgggcggtg

SEQ ID NO: 7899274 - DNA, 19 bp, Homo sapiens
tagggctggccgggcggtg

SEQ ID NO: 7899275 - DNA, 22 bp, Homo sapiens
tagggctgcctatggctagata

SEQ ID NO: 7899276 - DNA, 22 bp, Homo sapiens
tagggctgcctatggctagata

SEQ ID NO: 7899277 - DNA, 22 bp, Homo sapiens
tagggctgcctatggctagata

SEQ ID NO: 7899278 - DNA, 22 bp, Homo sapiens
tagggctgcctatggctagata

SEQ ID NO: 7899279 - DNA, 22 bp, Homo sapiens
tagggctgctgcagatgacagg

SEQ ID NO: 7899280 - DNA, 22 bp, Homo sapiens
tagggctgccatttgcttttct

SEQ ID NO: 7899281 - DNA, 22 bp, Homo sapiens
tagggctgcagaacaatggcct

SEQ ID NO: 7899282 - DNA, 22 bp, Homo sapiens
tagggctgccatttgcttttct

SEQ ID NO: 7899283 - DNA, 22 bp, Homo sapiens
tagggctgaggcaacaagggag

SEQ ID NO: 7899284 - DNA, 22 bp, Homo sapiens
tagggctgaggcaacaagggag

SEQ ID NO: 7899285 - DNA, 22 bp, Homo sapiens
tagggctgcagaacaatggcct

SEQ ID NO: 7899286 - DNA, 22 bp, Homo sapiens
tagggctgtggtcagtcctcta

SEQ ID NO: 7899287 - DNA, 22 bp, Homo sapiens
tagggctgggtacactcttgcc

SEQ ID NO: 7899288 - DNA, 22 bp, Homo sapiens
tagggctgggtacactcttgcc

SEQ ID NO: 7899289 - DNA, 22 bp, Homo sapiens
tagggctgtggtcagtcctcta

SEQ ID NO: 7899290 - DNA, 22 bp, Homo sapiens
tagggctgtggtcagtcctcta

SEQ ID NO: 7899291 - DNA, 22 bp, Homo sapiens
tagggctgtgtctccaggacca

SEQ ID NO: 7899292 - DNA, 22 bp, Homo sapiens
tagggctgggtacactcttgcc

SEQ ID NO: 7899293 - DNA, 16 bp, Homo sapiens
tagggctgggaaggag

SEQ ID NO: 7899294 - DNA, 16 bp, Homo sapiens
tagggctgggaaggag

SEQ ID NO: 7899295 - DNA, 22 bp, Homo sapiens
tagggctggcgtgctcagggaa

SEQ ID NO: 7899296 - DNA, 16 bp, Homo sapiens
tagggctgggaaggag

SEQ ID NO: 7899297 - DNA, 16 bp, Homo sapiens
tagggctgggaaggag

SEQ ID NO: 7899298 - DNA, 22 bp, Homo sapiens
tagggctgtgtctccaggacca

SEQ ID NO: 7899299 - DNA, 22 bp, Homo sapiens
tagggctgtgtctccaggacca

SEQ ID NO: 7899300 - DNA, 22 bp, Homo sapiens
tagggctgtgtctccaggacca

SEQ ID NO: 7899301 - DNA, 22 bp, Homo sapiens
tagggctgtgtctccaggacca

SEQ ID NO: 7899302 - DNA, 22 bp, Homo sapiens
tagggctgttagtaattctcag

SEQ ID NO: 7899303 - DNA, 22 bp, Homo sapiens
tagggctgtgtctccaggacca

SEQ ID NO: 7899304 - DNA, 22 bp, Homo sapiens
tagggctgttagtaattctcag

SEQ ID NO: 7899305 - DNA, 22 bp, Homo sapiens
tagggctgtttaaaagtgaggt

SEQ ID NO: 7899306 - DNA, 22 bp, Homo sapiens
tagggctgtttaaaagtgaggt

SEQ ID NO: 7899307 - DNA, 22 bp, Homo sapiens
tagggctgtttaaaagtgaggt

SEQ ID NO: 7899308 - DNA, 22 bp, Homo sapiens
tagggctgtttaaaagtgaggt

SEQ ID NO: 7899309 - DNA, 22 bp, Homo sapiens
tagggctgtttaaaagtgaggt

SEQ ID NO: 7899310 - DNA, 22 bp, Homo sapiens
tagggcttagaaaagaatttac

SEQ ID NO: 7899311 - DNA, 23 bp, Homo sapiens
tagttattttctctgtaatttgc

SEQ ID NO: 7899312 - DNA, 22 bp, Homo sapiens
tagttattattgttactatcag

SEQ ID NO: 7899313 - DNA, 22 bp, Homo sapiens
tagttatgtcagctctgcagag

SEQ ID NO: 7899314 - DNA, 22 bp, Homo sapiens
tagttattattgttactatcag

SEQ ID NO: 7899315 - DNA, 22 bp, Homo sapiens
tagttcaaagtctgtcaaagga

SEQ ID NO: 7899316 - DNA, 22 bp, Homo sapiens
tagttcaaagtctgtcaaagga

SEQ ID NO: 7899317 - DNA, 23 bp, Homo sapiens
tagttattttctctgtaatttgc

SEQ ID NO: 7899318 - DNA, 23 bp, Homo sapiens
tagttattttctctgtaatttgc

SEQ ID NO: 7899319 - DNA, 22 bp, Homo sapiens
tagttcaggaagagaaacaaca

SEQ ID NO: 7899320 - DNA, 22 bp, Homo sapiens
tagttctacagatggtttgtaa

SEQ ID NO: 7899321 - DNA, 22 bp, Homo sapiens
tagttcaggaagagaaacaaca

SEQ ID NO: 7899322 - DNA, 22 bp, Homo sapiens
tagttctactcaaagtgtgatc

SEQ ID NO: 7899323 - DNA, 21 bp, Homo sapiens
tagttctacttcagtctcatg

SEQ ID NO: 7899324 - DNA, 22 bp, Homo sapiens
tagttatatccagtctttaaaa

SEQ ID NO: 7899325 - DNA, 22 bp, Homo sapiens
tagttagcctcagagcctttgc

SEQ ID NO: 7899326 - DNA, 22 bp, Homo sapiens
tagttagcattcagggagctgg

SEQ ID NO: 7899327 - DNA, 22 bp, Homo sapiens
tagttagcactcggtctgctct

SEQ ID NO: 7899328 - DNA, 22 bp, Homo sapiens
tagttacagtgcatagcaagat

SEQ ID NO: 7899329 - DNA, 22 bp, Homo sapiens
tagttacagtgcatagcaagat

SEQ ID NO: 7899330 - DNA, 22 bp, Homo sapiens
tagtttaatggtcaactaatga

SEQ ID NO: 7899331 - DNA, 22 bp, Homo sapiens
tagtttaatggtcaactaatga

SEQ ID NO: 7899332 - DNA, 22 bp, Homo sapiens
tagtttaatggtcaactaatga

SEQ ID NO: 7899333 - DNA, 22 bp, Homo sapiens
tagtttaatggtcaactaatga

SEQ ID NO: 7899334 - DNA, 22 bp, Homo sapiens
tagtttaaaagttagggatgat

SEQ ID NO: 7899335 - DNA, 22 bp, Homo sapiens
tagtttaaaagttagggatgat

SEQ ID NO: 7899336 - DNA, 22 bp, Homo sapiens
tagtttaatggtcaactaatga

SEQ ID NO: 7899337 - DNA, 22 bp, Homo sapiens
tagttcttggttcttagttctt

SEQ ID NO: 7899338 - DNA, 22 bp, Homo sapiens
tagttgaaagggattattgtgg

SEQ ID NO: 7899339 - DNA, 22 bp, Homo sapiens
tagttctggtatttgctgacaa

SEQ ID NO: 7899340 - DNA, 22 bp, Homo sapiens
tagtttagcactaagaaaaaca

SEQ ID NO: 7899341 - DNA, 22 bp, Homo sapiens
tagtttagcactaagaaaaaca

SEQ ID NO: 7899342 - DNA, 22 bp, Homo sapiens
tagtttactgttcactttgccc

SEQ ID NO: 7899343 - DNA, 22 bp, Homo sapiens
tagtttagagaattggggatga

SEQ ID NO: 7899344 - DNA, 22 bp, Homo sapiens
tagtttagaatgttgcaataca

SEQ ID NO: 7899345 - DNA, 22 bp, Homo sapiens
tagtttaccaaattgatcttcc

SEQ ID NO: 7899346 - DNA, 22 bp, Homo sapiens
tagtttactcatctataaaatg

SEQ ID NO: 7899347 - DNA, 22 bp, Homo sapiens
tagtttactcatctataaaatg

SEQ ID NO: 7899348 - DNA, 22 bp, Homo sapiens
tagtttaccaaattgatcttcc

SEQ ID NO: 7899349 - DNA, 22 bp, Homo sapiens
tagtttaccaaattgatcttcc

SEQ ID NO: 7899350 - DNA, 22 bp, Homo sapiens
tagtttaccaaattgatcttcc

SEQ ID NO: 7899351 - DNA, 22 bp, Homo sapiens
tagtttcatatgcaaaatagta

SEQ ID NO: 7899352 - DNA, 22 bp, Homo sapiens
tagtttcatatgcaaaatagta

SEQ ID NO: 7899353 - DNA, 22 bp, Homo sapiens
tagtttcagattgctttcatat

SEQ ID NO: 7899354 - DNA, 22 bp, Homo sapiens
tagtttcagattgctttcatat

SEQ ID NO: 7899355 - DNA, 22 bp, Homo sapiens
tagtttcatctccaccctgccc

SEQ ID NO: 7899356 - DNA, 22 bp, Homo sapiens
tagtttcatctccaccctgccc

SEQ ID NO: 7899357 - DNA, 22 bp, Homo sapiens
tagtttcctaggctgtattgtt

SEQ ID NO: 7899358 - DNA, 22 bp, Homo sapiens
tagtttccatgttatacagttt

SEQ ID NO: 7899359 - DNA, 22 bp, Homo sapiens
tagtttaggatcttttttgtgc

SEQ ID NO: 7899360 - DNA, 22 bp, Homo sapiens
tagtttaggtcgtacaagcaaa

SEQ ID NO: 7899361 - DNA, 22 bp, Homo sapiens
tagtttaggatccaatctaaga

SEQ ID NO: 7899362 - DNA, 22 bp, Homo sapiens
tagtttatgctgctgcagtgag

SEQ ID NO: 7899363 - DNA, 22 bp, Homo sapiens
tagtttatgattttttggaagg

SEQ ID NO: 7899364 - DNA, 22 bp, Homo sapiens
tagtttatgattttttggaagg

SEQ ID NO: 7899365 - DNA, 22 bp, Homo sapiens
tagtttatagttagcgagcacg

SEQ ID NO: 7899366 - DNA, 22 bp, Homo sapiens
tagttttgaggattatatgtga

SEQ ID NO: 7899367 - DNA, 22 bp, Homo sapiens
tagttttgattagtattgtctt

SEQ ID NO: 7899368 - DNA, 22 bp, Homo sapiens
tagtttttaagtgtacaatttc

SEQ ID NO: 7899369 - DNA, 22 bp, Homo sapiens
tagtttttaagtgtacaatttc

SEQ ID NO: 7899370 - DNA, 22 bp, Homo sapiens
tagtttttaagtgtacaatttc

SEQ ID NO: 7899371 - DNA, 22 bp, Homo sapiens
tagttttatgaattggtataat

SEQ ID NO: 7899372 - DNA, 22 bp, Homo sapiens
tagttttatgaattggtataat

SEQ ID NO: 7899373 - DNA, 22 bp, Homo sapiens
tagtttttaagtgtacaatttc

SEQ ID NO: 7899374 - DNA, 22 bp, Homo sapiens
tagttttttcaacaaatggtgc

SEQ ID NO: 7899375 - DNA, 22 bp, Homo sapiens
tagttttttcaacaaatggtgc

SEQ ID NO: 7899376 - DNA, 22 bp, Homo sapiens
tagtttttactgcgagttataa

SEQ ID NO: 7899377 - DNA, 22 bp, Homo sapiens
tagtttttactgcgagttataa

SEQ ID NO: 7899378 - DNA, 22 bp, Homo sapiens
tagtttttactgcgagttataa

SEQ ID NO: 7899379 - DNA, 22 bp, Homo sapiens
tagtttctaaagcttcctaggt

SEQ ID NO: 7899380 - DNA, 22 bp, Homo sapiens
tagtttctaaagcttcctaggt

SEQ ID NO: 7899381 - DNA, 22 bp, Homo sapiens
tagtttctaaactgaactgtca

SEQ ID NO: 7899382 - DNA, 18 bp, Homo sapiens
tagtttctaatggccttt

SEQ ID NO: 7899383 - DNA, 21 bp, Homo sapiens
tagtttctacccagttaatgg

SEQ ID NO: 7899384 - DNA, 21 bp, Homo sapiens
tagtttctacccagttaatgg

SEQ ID NO: 7899385 - DNA, 22 bp, Homo sapiens
tagttttataatgttaacatct

SEQ ID NO: 7899386 - DNA, 22 bp, Homo sapiens
tagttttataatgttaacatct

SEQ ID NO: 7899387 - DNA, 22 bp, Homo sapiens
tagttttataatgttaacatct

SEQ ID NO: 7899388 - DNA, 22 bp, Homo sapiens
tagttttataatgttaacatct

SEQ ID NO: 7899389 - DNA, 22 bp, Homo sapiens
tagttttataatgttaacatct

SEQ ID NO: 7899390 - DNA, 22 bp, Homo sapiens
tagttttataatgttaacatct

SEQ ID NO: 7899391 - DNA, 22 bp, Homo sapiens
tagtgcttaacacaaagtgatt

SEQ ID NO: 7899392 - DNA, 22 bp, Homo sapiens
tagtgcttaacacaaagtgatt

SEQ ID NO: 7899393 - DNA, 22 bp, Homo sapiens
tagtgcttaataaatttcagaa

SEQ ID NO: 7899394 - DNA, 22 bp, Homo sapiens
tagtgctattaaggatacagag

SEQ ID NO: 7899395 - DNA, 22 bp, Homo sapiens
tagtgcttaacacaaagtgatt

SEQ ID NO: 7899396 - DNA, 22 bp, Homo sapiens
tagtgcttaaaagtggaagaga

SEQ ID NO: 7899397 - DNA, 22 bp, Homo sapiens
tagtgctatggccagagccctt

SEQ ID NO: 7899398 - DNA, 22 bp, Homo sapiens
tagtgctatggccagagccctt

SEQ ID NO: 7899399 - DNA, 22 bp, Homo sapiens
tagtgctatagaagtgcttgcg

SEQ ID NO: 7899400 - DNA, 22 bp, Homo sapiens
tagtgccctcccctttgggata

SEQ ID NO: 7899401 - DNA, 20 bp, Homo sapiens
tagtgccagtgtgcatgcta

SEQ ID NO: 7899402 - DNA, 22 bp, Homo sapiens
tagtgccatcttgagctgcttt

SEQ ID NO: 7899403 - DNA, 22 bp, Homo sapiens
tagtgccatgcgaggggtggga

SEQ ID NO: 7899404 - DNA, 22 bp, Homo sapiens
tagtgccattgccaggaagggc

SEQ ID NO: 7899405 - DNA, 22 bp, Homo sapiens
tagtgccattcaagaggtagtt

SEQ ID NO: 7899406 - DNA, 22 bp, Homo sapiens
tagtgccctcccctttgggata

SEQ ID NO: 7899407 - DNA, 22 bp, Homo sapiens
tagtgcttattactgtgctgtc

SEQ ID NO: 7899408 - DNA, 22 bp, Homo sapiens
tagtgcttattactgtgctgtc

SEQ ID NO: 7899409 - DNA, 22 bp, Homo sapiens
tagtgctttaagtttacagaga

SEQ ID NO: 7899410 - DNA, 22 bp, Homo sapiens
tagtgcttggccctaccagata

SEQ ID NO: 7899411 - DNA, 22 bp, Homo sapiens
tagtgcttgagtctctccgtac

SEQ ID NO: 7899412 - DNA, 22 bp, Homo sapiens
tagtgctttaggcctgagtgtc

SEQ ID NO: 7899413 - DNA, 22 bp, Homo sapiens
tagtgctttaagtttacagaga

SEQ ID NO: 7899414 - DNA, 22 bp, Homo sapiens
tagtgctttattgttcctgaaa

SEQ ID NO: 7899415 - DNA, 18 bp, Homo sapiens
tagtggaactgctctggg

SEQ ID NO: 7899416 - DNA, 22 bp, Homo sapiens
tagtggagaagtggagtctgtg

SEQ ID NO: 7899417 - DNA, 18 bp, Homo sapiens
tagtggaactgctctggg

SEQ ID NO: 7899418 - DNA, 22 bp, Homo sapiens
tagtggagaagtggagtctgtg

SEQ ID NO: 7899419 - DNA, 22 bp, Homo sapiens
tagtggagaagtggagtctgtg

SEQ ID NO: 7899420 - DNA, 22 bp, Homo sapiens
tagtggaactgtgtcatacaaa

SEQ ID NO: 7899421 - DNA, 22 bp, Homo sapiens
tagtggaactgtgtcatacaaa

SEQ ID NO: 7899422 - DNA, 22 bp, Homo sapiens
tagtggagaggatgtggagaaa

SEQ ID NO: 7899423 - DNA, 22 bp, Homo sapiens
tagtggagaggatgtggagaaa

SEQ ID NO: 7899424 - DNA, 22 bp, Homo sapiens
tagtggagaggatgtggagaaa

SEQ ID NO: 7899425 - DNA, 22 bp, Homo sapiens
tagtggaggggatgcaaagctt

SEQ ID NO: 7899426 - DNA, 22 bp, Homo sapiens
tagtggagagttgttttgtgca

SEQ ID NO: 7899427 - DNA, 22 bp, Homo sapiens
tagtggaggcctgttgtgtgca

SEQ ID NO: 7899428 - DNA, 22 bp, Homo sapiens
tagtggagtagaaaccaaagaa

SEQ ID NO: 7899429 - DNA, 19 bp, Homo sapiens
tagtggagtgacaagttct

SEQ ID NO: 7899430 - DNA, 22 bp, Homo sapiens
tagtggagtagaaaccaaagaa

SEQ ID NO: 7899431 - DNA, 22 bp, Homo sapiens
tagtggaggtggtctgtgaact

SEQ ID NO: 7899432 - DNA, 22 bp, Homo sapiens
tagtggagggtgtagctgctgg

SEQ ID NO: 7899433 - DNA, 22 bp, Homo sapiens
tagtggaggtggtctgtgaact

SEQ ID NO: 7899434 - DNA, 22 bp, Homo sapiens
tagtggaggtggtctgtgaact

SEQ ID NO: 7899435 - DNA, 22 bp, Homo sapiens
tagtggaggggatgcaaagctt

SEQ ID NO: 7899436 - DNA, 22 bp, Homo sapiens
tagtggagggtgtagctgctgg

SEQ ID NO: 7899437 - DNA, 22 bp, Homo sapiens
tagttacagcaggcaggatata

SEQ ID NO: 7899438 - DNA, 22 bp, Homo sapiens
tagttacagcaggcaggatata

SEQ ID NO: 7899439 - DNA, 22 bp, Homo sapiens
tagttacagaagataagggtat

SEQ ID NO: 7899440 - DNA, 22 bp, Homo sapiens
tagttacacatgggtagggaat

SEQ ID NO: 7899441 - DNA, 22 bp, Homo sapiens
tagttacaattatgcatggaaa

SEQ ID NO: 7899442 - DNA, 22 bp, Homo sapiens
tagttacaaaccaacaggcagc

SEQ ID NO: 7899443 - DNA, 22 bp, Homo sapiens
tagggggctgtcctgtgcatta

SEQ ID NO: 7899444 - DNA, 22 bp, Homo sapiens
tagggggctttgctgcttgaca

SEQ ID NO: 7899445 - DNA, 22 bp, Homo sapiens
tagggggctttgctgcttgaca

SEQ ID NO: 7899446 - DNA, 21 bp, Homo sapiens
tagggggcagtgggatgctta

SEQ ID NO: 7899447 - DNA, 22 bp, Homo sapiens
tagggggctgtcctgtgcatta

SEQ ID NO: 7899448 - DNA, 21 bp, Homo sapiens
tagggggcagtgggatgctta

SEQ ID NO: 7899449 - DNA, 21 bp, Homo sapiens
tagggggcagtgggatgctta

SEQ ID NO: 7899450 - DNA, 23 bp, Homo sapiens
taggggctggcgtggagcctgcg

SEQ ID NO: 7899451 - DNA, 22 bp, Homo sapiens
taggggctcagaacatgtcctt

SEQ ID NO: 7899452 - DNA, 22 bp, Homo sapiens
taggggaattgcagtgtgtcca

SEQ ID NO: 7899453 - DNA, 22 bp, Homo sapiens
taggggaagtctcagaatgcag

SEQ ID NO: 7899454 - DNA, 23 bp, Homo sapiens
taggggaaaaatcttctgcaatt

SEQ ID NO: 7899455 - DNA, 22 bp, Homo sapiens
taggggaactggcacagggcag

SEQ ID NO: 7899456 - DNA, 22 bp, Homo sapiens
taggggaactggcacagggcag

SEQ ID NO: 7899457 - DNA, 22 bp, Homo sapiens
taggggaactggcacagggcag

SEQ ID NO: 7899458 - DNA, 22 bp, Homo sapiens
taggggaactggcacagggcag

SEQ ID NO: 7899459 - DNA, 22 bp, Homo sapiens
taggggcagaagcggcggtcca

SEQ ID NO: 7899460 - DNA, 22 bp, Homo sapiens
taggggaggggatcatgtgctg

SEQ ID NO: 7899461 - DNA, 19 bp, Homo sapiens
tagtctctgatgaggcttt

SEQ ID NO: 7899462 - DNA, 22 bp, Homo sapiens
tagtctctgctttgcccttggc

SEQ ID NO: 7899463 - DNA, 22 bp, Homo sapiens
tagtctctggagactctagggg

SEQ ID NO: 7899464 - DNA, 22 bp, Homo sapiens
taggggtcttgttggcatcacg

SEQ ID NO: 7899465 - DNA, 21 bp, Homo sapiens
tagggggcagtgggatgctta

SEQ ID NO: 7899466 - DNA, 22 bp, Homo sapiens
taggggtcccactctcagagtt

SEQ ID NO: 7899467 - DNA, 22 bp, Homo sapiens
taggggtgaggccaggcatcag

SEQ ID NO: 7899468 - DNA, 22 bp, Homo sapiens
tagtgcaaggattgctgcagag

SEQ ID NO: 7899469 - DNA, 22 bp, Homo sapiens
tagtgcaaggttttgccaactt

SEQ ID NO: 7899470 - DNA, 22 bp, Homo sapiens
tagtgcaacagggaaagagtgt

SEQ ID NO: 7899471 - DNA, 22 bp, Homo sapiens
tagtgcaacagggaaagagtgt

SEQ ID NO: 7899472 - DNA, 22 bp, Homo sapiens
tagtgcaaaggccctgagatgg

SEQ ID NO: 7899473 - DNA, 22 bp, Homo sapiens
tagtgcaaaggtcttgcaccag

SEQ ID NO: 7899474 - DNA, 22 bp, Homo sapiens
tagtgccaccttccaagtatca

SEQ ID NO: 7899475 - DNA, 22 bp, Homo sapiens
tagtgccaccttccaagtatca

SEQ ID NO: 7899476 - DNA, 22 bp, Homo sapiens
tagtgccaccactgtctttggc

SEQ ID NO: 7899477 - DNA, 22 bp, Homo sapiens
tagtgccaaggttcgaagtaca

SEQ ID NO: 7899478 - DNA, 22 bp, Homo sapiens
tagtgccaagctaatgccagaa

SEQ ID NO: 7899479 - DNA, 22 bp, Homo sapiens
tagtgccaaagcctggtgtcat

SEQ ID NO: 7899480 - DNA, 22 bp, Homo sapiens
tagtgcataacatttaaaggtc

SEQ ID NO: 7899481 - DNA, 22 bp, Homo sapiens
tagtgccaaagcctggtgtcat

SEQ ID NO: 7899482 - DNA, 22 bp, Homo sapiens
tagtgcatacctaacatttttg

SEQ ID NO: 7899483 - DNA, 22 bp, Homo sapiens
tagtgcaggttaataggacttc

SEQ ID NO: 7899484 - DNA, 22 bp, Homo sapiens
tagtgcaggttaataggacttc

SEQ ID NO: 7899485 - DNA, 22 bp, Homo sapiens
tagtgcaggttaataggacttc

SEQ ID NO: 7899486 - DNA, 22 bp, Homo sapiens
tagtgcagggttttaagcactg

SEQ ID NO: 7899487 - DNA, 22 bp, Homo sapiens
tagtgcagggttttaagcactg

SEQ ID NO: 7899488 - DNA, 22 bp, Homo sapiens
tagtgcagaggaggagcctctg

SEQ ID NO: 7899489 - DNA, 22 bp, Homo sapiens
tagtgcagggttttaagcactg

SEQ ID NO: 7899490 - DNA, 22 bp, Homo sapiens
tagtgcaattccccatactaac

SEQ ID NO: 7899491 - DNA, 22 bp, Homo sapiens
tagtgcaatgtgaggcagtacc

SEQ ID NO: 7899492 - DNA, 22 bp, Homo sapiens
tagtgcaatctcttcctcagca

SEQ ID NO: 7899493 - DNA, 22 bp, Homo sapiens
tagtgcagaggaggagcctctg

SEQ ID NO: 7899494 - DNA, 23 bp, Homo sapiens
gacctggctttgaatcttgactc

SEQ ID NO: 7899495 - DNA, 23 bp, Homo sapiens
gacctggctttgaatcttgactc

SEQ ID NO: 7899496 - DNA, 22 bp, Homo sapiens
gacctggcctgcacagccctta

SEQ ID NO: 7899497 - DNA, 22 bp, Homo sapiens
gacctggcctgcacagccctta

SEQ ID NO: 7899498 - DNA, 22 bp, Homo sapiens
gacctggcctgcacagccctta

SEQ ID NO: 7899499 - DNA, 22 bp, Homo sapiens
gacctggctttgggccccggca

SEQ ID NO: 7899500 - DNA, 22 bp, Homo sapiens
gacctggctttgggccccggca

SEQ ID NO: 7899501 - DNA, 22 bp, Homo sapiens
gacctggggtaagcttggcaac

SEQ ID NO: 7899502 - DNA, 22 bp, Homo sapiens
gacctggggtaagcttggcaac

SEQ ID NO: 7899503 - DNA, 22 bp, Homo sapiens
gacctggggtaagcttggcaac

SEQ ID NO: 7899504 - DNA, 22 bp, Homo sapiens
gacctggggtggaaggaaggca

SEQ ID NO: 7899505 - DNA, 22 bp, Homo sapiens
gacctggggtaagcttggcaac

SEQ ID NO: 7899506 - DNA, 22 bp, Homo sapiens
gacctggggtaagcttggcaac

SEQ ID NO: 7899507 - DNA, 22 bp, Homo sapiens
gacctggggtggaaggaaggca

SEQ ID NO: 7899508 - DNA, 22 bp, Homo sapiens
gacctgggtaaggggctgacaa

SEQ ID NO: 7899509 - DNA, 22 bp, Homo sapiens
gaccttccttctttgctccggg

SEQ ID NO: 7899510 - DNA, 22 bp, Homo sapiens
gaccttctgttggaggcattta

SEQ ID NO: 7899511 - DNA, 22 bp, Homo sapiens
gaccttccaggctgaatggctg

SEQ ID NO: 7899512 - DNA, 22 bp, Homo sapiens
gaccttcttgctgtgtcctaac

SEQ ID NO: 7899513 - DNA, 22 bp, Homo sapiens
gaccttcagtgtgtttctcaca

SEQ ID NO: 7899514 - DNA, 22 bp, Homo sapiens
gaccttccatgccttcttccaa

SEQ ID NO: 7899515 - DNA, 22 bp, Homo sapiens
gaccttcagtgtgtttctcaca

SEQ ID NO: 7899516 - DNA, 22 bp, Homo sapiens
gaccttcagtgtgtttctcaca

SEQ ID NO: 7899517 - DNA, 22 bp, Homo sapiens
gaccttcaagcaccatatttat

SEQ ID NO: 7899518 - DNA, 20 bp, Homo sapiens
gacctgtgtctgggatgcgg

SEQ ID NO: 7899519 - DNA, 22 bp, Homo sapiens
gacctgtgttcaggtcgtggtg

SEQ ID NO: 7899520 - DNA, 22 bp, Homo sapiens
gaccttagaacgtgacacaaga

SEQ ID NO: 7899521 - DNA, 22 bp, Homo sapiens
gaccttagaacgtgacacaaga

SEQ ID NO: 7899522 - DNA, 22 bp, Homo sapiens
gaccttcaagcaccatatttat

SEQ ID NO: 7899523 - DNA, 22 bp, Homo sapiens
gacctggtgctagctggtgtgt

SEQ ID NO: 7899524 - DNA, 22 bp, Homo sapiens
gacctggtgcaggtggacagag

SEQ ID NO: 7899525 - DNA, 22 bp, Homo sapiens
gacctggtccttgtactttgaa

SEQ ID NO: 7899526 - DNA, 22 bp, Homo sapiens
gacctggtccttgtactttgaa

SEQ ID NO: 7899527 - DNA, 22 bp, Homo sapiens
gactatctgccaggtcccaggg

SEQ ID NO: 7899528 - DNA, 22 bp, Homo sapiens
gactaggggcagcgtgggagct

SEQ ID NO: 7899529 - DNA, 22 bp, Homo sapiens
gactagggaatcattcttggat

SEQ ID NO: 7899530 - DNA, 22 bp, Homo sapiens
gactaggctctcatagaggtag

SEQ ID NO: 7899531 - DNA, 22 bp, Homo sapiens
gactagaatagggggtaggaag

SEQ ID NO: 7899532 - DNA, 22 bp, Homo sapiens
gactagaatagggggtaggaag

SEQ ID NO: 7899533 - DNA, 22 bp, Homo sapiens
gactattacatgctttcaagac

SEQ ID NO: 7899534 - DNA, 22 bp, Homo sapiens
gactatgtgtattttactcacc

SEQ ID NO: 7899535 - DNA, 22 bp, Homo sapiens
gactatttatttacagaaagct

SEQ ID NO: 7899536 - DNA, 22 bp, Homo sapiens
gactatttccctcatcatcttc

SEQ ID NO: 7899537 - DNA, 22 bp, Homo sapiens
gactattttataaactagtgaa

SEQ ID NO: 7899538 - DNA, 22 bp, Homo sapiens
gaccttcttgctgtgtcctaac

SEQ ID NO: 7899539 - DNA, 22 bp, Homo sapiens
gaccttcttgctgtgtcctaac

SEQ ID NO: 7899540 - DNA, 22 bp, Homo sapiens
gaccttcttgctgtgtcctaac

SEQ ID NO: 7899541 - DNA, 22 bp, Homo sapiens
gaccttcttgctgtgtcctaac

SEQ ID NO: 7899542 - DNA, 22 bp, Homo sapiens
gaccttcttgctgtgtcctaac

SEQ ID NO: 7899543 - DNA, 22 bp, Homo sapiens
gaccttcttgctgtgtcctaac

SEQ ID NO: 7899544 - DNA, 22 bp, Homo sapiens
gaccttcttgctgtgtcctaac

SEQ ID NO: 7899545 - DNA, 22 bp, Homo sapiens
gaccttgtgatccacccgcctt

SEQ ID NO: 7899546 - DNA, 22 bp, Homo sapiens
gaccttgtgatccacccgcctt

SEQ ID NO: 7899547 - DNA, 22 bp, Homo sapiens
gaccttgtgatccacccgcctt

SEQ ID NO: 7899548 - DNA, 22 bp, Homo sapiens
gactagaagggcaagagtccct

SEQ ID NO: 7899549 - DNA, 19 bp, Homo sapiens
gactacagggggaagaagt

SEQ ID NO: 7899550 - DNA, 22 bp, Homo sapiens
gacctgcctgagctgcctctgc

SEQ ID NO: 7899551 - DNA, 22 bp, Homo sapiens
gacctgcctgagctgcctctgc

SEQ ID NO: 7899552 - DNA, 22 bp, Homo sapiens
gacctgcccactctgaggacat

SEQ ID NO: 7899553 - DNA, 22 bp, Homo sapiens
gacctgcccactctgaggacat

SEQ ID NO: 7899554 - DNA, 22 bp, Homo sapiens
gacctgctccacgacaagtggt

SEQ ID NO: 7899555 - DNA, 22 bp, Homo sapiens
gacctgcccactctgaggacat

SEQ ID NO: 7899556 - DNA, 22 bp, Homo sapiens
gacctggaagaactgaggcctt

SEQ ID NO: 7899557 - DNA, 22 bp, Homo sapiens
gacctggaagatggtcctcacc

SEQ ID NO: 7899558 - DNA, 22 bp, Homo sapiens
gacctggaggcttttcccaaga

SEQ ID NO: 7899559 - DNA, 22 bp, Homo sapiens
gacctggcaactgtagcttctg

SEQ ID NO: 7899560 - DNA, 19 bp, Homo sapiens
gacctggccaagttactta

SEQ ID NO: 7899561 - DNA, 22 bp, Homo sapiens
gacctggcatattcattggcac

SEQ ID NO: 7899562 - DNA, 22 bp, Homo sapiens
gacattaatttctttggtaatt

SEQ ID NO: 7899563 - DNA, 22 bp, Homo sapiens
gacattagactaatgtagcatt

SEQ ID NO: 7899564 - DNA, 22 bp, Homo sapiens
gacctgagattttgaggctcat

SEQ ID NO: 7899565 - DNA, 22 bp, Homo sapiens
gacctgagattttgaggctcat

SEQ ID NO: 7899566 - DNA, 22 bp, Homo sapiens
gacctgcccactctgaggacat

SEQ ID NO: 7899567 - DNA, 22 bp, Homo sapiens
gacattaaatgtcttagttgcc

SEQ ID NO: 7899568 - DNA, 22 bp, Homo sapiens
gacatgttgaagaatatttgga

SEQ ID NO: 7899569 - DNA, 22 bp, Homo sapiens
gacatgtttgctatagggattt

SEQ ID NO: 7899570 - DNA, 22 bp, Homo sapiens
gacatgttatctctggcttcaa

SEQ ID NO: 7899571 - DNA, 22 bp, Homo sapiens
gacatgttatctctggcttcaa

SEQ ID NO: 7899572 - DNA, 22 bp, Homo sapiens
gacatgttgaagaatatttgga

SEQ ID NO: 7899573 - DNA, 22 bp, Homo sapiens
gacatgcattaagacacactga

SEQ ID NO: 7899574 - DNA, 22 bp, Homo sapiens
gacatgcattaagacacactga

SEQ ID NO: 7899575 - DNA, 22 bp, Homo sapiens
gacatgggatgagatgaagcat

SEQ ID NO: 7899576 - DNA, 22 bp, Homo sapiens
gacatgtaaatggcaattatgg

SEQ ID NO: 7899577 - DNA, 22 bp, Homo sapiens
gacatggcttctaggaagcttt

SEQ ID NO: 7899578 - DNA, 22 bp, Homo sapiens
gacatgtacttcaatttctctt

SEQ ID NO: 7899579 - DNA, 22 bp, Homo sapiens
gacatgtacttcaatttctctt

SEQ ID NO: 7899580 - DNA, 22 bp, Homo sapiens
gacatgtattagtacatatggt

SEQ ID NO: 7899581 - DNA, 20 bp, Homo sapiens
gacatgtctttctcacacaa

SEQ ID NO: 7899582 - DNA, 22 bp, Homo sapiens
gacatgtattagtcatgcacag

SEQ ID NO: 7899583 - DNA, 22 bp, Homo sapiens
gacatgcatattcactcttctt

SEQ ID NO: 7899584 - DNA, 22 bp, Homo sapiens
gacatgcatgaatgcaggtctc

SEQ ID NO: 7899585 - DNA, 22 bp, Homo sapiens
gacatgcatgaatgcaggtctc

SEQ ID NO: 7899586 - DNA, 22 bp, Homo sapiens
gacatgcagttctcaagggtag

SEQ ID NO: 7899587 - DNA, 22 bp, Homo sapiens
gacatgaatgttatactttatt

SEQ ID NO: 7899588 - DNA, 22 bp, Homo sapiens
gacatgatgcttggaactacat

SEQ ID NO: 7899589 - DNA, 22 bp, Homo sapiens
gacatgcaacaatttggcattt

SEQ ID NO: 7899590 - DNA, 23 bp, Homo sapiens
gacatctgttttgtccctgtgct

SEQ ID NO: 7899591 - DNA, 22 bp, Homo sapiens
gacatagactgagtttagctga

SEQ ID NO: 7899592 - DNA, 22 bp, Homo sapiens
gacatagacaaagtcattgtca

SEQ ID NO: 7899593 - DNA, 22 bp, Homo sapiens
gacatagactgagtttagctga

SEQ ID NO: 7899594 - DNA, 18 bp, Homo sapiens
gacatagctcagagctca

SEQ ID NO: 7899595 - DNA, 22 bp, Homo sapiens
gacatagctcagagctcagcac

SEQ ID NO: 7899596 - DNA, 22 bp, Homo sapiens
gacatacagccctctccctggt

SEQ ID NO: 7899597 - DNA, 22 bp, Homo sapiens
gacatacatctctggaaaaaaa

SEQ ID NO: 7899598 - DNA, 22 bp, Homo sapiens
gacatagacaaagtcattgtca

SEQ ID NO: 7899599 - DNA, 22 bp, Homo sapiens
gacatagactgagtttagctga

SEQ ID NO: 7899600 - DNA, 22 bp, Homo sapiens
gacatagacaaagtcattgtca

SEQ ID NO: 7899601 - DNA, 22 bp, Homo sapiens
gacatcaggaagacatgagagg

SEQ ID NO: 7899602 - DNA, 22 bp, Homo sapiens
gacatcaggaagacatgagagg

SEQ ID NO: 7899603 - DNA, 22 bp, Homo sapiens
gacatcaggcctgcagtctggg

SEQ ID NO: 7899604 - DNA, 17 bp, Homo sapiens
gacatcagtacttacag

SEQ ID NO: 7899605 - DNA, 22 bp, Homo sapiens
gacatatgatattaaatgagca

SEQ ID NO: 7899606 - DNA, 22 bp, Homo sapiens
gacatatactatggatggttct

SEQ ID NO: 7899607 - DNA, 22 bp, Homo sapiens
gacatatgtgtacatggagatt

SEQ ID NO: 7899608 - DNA, 22 bp, Homo sapiens
gacatatttgaaaccaagagaa

SEQ ID NO: 7899609 - DNA, 22 bp, Homo sapiens
gacatcaatattctgcagggat

SEQ ID NO: 7899610 - DNA, 22 bp, Homo sapiens
gacatctgaggccctcagagcc

SEQ ID NO: 7899611 - DNA, 22 bp, Homo sapiens
gacatctggaggagatgaatgg

SEQ ID NO: 7899612 - DNA, 22 bp, Homo sapiens
gacatccatcatttcctgttga

SEQ ID NO: 7899613 - DNA, 22 bp, Homo sapiens
gacatctgaatattagagagaa

SEQ ID NO: 7899614 - DNA, 22 bp, Homo sapiens
gacatctccaaggcaacctgtt

SEQ ID NO: 7899615 - DNA, 22 bp, Homo sapiens
gacatcatgttctgctaatagt

SEQ ID NO: 7899616 - DNA, 22 bp, Homo sapiens
gacatcaggaagacatgagagg

SEQ ID NO: 7899617 - DNA, 22 bp, Homo sapiens
gacatcaggcctgcagtctggg

SEQ ID NO: 7899618 - DNA, 22 bp, Homo sapiens
gacatcaggcctgcagtctggg

SEQ ID NO: 7899619 - DNA, 22 bp, Homo sapiens
gacatacagccctctccctggt

SEQ ID NO: 7899620 - DNA, 22 bp, Homo sapiens
gacatacagcatggtctatgaa

SEQ ID NO: 7899621 - DNA, 22 bp, Homo sapiens
gacatacagcatggtctatgaa

SEQ ID NO: 7899622 - DNA, 22 bp, Homo sapiens
gacatacagaatctgcagactt

SEQ ID NO: 7899623 - DNA, 22 bp, Homo sapiens
gacagtgcatttcctggcatgg

SEQ ID NO: 7899624 - DNA, 22 bp, Homo sapiens
gacatacagaatctgcagactt

SEQ ID NO: 7899625 - DNA, 19 bp, Homo sapiens
gacagtgcagttgtagtac

SEQ ID NO: 7899626 - DNA, 19 bp, Homo sapiens
gacagtgcagttgtagtac

SEQ ID NO: 7899627 - DNA, 22 bp, Homo sapiens
gacagtgattagttactataaa

SEQ ID NO: 7899628 - DNA, 19 bp, Homo sapiens
gacagtgcagttgtagtac

SEQ ID NO: 7899629 - DNA, 22 bp, Homo sapiens
gacagtgagtacctcaaaggcc

SEQ ID NO: 7899630 - DNA, 22 bp, Homo sapiens
gacagtgagtacctcaaaggcc

SEQ ID NO: 7899631 - DNA, 22 bp, Homo sapiens
gacagtgagagtctacaccctc

SEQ ID NO: 7899632 - DNA, 22 bp, Homo sapiens
gacagtgacagcttggaaagca

SEQ ID NO: 7899633 - DNA, 22 bp, Homo sapiens
gacagtgacagcttggaaagca

SEQ ID NO: 7899634 - DNA, 22 bp, Homo sapiens
gacagtgaacaggttcccactg

SEQ ID NO: 7899635 - DNA, 22 bp, Homo sapiens
gacagtctggcctaaagggtta

SEQ ID NO: 7899636 - DNA, 22 bp, Homo sapiens
gacagtctggcctaaagggtta

SEQ ID NO: 7899637 - DNA, 22 bp, Homo sapiens
gacagctgtacactcctggtta

SEQ ID NO: 7899638 - DNA, 22 bp, Homo sapiens
gacagctgtacactcctggtta

SEQ ID NO: 7899639 - DNA, 22 bp, Homo sapiens
gacagctgtacactcctggtta

SEQ ID NO: 7899640 - DNA, 17 bp, Homo sapiens
gacagctggttcctggc

SEQ ID NO: 7899641 - DNA, 17 bp, Homo sapiens
gacagctggttcctggc

SEQ ID NO: 7899642 - DNA, 18 bp, Homo sapiens
gacagctgtcctgagccc

SEQ ID NO: 7899643 - DNA, 22 bp, Homo sapiens
gacagctgtacactcctggtta

SEQ ID NO: 7899644 - DNA, 22 bp, Homo sapiens
gacagctgggaggatgacataa

SEQ ID NO: 7899645 - DNA, 22 bp, Homo sapiens
gacagctggcagtggaaaggtg

SEQ ID NO: 7899646 - DNA, 17 bp, Homo sapiens
gacagctgggcgcacgc

SEQ ID NO: 7899647 - DNA, 22 bp, Homo sapiens
gacagctgggaggatgacataa

SEQ ID NO: 7899648 - DNA, 17 bp, Homo sapiens
gacagctggttcctggc

SEQ ID NO: 7899649 - DNA, 17 bp, Homo sapiens
gacagctgggcgcacgc

SEQ ID NO: 7899650 - DNA, 17 bp, Homo sapiens
gacagctgggcgcacgc

SEQ ID NO: 7899651 - DNA, 17 bp, Homo sapiens
gacagctgggcgcacgc

SEQ ID NO: 7899652 - DNA, 17 bp, Homo sapiens
gacagctgggcgcacgc

SEQ ID NO: 7899653 - DNA, 22 bp, Homo sapiens
gacagccatcagcacacgctgc

SEQ ID NO: 7899654 - DNA, 22 bp, Homo sapiens
gacagccatcagcacacgctgc

SEQ ID NO: 7899655 - DNA, 22 bp, Homo sapiens
gacagccatgcacttctgctgt

SEQ ID NO: 7899656 - DNA, 22 bp, Homo sapiens
gacagccatgcacttctgctgt

SEQ ID NO: 7899657 - DNA, 22 bp, Homo sapiens
gacagcctcatgaggagcaaaa

SEQ ID NO: 7899658 - DNA, 22 bp, Homo sapiens
gacagcctcatgtgcatgaact

SEQ ID NO: 7899659 - DNA, 22 bp, Homo sapiens
gacagcctcatgtgcatgaact

SEQ ID NO: 7899660 - DNA, 22 bp, Homo sapiens
gacagctgaacaggtgggataa

SEQ ID NO: 7899661 - DNA, 22 bp, Homo sapiens
gacagctgaacaggtgggataa

SEQ ID NO: 7899662 - DNA, 22 bp, Homo sapiens
gacagctgaaaaatgtaaggta

SEQ ID NO: 7899663 - DNA, 22 bp, Homo sapiens
gacagctgaaaaatgtaaggta

SEQ ID NO: 7899664 - DNA, 22 bp, Homo sapiens
gacagctgaaaaatgtaaggta

SEQ ID NO: 7899665 - DNA, 22 bp, Homo sapiens
gacagctatgtcccaaaaactg

SEQ ID NO: 7899666 - DNA, 22 bp, Homo sapiens
gacagctacagggagagcattg

SEQ ID NO: 7899667 - DNA, 22 bp, Homo sapiens
gacagctccagctcctccaggc

SEQ ID NO: 7899668 - DNA, 22 bp, Homo sapiens
gacagctcctttctgaggatga

SEQ ID NO: 7899669 - DNA, 22 bp, Homo sapiens
gacagctccttttggtgcatat

SEQ ID NO: 7899670 - DNA, 22 bp, Homo sapiens
gacagctgcatcctcagacaca

SEQ ID NO: 7899671 - DNA, 22 bp, Homo sapiens
gacagctgcatcctcagacaca

SEQ ID NO: 7899672 - DNA, 22 bp, Homo sapiens
gacagctgaaggatgattcagg

SEQ ID NO: 7899673 - DNA, 22 bp, Homo sapiens
gacagctgaaggatgattcagg

SEQ ID NO: 7899674 - DNA, 22 bp, Homo sapiens
gacagctgctcccgtttctgct

SEQ ID NO: 7899675 - DNA, 22 bp, Homo sapiens
gacagctgcctctgtgtagatc

SEQ ID NO: 7899676 - DNA, 22 bp, Homo sapiens
gacagctgcttatgaaccaacg

SEQ ID NO: 7899677 - DNA, 22 bp, Homo sapiens
gacagctgctcccgtttctgct

SEQ ID NO: 7899678 - DNA, 22 bp, Homo sapiens
gacagctggacagacactgatg

SEQ ID NO: 7899679 - DNA, 22 bp, Homo sapiens
gacagctggacagacactgatg

SEQ ID NO: 7899680 - DNA, 22 bp, Homo sapiens
gacagctggacagacactgatg

SEQ ID NO: 7899681 - DNA, 22 bp, Homo sapiens
gacagctgcttatgaaccaacg

SEQ ID NO: 7899682 - DNA, 22 bp, Homo sapiens
gacagctggcagtggaaaggtg

SEQ ID NO: 7899683 - DNA, 22 bp, Homo sapiens
gacagctggcagtggaaaggtg

SEQ ID NO: 7899684 - DNA, 22 bp, Homo sapiens
gacagctggacagacactgatg

SEQ ID NO: 7899685 - DNA, 22 bp, Homo sapiens
gacagccaggcatagggagtat

SEQ ID NO: 7899686 - DNA, 22 bp, Homo sapiens
gacagccatcagcacacgctgc

SEQ ID NO: 7899687 - DNA, 22 bp, Homo sapiens
gacagccaggtctgatgaccca

SEQ ID NO: 7899688 - DNA, 22 bp, Homo sapiens
gacagcagtttttctctagggt

SEQ ID NO: 7899689 - DNA, 22 bp, Homo sapiens
gacagcagtttttctctagggt

SEQ ID NO: 7899690 - DNA, 22 bp, Homo sapiens
gacagcaggtgcttgggaaagg

SEQ ID NO: 7899691 - DNA, 22 bp, Homo sapiens
gacagcagtcctggagttccca

SEQ ID NO: 7899692 - DNA, 22 bp, Homo sapiens
gacagcagtcctggagttccca

SEQ ID NO: 7899693 - DNA, 22 bp, Homo sapiens
gacagcagtcctggagttccca

SEQ ID NO: 7899694 - DNA, 22 bp, Homo sapiens
gacagcagtcctggagttccca

SEQ ID NO: 7899695 - DNA, 22 bp, Homo sapiens
gacagcagtcctggagttccca

SEQ ID NO: 7899696 - DNA, 22 bp, Homo sapiens
gacagcagggacatgtaggaag

SEQ ID NO: 7899697 - DNA, 22 bp, Homo sapiens
gacagcagggacatgtaggaag

SEQ ID NO: 7899698 - DNA, 22 bp, Homo sapiens
gacagcaggtaattagttaaca

SEQ ID NO: 7899699 - DNA, 22 bp, Homo sapiens
gacagcaggtaattagttaaca

SEQ ID NO: 7899700 - DNA, 22 bp, Homo sapiens
gacagcaggtgcttgggaaagg

SEQ ID NO: 7899701 - DNA, 22 bp, Homo sapiens
gacaaatgagacatcaattccc

SEQ ID NO: 7899702 - DNA, 22 bp, Homo sapiens
gacaaatgagacatcaattccc

SEQ ID NO: 7899703 - DNA, 22 bp, Homo sapiens
gacaaatgaatgatgaacacca

SEQ ID NO: 7899704 - DNA, 22 bp, Homo sapiens
gacaaatgagtctcatacccgg

SEQ ID NO: 7899705 - DNA, 22 bp, Homo sapiens
gacaaatgagtctcatacccgg

SEQ ID NO: 7899706 - DNA, 22 bp, Homo sapiens
gacaaatgaatgatgaacacca

SEQ ID NO: 7899707 - DNA, 22 bp, Homo sapiens
gacaaatgaatgatgaacacca

SEQ ID NO: 7899708 - DNA, 22 bp, Homo sapiens
gacaaatgaagtcactgacctt

SEQ ID NO: 7899709 - DNA, 22 bp, Homo sapiens
gacaaatgtacccctagagtct

SEQ ID NO: 7899710 - DNA, 22 bp, Homo sapiens
gacaaatgtacccctagagtct

SEQ ID NO: 7899711 - DNA, 18 bp, Homo sapiens
gacaaatgcaatttaaag

SEQ ID NO: 7899712 - DNA, 18 bp, Homo sapiens
gacaaatgcaatttaaag

SEQ ID NO: 7899713 - DNA, 18 bp, Homo sapiens
gacaaatgcaatttaaag

SEQ ID NO: 7899714 - DNA, 22 bp, Homo sapiens
gacaacaataatgtggagctga

SEQ ID NO: 7899715 - DNA, 22 bp, Homo sapiens
gacaacaataatgtggagctga

SEQ ID NO: 7899716 - DNA, 22 bp, Homo sapiens
gacaaagagaagtaacagtacc

SEQ ID NO: 7899717 - DNA, 22 bp, Homo sapiens
gacaaagtcaacagtactctca

SEQ ID NO: 7899718 - DNA, 22 bp, Homo sapiens
gacaaagtcaacagtactctca

SEQ ID NO: 7899719 - DNA, 22 bp, Homo sapiens
gacaaataggtcaacaggaggg

SEQ ID NO: 7899720 - DNA, 22 bp, Homo sapiens
gacaaataggtcaacaggaggg

SEQ ID NO: 7899721 - DNA, 22 bp, Homo sapiens
gacaaatcattctctgtgtctg

SEQ ID NO: 7899722 - DNA, 22 bp, Homo sapiens
gacaaatcattctctgtgtctg

SEQ ID NO: 7899723 - DNA, 22 bp, Homo sapiens
gacaaatcattctctgtgtctg

SEQ ID NO: 7899724 - DNA, 22 bp, Homo sapiens
gacaaatgaagtcactgacctt

SEQ ID NO: 7899725 - DNA, 22 bp, Homo sapiens
gacaaaggatcagaggttggga

SEQ ID NO: 7899726 - DNA, 22 bp, Homo sapiens
gacagcaggatgtgaggggatg

SEQ ID NO: 7899727 - DNA, 22 bp, Homo sapiens
gacagcaggatgtgaggggatg

SEQ ID NO: 7899728 - DNA, 22 bp, Homo sapiens
gacagcaggatgtgaggggatg

SEQ ID NO: 7899729 - DNA, 22 bp, Homo sapiens
gacagcaggatgtgaggggatg

SEQ ID NO: 7899730 - DNA, 22 bp, Homo sapiens
gacagcaggagatcatgataga

SEQ ID NO: 7899731 - DNA, 22 bp, Homo sapiens
gacagcagggaaagtccagacc

SEQ ID NO: 7899732 - DNA, 22 bp, Homo sapiens
gacagcagggaaagtccagacc

SEQ ID NO: 7899733 - DNA, 22 bp, Homo sapiens
gacagcaggatgtgaggggatg

SEQ ID NO: 7899734 - DNA, 22 bp, Homo sapiens
gacagcagggaaagtccagacc

SEQ ID NO: 7899735 - DNA, 22 bp, Homo sapiens
gacagcagggaaagtccagacc

SEQ ID NO: 7899736 - DNA, 22 bp, Homo sapiens
gacagcagggaaagtccagacc

SEQ ID NO: 7899737 - DNA, 22 bp, Homo sapiens
gacagcagggaaagtccagacc

SEQ ID NO: 7899738 - DNA, 22 bp, Homo sapiens
gacagcagggacatgtaggaag

SEQ ID NO: 7899739 - DNA, 22 bp, Homo sapiens
gacagcagggacatgtaggaag

SEQ ID NO: 7899740 - DNA, 22 bp, Homo sapiens
gacagcagccacagggagaggg

SEQ ID NO: 7899741 - DNA, 22 bp, Homo sapiens
gacagcagccacagggagaggg

SEQ ID NO: 7899742 - DNA, 22 bp, Homo sapiens
gacagcagccacagggagaggg

SEQ ID NO: 7899743 - DNA, 22 bp, Homo sapiens
gacagcagccacagggagaggg

SEQ ID NO: 7899744 - DNA, 22 bp, Homo sapiens
gacagcagccacagggagaggg

SEQ ID NO: 7899745 - DNA, 22 bp, Homo sapiens
gacagcagccacagggagaggg

SEQ ID NO: 7899746 - DNA, 22 bp, Homo sapiens
gacagcagccacagggagaggg

SEQ ID NO: 7899747 - DNA, 22 bp, Homo sapiens
gacagcagccacagggagaggg

SEQ ID NO: 7899748 - DNA, 18 bp, Homo sapiens
gacagcagcttttgttct

SEQ ID NO: 7899749 - DNA, 18 bp, Homo sapiens
gacagcagcttttgttct

SEQ ID NO: 7899750 - DNA, 22 bp, Homo sapiens
gacagcaggagatcatgataga

SEQ ID NO: 7899751 - DNA, 20 bp, Homo sapiens
gacaacagagtaccaggaag

SEQ ID NO: 7899752 - DNA, 20 bp, Homo sapiens
gacaacagagtaccaggaag

SEQ ID NO: 7899753 - DNA, 22 bp, Homo sapiens
gacaaagtgctaaaccacagag

SEQ ID NO: 7899754 - DNA, 20 bp, Homo sapiens
gacaacagagtaccaggaag

SEQ ID NO: 7899755 - DNA, 20 bp, Homo sapiens
gaattttatgaacactacca

SEQ ID NO: 7899756 - DNA, 20 bp, Homo sapiens
gaattttatgaacactacca

SEQ ID NO: 7899757 - DNA, 20 bp, Homo sapiens
gaattttatgaacactacca

SEQ ID NO: 7899758 - DNA, 22 bp, Homo sapiens
gaattttattactagtcaactg

SEQ ID NO: 7899759 - DNA, 20 bp, Homo sapiens
gaattttatgaacactacca

SEQ ID NO: 7899760 - DNA, 22 bp, Homo sapiens
gaatttatctacgttaagtatg

SEQ ID NO: 7899761 - DNA, 22 bp, Homo sapiens
gaatttatctacgttaagtatg

SEQ ID NO: 7899762 - DNA, 22 bp, Homo sapiens
gaatttacagggtgagcttcag

SEQ ID NO: 7899763 - DNA, 22 bp, Homo sapiens
gaatttacaagttgaataacaa

SEQ ID NO: 7899764 - DNA, 22 bp, Homo sapiens
gaatttaaggaccaagcatttt

SEQ ID NO: 7899765 - DNA, 22 bp, Homo sapiens
gaattttattactagtcaactg

SEQ ID NO: 7899766 - DNA, 22 bp, Homo sapiens
gaattttcaggtagcaatttca

SEQ ID NO: 7899767 - DNA, 22 bp, Homo sapiens
gaattttattactagtcaactg

SEQ ID NO: 7899768 - DNA, 22 bp, Homo sapiens
gaattttattactagtcaactg

SEQ ID NO: 7899769 - DNA, 22 bp, Homo sapiens
gaattttgcttttatgtcaagt

SEQ ID NO: 7899770 - DNA, 22 bp, Homo sapiens
gaatttttctggaagcaattat

SEQ ID NO: 7899771 - DNA, 22 bp, Homo sapiens
gaatttttctggaagcaattat

SEQ ID NO: 7899772 - DNA, 22 bp, Homo sapiens
gacaaaacacattagtttaaaa

SEQ ID NO: 7899773 - DNA, 22 bp, Homo sapiens
gacaaaacacattagtttaaaa

SEQ ID NO: 7899774 - DNA, 22 bp, Homo sapiens
gacaaaacacattagtttaaaa

SEQ ID NO: 7899775 - DNA, 22 bp, Homo sapiens
gaatttttctggaagcaattat

SEQ ID NO: 7899776 - DNA, 21 bp, Homo sapiens
gacaaacatttcatagcttta

SEQ ID NO: 7899777 - DNA, 21 bp, Homo sapiens
gacaaacatttcatagcttta

SEQ ID NO: 7899778 - DNA, 22 bp, Homo sapiens
gacaaaagtgttttgaacaagg

SEQ ID NO: 7899779 - DNA, 21 bp, Homo sapiens
gacaaacatttcatagcttta

SEQ ID NO: 7899780 - DNA, 22 bp, Homo sapiens
gacaaactgaagtatatttaga

SEQ ID NO: 7899781 - DNA, 22 bp, Homo sapiens
gacaaagagaagtaacagtacc

SEQ ID NO: 7899782 - DNA, 22 bp, Homo sapiens
gacaaaagtgttttgaacaagg

SEQ ID NO: 7899783 - DNA, 21 bp, Homo sapiens
gacaaacatttcatagcttta

SEQ ID NO: 7899784 - DNA, 21 bp, Homo sapiens
gacaaacatttcatagcttta

SEQ ID NO: 7899785 - DNA, 21 bp, Homo sapiens
gacaaacatttcatagcttta

SEQ ID NO: 7899786 - DNA, 21 bp, Homo sapiens
gacaaacatttcatagcttta

SEQ ID NO: 7899787 - DNA, 22 bp, Homo sapiens
gacaaaagtgttttgaacaagg

SEQ ID NO: 7899788 - DNA, 18 bp, Homo sapiens
gacaaaagtacagacaga

SEQ ID NO: 7899789 - DNA, 22 bp, Homo sapiens
gacaaaagtgttttgaacaagg

SEQ ID NO: 7899790 - DNA, 18 bp, Homo sapiens
gacaaaagtacagacaga

SEQ ID NO: 7899791 - DNA, 18 bp, Homo sapiens
gacaaaagtacagacaga

SEQ ID NO: 7899792 - DNA, 18 bp, Homo sapiens
gacaaaagtacagacaga

SEQ ID NO: 7899793 - DNA, 18 bp, Homo sapiens
gacaaaagtacagacaga

SEQ ID NO: 7899794 - DNA, 22 bp, Homo sapiens
gacaaaactgagatcacactgt

SEQ ID NO: 7899795 - DNA, 22 bp, Homo sapiens
gacaaaactgagatcacactgt

SEQ ID NO: 7899796 - DNA, 22 bp, Homo sapiens
gacaaaactgagatcacactgt

SEQ ID NO: 7899797 - DNA, 22 bp, Homo sapiens
gacaaaactgagatcacactgt

SEQ ID NO: 7899798 - DNA, 22 bp, Homo sapiens
gacaaaactgagatcacactgt

SEQ ID NO: 7899799 - DNA, 18 bp, Homo sapiens
gacaaaagtacagacaga

SEQ ID NO: 7899800 - DNA, 22 bp, Homo sapiens
gaatgctttgggaattcagaat

SEQ ID NO: 7899801 - DNA, 22 bp, Homo sapiens
gaatgctttgggaattcagaat

SEQ ID NO: 7899802 - DNA, 22 bp, Homo sapiens
gaatggaaactgggagatggcc

SEQ ID NO: 7899803 - DNA, 22 bp, Homo sapiens
gaatggaaactgggagatggcc

SEQ ID NO: 7899804 - DNA, 21 bp, Homo sapiens
gaatggcaccattagcatata

SEQ ID NO: 7899805 - DNA, 20 bp, Homo sapiens
gaatggagcctagtgtgtgg

SEQ ID NO: 7899806 - DNA, 22 bp, Homo sapiens
gaatgcttggaacctgaagttc

SEQ ID NO: 7899807 - DNA, 22 bp, Homo sapiens
gaatgctttgggaattcagaat

SEQ ID NO: 7899808 - DNA, 22 bp, Homo sapiens
gaatgcttggaacctgaagttc

SEQ ID NO: 7899809 - DNA, 22 bp, Homo sapiens
gaatgcttggaacctgaagttc

SEQ ID NO: 7899810 - DNA, 22 bp, Homo sapiens
gaatgctgtagacagactctat

SEQ ID NO: 7899811 - DNA, 22 bp, Homo sapiens
gaatgctggcttacaggcagtt

SEQ ID NO: 7899812 - DNA, 22 bp, Homo sapiens
gaatgctggcttacaggcagtt

SEQ ID NO: 7899813 - DNA, 22 bp, Homo sapiens
gaatgctggcttacaggcagtt

SEQ ID NO: 7899814 - DNA, 19 bp, Homo sapiens
gaatgtttgtattcagcgc

SEQ ID NO: 7899815 - DNA, 22 bp, Homo sapiens
gaatgtaagtgggcagaagaca

SEQ ID NO: 7899816 - DNA, 22 bp, Homo sapiens
gaatgtaaaattgcctacaaga

SEQ ID NO: 7899817 - DNA, 22 bp, Homo sapiens
gaatggctcaagattattgtct

SEQ ID NO: 7899818 - DNA, 23 bp, Homo sapiens
gaatggctaagcacatagacttg

SEQ ID NO: 7899819 - DNA, 22 bp, Homo sapiens
gaatggctatcggattattagg

SEQ ID NO: 7899820 - DNA, 22 bp, Homo sapiens
gaattacataataaaatgagag

SEQ ID NO: 7899821 - DNA, 22 bp, Homo sapiens
gaattacataataaaatgagag

SEQ ID NO: 7899822 - DNA, 22 bp, Homo sapiens
gaattacataataaaatgagag

SEQ ID NO: 7899823 - DNA, 22 bp, Homo sapiens
gaattacataataaaatgagag

SEQ ID NO: 7899824 - DNA, 22 bp, Homo sapiens
gaattacataataaaatgagag

SEQ ID NO: 7899825 - DNA, 22 bp, Homo sapiens
gaattacataataaaatgagag

SEQ ID NO: 7899826 - DNA, 22 bp, Homo sapiens
gaattacatagtttctaggttc

SEQ ID NO: 7899827 - DNA, 22 bp, Homo sapiens
gaattacagccagaagaatgaa

SEQ ID NO: 7899828 - DNA, 22 bp, Homo sapiens
gaattacagccagaagaatgaa

SEQ ID NO: 7899829 - DNA, 22 bp, Homo sapiens
gaattacagccagaagaatgaa

SEQ ID NO: 7899830 - DNA, 22 bp, Homo sapiens
gaattacaaagtgagacaagct

SEQ ID NO: 7899831 - DNA, 22 bp, Homo sapiens
gaattacaaagtgagacaagct

SEQ ID NO: 7899832 - DNA, 22 bp, Homo sapiens
gaattacagagttgttaagtca

SEQ ID NO: 7899833 - DNA, 22 bp, Homo sapiens
gaattacaaagtgagacaagct

SEQ ID NO: 7899834 - DNA, 22 bp, Homo sapiens
gaattaaaatagttttggtcga

SEQ ID NO: 7899835 - DNA, 22 bp, Homo sapiens
gaattaaaatagttttggtcga

SEQ ID NO: 7899836 - DNA, 22 bp, Homo sapiens
gaattaattgtgtggtttgaat

SEQ ID NO: 7899837 - DNA, 22 bp, Homo sapiens
gaattaactggcagttagtgct

SEQ ID NO: 7899838 - DNA, 22 bp, Homo sapiens
gaattaaaatagttttggtcga

SEQ ID NO: 7899839 - DNA, 22 bp, Homo sapiens
gaatgcagtgacggaggcttac

SEQ ID NO: 7899840 - DNA, 22 bp, Homo sapiens
gaatgcagttcatttctctatg

SEQ ID NO: 7899841 - DNA, 22 bp, Homo sapiens
gaatgcagtggtgagatcttgg

SEQ ID NO: 7899842 - DNA, 22 bp, Homo sapiens
gaatgcatgtgaagcaaagaat

SEQ ID NO: 7899843 - DNA, 22 bp, Homo sapiens
gaatgctaagcatgtgggagtt

SEQ ID NO: 7899844 - DNA, 22 bp, Homo sapiens
gaatgctaagcatgtgggagtt

SEQ ID NO: 7899845 - DNA, 22 bp, Homo sapiens
gaatgctgagactaaagagctt

SEQ ID NO: 7899846 - DNA, 22 bp, Homo sapiens
gaatgctgagactaaagagctt

SEQ ID NO: 7899847 - DNA, 22 bp, Homo sapiens
gaatgctaagcatgtgggagtt

SEQ ID NO: 7899848 - DNA, 22 bp, Homo sapiens
gaatgctaagcatgtgggagtt

SEQ ID NO: 7899849 - DNA, 22 bp, Homo sapiens
gaatgctaagcatgtgggagtt

SEQ ID NO: 7899850 - DNA, 22 bp, Homo sapiens
gaatgcattctcttagcatcta

SEQ ID NO: 7899851 - DNA, 22 bp, Homo sapiens
gaatgcattctcttagcatcta

SEQ ID NO: 7899852 - DNA, 22 bp, Homo sapiens
gaatgcaaagctctctatgtta

SEQ ID NO: 7899853 - DNA, 22 bp, Homo sapiens
gaatgcaaatatatggatcagt

SEQ ID NO: 7899854 - DNA, 21 bp, Homo sapiens
gaagacaaatgggaatagctg

SEQ ID NO: 7899855 - DNA, 22 bp, Homo sapiens
gaatgcaaagctctctatgtta

SEQ ID NO: 7899856 - DNA, 21 bp, Homo sapiens
gaagacaaatgggaatagctg

SEQ ID NO: 7899857 - DNA, 21 bp, Homo sapiens
gaagacaaatgggaatagctg

SEQ ID NO: 7899858 - DNA, 22 bp, Homo sapiens
gaagacaagctgagtgttgtcc

SEQ ID NO: 7899859 - DNA, 21 bp, Homo sapiens
gaagacaaatgggaatagctg

SEQ ID NO: 7899860 - DNA, 21 bp, Homo sapiens
gaagacaaatgggaatagctg

SEQ ID NO: 7899861 - DNA, 22 bp, Homo sapiens
gaatgcagatggctggtgtatg

SEQ ID NO: 7899862 - DNA, 22 bp, Homo sapiens
gaatgcagggctcctaagattc

SEQ ID NO: 7899863 - DNA, 20 bp, Homo sapiens
gaatgcacacaactgctttc

SEQ ID NO: 7899864 - DNA, 22 bp, Homo sapiens
gaatgcagatggctggtgtatg

SEQ ID NO: 7899865 - DNA, 22 bp, Homo sapiens
gaatgcacttccaacatctatt

SEQ ID NO: 7899866 - DNA, 22 bp, Homo sapiens
gaagaagtgtaagtctgtttca

SEQ ID NO: 7899867 - DNA, 22 bp, Homo sapiens
gaagaatatataatgattttgt

SEQ ID NO: 7899868 - DNA, 22 bp, Homo sapiens
gaagaatatataatgattttgt

SEQ ID NO: 7899869 - DNA, 22 bp, Homo sapiens
gaagaatatggctctcagcaat

SEQ ID NO: 7899870 - DNA, 22 bp, Homo sapiens
gaagaatattcttgatcttaga

SEQ ID NO: 7899871 - DNA, 22 bp, Homo sapiens
gaagaatattcttgatcttaga

SEQ ID NO: 7899872 - DNA, 22 bp, Homo sapiens
gaagaatctgaggacagtcatt

SEQ ID NO: 7899873 - DNA, 22 bp, Homo sapiens
gaagaatctgaggacagtcatt

SEQ ID NO: 7899874 - DNA, 22 bp, Homo sapiens
gaagaatccatgctaatttacc

SEQ ID NO: 7899875 - DNA, 22 bp, Homo sapiens
gaagaaggtggcccaggggtag

SEQ ID NO: 7899876 - DNA, 22 bp, Homo sapiens
gaagaaggtggcccaggggtag

SEQ ID NO: 7899877 - DNA, 22 bp, Homo sapiens
gaagaagtcattctgtctttca

SEQ ID NO: 7899878 - DNA, 22 bp, Homo sapiens
gaagaagtatttttgtcctgtt

SEQ ID NO: 7899879 - DNA, 22 bp, Homo sapiens
gaagaaggtgctacacagggca

SEQ ID NO: 7899880 - DNA, 22 bp, Homo sapiens
gaagaaggaagatcatgcttga

SEQ ID NO: 7899881 - DNA, 22 bp, Homo sapiens
gaagaaggtgctacacagggca

SEQ ID NO: 7899882 - DNA, 22 bp, Homo sapiens
gaagaaggtgctacacagggca

SEQ ID NO: 7899883 - DNA, 22 bp, Homo sapiens
gagcaagactacaggcagatga

SEQ ID NO: 7899884 - DNA, 22 bp, Homo sapiens
gagcaagactcactgcatcttg

SEQ ID NO: 7899885 - DNA, 22 bp, Homo sapiens
gagcaagactacaggcagatga

SEQ ID NO: 7899886 - DNA, 22 bp, Homo sapiens
gagcaagactacaggcagatga

SEQ ID NO: 7899887 - DNA, 22 bp, Homo sapiens
gagcaagactcactgcatcttg

SEQ ID NO: 7899888 - DNA, 22 bp, Homo sapiens
gagcaagactcactgcatcttg

SEQ ID NO: 7899889 - DNA, 22 bp, Homo sapiens
gagcaagactcactgcatcttg

SEQ ID NO: 7899890 - DNA, 22 bp, Homo sapiens
gagcaagattaaaaggctgggt

SEQ ID NO: 7899891 - DNA, 22 bp, Homo sapiens
gagcaagattaaaaggctgggt

SEQ ID NO: 7899892 - DNA, 22 bp, Homo sapiens
gagcaagatcctgtttttctat

SEQ ID NO: 7899893 - DNA, 22 bp, Homo sapiens
gagcaagagtgttggactttga

SEQ ID NO: 7899894 - DNA, 22 bp, Homo sapiens
gagcaagattaaaaggctgggt

SEQ ID NO: 7899895 - DNA, 22 bp, Homo sapiens
gagcaagagtgttggactttga

SEQ ID NO: 7899896 - DNA, 22 bp, Homo sapiens
gagcaaggagggtggggccttt

SEQ ID NO: 7899897 - DNA, 22 bp, Homo sapiens
gagcaagattttataagttgtg

SEQ ID NO: 7899898 - DNA, 22 bp, Homo sapiens
gagcaaggagggtggggccttt

SEQ ID NO: 7899899 - DNA, 22 bp, Homo sapiens
gagcaaggatgggtctatagta

SEQ ID NO: 7899900 - DNA, 22 bp, Homo sapiens
gagcaaggatggccggggccgt

SEQ ID NO: 7899901 - DNA, 22 bp, Homo sapiens
gagcaaggatggccggggccgt

SEQ ID NO: 7899902 - DNA, 22 bp, Homo sapiens
gagcaaggcggcatctctctga

SEQ ID NO: 7899903 - DNA, 22 bp, Homo sapiens
gagcaaggatgggtctatagta

SEQ ID NO: 7899904 - DNA, 22 bp, Homo sapiens
gagcaaggcggcatctctctga

SEQ ID NO: 7899905 - DNA, 22 bp, Homo sapiens
gagcaaggtagctctctggggc

SEQ ID NO: 7899906 - DNA, 22 bp, Homo sapiens
gagcaaggtagctctctggggc

SEQ ID NO: 7899907 - DNA, 22 bp, Homo sapiens
gagcaaggtagctctctggggc

SEQ ID NO: 7899908 - DNA, 22 bp, Homo sapiens
gagcacagatcctggagccaca

SEQ ID NO: 7899909 - DNA, 22 bp, Homo sapiens
gagcacagatcctggagccaca

SEQ ID NO: 7899910 - DNA, 22 bp, Homo sapiens
gagcacagatcctggagccaca

SEQ ID NO: 7899911 - DNA, 22 bp, Homo sapiens
gagcacagaatcttcccatgca

SEQ ID NO: 7899912 - DNA, 22 bp, Homo sapiens
gagcacagatcctggagccaca

SEQ ID NO: 7899913 - DNA, 22 bp, Homo sapiens
gagcacagaatcttcccatgca

SEQ ID NO: 7899914 - DNA, 22 bp, Homo sapiens
gagcacagatcctggagccaca

SEQ ID NO: 7899915 - DNA, 22 bp, Homo sapiens
gagcacagatcctggagccaca

SEQ ID NO: 7899916 - DNA, 22 bp, Homo sapiens
gagcacagaatcttcccatgca

SEQ ID NO: 7899917 - DNA, 22 bp, Homo sapiens
gagcacagaatcttcccatgca

SEQ ID NO: 7899918 - DNA, 22 bp, Homo sapiens
gagcacagaaggagaaatatgg

SEQ ID NO: 7899919 - DNA, 22 bp, Homo sapiens
gagcacagaaggagaaatatgg

SEQ ID NO: 7899920 - DNA, 22 bp, Homo sapiens
gagcacagaactaaatgctggt

SEQ ID NO: 7899921 - DNA, 22 bp, Homo sapiens
gagcaatggaagatagataaca

SEQ ID NO: 7899922 - DNA, 22 bp, Homo sapiens
gagcacacagtgtgcctgtgta

SEQ ID NO: 7899923 - DNA, 22 bp, Homo sapiens
gagcacacagtgtgcctgtgta

SEQ ID NO: 7899924 - DNA, 22 bp, Homo sapiens
gagcacacagtgtgcctgtgta

SEQ ID NO: 7899925 - DNA, 22 bp, Homo sapiens
gagcacagaactaaatgctggt

SEQ ID NO: 7899926 - DNA, 22 bp, Homo sapiens
gagcacagaactaaatgctggt

SEQ ID NO: 7899927 - DNA, 22 bp, Homo sapiens
gagcacagaactaaatgctggt

SEQ ID NO: 7899928 - DNA, 22 bp, Homo sapiens
gagcacagaactaaatgctggt

SEQ ID NO: 7899929 - DNA, 22 bp, Homo sapiens
gagcacagaactaaatgctggt

SEQ ID NO: 7899930 - DNA, 22 bp, Homo sapiens
gagcaatagcaccaattaactc

SEQ ID NO: 7899931 - DNA, 22 bp, Homo sapiens
gagcaatagaaagaatactgct

SEQ ID NO: 7899932 - DNA, 22 bp, Homo sapiens
gagcaaggtagctctctggggc

SEQ ID NO: 7899933 - DNA, 22 bp, Homo sapiens
gagcaatacatggcatgaaatt

SEQ ID NO: 7899934 - DNA, 22 bp, Homo sapiens
gagcaatggaagatagataaca

SEQ ID NO: 7899935 - DNA, 22 bp, Homo sapiens
gagcaatgcccttcaccagccc

SEQ ID NO: 7899936 - DNA, 22 bp, Homo sapiens
gagcaaatggagcttgtctact

SEQ ID NO: 7899937 - DNA, 22 bp, Homo sapiens
gagcaaaggtgcagtttgaaat

SEQ ID NO: 7899938 - DNA, 22 bp, Homo sapiens
gagcaaatggagcttgtctact

SEQ ID NO: 7899939 - DNA, 22 bp, Homo sapiens
gagcaaaggtgcagtttgaaat

SEQ ID NO: 7899940 - DNA, 22 bp, Homo sapiens
gagcaaaggtgcagtttgaaat

SEQ ID NO: 7899941 - DNA, 22 bp, Homo sapiens
gagcaaagcttttagggccttt

SEQ ID NO: 7899942 - DNA, 22 bp, Homo sapiens
gagcaaagcttttagggccttt

SEQ ID NO: 7899943 - DNA, 22 bp, Homo sapiens
gagcaaagcttttagggccttt

SEQ ID NO: 7899944 - DNA, 22 bp, Homo sapiens
gagcaaagcttttagggccttt

SEQ ID NO: 7899945 - DNA, 22 bp, Homo sapiens
gagcaaagcttttagggccttt

SEQ ID NO: 7899946 - DNA, 22 bp, Homo sapiens
gagcaaaataaattctgacaaa

SEQ ID NO: 7899947 - DNA, 22 bp, Homo sapiens
gagcaaacatcagtgatgtctg

SEQ ID NO: 7899948 - DNA, 22 bp, Homo sapiens
gagcaaagcttttagggccttt

SEQ ID NO: 7899949 - DNA, 22 bp, Homo sapiens
gagcaaaataaattctgacaaa

SEQ ID NO: 7899950 - DNA, 22 bp, Homo sapiens
gagcaaaataaattctgacaaa

SEQ ID NO: 7899951 - DNA, 22 bp, Homo sapiens
gagcaaaataaattctgacaaa

SEQ ID NO: 7899952 - DNA, 22 bp, Homo sapiens
gagcaaaataaattctgacaaa

SEQ ID NO: 7899953 - DNA, 22 bp, Homo sapiens
gagcaaaataaattctgacaaa

SEQ ID NO: 7899954 - DNA, 22 bp, Homo sapiens
gagcaaaataaattctgacaaa

SEQ ID NO: 7899955 - DNA, 22 bp, Homo sapiens
gagcaacttcaatagtactatt

SEQ ID NO: 7899956 - DNA, 22 bp, Homo sapiens
gagcaagaccctgggttctctc

SEQ ID NO: 7899957 - DNA, 22 bp, Homo sapiens
gagcaagactacaggcagatga

SEQ ID NO: 7899958 - DNA, 22 bp, Homo sapiens
gagcaacactccacattgctag

SEQ ID NO: 7899959 - DNA, 22 bp, Homo sapiens
gagcaacacgcagtagtatacg

SEQ ID NO: 7899960 - DNA, 22 bp, Homo sapiens
gagcaacactccacattgctag

SEQ ID NO: 7899961 - DNA, 22 bp, Homo sapiens
gagcaacactccacattgctag

SEQ ID NO: 7899962 - DNA, 22 bp, Homo sapiens
gagatttattgacttaacagta

SEQ ID NO: 7899963 - DNA, 22 bp, Homo sapiens
gagatttattgacttaacagta

SEQ ID NO: 7899964 - DNA, 22 bp, Homo sapiens
gagatttaggggggaagatacg

SEQ ID NO: 7899965 - DNA, 22 bp, Homo sapiens
gagaggcaggaatcctgggtga

SEQ ID NO: 7899966 - DNA, 22 bp, Homo sapiens
gagaggcaggaatcctgggtga

SEQ ID NO: 7899967 - DNA, 22 bp, Homo sapiens
gagaggcaggcgctgcaatggt

SEQ ID NO: 7899968 - DNA, 22 bp, Homo sapiens
gagaggcaggcgctgcaatggt

SEQ ID NO: 7899969 - DNA, 22 bp, Homo sapiens
gagaggcaggcgctgcaatggt

SEQ ID NO: 7899970 - DNA, 22 bp, Homo sapiens
gagattttcagcttgactggga

SEQ ID NO: 7899971 - DNA, 22 bp, Homo sapiens
gagattttcagcttgactggga

SEQ ID NO: 7899972 - DNA, 17 bp, Homo sapiens
gagattttcgtcctgaa

SEQ ID NO: 7899973 - DNA, 22 bp, Homo sapiens
gagaggcaggaatcctgggtga

SEQ ID NO: 7899974 - DNA, 22 bp, Homo sapiens
gagaggcaggaatcctgggtga

SEQ ID NO: 7899975 - DNA, 22 bp, Homo sapiens
gagaggcaggaatcctgggtga

SEQ ID NO: 7899976 - DNA, 22 bp, Homo sapiens
gagaggcaggaatcctgggtga

SEQ ID NO: 7899977 - DNA, 22 bp, Homo sapiens
gagaggcagaggcctgaaaccg

SEQ ID NO: 7899978 - DNA, 22 bp, Homo sapiens
gagaggcagaggcctgaaaccg

SEQ ID NO: 7899979 - DNA, 22 bp, Homo sapiens
gagaggcagaggcctgaaaccg

SEQ ID NO: 7899980 - DNA, 22 bp, Homo sapiens
gagaggagtccctatcacagtt

SEQ ID NO: 7899981 - DNA, 22 bp, Homo sapiens
gagcaccctttgcacatcagtc

SEQ ID NO: 7899982 - DNA, 22 bp, Homo sapiens
gagcaccgcctccacgatgccc

SEQ ID NO: 7899983 - DNA, 22 bp, Homo sapiens
gagcaccctacctgccactgag

SEQ ID NO: 7899984 - DNA, 22 bp, Homo sapiens
gagcacccgtcggtggtaggaa

SEQ ID NO: 7899985 - DNA, 22 bp, Homo sapiens
gagcacccatgcagagggaaca

SEQ ID NO: 7899986 - DNA, 22 bp, Homo sapiens
gagcaccaaggctctgccatgg

SEQ ID NO: 7899987 - DNA, 22 bp, Homo sapiens
gagcacagtgtgttgtgatttc

SEQ ID NO: 7899988 - DNA, 22 bp, Homo sapiens
gagcacagtgtgttgtgatttc

SEQ ID NO: 7899989 - DNA, 20 bp, Homo sapiens
gagcacagtaatgactgcta

SEQ ID NO: 7899990 - DNA, 22 bp, Homo sapiens
gagcacagtccttttgttaaaa

SEQ ID NO: 7899991 - DNA, 22 bp, Homo sapiens
gagcacagtccttttgttaaaa

SEQ ID NO: 7899992 - DNA, 22 bp, Homo sapiens
gagcacagtgcagtttctgcta

SEQ ID NO: 7899993 - DNA, 22 bp, Homo sapiens
gagcacagtgtgttgtgatttc

SEQ ID NO: 7899994 - DNA, 22 bp, Homo sapiens
gagcacagtccttttgttaaaa

SEQ ID NO: 7899995 - DNA, 22 bp, Homo sapiens
gagcacagtaaagcagtgtcac

SEQ ID NO: 7899996 - DNA, 20 bp, Homo sapiens
gagcacagtaatgactgcta

SEQ ID NO: 7899997 - DNA, 20 bp, Homo sapiens
gagcacagtaatgactgcta

SEQ ID NO: 7899998 - DNA, 20 bp, Homo sapiens
gagcacagtaatgactgcta

SEQ ID NO: 7899999 - DNA, 22 bp, Homo sapiens
gagcacagatcctggagccaca

SEQ ID NO: 7900000 - DNA, 22 bp, Homo sapiens
gagcacagatcctggagccaca

SEQ ID NO: 7900001 - DNA, 22 bp, Homo sapiens
gagcacagtaaagcagtgtcac

SEQ ID NO: 7900002 - DNA, 22 bp, Homo sapiens
gagcacagtaaagcagtgtcac

SEQ ID NO: 7900003 - DNA, 22 bp, Homo sapiens
gagcacctcaatttgctatttg

SEQ ID NO: 7900004 - DNA, 22 bp, Homo sapiens
gagcactctggcatgtaacctt

SEQ ID NO: 7900005 - DNA, 22 bp, Homo sapiens
gagcactgagctggaattggag

SEQ ID NO: 7900006 - DNA, 22 bp, Homo sapiens
gagcacgttgaagcgcactgtc

SEQ ID NO: 7900007 - DNA, 22 bp, Homo sapiens
gagcacgttgaagcgcactgtc

SEQ ID NO: 7900008 - DNA, 22 bp, Homo sapiens
gagcactgatttatttttgtct

SEQ ID NO: 7900009 - DNA, 22 bp, Homo sapiens
gagcactgaggaaagctggtta

SEQ ID NO: 7900010 - DNA, 22 bp, Homo sapiens
gagcactgatttatttttgtct

SEQ ID NO: 7900011 - DNA, 22 bp, Homo sapiens
gagcactgatttatttttgtct

SEQ ID NO: 7900012 - DNA, 22 bp, Homo sapiens
gagcagacgctgcagtcttggg

SEQ ID NO: 7900013 - DNA, 22 bp, Homo sapiens
gagcagacgctgcagtcttggg

SEQ ID NO: 7900014 - DNA, 22 bp, Homo sapiens
gagcagacgctgcagtcttggg

SEQ ID NO: 7900015 - DNA, 22 bp, Homo sapiens
gagcagaactactcacatatcg

SEQ ID NO: 7900016 - DNA, 22 bp, Homo sapiens
gagcagaactactcacatatcg

SEQ ID NO: 7900017 - DNA, 22 bp, Homo sapiens
gagcagaactactcacatatcg

SEQ ID NO: 7900018 - DNA, 22 bp, Homo sapiens
gagcagaactactcacatatcg

SEQ ID NO: 7900019 - DNA, 22 bp, Homo sapiens
gagcagaacaggccgggtggga

SEQ ID NO: 7900020 - DNA, 22 bp, Homo sapiens
gagcactgtactcatttgcact

SEQ ID NO: 7900021 - DNA, 22 bp, Homo sapiens
gagcacttaatcctgttattca

SEQ ID NO: 7900022 - DNA, 22 bp, Homo sapiens
gagcagaaagttatgtcttgca

SEQ ID NO: 7900023 - DNA, 22 bp, Homo sapiens
gagcagaaagttatgtcttgca

SEQ ID NO: 7900024 - DNA, 22 bp, Homo sapiens
gagcacttcagaattgggcaat

SEQ ID NO: 7900025 - DNA, 22 bp, Homo sapiens
gagcagaaagttatgtcttgca

SEQ ID NO: 7900026 - DNA, 22 bp, Homo sapiens
gagcagaaagttatgtcttgca

SEQ ID NO: 7900027 - DNA, 22 bp, Homo sapiens
gagcagaacaggccgggtggga

SEQ ID NO: 7900028 - DNA, 22 bp, Homo sapiens
gagcagaacaggccgggtggga

SEQ ID NO: 7900029 - DNA, 22 bp, Homo sapiens
gagcaggaaggccagaagggtc

SEQ ID NO: 7900030 - DNA, 22 bp, Homo sapiens
gagcaggacagcagcttcctgg

SEQ ID NO: 7900031 - DNA, 22 bp, Homo sapiens
gagcaggaaggccagaagggtc

SEQ ID NO: 7900032 - DNA, 22 bp, Homo sapiens
gagcaggaaggccagaagggtc

SEQ ID NO: 7900033 - DNA, 22 bp, Homo sapiens
gagcaggaaggccagaagggtc

SEQ ID NO: 7900034 - DNA, 22 bp, Homo sapiens
gagcaggacgtgggaatgggaa

SEQ ID NO: 7900035 - DNA, 22 bp, Homo sapiens
gagcaggacgtgggaatgggaa

SEQ ID NO: 7900036 - DNA, 22 bp, Homo sapiens
gagcaggacgtgggaatgggaa

SEQ ID NO: 7900037 - DNA, 22 bp, Homo sapiens
gagcaggacgtgggaatgggaa

SEQ ID NO: 7900038 - DNA, 22 bp, Homo sapiens
gagcaggacgtgggaatgggaa

SEQ ID NO: 7900039 - DNA, 22 bp, Homo sapiens
gagcaggacgtgggaatgggaa

SEQ ID NO: 7900040 - DNA, 22 bp, Homo sapiens
gagcaggacgtgggaatgggaa

SEQ ID NO: 7900041 - DNA, 22 bp, Homo sapiens
gagcaggacagcagcttcctgg

SEQ ID NO: 7900042 - DNA, 22 bp, Homo sapiens
gagcaggacagcagcttcctgg

SEQ ID NO: 7900043 - DNA, 22 bp, Homo sapiens
gagcaggacagcagcttcctgg

SEQ ID NO: 7900044 - DNA, 22 bp, Homo sapiens
gagcaggaaggccagaagggtc

SEQ ID NO: 7900045 - DNA, 22 bp, Homo sapiens
gagcaggaaggccagaagggtc

SEQ ID NO: 7900046 - DNA, 22 bp, Homo sapiens
gagcaggaaggccagaagggtc

SEQ ID NO: 7900047 - DNA, 22 bp, Homo sapiens
gagcaggaaggccagaagggtc

SEQ ID NO: 7900048 - DNA, 15 bp, Homo sapiens
gagcaggaaacttgg

SEQ ID NO: 7900049 - DNA, 22 bp, Homo sapiens
gagcaggaactgaaaatgagac

SEQ ID NO: 7900050 - DNA, 22 bp, Homo sapiens
gagcaggaactgaaaatgagac

SEQ ID NO: 7900051 - DNA, 22 bp, Homo sapiens
gagcaggaactgaaaatgagac

SEQ ID NO: 7900052 - DNA, 22 bp, Homo sapiens
gagcaggaactgaaaatgagac

SEQ ID NO: 7900053 - DNA, 22 bp, Homo sapiens
gagcaggaactgaaaatgagac

SEQ ID NO: 7900054 - DNA, 22 bp, Homo sapiens
gagcaggaacagatcccttgga

SEQ ID NO: 7900055 - DNA, 22 bp, Homo sapiens
gagcaggaacagatcccttgga

SEQ ID NO: 7900056 - DNA, 22 bp, Homo sapiens
gagcaggaacagatcccttgga

SEQ ID NO: 7900057 - DNA, 22 bp, Homo sapiens
gagcagcttgcgctgtcttcac

SEQ ID NO: 7900058 - DNA, 22 bp, Homo sapiens
gagcagcttgcgctgtcttcac

SEQ ID NO: 7900059 - DNA, 22 bp, Homo sapiens
gagcagcttgcgctgtcttcac

SEQ ID NO: 7900060 - DNA, 15 bp, Homo sapiens
gagcaggaaacttgg

SEQ ID NO: 7900061 - DNA, 19 bp, Homo sapiens
gagcagcttcctatctggt

SEQ ID NO: 7900062 - DNA, 19 bp, Homo sapiens
gagcagcttcctatctggt

SEQ ID NO: 7900063 - DNA, 19 bp, Homo sapiens
gagcagcttcctatctggt

SEQ ID NO: 7900064 - DNA, 19 bp, Homo sapiens
gagcagcttcctatctggt

SEQ ID NO: 7900065 - DNA, 18 bp, Homo sapiens
gagcagaggctcaactgg

SEQ ID NO: 7900066 - DNA, 18 bp, Homo sapiens
gagcagaggctcaactgg

SEQ ID NO: 7900067 - DNA, 16 bp, Homo sapiens
gagcagagcggttcca

SEQ ID NO: 7900068 - DNA, 22 bp, Homo sapiens
gagcagagcttctcaaagtaaa

SEQ ID NO: 7900069 - DNA, 18 bp, Homo sapiens
gagcagaggagggttttt

SEQ ID NO: 7900070 - DNA, 22 bp, Homo sapiens
gagcagagcttctcaaagtaaa

SEQ ID NO: 7900071 - DNA, 23 bp, Homo sapiens
gagcagagcgggcgggggtcctg

SEQ ID NO: 7900072 - DNA, 23 bp, Homo sapiens
gagcagagcgggcgggggtcctg

SEQ ID NO: 7900073 - DNA, 22 bp, Homo sapiens
gagcagagacagtacaactggc

SEQ ID NO: 7900074 - DNA, 22 bp, Homo sapiens
gagcagagacagtacaactggc

SEQ ID NO: 7900075 - DNA, 22 bp, Homo sapiens
gagcagagacagtacaactggc

SEQ ID NO: 7900076 - DNA, 22 bp, Homo sapiens
gagcagagacagtacaactggc

SEQ ID NO: 7900077 - DNA, 22 bp, Homo sapiens
gagcagagacagtacaactggc

SEQ ID NO: 7900078 - DNA, 22 bp, Homo sapiens
gagcagagaatccagctaagtg

SEQ ID NO: 7900079 - DNA, 22 bp, Homo sapiens
gagcagagaatccagctaagtg

SEQ ID NO: 7900080 - DNA, 22 bp, Homo sapiens
gagaaagggaacttacagagtg

SEQ ID NO: 7900081 - DNA, 22 bp, Homo sapiens
gagaaagggaacttacagagtg

SEQ ID NO: 7900082 - DNA, 22 bp, Homo sapiens
gagaaagggaacttacagagtg

SEQ ID NO: 7900083 - DNA, 22 bp, Homo sapiens
gagaaagggaacttacagagtg

SEQ ID NO: 7900084 - DNA, 22 bp, Homo sapiens
gagaaagggaacttacagagtg

SEQ ID NO: 7900085 - DNA, 22 bp, Homo sapiens
gagaaagggaacttacagagtg

SEQ ID NO: 7900086 - DNA, 22 bp, Homo sapiens
gagaacaggctctggagtcaga

SEQ ID NO: 7900087 - DNA, 22 bp, Homo sapiens
gagaaagggataatttgaagag

SEQ ID NO: 7900088 - DNA, 22 bp, Homo sapiens
gagaacaggctctggagtcaga

SEQ ID NO: 7900089 - DNA, 22 bp, Homo sapiens
gagaacaggctctggagtcaga

SEQ ID NO: 7900090 - DNA, 19 bp, Homo sapiens
gactccaactttaagcatg

SEQ ID NO: 7900091 - DNA, 19 bp, Homo sapiens
gactccaactttaagcatg

SEQ ID NO: 7900092 - DNA, 19 bp, Homo sapiens
gactccaactttaagcatg

SEQ ID NO: 7900093 - DNA, 19 bp, Homo sapiens
gactcacaccttccgctgt

SEQ ID NO: 7900094 - DNA, 22 bp, Homo sapiens
gactatttttatctaactgggt

SEQ ID NO: 7900095 - DNA, 19 bp, Homo sapiens
gactcacaccttccgctgt

SEQ ID NO: 7900096 - DNA, 22 bp, Homo sapiens
gactattttgcacaaaacaatt

SEQ ID NO: 7900097 - DNA, 22 bp, Homo sapiens
gagaacattaatagttaatttt

SEQ ID NO: 7900098 - DNA, 22 bp, Homo sapiens
gagaacagtgttgtattttttc

SEQ ID NO: 7900099 - DNA, 22 bp, Homo sapiens
gagaacctactgtatactatat

SEQ ID NO: 7900100 - DNA, 22 bp, Homo sapiens
gagaacctctccacaagtctgg

SEQ ID NO: 7900101 - DNA, 22 bp, Homo sapiens
gagaacctctccacaagtctgg

SEQ ID NO: 7900102 - DNA, 22 bp, Homo sapiens
gagaacttgaacttttcctctg

SEQ ID NO: 7900103 - DNA, 22 bp, Homo sapiens
gagaactgattagcatttgcca

SEQ ID NO: 7900104 - DNA, 22 bp, Homo sapiens
gagaacttcaggattattcaag

SEQ ID NO: 7900105 - DNA, 21 bp, Homo sapiens
gagaactgaaccagagcagct

SEQ ID NO: 7900106 - DNA, 21 bp, Homo sapiens
gagaactgaaccagagcagct

SEQ ID NO: 7900107 - DNA, 22 bp, Homo sapiens
gagaactcagacgcaggtcatg

SEQ ID NO: 7900108 - DNA, 22 bp, Homo sapiens
gagaactcagacgcaggtcatg

SEQ ID NO: 7900109 - DNA, 21 bp, Homo sapiens
gagaactgaaccagagcagct

SEQ ID NO: 7900110 - DNA, 16 bp, Homo sapiens
gagaagagcccggcag

SEQ ID NO: 7900111 - DNA, 22 bp, Homo sapiens
gagaagcaatcagcagccaccc

SEQ ID NO: 7900112 - DNA, 22 bp, Homo sapiens
gagaagcaatcagcagccaccc

SEQ ID NO: 7900113 - DNA, 22 bp, Homo sapiens
gagaagacgtgatggccaagaa

SEQ ID NO: 7900114 - DNA, 22 bp, Homo sapiens
gagaagacgtgatggccaagaa

SEQ ID NO: 7900115 - DNA, 16 bp, Homo sapiens
gagaagagcccggcag

SEQ ID NO: 7900116 - DNA, 22 bp, Homo sapiens
gagaagaaaattccgtgaacac

SEQ ID NO: 7900117 - DNA, 22 bp, Homo sapiens
gagaagaaatagaatcacattt

SEQ ID NO: 7900118 - DNA, 22 bp, Homo sapiens
gagaagaacttgggcaaagtca

SEQ ID NO: 7900119 - DNA, 22 bp, Homo sapiens
gagaagaacttgggcaaagtca

SEQ ID NO: 7900120 - DNA, 22 bp, Homo sapiens
gagaagaacttgggcaaagtca

SEQ ID NO: 7900121 - DNA, 22 bp, Homo sapiens
gagaagaacttgggcaaagtca

SEQ ID NO: 7900122 - DNA, 22 bp, Homo sapiens
gagaagcaatcagtggccaccc

SEQ ID NO: 7900123 - DNA, 22 bp, Homo sapiens
gagaagcaatcagcagccaccc

SEQ ID NO: 7900124 - DNA, 22 bp, Homo sapiens
gagaagcaatcagcagccaccc

SEQ ID NO: 7900125 - DNA, 22 bp, Homo sapiens
gagaagcaatcagtggccaccc

SEQ ID NO: 7900126 - DNA, 22 bp, Homo sapiens
gagaagcaatcagtggccaccc

SEQ ID NO: 7900127 - DNA, 22 bp, Homo sapiens
gagaagcaatcgtgacatctcc

SEQ ID NO: 7900128 - DNA, 22 bp, Homo sapiens
gagaagcaatcgtgacatctcc

SEQ ID NO: 7900129 - DNA, 22 bp, Homo sapiens
gagaagcaatcgtgacatctcc

SEQ ID NO: 7900130 - DNA, 22 bp, Homo sapiens
gagaagcaatcgtgacatctcc

SEQ ID NO: 7900131 - DNA, 22 bp, Homo sapiens
gagaagcaggtttagcagacaa

SEQ ID NO: 7900132 - DNA, 22 bp, Homo sapiens
gagaagcaggtttagcagacaa

SEQ ID NO: 7900133 - DNA, 22 bp, Homo sapiens
gagaagcaggtttagcagacaa

SEQ ID NO: 7900134 - DNA, 22 bp, Homo sapiens
gagaagcaggtttagcagacaa

SEQ ID NO: 7900135 - DNA, 22 bp, Homo sapiens
gagaagcaatttccaactgtgc

SEQ ID NO: 7900136 - DNA, 22 bp, Homo sapiens
gagaagccgagtcagctgagcc

SEQ ID NO: 7900137 - DNA, 22 bp, Homo sapiens
gagaagccgagtcagctgagcc

SEQ ID NO: 7900138 - DNA, 22 bp, Homo sapiens
gagaaggaagttgagccagcat

SEQ ID NO: 7900139 - DNA, 22 bp, Homo sapiens
gagaagccgagtcagctgagcc

SEQ ID NO: 7900140 - DNA, 22 bp, Homo sapiens
gagaagccgagtcagctgagcc

SEQ ID NO: 7900141 - DNA, 22 bp, Homo sapiens
gagaagctggactttccaaact

SEQ ID NO: 7900142 - DNA, 22 bp, Homo sapiens
gagagaagaaagccatggtcct

SEQ ID NO: 7900143 - DNA, 22 bp, Homo sapiens
gagagaagaaagccatggtcct

SEQ ID NO: 7900144 - DNA, 22 bp, Homo sapiens
gagagaagaaagccatggtcct

SEQ ID NO: 7900145 - DNA, 22 bp, Homo sapiens
gagagaagaaagccatggtcct

SEQ ID NO: 7900146 - DNA, 22 bp, Homo sapiens
gagagaagaaagccatggtcct

SEQ ID NO: 7900147 - DNA, 22 bp, Homo sapiens
gagagaagaacaatgtcattca

SEQ ID NO: 7900148 - DNA, 22 bp, Homo sapiens
gagagaagaacaatgtcattca

SEQ ID NO: 7900149 - DNA, 22 bp, Homo sapiens
gagagaagaacaatgtcattca

SEQ ID NO: 7900150 - DNA, 22 bp, Homo sapiens
gagagaagaacaatgtcattca

SEQ ID NO: 7900151 - DNA, 22 bp, Homo sapiens
gagagaagaacaatgtcattca

SEQ ID NO: 7900152 - DNA, 22 bp, Homo sapiens
gagagaagaacaatgtcattca

SEQ ID NO: 7900153 - DNA, 22 bp, Homo sapiens
gagagaagaatgttccgaggcc

SEQ ID NO: 7900154 - DNA, 22 bp, Homo sapiens
gagagaagggacttctacactt

SEQ ID NO: 7900155 - DNA, 22 bp, Homo sapiens
gagagaagggacttctacactt

SEQ ID NO: 7900156 - DNA, 22 bp, Homo sapiens
gagagaagggacttctacactt

SEQ ID NO: 7900157 - DNA, 22 bp, Homo sapiens
gagagaagaatgttccgaggcc

SEQ ID NO: 7900158 - DNA, 22 bp, Homo sapiens
gagagaagaatgttccgaggcc

SEQ ID NO: 7900159 - DNA, 22 bp, Homo sapiens
gagagaagggggatatgagcct

SEQ ID NO: 7900160 - DNA, 22 bp, Homo sapiens
gagagaagggacttctacactt

SEQ ID NO: 7900161 - DNA, 22 bp, Homo sapiens
gagagaagggggatatgagcct

SEQ ID NO: 7900162 - DNA, 22 bp, Homo sapiens
gagagaatgtacatgctagggg

SEQ ID NO: 7900163 - DNA, 22 bp, Homo sapiens
gagagaatgtacatgctagggg

SEQ ID NO: 7900164 - DNA, 22 bp, Homo sapiens
gagagaatgtacatgctagggg

SEQ ID NO: 7900165 - DNA, 22 bp, Homo sapiens
gagagaagggggatatgagcct

SEQ ID NO: 7900166 - DNA, 22 bp, Homo sapiens
gagagaagggggatatgagcct

SEQ ID NO: 7900167 - DNA, 22 bp, Homo sapiens
gagagaagggggatatgagcct

SEQ ID NO: 7900168 - DNA, 22 bp, Homo sapiens
gagaggaggtggctatgacagc

SEQ ID NO: 7900169 - DNA, 22 bp, Homo sapiens
gagaggaggtggctatgacagc

SEQ ID NO: 7900170 - DNA, 22 bp, Homo sapiens
gagaggaggtggctatgacagc

SEQ ID NO: 7900171 - DNA, 22 bp, Homo sapiens
gagaggaggtggctatgacagc

SEQ ID NO: 7900172 - DNA, 18 bp, Homo sapiens
gagaggagccagaatttt

SEQ ID NO: 7900173 - DNA, 22 bp, Homo sapiens
gagaggaggtggctatgacagc

SEQ ID NO: 7900174 - DNA, 22 bp, Homo sapiens
gagaggagtagacactttggtt

SEQ ID NO: 7900175 - DNA, 22 bp, Homo sapiens
gagaggaggtggctatgacagc

SEQ ID NO: 7900176 - DNA, 22 bp, Homo sapiens
gagaggaggtggctatgacagc

SEQ ID NO: 7900177 - DNA, 22 bp, Homo sapiens
gagaggaggtggctatgacagc

SEQ ID NO: 7900178 - DNA, 22 bp, Homo sapiens
gagaggagtaggctgatggtgc

SEQ ID NO: 7900179 - DNA, 22 bp, Homo sapiens
gagaggagtaggctgatggtgc

SEQ ID NO: 7900180 - DNA, 22 bp, Homo sapiens
gagaggagtaggctgatggtgc

SEQ ID NO: 7900181 - DNA, 22 bp, Homo sapiens
gagaggagtaggctgatggtgc

SEQ ID NO: 7900182 - DNA, 22 bp, Homo sapiens
gagaggagtccctatcacagtt

SEQ ID NO: 7900183 - DNA, 22 bp, Homo sapiens
gagaggagtccctatcacagtt

SEQ ID NO: 7900184 - DNA, 22 bp, Homo sapiens
gagaggagtccctatcacagtt

SEQ ID NO: 7900185 - DNA, 22 bp, Homo sapiens
gagaggagtccctatcacagtt

SEQ ID NO: 7900186 - DNA, 22 bp, Homo sapiens
gagagccctgcatggctgatga

SEQ ID NO: 7900187 - DNA, 22 bp, Homo sapiens
gagagccctcactccttccctg

SEQ ID NO: 7900188 - DNA, 22 bp, Homo sapiens
gagagccctgctcctatcccag

SEQ ID NO: 7900189 - DNA, 22 bp, Homo sapiens
gagagctgtaatagtcatgtct

SEQ ID NO: 7900190 - DNA, 22 bp, Homo sapiens
gagagctgtcagcgtagcaccg

SEQ ID NO: 7900191 - DNA, 22 bp, Homo sapiens
gagagctgtaatagtcatgtct

SEQ ID NO: 7900192 - DNA, 22 bp, Homo sapiens
gagagctgtcagcgtagcaccg

SEQ ID NO: 7900193 - DNA, 22 bp, Homo sapiens
gagagctgtcagcgtagcaccg

SEQ ID NO: 7900194 - DNA, 22 bp, Homo sapiens
gagagctgtcagcgtagcaccg

SEQ ID NO: 7900195 - DNA, 22 bp, Homo sapiens
gagagctgtcagcgtagcaccg

SEQ ID NO: 7900196 - DNA, 22 bp, Homo sapiens
gagagctgtcagcgtagcaccg

SEQ ID NO: 7900197 - DNA, 22 bp, Homo sapiens
gagagctgtccggctgagcagc

SEQ ID NO: 7900198 - DNA, 22 bp, Homo sapiens
gagagctgtccggctgagcagc

SEQ ID NO: 7900199 - DNA, 22 bp, Homo sapiens
gagagctgtccggctgagcagc

SEQ ID NO: 7900200 - DNA, 22 bp, Homo sapiens
gagagctgtccggctgagcagc

SEQ ID NO: 7900201 - DNA, 22 bp, Homo sapiens
gagagctgtccggctgagcagc

SEQ ID NO: 7900202 - DNA, 22 bp, Homo sapiens
gagagctgtccggctgagcagc

SEQ ID NO: 7900203 - DNA, 22 bp, Homo sapiens
gagaggagaagcctgcgcttca

SEQ ID NO: 7900204 - DNA, 22 bp, Homo sapiens
gagagctgtccggctgagcagc

SEQ ID NO: 7900205 - DNA, 22 bp, Homo sapiens
gagaggagacttatccagattg

SEQ ID NO: 7900206 - DNA, 22 bp, Homo sapiens
gagaggagacttatccagattg

SEQ ID NO: 7900207 - DNA, 22 bp, Homo sapiens
gagaggagacttatccagattg

SEQ ID NO: 7900208 - DNA, 22 bp, Homo sapiens
gagaggagacttatccagattg

SEQ ID NO: 7900209 - DNA, 22 bp, Homo sapiens
gagaggagacttatccagattg

SEQ ID NO: 7900210 - DNA, 22 bp, Homo sapiens
gagaggagacttatccagattg

SEQ ID NO: 7900211 - DNA, 22 bp, Homo sapiens
gagaggagacttatccagattg

SEQ ID NO: 7900212 - DNA, 18 bp, Homo sapiens
gagaggagccagaatttt

SEQ ID NO: 7900213 - DNA, 18 bp, Homo sapiens
gagaggagccagaatttt

SEQ ID NO: 7900214 - DNA, 22 bp, Homo sapiens
gagagccctacaaggcgttttg

SEQ ID NO: 7900215 - DNA, 18 bp, Homo sapiens
gagagcccagcaggtggt

SEQ ID NO: 7900216 - DNA, 18 bp, Homo sapiens
gagagcccagcaggtggt

SEQ ID NO: 7900217 - DNA, 18 bp, Homo sapiens
gagagcccagcaggtggt

SEQ ID NO: 7900218 - DNA, 18 bp, Homo sapiens
gagagcccagcaggtggt

SEQ ID NO: 7900219 - DNA, 22 bp, Homo sapiens
gagagccatggtggagatgggg

SEQ ID NO: 7900220 - DNA, 22 bp, Homo sapiens
gagagccatggtggagatgggg

SEQ ID NO: 7900221 - DNA, 22 bp, Homo sapiens
gagagccatggtggagatgggg

SEQ ID NO: 7900222 - DNA, 22 bp, Homo sapiens
gagagccagctcactccagggc

SEQ ID NO: 7900223 - DNA, 22 bp, Homo sapiens
gagagccagctcactccagggc

SEQ ID NO: 7900224 - DNA, 22 bp, Homo sapiens
gagagccagctcactccagggc

SEQ ID NO: 7900225 - DNA, 22 bp, Homo sapiens
gagagccagcagtaaagacatt

SEQ ID NO: 7900226 - DNA, 22 bp, Homo sapiens
gagagccatggtggagatgggg

SEQ ID NO: 7900227 - DNA, 22 bp, Homo sapiens
gagagccatggtggagatgggg

SEQ ID NO: 7900228 - DNA, 22 bp, Homo sapiens
gagagccatggtggagatgggg

SEQ ID NO: 7900229 - DNA, 22 bp, Homo sapiens
gagagcaggaggcagcgggacg

SEQ ID NO: 7900230 - DNA, 22 bp, Homo sapiens
gagagcaggctctcgggggcca

SEQ ID NO: 7900231 - DNA, 22 bp, Homo sapiens
gagagcaggaggcagcgggacg

SEQ ID NO: 7900232 - DNA, 22 bp, Homo sapiens
gagagcaggaggcagcgggacg

SEQ ID NO: 7900233 - DNA, 22 bp, Homo sapiens
gagagcaggaggcagcgggacg

SEQ ID NO: 7900234 - DNA, 22 bp, Homo sapiens
gagagcaggaggcagcgggacg

SEQ ID NO: 7900235 - DNA, 22 bp, Homo sapiens
gagagcaggctctcgggggcca

SEQ ID NO: 7900236 - DNA, 22 bp, Homo sapiens
gagagcaggctctcgggggcca

SEQ ID NO: 7900237 - DNA, 22 bp, Homo sapiens
gagagccagcagtaaagacatt

SEQ ID NO: 7900238 - DNA, 22 bp, Homo sapiens
gagagacagcacacagtgtggg

SEQ ID NO: 7900239 - DNA, 22 bp, Homo sapiens
gagagacagcacacagtgtggg

SEQ ID NO: 7900240 - DNA, 22 bp, Homo sapiens
gagagacagcagaacgtgcagc

SEQ ID NO: 7900241 - DNA, 22 bp, Homo sapiens
gagagacagcagaacgtgcagc

SEQ ID NO: 7900242 - DNA, 22 bp, Homo sapiens
gagagacagcagaacgtgcagc

SEQ ID NO: 7900243 - DNA, 22 bp, Homo sapiens
gagagactgatgtggctatgta

SEQ ID NO: 7900244 - DNA, 22 bp, Homo sapiens
gagagagaaaatgactccggac

SEQ ID NO: 7900245 - DNA, 22 bp, Homo sapiens
gagagagaaaatgactccggac

SEQ ID NO: 7900246 - DNA, 22 bp, Homo sapiens
gagagagaaccccgtgcccttc

SEQ ID NO: 7900247 - DNA, 22 bp, Homo sapiens
gagagagaaaatgactccggac

SEQ ID NO: 7900248 - DNA, 22 bp, Homo sapiens
gagagagaaggcctgtgggtgt

SEQ ID NO: 7900249 - DNA, 22 bp, Homo sapiens
gagagagaaccccgtgcccttc

SEQ ID NO: 7900250 - DNA, 22 bp, Homo sapiens
gagagagaaccccgtgcccttc

SEQ ID NO: 7900251 - DNA, 22 bp, Homo sapiens
gagagagaaggcctgtgggtgt

SEQ ID NO: 7900252 - DNA, 22 bp, Homo sapiens
gaggtgaaagttattcatttat

SEQ ID NO: 7900253 - DNA, 22 bp, Homo sapiens
gaggtgaaagttattcatttat

SEQ ID NO: 7900254 - DNA, 22 bp, Homo sapiens
gaggtgagaagggggtcagatg

SEQ ID NO: 7900255 - DNA, 22 bp, Homo sapiens
gaggtgagaagggggtcagatg

SEQ ID NO: 7900256 - DNA, 22 bp, Homo sapiens
gaggtgagaagggggtcagatg

SEQ ID NO: 7900257 - DNA, 22 bp, Homo sapiens
gaggtgagtggatcacgaggtc

SEQ ID NO: 7900258 - DNA, 22 bp, Homo sapiens
gaggtgagtggatcacgaggtc

SEQ ID NO: 7900259 - DNA, 22 bp, Homo sapiens
gaggtgagtggatcacgaggtc

SEQ ID NO: 7900260 - DNA, 22 bp, Homo sapiens
gaggtgagaagggggtcagatg

SEQ ID NO: 7900261 - DNA, 22 bp, Homo sapiens
gaggtgagaagggggtcagatg

SEQ ID NO: 7900262 - DNA, 22 bp, Homo sapiens
gaggtgcctttttgtaattagt

SEQ ID NO: 7900263 - DNA, 22 bp, Homo sapiens
gaggtgcctggcgatgtctctg

SEQ ID NO: 7900264 - DNA, 22 bp, Homo sapiens
gaggtgctgctgtacttcttgc

SEQ ID NO: 7900265 - DNA, 22 bp, Homo sapiens
gaggtgctgctgtacttcttgc

SEQ ID NO: 7900266 - DNA, 22 bp, Homo sapiens
gaggtgagtggatcacgaggtc

SEQ ID NO: 7900267 - DNA, 22 bp, Homo sapiens
gaggtgagtggatcacgaggtc

SEQ ID NO: 7900268 - DNA, 22 bp, Homo sapiens
gaggtgattttcaaaagaactt

SEQ ID NO: 7900269 - DNA, 22 bp, Homo sapiens
gaggtgatggttgcacaatgct

SEQ ID NO: 7900270 - DNA, 22 bp, Homo sapiens
gaggtggctggctcagagccag

SEQ ID NO: 7900271 - DNA, 22 bp, Homo sapiens
gaggtggctggctcagagccag

SEQ ID NO: 7900272 - DNA, 22 bp, Homo sapiens
gaggtggctggctcagagccag

SEQ ID NO: 7900273 - DNA, 22 bp, Homo sapiens
gaggtggctggctcagagccag

SEQ ID NO: 7900274 - DNA, 22 bp, Homo sapiens
gaggtggctggctcagagccag

SEQ ID NO: 7900275 - DNA, 22 bp, Homo sapiens
gaggtggctgcttgctgggaaa

SEQ ID NO: 7900276 - DNA, 22 bp, Homo sapiens
gaggtggctgcttgctgggaaa

SEQ ID NO: 7900277 - DNA, 22 bp, Homo sapiens
gaggtggctgcttgctgggaaa

SEQ ID NO: 7900278 - DNA, 22 bp, Homo sapiens
gaggtggctgcttgctgggaaa

SEQ ID NO: 7900279 - DNA, 18 bp, Homo sapiens
gaggtggctgggccatct

SEQ ID NO: 7900280 - DNA, 18 bp, Homo sapiens
gaggtggctgggccatct

SEQ ID NO: 7900281 - DNA, 22 bp, Homo sapiens
gaggtggctgggagtagggaat

SEQ ID NO: 7900282 - DNA, 22 bp, Homo sapiens
gaggtggctgggagtagggaat

SEQ ID NO: 7900283 - DNA, 22 bp, Homo sapiens
gaggtggctgggagtagggaat

SEQ ID NO: 7900284 - DNA, 18 bp, Homo sapiens
gaggtggctgggccatct

SEQ ID NO: 7900285 - DNA, 22 bp, Homo sapiens
gaggtggctccttcagggaata

SEQ ID NO: 7900286 - DNA, 22 bp, Homo sapiens
gaggtggctccaggagcaatgc

SEQ ID NO: 7900287 - DNA, 22 bp, Homo sapiens
gaggtggctccttcagggaata

SEQ ID NO: 7900288 - DNA, 22 bp, Homo sapiens
gaggtggctccttcagggaata

SEQ ID NO: 7900289 - DNA, 22 bp, Homo sapiens
gaggtggctccttcagggaata

SEQ ID NO: 7900290 - DNA, 22 bp, Homo sapiens
gaggtggctccttcagggaata

SEQ ID NO: 7900291 - DNA, 22 bp, Homo sapiens
gaggtggctgcttgctgggaaa

SEQ ID NO: 7900292 - DNA, 22 bp, Homo sapiens
gaggtggctgcttgctgggaaa

SEQ ID NO: 7900293 - DNA, 22 bp, Homo sapiens
gaggtggaaggcaggaacaaat

SEQ ID NO: 7900294 - DNA, 22 bp, Homo sapiens
gaggtggaaggcaggaacaaat

SEQ ID NO: 7900295 - DNA, 22 bp, Homo sapiens
gaggtggaaggcaggaacaaat

SEQ ID NO: 7900296 - DNA, 22 bp, Homo sapiens
gaggtggatgttgcagtgagct

SEQ ID NO: 7900297 - DNA, 22 bp, Homo sapiens
gaggtggctccaggagcaatgc

SEQ ID NO: 7900298 - DNA, 22 bp, Homo sapiens
gaggtggatgttgcagtgagct

SEQ ID NO: 7900299 - DNA, 22 bp, Homo sapiens
gaggtggctccaggagcaatgc

SEQ ID NO: 7900300 - DNA, 22 bp, Homo sapiens
gaggtggatgttgcagtgagct

SEQ ID NO: 7900301 - DNA, 22 bp, Homo sapiens
gaggtggatgttgcagtgagct

SEQ ID NO: 7900302 - DNA, 22 bp, Homo sapiens
gaggtggatgttgcagtgagct

SEQ ID NO: 7900303 - DNA, 22 bp, Homo sapiens
gaggtggatgttgcagtgagct

SEQ ID NO: 7900304 - DNA, 22 bp, Homo sapiens
gagtaaggctgctgatggagtg

SEQ ID NO: 7900305 - DNA, 22 bp, Homo sapiens
gagtaatattctgtactggagg

SEQ ID NO: 7900306 - DNA, 22 bp, Homo sapiens
gagtaaggctgctgatggagtg

SEQ ID NO: 7900307 - DNA, 22 bp, Homo sapiens
gagtaaggctgctgatggagtg

SEQ ID NO: 7900308 - DNA, 22 bp, Homo sapiens
gagtaacataccaaaattcaca

SEQ ID NO: 7900309 - DNA, 22 bp, Homo sapiens
gagtaacagcataaatttgtga

SEQ ID NO: 7900310 - DNA, 22 bp, Homo sapiens
gagtaaaagttggattacaaag

SEQ ID NO: 7900311 - DNA, 22 bp, Homo sapiens
gagtaaaagttggattacaaag

SEQ ID NO: 7900312 - DNA, 22 bp, Homo sapiens
gagtaaatgtcactgttgctgt

SEQ ID NO: 7900313 - DNA, 22 bp, Homo sapiens
gagtaaaataggtgagaatcaa

SEQ ID NO: 7900314 - DNA, 22 bp, Homo sapiens
gagtaaacacaccttaccagag

SEQ ID NO: 7900315 - DNA, 22 bp, Homo sapiens
gagtaacataccaaaattcaca

SEQ ID NO: 7900316 - DNA, 22 bp, Homo sapiens
gagtacatgtatagagattaac

SEQ ID NO: 7900317 - DNA, 22 bp, Homo sapiens
gagtacatcttaatttgactaa

SEQ ID NO: 7900318 - DNA, 22 bp, Homo sapiens
gagtaattttcttaaaacatca

SEQ ID NO: 7900319 - DNA, 22 bp, Homo sapiens
gagtaattttcttaaaacatca

SEQ ID NO: 7900320 - DNA, 22 bp, Homo sapiens
gagtacagctcttttgttttca

SEQ ID NO: 7900321 - DNA, 22 bp, Homo sapiens
gagtaattagagcaatgacttt

SEQ ID NO: 7900322 - DNA, 22 bp, Homo sapiens
gagtaattccaatataaatcac

SEQ ID NO: 7900323 - DNA, 22 bp, Homo sapiens
gagtaattctggtaaatcattg

SEQ ID NO: 7900324 - DNA, 22 bp, Homo sapiens
gagtaattccttagtgtgctta

SEQ ID NO: 7900325 - DNA, 22 bp, Homo sapiens
gagtaattgtgtctggcacact

SEQ ID NO: 7900326 - DNA, 23 bp, Homo sapiens
gaggtgtgaattctgggtgctgc

SEQ ID NO: 7900327 - DNA, 23 bp, Homo sapiens
gaggtgtgaattctgggtgctgc

SEQ ID NO: 7900328 - DNA, 23 bp, Homo sapiens
gaggtgtgaattctgggtgctgc

SEQ ID NO: 7900329 - DNA, 22 bp, Homo sapiens
gaggttggtgaggggacacggt

SEQ ID NO: 7900330 - DNA, 22 bp, Homo sapiens
gaggtttcactgtgttgtccag

SEQ ID NO: 7900331 - DNA, 22 bp, Homo sapiens
gaggttggtgaggggacacggt

SEQ ID NO: 7900332 - DNA, 22 bp, Homo sapiens
gaggtttcttatcaagaaagct

SEQ ID NO: 7900333 - DNA, 22 bp, Homo sapiens
gaggtgggagggcagtccctaa

SEQ ID NO: 7900334 - DNA, 22 bp, Homo sapiens
gaggtgggagggcagtccctaa

SEQ ID NO: 7900335 - DNA, 22 bp, Homo sapiens
gaggtggcttagtctctggaca

SEQ ID NO: 7900336 - DNA, 22 bp, Homo sapiens
gaggtggcttagtctctggaca

SEQ ID NO: 7900337 - DNA, 22 bp, Homo sapiens
gaggtggcttagtctctggaca

SEQ ID NO: 7900338 - DNA, 22 bp, Homo sapiens
gaggtggcttagtctctggaca

SEQ ID NO: 7900339 - DNA, 22 bp, Homo sapiens
gaggtggcttagtctctggaca

SEQ ID NO: 7900340 - DNA, 22 bp, Homo sapiens
gaggtggcttagtctctggaca

SEQ ID NO: 7900341 - DNA, 22 bp, Homo sapiens
gaggtggcttagtctctggaca

SEQ ID NO: 7900342 - DNA, 22 bp, Homo sapiens
gaggtggcttagtctctggaca

SEQ ID NO: 7900343 - DNA, 19 bp, Homo sapiens
gaggtgtctttcctgagta

SEQ ID NO: 7900344 - DNA, 19 bp, Homo sapiens
gaggtgtctttcctgagta

SEQ ID NO: 7900345 - DNA, 22 bp, Homo sapiens
gaggtgggagggcagtccctaa

SEQ ID NO: 7900346 - DNA, 22 bp, Homo sapiens
gaggtgggagggcagtccctaa

SEQ ID NO: 7900347 - DNA, 22 bp, Homo sapiens
gaggtgggagggcagtccctaa

SEQ ID NO: 7900348 - DNA, 22 bp, Homo sapiens
gagggtgggctcctatctgggt

SEQ ID NO: 7900349 - DNA, 22 bp, Homo sapiens
gagggtgggctcctatctgggt

SEQ ID NO: 7900350 - DNA, 22 bp, Homo sapiens
gagggtgggctttgttcctcca

SEQ ID NO: 7900351 - DNA, 22 bp, Homo sapiens
gagggtgggctttgttcctcca

SEQ ID NO: 7900352 - DNA, 22 bp, Homo sapiens
gagggtgggctcctatctgggt

SEQ ID NO: 7900353 - DNA, 22 bp, Homo sapiens
gagggtgggctcctatctgggt

SEQ ID NO: 7900354 - DNA, 22 bp, Homo sapiens
gagggtgggccagatatgaggg

SEQ ID NO: 7900355 - DNA, 22 bp, Homo sapiens
gagggtgggccagatatgaggg

SEQ ID NO: 7900356 - DNA, 22 bp, Homo sapiens
gagggtgggccagatatgaggg

SEQ ID NO: 7900357 - DNA, 22 bp, Homo sapiens
gagggtgggccagatatgaggg

SEQ ID NO: 7900358 - DNA, 22 bp, Homo sapiens
gagggtggggaatagactgcta

SEQ ID NO: 7900359 - DNA, 22 bp, Homo sapiens
gagggtggggaatagactgcta

SEQ ID NO: 7900360 - DNA, 22 bp, Homo sapiens
gagggtggggaatagactgcta

SEQ ID NO: 7900361 - DNA, 22 bp, Homo sapiens
gagggtggggaatagactgcta

SEQ ID NO: 7900362 - DNA, 22 bp, Homo sapiens
gagggtggggaatagactgcta

SEQ ID NO: 7900363 - DNA, 22 bp, Homo sapiens
gagggtggggaatagactgcta

SEQ ID NO: 7900364 - DNA, 22 bp, Homo sapiens
gagggtggggaatagactgcta

SEQ ID NO: 7900365 - DNA, 22 bp, Homo sapiens
gagggtgggtacaccagccctc

SEQ ID NO: 7900366 - DNA, 22 bp, Homo sapiens
gagggtgggtacaccagccctc

SEQ ID NO: 7900367 - DNA, 22 bp, Homo sapiens
gagggtgggtacaccagccctc

SEQ ID NO: 7900368 - DNA, 22 bp, Homo sapiens
gaggtctgggcttgggcctggt

SEQ ID NO: 7900369 - DNA, 22 bp, Homo sapiens
gaggtctgggatggggcctgaa

SEQ ID NO: 7900370 - DNA, 22 bp, Homo sapiens
gaggtctgggatggggcctgaa

SEQ ID NO: 7900371 - DNA, 22 bp, Homo sapiens
gaggtctgggcttgggcctggt

SEQ ID NO: 7900372 - DNA, 22 bp, Homo sapiens
gaggtctgtgtcactttagtgc

SEQ ID NO: 7900373 - DNA, 22 bp, Homo sapiens
gaggtctgccttcaggagagtt

SEQ ID NO: 7900374 - DNA, 22 bp, Homo sapiens
gaggtctggaccaagtcgcccc

SEQ ID NO: 7900375 - DNA, 22 bp, Homo sapiens
gaggtctgcttatctctcacag

SEQ ID NO: 7900376 - DNA, 22 bp, Homo sapiens
gaggtctggaccaagtcgcccc

SEQ ID NO: 7900377 - DNA, 22 bp, Homo sapiens
gaggtcctctgtgtccgcgggc

SEQ ID NO: 7900378 - DNA, 18 bp, Homo sapiens
gaggtcctgctctagccc

SEQ ID NO: 7900379 - DNA, 22 bp, Homo sapiens
gagggtggtggcttaaggtgct

SEQ ID NO: 7900380 - DNA, 22 bp, Homo sapiens
gagggtggtggcttaaggtgct

SEQ ID NO: 7900381 - DNA, 22 bp, Homo sapiens
gagggtggtggcttaaggtgct

SEQ ID NO: 7900382 - DNA, 22 bp, Homo sapiens
gagggtggtggcttaaggtgct

SEQ ID NO: 7900383 - DNA, 22 bp, Homo sapiens
gagggtgggtttcttgcacgtc

SEQ ID NO: 7900384 - DNA, 22 bp, Homo sapiens
gagggtgggtttcttgcacgtc

SEQ ID NO: 7900385 - DNA, 22 bp, Homo sapiens
gagggtgggtttcttgcacgtc

SEQ ID NO: 7900386 - DNA, 22 bp, Homo sapiens
gagggtgggtttcttgcacgtc

SEQ ID NO: 7900387 - DNA, 22 bp, Homo sapiens
gagggtggctcctccctgggcc

SEQ ID NO: 7900388 - DNA, 22 bp, Homo sapiens
gagggtggctcctccctgggcc

SEQ ID NO: 7900389 - DNA, 22 bp, Homo sapiens
gagggtggctcctccctgggcc

SEQ ID NO: 7900390 - DNA, 22 bp, Homo sapiens
gagggtggctcctccctgggcc

SEQ ID NO: 7900391 - DNA, 20 bp, Homo sapiens
gagggtgggacttcctaggc

SEQ ID NO: 7900392 - DNA, 20 bp, Homo sapiens
gagggtgggacttcctaggc

SEQ ID NO: 7900393 - DNA, 20 bp, Homo sapiens
gagggtgggacttcctaggc

SEQ ID NO: 7900394 - DNA, 22 bp, Homo sapiens
gagggtggcctttagagcccat

SEQ ID NO: 7900395 - DNA, 22 bp, Homo sapiens
gagggtggcctttagagcccat

SEQ ID NO: 7900396 - DNA, 22 bp, Homo sapiens
gagggtggcctttagagcccat

SEQ ID NO: 7900397 - DNA, 22 bp, Homo sapiens
gagggtggcctttagagcccat

SEQ ID NO: 7900398 - DNA, 22 bp, Homo sapiens
gagggtggcctttagagcccat

SEQ ID NO: 7900399 - DNA, 22 bp, Homo sapiens
gagggtggcctttagagcccat

SEQ ID NO: 7900400 - DNA, 22 bp, Homo sapiens
gagggtggcctttagagcccat

SEQ ID NO: 7900401 - DNA, 22 bp, Homo sapiens
gagggtggcctttagagcccat

SEQ ID NO: 7900402 - DNA, 22 bp, Homo sapiens
gagggtggatcagcctgattgg

SEQ ID NO: 7900403 - DNA, 22 bp, Homo sapiens
gagggtggatcagcctgattgg

SEQ ID NO: 7900404 - DNA, 22 bp, Homo sapiens
gagggtggagctccagaatctg

SEQ ID NO: 7900405 - DNA, 22 bp, Homo sapiens
gagggtggagctccagaatctg

SEQ ID NO: 7900406 - DNA, 22 bp, Homo sapiens
gagggtggaagagctgctgaga

SEQ ID NO: 7900407 - DNA, 22 bp, Homo sapiens
gagggtggaagagctgctgaga

SEQ ID NO: 7900408 - DNA, 22 bp, Homo sapiens
gagggtggaagagctgctgaga

SEQ ID NO: 7900409 - DNA, 22 bp, Homo sapiens
gagggtggaagagctgctgaga

SEQ ID NO: 7900410 - DNA, 22 bp, Homo sapiens
gagggtggagctccagaatctg

SEQ ID NO: 7900411 - DNA, 22 bp, Homo sapiens
gagggtggagctccagaatctg

SEQ ID NO: 7900412 - DNA, 22 bp, Homo sapiens
gagggctgataacaggaataca

SEQ ID NO: 7900413 - DNA, 22 bp, Homo sapiens
gagggctgataacaggaataca

SEQ ID NO: 7900414 - DNA, 22 bp, Homo sapiens
gagggctgataacaggaataca

SEQ ID NO: 7900415 - DNA, 22 bp, Homo sapiens
gagggctgatgcttacttattt

SEQ ID NO: 7900416 - DNA, 22 bp, Homo sapiens
gagggctgatgcttacttattt

SEQ ID NO: 7900417 - DNA, 22 bp, Homo sapiens
gagggtcctggctaagtctgac

SEQ ID NO: 7900418 - DNA, 22 bp, Homo sapiens
gagggctgatgttgccacctca

SEQ ID NO: 7900419 - DNA, 22 bp, Homo sapiens
gagggtccctgctcagggccag

SEQ ID NO: 7900420 - DNA, 22 bp, Homo sapiens
gagggtcttacctaagcagggt

SEQ ID NO: 7900421 - DNA, 22 bp, Homo sapiens
gagggtctcttaatgccagggg

SEQ ID NO: 7900422 - DNA, 22 bp, Homo sapiens
gagggtgcaggcaagagcaaaa

SEQ ID NO: 7900423 - DNA, 22 bp, Homo sapiens
gagggtgcaggcaagagcaaaa

SEQ ID NO: 7900424 - DNA, 22 bp, Homo sapiens
gagggtgcaggcaagagcaaaa

SEQ ID NO: 7900425 - DNA, 22 bp, Homo sapiens
gagggtgcaggcaagagcaaaa

SEQ ID NO: 7900426 - DNA, 22 bp, Homo sapiens
gagggtgctgtgccaagatgac

SEQ ID NO: 7900427 - DNA, 22 bp, Homo sapiens
gagggtgctgtgccaagatgac

SEQ ID NO: 7900428 - DNA, 22 bp, Homo sapiens
gagggtgctctgagcccttttg

SEQ ID NO: 7900429 - DNA, 22 bp, Homo sapiens
gagggtgcatgtgagattccta

SEQ ID NO: 7900430 - DNA, 22 bp, Homo sapiens
gagggtgcagctgggccccacg

SEQ ID NO: 7900431 - DNA, 22 bp, Homo sapiens
gagggtgctctgagcccttttg

SEQ ID NO: 7900432 - DNA, 22 bp, Homo sapiens
gagggtgctgtgccaagatgac

SEQ ID NO: 7900433 - DNA, 22 bp, Homo sapiens
gagggtggaaagggtgtacctg

SEQ ID NO: 7900434 - DNA, 22 bp, Homo sapiens
gagggtggaaagggtgtacctg

SEQ ID NO: 7900435 - DNA, 22 bp, Homo sapiens
gagggtggaaagggtgtacctg

SEQ ID NO: 7900436 - DNA, 22 bp, Homo sapiens
gagggtgcaggaggatggtagt

SEQ ID NO: 7900437 - DNA, 22 bp, Homo sapiens
gagggtgcaggaggatggtagt

SEQ ID NO: 7900438 - DNA, 22 bp, Homo sapiens
gagggtgcaggaggatggtagt

SEQ ID NO: 7900439 - DNA, 22 bp, Homo sapiens
gagggtgcaggaggatggtagt

SEQ ID NO: 7900440 - DNA, 22 bp, Homo sapiens
gagggtgcagctgggccccacg

SEQ ID NO: 7900441 - DNA, 22 bp, Homo sapiens
gagggtgacagttctggtctct

SEQ ID NO: 7900442 - DNA, 22 bp, Homo sapiens
gagggccagcagcctcagcatg

SEQ ID NO: 7900443 - DNA, 22 bp, Homo sapiens
gagggccagcagcctcagcatg

SEQ ID NO: 7900444 - DNA, 22 bp, Homo sapiens
gagggccagcagcctcagcatg

SEQ ID NO: 7900445 - DNA, 22 bp, Homo sapiens
gagggccagcagcctcagcatg

SEQ ID NO: 7900446 - DNA, 22 bp, Homo sapiens
gagggccagagtcctggggtca

SEQ ID NO: 7900447 - DNA, 22 bp, Homo sapiens
gagggccagagtcctggggtca

SEQ ID NO: 7900448 - DNA, 22 bp, Homo sapiens
gagggccagagtcctggggtca

SEQ ID NO: 7900449 - DNA, 22 bp, Homo sapiens
gagggccagatcccaggaggaa

SEQ ID NO: 7900450 - DNA, 22 bp, Homo sapiens
gagggccagatcccaggaggaa

SEQ ID NO: 7900451 - DNA, 22 bp, Homo sapiens
gagggccagatcccaggaggaa

SEQ ID NO: 7900452 - DNA, 22 bp, Homo sapiens
gagggccagatcccaggaggaa

SEQ ID NO: 7900453 - DNA, 22 bp, Homo sapiens
gagggccaggcagcaagaaggc

SEQ ID NO: 7900454 - DNA, 22 bp, Homo sapiens
gagggccaggcagcaagaaggc

SEQ ID NO: 7900455 - DNA, 22 bp, Homo sapiens
gagggccaggcagcaagaaggc

SEQ ID NO: 7900456 - DNA, 22 bp, Homo sapiens
gagggccaggcagcaagaaggc

SEQ ID NO: 7900457 - DNA, 22 bp, Homo sapiens
gagggccaggcagcaagaaggc

SEQ ID NO: 7900458 - DNA, 22 bp, Homo sapiens
gagggccagcctgccaagggcc

SEQ ID NO: 7900459 - DNA, 22 bp, Homo sapiens
gagggccagcctgccaagggcc

SEQ ID NO: 7900460 - DNA, 22 bp, Homo sapiens
gagggccaggcggagacaggcg

SEQ ID NO: 7900461 - DNA, 22 bp, Homo sapiens
gagggccaggcggagacaggcg

SEQ ID NO: 7900462 - DNA, 22 bp, Homo sapiens
gagggccaggcggagacaggcg

SEQ ID NO: 7900463 - DNA, 22 bp, Homo sapiens
gagggccaggcggagacaggcg

SEQ ID NO: 7900464 - DNA, 22 bp, Homo sapiens
gagggccaggtagatatcagga

SEQ ID NO: 7900465 - DNA, 22 bp, Homo sapiens
gagggccattctgagggggtga

SEQ ID NO: 7900466 - DNA, 22 bp, Homo sapiens
gagggcctactggacatgtcag

SEQ ID NO: 7900467 - DNA, 22 bp, Homo sapiens
gagggcctactggacatgtcag

SEQ ID NO: 7900468 - DNA, 22 bp, Homo sapiens
gagggccctggctggctccagc

SEQ ID NO: 7900469 - DNA, 22 bp, Homo sapiens
gagggccctggctggctccagc

SEQ ID NO: 7900470 - DNA, 22 bp, Homo sapiens
gagggcctggcacagggaggct

SEQ ID NO: 7900471 - DNA, 22 bp, Homo sapiens
gagggcctggcacagggaggct

SEQ ID NO: 7900472 - DNA, 22 bp, Homo sapiens
gagggcctctgctgctccacat

SEQ ID NO: 7900473 - DNA, 22 bp, Homo sapiens
gagggcctctgctgctccacat

SEQ ID NO: 7900474 - DNA, 22 bp, Homo sapiens
gagggcctagaagctccatatg

SEQ ID NO: 7900475 - DNA, 22 bp, Homo sapiens
gagggcctagaagctccatatg

SEQ ID NO: 7900476 - DNA, 22 bp, Homo sapiens
gagggcctctgctgctccacat

SEQ ID NO: 7900477 - DNA, 22 bp, Homo sapiens
gagggctgaagtgttttatgag

SEQ ID NO: 7900478 - DNA, 22 bp, Homo sapiens
gagggcctggcacagggaggct

SEQ ID NO: 7900479 - DNA, 22 bp, Homo sapiens
gagggctgaagtgttttatgag

SEQ ID NO: 7900480 - DNA, 22 bp, Homo sapiens
gagggctgaagtgttttatgag

SEQ ID NO: 7900481 - DNA, 22 bp, Homo sapiens
gagggctgataaatgcgcatgg

SEQ ID NO: 7900482 - DNA, 22 bp, Homo sapiens
gagggctgataaatgcgcatgg

SEQ ID NO: 7900483 - DNA, 22 bp, Homo sapiens
gagggctgataaatgcgcatgg

SEQ ID NO: 7900484 - DNA, 22 bp, Homo sapiens
gagggctgataaatgcgcatgg

SEQ ID NO: 7900485 - DNA, 22 bp, Homo sapiens
gagggctgataaatgcgcatgg

SEQ ID NO: 7900486 - DNA, 22 bp, Homo sapiens
gagggctgataaatgcgcatgg

SEQ ID NO: 7900487 - DNA, 22 bp, Homo sapiens
gagggctgataacaggaataca

SEQ ID NO: 7900488 - DNA, 22 bp, Homo sapiens
gagggctgataacaggaataca

SEQ ID NO: 7900489 - DNA, 22 bp, Homo sapiens
gagggctgataacaggaataca

SEQ ID NO: 7900490 - DNA, 22 bp, Homo sapiens
gagggctgataacaggaataca

SEQ ID NO: 7900491 - DNA, 22 bp, Homo sapiens
gagggaccccaggctggccctt

SEQ ID NO: 7900492 - DNA, 22 bp, Homo sapiens
gagggacctttacacagacatt

SEQ ID NO: 7900493 - DNA, 22 bp, Homo sapiens
gagggagaaggactatcaggct

SEQ ID NO: 7900494 - DNA, 22 bp, Homo sapiens
gagggagaaggactatcaggct

SEQ ID NO: 7900495 - DNA, 22 bp, Homo sapiens
gagggagaaggactatcaggct

SEQ ID NO: 7900496 - DNA, 22 bp, Homo sapiens
gagggacagctaaagagaaatt

SEQ ID NO: 7900497 - DNA, 22 bp, Homo sapiens
gagggaagtcataatgttctag

SEQ ID NO: 7900498 - DNA, 22 bp, Homo sapiens
gagggaagtcataatgttctag

SEQ ID NO: 7900499 - DNA, 22 bp, Homo sapiens
gagggccacttgaatgttttca

SEQ ID NO: 7900500 - DNA, 22 bp, Homo sapiens
gagggccacttgaatgttttca

SEQ ID NO: 7900501 - DNA, 22 bp, Homo sapiens
gagggccagaaagttattgaga

SEQ ID NO: 7900502 - DNA, 22 bp, Homo sapiens
gagggccagaaagttattgaga

SEQ ID NO: 7900503 - DNA, 22 bp, Homo sapiens
gagggccagagtcctggggtca

SEQ ID NO: 7900504 - DNA, 22 bp, Homo sapiens
gagggccagagtcctggggtca

SEQ ID NO: 7900505 - DNA, 22 bp, Homo sapiens
gagggccacgttcagggctctc

SEQ ID NO: 7900506 - DNA, 22 bp, Homo sapiens
gagggccacgttcagggctctc

SEQ ID NO: 7900507 - DNA, 22 bp, Homo sapiens
gagggccacgttcagggctctc

SEQ ID NO: 7900508 - DNA, 22 bp, Homo sapiens
gagggagaattgcagccagcgt

SEQ ID NO: 7900509 - DNA, 22 bp, Homo sapiens
gagggagaaggactatcaggct

SEQ ID NO: 7900510 - DNA, 21 bp, Homo sapiens
gaggctgtctgctgctggcct

SEQ ID NO: 7900511 - DNA, 21 bp, Homo sapiens
gaggctgtctgctgctggcct

SEQ ID NO: 7900512 - DNA, 22 bp, Homo sapiens
gaggctgtctgttagcctggga

SEQ ID NO: 7900513 - DNA, 22 bp, Homo sapiens
gagggaagaggcctgacatttt

SEQ ID NO: 7900514 - DNA, 22 bp, Homo sapiens
gagggaagaggcctgacatttt

SEQ ID NO: 7900515 - DNA, 22 bp, Homo sapiens
gaggctggtttgccttttggca

SEQ ID NO: 7900516 - DNA, 22 bp, Homo sapiens
gaggctgtaacttgggcactgg

SEQ ID NO: 7900517 - DNA, 22 bp, Homo sapiens
gaggctgtaacttgggcactgg

SEQ ID NO: 7900518 - DNA, 22 bp, Homo sapiens
gaggctgtaacttgggcactgg

SEQ ID NO: 7900519 - DNA, 22 bp, Homo sapiens
gaggctgtaagtgtggagccta

SEQ ID NO: 7900520 - DNA, 22 bp, Homo sapiens
gaggctgtaagtgtggagccta

SEQ ID NO: 7900521 - DNA, 22 bp, Homo sapiens
gagggaagattccccatatggg

SEQ ID NO: 7900522 - DNA, 22 bp, Homo sapiens
gagggaagattccccatatggg

SEQ ID NO: 7900523 - DNA, 22 bp, Homo sapiens
gagggaagagggtttgaattca

SEQ ID NO: 7900524 - DNA, 22 bp, Homo sapiens
gagggaagattccccatatggg

SEQ ID NO: 7900525 - DNA, 22 bp, Homo sapiens
gagggaagagggtttgaattca

SEQ ID NO: 7900526 - DNA, 22 bp, Homo sapiens
gagggaagagggtttgaattca

SEQ ID NO: 7900527 - DNA, 22 bp, Homo sapiens
gagggaagaggcctgacatttt

SEQ ID NO: 7900528 - DNA, 22 bp, Homo sapiens
gagggaagaggcctgacatttt

SEQ ID NO: 7900529 - DNA, 22 bp, Homo sapiens
gagggaagaggcctgacatttt

SEQ ID NO: 7900530 - DNA, 22 bp, Homo sapiens
gagggaaggtcacccttgtagc

SEQ ID NO: 7900531 - DNA, 22 bp, Homo sapiens
gagggaaggtcacccttgtagc

SEQ ID NO: 7900532 - DNA, 22 bp, Homo sapiens
gagggaaggagagttgtagctg

SEQ ID NO: 7900533 - DNA, 22 bp, Homo sapiens
gagggaaggtcacccttgtagc

SEQ ID NO: 7900534 - DNA, 22 bp, Homo sapiens
gagggaagtcataatgttctag

SEQ ID NO: 7900535 - DNA, 22 bp, Homo sapiens
gagggaaggtcacccttgtagc

SEQ ID NO: 7900536 - DNA, 22 bp, Homo sapiens
gagggaaggacccattttaagt

SEQ ID NO: 7900537 - DNA, 22 bp, Homo sapiens
gagggaagattccccatatggg

SEQ ID NO: 7900538 - DNA, 22 bp, Homo sapiens
gagggaagattccccatatggg

SEQ ID NO: 7900539 - DNA, 22 bp, Homo sapiens
gagggaagattccccatatggg

SEQ ID NO: 7900540 - DNA, 22 bp, Homo sapiens
gagggaaggagagttgtagctg

SEQ ID NO: 7900541 - DNA, 22 bp, Homo sapiens
gagggaaggagagttgtagctg

SEQ ID NO: 7900542 - DNA, 22 bp, Homo sapiens
gagggaaggacccattttaagt

SEQ ID NO: 7900543 - DNA, 22 bp, Homo sapiens
gagggaaggacccattttaagt

SEQ ID NO: 7900544 - DNA, 22 bp, Homo sapiens
gaggcctggtttccagcatcct

SEQ ID NO: 7900545 - DNA, 22 bp, Homo sapiens
gaggcctggtttccagcatcct

SEQ ID NO: 7900546 - DNA, 22 bp, Homo sapiens
gaggcctggtttccagcatcct

SEQ ID NO: 7900547 - DNA, 22 bp, Homo sapiens
gaggcctggtttccagcatcct

SEQ ID NO: 7900548 - DNA, 22 bp, Homo sapiens
gaggcctggtttgcatgagaat

SEQ ID NO: 7900549 - DNA, 22 bp, Homo sapiens
gaggcctggtttgcatgagaat

SEQ ID NO: 7900550 - DNA, 22 bp, Homo sapiens
gaggcctggtttgcatgagaat

SEQ ID NO: 7900551 - DNA, 22 bp, Homo sapiens
gaggcctggtttgcatgagaat

SEQ ID NO: 7900552 - DNA, 22 bp, Homo sapiens
gaggcctggtttgcatgagaat

SEQ ID NO: 7900553 - DNA, 22 bp, Homo sapiens
gaggcctgtagtcatggatgta

SEQ ID NO: 7900554 - DNA, 22 bp, Homo sapiens
gaggcctgtagtcatggatgta

SEQ ID NO: 7900555 - DNA, 22 bp, Homo sapiens
gaggcctggtttgcatgagaat

SEQ ID NO: 7900556 - DNA, 22 bp, Homo sapiens
gaggcctggtctatgagatgtt

SEQ ID NO: 7900557 - DNA, 22 bp, Homo sapiens
gaggcctggtctatgagatgtt

SEQ ID NO: 7900558 - DNA, 22 bp, Homo sapiens
gaggcctggtctatgagatgtt

SEQ ID NO: 7900559 - DNA, 22 bp, Homo sapiens
gaggcctggtagccgagcccca

SEQ ID NO: 7900560 - DNA, 22 bp, Homo sapiens
gaggcctggtagccgagcccca

SEQ ID NO: 7900561 - DNA, 22 bp, Homo sapiens
gaggcctggtgctgtgtccaca

SEQ ID NO: 7900562 - DNA, 22 bp, Homo sapiens
gaggcctggtgctgtgtccaca

SEQ ID NO: 7900563 - DNA, 22 bp, Homo sapiens
gaggcctggtgtgtctcccgct

SEQ ID NO: 7900564 - DNA, 22 bp, Homo sapiens
gaggcctggtgctgtgtccaca

SEQ ID NO: 7900565 - DNA, 22 bp, Homo sapiens
gaggcctgtcgctaggcctctg

SEQ ID NO: 7900566 - DNA, 22 bp, Homo sapiens
gaggcctgtagtcatggatgta

SEQ ID NO: 7900567 - DNA, 22 bp, Homo sapiens
gaggcctgtcgctaggcctctg

SEQ ID NO: 7900568 - DNA, 22 bp, Homo sapiens
gaggcctgtcgctaggcctctg

SEQ ID NO: 7900569 - DNA, 22 bp, Homo sapiens
gaggcctgtcgctaggcctctg

SEQ ID NO: 7900570 - DNA, 22 bp, Homo sapiens
gaggcctgtcgctaggcctctg

SEQ ID NO: 7900571 - DNA, 22 bp, Homo sapiens
gaggcctgtcgctaggcctctg

SEQ ID NO: 7900572 - DNA, 22 bp, Homo sapiens
gaggcctgtcgctaggcctctg

SEQ ID NO: 7900573 - DNA, 22 bp, Homo sapiens
gaggccttagagcttttctaga

SEQ ID NO: 7900574 - DNA, 22 bp, Homo sapiens
gaggccttcctctcaagcacat

SEQ ID NO: 7900575 - DNA, 22 bp, Homo sapiens
gaggccttcagaaggcattagt

SEQ ID NO: 7900576 - DNA, 22 bp, Homo sapiens
gaggccttcagaaggcattagt

SEQ ID NO: 7900577 - DNA, 22 bp, Homo sapiens
gaggccttcacttatttaaggg

SEQ ID NO: 7900578 - DNA, 22 bp, Homo sapiens
gaggccttcacttatttaaggg

SEQ ID NO: 7900579 - DNA, 22 bp, Homo sapiens
gaggccttagagcttttctaga

SEQ ID NO: 7900580 - DNA, 22 bp, Homo sapiens
gaggccttagagcttttctaga

SEQ ID NO: 7900581 - DNA, 19 bp, Homo sapiens
gaggcgaggcgtgcaggag

SEQ ID NO: 7900582 - DNA, 19 bp, Homo sapiens
gaggcgaggcgtgcaggag

SEQ ID NO: 7900583 - DNA, 22 bp, Homo sapiens
gaggcgcagcccggaggagaca

SEQ ID NO: 7900584 - DNA, 19 bp, Homo sapiens
gaggcgaggcgtgcaggag

SEQ ID NO: 7900585 - DNA, 19 bp, Homo sapiens
gaggcgaggcgtgcaggag

SEQ ID NO: 7900586 - DNA, 19 bp, Homo sapiens
gaggcgaggcgtgcaggag

SEQ ID NO: 7900587 - DNA, 19 bp, Homo sapiens
gaggcgaggcgtgcaggag

SEQ ID NO: 7900588 - DNA, 18 bp, Homo sapiens
gaggcgagctcttcagaa

SEQ ID NO: 7900589 - DNA, 22 bp, Homo sapiens
gaggcgagaagctggagatggt

SEQ ID NO: 7900590 - DNA, 22 bp, Homo sapiens
gaggcctttatgtacatctagt

SEQ ID NO: 7900591 - DNA, 22 bp, Homo sapiens
gaggcgagaagctggagatggt

SEQ ID NO: 7900592 - DNA, 22 bp, Homo sapiens
gaggccttgggatgtgccacgg

SEQ ID NO: 7900593 - DNA, 22 bp, Homo sapiens
gaggccttcctctcaagcacat

SEQ ID NO: 7900594 - DNA, 22 bp, Homo sapiens
gaggccttgggatgtgccacgg

SEQ ID NO: 7900595 - DNA, 22 bp, Homo sapiens
gaggcctttatgtacatctagt

SEQ ID NO: 7900596 - DNA, 22 bp, Homo sapiens
gaggccttgggatgtgccacgg

SEQ ID NO: 7900597 - DNA, 22 bp, Homo sapiens
gaggcgagaagctggagatggt

SEQ ID NO: 7900598 - DNA, 22 bp, Homo sapiens
gaggctggtcagccctaagatc

SEQ ID NO: 7900599 - DNA, 22 bp, Homo sapiens
gaggctggtcagccctaagatc

SEQ ID NO: 7900600 - DNA, 22 bp, Homo sapiens
gaggctggtcagccctaagatc

SEQ ID NO: 7900601 - DNA, 22 bp, Homo sapiens
gaggctggtcagccctaagatc

SEQ ID NO: 7900602 - DNA, 22 bp, Homo sapiens
gaggctggtggttagttccatt

SEQ ID NO: 7900603 - DNA, 22 bp, Homo sapiens
gaggctggtggttagttccatt

SEQ ID NO: 7900604 - DNA, 22 bp, Homo sapiens
gaggctggtggttagttccatt

SEQ ID NO: 7900605 - DNA, 22 bp, Homo sapiens
gaggctggtggttagttccatt

SEQ ID NO: 7900606 - DNA, 22 bp, Homo sapiens
gaggctggtcagccctaagatc

SEQ ID NO: 7900607 - DNA, 22 bp, Homo sapiens
gaggctggtcagccctaagatc

SEQ ID NO: 7900608 - DNA, 22 bp, Homo sapiens
gaggctggtcagccctaagatc

SEQ ID NO: 7900609 - DNA, 22 bp, Homo sapiens
gaggctggtggttagttccatt

SEQ ID NO: 7900610 - DNA, 22 bp, Homo sapiens
gaggctggtggttagttccatt

SEQ ID NO: 7900611 - DNA, 22 bp, Homo sapiens
gaggctggttcccttgatcttt

SEQ ID NO: 7900612 - DNA, 22 bp, Homo sapiens
gaggctggttcccttgatcttt

SEQ ID NO: 7900613 - DNA, 22 bp, Homo sapiens
gaggctggttcccttgatcttt

SEQ ID NO: 7900614 - DNA, 22 bp, Homo sapiens
gaggctggttctgaagtactgt

SEQ ID NO: 7900615 - DNA, 22 bp, Homo sapiens
gaggctggttctgaagtactgt

SEQ ID NO: 7900616 - DNA, 22 bp, Homo sapiens
gaggctggttctgaagtactgt

SEQ ID NO: 7900617 - DNA, 22 bp, Homo sapiens
gaggctggttctgaagtactgt

SEQ ID NO: 7900618 - DNA, 22 bp, Homo sapiens
gaggctggtggttagttccatt

SEQ ID NO: 7900619 - DNA, 22 bp, Homo sapiens
gaggctggggtctgcctttctg

SEQ ID NO: 7900620 - DNA, 22 bp, Homo sapiens
gaggctggggtctgcctttctg

SEQ ID NO: 7900621 - DNA, 22 bp, Homo sapiens
gaggctggggtctgcctttctg

SEQ ID NO: 7900622 - DNA, 22 bp, Homo sapiens
gaggctggggtctgcctttctg

SEQ ID NO: 7900623 - DNA, 22 bp, Homo sapiens
gaggctggggtctgcctttctg

SEQ ID NO: 7900624 - DNA, 22 bp, Homo sapiens
gaggctggggtctgcctttctg

SEQ ID NO: 7900625 - DNA, 22 bp, Homo sapiens
gaggctggggtctgcctttctg

SEQ ID NO: 7900626 - DNA, 22 bp, Homo sapiens
gaggctcaaacctggacagagc

SEQ ID NO: 7900627 - DNA, 22 bp, Homo sapiens
gaggctcaaacctggacagagc

SEQ ID NO: 7900628 - DNA, 22 bp, Homo sapiens
gaggctcaaacctggacagagc

SEQ ID NO: 7900629 - DNA, 22 bp, Homo sapiens
gaggctcaacccacaggggttg

SEQ ID NO: 7900630 - DNA, 22 bp, Homo sapiens
gaggctcaacccacaggggttg

SEQ ID NO: 7900631 - DNA, 22 bp, Homo sapiens
gaggctggtaggaaaggaaaca

SEQ ID NO: 7900632 - DNA, 22 bp, Homo sapiens
gaggctggtaggaaaggaaaca

SEQ ID NO: 7900633 - DNA, 22 bp, Homo sapiens
gaggctggggtctgcctttctg

SEQ ID NO: 7900634 - DNA, 22 bp, Homo sapiens
gaggctggggtctgcctttctg

SEQ ID NO: 7900635 - DNA, 22 bp, Homo sapiens
gaggcggcggccgagcctggct

SEQ ID NO: 7900636 - DNA, 22 bp, Homo sapiens
gaggcggtacagccagtcctcc

SEQ ID NO: 7900637 - DNA, 22 bp, Homo sapiens
gaggcggcggccgagcctggct

SEQ ID NO: 7900638 - DNA, 22 bp, Homo sapiens
gaggcggaggttgcagtgagcc

SEQ ID NO: 7900639 - DNA, 22 bp, Homo sapiens
gaggcggaggttgcagtgagct

SEQ ID NO: 7900640 - DNA, 22 bp, Homo sapiens
gaggctaagtaactgtccatgg

SEQ ID NO: 7900641 - DNA, 22 bp, Homo sapiens
gaggctaagcactggcatttct

SEQ ID NO: 7900642 - DNA, 22 bp, Homo sapiens
gaggctcaaacctggacagagc

SEQ ID NO: 7900643 - DNA, 22 bp, Homo sapiens
gaggctagatgtttgctgggag

SEQ ID NO: 7900644 - DNA, 22 bp, Homo sapiens
gagctcattgtggatggatggg

SEQ ID NO: 7900645 - DNA, 22 bp, Homo sapiens
gagctccaccaccttcaggcag

SEQ ID NO: 7900646 - DNA, 22 bp, Homo sapiens
gagctccaccaccttcaggcag

SEQ ID NO: 7900647 - DNA, 22 bp, Homo sapiens
gagctccaccaccttcaggcag

SEQ ID NO: 7900648 - DNA, 22 bp, Homo sapiens
gagctcatccccatggtccgtc

SEQ ID NO: 7900649 - DNA, 22 bp, Homo sapiens
gagctcataccctcttctcttt

SEQ ID NO: 7900650 - DNA, 22 bp, Homo sapiens
gagctcattcattcattgcctg

SEQ ID NO: 7900651 - DNA, 22 bp, Homo sapiens
gagctccagagttagacacccg

SEQ ID NO: 7900652 - DNA, 22 bp, Homo sapiens
gagctccagagttagacacccg

SEQ ID NO: 7900653 - DNA, 22 bp, Homo sapiens
gagctccagcatctctgccaaa

SEQ ID NO: 7900654 - DNA, 22 bp, Homo sapiens
gagctccagggaacagcagcta

SEQ ID NO: 7900655 - DNA, 22 bp, Homo sapiens
gagctccagcatctctgccaaa

SEQ ID NO: 7900656 - DNA, 22 bp, Homo sapiens
gagctccacttagcaaggccac

SEQ ID NO: 7900657 - DNA, 22 bp, Homo sapiens
gagctccacttagcaaggccac

SEQ ID NO: 7900658 - DNA, 22 bp, Homo sapiens
gagctcaggtggtcaaaacaat

SEQ ID NO: 7900659 - DNA, 22 bp, Homo sapiens
gagctcagggcattgagcaaga

SEQ ID NO: 7900660 - DNA, 23 bp, Homo sapiens
gagctcaggtagggctcgcccgc

SEQ ID NO: 7900661 - DNA, 22 bp, Homo sapiens
gagctcagggcattgagcaaga

SEQ ID NO: 7900662 - DNA, 22 bp, Homo sapiens
gagctcatccccatggtccgtc

SEQ ID NO: 7900663 - DNA, 22 bp, Homo sapiens
gagctcagtgtagtcatggctt

SEQ ID NO: 7900664 - DNA, 22 bp, Homo sapiens
gagctcagtgtagtcatggctt

SEQ ID NO: 7900665 - DNA, 22 bp, Homo sapiens
gagctcagtgtagtcatggctt

SEQ ID NO: 7900666 - DNA, 22 bp, Homo sapiens
gagctcagtgtagtcatggctt

SEQ ID NO: 7900667 - DNA, 22 bp, Homo sapiens
gagctcagattctggtgtcaga

SEQ ID NO: 7900668 - DNA, 22 bp, Homo sapiens
gagctcagattctggtgtcaga

SEQ ID NO: 7900669 - DNA, 22 bp, Homo sapiens
gagctcagattctggtgtcaga

SEQ ID NO: 7900670 - DNA, 22 bp, Homo sapiens
gagctcagcaaaggtctgtgtg

SEQ ID NO: 7900671 - DNA, 22 bp, Homo sapiens
gagctcagcaaaggtctgtgtg

SEQ ID NO: 7900672 - DNA, 22 bp, Homo sapiens
gagctcagcaaaggtctgtgtg

SEQ ID NO: 7900673 - DNA, 22 bp, Homo sapiens
gagctcagcactaaaatcatgt

SEQ ID NO: 7900674 - DNA, 22 bp, Homo sapiens
gagctcagcccaaagagcagtg

SEQ ID NO: 7900675 - DNA, 22 bp, Homo sapiens
gagctcagcccaaagagcagtg

SEQ ID NO: 7900676 - DNA, 22 bp, Homo sapiens
gagctcagcctgaggcctggct

SEQ ID NO: 7900677 - DNA, 22 bp, Homo sapiens
gagctcaggagcatcagaagaa

SEQ ID NO: 7900678 - DNA, 22 bp, Homo sapiens
gagctcaggagcatcagaagaa

SEQ ID NO: 7900679 - DNA, 22 bp, Homo sapiens
gagctcaggagcatcagaagaa

SEQ ID NO: 7900680 - DNA, 22 bp, Homo sapiens
gagctcaggagcatcagaagaa

SEQ ID NO: 7900681 - DNA, 22 bp, Homo sapiens
gagctcagcccaaagagcagtg

SEQ ID NO: 7900682 - DNA, 22 bp, Homo sapiens
gagctcagcccaaagagcagtg

SEQ ID NO: 7900683 - DNA, 22 bp, Homo sapiens
gagctcagcctgaggcctggct

SEQ ID NO: 7900684 - DNA, 22 bp, Homo sapiens
gagctcagcccaaagagcagtg

SEQ ID NO: 7900685 - DNA, 22 bp, Homo sapiens
gagctcagaggattctggggag

SEQ ID NO: 7900686 - DNA, 22 bp, Homo sapiens
gagctcagagcctatagttggt

SEQ ID NO: 7900687 - DNA, 22 bp, Homo sapiens
gagctcagaggattctggggag

SEQ ID NO: 7900688 - DNA, 22 bp, Homo sapiens
gagctcagactcgggcctgggg

SEQ ID NO: 7900689 - DNA, 22 bp, Homo sapiens
gagcaggctctgcctgtgtgtc

SEQ ID NO: 7900690 - DNA, 22 bp, Homo sapiens
gagcaggctctgcctgtgtgtc

SEQ ID NO: 7900691 - DNA, 22 bp, Homo sapiens
gagcaggcctggggtgaggcct

SEQ ID NO: 7900692 - DNA, 22 bp, Homo sapiens
gagcaggctctgcctgtgtgtc

SEQ ID NO: 7900693 - DNA, 22 bp, Homo sapiens
gagcaggctctgcctgtgtgtc

SEQ ID NO: 7900694 - DNA, 22 bp, Homo sapiens
gagcaggctctgcctgtgtgtc

SEQ ID NO: 7900695 - DNA, 22 bp, Homo sapiens
gagcaggctctgcctgtgtgtc

SEQ ID NO: 7900696 - DNA, 22 bp, Homo sapiens
gagcaggctctgcctgtgtgtc

SEQ ID NO: 7900697 - DNA, 22 bp, Homo sapiens
gagcaggcctggggtgaggcct

SEQ ID NO: 7900698 - DNA, 22 bp, Homo sapiens
gagcaggccagcaatggaaggg

SEQ ID NO: 7900699 - DNA, 19 bp, Homo sapiens
gagcaggccacacatgtgt

SEQ ID NO: 7900700 - DNA, 22 bp, Homo sapiens
gagcaggccagcaatggaaggg

SEQ ID NO: 7900701 - DNA, 19 bp, Homo sapiens
gagcaggccacacatgtgt

SEQ ID NO: 7900702 - DNA, 22 bp, Homo sapiens
gagcaggcctggggtgaggcct

SEQ ID NO: 7900703 - DNA, 22 bp, Homo sapiens
gagcaggcctggggtgaggcct

SEQ ID NO: 7900704 - DNA, 22 bp, Homo sapiens
gagcaggcctggggtgaggcct

SEQ ID NO: 7900705 - DNA, 22 bp, Homo sapiens
gagcaggccagcaatggaaggg

SEQ ID NO: 7900706 - DNA, 22 bp, Homo sapiens
gagcaggcctggggtgaggcct

SEQ ID NO: 7900707 - DNA, 22 bp, Homo sapiens
gagcaggcctggggtgaggcct

SEQ ID NO: 7900708 - DNA, 22 bp, Homo sapiens
gagcaggcctggggtgaggcct

SEQ ID NO: 7900709 - DNA, 22 bp, Homo sapiens
gagcaggatgggagctggggcc

SEQ ID NO: 7900710 - DNA, 22 bp, Homo sapiens
gagcaggcaaagatgaaaggag

SEQ ID NO: 7900711 - DNA, 22 bp, Homo sapiens
gagcaggcaaagatgaaaggag

SEQ ID NO: 7900712 - DNA, 22 bp, Homo sapiens
gagcaggcaactctgcagtgcc

SEQ ID NO: 7900713 - DNA, 22 bp, Homo sapiens
gagcaggcaaagatgaaaggag

SEQ ID NO: 7900714 - DNA, 22 bp, Homo sapiens
gagcaggatggcacttctgtga

SEQ ID NO: 7900715 - DNA, 22 bp, Homo sapiens
gagcaggatggcacttctgtga

SEQ ID NO: 7900716 - DNA, 22 bp, Homo sapiens
gagcaggacagcagcttcctgg

SEQ ID NO: 7900717 - DNA, 22 bp, Homo sapiens
gagcaggatggcacttctgtga

SEQ ID NO: 7900718 - DNA, 22 bp, Homo sapiens
gagcaggatgggagctggggcc

SEQ ID NO: 7900719 - DNA, 22 bp, Homo sapiens
gagcaggatggcacttctgtga

SEQ ID NO: 7900720 - DNA, 22 bp, Homo sapiens
gagcaggatgggagctggggcc

SEQ ID NO: 7900721 - DNA, 22 bp, Homo sapiens
gagcaggatgggagctggggcc

SEQ ID NO: 7900722 - DNA, 22 bp, Homo sapiens
gagcaggatgggagctggggcc

SEQ ID NO: 7900723 - DNA, 22 bp, Homo sapiens
gagcaggatgggagctggggcc

SEQ ID NO: 7900724 - DNA, 22 bp, Homo sapiens
gagcaggcattctagtggctga

SEQ ID NO: 7900725 - DNA, 22 bp, Homo sapiens
gagcaggcattctagtggctga

SEQ ID NO: 7900726 - DNA, 22 bp, Homo sapiens
gagcaggcattctagtggctga

SEQ ID NO: 7900727 - DNA, 19 bp, Homo sapiens
gagcaggccacacatgtgt

SEQ ID NO: 7900728 - DNA, 19 bp, Homo sapiens
gagcaggccacacatgtgt

SEQ ID NO: 7900729 - DNA, 22 bp, Homo sapiens
gagcaggcattctagtggctga

SEQ ID NO: 7900730 - DNA, 22 bp, Homo sapiens
gagcaggcattctagtggctga

SEQ ID NO: 7900731 - DNA, 22 bp, Homo sapiens
gagcaggcattctagtggctga

SEQ ID NO: 7900732 - DNA, 22 bp, Homo sapiens
gagcaggcaactctgcagtgcc

SEQ ID NO: 7900733 - DNA, 22 bp, Homo sapiens
gagcaggcaactctgcagtgcc

SEQ ID NO: 7900734 - DNA, 22 bp, Homo sapiens
gagcaggcaactctgcagtgcc

SEQ ID NO: 7900735 - DNA, 22 bp, Homo sapiens
gagcaggcaactctgcagtgcc

SEQ ID NO: 7900736 - DNA, 22 bp, Homo sapiens
gagctctaaccagggacaatta

SEQ ID NO: 7900737 - DNA, 22 bp, Homo sapiens
gagctgggattcatctatgtct

SEQ ID NO: 7900738 - DNA, 22 bp, Homo sapiens
gagctgggatttgaacctggga

SEQ ID NO: 7900739 - DNA, 22 bp, Homo sapiens
gagctgggatttgaacctggga

SEQ ID NO: 7900740 - DNA, 22 bp, Homo sapiens
gagctgggcacacgccacttga

SEQ ID NO: 7900741 - DNA, 22 bp, Homo sapiens
gagctgggcacacgccacttga

SEQ ID NO: 7900742 - DNA, 22 bp, Homo sapiens
gagctgggcacacgccacttga

SEQ ID NO: 7900743 - DNA, 22 bp, Homo sapiens
gagctgggcctcagaacacagt

SEQ ID NO: 7900744 - DNA, 22 bp, Homo sapiens
gagctgggcctcagaacacagt

SEQ ID NO: 7900745 - DNA, 22 bp, Homo sapiens
gagctcctggattgctcctagg

SEQ ID NO: 7900746 - DNA, 22 bp, Homo sapiens
gagctcctgctgcatcctgcct

SEQ ID NO: 7900747 - DNA, 22 bp, Homo sapiens
gagctcctatggtcggtggctc

SEQ ID NO: 7900748 - DNA, 22 bp, Homo sapiens
gagctcccaggccccagcaagg

SEQ ID NO: 7900749 - DNA, 22 bp, Homo sapiens
gagctccagggaacagcagcta

SEQ ID NO: 7900750 - DNA, 22 bp, Homo sapiens
gagctccagggaacagcagcta

SEQ ID NO: 7900751 - DNA, 22 bp, Homo sapiens
gagctggtaaaggatcttgtct

SEQ ID NO: 7900752 - DNA, 22 bp, Homo sapiens
gagctggtcagtttcaggagag

SEQ ID NO: 7900753 - DNA, 22 bp, Homo sapiens
gagctggtattccagtttagtt

SEQ ID NO: 7900754 - DNA, 22 bp, Homo sapiens
gagctggtcagtttcaggagag

SEQ ID NO: 7900755 - DNA, 22 bp, Homo sapiens
gagctggtcagtttcaggagag

SEQ ID NO: 7900756 - DNA, 22 bp, Homo sapiens
gagctggtcagtttcagggcca

SEQ ID NO: 7900757 - DNA, 22 bp, Homo sapiens
gagctggtcagtttcagggcca

SEQ ID NO: 7900758 - DNA, 22 bp, Homo sapiens
gagctggtcagtttcagggcca

SEQ ID NO: 7900759 - DNA, 22 bp, Homo sapiens
gagctggtcagtttcaggagag

SEQ ID NO: 7900760 - DNA, 22 bp, Homo sapiens
gagctggtcagtttcagggcca

SEQ ID NO: 7900761 - DNA, 22 bp, Homo sapiens
gagctggtcagtttcagggcca

SEQ ID NO: 7900762 - DNA, 22 bp, Homo sapiens
gagctgggtctccaccttggca

SEQ ID NO: 7900763 - DNA, 22 bp, Homo sapiens
gagctgggtatatggctttatg

SEQ ID NO: 7900764 - DNA, 22 bp, Homo sapiens
gagctgggtctccaccttggca

SEQ ID NO: 7900765 - DNA, 22 bp, Homo sapiens
gagctgggtgtttatttgccaa

SEQ ID NO: 7900766 - DNA, 22 bp, Homo sapiens
gagctggtgctgtgcctgttct

SEQ ID NO: 7900767 - DNA, 22 bp, Homo sapiens
gagctggtggtgagaaagctct

SEQ ID NO: 7900768 - DNA, 22 bp, Homo sapiens
gagctggtgctcttgtcaagac

SEQ ID NO: 7900769 - DNA, 22 bp, Homo sapiens
gagctggtgctcttgtcaagac

SEQ ID NO: 7900770 - DNA, 22 bp, Homo sapiens
gagctggtgctcttgtcaagac

SEQ ID NO: 7900771 - DNA, 22 bp, Homo sapiens
gagctggtgtgtgcccgagcac

SEQ ID NO: 7900772 - DNA, 22 bp, Homo sapiens
gagctggtggtgagaaagctct

SEQ ID NO: 7900773 - DNA, 22 bp, Homo sapiens
gagctggtgtgtgcccaagcac

SEQ ID NO: 7900774 - DNA, 22 bp, Homo sapiens
gagctggtgatcagctggagga

SEQ ID NO: 7900775 - DNA, 22 bp, Homo sapiens
gagctggtgatcagctggagga

SEQ ID NO: 7900776 - DNA, 22 bp, Homo sapiens
gagctggtgatcagctggagga

SEQ ID NO: 7900777 - DNA, 22 bp, Homo sapiens
gagctggtgatcagctggagga

SEQ ID NO: 7900778 - DNA, 22 bp, Homo sapiens
gagctggtccacaatctgcagg

SEQ ID NO: 7900779 - DNA, 22 bp, Homo sapiens
gagctggtccacaatctgcagg

SEQ ID NO: 7900780 - DNA, 22 bp, Homo sapiens
gagctggtcgaaatgggctgac

SEQ ID NO: 7900781 - DNA, 22 bp, Homo sapiens
gagctggtcgaaatgggctgac

SEQ ID NO: 7900782 - DNA, 22 bp, Homo sapiens
gagctggtcgaaatgggctgac

SEQ ID NO: 7900783 - DNA, 22 bp, Homo sapiens
gagctggtcgaaatgggctgac

SEQ ID NO: 7900784 - DNA, 22 bp, Homo sapiens
gagctgtgaaaagtgcctgggg

SEQ ID NO: 7900785 - DNA, 18 bp, Homo sapiens
gagctgtctgagctggtc

SEQ ID NO: 7900786 - DNA, 22 bp, Homo sapiens
gagctgtgacacgcagcccagg

SEQ ID NO: 7900787 - DNA, 22 bp, Homo sapiens
gagctgtgaaaagtgcctgggg

SEQ ID NO: 7900788 - DNA, 22 bp, Homo sapiens
gagctgtgaaaagtgcctgggg

SEQ ID NO: 7900789 - DNA, 22 bp, Homo sapiens
gagctgtgaaaagtgcctgggg

SEQ ID NO: 7900790 - DNA, 22 bp, Homo sapiens
gagctgtgaaaagtgcctgggg

SEQ ID NO: 7900791 - DNA, 22 bp, Homo sapiens
gagctgtgattggtgtctcact

SEQ ID NO: 7900792 - DNA, 22 bp, Homo sapiens
gagctgtgattggtgtctcact

SEQ ID NO: 7900793 - DNA, 22 bp, Homo sapiens
gagctgtgattggtgtctcact

SEQ ID NO: 7900794 - DNA, 22 bp, Homo sapiens
gagctgtgagggacacattgct

SEQ ID NO: 7900795 - DNA, 22 bp, Homo sapiens
gagctgtgattggtgtctcact

SEQ ID NO: 7900796 - DNA, 22 bp, Homo sapiens
gagctgtgagggacacattgct

SEQ ID NO: 7900797 - DNA, 22 bp, Homo sapiens
gagctgtgagggacacattgct

SEQ ID NO: 7900798 - DNA, 22 bp, Homo sapiens
gagctgtgacacgcagcccagg

SEQ ID NO: 7900799 - DNA, 22 bp, Homo sapiens
gagctgtgacacgcagcccagg

SEQ ID NO: 7900800 - DNA, 22 bp, Homo sapiens
gagctgtgacacgcagcccagg

SEQ ID NO: 7900801 - DNA, 22 bp, Homo sapiens
gagctgtgacacgcagcccagg

SEQ ID NO: 7900802 - DNA, 22 bp, Homo sapiens
gagctggttctgtccagggaat

SEQ ID NO: 7900803 - DNA, 22 bp, Homo sapiens
gagctggttctgtccagggaat

SEQ ID NO: 7900804 - DNA, 22 bp, Homo sapiens
gagctggtgtgtgcccgagcac

SEQ ID NO: 7900805 - DNA, 22 bp, Homo sapiens
gagctggtgtgtgcccgagcac

SEQ ID NO: 7900806 - DNA, 22 bp, Homo sapiens
gagctggttctgtccagggaat

SEQ ID NO: 7900807 - DNA, 22 bp, Homo sapiens
gagctggttttaggctatgtct

SEQ ID NO: 7900808 - DNA, 22 bp, Homo sapiens
gagctggttttaggctatgtct

SEQ ID NO: 7900809 - DNA, 22 bp, Homo sapiens
gagctggttctgtccagggaat

SEQ ID NO: 7900810 - DNA, 22 bp, Homo sapiens
gagctggttctgtccagggaat

SEQ ID NO: 7900811 - DNA, 22 bp, Homo sapiens
gagctggttctgtccagggaat

SEQ ID NO: 7900812 - DNA, 22 bp, Homo sapiens
gagctgtccgcccctgggccga

SEQ ID NO: 7900813 - DNA, 22 bp, Homo sapiens
gagctgtccaagatggtcgtaa

SEQ ID NO: 7900814 - DNA, 17 bp, Homo sapiens
gaggacagggaagtagg

SEQ ID NO: 7900815 - DNA, 17 bp, Homo sapiens
gaggacagggaagtagg

SEQ ID NO: 7900816 - DNA, 17 bp, Homo sapiens
gaggacagggaagtagg

SEQ ID NO: 7900817 - DNA, 17 bp, Homo sapiens
gaggacagggaagtagg

SEQ ID NO: 7900818 - DNA, 17 bp, Homo sapiens
gaggacagggaagtagg

SEQ ID NO: 7900819 - DNA, 17 bp, Homo sapiens
gaggacagggaagtagg

SEQ ID NO: 7900820 - DNA, 17 bp, Homo sapiens
gaggacagggaagtagg

SEQ ID NO: 7900821 - DNA, 17 bp, Homo sapiens
gaggacagggaagtagg

SEQ ID NO: 7900822 - DNA, 17 bp, Homo sapiens
gaggacagggaagtagg

SEQ ID NO: 7900823 - DNA, 22 bp, Homo sapiens
gaggacaggagactcactgttt

SEQ ID NO: 7900824 - DNA, 22 bp, Homo sapiens
gaggacaggagactcactgttt

SEQ ID NO: 7900825 - DNA, 22 bp, Homo sapiens
gagctgtgtgcctggatggtct

SEQ ID NO: 7900826 - DNA, 22 bp, Homo sapiens
gagctgtgcttataccaattca

SEQ ID NO: 7900827 - DNA, 22 bp, Homo sapiens
gagctgtgtatgcatcattctg

SEQ ID NO: 7900828 - DNA, 22 bp, Homo sapiens
gagctgtgtgcctggatggtct

SEQ ID NO: 7900829 - DNA, 22 bp, Homo sapiens
gagctgtgtatgcatcattctg

SEQ ID NO: 7900830 - DNA, 22 bp, Homo sapiens
gagctgtgtgcctggatggtct

SEQ ID NO: 7900831 - DNA, 22 bp, Homo sapiens
gagctgtgtgcctggatggtct

SEQ ID NO: 7900832 - DNA, 22 bp, Homo sapiens
gagctgtgcttataccaattca

SEQ ID NO: 7900833 - DNA, 22 bp, Homo sapiens
gagctgtggaaggcagggacca

SEQ ID NO: 7900834 - DNA, 22 bp, Homo sapiens
gagctgtggaaggcagggacca

SEQ ID NO: 7900835 - DNA, 22 bp, Homo sapiens
gagctgtgcttataccaattca

SEQ ID NO: 7900836 - DNA, 20 bp, Homo sapiens
gagctgtgctctcaggagcc

SEQ ID NO: 7900837 - DNA, 22 bp, Homo sapiens
gagctgtgtatgcatcattctg

SEQ ID NO: 7900838 - DNA, 22 bp, Homo sapiens
gagctgtggtcaacaggaaatt

SEQ ID NO: 7900839 - DNA, 22 bp, Homo sapiens
gagctgtggtcaacaggaaatt

SEQ ID NO: 7900840 - DNA, 22 bp, Homo sapiens
gagctgtggtcaacaggaaatt

SEQ ID NO: 7900841 - DNA, 22 bp, Homo sapiens
gagctgtggaaggcagggacca

SEQ ID NO: 7900842 - DNA, 22 bp, Homo sapiens
gagctgtggaaggcagggacca

SEQ ID NO: 7900843 - DNA, 22 bp, Homo sapiens
gagctgtggaaggcagggacca

SEQ ID NO: 7900844 - DNA, 22 bp, Homo sapiens
gagctgtgccaatctgtctggg

SEQ ID NO: 7900845 - DNA, 22 bp, Homo sapiens
gagctgtgccaatctgtctggg

SEQ ID NO: 7900846 - DNA, 22 bp, Homo sapiens
gagctgtgccaatctgtctggg

SEQ ID NO: 7900847 - DNA, 22 bp, Homo sapiens
gagctgtgattggtgtctcact

SEQ ID NO: 7900848 - DNA, 22 bp, Homo sapiens
gagctgtgattggtgtctcact

SEQ ID NO: 7900849 - DNA, 22 bp, Homo sapiens
gagctgtgccaatctgtctggg

SEQ ID NO: 7900850 - DNA, 20 bp, Homo sapiens
gagctgtgctctcaggagcc

SEQ ID NO: 7900851 - DNA, 20 bp, Homo sapiens
gagctgtgctctcaggagcc

SEQ ID NO: 7900852 - DNA, 20 bp, Homo sapiens
gagctgtgctctcaggagcc

SEQ ID NO: 7900853 - DNA, 22 bp, Homo sapiens
gaggagagaagctaacggtgct

SEQ ID NO: 7900854 - DNA, 22 bp, Homo sapiens
gaggagagagggactgtctgca

SEQ ID NO: 7900855 - DNA, 22 bp, Homo sapiens
gaggagagagggactgtctgca

SEQ ID NO: 7900856 - DNA, 22 bp, Homo sapiens
gaggagagagggactgtctgca

SEQ ID NO: 7900857 - DNA, 22 bp, Homo sapiens
gaggagagagggactgtctgca

SEQ ID NO: 7900858 - DNA, 22 bp, Homo sapiens
gaggaggttccgggtggagaag

SEQ ID NO: 7900859 - DNA, 22 bp, Homo sapiens
gaggaggtggagtcatgcagag

SEQ ID NO: 7900860 - DNA, 22 bp, Homo sapiens
gaggaggttgacggcactgtga

SEQ ID NO: 7900861 - DNA, 22 bp, Homo sapiens
gaggagtctttccctaagtcct

SEQ ID NO: 7900862 - DNA, 20 bp, Homo sapiens
gaggagtcttgtagaaaatg

SEQ ID NO: 7900863 - DNA, 22 bp, Homo sapiens
gaggagtggagttgctgggttg

SEQ ID NO: 7900864 - DNA, 22 bp, Homo sapiens
gaggagtgccagccgtggagtc

SEQ ID NO: 7900865 - DNA, 22 bp, Homo sapiens
gaggagtgccagccgtggagtc

SEQ ID NO: 7900866 - DNA, 22 bp, Homo sapiens
gaggagtgccagccgtggagtc

SEQ ID NO: 7900867 - DNA, 22 bp, Homo sapiens
gaggatggaggcagttagggcc

SEQ ID NO: 7900868 - DNA, 18 bp, Homo sapiens
gaggatggaaggagatgc

SEQ ID NO: 7900869 - DNA, 22 bp, Homo sapiens
gaggatggaggcagttagggcc

SEQ ID NO: 7900870 - DNA, 22 bp, Homo sapiens
gaggatggaggcagttagggcc

SEQ ID NO: 7900871 - DNA, 22 bp, Homo sapiens
gaggatggaggcagttagggcc

SEQ ID NO: 7900872 - DNA, 22 bp, Homo sapiens
gaggatggaggcagttagggcc

SEQ ID NO: 7900873 - DNA, 18 bp, Homo sapiens
gaggatggaaggagatgc

SEQ ID NO: 7900874 - DNA, 18 bp, Homo sapiens
gaggatggaaggagatgc

SEQ ID NO: 7900875 - DNA, 18 bp, Homo sapiens
gaggatggaaggagatgc

SEQ ID NO: 7900876 - DNA, 18 bp, Homo sapiens
gaggatggaaggagatgc

SEQ ID NO: 7900877 - DNA, 18 bp, Homo sapiens
gaggatggaaggagatgc

SEQ ID NO: 7900878 - DNA, 18 bp, Homo sapiens
gaggatggaaggagatgc

SEQ ID NO: 7900879 - DNA, 18 bp, Homo sapiens
gaggatggaaggagatgc

SEQ ID NO: 7900880 - DNA, 20 bp, Homo sapiens
gaggatgcagacagagggca

SEQ ID NO: 7900881 - DNA, 20 bp, Homo sapiens
gaggatgcagacagagggca

SEQ ID NO: 7900882 - DNA, 22 bp, Homo sapiens
gaggatgctgcagtgcaggaca

SEQ ID NO: 7900883 - DNA, 22 bp, Homo sapiens
gaggagtgtattccacaccact

SEQ ID NO: 7900884 - DNA, 22 bp, Homo sapiens
gaggatcatttgagcctaggag

SEQ ID NO: 7900885 - DNA, 22 bp, Homo sapiens
gaggagtgggttagtgcttatt

SEQ ID NO: 7900886 - DNA, 22 bp, Homo sapiens
gaggagtgccagccgtggagtc

SEQ ID NO: 7900887 - DNA, 22 bp, Homo sapiens
gaggactctgcaggctgctcct

SEQ ID NO: 7900888 - DNA, 22 bp, Homo sapiens
gaggactacatgagccacatca

SEQ ID NO: 7900889 - DNA, 22 bp, Homo sapiens
gaggacctttagtagaagtgca

SEQ ID NO: 7900890 - DNA, 22 bp, Homo sapiens
gaggacctttagtagaagtgca

SEQ ID NO: 7900891 - DNA, 22 bp, Homo sapiens
gaggaccagcattttcagagtg

SEQ ID NO: 7900892 - DNA, 22 bp, Homo sapiens
gaggaccacagatgagcctgca

SEQ ID NO: 7900893 - DNA, 22 bp, Homo sapiens
gaggaccacagatgagcctgca

SEQ ID NO: 7900894 - DNA, 22 bp, Homo sapiens
gaggaccacagatgagcctgca

SEQ ID NO: 7900895 - DNA, 22 bp, Homo sapiens
gaggacatagtggactagggtt

SEQ ID NO: 7900896 - DNA, 23 bp, Homo sapiens
gaggaccaaatatatacatggaa

SEQ ID NO: 7900897 - DNA, 23 bp, Homo sapiens
gaggaccaaatatatacatggaa

SEQ ID NO: 7900898 - DNA, 22 bp, Homo sapiens
gaggacatagtggactagggtt

SEQ ID NO: 7900899 - DNA, 22 bp, Homo sapiens
gaggacatagtccagatggcaa

SEQ ID NO: 7900900 - DNA, 22 bp, Homo sapiens
gaggacagtgtgatctgccagc

SEQ ID NO: 7900901 - DNA, 22 bp, Homo sapiens
gaggacagtgtgatctgccagc

SEQ ID NO: 7900902 - DNA, 22 bp, Homo sapiens
gaggacagtgtgatctgccagc

SEQ ID NO: 7900903 - DNA, 22 bp, Homo sapiens
gaggacagtgtgatctgccagc

SEQ ID NO: 7900904 - DNA, 17 bp, Homo sapiens
gaggacagggaagtagg

SEQ ID NO: 7900905 - DNA, 22 bp, Homo sapiens
gaggacagtgtgatctgccagc

SEQ ID NO: 7900906 - DNA, 22 bp, Homo sapiens
gaggacagtgtgatctgccagc

SEQ ID NO: 7900907 - DNA, 22 bp, Homo sapiens
gaggacagtgtgatctgccagc

SEQ ID NO: 7900908 - DNA, 22 bp, Homo sapiens
gaggacagtgtgatctgccagc

SEQ ID NO: 7900909 - DNA, 22 bp, Homo sapiens
gaggacagtgtgatctgccagc

SEQ ID NO: 7900910 - DNA, 21 bp, Homo sapiens
gaggactgcacactctgattg

SEQ ID NO: 7900911 - DNA, 22 bp, Homo sapiens
gaggactgaaacttacaggaaa

SEQ ID NO: 7900912 - DNA, 22 bp, Homo sapiens
gaggactgaaacttacaggaaa

SEQ ID NO: 7900913 - DNA, 21 bp, Homo sapiens
gaggactgcacactctgattg

SEQ ID NO: 7900914 - DNA, 22 bp, Homo sapiens
gaggactgcagatgggtgcatc

SEQ ID NO: 7900915 - DNA, 22 bp, Homo sapiens
gaggactgcagatgggtgcatc

SEQ ID NO: 7900916 - DNA, 22 bp, Homo sapiens
gaggagaaagcagtgatttgtg

SEQ ID NO: 7900917 - DNA, 22 bp, Homo sapiens
gaggagaaagcagtgatttgtg

SEQ ID NO: 7900918 - DNA, 22 bp, Homo sapiens
gaggagaaagcagtgatttgtg

SEQ ID NO: 7900919 - DNA, 22 bp, Homo sapiens
gaggagacagtggagccgctac

SEQ ID NO: 7900920 - DNA, 22 bp, Homo sapiens
gaggagaaattatccttggtgt

SEQ ID NO: 7900921 - DNA, 22 bp, Homo sapiens
gaggagacatatttttgaagca

SEQ ID NO: 7900922 - DNA, 22 bp, Homo sapiens
gaggagacatatttttgaagca

SEQ ID NO: 7900923 - DNA, 22 bp, Homo sapiens
gaggagacggggtgcctggagc

SEQ ID NO: 7900924 - DNA, 22 bp, Homo sapiens
gaggagacatatttttgaagca

SEQ ID NO: 7900925 - DNA, 22 bp, Homo sapiens
gaggagagaagctaacggtgct

SEQ ID NO: 7900926 - DNA, 22 bp, Homo sapiens
gaggagagaacattcctccata

SEQ ID NO: 7900927 - DNA, 22 bp, Homo sapiens
gaggagagaagctaacggtgct

SEQ ID NO: 7900928 - DNA, 22 bp, Homo sapiens
gaggagagaacattcctccata

SEQ ID NO: 7900929 - DNA, 22 bp, Homo sapiens
gaggagagaacattcctccata

SEQ ID NO: 7900930 - DNA, 22 bp, Homo sapiens
gaggagactgacagcagattct

SEQ ID NO: 7900931 - DNA, 22 bp, Homo sapiens
gaggagagaacattcctccata

SEQ ID NO: 7900932 - DNA, 22 bp, Homo sapiens
gaggagagaacattcctccata

SEQ ID NO: 7900933 - DNA, 22 bp, Homo sapiens
gaggagacggggtgcctggagc

SEQ ID NO: 7900934 - DNA, 22 bp, Homo sapiens
gaggagactgacagcagattct

SEQ ID NO: 7900935 - DNA, 22 bp, Homo sapiens
gaggcctggaattccagcctgg

SEQ ID NO: 7900936 - DNA, 22 bp, Homo sapiens
gaggcctggaccagccacagag

SEQ ID NO: 7900937 - DNA, 22 bp, Homo sapiens
gaggccagatactctcttctgc

SEQ ID NO: 7900938 - DNA, 22 bp, Homo sapiens
gaggccagatactctcttctgc

SEQ ID NO: 7900939 - DNA, 22 bp, Homo sapiens
gaggccagatactctcttctgc

SEQ ID NO: 7900940 - DNA, 22 bp, Homo sapiens
gaggccagatactctcttctgc

SEQ ID NO: 7900941 - DNA, 22 bp, Homo sapiens
gaggcctggaccagccacagag

SEQ ID NO: 7900942 - DNA, 22 bp, Homo sapiens
gaggcctggaccagccacagag

SEQ ID NO: 7900943 - DNA, 22 bp, Homo sapiens
gaggcctggaccagccacagag

SEQ ID NO: 7900944 - DNA, 22 bp, Homo sapiens
gaggcctggaccagccacagag

SEQ ID NO: 7900945 - DNA, 22 bp, Homo sapiens
gaggcctggagccgcctaggcg

SEQ ID NO: 7900946 - DNA, 22 bp, Homo sapiens
gaggcctggagccgcctaggcg

SEQ ID NO: 7900947 - DNA, 22 bp, Homo sapiens
gaggccagagttccccgagtca

SEQ ID NO: 7900948 - DNA, 22 bp, Homo sapiens
gaggccagatactctcttctgc

SEQ ID NO: 7900949 - DNA, 22 bp, Homo sapiens
gaggccagagttccccgagtca

SEQ ID NO: 7900950 - DNA, 22 bp, Homo sapiens
gaggccagactgccttttatga

SEQ ID NO: 7900951 - DNA, 22 bp, Homo sapiens
gaggccagactgccttttatga

SEQ ID NO: 7900952 - DNA, 22 bp, Homo sapiens
gaggccagactgccttttatga

SEQ ID NO: 7900953 - DNA, 22 bp, Homo sapiens
gaggccagaatgagtctctggg

SEQ ID NO: 7900954 - DNA, 22 bp, Homo sapiens
gaggccagaatgagtctctggg

SEQ ID NO: 7900955 - DNA, 22 bp, Homo sapiens
gaggccagaatgagtctctggg

SEQ ID NO: 7900956 - DNA, 22 bp, Homo sapiens
gaggccagaatgagtctctggg

SEQ ID NO: 7900957 - DNA, 22 bp, Homo sapiens
gaggccagaagtctgagatcag

SEQ ID NO: 7900958 - DNA, 22 bp, Homo sapiens
gaggccagaagtctgagatcag

SEQ ID NO: 7900959 - DNA, 22 bp, Homo sapiens
gaggccacttcctactggagga

SEQ ID NO: 7900960 - DNA, 22 bp, Homo sapiens
gaggccacttcctactggagga

SEQ ID NO: 7900961 - DNA, 22 bp, Homo sapiens
gaggccactgtccctgccttcc

SEQ ID NO: 7900962 - DNA, 22 bp, Homo sapiens
gaggccagaagtgcctcgggct

SEQ ID NO: 7900963 - DNA, 22 bp, Homo sapiens
gaggccagaagtgcctcgggct

SEQ ID NO: 7900964 - DNA, 22 bp, Homo sapiens
gaggccagaagtctgagatcag

SEQ ID NO: 7900965 - DNA, 22 bp, Homo sapiens
gaggccagaagtgcctcgggct

SEQ ID NO: 7900966 - DNA, 22 bp, Homo sapiens
gaggccagaagtgcctcgggct

SEQ ID NO: 7900967 - DNA, 22 bp, Homo sapiens
gaggccagaagtgcctcgggct

SEQ ID NO: 7900968 - DNA, 22 bp, Homo sapiens
gaggccagaagtgcctcgggct

SEQ ID NO: 7900969 - DNA, 22 bp, Homo sapiens
gaggccagaatgagctgaatgc

SEQ ID NO: 7900970 - DNA, 22 bp, Homo sapiens
gaggccagaatgagctgaatgc

SEQ ID NO: 7900971 - DNA, 22 bp, Homo sapiens
gaggccagaatgagctgaatgc

SEQ ID NO: 7900972 - DNA, 22 bp, Homo sapiens
gaggccagaatgagctgaatgc

SEQ ID NO: 7900973 - DNA, 22 bp, Homo sapiens
gaggccagaatgagtctctggg

SEQ ID NO: 7900974 - DNA, 22 bp, Homo sapiens
gaggccagaatgagtctctggg

SEQ ID NO: 7900975 - DNA, 21 bp, Homo sapiens
gaggccactaataggggcaga

SEQ ID NO: 7900976 - DNA, 21 bp, Homo sapiens
gaggccactaataggggcaga

SEQ ID NO: 7900977 - DNA, 21 bp, Homo sapiens
gaggccactaataggggcaga

SEQ ID NO: 7900978 - DNA, 22 bp, Homo sapiens
gaggccactgtccctgccttcc

SEQ ID NO: 7900979 - DNA, 22 bp, Homo sapiens
gaggccactgtccctgccttcc

SEQ ID NO: 7900980 - DNA, 22 bp, Homo sapiens
gaggccacggaagggagctgtg

SEQ ID NO: 7900981 - DNA, 22 bp, Homo sapiens
gaggccacggttttccttgggg

SEQ ID NO: 7900982 - DNA, 22 bp, Homo sapiens
gaggccacggaagggagctgtg

SEQ ID NO: 7900983 - DNA, 22 bp, Homo sapiens
gaggccacggttttccttgggg

SEQ ID NO: 7900984 - DNA, 22 bp, Homo sapiens
gaggccacgtgcttatgtttct

SEQ ID NO: 7900985 - DNA, 22 bp, Homo sapiens
gaggcatggcctgaggctagga

SEQ ID NO: 7900986 - DNA, 22 bp, Homo sapiens
gaggcatggcctgaggctagga

SEQ ID NO: 7900987 - DNA, 22 bp, Homo sapiens
gaggccacggaagggagctgtg

SEQ ID NO: 7900988 - DNA, 22 bp, Homo sapiens
gaggcatgtctggcctgtccca

SEQ ID NO: 7900989 - DNA, 22 bp, Homo sapiens
gaggccacggaagggagctgtg

SEQ ID NO: 7900990 - DNA, 22 bp, Homo sapiens
gaggcatggcctgaggctagga

SEQ ID NO: 7900991 - DNA, 22 bp, Homo sapiens
gaggcatggcctgaggctagga

SEQ ID NO: 7900992 - DNA, 22 bp, Homo sapiens
gaggcatgcagagctggagcag

SEQ ID NO: 7900993 - DNA, 22 bp, Homo sapiens
gaggcatggcctgaggctagga

SEQ ID NO: 7900994 - DNA, 22 bp, Homo sapiens
gaggcatggcctgaggctagga

SEQ ID NO: 7900995 - DNA, 22 bp, Homo sapiens
gaggcatgcagagctggagcag

SEQ ID NO: 7900996 - DNA, 22 bp, Homo sapiens
gaggcatgcagagctggagcag

SEQ ID NO: 7900997 - DNA, 22 bp, Homo sapiens
gaggcaagagaagccagctttc

SEQ ID NO: 7900998 - DNA, 22 bp, Homo sapiens
gaggcaagaaaggactttctag

SEQ ID NO: 7900999 - DNA, 22 bp, Homo sapiens
gaggcaagaaaggactttctag

SEQ ID NO: 7901000 - DNA, 22 bp, Homo sapiens
gaggcaagaaaggactttctag

SEQ ID NO: 7901001 - DNA, 22 bp, Homo sapiens
gaggcaacttcctgtcctctcc

SEQ ID NO: 7901002 - DNA, 22 bp, Homo sapiens
gaggatgtaaaatagacaaaat

SEQ ID NO: 7901003 - DNA, 22 bp, Homo sapiens
gaggatgtgtctggtctgggca

SEQ ID NO: 7901004 - DNA, 22 bp, Homo sapiens
gaggattctagtgacctcagag

SEQ ID NO: 7901005 - DNA, 22 bp, Homo sapiens
gaggatttgatggctttctccc

SEQ ID NO: 7901006 - DNA, 22 bp, Homo sapiens
gaggcaacaatgatggtgtgta

SEQ ID NO: 7901007 - DNA, 22 bp, Homo sapiens
gaggcaaagcatgtggctcagg

SEQ ID NO: 7901008 - DNA, 22 bp, Homo sapiens
gaggatggtgagcaggacccag

SEQ ID NO: 7901009 - DNA, 22 bp, Homo sapiens
gaggatggtgagcaggacccag

SEQ ID NO: 7901010 - DNA, 22 bp, Homo sapiens
gaggatggtgagcaggacccag

SEQ ID NO: 7901011 - DNA, 22 bp, Homo sapiens
gaggatggtgagcaggacccag

SEQ ID NO: 7901012 - DNA, 22 bp, Homo sapiens
gaggatggtgagcaggacccag

SEQ ID NO: 7901013 - DNA, 22 bp, Homo sapiens
gaggatggtatgaggcaagcaa

SEQ ID NO: 7901014 - DNA, 22 bp, Homo sapiens
gaggatggatccgaccccttcc

SEQ ID NO: 7901015 - DNA, 22 bp, Homo sapiens
gaggatggatccgaccccttcc

SEQ ID NO: 7901016 - DNA, 22 bp, Homo sapiens
gaggatggtatgaggcaagcaa

SEQ ID NO: 7901017 - DNA, 22 bp, Homo sapiens
gaggatggtatgaggcaagcaa

SEQ ID NO: 7901018 - DNA, 22 bp, Homo sapiens
gaggatggaggcagttagggcc

SEQ ID NO: 7901019 - DNA, 22 bp, Homo sapiens
gaggatggaggtgtgagctatg

SEQ ID NO: 7901020 - DNA, 22 bp, Homo sapiens
gaggatggaggtgtgagctatg

SEQ ID NO: 7901021 - DNA, 22 bp, Homo sapiens
ctgtgtttgctatgcaaagaca

SEQ ID NO: 7901022 - DNA, 22 bp, Homo sapiens
ctgtgtttgatgagaagccacc

SEQ ID NO: 7901023 - DNA, 22 bp, Homo sapiens
ctgtgtttgatgagaagccacc

SEQ ID NO: 7901024 - DNA, 22 bp, Homo sapiens
ctgtgtttgatgagaagccacc

SEQ ID NO: 7901025 - DNA, 22 bp, Homo sapiens
ctgtgttttgagatattattaa

SEQ ID NO: 7901026 - DNA, 22 bp, Homo sapiens
ctgtgtttggacaacttttcag

SEQ ID NO: 7901027 - DNA, 22 bp, Homo sapiens
ctgtgtttggacaacttttcag

SEQ ID NO: 7901028 - DNA, 22 bp, Homo sapiens
ctgtgttttgattaaaaagcaa

SEQ ID NO: 7901029 - DNA, 22 bp, Homo sapiens
ctgtgtttttggtctgatctat

SEQ ID NO: 7901030 - DNA, 22 bp, Homo sapiens
ctgtgtttttggtctgatctat

SEQ ID NO: 7901031 - DNA, 22 bp, Homo sapiens
ctgtgtgtttatatcatttcct

SEQ ID NO: 7901032 - DNA, 22 bp, Homo sapiens
ctgtgtgtttatatcatttcct

SEQ ID NO: 7901033 - DNA, 22 bp, Homo sapiens
ctgtgtgtttatatcatttcct

SEQ ID NO: 7901034 - DNA, 22 bp, Homo sapiens
ctgtgttcagtgctactgagtt

SEQ ID NO: 7901035 - DNA, 22 bp, Homo sapiens
ctgtgtgtttatatcatttcct

SEQ ID NO: 7901036 - DNA, 22 bp, Homo sapiens
ctgtgttggcttttctcttgta

SEQ ID NO: 7901037 - DNA, 22 bp, Homo sapiens
ctgtgttcccctgctgctgagg

SEQ ID NO: 7901038 - DNA, 22 bp, Homo sapiens
ctgtgttcccctgctgctgagg

SEQ ID NO: 7901039 - DNA, 22 bp, Homo sapiens
ctgtgtttctcttgacccaagt

SEQ ID NO: 7901040 - DNA, 22 bp, Homo sapiens
ctgtgtttctgagaagtgggga

SEQ ID NO: 7901041 - DNA, 22 bp, Homo sapiens
ctgtgtttctaagtaaaggagc

SEQ ID NO: 7901042 - DNA, 22 bp, Homo sapiens
ctgtgttcagtgctactgagtt

SEQ ID NO: 7901043 - DNA, 22 bp, Homo sapiens
ctgtgtttctaagtaaaggagc

SEQ ID NO: 7901044 - DNA, 22 bp, Homo sapiens
ctgtgtgtgagaagcaggttga

SEQ ID NO: 7901045 - DNA, 22 bp, Homo sapiens
ctgtgtgtgagaagcaggttga

SEQ ID NO: 7901046 - DNA, 22 bp, Homo sapiens
ctgtgtgtgagaagcaggttga

SEQ ID NO: 7901047 - DNA, 22 bp, Homo sapiens
ctgtgtgtgaacacagcccagc

SEQ ID NO: 7901048 - DNA, 22 bp, Homo sapiens
ctgtgtgtgagaagcaggttga

SEQ ID NO: 7901049 - DNA, 22 bp, Homo sapiens
ctgtgtgtgagaagcaggttga

SEQ ID NO: 7901050 - DNA, 23 bp, Homo sapiens
ctgtgtgtgccgagggtggccac

SEQ ID NO: 7901051 - DNA, 23 bp, Homo sapiens
ctgtgtgtgccgagggtggccac

SEQ ID NO: 7901052 - DNA, 23 bp, Homo sapiens
ctgtgtgtgccgagggtggccac

SEQ ID NO: 7901053 - DNA, 22 bp, Homo sapiens
ctgtgtgtgagaagcaggttga

SEQ ID NO: 7901054 - DNA, 23 bp, Homo sapiens
ctgtgtgtgccgagggtggccac

SEQ ID NO: 7901055 - DNA, 22 bp, Homo sapiens
ctgtgtgtgtctgcagcatact

SEQ ID NO: 7901056 - DNA, 22 bp, Homo sapiens
ctgtgtgtgtctgcagcatact

SEQ ID NO: 7901057 - DNA, 22 bp, Homo sapiens
ctgtgtgtgtctgcagcatact

SEQ ID NO: 7901058 - DNA, 22 bp, Homo sapiens
ctgtgtgtgtctgcagcatact

SEQ ID NO: 7901059 - DNA, 22 bp, Homo sapiens
ctgtgtgtgtctgcagcatact

SEQ ID NO: 7901060 - DNA, 22 bp, Homo sapiens
ctgtgtgtgctacaggcttcca

SEQ ID NO: 7901061 - DNA, 22 bp, Homo sapiens
ctgtgtgtgctacaggcttcca

SEQ ID NO: 7901062 - DNA, 22 bp, Homo sapiens
ctgtgtgtgctacaggcttcca

SEQ ID NO: 7901063 - DNA, 22 bp, Homo sapiens
ctgtgtgtgctacaggcttcca

SEQ ID NO: 7901064 - DNA, 22 bp, Homo sapiens
ctgtggtcatgagtccttccat

SEQ ID NO: 7901065 - DNA, 22 bp, Homo sapiens
ctgtggtctgtaggagtgatgg

SEQ ID NO: 7901066 - DNA, 22 bp, Homo sapiens
ctgtggtctgtaggagtgatgg

SEQ ID NO: 7901067 - DNA, 22 bp, Homo sapiens
ctgtggtcatctcagagtggcc

SEQ ID NO: 7901068 - DNA, 22 bp, Homo sapiens
ctgtggtcactgttggggaatg

SEQ ID NO: 7901069 - DNA, 22 bp, Homo sapiens
ctgtggtgagcaactgactgaa

SEQ ID NO: 7901070 - DNA, 20 bp, Homo sapiens
ctgtggtgagcaggagagta

SEQ ID NO: 7901071 - DNA, 20 bp, Homo sapiens
ctgtggtgagcaggagagta

SEQ ID NO: 7901072 - DNA, 23 bp, Homo sapiens
ctgtggtgaggccctagaatctg

SEQ ID NO: 7901073 - DNA, 20 bp, Homo sapiens
ctgtggtgagcaggagagta

SEQ ID NO: 7901074 - DNA, 22 bp, Homo sapiens
ctgtgtgatgggaagaatgttt

SEQ ID NO: 7901075 - DNA, 22 bp, Homo sapiens
ctgtgtgatgggaagaatgttt

SEQ ID NO: 7901076 - DNA, 22 bp, Homo sapiens
ctgtgtgtgaacacagcccagc

SEQ ID NO: 7901077 - DNA, 22 bp, Homo sapiens
ctgtgtctttcctactttgtgg

SEQ ID NO: 7901078 - DNA, 22 bp, Homo sapiens
ctgtgtgaatagtgaggtctat

SEQ ID NO: 7901079 - DNA, 22 bp, Homo sapiens
ctgtgtctttcctactttgtgg

SEQ ID NO: 7901080 - DNA, 22 bp, Homo sapiens
ctgtgtcttgagtaattcggtg

SEQ ID NO: 7901081 - DNA, 22 bp, Homo sapiens
ctgtgtcttgagtaattcggtg

SEQ ID NO: 7901082 - DNA, 22 bp, Homo sapiens
ctgtgtctttcctactttgtgg

SEQ ID NO: 7901083 - DNA, 22 bp, Homo sapiens
ctgtgtctttcctactttgtgg

SEQ ID NO: 7901084 - DNA, 22 bp, Homo sapiens
ctgtggtggcacagcgggctgg

SEQ ID NO: 7901085 - DNA, 22 bp, Homo sapiens
ctgtggtggcacagcgggctgg

SEQ ID NO: 7901086 - DNA, 22 bp, Homo sapiens
ctgtggtggcacagcgggctgg

SEQ ID NO: 7901087 - DNA, 22 bp, Homo sapiens
ctgtgtcttctgttttgaagtt

SEQ ID NO: 7901088 - DNA, 22 bp, Homo sapiens
ctgtgtcttctgttttgaagtt

SEQ ID NO: 7901089 - DNA, 22 bp, Homo sapiens
ctgtgtcttctgttttgaagtt

SEQ ID NO: 7901090 - DNA, 22 bp, Homo sapiens
ctgtgggtgaagacaagggaga

SEQ ID NO: 7901091 - DNA, 22 bp, Homo sapiens
ctgtggtcaccaggctggggcc

SEQ ID NO: 7901092 - DNA, 19 bp, Homo sapiens
ctgtgggtgtgcaagggtg

SEQ ID NO: 7901093 - DNA, 22 bp, Homo sapiens
ctgtggggaagatagaaccgac

SEQ ID NO: 7901094 - DNA, 22 bp, Homo sapiens
ctgtggggaagatagaaccgac

SEQ ID NO: 7901095 - DNA, 22 bp, Homo sapiens
ctgtggggagctgatcagatca

SEQ ID NO: 7901096 - DNA, 22 bp, Homo sapiens
ctgtggggccaaattctcctct

SEQ ID NO: 7901097 - DNA, 22 bp, Homo sapiens
ctgtggggccaaattctcctct

SEQ ID NO: 7901098 - DNA, 18 bp, Homo sapiens
ctgtgggctggtgcatga

SEQ ID NO: 7901099 - DNA, 22 bp, Homo sapiens
ctgtgggctgaaagtgctcccg

SEQ ID NO: 7901100 - DNA, 22 bp, Homo sapiens
ctgtgggctgaaagtgctcccg

SEQ ID NO: 7901101 - DNA, 22 bp, Homo sapiens
ctgtgggctcctgcagctcagg

SEQ ID NO: 7901102 - DNA, 18 bp, Homo sapiens
ctgtgggctggtgcatga

SEQ ID NO: 7901103 - DNA, 18 bp, Homo sapiens
ctgtgggctggtgcatga

SEQ ID NO: 7901104 - DNA, 22 bp, Homo sapiens
ctgtgggcttgaggttagacag

SEQ ID NO: 7901105 - DNA, 22 bp, Homo sapiens
ctgtggggaaagggtcctgctc

SEQ ID NO: 7901106 - DNA, 22 bp, Homo sapiens
ctgtggggaaagggtcctgctc

SEQ ID NO: 7901107 - DNA, 22 bp, Homo sapiens
ctgtggagtttgtggcgctgac

SEQ ID NO: 7901108 - DNA, 22 bp, Homo sapiens
ctgtggagtttgtggcgctgac

SEQ ID NO: 7901109 - DNA, 22 bp, Homo sapiens
ctgtggagtttgtggcgctgac

SEQ ID NO: 7901110 - DNA, 22 bp, Homo sapiens
ctgtggagtttgtggcgctgac

SEQ ID NO: 7901111 - DNA, 22 bp, Homo sapiens
ctgtggagtttgtggcgctgac

SEQ ID NO: 7901112 - DNA, 22 bp, Homo sapiens
ctgtggagtttgtggcgctgac

SEQ ID NO: 7901113 - DNA, 22 bp, Homo sapiens
ctgtggagtttgtggcgctgac

SEQ ID NO: 7901114 - DNA, 22 bp, Homo sapiens
ctgtggatttaggcagagctga

SEQ ID NO: 7901115 - DNA, 23 bp, Homo sapiens
ctgtggcaagtcctgcacctgcc

SEQ ID NO: 7901116 - DNA, 23 bp, Homo sapiens
ctgtggcaagtcctgcacctgcc

SEQ ID NO: 7901117 - DNA, 23 bp, Homo sapiens
ctgtggcaagtcctgcacctgcc

SEQ ID NO: 7901118 - DNA, 23 bp, Homo sapiens
ctgtggcaagtcctgcacctgcc

SEQ ID NO: 7901119 - DNA, 22 bp, Homo sapiens
ctgtggcaggaagggactagca

SEQ ID NO: 7901120 - DNA, 22 bp, Homo sapiens
ctgtggcaggaagggactagca

SEQ ID NO: 7901121 - DNA, 22 bp, Homo sapiens
ctgtggcactcaagaagcctcc

SEQ ID NO: 7901122 - DNA, 22 bp, Homo sapiens
ctgtggcagaggtgacacctct

SEQ ID NO: 7901123 - DNA, 22 bp, Homo sapiens
ctgtggcagaggtgacacctct

SEQ ID NO: 7901124 - DNA, 22 bp, Homo sapiens
ctgtggcacatgtggcaaggcc

SEQ ID NO: 7901125 - DNA, 22 bp, Homo sapiens
ctgtggcacatgtggcaaggcc

SEQ ID NO: 7901126 - DNA, 22 bp, Homo sapiens
ctgtggcacatgtggcaaggcc

SEQ ID NO: 7901127 - DNA, 22 bp, Homo sapiens
ctgtggcaagtctgcctgtcac

SEQ ID NO: 7901128 - DNA, 22 bp, Homo sapiens
ctgtggcaagtctgcctgtcac

SEQ ID NO: 7901129 - DNA, 22 bp, Homo sapiens
ctgtggcaagtctgcctgtcac

SEQ ID NO: 7901130 - DNA, 22 bp, Homo sapiens
ctgtggcattgccgaggctggc

SEQ ID NO: 7901131 - DNA, 22 bp, Homo sapiens
ctgtggcattgccgaggctggc

SEQ ID NO: 7901132 - DNA, 22 bp, Homo sapiens
ctgtggcattgccgaggctggc

SEQ ID NO: 7901133 - DNA, 22 bp, Homo sapiens
ctgtggcattgccgaggctggc

SEQ ID NO: 7901134 - DNA, 22 bp, Homo sapiens
ctgtggcattgccgaggctggc

SEQ ID NO: 7901135 - DNA, 22 bp, Homo sapiens
ctgtggcattgccgaggctggc

SEQ ID NO: 7901136 - DNA, 22 bp, Homo sapiens
ctgtggcattgccgaggctggc

SEQ ID NO: 7901137 - DNA, 22 bp, Homo sapiens
ctgtggcattgccgaggctggc

SEQ ID NO: 7901138 - DNA, 22 bp, Homo sapiens
ctgtggcattgtgaggactgca

SEQ ID NO: 7901139 - DNA, 22 bp, Homo sapiens
ctgtggcattgtgaggactgca

SEQ ID NO: 7901140 - DNA, 22 bp, Homo sapiens
ctgtggcagggaagaggccatg

SEQ ID NO: 7901141 - DNA, 22 bp, Homo sapiens
ctgtggcagggaagaggccatg

SEQ ID NO: 7901142 - DNA, 22 bp, Homo sapiens
ctgtggcaggtgtctggggcag

SEQ ID NO: 7901143 - DNA, 22 bp, Homo sapiens
ctgtggcaggtgtctggggcag

SEQ ID NO: 7901144 - DNA, 22 bp, Homo sapiens
ctgtggcaggtgtctggggcag

SEQ ID NO: 7901145 - DNA, 22 bp, Homo sapiens
ctgtggcagggaagaggccatg

SEQ ID NO: 7901146 - DNA, 22 bp, Homo sapiens
ctgtggcagggaagaggccatg

SEQ ID NO: 7901147 - DNA, 20 bp, Homo sapiens
ctgtggcatctgtcatggtg

SEQ ID NO: 7901148 - DNA, 20 bp, Homo sapiens
ctgtggcatctgtcatggtg

SEQ ID NO: 7901149 - DNA, 22 bp, Homo sapiens
ctgtggcaggtgtctggggcag

SEQ ID NO: 7901150 - DNA, 22 bp, Homo sapiens
ctgtggcaggtgtctggggcag

SEQ ID NO: 7901151 - DNA, 22 bp, Homo sapiens
ctgtggcaggtgtctggggcag

SEQ ID NO: 7901152 - DNA, 20 bp, Homo sapiens
ctgtggcatctgtcatggtg

SEQ ID NO: 7901153 - DNA, 22 bp, Homo sapiens
ctgtgggagggaaggcgcggcc

SEQ ID NO: 7901154 - DNA, 22 bp, Homo sapiens
ctgtgggagggaaggcgcggcc

SEQ ID NO: 7901155 - DNA, 22 bp, Homo sapiens
ctgtgggagggaaggcgcggcc

SEQ ID NO: 7901156 - DNA, 22 bp, Homo sapiens
ctgtgggatgggacctcagctg

SEQ ID NO: 7901157 - DNA, 22 bp, Homo sapiens
ctgtgggagcactggggaccga

SEQ ID NO: 7901158 - DNA, 22 bp, Homo sapiens
ctgtgggagcactggggaccga

SEQ ID NO: 7901159 - DNA, 22 bp, Homo sapiens
ctgtggctttgcagggcttgtt

SEQ ID NO: 7901160 - DNA, 22 bp, Homo sapiens
ctgtggctttctctgcctcctt

SEQ ID NO: 7901161 - DNA, 23 bp, Homo sapiens
ctgtggccacccctagctggagg

SEQ ID NO: 7901162 - DNA, 22 bp, Homo sapiens
ctgtggcattgtgaggactgca

SEQ ID NO: 7901163 - DNA, 22 bp, Homo sapiens
ctgtggcatttagaggttgcgt

SEQ ID NO: 7901164 - DNA, 22 bp, Homo sapiens
ctgtggcattgtgaggactgca

SEQ ID NO: 7901165 - DNA, 22 bp, Homo sapiens
ctgtggcattgtgaggactgca

SEQ ID NO: 7901166 - DNA, 22 bp, Homo sapiens
ctgtggcttctgggtcagttca

SEQ ID NO: 7901167 - DNA, 22 bp, Homo sapiens
ctgtggcttctgggtcagttca

SEQ ID NO: 7901168 - DNA, 22 bp, Homo sapiens
ctgtggctttctctgcctcctt

SEQ ID NO: 7901169 - DNA, 22 bp, Homo sapiens
ctgtggctttctctgcctcctt

SEQ ID NO: 7901170 - DNA, 22 bp, Homo sapiens
ctgtggcttctaggtccccgat

SEQ ID NO: 7901171 - DNA, 22 bp, Homo sapiens
ctgtggcttctgcttgggcctc

SEQ ID NO: 7901172 - DNA, 22 bp, Homo sapiens
ctgtggcttctgcttgggcctc

SEQ ID NO: 7901173 - DNA, 22 bp, Homo sapiens
ctgtgggcagctcctcctgtca

SEQ ID NO: 7901174 - DNA, 22 bp, Homo sapiens
ctgtgggattcatgacattaat

SEQ ID NO: 7901175 - DNA, 22 bp, Homo sapiens
ctgtgggcctagtctggcctag

SEQ ID NO: 7901176 - DNA, 22 bp, Homo sapiens
ctgtgggcatttgagtgtgggt

SEQ ID NO: 7901177 - DNA, 22 bp, Homo sapiens
ctgtgggcatttgagtgtgggt

SEQ ID NO: 7901178 - DNA, 22 bp, Homo sapiens
ctgtgggcatttgagtgtgggt

SEQ ID NO: 7901179 - DNA, 22 bp, Homo sapiens
ctgtgggcctagtctggcctag

SEQ ID NO: 7901180 - DNA, 22 bp, Homo sapiens
ctgtgggcctagtctggcctag

SEQ ID NO: 7901181 - DNA, 22 bp, Homo sapiens
ctgtgggcgcctgtcagcctca

SEQ ID NO: 7901182 - DNA, 22 bp, Homo sapiens
ctgtgggcgcctgtcagcctca

SEQ ID NO: 7901183 - DNA, 22 bp, Homo sapiens
ctgtgggcgcctgtcagcctca

SEQ ID NO: 7901184 - DNA, 22 bp, Homo sapiens
ctgtgggctcccagcttctctc

SEQ ID NO: 7901185 - DNA, 22 bp, Homo sapiens
ctgtgggctcccagcttctctc

SEQ ID NO: 7901186 - DNA, 22 bp, Homo sapiens
ctgtgggctcctgcagctcagg

SEQ ID NO: 7901187 - DNA, 19 bp, Homo sapiens
ctgtgggcggaggaggggc

SEQ ID NO: 7901188 - DNA, 22 bp, Homo sapiens
ctggttcatggtggaatgacat

SEQ ID NO: 7901189 - DNA, 22 bp, Homo sapiens
ctggttcatataggcaagttta

SEQ ID NO: 7901190 - DNA, 22 bp, Homo sapiens
ctggttggaagtgcagactctc

SEQ ID NO: 7901191 - DNA, 22 bp, Homo sapiens
ctggttattttgtttggcagag

SEQ ID NO: 7901192 - DNA, 22 bp, Homo sapiens
ctggttctgattttgctgcatt

SEQ ID NO: 7901193 - DNA, 22 bp, Homo sapiens
ctggttctgattttgctgcatt

SEQ ID NO: 7901194 - DNA, 22 bp, Homo sapiens
ctggttctgatgttcttggctt

SEQ ID NO: 7901195 - DNA, 22 bp, Homo sapiens
ctggttcctccatcagcaggaa

SEQ ID NO: 7901196 - DNA, 22 bp, Homo sapiens
ctggttctgatgttcttggctt

SEQ ID NO: 7901197 - DNA, 22 bp, Homo sapiens
ctggtttagctgtaaggttccc

SEQ ID NO: 7901198 - DNA, 22 bp, Homo sapiens
ctggtttaagcttatatagttg

SEQ ID NO: 7901199 - DNA, 22 bp, Homo sapiens
ctggttgggaggttggctttca

SEQ ID NO: 7901200 - DNA, 22 bp, Homo sapiens
ctggtttaaaattactggttaa

SEQ ID NO: 7901201 - DNA, 19 bp, Homo sapiens
ctggtttaggtagtgagtc

SEQ ID NO: 7901202 - DNA, 22 bp, Homo sapiens
ctggtttagtaggggactgaag

SEQ ID NO: 7901203 - DNA, 22 bp, Homo sapiens
ctggtttatgagggaagggatg

SEQ ID NO: 7901204 - DNA, 22 bp, Homo sapiens
ctggtttataaatctgtggcca

SEQ ID NO: 7901205 - DNA, 17 bp, Homo sapiens
ctggtttatgggcagtg

SEQ ID NO: 7901206 - DNA, 17 bp, Homo sapiens
ctggtttatgggcagtg

SEQ ID NO: 7901207 - DNA, 22 bp, Homo sapiens
ctgtccagtgcagagaacagag

SEQ ID NO: 7901208 - DNA, 22 bp, Homo sapiens
ctgtccagtgcagagaacagag

SEQ ID NO: 7901209 - DNA, 22 bp, Homo sapiens
ctgtcattcttacataatgtga

SEQ ID NO: 7901210 - DNA, 22 bp, Homo sapiens
ctgtcatggtcagattgtcatc

SEQ ID NO: 7901211 - DNA, 22 bp, Homo sapiens
ctgtcattcttacataatgtga

SEQ ID NO: 7901212 - DNA, 22 bp, Homo sapiens
ctggtttttagtgcttaggagt

SEQ ID NO: 7901213 - DNA, 22 bp, Homo sapiens
ctggttttgtcagaagctttat

SEQ ID NO: 7901214 - DNA, 22 bp, Homo sapiens
ctggttttgtcagaagctttat

SEQ ID NO: 7901215 - DNA, 22 bp, Homo sapiens
ctgtcatcacagttgagcagcc

SEQ ID NO: 7901216 - DNA, 22 bp, Homo sapiens
ctgtcatcacagttgagcagcc

SEQ ID NO: 7901217 - DNA, 22 bp, Homo sapiens
ctgtcatcacagttgagcagcc

SEQ ID NO: 7901218 - DNA, 22 bp, Homo sapiens
ctggttttccaatgttttgact

SEQ ID NO: 7901219 - DNA, 22 bp, Homo sapiens
ctggttttctagtccactggct

SEQ ID NO: 7901220 - DNA, 22 bp, Homo sapiens
ctggttttgaaaacgcaagctg

SEQ ID NO: 7901221 - DNA, 22 bp, Homo sapiens
ctggttttggctggcaaggttg

SEQ ID NO: 7901222 - DNA, 22 bp, Homo sapiens
ctggttttggctggcaaggttg

SEQ ID NO: 7901223 - DNA, 22 bp, Homo sapiens
ctggttttaatgttatgtttat

SEQ ID NO: 7901224 - DNA, 22 bp, Homo sapiens
ctggttttatgttatagatgga

SEQ ID NO: 7901225 - DNA, 22 bp, Homo sapiens
ctggttttatgttatagatgga

SEQ ID NO: 7901226 - DNA, 22 bp, Homo sapiens
ctggttttatgttatagatgga

SEQ ID NO: 7901227 - DNA, 22 bp, Homo sapiens
ctggttttaatgttatgtttat

SEQ ID NO: 7901228 - DNA, 22 bp, Homo sapiens
ctggtttgcccacaccagccac

SEQ ID NO: 7901229 - DNA, 22 bp, Homo sapiens
ctggttttaagctgtcagagag

SEQ ID NO: 7901230 - DNA, 22 bp, Homo sapiens
ctggtttgcccacaccagccac

SEQ ID NO: 7901231 - DNA, 22 bp, Homo sapiens
ctggtttgtcttgggaggatgt

SEQ ID NO: 7901232 - DNA, 21 bp, Homo sapiens
ctgtccccagtgagcaccccc

SEQ ID NO: 7901233 - DNA, 21 bp, Homo sapiens
ctgtccccagtgagcaccccc

SEQ ID NO: 7901234 - DNA, 22 bp, Homo sapiens
ctgtcccatccttactctaccc

SEQ ID NO: 7901235 - DNA, 22 bp, Homo sapiens
ctgtccccacccaaatctcatc

SEQ ID NO: 7901236 - DNA, 22 bp, Homo sapiens
ctgtcccaggatcctgactcca

SEQ ID NO: 7901237 - DNA, 22 bp, Homo sapiens
ctgtcccaggatcctgactcca

SEQ ID NO: 7901238 - DNA, 22 bp, Homo sapiens
ctgtcccatactatctgggtga

SEQ ID NO: 7901239 - DNA, 18 bp, Homo sapiens
ctgtcccatcctcaggtt

SEQ ID NO: 7901240 - DNA, 18 bp, Homo sapiens
ctgtcccatcctcaggtt

SEQ ID NO: 7901241 - DNA, 22 bp, Homo sapiens
ctgtcccctgtgctttcacttg

SEQ ID NO: 7901242 - DNA, 22 bp, Homo sapiens
ctgtcccctgtgctttcacttg

SEQ ID NO: 7901243 - DNA, 22 bp, Homo sapiens
ctgtccccgcgagtccagagct

SEQ ID NO: 7901244 - DNA, 22 bp, Homo sapiens
ctgtccccgcgagtccagagct

SEQ ID NO: 7901245 - DNA, 22 bp, Homo sapiens
ctgtccccgcgagtccagagct

SEQ ID NO: 7901246 - DNA, 22 bp, Homo sapiens
ctgtcccctgtgctttcacttg

SEQ ID NO: 7901247 - DNA, 22 bp, Homo sapiens
ctgtccctcagttctgggcaaa

SEQ ID NO: 7901248 - DNA, 20 bp, Homo sapiens
ctgtccccgaggtcaccagg

SEQ ID NO: 7901249 - DNA, 22 bp, Homo sapiens
ctgtccccattgtttgagggtt

SEQ ID NO: 7901250 - DNA, 20 bp, Homo sapiens
ctgtccccgaggtcaccagg

SEQ ID NO: 7901251 - DNA, 22 bp, Homo sapiens
ctgtccccgcgagtccagagct

SEQ ID NO: 7901252 - DNA, 22 bp, Homo sapiens
ctgtccccgcgagtccagagct

SEQ ID NO: 7901253 - DNA, 22 bp, Homo sapiens
ctgtcccaggatcctgactcca

SEQ ID NO: 7901254 - DNA, 22 bp, Homo sapiens
ctgtcccaggatcctgactcca

SEQ ID NO: 7901255 - DNA, 22 bp, Homo sapiens
ctgtcccagatgttctcagcac

SEQ ID NO: 7901256 - DNA, 22 bp, Homo sapiens
ctgtcccagccccgtactctaa

SEQ ID NO: 7901257 - DNA, 19 bp, Homo sapiens
ctgtcccagactctgctct

SEQ ID NO: 7901258 - DNA, 19 bp, Homo sapiens
ctgtcccagactctgctct

SEQ ID NO: 7901259 - DNA, 19 bp, Homo sapiens
ctgtcccagactctgctct

SEQ ID NO: 7901260 - DNA, 22 bp, Homo sapiens
ctgtcccagatgttctcagcac

SEQ ID NO: 7901261 - DNA, 22 bp, Homo sapiens
ctgtcccagatgttctcagcac

SEQ ID NO: 7901262 - DNA, 22 bp, Homo sapiens
ctgtcccacaagcagtgtgcac

SEQ ID NO: 7901263 - DNA, 22 bp, Homo sapiens
ctgtcccacaagcagtgtgcac

SEQ ID NO: 7901264 - DNA, 22 bp, Homo sapiens
ctgtcccacaagcagtgtgcac

SEQ ID NO: 7901265 - DNA, 22 bp, Homo sapiens
ctgtccatgttaagccccttgc

SEQ ID NO: 7901266 - DNA, 22 bp, Homo sapiens
ctgtccattttcgtgcctcctt

SEQ ID NO: 7901267 - DNA, 22 bp, Homo sapiens
ctgtctgttatctcaccagtcc

SEQ ID NO: 7901268 - DNA, 22 bp, Homo sapiens
ctgtctgttatctcaccagtcc

SEQ ID NO: 7901269 - DNA, 22 bp, Homo sapiens
ctgtctgttatctcaccagtcc

SEQ ID NO: 7901270 - DNA, 22 bp, Homo sapiens
ctgtctgtgtggacacggctgc

SEQ ID NO: 7901271 - DNA, 22 bp, Homo sapiens
ctgtctgtggtctcagtaggcc

SEQ ID NO: 7901272 - DNA, 22 bp, Homo sapiens
ctgtctgtgtggacacggctgc

SEQ ID NO: 7901273 - DNA, 22 bp, Homo sapiens
ctgtctgtggtctcagtaggcc

SEQ ID NO: 7901274 - DNA, 21 bp, Homo sapiens
ctgtccctctttgcttccctc

SEQ ID NO: 7901275 - DNA, 22 bp, Homo sapiens
ctgtctgtttcaaaagtggtta

SEQ ID NO: 7901276 - DNA, 22 bp, Homo sapiens
ctgtgaaactggacagcacttg

SEQ ID NO: 7901277 - DNA, 22 bp, Homo sapiens
ctgtctgttgaccatagtttgc

SEQ ID NO: 7901278 - DNA, 22 bp, Homo sapiens
ctgtgaaactggacagcacttg

SEQ ID NO: 7901279 - DNA, 22 bp, Homo sapiens
ctgtgaaatcaaccttgagccc

SEQ ID NO: 7901280 - DNA, 22 bp, Homo sapiens
ctgtctgttgaccatagtttgc

SEQ ID NO: 7901281 - DNA, 22 bp, Homo sapiens
ctgtctgttcagattcattact

SEQ ID NO: 7901282 - DNA, 21 bp, Homo sapiens
ctgtccctctttgcttccctc

SEQ ID NO: 7901283 - DNA, 22 bp, Homo sapiens
ctgtccctctcacacctcacca

SEQ ID NO: 7901284 - DNA, 22 bp, Homo sapiens
ctgtccctctcacacctcacca

SEQ ID NO: 7901285 - DNA, 19 bp, Homo sapiens
ctgtccctcccaggtatga

SEQ ID NO: 7901286 - DNA, 19 bp, Homo sapiens
ctgtccctcccaggtatga

SEQ ID NO: 7901287 - DNA, 22 bp, Homo sapiens
ctgtccctctcacacctcacca

SEQ ID NO: 7901288 - DNA, 19 bp, Homo sapiens
ctgtccctcccaggtatga

SEQ ID NO: 7901289 - DNA, 22 bp, Homo sapiens
ctgtccctcatcacctctgggt

SEQ ID NO: 7901290 - DNA, 22 bp, Homo sapiens
ctgtccctcatcacctctgggt

SEQ ID NO: 7901291 - DNA, 22 bp, Homo sapiens
ctgtccctcagttctgggcaaa

SEQ ID NO: 7901292 - DNA, 22 bp, Homo sapiens
ctgtccctcagttctgggcaaa

SEQ ID NO: 7901293 - DNA, 20 bp, Homo sapiens
ctgtgaccagagacccagga

SEQ ID NO: 7901294 - DNA, 22 bp, Homo sapiens
ctgtgacccagttcctggcacc

SEQ ID NO: 7901295 - DNA, 22 bp, Homo sapiens
ctgtgacccagttcctggcacc

SEQ ID NO: 7901296 - DNA, 22 bp, Homo sapiens
ctgtgacagtttctcagaattt

SEQ ID NO: 7901297 - DNA, 22 bp, Homo sapiens
ctgtgacagtttctcagacttt

SEQ ID NO: 7901298 - DNA, 22 bp, Homo sapiens
ctgtgacagtttctcagaattt

SEQ ID NO: 7901299 - DNA, 22 bp, Homo sapiens
ctgtgacagggatcagaatgca

SEQ ID NO: 7901300 - DNA, 22 bp, Homo sapiens
ctgtgacagagcttgagtgaga

SEQ ID NO: 7901301 - DNA, 22 bp, Homo sapiens
ctgtgacagagcttgagtgaga

SEQ ID NO: 7901302 - DNA, 22 bp, Homo sapiens
ctgtgacaaaagcagcctgcct

SEQ ID NO: 7901303 - DNA, 22 bp, Homo sapiens
ctgtgaatttaaagcacacatc

SEQ ID NO: 7901304 - DNA, 22 bp, Homo sapiens
ctgtgaattttccaatattccg

SEQ ID NO: 7901305 - DNA, 22 bp, Homo sapiens
ctgtgaatctgggtcagttgta

SEQ ID NO: 7901306 - DNA, 22 bp, Homo sapiens
ctgtgaatcttgatgttatttc

SEQ ID NO: 7901307 - DNA, 22 bp, Homo sapiens
ctgtgaatcttgatgttatttc

SEQ ID NO: 7901308 - DNA, 22 bp, Homo sapiens
ctgtgaagtgaatgctcctagt

SEQ ID NO: 7901309 - DNA, 22 bp, Homo sapiens
ctgtgaacaatagcagcatctt

SEQ ID NO: 7901310 - DNA, 22 bp, Homo sapiens
ctgtgaaatgctttgcgatggt

SEQ ID NO: 7901311 - DNA, 22 bp, Homo sapiens
ctgtgaaatgctttgcgatggt

SEQ ID NO: 7901312 - DNA, 22 bp, Homo sapiens
ctgtgaatgttgaataaatcct

SEQ ID NO: 7901313 - DNA, 22 bp, Homo sapiens
ctgtgaatgttgaataaatcct

SEQ ID NO: 7901314 - DNA, 22 bp, Homo sapiens
ctgtgaattgcaacaattgcaa

SEQ ID NO: 7901315 - DNA, 22 bp, Homo sapiens
ctgtgactgcagcaccaagtaa

SEQ ID NO: 7901316 - DNA, 22 bp, Homo sapiens
ctgtgactgcagcaccaagtaa

SEQ ID NO: 7901317 - DNA, 18 bp, Homo sapiens
ctgtgactcctagatctc

SEQ ID NO: 7901318 - DNA, 21 bp, Homo sapiens
ctgtgactccctgggcaatcc

SEQ ID NO: 7901319 - DNA, 21 bp, Homo sapiens
ctgtgacctttctttcctcct

SEQ ID NO: 7901320 - DNA, 21 bp, Homo sapiens
ctgtgacctttctttcctcct

SEQ ID NO: 7901321 - DNA, 22 bp, Homo sapiens
ctgtgacctccaggaaggggtg

SEQ ID NO: 7901322 - DNA, 22 bp, Homo sapiens
ctgtgaccttagcaagggaaat

SEQ ID NO: 7901323 - DNA, 22 bp, Homo sapiens
ctgtgacttgccaaaggtcatt

SEQ ID NO: 7901324 - DNA, 22 bp, Homo sapiens
ctgtgactgtgttggatgcaca

SEQ ID NO: 7901325 - DNA, 22 bp, Homo sapiens
ctgtgactgtgttggatgcaca

SEQ ID NO: 7901326 - DNA, 22 bp, Homo sapiens
ctgtgactggaatctggctctt

SEQ ID NO: 7901327 - DNA, 22 bp, Homo sapiens
ctgtgactggaatctggctctt

SEQ ID NO: 7901328 - DNA, 22 bp, Homo sapiens
ctgtgactggaatctggctctt

SEQ ID NO: 7901329 - DNA, 22 bp, Homo sapiens
ctgtgactgggtgacagtcctc

SEQ ID NO: 7901330 - DNA, 22 bp, Homo sapiens
ctgtgactgggtgacagtcctc

SEQ ID NO: 7901331 - DNA, 22 bp, Homo sapiens
ctgtgagatttttaaataactt

SEQ ID NO: 7901332 - DNA, 22 bp, Homo sapiens
ctgtgagatttttaaataactt

SEQ ID NO: 7901333 - DNA, 22 bp, Homo sapiens
ctgtgagatgtttctggttaga

SEQ ID NO: 7901334 - DNA, 22 bp, Homo sapiens
ctgtgagatgtttctggttaga

SEQ ID NO: 7901335 - DNA, 22 bp, Homo sapiens
ctgtgagatgaccaactgactg

SEQ ID NO: 7901336 - DNA, 22 bp, Homo sapiens
ctgtgagagtggtggcctaggc

SEQ ID NO: 7901337 - DNA, 22 bp, Homo sapiens
ctgtgagactgatagggaagag

SEQ ID NO: 7901338 - DNA, 22 bp, Homo sapiens
ctgtgagagtggtggcctaggc

SEQ ID NO: 7901339 - DNA, 22 bp, Homo sapiens
ctgtgagatatgcatatgctct

SEQ ID NO: 7901340 - DNA, 22 bp, Homo sapiens
ctgtgagatatgcatatgctct

SEQ ID NO: 7901341 - DNA, 22 bp, Homo sapiens
ctgtgacttttgccctgtacca

SEQ ID NO: 7901342 - DNA, 22 bp, Homo sapiens
ctgtgagaaaggtgatggaggt

SEQ ID NO: 7901343 - DNA, 22 bp, Homo sapiens
ctgtgagaaataaatgtttgct

SEQ ID NO: 7901344 - DNA, 22 bp, Homo sapiens
ctgtgagaaaggtgatggaggt

SEQ ID NO: 7901345 - DNA, 22 bp, Homo sapiens
ctgtgagaagaatcccacctga

SEQ ID NO: 7901346 - DNA, 22 bp, Homo sapiens
ctgtgagacctgatttcttcat

SEQ ID NO: 7901347 - DNA, 22 bp, Homo sapiens
ctgtgagaaataaatgtttgct

SEQ ID NO: 7901348 - DNA, 22 bp, Homo sapiens
ctgtgagacctgatttcttcat

SEQ ID NO: 7901349 - DNA, 22 bp, Homo sapiens
ctgtgagactgatagggaagag

SEQ ID NO: 7901350 - DNA, 22 bp, Homo sapiens
ctgtgagactgatagggaagag

SEQ ID NO: 7901351 - DNA, 22 bp, Homo sapiens
ctgtgaggcgggtggagtggag

SEQ ID NO: 7901352 - DNA, 22 bp, Homo sapiens
ctgtgaggcgggtggagtggag

SEQ ID NO: 7901353 - DNA, 22 bp, Homo sapiens
ctgtgaggcggaaaggactctc

SEQ ID NO: 7901354 - DNA, 22 bp, Homo sapiens
ctgtgagggcagggaccagagg

SEQ ID NO: 7901355 - DNA, 22 bp, Homo sapiens
ctgtgaggccctgggtgctgga

SEQ ID NO: 7901356 - DNA, 22 bp, Homo sapiens
ctgtgagctgggtggccaggac

SEQ ID NO: 7901357 - DNA, 22 bp, Homo sapiens
ctgtggaattgatgcttagtgt

SEQ ID NO: 7901358 - DNA, 22 bp, Homo sapiens
ctgtggaatcgggaaaagacag

SEQ ID NO: 7901359 - DNA, 22 bp, Homo sapiens
ctgtggaaggtttagataggta

SEQ ID NO: 7901360 - DNA, 20 bp, Homo sapiens
ctgtggaattttaccatgcg

SEQ ID NO: 7901361 - DNA, 21 bp, Homo sapiens
ctgtggacaggctggggcatg

SEQ ID NO: 7901362 - DNA, 22 bp, Homo sapiens
ctgtggacaggggcgcagaggt

SEQ ID NO: 7901363 - DNA, 19 bp, Homo sapiens
ctgtggactctagatcatg

SEQ ID NO: 7901364 - DNA, 22 bp, Homo sapiens
ctgtggacaggggcgcagaggt

SEQ ID NO: 7901365 - DNA, 22 bp, Homo sapiens
ctgggtggaaagtgctgagaat

SEQ ID NO: 7901366 - DNA, 22 bp, Homo sapiens
ctgggtggaaagtgctgagaat

SEQ ID NO: 7901367 - DNA, 22 bp, Homo sapiens
ctgggtggaaagtgctgagaat

SEQ ID NO: 7901368 - DNA, 22 bp, Homo sapiens
ctgggtggaaagtgctgagaat

SEQ ID NO: 7901369 - DNA, 22 bp, Homo sapiens
ctgggtggaaagtgctgagaat

SEQ ID NO: 7901370 - DNA, 22 bp, Homo sapiens
ctgggtggctgtccagccagcc

SEQ ID NO: 7901371 - DNA, 22 bp, Homo sapiens
ctgggtggttctaactgttgat

SEQ ID NO: 7901372 - DNA, 22 bp, Homo sapiens
ctgggtggttctaactgttgat

SEQ ID NO: 7901373 - DNA, 22 bp, Homo sapiens
ctgggtggttttgatgtgaatt

SEQ ID NO: 7901374 - DNA, 22 bp, Homo sapiens
ctgggttccatgtagccaagag

SEQ ID NO: 7901375 - DNA, 22 bp, Homo sapiens
ctgggttccatgtagccaagag

SEQ ID NO: 7901376 - DNA, 22 bp, Homo sapiens
ctgggttaccatgaggaaatga

SEQ ID NO: 7901377 - DNA, 22 bp, Homo sapiens
ctgggtgttcaggagctgggct

SEQ ID NO: 7901378 - DNA, 22 bp, Homo sapiens
ctgggtttagggtctccccttg

SEQ ID NO: 7901379 - DNA, 22 bp, Homo sapiens
ctgggtttagggtctccccttg

SEQ ID NO: 7901380 - DNA, 22 bp, Homo sapiens
ctgggttctctgcttagggcct

SEQ ID NO: 7901381 - DNA, 22 bp, Homo sapiens
ctgggttctatttttggcttca

SEQ ID NO: 7901382 - DNA, 22 bp, Homo sapiens
ctgggttcttggcacagcagga

SEQ ID NO: 7901383 - DNA, 22 bp, Homo sapiens
ctgggttctatttttggcttca

SEQ ID NO: 7901384 - DNA, 22 bp, Homo sapiens
ctgggttcttggcacagcagga

SEQ ID NO: 7901385 - DNA, 22 bp, Homo sapiens
ctgggttgcaaagcgctggctg

SEQ ID NO: 7901386 - DNA, 22 bp, Homo sapiens
ctggtacagtgttacaaaatgg

SEQ ID NO: 7901387 - DNA, 22 bp, Homo sapiens
ctggtacaaaatgctgatatca

SEQ ID NO: 7901388 - DNA, 22 bp, Homo sapiens
ctgggttttattacagtgagct

SEQ ID NO: 7901389 - DNA, 22 bp, Homo sapiens
ctgggttttattacagtgagct

SEQ ID NO: 7901390 - DNA, 22 bp, Homo sapiens
ctgggttttattacagtgagct

SEQ ID NO: 7901391 - DNA, 22 bp, Homo sapiens
ctgggttttattacagtgagct

SEQ ID NO: 7901392 - DNA, 23 bp, Homo sapiens
ctggtaaatcactaaaattacaa

SEQ ID NO: 7901393 - DNA, 22 bp, Homo sapiens
ctggtaaagaagacaaacaggg

SEQ ID NO: 7901394 - DNA, 22 bp, Homo sapiens
ctggtaaatgatgagaagcacc

SEQ ID NO: 7901395 - DNA, 22 bp, Homo sapiens
ctggtggggagtcctggtctcc

SEQ ID NO: 7901396 - DNA, 22 bp, Homo sapiens
ctggtgcctcctctcccaggtc

SEQ ID NO: 7901397 - DNA, 22 bp, Homo sapiens
ctggtgcctcctctcccaggtc

SEQ ID NO: 7901398 - DNA, 22 bp, Homo sapiens
ctggtgctggagcctagtccct

SEQ ID NO: 7901399 - DNA, 22 bp, Homo sapiens
ctggtgctggagcctagtccct

SEQ ID NO: 7901400 - DNA, 22 bp, Homo sapiens
ctggtgggtagagggcatcagg

SEQ ID NO: 7901401 - DNA, 22 bp, Homo sapiens
ctggtgggtagagggcatcagg

SEQ ID NO: 7901402 - DNA, 22 bp, Homo sapiens
ctggtgggtagagggcatcagg

SEQ ID NO: 7901403 - DNA, 22 bp, Homo sapiens
ctggtggggagtcctggtctcc

SEQ ID NO: 7901404 - DNA, 22 bp, Homo sapiens
ctggtcacctccttcccagcta

SEQ ID NO: 7901405 - DNA, 22 bp, Homo sapiens
ctggtgccctgtgtggcaggag

SEQ ID NO: 7901406 - DNA, 22 bp, Homo sapiens
ctggtgcctcctccctgtgctt

SEQ ID NO: 7901407 - DNA, 22 bp, Homo sapiens
ctggtgcctcctccctgtgctt

SEQ ID NO: 7901408 - DNA, 22 bp, Homo sapiens
ctggtgcctcctccctgtgctt

SEQ ID NO: 7901409 - DNA, 22 bp, Homo sapiens
ctggtcacctccttcccagcta

SEQ ID NO: 7901410 - DNA, 22 bp, Homo sapiens
ctggtcacctccttcccagcta

SEQ ID NO: 7901411 - DNA, 22 bp, Homo sapiens
ctggtcaccaggtagcattgta

SEQ ID NO: 7901412 - DNA, 22 bp, Homo sapiens
ctggtcaccaggtagcattgta

SEQ ID NO: 7901413 - DNA, 22 bp, Homo sapiens
ctggtcaccaggtagcattgta

SEQ ID NO: 7901414 - DNA, 22 bp, Homo sapiens
ctggtcaaaaattatgcttact

SEQ ID NO: 7901415 - DNA, 22 bp, Homo sapiens
ctggtcaagagctagcagagct

SEQ ID NO: 7901416 - DNA, 22 bp, Homo sapiens
ctggtcaataatcatgtagtac

SEQ ID NO: 7901417 - DNA, 22 bp, Homo sapiens
ctggtcaaggagagtctctgca

SEQ ID NO: 7901418 - DNA, 22 bp, Homo sapiens
ctggtagtttgcaaaatggtgt

SEQ ID NO: 7901419 - DNA, 22 bp, Homo sapiens
ctggtagtttgcaaaatggtgt

SEQ ID NO: 7901420 - DNA, 22 bp, Homo sapiens
ctggtagtgtctgccgaggtcc

SEQ ID NO: 7901421 - DNA, 22 bp, Homo sapiens
ctggtattgagttgttgcttcc

SEQ ID NO: 7901422 - DNA, 22 bp, Homo sapiens
ctggtagtttgcaaaatggtgt

SEQ ID NO: 7901423 - DNA, 22 bp, Homo sapiens
ctggtagctcctgaatatccct

SEQ ID NO: 7901424 - DNA, 22 bp, Homo sapiens
ctggtagcagtgaagctgttga

SEQ ID NO: 7901425 - DNA, 22 bp, Homo sapiens
ctggtaggggtgactgttatcg

SEQ ID NO: 7901426 - DNA, 22 bp, Homo sapiens
ctggtaggggtgactgttatcg

SEQ ID NO: 7901427 - DNA, 22 bp, Homo sapiens
ctggtggttcaggagaatggct

SEQ ID NO: 7901428 - DNA, 22 bp, Homo sapiens
ctggtgtaccttggctcaggca

SEQ ID NO: 7901429 - DNA, 22 bp, Homo sapiens
ctggtgtcattttagcctcagg

SEQ ID NO: 7901430 - DNA, 22 bp, Homo sapiens
ctggtgtccagcatgtgtggaa

SEQ ID NO: 7901431 - DNA, 22 bp, Homo sapiens
ctggtgtctgctccctcacagc

SEQ ID NO: 7901432 - DNA, 22 bp, Homo sapiens
ctggtgtgattgagcccaggtg

SEQ ID NO: 7901433 - DNA, 22 bp, Homo sapiens
ctggtgtgattgagcccaggtg

SEQ ID NO: 7901434 - DNA, 22 bp, Homo sapiens
ctggtgtggactccgcgcggag

SEQ ID NO: 7901435 - DNA, 22 bp, Homo sapiens
ctggtgtggactccgcgcggag

SEQ ID NO: 7901436 - DNA, 22 bp, Homo sapiens
ctggttattattcttggaatgc

SEQ ID NO: 7901437 - DNA, 22 bp, Homo sapiens
ctggttatcctgcctattttgt

SEQ ID NO: 7901438 - DNA, 22 bp, Homo sapiens
ctggtgtttattacaggtgctc

SEQ ID NO: 7901439 - DNA, 22 bp, Homo sapiens
ctggttaaatgaaaaagtatta

SEQ ID NO: 7901440 - DNA, 22 bp, Homo sapiens
ctggtgtttattacaggtgctc

SEQ ID NO: 7901441 - DNA, 22 bp, Homo sapiens
ctggtgtttattacaggtgctc

SEQ ID NO: 7901442 - DNA, 22 bp, Homo sapiens
ctggtgtggactccgcgcggag

SEQ ID NO: 7901443 - DNA, 22 bp, Homo sapiens
ctggtgtggcggcgccctgtag

SEQ ID NO: 7901444 - DNA, 22 bp, Homo sapiens
ctggtgttggagcaaatgcagg

SEQ ID NO: 7901445 - DNA, 22 bp, Homo sapiens
ctggtgttgtccgggtgagagt

SEQ ID NO: 7901446 - DNA, 22 bp, Homo sapiens
ctggtgtttatctgactgccta

SEQ ID NO: 7901447 - DNA, 22 bp, Homo sapiens
ctggtgttgtccgggtgagagt

SEQ ID NO: 7901448 - DNA, 22 bp, Homo sapiens
ctggggggctactgacagagga

SEQ ID NO: 7901449 - DNA, 22 bp, Homo sapiens
ctggggggctactgacagagga

SEQ ID NO: 7901450 - DNA, 22 bp, Homo sapiens
ctggggggctactgacagagga

SEQ ID NO: 7901451 - DNA, 22 bp, Homo sapiens
ctgggggtcttgaaagggagag

SEQ ID NO: 7901452 - DNA, 22 bp, Homo sapiens
ctgggggtcttgaaagggagag

SEQ ID NO: 7901453 - DNA, 22 bp, Homo sapiens
ctgggggtcgcgcctctgggca

SEQ ID NO: 7901454 - DNA, 22 bp, Homo sapiens
ctgggggtcgcgcctctgggca

SEQ ID NO: 7901455 - DNA, 22 bp, Homo sapiens
ctgggggtcgcgcctctgggca

SEQ ID NO: 7901456 - DNA, 22 bp, Homo sapiens
ctgggggtcgcgcctctgggca

SEQ ID NO: 7901457 - DNA, 22 bp, Homo sapiens
ctgggggtcgcgcctctgggca

SEQ ID NO: 7901458 - DNA, 22 bp, Homo sapiens
ctgggggtgagcagcagcgacg

SEQ ID NO: 7901459 - DNA, 22 bp, Homo sapiens
ctgggggtgagcagcagcgacg

SEQ ID NO: 7901460 - DNA, 19 bp, Homo sapiens
ctgggggtgctcacgctct

SEQ ID NO: 7901461 - DNA, 22 bp, Homo sapiens
ctggggtcagggatcagagagc

SEQ ID NO: 7901462 - DNA, 22 bp, Homo sapiens
ctggggtcagggatcagagagc

SEQ ID NO: 7901463 - DNA, 19 bp, Homo sapiens
ctgggggtgctcacgctct

SEQ ID NO: 7901464 - DNA, 22 bp, Homo sapiens
ctggggtgaaggattacctgag

SEQ ID NO: 7901465 - DNA, 22 bp, Homo sapiens
ctggggtgagcagaaacagggg

SEQ ID NO: 7901466 - DNA, 22 bp, Homo sapiens
ctggggtgagcagaaacagggg

SEQ ID NO: 7901467 - DNA, 22 bp, Homo sapiens
ctggggtccttgccatgtgtca

SEQ ID NO: 7901468 - DNA, 22 bp, Homo sapiens
ctggggtctcaattctagcggg

SEQ ID NO: 7901469 - DNA, 22 bp, Homo sapiens
ctggggtctcaattctagcggg

SEQ ID NO: 7901470 - DNA, 22 bp, Homo sapiens
ctggggtccttgccatgtgtca

SEQ ID NO: 7901471 - DNA, 22 bp, Homo sapiens
ctggggtggagattggcaatct

SEQ ID NO: 7901472 - DNA, 22 bp, Homo sapiens
ctggggtggagattggcaatct

SEQ ID NO: 7901473 - DNA, 22 bp, Homo sapiens
ctggggtggagattggcaatct

SEQ ID NO: 7901474 - DNA, 22 bp, Homo sapiens
ctggggtggaggagctcccctg

SEQ ID NO: 7901475 - DNA, 22 bp, Homo sapiens
ctggggtggatgggtccaagtt

SEQ ID NO: 7901476 - DNA, 22 bp, Homo sapiens
ctggggtggatgggtccaagtt

SEQ ID NO: 7901477 - DNA, 22 bp, Homo sapiens
ctggggtggaggagctcccctg

SEQ ID NO: 7901478 - DNA, 22 bp, Homo sapiens
ctggggtggatgggtccaagtt

SEQ ID NO: 7901479 - DNA, 22 bp, Homo sapiens
ctggggtggtgcaggcctcatg

SEQ ID NO: 7901480 - DNA, 22 bp, Homo sapiens
ctggggtggatgggtccaagtt

SEQ ID NO: 7901481 - DNA, 22 bp, Homo sapiens
ctgggtggaaagtgctgagaat

SEQ ID NO: 7901482 - DNA, 22 bp, Homo sapiens
ctgggtggaaagtgctgagaat

SEQ ID NO: 7901483 - DNA, 22 bp, Homo sapiens
ctgggtggaaagtgctgagaat

SEQ ID NO: 7901484 - DNA, 22 bp, Homo sapiens
ctgggtggaaagtgctgagaat

SEQ ID NO: 7901485 - DNA, 22 bp, Homo sapiens
ctgggtggaaagtgctgagaat

SEQ ID NO: 7901486 - DNA, 22 bp, Homo sapiens
ctggggtgtgctcagagcaggg

SEQ ID NO: 7901487 - DNA, 22 bp, Homo sapiens
ctggggtgtctcgtctgccatt

SEQ ID NO: 7901488 - DNA, 22 bp, Homo sapiens
ctggggtgtctcgtctgccatt

SEQ ID NO: 7901489 - DNA, 22 bp, Homo sapiens
ctggggtgtctcgtctgccatt

SEQ ID NO: 7901490 - DNA, 22 bp, Homo sapiens
ctggggtggtgcaggcctcatg

SEQ ID NO: 7901491 - DNA, 22 bp, Homo sapiens
ctggggtggtgcaggcctcatg

SEQ ID NO: 7901492 - DNA, 22 bp, Homo sapiens
ctggggtggtgcaggcctcatg

SEQ ID NO: 7901493 - DNA, 22 bp, Homo sapiens
ctggggctgtaggaggacttat

SEQ ID NO: 7901494 - DNA, 22 bp, Homo sapiens
ctggggctgtaggaggacttat

SEQ ID NO: 7901495 - DNA, 22 bp, Homo sapiens
ctggggctggtgaggcaggctc

SEQ ID NO: 7901496 - DNA, 22 bp, Homo sapiens
ctggggctggtgaggcaggctc

SEQ ID NO: 7901497 - DNA, 22 bp, Homo sapiens
ctgggctctagaaaggaaagaa

SEQ ID NO: 7901498 - DNA, 22 bp, Homo sapiens
ctggggctggtgaggcaggctc

SEQ ID NO: 7901499 - DNA, 22 bp, Homo sapiens
ctgggctctagaaaggaaagaa

SEQ ID NO: 7901500 - DNA, 22 bp, Homo sapiens
ctgggctctagaaaggaaagaa

SEQ ID NO: 7901501 - DNA, 22 bp, Homo sapiens
ctgggctctagaaaggaaagaa

SEQ ID NO: 7901502 - DNA, 22 bp, Homo sapiens
ctgggctctagaaaggaaagaa

SEQ ID NO: 7901503 - DNA, 22 bp, Homo sapiens
ctgggctctaagggagcaccgt

SEQ ID NO: 7901504 - DNA, 22 bp, Homo sapiens
ctggggggagctgcgtccagca

SEQ ID NO: 7901505 - DNA, 22 bp, Homo sapiens
ctgggggccttacggaactcca

SEQ ID NO: 7901506 - DNA, 22 bp, Homo sapiens
ctgggggccttacggaactcca

SEQ ID NO: 7901507 - DNA, 22 bp, Homo sapiens
ctgggggccttacggaactcca

SEQ ID NO: 7901508 - DNA, 22 bp, Homo sapiens
ctgggggcagcaagaagccatg

SEQ ID NO: 7901509 - DNA, 22 bp, Homo sapiens
ctgggggcagcaagaagccatg

SEQ ID NO: 7901510 - DNA, 22 bp, Homo sapiens
ctgggggcagcaagaagccatg

SEQ ID NO: 7901511 - DNA, 22 bp, Homo sapiens
ctgggggcagcaagaagccatg

SEQ ID NO: 7901512 - DNA, 22 bp, Homo sapiens
ctgggggcagcaagaagccatg

SEQ ID NO: 7901513 - DNA, 20 bp, Homo sapiens
ctgggctcggtggccctggc

SEQ ID NO: 7901514 - DNA, 20 bp, Homo sapiens
ctgggctcggtggccctggc

SEQ ID NO: 7901515 - DNA, 20 bp, Homo sapiens
ctgggctcggtggccctggc

SEQ ID NO: 7901516 - DNA, 18 bp, Homo sapiens
ctgggctcgagagatcct

SEQ ID NO: 7901517 - DNA, 20 bp, Homo sapiens
ctgggctcggtggccctggc

SEQ ID NO: 7901518 - DNA, 20 bp, Homo sapiens
ctgggctcggtggccctggc

SEQ ID NO: 7901519 - DNA, 18 bp, Homo sapiens
ctgggctcgagagatcct

SEQ ID NO: 7901520 - DNA, 18 bp, Homo sapiens
ctgggctcgagagatcct

SEQ ID NO: 7901521 - DNA, 18 bp, Homo sapiens
ctgggctcgagagatcct

SEQ ID NO: 7901522 - DNA, 18 bp, Homo sapiens
ctgggctcgagagatcct

SEQ ID NO: 7901523 - DNA, 20 bp, Homo sapiens
ctgggctcggtggccctggc

SEQ ID NO: 7901524 - DNA, 20 bp, Homo sapiens
ctgggctcggtggccctggc

SEQ ID NO: 7901525 - DNA, 20 bp, Homo sapiens
ctgggctcggtggccctggc

SEQ ID NO: 7901526 - DNA, 22 bp, Homo sapiens
ctgggctctaagggagcaccgt

SEQ ID NO: 7901527 - DNA, 22 bp, Homo sapiens
ctgggctctaagggagcaccgt

SEQ ID NO: 7901528 - DNA, 22 bp, Homo sapiens
ctgggctctaagggagcaccgt

SEQ ID NO: 7901529 - DNA, 22 bp, Homo sapiens
ctgggctctaagggagcaccgt

SEQ ID NO: 7901530 - DNA, 22 bp, Homo sapiens
ctgggctccctcatgtgtctgc

SEQ ID NO: 7901531 - DNA, 22 bp, Homo sapiens
ctgggctccctcatgtgtctgc

SEQ ID NO: 7901532 - DNA, 22 bp, Homo sapiens
ctgggctccctcatgtgtctgc

SEQ ID NO: 7901533 - DNA, 22 bp, Homo sapiens
ctgggctccctcatgtgtctgc

SEQ ID NO: 7901534 - DNA, 22 bp, Homo sapiens
ctgggctcctaaccatccaggt

SEQ ID NO: 7901535 - DNA, 22 bp, Homo sapiens
ctgggctcctaaccatccaggt

SEQ ID NO: 7901536 - DNA, 22 bp, Homo sapiens
ctgggctcctaaccatccaggt

SEQ ID NO: 7901537 - DNA, 22 bp, Homo sapiens
ctgggctcctaaccatccaggt

SEQ ID NO: 7901538 - DNA, 22 bp, Homo sapiens
ctgggctccctcatgtgtctgc

SEQ ID NO: 7901539 - DNA, 22 bp, Homo sapiens
ctgggctccctcatgtgtctgc

SEQ ID NO: 7901540 - DNA, 22 bp, Homo sapiens
ctgggctccctcatgtgtctgc

SEQ ID NO: 7901541 - DNA, 18 bp, Homo sapiens
ctgggctcgagagatcct

SEQ ID NO: 7901542 - DNA, 22 bp, Homo sapiens
ctgggctcctaaccatccaggt

SEQ ID NO: 7901543 - DNA, 22 bp, Homo sapiens
ctgggctcctaaccatccaggt

SEQ ID NO: 7901544 - DNA, 22 bp, Homo sapiens
ctgggctcctaaccatccaggt

SEQ ID NO: 7901545 - DNA, 22 bp, Homo sapiens
ctgggctcctaaccatccaggt

SEQ ID NO: 7901546 - DNA, 22 bp, Homo sapiens
ctgggctcaaatcctggccctg

SEQ ID NO: 7901547 - DNA, 22 bp, Homo sapiens
ctgggctcaaatcctggccctg

SEQ ID NO: 7901548 - DNA, 22 bp, Homo sapiens
ctgggctcaagaagtcttccct

SEQ ID NO: 7901549 - DNA, 22 bp, Homo sapiens
ctgggctcaagaagtcttccct

SEQ ID NO: 7901550 - DNA, 22 bp, Homo sapiens
ctgggctcaaatcctggccctg

SEQ ID NO: 7901551 - DNA, 22 bp, Homo sapiens
ctgggctcaaatcctggccctg

SEQ ID NO: 7901552 - DNA, 22 bp, Homo sapiens
ctgggctcaaatcctggccctg

SEQ ID NO: 7901553 - DNA, 22 bp, Homo sapiens
ctgggctcaaatcctggccctg

SEQ ID NO: 7901554 - DNA, 22 bp, Homo sapiens
ctgggctcaaatcctggccctg

SEQ ID NO: 7901555 - DNA, 22 bp, Homo sapiens
ctgggctcaaatcctggccctg

SEQ ID NO: 7901556 - DNA, 22 bp, Homo sapiens
ctgggctcagcaggccaaggcc

SEQ ID NO: 7901557 - DNA, 22 bp, Homo sapiens
ctgggctcagcaggccaaggcc

SEQ ID NO: 7901558 - DNA, 22 bp, Homo sapiens
ctgggctcagcaggccaaggcc

SEQ ID NO: 7901559 - DNA, 22 bp, Homo sapiens
ctgggctcaagaagtcttccct

SEQ ID NO: 7901560 - DNA, 22 bp, Homo sapiens
ctgggctcagcaggccaaggcc

SEQ ID NO: 7901561 - DNA, 22 bp, Homo sapiens
ctgggctcaagaagtcttccct

SEQ ID NO: 7901562 - DNA, 22 bp, Homo sapiens
ctgggctcaagaagtcttccct

SEQ ID NO: 7901563 - DNA, 22 bp, Homo sapiens
ctgggctcagcccatgctgtcc

SEQ ID NO: 7901564 - DNA, 22 bp, Homo sapiens
ctgggctcagcccatgctgtcc

SEQ ID NO: 7901565 - DNA, 22 bp, Homo sapiens
ctgggctcagcccatgctgtcc

SEQ ID NO: 7901566 - DNA, 22 bp, Homo sapiens
ctgggctcagcccatgctgtcc

SEQ ID NO: 7901567 - DNA, 22 bp, Homo sapiens
ctgggctcagcaggccaaggcc

SEQ ID NO: 7901568 - DNA, 22 bp, Homo sapiens
ctgggctcaagaagtcttccct

SEQ ID NO: 7901569 - DNA, 22 bp, Homo sapiens
ctgggcctcatgcacagagatg

SEQ ID NO: 7901570 - DNA, 22 bp, Homo sapiens
ctgggcctcatgcacagagatg

SEQ ID NO: 7901571 - DNA, 22 bp, Homo sapiens
ctgggcctcatgcacagagatg

SEQ ID NO: 7901572 - DNA, 22 bp, Homo sapiens
ctgggcctcatgcacagagatg

SEQ ID NO: 7901573 - DNA, 22 bp, Homo sapiens
ctgggcctccacgggccatcac

SEQ ID NO: 7901574 - DNA, 22 bp, Homo sapiens
ctgggcctccacgggccatcac

SEQ ID NO: 7901575 - DNA, 22 bp, Homo sapiens
ctgggcctccacgggccatcac

SEQ ID NO: 7901576 - DNA, 22 bp, Homo sapiens
ctgggcctccacgggccatcac

SEQ ID NO: 7901577 - DNA, 22 bp, Homo sapiens
ctgggcctccacgggccatcac

SEQ ID NO: 7901578 - DNA, 22 bp, Homo sapiens
ctgggcctccagctctgccagc

SEQ ID NO: 7901579 - DNA, 22 bp, Homo sapiens
ctgggcctccagctctgccagc

SEQ ID NO: 7901580 - DNA, 22 bp, Homo sapiens
ctgggcctccagctctgccagc

SEQ ID NO: 7901581 - DNA, 22 bp, Homo sapiens
ctgggcctccacgggccatcac

SEQ ID NO: 7901582 - DNA, 22 bp, Homo sapiens
ctgggcctccagctctgccagc

SEQ ID NO: 7901583 - DNA, 22 bp, Homo sapiens
ctgggctcagtgtctcactcct

SEQ ID NO: 7901584 - DNA, 22 bp, Homo sapiens
ctgggctcagtgtctcactcct

SEQ ID NO: 7901585 - DNA, 22 bp, Homo sapiens
ctgggctcagtgtctcactcct

SEQ ID NO: 7901586 - DNA, 22 bp, Homo sapiens
ctgggctcagtgtctcactcct

SEQ ID NO: 7901587 - DNA, 22 bp, Homo sapiens
ctgggctcagtgtctcactcct

SEQ ID NO: 7901588 - DNA, 22 bp, Homo sapiens
ctgggctcagtggctcatggct

SEQ ID NO: 7901589 - DNA, 22 bp, Homo sapiens
ctgggctcagtggctcatggct

SEQ ID NO: 7901590 - DNA, 22 bp, Homo sapiens
ctgggctcagtggctcatggct

SEQ ID NO: 7901591 - DNA, 22 bp, Homo sapiens
ctgggctcagtggctcatggct

SEQ ID NO: 7901592 - DNA, 22 bp, Homo sapiens
ctgggctcagtggctcatggct

SEQ ID NO: 7901593 - DNA, 22 bp, Homo sapiens
ctgggctcagtggctcatggct

SEQ ID NO: 7901594 - DNA, 22 bp, Homo sapiens
ctgggctcagtggctcatggct

SEQ ID NO: 7901595 - DNA, 22 bp, Homo sapiens
ctgggctcagtggctcatggct

SEQ ID NO: 7901596 - DNA, 22 bp, Homo sapiens
ctgggctcagtggctcatggct

SEQ ID NO: 7901597 - DNA, 22 bp, Homo sapiens
ctgggctcagcccatgctgtcc

SEQ ID NO: 7901598 - DNA, 22 bp, Homo sapiens
ctgggctcagtggctcatggct

SEQ ID NO: 7901599 - DNA, 22 bp, Homo sapiens
ctgggctcagtgtctcactcct

SEQ ID NO: 7901600 - DNA, 22 bp, Homo sapiens
ctgggctcagtgtctcactcct

SEQ ID NO: 7901601 - DNA, 21 bp, Homo sapiens
ctgggctcatggtgttacaga

SEQ ID NO: 7901602 - DNA, 21 bp, Homo sapiens
ctgggctcatggtgttacaga

SEQ ID NO: 7901603 - DNA, 22 bp, Homo sapiens
ctgggctccactacttgctaac

SEQ ID NO: 7901604 - DNA, 22 bp, Homo sapiens
ctgggctccactacttgctaac

SEQ ID NO: 7901605 - DNA, 22 bp, Homo sapiens
ctgggctccactacttgctaac

SEQ ID NO: 7901606 - DNA, 22 bp, Homo sapiens
ctgggctccactacttgctaac

SEQ ID NO: 7901607 - DNA, 22 bp, Homo sapiens
ctgggctccactacttgctaac

SEQ ID NO: 7901608 - DNA, 22 bp, Homo sapiens
ctgggctccactcccacagtgt

SEQ ID NO: 7901609 - DNA, 22 bp, Homo sapiens
ctgggctccactcccacagtgt

SEQ ID NO: 7901610 - DNA, 22 bp, Homo sapiens
ctgggctccactcccacagtgt

SEQ ID NO: 7901611 - DNA, 22 bp, Homo sapiens
ctgggctccctcatgtgtctgc

SEQ ID NO: 7901612 - DNA, 22 bp, Homo sapiens
ctgggctccactcccacagtgt

SEQ ID NO: 7901613 - DNA, 22 bp, Homo sapiens
ctgggctccactcccacagtgt

SEQ ID NO: 7901614 - DNA, 22 bp, Homo sapiens
ctgggctccactcccacagtgt

SEQ ID NO: 7901615 - DNA, 22 bp, Homo sapiens
ctgggctccactcccacagtgt

SEQ ID NO: 7901616 - DNA, 22 bp, Homo sapiens
ctgggctccactcccacagtgt

SEQ ID NO: 7901617 - DNA, 22 bp, Homo sapiens
ctgggctccactacttgctaac

SEQ ID NO: 7901618 - DNA, 22 bp, Homo sapiens
ctgggcctcaccctagaccaat

SEQ ID NO: 7901619 - DNA, 22 bp, Homo sapiens
ctgggcctcaccctagaccaat

SEQ ID NO: 7901620 - DNA, 22 bp, Homo sapiens
ctgggcctcaccctagaccaat

SEQ ID NO: 7901621 - DNA, 22 bp, Homo sapiens
ctgggcctcaccctagaccaat

SEQ ID NO: 7901622 - DNA, 22 bp, Homo sapiens
ctgggcctcacacccaccaaat

SEQ ID NO: 7901623 - DNA, 22 bp, Homo sapiens
ctgggcctcacacccaccaaat

SEQ ID NO: 7901624 - DNA, 22 bp, Homo sapiens
ctgggcctcaatctcagagttt

SEQ ID NO: 7901625 - DNA, 22 bp, Homo sapiens
ctgggcctcacacccaccaaat

SEQ ID NO: 7901626 - DNA, 22 bp, Homo sapiens
ctgggcctcacacccaccaaat

SEQ ID NO: 7901627 - DNA, 22 bp, Homo sapiens
ctgggcctcaatctcagagttt

SEQ ID NO: 7901628 - DNA, 22 bp, Homo sapiens
ctgggcctcaatctcagagttt

SEQ ID NO: 7901629 - DNA, 22 bp, Homo sapiens
ctgggcctcaatctcagagttt

SEQ ID NO: 7901630 - DNA, 23 bp, Homo sapiens
ctgggcctatggtctgaatccaa

SEQ ID NO: 7901631 - DNA, 23 bp, Homo sapiens
ctgggcctatggtctgaatccaa

SEQ ID NO: 7901632 - DNA, 22 bp, Homo sapiens
ctgggcctcaagctcagatttc

SEQ ID NO: 7901633 - DNA, 22 bp, Homo sapiens
ctgggcctcaagctcagatttc

SEQ ID NO: 7901634 - DNA, 22 bp, Homo sapiens
ctgggcctcatcctcagagttt

SEQ ID NO: 7901635 - DNA, 22 bp, Homo sapiens
ctgggcctcatcctcagagttt

SEQ ID NO: 7901636 - DNA, 22 bp, Homo sapiens
ctgggcctcatcctcagagttt

SEQ ID NO: 7901637 - DNA, 22 bp, Homo sapiens
ctgggcctcatccccagagttt

SEQ ID NO: 7901638 - DNA, 22 bp, Homo sapiens
ctgggcctcatccccagagttt

SEQ ID NO: 7901639 - DNA, 22 bp, Homo sapiens
ctgggcctcatcctcagagttt

SEQ ID NO: 7901640 - DNA, 22 bp, Homo sapiens
ctgggcctcatccagccacaac

SEQ ID NO: 7901641 - DNA, 22 bp, Homo sapiens
ctgggcctcatccagccacaac

SEQ ID NO: 7901642 - DNA, 22 bp, Homo sapiens
ctgggcctcatccagccacaac

SEQ ID NO: 7901643 - DNA, 22 bp, Homo sapiens
ctgggcctcatccccagagttt

SEQ ID NO: 7901644 - DNA, 22 bp, Homo sapiens
ctgggcctcatccccagagttt

SEQ ID NO: 7901645 - DNA, 22 bp, Homo sapiens
ctgggcctcatccccagagttt

SEQ ID NO: 7901646 - DNA, 22 bp, Homo sapiens
ctgggcctcatccccagagttt

SEQ ID NO: 7901647 - DNA, 22 bp, Homo sapiens
ctgggcctcatccccagagttt

SEQ ID NO: 7901648 - DNA, 22 bp, Homo sapiens
ctgggcctcatccccagagttt

SEQ ID NO: 7901649 - DNA, 22 bp, Homo sapiens
ctgggcctaacccacagcgttt

SEQ ID NO: 7901650 - DNA, 22 bp, Homo sapiens
ctgggcctagaggaagctgaca

SEQ ID NO: 7901651 - DNA, 22 bp, Homo sapiens
ctgggcctaacccacagcgttt

SEQ ID NO: 7901652 - DNA, 22 bp, Homo sapiens
ctgggcctaacccacagcgttt

SEQ ID NO: 7901653 - DNA, 22 bp, Homo sapiens
ctgggccctgaagacagtcagg

SEQ ID NO: 7901654 - DNA, 22 bp, Homo sapiens
ctgggcccaggcggctctcgga

SEQ ID NO: 7901655 - DNA, 22 bp, Homo sapiens
ctgggccctatggaagaaaggg

SEQ ID NO: 7901656 - DNA, 22 bp, Homo sapiens
ctgggccctatggaagaaaggg

SEQ ID NO: 7901657 - DNA, 22 bp, Homo sapiens
ctgggccctatggaagaaaggg

SEQ ID NO: 7901658 - DNA, 22 bp, Homo sapiens
ctgggccctatggaagaaaggg

SEQ ID NO: 7901659 - DNA, 22 bp, Homo sapiens
ctgggccctgaagacagtcagg

SEQ ID NO: 7901660 - DNA, 22 bp, Homo sapiens
ctgggccctgaagacagtcagg

SEQ ID NO: 7901661 - DNA, 22 bp, Homo sapiens
ctgggccctgaagacagtcagg

SEQ ID NO: 7901662 - DNA, 22 bp, Homo sapiens
ctgggccctgaagacagtcagg

SEQ ID NO: 7901663 - DNA, 22 bp, Homo sapiens
ctgggcctagaggaagctgaca

SEQ ID NO: 7901664 - DNA, 22 bp, Homo sapiens
ctgggcctagcaacagaggagt

SEQ ID NO: 7901665 - DNA, 22 bp, Homo sapiens
ctgggcctagcaacagaggagt

SEQ ID NO: 7901666 - DNA, 22 bp, Homo sapiens
ctgggcctagcaacagaggagt

SEQ ID NO: 7901667 - DNA, 22 bp, Homo sapiens
ctgggcctagcaacagaggagt

SEQ ID NO: 7901668 - DNA, 22 bp, Homo sapiens
ctgggcctaggatggaagggcc

SEQ ID NO: 7901669 - DNA, 23 bp, Homo sapiens
ctgggcctatggtctgaatccaa

SEQ ID NO: 7901670 - DNA, 22 bp, Homo sapiens
ctgggcctagcaacagaggagt

SEQ ID NO: 7901671 - DNA, 22 bp, Homo sapiens
ctgggcctaggatggaagggcc

SEQ ID NO: 7901672 - DNA, 22 bp, Homo sapiens
ctgggcctagcaacagaggagt

SEQ ID NO: 7901673 - DNA, 22 bp, Homo sapiens
ctgggagtcaccaggagcaagg

SEQ ID NO: 7901674 - DNA, 22 bp, Homo sapiens
ctgggagtactgggggatgtca

SEQ ID NO: 7901675 - DNA, 22 bp, Homo sapiens
ctgggagtactgggggatgtca

SEQ ID NO: 7901676 - DNA, 22 bp, Homo sapiens
ctgggaggcggaggttgcagtg

SEQ ID NO: 7901677 - DNA, 22 bp, Homo sapiens
ctgggaggcggaggttgcagtg

SEQ ID NO: 7901678 - DNA, 22 bp, Homo sapiens
ctgggagtccctggaatagctc

SEQ ID NO: 7901679 - DNA, 22 bp, Homo sapiens
ctgggagtcaccaggagcaagg

SEQ ID NO: 7901680 - DNA, 22 bp, Homo sapiens
ctgggagtcaccaggagcaagg

SEQ ID NO: 7901681 - DNA, 22 bp, Homo sapiens
ctgggagtctggaattttggta

SEQ ID NO: 7901682 - DNA, 22 bp, Homo sapiens
ctgggagtctaagctagcaccg

SEQ ID NO: 7901683 - DNA, 22 bp, Homo sapiens
ctgggagtctggcctctggtcc

SEQ ID NO: 7901684 - DNA, 22 bp, Homo sapiens
ctgggagtctggcctctggtcc

SEQ ID NO: 7901685 - DNA, 22 bp, Homo sapiens
ctgggagtctaagctagcaccg

SEQ ID NO: 7901686 - DNA, 22 bp, Homo sapiens
ctgggagtctaagctagcaccg

SEQ ID NO: 7901687 - DNA, 22 bp, Homo sapiens
ctgggagtccctggaatagctc

SEQ ID NO: 7901688 - DNA, 22 bp, Homo sapiens
ctgggagtggtgacagctctcg

SEQ ID NO: 7901689 - DNA, 22 bp, Homo sapiens
ctgggagtgaaaggagggctgc

SEQ ID NO: 7901690 - DNA, 22 bp, Homo sapiens
ctgggagtgaaaggagggctgc

SEQ ID NO: 7901691 - DNA, 22 bp, Homo sapiens
ctggagccttcaccaggggaaa

SEQ ID NO: 7901692 - DNA, 22 bp, Homo sapiens
ctggagccttcaccaggggaaa

SEQ ID NO: 7901693 - DNA, 22 bp, Homo sapiens
ctggagccttcaccaggggaaa

SEQ ID NO: 7901694 - DNA, 22 bp, Homo sapiens
ctggagccttcaccaggggaaa

SEQ ID NO: 7901695 - DNA, 22 bp, Homo sapiens
ctggagccttcaccaggggaaa

SEQ ID NO: 7901696 - DNA, 22 bp, Homo sapiens
ctggagccttcaccaggggaaa

SEQ ID NO: 7901697 - DNA, 22 bp, Homo sapiens
ctggagccttcaccaggggaaa

SEQ ID NO: 7901698 - DNA, 22 bp, Homo sapiens
ctggagctcagcccaggttcca

SEQ ID NO: 7901699 - DNA, 22 bp, Homo sapiens
ctggagctcagcccaggttcca

SEQ ID NO: 7901700 - DNA, 22 bp, Homo sapiens
ctggagctcagcccaggttcca

SEQ ID NO: 7901701 - DNA, 22 bp, Homo sapiens
ctggagctaataatccatctga

SEQ ID NO: 7901702 - DNA, 22 bp, Homo sapiens
ctggagctaataatccatctga

SEQ ID NO: 7901703 - DNA, 22 bp, Homo sapiens
ctggagctaggaagtccaagat

SEQ ID NO: 7901704 - DNA, 22 bp, Homo sapiens
ctggagctaggaagtccaagat

SEQ ID NO: 7901705 - DNA, 22 bp, Homo sapiens
ctggagctaataatccatctga

SEQ ID NO: 7901706 - DNA, 22 bp, Homo sapiens
ctggagctccagggtctcctct

SEQ ID NO: 7901707 - DNA, 22 bp, Homo sapiens
ctggagctccagggtctcctct

SEQ ID NO: 7901708 - DNA, 22 bp, Homo sapiens
ctggagctccagggtctcctct

SEQ ID NO: 7901709 - DNA, 22 bp, Homo sapiens
ctggagctccagggtctcctct

SEQ ID NO: 7901710 - DNA, 22 bp, Homo sapiens
ctggagctcagcccaggttcca

SEQ ID NO: 7901711 - DNA, 22 bp, Homo sapiens
ctggagctccagggtctcctct

SEQ ID NO: 7901712 - DNA, 22 bp, Homo sapiens
ctggagctccagggtctcctct

SEQ ID NO: 7901713 - DNA, 22 bp, Homo sapiens
ctggagctccagggtctcctct

SEQ ID NO: 7901714 - DNA, 22 bp, Homo sapiens
ctggagctccagggtctcctct

SEQ ID NO: 7901715 - DNA, 22 bp, Homo sapiens
ctgggaggcggaggttgcagtg

SEQ ID NO: 7901716 - DNA, 22 bp, Homo sapiens
ctgggaggcggaggttgcagtg

SEQ ID NO: 7901717 - DNA, 22 bp, Homo sapiens
ctgggaggcggaggttgcagtg

SEQ ID NO: 7901718 - DNA, 22 bp, Homo sapiens
ctggagctctccagagccccgt

SEQ ID NO: 7901719 - DNA, 22 bp, Homo sapiens
ctgggaggcggaggttgcagtg

SEQ ID NO: 7901720 - DNA, 22 bp, Homo sapiens
ctgggaggcggagcttgcagtg

SEQ ID NO: 7901721 - DNA, 22 bp, Homo sapiens
ctgggaggcggagcttgcagtg

SEQ ID NO: 7901722 - DNA, 22 bp, Homo sapiens
ctgggccagatccagcctcaca

SEQ ID NO: 7901723 - DNA, 22 bp, Homo sapiens
ctgggccagcaactgcaatgga

SEQ ID NO: 7901724 - DNA, 22 bp, Homo sapiens
ctgggatgtgaggagcgcctct

SEQ ID NO: 7901725 - DNA, 19 bp, Homo sapiens
ctgggatgtctcctcccag

SEQ ID NO: 7901726 - DNA, 22 bp, Homo sapiens
ctgggatggctccgctgctgct

SEQ ID NO: 7901727 - DNA, 22 bp, Homo sapiens
ctgggatgtctatagaacactt

SEQ ID NO: 7901728 - DNA, 22 bp, Homo sapiens
ctgggatgggaactgagaatca

SEQ ID NO: 7901729 - DNA, 22 bp, Homo sapiens
ctgggatgggaactgagaatca

SEQ ID NO: 7901730 - DNA, 22 bp, Homo sapiens
ctgggatggctttcctgcatta

SEQ ID NO: 7901731 - DNA, 22 bp, Homo sapiens
ctgggcccacgagggctctggg

SEQ ID NO: 7901732 - DNA, 22 bp, Homo sapiens
ctgggcccaggcggctctcgga

SEQ ID NO: 7901733 - DNA, 22 bp, Homo sapiens
ctgggcccaggcggctctcgga

SEQ ID NO: 7901734 - DNA, 22 bp, Homo sapiens
ctgggcccaggcggctctcgga

SEQ ID NO: 7901735 - DNA, 22 bp, Homo sapiens
ctgggcccaggcggctctcgga

SEQ ID NO: 7901736 - DNA, 22 bp, Homo sapiens
ctgggcccacgagggctctggg

SEQ ID NO: 7901737 - DNA, 22 bp, Homo sapiens
ctgggcccacgagggctctggg

SEQ ID NO: 7901738 - DNA, 22 bp, Homo sapiens
ctgggcccacgagggctctggg

SEQ ID NO: 7901739 - DNA, 22 bp, Homo sapiens
ctgggcccacgagggctctggg

SEQ ID NO: 7901740 - DNA, 22 bp, Homo sapiens
ctgggcccacgagggctctggg

SEQ ID NO: 7901741 - DNA, 22 bp, Homo sapiens
ctgggccagcaactgcaatgga

SEQ ID NO: 7901742 - DNA, 22 bp, Homo sapiens
ctgggccagcaactgcaatgga

SEQ ID NO: 7901743 - DNA, 22 bp, Homo sapiens
ctgggccaggaccagggttgaa

SEQ ID NO: 7901744 - DNA, 22 bp, Homo sapiens
ctgggccaggaccagggttgaa

SEQ ID NO: 7901745 - DNA, 22 bp, Homo sapiens
ctgggccaggaccagggttgaa

SEQ ID NO: 7901746 - DNA, 19 bp, Homo sapiens
ctgggagttcactgctgcc

SEQ ID NO: 7901747 - DNA, 22 bp, Homo sapiens
ctgggagttgacgaggcttgta

SEQ ID NO: 7901748 - DNA, 22 bp, Homo sapiens
ctgggagtgttctaggtcacat

SEQ ID NO: 7901749 - DNA, 22 bp, Homo sapiens
ctgggagtgttctaggtcacat

SEQ ID NO: 7901750 - DNA, 22 bp, Homo sapiens
ctgggagtgtccctctggtaat

SEQ ID NO: 7901751 - DNA, 22 bp, Homo sapiens
ctgggagtgttctaggtcacat

SEQ ID NO: 7901752 - DNA, 22 bp, Homo sapiens
ctgggagtgttctaggtcacat

SEQ ID NO: 7901753 - DNA, 22 bp, Homo sapiens
ctgggagtttctagagaaagac

SEQ ID NO: 7901754 - DNA, 22 bp, Homo sapiens
ctgggagtttctagagaaagac

SEQ ID NO: 7901755 - DNA, 22 bp, Homo sapiens
ctgggagtttgttagtaatgca

SEQ ID NO: 7901756 - DNA, 22 bp, Homo sapiens
ctgggatccacgggctcccaag

SEQ ID NO: 7901757 - DNA, 22 bp, Homo sapiens
ctgggatcagcagtagtgatga

SEQ ID NO: 7901758 - DNA, 22 bp, Homo sapiens
ctgggatgatagtgctagtatt

SEQ ID NO: 7901759 - DNA, 22 bp, Homo sapiens
ctgggatgctccggcctggatg

SEQ ID NO: 7901760 - DNA, 22 bp, Homo sapiens
ctgggatgctccggcctggatg

SEQ ID NO: 7901761 - DNA, 22 bp, Homo sapiens
ctgggatgctccggcctggatg

SEQ ID NO: 7901762 - DNA, 22 bp, Homo sapiens
ctgggatgcggaggttgcggtg

SEQ ID NO: 7901763 - DNA, 22 bp, Homo sapiens
gaaatattgtactggagatgtt

SEQ ID NO: 7901764 - DNA, 22 bp, Homo sapiens
gaaatattgtactggagatgtt

SEQ ID NO: 7901765 - DNA, 22 bp, Homo sapiens
gaaatattgtactggagatgtt

SEQ ID NO: 7901766 - DNA, 22 bp, Homo sapiens
gaaatattgtactggagatgtt

SEQ ID NO: 7901767 - DNA, 22 bp, Homo sapiens
gaaatattgtactggagatgtt

SEQ ID NO: 7901768 - DNA, 22 bp, Homo sapiens
gaaatattgtactggagatgtt

SEQ ID NO: 7901769 - DNA, 22 bp, Homo sapiens
gaaatattgtactggagatgtt

SEQ ID NO: 7901770 - DNA, 22 bp, Homo sapiens
gaaatattgtactggagatgtt

SEQ ID NO: 7901771 - DNA, 22 bp, Homo sapiens
gaaatattgtactggagatgtt

SEQ ID NO: 7901772 - DNA, 22 bp, Homo sapiens
gaaatgtagaattgcttaactg

SEQ ID NO: 7901773 - DNA, 22 bp, Homo sapiens
gaaatgtaggcataattatttt

SEQ ID NO: 7901774 - DNA, 22 bp, Homo sapiens
gaaatgtaggcataattatttt

SEQ ID NO: 7901775 - DNA, 22 bp, Homo sapiens
gaaatgtaggcataattatttt

SEQ ID NO: 7901776 - DNA, 22 bp, Homo sapiens
gaaatgtagagtatctgaggat

SEQ ID NO: 7901777 - DNA, 22 bp, Homo sapiens
gaaatgtagaattgcttaactg

SEQ ID NO: 7901778 - DNA, 22 bp, Homo sapiens
gaaatgtagaattgcttaactg

SEQ ID NO: 7901779 - DNA, 22 bp, Homo sapiens
gaaatgtagagtatctgaggat

SEQ ID NO: 7901780 - DNA, 22 bp, Homo sapiens
gaaatattgtactggagatgtt

SEQ ID NO: 7901781 - DNA, 22 bp, Homo sapiens
gaaatattgtactggagatgtt

SEQ ID NO: 7901782 - DNA, 22 bp, Homo sapiens
gaaatattgtactggagatgtt

SEQ ID NO: 7901783 - DNA, 22 bp, Homo sapiens
gaaatattgtactggagatgtt

SEQ ID NO: 7901784 - DNA, 22 bp, Homo sapiens
gaaatattgggactcagagctt

SEQ ID NO: 7901785 - DNA, 22 bp, Homo sapiens
gaaatattgggactcagagctt

SEQ ID NO: 7901786 - DNA, 22 bp, Homo sapiens
gaaatattgggactcagagctt

SEQ ID NO: 7901787 - DNA, 22 bp, Homo sapiens
gaaatattgggactcagagctt

SEQ ID NO: 7901788 - DNA, 22 bp, Homo sapiens
gaaatattgggactcagagctt

SEQ ID NO: 7901789 - DNA, 22 bp, Homo sapiens
gaaatattgggactcagagctt

SEQ ID NO: 7901790 - DNA, 22 bp, Homo sapiens
gaaatattgggactcagagctt

SEQ ID NO: 7901791 - DNA, 22 bp, Homo sapiens
gaaatattgggactcagagctt

SEQ ID NO: 7901792 - DNA, 22 bp, Homo sapiens
gaaatattgggactcagagctt

SEQ ID NO: 7901793 - DNA, 22 bp, Homo sapiens
gaaatattgggactcagagctt

SEQ ID NO: 7901794 - DNA, 22 bp, Homo sapiens
gaaatgtaggcataattatttt

SEQ ID NO: 7901795 - DNA, 22 bp, Homo sapiens
gaaatgtataagctggtctttt

SEQ ID NO: 7901796 - DNA, 20 bp, Homo sapiens
gaaatgtatctcttgattct

SEQ ID NO: 7901797 - DNA, 20 bp, Homo sapiens
gaaatgtatctcttgattct

SEQ ID NO: 7901798 - DNA, 22 bp, Homo sapiens
gaaatgtataagctggtctttt

SEQ ID NO: 7901799 - DNA, 22 bp, Homo sapiens
gaaatgtataagctggtctttt

SEQ ID NO: 7901800 - DNA, 20 bp, Homo sapiens
gaaatgtatctcttgattct

SEQ ID NO: 7901801 - DNA, 20 bp, Homo sapiens
gaaatgtatctcttgattct

SEQ ID NO: 7901802 - DNA, 22 bp, Homo sapiens
gaaatgtaggcataattatttt

SEQ ID NO: 7901803 - DNA, 22 bp, Homo sapiens
gaaatgtatgtcttcccccatt

SEQ ID NO: 7901804 - DNA, 22 bp, Homo sapiens
gaaatgtatgtcttcccccatt

SEQ ID NO: 7901805 - DNA, 22 bp, Homo sapiens
gaaatgtatttgacagtccttg

SEQ ID NO: 7901806 - DNA, 22 bp, Homo sapiens
gaaatgtatttgacagtccttg

SEQ ID NO: 7901807 - DNA, 22 bp, Homo sapiens
gaaatgtcaagatatgtttgga

SEQ ID NO: 7901808 - DNA, 22 bp, Homo sapiens
gaaatgtcatagtcttcaagcc

SEQ ID NO: 7901809 - DNA, 22 bp, Homo sapiens
gaaatgtcatagtcttcaagcc

SEQ ID NO: 7901810 - DNA, 22 bp, Homo sapiens
gaaatgtgtgacaagtttcaat

SEQ ID NO: 7901811 - DNA, 22 bp, Homo sapiens
gaaatgtgcagaatgtgttaga

SEQ ID NO: 7901812 - DNA, 18 bp, Homo sapiens
gaaatgtgattctagggc

SEQ ID NO: 7901813 - DNA, 22 bp, Homo sapiens
gaaatgtctttgacaagagagg

SEQ ID NO: 7901814 - DNA, 22 bp, Homo sapiens
gaaatgtctgccaggcacatag

SEQ ID NO: 7901815 - DNA, 22 bp, Homo sapiens
gaaatgtctttgacaagagagg

SEQ ID NO: 7901816 - DNA, 22 bp, Homo sapiens
gaaatgtctttgacaagagagg

SEQ ID NO: 7901817 - DNA, 22 bp, Homo sapiens
gaaatgtctcttgatttttgga

SEQ ID NO: 7901818 - DNA, 22 bp, Homo sapiens
gaaatgtctgccaggcacatag

SEQ ID NO: 7901819 - DNA, 22 bp, Homo sapiens
gaaatgtctctggatttgcttt

SEQ ID NO: 7901820 - DNA, 20 bp, Homo sapiens
gaaatgtctatgataatgat

SEQ ID NO: 7901821 - DNA, 22 bp, Homo sapiens
gaaatgtcctcatgaaggaagt

SEQ ID NO: 7901822 - DNA, 22 bp, Homo sapiens
gaaatgtcctcatgaaggaagt

SEQ ID NO: 7901823 - DNA, 22 bp, Homo sapiens
gaaatgtcattgccttcagccc

SEQ ID NO: 7901824 - DNA, 22 bp, Homo sapiens
gaaagagaacctgggcctagat

SEQ ID NO: 7901825 - DNA, 22 bp, Homo sapiens
gaaagactaactagaaagtgca

SEQ ID NO: 7901826 - DNA, 22 bp, Homo sapiens
gaaagactaactagaaagtgca

SEQ ID NO: 7901827 - DNA, 22 bp, Homo sapiens
gaaagacatagttgcaagatgg

SEQ ID NO: 7901828 - DNA, 22 bp, Homo sapiens
gaaagacatagttgcaagatgg

SEQ ID NO: 7901829 - DNA, 22 bp, Homo sapiens
gaaagacatagttgcaagatgg

SEQ ID NO: 7901830 - DNA, 22 bp, Homo sapiens
gaaagacatagttgcaagatgg

SEQ ID NO: 7901831 - DNA, 22 bp, Homo sapiens
gaaagacatagttgcaagatgg

SEQ ID NO: 7901832 - DNA, 22 bp, Homo sapiens
gaaagagaacctgggcctagat

SEQ ID NO: 7901833 - DNA, 22 bp, Homo sapiens
gaaagagaacctgggcctagat

SEQ ID NO: 7901834 - DNA, 22 bp, Homo sapiens
gaaagagaacctgggcctagat

SEQ ID NO: 7901835 - DNA, 22 bp, Homo sapiens
gaaagagaacctgggcctagat

SEQ ID NO: 7901836 - DNA, 22 bp, Homo sapiens
gaaatacagaaagggctgaatg

SEQ ID NO: 7901837 - DNA, 22 bp, Homo sapiens
gaaatacagaaagggctgaatg

SEQ ID NO: 7901838 - DNA, 22 bp, Homo sapiens
gaaatacagaaagggctgaatg

SEQ ID NO: 7901839 - DNA, 22 bp, Homo sapiens
gaaatatacattgcaggaagag

SEQ ID NO: 7901840 - DNA, 22 bp, Homo sapiens
gaaatatacattgcaggaagag

SEQ ID NO: 7901841 - DNA, 22 bp, Homo sapiens
gaaatatacattgcaggaagag

SEQ ID NO: 7901842 - DNA, 22 bp, Homo sapiens
gaaatacaggaatgccacacag

SEQ ID NO: 7901843 - DNA, 22 bp, Homo sapiens
gaaatacaggaatgccacacag

SEQ ID NO: 7901844 - DNA, 22 bp, Homo sapiens
gaaatatacattgcaggaagag

SEQ ID NO: 7901845 - DNA, 22 bp, Homo sapiens
gaaatatacattgcaggaagag

SEQ ID NO: 7901846 - DNA, 22 bp, Homo sapiens
gaaatatacattgcaggaagag

SEQ ID NO: 7901847 - DNA, 22 bp, Homo sapiens
gaaatatacattgcaggaagag

SEQ ID NO: 7901848 - DNA, 22 bp, Homo sapiens
gaaatatacattgcaggaagag

SEQ ID NO: 7901849 - DNA, 22 bp, Homo sapiens
gaaatattacagtggaggggat

SEQ ID NO: 7901850 - DNA, 22 bp, Homo sapiens
gaaatattacagtggaggggat

SEQ ID NO: 7901851 - DNA, 22 bp, Homo sapiens
gaaatattacagtggaggggat

SEQ ID NO: 7901852 - DNA, 22 bp, Homo sapiens
gaaatattacagtggaggggat

SEQ ID NO: 7901853 - DNA, 22 bp, Homo sapiens
gaaatattacagtggaggggat

SEQ ID NO: 7901854 - DNA, 22 bp, Homo sapiens
gaaatattacagtggaggggat

SEQ ID NO: 7901855 - DNA, 22 bp, Homo sapiens
gaaatattacagtggaggggat

SEQ ID NO: 7901856 - DNA, 22 bp, Homo sapiens
gaaatattacagtggaggggat

SEQ ID NO: 7901857 - DNA, 22 bp, Homo sapiens
gaaatattcttgtcttgttttc

SEQ ID NO: 7901858 - DNA, 22 bp, Homo sapiens
gaaatattcttgtcttgttttc

SEQ ID NO: 7901859 - DNA, 22 bp, Homo sapiens
gaaatattcttgtcttgttttc

SEQ ID NO: 7901860 - DNA, 22 bp, Homo sapiens
gaaatattcttgtcttgttttc

SEQ ID NO: 7901861 - DNA, 22 bp, Homo sapiens
gaaatattcttgtcttgttttc

SEQ ID NO: 7901862 - DNA, 22 bp, Homo sapiens
gaaatattcttgtcttgttttc

SEQ ID NO: 7901863 - DNA, 22 bp, Homo sapiens
gaaatattacagtggaggggat

SEQ ID NO: 7901864 - DNA, 22 bp, Homo sapiens
gaaatattacagtggaggggat

SEQ ID NO: 7901865 - DNA, 22 bp, Homo sapiens
gaaatattcttgtcttgttttc

SEQ ID NO: 7901866 - DNA, 22 bp, Homo sapiens
gaaatattcttgtcttgttttc

SEQ ID NO: 7901867 - DNA, 22 bp, Homo sapiens
gaaatattcttgtcttgttttc

SEQ ID NO: 7901868 - DNA, 22 bp, Homo sapiens
gaaatattcttgtcttgttttc

SEQ ID NO: 7901869 - DNA, 22 bp, Homo sapiens
gaaatattcttgtcttgttttc

SEQ ID NO: 7901870 - DNA, 22 bp, Homo sapiens
gaaatattcttgtcttgttttc

SEQ ID NO: 7901871 - DNA, 22 bp, Homo sapiens
gaaatattgggactcagagctt

SEQ ID NO: 7901872 - DNA, 22 bp, Homo sapiens
gaagaagacatggaacaatagt

SEQ ID NO: 7901873 - DNA, 22 bp, Homo sapiens
gaagaagacatggaacaatagt

SEQ ID NO: 7901874 - DNA, 22 bp, Homo sapiens
gaagaagacatggaacaatagt

SEQ ID NO: 7901875 - DNA, 22 bp, Homo sapiens
gaagaagagataatggggagca

SEQ ID NO: 7901876 - DNA, 22 bp, Homo sapiens
gaagaagcaggagtgtgtagca

SEQ ID NO: 7901877 - DNA, 22 bp, Homo sapiens
gaagaagagataatggggagca

SEQ ID NO: 7901878 - DNA, 22 bp, Homo sapiens
gaagaactgtgacagaagcagt

SEQ ID NO: 7901879 - DNA, 22 bp, Homo sapiens
gaagaactttagggcagaattt

SEQ ID NO: 7901880 - DNA, 19 bp, Homo sapiens
gaagaagcttgagaagtag

SEQ ID NO: 7901881 - DNA, 19 bp, Homo sapiens
gaagaagcttgagaagtag

SEQ ID NO: 7901882 - DNA, 19 bp, Homo sapiens
gaagaagcttgagaagtag

SEQ ID NO: 7901883 - DNA, 19 bp, Homo sapiens
gaagaagcttgagaagtag

SEQ ID NO: 7901884 - DNA, 22 bp, Homo sapiens
gaagaagcaggagtgtgtagca

SEQ ID NO: 7901885 - DNA, 22 bp, Homo sapiens
gaagaagcaggagtgtgtagca

SEQ ID NO: 7901886 - DNA, 22 bp, Homo sapiens
gaagaaggaagatcatgcttga

SEQ ID NO: 7901887 - DNA, 17 bp, Homo sapiens
gaagaaggaatctagaa

SEQ ID NO: 7901888 - DNA, 22 bp, Homo sapiens
gaagaaattgaattcatgagct

SEQ ID NO: 7901889 - DNA, 22 bp, Homo sapiens
gaagaaattgaattcatgagct

SEQ ID NO: 7901890 - DNA, 22 bp, Homo sapiens
gaagaaattgaattcatgagct

SEQ ID NO: 7901891 - DNA, 22 bp, Homo sapiens
gaagaaattgaattcatgagct

SEQ ID NO: 7901892 - DNA, 22 bp, Homo sapiens
gaagaacaagcagtgctttcct

SEQ ID NO: 7901893 - DNA, 22 bp, Homo sapiens
gaagaacaagcagtgctttcct

SEQ ID NO: 7901894 - DNA, 22 bp, Homo sapiens
gaagaacacttcatgattcatt

SEQ ID NO: 7901895 - DNA, 22 bp, Homo sapiens
gaagaacacttcatgattcatt

SEQ ID NO: 7901896 - DNA, 22 bp, Homo sapiens
gaagaacacttcatgattcatt

SEQ ID NO: 7901897 - DNA, 22 bp, Homo sapiens
gaagaacacttcatgattcatt

SEQ ID NO: 7901898 - DNA, 22 bp, Homo sapiens
gaagaactgacaaactagatca

SEQ ID NO: 7901899 - DNA, 22 bp, Homo sapiens
gaagaactaactgaccatgaat

SEQ ID NO: 7901900 - DNA, 22 bp, Homo sapiens
gaagaactaactgaccatgaat

SEQ ID NO: 7901901 - DNA, 22 bp, Homo sapiens
gaagaactgaaagttgatgcac

SEQ ID NO: 7901902 - DNA, 22 bp, Homo sapiens
gaacttgttgtaagaaaatatg

SEQ ID NO: 7901903 - DNA, 22 bp, Homo sapiens
gaactttaaaacaaagtacagt

SEQ ID NO: 7901904 - DNA, 22 bp, Homo sapiens
gaactttaaaacaaagtacagt

SEQ ID NO: 7901905 - DNA, 20 bp, Homo sapiens
gaacttgggcaagtggctta

SEQ ID NO: 7901906 - DNA, 22 bp, Homo sapiens
gaacttggcctgtctgtctggc

SEQ ID NO: 7901907 - DNA, 22 bp, Homo sapiens
gaacttgggagaagggagtgtg

SEQ ID NO: 7901908 - DNA, 22 bp, Homo sapiens
gaacttggtattccttttaaca

SEQ ID NO: 7901909 - DNA, 22 bp, Homo sapiens
gaacttgtgcactgctggtgat

SEQ ID NO: 7901910 - DNA, 22 bp, Homo sapiens
gaacttggaactggggctactg

SEQ ID NO: 7901911 - DNA, 22 bp, Homo sapiens
gaacttggacctggtcctttgg

SEQ ID NO: 7901912 - DNA, 19 bp, Homo sapiens
gaacttggccaggcacagt

SEQ ID NO: 7901913 - DNA, 23 bp, Homo sapiens
gaaatgtttcttgattaatccta

SEQ ID NO: 7901914 - DNA, 23 bp, Homo sapiens
gaaatgtttcttgattaatccta

SEQ ID NO: 7901915 - DNA, 22 bp, Homo sapiens
gaaatgtttgggaggagtcaac

SEQ ID NO: 7901916 - DNA, 22 bp, Homo sapiens
gaaatgttttacaaggcatact

SEQ ID NO: 7901917 - DNA, 22 bp, Homo sapiens
gaaattaagcaggggtctgtgg

SEQ ID NO: 7901918 - DNA, 22 bp, Homo sapiens
gaaattaagcaggggtctgtgg

SEQ ID NO: 7901919 - DNA, 22 bp, Homo sapiens
gaaattaaccacctttggcttt

SEQ ID NO: 7901920 - DNA, 22 bp, Homo sapiens
gaaattaaccacctttggcttt

SEQ ID NO: 7901921 - DNA, 22 bp, Homo sapiens
gaaatgtttgggaggagtcaac

SEQ ID NO: 7901922 - DNA, 22 bp, Homo sapiens
gaaattaaccacctttggcttt

SEQ ID NO: 7901923 - DNA, 22 bp, Homo sapiens
gaaatgtgttgttcatttctaa

SEQ ID NO: 7901924 - DNA, 22 bp, Homo sapiens
gaaatgtgttgttcatttctaa

SEQ ID NO: 7901925 - DNA, 22 bp, Homo sapiens
gaaatgttcctgatccctgatt

SEQ ID NO: 7901926 - DNA, 22 bp, Homo sapiens
gaaatgttcctgatccctgatt

SEQ ID NO: 7901927 - DNA, 22 bp, Homo sapiens
gaaatgttatgagatatgtact

SEQ ID NO: 7901928 - DNA, 22 bp, Homo sapiens
gaaatgttatgagatatgtact

SEQ ID NO: 7901929 - DNA, 22 bp, Homo sapiens
gaaatgttgtcctgtctcttga

SEQ ID NO: 7901930 - DNA, 18 bp, Homo sapiens
gaaatgtgattctagggc

SEQ ID NO: 7901931 - DNA, 22 bp, Homo sapiens
gaaatgttggacacttgaaatt

SEQ ID NO: 7901932 - DNA, 22 bp, Homo sapiens
gaaatgttgtctctgcagcaat

SEQ ID NO: 7901933 - DNA, 22 bp, Homo sapiens
gaaatgttggacacttgaaatt

SEQ ID NO: 7901934 - DNA, 22 bp, Homo sapiens
gaaattcactgtatttcttggg

SEQ ID NO: 7901935 - DNA, 22 bp, Homo sapiens
gaaattcaggacaaagactctt

SEQ ID NO: 7901936 - DNA, 22 bp, Homo sapiens
gaaattcaggacaaagactctt

SEQ ID NO: 7901937 - DNA, 22 bp, Homo sapiens
gaaattgtcagcttctttcagt

SEQ ID NO: 7901938 - DNA, 22 bp, Homo sapiens
gaaattgtcagcttctttcagt

SEQ ID NO: 7901939 - DNA, 22 bp, Homo sapiens
gaaattgaaaccgatctgtgtt

SEQ ID NO: 7901940 - DNA, 22 bp, Homo sapiens
gaaattgaaagaccaactgcat

SEQ ID NO: 7901941 - DNA, 22 bp, Homo sapiens
gaaattcaaaatgtcagtatag

SEQ ID NO: 7901942 - DNA, 22 bp, Homo sapiens
gaaattcaaaatgtcagtatag

SEQ ID NO: 7901943 - DNA, 22 bp, Homo sapiens
gaaattcaaaatgtcagtatag

SEQ ID NO: 7901944 - DNA, 22 bp, Homo sapiens
gaaattaagcaggggtctgtgg

SEQ ID NO: 7901945 - DNA, 22 bp, Homo sapiens
gaaattaagcaggggtctgtgg

SEQ ID NO: 7901946 - DNA, 22 bp, Homo sapiens
gaaattaagcaggggtctgtgg

SEQ ID NO: 7901947 - DNA, 22 bp, Homo sapiens
gaaattcactgtatttcttggg

SEQ ID NO: 7901948 - DNA, 22 bp, Homo sapiens
gaaattcaaataagatatgtag

SEQ ID NO: 7901949 - DNA, 22 bp, Homo sapiens
gaaattcaaataagatatgtag

SEQ ID NO: 7901950 - DNA, 22 bp, Homo sapiens
gaaattcaaataagatatgtag

SEQ ID NO: 7901951 - DNA, 22 bp, Homo sapiens
gaaaaatgagctgatgtcaggg

SEQ ID NO: 7901952 - DNA, 22 bp, Homo sapiens
gaaaaatgagctgatgtcaggg

SEQ ID NO: 7901953 - DNA, 22 bp, Homo sapiens
gaaaaatgagctgatgtcaggg

SEQ ID NO: 7901954 - DNA, 22 bp, Homo sapiens
gaaaaatgagctgatgtcaggg

SEQ ID NO: 7901955 - DNA, 22 bp, Homo sapiens
gaaaaatgagctgatgtcaggg

SEQ ID NO: 7901956 - DNA, 22 bp, Homo sapiens
gaaaaatgctccaaatctgtgg

SEQ ID NO: 7901957 - DNA, 22 bp, Homo sapiens
gaaaaatgctccaaatctgtgg

SEQ ID NO: 7901958 - DNA, 22 bp, Homo sapiens
gaaaaatgctccaaatctgtgg

SEQ ID NO: 7901959 - DNA, 22 bp, Homo sapiens
gaaaaatgctccaaatctgtgg

SEQ ID NO: 7901960 - DNA, 22 bp, Homo sapiens
gaaaaatgctccaaatctgtgg

SEQ ID NO: 7901961 - DNA, 22 bp, Homo sapiens
gaaacagctagaaagccattgg

SEQ ID NO: 7901962 - DNA, 22 bp, Homo sapiens
gaaacagcccctgtgtgaagca

SEQ ID NO: 7901963 - DNA, 22 bp, Homo sapiens
gaaacagcccctgtgtgaagca

SEQ ID NO: 7901964 - DNA, 22 bp, Homo sapiens
gaaacagcacgtttggagagat

SEQ ID NO: 7901965 - DNA, 22 bp, Homo sapiens
gaaaaatgctccaaatctgtgg

SEQ ID NO: 7901966 - DNA, 22 bp, Homo sapiens
gaaacagctttaagtgatactg

SEQ ID NO: 7901967 - DNA, 22 bp, Homo sapiens
gaaacagctagaaagccattgg

SEQ ID NO: 7901968 - DNA, 22 bp, Homo sapiens
gaaaccagataagggaggctga

SEQ ID NO: 7901969 - DNA, 22 bp, Homo sapiens
gaaaccagctagaggcagaggg

SEQ ID NO: 7901970 - DNA, 22 bp, Homo sapiens
gaaaccagctagaggcagaggg

SEQ ID NO: 7901971 - DNA, 22 bp, Homo sapiens
gaaaccagctagaggcagaggg

SEQ ID NO: 7901972 - DNA, 22 bp, Homo sapiens
gaaaccagcatttaaaccagga

SEQ ID NO: 7901973 - DNA, 22 bp, Homo sapiens
gaaaccagcatttaaaccagga

SEQ ID NO: 7901974 - DNA, 22 bp, Homo sapiens
ctttttgttgtccacactagga

SEQ ID NO: 7901975 - DNA, 22 bp, Homo sapiens
ctttttgttgtccacactagga

SEQ ID NO: 7901976 - DNA, 22 bp, Homo sapiens
cttttttaaggtagctcctcct

SEQ ID NO: 7901977 - DNA, 22 bp, Homo sapiens
cttttttaaggtagctcctcct

SEQ ID NO: 7901978 - DNA, 22 bp, Homo sapiens
cttttttaaggtagctcctcct

SEQ ID NO: 7901979 - DNA, 22 bp, Homo sapiens
cttttttaaggtagctcctcct

SEQ ID NO: 7901980 - DNA, 22 bp, Homo sapiens
cttttttcctaaggcaacatga

SEQ ID NO: 7901981 - DNA, 22 bp, Homo sapiens
cttttttaaggtagctcctcct

SEQ ID NO: 7901982 - DNA, 22 bp, Homo sapiens
cttttttcctaaggcaacatga

SEQ ID NO: 7901983 - DNA, 22 bp, Homo sapiens
ctttttgtctctgtcctgatga

SEQ ID NO: 7901984 - DNA, 22 bp, Homo sapiens
ctttttgtctctgtcctgatga

SEQ ID NO: 7901985 - DNA, 22 bp, Homo sapiens
ctttttgtgtatgctacagttg

SEQ ID NO: 7901986 - DNA, 22 bp, Homo sapiens
ctttttgtgtatgctacagttg

SEQ ID NO: 7901987 - DNA, 22 bp, Homo sapiens
ctttttgtgtatgctacagttg

SEQ ID NO: 7901988 - DNA, 22 bp, Homo sapiens
ctttttgtgtatgctacagttg

SEQ ID NO: 7901989 - DNA, 22 bp, Homo sapiens
ctttttgttgtataagcccttt

SEQ ID NO: 7901990 - DNA, 22 bp, Homo sapiens
gaaaaagtgaccttggtagcta

SEQ ID NO: 7901991 - DNA, 22 bp, Homo sapiens
gaaaaagtgaccttggtagcta

SEQ ID NO: 7901992 - DNA, 22 bp, Homo sapiens
gaaaaagtgaccttggtagcta

SEQ ID NO: 7901993 - DNA, 22 bp, Homo sapiens
gaaaaaggataaatacagtgtt

SEQ ID NO: 7901994 - DNA, 22 bp, Homo sapiens
gaaaaagtgaccttggtagcta

SEQ ID NO: 7901995 - DNA, 22 bp, Homo sapiens
cttttttcctaaggcaacatga

SEQ ID NO: 7901996 - DNA, 22 bp, Homo sapiens
cttttttcctaaggcaacatga

SEQ ID NO: 7901997 - DNA, 22 bp, Homo sapiens
cttttttcctaaggcaacatga

SEQ ID NO: 7901998 - DNA, 22 bp, Homo sapiens
cttttttcctaaggcaacatga

SEQ ID NO: 7901999 - DNA, 22 bp, Homo sapiens
cttttttcctaaggcaacatga

SEQ ID NO: 7902000 - DNA, 22 bp, Homo sapiens
gaaaaaggataaatacagtgtt

SEQ ID NO: 7902001 - DNA, 22 bp, Homo sapiens
gaaaaaggataaatacagtgtt

SEQ ID NO: 7902002 - DNA, 22 bp, Homo sapiens
gaaaaaggataaatacagtgtt

SEQ ID NO: 7902003 - DNA, 22 bp, Homo sapiens
gaaaaaggataaatacagtgtt

SEQ ID NO: 7902004 - DNA, 22 bp, Homo sapiens
gaaagaagctttagatggctat

SEQ ID NO: 7902005 - DNA, 22 bp, Homo sapiens
gaaagaatcaactatgtctctg

SEQ ID NO: 7902006 - DNA, 22 bp, Homo sapiens
gaaagaagctttagatggctat

SEQ ID NO: 7902007 - DNA, 22 bp, Homo sapiens
gaaagaagctttagatggctat

SEQ ID NO: 7902008 - DNA, 22 bp, Homo sapiens
gaaagaagctttagatggctat

SEQ ID NO: 7902009 - DNA, 22 bp, Homo sapiens
gaaagaatgctatagtgacttc

SEQ ID NO: 7902010 - DNA, 22 bp, Homo sapiens
gaaagaatgagcatcatgactt

SEQ ID NO: 7902011 - DNA, 22 bp, Homo sapiens
gaaagaatgagcatcatgactt

SEQ ID NO: 7902012 - DNA, 22 bp, Homo sapiens
gaaactttcatgaatataagat

SEQ ID NO: 7902013 - DNA, 22 bp, Homo sapiens
gaaactttggctaaaagccaga

SEQ ID NO: 7902014 - DNA, 22 bp, Homo sapiens
gaaactttcatgaatataagat

SEQ ID NO: 7902015 - DNA, 22 bp, Homo sapiens
gaaactttcatgaatataagat

SEQ ID NO: 7902016 - DNA, 22 bp, Homo sapiens
gaaacttgcctgaagtcaacca

SEQ ID NO: 7902017 - DNA, 22 bp, Homo sapiens
gaaactgtttctggctttggtg

SEQ ID NO: 7902018 - DNA, 22 bp, Homo sapiens
gaaactgtgatcgtgttctggg

SEQ ID NO: 7902019 - DNA, 22 bp, Homo sapiens
gaaacttacttactcacatttc

SEQ ID NO: 7902020 - DNA, 22 bp, Homo sapiens
gaaactgagtaggctagagcac

SEQ ID NO: 7902021 - DNA, 22 bp, Homo sapiens
gaaactgatattaactcagtgt

SEQ ID NO: 7902022 - DNA, 22 bp, Homo sapiens
gaaactggatgcagggatgcag

SEQ ID NO: 7902023 - DNA, 22 bp, Homo sapiens
gaaactgtgaggatcttaactt

SEQ ID NO: 7902024 - DNA, 22 bp, Homo sapiens
gaaactgtatgtagtttttggg

SEQ ID NO: 7902025 - DNA, 22 bp, Homo sapiens
gaaactctcgcatcctgggaac

SEQ ID NO: 7902026 - DNA, 22 bp, Homo sapiens
gaaactctcgcatcctgggaac

SEQ ID NO: 7902027 - DNA, 22 bp, Homo sapiens
gaaactctcgcatcctgggaac

SEQ ID NO: 7902028 - DNA, 22 bp, Homo sapiens
gaaactctcgcatcctgggaac

SEQ ID NO: 7902029 - DNA, 22 bp, Homo sapiens
gaaactctcgcatcctgggaac

SEQ ID NO: 7902030 - DNA, 22 bp, Homo sapiens
gaaactctcgcatcctgggaac

SEQ ID NO: 7902031 - DNA, 22 bp, Homo sapiens
gaaactctcgcatcctgggaac

SEQ ID NO: 7902032 - DNA, 22 bp, Homo sapiens
gaaactagatgtattagagatt

SEQ ID NO: 7902033 - DNA, 22 bp, Homo sapiens
gaaactagatgtattagagatt

SEQ ID NO: 7902034 - DNA, 22 bp, Homo sapiens
gaaacgttaaaccatatgtaat

SEQ ID NO: 7902035 - DNA, 18 bp, Homo sapiens
gaaacctgaggaagaaag

SEQ ID NO: 7902036 - DNA, 22 bp, Homo sapiens
gaaacctgagccagagtgggga

SEQ ID NO: 7902037 - DNA, 22 bp, Homo sapiens
gaaacctgggatatataagttt

SEQ ID NO: 7902038 - DNA, 22 bp, Homo sapiens
gaaacctgagtgcagatcagga

SEQ ID NO: 7902039 - DNA, 22 bp, Homo sapiens
gaaacctgagtgcagatcagga

SEQ ID NO: 7902040 - DNA, 22 bp, Homo sapiens
gaaacctgtcccctcttcctca

SEQ ID NO: 7902041 - DNA, 22 bp, Homo sapiens
gaaacctggttctgcgtgaggg

SEQ ID NO: 7902042 - DNA, 22 bp, Homo sapiens
gaaacctgtgctgatttgttag

SEQ ID NO: 7902043 - DNA, 22 bp, Homo sapiens
gaaacccttcctagagggcaag

SEQ ID NO: 7902044 - DNA, 22 bp, Homo sapiens
gaaacccaaactaagacagtag

SEQ ID NO: 7902045 - DNA, 22 bp, Homo sapiens
gaaaccatgcaagctgctagag

SEQ ID NO: 7902046 - DNA, 21 bp, Homo sapiens
gaaaccaggttatcaatcaca

SEQ ID NO: 7902047 - DNA, 22 bp, Homo sapiens
gaaaccagtttgtaccaagatc

SEQ ID NO: 7902048 - DNA, 22 bp, Homo sapiens
cttttgttctacagctggggaa

SEQ ID NO: 7902049 - DNA, 22 bp, Homo sapiens
cttttgttctacagctggggaa

SEQ ID NO: 7902050 - DNA, 22 bp, Homo sapiens
cttttgttctacagctggggaa

SEQ ID NO: 7902051 - DNA, 22 bp, Homo sapiens
ctttttcccaggtggagagagg

SEQ ID NO: 7902052 - DNA, 22 bp, Homo sapiens
cttttgttaggagaaaacatca

SEQ ID NO: 7902053 - DNA, 22 bp, Homo sapiens
cttttgttaggagaaaacatca

SEQ ID NO: 7902054 - DNA, 22 bp, Homo sapiens
cttttgttaggagaaaacatca

SEQ ID NO: 7902055 - DNA, 22 bp, Homo sapiens
cttttgttaggagaaaacatca

SEQ ID NO: 7902056 - DNA, 22 bp, Homo sapiens
ctttggcagacattaggggtga

SEQ ID NO: 7902057 - DNA, 22 bp, Homo sapiens
cttttgtggcaatggttaagag

SEQ ID NO: 7902058 - DNA, 22 bp, Homo sapiens
cttttgtgattcctcagttact

SEQ ID NO: 7902059 - DNA, 22 bp, Homo sapiens
cttttgtgattcctcagttact

SEQ ID NO: 7902060 - DNA, 22 bp, Homo sapiens
cttttggcctcaaaggaaagaa

SEQ ID NO: 7902061 - DNA, 23 bp, Homo sapiens
ctttggcactttacaataaactc

SEQ ID NO: 7902062 - DNA, 22 bp, Homo sapiens
ctttggcactgcgcagccattt

SEQ ID NO: 7902063 - DNA, 22 bp, Homo sapiens
ctttggcactgcgcagccattt

SEQ ID NO: 7902064 - DNA, 22 bp, Homo sapiens
ctttggcacagtctcatttgat

SEQ ID NO: 7902065 - DNA, 22 bp, Homo sapiens
ctttggcacagtctcatttgat

SEQ ID NO: 7902066 - DNA, 22 bp, Homo sapiens
ctttggcacagtgtttactagc

SEQ ID NO: 7902067 - DNA, 22 bp, Homo sapiens
ctttggcacagtctcatttgat

SEQ ID NO: 7902068 - DNA, 22 bp, Homo sapiens
ctttggcaatgtcattttcaat

SEQ ID NO: 7902069 - DNA, 22 bp, Homo sapiens
ctttggcaatgtcattttcaat

SEQ ID NO: 7902070 - DNA, 22 bp, Homo sapiens
ctttggcaatgtcattttcaat

SEQ ID NO: 7902071 - DNA, 20 bp, Homo sapiens
ctttggcaatgagaacaggg

SEQ ID NO: 7902072 - DNA, 20 bp, Homo sapiens
ctttggcaatgagaacaggg

SEQ ID NO: 7902073 - DNA, 20 bp, Homo sapiens
ctttggcaatgagaacaggg

SEQ ID NO: 7902074 - DNA, 22 bp, Homo sapiens
ctttttctgatgttccatgatt

SEQ ID NO: 7902075 - DNA, 22 bp, Homo sapiens
ctttttctgatgttccatgatt

SEQ ID NO: 7902076 - DNA, 22 bp, Homo sapiens
ctttttctgatgttccatgatt

SEQ ID NO: 7902077 - DNA, 16 bp, Homo sapiens
ctttttctcccctctt

SEQ ID NO: 7902078 - DNA, 20 bp, Homo sapiens
ctttttctccagctctgagc

SEQ ID NO: 7902079 - DNA, 22 bp, Homo sapiens
ctttttcttctaggtgtgcctg

SEQ ID NO: 7902080 - DNA, 22 bp, Homo sapiens
ctttttctgatgttccatgatt

SEQ ID NO: 7902081 - DNA, 22 bp, Homo sapiens
ctttttgcaagagtttctcatc

SEQ ID NO: 7902082 - DNA, 22 bp, Homo sapiens
ctttttcttctaggtgtgcctg

SEQ ID NO: 7902083 - DNA, 22 bp, Homo sapiens
ctttttgtctctgtcctgatga

SEQ ID NO: 7902084 - DNA, 20 bp, Homo sapiens
ctttttctccagctctgagc

SEQ ID NO: 7902085 - DNA, 16 bp, Homo sapiens
ctttttctcccctctt

SEQ ID NO: 7902086 - DNA, 20 bp, Homo sapiens
ctttttctccagctctgagc

SEQ ID NO: 7902087 - DNA, 20 bp, Homo sapiens
ctttttctccagctctgagc

SEQ ID NO: 7902088 - DNA, 20 bp, Homo sapiens
ctttttctccagctctgagc

SEQ ID NO: 7902089 - DNA, 22 bp, Homo sapiens
ctttttcctcgtagagcctaat

SEQ ID NO: 7902090 - DNA, 22 bp, Homo sapiens
ctttttcctcgtagagcctaat

SEQ ID NO: 7902091 - DNA, 22 bp, Homo sapiens
ctttttctaatcataattgtct

SEQ ID NO: 7902092 - DNA, 22 bp, Homo sapiens
ctttttcctcgtagagcctaat

SEQ ID NO: 7902093 - DNA, 22 bp, Homo sapiens
ctttttctaatcataattgtct

SEQ ID NO: 7902094 - DNA, 22 bp, Homo sapiens
ctttttctaatcataattgtct

SEQ ID NO: 7902095 - DNA, 22 bp, Homo sapiens
ctttttctaatcataattgtct

SEQ ID NO: 7902096 - DNA, 22 bp, Homo sapiens
ctttttctaatcataattgtct

SEQ ID NO: 7902097 - DNA, 22 bp, Homo sapiens
ctttggagaagaatgcatcctt

SEQ ID NO: 7902098 - DNA, 22 bp, Homo sapiens
ctttggagaagaatgcatcctt

SEQ ID NO: 7902099 - DNA, 20 bp, Homo sapiens
ctttggagaaagatgcaata

SEQ ID NO: 7902100 - DNA, 22 bp, Homo sapiens
ctttggaatgcacagaggtgta

SEQ ID NO: 7902101 - DNA, 22 bp, Homo sapiens
ctttggaatgcacagaggtgta

SEQ ID NO: 7902102 - DNA, 22 bp, Homo sapiens
ctttggaatgcacagaggtgta

SEQ ID NO: 7902103 - DNA, 22 bp, Homo sapiens
ctttggagaaaagttcttgggc

SEQ ID NO: 7902104 - DNA, 22 bp, Homo sapiens
ctttggaggaaaattgaggtca

SEQ ID NO: 7902105 - DNA, 22 bp, Homo sapiens
ctttggaggacctatgtgcaat

SEQ ID NO: 7902106 - DNA, 22 bp, Homo sapiens
ctttggaggacctatgtgcaat

SEQ ID NO: 7902107 - DNA, 22 bp, Homo sapiens
ctttggaggtcatagccaagag

SEQ ID NO: 7902108 - DNA, 22 bp, Homo sapiens
ctttggaggtcatagccaagag

SEQ ID NO: 7902109 - DNA, 22 bp, Homo sapiens
ctttggatttttatcaggcaat

SEQ ID NO: 7902110 - DNA, 22 bp, Homo sapiens
ctttggatttttatcaggcaat

SEQ ID NO: 7902111 - DNA, 22 bp, Homo sapiens
ctttggatgactggtgcaggtt

SEQ ID NO: 7902112 - DNA, 22 bp, Homo sapiens
ctttggatggctgtgtgtttat

SEQ ID NO: 7902113 - DNA, 22 bp, Homo sapiens
ctttggaggtcatagccaagag

SEQ ID NO: 7902114 - DNA, 22 bp, Homo sapiens
ctttggcaagggttttaattgt

SEQ ID NO: 7902115 - DNA, 22 bp, Homo sapiens
ctttggcaacacatgtgggaca

SEQ ID NO: 7902116 - DNA, 22 bp, Homo sapiens
ctttggcaacacatgtgggaca

SEQ ID NO: 7902117 - DNA, 22 bp, Homo sapiens
ctttggcaatgaaacacaagaa

SEQ ID NO: 7902118 - DNA, 22 bp, Homo sapiens
ctttggcaagggttttaattgt

SEQ ID NO: 7902119 - DNA, 22 bp, Homo sapiens
ctttggaagtgatagatatgat

SEQ ID NO: 7902120 - DNA, 22 bp, Homo sapiens
ctttggaagtgatagatatgat

SEQ ID NO: 7902121 - DNA, 22 bp, Homo sapiens
ctttggaagtgatagatatgat

SEQ ID NO: 7902122 - DNA, 22 bp, Homo sapiens
ctttggaataaaattagttgtt

SEQ ID NO: 7902123 - DNA, 22 bp, Homo sapiens
ctttggaataaaattagttgtt

SEQ ID NO: 7902124 - DNA, 22 bp, Homo sapiens
ctttggaagtaaagtcagcagg

SEQ ID NO: 7902125 - DNA, 22 bp, Homo sapiens
ctttggaagtgaccacaatcct

SEQ ID NO: 7902126 - DNA, 22 bp, Homo sapiens
ctttggaagtgaccacaatcct

SEQ ID NO: 7902127 - DNA, 22 bp, Homo sapiens
ctttggaagtgaccacaatcct

SEQ ID NO: 7902128 - DNA, 22 bp, Homo sapiens
ctttggaagtgaccacaatcct

SEQ ID NO: 7902129 - DNA, 22 bp, Homo sapiens
ctttggaatcattgcttattca

SEQ ID NO: 7902130 - DNA, 22 bp, Homo sapiens
ctttggaatattttattgagaa

SEQ ID NO: 7902131 - DNA, 22 bp, Homo sapiens
ctttggaatattttattgagaa

SEQ ID NO: 7902132 - DNA, 22 bp, Homo sapiens
ctttggaatattttattgagaa

SEQ ID NO: 7902133 - DNA, 22 bp, Homo sapiens
ctttggaatattttattgagaa

SEQ ID NO: 7902134 - DNA, 22 bp, Homo sapiens
ctttggaataatttcctggagt

SEQ ID NO: 7902135 - DNA, 22 bp, Homo sapiens
ctttggaataatttcctggagt

SEQ ID NO: 7902136 - DNA, 22 bp, Homo sapiens
ctttggaataatttcctggagt

SEQ ID NO: 7902137 - DNA, 22 bp, Homo sapiens
ctttggaataatcaagctctga

SEQ ID NO: 7902138 - DNA, 22 bp, Homo sapiens
ctttggaataatcaagctctga

SEQ ID NO: 7902139 - DNA, 22 bp, Homo sapiens
ctttggaataatttcctggagt

SEQ ID NO: 7902140 - DNA, 22 bp, Homo sapiens
ctttggaataatcaagctctga

SEQ ID NO: 7902141 - DNA, 22 bp, Homo sapiens
ctttggaaggaacaggattctc

SEQ ID NO: 7902142 - DNA, 22 bp, Homo sapiens
ctttggaaggaacaggattctc

SEQ ID NO: 7902143 - DNA, 22 bp, Homo sapiens
ctttggaaggaagacctttcag

SEQ ID NO: 7902144 - DNA, 22 bp, Homo sapiens
ctttggaaggcagagctctgtg

SEQ ID NO: 7902145 - DNA, 22 bp, Homo sapiens
ctttggaaggaagacctttcag

SEQ ID NO: 7902146 - DNA, 22 bp, Homo sapiens
ctttggaaggcagagctctgtg

SEQ ID NO: 7902147 - DNA, 22 bp, Homo sapiens
ctttggaaggcagagctctgtg

SEQ ID NO: 7902148 - DNA, 22 bp, Homo sapiens
ctttggaaggtcgtccgtgtgg

SEQ ID NO: 7902149 - DNA, 22 bp, Homo sapiens
ctttggaaggcagagctctgtg

SEQ ID NO: 7902150 - DNA, 22 bp, Homo sapiens
ctttggaaggaacaggattctc

SEQ ID NO: 7902151 - DNA, 22 bp, Homo sapiens
ctttggaaggaacaggattctc

SEQ ID NO: 7902152 - DNA, 22 bp, Homo sapiens
ctttggaactgtaaggagatgg

SEQ ID NO: 7902153 - DNA, 22 bp, Homo sapiens
ctttggaagccaggcagttcac

SEQ ID NO: 7902154 - DNA, 22 bp, Homo sapiens
ctttggaacacccagctctgtg

SEQ ID NO: 7902155 - DNA, 22 bp, Homo sapiens
ctttggaacacccagctctgtg

SEQ ID NO: 7902156 - DNA, 22 bp, Homo sapiens
ctttggaacacccagctctgtg

SEQ ID NO: 7902157 - DNA, 22 bp, Homo sapiens
ctttggaacatactgctgagct

SEQ ID NO: 7902158 - DNA, 22 bp, Homo sapiens
ctttggaacatactgctgagct

SEQ ID NO: 7902159 - DNA, 22 bp, Homo sapiens
ctttggaacatactgctgagct

SEQ ID NO: 7902160 - DNA, 22 bp, Homo sapiens
ctttggaactgtaaggagatgg

SEQ ID NO: 7902161 - DNA, 22 bp, Homo sapiens
ctttggaacatactgctgagct

SEQ ID NO: 7902162 - DNA, 22 bp, Homo sapiens
ctgttaaagatagttaagcttc

SEQ ID NO: 7902163 - DNA, 20 bp, Homo sapiens
ctgttaaaaggtatgaattc

SEQ ID NO: 7902164 - DNA, 22 bp, Homo sapiens
ctgttaaaaagaccaatggatt

SEQ ID NO: 7902165 - DNA, 20 bp, Homo sapiens
ctgttaaaaggtatgaattc

SEQ ID NO: 7902166 - DNA, 22 bp, Homo sapiens
ctgttaaaaagaccaatggatt

SEQ ID NO: 7902167 - DNA, 20 bp, Homo sapiens
ctgttaaaaggtatgaattc

SEQ ID NO: 7902168 - DNA, 20 bp, Homo sapiens
ctgttaaaaggtatgaattc

SEQ ID NO: 7902169 - DNA, 20 bp, Homo sapiens
ctgttaaaaggtatgaattc

SEQ ID NO: 7902170 - DNA, 20 bp, Homo sapiens
ctgttaaaaggtatgaattc

SEQ ID NO: 7902171 - DNA, 22 bp, Homo sapiens
ctgttaaatgagaaagcagact

SEQ ID NO: 7902172 - DNA, 22 bp, Homo sapiens
ctgttaaatgagaaagcagact

SEQ ID NO: 7902173 - DNA, 22 bp, Homo sapiens
ctgttaaatgagaaagcagact

SEQ ID NO: 7902174 - DNA, 22 bp, Homo sapiens
ctgttaaatgagaaagcagact

SEQ ID NO: 7902175 - DNA, 22 bp, Homo sapiens
ctgttaaatagactgcagtgca

SEQ ID NO: 7902176 - DNA, 23 bp, Homo sapiens
ctgttaaattccttaagagcagg

SEQ ID NO: 7902177 - DNA, 23 bp, Homo sapiens
ctgttaaattccttaagagcagg

SEQ ID NO: 7902178 - DNA, 23 bp, Homo sapiens
ctgttaaattccttaagagcagg

SEQ ID NO: 7902179 - DNA, 20 bp, Homo sapiens
cttcaaaggcagtaacagcc

SEQ ID NO: 7902180 - DNA, 22 bp, Homo sapiens
cttcaaatacaagtagattatg

SEQ ID NO: 7902181 - DNA, 22 bp, Homo sapiens
cttcaaatccccctgagtttga

SEQ ID NO: 7902182 - DNA, 22 bp, Homo sapiens
cttcaaatcctgtgtagggcta

SEQ ID NO: 7902183 - DNA, 22 bp, Homo sapiens
cttcacaggcaagtctgttttt

SEQ ID NO: 7902184 - DNA, 22 bp, Homo sapiens
cttcacaggcaagtctgttttt

SEQ ID NO: 7902185 - DNA, 22 bp, Homo sapiens
cttcacagatgctgagagggct

SEQ ID NO: 7902186 - DNA, 22 bp, Homo sapiens
cttcacagtataggtccctgag

SEQ ID NO: 7902187 - DNA, 22 bp, Homo sapiens
cttcacagtcaccctgctgtgt

SEQ ID NO: 7902188 - DNA, 22 bp, Homo sapiens
cttcacagtataggtccctgag

SEQ ID NO: 7902189 - DNA, 22 bp, Homo sapiens
cttcacagtaaatccagaagaa

SEQ ID NO: 7902190 - DNA, 22 bp, Homo sapiens
cttcacagtcaccctgctgtgt

SEQ ID NO: 7902191 - DNA, 22 bp, Homo sapiens
cttcacagtcaccctgctgtgt

SEQ ID NO: 7902192 - DNA, 22 bp, Homo sapiens
cttcacagtcaccctgctgtgt

SEQ ID NO: 7902193 - DNA, 22 bp, Homo sapiens
cttcaaatcctgtgtagggcta

SEQ ID NO: 7902194 - DNA, 22 bp, Homo sapiens
cttcaaatgtgattttaataac

SEQ ID NO: 7902195 - DNA, 22 bp, Homo sapiens
cttcaaagatttgataaagcca

SEQ ID NO: 7902196 - DNA, 22 bp, Homo sapiens
cttcaaatgtgattttaataac

SEQ ID NO: 7902197 - DNA, 16 bp, Homo sapiens
cttcacagaggagagt

SEQ ID NO: 7902198 - DNA, 22 bp, Homo sapiens
cttcacagccaacatgggcaca

SEQ ID NO: 7902199 - DNA, 22 bp, Homo sapiens
cttcacagcatgagctttggag

SEQ ID NO: 7902200 - DNA, 22 bp, Homo sapiens
cttcacagccaacatgggcaca

SEQ ID NO: 7902201 - DNA, 22 bp, Homo sapiens
cttcacagcatgagctttggag

SEQ ID NO: 7902202 - DNA, 22 bp, Homo sapiens
cttcacagcatgagctttggag

SEQ ID NO: 7902203 - DNA, 20 bp, Homo sapiens
cttcactaggagaaagagaa

SEQ ID NO: 7902204 - DNA, 22 bp, Homo sapiens
cttcactgagtagtctagactc

SEQ ID NO: 7902205 - DNA, 22 bp, Homo sapiens
cttcactgcagtcatggctctg

SEQ ID NO: 7902206 - DNA, 22 bp, Homo sapiens
cttcactgatgggacagctcaa

SEQ ID NO: 7902207 - DNA, 22 bp, Homo sapiens
cttcactgagtagtctagactc

SEQ ID NO: 7902208 - DNA, 22 bp, Homo sapiens
cttcacattgggcttgatatga

SEQ ID NO: 7902209 - DNA, 22 bp, Homo sapiens
cttcacattgggcttgatatga

SEQ ID NO: 7902210 - DNA, 22 bp, Homo sapiens
cttcacattgggcttgatatga

SEQ ID NO: 7902211 - DNA, 22 bp, Homo sapiens
cttcacattagtttggatcaaa

SEQ ID NO: 7902212 - DNA, 22 bp, Homo sapiens
cttcacattagtttggatcaaa

SEQ ID NO: 7902213 - DNA, 22 bp, Homo sapiens
cttcacattagtttggatcaaa

SEQ ID NO: 7902214 - DNA, 22 bp, Homo sapiens
cttcacatttgcgaaggccaaa

SEQ ID NO: 7902215 - DNA, 22 bp, Homo sapiens
cttcacatttgcgaaggccaaa

SEQ ID NO: 7902216 - DNA, 22 bp, Homo sapiens
cttcacattgggcttgatatga

SEQ ID NO: 7902217 - DNA, 22 bp, Homo sapiens
cttcacatgttggagtcctttg

SEQ ID NO: 7902218 - DNA, 22 bp, Homo sapiens
cttcacatgttggagtcctttg

SEQ ID NO: 7902219 - DNA, 22 bp, Homo sapiens
cttcacatgttggagtcctttg

SEQ ID NO: 7902220 - DNA, 22 bp, Homo sapiens
cttcacatgggtactgctgatc

SEQ ID NO: 7902221 - DNA, 19 bp, Homo sapiens
cttcacatctgtgagggga

SEQ ID NO: 7902222 - DNA, 22 bp, Homo sapiens
cttcacatctccctaaaacagc

SEQ ID NO: 7902223 - DNA, 19 bp, Homo sapiens
cttcacatctgtgagggga

SEQ ID NO: 7902224 - DNA, 22 bp, Homo sapiens
cttcacatgatgtccgtgctgt

SEQ ID NO: 7902225 - DNA, 22 bp, Homo sapiens
cttcacatgatgtccgtgctgt

SEQ ID NO: 7902226 - DNA, 22 bp, Homo sapiens
cttcacatgggtactgctgatc

SEQ ID NO: 7902227 - DNA, 22 bp, Homo sapiens
cttcacatctccctaaaacagc

SEQ ID NO: 7902228 - DNA, 22 bp, Homo sapiens
cttcacatctccctaaaacagc

SEQ ID NO: 7902229 - DNA, 22 bp, Homo sapiens
cttcacatctccctaaaacagc

SEQ ID NO: 7902230 - DNA, 22 bp, Homo sapiens
cttcacataaacaaagggccat

SEQ ID NO: 7902231 - DNA, 22 bp, Homo sapiens
cttcacataaacaaagggccat

SEQ ID NO: 7902232 - DNA, 22 bp, Homo sapiens
cttcacatctccctaaaacagc

SEQ ID NO: 7902233 - DNA, 22 bp, Homo sapiens
cttcacatctccctaaaacagc

SEQ ID NO: 7902234 - DNA, 22 bp, Homo sapiens
cttcacatctccctaaaacagc

SEQ ID NO: 7902235 - DNA, 22 bp, Homo sapiens
cttcacagtctttatttcctcc

SEQ ID NO: 7902236 - DNA, 22 bp, Homo sapiens
cttccaggacaccagggtagta

SEQ ID NO: 7902237 - DNA, 22 bp, Homo sapiens
cttccagggtccaggaagagcc

SEQ ID NO: 7902238 - DNA, 22 bp, Homo sapiens
cttccagggtccaggaagagcc

SEQ ID NO: 7902239 - DNA, 22 bp, Homo sapiens
cttccagggtccaggaagagcc

SEQ ID NO: 7902240 - DNA, 22 bp, Homo sapiens
cttccagggtccaggaagagcc

SEQ ID NO: 7902241 - DNA, 22 bp, Homo sapiens
cttccaggtaggcctaaggcag

SEQ ID NO: 7902242 - DNA, 22 bp, Homo sapiens
cttccaggtaggcctaaggcag

SEQ ID NO: 7902243 - DNA, 22 bp, Homo sapiens
cttccaggtccttcttgagaag

SEQ ID NO: 7902244 - DNA, 22 bp, Homo sapiens
cttccaggtccttcttgagaag

SEQ ID NO: 7902245 - DNA, 22 bp, Homo sapiens
cttccaggtaggcctaaggcag

SEQ ID NO: 7902246 - DNA, 22 bp, Homo sapiens
cttccaggtaggcctaaggcag

SEQ ID NO: 7902247 - DNA, 22 bp, Homo sapiens
cttccaggtaggcctaaggcag

SEQ ID NO: 7902248 - DNA, 22 bp, Homo sapiens
cttcagaaataacaacaattac

SEQ ID NO: 7902249 - DNA, 22 bp, Homo sapiens
cttcagaaataacaacaattac

SEQ ID NO: 7902250 - DNA, 22 bp, Homo sapiens
cttcagaaataacaacaattac

SEQ ID NO: 7902251 - DNA, 22 bp, Homo sapiens
cttcagaaataacaacaattac

SEQ ID NO: 7902252 - DNA, 22 bp, Homo sapiens
cttcagaaataacaacaattac

SEQ ID NO: 7902253 - DNA, 22 bp, Homo sapiens
cttcagaaccagccagaagagg

SEQ ID NO: 7902254 - DNA, 22 bp, Homo sapiens
cttcagaaccagccagaagagg

SEQ ID NO: 7902255 - DNA, 22 bp, Homo sapiens
cttccaggacaccagggtagta

SEQ ID NO: 7902256 - DNA, 22 bp, Homo sapiens
cttcagaaccagccagaagagg

SEQ ID NO: 7902257 - DNA, 22 bp, Homo sapiens
cttcactgtttggttcacagca

SEQ ID NO: 7902258 - DNA, 22 bp, Homo sapiens
cttcactgtgcttcaagcagct

SEQ ID NO: 7902259 - DNA, 22 bp, Homo sapiens
cttcactgtgcttcaagcagct

SEQ ID NO: 7902260 - DNA, 22 bp, Homo sapiens
cttcactggaatctgtaatagt

SEQ ID NO: 7902261 - DNA, 22 bp, Homo sapiens
cttcactgcagtcatggctctg

SEQ ID NO: 7902262 - DNA, 22 bp, Homo sapiens
cttcactgggctcctgagaggg

SEQ ID NO: 7902263 - DNA, 22 bp, Homo sapiens
cttcactgtttggttcacagca

SEQ ID NO: 7902264 - DNA, 22 bp, Homo sapiens
cttcacttgctcatcatgctat

SEQ ID NO: 7902265 - DNA, 22 bp, Homo sapiens
cttcagaaactagtaacagcta

SEQ ID NO: 7902266 - DNA, 22 bp, Homo sapiens
cttcagaaactagtaacagcta

SEQ ID NO: 7902267 - DNA, 22 bp, Homo sapiens
cttcagaaactagtaacagcta

SEQ ID NO: 7902268 - DNA, 20 bp, Homo sapiens
cttcttcagcctatgcttca

SEQ ID NO: 7902269 - DNA, 22 bp, Homo sapiens
cttcttcagttgcatgtattgg

SEQ ID NO: 7902270 - DNA, 22 bp, Homo sapiens
cttcttcataggcagtcctgtt

SEQ ID NO: 7902271 - DNA, 22 bp, Homo sapiens
cttcttcataggcagtcctgtt

SEQ ID NO: 7902272 - DNA, 22 bp, Homo sapiens
cttcttcatctgtaaaacttgg

SEQ ID NO: 7902273 - DNA, 22 bp, Homo sapiens
cttcttcatctgtaaaacttgg

SEQ ID NO: 7902274 - DNA, 22 bp, Homo sapiens
cttcttcatgtattgatagtct

SEQ ID NO: 7902275 - DNA, 20 bp, Homo sapiens
cttcttcagcctatgcttca

SEQ ID NO: 7902276 - DNA, 20 bp, Homo sapiens
cttcttcagcctatgcttca

SEQ ID NO: 7902277 - DNA, 22 bp, Homo sapiens
cttcttcaatagcaagcgcata

SEQ ID NO: 7902278 - DNA, 22 bp, Homo sapiens
cttcttcacactggtctgaagc

SEQ ID NO: 7902279 - DNA, 22 bp, Homo sapiens
cttcttcagcacaatattgatg

SEQ ID NO: 7902280 - DNA, 22 bp, Homo sapiens
cttcttcagaggccagcctctg

SEQ ID NO: 7902281 - DNA, 22 bp, Homo sapiens
cttctgtgaatgaagtgtggga

SEQ ID NO: 7902282 - DNA, 22 bp, Homo sapiens
cttctgtgacgtatgtgaggac

SEQ ID NO: 7902283 - DNA, 22 bp, Homo sapiens
cttctgtgaccaccagcagccc

SEQ ID NO: 7902284 - DNA, 22 bp, Homo sapiens
cttctgtgacgtatgtgaggac

SEQ ID NO: 7902285 - DNA, 19 bp, Homo sapiens
cttctgtgatacatcagtc

SEQ ID NO: 7902286 - DNA, 22 bp, Homo sapiens
cttcttcaagagaatgggagac

SEQ ID NO: 7902287 - DNA, 22 bp, Homo sapiens
cttcttcaagagaatgggagac

SEQ ID NO: 7902288 - DNA, 22 bp, Homo sapiens
cttctgtagccagtaacatata

SEQ ID NO: 7902289 - DNA, 22 bp, Homo sapiens
cttctgtagccagtaacatata

SEQ ID NO: 7902290 - DNA, 22 bp, Homo sapiens
cttccctttctggtgacttctc

SEQ ID NO: 7902291 - DNA, 22 bp, Homo sapiens
cttccctttctggtgacttctc

SEQ ID NO: 7902292 - DNA, 22 bp, Homo sapiens
cttccctttagcatatagtagt

SEQ ID NO: 7902293 - DNA, 22 bp, Homo sapiens
cttccctttagcatatagtagt

SEQ ID NO: 7902294 - DNA, 22 bp, Homo sapiens
cttccctttagcatatagtagt

SEQ ID NO: 7902295 - DNA, 22 bp, Homo sapiens
cttcccttggtgaacagagcat

SEQ ID NO: 7902296 - DNA, 22 bp, Homo sapiens
cttcccttctgtgcagggcaga

SEQ ID NO: 7902297 - DNA, 22 bp, Homo sapiens
cttcccttctgcagatctttgg

SEQ ID NO: 7902298 - DNA, 22 bp, Homo sapiens
cttcccttctgtgcagggcaga

SEQ ID NO: 7902299 - DNA, 22 bp, Homo sapiens
cttcccttctgcagatctttgg

SEQ ID NO: 7902300 - DNA, 18 bp, Homo sapiens
cttccctcttcctttgtc

SEQ ID NO: 7902301 - DNA, 22 bp, Homo sapiens
cttccctgagctttctcaggct

SEQ ID NO: 7902302 - DNA, 22 bp, Homo sapiens
cttccctgagctttctcaggct

SEQ ID NO: 7902303 - DNA, 22 bp, Homo sapiens
cttcccgttattgcccttgggt

SEQ ID NO: 7902304 - DNA, 22 bp, Homo sapiens
cttccccgccggttcgctgagt

SEQ ID NO: 7902305 - DNA, 22 bp, Homo sapiens
cttccctcctggattccagact

SEQ ID NO: 7902306 - DNA, 19 bp, Homo sapiens
cttcccctgttacctcact

SEQ ID NO: 7902307 - DNA, 22 bp, Homo sapiens
cttcccccaaatcaagagacct

SEQ ID NO: 7902308 - DNA, 21 bp, Homo sapiens
cttccccaggctggtctgtat

SEQ ID NO: 7902309 - DNA, 19 bp, Homo sapiens
cttcccctgttacctcact

SEQ ID NO: 7902310 - DNA, 19 bp, Homo sapiens
cttcccctgttacctcact

SEQ ID NO: 7902311 - DNA, 19 bp, Homo sapiens
cttcccctgttacctcact

SEQ ID NO: 7902312 - DNA, 22 bp, Homo sapiens
cttccctgagctttctcaggct

SEQ ID NO: 7902313 - DNA, 22 bp, Homo sapiens
cttccctgagctttctcaggct

SEQ ID NO: 7902314 - DNA, 22 bp, Homo sapiens
cttccctgataagagcctcaga

SEQ ID NO: 7902315 - DNA, 22 bp, Homo sapiens
cttccctgataagagcctcaga

SEQ ID NO: 7902316 - DNA, 22 bp, Homo sapiens
cttcccttcccctcacggagac

SEQ ID NO: 7902317 - DNA, 22 bp, Homo sapiens
cttcccttcctggggcaattta

SEQ ID NO: 7902318 - DNA, 22 bp, Homo sapiens
cttccctgataagagcctcaga

SEQ ID NO: 7902319 - DNA, 22 bp, Homo sapiens
cttccctggtgttagcccaatg

SEQ ID NO: 7902320 - DNA, 22 bp, Homo sapiens
cttccctggtgttagcccaatg

SEQ ID NO: 7902321 - DNA, 22 bp, Homo sapiens
cttccccaagtagagaggggag

SEQ ID NO: 7902322 - DNA, 22 bp, Homo sapiens
cttccccaggacctctgctaaa

SEQ ID NO: 7902323 - DNA, 22 bp, Homo sapiens
cttccccaggacctctgctaaa

SEQ ID NO: 7902324 - DNA, 22 bp, Homo sapiens
cttcccatataactaatttctg

SEQ ID NO: 7902325 - DNA, 22 bp, Homo sapiens
cttcccatataactaatttctg

SEQ ID NO: 7902326 - DNA, 22 bp, Homo sapiens
cttcccatataactaatttctg

SEQ ID NO: 7902327 - DNA, 22 bp, Homo sapiens
cttcccagttctgcttgagggg

SEQ ID NO: 7902328 - DNA, 22 bp, Homo sapiens
cttcccaggtgctcttagcatg

SEQ ID NO: 7902329 - DNA, 22 bp, Homo sapiens
cttcccagttctgcttgagggg

SEQ ID NO: 7902330 - DNA, 22 bp, Homo sapiens
cttcccagttctgcttgagggg

SEQ ID NO: 7902331 - DNA, 22 bp, Homo sapiens
cttcccaggtgctcttagcatg

SEQ ID NO: 7902332 - DNA, 22 bp, Homo sapiens
cttcccagttctgcttgagggg

SEQ ID NO: 7902333 - DNA, 22 bp, Homo sapiens
cttcccagcacctcagtctggc

SEQ ID NO: 7902334 - DNA, 22 bp, Homo sapiens
cttccaggtccttcttgagaag

SEQ ID NO: 7902335 - DNA, 22 bp, Homo sapiens
cttcccagaccttagagtgcag

SEQ ID NO: 7902336 - DNA, 22 bp, Homo sapiens
cttcccagaacaatgtaggctt

SEQ ID NO: 7902337 - DNA, 22 bp, Homo sapiens
cttcccagaacaatgtaggctt

SEQ ID NO: 7902338 - DNA, 22 bp, Homo sapiens
cttcccagaccttagagtgcag

SEQ ID NO: 7902339 - DNA, 22 bp, Homo sapiens
cttcccagaccttagagtgcag

SEQ ID NO: 7902340 - DNA, 22 bp, Homo sapiens
cttcccagaccttagagtgcag

SEQ ID NO: 7902341 - DNA, 22 bp, Homo sapiens
cttcccagcacctcagtctggc

SEQ ID NO: 7902342 - DNA, 22 bp, Homo sapiens
cttcccagcacctcagtctggc

SEQ ID NO: 7902343 - DNA, 22 bp, Homo sapiens
cttcccagcacctcagtctggc

SEQ ID NO: 7902344 - DNA, 22 bp, Homo sapiens
cttcccagacggggtggcagcc

SEQ ID NO: 7902345 - DNA, 22 bp, Homo sapiens
cttcccagacggggtggcagcc

SEQ ID NO: 7902346 - DNA, 22 bp, Homo sapiens
cttcccagacggggtggcagcc

SEQ ID NO: 7902347 - DNA, 22 bp, Homo sapiens
cttcccagacggggtggcagcc

SEQ ID NO: 7902348 - DNA, 22 bp, Homo sapiens
ctttctctgtgtggtaaagggc

SEQ ID NO: 7902349 - DNA, 22 bp, Homo sapiens
ctttctctgtggtgaggagggt

SEQ ID NO: 7902350 - DNA, 22 bp, Homo sapiens
ctttctctgtggtgaggagggt

SEQ ID NO: 7902351 - DNA, 22 bp, Homo sapiens
ctttctctgtgtggtaaagggc

SEQ ID NO: 7902352 - DNA, 22 bp, Homo sapiens
ctttctctgtgtttcacatgct

SEQ ID NO: 7902353 - DNA, 22 bp, Homo sapiens
ctttctctggaggggagtggtt

SEQ ID NO: 7902354 - DNA, 22 bp, Homo sapiens
ctttctctggaggggagtggtt

SEQ ID NO: 7902355 - DNA, 22 bp, Homo sapiens
ctttctctggaggggagtggtt

SEQ ID NO: 7902356 - DNA, 20 bp, Homo sapiens
ctttctctaatttataagta

SEQ ID NO: 7902357 - DNA, 20 bp, Homo sapiens
ctttctctaatttataagta

SEQ ID NO: 7902358 - DNA, 20 bp, Homo sapiens
ctttctctaatttataagta

SEQ ID NO: 7902359 - DNA, 22 bp, Homo sapiens
ctttctccagagctgcttattt

SEQ ID NO: 7902360 - DNA, 22 bp, Homo sapiens
ctttctccagagctgcttattt

SEQ ID NO: 7902361 - DNA, 22 bp, Homo sapiens
ctttctccctgtcccaaactgg

SEQ ID NO: 7902362 - DNA, 22 bp, Homo sapiens
ctttctccctgtcccaaactgg

SEQ ID NO: 7902363 - DNA, 22 bp, Homo sapiens
ctttctccctgtcccaaactgg

SEQ ID NO: 7902364 - DNA, 22 bp, Homo sapiens
ctttctccctgtcccaaactgg

SEQ ID NO: 7902365 - DNA, 22 bp, Homo sapiens
ctttctccagagctgcttattt

SEQ ID NO: 7902366 - DNA, 22 bp, Homo sapiens
ctttctccagagctgcttattt

SEQ ID NO: 7902367 - DNA, 20 bp, Homo sapiens
ctttctctaatttataagta

SEQ ID NO: 7902368 - DNA, 22 bp, Homo sapiens
ctttctcctactgggcgcggga

SEQ ID NO: 7902369 - DNA, 22 bp, Homo sapiens
ctttctcctactgggcgcggga

SEQ ID NO: 7902370 - DNA, 20 bp, Homo sapiens
ctttctctaatttataagta

SEQ ID NO: 7902371 - DNA, 22 bp, Homo sapiens
ctttctagttgacagcatgcca

SEQ ID NO: 7902372 - DNA, 22 bp, Homo sapiens
ctttctcagtgttaattacttt

SEQ ID NO: 7902373 - DNA, 22 bp, Homo sapiens
ctttctcagtgttaattacttt

SEQ ID NO: 7902374 - DNA, 22 bp, Homo sapiens
ctttctaattctcccatagtct

SEQ ID NO: 7902375 - DNA, 22 bp, Homo sapiens
ctttctaaatgttccttgatta

SEQ ID NO: 7902376 - DNA, 22 bp, Homo sapiens
ctttctagactgtccagatgat

SEQ ID NO: 7902377 - DNA, 22 bp, Homo sapiens
ctttctagttgacagcatgcca

SEQ ID NO: 7902378 - DNA, 22 bp, Homo sapiens
ctttctagagtatggagtctgt

SEQ ID NO: 7902379 - DNA, 22 bp, Homo sapiens
ctttctagactgtccagatgat

SEQ ID NO: 7902380 - DNA, 22 bp, Homo sapiens
ctttctcttacccaaggatctg

SEQ ID NO: 7902381 - DNA, 22 bp, Homo sapiens
ctttctcttacccaaggatctg

SEQ ID NO: 7902382 - DNA, 22 bp, Homo sapiens
ctttctctgtgtttcacatgct

SEQ ID NO: 7902383 - DNA, 22 bp, Homo sapiens
ctttctctgtgtttcacatgct

SEQ ID NO: 7902384 - DNA, 22 bp, Homo sapiens
ctttctctgtgtttcacatgct

SEQ ID NO: 7902385 - DNA, 22 bp, Homo sapiens
ctttctctgtgtttcacatgct

SEQ ID NO: 7902386 - DNA, 22 bp, Homo sapiens
ctttctcttcactgtcatgatc

SEQ ID NO: 7902387 - DNA, 22 bp, Homo sapiens
ctttctcttcactgtcatgatc

SEQ ID NO: 7902388 - DNA, 22 bp, Homo sapiens
ctttctcttcactgtcatgatc

SEQ ID NO: 7902389 - DNA, 22 bp, Homo sapiens
ctttctcttacccaaggatctg

SEQ ID NO: 7902390 - DNA, 22 bp, Homo sapiens
ctttctcttcactgtcatgatc

SEQ ID NO: 7902391 - DNA, 22 bp, Homo sapiens
ctttgcatgggtctgaaggctt

SEQ ID NO: 7902392 - DNA, 22 bp, Homo sapiens
ctttgcatgggtctgaaggctt

SEQ ID NO: 7902393 - DNA, 22 bp, Homo sapiens
ctttgcatgtggtagaaggttc

SEQ ID NO: 7902394 - DNA, 22 bp, Homo sapiens
ctttgcattctcagcacagagc

SEQ ID NO: 7902395 - DNA, 22 bp, Homo sapiens
ctttggaacaagaagaaatggc

SEQ ID NO: 7902396 - DNA, 22 bp, Homo sapiens
ctttggaacacatgggcatggt

SEQ ID NO: 7902397 - DNA, 22 bp, Homo sapiens
ctttggaacacccagctctgtg

SEQ ID NO: 7902398 - DNA, 22 bp, Homo sapiens
ctttggaacacatgggcatggt

SEQ ID NO: 7902399 - DNA, 22 bp, Homo sapiens
ctttgcataatgaatgatcata

SEQ ID NO: 7902400 - DNA, 21 bp, Homo sapiens
ctttgcatctatatgttctca

SEQ ID NO: 7902401 - DNA, 22 bp, Homo sapiens
ctttctaaatgttccttgatta

SEQ ID NO: 7902402 - DNA, 23 bp, Homo sapiens
ctttcctttctttgacacccagc

SEQ ID NO: 7902403 - DNA, 22 bp, Homo sapiens
ctttcgatcaagggtcccttca

SEQ ID NO: 7902404 - DNA, 22 bp, Homo sapiens
ctttccttctcgtggttctcac

SEQ ID NO: 7902405 - DNA, 23 bp, Homo sapiens
ctttcctttctttgacacccagc

SEQ ID NO: 7902406 - DNA, 23 bp, Homo sapiens
ctttcctttctttgacacccagc

SEQ ID NO: 7902407 - DNA, 22 bp, Homo sapiens
ctttccttctcgtggttctcac

SEQ ID NO: 7902408 - DNA, 22 bp, Homo sapiens
ctttccttctcgtggttctcac

SEQ ID NO: 7902409 - DNA, 22 bp, Homo sapiens
ctttccttctcgtggttctcac

SEQ ID NO: 7902410 - DNA, 22 bp, Homo sapiens
ctttccttaataagcaggtata

SEQ ID NO: 7902411 - DNA, 22 bp, Homo sapiens
ctttccttaataagcaggtata

SEQ ID NO: 7902412 - DNA, 22 bp, Homo sapiens
ctttcctccactccctaggctt

SEQ ID NO: 7902413 - DNA, 22 bp, Homo sapiens
ctttcctctggcactgtctggt

SEQ ID NO: 7902414 - DNA, 22 bp, Homo sapiens
ctttcctctggcactgtctggt

SEQ ID NO: 7902415 - DNA, 22 bp, Homo sapiens
ctttcctctggcactgtctggt

SEQ ID NO: 7902416 - DNA, 22 bp, Homo sapiens
ctttcctgaaatctcttctgca

SEQ ID NO: 7902417 - DNA, 22 bp, Homo sapiens
ctttcctggctggcagttgtgg

SEQ ID NO: 7902418 - DNA, 22 bp, Homo sapiens
ctttcctgccttattcattcat

SEQ ID NO: 7902419 - DNA, 22 bp, Homo sapiens
ctttcctgaggagtatggctgt

SEQ ID NO: 7902420 - DNA, 22 bp, Homo sapiens
ctttcctgagaaaggagaagga

SEQ ID NO: 7902421 - DNA, 22 bp, Homo sapiens
ctttcctgagaaaggagaagga

SEQ ID NO: 7902422 - DNA, 22 bp, Homo sapiens
ctttcctgaggagtatggctgt

SEQ ID NO: 7902423 - DNA, 22 bp, Homo sapiens
ctttcctgaaatctcttctgca

SEQ ID NO: 7902424 - DNA, 22 bp, Homo sapiens
ctttccaagaatgcagatacct

SEQ ID NO: 7902425 - DNA, 22 bp, Homo sapiens
cttggagtcaataagatctaga

SEQ ID NO: 7902426 - DNA, 22 bp, Homo sapiens
cttggagtatgagcttcctgga

SEQ ID NO: 7902427 - DNA, 22 bp, Homo sapiens
ctttccaatgtcactatgaatc

SEQ ID NO: 7902428 - DNA, 22 bp, Homo sapiens
ctttccaatgcatttccaatgt

SEQ ID NO: 7902429 - DNA, 22 bp, Homo sapiens
ctttccagacctccttgtagct

SEQ ID NO: 7902430 - DNA, 22 bp, Homo sapiens
ctttcctagtagttacagaatg

SEQ ID NO: 7902431 - DNA, 22 bp, Homo sapiens
cttggaggatgtgcggctgccc

SEQ ID NO: 7902432 - DNA, 22 bp, Homo sapiens
cttggaggtggaagttgcagtg

SEQ ID NO: 7902433 - DNA, 22 bp, Homo sapiens
cttggaggaaggggctcttctg

SEQ ID NO: 7902434 - DNA, 22 bp, Homo sapiens
cttggaggaaggggctcttctg

SEQ ID NO: 7902435 - DNA, 22 bp, Homo sapiens
cttggaggaaggggctcttctg

SEQ ID NO: 7902436 - DNA, 22 bp, Homo sapiens
cttggaggaaggggctcttctg

SEQ ID NO: 7902437 - DNA, 22 bp, Homo sapiens
cttggagagtggttatccctgt

SEQ ID NO: 7902438 - DNA, 22 bp, Homo sapiens
cttggagcaacacatgacatct

SEQ ID NO: 7902439 - DNA, 22 bp, Homo sapiens
cttggagcccagcaggcctgga

SEQ ID NO: 7902440 - DNA, 22 bp, Homo sapiens
cttggagatacagaggacattt

SEQ ID NO: 7902441 - DNA, 22 bp, Homo sapiens
cttggagattcattgcctgaaa

SEQ ID NO: 7902442 - DNA, 22 bp, Homo sapiens
cttggagattcattgcctgaaa

SEQ ID NO: 7902443 - DNA, 22 bp, Homo sapiens
cttggagcccagcaggcctgga

SEQ ID NO: 7902444 - DNA, 22 bp, Homo sapiens
cttggaggaaaggcagggagac

SEQ ID NO: 7902445 - DNA, 22 bp, Homo sapiens
cttggaatggggcagaaaatgg

SEQ ID NO: 7902446 - DNA, 22 bp, Homo sapiens
cttggaatcaagtttttggaga

SEQ ID NO: 7902447 - DNA, 22 bp, Homo sapiens
cttggaatggggcagaaaatgg

SEQ ID NO: 7902448 - DNA, 22 bp, Homo sapiens
cttggaaagttatcattttcct

SEQ ID NO: 7902449 - DNA, 22 bp, Homo sapiens
cttggaaggctggttctccctc

SEQ ID NO: 7902450 - DNA, 22 bp, Homo sapiens
cttggaatcaagtttttggaga

SEQ ID NO: 7902451 - DNA, 21 bp, Homo sapiens
cttggaacgggtagaactcac

SEQ ID NO: 7902452 - DNA, 22 bp, Homo sapiens
cttggaaggacgggctgtatct

SEQ ID NO: 7902453 - DNA, 22 bp, Homo sapiens
cttggaaggacgggctgtatct

SEQ ID NO: 7902454 - DNA, 16 bp, Homo sapiens
cttggaacttgttggg

SEQ ID NO: 7902455 - DNA, 22 bp, Homo sapiens
cttggaaggacgggctgtatct

SEQ ID NO: 7902456 - DNA, 22 bp, Homo sapiens
cttggactggacccgaggaatg

SEQ ID NO: 7902457 - DNA, 22 bp, Homo sapiens
cttggacaacttttctctggtt

SEQ ID NO: 7902458 - DNA, 22 bp, Homo sapiens
cttggaattgatgattttcata

SEQ ID NO: 7902459 - DNA, 22 bp, Homo sapiens
cttggacccactcccagaattg

SEQ ID NO: 7902460 - DNA, 22 bp, Homo sapiens
cttggagaaaggaaagggcttg

SEQ ID NO: 7902461 - DNA, 18 bp, Homo sapiens
cttggagaactaatgata

SEQ ID NO: 7902462 - DNA, 22 bp, Homo sapiens
cttggactttccagcttctaaa

SEQ ID NO: 7902463 - DNA, 22 bp, Homo sapiens
cttggagagggagaaaaataac

SEQ ID NO: 7902464 - DNA, 22 bp, Homo sapiens
cttggagagagcctcagctgtt

SEQ ID NO: 7902465 - DNA, 22 bp, Homo sapiens
cttggagaccagtgacattgct

SEQ ID NO: 7902466 - DNA, 22 bp, Homo sapiens
cttggagaccagtgacattgct

SEQ ID NO: 7902467 - DNA, 22 bp, Homo sapiens
cttggagagagcctcagctgtt

SEQ ID NO: 7902468 - DNA, 22 bp, Homo sapiens
cttggagagagcctcagctgtt

SEQ ID NO: 7902469 - DNA, 22 bp, Homo sapiens
cttggagatacaagtggtacct

SEQ ID NO: 7902470 - DNA, 22 bp, Homo sapiens
cttggagagtggttatccctgt

SEQ ID NO: 7902471 - DNA, 22 bp, Homo sapiens
cttggagatacagaggacattt

SEQ ID NO: 7902472 - DNA, 22 bp, Homo sapiens
cttggagatacagaggacattt

SEQ ID NO: 7902473 - DNA, 22 bp, Homo sapiens
cttggagatacagaggacattt

SEQ ID NO: 7902474 - DNA, 22 bp, Homo sapiens
cttggagatacagaggacattt

SEQ ID NO: 7902475 - DNA, 22 bp, Homo sapiens
cttggagacaggacaggcagaa

SEQ ID NO: 7902476 - DNA, 22 bp, Homo sapiens
cttggagacaggacaggcagaa

SEQ ID NO: 7902477 - DNA, 22 bp, Homo sapiens
cttggagacattgatcttttgc

SEQ ID NO: 7902478 - DNA, 22 bp, Homo sapiens
cttggagacattgatcttttgc

SEQ ID NO: 7902479 - DNA, 22 bp, Homo sapiens
cttggagacattgatcttttgc

SEQ ID NO: 7902480 - DNA, 22 bp, Homo sapiens
cttggagaatgacagtggatta

SEQ ID NO: 7902481 - DNA, 22 bp, Homo sapiens
cttggagaatgacagtggatta

SEQ ID NO: 7902482 - DNA, 22 bp, Homo sapiens
cttggagacaggacaggcagaa

SEQ ID NO: 7902483 - DNA, 22 bp, Homo sapiens
cttggagaatcctggttattca

SEQ ID NO: 7902484 - DNA, 22 bp, Homo sapiens
cttggagaatcctggttattca

SEQ ID NO: 7902485 - DNA, 19 bp, Homo sapiens
cttggagaaggctatgacc

SEQ ID NO: 7902486 - DNA, 22 bp, Homo sapiens
cttggaaactttccctgggcac

SEQ ID NO: 7902487 - DNA, 22 bp, Homo sapiens
cttggaaagaatatatgatgct

SEQ ID NO: 7902488 - DNA, 22 bp, Homo sapiens
cttggaaagaatatatgatgct

SEQ ID NO: 7902489 - DNA, 22 bp, Homo sapiens
cttggaaagaatatatgatgct

SEQ ID NO: 7902490 - DNA, 22 bp, Homo sapiens
cttggaaaggaatcttttacca

SEQ ID NO: 7902491 - DNA, 22 bp, Homo sapiens
cttggaaaggaatcttttacca

SEQ ID NO: 7902492 - DNA, 22 bp, Homo sapiens
cttggaaagttatcattttcct

SEQ ID NO: 7902493 - DNA, 22 bp, Homo sapiens
cttggaaagttatcattttcct

SEQ ID NO: 7902494 - DNA, 22 bp, Homo sapiens
cttgctgttgtgggagactggg

SEQ ID NO: 7902495 - DNA, 22 bp, Homo sapiens
cttgctgtgtggtgttctcaga

SEQ ID NO: 7902496 - DNA, 22 bp, Homo sapiens
cttgctgtgtggtgttctcaga

SEQ ID NO: 7902497 - DNA, 22 bp, Homo sapiens
cttgctgtcttgcatttagagc

SEQ ID NO: 7902498 - DNA, 22 bp, Homo sapiens
cttgcttacctagttagctcca

SEQ ID NO: 7902499 - DNA, 22 bp, Homo sapiens
cttgctgttttctaccctcaag

SEQ ID NO: 7902500 - DNA, 22 bp, Homo sapiens
cttgcttctgctgcactatcct

SEQ ID NO: 7902501 - DNA, 22 bp, Homo sapiens
cttgcttcattagtgtcttagt

SEQ ID NO: 7902502 - DNA, 22 bp, Homo sapiens
cttgctttatctggtttctcat

SEQ ID NO: 7902503 - DNA, 22 bp, Homo sapiens
cttgctttcagtctcggcctca

SEQ ID NO: 7902504 - DNA, 22 bp, Homo sapiens
cttgcttgtttagttcacagat

SEQ ID NO: 7902505 - DNA, 22 bp, Homo sapiens
cttgcttgattatgatcataaa

SEQ ID NO: 7902506 - DNA, 22 bp, Homo sapiens
cttgcctgccactacagctgaa

SEQ ID NO: 7902507 - DNA, 22 bp, Homo sapiens
cttgcctctgctaatggtttct

SEQ ID NO: 7902508 - DNA, 19 bp, Homo sapiens
cttgctgggtggtttctgc

SEQ ID NO: 7902509 - DNA, 22 bp, Homo sapiens
cttgctggggtaagtctgtgct

SEQ ID NO: 7902510 - DNA, 22 bp, Homo sapiens
cttgcctgctggagcagggctc

SEQ ID NO: 7902511 - DNA, 22 bp, Homo sapiens
cttgctggggtaagtctgtgct

SEQ ID NO: 7902512 - DNA, 22 bp, Homo sapiens
cttgctggtgtcgtgccttcac

SEQ ID NO: 7902513 - DNA, 22 bp, Homo sapiens
cttgctgtcccttggtatgaac

SEQ ID NO: 7902514 - DNA, 22 bp, Homo sapiens
cttgctggtggtgttttctatg

SEQ ID NO: 7902515 - DNA, 22 bp, Homo sapiens
cttgctggtggtgttttctatg

SEQ ID NO: 7902516 - DNA, 19 bp, Homo sapiens
cttgctgggtggtttctgc

SEQ ID NO: 7902517 - DNA, 22 bp, Homo sapiens
cttgctggtattttctctctca

SEQ ID NO: 7902518 - DNA, 19 bp, Homo sapiens
cttgctgggtggtttctgc

SEQ ID NO: 7902519 - DNA, 22 bp, Homo sapiens
cttgcctccctcagctcacagc

SEQ ID NO: 7902520 - DNA, 22 bp, Homo sapiens
cttgcctccctcagctcacagc

SEQ ID NO: 7902521 - DNA, 22 bp, Homo sapiens
cttgcctacttgtcaaccagca

SEQ ID NO: 7902522 - DNA, 22 bp, Homo sapiens
cttgcctacttgtcaaccagca

SEQ ID NO: 7902523 - DNA, 19 bp, Homo sapiens
cttcttcttggcagccaag

SEQ ID NO: 7902524 - DNA, 22 bp, Homo sapiens
cttcttcttcccccttcagggg

SEQ ID NO: 7902525 - DNA, 22 bp, Homo sapiens
cttcttcttcccccttcagggg

SEQ ID NO: 7902526 - DNA, 22 bp, Homo sapiens
cttcttcttcccccttcagggg

SEQ ID NO: 7902527 - DNA, 22 bp, Homo sapiens
cttcttctggtttatgtggcaa

SEQ ID NO: 7902528 - DNA, 22 bp, Homo sapiens
cttcttctggtttatgtggcaa

SEQ ID NO: 7902529 - DNA, 22 bp, Homo sapiens
cttcttcatgtattgatagtct

SEQ ID NO: 7902530 - DNA, 22 bp, Homo sapiens
cttcttccaagcttatgctcaa

SEQ ID NO: 7902531 - DNA, 22 bp, Homo sapiens
cttcttccaagcttatgctcaa

SEQ ID NO: 7902532 - DNA, 22 bp, Homo sapiens
cttcttcccagcttccctcacc

SEQ ID NO: 7902533 - DNA, 22 bp, Homo sapiens
cttcttcccagcttccctcacc

SEQ ID NO: 7902534 - DNA, 22 bp, Homo sapiens
cttcttcccagcttccctcacc

SEQ ID NO: 7902535 - DNA, 22 bp, Homo sapiens
cttcttcccagcttccctcacc

SEQ ID NO: 7902536 - DNA, 22 bp, Homo sapiens
cttcttccagttataagagctt

SEQ ID NO: 7902537 - DNA, 22 bp, Homo sapiens
cttcttcccagcttccctcacc

SEQ ID NO: 7902538 - DNA, 22 bp, Homo sapiens
cttcttccagttataagagctt

SEQ ID NO: 7902539 - DNA, 22 bp, Homo sapiens
cttcttcctgctgcagcctcca

SEQ ID NO: 7902540 - DNA, 22 bp, Homo sapiens
cttcttcctgctgcagcctcca

SEQ ID NO: 7902541 - DNA, 22 bp, Homo sapiens
cttcttcctgctgcagcctcca

SEQ ID NO: 7902542 - DNA, 22 bp, Homo sapiens
cttcttcctgctgcagcctcca

SEQ ID NO: 7902543 - DNA, 22 bp, Homo sapiens
cttcttctggacaggcagctcc

SEQ ID NO: 7902544 - DNA, 22 bp, Homo sapiens
cttcttctctacatcctttgat

SEQ ID NO: 7902545 - DNA, 22 bp, Homo sapiens
cttcttctctacatcctttgat

SEQ ID NO: 7902546 - DNA, 22 bp, Homo sapiens
cttcttctctacatcctttgat

SEQ ID NO: 7902547 - DNA, 22 bp, Homo sapiens
cttcttctctacatcctttgat

SEQ ID NO: 7902548 - DNA, 22 bp, Homo sapiens
cttcttcctgctgcagcctcca

SEQ ID NO: 7902549 - DNA, 22 bp, Homo sapiens
cttcttctcaaggggcaggtgg

SEQ ID NO: 7902550 - DNA, 22 bp, Homo sapiens
cttcttctcaaggggcaggtgg

SEQ ID NO: 7902551 - DNA, 22 bp, Homo sapiens
ctgccccagcctggggccttct

SEQ ID NO: 7902552 - DNA, 22 bp, Homo sapiens
ctgccccaccccaacctgaggt

SEQ ID NO: 7902553 - DNA, 22 bp, Homo sapiens
ctgccccaggacctcttctgga

SEQ ID NO: 7902554 - DNA, 22 bp, Homo sapiens
ctgccccaggacctcttctgga

SEQ ID NO: 7902555 - DNA, 22 bp, Homo sapiens
ctgccccaggacctcttctgga

SEQ ID NO: 7902556 - DNA, 22 bp, Homo sapiens
ctgccccaggacctcttctgga

SEQ ID NO: 7902557 - DNA, 22 bp, Homo sapiens
ctgccccaggcctccttttctt

SEQ ID NO: 7902558 - DNA, 22 bp, Homo sapiens
ctgccccaggcctccttttctt

SEQ ID NO: 7902559 - DNA, 22 bp, Homo sapiens
ctgccccaggcctccttttctt

SEQ ID NO: 7902560 - DNA, 22 bp, Homo sapiens
ctgccccaggcctccttttctt

SEQ ID NO: 7902561 - DNA, 22 bp, Homo sapiens
ctgccccagtgccaggcaggtg

SEQ ID NO: 7902562 - DNA, 22 bp, Homo sapiens
ctgccccagtgccaggcaggtg

SEQ ID NO: 7902563 - DNA, 22 bp, Homo sapiens
ctgcccctgccaggcagctgtc

SEQ ID NO: 7902564 - DNA, 22 bp, Homo sapiens
ctgcccctgccaggcagctgtc

SEQ ID NO: 7902565 - DNA, 22 bp, Homo sapiens
ctgcccctgccaggcagctgtc

SEQ ID NO: 7902566 - DNA, 22 bp, Homo sapiens
ctgcccccaggctgcatggctg

SEQ ID NO: 7902567 - DNA, 22 bp, Homo sapiens
ctgcccccaggctgcatggctg

SEQ ID NO: 7902568 - DNA, 22 bp, Homo sapiens
ctgcccctcgaccaagcgcgtc

SEQ ID NO: 7902569 - DNA, 22 bp, Homo sapiens
ctgcccctcgaccaagcgcgtc

SEQ ID NO: 7902570 - DNA, 22 bp, Homo sapiens
ctgccccatggtccctggtggg

SEQ ID NO: 7902571 - DNA, 22 bp, Homo sapiens
ctgccccatggtccctggtggg

SEQ ID NO: 7902572 - DNA, 22 bp, Homo sapiens
ctgccccagtgccaggcaggtg

SEQ ID NO: 7902573 - DNA, 22 bp, Homo sapiens
ctgccccatggtccctggtggg

SEQ ID NO: 7902574 - DNA, 22 bp, Homo sapiens
ctgccccatggtccctggtggg

SEQ ID NO: 7902575 - DNA, 22 bp, Homo sapiens
ctgcccaggggagtgctgtcgg

SEQ ID NO: 7902576 - DNA, 22 bp, Homo sapiens
ctgcccaggggagtgctgtcgg

SEQ ID NO: 7902577 - DNA, 22 bp, Homo sapiens
ctgcccaggggagtgctgtcgg

SEQ ID NO: 7902578 - DNA, 22 bp, Homo sapiens
ctgcccaggctgaaggaacatc

SEQ ID NO: 7902579 - DNA, 22 bp, Homo sapiens
ctgcccaggggagtgctgtcgg

SEQ ID NO: 7902580 - DNA, 22 bp, Homo sapiens
ctgcccaggctgaaggaacatc

SEQ ID NO: 7902581 - DNA, 22 bp, Homo sapiens
ctgcccaggaaggagaggatgg

SEQ ID NO: 7902582 - DNA, 22 bp, Homo sapiens
ctgcccaggaaggagaggatgg

SEQ ID NO: 7902583 - DNA, 22 bp, Homo sapiens
ctgcccaggaaggagaggatgg

SEQ ID NO: 7902584 - DNA, 22 bp, Homo sapiens
ctgcccaggaaccagaggggca

SEQ ID NO: 7902585 - DNA, 22 bp, Homo sapiens
ctgcccaggctgaaggaacatc

SEQ ID NO: 7902586 - DNA, 22 bp, Homo sapiens
ctgcccaggctgaaggaacatc

SEQ ID NO: 7902587 - DNA, 22 bp, Homo sapiens
ctgcccaggctgaaggaacatc

SEQ ID NO: 7902588 - DNA, 22 bp, Homo sapiens
ctgcccaggctgaaggaacatc

SEQ ID NO: 7902589 - DNA, 22 bp, Homo sapiens
ctgcccattcaaccagctacag

SEQ ID NO: 7902590 - DNA, 22 bp, Homo sapiens
ctgcccattcaaccagctacag

SEQ ID NO: 7902591 - DNA, 22 bp, Homo sapiens
ctgcccatctggccacacacag

SEQ ID NO: 7902592 - DNA, 23 bp, Homo sapiens
ctgccccaattataaaagaagat

SEQ ID NO: 7902593 - DNA, 22 bp, Homo sapiens
ctgccccaccccaacctgaggt

SEQ ID NO: 7902594 - DNA, 22 bp, Homo sapiens
ctgccccaccccaacctgaggt

SEQ ID NO: 7902595 - DNA, 22 bp, Homo sapiens
ctgcccataaactttccacctg

SEQ ID NO: 7902596 - DNA, 22 bp, Homo sapiens
ctgcccagtttgggagcctttc

SEQ ID NO: 7902597 - DNA, 22 bp, Homo sapiens
ctgcccagtttgggagcctttc

SEQ ID NO: 7902598 - DNA, 22 bp, Homo sapiens
ctgcccagtttgggagcctttc

SEQ ID NO: 7902599 - DNA, 22 bp, Homo sapiens
ctgcccaggggagtgctgtcgg

SEQ ID NO: 7902600 - DNA, 20 bp, Homo sapiens
ctgcccagccactgagggat

SEQ ID NO: 7902601 - DNA, 20 bp, Homo sapiens
ctgcccagccactgagggat

SEQ ID NO: 7902602 - DNA, 20 bp, Homo sapiens
ctgcccagccactgagggat

SEQ ID NO: 7902603 - DNA, 20 bp, Homo sapiens
ctgcccagccactgagggat

SEQ ID NO: 7902604 - DNA, 20 bp, Homo sapiens
ctgcccagccactgagggat

SEQ ID NO: 7902605 - DNA, 20 bp, Homo sapiens
ctgcccagccactgagggat

SEQ ID NO: 7902606 - DNA, 20 bp, Homo sapiens
ctgcccagccactgagggat

SEQ ID NO: 7902607 - DNA, 22 bp, Homo sapiens
ctgcccaggaaccagaggggca

SEQ ID NO: 7902608 - DNA, 22 bp, Homo sapiens
ctgcccaggaaccagaggggca

SEQ ID NO: 7902609 - DNA, 22 bp, Homo sapiens
ctgcccaggaaccagaggggca

SEQ ID NO: 7902610 - DNA, 20 bp, Homo sapiens
ctgcccagccactgagggat

SEQ ID NO: 7902611 - DNA, 20 bp, Homo sapiens
ctgcccagccactgagggat

SEQ ID NO: 7902612 - DNA, 18 bp, Homo sapiens
ctgccatgtcctactgtc

SEQ ID NO: 7902613 - DNA, 22 bp, Homo sapiens
ctgccatgttacctgcacaggt

SEQ ID NO: 7902614 - DNA, 22 bp, Homo sapiens
ctgccattggattttcacattt

SEQ ID NO: 7902615 - DNA, 22 bp, Homo sapiens
ctgcccaaatccttcttcctct

SEQ ID NO: 7902616 - DNA, 22 bp, Homo sapiens
ctgcccaagtggagtctccgca

SEQ ID NO: 7902617 - DNA, 22 bp, Homo sapiens
ctgccattaaagagcgttcaga

SEQ ID NO: 7902618 - DNA, 22 bp, Homo sapiens
ctgcccagattttaccacctgc

SEQ ID NO: 7902619 - DNA, 22 bp, Homo sapiens
ctgcccacacctgagctgggcc

SEQ ID NO: 7902620 - DNA, 22 bp, Homo sapiens
ctgcaggaggatcctgagagtg

SEQ ID NO: 7902621 - DNA, 22 bp, Homo sapiens
ctgcaggaggatcctgagagtg

SEQ ID NO: 7902622 - DNA, 22 bp, Homo sapiens
ctgcaggaggatcctgagagtg

SEQ ID NO: 7902623 - DNA, 22 bp, Homo sapiens
ctgcaggaggatcctgagagtg

SEQ ID NO: 7902624 - DNA, 22 bp, Homo sapiens
ctgcaggagcaagcctgggaga

SEQ ID NO: 7902625 - DNA, 22 bp, Homo sapiens
ctgcaggagcaagcctgggaga

SEQ ID NO: 7902626 - DNA, 22 bp, Homo sapiens
ctgcaggagcaaagcctctgct

SEQ ID NO: 7902627 - DNA, 22 bp, Homo sapiens
ctgcaggagcaaagcctctgct

SEQ ID NO: 7902628 - DNA, 22 bp, Homo sapiens
ctgcaggagtgaaagcaggcct

SEQ ID NO: 7902629 - DNA, 22 bp, Homo sapiens
ctgcaggagtgaaagcaggcct

SEQ ID NO: 7902630 - DNA, 22 bp, Homo sapiens
ctgcaggagggctggggaagcc

SEQ ID NO: 7902631 - DNA, 22 bp, Homo sapiens
ctgcaggaggatcctgagagtg

SEQ ID NO: 7902632 - DNA, 22 bp, Homo sapiens
ctgcaggaggatcctgagagtg

SEQ ID NO: 7902633 - DNA, 22 bp, Homo sapiens
ctgcaggagtgaaagcaggcct

SEQ ID NO: 7902634 - DNA, 21 bp, Homo sapiens
ctgcaggatgctgaagccagg

SEQ ID NO: 7902635 - DNA, 22 bp, Homo sapiens
ctgcaggatttcatgggctgac

SEQ ID NO: 7902636 - DNA, 22 bp, Homo sapiens
ctgcaggatttcatgggctgac

SEQ ID NO: 7902637 - DNA, 22 bp, Homo sapiens
ctgcaggcatctaactgtgggc

SEQ ID NO: 7902638 - DNA, 22 bp, Homo sapiens
ctgcaggcatctaactgtgggc

SEQ ID NO: 7902639 - DNA, 22 bp, Homo sapiens
ctgcaggcatctaactgtgggc

SEQ ID NO: 7902640 - DNA, 22 bp, Homo sapiens
ctgcaggatttcatgggctgac

SEQ ID NO: 7902641 - DNA, 22 bp, Homo sapiens
ctgcaggacgaccgcctcatct

SEQ ID NO: 7902642 - DNA, 22 bp, Homo sapiens
ctgcaggactgaaagatgaggt

SEQ ID NO: 7902643 - DNA, 22 bp, Homo sapiens
ctgcaggactgaaagatgaggt

SEQ ID NO: 7902644 - DNA, 22 bp, Homo sapiens
ctgcaggactgaaagatgaggt

SEQ ID NO: 7902645 - DNA, 22 bp, Homo sapiens
ctgcaggactgaaagatgaggt

SEQ ID NO: 7902646 - DNA, 22 bp, Homo sapiens
ctgcaggacagggaggagcaag

SEQ ID NO: 7902647 - DNA, 22 bp, Homo sapiens
ctgcaggacagggaggagcaag

SEQ ID NO: 7902648 - DNA, 22 bp, Homo sapiens
ctgcaggaattcaaagtgagct

SEQ ID NO: 7902649 - DNA, 22 bp, Homo sapiens
ctgcagctttcgctccatcagc

SEQ ID NO: 7902650 - DNA, 22 bp, Homo sapiens
ctgcagctttcgctccatcagc

SEQ ID NO: 7902651 - DNA, 22 bp, Homo sapiens
ctgcagctttttgtgcttgtaa

SEQ ID NO: 7902652 - DNA, 22 bp, Homo sapiens
ctgcaggaatctgtgctaggtg

SEQ ID NO: 7902653 - DNA, 22 bp, Homo sapiens
ctgcaggaatctgtgctaggtg

SEQ ID NO: 7902654 - DNA, 22 bp, Homo sapiens
ctgcaggaatctgtgctaggtg

SEQ ID NO: 7902655 - DNA, 22 bp, Homo sapiens
ctgcaggaattcaaagtgagct

SEQ ID NO: 7902656 - DNA, 22 bp, Homo sapiens
ctgcaggaatctgtgctaggtg

SEQ ID NO: 7902657 - DNA, 22 bp, Homo sapiens
ctgcagctgtgagtgctggatg

SEQ ID NO: 7902658 - DNA, 22 bp, Homo sapiens
ctgcagctgtgagtgctggatg

SEQ ID NO: 7902659 - DNA, 22 bp, Homo sapiens
ctgcagctgtgagtgctggatg

SEQ ID NO: 7902660 - DNA, 22 bp, Homo sapiens
ctgcagctgtgagtgctggatg

SEQ ID NO: 7902661 - DNA, 22 bp, Homo sapiens
ctgcagctgtgagtgctggatg

SEQ ID NO: 7902662 - DNA, 22 bp, Homo sapiens
ctgcagcttatttgctgtgtga

SEQ ID NO: 7902663 - DNA, 22 bp, Homo sapiens
ctgcagcttatttgctgtgtga

SEQ ID NO: 7902664 - DNA, 22 bp, Homo sapiens
ctgcagcttaaaggagttcaat

SEQ ID NO: 7902665 - DNA, 22 bp, Homo sapiens
ctgcagctgtagaggacagtgg

SEQ ID NO: 7902666 - DNA, 22 bp, Homo sapiens
ctgcagctgtagaggacagtgg

SEQ ID NO: 7902667 - DNA, 22 bp, Homo sapiens
ctgcagctgtctctactgggca

SEQ ID NO: 7902668 - DNA, 22 bp, Homo sapiens
ctgcagctgtctctactgggca

SEQ ID NO: 7902669 - DNA, 22 bp, Homo sapiens
ctgcagctgtctctactgggca

SEQ ID NO: 7902670 - DNA, 22 bp, Homo sapiens
ctgcagcctcaacctcctgagc

SEQ ID NO: 7902671 - DNA, 22 bp, Homo sapiens
ctgcagcctcaacctcctgagc

SEQ ID NO: 7902672 - DNA, 22 bp, Homo sapiens
ctgcagcctcaacctcctgagc

SEQ ID NO: 7902673 - DNA, 22 bp, Homo sapiens
ctgcagcctaggtgcagctggg

SEQ ID NO: 7902674 - DNA, 22 bp, Homo sapiens
ctgcagcctaggtgcagctggg

SEQ ID NO: 7902675 - DNA, 16 bp, Homo sapiens
ctgaggtttggccaca

SEQ ID NO: 7902676 - DNA, 22 bp, Homo sapiens
ctgaggtttacaagctattgct

SEQ ID NO: 7902677 - DNA, 22 bp, Homo sapiens
ctgcagcctaggtgcagctggg

SEQ ID NO: 7902678 - DNA, 23 bp, Homo sapiens
ctgcagccgcgtggggacgtgga

SEQ ID NO: 7902679 - DNA, 22 bp, Homo sapiens
ctgcagcctaggtgcagctggg

SEQ ID NO: 7902680 - DNA, 22 bp, Homo sapiens
ctgaggtgtggtctgggagtat

SEQ ID NO: 7902681 - DNA, 22 bp, Homo sapiens
ctgaggtgttgatgacctatgc

SEQ ID NO: 7902682 - DNA, 22 bp, Homo sapiens
ctgaggtgtttagtaggggcgg

SEQ ID NO: 7902683 - DNA, 22 bp, Homo sapiens
ctgaggtgtttagtaggggcgg

SEQ ID NO: 7902684 - DNA, 22 bp, Homo sapiens
ctgaggtgtgagccacttcccc

SEQ ID NO: 7902685 - DNA, 22 bp, Homo sapiens
ctgaggtgtgaaatggtggcaa

SEQ ID NO: 7902686 - DNA, 22 bp, Homo sapiens
ctgaggtgtgagccacttcccc

SEQ ID NO: 7902687 - DNA, 22 bp, Homo sapiens
ctgaggtgtgagccacttcccc

SEQ ID NO: 7902688 - DNA, 22 bp, Homo sapiens
ctgaggtgtgctttcaatgggt

SEQ ID NO: 7902689 - DNA, 22 bp, Homo sapiens
ctgaggtgtggtctgggagtat

SEQ ID NO: 7902690 - DNA, 22 bp, Homo sapiens
ctgaggtggcatcctagctcta

SEQ ID NO: 7902691 - DNA, 22 bp, Homo sapiens
ctgaggtggcatcctagctcta

SEQ ID NO: 7902692 - DNA, 22 bp, Homo sapiens
ctgaggtggcatcctagctcta

SEQ ID NO: 7902693 - DNA, 22 bp, Homo sapiens
ctgaggtggcatcctagctcta

SEQ ID NO: 7902694 - DNA, 22 bp, Homo sapiens
ctgaggtggaacagaggtgaag

SEQ ID NO: 7902695 - DNA, 23 bp, Homo sapiens
ctgaggtggagagtgaggtaagt

SEQ ID NO: 7902696 - DNA, 22 bp, Homo sapiens
ctgaggtggggcctgggcatca

SEQ ID NO: 7902697 - DNA, 22 bp, Homo sapiens
ctgaggtgggagtttttctcat

SEQ ID NO: 7902698 - DNA, 22 bp, Homo sapiens
ctgaggtggggcctgggcatca

SEQ ID NO: 7902699 - DNA, 22 bp, Homo sapiens
ctgaggtggggcctgggcatca

SEQ ID NO: 7902700 - DNA, 22 bp, Homo sapiens
ctgaggtgtgaaatggtggcaa

SEQ ID NO: 7902701 - DNA, 22 bp, Homo sapiens
ctgaggtggcctctgccgggga

SEQ ID NO: 7902702 - DNA, 22 bp, Homo sapiens
ctgaggtggcgcctctctttaa

SEQ ID NO: 7902703 - DNA, 22 bp, Homo sapiens
ctgaggtggcgcctctctttaa

SEQ ID NO: 7902704 - DNA, 19 bp, Homo sapiens
ctgaggtgcagtaagaggc

SEQ ID NO: 7902705 - DNA, 22 bp, Homo sapiens
ctgaggtgctagggtccctgct

SEQ ID NO: 7902706 - DNA, 22 bp, Homo sapiens
ctgaggtgctagggtccctgct

SEQ ID NO: 7902707 - DNA, 22 bp, Homo sapiens
ctgaggtgatgtcaaatgggtt

SEQ ID NO: 7902708 - DNA, 22 bp, Homo sapiens
ctgaggtgatgtcaaatgggtt

SEQ ID NO: 7902709 - DNA, 22 bp, Homo sapiens
ctgaggtgatgtcaaatgggtt

SEQ ID NO: 7902710 - DNA, 22 bp, Homo sapiens
ctgaggtgctatggaggatacg

SEQ ID NO: 7902711 - DNA, 22 bp, Homo sapiens
ctgaggtggaacagaggtgaag

SEQ ID NO: 7902712 - DNA, 22 bp, Homo sapiens
ctgaggtgctatggaggatacg

SEQ ID NO: 7902713 - DNA, 22 bp, Homo sapiens
ctgaggtgagaggaggccatgt

SEQ ID NO: 7902714 - DNA, 22 bp, Homo sapiens
ctgaggtgagaggaggccatgt

SEQ ID NO: 7902715 - DNA, 22 bp, Homo sapiens
ctgaggtgagaggaggccatgt

SEQ ID NO: 7902716 - DNA, 23 bp, Homo sapiens
ctgaggtctgcaattctagtagt

SEQ ID NO: 7902717 - DNA, 22 bp, Homo sapiens
ctgaggtctctttccatagtga

SEQ ID NO: 7902718 - DNA, 22 bp, Homo sapiens
ctgaggtctattttgaaactgc

SEQ ID NO: 7902719 - DNA, 23 bp, Homo sapiens
ctgaggtctgcaattctagtagt

SEQ ID NO: 7902720 - DNA, 22 bp, Homo sapiens
ctgaggtctctttccatagtga

SEQ ID NO: 7902721 - DNA, 22 bp, Homo sapiens
ctgaggtgagcttccctgggct

SEQ ID NO: 7902722 - DNA, 22 bp, Homo sapiens
ctgaggtgagaggaggccatgt

SEQ ID NO: 7902723 - DNA, 19 bp, Homo sapiens
ctgaggtgaggggcatcat

SEQ ID NO: 7902724 - DNA, 22 bp, Homo sapiens
ctgaggtgatggcccgttttcc

SEQ ID NO: 7902725 - DNA, 19 bp, Homo sapiens
ctgaggtgaggggcatcat

SEQ ID NO: 7902726 - DNA, 19 bp, Homo sapiens
ctgaggtgaggggcatcat

SEQ ID NO: 7902727 - DNA, 19 bp, Homo sapiens
ctgaggtgaggggcatcat

SEQ ID NO: 7902728 - DNA, 19 bp, Homo sapiens
ctgaggtgaggggcatcat

SEQ ID NO: 7902729 - DNA, 22 bp, Homo sapiens
ctgaggtgagcttccctgggct

SEQ ID NO: 7902730 - DNA, 17 bp, Homo sapiens
ctgaggggagtgctgtg

SEQ ID NO: 7902731 - DNA, 22 bp, Homo sapiens
ctgaggtcaggagttcaagctg

SEQ ID NO: 7902732 - DNA, 17 bp, Homo sapiens
ctgaggggagtgctgtg

SEQ ID NO: 7902733 - DNA, 17 bp, Homo sapiens
ctgaggggagtgctgtg

SEQ ID NO: 7902734 - DNA, 17 bp, Homo sapiens
ctgaggggagtgctgtg

SEQ ID NO: 7902735 - DNA, 17 bp, Homo sapiens
ctgaggggagtgctgtg

SEQ ID NO: 7902736 - DNA, 17 bp, Homo sapiens
ctgaggggagtgctgtg

SEQ ID NO: 7902737 - DNA, 22 bp, Homo sapiens
ctgaggtctattttgaaactgc

SEQ ID NO: 7902738 - DNA, 22 bp, Homo sapiens
ctgaggtctagacaccccaggg

SEQ ID NO: 7902739 - DNA, 22 bp, Homo sapiens
ctgaggtccttgactgcttgcc

SEQ ID NO: 7902740 - DNA, 22 bp, Homo sapiens
ctgaggtcctcagagggaaagg

SEQ ID NO: 7902741 - DNA, 18 bp, Homo sapiens
ctgaggctggcaggagcc

SEQ ID NO: 7902742 - DNA, 18 bp, Homo sapiens
ctgaggctggcaggagcc

SEQ ID NO: 7902743 - DNA, 18 bp, Homo sapiens
ctgaggctggcaggagcc

SEQ ID NO: 7902744 - DNA, 22 bp, Homo sapiens
ctgaggggaaaagtcaggatga

SEQ ID NO: 7902745 - DNA, 22 bp, Homo sapiens
ctgaggggaaaagtcaggatga

SEQ ID NO: 7902746 - DNA, 18 bp, Homo sapiens
ctgaggctggcaggagcc

SEQ ID NO: 7902747 - DNA, 22 bp, Homo sapiens
ctgaggctggagtgcagtggtg

SEQ ID NO: 7902748 - DNA, 18 bp, Homo sapiens
ctgaggctggcaggagcc

SEQ ID NO: 7902749 - DNA, 22 bp, Homo sapiens
ctgaggctggagtgcagtggtg

SEQ ID NO: 7902750 - DNA, 22 bp, Homo sapiens
ctgaggctggagtgcagtggtg

SEQ ID NO: 7902751 - DNA, 22 bp, Homo sapiens
ctgaggctccctcgggtctgct

SEQ ID NO: 7902752 - DNA, 22 bp, Homo sapiens
ctgaggctccctcgggtctgct

SEQ ID NO: 7902753 - DNA, 22 bp, Homo sapiens
ctgaggctccctcgggtctgct

SEQ ID NO: 7902754 - DNA, 22 bp, Homo sapiens
ctgaggctcagcgtgaggaaag

SEQ ID NO: 7902755 - DNA, 22 bp, Homo sapiens
ctgaggctcagcgtgaggaaag

SEQ ID NO: 7902756 - DNA, 22 bp, Homo sapiens
ctgaggctcagcgtgaggaaag

SEQ ID NO: 7902757 - DNA, 22 bp, Homo sapiens
ctgaggctctgagaaagccaaa

SEQ ID NO: 7902758 - DNA, 22 bp, Homo sapiens
ctgaggctccctcgggtctgct

SEQ ID NO: 7902759 - DNA, 22 bp, Homo sapiens
ctgaggctgaagagggcctacg

SEQ ID NO: 7902760 - DNA, 22 bp, Homo sapiens
ctgaggctctgggtgtcactgt

SEQ ID NO: 7902761 - DNA, 22 bp, Homo sapiens
ctgaggctgaagagggcctacg

SEQ ID NO: 7902762 - DNA, 22 bp, Homo sapiens
ctgaggctgaagagggcctacg

SEQ ID NO: 7902763 - DNA, 22 bp, Homo sapiens
ctgaggctctgagaaagccaaa

SEQ ID NO: 7902764 - DNA, 22 bp, Homo sapiens
ctgaggctctgggtgtcactgt

SEQ ID NO: 7902765 - DNA, 22 bp, Homo sapiens
ctgaggctgcccagggccaggt

SEQ ID NO: 7902766 - DNA, 22 bp, Homo sapiens
ctgaggctgcccagggccaggt

SEQ ID NO: 7902767 - DNA, 22 bp, Homo sapiens
ctgaggctgagacaggtgaaat

SEQ ID NO: 7902768 - DNA, 22 bp, Homo sapiens
ctgaggctgcccagggccaggt

SEQ ID NO: 7902769 - DNA, 22 bp, Homo sapiens
ctgaggctgcccagggccaggt

SEQ ID NO: 7902770 - DNA, 22 bp, Homo sapiens
ctgaggctgaagagggcctacg

SEQ ID NO: 7902771 - DNA, 22 bp, Homo sapiens
ctgaggctgagacaggtgaaat

SEQ ID NO: 7902772 - DNA, 22 bp, Homo sapiens
ctgaggctgagacaggtgaaat

SEQ ID NO: 7902773 - DNA, 22 bp, Homo sapiens
ctgaggctgcccagggccaggt

SEQ ID NO: 7902774 - DNA, 22 bp, Homo sapiens
ctgaggctggagtgcagtggtg

SEQ ID NO: 7902775 - DNA, 22 bp, Homo sapiens
ctgaggctggagtgcagtggtg

SEQ ID NO: 7902776 - DNA, 22 bp, Homo sapiens
ctgaggctggagtgcagtggtg

SEQ ID NO: 7902777 - DNA, 22 bp, Homo sapiens
ctgaggctggagtgcagtggtg

SEQ ID NO: 7902778 - DNA, 22 bp, Homo sapiens
ctgaggctggagtgcagtggtg

SEQ ID NO: 7902779 - DNA, 22 bp, Homo sapiens
ctgaggctggagtgcagtggtg

SEQ ID NO: 7902780 - DNA, 22 bp, Homo sapiens
ctgaggctcaagggcaggtggg

SEQ ID NO: 7902781 - DNA, 22 bp, Homo sapiens
ctgaggctcaagggcaggtggg

SEQ ID NO: 7902782 - DNA, 22 bp, Homo sapiens
ctgaggctcaagggcaggtggg

SEQ ID NO: 7902783 - DNA, 22 bp, Homo sapiens
ctgaggctcaagggcaggtggg

SEQ ID NO: 7902784 - DNA, 22 bp, Homo sapiens
ctgaggctagtataaagagcat

SEQ ID NO: 7902785 - DNA, 22 bp, Homo sapiens
ctgaggctaacctcgagagaca

SEQ ID NO: 7902786 - DNA, 22 bp, Homo sapiens
ctgaggctcaagggcaggtggg

SEQ ID NO: 7902787 - DNA, 22 bp, Homo sapiens
ctgaggctcaagggcaggtggg

SEQ ID NO: 7902788 - DNA, 22 bp, Homo sapiens
ctgaggctcaagggcaggtggg

SEQ ID NO: 7902789 - DNA, 22 bp, Homo sapiens
ctgaggctcagcgtgaggaaag

SEQ ID NO: 7902790 - DNA, 22 bp, Homo sapiens
ctgaggcctggtgaggtggtga

SEQ ID NO: 7902791 - DNA, 22 bp, Homo sapiens
ctgaggctaacctcgagagaca

SEQ ID NO: 7902792 - DNA, 22 bp, Homo sapiens
ctgaggcctgtgttggggcagt

SEQ ID NO: 7902793 - DNA, 22 bp, Homo sapiens
ctgaggctaacctcgagagaca

SEQ ID NO: 7902794 - DNA, 22 bp, Homo sapiens
ctgaggctaacctcgagagaca

SEQ ID NO: 7902795 - DNA, 22 bp, Homo sapiens
ctgaggctaacctcgagagaca

SEQ ID NO: 7902796 - DNA, 22 bp, Homo sapiens
ctgaggcctggccccaccacag

SEQ ID NO: 7902797 - DNA, 22 bp, Homo sapiens
ctgaggcctgggggcgtggacg

SEQ ID NO: 7902798 - DNA, 22 bp, Homo sapiens
ctgaggcctgggggcgtggacg

SEQ ID NO: 7902799 - DNA, 22 bp, Homo sapiens
ctgaggcctgggggcgtggacg

SEQ ID NO: 7902800 - DNA, 22 bp, Homo sapiens
ctgaggcctggtgaggtggtga

SEQ ID NO: 7902801 - DNA, 22 bp, Homo sapiens
ctgagccaaaaagcagagcttg

SEQ ID NO: 7902802 - DNA, 22 bp, Homo sapiens
ctgagccaaaaagcagagcttg

SEQ ID NO: 7902803 - DNA, 22 bp, Homo sapiens
ctgagccaaaaagcagagcttg

SEQ ID NO: 7902804 - DNA, 22 bp, Homo sapiens
ctgagccaaaaagcagagcttg

SEQ ID NO: 7902805 - DNA, 22 bp, Homo sapiens
ctgagcatttgtgcagcttctc

SEQ ID NO: 7902806 - DNA, 22 bp, Homo sapiens
ctgagcatgctacatgcagcac

SEQ ID NO: 7902807 - DNA, 22 bp, Homo sapiens
ctgagcatggccggtccatggt

SEQ ID NO: 7902808 - DNA, 22 bp, Homo sapiens
ctgagcatccagcaggtactgc

SEQ ID NO: 7902809 - DNA, 22 bp, Homo sapiens
ctgagccaaaaagcagagcttg

SEQ ID NO: 7902810 - DNA, 22 bp, Homo sapiens
ctgagccaaaaagcagagcttg

SEQ ID NO: 7902811 - DNA, 22 bp, Homo sapiens
ctgagccaaaaagcagagcttg

SEQ ID NO: 7902812 - DNA, 22 bp, Homo sapiens
ctgagccaaaaagcagagcttg

SEQ ID NO: 7902813 - DNA, 22 bp, Homo sapiens
ctgagccaaccacagcaggagc

SEQ ID NO: 7902814 - DNA, 22 bp, Homo sapiens
ctgaggccgtctgggtctgcag

SEQ ID NO: 7902815 - DNA, 22 bp, Homo sapiens
ctgaggccgtctgggtctgcag

SEQ ID NO: 7902816 - DNA, 22 bp, Homo sapiens
ctgaggccgttggtgggcctta

SEQ ID NO: 7902817 - DNA, 22 bp, Homo sapiens
ctgaggccgttggtgggcctta

SEQ ID NO: 7902818 - DNA, 22 bp, Homo sapiens
ctgaggccgttggtgggcctta

SEQ ID NO: 7902819 - DNA, 22 bp, Homo sapiens
ctgaggcctggccccaccacag

SEQ ID NO: 7902820 - DNA, 22 bp, Homo sapiens
ctgaggccgttggtgggcctta

SEQ ID NO: 7902821 - DNA, 23 bp, Homo sapiens
ctgaggcctgctgcgttcaggtt

SEQ ID NO: 7902822 - DNA, 22 bp, Homo sapiens
ctgagcagtggttcttgagcgc

SEQ ID NO: 7902823 - DNA, 22 bp, Homo sapiens
ctgagcagtggttcttgagcgc

SEQ ID NO: 7902824 - DNA, 22 bp, Homo sapiens
ctgagcagtgctttgcagtggg

SEQ ID NO: 7902825 - DNA, 22 bp, Homo sapiens
ctgagcagtgctttgcagtggg

SEQ ID NO: 7902826 - DNA, 22 bp, Homo sapiens
ctgagcagtgctttgcagtggg

SEQ ID NO: 7902827 - DNA, 22 bp, Homo sapiens
ctgagcagtgctttgcagtggg

SEQ ID NO: 7902828 - DNA, 22 bp, Homo sapiens
ctgagcagtctgactcaagcta

SEQ ID NO: 7902829 - DNA, 22 bp, Homo sapiens
ctgagcagtctgactcaagcta

SEQ ID NO: 7902830 - DNA, 19 bp, Homo sapiens
ctgagcaggcaggtaggat

SEQ ID NO: 7902831 - DNA, 19 bp, Homo sapiens
ctgagcaggcaggtaggat

SEQ ID NO: 7902832 - DNA, 22 bp, Homo sapiens
ctgagcaggcggtggagcggct

SEQ ID NO: 7902833 - DNA, 19 bp, Homo sapiens
ctgagcaggcaggtaggat

SEQ ID NO: 7902834 - DNA, 22 bp, Homo sapiens
ctgagcagggaccaaaagcatt

SEQ ID NO: 7902835 - DNA, 22 bp, Homo sapiens
ctgagcagtctagccaggtgtt

SEQ ID NO: 7902836 - DNA, 22 bp, Homo sapiens
ctgagcagtctagccaggtgtt

SEQ ID NO: 7902837 - DNA, 22 bp, Homo sapiens
ctgagcagtctagccaggtgtt

SEQ ID NO: 7902838 - DNA, 22 bp, Homo sapiens
ctgagcagtctagccaggtgtt

SEQ ID NO: 7902839 - DNA, 22 bp, Homo sapiens
ctgagcagtctagccaggtgtt

SEQ ID NO: 7902840 - DNA, 22 bp, Homo sapiens
ctgagcagtctagccaggtgtt

SEQ ID NO: 7902841 - DNA, 22 bp, Homo sapiens
ctgagcagggaccaaaagcatt

SEQ ID NO: 7902842 - DNA, 22 bp, Homo sapiens
ctgagcagaccatggcagaggt

SEQ ID NO: 7902843 - DNA, 22 bp, Homo sapiens
ctgagcagaccatggcagaggt

SEQ ID NO: 7902844 - DNA, 22 bp, Homo sapiens
ctcttcttgaaagaggaattca

SEQ ID NO: 7902845 - DNA, 22 bp, Homo sapiens
ctgagcagaagggtgcacgtgc

SEQ ID NO: 7902846 - DNA, 19 bp, Homo sapiens
ctgagcagcggcagcactt

SEQ ID NO: 7902847 - DNA, 19 bp, Homo sapiens
ctgagcagcggcagcactt

SEQ ID NO: 7902848 - DNA, 22 bp, Homo sapiens
ctgagcagaccatggcagaggt

SEQ ID NO: 7902849 - DNA, 22 bp, Homo sapiens
ctgagcagcgtggggagctggc

SEQ ID NO: 7902850 - DNA, 22 bp, Homo sapiens
ctgagcagcgtggggagctggc

SEQ ID NO: 7902851 - DNA, 22 bp, Homo sapiens
ctgagcaggacagtgggagacc

SEQ ID NO: 7902852 - DNA, 22 bp, Homo sapiens
ctgagcagctgttacagagtgt

SEQ ID NO: 7902853 - DNA, 22 bp, Homo sapiens
ctgagcagctgttacagagtgt

SEQ ID NO: 7902854 - DNA, 22 bp, Homo sapiens
ctgagcaggatattcacagcag

SEQ ID NO: 7902855 - DNA, 22 bp, Homo sapiens
ttttgcttgagtgcacaaaatg

SEQ ID NO: 7902856 - DNA, 22 bp, Homo sapiens
ttttgcttgagtgcacaaaatg

SEQ ID NO: 7902857 - DNA, 22 bp, Homo sapiens
ttttgcttatctgagtgcagcc

SEQ ID NO: 7902858 - DNA, 22 bp, Homo sapiens
ttttgcttatctgagtgcagcc

SEQ ID NO: 7902859 - DNA, 22 bp, Homo sapiens
ttttgcttatctgagtgcagcc

SEQ ID NO: 7902860 - DNA, 22 bp, Homo sapiens
ttttgcttttgtaacacagtgt

SEQ ID NO: 7902861 - DNA, 19 bp, Homo sapiens
ttttggaaatgtgaacagc

SEQ ID NO: 7902862 - DNA, 19 bp, Homo sapiens
ttttggaaatgtgaacagc

SEQ ID NO: 7902863 - DNA, 19 bp, Homo sapiens
ttttggaaatgtgaacagc

SEQ ID NO: 7902864 - DNA, 22 bp, Homo sapiens
ttttgctttaagatggagagga

SEQ ID NO: 7902865 - DNA, 22 bp, Homo sapiens
ttttgcttttgtaacacagtgt

SEQ ID NO: 7902866 - DNA, 22 bp, Homo sapiens
ttttgcttttgtaacacagtgt

SEQ ID NO: 7902867 - DNA, 22 bp, Homo sapiens
ttttgcttttgtaacacagtgt

SEQ ID NO: 7902868 - DNA, 22 bp, Homo sapiens
ttttgcttttgtaacacagtgt

SEQ ID NO: 7902869 - DNA, 22 bp, Homo sapiens
ttttggaacacagacattagaa

SEQ ID NO: 7902870 - DNA, 22 bp, Homo sapiens
ttttggaacacagacattagaa

SEQ ID NO: 7902871 - DNA, 22 bp, Homo sapiens
ttttggaacacagacattagaa

SEQ ID NO: 7902872 - DNA, 22 bp, Homo sapiens
ttttggaacacagacattagaa

SEQ ID NO: 7902873 - DNA, 22 bp, Homo sapiens
ttttggaatcatttacagagca

SEQ ID NO: 7902874 - DNA, 22 bp, Homo sapiens
ttttggaatcatttacagagca

SEQ ID NO: 7902875 - DNA, 22 bp, Homo sapiens
ttttggaatcatttacagagca

SEQ ID NO: 7902876 - DNA, 22 bp, Homo sapiens
ttttggaagccgcggctgggca

SEQ ID NO: 7902877 - DNA, 22 bp, Homo sapiens
ttttggaaccaacagtgcacct

SEQ ID NO: 7902878 - DNA, 22 bp, Homo sapiens
ttttggaaccaacagtgcacct

SEQ ID NO: 7902879 - DNA, 22 bp, Homo sapiens
ctcttcccagctccacgagagg

SEQ ID NO: 7902880 - DNA, 20 bp, Homo sapiens
ctcttccggaggggcgctcc

SEQ ID NO: 7902881 - DNA, 20 bp, Homo sapiens
ctcttccggaggggcgctcc

SEQ ID NO: 7902882 - DNA, 22 bp, Homo sapiens
ctcttcccagctccacgagagg

SEQ ID NO: 7902883 - DNA, 22 bp, Homo sapiens
ctcttcctacagtctgctatgc

SEQ ID NO: 7902884 - DNA, 22 bp, Homo sapiens
ctcttcctacagtctgctatgc

SEQ ID NO: 7902885 - DNA, 22 bp, Homo sapiens
ctcttcctacagtctgctatgc

SEQ ID NO: 7902886 - DNA, 22 bp, Homo sapiens
ctcttcctagtgtgcagcgtgg

SEQ ID NO: 7902887 - DNA, 22 bp, Homo sapiens
ctcttcctagtgtgcagcgtgg

SEQ ID NO: 7902888 - DNA, 22 bp, Homo sapiens
ctcttcctagtgtgcagcgtgg

SEQ ID NO: 7902889 - DNA, 22 bp, Homo sapiens
ctcttcctctcatgcggtcata

SEQ ID NO: 7902890 - DNA, 22 bp, Homo sapiens
ctcttcctctcatgcggtcata

SEQ ID NO: 7902891 - DNA, 22 bp, Homo sapiens
ctcttcctctcatgcggtcata

SEQ ID NO: 7902892 - DNA, 22 bp, Homo sapiens
ctcttcctagtgtgcagcgtgg

SEQ ID NO: 7902893 - DNA, 22 bp, Homo sapiens
ctcttcctagtgtgcagcgtgg

SEQ ID NO: 7902894 - DNA, 22 bp, Homo sapiens
ctcttcctctcatgcggtcata

SEQ ID NO: 7902895 - DNA, 22 bp, Homo sapiens
ctcttcctttcccttgagggtg

SEQ ID NO: 7902896 - DNA, 22 bp, Homo sapiens
ctcttctctgcagcctttgaag

SEQ ID NO: 7902897 - DNA, 22 bp, Homo sapiens
ctcttcctttcccttgagggtg

SEQ ID NO: 7902898 - DNA, 22 bp, Homo sapiens
ctcttccttaagactataaaga

SEQ ID NO: 7902899 - DNA, 22 bp, Homo sapiens
ctcttccttaagactataaaga

SEQ ID NO: 7902900 - DNA, 22 bp, Homo sapiens
ctcttcctttcccttgagggtg

SEQ ID NO: 7902901 - DNA, 22 bp, Homo sapiens
ctcttccttaagactataaaga

SEQ ID NO: 7902902 - DNA, 22 bp, Homo sapiens
ctcttccttaagactataaaga

SEQ ID NO: 7902903 - DNA, 22 bp, Homo sapiens
ctcttccttaagactataaaga

SEQ ID NO: 7902904 - DNA, 22 bp, Homo sapiens
ctcttcttatggccgtggctga

SEQ ID NO: 7902905 - DNA, 22 bp, Homo sapiens
ctcttcttgaaagaggaattca

SEQ ID NO: 7902906 - DNA, 22 bp, Homo sapiens
ctcttctctgcagcctttgaag

SEQ ID NO: 7902907 - DNA, 22 bp, Homo sapiens
ctcttctctgcagcctttgaag

SEQ ID NO: 7902908 - DNA, 22 bp, Homo sapiens
ctcttctctgcagcctttgaag

SEQ ID NO: 7902909 - DNA, 22 bp, Homo sapiens
ctcttctctgcagcctttgaag

SEQ ID NO: 7902910 - DNA, 22 bp, Homo sapiens
ctcttctctgcagcctttgaag

SEQ ID NO: 7902911 - DNA, 22 bp, Homo sapiens
ctcttctctgcagcctttgaag

SEQ ID NO: 7902912 - DNA, 22 bp, Homo sapiens
ctcttctgtacctcggcctcca

SEQ ID NO: 7902913 - DNA, 22 bp, Homo sapiens
ctcttctctgcagcctttgaag

SEQ ID NO: 7902914 - DNA, 22 bp, Homo sapiens
ctcttctgtacctcggcctcca

SEQ ID NO: 7902915 - DNA, 22 bp, Homo sapiens
ctcttctgtacctcggcctcca

SEQ ID NO: 7902916 - DNA, 22 bp, Homo sapiens
ctgctctgttcccccatcatct

SEQ ID NO: 7902917 - DNA, 22 bp, Homo sapiens
ctgctctgttcccccatcatct

SEQ ID NO: 7902918 - DNA, 22 bp, Homo sapiens
ctgctcttcacactacacccgt

SEQ ID NO: 7902919 - DNA, 22 bp, Homo sapiens
ctgctcttcacactacacccgt

SEQ ID NO: 7902920 - DNA, 22 bp, Homo sapiens
ctgctctgtttcttagctgggt

SEQ ID NO: 7902921 - DNA, 22 bp, Homo sapiens
ctgctctgtttcttagctgggt

SEQ ID NO: 7902922 - DNA, 22 bp, Homo sapiens
ctgctctgaccctttcaccttc

SEQ ID NO: 7902923 - DNA, 22 bp, Homo sapiens
ctgctctgagaggctcttccta

SEQ ID NO: 7902924 - DNA, 21 bp, Homo sapiens
ctgctctgacagtgaggccag

SEQ ID NO: 7902925 - DNA, 22 bp, Homo sapiens
ctgctctgtatatgagcaggaa

SEQ ID NO: 7902926 - DNA, 22 bp, Homo sapiens
ctgctctgagaggctcttccta

SEQ ID NO: 7902927 - DNA, 22 bp, Homo sapiens
ctgctctgtatatgagcaggaa

SEQ ID NO: 7902928 - DNA, 22 bp, Homo sapiens
ctgctctgtggtccatgagaca

SEQ ID NO: 7902929 - DNA, 22 bp, Homo sapiens
ctgctctgtggtccatgagaca

SEQ ID NO: 7902930 - DNA, 22 bp, Homo sapiens
ctgctctgtggtccatgagaca

SEQ ID NO: 7902931 - DNA, 22 bp, Homo sapiens
ctgctctgtggtccatgagaca

SEQ ID NO: 7902932 - DNA, 22 bp, Homo sapiens
ctgccttgcaccggctctctgg

SEQ ID NO: 7902933 - DNA, 22 bp, Homo sapiens
ctgccttggttcccagccagca

SEQ ID NO: 7902934 - DNA, 22 bp, Homo sapiens
ctgccttggtttctagcagggc

SEQ ID NO: 7902935 - DNA, 22 bp, Homo sapiens
ctgccttggttcccagccagca

SEQ ID NO: 7902936 - DNA, 22 bp, Homo sapiens
ctgcctttgaaagttctgttga

SEQ ID NO: 7902937 - DNA, 22 bp, Homo sapiens
ctgcctttgaaagttctgttga

SEQ ID NO: 7902938 - DNA, 22 bp, Homo sapiens
ctgccttgtcttgttttcaggg

SEQ ID NO: 7902939 - DNA, 22 bp, Homo sapiens
ctgcctttgcccttgacactgt

SEQ ID NO: 7902940 - DNA, 22 bp, Homo sapiens
ctgcctttgcccttgacactgt

SEQ ID NO: 7902941 - DNA, 21 bp, Homo sapiens
ctgctctgacagtgaggccag

SEQ ID NO: 7902942 - DNA, 21 bp, Homo sapiens
ctgctctgacagtgaggccag

SEQ ID NO: 7902943 - DNA, 22 bp, Homo sapiens
ctgcgcaggggtggcgccagaa

SEQ ID NO: 7902944 - DNA, 22 bp, Homo sapiens
ctgcgcaggggtggcgccagaa

SEQ ID NO: 7902945 - DNA, 22 bp, Homo sapiens
ctgcgcagcaatcagagaggag

SEQ ID NO: 7902946 - DNA, 22 bp, Homo sapiens
ctgccttttcatctgagctgga

SEQ ID NO: 7902947 - DNA, 22 bp, Homo sapiens
ctgcctttgtgatcagttcttt

SEQ ID NO: 7902948 - DNA, 22 bp, Homo sapiens
ctgcctttgtgatcagttcttt

SEQ ID NO: 7902949 - DNA, 22 bp, Homo sapiens
ctgccttttaaagccagtgtta

SEQ ID NO: 7902950 - DNA, 22 bp, Homo sapiens
ctgcctttgcccttgacactgt

SEQ ID NO: 7902951 - DNA, 22 bp, Homo sapiens
ctgcctttgcccttgacactgt

SEQ ID NO: 7902952 - DNA, 22 bp, Homo sapiens
ctgcctttggaagtccagagct

SEQ ID NO: 7902953 - DNA, 22 bp, Homo sapiens
ctgcctttggaagtccagagct

SEQ ID NO: 7902954 - DNA, 22 bp, Homo sapiens
ctgcctttggggagttagaggg

SEQ ID NO: 7902955 - DNA, 22 bp, Homo sapiens
ctgcctgtgggtacaagtggaa

SEQ ID NO: 7902956 - DNA, 22 bp, Homo sapiens
ctgcctgtgggtacaagtggaa

SEQ ID NO: 7902957 - DNA, 22 bp, Homo sapiens
ctgcctgtgtgtgcctgcagaa

SEQ ID NO: 7902958 - DNA, 22 bp, Homo sapiens
ctgcctgtggtctgtgatctaa

SEQ ID NO: 7902959 - DNA, 22 bp, Homo sapiens
ctgcctgtgtgtgcctgcagaa

SEQ ID NO: 7902960 - DNA, 22 bp, Homo sapiens
ctgcctgtgtgtgcctgcagaa

SEQ ID NO: 7902961 - DNA, 22 bp, Homo sapiens
ctgcctgtgtgtgcctgcagaa

SEQ ID NO: 7902962 - DNA, 22 bp, Homo sapiens
ctgcctgtgtgtgcctgcagaa

SEQ ID NO: 7902963 - DNA, 22 bp, Homo sapiens
ctgcctgttagtctagcagtta

SEQ ID NO: 7902964 - DNA, 19 bp, Homo sapiens
ctgcctgttatggagagaa

SEQ ID NO: 7902965 - DNA, 22 bp, Homo sapiens
ctgcctggggaatgtgaggatt

SEQ ID NO: 7902966 - DNA, 22 bp, Homo sapiens
ctgcctggggaatgtgaggatt

SEQ ID NO: 7902967 - DNA, 22 bp, Homo sapiens
ctgcctggggaatgtgaggatt

SEQ ID NO: 7902968 - DNA, 22 bp, Homo sapiens
ctgcctggggaatgtgaggatt

SEQ ID NO: 7902969 - DNA, 22 bp, Homo sapiens
ctgcctggggaatgtgaggatt

SEQ ID NO: 7902970 - DNA, 22 bp, Homo sapiens
ctgcctggggaatgtgaggatt

SEQ ID NO: 7902971 - DNA, 22 bp, Homo sapiens
ctgcccctgccaggcagctgtc

SEQ ID NO: 7902972 - DNA, 22 bp, Homo sapiens
ctgcccctgccaggcagctgtc

SEQ ID NO: 7902973 - DNA, 22 bp, Homo sapiens
ctgcctggggaatgtgaggatt

SEQ ID NO: 7902974 - DNA, 22 bp, Homo sapiens
ctgcctggggaatgtgaggatt

SEQ ID NO: 7902975 - DNA, 22 bp, Homo sapiens
ctgcctggggcatcagtcaagg

SEQ ID NO: 7902976 - DNA, 22 bp, Homo sapiens
ctgcctggggcatcagtcaagg

SEQ ID NO: 7902977 - DNA, 22 bp, Homo sapiens
ctgcctggggcatcagtcaagg

SEQ ID NO: 7902978 - DNA, 22 bp, Homo sapiens
ctgcctggggcatcagtcaagg

SEQ ID NO: 7902979 - DNA, 22 bp, Homo sapiens
ctgcctgtggacaccctggagg

SEQ ID NO: 7902980 - DNA, 22 bp, Homo sapiens
ctgccttccaaccccagactcc

SEQ ID NO: 7902981 - DNA, 22 bp, Homo sapiens
ctgccttccaaccccagactcc

SEQ ID NO: 7902982 - DNA, 22 bp, Homo sapiens
ctgccttccaaccccagactcc

SEQ ID NO: 7902983 - DNA, 22 bp, Homo sapiens
ctgccttcatctctgagctggg

SEQ ID NO: 7902984 - DNA, 22 bp, Homo sapiens
ctgccttcatctctgagctggg

SEQ ID NO: 7902985 - DNA, 22 bp, Homo sapiens
ctgccttccaaccccagactcc

SEQ ID NO: 7902986 - DNA, 22 bp, Homo sapiens
ctgccttccaaccccagactcc

SEQ ID NO: 7902987 - DNA, 22 bp, Homo sapiens
ctgccttgcaccggctctctgg

SEQ ID NO: 7902988 - DNA, 22 bp, Homo sapiens
ctgccttgaggaggttgtggga

SEQ ID NO: 7902989 - DNA, 22 bp, Homo sapiens
ctgccttgaggaggttgtggga

SEQ ID NO: 7902990 - DNA, 18 bp, Homo sapiens
ctgcctgttgctgagagg

SEQ ID NO: 7902991 - DNA, 22 bp, Homo sapiens
ctgcctgttcctgatcattcta

SEQ ID NO: 7902992 - DNA, 19 bp, Homo sapiens
ctgcctgttatggagagaa

SEQ ID NO: 7902993 - DNA, 22 bp, Homo sapiens
ctgcctgtttcctcttgctccc

SEQ ID NO: 7902994 - DNA, 22 bp, Homo sapiens
ctgcctgtttcctcttgctccc

SEQ ID NO: 7902995 - DNA, 22 bp, Homo sapiens
ctgcctgtttcctcttgctccc

SEQ ID NO: 7902996 - DNA, 22 bp, Homo sapiens
ctgcctgttttctgatagattt

SEQ ID NO: 7902997 - DNA, 22 bp, Homo sapiens
ctgccttcatctctgagctggg

SEQ ID NO: 7902998 - DNA, 22 bp, Homo sapiens
ctgctgggtctatgcaagtgga

SEQ ID NO: 7902999 - DNA, 22 bp, Homo sapiens
ctgctgggtctatgcaagtgga

SEQ ID NO: 7903000 - DNA, 22 bp, Homo sapiens
ctgctgggtctatgcaagtgga

SEQ ID NO: 7903001 - DNA, 22 bp, Homo sapiens
ctgctgggtctatgcaagtgga

SEQ ID NO: 7903002 - DNA, 22 bp, Homo sapiens
ctgctgggtctatgcaagtgga

SEQ ID NO: 7903003 - DNA, 22 bp, Homo sapiens
ctgctgggtctatgcaagtgga

SEQ ID NO: 7903004 - DNA, 22 bp, Homo sapiens
ctgctgggtccccctgctgatt

SEQ ID NO: 7903005 - DNA, 22 bp, Homo sapiens
ctgctgggtccccctgctgatt

SEQ ID NO: 7903006 - DNA, 22 bp, Homo sapiens
ctgctgggtccccctgctgatt

SEQ ID NO: 7903007 - DNA, 22 bp, Homo sapiens
ctgctgggtccccctgctgatt

SEQ ID NO: 7903008 - DNA, 22 bp, Homo sapiens
ctgctgggtccccctgctgatt

SEQ ID NO: 7903009 - DNA, 22 bp, Homo sapiens
ctgctggggtcagagcactggg

SEQ ID NO: 7903010 - DNA, 22 bp, Homo sapiens
ctgctgggtccccctgctgatt

SEQ ID NO: 7903011 - DNA, 22 bp, Homo sapiens
ctgctgggtccccctgctgatt

SEQ ID NO: 7903012 - DNA, 19 bp, Homo sapiens
ctgctgggtgctgagggag

SEQ ID NO: 7903013 - DNA, 22 bp, Homo sapiens
ctgctgggtttgcctttcacca

SEQ ID NO: 7903014 - DNA, 22 bp, Homo sapiens
ctgctggtaccagtggccgtca

SEQ ID NO: 7903015 - DNA, 22 bp, Homo sapiens
ctgctggtctctttggattgcg

SEQ ID NO: 7903016 - DNA, 22 bp, Homo sapiens
ctgctgggtttgcctttcacca

SEQ ID NO: 7903017 - DNA, 19 bp, Homo sapiens
ctgctgggtgctgagggag

SEQ ID NO: 7903018 - DNA, 19 bp, Homo sapiens
ctgctgggtgctgagggag

SEQ ID NO: 7903019 - DNA, 19 bp, Homo sapiens
ctgctgggtgctgagggag

SEQ ID NO: 7903020 - DNA, 19 bp, Homo sapiens
ctgctgggtgctgagggag

SEQ ID NO: 7903021 - DNA, 19 bp, Homo sapiens
ctgctgggtgctgagggag

SEQ ID NO: 7903022 - DNA, 22 bp, Homo sapiens
ctgctgtcaaaaatcactccat

SEQ ID NO: 7903023 - DNA, 22 bp, Homo sapiens
ctgctgtacttaggaagaggaa

SEQ ID NO: 7903024 - DNA, 22 bp, Homo sapiens
ctgctgtaatgagtcagcatct

SEQ ID NO: 7903025 - DNA, 22 bp, Homo sapiens
ctgctggtgcagagtggggctg

SEQ ID NO: 7903026 - DNA, 22 bp, Homo sapiens
ctgctggtgcagagtggggctg

SEQ ID NO: 7903027 - DNA, 22 bp, Homo sapiens
ctgctggtgggaatttacaaga

SEQ ID NO: 7903028 - DNA, 22 bp, Homo sapiens
ctgctggtgatgtctgggcatg

SEQ ID NO: 7903029 - DNA, 22 bp, Homo sapiens
ctgctggtgatgtctgggcatg

SEQ ID NO: 7903030 - DNA, 22 bp, Homo sapiens
ctgctggtctctttggattgcg

SEQ ID NO: 7903031 - DNA, 22 bp, Homo sapiens
ctgctggttagtcttagtggga

SEQ ID NO: 7903032 - DNA, 22 bp, Homo sapiens
ctgctggtgcagagtggggctg

SEQ ID NO: 7903033 - DNA, 22 bp, Homo sapiens
ctgctggttgcacagagctagg

SEQ ID NO: 7903034 - DNA, 22 bp, Homo sapiens
ctgctggttgcacagagctagg

SEQ ID NO: 7903035 - DNA, 22 bp, Homo sapiens
ctgctggttagtcttagtggga

SEQ ID NO: 7903036 - DNA, 22 bp, Homo sapiens
ctgctggttgcacagagctagg

SEQ ID NO: 7903037 - DNA, 22 bp, Homo sapiens
ctgctgtccaggagtgccctgt

SEQ ID NO: 7903038 - DNA, 22 bp, Homo sapiens
ctgctgtcccagcctcctcaca

SEQ ID NO: 7903039 - DNA, 22 bp, Homo sapiens
ctgctgtccaggagtgccctgt

SEQ ID NO: 7903040 - DNA, 22 bp, Homo sapiens
ctgctgtccaggagtgccctgt

SEQ ID NO: 7903041 - DNA, 22 bp, Homo sapiens
ctgctgtcctatctctttgttc

SEQ ID NO: 7903042 - DNA, 22 bp, Homo sapiens
ctgctgtccaacctgcactcgc

SEQ ID NO: 7903043 - DNA, 22 bp, Homo sapiens
ctgctgtccaacctgcactcgc

SEQ ID NO: 7903044 - DNA, 22 bp, Homo sapiens
ctgctgtcaaaggaaatatttg

SEQ ID NO: 7903045 - DNA, 22 bp, Homo sapiens
ctgctgtcatagccatccctcc

SEQ ID NO: 7903046 - DNA, 22 bp, Homo sapiens
ctgctcttcccactcactccca

SEQ ID NO: 7903047 - DNA, 22 bp, Homo sapiens
ctgctgaaaacaataatgatga

SEQ ID NO: 7903048 - DNA, 22 bp, Homo sapiens
ctgctcttgagggactgcggtc

SEQ ID NO: 7903049 - DNA, 22 bp, Homo sapiens
ctgctgaaaacaataatgatga

SEQ ID NO: 7903050 - DNA, 22 bp, Homo sapiens
ctgctgaacctttgctagataa

SEQ ID NO: 7903051 - DNA, 22 bp, Homo sapiens
ctgctgaagttcagctcctttt

SEQ ID NO: 7903052 - DNA, 22 bp, Homo sapiens
ctgctgaagttgttggtctttt

SEQ ID NO: 7903053 - DNA, 19 bp, Homo sapiens
ctgctgaattagctctgga

SEQ ID NO: 7903054 - DNA, 22 bp, Homo sapiens
ctgctgaatgtctctttggttt

SEQ ID NO: 7903055 - DNA, 19 bp, Homo sapiens
ctgctgaattagctctgga

SEQ ID NO: 7903056 - DNA, 22 bp, Homo sapiens
ctgctgacaaaataaaatgctc

SEQ ID NO: 7903057 - DNA, 22 bp, Homo sapiens
ctgctgagaaatgcatccagtt

SEQ ID NO: 7903058 - DNA, 22 bp, Homo sapiens
ctgctgagaaaagactgaggga

SEQ ID NO: 7903059 - DNA, 22 bp, Homo sapiens
ctgctgagaaaagactgaggga

SEQ ID NO: 7903060 - DNA, 22 bp, Homo sapiens
ctgctgagaaaagactgaggga

SEQ ID NO: 7903061 - DNA, 22 bp, Homo sapiens
ctgctgagactggctttgtgtc

SEQ ID NO: 7903062 - DNA, 22 bp, Homo sapiens
ctgctgagactggctttgtgtc

SEQ ID NO: 7903063 - DNA, 22 bp, Homo sapiens
ctgctgagactggctttgtgtc

SEQ ID NO: 7903064 - DNA, 22 bp, Homo sapiens
ctgctgagagatgccaatctca

SEQ ID NO: 7903065 - DNA, 22 bp, Homo sapiens
ctgctgagagatgccaatctca

SEQ ID NO: 7903066 - DNA, 20 bp, Homo sapiens
ctgctgagagcctggcttgc

SEQ ID NO: 7903067 - DNA, 20 bp, Homo sapiens
ctgctgagagcctggcttgc

SEQ ID NO: 7903068 - DNA, 20 bp, Homo sapiens
ctgctgagagcctggcttgc

SEQ ID NO: 7903069 - DNA, 22 bp, Homo sapiens
ctgctgagagctgaaggctgta

SEQ ID NO: 7903070 - DNA, 22 bp, Homo sapiens
ctgctgagagctgaaggctgta

SEQ ID NO: 7903071 - DNA, 22 bp, Homo sapiens
ctgctgagatgccaggagctct

SEQ ID NO: 7903072 - DNA, 22 bp, Homo sapiens
ctgctgggcagaggctgcatga

SEQ ID NO: 7903073 - DNA, 22 bp, Homo sapiens
ctgctgggcagaggctgcatga

SEQ ID NO: 7903074 - DNA, 22 bp, Homo sapiens
ctgctgggcagaggctgcatga

SEQ ID NO: 7903075 - DNA, 22 bp, Homo sapiens
ctgctgggaaggtctgctcagt

SEQ ID NO: 7903076 - DNA, 22 bp, Homo sapiens
ctgctgggcagaggctgcatga

SEQ ID NO: 7903077 - DNA, 22 bp, Homo sapiens
ctgctgggatagaagtatctca

SEQ ID NO: 7903078 - DNA, 22 bp, Homo sapiens
ctgctgggaaggtctgctcagt

SEQ ID NO: 7903079 - DNA, 22 bp, Homo sapiens
ctgctgagcatcagggctgccc

SEQ ID NO: 7903080 - DNA, 22 bp, Homo sapiens
ctgctgagcatcagggctgccc

SEQ ID NO: 7903081 - DNA, 22 bp, Homo sapiens
ctggagagttggaagatggact

SEQ ID NO: 7903082 - DNA, 22 bp, Homo sapiens
ctggagagttggaagatggact

SEQ ID NO: 7903083 - DNA, 22 bp, Homo sapiens
ctggagagtaatctctgtgtta

SEQ ID NO: 7903084 - DNA, 22 bp, Homo sapiens
ctggagagtaatctctgtgtta

SEQ ID NO: 7903085 - DNA, 22 bp, Homo sapiens
ctggagagtaatctctgtgtta

SEQ ID NO: 7903086 - DNA, 22 bp, Homo sapiens
ctggagagggagctgttggaag

SEQ ID NO: 7903087 - DNA, 22 bp, Homo sapiens
ctggagagggagctgttggaag

SEQ ID NO: 7903088 - DNA, 22 bp, Homo sapiens
ctggagagggagctgttggaag

SEQ ID NO: 7903089 - DNA, 22 bp, Homo sapiens
ctggagagggagctgttggaag

SEQ ID NO: 7903090 - DNA, 22 bp, Homo sapiens
ctggagagttggaagatggact

SEQ ID NO: 7903091 - DNA, 22 bp, Homo sapiens
ctggagagttggaagatggact

SEQ ID NO: 7903092 - DNA, 22 bp, Homo sapiens
ctggagagttggaagatggact

SEQ ID NO: 7903093 - DNA, 22 bp, Homo sapiens
ctggagagttggaagatggact

SEQ ID NO: 7903094 - DNA, 22 bp, Homo sapiens
ctggagagtaatctctgtgtta

SEQ ID NO: 7903095 - DNA, 22 bp, Homo sapiens
ctggagagttggaagatggact

SEQ ID NO: 7903096 - DNA, 22 bp, Homo sapiens
ctggagagttggaagatggact

SEQ ID NO: 7903097 - DNA, 22 bp, Homo sapiens
ctggagataagcagtcccaggc

SEQ ID NO: 7903098 - DNA, 22 bp, Homo sapiens
ctggagataagcagtcccaggc

SEQ ID NO: 7903099 - DNA, 22 bp, Homo sapiens
ctggagataagtaaagaggcaa

SEQ ID NO: 7903100 - DNA, 22 bp, Homo sapiens
ctggagagttggaagatggact

SEQ ID NO: 7903101 - DNA, 22 bp, Homo sapiens
ctggagataagcagtcccaggc

SEQ ID NO: 7903102 - DNA, 22 bp, Homo sapiens
ctggagatactgctctccatat

SEQ ID NO: 7903103 - DNA, 19 bp, Homo sapiens
ctggagatagggcctttaa

SEQ ID NO: 7903104 - DNA, 22 bp, Homo sapiens
ctggagatgtccgggtgctgtt

SEQ ID NO: 7903105 - DNA, 19 bp, Homo sapiens
ctggagatagggcctttaa

SEQ ID NO: 7903106 - DNA, 22 bp, Homo sapiens
ctggagatgtccgggtgctgtt

SEQ ID NO: 7903107 - DNA, 22 bp, Homo sapiens
ctggagatgtccgggtgctgtt

SEQ ID NO: 7903108 - DNA, 22 bp, Homo sapiens
ctggagatgtccgggtgctgtt

SEQ ID NO: 7903109 - DNA, 22 bp, Homo sapiens
ctggagcaaaagtgactcctct

SEQ ID NO: 7903110 - DNA, 22 bp, Homo sapiens
ctggagcaaaagtgactcctct

SEQ ID NO: 7903111 - DNA, 22 bp, Homo sapiens
ctggagcagcaggtggccaggg

SEQ ID NO: 7903112 - DNA, 22 bp, Homo sapiens
ctggagcagcaggtggccaggg

SEQ ID NO: 7903113 - DNA, 22 bp, Homo sapiens
ctggagcagcaggtggccaggg

SEQ ID NO: 7903114 - DNA, 22 bp, Homo sapiens
ctggagcagcaggtggccaggg

SEQ ID NO: 7903115 - DNA, 22 bp, Homo sapiens
ctggagagggagccctggcagt

SEQ ID NO: 7903116 - DNA, 22 bp, Homo sapiens
ctggagagggagccctggcagt

SEQ ID NO: 7903117 - DNA, 22 bp, Homo sapiens
ctggagaggctgggaacaggtt

SEQ ID NO: 7903118 - DNA, 22 bp, Homo sapiens
ctggagaggctgggaacaggtt

SEQ ID NO: 7903119 - DNA, 22 bp, Homo sapiens
ctggagaggctgggaacaggtt

SEQ ID NO: 7903120 - DNA, 22 bp, Homo sapiens
ctggagagggagctgttggaag

SEQ ID NO: 7903121 - DNA, 22 bp, Homo sapiens
ctggagagggagccctggcagt

SEQ ID NO: 7903122 - DNA, 22 bp, Homo sapiens
ctggagagggagccctggcagt

SEQ ID NO: 7903123 - DNA, 22 bp, Homo sapiens
ctggagagggagccctggcagt

SEQ ID NO: 7903124 - DNA, 22 bp, Homo sapiens
ctggagagggagccctggcagt

SEQ ID NO: 7903125 - DNA, 22 bp, Homo sapiens
ctggagagggagccctggcagt

SEQ ID NO: 7903126 - DNA, 22 bp, Homo sapiens
ctggagagggagccctggcagt

SEQ ID NO: 7903127 - DNA, 22 bp, Homo sapiens
ctggagaggctgggaacaggtt

SEQ ID NO: 7903128 - DNA, 22 bp, Homo sapiens
ctggagaggccccaagatattt

SEQ ID NO: 7903129 - DNA, 22 bp, Homo sapiens
ctggagagaccgaaagaggctg

SEQ ID NO: 7903130 - DNA, 22 bp, Homo sapiens
ctggagagagaaaaagccttaa

SEQ ID NO: 7903131 - DNA, 22 bp, Homo sapiens
ctggagagagaaaaagccttaa

SEQ ID NO: 7903132 - DNA, 22 bp, Homo sapiens
ctggagccctgaatgggcagga

SEQ ID NO: 7903133 - DNA, 22 bp, Homo sapiens
ctggagccctgaatgggcagga

SEQ ID NO: 7903134 - DNA, 22 bp, Homo sapiens
ctggagccccaggctgtgcaga

SEQ ID NO: 7903135 - DNA, 22 bp, Homo sapiens
ctggagccccaggctgtgcaga

SEQ ID NO: 7903136 - DNA, 22 bp, Homo sapiens
ctggagccctgaatgggcagga

SEQ ID NO: 7903137 - DNA, 22 bp, Homo sapiens
ctggagccccaggctgtgcaga

SEQ ID NO: 7903138 - DNA, 22 bp, Homo sapiens
ctggagcatccatgcccagggt

SEQ ID NO: 7903139 - DNA, 22 bp, Homo sapiens
ctggagccccaggctgtgcaga

SEQ ID NO: 7903140 - DNA, 22 bp, Homo sapiens
ctggagcaggtttaggagtccc

SEQ ID NO: 7903141 - DNA, 22 bp, Homo sapiens
ctggagcaggtttaggagtccc

SEQ ID NO: 7903142 - DNA, 22 bp, Homo sapiens
ctggagcatccatgcccagggt

SEQ ID NO: 7903143 - DNA, 22 bp, Homo sapiens
ctggagcatccatgcccagggt

SEQ ID NO: 7903144 - DNA, 22 bp, Homo sapiens
ctggagcatccatgcccagggt

SEQ ID NO: 7903145 - DNA, 22 bp, Homo sapiens
ctggagcaggtttaggagtccc

SEQ ID NO: 7903146 - DNA, 22 bp, Homo sapiens
ctggagcaggcttgtcccagct

SEQ ID NO: 7903147 - DNA, 22 bp, Homo sapiens
ctggagcaggtttaggagtccc

SEQ ID NO: 7903148 - DNA, 22 bp, Homo sapiens
ctggagcaggtttaggagtccc

SEQ ID NO: 7903149 - DNA, 22 bp, Homo sapiens
ctggagcaggcttgtcccagct

SEQ ID NO: 7903150 - DNA, 22 bp, Homo sapiens
ctggagcaggtttaggagtccc

SEQ ID NO: 7903151 - DNA, 22 bp, Homo sapiens
ctggagcaggtttaggagtccc

SEQ ID NO: 7903152 - DNA, 22 bp, Homo sapiens
ctggagcaggtttaggagtccc

SEQ ID NO: 7903153 - DNA, 22 bp, Homo sapiens
ctggagcaggtttaggagtccc

SEQ ID NO: 7903154 - DNA, 22 bp, Homo sapiens
ctggagcaggcttgtcccagct

SEQ ID NO: 7903155 - DNA, 22 bp, Homo sapiens
ctggagcagcaggtggccaggg

SEQ ID NO: 7903156 - DNA, 22 bp, Homo sapiens
ctggagcaggcttgtcccagct

SEQ ID NO: 7903157 - DNA, 22 bp, Homo sapiens
ctggagcaggcttgtcccagct

SEQ ID NO: 7903158 - DNA, 22 bp, Homo sapiens
ctggagcaggcttgtcccagct

SEQ ID NO: 7903159 - DNA, 22 bp, Homo sapiens
ctggagcagcaggtggccaggg

SEQ ID NO: 7903160 - DNA, 22 bp, Homo sapiens
ctggagccgcatggagcaggga

SEQ ID NO: 7903161 - DNA, 22 bp, Homo sapiens
ctggagccgcatggagcaggga

SEQ ID NO: 7903162 - DNA, 22 bp, Homo sapiens
ctggagccgcatggagcaggga

SEQ ID NO: 7903163 - DNA, 22 bp, Homo sapiens
ctggagccctgaatgggcagga

SEQ ID NO: 7903164 - DNA, 22 bp, Homo sapiens
ctggagccctgaatgggcagga

SEQ ID NO: 7903165 - DNA, 22 bp, Homo sapiens
ctggagccctgaatgggcagga

SEQ ID NO: 7903166 - DNA, 22 bp, Homo sapiens
ctggagccctgaatgggcagga

SEQ ID NO: 7903167 - DNA, 22 bp, Homo sapiens
ctggagccgcatggagcaggga

SEQ ID NO: 7903168 - DNA, 22 bp, Homo sapiens
ctggagccggcgagccccagcc

SEQ ID NO: 7903169 - DNA, 22 bp, Homo sapiens
ctggagccggaccagggacggt

SEQ ID NO: 7903170 - DNA, 22 bp, Homo sapiens
ctggagccggaccagggacggt

SEQ ID NO: 7903171 - DNA, 22 bp, Homo sapiens
ctggagccggaccagggacggt

SEQ ID NO: 7903172 - DNA, 22 bp, Homo sapiens
ctggagccggaccagggacggt

SEQ ID NO: 7903173 - DNA, 22 bp, Homo sapiens
ctggagccggaccagggacggt

SEQ ID NO: 7903174 - DNA, 22 bp, Homo sapiens
ctggagccgcatggagcaggga

SEQ ID NO: 7903175 - DNA, 22 bp, Homo sapiens
ctggagcctaggttgacctggg

SEQ ID NO: 7903176 - DNA, 22 bp, Homo sapiens
ctggagcctaggttgacctggg

SEQ ID NO: 7903177 - DNA, 22 bp, Homo sapiens
ctggagcctgcagttttcactt

SEQ ID NO: 7903178 - DNA, 17 bp, Homo sapiens
ctggagcctccaactcc

SEQ ID NO: 7903179 - DNA, 22 bp, Homo sapiens
ctggagccggcgagccccagcc

SEQ ID NO: 7903180 - DNA, 22 bp, Homo sapiens
ctggagccggcgagccccagcc

SEQ ID NO: 7903181 - DNA, 22 bp, Homo sapiens
ctggagccggcgagccccagcc

SEQ ID NO: 7903182 - DNA, 22 bp, Homo sapiens
ctggagccggcgagccccagcc

SEQ ID NO: 7903183 - DNA, 22 bp, Homo sapiens
ctggagcctaggttgacctggg

SEQ ID NO: 7903184 - DNA, 22 bp, Homo sapiens
ctggagccggcgagccccagcc

SEQ ID NO: 7903185 - DNA, 22 bp, Homo sapiens
ctgctgtctttatttcactgct

SEQ ID NO: 7903186 - DNA, 22 bp, Homo sapiens
ctgctgtctttatttcactgct

SEQ ID NO: 7903187 - DNA, 22 bp, Homo sapiens
ctgctgtctttatttcactgct

SEQ ID NO: 7903188 - DNA, 23 bp, Homo sapiens
ctgctgtgaaacatggttttggt

SEQ ID NO: 7903189 - DNA, 22 bp, Homo sapiens
ctgctgtctcactggtgtggtt

SEQ ID NO: 7903190 - DNA, 22 bp, Homo sapiens
ctgctgtctcactggtgtggtt

SEQ ID NO: 7903191 - DNA, 22 bp, Homo sapiens
ctgctgtctcactggtgtggtt

SEQ ID NO: 7903192 - DNA, 22 bp, Homo sapiens
ctgctgtgagtggttcttgcct

SEQ ID NO: 7903193 - DNA, 22 bp, Homo sapiens
ctgctgtgagtggttcttgcct

SEQ ID NO: 7903194 - DNA, 22 bp, Homo sapiens
ctgctgtgagcactccagcctg

SEQ ID NO: 7903195 - DNA, 22 bp, Homo sapiens
ctgctgtgacagctgccgtgtt

SEQ ID NO: 7903196 - DNA, 22 bp, Homo sapiens
ctgctgtgacagctgccgtgtt

SEQ ID NO: 7903197 - DNA, 22 bp, Homo sapiens
ctgctgtgagcactccagcctg

SEQ ID NO: 7903198 - DNA, 22 bp, Homo sapiens
ctggaaagtgcatgtaatgagg

SEQ ID NO: 7903199 - DNA, 22 bp, Homo sapiens
ctggaaagtgcttttctgagag

SEQ ID NO: 7903200 - DNA, 22 bp, Homo sapiens
ctggaaagtgctgagacaattg

SEQ ID NO: 7903201 - DNA, 22 bp, Homo sapiens
ctggaaagtgcttttctgagag

SEQ ID NO: 7903202 - DNA, 22 bp, Homo sapiens
ctggaaagtgcttttctgagag

SEQ ID NO: 7903203 - DNA, 22 bp, Homo sapiens
ctgctgtgagtttggaggtcta

SEQ ID NO: 7903204 - DNA, 22 bp, Homo sapiens
ctgctgtgagtttggaggtcta

SEQ ID NO: 7903205 - DNA, 22 bp, Homo sapiens
ctggaaagtcaggtcagaaact

SEQ ID NO: 7903206 - DNA, 22 bp, Homo sapiens
ctggaaagtgaggagagttcca

SEQ ID NO: 7903207 - DNA, 22 bp, Homo sapiens
ctgctgtgagtttggaggtcta

SEQ ID NO: 7903208 - DNA, 22 bp, Homo sapiens
ctggaaggagaaggaggctgtg

SEQ ID NO: 7903209 - DNA, 22 bp, Homo sapiens
ctggaaggagaaggaggctgtg

SEQ ID NO: 7903210 - DNA, 22 bp, Homo sapiens
ctggaagcttgtttgccagtct

SEQ ID NO: 7903211 - DNA, 22 bp, Homo sapiens
ctggaagctggaacaggtgtgg

SEQ ID NO: 7903212 - DNA, 22 bp, Homo sapiens
ctggaaggagaaggaggctgtg

SEQ ID NO: 7903213 - DNA, 22 bp, Homo sapiens
ctggaaggagaaggaggctgtg

SEQ ID NO: 7903214 - DNA, 20 bp, Homo sapiens
ctggaagcctttccagagca

SEQ ID NO: 7903215 - DNA, 20 bp, Homo sapiens
ctggaagcctttccagagca

SEQ ID NO: 7903216 - DNA, 22 bp, Homo sapiens
ctggaagctggaacaggtgtgg

SEQ ID NO: 7903217 - DNA, 22 bp, Homo sapiens
ctggaagcgtcggaggaagggc

SEQ ID NO: 7903218 - DNA, 22 bp, Homo sapiens
ctggaagctaacatccttttcc

SEQ ID NO: 7903219 - DNA, 22 bp, Homo sapiens
ctggaagagtgactttgcattt

SEQ ID NO: 7903220 - DNA, 22 bp, Homo sapiens
ctggaagagtgactttgcattt

SEQ ID NO: 7903221 - DNA, 20 bp, Homo sapiens
ctggaagcctttccagagca

SEQ ID NO: 7903222 - DNA, 20 bp, Homo sapiens
ctggaagcctttccagagca

SEQ ID NO: 7903223 - DNA, 22 bp, Homo sapiens
ctggaagagtgactttgcattt

SEQ ID NO: 7903224 - DNA, 22 bp, Homo sapiens
ctggaagagtcctaaacagata

SEQ ID NO: 7903225 - DNA, 22 bp, Homo sapiens
ctggaagagtcctaaacagata

SEQ ID NO: 7903226 - DNA, 22 bp, Homo sapiens
ctggaagagtcctaaacagata

SEQ ID NO: 7903227 - DNA, 22 bp, Homo sapiens
ctggaagagtaatataaattag

SEQ ID NO: 7903228 - DNA, 22 bp, Homo sapiens
ctggaagagtaatataaattag

SEQ ID NO: 7903229 - DNA, 22 bp, Homo sapiens
ctggaagaggggaaatgccatg

SEQ ID NO: 7903230 - DNA, 22 bp, Homo sapiens
ctggaagaggaagccagctgga

SEQ ID NO: 7903231 - DNA, 22 bp, Homo sapiens
ctggaagaggacacacgaatca

SEQ ID NO: 7903232 - DNA, 22 bp, Homo sapiens
ctggaagaggggaaatgccatg

SEQ ID NO: 7903233 - DNA, 22 bp, Homo sapiens
ctggaagaggacacacgaatca

SEQ ID NO: 7903234 - DNA, 22 bp, Homo sapiens
ctggaaggagaaggaggctgtg

SEQ ID NO: 7903235 - DNA, 19 bp, Homo sapiens
ctggaaggagggactgttc

SEQ ID NO: 7903236 - DNA, 22 bp, Homo sapiens
ctggaaggagcccgggcggatc

SEQ ID NO: 7903237 - DNA, 19 bp, Homo sapiens
ctggaaggagggactgttc

SEQ ID NO: 7903238 - DNA, 22 bp, Homo sapiens
ctggaaggcggaggttgtagtg

SEQ ID NO: 7903239 - DNA, 22 bp, Homo sapiens
ctggaaggctctgctgcctgtc

SEQ ID NO: 7903240 - DNA, 22 bp, Homo sapiens
ctggaaggcggaggttgtagtg

SEQ ID NO: 7903241 - DNA, 22 bp, Homo sapiens
ctggaaggcggaggttgtagtg

SEQ ID NO: 7903242 - DNA, 22 bp, Homo sapiens
ctggaaggcagaggttgcagtg

SEQ ID NO: 7903243 - DNA, 22 bp, Homo sapiens
ctggaagggtcagagtgatgag

SEQ ID NO: 7903244 - DNA, 22 bp, Homo sapiens
ctggaagggtcagagtgatgag

SEQ ID NO: 7903245 - DNA, 22 bp, Homo sapiens
ctggaagggtacataggaaact

SEQ ID NO: 7903246 - DNA, 22 bp, Homo sapiens
ctggaagggtacataggaaact

SEQ ID NO: 7903247 - DNA, 22 bp, Homo sapiens
ctggaagggtacataggaaact

SEQ ID NO: 7903248 - DNA, 22 bp, Homo sapiens
ctggaagggagcactgtagaga

SEQ ID NO: 7903249 - DNA, 22 bp, Homo sapiens
ctggaagggagcactgtagaga

SEQ ID NO: 7903250 - DNA, 22 bp, Homo sapiens
ctggaagggggacagccacaca

SEQ ID NO: 7903251 - DNA, 22 bp, Homo sapiens
ctggaagggggacagccacaca

SEQ ID NO: 7903252 - DNA, 22 bp, Homo sapiens
ctggaaggggcagtctttgggc

SEQ ID NO: 7903253 - DNA, 22 bp, Homo sapiens
ctggaagggggacagccacaca

SEQ ID NO: 7903254 - DNA, 22 bp, Homo sapiens
ctggaagggagcactgtagaga

SEQ ID NO: 7903255 - DNA, 22 bp, Homo sapiens
ctggaagggagcactgtagaga

SEQ ID NO: 7903256 - DNA, 22 bp, Homo sapiens
ctggaagggagcactgtagaga

SEQ ID NO: 7903257 - DNA, 22 bp, Homo sapiens
ctggaagggaaatctcttggca

SEQ ID NO: 7903258 - DNA, 22 bp, Homo sapiens
ctggaagggaaatctcttggca

SEQ ID NO: 7903259 - DNA, 22 bp, Homo sapiens
ctggaaggtggatggcgaggcc

SEQ ID NO: 7903260 - DNA, 22 bp, Homo sapiens
ctggaaggtggatggcgaggcc

SEQ ID NO: 7903261 - DNA, 22 bp, Homo sapiens
ctggaaggtgactgtcttgaat

SEQ ID NO: 7903262 - DNA, 22 bp, Homo sapiens
ctggaagggtcagagtgatgag

SEQ ID NO: 7903263 - DNA, 22 bp, Homo sapiens
ctggaaggttcctcccagctcc

SEQ ID NO: 7903264 - DNA, 22 bp, Homo sapiens
ctggaaggttcctcccagctcc

SEQ ID NO: 7903265 - DNA, 22 bp, Homo sapiens
ctggaaggttctttgtgtgcct

SEQ ID NO: 7903266 - DNA, 22 bp, Homo sapiens
ctggagaaaatccatgtgtatg

SEQ ID NO: 7903267 - DNA, 22 bp, Homo sapiens
ctggagaaacatcaggcatagg

SEQ ID NO: 7903268 - DNA, 22 bp, Homo sapiens
ctggagaaacatcaggcatagg

SEQ ID NO: 7903269 - DNA, 22 bp, Homo sapiens
ctggagaactagttaaacacgt

SEQ ID NO: 7903270 - DNA, 22 bp, Homo sapiens
ctggagaacagagctgtttaga

SEQ ID NO: 7903271 - DNA, 22 bp, Homo sapiens
ctggagaactagttaaacacgt

SEQ ID NO: 7903272 - DNA, 22 bp, Homo sapiens
ctggagagaccgaaagaggctg

SEQ ID NO: 7903273 - DNA, 22 bp, Homo sapiens
ctggagagaccgaaagaggctg

SEQ ID NO: 7903274 - DNA, 22 bp, Homo sapiens
ctctgcactgtccggctttctt

SEQ ID NO: 7903275 - DNA, 22 bp, Homo sapiens
ctctgcaccttgtaggaggcaa

SEQ ID NO: 7903276 - DNA, 22 bp, Homo sapiens
ctctgcacctacacaacaggaa

SEQ ID NO: 7903277 - DNA, 22 bp, Homo sapiens
ctctgcaccttgtaggaggcaa

SEQ ID NO: 7903278 - DNA, 22 bp, Homo sapiens
ctctgcaccttgtaggaggcaa

SEQ ID NO: 7903279 - DNA, 22 bp, Homo sapiens
ctctgcactgtccggctttctt

SEQ ID NO: 7903280 - DNA, 22 bp, Homo sapiens
ctctgcagaatttgagctgctc

SEQ ID NO: 7903281 - DNA, 22 bp, Homo sapiens
ctctgcagagcctccagcccag

SEQ ID NO: 7903282 - DNA, 22 bp, Homo sapiens
ctctgcagaatttgagctgctc

SEQ ID NO: 7903283 - DNA, 22 bp, Homo sapiens
ctctgcagaatttgagctgctc

SEQ ID NO: 7903284 - DNA, 22 bp, Homo sapiens
ctctgcagaggcccaaggctga

SEQ ID NO: 7903285 - DNA, 22 bp, Homo sapiens
ctctgcagaggcccaaggctga

SEQ ID NO: 7903286 - DNA, 22 bp, Homo sapiens
tttgactcaagccctcatgtta

SEQ ID NO: 7903287 - DNA, 22 bp, Homo sapiens
tttgaccctgttattctccctg

SEQ ID NO: 7903288 - DNA, 22 bp, Homo sapiens
tttgaccgtatcatattgacag

SEQ ID NO: 7903289 - DNA, 22 bp, Homo sapiens
tttgactcagcaaattcacagg

SEQ ID NO: 7903290 - DNA, 22 bp, Homo sapiens
tttgactcaagcctttctttag

SEQ ID NO: 7903291 - DNA, 22 bp, Homo sapiens
tttgactcagcaaattcacagg

SEQ ID NO: 7903292 - DNA, 22 bp, Homo sapiens
tttgactcaagcctttctttag

SEQ ID NO: 7903293 - DNA, 22 bp, Homo sapiens
tttgactcattaaagtctccgt

SEQ ID NO: 7903294 - DNA, 22 bp, Homo sapiens
tttgactcagtggacgtactag

SEQ ID NO: 7903295 - DNA, 20 bp, Homo sapiens
tttgactcaggcctttagcc

SEQ ID NO: 7903296 - DNA, 22 bp, Homo sapiens
tttgactcattgattttctctg

SEQ ID NO: 7903297 - DNA, 22 bp, Homo sapiens
ctctgcagaggcccaaggctga

SEQ ID NO: 7903298 - DNA, 22 bp, Homo sapiens
tttgaataatcactgggcatta

SEQ ID NO: 7903299 - DNA, 22 bp, Homo sapiens
tttgaataatcactgggcatta

SEQ ID NO: 7903300 - DNA, 21 bp, Homo sapiens
tttgaatagaaatagtgctta

SEQ ID NO: 7903301 - DNA, 22 bp, Homo sapiens
tttgaatagaggcccctcagaa

SEQ ID NO: 7903302 - DNA, 22 bp, Homo sapiens
tttgacattggcttattctgtt

SEQ ID NO: 7903303 - DNA, 22 bp, Homo sapiens
tttgaccagaggtccctggaaa

SEQ ID NO: 7903304 - DNA, 23 bp, Homo sapiens
ctctgcaccaggtggttttcagc

SEQ ID NO: 7903305 - DNA, 22 bp, Homo sapiens
ctctgcacccccggctcctcgt

SEQ ID NO: 7903306 - DNA, 22 bp, Homo sapiens
ctctgcacccccggctcctcgt

SEQ ID NO: 7903307 - DNA, 22 bp, Homo sapiens
ctctgcacctacacaacaggaa

SEQ ID NO: 7903308 - DNA, 22 bp, Homo sapiens
ctctgcacacaagtaatttcat

SEQ ID NO: 7903309 - DNA, 22 bp, Homo sapiens
ctctgcaaggccctccagtagc

SEQ ID NO: 7903310 - DNA, 22 bp, Homo sapiens
ctctgcaacttctagcagtgtc

SEQ ID NO: 7903311 - DNA, 22 bp, Homo sapiens
ctctgcaacttctagcagtgtc

SEQ ID NO: 7903312 - DNA, 22 bp, Homo sapiens
ctctgatttccttattctgtca

SEQ ID NO: 7903313 - DNA, 22 bp, Homo sapiens
ctctgagtttcatttccctcct

SEQ ID NO: 7903314 - DNA, 22 bp, Homo sapiens
ctctgatgtctgggggctggat

SEQ ID NO: 7903315 - DNA, 22 bp, Homo sapiens
ctctgatgtgaccacgtagaca

SEQ ID NO: 7903316 - DNA, 22 bp, Homo sapiens
ctctgaggtttcctcacaagct

SEQ ID NO: 7903317 - DNA, 22 bp, Homo sapiens
tttgaaagagctgatacatgaa

SEQ ID NO: 7903318 - DNA, 22 bp, Homo sapiens
ctctgaggttccctgggtccca

SEQ ID NO: 7903319 - DNA, 22 bp, Homo sapiens
ctctgaggttccctgggtccca

SEQ ID NO: 7903320 - DNA, 22 bp, Homo sapiens
ctctgaggtctaggaccatggc

SEQ ID NO: 7903321 - DNA, 22 bp, Homo sapiens
ctctgaggtctaggaccatggc

SEQ ID NO: 7903322 - DNA, 22 bp, Homo sapiens
ctctgaggtctaggaccatggc

SEQ ID NO: 7903323 - DNA, 22 bp, Homo sapiens
ctctgaggttcctttgccctcg

SEQ ID NO: 7903324 - DNA, 22 bp, Homo sapiens
ctctgaggttccctgggtccca

SEQ ID NO: 7903325 - DNA, 22 bp, Homo sapiens
tttgaaaaaggcctttggtatg

SEQ ID NO: 7903326 - DNA, 22 bp, Homo sapiens
tttgaaaaaggcctttggtatg

SEQ ID NO: 7903327 - DNA, 22 bp, Homo sapiens
tttcttgtaagatgtttattaa

SEQ ID NO: 7903328 - DNA, 22 bp, Homo sapiens
tttgaaaacttaatttggtcgt

SEQ ID NO: 7903329 - DNA, 22 bp, Homo sapiens
tttgaaaagaaccatcgcctta

SEQ ID NO: 7903330 - DNA, 22 bp, Homo sapiens
tttgaaaagaaccatcgcctta

SEQ ID NO: 7903331 - DNA, 22 bp, Homo sapiens
ctctgaagatggtaccagcttt

SEQ ID NO: 7903332 - DNA, 22 bp, Homo sapiens
ctctgaagatggtaccagcttt

SEQ ID NO: 7903333 - DNA, 22 bp, Homo sapiens
ctctgaaggtttctgttactgt

SEQ ID NO: 7903334 - DNA, 22 bp, Homo sapiens
ctctgaaggtttctgttactgt

SEQ ID NO: 7903335 - DNA, 22 bp, Homo sapiens
ctctgaaggtttctgttactgt

SEQ ID NO: 7903336 - DNA, 22 bp, Homo sapiens
ctctgaagggagggccaagccc

SEQ ID NO: 7903337 - DNA, 22 bp, Homo sapiens
ctctgaagggagggccaagccc

SEQ ID NO: 7903338 - DNA, 22 bp, Homo sapiens
ctctgaagccccaaatagtccg

SEQ ID NO: 7903339 - DNA, 22 bp, Homo sapiens
ctctgaagccccaaatagtccg

SEQ ID NO: 7903340 - DNA, 22 bp, Homo sapiens
tttcttgattagctgtggctca

SEQ ID NO: 7903341 - DNA, 22 bp, Homo sapiens
ctctgacagccacatagaggct

SEQ ID NO: 7903342 - DNA, 22 bp, Homo sapiens
tttcttgccagagaaaaagagt

SEQ ID NO: 7903343 - DNA, 22 bp, Homo sapiens
ctctgaatggacactccagtgt

SEQ ID NO: 7903344 - DNA, 21 bp, Homo sapiens
ctctgaatcctgcttctcagt

SEQ ID NO: 7903345 - DNA, 22 bp, Homo sapiens
ctctgaaggtttctgttactgt

SEQ ID NO: 7903346 - DNA, 22 bp, Homo sapiens
tttgaaactcatgatcatcact

SEQ ID NO: 7903347 - DNA, 22 bp, Homo sapiens
tttgaaactctgaacatgtttc

SEQ ID NO: 7903348 - DNA, 22 bp, Homo sapiens
tttgaaactctgaacatgtttc

SEQ ID NO: 7903349 - DNA, 22 bp, Homo sapiens
tttgaaactctgaacatgtttc

SEQ ID NO: 7903350 - DNA, 22 bp, Homo sapiens
tttgaaactcatgatcatcact

SEQ ID NO: 7903351 - DNA, 22 bp, Homo sapiens
tttgaaaatttaagtgctacac

SEQ ID NO: 7903352 - DNA, 22 bp, Homo sapiens
tttgaaaatttaagtgctacac

SEQ ID NO: 7903353 - DNA, 22 bp, Homo sapiens
tttgaaaattagacacaggcta

SEQ ID NO: 7903354 - DNA, 22 bp, Homo sapiens
tttgaaacctagttatatgact

SEQ ID NO: 7903355 - DNA, 22 bp, Homo sapiens
tttgaaacctagttatatgact

SEQ ID NO: 7903356 - DNA, 22 bp, Homo sapiens
tttgaaacctagttatatgact

SEQ ID NO: 7903357 - DNA, 22 bp, Homo sapiens
tttgaaacccgtcactttgagt

SEQ ID NO: 7903358 - DNA, 22 bp, Homo sapiens
tttgaaacaggtgattcagcta

SEQ ID NO: 7903359 - DNA, 22 bp, Homo sapiens
tttgaaacccgtcactttgagt

SEQ ID NO: 7903360 - DNA, 22 bp, Homo sapiens
tttgcaaagaaattattgctgt

SEQ ID NO: 7903361 - DNA, 22 bp, Homo sapiens
tttgcaaactttcctctggacc

SEQ ID NO: 7903362 - DNA, 22 bp, Homo sapiens
tttgcaaagaaattattgctgt

SEQ ID NO: 7903363 - DNA, 22 bp, Homo sapiens
tttgcaaagtccattgaagtta

SEQ ID NO: 7903364 - DNA, 22 bp, Homo sapiens
tttgcaaagtccattgaagtta

SEQ ID NO: 7903365 - DNA, 22 bp, Homo sapiens
tttgcaaagtccctgggatgga

SEQ ID NO: 7903366 - DNA, 18 bp, Homo sapiens
tttgcaaaggaagtatgg

SEQ ID NO: 7903367 - DNA, 22 bp, Homo sapiens
tttgcaaagtgcttgcagagta

SEQ ID NO: 7903368 - DNA, 22 bp, Homo sapiens
tttgcaaagtgcttgcagagta

SEQ ID NO: 7903369 - DNA, 22 bp, Homo sapiens
tttgcaaagtgcttgcagagta

SEQ ID NO: 7903370 - DNA, 22 bp, Homo sapiens
ctctggagtgcagcctggtggc

SEQ ID NO: 7903371 - DNA, 22 bp, Homo sapiens
tttgcaaagtgcttgcagagta

SEQ ID NO: 7903372 - DNA, 22 bp, Homo sapiens
ctctggagtgcagcctggtggc

SEQ ID NO: 7903373 - DNA, 22 bp, Homo sapiens
tttgcaaagtgactattatatg

SEQ ID NO: 7903374 - DNA, 22 bp, Homo sapiens
tttgcaaagtgactattatatg

SEQ ID NO: 7903375 - DNA, 22 bp, Homo sapiens
ctctggagtgggtggccgggag

SEQ ID NO: 7903376 - DNA, 22 bp, Homo sapiens
ctctggagtgggtggccgggag

SEQ ID NO: 7903377 - DNA, 22 bp, Homo sapiens
ctctggagtgggtggccgggag

SEQ ID NO: 7903378 - DNA, 22 bp, Homo sapiens
ctctggcacactccttccaggt

SEQ ID NO: 7903379 - DNA, 20 bp, Homo sapiens
ctctggcaaaggatgcctat

SEQ ID NO: 7903380 - DNA, 22 bp, Homo sapiens
ctctggccccagtggccccttg

SEQ ID NO: 7903381 - DNA, 22 bp, Homo sapiens
ctctggccagagcctgcgggaa

SEQ ID NO: 7903382 - DNA, 22 bp, Homo sapiens
ctctggcagagctgtagacttc

SEQ ID NO: 7903383 - DNA, 22 bp, Homo sapiens
ctctggccagagcctgcgggaa

SEQ ID NO: 7903384 - DNA, 22 bp, Homo sapiens
ctctggccgcagctcagctctg

SEQ ID NO: 7903385 - DNA, 19 bp, Homo sapiens
ctctggcctctggatgctg

SEQ ID NO: 7903386 - DNA, 19 bp, Homo sapiens
ctctggcctctggatgctg

SEQ ID NO: 7903387 - DNA, 22 bp, Homo sapiens
ctctggccgagcatgggggtta

SEQ ID NO: 7903388 - DNA, 22 bp, Homo sapiens
ctctggccgagcatgggggtta

SEQ ID NO: 7903389 - DNA, 22 bp, Homo sapiens
ctctggccccagtggccccttg

SEQ ID NO: 7903390 - DNA, 22 bp, Homo sapiens
ctctggccgcagctcagctctg

SEQ ID NO: 7903391 - DNA, 22 bp, Homo sapiens
ctctggccgcagctcagctctg

SEQ ID NO: 7903392 - DNA, 22 bp, Homo sapiens
ctctggcctgcttcctcaggta

SEQ ID NO: 7903393 - DNA, 22 bp, Homo sapiens
ctctggcctggggcctgctccc

SEQ ID NO: 7903394 - DNA, 22 bp, Homo sapiens
ctctggcctggggcctgctccc

SEQ ID NO: 7903395 - DNA, 22 bp, Homo sapiens
ctctggcctggggcctgctccc

SEQ ID NO: 7903396 - DNA, 22 bp, Homo sapiens
ctctggcctgcttcctcaggta

SEQ ID NO: 7903397 - DNA, 22 bp, Homo sapiens
ctctggcctgcttcctcaggta

SEQ ID NO: 7903398 - DNA, 22 bp, Homo sapiens
ctctggcctgcttcctcaggta

SEQ ID NO: 7903399 - DNA, 22 bp, Homo sapiens
ctctggcctgcagatccatgct

SEQ ID NO: 7903400 - DNA, 22 bp, Homo sapiens
tttgcaaacacttaagaagaga

SEQ ID NO: 7903401 - DNA, 22 bp, Homo sapiens
tttgcaaacacttaagaagaga

SEQ ID NO: 7903402 - DNA, 22 bp, Homo sapiens
tttgcaaacacttaagaagaga

SEQ ID NO: 7903403 - DNA, 22 bp, Homo sapiens
tttgcaaacacttaagaagaga

SEQ ID NO: 7903404 - DNA, 22 bp, Homo sapiens
tttgcaaacacttaagaagaga

SEQ ID NO: 7903405 - DNA, 22 bp, Homo sapiens
tttgcaaacacttaagaagaga

SEQ ID NO: 7903406 - DNA, 22 bp, Homo sapiens
tttgcaaacggccctgagtccc

SEQ ID NO: 7903407 - DNA, 22 bp, Homo sapiens
tttgcaaaccggagctctgcaa

SEQ ID NO: 7903408 - DNA, 22 bp, Homo sapiens
tttgcaaacggccctgagtccc

SEQ ID NO: 7903409 - DNA, 22 bp, Homo sapiens
tttgcaaactttcctctggacc

SEQ ID NO: 7903410 - DNA, 22 bp, Homo sapiens
tttgcaaacattcagggctcca

SEQ ID NO: 7903411 - DNA, 22 bp, Homo sapiens
tttgcaaacacttaagaagaga

SEQ ID NO: 7903412 - DNA, 22 bp, Homo sapiens
tttgcaaacattcagggctcca

SEQ ID NO: 7903413 - DNA, 22 bp, Homo sapiens
tttgcaaaccggagctctgcaa

SEQ ID NO: 7903414 - DNA, 22 bp, Homo sapiens
tttgagaagatgtaatgttaag

SEQ ID NO: 7903415 - DNA, 22 bp, Homo sapiens
tttgagaagatgtaatgttaag

SEQ ID NO: 7903416 - DNA, 22 bp, Homo sapiens
tttgagaagagtttgaggtatt

SEQ ID NO: 7903417 - DNA, 22 bp, Homo sapiens
tttgcaaaatgaggtgaagagt

SEQ ID NO: 7903418 - DNA, 22 bp, Homo sapiens
tttgcaaaattattcccagcat

SEQ ID NO: 7903419 - DNA, 22 bp, Homo sapiens
tttgcaaaatgtcttgtgttag

SEQ ID NO: 7903420 - DNA, 22 bp, Homo sapiens
tttgcaaaatgaggtgaagagt

SEQ ID NO: 7903421 - DNA, 22 bp, Homo sapiens
tttgagaaaaccagaaagatct

SEQ ID NO: 7903422 - DNA, 22 bp, Homo sapiens
tttgagaaaaagtgatgatgat

SEQ ID NO: 7903423 - DNA, 22 bp, Homo sapiens
tttgagaaaaagtgatgatgat

SEQ ID NO: 7903424 - DNA, 22 bp, Homo sapiens
tttgagaaacagacgaaagaca

SEQ ID NO: 7903425 - DNA, 22 bp, Homo sapiens
tttgagaaacagacgaaagaca

SEQ ID NO: 7903426 - DNA, 22 bp, Homo sapiens
tttgagaaatgggctctgtgct

SEQ ID NO: 7903427 - DNA, 22 bp, Homo sapiens
tttgagaaccctgtattttaag

SEQ ID NO: 7903428 - DNA, 22 bp, Homo sapiens
tttgagaaccctgtattttaag

SEQ ID NO: 7903429 - DNA, 22 bp, Homo sapiens
tttgagaaccctgtattttaag

SEQ ID NO: 7903430 - DNA, 22 bp, Homo sapiens
tttgagaaaggggatttaattc

SEQ ID NO: 7903431 - DNA, 22 bp, Homo sapiens
tttgactcttgctttggtggct

SEQ ID NO: 7903432 - DNA, 22 bp, Homo sapiens
tttgactgcccgagcctcccag

SEQ ID NO: 7903433 - DNA, 22 bp, Homo sapiens
tttgactgtgccacccagggtg

SEQ ID NO: 7903434 - DNA, 22 bp, Homo sapiens
tttgactcttgtctcttgttag

SEQ ID NO: 7903435 - DNA, 22 bp, Homo sapiens
tttgactcttgtctcttgttag

SEQ ID NO: 7903436 - DNA, 22 bp, Homo sapiens
tttgactcttgcccagtttggc

SEQ ID NO: 7903437 - DNA, 22 bp, Homo sapiens
tttgactcttctagcaagtgtg

SEQ ID NO: 7903438 - DNA, 22 bp, Homo sapiens
tttgactcttagcccaggactc

SEQ ID NO: 7903439 - DNA, 22 bp, Homo sapiens
tttgactcttgtctcttgttag

SEQ ID NO: 7903440 - DNA, 19 bp, Homo sapiens
tttgactcctcatttttat

SEQ ID NO: 7903441 - DNA, 22 bp, Homo sapiens
tttgactcccaaactgtgattt

SEQ ID NO: 7903442 - DNA, 22 bp, Homo sapiens
tttgactccagagcccattttt

SEQ ID NO: 7903443 - DNA, 22 bp, Homo sapiens
tttgactccactcctaactcct

SEQ ID NO: 7903444 - DNA, 22 bp, Homo sapiens
tttgactcattaaagtctccgt

SEQ ID NO: 7903445 - DNA, 22 bp, Homo sapiens
tttgactcattgattttctctg

SEQ ID NO: 7903446 - DNA, 22 bp, Homo sapiens
tttgactcattgattttctctg

SEQ ID NO: 7903447 - DNA, 22 bp, Homo sapiens
tttgactcctgccttctcctgt

SEQ ID NO: 7903448 - DNA, 22 bp, Homo sapiens
tttgactcctgccttctcctgt

SEQ ID NO: 7903449 - DNA, 21 bp, Homo sapiens
tttgactcctcatttttatat

SEQ ID NO: 7903450 - DNA, 22 bp, Homo sapiens
tttgactcctgccttctcctgt

SEQ ID NO: 7903451 - DNA, 22 bp, Homo sapiens
tttgactcctttgtgaaaagag

SEQ ID NO: 7903452 - DNA, 22 bp, Homo sapiens
tttgactcctgtgtttctggaa

SEQ ID NO: 7903453 - DNA, 22 bp, Homo sapiens
tttgactcctgtgtttctggaa

SEQ ID NO: 7903454 - DNA, 22 bp, Homo sapiens
tttgactcttaagtggctcaat

SEQ ID NO: 7903455 - DNA, 22 bp, Homo sapiens
tttgactctgggtgctttttcg

SEQ ID NO: 7903456 - DNA, 22 bp, Homo sapiens
tttgactctgggtgctttttcg

SEQ ID NO: 7903457 - DNA, 22 bp, Homo sapiens
tttgactctagtcatagaagtg

SEQ ID NO: 7903458 - DNA, 22 bp, Homo sapiens
tttgactctagtcatagaagtg

SEQ ID NO: 7903459 - DNA, 22 bp, Homo sapiens
tttggaagtcctgaaatagagg

SEQ ID NO: 7903460 - DNA, 22 bp, Homo sapiens
tttggaagtcctgaaatagagg

SEQ ID NO: 7903461 - DNA, 22 bp, Homo sapiens
tttggaagtcctgaaatagagg

SEQ ID NO: 7903462 - DNA, 20 bp, Homo sapiens
ctctggctccgcgtgaccgc

SEQ ID NO: 7903463 - DNA, 20 bp, Homo sapiens
ctctggctccgcgtgaccgc

SEQ ID NO: 7903464 - DNA, 20 bp, Homo sapiens
ctctggctccgcgtgaccgc

SEQ ID NO: 7903465 - DNA, 22 bp, Homo sapiens
ctctggctcccgcagcccccat

SEQ ID NO: 7903466 - DNA, 22 bp, Homo sapiens
ctctggctatctgtttctatgt

SEQ ID NO: 7903467 - DNA, 22 bp, Homo sapiens
ctctggctatctgtttctatgt

SEQ ID NO: 7903468 - DNA, 22 bp, Homo sapiens
ctctggctccatttccctatgt

SEQ ID NO: 7903469 - DNA, 22 bp, Homo sapiens
ctctggctatggcacggcgctc

SEQ ID NO: 7903470 - DNA, 22 bp, Homo sapiens
ctctggctcccgcagcccccat

SEQ ID NO: 7903471 - DNA, 22 bp, Homo sapiens
ctctggctccatttccctatgt

SEQ ID NO: 7903472 - DNA, 22 bp, Homo sapiens
tttggaatattaaaatgtctca

SEQ ID NO: 7903473 - DNA, 22 bp, Homo sapiens
tttggaatagcatagaagctca

SEQ ID NO: 7903474 - DNA, 22 bp, Homo sapiens
tttggaataatcagatcctagt

SEQ ID NO: 7903475 - DNA, 22 bp, Homo sapiens
tttggaatcatagatatattca

SEQ ID NO: 7903476 - DNA, 22 bp, Homo sapiens
tttggaatcctcagtatgatca

SEQ ID NO: 7903477 - DNA, 22 bp, Homo sapiens
tttggaatattaaaatgtctca

SEQ ID NO: 7903478 - DNA, 22 bp, Homo sapiens
tttggaatgaaacagcagagcc

SEQ ID NO: 7903479 - DNA, 22 bp, Homo sapiens
tttggaatgaaacagcagagcc

SEQ ID NO: 7903480 - DNA, 22 bp, Homo sapiens
tttggaatctgagggcttagtt

SEQ ID NO: 7903481 - DNA, 22 bp, Homo sapiens
tttggaatggaatagagattgc

SEQ ID NO: 7903482 - DNA, 22 bp, Homo sapiens
tttggaatggaatagagattgc

SEQ ID NO: 7903483 - DNA, 22 bp, Homo sapiens
tttggaatgcccatggactggt

SEQ ID NO: 7903484 - DNA, 22 bp, Homo sapiens
tttggaatgacagatatcaata

SEQ ID NO: 7903485 - DNA, 22 bp, Homo sapiens
tttggaatgacagatatcaata

SEQ ID NO: 7903486 - DNA, 23 bp, Homo sapiens
ctctgggtccgatgtcctgacag

SEQ ID NO: 7903487 - DNA, 23 bp, Homo sapiens
ctctgggtccgatgtcctgacag

SEQ ID NO: 7903488 - DNA, 20 bp, Homo sapiens
ctctgggctgcaccctcgcc

SEQ ID NO: 7903489 - DNA, 20 bp, Homo sapiens
ctctgggctgcaccctcgcc

SEQ ID NO: 7903490 - DNA, 20 bp, Homo sapiens
ctctgggctgcaccctcgcc

SEQ ID NO: 7903491 - DNA, 19 bp, Homo sapiens
ctctgggctgcatcttggt

SEQ ID NO: 7903492 - DNA, 22 bp, Homo sapiens
tttggaattcagatggcttagg

SEQ ID NO: 7903493 - DNA, 22 bp, Homo sapiens
tttggaattggaaagtgctgtg

SEQ ID NO: 7903494 - DNA, 22 bp, Homo sapiens
tttggaattctgcagctcatgt

SEQ ID NO: 7903495 - DNA, 22 bp, Homo sapiens
tttggaattggaaagtgctgtg

SEQ ID NO: 7903496 - DNA, 22 bp, Homo sapiens
tttggaattccatttctgcatt

SEQ ID NO: 7903497 - DNA, 22 bp, Homo sapiens
tttggaattctgcagctcatgt

SEQ ID NO: 7903498 - DNA, 22 bp, Homo sapiens
tttggaatggtaccttcagttg

SEQ ID NO: 7903499 - DNA, 22 bp, Homo sapiens
tttggaatggtaccttcagttg

SEQ ID NO: 7903500 - DNA, 22 bp, Homo sapiens
tttggaattacttactcaagcc

SEQ ID NO: 7903501 - DNA, 22 bp, Homo sapiens
tttggaatgtagtttaatcatc

SEQ ID NO: 7903502 - DNA, 22 bp, Homo sapiens
tttggaatggtgctgtacagat

SEQ ID NO: 7903503 - DNA, 22 bp, Homo sapiens
tttggaatgtagtttaatcatc

SEQ ID NO: 7903504 - DNA, 22 bp, Homo sapiens
tttgttcagctctcattgatta

SEQ ID NO: 7903505 - DNA, 22 bp, Homo sapiens
tttgttcagctctcattgatta

SEQ ID NO: 7903506 - DNA, 22 bp, Homo sapiens
ctctgggtgttaatgtcagtgt

SEQ ID NO: 7903507 - DNA, 22 bp, Homo sapiens
ctctgggtgtgacagcacctgg

SEQ ID NO: 7903508 - DNA, 22 bp, Homo sapiens
ctctgggtgtgacagcacctgg

SEQ ID NO: 7903509 - DNA, 22 bp, Homo sapiens
ctctgggtgttaatgtcagtgt

SEQ ID NO: 7903510 - DNA, 22 bp, Homo sapiens
ctctgggtgtgacagcacctgg

SEQ ID NO: 7903511 - DNA, 22 bp, Homo sapiens
ctctgggtgtgacagcacctgg

SEQ ID NO: 7903512 - DNA, 21 bp, Homo sapiens
tttgttcaggcaagttacagt

SEQ ID NO: 7903513 - DNA, 21 bp, Homo sapiens
tttgttcaggggcaaagttaa

SEQ ID NO: 7903514 - DNA, 21 bp, Homo sapiens
tttgttcaggcaagttacagt

SEQ ID NO: 7903515 - DNA, 22 bp, Homo sapiens
tttgttcagctctcattgatta

SEQ ID NO: 7903516 - DNA, 21 bp, Homo sapiens
tttgttcaggcaagttacagt

SEQ ID NO: 7903517 - DNA, 21 bp, Homo sapiens
tttgttcaggcaagttacagt

SEQ ID NO: 7903518 - DNA, 23 bp, Homo sapiens
tttgttcatcattagagtctagc

SEQ ID NO: 7903519 - DNA, 21 bp, Homo sapiens
tttgttcatagctcactcttt

SEQ ID NO: 7903520 - DNA, 21 bp, Homo sapiens
tttgttcatagctcactcttt

SEQ ID NO: 7903521 - DNA, 21 bp, Homo sapiens
tttgttcatagctcactcttt

SEQ ID NO: 7903522 - DNA, 22 bp, Homo sapiens
tttgttcataatggcaaagaga

SEQ ID NO: 7903523 - DNA, 21 bp, Homo sapiens
tttgttcaggggcaaagttaa

SEQ ID NO: 7903524 - DNA, 22 bp, Homo sapiens
tttgttcatgcctatattctca

SEQ ID NO: 7903525 - DNA, 22 bp, Homo sapiens
tttgttcatgaaaacctagatc

SEQ ID NO: 7903526 - DNA, 22 bp, Homo sapiens
tttgttcatgcctatattctca

SEQ ID NO: 7903527 - DNA, 22 bp, Homo sapiens
tttgttcattagtacagttgta

SEQ ID NO: 7903528 - DNA, 22 bp, Homo sapiens
tttgttcattagcattggcctt

SEQ ID NO: 7903529 - DNA, 22 bp, Homo sapiens
tttgttcattaaaagtgctgta

SEQ ID NO: 7903530 - DNA, 22 bp, Homo sapiens
ctctgggtgcagcgctgaccgg

SEQ ID NO: 7903531 - DNA, 22 bp, Homo sapiens
ctctgggtgcagcgctgaccgg

SEQ ID NO: 7903532 - DNA, 17 bp, Homo sapiens
ctctgggtgcctgtgtg

SEQ ID NO: 7903533 - DNA, 22 bp, Homo sapiens
ctctgggtggtctcactgagtg

SEQ ID NO: 7903534 - DNA, 22 bp, Homo sapiens
ctctgggtgggcagcagatgga

SEQ ID NO: 7903535 - DNA, 22 bp, Homo sapiens
ctctgggtgtcttaggagctca

SEQ ID NO: 7903536 - DNA, 22 bp, Homo sapiens
ctctgggtgtcttaggagctca

SEQ ID NO: 7903537 - DNA, 22 bp, Homo sapiens
ctctgggtgtgacagcacctgg

SEQ ID NO: 7903538 - DNA, 22 bp, Homo sapiens
ctctgggtgtcttaggagctca

SEQ ID NO: 7903539 - DNA, 22 bp, Homo sapiens
ctctgggtggtctcactgagtg

SEQ ID NO: 7903540 - DNA, 22 bp, Homo sapiens
ctctgggtggtctcactgagtg

SEQ ID NO: 7903541 - DNA, 22 bp, Homo sapiens
ctctgggtgtcttaggagctca

SEQ ID NO: 7903542 - DNA, 22 bp, Homo sapiens
ctctgggtgtcatggcctcagc

SEQ ID NO: 7903543 - DNA, 20 bp, Homo sapiens
ctctgggtcgagacagactt

SEQ ID NO: 7903544 - DNA, 22 bp, Homo sapiens
ctctgggtctacctgtggccag

SEQ ID NO: 7903545 - DNA, 22 bp, Homo sapiens
ctctgggtctacctgtggccag

SEQ ID NO: 7903546 - DNA, 22 bp, Homo sapiens
ctctgggtctataatgcagctg

SEQ ID NO: 7903547 - DNA, 22 bp, Homo sapiens
ctctgggtcctggggctacaag

SEQ ID NO: 7903548 - DNA, 22 bp, Homo sapiens
ctctgggtcctggggctacaag

SEQ ID NO: 7903549 - DNA, 20 bp, Homo sapiens
ctctgggtcgagacagactt

SEQ ID NO: 7903550 - DNA, 20 bp, Homo sapiens
ctctgggtcgagacagactt

SEQ ID NO: 7903551 - DNA, 17 bp, Homo sapiens
ctctgggtctcctgctt

SEQ ID NO: 7903552 - DNA, 17 bp, Homo sapiens
ctctgggtctcctgctt

SEQ ID NO: 7903553 - DNA, 22 bp, Homo sapiens
ctctgggtgagacagacctggt

SEQ ID NO: 7903554 - DNA, 22 bp, Homo sapiens
ctctgggtgagacagacctggt

SEQ ID NO: 7903555 - DNA, 22 bp, Homo sapiens
ctctgggtgagacagacctggt

SEQ ID NO: 7903556 - DNA, 22 bp, Homo sapiens
ctctgggtctccctgaggctaa

SEQ ID NO: 7903557 - DNA, 22 bp, Homo sapiens
ctctgggtctccctgaggctaa

SEQ ID NO: 7903558 - DNA, 22 bp, Homo sapiens
ctctgggtctataatgcagctg

SEQ ID NO: 7903559 - DNA, 22 bp, Homo sapiens
ctctgtgcttatgctccatggg

SEQ ID NO: 7903560 - DNA, 22 bp, Homo sapiens
ctctgtgccctactgctcagct

SEQ ID NO: 7903561 - DNA, 22 bp, Homo sapiens
ctctgtgccctactgctcagct

SEQ ID NO: 7903562 - DNA, 22 bp, Homo sapiens
ctctgtgccctactgctcagct

SEQ ID NO: 7903563 - DNA, 22 bp, Homo sapiens
ctctgtgccagtctgcactcgg

SEQ ID NO: 7903564 - DNA, 22 bp, Homo sapiens
ctctgtgattttgtgagccaga

SEQ ID NO: 7903565 - DNA, 22 bp, Homo sapiens
tttgttcattttgagctcatca

SEQ ID NO: 7903566 - DNA, 22 bp, Homo sapiens
tttgttcccagatttgctggca

SEQ ID NO: 7903567 - DNA, 22 bp, Homo sapiens
tttgttcccagatttgctggca

SEQ ID NO: 7903568 - DNA, 22 bp, Homo sapiens
tttgttcattttgagctcatca

SEQ ID NO: 7903569 - DNA, 17 bp, Homo sapiens
tttgttcattgaagaga

SEQ ID NO: 7903570 - DNA, 22 bp, Homo sapiens
tttgttcattttgagctcatca

SEQ ID NO: 7903571 - DNA, 22 bp, Homo sapiens
tttgttcattagcattggcctt

SEQ ID NO: 7903572 - DNA, 22 bp, Homo sapiens
tttgttcattagtacagttgta

SEQ ID NO: 7903573 - DNA, 22 bp, Homo sapiens
tttgttctaacttctgcagaca

SEQ ID NO: 7903574 - DNA, 22 bp, Homo sapiens
tttgttctagatcgtgtttgtg

SEQ ID NO: 7903575 - DNA, 22 bp, Homo sapiens
tttgttctagatcgtgtttgtg

SEQ ID NO: 7903576 - DNA, 22 bp, Homo sapiens
ctctgtggctacacaaacctcc

SEQ ID NO: 7903577 - DNA, 22 bp, Homo sapiens
ctctgtggcttgcctttctgtc

SEQ ID NO: 7903578 - DNA, 22 bp, Homo sapiens
ctctgtggaagaagaaagaagg

SEQ ID NO: 7903579 - DNA, 17 bp, Homo sapiens
ctctgtggaggtgttta

SEQ ID NO: 7903580 - DNA, 22 bp, Homo sapiens
ctctgtgggccagagaggcccc

SEQ ID NO: 7903581 - DNA, 22 bp, Homo sapiens
ctctgtgggccagagaggcccc

SEQ ID NO: 7903582 - DNA, 22 bp, Homo sapiens
ctctgtgggaagctgggtgtga

SEQ ID NO: 7903583 - DNA, 22 bp, Homo sapiens
ctctgtgggaggaggagtaggc

SEQ ID NO: 7903584 - DNA, 22 bp, Homo sapiens
ctctgtgggaggaggagtaggc

SEQ ID NO: 7903585 - DNA, 22 bp, Homo sapiens
ctctgtgggggagaggcagctg

SEQ ID NO: 7903586 - DNA, 22 bp, Homo sapiens
ctctgtgggggagaggcagctg

SEQ ID NO: 7903587 - DNA, 22 bp, Homo sapiens
ctctgtgggcctgtgctttagt

SEQ ID NO: 7903588 - DNA, 22 bp, Homo sapiens
ctctgtggtggagtgggtcacc

SEQ ID NO: 7903589 - DNA, 22 bp, Homo sapiens
ctctgtggtaaaatagcagtat

SEQ ID NO: 7903590 - DNA, 22 bp, Homo sapiens
ctctgtgtggtcctctgtattg

SEQ ID NO: 7903591 - DNA, 22 bp, Homo sapiens
ctctgtgtggtatgattgtcat

SEQ ID NO: 7903592 - DNA, 22 bp, Homo sapiens
ctctgtgtggtcctctgtattg

SEQ ID NO: 7903593 - DNA, 22 bp, Homo sapiens
ctctgtgttcagcctagcagaa

SEQ ID NO: 7903594 - DNA, 22 bp, Homo sapiens
ctctgtgttcagcctagcagaa

SEQ ID NO: 7903595 - DNA, 22 bp, Homo sapiens
ctctgtgttcagcctagcagaa

SEQ ID NO: 7903596 - DNA, 22 bp, Homo sapiens
ctctgtgttcagcctagcagaa

SEQ ID NO: 7903597 - DNA, 22 bp, Homo sapiens
ctctgtgttcagcctagcagaa

SEQ ID NO: 7903598 - DNA, 22 bp, Homo sapiens
ctctgtgttccgggttgctgct

SEQ ID NO: 7903599 - DNA, 22 bp, Homo sapiens
ctctgtgttccgggttgctgct

SEQ ID NO: 7903600 - DNA, 22 bp, Homo sapiens
ctctgtgttccgggttgctgct

SEQ ID NO: 7903601 - DNA, 22 bp, Homo sapiens
ctctgtgtgctggtggggtcct

SEQ ID NO: 7903602 - DNA, 22 bp, Homo sapiens
ctctgtgtctgagttatggtct

SEQ ID NO: 7903603 - DNA, 22 bp, Homo sapiens
ctctgtgtgctggtggggtcct

SEQ ID NO: 7903604 - DNA, 22 bp, Homo sapiens
ctctgtgtgctggtggggtcct

SEQ ID NO: 7903605 - DNA, 22 bp, Homo sapiens
ctctgtgtctgaagccctattt

SEQ ID NO: 7903606 - DNA, 22 bp, Homo sapiens
ctctgtgtcagctgggtgtgca

SEQ ID NO: 7903607 - DNA, 22 bp, Homo sapiens
ctctgtgtctgagttatggtct

SEQ ID NO: 7903608 - DNA, 22 bp, Homo sapiens
ctctgtggttagactatggctg

SEQ ID NO: 7903609 - DNA, 22 bp, Homo sapiens
ctctgtgtatccaagttcaggt

SEQ ID NO: 7903610 - DNA, 22 bp, Homo sapiens
ctctgtgtcagctgggtgtgca

SEQ ID NO: 7903611 - DNA, 22 bp, Homo sapiens
ctctgtgtatccaagttcaggt

SEQ ID NO: 7903612 - DNA, 22 bp, Homo sapiens
ctctgtggttagactatggctg

SEQ ID NO: 7903613 - DNA, 22 bp, Homo sapiens
ttttgcctgcactgtatatata

SEQ ID NO: 7903614 - DNA, 22 bp, Homo sapiens
ttttgctggggtggctagctta

SEQ ID NO: 7903615 - DNA, 22 bp, Homo sapiens
ttttgctggtttatctctatta

SEQ ID NO: 7903616 - DNA, 22 bp, Homo sapiens
ttttgcctgagagtgaaaataa

SEQ ID NO: 7903617 - DNA, 21 bp, Homo sapiens
ttttgctgttttagaatgaga

SEQ ID NO: 7903618 - DNA, 22 bp, Homo sapiens
ttttgcttaatctagattttgc

SEQ ID NO: 7903619 - DNA, 22 bp, Homo sapiens
ttttgcttaatctagattttgc

SEQ ID NO: 7903620 - DNA, 22 bp, Homo sapiens
ttttctcttccctctggacctg

SEQ ID NO: 7903621 - DNA, 22 bp, Homo sapiens
ttttctcttccctctggacctg

SEQ ID NO: 7903622 - DNA, 22 bp, Homo sapiens
ttttgcctaagaatctctctga

SEQ ID NO: 7903623 - DNA, 22 bp, Homo sapiens
ttttgcctaagaatctctctga

SEQ ID NO: 7903624 - DNA, 22 bp, Homo sapiens
ttttctcttccctctggacctg

SEQ ID NO: 7903625 - DNA, 22 bp, Homo sapiens
ttttgcctgagagtgaaaataa

SEQ ID NO: 7903626 - DNA, 17 bp, Homo sapiens
ttttctctcttggattc

SEQ ID NO: 7903627 - DNA, 17 bp, Homo sapiens
ttttctctcttggattc

SEQ ID NO: 7903628 - DNA, 22 bp, Homo sapiens
ttttctctccaggtggggtgat

SEQ ID NO: 7903629 - DNA, 21 bp, Homo sapiens
ctctgtgttgagggtgttgag

SEQ ID NO: 7903630 - DNA, 22 bp, Homo sapiens
ctctgtgttccgggttgctgct

SEQ ID NO: 7903631 - DNA, 21 bp, Homo sapiens
ctctgtgttgagggtgttgag

SEQ ID NO: 7903632 - DNA, 22 bp, Homo sapiens
tttcatgttacatttaaaatgt

SEQ ID NO: 7903633 - DNA, 22 bp, Homo sapiens
tttcatgttacatttaaaatgt

SEQ ID NO: 7903634 - DNA, 22 bp, Homo sapiens
tttcatgttacatttaaaatgt

SEQ ID NO: 7903635 - DNA, 22 bp, Homo sapiens
tttcatgttacatttaaaatgt

SEQ ID NO: 7903636 - DNA, 22 bp, Homo sapiens
tttcatgttattaatagtgctg

SEQ ID NO: 7903637 - DNA, 22 bp, Homo sapiens
tttcatgttagttggttcttgg

SEQ ID NO: 7903638 - DNA, 22 bp, Homo sapiens
tttcatgttggggagttgagtg

SEQ ID NO: 7903639 - DNA, 23 bp, Homo sapiens
tttcatgttggcatgactgactt

SEQ ID NO: 7903640 - DNA, 22 bp, Homo sapiens
tttcatgttggatactgtttca

SEQ ID NO: 7903641 - DNA, 23 bp, Homo sapiens
tttcatgttggcatgactgactt

SEQ ID NO: 7903642 - DNA, 22 bp, Homo sapiens
tttcatgttggatactgtttca

SEQ ID NO: 7903643 - DNA, 22 bp, Homo sapiens
tttcatgttggatactgtttca

SEQ ID NO: 7903644 - DNA, 22 bp, Homo sapiens
tttcatgttggatactgtttca

SEQ ID NO: 7903645 - DNA, 22 bp, Homo sapiens
tttcatgtttatggaaaatgag

SEQ ID NO: 7903646 - DNA, 22 bp, Homo sapiens
tttcatgtttatggaaaatgag

SEQ ID NO: 7903647 - DNA, 22 bp, Homo sapiens
tttcatgtttatggaaaatgag

SEQ ID NO: 7903648 - DNA, 19 bp, Homo sapiens
tttcatgtttttggtgaga

SEQ ID NO: 7903649 - DNA, 22 bp, Homo sapiens
tttcattaaagtcaaatctggt

SEQ ID NO: 7903650 - DNA, 19 bp, Homo sapiens
tttcatgtttttggtgaga

SEQ ID NO: 7903651 - DNA, 22 bp, Homo sapiens
tttcatgttttcttaaatggca

SEQ ID NO: 7903652 - DNA, 22 bp, Homo sapiens
tttcattaaagtcaaatctggt

SEQ ID NO: 7903653 - DNA, 22 bp, Homo sapiens
tttcattaaagtcaaatctggt

SEQ ID NO: 7903654 - DNA, 22 bp, Homo sapiens
tttcattacgtgtttgacttgt

SEQ ID NO: 7903655 - DNA, 22 bp, Homo sapiens
tttcattacgtgtttgacttgt

SEQ ID NO: 7903656 - DNA, 22 bp, Homo sapiens
tttcattacgtgtttgacttgt

SEQ ID NO: 7903657 - DNA, 22 bp, Homo sapiens
tttcattacgtgtttgacttgt

SEQ ID NO: 7903658 - DNA, 22 bp, Homo sapiens
tttcattacgtgtttgacttgt

SEQ ID NO: 7903659 - DNA, 22 bp, Homo sapiens
tttcattagtatgacagcacgc

SEQ ID NO: 7903660 - DNA, 22 bp, Homo sapiens
tttcattagtatgacagcacgc

SEQ ID NO: 7903661 - DNA, 22 bp, Homo sapiens
tttcattagtatgacagcacgc

SEQ ID NO: 7903662 - DNA, 18 bp, Homo sapiens
tttcattataaagcaggc

SEQ ID NO: 7903663 - DNA, 18 bp, Homo sapiens
tttcattataaagcaggc

SEQ ID NO: 7903664 - DNA, 18 bp, Homo sapiens
tttcattataaagcaggc

SEQ ID NO: 7903665 - DNA, 18 bp, Homo sapiens
tttcattataaagcaggc

SEQ ID NO: 7903666 - DNA, 22 bp, Homo sapiens
tttcattatacagcttcataaa

SEQ ID NO: 7903667 - DNA, 22 bp, Homo sapiens
tttccaagtactgagctgtcaa

SEQ ID NO: 7903668 - DNA, 22 bp, Homo sapiens
tttccaagtgtcaggtgcaaaa

SEQ ID NO: 7903669 - DNA, 22 bp, Homo sapiens
tttccaagtactgagctgtcaa

SEQ ID NO: 7903670 - DNA, 22 bp, Homo sapiens
tttccaagttgttaccttctac

SEQ ID NO: 7903671 - DNA, 22 bp, Homo sapiens
tttccaataaggtcaccttcct

SEQ ID NO: 7903672 - DNA, 22 bp, Homo sapiens
tttccaataaagtgtcattgtt

SEQ ID NO: 7903673 - DNA, 18 bp, Homo sapiens
tttccaagaagagagctc

SEQ ID NO: 7903674 - DNA, 18 bp, Homo sapiens
tttccaagaagagagctc

SEQ ID NO: 7903675 - DNA, 22 bp, Homo sapiens
tttccaagagcttatttctgaa

SEQ ID NO: 7903676 - DNA, 22 bp, Homo sapiens
tttccaagataatacacagaaa

SEQ ID NO: 7903677 - DNA, 22 bp, Homo sapiens
tttctacacttcgtggtgtttt

SEQ ID NO: 7903678 - DNA, 22 bp, Homo sapiens
tttctacaatttttggcatgag

SEQ ID NO: 7903679 - DNA, 22 bp, Homo sapiens
tttctacaatttttggcatgag

SEQ ID NO: 7903680 - DNA, 22 bp, Homo sapiens
tttctacaatttttggcatgag

SEQ ID NO: 7903681 - DNA, 22 bp, Homo sapiens
tttctacagaagatacactgct

SEQ ID NO: 7903682 - DNA, 22 bp, Homo sapiens
tttctacagaagatacactgct

SEQ ID NO: 7903683 - DNA, 22 bp, Homo sapiens
tttctacagaagatacactgct

SEQ ID NO: 7903684 - DNA, 22 bp, Homo sapiens
tttctacagaagatacactgct

SEQ ID NO: 7903685 - DNA, 22 bp, Homo sapiens
tttctacaacacttctgaatct

SEQ ID NO: 7903686 - DNA, 22 bp, Homo sapiens
tttcctttctcaagagccggca

SEQ ID NO: 7903687 - DNA, 22 bp, Homo sapiens
tttctacaacacttctgaatct

SEQ ID NO: 7903688 - DNA, 22 bp, Homo sapiens
tttcctttctagaagcctaaat

SEQ ID NO: 7903689 - DNA, 22 bp, Homo sapiens
tttcctttctcaagagccggca

SEQ ID NO: 7903690 - DNA, 22 bp, Homo sapiens
tttctacagctggtgcaacttt

SEQ ID NO: 7903691 - DNA, 22 bp, Homo sapiens
tttctacagctggtgcaacttt

SEQ ID NO: 7903692 - DNA, 22 bp, Homo sapiens
tttctacagctggtgcaacttt

SEQ ID NO: 7903693 - DNA, 22 bp, Homo sapiens
tttctacagaagatacactgct

SEQ ID NO: 7903694 - DNA, 22 bp, Homo sapiens
tttctacaatttttggcatgag

SEQ ID NO: 7903695 - DNA, 22 bp, Homo sapiens
tttctacagaagatacactgct

SEQ ID NO: 7903696 - DNA, 22 bp, Homo sapiens
tttctacagtactgatttcata

SEQ ID NO: 7903697 - DNA, 22 bp, Homo sapiens
tttctacagctggtgcaacttt

SEQ ID NO: 7903698 - DNA, 22 bp, Homo sapiens
tttctacaggttgatgggtttg

SEQ ID NO: 7903699 - DNA, 22 bp, Homo sapiens
tttctacagtactgatttcata

SEQ ID NO: 7903700 - DNA, 22 bp, Homo sapiens
tttccacccagagcatttgttt

SEQ ID NO: 7903701 - DNA, 22 bp, Homo sapiens
tttccacccagagcatttgttt

SEQ ID NO: 7903702 - DNA, 22 bp, Homo sapiens
tttccactcctattgcatctca

SEQ ID NO: 7903703 - DNA, 22 bp, Homo sapiens
tttcctttccaaaattctgcct

SEQ ID NO: 7903704 - DNA, 20 bp, Homo sapiens
tttccactgtaatgtatgat

SEQ ID NO: 7903705 - DNA, 22 bp, Homo sapiens
tttcctttctagaagcctaaat

SEQ ID NO: 7903706 - DNA, 22 bp, Homo sapiens
tttcctttctagaagcctaaat

SEQ ID NO: 7903707 - DNA, 22 bp, Homo sapiens
tttccactctggccaccatctt

SEQ ID NO: 7903708 - DNA, 22 bp, Homo sapiens
tttccactctggccaccatctt

SEQ ID NO: 7903709 - DNA, 22 bp, Homo sapiens
tttccactcctattgcatctca

SEQ ID NO: 7903710 - DNA, 22 bp, Homo sapiens
tttccactcctattgcatctca

SEQ ID NO: 7903711 - DNA, 22 bp, Homo sapiens
tttccactcctattgcatctca

SEQ ID NO: 7903712 - DNA, 22 bp, Homo sapiens
tttccacacaggctctactact

SEQ ID NO: 7903713 - DNA, 22 bp, Homo sapiens
tttccacaatttgagcagcaga

SEQ ID NO: 7903714 - DNA, 22 bp, Homo sapiens
tttccacactcactgcactcat

SEQ ID NO: 7903715 - DNA, 22 bp, Homo sapiens
tttccacactgcagccagcaaa

SEQ ID NO: 7903716 - DNA, 22 bp, Homo sapiens
tttccaatgtagatgtctctgg

SEQ ID NO: 7903717 - DNA, 22 bp, Homo sapiens
tttccaattcaagcttttacgt

SEQ ID NO: 7903718 - DNA, 22 bp, Homo sapiens
tttccaattcaagcttttacgt

SEQ ID NO: 7903719 - DNA, 22 bp, Homo sapiens
tttccaatttggtagtcatcgg

SEQ ID NO: 7903720 - DNA, 22 bp, Homo sapiens
tttccaataaggtcaccttcct

SEQ ID NO: 7903721 - DNA, 22 bp, Homo sapiens
tttctcaacctcaacactattt

SEQ ID NO: 7903722 - DNA, 22 bp, Homo sapiens
tttctcaactgtattatgcaga

SEQ ID NO: 7903723 - DNA, 22 bp, Homo sapiens
tttctcaactgtattatgcaga

SEQ ID NO: 7903724 - DNA, 18 bp, Homo sapiens
tttctcaaggctgacatt

SEQ ID NO: 7903725 - DNA, 18 bp, Homo sapiens
tttctcaaggctgacatt

SEQ ID NO: 7903726 - DNA, 22 bp, Homo sapiens
tttctcaagctgtttgccaatt

SEQ ID NO: 7903727 - DNA, 22 bp, Homo sapiens
tttctcaagtactgcacatgaa

SEQ ID NO: 7903728 - DNA, 22 bp, Homo sapiens
tttctcaaggtgtcatgtattt

SEQ ID NO: 7903729 - DNA, 22 bp, Homo sapiens
tttctcaaggtgtcatgtattt

SEQ ID NO: 7903730 - DNA, 22 bp, Homo sapiens
tttctcaaggtgtcatgtattt

SEQ ID NO: 7903731 - DNA, 22 bp, Homo sapiens
tttctcaaggtgtcatgtattt

SEQ ID NO: 7903732 - DNA, 22 bp, Homo sapiens
tttctcaaggtgtcatgtattt

SEQ ID NO: 7903733 - DNA, 22 bp, Homo sapiens
tttctcaagttcagatatttga

SEQ ID NO: 7903734 - DNA, 22 bp, Homo sapiens
tttctcaagttcagatatttga

SEQ ID NO: 7903735 - DNA, 22 bp, Homo sapiens
tttctcaagttcagatatttga

SEQ ID NO: 7903736 - DNA, 19 bp, Homo sapiens
ctctctggcggtgtctgcg

SEQ ID NO: 7903737 - DNA, 19 bp, Homo sapiens
ctctctggcggtgtctgcg

SEQ ID NO: 7903738 - DNA, 21 bp, Homo sapiens
tttctcaccatggtatggaaa

SEQ ID NO: 7903739 - DNA, 19 bp, Homo sapiens
ctctctggcggtgtctgcg

SEQ ID NO: 7903740 - DNA, 19 bp, Homo sapiens
ctctctggcggtgtctgcg

SEQ ID NO: 7903741 - DNA, 18 bp, Homo sapiens
ctctctggtctggatccc

SEQ ID NO: 7903742 - DNA, 18 bp, Homo sapiens
ctctctggtctggatccc

SEQ ID NO: 7903743 - DNA, 22 bp, Homo sapiens
tttctcaaattgcatgagtagc

SEQ ID NO: 7903744 - DNA, 22 bp, Homo sapiens
tttctcaaatactgttccagga

SEQ ID NO: 7903745 - DNA, 22 bp, Homo sapiens
tttctcaaattgcatgagtagc

SEQ ID NO: 7903746 - DNA, 22 bp, Homo sapiens
tttctcaaattgcatgagtagc

SEQ ID NO: 7903747 - DNA, 22 bp, Homo sapiens
tttctcaaattgcatgagtagc

SEQ ID NO: 7903748 - DNA, 22 bp, Homo sapiens
tttctcaacctcaacactattt

SEQ ID NO: 7903749 - DNA, 22 bp, Homo sapiens
tttctcaacctcaacactattt

SEQ ID NO: 7903750 - DNA, 22 bp, Homo sapiens
tttctcaacctcaacactattt

SEQ ID NO: 7903751 - DNA, 22 bp, Homo sapiens
tttctcaacctcaacactattt

SEQ ID NO: 7903752 - DNA, 22 bp, Homo sapiens
tttctcaacagagtatgccctt

SEQ ID NO: 7903753 - DNA, 22 bp, Homo sapiens
tttctcaaatactgttccagga

SEQ ID NO: 7903754 - DNA, 23 bp, Homo sapiens
tttctcaaagagtggcagcttca

SEQ ID NO: 7903755 - DNA, 23 bp, Homo sapiens
tttctcaaagagtggcagcttca

SEQ ID NO: 7903756 - DNA, 22 bp, Homo sapiens
tttctcaaaagacagaagtgaa

SEQ ID NO: 7903757 - DNA, 22 bp, Homo sapiens
tttctcaaaagacagaagtgaa

SEQ ID NO: 7903758 - DNA, 22 bp, Homo sapiens
tttctcaaaattcagtggtatc

SEQ ID NO: 7903759 - DNA, 22 bp, Homo sapiens
tttctacatgtcagtaactgat

SEQ ID NO: 7903760 - DNA, 22 bp, Homo sapiens
tttctacatgtcagtaactgat

SEQ ID NO: 7903761 - DNA, 22 bp, Homo sapiens
tttctacatgtcagtaactgat

SEQ ID NO: 7903762 - DNA, 22 bp, Homo sapiens
tttctattttaaaggcatatgg

SEQ ID NO: 7903763 - DNA, 22 bp, Homo sapiens
tttctattttaaaggcatatgg

SEQ ID NO: 7903764 - DNA, 22 bp, Homo sapiens
tttctattttaaaggcatatgg

SEQ ID NO: 7903765 - DNA, 22 bp, Homo sapiens
tttctattttaaaggcatatgg

SEQ ID NO: 7903766 - DNA, 22 bp, Homo sapiens
tttctattttaaaggcatatgg

SEQ ID NO: 7903767 - DNA, 22 bp, Homo sapiens
tttctattttaaaggcatatgg

SEQ ID NO: 7903768 - DNA, 22 bp, Homo sapiens
tttctacatgtcaatccaaacc

SEQ ID NO: 7903769 - DNA, 22 bp, Homo sapiens
tttctacatgtcaatccaaacc

SEQ ID NO: 7903770 - DNA, 17 bp, Homo sapiens
tttctacagttggcagc

SEQ ID NO: 7903771 - DNA, 22 bp, Homo sapiens
tttctacatgtcaatccaaacc

SEQ ID NO: 7903772 - DNA, 22 bp, Homo sapiens
tttctacatgtcaatccaaacc

SEQ ID NO: 7903773 - DNA, 18 bp, Homo sapiens
ctctctttccactctttg

SEQ ID NO: 7903774 - DNA, 22 bp, Homo sapiens
ctctctttcattggtcgccttg

SEQ ID NO: 7903775 - DNA, 22 bp, Homo sapiens
ctctctttgatgtataaataat

SEQ ID NO: 7903776 - DNA, 22 bp, Homo sapiens
ctctctttgatgtataaataat

SEQ ID NO: 7903777 - DNA, 22 bp, Homo sapiens
ctctctttctgaatgaggacta

SEQ ID NO: 7903778 - DNA, 22 bp, Homo sapiens
ctctctttgatgtataaataat

SEQ ID NO: 7903779 - DNA, 22 bp, Homo sapiens
ctctctttgatgtataaataat

SEQ ID NO: 7903780 - DNA, 22 bp, Homo sapiens
ctctctttttcgtgtgccgaag

SEQ ID NO: 7903781 - DNA, 22 bp, Homo sapiens
ctctgaaagttagagaaaatag

SEQ ID NO: 7903782 - DNA, 22 bp, Homo sapiens
ctctgaaagttagagaaaatag

SEQ ID NO: 7903783 - DNA, 22 bp, Homo sapiens
ctctgaaagttagagaaaatag

SEQ ID NO: 7903784 - DNA, 22 bp, Homo sapiens
ctctgaaagcaaaactagagaa

SEQ ID NO: 7903785 - DNA, 22 bp, Homo sapiens
ctctgaaagcaaaactagagaa

SEQ ID NO: 7903786 - DNA, 22 bp, Homo sapiens
ctctgaaagagtttagtattat

SEQ ID NO: 7903787 - DNA, 22 bp, Homo sapiens
ctctgaaagagtttagtattat

SEQ ID NO: 7903788 - DNA, 22 bp, Homo sapiens
ctctgaaagagtttagtattat

SEQ ID NO: 7903789 - DNA, 22 bp, Homo sapiens
ctctgaaagagtttagtattat

SEQ ID NO: 7903790 - DNA, 22 bp, Homo sapiens
ctctgaaagagtttagtattat

SEQ ID NO: 7903791 - DNA, 18 bp, Homo sapiens
ctctctttccactctttg

SEQ ID NO: 7903792 - DNA, 18 bp, Homo sapiens
ctctctttccactctttg

SEQ ID NO: 7903793 - DNA, 18 bp, Homo sapiens
ctctctttccactctttg

SEQ ID NO: 7903794 - DNA, 22 bp, Homo sapiens
ctctctttcattggtcgccttg

SEQ ID NO: 7903795 - DNA, 22 bp, Homo sapiens
ctctcttcccgtgagtgttgca

SEQ ID NO: 7903796 - DNA, 22 bp, Homo sapiens
ctctctttcattggtcgccttg

SEQ ID NO: 7903797 - DNA, 22 bp, Homo sapiens
ctctctttcattggtcgccttg

SEQ ID NO: 7903798 - DNA, 22 bp, Homo sapiens
ctctctgttcattgagtcaaaa

SEQ ID NO: 7903799 - DNA, 22 bp, Homo sapiens
ctctcttcccgtgagtgttgca

SEQ ID NO: 7903800 - DNA, 22 bp, Homo sapiens
ctctctgttcattgagtcaaaa

SEQ ID NO: 7903801 - DNA, 22 bp, Homo sapiens
ctctctgttatgctttcatgaa

SEQ ID NO: 7903802 - DNA, 22 bp, Homo sapiens
ctctctgttatgctttcatgaa

SEQ ID NO: 7903803 - DNA, 22 bp, Homo sapiens
ctctctggtttcagcgaagggg

SEQ ID NO: 7903804 - DNA, 22 bp, Homo sapiens
ctctctggtttcagcgaagggg

SEQ ID NO: 7903805 - DNA, 22 bp, Homo sapiens
ctctctgtcttggcatttggtc

SEQ ID NO: 7903806 - DNA, 22 bp, Homo sapiens
ctctctgtatgtgtatatttat

SEQ ID NO: 7903807 - DNA, 22 bp, Homo sapiens
ctctctggtttcagcgaagggg

SEQ ID NO: 7903808 - DNA, 22 bp, Homo sapiens
ctctctgtggtggctgtcccat

SEQ ID NO: 7903809 - DNA, 22 bp, Homo sapiens
ctctctgtggtggctgtcccat

SEQ ID NO: 7903810 - DNA, 22 bp, Homo sapiens
ctctctgtggtggctgtcccat

SEQ ID NO: 7903811 - DNA, 22 bp, Homo sapiens
ctctctgtggtggctgtcccat

SEQ ID NO: 7903812 - DNA, 22 bp, Homo sapiens
ctctctgtggtggctgtcccat

SEQ ID NO: 7903813 - DNA, 22 bp, Homo sapiens
ctctctgtcttggcatttggtc

SEQ ID NO: 7903814 - DNA, 22 bp, Homo sapiens
tttcatgttacagtgtaaaagt

SEQ ID NO: 7903815 - DNA, 22 bp, Homo sapiens
tttcagtttccagctttgtcat

SEQ ID NO: 7903816 - DNA, 22 bp, Homo sapiens
tttcagtttccagctttgtcat

SEQ ID NO: 7903817 - DNA, 22 bp, Homo sapiens
ctccttcctggttagcacctta

SEQ ID NO: 7903818 - DNA, 22 bp, Homo sapiens
ctccttcctggttagcacctta

SEQ ID NO: 7903819 - DNA, 22 bp, Homo sapiens
ctccttcctggttagcacctta

SEQ ID NO: 7903820 - DNA, 22 bp, Homo sapiens
ctccttcctgccccagtgataa

SEQ ID NO: 7903821 - DNA, 22 bp, Homo sapiens
ctccttcctgccccagtgataa

SEQ ID NO: 7903822 - DNA, 22 bp, Homo sapiens
ctccttcctgccccagtgataa

SEQ ID NO: 7903823 - DNA, 22 bp, Homo sapiens
ctccttcctggttagcacctta

SEQ ID NO: 7903824 - DNA, 22 bp, Homo sapiens
ctccttcctgcagatctgagat

SEQ ID NO: 7903825 - DNA, 22 bp, Homo sapiens
ctccttcctgcagatctgagat

SEQ ID NO: 7903826 - DNA, 22 bp, Homo sapiens
ctccttcccttcaagtgttcct

SEQ ID NO: 7903827 - DNA, 22 bp, Homo sapiens
ctccttcctgcagatctgagat

SEQ ID NO: 7903828 - DNA, 22 bp, Homo sapiens
ctccttcctgcagatctgagat

SEQ ID NO: 7903829 - DNA, 22 bp, Homo sapiens
ctccttccctaccatcaatgtt

SEQ ID NO: 7903830 - DNA, 22 bp, Homo sapiens
ctccttccctaccatcaatgtt

SEQ ID NO: 7903831 - DNA, 22 bp, Homo sapiens
ctccttccctaccatcaatgtt

SEQ ID NO: 7903832 - DNA, 22 bp, Homo sapiens
ctccttccctaccatcaatgtt

SEQ ID NO: 7903833 - DNA, 19 bp, Homo sapiens
ctccttccctggtttctgt

SEQ ID NO: 7903834 - DNA, 19 bp, Homo sapiens
ctccttccctggtttctgt

SEQ ID NO: 7903835 - DNA, 22 bp, Homo sapiens
ctccttcccttcaagtgttcct

SEQ ID NO: 7903836 - DNA, 22 bp, Homo sapiens
ctccttcccttcaagtgttcct

SEQ ID NO: 7903837 - DNA, 22 bp, Homo sapiens
ctccttcccttcaagtgttcct

SEQ ID NO: 7903838 - DNA, 22 bp, Homo sapiens
ctccttcccctactcagcatcc

SEQ ID NO: 7903839 - DNA, 22 bp, Homo sapiens
ctccttcccctactcagcatcc

SEQ ID NO: 7903840 - DNA, 22 bp, Homo sapiens
ctccttcccctactcagcatcc

SEQ ID NO: 7903841 - DNA, 22 bp, Homo sapiens
ctccttcccatgagtgtgggca

SEQ ID NO: 7903842 - DNA, 22 bp, Homo sapiens
ctccttcccatgagtgtgggca

SEQ ID NO: 7903843 - DNA, 22 bp, Homo sapiens
ctccttcccatgagtgtgggca

SEQ ID NO: 7903844 - DNA, 22 bp, Homo sapiens
ctccttccaacaagagaaagag

SEQ ID NO: 7903845 - DNA, 22 bp, Homo sapiens
ctccttccaacaagagaaagag

SEQ ID NO: 7903846 - DNA, 22 bp, Homo sapiens
ctccttccaacaagagaaagag

SEQ ID NO: 7903847 - DNA, 22 bp, Homo sapiens
tttcagaatagcaaagcaagct

SEQ ID NO: 7903848 - DNA, 22 bp, Homo sapiens
tttcagaatagcaaagcaagct

SEQ ID NO: 7903849 - DNA, 22 bp, Homo sapiens
tttcagaatagcaaagcaagct

SEQ ID NO: 7903850 - DNA, 22 bp, Homo sapiens
ctcctgtgttcaagcgattctc

SEQ ID NO: 7903851 - DNA, 22 bp, Homo sapiens
tttcagaatatcgattcagtga

SEQ ID NO: 7903852 - DNA, 22 bp, Homo sapiens
tttcagaatatcgattcagtga

SEQ ID NO: 7903853 - DNA, 23 bp, Homo sapiens
tttcagaagtggtcctaggaagc

SEQ ID NO: 7903854 - DNA, 23 bp, Homo sapiens
tttcagaagtggtcctaggaagc

SEQ ID NO: 7903855 - DNA, 22 bp, Homo sapiens
tttcagaagtcacagttgactg

SEQ ID NO: 7903856 - DNA, 22 bp, Homo sapiens
ctccttaaagggagcagcagct

SEQ ID NO: 7903857 - DNA, 22 bp, Homo sapiens
ctccttaaagggagcagcagct

SEQ ID NO: 7903858 - DNA, 22 bp, Homo sapiens
ctccttaaattacgaacccact

SEQ ID NO: 7903859 - DNA, 22 bp, Homo sapiens
ctccttaaattacgaacccact

SEQ ID NO: 7903860 - DNA, 22 bp, Homo sapiens
ctcctgttgcactagttcctga

SEQ ID NO: 7903861 - DNA, 22 bp, Homo sapiens
ctccttaactttgaagtgggta

SEQ ID NO: 7903862 - DNA, 22 bp, Homo sapiens
ctccttaagtatgggctgtgca

SEQ ID NO: 7903863 - DNA, 22 bp, Homo sapiens
ctccttcaaaagtcatagtaaa

SEQ ID NO: 7903864 - DNA, 22 bp, Homo sapiens
ctccttcaaagtggaattaaga

SEQ ID NO: 7903865 - DNA, 22 bp, Homo sapiens
ctccttcacgcaggctgccatg

SEQ ID NO: 7903866 - DNA, 22 bp, Homo sapiens
ctccttcacgcaggctgccatg

SEQ ID NO: 7903867 - DNA, 22 bp, Homo sapiens
ctccttcagctgaatccctgct

SEQ ID NO: 7903868 - DNA, 22 bp, Homo sapiens
ctccttcatgtcatgtgtccgg

SEQ ID NO: 7903869 - DNA, 22 bp, Homo sapiens
ctccttcagtctgcgtggctgt

SEQ ID NO: 7903870 - DNA, 22 bp, Homo sapiens
ctccttcagtctgcgtggctgt

SEQ ID NO: 7903871 - DNA, 22 bp, Homo sapiens
ctccttcagctgaatccctgct

SEQ ID NO: 7903872 - DNA, 22 bp, Homo sapiens
ctccttcagtctgcgtggctgt

SEQ ID NO: 7903873 - DNA, 22 bp, Homo sapiens
ctccttcagctgaatccctgct

SEQ ID NO: 7903874 - DNA, 22 bp, Homo sapiens
ctccttcatgtcatgtgtccgg

SEQ ID NO: 7903875 - DNA, 22 bp, Homo sapiens
ctccttcatgtcatgtgtccgg

SEQ ID NO: 7903876 - DNA, 22 bp, Homo sapiens
ctccttcatgtcatgtgtccgg

SEQ ID NO: 7903877 - DNA, 22 bp, Homo sapiens
ctccttccaacaagagaaagag

SEQ ID NO: 7903878 - DNA, 22 bp, Homo sapiens
tttcagaaatggcactgaaatc

SEQ ID NO: 7903879 - DNA, 22 bp, Homo sapiens
tttcacatatcaactctatcct

SEQ ID NO: 7903880 - DNA, 22 bp, Homo sapiens
tttcacatataggggaagctac

SEQ ID NO: 7903881 - DNA, 22 bp, Homo sapiens
tttcacatataggggaagctac

SEQ ID NO: 7903882 - DNA, 22 bp, Homo sapiens
tttcacatataggggaagctac

SEQ ID NO: 7903883 - DNA, 22 bp, Homo sapiens
tttcacatataggggaagctac

SEQ ID NO: 7903884 - DNA, 22 bp, Homo sapiens
tttcacatataggggaagctac

SEQ ID NO: 7903885 - DNA, 22 bp, Homo sapiens
tttattcattgtttcgtcgcag

SEQ ID NO: 7903886 - DNA, 22 bp, Homo sapiens
tttattcatcatctgttcatat

SEQ ID NO: 7903887 - DNA, 22 bp, Homo sapiens
tttattcatcatctgttcatat

SEQ ID NO: 7903888 - DNA, 22 bp, Homo sapiens
tttattcattgtttcgtcgcag

SEQ ID NO: 7903889 - DNA, 22 bp, Homo sapiens
tttattcattgtttcgtcgcag

SEQ ID NO: 7903890 - DNA, 22 bp, Homo sapiens
tttattcatcatctgttcatat

SEQ ID NO: 7903891 - DNA, 22 bp, Homo sapiens
tttattcatcatctgttcatat

SEQ ID NO: 7903892 - DNA, 22 bp, Homo sapiens
tttattcatcatctgttcatat

SEQ ID NO: 7903893 - DNA, 22 bp, Homo sapiens
tttattcatcatctgttcatat

SEQ ID NO: 7903894 - DNA, 22 bp, Homo sapiens
tttattcatcatctgttcatat

SEQ ID NO: 7903895 - DNA, 22 bp, Homo sapiens
tttattcatcatctgttcatat

SEQ ID NO: 7903896 - DNA, 22 bp, Homo sapiens
tttattcatcatctgttcatat

SEQ ID NO: 7903897 - DNA, 20 bp, Homo sapiens
tttattcagcctaccctctt

SEQ ID NO: 7903898 - DNA, 20 bp, Homo sapiens
tttattcagcctaccctctt

SEQ ID NO: 7903899 - DNA, 22 bp, Homo sapiens
tttattcagcagcagcagtggt

SEQ ID NO: 7903900 - DNA, 22 bp, Homo sapiens
tttattcagcagcagcagtggt

SEQ ID NO: 7903901 - DNA, 22 bp, Homo sapiens
tttcagaaattatattagatgc

SEQ ID NO: 7903902 - DNA, 22 bp, Homo sapiens
tttcagaaattgttattattct

SEQ ID NO: 7903903 - DNA, 22 bp, Homo sapiens
tttcagaaattatattagatgc

SEQ ID NO: 7903904 - DNA, 22 bp, Homo sapiens
tttcagaaattatattagatgc

SEQ ID NO: 7903905 - DNA, 22 bp, Homo sapiens
tttcacatatcaactctatcct

SEQ ID NO: 7903906 - DNA, 22 bp, Homo sapiens
tttcagaaattatattagatgc

SEQ ID NO: 7903907 - DNA, 22 bp, Homo sapiens
tttcagaaattatattagatgc

SEQ ID NO: 7903908 - DNA, 22 bp, Homo sapiens
tttcagaaccaagagagacatc

SEQ ID NO: 7903909 - DNA, 22 bp, Homo sapiens
tttcagaacagggattgggcct

SEQ ID NO: 7903910 - DNA, 22 bp, Homo sapiens
tttcagaaattgttattattct

SEQ ID NO: 7903911 - DNA, 22 bp, Homo sapiens
tttcagaaccgctaaaataaat

SEQ ID NO: 7903912 - DNA, 22 bp, Homo sapiens
tttcagaagtcaactaggtaaa

SEQ ID NO: 7903913 - DNA, 22 bp, Homo sapiens
tttcagaagtcaactaggtaaa

SEQ ID NO: 7903914 - DNA, 22 bp, Homo sapiens
tttcagaaggggagaaaggtca

SEQ ID NO: 7903915 - DNA, 22 bp, Homo sapiens
tttcagaaccgctaaaataaat

SEQ ID NO: 7903916 - DNA, 22 bp, Homo sapiens
tttcagaaccgctaaaataaat

SEQ ID NO: 7903917 - DNA, 22 bp, Homo sapiens
tttcagaaccaagagagacatc

SEQ ID NO: 7903918 - DNA, 22 bp, Homo sapiens
tttcagaaccgctaaaataaat

SEQ ID NO: 7903919 - DNA, 22 bp, Homo sapiens
ctccaggccatggctgcggagg

SEQ ID NO: 7903920 - DNA, 22 bp, Homo sapiens
ctccaggcccacggccgcggcc

SEQ ID NO: 7903921 - DNA, 22 bp, Homo sapiens
ctccaggcccacggccgcggcc

SEQ ID NO: 7903922 - DNA, 22 bp, Homo sapiens
ctccaggcccacggccgcggcc

SEQ ID NO: 7903923 - DNA, 22 bp, Homo sapiens
ctccaggcccacgtcgaggagg

SEQ ID NO: 7903924 - DNA, 22 bp, Homo sapiens
ctccaggccaagattaagtaat

SEQ ID NO: 7903925 - DNA, 22 bp, Homo sapiens
ctccaggccagggaagtggaca

SEQ ID NO: 7903926 - DNA, 22 bp, Homo sapiens
ctccaggccagggaagtggaca

SEQ ID NO: 7903927 - DNA, 22 bp, Homo sapiens
ctccaggccagggaagtggaca

SEQ ID NO: 7903928 - DNA, 22 bp, Homo sapiens
ctccaggccagggaagtggaca

SEQ ID NO: 7903929 - DNA, 22 bp, Homo sapiens
ctccaggccatggctgcggagg

SEQ ID NO: 7903930 - DNA, 22 bp, Homo sapiens
ctccaggccagggaagtggaca

SEQ ID NO: 7903931 - DNA, 22 bp, Homo sapiens
ctccaggccatggctgcggagg

SEQ ID NO: 7903932 - DNA, 22 bp, Homo sapiens
ctccaggcccctggccttctgc

SEQ ID NO: 7903933 - DNA, 23 bp, Homo sapiens
tttatattcctaatgtcttgagc

SEQ ID NO: 7903934 - DNA, 23 bp, Homo sapiens
tttatattcctaatgtcttgagc

SEQ ID NO: 7903935 - DNA, 22 bp, Homo sapiens
ctccaggcccctggccttctgc

SEQ ID NO: 7903936 - DNA, 22 bp, Homo sapiens
ctccaggcccacgtcgaggagg

SEQ ID NO: 7903937 - DNA, 22 bp, Homo sapiens
ctccaggcccctggccttctgc

SEQ ID NO: 7903938 - DNA, 22 bp, Homo sapiens
ctccaggcccctggccttctgc

SEQ ID NO: 7903939 - DNA, 23 bp, Homo sapiens
tttatattcctaatgtcttgagc

SEQ ID NO: 7903940 - DNA, 22 bp, Homo sapiens
tttatgattaatccaattctgt

SEQ ID NO: 7903941 - DNA, 23 bp, Homo sapiens
tttatattcctaatgtcttgagc

SEQ ID NO: 7903942 - DNA, 23 bp, Homo sapiens
tttatattcctaatgtcttgagc

SEQ ID NO: 7903943 - DNA, 22 bp, Homo sapiens
tttatgattaatccaattctgt

SEQ ID NO: 7903944 - DNA, 22 bp, Homo sapiens
tttatgattattttaaagcagc

SEQ ID NO: 7903945 - DNA, 22 bp, Homo sapiens
tttatgattattttaaagcagc

SEQ ID NO: 7903946 - DNA, 22 bp, Homo sapiens
tttatgattattttaaagcagc

SEQ ID NO: 7903947 - DNA, 22 bp, Homo sapiens
ctccaggatgttagacgtccag

SEQ ID NO: 7903948 - DNA, 22 bp, Homo sapiens
ctccaggatgttagacgtccag

SEQ ID NO: 7903949 - DNA, 22 bp, Homo sapiens
ctccaggccaagattaagtaat

SEQ ID NO: 7903950 - DNA, 22 bp, Homo sapiens
ctccaggatgttagacgtccag

SEQ ID NO: 7903951 - DNA, 22 bp, Homo sapiens
ctccaggatgttagacgtccag

SEQ ID NO: 7903952 - DNA, 22 bp, Homo sapiens
ctccaggatacctgttcctata

SEQ ID NO: 7903953 - DNA, 22 bp, Homo sapiens
ctccaggatacctgttcctata

SEQ ID NO: 7903954 - DNA, 19 bp, Homo sapiens
ctccaggatggctgggcga

SEQ ID NO: 7903955 - DNA, 19 bp, Homo sapiens
ctccaggatggctgggcga

SEQ ID NO: 7903956 - DNA, 19 bp, Homo sapiens
ctccaggatggctgggcga

SEQ ID NO: 7903957 - DNA, 22 bp, Homo sapiens
ctccaggatacctgttcctata

SEQ ID NO: 7903958 - DNA, 19 bp, Homo sapiens
ctccaggatggctgggcga

SEQ ID NO: 7903959 - DNA, 19 bp, Homo sapiens
ctccaggatggctgggcga

SEQ ID NO: 7903960 - DNA, 22 bp, Homo sapiens
ctccaggagggcttcctgtgat

SEQ ID NO: 7903961 - DNA, 22 bp, Homo sapiens
ctccaggagggcttcctgtgat

SEQ ID NO: 7903962 - DNA, 22 bp, Homo sapiens
ctccaggagggcttcctgtgat

SEQ ID NO: 7903963 - DNA, 22 bp, Homo sapiens
ctccaggagctgtgtctttctt

SEQ ID NO: 7903964 - DNA, 22 bp, Homo sapiens
ctccaggagggcttcctgtgat

SEQ ID NO: 7903965 - DNA, 22 bp, Homo sapiens
ctccaggaggttgctgcttcct

SEQ ID NO: 7903966 - DNA, 22 bp, Homo sapiens
ctccaggaggttgctgcttcct

SEQ ID NO: 7903967 - DNA, 22 bp, Homo sapiens
ctccaggaggttgctgcttcct

SEQ ID NO: 7903968 - DNA, 22 bp, Homo sapiens
ctccaggagtggcctggacacc

SEQ ID NO: 7903969 - DNA, 22 bp, Homo sapiens
ctccaggagtggcctggacacc

SEQ ID NO: 7903970 - DNA, 22 bp, Homo sapiens
ctccaggagggggatggctgta

SEQ ID NO: 7903971 - DNA, 22 bp, Homo sapiens
ctccaggaggttgctgcttcct

SEQ ID NO: 7903972 - DNA, 22 bp, Homo sapiens
ctccaggagggggatggctgta

SEQ ID NO: 7903973 - DNA, 22 bp, Homo sapiens
ctccaggagggggatggctgta

SEQ ID NO: 7903974 - DNA, 22 bp, Homo sapiens
tttattcactggggtctgcccg

SEQ ID NO: 7903975 - DNA, 22 bp, Homo sapiens
tttattcactggggtctgcccg

SEQ ID NO: 7903976 - DNA, 22 bp, Homo sapiens
tttattcactggggtctgcccg

SEQ ID NO: 7903977 - DNA, 22 bp, Homo sapiens
tttattcagcagcagcagtggt

SEQ ID NO: 7903978 - DNA, 22 bp, Homo sapiens
tttattcacttcagtgccaaag

SEQ ID NO: 7903979 - DNA, 22 bp, Homo sapiens
tttattcacttcagtgccaaag

SEQ ID NO: 7903980 - DNA, 22 bp, Homo sapiens
tttattcacttcagtgccaaag

SEQ ID NO: 7903981 - DNA, 22 bp, Homo sapiens
tttattcactcattcagccagt

SEQ ID NO: 7903982 - DNA, 22 bp, Homo sapiens
tttattcactcattcagccagt

SEQ ID NO: 7903983 - DNA, 19 bp, Homo sapiens
tttattcacctttaccttg

SEQ ID NO: 7903984 - DNA, 19 bp, Homo sapiens
tttattcacctttaccttg

SEQ ID NO: 7903985 - DNA, 22 bp, Homo sapiens
tttatgtaagtggaatgatgcc

SEQ ID NO: 7903986 - DNA, 22 bp, Homo sapiens
tttatgtaagtggaatgatgcc

SEQ ID NO: 7903987 - DNA, 22 bp, Homo sapiens
tttatgtaagtggaatgatgcc

SEQ ID NO: 7903988 - DNA, 22 bp, Homo sapiens
tttatgtaatttcataggtgtg

SEQ ID NO: 7903989 - DNA, 19 bp, Homo sapiens
tttattcacctttaccttg

SEQ ID NO: 7903990 - DNA, 19 bp, Homo sapiens
tttattcacctttaccttg

SEQ ID NO: 7903991 - DNA, 22 bp, Homo sapiens
tttatgctgaggcccaggaata

SEQ ID NO: 7903992 - DNA, 22 bp, Homo sapiens
tttatgggcatccagggggtat

SEQ ID NO: 7903993 - DNA, 22 bp, Homo sapiens
tttatgtaagtggaatgatgcc

SEQ ID NO: 7903994 - DNA, 22 bp, Homo sapiens
tttatgtaagtggaatgatgcc

SEQ ID NO: 7903995 - DNA, 22 bp, Homo sapiens
tttatggttgcagaggttggag

SEQ ID NO: 7903996 - DNA, 22 bp, Homo sapiens
tttatgctgtactcttgggaag

SEQ ID NO: 7903997 - DNA, 22 bp, Homo sapiens
tttatgctgaggcccaggaata

SEQ ID NO: 7903998 - DNA, 22 bp, Homo sapiens
tttatgctcatccaaggaaggt

SEQ ID NO: 7903999 - DNA, 22 bp, Homo sapiens
tttatgctactcaatagtcagt

SEQ ID NO: 7904000 - DNA, 22 bp, Homo sapiens
tttatgctactcaatagtcagt

SEQ ID NO: 7904001 - DNA, 22 bp, Homo sapiens
tttatgctcatccaaggaaggt

SEQ ID NO: 7904002 - DNA, 23 bp, Homo sapiens
tttatgctatactggaagggaaa

SEQ ID NO: 7904003 - DNA, 23 bp, Homo sapiens
tttatgctatactggaagggaaa

SEQ ID NO: 7904004 - DNA, 22 bp, Homo sapiens
tttatgctatactgctgacatg

SEQ ID NO: 7904005 - DNA, 22 bp, Homo sapiens
tttatgcatctctaggaagggc

SEQ ID NO: 7904006 - DNA, 22 bp, Homo sapiens
tttatgcagcctcagtatcaga

SEQ ID NO: 7904007 - DNA, 22 bp, Homo sapiens
tttatgcagcctcagtatcaga

SEQ ID NO: 7904008 - DNA, 22 bp, Homo sapiens
tttatgcagcctcagtatcaga

SEQ ID NO: 7904009 - DNA, 21 bp, Homo sapiens
tttatgcagataatgctattt

SEQ ID NO: 7904010 - DNA, 21 bp, Homo sapiens
tttatgcagataatgctattt

SEQ ID NO: 7904011 - DNA, 22 bp, Homo sapiens
tttatgcagatttgtacagtga

SEQ ID NO: 7904012 - DNA, 22 bp, Homo sapiens
tttatgcagcactttacatttg

SEQ ID NO: 7904013 - DNA, 22 bp, Homo sapiens
tttatgcagcactttacatttg

SEQ ID NO: 7904014 - DNA, 23 bp, Homo sapiens
tttatgcagcatgtagaacatgg

SEQ ID NO: 7904015 - DNA, 23 bp, Homo sapiens
tttatgcagcatgtagaacatgg

SEQ ID NO: 7904016 - DNA, 23 bp, Homo sapiens
tttatgcagcatgtagaacatgg

SEQ ID NO: 7904017 - DNA, 22 bp, Homo sapiens
tttatgcacacttagacatggc

SEQ ID NO: 7904018 - DNA, 22 bp, Homo sapiens
tttatgcacacttagacatggc

SEQ ID NO: 7904019 - DNA, 22 bp, Homo sapiens
tttatgcacacttagacatggc

SEQ ID NO: 7904020 - DNA, 21 bp, Homo sapiens
tttatgcagataatgctattt

SEQ ID NO: 7904021 - DNA, 22 bp, Homo sapiens
tttatgattattttaaagcagc

SEQ ID NO: 7904022 - DNA, 22 bp, Homo sapiens
ctatagaaaattgtatcacacg

SEQ ID NO: 7904023 - DNA, 22 bp, Homo sapiens
ctatagaaaattgtatcacacg

SEQ ID NO: 7904024 - DNA, 22 bp, Homo sapiens
ctatacagtgactagaagtaat

SEQ ID NO: 7904025 - DNA, 22 bp, Homo sapiens
ctatactactatacagatgtaa

SEQ ID NO: 7904026 - DNA, 22 bp, Homo sapiens
ctatacagcagcttactagtta

SEQ ID NO: 7904027 - DNA, 22 bp, Homo sapiens
ctatagaaacaacctctctttc

SEQ ID NO: 7904028 - DNA, 22 bp, Homo sapiens
ctcacaggttctgcagctcaca

SEQ ID NO: 7904029 - DNA, 22 bp, Homo sapiens
ctcacaggttctgcagctcaca

SEQ ID NO: 7904030 - DNA, 22 bp, Homo sapiens
ctcacaggttctgcagctcaca

SEQ ID NO: 7904031 - DNA, 22 bp, Homo sapiens
ctcaccatggatcttccatttc

SEQ ID NO: 7904032 - DNA, 18 bp, Homo sapiens
ctcaccattctgcccaat

SEQ ID NO: 7904033 - DNA, 22 bp, Homo sapiens
ctcacccatatctccatgactc

SEQ ID NO: 7904034 - DNA, 22 bp, Homo sapiens
ctcacccagaggctttccccct

SEQ ID NO: 7904035 - DNA, 22 bp, Homo sapiens
ctcacccatatctccatgactc

SEQ ID NO: 7904036 - DNA, 22 bp, Homo sapiens
ctcaccccactaccccttggtg

SEQ ID NO: 7904037 - DNA, 22 bp, Homo sapiens
ctcacccatatctccatgactc

SEQ ID NO: 7904038 - DNA, 22 bp, Homo sapiens
ctcacccatatctccatgactc

SEQ ID NO: 7904039 - DNA, 22 bp, Homo sapiens
ctcacccctgtaattccagcac

SEQ ID NO: 7904040 - DNA, 22 bp, Homo sapiens
ctcacccctgtaattccagcac

SEQ ID NO: 7904041 - DNA, 22 bp, Homo sapiens
ctcacccctgtaattccagcac

SEQ ID NO: 7904042 - DNA, 22 bp, Homo sapiens
ctcacccctgtaattccagcac

SEQ ID NO: 7904043 - DNA, 22 bp, Homo sapiens
ctcacctgggtcagacagttgt

SEQ ID NO: 7904044 - DNA, 19 bp, Homo sapiens
ctcacctggaggtgctgat

SEQ ID NO: 7904045 - DNA, 22 bp, Homo sapiens
ctcacctgcaatcccttccagg

SEQ ID NO: 7904046 - DNA, 22 bp, Homo sapiens
ctcacctataagtctcacagtc

SEQ ID NO: 7904047 - DNA, 22 bp, Homo sapiens
ctcacctccaggagctgctggc

SEQ ID NO: 7904048 - DNA, 22 bp, Homo sapiens
ctcactgaaccttggcacctca

SEQ ID NO: 7904049 - DNA, 22 bp, Homo sapiens
ctcactcagacatccagtgcag

SEQ ID NO: 7904050 - DNA, 22 bp, Homo sapiens
ctcactgcaacctccgcctcct

SEQ ID NO: 7904051 - DNA, 22 bp, Homo sapiens
ctcactgcaacctctgcctccc

SEQ ID NO: 7904052 - DNA, 22 bp, Homo sapiens
ctcactgcaacctctgcctccc

SEQ ID NO: 7904053 - DNA, 22 bp, Homo sapiens
ctcactgcaacctctgcctccc

SEQ ID NO: 7904054 - DNA, 22 bp, Homo sapiens
ctcactgcaagctcagcctccc

SEQ ID NO: 7904055 - DNA, 22 bp, Homo sapiens
ctcactgcaagctcagcctccc

SEQ ID NO: 7904056 - DNA, 22 bp, Homo sapiens
ttctggcttcatctgacaagcc

SEQ ID NO: 7904057 - DNA, 22 bp, Homo sapiens
ttctggcttgacccctacttcc

SEQ ID NO: 7904058 - DNA, 22 bp, Homo sapiens
ttctggcttcatctgacaagcc

SEQ ID NO: 7904059 - DNA, 22 bp, Homo sapiens
ttctggctttaggcttttcaag

SEQ ID NO: 7904060 - DNA, 22 bp, Homo sapiens
ttctggctttaggcttttcaag

SEQ ID NO: 7904061 - DNA, 22 bp, Homo sapiens
ctataaatctacccagcattgg

SEQ ID NO: 7904062 - DNA, 22 bp, Homo sapiens
ttctggcttatcctaactctaa

SEQ ID NO: 7904063 - DNA, 22 bp, Homo sapiens
ttctggcttagttgttgtatat

SEQ ID NO: 7904064 - DNA, 22 bp, Homo sapiens
ttctggcttagttgttgtatat

SEQ ID NO: 7904065 - DNA, 22 bp, Homo sapiens
ttctggcttagttgttgtatat

SEQ ID NO: 7904066 - DNA, 22 bp, Homo sapiens
ttctggcttagttgttgtatat

SEQ ID NO: 7904067 - DNA, 22 bp, Homo sapiens
ttctggcttacttcactcattt

SEQ ID NO: 7904068 - DNA, 22 bp, Homo sapiens
ctataagacagatactgacttt

SEQ ID NO: 7904069 - DNA, 22 bp, Homo sapiens
ctataaatctacccagcattgg

SEQ ID NO: 7904070 - DNA, 22 bp, Homo sapiens
ctataaatctacccagcattgg

SEQ ID NO: 7904071 - DNA, 22 bp, Homo sapiens
ctataaatctacccagcattgg

SEQ ID NO: 7904072 - DNA, 22 bp, Homo sapiens
ctataactgggtattagactac

SEQ ID NO: 7904073 - DNA, 22 bp, Homo sapiens
ctataaatctacccagcattgg

SEQ ID NO: 7904074 - DNA, 22 bp, Homo sapiens
ctataaatctacccagcattgg

SEQ ID NO: 7904075 - DNA, 22 bp, Homo sapiens
ctataaatctacccagcattgg

SEQ ID NO: 7904076 - DNA, 22 bp, Homo sapiens
ttctggctcgattctctgaccg

SEQ ID NO: 7904077 - DNA, 23 bp, Homo sapiens
ttctggctccgagctccatcttc

SEQ ID NO: 7904078 - DNA, 22 bp, Homo sapiens
ttctggctccagatgcttctgt

SEQ ID NO: 7904079 - DNA, 22 bp, Homo sapiens
ttctggctccagatgcttctgt

SEQ ID NO: 7904080 - DNA, 22 bp, Homo sapiens
ttctggctctcccctgctgggt

SEQ ID NO: 7904081 - DNA, 22 bp, Homo sapiens
ttctggctcgattctctgaccg

SEQ ID NO: 7904082 - DNA, 22 bp, Homo sapiens
ttctggctcgattctctgaccg

SEQ ID NO: 7904083 - DNA, 22 bp, Homo sapiens
ttctggctgaaagtttatttga

SEQ ID NO: 7904084 - DNA, 22 bp, Homo sapiens
ttctggctgtatgatatttaat

SEQ ID NO: 7904085 - DNA, 22 bp, Homo sapiens
ttctggctgtatgatatttaat

SEQ ID NO: 7904086 - DNA, 22 bp, Homo sapiens
ttctggctaccctcctaatgtt

SEQ ID NO: 7904087 - DNA, 22 bp, Homo sapiens
ttctggccaaggctgccagatt

SEQ ID NO: 7904088 - DNA, 18 bp, Homo sapiens
ttctggctcactcatgct

SEQ ID NO: 7904089 - DNA, 18 bp, Homo sapiens
ttctggctcactcatgct

SEQ ID NO: 7904090 - DNA, 22 bp, Homo sapiens
ttctggctcatatgctaagaag

SEQ ID NO: 7904091 - DNA, 22 bp, Homo sapiens
ttctggcagattgcgtaataaa

SEQ ID NO: 7904092 - DNA, 22 bp, Homo sapiens
ttctggcatctgggggaggcct

SEQ ID NO: 7904093 - DNA, 22 bp, Homo sapiens
ttctggcatgagagatgggggt

SEQ ID NO: 7904094 - DNA, 22 bp, Homo sapiens
ttctggattatgtgtaagtgaa

SEQ ID NO: 7904095 - DNA, 22 bp, Homo sapiens
ttctggattttccaactcactg

SEQ ID NO: 7904096 - DNA, 22 bp, Homo sapiens
ttctggatgttgtagtctgaga

SEQ ID NO: 7904097 - DNA, 22 bp, Homo sapiens
ttctggattagcatgatcccta

SEQ ID NO: 7904098 - DNA, 18 bp, Homo sapiens
ctcagagatgcccttatt

SEQ ID NO: 7904099 - DNA, 18 bp, Homo sapiens
ctcagagatgcccttatt

SEQ ID NO: 7904100 - DNA, 22 bp, Homo sapiens
ctcagagagtgaattcctgcct

SEQ ID NO: 7904101 - DNA, 22 bp, Homo sapiens
ctcagagcaatgaacatgcaaa

SEQ ID NO: 7904102 - DNA, 22 bp, Homo sapiens
ctcagagcaatgaacatgcaaa

SEQ ID NO: 7904103 - DNA, 22 bp, Homo sapiens
ctcagagcaatgaacatgcaaa

SEQ ID NO: 7904104 - DNA, 22 bp, Homo sapiens
ctcagagcaatgaacatgcaaa

SEQ ID NO: 7904105 - DNA, 17 bp, Homo sapiens
ctcagagcaggacagaa

SEQ ID NO: 7904106 - DNA, 17 bp, Homo sapiens
ctcagagcaggacagaa

SEQ ID NO: 7904107 - DNA, 22 bp, Homo sapiens
ctcagagcacttttgaaagctc

SEQ ID NO: 7904108 - DNA, 17 bp, Homo sapiens
ctcagagcaggacagaa

SEQ ID NO: 7904109 - DNA, 17 bp, Homo sapiens
ctcagagcaggacagaa

SEQ ID NO: 7904110 - DNA, 22 bp, Homo sapiens
ctcagagcacttttgaaagctc

SEQ ID NO: 7904111 - DNA, 22 bp, Homo sapiens
ctcagagagggcaccagggcca

SEQ ID NO: 7904112 - DNA, 22 bp, Homo sapiens
ctcagagagggcaccagggcca

SEQ ID NO: 7904113 - DNA, 22 bp, Homo sapiens
ctcagagagggcaccagggcca

SEQ ID NO: 7904114 - DNA, 22 bp, Homo sapiens
ctcagagagggcaccagggcca

SEQ ID NO: 7904115 - DNA, 21 bp, Homo sapiens
ctcagagacaaatgccatccc

SEQ ID NO: 7904116 - DNA, 22 bp, Homo sapiens
ctcagagagacaatgtgggaca

SEQ ID NO: 7904117 - DNA, 22 bp, Homo sapiens
ctcagagaggcagtggaagtca

SEQ ID NO: 7904118 - DNA, 22 bp, Homo sapiens
ctcagagagacaatgtgggaca

SEQ ID NO: 7904119 - DNA, 19 bp, Homo sapiens
ctcagagaggggcagtgcc

SEQ ID NO: 7904120 - DNA, 19 bp, Homo sapiens
ctcagagaggggcagtgcc

SEQ ID NO: 7904121 - DNA, 19 bp, Homo sapiens
ctcagagaggggcagtgcc

SEQ ID NO: 7904122 - DNA, 17 bp, Homo sapiens
ctcagagagggtaagta

SEQ ID NO: 7904123 - DNA, 22 bp, Homo sapiens
ctcagagaggttgaacaacttg

SEQ ID NO: 7904124 - DNA, 22 bp, Homo sapiens
ctcagagagtgaattcctgcct

SEQ ID NO: 7904125 - DNA, 22 bp, Homo sapiens
ctcagagagttaagtgaattac

SEQ ID NO: 7904126 - DNA, 22 bp, Homo sapiens
ctcagagagtgaattcctgcct

SEQ ID NO: 7904127 - DNA, 22 bp, Homo sapiens
ctcagaggcaagcaaggagctg

SEQ ID NO: 7904128 - DNA, 22 bp, Homo sapiens
ctcagaggcaagcaaggagctg

SEQ ID NO: 7904129 - DNA, 22 bp, Homo sapiens
ctcagaggcaagcaaggagctg

SEQ ID NO: 7904130 - DNA, 22 bp, Homo sapiens
ctcagagccccaggagggtgtg

SEQ ID NO: 7904131 - DNA, 22 bp, Homo sapiens
ctcagagcccagggtacacccg

SEQ ID NO: 7904132 - DNA, 22 bp, Homo sapiens
ctcagagcccagggtacacccg

SEQ ID NO: 7904133 - DNA, 22 bp, Homo sapiens
ctcagagctgaggccagggaca

SEQ ID NO: 7904134 - DNA, 17 bp, Homo sapiens
ctcagagcaggacagaa

SEQ ID NO: 7904135 - DNA, 21 bp, Homo sapiens
ctcagagcagttcagagggat

SEQ ID NO: 7904136 - DNA, 21 bp, Homo sapiens
ctcagagcagttcagagggat

SEQ ID NO: 7904137 - DNA, 22 bp, Homo sapiens
ctcagagccagttagcaggtgc

SEQ ID NO: 7904138 - DNA, 22 bp, Homo sapiens
ctcagagccagttagcaggtgc

SEQ ID NO: 7904139 - DNA, 22 bp, Homo sapiens
ctcagagccagttagcaggtgc

SEQ ID NO: 7904140 - DNA, 22 bp, Homo sapiens
ctcagagcccagggtacacccg

SEQ ID NO: 7904141 - DNA, 21 bp, Homo sapiens
ttctttctgaatctgaagtat

SEQ ID NO: 7904142 - DNA, 21 bp, Homo sapiens
ttctttctgaatctgaagtat

SEQ ID NO: 7904143 - DNA, 21 bp, Homo sapiens
ttctttctgaatctgaagtat

SEQ ID NO: 7904144 - DNA, 21 bp, Homo sapiens
ttctttctgaatctgaagtat

SEQ ID NO: 7904145 - DNA, 22 bp, Homo sapiens
ttctttctgaatacagttgagt

SEQ ID NO: 7904146 - DNA, 22 bp, Homo sapiens
ttctttctgaatacagttgagt

SEQ ID NO: 7904147 - DNA, 22 bp, Homo sapiens
ttctttctgaatacagttgagt

SEQ ID NO: 7904148 - DNA, 22 bp, Homo sapiens
ttctttctgggaagagttcaga

SEQ ID NO: 7904149 - DNA, 22 bp, Homo sapiens
ttctttctgggaagagttcaga

SEQ ID NO: 7904150 - DNA, 21 bp, Homo sapiens
ttctttctgaatctgaagtat

SEQ ID NO: 7904151 - DNA, 21 bp, Homo sapiens
ttctttctgaatctgaagtat

SEQ ID NO: 7904152 - DNA, 22 bp, Homo sapiens
ttctttctgggaagagttcaga

SEQ ID NO: 7904153 - DNA, 22 bp, Homo sapiens
ttctttctggggtccttcggct

SEQ ID NO: 7904154 - DNA, 22 bp, Homo sapiens
ttctttctgggaagagttcaga

SEQ ID NO: 7904155 - DNA, 22 bp, Homo sapiens
ttctttctgaatacagttgagt

SEQ ID NO: 7904156 - DNA, 22 bp, Homo sapiens
ttctttctgaatacagttgagt

SEQ ID NO: 7904157 - DNA, 22 bp, Homo sapiens
ttctttctctgtaaaaggaaaa

SEQ ID NO: 7904158 - DNA, 22 bp, Homo sapiens
ttctttctctccacaaggcttg

SEQ ID NO: 7904159 - DNA, 22 bp, Homo sapiens
ttctttctctccacaaggcttg

SEQ ID NO: 7904160 - DNA, 22 bp, Homo sapiens
ttctttctctccacaaggcttg

SEQ ID NO: 7904161 - DNA, 22 bp, Homo sapiens
ttctttctctgtaaaaggaaaa

SEQ ID NO: 7904162 - DNA, 22 bp, Homo sapiens
ttctttctctactagcagagct

SEQ ID NO: 7904163 - DNA, 22 bp, Homo sapiens
ctcactgcaagctccacctctt

SEQ ID NO: 7904164 - DNA, 22 bp, Homo sapiens
ctcactgcaagctcagcctccc

SEQ ID NO: 7904165 - DNA, 22 bp, Homo sapiens
ctcactgcaagctcagcctccc

SEQ ID NO: 7904166 - DNA, 22 bp, Homo sapiens
ctcactgcaagctcagcctccc

SEQ ID NO: 7904167 - DNA, 22 bp, Homo sapiens
ctcagagaacctaagcggagga

SEQ ID NO: 7904168 - DNA, 22 bp, Homo sapiens
ctcagagaacctaagcggagga

SEQ ID NO: 7904169 - DNA, 22 bp, Homo sapiens
ctcagagaacctaagcggagga

SEQ ID NO: 7904170 - DNA, 21 bp, Homo sapiens
ctcagagaaatgtctgggagc

SEQ ID NO: 7904171 - DNA, 22 bp, Homo sapiens
ctcagagaagtctttgctaaac

SEQ ID NO: 7904172 - DNA, 22 bp, Homo sapiens
ctcagagaagatggatgaggta

SEQ ID NO: 7904173 - DNA, 22 bp, Homo sapiens
ctcagagaacctaagcggagga

SEQ ID NO: 7904174 - DNA, 22 bp, Homo sapiens
ctcagagaaatgtcacaacaat

SEQ ID NO: 7904175 - DNA, 22 bp, Homo sapiens
ctcagagaaatgtcacaacaat

SEQ ID NO: 7904176 - DNA, 22 bp, Homo sapiens
ctcagagaaatgtcacaacaat

SEQ ID NO: 7904177 - DNA, 21 bp, Homo sapiens
ctcagagaaatgtctgggagc

SEQ ID NO: 7904178 - DNA, 21 bp, Homo sapiens
ctcagagaaatgtctgggagc

SEQ ID NO: 7904179 - DNA, 22 bp, Homo sapiens
ctcagagaaaaggagcaagggt

SEQ ID NO: 7904180 - DNA, 22 bp, Homo sapiens
ctcagagaaaaggagcaagggt

SEQ ID NO: 7904181 - DNA, 22 bp, Homo sapiens
ctcagagaaaaggagcaagggt

SEQ ID NO: 7904182 - DNA, 22 bp, Homo sapiens
ttctttctgtcatggtgtactg

SEQ ID NO: 7904183 - DNA, 22 bp, Homo sapiens
ttctttctggggtccttcggct

SEQ ID NO: 7904184 - DNA, 22 bp, Homo sapiens
ttctttctggggtccttcggct

SEQ ID NO: 7904185 - DNA, 22 bp, Homo sapiens
ttctttctgtccataatgagac

SEQ ID NO: 7904186 - DNA, 22 bp, Homo sapiens
ctcagaaagggttgctgagggc

SEQ ID NO: 7904187 - DNA, 22 bp, Homo sapiens
ctcagaaagggttgctgagggc

SEQ ID NO: 7904188 - DNA, 22 bp, Homo sapiens
ctcagaaagggttgctgagggc

SEQ ID NO: 7904189 - DNA, 22 bp, Homo sapiens
ctcagaaaggtgccatttatgt

SEQ ID NO: 7904190 - DNA, 22 bp, Homo sapiens
ctcagagaaaaggagcaagggt

SEQ ID NO: 7904191 - DNA, 22 bp, Homo sapiens
ctcagaaaggtgccatttatgt

SEQ ID NO: 7904192 - DNA, 22 bp, Homo sapiens
cgtgtgtgtacctgcgcattta

SEQ ID NO: 7904193 - DNA, 22 bp, Homo sapiens
cgttaataggtgcaaggtaagg

SEQ ID NO: 7904194 - DNA, 22 bp, Homo sapiens
cgttaataggtgcaaggtaagg

SEQ ID NO: 7904195 - DNA, 17 bp, Homo sapiens
cgttagtgattcctgcc

SEQ ID NO: 7904196 - DNA, 22 bp, Homo sapiens
cgttaataggtgcaaggtaagg

SEQ ID NO: 7904197 - DNA, 22 bp, Homo sapiens
cgttgtttgagattttcagaat

SEQ ID NO: 7904198 - DNA, 22 bp, Homo sapiens
cgtttattttgaagattccact

SEQ ID NO: 7904199 - DNA, 22 bp, Homo sapiens
cgtttattttgaagattccact

SEQ ID NO: 7904200 - DNA, 22 bp, Homo sapiens
cgtttattttgaagattccact

SEQ ID NO: 7904201 - DNA, 22 bp, Homo sapiens
cgtttattttgaagattccact

SEQ ID NO: 7904202 - DNA, 22 bp, Homo sapiens
cgttcttttcatatttacatgg

SEQ ID NO: 7904203 - DNA, 22 bp, Homo sapiens
cgttcctctactccagctaccc

SEQ ID NO: 7904204 - DNA, 22 bp, Homo sapiens
ctaaaaatccacactaggtgaa

SEQ ID NO: 7904205 - DNA, 22 bp, Homo sapiens
ctaaaaatccacactaggtgaa

SEQ ID NO: 7904206 - DNA, 23 bp, Homo sapiens
cgttttttcctcagatgttctgg

SEQ ID NO: 7904207 - DNA, 23 bp, Homo sapiens
cgttttttcctcagatgttctgg

SEQ ID NO: 7904208 - DNA, 22 bp, Homo sapiens
cgtttattttgaagattccact

SEQ ID NO: 7904209 - DNA, 22 bp, Homo sapiens
cgtttcatcagtgctttaagaa

SEQ ID NO: 7904210 - DNA, 22 bp, Homo sapiens
cgtttttcagtggtcttaggtc

SEQ ID NO: 7904211 - DNA, 22 bp, Homo sapiens
cgttttcttcactttgcaagtt

SEQ ID NO: 7904212 - DNA, 22 bp, Homo sapiens
cgtgtgtgtacctgcgcattta

SEQ ID NO: 7904213 - DNA, 22 bp, Homo sapiens
cgtgtgtgtacctgcgcattta

SEQ ID NO: 7904214 - DNA, 20 bp, Homo sapiens
cgtgtgtggctattttgggt

SEQ ID NO: 7904215 - DNA, 20 bp, Homo sapiens
cgtgtgtggctattttgggt

SEQ ID NO: 7904216 - DNA, 22 bp, Homo sapiens
cgtgtggtcccggcaaggcaag

SEQ ID NO: 7904217 - DNA, 17 bp, Homo sapiens
cgtgtgcttgtgtgcac

SEQ ID NO: 7904218 - DNA, 22 bp, Homo sapiens
cgtgtggtcccggcaaggcaag

SEQ ID NO: 7904219 - DNA, 22 bp, Homo sapiens
cgtgtgcgtgcatatgcacaag

SEQ ID NO: 7904220 - DNA, 22 bp, Homo sapiens
cgtgtgcgcacacctgtttcca

SEQ ID NO: 7904221 - DNA, 17 bp, Homo sapiens
cgtgtgcttgtgtgcac

SEQ ID NO: 7904222 - DNA, 17 bp, Homo sapiens
cgtgtgcttgtgtgcac

SEQ ID NO: 7904223 - DNA, 17 bp, Homo sapiens
cgtgtgcttgtgtgcac

SEQ ID NO: 7904224 - DNA, 22 bp, Homo sapiens
cgtgtacagtctatcttttttc

SEQ ID NO: 7904225 - DNA, 22 bp, Homo sapiens
cgtgtacagtctatcttttttc

SEQ ID NO: 7904226 - DNA, 22 bp, Homo sapiens
cgtgtacacgcacacgtgtcct

SEQ ID NO: 7904227 - DNA, 22 bp, Homo sapiens
cgtggggcgggtggacacttgc

SEQ ID NO: 7904228 - DNA, 23 bp, Homo sapiens
cgtgtctgtgggcgatccggcct

SEQ ID NO: 7904229 - DNA, 22 bp, Homo sapiens
cgtgtctgtatgtcaatcagct

SEQ ID NO: 7904230 - DNA, 22 bp, Homo sapiens
cgtgtctgtgtatgcaggccgt

SEQ ID NO: 7904231 - DNA, 22 bp, Homo sapiens
cgtgtctgggatagcagaagta

SEQ ID NO: 7904232 - DNA, 22 bp, Homo sapiens
cgtgtctgggctcccatggcag

SEQ ID NO: 7904233 - DNA, 22 bp, Homo sapiens
ctagagaacaacattcatatgg

SEQ ID NO: 7904234 - DNA, 22 bp, Homo sapiens
ctagagaagaggctcagccagc

SEQ ID NO: 7904235 - DNA, 22 bp, Homo sapiens
ctagagaaaccccatgagcttt

SEQ ID NO: 7904236 - DNA, 22 bp, Homo sapiens
ctagagaaacgccgtgggagga

SEQ ID NO: 7904237 - DNA, 22 bp, Homo sapiens
ctagagaatcttttaagaagtg

SEQ ID NO: 7904238 - DNA, 22 bp, Homo sapiens
ctagagaagaggctcagccagc

SEQ ID NO: 7904239 - DNA, 22 bp, Homo sapiens
ctagagaagaggttaagcatga

SEQ ID NO: 7904240 - DNA, 18 bp, Homo sapiens
ctagagaaggttactatg

SEQ ID NO: 7904241 - DNA, 22 bp, Homo sapiens
ctagagaatggcaaagattaga

SEQ ID NO: 7904242 - DNA, 22 bp, Homo sapiens
ctagagaatcttttaagaagtg

SEQ ID NO: 7904243 - DNA, 22 bp, Homo sapiens
ctagagaattgtcttgagagtt

SEQ ID NO: 7904244 - DNA, 22 bp, Homo sapiens
ctagagaatggcaaagattaga

SEQ ID NO: 7904245 - DNA, 22 bp, Homo sapiens
ctagagaaaatgttaatacagt

SEQ ID NO: 7904246 - DNA, 22 bp, Homo sapiens
ctagagaaacagtgctctgaac

SEQ ID NO: 7904247 - DNA, 22 bp, Homo sapiens
ctagagaaaatgatagcaggaa

SEQ ID NO: 7904248 - DNA, 22 bp, Homo sapiens
ctagaaatattttacagtcaag

SEQ ID NO: 7904249 - DNA, 22 bp, Homo sapiens
ctagaaatattttacagtcaag

SEQ ID NO: 7904250 - DNA, 22 bp, Homo sapiens
ctagaaatattttacagtcaag

SEQ ID NO: 7904251 - DNA, 22 bp, Homo sapiens
ctagaaatattttacagtcaag

SEQ ID NO: 7904252 - DNA, 22 bp, Homo sapiens
ctagaaagatacttaaatcaag

SEQ ID NO: 7904253 - DNA, 18 bp, Homo sapiens
ctagatgagcttggcaag

SEQ ID NO: 7904254 - DNA, 22 bp, Homo sapiens
ttctatgattcatttagaagtt

SEQ ID NO: 7904255 - DNA, 18 bp, Homo sapiens
ctagatgagcttggcaag

SEQ ID NO: 7904256 - DNA, 19 bp, Homo sapiens
ctagatccagaaagtggta

SEQ ID NO: 7904257 - DNA, 22 bp, Homo sapiens
ctagatccattttctgtctctg

SEQ ID NO: 7904258 - DNA, 22 bp, Homo sapiens
ctagatcacactggttggctgc

SEQ ID NO: 7904259 - DNA, 19 bp, Homo sapiens
ctagagtaataagtacttt

SEQ ID NO: 7904260 - DNA, 22 bp, Homo sapiens
ctagagggatgttaggatagca

SEQ ID NO: 7904261 - DNA, 22 bp, Homo sapiens
ctagaggctcagcagatgcctg

SEQ ID NO: 7904262 - DNA, 22 bp, Homo sapiens
ctagagctttctgctggtgttg

SEQ ID NO: 7904263 - DNA, 22 bp, Homo sapiens
ctagaggaacagtttcaggttt

SEQ ID NO: 7904264 - DNA, 22 bp, Homo sapiens
ctagagctttctgctggtgttg

SEQ ID NO: 7904265 - DNA, 22 bp, Homo sapiens
ctagagctgttctgtgcactca

SEQ ID NO: 7904266 - DNA, 22 bp, Homo sapiens
ctagagcagattgcagagtagg

SEQ ID NO: 7904267 - DNA, 22 bp, Homo sapiens
ctagagaattgtcttgagagtt

SEQ ID NO: 7904268 - DNA, 17 bp, Homo sapiens
ctagagagaaagagcta

SEQ ID NO: 7904269 - DNA, 23 bp, Homo sapiens
ttctggaagatttacttgagaca

SEQ ID NO: 7904270 - DNA, 23 bp, Homo sapiens
ttctggaagatttacttgagaca

SEQ ID NO: 7904271 - DNA, 22 bp, Homo sapiens
ttctggaagcagtggggagtga

SEQ ID NO: 7904272 - DNA, 23 bp, Homo sapiens
ttctggaagatttacttgagaca

SEQ ID NO: 7904273 - DNA, 22 bp, Homo sapiens
ttctggaagccatgggaacagg

SEQ ID NO: 7904274 - DNA, 22 bp, Homo sapiens
ttctggaagccatgggaacagg

SEQ ID NO: 7904275 - DNA, 22 bp, Homo sapiens
ttctggaagctgcaggtggccg

SEQ ID NO: 7904276 - DNA, 22 bp, Homo sapiens
ttctggaagccccagagtcaga

SEQ ID NO: 7904277 - DNA, 22 bp, Homo sapiens
ttctggaagccccagagtcaga

SEQ ID NO: 7904278 - DNA, 22 bp, Homo sapiens
ttctggaagccccagagtcaga

SEQ ID NO: 7904279 - DNA, 22 bp, Homo sapiens
ttctggaagccccagagtcaga

SEQ ID NO: 7904280 - DNA, 22 bp, Homo sapiens
ttctggaagccctaagggagaa

SEQ ID NO: 7904281 - DNA, 22 bp, Homo sapiens
ttctggaagggtggagtagctt

SEQ ID NO: 7904282 - DNA, 22 bp, Homo sapiens
ttctggaaggcagggagaaccc

SEQ ID NO: 7904283 - DNA, 22 bp, Homo sapiens
ttctggatgctgttaagatgta

SEQ ID NO: 7904284 - DNA, 22 bp, Homo sapiens
ttctggatgctgttaagatgta

SEQ ID NO: 7904285 - DNA, 23 bp, Homo sapiens
ttctggatgttctagtctgagag

SEQ ID NO: 7904286 - DNA, 23 bp, Homo sapiens
ttctggatgttctagtctgagag

SEQ ID NO: 7904287 - DNA, 23 bp, Homo sapiens
ttctggatgttctagtctgagag

SEQ ID NO: 7904288 - DNA, 22 bp, Homo sapiens
ttctggaagctgggcagcaccc

SEQ ID NO: 7904289 - DNA, 22 bp, Homo sapiens
ttctggaagctggaaaaggcaa

SEQ ID NO: 7904290 - DNA, 22 bp, Homo sapiens
ttctggaagctgggcagcaccc

SEQ ID NO: 7904291 - DNA, 22 bp, Homo sapiens
ttctggaagctgggcagcaccc

SEQ ID NO: 7904292 - DNA, 22 bp, Homo sapiens
ttctggaagctgggcagcaccc

SEQ ID NO: 7904293 - DNA, 22 bp, Homo sapiens
ttctgcatgatattaaatgtaa

SEQ ID NO: 7904294 - DNA, 22 bp, Homo sapiens
ttctgcatctgaatttaagtac

SEQ ID NO: 7904295 - DNA, 22 bp, Homo sapiens
ttctgcatctgaatttaagtac

SEQ ID NO: 7904296 - DNA, 22 bp, Homo sapiens
ttctgcatctcacagccagtgc

SEQ ID NO: 7904297 - DNA, 22 bp, Homo sapiens
ttctgcatctatttttctgctg

SEQ ID NO: 7904298 - DNA, 22 bp, Homo sapiens
ttctgcatctatttttctgctg

SEQ ID NO: 7904299 - DNA, 22 bp, Homo sapiens
ttctgcatcctatgatcgcata

SEQ ID NO: 7904300 - DNA, 22 bp, Homo sapiens
ttctgcatccctttttgggcca

SEQ ID NO: 7904301 - DNA, 22 bp, Homo sapiens
ttctgcatggtcaaggctttct

SEQ ID NO: 7904302 - DNA, 22 bp, Homo sapiens
ttctgcatgggctgttggcgtc

SEQ ID NO: 7904303 - DNA, 22 bp, Homo sapiens
ttctgcatgccctctgtgtggc

SEQ ID NO: 7904304 - DNA, 22 bp, Homo sapiens
ttctgcatggagaaactgagtc

SEQ ID NO: 7904305 - DNA, 22 bp, Homo sapiens
ttctgcatgtgtttcaaatact

SEQ ID NO: 7904306 - DNA, 22 bp, Homo sapiens
ttctggaactatactgttggtg

SEQ ID NO: 7904307 - DNA, 22 bp, Homo sapiens
ttctggaagaggtgtaagtata

SEQ ID NO: 7904308 - DNA, 22 bp, Homo sapiens
ttctggaagagtaaaataagcc

SEQ ID NO: 7904309 - DNA, 22 bp, Homo sapiens
ttctggaagatacctctcctaa

SEQ ID NO: 7904310 - DNA, 22 bp, Homo sapiens
ttctggaagatacctctcctaa

SEQ ID NO: 7904311 - DNA, 22 bp, Homo sapiens
ttctggaaccaacatgccagtt

SEQ ID NO: 7904312 - DNA, 22 bp, Homo sapiens
ttctggaaccaacatgccagtt

SEQ ID NO: 7904313 - DNA, 23 bp, Homo sapiens
ttctgcatgtttcagagctggga

SEQ ID NO: 7904314 - DNA, 22 bp, Homo sapiens
ttctggaaccagcctgcctggg

SEQ ID NO: 7904315 - DNA, 22 bp, Homo sapiens
ttctggaaccagcctgcctggg

SEQ ID NO: 7904316 - DNA, 22 bp, Homo sapiens
ttctattaatatgttaattctg

SEQ ID NO: 7904317 - DNA, 22 bp, Homo sapiens
ttctattgacattcactgtaac

SEQ ID NO: 7904318 - DNA, 22 bp, Homo sapiens
ttctattgaatgataatctata

SEQ ID NO: 7904319 - DNA, 22 bp, Homo sapiens
ttctattgaatgataatctata

SEQ ID NO: 7904320 - DNA, 22 bp, Homo sapiens
ttctattgacattcactgtaac

SEQ ID NO: 7904321 - DNA, 22 bp, Homo sapiens
ttctatttccagtccttcagag

SEQ ID NO: 7904322 - DNA, 22 bp, Homo sapiens
ttctattgtaccttttctctca

SEQ ID NO: 7904323 - DNA, 22 bp, Homo sapiens
ttctatttccagtccttcagag

SEQ ID NO: 7904324 - DNA, 22 bp, Homo sapiens
ttctattgtaccttttctctca

SEQ ID NO: 7904325 - DNA, 22 bp, Homo sapiens
ttctattgtaccttttctctca

SEQ ID NO: 7904326 - DNA, 22 bp, Homo sapiens
ttctattgggcagcattgcttc

SEQ ID NO: 7904327 - DNA, 22 bp, Homo sapiens
ttctattgggcagcattgcttc

SEQ ID NO: 7904328 - DNA, 22 bp, Homo sapiens
ttctattgcacacaaataatta

SEQ ID NO: 7904329 - DNA, 22 bp, Homo sapiens
ttctattgcacacaaataatta

SEQ ID NO: 7904330 - DNA, 22 bp, Homo sapiens
ttctattgggaagtgtgagagt

SEQ ID NO: 7904331 - DNA, 22 bp, Homo sapiens
ttctattgggaagtgtgagagt

SEQ ID NO: 7904332 - DNA, 22 bp, Homo sapiens
ttctatgtggatatagaactgc

SEQ ID NO: 7904333 - DNA, 22 bp, Homo sapiens
ttctatgttagtatgggtctcc

SEQ ID NO: 7904334 - DNA, 22 bp, Homo sapiens
ttctatgtggcatcaagctcag

SEQ ID NO: 7904335 - DNA, 22 bp, Homo sapiens
ttctatgtgttgacaagcctga

SEQ ID NO: 7904336 - DNA, 22 bp, Homo sapiens
ttctatgtcagtgtgctctgtg

SEQ ID NO: 7904337 - DNA, 22 bp, Homo sapiens
ttctatgtgaacgttatagttt

SEQ ID NO: 7904338 - DNA, 22 bp, Homo sapiens
ttctatgtcagtgtgctctgtg

SEQ ID NO: 7904339 - DNA, 22 bp, Homo sapiens
ttctatgtagataaggctgctc

SEQ ID NO: 7904340 - DNA, 22 bp, Homo sapiens
ttctatttccagtccttcagag

SEQ ID NO: 7904341 - DNA, 22 bp, Homo sapiens
ttctgaagctcccttttgtagt

SEQ ID NO: 7904342 - DNA, 22 bp, Homo sapiens
ttctgaagctcccttttgtagt

SEQ ID NO: 7904343 - DNA, 22 bp, Homo sapiens
ttctatttcttaatcttggctg

SEQ ID NO: 7904344 - DNA, 21 bp, Homo sapiens
ttctgcagccatgttggtttt

SEQ ID NO: 7904345 - DNA, 21 bp, Homo sapiens
ttctgcagccatgttggtttt

SEQ ID NO: 7904346 - DNA, 22 bp, Homo sapiens
ttctgaaggctcctcaggaaag

SEQ ID NO: 7904347 - DNA, 22 bp, Homo sapiens
ttctgaaggctcctcaggaaag

SEQ ID NO: 7904348 - DNA, 22 bp, Homo sapiens
ttctgcagcccaacagtagttt

SEQ ID NO: 7904349 - DNA, 22 bp, Homo sapiens
ttctgcaggagccctagtgtat

SEQ ID NO: 7904350 - DNA, 22 bp, Homo sapiens
ttctgcagctgtctcgcaggca

SEQ ID NO: 7904351 - DNA, 22 bp, Homo sapiens
ttctgcagctgtctcgcaggca

SEQ ID NO: 7904352 - DNA, 22 bp, Homo sapiens
ttctgcagtgttaacaatgtca

SEQ ID NO: 7904353 - DNA, 22 bp, Homo sapiens
ttctgcagtgttaacaatgtca

SEQ ID NO: 7904354 - DNA, 22 bp, Homo sapiens
ttctgcagtgtgcagggcctgt

SEQ ID NO: 7904355 - DNA, 22 bp, Homo sapiens
ttctgcagtgtgcagggcctgt

SEQ ID NO: 7904356 - DNA, 22 bp, Homo sapiens
ttctgcagtgaatgactcaata

SEQ ID NO: 7904357 - DNA, 22 bp, Homo sapiens
ttctgcaggctgtacaagaagc

SEQ ID NO: 7904358 - DNA, 22 bp, Homo sapiens
ttctgaaggctcctcaggaaag

SEQ ID NO: 7904359 - DNA, 22 bp, Homo sapiens
ttctgcaggatgctctggtggt

SEQ ID NO: 7904360 - DNA, 22 bp, Homo sapiens
ttctgcatcccagaagaggaca

SEQ ID NO: 7904361 - DNA, 22 bp, Homo sapiens
ttctgcataggctatatttgtt

SEQ ID NO: 7904362 - DNA, 22 bp, Homo sapiens
ttctgcataggctatatttgtt

SEQ ID NO: 7904363 - DNA, 22 bp, Homo sapiens
ttctgcagtgaatgactcaata

SEQ ID NO: 7904364 - DNA, 22 bp, Homo sapiens
ttctgcagtgttaacaatgtca

SEQ ID NO: 7904365 - DNA, 22 bp, Homo sapiens
ttctgcataacttcctgggtca

SEQ ID NO: 7904366 - DNA, 22 bp, Homo sapiens
ttctgcatacactgaatgtagt

SEQ ID NO: 7904367 - DNA, 22 bp, Homo sapiens
ttgcccagagtccacagcgtac

SEQ ID NO: 7904368 - DNA, 22 bp, Homo sapiens
ttgcccagagtccacagcgtac

SEQ ID NO: 7904369 - DNA, 22 bp, Homo sapiens
ttgcccagagtccacagcgtac

SEQ ID NO: 7904370 - DNA, 22 bp, Homo sapiens
ttgcccaggctggagtgcagta

SEQ ID NO: 7904371 - DNA, 22 bp, Homo sapiens
ttgcccaggctggagtgcagta

SEQ ID NO: 7904372 - DNA, 22 bp, Homo sapiens
ttgcccaggctggagtgcagta

SEQ ID NO: 7904373 - DNA, 22 bp, Homo sapiens
ttgcccaggctggagtgcagtg

SEQ ID NO: 7904374 - DNA, 22 bp, Homo sapiens
ttgcatcatttcctggccgtgt

SEQ ID NO: 7904375 - DNA, 22 bp, Homo sapiens
ttgcatcttctggttgagcccc

SEQ ID NO: 7904376 - DNA, 22 bp, Homo sapiens
ttgcatcaggtagacaactata

SEQ ID NO: 7904377 - DNA, 22 bp, Homo sapiens
ttgcatcaggtagacaactata

SEQ ID NO: 7904378 - DNA, 22 bp, Homo sapiens
ttgcatcagcaggcataattgg

SEQ ID NO: 7904379 - DNA, 22 bp, Homo sapiens
ttgcatcagaattacttggagg

SEQ ID NO: 7904380 - DNA, 22 bp, Homo sapiens
ttgcatcaaatatgtaccacag

SEQ ID NO: 7904381 - DNA, 22 bp, Homo sapiens
ttgcatcaattccttgtcctga

SEQ ID NO: 7904382 - DNA, 22 bp, Homo sapiens
ttgcatcagaaaatatgggaag

SEQ ID NO: 7904383 - DNA, 22 bp, Homo sapiens
ttgcatcacagtatctctgtaa

SEQ ID NO: 7904384 - DNA, 22 bp, Homo sapiens
ttgcatcacagtatctctgtaa

SEQ ID NO: 7904385 - DNA, 22 bp, Homo sapiens
ttgcatatgaagctgacttaaa

SEQ ID NO: 7904386 - DNA, 22 bp, Homo sapiens
ttgcatatcctccaacacatgg

SEQ ID NO: 7904387 - DNA, 22 bp, Homo sapiens
ttgcatatcctccaacacatgg

SEQ ID NO: 7904388 - DNA, 22 bp, Homo sapiens
ttgcatatatttctaaggaggt

SEQ ID NO: 7904389 - DNA, 22 bp, Homo sapiens
ttgcatagtgctgaggttcggg

SEQ ID NO: 7904390 - DNA, 22 bp, Homo sapiens
ttgccctggggctggcctggca

SEQ ID NO: 7904391 - DNA, 22 bp, Homo sapiens
ttgccctgcgttaccatctctt

SEQ ID NO: 7904392 - DNA, 22 bp, Homo sapiens
ttgccctgcgggtcctgcgcaa

SEQ ID NO: 7904393 - DNA, 22 bp, Homo sapiens
ttgccctgtcagtagaagtgca

SEQ ID NO: 7904394 - DNA, 22 bp, Homo sapiens
ttgccctgtcttaagctggcaa

SEQ ID NO: 7904395 - DNA, 22 bp, Homo sapiens
ttgccctgaagaacgtcccaga

SEQ ID NO: 7904396 - DNA, 22 bp, Homo sapiens
ttgccctgaagaacgtcccaga

SEQ ID NO: 7904397 - DNA, 22 bp, Homo sapiens
ttgccctgaagaacgtcccaga

SEQ ID NO: 7904398 - DNA, 22 bp, Homo sapiens
ttgccctgcctccctgaggtga

SEQ ID NO: 7904399 - DNA, 22 bp, Homo sapiens
ttgccctgcagcggtgagtggt

SEQ ID NO: 7904400 - DNA, 22 bp, Homo sapiens
ttgcccatctcagtgcctcgct

SEQ ID NO: 7904401 - DNA, 22 bp, Homo sapiens
ttgcccctcttggattttccgg

SEQ ID NO: 7904402 - DNA, 21 bp, Homo sapiens
ttgcccctgagtttttctgag

SEQ ID NO: 7904403 - DNA, 22 bp, Homo sapiens
ttgcccaggctggagtgcagtg

SEQ ID NO: 7904404 - DNA, 22 bp, Homo sapiens
ttgcccaggctggagtgcagtg

SEQ ID NO: 7904405 - DNA, 18 bp, Homo sapiens
ttgcccctgggtgaggat

SEQ ID NO: 7904406 - DNA, 22 bp, Homo sapiens
ttgcccctggtcagaggaggct

SEQ ID NO: 7904407 - DNA, 22 bp, Homo sapiens
ttgccccttggccgttaaaaca

SEQ ID NO: 7904408 - DNA, 22 bp, Homo sapiens
ctcagggtgagaaattgatcca

SEQ ID NO: 7904409 - DNA, 22 bp, Homo sapiens
ctcagggtgagaaattgatcca

SEQ ID NO: 7904410 - DNA, 22 bp, Homo sapiens
ctcagggtgcccggatcccagg

SEQ ID NO: 7904411 - DNA, 22 bp, Homo sapiens
ctcaggtagagtctgcatgggg

SEQ ID NO: 7904412 - DNA, 22 bp, Homo sapiens
ctcaggtcgctatttctcttac

SEQ ID NO: 7904413 - DNA, 22 bp, Homo sapiens
ctcagggtgcagcacagttcct

SEQ ID NO: 7904414 - DNA, 22 bp, Homo sapiens
ctcaggtagagtctgcatgggg

SEQ ID NO: 7904415 - DNA, 22 bp, Homo sapiens
ctcaggtcacggatctgagctg

SEQ ID NO: 7904416 - DNA, 22 bp, Homo sapiens
ctcagtcagtttttgtgagaga

SEQ ID NO: 7904417 - DNA, 22 bp, Homo sapiens
ctcagtaaggatgcttcagcgg

SEQ ID NO: 7904418 - DNA, 22 bp, Homo sapiens
ctcagtagaaaatacatggact

SEQ ID NO: 7904419 - DNA, 22 bp, Homo sapiens
ctcagtaaggatgcttcagcgg

SEQ ID NO: 7904420 - DNA, 22 bp, Homo sapiens
ctcagtactttatgtatatgat

SEQ ID NO: 7904421 - DNA, 22 bp, Homo sapiens
ctcagtactttatgtatatgat

SEQ ID NO: 7904422 - DNA, 22 bp, Homo sapiens
ctcaggtcttagttctgtcatc

SEQ ID NO: 7904423 - DNA, 22 bp, Homo sapiens
ctcaggtcttagttctgtcatc

SEQ ID NO: 7904424 - DNA, 22 bp, Homo sapiens
ctcaggttttggctttgtgtac

SEQ ID NO: 7904425 - DNA, 18 bp, Homo sapiens
ctcagggtgaccaatgca

SEQ ID NO: 7904426 - DNA, 22 bp, Homo sapiens
ctcagggtctggtccttagatt

SEQ ID NO: 7904427 - DNA, 22 bp, Homo sapiens
ctcagggggaatcaggtcacag

SEQ ID NO: 7904428 - DNA, 21 bp, Homo sapiens
ctcaggggattttgagattag

SEQ ID NO: 7904429 - DNA, 21 bp, Homo sapiens
ctcagggcttggtgtcctcat

SEQ ID NO: 7904430 - DNA, 22 bp, Homo sapiens
ctcaggggacctggctccgagt

SEQ ID NO: 7904431 - DNA, 22 bp, Homo sapiens
ctcaggggacctggctccgagt

SEQ ID NO: 7904432 - DNA, 21 bp, Homo sapiens
ctcagggcttggtgtcctcat

SEQ ID NO: 7904433 - DNA, 22 bp, Homo sapiens
ctcagggcttgagtgtccagga

SEQ ID NO: 7904434 - DNA, 22 bp, Homo sapiens
ctcagggagtagcacatgtgga

SEQ ID NO: 7904435 - DNA, 23 bp, Homo sapiens
ctcagggatagaaaggaagacag

SEQ ID NO: 7904436 - DNA, 23 bp, Homo sapiens
ctcagggatagaaaggaagacag

SEQ ID NO: 7904437 - DNA, 22 bp, Homo sapiens
ctcagggaattatttctgtcct

SEQ ID NO: 7904438 - DNA, 22 bp, Homo sapiens
ctcagggaagctatggtgaggg

SEQ ID NO: 7904439 - DNA, 22 bp, Homo sapiens
ctcagggaattgaatctccttg

SEQ ID NO: 7904440 - DNA, 22 bp, Homo sapiens
ctcagggaattatttctgtcct

SEQ ID NO: 7904441 - DNA, 22 bp, Homo sapiens
ctcagggaagctatggtgaggg

SEQ ID NO: 7904442 - DNA, 23 bp, Homo sapiens
ctcagggatagaaaggaagacag

SEQ ID NO: 7904443 - DNA, 22 bp, Homo sapiens
ctcagggatgggcagatgttaa

SEQ ID NO: 7904444 - DNA, 22 bp, Homo sapiens
ctcagggatggtgaagcaccca

SEQ ID NO: 7904445 - DNA, 22 bp, Homo sapiens
ctcagggatggtgaagcaccca

SEQ ID NO: 7904446 - DNA, 22 bp, Homo sapiens
ctcagggcagtatggctgagag

SEQ ID NO: 7904447 - DNA, 22 bp, Homo sapiens
ctcagggcagtatggctgagag

SEQ ID NO: 7904448 - DNA, 22 bp, Homo sapiens
ctcagggcagtatggctgagag

SEQ ID NO: 7904449 - DNA, 22 bp, Homo sapiens
ctcagggcagtatggctgagag

SEQ ID NO: 7904450 - DNA, 22 bp, Homo sapiens
ctcagggatggtgaagcaccca

SEQ ID NO: 7904451 - DNA, 22 bp, Homo sapiens
ctcagggccaaggatgctgttg

SEQ ID NO: 7904452 - DNA, 21 bp, Homo sapiens
ctcagggccatcttgccactg

SEQ ID NO: 7904453 - DNA, 21 bp, Homo sapiens
ctcagggccatcttgccactg

SEQ ID NO: 7904454 - DNA, 22 bp, Homo sapiens
ctcagggccaaggatgctgttg

SEQ ID NO: 7904455 - DNA, 22 bp, Homo sapiens
ctcagggcagtatggctgagag

SEQ ID NO: 7904456 - DNA, 22 bp, Homo sapiens
ctcagggcagtatggctgagag

SEQ ID NO: 7904457 - DNA, 18 bp, Homo sapiens
ctcagggcatcagtctgg

SEQ ID NO: 7904458 - DNA, 22 bp, Homo sapiens
ctcagggcggcgggcagcccag

SEQ ID NO: 7904459 - DNA, 22 bp, Homo sapiens
ctcagggctctgcatgcacacg

SEQ ID NO: 7904460 - DNA, 22 bp, Homo sapiens
ctcagggctctgcatgcacacg

SEQ ID NO: 7904461 - DNA, 22 bp, Homo sapiens
ctcagggctggaaagccaggaa

SEQ ID NO: 7904462 - DNA, 22 bp, Homo sapiens
ctcagggctggaaagccaggaa

SEQ ID NO: 7904463 - DNA, 22 bp, Homo sapiens
ctcaggagtagttcagcagctg

SEQ ID NO: 7904464 - DNA, 22 bp, Homo sapiens
ttgcagaaaacagttttcttgt

SEQ ID NO: 7904465 - DNA, 22 bp, Homo sapiens
ttgcagttgtctttcctaattt

SEQ ID NO: 7904466 - DNA, 22 bp, Homo sapiens
ttgcagttgtctttcctaattt

SEQ ID NO: 7904467 - DNA, 22 bp, Homo sapiens
ttgcagttgttgccttccctga

SEQ ID NO: 7904468 - DNA, 22 bp, Homo sapiens
ttgcagttgtttagaatatgtg

SEQ ID NO: 7904469 - DNA, 22 bp, Homo sapiens
ttgcagtttatgttcctgcagt

SEQ ID NO: 7904470 - DNA, 19 bp, Homo sapiens
ttgcagttgggtggggagt

SEQ ID NO: 7904471 - DNA, 19 bp, Homo sapiens
ttgcagttgggtggggagt

SEQ ID NO: 7904472 - DNA, 22 bp, Homo sapiens
ttgcagttgctttctatattga

SEQ ID NO: 7904473 - DNA, 22 bp, Homo sapiens
ttgcataaaagagtatatctta

SEQ ID NO: 7904474 - DNA, 22 bp, Homo sapiens
ttgcataaatgcttaaaatttg

SEQ ID NO: 7904475 - DNA, 22 bp, Homo sapiens
ttgcataaatgcttaaaatttg

SEQ ID NO: 7904476 - DNA, 22 bp, Homo sapiens
ttgcataaagattttattgcat

SEQ ID NO: 7904477 - DNA, 22 bp, Homo sapiens
ttgcatagtgctgaggttcggg

SEQ ID NO: 7904478 - DNA, 23 bp, Homo sapiens
ttgcatagacatcctcatagatt

SEQ ID NO: 7904479 - DNA, 22 bp, Homo sapiens
ttgcataacagccattaaagta

SEQ ID NO: 7904480 - DNA, 22 bp, Homo sapiens
ttgcagttttctgcctcatttc

SEQ ID NO: 7904481 - DNA, 22 bp, Homo sapiens
ttgcagttttgacagaccaaat

SEQ ID NO: 7904482 - DNA, 22 bp, Homo sapiens
ttgcataaaagagtatatctta

SEQ ID NO: 7904483 - DNA, 22 bp, Homo sapiens
ttgcataaagattttattgcat

SEQ ID NO: 7904484 - DNA, 22 bp, Homo sapiens
ttgcagttttctgcctcatttc

SEQ ID NO: 7904485 - DNA, 22 bp, Homo sapiens
ttgcagtttgtggcaactttga

SEQ ID NO: 7904486 - DNA, 22 bp, Homo sapiens
ttgcagtttctggatgccttct

SEQ ID NO: 7904487 - DNA, 22 bp, Homo sapiens
ttgcagtttgcttttaatggga

SEQ ID NO: 7904488 - DNA, 22 bp, Homo sapiens
ttgcagtttgcttttaatggga

SEQ ID NO: 7904489 - DNA, 22 bp, Homo sapiens
ctcaggagcttcctcagcccat

SEQ ID NO: 7904490 - DNA, 22 bp, Homo sapiens
ctcaggagatgacagaaggtat

SEQ ID NO: 7904491 - DNA, 22 bp, Homo sapiens
ctcaggaggaggaagttcattg

SEQ ID NO: 7904492 - DNA, 22 bp, Homo sapiens
ctcaggaggaggaagttcattg

SEQ ID NO: 7904493 - DNA, 22 bp, Homo sapiens
ctcaggaggaggaagttcattg

SEQ ID NO: 7904494 - DNA, 22 bp, Homo sapiens
ctcaggaggaggaagttcattg

SEQ ID NO: 7904495 - DNA, 22 bp, Homo sapiens
ctcaggagcttcctcagcccat

SEQ ID NO: 7904496 - DNA, 22 bp, Homo sapiens
ctcaggaggccattctcaaggt

SEQ ID NO: 7904497 - DNA, 22 bp, Homo sapiens
ctcaggaggatgactgccttgg

SEQ ID NO: 7904498 - DNA, 22 bp, Homo sapiens
ctcaggaggccattctcaaggt

SEQ ID NO: 7904499 - DNA, 22 bp, Homo sapiens
ctcaggaggccattctcaaggt

SEQ ID NO: 7904500 - DNA, 22 bp, Homo sapiens
ctcaggaggatgactgccttgg

SEQ ID NO: 7904501 - DNA, 22 bp, Homo sapiens
ctcaggaggatgactgccttgg

SEQ ID NO: 7904502 - DNA, 22 bp, Homo sapiens
ctcaggaggatgactgccttgg

SEQ ID NO: 7904503 - DNA, 22 bp, Homo sapiens
ctcaggaggatgactgccttgg

SEQ ID NO: 7904504 - DNA, 22 bp, Homo sapiens
ctcaggaggtggtagaggccct

SEQ ID NO: 7904505 - DNA, 22 bp, Homo sapiens
ctcaggaggtggtagaggccct

SEQ ID NO: 7904506 - DNA, 22 bp, Homo sapiens
ctcaggaggtggtagaggccct

SEQ ID NO: 7904507 - DNA, 22 bp, Homo sapiens
ctcaggaggtggtagaggccct

SEQ ID NO: 7904508 - DNA, 22 bp, Homo sapiens
ctcaggaggtggtagaggccct

SEQ ID NO: 7904509 - DNA, 22 bp, Homo sapiens
ctcaggaggtttcctgtctagg

SEQ ID NO: 7904510 - DNA, 22 bp, Homo sapiens
ctcaggaggtttcctgtctagg

SEQ ID NO: 7904511 - DNA, 22 bp, Homo sapiens
ctcaggaggtttcctgtctagg

SEQ ID NO: 7904512 - DNA, 22 bp, Homo sapiens
ctcaggagtagttcagcagctg

SEQ ID NO: 7904513 - DNA, 22 bp, Homo sapiens
ctcaggagtagttcagcagctg

SEQ ID NO: 7904514 - DNA, 22 bp, Homo sapiens
ctcaggagtagttcagcagctg

SEQ ID NO: 7904515 - DNA, 22 bp, Homo sapiens
ctcaggaggtttcctgtctagg

SEQ ID NO: 7904516 - DNA, 22 bp, Homo sapiens
ctcaggagtagttcagcagctg

SEQ ID NO: 7904517 - DNA, 22 bp, Homo sapiens
ctcaggagagtcttatatctcc

SEQ ID NO: 7904518 - DNA, 22 bp, Homo sapiens
ctcaggagatgacagaaggtat

SEQ ID NO: 7904519 - DNA, 22 bp, Homo sapiens
ctcaggagagtcttatatctcc

SEQ ID NO: 7904520 - DNA, 22 bp, Homo sapiens
ctcaggagatgacagaaggtat

SEQ ID NO: 7904521 - DNA, 22 bp, Homo sapiens
ctcaggagacagtgtccacatg

SEQ ID NO: 7904522 - DNA, 22 bp, Homo sapiens
ctcaggagacagtgtccacatg

SEQ ID NO: 7904523 - DNA, 22 bp, Homo sapiens
ctcaggagacagtgtccacatg

SEQ ID NO: 7904524 - DNA, 22 bp, Homo sapiens
ctcaggactttcaaatagaaat

SEQ ID NO: 7904525 - DNA, 22 bp, Homo sapiens
ctcaggagacagtgtccacatg

SEQ ID NO: 7904526 - DNA, 22 bp, Homo sapiens
ctcaggagagtcttatatctcc

SEQ ID NO: 7904527 - DNA, 22 bp, Homo sapiens
ctcaggagacagtgtccacatg

SEQ ID NO: 7904528 - DNA, 22 bp, Homo sapiens
ctcaggagacagtgtccacatg

SEQ ID NO: 7904529 - DNA, 22 bp, Homo sapiens
ctcaggagacagtgtccacatg

SEQ ID NO: 7904530 - DNA, 22 bp, Homo sapiens
ctcaggacttggttagtgtttt

SEQ ID NO: 7904531 - DNA, 22 bp, Homo sapiens
ctcaggacttggttagtgtttt

SEQ ID NO: 7904532 - DNA, 22 bp, Homo sapiens
ctcaggacggccgggggagcct

SEQ ID NO: 7904533 - DNA, 22 bp, Homo sapiens
ctcaggacccggtccaggtggg

SEQ ID NO: 7904534 - DNA, 22 bp, Homo sapiens
ctcaggacccggtccaggtggg

SEQ ID NO: 7904535 - DNA, 22 bp, Homo sapiens
ctcaggacagattccagagaaa

SEQ ID NO: 7904536 - DNA, 22 bp, Homo sapiens
ctcaggacccaccttattagga

SEQ ID NO: 7904537 - DNA, 22 bp, Homo sapiens
ctcaggaaccgcggcagcagcc

SEQ ID NO: 7904538 - DNA, 22 bp, Homo sapiens
ctcaggaaccgcggcagcagcc

SEQ ID NO: 7904539 - DNA, 22 bp, Homo sapiens
ctcaggaagcacaggccctaca

SEQ ID NO: 7904540 - DNA, 22 bp, Homo sapiens
ctcaggaaggaagcagggagcc

SEQ ID NO: 7904541 - DNA, 22 bp, Homo sapiens
ctcaggaagcctgtaatgtggg

SEQ ID NO: 7904542 - DNA, 19 bp, Homo sapiens
ctcagctgtagctcatgtg

SEQ ID NO: 7904543 - DNA, 19 bp, Homo sapiens
ctcagctgtagctcatgtg

SEQ ID NO: 7904544 - DNA, 19 bp, Homo sapiens
ctcagctgtagctcatgtg

SEQ ID NO: 7904545 - DNA, 22 bp, Homo sapiens
ctcagctggcaattctggctcc

SEQ ID NO: 7904546 - DNA, 22 bp, Homo sapiens
ctcagctggcaattctggctcc

SEQ ID NO: 7904547 - DNA, 22 bp, Homo sapiens
ctcagccccaatttgccctctt

SEQ ID NO: 7904548 - DNA, 22 bp, Homo sapiens
ctcagccccaatttgccctctt

SEQ ID NO: 7904549 - DNA, 23 bp, Homo sapiens
ctcagaggcctgtccagggtggt

SEQ ID NO: 7904550 - DNA, 23 bp, Homo sapiens
ctcagaggcctgtccagggtggt

SEQ ID NO: 7904551 - DNA, 23 bp, Homo sapiens
ctcagaggcctgtccagggtggt

SEQ ID NO: 7904552 - DNA, 22 bp, Homo sapiens
ctcagaggcaagcaaggagctg

SEQ ID NO: 7904553 - DNA, 22 bp, Homo sapiens
ctcaggaaaggccatgcaaggg

SEQ ID NO: 7904554 - DNA, 22 bp, Homo sapiens
ctcaggaaaggccatgcaaggg

SEQ ID NO: 7904555 - DNA, 22 bp, Homo sapiens
ctcaggaaaatattgaagaagt

SEQ ID NO: 7904556 - DNA, 22 bp, Homo sapiens
ctcaggaaaggccatgcaaggg

SEQ ID NO: 7904557 - DNA, 22 bp, Homo sapiens
ctcaggaaaatattgaagaagt

SEQ ID NO: 7904558 - DNA, 22 bp, Homo sapiens
ctcaggaaaatattgaagaagt

SEQ ID NO: 7904559 - DNA, 22 bp, Homo sapiens
ctcaggaaaatattgaagaagt

SEQ ID NO: 7904560 - DNA, 22 bp, Homo sapiens
ctcagcttttcccggataggtg

SEQ ID NO: 7904561 - DNA, 22 bp, Homo sapiens
ctcagcttctacctcctgagtg

SEQ ID NO: 7904562 - DNA, 22 bp, Homo sapiens
ctcagcttctacctcctgagtg

SEQ ID NO: 7904563 - DNA, 22 bp, Homo sapiens
ctcagcttctacctcctgagtg

SEQ ID NO: 7904564 - DNA, 22 bp, Homo sapiens
ctcagcttctacctcctgagtg

SEQ ID NO: 7904565 - DNA, 22 bp, Homo sapiens
ctcagcttcatttgttccatga

SEQ ID NO: 7904566 - DNA, 22 bp, Homo sapiens
ctcagcttcatttgttccatga

SEQ ID NO: 7904567 - DNA, 22 bp, Homo sapiens
ctcagcttcatttgttccatga

SEQ ID NO: 7904568 - DNA, 22 bp, Homo sapiens
ctcagctgtctcatgggtctgt

SEQ ID NO: 7904569 - DNA, 19 bp, Homo sapiens
ctcagctgtagctcatgtg

SEQ ID NO: 7904570 - DNA, 22 bp, Homo sapiens
ttggaaggcagcatttgtccat

SEQ ID NO: 7904571 - DNA, 22 bp, Homo sapiens
ttggaaggccagcaccttgagt

SEQ ID NO: 7904572 - DNA, 22 bp, Homo sapiens
ttggaaggagcctaaaagagac

SEQ ID NO: 7904573 - DNA, 22 bp, Homo sapiens
ttggaaggaattaaggtcatga

SEQ ID NO: 7904574 - DNA, 22 bp, Homo sapiens
ttggaaggaagaaccgcggtag

SEQ ID NO: 7904575 - DNA, 22 bp, Homo sapiens
ttggaagcagtgtacactgtac

SEQ ID NO: 7904576 - DNA, 22 bp, Homo sapiens
ttggaagcaataaatggaaaga

SEQ ID NO: 7904577 - DNA, 22 bp, Homo sapiens
ttggaagattctgtgtctggtg

SEQ ID NO: 7904578 - DNA, 22 bp, Homo sapiens
ttggaagattctgtgtctggtg

SEQ ID NO: 7904579 - DNA, 21 bp, Homo sapiens
ttggaagataatgcttatgat

SEQ ID NO: 7904580 - DNA, 22 bp, Homo sapiens
ttggaagatctaacagaggcat

SEQ ID NO: 7904581 - DNA, 22 bp, Homo sapiens
ttggaagatctaacagaggcat

SEQ ID NO: 7904582 - DNA, 22 bp, Homo sapiens
ttggaagatctaacagaggcat

SEQ ID NO: 7904583 - DNA, 22 bp, Homo sapiens
ttggaagatctaacagaggcat

SEQ ID NO: 7904584 - DNA, 22 bp, Homo sapiens
ttggaagattacttagttttct

SEQ ID NO: 7904585 - DNA, 22 bp, Homo sapiens
ttggaagattacttagttttct

SEQ ID NO: 7904586 - DNA, 22 bp, Homo sapiens
ttggaagattacttagttttct

SEQ ID NO: 7904587 - DNA, 22 bp, Homo sapiens
ttggaagccctctgcaagatcc

SEQ ID NO: 7904588 - DNA, 22 bp, Homo sapiens
ttggaagccctctgcaagatcc

SEQ ID NO: 7904589 - DNA, 22 bp, Homo sapiens
ttggaagcctagttaagatgaa

SEQ ID NO: 7904590 - DNA, 22 bp, Homo sapiens
ttggaagcgagcacatggagga

SEQ ID NO: 7904591 - DNA, 22 bp, Homo sapiens
ttggaaaagtgaaactagatgc

SEQ ID NO: 7904592 - DNA, 22 bp, Homo sapiens
ctcagtgcttctagcttgatga

SEQ ID NO: 7904593 - DNA, 22 bp, Homo sapiens
ctcagtgcttctagcttgatga

SEQ ID NO: 7904594 - DNA, 22 bp, Homo sapiens
ctcagtgcttagtgtgttttgg

SEQ ID NO: 7904595 - DNA, 22 bp, Homo sapiens
ttggaaaagtgaaactagatgc

SEQ ID NO: 7904596 - DNA, 22 bp, Homo sapiens
ttggaaaagtgaaactagatgc

SEQ ID NO: 7904597 - DNA, 22 bp, Homo sapiens
ctcagtgcagctaggcatgaga

SEQ ID NO: 7904598 - DNA, 22 bp, Homo sapiens
ctcagtgcagctaggcatgaga

SEQ ID NO: 7904599 - DNA, 22 bp, Homo sapiens
ctcagtcttctcctccaatgga

SEQ ID NO: 7904600 - DNA, 22 bp, Homo sapiens
ctcagtgctacggttaccatat

SEQ ID NO: 7904601 - DNA, 22 bp, Homo sapiens
ctcagtgctgaggaaagttgaa

SEQ ID NO: 7904602 - DNA, 22 bp, Homo sapiens
ctcagtgctagaagtagattgc

SEQ ID NO: 7904603 - DNA, 22 bp, Homo sapiens
ctcagtcttctcctccaatgga

SEQ ID NO: 7904604 - DNA, 22 bp, Homo sapiens
ctcagtctgtcttgtctgtgtt

SEQ ID NO: 7904605 - DNA, 22 bp, Homo sapiens
ctcagtgcaaccaaagtgatct

SEQ ID NO: 7904606 - DNA, 22 bp, Homo sapiens
ctcagtgaattggaggatggcc

SEQ ID NO: 7904607 - DNA, 22 bp, Homo sapiens
ctcagtgcaaccaaagtgatct

SEQ ID NO: 7904608 - DNA, 22 bp, Homo sapiens
ctcagtctcttgggctgtgaag

SEQ ID NO: 7904609 - DNA, 22 bp, Homo sapiens
ctcagtctcttgggctgtgaag

SEQ ID NO: 7904610 - DNA, 19 bp, Homo sapiens
ctcagtctggctctgcctg

SEQ ID NO: 7904611 - DNA, 22 bp, Homo sapiens
ctcagtctgtcttgtctgtgtt

SEQ ID NO: 7904612 - DNA, 22 bp, Homo sapiens
ctcagtctgtcttgtctgtgtt

SEQ ID NO: 7904613 - DNA, 22 bp, Homo sapiens
ctcagtctgtcttgtctgtgtt

SEQ ID NO: 7904614 - DNA, 22 bp, Homo sapiens
ctcagtctgtcttgtctgtgtt

SEQ ID NO: 7904615 - DNA, 22 bp, Homo sapiens
ctcagtccttatttgcctctac

SEQ ID NO: 7904616 - DNA, 22 bp, Homo sapiens
ctcagtccgtcccgctaggtgc

SEQ ID NO: 7904617 - DNA, 22 bp, Homo sapiens
ctcagtccgtcccgctaggtgc

SEQ ID NO: 7904618 - DNA, 22 bp, Homo sapiens
ctcagtccgtcccgctaggtgc

SEQ ID NO: 7904619 - DNA, 22 bp, Homo sapiens
ctcagtccagggaccggcctcc

SEQ ID NO: 7904620 - DNA, 22 bp, Homo sapiens
ctcagtccacgcagcctcctga

SEQ ID NO: 7904621 - DNA, 22 bp, Homo sapiens
ctcagtccagggaccggcctcc

SEQ ID NO: 7904622 - DNA, 22 bp, Homo sapiens
ttggatccatctcaggcatagg

SEQ ID NO: 7904623 - DNA, 22 bp, Homo sapiens
ttggatcactctgaagccttac

SEQ ID NO: 7904624 - DNA, 22 bp, Homo sapiens
ttggatcagatgatatctttgt

SEQ ID NO: 7904625 - DNA, 22 bp, Homo sapiens
ttggatccatctcaggcatagg

SEQ ID NO: 7904626 - DNA, 22 bp, Homo sapiens
ctccactcaccagatgccagga

SEQ ID NO: 7904627 - DNA, 22 bp, Homo sapiens
ctccactcaccagatgccagga

SEQ ID NO: 7904628 - DNA, 22 bp, Homo sapiens
ctccactcaccagatgccagga

SEQ ID NO: 7904629 - DNA, 22 bp, Homo sapiens
ctccactcaacaagcccagtgt

SEQ ID NO: 7904630 - DNA, 22 bp, Homo sapiens
ctccactcaacaagcccagtgt

SEQ ID NO: 7904631 - DNA, 22 bp, Homo sapiens
ttggatccatctcaggcatagg

SEQ ID NO: 7904632 - DNA, 22 bp, Homo sapiens
ctccactcaacaagcccagtgt

SEQ ID NO: 7904633 - DNA, 22 bp, Homo sapiens
ctccactcaacaagcccagtgt

SEQ ID NO: 7904634 - DNA, 22 bp, Homo sapiens
ttggaggttattaacactggcc

SEQ ID NO: 7904635 - DNA, 22 bp, Homo sapiens
ttggaggtttcccaactgtggg

SEQ ID NO: 7904636 - DNA, 22 bp, Homo sapiens
ttggaggttccatgatttgtct

SEQ ID NO: 7904637 - DNA, 22 bp, Homo sapiens
ttggaggtttgaaaatatgtgt

SEQ ID NO: 7904638 - DNA, 22 bp, Homo sapiens
ttggagtcacaggagaagaatg

SEQ ID NO: 7904639 - DNA, 22 bp, Homo sapiens
ttggagtcagatgactgtagga

SEQ ID NO: 7904640 - DNA, 20 bp, Homo sapiens
ttggagtctaaagactgggg

SEQ ID NO: 7904641 - DNA, 22 bp, Homo sapiens
ttggagtcattggcctgggtga

SEQ ID NO: 7904642 - DNA, 18 bp, Homo sapiens
ttggagtccaggtatgac

SEQ ID NO: 7904643 - DNA, 20 bp, Homo sapiens
ttggagtctaaagactgggg

SEQ ID NO: 7904644 - DNA, 20 bp, Homo sapiens
ttggagtctaaagactgggg

SEQ ID NO: 7904645 - DNA, 22 bp, Homo sapiens
ttggataaagaggaagattatc

SEQ ID NO: 7904646 - DNA, 22 bp, Homo sapiens
ttggataaaaatgtttaagtgt

SEQ ID NO: 7904647 - DNA, 22 bp, Homo sapiens
ttggagttctgggcacagctgc

SEQ ID NO: 7904648 - DNA, 22 bp, Homo sapiens
ttggaagggaacaccatttgac

SEQ ID NO: 7904649 - DNA, 22 bp, Homo sapiens
ttggaagggatattggcatatg

SEQ ID NO: 7904650 - DNA, 23 bp, Homo sapiens
ttggaagggaagagcatttgaga

SEQ ID NO: 7904651 - DNA, 23 bp, Homo sapiens
ttggaagggaagagcatttgaga

SEQ ID NO: 7904652 - DNA, 20 bp, Homo sapiens
ttggaaggtggagaagagga

SEQ ID NO: 7904653 - DNA, 20 bp, Homo sapiens
ttggaaggtggagaagagga

SEQ ID NO: 7904654 - DNA, 22 bp, Homo sapiens
ttggaaggttctggtcatggtt

SEQ ID NO: 7904655 - DNA, 22 bp, Homo sapiens
ttggaaggggcagagtggctgc

SEQ ID NO: 7904656 - DNA, 22 bp, Homo sapiens
ttggaggggccactgcagagct

SEQ ID NO: 7904657 - DNA, 22 bp, Homo sapiens
ttggagggacagatggctaggc

SEQ ID NO: 7904658 - DNA, 22 bp, Homo sapiens
ttggaggggccactgcagagct

SEQ ID NO: 7904659 - DNA, 22 bp, Homo sapiens
ttggaggggccactgcagagct

SEQ ID NO: 7904660 - DNA, 20 bp, Homo sapiens
ttggaggtgcagtgcatgca

SEQ ID NO: 7904661 - DNA, 22 bp, Homo sapiens
ttggagggtcttccacagccat

SEQ ID NO: 7904662 - DNA, 22 bp, Homo sapiens
ctccaggactgaggacagagct

SEQ ID NO: 7904663 - DNA, 22 bp, Homo sapiens
ctccaggactgaggacagagct

SEQ ID NO: 7904664 - DNA, 22 bp, Homo sapiens
ctccaggactgaggacagagct

SEQ ID NO: 7904665 - DNA, 22 bp, Homo sapiens
ctccaggactgaggacagagct

SEQ ID NO: 7904666 - DNA, 22 bp, Homo sapiens
ctccaggactgaggacagagct

SEQ ID NO: 7904667 - DNA, 22 bp, Homo sapiens
ctccaggactcaggcccctggg

SEQ ID NO: 7904668 - DNA, 22 bp, Homo sapiens
ctccaggactcaggcccctggg

SEQ ID NO: 7904669 - DNA, 22 bp, Homo sapiens
ctccaggactgaggacagagct

SEQ ID NO: 7904670 - DNA, 22 bp, Homo sapiens
ctccaggactcaggcccctggg

SEQ ID NO: 7904671 - DNA, 22 bp, Homo sapiens
ctccaggacccagtggctccag

SEQ ID NO: 7904672 - DNA, 22 bp, Homo sapiens
ctccaggacccagtggctccag

SEQ ID NO: 7904673 - DNA, 22 bp, Homo sapiens
ctccaggactcaggcccctggg

SEQ ID NO: 7904674 - DNA, 22 bp, Homo sapiens
ctccaggactcaggcccctggg

SEQ ID NO: 7904675 - DNA, 22 bp, Homo sapiens
ctccaggacccagtggctccag

SEQ ID NO: 7904676 - DNA, 22 bp, Homo sapiens
ctccaggacccagtggctccag

SEQ ID NO: 7904677 - DNA, 22 bp, Homo sapiens
ctccaggacccagtggctccag

SEQ ID NO: 7904678 - DNA, 22 bp, Homo sapiens
ctccaggaccagggctcctgga

SEQ ID NO: 7904679 - DNA, 22 bp, Homo sapiens
ctccaggaccagggctcctgga

SEQ ID NO: 7904680 - DNA, 22 bp, Homo sapiens
ctccaggaccagggctcctgga

SEQ ID NO: 7904681 - DNA, 22 bp, Homo sapiens
ctccaggaccagggctcctgga

SEQ ID NO: 7904682 - DNA, 22 bp, Homo sapiens
ctccaggacatgactttcttgc

SEQ ID NO: 7904683 - DNA, 22 bp, Homo sapiens
ctccaggaccagggctcctgga

SEQ ID NO: 7904684 - DNA, 22 bp, Homo sapiens
ctccaggaccagggctcctgga

SEQ ID NO: 7904685 - DNA, 22 bp, Homo sapiens
ctccaggaccagggctcctgga

SEQ ID NO: 7904686 - DNA, 22 bp, Homo sapiens
ctccaggacactaacccaggct

SEQ ID NO: 7904687 - DNA, 22 bp, Homo sapiens
ctccaggacactaacccaggct

SEQ ID NO: 7904688 - DNA, 22 bp, Homo sapiens
ctccaggacagattcagggcca

SEQ ID NO: 7904689 - DNA, 22 bp, Homo sapiens
ctccaggacagattcagggcca

SEQ ID NO: 7904690 - DNA, 22 bp, Homo sapiens
ctccaggacagattcagggcca

SEQ ID NO: 7904691 - DNA, 22 bp, Homo sapiens
ctccaggacagattcagggcca

SEQ ID NO: 7904692 - DNA, 22 bp, Homo sapiens
ctccaggacagattcagggcca

SEQ ID NO: 7904693 - DNA, 22 bp, Homo sapiens
ttggctgaccagaacctgcccc

SEQ ID NO: 7904694 - DNA, 22 bp, Homo sapiens
ttggctgagagaggaaaagggc

SEQ ID NO: 7904695 - DNA, 22 bp, Homo sapiens
ttggctgaaggttaagtgctgg

SEQ ID NO: 7904696 - DNA, 22 bp, Homo sapiens
ttggctgaaggaataaatggat

SEQ ID NO: 7904697 - DNA, 22 bp, Homo sapiens
ttggctgaaggaataaatggat

SEQ ID NO: 7904698 - DNA, 22 bp, Homo sapiens
ttggctgaagactagatgttta

SEQ ID NO: 7904699 - DNA, 22 bp, Homo sapiens
ttggctctttctcagtcacgtt

SEQ ID NO: 7904700 - DNA, 22 bp, Homo sapiens
ttggctctttctcagtcacgtt

SEQ ID NO: 7904701 - DNA, 22 bp, Homo sapiens
ttggctctgtgtctccactcaa

SEQ ID NO: 7904702 - DNA, 22 bp, Homo sapiens
ttggctcttctcccagtggcct

SEQ ID NO: 7904703 - DNA, 22 bp, Homo sapiens
ttggctcttctcccagtggcct

SEQ ID NO: 7904704 - DNA, 22 bp, Homo sapiens
ttggctctttcctcacacagga

SEQ ID NO: 7904705 - DNA, 22 bp, Homo sapiens
ctccagcctcatctcctggctg

SEQ ID NO: 7904706 - DNA, 22 bp, Homo sapiens
ctccagcctcatctcctggctg

SEQ ID NO: 7904707 - DNA, 22 bp, Homo sapiens
ctccaggacactaacccaggct

SEQ ID NO: 7904708 - DNA, 22 bp, Homo sapiens
ttggctgctaatggctgacagc

SEQ ID NO: 7904709 - DNA, 22 bp, Homo sapiens
ctccagcctcatctcctggctg

SEQ ID NO: 7904710 - DNA, 22 bp, Homo sapiens
ttggctgccttcacccctggcc

SEQ ID NO: 7904711 - DNA, 22 bp, Homo sapiens
ttggctgccgagcgcatcccgg

SEQ ID NO: 7904712 - DNA, 22 bp, Homo sapiens
ttggctgcattttgggttcgtt

SEQ ID NO: 7904713 - DNA, 22 bp, Homo sapiens
ttggctgcaatcacagggactc

SEQ ID NO: 7904714 - DNA, 22 bp, Homo sapiens
ttggctgagccatgtgaaacca

SEQ ID NO: 7904715 - DNA, 22 bp, Homo sapiens
ttggctctgaaacccaagctct

SEQ ID NO: 7904716 - DNA, 22 bp, Homo sapiens
ttggctctgaaacccaagctct

SEQ ID NO: 7904717 - DNA, 22 bp, Homo sapiens
ttggctctcattttccccatta

SEQ ID NO: 7904718 - DNA, 22 bp, Homo sapiens
ttggctctgaactatgcagttt

SEQ ID NO: 7904719 - DNA, 21 bp, Homo sapiens
ttggctctgaaacttgcacct

SEQ ID NO: 7904720 - DNA, 22 bp, Homo sapiens
ttggctctgaaacccaagctct

SEQ ID NO: 7904721 - DNA, 17 bp, Homo sapiens
ttggctctattgcctct

SEQ ID NO: 7904722 - DNA, 22 bp, Homo sapiens
ttggctctaggaaccaaagtga

SEQ ID NO: 7904723 - DNA, 22 bp, Homo sapiens
ttggctctgtgtctccactcaa

SEQ ID NO: 7904724 - DNA, 22 bp, Homo sapiens
ttggctctggttgccctgtgac

SEQ ID NO: 7904725 - DNA, 22 bp, Homo sapiens
ttggctctggaactatttctga

SEQ ID NO: 7904726 - DNA, 22 bp, Homo sapiens
ttggctctggaactatttctga

SEQ ID NO: 7904727 - DNA, 22 bp, Homo sapiens
ttggctctgatggggatcagga

SEQ ID NO: 7904728 - DNA, 22 bp, Homo sapiens
ttggctctgatggggatcagga

SEQ ID NO: 7904729 - DNA, 22 bp, Homo sapiens
ttggctctgatggggatcagga

SEQ ID NO: 7904730 - DNA, 20 bp, Homo sapiens
ttggctctgatcagtggagc

SEQ ID NO: 7904731 - DNA, 22 bp, Homo sapiens
ttggctctgacattaaaacaat

SEQ ID NO: 7904732 - DNA, 20 bp, Homo sapiens
ttggctctgatcagtggagc

SEQ ID NO: 7904733 - DNA, 20 bp, Homo sapiens
ttggctctgatcagtggagc

SEQ ID NO: 7904734 - DNA, 22 bp, Homo sapiens
ctccagagtcacactgcctggg

SEQ ID NO: 7904735 - DNA, 22 bp, Homo sapiens
ctccagagtcacactgcctggg

SEQ ID NO: 7904736 - DNA, 22 bp, Homo sapiens
ctccagagtcatcgagcattcc

SEQ ID NO: 7904737 - DNA, 22 bp, Homo sapiens
ctccagataggagggggtcccc

SEQ ID NO: 7904738 - DNA, 22 bp, Homo sapiens
ctccagagtcatcgagcattcc

SEQ ID NO: 7904739 - DNA, 22 bp, Homo sapiens
ctccagaggttctcatctggga

SEQ ID NO: 7904740 - DNA, 22 bp, Homo sapiens
ctccagaggttctcatctggga

SEQ ID NO: 7904741 - DNA, 22 bp, Homo sapiens
ctccagaggttctcatctggga

SEQ ID NO: 7904742 - DNA, 22 bp, Homo sapiens
ctccagaggttctcatctggga

SEQ ID NO: 7904743 - DNA, 22 bp, Homo sapiens
ctccagagtcacactgcctggg

SEQ ID NO: 7904744 - DNA, 18 bp, Homo sapiens
ctccagagctgtgagaca

SEQ ID NO: 7904745 - DNA, 18 bp, Homo sapiens
ctccagagctgtgagaca

SEQ ID NO: 7904746 - DNA, 18 bp, Homo sapiens
ctccagagctgtgagaca

SEQ ID NO: 7904747 - DNA, 18 bp, Homo sapiens
ctccagagctgtgagaca

SEQ ID NO: 7904748 - DNA, 18 bp, Homo sapiens
ctccagagctgtgagaca

SEQ ID NO: 7904749 - DNA, 22 bp, Homo sapiens
ctccagaggaaagcacatagtg

SEQ ID NO: 7904750 - DNA, 22 bp, Homo sapiens
ctccagaggaaagcacatagtg

SEQ ID NO: 7904751 - DNA, 22 bp, Homo sapiens
ctccagaggaaagcacatagtg

SEQ ID NO: 7904752 - DNA, 22 bp, Homo sapiens
ctccactcaccagatgccagga

SEQ ID NO: 7904753 - DNA, 22 bp, Homo sapiens
ctccagaggatgcaggtgaggg

SEQ ID NO: 7904754 - DNA, 22 bp, Homo sapiens
ctccagaggatgcaggtgaggg

SEQ ID NO: 7904755 - DNA, 22 bp, Homo sapiens
ctccagaggatgcaggtgaggg

SEQ ID NO: 7904756 - DNA, 22 bp, Homo sapiens
ctccagaggatgcaggtgaggg

SEQ ID NO: 7904757 - DNA, 22 bp, Homo sapiens
ctccagaggatgcaggtgaggg

SEQ ID NO: 7904758 - DNA, 22 bp, Homo sapiens
ctccagaggatgcaggtgaggg

SEQ ID NO: 7904759 - DNA, 22 bp, Homo sapiens
ctccagaggatgcaggtgaggg

SEQ ID NO: 7904760 - DNA, 22 bp, Homo sapiens
ctccagaggatgcaggtgaggg

SEQ ID NO: 7904761 - DNA, 22 bp, Homo sapiens
ctccagaggtccccgcggcact

SEQ ID NO: 7904762 - DNA, 22 bp, Homo sapiens
ctccagaggttctcatctggga

SEQ ID NO: 7904763 - DNA, 22 bp, Homo sapiens
ctccagaggtccccgcggcact

SEQ ID NO: 7904764 - DNA, 22 bp, Homo sapiens
ctccagagggtcagactctgag

SEQ ID NO: 7904765 - DNA, 22 bp, Homo sapiens
ctccagagggtcagactctgag

SEQ ID NO: 7904766 - DNA, 22 bp, Homo sapiens
ctccagaggcgacttgcatcac

SEQ ID NO: 7904767 - DNA, 22 bp, Homo sapiens
ccttagatcaggctgtctaggg

SEQ ID NO: 7904768 - DNA, 22 bp, Homo sapiens
ccttagatcaggctgtctaggg

SEQ ID NO: 7904769 - DNA, 22 bp, Homo sapiens
ccttagaggcaggaagaattgc

SEQ ID NO: 7904770 - DNA, 22 bp, Homo sapiens
ccttacctgattgctggcatcc

SEQ ID NO: 7904771 - DNA, 22 bp, Homo sapiens
ccttacactgcctggggccacg

SEQ ID NO: 7904772 - DNA, 22 bp, Homo sapiens
ccttagaaggctgaataattct

SEQ ID NO: 7904773 - DNA, 22 bp, Homo sapiens
ccttagaaggctgaataattct

SEQ ID NO: 7904774 - DNA, 22 bp, Homo sapiens
ccttagaagaaagttacttttt

SEQ ID NO: 7904775 - DNA, 22 bp, Homo sapiens
ccttagaaaatcatggaatatt

SEQ ID NO: 7904776 - DNA, 22 bp, Homo sapiens
ccttagaaatgtaccaaaggaa

SEQ ID NO: 7904777 - DNA, 22 bp, Homo sapiens
ccttagaaatgtaccaaaggaa

SEQ ID NO: 7904778 - DNA, 22 bp, Homo sapiens
ttacaaagagtgttcttttcca

SEQ ID NO: 7904779 - DNA, 22 bp, Homo sapiens
ttacaaagagtgccagagtgtg

SEQ ID NO: 7904780 - DNA, 22 bp, Homo sapiens
ccttagtgtgcctgaggcagat

SEQ ID NO: 7904781 - DNA, 22 bp, Homo sapiens
ttacaaagagtgccagagtgtg

SEQ ID NO: 7904782 - DNA, 22 bp, Homo sapiens
ttacaaagagtgccagagtgtg

SEQ ID NO: 7904783 - DNA, 22 bp, Homo sapiens
ccttatcacaatggagtgtcac

SEQ ID NO: 7904784 - DNA, 22 bp, Homo sapiens
ccttagctggagtggtggaatg

SEQ ID NO: 7904785 - DNA, 21 bp, Homo sapiens
ccttagtcttccacatagtcc

SEQ ID NO: 7904786 - DNA, 22 bp, Homo sapiens
ccttagtgaaacagaggcaatt

SEQ ID NO: 7904787 - DNA, 22 bp, Homo sapiens
ccttagtgtgaggggatacccc

SEQ ID NO: 7904788 - DNA, 22 bp, Homo sapiens
ttaagcataattaaagtgaaat

SEQ ID NO: 7904789 - DNA, 22 bp, Homo sapiens
ttaagcataattaaagtgaaat

SEQ ID NO: 7904790 - DNA, 22 bp, Homo sapiens
ttaagcagcatgcattcagtgg

SEQ ID NO: 7904791 - DNA, 22 bp, Homo sapiens
ttaagcatggaagtgaaataat

SEQ ID NO: 7904792 - DNA, 22 bp, Homo sapiens
ttaagcagaaaatttgagcact

SEQ ID NO: 7904793 - DNA, 22 bp, Homo sapiens
ttaagcaacacacattaattat

SEQ ID NO: 7904794 - DNA, 22 bp, Homo sapiens
ttaagcaacacacattaattat

SEQ ID NO: 7904795 - DNA, 21 bp, Homo sapiens
cctgtgtgtgtccctttaaga

SEQ ID NO: 7904796 - DNA, 18 bp, Homo sapiens
cctgtgtgtgttgcaggc

SEQ ID NO: 7904797 - DNA, 22 bp, Homo sapiens
ccttaaattctccatttgaaag

SEQ ID NO: 7904798 - DNA, 22 bp, Homo sapiens
ccttaaattctccatttgaaag

SEQ ID NO: 7904799 - DNA, 22 bp, Homo sapiens
ccttaaattctccatttgaaag

SEQ ID NO: 7904800 - DNA, 22 bp, Homo sapiens
ccttaaattctccatttgaaag

SEQ ID NO: 7904801 - DNA, 22 bp, Homo sapiens
ccttaaattctccatttgaaag

SEQ ID NO: 7904802 - DNA, 22 bp, Homo sapiens
ccttacacctaaaatgagagtt

SEQ ID NO: 7904803 - DNA, 22 bp, Homo sapiens
ccttaattagcactctgatggg

SEQ ID NO: 7904804 - DNA, 22 bp, Homo sapiens
ccttaatttctgtccttcagat

SEQ ID NO: 7904805 - DNA, 22 bp, Homo sapiens
ccttaagtacctgactagcatg

SEQ ID NO: 7904806 - DNA, 22 bp, Homo sapiens
ccttaagaaatagcatttaaat

SEQ ID NO: 7904807 - DNA, 22 bp, Homo sapiens
ccttaaaagaactatctcttct

SEQ ID NO: 7904808 - DNA, 22 bp, Homo sapiens
ccttaaaagaactatctcttct

SEQ ID NO: 7904809 - DNA, 22 bp, Homo sapiens
ccttaaaagaactatctcttct

SEQ ID NO: 7904810 - DNA, 22 bp, Homo sapiens
ccttaaaagaactatctcttct

SEQ ID NO: 7904811 - DNA, 23 bp, Homo sapiens
ccttaaatatctaccctgtggca

SEQ ID NO: 7904812 - DNA, 23 bp, Homo sapiens
ccttaaatatctaccctgtggca

SEQ ID NO: 7904813 - DNA, 22 bp, Homo sapiens
ccttaaactttatcttgtgaga

SEQ ID NO: 7904814 - DNA, 22 bp, Homo sapiens
ccttaaaagaactatctcttct

SEQ ID NO: 7904815 - DNA, 22 bp, Homo sapiens
ccttaaactctgatatgatatt

SEQ ID NO: 7904816 - DNA, 22 bp, Homo sapiens
ttacagtttaccaagaatattg

SEQ ID NO: 7904817 - DNA, 22 bp, Homo sapiens
ttacagtttaccaagaatattg

SEQ ID NO: 7904818 - DNA, 22 bp, Homo sapiens
ttacagtttatccaggaagagc

SEQ ID NO: 7904819 - DNA, 22 bp, Homo sapiens
ttacagttgttctatcagcatg

SEQ ID NO: 7904820 - DNA, 22 bp, Homo sapiens
ttacagtttaagaggaaacaaa

SEQ ID NO: 7904821 - DNA, 22 bp, Homo sapiens
ttacagtttacataagaattgt

SEQ ID NO: 7904822 - DNA, 22 bp, Homo sapiens
ttacagtttacataagaattgt

SEQ ID NO: 7904823 - DNA, 22 bp, Homo sapiens
ttacagtttacataagaattgt

SEQ ID NO: 7904824 - DNA, 22 bp, Homo sapiens
ttacagtgttacttgatgtcca

SEQ ID NO: 7904825 - DNA, 22 bp, Homo sapiens
ttacagtgtgcaatcccagaat

SEQ ID NO: 7904826 - DNA, 22 bp, Homo sapiens
ttacagtgttacttgatgtcca

SEQ ID NO: 7904827 - DNA, 22 bp, Homo sapiens
ttacagtggtcatttgggaaaa

SEQ ID NO: 7904828 - DNA, 22 bp, Homo sapiens
ttacagtgtgcaatcccagaat

SEQ ID NO: 7904829 - DNA, 22 bp, Homo sapiens
ttacagtggtcatttgggaaaa

SEQ ID NO: 7904830 - DNA, 21 bp, Homo sapiens
ttacagaatccatgggaagtc

SEQ ID NO: 7904831 - DNA, 22 bp, Homo sapiens
ttacagaagtttcagcgtttta

SEQ ID NO: 7904832 - DNA, 22 bp, Homo sapiens
ttacagaagtttcagcgtttta

SEQ ID NO: 7904833 - DNA, 21 bp, Homo sapiens
ttacagaatccatgggaagtc

SEQ ID NO: 7904834 - DNA, 21 bp, Homo sapiens
ttacagaatccatgggaagtc

SEQ ID NO: 7904835 - DNA, 22 bp, Homo sapiens
ttacagttagaatctgatgaaa

SEQ ID NO: 7904836 - DNA, 22 bp, Homo sapiens
ttacagttaatgtgactaacca

SEQ ID NO: 7904837 - DNA, 22 bp, Homo sapiens
ttacagttactggtactgttaa

SEQ ID NO: 7904838 - DNA, 21 bp, Homo sapiens
ttacagttgatggagtattcc

SEQ ID NO: 7904839 - DNA, 22 bp, Homo sapiens
ttacaaagcgttgagacaagta

SEQ ID NO: 7904840 - DNA, 22 bp, Homo sapiens
ttacaaagcgttgagacaagta

SEQ ID NO: 7904841 - DNA, 22 bp, Homo sapiens
ttacaaagcgttgagacaagta

SEQ ID NO: 7904842 - DNA, 22 bp, Homo sapiens
ttacaaagcgttgagacaagta

SEQ ID NO: 7904843 - DNA, 22 bp, Homo sapiens
ttacagaagtattgagagatcc

SEQ ID NO: 7904844 - DNA, 22 bp, Homo sapiens
ttacaaagcaggtcagctgaaa

SEQ ID NO: 7904845 - DNA, 22 bp, Homo sapiens
ttacaaagcaggtcagctgaaa

SEQ ID NO: 7904846 - DNA, 22 bp, Homo sapiens
ttacaaagcgctttacctctga

SEQ ID NO: 7904847 - DNA, 22 bp, Homo sapiens
ttacaaagattatattcagtta

SEQ ID NO: 7904848 - DNA, 22 bp, Homo sapiens
ttacaaagattatattcagtta

SEQ ID NO: 7904849 - DNA, 22 bp, Homo sapiens
ttacaaagattatattcagtta

SEQ ID NO: 7904850 - DNA, 22 bp, Homo sapiens
ttacaaagattatattcagtta

SEQ ID NO: 7904851 - DNA, 22 bp, Homo sapiens
ttacaaagattatattcagtta

SEQ ID NO: 7904852 - DNA, 22 bp, Homo sapiens
ttacaaagattatattcagtta

SEQ ID NO: 7904853 - DNA, 22 bp, Homo sapiens
ttacaaagcaggtcagctgaaa

SEQ ID NO: 7904854 - DNA, 22 bp, Homo sapiens
ttaaattgtcatttgagcaatg

SEQ ID NO: 7904855 - DNA, 22 bp, Homo sapiens
ttaaattgtcatttgagcaatg

SEQ ID NO: 7904856 - DNA, 22 bp, Homo sapiens
ttaaattccagcctcataatag

SEQ ID NO: 7904857 - DNA, 22 bp, Homo sapiens
ttaaattccagcctcataatag

SEQ ID NO: 7904858 - DNA, 22 bp, Homo sapiens
ttaaattccagcctcataatag

SEQ ID NO: 7904859 - DNA, 22 bp, Homo sapiens
ttaaattccagcctcataatag

SEQ ID NO: 7904860 - DNA, 22 bp, Homo sapiens
ttaaattccagcctcataatag

SEQ ID NO: 7904861 - DNA, 22 bp, Homo sapiens
ttaaattttagaaacagactct

SEQ ID NO: 7904862 - DNA, 22 bp, Homo sapiens
ttaaattttagaaacagactct

SEQ ID NO: 7904863 - DNA, 22 bp, Homo sapiens
ttaaattttagaaacagactct

SEQ ID NO: 7904864 - DNA, 22 bp, Homo sapiens
ttaaatttctacgtgatccagg

SEQ ID NO: 7904865 - DNA, 22 bp, Homo sapiens
ttaaatttctacgtgatccagg

SEQ ID NO: 7904866 - DNA, 22 bp, Homo sapiens
ttaaatttctacgtgatccagg

SEQ ID NO: 7904867 - DNA, 22 bp, Homo sapiens
ttaaattcattccaacttttga

SEQ ID NO: 7904868 - DNA, 22 bp, Homo sapiens
ttaaattcattccaacttttga

SEQ ID NO: 7904869 - DNA, 22 bp, Homo sapiens
ttaaattcattccaacttttga

SEQ ID NO: 7904870 - DNA, 22 bp, Homo sapiens
ttaaattatttctagtgaggtg

SEQ ID NO: 7904871 - DNA, 22 bp, Homo sapiens
ttaaattatttctagtgaggtg

SEQ ID NO: 7904872 - DNA, 22 bp, Homo sapiens
ttaaattatttctagtgaggtg

SEQ ID NO: 7904873 - DNA, 22 bp, Homo sapiens
ttaaattattgagggattgtca

SEQ ID NO: 7904874 - DNA, 22 bp, Homo sapiens
ttaaattatttctagtgaggtg

SEQ ID NO: 7904875 - DNA, 22 bp, Homo sapiens
ttaaattatttctagtgaggtg

SEQ ID NO: 7904876 - DNA, 22 bp, Homo sapiens
ttaagatgttcagataatttgg

SEQ ID NO: 7904877 - DNA, 22 bp, Homo sapiens
ttaagatttgtagagaaaaagc

SEQ ID NO: 7904878 - DNA, 22 bp, Homo sapiens
ttaagatttgtagagaaaaagc

SEQ ID NO: 7904879 - DNA, 22 bp, Homo sapiens
ttaagcaaatgtcagttgttag

SEQ ID NO: 7904880 - DNA, 22 bp, Homo sapiens
ttaagattttcttcagtattat

SEQ ID NO: 7904881 - DNA, 22 bp, Homo sapiens
ttaagattttcttcagtattat

SEQ ID NO: 7904882 - DNA, 22 bp, Homo sapiens
ttaagattttcttcagtattat

SEQ ID NO: 7904883 - DNA, 22 bp, Homo sapiens
ttaagattttcttcagtattat

SEQ ID NO: 7904884 - DNA, 22 bp, Homo sapiens
ttaagattttcttcagtattat

SEQ ID NO: 7904885 - DNA, 22 bp, Homo sapiens
ttaagaggtggtcgtgtctgtg

SEQ ID NO: 7904886 - DNA, 22 bp, Homo sapiens
ttaagagtaatggaaggccact

SEQ ID NO: 7904887 - DNA, 22 bp, Homo sapiens
ttaagaggtggtcgtgtctgtg

SEQ ID NO: 7904888 - DNA, 22 bp, Homo sapiens
ttaagagtttagtgccacctgg

SEQ ID NO: 7904889 - DNA, 22 bp, Homo sapiens
ttaagagttatttgcacataat

SEQ ID NO: 7904890 - DNA, 22 bp, Homo sapiens
ttaagatagaacccagtagtct

SEQ ID NO: 7904891 - DNA, 22 bp, Homo sapiens
ttaagagggtgatgctagcatt

SEQ ID NO: 7904892 - DNA, 22 bp, Homo sapiens
ttaagatgatgtttcttgttgt

SEQ ID NO: 7904893 - DNA, 22 bp, Homo sapiens
ttaaattttagaaacagactct

SEQ ID NO: 7904894 - DNA, 22 bp, Homo sapiens
ttaaattttagaaacagactct

SEQ ID NO: 7904895 - DNA, 21 bp, Homo sapiens
ttaagagcttagcagtaggcc

SEQ ID NO: 7904896 - DNA, 22 bp, Homo sapiens
ttaagagccaacttatccatct

SEQ ID NO: 7904897 - DNA, 18 bp, Homo sapiens
ttaagagctgaaagggga

SEQ ID NO: 7904898 - DNA, 22 bp, Homo sapiens
ttaagagggtgatgctagcatt

SEQ ID NO: 7904899 - DNA, 22 bp, Homo sapiens
ttaagaggagatcatactggag

SEQ ID NO: 7904900 - DNA, 22 bp, Homo sapiens
ttaagagggtgatgctagcatt

SEQ ID NO: 7904901 - DNA, 22 bp, Homo sapiens
ttaagaggtgaggcctttaaga

SEQ ID NO: 7904902 - DNA, 20 bp, Homo sapiens
tgtcagataactagctgtta

SEQ ID NO: 7904903 - DNA, 22 bp, Homo sapiens
tgtcagatgagtaggttgcgaa

SEQ ID NO: 7904904 - DNA, 22 bp, Homo sapiens
tgtcagatgattctcaggagac

SEQ ID NO: 7904905 - DNA, 22 bp, Homo sapiens
tgtcagatgcgataaactagtg

SEQ ID NO: 7904906 - DNA, 22 bp, Homo sapiens
tgtcagatgcgataaactagtg

SEQ ID NO: 7904907 - DNA, 21 bp, Homo sapiens
tgtcagagcttgtaggacatt

SEQ ID NO: 7904908 - DNA, 21 bp, Homo sapiens
tgtcagagcttgtaggacatt

SEQ ID NO: 7904909 - DNA, 21 bp, Homo sapiens
tgtcagcaacaatactttctc

SEQ ID NO: 7904910 - DNA, 21 bp, Homo sapiens
tgtcagcaacaatactttctc

SEQ ID NO: 7904911 - DNA, 22 bp, Homo sapiens
tgtcagcaagacatcagagtga

SEQ ID NO: 7904912 - DNA, 22 bp, Homo sapiens
tgtcagcaacccatcactccca

SEQ ID NO: 7904913 - DNA, 22 bp, Homo sapiens
tgtcagcaattctggcttactc

SEQ ID NO: 7904914 - DNA, 20 bp, Homo sapiens
tgtcagcaattaggagaaaa

SEQ ID NO: 7904915 - DNA, 20 bp, Homo sapiens
tgtcagcaattaggagaaaa

SEQ ID NO: 7904916 - DNA, 21 bp, Homo sapiens
tgtcagcacgcatgaggccag

SEQ ID NO: 7904917 - DNA, 22 bp, Homo sapiens
tgtcagcagaaatctggtctgc

SEQ ID NO: 7904918 - DNA, 22 bp, Homo sapiens
tgtcagcaccatgggtagtgat

SEQ ID NO: 7904919 - DNA, 22 bp, Homo sapiens
tgtcagagagcaggcagtagaa

SEQ ID NO: 7904920 - DNA, 22 bp, Homo sapiens
tgtcagacctgtgatttcagca

SEQ ID NO: 7904921 - DNA, 22 bp, Homo sapiens
tgtcagacctgtgatttcagca

SEQ ID NO: 7904922 - DNA, 22 bp, Homo sapiens
tgtcagagcaatgaggttcagc

SEQ ID NO: 7904923 - DNA, 22 bp, Homo sapiens
tgtcagagcaatgaggttcagc

SEQ ID NO: 7904924 - DNA, 21 bp, Homo sapiens
tgtcagagcttgtaggacatt

SEQ ID NO: 7904925 - DNA, 20 bp, Homo sapiens
tgtcaatagcactgaggctg

SEQ ID NO: 7904926 - DNA, 22 bp, Homo sapiens
tgtcaataactggagtcattat

SEQ ID NO: 7904927 - DNA, 22 bp, Homo sapiens
tgtcaagtctctgaatgaaatg

SEQ ID NO: 7904928 - DNA, 22 bp, Homo sapiens
tgtcaatagttttgagttctct

SEQ ID NO: 7904929 - DNA, 22 bp, Homo sapiens
tgtcagaactctattgatgtcc

SEQ ID NO: 7904930 - DNA, 22 bp, Homo sapiens
tgtcagacacagccagagactg

SEQ ID NO: 7904931 - DNA, 22 bp, Homo sapiens
tgtcaatatgtaataactgaat

SEQ ID NO: 7904932 - DNA, 22 bp, Homo sapiens
tgtcaatatcaggcagacctaa

SEQ ID NO: 7904933 - DNA, 22 bp, Homo sapiens
tgtcagcatcatttgttgaagg

SEQ ID NO: 7904934 - DNA, 22 bp, Homo sapiens
tgtcagcagtttttagtggagg

SEQ ID NO: 7904935 - DNA, 22 bp, Homo sapiens
tgtcagcagtttttagtggagg

SEQ ID NO: 7904936 - DNA, 22 bp, Homo sapiens
tgtcagcaggacattaaaagct

SEQ ID NO: 7904937 - DNA, 22 bp, Homo sapiens
tgtcagcaggacattaaaagct

SEQ ID NO: 7904938 - DNA, 22 bp, Homo sapiens
tgtcagcagtatctctatctca

SEQ ID NO: 7904939 - DNA, 22 bp, Homo sapiens
tgtcagattactggtgggaccg

SEQ ID NO: 7904940 - DNA, 22 bp, Homo sapiens
tgtcagcagctggtttgctgtt

SEQ ID NO: 7904941 - DNA, 22 bp, Homo sapiens
tgtcagcagctggtttgctgtt

SEQ ID NO: 7904942 - DNA, 22 bp, Homo sapiens
tgtcagcagatctcctgcagcc

SEQ ID NO: 7904943 - DNA, 22 bp, Homo sapiens
tgtcagcagatctcctgcagcc

SEQ ID NO: 7904944 - DNA, 22 bp, Homo sapiens
tgtcagccttgctttagcggtt

SEQ ID NO: 7904945 - DNA, 22 bp, Homo sapiens
tgtcagctcccagtcagagaga

SEQ ID NO: 7904946 - DNA, 22 bp, Homo sapiens
tgtcagcattgcgtcactgagc

SEQ ID NO: 7904947 - DNA, 22 bp, Homo sapiens
tgtcagcatttaaggagtaagg

SEQ ID NO: 7904948 - DNA, 22 bp, Homo sapiens
tgtcagcattgcgtcactgagc

SEQ ID NO: 7904949 - DNA, 22 bp, Homo sapiens
tgtcagcattgcgtcactgagc

SEQ ID NO: 7904950 - DNA, 22 bp, Homo sapiens
tgtcagcatgaaccctgaatta

SEQ ID NO: 7904951 - DNA, 22 bp, Homo sapiens
tgtcagcatcatttgttgaagg

SEQ ID NO: 7904952 - DNA, 22 bp, Homo sapiens
tgtcagcatcatttgttgaagg

SEQ ID NO: 7904953 - DNA, 22 bp, Homo sapiens
tgtcagcattgatgaaatgtgg

SEQ ID NO: 7904954 - DNA, 22 bp, Homo sapiens
tgtcagcatgtcagccaaagat

SEQ ID NO: 7904955 - DNA, 22 bp, Homo sapiens
tgtcagcatgtcagccaaagat

SEQ ID NO: 7904956 - DNA, 22 bp, Homo sapiens
tgtcagcattgcgtcactgagc

SEQ ID NO: 7904957 - DNA, 22 bp, Homo sapiens
tgtcagcattgatgaaatgtgg

SEQ ID NO: 7904958 - DNA, 22 bp, Homo sapiens
ttaaattagtcaagcttctctg

SEQ ID NO: 7904959 - DNA, 22 bp, Homo sapiens
ttaaattagtcaagcttctctg

SEQ ID NO: 7904960 - DNA, 22 bp, Homo sapiens
ttaaattattgagggattgtca

SEQ ID NO: 7904961 - DNA, 22 bp, Homo sapiens
ttaaattattgagggattgtca

SEQ ID NO: 7904962 - DNA, 22 bp, Homo sapiens
ttaaattagtcaagcttctctg

SEQ ID NO: 7904963 - DNA, 22 bp, Homo sapiens
ttaaatagtaggtctattttgg

SEQ ID NO: 7904964 - DNA, 22 bp, Homo sapiens
ttaaatagtaggtctattttgg

SEQ ID NO: 7904965 - DNA, 22 bp, Homo sapiens
ttaaatagtaggtctattttgg

SEQ ID NO: 7904966 - DNA, 22 bp, Homo sapiens
ttaaatagtaggtctattttgg

SEQ ID NO: 7904967 - DNA, 22 bp, Homo sapiens
ttaaatagtaggtctattttgg

SEQ ID NO: 7904968 - DNA, 22 bp, Homo sapiens
tgtcagctcccagtcagagaga

SEQ ID NO: 7904969 - DNA, 22 bp, Homo sapiens
ttaaatagctcttgtagaagaa

SEQ ID NO: 7904970 - DNA, 22 bp, Homo sapiens
ttaaatagtaggtctattttgg

SEQ ID NO: 7904971 - DNA, 22 bp, Homo sapiens
ttatatttctggtagccttcag

SEQ ID NO: 7904972 - DNA, 22 bp, Homo sapiens
ttatatttctggtagccttcag

SEQ ID NO: 7904973 - DNA, 22 bp, Homo sapiens
ttatatttctggtagccttcag

SEQ ID NO: 7904974 - DNA, 22 bp, Homo sapiens
ttatcaagggagaaacaggagg

SEQ ID NO: 7904975 - DNA, 22 bp, Homo sapiens
ttatcaactagtttaggtttga

SEQ ID NO: 7904976 - DNA, 22 bp, Homo sapiens
ttatcacttatgagctttttgc

SEQ ID NO: 7904977 - DNA, 22 bp, Homo sapiens
ttatcacttatgagctttttgc

SEQ ID NO: 7904978 - DNA, 22 bp, Homo sapiens
ttatatttctggtagccttcag

SEQ ID NO: 7904979 - DNA, 22 bp, Homo sapiens
ttatattgtgtaataagtgaag

SEQ ID NO: 7904980 - DNA, 22 bp, Homo sapiens
ttatattagttagacttgctgt

SEQ ID NO: 7904981 - DNA, 22 bp, Homo sapiens
ttatattgggtctggtatcagg

SEQ ID NO: 7904982 - DNA, 22 bp, Homo sapiens
ttatattgtgtaataagtgaag

SEQ ID NO: 7904983 - DNA, 22 bp, Homo sapiens
ttatcagttgtgtgtatacacg

SEQ ID NO: 7904984 - DNA, 22 bp, Homo sapiens
ttatcataagtaattgaaataa

SEQ ID NO: 7904985 - DNA, 22 bp, Homo sapiens
ttatcacttatgagctttttgc

SEQ ID NO: 7904986 - DNA, 22 bp, Homo sapiens
ttatcagagtccccaaaagaaa

SEQ ID NO: 7904987 - DNA, 22 bp, Homo sapiens
ttatcattgtcgcagtctaatt

SEQ ID NO: 7904988 - DNA, 22 bp, Homo sapiens
ttatcattgtcgcagtctaatt

SEQ ID NO: 7904989 - DNA, 22 bp, Homo sapiens
ttatccaaactggtgaatcatt

SEQ ID NO: 7904990 - DNA, 22 bp, Homo sapiens
ttatcattgtcgcagtctaatt

SEQ ID NO: 7904991 - DNA, 22 bp, Homo sapiens
ttatcatctcctgctgtggtta

SEQ ID NO: 7904992 - DNA, 23 bp, Homo sapiens
ttataaatattttcaggtgtgtt

SEQ ID NO: 7904993 - DNA, 23 bp, Homo sapiens
ttataaatattttcaggtgtgtt

SEQ ID NO: 7904994 - DNA, 23 bp, Homo sapiens
ttataaatattttcaggtgtgtt

SEQ ID NO: 7904995 - DNA, 23 bp, Homo sapiens
ttataaatattttcaggtgtgtt

SEQ ID NO: 7904996 - DNA, 23 bp, Homo sapiens
ttataaatattttcaggtgtgtt

SEQ ID NO: 7904997 - DNA, 23 bp, Homo sapiens
ttataaatattttcaggtgtgtt

SEQ ID NO: 7904998 - DNA, 23 bp, Homo sapiens
ttataaatattttcaggtgtgtt

SEQ ID NO: 7904999 - DNA, 22 bp, Homo sapiens
ttataaaggtttgtgcatattt

SEQ ID NO: 7905000 - DNA, 22 bp, Homo sapiens
ttataaaggtttgtgcatattt

SEQ ID NO: 7905001 - DNA, 22 bp, Homo sapiens
ttataaaggtttgtgcatattt

SEQ ID NO: 7905002 - DNA, 22 bp, Homo sapiens
ttataaaggtttgtgcatattt

SEQ ID NO: 7905003 - DNA, 22 bp, Homo sapiens
ttataaagtgagaagtgctatg

SEQ ID NO: 7905004 - DNA, 22 bp, Homo sapiens
ttataaagtgagaagtgctatg

SEQ ID NO: 7905005 - DNA, 22 bp, Homo sapiens
ttataaagtgagaagtgctatg

SEQ ID NO: 7905006 - DNA, 22 bp, Homo sapiens
ttataacatcaatcagagttaa

SEQ ID NO: 7905007 - DNA, 22 bp, Homo sapiens
ttataacaacagtttactttaa

SEQ ID NO: 7905008 - DNA, 22 bp, Homo sapiens
ttataacaacagtttactttaa

SEQ ID NO: 7905009 - DNA, 22 bp, Homo sapiens
ttataacattataaagtggaga

SEQ ID NO: 7905010 - DNA, 22 bp, Homo sapiens
ttatattagttagacttgctgt

SEQ ID NO: 7905011 - DNA, 22 bp, Homo sapiens
ttagttttcccatctttatggt

SEQ ID NO: 7905012 - DNA, 22 bp, Homo sapiens
ttagttttcccatctttatggt

SEQ ID NO: 7905013 - DNA, 22 bp, Homo sapiens
ttagttttctcatctatctcac

SEQ ID NO: 7905014 - DNA, 22 bp, Homo sapiens
ttagttttcccatctttatggt

SEQ ID NO: 7905015 - DNA, 22 bp, Homo sapiens
ttagttttctcatctatctcac

SEQ ID NO: 7905016 - DNA, 22 bp, Homo sapiens
ttataaacttgccaagaaggag

SEQ ID NO: 7905017 - DNA, 22 bp, Homo sapiens
ttataaacttgccaagaaggag

SEQ ID NO: 7905018 - DNA, 22 bp, Homo sapiens
ttataaagattgttatgtatct

SEQ ID NO: 7905019 - DNA, 22 bp, Homo sapiens
ttataaagattgttatgtatct

SEQ ID NO: 7905020 - DNA, 22 bp, Homo sapiens
ttataaagatccttccagagtt

SEQ ID NO: 7905021 - DNA, 22 bp, Homo sapiens
ttataaagatccttccagagtt

SEQ ID NO: 7905022 - DNA, 22 bp, Homo sapiens
ttataaagattgttatgtatct

SEQ ID NO: 7905023 - DNA, 22 bp, Homo sapiens
ttataaagattgttatgtatct

SEQ ID NO: 7905024 - DNA, 22 bp, Homo sapiens
ttagtttcctgtggtgtgaagt

SEQ ID NO: 7905025 - DNA, 22 bp, Homo sapiens
ttagttttcccatctttatggt

SEQ ID NO: 7905026 - DNA, 22 bp, Homo sapiens
ttagtttccaccacacatgttc

SEQ ID NO: 7905027 - DNA, 22 bp, Homo sapiens
ttagtttataattcatttctgt

SEQ ID NO: 7905028 - DNA, 22 bp, Homo sapiens
ttagggaaagcagcattccctt

SEQ ID NO: 7905029 - DNA, 22 bp, Homo sapiens
ttagggaaataaaattatcagt

SEQ ID NO: 7905030 - DNA, 22 bp, Homo sapiens
ttagggaaagcagcattccctt

SEQ ID NO: 7905031 - DNA, 22 bp, Homo sapiens
ttagggaaataaaattatcagt

SEQ ID NO: 7905032 - DNA, 22 bp, Homo sapiens
ttagggaaataaaattatcagt

SEQ ID NO: 7905033 - DNA, 22 bp, Homo sapiens
ttagggaaataaaattatcagt

SEQ ID NO: 7905034 - DNA, 22 bp, Homo sapiens
ttagggaaacaaacattttctt

SEQ ID NO: 7905035 - DNA, 22 bp, Homo sapiens
ttaggcttttttaaagcacaga

SEQ ID NO: 7905036 - DNA, 22 bp, Homo sapiens
ttagggaaacaaacattttctt

SEQ ID NO: 7905037 - DNA, 22 bp, Homo sapiens
ccttgcccgctgcctctgagtt

SEQ ID NO: 7905038 - DNA, 22 bp, Homo sapiens
ccttgcccgctgcctctgagtt

SEQ ID NO: 7905039 - DNA, 22 bp, Homo sapiens
ccttgagacacagccaaagatg

SEQ ID NO: 7905040 - DNA, 22 bp, Homo sapiens
ccttgagatgagctaatttttt

SEQ ID NO: 7905041 - DNA, 22 bp, Homo sapiens
ccttgagaggaagtttgtagaa

SEQ ID NO: 7905042 - DNA, 22 bp, Homo sapiens
ccttgagaggaagtttgtagaa

SEQ ID NO: 7905043 - DNA, 22 bp, Homo sapiens
ccttgaaatgttctcactgggg

SEQ ID NO: 7905044 - DNA, 22 bp, Homo sapiens
ccttgaaatgagaaaaagttgg

SEQ ID NO: 7905045 - DNA, 22 bp, Homo sapiens
ccttgaaatgttctcactgggg

SEQ ID NO: 7905046 - DNA, 22 bp, Homo sapiens
ccttgactgccttcaggctggg

SEQ ID NO: 7905047 - DNA, 22 bp, Homo sapiens
ccttgagccagggagctggcag

SEQ ID NO: 7905048 - DNA, 22 bp, Homo sapiens
ccttgagatgagctaatttttt

SEQ ID NO: 7905049 - DNA, 22 bp, Homo sapiens
ccttgaatctctgctctagaac

SEQ ID NO: 7905050 - DNA, 22 bp, Homo sapiens
ccttgagccagggagctggcag

SEQ ID NO: 7905051 - DNA, 22 bp, Homo sapiens
ccttgagccagggagctggcag

SEQ ID NO: 7905052 - DNA, 22 bp, Homo sapiens
ccttgagccagggagctggcag

SEQ ID NO: 7905053 - DNA, 20 bp, Homo sapiens
ccttgatcttggacttccag

SEQ ID NO: 7905054 - DNA, 22 bp, Homo sapiens
ccttgcagacatcagtagtggc

SEQ ID NO: 7905055 - DNA, 22 bp, Homo sapiens
ccttgattcctaagagggggca

SEQ ID NO: 7905056 - DNA, 20 bp, Homo sapiens
ccttgccagtagggctggga

SEQ ID NO: 7905057 - DNA, 22 bp, Homo sapiens
ccttgcatgtgctaacgacaag

SEQ ID NO: 7905058 - DNA, 22 bp, Homo sapiens
ccttgcagttgttactgtagcc

SEQ ID NO: 7905059 - DNA, 22 bp, Homo sapiens
ccttgcagttgttactgtagcc

SEQ ID NO: 7905060 - DNA, 22 bp, Homo sapiens
ccttgcaggggaacaggcagtg

SEQ ID NO: 7905061 - DNA, 22 bp, Homo sapiens
ccttgcatatattatatctttg

SEQ ID NO: 7905062 - DNA, 22 bp, Homo sapiens
ccttgcagagcataggagccct

SEQ ID NO: 7905063 - DNA, 22 bp, Homo sapiens
ccttgcagacatcagtagtggc

SEQ ID NO: 7905064 - DNA, 22 bp, Homo sapiens
ccttgcagcatatagagtccct

SEQ ID NO: 7905065 - DNA, 22 bp, Homo sapiens
ccttgcagagcataggagccct

SEQ ID NO: 7905066 - DNA, 22 bp, Homo sapiens
ccttgcagacatcagtagtggc

SEQ ID NO: 7905067 - DNA, 22 bp, Homo sapiens
ccttgcaggggaacaggcagtg

SEQ ID NO: 7905068 - DNA, 22 bp, Homo sapiens
ccttgcaggggaacaggcagtg

SEQ ID NO: 7905069 - DNA, 22 bp, Homo sapiens
ccttgcagcatatagagtccct

SEQ ID NO: 7905070 - DNA, 22 bp, Homo sapiens
ccttgcagggaaactggaccca

SEQ ID NO: 7905071 - DNA, 22 bp, Homo sapiens
ccttgcagggaaactggaccca

SEQ ID NO: 7905072 - DNA, 22 bp, Homo sapiens
ttagcaaatatcttgaaacagg

SEQ ID NO: 7905073 - DNA, 22 bp, Homo sapiens
ttagcaaatatcttgaaacagg

SEQ ID NO: 7905074 - DNA, 22 bp, Homo sapiens
ttagcaaatatcttgaaacagg

SEQ ID NO: 7905075 - DNA, 22 bp, Homo sapiens
ttagcaaaggcccctacaccca

SEQ ID NO: 7905076 - DNA, 22 bp, Homo sapiens
ttagcaaaggcccctacaccca

SEQ ID NO: 7905077 - DNA, 22 bp, Homo sapiens
ttagcaaagtttgccatctagt

SEQ ID NO: 7905078 - DNA, 22 bp, Homo sapiens
ttagcaaagtttgccatctagt

SEQ ID NO: 7905079 - DNA, 21 bp, Homo sapiens
ttagcaaagcaaacacatgct

SEQ ID NO: 7905080 - DNA, 21 bp, Homo sapiens
ttagcaaagcaaacacatgct

SEQ ID NO: 7905081 - DNA, 21 bp, Homo sapiens
ttagcaaagcaaacacatgct

SEQ ID NO: 7905082 - DNA, 21 bp, Homo sapiens
ttagcaaagcaaacacatgct

SEQ ID NO: 7905083 - DNA, 22 bp, Homo sapiens
ttagcaaagaagatgtgagttt

SEQ ID NO: 7905084 - DNA, 22 bp, Homo sapiens
ttagcaaagaagatgtgagttt

SEQ ID NO: 7905085 - DNA, 22 bp, Homo sapiens
ttagcaaagaagatgtgagttt

SEQ ID NO: 7905086 - DNA, 22 bp, Homo sapiens
ttagcaaagaagatgtgagttt

SEQ ID NO: 7905087 - DNA, 22 bp, Homo sapiens
ttagcaaactctgttagattct

SEQ ID NO: 7905088 - DNA, 22 bp, Homo sapiens
ttagacaggatgtatgaaagct

SEQ ID NO: 7905089 - DNA, 22 bp, Homo sapiens
ttagacaggatgtatgaaagct

SEQ ID NO: 7905090 - DNA, 22 bp, Homo sapiens
ttagacatagaatattgtctag

SEQ ID NO: 7905091 - DNA, 22 bp, Homo sapiens
ttagacatagaatattgtctag

SEQ ID NO: 7905092 - DNA, 22 bp, Homo sapiens
ttagcaaactctgttagattct

SEQ ID NO: 7905093 - DNA, 22 bp, Homo sapiens
ttagcaaactctgttagattct

SEQ ID NO: 7905094 - DNA, 18 bp, Homo sapiens
ccttcagctctgccagta

SEQ ID NO: 7905095 - DNA, 18 bp, Homo sapiens
ccttcagctctgccagta

SEQ ID NO: 7905096 - DNA, 18 bp, Homo sapiens
ccttcagctctgccagta

SEQ ID NO: 7905097 - DNA, 22 bp, Homo sapiens
ttagcaaatatcttgaaacagg

SEQ ID NO: 7905098 - DNA, 22 bp, Homo sapiens
ttagcaaatatcttgaaacagg

SEQ ID NO: 7905099 - DNA, 22 bp, Homo sapiens
ttagcaaatatcttgaaacagg

SEQ ID NO: 7905100 - DNA, 22 bp, Homo sapiens
ttagcaaatatcttgaaacagg

SEQ ID NO: 7905101 - DNA, 22 bp, Homo sapiens
ttagcaaatatcttgaaacagg

SEQ ID NO: 7905102 - DNA, 22 bp, Homo sapiens
ttagcaaatatcttgaaacagg

SEQ ID NO: 7905103 - DNA, 22 bp, Homo sapiens
ttagcaaatatcttgaaacagg

SEQ ID NO: 7905104 - DNA, 22 bp, Homo sapiens
ttagcaagaaagattgcagcac

SEQ ID NO: 7905105 - DNA, 22 bp, Homo sapiens
ttagcaaatttccaggtgatgc

SEQ ID NO: 7905106 - DNA, 22 bp, Homo sapiens
ttagcaatgtatgattaaaata

SEQ ID NO: 7905107 - DNA, 22 bp, Homo sapiens
ttagcaatgtatgattaaaata

SEQ ID NO: 7905108 - DNA, 22 bp, Homo sapiens
ttagcaatgtatgattaaaata

SEQ ID NO: 7905109 - DNA, 22 bp, Homo sapiens
ttagcaatgtatgattaaaata

SEQ ID NO: 7905110 - DNA, 22 bp, Homo sapiens
ttagcaatgtatgattaaaata

SEQ ID NO: 7905111 - DNA, 22 bp, Homo sapiens
ttagcaattccaggtaagttat

SEQ ID NO: 7905112 - DNA, 22 bp, Homo sapiens
ttagcaatgtatgattaaaata

SEQ ID NO: 7905113 - DNA, 22 bp, Homo sapiens
ttagcaattccaggtaagttat

SEQ ID NO: 7905114 - DNA, 22 bp, Homo sapiens
ttagcaattgattctcataagc

SEQ ID NO: 7905115 - DNA, 22 bp, Homo sapiens
ttagcaatcctaggctggatca

SEQ ID NO: 7905116 - DNA, 22 bp, Homo sapiens
ttagcaatatgaatgcatttgc

SEQ ID NO: 7905117 - DNA, 22 bp, Homo sapiens
ttagcaatatgaatgcatttgc

SEQ ID NO: 7905118 - DNA, 22 bp, Homo sapiens
ttagcaagataacagtaatttt

SEQ ID NO: 7905119 - DNA, 22 bp, Homo sapiens
ttagcaagataacagtaatttt

SEQ ID NO: 7905120 - DNA, 22 bp, Homo sapiens
ccttgaaagccaggcagaggaa

SEQ ID NO: 7905121 - DNA, 22 bp, Homo sapiens
ccttgaaagtatatgctcaatt

SEQ ID NO: 7905122 - DNA, 22 bp, Homo sapiens
ccttgaaagccaggcagaggaa

SEQ ID NO: 7905123 - DNA, 22 bp, Homo sapiens
ccttgaaagtatatgctcaatt

SEQ ID NO: 7905124 - DNA, 22 bp, Homo sapiens
ttagcactggattaatcaaagt

SEQ ID NO: 7905125 - DNA, 22 bp, Homo sapiens
ttagcactggatttcatcagaa

SEQ ID NO: 7905126 - DNA, 22 bp, Homo sapiens
ccttgaaaccctgacactctgt

SEQ ID NO: 7905127 - DNA, 22 bp, Homo sapiens
ccttgaaaccctgacactctgt

SEQ ID NO: 7905128 - DNA, 22 bp, Homo sapiens
ttagcaccctgatactagaatg

SEQ ID NO: 7905129 - DNA, 22 bp, Homo sapiens
ttagcacctcattcccaccttc

SEQ ID NO: 7905130 - DNA, 18 bp, Homo sapiens
ttagcacctatgtgggta

SEQ ID NO: 7905131 - DNA, 22 bp, Homo sapiens
ttagcaccttaactgtggagat

SEQ ID NO: 7905132 - DNA, 22 bp, Homo sapiens
ttagcaccttgaacagaccctg

SEQ ID NO: 7905133 - DNA, 22 bp, Homo sapiens
ttagcacccgggccagcggctg

SEQ ID NO: 7905134 - DNA, 22 bp, Homo sapiens
ttagcaccagctatggatgtgc

SEQ ID NO: 7905135 - DNA, 22 bp, Homo sapiens
ttagcaccacacactttagagg

SEQ ID NO: 7905136 - DNA, 22 bp, Homo sapiens
ttagcacaggcaactccacata

SEQ ID NO: 7905137 - DNA, 22 bp, Homo sapiens
ttagcacaattatttcagttgt

SEQ ID NO: 7905138 - DNA, 22 bp, Homo sapiens
ttagcacaggagtctctgttat

SEQ ID NO: 7905139 - DNA, 22 bp, Homo sapiens
ttacataacggtatgaaaaatg

SEQ ID NO: 7905140 - DNA, 22 bp, Homo sapiens
ttacataacggtatgaaaaatg

SEQ ID NO: 7905141 - DNA, 22 bp, Homo sapiens
ttacataacggtatgaaaaatg

SEQ ID NO: 7905142 - DNA, 22 bp, Homo sapiens
ttacataacggtatgaaaaatg

SEQ ID NO: 7905143 - DNA, 22 bp, Homo sapiens
ttacataacggtatgaaaaatg

SEQ ID NO: 7905144 - DNA, 22 bp, Homo sapiens
ttacataactttaaaatgccgt

SEQ ID NO: 7905145 - DNA, 22 bp, Homo sapiens
ttacataacggtatgaaaaatg

SEQ ID NO: 7905146 - DNA, 22 bp, Homo sapiens
ttacataaaagttcacgtaggc

SEQ ID NO: 7905147 - DNA, 22 bp, Homo sapiens
ttacataaaagttcacgtaggc

SEQ ID NO: 7905148 - DNA, 22 bp, Homo sapiens
ttacataaaagttcacgtaggc

SEQ ID NO: 7905149 - DNA, 22 bp, Homo sapiens
ttacagtttctagtaatacttg

SEQ ID NO: 7905150 - DNA, 22 bp, Homo sapiens
ttacataaaagttcacgtaggc

SEQ ID NO: 7905151 - DNA, 22 bp, Homo sapiens
ttacataaaagttcacgtaggc

SEQ ID NO: 7905152 - DNA, 22 bp, Homo sapiens
ttacataaaagttcacgtaggc

SEQ ID NO: 7905153 - DNA, 22 bp, Homo sapiens
ttacagtttctagtaatacttg

SEQ ID NO: 7905154 - DNA, 22 bp, Homo sapiens
ttacatacctcatagactcagg

SEQ ID NO: 7905155 - DNA, 22 bp, Homo sapiens
ttacatacttactagatctatg

SEQ ID NO: 7905156 - DNA, 22 bp, Homo sapiens
ttacatacttactagatctatg

SEQ ID NO: 7905157 - DNA, 22 bp, Homo sapiens
ttacatacctcatagactcagg

SEQ ID NO: 7905158 - DNA, 22 bp, Homo sapiens
ttacataactttaaaatgccgt

SEQ ID NO: 7905159 - DNA, 22 bp, Homo sapiens
ttacatagttaaatagtacagc

SEQ ID NO: 7905160 - DNA, 22 bp, Homo sapiens
ccttcaaactttcattaaccag

SEQ ID NO: 7905161 - DNA, 22 bp, Homo sapiens
ttacatagttaaatagtacagc

SEQ ID NO: 7905162 - DNA, 22 bp, Homo sapiens
ccttcagcctcaagatccttca

SEQ ID NO: 7905163 - DNA, 22 bp, Homo sapiens
ccttcagccttcatccttcctt

SEQ ID NO: 7905164 - DNA, 20 bp, Homo sapiens
ccttcagatgactttttcag

SEQ ID NO: 7905165 - DNA, 22 bp, Homo sapiens
ccttcagaggtgtagattgcgt

SEQ ID NO: 7905166 - DNA, 23 bp, Homo sapiens
ccttcagaagaagtaacaggggc

SEQ ID NO: 7905167 - DNA, 22 bp, Homo sapiens
ccttcagaatgaaattctaatg

SEQ ID NO: 7905168 - DNA, 23 bp, Homo sapiens
ccttcagaagaagtaacaggggc

SEQ ID NO: 7905169 - DNA, 22 bp, Homo sapiens
ccttcagaatgaaattctaatg

SEQ ID NO: 7905170 - DNA, 22 bp, Homo sapiens
ccttcagaatgaaattctaatg

SEQ ID NO: 7905171 - DNA, 22 bp, Homo sapiens
ccttcagacctagacaggaatc

SEQ ID NO: 7905172 - DNA, 22 bp, Homo sapiens
ccttcagaggtgtagattgcgt

SEQ ID NO: 7905173 - DNA, 22 bp, Homo sapiens
ccttcagacctagacaggaatc

SEQ ID NO: 7905174 - DNA, 22 bp, Homo sapiens
ccttcaaggcaaggagggctgg

SEQ ID NO: 7905175 - DNA, 22 bp, Homo sapiens
ccttcaaatttagaacaagtga

SEQ ID NO: 7905176 - DNA, 22 bp, Homo sapiens
ccttcaaatttagaacaagtga

SEQ ID NO: 7905177 - DNA, 22 bp, Homo sapiens
ccttcaaattctcttagctgaa

SEQ ID NO: 7905178 - DNA, 22 bp, Homo sapiens
ccttcaagttcctggtccctgg

SEQ ID NO: 7905179 - DNA, 22 bp, Homo sapiens
ccttcaatcagcagtctagctt

SEQ ID NO: 7905180 - DNA, 22 bp, Homo sapiens
ccttcaatcagcagtctagctt

SEQ ID NO: 7905181 - DNA, 22 bp, Homo sapiens
ccttcaaggcaaggagggctgg

SEQ ID NO: 7905182 - DNA, 20 bp, Homo sapiens
ccttcagaacttacatagta

SEQ ID NO: 7905183 - DNA, 22 bp, Homo sapiens
ccttcacaccatctttaccagg

SEQ ID NO: 7905184 - DNA, 20 bp, Homo sapiens
ccttcagaacttacatagta

SEQ ID NO: 7905185 - DNA, 22 bp, Homo sapiens
ccttcaatcttaagtcagccca

SEQ ID NO: 7905186 - DNA, 22 bp, Homo sapiens
ccttcaatcttaagtcagccca

SEQ ID NO: 7905187 - DNA, 22 bp, Homo sapiens
ccttcacactttcacttggata

SEQ ID NO: 7905188 - DNA, 16 bp, Homo sapiens
cgcctccctccctcgc

SEQ ID NO: 7905189 - DNA, 22 bp, Homo sapiens
cgcctcagccgtggtcatcttc

SEQ ID NO: 7905190 - DNA, 22 bp, Homo sapiens
cgccgtcccctaggaaagagct

SEQ ID NO: 7905191 - DNA, 22 bp, Homo sapiens
ttatttcatgtaaaatttatgt

SEQ ID NO: 7905192 - DNA, 22 bp, Homo sapiens
ttatttcatataatgttatcaa

SEQ ID NO: 7905193 - DNA, 22 bp, Homo sapiens
ttatttcatataatgttatcaa

SEQ ID NO: 7905194 - DNA, 22 bp, Homo sapiens
ttatttcatataatgttatcaa

SEQ ID NO: 7905195 - DNA, 22 bp, Homo sapiens
ttatttcatgtaaaatttatgt

SEQ ID NO: 7905196 - DNA, 22 bp, Homo sapiens
ttatttcatgtaaaatttatgt

SEQ ID NO: 7905197 - DNA, 22 bp, Homo sapiens
ttatttcatgtaaaatttatgt

SEQ ID NO: 7905198 - DNA, 22 bp, Homo sapiens
ttatttcatgtaaaatttatgt

SEQ ID NO: 7905199 - DNA, 22 bp, Homo sapiens
cgctgataaacgtcacgttccc

SEQ ID NO: 7905200 - DNA, 22 bp, Homo sapiens
cgctgataaacgtcacgttccc

SEQ ID NO: 7905201 - DNA, 19 bp, Homo sapiens
cgctctgggtttcgtgtca

SEQ ID NO: 7905202 - DNA, 22 bp, Homo sapiens
cgctctggcaggcacaggaggg

SEQ ID NO: 7905203 - DNA, 19 bp, Homo sapiens
cgctctgggtttcgtgtca

SEQ ID NO: 7905204 - DNA, 22 bp, Homo sapiens
cgctctggcaggcacaggaggg

SEQ ID NO: 7905205 - DNA, 22 bp, Homo sapiens
cgctctggcaggcacaggaggg

SEQ ID NO: 7905206 - DNA, 22 bp, Homo sapiens
cgctctggagaatagtagcttt

SEQ ID NO: 7905207 - DNA, 22 bp, Homo sapiens
cgctctggagaatagtagcttt

SEQ ID NO: 7905208 - DNA, 22 bp, Homo sapiens
cgctctggagaatagtagcttt

SEQ ID NO: 7905209 - DNA, 22 bp, Homo sapiens
cgctccttgagcgtgtcggcct

SEQ ID NO: 7905210 - DNA, 22 bp, Homo sapiens
cgctccttgagcgtgtcggcct

SEQ ID NO: 7905211 - DNA, 22 bp, Homo sapiens
cgcctctctttttctcccagac

SEQ ID NO: 7905212 - DNA, 22 bp, Homo sapiens
ttcaaagtaccgtacttaatgg

SEQ ID NO: 7905213 - DNA, 22 bp, Homo sapiens
cgctgggcaggtccacttgtta

SEQ ID NO: 7905214 - DNA, 22 bp, Homo sapiens
cgctggcttcctcctggggcca

SEQ ID NO: 7905215 - DNA, 22 bp, Homo sapiens
cgctggcttcctcctggggcca

SEQ ID NO: 7905216 - DNA, 22 bp, Homo sapiens
cgctggccatagcctcctgtgt

SEQ ID NO: 7905217 - DNA, 22 bp, Homo sapiens
cgctgccttcatcccacgccta

SEQ ID NO: 7905218 - DNA, 22 bp, Homo sapiens
cgctgccttcatcccacgccta

SEQ ID NO: 7905219 - DNA, 22 bp, Homo sapiens
cgctgcgaggcgcccttgttgc

SEQ ID NO: 7905220 - DNA, 21 bp, Homo sapiens
cgctgccttgggagtggacct

SEQ ID NO: 7905221 - DNA, 21 bp, Homo sapiens
cgctgccttgggagtggacct

SEQ ID NO: 7905222 - DNA, 22 bp, Homo sapiens
cgctgctcggaaggtgtcacgt

SEQ ID NO: 7905223 - DNA, 22 bp, Homo sapiens
cgctggcattagggcagtggcc

SEQ ID NO: 7905224 - DNA, 22 bp, Homo sapiens
cgctgcctctctggggccctgg

SEQ ID NO: 7905225 - DNA, 22 bp, Homo sapiens
cgctgcctccaggtgcagcagg

SEQ ID NO: 7905226 - DNA, 22 bp, Homo sapiens
cgctgcctctctggggccctgg

SEQ ID NO: 7905227 - DNA, 22 bp, Homo sapiens
cgctgcctccaggtgcagcagg

SEQ ID NO: 7905228 - DNA, 22 bp, Homo sapiens
cgctgccaggatcccctgccgg

SEQ ID NO: 7905229 - DNA, 22 bp, Homo sapiens
cgctgccaggtcaccaggggta

SEQ ID NO: 7905230 - DNA, 22 bp, Homo sapiens
cgctgcagaagcgtgttcagga

SEQ ID NO: 7905231 - DNA, 22 bp, Homo sapiens
cgctgcacgtgtcacactaacc

SEQ ID NO: 7905232 - DNA, 22 bp, Homo sapiens
cgctgataaacgtcacgttccc

SEQ ID NO: 7905233 - DNA, 22 bp, Homo sapiens
cgctgcagatgggagctggttg

SEQ ID NO: 7905234 - DNA, 22 bp, Homo sapiens
cgctgcagctggctgcagggaa

SEQ ID NO: 7905235 - DNA, 22 bp, Homo sapiens
cgctgcagctggctgcagggaa

SEQ ID NO: 7905236 - DNA, 22 bp, Homo sapiens
ttatttattgtgtacctactgt

SEQ ID NO: 7905237 - DNA, 22 bp, Homo sapiens
ttatttcaaaagagcttggggt

SEQ ID NO: 7905238 - DNA, 22 bp, Homo sapiens
ttatttattgtgtacctactgt

SEQ ID NO: 7905239 - DNA, 20 bp, Homo sapiens
ttatttcagttgctagattg

SEQ ID NO: 7905240 - DNA, 20 bp, Homo sapiens
ttatttcagttgctagattg

SEQ ID NO: 7905241 - DNA, 21 bp, Homo sapiens
ttatttcacatggacttccag

SEQ ID NO: 7905242 - DNA, 22 bp, Homo sapiens
ttatttcatataatgttatcaa

SEQ ID NO: 7905243 - DNA, 20 bp, Homo sapiens
ttatttcagttgctagattg

SEQ ID NO: 7905244 - DNA, 20 bp, Homo sapiens
ttatttcagttgctagattg

SEQ ID NO: 7905245 - DNA, 20 bp, Homo sapiens
ttatttcagttgctagattg

SEQ ID NO: 7905246 - DNA, 22 bp, Homo sapiens
ttatttattgtgtacctactgt

SEQ ID NO: 7905247 - DNA, 22 bp, Homo sapiens
ttatttattgtgtacctactgt

SEQ ID NO: 7905248 - DNA, 22 bp, Homo sapiens
ttatttattgtgtacctactgt

SEQ ID NO: 7905249 - DNA, 22 bp, Homo sapiens
ttatttattgtgtacctactgt

SEQ ID NO: 7905250 - DNA, 22 bp, Homo sapiens
ttatttattcattctgtctgtc

SEQ ID NO: 7905251 - DNA, 22 bp, Homo sapiens
ttattgctatggtgagagggat

SEQ ID NO: 7905252 - DNA, 22 bp, Homo sapiens
ttattgctatggtgagagggat

SEQ ID NO: 7905253 - DNA, 22 bp, Homo sapiens
ttattgcagatggtgtgagaga

SEQ ID NO: 7905254 - DNA, 22 bp, Homo sapiens
ttattgcagccgcagggcgctg

SEQ ID NO: 7905255 - DNA, 22 bp, Homo sapiens
ttattgcagatggtgtgagaga

SEQ ID NO: 7905256 - DNA, 22 bp, Homo sapiens
ttattgcatagattatgccata

SEQ ID NO: 7905257 - DNA, 17 bp, Homo sapiens
ttattgcagtgctgaag

SEQ ID NO: 7905258 - DNA, 22 bp, Homo sapiens
ttattgctaaggtactaggtgg

SEQ ID NO: 7905259 - DNA, 22 bp, Homo sapiens
ttattgctaaggtactaggtgg

SEQ ID NO: 7905260 - DNA, 22 bp, Homo sapiens
ttattgcatagattatgccata

SEQ ID NO: 7905261 - DNA, 22 bp, Homo sapiens
ttattgcatagattatgccata

SEQ ID NO: 7905262 - DNA, 23 bp, Homo sapiens
ttattgcatccaaatgcattcct

SEQ ID NO: 7905263 - DNA, 22 bp, Homo sapiens
ttattgcactattgattttcta

SEQ ID NO: 7905264 - DNA, 22 bp, Homo sapiens
ttattgcaccttcctcactaac

SEQ ID NO: 7905265 - DNA, 22 bp, Homo sapiens
ttattgcaccttcctcactaac

SEQ ID NO: 7905266 - DNA, 22 bp, Homo sapiens
ttattgcactattgattttcta

SEQ ID NO: 7905267 - DNA, 22 bp, Homo sapiens
ttattgcactattgattttcta

SEQ ID NO: 7905268 - DNA, 23 bp, Homo sapiens
ttattgcaaggtaaaattgctga

SEQ ID NO: 7905269 - DNA, 23 bp, Homo sapiens
ttattgcaaggtaaaattgctga

SEQ ID NO: 7905270 - DNA, 22 bp, Homo sapiens
ttattgcaccatgcctcagttt

SEQ ID NO: 7905271 - DNA, 22 bp, Homo sapiens
ttattgcaccatgcctcagttt

SEQ ID NO: 7905272 - DNA, 22 bp, Homo sapiens
ttattgcaactttagggataga

SEQ ID NO: 7905273 - DNA, 23 bp, Homo sapiens
ttattgcaaggtaaaattgctga

SEQ ID NO: 7905274 - DNA, 22 bp, Homo sapiens
ttattgcaactcctaaatagag

SEQ ID NO: 7905275 - DNA, 22 bp, Homo sapiens
ttattgcaactcctaaatagag

SEQ ID NO: 7905276 - DNA, 22 bp, Homo sapiens
ttattcagattggctacaggat

SEQ ID NO: 7905277 - DNA, 22 bp, Homo sapiens
ttattcagcagggacttccttt

SEQ ID NO: 7905278 - DNA, 22 bp, Homo sapiens
ttattcagcatttagaggaagg

SEQ ID NO: 7905279 - DNA, 22 bp, Homo sapiens
ttattcagcatttagaggaagg

SEQ ID NO: 7905280 - DNA, 22 bp, Homo sapiens
ttattcagctctctagaggcac

SEQ ID NO: 7905281 - DNA, 22 bp, Homo sapiens
ttattcaggaaggtgttactta

SEQ ID NO: 7905282 - DNA, 22 bp, Homo sapiens
cgagagttagctaggagtcaca

SEQ ID NO: 7905283 - DNA, 22 bp, Homo sapiens
cgagagttagctaggagtcaca

SEQ ID NO: 7905284 - DNA, 22 bp, Homo sapiens
cgagaggctggacagggctggg

SEQ ID NO: 7905285 - DNA, 22 bp, Homo sapiens
cgagagttagctaggagtcaca

SEQ ID NO: 7905286 - DNA, 22 bp, Homo sapiens
cgagatccttcagagcgcggac

SEQ ID NO: 7905287 - DNA, 22 bp, Homo sapiens
cgagcagaagcctggtggtctg

SEQ ID NO: 7905288 - DNA, 22 bp, Homo sapiens
cgagatccttcagagcgcggac

SEQ ID NO: 7905289 - DNA, 22 bp, Homo sapiens
cgagatggtatttttaacgcag

SEQ ID NO: 7905290 - DNA, 22 bp, Homo sapiens
ttattgagtatctgcttggtgt

SEQ ID NO: 7905291 - DNA, 22 bp, Homo sapiens
ttattgagtatctgcttggtgt

SEQ ID NO: 7905292 - DNA, 22 bp, Homo sapiens
ttattgagttgtaagagctctt

SEQ ID NO: 7905293 - DNA, 16 bp, Homo sapiens
ttattgaggccaagga

SEQ ID NO: 7905294 - DNA, 22 bp, Homo sapiens
ttattgcaaaggaagagcttga

SEQ ID NO: 7905295 - DNA, 22 bp, Homo sapiens
ttattgcaaaggaagagcttga

SEQ ID NO: 7905296 - DNA, 22 bp, Homo sapiens
ttattgcaaaggaagagcttga

SEQ ID NO: 7905297 - DNA, 22 bp, Homo sapiens
ttattgagtttacagctttaga

SEQ ID NO: 7905298 - DNA, 22 bp, Homo sapiens
ttattgcaaccttttctggtgt

SEQ ID NO: 7905299 - DNA, 22 bp, Homo sapiens
ttattgcaaccttttctggtgt

SEQ ID NO: 7905300 - DNA, 22 bp, Homo sapiens
cgacgggctcggtccgcttcct

SEQ ID NO: 7905301 - DNA, 21 bp, Homo sapiens
cgacaggagaggcagccagcc

SEQ ID NO: 7905302 - DNA, 22 bp, Homo sapiens
cgactgtcatacacaagacatg

SEQ ID NO: 7905303 - DNA, 22 bp, Homo sapiens
cgaagacagaccatctgagtag

SEQ ID NO: 7905304 - DNA, 22 bp, Homo sapiens
cgaagacagaccatctgagtag

SEQ ID NO: 7905305 - DNA, 22 bp, Homo sapiens
cgagaggctggacagggctggg

SEQ ID NO: 7905306 - DNA, 22 bp, Homo sapiens
cgagaggctggacagggctggg

SEQ ID NO: 7905307 - DNA, 22 bp, Homo sapiens
cgagagatgggttggcaggggc

SEQ ID NO: 7905308 - DNA, 22 bp, Homo sapiens
cgagagatgggttggcaggggc

SEQ ID NO: 7905309 - DNA, 22 bp, Homo sapiens
cgagaaggtcttcccacagagc

SEQ ID NO: 7905310 - DNA, 22 bp, Homo sapiens
cgagagagacatggtgacctgc

SEQ ID NO: 7905311 - DNA, 22 bp, Homo sapiens
cgagagagacatggtgacctgc

SEQ ID NO: 7905312 - DNA, 22 bp, Homo sapiens
cgacgggctcggtccgcttcct

SEQ ID NO: 7905313 - DNA, 22 bp, Homo sapiens
cgagaaggtcttcccacagagc

SEQ ID NO: 7905314 - DNA, 19 bp, Homo sapiens
ccttttttaacttcagcaa

SEQ ID NO: 7905315 - DNA, 19 bp, Homo sapiens
ccttttttaacttcagcaa

SEQ ID NO: 7905316 - DNA, 22 bp, Homo sapiens
ccttttttctatgccaactctg

SEQ ID NO: 7905317 - DNA, 19 bp, Homo sapiens
ccttttttaacttcagcaa

SEQ ID NO: 7905318 - DNA, 21 bp, Homo sapiens
cctttttgcttatggacagac

SEQ ID NO: 7905319 - DNA, 22 bp, Homo sapiens
cctttttctgagttgtagcttc

SEQ ID NO: 7905320 - DNA, 22 bp, Homo sapiens
cctttttctgagttgtagcttc

SEQ ID NO: 7905321 - DNA, 22 bp, Homo sapiens
cgaacacacttgggagttctga

SEQ ID NO: 7905322 - DNA, 22 bp, Homo sapiens
cgaaaatagatctgtttcccag

SEQ ID NO: 7905323 - DNA, 22 bp, Homo sapiens
cgaaaatagatctgtttcccag

SEQ ID NO: 7905324 - DNA, 22 bp, Homo sapiens
ccttttttctatgccaactctg

SEQ ID NO: 7905325 - DNA, 22 bp, Homo sapiens
ttatccaaactggtgaatcatt

SEQ ID NO: 7905326 - DNA, 22 bp, Homo sapiens
ttatccaagcagaagctgcaca

SEQ ID NO: 7905327 - DNA, 22 bp, Homo sapiens
ttatccaagcagaagctgcaca

SEQ ID NO: 7905328 - DNA, 22 bp, Homo sapiens
ttatcattgtcgcagtctaatt

SEQ ID NO: 7905329 - DNA, 22 bp, Homo sapiens
ccttttcccatgtttctggagc

SEQ ID NO: 7905330 - DNA, 22 bp, Homo sapiens
cctttggtaattctgtgtagag

SEQ ID NO: 7905331 - DNA, 22 bp, Homo sapiens
cctttggtaacattccaacctt

SEQ ID NO: 7905332 - DNA, 22 bp, Homo sapiens
cctttgggttcaatctcggtct

SEQ ID NO: 7905333 - DNA, 16 bp, Homo sapiens
ttatccaatcagttga

SEQ ID NO: 7905334 - DNA, 22 bp, Homo sapiens
ccttttctatccttctaggttc

SEQ ID NO: 7905335 - DNA, 22 bp, Homo sapiens
ccttttctatccttctaggttc

SEQ ID NO: 7905336 - DNA, 22 bp, Homo sapiens
ccttttctaggatgctttatag

SEQ ID NO: 7905337 - DNA, 22 bp, Homo sapiens
ccttttctatccttctaggttc

SEQ ID NO: 7905338 - DNA, 16 bp, Homo sapiens
ccttttctcatctcta

SEQ ID NO: 7905339 - DNA, 22 bp, Homo sapiens
ccttttctatgtaccagcagtg

SEQ ID NO: 7905340 - DNA, 22 bp, Homo sapiens
ccttttctatgtaccagcagtg

SEQ ID NO: 7905341 - DNA, 22 bp, Homo sapiens
ccttttctaggatgctttatag

SEQ ID NO: 7905342 - DNA, 22 bp, Homo sapiens
ccttttctagaaagggaggcaa

SEQ ID NO: 7905343 - DNA, 22 bp, Homo sapiens
ccttttctagaaagggaggcaa

SEQ ID NO: 7905344 - DNA, 22 bp, Homo sapiens
ccttttctaatcttaagaatgt

SEQ ID NO: 7905345 - DNA, 22 bp, Homo sapiens
ccttttctacaagcaaatgtgc

SEQ ID NO: 7905346 - DNA, 22 bp, Homo sapiens
ccttttctacaagcaaatgtgc

SEQ ID NO: 7905347 - DNA, 22 bp, Homo sapiens
ccttttcttgccactgactcgg

SEQ ID NO: 7905348 - DNA, 22 bp, Homo sapiens
ccttttctgtttcctgtcactg

SEQ ID NO: 7905349 - DNA, 22 bp, Homo sapiens
ccttttctgtttcctgtcactg

SEQ ID NO: 7905350 - DNA, 22 bp, Homo sapiens
ccttttcttgccactgactcgg

SEQ ID NO: 7905351 - DNA, 22 bp, Homo sapiens
ccttttcttgccactgactcgg

SEQ ID NO: 7905352 - DNA, 22 bp, Homo sapiens
ccttttcttgccactgactcgg

SEQ ID NO: 7905353 - DNA, 22 bp, Homo sapiens
ccttttgaaggtgttgttaagt

SEQ ID NO: 7905354 - DNA, 22 bp, Homo sapiens
ccttttgaaggtgttgttaagt

SEQ ID NO: 7905355 - DNA, 22 bp, Homo sapiens
ccttttgaaggtgttgttaagt

SEQ ID NO: 7905356 - DNA, 22 bp, Homo sapiens
ccttttgaggcttgggctcaga

SEQ ID NO: 7905357 - DNA, 22 bp, Homo sapiens
ccttttctgaaccacttaaata

SEQ ID NO: 7905358 - DNA, 22 bp, Homo sapiens
ccttttctggccaccaagcgct

SEQ ID NO: 7905359 - DNA, 22 bp, Homo sapiens
ccttttctgaaccacttaaata

SEQ ID NO: 7905360 - DNA, 22 bp, Homo sapiens
ccttttctgtgtgggtaattta

SEQ ID NO: 7905361 - DNA, 22 bp, Homo sapiens
cctttttctgagttgtagcttc

SEQ ID NO: 7905362 - DNA, 22 bp, Homo sapiens
ccttttgttggggtgtattcaa

SEQ ID NO: 7905363 - DNA, 22 bp, Homo sapiens
cctttttcaatatagaattgca

SEQ ID NO: 7905364 - DNA, 22 bp, Homo sapiens
ccttttgctctcccatccagaa

SEQ ID NO: 7905365 - DNA, 22 bp, Homo sapiens
ccttttgctctcccatccagaa

SEQ ID NO: 7905366 - DNA, 22 bp, Homo sapiens
ccttttgctctcccatccagaa

SEQ ID NO: 7905367 - DNA, 22 bp, Homo sapiens
ccttttggccaggtcagtgcag

SEQ ID NO: 7905368 - DNA, 22 bp, Homo sapiens
ccttttgtacacttactatata

SEQ ID NO: 7905369 - DNA, 22 bp, Homo sapiens
ccttttgtacacttactatata

SEQ ID NO: 7905370 - DNA, 22 bp, Homo sapiens
cggaggttgaggctgcagtgag

SEQ ID NO: 7905371 - DNA, 22 bp, Homo sapiens
cggaggttgaggctgcagtgag

SEQ ID NO: 7905372 - DNA, 22 bp, Homo sapiens
cggaggttgaggctgcagtgag

SEQ ID NO: 7905373 - DNA, 22 bp, Homo sapiens
cggagtcttgctatgttgccca

SEQ ID NO: 7905374 - DNA, 22 bp, Homo sapiens
cggagtcttgctatgttgccca

SEQ ID NO: 7905375 - DNA, 22 bp, Homo sapiens
cggagtcttgctatgttgccca

SEQ ID NO: 7905376 - DNA, 22 bp, Homo sapiens
cggagtgcctgtcatgcaggtt

SEQ ID NO: 7905377 - DNA, 22 bp, Homo sapiens
cggagtcttgctatgttgccca

SEQ ID NO: 7905378 - DNA, 22 bp, Homo sapiens
cggagtggggactggggtaatc

SEQ ID NO: 7905379 - DNA, 22 bp, Homo sapiens
cggagtcttgctatgttgccca

SEQ ID NO: 7905380 - DNA, 22 bp, Homo sapiens
cggagtcttgctatgttgccca

SEQ ID NO: 7905381 - DNA, 22 bp, Homo sapiens
ttcaaattaccacatttgctta

SEQ ID NO: 7905382 - DNA, 22 bp, Homo sapiens
cggagaggacctgcaactcgct

SEQ ID NO: 7905383 - DNA, 20 bp, Homo sapiens
cggactttcttctcagggca

SEQ ID NO: 7905384 - DNA, 22 bp, Homo sapiens
cggagaggtgggggcagcatct

SEQ ID NO: 7905385 - DNA, 22 bp, Homo sapiens
cggagaggtgggggcagcatct

SEQ ID NO: 7905386 - DNA, 22 bp, Homo sapiens
cggaggttgaggctgcagtgag

SEQ ID NO: 7905387 - DNA, 22 bp, Homo sapiens
ttcaaattaccacatttgctta

SEQ ID NO: 7905388 - DNA, 22 bp, Homo sapiens
ttcaaattaccacatttgctta

SEQ ID NO: 7905389 - DNA, 22 bp, Homo sapiens
ttcaaattaccacatttgctta

SEQ ID NO: 7905390 - DNA, 22 bp, Homo sapiens
ttcaaatggttagactgttagc

SEQ ID NO: 7905391 - DNA, 22 bp, Homo sapiens
ttcaaatgcaagttactacttt

SEQ ID NO: 7905392 - DNA, 22 bp, Homo sapiens
ttcaaatgcaagttactacttt

SEQ ID NO: 7905393 - DNA, 22 bp, Homo sapiens
ttcaaatgcaagttactacttt

SEQ ID NO: 7905394 - DNA, 22 bp, Homo sapiens
ttcaaatggttagactgttagc

SEQ ID NO: 7905395 - DNA, 22 bp, Homo sapiens
ttcaaatggttagactgttagc

SEQ ID NO: 7905396 - DNA, 22 bp, Homo sapiens
ttcaaagttgcatgacagctta

SEQ ID NO: 7905397 - DNA, 22 bp, Homo sapiens
ttcaaagttgcatgacagctta

SEQ ID NO: 7905398 - DNA, 22 bp, Homo sapiens
ttcaaagtttcaatctgtatca

SEQ ID NO: 7905399 - DNA, 22 bp, Homo sapiens
ttcaaagtgtgacctgacaagc

SEQ ID NO: 7905400 - DNA, 22 bp, Homo sapiens
ttcaaagttgcatgacagctta

SEQ ID NO: 7905401 - DNA, 22 bp, Homo sapiens
ttcaaagtgtgacctgacaagc

SEQ ID NO: 7905402 - DNA, 22 bp, Homo sapiens
ttcaaagtgtgacctgacaagc

SEQ ID NO: 7905403 - DNA, 20 bp, Homo sapiens
ttcaaagtgtatgatatgca

SEQ ID NO: 7905404 - DNA, 22 bp, Homo sapiens
ttcaaagtcctgtcaggtagcc

SEQ ID NO: 7905405 - DNA, 22 bp, Homo sapiens
ttcaaagtgcatgttcctcaga

SEQ ID NO: 7905406 - DNA, 22 bp, Homo sapiens
ttcaaagtgctgttcaaagtag

SEQ ID NO: 7905407 - DNA, 22 bp, Homo sapiens
ttcaaatacattctttgccact

SEQ ID NO: 7905408 - DNA, 21 bp, Homo sapiens
ttcaaagtttgcctaaagatt

SEQ ID NO: 7905409 - DNA, 22 bp, Homo sapiens
ttcaaatacattctttgccact

SEQ ID NO: 7905410 - DNA, 22 bp, Homo sapiens
ttcaaatctctcctaatccact

SEQ ID NO: 7905411 - DNA, 22 bp, Homo sapiens
ttcaaatgatggcagtcctggc

SEQ ID NO: 7905412 - DNA, 22 bp, Homo sapiens
ttcaaatgatggcagtcctggc

SEQ ID NO: 7905413 - DNA, 22 bp, Homo sapiens
ttcaaatccctgctccactatt

SEQ ID NO: 7905414 - DNA, 22 bp, Homo sapiens
ttcaaatcactttggagcttaa

SEQ ID NO: 7905415 - DNA, 22 bp, Homo sapiens
cggcagctgattgcagagcacc

SEQ ID NO: 7905416 - DNA, 22 bp, Homo sapiens
cggcaggacctcatttccttct

SEQ ID NO: 7905417 - DNA, 22 bp, Homo sapiens
cggcaggacctcatttccttct

SEQ ID NO: 7905418 - DNA, 22 bp, Homo sapiens
cggcagctgattgcagagcacc

SEQ ID NO: 7905419 - DNA, 22 bp, Homo sapiens
cggcagcatcgaaactacattc

SEQ ID NO: 7905420 - DNA, 22 bp, Homo sapiens
cggcagctccgcgccgtaggac

SEQ ID NO: 7905421 - DNA, 22 bp, Homo sapiens
cggcagctcgagggccacccgt

SEQ ID NO: 7905422 - DNA, 22 bp, Homo sapiens
cggcagggctccatgcatttct

SEQ ID NO: 7905423 - DNA, 22 bp, Homo sapiens
cggcaggacctcatttccttct

SEQ ID NO: 7905424 - DNA, 22 bp, Homo sapiens
cggcagggttggttttctctga

SEQ ID NO: 7905425 - DNA, 22 bp, Homo sapiens
cggcagagtgtgtgcgtgcatg

SEQ ID NO: 7905426 - DNA, 22 bp, Homo sapiens
cggcagagtgtgtgcgtgcatg

SEQ ID NO: 7905427 - DNA, 22 bp, Homo sapiens
cggcagcaaaggaagccaggtc

SEQ ID NO: 7905428 - DNA, 22 bp, Homo sapiens
cggcagcaaaggaagccaggtc

SEQ ID NO: 7905429 - DNA, 22 bp, Homo sapiens
cggcagcaaaggaagccaggtc

SEQ ID NO: 7905430 - DNA, 22 bp, Homo sapiens
cggcagcaaaggaagccaggtc

SEQ ID NO: 7905431 - DNA, 18 bp, Homo sapiens
cggcagagtgcttctagc

SEQ ID NO: 7905432 - DNA, 18 bp, Homo sapiens
cggcagagtgcttctagc

SEQ ID NO: 7905433 - DNA, 22 bp, Homo sapiens
cggatcctcagtcgtgcgggag

SEQ ID NO: 7905434 - DNA, 22 bp, Homo sapiens
cggatcatgtgacctttgagtg

SEQ ID NO: 7905435 - DNA, 22 bp, Homo sapiens
cggcacagccgggcaaggctgg

SEQ ID NO: 7905436 - DNA, 22 bp, Homo sapiens
cggcaaagaacgctttttcaga

SEQ ID NO: 7905437 - DNA, 18 bp, Homo sapiens
cggatcatgcgctgaggc

SEQ ID NO: 7905438 - DNA, 22 bp, Homo sapiens
cggagtggggactggggtaatc

SEQ ID NO: 7905439 - DNA, 22 bp, Homo sapiens
cggagttagggaattgcattct

SEQ ID NO: 7905440 - DNA, 22 bp, Homo sapiens
cggcacagccgggcaaggctgg

SEQ ID NO: 7905441 - DNA, 22 bp, Homo sapiens
cggcacagccgggcaaggctgg

SEQ ID NO: 7905442 - DNA, 22 bp, Homo sapiens
cggcacagccgggcaaggctgg

SEQ ID NO: 7905443 - DNA, 22 bp, Homo sapiens
cggcacagccgggcaaggctgg

SEQ ID NO: 7905444 - DNA, 23 bp, Homo sapiens
cggatttgactgaggtcctgcca

SEQ ID NO: 7905445 - DNA, 22 bp, Homo sapiens
cggcagagacggcgctttgaac

SEQ ID NO: 7905446 - DNA, 22 bp, Homo sapiens
cggcagagacggcgctttgaac

SEQ ID NO: 7905447 - DNA, 22 bp, Homo sapiens
cggcacagggtaaacgttaccc

SEQ ID NO: 7905448 - DNA, 22 bp, Homo sapiens
cggcagagcttcctgctcagcg

SEQ ID NO: 7905449 - DNA, 22 bp, Homo sapiens
cggcagagcttcctgctcagcg

SEQ ID NO: 7905450 - DNA, 22 bp, Homo sapiens
cggcagagcggcgagcccctcc

SEQ ID NO: 7905451 - DNA, 22 bp, Homo sapiens
cggcagagcggcgagcccctcc

SEQ ID NO: 7905452 - DNA, 22 bp, Homo sapiens
cggcagagccctgagtcagcct

SEQ ID NO: 7905453 - DNA, 22 bp, Homo sapiens
cggcagagccctgagtcagcct

SEQ ID NO: 7905454 - DNA, 22 bp, Homo sapiens
cggcagagccctgagtcagcct

SEQ ID NO: 7905455 - DNA, 22 bp, Homo sapiens
cgtgacagggtctggctggtca

SEQ ID NO: 7905456 - DNA, 21 bp, Homo sapiens
cgtgactgggtccgtctggct

SEQ ID NO: 7905457 - DNA, 21 bp, Homo sapiens
cgtgactgggtccgtctggct

SEQ ID NO: 7905458 - DNA, 21 bp, Homo sapiens
cgtgactgggtccgtctggct

SEQ ID NO: 7905459 - DNA, 22 bp, Homo sapiens
cgtggctggtggacctgagggc

SEQ ID NO: 7905460 - DNA, 22 bp, Homo sapiens
cgtggctggtggacctgagggc

SEQ ID NO: 7905461 - DNA, 22 bp, Homo sapiens
cgtggctggtggacctgagggc

SEQ ID NO: 7905462 - DNA, 22 bp, Homo sapiens
cgtgagcaaaatggacactccc

SEQ ID NO: 7905463 - DNA, 22 bp, Homo sapiens
cgtgagcaaaatggacactccc

SEQ ID NO: 7905464 - DNA, 22 bp, Homo sapiens
cggggctggcacaggtgaccac

SEQ ID NO: 7905465 - DNA, 22 bp, Homo sapiens
cggggctggcacaggtgaccac

SEQ ID NO: 7905466 - DNA, 22 bp, Homo sapiens
cggggctggcacaggtgaccac

SEQ ID NO: 7905467 - DNA, 21 bp, Homo sapiens
cgtgactgggtccgtctggct

SEQ ID NO: 7905468 - DNA, 22 bp, Homo sapiens
cgtgacagggtctggctggtca

SEQ ID NO: 7905469 - DNA, 22 bp, Homo sapiens
cggggctggcacaggtgaccac

SEQ ID NO: 7905470 - DNA, 22 bp, Homo sapiens
cgtgggtcgggactccgcctcg

SEQ ID NO: 7905471 - DNA, 22 bp, Homo sapiens
cgtggggcgggtggacacttgc

SEQ ID NO: 7905472 - DNA, 22 bp, Homo sapiens
cgtggtctcccacagaaagaag

SEQ ID NO: 7905473 - DNA, 22 bp, Homo sapiens
cgtgggtcgggactccgcctcg

SEQ ID NO: 7905474 - DNA, 22 bp, Homo sapiens
cgtgggccccagccactccctc

SEQ ID NO: 7905475 - DNA, 22 bp, Homo sapiens
cgtgggctgcgcccagttcttc

SEQ ID NO: 7905476 - DNA, 22 bp, Homo sapiens
cgtgggctgcgcccagttcttc

SEQ ID NO: 7905477 - DNA, 22 bp, Homo sapiens
cgtggggacccacgtgcagcac

SEQ ID NO: 7905478 - DNA, 22 bp, Homo sapiens
cgtggctggtggacctgagggc

SEQ ID NO: 7905479 - DNA, 22 bp, Homo sapiens
cgtgggaggaaaaatgggcttc

SEQ ID NO: 7905480 - DNA, 22 bp, Homo sapiens
cgtgggccccagccactccctc

SEQ ID NO: 7905481 - DNA, 22 bp, Homo sapiens
cggggctgcgctcttcctgccg

SEQ ID NO: 7905482 - DNA, 22 bp, Homo sapiens
cggggctgcgctcttcctgccg

SEQ ID NO: 7905483 - DNA, 22 bp, Homo sapiens
cggggctgcgctcttcctgccg

SEQ ID NO: 7905484 - DNA, 22 bp, Homo sapiens
cggggctgctcgtcctcctgtg

SEQ ID NO: 7905485 - DNA, 22 bp, Homo sapiens
cggggctgctcgtcctcctgtg

SEQ ID NO: 7905486 - DNA, 22 bp, Homo sapiens
cggggctgctcgtcctcctgtg

SEQ ID NO: 7905487 - DNA, 22 bp, Homo sapiens
cggggctgacagcaggtgtgct

SEQ ID NO: 7905488 - DNA, 22 bp, Homo sapiens
cggggctgaggcaacgcggaga

SEQ ID NO: 7905489 - DNA, 22 bp, Homo sapiens
cggggctgacagcaggtgtgct

SEQ ID NO: 7905490 - DNA, 22 bp, Homo sapiens
cggggctgacagcaggtgtgct

SEQ ID NO: 7905491 - DNA, 22 bp, Homo sapiens
cggggctgacagcaggtgtgct

SEQ ID NO: 7905492 - DNA, 22 bp, Homo sapiens
cggggctgacagcaggtgtgct

SEQ ID NO: 7905493 - DNA, 22 bp, Homo sapiens
cggggcctagtctacctcggca

SEQ ID NO: 7905494 - DNA, 22 bp, Homo sapiens
cggggcgagcagacggcggcaa

SEQ ID NO: 7905495 - DNA, 22 bp, Homo sapiens
cggggcgagcagacggcggcaa

SEQ ID NO: 7905496 - DNA, 22 bp, Homo sapiens
cggggcctgtgccagcctgtgg

SEQ ID NO: 7905497 - DNA, 22 bp, Homo sapiens
cggggccctggggctgaaggtc

SEQ ID NO: 7905498 - DNA, 22 bp, Homo sapiens
cggggccctggggctgaaggtc

SEQ ID NO: 7905499 - DNA, 22 bp, Homo sapiens
cggggccctggggctgaaggtc

SEQ ID NO: 7905500 - DNA, 22 bp, Homo sapiens
cggggccctggggctgaaggtc

SEQ ID NO: 7905501 - DNA, 22 bp, Homo sapiens
cggggccctggggctgaaggtc

SEQ ID NO: 7905502 - DNA, 22 bp, Homo sapiens
cggggcctaccgctgcgtggcc

SEQ ID NO: 7905503 - DNA, 22 bp, Homo sapiens
cggggccctggggctgaaggtc

SEQ ID NO: 7905504 - DNA, 22 bp, Homo sapiens
cggggccctggggctgaaggtc

SEQ ID NO: 7905505 - DNA, 22 bp, Homo sapiens
cggggccctggggctgaaggtc

SEQ ID NO: 7905506 - DNA, 22 bp, Homo sapiens
cggggccctggggctgaaggtc

SEQ ID NO: 7905507 - DNA, 22 bp, Homo sapiens
cggggccctggggctgaaggtc

SEQ ID NO: 7905508 - DNA, 22 bp, Homo sapiens
cggggccctggggctgaaggtc

SEQ ID NO: 7905509 - DNA, 23 bp, Homo sapiens
cggggccagggtcaggaccggtc

SEQ ID NO: 7905510 - DNA, 22 bp, Homo sapiens
cggggcaggagtccctgtagag

SEQ ID NO: 7905511 - DNA, 22 bp, Homo sapiens
cggggcaggagtccctgtagag

SEQ ID NO: 7905512 - DNA, 22 bp, Homo sapiens
cggggcaccgacctcctgccgc

SEQ ID NO: 7905513 - DNA, 22 bp, Homo sapiens
cggggcaccgacctcctgccgc

SEQ ID NO: 7905514 - DNA, 22 bp, Homo sapiens
cggggcagaaagttgtcttttg

SEQ ID NO: 7905515 - DNA, 22 bp, Homo sapiens
cggggcagaaagttgtcttttg

SEQ ID NO: 7905516 - DNA, 22 bp, Homo sapiens
cggggcagaaagttgtcttttg

SEQ ID NO: 7905517 - DNA, 22 bp, Homo sapiens
cggggagggcagaggctccctc

SEQ ID NO: 7905518 - DNA, 22 bp, Homo sapiens
cggggagggcagaggctccctc

SEQ ID NO: 7905519 - DNA, 22 bp, Homo sapiens
cggggcagagggtcttctccag

SEQ ID NO: 7905520 - DNA, 22 bp, Homo sapiens
cggggcaggagtccctgtagag

SEQ ID NO: 7905521 - DNA, 22 bp, Homo sapiens
cggggcaggagtccctgtagag

SEQ ID NO: 7905522 - DNA, 22 bp, Homo sapiens
cggggcagagggtcttctccag

SEQ ID NO: 7905523 - DNA, 22 bp, Homo sapiens
cggggcagagggtcttctccag

SEQ ID NO: 7905524 - DNA, 22 bp, Homo sapiens
cgggcaaggcgagactaggccc

SEQ ID NO: 7905525 - DNA, 22 bp, Homo sapiens
cgggcaaggcgagactaggccc

SEQ ID NO: 7905526 - DNA, 21 bp, Homo sapiens
cgggctggccgggccctcacc

SEQ ID NO: 7905527 - DNA, 22 bp, Homo sapiens
cgggcaaggcgagactaggccc

SEQ ID NO: 7905528 - DNA, 22 bp, Homo sapiens
cgggctggctgcagctgctgga

SEQ ID NO: 7905529 - DNA, 22 bp, Homo sapiens
cgggctggctgcagctgctgga

SEQ ID NO: 7905530 - DNA, 22 bp, Homo sapiens
cgggctggctgcagctgctgga

SEQ ID NO: 7905531 - DNA, 22 bp, Homo sapiens
cgggctggctgcagctgctgga

SEQ ID NO: 7905532 - DNA, 22 bp, Homo sapiens
cgggcaaggcgagactaggccc

SEQ ID NO: 7905533 - DNA, 22 bp, Homo sapiens
cgggctggctgcagctgctgga

SEQ ID NO: 7905534 - DNA, 22 bp, Homo sapiens
cgggctggctgcagctgctgga

SEQ ID NO: 7905535 - DNA, 22 bp, Homo sapiens
cgggctggctgcagctgctgga

SEQ ID NO: 7905536 - DNA, 22 bp, Homo sapiens
cgggctggctgcagctgctgga

SEQ ID NO: 7905537 - DNA, 22 bp, Homo sapiens
cgggctggctgcagctgctgga

SEQ ID NO: 7905538 - DNA, 22 bp, Homo sapiens
cggggaggcttcggattaaagc

SEQ ID NO: 7905539 - DNA, 22 bp, Homo sapiens
cggggaggcttcggattaaagc

SEQ ID NO: 7905540 - DNA, 22 bp, Homo sapiens
cggggaggcttcggattaaagc

SEQ ID NO: 7905541 - DNA, 22 bp, Homo sapiens
cggggagggcagaggctccctc

SEQ ID NO: 7905542 - DNA, 22 bp, Homo sapiens
cggggagggcagaggctccctc

SEQ ID NO: 7905543 - DNA, 22 bp, Homo sapiens
cggggagggcagaggctccctc

SEQ ID NO: 7905544 - DNA, 22 bp, Homo sapiens
cggggagggcagaggctccctc

SEQ ID NO: 7905545 - DNA, 22 bp, Homo sapiens
cggggagggcagaggctccctc

SEQ ID NO: 7905546 - DNA, 22 bp, Homo sapiens
cggggacacactggcagctcct

SEQ ID NO: 7905547 - DNA, 22 bp, Homo sapiens
cggggaagcggttctggcggta

SEQ ID NO: 7905548 - DNA, 22 bp, Homo sapiens
cggggaagcggttctggcggta

SEQ ID NO: 7905549 - DNA, 22 bp, Homo sapiens
cggggaagcggttctggcggta

SEQ ID NO: 7905550 - DNA, 22 bp, Homo sapiens
cggggaggcttcggattaaagc

SEQ ID NO: 7905551 - DNA, 22 bp, Homo sapiens
cggggacacactggcagctcct

SEQ ID NO: 7905552 - DNA, 22 bp, Homo sapiens
cccaccagccatctgagagtgt

SEQ ID NO: 7905553 - DNA, 22 bp, Homo sapiens
cccaccagccatctgagagtgt

SEQ ID NO: 7905554 - DNA, 22 bp, Homo sapiens
cccaccagccatctgagagtgt

SEQ ID NO: 7905555 - DNA, 22 bp, Homo sapiens
cccaccacgtgctttgctggag

SEQ ID NO: 7905556 - DNA, 23 bp, Homo sapiens
cccacatgtctgagtcagtgcca

SEQ ID NO: 7905557 - DNA, 22 bp, Homo sapiens
cccaccacgtgctttgctggag

SEQ ID NO: 7905558 - DNA, 22 bp, Homo sapiens
cccaccagtacagatggtagat

SEQ ID NO: 7905559 - DNA, 22 bp, Homo sapiens
cccaccagtacagatggtagat

SEQ ID NO: 7905560 - DNA, 22 bp, Homo sapiens
cccaccatgtgcccattggctt

SEQ ID NO: 7905561 - DNA, 22 bp, Homo sapiens
cccacccactctgaccagaagc

SEQ ID NO: 7905562 - DNA, 22 bp, Homo sapiens
cccacccagcctggctgagggg

SEQ ID NO: 7905563 - DNA, 21 bp, Homo sapiens
cccaccccataaggcagaacc

SEQ ID NO: 7905564 - DNA, 21 bp, Homo sapiens
cccaccccataaggcagaacc

SEQ ID NO: 7905565 - DNA, 21 bp, Homo sapiens
cccaccccataaggcagaacc

SEQ ID NO: 7905566 - DNA, 21 bp, Homo sapiens
cccaccccataaggcagaacc

SEQ ID NO: 7905567 - DNA, 21 bp, Homo sapiens
cccaccccataaggcagaacc

SEQ ID NO: 7905568 - DNA, 22 bp, Homo sapiens
tgcagagatagaactactttct

SEQ ID NO: 7905569 - DNA, 22 bp, Homo sapiens
cccacccctggacaggtgagtg

SEQ ID NO: 7905570 - DNA, 22 bp, Homo sapiens
cccacccagcctggctgagggg

SEQ ID NO: 7905571 - DNA, 22 bp, Homo sapiens
cccacccagcctggctgagggg

SEQ ID NO: 7905572 - DNA, 22 bp, Homo sapiens
tgcagaggtgaaagactagcaa

SEQ ID NO: 7905573 - DNA, 22 bp, Homo sapiens
tgcagaggtgaaagactagcaa

SEQ ID NO: 7905574 - DNA, 22 bp, Homo sapiens
tgcagaggtgaaagactagcaa

SEQ ID NO: 7905575 - DNA, 22 bp, Homo sapiens
tgcagaggtgaaagactagcaa

SEQ ID NO: 7905576 - DNA, 22 bp, Homo sapiens
tgcagaggtgaaagactagcaa

SEQ ID NO: 7905577 - DNA, 21 bp, Homo sapiens
tgcagagatatctgaagcaga

SEQ ID NO: 7905578 - DNA, 15 bp, Homo sapiens
tgcagaggtacctgg

SEQ ID NO: 7905579 - DNA, 15 bp, Homo sapiens
tgcagaggtacctgg

SEQ ID NO: 7905580 - DNA, 21 bp, Homo sapiens
tgcagagatatctgaagcaga

SEQ ID NO: 7905581 - DNA, 22 bp, Homo sapiens
tgcagaggtgttgctgagataa

SEQ ID NO: 7905582 - DNA, 22 bp, Homo sapiens
tgcagaggtgtgcattcttaag

SEQ ID NO: 7905583 - DNA, 22 bp, Homo sapiens
tgcagaggtgtgcattcttaag

SEQ ID NO: 7905584 - DNA, 22 bp, Homo sapiens
tgcagaggtgaaagactagcaa

SEQ ID NO: 7905585 - DNA, 22 bp, Homo sapiens
tgcagaggtgaaagactagcaa

SEQ ID NO: 7905586 - DNA, 22 bp, Homo sapiens
tgcagaggtttccaggcaagtt

SEQ ID NO: 7905587 - DNA, 22 bp, Homo sapiens
tgcagaggtttccaggcaagtt

SEQ ID NO: 7905588 - DNA, 22 bp, Homo sapiens
tgcagaggtttccaggcaagtt

SEQ ID NO: 7905589 - DNA, 22 bp, Homo sapiens
tgcagaggtttccaggcaagtt

SEQ ID NO: 7905590 - DNA, 22 bp, Homo sapiens
tgcagaggtttccaggcaagtt

SEQ ID NO: 7905591 - DNA, 22 bp, Homo sapiens
tgcagaggtttccaggcaagtt

SEQ ID NO: 7905592 - DNA, 22 bp, Homo sapiens
tgcagaggtgttgctgagataa

SEQ ID NO: 7905593 - DNA, 22 bp, Homo sapiens
tgcagaggtgttgctgagataa

SEQ ID NO: 7905594 - DNA, 22 bp, Homo sapiens
tgcagaggtgttgctgagataa

SEQ ID NO: 7905595 - DNA, 22 bp, Homo sapiens
tgcagaggtgttgctgagataa

SEQ ID NO: 7905596 - DNA, 22 bp, Homo sapiens
tgcagaggtgttgctgagataa

SEQ ID NO: 7905597 - DNA, 22 bp, Homo sapiens
tgcagaggtttccaggcaagtt

SEQ ID NO: 7905598 - DNA, 22 bp, Homo sapiens
cccacaggtggaagcctcggaa

SEQ ID NO: 7905599 - DNA, 22 bp, Homo sapiens
cccacaggtccccatgaactcg

SEQ ID NO: 7905600 - DNA, 22 bp, Homo sapiens
cccacaggtccccatgaactcg

SEQ ID NO: 7905601 - DNA, 22 bp, Homo sapiens
cccacaggtccccatgaactcg

SEQ ID NO: 7905602 - DNA, 22 bp, Homo sapiens
cccacaggtggaagcctcggaa

SEQ ID NO: 7905603 - DNA, 22 bp, Homo sapiens
cccacaggtggaagcctcggaa

SEQ ID NO: 7905604 - DNA, 22 bp, Homo sapiens
cccacaggtggaagcctcggaa

SEQ ID NO: 7905605 - DNA, 22 bp, Homo sapiens
cccacaggtggaagcctcggaa

SEQ ID NO: 7905606 - DNA, 22 bp, Homo sapiens
cccacaggtggaagcctcggaa

SEQ ID NO: 7905607 - DNA, 22 bp, Homo sapiens
cccacaggtggaagcctcggaa

SEQ ID NO: 7905608 - DNA, 22 bp, Homo sapiens
cccacaggtgtgagcttgctgg

SEQ ID NO: 7905609 - DNA, 22 bp, Homo sapiens
cccacaggtgtgagcttgctgg

SEQ ID NO: 7905610 - DNA, 22 bp, Homo sapiens
cccacagttaaccaaaggaatt

SEQ ID NO: 7905611 - DNA, 22 bp, Homo sapiens
cccacaggtgtgagcttgctgg

SEQ ID NO: 7905612 - DNA, 22 bp, Homo sapiens
cccacaggtgtgagcttgctgg

SEQ ID NO: 7905613 - DNA, 22 bp, Homo sapiens
cccacatctcacatcttggaac

SEQ ID NO: 7905614 - DNA, 22 bp, Homo sapiens
cccacatcccttccccgctgtg

SEQ ID NO: 7905615 - DNA, 22 bp, Homo sapiens
cccacaggctaggggtagggca

SEQ ID NO: 7905616 - DNA, 22 bp, Homo sapiens
cccacaggccctgctgccttga

SEQ ID NO: 7905617 - DNA, 22 bp, Homo sapiens
cccacaggctaggggtagggca

SEQ ID NO: 7905618 - DNA, 22 bp, Homo sapiens
cccacaggccctgctgccttga

SEQ ID NO: 7905619 - DNA, 22 bp, Homo sapiens
cccacaggctaggggtagggca

SEQ ID NO: 7905620 - DNA, 22 bp, Homo sapiens
cccacaggctaggggtagggca

SEQ ID NO: 7905621 - DNA, 22 bp, Homo sapiens
cccacagggctgctgatggcag

SEQ ID NO: 7905622 - DNA, 22 bp, Homo sapiens
cccacagggctgctgatggcag

SEQ ID NO: 7905623 - DNA, 22 bp, Homo sapiens
cccacagggctgctgatggcag

SEQ ID NO: 7905624 - DNA, 22 bp, Homo sapiens
cccacagggctgctgatggcag

SEQ ID NO: 7905625 - DNA, 22 bp, Homo sapiens
cccacagggctgctgatggcag

SEQ ID NO: 7905626 - DNA, 22 bp, Homo sapiens
cccacagggctgctgatggcag

SEQ ID NO: 7905627 - DNA, 22 bp, Homo sapiens
cccacaggcaggggcagagaca

SEQ ID NO: 7905628 - DNA, 22 bp, Homo sapiens
cccacaggcaggggcagagaca

SEQ ID NO: 7905629 - DNA, 19 bp, Homo sapiens
cccacaggaggacatatgg

SEQ ID NO: 7905630 - DNA, 22 bp, Homo sapiens
cccacaggcaggggcagagaca

SEQ ID NO: 7905631 - DNA, 22 bp, Homo sapiens
cccacagaatgccaatgagacc

SEQ ID NO: 7905632 - DNA, 22 bp, Homo sapiens
cccacagaatgccaatgagacc

SEQ ID NO: 7905633 - DNA, 22 bp, Homo sapiens
cccacaggacgggctaaagagt

SEQ ID NO: 7905634 - DNA, 22 bp, Homo sapiens
cccaagggtgcccagcagagga

SEQ ID NO: 7905635 - DNA, 20 bp, Homo sapiens
cccaaggtcacagctagcag

SEQ ID NO: 7905636 - DNA, 22 bp, Homo sapiens
cccacactctgagaaatgctga

SEQ ID NO: 7905637 - DNA, 22 bp, Homo sapiens
cccaagggtgcccagcagagga

SEQ ID NO: 7905638 - DNA, 22 bp, Homo sapiens
cccaagggtgcccagcagagga

SEQ ID NO: 7905639 - DNA, 22 bp, Homo sapiens
cccacaggccctgctgccttga

SEQ ID NO: 7905640 - DNA, 22 bp, Homo sapiens
cccacaggcaggtgcatgggct

SEQ ID NO: 7905641 - DNA, 22 bp, Homo sapiens
cccacaggcaggtgcatgggct

SEQ ID NO: 7905642 - DNA, 22 bp, Homo sapiens
cccacaggcaggtgcatgggct

SEQ ID NO: 7905643 - DNA, 22 bp, Homo sapiens
cccacaggccctgctgccttga

SEQ ID NO: 7905644 - DNA, 22 bp, Homo sapiens
cccacaggccctgctgccttga

SEQ ID NO: 7905645 - DNA, 22 bp, Homo sapiens
cccacaggcaggtgcatgggct

SEQ ID NO: 7905646 - DNA, 22 bp, Homo sapiens
cccacaggcaggtgcatgggct

SEQ ID NO: 7905647 - DNA, 22 bp, Homo sapiens
cccacaggcaggtgcatgggct

SEQ ID NO: 7905648 - DNA, 22 bp, Homo sapiens
cccacaggcaggtgcatgggct

SEQ ID NO: 7905649 - DNA, 22 bp, Homo sapiens
cccacaggcaggggcagagaca

SEQ ID NO: 7905650 - DNA, 22 bp, Homo sapiens
cccacaggcaggggcagagaca

SEQ ID NO: 7905651 - DNA, 22 bp, Homo sapiens
cccacaggcaggggcagagaca

SEQ ID NO: 7905652 - DNA, 22 bp, Homo sapiens
cccagcagccagaatgaggagc

SEQ ID NO: 7905653 - DNA, 22 bp, Homo sapiens
cccagcagccagaatgaggagc

SEQ ID NO: 7905654 - DNA, 22 bp, Homo sapiens
cccagcagccagaatgaggagc

SEQ ID NO: 7905655 - DNA, 22 bp, Homo sapiens
cccagcagccagaatgaggagc

SEQ ID NO: 7905656 - DNA, 22 bp, Homo sapiens
cccagcagccagaatgaggagc

SEQ ID NO: 7905657 - DNA, 22 bp, Homo sapiens
cccagcagccagaatgaggagc

SEQ ID NO: 7905658 - DNA, 22 bp, Homo sapiens
cccagcagccagaatgaggagc

SEQ ID NO: 7905659 - DNA, 22 bp, Homo sapiens
cccagcagccagaatgaggagc

SEQ ID NO: 7905660 - DNA, 22 bp, Homo sapiens
cccagcagccagaatgaggagc

SEQ ID NO: 7905661 - DNA, 22 bp, Homo sapiens
cccagcagccagaatgaggagc

SEQ ID NO: 7905662 - DNA, 22 bp, Homo sapiens
cccagcagccagaatgaggagc

SEQ ID NO: 7905663 - DNA, 22 bp, Homo sapiens
cccagcagccagaatgaggagc

SEQ ID NO: 7905664 - DNA, 23 bp, Homo sapiens
cccagcagattgtaaagtgtcca

SEQ ID NO: 7905665 - DNA, 23 bp, Homo sapiens
cccagcagattgtaaagtgtcca

SEQ ID NO: 7905666 - DNA, 23 bp, Homo sapiens
cccagcagattgtaaagtgtcca

SEQ ID NO: 7905667 - DNA, 23 bp, Homo sapiens
cccagcagattgtaaagtgtcca

SEQ ID NO: 7905668 - DNA, 22 bp, Homo sapiens
tgcagcagtcagtcaggcctgg

SEQ ID NO: 7905669 - DNA, 22 bp, Homo sapiens
tgcagcagtcagtcaggcctgg

SEQ ID NO: 7905670 - DNA, 22 bp, Homo sapiens
tgcagcagtcagtcaggcctgg

SEQ ID NO: 7905671 - DNA, 22 bp, Homo sapiens
tgcagcagtcagtcaggcctgg

SEQ ID NO: 7905672 - DNA, 22 bp, Homo sapiens
tgcagcagtcagtcaggcctgg

SEQ ID NO: 7905673 - DNA, 22 bp, Homo sapiens
tgcagcagtcagtcaggcctgg

SEQ ID NO: 7905674 - DNA, 22 bp, Homo sapiens
tgcagcagtgttccttggcttg

SEQ ID NO: 7905675 - DNA, 22 bp, Homo sapiens
tgcagcaggtatggcaagctcc

SEQ ID NO: 7905676 - DNA, 22 bp, Homo sapiens
tgcagcaggtatggcaagctcc

SEQ ID NO: 7905677 - DNA, 22 bp, Homo sapiens
tgcagcaggtatggcaagctcc

SEQ ID NO: 7905678 - DNA, 22 bp, Homo sapiens
tgcagcaggttccaaagggtta

SEQ ID NO: 7905679 - DNA, 22 bp, Homo sapiens
tgcagcaggttccaaagggtta

SEQ ID NO: 7905680 - DNA, 22 bp, Homo sapiens
cccagcagaatctgatgagggc

SEQ ID NO: 7905681 - DNA, 22 bp, Homo sapiens
cccagcagaatctgatgagggc

SEQ ID NO: 7905682 - DNA, 22 bp, Homo sapiens
cccagcagaatctgatgagggc

SEQ ID NO: 7905683 - DNA, 22 bp, Homo sapiens
cccagcagaatctgatgagggc

SEQ ID NO: 7905684 - DNA, 22 bp, Homo sapiens
cccagcagaatctgatgagggc

SEQ ID NO: 7905685 - DNA, 22 bp, Homo sapiens
cccagcagaatctgatgagggc

SEQ ID NO: 7905686 - DNA, 22 bp, Homo sapiens
cccagcagaatctgatgagggc

SEQ ID NO: 7905687 - DNA, 22 bp, Homo sapiens
cccagcactttgaatatgtcac

SEQ ID NO: 7905688 - DNA, 22 bp, Homo sapiens
cccagcactttgaatatgtcac

SEQ ID NO: 7905689 - DNA, 18 bp, Homo sapiens
cccagcactttgggagcc

SEQ ID NO: 7905690 - DNA, 22 bp, Homo sapiens
cccagcagaatctgatgagggc

SEQ ID NO: 7905691 - DNA, 22 bp, Homo sapiens
cccagcagaatctgatgagggc

SEQ ID NO: 7905692 - DNA, 18 bp, Homo sapiens
cccagcactttgggagcc

SEQ ID NO: 7905693 - DNA, 23 bp, Homo sapiens
cccagcagagatgaggaggggtc

SEQ ID NO: 7905694 - DNA, 23 bp, Homo sapiens
cccagcagagatgaggaggggtc

SEQ ID NO: 7905695 - DNA, 22 bp, Homo sapiens
cccagcagaccgctgtgatggc

SEQ ID NO: 7905696 - DNA, 23 bp, Homo sapiens
cccagcagagatgaggaggggtc

SEQ ID NO: 7905697 - DNA, 22 bp, Homo sapiens
cccagcagaccgctgtgatggc

SEQ ID NO: 7905698 - DNA, 22 bp, Homo sapiens
cccagcagaccgctgtgatggc

SEQ ID NO: 7905699 - DNA, 22 bp, Homo sapiens
cccagcagaccgctgtgatggc

SEQ ID NO: 7905700 - DNA, 22 bp, Homo sapiens
cccagcagaccgctgtgatggc

SEQ ID NO: 7905701 - DNA, 22 bp, Homo sapiens
cccagcagaccgctgtgatggc

SEQ ID NO: 7905702 - DNA, 22 bp, Homo sapiens
cccagcagatggctatgtgcta

SEQ ID NO: 7905703 - DNA, 22 bp, Homo sapiens
cccagcagatggctatgtgcta

SEQ ID NO: 7905704 - DNA, 22 bp, Homo sapiens
cccagcagatggctatgtgcta

SEQ ID NO: 7905705 - DNA, 22 bp, Homo sapiens
cccagcagatggctatgtgcta

SEQ ID NO: 7905706 - DNA, 23 bp, Homo sapiens
cccagcagagatgaggaggggtc

SEQ ID NO: 7905707 - DNA, 23 bp, Homo sapiens
cccagcagagatgaggaggggtc

SEQ ID NO: 7905708 - DNA, 23 bp, Homo sapiens
cccagcagagatgaggaggggtc

SEQ ID NO: 7905709 - DNA, 22 bp, Homo sapiens
cccagagagcacaggtggtggg

SEQ ID NO: 7905710 - DNA, 22 bp, Homo sapiens
cccagagagcatttggacaaag

SEQ ID NO: 7905711 - DNA, 22 bp, Homo sapiens
cccagagagcatttggacaaag

SEQ ID NO: 7905712 - DNA, 22 bp, Homo sapiens
cccagagagcatttggacaaag

SEQ ID NO: 7905713 - DNA, 22 bp, Homo sapiens
cccagagaggtaaaacagcctt

SEQ ID NO: 7905714 - DNA, 22 bp, Homo sapiens
cccagagaggtaaaacagcctt

SEQ ID NO: 7905715 - DNA, 22 bp, Homo sapiens
cccagagagctttctttgtgct

SEQ ID NO: 7905716 - DNA, 22 bp, Homo sapiens
cccagagatctactgagcccag

SEQ ID NO: 7905717 - DNA, 22 bp, Homo sapiens
cccagagaggtaaaacagcctt

SEQ ID NO: 7905718 - DNA, 22 bp, Homo sapiens
cccagagaattccacatagagg

SEQ ID NO: 7905719 - DNA, 22 bp, Homo sapiens
cccagagaattccacatagagg

SEQ ID NO: 7905720 - DNA, 22 bp, Homo sapiens
cccagagactttgtccgacgac

SEQ ID NO: 7905721 - DNA, 22 bp, Homo sapiens
cccagagactttgtccgacgac

SEQ ID NO: 7905722 - DNA, 22 bp, Homo sapiens
cccagagaattccacatagagg

SEQ ID NO: 7905723 - DNA, 22 bp, Homo sapiens
cccagagactttgtccgacgac

SEQ ID NO: 7905724 - DNA, 22 bp, Homo sapiens
cccagagagcacaggtggtggg

SEQ ID NO: 7905725 - DNA, 19 bp, Homo sapiens
cccagagagatctcttgcc

SEQ ID NO: 7905726 - DNA, 19 bp, Homo sapiens
cccagagagatctcttgcc

SEQ ID NO: 7905727 - DNA, 19 bp, Homo sapiens
cccagagagatctcttgcc

SEQ ID NO: 7905728 - DNA, 22 bp, Homo sapiens
cccagcactcagcaggctcata

SEQ ID NO: 7905729 - DNA, 22 bp, Homo sapiens
cccagaggtgaaggaggtggga

SEQ ID NO: 7905730 - DNA, 22 bp, Homo sapiens
cccagagatcttgtcctttcca

SEQ ID NO: 7905731 - DNA, 17 bp, Homo sapiens
cccagagatgctgcctt

SEQ ID NO: 7905732 - DNA, 22 bp, Homo sapiens
cccagagatcttgtcctttcca

SEQ ID NO: 7905733 - DNA, 22 bp, Homo sapiens
cccagagatcttgtcctttcca

SEQ ID NO: 7905734 - DNA, 22 bp, Homo sapiens
cccagagatctactgagcccag

SEQ ID NO: 7905735 - DNA, 22 bp, Homo sapiens
cccagagatctactgagcccag

SEQ ID NO: 7905736 - DNA, 22 bp, Homo sapiens
cccagagatctactgagcccag

SEQ ID NO: 7905737 - DNA, 17 bp, Homo sapiens
cccagagatgctgcctt

SEQ ID NO: 7905738 - DNA, 22 bp, Homo sapiens
cccagagggtggaggttgcagt

SEQ ID NO: 7905739 - DNA, 22 bp, Homo sapiens
cccagagggtggaggttgcagt

SEQ ID NO: 7905740 - DNA, 22 bp, Homo sapiens
cccagagaatctttcagaaagg

SEQ ID NO: 7905741 - DNA, 22 bp, Homo sapiens
cccagagaatctttcagaaagg

SEQ ID NO: 7905742 - DNA, 22 bp, Homo sapiens
cccagagaagtgaagtgacttg

SEQ ID NO: 7905743 - DNA, 22 bp, Homo sapiens
cccagagaattccacatagagg

SEQ ID NO: 7905744 - DNA, 22 bp, Homo sapiens
cccagagaattccacatagagg

SEQ ID NO: 7905745 - DNA, 22 bp, Homo sapiens
cccagagaatctttcagaaagg

SEQ ID NO: 7905746 - DNA, 22 bp, Homo sapiens
cccagagaagtgaagtgacttg

SEQ ID NO: 7905747 - DNA, 22 bp, Homo sapiens
cccagagaagtgaagtgacttg

SEQ ID NO: 7905748 - DNA, 22 bp, Homo sapiens
cccagagaaccttctgtgccac

SEQ ID NO: 7905749 - DNA, 22 bp, Homo sapiens
cccagagaaccttctgtgccac

SEQ ID NO: 7905750 - DNA, 22 bp, Homo sapiens
cccagagaaccttctgtgccac

SEQ ID NO: 7905751 - DNA, 22 bp, Homo sapiens
cccagagaaccttctgtgccac

SEQ ID NO: 7905752 - DNA, 22 bp, Homo sapiens
tgcagaggtttgtggtgttgct

SEQ ID NO: 7905753 - DNA, 22 bp, Homo sapiens
tgcagaggtttgtggtgttgct

SEQ ID NO: 7905754 - DNA, 22 bp, Homo sapiens
tgcagaggtttgtggtgttgct

SEQ ID NO: 7905755 - DNA, 22 bp, Homo sapiens
tgcagaggtttgtggtgttgct

SEQ ID NO: 7905756 - DNA, 22 bp, Homo sapiens
tgcagaggtttccaggcaagtt

SEQ ID NO: 7905757 - DNA, 22 bp, Homo sapiens
tgcagaggtttttaatacattt

SEQ ID NO: 7905758 - DNA, 22 bp, Homo sapiens
tgcagaggtttttaatacattt

SEQ ID NO: 7905759 - DNA, 22 bp, Homo sapiens
tgcagagtaaaagcagatgcta

SEQ ID NO: 7905760 - DNA, 22 bp, Homo sapiens
tgcagagtaaaagcagatgcta

SEQ ID NO: 7905761 - DNA, 22 bp, Homo sapiens
tgatacataaaccatcattttg

SEQ ID NO: 7905762 - DNA, 22 bp, Homo sapiens
tgatacagtcagctcacaattg

SEQ ID NO: 7905763 - DNA, 22 bp, Homo sapiens
tgatacagtcagctcacaattg

SEQ ID NO: 7905764 - DNA, 21 bp, Homo sapiens
tgatacaggaatggttctatg

SEQ ID NO: 7905765 - DNA, 22 bp, Homo sapiens
tgaggcagtgctgggaagcctg

SEQ ID NO: 7905766 - DNA, 22 bp, Homo sapiens
tgaggcagtgctgggaagcctg

SEQ ID NO: 7905767 - DNA, 22 bp, Homo sapiens
tgaggcagtgctgggaagcctg

SEQ ID NO: 7905768 - DNA, 22 bp, Homo sapiens
tgaggcagtgatgtttaagcac

SEQ ID NO: 7905769 - DNA, 18 bp, Homo sapiens
tgaggcagtcagtgatgg

SEQ ID NO: 7905770 - DNA, 16 bp, Homo sapiens
tgatgacagatatggc

SEQ ID NO: 7905771 - DNA, 22 bp, Homo sapiens
tgatgacagcaaaaaatgctag

SEQ ID NO: 7905772 - DNA, 22 bp, Homo sapiens
tgatgacagtgttacagctcca

SEQ ID NO: 7905773 - DNA, 22 bp, Homo sapiens
tgatgacagcatggaccccagg

SEQ ID NO: 7905774 - DNA, 22 bp, Homo sapiens
tgatgacaggcagggttaagtg

SEQ ID NO: 7905775 - DNA, 22 bp, Homo sapiens
tgatgacagcatggaccccagg

SEQ ID NO: 7905776 - DNA, 22 bp, Homo sapiens
tgatgacaggcagggttaagtg

SEQ ID NO: 7905777 - DNA, 22 bp, Homo sapiens
tgatgacagtgttacagctcca

SEQ ID NO: 7905778 - DNA, 22 bp, Homo sapiens
tgatgaattagtaacaaatgag

SEQ ID NO: 7905779 - DNA, 22 bp, Homo sapiens
tgatacataaaccatcattttg

SEQ ID NO: 7905780 - DNA, 22 bp, Homo sapiens
tgatgaattggaaattctgatt

SEQ ID NO: 7905781 - DNA, 22 bp, Homo sapiens
tgatgacaaactttcctgatgc

SEQ ID NO: 7905782 - DNA, 22 bp, Homo sapiens
tgatgacaaactttcctgatgc

SEQ ID NO: 7905783 - DNA, 22 bp, Homo sapiens
tgatgacaatgttgctgcaata

SEQ ID NO: 7905784 - DNA, 22 bp, Homo sapiens
tgatgactgccattctattact

SEQ ID NO: 7905785 - DNA, 22 bp, Homo sapiens
tgatgagagaggtcattgaaat

SEQ ID NO: 7905786 - DNA, 22 bp, Homo sapiens
tgatgaggacccatcacctggt

SEQ ID NO: 7905787 - DNA, 22 bp, Homo sapiens
tgatgaggacctggtctctgct

SEQ ID NO: 7905788 - DNA, 22 bp, Homo sapiens
tgatgaccgccaacgtttaggt

SEQ ID NO: 7905789 - DNA, 22 bp, Homo sapiens
tgatgaccgccaacgtttaggt

SEQ ID NO: 7905790 - DNA, 22 bp, Homo sapiens
tgatgaccgccaacgtttaggt

SEQ ID NO: 7905791 - DNA, 22 bp, Homo sapiens
tgatgaggcatatgctacacat

SEQ ID NO: 7905792 - DNA, 22 bp, Homo sapiens
ccatggaagaactgatgtgcca

SEQ ID NO: 7905793 - DNA, 22 bp, Homo sapiens
tgatgaggtggattcaaagcag

SEQ ID NO: 7905794 - DNA, 19 bp, Homo sapiens
ccatggagagagatgcatt

SEQ ID NO: 7905795 - DNA, 18 bp, Homo sapiens
tgaggcagtcagtgatgg

SEQ ID NO: 7905796 - DNA, 18 bp, Homo sapiens
tgaggcagtcagtgatgg

SEQ ID NO: 7905797 - DNA, 18 bp, Homo sapiens
tgaggcagtcagtgatgg

SEQ ID NO: 7905798 - DNA, 22 bp, Homo sapiens
tgaggcagtcaccccctcctgc

SEQ ID NO: 7905799 - DNA, 22 bp, Homo sapiens
tgaggcagtattttagtgactt

SEQ ID NO: 7905800 - DNA, 22 bp, Homo sapiens
tgaggcagtattttagtgactt

SEQ ID NO: 7905801 - DNA, 21 bp, Homo sapiens
tgaggcaggggtgcttttgtc

SEQ ID NO: 7905802 - DNA, 22 bp, Homo sapiens
tgaggcaggtaagcaagttttg

SEQ ID NO: 7905803 - DNA, 22 bp, Homo sapiens
tgaggcagtattctccattcca

SEQ ID NO: 7905804 - DNA, 22 bp, Homo sapiens
tgaggcaggtggattacaaggt

SEQ ID NO: 7905805 - DNA, 22 bp, Homo sapiens
tgaggcagtattctccattcca

SEQ ID NO: 7905806 - DNA, 23 bp, Homo sapiens
ccagtgtggctctgtccgctctc

SEQ ID NO: 7905807 - DNA, 22 bp, Homo sapiens
ccagtgtggccaggtgctggta

SEQ ID NO: 7905808 - DNA, 22 bp, Homo sapiens
ccagtgtggccaggtcttctgg

SEQ ID NO: 7905809 - DNA, 23 bp, Homo sapiens
ccagtgtggctctgtccgctctc

SEQ ID NO: 7905810 - DNA, 22 bp, Homo sapiens
ccagtgtgggcccggcctcctc

SEQ ID NO: 7905811 - DNA, 22 bp, Homo sapiens
ccagtgtgggctggtggaggac

SEQ ID NO: 7905812 - DNA, 23 bp, Homo sapiens
ccagtgtggctctgtccgctctc

SEQ ID NO: 7905813 - DNA, 22 bp, Homo sapiens
ccagtgtggtaggtccacaggt

SEQ ID NO: 7905814 - DNA, 22 bp, Homo sapiens
ccagtgtgggctggtggaggac

SEQ ID NO: 7905815 - DNA, 22 bp, Homo sapiens
ccagtgtgttagtggatttccc

SEQ ID NO: 7905816 - DNA, 22 bp, Homo sapiens
ccagtgtggtttaggataggga

SEQ ID NO: 7905817 - DNA, 23 bp, Homo sapiens
ccagtgtggtaggtccacaggtg

SEQ ID NO: 7905818 - DNA, 22 bp, Homo sapiens
ccagtgtggtttaggataggga

SEQ ID NO: 7905819 - DNA, 23 bp, Homo sapiens
ccagtgtggtaggtccacaggtg

SEQ ID NO: 7905820 - DNA, 22 bp, Homo sapiens
ccagtgtggtaggtccacaggt

SEQ ID NO: 7905821 - DNA, 23 bp, Homo sapiens
ccagtgtggtaggtccacaggtg

SEQ ID NO: 7905822 - DNA, 22 bp, Homo sapiens
ccagtgtggtaggtccacaggt

SEQ ID NO: 7905823 - DNA, 22 bp, Homo sapiens
ccagtgttcaatacatatttgt

SEQ ID NO: 7905824 - DNA, 22 bp, Homo sapiens
ccagtgttagagactgatacag

SEQ ID NO: 7905825 - DNA, 22 bp, Homo sapiens
ccagtgttattttagagtgtga

SEQ ID NO: 7905826 - DNA, 22 bp, Homo sapiens
ccagtgttcataattttacact

SEQ ID NO: 7905827 - DNA, 22 bp, Homo sapiens
ccagtgttcatcaagaaaatgt

SEQ ID NO: 7905828 - DNA, 22 bp, Homo sapiens
ccagtgtgtttttctctgactc

SEQ ID NO: 7905829 - DNA, 22 bp, Homo sapiens
ccagtgttacggcttgaactat

SEQ ID NO: 7905830 - DNA, 22 bp, Homo sapiens
ccagtgtgtttttctctgactc

SEQ ID NO: 7905831 - DNA, 22 bp, Homo sapiens
ccagtgtgtttttctctgactc

SEQ ID NO: 7905832 - DNA, 22 bp, Homo sapiens
ccagtgtgtttaatgcattcca

SEQ ID NO: 7905833 - DNA, 22 bp, Homo sapiens
ccagtgtgttccctgcctcact

SEQ ID NO: 7905834 - DNA, 22 bp, Homo sapiens
ccagtgtgttccctgcctcact

SEQ ID NO: 7905835 - DNA, 22 bp, Homo sapiens
ccatggccgccgctgctcagga

SEQ ID NO: 7905836 - DNA, 22 bp, Homo sapiens
ccatggccgccgctgctcagga

SEQ ID NO: 7905837 - DNA, 22 bp, Homo sapiens
ccatggccgccgctgctcagga

SEQ ID NO: 7905838 - DNA, 22 bp, Homo sapiens
ccattgtaaattctgtggaagt

SEQ ID NO: 7905839 - DNA, 19 bp, Homo sapiens
ccattgtttgttgcccaag

SEQ ID NO: 7905840 - DNA, 18 bp, Homo sapiens
ccattgtcctgaggatcc

SEQ ID NO: 7905841 - DNA, 22 bp, Homo sapiens
ccattgtttatttagacttaat

SEQ ID NO: 7905842 - DNA, 22 bp, Homo sapiens
ccatttttaaagagcttaagta

SEQ ID NO: 7905843 - DNA, 22 bp, Homo sapiens
ccatttttcacaagactcactt

SEQ ID NO: 7905844 - DNA, 22 bp, Homo sapiens
ccatttttcacaagactcactt

SEQ ID NO: 7905845 - DNA, 22 bp, Homo sapiens
ccatttttaaagagcttaagta

SEQ ID NO: 7905846 - DNA, 22 bp, Homo sapiens
ccatttttaaagagcttaagta

SEQ ID NO: 7905847 - DNA, 22 bp, Homo sapiens
ccatttttcataaactatccaa

SEQ ID NO: 7905848 - DNA, 22 bp, Homo sapiens
ccatttttcacaagactcactt

SEQ ID NO: 7905849 - DNA, 22 bp, Homo sapiens
cccaaaatgtgcatgttcgaat

SEQ ID NO: 7905850 - DNA, 22 bp, Homo sapiens
ccatttttgacagaaggcctaa

SEQ ID NO: 7905851 - DNA, 22 bp, Homo sapiens
ccatttttcataaactatccaa

SEQ ID NO: 7905852 - DNA, 22 bp, Homo sapiens
cccaaaggataaggtaagaatg

SEQ ID NO: 7905853 - DNA, 22 bp, Homo sapiens
ccatggcattttatgtgtctta

SEQ ID NO: 7905854 - DNA, 22 bp, Homo sapiens
ccatggcagccatgggagccac

SEQ ID NO: 7905855 - DNA, 22 bp, Homo sapiens
ccatggcagccatgggagccac

SEQ ID NO: 7905856 - DNA, 22 bp, Homo sapiens
ccatggcagcctggcctggctt

SEQ ID NO: 7905857 - DNA, 22 bp, Homo sapiens
ccatggcagcctggcctggctt

SEQ ID NO: 7905858 - DNA, 22 bp, Homo sapiens
ccatggcattttatgtgtctta

SEQ ID NO: 7905859 - DNA, 23 bp, Homo sapiens
ccatggccaatgtcaagctacta

SEQ ID NO: 7905860 - DNA, 20 bp, Homo sapiens
ccatggccacatctgtgctg

SEQ ID NO: 7905861 - DNA, 20 bp, Homo sapiens
ccatggccacatctgtgctg

SEQ ID NO: 7905862 - DNA, 19 bp, Homo sapiens
ccatggcaatgatctgatg

SEQ ID NO: 7905863 - DNA, 19 bp, Homo sapiens
ccatggcaatgatctgatg

SEQ ID NO: 7905864 - DNA, 22 bp, Homo sapiens
ccatggcaactggcgtccaggg

SEQ ID NO: 7905865 - DNA, 22 bp, Homo sapiens
ccatggcaactggcgtccaggg

SEQ ID NO: 7905866 - DNA, 22 bp, Homo sapiens
ccatggcaaaggagatgttttc

SEQ ID NO: 7905867 - DNA, 22 bp, Homo sapiens
ccatggcaactggcgtccaggg

SEQ ID NO: 7905868 - DNA, 22 bp, Homo sapiens
ccatggcaatggtcagtctatt

SEQ ID NO: 7905869 - DNA, 22 bp, Homo sapiens
ccatggcagccatgggagccac

SEQ ID NO: 7905870 - DNA, 22 bp, Homo sapiens
ccatggcaatggtcagtctatt

SEQ ID NO: 7905871 - DNA, 22 bp, Homo sapiens
ccatggcaatggtcagtctatt

SEQ ID NO: 7905872 - DNA, 22 bp, Homo sapiens
ccatggcaatggtaaactgaca

SEQ ID NO: 7905873 - DNA, 22 bp, Homo sapiens
ccatggcaatggtcagtctatt

SEQ ID NO: 7905874 - DNA, 22 bp, Homo sapiens
ccatggagttcctctggtctat

SEQ ID NO: 7905875 - DNA, 22 bp, Homo sapiens
ccatggagttcctctggtctat

SEQ ID NO: 7905876 - DNA, 22 bp, Homo sapiens
ccatggcaaaggagatgttttc

SEQ ID NO: 7905877 - DNA, 22 bp, Homo sapiens
ccatggagcgggtgagtgagtg

SEQ ID NO: 7905878 - DNA, 22 bp, Homo sapiens
ccatggagcgggtgagtgagtg

SEQ ID NO: 7905879 - DNA, 22 bp, Homo sapiens
ccatggagcgggtgagtgagtg

SEQ ID NO: 7905880 - DNA, 23 bp, Homo sapiens
ccatggagcatggctcactaggc

SEQ ID NO: 7905881 - DNA, 22 bp, Homo sapiens
tgattatattctaacttcataa

SEQ ID NO: 7905882 - DNA, 22 bp, Homo sapiens
tgattatattctaacttcataa

SEQ ID NO: 7905883 - DNA, 22 bp, Homo sapiens
tgattagattgagtcaaccttg

SEQ ID NO: 7905884 - DNA, 22 bp, Homo sapiens
tgattagattgagtcaaccttg

SEQ ID NO: 7905885 - DNA, 22 bp, Homo sapiens
tgattatattaactatgttcct

SEQ ID NO: 7905886 - DNA, 22 bp, Homo sapiens
tgattatattctaacttcataa

SEQ ID NO: 7905887 - DNA, 22 bp, Homo sapiens
tgattatcttttactgccagag

SEQ ID NO: 7905888 - DNA, 22 bp, Homo sapiens
tgattacattggtaatgtttat

SEQ ID NO: 7905889 - DNA, 22 bp, Homo sapiens
tgattacattggtaatgtttat

SEQ ID NO: 7905890 - DNA, 22 bp, Homo sapiens
tgattagacaaaggaatcatgc

SEQ ID NO: 7905891 - DNA, 22 bp, Homo sapiens
tgattagacaaaggaatcatgc

SEQ ID NO: 7905892 - DNA, 22 bp, Homo sapiens
tgattacagtatttgagatcca

SEQ ID NO: 7905893 - DNA, 22 bp, Homo sapiens
tgattacagtctgacagatgtt

SEQ ID NO: 7905894 - DNA, 23 bp, Homo sapiens
tgattacaggaagttcaagtgtt

SEQ ID NO: 7905895 - DNA, 22 bp, Homo sapiens
tgattacagtatttgagatcca

SEQ ID NO: 7905896 - DNA, 22 bp, Homo sapiens
tgattacacagcagtaatttca

SEQ ID NO: 7905897 - DNA, 22 bp, Homo sapiens
tgattacactatttgggaatag

SEQ ID NO: 7905898 - DNA, 22 bp, Homo sapiens
tgattacacagcagtaatttca

SEQ ID NO: 7905899 - DNA, 22 bp, Homo sapiens
cccaagaggtggaggttgcagt

SEQ ID NO: 7905900 - DNA, 22 bp, Homo sapiens
cccaagagcttctaggacgctg

SEQ ID NO: 7905901 - DNA, 22 bp, Homo sapiens
cccaagagatcgcatgtagttg

SEQ ID NO: 7905902 - DNA, 19 bp, Homo sapiens
cccaacttgactattttct

SEQ ID NO: 7905903 - DNA, 22 bp, Homo sapiens
cccaagccagaccctgaccctg

SEQ ID NO: 7905904 - DNA, 22 bp, Homo sapiens
tgattacacaccacagtgctcc

SEQ ID NO: 7905905 - DNA, 22 bp, Homo sapiens
cccaagcagggtgcagaggcat

SEQ ID NO: 7905906 - DNA, 22 bp, Homo sapiens
cccaagcagggtgcagaggcat

SEQ ID NO: 7905907 - DNA, 22 bp, Homo sapiens
cccaagcagggtgcagaggcat

SEQ ID NO: 7905908 - DNA, 22 bp, Homo sapiens
cccaagcagggtgcagaggcat

SEQ ID NO: 7905909 - DNA, 22 bp, Homo sapiens
cccaaccagaaattgacagaca

SEQ ID NO: 7905910 - DNA, 22 bp, Homo sapiens
cccaaccagaaattgacagaga

SEQ ID NO: 7905911 - DNA, 22 bp, Homo sapiens
cccaaccagaaattgacagaca

SEQ ID NO: 7905912 - DNA, 22 bp, Homo sapiens
cccaaccagaaattgacagaga

SEQ ID NO: 7905913 - DNA, 21 bp, Homo sapiens
cccaacccatttccagttcat

SEQ ID NO: 7905914 - DNA, 22 bp, Homo sapiens
cccaaccccaacttcctatgtt

SEQ ID NO: 7905915 - DNA, 22 bp, Homo sapiens
cccaactactctcaggcagctt

SEQ ID NO: 7905916 - DNA, 19 bp, Homo sapiens
cccaactggatccatcata

SEQ ID NO: 7905917 - DNA, 22 bp, Homo sapiens
cccaaccccaacttcctatgtt

SEQ ID NO: 7905918 - DNA, 22 bp, Homo sapiens
cccaacaacatgaaactaccta

SEQ ID NO: 7905919 - DNA, 22 bp, Homo sapiens
cccaacactcacctccggatta

SEQ ID NO: 7905920 - DNA, 22 bp, Homo sapiens
cccaaagggtgtcagcagcaag

SEQ ID NO: 7905921 - DNA, 22 bp, Homo sapiens
cccaaagggcttcctgttctca

SEQ ID NO: 7905922 - DNA, 22 bp, Homo sapiens
cccaaagggtgtcagcagcaag

SEQ ID NO: 7905923 - DNA, 22 bp, Homo sapiens
cccaaaggttgaggctgcagtg

SEQ ID NO: 7905924 - DNA, 22 bp, Homo sapiens
cccaaaggttgaggctgcagtg

SEQ ID NO: 7905925 - DNA, 22 bp, Homo sapiens
cccaggaattggaggctgcagt

SEQ ID NO: 7905926 - DNA, 22 bp, Homo sapiens
cccaggaattggaggctgcagt

SEQ ID NO: 7905927 - DNA, 22 bp, Homo sapiens
cccaggacccttcaatggctcc

SEQ ID NO: 7905928 - DNA, 22 bp, Homo sapiens
cccaggacccttcaatggctcc

SEQ ID NO: 7905929 - DNA, 22 bp, Homo sapiens
cccaggaccgcgcggctgagcg

SEQ ID NO: 7905930 - DNA, 22 bp, Homo sapiens
cccaggacccttcaatggctcc

SEQ ID NO: 7905931 - DNA, 22 bp, Homo sapiens
cccaggactaatgagctctacg

SEQ ID NO: 7905932 - DNA, 22 bp, Homo sapiens
cccaggaccgcgcggctgagcg

SEQ ID NO: 7905933 - DNA, 22 bp, Homo sapiens
cccaggaccgcgcggctgagcg

SEQ ID NO: 7905934 - DNA, 22 bp, Homo sapiens
cccaggaccgcgcggctgagcg

SEQ ID NO: 7905935 - DNA, 22 bp, Homo sapiens
cccaggaccgcgcggctgagcg

SEQ ID NO: 7905936 - DNA, 22 bp, Homo sapiens
cccaggactcttcactgcagcc

SEQ ID NO: 7905937 - DNA, 22 bp, Homo sapiens
cccaggactcttcactgcagcc

SEQ ID NO: 7905938 - DNA, 22 bp, Homo sapiens
cccaggactcttcactgcagcc

SEQ ID NO: 7905939 - DNA, 22 bp, Homo sapiens
cccaggactctgacacccccaa

SEQ ID NO: 7905940 - DNA, 22 bp, Homo sapiens
cccaggactctgacacccccaa

SEQ ID NO: 7905941 - DNA, 22 bp, Homo sapiens
cccaggactcttcactgcagcc

SEQ ID NO: 7905942 - DNA, 22 bp, Homo sapiens
cccaggactcttcactgcagcc

SEQ ID NO: 7905943 - DNA, 21 bp, Homo sapiens
cccaggagaagaaaagatgca

SEQ ID NO: 7905944 - DNA, 21 bp, Homo sapiens
cccaggagaagaaaagatgca

SEQ ID NO: 7905945 - DNA, 22 bp, Homo sapiens
cccaggagaatataatgttctt

SEQ ID NO: 7905946 - DNA, 22 bp, Homo sapiens
cccagctccagagccagaaaca

SEQ ID NO: 7905947 - DNA, 22 bp, Homo sapiens
cccagctccagagccagaaaca

SEQ ID NO: 7905948 - DNA, 18 bp, Homo sapiens
cccagctccacttccctc

SEQ ID NO: 7905949 - DNA, 18 bp, Homo sapiens
cccagctccacttccctc

SEQ ID NO: 7905950 - DNA, 22 bp, Homo sapiens
cccagctcccatgttctccaat

SEQ ID NO: 7905951 - DNA, 22 bp, Homo sapiens
cccagctcccatgttctccaat

SEQ ID NO: 7905952 - DNA, 22 bp, Homo sapiens
cccagctcccatgttctccaat

SEQ ID NO: 7905953 - DNA, 22 bp, Homo sapiens
cccaggaattggaggctgcagt

SEQ ID NO: 7905954 - DNA, 22 bp, Homo sapiens
cccaggaattggaggctgcagt

SEQ ID NO: 7905955 - DNA, 22 bp, Homo sapiens
cccaggaattggaggctgcagt

SEQ ID NO: 7905956 - DNA, 22 bp, Homo sapiens
cccaggaaatagccaggaggtg

SEQ ID NO: 7905957 - DNA, 22 bp, Homo sapiens
cccaggaaatagccaggaggtg

SEQ ID NO: 7905958 - DNA, 22 bp, Homo sapiens
cccaggaaatagccaggaggtg

SEQ ID NO: 7905959 - DNA, 22 bp, Homo sapiens
cccaggaaatagccaggaggtg

SEQ ID NO: 7905960 - DNA, 22 bp, Homo sapiens
cccagctccgagctccgagccg

SEQ ID NO: 7905961 - DNA, 22 bp, Homo sapiens
cccagctccctggtatttgtgc

SEQ ID NO: 7905962 - DNA, 22 bp, Homo sapiens
cccagctccgagctccgagccg

SEQ ID NO: 7905963 - DNA, 22 bp, Homo sapiens
tgcagtgatttgtacaattaga

SEQ ID NO: 7905964 - DNA, 22 bp, Homo sapiens
tgcagtgcctcggcagtgcagc

SEQ ID NO: 7905965 - DNA, 22 bp, Homo sapiens
tgcagtgatgcttctggctcag

SEQ ID NO: 7905966 - DNA, 21 bp, Homo sapiens
tgcagtgaggggagctgtcag

SEQ ID NO: 7905967 - DNA, 22 bp, Homo sapiens
tgcagtgatttgtacaattaga

SEQ ID NO: 7905968 - DNA, 22 bp, Homo sapiens
tgcagtgatgcttctggctcag

SEQ ID NO: 7905969 - DNA, 22 bp, Homo sapiens
tgcagtgattaaagtgttaaat

SEQ ID NO: 7905970 - DNA, 22 bp, Homo sapiens
tgcagtggaaagactcagactt

SEQ ID NO: 7905971 - DNA, 22 bp, Homo sapiens
tgcagtggaagaggtggagatc

SEQ ID NO: 7905972 - DNA, 22 bp, Homo sapiens
tgcagtggaagaggtggagatc

SEQ ID NO: 7905973 - DNA, 22 bp, Homo sapiens
tgcagtggaagaggtggagatc

SEQ ID NO: 7905974 - DNA, 22 bp, Homo sapiens
tgcagtcttccagctgcacaaa

SEQ ID NO: 7905975 - DNA, 22 bp, Homo sapiens
tgcagtctgtacattttaagaa

SEQ ID NO: 7905976 - DNA, 22 bp, Homo sapiens
tgcagtctggatgtcctcagat

SEQ ID NO: 7905977 - DNA, 22 bp, Homo sapiens
tgcagtctggatgtcctcagat

SEQ ID NO: 7905978 - DNA, 22 bp, Homo sapiens
tgcagtgaggcagttgggttgg

SEQ ID NO: 7905979 - DNA, 22 bp, Homo sapiens
tgcagtgagaagcagttatgat

SEQ ID NO: 7905980 - DNA, 22 bp, Homo sapiens
tgcagtgaaagtatcttaattt

SEQ ID NO: 7905981 - DNA, 22 bp, Homo sapiens
tgcaggtggacacgggagacgg

SEQ ID NO: 7905982 - DNA, 22 bp, Homo sapiens
tgcaggtgctgtgtcaagagag

SEQ ID NO: 7905983 - DNA, 22 bp, Homo sapiens
cccagccctgacctattggaaa

SEQ ID NO: 7905984 - DNA, 22 bp, Homo sapiens
cccagccctgacctattggaaa

SEQ ID NO: 7905985 - DNA, 22 bp, Homo sapiens
tgcagtctggatgtcctcagat

SEQ ID NO: 7905986 - DNA, 22 bp, Homo sapiens
tgcagtggaggccgtgagacag

SEQ ID NO: 7905987 - DNA, 22 bp, Homo sapiens
tgcagtggaggccgtgagacag

SEQ ID NO: 7905988 - DNA, 22 bp, Homo sapiens
tgcagtggaatctggagagcag

SEQ ID NO: 7905989 - DNA, 22 bp, Homo sapiens
tgcagtggaggccgtgagacag

SEQ ID NO: 7905990 - DNA, 22 bp, Homo sapiens
tgcagtggaggccgtgagacag

SEQ ID NO: 7905991 - DNA, 22 bp, Homo sapiens
tgcagtggcgccatctcagctc

SEQ ID NO: 7905992 - DNA, 22 bp, Homo sapiens
tgcagtggaggccgtgagacag

SEQ ID NO: 7905993 - DNA, 22 bp, Homo sapiens
tgcagtggaagaggtggagatc

SEQ ID NO: 7905994 - DNA, 22 bp, Homo sapiens
tgcagtggaagaggtggagatc

SEQ ID NO: 7905995 - DNA, 22 bp, Homo sapiens
tgcagtggaagaggtggagatc

SEQ ID NO: 7905996 - DNA, 22 bp, Homo sapiens
tgcagtggaatctggagagcag

SEQ ID NO: 7905997 - DNA, 22 bp, Homo sapiens
tgcagtggaagaggtggagatc

SEQ ID NO: 7905998 - DNA, 22 bp, Homo sapiens
tgcagtggaatctggagagcag

SEQ ID NO: 7905999 - DNA, 22 bp, Homo sapiens
tgcagtggaatctggagagcag

SEQ ID NO: 7906000 - DNA, 22 bp, Homo sapiens
tgcagtggaatctggagagcag

SEQ ID NO: 7906001 - DNA, 22 bp, Homo sapiens
tgcagtggcgccatctcagctc

SEQ ID NO: 7906002 - DNA, 22 bp, Homo sapiens
tgcagtggaggccgtgagacag

SEQ ID NO: 7906003 - DNA, 22 bp, Homo sapiens
cccagctcatcaggagccgccc

SEQ ID NO: 7906004 - DNA, 18 bp, Homo sapiens
cccagctccacttccctc

SEQ ID NO: 7906005 - DNA, 18 bp, Homo sapiens
cccagctccacttccctc

SEQ ID NO: 7906006 - DNA, 22 bp, Homo sapiens
cccagcccacggtcctgggtgg

SEQ ID NO: 7906007 - DNA, 22 bp, Homo sapiens
cccagcccagcgttcgaggggt

SEQ ID NO: 7906008 - DNA, 22 bp, Homo sapiens
cccagcccacggtcctgggtgg

SEQ ID NO: 7906009 - DNA, 22 bp, Homo sapiens
cccagcccagcgttcgaggggt

SEQ ID NO: 7906010 - DNA, 22 bp, Homo sapiens
cccagcccagcgttcgaggggt

SEQ ID NO: 7906011 - DNA, 22 bp, Homo sapiens
cccagcccagcgttcgaggggt

SEQ ID NO: 7906012 - DNA, 22 bp, Homo sapiens
cccagcccagcgttcgaggggt

SEQ ID NO: 7906013 - DNA, 18 bp, Homo sapiens
cccagcccaccatttctc

SEQ ID NO: 7906014 - DNA, 18 bp, Homo sapiens
cccagcccaccatttctc

SEQ ID NO: 7906015 - DNA, 18 bp, Homo sapiens
cccagcccaccatttctc

SEQ ID NO: 7906016 - DNA, 19 bp, Homo sapiens
cccagccaggtcttgcatc

SEQ ID NO: 7906017 - DNA, 18 bp, Homo sapiens
cccagcccaccatttctc

SEQ ID NO: 7906018 - DNA, 19 bp, Homo sapiens
cccagccaggtcttgcatc

SEQ ID NO: 7906019 - DNA, 19 bp, Homo sapiens
cccagccaggtcttgcatc

SEQ ID NO: 7906020 - DNA, 20 bp, Homo sapiens
cccagcccctacctgttgcc

SEQ ID NO: 7906021 - DNA, 20 bp, Homo sapiens
cccagcccctacctgttgcc

SEQ ID NO: 7906022 - DNA, 20 bp, Homo sapiens
cccagcccgggccgcgctcg

SEQ ID NO: 7906023 - DNA, 20 bp, Homo sapiens
cccagcccgggccgcgctcg

SEQ ID NO: 7906024 - DNA, 22 bp, Homo sapiens
cccagcccatctcaaaggtcta

SEQ ID NO: 7906025 - DNA, 22 bp, Homo sapiens
cccagcccatctcaaaggtcta

SEQ ID NO: 7906026 - DNA, 22 bp, Homo sapiens
cccagcccccgagtgtctggaa

SEQ ID NO: 7906027 - DNA, 22 bp, Homo sapiens
cccagcccccgagtgtctggaa

SEQ ID NO: 7906028 - DNA, 22 bp, Homo sapiens
cccagcccccgagtgtctggaa

SEQ ID NO: 7906029 - DNA, 22 bp, Homo sapiens
cccagcccccgagtgtctggaa

SEQ ID NO: 7906030 - DNA, 20 bp, Homo sapiens
cccagcccctacctgttgcc

SEQ ID NO: 7906031 - DNA, 20 bp, Homo sapiens
cccagcccctacctgttgcc

SEQ ID NO: 7906032 - DNA, 22 bp, Homo sapiens
cccagcccccgagtgtctggaa

SEQ ID NO: 7906033 - DNA, 22 bp, Homo sapiens
tgcagcagtttaatgcagggtt

SEQ ID NO: 7906034 - DNA, 22 bp, Homo sapiens
tgcagcagtgttccttggcttg

SEQ ID NO: 7906035 - DNA, 22 bp, Homo sapiens
tgcagcagtgttccttggcttg

SEQ ID NO: 7906036 - DNA, 22 bp, Homo sapiens
tgcagcagtttaatgcagggtt

SEQ ID NO: 7906037 - DNA, 22 bp, Homo sapiens
tgcagcagtttaatgcagggtt

SEQ ID NO: 7906038 - DNA, 22 bp, Homo sapiens
tgcagcagtttaatgcagggtt

SEQ ID NO: 7906039 - DNA, 22 bp, Homo sapiens
tgcagcagtttaatgcagggtt

SEQ ID NO: 7906040 - DNA, 22 bp, Homo sapiens
tgcagcatctccttgtgccatg

SEQ ID NO: 7906041 - DNA, 22 bp, Homo sapiens
tgcagcatgccaaacgaggagg

SEQ ID NO: 7906042 - DNA, 22 bp, Homo sapiens
tgcagcatgtgtgcaattagtt

SEQ ID NO: 7906043 - DNA, 22 bp, Homo sapiens
tgcagcatgcaggagaggctct

SEQ ID NO: 7906044 - DNA, 22 bp, Homo sapiens
tgcagcatgcaggagaggctct

SEQ ID NO: 7906045 - DNA, 22 bp, Homo sapiens
tgcagcatctccttaaatcttg

SEQ ID NO: 7906046 - DNA, 22 bp, Homo sapiens
tgcagcatatagcttagtgatg

SEQ ID NO: 7906047 - DNA, 22 bp, Homo sapiens
tgcagcatccatatattattag

SEQ ID NO: 7906048 - DNA, 22 bp, Homo sapiens
tgcagcagtttaatgcagggtt

SEQ ID NO: 7906049 - DNA, 22 bp, Homo sapiens
tgcagcatctccttaaatcttg

SEQ ID NO: 7906050 - DNA, 22 bp, Homo sapiens
tgcagcatatagcttagtgatg

SEQ ID NO: 7906051 - DNA, 22 bp, Homo sapiens
tgcagcatctccttaaatcttg

SEQ ID NO: 7906052 - DNA, 22 bp, Homo sapiens
tgcagcatttgctgaagcagga

SEQ ID NO: 7906053 - DNA, 22 bp, Homo sapiens
tgcagcattgcactccagcctg

SEQ ID NO: 7906054 - DNA, 22 bp, Homo sapiens
tgcagcattgcaaagcagtctt

SEQ ID NO: 7906055 - DNA, 22 bp, Homo sapiens
tgcagcattgaaatagctaggc

SEQ ID NO: 7906056 - DNA, 22 bp, Homo sapiens
tgcagcattctggtaaaaggca

SEQ ID NO: 7906057 - DNA, 22 bp, Homo sapiens
tgcagcattgaaatagctaggc

SEQ ID NO: 7906058 - DNA, 22 bp, Homo sapiens
cccagcaggtgccatcactctg

SEQ ID NO: 7906059 - DNA, 22 bp, Homo sapiens
cccagcaggtgccatcactctg

SEQ ID NO: 7906060 - DNA, 22 bp, Homo sapiens
tgcagcattattcacagtagcc

SEQ ID NO: 7906061 - DNA, 22 bp, Homo sapiens
tgcagcattattcacagtagcc

SEQ ID NO: 7906062 - DNA, 22 bp, Homo sapiens
tgcagcattctggtaaaaggca

SEQ ID NO: 7906063 - DNA, 22 bp, Homo sapiens
tgcagcattctggtaaaaggca

SEQ ID NO: 7906064 - DNA, 22 bp, Homo sapiens
tgcagcattcttggccactact

SEQ ID NO: 7906065 - DNA, 22 bp, Homo sapiens
tgcagcattagtacaagtctca

SEQ ID NO: 7906066 - DNA, 22 bp, Homo sapiens
tgcagcattagtacaagtctca

SEQ ID NO: 7906067 - DNA, 22 bp, Homo sapiens
tgcagcattatgtagctgtttt

SEQ ID NO: 7906068 - DNA, 22 bp, Homo sapiens
tgcagcattagtacaagtctca

SEQ ID NO: 7906069 - DNA, 18 bp, Homo sapiens
tgcagcatgttcccataa

SEQ ID NO: 7906070 - DNA, 22 bp, Homo sapiens
cccagcatctccaggcatggcc

SEQ ID NO: 7906071 - DNA, 22 bp, Homo sapiens
cccagcaggtgccatcactctg

SEQ ID NO: 7906072 - DNA, 22 bp, Homo sapiens
cccagcaggtgccatcactctg

SEQ ID NO: 7906073 - DNA, 22 bp, Homo sapiens
cccagcagtaaccagtggaaat

SEQ ID NO: 7906074 - DNA, 22 bp, Homo sapiens
cccagcagtaaccagtggaaat

SEQ ID NO: 7906075 - DNA, 22 bp, Homo sapiens
cccagcaggtgccatcactctg

SEQ ID NO: 7906076 - DNA, 22 bp, Homo sapiens
cccagcatgcacgctgacactc

SEQ ID NO: 7906077 - DNA, 22 bp, Homo sapiens
cccagcatgcacgctgacactc

SEQ ID NO: 7906078 - DNA, 22 bp, Homo sapiens
cccagcatgcacgctgacactc

SEQ ID NO: 7906079 - DNA, 22 bp, Homo sapiens
cccagcatggagtgaggactca

SEQ ID NO: 7906080 - DNA, 22 bp, Homo sapiens
cccagcatttctgggctgcact

SEQ ID NO: 7906081 - DNA, 22 bp, Homo sapiens
cccagcatttctgggctgcact

SEQ ID NO: 7906082 - DNA, 22 bp, Homo sapiens
cccagcatttctgggctgcact

SEQ ID NO: 7906083 - DNA, 22 bp, Homo sapiens
cccagcatggagtgaggactca

SEQ ID NO: 7906084 - DNA, 22 bp, Homo sapiens
cccagcatggagtgaggactca

SEQ ID NO: 7906085 - DNA, 22 bp, Homo sapiens
cccagcatttctgggctgcact

SEQ ID NO: 7906086 - DNA, 22 bp, Homo sapiens
cccagccaaaagcaagtttacc

SEQ ID NO: 7906087 - DNA, 22 bp, Homo sapiens
cccagccaaggtgctggtgttg

SEQ ID NO: 7906088 - DNA, 22 bp, Homo sapiens
cccagccaaggtgctggtgttg

SEQ ID NO: 7906089 - DNA, 22 bp, Homo sapiens
cccagccagcctcttcccatat

SEQ ID NO: 7906090 - DNA, 22 bp, Homo sapiens
cccagccaagtgatctgaccgc

SEQ ID NO: 7906091 - DNA, 22 bp, Homo sapiens
cccagccaagtgatctgaccgc

SEQ ID NO: 7906092 - DNA, 23 bp, Homo sapiens
tgcctcagtggaatgtgagggtg

SEQ ID NO: 7906093 - DNA, 23 bp, Homo sapiens
tgcctcagtggaatgtgagggtg

SEQ ID NO: 7906094 - DNA, 23 bp, Homo sapiens
tgcctcagtggaatgtgagggtg

SEQ ID NO: 7906095 - DNA, 23 bp, Homo sapiens
tgcctcagtggaatgtgagggtg

SEQ ID NO: 7906096 - DNA, 22 bp, Homo sapiens
tgcctcagtttcatctgcagaa

SEQ ID NO: 7906097 - DNA, 22 bp, Homo sapiens
tgcctcagtttcatctgcagaa

SEQ ID NO: 7906098 - DNA, 22 bp, Homo sapiens
tgcctcagtttcatctgcagaa

SEQ ID NO: 7906099 - DNA, 22 bp, Homo sapiens
tgcctcagtttcatctgcagaa

SEQ ID NO: 7906100 - DNA, 22 bp, Homo sapiens
tgcctcagtttcatctgcagaa

SEQ ID NO: 7906101 - DNA, 22 bp, Homo sapiens
tgccctggttacactggagtcc

SEQ ID NO: 7906102 - DNA, 22 bp, Homo sapiens
tgccctggttctgtgggtgagc

SEQ ID NO: 7906103 - DNA, 22 bp, Homo sapiens
tgcctcagtctaaagtctctca

SEQ ID NO: 7906104 - DNA, 22 bp, Homo sapiens
tgcctcagtctaaagtctctca

SEQ ID NO: 7906105 - DNA, 23 bp, Homo sapiens
tgcctcagtggaatgtgagggtg

SEQ ID NO: 7906106 - DNA, 19 bp, Homo sapiens
cccaggagtctggctggtt

SEQ ID NO: 7906107 - DNA, 19 bp, Homo sapiens
cccaggagtctggctggtt

SEQ ID NO: 7906108 - DNA, 20 bp, Homo sapiens
cccaggagtgagcagcttta

SEQ ID NO: 7906109 - DNA, 20 bp, Homo sapiens
cccaggagtgagcagcttta

SEQ ID NO: 7906110 - DNA, 20 bp, Homo sapiens
cccaggagtgagcagcttta

SEQ ID NO: 7906111 - DNA, 20 bp, Homo sapiens
cccaggagtgagcagcttta

SEQ ID NO: 7906112 - DNA, 20 bp, Homo sapiens
cccaggagtgagcagcttta

SEQ ID NO: 7906113 - DNA, 20 bp, Homo sapiens
cccaggagtgagcagcttta

SEQ ID NO: 7906114 - DNA, 20 bp, Homo sapiens
cccaggagtgagcagcttta

SEQ ID NO: 7906115 - DNA, 22 bp, Homo sapiens
cccaggagttagaggttgtggt

SEQ ID NO: 7906116 - DNA, 22 bp, Homo sapiens
cccaggagttagaggttgtggt

SEQ ID NO: 7906117 - DNA, 22 bp, Homo sapiens
tgccctggttacactggagtcc

SEQ ID NO: 7906118 - DNA, 22 bp, Homo sapiens
cccaggagttagaggttgtggt

SEQ ID NO: 7906119 - DNA, 19 bp, Homo sapiens
cccaggagtctggctggtt

SEQ ID NO: 7906120 - DNA, 19 bp, Homo sapiens
cccaggagtctggctggtt

SEQ ID NO: 7906121 - DNA, 19 bp, Homo sapiens
cccaggagtctggctggtt

SEQ ID NO: 7906122 - DNA, 19 bp, Homo sapiens
cccaggagtctggctggtt

SEQ ID NO: 7906123 - DNA, 19 bp, Homo sapiens
cccaggagtctggctggtt

SEQ ID NO: 7906124 - DNA, 22 bp, Homo sapiens
cccaggagtaagtgacattgtt

SEQ ID NO: 7906125 - DNA, 22 bp, Homo sapiens
cccaggagtaagtgacattgtt

SEQ ID NO: 7906126 - DNA, 22 bp, Homo sapiens
cccaggagtaagtgacattgtt

SEQ ID NO: 7906127 - DNA, 22 bp, Homo sapiens
cccaggaggttggggctacagt

SEQ ID NO: 7906128 - DNA, 22 bp, Homo sapiens
cccaggaggttggggctacagt

SEQ ID NO: 7906129 - DNA, 22 bp, Homo sapiens
cccaggaggttggggctacagt

SEQ ID NO: 7906130 - DNA, 22 bp, Homo sapiens
cccaggaggttggggctacagt

SEQ ID NO: 7906131 - DNA, 22 bp, Homo sapiens
cccaggaggttggggctacagt

SEQ ID NO: 7906132 - DNA, 22 bp, Homo sapiens
cccaggaggttgaggctgcagt

SEQ ID NO: 7906133 - DNA, 22 bp, Homo sapiens
cccaggaggttgaggctgcagt

SEQ ID NO: 7906134 - DNA, 22 bp, Homo sapiens
cccaggaggttgaggctgcagt

SEQ ID NO: 7906135 - DNA, 22 bp, Homo sapiens
cccaggaggttgaggctgcagt

SEQ ID NO: 7906136 - DNA, 22 bp, Homo sapiens
cccaggaggttgaggctgcagt

SEQ ID NO: 7906137 - DNA, 22 bp, Homo sapiens
cccaggaggttgaggctgcagt

SEQ ID NO: 7906138 - DNA, 19 bp, Homo sapiens
tgccctgcacgctgtcctg

SEQ ID NO: 7906139 - DNA, 22 bp, Homo sapiens
tgccctctttctgtacagctcc

SEQ ID NO: 7906140 - DNA, 19 bp, Homo sapiens
tgccctgcacgctgtcctg

SEQ ID NO: 7906141 - DNA, 22 bp, Homo sapiens
tgccctctaggctacagttcca

SEQ ID NO: 7906142 - DNA, 22 bp, Homo sapiens
tgccctctaggctacagttcca

SEQ ID NO: 7906143 - DNA, 22 bp, Homo sapiens
tgccctccctgtactgtcagga

SEQ ID NO: 7906144 - DNA, 22 bp, Homo sapiens
tgccctcctcctgagcccatgt

SEQ ID NO: 7906145 - DNA, 22 bp, Homo sapiens
tgccctctgcaggccgccatgg

SEQ ID NO: 7906146 - DNA, 22 bp, Homo sapiens
tgccctctgcaggccgccatgg

SEQ ID NO: 7906147 - DNA, 22 bp, Homo sapiens
tgccctctgcaggccgccatgg

SEQ ID NO: 7906148 - DNA, 22 bp, Homo sapiens
tgccctctcaagttgagtcaga

SEQ ID NO: 7906149 - DNA, 22 bp, Homo sapiens
tgccctcttaggtctgcgcagc

SEQ ID NO: 7906150 - DNA, 22 bp, Homo sapiens
tgccctcttaggtctgcgcagc

SEQ ID NO: 7906151 - DNA, 22 bp, Homo sapiens
tgccctcttaggtctgcgcagc

SEQ ID NO: 7906152 - DNA, 22 bp, Homo sapiens
tgccctctttctgtacagctcc

SEQ ID NO: 7906153 - DNA, 22 bp, Homo sapiens
tgccctctttctgtacagctcc

SEQ ID NO: 7906154 - DNA, 22 bp, Homo sapiens
tgccctcttaggtctgcgcagc

SEQ ID NO: 7906155 - DNA, 22 bp, Homo sapiens
tgccctctgcctcctctgcaga

SEQ ID NO: 7906156 - DNA, 22 bp, Homo sapiens
tgccctctgcctcctctgcaga

SEQ ID NO: 7906157 - DNA, 22 bp, Homo sapiens
tgccctccacagtggctccacc

SEQ ID NO: 7906158 - DNA, 22 bp, Homo sapiens
tgccctcccacattatggctgt

SEQ ID NO: 7906159 - DNA, 22 bp, Homo sapiens
tgccctccctgtactgtcagga

SEQ ID NO: 7906160 - DNA, 22 bp, Homo sapiens
tgccctccctgtactgtcagga

SEQ ID NO: 7906161 - DNA, 22 bp, Homo sapiens
tgccctccctgtactgtcagga

SEQ ID NO: 7906162 - DNA, 22 bp, Homo sapiens
tgccctcattataagaggctca

SEQ ID NO: 7906163 - DNA, 22 bp, Homo sapiens
tgccctcattataagaggctca

SEQ ID NO: 7906164 - DNA, 22 bp, Homo sapiens
tgccctccacagtggctccacc

SEQ ID NO: 7906165 - DNA, 22 bp, Homo sapiens
tgccctccacagtggctccacc

SEQ ID NO: 7906166 - DNA, 22 bp, Homo sapiens
tgccctcattataagaggctca

SEQ ID NO: 7906167 - DNA, 22 bp, Homo sapiens
tgccctcaggagtccctgacca

SEQ ID NO: 7906168 - DNA, 22 bp, Homo sapiens
tgccctcagccacctccaagtt

SEQ ID NO: 7906169 - DNA, 22 bp, Homo sapiens
cccaggaggcggaggttgtggt

SEQ ID NO: 7906170 - DNA, 22 bp, Homo sapiens
cccaggaggcggaggttgtggt

SEQ ID NO: 7906171 - DNA, 22 bp, Homo sapiens
cccaggaggcggaggttgtggt

SEQ ID NO: 7906172 - DNA, 22 bp, Homo sapiens
cccaggaggcggaggttgtggt

SEQ ID NO: 7906173 - DNA, 21 bp, Homo sapiens
cccaggaggctgagaagagca

SEQ ID NO: 7906174 - DNA, 22 bp, Homo sapiens
cccaggaggcggaggttgcagt

SEQ ID NO: 7906175 - DNA, 22 bp, Homo sapiens
cccaggaggcggaggttgcagt

SEQ ID NO: 7906176 - DNA, 22 bp, Homo sapiens
cccaggaggcggaggttgcagt

SEQ ID NO: 7906177 - DNA, 22 bp, Homo sapiens
cccaggaggcggaggttgcagt

SEQ ID NO: 7906178 - DNA, 22 bp, Homo sapiens
tgccctcagcagcagctcctgc

SEQ ID NO: 7906179 - DNA, 22 bp, Homo sapiens
tgcccaggatctggcgatgctc

SEQ ID NO: 7906180 - DNA, 21 bp, Homo sapiens
cccaggaggctgagaagagca

SEQ ID NO: 7906181 - DNA, 21 bp, Homo sapiens
cccaggaggctgagaagagca

SEQ ID NO: 7906182 - DNA, 22 bp, Homo sapiens
tgcccagcttcttacttttaaa

SEQ ID NO: 7906183 - DNA, 22 bp, Homo sapiens
tgcccaggatctggcgatgctc

SEQ ID NO: 7906184 - DNA, 22 bp, Homo sapiens
tgcccagcttcttacttttaaa

SEQ ID NO: 7906185 - DNA, 22 bp, Homo sapiens
tgcccagcttcttacttttaaa

SEQ ID NO: 7906186 - DNA, 22 bp, Homo sapiens
tgcatattgtgaaaatgtagat

SEQ ID NO: 7906187 - DNA, 22 bp, Homo sapiens
tgcatattgtccttgatattat

SEQ ID NO: 7906188 - DNA, 22 bp, Homo sapiens
tgcatattgtccttgatattat

SEQ ID NO: 7906189 - DNA, 21 bp, Homo sapiens
tgcatattcttctggtggctg

SEQ ID NO: 7906190 - DNA, 22 bp, Homo sapiens
tgcatatttgtatgatgtttag

SEQ ID NO: 7906191 - DNA, 22 bp, Homo sapiens
tgcatattttataaagatggaa

SEQ ID NO: 7906192 - DNA, 22 bp, Homo sapiens
tgcatatttgattgagatacct

SEQ ID NO: 7906193 - DNA, 22 bp, Homo sapiens
tgcatatttgtatgatgtttag

SEQ ID NO: 7906194 - DNA, 22 bp, Homo sapiens
tgcatatttgattgagatacct

SEQ ID NO: 7906195 - DNA, 22 bp, Homo sapiens
cccaggagcttctctctgcctc

SEQ ID NO: 7906196 - DNA, 22 bp, Homo sapiens
cccaggagatctggatctcgtc

SEQ ID NO: 7906197 - DNA, 22 bp, Homo sapiens
cccaggaggacattccataccc

SEQ ID NO: 7906198 - DNA, 21 bp, Homo sapiens
cccaggaggagctccggctcc

SEQ ID NO: 7906199 - DNA, 21 bp, Homo sapiens
cccaggaggagctccggctcc

SEQ ID NO: 7906200 - DNA, 21 bp, Homo sapiens
cccaggaggagctccggctcc

SEQ ID NO: 7906201 - DNA, 22 bp, Homo sapiens
tgcatattttctgattcagaag

SEQ ID NO: 7906202 - DNA, 22 bp, Homo sapiens
cccaggagatctggatctcgtc

SEQ ID NO: 7906203 - DNA, 19 bp, Homo sapiens
tgcatatatctatgaaaga

SEQ ID NO: 7906204 - DNA, 19 bp, Homo sapiens
tgcatatatctatgaaaga

SEQ ID NO: 7906205 - DNA, 22 bp, Homo sapiens
tgcatatcttcaatgctgttgc

SEQ ID NO: 7906206 - DNA, 22 bp, Homo sapiens
tgcatatccacaccttatctct

SEQ ID NO: 7906207 - DNA, 22 bp, Homo sapiens
tgcatatcagaattcaagagtg

SEQ ID NO: 7906208 - DNA, 22 bp, Homo sapiens
tgcatattctcctttattttgt

SEQ ID NO: 7906209 - DNA, 22 bp, Homo sapiens
tgcatattctcctttattttgt

SEQ ID NO: 7906210 - DNA, 22 bp, Homo sapiens
tgcatattataaagagaattag

SEQ ID NO: 7906211 - DNA, 22 bp, Homo sapiens
tgcatattatgtgtatctgtct

SEQ ID NO: 7906212 - DNA, 22 bp, Homo sapiens
cccaggagacagaaacagaggt

SEQ ID NO: 7906213 - DNA, 22 bp, Homo sapiens
cccaggagacagaaacagaggt

SEQ ID NO: 7906214 - DNA, 22 bp, Homo sapiens
cccaggagacagaaacagaggt

SEQ ID NO: 7906215 - DNA, 22 bp, Homo sapiens
cccaggagacagaaacagaggt

SEQ ID NO: 7906216 - DNA, 22 bp, Homo sapiens
cccaggagacagaaacagaggt

SEQ ID NO: 7906217 - DNA, 22 bp, Homo sapiens
cccaggagacagaaacagaggt

SEQ ID NO: 7906218 - DNA, 22 bp, Homo sapiens
cccaggagacagaaacagaggt

SEQ ID NO: 7906219 - DNA, 22 bp, Homo sapiens
cccaggaggcctgcctggccgg

SEQ ID NO: 7906220 - DNA, 22 bp, Homo sapiens
cccaggaggcctgcctggccgg

SEQ ID NO: 7906221 - DNA, 22 bp, Homo sapiens
cccaggaggcgcaggttgcggt

SEQ ID NO: 7906222 - DNA, 22 bp, Homo sapiens
cccaggaggcgcaggttgcggt

SEQ ID NO: 7906223 - DNA, 22 bp, Homo sapiens
cccaggaggcgcaggttgcggt

SEQ ID NO: 7906224 - DNA, 19 bp, Homo sapiens
cccaggaggcggaggttgc

SEQ ID NO: 7906225 - DNA, 22 bp, Homo sapiens
cccaggaggccaaggttgcagt

SEQ ID NO: 7906226 - DNA, 22 bp, Homo sapiens
cccaggaggccaaggttgcagt

SEQ ID NO: 7906227 - DNA, 22 bp, Homo sapiens
cccaggaggccaaggttgcagt

SEQ ID NO: 7906228 - DNA, 22 bp, Homo sapiens
cccaggaggcctgcctggccgg

SEQ ID NO: 7906229 - DNA, 22 bp, Homo sapiens
cccaggaggcctgcctggccgg

SEQ ID NO: 7906230 - DNA, 22 bp, Homo sapiens
cccaggaggcctgcctggccgg

SEQ ID NO: 7906231 - DNA, 22 bp, Homo sapiens
cccaggaggcagaggttggagc

SEQ ID NO: 7906232 - DNA, 22 bp, Homo sapiens
cccaggaggcagaggttggagc

SEQ ID NO: 7906233 - DNA, 22 bp, Homo sapiens
cccaggaggcagatgttgcagt

SEQ ID NO: 7906234 - DNA, 22 bp, Homo sapiens
cccaggaggccaaggttgcagt

SEQ ID NO: 7906235 - DNA, 22 bp, Homo sapiens
cccaggaggcagaggttggagc

SEQ ID NO: 7906236 - DNA, 22 bp, Homo sapiens
cccaggaggcagaggttggagc

SEQ ID NO: 7906237 - DNA, 22 bp, Homo sapiens
cccaggaggcagaggttggagc

SEQ ID NO: 7906238 - DNA, 22 bp, Homo sapiens
cccaggaggcagaggttgcagt

SEQ ID NO: 7906239 - DNA, 22 bp, Homo sapiens
cccaggaggcagaggttgcagt

SEQ ID NO: 7906240 - DNA, 22 bp, Homo sapiens
cccaggaggcagaggttgcagt

SEQ ID NO: 7906241 - DNA, 22 bp, Homo sapiens
cccaggaggcagagatagcagt

SEQ ID NO: 7906242 - DNA, 22 bp, Homo sapiens
cccaggaggcagagatagcagt

SEQ ID NO: 7906243 - DNA, 22 bp, Homo sapiens
cccaggaggcagagatagcagt

SEQ ID NO: 7906244 - DNA, 22 bp, Homo sapiens
cccaggaggcagagcttgcagt

SEQ ID NO: 7906245 - DNA, 22 bp, Homo sapiens
cccaggaggcagagcttgcagt

SEQ ID NO: 7906246 - DNA, 22 bp, Homo sapiens
cccaggaggcagagcttgcagt

SEQ ID NO: 7906247 - DNA, 22 bp, Homo sapiens
cccaggaggcagagcttgcagt

SEQ ID NO: 7906248 - DNA, 22 bp, Homo sapiens
cccaggaggcagagcttgcagt

SEQ ID NO: 7906249 - DNA, 22 bp, Homo sapiens
cccaggaggcagagcttgcagt

SEQ ID NO: 7906250 - DNA, 22 bp, Homo sapiens
cccaggaggcagaggttgcagt

SEQ ID NO: 7906251 - DNA, 22 bp, Homo sapiens
cccaggaggaggaaaaagctcg

SEQ ID NO: 7906252 - DNA, 22 bp, Homo sapiens
cccaggaggaggaaaaagctcg

SEQ ID NO: 7906253 - DNA, 22 bp, Homo sapiens
cccaggaggaggaaaaagctcg

SEQ ID NO: 7906254 - DNA, 22 bp, Homo sapiens
cccaggaggcagaagttgcagt

SEQ ID NO: 7906255 - DNA, 22 bp, Homo sapiens
cccaggaggcagaagttgcagt

SEQ ID NO: 7906256 - DNA, 22 bp, Homo sapiens
cccaggaggcagaagttgcagt

SEQ ID NO: 7906257 - DNA, 22 bp, Homo sapiens
cccaggaggcagaagttgcagt

SEQ ID NO: 7906258 - DNA, 22 bp, Homo sapiens
ccagggtctctgctgcctgaga

SEQ ID NO: 7906259 - DNA, 22 bp, Homo sapiens
ccagggtctctgctgcctgaga

SEQ ID NO: 7906260 - DNA, 22 bp, Homo sapiens
ccagggtcttcgaggcagcaat

SEQ ID NO: 7906261 - DNA, 22 bp, Homo sapiens
ccagggtggcgtagatgctggg

SEQ ID NO: 7906262 - DNA, 22 bp, Homo sapiens
tgagaaaaggttgagatgataa

SEQ ID NO: 7906263 - DNA, 22 bp, Homo sapiens
tgagaaaaggttgagatgataa

SEQ ID NO: 7906264 - DNA, 22 bp, Homo sapiens
tgagaaaaggttgagatgataa

SEQ ID NO: 7906265 - DNA, 22 bp, Homo sapiens
tgagaaaactcaaagacagatc

SEQ ID NO: 7906266 - DNA, 22 bp, Homo sapiens
tgagaaaactcaaagacagatc

SEQ ID NO: 7906267 - DNA, 22 bp, Homo sapiens
tgagaaaactcaaagacagatc

SEQ ID NO: 7906268 - DNA, 22 bp, Homo sapiens
tgagaaaactcaaagacagatc

SEQ ID NO: 7906269 - DNA, 22 bp, Homo sapiens
tgagaaaactcaaagacagatc

SEQ ID NO: 7906270 - DNA, 22 bp, Homo sapiens
tgagaaaactcaaagacagatc

SEQ ID NO: 7906271 - DNA, 22 bp, Homo sapiens
tgacttttggacctcactgtcc

SEQ ID NO: 7906272 - DNA, 22 bp, Homo sapiens
tgacttttggacctcactgtcc

SEQ ID NO: 7906273 - DNA, 22 bp, Homo sapiens
tgactttgtgcaagtgaattat

SEQ ID NO: 7906274 - DNA, 22 bp, Homo sapiens
tgactttgtccctttcaaatcc

SEQ ID NO: 7906275 - DNA, 22 bp, Homo sapiens
tgactttggataagaaaatgag

SEQ ID NO: 7906276 - DNA, 18 bp, Homo sapiens
tgactttctttttcaacc

SEQ ID NO: 7906277 - DNA, 22 bp, Homo sapiens
tgactttggataagaaaatgag

SEQ ID NO: 7906278 - DNA, 21 bp, Homo sapiens
tgactttatattgtgtcagga

SEQ ID NO: 7906279 - DNA, 17 bp, Homo sapiens
tgactttatttgcttgg

SEQ ID NO: 7906280 - DNA, 22 bp, Homo sapiens
tgactttagaattttatccaga

SEQ ID NO: 7906281 - DNA, 22 bp, Homo sapiens
tgactttagaattttatccaga

SEQ ID NO: 7906282 - DNA, 22 bp, Homo sapiens
tgactttagacttagtcaagtt

SEQ ID NO: 7906283 - DNA, 22 bp, Homo sapiens
tgactttagagatgggaggtca

SEQ ID NO: 7906284 - DNA, 22 bp, Homo sapiens
tgactttagaattttatccaga

SEQ ID NO: 7906285 - DNA, 22 bp, Homo sapiens
tgactttacagatatgtttcct

SEQ ID NO: 7906286 - DNA, 22 bp, Homo sapiens
tgactttacagatatgtttcct

SEQ ID NO: 7906287 - DNA, 22 bp, Homo sapiens
tgaccccactgtgctcagaggt

SEQ ID NO: 7906288 - DNA, 22 bp, Homo sapiens
tgacccatttgcttttcctgta

SEQ ID NO: 7906289 - DNA, 22 bp, Homo sapiens
tgaccctgagagctgaatggct

SEQ ID NO: 7906290 - DNA, 22 bp, Homo sapiens
tgacccgggcctgctacgccgc

SEQ ID NO: 7906291 - DNA, 22 bp, Homo sapiens
tgaccctcttccccatgcgctc

SEQ ID NO: 7906292 - DNA, 22 bp, Homo sapiens
tgactttaaagctcactctttt

SEQ ID NO: 7906293 - DNA, 22 bp, Homo sapiens
tgaccctgagagctgaatggct

SEQ ID NO: 7906294 - DNA, 22 bp, Homo sapiens
tgactttaagctatctgattct

SEQ ID NO: 7906295 - DNA, 22 bp, Homo sapiens
tgactttaagctatctgattct

SEQ ID NO: 7906296 - DNA, 22 bp, Homo sapiens
tgactttaagctatctgattct

SEQ ID NO: 7906297 - DNA, 22 bp, Homo sapiens
tgactttaataggattttgcat

SEQ ID NO: 7906298 - DNA, 22 bp, Homo sapiens
tgaccaggatactgcagggatg

SEQ ID NO: 7906299 - DNA, 22 bp, Homo sapiens
tgaccaggatactgcagggatg

SEQ ID NO: 7906300 - DNA, 22 bp, Homo sapiens
tgaccaggatactgcagggatg

SEQ ID NO: 7906301 - DNA, 22 bp, Homo sapiens
tgacccaagtagtgccttttct

SEQ ID NO: 7906302 - DNA, 22 bp, Homo sapiens
tgaccatttgatctacattcca

SEQ ID NO: 7906303 - DNA, 22 bp, Homo sapiens
tgacccatcaggccacatgagg

SEQ ID NO: 7906304 - DNA, 22 bp, Homo sapiens
tgacccatcaggccacatgagg

SEQ ID NO: 7906305 - DNA, 22 bp, Homo sapiens
tgacccatggtctgatcatagg

SEQ ID NO: 7906306 - DNA, 22 bp, Homo sapiens
tgacccattaaccactttccct

SEQ ID NO: 7906307 - DNA, 22 bp, Homo sapiens
tgacccattggtccctagatcc

SEQ ID NO: 7906308 - DNA, 22 bp, Homo sapiens
tgaccacagacccaatgactac

SEQ ID NO: 7906309 - DNA, 22 bp, Homo sapiens
tgaccacacgtctggaattgtg

SEQ ID NO: 7906310 - DNA, 22 bp, Homo sapiens
tgaccacacttgatcactctga

SEQ ID NO: 7906311 - DNA, 22 bp, Homo sapiens
tgaccacgacatcttgtgagtt

SEQ ID NO: 7906312 - DNA, 22 bp, Homo sapiens
tgaccacattgatttctcatcc

SEQ ID NO: 7906313 - DNA, 22 bp, Homo sapiens
tgaccaaaggtggtttatttgg

SEQ ID NO: 7906314 - DNA, 22 bp, Homo sapiens
tgaccacacgtctggaattgtg

SEQ ID NO: 7906315 - DNA, 22 bp, Homo sapiens
tgaccaatactgtggatgccag

SEQ ID NO: 7906316 - DNA, 20 bp, Homo sapiens
tgacatctgttgaggaggaa

SEQ ID NO: 7906317 - DNA, 23 bp, Homo sapiens
ccagggcccctacaccactgtcc

SEQ ID NO: 7906318 - DNA, 22 bp, Homo sapiens
tgacatgctaagattatgttat

SEQ ID NO: 7906319 - DNA, 22 bp, Homo sapiens
tgacatgaaactgtgttgctac

SEQ ID NO: 7906320 - DNA, 22 bp, Homo sapiens
tgacatgaaactgtgttgctac

SEQ ID NO: 7906321 - DNA, 22 bp, Homo sapiens
tgacatttttgtacaaagtcag

SEQ ID NO: 7906322 - DNA, 22 bp, Homo sapiens
tgacatttttataagagtcaaa

SEQ ID NO: 7906323 - DNA, 22 bp, Homo sapiens
tgacatctgccagtttggtcgt

SEQ ID NO: 7906324 - DNA, 22 bp, Homo sapiens
tgacatctgccagtttggtcgt

SEQ ID NO: 7906325 - DNA, 23 bp, Homo sapiens
ccagggcccctacaccactgtcc

SEQ ID NO: 7906326 - DNA, 23 bp, Homo sapiens
ccagggcccctacaccactgtcc

SEQ ID NO: 7906327 - DNA, 23 bp, Homo sapiens
ccagggcccctacaccactgtcc

SEQ ID NO: 7906328 - DNA, 22 bp, Homo sapiens
tgacatctcattttgttgttgt

SEQ ID NO: 7906329 - DNA, 23 bp, Homo sapiens
ccagggcccctacaccactgtcc

SEQ ID NO: 7906330 - DNA, 23 bp, Homo sapiens
ccagggcccctacaccactgtcc

SEQ ID NO: 7906331 - DNA, 22 bp, Homo sapiens
ccagggccaagagacctcgagg

SEQ ID NO: 7906332 - DNA, 22 bp, Homo sapiens
ccagggccagtaagattggcat

SEQ ID NO: 7906333 - DNA, 22 bp, Homo sapiens
ccagggccagtaagattggcat

SEQ ID NO: 7906334 - DNA, 22 bp, Homo sapiens
ccagggccagtaagattggcat

SEQ ID NO: 7906335 - DNA, 22 bp, Homo sapiens
ccagggccagtaagattggcat

SEQ ID NO: 7906336 - DNA, 22 bp, Homo sapiens
ccagggccagtaagattggcat

SEQ ID NO: 7906337 - DNA, 22 bp, Homo sapiens
ccagggcccacggccagaatag

SEQ ID NO: 7906338 - DNA, 23 bp, Homo sapiens
ccagggcccctacaccactgtcc

SEQ ID NO: 7906339 - DNA, 23 bp, Homo sapiens
ccagggcccctacaccactgtcc

SEQ ID NO: 7906340 - DNA, 23 bp, Homo sapiens
ccagggcccctacaccactgtcc

SEQ ID NO: 7906341 - DNA, 22 bp, Homo sapiens
ccagggcccacggccagaatag

SEQ ID NO: 7906342 - DNA, 22 bp, Homo sapiens
ccagggcccacggccagaatag

SEQ ID NO: 7906343 - DNA, 22 bp, Homo sapiens
ccagggcccacggccagaatag

SEQ ID NO: 7906344 - DNA, 22 bp, Homo sapiens
ccagggcccacggccagaatag

SEQ ID NO: 7906345 - DNA, 22 bp, Homo sapiens
ccagggcccacggccagaatag

SEQ ID NO: 7906346 - DNA, 22 bp, Homo sapiens
ccagggcccacggccagaatag

SEQ ID NO: 7906347 - DNA, 22 bp, Homo sapiens
tgacagagcatgtagtgacagc

SEQ ID NO: 7906348 - DNA, 22 bp, Homo sapiens
tgacagagcatgtagtgacagc

SEQ ID NO: 7906349 - DNA, 22 bp, Homo sapiens
tgacagagcatgtagtgacagc

SEQ ID NO: 7906350 - DNA, 22 bp, Homo sapiens
tgacagagcatgtagtgacagc

SEQ ID NO: 7906351 - DNA, 22 bp, Homo sapiens
tgacagagcatgtagtgacagc

SEQ ID NO: 7906352 - DNA, 22 bp, Homo sapiens
tgacagagcatgtagtgacagc

SEQ ID NO: 7906353 - DNA, 22 bp, Homo sapiens
tgacagaggagctggaatgatt

SEQ ID NO: 7906354 - DNA, 22 bp, Homo sapiens
tgacagagccaagatcagtact

SEQ ID NO: 7906355 - DNA, 22 bp, Homo sapiens
tgacagagccaagatcagtact

SEQ ID NO: 7906356 - DNA, 22 bp, Homo sapiens
tgacagagccaagatcagtact

SEQ ID NO: 7906357 - DNA, 22 bp, Homo sapiens
tgacagagagcttttgactgtc

SEQ ID NO: 7906358 - DNA, 22 bp, Homo sapiens
tgacagagaggtaagttatgaa

SEQ ID NO: 7906359 - DNA, 22 bp, Homo sapiens
tgacagagaggtaagttatgaa

SEQ ID NO: 7906360 - DNA, 19 bp, Homo sapiens
tgacagagagcagggtggt

SEQ ID NO: 7906361 - DNA, 22 bp, Homo sapiens
tgacagagcaagatctagataa

SEQ ID NO: 7906362 - DNA, 22 bp, Homo sapiens
ccagggccaagagacctcgagg

SEQ ID NO: 7906363 - DNA, 22 bp, Homo sapiens
ccagggccaagagacctcgagg

SEQ ID NO: 7906364 - DNA, 22 bp, Homo sapiens
ccagggccaagagacctcgagg

SEQ ID NO: 7906365 - DNA, 22 bp, Homo sapiens
ccagggccaagagacctcgagg

SEQ ID NO: 7906366 - DNA, 22 bp, Homo sapiens
ccagggcatgtccaagacttag

SEQ ID NO: 7906367 - DNA, 22 bp, Homo sapiens
ccagggcatgtaactaatggtg

SEQ ID NO: 7906368 - DNA, 22 bp, Homo sapiens
tgacagagtccagaagtagtgt

SEQ ID NO: 7906369 - DNA, 22 bp, Homo sapiens
tgacagagtcggggcaagctgt

SEQ ID NO: 7906370 - DNA, 22 bp, Homo sapiens
ccagggcatgggaagaactgaa

SEQ ID NO: 7906371 - DNA, 22 bp, Homo sapiens
ccagggcatgggaagaactgaa

SEQ ID NO: 7906372 - DNA, 22 bp, Homo sapiens
ccaggctttcccagcctctcca

SEQ ID NO: 7906373 - DNA, 19 bp, Homo sapiens
ccaggctttatgcaaatac

SEQ ID NO: 7906374 - DNA, 22 bp, Homo sapiens
ccaggctttcccagcctctcca

SEQ ID NO: 7906375 - DNA, 22 bp, Homo sapiens
ccaggctttcccagcctctcca

SEQ ID NO: 7906376 - DNA, 22 bp, Homo sapiens
ccaggctttctcctgactcaca

SEQ ID NO: 7906377 - DNA, 22 bp, Homo sapiens
ccaggcttttagctgcatggca

SEQ ID NO: 7906378 - DNA, 22 bp, Homo sapiens
ccaggctttctcctgactcaca

SEQ ID NO: 7906379 - DNA, 22 bp, Homo sapiens
ccagggaaaatcaacttctact

SEQ ID NO: 7906380 - DNA, 22 bp, Homo sapiens
ccaggcttttctcatggagtca

SEQ ID NO: 7906381 - DNA, 22 bp, Homo sapiens
ccaggcttttagctgcatggca

SEQ ID NO: 7906382 - DNA, 22 bp, Homo sapiens
ccaggcttttctcatggagtca

SEQ ID NO: 7906383 - DNA, 22 bp, Homo sapiens
ccagggaaaatcaacttctact

SEQ ID NO: 7906384 - DNA, 22 bp, Homo sapiens
ccagggaaacagcccagtgtga

SEQ ID NO: 7906385 - DNA, 22 bp, Homo sapiens
ccagggaaacagcccagtgtga

SEQ ID NO: 7906386 - DNA, 22 bp, Homo sapiens
ccagggaaacagcccagtgtga

SEQ ID NO: 7906387 - DNA, 22 bp, Homo sapiens
ccagggaaactttggagtggag

SEQ ID NO: 7906388 - DNA, 22 bp, Homo sapiens
ccaggcttggtgtgtggtcagg

SEQ ID NO: 7906389 - DNA, 19 bp, Homo sapiens
ccaggctttatgcaaatac

SEQ ID NO: 7906390 - DNA, 22 bp, Homo sapiens
ccaggctttaagaggtggaaac

SEQ ID NO: 7906391 - DNA, 22 bp, Homo sapiens
tgaaggagaattaataggcatt

SEQ ID NO: 7906392 - DNA, 21 bp, Homo sapiens
tgaaggagaggaccgagtgct

SEQ ID NO: 7906393 - DNA, 21 bp, Homo sapiens
tgaaggagaggaccgagtgct

SEQ ID NO: 7906394 - DNA, 21 bp, Homo sapiens
tgaaggagaggaccgagtgct

SEQ ID NO: 7906395 - DNA, 22 bp, Homo sapiens
tgaaggagaattaataggcatt

SEQ ID NO: 7906396 - DNA, 22 bp, Homo sapiens
tgaaggagaattaataggcatt

SEQ ID NO: 7906397 - DNA, 22 bp, Homo sapiens
tgacagagacttcagagccaaa

SEQ ID NO: 7906398 - DNA, 22 bp, Homo sapiens
tgacagagagatgggaaagggc

SEQ ID NO: 7906399 - DNA, 22 bp, Homo sapiens
tgacagagacttcagagccaaa

SEQ ID NO: 7906400 - DNA, 22 bp, Homo sapiens
tgacagagacttcagagccaaa

SEQ ID NO: 7906401 - DNA, 22 bp, Homo sapiens
tgacaatggggcacatggaaag

SEQ ID NO: 7906402 - DNA, 22 bp, Homo sapiens
tgacaatgggtggacaagatag

SEQ ID NO: 7906403 - DNA, 21 bp, Homo sapiens
ccagggaagaaatgagggcag

SEQ ID NO: 7906404 - DNA, 21 bp, Homo sapiens
ccagggaagaaatgagggcag

SEQ ID NO: 7906405 - DNA, 21 bp, Homo sapiens
ccagggaagaaatgagggcag

SEQ ID NO: 7906406 - DNA, 21 bp, Homo sapiens
ccagggaagaaatgagggcag

SEQ ID NO: 7906407 - DNA, 22 bp, Homo sapiens
ccagggaagaataggtgtggtt

SEQ ID NO: 7906408 - DNA, 22 bp, Homo sapiens
ccagggaagaccacttcctgga

SEQ ID NO: 7906409 - DNA, 22 bp, Homo sapiens
ccagggaagaataggtgtggtt

SEQ ID NO: 7906410 - DNA, 22 bp, Homo sapiens
ccagggaagaataggtgtggtt

SEQ ID NO: 7906411 - DNA, 21 bp, Homo sapiens
ccagggaagaaatgagggcag

SEQ ID NO: 7906412 - DNA, 22 bp, Homo sapiens
ccagggaaattaatgagttaat

SEQ ID NO: 7906413 - DNA, 22 bp, Homo sapiens
ccagggaaattaatgagttaat

SEQ ID NO: 7906414 - DNA, 22 bp, Homo sapiens
ccagggaagaaagatgaagtgc

SEQ ID NO: 7906415 - DNA, 22 bp, Homo sapiens
ccagggaagaaagatgaagtgc

SEQ ID NO: 7906416 - DNA, 22 bp, Homo sapiens
ccagggaagaaagatgaagtgc

SEQ ID NO: 7906417 - DNA, 22 bp, Homo sapiens
ccagggaagaaagatgaagtgc

SEQ ID NO: 7906418 - DNA, 22 bp, Homo sapiens
ccagggaagaaagatgaagtgc

SEQ ID NO: 7906419 - DNA, 22 bp, Homo sapiens
ccagggaaaggaggttgacttg

SEQ ID NO: 7906420 - DNA, 22 bp, Homo sapiens
ccagggaaaggaggttgacttg

SEQ ID NO: 7906421 - DNA, 22 bp, Homo sapiens
ccagggaaactttggagtggag

SEQ ID NO: 7906422 - DNA, 22 bp, Homo sapiens
ccagggaaaatcaacttctact

SEQ ID NO: 7906423 - DNA, 22 bp, Homo sapiens
ccagggaaactttggagtggag

SEQ ID NO: 7906424 - DNA, 22 bp, Homo sapiens
ccagggaaactttggagtggag

SEQ ID NO: 7906425 - DNA, 22 bp, Homo sapiens
ccagggaaactttggagtggag

SEQ ID NO: 7906426 - DNA, 22 bp, Homo sapiens
tgagcagaaaagaatgctgagc

SEQ ID NO: 7906427 - DNA, 22 bp, Homo sapiens
tgagcagaacacgggatccatg

SEQ ID NO: 7906428 - DNA, 22 bp, Homo sapiens
tgagcagaaaagaatgctgagc

SEQ ID NO: 7906429 - DNA, 22 bp, Homo sapiens
tgagcagaaaagaatgctgagc

SEQ ID NO: 7906430 - DNA, 22 bp, Homo sapiens
tgagcagaaaagaatgctgagc

SEQ ID NO: 7906431 - DNA, 22 bp, Homo sapiens
tgagcagaaaagaatgctgagc

SEQ ID NO: 7906432 - DNA, 22 bp, Homo sapiens
tgagcacttttcaaagagagct

SEQ ID NO: 7906433 - DNA, 22 bp, Homo sapiens
tgagcaccttgtgactggctgc

SEQ ID NO: 7906434 - DNA, 22 bp, Homo sapiens
tgagcagaagccctcctggact

SEQ ID NO: 7906435 - DNA, 22 bp, Homo sapiens
tgagcagaagccctcctggact

SEQ ID NO: 7906436 - DNA, 22 bp, Homo sapiens
tgagcagaagccctcctggact

SEQ ID NO: 7906437 - DNA, 22 bp, Homo sapiens
tgagcagaacacgggatccatg

SEQ ID NO: 7906438 - DNA, 22 bp, Homo sapiens
tgagcagaagattggaacttac

SEQ ID NO: 7906439 - DNA, 22 bp, Homo sapiens
tgagcagaagattggaacttac

SEQ ID NO: 7906440 - DNA, 22 bp, Homo sapiens
tgagcagacttgatgaggcagc

SEQ ID NO: 7906441 - DNA, 22 bp, Homo sapiens
tgagcagacttgatgaggcagc

SEQ ID NO: 7906442 - DNA, 22 bp, Homo sapiens
tgagcagacttgatgaggcagc

SEQ ID NO: 7906443 - DNA, 22 bp, Homo sapiens
tgagcagacttgatgaggcagc

SEQ ID NO: 7906444 - DNA, 22 bp, Homo sapiens
tgagcccaggagttggagaccg

SEQ ID NO: 7906445 - DNA, 22 bp, Homo sapiens
tgagcccaggagttggaggctg

SEQ ID NO: 7906446 - DNA, 22 bp, Homo sapiens
tgagcccaggagttggaggctg

SEQ ID NO: 7906447 - DNA, 22 bp, Homo sapiens
tgagcagagacgggggcctcca

SEQ ID NO: 7906448 - DNA, 22 bp, Homo sapiens
tgagcagactctgcagagccac

SEQ ID NO: 7906449 - DNA, 22 bp, Homo sapiens
tgagcagactctgcagagccac

SEQ ID NO: 7906450 - DNA, 22 bp, Homo sapiens
tgagcagactctgcagagccac

SEQ ID NO: 7906451 - DNA, 22 bp, Homo sapiens
tgagcagaagttataaataaga

SEQ ID NO: 7906452 - DNA, 22 bp, Homo sapiens
tgagcagaagttataaataaga

SEQ ID NO: 7906453 - DNA, 22 bp, Homo sapiens
tgagcagaatgttcagataaat

SEQ ID NO: 7906454 - DNA, 22 bp, Homo sapiens
tgagcagaatgttcagataaat

SEQ ID NO: 7906455 - DNA, 22 bp, Homo sapiens
tgagcagaatgttcagataaat

SEQ ID NO: 7906456 - DNA, 22 bp, Homo sapiens
tgagctgggaagagcagccaga

SEQ ID NO: 7906457 - DNA, 22 bp, Homo sapiens
tgagctgggaagagcagccaga

SEQ ID NO: 7906458 - DNA, 22 bp, Homo sapiens
tgagctgggagtggtgatgagg

SEQ ID NO: 7906459 - DNA, 22 bp, Homo sapiens
tgagctgggaagagcagccaga

SEQ ID NO: 7906460 - DNA, 22 bp, Homo sapiens
tgagctgggagtggtgatgagg

SEQ ID NO: 7906461 - DNA, 22 bp, Homo sapiens
tgagctgggagtggtgatgagg

SEQ ID NO: 7906462 - DNA, 22 bp, Homo sapiens
tgagctgggagtggtgatgagg

SEQ ID NO: 7906463 - DNA, 22 bp, Homo sapiens
tgagctgggagtggtgatgagg

SEQ ID NO: 7906464 - DNA, 21 bp, Homo sapiens
tgagctgggagttctgaaaag

SEQ ID NO: 7906465 - DNA, 21 bp, Homo sapiens
tgagctgggagttctgaaaag

SEQ ID NO: 7906466 - DNA, 21 bp, Homo sapiens
tgagctgggagttctgaaaag

SEQ ID NO: 7906467 - DNA, 21 bp, Homo sapiens
tgagctgggagttctgaaaag

SEQ ID NO: 7906468 - DNA, 22 bp, Homo sapiens
tgagctggcttgtcaaccaggg

SEQ ID NO: 7906469 - DNA, 22 bp, Homo sapiens
tgagctgggaagagcagccaga

SEQ ID NO: 7906470 - DNA, 22 bp, Homo sapiens
tgagctgggaagagcagccaga

SEQ ID NO: 7906471 - DNA, 22 bp, Homo sapiens
tgagctgggaagagcagccaga

SEQ ID NO: 7906472 - DNA, 22 bp, Homo sapiens
tgagctgggaagagcagccaga

SEQ ID NO: 7906473 - DNA, 19 bp, Homo sapiens
tgagctggctgagcctctc

SEQ ID NO: 7906474 - DNA, 22 bp, Homo sapiens
tgagctggcttgtcaaccaggg

SEQ ID NO: 7906475 - DNA, 22 bp, Homo sapiens
tgagctggcttgtcaaccaggg

SEQ ID NO: 7906476 - DNA, 22 bp, Homo sapiens
tgagctggcttgtcaaccaggg

SEQ ID NO: 7906477 - DNA, 22 bp, Homo sapiens
tgagctggcttgtcaaccaggg

SEQ ID NO: 7906478 - DNA, 22 bp, Homo sapiens
tgagctggcaggggctcaggga

SEQ ID NO: 7906479 - DNA, 19 bp, Homo sapiens
tgagctggctgagcctctc

SEQ ID NO: 7906480 - DNA, 19 bp, Homo sapiens
tgagctggctgagcctctc

SEQ ID NO: 7906481 - DNA, 19 bp, Homo sapiens
tgagctggctgagcctctc

SEQ ID NO: 7906482 - DNA, 19 bp, Homo sapiens
tgagctggctgagcctctc

SEQ ID NO: 7906483 - DNA, 22 bp, Homo sapiens
tgagctggcaggggctcaggga

SEQ ID NO: 7906484 - DNA, 22 bp, Homo sapiens
tgagctggcaggggctcaggga

SEQ ID NO: 7906485 - DNA, 22 bp, Homo sapiens
tgagctggcaggggctcaggga

SEQ ID NO: 7906486 - DNA, 22 bp, Homo sapiens
tgagctggcaggggctcaggga

SEQ ID NO: 7906487 - DNA, 22 bp, Homo sapiens
tgagctggcaggggctcaggga

SEQ ID NO: 7906488 - DNA, 22 bp, Homo sapiens
tgagctggcaggggctcaggga

SEQ ID NO: 7906489 - DNA, 22 bp, Homo sapiens
tgagctggcacttttcctggga

SEQ ID NO: 7906490 - DNA, 22 bp, Homo sapiens
tgagctggcacttttcctggga

SEQ ID NO: 7906491 - DNA, 22 bp, Homo sapiens
tgagctggcaggggctcaggga

SEQ ID NO: 7906492 - DNA, 22 bp, Homo sapiens
tgagctggcaggggctcaggga

SEQ ID NO: 7906493 - DNA, 22 bp, Homo sapiens
tgagcccaggagttggaggctg

SEQ ID NO: 7906494 - DNA, 22 bp, Homo sapiens
tgagcccagtctgtctgacatg

SEQ ID NO: 7906495 - DNA, 22 bp, Homo sapiens
tgagctggcacttttcctggga

SEQ ID NO: 7906496 - DNA, 22 bp, Homo sapiens
tgaggacattaggaagtgaagg

SEQ ID NO: 7906497 - DNA, 22 bp, Homo sapiens
tgaggacattgagactggagac

SEQ ID NO: 7906498 - DNA, 22 bp, Homo sapiens
tgaggacattgagactggagac

SEQ ID NO: 7906499 - DNA, 22 bp, Homo sapiens
tgaggacattgagactggagac

SEQ ID NO: 7906500 - DNA, 22 bp, Homo sapiens
tgaggacatgagtgggacagag

SEQ ID NO: 7906501 - DNA, 22 bp, Homo sapiens
tgaggacatgagtgggacagag

SEQ ID NO: 7906502 - DNA, 22 bp, Homo sapiens
tgaggacatgagtgggacagag

SEQ ID NO: 7906503 - DNA, 22 bp, Homo sapiens
tgaggacatgagtgggacagag

SEQ ID NO: 7906504 - DNA, 22 bp, Homo sapiens
tgaggacattaggaagtgaagg

SEQ ID NO: 7906505 - DNA, 22 bp, Homo sapiens
tgaggacattggtcaggacatg

SEQ ID NO: 7906506 - DNA, 22 bp, Homo sapiens
tgaggacattggtcaggacatg

SEQ ID NO: 7906507 - DNA, 23 bp, Homo sapiens
ccagtggcgtaaactagaggata

SEQ ID NO: 7906508 - DNA, 22 bp, Homo sapiens
tgaggacatttatcttggcgca

SEQ ID NO: 7906509 - DNA, 22 bp, Homo sapiens
tgaggacatttatcttggcgca

SEQ ID NO: 7906510 - DNA, 23 bp, Homo sapiens
ccagtggcgtaaactagaggata

SEQ ID NO: 7906511 - DNA, 22 bp, Homo sapiens
ccagtggctacaggggggttga

SEQ ID NO: 7906512 - DNA, 22 bp, Homo sapiens
ccagtgtggactctctcctttg

SEQ ID NO: 7906513 - DNA, 22 bp, Homo sapiens
ccagtgtgccaatttacagctg

SEQ ID NO: 7906514 - DNA, 22 bp, Homo sapiens
ccagtgtgccaatttacagctg

SEQ ID NO: 7906515 - DNA, 22 bp, Homo sapiens
ccagtgggaacactggcattgc

SEQ ID NO: 7906516 - DNA, 22 bp, Homo sapiens
tgaggaatgctgagcagaggaa

SEQ ID NO: 7906517 - DNA, 22 bp, Homo sapiens
tgaggacaatccctaactcaga

SEQ ID NO: 7906518 - DNA, 22 bp, Homo sapiens
tgaggacatgagtgggacagag

SEQ ID NO: 7906519 - DNA, 22 bp, Homo sapiens
tgaggacaatccctaactcaga

SEQ ID NO: 7906520 - DNA, 23 bp, Homo sapiens
tgagctggtattgtccatctcca

SEQ ID NO: 7906521 - DNA, 23 bp, Homo sapiens
tgagctggtattgtccatctcca

SEQ ID NO: 7906522 - DNA, 22 bp, Homo sapiens
tgagctggtcactccttctgaa

SEQ ID NO: 7906523 - DNA, 23 bp, Homo sapiens
tgagctggtattgtccatctcca

SEQ ID NO: 7906524 - DNA, 22 bp, Homo sapiens
tgaggaagttgtttctcttcta

SEQ ID NO: 7906525 - DNA, 22 bp, Homo sapiens
tgaggaatgctgagcagaggaa

SEQ ID NO: 7906526 - DNA, 22 bp, Homo sapiens
tgaggaagttgtttctcttcta

SEQ ID NO: 7906527 - DNA, 23 bp, Homo sapiens
tgagctgggcctgcaggggtctc

SEQ ID NO: 7906528 - DNA, 23 bp, Homo sapiens
tgagctgggcctgcaggggtctc

SEQ ID NO: 7906529 - DNA, 23 bp, Homo sapiens
tgagctgggcctgcaggggtctc

SEQ ID NO: 7906530 - DNA, 23 bp, Homo sapiens
tgagctgggcctgcaggggtctc

SEQ ID NO: 7906531 - DNA, 23 bp, Homo sapiens
tgagctgggcctgcaggggtctc

SEQ ID NO: 7906532 - DNA, 22 bp, Homo sapiens
tgagctgggctgggctgagctg

SEQ ID NO: 7906533 - DNA, 22 bp, Homo sapiens
tgagctgggctgggctgagctg

SEQ ID NO: 7906534 - DNA, 23 bp, Homo sapiens
tgagctgggcctgcaggggtctc

SEQ ID NO: 7906535 - DNA, 22 bp, Homo sapiens
tgagctgggctgggctgagctg

SEQ ID NO: 7906536 - DNA, 22 bp, Homo sapiens
tgagctgggctgggctgagctg

SEQ ID NO: 7906537 - DNA, 22 bp, Homo sapiens
tgagctgggctgggctgagctg

SEQ ID NO: 7906538 - DNA, 22 bp, Homo sapiens
tgagctgggctgggctgagctg

SEQ ID NO: 7906539 - DNA, 22 bp, Homo sapiens
tgagctggggtcagctcccctg

SEQ ID NO: 7906540 - DNA, 22 bp, Homo sapiens
tgagctggggtcagctcccctg

SEQ ID NO: 7906541 - DNA, 22 bp, Homo sapiens
tgagctggggtcagctcccctg

SEQ ID NO: 7906542 - DNA, 23 bp, Homo sapiens
tgagctggtattgtccatctcca

SEQ ID NO: 7906543 - DNA, 18 bp, Homo sapiens
tgagagtgtgtgctcttg

SEQ ID NO: 7906544 - DNA, 22 bp, Homo sapiens
tgagagttattctgaatttagc

SEQ ID NO: 7906545 - DNA, 22 bp, Homo sapiens
tgagagtggttcagctcagaag

SEQ ID NO: 7906546 - DNA, 22 bp, Homo sapiens
tgagagtgccttgtaaacctgc

SEQ ID NO: 7906547 - DNA, 19 bp, Homo sapiens
tgagagtgaggaaggcttc

SEQ ID NO: 7906548 - DNA, 22 bp, Homo sapiens
tgagagtgaaatgtcacatgtc

SEQ ID NO: 7906549 - DNA, 22 bp, Homo sapiens
tgagagtggttcagctcagaag

SEQ ID NO: 7906550 - DNA, 19 bp, Homo sapiens
tgagagtgaggaaggcttc

SEQ ID NO: 7906551 - DNA, 22 bp, Homo sapiens
tgagagtgattggttcgaatgt

SEQ ID NO: 7906552 - DNA, 22 bp, Homo sapiens
tgagagtgaaatgtcacatgtc

SEQ ID NO: 7906553 - DNA, 22 bp, Homo sapiens
tgagagtctgttcctcttgcag

SEQ ID NO: 7906554 - DNA, 22 bp, Homo sapiens
tgagagtctgttcctcttgcag

SEQ ID NO: 7906555 - DNA, 22 bp, Homo sapiens
tgagagtctcagacctcctggt

SEQ ID NO: 7906556 - DNA, 22 bp, Homo sapiens
tgagagtacttatatgaacatt

SEQ ID NO: 7906557 - DNA, 22 bp, Homo sapiens
tgagagtattttggcattatca

SEQ ID NO: 7906558 - DNA, 22 bp, Homo sapiens
tgagagtctcagacctcctggt

SEQ ID NO: 7906559 - DNA, 22 bp, Homo sapiens
tgagagtattttggcattatca

SEQ ID NO: 7906560 - DNA, 22 bp, Homo sapiens
ccaggtcctgttttcaccacag

SEQ ID NO: 7906561 - DNA, 22 bp, Homo sapiens
ccaggtctatcaagttgggctc

SEQ ID NO: 7906562 - DNA, 22 bp, Homo sapiens
ccaggtctatcaagttgggctc

SEQ ID NO: 7906563 - DNA, 22 bp, Homo sapiens
ccaggtcctgttttcaccacag

SEQ ID NO: 7906564 - DNA, 22 bp, Homo sapiens
ccaggtctatcaagttgggctc

SEQ ID NO: 7906565 - DNA, 22 bp, Homo sapiens
ccaggtctatcaagttgggctc

SEQ ID NO: 7906566 - DNA, 19 bp, Homo sapiens
tgagactgggtgcagtact

SEQ ID NO: 7906567 - DNA, 22 bp, Homo sapiens
tgagagtagagtcttcatctgt

SEQ ID NO: 7906568 - DNA, 22 bp, Homo sapiens
tgagaggtgaggcatgaggcat

SEQ ID NO: 7906569 - DNA, 22 bp, Homo sapiens
tgagaggtcattaggccatgag

SEQ ID NO: 7906570 - DNA, 19 bp, Homo sapiens
tgagactgggtgcagtact

SEQ ID NO: 7906571 - DNA, 22 bp, Homo sapiens
tgagacttaagaggtcatgttg

SEQ ID NO: 7906572 - DNA, 22 bp, Homo sapiens
tgagacttcctgatgaggcccg

SEQ ID NO: 7906573 - DNA, 22 bp, Homo sapiens
tgagataactctgatttatgtt

SEQ ID NO: 7906574 - DNA, 22 bp, Homo sapiens
tgagagttttgacgcttgtaac

SEQ ID NO: 7906575 - DNA, 22 bp, Homo sapiens
tgagagttctctcttcaggtgg

SEQ ID NO: 7906576 - DNA, 22 bp, Homo sapiens
tgagagttcctcctctttccac

SEQ ID NO: 7906577 - DNA, 22 bp, Homo sapiens
tgagataacaaaattatcttca

SEQ ID NO: 7906578 - DNA, 22 bp, Homo sapiens
tgagagttttgacgcttgtaac

SEQ ID NO: 7906579 - DNA, 21 bp, Homo sapiens
tgagataaatttccttactac

SEQ ID NO: 7906580 - DNA, 22 bp, Homo sapiens
tgagcacctactgtattccagg

SEQ ID NO: 7906581 - DNA, 22 bp, Homo sapiens
tgagcacctactgtattccagg

SEQ ID NO: 7906582 - DNA, 22 bp, Homo sapiens
tgagcaccgccgcatttccaag

SEQ ID NO: 7906583 - DNA, 23 bp, Homo sapiens
tgagcacctaatgctgggcactg

SEQ ID NO: 7906584 - DNA, 23 bp, Homo sapiens
tgagcacctaatgctgggcactg

SEQ ID NO: 7906585 - DNA, 22 bp, Homo sapiens
tgagataaggatgttatactcg

SEQ ID NO: 7906586 - DNA, 22 bp, Homo sapiens
tgagataataaatagctttctt

SEQ ID NO: 7906587 - DNA, 22 bp, Homo sapiens
ccaggtcaagctcccctgtggt

SEQ ID NO: 7906588 - DNA, 22 bp, Homo sapiens
ccaggtcaagctcccctgtggt

SEQ ID NO: 7906589 - DNA, 22 bp, Homo sapiens
ccaggtcaagctcccctgtggt

SEQ ID NO: 7906590 - DNA, 22 bp, Homo sapiens
ccaggtccctggaatttatgag

SEQ ID NO: 7906591 - DNA, 22 bp, Homo sapiens
ccaggtaaattacctactgaat

SEQ ID NO: 7906592 - DNA, 22 bp, Homo sapiens
ccaggtagccaaggggtctggg

SEQ ID NO: 7906593 - DNA, 22 bp, Homo sapiens
ccaggtaggagagagggatcct

SEQ ID NO: 7906594 - DNA, 22 bp, Homo sapiens
ccaggtaggagagtcaacatgt

SEQ ID NO: 7906595 - DNA, 22 bp, Homo sapiens
ccaggtaggagagtcaacatgt

SEQ ID NO: 7906596 - DNA, 22 bp, Homo sapiens
ccaggtaacttgagaacatgag

SEQ ID NO: 7906597 - DNA, 22 bp, Homo sapiens
ccagggtttttccagttgctca

SEQ ID NO: 7906598 - DNA, 22 bp, Homo sapiens
ccagggtttcttctctgtatag

SEQ ID NO: 7906599 - DNA, 22 bp, Homo sapiens
ccagggtttagcaagcctacaa

SEQ ID NO: 7906600 - DNA, 22 bp, Homo sapiens
ccagggtttaaattctgactat

SEQ ID NO: 7906601 - DNA, 22 bp, Homo sapiens
ccagggtttaaattctgactat

SEQ ID NO: 7906602 - DNA, 22 bp, Homo sapiens
ccagggttggtattcacctgga

SEQ ID NO: 7906603 - DNA, 22 bp, Homo sapiens
ccagggttggtctctctgaggt

SEQ ID NO: 7906604 - DNA, 22 bp, Homo sapiens
ccagggttgcagggagccagca

SEQ ID NO: 7906605 - DNA, 22 bp, Homo sapiens
ccagggtgtgggcgtcggcacg

SEQ ID NO: 7906606 - DNA, 22 bp, Homo sapiens
ccagggttggtattcacctgga

SEQ ID NO: 7906607 - DNA, 22 bp, Homo sapiens
ccagggttggcaagcaaggctt

SEQ ID NO: 7906608 - DNA, 22 bp, Homo sapiens
ccagggttggatgagtcactta

SEQ ID NO: 7906609 - DNA, 22 bp, Homo sapiens
ccagggttggatgagtcactta

SEQ ID NO: 7906610 - DNA, 22 bp, Homo sapiens
ccagggttgctgtatggcactt

SEQ ID NO: 7906611 - DNA, 22 bp, Homo sapiens
ccagggtggcgtagatgctggg

SEQ ID NO: 7906612 - DNA, 22 bp, Homo sapiens
ccagggtggcgtagatgctggg

SEQ ID NO: 7906613 - DNA, 22 bp, Homo sapiens
ccagggtggcgtagatgctggg

SEQ ID NO: 7906614 - DNA, 22 bp, Homo sapiens
ccagggtgggaggctgaaggcg

SEQ ID NO: 7906615 - DNA, 22 bp, Homo sapiens
ccagggtggcgtagatgctggg

SEQ ID NO: 7906616 - DNA, 22 bp, Homo sapiens
ccagggtgggaggctgaaggcg

SEQ ID NO: 7906617 - DNA, 22 bp, Homo sapiens
ccagggtgggaggctgaaggcg

SEQ ID NO: 7906618 - DNA, 22 bp, Homo sapiens
ccagggtggggcaggcccactg

SEQ ID NO: 7906619 - DNA, 22 bp, Homo sapiens
ccagggtgtagggattccagat

SEQ ID NO: 7906620 - DNA, 22 bp, Homo sapiens
ccagggtgtgagaaggaagtag

SEQ ID NO: 7906621 - DNA, 22 bp, Homo sapiens
ccagggtgtagggattccagat

SEQ ID NO: 7906622 - DNA, 22 bp, Homo sapiens
ccagggtgtgagaaggaagtag

SEQ ID NO: 7906623 - DNA, 22 bp, Homo sapiens
ccagggtggggtccaggaacca

SEQ ID NO: 7906624 - DNA, 22 bp, Homo sapiens
ccagggtgtagggattccagat

SEQ ID NO: 7906625 - DNA, 22 bp, Homo sapiens
ccagggtggggtccaggaacca

SEQ ID NO: 7906626 - DNA, 22 bp, Homo sapiens
ccagggtggggtccaggaacca

SEQ ID NO: 7906627 - DNA, 22 bp, Homo sapiens
ccagggtggggtccaggaacca

SEQ ID NO: 7906628 - DNA, 22 bp, Homo sapiens
ccagggtggggtccaggaacca

SEQ ID NO: 7906629 - DNA, 22 bp, Homo sapiens
ccagggtggggtccaggaacca

SEQ ID NO: 7906630 - DNA, 22 bp, Homo sapiens
ccaggctagagagcagtggcac

SEQ ID NO: 7906631 - DNA, 22 bp, Homo sapiens
ccaggctagaaactgaggcaca

SEQ ID NO: 7906632 - DNA, 19 bp, Homo sapiens
ccaggcctggcgtctccgc

SEQ ID NO: 7906633 - DNA, 19 bp, Homo sapiens
ccaggcctggcgtctccgc

SEQ ID NO: 7906634 - DNA, 19 bp, Homo sapiens
ccaggcctggcgtctccgc

SEQ ID NO: 7906635 - DNA, 22 bp, Homo sapiens
tctttcaaagtaacaaccacga

SEQ ID NO: 7906636 - DNA, 19 bp, Homo sapiens
ccaggcctggcgtctccgc

SEQ ID NO: 7906637 - DNA, 19 bp, Homo sapiens
ccaggcctggcgtctccgc

SEQ ID NO: 7906638 - DNA, 19 bp, Homo sapiens
ccaggcctggcgtctccgc

SEQ ID NO: 7906639 - DNA, 22 bp, Homo sapiens
tctttcaaatgcttgaattgga

SEQ ID NO: 7906640 - DNA, 19 bp, Homo sapiens
ccaggcctggcgtctccgc

SEQ ID NO: 7906641 - DNA, 22 bp, Homo sapiens
tctttcaaagctgtagtagatt

SEQ ID NO: 7906642 - DNA, 22 bp, Homo sapiens
tctttcaaagtaacaaccacga

SEQ ID NO: 7906643 - DNA, 22 bp, Homo sapiens
tctttcaaagctgtagtagatt

SEQ ID NO: 7906644 - DNA, 22 bp, Homo sapiens
tctttattttatgcttgtgcaa

SEQ ID NO: 7906645 - DNA, 22 bp, Homo sapiens
tctttattttatgcttgtgcaa

SEQ ID NO: 7906646 - DNA, 22 bp, Homo sapiens
tctttattttatgcttgtgcaa

SEQ ID NO: 7906647 - DNA, 22 bp, Homo sapiens
tctttattttatgcttgtgcaa

SEQ ID NO: 7906648 - DNA, 22 bp, Homo sapiens
tctttattttatgcttgtgcaa

SEQ ID NO: 7906649 - DNA, 22 bp, Homo sapiens
tctttattttatgcttgtgcaa

SEQ ID NO: 7906650 - DNA, 22 bp, Homo sapiens
tctttattttatgcttgtgcaa

SEQ ID NO: 7906651 - DNA, 22 bp, Homo sapiens
tctttattttatgcttgtgcaa

SEQ ID NO: 7906652 - DNA, 22 bp, Homo sapiens
tctttattttatgcttgtgcaa

SEQ ID NO: 7906653 - DNA, 22 bp, Homo sapiens
tctttatttctgaatcccccat

SEQ ID NO: 7906654 - DNA, 22 bp, Homo sapiens
tctttatttctgaatcccccat

SEQ ID NO: 7906655 - DNA, 22 bp, Homo sapiens
tctttatttctgaatcccccat

SEQ ID NO: 7906656 - DNA, 22 bp, Homo sapiens
tctttatttctgaatcccccat

SEQ ID NO: 7906657 - DNA, 22 bp, Homo sapiens
tctttattttatgcttgtgcaa

SEQ ID NO: 7906658 - DNA, 22 bp, Homo sapiens
tctttatttctgaatcccccat

SEQ ID NO: 7906659 - DNA, 22 bp, Homo sapiens
tctttatttctgaatcccccat

SEQ ID NO: 7906660 - DNA, 22 bp, Homo sapiens
tctttatttctgaatcccccat

SEQ ID NO: 7906661 - DNA, 22 bp, Homo sapiens
tctttatttctgaatcccccat

SEQ ID NO: 7906662 - DNA, 22 bp, Homo sapiens
tctttatttctgaatcccccat

SEQ ID NO: 7906663 - DNA, 22 bp, Homo sapiens
tctttatttctgaatcccccat

SEQ ID NO: 7906664 - DNA, 22 bp, Homo sapiens
tctttatttaagtctgttgtaa

SEQ ID NO: 7906665 - DNA, 22 bp, Homo sapiens
tctttatttaagtctgttgtaa

SEQ ID NO: 7906666 - DNA, 22 bp, Homo sapiens
tctttatttaagtctgttgtaa

SEQ ID NO: 7906667 - DNA, 22 bp, Homo sapiens
tctttatttaagtctgttgtaa

SEQ ID NO: 7906668 - DNA, 22 bp, Homo sapiens
tctttatttaagtctgttgtaa

SEQ ID NO: 7906669 - DNA, 22 bp, Homo sapiens
tctttatttaagtctgttgtaa

SEQ ID NO: 7906670 - DNA, 22 bp, Homo sapiens
tctttatttaagtctgttgtaa

SEQ ID NO: 7906671 - DNA, 22 bp, Homo sapiens
tctttatttaagtctgttgtaa

SEQ ID NO: 7906672 - DNA, 22 bp, Homo sapiens
tctttatttaagtctgttgtaa

SEQ ID NO: 7906673 - DNA, 22 bp, Homo sapiens
tctttaagagttcatttgcatg

SEQ ID NO: 7906674 - DNA, 18 bp, Homo sapiens
tctttaagttgtcagagt

SEQ ID NO: 7906675 - DNA, 17 bp, Homo sapiens
ccaggctccatcactgt

SEQ ID NO: 7906676 - DNA, 22 bp, Homo sapiens
ccaggctccccaggaggccctt

SEQ ID NO: 7906677 - DNA, 22 bp, Homo sapiens
ccaggctccccaggaggccctt

SEQ ID NO: 7906678 - DNA, 17 bp, Homo sapiens
ccaggctccatcactgt

SEQ ID NO: 7906679 - DNA, 22 bp, Homo sapiens
ccaggctcagggcagactttca

SEQ ID NO: 7906680 - DNA, 17 bp, Homo sapiens
ccaggctccatcactgt

SEQ ID NO: 7906681 - DNA, 17 bp, Homo sapiens
ccaggctccatcactgt

SEQ ID NO: 7906682 - DNA, 22 bp, Homo sapiens
ccaggctcaggcctgctcgttg

SEQ ID NO: 7906683 - DNA, 22 bp, Homo sapiens
ccaggctcaggcctgctcgttg

SEQ ID NO: 7906684 - DNA, 22 bp, Homo sapiens
ccaggctcaggcctgctcgttg

SEQ ID NO: 7906685 - DNA, 22 bp, Homo sapiens
ccaggctcaggcctgctcgttg

SEQ ID NO: 7906686 - DNA, 22 bp, Homo sapiens
ccaggctcaggcctgctcgttg

SEQ ID NO: 7906687 - DNA, 22 bp, Homo sapiens
ccaggctcaggcctgctcgttg

SEQ ID NO: 7906688 - DNA, 22 bp, Homo sapiens
ccaggctcaggcctgctcgttg

SEQ ID NO: 7906689 - DNA, 22 bp, Homo sapiens
ccaggctcagcgcgcacgtctg

SEQ ID NO: 7906690 - DNA, 22 bp, Homo sapiens
ccaggctcagcgcgcacgtctg

SEQ ID NO: 7906691 - DNA, 22 bp, Homo sapiens
ccaggctcagcgcgcacgtctg

SEQ ID NO: 7906692 - DNA, 22 bp, Homo sapiens
ccaggctcagcgcgcacgtctg

SEQ ID NO: 7906693 - DNA, 22 bp, Homo sapiens
ccaggctcagctattaagaaac

SEQ ID NO: 7906694 - DNA, 22 bp, Homo sapiens
ccaggctcagcgcgcacgtctg

SEQ ID NO: 7906695 - DNA, 22 bp, Homo sapiens
ccaggctcacagcatcccagga

SEQ ID NO: 7906696 - DNA, 22 bp, Homo sapiens
ccaggctcacagcatcccagga

SEQ ID NO: 7906697 - DNA, 22 bp, Homo sapiens
ccaggctcacagcatcccagga

SEQ ID NO: 7906698 - DNA, 17 bp, Homo sapiens
ccaggctataccaggct

SEQ ID NO: 7906699 - DNA, 22 bp, Homo sapiens
ccaggctagagtgcagtggcgt

SEQ ID NO: 7906700 - DNA, 22 bp, Homo sapiens
ccaggctagagtgcagtggcat

SEQ ID NO: 7906701 - DNA, 22 bp, Homo sapiens
ccaggctagagagcagtggcat

SEQ ID NO: 7906702 - DNA, 22 bp, Homo sapiens
ccaggctcacctggagcccctg

SEQ ID NO: 7906703 - DNA, 22 bp, Homo sapiens
ccaggctcacctggagcccctg

SEQ ID NO: 7906704 - DNA, 22 bp, Homo sapiens
ccaggctcactgactaccacat

SEQ ID NO: 7906705 - DNA, 22 bp, Homo sapiens
ccaggctcacctggagcccctg

SEQ ID NO: 7906706 - DNA, 22 bp, Homo sapiens
ccaggctcacctggagcccctg

SEQ ID NO: 7906707 - DNA, 22 bp, Homo sapiens
ccaggctcacagcatcccagga

SEQ ID NO: 7906708 - DNA, 22 bp, Homo sapiens
ccaggctcactgactaccacat

SEQ ID NO: 7906709 - DNA, 22 bp, Homo sapiens
ccaggctcagcgcgcacgtctg

SEQ ID NO: 7906710 - DNA, 22 bp, Homo sapiens
ccaggctcagcgcgcacgtctg

SEQ ID NO: 7906711 - DNA, 22 bp, Homo sapiens
ccaggctcagcgcgcacgtctg

SEQ ID NO: 7906712 - DNA, 22 bp, Homo sapiens
ccagcccttgctgaagggtggc

SEQ ID NO: 7906713 - DNA, 22 bp, Homo sapiens
ccagccctttgtggttcactga

SEQ ID NO: 7906714 - DNA, 22 bp, Homo sapiens
ccagccctttgtggttcactga

SEQ ID NO: 7906715 - DNA, 22 bp, Homo sapiens
ccagcccttgctgaagggtggc

SEQ ID NO: 7906716 - DNA, 22 bp, Homo sapiens
ccagcccttgctgaagggtggc

SEQ ID NO: 7906717 - DNA, 22 bp, Homo sapiens
ccagcccttgaggtctgtccat

SEQ ID NO: 7906718 - DNA, 22 bp, Homo sapiens
ccagcctcactggcatcaccta

SEQ ID NO: 7906719 - DNA, 22 bp, Homo sapiens
ccagccggactccacttcccgt

SEQ ID NO: 7906720 - DNA, 22 bp, Homo sapiens
ccagccctttgtggttcactga

SEQ ID NO: 7906721 - DNA, 22 bp, Homo sapiens
ccagcctcactggcatcaccta

SEQ ID NO: 7906722 - DNA, 22 bp, Homo sapiens
ccagcccttgagatggaaggga

SEQ ID NO: 7906723 - DNA, 22 bp, Homo sapiens
ccagcccttgagatggaaggga

SEQ ID NO: 7906724 - DNA, 22 bp, Homo sapiens
ccagcccttgagatggaaggga

SEQ ID NO: 7906725 - DNA, 22 bp, Homo sapiens
ccagcccttgaggtctgtccat

SEQ ID NO: 7906726 - DNA, 22 bp, Homo sapiens
ccagcccttgaggtctgtccat

SEQ ID NO: 7906727 - DNA, 22 bp, Homo sapiens
ccagcccttgaggtctgtccat

SEQ ID NO: 7906728 - DNA, 22 bp, Homo sapiens
ccagcccttgagatggaaggga

SEQ ID NO: 7906729 - DNA, 22 bp, Homo sapiens
tctgcagatttatcagcagctg

SEQ ID NO: 7906730 - DNA, 22 bp, Homo sapiens
tctgcagaggtaatttacagat

SEQ ID NO: 7906731 - DNA, 22 bp, Homo sapiens
tctgcagacaggaagctgaggc

SEQ ID NO: 7906732 - DNA, 22 bp, Homo sapiens
tctgcagacaggaagctgaggc

SEQ ID NO: 7906733 - DNA, 22 bp, Homo sapiens
tctgcagaattgtctcaagcta

SEQ ID NO: 7906734 - DNA, 22 bp, Homo sapiens
tctgcagaattcgaggaagaaa

SEQ ID NO: 7906735 - DNA, 22 bp, Homo sapiens
tctgcagaattgtctcaagcta

SEQ ID NO: 7906736 - DNA, 22 bp, Homo sapiens
tctgcagacaggaagctgaggc

SEQ ID NO: 7906737 - DNA, 23 bp, Homo sapiens
tctgcagacgctgttctattgtc

SEQ ID NO: 7906738 - DNA, 23 bp, Homo sapiens
tctgcagacgctgttctattgtc

SEQ ID NO: 7906739 - DNA, 22 bp, Homo sapiens
tctgcagacttgataaccactg

SEQ ID NO: 7906740 - DNA, 22 bp, Homo sapiens
tctgcagacttgcctaagtgtg

SEQ ID NO: 7906741 - DNA, 22 bp, Homo sapiens
tctgcagacttgcctaagtgtg

SEQ ID NO: 7906742 - DNA, 22 bp, Homo sapiens
tctgcagagacaaagtgttatt

SEQ ID NO: 7906743 - DNA, 22 bp, Homo sapiens
tctgcagacttgcctaagtgtg

SEQ ID NO: 7906744 - DNA, 22 bp, Homo sapiens
tctgcagagattctgggctgag

SEQ ID NO: 7906745 - DNA, 22 bp, Homo sapiens
tctgcagagcattatagcaaaa

SEQ ID NO: 7906746 - DNA, 22 bp, Homo sapiens
tctgcagagggagtgctgggtc

SEQ ID NO: 7906747 - DNA, 22 bp, Homo sapiens
tctgcagagggagtgctgggtc

SEQ ID NO: 7906748 - DNA, 22 bp, Homo sapiens
tctgcagaggtaatttacagat

SEQ ID NO: 7906749 - DNA, 19 bp, Homo sapiens
tctgcagaggaattcttca

SEQ ID NO: 7906750 - DNA, 22 bp, Homo sapiens
ccagcctcactggcatcaccta

SEQ ID NO: 7906751 - DNA, 22 bp, Homo sapiens
ccagcctcactggcatcaccta

SEQ ID NO: 7906752 - DNA, 22 bp, Homo sapiens
ccagcctcactggcatcaccta

SEQ ID NO: 7906753 - DNA, 21 bp, Homo sapiens
ccagcctcagatcagggagct

SEQ ID NO: 7906754 - DNA, 21 bp, Homo sapiens
ccagcctcagatcagggagct

SEQ ID NO: 7906755 - DNA, 21 bp, Homo sapiens
ccagcctcagatcagggagct

SEQ ID NO: 7906756 - DNA, 21 bp, Homo sapiens
ccagcctcagatcagggagct

SEQ ID NO: 7906757 - DNA, 22 bp, Homo sapiens
tcttgccgcgcaggcgcagttc

SEQ ID NO: 7906758 - DNA, 18 bp, Homo sapiens
tcttgcctgcaccctctc

SEQ ID NO: 7906759 - DNA, 18 bp, Homo sapiens
tcttgcctgcaccctctc

SEQ ID NO: 7906760 - DNA, 21 bp, Homo sapiens
ccagcctcagatcagggagct

SEQ ID NO: 7906761 - DNA, 21 bp, Homo sapiens
ccagcctcagatcagggagct

SEQ ID NO: 7906762 - DNA, 21 bp, Homo sapiens
ccagcctcagatcagggagct

SEQ ID NO: 7906763 - DNA, 21 bp, Homo sapiens
ccagcctcagatcagggagct

SEQ ID NO: 7906764 - DNA, 22 bp, Homo sapiens
tcttgtaggtactggtttgctg

SEQ ID NO: 7906765 - DNA, 22 bp, Homo sapiens
tcttggttaggggaaataggca

SEQ ID NO: 7906766 - DNA, 21 bp, Homo sapiens
tcttggttccgtgtgtttgat

SEQ ID NO: 7906767 - DNA, 22 bp, Homo sapiens
tcttggtttttccagggctgat

SEQ ID NO: 7906768 - DNA, 22 bp, Homo sapiens
tcttgggggactttggcatgga

SEQ ID NO: 7906769 - DNA, 22 bp, Homo sapiens
tcttgccttatgccatgaagca

SEQ ID NO: 7906770 - DNA, 22 bp, Homo sapiens
tcttgggggactttggcatgga

SEQ ID NO: 7906771 - DNA, 22 bp, Homo sapiens
tcttgggggactttggcatgga

SEQ ID NO: 7906772 - DNA, 22 bp, Homo sapiens
tcttgggggactttggcatgga

SEQ ID NO: 7906773 - DNA, 19 bp, Homo sapiens
tcttgggtcgagacataga

SEQ ID NO: 7906774 - DNA, 22 bp, Homo sapiens
tcttgtttggattttgggcagt

SEQ ID NO: 7906775 - DNA, 22 bp, Homo sapiens
tcttgtttcttctaagcagcag

SEQ ID NO: 7906776 - DNA, 22 bp, Homo sapiens
tcttgttttgaactcatcagga

SEQ ID NO: 7906777 - DNA, 22 bp, Homo sapiens
tctttaaagttggagcttgcaa

SEQ ID NO: 7906778 - DNA, 22 bp, Homo sapiens
tctttaaagttggagcttgcaa

SEQ ID NO: 7906779 - DNA, 22 bp, Homo sapiens
tctttaaagttggagcttgcaa

SEQ ID NO: 7906780 - DNA, 22 bp, Homo sapiens
tctttaaagttggagcttgcaa

SEQ ID NO: 7906781 - DNA, 21 bp, Homo sapiens
tcttgtccttgctctcccact

SEQ ID NO: 7906782 - DNA, 22 bp, Homo sapiens
tcttgtcctaagagctggattc

SEQ ID NO: 7906783 - DNA, 21 bp, Homo sapiens
tcttgtgtgggaaacaatttg

SEQ ID NO: 7906784 - DNA, 22 bp, Homo sapiens
tcttgtctaggacagtgatgtg

SEQ ID NO: 7906785 - DNA, 21 bp, Homo sapiens
tcttgtccttgctctcccact

SEQ ID NO: 7906786 - DNA, 22 bp, Homo sapiens
tcttgtgtggtggaagatatgg

SEQ ID NO: 7906787 - DNA, 22 bp, Homo sapiens
tcttgtgtggtggaagatatgg

SEQ ID NO: 7906788 - DNA, 22 bp, Homo sapiens
tcttgttaaagtgaagatactg

SEQ ID NO: 7906789 - DNA, 22 bp, Homo sapiens
tcttgttaaagtgaagatactg

SEQ ID NO: 7906790 - DNA, 23 bp, Homo sapiens
tcttgtttcctttgcgctatcca

SEQ ID NO: 7906791 - DNA, 22 bp, Homo sapiens
tcttgtttctgtatataatgac

SEQ ID NO: 7906792 - DNA, 20 bp, Homo sapiens
tgaagaggaagaggacggcc

SEQ ID NO: 7906793 - DNA, 19 bp, Homo sapiens
tgaagagctgtcaaaagtg

SEQ ID NO: 7906794 - DNA, 22 bp, Homo sapiens
tgaagagattaagttggttttg

SEQ ID NO: 7906795 - DNA, 22 bp, Homo sapiens
tgaagagattaagttggttttg

SEQ ID NO: 7906796 - DNA, 22 bp, Homo sapiens
tgaagaggccaaactatcattg

SEQ ID NO: 7906797 - DNA, 20 bp, Homo sapiens
tgaagagtgcgcacattgcc

SEQ ID NO: 7906798 - DNA, 22 bp, Homo sapiens
tgaacaggtgccttcagggagt

SEQ ID NO: 7906799 - DNA, 23 bp, Homo sapiens
tgaacagtatgtgggacattgag

SEQ ID NO: 7906800 - DNA, 22 bp, Homo sapiens
tgaacaggtatttattgaacat

SEQ ID NO: 7906801 - DNA, 22 bp, Homo sapiens
tgaacagtcaaaaagtgaccat

SEQ ID NO: 7906802 - DNA, 22 bp, Homo sapiens
tgaacagtcaaaaagtgaccat

SEQ ID NO: 7906803 - DNA, 22 bp, Homo sapiens
tgaagagaagaaaattatcttt

SEQ ID NO: 7906804 - DNA, 22 bp, Homo sapiens
tgaacagtcatttagaatgtgc

SEQ ID NO: 7906805 - DNA, 22 bp, Homo sapiens
tgaagagattaagttggttttg

SEQ ID NO: 7906806 - DNA, 22 bp, Homo sapiens
tgaagagatagaagtacatgct

SEQ ID NO: 7906807 - DNA, 22 bp, Homo sapiens
tgaagagatagaagtacatgct

SEQ ID NO: 7906808 - DNA, 22 bp, Homo sapiens
tgaagagatagaagtacatgct

SEQ ID NO: 7906809 - DNA, 22 bp, Homo sapiens
tgaagagatagaagtacatgct

SEQ ID NO: 7906810 - DNA, 22 bp, Homo sapiens
tgaagagatagaagtacatgct

SEQ ID NO: 7906811 - DNA, 22 bp, Homo sapiens
tgaagagatagaagtacatgct

SEQ ID NO: 7906812 - DNA, 22 bp, Homo sapiens
tgaagagatagaagtacatgct

SEQ ID NO: 7906813 - DNA, 22 bp, Homo sapiens
tgaagagaagaaaattatcttt

SEQ ID NO: 7906814 - DNA, 18 bp, Homo sapiens
tgaacagatgagttgaag

SEQ ID NO: 7906815 - DNA, 22 bp, Homo sapiens
tgaacagatgccttctcccatg

SEQ ID NO: 7906816 - DNA, 22 bp, Homo sapiens
tgaacagatcaatagaactgac

SEQ ID NO: 7906817 - DNA, 22 bp, Homo sapiens
tgaacagctatcttgtcagtgt

SEQ ID NO: 7906818 - DNA, 22 bp, Homo sapiens
tgaacaggcattatcagggatc

SEQ ID NO: 7906819 - DNA, 22 bp, Homo sapiens
tgaacagctatcttgtcagtgt

SEQ ID NO: 7906820 - DNA, 20 bp, Homo sapiens
tgaacactggggtgtttcag

SEQ ID NO: 7906821 - DNA, 22 bp, Homo sapiens
tgaacacatttctggccaattt

SEQ ID NO: 7906822 - DNA, 22 bp, Homo sapiens
tgaacacatttgggaaaatctt

SEQ ID NO: 7906823 - DNA, 22 bp, Homo sapiens
tgaacacatttgggaaaatctt

SEQ ID NO: 7906824 - DNA, 22 bp, Homo sapiens
tgaacacattttcttcagtaga

SEQ ID NO: 7906825 - DNA, 22 bp, Homo sapiens
tgaacacattttcttcagtaga

SEQ ID NO: 7906826 - DNA, 21 bp, Homo sapiens
tgaacactctacccatttttt

SEQ ID NO: 7906827 - DNA, 22 bp, Homo sapiens
tgaacacgcttcatacagaggg

SEQ ID NO: 7906828 - DNA, 22 bp, Homo sapiens
tgaagctttaggatgggttcat

SEQ ID NO: 7906829 - DNA, 22 bp, Homo sapiens
tgaagctttaggatgggttcat

SEQ ID NO: 7906830 - DNA, 22 bp, Homo sapiens
tgaagctttaggatgggttcat

SEQ ID NO: 7906831 - DNA, 22 bp, Homo sapiens
tgaagatttccaccaaatcaca

SEQ ID NO: 7906832 - DNA, 22 bp, Homo sapiens
tgaagctttaggatgggttcat

SEQ ID NO: 7906833 - DNA, 22 bp, Homo sapiens
tgaagctttaggatgggttcat

SEQ ID NO: 7906834 - DNA, 22 bp, Homo sapiens
tgaagctttaggatgggttcat

SEQ ID NO: 7906835 - DNA, 22 bp, Homo sapiens
tgaagctttcctgtggtcagga

SEQ ID NO: 7906836 - DNA, 22 bp, Homo sapiens
tgaaggaaagagggaacatccc

SEQ ID NO: 7906837 - DNA, 22 bp, Homo sapiens
tgaaggaaagagggaacatccc

SEQ ID NO: 7906838 - DNA, 22 bp, Homo sapiens
tgaaggaaagagggaacatccc

SEQ ID NO: 7906839 - DNA, 17 bp, Homo sapiens
tgaagatgcatggcagc

SEQ ID NO: 7906840 - DNA, 17 bp, Homo sapiens
tgaagatgcatggcagc

SEQ ID NO: 7906841 - DNA, 22 bp, Homo sapiens
tgaagatcagttttgtgtctga

SEQ ID NO: 7906842 - DNA, 17 bp, Homo sapiens
tgaagatgcatggcagc

SEQ ID NO: 7906843 - DNA, 17 bp, Homo sapiens
tgaagatgcatggcagc

SEQ ID NO: 7906844 - DNA, 22 bp, Homo sapiens
tgaagataaattgtactgaaga

SEQ ID NO: 7906845 - DNA, 22 bp, Homo sapiens
tgaaggaagaataggcagtgtt

SEQ ID NO: 7906846 - DNA, 22 bp, Homo sapiens
tgaaggaagaataggcagtgtt

SEQ ID NO: 7906847 - DNA, 22 bp, Homo sapiens
tgaaggaagaataggcagtgtt

SEQ ID NO: 7906848 - DNA, 22 bp, Homo sapiens
tgaaggaaatgacggcagaaga

SEQ ID NO: 7906849 - DNA, 22 bp, Homo sapiens
tgaaggaaatgacggcagaaga

SEQ ID NO: 7906850 - DNA, 22 bp, Homo sapiens
tgaaggaaatgacggcagaaga

SEQ ID NO: 7906851 - DNA, 22 bp, Homo sapiens
tgaaggaaatgacggcagaaga

SEQ ID NO: 7906852 - DNA, 22 bp, Homo sapiens
tgaaggaagaataggcagtgtt

SEQ ID NO: 7906853 - DNA, 17 bp, Homo sapiens
tgaaggaaggatgatgt

SEQ ID NO: 7906854 - DNA, 17 bp, Homo sapiens
tgaaggaaggatgatgt

SEQ ID NO: 7906855 - DNA, 22 bp, Homo sapiens
tgaaggaatgagggagtgggtc

SEQ ID NO: 7906856 - DNA, 22 bp, Homo sapiens
tgaaggaatgagggagtgggtc

SEQ ID NO: 7906857 - DNA, 22 bp, Homo sapiens
tgaaggaatgagggagtgggtc

SEQ ID NO: 7906858 - DNA, 22 bp, Homo sapiens
tgaaggaatgagggagtgggtc

SEQ ID NO: 7906859 - DNA, 22 bp, Homo sapiens
tgaaggaatgagggagtgggtc

SEQ ID NO: 7906860 - DNA, 22 bp, Homo sapiens
tgaaggagaaatggaaagtggg

SEQ ID NO: 7906861 - DNA, 22 bp, Homo sapiens
tgaaggagaattaataggcatt

SEQ ID NO: 7906862 - DNA, 22 bp, Homo sapiens
tgaaggagaattaataggcatt

SEQ ID NO: 7906863 - DNA, 22 bp, Homo sapiens
tgaaggagaaatggaaagtggg

SEQ ID NO: 7906864 - DNA, 22 bp, Homo sapiens
tgaaggagaaatggaaagtggg

SEQ ID NO: 7906865 - DNA, 22 bp, Homo sapiens
tgaaggaatggaggatcagagc

SEQ ID NO: 7906866 - DNA, 22 bp, Homo sapiens
tgaaggaatggaggatcagagc

SEQ ID NO: 7906867 - DNA, 22 bp, Homo sapiens
tgaaggacagcagtggctccaa

SEQ ID NO: 7906868 - DNA, 22 bp, Homo sapiens
tgaaggacagcagtggctccaa

SEQ ID NO: 7906869 - DNA, 22 bp, Homo sapiens
tgaaggaatgagtatactgttt

SEQ ID NO: 7906870 - DNA, 22 bp, Homo sapiens
tgaaggaatgagtatactgttt

SEQ ID NO: 7906871 - DNA, 22 bp, Homo sapiens
tgaaggaatgagtatactgttt

SEQ ID NO: 7906872 - DNA, 22 bp, Homo sapiens
tgaaggaatgagtatactgttt

SEQ ID NO: 7906873 - DNA, 22 bp, Homo sapiens
tgaaggaatggaggatcagagc

SEQ ID NO: 7906874 - DNA, 22 bp, Homo sapiens
tgaaagcttgttggaaatgtag

SEQ ID NO: 7906875 - DNA, 22 bp, Homo sapiens
tgaaagctgtccactaggctgt

SEQ ID NO: 7906876 - DNA, 22 bp, Homo sapiens
tgaaagctgggcacaagattct

SEQ ID NO: 7906877 - DNA, 22 bp, Homo sapiens
tgaaagctgggcacaagattct

SEQ ID NO: 7906878 - DNA, 22 bp, Homo sapiens
tgaaagcattagtctaaggtag

SEQ ID NO: 7906879 - DNA, 20 bp, Homo sapiens
tgaaagcatgtggtatttgg

SEQ ID NO: 7906880 - DNA, 22 bp, Homo sapiens
tgaaagcattagtctaaggtag

SEQ ID NO: 7906881 - DNA, 22 bp, Homo sapiens
tgaaagcatgcttgccaagctt

SEQ ID NO: 7906882 - DNA, 22 bp, Homo sapiens
tgaaagcatgcttgccaagctt

SEQ ID NO: 7906883 - DNA, 22 bp, Homo sapiens
tgaaagcatgcttgccaagctt

SEQ ID NO: 7906884 - DNA, 22 bp, Homo sapiens
tgaaagcatatgctaaagacca

SEQ ID NO: 7906885 - DNA, 22 bp, Homo sapiens
tgaaagcagtgatttctccttc

SEQ ID NO: 7906886 - DNA, 22 bp, Homo sapiens
tgaaagcaggcgggctacttta

SEQ ID NO: 7906887 - DNA, 22 bp, Homo sapiens
tgaaagcaggcgggctacttta

SEQ ID NO: 7906888 - DNA, 22 bp, Homo sapiens
tgaaagcagtgccatgattatg

SEQ ID NO: 7906889 - DNA, 22 bp, Homo sapiens
tgaaagcagtgccatgattatg

SEQ ID NO: 7906890 - DNA, 22 bp, Homo sapiens
tgaaagcagtgccatgattatg

SEQ ID NO: 7906891 - DNA, 22 bp, Homo sapiens
tgaaagcagatagctctgttgt

SEQ ID NO: 7906892 - DNA, 22 bp, Homo sapiens
tgaaagcagatagctctgttgt

SEQ ID NO: 7906893 - DNA, 22 bp, Homo sapiens
tgaaagcagatagctctgttgt

SEQ ID NO: 7906894 - DNA, 22 bp, Homo sapiens
tgaaagcagcaccaataccatt

SEQ ID NO: 7906895 - DNA, 22 bp, Homo sapiens
tgaaagcagcaccaataccatt

SEQ ID NO: 7906896 - DNA, 22 bp, Homo sapiens
tgaaacagctatcagtagactg

SEQ ID NO: 7906897 - DNA, 22 bp, Homo sapiens
tgaaacaggaagtaaacagaca

SEQ ID NO: 7906898 - DNA, 22 bp, Homo sapiens
tgaaagcactgattctcaactc

SEQ ID NO: 7906899 - DNA, 22 bp, Homo sapiens
tgaaagcactgattctcaactc

SEQ ID NO: 7906900 - DNA, 22 bp, Homo sapiens
tgaaacaggaagtaaacagaca

SEQ ID NO: 7906901 - DNA, 22 bp, Homo sapiens
ccaggctccccaggaggccctt

SEQ ID NO: 7906902 - DNA, 22 bp, Homo sapiens
ccaggctccccaggaggccctt

SEQ ID NO: 7906903 - DNA, 22 bp, Homo sapiens
ccaggctccccaggaggccctt

SEQ ID NO: 7906904 - DNA, 22 bp, Homo sapiens
ccaggctccgcatagaccccac

SEQ ID NO: 7906905 - DNA, 22 bp, Homo sapiens
ccaggctccgcatagaccccac

SEQ ID NO: 7906906 - DNA, 22 bp, Homo sapiens
ccaggctccccaggaggccctt

SEQ ID NO: 7906907 - DNA, 22 bp, Homo sapiens
ccaggctccgcatagaccccac

SEQ ID NO: 7906908 - DNA, 22 bp, Homo sapiens
ccaggctcctcatgatcttgtt

SEQ ID NO: 7906909 - DNA, 22 bp, Homo sapiens
ccaggctcctcatgatcttgtt

SEQ ID NO: 7906910 - DNA, 21 bp, Homo sapiens
tgaaacagatggaagtatttg

SEQ ID NO: 7906911 - DNA, 21 bp, Homo sapiens
ccaggctcctgaggctggtca

SEQ ID NO: 7906912 - DNA, 22 bp, Homo sapiens
ccaggctcctcatgatcttgtt

SEQ ID NO: 7906913 - DNA, 22 bp, Homo sapiens
ccaggctcctcatgatcttgtt

SEQ ID NO: 7906914 - DNA, 22 bp, Homo sapiens
ccaggctgctcacaagctgccc

SEQ ID NO: 7906915 - DNA, 22 bp, Homo sapiens
ccaggctgctgttggtgtccgc

SEQ ID NO: 7906916 - DNA, 22 bp, Homo sapiens
tgaaatgcaacagttatttttg

SEQ ID NO: 7906917 - DNA, 22 bp, Homo sapiens
tgaaatgcaacagttatttttg

SEQ ID NO: 7906918 - DNA, 22 bp, Homo sapiens
tgaaatgattatatggtgtttg

SEQ ID NO: 7906919 - DNA, 22 bp, Homo sapiens
tgaaatgcaacagttatttttg

SEQ ID NO: 7906920 - DNA, 21 bp, Homo sapiens
tgaacacagatttgtctgatt

SEQ ID NO: 7906921 - DNA, 22 bp, Homo sapiens
ccaggctgctcacaagctgccc

SEQ ID NO: 7906922 - DNA, 22 bp, Homo sapiens
ccaggctgctcacaagctgccc

SEQ ID NO: 7906923 - DNA, 22 bp, Homo sapiens
ccaggctgctcacaagctgccc

SEQ ID NO: 7906924 - DNA, 22 bp, Homo sapiens
ccaggctgctcacaagctgccc

SEQ ID NO: 7906925 - DNA, 22 bp, Homo sapiens
tgaacacatattaggtgctcat

SEQ ID NO: 7906926 - DNA, 22 bp, Homo sapiens
tgaacacatattaggtgctcat

SEQ ID NO: 7906927 - DNA, 22 bp, Homo sapiens
tgaacacatctgcgtgtgtctc

SEQ ID NO: 7906928 - DNA, 22 bp, Homo sapiens
tgaacacatctgcgtgtgtctc

SEQ ID NO: 7906929 - DNA, 22 bp, Homo sapiens
tgaacacataaggctttcctgt

SEQ ID NO: 7906930 - DNA, 22 bp, Homo sapiens
tgaacacataaggctttcctgt

SEQ ID NO: 7906931 - DNA, 22 bp, Homo sapiens
tgaacacataaggctttcctgt

SEQ ID NO: 7906932 - DNA, 22 bp, Homo sapiens
tgaacacataaaagcaaagggt

SEQ ID NO: 7906933 - DNA, 22 bp, Homo sapiens
tgaacacataaaagcaaagggt

SEQ ID NO: 7906934 - DNA, 22 bp, Homo sapiens
tgaacacagttctgatgagctt

SEQ ID NO: 7906935 - DNA, 22 bp, Homo sapiens
tgaacacagttctgatgagctt

SEQ ID NO: 7906936 - DNA, 22 bp, Homo sapiens
tgaacacagggaatgggggttt

SEQ ID NO: 7906937 - DNA, 22 bp, Homo sapiens
tgaacacagggaatgggggttt

SEQ ID NO: 7906938 - DNA, 22 bp, Homo sapiens
tgaacacagcatattttgttac

SEQ ID NO: 7906939 - DNA, 22 bp, Homo sapiens
tgaacacagcatattttgttac

SEQ ID NO: 7906940 - DNA, 22 bp, Homo sapiens
tgaacacagggccaaacttgag

SEQ ID NO: 7906941 - DNA, 22 bp, Homo sapiens
tgaacacagggccaaacttgag

SEQ ID NO: 7906942 - DNA, 22 bp, Homo sapiens
tgaacacagggccaaacttgag

SEQ ID NO: 7906943 - DNA, 18 bp, Homo sapiens
tgaacacagtacaattcc

SEQ ID NO: 7906944 - DNA, 18 bp, Homo sapiens
tgaacacagtacaattcc

SEQ ID NO: 7906945 - DNA, 18 bp, Homo sapiens
tgaacacagtacaattcc

SEQ ID NO: 7906946 - DNA, 22 bp, Homo sapiens
ccaggctgccgaggaaagaaag

SEQ ID NO: 7906947 - DNA, 22 bp, Homo sapiens
ccaggctgccgaggaaagaaag

SEQ ID NO: 7906948 - DNA, 22 bp, Homo sapiens
ccaggctgctcacaagctgccc

SEQ ID NO: 7906949 - DNA, 22 bp, Homo sapiens
ccaggctgctcacaagctgccc

SEQ ID NO: 7906950 - DNA, 22 bp, Homo sapiens
ccaggctgctcacaagctgccc

SEQ ID NO: 7906951 - DNA, 22 bp, Homo sapiens
ccaggctgcagtcaaggggcat

SEQ ID NO: 7906952 - DNA, 22 bp, Homo sapiens
ccaggctgcagtcaaggggcat

SEQ ID NO: 7906953 - DNA, 22 bp, Homo sapiens
ccaggctgcagtcaaggggcat

SEQ ID NO: 7906954 - DNA, 22 bp, Homo sapiens
ccaggctgcagtcaaggggcat

SEQ ID NO: 7906955 - DNA, 22 bp, Homo sapiens
ccaggctgcagtcaaggggcat

SEQ ID NO: 7906956 - DNA, 22 bp, Homo sapiens
ccaggctgccgaggaaagaaag

SEQ ID NO: 7906957 - DNA, 22 bp, Homo sapiens
tgaaagggaacctgctggactg

SEQ ID NO: 7906958 - DNA, 22 bp, Homo sapiens
ccaggctgcagtcaaggggcat

SEQ ID NO: 7906959 - DNA, 22 bp, Homo sapiens
ccaggctgcagtcaaggggcat

SEQ ID NO: 7906960 - DNA, 22 bp, Homo sapiens
ccaggctgcagtcaaggggcat

SEQ ID NO: 7906961 - DNA, 22 bp, Homo sapiens
ccaggctgagcatgattggagc

SEQ ID NO: 7906962 - DNA, 22 bp, Homo sapiens
ccaggctgcagtcaaggggcat

SEQ ID NO: 7906963 - DNA, 22 bp, Homo sapiens
ccaggctgagcatgattggagc

SEQ ID NO: 7906964 - DNA, 22 bp, Homo sapiens
ccaggctgcagtcaaggggcat

SEQ ID NO: 7906965 - DNA, 22 bp, Homo sapiens
ccaggctgagcatgattggagc

SEQ ID NO: 7906966 - DNA, 21 bp, Homo sapiens
tggctctgaaagagtgctgca

SEQ ID NO: 7906967 - DNA, 21 bp, Homo sapiens
tggctctgaaagagtgctgca

SEQ ID NO: 7906968 - DNA, 22 bp, Homo sapiens
tggctctcttgtaaggtagtag

SEQ ID NO: 7906969 - DNA, 22 bp, Homo sapiens
tggctctcttgtaaggtagtag

SEQ ID NO: 7906970 - DNA, 22 bp, Homo sapiens
tggctctcttgtaaggtagtag

SEQ ID NO: 7906971 - DNA, 22 bp, Homo sapiens
tggctctcttgtaaggtagtag

SEQ ID NO: 7906972 - DNA, 20 bp, Homo sapiens
tggctctctctagtaagtgg

SEQ ID NO: 7906973 - DNA, 20 bp, Homo sapiens
tggctctctctagtaagtgg

SEQ ID NO: 7906974 - DNA, 20 bp, Homo sapiens
tggctctctctagtaagtgg

SEQ ID NO: 7906975 - DNA, 22 bp, Homo sapiens
tggctctctgggaggtcctggc

SEQ ID NO: 7906976 - DNA, 22 bp, Homo sapiens
tggctctctgggaggtcctggc

SEQ ID NO: 7906977 - DNA, 22 bp, Homo sapiens
tggctctctgggaggtcctggc

SEQ ID NO: 7906978 - DNA, 22 bp, Homo sapiens
tggctctctgggaggtcctggc

SEQ ID NO: 7906979 - DNA, 22 bp, Homo sapiens
tggctctgaccaggtagaggag

SEQ ID NO: 7906980 - DNA, 22 bp, Homo sapiens
tggctctgaccaggtagaggag

SEQ ID NO: 7906981 - DNA, 21 bp, Homo sapiens
tggctctgaaagagtgctgca

SEQ ID NO: 7906982 - DNA, 21 bp, Homo sapiens
tggctctgaaagagtgctgca

SEQ ID NO: 7906983 - DNA, 21 bp, Homo sapiens
tggctctgaaagagtgctgca

SEQ ID NO: 7906984 - DNA, 21 bp, Homo sapiens
tggctctgaaagagtgctgca

SEQ ID NO: 7906985 - DNA, 21 bp, Homo sapiens
tggctctgaaagagtgctgca

SEQ ID NO: 7906986 - DNA, 21 bp, Homo sapiens
tggctctgaaagagtgctgca

SEQ ID NO: 7906987 - DNA, 21 bp, Homo sapiens
tggctctgaaagagtgctgca

SEQ ID NO: 7906988 - DNA, 22 bp, Homo sapiens
tgggagcaggtgtgctagggaa

SEQ ID NO: 7906989 - DNA, 22 bp, Homo sapiens
tgggagcaggtgtgctagggaa

SEQ ID NO: 7906990 - DNA, 22 bp, Homo sapiens
tgggagcaggtgtgctagggaa

SEQ ID NO: 7906991 - DNA, 22 bp, Homo sapiens
tgggagcaggtgtgctagggaa

SEQ ID NO: 7906992 - DNA, 22 bp, Homo sapiens
tgggagcaggaagcaggaagta

SEQ ID NO: 7906993 - DNA, 22 bp, Homo sapiens
tgggagcaggctgatgataggt

SEQ ID NO: 7906994 - DNA, 22 bp, Homo sapiens
tgggagcaggaagcaggaagta

SEQ ID NO: 7906995 - DNA, 22 bp, Homo sapiens
tgggagcaggctgatgataggt

SEQ ID NO: 7906996 - DNA, 22 bp, Homo sapiens
tgggagcaggctgatgataggt

SEQ ID NO: 7906997 - DNA, 22 bp, Homo sapiens
tggctctgaccaggtagaggag

SEQ ID NO: 7906998 - DNA, 22 bp, Homo sapiens
tggctctgaccaggtagaggag

SEQ ID NO: 7906999 - DNA, 21 bp, Homo sapiens
tgggagagcgttgctgtcctc

SEQ ID NO: 7907000 - DNA, 21 bp, Homo sapiens
tgggagagcgttgctgtcctc

SEQ ID NO: 7907001 - DNA, 21 bp, Homo sapiens
tgggagagcgttgctgtcctc

SEQ ID NO: 7907002 - DNA, 22 bp, Homo sapiens
cctccctgcgctcctgcggcgg

SEQ ID NO: 7907003 - DNA, 22 bp, Homo sapiens
cctccctgccggctggactagt

SEQ ID NO: 7907004 - DNA, 22 bp, Homo sapiens
cctccctgcgctcctgcggcgg

SEQ ID NO: 7907005 - DNA, 22 bp, Homo sapiens
tggctctcagctcccagcagcc

SEQ ID NO: 7907006 - DNA, 22 bp, Homo sapiens
cctccctgctcctcaactggca

SEQ ID NO: 7907007 - DNA, 22 bp, Homo sapiens
tggctctcagctcccagcagcc

SEQ ID NO: 7907008 - DNA, 22 bp, Homo sapiens
cctccctgcgctcctgcggcgg

SEQ ID NO: 7907009 - DNA, 22 bp, Homo sapiens
cctccctgctcctcaactggca

SEQ ID NO: 7907010 - DNA, 22 bp, Homo sapiens
cctccctgctcctcaactggca

SEQ ID NO: 7907011 - DNA, 22 bp, Homo sapiens
tggctctcagctcccagcagcc

SEQ ID NO: 7907012 - DNA, 22 bp, Homo sapiens
tggctctcagctcccagcagcc

SEQ ID NO: 7907013 - DNA, 22 bp, Homo sapiens
tggctctcaggcctgctgcgtt

SEQ ID NO: 7907014 - DNA, 22 bp, Homo sapiens
tggctctccagctctaaggcct

SEQ ID NO: 7907015 - DNA, 22 bp, Homo sapiens
tggctctccagctctaaggcct

SEQ ID NO: 7907016 - DNA, 22 bp, Homo sapiens
tggctctccagagcctatggta

SEQ ID NO: 7907017 - DNA, 22 bp, Homo sapiens
tggctctccagagcctatggta

SEQ ID NO: 7907018 - DNA, 22 bp, Homo sapiens
tggctctcccaatacctttctg

SEQ ID NO: 7907019 - DNA, 22 bp, Homo sapiens
tggctctcccaatacctttctg

SEQ ID NO: 7907020 - DNA, 22 bp, Homo sapiens
tggctctctacaggtcaagacc

SEQ ID NO: 7907021 - DNA, 22 bp, Homo sapiens
tggctctctacaggtcaagacc

SEQ ID NO: 7907022 - DNA, 23 bp, Homo sapiens
tggctctctcagtgctgcagagg

SEQ ID NO: 7907023 - DNA, 20 bp, Homo sapiens
tggctctctctagtaagtgg

SEQ ID NO: 7907024 - DNA, 23 bp, Homo sapiens
tggctctctcagtgctgcagagg

SEQ ID NO: 7907025 - DNA, 23 bp, Homo sapiens
tggctctctcagtgctgcagagg

SEQ ID NO: 7907026 - DNA, 22 bp, Homo sapiens
tgggagcagttcaggtgtggct

SEQ ID NO: 7907027 - DNA, 22 bp, Homo sapiens
tgggagcagttcaggtgtggct

SEQ ID NO: 7907028 - DNA, 22 bp, Homo sapiens
tgggagcagttcaggtgtggct

SEQ ID NO: 7907029 - DNA, 22 bp, Homo sapiens
tgggagcagttcaggtgtggct

SEQ ID NO: 7907030 - DNA, 22 bp, Homo sapiens
tgggagcaggtgtgctagggaa

SEQ ID NO: 7907031 - DNA, 22 bp, Homo sapiens
tgggagcaggtgtgctagggaa

SEQ ID NO: 7907032 - DNA, 22 bp, Homo sapiens
tgggagcaggtgtgctagggaa

SEQ ID NO: 7907033 - DNA, 22 bp, Homo sapiens
tgggagcaggtgtgctagggaa

SEQ ID NO: 7907034 - DNA, 22 bp, Homo sapiens
tgggagcaggtgtgctagggaa

SEQ ID NO: 7907035 - DNA, 22 bp, Homo sapiens
tgggagcaggtgtgctagggaa

SEQ ID NO: 7907036 - DNA, 22 bp, Homo sapiens
tgggagcagttgcatctccagt

SEQ ID NO: 7907037 - DNA, 22 bp, Homo sapiens
tgggagcagttcaggtgtggct

SEQ ID NO: 7907038 - DNA, 22 bp, Homo sapiens
tgggagcagttgtgaagctcag

SEQ ID NO: 7907039 - DNA, 22 bp, Homo sapiens
tgggagcagttgtgaagctcag

SEQ ID NO: 7907040 - DNA, 22 bp, Homo sapiens
tgggagcagttgtgaagctcag

SEQ ID NO: 7907041 - DNA, 22 bp, Homo sapiens
tgggagcagttgtgaagctcag

SEQ ID NO: 7907042 - DNA, 22 bp, Homo sapiens
tgggagcagttgtgaagctcag

SEQ ID NO: 7907043 - DNA, 22 bp, Homo sapiens
tgggagcagttgtgaagctcag

SEQ ID NO: 7907044 - DNA, 22 bp, Homo sapiens
tgggagcagttgtgaagctcag

SEQ ID NO: 7907045 - DNA, 22 bp, Homo sapiens
tgggagccattttagaggctgc

SEQ ID NO: 7907046 - DNA, 22 bp, Homo sapiens
tgggagccattttagaggctgc

SEQ ID NO: 7907047 - DNA, 22 bp, Homo sapiens
tgggagccattttagaggctgc

SEQ ID NO: 7907048 - DNA, 22 bp, Homo sapiens
tgggagcccaagggagctgccg

SEQ ID NO: 7907049 - DNA, 22 bp, Homo sapiens
tgggagcccaagggagctgccg

SEQ ID NO: 7907050 - DNA, 22 bp, Homo sapiens
tgggagcccaagggagctgccg

SEQ ID NO: 7907051 - DNA, 22 bp, Homo sapiens
tgggagcccaagggagctgccg

SEQ ID NO: 7907052 - DNA, 22 bp, Homo sapiens
tgggagcctggcaggccagagg

SEQ ID NO: 7907053 - DNA, 22 bp, Homo sapiens
tgggagcccaagggagctgccg

SEQ ID NO: 7907054 - DNA, 23 bp, Homo sapiens
tgggagctcaagggaggctgccc

SEQ ID NO: 7907055 - DNA, 23 bp, Homo sapiens
tgggagctcaagggaggctgccc

SEQ ID NO: 7907056 - DNA, 23 bp, Homo sapiens
tgggagctcaagggaggctgccc

SEQ ID NO: 7907057 - DNA, 22 bp, Homo sapiens
tgggagctcacaggcctggctc

SEQ ID NO: 7907058 - DNA, 22 bp, Homo sapiens
tgggagctcacaggcctggctc

SEQ ID NO: 7907059 - DNA, 22 bp, Homo sapiens
tgggagctcagaaagggaggtc

SEQ ID NO: 7907060 - DNA, 22 bp, Homo sapiens
cctctggatctttctccacact

SEQ ID NO: 7907061 - DNA, 22 bp, Homo sapiens
cctctggatctttctccacact

SEQ ID NO: 7907062 - DNA, 22 bp, Homo sapiens
cctctggcaacttcacagccca

SEQ ID NO: 7907063 - DNA, 22 bp, Homo sapiens
cctctggagtcagaccagcttg

SEQ ID NO: 7907064 - DNA, 23 bp, Homo sapiens
tgggagctcaagggaggctgccc

SEQ ID NO: 7907065 - DNA, 22 bp, Homo sapiens
cctctggcaacttcacagccca

SEQ ID NO: 7907066 - DNA, 22 bp, Homo sapiens
cctctggcaacttcacagccca

SEQ ID NO: 7907067 - DNA, 22 bp, Homo sapiens
cctctggcaacttcacagccca

SEQ ID NO: 7907068 - DNA, 22 bp, Homo sapiens
cctctggcaacttcacagccca

SEQ ID NO: 7907069 - DNA, 22 bp, Homo sapiens
cctctggcaacttcacagccca

SEQ ID NO: 7907070 - DNA, 22 bp, Homo sapiens
cctctggcagccagccagttgt

SEQ ID NO: 7907071 - DNA, 22 bp, Homo sapiens
cctctggcagccagccagttgt

SEQ ID NO: 7907072 - DNA, 22 bp, Homo sapiens
cctctggcagccagccagttgt

SEQ ID NO: 7907073 - DNA, 16 bp, Homo sapiens
cctctggcaattagat

SEQ ID NO: 7907074 - DNA, 16 bp, Homo sapiens
cctctggcaattagat

SEQ ID NO: 7907075 - DNA, 16 bp, Homo sapiens
cctctggcaattagat

SEQ ID NO: 7907076 - DNA, 22 bp, Homo sapiens
cctctggcaagtgatttatcat

SEQ ID NO: 7907077 - DNA, 22 bp, Homo sapiens
cctctggcaagtgatttatcat

SEQ ID NO: 7907078 - DNA, 22 bp, Homo sapiens
cctctggcaagtgatttatcat

SEQ ID NO: 7907079 - DNA, 22 bp, Homo sapiens
cctctggcaacttcacagccca

SEQ ID NO: 7907080 - DNA, 22 bp, Homo sapiens
cctctggcaacttcacagccca

SEQ ID NO: 7907081 - DNA, 22 bp, Homo sapiens
cctctggcatagcaagtggcct

SEQ ID NO: 7907082 - DNA, 22 bp, Homo sapiens
cctctggcatagcaagtggcct

SEQ ID NO: 7907083 - DNA, 22 bp, Homo sapiens
cctctggcagccagccagttgt

SEQ ID NO: 7907084 - DNA, 22 bp, Homo sapiens
cctctggcagccagccagttgt

SEQ ID NO: 7907085 - DNA, 22 bp, Homo sapiens
cctctggcagccagccagttgt

SEQ ID NO: 7907086 - DNA, 22 bp, Homo sapiens
cctctggcatagcaagtggcct

SEQ ID NO: 7907087 - DNA, 22 bp, Homo sapiens
cctctggccacatgggacatag

SEQ ID NO: 7907088 - DNA, 22 bp, Homo sapiens
cctctggcatagcaagtggcct

SEQ ID NO: 7907089 - DNA, 22 bp, Homo sapiens
cctctggccacatgggacatag

SEQ ID NO: 7907090 - DNA, 22 bp, Homo sapiens
cctgaatactggtgctgaaagt

SEQ ID NO: 7907091 - DNA, 22 bp, Homo sapiens
cctgaataggctctgctcaaaa

SEQ ID NO: 7907092 - DNA, 22 bp, Homo sapiens
cctgaataatttgtgaaaagat

SEQ ID NO: 7907093 - DNA, 22 bp, Homo sapiens
cctgaatactggtgctgaaagt

SEQ ID NO: 7907094 - DNA, 23 bp, Homo sapiens
cctgaagggtcagggtcctcagc

SEQ ID NO: 7907095 - DNA, 22 bp, Homo sapiens
cctgaagggactccagagagca

SEQ ID NO: 7907096 - DNA, 23 bp, Homo sapiens
cctgaagggtcagggtcctcagc

SEQ ID NO: 7907097 - DNA, 22 bp, Homo sapiens
cctgaagggactccagagagca

SEQ ID NO: 7907098 - DNA, 22 bp, Homo sapiens
cctgaagggactccagagagca

SEQ ID NO: 7907099 - DNA, 22 bp, Homo sapiens
cctgaagggactccagagagca

SEQ ID NO: 7907100 - DNA, 17 bp, Homo sapiens
cctgaaggcacttccag

SEQ ID NO: 7907101 - DNA, 17 bp, Homo sapiens
cctgaaggcacttccag

SEQ ID NO: 7907102 - DNA, 22 bp, Homo sapiens
cctgaaggaaactggaaataca

SEQ ID NO: 7907103 - DNA, 22 bp, Homo sapiens
cctgaaggaaactggaaataca

SEQ ID NO: 7907104 - DNA, 22 bp, Homo sapiens
cctgaagctcttaagaccttta

SEQ ID NO: 7907105 - DNA, 18 bp, Homo sapiens
cctgaagcctgtgtcttt

SEQ ID NO: 7907106 - DNA, 22 bp, Homo sapiens
cctgaagcacaaaagcacagct

SEQ ID NO: 7907107 - DNA, 22 bp, Homo sapiens
cctgaaaatcaaggtagtttgg

SEQ ID NO: 7907108 - DNA, 22 bp, Homo sapiens
cctctttgagattcagttttcc

SEQ ID NO: 7907109 - DNA, 22 bp, Homo sapiens
cctctttgtgcctgcaggctgc

SEQ ID NO: 7907110 - DNA, 22 bp, Homo sapiens
cctctttgttcaggctgctggc

SEQ ID NO: 7907111 - DNA, 22 bp, Homo sapiens
cctctttgttcaggctgctggc

SEQ ID NO: 7907112 - DNA, 22 bp, Homo sapiens
cctctttgactctcaggtcttt

SEQ ID NO: 7907113 - DNA, 22 bp, Homo sapiens
cctctttgtgcctgcaggctgc

SEQ ID NO: 7907114 - DNA, 22 bp, Homo sapiens
cctctttaatcccatccatgtg

SEQ ID NO: 7907115 - DNA, 22 bp, Homo sapiens
cctcttgccaatcagctacaga

SEQ ID NO: 7907116 - DNA, 22 bp, Homo sapiens
cctctttgacaagtacctgccc

SEQ ID NO: 7907117 - DNA, 22 bp, Homo sapiens
cctctttgacaagtacctgccc

SEQ ID NO: 7907118 - DNA, 22 bp, Homo sapiens
cctctttaatcccatccatgtg

SEQ ID NO: 7907119 - DNA, 22 bp, Homo sapiens
cctctttgactctcaggtcttt

SEQ ID NO: 7907120 - DNA, 22 bp, Homo sapiens
cctctttgactctcaggtcttt

SEQ ID NO: 7907121 - DNA, 22 bp, Homo sapiens
cctcttgagttctttaaaagct

SEQ ID NO: 7907122 - DNA, 22 bp, Homo sapiens
cctcttgagtgtctgttttcca

SEQ ID NO: 7907123 - DNA, 22 bp, Homo sapiens
cctcttgattggttggaagcgg

SEQ ID NO: 7907124 - DNA, 22 bp, Homo sapiens
cctcttgattggttggaagcgg

SEQ ID NO: 7907125 - DNA, 22 bp, Homo sapiens
cctcttgatttggctgtgaagt

SEQ ID NO: 7907126 - DNA, 21 bp, Homo sapiens
cctcttgatttttagctctgg

SEQ ID NO: 7907127 - DNA, 22 bp, Homo sapiens
cctcttgccaatcagctacaga

SEQ ID NO: 7907128 - DNA, 22 bp, Homo sapiens
tgggccagcaattgctgctcag

SEQ ID NO: 7907129 - DNA, 22 bp, Homo sapiens
tgggccagcaattgctgctcag

SEQ ID NO: 7907130 - DNA, 22 bp, Homo sapiens
tgggccagcaattgctgctcag

SEQ ID NO: 7907131 - DNA, 22 bp, Homo sapiens
cctcttctgagtgagactccct

SEQ ID NO: 7907132 - DNA, 22 bp, Homo sapiens
cctcttgaatgccaggaaggac

SEQ ID NO: 7907133 - DNA, 22 bp, Homo sapiens
cctcttgaagagaagagttact

SEQ ID NO: 7907134 - DNA, 22 bp, Homo sapiens
cctcttgaacctaggcaagact

SEQ ID NO: 7907135 - DNA, 22 bp, Homo sapiens
cctcttctgcttcaggagcact

SEQ ID NO: 7907136 - DNA, 22 bp, Homo sapiens
cctcttgactctaaatcccgcg

SEQ ID NO: 7907137 - DNA, 22 bp, Homo sapiens
cctcttgacagcctctgtttcc

SEQ ID NO: 7907138 - DNA, 22 bp, Homo sapiens
cctcttgaggccgggccggatc

SEQ ID NO: 7907139 - DNA, 22 bp, Homo sapiens
cctcttgagaggcactcaggtt

SEQ ID NO: 7907140 - DNA, 22 bp, Homo sapiens
tgggccagaagtatgcatgttt

SEQ ID NO: 7907141 - DNA, 22 bp, Homo sapiens
tgggccacttgaaagtggatgt

SEQ ID NO: 7907142 - DNA, 22 bp, Homo sapiens
tgggccagaagtatgcatgttt

SEQ ID NO: 7907143 - DNA, 22 bp, Homo sapiens
tgggccagaagtatgcatgttt

SEQ ID NO: 7907144 - DNA, 22 bp, Homo sapiens
tgggccagagagtaagaaaggt

SEQ ID NO: 7907145 - DNA, 22 bp, Homo sapiens
tgggccagagagtaagaaaggt

SEQ ID NO: 7907146 - DNA, 22 bp, Homo sapiens
tgggccagagagtaagaaaggt

SEQ ID NO: 7907147 - DNA, 22 bp, Homo sapiens
tgggccagaggcatggagctat

SEQ ID NO: 7907148 - DNA, 22 bp, Homo sapiens
tgggccagaggcatggagctat

SEQ ID NO: 7907149 - DNA, 22 bp, Homo sapiens
tgggccagaggcatggagctat

SEQ ID NO: 7907150 - DNA, 22 bp, Homo sapiens
tgggccagaggcatggagctat

SEQ ID NO: 7907151 - DNA, 22 bp, Homo sapiens
tgggccagatccatggcaataa

SEQ ID NO: 7907152 - DNA, 22 bp, Homo sapiens
tgggccagaggcatggagctat

SEQ ID NO: 7907153 - DNA, 22 bp, Homo sapiens
tgggccagatccatggcaataa

SEQ ID NO: 7907154 - DNA, 22 bp, Homo sapiens
tgggccagcaattgctgctcag

SEQ ID NO: 7907155 - DNA, 21 bp, Homo sapiens
tgggccagatctgagtttcta

SEQ ID NO: 7907156 - DNA, 22 bp, Homo sapiens
tgggccagcaattgctgctcag

SEQ ID NO: 7907157 - DNA, 22 bp, Homo sapiens
tgggccagcaattgctgctcag

SEQ ID NO: 7907158 - DNA, 21 bp, Homo sapiens
tgggccagatctgagtttcta

SEQ ID NO: 7907159 - DNA, 21 bp, Homo sapiens
tgggccagatctgagtttcta

SEQ ID NO: 7907160 - DNA, 21 bp, Homo sapiens
tgggccagatctgagtttcta

SEQ ID NO: 7907161 - DNA, 22 bp, Homo sapiens
tgggccactgagggtggtcatt

SEQ ID NO: 7907162 - DNA, 22 bp, Homo sapiens
tgggccactgctgcggaaggcg

SEQ ID NO: 7907163 - DNA, 22 bp, Homo sapiens
tgggccactgctgcggaaggcg

SEQ ID NO: 7907164 - DNA, 22 bp, Homo sapiens
tgggccactgctccaagtagct

SEQ ID NO: 7907165 - DNA, 22 bp, Homo sapiens
cctctggcctaggccgggagag

SEQ ID NO: 7907166 - DNA, 22 bp, Homo sapiens
cctctggctcacagcaccaact

SEQ ID NO: 7907167 - DNA, 22 bp, Homo sapiens
tgggcagggagctggaaccaca

SEQ ID NO: 7907168 - DNA, 22 bp, Homo sapiens
cctctggctcacagcaccaact

SEQ ID NO: 7907169 - DNA, 22 bp, Homo sapiens
cctctggctcacagcaccaact

SEQ ID NO: 7907170 - DNA, 22 bp, Homo sapiens
tgggcagggagctggaaccaca

SEQ ID NO: 7907171 - DNA, 22 bp, Homo sapiens
tgggcagggagctggaaccaca

SEQ ID NO: 7907172 - DNA, 22 bp, Homo sapiens
tgggccacgtgacccttaccct

SEQ ID NO: 7907173 - DNA, 22 bp, Homo sapiens
cctctggccacatgggacatag

SEQ ID NO: 7907174 - DNA, 22 bp, Homo sapiens
cctctggccacatgggacatag

SEQ ID NO: 7907175 - DNA, 22 bp, Homo sapiens
cctctggccagagaaaggccag

SEQ ID NO: 7907176 - DNA, 22 bp, Homo sapiens
cctctggccacatgggacatag

SEQ ID NO: 7907177 - DNA, 22 bp, Homo sapiens
cctctggccagagaaaggccag

SEQ ID NO: 7907178 - DNA, 22 bp, Homo sapiens
cctctggccagagaaaggccag

SEQ ID NO: 7907179 - DNA, 22 bp, Homo sapiens
cctctggccatcccccattaag

SEQ ID NO: 7907180 - DNA, 22 bp, Homo sapiens
cctctggccagagaaaggccag

SEQ ID NO: 7907181 - DNA, 22 bp, Homo sapiens
cctctggcctaggccgggagag

SEQ ID NO: 7907182 - DNA, 22 bp, Homo sapiens
cctctggccattctttgatgga

SEQ ID NO: 7907183 - DNA, 22 bp, Homo sapiens
cctctggccatcccccattaag

SEQ ID NO: 7907184 - DNA, 22 bp, Homo sapiens
cctctggccattctttgatgga

SEQ ID NO: 7907185 - DNA, 22 bp, Homo sapiens
cctctggccatcccccattaag

SEQ ID NO: 7907186 - DNA, 22 bp, Homo sapiens
cctctggccattctttgatgga

SEQ ID NO: 7907187 - DNA, 22 bp, Homo sapiens
cctctggcctaggccgggagag

SEQ ID NO: 7907188 - DNA, 22 bp, Homo sapiens
cctctggcctaggccgggagag

SEQ ID NO: 7907189 - DNA, 22 bp, Homo sapiens
cctctggcctaggccgggagag

SEQ ID NO: 7907190 - DNA, 22 bp, Homo sapiens
cctctggcctaggccgggagag

SEQ ID NO: 7907191 - DNA, 22 bp, Homo sapiens
tggggtacttgtatcaaagcac

SEQ ID NO: 7907192 - DNA, 22 bp, Homo sapiens
tggggtacttgtatcaaagcac

SEQ ID NO: 7907193 - DNA, 22 bp, Homo sapiens
tggggtaggagtcagcgagaga

SEQ ID NO: 7907194 - DNA, 22 bp, Homo sapiens
tggggtaggagtcagcgagaga

SEQ ID NO: 7907195 - DNA, 22 bp, Homo sapiens
tgggggtgtgccagggacctcc

SEQ ID NO: 7907196 - DNA, 22 bp, Homo sapiens
tgggggtgtgccagggacctcc

SEQ ID NO: 7907197 - DNA, 22 bp, Homo sapiens
tgggggtgtcctggtgcacaca

SEQ ID NO: 7907198 - DNA, 22 bp, Homo sapiens
tgggggtgtcctggtgcacaca

SEQ ID NO: 7907199 - DNA, 22 bp, Homo sapiens
tgggggtgtcctggtgcacaca

SEQ ID NO: 7907200 - DNA, 22 bp, Homo sapiens
tggggtcccactcagctcccct

SEQ ID NO: 7907201 - DNA, 22 bp, Homo sapiens
tggggtcagcaggcctggcctg

SEQ ID NO: 7907202 - DNA, 19 bp, Homo sapiens
tggggtcaagagaggcttc

SEQ ID NO: 7907203 - DNA, 19 bp, Homo sapiens
tggggtcaagagaggcttc

SEQ ID NO: 7907204 - DNA, 22 bp, Homo sapiens
tggggtagggaaaagaagtcga

SEQ ID NO: 7907205 - DNA, 22 bp, Homo sapiens
tggggtagggaaaagaagtcga

SEQ ID NO: 7907206 - DNA, 22 bp, Homo sapiens
tggggtaggagtcagcgagaga

SEQ ID NO: 7907207 - DNA, 22 bp, Homo sapiens
tggggtaggtatgaaaactagg

SEQ ID NO: 7907208 - DNA, 19 bp, Homo sapiens
tggggtcaagagaggcttc

SEQ ID NO: 7907209 - DNA, 22 bp, Homo sapiens
cctgaggtcagcggttcccaca

SEQ ID NO: 7907210 - DNA, 22 bp, Homo sapiens
cctgaggtcatgcatttccaac

SEQ ID NO: 7907211 - DNA, 22 bp, Homo sapiens
cctgaggtcatggtccagtgtt

SEQ ID NO: 7907212 - DNA, 22 bp, Homo sapiens
cctgaggtcatgcatttccaac

SEQ ID NO: 7907213 - DNA, 22 bp, Homo sapiens
cctgaggtcagccattcttgcc

SEQ ID NO: 7907214 - DNA, 22 bp, Homo sapiens
cctgaggtcagccattcttgcc

SEQ ID NO: 7907215 - DNA, 22 bp, Homo sapiens
cctgaggtcagccattcttgcc

SEQ ID NO: 7907216 - DNA, 22 bp, Homo sapiens
cctgaggtcacaacttgcttat

SEQ ID NO: 7907217 - DNA, 21 bp, Homo sapiens
cctgagggtggttgtgaagat

SEQ ID NO: 7907218 - DNA, 21 bp, Homo sapiens
cctgagggtggttgtgaagat

SEQ ID NO: 7907219 - DNA, 21 bp, Homo sapiens
cctgagggtggttgtgaagat

SEQ ID NO: 7907220 - DNA, 22 bp, Homo sapiens
cctgaggtcacaacttgcttat

SEQ ID NO: 7907221 - DNA, 22 bp, Homo sapiens
cctgaggtcacaacttgcttat

SEQ ID NO: 7907222 - DNA, 22 bp, Homo sapiens
tgggggtggttcttgcctccag

SEQ ID NO: 7907223 - DNA, 22 bp, Homo sapiens
tgggggtgtcctggtgcacaca

SEQ ID NO: 7907224 - DNA, 22 bp, Homo sapiens
tgggggtgtcctggtgcacaca

SEQ ID NO: 7907225 - DNA, 22 bp, Homo sapiens
tgggggtgtcctggtgcacaca

SEQ ID NO: 7907226 - DNA, 22 bp, Homo sapiens
tgggggtgtcctggtgcacaca

SEQ ID NO: 7907227 - DNA, 22 bp, Homo sapiens
tgggggtgtcctggtgcacaca

SEQ ID NO: 7907228 - DNA, 22 bp, Homo sapiens
tgggggtgtcctggtgcacaca

SEQ ID NO: 7907229 - DNA, 22 bp, Homo sapiens
tgggggagagaggcattctttc

SEQ ID NO: 7907230 - DNA, 22 bp, Homo sapiens
cctgaggtcatggtccagtgtt

SEQ ID NO: 7907231 - DNA, 22 bp, Homo sapiens
cctgaggtcatggtccagtgtt

SEQ ID NO: 7907232 - DNA, 22 bp, Homo sapiens
tgggggagagaggcattctttc

SEQ ID NO: 7907233 - DNA, 22 bp, Homo sapiens
cctgcacctctgtgcttggaac

SEQ ID NO: 7907234 - DNA, 22 bp, Homo sapiens
cctgcagaaagggtccccagga

SEQ ID NO: 7907235 - DNA, 22 bp, Homo sapiens
cctgcagaaagggtccccagga

SEQ ID NO: 7907236 - DNA, 22 bp, Homo sapiens
cctgcacttctcacagctgctg

SEQ ID NO: 7907237 - DNA, 22 bp, Homo sapiens
cctgcacttctcacagctgctg

SEQ ID NO: 7907238 - DNA, 22 bp, Homo sapiens
cctgccaggccagtgagcttcc

SEQ ID NO: 7907239 - DNA, 22 bp, Homo sapiens
cctgccaggagctggtgctgca

SEQ ID NO: 7907240 - DNA, 22 bp, Homo sapiens
cctgccaggagctggtgctgca

SEQ ID NO: 7907241 - DNA, 22 bp, Homo sapiens
cctgccaggagctggtgctgca

SEQ ID NO: 7907242 - DNA, 22 bp, Homo sapiens
cctgccagagcagcttgtcctc

SEQ ID NO: 7907243 - DNA, 22 bp, Homo sapiens
cctgccagacgcaccagggggc

SEQ ID NO: 7907244 - DNA, 22 bp, Homo sapiens
cctgcagacacttgtccagcaa

SEQ ID NO: 7907245 - DNA, 22 bp, Homo sapiens
cctgcagaagagtccagctcat

SEQ ID NO: 7907246 - DNA, 22 bp, Homo sapiens
cctgatgtccataatcctgtaa

SEQ ID NO: 7907247 - DNA, 22 bp, Homo sapiens
cctgatggctgtctgggcctga

SEQ ID NO: 7907248 - DNA, 22 bp, Homo sapiens
cctgatggctgtctgggcctga

SEQ ID NO: 7907249 - DNA, 22 bp, Homo sapiens
cctgatggtatattgttgggag

SEQ ID NO: 7907250 - DNA, 22 bp, Homo sapiens
cctgatggctgtctgggcctga

SEQ ID NO: 7907251 - DNA, 22 bp, Homo sapiens
cctgattattgtaaatatattt

SEQ ID NO: 7907252 - DNA, 22 bp, Homo sapiens
cctgattagggtctttcaaatg

SEQ ID NO: 7907253 - DNA, 22 bp, Homo sapiens
cctgattcagtggtgcccagag

SEQ ID NO: 7907254 - DNA, 22 bp, Homo sapiens
cctgattctgccactactagcc

SEQ ID NO: 7907255 - DNA, 22 bp, Homo sapiens
cctgattctgatgcctcatgga

SEQ ID NO: 7907256 - DNA, 17 bp, Homo sapiens
tggggtccccgatggtg

SEQ ID NO: 7907257 - DNA, 17 bp, Homo sapiens
tggggtccccgatggtg

SEQ ID NO: 7907258 - DNA, 22 bp, Homo sapiens
tggggtcctctcacttggaggg

SEQ ID NO: 7907259 - DNA, 20 bp, Homo sapiens
tggggtcctggaggggatcc

SEQ ID NO: 7907260 - DNA, 22 bp, Homo sapiens
cctgatggctgtctgggcctga

SEQ ID NO: 7907261 - DNA, 22 bp, Homo sapiens
cctgcacagccggacccctgct

SEQ ID NO: 7907262 - DNA, 22 bp, Homo sapiens
cctgcaccaggcccagcatggt

SEQ ID NO: 7907263 - DNA, 22 bp, Homo sapiens
cctgcaccacactcactgctca

SEQ ID NO: 7907264 - DNA, 22 bp, Homo sapiens
cctgcaccacactcactgctca

SEQ ID NO: 7907265 - DNA, 22 bp, Homo sapiens
cctgcacagttctttttgccaa

SEQ ID NO: 7907266 - DNA, 22 bp, Homo sapiens
cctgcacaggccaggcatctga

SEQ ID NO: 7907267 - DNA, 22 bp, Homo sapiens
cctgcacatgtgtgcgcctgta

SEQ ID NO: 7907268 - DNA, 22 bp, Homo sapiens
cctgcacagccttggctgacac

SEQ ID NO: 7907269 - DNA, 22 bp, Homo sapiens
cctgacctatttttctcagctg

SEQ ID NO: 7907270 - DNA, 22 bp, Homo sapiens
cctgacctatttttctcagctg

SEQ ID NO: 7907271 - DNA, 22 bp, Homo sapiens
cctgacctccaagtggctctgg

SEQ ID NO: 7907272 - DNA, 22 bp, Homo sapiens
cctgacctccaagtggctctgg

SEQ ID NO: 7907273 - DNA, 22 bp, Homo sapiens
cctgaccttagtttccttgtga

SEQ ID NO: 7907274 - DNA, 22 bp, Homo sapiens
cctgacgaaaggcgtgctggag

SEQ ID NO: 7907275 - DNA, 22 bp, Homo sapiens
cctgaccttcaagtctgttctt

SEQ ID NO: 7907276 - DNA, 22 bp, Homo sapiens
cctgactcctgggcaaaaccaa

SEQ ID NO: 7907277 - DNA, 22 bp, Homo sapiens
cctgactctggccaggccagct

SEQ ID NO: 7907278 - DNA, 22 bp, Homo sapiens
cctgactctggccaggccagct

SEQ ID NO: 7907279 - DNA, 22 bp, Homo sapiens
cctgacttaagtctcctgttgg

SEQ ID NO: 7907280 - DNA, 22 bp, Homo sapiens
cctgagaaacctggtgcaatta

SEQ ID NO: 7907281 - DNA, 22 bp, Homo sapiens
cctgacttaagtctcctgttgg

SEQ ID NO: 7907282 - DNA, 22 bp, Homo sapiens
cctgagaaacctggtgcaatta

SEQ ID NO: 7907283 - DNA, 22 bp, Homo sapiens
cctgagaatgtttaacagagaa

SEQ ID NO: 7907284 - DNA, 22 bp, Homo sapiens
cctgagaatgtttaacagagaa

SEQ ID NO: 7907285 - DNA, 22 bp, Homo sapiens
cctgagaataattctccatagc

SEQ ID NO: 7907286 - DNA, 22 bp, Homo sapiens
cctgagacatgaaccaggctcc

SEQ ID NO: 7907287 - DNA, 22 bp, Homo sapiens
cctgagaagctggacctggcag

SEQ ID NO: 7907288 - DNA, 22 bp, Homo sapiens
cctgagaagagcttatgagtga

SEQ ID NO: 7907289 - DNA, 22 bp, Homo sapiens
cctgagaataattctccatagc

SEQ ID NO: 7907290 - DNA, 22 bp, Homo sapiens
cctgagaagagcttatgagtga

SEQ ID NO: 7907291 - DNA, 22 bp, Homo sapiens
cctgagaaatagcatcattttt

SEQ ID NO: 7907292 - DNA, 22 bp, Homo sapiens
cctgacaggcggaggctgcagt

SEQ ID NO: 7907293 - DNA, 22 bp, Homo sapiens
cctgacagtccttttctagtgt

SEQ ID NO: 7907294 - DNA, 22 bp, Homo sapiens
cctgacagttaattgtcctgta

SEQ ID NO: 7907295 - DNA, 22 bp, Homo sapiens
cctgacagttaattgtcctgta

SEQ ID NO: 7907296 - DNA, 22 bp, Homo sapiens
cctgacagcgtgtccctggccc

SEQ ID NO: 7907297 - DNA, 22 bp, Homo sapiens
cctgacaaggctaacaaaaggc

SEQ ID NO: 7907298 - DNA, 22 bp, Homo sapiens
cctgacaggagaagcgcagcat

SEQ ID NO: 7907299 - DNA, 22 bp, Homo sapiens
cctgacaggagaagcgcagcat

SEQ ID NO: 7907300 - DNA, 22 bp, Homo sapiens
cctgacaggagaagcgcagcat

SEQ ID NO: 7907301 - DNA, 22 bp, Homo sapiens
cctgaccctccttagagtccag

SEQ ID NO: 7907302 - DNA, 22 bp, Homo sapiens
cctgaccccagcacttgtccct

SEQ ID NO: 7907303 - DNA, 22 bp, Homo sapiens
cctgacctatttttctcagctg

SEQ ID NO: 7907304 - DNA, 22 bp, Homo sapiens
cctgacctatttttctcagctg

SEQ ID NO: 7907305 - DNA, 22 bp, Homo sapiens
cctgacctatttttctcagctg

SEQ ID NO: 7907306 - DNA, 21 bp, Homo sapiens
cctgacctaatttgccatcag

SEQ ID NO: 7907307 - DNA, 21 bp, Homo sapiens
cctgacctaatttgccatcag

SEQ ID NO: 7907308 - DNA, 22 bp, Homo sapiens
cctgaccctttccagtgttggc

SEQ ID NO: 7907309 - DNA, 22 bp, Homo sapiens
cctgaccctttccagtgttggc

SEQ ID NO: 7907310 - DNA, 22 bp, Homo sapiens
cctgaccatttgccacatgggt

SEQ ID NO: 7907311 - DNA, 22 bp, Homo sapiens
cctgaccatttgccacatgggt

SEQ ID NO: 7907312 - DNA, 22 bp, Homo sapiens
cctgaccagagtgagggcttag

SEQ ID NO: 7907313 - DNA, 19 bp, Homo sapiens
cctgaccacacaggccttg

SEQ ID NO: 7907314 - DNA, 22 bp, Homo sapiens
cctgaccacccttggacaaggt

SEQ ID NO: 7907315 - DNA, 22 bp, Homo sapiens
cctgaggggctgcaggccagct

SEQ ID NO: 7907316 - DNA, 22 bp, Homo sapiens
cctgaggggctgcaggccagct

SEQ ID NO: 7907317 - DNA, 22 bp, Homo sapiens
cctgaggggctgcaggccagct

SEQ ID NO: 7907318 - DNA, 22 bp, Homo sapiens
cctgagggtcaaggagccctag

SEQ ID NO: 7907319 - DNA, 22 bp, Homo sapiens
cctgagggcgccgagctcccag

SEQ ID NO: 7907320 - DNA, 22 bp, Homo sapiens
cctgagggcgccgagctcccag

SEQ ID NO: 7907321 - DNA, 22 bp, Homo sapiens
cctgagggctcagcccccagcc

SEQ ID NO: 7907322 - DNA, 22 bp, Homo sapiens
cctgagggctcagcccccagcc

SEQ ID NO: 7907323 - DNA, 22 bp, Homo sapiens
cctgagggagggtataggctgt

SEQ ID NO: 7907324 - DNA, 22 bp, Homo sapiens
cctgagggaacatgcacccaat

SEQ ID NO: 7907325 - DNA, 22 bp, Homo sapiens
cctgaggcttgggagttccgcc

SEQ ID NO: 7907326 - DNA, 22 bp, Homo sapiens
cctgaggcttaatctgtcccaa

SEQ ID NO: 7907327 - DNA, 22 bp, Homo sapiens
cctgaggcttaatctgtcccaa

SEQ ID NO: 7907328 - DNA, 22 bp, Homo sapiens
cctgaggcttaatctgtcccaa

SEQ ID NO: 7907329 - DNA, 22 bp, Homo sapiens
cctgaggctggcccttccatcc

SEQ ID NO: 7907330 - DNA, 22 bp, Homo sapiens
cctgaggctctcctgaataatg

SEQ ID NO: 7907331 - DNA, 22 bp, Homo sapiens
cctgaggctggcccttccatcc

SEQ ID NO: 7907332 - DNA, 22 bp, Homo sapiens
cctgaggcttaatctgtcccaa

SEQ ID NO: 7907333 - DNA, 22 bp, Homo sapiens
cctgaggctggcccttccatcc

SEQ ID NO: 7907334 - DNA, 22 bp, Homo sapiens
cctgaggctctcctgaataatg

SEQ ID NO: 7907335 - DNA, 22 bp, Homo sapiens
cctgaggctctcctgaataatg

SEQ ID NO: 7907336 - DNA, 22 bp, Homo sapiens
cctgaggctcgcgcgcccctgg

SEQ ID NO: 7907337 - DNA, 22 bp, Homo sapiens
cctgaggctccacctccagaga

SEQ ID NO: 7907338 - DNA, 22 bp, Homo sapiens
cctgaggccctggctgtgctga

SEQ ID NO: 7907339 - DNA, 22 bp, Homo sapiens
cctgaggctccacctccagaga

SEQ ID NO: 7907340 - DNA, 22 bp, Homo sapiens
cctgaggctccacctccagaga

SEQ ID NO: 7907341 - DNA, 22 bp, Homo sapiens
cctgaggctccacctccagaga

SEQ ID NO: 7907342 - DNA, 22 bp, Homo sapiens
cctgaggctccacctccagaga

SEQ ID NO: 7907343 - DNA, 22 bp, Homo sapiens
cctgaggccctggctgtgctga

SEQ ID NO: 7907344 - DNA, 22 bp, Homo sapiens
cctgagcttgatccttctgtct

SEQ ID NO: 7907345 - DNA, 22 bp, Homo sapiens
cctgagcttgatccttctgtct

SEQ ID NO: 7907346 - DNA, 22 bp, Homo sapiens
cctgagcttgatccttctgtct

SEQ ID NO: 7907347 - DNA, 22 bp, Homo sapiens
cctgagcttgatccttctgtct

SEQ ID NO: 7907348 - DNA, 22 bp, Homo sapiens
cctgagctggcagtgacctgga

SEQ ID NO: 7907349 - DNA, 22 bp, Homo sapiens
cctgagctggcagtgacctgga

SEQ ID NO: 7907350 - DNA, 22 bp, Homo sapiens
cctgagctggcagtgacctgga

SEQ ID NO: 7907351 - DNA, 22 bp, Homo sapiens
tgtaatataagcattaatagtt

SEQ ID NO: 7907352 - DNA, 22 bp, Homo sapiens
tgtaatatatataactgtgtgc

SEQ ID NO: 7907353 - DNA, 22 bp, Homo sapiens
tgtaatatatataactgtgtgc

SEQ ID NO: 7907354 - DNA, 22 bp, Homo sapiens
tgtaatatatataactgtgtgc

SEQ ID NO: 7907355 - DNA, 22 bp, Homo sapiens
tgtaatattgtagtgacagtac

SEQ ID NO: 7907356 - DNA, 22 bp, Homo sapiens
tgtaatattgtagtgacagtac

SEQ ID NO: 7907357 - DNA, 22 bp, Homo sapiens
tgtaatcattacagtacatgga

SEQ ID NO: 7907358 - DNA, 22 bp, Homo sapiens
tgtaatcattacagtacatgga

SEQ ID NO: 7907359 - DNA, 22 bp, Homo sapiens
tgtaatgatgtacttagaagga

SEQ ID NO: 7907360 - DNA, 22 bp, Homo sapiens
tgtaatgagaaagagagtgaat

SEQ ID NO: 7907361 - DNA, 22 bp, Homo sapiens
tgtaatgaaatggtacaactgt

SEQ ID NO: 7907362 - DNA, 22 bp, Homo sapiens
tgtaagtgctcagctgatggtt

SEQ ID NO: 7907363 - DNA, 21 bp, Homo sapiens
tgtaagtttcatctgaattgg

SEQ ID NO: 7907364 - DNA, 21 bp, Homo sapiens
tgtaagtttcatctgaattgg

SEQ ID NO: 7907365 - DNA, 22 bp, Homo sapiens
tgtaagtagtaatggaaggaca

SEQ ID NO: 7907366 - DNA, 22 bp, Homo sapiens
tgtaagtagtaatggaaggaca

SEQ ID NO: 7907367 - DNA, 22 bp, Homo sapiens
tgtaagtagtaatggaaggaca

SEQ ID NO: 7907368 - DNA, 22 bp, Homo sapiens
tgtaatataagcattaatagtt

SEQ ID NO: 7907369 - DNA, 22 bp, Homo sapiens
tgtaatactccattgtatggat

SEQ ID NO: 7907370 - DNA, 22 bp, Homo sapiens
tgtaagttttgtgaaacaaaca

SEQ ID NO: 7907371 - DNA, 21 bp, Homo sapiens
tgtaagtttcatctgaattgg

SEQ ID NO: 7907372 - DNA, 21 bp, Homo sapiens
tgtaagtttcatctgaattgg

SEQ ID NO: 7907373 - DNA, 21 bp, Homo sapiens
tgtaagtttcatctgaattgg

SEQ ID NO: 7907374 - DNA, 21 bp, Homo sapiens
tgtaagtttcatctgaattgg

SEQ ID NO: 7907375 - DNA, 22 bp, Homo sapiens
cctgctgtgtgacgggatgtta

SEQ ID NO: 7907376 - DNA, 22 bp, Homo sapiens
cctgctgttctgtttagtgaac

SEQ ID NO: 7907377 - DNA, 20 bp, Homo sapiens
cctgctgtgctttccatgga

SEQ ID NO: 7907378 - DNA, 22 bp, Homo sapiens
cctgctgttttcttcacttcag

SEQ ID NO: 7907379 - DNA, 20 bp, Homo sapiens
cctgctgtttccatggggcc

SEQ ID NO: 7907380 - DNA, 22 bp, Homo sapiens
cctgcttcagggatgatggcac

SEQ ID NO: 7907381 - DNA, 22 bp, Homo sapiens
cctgcttaacattgccatgaca

SEQ ID NO: 7907382 - DNA, 22 bp, Homo sapiens
cctgcttaacattgccatgaca

SEQ ID NO: 7907383 - DNA, 22 bp, Homo sapiens
cctgcttaacattgccatgaca

SEQ ID NO: 7907384 - DNA, 22 bp, Homo sapiens
tgtaaagacgcttatagcttgc

SEQ ID NO: 7907385 - DNA, 22 bp, Homo sapiens
tgtaagtagtaatggaaggaca

SEQ ID NO: 7907386 - DNA, 22 bp, Homo sapiens
tgtaaagagaagaaacgtgagc

SEQ ID NO: 7907387 - DNA, 22 bp, Homo sapiens
tgtaaagaaatagcatttgtag

SEQ ID NO: 7907388 - DNA, 22 bp, Homo sapiens
cctgcttaacattgccatgaca

SEQ ID NO: 7907389 - DNA, 22 bp, Homo sapiens
cctgctttggcaggcagctcct

SEQ ID NO: 7907390 - DNA, 22 bp, Homo sapiens
cctgctttgctggtaccatcag

SEQ ID NO: 7907391 - DNA, 22 bp, Homo sapiens
cctggaaaacatgggaatcaca

SEQ ID NO: 7907392 - DNA, 22 bp, Homo sapiens
tgtaatttcctgatgttagaac

SEQ ID NO: 7907393 - DNA, 22 bp, Homo sapiens
tgtaatttgcatggctgaatgc

SEQ ID NO: 7907394 - DNA, 22 bp, Homo sapiens
tgtaatttcctgatgttagaac

SEQ ID NO: 7907395 - DNA, 22 bp, Homo sapiens
tgtaattcattcaactgaagaa

SEQ ID NO: 7907396 - DNA, 22 bp, Homo sapiens
tgtaatttcctgatgttagaac

SEQ ID NO: 7907397 - DNA, 22 bp, Homo sapiens
tgtaattatgttgttagagtat

SEQ ID NO: 7907398 - DNA, 22 bp, Homo sapiens
tgtaattatttctgtgcagtca

SEQ ID NO: 7907399 - DNA, 22 bp, Homo sapiens
tgtaattaacgttcttgttaga

SEQ ID NO: 7907400 - DNA, 22 bp, Homo sapiens
tgtaattaacgttcttgttaga

SEQ ID NO: 7907401 - DNA, 22 bp, Homo sapiens
tgtaattaaactgaagacagaa

SEQ ID NO: 7907402 - DNA, 22 bp, Homo sapiens
tgtaattaaactgaagacagaa

SEQ ID NO: 7907403 - DNA, 23 bp, Homo sapiens
tgtacagttgtttgactcagctc

SEQ ID NO: 7907404 - DNA, 18 bp, Homo sapiens
tgtacagttatgagcatt

SEQ ID NO: 7907405 - DNA, 18 bp, Homo sapiens
tgtacagttatgagcatt

SEQ ID NO: 7907406 - DNA, 22 bp, Homo sapiens
tgtacatacatagatatacaca

SEQ ID NO: 7907407 - DNA, 22 bp, Homo sapiens
tgtacatacatagatatacaca

SEQ ID NO: 7907408 - DNA, 22 bp, Homo sapiens
tgtacatacatagatatacaca

SEQ ID NO: 7907409 - DNA, 22 bp, Homo sapiens
tgtaattttacgtgacacagtt

SEQ ID NO: 7907410 - DNA, 18 bp, Homo sapiens
tgtacagttatgagcatt

SEQ ID NO: 7907411 - DNA, 22 bp, Homo sapiens
tgtacagtgtaaataagtggat

SEQ ID NO: 7907412 - DNA, 22 bp, Homo sapiens
tgtacagtgtagtcatgaggtt

SEQ ID NO: 7907413 - DNA, 19 bp, Homo sapiens
tgtacatatagagctcagt

SEQ ID NO: 7907414 - DNA, 22 bp, Homo sapiens
tgtacatagatcttgaaaatta

SEQ ID NO: 7907415 - DNA, 22 bp, Homo sapiens
tgtacatagatcttgaaaatta

SEQ ID NO: 7907416 - DNA, 22 bp, Homo sapiens
tgtacatagaaaggatacagct

SEQ ID NO: 7907417 - DNA, 22 bp, Homo sapiens
tgtacatagatcttgaaaatta

SEQ ID NO: 7907418 - DNA, 22 bp, Homo sapiens
tgtacatagaaaggatacagct

SEQ ID NO: 7907419 - DNA, 22 bp, Homo sapiens
tgtacatatatgtatgtacgca

SEQ ID NO: 7907420 - DNA, 22 bp, Homo sapiens
tgtacatatatgtatgtacgca

SEQ ID NO: 7907421 - DNA, 22 bp, Homo sapiens
tgtacatagatcttgaaaatta

SEQ ID NO: 7907422 - DNA, 22 bp, Homo sapiens
tgtacatacatagatatacaca

SEQ ID NO: 7907423 - DNA, 22 bp, Homo sapiens
tgtacatacatagatatacaca

SEQ ID NO: 7907424 - DNA, 22 bp, Homo sapiens
tgtacatacatagatatacaca

SEQ ID NO: 7907425 - DNA, 22 bp, Homo sapiens
tgtacatacatagatatacaca

SEQ ID NO: 7907426 - DNA, 22 bp, Homo sapiens
tgtacatacatagatatacaca

SEQ ID NO: 7907427 - DNA, 22 bp, Homo sapiens
tgtacatagaaaggatacagct

SEQ ID NO: 7907428 - DNA, 22 bp, Homo sapiens
tgtacatacatagatatacaca

SEQ ID NO: 7907429 - DNA, 22 bp, Homo sapiens
tgtacatacatagatatacaca

SEQ ID NO: 7907430 - DNA, 22 bp, Homo sapiens
cctggagcactctccctggctg

SEQ ID NO: 7907431 - DNA, 22 bp, Homo sapiens
cctggagcactctccctggctg

SEQ ID NO: 7907432 - DNA, 22 bp, Homo sapiens
tgtaccaaaaatgtgtcagact

SEQ ID NO: 7907433 - DNA, 22 bp, Homo sapiens
tgtaccaaaaatgtgtcagact

SEQ ID NO: 7907434 - DNA, 22 bp, Homo sapiens
cctggagcacatggcaggaggc

SEQ ID NO: 7907435 - DNA, 22 bp, Homo sapiens
cctggagcactctccctggctg

SEQ ID NO: 7907436 - DNA, 22 bp, Homo sapiens
cctggagcactctccctggctg

SEQ ID NO: 7907437 - DNA, 22 bp, Homo sapiens
tgtacattttctcagagtttat

SEQ ID NO: 7907438 - DNA, 22 bp, Homo sapiens
tgtacattttctcagagtttat

SEQ ID NO: 7907439 - DNA, 22 bp, Homo sapiens
tgtacattttctcagagtttat

SEQ ID NO: 7907440 - DNA, 22 bp, Homo sapiens
tgtacatttagagctcaataga

SEQ ID NO: 7907441 - DNA, 22 bp, Homo sapiens
tgtacatttagagctcaataga

SEQ ID NO: 7907442 - DNA, 22 bp, Homo sapiens
tgtacattgtcactcatcaagt

SEQ ID NO: 7907443 - DNA, 22 bp, Homo sapiens
tgtacattgtcactcatcaagt

SEQ ID NO: 7907444 - DNA, 22 bp, Homo sapiens
tgtcaagtctagttgctggctt

SEQ ID NO: 7907445 - DNA, 22 bp, Homo sapiens
tgtcaagtctagttgctggctt

SEQ ID NO: 7907446 - DNA, 22 bp, Homo sapiens
tgtcaagtctctgaatgaaatg

SEQ ID NO: 7907447 - DNA, 22 bp, Homo sapiens
tgtcaagtgattagccataatg

SEQ ID NO: 7907448 - DNA, 22 bp, Homo sapiens
tgtcaagttgttaagttctggg

SEQ ID NO: 7907449 - DNA, 22 bp, Homo sapiens
tgtcaataactggagtcattat

SEQ ID NO: 7907450 - DNA, 22 bp, Homo sapiens
tgtcaataacatttacttctat

SEQ ID NO: 7907451 - DNA, 22 bp, Homo sapiens
tgtcaagagtagtttgaatagt

SEQ ID NO: 7907452 - DNA, 22 bp, Homo sapiens
tgtcaagagtgcacacatctgc

SEQ ID NO: 7907453 - DNA, 22 bp, Homo sapiens
tgtcaagagtagtttgaatagt

SEQ ID NO: 7907454 - DNA, 22 bp, Homo sapiens
tgtcaaggacgtgcatgaaccc

SEQ ID NO: 7907455 - DNA, 22 bp, Homo sapiens
tgtcaagccccagctgtcacgc

SEQ ID NO: 7907456 - DNA, 22 bp, Homo sapiens
tgtcaagatgacagatagatga

SEQ ID NO: 7907457 - DNA, 22 bp, Homo sapiens
tgtcaaggacgtgcatgaaccc

SEQ ID NO: 7907458 - DNA, 22 bp, Homo sapiens
tgtcaacattggctgacagttg

SEQ ID NO: 7907459 - DNA, 22 bp, Homo sapiens
tgtcaacattggctgacagttg

SEQ ID NO: 7907460 - DNA, 22 bp, Homo sapiens
tgtcaacaggctttctaaggca

SEQ ID NO: 7907461 - DNA, 22 bp, Homo sapiens
tgtcaacatttatcaagttatt

SEQ ID NO: 7907462 - DNA, 22 bp, Homo sapiens
tgtcaaccaggtattttggtct

SEQ ID NO: 7907463 - DNA, 22 bp, Homo sapiens
tgtcaacagatactagagagct

SEQ ID NO: 7907464 - DNA, 22 bp, Homo sapiens
tgtcaacagatactagagagct

SEQ ID NO: 7907465 - DNA, 22 bp, Homo sapiens
tgtcaacagatactagagagct

SEQ ID NO: 7907466 - DNA, 22 bp, Homo sapiens
tgtcaacacacctatctcaatt

SEQ ID NO: 7907467 - DNA, 22 bp, Homo sapiens
tgtcaacaacagcattttctat

SEQ ID NO: 7907468 - DNA, 22 bp, Homo sapiens
tgtcaacaacagcattttctat

SEQ ID NO: 7907469 - DNA, 22 bp, Homo sapiens
tgtcaaatttttattgcagtat

SEQ ID NO: 7907470 - DNA, 22 bp, Homo sapiens
tgtcaaatagtagaaagatggc

SEQ ID NO: 7907471 - DNA, 22 bp, Homo sapiens
tgtattctctcaatatttcata

SEQ ID NO: 7907472 - DNA, 22 bp, Homo sapiens
tgtcaaatttttattgcagtat

SEQ ID NO: 7907473 - DNA, 22 bp, Homo sapiens
tgtattcagtgcctagcatatg

SEQ ID NO: 7907474 - DNA, 22 bp, Homo sapiens
tgtattcagtgatttcacaata

SEQ ID NO: 7907475 - DNA, 19 bp, Homo sapiens
cctggaggtgaaggttctc

SEQ ID NO: 7907476 - DNA, 22 bp, Homo sapiens
tgtattccaaaatgctgaggat

SEQ ID NO: 7907477 - DNA, 22 bp, Homo sapiens
tgtattctctcaatatttcata

SEQ ID NO: 7907478 - DNA, 22 bp, Homo sapiens
tgtattctctcaatatttcata

SEQ ID NO: 7907479 - DNA, 22 bp, Homo sapiens
cctggaggggaccaggaccagg

SEQ ID NO: 7907480 - DNA, 22 bp, Homo sapiens
cctggaggggaccaggaccagg

SEQ ID NO: 7907481 - DNA, 22 bp, Homo sapiens
cctggaggggaccaggaccagg

SEQ ID NO: 7907482 - DNA, 18 bp, Homo sapiens
cctggaggtcttcggggt

SEQ ID NO: 7907483 - DNA, 19 bp, Homo sapiens
cctggaggtgaaggttctc

SEQ ID NO: 7907484 - DNA, 18 bp, Homo sapiens
cctggaggtcttcggggt

SEQ ID NO: 7907485 - DNA, 22 bp, Homo sapiens
cctggaggagcgctgaccagct

SEQ ID NO: 7907486 - DNA, 22 bp, Homo sapiens
cctggaggagcgctgaccagct

SEQ ID NO: 7907487 - DNA, 22 bp, Homo sapiens
cctggaggagcgctgaccagct

SEQ ID NO: 7907488 - DNA, 22 bp, Homo sapiens
cctggaggagcgctgaccagct

SEQ ID NO: 7907489 - DNA, 22 bp, Homo sapiens
cctggagcttttccatcctgga

SEQ ID NO: 7907490 - DNA, 22 bp, Homo sapiens
cctggagcttttccatcctgga

SEQ ID NO: 7907491 - DNA, 22 bp, Homo sapiens
cctggagcttttccatcctgga

SEQ ID NO: 7907492 - DNA, 22 bp, Homo sapiens
cctggagcttttccatcctgga

SEQ ID NO: 7907493 - DNA, 22 bp, Homo sapiens
cctggagcttttccatcctgga

SEQ ID NO: 7907494 - DNA, 22 bp, Homo sapiens
cctggagcttttccatcctgga

SEQ ID NO: 7907495 - DNA, 22 bp, Homo sapiens
cctggagcttttccatcctgga

SEQ ID NO: 7907496 - DNA, 18 bp, Homo sapiens
cctggagctccacagcaa

SEQ ID NO: 7907497 - DNA, 18 bp, Homo sapiens
cctggagctccacagcaa

SEQ ID NO: 7907498 - DNA, 18 bp, Homo sapiens
cctggagctccacagcaa

SEQ ID NO: 7907499 - DNA, 18 bp, Homo sapiens
cctggagctccacagcaa

SEQ ID NO: 7907500 - DNA, 18 bp, Homo sapiens
cctggagctccacagcaa

SEQ ID NO: 7907501 - DNA, 18 bp, Homo sapiens
cctggagctccacagcaa

SEQ ID NO: 7907502 - DNA, 18 bp, Homo sapiens
cctggagctccacagcaa

SEQ ID NO: 7907503 - DNA, 18 bp, Homo sapiens
cctggagctccacagcaa

SEQ ID NO: 7907504 - DNA, 22 bp, Homo sapiens
cctggagcttggtcacgctgcg

SEQ ID NO: 7907505 - DNA, 22 bp, Homo sapiens
cctggagcttggtcacgctgcg

SEQ ID NO: 7907506 - DNA, 18 bp, Homo sapiens
cctggagctccacagcaa

SEQ ID NO: 7907507 - DNA, 22 bp, Homo sapiens
cctggagcttggtcacgctgcg

SEQ ID NO: 7907508 - DNA, 22 bp, Homo sapiens
cctggagcttttccagttgaca

SEQ ID NO: 7907509 - DNA, 22 bp, Homo sapiens
cctggagcttttccagttgaca

SEQ ID NO: 7907510 - DNA, 22 bp, Homo sapiens
cctggagcttttccagttgaca

SEQ ID NO: 7907511 - DNA, 22 bp, Homo sapiens
cctggagcttttccagttgaca

SEQ ID NO: 7907512 - DNA, 22 bp, Homo sapiens
cctggaggcggaggttgcagtg

SEQ ID NO: 7907513 - DNA, 22 bp, Homo sapiens
cctggaggcggaggttgcagtg

SEQ ID NO: 7907514 - DNA, 22 bp, Homo sapiens
cctggaggcggaggttgcagtg

SEQ ID NO: 7907515 - DNA, 22 bp, Homo sapiens
cctggaggcagaaataggactt

SEQ ID NO: 7907516 - DNA, 22 bp, Homo sapiens
cctggaggcagaaataggactt

SEQ ID NO: 7907517 - DNA, 22 bp, Homo sapiens
cctggaggagcgctgaccagct

SEQ ID NO: 7907518 - DNA, 22 bp, Homo sapiens
cctggaggctctgggagggcag

SEQ ID NO: 7907519 - DNA, 22 bp, Homo sapiens
cctggaggctctgggagggcag

SEQ ID NO: 7907520 - DNA, 22 bp, Homo sapiens
cctggaggctctgggagggcag

SEQ ID NO: 7907521 - DNA, 22 bp, Homo sapiens
cctggaggctctgggagggcag

SEQ ID NO: 7907522 - DNA, 22 bp, Homo sapiens
cctggaggcggaggttgcagtg

SEQ ID NO: 7907523 - DNA, 22 bp, Homo sapiens
cctggagggaccctggccctgt

SEQ ID NO: 7907524 - DNA, 22 bp, Homo sapiens
cctggagggaccctggccctgt

SEQ ID NO: 7907525 - DNA, 22 bp, Homo sapiens
cctggagggaccctggccctgt

SEQ ID NO: 7907526 - DNA, 22 bp, Homo sapiens
cctggagggcgccgcacagtcc

SEQ ID NO: 7907527 - DNA, 22 bp, Homo sapiens
cctggagggcgccgcacagtcc

SEQ ID NO: 7907528 - DNA, 22 bp, Homo sapiens
cctggagggcgccgcacagtcc

SEQ ID NO: 7907529 - DNA, 22 bp, Homo sapiens
cctggagggcgccgcacagtcc

SEQ ID NO: 7907530 - DNA, 22 bp, Homo sapiens
cctggagggcgccgcacagtcc

SEQ ID NO: 7907531 - DNA, 22 bp, Homo sapiens
cctggagggcagcccattctgg

SEQ ID NO: 7907532 - DNA, 22 bp, Homo sapiens
cctggagggcagcccattctgg

SEQ ID NO: 7907533 - DNA, 22 bp, Homo sapiens
cctgctggtgtccaggctttgg

SEQ ID NO: 7907534 - DNA, 22 bp, Homo sapiens
cctgctggtgtccaggctttgg

SEQ ID NO: 7907535 - DNA, 22 bp, Homo sapiens
cctgctggtttttacaaagatg

SEQ ID NO: 7907536 - DNA, 22 bp, Homo sapiens
cctgctgtagggcccctggggc

SEQ ID NO: 7907537 - DNA, 22 bp, Homo sapiens
cctgctgtaatgtgtctttatt

SEQ ID NO: 7907538 - DNA, 22 bp, Homo sapiens
cctgctgtcagtggggcaggca

SEQ ID NO: 7907539 - DNA, 22 bp, Homo sapiens
cctgctgtcagcatcctcgcga

SEQ ID NO: 7907540 - DNA, 22 bp, Homo sapiens
cctgctgtcccctgagcctgga

SEQ ID NO: 7907541 - DNA, 22 bp, Homo sapiens
cctgctgtcagtggggcaggca

SEQ ID NO: 7907542 - DNA, 22 bp, Homo sapiens
cctgctgtccctctgggctcca

SEQ ID NO: 7907543 - DNA, 22 bp, Homo sapiens
cctgctgtccctctgggctcca

SEQ ID NO: 7907544 - DNA, 22 bp, Homo sapiens
cctgctgtctctgggcaggcag

SEQ ID NO: 7907545 - DNA, 22 bp, Homo sapiens
cctgctgtgaaactggcatatg

SEQ ID NO: 7907546 - DNA, 22 bp, Homo sapiens
cctgctgtctctgggcaggcag

SEQ ID NO: 7907547 - DNA, 22 bp, Homo sapiens
cctgctgtgaccggggagcagg

SEQ ID NO: 7907548 - DNA, 22 bp, Homo sapiens
cctgctgtgaagccaggcctgt

SEQ ID NO: 7907549 - DNA, 22 bp, Homo sapiens
cctgctgtgaagccaggcctgt

SEQ ID NO: 7907550 - DNA, 22 bp, Homo sapiens
cctgctgtgaccggggagcagg

SEQ ID NO: 7907551 - DNA, 22 bp, Homo sapiens
cctgctgtgaccggggagcagg

SEQ ID NO: 7907552 - DNA, 21 bp, Homo sapiens
cctgctgtgatcttagtgagt

SEQ ID NO: 7907553 - DNA, 22 bp, Homo sapiens
cctgctgggcctgagcaatgag

SEQ ID NO: 7907554 - DNA, 22 bp, Homo sapiens
cctgctgggcctgagcaatgag

SEQ ID NO: 7907555 - DNA, 22 bp, Homo sapiens
cctgctgggcctgagcaatgag

SEQ ID NO: 7907556 - DNA, 22 bp, Homo sapiens
cctgctgggacgtgtggttgcc

SEQ ID NO: 7907557 - DNA, 22 bp, Homo sapiens
cctgctgggcctgagcaatgag

SEQ ID NO: 7907558 - DNA, 22 bp, Homo sapiens
cctgctgggacgtgtggttgcc

SEQ ID NO: 7907559 - DNA, 22 bp, Homo sapiens
cctgctgggacgtgtggttgcc

SEQ ID NO: 7907560 - DNA, 20 bp, Homo sapiens
cctgctgggaaccctctgaa

SEQ ID NO: 7907561 - DNA, 20 bp, Homo sapiens
cctgctgggaaccctctgaa

SEQ ID NO: 7907562 - DNA, 20 bp, Homo sapiens
cctgctgggaaccctctgaa

SEQ ID NO: 7907563 - DNA, 20 bp, Homo sapiens
cctgctgggaaccctctgaa

SEQ ID NO: 7907564 - DNA, 22 bp, Homo sapiens
cctgctggcgtggctggcgccc

SEQ ID NO: 7907565 - DNA, 22 bp, Homo sapiens
cctgctggcgtggctggcgccc

SEQ ID NO: 7907566 - DNA, 22 bp, Homo sapiens
cctgctggcgtggctggcgccc

SEQ ID NO: 7907567 - DNA, 22 bp, Homo sapiens
cctgctggcgtggctggcgccc

SEQ ID NO: 7907568 - DNA, 22 bp, Homo sapiens
cctgctggcagagggggttact

SEQ ID NO: 7907569 - DNA, 22 bp, Homo sapiens
cctgctggcattcttgctccct

SEQ ID NO: 7907570 - DNA, 22 bp, Homo sapiens
cctgctggccactgctccacct

SEQ ID NO: 7907571 - DNA, 22 bp, Homo sapiens
cctgctggccactgctccacct

SEQ ID NO: 7907572 - DNA, 22 bp, Homo sapiens
cctgctggccactgctccacct

SEQ ID NO: 7907573 - DNA, 22 bp, Homo sapiens
cctgctggcggggacccagtga

SEQ ID NO: 7907574 - DNA, 22 bp, Homo sapiens
cctgctggcggggacccagtga

SEQ ID NO: 7907575 - DNA, 22 bp, Homo sapiens
cctgctggcggggacccagtga

SEQ ID NO: 7907576 - DNA, 22 bp, Homo sapiens
cctgctggcgcttgtctgggag

SEQ ID NO: 7907577 - DNA, 22 bp, Homo sapiens
cctgctggcgcttgtctgggag

SEQ ID NO: 7907578 - DNA, 22 bp, Homo sapiens
cctgctggcgcttgtctgggag

SEQ ID NO: 7907579 - DNA, 22 bp, Homo sapiens
cctgctggccagtggagggctg

SEQ ID NO: 7907580 - DNA, 22 bp, Homo sapiens
cctgctggccagtggagggctg

SEQ ID NO: 7907581 - DNA, 22 bp, Homo sapiens
cctgctggccagtggagggctg

SEQ ID NO: 7907582 - DNA, 22 bp, Homo sapiens
cctgctggccactgctccacct

SEQ ID NO: 7907583 - DNA, 22 bp, Homo sapiens
cctgctggccagtggagggctg

SEQ ID NO: 7907584 - DNA, 22 bp, Homo sapiens
cctgccttccagccttgggctc

SEQ ID NO: 7907585 - DNA, 22 bp, Homo sapiens
cctgccttcagccctgaagtct

SEQ ID NO: 7907586 - DNA, 22 bp, Homo sapiens
cctgccttcccagcttggcttt

SEQ ID NO: 7907587 - DNA, 22 bp, Homo sapiens
tggtctctgtgctcgggcatgg

SEQ ID NO: 7907588 - DNA, 22 bp, Homo sapiens
tggtctctgtgctcgggcatgg

SEQ ID NO: 7907589 - DNA, 22 bp, Homo sapiens
cctgccttcccagcttggcttt

SEQ ID NO: 7907590 - DNA, 22 bp, Homo sapiens
cctgccttccagccttgggctc

SEQ ID NO: 7907591 - DNA, 22 bp, Homo sapiens
tggtctcttcttccaagatggc

SEQ ID NO: 7907592 - DNA, 22 bp, Homo sapiens
tggtctcttcttccaagatggc

SEQ ID NO: 7907593 - DNA, 22 bp, Homo sapiens
tggtctcttcttccaagatggc

SEQ ID NO: 7907594 - DNA, 22 bp, Homo sapiens
tggtctcttttcagcctgggga

SEQ ID NO: 7907595 - DNA, 22 bp, Homo sapiens
tggtctcttttcagcctgggga

SEQ ID NO: 7907596 - DNA, 23 bp, Homo sapiens
tggtctgaagcctcaggttcctc

SEQ ID NO: 7907597 - DNA, 22 bp, Homo sapiens
tggtctgcctggatcacagccc

SEQ ID NO: 7907598 - DNA, 22 bp, Homo sapiens
tggtctgcatttattcaagact

SEQ ID NO: 7907599 - DNA, 22 bp, Homo sapiens
tggtctgatggtcccaccaccg

SEQ ID NO: 7907600 - DNA, 22 bp, Homo sapiens
tggtctgattcttgctccccaa

SEQ ID NO: 7907601 - DNA, 22 bp, Homo sapiens
tggtctgataccggattccagt

SEQ ID NO: 7907602 - DNA, 22 bp, Homo sapiens
tggtctgaaggtggatttgaga

SEQ ID NO: 7907603 - DNA, 22 bp, Homo sapiens
tggtctgaaggacttctgaggg

SEQ ID NO: 7907604 - DNA, 20 bp, Homo sapiens
tggtctggagccagtgagga

SEQ ID NO: 7907605 - DNA, 20 bp, Homo sapiens
tggtctggagccagtgagga

SEQ ID NO: 7907606 - DNA, 22 bp, Homo sapiens
tggtctgggcaaatccttctga

SEQ ID NO: 7907607 - DNA, 20 bp, Homo sapiens
tggtctggagccagtgagga

SEQ ID NO: 7907608 - DNA, 22 bp, Homo sapiens
tggtctggggaccgagggttac

SEQ ID NO: 7907609 - DNA, 17 bp, Homo sapiens
tggtctggaagaactga

SEQ ID NO: 7907610 - DNA, 20 bp, Homo sapiens
tggtctggagccagtgagga

SEQ ID NO: 7907611 - DNA, 17 bp, Homo sapiens
tggtctggaagaactga

SEQ ID NO: 7907612 - DNA, 22 bp, Homo sapiens
tggtctggaactcctggcttca

SEQ ID NO: 7907613 - DNA, 22 bp, Homo sapiens
tggtctgctgaacagccgtatc

SEQ ID NO: 7907614 - DNA, 22 bp, Homo sapiens
tggtctgctgaacagccgtatc

SEQ ID NO: 7907615 - DNA, 22 bp, Homo sapiens
tggtctgctgaacagccgtatc

SEQ ID NO: 7907616 - DNA, 22 bp, Homo sapiens
cctgctgctatgaaggtgacag

SEQ ID NO: 7907617 - DNA, 22 bp, Homo sapiens
cctgctcggggtgcagtgggct

SEQ ID NO: 7907618 - DNA, 22 bp, Homo sapiens
cctgctctaaatctcatggaac

SEQ ID NO: 7907619 - DNA, 22 bp, Homo sapiens
cctgctcggggtgcagtgggct

SEQ ID NO: 7907620 - DNA, 22 bp, Homo sapiens
cctgctctaaatctcatggaac

SEQ ID NO: 7907621 - DNA, 22 bp, Homo sapiens
tggtctgttcaaggtggctgat

SEQ ID NO: 7907622 - DNA, 22 bp, Homo sapiens
cctgctggacctcaacacattt

SEQ ID NO: 7907623 - DNA, 22 bp, Homo sapiens
cctgctggacgtggaggagggg

SEQ ID NO: 7907624 - DNA, 22 bp, Homo sapiens
cctgctggacgtggaggagggg

SEQ ID NO: 7907625 - DNA, 22 bp, Homo sapiens
cctgctggacctcaacacattt

SEQ ID NO: 7907626 - DNA, 22 bp, Homo sapiens
cctgctggacaggggtgttcat

SEQ ID NO: 7907627 - DNA, 22 bp, Homo sapiens
cctgctgcttaggccatatttc

SEQ ID NO: 7907628 - DNA, 22 bp, Homo sapiens
cctgctggacaggggtgttcat

SEQ ID NO: 7907629 - DNA, 22 bp, Homo sapiens
cctgcctgtcatcgcctgcgcc

SEQ ID NO: 7907630 - DNA, 22 bp, Homo sapiens
cctgcctgtcatcgcctgcgcc

SEQ ID NO: 7907631 - DNA, 22 bp, Homo sapiens
cctgcctgtccctcagtccaca

SEQ ID NO: 7907632 - DNA, 22 bp, Homo sapiens
cctgcctgtccctcagtccaca

SEQ ID NO: 7907633 - DNA, 22 bp, Homo sapiens
cctgcctgtcatcgcctgcgcc

SEQ ID NO: 7907634 - DNA, 22 bp, Homo sapiens
cctgcctgtcatcgcctgcgcc

SEQ ID NO: 7907635 - DNA, 22 bp, Homo sapiens
cctgcctgtactagagacccag

SEQ ID NO: 7907636 - DNA, 22 bp, Homo sapiens
cctgcctgtactagagacccag

SEQ ID NO: 7907637 - DNA, 22 bp, Homo sapiens
cctgcctgtccctcagtccaca

SEQ ID NO: 7907638 - DNA, 22 bp, Homo sapiens
cctgcctgtccctcagtccaca

SEQ ID NO: 7907639 - DNA, 22 bp, Homo sapiens
cctgcctgtccctcagtccaca

SEQ ID NO: 7907640 - DNA, 22 bp, Homo sapiens
cctgcctgtctttatcccctgt

SEQ ID NO: 7907641 - DNA, 23 bp, Homo sapiens
cctgcctgttctaactccatttc

SEQ ID NO: 7907642 - DNA, 23 bp, Homo sapiens
cctgcctgttctaactccatttc

SEQ ID NO: 7907643 - DNA, 23 bp, Homo sapiens
cctgcctgttctaactccatttc

SEQ ID NO: 7907644 - DNA, 20 bp, Homo sapiens
cctgcctgtgtttgtgatga

SEQ ID NO: 7907645 - DNA, 22 bp, Homo sapiens
tgggtcagattgagcccctggt

SEQ ID NO: 7907646 - DNA, 22 bp, Homo sapiens
tgggtcagattgagcccctggt

SEQ ID NO: 7907647 - DNA, 22 bp, Homo sapiens
tgggtcagaggacctcgtggcc

SEQ ID NO: 7907648 - DNA, 22 bp, Homo sapiens
tgggtcagaggacctcgtggcc

SEQ ID NO: 7907649 - DNA, 22 bp, Homo sapiens
tgggtcagaggacctcgtggcc

SEQ ID NO: 7907650 - DNA, 22 bp, Homo sapiens
tgggtcaggctgggagtcctga

SEQ ID NO: 7907651 - DNA, 23 bp, Homo sapiens
tgggtcagctgcctccaggacaa

SEQ ID NO: 7907652 - DNA, 22 bp, Homo sapiens
tgggtcagattgagcccctggt

SEQ ID NO: 7907653 - DNA, 22 bp, Homo sapiens
tgggtcaggctgggagtcctga

SEQ ID NO: 7907654 - DNA, 22 bp, Homo sapiens
tgggtcaggctgggagtcctga

SEQ ID NO: 7907655 - DNA, 22 bp, Homo sapiens
tgggtcaggctgggagtcctga

SEQ ID NO: 7907656 - DNA, 22 bp, Homo sapiens
tgggtcagtttgggggccagcc

SEQ ID NO: 7907657 - DNA, 22 bp, Homo sapiens
tgggtcagtttgggggccagcc

SEQ ID NO: 7907658 - DNA, 22 bp, Homo sapiens
tgggtcaggctgggagtcctga

SEQ ID NO: 7907659 - DNA, 22 bp, Homo sapiens
tgggtcagtttgggggccagcc

SEQ ID NO: 7907660 - DNA, 22 bp, Homo sapiens
tgggtcagtttgggggccagcc

SEQ ID NO: 7907661 - DNA, 20 bp, Homo sapiens
cctgcctgcctcggctcatt

SEQ ID NO: 7907662 - DNA, 20 bp, Homo sapiens
cctgcctgcctcggctcatt

SEQ ID NO: 7907663 - DNA, 22 bp, Homo sapiens
tgggtcagtttgggggccagcc

SEQ ID NO: 7907664 - DNA, 22 bp, Homo sapiens
cctgcctgcctgctggccggga

SEQ ID NO: 7907665 - DNA, 22 bp, Homo sapiens
cctgcctgcctgctggccggga

SEQ ID NO: 7907666 - DNA, 22 bp, Homo sapiens
cctgcctgggctcacttgccag

SEQ ID NO: 7907667 - DNA, 22 bp, Homo sapiens
cctgcctgggctcacttgccag

SEQ ID NO: 7907668 - DNA, 22 bp, Homo sapiens
cctgcctggcttccagaagaga

SEQ ID NO: 7907669 - DNA, 22 bp, Homo sapiens
cctgcctggtgtaagtctaagg

SEQ ID NO: 7907670 - DNA, 22 bp, Homo sapiens
cctgcctggggacaaaggaggg

SEQ ID NO: 7907671 - DNA, 22 bp, Homo sapiens
cctgcctggggacaaaggaggg

SEQ ID NO: 7907672 - DNA, 22 bp, Homo sapiens
tgggtcaaatggtaattctatg

SEQ ID NO: 7907673 - DNA, 22 bp, Homo sapiens
tgggtcacaaaggccagatgat

SEQ ID NO: 7907674 - DNA, 22 bp, Homo sapiens
tgggtcagagcagacctctgga

SEQ ID NO: 7907675 - DNA, 22 bp, Homo sapiens
tgggtcagagctgtgctgccca

SEQ ID NO: 7907676 - DNA, 22 bp, Homo sapiens
tgggtcagagctgtgctgccca

SEQ ID NO: 7907677 - DNA, 22 bp, Homo sapiens
tgggtcagaggacctcgtggcc

SEQ ID NO: 7907678 - DNA, 22 bp, Homo sapiens
tgggtcagagctgtgctgccca

SEQ ID NO: 7907679 - DNA, 22 bp, Homo sapiens
tgggtcagagctgtgctgccca

SEQ ID NO: 7907680 - DNA, 22 bp, Homo sapiens
tgggtcagagctgtgctgccca

SEQ ID NO: 7907681 - DNA, 22 bp, Homo sapiens
tgggtcagagctgtgctgccca

SEQ ID NO: 7907682 - DNA, 22 bp, Homo sapiens
tgggtcagagctgtgctgccca

SEQ ID NO: 7907683 - DNA, 22 bp, Homo sapiens
tgggtcagaatcagagagttgc

SEQ ID NO: 7907684 - DNA, 22 bp, Homo sapiens
tgggtcaccacttcagaggaga

SEQ ID NO: 7907685 - DNA, 22 bp, Homo sapiens
tgggtcagacagccagtgggcc

SEQ ID NO: 7907686 - DNA, 22 bp, Homo sapiens
tgggtcagacagccagtgggcc

SEQ ID NO: 7907687 - DNA, 22 bp, Homo sapiens
tgggtcagacagccagtgggcc

SEQ ID NO: 7907688 - DNA, 22 bp, Homo sapiens
tgggtcagacagccagtgggcc

SEQ ID NO: 7907689 - DNA, 22 bp, Homo sapiens
tgggtcagacagccagtgggcc

SEQ ID NO: 7907690 - DNA, 22 bp, Homo sapiens
tgggtcagaatcagagagttgc

SEQ ID NO: 7907691 - DNA, 22 bp, Homo sapiens
tgggtcagaatcagagagttgc

SEQ ID NO: 7907692 - DNA, 22 bp, Homo sapiens
tgggtcagaatcagagagttgc

SEQ ID NO: 7907693 - DNA, 22 bp, Homo sapiens
tgggtcagacagccagtgggcc

SEQ ID NO: 7907694 - DNA, 22 bp, Homo sapiens
cctgccaggcgagtctaggcca

SEQ ID NO: 7907695 - DNA, 22 bp, Homo sapiens
cctgccaggcgagtctaggcca

SEQ ID NO: 7907696 - DNA, 22 bp, Homo sapiens
cctgccaggcgagtctaggcca

SEQ ID NO: 7907697 - DNA, 22 bp, Homo sapiens
cctgccaggcgagtctaggcca

SEQ ID NO: 7907698 - DNA, 22 bp, Homo sapiens
cctgccaggccagtgagcttcc

SEQ ID NO: 7907699 - DNA, 22 bp, Homo sapiens
cctgccaggcgagtctaggcca

SEQ ID NO: 7907700 - DNA, 22 bp, Homo sapiens
cctgccaggctttgggcttctg

SEQ ID NO: 7907701 - DNA, 22 bp, Homo sapiens
cctgccagggccagaggccagc

SEQ ID NO: 7907702 - DNA, 22 bp, Homo sapiens
cctgccagggccagaggccagc

SEQ ID NO: 7907703 - DNA, 22 bp, Homo sapiens
cctgccagggccagaggccagc

SEQ ID NO: 7907704 - DNA, 22 bp, Homo sapiens
cctgccagggccttggaagaaa

SEQ ID NO: 7907705 - DNA, 22 bp, Homo sapiens
cctgccagggccttggaagaaa

SEQ ID NO: 7907706 - DNA, 22 bp, Homo sapiens
cctgccagtcactatgtcacct

SEQ ID NO: 7907707 - DNA, 18 bp, Homo sapiens
cctgccagtctggagcag

SEQ ID NO: 7907708 - DNA, 18 bp, Homo sapiens
cctgccagtctggagcag

SEQ ID NO: 7907709 - DNA, 22 bp, Homo sapiens
tggcctcaatctgtcctccagc

SEQ ID NO: 7907710 - DNA, 22 bp, Homo sapiens
tggcctcaagtctgagggcctt

SEQ ID NO: 7907711 - DNA, 22 bp, Homo sapiens
tggcctcaatctgtcctccagc

SEQ ID NO: 7907712 - DNA, 22 bp, Homo sapiens
tggcctcaatctgtcctccagc

SEQ ID NO: 7907713 - DNA, 22 bp, Homo sapiens
tggcctcaagtctgagggcctt

SEQ ID NO: 7907714 - DNA, 22 bp, Homo sapiens
tggcctcaagtctgagggcctt

SEQ ID NO: 7907715 - DNA, 22 bp, Homo sapiens
tggcctcaagtctgagggcctt

SEQ ID NO: 7907716 - DNA, 22 bp, Homo sapiens
tggccctgcttatgtctctctt

SEQ ID NO: 7907717 - DNA, 22 bp, Homo sapiens
cctcagaagctcaaggacattg

SEQ ID NO: 7907718 - DNA, 22 bp, Homo sapiens
cctcagaagctcaaggacattg

SEQ ID NO: 7907719 - DNA, 21 bp, Homo sapiens
tggccctggccacggctgcca

SEQ ID NO: 7907720 - DNA, 21 bp, Homo sapiens
tggccctggccacggctgcca

SEQ ID NO: 7907721 - DNA, 21 bp, Homo sapiens
tggccctggccacggctgcca

SEQ ID NO: 7907722 - DNA, 22 bp, Homo sapiens
tggcctcccctaacagcctctt

SEQ ID NO: 7907723 - DNA, 22 bp, Homo sapiens
tggcctcagatttcaggggtgg

SEQ ID NO: 7907724 - DNA, 21 bp, Homo sapiens
tggcctcccacacttccatgg

SEQ ID NO: 7907725 - DNA, 22 bp, Homo sapiens
tggcctcaccactagctgggtg

SEQ ID NO: 7907726 - DNA, 22 bp, Homo sapiens
tggcctcaccactagctgggtg

SEQ ID NO: 7907727 - DNA, 22 bp, Homo sapiens
tggcctcaatctgtcctccagc

SEQ ID NO: 7907728 - DNA, 22 bp, Homo sapiens
tggcctcaatctgtcctccagc

SEQ ID NO: 7907729 - DNA, 22 bp, Homo sapiens
tggcctcaccactagctgggtg

SEQ ID NO: 7907730 - DNA, 22 bp, Homo sapiens
tggcctcagattattgcacagt

SEQ ID NO: 7907731 - DNA, 22 bp, Homo sapiens
tggcctcagatttcaggggtgg

SEQ ID NO: 7907732 - DNA, 22 bp, Homo sapiens
tggcctcagatttcaggggtgg

SEQ ID NO: 7907733 - DNA, 22 bp, Homo sapiens
tggcctcagattattgcacagt

SEQ ID NO: 7907734 - DNA, 22 bp, Homo sapiens
tggcctcagattattgcacagt

SEQ ID NO: 7907735 - DNA, 22 bp, Homo sapiens
tggcctcagattattgcacagt

SEQ ID NO: 7907736 - DNA, 19 bp, Homo sapiens
cctcaccctgcagaggagg

SEQ ID NO: 7907737 - DNA, 19 bp, Homo sapiens
cctcaccctgcagaggagg

SEQ ID NO: 7907738 - DNA, 19 bp, Homo sapiens
cctcaccctgcagaggagg

SEQ ID NO: 7907739 - DNA, 19 bp, Homo sapiens
cctcaccctgcagaggagg

SEQ ID NO: 7907740 - DNA, 19 bp, Homo sapiens
cctcaccctgcagaggagg

SEQ ID NO: 7907741 - DNA, 22 bp, Homo sapiens
cctcacctcagtctgggcctca

SEQ ID NO: 7907742 - DNA, 22 bp, Homo sapiens
cctcactctgcaccctgcagca

SEQ ID NO: 7907743 - DNA, 22 bp, Homo sapiens
cctcactcttgtcctggcaggt

SEQ ID NO: 7907744 - DNA, 22 bp, Homo sapiens
cctcactcttgtcctggcaggt

SEQ ID NO: 7907745 - DNA, 22 bp, Homo sapiens
cctcagaagaagtggaattgat

SEQ ID NO: 7907746 - DNA, 22 bp, Homo sapiens
cctcactgtcatcagtagttat

SEQ ID NO: 7907747 - DNA, 22 bp, Homo sapiens
cctcactgtcacttatagtggt

SEQ ID NO: 7907748 - DNA, 22 bp, Homo sapiens
cctcagaacggaaatggttttg

SEQ ID NO: 7907749 - DNA, 22 bp, Homo sapiens
cctcagaagactttagggaaga

SEQ ID NO: 7907750 - DNA, 22 bp, Homo sapiens
cctcagaagaagtggaattgat

SEQ ID NO: 7907751 - DNA, 22 bp, Homo sapiens
cctcagaagactttagggaaga

SEQ ID NO: 7907752 - DNA, 22 bp, Homo sapiens
cctcagaagctcaaggacattg

SEQ ID NO: 7907753 - DNA, 22 bp, Homo sapiens
cctcactgaagaggtgacattt

SEQ ID NO: 7907754 - DNA, 22 bp, Homo sapiens
tggctaacaaggtgaaaccccg

SEQ ID NO: 7907755 - DNA, 22 bp, Homo sapiens
tggctaacaaggtgaaaccccg

SEQ ID NO: 7907756 - DNA, 22 bp, Homo sapiens
tggctaacaaggtgaaaccccg

SEQ ID NO: 7907757 - DNA, 22 bp, Homo sapiens
tggctaacaaggtgaaaccccg

SEQ ID NO: 7907758 - DNA, 22 bp, Homo sapiens
tggctaacaaggtgaaaccccg

SEQ ID NO: 7907759 - DNA, 22 bp, Homo sapiens
tggctaacaaggtgaaaccccg

SEQ ID NO: 7907760 - DNA, 22 bp, Homo sapiens
tggctaacaaggtgaaaccccg

SEQ ID NO: 7907761 - DNA, 22 bp, Homo sapiens
cctcagctgcttccctggagcc

SEQ ID NO: 7907762 - DNA, 22 bp, Homo sapiens
cctcagctgcttccctggagcc

SEQ ID NO: 7907763 - DNA, 22 bp, Homo sapiens
cctcagctgcttccctggagcc

SEQ ID NO: 7907764 - DNA, 22 bp, Homo sapiens
cctcagctgcttccctggagcc

SEQ ID NO: 7907765 - DNA, 22 bp, Homo sapiens
tggcctgggtcacaccagggtc

SEQ ID NO: 7907766 - DNA, 22 bp, Homo sapiens
tggcctggggacctgtgagacc

SEQ ID NO: 7907767 - DNA, 22 bp, Homo sapiens
cctcagctgctgcacagctttt

SEQ ID NO: 7907768 - DNA, 22 bp, Homo sapiens
cctcagctgctgcacagctttt

SEQ ID NO: 7907769 - DNA, 22 bp, Homo sapiens
cctcagctgctgcacagctttt

SEQ ID NO: 7907770 - DNA, 22 bp, Homo sapiens
cctcagctgcttccctggagcc

SEQ ID NO: 7907771 - DNA, 22 bp, Homo sapiens
cctcagctgcttccctggagcc

SEQ ID NO: 7907772 - DNA, 22 bp, Homo sapiens
cctcagctcttccctgtgcaca

SEQ ID NO: 7907773 - DNA, 22 bp, Homo sapiens
cctcagccttggccccaggcag

SEQ ID NO: 7907774 - DNA, 22 bp, Homo sapiens
cctcagctcttccctgtgcaca

SEQ ID NO: 7907775 - DNA, 22 bp, Homo sapiens
cctcagctcccatgagatctgc

SEQ ID NO: 7907776 - DNA, 22 bp, Homo sapiens
cctcagccttggccccaggcag

SEQ ID NO: 7907777 - DNA, 22 bp, Homo sapiens
cctcagccttggccccaggcag

SEQ ID NO: 7907778 - DNA, 22 bp, Homo sapiens
tggcctcggcatccagcaagag

SEQ ID NO: 7907779 - DNA, 22 bp, Homo sapiens
tggcctcggcatccagcaagag

SEQ ID NO: 7907780 - DNA, 22 bp, Homo sapiens
tggcctcggcatccagcaagag

SEQ ID NO: 7907781 - DNA, 22 bp, Homo sapiens
tggcctcggcatccagcaagag

SEQ ID NO: 7907782 - DNA, 22 bp, Homo sapiens
tggcctcggcatccagcaagag

SEQ ID NO: 7907783 - DNA, 22 bp, Homo sapiens
tggcctctcctggcagcatcca

SEQ ID NO: 7907784 - DNA, 23 bp, Homo sapiens
tggcctctccccacctggcagaa

SEQ ID NO: 7907785 - DNA, 23 bp, Homo sapiens
tggcctctccccacctggcagaa

SEQ ID NO: 7907786 - DNA, 23 bp, Homo sapiens
tggcctctccccacctggcagaa

SEQ ID NO: 7907787 - DNA, 23 bp, Homo sapiens
tggcctctccccacctggcagaa

SEQ ID NO: 7907788 - DNA, 22 bp, Homo sapiens
tggcctcggcatccagcaagag

SEQ ID NO: 7907789 - DNA, 22 bp, Homo sapiens
tggcctctctaccaggcagcct

SEQ ID NO: 7907790 - DNA, 22 bp, Homo sapiens
tggcctctcctggctgagtttc

SEQ ID NO: 7907791 - DNA, 22 bp, Homo sapiens
tggcctctcctggcagcatcca

SEQ ID NO: 7907792 - DNA, 22 bp, Homo sapiens
tggcctctcctggcagcatcca

SEQ ID NO: 7907793 - DNA, 22 bp, Homo sapiens
tggcctctcctggcagcatcca

SEQ ID NO: 7907794 - DNA, 22 bp, Homo sapiens
tggcctctcctggcagcatcca

SEQ ID NO: 7907795 - DNA, 22 bp, Homo sapiens
cctcagcccctgaatggagaga

SEQ ID NO: 7907796 - DNA, 22 bp, Homo sapiens
cctcagcccctgaatggagaga

SEQ ID NO: 7907797 - DNA, 22 bp, Homo sapiens
cctcagcccctgaatggagaga

SEQ ID NO: 7907798 - DNA, 22 bp, Homo sapiens
cctcagccttggccccaggcag

SEQ ID NO: 7907799 - DNA, 22 bp, Homo sapiens
cctcagccttggccccaggcag

SEQ ID NO: 7907800 - DNA, 22 bp, Homo sapiens
cctcagccttggccccaggcag

SEQ ID NO: 7907801 - DNA, 22 bp, Homo sapiens
cctcagccttggccccaggcag

SEQ ID NO: 7907802 - DNA, 23 bp, Homo sapiens
cctcagcatggcaggagcccagc

SEQ ID NO: 7907803 - DNA, 22 bp, Homo sapiens
cctcagcccctgaatggagaga

SEQ ID NO: 7907804 - DNA, 22 bp, Homo sapiens
cctcagcatcctggtgaagtag

SEQ ID NO: 7907805 - DNA, 23 bp, Homo sapiens
cctcagcatggcaggagcccagc

SEQ ID NO: 7907806 - DNA, 22 bp, Homo sapiens
cctcagcatcctggtgaagtag

SEQ ID NO: 7907807 - DNA, 22 bp, Homo sapiens
tggcctctcctggctgagtttc

SEQ ID NO: 7907808 - DNA, 22 bp, Homo sapiens
tggcctctctaccaggcagcct

SEQ ID NO: 7907809 - DNA, 22 bp, Homo sapiens
tggcctctctaccaggcagcct

SEQ ID NO: 7907810 - DNA, 22 bp, Homo sapiens
cctccccatgacccggtgctgg

SEQ ID NO: 7907811 - DNA, 22 bp, Homo sapiens
cctcccctcagacagagactgg

SEQ ID NO: 7907812 - DNA, 22 bp, Homo sapiens
cctcccctgctcagaactctgg

SEQ ID NO: 7907813 - DNA, 22 bp, Homo sapiens
cctcccctcagacagagactgg

SEQ ID NO: 7907814 - DNA, 22 bp, Homo sapiens
cctcccctcagacagagactgg

SEQ ID NO: 7907815 - DNA, 22 bp, Homo sapiens
cctcccaggcattgccattttc

SEQ ID NO: 7907816 - DNA, 22 bp, Homo sapiens
cctcccaggcattgccattttc

SEQ ID NO: 7907817 - DNA, 22 bp, Homo sapiens
cctccccatgacccggtgctgg

SEQ ID NO: 7907818 - DNA, 22 bp, Homo sapiens
cctcccaggcattgccattttc

SEQ ID NO: 7907819 - DNA, 22 bp, Homo sapiens
tggctcagctgactcggcttct

SEQ ID NO: 7907820 - DNA, 23 bp, Homo sapiens
tggctcagctagttttccatttc

SEQ ID NO: 7907821 - DNA, 22 bp, Homo sapiens
tggctcagcggtggcagcagac

SEQ ID NO: 7907822 - DNA, 22 bp, Homo sapiens
tggctcagcggtggcagcagac

SEQ ID NO: 7907823 - DNA, 22 bp, Homo sapiens
tggctcagcggtggcagcagac

SEQ ID NO: 7907824 - DNA, 22 bp, Homo sapiens
tggctcagcggtggcagcagac

SEQ ID NO: 7907825 - DNA, 22 bp, Homo sapiens
tggctcagcggtggcagcagac

SEQ ID NO: 7907826 - DNA, 22 bp, Homo sapiens
tggctcagcgcggcctggtctt

SEQ ID NO: 7907827 - DNA, 22 bp, Homo sapiens
tggctcagcgcggcctggtctt

SEQ ID NO: 7907828 - DNA, 22 bp, Homo sapiens
tggctcagcgcggcctggtctt

SEQ ID NO: 7907829 - DNA, 23 bp, Homo sapiens
tggctcagctagttttccatttc

SEQ ID NO: 7907830 - DNA, 23 bp, Homo sapiens
tggctcagctagttttccatttc

SEQ ID NO: 7907831 - DNA, 23 bp, Homo sapiens
tggctcagctagttttccatttc

SEQ ID NO: 7907832 - DNA, 23 bp, Homo sapiens
tggctcagctagttttccatttc

SEQ ID NO: 7907833 - DNA, 23 bp, Homo sapiens
tggctcagctagttttccatttc

SEQ ID NO: 7907834 - DNA, 22 bp, Homo sapiens
tggctcagcggtggcagcagac

SEQ ID NO: 7907835 - DNA, 22 bp, Homo sapiens
tggctcagcggtggcagcagac

SEQ ID NO: 7907836 - DNA, 22 bp, Homo sapiens
tggctcagcggtggcagcagac

SEQ ID NO: 7907837 - DNA, 22 bp, Homo sapiens
tggctcagcggtggcagcagac

SEQ ID NO: 7907838 - DNA, 22 bp, Homo sapiens
tggctcagcggtggcagcagac

SEQ ID NO: 7907839 - DNA, 19 bp, Homo sapiens
cctccccttggaccagcaa

SEQ ID NO: 7907840 - DNA, 19 bp, Homo sapiens
cctccccttggaccagcaa

SEQ ID NO: 7907841 - DNA, 19 bp, Homo sapiens
cctccccttggaccagcaa

SEQ ID NO: 7907842 - DNA, 19 bp, Homo sapiens
cctccccttggaccagcaa

SEQ ID NO: 7907843 - DNA, 22 bp, Homo sapiens
cctcccctgctcagaactctgg

SEQ ID NO: 7907844 - DNA, 23 bp, Homo sapiens
cctccccttcccacagctgggtg

SEQ ID NO: 7907845 - DNA, 23 bp, Homo sapiens
cctccccttcccacagctgggtg

SEQ ID NO: 7907846 - DNA, 19 bp, Homo sapiens
cctccccttggaccagcaa

SEQ ID NO: 7907847 - DNA, 22 bp, Homo sapiens
cctccctcagaatgaagaaagg

SEQ ID NO: 7907848 - DNA, 22 bp, Homo sapiens
cctccctccattgccatcgtct

SEQ ID NO: 7907849 - DNA, 22 bp, Homo sapiens
cctccctccattgccatcgtct

SEQ ID NO: 7907850 - DNA, 18 bp, Homo sapiens
cctccctcattttcccag

SEQ ID NO: 7907851 - DNA, 19 bp, Homo sapiens
cctccccttggaccagcaa

SEQ ID NO: 7907852 - DNA, 22 bp, Homo sapiens
cctccctccctcttatggttta

SEQ ID NO: 7907853 - DNA, 22 bp, Homo sapiens
cctccctccctcttatggttta

SEQ ID NO: 7907854 - DNA, 22 bp, Homo sapiens
cctccctccctcttatggttta

SEQ ID NO: 7907855 - DNA, 22 bp, Homo sapiens
cctccctccctgcagaagccac

SEQ ID NO: 7907856 - DNA, 22 bp, Homo sapiens
cctccctccattgccatcgtct

SEQ ID NO: 7907857 - DNA, 22 bp, Homo sapiens
cctccctccattgccatcgtct

SEQ ID NO: 7907858 - DNA, 22 bp, Homo sapiens
cctccctctgttagagctgtct

SEQ ID NO: 7907859 - DNA, 22 bp, Homo sapiens
cctccctctgttagagctgtct

SEQ ID NO: 7907860 - DNA, 22 bp, Homo sapiens
cctccctctgttagagctgtct

SEQ ID NO: 7907861 - DNA, 22 bp, Homo sapiens
cctccctctttcagtcccacag

SEQ ID NO: 7907862 - DNA, 22 bp, Homo sapiens
cctccctctttcagtcccacag

SEQ ID NO: 7907863 - DNA, 22 bp, Homo sapiens
cctccctctttcagtcccacag

SEQ ID NO: 7907864 - DNA, 22 bp, Homo sapiens
tggctacatttatactctcatt

SEQ ID NO: 7907865 - DNA, 22 bp, Homo sapiens
tggctacatcacagagaattcc

SEQ ID NO: 7907866 - DNA, 22 bp, Homo sapiens
tggctacatttgttgatcactt

SEQ ID NO: 7907867 - DNA, 22 bp, Homo sapiens
tggctactgtacttgagctatt

SEQ ID NO: 7907868 - DNA, 22 bp, Homo sapiens
tggctacagcaagaggaaagaa

SEQ ID NO: 7907869 - DNA, 22 bp, Homo sapiens
tggctacagatttgctgacaat

SEQ ID NO: 7907870 - DNA, 22 bp, Homo sapiens
tggctacagatttgctgacaat

SEQ ID NO: 7907871 - DNA, 22 bp, Homo sapiens
tggctacatcacagagaattcc

SEQ ID NO: 7907872 - DNA, 22 bp, Homo sapiens
tggctacagtggcatatcaaat

SEQ ID NO: 7907873 - DNA, 22 bp, Homo sapiens
tggctacagtggcatatcaaat

SEQ ID NO: 7907874 - DNA, 22 bp, Homo sapiens
tggctacagcttggccacagag

SEQ ID NO: 7907875 - DNA, 22 bp, Homo sapiens
tggctacagacattcctaggga

SEQ ID NO: 7907876 - DNA, 22 bp, Homo sapiens
tggctacagacattcctaggga

SEQ ID NO: 7907877 - DNA, 22 bp, Homo sapiens
tggctacagaattggccctgtt

SEQ ID NO: 7907878 - DNA, 22 bp, Homo sapiens
tggctacagaattggccctgtt

SEQ ID NO: 7907879 - DNA, 22 bp, Homo sapiens
tggctacagaatgaatgctgcc

SEQ ID NO: 7907880 - DNA, 22 bp, Homo sapiens
tggctacaagtgtgtttagttt

SEQ ID NO: 7907881 - DNA, 19 bp, Homo sapiens
tggctaattttatagaggc

SEQ ID NO: 7907882 - DNA, 22 bp, Homo sapiens
tggctaagctggggaggcctgg

SEQ ID NO: 7907883 - DNA, 22 bp, Homo sapiens
tggctaagcatgctccagctgc

SEQ ID NO: 7907884 - DNA, 22 bp, Homo sapiens
tggctaagatttaaatgtttgc

SEQ ID NO: 7907885 - DNA, 22 bp, Homo sapiens
tggctaagaattggcagctgct

SEQ ID NO: 7907886 - DNA, 22 bp, Homo sapiens
tggctaagaattggcagctgct

SEQ ID NO: 7907887 - DNA, 22 bp, Homo sapiens
tggctaaggggaacaggcttag

SEQ ID NO: 7907888 - DNA, 22 bp, Homo sapiens
tggctaaggggaacaggcttag

SEQ ID NO: 7907889 - DNA, 22 bp, Homo sapiens
tggctaaggggaacaggcttag

SEQ ID NO: 7907890 - DNA, 22 bp, Homo sapiens
tggctaaggtcgatagaggctt

SEQ ID NO: 7907891 - DNA, 22 bp, Homo sapiens
tggctaagctggggaggcctgg

SEQ ID NO: 7907892 - DNA, 19 bp, Homo sapiens
tggctaaggccagcggaaa

SEQ ID NO: 7907893 - DNA, 22 bp, Homo sapiens
tggctaacaaggtgaaaccccg

SEQ ID NO: 7907894 - DNA, 22 bp, Homo sapiens
tggctaacaaggtgaaaccccg

SEQ ID NO: 7907895 - DNA, 22 bp, Homo sapiens
tggctaacaaggtgaaaccccg

SEQ ID NO: 7907896 - DNA, 22 bp, Homo sapiens
tggctagggcctttaacgagta

SEQ ID NO: 7907897 - DNA, 22 bp, Homo sapiens
tggctaggctggtgtcaagctc

SEQ ID NO: 7907898 - DNA, 22 bp, Homo sapiens
tggctcagccagccctaggaac

SEQ ID NO: 7907899 - DNA, 22 bp, Homo sapiens
tggctaggacctctgcggagca

SEQ ID NO: 7907900 - DNA, 22 bp, Homo sapiens
tggctaggctccaagagctgga

SEQ ID NO: 7907901 - DNA, 22 bp, Homo sapiens
tggctagatttattgctgagca

SEQ ID NO: 7907902 - DNA, 22 bp, Homo sapiens
tggctagcaactcaactgttaa

SEQ ID NO: 7907903 - DNA, 22 bp, Homo sapiens
tggctagatggcagaaagctgg

SEQ ID NO: 7907904 - DNA, 20 bp, Homo sapiens
tggctagcattaaaatgact

SEQ ID NO: 7907905 - DNA, 22 bp, Homo sapiens
tggctaggaatccatgactctc

SEQ ID NO: 7907906 - DNA, 22 bp, Homo sapiens
tggctaggaaagagttctggga

SEQ ID NO: 7907907 - DNA, 22 bp, Homo sapiens
tggctagctgtgggctggaagc

SEQ ID NO: 7907908 - DNA, 22 bp, Homo sapiens
tggctcagcgcggcctggtctt

SEQ ID NO: 7907909 - DNA, 22 bp, Homo sapiens
tggctcagcgcggcctggtctt

SEQ ID NO: 7907910 - DNA, 22 bp, Homo sapiens
tggctcagcgcggcctggtctt

SEQ ID NO: 7907911 - DNA, 22 bp, Homo sapiens
tggctcagcgcggcctggtctt

SEQ ID NO: 7907912 - DNA, 22 bp, Homo sapiens
tggctcagcctggccctttcat

SEQ ID NO: 7907913 - DNA, 22 bp, Homo sapiens
tggctcagcctggccctttcat

SEQ ID NO: 7907914 - DNA, 22 bp, Homo sapiens
tggctcagccattcgtgttgcc

SEQ ID NO: 7907915 - DNA, 22 bp, Homo sapiens
tggctcagccattcgtgttgcc

SEQ ID NO: 7907916 - DNA, 22 bp, Homo sapiens
tggctcagccattcgtgttgcc

SEQ ID NO: 7907917 - DNA, 22 bp, Homo sapiens
tggctcagccattcgtgttgcc

SEQ ID NO: 7907918 - DNA, 22 bp, Homo sapiens
tggctcagcctggccctttcat

SEQ ID NO: 7907919 - DNA, 17 bp, Homo sapiens
ccgtccattaaactcat

SEQ ID NO: 7907920 - DNA, 22 bp, Homo sapiens
ccgtccattgcccaacagcatg

SEQ ID NO: 7907921 - DNA, 22 bp, Homo sapiens
ccggtgttcaaagtctggtatg

SEQ ID NO: 7907922 - DNA, 22 bp, Homo sapiens
ccgtattataagtttttccttc

SEQ ID NO: 7907923 - DNA, 22 bp, Homo sapiens
ccggtcttcaaatggctgcttc

SEQ ID NO: 7907924 - DNA, 22 bp, Homo sapiens
ccggtcccaggtgccccggtga

SEQ ID NO: 7907925 - DNA, 22 bp, Homo sapiens
ccggggacttaaagtgaaggaa

SEQ ID NO: 7907926 - DNA, 22 bp, Homo sapiens
ccgggctggagtgcaatggctc

SEQ ID NO: 7907927 - DNA, 22 bp, Homo sapiens
ccggggacagcaggtccgactt

SEQ ID NO: 7907928 - DNA, 22 bp, Homo sapiens
ccgtccccagccacctgctgat

SEQ ID NO: 7907929 - DNA, 22 bp, Homo sapiens
ccgtctgcagcctccaggagtt

SEQ ID NO: 7907930 - DNA, 22 bp, Homo sapiens
ccgtctgcagcctccaggagtt

SEQ ID NO: 7907931 - DNA, 21 bp, Homo sapiens
ccgtgctcggctatggaccac

SEQ ID NO: 7907932 - DNA, 22 bp, Homo sapiens
ccgtggtcacctgagctccttg

SEQ ID NO: 7907933 - DNA, 22 bp, Homo sapiens
ccgtggccttgatggctccggt

SEQ ID NO: 7907934 - DNA, 22 bp, Homo sapiens
ccgtggctggactggcattcag

SEQ ID NO: 7907935 - DNA, 22 bp, Homo sapiens
ccgtggagttgtgctgagtatg

SEQ ID NO: 7907936 - DNA, 22 bp, Homo sapiens
ccggctactcgggaggctgacg

SEQ ID NO: 7907937 - DNA, 22 bp, Homo sapiens
ccggctactcgggaggctgacg

SEQ ID NO: 7907938 - DNA, 22 bp, Homo sapiens
ccggctactcgggaggctgacg

SEQ ID NO: 7907939 - DNA, 22 bp, Homo sapiens
ccggctactcgggaggctgacg

SEQ ID NO: 7907940 - DNA, 22 bp, Homo sapiens
ccggctactcgggaggctgacg

SEQ ID NO: 7907941 - DNA, 22 bp, Homo sapiens
ccggctactcgggaggctgacg

SEQ ID NO: 7907942 - DNA, 22 bp, Homo sapiens
ccggctactcgggaggctgacg

SEQ ID NO: 7907943 - DNA, 22 bp, Homo sapiens
ccgggagcaggcgccaccgcca

SEQ ID NO: 7907944 - DNA, 22 bp, Homo sapiens
ccgggagcaggcgccaccgcca

SEQ ID NO: 7907945 - DNA, 22 bp, Homo sapiens
ccggctactcgggaggctgacg

SEQ ID NO: 7907946 - DNA, 22 bp, Homo sapiens
ccggctactcgggaggctgacg

SEQ ID NO: 7907947 - DNA, 22 bp, Homo sapiens
ccggctcggcgaccaggctgaa

SEQ ID NO: 7907948 - DNA, 22 bp, Homo sapiens
ccgggagcaggcgccaccgcca

SEQ ID NO: 7907949 - DNA, 22 bp, Homo sapiens
ccgggagcaggcgccaccgcca

SEQ ID NO: 7907950 - DNA, 22 bp, Homo sapiens
ccgggagcaggcgccaccgcca

SEQ ID NO: 7907951 - DNA, 22 bp, Homo sapiens
ccgggagcaggcgccaccgcca

SEQ ID NO: 7907952 - DNA, 22 bp, Homo sapiens
ccgggcctcgggacaccgggta

SEQ ID NO: 7907953 - DNA, 22 bp, Homo sapiens
ccgggcctcgggacaccgggta

SEQ ID NO: 7907954 - DNA, 22 bp, Homo sapiens
ccgggcctcgggacaccgggta

SEQ ID NO: 7907955 - DNA, 22 bp, Homo sapiens
ccgggcctcgggacaccgggta

SEQ ID NO: 7907956 - DNA, 22 bp, Homo sapiens
ccgggcctcgggacaccgggta

SEQ ID NO: 7907957 - DNA, 22 bp, Homo sapiens
ccgggcgggggctctcgtcacc

SEQ ID NO: 7907958 - DNA, 22 bp, Homo sapiens
ccgggcctcgggacaccgggta

SEQ ID NO: 7907959 - DNA, 22 bp, Homo sapiens
ccgggctggagtgcaatggctc

SEQ ID NO: 7907960 - DNA, 17 bp, Homo sapiens
cctcacagggaccagac

SEQ ID NO: 7907961 - DNA, 22 bp, Homo sapiens
cctcacagcctcatgcccagcc

SEQ ID NO: 7907962 - DNA, 22 bp, Homo sapiens
cctcacagcctcatgcccagcc

SEQ ID NO: 7907963 - DNA, 22 bp, Homo sapiens
cctcacagcttgggcaaacggc

SEQ ID NO: 7907964 - DNA, 17 bp, Homo sapiens
cctcacagggaccagac

SEQ ID NO: 7907965 - DNA, 22 bp, Homo sapiens
cctcacatgaatgtaagctcca

SEQ ID NO: 7907966 - DNA, 22 bp, Homo sapiens
cctcacagtttggctaactgtg

SEQ ID NO: 7907967 - DNA, 22 bp, Homo sapiens
cctcacagtgttcgtgtcagat

SEQ ID NO: 7907968 - DNA, 22 bp, Homo sapiens
cctcacagtttggctaactgtg

SEQ ID NO: 7907969 - DNA, 22 bp, Homo sapiens
cctcacagtcagttcttagtct

SEQ ID NO: 7907970 - DNA, 22 bp, Homo sapiens
cctcacccagtcacctaggtgg

SEQ ID NO: 7907971 - DNA, 22 bp, Homo sapiens
cctcacccagtcacctaggtgg

SEQ ID NO: 7907972 - DNA, 22 bp, Homo sapiens
cctcacccactacactcaaggg

SEQ ID NO: 7907973 - DNA, 22 bp, Homo sapiens
cctcacccactacactcaaggg

SEQ ID NO: 7907974 - DNA, 22 bp, Homo sapiens
cctcacccagtcacctaggtgg

SEQ ID NO: 7907975 - DNA, 22 bp, Homo sapiens
cctatttgtaggctgggccagt

SEQ ID NO: 7907976 - DNA, 20 bp, Homo sapiens
cctaaatacctgtcaccagg

SEQ ID NO: 7907977 - DNA, 22 bp, Homo sapiens
cctattcagtccttcaaggagg

SEQ ID NO: 7907978 - DNA, 22 bp, Homo sapiens
ccgtgtacataaagccctggta

SEQ ID NO: 7907979 - DNA, 23 bp, Homo sapiens
ccgtgtgtatactctgtaataga

SEQ ID NO: 7907980 - DNA, 22 bp, Homo sapiens
ccgtgtgtatggtggaactgct

SEQ ID NO: 7907981 - DNA, 22 bp, Homo sapiens
ccgtgttcaccagatgcccctc

SEQ ID NO: 7907982 - DNA, 21 bp, Homo sapiens
cctaaacaagactgacacaca

SEQ ID NO: 7907983 - DNA, 21 bp, Homo sapiens
cctaaacaagactgacacaca

SEQ ID NO: 7907984 - DNA, 22 bp, Homo sapiens
cctaaagaattttcatagagct

SEQ ID NO: 7907985 - DNA, 20 bp, Homo sapiens
cctaaatacctgtcaccagg

SEQ ID NO: 7907986 - DNA, 22 bp, Homo sapiens
cctaaagaattttcatagagct

SEQ ID NO: 7907987 - DNA, 22 bp, Homo sapiens
cctcacagccctcctctagcac

SEQ ID NO: 7907988 - DNA, 22 bp, Homo sapiens
cctcacagccctcctctagcac

SEQ ID NO: 7907989 - DNA, 22 bp, Homo sapiens
cctcacagccctcctctagcac

SEQ ID NO: 7907990 - DNA, 22 bp, Homo sapiens
cctcacagccctcctctagcac

SEQ ID NO: 7907991 - DNA, 22 bp, Homo sapiens
cctcacagcccttggcccagga

SEQ ID NO: 7907992 - DNA, 22 bp, Homo sapiens
cctcacagaggggcagccatct

SEQ ID NO: 7907993 - DNA, 22 bp, Homo sapiens
cctcacagaggggcagccatct

SEQ ID NO: 7907994 - DNA, 22 bp, Homo sapiens
cctcacagagcccagatgtcta

SEQ ID NO: 7907995 - DNA, 22 bp, Homo sapiens
cctcacagcaaggatttcagtg

SEQ ID NO: 7907996 - DNA, 22 bp, Homo sapiens
cctcacagaggggcagccatct

SEQ ID NO: 7907997 - DNA, 22 bp, Homo sapiens
cctcacagaggggcagccatct

SEQ ID NO: 7907998 - DNA, 22 bp, Homo sapiens
ccctgtgctgtcatgctgggcg

SEQ ID NO: 7907999 - DNA, 22 bp, Homo sapiens
ccctgtggaggaggagagcagt

SEQ ID NO: 7908000 - DNA, 22 bp, Homo sapiens
ccctgtggaggaggagagcagt

SEQ ID NO: 7908001 - DNA, 22 bp, Homo sapiens
ccctgtggaggcagcatcctgc

SEQ ID NO: 7908002 - DNA, 22 bp, Homo sapiens
ccctgtggaggaggagagcagt

SEQ ID NO: 7908003 - DNA, 22 bp, Homo sapiens
ccctgtggaggcagcatcctgc

SEQ ID NO: 7908004 - DNA, 22 bp, Homo sapiens
ccctgtgcctagttggcctaaa

SEQ ID NO: 7908005 - DNA, 22 bp, Homo sapiens
ccctgtgccagagaggcaggag

SEQ ID NO: 7908006 - DNA, 22 bp, Homo sapiens
ccctgtgccagagaggcaggag

SEQ ID NO: 7908007 - DNA, 22 bp, Homo sapiens
ccctgtgcctcagtttcctcat

SEQ ID NO: 7908008 - DNA, 22 bp, Homo sapiens
ccctgtgctgtcatgctgggcg

SEQ ID NO: 7908009 - DNA, 22 bp, Homo sapiens
ccctgtgcctagttggcctaaa

SEQ ID NO: 7908010 - DNA, 22 bp, Homo sapiens
ccctgtgatgtagctagagtag

SEQ ID NO: 7908011 - DNA, 22 bp, Homo sapiens
ccctgtgagcggctggatgcct

SEQ ID NO: 7908012 - DNA, 20 bp, Homo sapiens
ccctgtgattggcaagtgtc

SEQ ID NO: 7908013 - DNA, 20 bp, Homo sapiens
ccctgtgattggcaagtgtc

SEQ ID NO: 7908014 - DNA, 20 bp, Homo sapiens
ccctgtgattggcaagtgtc

SEQ ID NO: 7908015 - DNA, 22 bp, Homo sapiens
ccctgtgcattggagggtgttt

SEQ ID NO: 7908016 - DNA, 22 bp, Homo sapiens
ccctgtgcatattgccagatac

SEQ ID NO: 7908017 - DNA, 22 bp, Homo sapiens
ccctgtgcagatggcagctggg

SEQ ID NO: 7908018 - DNA, 22 bp, Homo sapiens
ccctgtgcagatggcagctggg

SEQ ID NO: 7908019 - DNA, 22 bp, Homo sapiens
ccctgtgcagatggcagctggg

SEQ ID NO: 7908020 - DNA, 22 bp, Homo sapiens
ccctgtgcacacacttcactct

SEQ ID NO: 7908021 - DNA, 22 bp, Homo sapiens
ccctgtgcacacacttcactct

SEQ ID NO: 7908022 - DNA, 22 bp, Homo sapiens
ccctgtgcacacacttcactct

SEQ ID NO: 7908023 - DNA, 22 bp, Homo sapiens
ccggagagtcagagcgcggccc

SEQ ID NO: 7908024 - DNA, 22 bp, Homo sapiens
ccggagtgtctggcctgctggg

SEQ ID NO: 7908025 - DNA, 22 bp, Homo sapiens
ccgcttggatggggggtccaga

SEQ ID NO: 7908026 - DNA, 22 bp, Homo sapiens
ccgcgtcttttgttcgggccta

SEQ ID NO: 7908027 - DNA, 22 bp, Homo sapiens
ccggcaaaggccccttccccag

SEQ ID NO: 7908028 - DNA, 22 bp, Homo sapiens
ccggagtgtctggcctgctggg

SEQ ID NO: 7908029 - DNA, 22 bp, Homo sapiens
ccggcgaccgctgtcggaggcg

SEQ ID NO: 7908030 - DNA, 22 bp, Homo sapiens
ccggcgaccgctgtcggaggcg

SEQ ID NO: 7908031 - DNA, 22 bp, Homo sapiens
ccggctactcgggaggctgacg

SEQ ID NO: 7908032 - DNA, 22 bp, Homo sapiens
ccctgtggatttcagtttgtgt

SEQ ID NO: 7908033 - DNA, 22 bp, Homo sapiens
ccctgtggatttcagtttgtgt

SEQ ID NO: 7908034 - DNA, 22 bp, Homo sapiens
ccctgtggcaggaggaggagca

SEQ ID NO: 7908035 - DNA, 22 bp, Homo sapiens
ccctgtggaggcagcatcctgc

SEQ ID NO: 7908036 - DNA, 22 bp, Homo sapiens
ccctgtgggaactcctgagttg

SEQ ID NO: 7908037 - DNA, 22 bp, Homo sapiens
ccctgtggcaggaggaggagca

SEQ ID NO: 7908038 - DNA, 22 bp, Homo sapiens
ccctttccatggctctcctagg

SEQ ID NO: 7908039 - DNA, 22 bp, Homo sapiens
ccgcgcgcgtgggcgtccaggg

SEQ ID NO: 7908040 - DNA, 22 bp, Homo sapiens
ccgcgccacccattcccactga

SEQ ID NO: 7908041 - DNA, 22 bp, Homo sapiens
ccctttcattggcagagctctc

SEQ ID NO: 7908042 - DNA, 22 bp, Homo sapiens
ccctttcattggcagagctctc

SEQ ID NO: 7908043 - DNA, 22 bp, Homo sapiens
ccctttcatattttataaatgg

SEQ ID NO: 7908044 - DNA, 22 bp, Homo sapiens
ccctgtgggaactcctgagttg

SEQ ID NO: 7908045 - DNA, 22 bp, Homo sapiens
ccctttcattggcagagctctc

SEQ ID NO: 7908046 - DNA, 22 bp, Homo sapiens
ccctgtccttggctgtgaggct

SEQ ID NO: 7908047 - DNA, 22 bp, Homo sapiens
ccctgtctcattgatcacttgt

SEQ ID NO: 7908048 - DNA, 22 bp, Homo sapiens
ccctgtctgtaccgtgatgagc

SEQ ID NO: 7908049 - DNA, 22 bp, Homo sapiens
ccctgtctgtaccgtgatgagc

SEQ ID NO: 7908050 - DNA, 22 bp, Homo sapiens
ccctgtcctggatgggagcact

SEQ ID NO: 7908051 - DNA, 22 bp, Homo sapiens
ccctgtcctgctaggccctggt

SEQ ID NO: 7908052 - DNA, 22 bp, Homo sapiens
ccctggtgtccactggaggaag

SEQ ID NO: 7908053 - DNA, 22 bp, Homo sapiens
ccctggtgtccactggaggaag

SEQ ID NO: 7908054 - DNA, 22 bp, Homo sapiens
ccctggtggtacggcactggca

SEQ ID NO: 7908055 - DNA, 22 bp, Homo sapiens
ccctggtggtacggcactggca

SEQ ID NO: 7908056 - DNA, 22 bp, Homo sapiens
ccctggtggtacggcactggca

SEQ ID NO: 7908057 - DNA, 22 bp, Homo sapiens
ccctggtggtacggcactggca

SEQ ID NO: 7908058 - DNA, 22 bp, Homo sapiens
ccctggtggtacggcactggca

SEQ ID NO: 7908059 - DNA, 22 bp, Homo sapiens
ccctggtggtacggcactggca

SEQ ID NO: 7908060 - DNA, 22 bp, Homo sapiens
ccctggtggtacggcactggca

SEQ ID NO: 7908061 - DNA, 22 bp, Homo sapiens
ccctggtggtacggcactggca

SEQ ID NO: 7908062 - DNA, 22 bp, Homo sapiens
ccctggtgtggatgtgattggc

SEQ ID NO: 7908063 - DNA, 22 bp, Homo sapiens
ccctggtgtccactggaggaag

SEQ ID NO: 7908064 - DNA, 22 bp, Homo sapiens
ccctggtgtccactggaggaag

SEQ ID NO: 7908065 - DNA, 22 bp, Homo sapiens
ccctggtgtggatgtgattggc

SEQ ID NO: 7908066 - DNA, 22 bp, Homo sapiens
ccctggttcaggtttctctgaa

SEQ ID NO: 7908067 - DNA, 22 bp, Homo sapiens
ccctggagctgcttgcatgttg

SEQ ID NO: 7908068 - DNA, 22 bp, Homo sapiens
ccctggaggaaaatctgaggct

SEQ ID NO: 7908069 - DNA, 22 bp, Homo sapiens
ccctggaggaaaatctgaggct

SEQ ID NO: 7908070 - DNA, 22 bp, Homo sapiens
ccctggaggaaaatctgaggct

SEQ ID NO: 7908071 - DNA, 22 bp, Homo sapiens
ccctggagctgcttgcatgttg

SEQ ID NO: 7908072 - DNA, 22 bp, Homo sapiens
ccctggagctgcttgcatgttg

SEQ ID NO: 7908073 - DNA, 22 bp, Homo sapiens
ccctggagctgcttgcatgttg

SEQ ID NO: 7908074 - DNA, 22 bp, Homo sapiens
ccctggaggaaaatctgaggct

SEQ ID NO: 7908075 - DNA, 22 bp, Homo sapiens
ccctggaggaagaaacaatggc

SEQ ID NO: 7908076 - DNA, 22 bp, Homo sapiens
ccctggaggaaaatctgaggct

SEQ ID NO: 7908077 - DNA, 22 bp, Homo sapiens
ccctggaggaagaaacaatggc

SEQ ID NO: 7908078 - DNA, 22 bp, Homo sapiens
ccctgggagtccactgatgtca

SEQ ID NO: 7908079 - DNA, 22 bp, Homo sapiens
ccctggtggtacggcactggca

SEQ ID NO: 7908080 - DNA, 22 bp, Homo sapiens
ccctggtggggccagacttgct

SEQ ID NO: 7908081 - DNA, 22 bp, Homo sapiens
ccctggtggggccagacttgct

SEQ ID NO: 7908082 - DNA, 22 bp, Homo sapiens
ccctggtgccctgggtcagcct

SEQ ID NO: 7908083 - DNA, 22 bp, Homo sapiens
ccctggtgccctgggtcagcct

SEQ ID NO: 7908084 - DNA, 22 bp, Homo sapiens
ccctggtgccctgggtcagcct

SEQ ID NO: 7908085 - DNA, 22 bp, Homo sapiens
ccctggtcagggaaggcgcctg

SEQ ID NO: 7908086 - DNA, 22 bp, Homo sapiens
ccctgggataccagacaccaga

SEQ ID NO: 7908087 - DNA, 22 bp, Homo sapiens
ccctgggatggattggcaggaa

SEQ ID NO: 7908088 - DNA, 22 bp, Homo sapiens
ccctgggataccagacaccaga

SEQ ID NO: 7908089 - DNA, 22 bp, Homo sapiens
ccctgggatggattggcaggaa

SEQ ID NO: 7908090 - DNA, 22 bp, Homo sapiens
ccctggtcagggaaggcgcctg

SEQ ID NO: 7908091 - DNA, 22 bp, Homo sapiens
cccgtcccttttgcccgctggt

SEQ ID NO: 7908092 - DNA, 22 bp, Homo sapiens
cccgtgtggacagcgtgccagt

SEQ ID NO: 7908093 - DNA, 23 bp, Homo sapiens
cccggtttgcccacatgtccttg

SEQ ID NO: 7908094 - DNA, 22 bp, Homo sapiens
cccgggaggtggagcttgcagt

SEQ ID NO: 7908095 - DNA, 22 bp, Homo sapiens
cccgggttgtccgcgcgtccgg

SEQ ID NO: 7908096 - DNA, 21 bp, Homo sapiens
tgctttctaaaaatactattg

SEQ ID NO: 7908097 - DNA, 21 bp, Homo sapiens
tgctttctaaaaatactattg

SEQ ID NO: 7908098 - DNA, 18 bp, Homo sapiens
cccggctaatttttggta

SEQ ID NO: 7908099 - DNA, 18 bp, Homo sapiens
cccggctaatttttggta

SEQ ID NO: 7908100 - DNA, 22 bp, Homo sapiens
cccgggagactcctctagggct

SEQ ID NO: 7908101 - DNA, 22 bp, Homo sapiens
cccgggaggtggagactgcagt

SEQ ID NO: 7908102 - DNA, 17 bp, Homo sapiens
cccgttctcttcgctgg

SEQ ID NO: 7908103 - DNA, 22 bp, Homo sapiens
cccgtttcagtgttccttgctt

SEQ ID NO: 7908104 - DNA, 22 bp, Homo sapiens
cccgtgtggacagcgtgccagt

SEQ ID NO: 7908105 - DNA, 22 bp, Homo sapiens
cccgtgtggacagcgtgccagt

SEQ ID NO: 7908106 - DNA, 17 bp, Homo sapiens
cccgttctcttcgctgg

SEQ ID NO: 7908107 - DNA, 22 bp, Homo sapiens
ccctaaaagtctcattttccag

SEQ ID NO: 7908108 - DNA, 22 bp, Homo sapiens
ccctaagaagcaaagtgatacc

SEQ ID NO: 7908109 - DNA, 22 bp, Homo sapiens
ccctaagaccctcaagatctcc

SEQ ID NO: 7908110 - DNA, 22 bp, Homo sapiens
ccctacaggtgattctggtgct

SEQ ID NO: 7908111 - DNA, 22 bp, Homo sapiens
ccctagaaatgaaagcatacgt

SEQ ID NO: 7908112 - DNA, 22 bp, Homo sapiens
tggaagaataggatagaagaac

SEQ ID NO: 7908113 - DNA, 22 bp, Homo sapiens
tggaagaataggatagaagaac

SEQ ID NO: 7908114 - DNA, 22 bp, Homo sapiens
tggaagaataggatagaagaac

SEQ ID NO: 7908115 - DNA, 22 bp, Homo sapiens
tggaagaataggatagaagaac

SEQ ID NO: 7908116 - DNA, 22 bp, Homo sapiens
tggaagaataggatagaagaac

SEQ ID NO: 7908117 - DNA, 22 bp, Homo sapiens
tggaagaatatgggggtacaga

SEQ ID NO: 7908118 - DNA, 22 bp, Homo sapiens
tggaagaagctacaagcggtga

SEQ ID NO: 7908119 - DNA, 22 bp, Homo sapiens
tggaagaaggcagagaggcatt

SEQ ID NO: 7908120 - DNA, 22 bp, Homo sapiens
tggaagaatagaagatggttga

SEQ ID NO: 7908121 - DNA, 22 bp, Homo sapiens
tggaagaaggcagagaggcatt

SEQ ID NO: 7908122 - DNA, 22 bp, Homo sapiens
tggaagaaggcagagaggcatt

SEQ ID NO: 7908123 - DNA, 22 bp, Homo sapiens
tggaaagacatgtccttcatta

SEQ ID NO: 7908124 - DNA, 22 bp, Homo sapiens
tggaaagacattcagccgctgg

SEQ ID NO: 7908125 - DNA, 22 bp, Homo sapiens
tggaaagagaaactcttgctaa

SEQ ID NO: 7908126 - DNA, 22 bp, Homo sapiens
tggaaagagaaactcttgctaa

SEQ ID NO: 7908127 - DNA, 20 bp, Homo sapiens
tggaagaagaactcaggctt

SEQ ID NO: 7908128 - DNA, 20 bp, Homo sapiens
tggaagaagaactcaggctt

SEQ ID NO: 7908129 - DNA, 19 bp, Homo sapiens
ccctagagtaagactgcat

SEQ ID NO: 7908130 - DNA, 19 bp, Homo sapiens
ccctagagtaagactgcat

SEQ ID NO: 7908131 - DNA, 19 bp, Homo sapiens
ccctagagtaagactgcat

SEQ ID NO: 7908132 - DNA, 22 bp, Homo sapiens
ccctagaaatgaaagcatacgt

SEQ ID NO: 7908133 - DNA, 22 bp, Homo sapiens
ccctagaacacgcagacactga

SEQ ID NO: 7908134 - DNA, 22 bp, Homo sapiens
ccctagagagatcagatgggga

SEQ ID NO: 7908135 - DNA, 22 bp, Homo sapiens
ccctagaacacgcagacactga

SEQ ID NO: 7908136 - DNA, 20 bp, Homo sapiens
tggaaggcatctgcattatt

SEQ ID NO: 7908137 - DNA, 22 bp, Homo sapiens
tggaaggcatgggaactgttct

SEQ ID NO: 7908138 - DNA, 22 bp, Homo sapiens
tggaaggcatttcacacaggat

SEQ ID NO: 7908139 - DNA, 22 bp, Homo sapiens
tggaaggcactgggagaagact

SEQ ID NO: 7908140 - DNA, 22 bp, Homo sapiens
tggaaggcaggacctgccttgg

SEQ ID NO: 7908141 - DNA, 22 bp, Homo sapiens
tggaagacaggctgtattttaa

SEQ ID NO: 7908142 - DNA, 22 bp, Homo sapiens
tggaagacaggctgtattttaa

SEQ ID NO: 7908143 - DNA, 22 bp, Homo sapiens
tggaagacaggcatggaagtgg

SEQ ID NO: 7908144 - DNA, 22 bp, Homo sapiens
tggaagacaggagatgtgtgta

SEQ ID NO: 7908145 - DNA, 22 bp, Homo sapiens
tggaagacaggagatgtgtgta

SEQ ID NO: 7908146 - DNA, 22 bp, Homo sapiens
tggaagacaggcatggaagtgg

SEQ ID NO: 7908147 - DNA, 22 bp, Homo sapiens
tggaagacagtgactggttgtg

SEQ ID NO: 7908148 - DNA, 22 bp, Homo sapiens
tggaaggcaacggagtgagctg

SEQ ID NO: 7908149 - DNA, 22 bp, Homo sapiens
tggaagacatactgttttctta

SEQ ID NO: 7908150 - DNA, 22 bp, Homo sapiens
tggaagacagttgatgggagtt

SEQ ID NO: 7908151 - DNA, 22 bp, Homo sapiens
tggaagacatactgttttctta

SEQ ID NO: 7908152 - DNA, 22 bp, Homo sapiens
tggaagacaagtgttagcatgg

SEQ ID NO: 7908153 - DNA, 22 bp, Homo sapiens
tggaagacaagtgttagcatgg

SEQ ID NO: 7908154 - DNA, 22 bp, Homo sapiens
tggaagacaaagattcaatatt

SEQ ID NO: 7908155 - DNA, 22 bp, Homo sapiens
tggaagaatttggggataaatt

SEQ ID NO: 7908156 - DNA, 22 bp, Homo sapiens
tggaagacaaagattcaatatt

SEQ ID NO: 7908157 - DNA, 22 bp, Homo sapiens
tggaagaatttggggataaatt

SEQ ID NO: 7908158 - DNA, 22 bp, Homo sapiens
tggaagacaatgtacatgcagt

SEQ ID NO: 7908159 - DNA, 22 bp, Homo sapiens
tggaagacaagtgttagcatgg

SEQ ID NO: 7908160 - DNA, 22 bp, Homo sapiens
tggaagacaatgtacatgcagt

SEQ ID NO: 7908161 - DNA, 22 bp, Homo sapiens
tggaagacaatgtacatgcagt

SEQ ID NO: 7908162 - DNA, 22 bp, Homo sapiens
tggaagacaatttgaaaacatt

SEQ ID NO: 7908163 - DNA, 22 bp, Homo sapiens
tggaagacactatttaccaggt

SEQ ID NO: 7908164 - DNA, 20 bp, Homo sapiens
tggaagacactgaagggcca

SEQ ID NO: 7908165 - DNA, 22 bp, Homo sapiens
tggaagacactatttaccaggt

SEQ ID NO: 7908166 - DNA, 22 bp, Homo sapiens
tggaagacaatttgaaaacatt

SEQ ID NO: 7908167 - DNA, 20 bp, Homo sapiens
tggaagacactgaagggcca

SEQ ID NO: 7908168 - DNA, 22 bp, Homo sapiens
tggaagacactatttaccaggt

SEQ ID NO: 7908169 - DNA, 22 bp, Homo sapiens
tggaagggaacaggtgggtgtt

SEQ ID NO: 7908170 - DNA, 22 bp, Homo sapiens
tggaagggaacaggtgggtgtt

SEQ ID NO: 7908171 - DNA, 22 bp, Homo sapiens
tggaagggaacaggtgggtgtt

SEQ ID NO: 7908172 - DNA, 22 bp, Homo sapiens
tggaagggaaagtttggggtcc

SEQ ID NO: 7908173 - DNA, 22 bp, Homo sapiens
tggaagggaaagtttggggtcc

SEQ ID NO: 7908174 - DNA, 22 bp, Homo sapiens
tggaagggaaagtttggggtcc

SEQ ID NO: 7908175 - DNA, 22 bp, Homo sapiens
tggaaggcttggaatacttcca

SEQ ID NO: 7908176 - DNA, 17 bp, Homo sapiens
tggaaggcttcaatatt

SEQ ID NO: 7908177 - DNA, 17 bp, Homo sapiens
tggaaggcttcaatatt

SEQ ID NO: 7908178 - DNA, 22 bp, Homo sapiens
tggaaggcttcatatgtaaaga

SEQ ID NO: 7908179 - DNA, 22 bp, Homo sapiens
tggaagggaaagtttggggtcc

SEQ ID NO: 7908180 - DNA, 22 bp, Homo sapiens
tggaagggaaagtttggggtcc

SEQ ID NO: 7908181 - DNA, 22 bp, Homo sapiens
tggaaggctttgctgtccttgc

SEQ ID NO: 7908182 - DNA, 22 bp, Homo sapiens
tggaaggcttggaatacttcca

SEQ ID NO: 7908183 - DNA, 22 bp, Homo sapiens
tggaaggcgcagtgatgatgct

SEQ ID NO: 7908184 - DNA, 22 bp, Homo sapiens
tggaaggcatttcacacaggat

SEQ ID NO: 7908185 - DNA, 22 bp, Homo sapiens
tggaaggctaggtgctaggccc

SEQ ID NO: 7908186 - DNA, 19 bp, Homo sapiens
tggaaggctaagacacttg

SEQ ID NO: 7908187 - DNA, 21 bp, Homo sapiens
tggaaggctgctctgccaggg

SEQ ID NO: 7908188 - DNA, 22 bp, Homo sapiens
tggaaggctgagagtcctgggg

SEQ ID NO: 7908189 - DNA, 22 bp, Homo sapiens
tggaaggctgagagtcctgggg

SEQ ID NO: 7908190 - DNA, 21 bp, Homo sapiens
tggaaggctgctctgccaggg

SEQ ID NO: 7908191 - DNA, 22 bp, Homo sapiens
tgctttcaatgaattgtatact

SEQ ID NO: 7908192 - DNA, 22 bp, Homo sapiens
tgctttcaatgaattgtatact

SEQ ID NO: 7908193 - DNA, 22 bp, Homo sapiens
tgctttcaatgaattgtatact

SEQ ID NO: 7908194 - DNA, 22 bp, Homo sapiens
tgctttcacaccatgcctataa

SEQ ID NO: 7908195 - DNA, 22 bp, Homo sapiens
tgctttcaaaggctttctagat

SEQ ID NO: 7908196 - DNA, 22 bp, Homo sapiens
tgctttcacatgtatgcacaaa

SEQ ID NO: 7908197 - DNA, 22 bp, Homo sapiens
tgctttcacatgtatgcacaaa

SEQ ID NO: 7908198 - DNA, 22 bp, Homo sapiens
tgctttcacctgtttgcaccca

SEQ ID NO: 7908199 - DNA, 22 bp, Homo sapiens
tgctttcacttctctgcagcca

SEQ ID NO: 7908200 - DNA, 22 bp, Homo sapiens
tgctttcagctggtaaagaaac

SEQ ID NO: 7908201 - DNA, 22 bp, Homo sapiens
tgctttcagggatgtctgtgag

SEQ ID NO: 7908202 - DNA, 22 bp, Homo sapiens
tgctttcagctggtaaagaaac

SEQ ID NO: 7908203 - DNA, 22 bp, Homo sapiens
tgctttcatattgcctatgact

SEQ ID NO: 7908204 - DNA, 22 bp, Homo sapiens
tgctttcagtttacatcagaac

SEQ ID NO: 7908205 - DNA, 22 bp, Homo sapiens
tgctttcattgtgataggaagc

SEQ ID NO: 7908206 - DNA, 22 bp, Homo sapiens
tgctttcattcacaaaatagca

SEQ ID NO: 7908207 - DNA, 22 bp, Homo sapiens
tgctttcattcacaaaatagca

SEQ ID NO: 7908208 - DNA, 22 bp, Homo sapiens
tgctttattggaacctcatcct

SEQ ID NO: 7908209 - DNA, 22 bp, Homo sapiens
tgctttattttaaatatgccat

SEQ ID NO: 7908210 - DNA, 22 bp, Homo sapiens
tgctttatttataaaatagcaa

SEQ ID NO: 7908211 - DNA, 22 bp, Homo sapiens
tgctttatttataaaatagcaa

SEQ ID NO: 7908212 - DNA, 22 bp, Homo sapiens
tgctttatttataaaatagcaa

SEQ ID NO: 7908213 - DNA, 22 bp, Homo sapiens
tgcttgtccgaggtgagtactt

SEQ ID NO: 7908214 - DNA, 22 bp, Homo sapiens
tgcttgtctcagataaaactat

SEQ ID NO: 7908215 - DNA, 19 bp, Homo sapiens
tgcctgctcctggcttcca

SEQ ID NO: 7908216 - DNA, 22 bp, Homo sapiens
tgcttgtctcagataaaactat

SEQ ID NO: 7908217 - DNA, 22 bp, Homo sapiens
tgcttgtctctctgtgcccact

SEQ ID NO: 7908218 - DNA, 22 bp, Homo sapiens
tgcttgtctctctgtgcccact

SEQ ID NO: 7908219 - DNA, 22 bp, Homo sapiens
tgctttattgcatcagtgtggg

SEQ ID NO: 7908220 - DNA, 22 bp, Homo sapiens
tgcttgtctctctgtgcccact

SEQ ID NO: 7908221 - DNA, 22 bp, Homo sapiens
tgctttattgcatcagtgtggg

SEQ ID NO: 7908222 - DNA, 22 bp, Homo sapiens
tgcctgctaggccctgctgggt

SEQ ID NO: 7908223 - DNA, 22 bp, Homo sapiens
tgcctgctatttgcctaaagtg

SEQ ID NO: 7908224 - DNA, 22 bp, Homo sapiens
tgcctgctatttgcctaaagtg

SEQ ID NO: 7908225 - DNA, 22 bp, Homo sapiens
tgcctgctccagtcctgtccac

SEQ ID NO: 7908226 - DNA, 22 bp, Homo sapiens
tgcctgcctctggcagccctgc

SEQ ID NO: 7908227 - DNA, 22 bp, Homo sapiens
tgcctgcctctggagcccatcc

SEQ ID NO: 7908228 - DNA, 22 bp, Homo sapiens
tgcctgcctgcatagtcccacg

SEQ ID NO: 7908229 - DNA, 22 bp, Homo sapiens
tgcctgcctgcatagtcccacg

SEQ ID NO: 7908230 - DNA, 22 bp, Homo sapiens
tgcctgctagatatccaggtga

SEQ ID NO: 7908231 - DNA, 22 bp, Homo sapiens
tgcctgccttgctgctggacag

SEQ ID NO: 7908232 - DNA, 22 bp, Homo sapiens
tgcctgcgaggcatgggtgaga

SEQ ID NO: 7908233 - DNA, 18 bp, Homo sapiens
tgcctgccccgtaagggt

SEQ ID NO: 7908234 - DNA, 22 bp, Homo sapiens
tgcctccattcctgggtcattg

SEQ ID NO: 7908235 - DNA, 22 bp, Homo sapiens
tgcctgccctgaaaactgccca

SEQ ID NO: 7908236 - DNA, 22 bp, Homo sapiens
tgcctccatgtttcagcatcta

SEQ ID NO: 7908237 - DNA, 22 bp, Homo sapiens
tgcctccaggaggggcagctct

SEQ ID NO: 7908238 - DNA, 22 bp, Homo sapiens
tgcctgccctttccacacagcc

SEQ ID NO: 7908239 - DNA, 22 bp, Homo sapiens
tgcctgccctttccacacagcc

SEQ ID NO: 7908240 - DNA, 22 bp, Homo sapiens
tgcctgcctcaggccgagtgct

SEQ ID NO: 7908241 - DNA, 22 bp, Homo sapiens
tgcctgcctaggaagctgtgaa

SEQ ID NO: 7908242 - DNA, 22 bp, Homo sapiens
tgcctgcctcaggccgagtgct

SEQ ID NO: 7908243 - DNA, 22 bp, Homo sapiens
tgcctgcctcaggccgagtgct

SEQ ID NO: 7908244 - DNA, 22 bp, Homo sapiens
tgcctgcctcaggccgagtgct

SEQ ID NO: 7908245 - DNA, 22 bp, Homo sapiens
tgcctgcctaggaagctgtgaa

SEQ ID NO: 7908246 - DNA, 22 bp, Homo sapiens
tgcctgccgctgtctagtactg

SEQ ID NO: 7908247 - DNA, 22 bp, Homo sapiens
tgcctgccctttccacacagcc

SEQ ID NO: 7908248 - DNA, 22 bp, Homo sapiens
tgcctgccgctgtctagtactg

SEQ ID NO: 7908249 - DNA, 22 bp, Homo sapiens
tgcctcagtttctccatatgaa

SEQ ID NO: 7908250 - DNA, 22 bp, Homo sapiens
tgcctcagtttcatctgcagaa

SEQ ID NO: 7908251 - DNA, 22 bp, Homo sapiens
tgcctcagtttcatctgcagaa

SEQ ID NO: 7908252 - DNA, 22 bp, Homo sapiens
tgcctcagtttcatctgcagaa

SEQ ID NO: 7908253 - DNA, 22 bp, Homo sapiens
tgcctcagtttcatctgcagaa

SEQ ID NO: 7908254 - DNA, 22 bp, Homo sapiens
tgcctcagtttcatctgcagaa

SEQ ID NO: 7908255 - DNA, 22 bp, Homo sapiens
tgcctcagtttctccatatgaa

SEQ ID NO: 7908256 - DNA, 22 bp, Homo sapiens
tgcctcagtttctccatatgaa

SEQ ID NO: 7908257 - DNA, 22 bp, Homo sapiens
tgcctcagtttctccatatgaa

SEQ ID NO: 7908258 - DNA, 22 bp, Homo sapiens
tgcctccaacagcccatcctag

SEQ ID NO: 7908259 - DNA, 22 bp, Homo sapiens
tgcctccaacagcccatcctag

SEQ ID NO: 7908260 - DNA, 22 bp, Homo sapiens
tgcctccaccattgctcacttt

SEQ ID NO: 7908261 - DNA, 22 bp, Homo sapiens
tgcctccaccattgctcacttt

SEQ ID NO: 7908262 - DNA, 22 bp, Homo sapiens
tgcctccaccattgctcacttt

SEQ ID NO: 7908263 - DNA, 22 bp, Homo sapiens
tgcctccaccattgctcacttt

SEQ ID NO: 7908264 - DNA, 22 bp, Homo sapiens
tgcctccaggaggggcagctct

SEQ ID NO: 7908265 - DNA, 22 bp, Homo sapiens
tgcctccaggaggggcagctct

SEQ ID NO: 7908266 - DNA, 22 bp, Homo sapiens
tgcctccaggaggggcagctct

SEQ ID NO: 7908267 - DNA, 22 bp, Homo sapiens
tgcctccaggaggggcagctct

SEQ ID NO: 7908268 - DNA, 22 bp, Homo sapiens
tgcctccaggaggggcagctct

SEQ ID NO: 7908269 - DNA, 22 bp, Homo sapiens
tgcctccatgtttcagcatcta

SEQ ID NO: 7908270 - DNA, 22 bp, Homo sapiens
tgcctccatgtttcagcatcta

SEQ ID NO: 7908271 - DNA, 22 bp, Homo sapiens
tgcctccatgtttcagcatcta

SEQ ID NO: 7908272 - DNA, 22 bp, Homo sapiens
tgcctccatgtttcagcatcta

SEQ ID NO: 7908273 - DNA, 23 bp, Homo sapiens
tgcctccaccgagggccaggcat

SEQ ID NO: 7908274 - DNA, 23 bp, Homo sapiens
tgcctccaccgagggccaggcat

SEQ ID NO: 7908275 - DNA, 23 bp, Homo sapiens
tgcctccaccgagggccaggcat

SEQ ID NO: 7908276 - DNA, 23 bp, Homo sapiens
tgcctccaccgagggccaggcat

SEQ ID NO: 7908277 - DNA, 17 bp, Homo sapiens
tgcctccagcagggtga

SEQ ID NO: 7908278 - DNA, 23 bp, Homo sapiens
tgcctccaccgagggccaggcat

SEQ ID NO: 7908279 - DNA, 23 bp, Homo sapiens
tgcctccaccgagggccaggcat

SEQ ID NO: 7908280 - DNA, 17 bp, Homo sapiens
tgcctccagcagggtga

SEQ ID NO: 7908281 - DNA, 22 bp, Homo sapiens
ccctgccttgtctgggctaggt

SEQ ID NO: 7908282 - DNA, 22 bp, Homo sapiens
ccctgccttggggtccacaccg

SEQ ID NO: 7908283 - DNA, 22 bp, Homo sapiens
ccctgccttggggtccacaccg

SEQ ID NO: 7908284 - DNA, 22 bp, Homo sapiens
ccctgccttggggtccacaccg

SEQ ID NO: 7908285 - DNA, 22 bp, Homo sapiens
ccctgccttcttggcctttaaa

SEQ ID NO: 7908286 - DNA, 22 bp, Homo sapiens
ccctgccttcttggcctttaaa

SEQ ID NO: 7908287 - DNA, 22 bp, Homo sapiens
ccctgccttggggtccacaccg

SEQ ID NO: 7908288 - DNA, 22 bp, Homo sapiens
ccctgccttggggtccacaccg

SEQ ID NO: 7908289 - DNA, 22 bp, Homo sapiens
ccctgccttgttggagcctatg

SEQ ID NO: 7908290 - DNA, 22 bp, Homo sapiens
ccctgctagaacctccaacatg

SEQ ID NO: 7908291 - DNA, 22 bp, Homo sapiens
ccctgccttgttggagcctatg

SEQ ID NO: 7908292 - DNA, 22 bp, Homo sapiens
ccctgccttgttggagcctatg

SEQ ID NO: 7908293 - DNA, 22 bp, Homo sapiens
ccctgccttgtctgggctaggt

SEQ ID NO: 7908294 - DNA, 22 bp, Homo sapiens
ccctgccttgttggagcctatg

SEQ ID NO: 7908295 - DNA, 22 bp, Homo sapiens
ccctgccttgttggagcctatg

SEQ ID NO: 7908296 - DNA, 22 bp, Homo sapiens
ccctgccttgtctgggctaggt

SEQ ID NO: 7908297 - DNA, 22 bp, Homo sapiens
ccctgccttgtctgggctaggt

SEQ ID NO: 7908298 - DNA, 22 bp, Homo sapiens
ccctgctgaatcccatggagtc

SEQ ID NO: 7908299 - DNA, 22 bp, Homo sapiens
ccctgctgaatcccatggagtc

SEQ ID NO: 7908300 - DNA, 22 bp, Homo sapiens
tggaggccagaggtactgggac

SEQ ID NO: 7908301 - DNA, 22 bp, Homo sapiens
tggaggccagaggtactgggac

SEQ ID NO: 7908302 - DNA, 22 bp, Homo sapiens
ccctgctgaatcccatggagtc

SEQ ID NO: 7908303 - DNA, 22 bp, Homo sapiens
tggaggccaggaaggcagcgag

SEQ ID NO: 7908304 - DNA, 22 bp, Homo sapiens
tggaggccaggaaggcagcgag

SEQ ID NO: 7908305 - DNA, 22 bp, Homo sapiens
tggaggccaggaaggcagcgag

SEQ ID NO: 7908306 - DNA, 22 bp, Homo sapiens
tggaggccaggaaggcagcgag

SEQ ID NO: 7908307 - DNA, 22 bp, Homo sapiens
tggaggccaggaaggcagcgag

SEQ ID NO: 7908308 - DNA, 22 bp, Homo sapiens
tggaggggcaatggagcgcgga

SEQ ID NO: 7908309 - DNA, 22 bp, Homo sapiens
tggaggggcaatggagcgcgga

SEQ ID NO: 7908310 - DNA, 22 bp, Homo sapiens
tggaggggcaatggagcgcgga

SEQ ID NO: 7908311 - DNA, 22 bp, Homo sapiens
tggaggggcaatggagcgcgga

SEQ ID NO: 7908312 - DNA, 19 bp, Homo sapiens
tggaggccaggacacaggt

SEQ ID NO: 7908313 - DNA, 19 bp, Homo sapiens
tggaggccaggacacaggt

SEQ ID NO: 7908314 - DNA, 22 bp, Homo sapiens
ccctgctcttctgactcaagct

SEQ ID NO: 7908315 - DNA, 22 bp, Homo sapiens
ccctgctcttctgactcaagct

SEQ ID NO: 7908316 - DNA, 22 bp, Homo sapiens
ccctgctcttctgactcaagct

SEQ ID NO: 7908317 - DNA, 22 bp, Homo sapiens
ccctgctgaagaacgttcatac

SEQ ID NO: 7908318 - DNA, 22 bp, Homo sapiens
ccctgctcttagtgcctgtgtg

SEQ ID NO: 7908319 - DNA, 23 bp, Homo sapiens
ccctgctcaggggtctgattctc

SEQ ID NO: 7908320 - DNA, 22 bp, Homo sapiens
ccctgctcttagtgcctgtgtg

SEQ ID NO: 7908321 - DNA, 22 bp, Homo sapiens
ccctgctcttagtgcctgtgtg

SEQ ID NO: 7908322 - DNA, 22 bp, Homo sapiens
ccctgctcttagtgcctgtgtg

SEQ ID NO: 7908323 - DNA, 23 bp, Homo sapiens
ccctgctcaggggtctgattctc

SEQ ID NO: 7908324 - DNA, 23 bp, Homo sapiens
ccctgctcaggggtctgattctc

SEQ ID NO: 7908325 - DNA, 22 bp, Homo sapiens
ccctgctagttgtctcagtgat

SEQ ID NO: 7908326 - DNA, 22 bp, Homo sapiens
ccctgctagttgtctcagtgat

SEQ ID NO: 7908327 - DNA, 22 bp, Homo sapiens
tggaggtcttacccagggctat

SEQ ID NO: 7908328 - DNA, 22 bp, Homo sapiens
tggaggtcttacccagggctat

SEQ ID NO: 7908329 - DNA, 22 bp, Homo sapiens
tggaggtcttacccagggctat

SEQ ID NO: 7908330 - DNA, 22 bp, Homo sapiens
tggaggtctgcaaggcgctgga

SEQ ID NO: 7908331 - DNA, 22 bp, Homo sapiens
tggaggtctgcaaggcgctgga

SEQ ID NO: 7908332 - DNA, 22 bp, Homo sapiens
tggaggtctctgtctgggcagg

SEQ ID NO: 7908333 - DNA, 22 bp, Homo sapiens
tggaggtctctgtctgggcagg

SEQ ID NO: 7908334 - DNA, 22 bp, Homo sapiens
tggaggtcgctagcgagcgggc

SEQ ID NO: 7908335 - DNA, 22 bp, Homo sapiens
tggaggtctctgtctgggcagg

SEQ ID NO: 7908336 - DNA, 22 bp, Homo sapiens
tggaggtctcctggtattgacc

SEQ ID NO: 7908337 - DNA, 22 bp, Homo sapiens
tggaggtctctgtctgggcagg

SEQ ID NO: 7908338 - DNA, 22 bp, Homo sapiens
tggaggtctgcaaggcgctgga

SEQ ID NO: 7908339 - DNA, 22 bp, Homo sapiens
tggaggtctgcaaggcgctgga

SEQ ID NO: 7908340 - DNA, 22 bp, Homo sapiens
tggaggtcgcgcgggtgctgca

SEQ ID NO: 7908341 - DNA, 22 bp, Homo sapiens
tggaggtcgcgcgggtgctgca

SEQ ID NO: 7908342 - DNA, 22 bp, Homo sapiens
tggaggtcctggctgggtttta

SEQ ID NO: 7908343 - DNA, 22 bp, Homo sapiens
tggaggtcctgcaggatggcac

SEQ ID NO: 7908344 - DNA, 22 bp, Homo sapiens
tggaggtcgcgcgggtgctgca

SEQ ID NO: 7908345 - DNA, 22 bp, Homo sapiens
tggaggtcgctagcgagcgggc

SEQ ID NO: 7908346 - DNA, 19 bp, Homo sapiens
tggaggtccaggagtaggg

SEQ ID NO: 7908347 - DNA, 22 bp, Homo sapiens
tggaggtcctgcaggatggcac

SEQ ID NO: 7908348 - DNA, 22 bp, Homo sapiens
tggaggtaggacgaagaactct

SEQ ID NO: 7908349 - DNA, 19 bp, Homo sapiens
tggaggtccaggagtaggg

SEQ ID NO: 7908350 - DNA, 22 bp, Homo sapiens
tggaggtactcaggcacagagt

SEQ ID NO: 7908351 - DNA, 22 bp, Homo sapiens
tggagggtcaccccttgctgag

SEQ ID NO: 7908352 - DNA, 22 bp, Homo sapiens
tggaggtacataatgagagggt

SEQ ID NO: 7908353 - DNA, 22 bp, Homo sapiens
tggagggtcaccccttgctgag

SEQ ID NO: 7908354 - DNA, 19 bp, Homo sapiens
tggaggggtttgaatgtgg

SEQ ID NO: 7908355 - DNA, 19 bp, Homo sapiens
tggaggggtttgaatgtgg

SEQ ID NO: 7908356 - DNA, 19 bp, Homo sapiens
tggaggggtttgaatgtgg

SEQ ID NO: 7908357 - DNA, 19 bp, Homo sapiens
tggaggggtttgaatgtgg

SEQ ID NO: 7908358 - DNA, 19 bp, Homo sapiens
tggaggggtttgaatgtgg

SEQ ID NO: 7908359 - DNA, 19 bp, Homo sapiens
tggaggggtttgaatgtgg

SEQ ID NO: 7908360 - DNA, 22 bp, Homo sapiens
tggaggggcaatggagcgcgga

SEQ ID NO: 7908361 - DNA, 22 bp, Homo sapiens
tggaggtgagtgtggtacagca

SEQ ID NO: 7908362 - DNA, 22 bp, Homo sapiens
tggaggtgagtgtggtacagca

SEQ ID NO: 7908363 - DNA, 22 bp, Homo sapiens
tggaggtgagtgtggtacagca

SEQ ID NO: 7908364 - DNA, 22 bp, Homo sapiens
tggaggtgacggggcctcgttg

SEQ ID NO: 7908365 - DNA, 22 bp, Homo sapiens
tggaggtgacggggcctcgttg

SEQ ID NO: 7908366 - DNA, 22 bp, Homo sapiens
tggaggtgacggggcctcgttg

SEQ ID NO: 7908367 - DNA, 22 bp, Homo sapiens
tggaggtgaaatgagattttgt

SEQ ID NO: 7908368 - DNA, 22 bp, Homo sapiens
tggaggtgacggggcctcgttg

SEQ ID NO: 7908369 - DNA, 22 bp, Homo sapiens
ccctggagctagtctgagcaga

SEQ ID NO: 7908370 - DNA, 22 bp, Homo sapiens
tggaggtggagttggaaactga

SEQ ID NO: 7908371 - DNA, 22 bp, Homo sapiens
tggaggtgagtgtggtacagca

SEQ ID NO: 7908372 - DNA, 22 bp, Homo sapiens
tggaggtgagtgtggtacagca

SEQ ID NO: 7908373 - DNA, 23 bp, Homo sapiens
ccctggagctagtctgagcagag

SEQ ID NO: 7908374 - DNA, 23 bp, Homo sapiens
ccctggagctagtctgagcgggg

SEQ ID NO: 7908375 - DNA, 23 bp, Homo sapiens
ccctggagctagtctgagcgggg

SEQ ID NO: 7908376 - DNA, 22 bp, Homo sapiens
ccctggagctgcttgcatgttg

SEQ ID NO: 7908377 - DNA, 22 bp, Homo sapiens
ccctggagctgcttgcatgttg

SEQ ID NO: 7908378 - DNA, 23 bp, Homo sapiens
ccctggagctagtctgagcagag

SEQ ID NO: 7908379 - DNA, 23 bp, Homo sapiens
ccctggagctagtctgagcagag

SEQ ID NO: 7908380 - DNA, 23 bp, Homo sapiens
ccctggagctagtctgagcagag

SEQ ID NO: 7908381 - DNA, 23 bp, Homo sapiens
ccctggagctagtctgagcagag

SEQ ID NO: 7908382 - DNA, 23 bp, Homo sapiens
ccctggagctagtctgagcagag

SEQ ID NO: 7908383 - DNA, 22 bp, Homo sapiens
ccctggagctagtctgagcaga

SEQ ID NO: 7908384 - DNA, 22 bp, Homo sapiens
ccctgcctctgaagctgctcag

SEQ ID NO: 7908385 - DNA, 22 bp, Homo sapiens
ccctgcctctgaagctgctcag

SEQ ID NO: 7908386 - DNA, 22 bp, Homo sapiens
ccctgcctctgaagctgctcag

SEQ ID NO: 7908387 - DNA, 22 bp, Homo sapiens
ccctgcctctgaagctgctcag

SEQ ID NO: 7908388 - DNA, 22 bp, Homo sapiens
ccctgcctgtgggcatcaacat

SEQ ID NO: 7908389 - DNA, 22 bp, Homo sapiens
ccctgcctgtgggcatcaacat

SEQ ID NO: 7908390 - DNA, 22 bp, Homo sapiens
ccctgcctgtgggcatcaacat

SEQ ID NO: 7908391 - DNA, 22 bp, Homo sapiens
ccctgccttcttggcctttaaa

SEQ ID NO: 7908392 - DNA, 22 bp, Homo sapiens
ccctgcagtcctttcttggctc

SEQ ID NO: 7908393 - DNA, 22 bp, Homo sapiens
ccctgcagtcctttcttggctc

SEQ ID NO: 7908394 - DNA, 22 bp, Homo sapiens
ccctgcctacagggttttcttt

SEQ ID NO: 7908395 - DNA, 22 bp, Homo sapiens
ccctgcctctgaagctgctcag

SEQ ID NO: 7908396 - DNA, 22 bp, Homo sapiens
ccctgcctctgaagctgctcag

SEQ ID NO: 7908397 - DNA, 22 bp, Homo sapiens
ccctgcctacagggttttcttt

SEQ ID NO: 7908398 - DNA, 22 bp, Homo sapiens
tggacaggtgcacacagcagcc

SEQ ID NO: 7908399 - DNA, 22 bp, Homo sapiens
tggacaggttgagtaggaggag

SEQ ID NO: 7908400 - DNA, 22 bp, Homo sapiens
tggacaggttgagtaggaggag

SEQ ID NO: 7908401 - DNA, 22 bp, Homo sapiens
tggacaggttgagtaggaggag

SEQ ID NO: 7908402 - DNA, 22 bp, Homo sapiens
tggacaggttgagtaggaggag

SEQ ID NO: 7908403 - DNA, 22 bp, Homo sapiens
tggacaggttgagtaggaggag

SEQ ID NO: 7908404 - DNA, 22 bp, Homo sapiens
tggacaggttgagtaggaggag

SEQ ID NO: 7908405 - DNA, 22 bp, Homo sapiens
tggacaggtttgggtgcctgtt

SEQ ID NO: 7908406 - DNA, 22 bp, Homo sapiens
tggacagtaggaagagtgtggg

SEQ ID NO: 7908407 - DNA, 22 bp, Homo sapiens
tggacaggtttgggtgcctgtt

SEQ ID NO: 7908408 - DNA, 22 bp, Homo sapiens
tggacaggttgagtaggaggag

SEQ ID NO: 7908409 - DNA, 22 bp, Homo sapiens
tggacaggttgagtaggaggag

SEQ ID NO: 7908410 - DNA, 22 bp, Homo sapiens
tggacaggtttgggtgcctgtt

SEQ ID NO: 7908411 - DNA, 22 bp, Homo sapiens
tggacaggtttgggtgcctgtt

SEQ ID NO: 7908412 - DNA, 22 bp, Homo sapiens
tggacagttactgagcttgagt

SEQ ID NO: 7908413 - DNA, 23 bp, Homo sapiens
tggacagttatctcattgtcctg

SEQ ID NO: 7908414 - DNA, 20 bp, Homo sapiens
tggacagttactttatctct

SEQ ID NO: 7908415 - DNA, 23 bp, Homo sapiens
tggacagtagggtagacagtgcc

SEQ ID NO: 7908416 - DNA, 22 bp, Homo sapiens
tggacagtgcagatacagaatg

SEQ ID NO: 7908417 - DNA, 22 bp, Homo sapiens
tggacagttgtcttgtagctaa

SEQ ID NO: 7908418 - DNA, 22 bp, Homo sapiens
tggacatcttagtcatgtcaat

SEQ ID NO: 7908419 - DNA, 22 bp, Homo sapiens
tggacatgacctcgagcgagat

SEQ ID NO: 7908420 - DNA, 17 bp, Homo sapiens
ccctgcaccctactctc

SEQ ID NO: 7908421 - DNA, 17 bp, Homo sapiens
ccctgcaccctactctc

SEQ ID NO: 7908422 - DNA, 17 bp, Homo sapiens
ccctgcaccctactctc

SEQ ID NO: 7908423 - DNA, 17 bp, Homo sapiens
ccctgcaccctactctc

SEQ ID NO: 7908424 - DNA, 22 bp, Homo sapiens
ccctgaggaccaggaaggaggg

SEQ ID NO: 7908425 - DNA, 22 bp, Homo sapiens
ccctgaggagagcgcttcccga

SEQ ID NO: 7908426 - DNA, 22 bp, Homo sapiens
ccctgaggagagcgcttcccga

SEQ ID NO: 7908427 - DNA, 22 bp, Homo sapiens
tggaagggaacaggtgggtgtt

SEQ ID NO: 7908428 - DNA, 22 bp, Homo sapiens
tggaagggaacaggtgggtgtt

SEQ ID NO: 7908429 - DNA, 21 bp, Homo sapiens
tggaagggaagtcttggttgt

SEQ ID NO: 7908430 - DNA, 21 bp, Homo sapiens
tggaagggaagtcttggttgt

SEQ ID NO: 7908431 - DNA, 21 bp, Homo sapiens
tggaagggaagtcttggttgt

SEQ ID NO: 7908432 - DNA, 22 bp, Homo sapiens
ccctgcagagccagccctgacc

SEQ ID NO: 7908433 - DNA, 22 bp, Homo sapiens
ccctgcagagccagccctgacc

SEQ ID NO: 7908434 - DNA, 22 bp, Homo sapiens
ccctgcagagagtgcttttgtg

SEQ ID NO: 7908435 - DNA, 22 bp, Homo sapiens
ccctgcagagccagccctgacc

SEQ ID NO: 7908436 - DNA, 22 bp, Homo sapiens
ccctgcagagaccactgacctt

SEQ ID NO: 7908437 - DNA, 22 bp, Homo sapiens
ccctgcagacgtcttgatgcct

SEQ ID NO: 7908438 - DNA, 22 bp, Homo sapiens
ccctgcagaccaatgccataga

SEQ ID NO: 7908439 - DNA, 22 bp, Homo sapiens
ccctgcagaaccacagacaaac

SEQ ID NO: 7908440 - DNA, 22 bp, Homo sapiens
ccctgcagaccaatgccataga

SEQ ID NO: 7908441 - DNA, 23 bp, Homo sapiens
ccctgcactaagaggagaaggtg

SEQ ID NO: 7908442 - DNA, 23 bp, Homo sapiens
ccctgcactaagaggagaaggtg

SEQ ID NO: 7908443 - DNA, 22 bp, Homo sapiens
ccctgcagaaccacagacaaac

SEQ ID NO: 7908444 - DNA, 22 bp, Homo sapiens
ccctgcagaaccacagacaaac

SEQ ID NO: 7908445 - DNA, 22 bp, Homo sapiens
ccctgcagatctagggtccttc

SEQ ID NO: 7908446 - DNA, 22 bp, Homo sapiens
ccctgcagatctagggtccttc

SEQ ID NO: 7908447 - DNA, 22 bp, Homo sapiens
ccctgcagatctagggtccttc

SEQ ID NO: 7908448 - DNA, 22 bp, Homo sapiens
ccctgcagagggatgggggcag

SEQ ID NO: 7908449 - DNA, 22 bp, Homo sapiens
ccctgcagagggatgggggcag

SEQ ID NO: 7908450 - DNA, 22 bp, Homo sapiens
ccctgcagagggatgggggcag

SEQ ID NO: 7908451 - DNA, 22 bp, Homo sapiens
ccctgcagagccagccctgacc

SEQ ID NO: 7908452 - DNA, 22 bp, Homo sapiens
ccctgcagatcagtgagaactt

SEQ ID NO: 7908453 - DNA, 22 bp, Homo sapiens
ccctgcagatcagtgagaactt

SEQ ID NO: 7908454 - DNA, 22 bp, Homo sapiens
ccctgcagagggatgggggcag

SEQ ID NO: 7908455 - DNA, 20 bp, Homo sapiens
ccctgcagccatgggagtgg

SEQ ID NO: 7908456 - DNA, 20 bp, Homo sapiens
ccctgcagccatgggagtgg

SEQ ID NO: 7908457 - DNA, 20 bp, Homo sapiens
ccctgcagccatgggagtgg

SEQ ID NO: 7908458 - DNA, 20 bp, Homo sapiens
ccctgcagccatgggagtgg

SEQ ID NO: 7908459 - DNA, 20 bp, Homo sapiens
ccctgcagccatgggagtgg

SEQ ID NO: 7908460 - DNA, 22 bp, Homo sapiens
ccctgcagccggccagctcatt

SEQ ID NO: 7908461 - DNA, 22 bp, Homo sapiens
ccctgcagccggccagctcatt

SEQ ID NO: 7908462 - DNA, 22 bp, Homo sapiens
tggacaggttgagtaggaggag

SEQ ID NO: 7908463 - DNA, 22 bp, Homo sapiens
tggacaggttgagtaggaggag

SEQ ID NO: 7908464 - DNA, 22 bp, Homo sapiens
ccctgcagccggccagctcatt

SEQ ID NO: 7908465 - DNA, 22 bp, Homo sapiens
ccctgcagccggccagctcatt

SEQ ID NO: 7908466 - DNA, 22 bp, Homo sapiens
tggacaggtgcacacagcagcc

SEQ ID NO: 7908467 - DNA, 22 bp, Homo sapiens
tggacaggtgcacacagcagcc

SEQ ID NO: 7908468 - DNA, 22 bp, Homo sapiens
tccacaggtcctctttgcaaag

SEQ ID NO: 7908469 - DNA, 22 bp, Homo sapiens
tccacaggtccggcatgaacag

SEQ ID NO: 7908470 - DNA, 22 bp, Homo sapiens
tccacaggtccggcatgaacag

SEQ ID NO: 7908471 - DNA, 22 bp, Homo sapiens
tccacaggtcagggagataggc

SEQ ID NO: 7908472 - DNA, 22 bp, Homo sapiens
tccacaggtcagggagataggc

SEQ ID NO: 7908473 - DNA, 22 bp, Homo sapiens
tccacaggtccggcatgaacag

SEQ ID NO: 7908474 - DNA, 22 bp, Homo sapiens
tccacagtctatttttagtcta

SEQ ID NO: 7908475 - DNA, 22 bp, Homo sapiens
tccacaggtcctctttgcaaag

SEQ ID NO: 7908476 - DNA, 22 bp, Homo sapiens
tccacaggtccggcatgaacag

SEQ ID NO: 7908477 - DNA, 22 bp, Homo sapiens
tccacaggtatgaggccccacc

SEQ ID NO: 7908478 - DNA, 22 bp, Homo sapiens
tccacaggtatgaggccccacc

SEQ ID NO: 7908479 - DNA, 22 bp, Homo sapiens
tccacaggtatgaggccccacc

SEQ ID NO: 7908480 - DNA, 22 bp, Homo sapiens
tccacagggcctttctggtgtg

SEQ ID NO: 7908481 - DNA, 22 bp, Homo sapiens
tccacaggtatttctccttgct

SEQ ID NO: 7908482 - DNA, 22 bp, Homo sapiens
tccacaggtatttctccttgct

SEQ ID NO: 7908483 - DNA, 22 bp, Homo sapiens
tccacaggtatttctccttgct

SEQ ID NO: 7908484 - DNA, 22 bp, Homo sapiens
tcatttatttgactttggagtg

SEQ ID NO: 7908485 - DNA, 22 bp, Homo sapiens
tccacagggcctttctggtgtg

SEQ ID NO: 7908486 - DNA, 21 bp, Homo sapiens
tccaagccttcaacacattca

SEQ ID NO: 7908487 - DNA, 22 bp, Homo sapiens
tccacagggcctttctggtgtg

SEQ ID NO: 7908488 - DNA, 22 bp, Homo sapiens
tccacagggcctttctggtgtg

SEQ ID NO: 7908489 - DNA, 17 bp, Homo sapiens
tccaagccagcttgcct

SEQ ID NO: 7908490 - DNA, 20 bp, Homo sapiens
tccaagccctccttccattc

SEQ ID NO: 7908491 - DNA, 22 bp, Homo sapiens
tccagaccatggatggctgcaa

SEQ ID NO: 7908492 - DNA, 22 bp, Homo sapiens
tccagaccaaggaaggctgggc

SEQ ID NO: 7908493 - DNA, 20 bp, Homo sapiens
tccacatcttttgagatgtg

SEQ ID NO: 7908494 - DNA, 22 bp, Homo sapiens
tccacatctctcgccaaccaat

SEQ ID NO: 7908495 - DNA, 20 bp, Homo sapiens
tccacatcttttgagatgtg

SEQ ID NO: 7908496 - DNA, 22 bp, Homo sapiens
tccacatgaccattgtgctcct

SEQ ID NO: 7908497 - DNA, 22 bp, Homo sapiens
tccacatagtcattaatttctg

SEQ ID NO: 7908498 - DNA, 22 bp, Homo sapiens
tccacatcaagggcagagaggt

SEQ ID NO: 7908499 - DNA, 22 bp, Homo sapiens
tccacatcaagggcagagaggt

SEQ ID NO: 7908500 - DNA, 22 bp, Homo sapiens
tccacatcaagggcagagaggt

SEQ ID NO: 7908501 - DNA, 22 bp, Homo sapiens
tccacatctctcgccaaccaat

SEQ ID NO: 7908502 - DNA, 22 bp, Homo sapiens
tccacatctaggtttgtcaaca

SEQ ID NO: 7908503 - DNA, 22 bp, Homo sapiens
tccacatccattgcttgacttt

SEQ ID NO: 7908504 - DNA, 22 bp, Homo sapiens
tccacatccattgcttgacttt

SEQ ID NO: 7908505 - DNA, 22 bp, Homo sapiens
tccacatctaggtttgtcaaca

SEQ ID NO: 7908506 - DNA, 22 bp, Homo sapiens
tccacatccattgcttgacttt

SEQ ID NO: 7908507 - DNA, 14 bp, Homo sapiens
tccacatcagcagt

SEQ ID NO: 7908508 - DNA, 22 bp, Homo sapiens
tccacatccattgcttgacttt

SEQ ID NO: 7908509 - DNA, 22 bp, Homo sapiens
tccacatagagcttagaagcaa

SEQ ID NO: 7908510 - DNA, 22 bp, Homo sapiens
tccacagttttgccactagctg

SEQ ID NO: 7908511 - DNA, 22 bp, Homo sapiens
tccacagttttgccactagctg

SEQ ID NO: 7908512 - DNA, 22 bp, Homo sapiens
tccacagtggttgaactagttt

SEQ ID NO: 7908513 - DNA, 22 bp, Homo sapiens
tccacagttttgccactagctg

SEQ ID NO: 7908514 - DNA, 22 bp, Homo sapiens
tccacagttttgccactagctg

SEQ ID NO: 7908515 - DNA, 22 bp, Homo sapiens
tccacagtggttgaactagtaa

SEQ ID NO: 7908516 - DNA, 22 bp, Homo sapiens
tccacagtggttgaactagttt

SEQ ID NO: 7908517 - DNA, 22 bp, Homo sapiens
tccacagtggttgaactagtaa

SEQ ID NO: 7908518 - DNA, 21 bp, Homo sapiens
tcatttattgagaaatgactg

SEQ ID NO: 7908519 - DNA, 21 bp, Homo sapiens
tcatttattgagaaatgactg

SEQ ID NO: 7908520 - DNA, 21 bp, Homo sapiens
tcatttattgagaaatgactg

SEQ ID NO: 7908521 - DNA, 21 bp, Homo sapiens
tcatttattgagaaatgactg

SEQ ID NO: 7908522 - DNA, 21 bp, Homo sapiens
tcatttattgagaaatgactg

SEQ ID NO: 7908523 - DNA, 21 bp, Homo sapiens
tcatttattgagaaatgactg

SEQ ID NO: 7908524 - DNA, 21 bp, Homo sapiens
tcatttattgagaaatgactg

SEQ ID NO: 7908525 - DNA, 22 bp, Homo sapiens
tcatttatgcaggaatggcata

SEQ ID NO: 7908526 - DNA, 22 bp, Homo sapiens
tcatttatgcaggaatggcata

SEQ ID NO: 7908527 - DNA, 22 bp, Homo sapiens
tcatttatgtctttgccatcca

SEQ ID NO: 7908528 - DNA, 22 bp, Homo sapiens
tcatttatgcaggaatggcata

SEQ ID NO: 7908529 - DNA, 22 bp, Homo sapiens
tcatttatgcaggaatggcata

SEQ ID NO: 7908530 - DNA, 22 bp, Homo sapiens
tcatttatgcaggaatggcata

SEQ ID NO: 7908531 - DNA, 22 bp, Homo sapiens
tcatttatgcaggaatggcata

SEQ ID NO: 7908532 - DNA, 22 bp, Homo sapiens
tcatttatgcaggaatggcata

SEQ ID NO: 7908533 - DNA, 22 bp, Homo sapiens
tcatttatcgctgccttttaaa

SEQ ID NO: 7908534 - DNA, 22 bp, Homo sapiens
tcatttatcgctgccttttaaa

SEQ ID NO: 7908535 - DNA, 22 bp, Homo sapiens
tcatttatcgctgccttttaaa

SEQ ID NO: 7908536 - DNA, 22 bp, Homo sapiens
tcattcttgatcactagttagt

SEQ ID NO: 7908537 - DNA, 22 bp, Homo sapiens
tcattcttgatcactagttagt

SEQ ID NO: 7908538 - DNA, 22 bp, Homo sapiens
tcattctgcatcactcttgctc

SEQ ID NO: 7908539 - DNA, 22 bp, Homo sapiens
tcattctctgggatgcagtttg

SEQ ID NO: 7908540 - DNA, 22 bp, Homo sapiens
tcattcttgcgtatgccatggt

SEQ ID NO: 7908541 - DNA, 22 bp, Homo sapiens
tcattctttaccaagttgtcac

SEQ ID NO: 7908542 - DNA, 22 bp, Homo sapiens
tcattccctcattgttcactgg

SEQ ID NO: 7908543 - DNA, 22 bp, Homo sapiens
tcattcccccataatggtattt

SEQ ID NO: 7908544 - DNA, 22 bp, Homo sapiens
tcattccctccagctgtggcta

SEQ ID NO: 7908545 - DNA, 22 bp, Homo sapiens
tcattccatttccagctctgaa

SEQ ID NO: 7908546 - DNA, 22 bp, Homo sapiens
tcattccatttccagctctgaa

SEQ ID NO: 7908547 - DNA, 22 bp, Homo sapiens
tcattcctccagcgggagtcca

SEQ ID NO: 7908548 - DNA, 22 bp, Homo sapiens
tcattcctcaggaagggattta

SEQ ID NO: 7908549 - DNA, 22 bp, Homo sapiens
tcattcctcaggaagggattta

SEQ ID NO: 7908550 - DNA, 22 bp, Homo sapiens
tcattccttaacattcatttgc

SEQ ID NO: 7908551 - DNA, 22 bp, Homo sapiens
tcattcctccagcgggagtcca

SEQ ID NO: 7908552 - DNA, 22 bp, Homo sapiens
tcattccttaacattcatttgc

SEQ ID NO: 7908553 - DNA, 22 bp, Homo sapiens
tcattctcagactcttggcctc

SEQ ID NO: 7908554 - DNA, 22 bp, Homo sapiens
tcattcctttacagttgatcct

SEQ ID NO: 7908555 - DNA, 22 bp, Homo sapiens
tcattccttatccgtatctttt

SEQ ID NO: 7908556 - DNA, 22 bp, Homo sapiens
tcattccttatccgtatctttt

SEQ ID NO: 7908557 - DNA, 22 bp, Homo sapiens
tcattcctttacagttgatcct

SEQ ID NO: 7908558 - DNA, 22 bp, Homo sapiens
tcattctcagactcttggcctc

SEQ ID NO: 7908559 - DNA, 22 bp, Homo sapiens
tcattctctgggatgcagtttg

SEQ ID NO: 7908560 - DNA, 22 bp, Homo sapiens
tcattctcctctggaaaaggca

SEQ ID NO: 7908561 - DNA, 18 bp, Homo sapiens
tcatgaggtagaggctgg

SEQ ID NO: 7908562 - DNA, 22 bp, Homo sapiens
tcatgagtggattaatatggct

SEQ ID NO: 7908563 - DNA, 22 bp, Homo sapiens
tcatgagtctgcaaattatgga

SEQ ID NO: 7908564 - DNA, 18 bp, Homo sapiens
tcatgaggaaggagaaga

SEQ ID NO: 7908565 - DNA, 22 bp, Homo sapiens
tcatgaggatttactagactag

SEQ ID NO: 7908566 - DNA, 18 bp, Homo sapiens
tcatgaggtagaggctgg

SEQ ID NO: 7908567 - DNA, 22 bp, Homo sapiens
tcatgattcttctaccacagca

SEQ ID NO: 7908568 - DNA, 22 bp, Homo sapiens
tcatgattaacatttccaagca

SEQ ID NO: 7908569 - DNA, 22 bp, Homo sapiens
tcatgatacccaagtacctaga

SEQ ID NO: 7908570 - DNA, 22 bp, Homo sapiens
tcatgagtttaaggtttaggct

SEQ ID NO: 7908571 - DNA, 22 bp, Homo sapiens
tcatgcaaagccaattccagct

SEQ ID NO: 7908572 - DNA, 22 bp, Homo sapiens
tcatgcaaggctgaaacatggt

SEQ ID NO: 7908573 - DNA, 22 bp, Homo sapiens
tcatgcaaggctgaaacatggt

SEQ ID NO: 7908574 - DNA, 20 bp, Homo sapiens
tcatgcaagattcataaagg

SEQ ID NO: 7908575 - DNA, 22 bp, Homo sapiens
tcatgaaaatagatcagaaatt

SEQ ID NO: 7908576 - DNA, 22 bp, Homo sapiens
tcatgaacaaatgatttactaa

SEQ ID NO: 7908577 - DNA, 22 bp, Homo sapiens
tcatgaacatctcaaataacca

SEQ ID NO: 7908578 - DNA, 22 bp, Homo sapiens
tcatgaacatctcaaataacca

SEQ ID NO: 7908579 - DNA, 21 bp, Homo sapiens
tcatgaagcatcacttctgcc

SEQ ID NO: 7908580 - DNA, 21 bp, Homo sapiens
tcatgaacattcactgactgc

SEQ ID NO: 7908581 - DNA, 22 bp, Homo sapiens
tcatgaacatggaatatctttt

SEQ ID NO: 7908582 - DNA, 22 bp, Homo sapiens
tcatgaacatggaatatctttt

SEQ ID NO: 7908583 - DNA, 22 bp, Homo sapiens
tcatcatcactctggcaagcat

SEQ ID NO: 7908584 - DNA, 22 bp, Homo sapiens
tcatcataatatggaatcttgt

SEQ ID NO: 7908585 - DNA, 22 bp, Homo sapiens
tcatcatccttttttgaagagt

SEQ ID NO: 7908586 - DNA, 22 bp, Homo sapiens
tcatcatccttttttgaagagt

SEQ ID NO: 7908587 - DNA, 22 bp, Homo sapiens
tcatcagtgtccttatcactta

SEQ ID NO: 7908588 - DNA, 22 bp, Homo sapiens
tcatcagtttagaaaaaatatg

SEQ ID NO: 7908589 - DNA, 22 bp, Homo sapiens
cataacagtggcttcagcaagt

SEQ ID NO: 7908590 - DNA, 22 bp, Homo sapiens
cataacagtggcttcagcaagt

SEQ ID NO: 7908591 - DNA, 22 bp, Homo sapiens
tcatgaagtccaaactaaagca

SEQ ID NO: 7908592 - DNA, 22 bp, Homo sapiens
tcatgaatattgaatgcttcat

SEQ ID NO: 7908593 - DNA, 20 bp, Homo sapiens
tcatgaagcctacaaacatc

SEQ ID NO: 7908594 - DNA, 22 bp, Homo sapiens
tcatgacaggtgagtttttagg

SEQ ID NO: 7908595 - DNA, 22 bp, Homo sapiens
tcatgacatggacatgattgta

SEQ ID NO: 7908596 - DNA, 22 bp, Homo sapiens
tcatgacatgtgaattgaatat

SEQ ID NO: 7908597 - DNA, 22 bp, Homo sapiens
tcatgacaggtgagtttttagg

SEQ ID NO: 7908598 - DNA, 22 bp, Homo sapiens
catgaaaaatttactgttaaca

SEQ ID NO: 7908599 - DNA, 22 bp, Homo sapiens
tcatgtcttctgtgatgtccaa

SEQ ID NO: 7908600 - DNA, 22 bp, Homo sapiens
tcatgtctgggagcagactcca

SEQ ID NO: 7908601 - DNA, 22 bp, Homo sapiens
tcatgtctgggagcagactcca

SEQ ID NO: 7908602 - DNA, 22 bp, Homo sapiens
catgaaaaatttactgttaaca

SEQ ID NO: 7908603 - DNA, 22 bp, Homo sapiens
catgaaaaatttactgttaaca

SEQ ID NO: 7908604 - DNA, 22 bp, Homo sapiens
catgaaaaatttactgttaaca

SEQ ID NO: 7908605 - DNA, 22 bp, Homo sapiens
catcttttggcctattctgagg

SEQ ID NO: 7908606 - DNA, 22 bp, Homo sapiens
catcttttggcctattctgagg

SEQ ID NO: 7908607 - DNA, 22 bp, Homo sapiens
tcattcatgaggtgctagtgct

SEQ ID NO: 7908608 - DNA, 22 bp, Homo sapiens
tcattcatgaggtgctagtgct

SEQ ID NO: 7908609 - DNA, 22 bp, Homo sapiens
tcattcatcagttggtagagat

SEQ ID NO: 7908610 - DNA, 22 bp, Homo sapiens
tcattcatcagttggtagagat

SEQ ID NO: 7908611 - DNA, 21 bp, Homo sapiens
tcatgtgctgaggatgatgcc

SEQ ID NO: 7908612 - DNA, 23 bp, Homo sapiens
tcattccacaaatacttatctag

SEQ ID NO: 7908613 - DNA, 23 bp, Homo sapiens
tcattccacaaatacttatctag

SEQ ID NO: 7908614 - DNA, 20 bp, Homo sapiens
tcattccaaatagttcagca

SEQ ID NO: 7908615 - DNA, 22 bp, Homo sapiens
tcattcattcatccagcttgag

SEQ ID NO: 7908616 - DNA, 18 bp, Homo sapiens
tcattcattaaacttggc

SEQ ID NO: 7908617 - DNA, 22 bp, Homo sapiens
tcattcattgcttaccctgtgt

SEQ ID NO: 7908618 - DNA, 22 bp, Homo sapiens
tcattcatttgctcactccaca

SEQ ID NO: 7908619 - DNA, 22 bp, Homo sapiens
tcatgcactacataacgatgtt

SEQ ID NO: 7908620 - DNA, 22 bp, Homo sapiens
tcatgcactacataacgatgtt

SEQ ID NO: 7908621 - DNA, 19 bp, Homo sapiens
tcatgcactttgatgtaac

SEQ ID NO: 7908622 - DNA, 22 bp, Homo sapiens
catctttggagaaacttccgtt

SEQ ID NO: 7908623 - DNA, 22 bp, Homo sapiens
catctttgcccatccacttcca

SEQ ID NO: 7908624 - DNA, 22 bp, Homo sapiens
tcatgcaatgagtcaggaggca

SEQ ID NO: 7908625 - DNA, 19 bp, Homo sapiens
catctttggtcacctagtc

SEQ ID NO: 7908626 - DNA, 22 bp, Homo sapiens
catctttgggctgcatggaagg

SEQ ID NO: 7908627 - DNA, 19 bp, Homo sapiens
catctttggtcacctagtc

SEQ ID NO: 7908628 - DNA, 19 bp, Homo sapiens
catctttggtcacctagtc

SEQ ID NO: 7908629 - DNA, 22 bp, Homo sapiens
catctttggagaaacttccgtt

SEQ ID NO: 7908630 - DNA, 20 bp, Homo sapiens
catctttggcaggactcctt

SEQ ID NO: 7908631 - DNA, 20 bp, Homo sapiens
catctttggcaggactcctt

SEQ ID NO: 7908632 - DNA, 22 bp, Homo sapiens
catctttgggctgcatggaagg

SEQ ID NO: 7908633 - DNA, 22 bp, Homo sapiens
catctttggttttctatatgcc

SEQ ID NO: 7908634 - DNA, 22 bp, Homo sapiens
catctttgttctgtaaactttt

SEQ ID NO: 7908635 - DNA, 22 bp, Homo sapiens
catctttgtttcatctgtccag

SEQ ID NO: 7908636 - DNA, 22 bp, Homo sapiens
catctttgttctgtaaactttt

SEQ ID NO: 7908637 - DNA, 22 bp, Homo sapiens
catctttggttttctatatgcc

SEQ ID NO: 7908638 - DNA, 22 bp, Homo sapiens
catctttgtaacttccacataa

SEQ ID NO: 7908639 - DNA, 22 bp, Homo sapiens
catctttgtaacttccacataa

SEQ ID NO: 7908640 - DNA, 22 bp, Homo sapiens
catcttttcagaagccattctg

SEQ ID NO: 7908641 - DNA, 22 bp, Homo sapiens
catcttttcagaagccattctg

SEQ ID NO: 7908642 - DNA, 22 bp, Homo sapiens
catcttttggcctattctgagg

SEQ ID NO: 7908643 - DNA, 22 bp, Homo sapiens
catcttttggcctattctgagg

SEQ ID NO: 7908644 - DNA, 22 bp, Homo sapiens
catctttgtttcatctgtccag

SEQ ID NO: 7908645 - DNA, 22 bp, Homo sapiens
catctttgttttggatataatc

SEQ ID NO: 7908646 - DNA, 22 bp, Homo sapiens
catctttgtttcatctgtccag

SEQ ID NO: 7908647 - DNA, 22 bp, Homo sapiens
catctttgttttggatataatc

SEQ ID NO: 7908648 - DNA, 22 bp, Homo sapiens
catgtgtgtccatgtgactaag

SEQ ID NO: 7908649 - DNA, 21 bp, Homo sapiens
catgtgtcattggagagcaat

SEQ ID NO: 7908650 - DNA, 22 bp, Homo sapiens
catgtgtggttacctacttgac

SEQ ID NO: 7908651 - DNA, 22 bp, Homo sapiens
catgtgtgtggacgagcgtggc

SEQ ID NO: 7908652 - DNA, 22 bp, Homo sapiens
catgtgtgtggacgagcgtggc

SEQ ID NO: 7908653 - DNA, 22 bp, Homo sapiens
catgtgtgtggacgagcgtggc

SEQ ID NO: 7908654 - DNA, 22 bp, Homo sapiens
catgtgtgtctccaccagctgc

SEQ ID NO: 7908655 - DNA, 22 bp, Homo sapiens
catgtgtgtctccaccagctgc

SEQ ID NO: 7908656 - DNA, 22 bp, Homo sapiens
catgtgtgtgagggaaacatgt

SEQ ID NO: 7908657 - DNA, 22 bp, Homo sapiens
catgttaaaatatacattctga

SEQ ID NO: 7908658 - DNA, 22 bp, Homo sapiens
catgttaaaatatacattctga

SEQ ID NO: 7908659 - DNA, 22 bp, Homo sapiens
catgttaaaatatacattctga

SEQ ID NO: 7908660 - DNA, 22 bp, Homo sapiens
catgttaaattgagtttgcaat

SEQ ID NO: 7908661 - DNA, 22 bp, Homo sapiens
catgtgtgtggctgacaatttt

SEQ ID NO: 7908662 - DNA, 18 bp, Homo sapiens
catgtgttctacatcagt

SEQ ID NO: 7908663 - DNA, 18 bp, Homo sapiens
catgtgttctacatcagt

SEQ ID NO: 7908664 - DNA, 22 bp, Homo sapiens
catgtgttaatctttctgcaaa

SEQ ID NO: 7908665 - DNA, 22 bp, Homo sapiens
catgtgttgtctcatttaatcc

SEQ ID NO: 7908666 - DNA, 22 bp, Homo sapiens
catgtgtttcgagactgttgag

SEQ ID NO: 7908667 - DNA, 18 bp, Homo sapiens
catgtgttctacatcagt

SEQ ID NO: 7908668 - DNA, 22 bp, Homo sapiens
tccaggctcccctgcgtgctcc

SEQ ID NO: 7908669 - DNA, 22 bp, Homo sapiens
tccaggctcccctgcgtgctcc

SEQ ID NO: 7908670 - DNA, 22 bp, Homo sapiens
tccaggctccctcaggatgcac

SEQ ID NO: 7908671 - DNA, 22 bp, Homo sapiens
tccaggctccctcaggatgcac

SEQ ID NO: 7908672 - DNA, 22 bp, Homo sapiens
tccaggctccctcaggatgcac

SEQ ID NO: 7908673 - DNA, 22 bp, Homo sapiens
tccaggctccctcaggatgcac

SEQ ID NO: 7908674 - DNA, 22 bp, Homo sapiens
tccaggctccctcaggatgcac

SEQ ID NO: 7908675 - DNA, 22 bp, Homo sapiens
tccaggctcccctgcgtgctcc

SEQ ID NO: 7908676 - DNA, 22 bp, Homo sapiens
tccaggctcccctgcgtgctcc

SEQ ID NO: 7908677 - DNA, 22 bp, Homo sapiens
tccaggctcccctgcgtgctcc

SEQ ID NO: 7908678 - DNA, 22 bp, Homo sapiens
tccaggctccctcaggatgcac

SEQ ID NO: 7908679 - DNA, 22 bp, Homo sapiens
tccaggctccctcaggatgcac

SEQ ID NO: 7908680 - DNA, 20 bp, Homo sapiens
tccaggctcctccacttagt

SEQ ID NO: 7908681 - DNA, 20 bp, Homo sapiens
tccaggctcctccacttagt

SEQ ID NO: 7908682 - DNA, 19 bp, Homo sapiens
tccaggctccattggcaga

SEQ ID NO: 7908683 - DNA, 19 bp, Homo sapiens
tccaggctccattggcaga

SEQ ID NO: 7908684 - DNA, 19 bp, Homo sapiens
tccaggctccattggcaga

SEQ ID NO: 7908685 - DNA, 19 bp, Homo sapiens
tccaggctccattggcaga

SEQ ID NO: 7908686 - DNA, 19 bp, Homo sapiens
tccaggctccattggcaga

SEQ ID NO: 7908687 - DNA, 22 bp, Homo sapiens
tccaggctcccctgcgtgctcc

SEQ ID NO: 7908688 - DNA, 22 bp, Homo sapiens
tccaggctcccctgcgtgctcc

SEQ ID NO: 7908689 - DNA, 22 bp, Homo sapiens
tccaggctcccctgcgtgctcc

SEQ ID NO: 7908690 - DNA, 18 bp, Homo sapiens
tccaggctccaggctaac

SEQ ID NO: 7908691 - DNA, 18 bp, Homo sapiens
tccaggctccaggctaac

SEQ ID NO: 7908692 - DNA, 22 bp, Homo sapiens
tccaggcccctgcctgggcctg

SEQ ID NO: 7908693 - DNA, 18 bp, Homo sapiens
tccaggctccaggctaac

SEQ ID NO: 7908694 - DNA, 18 bp, Homo sapiens
tccaggctccaggctaac

SEQ ID NO: 7908695 - DNA, 18 bp, Homo sapiens
tccaggctccaggctaac

SEQ ID NO: 7908696 - DNA, 22 bp, Homo sapiens
tccaggcccgagatgggctgga

SEQ ID NO: 7908697 - DNA, 22 bp, Homo sapiens
tccaggcccgagatgggctgga

SEQ ID NO: 7908698 - DNA, 22 bp, Homo sapiens
tccaggcccgagatgggctgga

SEQ ID NO: 7908699 - DNA, 22 bp, Homo sapiens
tccaggctcagtcaagcacttc

SEQ ID NO: 7908700 - DNA, 22 bp, Homo sapiens
tccaggctcagtcaagcacttc

SEQ ID NO: 7908701 - DNA, 22 bp, Homo sapiens
tccaggctcagtcaagcacttc

SEQ ID NO: 7908702 - DNA, 22 bp, Homo sapiens
tccaggcccgagatgggctgga

SEQ ID NO: 7908703 - DNA, 22 bp, Homo sapiens
tccaggcccctgcctgggcctg

SEQ ID NO: 7908704 - DNA, 22 bp, Homo sapiens
tccaggcccctgcctgggcctg

SEQ ID NO: 7908705 - DNA, 22 bp, Homo sapiens
tccaggcccgagatgggctgga

SEQ ID NO: 7908706 - DNA, 22 bp, Homo sapiens
tccaggcccctgcctgggcctg

SEQ ID NO: 7908707 - DNA, 22 bp, Homo sapiens
tccaggcccctgcctgggcctg

SEQ ID NO: 7908708 - DNA, 22 bp, Homo sapiens
tccaggcccctgcctgggcctg

SEQ ID NO: 7908709 - DNA, 22 bp, Homo sapiens
tccaggcccctgcctgggcctg

SEQ ID NO: 7908710 - DNA, 22 bp, Homo sapiens
tccaggccccagcaccttggga

SEQ ID NO: 7908711 - DNA, 22 bp, Homo sapiens
tccaggccccagcaccttggga

SEQ ID NO: 7908712 - DNA, 22 bp, Homo sapiens
tccaggccccagcaccttggga

SEQ ID NO: 7908713 - DNA, 22 bp, Homo sapiens
tccaggccccccacgctaatgg

SEQ ID NO: 7908714 - DNA, 22 bp, Homo sapiens
tccaggccccccacgctaatgg

SEQ ID NO: 7908715 - DNA, 22 bp, Homo sapiens
tccaggccccagaccgtactgc

SEQ ID NO: 7908716 - DNA, 22 bp, Homo sapiens
tccaggccccagaccgtactgc

SEQ ID NO: 7908717 - DNA, 22 bp, Homo sapiens
tccaggccccagaccgtactgc

SEQ ID NO: 7908718 - DNA, 22 bp, Homo sapiens
tccaggccccagaccgtactgc

SEQ ID NO: 7908719 - DNA, 22 bp, Homo sapiens
tccaggccccagaccgtactgc

SEQ ID NO: 7908720 - DNA, 22 bp, Homo sapiens
tccaggccccactgaagcccct

SEQ ID NO: 7908721 - DNA, 22 bp, Homo sapiens
tccaggccccactgaagcccct

SEQ ID NO: 7908722 - DNA, 20 bp, Homo sapiens
tccaggcagctcagagtgtc

SEQ ID NO: 7908723 - DNA, 22 bp, Homo sapiens
tccaggcccatagacacttctc

SEQ ID NO: 7908724 - DNA, 22 bp, Homo sapiens
tccaggcccatagacacttctc

SEQ ID NO: 7908725 - DNA, 22 bp, Homo sapiens
tccaggcccatggagcagagct

SEQ ID NO: 7908726 - DNA, 22 bp, Homo sapiens
tccaggcccatggagcagagct

SEQ ID NO: 7908727 - DNA, 22 bp, Homo sapiens
tccaggcccatggagcagagct

SEQ ID NO: 7908728 - DNA, 22 bp, Homo sapiens
tccagctggcctaacttcaggg

SEQ ID NO: 7908729 - DNA, 22 bp, Homo sapiens
tccaggcccatggagcagagct

SEQ ID NO: 7908730 - DNA, 22 bp, Homo sapiens
tccaggcccatggagcagagct

SEQ ID NO: 7908731 - DNA, 22 bp, Homo sapiens
tccaggccccactgaagcccct

SEQ ID NO: 7908732 - DNA, 22 bp, Homo sapiens
tccaggccccactgaagcccct

SEQ ID NO: 7908733 - DNA, 22 bp, Homo sapiens
tccaggcagcccttcctgactc

SEQ ID NO: 7908734 - DNA, 22 bp, Homo sapiens
tccaggcagcccttcctgactc

SEQ ID NO: 7908735 - DNA, 22 bp, Homo sapiens
tccaggcagcccttcctgactc

SEQ ID NO: 7908736 - DNA, 22 bp, Homo sapiens
tccaggcagcccttcctgactc

SEQ ID NO: 7908737 - DNA, 20 bp, Homo sapiens
tccagctgggaacagctgat

SEQ ID NO: 7908738 - DNA, 20 bp, Homo sapiens
tccaggcagctcagagtgtc

SEQ ID NO: 7908739 - DNA, 20 bp, Homo sapiens
tccaggcagctcagagtgtc

SEQ ID NO: 7908740 - DNA, 22 bp, Homo sapiens
tccagctggcccggccatgaat

SEQ ID NO: 7908741 - DNA, 22 bp, Homo sapiens
tccagctggcctaacttcaggg

SEQ ID NO: 7908742 - DNA, 22 bp, Homo sapiens
tccagctggcccggccatgaat

SEQ ID NO: 7908743 - DNA, 22 bp, Homo sapiens
tccagctggcccggccatgaat

SEQ ID NO: 7908744 - DNA, 22 bp, Homo sapiens
tccagctggcctaacttcaggg

SEQ ID NO: 7908745 - DNA, 22 bp, Homo sapiens
tccagctggcttcggaagtgga

SEQ ID NO: 7908746 - DNA, 22 bp, Homo sapiens
tccagctggcctaacttcaggg

SEQ ID NO: 7908747 - DNA, 22 bp, Homo sapiens
tccagctggcctaacttcaggg

SEQ ID NO: 7908748 - DNA, 22 bp, Homo sapiens
tccagagagaaaaacaagcttt

SEQ ID NO: 7908749 - DNA, 22 bp, Homo sapiens
tccagagagaaaaacaagcttt

SEQ ID NO: 7908750 - DNA, 22 bp, Homo sapiens
tccagagacttgcatgtgcttg

SEQ ID NO: 7908751 - DNA, 22 bp, Homo sapiens
tccagagagaaaaacaagcttt

SEQ ID NO: 7908752 - DNA, 22 bp, Homo sapiens
tccagagacttgcatgtgcttg

SEQ ID NO: 7908753 - DNA, 22 bp, Homo sapiens
tccagagacttgcatgtgcttg

SEQ ID NO: 7908754 - DNA, 22 bp, Homo sapiens
tccagagacttgcatgtgcttg

SEQ ID NO: 7908755 - DNA, 22 bp, Homo sapiens
tccagagacttgcatgtgcttg

SEQ ID NO: 7908756 - DNA, 22 bp, Homo sapiens
tccagagaattctacgcagtgc

SEQ ID NO: 7908757 - DNA, 22 bp, Homo sapiens
tccagagacttgcatgtgcttg

SEQ ID NO: 7908758 - DNA, 22 bp, Homo sapiens
tccagagaattctacgcagtgc

SEQ ID NO: 7908759 - DNA, 22 bp, Homo sapiens
tccagagaattctacgcagtgc

SEQ ID NO: 7908760 - DNA, 22 bp, Homo sapiens
tccagagaattctacgcagtgc

SEQ ID NO: 7908761 - DNA, 22 bp, Homo sapiens
tccagagaacgatgaaagctgg

SEQ ID NO: 7908762 - DNA, 22 bp, Homo sapiens
tccagagaacgatgaaagctgg

SEQ ID NO: 7908763 - DNA, 22 bp, Homo sapiens
tccagagaacgatgaaagctgg

SEQ ID NO: 7908764 - DNA, 22 bp, Homo sapiens
tccagagaacgatgaaagctgg

SEQ ID NO: 7908765 - DNA, 19 bp, Homo sapiens
tccagactgtccaggctat

SEQ ID NO: 7908766 - DNA, 22 bp, Homo sapiens
tccagactctgtcacttcctag

SEQ ID NO: 7908767 - DNA, 22 bp, Homo sapiens
tccagactctgtcacttcctag

SEQ ID NO: 7908768 - DNA, 22 bp, Homo sapiens
tccagactgccctgcacatgtg

SEQ ID NO: 7908769 - DNA, 22 bp, Homo sapiens
tccagactgccctgcacatgtg

SEQ ID NO: 7908770 - DNA, 22 bp, Homo sapiens
tccagcctaatgttcttcccac

SEQ ID NO: 7908771 - DNA, 19 bp, Homo sapiens
tccagccctgttccctttt

SEQ ID NO: 7908772 - DNA, 19 bp, Homo sapiens
tccagccctgttccctttt

SEQ ID NO: 7908773 - DNA, 22 bp, Homo sapiens
tccagccctgtgtctgggagag

SEQ ID NO: 7908774 - DNA, 22 bp, Homo sapiens
tccagccctgtgtctgggagag

SEQ ID NO: 7908775 - DNA, 22 bp, Homo sapiens
tccagccctgtggcttccaccc

SEQ ID NO: 7908776 - DNA, 22 bp, Homo sapiens
tccagccctgtgtctgggagag

SEQ ID NO: 7908777 - DNA, 22 bp, Homo sapiens
tccagccctgtggcttccaccc

SEQ ID NO: 7908778 - DNA, 22 bp, Homo sapiens
tccagccctgtgtctgggagag

SEQ ID NO: 7908779 - DNA, 22 bp, Homo sapiens
tccagagagatagtggctaata

SEQ ID NO: 7908780 - DNA, 22 bp, Homo sapiens
tccagagagaaaaacaagcttt

SEQ ID NO: 7908781 - DNA, 22 bp, Homo sapiens
tccagagagccacggacagggg

SEQ ID NO: 7908782 - DNA, 22 bp, Homo sapiens
tccagagagatagtggctaata

SEQ ID NO: 7908783 - DNA, 22 bp, Homo sapiens
tccagagagccacggacagggg

SEQ ID NO: 7908784 - DNA, 22 bp, Homo sapiens
tccagagaggcatatttacaag

SEQ ID NO: 7908785 - DNA, 22 bp, Homo sapiens
tccagccctgtggcttccaccc

SEQ ID NO: 7908786 - DNA, 22 bp, Homo sapiens
tccagcccagctgtccccttca

SEQ ID NO: 7908787 - DNA, 22 bp, Homo sapiens
tccagcccagctgtccccttca

SEQ ID NO: 7908788 - DNA, 17 bp, Homo sapiens
tccagagaggcttccct

SEQ ID NO: 7908789 - DNA, 22 bp, Homo sapiens
tccagcccagctcctctcagaa

SEQ ID NO: 7908790 - DNA, 17 bp, Homo sapiens
tccagagaggcttccct

SEQ ID NO: 7908791 - DNA, 22 bp, Homo sapiens
tccagcccagctcctctcagaa

SEQ ID NO: 7908792 - DNA, 22 bp, Homo sapiens
tccagcctcatttctcctgctt

SEQ ID NO: 7908793 - DNA, 22 bp, Homo sapiens
tccagcctcctatttaccctaa

SEQ ID NO: 7908794 - DNA, 17 bp, Homo sapiens
tccagcctcctctgctg

SEQ ID NO: 7908795 - DNA, 17 bp, Homo sapiens
tccagcctcctctgctg

SEQ ID NO: 7908796 - DNA, 17 bp, Homo sapiens
tccagcctcctctgctg

SEQ ID NO: 7908797 - DNA, 17 bp, Homo sapiens
tccagcctcctctgctg

SEQ ID NO: 7908798 - DNA, 22 bp, Homo sapiens
tccagctcttcagttctgcaaa

SEQ ID NO: 7908799 - DNA, 17 bp, Homo sapiens
tccagcctcctctgctg

SEQ ID NO: 7908800 - DNA, 22 bp, Homo sapiens
tccagctcttcagttctgcaaa

SEQ ID NO: 7908801 - DNA, 22 bp, Homo sapiens
tccagcctcatttctcctgctt

SEQ ID NO: 7908802 - DNA, 22 bp, Homo sapiens
tccagcctcatttctcctgctt

SEQ ID NO: 7908803 - DNA, 22 bp, Homo sapiens
tccagcctcatttctcctgctt

SEQ ID NO: 7908804 - DNA, 22 bp, Homo sapiens
tccagcctcatttctcctgctt

SEQ ID NO: 7908805 - DNA, 22 bp, Homo sapiens
tccagcctcatttctcctgctt

SEQ ID NO: 7908806 - DNA, 22 bp, Homo sapiens
tccagcctaggggaacagctgc

SEQ ID NO: 7908807 - DNA, 22 bp, Homo sapiens
tccagcctaggggaacagctgc

SEQ ID NO: 7908808 - DNA, 22 bp, Homo sapiens
tccagcctaggggaacagctgc

SEQ ID NO: 7908809 - DNA, 22 bp, Homo sapiens
tccagcctaatgttcttcccac

SEQ ID NO: 7908810 - DNA, 22 bp, Homo sapiens
tccagcctaggggaacagctgc

SEQ ID NO: 7908811 - DNA, 22 bp, Homo sapiens
tccagcctaatgttcttcccac

SEQ ID NO: 7908812 - DNA, 22 bp, Homo sapiens
tccagctgacagttcaaaatga

SEQ ID NO: 7908813 - DNA, 22 bp, Homo sapiens
tccagctgacatctcctgaggg

SEQ ID NO: 7908814 - DNA, 22 bp, Homo sapiens
tccagctgacatctcctgaggg

SEQ ID NO: 7908815 - DNA, 22 bp, Homo sapiens
tccagctgacacttaaggggag

SEQ ID NO: 7908816 - DNA, 22 bp, Homo sapiens
tccagctcttgttgcccactgc

SEQ ID NO: 7908817 - DNA, 22 bp, Homo sapiens
tccagctcttgttgcccactgc

SEQ ID NO: 7908818 - DNA, 22 bp, Homo sapiens
tccagctcttgttgcccactgc

SEQ ID NO: 7908819 - DNA, 22 bp, Homo sapiens
tccagctcttgttgcccactgc

SEQ ID NO: 7908820 - DNA, 22 bp, Homo sapiens
tccagctgcaaggggcacagct

SEQ ID NO: 7908821 - DNA, 22 bp, Homo sapiens
tccagctgaggtggcctctgtg

SEQ ID NO: 7908822 - DNA, 22 bp, Homo sapiens
tccagctgaggtggcctctgtg

SEQ ID NO: 7908823 - DNA, 22 bp, Homo sapiens
tccagctgaggtggcctctgtg

SEQ ID NO: 7908824 - DNA, 22 bp, Homo sapiens
tccagctgaggtggcctctgtg

SEQ ID NO: 7908825 - DNA, 20 bp, Homo sapiens
tccagctgacattctctttc

SEQ ID NO: 7908826 - DNA, 22 bp, Homo sapiens
tccagctgacatctcctgaggg

SEQ ID NO: 7908827 - DNA, 22 bp, Homo sapiens
tccagctgacatctcctgaggg

SEQ ID NO: 7908828 - DNA, 22 bp, Homo sapiens
tccagctgcaaggggcacagct

SEQ ID NO: 7908829 - DNA, 21 bp, Homo sapiens
tccagctgcacaagcatgggg

SEQ ID NO: 7908830 - DNA, 21 bp, Homo sapiens
tccagctgcacaagcatgggg

SEQ ID NO: 7908831 - DNA, 23 bp, Homo sapiens
tccagctgcagtgggatggggaa

SEQ ID NO: 7908832 - DNA, 21 bp, Homo sapiens
tccagctgcacaagcatgggg

SEQ ID NO: 7908833 - DNA, 21 bp, Homo sapiens
tccagctgcacaagcatgggg

SEQ ID NO: 7908834 - DNA, 21 bp, Homo sapiens
tccagctgcacaagcatgggg

SEQ ID NO: 7908835 - DNA, 22 bp, Homo sapiens
tccagctgctgccagccaagct

SEQ ID NO: 7908836 - DNA, 22 bp, Homo sapiens
tccagctgctgacccagtagcc

SEQ ID NO: 7908837 - DNA, 22 bp, Homo sapiens
tccagctgctagctagatgcaa

SEQ ID NO: 7908838 - DNA, 22 bp, Homo sapiens
tccagctgctgacccagtagcc

SEQ ID NO: 7908839 - DNA, 22 bp, Homo sapiens
tccagctgctagctagatgcaa

SEQ ID NO: 7908840 - DNA, 22 bp, Homo sapiens
tccagctgccaaccgggccccg

SEQ ID NO: 7908841 - DNA, 22 bp, Homo sapiens
tccagctgccaaccgggccccg

SEQ ID NO: 7908842 - DNA, 22 bp, Homo sapiens
catttgtaggatgcttcttgtt

SEQ ID NO: 7908843 - DNA, 22 bp, Homo sapiens
catttgtaggatgcttcttgtt

SEQ ID NO: 7908844 - DNA, 22 bp, Homo sapiens
catttgtaggatgcttcttgtt

SEQ ID NO: 7908845 - DNA, 22 bp, Homo sapiens
catttgtagtatctgtttatat

SEQ ID NO: 7908846 - DNA, 22 bp, Homo sapiens
catttgtagtatctgtttatat

SEQ ID NO: 7908847 - DNA, 22 bp, Homo sapiens
catttgtagttaaaaatgtctc

SEQ ID NO: 7908848 - DNA, 22 bp, Homo sapiens
catttgtagctatttactgtat

SEQ ID NO: 7908849 - DNA, 22 bp, Homo sapiens
catttgtagttaaaaatgtctc

SEQ ID NO: 7908850 - DNA, 22 bp, Homo sapiens
catttgtatagtgcttagacca

SEQ ID NO: 7908851 - DNA, 22 bp, Homo sapiens
catttgtatagtgcttagacca

SEQ ID NO: 7908852 - DNA, 22 bp, Homo sapiens
catttgtatagtgcttagacca

SEQ ID NO: 7908853 - DNA, 22 bp, Homo sapiens
catttgtagttaaaaatgtctc

SEQ ID NO: 7908854 - DNA, 22 bp, Homo sapiens
catttgtatcatatgtatctta

SEQ ID NO: 7908855 - DNA, 22 bp, Homo sapiens
catttgtatcatatgtatctta

SEQ ID NO: 7908856 - DNA, 22 bp, Homo sapiens
tcctctccatattttctgattt

SEQ ID NO: 7908857 - DNA, 22 bp, Homo sapiens
tcctctccatattttctgattt

SEQ ID NO: 7908858 - DNA, 22 bp, Homo sapiens
tcctctccatattttctgattt

SEQ ID NO: 7908859 - DNA, 22 bp, Homo sapiens
tcctctccatattttctgattt

SEQ ID NO: 7908860 - DNA, 21 bp, Homo sapiens
tcctctccatgatctgtttgt

SEQ ID NO: 7908861 - DNA, 22 bp, Homo sapiens
tcctcccctcagggcaacggat

SEQ ID NO: 7908862 - DNA, 22 bp, Homo sapiens
tcctcccctcagggcaacggat

SEQ ID NO: 7908863 - DNA, 22 bp, Homo sapiens
tcctcccctcagggcaacggat

SEQ ID NO: 7908864 - DNA, 22 bp, Homo sapiens
tcctcccctcagggcaacggat

SEQ ID NO: 7908865 - DNA, 22 bp, Homo sapiens
tcctcccctcagggcaacggat

SEQ ID NO: 7908866 - DNA, 22 bp, Homo sapiens
tcctcccctcagggcaacggat

SEQ ID NO: 7908867 - DNA, 17 bp, Homo sapiens
tcctccccgcagttgca

SEQ ID NO: 7908868 - DNA, 22 bp, Homo sapiens
catttgtatctgggctgctgtg

SEQ ID NO: 7908869 - DNA, 22 bp, Homo sapiens
catttgtatgttcctccttagg

SEQ ID NO: 7908870 - DNA, 17 bp, Homo sapiens
tcctccccgcagttgca

SEQ ID NO: 7908871 - DNA, 22 bp, Homo sapiens
catttggaaagagactagagaa

SEQ ID NO: 7908872 - DNA, 22 bp, Homo sapiens
tcctcagggaagatgagcctca

SEQ ID NO: 7908873 - DNA, 22 bp, Homo sapiens
tcctcagggaagatgagcctca

SEQ ID NO: 7908874 - DNA, 22 bp, Homo sapiens
tcctcaggctgcctggaagact

SEQ ID NO: 7908875 - DNA, 22 bp, Homo sapiens
tcctcaggctgcctggaagact

SEQ ID NO: 7908876 - DNA, 22 bp, Homo sapiens
catttggattttgaagagagta

SEQ ID NO: 7908877 - DNA, 22 bp, Homo sapiens
catttggccattccagtcacat

SEQ ID NO: 7908878 - DNA, 22 bp, Homo sapiens
catttggattttgaagagagta

SEQ ID NO: 7908879 - DNA, 22 bp, Homo sapiens
catttggaccaaaatagccaac

SEQ ID NO: 7908880 - DNA, 22 bp, Homo sapiens
catttgtacagaacagctttat

SEQ ID NO: 7908881 - DNA, 22 bp, Homo sapiens
catttgtactgttcaatgtcat

SEQ ID NO: 7908882 - DNA, 22 bp, Homo sapiens
catttgtacagaacagctttat

SEQ ID NO: 7908883 - DNA, 22 bp, Homo sapiens
catttgtacatgttgtcttctt

SEQ ID NO: 7908884 - DNA, 22 bp, Homo sapiens
catttgtagagtaggaaagagt

SEQ ID NO: 7908885 - DNA, 22 bp, Homo sapiens
catttgtagctatttactgtat

SEQ ID NO: 7908886 - DNA, 22 bp, Homo sapiens
catttgtagctatttactgtat

SEQ ID NO: 7908887 - DNA, 22 bp, Homo sapiens
catttgtacagaacagctttat

SEQ ID NO: 7908888 - DNA, 22 bp, Homo sapiens
catttgtacagaacagctttat

SEQ ID NO: 7908889 - DNA, 22 bp, Homo sapiens
catttgtaagcatggcgttgga

SEQ ID NO: 7908890 - DNA, 22 bp, Homo sapiens
catttgtaatactgacttgcag

SEQ ID NO: 7908891 - DNA, 22 bp, Homo sapiens
catttggtggctacagagtaac

SEQ ID NO: 7908892 - DNA, 22 bp, Homo sapiens
catttggtggctacagagtaac

SEQ ID NO: 7908893 - DNA, 22 bp, Homo sapiens
tcctcaggatctaggagtgctt

SEQ ID NO: 7908894 - DNA, 22 bp, Homo sapiens
tcctcaggatctaggagtgctt

SEQ ID NO: 7908895 - DNA, 22 bp, Homo sapiens
tcctcaggatctaggagtgctt

SEQ ID NO: 7908896 - DNA, 22 bp, Homo sapiens
tcctcaggatctaggagtgctt

SEQ ID NO: 7908897 - DNA, 22 bp, Homo sapiens
tcctcaggagagctcctatgcc

SEQ ID NO: 7908898 - DNA, 22 bp, Homo sapiens
tcctcaggatctaggagtgctt

SEQ ID NO: 7908899 - DNA, 18 bp, Homo sapiens
tcctcagcctcacctagc

SEQ ID NO: 7908900 - DNA, 22 bp, Homo sapiens
tcctcaggagagctcctatgcc

SEQ ID NO: 7908901 - DNA, 22 bp, Homo sapiens
tcctcagcttttatttcacttg

SEQ ID NO: 7908902 - DNA, 22 bp, Homo sapiens
tcctcagcttttatttcacttg

SEQ ID NO: 7908903 - DNA, 22 bp, Homo sapiens
tcctcaggctgcctggaagact

SEQ ID NO: 7908904 - DNA, 22 bp, Homo sapiens
tcctcaggctgcctggaagact

SEQ ID NO: 7908905 - DNA, 22 bp, Homo sapiens
tcctcaggcggtgaggaggggc

SEQ ID NO: 7908906 - DNA, 22 bp, Homo sapiens
tcctcaggcggtgaggaggggc

SEQ ID NO: 7908907 - DNA, 22 bp, Homo sapiens
tcctcaggcggtgaggaggggc

SEQ ID NO: 7908908 - DNA, 22 bp, Homo sapiens
tcctcaggatgtggagtagaat

SEQ ID NO: 7908909 - DNA, 22 bp, Homo sapiens
tcctcaggatgtggagtagaat

SEQ ID NO: 7908910 - DNA, 22 bp, Homo sapiens
tcctcaggatgtggggtagaat

SEQ ID NO: 7908911 - DNA, 22 bp, Homo sapiens
tcctcaggatgtggggtagaat

SEQ ID NO: 7908912 - DNA, 22 bp, Homo sapiens
tcctcaggatgtggagtagaat

SEQ ID NO: 7908913 - DNA, 22 bp, Homo sapiens
tccctcactggttctgcatccc

SEQ ID NO: 7908914 - DNA, 22 bp, Homo sapiens
tccctcagaaattctctctgaa

SEQ ID NO: 7908915 - DNA, 22 bp, Homo sapiens
tccctcagaaattctctctgaa

SEQ ID NO: 7908916 - DNA, 22 bp, Homo sapiens
tccctcagaaattctctctgaa

SEQ ID NO: 7908917 - DNA, 22 bp, Homo sapiens
tccctcactggttctgcatccc

SEQ ID NO: 7908918 - DNA, 22 bp, Homo sapiens
tccctcactggttctgcatccc

SEQ ID NO: 7908919 - DNA, 22 bp, Homo sapiens
tccctcactggttctgcatccc

SEQ ID NO: 7908920 - DNA, 22 bp, Homo sapiens
tccctcactggttctgcatccc

SEQ ID NO: 7908921 - DNA, 22 bp, Homo sapiens
tccctcagaaattctctctgaa

SEQ ID NO: 7908922 - DNA, 22 bp, Homo sapiens
tccctcagaaattctctctgaa

SEQ ID NO: 7908923 - DNA, 22 bp, Homo sapiens
tcctagaagatggatcagagaa

SEQ ID NO: 7908924 - DNA, 22 bp, Homo sapiens
tcctagaaggatcattctagtg

SEQ ID NO: 7908925 - DNA, 22 bp, Homo sapiens
tcctagaagatggatcagagaa

SEQ ID NO: 7908926 - DNA, 22 bp, Homo sapiens
tcctagaaggatcattctagtg

SEQ ID NO: 7908927 - DNA, 22 bp, Homo sapiens
tcctagaaggatcattctagtg

SEQ ID NO: 7908928 - DNA, 18 bp, Homo sapiens
tcctcagcctcacctagc

SEQ ID NO: 7908929 - DNA, 22 bp, Homo sapiens
tcctcagcattagcacagacat

SEQ ID NO: 7908930 - DNA, 18 bp, Homo sapiens
tcctcagcctcacctagc

SEQ ID NO: 7908931 - DNA, 22 bp, Homo sapiens
tccctagtcgcatctgtggaga

SEQ ID NO: 7908932 - DNA, 22 bp, Homo sapiens
tccctagtcgcatctgtggaga

SEQ ID NO: 7908933 - DNA, 22 bp, Homo sapiens
tccctagtcgcatctgtggaga

SEQ ID NO: 7908934 - DNA, 22 bp, Homo sapiens
tccctagtagacccagatcatt

SEQ ID NO: 7908935 - DNA, 20 bp, Homo sapiens
tccctaggcaggagggcact

SEQ ID NO: 7908936 - DNA, 20 bp, Homo sapiens
tccctaggcaggagggcact

SEQ ID NO: 7908937 - DNA, 22 bp, Homo sapiens
tccctaggtcctagtcacagta

SEQ ID NO: 7908938 - DNA, 22 bp, Homo sapiens
tccctaggtcctagtcacagta

SEQ ID NO: 7908939 - DNA, 22 bp, Homo sapiens
tccctagtcgcatctgtggaga

SEQ ID NO: 7908940 - DNA, 22 bp, Homo sapiens
tccctcactggttctgcatccc

SEQ ID NO: 7908941 - DNA, 22 bp, Homo sapiens
tccctcacctagtctttgactc

SEQ ID NO: 7908942 - DNA, 22 bp, Homo sapiens
tccccagccgtgaaggagagga

SEQ ID NO: 7908943 - DNA, 22 bp, Homo sapiens
tccccagcattgagggtctctc

SEQ ID NO: 7908944 - DNA, 22 bp, Homo sapiens
tccccagctctgtgcttccact

SEQ ID NO: 7908945 - DNA, 22 bp, Homo sapiens
tccccagccgtgaaggagagga

SEQ ID NO: 7908946 - DNA, 22 bp, Homo sapiens
tccccagccgtgaaggagagga

SEQ ID NO: 7908947 - DNA, 22 bp, Homo sapiens
tccccagctctgtgcttccact

SEQ ID NO: 7908948 - DNA, 22 bp, Homo sapiens
tccccagcttgctacttctgct

SEQ ID NO: 7908949 - DNA, 22 bp, Homo sapiens
tccccagcttgctacttctgct

SEQ ID NO: 7908950 - DNA, 22 bp, Homo sapiens
tcccgtcttgctgttgtctgcg

SEQ ID NO: 7908951 - DNA, 22 bp, Homo sapiens
tcccgtaggttgctgtagtcgg

SEQ ID NO: 7908952 - DNA, 22 bp, Homo sapiens
tcccgttgatgacggtgcatcc

SEQ ID NO: 7908953 - DNA, 22 bp, Homo sapiens
tcccgtaggttgctgtagtcgg

SEQ ID NO: 7908954 - DNA, 22 bp, Homo sapiens
tccctagcttccgggggctgcc

SEQ ID NO: 7908955 - DNA, 22 bp, Homo sapiens
tccctagcttatttgtgctcta

SEQ ID NO: 7908956 - DNA, 22 bp, Homo sapiens
tccctaggaccccaccttccgc

SEQ ID NO: 7908957 - DNA, 20 bp, Homo sapiens
tccctaggcaggagggcact

SEQ ID NO: 7908958 - DNA, 22 bp, Homo sapiens
tccctaggagaattgccgcagc

SEQ ID NO: 7908959 - DNA, 22 bp, Homo sapiens
tccctagaggtcttcacaagat

SEQ ID NO: 7908960 - DNA, 22 bp, Homo sapiens
tccctaaactctgaactgattc

SEQ ID NO: 7908961 - DNA, 22 bp, Homo sapiens
tccctactgttagggactcagc

SEQ ID NO: 7908962 - DNA, 23 bp, Homo sapiens
tccctacaaagtgcaggaatcag

SEQ ID NO: 7908963 - DNA, 22 bp, Homo sapiens
tccctaaactctgaactgattc

SEQ ID NO: 7908964 - DNA, 22 bp, Homo sapiens
tccccactgggcctcctctttc

SEQ ID NO: 7908965 - DNA, 22 bp, Homo sapiens
tccccagacagcgggaggcctg

SEQ ID NO: 7908966 - DNA, 22 bp, Homo sapiens
tccccagacagcgggaggcctg

SEQ ID NO: 7908967 - DNA, 22 bp, Homo sapiens
tccccagaggtgaggcagcttt

SEQ ID NO: 7908968 - DNA, 22 bp, Homo sapiens
tccccagaggtgaggcagcttt

SEQ ID NO: 7908969 - DNA, 22 bp, Homo sapiens
tccccagaggaatatgagattg

SEQ ID NO: 7908970 - DNA, 22 bp, Homo sapiens
tccccactctgggccaccacaa

SEQ ID NO: 7908971 - DNA, 22 bp, Homo sapiens
tccccactctctcctggagctt

SEQ ID NO: 7908972 - DNA, 22 bp, Homo sapiens
tccccactcctgggcagatgcg

SEQ ID NO: 7908973 - DNA, 22 bp, Homo sapiens
tccccactgggcctcctctttc

SEQ ID NO: 7908974 - DNA, 22 bp, Homo sapiens
tccccactgggcctcctctttc

SEQ ID NO: 7908975 - DNA, 22 bp, Homo sapiens
tccccactgggcctcctctttc

SEQ ID NO: 7908976 - DNA, 22 bp, Homo sapiens
tccccagaggtgaggcagcttt

SEQ ID NO: 7908977 - DNA, 22 bp, Homo sapiens
tccccagatggccagctacatg

SEQ ID NO: 7908978 - DNA, 22 bp, Homo sapiens
tccccagattcatgtctgctgt

SEQ ID NO: 7908979 - DNA, 22 bp, Homo sapiens
tccccagattcatgtctgctgt

SEQ ID NO: 7908980 - DNA, 22 bp, Homo sapiens
tccccagattcatgtctgctgt

SEQ ID NO: 7908981 - DNA, 19 bp, Homo sapiens
tccccagcacctctgagtc

SEQ ID NO: 7908982 - DNA, 19 bp, Homo sapiens
tccccagcacctctgagtc

SEQ ID NO: 7908983 - DNA, 22 bp, Homo sapiens
tcccagggtcctcttctggaat

SEQ ID NO: 7908984 - DNA, 22 bp, Homo sapiens
tcccagggtcctcttctggaat

SEQ ID NO: 7908985 - DNA, 22 bp, Homo sapiens
tcccagggtcctcttctggaat

SEQ ID NO: 7908986 - DNA, 22 bp, Homo sapiens
cattgcaacttcaaactcctgg

SEQ ID NO: 7908987 - DNA, 22 bp, Homo sapiens
cattgcaacttcaaactcctgg

SEQ ID NO: 7908988 - DNA, 22 bp, Homo sapiens
cattgcaacttcaaactcctgg

SEQ ID NO: 7908989 - DNA, 22 bp, Homo sapiens
cattgcaacttcaaactcctgg

SEQ ID NO: 7908990 - DNA, 22 bp, Homo sapiens
cattgcaccacattgcatccct

SEQ ID NO: 7908991 - DNA, 22 bp, Homo sapiens
cattgcaccacattgcatccct

SEQ ID NO: 7908992 - DNA, 22 bp, Homo sapiens
cattgcaacttcaaactcctgg

SEQ ID NO: 7908993 - DNA, 22 bp, Homo sapiens
cattgcaacttcaaactcctgg

SEQ ID NO: 7908994 - DNA, 22 bp, Homo sapiens
cattgcaacttcaaactcctgg

SEQ ID NO: 7908995 - DNA, 22 bp, Homo sapiens
cattgcaacttcaaactcctgg

SEQ ID NO: 7908996 - DNA, 22 bp, Homo sapiens
cattgagaatctgggctacagc

SEQ ID NO: 7908997 - DNA, 22 bp, Homo sapiens
cattgacagttctttaagttgc

SEQ ID NO: 7908998 - DNA, 22 bp, Homo sapiens
cattgacatcaggcttggccaa

SEQ ID NO: 7908999 - DNA, 22 bp, Homo sapiens
cattgacgatcatgtactttta

SEQ ID NO: 7909000 - DNA, 22 bp, Homo sapiens
cattgacatcaggcttggccaa

SEQ ID NO: 7909001 - DNA, 22 bp, Homo sapiens
tcccaggatctgagggcagaga

SEQ ID NO: 7909002 - DNA, 22 bp, Homo sapiens
tcccaggatctgagggcagaga

SEQ ID NO: 7909003 - DNA, 18 bp, Homo sapiens
cattcttggcagcttttg

SEQ ID NO: 7909004 - DNA, 22 bp, Homo sapiens
cattgaaaaacgttgactgagt

SEQ ID NO: 7909005 - DNA, 22 bp, Homo sapiens
tcccaggaggtgcttcctagga

SEQ ID NO: 7909006 - DNA, 22 bp, Homo sapiens
tcccaggaggtgcttcctagga

SEQ ID NO: 7909007 - DNA, 22 bp, Homo sapiens
tcccaggaggtgcttcctagga

SEQ ID NO: 7909008 - DNA, 16 bp, Homo sapiens
tcccaggaggcggaac

SEQ ID NO: 7909009 - DNA, 22 bp, Homo sapiens
tcccaggagcaccttttgagcc

SEQ ID NO: 7909010 - DNA, 16 bp, Homo sapiens
tcccaggaggcggaac

SEQ ID NO: 7909011 - DNA, 18 bp, Homo sapiens
cattgacagtatatcttt

SEQ ID NO: 7909012 - DNA, 22 bp, Homo sapiens
cattgaatccttccttcagaag

SEQ ID NO: 7909013 - DNA, 22 bp, Homo sapiens
cattgaaatatggaaactgatg

SEQ ID NO: 7909014 - DNA, 22 bp, Homo sapiens
cattgaaatatggaaactgatg

SEQ ID NO: 7909015 - DNA, 22 bp, Homo sapiens
cattgaataatgtccttgcaaa

SEQ ID NO: 7909016 - DNA, 22 bp, Homo sapiens
cattgaaatatggaaactgatg

SEQ ID NO: 7909017 - DNA, 22 bp, Homo sapiens
cattgaaacctaacataggctg

SEQ ID NO: 7909018 - DNA, 22 bp, Homo sapiens
cattgaaagagataaagccttt

SEQ ID NO: 7909019 - DNA, 22 bp, Homo sapiens
cattgaaaatgttgcaggctgt

SEQ ID NO: 7909020 - DNA, 22 bp, Homo sapiens
cattgaaaaacgttgactgagt

SEQ ID NO: 7909021 - DNA, 22 bp, Homo sapiens
cattgaaacctaacataggctg

SEQ ID NO: 7909022 - DNA, 22 bp, Homo sapiens
cattgaaacagatgtacccatg

SEQ ID NO: 7909023 - DNA, 22 bp, Homo sapiens
cattgaaacctaacataggctg

SEQ ID NO: 7909024 - DNA, 22 bp, Homo sapiens
cattcatccactgttggaaatt

SEQ ID NO: 7909025 - DNA, 22 bp, Homo sapiens
cattcattagaatagatatgta

SEQ ID NO: 7909026 - DNA, 22 bp, Homo sapiens
cattcattagaatagatatgta

SEQ ID NO: 7909027 - DNA, 22 bp, Homo sapiens
cattcattcacattttgtctat

SEQ ID NO: 7909028 - DNA, 22 bp, Homo sapiens
cattcataagactttgctcttg

SEQ ID NO: 7909029 - DNA, 22 bp, Homo sapiens
cattcagtggagtattattcag

SEQ ID NO: 7909030 - DNA, 22 bp, Homo sapiens
cattcagtggagtattattcag

SEQ ID NO: 7909031 - DNA, 22 bp, Homo sapiens
cattcagtcatgctggttttga

SEQ ID NO: 7909032 - DNA, 22 bp, Homo sapiens
cattcagtcatgctggttttga

SEQ ID NO: 7909033 - DNA, 22 bp, Homo sapiens
cattcaggtacactcagtgcta

SEQ ID NO: 7909034 - DNA, 22 bp, Homo sapiens
cattcataagtttttgtgctgg

SEQ ID NO: 7909035 - DNA, 22 bp, Homo sapiens
cattcatacaagtttgtttcat

SEQ ID NO: 7909036 - DNA, 22 bp, Homo sapiens
cattcatatttgcagtatacct

SEQ ID NO: 7909037 - DNA, 22 bp, Homo sapiens
cattcacatcttgttccatcac

SEQ ID NO: 7909038 - DNA, 21 bp, Homo sapiens
cattcacagtctggctcttga

SEQ ID NO: 7909039 - DNA, 22 bp, Homo sapiens
cattcacagagggggaagcatc

SEQ ID NO: 7909040 - DNA, 22 bp, Homo sapiens
cattcacatcttgttccatcac

SEQ ID NO: 7909041 - DNA, 22 bp, Homo sapiens
cattcacatcttgttccatcac

SEQ ID NO: 7909042 - DNA, 22 bp, Homo sapiens
cattcacatcttgttccatcac

SEQ ID NO: 7909043 - DNA, 22 bp, Homo sapiens
cattcagagctttcttatcata

SEQ ID NO: 7909044 - DNA, 22 bp, Homo sapiens
cattcaggtacactcagtgcta

SEQ ID NO: 7909045 - DNA, 22 bp, Homo sapiens
cattcacattcttcttactgtt

SEQ ID NO: 7909046 - DNA, 22 bp, Homo sapiens
cattcactcagcgatgccagta

SEQ ID NO: 7909047 - DNA, 22 bp, Homo sapiens
cattcaagagtggacataatgc

SEQ ID NO: 7909048 - DNA, 22 bp, Homo sapiens
cattcacaaaaccacatgccat

SEQ ID NO: 7909049 - DNA, 22 bp, Homo sapiens
cattcacaaaaccacatgccat

SEQ ID NO: 7909050 - DNA, 22 bp, Homo sapiens
cattcacaaaaccacatgccat

SEQ ID NO: 7909051 - DNA, 22 bp, Homo sapiens
cattcacaaagctgattgatgg

SEQ ID NO: 7909052 - DNA, 22 bp, Homo sapiens
cattcacaaaaccacatgccat

SEQ ID NO: 7909053 - DNA, 22 bp, Homo sapiens
cattcacaactgagcattgttg

SEQ ID NO: 7909054 - DNA, 22 bp, Homo sapiens
cattcacaaagctgattgatgg

SEQ ID NO: 7909055 - DNA, 22 bp, Homo sapiens
cattcacaatagttgaaaggtg

SEQ ID NO: 7909056 - DNA, 22 bp, Homo sapiens
cattcacagcaggtcagctgaa

SEQ ID NO: 7909057 - DNA, 22 bp, Homo sapiens
cattcacagcaggtcagctgaa

SEQ ID NO: 7909058 - DNA, 22 bp, Homo sapiens
cattcacagagggggaagcatc

SEQ ID NO: 7909059 - DNA, 22 bp, Homo sapiens
cattcacaatggattgcttcaa

SEQ ID NO: 7909060 - DNA, 22 bp, Homo sapiens
cattcacagagggggaagcatc

SEQ ID NO: 7909061 - DNA, 22 bp, Homo sapiens
cattatctcttctatatgctag

SEQ ID NO: 7909062 - DNA, 22 bp, Homo sapiens
cattatattttactgcatggga

SEQ ID NO: 7909063 - DNA, 22 bp, Homo sapiens
cattatattttactgcatggga

SEQ ID NO: 7909064 - DNA, 22 bp, Homo sapiens
catgtttctgagaaaagtagga

SEQ ID NO: 7909065 - DNA, 22 bp, Homo sapiens
catgtttctgagaaaagtagga

SEQ ID NO: 7909066 - DNA, 22 bp, Homo sapiens
cattatattacagcactgttaa

SEQ ID NO: 7909067 - DNA, 22 bp, Homo sapiens
cattatattacagcactgttaa

SEQ ID NO: 7909068 - DNA, 22 bp, Homo sapiens
catgttttctaggctttcacaa

SEQ ID NO: 7909069 - DNA, 22 bp, Homo sapiens
catgtttgtacaaaggtacaca

SEQ ID NO: 7909070 - DNA, 22 bp, Homo sapiens
catgtttgtaggtcctgcttgc

SEQ ID NO: 7909071 - DNA, 22 bp, Homo sapiens
catgtttaattgcgatgtttga

SEQ ID NO: 7909072 - DNA, 22 bp, Homo sapiens
catgtttaattgcgatgtttga

SEQ ID NO: 7909073 - DNA, 22 bp, Homo sapiens
catgtttactaccaggagaatg

SEQ ID NO: 7909074 - DNA, 22 bp, Homo sapiens
catgtttactaccaggagaatg

SEQ ID NO: 7909075 - DNA, 22 bp, Homo sapiens
catgtttaattgcgatgtttga

SEQ ID NO: 7909076 - DNA, 22 bp, Homo sapiens
catgtttaattgcgatgtttga

SEQ ID NO: 7909077 - DNA, 22 bp, Homo sapiens
catgttgtgaaggaaaatgggc

SEQ ID NO: 7909078 - DNA, 22 bp, Homo sapiens
catgttgtattctttggctggt

SEQ ID NO: 7909079 - DNA, 22 bp, Homo sapiens
catgttgtatcattctgttcct

SEQ ID NO: 7909080 - DNA, 22 bp, Homo sapiens
catgttgggcatgcatatgtgt

SEQ ID NO: 7909081 - DNA, 22 bp, Homo sapiens
catgttgtattctttggctggt

SEQ ID NO: 7909082 - DNA, 22 bp, Homo sapiens
catgttggtgtgctgcacccgt

SEQ ID NO: 7909083 - DNA, 22 bp, Homo sapiens
catgttggtgtgctgcacccat

SEQ ID NO: 7909084 - DNA, 22 bp, Homo sapiens
catgttgtagtatcataatggt

SEQ ID NO: 7909085 - DNA, 22 bp, Homo sapiens
catgttgtatcattctgttcct

SEQ ID NO: 7909086 - DNA, 22 bp, Homo sapiens
catgttggctgaggctgtattt

SEQ ID NO: 7909087 - DNA, 22 bp, Homo sapiens
catgttgaatggccttgatttt

SEQ ID NO: 7909088 - DNA, 22 bp, Homo sapiens
catgttctcttaatgttaacta

SEQ ID NO: 7909089 - DNA, 22 bp, Homo sapiens
catgttctcttaatgttaacta

SEQ ID NO: 7909090 - DNA, 22 bp, Homo sapiens
catgttggcactgtctctgcct

SEQ ID NO: 7909091 - DNA, 22 bp, Homo sapiens
catgttggcactgtctctgcct

SEQ ID NO: 7909092 - DNA, 22 bp, Homo sapiens
catgttctaatattgtgacata

SEQ ID NO: 7909093 - DNA, 22 bp, Homo sapiens
catgttctaatattgtgacata

SEQ ID NO: 7909094 - DNA, 22 bp, Homo sapiens
catgttcagtgacagttattga

SEQ ID NO: 7909095 - DNA, 22 bp, Homo sapiens
catgttcatcagatcaattgta

SEQ ID NO: 7909096 - DNA, 22 bp, Homo sapiens
catgttaactaagattaactat

SEQ ID NO: 7909097 - DNA, 22 bp, Homo sapiens
catgttaagtgtttgataacca

SEQ ID NO: 7909098 - DNA, 22 bp, Homo sapiens
catgttaatatgcattgagtac

SEQ ID NO: 7909099 - DNA, 22 bp, Homo sapiens
catgttcaaataagtagtttct

SEQ ID NO: 7909100 - DNA, 22 bp, Homo sapiens
catgttatttatccattaaaca

SEQ ID NO: 7909101 - DNA, 22 bp, Homo sapiens
catgttatttatccattaaaca

SEQ ID NO: 7909102 - DNA, 19 bp, Homo sapiens
catgttatgctgtagtatc

SEQ ID NO: 7909103 - DNA, 19 bp, Homo sapiens
catgttatgctgtagtatc

SEQ ID NO: 7909104 - DNA, 22 bp, Homo sapiens
catgttaatgaatttttgcagt

SEQ ID NO: 7909105 - DNA, 22 bp, Homo sapiens
cattcatttactttcaacagct

SEQ ID NO: 7909106 - DNA, 22 bp, Homo sapiens
cattcattcagcaactgttatt

SEQ ID NO: 7909107 - DNA, 22 bp, Homo sapiens
cattcattcagcaactgttatt

SEQ ID NO: 7909108 - DNA, 22 bp, Homo sapiens
cattcattctgtaagtaactat

SEQ ID NO: 7909109 - DNA, 22 bp, Homo sapiens
cattcattctgtaagtaactat

SEQ ID NO: 7909110 - DNA, 22 bp, Homo sapiens
tcccagagcccaagttggagag

SEQ ID NO: 7909111 - DNA, 22 bp, Homo sapiens
tcccagagcccaagttggagag

SEQ ID NO: 7909112 - DNA, 22 bp, Homo sapiens
tcccagagcccaagttggagag

SEQ ID NO: 7909113 - DNA, 22 bp, Homo sapiens
tcccagagcccaagttggagag

SEQ ID NO: 7909114 - DNA, 22 bp, Homo sapiens
tcccagagcccaagttggagag

SEQ ID NO: 7909115 - DNA, 22 bp, Homo sapiens
tcccagagcccaagttggagag

SEQ ID NO: 7909116 - DNA, 22 bp, Homo sapiens
tcccagagcctctgccactctg

SEQ ID NO: 7909117 - DNA, 22 bp, Homo sapiens
tcccagagcctctgccactctg

SEQ ID NO: 7909118 - DNA, 22 bp, Homo sapiens
tcccagagcctctgccactctg

SEQ ID NO: 7909119 - DNA, 22 bp, Homo sapiens
tcccagagcccaagttggagag

SEQ ID NO: 7909120 - DNA, 21 bp, Homo sapiens
tcccactctaaatggactgaa

SEQ ID NO: 7909121 - DNA, 22 bp, Homo sapiens
cattcatttatgaaatatctat

SEQ ID NO: 7909122 - DNA, 22 bp, Homo sapiens
cattcatttatgaaatatctat

SEQ ID NO: 7909123 - DNA, 22 bp, Homo sapiens
tcccactgagcatatgcagatg

SEQ ID NO: 7909124 - DNA, 22 bp, Homo sapiens
tcccactgagcccctgctggtg

SEQ ID NO: 7909125 - DNA, 20 bp, Homo sapiens
tcccactcttgtgttttcag

SEQ ID NO: 7909126 - DNA, 22 bp, Homo sapiens
tcccagccacaggtgtagccct

SEQ ID NO: 7909127 - DNA, 22 bp, Homo sapiens
tcccagccacaggtgtagccct

SEQ ID NO: 7909128 - DNA, 22 bp, Homo sapiens
tcccagccacaggtgtagccct

SEQ ID NO: 7909129 - DNA, 22 bp, Homo sapiens
tcccagaggaaatggcagctga

SEQ ID NO: 7909130 - DNA, 22 bp, Homo sapiens
tcccagaggaaatggcagctga

SEQ ID NO: 7909131 - DNA, 22 bp, Homo sapiens
tcccagaggactgttggtgcta

SEQ ID NO: 7909132 - DNA, 22 bp, Homo sapiens
tcccagaggactgttggtgcta

SEQ ID NO: 7909133 - DNA, 22 bp, Homo sapiens
tcccagaggactgttggtgcta

SEQ ID NO: 7909134 - DNA, 22 bp, Homo sapiens
tcccagagctgataagccttta

SEQ ID NO: 7909135 - DNA, 22 bp, Homo sapiens
tcccagagctgataagccttta

SEQ ID NO: 7909136 - DNA, 22 bp, Homo sapiens
tcccagaggaaatggcagctga

SEQ ID NO: 7909137 - DNA, 22 bp, Homo sapiens
tcccagaggaaatggcagctga

SEQ ID NO: 7909138 - DNA, 22 bp, Homo sapiens
tcccagagctgataagccttta

SEQ ID NO: 7909139 - DNA, 22 bp, Homo sapiens
tcccagaggaaatggcagctga

SEQ ID NO: 7909140 - DNA, 22 bp, Homo sapiens
tcccagaggaaatggcagctga

SEQ ID NO: 7909141 - DNA, 22 bp, Homo sapiens
tcccagaggaaatggcagctga

SEQ ID NO: 7909142 - DNA, 22 bp, Homo sapiens
tcccagaggaaatggcagctga

SEQ ID NO: 7909143 - DNA, 22 bp, Homo sapiens
tcccagaggaaatggcagctga

SEQ ID NO: 7909144 - DNA, 22 bp, Homo sapiens
tcccagagctctgacaccagct

SEQ ID NO: 7909145 - DNA, 22 bp, Homo sapiens
tcccagagctctgacaccagct

SEQ ID NO: 7909146 - DNA, 22 bp, Homo sapiens
tcccagagctctgacaccagct

SEQ ID NO: 7909147 - DNA, 22 bp, Homo sapiens
tcccagagcctctgccactctg

SEQ ID NO: 7909148 - DNA, 22 bp, Homo sapiens
tcccagagcctctgccactctg

SEQ ID NO: 7909149 - DNA, 22 bp, Homo sapiens
tcccagagcctctgccactctg

SEQ ID NO: 7909150 - DNA, 22 bp, Homo sapiens
tcccagagcctctgccactctg

SEQ ID NO: 7909151 - DNA, 22 bp, Homo sapiens
tcccagagctctggaggttgga

SEQ ID NO: 7909152 - DNA, 22 bp, Homo sapiens
tcccagagctctggaggttgga

SEQ ID NO: 7909153 - DNA, 22 bp, Homo sapiens
tcccagagctctggaggttgga

SEQ ID NO: 7909154 - DNA, 22 bp, Homo sapiens
tcccagagctctgacaccagct

SEQ ID NO: 7909155 - DNA, 22 bp, Homo sapiens
tcccagagctctgacaccagct

SEQ ID NO: 7909156 - DNA, 22 bp, Homo sapiens
tcccagagctctggaggttgga

SEQ ID NO: 7909157 - DNA, 22 bp, Homo sapiens
tcccagagctctggaggttgga

SEQ ID NO: 7909158 - DNA, 22 bp, Homo sapiens
tcccagagctgataagccttta

SEQ ID NO: 7909159 - DNA, 22 bp, Homo sapiens
tcccagagctgataagccttta

SEQ ID NO: 7909160 - DNA, 22 bp, Homo sapiens
tcccagccacagtttccacctg

SEQ ID NO: 7909161 - DNA, 22 bp, Homo sapiens
tcccagccacagtttccacctg

SEQ ID NO: 7909162 - DNA, 22 bp, Homo sapiens
tcccagccacagtttccacctg

SEQ ID NO: 7909163 - DNA, 22 bp, Homo sapiens
tcccagccacagtttccacctg

SEQ ID NO: 7909164 - DNA, 22 bp, Homo sapiens
tcccagccaggctctaccactt

SEQ ID NO: 7909165 - DNA, 22 bp, Homo sapiens
tcccagccaggctctaccactt

SEQ ID NO: 7909166 - DNA, 22 bp, Homo sapiens
tcccagccaggctctaccactt

SEQ ID NO: 7909167 - DNA, 22 bp, Homo sapiens
tcccagccaggctctaccactt

SEQ ID NO: 7909168 - DNA, 22 bp, Homo sapiens
tcccagcccagatttgtgtgac

SEQ ID NO: 7909169 - DNA, 22 bp, Homo sapiens
tcccagcccagacttctccagt

SEQ ID NO: 7909170 - DNA, 22 bp, Homo sapiens
tcccagcccagatttgtgtgac

SEQ ID NO: 7909171 - DNA, 22 bp, Homo sapiens
tcccagcccagacttctccagt

SEQ ID NO: 7909172 - DNA, 22 bp, Homo sapiens
tcccagccattcctttaggtgt

SEQ ID NO: 7909173 - DNA, 22 bp, Homo sapiens
tcccagccattcctttaggtgt

SEQ ID NO: 7909174 - DNA, 22 bp, Homo sapiens
tcccaggacaggccacatggaa

SEQ ID NO: 7909175 - DNA, 22 bp, Homo sapiens
tcccaggacaggccacatggaa

SEQ ID NO: 7909176 - DNA, 22 bp, Homo sapiens
tcccaggaattgaagccagtgt

SEQ ID NO: 7909177 - DNA, 22 bp, Homo sapiens
tcccaggacaggccacatggaa

SEQ ID NO: 7909178 - DNA, 22 bp, Homo sapiens
tcccaggaattgaagccagtgt

SEQ ID NO: 7909179 - DNA, 22 bp, Homo sapiens
tcccaggaattgaagccagtgt

SEQ ID NO: 7909180 - DNA, 22 bp, Homo sapiens
tcccaggaattgaagccagtgt

SEQ ID NO: 7909181 - DNA, 22 bp, Homo sapiens
tcccaggaattgaagccagtgt

SEQ ID NO: 7909182 - DNA, 22 bp, Homo sapiens
tcccaggaatgtctgaaagtga

SEQ ID NO: 7909183 - DNA, 22 bp, Homo sapiens
tcccaggaatgtctgaaagtga

SEQ ID NO: 7909184 - DNA, 22 bp, Homo sapiens
tcccaggaatccgtcctctaga

SEQ ID NO: 7909185 - DNA, 22 bp, Homo sapiens
tcccaggaatccgtcctctaga

SEQ ID NO: 7909186 - DNA, 23 bp, Homo sapiens
tcccaggaatctgcatttttaac

SEQ ID NO: 7909187 - DNA, 23 bp, Homo sapiens
tcccaggaatctgcatttttaac

SEQ ID NO: 7909188 - DNA, 22 bp, Homo sapiens
tcccaggacccaggcattcaca

SEQ ID NO: 7909189 - DNA, 22 bp, Homo sapiens
tcccaggacccaggcattcaca

SEQ ID NO: 7909190 - DNA, 22 bp, Homo sapiens
tcccaggacccaggcattcaca

SEQ ID NO: 7909191 - DNA, 22 bp, Homo sapiens
tcccaggacttccagttggagg

SEQ ID NO: 7909192 - DNA, 22 bp, Homo sapiens
tcccaggacttccagttggagg

SEQ ID NO: 7909193 - DNA, 22 bp, Homo sapiens
tcccaggacttccagttggagg

SEQ ID NO: 7909194 - DNA, 22 bp, Homo sapiens
tcccaggagcaccttttgagcc

SEQ ID NO: 7909195 - DNA, 22 bp, Homo sapiens
tcccaggacatgggctctgctc

SEQ ID NO: 7909196 - DNA, 22 bp, Homo sapiens
tcccaggacaggccacatggaa

SEQ ID NO: 7909197 - DNA, 22 bp, Homo sapiens
tcccaggacaggccacatggaa

SEQ ID NO: 7909198 - DNA, 22 bp, Homo sapiens
tcccaggacatgggctctgctc

SEQ ID NO: 7909199 - DNA, 22 bp, Homo sapiens
tcccaggacatgggctctgctc

SEQ ID NO: 7909200 - DNA, 22 bp, Homo sapiens
tcccaggacatgggctctgctc

SEQ ID NO: 7909201 - DNA, 22 bp, Homo sapiens
tctctgggacactgggtcagtt

SEQ ID NO: 7909202 - DNA, 22 bp, Homo sapiens
tctctgggaattttttggacat

SEQ ID NO: 7909203 - DNA, 22 bp, Homo sapiens
tctctgggaattttttggacat

SEQ ID NO: 7909204 - DNA, 22 bp, Homo sapiens
tctctgggagccaggatgacac

SEQ ID NO: 7909205 - DNA, 22 bp, Homo sapiens
tctctgggagccaggatgacac

SEQ ID NO: 7909206 - DNA, 22 bp, Homo sapiens
tctctgggagccaggatgacac

SEQ ID NO: 7909207 - DNA, 22 bp, Homo sapiens
tctctgggagcaattgtttgct

SEQ ID NO: 7909208 - DNA, 22 bp, Homo sapiens
tctctgggagcaattgtttgct

SEQ ID NO: 7909209 - DNA, 22 bp, Homo sapiens
tctctgggacactgggtcagtt

SEQ ID NO: 7909210 - DNA, 22 bp, Homo sapiens
tctctgggagcaattgtttgct

SEQ ID NO: 7909211 - DNA, 22 bp, Homo sapiens
tctctgggagttgagcagcagc

SEQ ID NO: 7909212 - DNA, 21 bp, Homo sapiens
tctctgggaggacttgtgaga

SEQ ID NO: 7909213 - DNA, 22 bp, Homo sapiens
tctctgggagttgagcagcagc

SEQ ID NO: 7909214 - DNA, 22 bp, Homo sapiens
tctctgggagttgagcagcagc

SEQ ID NO: 7909215 - DNA, 22 bp, Homo sapiens
tctctgggagttgagcagcagc

SEQ ID NO: 7909216 - DNA, 22 bp, Homo sapiens
tctctgggagttgagcagcagc

SEQ ID NO: 7909217 - DNA, 22 bp, Homo sapiens
ccagcactctgtcccagcttcc

SEQ ID NO: 7909218 - DNA, 21 bp, Homo sapiens
tctctgggaggacttgtgaga

SEQ ID NO: 7909219 - DNA, 21 bp, Homo sapiens
tctctgggaggacttgtgaga

SEQ ID NO: 7909220 - DNA, 21 bp, Homo sapiens
tctctgggaggacttgtgaga

SEQ ID NO: 7909221 - DNA, 22 bp, Homo sapiens
tctctgggagccaggatgacac

SEQ ID NO: 7909222 - DNA, 21 bp, Homo sapiens
tctctgggaggacttgtgaga

SEQ ID NO: 7909223 - DNA, 21 bp, Homo sapiens
tctctgggaggacttgtgaga

SEQ ID NO: 7909224 - DNA, 22 bp, Homo sapiens
tctctgcccatcctcagtccac

SEQ ID NO: 7909225 - DNA, 22 bp, Homo sapiens
tctctgcccatcctcagtccac

SEQ ID NO: 7909226 - DNA, 22 bp, Homo sapiens
tctctgcccatcctcagtccac

SEQ ID NO: 7909227 - DNA, 22 bp, Homo sapiens
tctctgcccatgagcaatctgc

SEQ ID NO: 7909228 - DNA, 22 bp, Homo sapiens
tctctgggaaatggagaatttt

SEQ ID NO: 7909229 - DNA, 22 bp, Homo sapiens
tctctgggaaatggagaatttt

SEQ ID NO: 7909230 - DNA, 22 bp, Homo sapiens
tctctgggaatgggcctgggta

SEQ ID NO: 7909231 - DNA, 22 bp, Homo sapiens
tctctgggaatgggcctgggta

SEQ ID NO: 7909232 - DNA, 22 bp, Homo sapiens
tctctgggaatgggcctgggta

SEQ ID NO: 7909233 - DNA, 22 bp, Homo sapiens
tctctgggaatgggcctgggta

SEQ ID NO: 7909234 - DNA, 22 bp, Homo sapiens
tctctgggaattcacaagccct

SEQ ID NO: 7909235 - DNA, 22 bp, Homo sapiens
tctctgggaattcacaagccct

SEQ ID NO: 7909236 - DNA, 22 bp, Homo sapiens
tctctgggaattcacaagccct

SEQ ID NO: 7909237 - DNA, 22 bp, Homo sapiens
tctctgggaattcacaagccct

SEQ ID NO: 7909238 - DNA, 22 bp, Homo sapiens
tctctgggaatgggcctgggta

SEQ ID NO: 7909239 - DNA, 22 bp, Homo sapiens
tctctgcccatcctcagtccac

SEQ ID NO: 7909240 - DNA, 22 bp, Homo sapiens
tctctgcccatcctcagtccac

SEQ ID NO: 7909241 - DNA, 22 bp, Homo sapiens
tctctgcccatcctcagtccac

SEQ ID NO: 7909242 - DNA, 22 bp, Homo sapiens
tctctgcccatcctcagtccac

SEQ ID NO: 7909243 - DNA, 22 bp, Homo sapiens
tctctgccacagcttctgcctt

SEQ ID NO: 7909244 - DNA, 22 bp, Homo sapiens
tctctgccacagcttctgcctt

SEQ ID NO: 7909245 - DNA, 22 bp, Homo sapiens
tctctgccacagcttctgcctt

SEQ ID NO: 7909246 - DNA, 22 bp, Homo sapiens
tctctgccaccatgagatgggc

SEQ ID NO: 7909247 - DNA, 23 bp, Homo sapiens
tctcctggctgcactgtggccac

SEQ ID NO: 7909248 - DNA, 17 bp, Homo sapiens
tctcctggctctatcag

SEQ ID NO: 7909249 - DNA, 23 bp, Homo sapiens
tctcctggctgcactgtggccac

SEQ ID NO: 7909250 - DNA, 23 bp, Homo sapiens
tctcctggctgcactgtggccac

SEQ ID NO: 7909251 - DNA, 23 bp, Homo sapiens
tctcctggctgcactgtggccac

SEQ ID NO: 7909252 - DNA, 23 bp, Homo sapiens
tctcctggctgcactgtggccac

SEQ ID NO: 7909253 - DNA, 22 bp, Homo sapiens
tctcctggctctaaaaggctgt

SEQ ID NO: 7909254 - DNA, 22 bp, Homo sapiens
tctcctggctctaaaaggctgt

SEQ ID NO: 7909255 - DNA, 22 bp, Homo sapiens
tctcctggctctaaaaggctgt

SEQ ID NO: 7909256 - DNA, 17 bp, Homo sapiens
tctcctggctctatcag

SEQ ID NO: 7909257 - DNA, 22 bp, Homo sapiens
tctcctggctctaaaaggctgt

SEQ ID NO: 7909258 - DNA, 17 bp, Homo sapiens
tctcctggctctatcag

SEQ ID NO: 7909259 - DNA, 22 bp, Homo sapiens
tctcctggctcaccaggctgga

SEQ ID NO: 7909260 - DNA, 22 bp, Homo sapiens
tctcctggctcaccaggctgga

SEQ ID NO: 7909261 - DNA, 22 bp, Homo sapiens
tctcctggctcaccaggctgga

SEQ ID NO: 7909262 - DNA, 22 bp, Homo sapiens
tctcctggctcaccaggctgga

SEQ ID NO: 7909263 - DNA, 22 bp, Homo sapiens
tctcctggctcaccaggctgga

SEQ ID NO: 7909264 - DNA, 22 bp, Homo sapiens
tctcctggctcaccaggctgga

SEQ ID NO: 7909265 - DNA, 22 bp, Homo sapiens
tctcctggcctttaggttaagg

SEQ ID NO: 7909266 - DNA, 22 bp, Homo sapiens
tctcctggcctttaggttaagg

SEQ ID NO: 7909267 - DNA, 22 bp, Homo sapiens
tctcctggcctttaggttaagg

SEQ ID NO: 7909268 - DNA, 22 bp, Homo sapiens
tctcctggccgggctgtcccct

SEQ ID NO: 7909269 - DNA, 22 bp, Homo sapiens
tctcctggccgggctgtcccct

SEQ ID NO: 7909270 - DNA, 19 bp, Homo sapiens
tctctgcagcgcgcccggc

SEQ ID NO: 7909271 - DNA, 22 bp, Homo sapiens
tctctgcatccccagggctctc

SEQ ID NO: 7909272 - DNA, 23 bp, Homo sapiens
tctctgcatgtcctgagcacatc

SEQ ID NO: 7909273 - DNA, 22 bp, Homo sapiens
tctctgcatgacccaaggctga

SEQ ID NO: 7909274 - DNA, 22 bp, Homo sapiens
tctctgatgacctatgatgttg

SEQ ID NO: 7909275 - DNA, 22 bp, Homo sapiens
tctctgatgattggaagcttag

SEQ ID NO: 7909276 - DNA, 22 bp, Homo sapiens
tctctgatgattggaagcttag

SEQ ID NO: 7909277 - DNA, 22 bp, Homo sapiens
tctctgatgtatatcagagaac

SEQ ID NO: 7909278 - DNA, 22 bp, Homo sapiens
tctctgcacttgcacataagct

SEQ ID NO: 7909279 - DNA, 22 bp, Homo sapiens
tctctgcacagaagtagatagc

SEQ ID NO: 7909280 - DNA, 22 bp, Homo sapiens
tctctgagttgtaaaaaatagt

SEQ ID NO: 7909281 - DNA, 22 bp, Homo sapiens
tctctgagttctcctccagccc

SEQ ID NO: 7909282 - DNA, 23 bp, Homo sapiens
tctctgagttgtactttcccttg

SEQ ID NO: 7909283 - DNA, 22 bp, Homo sapiens
tctctgagttttaaggatgatg

SEQ ID NO: 7909284 - DNA, 22 bp, Homo sapiens
tctctgagttttaaggatgatg

SEQ ID NO: 7909285 - DNA, 22 bp, Homo sapiens
tctctgagttttaaggatgatg

SEQ ID NO: 7909286 - DNA, 22 bp, Homo sapiens
tctctgagttttaaggatgatg

SEQ ID NO: 7909287 - DNA, 22 bp, Homo sapiens
tctctcttgtcaccccatctgc

SEQ ID NO: 7909288 - DNA, 22 bp, Homo sapiens
ccagcagggcagtgccctggac

SEQ ID NO: 7909289 - DNA, 22 bp, Homo sapiens
ccagcagggcagtgccctggac

SEQ ID NO: 7909290 - DNA, 22 bp, Homo sapiens
ccagcagggcagtgccctggac

SEQ ID NO: 7909291 - DNA, 22 bp, Homo sapiens
ccagcagggcagtgccctggac

SEQ ID NO: 7909292 - DNA, 22 bp, Homo sapiens
ccagcaggggaatatttttagg

SEQ ID NO: 7909293 - DNA, 22 bp, Homo sapiens
ccagcagggcagtgccctggac

SEQ ID NO: 7909294 - DNA, 22 bp, Homo sapiens
ccagcagggcagtgccctggac

SEQ ID NO: 7909295 - DNA, 22 bp, Homo sapiens
ccagcagggcagtgccctggac

SEQ ID NO: 7909296 - DNA, 22 bp, Homo sapiens
ccagcagggcagtgccctggac

SEQ ID NO: 7909297 - DNA, 22 bp, Homo sapiens
ccagcagggaaaaacccaccaa

SEQ ID NO: 7909298 - DNA, 22 bp, Homo sapiens
ccagcagctttattggctctcc

SEQ ID NO: 7909299 - DNA, 22 bp, Homo sapiens
ccagcagctttattggctctcc

SEQ ID NO: 7909300 - DNA, 22 bp, Homo sapiens
ccagcagctgtggctttgcctc

SEQ ID NO: 7909301 - DNA, 22 bp, Homo sapiens
ccagcagctgtggctttgcctc

SEQ ID NO: 7909302 - DNA, 22 bp, Homo sapiens
ccagcagctgtggctttgcctc

SEQ ID NO: 7909303 - DNA, 22 bp, Homo sapiens
ccagcagctgtggctttgcctc

SEQ ID NO: 7909304 - DNA, 22 bp, Homo sapiens
ccagcagctgtggctttgcctc

SEQ ID NO: 7909305 - DNA, 22 bp, Homo sapiens
ccagcagctgctatgtggtttt

SEQ ID NO: 7909306 - DNA, 22 bp, Homo sapiens
ccagcagctgctatgtggtttt

SEQ ID NO: 7909307 - DNA, 22 bp, Homo sapiens
ccagcagctttattggctctcc

SEQ ID NO: 7909308 - DNA, 22 bp, Homo sapiens
ccagcagctttattggctctcc

SEQ ID NO: 7909309 - DNA, 22 bp, Homo sapiens
ccagcagctttattggctctcc

SEQ ID NO: 7909310 - DNA, 22 bp, Homo sapiens
ccagcagctttattggctctcc

SEQ ID NO: 7909311 - DNA, 22 bp, Homo sapiens
ccagcagctttattggctctcc

SEQ ID NO: 7909312 - DNA, 22 bp, Homo sapiens
ccagcagctttattggctctcc

SEQ ID NO: 7909313 - DNA, 22 bp, Homo sapiens
ccagcagctgcaaagcctgggt

SEQ ID NO: 7909314 - DNA, 22 bp, Homo sapiens
ccagcagctgcaaagcctgggt

SEQ ID NO: 7909315 - DNA, 22 bp, Homo sapiens
ccagcagctgcaaagcctgggt

SEQ ID NO: 7909316 - DNA, 22 bp, Homo sapiens
ccagcagctgcaaagcctgggt

SEQ ID NO: 7909317 - DNA, 22 bp, Homo sapiens
ccagcagctgacaccagtccca

SEQ ID NO: 7909318 - DNA, 22 bp, Homo sapiens
ccagcagctgcaaagcctgggt

SEQ ID NO: 7909319 - DNA, 22 bp, Homo sapiens
ccagcagctgcaaagcctgggt

SEQ ID NO: 7909320 - DNA, 22 bp, Homo sapiens
ccagcagctgcaaagcctgggt

SEQ ID NO: 7909321 - DNA, 22 bp, Homo sapiens
ccagcagctgctatgtggtttt

SEQ ID NO: 7909322 - DNA, 22 bp, Homo sapiens
ccagcagctgcaaagcctgggt

SEQ ID NO: 7909323 - DNA, 22 bp, Homo sapiens
ccagcagctgctatgtggtttt

SEQ ID NO: 7909324 - DNA, 22 bp, Homo sapiens
ccagcagctgacaccagtccca

SEQ ID NO: 7909325 - DNA, 22 bp, Homo sapiens
ccagcagctgacaccagtccca

SEQ ID NO: 7909326 - DNA, 22 bp, Homo sapiens
ccagcagctgcaaagcctgggt

SEQ ID NO: 7909327 - DNA, 22 bp, Homo sapiens
ccagcagctgcaaagcctgggt

SEQ ID NO: 7909328 - DNA, 22 bp, Homo sapiens
ccagcagctgacaccagtccca

SEQ ID NO: 7909329 - DNA, 22 bp, Homo sapiens
ccagcagctgacaccagtccca

SEQ ID NO: 7909330 - DNA, 22 bp, Homo sapiens
ccagcagctgacaccagtccca

SEQ ID NO: 7909331 - DNA, 22 bp, Homo sapiens
ccagcagctgacaccagtccca

SEQ ID NO: 7909332 - DNA, 22 bp, Homo sapiens
ccagcagctccctcagggtccg

SEQ ID NO: 7909333 - DNA, 22 bp, Homo sapiens
ccagcagctccctcagggtccg

SEQ ID NO: 7909334 - DNA, 22 bp, Homo sapiens
ccagcagctccctcagggtccg

SEQ ID NO: 7909335 - DNA, 22 bp, Homo sapiens
ccagcagctccctcagggtccg

SEQ ID NO: 7909336 - DNA, 22 bp, Homo sapiens
ccagcagctccctcagggtccg

SEQ ID NO: 7909337 - DNA, 22 bp, Homo sapiens
ccagcagctcagctactggtca

SEQ ID NO: 7909338 - DNA, 22 bp, Homo sapiens
ccagcagctcagctactggtca

SEQ ID NO: 7909339 - DNA, 22 bp, Homo sapiens
ccagcagctccctcagggtccg

SEQ ID NO: 7909340 - DNA, 22 bp, Homo sapiens
ccagcagctccctcagggtccg

SEQ ID NO: 7909341 - DNA, 22 bp, Homo sapiens
ccagcagctccctcagggtccg

SEQ ID NO: 7909342 - DNA, 22 bp, Homo sapiens
ccagcagctccctcagggtccg

SEQ ID NO: 7909343 - DNA, 21 bp, Homo sapiens
ccagcagctcaaggatctctt

SEQ ID NO: 7909344 - DNA, 21 bp, Homo sapiens
ccagcagctcaaggatctctt

SEQ ID NO: 7909345 - DNA, 22 bp, Homo sapiens
ccagcagctcagctactggtca

SEQ ID NO: 7909346 - DNA, 22 bp, Homo sapiens
ccagcagctcagctactggtca

SEQ ID NO: 7909347 - DNA, 22 bp, Homo sapiens
ccagcagctcagctactggtca

SEQ ID NO: 7909348 - DNA, 22 bp, Homo sapiens
ccagcagcgatagggtgagtgc

SEQ ID NO: 7909349 - DNA, 22 bp, Homo sapiens
ccagcagcgatagggtgagtgc

SEQ ID NO: 7909350 - DNA, 22 bp, Homo sapiens
ccagcagcgatagggtgagtgc

SEQ ID NO: 7909351 - DNA, 21 bp, Homo sapiens
ccagcagctcaaggatctctt

SEQ ID NO: 7909352 - DNA, 21 bp, Homo sapiens
ccagcagctcaaggatctctt

SEQ ID NO: 7909353 - DNA, 21 bp, Homo sapiens
ccagcagctcaaggatctctt

SEQ ID NO: 7909354 - DNA, 22 bp, Homo sapiens
ccagcactgctctcagactgag

SEQ ID NO: 7909355 - DNA, 22 bp, Homo sapiens
ccagcagaggggcggagtgcag

SEQ ID NO: 7909356 - DNA, 22 bp, Homo sapiens
ccagcagagggtcttggccatt

SEQ ID NO: 7909357 - DNA, 22 bp, Homo sapiens
ccagcactgctctcagactgag

SEQ ID NO: 7909358 - DNA, 22 bp, Homo sapiens
ccagcactgctctcagactgag

SEQ ID NO: 7909359 - DNA, 22 bp, Homo sapiens
ccagcagagggtcttggccatt

SEQ ID NO: 7909360 - DNA, 22 bp, Homo sapiens
ccagcagagtatcaatgtattt

SEQ ID NO: 7909361 - DNA, 22 bp, Homo sapiens
ccagcagagggtcttggccatt

SEQ ID NO: 7909362 - DNA, 22 bp, Homo sapiens
ccagcagagtctaggaaggagg

SEQ ID NO: 7909363 - DNA, 22 bp, Homo sapiens
ccagcagcagcgtccaaggaga

SEQ ID NO: 7909364 - DNA, 22 bp, Homo sapiens
ccagcagcagcgtccaaggaga

SEQ ID NO: 7909365 - DNA, 22 bp, Homo sapiens
ccagcagcagcgtccaaggaga

SEQ ID NO: 7909366 - DNA, 22 bp, Homo sapiens
ccagcagagttggtttctggta

SEQ ID NO: 7909367 - DNA, 22 bp, Homo sapiens
ccagcagagttggtttctggta

SEQ ID NO: 7909368 - DNA, 22 bp, Homo sapiens
ccagcagagtctaggaaggagg

SEQ ID NO: 7909369 - DNA, 22 bp, Homo sapiens
ccagcagagtctaggaaggagg

SEQ ID NO: 7909370 - DNA, 22 bp, Homo sapiens
ccagcagagtctaggaaggagg

SEQ ID NO: 7909371 - DNA, 22 bp, Homo sapiens
ccagcagagttggtttctggta

SEQ ID NO: 7909372 - DNA, 22 bp, Homo sapiens
ccagcagagtggggtttagagt

SEQ ID NO: 7909373 - DNA, 22 bp, Homo sapiens
ccagcagcaggccaggccctcc

SEQ ID NO: 7909374 - DNA, 22 bp, Homo sapiens
ccagcagcagcgtccaaggaga

SEQ ID NO: 7909375 - DNA, 22 bp, Homo sapiens
ccagcagcagcgtccaaggaga

SEQ ID NO: 7909376 - DNA, 22 bp, Homo sapiens
ccagcagcaggccaggccctcc

SEQ ID NO: 7909377 - DNA, 22 bp, Homo sapiens
ccagcagcagcgtccaaggaga

SEQ ID NO: 7909378 - DNA, 22 bp, Homo sapiens
ccagcagcccctcaatgatctg

SEQ ID NO: 7909379 - DNA, 22 bp, Homo sapiens
ccagcagcccacaggcgtccct

SEQ ID NO: 7909380 - DNA, 22 bp, Homo sapiens
ccagcagcccctcaatgatctg

SEQ ID NO: 7909381 - DNA, 22 bp, Homo sapiens
ccagcagcccctcaatgatctg

SEQ ID NO: 7909382 - DNA, 22 bp, Homo sapiens
ccagcagcccacaggcgtccct

SEQ ID NO: 7909383 - DNA, 22 bp, Homo sapiens
ccagcagcccacaggcgtccct

SEQ ID NO: 7909384 - DNA, 22 bp, Homo sapiens
ccagcagcccacaggcgtccct

SEQ ID NO: 7909385 - DNA, 22 bp, Homo sapiens
ccagcagcccacaggcgtccct

SEQ ID NO: 7909386 - DNA, 22 bp, Homo sapiens
ccagcagcccacaggcgtccct

SEQ ID NO: 7909387 - DNA, 22 bp, Homo sapiens
ccagcagcccacaggcgtccct

SEQ ID NO: 7909388 - DNA, 22 bp, Homo sapiens
ccagcagcccacaggcgtccct

SEQ ID NO: 7909389 - DNA, 22 bp, Homo sapiens
ccagcagccagagaaggacctc

SEQ ID NO: 7909390 - DNA, 22 bp, Homo sapiens
ccagcagcccacaggcgtccct

SEQ ID NO: 7909391 - DNA, 22 bp, Homo sapiens
ccagcagccctcttccaagact

SEQ ID NO: 7909392 - DNA, 22 bp, Homo sapiens
ccagcagcccctcaatgatctg

SEQ ID NO: 7909393 - DNA, 22 bp, Homo sapiens
ccagcagccctcttccaagact

SEQ ID NO: 7909394 - DNA, 22 bp, Homo sapiens
ccagcagccctcttccaagact

SEQ ID NO: 7909395 - DNA, 22 bp, Homo sapiens
ccagcagccctcttccaagact

SEQ ID NO: 7909396 - DNA, 22 bp, Homo sapiens
ccagcagccctcttccaagact

SEQ ID NO: 7909397 - DNA, 22 bp, Homo sapiens
ccagcagccctcttccaagact

SEQ ID NO: 7909398 - DNA, 22 bp, Homo sapiens
ccagcagcgatagggtgagtgc

SEQ ID NO: 7909399 - DNA, 22 bp, Homo sapiens
ccagcagcgatagggtgagtgc

SEQ ID NO: 7909400 - DNA, 22 bp, Homo sapiens
ccagcagccctcttccaagact

SEQ ID NO: 7909401 - DNA, 22 bp, Homo sapiens
ccagcagcgatagggtgagtgc

SEQ ID NO: 7909402 - DNA, 22 bp, Homo sapiens
ccagcagcatcctgcagcactt

SEQ ID NO: 7909403 - DNA, 22 bp, Homo sapiens
ccagcagccaccttctcgaaat

SEQ ID NO: 7909404 - DNA, 22 bp, Homo sapiens
ccagcagccaccttctcgaaat

SEQ ID NO: 7909405 - DNA, 22 bp, Homo sapiens
ccagcagccaccttctcgaaat

SEQ ID NO: 7909406 - DNA, 22 bp, Homo sapiens
ccagcagccagagaaggacctc

SEQ ID NO: 7909407 - DNA, 22 bp, Homo sapiens
ccagcagccagagaaggacctc

SEQ ID NO: 7909408 - DNA, 22 bp, Homo sapiens
ccagcagccagagaaggacctc

SEQ ID NO: 7909409 - DNA, 22 bp, Homo sapiens
ccagcagccagagaaggacctc

SEQ ID NO: 7909410 - DNA, 22 bp, Homo sapiens
ccagcagccagagaaggacctc

SEQ ID NO: 7909411 - DNA, 22 bp, Homo sapiens
ccagcagccagagaaggacctc

SEQ ID NO: 7909412 - DNA, 22 bp, Homo sapiens
ccagcagcatcctgcagcactt

SEQ ID NO: 7909413 - DNA, 22 bp, Homo sapiens
ccagcagcatcctgcagcactt

SEQ ID NO: 7909414 - DNA, 22 bp, Homo sapiens
ccagcagcatcctgcagcactt

SEQ ID NO: 7909415 - DNA, 22 bp, Homo sapiens
ccagcagcatcctgcagcactt

SEQ ID NO: 7909416 - DNA, 22 bp, Homo sapiens
ccagcagcaggccaggccctcc

SEQ ID NO: 7909417 - DNA, 22 bp, Homo sapiens
ccagcagcaggccaggccctcc

SEQ ID NO: 7909418 - DNA, 22 bp, Homo sapiens
ccagcagcaggccaggccctcc

SEQ ID NO: 7909419 - DNA, 22 bp, Homo sapiens
ccagcagcaggccaggccctcc

SEQ ID NO: 7909420 - DNA, 22 bp, Homo sapiens
ccagcagcaggccaggccctcc

SEQ ID NO: 7909421 - DNA, 22 bp, Homo sapiens
ccagcagcatcctgcagcactt

SEQ ID NO: 7909422 - DNA, 22 bp, Homo sapiens
ccagcagcaggccaggccctcc

SEQ ID NO: 7909423 - DNA, 22 bp, Homo sapiens
ccagccctgtcaccaactggag

SEQ ID NO: 7909424 - DNA, 22 bp, Homo sapiens
ccagccctgtcaccaactggag

SEQ ID NO: 7909425 - DNA, 19 bp, Homo sapiens
ccagccctgtcacttcttg

SEQ ID NO: 7909426 - DNA, 22 bp, Homo sapiens
ccagccctgtcaccaactggag

SEQ ID NO: 7909427 - DNA, 22 bp, Homo sapiens
ccagccctgcctctcagggccc

SEQ ID NO: 7909428 - DNA, 22 bp, Homo sapiens
ccagccctgtaaggatgaggca

SEQ ID NO: 7909429 - DNA, 22 bp, Homo sapiens
ccagccctgtaaggatgaggca

SEQ ID NO: 7909430 - DNA, 22 bp, Homo sapiens
ccagccctgtcaccaactggag

SEQ ID NO: 7909431 - DNA, 22 bp, Homo sapiens
ccagccctgtcaccaactggag

SEQ ID NO: 7909432 - DNA, 22 bp, Homo sapiens
ccagccctgtcaccaactggag

SEQ ID NO: 7909433 - DNA, 22 bp, Homo sapiens
ccagccctgtaaggatgaggca

SEQ ID NO: 7909434 - DNA, 22 bp, Homo sapiens
ccagccctgtttatgtgtcact

SEQ ID NO: 7909435 - DNA, 22 bp, Homo sapiens
ccagccctgtttatgtgtcact

SEQ ID NO: 7909436 - DNA, 22 bp, Homo sapiens
ccagcccttagataaacctggc

SEQ ID NO: 7909437 - DNA, 22 bp, Homo sapiens
ccagcccttcccaactggccag

SEQ ID NO: 7909438 - DNA, 22 bp, Homo sapiens
ccagccctgtttatgtgtcact

SEQ ID NO: 7909439 - DNA, 19 bp, Homo sapiens
ccagccctgtcacttcttg

SEQ ID NO: 7909440 - DNA, 22 bp, Homo sapiens
ccagccacagcttccagctcct

SEQ ID NO: 7909441 - DNA, 22 bp, Homo sapiens
ccagccacagcttccagctcct

SEQ ID NO: 7909442 - DNA, 22 bp, Homo sapiens
ccagcatttgcttaatttggag

SEQ ID NO: 7909443 - DNA, 22 bp, Homo sapiens
ccagcatttgcttctggtgggg

SEQ ID NO: 7909444 - DNA, 22 bp, Homo sapiens
ccagccacagcttccagctcct

SEQ ID NO: 7909445 - DNA, 20 bp, Homo sapiens
ccagcatgtacacatgtgga

SEQ ID NO: 7909446 - DNA, 22 bp, Homo sapiens
ccagcatgctcagtctaaattg

SEQ ID NO: 7909447 - DNA, 22 bp, Homo sapiens
ccagccacagcttccagctcct

SEQ ID NO: 7909448 - DNA, 22 bp, Homo sapiens
ccagccaccgcttgtttgcact

SEQ ID NO: 7909449 - DNA, 22 bp, Homo sapiens
ccagccacgaagctcccttcat

SEQ ID NO: 7909450 - DNA, 22 bp, Homo sapiens
ccagccctcactgaggcctctc

SEQ ID NO: 7909451 - DNA, 22 bp, Homo sapiens
ccagccctcactgaggcctctc

SEQ ID NO: 7909452 - DNA, 22 bp, Homo sapiens
ccagccctgcctctcagggccc

SEQ ID NO: 7909453 - DNA, 22 bp, Homo sapiens
ccagccctgcctctcagggccc

SEQ ID NO: 7909454 - DNA, 22 bp, Homo sapiens
ccagccctgcctctcagggccc

SEQ ID NO: 7909455 - DNA, 22 bp, Homo sapiens
ccagccctgcctctcagggccc

SEQ ID NO: 7909456 - DNA, 22 bp, Homo sapiens
tctgcagaaggaatcagctgag

SEQ ID NO: 7909457 - DNA, 19 bp, Homo sapiens
tctgcagaaggcatacatg

SEQ ID NO: 7909458 - DNA, 22 bp, Homo sapiens
tctgcagaaggaatcagctgag

SEQ ID NO: 7909459 - DNA, 22 bp, Homo sapiens
tctgatattggggtcagagtag

SEQ ID NO: 7909460 - DNA, 22 bp, Homo sapiens
tctgcagaaggaatcagctgag

SEQ ID NO: 7909461 - DNA, 22 bp, Homo sapiens
tctgcagaagctcactaaatcc

SEQ ID NO: 7909462 - DNA, 22 bp, Homo sapiens
tctgcagaattcgaggaagaaa

SEQ ID NO: 7909463 - DNA, 22 bp, Homo sapiens
tctgcagaattcgaggaagaaa

SEQ ID NO: 7909464 - DNA, 22 bp, Homo sapiens
tctgcagaagtggctgggccac

SEQ ID NO: 7909465 - DNA, 19 bp, Homo sapiens
tctgcagaaggcatacatg

SEQ ID NO: 7909466 - DNA, 22 bp, Homo sapiens
tctgagagtctctgaggcagat

SEQ ID NO: 7909467 - DNA, 22 bp, Homo sapiens
tctgagagtctctgaggcagat

SEQ ID NO: 7909468 - DNA, 22 bp, Homo sapiens
tctgagagtctctgaggcagat

SEQ ID NO: 7909469 - DNA, 22 bp, Homo sapiens
tctgagagtccatctccaagcc

SEQ ID NO: 7909470 - DNA, 22 bp, Homo sapiens
tctgagagtagagctgcctctt

SEQ ID NO: 7909471 - DNA, 22 bp, Homo sapiens
tctgagagtacgggctgcgcgc

SEQ ID NO: 7909472 - DNA, 22 bp, Homo sapiens
tctgagagtacgggctgcgcgc

SEQ ID NO: 7909473 - DNA, 22 bp, Homo sapiens
tctgagagtacgggctgcgcgc

SEQ ID NO: 7909474 - DNA, 22 bp, Homo sapiens
tctgatatgaatgtctagctct

SEQ ID NO: 7909475 - DNA, 22 bp, Homo sapiens
tctgatatcgcactaaactctg

SEQ ID NO: 7909476 - DNA, 22 bp, Homo sapiens
tctgagagtctctgaggcagat

SEQ ID NO: 7909477 - DNA, 22 bp, Homo sapiens
tctgatataaaagtgacattca

SEQ ID NO: 7909478 - DNA, 22 bp, Homo sapiens
ccagcccttcccaactggccag

SEQ ID NO: 7909479 - DNA, 22 bp, Homo sapiens
tctgagagatacaaggaggcaa

SEQ ID NO: 7909480 - DNA, 21 bp, Homo sapiens
tctgagagcaactgcccttta

SEQ ID NO: 7909481 - DNA, 22 bp, Homo sapiens
tctgagagcaaggcattagcag

SEQ ID NO: 7909482 - DNA, 22 bp, Homo sapiens
tctgagagcaaggcattagcag

SEQ ID NO: 7909483 - DNA, 22 bp, Homo sapiens
tctgagagcaggaggagctgct

SEQ ID NO: 7909484 - DNA, 22 bp, Homo sapiens
tctgagagcaggaggagctgct

SEQ ID NO: 7909485 - DNA, 22 bp, Homo sapiens
tctgagagcaaggcattagcag

SEQ ID NO: 7909486 - DNA, 22 bp, Homo sapiens
tctgagagcatcactggggtac

SEQ ID NO: 7909487 - DNA, 22 bp, Homo sapiens
tctgagagccactgaacagcaa

SEQ ID NO: 7909488 - DNA, 22 bp, Homo sapiens
tctgagagcatcactggggtac

SEQ ID NO: 7909489 - DNA, 22 bp, Homo sapiens
tctgagagccactgaacagcaa

SEQ ID NO: 7909490 - DNA, 22 bp, Homo sapiens
tctgagaggtgaattcagcaaa

SEQ ID NO: 7909491 - DNA, 22 bp, Homo sapiens
tctgagaggtgaattcagcaaa

SEQ ID NO: 7909492 - DNA, 22 bp, Homo sapiens
tctgagaggtgaattcagcaaa

SEQ ID NO: 7909493 - DNA, 22 bp, Homo sapiens
tctgagaggtgaattcagcaaa

SEQ ID NO: 7909494 - DNA, 22 bp, Homo sapiens
tctgagaggtgaattcagcaaa

SEQ ID NO: 7909495 - DNA, 22 bp, Homo sapiens
tctgagaggttaagcaatttga

SEQ ID NO: 7909496 - DNA, 22 bp, Homo sapiens
tctgagaggcagaccttcctaa

SEQ ID NO: 7909497 - DNA, 22 bp, Homo sapiens
tctgagaggcagaccttcctaa

SEQ ID NO: 7909498 - DNA, 22 bp, Homo sapiens
tctgagaggcatctgcacttct

SEQ ID NO: 7909499 - DNA, 22 bp, Homo sapiens
tctgagaggcatctgcacttct

SEQ ID NO: 7909500 - DNA, 22 bp, Homo sapiens
tctgagaggattcctgtcccga

SEQ ID NO: 7909501 - DNA, 22 bp, Homo sapiens
tctgagagctgtagaagcctat

SEQ ID NO: 7909502 - DNA, 22 bp, Homo sapiens
tctgagagctgccatctcattt

SEQ ID NO: 7909503 - DNA, 22 bp, Homo sapiens
tctgagagctgtagaagcctat

SEQ ID NO: 7909504 - DNA, 22 bp, Homo sapiens
tctgagagctgtagaagcctat

SEQ ID NO: 7909505 - DNA, 22 bp, Homo sapiens
tctgagagcctctagcctaagt

SEQ ID NO: 7909506 - DNA, 22 bp, Homo sapiens
tctgagagcctctagcctaagt

SEQ ID NO: 7909507 - DNA, 22 bp, Homo sapiens
tctgagagctctggggcccctt

SEQ ID NO: 7909508 - DNA, 22 bp, Homo sapiens
tctgagagctgccatctcattt

SEQ ID NO: 7909509 - DNA, 22 bp, Homo sapiens
tctgagagctgccatctcattt

SEQ ID NO: 7909510 - DNA, 22 bp, Homo sapiens
tctgaaatgaactcttgaactt

SEQ ID NO: 7909511 - DNA, 22 bp, Homo sapiens
tctgaaatgacctttccccact

SEQ ID NO: 7909512 - DNA, 22 bp, Homo sapiens
tctgaaatgacctttccccact

SEQ ID NO: 7909513 - DNA, 22 bp, Homo sapiens
tctgaaatgaactcttgaactt

SEQ ID NO: 7909514 - DNA, 22 bp, Homo sapiens
tctcttaaatacttcacatctc

SEQ ID NO: 7909515 - DNA, 22 bp, Homo sapiens
tctcttaaaggtcttcagctga

SEQ ID NO: 7909516 - DNA, 22 bp, Homo sapiens
tctcttaactggttcagcaatt

SEQ ID NO: 7909517 - DNA, 22 bp, Homo sapiens
tctcttaactggttcagcaatt

SEQ ID NO: 7909518 - DNA, 22 bp, Homo sapiens
tctcttaactccaccagtgcag

SEQ ID NO: 7909519 - DNA, 22 bp, Homo sapiens
tctctgttcatggcactatgtc

SEQ ID NO: 7909520 - DNA, 22 bp, Homo sapiens
tctctgttcatggcactatgtc

SEQ ID NO: 7909521 - DNA, 22 bp, Homo sapiens
tctcttaaaagagtaatagaga

SEQ ID NO: 7909522 - DNA, 22 bp, Homo sapiens
tctcttaaaagagtaatagaga

SEQ ID NO: 7909523 - DNA, 22 bp, Homo sapiens
tctctgttcatggcactatgtc

SEQ ID NO: 7909524 - DNA, 22 bp, Homo sapiens
tctctgttcatggcactatgtc

SEQ ID NO: 7909525 - DNA, 22 bp, Homo sapiens
tctctgtgtgttggctgtatat

SEQ ID NO: 7909526 - DNA, 22 bp, Homo sapiens
tctctgtgtgttggctgtatat

SEQ ID NO: 7909527 - DNA, 22 bp, Homo sapiens
tctctgtgttccctgttttctc

SEQ ID NO: 7909528 - DNA, 22 bp, Homo sapiens
tctctgtgttccctgttttctc

SEQ ID NO: 7909529 - DNA, 22 bp, Homo sapiens
tctctgtgtgtgtgacagcatt

SEQ ID NO: 7909530 - DNA, 22 bp, Homo sapiens
tctctgtgtgtgtgacagcatt

SEQ ID NO: 7909531 - DNA, 22 bp, Homo sapiens
tctctgtgtgttggctgtatat

SEQ ID NO: 7909532 - DNA, 22 bp, Homo sapiens
tctctgtgtgttggctgtatat

SEQ ID NO: 7909533 - DNA, 22 bp, Homo sapiens
ccagcagggttggtttcttctg

SEQ ID NO: 7909534 - DNA, 22 bp, Homo sapiens
ccagcaggggaatatttttagg

SEQ ID NO: 7909535 - DNA, 22 bp, Homo sapiens
ccagcagggttggtttcttctg

SEQ ID NO: 7909536 - DNA, 22 bp, Homo sapiens
ccagcaggtgtagggctcatgg

SEQ ID NO: 7909537 - DNA, 22 bp, Homo sapiens
ccagcagggttggtttcttctg

SEQ ID NO: 7909538 - DNA, 22 bp, Homo sapiens
ccagcaggtgtagggctcatgg

SEQ ID NO: 7909539 - DNA, 22 bp, Homo sapiens
ccagcaggtgtagggctcatgg

SEQ ID NO: 7909540 - DNA, 22 bp, Homo sapiens
ccagcaggtgtagggctcatgg

SEQ ID NO: 7909541 - DNA, 19 bp, Homo sapiens
ccagcaggttcatttcagg

SEQ ID NO: 7909542 - DNA, 22 bp, Homo sapiens
ccagcaggtgtagggctcatgg

SEQ ID NO: 7909543 - DNA, 22 bp, Homo sapiens
ccagcaggtgtagggctcatgg

SEQ ID NO: 7909544 - DNA, 22 bp, Homo sapiens
ccagcaggtgtagggctcatgg

SEQ ID NO: 7909545 - DNA, 22 bp, Homo sapiens
ccagcatcagcacccaaggagc

SEQ ID NO: 7909546 - DNA, 22 bp, Homo sapiens
ccagcatcagcacccaaggagc

SEQ ID NO: 7909547 - DNA, 22 bp, Homo sapiens
ccagcatcagcattgtcttagg

SEQ ID NO: 7909548 - DNA, 22 bp, Homo sapiens
ccagcatcagcacccaaggagc

SEQ ID NO: 7909549 - DNA, 19 bp, Homo sapiens
ccagcaggttcatttcagg

SEQ ID NO: 7909550 - DNA, 19 bp, Homo sapiens
ccagcaggttcatttcagg

SEQ ID NO: 7909551 - DNA, 19 bp, Homo sapiens
ccagcaggttcatttcagg

SEQ ID NO: 7909552 - DNA, 22 bp, Homo sapiens
tctctgtgtgccttcatctgcc

SEQ ID NO: 7909553 - DNA, 23 bp, Homo sapiens
tctctgtgtgcctcagtttcttc

SEQ ID NO: 7909554 - DNA, 22 bp, Homo sapiens
tctctgtgtgccttcatctgcc

SEQ ID NO: 7909555 - DNA, 22 bp, Homo sapiens
tctctgtgtgccttcatctgcc

SEQ ID NO: 7909556 - DNA, 22 bp, Homo sapiens
tctctgtgtgccttcatctgcc

SEQ ID NO: 7909557 - DNA, 22 bp, Homo sapiens
tctctgtgtgggagatcttttt

SEQ ID NO: 7909558 - DNA, 22 bp, Homo sapiens
ccagcatctatgtgctgttgat

SEQ ID NO: 7909559 - DNA, 22 bp, Homo sapiens
ccagcatctgtcctttccctca

SEQ ID NO: 7909560 - DNA, 18 bp, Homo sapiens
ccagcatgccagaggctg

SEQ ID NO: 7909561 - DNA, 22 bp, Homo sapiens
ccagcatctaacgctcctggga

SEQ ID NO: 7909562 - DNA, 22 bp, Homo sapiens
ccagcatctaacgctcctggga

SEQ ID NO: 7909563 - DNA, 22 bp, Homo sapiens
ccagcatctaacgctcctggga

SEQ ID NO: 7909564 - DNA, 22 bp, Homo sapiens
ccagcatctaacgctcctggga

SEQ ID NO: 7909565 - DNA, 22 bp, Homo sapiens
ccagcatcgacttcctgcctga

SEQ ID NO: 7909566 - DNA, 22 bp, Homo sapiens
ccagcatcgacttcctgcctga

SEQ ID NO: 7909567 - DNA, 22 bp, Homo sapiens
ccagcatcctcagctcacttct

SEQ ID NO: 7909568 - DNA, 22 bp, Homo sapiens
ccagcatcgacttcctgcctga

SEQ ID NO: 7909569 - DNA, 22 bp, Homo sapiens
ccagcatccatgctccctcggg

SEQ ID NO: 7909570 - DNA, 22 bp, Homo sapiens
ccagcatccctggggttggcca

SEQ ID NO: 7909571 - DNA, 22 bp, Homo sapiens
ccagcatccatgctccctcggg

SEQ ID NO: 7909572 - DNA, 22 bp, Homo sapiens
ccagcatccctggggttggcca

SEQ ID NO: 7909573 - DNA, 22 bp, Homo sapiens
ccagcatccatgctccctcggg

SEQ ID NO: 7909574 - DNA, 22 bp, Homo sapiens
ccagcatcctcagctcacttct

SEQ ID NO: 7909575 - DNA, 22 bp, Homo sapiens
ccagcatccatgctccctcggg

SEQ ID NO: 7909576 - DNA, 22 bp, Homo sapiens
ccagcatccatgctccctcggg

SEQ ID NO: 7909577 - DNA, 22 bp, Homo sapiens
ccagcatcagtcagattttgct

SEQ ID NO: 7909578 - DNA, 22 bp, Homo sapiens
tctgaatttcccaaggctatct

SEQ ID NO: 7909579 - DNA, 22 bp, Homo sapiens
tctgaatttcccaaggctatct

SEQ ID NO: 7909580 - DNA, 22 bp, Homo sapiens
tctgaatttatggcaaaacctg

SEQ ID NO: 7909581 - DNA, 22 bp, Homo sapiens
tctgaattctgacaatttgaat

SEQ ID NO: 7909582 - DNA, 22 bp, Homo sapiens
tctgaattcttagaattaaagg

SEQ ID NO: 7909583 - DNA, 22 bp, Homo sapiens
tctgaattctgacaatttgaat

SEQ ID NO: 7909584 - DNA, 20 bp, Homo sapiens
tctgaattgagtgaatgtct

SEQ ID NO: 7909585 - DNA, 22 bp, Homo sapiens
tctgaattggctgcgtgtttaa

SEQ ID NO: 7909586 - DNA, 22 bp, Homo sapiens
tctgaattgtgcaaagagccac

SEQ ID NO: 7909587 - DNA, 17 bp, Homo sapiens
tctgaatttatactttg

SEQ ID NO: 7909588 - DNA, 22 bp, Homo sapiens
tctgaatttagtgattagcttt

SEQ ID NO: 7909589 - DNA, 22 bp, Homo sapiens
tctgaattcagtatggtctttc

SEQ ID NO: 7909590 - DNA, 19 bp, Homo sapiens
tctgaattatttatgtacc

SEQ ID NO: 7909591 - DNA, 19 bp, Homo sapiens
tctgaattatttatgtacc

SEQ ID NO: 7909592 - DNA, 22 bp, Homo sapiens
tctgaattaatcatgcctcttt

SEQ ID NO: 7909593 - DNA, 22 bp, Homo sapiens
tctgaattagaggatacgtctt

SEQ ID NO: 7909594 - DNA, 22 bp, Homo sapiens
tctgaattaggggttttcaggt

SEQ ID NO: 7909595 - DNA, 23 bp, Homo sapiens
tctgaattatctcattttcagag

SEQ ID NO: 7909596 - DNA, 19 bp, Homo sapiens
tctgaattatttatgtacc

SEQ ID NO: 7909597 - DNA, 22 bp, Homo sapiens
tctgaatgtatcgaattgaggc

SEQ ID NO: 7909598 - DNA, 22 bp, Homo sapiens
tctgaatgttaggaaactttct

SEQ ID NO: 7909599 - DNA, 22 bp, Homo sapiens
tctgaattaaaccctttgtgcc

SEQ ID NO: 7909600 - DNA, 22 bp, Homo sapiens
tctgaattaactggggttgcca

SEQ ID NO: 7909601 - DNA, 22 bp, Homo sapiens
tctgaatcgttcccatgcagga

SEQ ID NO: 7909602 - DNA, 22 bp, Homo sapiens
tctgaatcgttcccatgcagga

SEQ ID NO: 7909603 - DNA, 22 bp, Homo sapiens
tctgaatcacagtcattcagct

SEQ ID NO: 7909604 - DNA, 22 bp, Homo sapiens
tctgaatcacagtcattcagct

SEQ ID NO: 7909605 - DNA, 18 bp, Homo sapiens
tctgaatattatgcagtg

SEQ ID NO: 7909606 - DNA, 22 bp, Homo sapiens
tctgaaggtttgattggagcta

SEQ ID NO: 7909607 - DNA, 19 bp, Homo sapiens
tctgaagtccagggcatac

SEQ ID NO: 7909608 - DNA, 19 bp, Homo sapiens
tctgaagtccagggcatac

SEQ ID NO: 7909609 - DNA, 22 bp, Homo sapiens
tctgaagttcttaaattagttt

SEQ ID NO: 7909610 - DNA, 22 bp, Homo sapiens
tctgaataatgtccttgtatca

SEQ ID NO: 7909611 - DNA, 22 bp, Homo sapiens
tctgaatatgtttatcatctct

SEQ ID NO: 7909612 - DNA, 22 bp, Homo sapiens
tctgaatagagagaggtccttt

SEQ ID NO: 7909613 - DNA, 22 bp, Homo sapiens
tctgaatagtatattgaaagca

SEQ ID NO: 7909614 - DNA, 22 bp, Homo sapiens
tctgaatagtatattgaaagca

SEQ ID NO: 7909615 - DNA, 22 bp, Homo sapiens
tctgaatagttctattttaaag

SEQ ID NO: 7909616 - DNA, 22 bp, Homo sapiens
tctccgatcacaggttttcaat

SEQ ID NO: 7909617 - DNA, 22 bp, Homo sapiens
tctccgtgccgtgggaggctcc

SEQ ID NO: 7909618 - DNA, 22 bp, Homo sapiens
tctcctggccctgtcgccatct

SEQ ID NO: 7909619 - DNA, 22 bp, Homo sapiens
tctcctggccgggctgtcccct

SEQ ID NO: 7909620 - DNA, 22 bp, Homo sapiens
tctccctggagccctgaagcat

SEQ ID NO: 7909621 - DNA, 22 bp, Homo sapiens
tctcccttggtcacagattcct

SEQ ID NO: 7909622 - DNA, 22 bp, Homo sapiens
tctcccttggtcacagattcct

SEQ ID NO: 7909623 - DNA, 22 bp, Homo sapiens
tctccctctttgtctgctttgg

SEQ ID NO: 7909624 - DNA, 22 bp, Homo sapiens
tctccctctttgtctgctttgg

SEQ ID NO: 7909625 - DNA, 22 bp, Homo sapiens
tctccctctttgtctgctttgg

SEQ ID NO: 7909626 - DNA, 23 bp, Homo sapiens
tctccctgaggttgttagcatta

SEQ ID NO: 7909627 - DNA, 23 bp, Homo sapiens
tctccctgaggttgttagcatta

SEQ ID NO: 7909628 - DNA, 20 bp, Homo sapiens
tctccctgcccatctcagat

SEQ ID NO: 7909629 - DNA, 20 bp, Homo sapiens
tctccctgcccatctcagat

SEQ ID NO: 7909630 - DNA, 20 bp, Homo sapiens
tctccctgcccatctcagat

SEQ ID NO: 7909631 - DNA, 20 bp, Homo sapiens
tctccctgcccatctcagat

SEQ ID NO: 7909632 - DNA, 20 bp, Homo sapiens
tctccctgcccatctcagat

SEQ ID NO: 7909633 - DNA, 20 bp, Homo sapiens
tctccctgcccatctcagat

SEQ ID NO: 7909634 - DNA, 20 bp, Homo sapiens
tctccctgcccatctcagat

SEQ ID NO: 7909635 - DNA, 22 bp, Homo sapiens
tctcccacagtctcccatggct

SEQ ID NO: 7909636 - DNA, 22 bp, Homo sapiens
tctcccacagtctcccatggct

SEQ ID NO: 7909637 - DNA, 22 bp, Homo sapiens
ccagagaggccttggcaagaca

SEQ ID NO: 7909638 - DNA, 22 bp, Homo sapiens
ccagagaggccttggcaagaca

SEQ ID NO: 7909639 - DNA, 22 bp, Homo sapiens
ccagagaggccaaggtcgtggt

SEQ ID NO: 7909640 - DNA, 22 bp, Homo sapiens
ccagagaggccttggcaagaca

SEQ ID NO: 7909641 - DNA, 22 bp, Homo sapiens
ccagagaggccttggcaagaca

SEQ ID NO: 7909642 - DNA, 22 bp, Homo sapiens
ccagagaggccaaggtcgtggt

SEQ ID NO: 7909643 - DNA, 22 bp, Homo sapiens
ccagagaggccaaggtcgtggt

SEQ ID NO: 7909644 - DNA, 22 bp, Homo sapiens
ccagagaggccaaggtcgtggt

SEQ ID NO: 7909645 - DNA, 22 bp, Homo sapiens
ccagagaggcaaaactccttcc

SEQ ID NO: 7909646 - DNA, 22 bp, Homo sapiens
ccagagaggcaaaactccttcc

SEQ ID NO: 7909647 - DNA, 22 bp, Homo sapiens
ccagagaggcaaaactccttcc

SEQ ID NO: 7909648 - DNA, 22 bp, Homo sapiens
tctccctcattcctgcttccat

SEQ ID NO: 7909649 - DNA, 22 bp, Homo sapiens
tctccctctcagatttattcac

SEQ ID NO: 7909650 - DNA, 22 bp, Homo sapiens
tctccctctcagatttattcac

SEQ ID NO: 7909651 - DNA, 22 bp, Homo sapiens
tctccctctgtaagatcagggg

SEQ ID NO: 7909652 - DNA, 22 bp, Homo sapiens
tctccctctcagatttattcac

SEQ ID NO: 7909653 - DNA, 22 bp, Homo sapiens
ccagagagctacaaggcataaa

SEQ ID NO: 7909654 - DNA, 22 bp, Homo sapiens
ccagagagctacaaggcataaa

SEQ ID NO: 7909655 - DNA, 22 bp, Homo sapiens
ccagagagctacaaggcataaa

SEQ ID NO: 7909656 - DNA, 19 bp, Homo sapiens
ccagagagctaggtacaga

SEQ ID NO: 7909657 - DNA, 22 bp, Homo sapiens
ccagagagctacaaggcataaa

SEQ ID NO: 7909658 - DNA, 22 bp, Homo sapiens
ccagagagctacaaggcataaa

SEQ ID NO: 7909659 - DNA, 19 bp, Homo sapiens
ccagagagctaggtacaga

SEQ ID NO: 7909660 - DNA, 22 bp, Homo sapiens
ccagagaggcaaaactccttcc

SEQ ID NO: 7909661 - DNA, 19 bp, Homo sapiens
ccagagagctaggtacaga

SEQ ID NO: 7909662 - DNA, 19 bp, Homo sapiens
ccagagagctaggtacaga

SEQ ID NO: 7909663 - DNA, 19 bp, Homo sapiens
ccagagagctaggtacaga

SEQ ID NO: 7909664 - DNA, 21 bp, Homo sapiens
ccagagagagggaagtgggtt

SEQ ID NO: 7909665 - DNA, 21 bp, Homo sapiens
ccagagagagggaagtgggtt

SEQ ID NO: 7909666 - DNA, 21 bp, Homo sapiens
ccagagagagggaagtgggtt

SEQ ID NO: 7909667 - DNA, 21 bp, Homo sapiens
ccagagagagggaagtgggtt

SEQ ID NO: 7909668 - DNA, 22 bp, Homo sapiens
ccagagagagtactgggctctg

SEQ ID NO: 7909669 - DNA, 22 bp, Homo sapiens
ccagagagagtactgggctctg

SEQ ID NO: 7909670 - DNA, 22 bp, Homo sapiens
ccagagagagtactgggctctg

SEQ ID NO: 7909671 - DNA, 21 bp, Homo sapiens
ccagagagagggaagtgggtt

SEQ ID NO: 7909672 - DNA, 22 bp, Homo sapiens
ccagagagctacaaggcataaa

SEQ ID NO: 7909673 - DNA, 22 bp, Homo sapiens
ccagagagattgcttctaaaga

SEQ ID NO: 7909674 - DNA, 22 bp, Homo sapiens
ccagagagagtactgggctctg

SEQ ID NO: 7909675 - DNA, 22 bp, Homo sapiens
ccagagagagtactgggctctg

SEQ ID NO: 7909676 - DNA, 22 bp, Homo sapiens
ccagagagagtactgggctctg

SEQ ID NO: 7909677 - DNA, 22 bp, Homo sapiens
tctccagaggtcccttgtctct

SEQ ID NO: 7909678 - DNA, 22 bp, Homo sapiens
tctccagaggtcccttgtctct

SEQ ID NO: 7909679 - DNA, 21 bp, Homo sapiens
tctccagagtgggaggaaatc

SEQ ID NO: 7909680 - DNA, 21 bp, Homo sapiens
tctccagagtgggaggaaatc

SEQ ID NO: 7909681 - DNA, 21 bp, Homo sapiens
tctccagagtgggaggaaatc

SEQ ID NO: 7909682 - DNA, 20 bp, Homo sapiens
tctccagatgcagatgacat

SEQ ID NO: 7909683 - DNA, 20 bp, Homo sapiens
tctccagatgcagatgacat

SEQ ID NO: 7909684 - DNA, 20 bp, Homo sapiens
tctccagatgcagatgacat

SEQ ID NO: 7909685 - DNA, 18 bp, Homo sapiens
tctccacttctgtgagaa

SEQ ID NO: 7909686 - DNA, 22 bp, Homo sapiens
tctccagaaatggggctgggga

SEQ ID NO: 7909687 - DNA, 22 bp, Homo sapiens
tctccagaaatggggctgggga

SEQ ID NO: 7909688 - DNA, 22 bp, Homo sapiens
tctccactattttctagctctt

SEQ ID NO: 7909689 - DNA, 22 bp, Homo sapiens
tctccactctgagtgcctttca

SEQ ID NO: 7909690 - DNA, 20 bp, Homo sapiens
tctccagatgcagatgacat

SEQ ID NO: 7909691 - DNA, 22 bp, Homo sapiens
tctccaggaaagacactggact

SEQ ID NO: 7909692 - DNA, 22 bp, Homo sapiens
tctccaggaaccatcatggtaa

SEQ ID NO: 7909693 - DNA, 22 bp, Homo sapiens
tctccaggaaccatcatggtaa

SEQ ID NO: 7909694 - DNA, 22 bp, Homo sapiens
tctccaggaaccatcatggtaa

SEQ ID NO: 7909695 - DNA, 22 bp, Homo sapiens
tctccaggaagccctccctgac

SEQ ID NO: 7909696 - DNA, 21 bp, Homo sapiens
ccagagagagggaagtgggtt

SEQ ID NO: 7909697 - DNA, 22 bp, Homo sapiens
ccagagagagaggtcaatggca

SEQ ID NO: 7909698 - DNA, 22 bp, Homo sapiens
tctccaggaagccctccctgac

SEQ ID NO: 7909699 - DNA, 22 bp, Homo sapiens
tctccaggaagccctccctgac

SEQ ID NO: 7909700 - DNA, 20 bp, Homo sapiens
tctcagtttctagagtcagg

SEQ ID NO: 7909701 - DNA, 20 bp, Homo sapiens
tctcagtttctagagtcagg

SEQ ID NO: 7909702 - DNA, 22 bp, Homo sapiens
tctcagtttctcattataaaag

SEQ ID NO: 7909703 - DNA, 22 bp, Homo sapiens
tctcagtttcctcatatgtaaa

SEQ ID NO: 7909704 - DNA, 22 bp, Homo sapiens
tctccacaagtgttgagagtac

SEQ ID NO: 7909705 - DNA, 22 bp, Homo sapiens
tctccacaagtgttgagagtac

SEQ ID NO: 7909706 - DNA, 22 bp, Homo sapiens
tctccacaagtgttgagagtac

SEQ ID NO: 7909707 - DNA, 22 bp, Homo sapiens
tctccacaccagaaggagctga

SEQ ID NO: 7909708 - DNA, 22 bp, Homo sapiens
tctccacaagctttctcctttt

SEQ ID NO: 7909709 - DNA, 22 bp, Homo sapiens
tctccacaagctttctcctttt

SEQ ID NO: 7909710 - DNA, 22 bp, Homo sapiens
tctccacaagtgttgagagtac

SEQ ID NO: 7909711 - DNA, 22 bp, Homo sapiens
ccagaaaactctacatgcttgt

SEQ ID NO: 7909712 - DNA, 22 bp, Homo sapiens
ccagaaaactctacatgcttgt

SEQ ID NO: 7909713 - DNA, 22 bp, Homo sapiens
ccagaaaactctacatgcttgt

SEQ ID NO: 7909714 - DNA, 22 bp, Homo sapiens
tctcagtttcctcatatgtaaa

SEQ ID NO: 7909715 - DNA, 22 bp, Homo sapiens
ccacttttttctccatctctga

SEQ ID NO: 7909716 - DNA, 22 bp, Homo sapiens
ccagaaaaatcctcccttgtcc

SEQ ID NO: 7909717 - DNA, 22 bp, Homo sapiens
ccagaaaaatcctcccttgtcc

SEQ ID NO: 7909718 - DNA, 22 bp, Homo sapiens
ccagaaaaatcctcccttgtcc

SEQ ID NO: 7909719 - DNA, 22 bp, Homo sapiens
tctccacactttctctcccagg

SEQ ID NO: 7909720 - DNA, 22 bp, Homo sapiens
tctccacagaaggttccaggcc

SEQ ID NO: 7909721 - DNA, 22 bp, Homo sapiens
tctccacagaaggttccaggcc

SEQ ID NO: 7909722 - DNA, 22 bp, Homo sapiens
tctccacagtcccacctcgctt

SEQ ID NO: 7909723 - DNA, 22 bp, Homo sapiens
tctccacagtcccacctcgctt

SEQ ID NO: 7909724 - DNA, 22 bp, Homo sapiens
tctccacagtcccacctcgctt

SEQ ID NO: 7909725 - DNA, 22 bp, Homo sapiens
tctccactattttctagctctt

SEQ ID NO: 7909726 - DNA, 20 bp, Homo sapiens
tctccaccacagagagcaga

SEQ ID NO: 7909727 - DNA, 22 bp, Homo sapiens
tctccacagaaggttccaggcc

SEQ ID NO: 7909728 - DNA, 22 bp, Homo sapiens
tctccacattctattggctata

SEQ ID NO: 7909729 - DNA, 22 bp, Homo sapiens
tctccacaccagaaggagctga

SEQ ID NO: 7909730 - DNA, 22 bp, Homo sapiens
tctccacaccagaaggagctga

SEQ ID NO: 7909731 - DNA, 22 bp, Homo sapiens
tctccacactttctctcccagg

SEQ ID NO: 7909732 - DNA, 22 bp, Homo sapiens
tctccacactttctctcccagg

SEQ ID NO: 7909733 - DNA, 22 bp, Homo sapiens
tctccacactttctctcccagg

SEQ ID NO: 7909734 - DNA, 22 bp, Homo sapiens
tctccacactttctctcccagg

SEQ ID NO: 7909735 - DNA, 22 bp, Homo sapiens
tctccacactttctctcccagg

SEQ ID NO: 7909736 - DNA, 22 bp, Homo sapiens
ccactttgaaccactgaggtgg

SEQ ID NO: 7909737 - DNA, 22 bp, Homo sapiens
ccactttgaaccactgaggtgg

SEQ ID NO: 7909738 - DNA, 22 bp, Homo sapiens
ccactttgagaagctgatgaaa

SEQ ID NO: 7909739 - DNA, 22 bp, Homo sapiens
ccactttgaaccactgaggtgg

SEQ ID NO: 7909740 - DNA, 22 bp, Homo sapiens
ccactttgcaagatattcagag

SEQ ID NO: 7909741 - DNA, 18 bp, Homo sapiens
ccactttgcagcctggcc

SEQ ID NO: 7909742 - DNA, 19 bp, Homo sapiens
ccactttgcagatagtgag

SEQ ID NO: 7909743 - DNA, 22 bp, Homo sapiens
ccacttgaaatatctttgttct

SEQ ID NO: 7909744 - DNA, 22 bp, Homo sapiens
ccacttgaatcaaattcttagg

SEQ ID NO: 7909745 - DNA, 22 bp, Homo sapiens
ccacttgacaataaactgagct

SEQ ID NO: 7909746 - DNA, 22 bp, Homo sapiens
ccacttgcaaaagagaaagtta

SEQ ID NO: 7909747 - DNA, 22 bp, Homo sapiens
ccactttctgagggaacagcag

SEQ ID NO: 7909748 - DNA, 19 bp, Homo sapiens
ccactttgcttctctgggt

SEQ ID NO: 7909749 - DNA, 19 bp, Homo sapiens
ccactttgcttctctgggt

SEQ ID NO: 7909750 - DNA, 22 bp, Homo sapiens
ccactttgtaatgtgttatgtt

SEQ ID NO: 7909751 - DNA, 22 bp, Homo sapiens
ccactttggcaccttctgccta

SEQ ID NO: 7909752 - DNA, 22 bp, Homo sapiens
ccacttttcactaagatgaatt

SEQ ID NO: 7909753 - DNA, 22 bp, Homo sapiens
ccacttttcactaagatgaatt

SEQ ID NO: 7909754 - DNA, 22 bp, Homo sapiens
ccacttttcactaagatgaatt

SEQ ID NO: 7909755 - DNA, 22 bp, Homo sapiens
ccacttttctacccactgtgac

SEQ ID NO: 7909756 - DNA, 22 bp, Homo sapiens
ccacttttctacccactgtgac

SEQ ID NO: 7909757 - DNA, 22 bp, Homo sapiens
ccacttttctacccactgtgac

SEQ ID NO: 7909758 - DNA, 22 bp, Homo sapiens
ccactttttcagtgtgcatgca

SEQ ID NO: 7909759 - DNA, 22 bp, Homo sapiens
ccacttttttctccatctctga

SEQ ID NO: 7909760 - DNA, 22 bp, Homo sapiens
ccacttttttctccatctctga

SEQ ID NO: 7909761 - DNA, 22 bp, Homo sapiens
ccacttttttctccatctctga

SEQ ID NO: 7909762 - DNA, 22 bp, Homo sapiens
ccacttttttctccatctctga

SEQ ID NO: 7909763 - DNA, 22 bp, Homo sapiens
ccacttttgggaacagtgagta

SEQ ID NO: 7909764 - DNA, 22 bp, Homo sapiens
ccacttttgggaacagtgagta

SEQ ID NO: 7909765 - DNA, 22 bp, Homo sapiens
ccacttttcactaagatgaatt

SEQ ID NO: 7909766 - DNA, 22 bp, Homo sapiens
ccacttttctacccactgtgac

SEQ ID NO: 7909767 - DNA, 22 bp, Homo sapiens
ccactttttagagaacaaaact

SEQ ID NO: 7909768 - DNA, 22 bp, Homo sapiens
ccactttttagagaacaaaact

SEQ ID NO: 7909769 - DNA, 22 bp, Homo sapiens
ccacttttgggaacagtgagta

SEQ ID NO: 7909770 - DNA, 22 bp, Homo sapiens
tctcaactttgagaaacattgt

SEQ ID NO: 7909771 - DNA, 21 bp, Homo sapiens
tctcaacttttctctttgggc

SEQ ID NO: 7909772 - DNA, 22 bp, Homo sapiens
tctcaactaatggtgcaagatg

SEQ ID NO: 7909773 - DNA, 22 bp, Homo sapiens
tctcaactaatggtgcaagatg

SEQ ID NO: 7909774 - DNA, 22 bp, Homo sapiens
tctcaagagggaggcaatcatg

SEQ ID NO: 7909775 - DNA, 22 bp, Homo sapiens
tctcaagagggaggcaatcatg

SEQ ID NO: 7909776 - DNA, 23 bp, Homo sapiens
tctcaagaggaagcagggctcat

SEQ ID NO: 7909777 - DNA, 22 bp, Homo sapiens
tctcaagatctcaagatggccc

SEQ ID NO: 7909778 - DNA, 22 bp, Homo sapiens
tctcaagctactaccttggatc

SEQ ID NO: 7909779 - DNA, 22 bp, Homo sapiens
tctcaagcttgttggtatgttt

SEQ ID NO: 7909780 - DNA, 22 bp, Homo sapiens
tctcaagcttgttggtatgttt

SEQ ID NO: 7909781 - DNA, 22 bp, Homo sapiens
tctcaagcttgttggtatgttt

SEQ ID NO: 7909782 - DNA, 22 bp, Homo sapiens
tctcaagcttgttggtatgttt

SEQ ID NO: 7909783 - DNA, 23 bp, Homo sapiens
tctcaagcttcactgtgtgttgt

SEQ ID NO: 7909784 - DNA, 22 bp, Homo sapiens
tctcaaatttgctggaccagta

SEQ ID NO: 7909785 - DNA, 22 bp, Homo sapiens
tctcaaatttgttagataaaat

SEQ ID NO: 7909786 - DNA, 22 bp, Homo sapiens
tctcaaatttatacagagttca

SEQ ID NO: 7909787 - DNA, 22 bp, Homo sapiens
tctcaaatttgctggaccagta

SEQ ID NO: 7909788 - DNA, 22 bp, Homo sapiens
tctcaaatttatacagagttca

SEQ ID NO: 7909789 - DNA, 22 bp, Homo sapiens
tctcaaatttatacagagttca

SEQ ID NO: 7909790 - DNA, 22 bp, Homo sapiens
tctcaaatttatacagagttca

SEQ ID NO: 7909791 - DNA, 22 bp, Homo sapiens
tctcaaatttatacagagttca

SEQ ID NO: 7909792 - DNA, 22 bp, Homo sapiens
tctcaaatttgttagataaaat

SEQ ID NO: 7909793 - DNA, 22 bp, Homo sapiens
tctcaaatttgttagataaaat

SEQ ID NO: 7909794 - DNA, 22 bp, Homo sapiens
tctcaacaccacttgctgaaga

SEQ ID NO: 7909795 - DNA, 22 bp, Homo sapiens
tctcaaattcccttttcctcct

SEQ ID NO: 7909796 - DNA, 22 bp, Homo sapiens
tctcaaatgtaaagcatgattt

SEQ ID NO: 7909797 - DNA, 22 bp, Homo sapiens
tctcaaatgtaaagcatgattt

SEQ ID NO: 7909798 - DNA, 22 bp, Homo sapiens
tctatattccagatacagatta

SEQ ID NO: 7909799 - DNA, 22 bp, Homo sapiens
tctatattccagatacagatta

SEQ ID NO: 7909800 - DNA, 22 bp, Homo sapiens
tctatattccagatacagatta

SEQ ID NO: 7909801 - DNA, 16 bp, Homo sapiens
ccacctgcagctctca

SEQ ID NO: 7909802 - DNA, 16 bp, Homo sapiens
ccacctgcagctctca

SEQ ID NO: 7909803 - DNA, 16 bp, Homo sapiens
ccacctgcagctctca

SEQ ID NO: 7909804 - DNA, 22 bp, Homo sapiens
ccacctgagataagagagctca

SEQ ID NO: 7909805 - DNA, 22 bp, Homo sapiens
ccacctgagataagagagctca

SEQ ID NO: 7909806 - DNA, 22 bp, Homo sapiens
tctatattatacatccaggatt

SEQ ID NO: 7909807 - DNA, 18 bp, Homo sapiens
tctatatggacatagaga

SEQ ID NO: 7909808 - DNA, 16 bp, Homo sapiens
ccacctgcagctctca

SEQ ID NO: 7909809 - DNA, 22 bp, Homo sapiens
ccacctcctaggcctggagaag

SEQ ID NO: 7909810 - DNA, 22 bp, Homo sapiens
ccacctcctaggcctggagaag

SEQ ID NO: 7909811 - DNA, 22 bp, Homo sapiens
ccacctccacctattgccagcc

SEQ ID NO: 7909812 - DNA, 22 bp, Homo sapiens
ccacctccacctattgccagcc

SEQ ID NO: 7909813 - DNA, 22 bp, Homo sapiens
ccacctcctcggccatgtgacg

SEQ ID NO: 7909814 - DNA, 22 bp, Homo sapiens
ccacctcctaggcctggagaag

SEQ ID NO: 7909815 - DNA, 22 bp, Homo sapiens
ccacctcctcggccatgtgacg

SEQ ID NO: 7909816 - DNA, 22 bp, Homo sapiens
ccacctcctcggccatgtgacg

SEQ ID NO: 7909817 - DNA, 22 bp, Homo sapiens
ccacctcctcggccatgtgacg

SEQ ID NO: 7909818 - DNA, 22 bp, Homo sapiens
ccacctcctcggccatgtgacg

SEQ ID NO: 7909819 - DNA, 22 bp, Homo sapiens
ccacctcctcggccatgtgacg

SEQ ID NO: 7909820 - DNA, 22 bp, Homo sapiens
ccacctctcagggtttcctaat

SEQ ID NO: 7909821 - DNA, 22 bp, Homo sapiens
tcggtggcgcccgcgcgggacc

SEQ ID NO: 7909822 - DNA, 23 bp, Homo sapiens
tcggtgggcgtggaggccgaggc

SEQ ID NO: 7909823 - DNA, 23 bp, Homo sapiens
tcggtgggcgtggaggccgaggc

SEQ ID NO: 7909824 - DNA, 22 bp, Homo sapiens
ccaccctggactcgaggcccga

SEQ ID NO: 7909825 - DNA, 22 bp, Homo sapiens
ccaccctggactcgaggcccga

SEQ ID NO: 7909826 - DNA, 22 bp, Homo sapiens
ccaccctgtgcaggcgtgggta

SEQ ID NO: 7909827 - DNA, 22 bp, Homo sapiens
ccaccctgggttctgatgtgga

SEQ ID NO: 7909828 - DNA, 22 bp, Homo sapiens
ccaccctgtgcaggcgtgggta

SEQ ID NO: 7909829 - DNA, 20 bp, Homo sapiens
ccaccctgtccggggcggag

SEQ ID NO: 7909830 - DNA, 19 bp, Homo sapiens
ccaccctgggagctcactc

SEQ ID NO: 7909831 - DNA, 22 bp, Homo sapiens
ccaccctgggttctgatgtgga

SEQ ID NO: 7909832 - DNA, 19 bp, Homo sapiens
ccaccctgggagctcactc

SEQ ID NO: 7909833 - DNA, 22 bp, Homo sapiens
ccaccctgggttctgatgtgga

SEQ ID NO: 7909834 - DNA, 22 bp, Homo sapiens
ccaccgctgaaggcactggcat

SEQ ID NO: 7909835 - DNA, 22 bp, Homo sapiens
ccaccgccttggcgtgttcccc

SEQ ID NO: 7909836 - DNA, 22 bp, Homo sapiens
ccacccttccattcttcctctt

SEQ ID NO: 7909837 - DNA, 22 bp, Homo sapiens
ccaccgccatggcgttgtacag

SEQ ID NO: 7909838 - DNA, 22 bp, Homo sapiens
ccacccttgggttcggaggccg

SEQ ID NO: 7909839 - DNA, 22 bp, Homo sapiens
ccacccttgggttcggaggccg

SEQ ID NO: 7909840 - DNA, 22 bp, Homo sapiens
ccacccttgggttcggaggccg

SEQ ID NO: 7909841 - DNA, 22 bp, Homo sapiens
ccaccctgtgtttttgccattg

SEQ ID NO: 7909842 - DNA, 22 bp, Homo sapiens
ccaccctgtgcaggcgtgggta

SEQ ID NO: 7909843 - DNA, 22 bp, Homo sapiens
ccaccctgtgtttttgccattg

SEQ ID NO: 7909844 - DNA, 22 bp, Homo sapiens
ccaccctgtgtttttgccattg

SEQ ID NO: 7909845 - DNA, 22 bp, Homo sapiens
tcgggctcgctctcctagcgga

SEQ ID NO: 7909846 - DNA, 22 bp, Homo sapiens
tcgggctcgctctcctagcgga

SEQ ID NO: 7909847 - DNA, 22 bp, Homo sapiens
tcgggctcgctctcctagcgga

SEQ ID NO: 7909848 - DNA, 22 bp, Homo sapiens
tcgggctcgctctcctagcgga

SEQ ID NO: 7909849 - DNA, 22 bp, Homo sapiens
tcggcgcgcccagtcgatgggg

SEQ ID NO: 7909850 - DNA, 22 bp, Homo sapiens
tcggccacggggtttcctccaa

SEQ ID NO: 7909851 - DNA, 20 bp, Homo sapiens
tcggctggacactgtgcact

SEQ ID NO: 7909852 - DNA, 22 bp, Homo sapiens
tcggggtctttgacacgctctg

SEQ ID NO: 7909853 - DNA, 22 bp, Homo sapiens
tcggggtctttgacacgctctg

SEQ ID NO: 7909854 - DNA, 23 bp, Homo sapiens
tcggtgggcgtggaggccgaggc

SEQ ID NO: 7909855 - DNA, 22 bp, Homo sapiens
tcgggctgctcgctgcggaact

SEQ ID NO: 7909856 - DNA, 22 bp, Homo sapiens
tcggggatgggagagagctcca

SEQ ID NO: 7909857 - DNA, 22 bp, Homo sapiens
tcgggctcgctctcctagcgga

SEQ ID NO: 7909858 - DNA, 22 bp, Homo sapiens
tcggggtctttgacacgctctg

SEQ ID NO: 7909859 - DNA, 22 bp, Homo sapiens
tcggggtctttgacacgctctg

SEQ ID NO: 7909860 - DNA, 22 bp, Homo sapiens
tcgcttgcttcggtgaccctgg

SEQ ID NO: 7909861 - DNA, 22 bp, Homo sapiens
tcggaaccgacctgggagctgg

SEQ ID NO: 7909862 - DNA, 22 bp, Homo sapiens
tcggaatgtagtaaatctttct

SEQ ID NO: 7909863 - DNA, 22 bp, Homo sapiens
tcggaagttagagtgtgttatt

SEQ ID NO: 7909864 - DNA, 22 bp, Homo sapiens
tcgctgtggtttctgtacatgg

SEQ ID NO: 7909865 - DNA, 22 bp, Homo sapiens
tcgcttgaacccaggaagtgga

SEQ ID NO: 7909866 - DNA, 22 bp, Homo sapiens
tcggagagttcatgaagacccg

SEQ ID NO: 7909867 - DNA, 22 bp, Homo sapiens
tcggagcgtcactggctggagg

SEQ ID NO: 7909868 - DNA, 22 bp, Homo sapiens
tcggagcgtcactggctggagg

SEQ ID NO: 7909869 - DNA, 22 bp, Homo sapiens
tcggagctgtagatgaaaccct

SEQ ID NO: 7909870 - DNA, 22 bp, Homo sapiens
tcggagtgaatcttcacaatgt

SEQ ID NO: 7909871 - DNA, 22 bp, Homo sapiens
tcggaggatatcacagagcttt

SEQ ID NO: 7909872 - DNA, 22 bp, Homo sapiens
tcgcgggctcccagctccgggt

SEQ ID NO: 7909873 - DNA, 22 bp, Homo sapiens
tcgcgcccccaagcgtcattgg

SEQ ID NO: 7909874 - DNA, 22 bp, Homo sapiens
tcgctgaggctgcacggctgcc

SEQ ID NO: 7909875 - DNA, 22 bp, Homo sapiens
tcgctgaggctgcacggctgcc

SEQ ID NO: 7909876 - DNA, 22 bp, Homo sapiens
tcgctgaggctgcacggctgcc

SEQ ID NO: 7909877 - DNA, 22 bp, Homo sapiens
tcgctggcctggaggggagcca

SEQ ID NO: 7909878 - DNA, 18 bp, Homo sapiens
tcctttcaccccttctct

SEQ ID NO: 7909879 - DNA, 18 bp, Homo sapiens
tcctttcaccccttctct

SEQ ID NO: 7909880 - DNA, 22 bp, Homo sapiens
tcctttccagcctcacctcagc

SEQ ID NO: 7909881 - DNA, 22 bp, Homo sapiens
tcctttccagcctcacctcagc

SEQ ID NO: 7909882 - DNA, 22 bp, Homo sapiens
ccaccagctttggcggtgacag

SEQ ID NO: 7909883 - DNA, 22 bp, Homo sapiens
ccaccaggacagccctgagggg

SEQ ID NO: 7909884 - DNA, 22 bp, Homo sapiens
ccaccaggacagccctgagggg

SEQ ID NO: 7909885 - DNA, 22 bp, Homo sapiens
ccaccagctttgccaccctgct

SEQ ID NO: 7909886 - DNA, 22 bp, Homo sapiens
ccaccagctttggcggtgacag

SEQ ID NO: 7909887 - DNA, 22 bp, Homo sapiens
ccaccagctttgccaccctgct

SEQ ID NO: 7909888 - DNA, 22 bp, Homo sapiens
ccaccagctttgccaccctgct

SEQ ID NO: 7909889 - DNA, 22 bp, Homo sapiens
ccacattttgctttgcctaggt

SEQ ID NO: 7909890 - DNA, 22 bp, Homo sapiens
ccacatttttgatactctcact

SEQ ID NO: 7909891 - DNA, 22 bp, Homo sapiens
ccaccacatttgcctagacttt

SEQ ID NO: 7909892 - DNA, 22 bp, Homo sapiens
ccaccacttctggcttctggtg

SEQ ID NO: 7909893 - DNA, 22 bp, Homo sapiens
ccaccacatttgcctagacttt

SEQ ID NO: 7909894 - DNA, 22 bp, Homo sapiens
ccaccactgaggcacaggagcc

SEQ ID NO: 7909895 - DNA, 22 bp, Homo sapiens
ccaccagaagctgggagaagct

SEQ ID NO: 7909896 - DNA, 22 bp, Homo sapiens
ccaccacttctggcttctggtg

SEQ ID NO: 7909897 - DNA, 22 bp, Homo sapiens
ccaccagcttcagcagccgcgg

SEQ ID NO: 7909898 - DNA, 22 bp, Homo sapiens
ccaccagcttcagcagccgcgg

SEQ ID NO: 7909899 - DNA, 22 bp, Homo sapiens
ccaccagctgcatatgcacgta

SEQ ID NO: 7909900 - DNA, 22 bp, Homo sapiens
ccaccagcttcagcagccgcgg

SEQ ID NO: 7909901 - DNA, 22 bp, Homo sapiens
ccaccagagggcagactgtgat

SEQ ID NO: 7909902 - DNA, 22 bp, Homo sapiens
ccaccagatttactttactatt

SEQ ID NO: 7909903 - DNA, 22 bp, Homo sapiens
tcctctccatgtctcacgccac

SEQ ID NO: 7909904 - DNA, 22 bp, Homo sapiens
tcctctctgcactggccctgcc

SEQ ID NO: 7909905 - DNA, 22 bp, Homo sapiens
tcctctccatgtctcacgccac

SEQ ID NO: 7909906 - DNA, 22 bp, Homo sapiens
tcctctccatgtctcacgccac

SEQ ID NO: 7909907 - DNA, 22 bp, Homo sapiens
tcctctccatgtctcacgccac

SEQ ID NO: 7909908 - DNA, 22 bp, Homo sapiens
tcctctccatgtctcacgccac

SEQ ID NO: 7909909 - DNA, 22 bp, Homo sapiens
tcctctctgcactggccctgcc

SEQ ID NO: 7909910 - DNA, 22 bp, Homo sapiens
tcctctctgcactggccctgcc

SEQ ID NO: 7909911 - DNA, 18 bp, Homo sapiens
tcctctctttccccaggg

SEQ ID NO: 7909912 - DNA, 18 bp, Homo sapiens
tcctctctttccccaggg

SEQ ID NO: 7909913 - DNA, 18 bp, Homo sapiens
tcctctctttccccaggg

SEQ ID NO: 7909914 - DNA, 18 bp, Homo sapiens
tcctctctttccccaggg

SEQ ID NO: 7909915 - DNA, 22 bp, Homo sapiens
tcctctgacaccttgtgcagtg

SEQ ID NO: 7909916 - DNA, 22 bp, Homo sapiens
tcctctgaatgctgttgaagaa

SEQ ID NO: 7909917 - DNA, 22 bp, Homo sapiens
tcctgaagtatgggtatggagt

SEQ ID NO: 7909918 - DNA, 22 bp, Homo sapiens
tcctctgccaaagggagttgcc

SEQ ID NO: 7909919 - DNA, 22 bp, Homo sapiens
tcctgaaggcctgagttccacc

SEQ ID NO: 7909920 - DNA, 21 bp, Homo sapiens
tcctctgcagtgaggtggcct

SEQ ID NO: 7909921 - DNA, 22 bp, Homo sapiens
tcctctgatttgattacctagt

SEQ ID NO: 7909922 - DNA, 22 bp, Homo sapiens
tcctctgagacatcaggttgag

SEQ ID NO: 7909923 - DNA, 22 bp, Homo sapiens
tcctgaagtcacaggctctgag

SEQ ID NO: 7909924 - DNA, 22 bp, Homo sapiens
tcctgaataaattagctgtcac

SEQ ID NO: 7909925 - DNA, 22 bp, Homo sapiens
tcctgaatccaggagagtaggg

SEQ ID NO: 7909926 - DNA, 22 bp, Homo sapiens
tcctgaatgagttgatcacaat

SEQ ID NO: 7909927 - DNA, 22 bp, Homo sapiens
tcctgaatgagttgatcacaat

SEQ ID NO: 7909928 - DNA, 22 bp, Homo sapiens
tcctgaattcctctttgcatcc

SEQ ID NO: 7909929 - DNA, 22 bp, Homo sapiens
tcctgaattgaactcagttaat

SEQ ID NO: 7909930 - DNA, 22 bp, Homo sapiens
tcctgaattgaactcagttaat

SEQ ID NO: 7909931 - DNA, 22 bp, Homo sapiens
tcctgaattgttgagaagcagc

SEQ ID NO: 7909932 - DNA, 22 bp, Homo sapiens
tcctgaatttcccagcatgaac

SEQ ID NO: 7909933 - DNA, 22 bp, Homo sapiens
tcctgaattgttgagaagcagc

SEQ ID NO: 7909934 - DNA, 20 bp, Homo sapiens
ccacatggaagtttgagacc

SEQ ID NO: 7909935 - DNA, 22 bp, Homo sapiens
ccacatggagcaggaggtgggg

SEQ ID NO: 7909936 - DNA, 22 bp, Homo sapiens
ccacatggagcaggaggtgggg

SEQ ID NO: 7909937 - DNA, 22 bp, Homo sapiens
ccacatggtcctcatttactct

SEQ ID NO: 7909938 - DNA, 22 bp, Homo sapiens
ccacatgtgcactgctgtatgg

SEQ ID NO: 7909939 - DNA, 22 bp, Homo sapiens
ccacatttactgatgtatgtat

SEQ ID NO: 7909940 - DNA, 22 bp, Homo sapiens
ccacatttactggatgctcagg

SEQ ID NO: 7909941 - DNA, 22 bp, Homo sapiens
ccacatttactggatgctcagg

SEQ ID NO: 7909942 - DNA, 22 bp, Homo sapiens
ccacattcagtccaggcttgga

SEQ ID NO: 7909943 - DNA, 22 bp, Homo sapiens
ccacattcactcatttcattgt

SEQ ID NO: 7909944 - DNA, 21 bp, Homo sapiens
ccacattctcattctgactgc

SEQ ID NO: 7909945 - DNA, 22 bp, Homo sapiens
tcctgaccattccttgtctcca

SEQ ID NO: 7909946 - DNA, 22 bp, Homo sapiens
tcctgaccactaggaccaggct

SEQ ID NO: 7909947 - DNA, 22 bp, Homo sapiens
tcctgaccacactgccttctgc

SEQ ID NO: 7909948 - DNA, 22 bp, Homo sapiens
tcctgaccacactgccttctgc

SEQ ID NO: 7909949 - DNA, 20 bp, Homo sapiens
tcctgaatttcctttctgct

SEQ ID NO: 7909950 - DNA, 22 bp, Homo sapiens
tcctgacctcttgctctgacct

SEQ ID NO: 7909951 - DNA, 22 bp, Homo sapiens
tcctgacccaccaagtctgtaa

SEQ ID NO: 7909952 - DNA, 22 bp, Homo sapiens
tcctgacctcttgctctgacct

SEQ ID NO: 7909953 - DNA, 22 bp, Homo sapiens
tcctgaccattccttgtctcca

SEQ ID NO: 7909954 - DNA, 22 bp, Homo sapiens
ccacagtgatccctgcctgcga

SEQ ID NO: 7909955 - DNA, 22 bp, Homo sapiens
ccacagtgatccctgcctgcga

SEQ ID NO: 7909956 - DNA, 22 bp, Homo sapiens
ccacagtgagttctgtactctg

SEQ ID NO: 7909957 - DNA, 22 bp, Homo sapiens
ccacagtgatccctgcctgcga

SEQ ID NO: 7909958 - DNA, 22 bp, Homo sapiens
tcctgactctggtgtcctctac

SEQ ID NO: 7909959 - DNA, 22 bp, Homo sapiens
ccacagtgagttctgtactctg

SEQ ID NO: 7909960 - DNA, 22 bp, Homo sapiens
tcctgactccaggtcctgtgtg

SEQ ID NO: 7909961 - DNA, 22 bp, Homo sapiens
tcctgacctgaactggggtctt

SEQ ID NO: 7909962 - DNA, 22 bp, Homo sapiens
tcctgacctgaactggggtctt

SEQ ID NO: 7909963 - DNA, 22 bp, Homo sapiens
ccacagtgcctggaattctgca

SEQ ID NO: 7909964 - DNA, 22 bp, Homo sapiens
ccacatctcttgatgtacctac

SEQ ID NO: 7909965 - DNA, 22 bp, Homo sapiens
ccacatctgttcttagttctga

SEQ ID NO: 7909966 - DNA, 22 bp, Homo sapiens
ccacatctgcatttaatgtata

SEQ ID NO: 7909967 - DNA, 22 bp, Homo sapiens
ccacatgatgaggaagctgaac

SEQ ID NO: 7909968 - DNA, 22 bp, Homo sapiens
ccacatgctctctctccaggtt

SEQ ID NO: 7909969 - DNA, 20 bp, Homo sapiens
cagtccactggagttcctac

SEQ ID NO: 7909970 - DNA, 20 bp, Homo sapiens
cagtccactggagttcctac

SEQ ID NO: 7909971 - DNA, 20 bp, Homo sapiens
cagtccactggagttcctac

SEQ ID NO: 7909972 - DNA, 22 bp, Homo sapiens
cagtccagagcccaccagagga

SEQ ID NO: 7909973 - DNA, 22 bp, Homo sapiens
cagtccagagcccaccagagga

SEQ ID NO: 7909974 - DNA, 20 bp, Homo sapiens
cagtccactggagttcctac

SEQ ID NO: 7909975 - DNA, 18 bp, Homo sapiens
cagtcccaaaccttagga

SEQ ID NO: 7909976 - DNA, 19 bp, Homo sapiens
cagtcccaaattcttgtca

SEQ ID NO: 7909977 - DNA, 19 bp, Homo sapiens
cagtcccaaattcttgtca

SEQ ID NO: 7909978 - DNA, 22 bp, Homo sapiens
cagtcccaaggaggaagcagtc

SEQ ID NO: 7909979 - DNA, 22 bp, Homo sapiens
cagtcccaaggaggaagcagtc

SEQ ID NO: 7909980 - DNA, 22 bp, Homo sapiens
cagtcccaaggaggaagcagtc

SEQ ID NO: 7909981 - DNA, 22 bp, Homo sapiens
cagtcccaaggaggaagcagtc

SEQ ID NO: 7909982 - DNA, 22 bp, Homo sapiens
cagtcccaccaggatcgctctt

SEQ ID NO: 7909983 - DNA, 22 bp, Homo sapiens
cagtcccacaagatctccacaa

SEQ ID NO: 7909984 - DNA, 22 bp, Homo sapiens
cagtcccacaagatctccacaa

SEQ ID NO: 7909985 - DNA, 22 bp, Homo sapiens
cagtcccactagtgccaatacc

SEQ ID NO: 7909986 - DNA, 22 bp, Homo sapiens
cagtcccactagtgccaatacc

SEQ ID NO: 7909987 - DNA, 22 bp, Homo sapiens
cagtcccaccaggatcgctctt

SEQ ID NO: 7909988 - DNA, 22 bp, Homo sapiens
cagtcccaccaggatcgctctt

SEQ ID NO: 7909989 - DNA, 20 bp, Homo sapiens
cagtcccaatccagggccag

SEQ ID NO: 7909990 - DNA, 20 bp, Homo sapiens
cagtcccaatccagggccag

SEQ ID NO: 7909991 - DNA, 22 bp, Homo sapiens
cagtcccaaggaggaagcagtc

SEQ ID NO: 7909992 - DNA, 20 bp, Homo sapiens
cagtcccaatccagggccag

SEQ ID NO: 7909993 - DNA, 20 bp, Homo sapiens
cagtcccaatccagggccag

SEQ ID NO: 7909994 - DNA, 20 bp, Homo sapiens
cagtcccaatccagggccag

SEQ ID NO: 7909995 - DNA, 20 bp, Homo sapiens
cagtcccaatccagggccag

SEQ ID NO: 7909996 - DNA, 20 bp, Homo sapiens
cagtcccaatccagggccag

SEQ ID NO: 7909997 - DNA, 20 bp, Homo sapiens
cagtcccaatccagggccag

SEQ ID NO: 7909998 - DNA, 22 bp, Homo sapiens
tatttctttcaggtatgtgttg

SEQ ID NO: 7909999 - DNA, 22 bp, Homo sapiens
tatttctttcaggtatgtgttg

SEQ ID NO: 7910000 - DNA, 22 bp, Homo sapiens
tatttctttcaggtatgtgttg

SEQ ID NO: 7910001 - DNA, 22 bp, Homo sapiens
tatttctttcaggtatgtgttg

SEQ ID NO: 7910002 - DNA, 22 bp, Homo sapiens
tatttctttcaggtatgtgttg

SEQ ID NO: 7910003 - DNA, 22 bp, Homo sapiens
tatttcttttcgtgacttattg

SEQ ID NO: 7910004 - DNA, 22 bp, Homo sapiens
tatttcttttcgtgacttattg

SEQ ID NO: 7910005 - DNA, 22 bp, Homo sapiens
cagtcccactagtgccaatacc

SEQ ID NO: 7910006 - DNA, 22 bp, Homo sapiens
cagtcccagaagagcctgggag

SEQ ID NO: 7910007 - DNA, 22 bp, Homo sapiens
cagtcccagaagagcctgggag

SEQ ID NO: 7910008 - DNA, 22 bp, Homo sapiens
cagtcccagaagagcctgggag

SEQ ID NO: 7910009 - DNA, 22 bp, Homo sapiens
cagtcccagaagagcctgggag

SEQ ID NO: 7910010 - DNA, 22 bp, Homo sapiens
cagtcccagacatagtaaggga

SEQ ID NO: 7910011 - DNA, 22 bp, Homo sapiens
cagtcccagaagagcctgggag

SEQ ID NO: 7910012 - DNA, 22 bp, Homo sapiens
cagtcccagacatagtaaggga

SEQ ID NO: 7910013 - DNA, 22 bp, Homo sapiens
cagtcccagacccagaaggtgg

SEQ ID NO: 7910014 - DNA, 22 bp, Homo sapiens
cagtagtggaagggagagaaaa

SEQ ID NO: 7910015 - DNA, 22 bp, Homo sapiens
cagtagtggaagggagagaaaa

SEQ ID NO: 7910016 - DNA, 17 bp, Homo sapiens
cagtagtggcactggag

SEQ ID NO: 7910017 - DNA, 22 bp, Homo sapiens
cagtagtggggagcccagtgtc

SEQ ID NO: 7910018 - DNA, 22 bp, Homo sapiens
cagtagtggtctatcactggag

SEQ ID NO: 7910019 - DNA, 22 bp, Homo sapiens
cagtagtggggagcccagtgtc

SEQ ID NO: 7910020 - DNA, 22 bp, Homo sapiens
cagtagtggtctatcactggag

SEQ ID NO: 7910021 - DNA, 22 bp, Homo sapiens
cagtagtggtctatcactggag

SEQ ID NO: 7910022 - DNA, 22 bp, Homo sapiens
cagtagtggtctatcactggag

SEQ ID NO: 7910023 - DNA, 22 bp, Homo sapiens
cagtagtgttgctgagtgtcag

SEQ ID NO: 7910024 - DNA, 22 bp, Homo sapiens
cagtataagagtgaggaagggc

SEQ ID NO: 7910025 - DNA, 22 bp, Homo sapiens
cagtataatgccccctgtgggg

SEQ ID NO: 7910026 - DNA, 23 bp, Homo sapiens
cagtataatgtatggatggggca

SEQ ID NO: 7910027 - DNA, 22 bp, Homo sapiens
cagtagttattagttgccactg

SEQ ID NO: 7910028 - DNA, 18 bp, Homo sapiens
cagtataaccagcaactc

SEQ ID NO: 7910029 - DNA, 21 bp, Homo sapiens
cagtataacgttgggctcttc

SEQ ID NO: 7910030 - DNA, 18 bp, Homo sapiens
cagtataaccagcaactc

SEQ ID NO: 7910031 - DNA, 22 bp, Homo sapiens
cagtataagagtgaggaagggc

SEQ ID NO: 7910032 - DNA, 22 bp, Homo sapiens
cagtataagagtgaggaagggc

SEQ ID NO: 7910033 - DNA, 22 bp, Homo sapiens
cagtaggaaggatgcagaaaaa

SEQ ID NO: 7910034 - DNA, 22 bp, Homo sapiens
cagtaggaaggatgcagaaaaa

SEQ ID NO: 7910035 - DNA, 22 bp, Homo sapiens
cagtagggaatgtgggaggctg

SEQ ID NO: 7910036 - DNA, 22 bp, Homo sapiens
cagtagggaatgtgggaggctg

SEQ ID NO: 7910037 - DNA, 22 bp, Homo sapiens
cagtaggcaggttgtcttctta

SEQ ID NO: 7910038 - DNA, 22 bp, Homo sapiens
cagtaggaggttctgaggttct

SEQ ID NO: 7910039 - DNA, 22 bp, Homo sapiens
cagtagcttgcttaggctttta

SEQ ID NO: 7910040 - DNA, 22 bp, Homo sapiens
cagtagcttcagttgaggcctg

SEQ ID NO: 7910041 - DNA, 22 bp, Homo sapiens
cagtagggaatgtgggaggctg

SEQ ID NO: 7910042 - DNA, 22 bp, Homo sapiens
cagtagggaatgtgggaggctg

SEQ ID NO: 7910043 - DNA, 22 bp, Homo sapiens
cagtagggaatgtgggaggctg

SEQ ID NO: 7910044 - DNA, 22 bp, Homo sapiens
cagtagtctttttcctcctaga

SEQ ID NO: 7910045 - DNA, 21 bp, Homo sapiens
cagtagtgcgtcgcagaggac

SEQ ID NO: 7910046 - DNA, 21 bp, Homo sapiens
cagtagtgaggtatttgccaa

SEQ ID NO: 7910047 - DNA, 21 bp, Homo sapiens
cagtagtgaggtatttgccaa

SEQ ID NO: 7910048 - DNA, 21 bp, Homo sapiens
cagtagtgcgtcgcagaggac

SEQ ID NO: 7910049 - DNA, 22 bp, Homo sapiens
cagtagtctttttcctcctaga

SEQ ID NO: 7910050 - DNA, 22 bp, Homo sapiens
cagtagtgaaaagcagcccagc

SEQ ID NO: 7910051 - DNA, 22 bp, Homo sapiens
cagtagtgaaaagcagcccagc

SEQ ID NO: 7910052 - DNA, 22 bp, Homo sapiens
tatttccacttaggtgcctgtt

SEQ ID NO: 7910053 - DNA, 22 bp, Homo sapiens
tatttccacttaggtgcctgtt

SEQ ID NO: 7910054 - DNA, 22 bp, Homo sapiens
tatttccagaggagtatagaag

SEQ ID NO: 7910055 - DNA, 22 bp, Homo sapiens
tatttccagaggagtatagaag

SEQ ID NO: 7910056 - DNA, 22 bp, Homo sapiens
tatttccacctattattttctg

SEQ ID NO: 7910057 - DNA, 22 bp, Homo sapiens
tatttccacctattattttctg

SEQ ID NO: 7910058 - DNA, 22 bp, Homo sapiens
cagtagcatgtaataaagacag

SEQ ID NO: 7910059 - DNA, 22 bp, Homo sapiens
tatttccagatgaggttacatt

SEQ ID NO: 7910060 - DNA, 22 bp, Homo sapiens
cagtagcatgtaataaagacag

SEQ ID NO: 7910061 - DNA, 22 bp, Homo sapiens
tatttccacaccttttgaatct

SEQ ID NO: 7910062 - DNA, 22 bp, Homo sapiens
tatttccaccctcagtaaggaa

SEQ ID NO: 7910063 - DNA, 22 bp, Homo sapiens
tatttccaccctcagtaaggaa

SEQ ID NO: 7910064 - DNA, 22 bp, Homo sapiens
tatttccaagctgaatccaatg

SEQ ID NO: 7910065 - DNA, 22 bp, Homo sapiens
tatttccaagctgaatccaatg

SEQ ID NO: 7910066 - DNA, 22 bp, Homo sapiens
tatttccaaaagcctattatga

SEQ ID NO: 7910067 - DNA, 22 bp, Homo sapiens
tatttccaaaagcctattatga

SEQ ID NO: 7910068 - DNA, 22 bp, Homo sapiens
tatttccaagctgaatccaatg

SEQ ID NO: 7910069 - DNA, 21 bp, Homo sapiens
tatttccaaccctttatcctt

SEQ ID NO: 7910070 - DNA, 22 bp, Homo sapiens
tatttccaaaagcctattatga

SEQ ID NO: 7910071 - DNA, 21 bp, Homo sapiens
tatttccaaccctttatcctt

SEQ ID NO: 7910072 - DNA, 22 bp, Homo sapiens
caggtggtgcctccaggctggt

SEQ ID NO: 7910073 - DNA, 22 bp, Homo sapiens
caggtgtgccgggagcagtttg

SEQ ID NO: 7910074 - DNA, 22 bp, Homo sapiens
caggtgtgccgggagcagtttg

SEQ ID NO: 7910075 - DNA, 22 bp, Homo sapiens
caggtgttcaagctggaggcca

SEQ ID NO: 7910076 - DNA, 22 bp, Homo sapiens
cagggtggggaaatagcgccct

SEQ ID NO: 7910077 - DNA, 22 bp, Homo sapiens
cagggtggggaaatagcgccct

SEQ ID NO: 7910078 - DNA, 22 bp, Homo sapiens
caggtggtcaggcagatgggct

SEQ ID NO: 7910079 - DNA, 22 bp, Homo sapiens
cagggtggggaaatagcgccct

SEQ ID NO: 7910080 - DNA, 22 bp, Homo sapiens
cagggtgggcacccagcctcca

SEQ ID NO: 7910081 - DNA, 22 bp, Homo sapiens
cagggtgggcacccagcctcca

SEQ ID NO: 7910082 - DNA, 22 bp, Homo sapiens
cagggtgggcacccagcctcca

SEQ ID NO: 7910083 - DNA, 22 bp, Homo sapiens
cagggtgggcacccagcctcca

SEQ ID NO: 7910084 - DNA, 22 bp, Homo sapiens
cagggtgggcacccagcctcca

SEQ ID NO: 7910085 - DNA, 22 bp, Homo sapiens
cagggtggccctgtggtctcat

SEQ ID NO: 7910086 - DNA, 22 bp, Homo sapiens
cagggtgggcacccagcctcca

SEQ ID NO: 7910087 - DNA, 22 bp, Homo sapiens
cagggtggccctgtggtctcat

SEQ ID NO: 7910088 - DNA, 22 bp, Homo sapiens
cagggtggccctgtggtctcat

SEQ ID NO: 7910089 - DNA, 22 bp, Homo sapiens
cagggtggccctgtggtctcat

SEQ ID NO: 7910090 - DNA, 22 bp, Homo sapiens
caggtgttggaagggcagtggg

SEQ ID NO: 7910091 - DNA, 22 bp, Homo sapiens
caggtgttgcagttgaagactg

SEQ ID NO: 7910092 - DNA, 22 bp, Homo sapiens
caggtgtttcaaatgtgaaact

SEQ ID NO: 7910093 - DNA, 22 bp, Homo sapiens
caggttcccaggtccagggctt

SEQ ID NO: 7910094 - DNA, 22 bp, Homo sapiens
caggttcaagcgattctcctgc

SEQ ID NO: 7910095 - DNA, 22 bp, Homo sapiens
caggttccctagcagcaaagcc

SEQ ID NO: 7910096 - DNA, 22 bp, Homo sapiens
caggttccagttgcagggactt

SEQ ID NO: 7910097 - DNA, 22 bp, Homo sapiens
caggttcattctttcttgtatt

SEQ ID NO: 7910098 - DNA, 22 bp, Homo sapiens
caggttcattctttcttgtatt

SEQ ID NO: 7910099 - DNA, 22 bp, Homo sapiens
caggttcccaggtccagggctt

SEQ ID NO: 7910100 - DNA, 22 bp, Homo sapiens
caggttcccaggtccagggctt

SEQ ID NO: 7910101 - DNA, 23 bp, Homo sapiens
caggtgttttacatatggtagtt

SEQ ID NO: 7910102 - DNA, 22 bp, Homo sapiens
caggttggtcggcaagtacaca

SEQ ID NO: 7910103 - DNA, 22 bp, Homo sapiens
caggtttacaaagtaaagtgtg

SEQ ID NO: 7910104 - DNA, 22 bp, Homo sapiens
caggtttagttccacacagctc

SEQ ID NO: 7910105 - DNA, 22 bp, Homo sapiens
caggtttcattggcagcttcat

SEQ ID NO: 7910106 - DNA, 22 bp, Homo sapiens
caggtttctagttctaagaata

SEQ ID NO: 7910107 - DNA, 22 bp, Homo sapiens
caggttgggctgcgaggaggag

SEQ ID NO: 7910108 - DNA, 22 bp, Homo sapiens
caggttgggctgcgaggaggag

SEQ ID NO: 7910109 - DNA, 22 bp, Homo sapiens
caggttggggacttaggatgac

SEQ ID NO: 7910110 - DNA, 22 bp, Homo sapiens
caggttggggacttaggatgac

SEQ ID NO: 7910111 - DNA, 22 bp, Homo sapiens
caggttgggatcggttgcaatg

SEQ ID NO: 7910112 - DNA, 22 bp, Homo sapiens
caggttgggatcggttgcaatg

SEQ ID NO: 7910113 - DNA, 22 bp, Homo sapiens
caggttcttgtttcaaacagac

SEQ ID NO: 7910114 - DNA, 22 bp, Homo sapiens
caggttggagatctgtctatgg

SEQ ID NO: 7910115 - DNA, 22 bp, Homo sapiens
caggttctggggctccactgtg

SEQ ID NO: 7910116 - DNA, 22 bp, Homo sapiens
caggttcttaacttgttcttcc

SEQ ID NO: 7910117 - DNA, 22 bp, Homo sapiens
caggttcttgaagccttctggc

SEQ ID NO: 7910118 - DNA, 22 bp, Homo sapiens
caggttcttaagtaacagcaca

SEQ ID NO: 7910119 - DNA, 22 bp, Homo sapiens
caggttctatactgaataattt

SEQ ID NO: 7910120 - DNA, 22 bp, Homo sapiens
caggttcccttgcagctaagtg

SEQ ID NO: 7910121 - DNA, 22 bp, Homo sapiens
caggttctcagaaggcagtcac

SEQ ID NO: 7910122 - DNA, 22 bp, Homo sapiens
caggttctgccatttacttgta

SEQ ID NO: 7910123 - DNA, 22 bp, Homo sapiens
caggttctgccatttacttgta

SEQ ID NO: 7910124 - DNA, 22 bp, Homo sapiens
caggttctggagatgcagagat

SEQ ID NO: 7910125 - DNA, 22 bp, Homo sapiens
caggttctggagatgcagagat

SEQ ID NO: 7910126 - DNA, 22 bp, Homo sapiens
tatttcagggggtacaagaaga

SEQ ID NO: 7910127 - DNA, 22 bp, Homo sapiens
tatttcagtcacttcttctctg

SEQ ID NO: 7910128 - DNA, 22 bp, Homo sapiens
caggtttctagttctaagaata

SEQ ID NO: 7910129 - DNA, 22 bp, Homo sapiens
caggtttctagttctaagaata

SEQ ID NO: 7910130 - DNA, 22 bp, Homo sapiens
tatttataacagtgagaacggg

SEQ ID NO: 7910131 - DNA, 22 bp, Homo sapiens
tatttcattctttatcaggagc

SEQ ID NO: 7910132 - DNA, 22 bp, Homo sapiens
tatttcattctttatcaggagc

SEQ ID NO: 7910133 - DNA, 22 bp, Homo sapiens
tatttccaaaaaggccatattc

SEQ ID NO: 7910134 - DNA, 22 bp, Homo sapiens
tatttccaaaaaggccatattc

SEQ ID NO: 7910135 - DNA, 22 bp, Homo sapiens
tatttcatctggaacaaggtaa

SEQ ID NO: 7910136 - DNA, 22 bp, Homo sapiens
tatttcatctggaacaaggtaa

SEQ ID NO: 7910137 - DNA, 22 bp, Homo sapiens
tatttcagtcacttcttctctg

SEQ ID NO: 7910138 - DNA, 22 bp, Homo sapiens
tatttcatgtgcaccataattc

SEQ ID NO: 7910139 - DNA, 22 bp, Homo sapiens
tatttcatgtgcaccataattc

SEQ ID NO: 7910140 - DNA, 22 bp, Homo sapiens
tatttcatgtgcaccataattc

SEQ ID NO: 7910141 - DNA, 22 bp, Homo sapiens
tatttcatgtgcaccataattc

SEQ ID NO: 7910142 - DNA, 22 bp, Homo sapiens
tcacaacaggaaggaccagctg

SEQ ID NO: 7910143 - DNA, 22 bp, Homo sapiens
tcacaagaatttgtagatgaaa

SEQ ID NO: 7910144 - DNA, 22 bp, Homo sapiens
tcacaagaatttgtagatgaaa

SEQ ID NO: 7910145 - DNA, 22 bp, Homo sapiens
tcacaagaatttgtagatgaaa

SEQ ID NO: 7910146 - DNA, 22 bp, Homo sapiens
tcacaagaatttgtagatgaaa

SEQ ID NO: 7910147 - DNA, 22 bp, Homo sapiens
tcacaagaatttgtagatgaaa

SEQ ID NO: 7910148 - DNA, 22 bp, Homo sapiens
tcacaagacagaaaacatttag

SEQ ID NO: 7910149 - DNA, 22 bp, Homo sapiens
tcacaagacagaaaacatttag

SEQ ID NO: 7910150 - DNA, 22 bp, Homo sapiens
tcacaagacagaaaacatttag

SEQ ID NO: 7910151 - DNA, 22 bp, Homo sapiens
tcacaaatgaggaaatcgagca

SEQ ID NO: 7910152 - DNA, 22 bp, Homo sapiens
tcacaaatgaggaaatcgagca

SEQ ID NO: 7910153 - DNA, 22 bp, Homo sapiens
tcacaaatgaccatggttacta

SEQ ID NO: 7910154 - DNA, 22 bp, Homo sapiens
tcacaaatcgaagccttataat

SEQ ID NO: 7910155 - DNA, 22 bp, Homo sapiens
tcacaaatcgaagccttataat

SEQ ID NO: 7910156 - DNA, 22 bp, Homo sapiens
tcacaaatcattttatctgtgt

SEQ ID NO: 7910157 - DNA, 22 bp, Homo sapiens
tcacaaatcattttatctgtgt

SEQ ID NO: 7910158 - DNA, 22 bp, Homo sapiens
tcacaaatcattttatctgtgt

SEQ ID NO: 7910159 - DNA, 22 bp, Homo sapiens
tcacaaatgtttgcatgtgtct

SEQ ID NO: 7910160 - DNA, 22 bp, Homo sapiens
tcacaaatgtctcctgtcctgt

SEQ ID NO: 7910161 - DNA, 22 bp, Homo sapiens
tcacaaatttcagctccctgaa

SEQ ID NO: 7910162 - DNA, 22 bp, Homo sapiens
tcacaaatttcagctccctgaa

SEQ ID NO: 7910163 - DNA, 22 bp, Homo sapiens
tcacaaatgtttgcatgtgtct

SEQ ID NO: 7910164 - DNA, 22 bp, Homo sapiens
tcacaaatttcagctccctgaa

SEQ ID NO: 7910165 - DNA, 22 bp, Homo sapiens
tcacaacaggaaggaccagctg

SEQ ID NO: 7910166 - DNA, 22 bp, Homo sapiens
tcacaaatattttaacagtagg

SEQ ID NO: 7910167 - DNA, 22 bp, Homo sapiens
tcacaaatattttaacagtagg

SEQ ID NO: 7910168 - DNA, 22 bp, Homo sapiens
tcacaaatattttaacagtagg

SEQ ID NO: 7910169 - DNA, 22 bp, Homo sapiens
tcacaaatatagtgagaaccag

SEQ ID NO: 7910170 - DNA, 22 bp, Homo sapiens
tcaatgactggtccaaggtggc

SEQ ID NO: 7910171 - DNA, 22 bp, Homo sapiens
tcaatgagaatagctttcctta

SEQ ID NO: 7910172 - DNA, 22 bp, Homo sapiens
tatttcttttcgtgacttattg

SEQ ID NO: 7910173 - DNA, 22 bp, Homo sapiens
tatttcttttcgtgacttattg

SEQ ID NO: 7910174 - DNA, 22 bp, Homo sapiens
tatttgaaagtgtacaaaaact

SEQ ID NO: 7910175 - DNA, 22 bp, Homo sapiens
tatttgaaagtgtacaaaaact

SEQ ID NO: 7910176 - DNA, 22 bp, Homo sapiens
tatttgaaagtgtacaaaaact

SEQ ID NO: 7910177 - DNA, 22 bp, Homo sapiens
tatttgaaagtgtacaaaaact

SEQ ID NO: 7910178 - DNA, 22 bp, Homo sapiens
tatttgaaagtgtacaaaaact

SEQ ID NO: 7910179 - DNA, 22 bp, Homo sapiens
cagtgaggaagctgtctggacc

SEQ ID NO: 7910180 - DNA, 22 bp, Homo sapiens
cagtgaggaagctgtctggacc

SEQ ID NO: 7910181 - DNA, 22 bp, Homo sapiens
cagtgaggaagctgtctggacc

SEQ ID NO: 7910182 - DNA, 22 bp, Homo sapiens
tcacacttagagcgaattgttt

SEQ ID NO: 7910183 - DNA, 22 bp, Homo sapiens
cagtgaggaagctgtctggacc

SEQ ID NO: 7910184 - DNA, 22 bp, Homo sapiens
cagtgagctcctgtctgtccct

SEQ ID NO: 7910185 - DNA, 22 bp, Homo sapiens
cagtgaggaagctgtctggacc

SEQ ID NO: 7910186 - DNA, 22 bp, Homo sapiens
cagtgaggaagctgtctggacc

SEQ ID NO: 7910187 - DNA, 22 bp, Homo sapiens
cagtgagataccacagagcaaa

SEQ ID NO: 7910188 - DNA, 22 bp, Homo sapiens
cagtgagataccacagagcaaa

SEQ ID NO: 7910189 - DNA, 22 bp, Homo sapiens
cagtgagataccacagagcaaa

SEQ ID NO: 7910190 - DNA, 22 bp, Homo sapiens
cagtgagcacggccagagggga

SEQ ID NO: 7910191 - DNA, 22 bp, Homo sapiens
cagtgagataccacagagcaaa

SEQ ID NO: 7910192 - DNA, 22 bp, Homo sapiens
cagtgagcacggccagagggga

SEQ ID NO: 7910193 - DNA, 22 bp, Homo sapiens
tcacagacgcctcccctcgcct

SEQ ID NO: 7910194 - DNA, 22 bp, Homo sapiens
tcacagactcttgattgtctaa

SEQ ID NO: 7910195 - DNA, 22 bp, Homo sapiens
tcacagactcttgattgtctaa

SEQ ID NO: 7910196 - DNA, 22 bp, Homo sapiens
tcacacttatcccactcagtca

SEQ ID NO: 7910197 - DNA, 22 bp, Homo sapiens
tcacacttcaaagggttagatc

SEQ ID NO: 7910198 - DNA, 21 bp, Homo sapiens
tcacacttgattggcttagac

SEQ ID NO: 7910199 - DNA, 22 bp, Homo sapiens
tcacactttccatggctgttaa

SEQ ID NO: 7910200 - DNA, 22 bp, Homo sapiens
tcacaagactgagcttgcttga

SEQ ID NO: 7910201 - DNA, 22 bp, Homo sapiens
tcacaagactgagcttgcttga

SEQ ID NO: 7910202 - DNA, 22 bp, Homo sapiens
tcacaagacagaaaacatttag

SEQ ID NO: 7910203 - DNA, 19 bp, Homo sapiens
tcacaagagagataaagtg

SEQ ID NO: 7910204 - DNA, 19 bp, Homo sapiens
tcacaagagagataaagtg

SEQ ID NO: 7910205 - DNA, 22 bp, Homo sapiens
tcacaagagctggactgtcttt

SEQ ID NO: 7910206 - DNA, 22 bp, Homo sapiens
cagtgaagttctactgaatggt

SEQ ID NO: 7910207 - DNA, 22 bp, Homo sapiens
cagtgaagtgtggacgtcacca

SEQ ID NO: 7910208 - DNA, 17 bp, Homo sapiens
cagtgaagagacattaa

SEQ ID NO: 7910209 - DNA, 22 bp, Homo sapiens
cagtgaagtttaaagtgtagat

SEQ ID NO: 7910210 - DNA, 22 bp, Homo sapiens
cagtgaagtttaaagtgtagat

SEQ ID NO: 7910211 - DNA, 22 bp, Homo sapiens
cagtgaatttagatgttggtgg

SEQ ID NO: 7910212 - DNA, 22 bp, Homo sapiens
cagtgaagtttaaagtgtagat

SEQ ID NO: 7910213 - DNA, 22 bp, Homo sapiens
cagtgaatttagatgttggtgg

SEQ ID NO: 7910214 - DNA, 22 bp, Homo sapiens
cagtgacgtaaactgcatgtgc

SEQ ID NO: 7910215 - DNA, 22 bp, Homo sapiens
cagtgacctaatattctgccac

SEQ ID NO: 7910216 - DNA, 22 bp, Homo sapiens
cagtgacgtaaactgcatgtgc

SEQ ID NO: 7910217 - DNA, 22 bp, Homo sapiens
cagtgacgtaaactgcatgtgc

SEQ ID NO: 7910218 - DNA, 22 bp, Homo sapiens
cagtgacagcaagcagtgctgg

SEQ ID NO: 7910219 - DNA, 22 bp, Homo sapiens
cagtgacacgggctggcccacg

SEQ ID NO: 7910220 - DNA, 22 bp, Homo sapiens
cagtgacagcaagcagtgctgg

SEQ ID NO: 7910221 - DNA, 22 bp, Homo sapiens
cagtgacagcaagcagtgctgg

SEQ ID NO: 7910222 - DNA, 22 bp, Homo sapiens
cagtgacaggttccatgccgca

SEQ ID NO: 7910223 - DNA, 22 bp, Homo sapiens
cagtgagagtatttgtgctaag

SEQ ID NO: 7910224 - DNA, 22 bp, Homo sapiens
cagtgagagtatttgtgctaag

SEQ ID NO: 7910225 - DNA, 22 bp, Homo sapiens
cagtgagaaaactaagacatta

SEQ ID NO: 7910226 - DNA, 22 bp, Homo sapiens
cagtgagaattcagtaggtact

SEQ ID NO: 7910227 - DNA, 22 bp, Homo sapiens
tcacagctttcagattgttccc

SEQ ID NO: 7910228 - DNA, 22 bp, Homo sapiens
tcacagcttcttgcgggtctga

SEQ ID NO: 7910229 - DNA, 22 bp, Homo sapiens
tcacagcttcttgcgggtctga

SEQ ID NO: 7910230 - DNA, 22 bp, Homo sapiens
tcacagctttcagattgttccc

SEQ ID NO: 7910231 - DNA, 22 bp, Homo sapiens
tcacagctggggttttggcagc

SEQ ID NO: 7910232 - DNA, 20 bp, Homo sapiens
tcacagctggctatgacagg

SEQ ID NO: 7910233 - DNA, 22 bp, Homo sapiens
tcacagctgttttgtccattaa

SEQ ID NO: 7910234 - DNA, 22 bp, Homo sapiens
tcacagctgttttgtccattaa

SEQ ID NO: 7910235 - DNA, 22 bp, Homo sapiens
tcacagagaaatgtggcacaaa

SEQ ID NO: 7910236 - DNA, 22 bp, Homo sapiens
tcacagagaactataatccatc

SEQ ID NO: 7910237 - DNA, 22 bp, Homo sapiens
tcacagagaactataatccatc

SEQ ID NO: 7910238 - DNA, 22 bp, Homo sapiens
tcacagagaaatgtggcacaaa

SEQ ID NO: 7910239 - DNA, 22 bp, Homo sapiens
tcacagagaaatgtggcacaaa

SEQ ID NO: 7910240 - DNA, 22 bp, Homo sapiens
tcacagagaaatgtggcacaaa

SEQ ID NO: 7910241 - DNA, 22 bp, Homo sapiens
tcacagagaaatgtggcacaaa

SEQ ID NO: 7910242 - DNA, 22 bp, Homo sapiens
tcacagagaaaagctatcacaa

SEQ ID NO: 7910243 - DNA, 22 bp, Homo sapiens
tcacagagaaatgtggcacaaa

SEQ ID NO: 7910244 - DNA, 22 bp, Homo sapiens
tcacagactgtgttgctactca

SEQ ID NO: 7910245 - DNA, 21 bp, Homo sapiens
tcacagactggtcagtgaggc

SEQ ID NO: 7910246 - DNA, 21 bp, Homo sapiens
tcacagactggtcagtgaggc

SEQ ID NO: 7910247 - DNA, 22 bp, Homo sapiens
tcacagactcttgattgtctaa

SEQ ID NO: 7910248 - DNA, 22 bp, Homo sapiens
tcacagagaaaagctatcacaa

SEQ ID NO: 7910249 - DNA, 22 bp, Homo sapiens
tcacagagaaaagctatcacaa

SEQ ID NO: 7910250 - DNA, 22 bp, Homo sapiens
tcacagagaaaagctatcacaa

SEQ ID NO: 7910251 - DNA, 22 bp, Homo sapiens
tcacagactggtcagtcaactt

SEQ ID NO: 7910252 - DNA, 22 bp, Homo sapiens
tcacaggaccctgagggtggcg

SEQ ID NO: 7910253 - DNA, 22 bp, Homo sapiens
tcacaggaccctgagggtggcg

SEQ ID NO: 7910254 - DNA, 22 bp, Homo sapiens
tcacaggaccctgagggtggcg

SEQ ID NO: 7910255 - DNA, 22 bp, Homo sapiens
tcacaggagagctgatgctggt

SEQ ID NO: 7910256 - DNA, 22 bp, Homo sapiens
tcacaggagagctgatgctggt

SEQ ID NO: 7910257 - DNA, 22 bp, Homo sapiens
tcacaggagagctgatgctggt

SEQ ID NO: 7910258 - DNA, 22 bp, Homo sapiens
tcacaggagagctgatgctggt

SEQ ID NO: 7910259 - DNA, 22 bp, Homo sapiens
tcacaggagaatgtacttacca

SEQ ID NO: 7910260 - DNA, 22 bp, Homo sapiens
tcacaggagcccaggggagctg

SEQ ID NO: 7910261 - DNA, 22 bp, Homo sapiens
tcacaggagcccaggggagctg

SEQ ID NO: 7910262 - DNA, 22 bp, Homo sapiens
tcacaggagattatgtgtgcta

SEQ ID NO: 7910263 - DNA, 22 bp, Homo sapiens
tcacaggaggaacctggcctgg

SEQ ID NO: 7910264 - DNA, 22 bp, Homo sapiens
tcacaggaggaacctggcctgg

SEQ ID NO: 7910265 - DNA, 22 bp, Homo sapiens
tcacaggaggaacctggcctgg

SEQ ID NO: 7910266 - DNA, 22 bp, Homo sapiens
tcacaggaggaacctggcctgg

SEQ ID NO: 7910267 - DNA, 22 bp, Homo sapiens
tcacaggaagaggtgtctatct

SEQ ID NO: 7910268 - DNA, 22 bp, Homo sapiens
tcacaggaagaggtgtctatct

SEQ ID NO: 7910269 - DNA, 22 bp, Homo sapiens
tcacaggaaccatcagagaaat

SEQ ID NO: 7910270 - DNA, 22 bp, Homo sapiens
tcacaggaaccatcagagaaat

SEQ ID NO: 7910271 - DNA, 22 bp, Homo sapiens
tcacagctttgagcagagacca

SEQ ID NO: 7910272 - DNA, 22 bp, Homo sapiens
tcacaggaaccatcagagaaat

SEQ ID NO: 7910273 - DNA, 22 bp, Homo sapiens
tcacaggaaccatcagagaaat

SEQ ID NO: 7910274 - DNA, 22 bp, Homo sapiens
tcacagctttgagcagagacca

SEQ ID NO: 7910275 - DNA, 22 bp, Homo sapiens
tcacaggaagggtaaatattta

SEQ ID NO: 7910276 - DNA, 22 bp, Homo sapiens
tcacaggaagggtaaatattta

SEQ ID NO: 7910277 - DNA, 22 bp, Homo sapiens
tcacaggaagaggtgtctatct

SEQ ID NO: 7910278 - DNA, 22 bp, Homo sapiens
tcacaggaagaggtgtctatct

SEQ ID NO: 7910279 - DNA, 22 bp, Homo sapiens
tcacaggacagccttccacccg

SEQ ID NO: 7910280 - DNA, 22 bp, Homo sapiens
tcacaggaagggtaaatattta

SEQ ID NO: 7910281 - DNA, 22 bp, Homo sapiens
tcacaggacagccttccacccg

SEQ ID NO: 7910282 - DNA, 22 bp, Homo sapiens
tcacaggacagccttccacccg

SEQ ID NO: 7910283 - DNA, 22 bp, Homo sapiens
tcacaggacagccttccacccg

SEQ ID NO: 7910284 - DNA, 22 bp, Homo sapiens
tcacaggaccctgagggtggcg

SEQ ID NO: 7910285 - DNA, 22 bp, Homo sapiens
tcacaggagtcaaggaatagta

SEQ ID NO: 7910286 - DNA, 22 bp, Homo sapiens
tcacagtgtggcaactcacaga

SEQ ID NO: 7910287 - DNA, 22 bp, Homo sapiens
tcacagtgtggcaactcacaga

SEQ ID NO: 7910288 - DNA, 22 bp, Homo sapiens
tcacaggagtcaaggaatagta

SEQ ID NO: 7910289 - DNA, 22 bp, Homo sapiens
tcacaggagtcaaggaatagta

SEQ ID NO: 7910290 - DNA, 22 bp, Homo sapiens
tcacaggagggagagacaccca

SEQ ID NO: 7910291 - DNA, 22 bp, Homo sapiens
tcacaggagggagagacaccca

SEQ ID NO: 7910292 - DNA, 22 bp, Homo sapiens
tcacaggagggagagacaccca

SEQ ID NO: 7910293 - DNA, 22 bp, Homo sapiens
tcacaggagggagagacaccca

SEQ ID NO: 7910294 - DNA, 20 bp, Homo sapiens
tcacaggagggaaggcaggt

SEQ ID NO: 7910295 - DNA, 22 bp, Homo sapiens
tcacaggagattatgtgtgcta

SEQ ID NO: 7910296 - DNA, 20 bp, Homo sapiens
tcacaggagggaaggcaggt

SEQ ID NO: 7910297 - DNA, 20 bp, Homo sapiens
tcacaggagggaaggcaggt

SEQ ID NO: 7910298 - DNA, 22 bp, Homo sapiens
tcacaggaggactgaaagatat

SEQ ID NO: 7910299 - DNA, 20 bp, Homo sapiens
tcacaggagggaaggcaggt

SEQ ID NO: 7910300 - DNA, 22 bp, Homo sapiens
tcacaggaggactgaaagatat

SEQ ID NO: 7910301 - DNA, 22 bp, Homo sapiens
tcacagtgttggaatcagagct

SEQ ID NO: 7910302 - DNA, 22 bp, Homo sapiens
tcacagttaattgttggaatgt

SEQ ID NO: 7910303 - DNA, 22 bp, Homo sapiens
tcacagttactccttcagatga

SEQ ID NO: 7910304 - DNA, 22 bp, Homo sapiens
tcacagttactccttcagatga

SEQ ID NO: 7910305 - DNA, 22 bp, Homo sapiens
tcacagtgttggaatcagagct

SEQ ID NO: 7910306 - DNA, 22 bp, Homo sapiens
tcacagtgttggaatcagagct

SEQ ID NO: 7910307 - DNA, 22 bp, Homo sapiens
tcacagtgttggaatcagagct

SEQ ID NO: 7910308 - DNA, 22 bp, Homo sapiens
tcacagtgttaaacctttcttt

SEQ ID NO: 7910309 - DNA, 22 bp, Homo sapiens
tcacagtgtggcaactcacaga

SEQ ID NO: 7910310 - DNA, 22 bp, Homo sapiens
tcacagtgttaaacctttcttt

SEQ ID NO: 7910311 - DNA, 22 bp, Homo sapiens
tcacagtgttggaatcagagct

SEQ ID NO: 7910312 - DNA, 22 bp, Homo sapiens
tcacagtgtggcaactcacaga

SEQ ID NO: 7910313 - DNA, 22 bp, Homo sapiens
tcacagtgtggcaactcacaga

SEQ ID NO: 7910314 - DNA, 22 bp, Homo sapiens
tcacagtgtggcaactcacaga

SEQ ID NO: 7910315 - DNA, 22 bp, Homo sapiens
tcacagtgtggcaactcacaga

SEQ ID NO: 7910316 - DNA, 17 bp, Homo sapiens
tcacagttggtctcagt

SEQ ID NO: 7910317 - DNA, 17 bp, Homo sapiens
tcacagttggtctcagt

SEQ ID NO: 7910318 - DNA, 22 bp, Homo sapiens
cagtgcatatgattctgcagtt

SEQ ID NO: 7910319 - DNA, 22 bp, Homo sapiens
cagtgcatatgattctgcagtt

SEQ ID NO: 7910320 - DNA, 22 bp, Homo sapiens
cagtgcatatgattctgcagtt

SEQ ID NO: 7910321 - DNA, 22 bp, Homo sapiens
tcacagtttccataggtcagca

SEQ ID NO: 7910322 - DNA, 22 bp, Homo sapiens
tcacagttgattgaaacacagc

SEQ ID NO: 7910323 - DNA, 22 bp, Homo sapiens
tcacagttgattgaaacacagc

SEQ ID NO: 7910324 - DNA, 21 bp, Homo sapiens
tcacagttggccaggcattta

SEQ ID NO: 7910325 - DNA, 22 bp, Homo sapiens
tcacagttgattgaaacacagc

SEQ ID NO: 7910326 - DNA, 22 bp, Homo sapiens
cagtgcatgtctgtgtggggat

SEQ ID NO: 7910327 - DNA, 20 bp, Homo sapiens
cagtgcattgcttctgattt

SEQ ID NO: 7910328 - DNA, 22 bp, Homo sapiens
cagtgccaagccacagatcact

SEQ ID NO: 7910329 - DNA, 22 bp, Homo sapiens
cagtgccaagccacagatcact

SEQ ID NO: 7910330 - DNA, 22 bp, Homo sapiens
cagtgccaaggagaaggacagc

SEQ ID NO: 7910331 - DNA, 22 bp, Homo sapiens
cagtgccaaggagaaggacagc

SEQ ID NO: 7910332 - DNA, 22 bp, Homo sapiens
tcacagttatagtctgtagaat

SEQ ID NO: 7910333 - DNA, 23 bp, Homo sapiens
tcacagttacttttgcatcaacc

SEQ ID NO: 7910334 - DNA, 23 bp, Homo sapiens
tcacagttacttttgcatcaacc

SEQ ID NO: 7910335 - DNA, 22 bp, Homo sapiens
tcacagttatagtctgtagaat

SEQ ID NO: 7910336 - DNA, 22 bp, Homo sapiens
tcacagttatagtctgtagaat

SEQ ID NO: 7910337 - DNA, 22 bp, Homo sapiens
tcacagttcaaaccccatatct

SEQ ID NO: 7910338 - DNA, 22 bp, Homo sapiens
tcacagttcatctgataaacta

SEQ ID NO: 7910339 - DNA, 22 bp, Homo sapiens
tcacagttcatctgataaacta

SEQ ID NO: 7910340 - DNA, 22 bp, Homo sapiens
tcacagttctagaggtaagcag

SEQ ID NO: 7910341 - DNA, 22 bp, Homo sapiens
tcacagttcatctgataaacta

SEQ ID NO: 7910342 - DNA, 21 bp, Homo sapiens
tcacagttcaagatgaacccc

SEQ ID NO: 7910343 - DNA, 22 bp, Homo sapiens
tcacagttcaactagttcagat

SEQ ID NO: 7910344 - DNA, 21 bp, Homo sapiens
tcacagttcaagatgaacccc

SEQ ID NO: 7910345 - DNA, 22 bp, Homo sapiens
cagtgggaagggcagaggcttt

SEQ ID NO: 7910346 - DNA, 22 bp, Homo sapiens
cagtgggaagggcagaggcttt

SEQ ID NO: 7910347 - DNA, 22 bp, Homo sapiens
cagtgggaaagtgaagagcatt

SEQ ID NO: 7910348 - DNA, 22 bp, Homo sapiens
cagtgggaagaatgcagcctcc

SEQ ID NO: 7910349 - DNA, 22 bp, Homo sapiens
cagtgggaagggcagaggcttt

SEQ ID NO: 7910350 - DNA, 22 bp, Homo sapiens
cagtgggaatgaagtggaggcc

SEQ ID NO: 7910351 - DNA, 22 bp, Homo sapiens
cagtgggacatgggcactgggc

SEQ ID NO: 7910352 - DNA, 22 bp, Homo sapiens
cagtgggacatgggcactgggc

SEQ ID NO: 7910353 - DNA, 22 bp, Homo sapiens
cagtgggacatgggcactgggc

SEQ ID NO: 7910354 - DNA, 22 bp, Homo sapiens
cagtgggacatgggcactgggc

SEQ ID NO: 7910355 - DNA, 21 bp, Homo sapiens
cagtgggctgctgcgctccag

SEQ ID NO: 7910356 - DNA, 22 bp, Homo sapiens
cagtgggattgggattggaacc

SEQ ID NO: 7910357 - DNA, 23 bp, Homo sapiens
cagtgggcttctaactgctcctg

SEQ ID NO: 7910358 - DNA, 21 bp, Homo sapiens
cagtgggctgctgcgctccag

SEQ ID NO: 7910359 - DNA, 22 bp, Homo sapiens
cagtgggatatgggggcagcat

SEQ ID NO: 7910360 - DNA, 22 bp, Homo sapiens
cagtgggtaaataagtgggtaa

SEQ ID NO: 7910361 - DNA, 22 bp, Homo sapiens
cagtggggtttctgtgggtgct

SEQ ID NO: 7910362 - DNA, 22 bp, Homo sapiens
cagtggggtttctgtgggtgct

SEQ ID NO: 7910363 - DNA, 22 bp, Homo sapiens
cagtgggggtgaggccgaggta

SEQ ID NO: 7910364 - DNA, 22 bp, Homo sapiens
cagtgggggtgaggccgaggta

SEQ ID NO: 7910365 - DNA, 22 bp, Homo sapiens
cagtgggggtgaggccgaggta

SEQ ID NO: 7910366 - DNA, 22 bp, Homo sapiens
cagtgggtatttactgattcct

SEQ ID NO: 7910367 - DNA, 22 bp, Homo sapiens
cagtgggtcctgcgtctgccag

SEQ ID NO: 7910368 - DNA, 22 bp, Homo sapiens
cagtgggtcctgcgtctgccag

SEQ ID NO: 7910369 - DNA, 22 bp, Homo sapiens
cagtgggtaggaaaggctcttc

SEQ ID NO: 7910370 - DNA, 22 bp, Homo sapiens
cagtgggtaggaaaggctcttc

SEQ ID NO: 7910371 - DNA, 22 bp, Homo sapiens
cagtgggggtgaggccgaggta

SEQ ID NO: 7910372 - DNA, 22 bp, Homo sapiens
cagtggggggactgaggcctga

SEQ ID NO: 7910373 - DNA, 22 bp, Homo sapiens
cagtggggggactgaggcctga

SEQ ID NO: 7910374 - DNA, 22 bp, Homo sapiens
cagtggggggactgaggcctga

SEQ ID NO: 7910375 - DNA, 23 bp, Homo sapiens
cagtgggcttctaactgctcctg

SEQ ID NO: 7910376 - DNA, 23 bp, Homo sapiens
cagtgggcttctaactgctcctg

SEQ ID NO: 7910377 - DNA, 22 bp, Homo sapiens
cagtggggaggccaggatagaa

SEQ ID NO: 7910378 - DNA, 22 bp, Homo sapiens
cagtggggaggccaggatagaa

SEQ ID NO: 7910379 - DNA, 22 bp, Homo sapiens
cagtgccacttaatgaggctgc

SEQ ID NO: 7910380 - DNA, 22 bp, Homo sapiens
cagtgccacttaatgaggctgc

SEQ ID NO: 7910381 - DNA, 22 bp, Homo sapiens
cagtgccacaggaatggccaat

SEQ ID NO: 7910382 - DNA, 22 bp, Homo sapiens
cagtgccacaggaatggccaat

SEQ ID NO: 7910383 - DNA, 22 bp, Homo sapiens
cagtgccaaggatggcctggga

SEQ ID NO: 7910384 - DNA, 22 bp, Homo sapiens
cagtgccaaggctcttggtctg

SEQ ID NO: 7910385 - DNA, 22 bp, Homo sapiens
cagtgccaaggagaaggacagc

SEQ ID NO: 7910386 - DNA, 22 bp, Homo sapiens
cagtgccagaggtactagtgga

SEQ ID NO: 7910387 - DNA, 21 bp, Homo sapiens
cagtgccagccacaggacgcc

SEQ ID NO: 7910388 - DNA, 22 bp, Homo sapiens
cagtgccagaggtactagtgga

SEQ ID NO: 7910389 - DNA, 22 bp, Homo sapiens
cagtgccagaggtactagtgga

SEQ ID NO: 7910390 - DNA, 22 bp, Homo sapiens
cagtgccacttaatgaggctgc

SEQ ID NO: 7910391 - DNA, 21 bp, Homo sapiens
cagtgccagccacaggacgcc

SEQ ID NO: 7910392 - DNA, 22 bp, Homo sapiens
cagtgccagctgcttggcctac

SEQ ID NO: 7910393 - DNA, 22 bp, Homo sapiens
cagtgccatgtctgagccccta

SEQ ID NO: 7910394 - DNA, 22 bp, Homo sapiens
cagtgccatgtctgagccccta

SEQ ID NO: 7910395 - DNA, 22 bp, Homo sapiens
cagtgccatgatgcagagcaat

SEQ ID NO: 7910396 - DNA, 22 bp, Homo sapiens
cagtggcaggggaagcaggtgt

SEQ ID NO: 7910397 - DNA, 22 bp, Homo sapiens
cagtgcccaagatgtgccatgc

SEQ ID NO: 7910398 - DNA, 23 bp, Homo sapiens
cagtgccatttgtcttgcctatg

SEQ ID NO: 7910399 - DNA, 22 bp, Homo sapiens
cagtgcccaaaggaacagaaag

SEQ ID NO: 7910400 - DNA, 22 bp, Homo sapiens
cagtgccatattgaaagacatt

SEQ ID NO: 7910401 - DNA, 22 bp, Homo sapiens
cagtgccagggttgtgtaaatc

SEQ ID NO: 7910402 - DNA, 22 bp, Homo sapiens
cagtgccagtggatgaactgtt

SEQ ID NO: 7910403 - DNA, 22 bp, Homo sapiens
cagtgccagtggatgaactgtt

SEQ ID NO: 7910404 - DNA, 22 bp, Homo sapiens
cagtgccaggagacaagatcag

SEQ ID NO: 7910405 - DNA, 22 bp, Homo sapiens
cagtgccatgatgcagagcaat

SEQ ID NO: 7910406 - DNA, 22 bp, Homo sapiens
cagtgccatattgaaagacatt

SEQ ID NO: 7910407 - DNA, 22 bp, Homo sapiens
cagtgccatgatgcagagcaat

SEQ ID NO: 7910408 - DNA, 22 bp, Homo sapiens
cagtggcttctcatgtcattca

SEQ ID NO: 7910409 - DNA, 22 bp, Homo sapiens
cagtggcttctcatgtcattca

SEQ ID NO: 7910410 - DNA, 22 bp, Homo sapiens
cagtggcttctcatgtcattca

SEQ ID NO: 7910411 - DNA, 22 bp, Homo sapiens
cagtggcttctcatgtcattca

SEQ ID NO: 7910412 - DNA, 22 bp, Homo sapiens
cagtggcttcttcctagagcca

SEQ ID NO: 7910413 - DNA, 22 bp, Homo sapiens
cagtggcttcttcctagagcca

SEQ ID NO: 7910414 - DNA, 22 bp, Homo sapiens
cagtggcttcttcctagagcca

SEQ ID NO: 7910415 - DNA, 22 bp, Homo sapiens
cagtggctgtttctggaaggca

SEQ ID NO: 7910416 - DNA, 22 bp, Homo sapiens
cagtggctgtttctggaaggca

SEQ ID NO: 7910417 - DNA, 22 bp, Homo sapiens
cagtggctgtttctggaaggca

SEQ ID NO: 7910418 - DNA, 22 bp, Homo sapiens
cagtggcttacaatgaactaga

SEQ ID NO: 7910419 - DNA, 22 bp, Homo sapiens
cagtggcttaaataagattagg
